United States Patent 11,640,849 (METHODS FOR HISTOLOGICAL DIAGNOSIS AND TREATMENT OF DISEASES) - sequence listing, part 73

SEQ ID NO: 2784957 - protein, 32 aa, Entamoeba invadens
ASPITGYVIGFVKCWDLSLVILSIAPFMILGT

SEQ ID NO: 2784958 - protein, 18 aa, Entamoeba invadens
ATKICVFENGKIIESGSH

SEQ ID NO: 2784959 - protein, 30 aa, Entamoeba invadens
AVILNFPLIIPRSVKFLSRISTLTLVSGLV

SEQ ID NO: 2784960 - protein, 24 aa, Entamoeba invadens
AVNGCQKCIFGYFPDEKRCSPCDT

SEQ ID NO: 2784961 - protein, 21 aa, Entamoeba invadens
AVTMYEVFGWCEIYPKNIFKY

SEQ ID NO: 2784962 - protein, 18 aa, Entamoeba invadens
AVWWVLLIVVLFAIIVMA

SEQ ID NO: 2784963 - protein, 27 aa, Entamoeba invadens
AYPKTFFKFPWKIAEFVTSGKRLEKQD

SEQ ID NO: 2784964 - protein, 24 aa, Entamoeba invadens
CAVCPNAKCTQCKEGYSLTENKCV

SEQ ID NO: 2784965 - protein, 17 aa, Entamoeba invadens
CDATCGGKCDTTNGHCT

SEQ ID NO: 2784966 - protein, 20 aa, Entamoeba invadens
CDGGDGCVECECQPDWFSQN

SEQ ID NO: 2784967 - protein, 18 aa, Entamoeba invadens
CDMTCLTCSSYGICESCI

SEQ ID NO: 2784968 - protein, 19 aa, Entamoeba invadens
CDSSCLTCNLYSTKCTLCD

SEQ ID NO: 2784969 - protein, 23 aa, Entamoeba invadens
CEYCSESLCLKCRNEYYLSDTST

SEQ ID NO: 2784970 - protein, 18 aa, Entamoeba invadens
CHSNCLTCSSNAESTCLS

SEQ ID NO: 2784971 - protein, 19 aa, Entamoeba invadens
CKDKHKIVCVNTINECSSM

SEQ ID NO: 2784972 - protein, 20 aa, Entamoeba invadens
CKNNQCFPRYPLNCQEEDLF

SEQ ID NO: 2784973 - protein, 18 aa, Entamoeba invadens
CLLCSTNCKECYNTTYCT

SEQ ID NO: 2784974 - protein, 17 aa, Entamoeba invadens
CNTCSYNYVFNEPKGRS

SEQ ID NO: 2784975 - protein, 20 aa, Entamoeba invadens
CSKCSFWYIPSEDGDHCDTH

SEQ ID NO: 2784976 - protein, 18 aa, Entamoeba invadens
CSSPCNYCTTATSCVTCN

SEQ ID NO: 2784977 - protein, 17 aa, Entamoeba invadens
CTDKVRYLVGRQCVLCD

SEQ ID NO: 2784978 - protein, 29 aa, Entamoeba invadens
CTSCNIGYRLYKGVCTSIRSIPNCANYDE

SEQ ID NO: 2784979 - protein, 18 aa, Entamoeba invadens
CTTCSIELYKTGDQNSMC

SEQ ID NO: 2784980 - protein, 17 aa, Entamoeba invadens
CTYKMSRSNIKMSTLVD

SEQ ID NO: 2784981 - protein, 17 aa, Entamoeba invadens
CVFKMKRSNVIFEKVND

SEQ ID NO: 2784982 - protein, 24 aa, Entamoeba invadens
CVNCPSHCRICYSPNECAVCDINY

SEQ ID NO: 2784983 - protein, 18 aa, Entamoeba invadens
CVTCADMQYSLAGSTTCK

SEQ ID NO: 2784984 - protein, 18 aa, Entamoeba invadens
CVTCSVDSSRVCTTCKSG

SEQ ID NO: 2784985 - protein, 20 aa, Entamoeba invadens
CVTVSLLSLVFWRNYPPSVI

SEQ ID NO: 2784986 - protein, 22 aa, Entamoeba invadens
DEFRKEVAMLAKFVSPYVIRFY

SEQ ID NO: 2784987 - protein, 24 aa, Entamoeba invadens
DELKIKKGELVCVLGSVGGGKSSF

SEQ ID NO: 2784988 - protein, 19 aa, Entamoeba invadens
DELTCLHCVDGYYPDDGKC

SEQ ID NO: 2784989 - protein, 31 aa, Entamoeba invadens
DENTKLWGYRALSALLLYLVISFMTCYIVFQ

SEQ ID NO: 2784990 - protein, 21 aa, Entamoeba invadens
DFRCKYCDATCGGKCDTTNGH

SEQ ID NO: 2784991 - protein, 19 aa, Entamoeba invadens
DGDCVICSDGYYRTPNNNT

SEQ ID NO: 2784992 - protein, 20 aa, Entamoeba invadens
DGGRCVYCWDKHPHCAECDS

SEQ ID NO: 2784993 - protein, 24 aa, Entamoeba invadens
DGKCLTCAAGYGFDSGVCTLCGDL

SEQ ID NO: 2784994 - protein, 19 aa, Entamoeba invadens
DGLRCLQCTENFYPTDSIN

SEQ ID NO: 2784995 - protein, 21 aa, Entamoeba invadens
DGRTCKNCNILNCLKCAEKEI

SEQ ID NO: 2784996 - protein, 28 aa, Entamoeba invadens
DIFPIKRFKRRFFIVIGSIIAIILLPFV

SEQ ID NO: 2784997 - protein, 18 aa, Entamoeba invadens
DIFSFAISMYECFTWKEP

SEQ ID NO: 2784998 - protein, 20 aa, Entamoeba invadens
DKCWRYDEINRISVSEIGES

SEQ ID NO: 2784999 - protein, 17 aa, Entamoeba invadens
DKEVKFTLELAPEVANS

SEQ ID NO: 2785000 - protein, 17 aa, Entamoeba invadens
DKVCTACVDDCKTCTEE

SEQ ID NO: 2785001 - protein, 17 aa, Entamoeba invadens
DKYYKQKTDCISCDESC

SEQ ID NO: 2785002 - protein, 19 aa, Entamoeba invadens
DLLSQRLLRICPTNNENST

SEQ ID NO: 2785003 - protein, 27 aa, Entamoeba invadens
DNMCKKCTTANCATCDGDGKPDVCITC

SEQ ID NO: 2785004 - protein, 23 aa, Entamoeba invadens
DPNCAYGYCSTVNGCTKCIEGYF

SEQ ID NO: 2785005 - protein, 23 aa, Entamoeba invadens
DQFSCLKCAPNHFKIYGESLLCL

SEQ ID NO: 2785006 - protein, 24 aa, Entamoeba invadens
DRFECKECALGSFMSSGYCRSSCP

SEQ ID NO: 2785007 - protein, 20 aa, Entamoeba invadens
DRVKTMRFRTRLFSEEYNQQ

SEQ ID NO: 2785008 - protein, 25 aa, Entamoeba invadens
DSTGKCLTCYKGYYIENEECVEIEH

SEQ ID NO: 2785009 - protein, 32 aa, Entamoeba invadens
DSTMPSDLKWLILKCWEYKYLQRITLRETHEI

SEQ ID NO: 2785010 - protein, 23 aa, Entamoeba invadens
DVKGENLLVFSLNPHSPVCAKLT

SEQ ID NO: 2785011 - protein, 23 aa, Entamoeba invadens
DVNKEIKNLFSIGNTTNHKVKIQ

SEQ ID NO: 2785012 - protein, 27 aa, Entamoeba invadens
DYIKLPYKLKVRMLFDTTRGMQFLHEN

SEQ ID NO: 2785013 - protein, 21 aa, Entamoeba invadens
EAIILFCLIVSVRLHKNLIHK

SEQ ID NO: 2785014 - protein, 20 aa, Entamoeba invadens
EALASGFFVGPMLMEIAGKS

SEQ ID NO: 2785015 - protein, 23 aa, Entamoeba invadens
ECEKCTDLNCLDCFYNTNECLRC

SEQ ID NO: 2785016 - protein, 22 aa, Entamoeba invadens
EEKLRKSLVNEFLLKDLKKKGV

SEQ ID NO: 2785017 - protein, 24 aa, Entamoeba invadens
EFNKCVECSENSYLYDGECHSTIN

SEQ ID NO: 2785018 - protein, 19 aa, Entamoeba invadens
EGAILPTKLCKDAKDGEIW

SEQ ID NO: 2785019 - protein, 19 aa, Entamoeba invadens
EGSFGIVVKGTFRNNTVAI

SEQ ID NO: 2785020 - protein, 20 aa, Entamoeba invadens
EGSFGVVFIGTFRGNKVAIK

SEQ ID NO: 2785021 - protein, 21 aa, Entamoeba invadens
EGSFGVVFKGTFRGNTVAIKK

SEQ ID NO: 2785022 - protein, 20 aa, Entamoeba invadens
EGVCKMCLGGTKSNSITNLC

SEQ ID NO: 2785023 - protein, 20 aa, Entamoeba invadens
EHNSKCSKCSFWYIPSEDGD

SEQ ID NO: 2785024 - protein, 20 aa, Entamoeba invadens
EIKIPCSFASEASTALDPDE

SEQ ID NO: 2785025 - protein, 21 aa, Entamoeba invadens
EIQCKMCHSVVGIVHTNPMLF

SEQ ID NO: 2785026 - protein, 20 aa, Entamoeba invadens
EKCDKCKENFFLSEDKCVDI

SEQ ID NO: 2785027 - protein, 25 aa, Entamoeba invadens
EKKYNLGQWFKLRADSITTDHFLIV

SEQ ID NO: 2785028 - protein, 18 aa, Entamoeba invadens
EKLYQLIEMCWKQNPKER

SEQ ID NO: 2785029 - protein, 19 aa, Entamoeba invadens
EKTKIWVYIVILFSIILLI

SEQ ID NO: 2785030 - protein, 19 aa, Entamoeba invadens
EKYFEMEGMCNKCKDTYQT

SEQ ID NO: 2785031 - protein, 20 aa, Entamoeba invadens
ENNRCIICNDGYYIQNDGNC

SEQ ID NO: 2785032 - protein, 19 aa, Entamoeba invadens
ENSGFYLLNGRCVACDSTC

SEQ ID NO: 2785033 - protein, 17 aa, Entamoeba invadens
ENYIFKYPNCVPVGDCY

SEQ ID NO: 2785034 - protein, 17 aa, Entamoeba invadens
EPIPRNLCEDAKCNPLT

SEQ ID NO: 2785035 - protein, 20 aa, Entamoeba invadens
EPYCPCSSVNCYITPLKNIT

SEQ ID NO: 2785036 - protein, 19 aa, Entamoeba invadens
EQEKGICVFEMKRSNVSMK

SEQ ID NO: 2785037 - protein, 22 aa, Entamoeba invadens
EQIKFGINAIGTFKNNTKIESQ

SEQ ID NO: 2785038 - protein, 20 aa, Entamoeba invadens
ERKKKGVISVHDIKEPLNCF

SEQ ID NO: 2785039 - protein, 20 aa, Entamoeba invadens
ETCYTCAESFYMTINGDCLP

SEQ ID NO: 2785040 - protein, 24 aa, Entamoeba invadens
ETQAVWWFIVLVLLFVFFVVFVVI

SEQ ID NO: 2785041 - protein, 20 aa, Entamoeba invadens
ETQMCKTCELGYYLVSDTNE

SEQ ID NO: 2785042 - protein, 19 aa, Entamoeba invadens
ETTSCKLKSIGGGAIAGIV

SEQ ID NO: 2785043 - protein, 25 aa, Entamoeba invadens
EVDVKLRIKFLFDAAKGIFYLHENG

SEQ ID NO: 2785044 - protein, 21 aa, Entamoeba invadens
EVGCGKSAFFRSLLGNLHKTN

SEQ ID NO: 2785045 - protein, 21 aa, Entamoeba invadens
EVGCLLCQNGYYTNEYNKCTK

SEQ ID NO: 2785046 - protein, 20 aa, Entamoeba invadens
EVPTGYKLVVETANFDMSTL

SEQ ID NO: 2785047 - protein, 18 aa, Entamoeba invadens
EYIVHFYGAVSIPSKVCM

SEQ ID NO: 2785048 - protein, 22 aa, Entamoeba invadens
EYMNVYLLDKCYYTGGNTYTKY

SEQ ID NO: 2785049 - protein, 23 aa, Entamoeba invadens
FASNCAKKGYGCYNQSLDMIIKE

SEQ ID NO: 2785050 - protein, 21 aa, Entamoeba invadens
FCEGNKCKRCANDYLMVKENQ

SEQ ID NO: 2785051 - protein, 22 aa, Entamoeba invadens
FCFSACSLFTYHFSEKKSAITA

SEQ ID NO: 2785052 - protein, 19 aa, Entamoeba invadens
FCQMPSSWAGSTVNKQAMI

SEQ ID NO: 2785053 - protein, 18 aa, Entamoeba invadens
FDRKCVMCNTGYYPDEIG

SEQ ID NO: 2785054 - protein, 17 aa, Entamoeba invadens
FEGKHLFMHFWRKKHPI

SEQ ID NO: 2785055 - protein, 18 aa, Entamoeba invadens
FEKEVAMLDKFRCEYIVH

SEQ ID NO: 2785056 - protein, 18 aa, Entamoeba invadens
FEKEVSMLDKFRCDYIVH

SEQ ID NO: 2785057 - protein, 20 aa, Entamoeba invadens
FFEAFAWKDAFGDVKYFFEI

SEQ ID NO: 2785058 - protein, 22 aa, Entamoeba invadens
FFVLLWPFAFIASRKSRNQSTR

SEQ ID NO: 2785059 - protein, 23 aa, Entamoeba invadens
FGVTMYEIFGWCEAYPVKQFKFP

SEQ ID NO: 2785060 - protein, 26 aa, Entamoeba invadens
FIVLYSFMGYYVGKWVYVPLVVLAFF

SEQ ID NO: 2785061 - protein, 31 aa, Entamoeba invadens
FKLKVMKDVQCGLSYLHGFKLFHLNLKLSNV

SEQ ID NO: 2785062 - protein, 25 aa, Entamoeba invadens
FKNGKCPVCVDGYFNTPARVCELNT

SEQ ID NO: 2785063 - protein, 25 aa, Entamoeba invadens
FLFVIPWLVGFIISRKTTNKTVRVL

SEQ ID NO: 2785064 - protein, 17 aa, Entamoeba invadens
FLIIFIFVFRYKKIDIN

SEQ ID NO: 2785065 - protein, 19 aa, Entamoeba invadens
FLRERCSVNINVFMTLTAN

SEQ ID NO: 2785066 - protein, 19 aa, Entamoeba invadens
FLVDGSSTLNVWNSSVVNA

SEQ ID NO: 2785067 - protein, 23 aa, Entamoeba invadens
FNSKCSKCAFWYSPTNSGTSCNK

SEQ ID NO: 2785068 - protein, 17 aa, Entamoeba invadens
FPLKIRALTKMTTRLDF

SEQ ID NO: 2785069 - protein, 20 aa, Entamoeba invadens
FRIANETKLCLPFDELTQFC

SEQ ID NO: 2785070 - protein, 27 aa, Entamoeba invadens
FSAIFTKVFLRRQVRAYQWVGVAFVAF

SEQ ID NO: 2785071 - protein, 17 aa, Entamoeba invadens
FSLHIFSSLTLEGNAKL

SEQ ID NO: 2785072 - protein, 28 aa, Entamoeba invadens
FSTSNWCKKCLNGFYMKNGNCEKVTDCN

SEQ ID NO: 2785073 - protein, 19 aa, Entamoeba invadens
FTGFFRAMFFTFTIDVGPM

SEQ ID NO: 2785074 - protein, 17 aa, Entamoeba invadens
FTRKCVTCVSGYFVFEN

SEQ ID NO: 2785075 - protein, 18 aa, Entamoeba invadens
FYGACYIPSHICMVTEFA

SEQ ID NO: 2785076 - protein, 17 aa, Entamoeba invadens
GAILVVFMSNVISTMSL

SEQ ID NO: 2785077 - protein, 18 aa, Entamoeba invadens
GATCVKGENCLLTKGDGK

SEQ ID NO: 2785078 - protein, 18 aa, Entamoeba invadens
GCESCANLMYPIEGRCLS

SEQ ID NO: 2785079 - protein, 27 aa, Entamoeba invadens
GDCATSIPGCESCSTTGFTCTSCGNGY

SEQ ID NO: 2785080 - protein, 20 aa, Entamoeba invadens
GDSFKRFVSVLDITPEECTA

SEQ ID NO: 2785081 - protein, 19 aa, Entamoeba invadens
GEACEFEIFVTLFCTSKIQ

SEQ ID NO: 2785082 - protein, 17 aa, Entamoeba invadens
GEACEFEIFVTPHCTMK

SEQ ID NO: 2785083 - protein, 20 aa, Entamoeba invadens
GEGAFGMVFCGTYRGQKVAV

SEQ ID NO: 2785084 - protein, 21 aa, Entamoeba invadens
GEGAFGMVFRGTYRGRDVAIK

SEQ ID NO: 2785085 - protein, 22 aa, Entamoeba invadens
GEIFKKFGDCMDLINYKYHYSD

SEQ ID NO: 2785086 - protein, 25 aa, Entamoeba invadens
GELAEKCKLFLPSGVDCATCNEGYI

SEQ ID NO: 2785087 - protein, 20 aa, Entamoeba invadens
GELLSLVFGNAFAIIVDVCN

SEQ ID NO: 2785088 - protein, 19 aa, Entamoeba invadens
GETCVKTEMGYCTECKNGF

SEQ ID NO: 2785089 - protein, 18 aa, Entamoeba invadens
GGGCAICKDHYYKQKTDC

SEQ ID NO: 2785090 - protein, 19 aa, Entamoeba invadens
GGGCAICNSGYYREGISCT

SEQ ID NO: 2785091 - protein, 20 aa, Entamoeba invadens
GGGCAICRDGYYKVLKDCIV

SEQ ID NO: 2785092 - protein, 26 aa, Entamoeba invadens
GGGTFGIVYRAEWRRVDVAVKVMKTD

SEQ ID NO: 2785093 - protein, 27 aa, Entamoeba invadens
GGGTFGIVYRAEWRRVDVAVKVMKTDL

SEQ ID NO: 2785094 - protein, 19 aa, Entamoeba invadens
GICTTCASGYVLKTTESTK

SEQ ID NO: 2785095 - protein, 23 aa, Entamoeba invadens
GKLTGMRLVGWVFPGELFTVTVP

SEQ ID NO: 2785096 - protein, 18 aa, Entamoeba invadens
GKSIIWDLLKQVRPGMDL

SEQ ID NO: 2785097 - protein, 24 aa, Entamoeba invadens
GKTDVCAKCAATYYLSEGTCVTQC

SEQ ID NO: 2785098 - protein, 18 aa, Entamoeba invadens
GMRCVICNTKYYLENGKC

SEQ ID NO: 2785099 - protein, 24 aa, Entamoeba invadens
GNAKLFAVELLDFYHTVTATVNDN

SEQ ID NO: 2785100 - protein, 23 aa, Entamoeba invadens
GNCIKCGINTTFIGNGCATNNNN

SEQ ID NO: 2785101 - protein, 19 aa, Entamoeba invadens
GSFGIVYKGIYRGNCVAIK

SEQ ID NO: 2785102 - protein, 17 aa, Entamoeba invadens
GSFGIVYKGNYRGNVVA

SEQ ID NO: 2785103 - protein, 19 aa, Entamoeba invadens
GSFGVVFKGTFRGNTVAIK

SEQ ID NO: 2785104 - protein, 23 aa, Entamoeba invadens
GSHTCLNCSKGYYLNQNGFCTKC

SEQ ID NO: 2785105 - protein, 23 aa, Entamoeba invadens
GSLLGVVCVFAIGSVIAGVAIFI

SEQ ID NO: 2785106 - protein, 17 aa, Entamoeba invadens
GSMTIFSAIFTKVFLRR

SEQ ID NO: 2785107 - protein, 21 aa, Entamoeba invadens
GSSKKIFCHLYNFDLTTQKMM

SEQ ID NO: 2785108 - protein, 20 aa, Entamoeba invadens
GSTECKPCQGGYYSLIGYSE

SEQ ID NO: 2785109 - protein, 17 aa, Entamoeba invadens
GYACEFEIFITPKCTLK

SEQ ID NO: 2785110 - protein, 22 aa, Entamoeba invadens
GYCTSCKLGYVLKLDKQSLICE

SEQ ID NO: 2785111 - protein, 18 aa, Entamoeba invadens
GYTTQFVCEKCIGNYVVN

SEQ ID NO: 2785112 - protein, 26 aa, Entamoeba invadens
IATIPPKFACEFSLFLNPLCTSTIDS

SEQ ID NO: 2785113 - protein, 19 aa, Entamoeba invadens
ICFSLNFNFSSDIFMFHKF

SEQ ID NO: 2785114 - protein, 17 aa, Entamoeba invadens
IDHSMLLYKTSADDETR

SEQ ID NO: 2785115 - protein, 19 aa, Entamoeba invadens
IGAKAFKGATMLSTVTIEN

SEQ ID NO: 2785116 - protein, 20 aa, Entamoeba invadens
IGDSCLYSLNLGIAVGIPIS

SEQ ID NO: 2785117 - protein, 18 aa, Entamoeba invadens
IIEKCWKHNQIERITSSK

SEQ ID NO: 2785118 - protein, 18 aa, Entamoeba invadens
IKCSGPAYNQCESCVANY

SEQ ID NO: 2785119 - protein, 17 aa, Entamoeba invadens
IKCTVEGCATCENVDEC

SEQ ID NO: 2785120 - protein, 21 aa, Entamoeba invadens
IKIISGVECGNGLYNKSSQQC

SEQ ID NO: 2785121 - protein, 19 aa, Entamoeba invadens
IKSNSYGCEMCMDRYHLSN

SEQ ID NO: 2785122 - protein, 17 aa, Entamoeba invadens
IKSSKGCISCLDGYYLT

SEQ ID NO: 2785123 - protein, 17 aa, Entamoeba invadens
ILFTKSVLISSLTSTST

SEQ ID NO: 2785124 - protein, 18 aa, Entamoeba invadens
ILRNIKFIKYNRWEKPLE

SEQ ID NO: 2785125 - protein, 17 aa, Entamoeba invadens
INALPFIQLKESRYFSV

SEQ ID NO: 2785126 - protein, 18 aa, Entamoeba invadens
INGSFNYTNCEFAQCDDG

SEQ ID NO: 2785127 - protein, 17 aa, Entamoeba invadens
INIRATKSLNIYQITDE

SEQ ID NO: 2785128 - protein, 18 aa, Entamoeba invadens
INNLNCFDVLSMSNTSCL

SEQ ID NO: 2785129 - protein, 26 aa, Entamoeba invadens
INNSKCSKCSFWYSPIKYGTLCESRA

SEQ ID NO: 2785130 - protein, 26 aa, Entamoeba invadens
INSTHCITCPLGYYLSNNTCNTNAKL

SEQ ID NO: 2785131 - protein, 25 aa, Entamoeba invadens
IPKGKACEFEVFLLVNCSTQIEDTI

SEQ ID NO: 2785132 - protein, 22 aa, Entamoeba invadens
IPNKICLVTEFAQYGSLQDLMK

SEQ ID NO: 2785133 - protein, 18 aa, Entamoeba invadens
IPPMKIRVKMMIDGARGI

SEQ ID NO: 2785134 - protein, 17 aa, Entamoeba invadens
IQPEFRNTKFLKSIKTA

SEQ ID NO: 2785135 - protein, 17 aa, Entamoeba invadens
IRCNLTGSVFSKFQSYQ

SEQ ID NO: 2785136 - protein, 25 aa, Entamoeba invadens
ISAKRGAGFSGWEYITDGFATMKPV

SEQ ID NO: 2785137 - protein, 17 aa, Entamoeba invadens
ISFMTCYIVFQLDVEYC

SEQ ID NO: 2785138 - protein, 19 aa, Entamoeba invadens
ITCQCIEGFITSPDDPFSC

SEQ ID NO: 2785139 - protein, 23 aa, Entamoeba invadens
ITMYECFTWTNAYPKEQFKFPWT

SEQ ID NO: 2785140 - protein, 23 aa, Entamoeba invadens
ITMYECFTWTNAYPKEYFKFPWT

SEQ ID NO: 2785141 - protein, 39 aa, Entamoeba invadens
ITMYEVFGWCKAYPITTFKFPWKIAEFVTAGERLERREN

SEQ ID NO: 2785142 - protein, 21 aa, Entamoeba invadens
IVAITICKASIYLVILVLVIA

SEQ ID NO: 2785143 - protein, 26 aa, Entamoeba invadens
IVLFLFLLRRLFRKMQKRNIEQNYTI

SEQ ID NO: 2785144 - protein, 18 aa, Entamoeba invadens
IVLPRNGGGFVDAEDFLY

SEQ ID NO: 2785145 - protein, 31 aa, Entamoeba invadens
IVTKVLYLIGWVFPVIWMVQLFFIFSSNQSI

SEQ ID NO: 2785146 - protein, 19 aa, Entamoeba invadens
IYGESLLCLPFENMTNCEN

SEQ ID NO: 2785147 - protein, 28 aa, Entamoeba invadens
IYYYPTCMPTFLSKIVIFTITFDANYSL

SEQ ID NO: 2785148 - protein, 21 aa, Entamoeba invadens
KAGGCAICRDGYFKVLKDCIV

SEQ ID NO: 2785149 - protein, 23 aa, Entamoeba invadens
KCEKCKPGFWIEDFECVTCETCG

SEQ ID NO: 2785150 - protein, 17 aa, Entamoeba invadens
KCGLLNYSNYNEVYCDV

SEQ ID NO: 2785151 - protein, 17 aa, Entamoeba invadens
KCIANGVLNQTGSSMIE

SEQ ID NO: 2785152 - protein, 26 aa, Entamoeba invadens
KCTKCKNDNCALCVGGKCQMCSANHL

SEQ ID NO: 2785153 - protein, 17 aa, Entamoeba invadens
KCTSCGDTQVLVDSKCL

SEQ ID NO: 2785154 - protein, 17 aa, Entamoeba invadens
KCTSCPEGHLLLDDTKK

SEQ ID NO: 2785155 - protein, 23 aa, Entamoeba invadens
KCVCKSGYGGDDCHLLCYYHDNW

SEQ ID NO: 2785156 - protein, 20 aa, Entamoeba invadens
KCVTCVSGYFVFENKCKKCD

SEQ ID NO: 2785157 - protein, 21 aa, Entamoeba invadens
KDSVCTKCGNGVLDENEDCDL

SEQ ID NO: 2785158 - protein, 18 aa, Entamoeba invadens
KEKLKVCTYKMSRSNIKM

SEQ ID NO: 2785159 - protein, 23 aa, Entamoeba invadens
KELKKEVTAECEIMSKLRNPFIA

SEQ ID NO: 2785160 - protein, 21 aa, Entamoeba invadens
KESCLDCSDTFFVSNSKCVSS

SEQ ID NO: 2785161 - protein, 20 aa, Entamoeba invadens
KFRSEHIVHFYGAVFVSHKI

SEQ ID NO: 2785162 - protein, 18 aa, Entamoeba invadens
KGEACEFEIFIKPLCSCE

SEQ ID NO: 2785163 - protein, 17 aa, Entamoeba invadens
KGEECDGGDGCVECECQ

SEQ ID NO: 2785164 - protein, 25 aa, Entamoeba invadens
KGFACEFEILLTLSCTSKIESKILL

SEQ ID NO: 2785165 - protein, 17 aa, Entamoeba invadens
KGIISFTKPMKVPIING

SEQ ID NO: 2785166 - protein, 20 aa, Entamoeba invadens
KHLFMHFWRKKHPIVEDAKE

SEQ ID NO: 2785167 - protein, 19 aa, Entamoeba invadens
KIRVKMMIDGARGINYLHE

SEQ ID NO: 2785168 - protein, 17 aa, Entamoeba invadens
KITCKVENCKTCIETDI

SEQ ID NO: 2785169 - protein, 25 aa, Entamoeba invadens
KKCEPCEDIICISCGTQPNTCIHCK

SEQ ID NO: 2785170 - protein, 20 aa, Entamoeba invadens
KKLRLKFLLDGAKGIQYLHE

SEQ ID NO: 2785171 - protein, 31 aa, Entamoeba invadens
KKRLLKMPKYSIEWGGSVKKDLINLGLTIPF

SEQ ID NO: 2785172 - protein, 22 aa, Entamoeba invadens
KLCLPFDELTQFCLKKTKNGCV

SEQ ID NO: 2785173 - protein, 26 aa, Entamoeba invadens
KLDTPELYELIALIAAPPKENNTTKY

SEQ ID NO: 2785174 - protein, 20 aa, Entamoeba invadens
KLRVKYCLDASKGILYLHEN

SEQ ID NO: 2785175 - protein, 18 aa, Entamoeba invadens
KMSTKGCLECEDTYYLTL

SEQ ID NO: 2785176 - protein, 25 aa, Entamoeba invadens
KNAESCFTCAFGYYFDTTNNDCIYV

SEQ ID NO: 2785177 - protein, 18 aa, Entamoeba invadens
KPKCITCYPPYKVSSNGD

SEQ ID NO: 2785178 - protein, 26 aa, Entamoeba invadens
KPVHFNWIVVFIGYFFAIEIQLINQM

SEQ ID NO: 2785179 - protein, 22 aa, Entamoeba invadens
KRGESHCKFNCQCEDGYIIKNN

SEQ ID NO: 2785180 - protein, 21 aa, Entamoeba invadens
KRIGIPIIVVAIVIIIISTTT

SEQ ID NO: 2785181 - protein, 19 aa, Entamoeba invadens
KRSQCPCNGETCIVNTESV

SEQ ID NO: 2785182 - protein, 26 aa, Entamoeba invadens
KSVRGCLKCSSGYFVENQFCSSCDSK

SEQ ID NO: 2785183 - protein, 17 aa, Entamoeba invadens
KTCKACMSGCKTCTKAN

SEQ ID NO: 2785184 - protein, 17 aa, Entamoeba invadens
KTCKLCIDGNYYDKTTK

SEQ ID NO: 2785185 - protein, 19 aa, Entamoeba invadens
KTVCIKCNSNTRLVDGMCV

SEQ ID NO: 2785186 - protein, 25 aa, Entamoeba invadens
KVANSKCSKCTFWHVPSESGTFCNT

SEQ ID NO: 2785187 - protein, 26 aa, Entamoeba invadens
KVPNGNGCLVCKVGYYKKGADCVLCD

SEQ ID NO: 2785188 - protein, 31 aa, Entamoeba invadens
KYPPLTITFPMKLRLKFLIDAAKGIEYLHNN

SEQ ID NO: 2785189 - protein, 24 aa, Entamoeba invadens
LAAGKCAICPRGTYYTSSVCQSCG

SEQ ID NO: 2785190 - protein, 19 aa, Entamoeba invadens
LFVNCGVCKLVNNKVQYTE

SEQ ID NO: 2785191 - protein, 18 aa, Entamoeba invadens
LGSPFGGGVYVYTGGSTG

SEQ ID NO: 2785192 - protein, 19 aa, Entamoeba invadens
LIFFICELVTGIVIHSLAL

SEQ ID NO: 2785193 - protein, 17 aa, Entamoeba invadens
LKCKKEMPNMVGCAICQ

SEQ ID NO: 2785194 - protein, 20 aa, Entamoeba invadens
LKPGYACEFEIIIKPLCTCV

SEQ ID NO: 2785195 - protein, 19 aa, Entamoeba invadens
LKVQFSVMEGCDYYEIRSV

SEQ ID NO: 2785196 - protein, 21 aa, Entamoeba invadens
LLKWNEHYTMTFPEALASGFF

SEQ ID NO: 2785197 - protein, 32 aa, Entamoeba invadens
LMFGLGFLLLFPWLVAFIISRKTKNKAVNVVG

SEQ ID NO: 2785198 - protein, 23 aa, Entamoeba invadens
LNGGECQLCPSGKYYNPNSKSCQ

SEQ ID NO: 2785199 - protein, 23 aa, Entamoeba invadens
LNNPRIVLWNSTYLHLNLNMTPR

SEQ ID NO: 2785200 - protein, 17 aa, Entamoeba invadens
LNYLYIYGATLLMNSYT

SEQ ID NO: 2785201 - protein, 17 aa, Entamoeba invadens
LNYSTFVVKNIFEMIAG

SEQ ID NO: 2785202 - protein, 26 aa, Entamoeba invadens
LPAGGGCAICKVGYYKVEKDCDACDE

SEQ ID NO: 2785203 - protein, 21 aa, Entamoeba invadens
LPTKLCKDAKDGEIWAAKCIN

SEQ ID NO: 2785204 - protein, 23 aa, Entamoeba invadens
LRDICMQFVPSGGCVKCVNGYYR

SEQ ID NO: 2785205 - protein, 17 aa, Entamoeba invadens
LRELICVGNTTKHNMKI

SEQ ID NO: 2785206 - protein, 17 aa, Entamoeba invadens
LRGCLNCSEGYYPSNKI

SEQ ID NO: 2785207 - protein, 19 aa, Entamoeba invadens
LRRRNLKVFNDEDNLFFQT

SEQ ID NO: 2785208 - protein, 18 aa, Entamoeba invadens
LRTACIWIVQLIIGCFVD

SEQ ID NO: 2785209 - protein, 18 aa, Entamoeba invadens
LSCTSLKSCEICNVTDYV

SEQ ID NO: 2785210 - protein, 20 aa, Entamoeba invadens
LSFFNEILRNIKFIKYNRWE

SEQ ID NO: 2785211 - protein, 23 aa, Entamoeba invadens
LSTQTELGFSYILGGVNNVYNFG

SEQ ID NO: 2785212 - protein, 18 aa, Entamoeba invadens
LTCSSYGICESCISSEVL

SEQ ID NO: 2785213 - protein, 26 aa, Entamoeba invadens
LTESGCLRCLDGYYLDKMTCKKCEEP

SEQ ID NO: 2785214 - protein, 21 aa, Entamoeba invadens
LVESFPCVLCGTKSDLETQRS

SEQ ID NO: 2785215 - protein, 21 aa, Entamoeba invadens
LVGCLSLGAIVTVGAIQIASI

SEQ ID NO: 2785216 - protein, 18 aa, Entamoeba invadens
LVTLKPGYACEFEIFIKP

SEQ ID NO: 2785217 - protein, 25 aa, Entamoeba invadens
LYSTKCTLCDSSLVLLSNGSCVGLF

SEQ ID NO: 2785218 - protein, 26 aa, Entamoeba invadens
MEQLYCKRSHGVSCEECIPSYYKSNT

SEQ ID NO: 2785219 - protein, 18 aa, Entamoeba invadens
MFEAFTWQEAYPKEQFRF

SEQ ID NO: 2785220 - protein, 27 aa, Entamoeba invadens
MGKGIEVFCGLPFIETTGFIALNREKC

SEQ ID NO: 2785221 - protein, 18 aa, Entamoeba invadens
MIMECWRADPKDRPSFDQ

SEQ ID NO: 2785222 - protein, 19 aa, Entamoeba invadens
MKLNCSITQFIDVSEPNPM

SEQ ID NO: 2785223 - protein, 20 aa, Entamoeba invadens
MKLRTKLLLDASIGIQYLHE

SEQ ID NO: 2785224 - protein, 21 aa, Entamoeba invadens
MKNTRFVVSGIHFSKFEEIRN

SEQ ID NO: 2785225 - protein, 17 aa, Entamoeba invadens
MMSKLRNPFIANYIGSV

SEQ ID NO: 2785226 - protein, 17 aa, Entamoeba invadens
MPLKCYTDYVFDTTSNQ

SEQ ID NO: 2785227 - protein, 24 aa, Entamoeba invadens
MSSTCISCDFGMYLEDGGNCAECP

SEQ ID NO: 2785228 - protein, 24 aa, Entamoeba invadens
NAGSCVTCAFGYYFDTTSNDCIYV

SEQ ID NO: 2785229 - protein, 27 aa, Entamoeba invadens
NAMTDLLKVRFCQDIAKGMEYLHHNDI

SEQ ID NO: 2785230 - protein, 19 aa, Entamoeba invadens
NCKLCRNIINFGIRCEECF

SEQ ID NO: 2785231 - protein, 22 aa, Entamoeba invadens
NCLPVCGDSGLLSWNKNSQCIS

SEQ ID NO: 2785232 - protein, 20 aa, Entamoeba invadens
NCLTCSSNAESTCLSCVKNV

SEQ ID NO: 2785233 - protein, 18 aa, Entamoeba invadens
NCQTCSTKTVGIPVCTAC

SEQ ID NO: 2785234 - protein, 21 aa, Entamoeba invadens
NCVKCNVKGGYFEDVEFTTIE

SEQ ID NO: 2785235 - protein, 19 aa, Entamoeba invadens
NDGDCVVCSDGYYRTPNNN

SEQ ID NO: 2785236 - protein, 25 aa, Entamoeba invadens
NDILKCSYLLNKQCVECEIGKFLTN

SEQ ID NO: 2785237 - protein, 21 aa, Entamoeba invadens
NDVGCAICKNGYFKDKNDCVK

SEQ ID NO: 2785238 - protein, 17 aa, Entamoeba invadens
NEIPIRFQTVISSRLDY

SEQ ID NO: 2785239 - protein, 22 aa, Entamoeba invadens
NGCIKCKDAFYINNKMCSPCNS

SEQ ID NO: 2785240 - protein, 24 aa, Entamoeba invadens
NGCKEGTCLKNYYGKQVWNNDQQY

SEQ ID NO: 2785241 - protein, 22 aa, Entamoeba invadens
NGCTLCPDGFFIENKRCSQCNG

SEQ ID NO: 2785242 - protein, 17 aa, Entamoeba invadens
NGIKIISGVECGNGLYN

SEQ ID NO: 2785243 - protein, 20 aa, Entamoeba invadens
NGKCVNCVNGFYLDYNTQTC

SEQ ID NO: 2785244 - protein, 19 aa, Entamoeba invadens
NGKLLRYGSSKKIFCHLYN

SEQ ID NO: 2785245 - protein, 21 aa, Entamoeba invadens
NGMCESCPIGFFKESETKCGE

SEQ ID NO: 2785246 - protein, 19 aa, Entamoeba invadens
NGNCLSCYDGYFMNGKMCD

SEQ ID NO: 2785247 - protein, 20 aa, Entamoeba invadens
NGVCTLCGDLTYSEGGVLQC

SEQ ID NO: 2785248 - protein, 19 aa, Entamoeba invadens
NICIFKMKRSNIIMTKLSD

SEQ ID NO: 2785249 - protein, 24 aa, Entamoeba invadens
NIKCPQASISELWGIKCINGRYNT

SEQ ID NO: 2785250 - protein, 20 aa, Entamoeba invadens
NIMRLPLIRFPKLLNDTMQG

SEQ ID NO: 2785251 - protein, 23 aa, Entamoeba invadens
NIPSCVVGGIIYGYIGALFDTNK

SEQ ID NO: 2785252 - protein, 20 aa, Entamoeba invadens
NKCNVCPAGTYSFMQSTTCS

SEQ ID NO: 2785253 - protein, 24 aa, Entamoeba invadens
NLCLFLSVLCFILLAILSVSEKRN

SEQ ID NO: 2785254 - protein, 25 aa, Entamoeba invadens
NLIHKLLKCKLGFFDVTPMGRIINY

SEQ ID NO: 2785255 - protein, 25 aa, Entamoeba invadens
NLKPEFKNKILFVVHNGLLISEQLE

SEQ ID NO: 2785256 - protein, 18 aa, Entamoeba invadens
NMVGCAICQEGYYRKQSD

SEQ ID NO: 2785257 - protein, 25 aa, Entamoeba invadens
NNGNCVSCGYGFFSNNGICEQCSNL

SEQ ID NO: 2785258 - protein, 18 aa, Entamoeba invadens
NNLFIFKFENSFLTLNKF

SEQ ID NO: 2785259 - protein, 18 aa, Entamoeba invadens
NSSLEMNGTALLETQNVL

SEQ ID NO: 2785260 - protein, 24 aa, Entamoeba invadens
NSTFCLSCKEGTFLSDHKCITNNV

SEQ ID NO: 2785261 - protein, 21 aa, Entamoeba invadens
NTNLRCLTCNITNYKTSSGDC

SEQ ID NO: 2785262 - protein, 36 aa, Entamoeba invadens
NTRSCLKCSPECKTCLSTATTCLSCYNETYLSDGTC

SEQ ID NO: 2785263 - protein, 25 aa, Entamoeba invadens
NVKSAQKWFVIGGHFLGIGMGFVMF

SEQ ID NO: 2785264 - protein, 19 aa, Entamoeba invadens
NYSGICHEVFKYKPHNKKD

SEQ ID NO: 2785265 - protein, 17 aa, Entamoeba invadens
PCMAVKVKFMLDMAKGI

SEQ ID NO: 2785266 - protein, 25 aa, Entamoeba invadens
PDASRRMLLLVSWLLSGFYLMPTGI

SEQ ID NO: 2785267 - protein, 19 aa, Entamoeba invadens
PDIVTLKKGFACEFSIGIT

SEQ ID NO: 2785268 - protein, 30 aa, Entamoeba invadens
PEEKRPSSVSSRFCWILIFVLLNSLLVMYL

SEQ ID NO: 2785269 - protein, 24 aa, Entamoeba invadens
PEMCNGRIDAVWIWVNGSDPTWCS

SEQ ID NO: 2785270 - protein, 25 aa, Entamoeba invadens
PFIFLYCFVCFGLIGYLFTRHVIQI

SEQ ID NO: 2785271 - protein, 24 aa, Entamoeba invadens
PGDRFKYPWDIIDFVNKGNRIQKP

SEQ ID NO: 2785272 - protein, 25 aa, Entamoeba invadens
PKEQFKFPWTIAEFVIKGLRLPKPD

SEQ ID NO: 2785273 - protein, 25 aa, Entamoeba invadens
PKEQFRFPWKIAEYVTHGKHPRKRS

SEQ ID NO: 2785274 - protein, 23 aa, Entamoeba invadens
PKEQVKLSITFMAKCTTILNEKV

SEQ ID NO: 2785275 - protein, 23 aa, Entamoeba invadens
PKTQFKFPWTIAEFVIEGKRLDK

SEQ ID NO: 2785276 - protein, 25 aa, Entamoeba invadens
PLGESWNDWSYLQLAGFFFLLEGLF

SEQ ID NO: 2785277 - protein, 19 aa, Entamoeba invadens
PNYGCEFSLFLTPLCNSTM

SEQ ID NO: 2785278 - protein, 25 aa, Entamoeba invadens
PPSVIGCGLLLWGDGMAEIIGKMIG

SEQ ID NO: 2785279 - protein, 25 aa, Entamoeba invadens
PSGEACEFEILLTLKCTTKMDESVV

SEQ ID NO: 2785280 - protein, 20 aa, Entamoeba invadens
PSGVCTKCDVGFYFNGNSCS

SEQ ID NO: 2785281 - protein, 32 aa, Entamoeba invadens
PSIGKVILKREWKRFLFMYLMVAIYDLFSIAF

SEQ ID NO: 2785282 - protein, 25 aa, Entamoeba invadens
PTCSLCEVEDPFNIDHFGCTAYKTS

SEQ ID NO: 2785283 - protein, 19 aa, Entamoeba invadens
PTQLFDIIEKCWKHNQIER

SEQ ID NO: 2785284 - protein, 23 aa, Entamoeba invadens
QCENDCLFCYNTTYCTTCRSGFY

SEQ ID NO: 2785285 - protein, 19 aa, Entamoeba invadens
QCTGCSMNYVFSNTDKMTC

SEQ ID NO: 2785286 - protein, 24 aa, Entamoeba invadens
QCVSYKSVEFCLSANNSKCTECEG

SEQ ID NO: 2785287 - protein, 17 aa, Entamoeba invadens
QEQPNCLNQELLLSKDN

SEQ ID NO: 2785288 - protein, 18 aa, Entamoeba invadens
QGIMCCIAAGSFLFVSIV

SEQ ID NO: 2785289 - protein, 25 aa, Entamoeba invadens
QIVTLKSGFACEFEVFITPYCTMDL

SEQ ID NO: 2785290 - protein, 24 aa, Entamoeba invadens
QLKCIECLNAYSLKNGICAETFDD

SEQ ID NO: 2785291 - protein, 18 aa, Entamoeba invadens
QLLLNGKLLRYGSSKKIF

SEQ ID NO: 2785292 - protein, 18 aa, Entamoeba invadens
QLYLRTYVTPAFGFGTIA

SEQ ID NO: 2785293 - protein, 20 aa, Entamoeba invadens
QSGCSKCGDGYFQVNTNECQ

SEQ ID NO: 2785294 - protein, 23 aa, Entamoeba invadens
QSLCALCDIGFYRDEYGQCKNCI

SEQ ID NO: 2785295 - protein, 24 aa, Entamoeba invadens
QTILFKFNYDYVFGENYGSGRYLF

SEQ ID NO: 2785296 - protein, 18 aa, Entamoeba invadens
RCADTYYIENGVCVKCEY

SEQ ID NO: 2785297 - protein, 24 aa, Entamoeba invadens
RDVKGENLLVFSLNPHSPVCAKLT

SEQ ID NO: 2785298 - protein, 18 aa, Entamoeba invadens
RESCLTCNLTNYRTSNNE

SEQ ID NO: 2785299 - protein, 19 aa, Entamoeba invadens
RHFDYKAYNWISAHPEEKR

SEQ ID NO: 2785300 - protein, 19 aa, Entamoeba invadens
RKILLRRRNLKVFNDEDNL

SEQ ID NO: 2785301 - protein, 19 aa, Entamoeba invadens
RNECLKCNINYYLKLGKCY

SEQ ID NO: 2785302 - protein, 17 aa, Entamoeba invadens
RNGGGFVDAEDFLYKII

SEQ ID NO: 2785303 - protein, 21 aa, Entamoeba invadens
RNKRLRYSVSNEHFDYEMNMV

SEQ ID NO: 2785304 - protein, 19 aa, Entamoeba invadens
RSCESCLSSKVLLSSGICV

SEQ ID NO: 2785305 - protein, 18 aa, Entamoeba invadens
RSEYGCAQNCYCDTANGF

SEQ ID NO: 2785306 - protein, 21 aa, Entamoeba invadens
RSSKCTKCTFWHIPSENGSSC

SEQ ID NO: 2785307 - protein, 29 aa, Entamoeba invadens
RTKINGMPRFSVRVKIMMDLANGISYLQA

SEQ ID NO: 2785308 - protein, 17 aa, Entamoeba invadens
SCGSGRYLQNGQCLSCD

SEQ ID NO: 2785309 - protein, 22 aa, Entamoeba invadens
SCQDLNCESCTIGVDVCLKCGG

SEQ ID NO: 2785310 - protein, 19 aa, Entamoeba invadens
SCTLCKSTYYISDNKKCSK

SEQ ID NO: 2785311 - protein, 20 aa, Entamoeba invadens
SCVTCPDMQYSLAGSTTCKS

SEQ ID NO: 2785312 - protein, 24 aa, Entamoeba invadens
SDTKCLSCIDGFYLADEGKCSACN

SEQ ID NO: 2785313 - protein, 19 aa, Entamoeba invadens
SDTYYLKDYKCIKCEYPCV

SEQ ID NO: 2785314 - protein, 25 aa, Entamoeba invadens
SEQLKRLHVYGEIFAENGYLVRSDA

SEQ ID NO: 2785315 - protein, 18 aa, Entamoeba invadens
SESILRFVGASKRLEIAD

SEQ ID NO: 2785316 - protein, 19 aa, Entamoeba invadens
SEYIVHFFGAVLIPNKICM

SEQ ID NO: 2785317 - protein, 18 aa, Entamoeba invadens
SFIYACVIYEAILRNYLV

SEQ ID NO: 2785318 - protein, 18 aa, Entamoeba invadens
SFKCKKCLAECQNCTDGI

SEQ ID NO: 2785319 - protein, 29 aa, Entamoeba invadens
SFSSYTIKQICSIYVALVPSDFVEAGYEC

SEQ ID NO: 2785320 - protein, 25 aa, Entamoeba invadens
SFVLFFSVKISHHYQTKKVYENMCI

SEQ ID NO: 2785321 - protein, 24 aa, Entamoeba invadens
SFYKSDRVILGISIPETVVMNSFT

SEQ ID NO: 2785322 - protein, 20 aa, Entamoeba invadens
SGICTACLTNYVFEETKSKM

SEQ ID NO: 2785323 - protein, 19 aa, Entamoeba invadens
SGQCLACDAGYYSKGGQNS

SEQ ID NO: 2785324 - protein, 21 aa, Entamoeba invadens
SGRCVKCDKGYYISNGNCVVC

SEQ ID NO: 2785325 - protein, 27 aa, Entamoeba invadens
SHCRLCKNEKCSICDNNFILKNESFCV

SEQ ID NO: 2785326 - protein, 25 aa, Entamoeba invadens
SHLNKCLKCEISFMRVDEIIVKAEY

SEQ ID NO: 2785327 - protein, 20 aa, Entamoeba invadens
SIRDIPILFTKSVLISSLTS

SEQ ID NO: 2785328 - protein, 20 aa, Entamoeba invadens
SISCSLCADTYFYYKKDSDL

SEQ ID NO: 2785329 - protein, 25 aa, Entamoeba invadens
SKFNYSGVCGDVFKYGPNTKRDLVI

SEQ ID NO: 2785330 - protein, 18 aa, Entamoeba invadens
SKTNWALIIPLVVVGVII

SEQ ID NO: 2785331 - protein, 18 aa, Entamoeba invadens
SLDSFLIQYLYIRIQALT

SEQ ID NO: 2785332 - protein, 21 aa, Entamoeba invadens
SLGTCQLALWGLYPDEMSARV

SEQ ID NO: 2785333 - protein, 36 aa, Entamoeba invadens
SLYLTKMAKYWMLQRMDWLGVFICFVTVTVLVITKL

SEQ ID NO: 2785334 - protein, 17 aa, Entamoeba invadens
SNCVLCLEEYYLKDLQC

SEQ ID NO: 2785335 - protein, 22 aa, Entamoeba invadens
SNKNEKCLLCENNTFYDNTSMC

SEQ ID NO: 2785336 - protein, 19 aa, Entamoeba invadens
SNLNRYAHTIDFTRYRDSR

SEQ ID NO: 2785337 - protein, 36 aa, Entamoeba invadens
SNPDKACPCYNDISGKGGDCLIHLETTSATPVTVMA

SEQ ID NO: 2785338 - protein, 18 aa, Entamoeba invadens
SNPKCKRCDSDPSICSSY

SEQ ID NO: 2785339 - protein, 24 aa, Entamoeba invadens
SNQARCFYCQCSYIDGGASLVMFA

SEQ ID NO: 2785340 - protein, 19 aa, Entamoeba invadens
SNQKCLSCEAGTYKKTETT

SEQ ID NO: 2785341 - protein, 24 aa, Entamoeba invadens
SPVCAKLTDFGTCRNISERNLQSK

SEQ ID NO: 2785342 - protein, 24 aa, Entamoeba invadens
SPVCGKLTDFGTCRNISERALSTK

SEQ ID NO: 2785343 - protein, 19 aa, Entamoeba invadens
SQCISCKNGYYLGENNKCI

SEQ ID NO: 2785344 - protein, 20 aa, Entamoeba invadens
SQIIGLIAILLSKKKASPNY

SEQ ID NO: 2785345 - protein, 19 aa, Entamoeba invadens
SSDGTTCIGCDESCKSCTN

SEQ ID NO: 2785346 - protein, 21 aa, Entamoeba invadens
SSEYCISCNQTTFLVNNKCAS

SEQ ID NO: 2785347 - protein, 39 aa, Entamoeba invadens
SSGGCAKCAEGYYRNGLDCYKCDLSCSLCNTNFTCLTCN

SEQ ID NO: 2785348 - protein, 19 aa, Entamoeba invadens
SSIFIFIAILNHRKTEKLR

SEQ ID NO: 2785349 - protein, 33 aa, Entamoeba invadens
SSNQSIKIWGYRALSALLLYGFVAFMSCYLVFQ

SEQ ID NO: 2785350 - protein, 18 aa, Entamoeba invadens
SSSGCAVCMDGYYRDNVI

SEQ ID NO: 2785351 - protein, 18 aa, Entamoeba invadens
STCSKCFDGYYYKEDDKI

SEQ ID NO: 2785352 - protein, 17 aa, Entamoeba invadens
STECVFADPINKETIQI

SEQ ID NO: 2785353 - protein, 23 aa, Entamoeba invadens
STGYCSSCSTGLVYTNPKSMQCE

SEQ ID NO: 2785354 - protein, 25 aa, Entamoeba invadens
STYCVKCKIGLVLRSGVCSEYINSE

SEQ ID NO: 2785355 - protein, 20 aa, Entamoeba invadens
STYRGCVVCKNGYMRSSDGT

SEQ ID NO: 2785356 - protein, 18 aa, Entamoeba invadens
SVNCTKCEFNKCVECSEN

SEQ ID NO: 2785357 - protein, 19 aa, Entamoeba invadens
SVTALKFVKIMLTNNTSIN

SEQ ID NO: 2785358 - protein, 19 aa, Entamoeba invadens
SYNCLRCSRGFKLVDGVCL

SEQ ID NO: 2785359 - protein, 25 aa, Entamoeba invadens
TCIECKNCKQGFCGNETGCYECEDS

SEQ ID NO: 2785360 - protein, 36 aa, Entamoeba invadens
TCPEDRMARVVEKFEFPMYMIAVIIIFVLVLAVIVA

SEQ ID NO: 2785361 - protein, 17 aa, Entamoeba invadens
TDIDHSMLLYKTSADDE

SEQ ID NO: 2785362 - protein, 25 aa, Entamoeba invadens
TDVQFKHAWSIADFTSSGKRLQIPT

SEQ ID NO: 2785363 - protein, 23 aa, Entamoeba invadens
TEDKCLRCNDGFVFEGNNCVDIT

SEQ ID NO: 2785364 - protein, 21 aa, Entamoeba invadens
TEKLREKYCLFDMKKTNIEFV

SEQ ID NO: 2785365 - protein, 20 aa, Entamoeba invadens
TENKCVLCSDISGCVMCSTT

SEQ ID NO: 2785366 - protein, 20 aa, Entamoeba invadens
THAVWWFILIWVLFVIIVVI

SEQ ID NO: 2785367 - protein, 20 aa, Entamoeba invadens
TKAVWWFILIIIIFVLVIIT

SEQ ID NO: 2785368 - protein, 22 aa, Entamoeba invadens
TKDSKCSSCTFWYSPSDDGTFC

SEQ ID NO: 2785369 - protein, 23 aa, Entamoeba invadens
TKDSKCSSCTFWYSPSDDGTYCS

SEQ ID NO: 2785370 - protein, 18 aa, Entamoeba invadens
TKFAGLKPKIMKMKYTKY

SEQ ID NO: 2785371 - protein, 25 aa, Entamoeba invadens
TKGCLRCLSGYYLADHMCVKCDYPC

SEQ ID NO: 2785372 - protein, 23 aa, Entamoeba invadens
TKKCSKTNCPAMYYKVDKTCKKC

SEQ ID NO: 2785373 - protein, 24 aa, Entamoeba invadens
TKLLLGGKLLRYGTSNKIFCHVED

SEQ ID NO: 2785374 - protein, 22 aa, Entamoeba invadens
TLCISCPSGFYLTSEHTCKEVG

SEQ ID NO: 2785375 - protein, 18 aa, Entamoeba invadens
TMIDECWKQKPEARPNFD

SEQ ID NO: 2785376 - protein, 23 aa, Entamoeba invadens
TNCNLTCYCAEGYVTNPTDKRNC

SEQ ID NO: 2785377 - protein, 25 aa, Entamoeba invadens
TNNFCLSCPNGFYLNSQKTCMSCGN

SEQ ID NO: 2785378 - protein, 22 aa, Entamoeba invadens
TNSKCSKCSFWHTTNSDNTSCI

SEQ ID NO: 2785379 - protein, 21 aa, Entamoeba invadens
TNSKCTKCTFWHTPNYSNTSC

SEQ ID NO: 2785380 - protein, 19 aa, Entamoeba invadens
TPLDYSFCRYPMKYRVGKW

SEQ ID NO: 2785381 - protein, 25 aa, Entamoeba invadens
TQAVWWVILLCVLFVIFIFIIIIAS

SEQ ID NO: 2785382 - protein, 23 aa, Entamoeba invadens
TRIRDLRIPYSVWFAHSKSTLSS

SEQ ID NO: 2785383 - protein, 21 aa, Entamoeba invadens
TRKCSKCSGSHTVSENGDECI

SEQ ID NO: 2785384 - protein, 20 aa, Entamoeba invadens
TRKCSKCSRSRTVSENGDEC

SEQ ID NO: 2785385 - protein, 19 aa, Entamoeba invadens
TSGAFEVFALLALALAFLF

SEQ ID NO: 2785386 - protein, 24 aa, Entamoeba invadens
TSTDCLSCASGLYLNDSTHQCIDC

SEQ ID NO: 2785387 - protein, 18 aa, Entamoeba invadens
TTAGCMLCEGGHYLSNNL

SEQ ID NO: 2785388 - protein, 21 aa, Entamoeba invadens
TTGQCLTCYSGYIVSGGNCVA

SEQ ID NO: 2785389 - protein, 21 aa, Entamoeba invadens
TYFEPYCPCEGSNCYITPLPS

SEQ ID NO: 2785390 - protein, 18 aa, Entamoeba invadens
TYRGCVVCKEGYMRSSDG

SEQ ID NO: 2785391 - protein, 18 aa, Entamoeba invadens
VAFSGLFLSNVLMLNQFA

SEQ ID NO: 2785392 - protein, 26 aa, Entamoeba invadens
VCKDGYYRVGLDCFKCDQKCKTCNNK

SEQ ID NO: 2785393 - protein, 17 aa, Entamoeba invadens
VCTGCLDGYVKNGMSCI

SEQ ID NO: 2785394 - protein, 27 aa, Entamoeba invadens
VECLDAFKLKGGICAETFDEDDKLKTN

SEQ ID NO: 2785395 - protein, 18 aa, Entamoeba invadens
VGNFKRLSDLHVETYKVT

SEQ ID NO: 2785396 - protein, 17 aa, Entamoeba invadens
VGPNWPEQGDVKFENLT

SEQ ID NO: 2785397 - protein, 26 aa, Entamoeba invadens
VIVEELMLRGKVVIFSDEKIDNDTFT

SEQ ID NO: 2785398 - protein, 23 aa, Entamoeba invadens
VKLTKLHLGNVITFQDNLQYITE

SEQ ID NO: 2785399 - protein, 34 aa, Entamoeba invadens
VLLIKKPEAFPLMFSTGASVSWPEGTIKIVVDPS

SEQ ID NO: 2785400 - protein, 21 aa, Entamoeba invadens
VLYDPKRLLGLSLEEIPEDEK

SEQ ID NO: 2785401 - protein, 19 aa, Entamoeba invadens
VNCGVSVSVCQLSRTKVMP

SEQ ID NO: 2785402 - protein, 22 aa, Entamoeba invadens
VNKEIKNLFSIGNTTNHKVKIQ

SEQ ID NO: 2785403 - protein, 19 aa, Entamoeba invadens
VPITLRYGQLQNIMKDIKK

SEQ ID NO: 2785404 - protein, 23 aa, Entamoeba invadens
VSNSKCTKCTFWHVPDNTKTKCI

SEQ ID NO: 2785405 - protein, 17 aa, Entamoeba invadens
VSVCQLSRTKVMPLKCY

SEQ ID NO: 2785406 - protein, 17 aa, Entamoeba invadens
VTRQIYFGKDAKINLLE

SEQ ID NO: 2785407 - protein, 18 aa, Entamoeba invadens
VVGIPIVSVFIIVLIIIS

SEQ ID NO: 2785408 - protein, 27 aa, Entamoeba invadens
VVKDMGFKMGISYLPTLPLNESDLVPN

SEQ ID NO: 2785409 - protein, 22 aa, Entamoeba invadens
VVLPILCILLLVIILFIIIITT

SEQ ID NO: 2785410 - protein, 17 aa, Entamoeba invadens
VVLPIVFVVIFIVLVVV

SEQ ID NO: 2785411 - protein, 25 aa, Entamoeba invadens
VVLRRFTFLMGVNFFLRSVCLYFTL

SEQ ID NO: 2785412 - protein, 18 aa, Entamoeba invadens
WAAKCINGSFNYTNCEFA

SEQ ID NO: 2785413 - protein, 25 aa, Entamoeba invadens
WDLLKQVRPGMDLSRISFPSHILEP

SEQ ID NO: 2785414 - protein, 24 aa, Entamoeba invadens
WEADRVSIKYGIMGKLTGMRLVGW

SEQ ID NO: 2785415 - protein, 20 aa, Entamoeba invadens
WKYNESTGRCCAINCSSETC

SEQ ID NO: 2785416 - protein, 25 aa, Entamoeba invadens
WRKIRADTILSMGLAKSSIPHADKV

SEQ ID NO: 2785417 - protein, 18 aa, Entamoeba invadens
WTGFPNVFSDLWKPYLEI

SEQ ID NO: 2785418 - protein, 19 aa, Entamoeba invadens
WYITPFDNVTAFAIESHKQ

SEQ ID NO: 2785419 - protein, 19 aa, Entamoeba invadens
YCTIYAFVLFLKKGLDCSE

SEQ ID NO: 2785420 - protein, 20 aa, Entamoeba invadens
YEIRSVPPLVTLKPGYACEF

SEQ ID NO: 2785421 - protein, 33 aa, Entamoeba invadens
YKMPCDIYSLAISFFEIIGWAEPFPKKRFKHPW

SEQ ID NO: 2785422 - protein, 23 aa, Entamoeba invadens
YKSCTCITGFNFLDSGLCETCHS

SEQ ID NO: 2785423 - protein, 22 aa, Entamoeba invadens
YKTMLLKANYYYNFILQNYNAG

SEQ ID NO: 2785424 - protein, 20 aa, Entamoeba invadens
YNSYKLRNGVCAEYFDDNVD

SEQ ID NO: 2785425 - protein, 20 aa, Entamoeba invadens
YPKQGRCVPCDYGCTTCSSA

SEQ ID NO: 2785426 - protein, 17 aa, Entamoeba invadens
YQLKVKILDDMAVALAY

SEQ ID NO: 2785427 - protein, 23 aa, Entamoeba invadens
YSDCQKYGCGEHVCYYSNVFYQR

SEQ ID NO: 2785428 - protein, 22 aa, Entamoeba invadens
YTICRFDFIGGKSITFRSFNGY

SEQ ID NO: 2785429 - protein, 25 aa, Entamoeba invadens
YTVKQICSIYVALVPSDFVEAGYEC

SEQ ID NO: 2785430 - protein, 17 aa, Entamoeba invadens
YVCKGSTECVFADPINK

SEQ ID NO: 2785431 - protein, 24 aa, Entamoeba invadens
YVIRFYGACFIPNRICMVTELAKY

SEQ ID NO: 2785432 - protein, 18 aa, Entamoeba invadens
AAAIPLPIVKKLLGNYIV

SEQ ID NO: 2785433 - protein, 18 aa, Entamoeba invadens
AAALTFKVSINRLQTYFL

SEQ ID NO: 2785434 - protein, 19 aa, Entamoeba invadens
AADKVSCDAFWGRSSYGVW

SEQ ID NO: 2785435 - protein, 17 aa, Entamoeba invadens
AAEEFCNIFPPSTYEVD

SEQ ID NO: 2785436 - protein, 29 aa, Entamoeba invadens
AAFFDKSNKCGICYEMVGLSGTLRFRVDN

SEQ ID NO: 2785437 - protein, 25 aa, Entamoeba invadens
AAGFCCFCCMLYMFGVLCDRQPKFA

SEQ ID NO: 2785438 - protein, 18 aa, Entamoeba invadens
AAIVCCRCAPSQKAKIVE

SEQ ID NO: 2785439 - protein, 17 aa, Entamoeba invadens
AAKSKIISMISIYNKTI

SEQ ID NO: 2785440 - protein, 19 aa, Entamoeba invadens
AAKTANCHDFISAMPEGYN

SEQ ID NO: 2785441 - protein, 19 aa, Entamoeba invadens
AAKTANCHEFISAMPEGYN

SEQ ID NO: 2785442 - protein, 17 aa, Entamoeba invadens
AALAQWILVGLIILIFV

SEQ ID NO: 2785443 - protein, 21 aa, Entamoeba invadens
AALEFSKWNLNAENKFCPVKK

SEQ ID NO: 2785444 - protein, 25 aa, Entamoeba invadens
AALEIVKLCIKHCEPHAKTVFYKGT

SEQ ID NO: 2785445 - protein, 21 aa, Entamoeba invadens
AALGCSSKIWVGCPSKATPFD

SEQ ID NO: 2785446 - protein, 25 aa, Entamoeba invadens
AALIDFAFVLLFFHWKFFNIACLLP

SEQ ID NO: 2785447 - protein, 20 aa, Entamoeba invadens
AALLLYILIIFDALRKPLSQ

SEQ ID NO: 2785448 - protein, 22 aa, Entamoeba invadens
AALMLGWYFSFFLLVPLGVFGF

SEQ ID NO: 2785449 - protein, 25 aa, Entamoeba invadens
AALNGSYVTLKWLLTKGANPNAENC

SEQ ID NO: 2785450 - protein, 17 aa, Entamoeba invadens
AALQVITSFCFQMSIKW

SEQ ID NO: 2785451 - protein, 19 aa, Entamoeba invadens
AALRLIGESYPFTNSSSFI

SEQ ID NO: 2785452 - protein, 30 aa, Entamoeba invadens
AALYSNRAFCYIKLECFKAAITDAEKCVSV

SEQ ID NO: 2785453 - protein, 22 aa, Entamoeba invadens
AAMAVLVVCYFVNKGGSRFGIP

SEQ ID NO: 2785454 - protein, 17 aa, Entamoeba invadens
AAMSITLAWTYKRSLFL

SEQ ID NO: 2785455 - protein, 21 aa, Entamoeba invadens
AANACSKCVPNFVGYISKGVC

SEQ ID NO: 2785456 - protein, 23 aa, Entamoeba invadens
AANFYKFSLAYDVPVDISTCFAK

SEQ ID NO: 2785457 - protein, 19 aa, Entamoeba invadens
AANVNAWSAIKIGGNSIFN

SEQ ID NO: 2785458 - protein, 20 aa, Entamoeba invadens
AAPNIRSAPTMNSMKLYVMM

SEQ ID NO: 2785459 - protein, 18 aa, Entamoeba invadens
AAQLQFFTQFIIKKDKDN

SEQ ID NO: 2785460 - protein, 22 aa, Entamoeba invadens
AARKFIMAGSIYFVENVNTPPV

SEQ ID NO: 2785461 - protein, 20 aa, Entamoeba invadens
AARYGWEILQVVIREFRTSD

SEQ ID NO: 2785462 - protein, 22 aa, Entamoeba invadens
AASEILMDFSLLVEILDNDIQK

SEQ ID NO: 2785463 - protein, 23 aa, Entamoeba invadens
AASGRLDIYSSQIIFDDKTIFNM

SEQ ID NO: 2785464 - protein, 17 aa, Entamoeba invadens
AATCKKCKTGSNCLTCE

SEQ ID NO: 2785465 - protein, 18 aa, Entamoeba invadens
AATELCLPYLKFEENAVT

SEQ ID NO: 2785466 - protein, 23 aa, Entamoeba invadens
AATSRIASLVGIKVFVTGGLGGV

SEQ ID NO: 2785467 - protein, 21 aa, Entamoeba invadens
AAVISRISNIFAVLISLVVLC

SEQ ID NO: 2785468 - protein, 19 aa, Entamoeba invadens
AAVMSCADPLSKLISSILT

SEQ ID NO: 2785469 - protein, 20 aa, Entamoeba invadens
AAVVLIKFHLFWDEFNINLH

SEQ ID NO: 2785470 - protein, 34 aa, Entamoeba invadens
AAYLWLKDKINEFKDIKGFFGYYPIDEPKLDCYE

SEQ ID NO: 2785471 - protein, 18 aa, Entamoeba invadens
ACANDLRLNADGTLCEKV

SEQ ID NO: 2785472 - protein, 18 aa, Entamoeba invadens
ACASGCKTCTKADDCSAC

SEQ ID NO: 2785473 - protein, 18 aa, Entamoeba invadens
ACATCKSINCLNSSCSQI

SEQ ID NO: 2785474 - protein, 17 aa, Entamoeba invadens
ACATCYGRNNGECTSCT

SEQ ID NO: 2785475 - protein, 18 aa, Entamoeba invadens
ACCLNMIGDYALCRMFVG

SEQ ID NO: 2785476 - protein, 17 aa, Entamoeba invadens
ACDCPQKKYGSRGDRYD

SEQ ID NO: 2785477 - protein, 25 aa, Entamoeba invadens
ACDLKAVWWVLLFVIVISILVVILI

SEQ ID NO: 2785478 - protein, 17 aa, Entamoeba invadens
ACEFSIYLTPKCTCQIN

SEQ ID NO: 2785479 - protein, 17 aa, Entamoeba invadens
ACGCIPFIVIGSLCLVW

SEQ ID NO: 2785480 - protein, 20 aa, Entamoeba invadens
ACGQRVFFDIRYNFLEVSSF

SEQ ID NO: 2785481 - protein, 17 aa, Entamoeba invadens
ACIGLKIGFVKQSMEIE

SEQ ID NO: 2785482 - protein, 19 aa, Entamoeba invadens
ACISCPITTYSKANSTICT

SEQ ID NO: 2785483 - protein, 19 aa, Entamoeba invadens
ACISFCFIMAASFPLVHFA

SEQ ID NO: 2785484 - protein, 19 aa, Entamoeba invadens
ACITIFGFLFLLTYTVYGM

SEQ ID NO: 2785485 - protein, 23 aa, Entamoeba invadens
ACKEKCILCSTFCLRCIDDQCIL

SEQ ID NO: 2785486 - protein, 20 aa, Entamoeba invadens
ACMVLYIYGGLWAYVATATS

SEQ ID NO: 2785487 - protein, 19 aa, Entamoeba invadens
ACQLMLVDVVMRCGKKNNK

SEQ ID NO: 2785488 - protein, 22 aa, Entamoeba invadens
ACQTPNCKFCEGNKCKRCANDY

SEQ ID NO: 2785489 - protein, 19 aa, Entamoeba invadens
ACSCRGIVVVTVYATLGVE

SEQ ID NO: 2785490 - protein, 20 aa, Entamoeba invadens
ACSKCAAGYYLDGTSCTICS

SEQ ID NO: 2785491 - protein, 17 aa, Entamoeba invadens
ACSNASICIACNEGYYL

SEQ ID NO: 2785492 - protein, 18 aa, Entamoeba invadens
ACSPCSQNSYSFLGFSSC

SEQ ID NO: 2785493 - protein, 28 aa, Entamoeba invadens
ACSPDFSRKCKVCAIGFYPDDASGKCVA

SEQ ID NO: 2785494 - protein, 17 aa, Entamoeba invadens
ACSPGTFSNSATNGSCF

SEQ ID NO: 2785495 - protein, 21 aa, Entamoeba invadens
ACSTIAGGCVCKDGYGGDDCH

SEQ ID NO: 2785496 - protein, 21 aa, Entamoeba invadens
ACTVFSPWFISTEMTHHKQPN

SEQ ID NO: 2785497 - protein, 18 aa, Entamoeba invadens
ACVACSPGTFSNSATNGS

SEQ ID NO: 2785498 - protein, 18 aa, Entamoeba invadens
ACVGLKKGFVKKSKEIEI

SEQ ID NO: 2785499 - protein, 24 aa, Entamoeba invadens
ACVKEVVWWLILIIVIVFLIILIT

SEQ ID NO: 2785500 - protein, 24 aa, Entamoeba invadens
ACVKGVEYCKSFSGTKCTSCYAPY

SEQ ID NO: 2785501 - protein, 20 aa, Entamoeba invadens
ACVLCSSKYSNCKLCTQNSC

SEQ ID NO: 2785502 - protein, 18 aa, Entamoeba invadens
ACYFILRPIFALMEGTAE

SEQ ID NO: 2785503 - protein, 17 aa, Entamoeba invadens
ACYFVLRPLFALIEGTK

SEQ ID NO: 2785504 - protein, 20 aa, Entamoeba invadens
ACYYKYYLENNICKLCGVIN

SEQ ID NO: 2785505 - protein, 17 aa, Entamoeba invadens
ADAFVFFQNMFNGAINI

SEQ ID NO: 2785506 - protein, 25 aa, Entamoeba invadens
ADAGYKYHINKFFNKKIEVVEDPTY

SEQ ID NO: 2785507 - protein, 17 aa, Entamoeba invadens
ADAQAGISEFLSQTPSL

SEQ ID NO: 2785508 - protein, 21 aa, Entamoeba invadens
ADDCLFKDIIQQSWKNKPNER

SEQ ID NO: 2785509 - protein, 22 aa, Entamoeba invadens
ADDCLFKNIIQQSWRNKPTERP

SEQ ID NO: 2785510 - protein, 22 aa, Entamoeba invadens
ADDCLRLGDYNIAHLIFSAIIK

SEQ ID NO: 2785511 - protein, 33 aa, Entamoeba invadens
ADEFKVSESFSMKCSNLFYGCYSCDYKQLNSRI

SEQ ID NO: 2785512 - protein, 21 aa, Entamoeba invadens
ADEKGNCKIMCSFNEACLTGC

SEQ ID NO: 2785513 - protein, 19 aa, Entamoeba invadens
ADEMFKDCVLLSSHEGADK

SEQ ID NO: 2785514 - protein, 23 aa, Entamoeba invadens
ADERVLICRSGVLLLQQEGTNFD

SEQ ID NO: 2785515 - protein, 25 aa, Entamoeba invadens
ADEVILKMRIKLILDTAKGIQYLHA

SEQ ID NO: 2785516 - protein, 17 aa, Entamoeba invadens
ADFFKKNVQIFSAKMEV

SEQ ID NO: 2785517 - protein, 25 aa, Entamoeba invadens
ADFWLGIFCGTLFFGQALGYICGAF

SEQ ID NO: 2785518 - protein, 18 aa, Entamoeba invadens
ADFWLGIFSGTWTFGQSV

SEQ ID NO: 2785519 - protein, 18 aa, Entamoeba invadens
ADFWLGVFSGSWTFGQAV

SEQ ID NO: 2785520 - protein, 37 aa, Entamoeba invadens
ADFYRYIPEAIIIPFFVFCITVVYLLSDYWKLKVDVE

SEQ ID NO: 2785521 - protein, 24 aa, Entamoeba invadens
ADGNFKVADGLFYNVETLQKITKP

SEQ ID NO: 2785522 - protein, 21 aa, Entamoeba invadens
ADGYGGDSCIPKCYYNNQWTT

SEQ ID NO: 2785523 - protein, 26 aa, Entamoeba invadens
ADIFSFAITLYECFGWCNAYSEKEFK

SEQ ID NO: 2785524 - protein, 19 aa, Entamoeba invadens
ADIKLSPPKRVSRLSQDFL

SEQ ID NO: 2785525 - protein, 17 aa, Entamoeba invadens
ADIKRYLDHSVTLDPFV

SEQ ID NO: 2785526 - protein, 24 aa, Entamoeba invadens
ADILLKREFAYVVMNYVCITFECF

SEQ ID NO: 2785527 - protein, 24 aa, Entamoeba invadens
ADKCGRGKFVASFIGAIFQTHKMG

SEQ ID NO: 2785528 - protein, 20 aa, Entamoeba invadens
ADKMCKKCTDGCKVCSNAND

SEQ ID NO: 2785529 - protein, 19 aa, Entamoeba invadens
ADKMCKKCTDKCKVCSNAN

SEQ ID NO: 2785530 - protein, 27 aa, Entamoeba invadens
ADKMFKFSLYVYIAFFAVSFFFYIATF

SEQ ID NO: 2785531 - protein, 27 aa, Entamoeba invadens
ADKNSVCFLCDPLYYNRFGCIPCPNNC

SEQ ID NO: 2785532 - protein, 22 aa, Entamoeba invadens
ADLFYNPKCTTRNGGRTDYIQS

SEQ ID NO: 2785533 - protein, 19 aa, Entamoeba invadens
ADLKELFLPSTLEKADKYL

SEQ ID NO: 2785534 - protein, 17 aa, Entamoeba invadens
ADLLYSPYISFRAILIV

SEQ ID NO: 2785535 - protein, 17 aa, Entamoeba invadens
ADLTFLAKMCVIHNVIR

SEQ ID NO: 2785536 - protein, 20 aa, Entamoeba invadens
ADLTHLLSIYFLLTKIISHK

SEQ ID NO: 2785537 - protein, 28 aa, Entamoeba invadens
ADLTPVGQCFICILMILGRHRGFPTQSY

SEQ ID NO: 2785538 - protein, 23 aa, Entamoeba invadens
ADLWCFTPGLFPLIRSGSTEVRV

SEQ ID NO: 2785539 - protein, 17 aa, Entamoeba invadens
ADLYTSIEFDSKFKDKT

SEQ ID NO: 2785540 - protein, 18 aa, Entamoeba invadens
ADNDYTEFMILFEVISAY

SEQ ID NO: 2785541 - protein, 20 aa, Entamoeba invadens
ADNKLMRWCPSAEINTTVVK

SEQ ID NO: 2785542 - protein, 17 aa, Entamoeba invadens
ADPFPLFDCVWSSNGCC

SEQ ID NO: 2785543 - protein, 24 aa, Entamoeba invadens
ADPIPEWLQKCQIDDRLGKLEIPK

SEQ ID NO: 2785544 - protein, 19 aa, Entamoeba invadens
ADPLCFAHTTLFEEDDSFN

SEQ ID NO: 2785545 - protein, 28 aa, Entamoeba invadens
ADSCDYYSGGICRKCPGKKMTDGTFQSC

SEQ ID NO: 2785546 - protein, 23 aa, Entamoeba invadens
ADSDLTMSVGCFGVVTTNLNSVS

SEQ ID NO: 2785547 - protein, 21 aa, Entamoeba invadens
ADSIGLYWVVPVITFPIIIGL

SEQ ID NO: 2785548 - protein, 25 aa, Entamoeba invadens
ADSSLLFTCFSAFWVDSKLDVSFNF

SEQ ID NO: 2785549 - protein, 22 aa, Entamoeba invadens
ADVFCPCGGRPRALNEDNVDTY

SEQ ID NO: 2785550 - protein, 18 aa, Entamoeba invadens
ADVFSFAITMLECFLWSN

SEQ ID NO: 2785551 - protein, 17 aa, Entamoeba invadens
ADVFSFAITMYEVFGWN

SEQ ID NO: 2785552 - protein, 20 aa, Entamoeba invadens
ADVFSFAVVMYEIFVWGPPY

SEQ ID NO: 2785553 - protein, 28 aa, Entamoeba invadens
ADVFSFGVTMYEVFGWSEAYQNDTFKFP

SEQ ID NO: 2785554 - protein, 23 aa, Entamoeba invadens
ADVHMWQHFLVIVPPIFLMIFAL

SEQ ID NO: 2785555 - protein, 21 aa, Entamoeba invadens
ADVLKRHSRIFLKRKDAIDSV

SEQ ID NO: 2785556 - protein, 17 aa, Entamoeba invadens
ADYNGSVCIACQQNHHI

SEQ ID NO: 2785557 - protein, 26 aa, Entamoeba invadens
ADYYIPMFICEVICFVFLIVFQGSFT

SEQ ID NO: 2785558 - protein, 25 aa, Entamoeba invadens
AEADAEAYCEWSFVESNCKRCLITP

SEQ ID NO: 2785559 - protein, 24 aa, Entamoeba invadens
AEADAEAYCEWSFVESNCQKCVIT

SEQ ID NO: 2785560 - protein, 20 aa, Entamoeba invadens
AEAESCLFNGGTFNVHERTI

SEQ ID NO: 2785561 - protein, 21 aa, Entamoeba invadens
AEAKNALLFNVTKIATYRTLS

SEQ ID NO: 2785562 - protein, 19 aa, Entamoeba invadens
AEARMVVCETTLYKHTHTD

SEQ ID NO: 2785563 - protein, 23 aa, Entamoeba invadens
AEAVVCLFVILTFYFLYKRKIYL

SEQ ID NO: 2785564 - protein, 17 aa, Entamoeba invadens
AECKNCLTMNENWIKCD

SEQ ID NO: 2785565 - protein, 19 aa, Entamoeba invadens
AEDSKCARCSFWHKPSVNG

SEQ ID NO: 2785566 - protein, 20 aa, Entamoeba invadens
AEEFGWKYQGVVPITAKCRS

SEQ ID NO: 2785567 - protein, 20 aa, Entamoeba invadens
AEFGEKWAYPMSKKLEQEKL

SEQ ID NO: 2785568 - protein, 24 aa, Entamoeba invadens
AEFMVEPMCGAPIGKSDMSLDGII

SEQ ID NO: 2785569 - protein, 17 aa, Entamoeba invadens
AEFVCCKTLETINGTTV

SEQ ID NO: 2785570 - protein, 25 aa, Entamoeba invadens
AEFYPDFIHFLPLVMKRVVNILEER

SEQ ID NO: 2785571 - protein, 23 aa, Entamoeba invadens
AEGAMGVVFFGEYRSMPVAVKQF

SEQ ID NO: 2785572 - protein, 28 aa, Entamoeba invadens
AEGDAECSACIPGYVLLGNKTCQTTEDV

SEQ ID NO: 2785573 - protein, 18 aa, Entamoeba invadens
AEHLNYVFIRSFTEDSNS

SEQ ID NO: 2785574 - protein, 21 aa, Entamoeba invadens
AEHYSYLLGVANYVHVDGWTF

SEQ ID NO: 2785575 - protein, 22 aa, Entamoeba invadens
AEIRYYISAIKSCFEKFDENNG

SEQ ID NO: 2785576 - protein, 21 aa, Entamoeba invadens
AEKCQDCITGTVLINGKCVTL

SEQ ID NO: 2785577 - protein, 17 aa, Entamoeba invadens
AEKCVKCKNGYYPYTNG

SEQ ID NO: 2785578 - protein, 17 aa, Entamoeba invadens
AEKKFGKKVSVRNCLAW

SEQ ID NO: 2785579 - protein, 33 aa, Entamoeba invadens
AEKKRTVCGCICLTITMVVTFVALTVMVANIVD

SEQ ID NO: 2785580 - protein, 22 aa, Entamoeba invadens
AEKKTPWIAVRLSKYSDGYSLS

SEQ ID NO: 2785581 - protein, 24 aa, Entamoeba invadens
AEKTRCVVFQGFVICFVKVQKNTQ

SEQ ID NO: 2785582 - protein, 22 aa, Entamoeba invadens
AEKVLQKYKWFRPGSGLPSSFM

SEQ ID NO: 2785583 - protein, 18 aa, Entamoeba invadens
AEKWCFTENSAVLSYRNE

SEQ ID NO: 2785584 - protein, 26 aa, Entamoeba invadens
AELIPSQDFFPLFWQTLLPMLQVNDT

SEQ ID NO: 2785585 - protein, 22 aa, Entamoeba invadens
AELKKIDVGYYFTEDGVTFPMR

SEQ ID NO: 2785586 - protein, 27 aa, Entamoeba invadens
AELTQRAPVFFEFFNREISTFITDCVF

SEQ ID NO: 2785587 - protein, 18 aa, Entamoeba invadens
AEMAKRVGSLVASPYFKT

SEQ ID NO: 2785588 - protein, 25 aa, Entamoeba invadens
AEMCIKLPLHMNKLLSFLYISLPIA

SEQ ID NO: 2785589 - protein, 20 aa, Entamoeba invadens
AEMSEIYGQLALTMALIVGL

SEQ ID NO: 2785590 - protein, 22 aa, Entamoeba invadens
AENCITCNFGYYYDLMNKDCKY

SEQ ID NO: 2785591 - protein, 26 aa, Entamoeba invadens
AEPMRYTLKPGYAISVKFTIKMLCTA

SEQ ID NO: 2785592 - protein, 21 aa, Entamoeba invadens
AEPYKEFKSIFEIKDHVINGK

SEQ ID NO: 2785593 - protein, 21 aa, Entamoeba invadens
AEQEKEAAFAAAQEAQRKSQL

SEQ ID NO: 2785594 - protein, 23 aa, Entamoeba invadens
AERESLHSIVLCFDAYIQVKEVQ

SEQ ID NO: 2785595 - protein, 17 aa, Entamoeba invadens
AERKCKQCKAGYYPKTS

SEQ ID NO: 2785596 - protein, 17 aa, Entamoeba invadens
AERKCSVCKAGYYPKTS

SEQ ID NO: 2785597 - protein, 22 aa, Entamoeba invadens
AERMCMKTGTLLDSSLRSNDML

SEQ ID NO: 2785598 - protein, 26 aa, Entamoeba invadens
AESLKYIPMHVIRTLQIIEEEVAKKQ

SEQ ID NO: 2785599 - protein, 17 aa, Entamoeba invadens
AESPLFYIIGLLVCMLI

SEQ ID NO: 2785600 - protein, 21 aa, Entamoeba invadens
AETGILKVFFIFLLTLFIVPV

SEQ ID NO: 2785601 - protein, 17 aa, Entamoeba invadens
AETKIVFCVGNMSKGVL

SEQ ID NO: 2785602 - protein, 21 aa, Entamoeba invadens
AETPKKIIVIILCTTVVVITT

SEQ ID NO: 2785603 - protein, 21 aa, Entamoeba invadens
AETVSGFKKTISMTTNFQMYT

SEQ ID NO: 2785604 - protein, 24 aa, Entamoeba invadens
AEVCKLCPAGTFANLSSCVTCGDM

SEQ ID NO: 2785605 - protein, 27 aa, Entamoeba invadens
AEVGFCWVEKGHTKWFGGYHIGFVKNT

SEQ ID NO: 2785606 - protein, 17 aa, Entamoeba invadens
AEVGRNGCKKCEDGYFL

SEQ ID NO: 2785607 - protein, 23 aa, Entamoeba invadens
AEVICSTSAMGCSKCKQDKTTCL

SEQ ID NO: 2785608 - protein, 25 aa, Entamoeba invadens
AEVRRFCNKFGWYFSALQLFDTFIP

SEQ ID NO: 2785609 - protein, 20 aa, Entamoeba invadens
AEVVKAFGGGDVRKNTEYMK

SEQ ID NO: 2785610 - protein, 23 aa, Entamoeba invadens
AEVWVSTLITWVGSNEVIFPKQA

SEQ ID NO: 2785611 - protein, 21 aa, Entamoeba invadens
AEYIVLAGLCLVQSIRIIKNH

SEQ ID NO: 2785612 - protein, 17 aa, Entamoeba invadens
AEYNKLTLEECVMTVDA

SEQ ID NO: 2785613 - protein, 17 aa, Entamoeba invadens
AFCGPTCYCTEGTVMKR

SEQ ID NO: 2785614 - protein, 24 aa, Entamoeba invadens
AFCGVGLCYFVFPKVIKHWMFWYV

SEQ ID NO: 2785615 - protein, 19 aa, Entamoeba invadens
AFCKDFFSKISMFTTVLLS

SEQ ID NO: 2785616 - protein, 27 aa, Entamoeba invadens
AFCLLCDSSSCLKCKDAVLTMEGTCSS

SEQ ID NO: 2785617 - protein, 26 aa, Entamoeba invadens
AFCLNFSVYFFWLIIPIMMRDLGASP

SEQ ID NO: 2785618 - protein, 26 aa, Entamoeba invadens
AFCLNFSVYFFWLIVPIMMRNLGASP

SEQ ID NO: 2785619 - protein, 28 aa, Entamoeba invadens
AFDCHSCGDGFYMDGFMNCVAYSASDIN

SEQ ID NO: 2785620 - protein, 17 aa, Entamoeba invadens
AFFCVYVLMEVLIVFEA

SEQ ID NO: 2785621 - protein, 19 aa, Entamoeba invadens
AFFELSFEVKKRLYVEKHF

SEQ ID NO: 2785622 - protein, 18 aa, Entamoeba invadens
AFFLHKFGPKRAMQLMLI

SEQ ID NO: 2785623 - protein, 24 aa, Entamoeba invadens
AFFVCSYCFDSIIVSLVVVTKNIF

SEQ ID NO: 2785624 - protein, 17 aa, Entamoeba invadens
AFGALQLATNFAARADQ

SEQ ID NO: 2785625 - protein, 18 aa, Entamoeba invadens
AFGDVFIGLFQKVQVAVK

SEQ ID NO: 2785626 - protein, 27 aa, Entamoeba invadens
AFGKETFRYPWKIAEFVTSGKHLEKKE

SEQ ID NO: 2785627 - protein, 18 aa, Entamoeba invadens
AFGLIVVMISLIFLPYSK

SEQ ID NO: 2785628 - protein, 17 aa, Entamoeba invadens
AFGQVFRGNYRGMDVAI

SEQ ID NO: 2785629 - protein, 17 aa, Entamoeba invadens
AFGTVFKGKYRTVDVAV

SEQ ID NO: 2785630 - protein, 26 aa, Entamoeba invadens
AFIDHYYRYIPLLTFNSPSPLVKKAK

SEQ ID NO: 2785631 - protein, 29 aa, Entamoeba invadens
AFIPSGSGCAVCYYGYFKVNATCHKCSLN

SEQ ID NO: 2785632 - protein, 23 aa, Entamoeba invadens
AFKEADVALAMGLRGTDVAKQAA

SEQ ID NO: 2785633 - protein, 18 aa, Entamoeba invadens
AFLECANAAMAKINELKD

SEQ ID NO: 2785634 - protein, 21 aa, Entamoeba invadens
AFLERMIPRTGLGDETALPHA

SEQ ID NO: 2785635 - protein, 27 aa, Entamoeba invadens
AFLYNTSCYFYWIVVPLLFNEQGASAL

SEQ ID NO: 2785636 - protein, 18 aa, Entamoeba invadens
AFNGVAITAFEFAESMTK

SEQ ID NO: 2785637 - protein, 24 aa, Entamoeba invadens
AFNLPNFHTFCCGEDAKIISANLV

SEQ ID NO: 2785638 - protein, 20 aa, Entamoeba invadens
AFNYEDYNLLLILGAMSEED

SEQ ID NO: 2785639 - protein, 30 aa, Entamoeba invadens
AFPKEHFSYPWKIADFISAGSRPSQYGDIT

SEQ ID NO: 2785640 - protein, 26 aa, Entamoeba invadens
AFPKEKFKHAWDVANFITTDKRPDID

SEQ ID NO: 2785641 - protein, 17 aa, Entamoeba invadens
AFPKSTYIFPWTIADDV

SEQ ID NO: 2785642 - protein, 23 aa, Entamoeba invadens
AFPNCVSCSQTLRQCQTCSKGLY

SEQ ID NO: 2785643 - protein, 21 aa, Entamoeba invadens
AFQEIFFFYVFFTLFVFFLCV

SEQ ID NO: 2785644 - protein, 23 aa, Entamoeba invadens
AFQGEQCCFDFGSLGRVKEIGDF

SEQ ID NO: 2785645 - protein, 18 aa, Entamoeba invadens
AFRKLKFIVNDAQINVQN

SEQ ID NO: 2785646 - protein, 22 aa, Entamoeba invadens
AFRLKICLDAAKGILYLHTNGI

SEQ ID NO: 2785647 - protein, 22 aa, Entamoeba invadens
AFSFLSVFLVFFSFIPLYYRFF

SEQ ID NO: 2785648 - protein, 20 aa, Entamoeba invadens
AFSILFLCNLIFEFVIPTLF

SEQ ID NO: 2785649 - protein, 28 aa, Entamoeba invadens
AFSISFYVCIAISFSVSCYCIFSSTPDY

SEQ ID NO: 2785650 - protein, 20 aa, Entamoeba invadens
AFSRELNTIIDLFVDEKTPN

SEQ ID NO: 2785651 - protein, 24 aa, Entamoeba invadens
AFTCLYYLLHACAPTQKCLKAMKL

SEQ ID NO: 2785652 - protein, 24 aa, Entamoeba invadens
AFTKMSDCVLLIKQLEKVISKVGG

SEQ ID NO: 2785653 - protein, 19 aa, Entamoeba invadens
AFTLNNKCVECFNNYMIDD

SEQ ID NO: 2785654 - protein, 23 aa, Entamoeba invadens
AFTLPCIYVFMSLYRFNNIKMCH

SEQ ID NO: 2785655 - protein, 23 aa, Entamoeba invadens
AFVCALCHSGMIAVDYLSTYYDE

SEQ ID NO: 2785656 - protein, 24 aa, Entamoeba invadens
AFVECCIFPLMFLIIPLALVPAMT

SEQ ID NO: 2785657 - protein, 25 aa, Entamoeba invadens
AFVLCLCVTLMFWVLFFKSPSNVLR

SEQ ID NO: 2785658 - protein, 17 aa, Entamoeba invadens
AFVLFKVINEDFINNAG

SEQ ID NO: 2785659 - protein, 22 aa, Entamoeba invadens
AFVMGCDFGFSVTQQVILIGMG

SEQ ID NO: 2785660 - protein, 18 aa, Entamoeba invadens
AFVPLLVIMFIIGIIVLI

SEQ ID NO: 2785661 - protein, 25 aa, Entamoeba invadens
AFYMKPHIMYFLSFLIVAILFFAPL

SEQ ID NO: 2785662 - protein, 25 aa, Entamoeba invadens
AFYYYRYGFQFLWETYLYHATRTDH

SEQ ID NO: 2785663 - protein, 26 aa, Entamoeba invadens
AGAFACKKCRVSNCAKCDSKVDECQQ

SEQ ID NO: 2785664 - protein, 26 aa, Entamoeba invadens
AGAFACKKCRVSNCAKCDSKVEECQQ

SEQ ID NO: 2785665 - protein, 39 aa, Entamoeba invadens
AGAIYTGRRWDWPGTVIKYNYIYNITGWGQSGSYVQGIY

SEQ ID NO: 2785666 - protein, 20 aa, Entamoeba invadens
AGASKCSICSAGTYSSSFAS

SEQ ID NO: 2785667 - protein, 19 aa, Entamoeba invadens
AGCNYCNDQVCYQCGTDET

SEQ ID NO: 2785668 - protein, 26 aa, Entamoeba invadens
AGDAEFWLGIFSGMWTFGQALGYLCG

SEQ ID NO: 2785669 - protein, 21 aa, Entamoeba invadens
AGDLIPWTLTQQFLDDEFAGL

SEQ ID NO: 2785670 - protein, 20 aa, Entamoeba invadens
AGIITEGFQPLTCGSTYNRI

SEQ ID NO: 2785671 - protein, 18 aa, Entamoeba invadens
AGISKWVSPSYLYIVNFV

SEQ ID NO: 2785672 - protein, 25 aa, Entamoeba invadens
AGKCAICPMGTYYLRSVCQSCGEME

SEQ ID NO: 2785673 - protein, 19 aa, Entamoeba invadens
AGKCLSCNSSNFMTNENKC

SEQ ID NO: 2785674 - protein, 27 aa, Entamoeba invadens
AGKCQKCSVSGCKRCSDGETCDMCNGI

SEQ ID NO: 2785675 - protein, 23 aa, Entamoeba invadens
AGKDFLSCDNLMLFTKKSTNCEM

SEQ ID NO: 2785676 - protein, 17 aa, Entamoeba invadens
AGKMCKRCTDGCKVCSN

SEQ ID NO: 2785677 - protein, 19 aa, Entamoeba invadens
AGKSVRPFIALETTQNVLN

SEQ ID NO: 2785678 - protein, 24 aa, Entamoeba invadens
AGLCLLSQIFQPWMQTIIRYIIIT

SEQ ID NO: 2785679 - protein, 24 aa, Entamoeba invadens
AGLDDGKLAWCFFDSNSGEIEETN

SEQ ID NO: 2785680 - protein, 25 aa, Entamoeba invadens
AGLFAFVAGCIFFRNHESPKFEWTM

SEQ ID NO: 2785681 - protein, 26 aa, Entamoeba invadens
AGLFGLKLNLCVNFTFDGASTMISNE

SEQ ID NO: 2785682 - protein, 21 aa, Entamoeba invadens
AGLFLCNGLALYFDKKYLFAN

SEQ ID NO: 2785683 - protein, 22 aa, Entamoeba invadens
AGLIKVDFVLDFPVEPTSSESS

SEQ ID NO: 2785684 - protein, 19 aa, Entamoeba invadens
AGLILSLGLLLVFYVLTSF

SEQ ID NO: 2785685 - protein, 25 aa, Entamoeba invadens
AGLLSTYITLEWCMYTSFIYCILGL

SEQ ID NO: 2785686 - protein, 19 aa, Entamoeba invadens
AGLSIKYALLPAAFISVIY

SEQ ID NO: 2785687 - protein, 19 aa, Entamoeba invadens
AGNCIRTRFCKELFGGICA

SEQ ID NO: 2785688 - protein, 17 aa, Entamoeba invadens
AGNDCLSCTEFNMNMTT

SEQ ID NO: 2785689 - protein, 18 aa, Entamoeba invadens
AGNGFSFGEIHCYYGYFK

SEQ ID NO: 2785690 - protein, 18 aa, Entamoeba invadens
AGPCALADEVIENTTKAV

SEQ ID NO: 2785691 - protein, 21 aa, Entamoeba invadens
AGRDPLRFCQCMSGYYQENSS

SEQ ID NO: 2785692 - protein, 19 aa, Entamoeba invadens
AGRWYKIRTNGVGDILEID

SEQ ID NO: 2785693 - protein, 29 aa, Entamoeba invadens
AGSCIKKQFCKQIYGGICVELNGFFHYQK

SEQ ID NO: 2785694 - protein, 25 aa, Entamoeba invadens
AGSGYPANMLIPFDNPIMGKFVVDT

SEQ ID NO: 2785695 - protein, 18 aa, Entamoeba invadens
AGSLKLGGTLTIDEKSSI

SEQ ID NO: 2785696 - protein, 24 aa, Entamoeba invadens
AGSSTCYDCKVGSYSQEGFSVCRN

SEQ ID NO: 2785697 - protein, 22 aa, Entamoeba invadens
AGSSYPAYMVIPLDNPIMGNMC

SEQ ID NO: 2785698 - protein, 27 aa, Entamoeba invadens
AGTFGIVYRAKWRKVEIAVKVLKTDMV

SEQ ID NO: 2785699 - protein, 20 aa, Entamoeba invadens
AGTVLQNGKCLTIFELEGIC

SEQ ID NO: 2785700 - protein, 18 aa, Entamoeba invadens
AGVFTGSNGLFWSVPVMC

SEQ ID NO: 2785701 - protein, 19 aa, Entamoeba invadens
AGVLIYIFACLLLMFINDN

SEQ ID NO: 2785702 - protein, 17 aa, Entamoeba invadens
AGVPLKYREEAMKQIGE

SEQ ID NO: 2785703 - protein, 20 aa, Entamoeba invadens
AGWSRLIFTFFMPAIVFYQT

SEQ ID NO: 2785704 - protein, 31 aa, Entamoeba invadens
AGYYLSAGYCVKCIKGFYSIGGTVGECTRCD

SEQ ID NO: 2785705 - protein, 20 aa, Entamoeba invadens
AHAKCQICLEDKCRKCDEKL

SEQ ID NO: 2785706 - protein, 26 aa, Entamoeba invadens
AHCRLCKNEKCLICDNNFILNNESVC

SEQ ID NO: 2785707 - protein, 18 aa, Entamoeba invadens
AHCTDCYAPYLLETNQGT

SEQ ID NO: 2785708 - protein, 27 aa, Entamoeba invadens
AHENCKVCAVDKCYQCNENMYLEQDIS

SEQ ID NO: 2785709 - protein, 24 aa, Entamoeba invadens
AHESEGLPIETIRTQFKQLVDSSK

SEQ ID NO: 2785710 - protein, 17 aa, Entamoeba invadens
AHFEFNSIFFLRPNSKV

SEQ ID NO: 2785711 - protein, 18 aa, Entamoeba invadens
AHFLRFAPTALFILYFQM

SEQ ID NO: 2785712 - protein, 19 aa, Entamoeba invadens
AHGGYVCGDDGRWSEVCVP

SEQ ID NO: 2785713 - protein, 23 aa, Entamoeba invadens
AHIRMEFKTGKKLKGHGRRKYIL

SEQ ID NO: 2785714 - protein, 20 aa, Entamoeba invadens
AHKRRGQTLIGIGKLPEALA

SEQ ID NO: 2785715 - protein, 24 aa, Entamoeba invadens
AHLTRLHNELPYYLRDDLDEILQV

SEQ ID NO: 2785716 - protein, 25 aa, Entamoeba invadens
AHMILEFFGSLLLGTLLRIPKLDNR

SEQ ID NO: 2785717 - protein, 17 aa, Entamoeba invadens
AHRASLKFMKYTGCTSV

SEQ ID NO: 2785718 - protein, 18 aa, Entamoeba invadens
AHVVLRALAGQTYYVVVS

SEQ ID NO: 2785719 - protein, 18 aa, Entamoeba invadens
AHYNQLFIAHAILQIEHP

SEQ ID NO: 2785720 - protein, 19 aa, Entamoeba invadens
AIAHPGAKTLVLVYVRDYA

SEQ ID NO: 2785721 - protein, 19 aa, Entamoeba invadens
AIAIGFLFVRKREMKKKAE

SEQ ID NO: 2785722 - protein, 18 aa, Entamoeba invadens
AIANAFVMGCDFGFSVTQ

SEQ ID NO: 2785723 - protein, 19 aa, Entamoeba invadens
AIATLSGWMAVIMLLIQTK

SEQ ID NO: 2785724 - protein, 21 aa, Entamoeba invadens
AICPKNCNFENGFGACSTIAG

SEQ ID NO: 2785725 - protein, 24 aa, Entamoeba invadens
AIDIPRLVSKLVISNADGVVADGP

SEQ ID NO: 2785726 - protein, 18 aa, Entamoeba invadens
AIDRFKKKYPESVLKHMS

SEQ ID NO: 2785727 - protein, 22 aa, Entamoeba invadens
AIFASFCLISLFRSILTQEKPH

SEQ ID NO: 2785728 - protein, 25 aa, Entamoeba invadens
AIFFVSDVLVCFAVMIYENKLISMT

SEQ ID NO: 2785729 - protein, 18 aa, Entamoeba invadens
AIFGESLLLEYAVDQFLI

SEQ ID NO: 2785730 - protein, 25 aa, Entamoeba invadens
AIFIPCLVIHIIKFYRDEQRSLATD

SEQ ID NO: 2785731 - protein, 18 aa, Entamoeba invadens
AIFIRRWSYNIFHKIHVI

SEQ ID NO: 2785732 - protein, 19 aa, Entamoeba invadens
AIFKMEHGFKINSLGDVIS

SEQ ID NO: 2785733 - protein, 21 aa, Entamoeba invadens
AIFMPFTLSFFLVFYSVISAA

SEQ ID NO: 2785734 - protein, 18 aa, Entamoeba invadens
AIFTIEFSGNYSVRLSTK

SEQ ID NO: 2785735 - protein, 24 aa, Entamoeba invadens
AIFYKSKEFFKILFNLVSLLQEAN

SEQ ID NO: 2785736 - protein, 17 aa, Entamoeba invadens
AIGCTLCAESYKLENEL

SEQ ID NO: 2785737 - protein, 26 aa, Entamoeba invadens
AIGGCICNPGFIKRDEMCTSCGNGVL

SEQ ID NO: 2785738 - protein, 18 aa, Entamoeba invadens
AIGLPVVFVIIIVIITAL

SEQ ID NO: 2785739 - protein, 22 aa, Entamoeba invadens
AIHGNFPYIFFYLLIIGILHGV

SEQ ID NO: 2785740 - protein, 19 aa, Entamoeba invadens
AIIGFPFFLFCVILGGAME

SEQ ID NO: 2785741 - protein, 23 aa, Entamoeba invadens
AIIGGVWIIFGWISRFLNRKTEE

SEQ ID NO: 2785742 - protein, 18 aa, Entamoeba invadens
AIIGVVVFFIVKKGPKTS

SEQ ID NO: 2785743 - protein, 18 aa, Entamoeba invadens
AIIHEFDPYFNFRATKYL

SEQ ID NO: 2785744 - protein, 24 aa, Entamoeba invadens
AIILTLLFLFSFGFVGYQMNKNER

SEQ ID NO: 2785745 - protein, 17 aa, Entamoeba invadens
AIIQSCWDQNPKERLQI

SEQ ID NO: 2785746 - protein, 20 aa, Entamoeba invadens
AIISLPDLSIFSALYSLVNV

SEQ ID NO: 2785747 - protein, 18 aa, Entamoeba invadens
AIITIFLLIISFFKVIAS

SEQ ID NO: 2785748 - protein, 18 aa, Entamoeba invadens
AIIVAVVMYFMKKKKKSE

SEQ ID NO: 2785749 - protein, 18 aa, Entamoeba invadens
AIKKCSKKKLFEDNLVGF

SEQ ID NO: 2785750 - protein, 23 aa, Entamoeba invadens
AIKTTCKRSRWTQYDKELEACWN

SEQ ID NO: 2785751 - protein, 22 aa, Entamoeba invadens
AIKVRVPLSLLKKGIYLVQSYP

SEQ ID NO: 2785752 - protein, 17 aa, Entamoeba invadens
AILAPIIYKAIKNKNDT

SEQ ID NO: 2785753 - protein, 19 aa, Entamoeba invadens
AILKKGEACEFHIEVFPLT

SEQ ID NO: 2785754 - protein, 18 aa, Entamoeba invadens
AILLSLKTLFLIIETYIF

SEQ ID NO: 2785755 - protein, 29 aa, Entamoeba invadens
AILLTGKFRFGYVFGFTFVGSFAEYFVLS

SEQ ID NO: 2785756 - protein, 22 aa, Entamoeba invadens
AIMLKKKMCYNFKEVSDIKEMF

SEQ ID NO: 2785757 - protein, 25 aa, Entamoeba invadens
AIMTMMCVILPFTYEDQYVIWGFFI

SEQ ID NO: 2785758 - protein, 24 aa, Entamoeba invadens
AINKFDPICNVIWDKTILNDVGDT

SEQ ID NO: 2785759 - protein, 26 aa, Entamoeba invadens
AINYSDMVGFNWKHLTAVVDYLITAV

SEQ ID NO: 2785760 - protein, 22 aa, Entamoeba invadens
AIPELSCDLTASFSGKVTEDTK

SEQ ID NO: 2785761 - protein, 25 aa, Entamoeba invadens
AIPELSCDLTSEFSGKVSSETKWKR

SEQ ID NO: 2785762 - protein, 27 aa, Entamoeba invadens
AIPILHLVSLFALWFLPLQRKFQSWLY

SEQ ID NO: 2785763 - protein, 19 aa, Entamoeba invadens
AIRYREIGIGLLMGVICSF

SEQ ID NO: 2785764 - protein, 27 aa, Entamoeba invadens
AISFNYGIISGFGKFTIEAYQFTNGGY

SEQ ID NO: 2785765 - protein, 26 aa, Entamoeba invadens
AISIASYYQREWPLLVICPSSVRHNW

SEQ ID NO: 2785766 - protein, 18 aa, Entamoeba invadens
AISLPFLVIPVVIWINKF

SEQ ID NO: 2785767 - protein, 22 aa, Entamoeba invadens
AISRLKNSVIISGVDKETKKDV

SEQ ID NO: 2785768 - protein, 19 aa, Entamoeba invadens
AITAWELFYQVEPYDQLKS

SEQ ID NO: 2785769 - protein, 18 aa, Entamoeba invadens
AITFYRWSIENNILKNKK

SEQ ID NO: 2785770 - protein, 22 aa, Entamoeba invadens
AITMFECFSWSYAYSKDKFKFP

SEQ ID NO: 2785771 - protein, 25 aa, Entamoeba invadens
AITMYECFGWADAYSKDAFKFPWKI

SEQ ID NO: 2785772 - protein, 24 aa, Entamoeba invadens
AITMYECFIWGVAYPKNEFKYSWN

SEQ ID NO: 2785773 - protein, 37 aa, Entamoeba invadens
AITMYECFTWSDAFPKDVYKYAWDIADSVCYGKRPDL

SEQ ID NO: 2785774 - protein, 37 aa, Entamoeba invadens
AITMYECFTWSDAFPKDVYKYAWDIADSVCYGKRPNT

SEQ ID NO: 2785775 - protein, 40 aa, Entamoeba invadens
AITMYECLRWKEAYDKQTFKFPWKIAEFVISGKRLDKLEC

SEQ ID NO: 2785776 - protein, 23 aa, Entamoeba invadens
AITMYEVFSWKEAYNKTEFKFPW

SEQ ID NO: 2785777 - protein, 17 aa, Entamoeba invadens
AIVAIWPTNKAAIYISC

SEQ ID NO: 2785778 - protein, 22 aa, Entamoeba invadens
AIVFCSTFGAIVFITIIVVSIY

SEQ ID NO: 2785779 - protein, 24 aa, Entamoeba invadens
AIVGCSVCKTGTPITCTTCKPGYF

SEQ ID NO: 2785780 - protein, 18 aa, Entamoeba invadens
AIVLCLLTALLYYFDITK

SEQ ID NO: 2785781 - protein, 19 aa, Entamoeba invadens
AIVLPIIFTIILIVVIIIA

SEQ ID NO: 2785782 - protein, 18 aa, Entamoeba invadens
AIVLSLFSVYFAVTGRFP

SEQ ID NO: 2785783 - protein, 19 aa, Entamoeba invadens
AIYISMGIVCAFVILVIVS

SEQ ID NO: 2785784 - protein, 23 aa, Entamoeba invadens
AIYKCYQCNFTALGDNKRLECLL

SEQ ID NO: 2785785 - protein, 20 aa, Entamoeba invadens
AIYLRSYVSPAFSFGTEAVK

SEQ ID NO: 2785786 - protein, 21 aa, Entamoeba invadens
AIYSCYQCNFTALGDNKRLEC

SEQ ID NO: 2785787 - protein, 22 aa, Entamoeba invadens
AKCDSYRCFQCADTYTMMNTNN

SEQ ID NO: 2785788 - protein, 18 aa, Entamoeba invadens
AKCFSFCTGLGTVSNTKD

SEQ ID NO: 2785789 - protein, 32 aa, Entamoeba invadens
AKCKDYASSGNWCYECSDGYYHHGVDCHPCNQ

SEQ ID NO: 2785790 - protein, 19 aa, Entamoeba invadens
AKCSDGYYLSGTECLPCDK

SEQ ID NO: 2785791 - protein, 19 aa, Entamoeba invadens
AKCVECPNKMLLNGETCVL

SEQ ID NO: 2785792 - protein, 22 aa, Entamoeba invadens
AKCVLCDKSVNCTKCEFNKCVE

SEQ ID NO: 2785793 - protein, 18 aa, Entamoeba invadens
AKDDVGVICIHDDQIKCI

SEQ ID NO: 2785794 - protein, 21 aa, Entamoeba invadens
AKDNFPILVCGDFSVNALEST

SEQ ID NO: 2785795 - protein, 23 aa, Entamoeba invadens
AKDNLGFRMPVKYNDSIGGRDES

SEQ ID NO: 2785796 - protein, 26 aa, Entamoeba invadens
AKDNLGFRMTIKYNDSIGGRDESFTI

SEQ ID NO: 2785797 - protein, 18 aa, Entamoeba invadens
AKEKFVFYFTLYFATVMY

SEQ ID NO: 2785798 - protein, 17 aa, Entamoeba invadens
AKELFELGEGVVVVGTI

SEQ ID NO: 2785799 - protein, 18 aa, Entamoeba invadens
AKEMKRRQTLFLAEMQGF

SEQ ID NO: 2785800 - protein, 19 aa, Entamoeba invadens
AKERSRCDGGVFAEFTQSK

SEQ ID NO: 2785801 - protein, 19 aa, Entamoeba invadens
AKESVKDFILRLVSKLGEY

SEQ ID NO: 2785802 - protein, 23 aa, Entamoeba invadens
AKEVIKLLLTKSVILSVNSLNEF

SEQ ID NO: 2785803 - protein, 18 aa, Entamoeba invadens
AKFFPRSALSTLFEKFGD

SEQ ID NO: 2785804 - protein, 25 aa, Entamoeba invadens
AKFIEISVAFSLFFGALFAGLCPPA

SEQ ID NO: 2785805 - protein, 22 aa, Entamoeba invadens
AKFIHSITCFTGMFLLIVSLIP

SEQ ID NO: 2785806 - protein, 30 aa, Entamoeba invadens
AKFIPVCIAGILALIAYHIYILAISYYKKQ

SEQ ID NO: 2785807 - protein, 19 aa, Entamoeba invadens
AKFLQEFMTRLVAFDLLKE

SEQ ID NO: 2785808 - protein, 21 aa, Entamoeba invadens
AKFSLRIESDISLKLDYNELK

SEQ ID NO: 2785809 - protein, 27 aa, Entamoeba invadens
AKFTNWYLRLLVPQWRLFLFSAASGLM

SEQ ID NO: 2785810 - protein, 26 aa, Entamoeba invadens
AKFTYAKEMFGMFMMSYAPLTKEYLE

SEQ ID NO: 2785811 - protein, 25 aa, Entamoeba invadens
AKGASLRYAMQLISLAMIKAKKRGE

SEQ ID NO: 2785812 - protein, 19 aa, Entamoeba invadens
AKGDLPILQRIVTEYHTPW

SEQ ID NO: 2785813 - protein, 22 aa, Entamoeba invadens
AKGNKCDKCSFWYKPSPDGLYC

SEQ ID NO: 2785814 - protein, 20 aa, Entamoeba invadens
AKGRTTLVIAHRLSTIQNAD

SEQ ID NO: 2785815 - protein, 17 aa, Entamoeba invadens
AKGVVILIHGFRHYSGC

SEQ ID NO: 2785816 - protein, 25 aa, Entamoeba invadens
AKHIRQMRCESRKWTIIGIAVGIVI

SEQ ID NO: 2785817 - protein, 17 aa, Entamoeba invadens
AKHLICSVVQKGKPWKF

SEQ ID NO: 2785818 - protein, 21 aa, Entamoeba invadens
AKHNKCLKCTSGNTFDNCKAC

SEQ ID NO: 2785819 - protein, 33 aa, Entamoeba invadens
AKHQTLSWGVRLQISMSIARGMELFTTRKQPLV

SEQ ID NO: 2785820 - protein, 21 aa, Entamoeba invadens
AKHVSRFSTFFFTSSIVGCTR

SEQ ID NO: 2785821 - protein, 24 aa, Entamoeba invadens
AKIFAGRPRPHFYARLEENSDQID

SEQ ID NO: 2785822 - protein, 21 aa, Entamoeba invadens
AKIGDYFSFYFSKGGEIARAL

SEQ ID NO: 2785823 - protein, 17 aa, Entamoeba invadens
AKILIIFEKHDEDAKQL

SEQ ID NO: 2785824 - protein, 32 aa, Entamoeba invadens
AKIWDGVVRPECFKRAPITKFFDLEFTSLPHF

SEQ ID NO: 2785825 - protein, 20 aa, Entamoeba invadens
AKKAVWWVILVGIFLIILVL

SEQ ID NO: 2785826 - protein, 26 aa, Entamoeba invadens
AKKCSKKFFGCYSCEYLPDDGTFNRQ

SEQ ID NO: 2785827 - protein, 18 aa, Entamoeba invadens
AKKDPNCQICEEEIFEGD

SEQ ID NO: 2785828 - protein, 25 aa, Entamoeba invadens
AKKIIKSLVCVILIINTSLLTFVPL

SEQ ID NO: 2785829 - protein, 25 aa, Entamoeba invadens
AKKQEYAAAFGFDYCAKEENQGKEL

SEQ ID NO: 2785830 - protein, 18 aa, Entamoeba invadens
AKKSPALDVTKYFQSKID

SEQ ID NO: 2785831 - protein, 29 aa, Entamoeba invadens
AKKTKSGCLRPEWDVSFGSWEETINEVIG

SEQ ID NO: 2785832 - protein, 29 aa, Entamoeba invadens
AKKTVGGCSLCLSGYYLKDGKCHPLSESN

SEQ ID NO: 2785833 - protein, 21 aa, Entamoeba invadens
AKLCLWAIGIITEIKGMIQTI

SEQ ID NO: 2785834 - protein, 20 aa, Entamoeba invadens
AKLFRLEHKTTRVFVYTISF

SEQ ID NO: 2785835 - protein, 26 aa, Entamoeba invadens
AKLFTLGFECLRVLSPTVNIGKVRTL

SEQ ID NO: 2785836 - protein, 20 aa, Entamoeba invadens
AKLGEKAYKAFEEVFTQLPL

SEQ ID NO: 2785837 - protein, 17 aa, Entamoeba invadens
AKLGLMYNNSWPVQGKY

SEQ ID NO: 2785838 - protein, 18 aa, Entamoeba invadens
AKLKRENEEMVKKMEEEK

SEQ ID NO: 2785839 - protein, 23 aa, Entamoeba invadens
AKLLSRYDVITCMTKYTLRQGEC

SEQ ID NO: 2785840 - protein, 17 aa, Entamoeba invadens
AKLRNPFIASYMGSVTY

SEQ ID NO: 2785841 - protein, 19 aa, Entamoeba invadens
AKLSYFAKEILNFHGKNLI

SEQ ID NO: 2785842 - protein, 17 aa, Entamoeba invadens
AKLTTLLSLGDHFHETS

SEQ ID NO: 2785843 - protein, 17 aa, Entamoeba invadens
AKLTTLLSLGDHFHETT

SEQ ID NO: 2785844 - protein, 18 aa, Entamoeba invadens
AKLVLPMYTPDGEFDRHG

SEQ ID NO: 2785845 - protein, 19 aa, Entamoeba invadens
AKMEFKGNGGRTLRGLSHT

SEQ ID NO: 2785846 - protein, 19 aa, Entamoeba invadens
AKMKVLFSLLMYNSSSINL

SEQ ID NO: 2785847 - protein, 27 aa, Entamoeba invadens
AKMSGDFPNVISIPSFYQPKQIETLSL

SEQ ID NO: 2785848 - protein, 25 aa, Entamoeba invadens
AKNFCLTCPGGMFVSNGVCKQNGNL

SEQ ID NO: 2785849 - protein, 19 aa, Entamoeba invadens
AKNGVIIGIVVSVIVCVII

SEQ ID NO: 2785850 - protein, 24 aa, Entamoeba invadens
AKNNLKWIPFVSVMQFLSHFQSIT

SEQ ID NO: 2785851 - protein, 18 aa, Entamoeba invadens
AKNVWKFSGNATTVYMRV

SEQ ID NO: 2785852 - protein, 27 aa, Entamoeba invadens
AKNYFMLKMGVCLFGEQSKCRGILGGI

SEQ ID NO: 2785853 - protein, 20 aa, Entamoeba invadens
AKPFESYGFFLIYIFGLLYT

SEQ ID NO: 2785854 - protein, 18 aa, Entamoeba invadens
AKQFPRCLGITDKVAVTK

SEQ ID NO: 2785855 - protein, 24 aa, Entamoeba invadens
AKQMPWKTIVVVVAVSAVYTTFQY

SEQ ID NO: 2785856 - protein, 17 aa, Entamoeba invadens
AKQWRMRIEIISELLRL

SEQ ID NO: 2785857 - protein, 19 aa, Entamoeba invadens
AKRVYFRLLLSTNLLDETL

SEQ ID NO: 2785858 - protein, 20 aa, Entamoeba invadens
AKRWIPMRYDCFKSKQDPEL

SEQ ID NO: 2785859 - protein, 21 aa, Entamoeba invadens
AKSDMKVEFLILEILLISMDY

SEQ ID NO: 2785860 - protein, 20 aa, Entamoeba invadens
AKSIWCSDCQPGTYSSVDGA

SEQ ID NO: 2785861 - protein, 19 aa, Entamoeba invadens
AKSSLNFSALMKGVQSFGI

SEQ ID NO: 2785862 - protein, 25 aa, Entamoeba invadens
AKSTFKYPWEIADFVGKGNHLTYNE

SEQ ID NO: 2785863 - protein, 17 aa, Entamoeba invadens
AKTACPNKDKKIAGVYN

SEQ ID NO: 2785864 - protein, 21 aa, Entamoeba invadens
AKTLWMVALRIAFVKFNVWSA

SEQ ID NO: 2785865 - protein, 18 aa, Entamoeba invadens
AKTRLLIEDVVLRIKDLI

SEQ ID NO: 2785866 - protein, 21 aa, Entamoeba invadens
AKTVWRLLAEYQYIDETLTTE

SEQ ID NO: 2785867 - protein, 20 aa, Entamoeba invadens
AKVLFRLYGLCIMFIALWIL

SEQ ID NO: 2785868 - protein, 18 aa, Entamoeba invadens
AKVLTTFSKKVIIKNYDE

SEQ ID NO: 2785869 - protein, 19 aa, Entamoeba invadens
AKWEVPPLMNDEFRYYLLQ

SEQ ID NO: 2785870 - protein, 20 aa, Entamoeba invadens
AKYALLYIIVMRLQRKTNVL

SEQ ID NO: 2785871 - protein, 18 aa, Entamoeba invadens
AKYNIFTFIPKFLFFQYK

SEQ ID NO: 2785872 - protein, 17 aa, Entamoeba invadens
ALAIILAIVLSFLVPII

SEQ ID NO: 2785873 - protein, 20 aa, Entamoeba invadens
ALCNEARPKIEGDKMMYQSQ

SEQ ID NO: 2785874 - protein, 24 aa, Entamoeba invadens
ALCVFVCGWYYYKNTDVFARVKDD

SEQ ID NO: 2785875 - protein, 23 aa, Entamoeba invadens
ALDCSQCTFSSLEIKCDNLTTLV

SEQ ID NO: 2785876 - protein, 17 aa, Entamoeba invadens
ALDKCYYVNDSSSFMYT

SEQ ID NO: 2785877 - protein, 18 aa, Entamoeba invadens
ALDMLPLLHSKRIKYDFK

SEQ ID NO: 2785878 - protein, 19 aa, Entamoeba invadens
ALEAIQCIRTYTTITSYTE

SEQ ID NO: 2785879 - protein, 23 aa, Entamoeba invadens
ALECSYCKAGYAFDSEKNMKCIE

SEQ ID NO: 2785880 - protein, 21 aa, Entamoeba invadens
ALEELSEFFLVYLPVLTEYLE

SEQ ID NO: 2785881 - protein, 41 aa, Entamoeba invadens
ALEISFPFEAEGYFAYPVCFQTRMYKCILFTLEYDGNYSLL

SEQ ID NO: 2785882 - protein, 17 aa, Entamoeba invadens
ALENGNCKFVYNLCDNA

SEQ ID NO: 2785883 - protein, 25 aa, Entamoeba invadens
ALERPELKKSVIIVTVILFLCAGTT

SEQ ID NO: 2785884 - protein, 20 aa, Entamoeba invadens
ALESWQYCGQAKVALNVNDL

SEQ ID NO: 2785885 - protein, 25 aa, Entamoeba invadens
ALEVTLPFTALHSFANTKSYQTCLS

SEQ ID NO: 2785886 - protein, 17 aa, Entamoeba invadens
ALFGVKFIYRMTLLLTA

SEQ ID NO: 2785887 - protein, 19 aa, Entamoeba invadens
ALFILKLVFLFLVFFSVPL

SEQ ID NO: 2785888 - protein, 25 aa, Entamoeba invadens
ALFKEVLNIPAGYSVLFLGGGASLQ

SEQ ID NO: 2785889 - protein, 26 aa, Entamoeba invadens
ALFLCEMSIVFLCLGSSKKLHEKMMH

SEQ ID NO: 2785890 - protein, 21 aa, Entamoeba invadens
ALFLCFILILCLSKIQRKLRT

SEQ ID NO: 2785891 - protein, 30 aa, Entamoeba invadens
ALFRMEWKQLLLCILAMFISQLSTLIMPVL

SEQ ID NO: 2785892 - protein, 20 aa, Entamoeba invadens
ALFVVLIILKLVSNIRKVDI

SEQ ID NO: 2785893 - protein, 19 aa, Entamoeba invadens
ALGKWSMLDSYVMVLMIVA

SEQ ID NO: 2785894 - protein, 17 aa, Entamoeba invadens
ALGMKYSCSIDMWSVGC

SEQ ID NO: 2785895 - protein, 27 aa, Entamoeba invadens
ALHKSICDVCGVDGSFRMRVSNTLRVV

SEQ ID NO: 2785896 - protein, 21 aa, Entamoeba invadens
ALICIICPDGQYAQELASSTC

SEQ ID NO: 2785897 - protein, 18 aa, Entamoeba invadens
ALIGPEFVILPLLFVDTG

SEQ ID NO: 2785898 - protein, 24 aa, Entamoeba invadens
ALIRDCKEFIKVGSSVIDIKKYRT

SEQ ID NO: 2785899 - protein, 18 aa, Entamoeba invadens
ALKDCVKLTKLHLGNVIT

SEQ ID NO: 2785900 - protein, 29 aa, Entamoeba invadens
ALKQAYRLKLLWCEFEPCAVLYDGMQIPS

SEQ ID NO: 2785901 - protein, 23 aa, Entamoeba invadens
ALKSCVLCSDLYYLCETCDDTKC

SEQ ID NO: 2785902 - protein, 23 aa, Entamoeba invadens
ALKTSISKFGFPRLLINTAGIAH

SEQ ID NO: 2785903 - protein, 19 aa, Entamoeba invadens
ALLEPKNIWSIVFFVLVIV

SEQ ID NO: 2785904 - protein, 24 aa, Entamoeba invadens
ALLGELKTAMLFSEDDVEALKSIK

SEQ ID NO: 2785905 - protein, 19 aa, Entamoeba invadens
ALLGFVLRQHTEYIKRAEN

SEQ ID NO: 2785906 - protein, 17 aa, Entamoeba invadens
ALLILDYMLRYHNDFSV

SEQ ID NO: 2785907 - protein, 17 aa, Entamoeba invadens
ALLKGIVPSAHFGLFVG

SEQ ID NO: 2785908 - protein, 24 aa, Entamoeba invadens
ALLQFSKELGLFLTCSAEDINKKD

SEQ ID NO: 2785909 - protein, 21 aa, Entamoeba invadens
ALLQPVRCEFPAWQNSTEAID

SEQ ID NO: 2785910 - protein, 20 aa, Entamoeba invadens
ALLSKIFPERLIKEKLPRKS

SEQ ID NO: 2785911 - protein, 20 aa, Entamoeba invadens
ALLTGFPWAFFLHKFGPKRA

SEQ ID NO: 2785912 - protein, 18 aa, Entamoeba invadens
ALLVCSIFLFTLLTMIFV

SEQ ID NO: 2785913 - protein, 46 aa, Entamoeba invadens
ALMFPTCAGIYRYLPKTWKFTTLWNGRLAILTIRIIILLLTTLFAS

SEQ ID NO: 2785914 - protein, 25 aa, Entamoeba invadens
ALMMSCICAMSIDYSLFLLTRFTEE

SEQ ID NO: 2785915 - protein, 18 aa, Entamoeba invadens
ALMRPLCTHQSFPNLGQI

SEQ ID NO: 2785916 - protein, 25 aa, Entamoeba invadens
ALMSSCICAMSIDYSLFLLTRFTEE

SEQ ID NO: 2785917 - protein, 19 aa, Entamoeba invadens
ALMSVFKFWDFKGMGCPHG

SEQ ID NO: 2785918 - protein, 27 aa, Entamoeba invadens
ALNGKLRFGDVYGFSILAVFVEYLFLN

SEQ ID NO: 2785919 - protein, 24 aa, Entamoeba invadens
ALNVFPISFLMNFRKKAAKITWRH

SEQ ID NO: 2785920 - protein, 20 aa, Entamoeba invadens
ALNVGVEFWLMNKPELLKNF

SEQ ID NO: 2785921 - protein, 17 aa, Entamoeba invadens
ALPFCLSSMTLIRYVDK

SEQ ID NO: 2785922 - protein, 19 aa, Entamoeba invadens
ALPKELKKLIINKGSFLKE

SEQ ID NO: 2785923 - protein, 25 aa, Entamoeba invadens
ALPNLRRLEIKAGRVALNENLPIRQ

SEQ ID NO: 2785924 - protein, 18 aa, Entamoeba invadens
ALQSEKTGKCNSQSNEEQ

SEQ ID NO: 2785925 - protein, 17 aa, Entamoeba invadens
ALRQCYIEDLFYGSCIK

SEQ ID NO: 2785926 - protein, 47 aa, Entamoeba invadens
ALRRSELLSIFGTLCGRSSVVTLMLELSPFLAFALFLSFIITKKTLD

SEQ ID NO: 2785927 - protein, 18 aa, Entamoeba invadens
ALSCELCGVGYSQSQRGQ

SEQ ID NO: 2785928 - protein, 25 aa, Entamoeba invadens
ALSECDLRLAFGIISCFLAMVFMFV

SEQ ID NO: 2785929 - protein, 17 aa, Entamoeba invadens
ALSRHSEREILFRIENM

SEQ ID NO: 2785930 - protein, 17 aa, Entamoeba invadens
ALSRVWMHIINMSMCVI

SEQ ID NO: 2785931 - protein, 18 aa, Entamoeba invadens
ALSVSKFSVYVFDVGMAD

SEQ ID NO: 2785932 - protein, 18 aa, Entamoeba invadens
ALTALRVLMSDEYGFNTI

SEQ ID NO: 2785933 - protein, 27 aa, Entamoeba invadens
ALTDLLKIRFCQDIARGMEYLHQNDIL

SEQ ID NO: 2785934 - protein, 25 aa, Entamoeba invadens
ALTFRKKRALVIGPLGFERRVRNFL

SEQ ID NO: 2785935 - protein, 23 aa, Entamoeba invadens
ALTFRPETPCGFTNKTRYDTSTF

SEQ ID NO: 2785936 - protein, 20 aa, Entamoeba invadens
ALTLYPDFFKAEAKDIANKI

SEQ ID NO: 2785937 - protein, 18 aa, Entamoeba invadens
ALVDVILLLPIICIVLYF

SEQ ID NO: 2785938 - protein, 17 aa, Entamoeba invadens
ALVEMLRMYEGYIAVLK

SEQ ID NO: 2785939 - protein, 18 aa, Entamoeba invadens
ALVTLSIFMICRTIFGIT

SEQ ID NO: 2785940 - protein, 18 aa, Entamoeba invadens
ALVVSALVFFVPFSACVT

SEQ ID NO: 2785941 - protein, 23 aa, Entamoeba invadens
ALYACKMTKYWFLQRSDWIGALI

SEQ ID NO: 2785942 - protein, 22 aa, Entamoeba invadens
ALYGLSQLCGRQFKYLTDPQKA

SEQ ID NO: 2785943 - protein, 20 aa, Entamoeba invadens
ALYPQIIEFLSLVPSSTTKS

SEQ ID NO: 2785944 - protein, 18 aa, Entamoeba invadens
ALYSIFLEYYYKRDESEM

SEQ ID NO: 2785945 - protein, 23 aa, Entamoeba invadens
ALYVILSCCLRLNSDEKYNESYG

SEQ ID NO: 2785946 - protein, 28 aa, Entamoeba invadens
ALYVSVCIWPFCTAVFWPVATGTIGLES

SEQ ID NO: 2785947 - protein, 26 aa, Entamoeba invadens
AMALCTFPYLLLKYMFNPEMGKPNQY

SEQ ID NO: 2785948 - protein, 20 aa, Entamoeba invadens
AMAMNCIREDLQALLITNLV

SEQ ID NO: 2785949 - protein, 25 aa, Entamoeba invadens
AMEECRVFERFLQYFDRAVINKTVR

SEQ ID NO: 2785950 - protein, 18 aa, Entamoeba invadens
AMERRYSPFVLQETLQDI

SEQ ID NO: 2785951 - protein, 20 aa, Entamoeba invadens
AMEYLCYMLLYLHDSVNRRR

SEQ ID NO: 2785952 - protein, 23 aa, Entamoeba invadens
AMEYRMKMLLKRENHGHMMYETA

SEQ ID NO: 2785953 - protein, 21 aa, Entamoeba invadens
AMIFIPMLVASVFVDVKDVKE

SEQ ID NO: 2785954 - protein, 23 aa, Entamoeba invadens
AMKLNVGRRTWILLIFSIIGLAI

SEQ ID NO: 2785955 - protein, 29 aa, Entamoeba invadens
AMKTGIPAEVWRYYLLMNRPEQSDTIFLW

SEQ ID NO: 2785956 - protein, 17 aa, Entamoeba invadens
AMLALNLTAMFAIFAVF

SEQ ID NO: 2785957 - protein, 20 aa, Entamoeba invadens
AMLDKFRCDYIIHFYGAVFI

SEQ ID NO: 2785958 - protein, 19 aa, Entamoeba invadens
AMLDKFRCDYIIHFYGSVR

SEQ ID NO: 2785959 - protein, 20 aa, Entamoeba invadens
AMLDKFRCEYIIHFYGAVFI

SEQ ID NO: 2785960 - protein, 22 aa, Entamoeba invadens
AMLDKFRCEYIVAFYGAVFIPS

SEQ ID NO: 2785961 - protein, 21 aa, Entamoeba invadens
AMLDKFRNAYIVHFYGAVFVP

SEQ ID NO: 2785962 - protein, 19 aa, Entamoeba invadens
AMLGGALWCTGNILCVPVL

SEQ ID NO: 2785963 - protein, 18 aa, Entamoeba invadens
AMMFLSLLLCGEFKVFSG

SEQ ID NO: 2785964 - protein, 30 aa, Entamoeba invadens
AMNTPKERILWCYKKDLGFSTNAKRRVRDK

SEQ ID NO: 2785965 - protein, 19 aa, Entamoeba invadens
AMQCFSCYDEYVFINKRCI

SEQ ID NO: 2785966 - protein, 20 aa, Entamoeba invadens
AMSNNLFCYLAVTGYSSTTN

SEQ ID NO: 2785967 - protein, 33 aa, Entamoeba invadens
AMVRNVMEPMRMITIWICSVFLYYVVDPKIGEK

SEQ ID NO: 2785968 - protein, 22 aa, Entamoeba invadens
AMWAVPQIFDWTVYNDSYNLDW

SEQ ID NO: 2785969 - protein, 24 aa, Entamoeba invadens
ANATKCIICPAGTYSNSDGTSCVK

SEQ ID NO: 2785970 - protein, 25 aa, Entamoeba invadens
ANCGSCSDVNCMICENNKCIVCNNG

SEQ ID NO: 2785971 - protein, 17 aa, Entamoeba invadens
ANCRVCASSGERKCNTC

SEQ ID NO: 2785972 - protein, 25 aa, Entamoeba invadens
ANDDFKYLWKIADFICDGKRLMKPS

SEQ ID NO: 2785973 - protein, 25 aa, Entamoeba invadens
ANDSFQWVFGRAFGKHHPFPYLSPN

SEQ ID NO: 2785974 - protein, 26 aa, Entamoeba invadens
ANEPEKCITRFTLFLQTIISGICQER

SEQ ID NO: 2785975 - protein, 31 aa, Entamoeba invadens
ANFDQNVVLWSWFFFDIIIRSTVEYLHEQMD

SEQ ID NO: 2785976 - protein, 19 aa, Entamoeba invadens
ANFPRIYRTDSFGKIFEVA

SEQ ID NO: 2785977 - protein, 19 aa, Entamoeba invadens
ANFTMKSGIANRVDSKTFA

SEQ ID NO: 2785978 - protein, 19 aa, Entamoeba invadens
ANGEWCVKCYDGYVGGKNK

SEQ ID NO: 2785979 - protein, 21 aa, Entamoeba invadens
ANGMSCPQCNEGFYAIETLNN

SEQ ID NO: 2785980 - protein, 24 aa, Entamoeba invadens
ANGNCISCGLNISNCVVCSSELGC

SEQ ID NO: 2785981 - protein, 19 aa, Entamoeba invadens
ANGRTTIIVAHRLSTIKNA

SEQ ID NO: 2785982 - protein, 18 aa, Entamoeba invadens
ANGRTTIIVAHRLSTIVN

SEQ ID NO: 2785983 - protein, 19 aa, Entamoeba invadens
ANGVYRYSTQIQITSSPKT

SEQ ID NO: 2785984 - protein, 22 aa, Entamoeba invadens
ANHCINGFKCASCDGNQYIDSD

SEQ ID NO: 2785985 - protein, 29 aa, Entamoeba invadens
ANHIEPPEIRECFDMEEVKQESDEDAKEK

SEQ ID NO: 2785986 - protein, 30 aa, Entamoeba invadens
ANIIKEYRDIGAFSIDWKDLKKLREGESSI

SEQ ID NO: 2785987 - protein, 21 aa, Entamoeba invadens
ANKCKYCSLGTYSSSQKSLKC

SEQ ID NO: 2785988 - protein, 17 aa, Entamoeba invadens
ANKCNGCVPGYYLQSGD

SEQ ID NO: 2785989 - protein, 18 aa, Entamoeba invadens
ANKKCFKCDVSCKTCKDS

SEQ ID NO: 2785990 - protein, 17 aa, Entamoeba invadens
ANLDVSRLSDTQMSVKS

SEQ ID NO: 2785991 - protein, 25 aa, Entamoeba invadens
ANLESGCWLLFVAVVLYTIVTIAMM

SEQ ID NO: 2785992 - protein, 17 aa, Entamoeba invadens
ANLFEIIEEAWLQDQKL

SEQ ID NO: 2785993 - protein, 20 aa, Entamoeba invadens
ANLKCRVENKVCVKTIPYVE

SEQ ID NO: 2785994 - protein, 17 aa, Entamoeba invadens
ANLKIEIRQKGQNADKF

SEQ ID NO: 2785995 - protein, 20 aa, Entamoeba invadens
ANLLHCNEMYYANRDKDCQK

SEQ ID NO: 2785996 - protein, 17 aa, Entamoeba invadens
ANLRVTGNMGFNMISDF

SEQ ID NO: 2785997 - protein, 21 aa, Entamoeba invadens
ANLTGIFAFLLSYVFPCAFVL

SEQ ID NO: 2785998 - protein, 27 aa, Entamoeba invadens
ANLTHLPCFKFLRKSNDLFVQMIAIAA

SEQ ID NO: 2785999 - protein, 18 aa, Entamoeba invadens
ANLVKRFPNDDIVNKYYK

SEQ ID NO: 2786000 - protein, 20 aa, Entamoeba invadens
ANMMNYEFIHKLGKRNDVGK

SEQ ID NO: 2786001 - protein, 26 aa, Entamoeba invadens
ANMYYKTIDLVFAFIFVFSGIVFYLK

SEQ ID NO: 2786002 - protein, 24 aa, Entamoeba invadens
ANNCLTCASGTYRNGFYCSVCDTR

SEQ ID NO: 2786003 - protein, 22 aa, Entamoeba invadens
ANNCLTCPEGTFISEGTCSTNE

SEQ ID NO: 2786004 - protein, 27 aa, Entamoeba invadens
ANNECSLCKTGYVLSQYLACLISTNSC

SEQ ID NO: 2786005 - protein, 23 aa, Entamoeba invadens
ANNETKIMWNIVNLNNELLFKRH

SEQ ID NO: 2786006 - protein, 18 aa, Entamoeba invadens
ANNFGQWLYKNIFFTVGI

SEQ ID NO: 2786007 - protein, 20 aa, Entamoeba invadens
ANNSCTPSLILRINNTNYSI

SEQ ID NO: 2786008 - protein, 27 aa, Entamoeba invadens
ANNVLFVFRPDRICFSSSGNTLLSKHV

SEQ ID NO: 2786009 - protein, 30 aa, Entamoeba invadens
ANPFFFLCLRIRPTIFLGVPRVYEKIIDKI

SEQ ID NO: 2786010 - protein, 24 aa, Entamoeba invadens
ANQARCFYCKCSYIDGSPSLIMYA

SEQ ID NO: 2786011 - protein, 24 aa, Entamoeba invadens
ANQCLSDGCTKCMDGFLLIDKNCF

SEQ ID NO: 2786012 - protein, 25 aa, Entamoeba invadens
ANQMIKRYPSPVIISSLQKTAGYTI

SEQ ID NO: 2786013 - protein, 18 aa, Entamoeba invadens
ANSCASNGSRICTNCMVG

SEQ ID NO: 2786014 - protein, 18 aa, Entamoeba invadens
ANSCASNGSRICTNCTAG

SEQ ID NO: 2786015 - protein, 20 aa, Entamoeba invadens
ANSCFKCKKGYYPVNGKCVS

SEQ ID NO: 2786016 - protein, 21 aa, Entamoeba invadens
ANTSLPYIIVYPIVCTLPSLI

SEQ ID NO: 2786017 - protein, 24 aa, Entamoeba invadens
ANTSMFYKRWLKVEDIHAELFMNQ

SEQ ID NO: 2786018 - protein, 19 aa, Entamoeba invadens
ANVPYYLFVHSKFASSKMK

SEQ ID NO: 2786019 - protein, 24 aa, Entamoeba invadens
ANVRCRNCGLPIMNTAPCTVECGG

SEQ ID NO: 2786020 - protein, 27 aa, Entamoeba invadens
ANWSLPAALLCFIGYAIFFVSDVLVCF

SEQ ID NO: 2786021 - protein, 19 aa, Entamoeba invadens
ANYLFDLKCTSCLSYSEET

SEQ ID NO: 2786022 - protein, 21 aa, Entamoeba invadens
ANYTSVHWIFFNLLPVTLGNF

SEQ ID NO: 2786023 - protein, 29 aa, Entamoeba invadens
ANYYRFTSEKGLDVDISTCFPRTLVNTGL

SEQ ID NO: 2786024 - protein, 23 aa, Entamoeba invadens
APAICLLSGIALAEFFTKIEKQM

SEQ ID NO: 2786025 - protein, 20 aa, Entamoeba invadens
APASLRSKMQMTFSSPVSVD

SEQ ID NO: 2786026 - protein, 17 aa, Entamoeba invadens
APDIPKYVFHFDPQVYV

SEQ ID NO: 2786027 - protein, 17 aa, Entamoeba invadens
APELIVFTFYRTSNGPD

SEQ ID NO: 2786028 - protein, 21 aa, Entamoeba invadens
APENVKLRFVGKDGTGRSVQT

SEQ ID NO: 2786029 - protein, 20 aa, Entamoeba invadens
APESYSRAYKWLPLIYGLTS

SEQ ID NO: 2786030 - protein, 17 aa, Entamoeba invadens
APFSSWDGVHFLSIAMK

SEQ ID NO: 2786031 - protein, 20 aa, Entamoeba invadens
APFYTVELYIDINLDTDLGK

SEQ ID NO: 2786032 - protein, 25 aa, Entamoeba invadens
APFYYDWKVNFGIIQKESNGNVTII

SEQ ID NO: 2786033 - protein, 17 aa, Entamoeba invadens
APILSGINGTVNFLNFG

SEQ ID NO: 2786034 - protein, 21 aa, Entamoeba invadens
APIRYFTRTSIYSTYPTSDQM

SEQ ID NO: 2786035 - protein, 18 aa, Entamoeba invadens
APLAFMSMSLLNFMHLVG

SEQ ID NO: 2786036 - protein, 24 aa, Entamoeba invadens
APLDEFKIYINTVVHACSSSYSDV

SEQ ID NO: 2786037 - protein, 17 aa, Entamoeba invadens
APLKDLVKNGVMDLTKK

SEQ ID NO: 2786038 - protein, 25 aa, Entamoeba invadens
APLSTLKLSDKWVTSCDKMTLTYNT

SEQ ID NO: 2786039 - protein, 18 aa, Entamoeba invadens
APNLTFFPIMIDKIEEYR

SEQ ID NO: 2786040 - protein, 26 aa, Entamoeba invadens
APNQWKVQLFFVIFFFMLFAIFIPCL

SEQ ID NO: 2786041 - protein, 23 aa, Entamoeba invadens
APPLDLWDSMYLHLYHNYPGRLD

SEQ ID NO: 2786042 - protein, 29 aa, Entamoeba invadens
APQTKLWGYRALSALLMYLVIIFVVLFSI

SEQ ID NO: 2786043 - protein, 23 aa, Entamoeba invadens
APSESMTKCAFSLVDDIVDALAT

SEQ ID NO: 2786044 - protein, 20 aa, Entamoeba invadens
APSGVKYLGFLGDKNVNCAD

SEQ ID NO: 2786045 - protein, 18 aa, Entamoeba invadens
APSVPSLSPCRTPDIRPE

SEQ ID NO: 2786046 - protein, 18 aa, Entamoeba invadens
APVGWGHASLGRTYLYPC

SEQ ID NO: 2786047 - protein, 26 aa, Entamoeba invadens
AQAVWWVILLCVLFVMVIFIIFIALS

SEQ ID NO: 2786048 - protein, 18 aa, Entamoeba invadens
AQCADDGVTCYKCAFNNG

SEQ ID NO: 2786049 - protein, 20 aa, Entamoeba invadens
AQCSVCTETLELINGKCVVP

SEQ ID NO: 2786050 - protein, 20 aa, Entamoeba invadens
AQDCPEYLYDIAAIDDKYRI

SEQ ID NO: 2786051 - protein, 24 aa, Entamoeba invadens
AQEAALWKTVDAFRVQLSANERVI

SEQ ID NO: 2786052 - protein, 22 aa, Entamoeba invadens
AQEQCSLCKYGYHLDGVNKKCY

SEQ ID NO: 2786053 - protein, 19 aa, Entamoeba invadens
AQGRTTIVIAHRLSTIQGA

SEQ ID NO: 2786054 - protein, 19 aa, Entamoeba invadens
AQIEASFLKGNGMNVRAGS

SEQ ID NO: 2786055 - protein, 18 aa, Entamoeba invadens
AQIIACFMGLLYRKFFGI

SEQ ID NO: 2786056 - protein, 18 aa, Entamoeba invadens
AQILLAAHLTRLHNELPY

SEQ ID NO: 2786057 - protein, 17 aa, Entamoeba invadens
AQLLFSYPPKNTLNDKI

SEQ ID NO: 2786058 - protein, 27 aa, Entamoeba invadens
AQLSYELAFHRCLFEGITDVLFEKVKA

SEQ ID NO: 2786059 - protein, 27 aa, Entamoeba invadens
AQNCLKVDPLGKCIRCDNESYLNDEYS

SEQ ID NO: 2786060 - protein, 20 aa, Entamoeba invadens
AQNYVLRGSPVFSYVMSIGG

SEQ ID NO: 2786061 - protein, 41 aa, Entamoeba invadens
AQRKKLKDFLIFRVMKVTWKKSQFFVWFGIVVLIHISFIIS

SEQ ID NO: 2786062 - protein, 19 aa, Entamoeba invadens
AQSKCSKCTFWHIPNNSGT

SEQ ID NO: 2786063 - protein, 28 aa, Entamoeba invadens
AQSNCLEHILCIVAMLAVDTQFFVSAPA

SEQ ID NO: 2786064 - protein, 25 aa, Entamoeba invadens
AQTECLQCIPGSYSTPGSSKCVECD

SEQ ID NO: 2786065 - protein, 21 aa, Entamoeba invadens
AQTFLPFQFQYDVQKTSEGVY

SEQ ID NO: 2786066 - protein, 18 aa, Entamoeba invadens
AQTHFKEEFELLMKTKYG

SEQ ID NO: 2786067 - protein, 17 aa, Entamoeba invadens
AQTPSERFTIQEVIKQL

SEQ ID NO: 2786068 - protein, 17 aa, Entamoeba invadens
AQTVFMRFFLKRKLEGV

SEQ ID NO: 2786069 - protein, 18 aa, Entamoeba invadens
AQVGFKSGDKIAIYCETR

SEQ ID NO: 2786070 - protein, 30 aa, Entamoeba invadens
AQVLEEIVCFIVLEFKHFFPEDISDTVLML

SEQ ID NO: 2786071 - protein, 22 aa, Entamoeba invadens
AQVLKFYQRLFLNYQKYFKDVK

SEQ ID NO: 2786072 - protein, 19 aa, Entamoeba invadens
AQVMKKRVDEMVKEGKNPR

SEQ ID NO: 2786073 - protein, 19 aa, Entamoeba invadens
AQVVWWVILLCVLFVIVIF

SEQ ID NO: 2786074 - protein, 18 aa, Entamoeba invadens
AQYYFDWEENMKLDTKQR

SEQ ID NO: 2786075 - protein, 18 aa, Entamoeba invadens
ARCICPMCCHNKCYYTKC

SEQ ID NO: 2786076 - protein, 27 aa, Entamoeba invadens
ARDNCKVCAVDKCYQCNENMYLEQDIS

SEQ ID NO: 2786077 - protein, 20 aa, Entamoeba invadens
AREFQPFYNCCGYKDITNST

SEQ ID NO: 2786078 - protein, 29 aa, Entamoeba invadens
ARERKDLKGCVALAPAFYMKPHIMYFLSF

SEQ ID NO: 2786079 - protein, 29 aa, Entamoeba invadens
ARERKEKRLEVLVSLILFVLGFFCLITWV

SEQ ID NO: 2786080 - protein, 24 aa, Entamoeba invadens
ARFVDCPYKTFPTAIITQIVEEKQ

SEQ ID NO: 2786081 - protein, 20 aa, Entamoeba invadens
ARGAVMFIWVLTFLQSFMLF

SEQ ID NO: 2786082 - protein, 19 aa, Entamoeba invadens
ARGGLRTVITRDAEQAKYE

SEQ ID NO: 2786083 - protein, 18 aa, Entamoeba invadens
ARHDEILCIVRSIDDLSQ

SEQ ID NO: 2786084 - protein, 18 aa, Entamoeba invadens
ARHGDGFGFWLTQENPQM

SEQ ID NO: 2786085 - protein, 18 aa, Entamoeba invadens
ARHLMKVFQICINADNGE

SEQ ID NO: 2786086 - protein, 29 aa, Entamoeba invadens
ARHWSCGINFLLHRLFFQFFDNHKITAKI

SEQ ID NO: 2786087 - protein, 17 aa, Entamoeba invadens
ARIPMTLEYMKKHKSEI

SEQ ID NO: 2786088 - protein, 22 aa, Entamoeba invadens
ARKEPYPDIPRFHLIEKVGEIG

SEQ ID NO: 2786089 - protein, 23 aa, Entamoeba invadens
ARKFAYDAMKAFTQVFDIWNIIP

SEQ ID NO: 2786090 - protein, 26 aa, Entamoeba invadens
ARKKMVMTIYLATGFVKPIGLENTNF

SEQ ID NO: 2786091 - protein, 17 aa, Entamoeba invadens
ARKSLEEHINRHPKAMK

SEQ ID NO: 2786092 - protein, 24 aa, Entamoeba invadens
ARKYRCSMNNIFHIGKLYIGTRHL

SEQ ID NO: 2786093 - protein, 20 aa, Entamoeba invadens
ARLHSLRYDVIIRLVGAVYT

SEQ ID NO: 2786094 - protein, 21 aa, Entamoeba invadens
ARLKAPLVITQEFLRKNRTLS

SEQ ID NO: 2786095 - protein, 19 aa, Entamoeba invadens
ARLNYKMFISLSASIPTPL

SEQ ID NO: 2786096 - protein, 24 aa, Entamoeba invadens
ARLPCLHKVHFDCFKHDIEAAEPT

SEQ ID NO: 2786097 - protein, 24 aa, Entamoeba invadens
ARLYDIFKSIPFYLLSTMTPETLK

SEQ ID NO: 2786098 - protein, 17 aa, Entamoeba invadens
ARNCKTCDPSTGECLSC

SEQ ID NO: 2786099 - protein, 19 aa, Entamoeba invadens
ARNNYCFLCQDGYSQVGRD

SEQ ID NO: 2786100 - protein, 28 aa, Entamoeba invadens
ARNTLKCSMKSLPSFWYNIQLTESVDLI

SEQ ID NO: 2786101 - protein, 19 aa, Entamoeba invadens
ARQPVQLFINGVVKQSVVY

SEQ ID NO: 2786102 - protein, 17 aa, Entamoeba invadens
ARRCEISLPSGIGCAIC

SEQ ID NO: 2786103 - protein, 21 aa, Entamoeba invadens
ARRMIDGALVWQTKSSDTLLS

SEQ ID NO: 2786104 - protein, 20 aa, Entamoeba invadens
ARRVHFKGCVKTSETTSVLT

SEQ ID NO: 2786105 - protein, 21 aa, Entamoeba invadens
ARSEIYASLANNAIDEGNMCV

SEQ ID NO: 2786106 - protein, 17 aa, Entamoeba invadens
ARSFILALINREAEIEL

SEQ ID NO: 2786107 - protein, 20 aa, Entamoeba invadens
ARSIFDLCSVVIVFPCILLI

SEQ ID NO: 2786108 - protein, 19 aa, Entamoeba invadens
ARSSVLVKIGERIVLYSKG

SEQ ID NO: 2786109 - protein, 19 aa, Entamoeba invadens
ARTHKSSAITFVEENKATL

SEQ ID NO: 2786110 - protein, 18 aa, Entamoeba invadens
ARVISLLIGFIVLHLLGD

SEQ ID NO: 2786111 - protein, 19 aa, Entamoeba invadens
ARVKHWFDFLTFSNITELL

SEQ ID NO: 2786112 - protein, 18 aa, Entamoeba invadens
ARVKKYISSFFMVMIIGL

SEQ ID NO: 2786113 - protein, 25 aa, Entamoeba invadens
ARVLGRLSMLCGLYNGMESEDFDKY

SEQ ID NO: 2786114 - protein, 24 aa, Entamoeba invadens
ARVVLKSAYLFREVELNDTDKCNS

SEQ ID NO: 2786115 - protein, 17 aa, Entamoeba invadens
ASAKIFQILPAYFMQIK

SEQ ID NO: 2786116 - protein, 20 aa, Entamoeba invadens
ASCKTCSGGTQSSCTSCDSG

SEQ ID NO: 2786117 - protein, 21 aa, Entamoeba invadens
ASCLSCQLGCDYCNNKNVCTK

SEQ ID NO: 2786118 - protein, 19 aa, Entamoeba invadens
ASCSNRGCYTCNEGYSVSA

SEQ ID NO: 2786119 - protein, 29 aa, Entamoeba invadens
ASESGEYCYLKAVWWVFFISSLIFVIILV

SEQ ID NO: 2786120 - protein, 19 aa, Entamoeba invadens
ASFARKGYVLFKRAFAFCF

SEQ ID NO: 2786121 - protein, 23 aa, Entamoeba invadens
ASFKDCAKFKGFSNEVKVSNIGE

SEQ ID NO: 2786122 - protein, 22 aa, Entamoeba invadens
ASFLADIGVVFSVASAIFSIFV

SEQ ID NO: 2786123 - protein, 23 aa, Entamoeba invadens
ASFLADIGVVFSVASALFSIFVV

SEQ ID NO: 2786124 - protein, 23 aa, Entamoeba invadens
ASGCGKSTIAQLIERFYDVNEGA

SEQ ID NO: 2786125 - protein, 24 aa, Entamoeba invadens
ASGCVLCSKGYFILNQMCAKCDSK

SEQ ID NO: 2786126 - protein, 18 aa, Entamoeba invadens
ASGDCAKLVLPMYTPDGE

SEQ ID NO: 2786127 - protein, 18 aa, Entamoeba invadens
ASHKDFPILNTYLQPAQT

SEQ ID NO: 2786128 - protein, 19 aa, Entamoeba invadens
ASIAFRLFYVLAAFNIPFA

SEQ ID NO: 2786129 - protein, 26 aa, Entamoeba invadens
ASICKCVKKLTGKICLSIGDGMNDVP

SEQ ID NO: 2786130 - protein, 19 aa, Entamoeba invadens
ASISFCFSTNLTIMESVVY

SEQ ID NO: 2786131 - protein, 38 aa, Entamoeba invadens
ASKCSLKTNLPRLGKIYIFNLHVCFWPQVMKSNAEVWK

SEQ ID NO: 2786132 - protein, 21 aa, Entamoeba invadens
ASKGRTTIVIAHRLSTIQGAD

SEQ ID NO: 2786133 - protein, 25 aa, Entamoeba invadens
ASKNLRRDFYFGMVLFSMALLFIIS

SEQ ID NO: 2786134 - protein, 17 aa, Entamoeba invadens
ASKSILGLRDLDLNDEP

SEQ ID NO: 2786135 - protein, 20 aa, Entamoeba invadens
ASLFLDSRVNIVIRVVIPFV

SEQ ID NO: 2786136 - protein, 27 aa, Entamoeba invadens
ASLLKFLFYTIHSFRFNDELLQQFVTL

SEQ ID NO: 2786137 - protein, 21 aa, Entamoeba invadens
ASLSFTKLVIESEVTLTSTYN

SEQ ID NO: 2786138 - protein, 29 aa, Entamoeba invadens
ASMFEYLRGFALCKPLIDIVWPVDVPEQN

SEQ ID NO: 2786139 - protein, 25 aa, Entamoeba invadens
ASMLVDLVGYLLVERKFLFVSQSIQ

SEQ ID NO: 2786140 - protein, 20 aa, Entamoeba invadens
ASMTWKHIIIIPVVSSLVLV

SEQ ID NO: 2786141 - protein, 22 aa, Entamoeba invadens
ASNCNLCLNQKCTLCNEKHVLN

SEQ ID NO: 2786142 - protein, 23 aa, Entamoeba invadens
ASNEFLYPWNVVDFVTKGKRLPK

SEQ ID NO: 2786143 - protein, 18 aa, Entamoeba invadens
ASNFDTLMPYYFISDGIV

SEQ ID NO: 2786144 - protein, 25 aa, Entamoeba invadens
ASNIKRSMSVAVPPCEIIKPPEQKS

SEQ ID NO: 2786145 - protein, 23 aa, Entamoeba invadens
ASNLIIKSGFLKIVNMYTSTSFK

SEQ ID NO: 2786146 - protein, 19 aa, Entamoeba invadens
ASNNELYYVNSLKMKLSIL

SEQ ID NO: 2786147 - protein, 25 aa, Entamoeba invadens
ASNNKYTLSYSWKDVKLTSTVTTPM

SEQ ID NO: 2786148 - protein, 19 aa, Entamoeba invadens
ASNVPLYFLYALTLFHFSS

SEQ ID NO: 2786149 - protein, 24 aa, Entamoeba invadens
ASQCSVCAPGFYTSFNKQCEECTF

SEQ ID NO: 2786150 - protein, 24 aa, Entamoeba invadens
ASRERVGGVDLYFDKYLTGNTNRF

SEQ ID NO: 2786151 - protein, 17 aa, Entamoeba invadens
ASRICVFHQGEIIESGT

SEQ ID NO: 2786152 - protein, 27 aa, Entamoeba invadens
ASRKYRTAWRHPVNIILHALQYLLGGI

SEQ ID NO: 2786153 - protein, 23 aa, Entamoeba invadens
ASRRVYSSIVFQYFVPAVIFAQT

SEQ ID NO: 2786154 - protein, 25 aa, Entamoeba invadens
ASRTCVLLFAFGFVMPLCWIACGVM

SEQ ID NO: 2786155 - protein, 28 aa, Entamoeba invadens
ASRVDVSACDFFKVQFKTSKSVEMKTAS

SEQ ID NO: 2786156 - protein, 19 aa, Entamoeba invadens
ASRVFPLKHCDVALMPYPT

SEQ ID NO: 2786157 - protein, 17 aa, Entamoeba invadens
ASSCTKCSMGYYSSSSG

SEQ ID NO: 2786158 - protein, 28 aa, Entamoeba invadens
ASSFVWDIICLFAILLHVSMMRSNGYWT

SEQ ID NO: 2786159 - protein, 25 aa, Entamoeba invadens
ASSGHCTSCADGFYLVGTTLNNQRC

SEQ ID NO: 2786160 - protein, 20 aa, Entamoeba invadens
ASTAQIVIKIGLEHVKNTTE

SEQ ID NO: 2786161 - protein, 23 aa, Entamoeba invadens
ASTCLLCVSEICFSCVKTNGYCT

SEQ ID NO: 2786162 - protein, 20 aa, Entamoeba invadens
ASTCSTCFAGTYSSSGSTSC

SEQ ID NO: 2786163 - protein, 18 aa, Entamoeba invadens
ASTCTPLALFTVASQTEK

SEQ ID NO: 2786164 - protein, 25 aa, Entamoeba invadens
ASTIVPSLCRYYRLYNIAHQLQKEK

SEQ ID NO: 2786165 - protein, 27 aa, Entamoeba invadens
ASVASFSFGFGMPGFFMSYGNNNNTPQ

SEQ ID NO: 2786166 - protein, 20 aa, Entamoeba invadens
ASVCLECPAGSYSSKISSSC

SEQ ID NO: 2786167 - protein, 19 aa, Entamoeba invadens
ASVCSSCPAGYYSNSGSSG

SEQ ID NO: 2786168 - protein, 17 aa, Entamoeba invadens
ASVCTICRAGTYSNERS

SEQ ID NO: 2786169 - protein, 26 aa, Entamoeba invadens
ASVLRPTYQKAFSVVVPSGWAKLGAA

SEQ ID NO: 2786170 - protein, 17 aa, Entamoeba invadens
ASVPYKIVFAMEEVEDL

SEQ ID NO: 2786171 - protein, 19 aa, Entamoeba invadens
ASVVCGFIAILLMINGIYM

SEQ ID NO: 2786172 - protein, 18 aa, Entamoeba invadens
ASYFFKIVYKYKEPKSIE

SEQ ID NO: 2786173 - protein, 17 aa, Entamoeba invadens
ATARMFGIISLVFFIIS

SEQ ID NO: 2786174 - protein, 20 aa, Entamoeba invadens
ATATQHWNAYCLKNNNQITS

SEQ ID NO: 2786175 - protein, 21 aa, Entamoeba invadens
ATCGDEKCVSCAKQNSEEKCL

SEQ ID NO: 2786176 - protein, 18 aa, Entamoeba invadens
ATCGRAIPIKTLPFTRQV

SEQ ID NO: 2786177 - protein, 20 aa, Entamoeba invadens
ATCKGQRNRLQFTAKTGTTY

SEQ ID NO: 2786178 - protein, 24 aa, Entamoeba invadens
ATCKTCAYGYALNGKVCKKCDTGC

SEQ ID NO: 2786179 - protein, 19 aa, Entamoeba invadens
ATCKTCGSGYNLEAGKCVR

SEQ ID NO: 2786180 - protein, 19 aa, Entamoeba invadens
ATCSNCPAGSYSLDGASFC

SEQ ID NO: 2786181 - protein, 23 aa, Entamoeba invadens
ATCTACPAGSYSGKGFSSCYKCS

SEQ ID NO: 2786182 - protein, 20 aa, Entamoeba invadens
ATCVECLPSYILMDDNTCTS

SEQ ID NO: 2786183 - protein, 25 aa, Entamoeba invadens
ATDDFYLLVRVFRRDDGNSMMVTMY

SEQ ID NO: 2786184 - protein, 25 aa, Entamoeba invadens
ATDEGCKSCLNGYVSNFGSSECSAC

SEQ ID NO: 2786185 - protein, 18 aa, Entamoeba invadens
ATDNFCFVLEKFPHIISG

SEQ ID NO: 2786186 - protein, 17 aa, Entamoeba invadens
ATECLRCPQDYSVVNGM

SEQ ID NO: 2786187 - protein, 19 aa, Entamoeba invadens
ATECLRCPQDYSVVNGMCA

SEQ ID NO: 2786188 - protein, 19 aa, Entamoeba invadens
ATFNLTLMFFILGFCIACF

SEQ ID NO: 2786189 - protein, 24 aa, Entamoeba invadens
ATGYPSSSCLFDYFTPNDQVGLKH

SEQ ID NO: 2786190 - protein, 29 aa, Entamoeba invadens
ATHEKCQICIGDKCTKCEEKLFVDTVKDE

SEQ ID NO: 2786191 - protein, 18 aa, Entamoeba invadens
ATHLKDKIVWDVNFESRG

SEQ ID NO: 2786192 - protein, 17 aa, Entamoeba invadens
ATIKCLILKEIEIRFDE

SEQ ID NO: 2786193 - protein, 29 aa, Entamoeba invadens
ATIMFGFSFNFWWAVVCRFISGFVNGNIG

SEQ ID NO: 2786194 - protein, 17 aa, Entamoeba invadens
ATIPIVFGVAVIVILLV

SEQ ID NO: 2786195 - protein, 23 aa, Entamoeba invadens
ATKCKTCTSGHYINPDYQCVNRP

SEQ ID NO: 2786196 - protein, 23 aa, Entamoeba invadens
ATKCLSCPQNMYLSDYKCNTNND

SEQ ID NO: 2786197 - protein, 20 aa, Entamoeba invadens
ATKSHLQYLLLTITTASGTI

SEQ ID NO: 2786198 - protein, 26 aa, Entamoeba invadens
ATKSSRCLSCGVGYGVDDNGQCQKCV

SEQ ID NO: 2786199 - protein, 24 aa, Entamoeba invadens
ATLKPSTAVPITFKIKMLCTASVS

SEQ ID NO: 2786200 - protein, 22 aa, Entamoeba invadens
ATLNIFWLDSFNSMIFNSLSLI

SEQ ID NO: 2786201 - protein, 17 aa, Entamoeba invadens
ATLPLFRNSMIVSSMTY

SEQ ID NO: 2786202 - protein, 19 aa, Entamoeba invadens
ATLTYTTFLLLFLISAASS

SEQ ID NO: 2786203 - protein, 19 aa, Entamoeba invadens
ATLVFCFDTSIPYLLITKN

SEQ ID NO: 2786204 - protein, 19 aa, Entamoeba invadens
ATMYWPTLFCENGVAIKQM

SEQ ID NO: 2786205 - protein, 25 aa, Entamoeba invadens
ATNERCVFCGEGALNTQYNSCDMCL

SEQ ID NO: 2786206 - protein, 26 aa, Entamoeba invadens
ATNSKCLICAAGYGFDSGVCTLCGDL

SEQ ID NO: 2786207 - protein, 20 aa, Entamoeba invadens
ATNTMSLWMMIFVIGTVIAS

SEQ ID NO: 2786208 - protein, 17 aa, Entamoeba invadens
ATPFDCGGSEMCVITST

SEQ ID NO: 2786209 - protein, 19 aa, Entamoeba invadens
ATQILPLMEISGRFVLTQY

SEQ ID NO: 2786210 - protein, 25 aa, Entamoeba invadens
ATQNKWTINGWVFVCDFTFIDFSNF

SEQ ID NO: 2786211 - protein, 20 aa, Entamoeba invadens
ATRCKACASVCNTCNKTTGV

SEQ ID NO: 2786212 - protein, 28 aa, Entamoeba invadens
ATRERLKRLFGEVGMGHLLVLAVGAIVI

SEQ ID NO: 2786213 - protein, 24 aa, Entamoeba invadens
ATRIFKCDTCEGVLLNYQMQQCGS

SEQ ID NO: 2786214 - protein, 19 aa, Entamoeba invadens
ATSCSLCQPGTYSTGGSVS

SEQ ID NO: 2786215 - protein, 22 aa, Entamoeba invadens
ATSDKPIFYGITPLTINGTNPN

SEQ ID NO: 2786216 - protein, 17 aa, Entamoeba invadens
ATSFKCKKCLAECQNCT

SEQ ID NO: 2786217 - protein, 17 aa, Entamoeba invadens
ATSGGLITLCFVSLCFF

SEQ ID NO: 2786218 - protein, 25 aa, Entamoeba invadens
ATSLACKLVYGRGLDWNVTVVDVLP

SEQ ID NO: 2786219 - protein, 26 aa, Entamoeba invadens
ATSNFLLDVLRLCGFFFDSKYPKKSC

SEQ ID NO: 2786220 - protein, 17 aa, Entamoeba invadens
ATSRWCTIGNYIQCDCD

SEQ ID NO: 2786221 - protein, 20 aa, Entamoeba invadens
ATSVGCVQCADGFYQTDSVN

SEQ ID NO: 2786222 - protein, 25 aa, Entamoeba invadens
ATTFPSTYPSAGILIIRNGITQSSP

SEQ ID NO: 2786223 - protein, 30 aa, Entamoeba invadens
ATTIFTLFCVFKFRFLLVIIISIILQLAAS

SEQ ID NO: 2786224 - protein, 20 aa, Entamoeba invadens
ATTLRLVRSVLTFIGNFETI

SEQ ID NO: 2786225 - protein, 25 aa, Entamoeba invadens
ATTVKRWNGLLIFGFIVSVTSFFFT

SEQ ID NO: 2786226 - protein, 19 aa, Entamoeba invadens
ATVDLVWRVWGALISAEPF

SEQ ID NO: 2786227 - protein, 21 aa, Entamoeba invadens
ATVLEDARISSSLCGGSTLRF

SEQ ID NO: 2786228 - protein, 30 aa, Entamoeba invadens
ATWKDIYPKDRFKFAWNIVDFVVSGKRLKK

SEQ ID NO: 2786229 - protein, 22 aa, Entamoeba invadens
ATYKYPFLVAVCKGKTYSTLYD

SEQ ID NO: 2786230 - protein, 18 aa, Entamoeba invadens
ATYLMNFGLLFVSSSVFQ

SEQ ID NO: 2786231 - protein, 18 aa, Entamoeba invadens
AVADCHRAGITVRMVTGD

SEQ ID NO: 2786232 - protein, 19 aa, Entamoeba invadens
AVALVFDFVVIIASTLCYF

SEQ ID NO: 2786233 - protein, 23 aa, Entamoeba invadens
AVAVALCVWFIDGDWKYYLDPAL

SEQ ID NO: 2786234 - protein, 18 aa, Entamoeba invadens
AVCKTCVFKKAAKSILTE

SEQ ID NO: 2786235 - protein, 27 aa, Entamoeba invadens
AVCLCKEQFRLLLACELLCPHSFDVLR

SEQ ID NO: 2786236 - protein, 30 aa, Entamoeba invadens
AVCLSKHPKCKVCAVDKCYQCQENKYLKED

SEQ ID NO: 2786237 - protein, 18 aa, Entamoeba invadens
AVCTAALPIKNIPFSKSV

SEQ ID NO: 2786238 - protein, 20 aa, Entamoeba invadens
AVCTIALKCTIDTTQAPNCT

SEQ ID NO: 2786239 - protein, 17 aa, Entamoeba invadens
AVCTSAVNCYKCESGNL

SEQ ID NO: 2786240 - protein, 28 aa, Entamoeba invadens
AVEIPACKKLRVNTCNKKTTARVTIHIT

SEQ ID NO: 2786241 - protein, 25 aa, Entamoeba invadens
AVELLKIRFEMIYKYFDDKSLVLVV

SEQ ID NO: 2786242 - protein, 20 aa, Entamoeba invadens
AVFISNKWYSLIVIVVVICM

SEQ ID NO: 2786243 - protein, 29 aa, Entamoeba invadens
AVFLFFADCVFRYVTYFAKVLVILFAKKV

SEQ ID NO: 2786244 - protein, 21 aa, Entamoeba invadens
AVFLSFKLRKYIANKRQFHRL

SEQ ID NO: 2786245 - protein, 27 aa, Entamoeba invadens
AVGGCVLSSLLIGFGIYAYTFIDVDYI

SEQ ID NO: 2786246 - protein, 19 aa, Entamoeba invadens
AVGINRCFPPLLSYFQMLA

SEQ ID NO: 2786247 - protein, 23 aa, Entamoeba invadens
AVGKCAICQKGTYYLSSVCQSCG

SEQ ID NO: 2786248 - protein, 28 aa, Entamoeba invadens
AVHVLRCYFFFIRKDIFLIHSIPPCFLT

SEQ ID NO: 2786249 - protein, 18 aa, Entamoeba invadens
AVICVKVYNFFLLGFGLE

SEQ ID NO: 2786250 - protein, 20 aa, Entamoeba invadens
AVIFACISMSYVAVEYPAVT

SEQ ID NO: 2786251 - protein, 20 aa, Entamoeba invadens
AVIFLIKQSGIWVKRTALMI

SEQ ID NO: 2786252 - protein, 22 aa, Entamoeba invadens
AVIKIPFLQIFKNVITIQAIIP

SEQ ID NO: 2786253 - protein, 25 aa, Entamoeba invadens
AVINTIICILIRQFGAVATFRKSKK

SEQ ID NO: 2786254 - protein, 20 aa, Entamoeba invadens
AVIPDTRFGTTSLKSGDNSA

SEQ ID NO: 2786255 - protein, 18 aa, Entamoeba invadens
AVIVALLIAYVVHVYIVR

SEQ ID NO: 2786256 - protein, 19 aa, Entamoeba invadens
AVIVALLIAYVVHVYIVRK

SEQ ID NO: 2786257 - protein, 19 aa, Entamoeba invadens
AVKSLQCYADLPHYEKDVY

SEQ ID NO: 2786258 - protein, 24 aa, Entamoeba invadens
AVLELSQFAAFMVEPFCDVPLGGS

SEQ ID NO: 2786259 - protein, 25 aa, Entamoeba invadens
AVLFWIIAFCVAMKDILVDYYFLFF

SEQ ID NO: 2786260 - protein, 25 aa, Entamoeba invadens
AVLHREVVRFVKIGKLGGGDPLDYK

SEQ ID NO: 2786261 - protein, 19 aa, Entamoeba invadens
AVLLFKFYHHYILFCNTRD

SEQ ID NO: 2786262 - protein, 25 aa, Entamoeba invadens
AVLLKHVKKGFVLGEVFHGCVQDVC

SEQ ID NO: 2786263 - protein, 19 aa, Entamoeba invadens
AVLLNFPLIIPKSVKFLNR

SEQ ID NO: 2786264 - protein, 19 aa, Entamoeba invadens
AVLSVSFFVGFLVLVFLIF

SEQ ID NO: 2786265 - protein, 17 aa, Entamoeba invadens
AVMEVRALTDLGITENL

SEQ ID NO: 2786266 - protein, 24 aa, Entamoeba invadens
AVMSPQLFKEVCDNVGLTESEVNK

SEQ ID NO: 2786267 - protein, 25 aa, Entamoeba invadens
AVNGCQKCIFGYFPDEKRCSPCDTI

SEQ ID NO: 2786268 - protein, 20 aa, Entamoeba invadens
AVNGCQKCILGYFPDEKRCS

SEQ ID NO: 2786269 - protein, 24 aa, Entamoeba invadens
AVNMKNWLLEVLKSFNAPLLKLVF

SEQ ID NO: 2786270 - protein, 26 aa, Entamoeba invadens
AVNPKELWPPVLFTYMLSMYVANYPV

SEQ ID NO: 2786271 - protein, 18 aa, Entamoeba invadens
AVNWKITQPDIFEMKSNV

SEQ ID NO: 2786272 - protein, 24 aa, Entamoeba invadens
AVRIKICHDFARALLYLHSNGILH

SEQ ID NO: 2786273 - protein, 24 aa, Entamoeba invadens
AVRRLCVFGEVLAESGYLQRSDAR

SEQ ID NO: 2786274 - protein, 21 aa, Entamoeba invadens
AVSCTICPDGKYAPNNSSSSC

SEQ ID NO: 2786275 - protein, 18 aa, Entamoeba invadens
AVSFCTTLLWGSYSNVNT

SEQ ID NO: 2786276 - protein, 19 aa, Entamoeba invadens
AVSFFKLTKSVLLISQNAD

SEQ ID NO: 2786277 - protein, 18 aa, Entamoeba invadens
AVSGVTCEVCKESYTTPC

SEQ ID NO: 2786278 - protein, 22 aa, Entamoeba invadens
AVSNSKCSKCTFWYTPSENGTF

SEQ ID NO: 2786279 - protein, 24 aa, Entamoeba invadens
AVSVSCAIFVFFIIFVGAALIVGL

SEQ ID NO: 2786280 - protein, 24 aa, Entamoeba invadens
AVTKCLLCAKGYYANGSSCVKCDD

SEQ ID NO: 2786281 - protein, 22 aa, Entamoeba invadens
AVTMYELFKWGDAYDPDKIRSW

SEQ ID NO: 2786282 - protein, 20 aa, Entamoeba invadens
AVTMYETFGWCNIYTEAQFK

SEQ ID NO: 2786283 - protein, 18 aa, Entamoeba invadens
AVTPKCKNCETNFLSVDG

SEQ ID NO: 2786284 - protein, 19 aa, Entamoeba invadens
AVTTVVIGFMFTRNDNSKE

SEQ ID NO: 2786285 - protein, 18 aa, Entamoeba invadens
AVVAHTCNYYTNFDSRLS

SEQ ID NO: 2786286 - protein, 24 aa, Entamoeba invadens
AVVFCPKKQSFSFIDLQSKEKYLV

SEQ ID NO: 2786287 - protein, 26 aa, Entamoeba invadens
AVVFFCILLILSVVFLIVFTKKILGK

SEQ ID NO: 2786288 - protein, 34 aa, Entamoeba invadens
AVVGKFPFIWIFLVFASICFWMSHQFAPKGSFTT

SEQ ID NO: 2786289 - protein, 17 aa, Entamoeba invadens
AVVMYFSQIVCYQLFGE

SEQ ID NO: 2786290 - protein, 24 aa, Entamoeba invadens
AVVYSPHMFLFWGFGSVGVLSLYC

SEQ ID NO: 2786291 - protein, 17 aa, Entamoeba invadens
AVWWVILLIVIVCLALI

SEQ ID NO: 2786292 - protein, 17 aa, Entamoeba invadens
AVWWVLLIVVVFAIIVM

SEQ ID NO: 2786293 - protein, 19 aa, Entamoeba invadens
AWANKGCRTLALSYKDIAP

SEQ ID NO: 2786294 - protein, 22 aa, Entamoeba invadens
AWQKFSAHFLVFGRVFRMNIKE

SEQ ID NO: 2786295 - protein, 19 aa, Entamoeba invadens
AWSCDSCFDYDYPYLYEGT

SEQ ID NO: 2786296 - protein, 17 aa, Entamoeba invadens
AWTNLYFYFYVMLAAMY

SEQ ID NO: 2786297 - protein, 19 aa, Entamoeba invadens
AWTNNAYDYPDCPISAASS

SEQ ID NO: 2786298 - protein, 19 aa, Entamoeba invadens
AYAAEIAPNLTFFPIMIDK

SEQ ID NO: 2786299 - protein, 17 aa, Entamoeba invadens
AYCGTGCLGCFNSSQNS

SEQ ID NO: 2786300 - protein, 24 aa, Entamoeba invadens
AYCVLLRLPILFNFITIGNERFRC

SEQ ID NO: 2786301 - protein, 19 aa, Entamoeba invadens
AYDSWCEFEENYVTFKYGQ

SEQ ID NO: 2786302 - protein, 20 aa, Entamoeba invadens
AYFPFSRSGGLIVRENVYLD

SEQ ID NO: 2786303 - protein, 18 aa, Entamoeba invadens
AYFPSRRMTLDSTLLQPI

SEQ ID NO: 2786304 - protein, 25 aa, Entamoeba invadens
AYFVDGVFIFLGLVAAFFFITPTEI

SEQ ID NO: 2786305 - protein, 26 aa, Entamoeba invadens
AYGEGYTPCRLDFIGGKSITFRSASE

SEQ ID NO: 2786306 - protein, 22 aa, Entamoeba invadens
AYGFVCSQCAEGFYLIDSLNNE

SEQ ID NO: 2786307 - protein, 19 aa, Entamoeba invadens
AYGLVLLRNVMSFDSGMQK

SEQ ID NO: 2786308 - protein, 30 aa, Entamoeba invadens
AYGVTLLEGIKWRECFEGNQFKYTWQIAEF

SEQ ID NO: 2786309 - protein, 21 aa, Entamoeba invadens
AYHRRLEIFVHLFKETKIDIE

SEQ ID NO: 2786310 - protein, 19 aa, Entamoeba invadens
AYICDSCALFDINCLTCDS

SEQ ID NO: 2786311 - protein, 17 aa, Entamoeba invadens
AYICFALSLGYLLTLHI

SEQ ID NO: 2786312 - protein, 18 aa, Entamoeba invadens
AYISKLLVEMVVLNIDIW

SEQ ID NO: 2786313 - protein, 20 aa, Entamoeba invadens
AYKLIKAVDFMPCSDDDVKK

SEQ ID NO: 2786314 - protein, 18 aa, Entamoeba invadens
AYKVWSFNVDSLEISGNL

SEQ ID NO: 2786315 - protein, 19 aa, Entamoeba invadens
AYLAVDFFFLLSGYMTSYT

SEQ ID NO: 2786316 - protein, 22 aa, Entamoeba invadens
AYLFWLAFDVIRSFSERRKMSG

SEQ ID NO: 2786317 - protein, 18 aa, Entamoeba invadens
AYLLQFKYTYNIFFLFTV

SEQ ID NO: 2786318 - protein, 25 aa, Entamoeba invadens
AYLSETFKFPWKIAEFVTKGKRLER

SEQ ID NO: 2786319 - protein, 17 aa, Entamoeba invadens
AYLVFPLICVFTHVTLI

SEQ ID NO: 2786320 - protein, 30 aa, Entamoeba invadens
AYMNQDWRLRFQAMSVFASMLVKIDEKQSI

SEQ ID NO: 2786321 - protein, 17 aa, Entamoeba invadens
AYNIISMMWEDEADKRI

SEQ ID NO: 2786322 - protein, 27 aa, Entamoeba invadens
AYNKIQFKFPWKIAEFVINRNRLPKKE

SEQ ID NO: 2786323 - protein, 27 aa, Entamoeba invadens
AYPKESFQFPWKVAEFVSGGRRLAQSS

SEQ ID NO: 2786324 - protein, 27 aa, Entamoeba invadens
AYPKETFKFPWKIAEFVTTGKRLQRKD

SEQ ID NO: 2786325 - protein, 17 aa, Entamoeba invadens
AYPKSTFKFPWEIPEFV

SEQ ID NO: 2786326 - protein, 17 aa, Entamoeba invadens
AYPKTQFMFPWKIAEFV

SEQ ID NO: 2786327 - protein, 28 aa, Entamoeba invadens
AYPSSKFKFPWKIAEFVVQGNRREKPEN

SEQ ID NO: 2786328 - protein, 20 aa, Entamoeba invadens
AYQFVCLTSVFSQITTPESV

SEQ ID NO: 2786329 - protein, 19 aa, Entamoeba invadens
AYRVIKHLVSNKECETYLM

SEQ ID NO: 2786330 - protein, 19 aa, Entamoeba invadens
AYSCTLCSNGYFSSSSGQS

SEQ ID NO: 2786331 - protein, 26 aa, Entamoeba invadens
AYSGKWECKDGFVLRDNVCTQCGNGV

SEQ ID NO: 2786332 - protein, 29 aa, Entamoeba invadens
AYSKDAFKFPWKIAEFVTAGKRLERRKNI

SEQ ID NO: 2786333 - protein, 23 aa, Entamoeba invadens
AYSRSNGWEQFCFKTPEIKNSSH

SEQ ID NO: 2786334 - protein, 17 aa, Entamoeba invadens
AYVIVAIVVSITLFFVL

SEQ ID NO: 2786335 - protein, 26 aa, Entamoeba invadens
AYWYYYKFYFLLVIYFVVIIITTKYE

SEQ ID NO: 2786336 - protein, 27 aa, Entamoeba invadens
AYYTQNFPNMYPVTAFKKTADKNPMKV

SEQ ID NO: 2786337 - protein, 25 aa, Entamoeba invadens
CAAANGFKCITCDFWYSLNNSHSTC

SEQ ID NO: 2786338 - protein, 20 aa, Entamoeba invadens
CAASTCTIGTIKPGVTKLIL

SEQ ID NO: 2786339 - protein, 18 aa, Entamoeba invadens
CAATSLEELGYWDGVKAL

SEQ ID NO: 2786340 - protein, 18 aa, Entamoeba invadens
CADCVYTEKFICSPTYGQ

SEQ ID NO: 2786341 - protein, 17 aa, Entamoeba invadens
CADGYKLSDDKIECFAN

SEQ ID NO: 2786342 - protein, 18 aa, Entamoeba invadens
CAECPGGAERKCKQCKAG

SEQ ID NO: 2786343 - protein, 20 aa, Entamoeba invadens
CAEGYYRNGLDCYKCDLSCS

SEQ ID NO: 2786344 - protein, 26 aa, Entamoeba invadens
CAEGYYRNGLDCYKCNLSCSLCNTNS

SEQ ID NO: 2786345 - protein, 20 aa, Entamoeba invadens
CAEKTFNSCCYVTDDHKYHK

SEQ ID NO: 2786346 - protein, 27 aa, Entamoeba invadens
CAERKTWWICVTFSICIVLFIILILLF

SEQ ID NO: 2786347 - protein, 24 aa, Entamoeba invadens
CAEVRKRQTALRRFEKNKKIFVQH

SEQ ID NO: 2786348 - protein, 19 aa, Entamoeba invadens
CAGVCVPWGLSALDIPDLY

SEQ ID NO: 2786349 - protein, 25 aa, Entamoeba invadens
CAHGDKGAGMFATFVGTGKKYILNT

SEQ ID NO: 2786350 - protein, 19 aa, Entamoeba invadens
CAICIDSFSCITCQKDYFY

SEQ ID NO: 2786351 - protein, 17 aa, Entamoeba invadens
CAICNEGYYKEGTDCIS

SEQ ID NO: 2786352 - protein, 32 aa, Entamoeba invadens
CAICQTQSPFYCQTCISGFVFMRGSCRKCPTG

SEQ ID NO: 2786353 - protein, 25 aa, Entamoeba invadens
CAIISLIWFCIWVFNWVMALIKAQS

SEQ ID NO: 2786354 - protein, 17 aa, Entamoeba invadens
CAIKGSGPYPMEMFIKP

SEQ ID NO: 2786355 - protein, 17 aa, Entamoeba invadens
CAIQNSYGCVRCILQNY

SEQ ID NO: 2786356 - protein, 21 aa, Entamoeba invadens
CAISLAFQHFWYKNESHRKGF

SEQ ID NO: 2786357 - protein, 20 aa, Entamoeba invadens
CAKCSSAFDRKCVMCNTGYY

SEQ ID NO: 2786358 - protein, 25 aa, Entamoeba invadens
CAKCTKDGCSQCVTGFVGYLSSKGV

SEQ ID NO: 2786359 - protein, 19 aa, Entamoeba invadens
CAKFFVKYQIETFITQENE

SEQ ID NO: 2786360 - protein, 26 aa, Entamoeba invadens
CAKKTVGGCSLCLSEYYLKDGKCHPL

SEQ ID NO: 2786361 - protein, 18 aa, Entamoeba invadens
CALGCGLTVVLAMVVHPT

SEQ ID NO: 2786362 - protein, 18 aa, Entamoeba invadens
CAMFNRVPVLIFTFLLIV

SEQ ID NO: 2786363 - protein, 20 aa, Entamoeba invadens
CAMILFGAFVGIFGVITFVI

SEQ ID NO: 2786364 - protein, 21 aa, Entamoeba invadens
CAMLFDFRLLFLSFLFANASL

SEQ ID NO: 2786365 - protein, 20 aa, Entamoeba invadens
CAMNGCFDCSTTSGACTSCR

SEQ ID NO: 2786366 - protein, 26 aa, Entamoeba invadens
CAMNSCGYCKASTNAFCGICGKAFES

SEQ ID NO: 2786367 - protein, 26 aa, Entamoeba invadens
CAMYLSLLLEPNWRKSQINVNHKKHM

SEQ ID NO: 2786368 - protein, 19 aa, Entamoeba invadens
CAPSEGGCICEEKYGGDDC

SEQ ID NO: 2786369 - protein, 19 aa, Entamoeba invadens
CAQCADDGVTCYKCAFNNG

SEQ ID NO: 2786370 - protein, 19 aa, Entamoeba invadens
CAQNYFKKNYLCVSCSSLN

SEQ ID NO: 2786371 - protein, 19 aa, Entamoeba invadens
CASCQTGYFLSNGRCSKCL

SEQ ID NO: 2786372 - protein, 22 aa, Entamoeba invadens
CASCSLSSSRNCTTCKSNMYPD

SEQ ID NO: 2786373 - protein, 20 aa, Entamoeba invadens
CASNGSRICTNCMVGYFPQS

SEQ ID NO: 2786374 - protein, 20 aa, Entamoeba invadens
CATCADNGVRSCLVCSSGYY

SEQ ID NO: 2786375 - protein, 26 aa, Entamoeba invadens
CATCNRANSCLVCRSDMFMSVNGVCL

SEQ ID NO: 2786376 - protein, 22 aa, Entamoeba invadens
CATCTGSGYGQCTSCVTTGFIL

SEQ ID NO: 2786377 - protein, 20 aa, Entamoeba invadens
CATGNVSGCNRCELDYYYSY

SEQ ID NO: 2786378 - protein, 19 aa, Entamoeba invadens
CATSAYLDFMVPQQNLYVY

SEQ ID NO: 2786379 - protein, 28 aa, Entamoeba invadens
CATWKHDTICPVKGYWYLAVDIQLSLPL

SEQ ID NO: 2786380 - protein, 17 aa, Entamoeba invadens
CAVKETFTLTVVNLNTS

SEQ ID NO: 2786381 - protein, 18 aa, Entamoeba invadens
CCESKCLNSYLSEPNVKC

SEQ ID NO: 2786382 - protein, 17 aa, Entamoeba invadens
CCHNKCYYTKCETSTGT

SEQ ID NO: 2786383 - protein, 19 aa, Entamoeba invadens
CCIFLPDLPFILLGLTLTA

SEQ ID NO: 2786384 - protein, 18 aa, Entamoeba invadens
CCITHGFLRNSQYELESN

SEQ ID NO: 2786385 - protein, 17 aa, Entamoeba invadens
CCLACKERYILMSNNVC

SEQ ID NO: 2786386 - protein, 25 aa, Entamoeba invadens
CCSRVKTGFIWPALSLLMFIILTLI

SEQ ID NO: 2786387 - protein, 17 aa, Entamoeba invadens
CCTLWDDYSVLYQDSII

SEQ ID NO: 2786388 - protein, 17 aa, Entamoeba invadens
CCYTCDDVIEAYKERGW

SEQ ID NO: 2786389 - protein, 17 aa, Entamoeba invadens
CDACDTTDRKACGSGKY

SEQ ID NO: 2786390 - protein, 17 aa, Entamoeba invadens
CDACVSGAVSLNGVCSL

SEQ ID NO: 2786391 - protein, 23 aa, Entamoeba invadens
CDAKTCLKCSSNGVVNITDGHCV

SEQ ID NO: 2786392 - protein, 26 aa, Entamoeba invadens
CDAMFTLPWYLTWFIHSISSVEVGVR

SEQ ID NO: 2786393 - protein, 24 aa, Entamoeba invadens
CDATRCFNCSNGHYLMNGSCVQCP

SEQ ID NO: 2786394 - protein, 18 aa, Entamoeba invadens
CDCDFNFEKYNGKCLTKC

SEQ ID NO: 2786395 - protein, 21 aa, Entamoeba invadens
CDDLKIKKGELVCVLGSVGSG

SEQ ID NO: 2786396 - protein, 25 aa, Entamoeba invadens
CDDLKIKKGELVCVLGSVGSGKSSF

SEQ ID NO: 2786397 - protein, 24 aa, Entamoeba invadens
CDDNVTICYLNFLTTLSKIDLQNN

SEQ ID NO: 2786398 - protein, 22 aa, Entamoeba invadens
CDDRQCKTCQVGYFLNQTGICQ

SEQ ID NO: 2786399 - protein, 18 aa, Entamoeba invadens
CDDWYALSYNRQRCEKYP

SEQ ID NO: 2786400 - protein, 22 aa, Entamoeba invadens
CDECVEGFVLQNGVCETSKTAL

SEQ ID NO: 2786401 - protein, 23 aa, Entamoeba invadens
CDEGCRVCYLSLVGQMSECDICF

SEQ ID NO: 2786402 - protein, 18 aa, Entamoeba invadens
CDEHVVWWVLFIIILFAI

SEQ ID NO: 2786403 - protein, 19 aa, Entamoeba invadens
CDESPCIYPPHSTESTSKS

SEQ ID NO: 2786404 - protein, 21 aa, Entamoeba invadens
CDFDKCLKCSQYGVMNKVTGW

SEQ ID NO: 2786405 - protein, 23 aa, Entamoeba invadens
CDFNCFIEGLSFTVDMEGKMSTM

SEQ ID NO: 2786406 - protein, 17 aa, Entamoeba invadens
CDFSCSLCDANGYCTSC

SEQ ID NO: 2786407 - protein, 27 aa, Entamoeba invadens
CDGGCTATVLLRVRFVKSTIWKTKIES

SEQ ID NO: 2786408 - protein, 19 aa, Entamoeba invadens
CDGGDGCIECECQDDYFGH

SEQ ID NO: 2786409 - protein, 19 aa, Entamoeba invadens
CDGGDGCYECECQEDWFTW

SEQ ID NO: 2786410 - protein, 20 aa, Entamoeba invadens
CDGGDNCFACRCVNNTHNYA

SEQ ID NO: 2786411 - protein, 19 aa, Entamoeba invadens
CDGGEGCVECLCDKQLMYF

SEQ ID NO: 2786412 - protein, 25 aa, Entamoeba invadens
CDGGFGCDHCLCVNGTKSYNKSRLY

SEQ ID NO: 2786413 - protein, 24 aa, Entamoeba invadens
CDGGFGCDHCLCVNGTQSYNKSRL

SEQ ID NO: 2786414 - protein, 22 aa, Entamoeba invadens
CDGGLGCDHCVCVNGTTKYAKA

SEQ ID NO: 2786415 - protein, 17 aa, Entamoeba invadens
CDGGLGCQHCMCTEGYV

SEQ ID NO: 2786416 - protein, 27 aa, Entamoeba invadens
CDGGQGCKDCKCLPNYRVKRGKGCEYR

SEQ ID NO: 2786417 - protein, 20 aa, Entamoeba invadens
CDGGTGCYECQCQTGYIFHN

SEQ ID NO: 2786418 - protein, 22 aa, Entamoeba invadens
CDGINACLRCNTGFYAESGTCH

SEQ ID NO: 2786419 - protein, 21 aa, Entamoeba invadens
CDGRRGCLNCSEGYYPSNKIC

SEQ ID NO: 2786420 - protein, 21 aa, Entamoeba invadens
CDGSPKGFAQCITKMCNDKEL

SEQ ID NO: 2786421 - protein, 18 aa, Entamoeba invadens
CDGTEGCTEDCLCGDGYT

SEQ ID NO: 2786422 - protein, 18 aa, Entamoeba invadens
CDGTEGCTEDCLCSDGYT

SEQ ID NO: 2786423 - protein, 22 aa, Entamoeba invadens
CDHDMCFDCYDGYYTFNYHCYT

SEQ ID NO: 2786424 - protein, 19 aa, Entamoeba invadens
CDICSSGCIHCDGTSKNEC

SEQ ID NO: 2786425 - protein, 17 aa, Entamoeba invadens
CDICVGGTCQICKVNYL

SEQ ID NO: 2786426 - protein, 17 aa, Entamoeba invadens
CDINTFNIYPFVSPISG

SEQ ID NO: 2786427 - protein, 19 aa, Entamoeba invadens
CDITCHCVTGFYTLSDNPT

SEQ ID NO: 2786428 - protein, 20 aa, Entamoeba invadens
CDKDKCATCNDGYKMDPGSK

SEQ ID NO: 2786429 - protein, 24 aa, Entamoeba invadens
CDKHAVWWIILIIVMFIVLIIIIS

SEQ ID NO: 2786430 - protein, 17 aa, Entamoeba invadens
CDLCPKGSSSKYGSTEC

SEQ ID NO: 2786431 - protein, 17 aa, Entamoeba invadens
CDLTCGGSCDTNTGFCT

SEQ ID NO: 2786432 - protein, 19 aa, Entamoeba invadens
CDMKRSYKKNGVYTIGSET

SEQ ID NO: 2786433 - protein, 21 aa, Entamoeba invadens
CDNATATICSLMFDKENETYD

SEQ ID NO: 2786434 - protein, 17 aa, Entamoeba invadens
CDNGFPDNGTCVICPKH

SEQ ID NO: 2786435 - protein, 25 aa, Entamoeba invadens
CDNISGKCLMCYAGYGLGHNGNCEI

SEQ ID NO: 2786436 - protein, 18 aa, Entamoeba invadens
CDNLKKVTLRNCHDPINL

SEQ ID NO: 2786437 - protein, 21 aa, Entamoeba invadens
CDNYCRCVEGYIPDPNDKLSC

SEQ ID NO: 2786438 - protein, 19 aa, Entamoeba invadens
CDPFEFLESEFKAVSSQFQ

SEQ ID NO: 2786439 - protein, 25 aa, Entamoeba invadens
CDPSKPESFLLFGYEDMDSESGQFI

SEQ ID NO: 2786440 - protein, 17 aa, Entamoeba invadens
CDPYFRCVVRNSLGECT

SEQ ID NO: 2786441 - protein, 19 aa, Entamoeba invadens
CDQKGCFGKTCLEGFYGKR

SEQ ID NO: 2786442 - protein, 25 aa, Entamoeba invadens
CDQNECIQCANGFVKMFEKCIKVDH

SEQ ID NO: 2786443 - protein, 25 aa, Entamoeba invadens
CDQRYCFKCSASYYLSIDQKYCTQC

SEQ ID NO: 2786444 - protein, 18 aa, Entamoeba invadens
CDQYCHCTSGNVLSNHLC

SEQ ID NO: 2786445 - protein, 19 aa, Entamoeba invadens
CDSCKGSGATECVTCSPGY

SEQ ID NO: 2786446 - protein, 17 aa, Entamoeba invadens
CDSDCNCVNNTILYKHY

SEQ ID NO: 2786447 - protein, 23 aa, Entamoeba invadens
CDSELMANQPLDWFDSFNNNSDV

SEQ ID NO: 2786448 - protein, 26 aa, Entamoeba invadens
CDSIRCLTCKSGYYMKGDGCELCSTP

SEQ ID NO: 2786449 - protein, 27 aa, Entamoeba invadens
CDSIRCLTCKSGYYMKGDVCELCSTPM

SEQ ID NO: 2786450 - protein, 22 aa, Entamoeba invadens
CDSKKCFNCSQDGVINTITGKC

SEQ ID NO: 2786451 - protein, 24 aa, Entamoeba invadens
CDSKMCFNCSQNGIINAITGQCEV

SEQ ID NO: 2786452 - protein, 18 aa, Entamoeba invadens
CDSNCICDAGYSLVDHYC

SEQ ID NO: 2786453 - protein, 22 aa, Entamoeba invadens
CDSNCLTCVITPTYCLSCPPGF

SEQ ID NO: 2786454 - protein, 18 aa, Entamoeba invadens
CDSQSGICTTCISGYYID

SEQ ID NO: 2786455 - protein, 21 aa, Entamoeba invadens
CDSRERCLSCKNGYFRIPLEK

SEQ ID NO: 2786456 - protein, 24 aa, Entamoeba invadens
CDSSCYSCSGSSTYCTKCYTGDYL

SEQ ID NO: 2786457 - protein, 19 aa, Entamoeba invadens
CDSTCLTCSTTSTHCNSCK

SEQ ID NO: 2786458 - protein, 17 aa, Entamoeba invadens
CDSTCYNCTGLATNCTS

SEQ ID NO: 2786459 - protein, 17 aa, Entamoeba invadens
CDSTCYNCTGSATKCTS

SEQ ID NO: 2786460 - protein, 17 aa, Entamoeba invadens
CDSYCQCAENYTLIGHD

SEQ ID NO: 2786461 - protein, 22 aa, Entamoeba invadens
CDTCATANCYVCDKDGKCSKCK

SEQ ID NO: 2786462 - protein, 17 aa, Entamoeba invadens
CDTCPKGYYCPDGYNMV

SEQ ID NO: 2786463 - protein, 29 aa, Entamoeba invadens
CDTIAVGKARCNLCISPYVLNDTKCELCQ

SEQ ID NO: 2786464 - protein, 18 aa, Entamoeba invadens
CDTKNGLCTKCIQNYVVT

SEQ ID NO: 2786465 - protein, 17 aa, Entamoeba invadens
CDTKTGMCTVCIEGYTQ

SEQ ID NO: 2786466 - protein, 27 aa, Entamoeba invadens
CDTNGLCLECKWGSFLEDGKCVSTCKE

SEQ ID NO: 2786467 - protein, 24 aa, Entamoeba invadens
CDTTCKRCRGTRCDICEPFEQTLN

SEQ ID NO: 2786468 - protein, 23 aa, Entamoeba invadens
CDTTSFPVYGWILIAFGCFLFVI

SEQ ID NO: 2786469 - protein, 17 aa, Entamoeba invadens
CDVCKAGTYAGEGFSEC

SEQ ID NO: 2786470 - protein, 24 aa, Entamoeba invadens
CDVCKSNFFPKTIGDYRCQSCDIS

SEQ ID NO: 2786471 - protein, 20 aa, Entamoeba invadens
CDVDLKMCLGPFIDKLATLP

SEQ ID NO: 2786472 - protein, 25 aa, Entamoeba invadens
  misc_feature (24)..(25): Xaa can be any naturally occurring amino acid
CDVECKELPPPAGSGNLGLEVEQXX

SEQ ID NO: 2786473 - protein, 22 aa, Entamoeba invadens
CDVECKELPPPAGSGNVCNSIF

SEQ ID NO: 2786474 - protein, 17 aa, Entamoeba invadens
CDVECLELPPPAGSGNV

SEQ ID NO: 2786475 - protein, 26 aa, Entamoeba invadens
CDVGYKFDMFNSVCVKDACDKEQSSS

SEQ ID NO: 2786476 - protein, 25 aa, Entamoeba invadens
CDVKCGNENCELCDTLTEQDQNSNN

SEQ ID NO: 2786477 - protein, 25 aa, Entamoeba invadens
CDVKNKFGCQKCVDGFYVSNQFCDS

SEQ ID NO: 2786478 - protein, 19 aa, Entamoeba invadens
CDVNCKGITSSYCSTTEGC

SEQ ID NO: 2786479 - protein, 23 aa, Entamoeba invadens
CDYYEIRSVPPLVTLKPGYACEF

SEQ ID NO: 2786480 - protein, 19 aa, Entamoeba invadens
CDYYSKFGGYSGLPYDVMA

SEQ ID NO: 2786481 - protein, 19 aa, Entamoeba invadens
CEACATANCDVCDKDDKCT

SEQ ID NO: 2786482 - protein, 19 aa, Entamoeba invadens
CEAHVVWWVVLLIILFFIL

SEQ ID NO: 2786483 - protein, 22 aa, Entamoeba invadens
CEDSYFLQCFVYSYKLITTTSN

SEQ ID NO: 2786484 - protein, 17 aa, Entamoeba invadens
CEECMPGYTLLDSGCEL

SEQ ID NO: 2786485 - protein, 23 aa, Entamoeba invadens
CEECTDLNCLGCSYNTNECLRCQ

SEQ ID NO: 2786486 - protein, 23 aa, Entamoeba invadens
CEEHVVWWVLFLVVLFVIIIIIV

SEQ ID NO: 2786487 - protein, 24 aa, Entamoeba invadens
CEEIKKLIVRYSKFDEILRVYQLE

SEQ ID NO: 2786488 - protein, 21 aa, Entamoeba invadens
CEEKCTLCSEGYFLDTETHDC

SEQ ID NO: 2786489 - protein, 20 aa, Entamoeba invadens
CEENGVIKYGYFNNCTKDYW

SEQ ID NO: 2786490 - protein, 19 aa, Entamoeba invadens
CEESFYLQNGRCFVCENDC

SEQ ID NO: 2786491 - protein, 17 aa, Entamoeba invadens
CEFLYDMCEANELKVED

SEQ ID NO: 2786492 - protein, 25 aa, Entamoeba invadens
CEFSIYLKPLCTCKFHSTIQMISKN

SEQ ID NO: 2786493 - protein, 25 aa, Entamoeba invadens
CEFWKAPSQSGTFCVSKAVWWVIFI

SEQ ID NO: 2786494 - protein, 37 aa, Entamoeba invadens
CEFWRRPSPDGSKCLFYFEWIPVIVLLLTIIVVIIIS

SEQ ID NO: 2786495 - protein, 23 aa, Entamoeba invadens
CEGCSTHNAKICALNLTDNFSVF

SEQ ID NO: 2786496 - protein, 18 aa, Entamoeba invadens
CEGKCVTCYNSTYCLSCS

SEQ ID NO: 2786497 - protein, 24 aa, Entamoeba invadens
CEHKCLVSSLIAFLVEAIYPFQFE

SEQ ID NO: 2786498 - protein, 29 aa, Entamoeba invadens
CEICEKLRIKICLDAAMGVQYLHSNGILH

SEQ ID NO: 2786499 - protein, 25 aa, Entamoeba invadens
CEICKPTKCVLCKNGATPSFGNSCE

SEQ ID NO: 2786500 - protein, 27 aa, Entamoeba invadens
CEIKSKFGCQKCVDGFYVYNQFCDSCN

SEQ ID NO: 2786501 - protein, 22 aa, Entamoeba invadens
CEIQNSFGCLRCVSGKYFDTAE

SEQ ID NO: 2786502 - protein, 29 aa, Entamoeba invadens
CEIVGNLRKCLKCFAPYYLSSDGLLCILA

SEQ ID NO: 2786503 - protein, 31 aa, Entamoeba invadens
CEIYPKNIFKYSWKIAEFVTAGKRVENINNI

SEQ ID NO: 2786504 - protein, 31 aa, Entamoeba invadens
CEIYPKNIFKYSWKIAEFVTAGKRVENVNNI

SEQ ID NO: 2786505 - protein, 18 aa, Entamoeba invadens
CEKAVVWWVILLIVLFCV

SEQ ID NO: 2786506 - protein, 17 aa, Entamoeba invadens
CEKCATENCDVCDKDDK

SEQ ID NO: 2786507 - protein, 23 aa, Entamoeba invadens
CEKCKDSNCATCIVNKDMCTICL

SEQ ID NO: 2786508 - protein, 24 aa, Entamoeba invadens
CEKCQKLSSFTFCYHISITVNIIS

SEQ ID NO: 2786509 - protein, 20 aa, Entamoeba invadens
CEKCSSSCLGCFGTKDYCVS

SEQ ID NO: 2786510 - protein, 26 aa, Entamoeba invadens
CEKCTSIPKCVLCTLYGECRQCISGH

SEQ ID NO: 2786511 - protein, 26 aa, Entamoeba invadens
CEKDECFLCVKGAFYLVDGKCENCSL

SEQ ID NO: 2786512 - protein, 21 aa, Entamoeba invadens
CEKESGFCFSCMSGCILSENR

SEQ ID NO: 2786513 - protein, 21 aa, Entamoeba invadens
CEKHVVWWFILIIVIIGVMVL

SEQ ID NO: 2786514 - protein, 24 aa, Entamoeba invadens
CEKKALWWFVLIVIIASIFVLVII

SEQ ID NO: 2786515 - protein, 23 aa, Entamoeba invadens
CEKMKRKIVYDGTKGIMYLHMND

SEQ ID NO: 2786516 - protein, 27 aa, Entamoeba invadens
CEKQPKWEIFLIIFLFVFEVSKIVVIF

SEQ ID NO: 2786517 - protein, 27 aa, Entamoeba invadens
CEKRSLWWISLIAIFFVILVVGVVAII

SEQ ID NO: 2786518 - protein, 18 aa, Entamoeba invadens
CELAVEWMLRGKGEDRVV

SEQ ID NO: 2786519 - protein, 17 aa, Entamoeba invadens
CELAVNVVEMFGGVEKQ

SEQ ID NO: 2786520 - protein, 27 aa, Entamoeba invadens
CELCSSFDPYCTVCSQTIRKCTTCTTG

SEQ ID NO: 2786521 - protein, 17 aa, Entamoeba invadens
CELCSSGKYPKPSENYK

SEQ ID NO: 2786522 - protein, 26 aa, Entamoeba invadens
CELFGVGGCNRCIFGTYLDFNTLKCN

SEQ ID NO: 2786523 - protein, 21 aa, Entamoeba invadens
CELFTVMALKLRLLVNKLGNN

SEQ ID NO: 2786524 - protein, 17 aa, Entamoeba invadens
CELIAGAVNPFVMSGIN

SEQ ID NO: 2786525 - protein, 18 aa, Entamoeba invadens
CELKEKLLTKKMITKERA

SEQ ID NO: 2786526 - protein, 18 aa, Entamoeba invadens
CELLCGTCRDGFVCSTKG

SEQ ID NO: 2786527 - protein, 19 aa, Entamoeba invadens
CEMCLPGYVLISPYCLSCE

SEQ ID NO: 2786528 - protein, 18 aa, Entamoeba invadens
CEMCPNSALICINYGNKI

SEQ ID NO: 2786529 - protein, 20 aa, Entamoeba invadens
CEMLESYSQMILKVNQPIFV

SEQ ID NO: 2786530 - protein, 25 aa, Entamoeba invadens
CENAPVWWVFFVLFLVVLGVIGLLV

SEQ ID NO: 2786531 - protein, 19 aa, Entamoeba invadens
CENCKLCVGTTILCSECND

SEQ ID NO: 2786532 - protein, 23 aa, Entamoeba invadens
CENDILIICCYLQIIVTNTLAAI

SEQ ID NO: 2786533 - protein, 19 aa, Entamoeba invadens
CENNYFLSSWRCETCSQNC

SEQ ID NO: 2786534 - protein, 17 aa, Entamoeba invadens
CENVCKTCYNLTYCTSC

SEQ ID NO: 2786535 - protein, 23 aa, Entamoeba invadens
CEPNCKKCNSKSCEVCNDNYTLN

SEQ ID NO: 2786536 - protein, 24 aa, Entamoeba invadens
CEPNTNCAISFKNGKCPVCVDGYF

SEQ ID NO: 2786537 - protein, 18 aa, Entamoeba invadens
CEPQCGVCRDGFLCNTMG

SEQ ID NO: 2786538 - protein, 17 aa, Entamoeba invadens
CEPTCGSCNDGFVCTTM

SEQ ID NO: 2786539 - protein, 22 aa, Entamoeba invadens
CEQCDFHYLFKDGICVEISNCL

SEQ ID NO: 2786540 - protein, 24 aa, Entamoeba invadens
CEQCSTLYGNLCEYCDAKTCLKCS

SEQ ID NO: 2786541 - protein, 18 aa, Entamoeba invadens
CEQRLCYIGREAFTLENK

SEQ ID NO: 2786542 - protein, 19 aa, Entamoeba invadens
CERCGIVGCSLCNSTGSDC

SEQ ID NO: 2786543 - protein, 22 aa, Entamoeba invadens
CERCSESSCTICENDLCSKCEN

SEQ ID NO: 2786544 - protein, 17 aa, Entamoeba invadens
CESCISGYYLTENTCSL

SEQ ID NO: 2786545 - protein, 18 aa, Entamoeba invadens
CESCKNKYGKLCERCTPT

SEQ ID NO: 2786546 - protein, 26 aa, Entamoeba invadens
CESCNGNSSLNCLSCSQGKYIDSNQC

SEQ ID NO: 2786547 - protein, 24 aa, Entamoeba invadens
CESEKCIFCDMGFVINSVGICESQ

SEQ ID NO: 2786548 - protein, 24 aa, Entamoeba invadens
CESEKCILCNMGFVINSVGICEIQ

SEQ ID NO: 2786549 - protein, 33 aa, Entamoeba invadens
CESGCLRTRTRPCKYKNGTILEFLPSIQTFLKA

SEQ ID NO: 2786550 - protein, 21 aa, Entamoeba invadens
CESHVVWWVILLGVIFVIIVL

SEQ ID NO: 2786551 - protein, 23 aa, Entamoeba invadens
CESKAAWWVIFIIIVIIIIFILA

SEQ ID NO: 2786552 - protein, 18 aa, Entamoeba invadens
CESKRFYLEDGVCKKCDT

SEQ ID NO: 2786553 - protein, 22 aa, Entamoeba invadens
CESRAVWWVILVVVLFVLIVFV

SEQ ID NO: 2786554 - protein, 22 aa, Entamoeba invadens
CESRAVWWVILVVVLFVLIVLL

SEQ ID NO: 2786555 - protein, 17 aa, Entamoeba invadens
CESTLFLKVEDDITECV

SEQ ID NO: 2786556 - protein, 25 aa, Entamoeba invadens
CETCKDVNCLSCVYNKCQTCQKNFY

SEQ ID NO: 2786557 - protein, 23 aa, Entamoeba invadens
CETCKKASCDKCDGVDGNCFRCI

SEQ ID NO: 2786558 - protein, 30 aa, Entamoeba invadens
CETCLPRYVLKDHKCVLCNEVDKTCLKCHT

SEQ ID NO: 2786559 - protein, 17 aa, Entamoeba invadens
CETCLSKHCTSCDSRSG

SEQ ID NO: 2786560 - protein, 26 aa, Entamoeba invadens
CETHKIKLTLLWSGLQTLPALGCCAL

SEQ ID NO: 2786561 - protein, 22 aa, Entamoeba invadens
CETKAVWWAIIIVVIVSVIIIT

SEQ ID NO: 2786562 - protein, 21 aa, Entamoeba invadens
CETYATGEFAIFVLGNGVTKM

SEQ ID NO: 2786563 - protein, 17 aa, Entamoeba invadens
CEVCPNSASICINNKNN

SEQ ID NO: 2786564 - protein, 28 aa, Entamoeba invadens
CEVFDRIPALIGVVWMLHCEKTEEIKNV

SEQ ID NO: 2786565 - protein, 26 aa, Entamoeba invadens
CEVKSKFGCQKCVDGFYVSNQFCNKC

SEQ ID NO: 2786566 - protein, 23 aa, Entamoeba invadens
CEVNNVIYLDGFLTYECNQKNFV

SEQ ID NO: 2786567 - protein, 17 aa, Entamoeba invadens
CEVQGGVCQKCNDAFWF

SEQ ID NO: 2786568 - protein, 27 aa, Entamoeba invadens
CEVSSSFDCLRCIDNYYFDSNTRSCLK

SEQ ID NO: 2786569 - protein, 23 aa, Entamoeba invadens
CEYPEKQTATGFFRVAKSSLDKK

SEQ ID NO: 2786570 - protein, 20 aa, Entamoeba invadens
CEYPHPVFNIFKGFFSLSGD

SEQ ID NO: 2786571 - protein, 17 aa, Entamoeba invadens
CFADFFMKKIIFTKNAS

SEQ ID NO: 2786572 - protein, 21 aa, Entamoeba invadens
CFAYANAFRIQKDFKEMKVVF

SEQ ID NO: 2786573 - protein, 19 aa, Entamoeba invadens
CFDFGPSCNNINGCIKCKD

SEQ ID NO: 2786574 - protein, 19 aa, Entamoeba invadens
CFDGSYRSGLECLPCISSC

SEQ ID NO: 2786575 - protein, 18 aa, Entamoeba invadens
CFDPEIYKTVLTKKVKKT

SEQ ID NO: 2786576 - protein, 17 aa, Entamoeba invadens
CFDSYYFANTNMNNDNN

SEQ ID NO: 2786577 - protein, 17 aa, Entamoeba invadens
CFECISGFYPSNKNDET

SEQ ID NO: 2786578 - protein, 25 aa, Entamoeba invadens
CFEHCAVCSSEVCQTCESAYAYDTE

SEQ ID NO: 2786579 - protein, 30 aa, Entamoeba invadens
CFEVKAVLTDGCWYLFAGVVLYTITAIAIT

SEQ ID NO: 2786580 - protein, 23 aa, Entamoeba invadens
CFFALSITFFFVRLLQNRSPLVS

SEQ ID NO: 2786581 - protein, 19 aa, Entamoeba invadens
CFGCGAIVLLLTCVMFLQG

SEQ ID NO: 2786582 - protein, 17 aa, Entamoeba invadens
CFHYSYIDNCVKSLDSK

SEQ ID NO: 2786583 - protein, 26 aa, Entamoeba invadens
CFIIGMTWYACYGVAMNCMKRYIAGS

SEQ ID NO: 2786584 - protein, 27 aa, Entamoeba invadens
CFILPTIFFFVFWRFLRGTLNGTAYFV

SEQ ID NO: 2786585 - protein, 19 aa, Entamoeba invadens
CFKCGINCIICEDSTGNCL

SEQ ID NO: 2786586 - protein, 21 aa, Entamoeba invadens
CFLSCCFYGVTVIVTLGLGCV

SEQ ID NO: 2786587 - protein, 20 aa, Entamoeba invadens
CFLVCFGVSLIYRSGIILFF

SEQ ID NO: 2786588 - protein, 24 aa, Entamoeba invadens
CFMVSLDIPIGVYRRAIRMLNFSI

SEQ ID NO: 2786589 - protein, 18 aa, Entamoeba invadens
CFNCGGVDKYCLEFDDSK

SEQ ID NO: 2786590 - protein, 25 aa, Entamoeba invadens
CFNGKECVECYSPFFSNETSKCELS

SEQ ID NO: 2786591 - protein, 19 aa, Entamoeba invadens
CFNTKYILYYLFGTNKIVE

SEQ ID NO: 2786592 - protein, 26 aa, Entamoeba invadens
CFQKDNYRFGKWIKIKSTDFSTKNFF

SEQ ID NO: 2786593 - protein, 17 aa, Entamoeba invadens
CFSACSFLSKDFRQKNA

SEQ ID NO: 2786594 - protein, 28 aa, Entamoeba invadens
CFSCTSDGCLACNTGFYFENGICTTCPN

SEQ ID NO: 2786595 - protein, 18 aa, Entamoeba invadens
CFTFFKSVLYCLIEVIGV

SEQ ID NO: 2786596 - protein, 17 aa, Entamoeba invadens
CFVAEEFPTLTANQARC

SEQ ID NO: 2786597 - protein, 20 aa, Entamoeba invadens
CFVDCYRLKTLTLPKSVTKL

SEQ ID NO: 2786598 - protein, 19 aa, Entamoeba invadens
CFVLEKFPHIISGVKNIFG

SEQ ID NO: 2786599 - protein, 19 aa, Entamoeba invadens
CFVSWYFLVRNESLSKVDV

SEQ ID NO: 2786600 - protein, 21 aa, Entamoeba invadens
CFVTCWDLALVLFSSIPFIVL

SEQ ID NO: 2786601 - protein, 25 aa, Entamoeba invadens
CFYKNKYRFGKWFKLLYNVKNSSHV

SEQ ID NO: 2786602 - protein, 27 aa, Entamoeba invadens
CFYTLLCLFGGCTIGCVLISIAMVVIM

SEQ ID NO: 2786603 - protein, 19 aa, Entamoeba invadens
CGAFCVECSLNGECEKCDS

SEQ ID NO: 2786604 - protein, 21 aa, Entamoeba invadens
CGCCYAAAIANHGQILYANMT

SEQ ID NO: 2786605 - protein, 23 aa, Entamoeba invadens
CGDGCKICKDGLSCEKCIDDYVY

SEQ ID NO: 2786606 - protein, 21 aa, Entamoeba invadens
CGDGKFGMAPNCEDCGVENCK

SEQ ID NO: 2786607 - protein, 21 aa, Entamoeba invadens
CGDIKSISFGFGMKYTQAEYI

SEQ ID NO: 2786608 - protein, 20 aa, Entamoeba invadens
CGDTLIICNIPIQKYSCGSK

SEQ ID NO: 2786609 - protein, 22 aa, Entamoeba invadens
CGECIPQFYLKNGICTSDDFNC

SEQ ID NO: 2786610 - protein, 21 aa, Entamoeba invadens
CGEDGCTNCINFFVLLAASFV

SEQ ID NO: 2786611 - protein, 18 aa, Entamoeba invadens
CGEHCKSCVSQIECTICD

SEQ ID NO: 2786612 - protein, 22 aa, Entamoeba invadens
CGELPFSLEVEYNGSLTLGGEY

SEQ ID NO: 2786613 - protein, 29 aa, Entamoeba invadens
CGEPEKRGQCVLSVFGCLCNSGYGYEECG

SEQ ID NO: 2786614 - protein, 17 aa, Entamoeba invadens
CGFEFKHSAFLVEVFCG

SEQ ID NO: 2786615 - protein, 21 aa, Entamoeba invadens
CGFFLACFSQSVLKYNKVIIY

SEQ ID NO: 2786616 - protein, 20 aa, Entamoeba invadens
CGFVCIQFIYLLGTIGYTFL

SEQ ID NO: 2786617 - protein, 23 aa, Entamoeba invadens
CGFVSDGICKACEAGYFSLGGTA

SEQ ID NO: 2786618 - protein, 22 aa, Entamoeba invadens
CGGGIGYWLSENWMGRGGLFGA

SEQ ID NO: 2786619 - protein, 19 aa, Entamoeba invadens
CGGVLGLVIILTFIIFIAY

SEQ ID NO: 2786620 - protein, 17 aa, Entamoeba invadens
CGGVLGLVLFYFGKGDF

SEQ ID NO: 2786621 - protein, 17 aa, Entamoeba invadens
CGGYTGLVFDKLMRVTE

SEQ ID NO: 2786622 - protein, 20 aa, Entamoeba invadens
CGHACITICHKGECPKCAVQ

SEQ ID NO: 2786623 - protein, 24 aa, Entamoeba invadens
CGIESLEIPDSVSYLGESTFQNCT

SEQ ID NO: 2786624 - protein, 19 aa, Entamoeba invadens
CGIGLLFVLIFYYYTYANQ

SEQ ID NO: 2786625 - protein, 20 aa, Entamoeba invadens
CGIIMAIAFSGLFMSDILCL

SEQ ID NO: 2786626 - protein, 23 aa, Entamoeba invadens
CGIPIGIRYTIFVLHRLTEPRNM

SEQ ID NO: 2786627 - protein, 20 aa, Entamoeba invadens
CGIVGGIFTIFSLLDAFIFH

SEQ ID NO: 2786628 - protein, 19 aa, Entamoeba invadens
CGIYEVLQKVIITNLQNER

SEQ ID NO: 2786629 - protein, 18 aa, Entamoeba invadens
CGKYGDFDKLAMETLTIL

SEQ ID NO: 2786630 - protein, 25 aa, Entamoeba invadens
CGLCNSSILCERCMNGFVFENGECV

SEQ ID NO: 2786631 - protein, 29 aa, Entamoeba invadens
CGLENCLSCLDGKCINCLDGYLLTTTNQC

SEQ ID NO: 2786632 - protein, 17 aa, Entamoeba invadens
CGLIHANYYFAKFFRSM

SEQ ID NO: 2786633 - protein, 21 aa, Entamoeba invadens
CGLIMAIAFSGLFLSGLLVLN

SEQ ID NO: 2786634 - protein, 25 aa, Entamoeba invadens
CGLLCPVIGLFLDKKWFPIDDIIRI

SEQ ID NO: 2786635 - protein, 24 aa, Entamoeba invadens
CGLNTLPFLFDLVFSSTFGGSYKI

SEQ ID NO: 2786636 - protein, 27 aa, Entamoeba invadens
CGLSLFSNTSFYWALNLVISPESRGYK

SEQ ID NO: 2786637 - protein, 21 aa, Entamoeba invadens
CGMATPVGCIRCDGNTFLNVM

SEQ ID NO: 2786638 - protein, 18 aa, Entamoeba invadens
CGNSGRLAKTIVVGTKYM

SEQ ID NO: 2786639 - protein, 21 aa, Entamoeba invadens
CGNWKETTYMLSNDIKIVDEI

SEQ ID NO: 2786640 - protein, 17 aa, Entamoeba invadens
CGPKKYFKDGKCMDMDS

SEQ ID NO: 2786641 - protein, 24 aa, Entamoeba invadens
CGQNCIFCGVTFECSKCGDNNILR

SEQ ID NO: 2786642 - protein, 30 aa, Entamoeba invadens
CGRCKTYDRCLYCTTGVLINESCFNYTAIE

SEQ ID NO: 2786643 - protein, 19 aa, Entamoeba invadens
CGRCVLKLDHHCPFVGSCI

SEQ ID NO: 2786644 - protein, 18 aa, Entamoeba invadens
CGSASHLEKVTVETFKSN

SEQ ID NO: 2786645 - protein, 24 aa, Entamoeba invadens
CGSCTKEKCLTCRNDLEMTASGLC

SEQ ID NO: 2786646 - protein, 18 aa, Entamoeba invadens
CGSIPFVKTNAARVAIDR

SEQ ID NO: 2786647 - protein, 39 aa, Entamoeba invadens
CGSKRHVVYIFPALCTIQNVEWCECPDCIASKIPNYSFS

SEQ ID NO: 2786648 - protein, 19 aa, Entamoeba invadens
CGSNARLIERLSDGYYYYI

SEQ ID NO: 2786649 - protein, 19 aa, Entamoeba invadens
CGSNIPFDIQLIILEGNAV

SEQ ID NO: 2786650 - protein, 21 aa, Entamoeba invadens
CGTCTTCASGYYLESNKCVRI

SEQ ID NO: 2786651 - protein, 18 aa, Entamoeba invadens
CGTDENYILIAMALMERG

SEQ ID NO: 2786652 - protein, 21 aa, Entamoeba invadens
CGTEKMARCDIANEFGCERCI

SEQ ID NO: 2786653 - protein, 17 aa, Entamoeba invadens
CGTLLIKKTAESVLSGY

SEQ ID NO: 2786654 - protein, 20 aa, Entamoeba invadens
CGTNNPNHCLDNFCDPTTEG

SEQ ID NO: 2786655 - protein, 20 aa, Entamoeba invadens
CGTPEYLAPELVMNVPYTNS

SEQ ID NO: 2786656 - protein, 26 aa, Entamoeba invadens
CGVAFASVCIPSFIRYYRLKQIIPPS

SEQ ID NO: 2786657 - protein, 18 aa, Entamoeba invadens
CGVCLKKTGECTSCNVGY

SEQ ID NO: 2786658 - protein, 20 aa, Entamoeba invadens
CGVDIISCHIFDISSYVKLY

SEQ ID NO: 2786659 - protein, 22 aa, Entamoeba invadens
CHASCKTCSGGTQSSCTSCDSG

SEQ ID NO: 2786660 - protein, 18 aa, Entamoeba invadens
CHECVGNFELLKGICVCK

SEQ ID NO: 2786661 - protein, 30 aa, Entamoeba invadens
CHFIYSKKAKICFFFFFLFSTILFLQGIIT

SEQ ID NO: 2786662 - protein, 23 aa, Entamoeba invadens
CHFSELKFSSANFVEPFCPCETE

SEQ ID NO: 2786663 - protein, 19 aa, Entamoeba invadens
CHKCEKWLYNILVGCLEKT

SEQ ID NO: 2786664 - protein, 17 aa, Entamoeba invadens
CHLCKNDSYLSSGNCEV

SEQ ID NO: 2786665 - protein, 18 aa, Entamoeba invadens
CHLLCYYNRVWQIDNTSL

SEQ ID NO: 2786666 - protein, 19 aa, Entamoeba invadens
CHMKCLKLTEKKCVNGKIY

SEQ ID NO: 2786667 - protein, 19 aa, Entamoeba invadens
CHSECYRCNGPYRTNCTRC

SEQ ID NO: 2786668 - protein, 22 aa, Entamoeba invadens
CIACSVNLCSTCINDVCDTCEP

SEQ ID NO: 2786669 - protein, 22 aa, Entamoeba invadens
CIAKYGDKFLVGYTEDKTKFYL

SEQ ID NO: 2786670 - protein, 17 aa, Entamoeba invadens
CIDGGVCGLDILDNDIP

SEQ ID NO: 2786671 - protein, 17 aa, Entamoeba invadens
CIDICYLIPNCKNGYYD

SEQ ID NO: 2786672 - protein, 21 aa, Entamoeba invadens
CIDKSKIAIYISMGIVCAFVI

SEQ ID NO: 2786673 - protein, 20 aa, Entamoeba invadens
CIDSECYQCTAQKSSAVMIC

SEQ ID NO: 2786674 - protein, 25 aa, Entamoeba invadens
CIDVISFRYKPNWNANQLSLLRGGK

SEQ ID NO: 2786675 - protein, 28 aa, Entamoeba invadens
CIDYYVGDWWGIWSSTRVQQGLRVRMKP

SEQ ID NO: 2786676 - protein, 25 aa, Entamoeba invadens
CIEKAQEPIYMFSFGPAPVVLYIAA

SEQ ID NO: 2786677 - protein, 18 aa, Entamoeba invadens
CIEKCILCSNKSNCEQCI

SEQ ID NO: 2786678 - protein, 24 aa, Entamoeba invadens
CIELISFESLHQFDAFTPNSKLIG

SEQ ID NO: 2786679 - protein, 24 aa, Entamoeba invadens
CIELISFESLHQFEAFTPNSKLIG

SEQ ID NO: 2786680 - protein, 18 aa, Entamoeba invadens
CIENCSMCSDQLSCNSCQ

SEQ ID NO: 2786681 - protein, 20 aa, Entamoeba invadens
CIEPTTFGCISCEDGYYATE

SEQ ID NO: 2786682 - protein, 20 aa, Entamoeba invadens
CIESANGIHCTLCATGAKYT

SEQ ID NO: 2786683 - protein, 19 aa, Entamoeba invadens
CIFCSNGCEKCYFDITTKT

SEQ ID NO: 2786684 - protein, 21 aa, Entamoeba invadens
CIFPCCLPPFVANSRLEKYLR

SEQ ID NO: 2786685 - protein, 18 aa, Entamoeba invadens
CIFQTKFRSINCGLLELL

SEQ ID NO: 2786686 - protein, 18 aa, Entamoeba invadens
CIFRMKKSNIDFVKLSKN

SEQ ID NO: 2786687 - protein, 20 aa, Entamoeba invadens
CIFVSSLSSGSCFKSVSPLT

SEQ ID NO: 2786688 - protein, 26 aa, Entamoeba invadens
CIIELKSDWYKRCFLDGRLEEGLSLS

SEQ ID NO: 2786689 - protein, 19 aa, Entamoeba invadens
CIIPQLSKFNISFIKVKSF

SEQ ID NO: 2786690 - protein, 23 aa, Entamoeba invadens
CIKAKNSKCARCEFWRRPSPDGS

SEQ ID NO: 2786691 - protein, 19 aa, Entamoeba invadens
CIKCTIEGCATCEKVDECT

SEQ ID NO: 2786692 - protein, 18 aa, Entamoeba invadens
CIKQFLKYTKVFTKESYY

SEQ ID NO: 2786693 - protein, 20 aa, Entamoeba invadens
CIKTSFGLCILCENGYFVED

SEQ ID NO: 2786694 - protein, 24 aa, Entamoeba invadens
CIKVQHGSCVLCSEKYFVNERSLC

SEQ ID NO: 2786695 - protein, 22 aa, Entamoeba invadens
CIKVTQIGSVFGYFHRGPHPSL

SEQ ID NO: 2786696 - protein, 19 aa, Entamoeba invadens
CILSNFSALKSRPVQQQDE

SEQ ID NO: 2786697 - protein, 19 aa, Entamoeba invadens
CILTCKIYVKLFECIEMLK

SEQ ID NO: 2786698 - protein, 32 aa, Entamoeba invadens
CILVTMGLSVKRWSFYLAVGFVLSFVLSIVSI

SEQ ID NO: 2786699 - protein, 23 aa, Entamoeba invadens
CINCTDANCIKCSSNKNVCEQCD

SEQ ID NO: 2786700 - protein, 18 aa, Entamoeba invadens
CINELYYLENAICVDCST

SEQ ID NO: 2786701 - protein, 21 aa, Entamoeba invadens
CIPCEASCAPNMCNTSNGNCD

SEQ ID NO: 2786702 - protein, 18 aa, Entamoeba invadens
CIPFIVIGSLCLVWGTGM

SEQ ID NO: 2786703 - protein, 25 aa, Entamoeba invadens
CIQCKEGYFRVGLDCLECDKKCLTC

SEQ ID NO: 2786704 - protein, 18 aa, Entamoeba invadens
CIQCKNSLLVNGSCIGVD

SEQ ID NO: 2786705 - protein, 19 aa, Entamoeba invadens
CIQCKPDFYPNSSGKCSSS

SEQ ID NO: 2786706 - protein, 18 aa, Entamoeba invadens
CIQCSNNCYSCYNSTYCI

SEQ ID NO: 2786707 - protein, 21 aa, Entamoeba invadens
CIQVISLFPFFSRLFIRLFCS

SEQ ID NO: 2786708 - protein, 21 aa, Entamoeba invadens
CIQYPKVFGGITFFETFPYIL

SEQ ID NO: 2786709 - protein, 20 aa, Entamoeba invadens
CIRCSPGHYLENGVCPSCQD

SEQ ID NO: 2786710 - protein, 25 aa, Entamoeba invadens
CIRGCDGINACSWCNNGFYEYGGTC

SEQ ID NO: 2786711 - protein, 20 aa, Entamoeba invadens
CIRQAESFDIIYPFEDGYTF

SEQ ID NO: 2786712 - protein, 18 aa, Entamoeba invadens
CISCDSSGERMCIKCAEN

SEQ ID NO: 2786713 - protein, 18 aa, Entamoeba invadens
CISCEPFQVLLLNNTCVG

SEQ ID NO: 2786714 - protein, 26 aa, Entamoeba invadens
CISGFPALQCTTCFDGYYRSGNSCFA

SEQ ID NO: 2786715 - protein, 21 aa, Entamoeba invadens
CISNATCENGIFDSTKGQCQK

SEQ ID NO: 2786716 - protein, 17 aa, Entamoeba invadens
CISNCEFCNTHSTCLKC

SEQ ID NO: 2786717 - protein, 20 aa, Entamoeba invadens
CITCSNEGSCLICNESYYRR

SEQ ID NO: 2786718 - protein, 19 aa, Entamoeba invadens
CITCVHPYYLSGGVCNTCA

SEQ ID NO: 2786719 - protein, 17 aa, Entamoeba invadens
CITKYPLFLQVMIGGIV

SEQ ID NO: 2786720 - protein, 27 aa, Entamoeba invadens
CIVCNEGYYRFGLDCVKCDSKCFTCNT

SEQ ID NO: 2786721 - protein, 24 aa, Entamoeba invadens
CIVEEIRPAFQVVMTEKEVSDIFL

SEQ ID NO: 2786722 - protein, 18 aa, Entamoeba invadens
CIVQELLGPNLYQVIKEA

SEQ ID NO: 2786723 - protein, 21 aa, Entamoeba invadens
CKACSSLCLTCEFTKADASSP

SEQ ID NO: 2786724 - protein, 19 aa, Entamoeba invadens
CKAGFKWSSTVYLECQDIP

SEQ ID NO: 2786725 - protein, 21 aa, Entamoeba invadens
CKAIGISALSKISIRIDPDEL

SEQ ID NO: 2786726 - protein, 21 aa, Entamoeba invadens
CKATNGANCIKCHNGELDTNC

SEQ ID NO: 2786727 - protein, 21 aa, Entamoeba invadens
CKATNGANCIKCHNGELNTNC

SEQ ID NO: 2786728 - protein, 17 aa, Entamoeba invadens
CKDCDWLSEDGTDVTKG

SEQ ID NO: 2786729 - protein, 18 aa, Entamoeba invadens
CKDDCALCTESYNCYQCK

SEQ ID NO: 2786730 - protein, 21 aa, Entamoeba invadens
CKDEECEKCTGGVGGIVIAAL

SEQ ID NO: 2786731 - protein, 18 aa, Entamoeba invadens
CKDGFYVQNNVCNDCTTN

SEQ ID NO: 2786732 - protein, 26 aa, Entamoeba invadens
CKDGFYYPSVDGFCVLRNSIIHCKNY

SEQ ID NO: 2786733 - protein, 17 aa, Entamoeba invadens
CKDGMYVDNELKCSDCD

SEQ ID NO: 2786734 - protein, 25 aa, Entamoeba invadens
CKDGYEFYESVCLLKCKKNQERNPT

SEQ ID NO: 2786735 - protein, 19 aa, Entamoeba invadens
CKDGYYISGYFLFLKCIQC

SEQ ID NO: 2786736 - protein, 20 aa, Entamoeba invadens
CKDKYYKRETDCISCDESCE

SEQ ID NO: 2786737 - protein, 17 aa, Entamoeba invadens
CKDLEGCVVSRYNNSCE

SEQ ID NO: 2786738 - protein, 18 aa, Entamoeba invadens
CKDPQYVALSGFCSNCEI

SEQ ID NO: 2786739 - protein, 17 aa, Entamoeba invadens
CKDPVEHIAFFKSFSFE

SEQ ID NO: 2786740 - protein, 21 aa, Entamoeba invadens
CKEESCLKCSFNKTTTETSLE

SEQ ID NO: 2786741 - protein, 21 aa, Entamoeba invadens
CKEGCIFCRNNICIICEPNRV

SEQ ID NO: 2786742 - protein, 24 aa, Entamoeba invadens
CKEGCVFCRNSVCIICEPNRVFDV

SEQ ID NO: 2786743 - protein, 18 aa, Entamoeba invadens
CKEGKIMRDGMCEDVTLD

SEQ ID NO: 2786744 - protein, 19 aa, Entamoeba invadens
CKEGTCLESFYGKQVWNNE

SEQ ID NO: 2786745 - protein, 21 aa, Entamoeba invadens
CKEGVMYQCAASAVALLFVEI

SEQ ID NO: 2786746 - protein, 19 aa, Entamoeba invadens
CKEGYYLSFSFDQDYPFYG

SEQ ID NO: 2786747 - protein, 22 aa, Entamoeba invadens
CKEGYYSRYVECVKCDSNCRVC

SEQ ID NO: 2786748 - protein, 17 aa, Entamoeba invadens
CKEKFLVTDGICREIEY

SEQ ID NO: 2786749 - protein, 20 aa, Entamoeba invadens
CKEKIIGFYSLFPALKNMYP

SEQ ID NO: 2786750 - protein, 18 aa, Entamoeba invadens
CKELNLYDRTCVYEDNNY

SEQ ID NO: 2786751 - protein, 30 aa, Entamoeba invadens
CKENCRFCNVSTCFLCQNGFVLKDGICQNK

SEQ ID NO: 2786752 - protein, 17 aa, Entamoeba invadens
CKENYYLSGAKCIHCNN

SEQ ID NO: 2786753 - protein, 19 aa, Entamoeba invadens
CKEPPTFNCSDLFKNTTNP

SEQ ID NO: 2786754 - protein, 24 aa, Entamoeba invadens
CKEQYKLKDGWCVPYATDCVFYSN

SEQ ID NO: 2786755 - protein, 19 aa, Entamoeba invadens
CKETYYKERSDCLTCDSTC

SEQ ID NO: 2786756 - protein, 24 aa, Entamoeba invadens
CKEVKIGMCTQCVDDYYFLPNSNT

SEQ ID NO: 2786757 - protein, 17 aa, Entamoeba invadens
CKFDLALGASDLKIKVK

SEQ ID NO: 2786758 - protein, 19 aa, Entamoeba invadens
CKFIDKYGYIIAFLLFVAI

SEQ ID NO: 2786759 - protein, 33 aa, Entamoeba invadens
CKFMSKVGYIWLLVCCLVLSDVLVFFFILGISY

SEQ ID NO: 2786760 - protein, 17 aa, Entamoeba invadens
CKFWYSPDEKGTFCQKE

SEQ ID NO: 2786761 - protein, 21 aa, Entamoeba invadens
CKGKCVTCYNSTYCLSCSTDL

SEQ ID NO: 2786762 - protein, 17 aa, Entamoeba invadens
CKGLRPSLDDVDEKVRD

SEQ ID NO: 2786763 - protein, 17 aa, Entamoeba invadens
CKGNMNGIMEFKQGRPN

SEQ ID NO: 2786764 - protein, 22 aa, Entamoeba invadens
CKGSKCTWCVEKYYLTSNLTCD

SEQ ID NO: 2786765 - protein, 23 aa, Entamoeba invadens
CKIATNLGCLSCEDSFYSDKNLR

SEQ ID NO: 2786766 - protein, 18 aa, Entamoeba invadens
CKICSPDYNRKCVECESG

SEQ ID NO: 2786767 - protein, 17 aa, Entamoeba invadens
CKIGFKLVDETTCTKIE

SEQ ID NO: 2786768 - protein, 23 aa, Entamoeba invadens
CKIKTTKGCITCFNGYYRSDGTC

SEQ ID NO: 2786769 - protein, 17 aa, Entamoeba invadens
CKILYVYNKTRIIVDNF

SEQ ID NO: 2786770 - protein, 25 aa, Entamoeba invadens
CKKCAPECLTCYGPNNNTCYSCAEK

SEQ ID NO: 2786771 - protein, 17 aa, Entamoeba invadens
CKKCKGHFMECLTADTP

SEQ ID NO: 2786772 - protein, 20 aa, Entamoeba invadens
CKKDLKKMNLGIGLGVVVGV

SEQ ID NO: 2786773 - protein, 18 aa, Entamoeba invadens
CKKFKRILDDNGNPTDTI

SEQ ID NO: 2786774 - protein, 21 aa, Entamoeba invadens
CKKHSTTMCDVCATEVITTAN

SEQ ID NO: 2786775 - protein, 20 aa, Entamoeba invadens
CKKLLPSKSICAFCESHFYR

SEQ ID NO: 2786776 - protein, 22 aa, Entamoeba invadens
CKKNCIFADWLISIICTVGVFF

SEQ ID NO: 2786777 - protein, 22 aa, Entamoeba invadens
CKKSFRILFRCFKVVNVPYNIF

SEQ ID NO: 2786778 - protein, 17 aa, Entamoeba invadens
CKLCDIGGCEQCSNTTY

SEQ ID NO: 2786779 - protein, 21 aa, Entamoeba invadens
CKLKIYFLIYYNNFVNIHCKI

SEQ ID NO: 2786780 - protein, 17 aa, Entamoeba invadens
CKLLRFPKGESGYAAST

SEQ ID NO: 2786781 - protein, 17 aa, Entamoeba invadens
CKLQLADSFPMEKYFKE

SEQ ID NO: 2786782 - protein, 19 aa, Entamoeba invadens
CKNCIKGKYLADNNTCQQC

SEQ ID NO: 2786783 - protein, 17 aa, Entamoeba invadens
CKNGFYVQNNMCNNCTT

SEQ ID NO: 2786784 - protein, 19 aa, Entamoeba invadens
CKNGYQLNEKLECIQSTNN

SEQ ID NO: 2786785 - protein, 20 aa, Entamoeba invadens
CKNSKCAKQADDGCSADSLS

SEQ ID NO: 2786786 - protein, 18 aa, Entamoeba invadens
CKPCSSIEGCTICNSNEK

SEQ ID NO: 2786787 - protein, 25 aa, Entamoeba invadens
CKPNCPEAYFAKDKVCTACVNDCKT

SEQ ID NO: 2786788 - protein, 21 aa, Entamoeba invadens
CKQEYKWSISSNIINLDGLFN

SEQ ID NO: 2786789 - protein, 26 aa, Entamoeba invadens
CKQKMVYRSPYTYGIYFDVPIHSPTD

SEQ ID NO: 2786790 - protein, 17 aa, Entamoeba invadens
CKREVTLRRNVTMINFH

SEQ ID NO: 2786791 - protein, 21 aa, Entamoeba invadens
CKRGFYILDGKCIGCHSFGES

SEQ ID NO: 2786792 - protein, 19 aa, Entamoeba invadens
CKSCNSCCTECYSALECTK

SEQ ID NO: 2786793 - protein, 19 aa, Entamoeba invadens
CKSCVSQIECTICDYNYKL

SEQ ID NO: 2786794 - protein, 20 aa, Entamoeba invadens
CKSGYEYCLDFTVDPLTKIY

SEQ ID NO: 2786795 - protein, 26 aa, Entamoeba invadens
CKSGYYRLGLNCLRCSEKCSTCVNAE

SEQ ID NO: 2786796 - protein, 22 aa, Entamoeba invadens
CKSHAVWWIILLVILFLIICVV

SEQ ID NO: 2786797 - protein, 19 aa, Entamoeba invadens
CKSLAGLRMDRTCYGSVGT

SEQ ID NO: 2786798 - protein, 22 aa, Entamoeba invadens
CKSQAVWWVILVVVMFVLIVLF

SEQ ID NO: 2786799 - protein, 29 aa, Entamoeba invadens
CKSTIGGKCSSCIKGFFLTAYFKCDSCSK

SEQ ID NO: 2786800 - protein, 23 aa, Entamoeba invadens
CKTAIEFNAPFSLVEYKSNLGMK

SEQ ID NO: 2786801 - protein, 24 aa, Entamoeba invadens
CKTALRYDIIFGTIVGFIVFIVLL

SEQ ID NO: 2786802 - protein, 17 aa, Entamoeba invadens
CKTCATNFTRKCVECNT

SEQ ID NO: 2786803 - protein, 21 aa, Entamoeba invadens
CKTCHSGHVLVGGSCSICSAG

SEQ ID NO: 2786804 - protein, 20 aa, Entamoeba invadens
CKTCTTLFVRYCKECNDHFK

SEQ ID NO: 2786805 - protein, 19 aa, Entamoeba invadens
CKTFLPSGEKCAICKDGFV

SEQ ID NO: 2786806 - protein, 21 aa, Entamoeba invadens
CKTGFRINPSTGMCINCDSYC

SEQ ID NO: 2786807 - protein, 17 aa, Entamoeba invadens
CKTHYKIPCEDYECERC

SEQ ID NO: 2786808 - protein, 17 aa, Entamoeba invadens
CKTNYILSDGICIHKSE

SEQ ID NO: 2786809 - protein, 20 aa, Entamoeba invadens
CKTPSSSICLLQCGEDLLFS

SEQ ID NO: 2786810 - protein, 25 aa, Entamoeba invadens
CKTSSCKTCVAGFVLVNYICKRCDL

SEQ ID NO: 2786811 - protein, 17 aa, Entamoeba invadens
CKVCAENKCYECKENKF

SEQ ID NO: 2786812 - protein, 18 aa, Entamoeba invadens
CKVCKIKGKVVIKSNFLC

SEQ ID NO: 2786813 - protein, 24 aa, Entamoeba invadens
CKVCSKDACTSCTTDSYYIDTKEC

SEQ ID NO: 2786814 - protein, 21 aa, Entamoeba invadens
CKVTDQYGCLECEYDKKLSDE

SEQ ID NO: 2786815 - protein, 33 aa, Entamoeba invadens
CKYDECARCTLNLCDRCKEGSHLDNALYYCFKC

SEQ ID NO: 2786816 - protein, 19 aa, Entamoeba invadens
CKYKDFSTYYNIKVSSSLS

SEQ ID NO: 2786817 - protein, 23 aa, Entamoeba invadens
CKYKLVIEPDVAILRKGEACEFK

SEQ ID NO: 2786818 - protein, 25 aa, Entamoeba invadens
CLAGCVFCEYDVLGKIVFDIYKEMK

SEQ ID NO: 2786819 - protein, 28 aa, Entamoeba invadens
CLALMFKRTRKLFLYLILFVFLSGALTL

SEQ ID NO: 2786820 - protein, 17 aa, Entamoeba invadens
CLAPYCQGNTCLFKDNC

SEQ ID NO: 2786821 - protein, 21 aa, Entamoeba invadens
CLCLILFFSEFKNIYFQINVF

SEQ ID NO: 2786822 - protein, 21 aa, Entamoeba invadens
CLCNSGRVPKNFTSGIYCVIP

SEQ ID NO: 2786823 - protein, 20 aa, Entamoeba invadens
CLDAFKHFIVEKVKKTELKK

SEQ ID NO: 2786824 - protein, 25 aa, Entamoeba invadens
CLDAFKMKDGICADNFNTKEDDHKE

SEQ ID NO: 2786825 - protein, 28 aa, Entamoeba invadens
CLDCPNNCKRCVNQKCVLCEDKYSYDSE

SEQ ID NO: 2786826 - protein, 22 aa, Entamoeba invadens
CLDEFFKLSLFTKGIQEMMLNI

SEQ ID NO: 2786827 - protein, 23 aa, Entamoeba invadens
CLDKYLQVFCFNKDFTFSSGSKF

SEQ ID NO: 2786828 - protein, 20 aa, Entamoeba invadens
CLDSICIDCSYNSKKCLRCQ

SEQ ID NO: 2786829 - protein, 18 aa, Entamoeba invadens
CLEAAGVVTQPGQVFTFT

SEQ ID NO: 2786830 - protein, 20 aa, Entamoeba invadens
CLECADGYFKFSGDSKGLCR

SEQ ID NO: 2786831 - protein, 17 aa, Entamoeba invadens
CLECFSPYQLVNGSCEF

SEQ ID NO: 2786832 - protein, 17 aa, Entamoeba invadens
CLEGEKCTDCGSNYFMD

SEQ ID NO: 2786833 - protein, 18 aa, Entamoeba invadens
CLEGISFLENGQCITCDK

SEQ ID NO: 2786834 - protein, 18 aa, Entamoeba invadens
CLFDESIWTFDGFAVDAT

SEQ ID NO: 2786835 - protein, 19 aa, Entamoeba invadens
CLFDMKKTNIEFVKTDIVD

SEQ ID NO: 2786836 - protein, 18 aa, Entamoeba invadens
CLFDMKKTNIEFVKTEIA

SEQ ID NO: 2786837 - protein, 18 aa, Entamoeba invadens
CLFDMKKTNIEFVKTEIV

SEQ ID NO: 2786838 - protein, 25 aa, Entamoeba invadens
CLFIFSACFILSFIQFVMLIVEISL

SEQ ID NO: 2786839 - protein, 19 aa, Entamoeba invadens
CLFVPTLVFFLFGLDVTAE

SEQ ID NO: 2786840 - protein, 21 aa, Entamoeba invadens
CLGEFILQNGMCVFGLSTCEQ

SEQ ID NO: 2786841 - protein, 19 aa, Entamoeba invadens
CLICQPKYFLLNGTCELLT

SEQ ID NO: 2786842 - protein, 18 aa, Entamoeba invadens
CLIFSLGENCYQVDQENQ

SEQ ID NO: 2786843 - protein, 17 aa, Entamoeba invadens
CLISKGNYCVKCVDDYH

SEQ ID NO: 2786844 - protein, 20 aa, Entamoeba invadens
CLIVACVLSAMFCGIALMVL

SEQ ID NO: 2786845 - protein, 18 aa, Entamoeba invadens
CLIVRPLRSSHCSYCNNC

SEQ ID NO: 2786846 - protein, 20 aa, Entamoeba invadens
CLKCGADNVLHCKENRCSLY

SEQ ID NO: 2786847 - protein, 20 aa, Entamoeba invadens
CLKCQPSNYLLNGKCVQFTN

SEQ ID NO: 2786848 - protein, 18 aa, Entamoeba invadens
CLKCQPSNYLLNVKCVQF

SEQ ID NO: 2786849 - protein, 21 aa, Entamoeba invadens
CLKNPCKRNQFYYNVGCKECN

SEQ ID NO: 2786850 - protein, 20 aa, Entamoeba invadens
CLKVGYYGCEVCADGYYLSH

SEQ ID NO: 2786851 - protein, 28 aa, Entamoeba invadens
CLKVGYYGCKVCADGYYLLNSRCTKCNE

SEQ ID NO: 2786852 - protein, 21 aa, Entamoeba invadens
CLLCNATTCFSCETINNITYT

SEQ ID NO: 2786853 - protein, 18 aa, Entamoeba invadens
CLLCSSEETCLICDINFV

SEQ ID NO: 2786854 - protein, 18 aa, Entamoeba invadens
CLLHSAFSQITCVANGNN

SEQ ID NO: 2786855 - protein, 27 aa, Entamoeba invadens
CLLKRSNRCLKCSDGYLLTENHCQNVS

SEQ ID NO: 2786856 - protein, 28 aa, Entamoeba invadens
CLLKRSNRCLKCSNGYLLSEGYCQNTSS

SEQ ID NO: 2786857 - protein, 21 aa, Entamoeba invadens
CLLKSGMCISERVLIYPNCSF

SEQ ID NO: 2786858 - protein, 18 aa, Entamoeba invadens
CLLLSGFFIGKRVTNTSI

SEQ ID NO: 2786859 - protein, 30 aa, Entamoeba invadens
CLLMDICLELGYFFECKRVAKGKRNYKTEQ

SEQ ID NO: 2786860 - protein, 18 aa, Entamoeba invadens
CLLNNPFGCIKCKDTYYL

SEQ ID NO: 2786861 - protein, 22 aa, Entamoeba invadens
CLLQDILKLILMLNEEFSTMSQ

SEQ ID NO: 2786862 - protein, 24 aa, Entamoeba invadens
CLLVSESKCKRCDINYYVTSSGSC

SEQ ID NO: 2786863 - protein, 27 aa, Entamoeba invadens
CLLVVTACGLVVIFGMIIAKFAKKKTG

SEQ ID NO: 2786864 - protein, 25 aa, Entamoeba invadens
CLMCDLTKCYLCENGYDIQSDGLCK

SEQ ID NO: 2786865 - protein, 26 aa, Entamoeba invadens
CLNAFTCLSCSSGLYLNEHQCNNNTE

SEQ ID NO: 2786866 - protein, 20 aa, Entamoeba invadens
CLNCSINACSQCLDGYGLYN

SEQ ID NO: 2786867 - protein, 20 aa, Entamoeba invadens
CLNNATSFGCSKCQDGYYTY

SEQ ID NO: 2786868 - protein, 27 aa, Entamoeba invadens
CLNSTMCLSCVDGFFLSDHICKSNDAL

SEQ ID NO: 2786869 - protein, 20 aa, Entamoeba invadens
CLPCPGDCLNCFKESGECTT

SEQ ID NO: 2786870 - protein, 31 aa, Entamoeba invadens
CLPCPTNCLHCVKGKCVLCDKEYIVDVNRNC

SEQ ID NO: 2786871 - protein, 19 aa, Entamoeba invadens
CLPCSTITGCLKCSPTQKE

SEQ ID NO: 2786872 - protein, 33 aa, Entamoeba invadens
CLPFCKKCSGLKCILCKGNSVINYNGFCYTPDG

SEQ ID NO: 2786873 - protein, 20 aa, Entamoeba invadens
CLPNCVCAKGYTNTPSGYCK

SEQ ID NO: 2786874 - protein, 18 aa, Entamoeba invadens
CLPPLFRFLQCFRSARDS

SEQ ID NO: 2786875 - protein, 20 aa, Entamoeba invadens
CLPSERRCVCNPSYGGDDCH

SEQ ID NO: 2786876 - protein, 21 aa, Entamoeba invadens
CLPSMRICVVFDLVEKITHLY

SEQ ID NO: 2786877 - protein, 21 aa, Entamoeba invadens
CLQCSNGYYLGKVIPRCYECS

SEQ ID NO: 2786878 - protein, 19 aa, Entamoeba invadens
CLQTNIGNKVMRNEVIYQC

SEQ ID NO: 2786879 - protein, 19 aa, Entamoeba invadens
CLQTPSFIQFLAVMLTTSA

SEQ ID NO: 2786880 - protein, 21 aa, Entamoeba invadens
CLRCSDGYHISKSVCVKCEYP

SEQ ID NO: 2786881 - protein, 18 aa, Entamoeba invadens
CLREQIAKIFIKYQSSSN

SEQ ID NO: 2786882 - protein, 20 aa, Entamoeba invadens
CLSCDEYFCHSCEEKYVLSN

SEQ ID NO: 2786883 - protein, 21 aa, Entamoeba invadens
CLSCDEYFCHSCEKKYVLSNG

SEQ ID NO: 2786884 - protein, 18 aa, Entamoeba invadens
CLSCFTNYFLLTNNTQCI

SEQ ID NO: 2786885 - protein, 22 aa, Entamoeba invadens
CLSCINSSFYISRNVCKSQEDL

SEQ ID NO: 2786886 - protein, 19 aa, Entamoeba invadens
CLSCPYSYGISDGYCVKCD

SEQ ID NO: 2786887 - protein, 18 aa, Entamoeba invadens
CLSCSKIGCVNDCQDGMY

SEQ ID NO: 2786888 - protein, 19 aa, Entamoeba invadens
CLSCVSGYYLNTSLTCVEC

SEQ ID NO: 2786889 - protein, 19 aa, Entamoeba invadens
CLSCYNATYCISCHSKYFL

SEQ ID NO: 2786890 - protein, 24 aa, Entamoeba invadens
CLSDCAKGMRFLHANGILHRDLKP

SEQ ID NO: 2786891 - protein, 19 aa, Entamoeba invadens
CLSGFFCPNGKNIYPCPPG

SEQ ID NO: 2786892 - protein, 25 aa, Entamoeba invadens
CLSLCLTTTFAYNWEPNNPVPSSEY

SEQ ID NO: 2786893 - protein, 21 aa, Entamoeba invadens
CLSLDSIPHCVAIKHSKCSKC

SEQ ID NO: 2786894 - protein, 21 aa, Entamoeba invadens
CLSLDTSECITSFNTFCSGCS

SEQ ID NO: 2786895 - protein, 23 aa, Entamoeba invadens
CLSPTTICKLSIESDTSSDISKN

SEQ ID NO: 2786896 - protein, 24 aa, Entamoeba invadens
CLSTSTFCLSCKEGTFLSQHKCIT

SEQ ID NO: 2786897 - protein, 26 aa, Entamoeba invadens
CLTCCSRIQCRSCLDKNVLNDGKCQS

SEQ ID NO: 2786898 - protein, 20 aa, Entamoeba invadens
CLTCDAGYYSSIRASSCSIC

SEQ ID NO: 2786899 - protein, 26 aa, Entamoeba invadens
CLTCDSLKCFICENGYDLKSDGMCYD

SEQ ID NO: 2786900 - protein, 24 aa, Entamoeba invadens
CLTCGQNGCTLCKSTYYVEGKRCG

SEQ ID NO: 2786901 - protein, 20 aa, Entamoeba invadens
CLTCGTSPSNCLSCHENTFL

SEQ ID NO: 2786902 - protein, 17 aa, Entamoeba invadens
CLTCKSSTYCLICNLTT

SEQ ID NO: 2786903 - protein, 19 aa, Entamoeba invadens
CLTCKSSYYPSGVGCSPCI

SEQ ID NO: 2786904 - protein, 19 aa, Entamoeba invadens
CLTCNLYSTKCTLCDSSLV

SEQ ID NO: 2786905 - protein, 19 aa, Entamoeba invadens
CLTCNSFNLCLTCNSTYDK

SEQ ID NO: 2786906 - protein, 30 aa, Entamoeba invadens
CLTCTTYSRCLSCSDSLFLVGNTCQTMNEG

SEQ ID NO: 2786907 - protein, 22 aa, Entamoeba invadens
CLTCYNKADFCTSCEDGYYLSE

SEQ ID NO: 2786908 - protein, 20 aa, Entamoeba invadens
CLTGFLLKEKVNCLYRNGGL

SEQ ID NO: 2786909 - protein, 33 aa, Entamoeba invadens
CLTIFGLGCGIFLAMYFLFGLSFISGEKLISRM

SEQ ID NO: 2786910 - protein, 30 aa, Entamoeba invadens
CLTSSKSGNCFTCAEGLHLDGTRSCVSEGT

SEQ ID NO: 2786911 - protein, 23 aa, Entamoeba invadens
CLTYDGLYCIECQQGYYISNMLC

SEQ ID NO: 2786912 - protein, 19 aa, Entamoeba invadens
CLVSLEFSKTFQMLFMVFD

SEQ ID NO: 2786913 - protein, 19 aa, Entamoeba invadens
CLYIALFFLASPWRQCILI

SEQ ID NO: 2786914 - protein, 25 aa, Entamoeba invadens
CLYRDFTSLLSIWITFLYIVIVCIF

SEQ ID NO: 2786915 - protein, 28 aa, Entamoeba invadens
CLYTKANRCLFCSKGYHLQTNGTCSLIN

SEQ ID NO: 2786916 - protein, 27 aa, Entamoeba invadens
CLYTKANRCLSCSKGYHLQTNGTCSLI

SEQ ID NO: 2786917 - protein, 19 aa, Entamoeba invadens
CMAHTTWYFIILLMCGVVF

SEQ ID NO: 2786918 - protein, 22 aa, Entamoeba invadens
CMCHRLNIAEGFMWATGDTEVF

SEQ ID NO: 2786919 - protein, 18 aa, Entamoeba invadens
CMCLDGYVPIYANDTYKC

SEQ ID NO: 2786920 - protein, 20 aa, Entamoeba invadens
CMFEMKRSNIQFVTLGNDTV

SEQ ID NO: 2786921 - protein, 19 aa, Entamoeba invadens
CMGFSCILVAPGWFYFCPT

SEQ ID NO: 2786922 - protein, 20 aa, Entamoeba invadens
CMIINFLVVFASTYKSQEAQ

SEQ ID NO: 2786923 - protein, 20 aa, Entamoeba invadens
CMKPTCPNGDKGTCSIQDNC

SEQ ID NO: 2786924 - protein, 17 aa, Entamoeba invadens
CMMCMNIDPEKLSDEAL

SEQ ID NO: 2786925 - protein, 28 aa, Entamoeba invadens
CMQISGNIFPLFMLKDYILKTVHLNKKL

SEQ ID NO: 2786926 - protein, 18 aa, Entamoeba invadens
CMRKERYQDWLFEQTCTG

SEQ ID NO: 2786927 - protein, 17 aa, Entamoeba invadens
CMSCFNATVCIECEGGL

SEQ ID NO: 2786928 - protein, 17 aa, Entamoeba invadens
CMTEFEYKNGLCQCKDS

SEQ ID NO: 2786929 - protein, 19 aa, Entamoeba invadens
CNAFPPDKFKFAWDIADFI

SEQ ID NO: 2786930 - protein, 17 aa, Entamoeba invadens
CNAGSKLSGTTCTRITE

SEQ ID NO: 2786931 - protein, 22 aa, Entamoeba invadens
CNATHCLSCKTDSAVTYFLSLD

SEQ ID NO: 2786932 - protein, 17 aa, Entamoeba invadens
CNAVYRYFASGSTQHCD

SEQ ID NO: 2786933 - protein, 17 aa, Entamoeba invadens
CNCEDGTSVIEWDCINT

SEQ ID NO: 2786934 - protein, 25 aa, Entamoeba invadens
CNCKTTDTFKEWDCDNDDDISMKGI

SEQ ID NO: 2786935 - protein, 25 aa, Entamoeba invadens
CNCWEHCAADRVCIDEVVLDLKKLQ

SEQ ID NO: 2786936 - protein, 18 aa, Entamoeba invadens
CNDAFWFDFTTQKCEECS

SEQ ID NO: 2786937 - protein, 17 aa, Entamoeba invadens
CNDGYYRSGLYCEKCDV

SEQ ID NO: 2786938 - protein, 19 aa, Entamoeba invadens
CNDISYLFMSLVFIALLLI

SEQ ID NO: 2786939 - protein, 19 aa, Entamoeba invadens
CNDKYFLLFGKCVSCDDNC

SEQ ID NO: 2786940 - protein, 20 aa, Entamoeba invadens
CNDNNCKLCTKKYCVKCKSE

SEQ ID NO: 2786941 - protein, 23 aa, Entamoeba invadens
CNDPKLCKELGFYTIALKNPTGS

SEQ ID NO: 2786942 - protein, 19 aa, Entamoeba invadens
CNECKRKYYLTNNICNNNN

SEQ ID NO: 2786943 - protein, 18 aa, Entamoeba invadens
CNECTLYECTSCEKDYVL

SEQ ID NO: 2786944 - protein, 20 aa, Entamoeba invadens
CNEFCGLSKFVPMSLGSVVT

SEQ ID NO: 2786945 - protein, 17 aa, Entamoeba invadens
CNEGMFLSDHVCKSNDE

SEQ ID NO: 2786946 - protein, 30 aa, Entamoeba invadens
CNEKFPNCTLCDFKRCYSCEENYKLYESKC

SEQ ID NO: 2786947 - protein, 25 aa, Entamoeba invadens
CNEPLKTRFNCYAHVWDSHLRAYYT

SEQ ID NO: 2786948 - protein, 23 aa, Entamoeba invadens
CNESFFLQNGRCFSCKESCATCV

SEQ ID NO: 2786949 - protein, 24 aa, Entamoeba invadens
CNESGCLSCKSGMYLSTHNNVTFC

SEQ ID NO: 2786950 - protein, 23 aa, Entamoeba invadens
CNESYYLQNGRCFSCKESCATCV

SEQ ID NO: 2786951 - protein, 23 aa, Entamoeba invadens
CNESYYLQNGRCFSCKESCVTCV

SEQ ID NO: 2786952 - protein, 21 aa, Entamoeba invadens
CNFKKTKINGIAMRNTSIDCI

SEQ ID NO: 2786953 - protein, 19 aa, Entamoeba invadens
CNGCVPGYYLQSGDKSPCL

SEQ ID NO: 2786954 - protein, 27 aa, Entamoeba invadens
CNGKEQCSVCKTGFLLEQVTLKCVSEC

SEQ ID NO: 2786955 - protein, 24 aa, Entamoeba invadens
CNIANCKLCSFGNSSSCIVCNDRY

SEQ ID NO: 2786956 - protein, 18 aa, Entamoeba invadens
CNIDNCYIAPVGGDDCVF

SEQ ID NO: 2786957 - protein, 17 aa, Entamoeba invadens
CNIKCRKCTGNAEKCQD

SEQ ID NO: 2786958 - protein, 17 aa, Entamoeba invadens
CNIKTTKGCISCFNGYY

SEQ ID NO: 2786959 - protein, 22 aa, Entamoeba invadens
CNIKTTKGCISCFNGYYRSNIT

SEQ ID NO: 2786960 - protein, 23 aa, Entamoeba invadens
CNIKTTKGCITCFNGYYRSDGTC

SEQ ID NO: 2786961 - protein, 17 aa, Entamoeba invadens
CNILYSQCENGTFDSTL

SEQ ID NO: 2786962 - protein, 26 aa, Entamoeba invadens
CNIVNCKLCSKGNINLCSECNDGHGL

SEQ ID NO: 2786963 - protein, 32 aa, Entamoeba invadens
CNKCPNHCLRCFKSNCLLCKVNYQINSLFGCS

SEQ ID NO: 2786964 - protein, 32 aa, Entamoeba invadens
CNKCPNHCLRCFKSNCLLCKVNYQINSSFGCS

SEQ ID NO: 2786965 - protein, 19 aa, Entamoeba invadens
CNKCSSAFDRKCVMCNTGY

SEQ ID NO: 2786966 - protein, 20 aa, Entamoeba invadens
CNKCSSAFDRKCVMCNTGYY

SEQ ID NO: 2786967 - protein, 19 aa, Entamoeba invadens
CNKCSSAFDRKCVTCNTGY

SEQ ID NO: 2786968 - protein, 27 aa, Entamoeba invadens
CNKCTNDAMCLLCNVDYFLLSDHTQCI

SEQ ID NO: 2786969 - protein, 22 aa, Entamoeba invadens
CNKCTNGNLVKCYGVDGVAAWT

SEQ ID NO: 2786970 - protein, 19 aa, Entamoeba invadens
CNKCTRGTYQNEMGKSKCD

SEQ ID NO: 2786971 - protein, 17 aa, Entamoeba invadens
CNLACFLSGFKVNVNFN

SEQ ID NO: 2786972 - protein, 25 aa, Entamoeba invadens
CNLMERMRCPYILGFIGSVTMPDQL

SEQ ID NO: 2786973 - protein, 27 aa, Entamoeba invadens
CNLNVCLECVTGFYFQLGNCVTCPNTC

SEQ ID NO: 2786974 - protein, 19 aa, Entamoeba invadens
CNLTNYKTSSGICLPQNSI

SEQ ID NO: 2786975 - protein, 18 aa, Entamoeba invadens
CNLVRPLRASHCKMCNRC

SEQ ID NO: 2786976 - protein, 20 aa, Entamoeba invadens
CNMGNPNLCMVCNDGYYVYG

SEQ ID NO: 2786977 - protein, 20 aa, Entamoeba invadens
CNMLSEIHCKSIVITTNNEV

SEQ ID NO: 2786978 - protein, 21 aa, Entamoeba invadens
CNNCGDDICYFCENEMCLICF

SEQ ID NO: 2786979 - protein, 23 aa, Entamoeba invadens
CNNCGDDNCYFCENEMCSICFKN

SEQ ID NO: 2786980 - protein, 19 aa, Entamoeba invadens
CNNGFLLYDGICINKISQA

SEQ ID NO: 2786981 - protein, 22 aa, Entamoeba invadens
CNNKEVLSCTICESNYYIKNKK

SEQ ID NO: 2786982 - protein, 22 aa, Entamoeba invadens
CNNNNCKLCQAGSVINDTGKCE

SEQ ID NO: 2786983 - protein, 34 aa, Entamoeba invadens
CNPEIVSLKKGFACEFEVFVTPNFTCVFENKILI

SEQ ID NO: 2786984 - protein, 24 aa, Entamoeba invadens
CNPGCPYSNCLTNYTCKTSCGPNY

SEQ ID NO: 2786985 - protein, 18 aa, Entamoeba invadens
CNPMCRMCVSQPNNCVAC

SEQ ID NO: 2786986 - protein, 17 aa, Entamoeba invadens
CNQGYSLEDGVCYQESP

SEQ ID NO: 2786987 - protein, 18 aa, Entamoeba invadens
CNQKRYNTNLAIATEKHI

SEQ ID NO: 2786988 - protein, 20 aa, Entamoeba invadens
CNQSSIKNCDVCWNENVITT

SEQ ID NO: 2786989 - protein, 24 aa, Entamoeba invadens
CNQVCLKLVYIGVGLFFSSMIRTI

SEQ ID NO: 2786990 - protein, 22 aa, Entamoeba invadens
CNRCANSVCKQCNSYTSQCSSC

SEQ ID NO: 2786991 - protein, 19 aa, Entamoeba invadens
CNSCSLKYEHSHLCDKTHV

SEQ ID NO: 2786992 - protein, 18 aa, Entamoeba invadens
CNSCYTGYILKDGLCIQC

SEQ ID NO: 2786993 - protein, 17 aa, Entamoeba invadens
CNSDTTVNCKLKFSKTY

SEQ ID NO: 2786994 - protein, 19 aa, Entamoeba invadens
CNSGFYPKQYGDFKCQKCD

SEQ ID NO: 2786995 - protein, 29 aa, Entamoeba invadens
CNSKRCSKCTKGVLDLNGFCTLNSGCEII

SEQ ID NO: 2786996 - protein, 25 aa, Entamoeba invadens
CNSKRCSKCTKGVLDSNGYCTLNSG

SEQ ID NO: 2786997 - protein, 26 aa, Entamoeba invadens
CNSLIPSICCLLIYFMKGTYKIEYCN

SEQ ID NO: 2786998 - protein, 22 aa, Entamoeba invadens
CNSNLYLSLGILELVVSALCFV

SEQ ID NO: 2786999 - protein, 22 aa, Entamoeba invadens
CNSQECFQCASGYTLVKNGKAC

SEQ ID NO: 2787000 - protein, 24 aa, Entamoeba invadens
CNSQECFQCSYGYTLVKNGKECVD

SEQ ID NO: 2787001 - protein, 21 aa, Entamoeba invadens
CNSQECFQCTSGYTLVKNGKS

SEQ ID NO: 2787002 - protein, 20 aa, Entamoeba invadens
CNSSSRLARMVATLEHDSVY

SEQ ID NO: 2787003 - protein, 25 aa, Entamoeba invadens
CNSTDCLKCLHSILNTNGECVNDIQ

SEQ ID NO: 2787004 - protein, 22 aa, Entamoeba invadens
CNSTHCYQCAKVAETQYYLSID

SEQ ID NO: 2787005 - protein, 17 aa, Entamoeba invadens
CNTCFDPGNNGSCESCI

SEQ ID NO: 2787006 - protein, 24 aa, Entamoeba invadens
CNTCGQNGCTLCKNTYYVEGKRCG

SEQ ID NO: 2787007 - protein, 27 aa, Entamoeba invadens
CNTCGQTGCTLCKSTFYVEGKRCGKCT

SEQ ID NO: 2787008 - protein, 31 aa, Entamoeba invadens
CNTCSPLFEKKCVKCGIGYYVEENGSCSQCF

SEQ ID NO: 2787009 - protein, 19 aa, Entamoeba invadens
CNTGCAILLNRNRSASIAT

SEQ ID NO: 2787010 - protein, 17 aa, Entamoeba invadens
CNTGFYFENGVCVTCPN

SEQ ID NO: 2787011 - protein, 18 aa, Entamoeba invadens
CNTGFYLDQGKCVQLPNC

SEQ ID NO: 2787012 - protein, 18 aa, Entamoeba invadens
CNTHSPNVCGLRSAEELR

SEQ ID NO: 2787013 - protein, 21 aa, Entamoeba invadens
CNTRKSSDCVGCITNHHIEDH

SEQ ID NO: 2787014 - protein, 20 aa, Entamoeba invadens
CNVFEMCPLLSHVEIVKTRE

SEQ ID NO: 2787015 - protein, 20 aa, Entamoeba invadens
CNVKGCSKCDPIFVGYISSE

SEQ ID NO: 2787016 - protein, 24 aa, Entamoeba invadens
CNVRDSIYISIRYSNFKRIYKSVV

SEQ ID NO: 2787017 - protein, 19 aa, Entamoeba invadens
CPCHLLDVSCNLNYGNINT

SEQ ID NO: 2787018 - protein, 20 aa, Entamoeba invadens
CPCKGELCTVAIPSDLTSLV

SEQ ID NO: 2787019 - protein, 18 aa, Entamoeba invadens
CPCSGQMCFVHTMKQKVT

SEQ ID NO: 2787020 - protein, 22 aa, Entamoeba invadens
CPDDCLRCFNSNCLLCEVNYQI

SEQ ID NO: 2787021 - protein, 25 aa, Entamoeba invadens
CPDDLFKYKELRTIDLKNNPLSVIP

SEQ ID NO: 2787022 - protein, 27 aa, Entamoeba invadens
CPDHCLRCSNSNCLLCEVNYRINSSFG

SEQ ID NO: 2787023 - protein, 27 aa, Entamoeba invadens
CPDNCKRCTSTSCLKCEDGTEARGNEC

SEQ ID NO: 2787024 - protein, 17 aa, Entamoeba invadens
CPDQNCIYCEDTTQKCI

SEQ ID NO: 2787025 - protein, 35 aa, Entamoeba invadens
CPEDRMARVVEKFEFPMYMIAVIIIFVLVLAVIVA

SEQ ID NO: 2787026 - protein, 19 aa, Entamoeba invadens
CPELNCKVENSPTACYCQY

SEQ ID NO: 2787027 - protein, 22 aa, Entamoeba invadens
CPEMYYKSEADKMCKKCTDGCK

SEQ ID NO: 2787028 - protein, 29 aa, Entamoeba invadens
CPENCKNCYDNENCILCETGYFLNNGMCL

SEQ ID NO: 2787029 - protein, 23 aa, Entamoeba invadens
CPESCTLCKSNTLCTWCLDSYVL

SEQ ID NO: 2787030 - protein, 17 aa, Entamoeba invadens
CPFIAGVMMDFIDRDWC

SEQ ID NO: 2787031 - protein, 17 aa, Entamoeba invadens
CPFSCLNGFCSVALEGC

SEQ ID NO: 2787032 - protein, 23 aa, Entamoeba invadens
CPGYFCVSCICSMRDGTNCCARW

SEQ ID NO: 2787033 - protein, 25 aa, Entamoeba invadens
CPHIFQHIFFLKLTHVIIAAPNIRS

SEQ ID NO: 2787034 - protein, 17 aa, Entamoeba invadens
CPIDFSRKCIACQSNMY

SEQ ID NO: 2787035 - protein, 18 aa, Entamoeba invadens
CPIEYNYDIGCILEQKDM

SEQ ID NO: 2787036 - protein, 17 aa, Entamoeba invadens
CPINCTICDNAVCCLAC

SEQ ID NO: 2787037 - protein, 17 aa, Entamoeba invadens
CPINTPINKKVVCTLKL

SEQ ID NO: 2787038 - protein, 21 aa, Entamoeba invadens
CPKGPLRILVNLAQKREQPIP

SEQ ID NO: 2787039 - protein, 22 aa, Entamoeba invadens
CPKNCLRCERGICTECDTQNSE

SEQ ID NO: 2787040 - protein, 18 aa, Entamoeba invadens
CPLIKTSCITCKSQFADG

SEQ ID NO: 2787041 - protein, 18 aa, Entamoeba invadens
CPMKAYSYTTNTGYPQFL

SEQ ID NO: 2787042 - protein, 18 aa, Entamoeba invadens
CPNGCSSCNFLLSCKTCF

SEQ ID NO: 2787043 - protein, 20 aa, Entamoeba invadens
CPNGSPLPCKLGYYSTGGTT

SEQ ID NO: 2787044 - protein, 20 aa, Entamoeba invadens
CPNLKHLLEPIISMLSSIIL

SEQ ID NO: 2787045 - protein, 22 aa, Entamoeba invadens
CPNSILPKMIFTFSSKRWYFLF

SEQ ID NO: 2787046 - protein, 34 aa, Entamoeba invadens
CPNSILPKMTFTFSSKRWYFLFVGIHEESNVEMV

SEQ ID NO: 2787047 - protein, 18 aa, Entamoeba invadens
CPNYCLRCNDTTCLLCDQ

SEQ ID NO: 2787048 - protein, 28 aa, Entamoeba invadens
CPSAMPITLPFTALHTFNSKKTTTFCRG

SEQ ID NO: 2787049 - protein, 23 aa, Entamoeba invadens
CPSECTSCLNSEKCITCLENRFL

SEQ ID NO: 2787050 - protein, 30 aa, Entamoeba invadens
CPSLLKHPFKVLAYICVTQFTLGLLSPFLM

SEQ ID NO: 2787051 - protein, 22 aa, Entamoeba invadens
CPSNCMSCFNTSYCLSCANDSV

SEQ ID NO: 2787052 - protein, 25 aa, Entamoeba invadens
CPSNCRRCDNNICFSCFTNYSLYEN

SEQ ID NO: 2787053 - protein, 18 aa, Entamoeba invadens
CPSSPTLCESCIDNYILT

SEQ ID NO: 2787054 - protein, 17 aa, Entamoeba invadens
CPTEFNCNLTYSGVEKC

SEQ ID NO: 2787055 - protein, 18 aa, Entamoeba invadens
CPTRGVVSGCEIYNSGGN

SEQ ID NO: 2787056 - protein, 19 aa, Entamoeba invadens
CPTSPIINGILEDKYYQIT

SEQ ID NO: 2787057 - protein, 30 aa, Entamoeba invadens
CPVAIVGYLYCCFCTSLLDRNKEKKEKEKK

SEQ ID NO: 2787058 - protein, 35 aa, Entamoeba invadens
CPVTCKSCFNSSYCLTCKSGMFLNAQFECEESTDL

SEQ ID NO: 2787059 - protein, 31 aa, Entamoeba invadens
CPYCPNERLERWWFILTDMRNSVVLNAAHGY

SEQ ID NO: 2787060 - protein, 20 aa, Entamoeba invadens
CPYTNCFVKTQFREIIIGDL

SEQ ID NO: 2787061 - protein, 18 aa, Entamoeba invadens
CPYYFPERVQTFFDVIVK

SEQ ID NO: 2787062 - protein, 17 aa, Entamoeba invadens
CQACPPGTTSDEYRVQC

SEQ ID NO: 2787063 - protein, 27 aa, Entamoeba invadens
CQAGINGCETCFPGYYINHDDPKQYIC

SEQ ID NO: 2787064 - protein, 22 aa, Entamoeba invadens
CQDASKRFFAFKEYLEDKLQLY

SEQ ID NO: 2787065 - protein, 18 aa, Entamoeba invadens
CQDKSCLKCSQGKEKCDK

SEQ ID NO: 2787066 - protein, 19 aa, Entamoeba invadens
CQDKSCLKCSQGKEKCDKC

SEQ ID NO: 2787067 - protein, 24 aa, Entamoeba invadens
CQENCLLCDSTLCTKCVDNYILKN

SEQ ID NO: 2787068 - protein, 22 aa, Entamoeba invadens
CQERCVYRTHFVRLIEESLLFF

SEQ ID NO: 2787069 - protein, 20 aa, Entamoeba invadens
CQFDEVLKEMGLLVNPLFPV

SEQ ID NO: 2787070 - protein, 24 aa, Entamoeba invadens
CQHCDIYYVYSFPDVTYFTENDIK

SEQ ID NO: 2787071 - protein, 25 aa, Entamoeba invadens
CQHCSNNKCVLCKRNYYFNNNGICT

SEQ ID NO: 2787072 - protein, 17 aa, Entamoeba invadens
CQICSLKTFNFNNSSCE

SEQ ID NO: 2787073 - protein, 18 aa, Entamoeba invadens
CQIEKFCFYGCAIISSVR

SEQ ID NO: 2787074 - protein, 18 aa, Entamoeba invadens
CQIFTWICEGGKMPRAGH

SEQ ID NO: 2787075 - protein, 28 aa, Entamoeba invadens
CQIGCQKCTKSGCTLCENNSSLILNGNC

SEQ ID NO: 2787076 - protein, 17 aa, Entamoeba invadens
CQIKSSKGCISCLDGYY

SEQ ID NO: 2787077 - protein, 19 aa, Entamoeba invadens
CQKCADNGERKCINCENGM

SEQ ID NO: 2787078 - protein, 23 aa, Entamoeba invadens
CQKCSQPNCKTCSTTSNTCDECT

SEQ ID NO: 2787079 - protein, 19 aa, Entamoeba invadens
CQKGFFLSDNYCWETSLYK

SEQ ID NO: 2787080 - protein, 20 aa, Entamoeba invadens
CQKLKRPTCYSRIVNPFMTF

SEQ ID NO: 2787081 - protein, 23 aa, Entamoeba invadens
CQMLERISVVWSFEHADILFFQG

SEQ ID NO: 2787082 - protein, 25 aa, Entamoeba invadens
CQNECLQCQNGFYLNAGRCVKCANC

SEQ ID NO: 2787083 - protein, 20 aa, Entamoeba invadens
CQNFAFALMSVFKFWDFKGM

SEQ ID NO: 2787084 - protein, 33 aa, Entamoeba invadens
CQNRGYGWKLYWDGLCDWVLFTGECCENLHTYY

SEQ ID NO: 2787085 - protein, 30 aa, Entamoeba invadens
CQPNCKYCSSSLCQQCYPGYYTQQAFCNKI

SEQ ID NO: 2787086 - protein, 24 aa, Entamoeba invadens
CQRCSNNKCVLCEKDYYYDKDGTC

SEQ ID NO: 2787087 - protein, 17 aa, Entamoeba invadens
CQRIGRLTTSEGMGEVQ

SEQ ID NO: 2787088 - protein, 17 aa, Entamoeba invadens
CQRKPKYVIDVSIAVCG

SEQ ID NO: 2787089 - protein, 17 aa, Entamoeba invadens
CQSCFSFDPNCIICASD

SEQ ID NO: 2787090 - protein, 22 aa, Entamoeba invadens
CQSCPNDTCERCESGFELVSTL

SEQ ID NO: 2787091 - protein, 23 aa, Entamoeba invadens
CQSCVKGYYLWKATDINPIPSCR

SEQ ID NO: 2787092 - protein, 23 aa, Entamoeba invadens
CQSNCLTCGTSPSNCLSCDENTF

SEQ ID NO: 2787093 - protein, 31 aa, Entamoeba invadens
CQSNCLTCGTSPSNCLSCYEDAFLSESRCIT

SEQ ID NO: 2787094 - protein, 18 aa, Entamoeba invadens
CQSYEFFNKTTLKCAFND

SEQ ID NO: 2787095 - protein, 19 aa, Entamoeba invadens
CQTCALNGERKCLTCKDKY

SEQ ID NO: 2787096 - protein, 17 aa, Entamoeba invadens
CQTCLNGYYLSDYHCKK

SEQ ID NO: 2787097 - protein, 27 aa, Entamoeba invadens
CQTKTVGKCSVCGGSFSEGSDCYKCLN

SEQ ID NO: 2787098 - protein, 20 aa, Entamoeba invadens
CQTPNCKFCEGNKCKRCAND

SEQ ID NO: 2787099 - protein, 20 aa, Entamoeba invadens
CQYAKNVLRAEEFVTSEKTT

SEQ ID NO: 2787100 - protein, 20 aa, Entamoeba invadens
CQYCSYDFTRQCKVCKSNYY

SEQ ID NO: 2787101 - protein, 18 aa, Entamoeba invadens
CRAAYCDVGYKFDMFNSV

SEQ ID NO: 2787102 - protein, 17 aa, Entamoeba invadens
CRDECPQCADEKMCLSC

SEQ ID NO: 2787103 - protein, 17 aa, Entamoeba invadens
CRDGYYPNGVLCVTCPE

SEQ ID NO: 2787104 - protein, 17 aa, Entamoeba invadens
CRDKVSYLVGRRCILCD

SEQ ID NO: 2787105 - protein, 17 aa, Entamoeba invadens
CRDLKTVVIPDIIVEYC

SEQ ID NO: 2787106 - protein, 26 aa, Entamoeba invadens
CRDNCKSCTSSVCLVCDTNYKNVNGN

SEQ ID NO: 2787107 - protein, 23 aa, Entamoeba invadens
CRDNCTLCSSFDLCYNCSENHIL

SEQ ID NO: 2787108 - protein, 19 aa, Entamoeba invadens
CRDNMGVAFFISEVIETIL

SEQ ID NO: 2787109 - protein, 21 aa, Entamoeba invadens
CREIVKAMLLDFSVLVVSIEI

SEQ ID NO: 2787110 - protein, 18 aa, Entamoeba invadens
CRGGPPLRSTVTHSIVSG

SEQ ID NO: 2787111 - protein, 23 aa, Entamoeba invadens
CRKCSDNLCIECDKGFYYEKGHC

SEQ ID NO: 2787112 - protein, 21 aa, Entamoeba invadens
CRKKVVWWVVFLLVLFVLFVF

SEQ ID NO: 2787113 - protein, 17 aa, Entamoeba invadens
CRKLCYYNQKFYKNDGV

SEQ ID NO: 2787114 - protein, 24 aa, Entamoeba invadens
CRKLSRWYIYVIVAAVVVILFIIV

SEQ ID NO: 2787115 - protein, 29 aa, Entamoeba invadens
CRLIDCLKILINCAEGFCLAIDDPILKAN

SEQ ID NO: 2787116 - protein, 17 aa, Entamoeba invadens
CRLQLDVPVVKYSEDNV

SEQ ID NO: 2787117 - protein, 20 aa, Entamoeba invadens
CRNIKTCTFCESNHFLLTNS

SEQ ID NO: 2787118 - protein, 22 aa, Entamoeba invadens
CRNWLHYLWMIFLGGFAIICCS

SEQ ID NO: 2787119 - protein, 18 aa, Entamoeba invadens
CRPACGTCRVGFVCTTGG

SEQ ID NO: 2787120 - protein, 20 aa, Entamoeba invadens
CRQCGGSVDCVIIKQEQSFI

SEQ ID NO: 2787121 - protein, 22 aa, Entamoeba invadens
CRQCISDSFYLDGNRNCQRCIS

SEQ ID NO: 2787122 - protein, 22 aa, Entamoeba invadens
CRSEGRSALFSLKKVDNDLPKE

SEQ ID NO: 2787123 - protein, 19 aa, Entamoeba invadens
CRTCMSGYFLNDYKQCELC

SEQ ID NO: 2787124 - protein, 20 aa, Entamoeba invadens
CRVSELHNGFYGYHYLFDNE

SEQ ID NO: 2787125 - protein, 26 aa, Entamoeba invadens
CRYPMKYRVGKWFKINMTDITNRFLL

SEQ ID NO: 2787126 - protein, 26 aa, Entamoeba invadens
CRYPMKYRVGKWFKLNMTPIKNNYID

SEQ ID NO: 2787127 - protein, 26 aa, Entamoeba invadens
CRYPMKYRVGKWFKLNMTPIKNNYMY

SEQ ID NO: 2787128 - protein, 17 aa, Entamoeba invadens
CRYVWNIASKTSNGERP

SEQ ID NO: 2787129 - protein, 19 aa, Entamoeba invadens
CSACNTVAGCGKCKSATEC

SEQ ID NO: 2787130 - protein, 25 aa, Entamoeba invadens
CSANFPRWLFVGDITGPARTATCIM

SEQ ID NO: 2787131 - protein, 20 aa, Entamoeba invadens
CSAPMPYVIGIKNAFLENVF

SEQ ID NO: 2787132 - protein, 17 aa, Entamoeba invadens
CSAVGINRCFPPLLSYF

SEQ ID NO: 2787133 - protein, 17 aa, Entamoeba invadens
CSCCIKEQILCTSFSIS

SEQ ID NO: 2787134 - protein, 17 aa, Entamoeba invadens
CSCKIEDKITLFSVDFE

SEQ ID NO: 2787135 - protein, 24 aa, Entamoeba invadens
CSCPKRMCFCVDQIIKKHLYFHLD

SEQ ID NO: 2787136 - protein, 33 aa, Entamoeba invadens
CSDCPLHCELCDWNRNCFVCSSSFILMNGRCLL

SEQ ID NO: 2787137 - protein, 19 aa, Entamoeba invadens
CSDGYYIFNSFCVKCEYPC

SEQ ID NO: 2787138 - protein, 18 aa, Entamoeba invadens
CSDGYYIFNSLCVKCEYP

SEQ ID NO: 2787139 - protein, 17 aa, Entamoeba invadens
CSDGYYLTETNLCLSCQ

SEQ ID NO: 2787140 - protein, 21 aa, Entamoeba invadens
CSDHCLYCETFEFCLSCKNTH

SEQ ID NO: 2787141 - protein, 18 aa, Entamoeba invadens
CSDKAQVTYSLKVVQSVS

SEQ ID NO: 2787142 - protein, 19 aa, Entamoeba invadens
CSDKIKICFNEMKKSFKKI

SEQ ID NO: 2787143 - protein, 25 aa, Entamoeba invadens
CSDLFEKYCACIKQTLIKCNINSRS

SEQ ID NO: 2787144 - protein, 20 aa, Entamoeba invadens
CSDLNCLDCSYNTNECLRCQ

SEQ ID NO: 2787145 - protein, 21 aa, Entamoeba invadens
CSDNKCSSCATKYFLSSSSLK

SEQ ID NO: 2787146 - protein, 25 aa, Entamoeba invadens
CSDTNCKYCPLDTRYCVQCHSSYSL

SEQ ID NO: 2787147 - protein, 24 aa, Entamoeba invadens
CSDTNCKYCPSDTRSCVQCHSSYS

SEQ ID NO: 2787148 - protein, 25 aa, Entamoeba invadens
CSDTNCKYCPSDTRSCVQCHSSYSL

SEQ ID NO: 2787149 - protein, 18 aa, Entamoeba invadens
CSECKSGFVPFENKQITC

SEQ ID NO: 2787150 - protein, 23 aa, Entamoeba invadens
CSECPSICKTCQWVESVSKPYCT

SEQ ID NO: 2787151 - protein, 30 aa, Entamoeba invadens
CSECTLANCLLCSATSFGCETCESGYYRGS

SEQ ID NO: 2787152 - protein, 22 aa, Entamoeba invadens
CSEFQMGPFLPVFNDPEVRTTN

SEQ ID NO: 2787153 - protein, 21 aa, Entamoeba invadens
CSEGGINRLTEPWKSAYPLLY

SEQ ID NO: 2787154 - protein, 19 aa, Entamoeba invadens
CSEGYYKSKLRCIQCKQNC

SEQ ID NO: 2787155 - protein, 17 aa, Entamoeba invadens
CSFCKNDKCIVCVEEYL

SEQ ID NO: 2787156 - protein, 18 aa, Entamoeba invadens
CSFCKNDQCIVCVEEYLL

SEQ ID NO: 2787157 - protein, 29 aa, Entamoeba invadens
CSFICSILGALAWYYPIPWPQSYWHIFAI

SEQ ID NO: 2787158 - protein, 20 aa, Entamoeba invadens
CSFNIIPMSTRVSAYLFIGT

SEQ ID NO: 2787159 - protein, 29 aa, Entamoeba invadens
CSFTRLRKRIPTIINELISIFNLPFERDG

SEQ ID NO: 2787160 - protein, 17 aa, Entamoeba invadens
CSFWKKPDTSGVYCKSS

SEQ ID NO: 2787161 - protein, 18 aa, Entamoeba invadens
CSFWNAPSLDGTYCEKRA

SEQ ID NO: 2787162 - protein, 18 aa, Entamoeba invadens
CSFWNVPSGDGISCESQI

SEQ ID NO: 2787163 - protein, 17 aa, Entamoeba invadens
CSGDIKSVTSQERVLYP

SEQ ID NO: 2787164 - protein, 20 aa, Entamoeba invadens
CSHCKLVDVYHSFSEENPLY

SEQ ID NO: 2787165 - protein, 20 aa, Entamoeba invadens
CSHTDVLQCDDIILPLTIRY

SEQ ID NO: 2787166 - protein, 17 aa, Entamoeba invadens
CSIKDNILLGAKEDQKV

SEQ ID NO: 2787167 - protein, 17 aa, Entamoeba invadens
CSIKDVPATYVYAKGLG

SEQ ID NO: 2787168 - protein, 19 aa, Entamoeba invadens
CSIKENILLGAKEGETPTD

SEQ ID NO: 2787169 - protein, 24 aa, Entamoeba invadens
CSIKGKEYGLKWDVLLDTEAKSLK

SEQ ID NO: 2787170 - protein, 18 aa, Entamoeba invadens
CSIMKSSDCVGCTTNHHI

SEQ ID NO: 2787171 - protein, 27 aa, Entamoeba invadens
CSINRNGKCLVCGSGFIMTTSQECEAC

SEQ ID NO: 2787172 - protein, 20 aa, Entamoeba invadens
CSIPKCIKCSTNSNLCIECE

SEQ ID NO: 2787173 - protein, 18 aa, Entamoeba invadens
CSISCSTCINGLNCIQCN

SEQ ID NO: 2787174 - protein, 17 aa, Entamoeba invadens
CSISDGNLCLKCSNGVI

SEQ ID NO: 2787175 - protein, 17 aa, Entamoeba invadens
CSISETIAIVFFNTSKG

SEQ ID NO: 2787176 - protein, 21 aa, Entamoeba invadens
CSISGSLGCYRCIDGKFLNAE

SEQ ID NO: 2787177 - protein, 17 aa, Entamoeba invadens
CSIVDVPPTYVYTKGLG

SEQ ID NO: 2787178 - protein, 17 aa, Entamoeba invadens
CSKCANGYYSLGGSGGC

SEQ ID NO: 2787179 - protein, 18 aa, Entamoeba invadens
CSKCAVDFTRKCELCSSG

SEQ ID NO: 2787180 - protein, 19 aa, Entamoeba invadens
CSKCDIGYLLVDGECQKTD

SEQ ID NO: 2787181 - protein, 23 aa, Entamoeba invadens
CSKCSFWYIPSVNGIGCKSHAVW

SEQ ID NO: 2787182 - protein, 22 aa, Entamoeba invadens
CSKCSIKSCAICVNDQCTSCES

SEQ ID NO: 2787183 - protein, 24 aa, Entamoeba invadens
CSKCSVDNCFLCSSDGTCDTCVTN

SEQ ID NO: 2787184 - protein, 18 aa, Entamoeba invadens
CSKFITFHCGSFVIEPQQ

SEQ ID NO: 2787185 - protein, 19 aa, Entamoeba invadens
CSKNKWMMVIFHTPNNPKY

SEQ ID NO: 2787186 - protein, 21 aa, Entamoeba invadens
CSKTAVWWVILLIIVIVISIL

SEQ ID NO: 2787187 - protein, 21 aa, Entamoeba invadens
CSKTAVWWVILLIVVVIIAIL

SEQ ID NO: 2787188 - protein, 24 aa, Entamoeba invadens
CSKTNWALIIPLIIVGVIIIIIIF

SEQ ID NO: 2787189 - protein, 22 aa, Entamoeba invadens
CSKTNWALIIPLVILGVIIIVI

SEQ ID NO: 2787190 - protein, 21 aa, Entamoeba invadens
CSKTTGSVFMSGCNTRIPGTL

SEQ ID NO: 2787191 - protein, 19 aa, Entamoeba invadens
CSLAGLLVPIEKPWSWKAF

SEQ ID NO: 2787192 - protein, 17 aa, Entamoeba invadens
CSLCQTQFLPFSRERLF

SEQ ID NO: 2787193 - protein, 18 aa, Entamoeba invadens
CSLFCTFFSIWGTLFLVV

SEQ ID NO: 2787194 - protein, 18 aa, Entamoeba invadens
CSLFSPLKNLEIMTDVKM

SEQ ID NO: 2787195 - protein, 24 aa, Entamoeba invadens
CSLHERIALVVLDLQKGKQFDVLI

SEQ ID NO: 2787196 - protein, 30 aa, Entamoeba invadens
CSLKRSNRCFKCSKGYLLVAGSCQKSTNCL

SEQ ID NO: 2787197 - protein, 17 aa, Entamoeba invadens
CSLLVMLPICLITAELS

SEQ ID NO: 2787198 - protein, 19 aa, Entamoeba invadens
CSLLYNFGAFLFWIVVPLI

SEQ ID NO: 2787199 - protein, 22 aa, Entamoeba invadens
CSLNSCGYCRASTQQQSFCGIC

SEQ ID NO: 2787200 - protein, 29 aa, Entamoeba invadens
CSLQSSSTCYLCLDGYFLSNGICVSIIAN

SEQ ID NO: 2787201 - protein, 23 aa, Entamoeba invadens
CSLVDQAGCKECYNDLTTEGQKT

SEQ ID NO: 2787202 - protein, 19 aa, Entamoeba invadens
CSLYTFQILHAFSTQLAIH

SEQ ID NO: 2787203 - protein, 18 aa, Entamoeba invadens
CSMCCYGNLLSYGSQYFN

SEQ ID NO: 2787204 - protein, 19 aa, Entamoeba invadens
CSMCSTLFERKCVLCNEGY

SEQ ID NO: 2787205 - protein, 17 aa, Entamoeba invadens
CSMYYNIFDCMTYLDNF

SEQ ID NO: 2787206 - protein, 20 aa, Entamoeba invadens
CSNCSSSFERMCIKCTTTDN

SEQ ID NO: 2787207 - protein, 25 aa, Entamoeba invadens
CSNDFYYLKCDLPAPINPSDNSQFI

SEQ ID NO: 2787208 - protein, 19 aa, Entamoeba invadens
CSNKYFINKKTFKCTMESI

SEQ ID NO: 2787209 - protein, 20 aa, Entamoeba invadens
CSNLFYGCYSCDYKQLDSTI

SEQ ID NO: 2787210 - protein, 24 aa, Entamoeba invadens
CSNLIIKYKFFVHLIQKVKSLKTP

SEQ ID NO: 2787211 - protein, 19 aa, Entamoeba invadens
CSPCDVIVSHCLICSTLGC

SEQ ID NO: 2787212 - protein, 24 aa, Entamoeba invadens
CSPCTDLKCKKCMSVESTSTSGEC

SEQ ID NO: 2787213 - protein, 17 aa, Entamoeba invadens
CSPGCKSGCIADYTCLG

SEQ ID NO: 2787214 - protein, 18 aa, Entamoeba invadens
CSPNCLTCTTYSRCLSCS

SEQ ID NO: 2787215 - protein, 28 aa, Entamoeba invadens
CSPSIRRDIPQELAICYSDGEIKVFFND

SEQ ID NO: 2787216 - protein, 25 aa, Entamoeba invadens
CSQCAPNYYSLVGFPSCTPCDSLCA

SEQ ID NO: 2787217 - protein, 17 aa, Entamoeba invadens
CSQCKDGYYRIGLECEL

SEQ ID NO: 2787218 - protein, 17 aa, Entamoeba invadens
CSQCNLNVCLECVTGFY

SEQ ID NO: 2787219 - protein, 20 aa, Entamoeba invadens
CSQCPVGCSTCLSAESCGSC

SEQ ID NO: 2787220 - protein, 23 aa, Entamoeba invadens
CSQCSGWYLPSEDGMYCIYTIPL

SEQ ID NO: 2787221 - protein, 19 aa, Entamoeba invadens
CSQRFCFKEIGTIVYDSQK

SEQ ID NO: 2787222 - protein, 17 aa, Entamoeba invadens
CSRCEPKYYPLENYCST

SEQ ID NO: 2787223 - protein, 18 aa, Entamoeba invadens
CSRCFNGFYLNNYECKKC

SEQ ID NO: 2787224 - protein, 23 aa, Entamoeba invadens
CSSATKCSKCKAGYYLEESKCKT

SEQ ID NO: 2787225 - protein, 24 aa, Entamoeba invadens
CSSCAEGFSGELCDTCADGYNDYP

SEQ ID NO: 2787226 - protein, 19 aa, Entamoeba invadens
CSSCLNSTTCLICKDNYYL

SEQ ID NO: 2787227 - protein, 17 aa, Entamoeba invadens
CSSCLSYSLAPLLAGLL

SEQ ID NO: 2787228 - protein, 21 aa, Entamoeba invadens
CSSCLSYSLAPLLAGLLSTYI

SEQ ID NO: 2787229 - protein, 21 aa, Entamoeba invadens
CSSCNAGFVVTNPVSAKCITC

SEQ ID NO: 2787230 - protein, 27 aa, Entamoeba invadens
CSSCNFLLSCKTCFSGFYLDSNECLSC

SEQ ID NO: 2787231 - protein, 21 aa, Entamoeba invadens
CSSCNGIGPSNCVSCPYSYFN

SEQ ID NO: 2787232 - protein, 26 aa, Entamoeba invadens
CSSCSFNYKFVDGVCTQCAEVAHCSA

SEQ ID NO: 2787233 - protein, 19 aa, Entamoeba invadens
CSSCTETYCQICLEGYYGI

SEQ ID NO: 2787234 - protein, 29 aa, Entamoeba invadens
CSSCTSKECSICKTGFYLQSGVCVTCPNT

SEQ ID NO: 2787235 - protein, 27 aa, Entamoeba invadens
CSSITDLFCCKSNSYSCITCFENYTKT

SEQ ID NO: 2787236 - protein, 22 aa, Entamoeba invadens
CSSNCMSCFNTSYCLSCADGSV

SEQ ID NO: 2787237 - protein, 17 aa, Entamoeba invadens
CSSNFKASDSAFIQIMG

SEQ ID NO: 2787238 - protein, 18 aa, Entamoeba invadens
CSSQCKQCSNANLCESCF

SEQ ID NO: 2787239 - protein, 26 aa, Entamoeba invadens
CSSSSSSSCKTCYSRYYMLNSQCFAC

SEQ ID NO: 2787240 - protein, 18 aa, Entamoeba invadens
CSTAMKIFVLVWVVLSGL

SEQ ID NO: 2787241 - protein, 20 aa, Entamoeba invadens
CSTASCVLCSTDSTTCSGCK

SEQ ID NO: 2787242 - protein, 20 aa, Entamoeba invadens
CSTCINGLNCIQCNTSNYQI

SEQ ID NO: 2787243 - protein, 19 aa, Entamoeba invadens
CSTCNLLLEQVVCITCSVE

SEQ ID NO: 2787244 - protein, 25 aa, Entamoeba invadens
CSTCSATSCKICSNDTMLSKSSDSG

SEQ ID NO: 2787245 - protein, 19 aa, Entamoeba invadens
CSTCTSGFYVRSGECVWCN

SEQ ID NO: 2787246 - protein, 17 aa, Entamoeba invadens
CSTCTSSSLTNESDSTD

SEQ ID NO: 2787247 - protein, 26 aa, Entamoeba invadens
CSTDCLNCLNNVCLLCSLGNQVKNGV

SEQ ID NO: 2787248 - protein, 24 aa, Entamoeba invadens
CSTESRYSKWYTLEGTGRYHEIST

SEQ ID NO: 2787249 - protein, 22 aa, Entamoeba invadens
CSTGEYNDVCLFEESVINLNGF

SEQ ID NO: 2787250 - protein, 23 aa, Entamoeba invadens
CSTIPLDGCAAVFNSRCVLCDSD

SEQ ID NO: 2787251 - protein, 24 aa, Entamoeba invadens
CSTIRTSYEISRQWVFTSESKRMD

SEQ ID NO: 2787252 - protein, 24 aa, Entamoeba invadens
CSTLNCKYCVGNKCLKCVENTLLY

SEQ ID NO: 2787253 - protein, 20 aa, Entamoeba invadens
CSTMKSSDCVGCITNHHIED

SEQ ID NO: 2787254 - protein, 26 aa, Entamoeba invadens
CSTQEMAFEYVRLIGGDCKVTITTGK

SEQ ID NO: 2787255 - protein, 19 aa, Entamoeba invadens
CSVANCQTCDIDFTTLCDT

SEQ ID NO: 2787256 - protein, 26 aa, Entamoeba invadens
CSVCSKTTGICFVCANGFTKPSSDTQ

SEQ ID NO: 2787257 - protein, 33 aa, Entamoeba invadens
CSVCSVPNCKYCEGGKCKRCNEKYVIQTNGFCF

SEQ ID NO: 2787258 - protein, 21 aa, Entamoeba invadens
CSVGYFFKNEMCVSCTETYGE

SEQ ID NO: 2787259 - protein, 17 aa, Entamoeba invadens
CSVKRLLPPLSTILACW

SEQ ID NO: 2787260 - protein, 17 aa, Entamoeba invadens
CSVLETNCWVCYHDEVN

SEQ ID NO: 2787261 - protein, 19 aa, Entamoeba invadens
CSVMGIAVFVFFLNQIWIM

SEQ ID NO: 2787262 - protein, 19 aa, Entamoeba invadens
CSVRARKKMVMTIYLATGF

SEQ ID NO: 2787263 - protein, 24 aa, Entamoeba invadens
CSVSSMRALIFRKVQFGLVDIIHI

SEQ ID NO: 2787264 - protein, 25 aa, Entamoeba invadens
CSVTFKGLFNVFSFRTITLGLHPKF

SEQ ID NO: 2787265 - protein, 28 aa, Entamoeba invadens
CSVTTRKCIKCKIGFRPDIYYPNNCIPC

SEQ ID NO: 2787266 - protein, 17 aa, Entamoeba invadens
CTACASGFYSNEGYSAC

SEQ ID NO: 2787267 - protein, 22 aa, Entamoeba invadens
CTACPPELGCAKCGYNENKKEP

SEQ ID NO: 2787268 - protein, 23 aa, Entamoeba invadens
CTACSYSLNGRDVFYEPFENGLC

SEQ ID NO: 2787269 - protein, 19 aa, Entamoeba invadens
CTACTTANCATCDASNVCT

SEQ ID NO: 2787270 - protein, 20 aa, Entamoeba invadens
CTALDLKKGCARVFNIPCEF

SEQ ID NO: 2787271 - protein, 26 aa, Entamoeba invadens
CTAVDSTALYSEWDCNKYAQTNPTNA

SEQ ID NO: 2787272 - protein, 18 aa, Entamoeba invadens
CTCEFGYKLISDNVTHVC

SEQ ID NO: 2787273 - protein, 19 aa, Entamoeba invadens
CTCKSRYQLEDHFCVSEMC

SEQ ID NO: 2787274 - protein, 17 aa, Entamoeba invadens
CTDALYFYPQSDDQNIV

SEQ ID NO: 2787275 - protein, 21 aa, Entamoeba invadens
CTDCVKYSVLVTGVCSHYTTI

SEQ ID NO: 2787276 - protein, 35 aa, Entamoeba invadens
CTDKSIWLGIKCRFIQFCVDLVIRSDIKKFVEICI

SEQ ID NO: 2787277 - protein, 24 aa, Entamoeba invadens
CTDKSSCLICDVSLGYSMIGGVCV

SEQ ID NO: 2787278 - protein, 17 aa, Entamoeba invadens
CTECKTGGILNGGTCLY

SEQ ID NO: 2787279 - protein, 19 aa, Entamoeba invadens
CTEEKSLVSKRCEDPKEKC

SEQ ID NO: 2787280 - protein, 24 aa, Entamoeba invadens
CTEGCLSCDSFGCTSCQKDYYYHT

SEQ ID NO: 2787281 - protein, 17 aa, Entamoeba invadens
CTEGYYRNCWTVINAIF

SEQ ID NO: 2787282 - protein, 25 aa, Entamoeba invadens
CTEPFRIPFAGSVDVCAFDKTGTLT

SEQ ID NO: 2787283 - protein, 19 aa, Entamoeba invadens
CTFCDKYFECSKCEDDNIL

SEQ ID NO: 2787284 - protein, 20 aa, Entamoeba invadens
CTFEGCSDPLKTRYNLYSHI

SEQ ID NO: 2787285 - protein, 38 aa, Entamoeba invadens
CTFFLDCFFPSFEFPELFVELFPKFSVLPKKIDIISMD

SEQ ID NO: 2787286 - protein, 19 aa, Entamoeba invadens
CTFFTLNYEYIFFNGSFVI

SEQ ID NO: 2787287 - protein, 20 aa, Entamoeba invadens
CTFILMSTLIYWVFGYSYIQ

SEQ ID NO: 2787288 - protein, 19 aa, Entamoeba invadens
CTFLFWRSIVFAMVLSCVV

SEQ ID NO: 2787289 - protein, 17 aa, Entamoeba invadens
CTFPGCSQTKMTRYNAA

SEQ ID NO: 2787290 - protein, 17 aa, Entamoeba invadens
CTFTRYVYTTSNMNAID

SEQ ID NO: 2787291 - protein, 20 aa, Entamoeba invadens
CTFVTRRIPYHAIFGNIIYG

SEQ ID NO: 2787292 - protein, 21 aa, Entamoeba invadens
CTHSSCTSCPTSADVCDACRI

SEQ ID NO: 2787293 - protein, 17 aa, Entamoeba invadens
CTIGYRLTDGICVRVHL

SEQ ID NO: 2787294 - protein, 23 aa, Entamoeba invadens
CTINGKIFMKTVGSFTFNNSVLQ

SEQ ID NO: 2787295 - protein, 18 aa, Entamoeba invadens
CTIPNCVDCKPNGECNKC

SEQ ID NO: 2787296 - protein, 28 aa, Entamoeba invadens
CTISVSFAVSFGIMYPITFAIDIYGVAP

SEQ ID NO: 2787297 - protein, 28 aa, Entamoeba invadens
CTISVSFAVSFGIMYPITFAIDIYSVAP

SEQ ID NO: 2787298 - protein, 18 aa, Entamoeba invadens
CTKCSTKNCATCDANDVC

SEQ ID NO: 2787299 - protein, 24 aa, Entamoeba invadens
CTKDQCINCSYGYGLNVRSGLCKP

SEQ ID NO: 2787300 - protein, 24 aa, Entamoeba invadens
CTKEGCSACVTGFVGYLSKDNVCT

SEQ ID NO: 2787301 - protein, 27 aa, Entamoeba invadens
CTKNLCLLCLSNLYFLDNGKCLSCQMK

SEQ ID NO: 2787302 - protein, 23 aa, Entamoeba invadens
CTKSNGVNFMFSEGAFEVFAFLA

SEQ ID NO: 2787303 - protein, 21 aa, Entamoeba invadens
CTKTDMGYCTSCIEGFFIGGG

SEQ ID NO: 2787304 - protein, 20 aa, Entamoeba invadens
CTKTECFSCANNMIVSGTTC

SEQ ID NO: 2787305 - protein, 24 aa, Entamoeba invadens
CTLEVILSLIWLFYLVQWSACAGL

SEQ ID NO: 2787306 - protein, 28 aa, Entamoeba invadens
CTLEVILSLIWLFYLVQWSACAGLLVML

SEQ ID NO: 2787307 - protein, 18 aa, Entamoeba invadens
CTLEVIVSIVWLFCVVQW

SEQ ID NO: 2787308 - protein, 18 aa, Entamoeba invadens
CTLKHEHSVLCNKNNTIS

SEQ ID NO: 2787309 - protein, 18 aa, Entamoeba invadens
CTLPLEGDFEEWDCSKYA

SEQ ID NO: 2787310 - protein, 19 aa, Entamoeba invadens
CTMCTSCISTTGKCLSCSS

SEQ ID NO: 2787311 - protein, 17 aa, Entamoeba invadens
CTNDSYYQWDVKPYCFV

SEQ ID NO: 2787312 - protein, 22 aa, Entamoeba invadens
CTNEYCLSCGPIEFNCSRCIPG

SEQ ID NO: 2787313 - protein, 19 aa, Entamoeba invadens
CTNITCLLALFQNGTGIPL

SEQ ID NO: 2787314 - protein, 22 aa, Entamoeba invadens
CTNNKCALCESGYGLFNNKCNS

SEQ ID NO: 2787315 - protein, 18 aa, Entamoeba invadens
CTNTYYLNKKIFKCTNTN

SEQ ID NO: 2787316 - protein, 17 aa, Entamoeba invadens
CTNVTFSNFKIYNSTNW

SEQ ID NO: 2787317 - protein, 19 aa, Entamoeba invadens
CTPKSYPDMIPFVESDCND

SEQ ID NO: 2787318 - protein, 17 aa, Entamoeba invadens
CTPQVEPNCSFQMSSTC

SEQ ID NO: 2787319 - protein, 21 aa, Entamoeba invadens
CTPQVEPNCSFQMSSTCISCD

SEQ ID NO: 2787320 - protein, 26 aa, Entamoeba invadens
CTPYSGRKGLWYSFKGTGEAVVVDNC

SEQ ID NO: 2787321 - protein, 21 aa, Entamoeba invadens
CTQCKYGYYPYGRYCYSCGNM

SEQ ID NO: 2787322 - protein, 28 aa, Entamoeba invadens
CTQCQNCASGFCYQKGCTQCVSENYYRE

SEQ ID NO: 2787323 - protein, 19 aa, Entamoeba invadens
CTQFIPSGGCVKCVDGYYR

SEQ ID NO: 2787324 - protein, 26 aa, Entamoeba invadens
CTQFIPSGGCVKCVDGYYRSELSCER

SEQ ID NO: 2787325 - protein, 28 aa, Entamoeba invadens
CTQFVPSGGCVKCINGYYRNGLSCEKCD

SEQ ID NO: 2787326 - protein, 29 aa, Entamoeba invadens
CTQHEKCTFCVKSKILFESGLCLDISYVS

SEQ ID NO: 2787327 - protein, 21 aa, Entamoeba invadens
CTQSNWMQCFVTGAIDAKVPI

SEQ ID NO: 2787328 - protein, 24 aa, Entamoeba invadens
CTRATPIIIDEGFVSYTVLNKYSR

SEQ ID NO: 2787329 - protein, 20 aa, Entamoeba invadens
CTRCTPSCRVCEGVSHCVTC

SEQ ID NO: 2787330 - protein, 18 aa, Entamoeba invadens
CTRDAVIMKSQLEENEKT

SEQ ID NO: 2787331 - protein, 24 aa, Entamoeba invadens
CTRFPEKYRSVFLTIVGEGKEMVI

SEQ ID NO: 2787332 - protein, 29 aa, Entamoeba invadens
CTSCISDNITICFSCEPFGYYFDNNNCRK

SEQ ID NO: 2787333 - protein, 19 aa, Entamoeba invadens
CTSCISGYYLYGAECITNE

SEQ ID NO: 2787334 - protein, 19 aa, Entamoeba invadens
CTSCKSGFYIDSTNKCQTL

SEQ ID NO: 2787335 - protein, 18 aa, Entamoeba invadens
CTSCKSGYYIYKSNQCQA

SEQ ID NO: 2787336 - protein, 17 aa, Entamoeba invadens
CTSCLSSYFLNSEIKCQ

SEQ ID NO: 2787337 - protein, 34 aa, Entamoeba invadens
CTSCMKGYYKTGGYCYACYTGCLTCTGPSNGFCN

SEQ ID NO: 2787338 - protein, 17 aa, Entamoeba invadens
CTSCPTNFVLDGQNCTS

SEQ ID NO: 2787339 - protein, 17 aa, Entamoeba invadens
CTSCSPGYYTFKTNQCA

SEQ ID NO: 2787340 - protein, 23 aa, Entamoeba invadens
CTSCSTEKCSVCNAEYFEAKGGE

SEQ ID NO: 2787341 - protein, 20 aa, Entamoeba invadens
CTSCYGGYFLSGGTCKSGGE

SEQ ID NO: 2787342 - protein, 27 aa, Entamoeba invadens
CTSFDIKCSICLSGFERKCFTCKTGKY

SEQ ID NO: 2787343 - protein, 17 aa, Entamoeba invadens
CTSFYRPPELFLGEERY

SEQ ID NO: 2787344 - protein, 21 aa, Entamoeba invadens
CTSGGCSACNTGFYFENGVCV

SEQ ID NO: 2787345 - protein, 20 aa, Entamoeba invadens
CTSIEKCLIYSSSYCVECES

SEQ ID NO: 2787346 - protein, 19 aa, Entamoeba invadens
CTSISLNFCFCGMSEISSG

SEQ ID NO: 2787347 - protein, 20 aa, Entamoeba invadens
CTSKNCLVCGQSDGLCTSCL

SEQ ID NO: 2787348 - protein, 24 aa, Entamoeba invadens
CTSKSGACGDGYYGEAGKCQKCSV

SEQ ID NO: 2787349 - protein, 18 aa, Entamoeba invadens
CTSLEEIEGLSAVTQIQE

SEQ ID NO: 2787350 - protein, 20 aa, Entamoeba invadens
CTSLRSVDGFERITEFGENS

SEQ ID NO: 2787351 - protein, 18 aa, Entamoeba invadens
CTSNGCTECLPNFQKTDG

SEQ ID NO: 2787352 - protein, 19 aa, Entamoeba invadens
CTSRNCLTCTIDSCETCLP

SEQ ID NO: 2787353 - protein, 21 aa, Entamoeba invadens
CTSTGCLECISGYFKDGPLCV

SEQ ID NO: 2787354 - protein, 25 aa, Entamoeba invadens
CTSTKCFKCKDNLVLYEYIDTNGNE

SEQ ID NO: 2787355 - protein, 17 aa, Entamoeba invadens
CTTCFNSTLCLTCNESN

SEQ ID NO: 2787356 - protein, 20 aa, Entamoeba invadens
CTTCKSGFYLSADMSCKSLG

SEQ ID NO: 2787357 - protein, 19 aa, Entamoeba invadens
CTTHDRFLAIFDLKSGDLV

SEQ ID NO: 2787358 - protein, 26 aa, Entamoeba invadens
CTTPASGSAKCTKCYAPYIPDENGNC

SEQ ID NO: 2787359 - protein, 23 aa, Entamoeba invadens
CTTQAEWWVILIIIISLILLIII

SEQ ID NO: 2787360 - protein, 20 aa, Entamoeba invadens
CTVLKHLTFSKSLFIIPNGC

SEQ ID NO: 2787361 - protein, 19 aa, Entamoeba invadens
CTYFFRGQLKFSRLDMKKG

SEQ ID NO: 2787362 - protein, 19 aa, Entamoeba invadens
CTYLNVLLLEACDTQDSLL

SEQ ID NO: 2787363 - protein, 19 aa, Entamoeba invadens
CTYLSRYFDFYVNPKQDKI

SEQ ID NO: 2787364 - protein, 19 aa, Entamoeba invadens
CTYVSLILLIMVLFILLKP

SEQ ID NO: 2787365 - protein, 21 aa, Entamoeba invadens
CTYYYCRECYPYFFRNSSRLC

SEQ ID NO: 2787366 - protein, 21 aa, Entamoeba invadens
CVACHDPNCYRCENDNITNCI

SEQ ID NO: 2787367 - protein, 27 aa, Entamoeba invadens
CVACKDGFYRVGLDCFECDQKCKTCNN

SEQ ID NO: 2787368 - protein, 22 aa, Entamoeba invadens
CVACKSFDPSCKICSPDYNRKC

SEQ ID NO: 2787369 - protein, 19 aa, Entamoeba invadens
CVACKSGSYLSGTSCVTCH

SEQ ID NO: 2787370 - protein, 22 aa, Entamoeba invadens
CVACSTANCATCGTNNVCTACK

SEQ ID NO: 2787371 - protein, 17 aa, Entamoeba invadens
CVACVSGAVYLNGVCSL

SEQ ID NO: 2787372 - protein, 20 aa, Entamoeba invadens
CVAVGEYFRKVTRIDDTYVF

SEQ ID NO: 2787373 - protein, 17 aa, Entamoeba invadens
CVCADGWVSKDNESCTP

SEQ ID NO: 2787374 - protein, 17 aa, Entamoeba invadens
CVCMGPIYSVITCITAY

SEQ ID NO: 2787375 - protein, 23 aa, Entamoeba invadens
CVDCLNTNCLQCILSQNNCSLCS

SEQ ID NO: 2787376 - protein, 20 aa, Entamoeba invadens
CVDDGKHIHEFLVCTKDYKG

SEQ ID NO: 2787377 - protein, 24 aa, Entamoeba invadens
CVDFWVGDWWGIWTDSWDQALRVR

SEQ ID NO: 2787378 - protein, 18 aa, Entamoeba invadens
CVDNNCKTCVIFTEEKCV

SEQ ID NO: 2787379 - protein, 21 aa, Entamoeba invadens
CVDVSRIFKCKEITNSKCSKC

SEQ ID NO: 2787380 - protein, 23 aa, Entamoeba invadens
CVDYKNVEFCLSANNSKCTECEG

SEQ ID NO: 2787381 - protein, 23 aa, Entamoeba invadens
CVDYKSVEFCLSANNSKCTECEG

SEQ ID NO: 2787382 - protein, 24 aa, Entamoeba invadens
CVDYKSVEFCLSANNSKCTECEGF

SEQ ID NO: 2787383 - protein, 18 aa, Entamoeba invadens
CVECALNGERMCVKCREN

SEQ ID NO: 2787384 - protein, 20 aa, Entamoeba invadens
CVECANGWFIQSGMCQELKK

SEQ ID NO: 2787385 - protein, 18 aa, Entamoeba invadens
CVECENGLILYDQEICKS

SEQ ID NO: 2787386 - protein, 19 aa, Entamoeba invadens
CVECESGFVLSNHTCYSQV

SEQ ID NO: 2787387 - protein, 18 aa, Entamoeba invadens
CVECKESYILNNGMCTSE

SEQ ID NO: 2787388 - protein, 17 aa, Entamoeba invadens
CVECLAGYFMNDDFTCS

SEQ ID NO: 2787389 - protein, 20 aa, Entamoeba invadens
CVECLSGYYLKHNNCYNCSL

SEQ ID NO: 2787390 - protein, 17 aa, Entamoeba invadens
CVECLTPNRQCRVCTNG

SEQ ID NO: 2787391 - protein, 17 aa, Entamoeba invadens
CVECPIECTSCISNSKC

SEQ ID NO: 2787392 - protein, 19 aa, Entamoeba invadens
CVECQRGSYCDRVGCILCT

SEQ ID NO: 2787393 - protein, 22 aa, Entamoeba invadens
CVELKGPSLKIAHCVVSGSYMI

SEQ ID NO: 2787394 - protein, 26 aa, Entamoeba invadens
CVENRILFESGLCFDISFVSKCLEAL

SEQ ID NO: 2787395 - protein, 24 aa, Entamoeba invadens
CVERCAKCSEQYRCTSCDDTYVLK

SEQ ID NO: 2787396 - protein, 24 aa, Entamoeba invadens
CVESKELLCLGNLTKGRIKVQLSA

SEQ ID NO: 2787397 - protein, 25 aa, Entamoeba invadens
CVEVKSSKCVKCDFWYETGVTQTSC

SEQ ID NO: 2787398 - protein, 17 aa, Entamoeba invadens
CVFAVNYGIIIGCPLAF

SEQ ID NO: 2787399 - protein, 25 aa, Entamoeba invadens
CVFDMKRSNIEMVILSGDVMVNMKS

SEQ ID NO: 2787400 - protein, 17 aa, Entamoeba invadens
CVFKMKRSNVAFYDMNE

SEQ ID NO: 2787401 - protein, 19 aa, Entamoeba invadens
CVFKMSRSNISFPYTISSN

SEQ ID NO: 2787402 - protein, 21 aa, Entamoeba invadens
CVFQIEHCVVMGMLNCLQCEP

SEQ ID NO: 2787403 - protein, 20 aa, Entamoeba invadens
CVGCGVSVSVCQFSKTKIIP

SEQ ID NO: 2787404 - protein, 17 aa, Entamoeba invadens
CVGKFEMGLSRYVATDD

SEQ ID NO: 2787405 - protein, 23 aa, Entamoeba invadens
CVHCSLEGCSTCLTHTLESPEVC

SEQ ID NO: 2787406 - protein, 31 aa, Entamoeba invadens
CVHNEKCLLTSASRCWKCSEGNVNTNCDNCD

SEQ ID NO: 2787407 - protein, 19 aa, Entamoeba invadens
CVHYTHFMFCIAAFNGECL

SEQ ID NO: 2787408 - protein, 20 aa, Entamoeba invadens
CVICDEGYYQLGYSCHQITN

SEQ ID NO: 2787409 - protein, 17 aa, Entamoeba invadens
CVIRATSTLLGKCNAII

SEQ ID NO: 2787410 - protein, 23 aa, Entamoeba invadens
CVIWKNGYYRVGLDCYDCDVKCE

SEQ ID NO: 2787411 - protein, 24 aa, Entamoeba invadens
CVKADGLFCSQCKEGFNPIETLNN

SEQ ID NO: 2787412 - protein, 23 aa, Entamoeba invadens
CVKADGLFCSQCNEGFNPIETLN

SEQ ID NO: 2787413 - protein, 20 aa, Entamoeba invadens
CVKCADGYYREEFGCSKCST

SEQ ID NO: 2787414 - protein, 18 aa, Entamoeba invadens
CVKCASGFYKDSYNECIK

SEQ ID NO: 2787415 - protein, 28 aa, Entamoeba invadens
CVKCKDGYYRYGLQCFSCNIKCSTCLNG

SEQ ID NO: 2787416 - protein, 21 aa, Entamoeba invadens
CVKCKSGSFLSEYKCKNTTNC

SEQ ID NO: 2787417 - protein, 19 aa, Entamoeba invadens
CVKCLPTTLLGISNSETVC

SEQ ID NO: 2787418 - protein, 17 aa, Entamoeba invadens
CVKCPADEVSPVQSSFC

SEQ ID NO: 2787419 - protein, 18 aa, Entamoeba invadens
CVKCSTLNCKYCVGNKCL

SEQ ID NO: 2787420 - protein, 21 aa, Entamoeba invadens
CVKFDSLILKDSWLPPEEFIT

SEQ ID NO: 2787421 - protein, 20 aa, Entamoeba invadens
CVKGVDMDHCEKFNCFVALL

SEQ ID NO: 2787422 - protein, 19 aa, Entamoeba invadens
CVKIDCFYDLSYGQRDSFS

SEQ ID NO: 2787423 - protein, 21 aa, Entamoeba invadens
CVKIGDYSFIKGITSFGEYSM

SEQ ID NO: 2787424 - protein, 20 aa, Entamoeba invadens
CVKLCDFGMAVKGYDKMWGR

SEQ ID NO: 2787425 - protein, 23 aa, Entamoeba invadens
CVKSDNFATATGWISNNIQKLNF

SEQ ID NO: 2787426 - protein, 19 aa, Entamoeba invadens
CVKTHFTFLNLVLFIFGPK

SEQ ID NO: 2787427 - protein, 17 aa, Entamoeba invadens
CVLCSSGFYQVDSLNVE

SEQ ID NO: 2787428 - protein, 18 aa, Entamoeba invadens
CVLISLFLILIGAIIVVL

SEQ ID NO: 2787429 - protein, 17 aa, Entamoeba invadens
CVLMIIFMILSKCLCKH

SEQ ID NO: 2787430 - protein, 17 aa, Entamoeba invadens
CVLNYVFGNPKSKKCIP

SEQ ID NO: 2787431 - protein, 17 aa, Entamoeba invadens
CVLQCSSEGTVLNENNN

SEQ ID NO: 2787432 - protein, 23 aa, Entamoeba invadens
CVMCKNSKCIICDDNYFIGNDGI

SEQ ID NO: 2787433 - protein, 17 aa, Entamoeba invadens
CVMCNLSSYDIVKGKCS

SEQ ID NO: 2787434 - protein, 21 aa, Entamoeba invadens
CVMLCCFSVIAFFPFDLIRYM

SEQ ID NO: 2787435 - protein, 18 aa, Entamoeba invadens
CVMSRLVLILAPAICLLS

SEQ ID NO: 2787436 - protein, 17 aa, Entamoeba invadens
CVMYLHYLLLKHPTSGI

SEQ ID NO: 2787437 - protein, 27 aa, Entamoeba invadens
CVNSRGGVCSICPKETYLNDGKCELCN

SEQ ID NO: 2787438 - protein, 23 aa, Entamoeba invadens
CVNYKNIEFCLSAYNSKCTECEG

SEQ ID NO: 2787439 - protein, 24 aa, Entamoeba invadens
CVNYKNVEFCLSANNSKCTECDGF

SEQ ID NO: 2787440 - protein, 23 aa, Entamoeba invadens
CVNYKNVEFCLSANNSKCTECEG

SEQ ID NO: 2787441 - protein, 23 aa, Entamoeba invadens
CVNYKNVEFCLSANNSKCTKCDG

SEQ ID NO: 2787442 - protein, 17 aa, Entamoeba invadens
CVPCTTKFCDRCSRVNG

SEQ ID NO: 2787443 - protein, 17 aa, Entamoeba invadens
CVPSPDTVRKVCLDKYK

SEQ ID NO: 2787444 - protein, 23 aa, Entamoeba invadens
CVQCVSTSCGVCLKKTGECTSCN

SEQ ID NO: 2787445 - protein, 20 aa, Entamoeba invadens
CVQDLRIVSDVIKKMNDARE

SEQ ID NO: 2787446 - protein, 24 aa, Entamoeba invadens
CVQFLCVLWTFASRVYTMVNTNKD

SEQ ID NO: 2787447 - protein, 24 aa, Entamoeba invadens
CVRCNKTYYGLDCLQCKGNRVISL

SEQ ID NO: 2787448 - protein, 24 aa, Entamoeba invadens
CVRGNWSDDEYLEFIDKEAETIDL

SEQ ID NO: 2787449 - protein, 26 aa, Entamoeba invadens
CVSCKEGYYRVGLDCFNCQPKCGTCL

SEQ ID NO: 2787450 - protein, 17 aa, Entamoeba invadens
CVSCNDKYFLLFGKCVS

SEQ ID NO: 2787451 - protein, 20 aa, Entamoeba invadens
CVSCTPGYHWDRGTCTKCTP

SEQ ID NO: 2787452 - protein, 21 aa, Entamoeba invadens
CVSCTTNACKLCDGVTGVCTS

SEQ ID NO: 2787453 - protein, 21 aa, Entamoeba invadens
CVSDRFNAMFMRNEIVVDYNY

SEQ ID NO: 2787454 - protein, 20 aa, Entamoeba invadens
CVSDTCTLCDLKYRLDSTGH

SEQ ID NO: 2787455 - protein, 17 aa, Entamoeba invadens
CVSEMCYSNLLNASEDN

SEQ ID NO: 2787456 - protein, 20 aa, Entamoeba invadens
CVSGGQIFFVYAAKVYAQKH

SEQ ID NO: 2787457 - protein, 26 aa, Entamoeba invadens
CVSGYHLIGGWCFKETSMNLGTDTGK

SEQ ID NO: 2787458 - protein, 18 aa, Entamoeba invadens
CVSNAYYFKNERYIYSLH

SEQ ID NO: 2787459 - protein, 21 aa, Entamoeba invadens
CVSPFLSWCLNNGLKYPLNQY

SEQ ID NO: 2787460 - protein, 22 aa, Entamoeba invadens
CVSSIFGILLMKYRGCRDKALR

SEQ ID NO: 2787461 - protein, 23 aa, Entamoeba invadens
CVSYKNVEFCLSANNSKCTECEG

SEQ ID NO: 2787462 - protein, 19 aa, Entamoeba invadens
CVTCEGCGSLGCEYMSGLC

SEQ ID NO: 2787463 - protein, 19 aa, Entamoeba invadens
CVTCPDMQYSLAGSTICRS

SEQ ID NO: 2787464 - protein, 24 aa, Entamoeba invadens
CVTCSDTTCTKCYDGYYLSSGSCS

SEQ ID NO: 2787465 - protein, 19 aa, Entamoeba invadens
CVTCSKTFQRECVTCTTGY

SEQ ID NO: 2787466 - protein, 26 aa, Entamoeba invadens
CVTCSPLFERKCIKCVAGCYPQTAGD

SEQ ID NO: 2787467 - protein, 31 aa, Entamoeba invadens
CVTCSPLFVRKCVKCVAGSYPQTAGDFRCKY

SEQ ID NO: 2787468 - protein, 30 aa, Entamoeba invadens
CVTCSPLFVRKCVKCVAGSYPQTAGDFRCN

SEQ ID NO: 2787469 - protein, 17 aa, Entamoeba invadens
CVTCTDMQYSLAGSTTC

SEQ ID NO: 2787470 - protein, 17 aa, Entamoeba invadens
CVTCYNSTYCLSCSTDL

SEQ ID NO: 2787471 - protein, 25 aa, Entamoeba invadens
CVVCKDGYYRVGFDCYECDPKCGTC

SEQ ID NO: 2787472 - protein, 17 aa, Entamoeba invadens
CVVCKDGYYRVGLDCFK

SEQ ID NO: 2787473 - protein, 20 aa, Entamoeba invadens
CVVCPDHCLLCNATTCFSCE

SEQ ID NO: 2787474 - protein, 21 aa, Entamoeba invadens
CVVDTKCLFYINGQCVTCSSL

SEQ ID NO: 2787475 - protein, 21 aa, Entamoeba invadens
CVVKLFDCLKEKTLNSTISIT

SEQ ID NO: 2787476 - protein, 19 aa, Entamoeba invadens
CVVPLLFLAVFVNVLIIFR

SEQ ID NO: 2787477 - protein, 20 aa, Entamoeba invadens
CVWLDRSSKTFGYCPTPKTQ

SEQ ID NO: 2787478 - protein, 18 aa, Entamoeba invadens
CVYGCNKCTNDATCLLYN

SEQ ID NO: 2787479 - protein, 19 aa, Entamoeba invadens
CVYKEGIYMDAYYQIDYSC

SEQ ID NO: 2787480 - protein, 18 aa, Entamoeba invadens
CVYQFSFENMLPPDVDAA

SEQ ID NO: 2787481 - protein, 19 aa, Entamoeba invadens
CVYTEKFICSPTYGQVGTI

SEQ ID NO: 2787482 - protein, 20 aa, Entamoeba invadens
CWCQTLKLFMLVLVGVGSQK

SEQ ID NO: 2787483 - protein, 30 aa, Entamoeba invadens
CWKGFMLHFFFCFLHKWVASLFGNHLQNVK

SEQ ID NO: 2787484 - protein, 17 aa, Entamoeba invadens
CYAPVKFIFLAFQLFYH

SEQ ID NO: 2787485 - protein, 18 aa, Entamoeba invadens
CYDGLYLNSDFECDYCSS

SEQ ID NO: 2787486 - protein, 18 aa, Entamoeba invadens
CYDISFVSNCVAVSNSKC

SEQ ID NO: 2787487 - protein, 18 aa, Entamoeba invadens
CYDISFVSYCVAVSNSKC

SEQ ID NO: 2787488 - protein, 21 aa, Entamoeba invadens
CYDQNCLNCSYDATECLRCPQ

SEQ ID NO: 2787489 - protein, 21 aa, Entamoeba invadens
CYDQNCLNCSYGATECLRCPQ

SEQ ID NO: 2787490 - protein, 22 aa, Entamoeba invadens
CYECKETYYLSSKCLKCGENCL

SEQ ID NO: 2787491 - protein, 17 aa, Entamoeba invadens
CYECKLSALDNGTQVPR

SEQ ID NO: 2787492 - protein, 27 aa, Entamoeba invadens
CYEQNSKVLFSFGFYDDICVYKKGIDK

SEQ ID NO: 2787493 - protein, 20 aa, Entamoeba invadens
CYFGAPGCDQYCHCTEGRAL

SEQ ID NO: 2787494 - protein, 20 aa, Entamoeba invadens
CYFGAPGCDQYCHCTEGRSL

SEQ ID NO: 2787495 - protein, 19 aa, Entamoeba invadens
CYFTMSIVLEKYRELLEAD

SEQ ID NO: 2787496 - protein, 20 aa, Entamoeba invadens
CYHFEMTPLLNIVRVSFFMS

SEQ ID NO: 2787497 - protein, 27 aa, Entamoeba invadens
CYHKQKFRIGKWFKINMDNLITSQLII

SEQ ID NO: 2787498 - protein, 17 aa, Entamoeba invadens
CYIDVIVINAERMCMKT

SEQ ID NO: 2787499 - protein, 17 aa, Entamoeba invadens
CYIEDLFYGSCIKYYDR

SEQ ID NO: 2787500 - protein, 17 aa, Entamoeba invadens
CYIVFQLDVEYCYTYLY

SEQ ID NO: 2787501 - protein, 18 aa, Entamoeba invadens
CYKCGSSCSECKDSISCY

SEQ ID NO: 2787502 - protein, 26 aa, Entamoeba invadens
CYKCKEGYFRNGLDCQKCSSSCSTCN

SEQ ID NO: 2787503 - protein, 24 aa, Entamoeba invadens
CYKDNAYWRFTIVEVDGKNELHRR

SEQ ID NO: 2787504 - protein, 21 aa, Entamoeba invadens
CYKENKCVLSNEYLCLHCSAG

SEQ ID NO: 2787505 - protein, 22 aa, Entamoeba invadens
CYLCDFTAMLLNGVCNVKNEKC

SEQ ID NO: 2787506 - protein, 24 aa, Entamoeba invadens
CYLPTKMCIAIEFAPDGSLGHVMK

SEQ ID NO: 2787507 - protein, 17 aa, Entamoeba invadens
CYNCNGPEKTNCTTCPN

SEQ ID NO: 2787508 - protein, 24 aa, Entamoeba invadens
CYNKEQCLLCQDGYYLQNNGSCSH

SEQ ID NO: 2787509 - protein, 20 aa, Entamoeba invadens
CYNSKCTRCNEGFQLETQSV

SEQ ID NO: 2787510 - protein, 32 aa, Entamoeba invadens
CYNTSCSQIDFVGWIAICVAIVVILFVILAIY

SEQ ID NO: 2787511 - protein, 18 aa, Entamoeba invadens
CYNWFLTKWTNAIDDNHP

SEQ ID NO: 2787512 - protein, 17 aa, Entamoeba invadens
CYPGYYTQQAFCNKIQK

SEQ ID NO: 2787513 - protein, 30 aa, Entamoeba invadens
CYQCKDGYYRVGMDCLECLLNCSTCNTKNK

SEQ ID NO: 2787514 - protein, 25 aa, Entamoeba invadens
CYQCKDGYYRVGMDCVECLSNCSTC

SEQ ID NO: 2787515 - protein, 28 aa, Entamoeba invadens
CYQCKEGYYRVGMDCIKCLSNCSICNTI

SEQ ID NO: 2787516 - protein, 26 aa, Entamoeba invadens
CYQCKEGYYRVGMDCLECLSNCSTCN

SEQ ID NO: 2787517 - protein, 18 aa, Entamoeba invadens
CYQCKNGYYRSGLDCIEC

SEQ ID NO: 2787518 - protein, 21 aa, Entamoeba invadens
CYQFASFKSGCVVCQDGYYRL

SEQ ID NO: 2787519 - protein, 17 aa, Entamoeba invadens
CYQKYCCPYLCPDSFGG

SEQ ID NO: 2787520 - protein, 18 aa, Entamoeba invadens
CYSACSVLAKGMVEKGNA

SEQ ID NO: 2787521 - protein, 25 aa, Entamoeba invadens
CYSCKDSFYRIGLDCQQCDEKCDLC

SEQ ID NO: 2787522 - protein, 17 aa, Entamoeba invadens
CYSCLSGYTFNDYYCYK

SEQ ID NO: 2787523 - protein, 25 aa, Entamoeba invadens
CYSCSSATTCSRCYYGYYLTSSTNT

SEQ ID NO: 2787524 - protein, 20 aa, Entamoeba invadens
CYSHVSLTPILPCFLCDGGL

SEQ ID NO: 2787525 - protein, 24 aa, Entamoeba invadens
CYSPPVPWWAFLIIAVVVVFLVVV

SEQ ID NO: 2787526 - protein, 24 aa, Entamoeba invadens
CYTCSSICKTCWGPQTTQCYSCVD

SEQ ID NO: 2787527 - protein, 19 aa, Entamoeba invadens
CYTGYILKDGLCIQCTAGT

SEQ ID NO: 2787528 - protein, 19 aa, Entamoeba invadens
CYVPHYLFYKVHESSYVSR

SEQ ID NO: 2787529 - protein, 18 aa, Entamoeba invadens
CYVQTCSPFISNTVGYDI

SEQ ID NO: 2787530 - protein, 17 aa, Entamoeba invadens
CYYCGGSKFYSTETNTC

SEQ ID NO: 2787531 - protein, 20 aa, Entamoeba invadens
CYYCPSACATCYGRNNGECT

SEQ ID NO: 2787532 - protein, 26 aa, Entamoeba invadens
CYYNPKYRIGKWIKLNMTLVKAPFIA

SEQ ID NO: 2787533 - protein, 26 aa, Entamoeba invadens
CYYRQKYRMGKWFKFDSNEMTKDHFR

SEQ ID NO: 2787534 - protein, 23 aa, Entamoeba invadens
CYYSCTKCVSRHNFCYSCNDGFM

SEQ ID NO: 2787535 - protein, 18 aa, Entamoeba invadens
DAAHAFVLISQRVPDIYE

SEQ ID NO: 2787536 - protein, 17 aa, Entamoeba invadens
DACLTCNLTNYKTTSGK

SEQ ID NO: 2787537 - protein, 26 aa, Entamoeba invadens
DAEACSKCYECFSLNIQHKCVLKIAH

SEQ ID NO: 2787538 - protein, 25 aa, Entamoeba invadens
DAEPPGRPSFFSLLVDEEEDDGEEE

SEQ ID NO: 2787539 - protein, 17 aa, Entamoeba invadens
DAFFACSEAFLQILKNF

SEQ ID NO: 2787540 - protein, 22 aa, Entamoeba invadens
DAIFKMEHGFKINNLIEIRSRG

SEQ ID NO: 2787541 - protein, 24 aa, Entamoeba invadens
DAIGCAICKVGYYYVSKDCRQCET

SEQ ID NO: 2787542 - protein, 25 aa, Entamoeba invadens
DAKLLDVCRGFLLADRLRHCVESLN

SEQ ID NO: 2787543 - protein, 22 aa, Entamoeba invadens
DALGKWSFLDSYVMTLMIMAFY

SEQ ID NO: 2787544 - protein, 21 aa, Entamoeba invadens
DALGKWSFLDSYVMTLMTMAF

SEQ ID NO: 2787545 - protein, 20 aa, Entamoeba invadens
DALGKWSFLDSYVMTLMVVS

SEQ ID NO: 2787546 - protein, 18 aa, Entamoeba invadens
DALKRLGQLLALGHFPKH

SEQ ID NO: 2787547 - protein, 20 aa, Entamoeba invadens
DALNPLVLWCNTFAGLILRI

SEQ ID NO: 2787548 - protein, 18 aa, Entamoeba invadens
DALRRMGQMLALGNFPQH

SEQ ID NO: 2787549 - protein, 21 aa, Entamoeba invadens
DALTFCLAGLLAPVMGILTDK

SEQ ID NO: 2787550 - protein, 21 aa, Entamoeba invadens
DAMCLLCNVDYFLLSDHTQCI

SEQ ID NO: 2787551 - protein, 22 aa, Entamoeba invadens
DAMSPRFGALFQTVGTLLSSFA

SEQ ID NO: 2787552 - protein, 25 aa, Entamoeba invadens
DAMSPRVGALFQMIGTVLSAIVLCF

SEQ ID NO: 2787553 - protein, 28 aa, Entamoeba invadens
DANCCGWKRLKISGCNALHPENVKTSCY

SEQ ID NO: 2787554 - protein, 17 aa, Entamoeba invadens
DANCKYCPFNKNSCVLC

SEQ ID NO: 2787555 - protein, 18 aa, Entamoeba invadens
DANECFSCQANAYLHNGV

SEQ ID NO: 2787556 - protein, 22 aa, Entamoeba invadens
DANICLKCEPGYTLVDRKCVKI

SEQ ID NO: 2787557 - protein, 37 aa, Entamoeba invadens
DANNCLKCTSRGKCLLCKDGYRLTNNKCEAVVNCAGY

SEQ ID NO: 2787558 - protein, 18 aa, Entamoeba invadens
DAPVSLEFALGAVSVLIA

SEQ ID NO: 2787559 - protein, 23 aa, Entamoeba invadens
DAQARSFAFLSLVFFIISTIIAV

SEQ ID NO: 2787560 - protein, 25 aa, Entamoeba invadens
DAQHPLTFSLCKNGYTIALLSKKSG

SEQ ID NO: 2787561 - protein, 19 aa, Entamoeba invadens
DARWEIRHGAAISLREVIR

SEQ ID NO: 2787562 - protein, 22 aa, Entamoeba invadens
DASLSMWIYLYIVMVFVPMVFG

SEQ ID NO: 2787563 - protein, 24 aa, Entamoeba invadens
DASNCLTCAKGYFRNNSICVSLST

SEQ ID NO: 2787564 - protein, 22 aa, Entamoeba invadens
DASRNCILCNTGYYPVNNNNTK

SEQ ID NO: 2787565 - protein, 18 aa, Entamoeba invadens
DASRSVRSQMCIFNEVLA

SEQ ID NO: 2787566 - protein, 17 aa, Entamoeba invadens
DATALAQLFRLVPATTI

SEQ ID NO: 2787567 - protein, 19 aa, Entamoeba invadens
DATCTICPAGTYSNAGASG

SEQ ID NO: 2787568 - protein, 19 aa, Entamoeba invadens
DATCYECSSNSFINATTTC

SEQ ID NO: 2787569 - protein, 24 aa, Entamoeba invadens
DATKCLSCALGEVVDSLGKCSICS

SEQ ID NO: 2787570 - protein, 17 aa, Entamoeba invadens
DATVFSVVIIVLALYII

SEQ ID NO: 2787571 - protein, 26 aa, Entamoeba invadens
DAVNFNFPLEFLKPMEPNFDELFEDD

SEQ ID NO: 2787572 - protein, 20 aa, Entamoeba invadens
DAYFGTFIRQRIDWLNKQLP

SEQ ID NO: 2787573 - protein, 24 aa, Entamoeba invadens
DAYKGDAFEYMWSIASFVMDGKRL

SEQ ID NO: 2787574 - protein, 24 aa, Entamoeba invadens
DAYPKGLFAFPWKIAEYVNNGKRP

SEQ ID NO: 2787575 - protein, 20 aa, Entamoeba invadens
DCAGCGSSISICQLSKNRIT

SEQ ID NO: 2787576 - protein, 23 aa, Entamoeba invadens
DCAIESIEFPEPLDFSTATKTNL

SEQ ID NO: 2787577 - protein, 17 aa, Entamoeba invadens
DCATCKTCGSGYNLEAG

SEQ ID NO: 2787578 - protein, 24 aa, Entamoeba invadens
DCATVKYDNGFTCVADEPSETPSE

SEQ ID NO: 2787579 - protein, 21 aa, Entamoeba invadens
DCDELLKVCAICNNSSTKEND

SEQ ID NO: 2787580 - protein, 18 aa, Entamoeba invadens
DCDSMTWSTEGSATCTPC

SEQ ID NO: 2787581 - protein, 25 aa, Entamoeba invadens
DCEIKGEIFGGINQRVFDLILRQGR

SEQ ID NO: 2787582 - protein, 18 aa, Entamoeba invadens
DCEYVSVVMLLCLECNKS

SEQ ID NO: 2787583 - protein, 19 aa, Entamoeba invadens
DCFKRRWVDTRGNHDSDGM

SEQ ID NO: 2787584 - protein, 17 aa, Entamoeba invadens
DCGKGQYSYGPSCDTCP

SEQ ID NO: 2787585 - protein, 17 aa, Entamoeba invadens
DCGLCPEATYFEPSKSV

SEQ ID NO: 2787586 - protein, 21 aa, Entamoeba invadens
DCGLLWSYYCVLTLLYCGIMF

SEQ ID NO: 2787587 - protein, 22 aa, Entamoeba invadens
DCHKLCYYNGAFLDGVGNNQCY

SEQ ID NO: 2787588 - protein, 19 aa, Entamoeba invadens
DCHKLCYYNGSWQTDNSDL

SEQ ID NO: 2787589 - protein, 20 aa, Entamoeba invadens
DCHKVCYYDRKWLVDNTNLC

SEQ ID NO: 2787590 - protein, 18 aa, Entamoeba invadens
DCHLKCFFNDKWNEDSTN

SEQ ID NO: 2787591 - protein, 23 aa, Entamoeba invadens
DCHLKCYYNRTWTVEDNTNSCKF

SEQ ID NO: 2787592 - protein, 17 aa, Entamoeba invadens
DCIKCSNTSHYVIQHNQ

SEQ ID NO: 2787593 - protein, 18 aa, Entamoeba invadens
DCILPLFVLLAYILFVCF

SEQ ID NO: 2787594 - protein, 22 aa, Entamoeba invadens
DCKCNACPLNYYLTAQNTCETK

SEQ ID NO: 2787595 - protein, 20 aa, Entamoeba invadens
DCKKEKCFIKTSSPNGNCDV

SEQ ID NO: 2787596 - protein, 22 aa, Entamoeba invadens
DCKTLYFKGDRCVRCKSTFYLT

SEQ ID NO: 2787597 - protein, 20 aa, Entamoeba invadens
DCKYSLISKSMCVECLDTFK

SEQ ID NO: 2787598 - protein, 20 aa, Entamoeba invadens
DCKYSLISQSMCVECLDSFK

SEQ ID NO: 2787599 - protein, 20 aa, Entamoeba invadens
DCLECPSICRSCNGPTTSEC

SEQ ID NO: 2787600 - protein, 23 aa, Entamoeba invadens
DCLFSEALMYFWIGENKKKFLIT

SEQ ID NO: 2787601 - protein, 21 aa, Entamoeba invadens
DCLKCTENACLECTDKYILEG

SEQ ID NO: 2787602 - protein, 20 aa, Entamoeba invadens
DCLNTFLGNCEGRCVVYELN

SEQ ID NO: 2787603 - protein, 27 aa, Entamoeba invadens
DCNCASATAFTEWDCTNTYYLNKKIFK

SEQ ID NO: 2787604 - protein, 25 aa, Entamoeba invadens
DCNMYKRQGFCLTSYSKCQCVDGYG

SEQ ID NO: 2787605 - protein, 17 aa, Entamoeba invadens
DCPCSKTTGSVFMSGCN

SEQ ID NO: 2787606 - protein, 26 aa, Entamoeba invadens
DCQSCKPECKTCLTSNKCLECNSVYF

SEQ ID NO: 2787607 - protein, 25 aa, Entamoeba invadens
DCQSCNQYECLACQNNTWLNENNTC

SEQ ID NO: 2787608 - protein, 17 aa, Entamoeba invadens
DCSIGCAICQTQSPFYC

SEQ ID NO: 2787609 - protein, 17 aa, Entamoeba invadens
DCSLSANSVQCGKCDAG

SEQ ID NO: 2787610 - protein, 22 aa, Entamoeba invadens
DCSTASCVSCNSGSDKCVECKT

SEQ ID NO: 2787611 - protein, 26 aa, Entamoeba invadens
DCSTCTSLKCTLCLNNTVFDGTKCTS

SEQ ID NO: 2787612 - protein, 17 aa, Entamoeba invadens
DCSTSGCTTCNSTSCIT

SEQ ID NO: 2787613 - protein, 25 aa, Entamoeba invadens
DCSVAKRWSAVFSLSNLLLHQYNKD

SEQ ID NO: 2787614 - protein, 18 aa, Entamoeba invadens
DCTCLQCKDNFLLVENEC

SEQ ID NO: 2787615 - protein, 25 aa, Entamoeba invadens
DCTKCKDAICYKCNTGYYLENNTCI

SEQ ID NO: 2787616 - protein, 21 aa, Entamoeba invadens
DCTKNPSVFHLMLDTASNNKY

SEQ ID NO: 2787617 - protein, 20 aa, Entamoeba invadens
DCTQRFCYLGDSFRTVQKTI

SEQ ID NO: 2787618 - protein, 20 aa, Entamoeba invadens
DCTRYFNGRCIQCSNKSALY

SEQ ID NO: 2787619 - protein, 18 aa, Entamoeba invadens
DCTTPLYCHTCSAKGICV

SEQ ID NO: 2787620 - protein, 20 aa, Entamoeba invadens
DCVSCSLIDYVLVATLDKVL

SEQ ID NO: 2787621 - protein, 21 aa, Entamoeba invadens
DCYFAREFFYQKLLGKDYPRC

SEQ ID NO: 2787622 - protein, 19 aa, Entamoeba invadens
DDAHLMHVIAIFSTSSNFM

SEQ ID NO: 2787623 - protein, 26 aa, Entamoeba invadens
DDAKYIFKSIEAISFMVRIYTKIGEF

SEQ ID NO: 2787624 - protein, 21 aa, Entamoeba invadens
DDAPFNFALIYVRQTDEKLEQ

SEQ ID NO: 2787625 - protein, 18 aa, Entamoeba invadens
DDAYCIFCPTRKSECERC

SEQ ID NO: 2787626 - protein, 21 aa, Entamoeba invadens
DDCHKLCYYNKVWQTDNTNLC

SEQ ID NO: 2787627 - protein, 21 aa, Entamoeba invadens
DDCHKLCYYNNTWTLKNYDDK

SEQ ID NO: 2787628 - protein, 21 aa, Entamoeba invadens
DDCHKLCYYNNTWTLTNYDDK

SEQ ID NO: 2787629 - protein, 21 aa, Entamoeba invadens
DDCHKLCYYNSEWTIPNIEEK

SEQ ID NO: 2787630 - protein, 25 aa, Entamoeba invadens
DDCHQLCYYYGWQVSNTDGLCYFGT

SEQ ID NO: 2787631 - protein, 20 aa, Entamoeba invadens
DDCHSLCFFNGTWQTNTNYD

SEQ ID NO: 2787632 - protein, 20 aa, Entamoeba invadens
DDCLFKNIIQQSWKNKPTER

SEQ ID NO: 2787633 - protein, 20 aa, Entamoeba invadens
DDCLLKDIIQQSWKHKASER

SEQ ID NO: 2787634 - protein, 19 aa, Entamoeba invadens
DDDCSTCSAGYINYPYCTA

SEQ ID NO: 2787635 - protein, 24 aa, Entamoeba invadens
DDDPKTGLIVRVFNKKEYCVSLEE

SEQ ID NO: 2787636 - protein, 24 aa, Entamoeba invadens
DDDTWIWITIGVVGGVLFLAVVIA

SEQ ID NO: 2787637 - protein, 19 aa, Entamoeba invadens
DDEFCFQISENYYRCTKTA

SEQ ID NO: 2787638 - protein, 17 aa, Entamoeba invadens
DDEFKFAQLDFSVTFAR

SEQ ID NO: 2787639 - protein, 22 aa, Entamoeba invadens
DDEKIRFLAVNFSKIDMATAAV

SEQ ID NO: 2787640 - protein, 25 aa, Entamoeba invadens
DDEKIRVATYYFKSKMNNFVSLELK

SEQ ID NO: 2787641 - protein, 24 aa, Entamoeba invadens
DDELCSILLFVRVIIIKCSFVMVR

SEQ ID NO: 2787642 - protein, 27 aa, Entamoeba invadens
DDFIRLPYRLKVRMLYDTAKGMQFLHE

SEQ ID NO: 2787643 - protein, 19 aa, Entamoeba invadens
DDFKYPWDIANFVSDGKRL

SEQ ID NO: 2787644 - protein, 17 aa, Entamoeba invadens
DDFKYTVSTTRTGFFLV

SEQ ID NO: 2787645 - protein, 28 aa, Entamoeba invadens
DDFLDIRWRYKLILSFCASILVVVLYPG

SEQ ID NO: 2787646 - protein, 23 aa, Entamoeba invadens
DDFLRAECLEKIIGATSLMTQRG

SEQ ID NO: 2787647 - protein, 20 aa, Entamoeba invadens
DDGEIEWMYYFRKYNSKFFY

SEQ ID NO: 2787648 - protein, 21 aa, Entamoeba invadens
DDGILFLRKDPPQFSTFDADR

SEQ ID NO: 2787649 - protein, 32 aa, Entamoeba invadens
DDGKLCIKHVVWWVILLCLLFVILLLMTFILI

SEQ ID NO: 2787650 - protein, 21 aa, Entamoeba invadens
DDGKLCYKCTSLSGSQSVSLI

SEQ ID NO: 2787651 - protein, 19 aa, Entamoeba invadens
DDGKRWWCGFKNENYLDDS

SEQ ID NO: 2787652 - protein, 25 aa, Entamoeba invadens
DDGKWSQNCSLSYCDYNYYVDITDM

SEQ ID NO: 2787653 - protein, 23 aa, Entamoeba invadens
DDHSCLQCALIAIDSTSSTTYVR

SEQ ID NO: 2787654 - protein, 24 aa, Entamoeba invadens
DDICKDKDGYYCVKGEEHKYLWCT

SEQ ID NO: 2787655 - protein, 19 aa, Entamoeba invadens
DDINCKYCPYNKNSCISCK

SEQ ID NO: 2787656 - protein, 23 aa, Entamoeba invadens
DDKKCLKCSNMGVLDCDGKCIAF

SEQ ID NO: 2787657 - protein, 21 aa, Entamoeba invadens
DDKLSCRQKGLSVGVIVAIVI

SEQ ID NO: 2787658 - protein, 23 aa, Entamoeba invadens
DDKRFRVARYPNYEYTDTSHQTE

SEQ ID NO: 2787659 - protein, 25 aa, Entamoeba invadens
DDKYIFRIWDAVFAFPSSKFYYFIV

SEQ ID NO: 2787660 - protein, 18 aa, Entamoeba invadens
DDLCTFSIDKTCYYCGGS

SEQ ID NO: 2787661 - protein, 20 aa, Entamoeba invadens
DDLKIVINGIRIVKKLIEDV

SEQ ID NO: 2787662 - protein, 22 aa, Entamoeba invadens
DDLKKAPNFVFFPFASNCAKKG

SEQ ID NO: 2787663 - protein, 18 aa, Entamoeba invadens
DDLPRLAKLNIEIQKVAK

SEQ ID NO: 2787664 - protein, 17 aa, Entamoeba invadens
DDLTWLWITLGVVGGVV

SEQ ID NO: 2787665 - protein, 24 aa, Entamoeba invadens
DDMWIPRVLIFGAILDCLVLGIIT

SEQ ID NO: 2787666 - protein, 34 aa, Entamoeba invadens
DDNCRTCLLNSTFCLSCPEGTFLSNHKCVTNEDL

SEQ ID NO: 2787667 - protein, 28 aa, Entamoeba invadens
DDNFKSIVKSVLWGRCVFDNIRKFLQFQ

SEQ ID NO: 2787668 - protein, 25 aa, Entamoeba invadens
DDNKWTPTCAASYCDDGYKFDYKNQ

SEQ ID NO: 2787669 - protein, 23 aa, Entamoeba invadens
DDNLERWSVPFSIKTAGSTGSYY

SEQ ID NO: 2787670 - protein, 25 aa, Entamoeba invadens
DDNQYELICECWKQNPIERITIETI

SEQ ID NO: 2787671 - protein, 18 aa, Entamoeba invadens
DDNWCVKVSDFGLSVPLY

SEQ ID NO: 2787672 - protein, 18 aa, Entamoeba invadens
DDPECPFLGERSYLPNGE

SEQ ID NO: 2787673 - protein, 25 aa, Entamoeba invadens
DDPGRYDMFIGVFFCVVYIAFTIGF

SEQ ID NO: 2787674 - protein, 25 aa, Entamoeba invadens
DDPKFKYPWNVADYVVKCGRPEKCE

SEQ ID NO: 2787675 - protein, 27 aa, Entamoeba invadens
DDPMFKADDSFGLKLLTNVLMSATMFN

SEQ ID NO: 2787676 - protein, 25 aa, Entamoeba invadens
DDPQCTSECNCIFGTEPMPIDNVTK

SEQ ID NO: 2787677 - protein, 19 aa, Entamoeba invadens
DDQKKRPSIIDVVEKLETF

SEQ ID NO: 2787678 - protein, 19 aa, Entamoeba invadens
DDRISIIIRVIVPLVIFLT

SEQ ID NO: 2787679 - protein, 24 aa, Entamoeba invadens
DDSCCAKCKIPFTVRITIVGILVL

SEQ ID NO: 2787680 - protein, 23 aa, Entamoeba invadens
DDSKCSKCAFWHTPTSTGRSCQF

SEQ ID NO: 2787681 - protein, 19 aa, Entamoeba invadens
DDSKDAFLYFTYPSVSKMS

SEQ ID NO: 2787682 - protein, 34 aa, Entamoeba invadens
DDSRVIVVKLMLVGIVLYPIYIVIFALFNNSSDK

SEQ ID NO: 2787683 - protein, 28 aa, Entamoeba invadens
DDSSRKCIKCKLGLYPKEENQFTCQACD

SEQ ID NO: 2787684 - protein, 33 aa, Entamoeba invadens
DDTLCTILTPKGCLKCVNGFYLDNSKNCVKCSN

SEQ ID NO: 2787685 - protein, 20 aa, Entamoeba invadens
DDTRLIGSMRAFQEMNNMVV

SEQ ID NO: 2787686 - protein, 24 aa, Entamoeba invadens
DDTRVRFSVLLSLPVVSSYPPPLR

SEQ ID NO: 2787687 - protein, 25 aa, Entamoeba invadens
DDTWKAVGVANAFAFIYDESGFRLE

SEQ ID NO: 2787688 - protein, 25 aa, Entamoeba invadens
DDVACPKSPFNMRGVNVVLVPRKWR

SEQ ID NO: 2787689 - protein, 20 aa, Entamoeba invadens
DDVLCTFNKEGDCKRTSLTT

SEQ ID NO: 2787690 - protein, 19 aa, Entamoeba invadens
DDWAYEIVSMCWKHNPAER

SEQ ID NO: 2787691 - protein, 20 aa, Entamoeba invadens
DDYIKLLLLPATKISISFGF

SEQ ID NO: 2787692 - protein, 20 aa, Entamoeba invadens
DDYRVCLANGVISKGTKLVC

SEQ ID NO: 2787693 - protein, 20 aa, Entamoeba invadens
DECHRCDTLFANCSTCSATS

SEQ ID NO: 2787694 - protein, 21 aa, Entamoeba invadens
DECLLCKDNYFLLENGTCGEI

SEQ ID NO: 2787695 - protein, 18 aa, Entamoeba invadens
DECTSCFDNYVLLDLNCV

SEQ ID NO: 2787696 - protein, 22 aa, Entamoeba invadens
DECYKIICDCWKHEPGDRPPIE

SEQ ID NO: 2787697 - protein, 25 aa, Entamoeba invadens
DEDIFDLVKMCWRQEPKERPTMREV

SEQ ID NO: 2787698 - protein, 25 aa, Entamoeba invadens
DEDWWWPLCRYGSMLSVSFFSLINC

SEQ ID NO: 2787699 - protein, 32 aa, Entamoeba invadens
DEEVQMPIALLCVFLLLAEALFLNWGVVAVTL

SEQ ID NO: 2787700 - protein, 25 aa, Entamoeba invadens
DEFKACGLCGEKIECDGCMARDVMY

SEQ ID NO: 2787701 - protein, 22 aa, Entamoeba invadens
DEFKNIINSISFQNMKRKELLQ

SEQ ID NO: 2787702 - protein, 31 aa, Entamoeba invadens
DEFKVSESFSMKCFNLFYGCYSRDYKLNSTI

SEQ ID NO: 2787703 - protein, 23 aa, Entamoeba invadens
DEFLQKCDFYIDQLDGCLRCKIG

SEQ ID NO: 2787704 - protein, 18 aa, Entamoeba invadens
DEFNLYKLICLTIVGCFT

SEQ ID NO: 2787705 - protein, 21 aa, Entamoeba invadens
DEFNYPWKIAEFVVNGNRVKK

SEQ ID NO: 2787706 - protein, 22 aa, Entamoeba invadens
DEFRCSKLLKCLNGDSFDSITQ

SEQ ID NO: 2787707 - protein, 22 aa, Entamoeba invadens
DEFRKEVAMLAKFVSPYLIRFY

SEQ ID NO: 2787708 - protein, 20 aa, Entamoeba invadens
DEFRSYIATEEMARTPILCH

SEQ ID NO: 2787709 - protein, 17 aa, Entamoeba invadens
DEFTKFPSWSVGVFTVQ

SEQ ID NO: 2787710 - protein, 31 aa, Entamoeba invadens
DEFTLTNACVLRFSPHTKFIVSRGAYIELTF

SEQ ID NO: 2787711 - protein, 24 aa, Entamoeba invadens
DEFTPNVKFIFQFIKTEVEKKYKG

SEQ ID NO: 2787712 - protein, 19 aa, Entamoeba invadens
DEGCSIPADLRLCETHHLE

SEQ ID NO: 2787713 - protein, 22 aa, Entamoeba invadens
DEGRFIWQKGCEPVCGNCRDGY

SEQ ID NO: 2787714 - protein, 24 aa, Entamoeba invadens
DEGVKCTLISFPNDYVINKDTTEE

SEQ ID NO: 2787715 - protein, 20 aa, Entamoeba invadens
DEGYIYRGFMFTAFADTTTT

SEQ ID NO: 2787716 - protein, 19 aa, Entamoeba invadens
DEIGMKMRVKIMLDSSKGI

SEQ ID NO: 2787717 - protein, 25 aa, Entamoeba invadens
DEIKLELPFPLTPTHHLLFCVRDIG

SEQ ID NO: 2787718 - protein, 20 aa, Entamoeba invadens
DEINKRWQVLKERHTQHHKD

SEQ ID NO: 2787719 - protein, 27 aa, Entamoeba invadens
DEIQPVCFVQRTFSRWYKITGDGKAVV

SEQ ID NO: 2787720 - protein, 17 aa, Entamoeba invadens
DEKCAKCKEPSQYQKPC

SEQ ID NO: 2787721 - protein, 17 aa, Entamoeba invadens
DEKCIKTSFGLCILCEN

SEQ ID NO: 2787722 - protein, 24 aa, Entamoeba invadens
DEKCVRWSNTLGCVDCEEGYYLGD

SEQ ID NO: 2787723 - protein, 21 aa, Entamoeba invadens
DEKKRWMNLEDDCLVNKYASL

SEQ ID NO: 2787724 - protein, 24 aa, Entamoeba invadens
DEKLRKVSYCVLQRSIYLLNTQTT

SEQ ID NO: 2787725 - protein, 26 aa, Entamoeba invadens
DEKRASCVGFLLKNWRRVPHAFDTVF

SEQ ID NO: 2787726 - protein, 23 aa, Entamoeba invadens
DEKRATNLVFLMFGLGFLLLFPW

SEQ ID NO: 2787727 - protein, 20 aa, Entamoeba invadens
DEKRYMAVLRDLRHLETSHL

SEQ ID NO: 2787728 - protein, 19 aa, Entamoeba invadens
DEKSFGFFLKVADDCLRLG

SEQ ID NO: 2787729 - protein, 23 aa, Entamoeba invadens
DEKTDICAKCAATYYLSEGTCVT

SEQ ID NO: 2787730 - protein, 17 aa, Entamoeba invadens
DELASVVKDCWRQKMYD

SEQ ID NO: 2787731 - protein, 17 aa, Entamoeba invadens
DELCLDYQVIGSDLQCT

SEQ ID NO: 2787732 - protein, 20 aa, Entamoeba invadens
DELCTSWSYPNSFICQECVS

SEQ ID NO: 2787733 - protein, 19 aa, Entamoeba invadens
DELKCMMCMNIDPEKLSDE

SEQ ID NO: 2787734 - protein, 22 aa, Entamoeba invadens
DELKSVFPPTRLKFNVNNSDQF

SEQ ID NO: 2787735 - protein, 17 aa, Entamoeba invadens
DELMFKMIELVYQLTKY

SEQ ID NO: 2787736 - protein, 24 aa, Entamoeba invadens
DELMKSCWNSVVSKRPTINVLVDK

SEQ ID NO: 2787737 - protein, 21 aa, Entamoeba invadens
DELTLPLIHTLKVFLETISKS

SEQ ID NO: 2787738 - protein, 17 aa, Entamoeba invadens
DEMILLFNGTSFTSTTL

SEQ ID NO: 2787739 - protein, 18 aa, Entamoeba invadens
DENHCFQCGSVDGVQLYL

SEQ ID NO: 2787740 - protein, 25 aa, Entamoeba invadens
DENMAVILLRLLVYFHEHVSDRDQI

SEQ ID NO: 2787741 - protein, 20 aa, Entamoeba invadens
DEPPIWLLIASFVLIGMVGT

SEQ ID NO: 2787742 - protein, 17 aa, Entamoeba invadens
DEQHLICFMTIRNYFAM

SEQ ID NO: 2787743 - protein, 29 aa, Entamoeba invadens
DEQRPTVVIYKRGLHLFSNIDQRYWIVYR

SEQ ID NO: 2787744 - protein, 24 aa, Entamoeba invadens
DERGCLSCKSGYYSTTKFECEPCD

SEQ ID NO: 2787745 - protein, 22 aa, Entamoeba invadens
DERKCLQCSVGYYPEDSTSVCK

SEQ ID NO: 2787746 - protein, 22 aa, Entamoeba invadens
DERKCTLSFCQNGTFKEQNGMC

SEQ ID NO: 2787747 - protein, 24 aa, Entamoeba invadens
DERLIKFDLSSLFDLAFYSININH

SEQ ID NO: 2787748 - protein, 17 aa, Entamoeba invadens
DESCAKCDVFGNCIDCN

SEQ ID NO: 2787749 - protein, 25 aa, Entamoeba invadens
DESSDIDTGFCFYKNKYRFGKWFKL

SEQ ID NO: 2787750 - protein, 21 aa, Entamoeba invadens
DETADFFKVFNTCIQQIDENT

SEQ ID NO: 2787751 - protein, 17 aa, Entamoeba invadens
DETCLDYFCSGYACNRC

SEQ ID NO: 2787752 - protein, 28 aa, Entamoeba invadens
DETDCYKCKTGLFLRDGKCLSCGDIYDN

SEQ ID NO: 2787753 - protein, 24 aa, Entamoeba invadens
DETIKGKVIMRGSGNVEGCSYVIH

SEQ ID NO: 2787754 - protein, 21 aa, Entamoeba invadens
DETKMSVGMKIDKLFVQLEKE

SEQ ID NO: 2787755 - protein, 24 aa, Entamoeba invadens
DETSGKCVACFTIPNCNACSSDAK

SEQ ID NO: 2787756 - protein, 24 aa, Entamoeba invadens
DEVDLKLRVKIMIDAAKGILYLHE

SEQ ID NO: 2787757 - protein, 21 aa, Entamoeba invadens
DEVMKYFYIFVGMSGIAFIST

SEQ ID NO: 2787758 - protein, 26 aa, Entamoeba invadens
DEVVECFLRLLLMLLLSLLLKSRPFV

SEQ ID NO: 2787759 - protein, 24 aa, Entamoeba invadens
DEVVMKMRIKLMLDTAKGIQYLHA

SEQ ID NO: 2787760 - protein, 24 aa, Entamoeba invadens
DEWVKRYSVVFDFGVYNKLKENEK

SEQ ID NO: 2787761 - protein, 22 aa, Entamoeba invadens
DEYEIIKSCWAHKTQDRPTMKE

SEQ ID NO: 2787762 - protein, 20 aa, Entamoeba invadens
DEYHLSFVFNRVDVTLDNLG

SEQ ID NO: 2787763 - protein, 31 aa, Entamoeba invadens
DEYLELPYHLKLRILFDTARGMQFLHENKIM

SEQ ID NO: 2787764 - protein, 18 aa, Entamoeba invadens
DFADCYFENFTVNKQKVD

SEQ ID NO: 2787765 - protein, 26 aa, Entamoeba invadens
DFASECIRWLGAFRFILWTLWYCVKL

SEQ ID NO: 2787766 - protein, 21 aa, Entamoeba invadens
DFCFKEQWIKQFYLKTIPLIP

SEQ ID NO: 2787767 - protein, 19 aa, Entamoeba invadens
DFDGFLLIRHKIDEGVIQI

SEQ ID NO: 2787768 - protein, 19 aa, Entamoeba invadens
DFDNEFRKILDFFEWNESV

SEQ ID NO: 2787769 - protein, 24 aa, Entamoeba invadens
DFDYLRLSSFNLFLIKIILYLFYI

SEQ ID NO: 2787770 - protein, 26 aa, Entamoeba invadens
DFEATSWRKLNCRNSFYCVYGQSTHN

SEQ ID NO: 2787771 - protein, 17 aa, Entamoeba invadens
DFEDVRFSYPIRPLTMI

SEQ ID NO: 2787772 - protein, 24 aa, Entamoeba invadens
DFEIKCLISLPLKIGCSVCNKKYF

SEQ ID NO: 2787773 - protein, 18 aa, Entamoeba invadens
DFEREVCMLDKFRSEYIV

SEQ ID NO: 2787774 - protein, 26 aa, Entamoeba invadens
DFEVICLNSDLTIRWRQNAYKAKAQA

SEQ ID NO: 2787775 - protein, 21 aa, Entamoeba invadens
DFFRINIWFGVEYTFAQLHSD

SEQ ID NO: 2787776 - protein, 21 aa, Entamoeba invadens
DFGKQLPFRFVYICEYVGPLA

SEQ ID NO: 2787777 - protein, 25 aa, Entamoeba invadens
DFGLKFLNISGLNTWNKMEFFEPLR

SEQ ID NO: 2787778 - protein, 25 aa, Entamoeba invadens
DFGPLRFIIFANFFLGTYIFIPYLF

SEQ ID NO: 2787779 - protein, 27 aa, Entamoeba invadens
DFIKMPYKLKVRMLFDTSRGMQFLHEN

SEQ ID NO: 2787780 - protein, 23 aa, Entamoeba invadens
DFKCKYCDATCGGKCDTTNGHCT

SEQ ID NO: 2787781 - protein, 19 aa, Entamoeba invadens
DFKCKYCDVTCGGKCDTTN

SEQ ID NO: 2787782 - protein, 23 aa, Entamoeba invadens
DFKKALIPFCMISSCRIIVEYII

SEQ ID NO: 2787783 - protein, 30 aa, Entamoeba invadens
DFKKNTKSGVWFKFFGKKGGNVTVETCGEE

SEQ ID NO: 2787784 - protein, 26 aa, Entamoeba invadens
DFKQSVFKSSLFSMSNMSTLSFIGKH

SEQ ID NO: 2787785 - protein, 27 aa, Entamoeba invadens
DFKQSVFKSSLFSMSNMSTLSFIGKHN

SEQ ID NO: 2787786 - protein, 26 aa, Entamoeba invadens
DFMIPTLLASVWITFRVFQSTFVDLK

SEQ ID NO: 2787787 - protein, 21 aa, Entamoeba invadens
DFMNRMISFNFGTAIRLLVKT

SEQ ID NO: 2787788 - protein, 30 aa, Entamoeba invadens
DFNDAKCSSGRSCIMLLLSLAKEMNKLPKE

SEQ ID NO: 2787789 - protein, 17 aa, Entamoeba invadens
DFNSGPDAYRWMAHTYG

SEQ ID NO: 2787790 - protein, 23 aa, Entamoeba invadens
DFPEEDRLDFVYNYLSQWSDPAN

SEQ ID NO: 2787791 - protein, 21 aa, Entamoeba invadens
DFPFFRYVTVPANSSHIEDFC

SEQ ID NO: 2787792 - protein, 20 aa, Entamoeba invadens
DFPIPGFLVKIANTYCVLLM

SEQ ID NO: 2787793 - protein, 33 aa, Entamoeba invadens
DFPNFLRTIPVDSFSFSSIVAFVDAFNKKNVAM

SEQ ID NO: 2787794 - protein, 17 aa, Entamoeba invadens
DFQFEIVDVKLLLIKNI

SEQ ID NO: 2787795 - protein, 19 aa, Entamoeba invadens
DFQKCYSCENGVINSTGKC

SEQ ID NO: 2787796 - protein, 24 aa, Entamoeba invadens
DFQRKCITCSTGYYPDADGNCVTC

SEQ ID NO: 2787797 - protein, 21 aa, Entamoeba invadens
DFRCKYCDATCKLKCDTTNGH

SEQ ID NO: 2787798 - protein, 22 aa, Entamoeba invadens
DFRDVLFFADFFRTFSANEVNW

SEQ ID NO: 2787799 - protein, 24 aa, Entamoeba invadens
DFSDDGKVVFGWKDHILVVQMSTG

SEQ ID NO: 2787800 - protein, 24 aa, Entamoeba invadens
DFSHNFTEGVAFCPKNTILDNTVI

SEQ ID NO: 2787801 - protein, 24 aa, Entamoeba invadens
DFSKEGFRTLLFAKREITETYFGE

SEQ ID NO: 2787802 - protein, 25 aa, Entamoeba invadens
DFSKFTFTVCIDWKKDNTIRYDQSI

SEQ ID NO: 2787803 - protein, 31 aa, Entamoeba invadens
DFSMDLECEWPRAKFNDFKGLFSSETVKIAL

SEQ ID NO: 2787804 - protein, 20 aa, Entamoeba invadens
DFSSKSAKYVNYEFNGIQVD

SEQ ID NO: 2787805 - protein, 28 aa, Entamoeba invadens
DFSVGLKIKICFDVAKGMKYLHSNNIIH

SEQ ID NO: 2787806 - protein, 19 aa, Entamoeba invadens
DFTRYRDSRVLKYSMRSVS

SEQ ID NO: 2787807 - protein, 21 aa, Entamoeba invadens
DFYEPCGLVAASFFNDTFKID

SEQ ID NO: 2787808 - protein, 21 aa, Entamoeba invadens
DFYFEKGVVLEKLFIQTKNTQ

SEQ ID NO: 2787809 - protein, 22 aa, Entamoeba invadens
DFYFEKGVVLEKLFLQTSNEQE

SEQ ID NO: 2787810 - protein, 18 aa, Entamoeba invadens
DFYGRVYGTVFSYSFGEI

SEQ ID NO: 2787811 - protein, 28 aa, Entamoeba invadens
DFYVEFPYKLKVRMLFDTSRGMQFLHEN

SEQ ID NO: 2787812 - protein, 22 aa, Entamoeba invadens
DGAVVCELCKAGTYQNETGQSE

SEQ ID NO: 2787813 - protein, 25 aa, Entamoeba invadens
DGCFICGETGHWACDCPQKKYGSRG

SEQ ID NO: 2787814 - protein, 19 aa, Entamoeba invadens
DGDASGFQNGWGSTSTTFS

SEQ ID NO: 2787815 - protein, 21 aa, Entamoeba invadens
DGDCLSSLDTSHMILTVCCIG

SEQ ID NO: 2787816 - protein, 20 aa, Entamoeba invadens
DGDCVICSDGYYRTPNNNTK

SEQ ID NO: 2787817 - protein, 17 aa, Entamoeba invadens
DGDCVVCSDGYYRTPNN

SEQ ID NO: 2787818 - protein, 18 aa, Entamoeba invadens
DGDWKYYLDPSLSLVVAC

SEQ ID NO: 2787819 - protein, 25 aa, Entamoeba invadens
DGECDLCSSACKTCKSSAEECTQCS

SEQ ID NO: 2787820 - protein, 18 aa, Entamoeba invadens
DGECIECNSTYYLNEGYC

SEQ ID NO: 2787821 - protein, 19 aa, Entamoeba invadens
DGFALKYNLCYKCGENCSS

SEQ ID NO: 2787822 - protein, 21 aa, Entamoeba invadens
DGFCYSACSVFAKGMADRGNA

SEQ ID NO: 2787823 - protein, 19 aa, Entamoeba invadens
DGFFLSVVFLLNFGLSKLY

SEQ ID NO: 2787824 - protein, 36 aa, Entamoeba invadens
DGFIVLKVPFPLSYRFKLITQQGMGFLDIDVSYVSS

SEQ ID NO: 2787825 - protein, 20 aa, Entamoeba invadens
DGFQCIPCQIGTYSNIPGSE

SEQ ID NO: 2787826 - protein, 24 aa, Entamoeba invadens
DGGCAICKNGYYWQGRNCYKCGSN

SEQ ID NO: 2787827 - protein, 21 aa, Entamoeba invadens
DGGFGCDHCVCVNGTKKYAKA

SEQ ID NO: 2787828 - protein, 21 aa, Entamoeba invadens
DGGFGCDHCVCVNGTQKFAKA

SEQ ID NO: 2787829 - protein, 17 aa, Entamoeba invadens
DGGKEWINVFSQLILSF

SEQ ID NO: 2787830 - protein, 22 aa, Entamoeba invadens
DGGKYCEHCLCNPKESVHYLVP

SEQ ID NO: 2787831 - protein, 25 aa, Entamoeba invadens
DGGVGCLFCHCVAGYLPYASPRRGC

SEQ ID NO: 2787832 - protein, 21 aa, Entamoeba invadens
DGIARPAFVQLLLKVNPLLYT

SEQ ID NO: 2787833 - protein, 20 aa, Entamoeba invadens
DGICKKCDTNHFFNYKTQRC

SEQ ID NO: 2787834 - protein, 22 aa, Entamoeba invadens
DGIIKFSFGILIVKESNTQITY

SEQ ID NO: 2787835 - protein, 21 aa, Entamoeba invadens
DGILCKKKVVWWVVLIVVIFI

SEQ ID NO: 2787836 - protein, 17 aa, Entamoeba invadens
DGKCGICNILSNCINRE

SEQ ID NO: 2787837 - protein, 23 aa, Entamoeba invadens
DGKCLTCAAGYGFYNGVCTLCGD

SEQ ID NO: 2787838 - protein, 21 aa, Entamoeba invadens
DGKCREIFKYPANNKRDLFIT

SEQ ID NO: 2787839 - protein, 20 aa, Entamoeba invadens
DGKCTPCRAGTYPSGDMCVE

SEQ ID NO: 2787840 - protein, 24 aa, Entamoeba invadens
DGKCVRDTNCLYAEHRFCVKCKEG

SEQ ID NO: 2787841 - protein, 20 aa, Entamoeba invadens
DGKIPLWRYLVFIPAMLICV

SEQ ID NO: 2787842 - protein, 17 aa, Entamoeba invadens
DGKKKEEITEDKLTPEM

SEQ ID NO: 2787843 - protein, 19 aa, Entamoeba invadens
DGKLSTIVFTRTGSNKTPV

SEQ ID NO: 2787844 - protein, 23 aa, Entamoeba invadens
DGKRLPLDNTIPVEWKNLIVKCW

SEQ ID NO: 2787845 - protein, 24 aa, Entamoeba invadens
DGKSCLKCNKGDYSTMCKSCESNC

SEQ ID NO: 2787846 - protein, 21 aa, Entamoeba invadens
DGKTCYKCLAMSGNSEVEKIS

SEQ ID NO: 2787847 - protein, 26 aa, Entamoeba invadens
DGKVSLPKRYVLRILEDVKRHFMTTS

SEQ ID NO: 2787848 - protein, 18 aa, Entamoeba invadens
DGLCIQCTAGTKANQVTN

SEQ ID NO: 2787849 - protein, 19 aa, Entamoeba invadens
DGLCLKCTQYTPSDDSIVF

SEQ ID NO: 2787850 - protein, 28 aa, Entamoeba invadens
DGLECYRTRWELIIPFVVIGVLILIVIV

SEQ ID NO: 2787851 - protein, 22 aa, Entamoeba invadens
DGLPISTIIGWIVGDSFKTIYF

SEQ ID NO: 2787852 - protein, 20 aa, Entamoeba invadens
DGLRCLQCTENFYPTDSINN

SEQ ID NO: 2787853 - protein, 21 aa, Entamoeba invadens
DGLRCLQCTENFYPTDSINNE

SEQ ID NO: 2787854 - protein, 18 aa, Entamoeba invadens
DGLSCERRSIWTIILGVI

SEQ ID NO: 2787855 - protein, 18 aa, Entamoeba invadens
DGLVKCIEEKVVGRCLHG

SEQ ID NO: 2787856 - protein, 32 aa, Entamoeba invadens
DGNEAKSWDRKGCACDGEFCELIAGAVNPFVM

SEQ ID NO: 2787857 - protein, 26 aa, Entamoeba invadens
DGNFCRKCTSGVLYGVCDVCSSHCIH

SEQ ID NO: 2787858 - protein, 20 aa, Entamoeba invadens
DGNIVFRKGMTCSQIDTNGV

SEQ ID NO: 2787859 - protein, 25 aa, Entamoeba invadens
DGNKCLRCKKGYYSIGKGCVKCEEG

SEQ ID NO: 2787860 - protein, 20 aa, Entamoeba invadens
DGNLCLKCHTGDYSTQCESC

SEQ ID NO: 2787861 - protein, 18 aa, Entamoeba invadens
DGNLGAVVELQFDENKDV

SEQ ID NO: 2787862 - protein, 20 aa, Entamoeba invadens
DGNNLPAMFYLNRRYNVTQS

SEQ ID NO: 2787863 - protein, 33 aa, Entamoeba invadens
DGNQCKSCSMEFCNYCNSTFCYQCGSNAAGTQL

SEQ ID NO: 2787864 - protein, 23 aa, Entamoeba invadens
DGNSVSTILAFFVSVCDNTENAE

SEQ ID NO: 2787865 - protein, 25 aa, Entamoeba invadens
DGQQGRWEKYYVFKVNRDMSYTVEN

SEQ ID NO: 2787866 - protein, 18 aa, Entamoeba invadens
DGRCQLIEKCILAKNNRC

SEQ ID NO: 2787867 - protein, 19 aa, Entamoeba invadens
DGRCTPCRAGTIQNGDMCV

SEQ ID NO: 2787868 - protein, 19 aa, Entamoeba invadens
DGRCTPCRAGTYPSGDMCV

SEQ ID NO: 2787869 - protein, 18 aa, Entamoeba invadens
DGRCVSCDNTTYYTDFEC

SEQ ID NO: 2787870 - protein, 20 aa, Entamoeba invadens
DGRIAFWQLGLYGHWGEWHE

SEQ ID NO: 2787871 - protein, 17 aa, Entamoeba invadens
DGRKISLNYGIRDVPQP

SEQ ID NO: 2787872 - protein, 25 aa, Entamoeba invadens
DGRLYLTNYRLMWIVSNEIINPVGM

SEQ ID NO: 2787873 - protein, 25 aa, Entamoeba invadens
DGRRSYCYCRRELHHTSQCLIFVSH

SEQ ID NO: 2787874 - protein, 19 aa, Entamoeba invadens
DGSCGGCAKGKYSSNGECL

SEQ ID NO: 2787875 - protein, 27 aa, Entamoeba invadens
DGSCSRCEVSNCLRCSGNTCLECSSNY

SEQ ID NO: 2787876 - protein, 23 aa, Entamoeba invadens
DGSCYRTSLSTVLIPIGLSVGLV

SEQ ID NO: 2787877 - protein, 20 aa, Entamoeba invadens
DGSIFARSAFIKTVDKNVLE

SEQ ID NO: 2787878 - protein, 18 aa, Entamoeba invadens
DGSIVCPTDRLARSVETK

SEQ ID NO: 2787879 - protein, 23 aa, Entamoeba invadens
DGSSCQKCPLGCLTCHTDTNCSS

SEQ ID NO: 2787880 - protein, 19 aa, Entamoeba invadens
DGTCAICGKQIKNNSNLFF

SEQ ID NO: 2787881 - protein, 17 aa, Entamoeba invadens
DGTCSLCSGESSICEKC

SEQ ID NO: 2787882 - protein, 18 aa, Entamoeba invadens
DGTCSLCSGESSICEKCG

SEQ ID NO: 2787883 - protein, 20 aa, Entamoeba invadens
DGTFFKALHKSICDVCGVDG

SEQ ID NO: 2787884 - protein, 22 aa, Entamoeba invadens
DGTICTLKLISTLSKFDFKKSM

SEQ ID NO: 2787885 - protein, 25 aa, Entamoeba invadens
DGTKCTLCKTGYFLTIDNICALCTT

SEQ ID NO: 2787886 - protein, 17 aa, Entamoeba invadens
DGTLCESHVVWWVILLG

SEQ ID NO: 2787887 - protein, 21 aa, Entamoeba invadens
DGTNCCARWFGACSLIAVVVI

SEQ ID NO: 2787888 - protein, 23 aa, Entamoeba invadens
DGTSCNSGVCIFDYTKTTKSSVE

SEQ ID NO: 2787889 - protein, 19 aa, Entamoeba invadens
DGVCTLCSTGSYSESGTVC

SEQ ID NO: 2787890 - protein, 23 aa, Entamoeba invadens
DGVECFTLLLLWSLDRMSSQFNQ

SEQ ID NO: 2787891 - protein, 18 aa, Entamoeba invadens
DGVLAVSFVLSLIALFAF

SEQ ID NO: 2787892 - protein, 17 aa, Entamoeba invadens
DGVLCCNVSYIVVPLEC

SEQ ID NO: 2787893 - protein, 22 aa, Entamoeba invadens
DGVTCLKCSTMFSVSADGKDCE

SEQ ID NO: 2787894 - protein, 19 aa, Entamoeba invadens
DGYFPPYDMDAGIAEIQTY

SEQ ID NO: 2787895 - protein, 19 aa, Entamoeba invadens
DGYGGSDCHLKCYYKGKWN

SEQ ID NO: 2787896 - protein, 20 aa, Entamoeba invadens
DGYISIALVYGCYGISQFFT

SEQ ID NO: 2787897 - protein, 20 aa, Entamoeba invadens
DGYISVALVYGFFGIGQFVT

SEQ ID NO: 2787898 - protein, 21 aa, Entamoeba invadens
DGYYRVGFDCYECDPKCGTCN

SEQ ID NO: 2787899 - protein, 20 aa, Entamoeba invadens
DGYYRVGLDCFECDLKCEKC

SEQ ID NO: 2787900 - protein, 26 aa, Entamoeba invadens
DGYYRVGLNCYECFLNCSTCNTKDKC

SEQ ID NO: 2787901 - protein, 20 aa, Entamoeba invadens
DGYYRVGMDCVECLSNCSIC

SEQ ID NO: 2787902 - protein, 20 aa, Entamoeba invadens
DGYYRVGMDCVECLSNCSTC

SEQ ID NO: 2787903 - protein, 22 aa, Entamoeba invadens
DHCQIVAMNLCSLCSPNSSYVN

SEQ ID NO: 2787904 - protein, 27 aa, Entamoeba invadens
DHFYVYSGEEWHEWFISSIEDLPLIEV

SEQ ID NO: 2787905 - protein, 17 aa, Entamoeba invadens
DHHCPWIGQCVGQKNYK

SEQ ID NO: 2787906 - protein, 23 aa, Entamoeba invadens
DHHCPWLGNCVGRRNYRSYFFLL

SEQ ID NO: 2787907 - protein, 18 aa, Entamoeba invadens
DHHCPWTGQCIGTYNLRY

SEQ ID NO: 2787908 - protein, 17 aa, Entamoeba invadens
DHIFLFVDFFLANMMNY

SEQ ID NO: 2787909 - protein, 17 aa, Entamoeba invadens
DHIYIGFWLKYRFQMAN

SEQ ID NO: 2787910 - protein, 24 aa, Entamoeba invadens
DHKPVSCCFLLYPSKLFNDKLEEV

SEQ ID NO: 2787911 - protein, 23 aa, Entamoeba invadens
DHPFYKYFMRGMLVTLSTDSPMH

SEQ ID NO: 2787912 - protein, 17 aa, Entamoeba invadens
DHSCLTCGQEYFNTNEG

SEQ ID NO: 2787913 - protein, 21 aa, Entamoeba invadens
DHSLCVICPAGTYNSQNGSTC

SEQ ID NO: 2787914 - protein, 22 aa, Entamoeba invadens
DHTCNLCKWSSPSALNPEAYLM

SEQ ID NO: 2787915 - protein, 19 aa, Entamoeba invadens
DHTELLPIMPAIGEGAFGI

SEQ ID NO: 2787916 - protein, 29 aa, Entamoeba invadens
DIAFIVIICMADVTLLLVLGVFGTLAILQ

SEQ ID NO: 2787917 - protein, 27 aa, Entamoeba invadens
DIAKKRLPRLFAWKQFHSYIRELGIDE

SEQ ID NO: 2787918 - protein, 22 aa, Entamoeba invadens
DIAKPGLNTTIFLSLALLISKL

SEQ ID NO: 2787919 - protein, 27 aa, Entamoeba invadens
DIATGFVNCCVRIGAPQIFIVSHLLGG

SEQ ID NO: 2787920 - protein, 17 aa, Entamoeba invadens
DICLYKYTNGVLTVQYL

SEQ ID NO: 2787921 - protein, 19 aa, Entamoeba invadens
DICRFDFIGGKTITFRSFN

SEQ ID NO: 2787922 - protein, 18 aa, Entamoeba invadens
DICVKKDECLSCKEGYFK

SEQ ID NO: 2787923 - protein, 20 aa, Entamoeba invadens
DIDIVICNCSLFNPTPSISA

SEQ ID NO: 2787924 - protein, 18 aa, Entamoeba invadens
DIDKSFVFFKDFFYSKDT

SEQ ID NO: 2787925 - protein, 31 aa, Entamoeba invadens
DIDNSFCYYRQKFRVGQWLKMNMSQVTHDHL

SEQ ID NO: 2787926 - protein, 23 aa, Entamoeba invadens
DIDPRYFKLFGDLFGNYSIEKTT

SEQ ID NO: 2787927 - protein, 26 aa, Entamoeba invadens
DIDTRLSAARCFYEIWKKDERDVLSM

SEQ ID NO: 2787928 - protein, 26 aa, Entamoeba invadens
DIDVSYVSSISWYILVFAGGRYIMKL

SEQ ID NO: 2787929 - protein, 18 aa, Entamoeba invadens
DIDYSFCYHKQKFRIGKW

SEQ ID NO: 2787930 - protein, 32 aa, Entamoeba invadens
DIEALKKMRAHRGLRHYWGLRVRGQHTKTTGR

SEQ ID NO: 2787931 - protein, 22 aa, Entamoeba invadens
DIECLYMIFFFILKNLEDNLLD

SEQ ID NO: 2787932 - protein, 18 aa, Entamoeba invadens
DIEIPLDMVDDLEKQTGV

SEQ ID NO: 2787933 - protein, 18 aa, Entamoeba invadens
DIEQCLRGSEGCGVNCYC

SEQ ID NO: 2787934 - protein, 22 aa, Entamoeba invadens
DIEVALSLYLFFTMIYLNLIKL

SEQ ID NO: 2787935 - protein, 17 aa, Entamoeba invadens
DIFIGVFFFVVFLMFTI

SEQ ID NO: 2787936 - protein, 19 aa, Entamoeba invadens
DIFSFAISMYECFTWKDPY

SEQ ID NO: 2787937 - protein, 19 aa, Entamoeba invadens
DIFSFSIVMFEIFHWGNPY

SEQ ID NO: 2787938 - protein, 22 aa, Entamoeba invadens
DIFVALRVPSPVNSFVLFANKE

SEQ ID NO: 2787939 - protein, 22 aa, Entamoeba invadens
DIGACTLTFHIFRKMQMDIMSR

SEQ ID NO: 2787940 - protein, 17 aa, Entamoeba invadens
DIGFGYTKVRAVELATK

SEQ ID NO: 2787941 - protein, 19 aa, Entamoeba invadens
DIGRGWEYDPLAPKSVVLS

SEQ ID NO: 2787942 - protein, 21 aa, Entamoeba invadens
DIICIYGKVTPLRECAVKETF

SEQ ID NO: 2787943 - protein, 19 aa, Entamoeba invadens
DIIEKIRSGEIGRQFLKKT

SEQ ID NO: 2787944 - protein, 20 aa, Entamoeba invadens
DIIEVLKKALGIEDRVMCFV

SEQ ID NO: 2787945 - protein, 20 aa, Entamoeba invadens
DIIPFSAFAATLVFTGIAMD

SEQ ID NO: 2787946 - protein, 23 aa, Entamoeba invadens
DIISMGGNCFVSFGENVTEVNNL

SEQ ID NO: 2787947 - protein, 18 aa, Entamoeba invadens
DIIYHIVFVILKEVKIRF

SEQ ID NO: 2787948 - protein, 22 aa, Entamoeba invadens
DIKDICVFLGPVFAAFTVIVGY

SEQ ID NO: 2787949 - protein, 21 aa, Entamoeba invadens
DIKEKLCHVALDFNEEIEKAA

SEQ ID NO: 2787950 - protein, 17 aa, Entamoeba invadens
DIKEVLGVSAYFKPTQT

SEQ ID NO: 2787951 - protein, 20 aa, Entamoeba invadens
DIKIIREFIFKKNAVDKQRV

SEQ ID NO: 2787952 - protein, 22 aa, Entamoeba invadens
DIKPDNFLIFSLEAKDTVNAKL

SEQ ID NO: 2787953 - protein, 18 aa, Entamoeba invadens
DIKPDNFLLFSIEESEVV

SEQ ID NO: 2787954 - protein, 21 aa, Entamoeba invadens
DIKPDNFLVFSLKENELANAK

SEQ ID NO: 2787955 - protein, 21 aa, Entamoeba invadens
DILGGTAFGIFFGVVVYLAKF

SEQ ID NO: 2787956 - protein, 17 aa, Entamoeba invadens
DILPFGFYVKVGGSDVQ

SEQ ID NO: 2787957 - protein, 25 aa, Entamoeba invadens
DILPILLRLAVHAFLKSQPLNSSQT

SEQ ID NO: 2787958 - protein, 20 aa, Entamoeba invadens
DILPLMKHWFINKEENMYYE

SEQ ID NO: 2787959 - protein, 20 aa, Entamoeba invadens
DILSQMLLERKFLFVSEYLM

SEQ ID NO: 2787960 - protein, 21 aa, Entamoeba invadens
DILTWVFEFLCVVEVVLFWVF

SEQ ID NO: 2787961 - protein, 19 aa, Entamoeba invadens
DIMKSACAIIFGAMSVGFA

SEQ ID NO: 2787962 - protein, 26 aa, Entamoeba invadens
DINCLRCSKSECLKCKDEMKTSGNGC

SEQ ID NO: 2787963 - protein, 17 aa, Entamoeba invadens
DINEGKYLIGLSLNTAD

SEQ ID NO: 2787964 - protein, 18 aa, Entamoeba invadens
DIPHCVKSGHSMCVKCES

SEQ ID NO: 2787965 - protein, 17 aa, Entamoeba invadens
DIPPGFTSINGHCFYGC

SEQ ID NO: 2787966 - protein, 24 aa, Entamoeba invadens
DIPPMKLRVKMMIDGARGVLYLHE

SEQ ID NO: 2787967 - protein, 23 aa, Entamoeba invadens
DIRCYSCVSGYYQSYGHCYTCNE

SEQ ID NO: 2787968 - protein, 26 aa, Entamoeba invadens
DIRDFSKCDLTAAGVLEIKDGIELTC

SEQ ID NO: 2787969 - protein, 21 aa, Entamoeba invadens
DISFMRLFYILTLICVTATLS

SEQ ID NO: 2787970 - protein, 25 aa, Entamoeba invadens
DISGICIICPIGTYSLDSQCIECDN

SEQ ID NO: 2787971 - protein, 18 aa, Entamoeba invadens
DISLTVALRNHFSIGPFV

SEQ ID NO: 2787972 - protein, 18 aa, Entamoeba invadens
DISNCIFITCKIGYTLNS

SEQ ID NO: 2787973 - protein, 21 aa, Entamoeba invadens
DISNCKKCDATQCVECLTNYT

SEQ ID NO: 2787974 - protein, 24 aa, Entamoeba invadens
DISNCKKCDVTGCVECLTNYTQSL

SEQ ID NO: 2787975 - protein, 22 aa, Entamoeba invadens
DISPVSSWRLGVLIGGLIMLLV

SEQ ID NO: 2787976 - protein, 26 aa, Entamoeba invadens
DISTCFPRTLVNTGLEMTSGCAGEPT

SEQ ID NO: 2787977 - protein, 21 aa, Entamoeba invadens
DITCDCKFSQFDVDCTKNPSV

SEQ ID NO: 2787978 - protein, 19 aa, Entamoeba invadens
DITITAWKAFWGRKKMDVA

SEQ ID NO: 2787979 - protein, 24 aa, Entamoeba invadens
DITKCFEEYFGIKNINSINDYLNS

SEQ ID NO: 2787980 - protein, 19 aa, Entamoeba invadens
DITKCFEEYFGVKNINSIN

SEQ ID NO: 2787981 - protein, 20 aa, Entamoeba invadens
DIVDFKGWHLPVYPITLSSD

SEQ ID NO: 2787982 - protein, 17 aa, Entamoeba invadens
DIVDVFYFPSVALDIIG

SEQ ID NO: 2787983 - protein, 25 aa, Entamoeba invadens
DIVEIFEIFTFIILLCLTNFGSYDW

SEQ ID NO: 2787984 - protein, 20 aa, Entamoeba invadens
DIYIGFVFSLFLFKLYHNYI

SEQ ID NO: 2787985 - protein, 20 aa, Entamoeba invadens
DIYSFAITMFEVFGWCMAYP

SEQ ID NO: 2787986 - protein, 33 aa, Entamoeba invadens
DIYSFAITMFEVFGWSQAYLIDTFKFAWKIAEF

SEQ ID NO: 2787987 - protein, 27 aa, Entamoeba invadens
DIYSFAITMLSCFAWDNPFPKTIYPFA

SEQ ID NO: 2787988 - protein, 42 aa, Entamoeba invadens
DIYSFGITLLECFKWKEAYGGENFRYPWGIVDFITKGKRLEK

SEQ ID NO: 2787989 - protein, 19 aa, Entamoeba invadens
DIYSFGITMFECFSWENAY

SEQ ID NO: 2787990 - protein, 32 aa, Entamoeba invadens
DIYSFGITMFEIFSWKEAYPKEEFKFPWKIAE

SEQ ID NO: 2787991 - protein, 30 aa, Entamoeba invadens
DIYSFGMTMYEVFGWKSSYPKDEFKYPWDV

SEQ ID NO: 2787992 - protein, 31 aa, Entamoeba invadens
DKAMSRVIFCISPTAFLVVLFGITALVLTTY

SEQ ID NO: 2787993 - protein, 23 aa, Entamoeba invadens
DKARELCMPYLHFVKDAETTRKR

SEQ ID NO: 2787994 - protein, 17 aa, Entamoeba invadens
DKARFVEIYYKSKTPER

SEQ ID NO: 2787995 - protein, 23 aa, Entamoeba invadens
DKARMEAYLSRVLKVQAPSLTQI

SEQ ID NO: 2787996 - protein, 25 aa, Entamoeba invadens
DKAYKEIKFAFQIANYVCEGKRPET

SEQ ID NO: 2787997 - protein, 25 aa, Entamoeba invadens
DKCAVCKDGYILKDSNCFACNEACE

SEQ ID NO: 2787998 - protein, 25 aa, Entamoeba invadens
DKCDFLFQFALDMLKRMKNKNTHIF

SEQ ID NO: 2787999 - protein, 19 aa, Entamoeba invadens
DKCEVCSTSIRKCNQCTSG

SEQ ID NO: 2788000 - protein, 24 aa, Entamoeba invadens
DKCIRRLKEPTNWQILQEVNYKEK

SEQ ID NO: 2788001 - protein, 21 aa, Entamoeba invadens
DKCMMCAAKEKCDKCKENFFL

SEQ ID NO: 2788002 - protein, 18 aa, Entamoeba invadens
DKCNTELTYSYKITSGAF

SEQ ID NO: 2788003 - protein, 17 aa, Entamoeba invadens
DKCRGSGKVSESIKVSI

SEQ ID NO: 2788004 - protein, 22 aa, Entamoeba invadens
DKCVECLKGFIKSGDTCYSIKY

SEQ ID NO: 2788005 - protein, 18 aa, Entamoeba invadens
DKCVLGFYPETNMCKSCL

SEQ ID NO: 2788006 - protein, 24 aa, Entamoeba invadens
DKDFKSIRFMVRYENDDVKELPLN

SEQ ID NO: 2788007 - protein, 19 aa, Entamoeba invadens
DKDIRFSRYTKYTDGTGVI

SEQ ID NO: 2788008 - protein, 21 aa, Entamoeba invadens
DKEAKFTLLLGPEVANSDISL

SEQ ID NO: 2788009 - protein, 35 aa, Entamoeba invadens
DKEECLTCFEGFYLKEEKCANCAERGCLNCSINAC

SEQ ID NO: 2788010 - protein, 26 aa, Entamoeba invadens
DKEEFKFPWKIAEFVISGKRLDKEEN

SEQ ID NO: 2788011 - protein, 18 aa, Entamoeba invadens
DKEKEIYKEIKFSLTSKI

SEQ ID NO: 2788012 - protein, 25 aa, Entamoeba invadens
DKELEACWRQIVLLALTRKGKDYEI

SEQ ID NO: 2788013 - protein, 25 aa, Entamoeba invadens
DKERFRFPWKIAEFVMSGKRLEKHE

SEQ ID NO: 2788014 - protein, 21 aa, Entamoeba invadens
DKETCLKCEYGYLINNGKCEP

SEQ ID NO: 2788015 - protein, 18 aa, Entamoeba invadens
DKFDFMFNTIVKFPEVME

SEQ ID NO: 2788016 - protein, 21 aa, Entamoeba invadens
DKFKFPWSIAEFVIKGSRLPK

SEQ ID NO: 2788017 - protein, 18 aa, Entamoeba invadens
DKFKRYKFRYEPNRFRDF

SEQ ID NO: 2788018 - protein, 17 aa, Entamoeba invadens
DKFRCEYIVHFYGAVLI

SEQ ID NO: 2788019 - protein, 17 aa, Entamoeba invadens
DKFRSDHIVHFYGAVFI

SEQ ID NO: 2788020 - protein, 18 aa, Entamoeba invadens
DKFRSEYIVYFYGAVFIP

SEQ ID NO: 2788021 - protein, 20 aa, Entamoeba invadens
DKFVALLFFVDFITSQVKVL

SEQ ID NO: 2788022 - protein, 21 aa, Entamoeba invadens
DKGELSRYVVECMMGNVVSQK

SEQ ID NO: 2788023 - protein, 22 aa, Entamoeba invadens
DKHAVWWIILIIVMFLVLIIII

SEQ ID NO: 2788024 - protein, 23 aa, Entamoeba invadens
DKHVIEVLPPLLVPAFERKSDGS

SEQ ID NO: 2788025 - protein, 25 aa, Entamoeba invadens
DKHWMELVTMLSWVFIIVFAAVIHG

SEQ ID NO: 2788026 - protein, 22 aa, Entamoeba invadens
DKICIECKFGYYKDVDGCKEKS

SEQ ID NO: 2788027 - protein, 27 aa, Entamoeba invadens
DKIICQGSSCSFNLKKEMNPLITTDAS

SEQ ID NO: 2788028 - protein, 23 aa, Entamoeba invadens
DKISGECLTCYAGYGLGYDGNCE

SEQ ID NO: 2788029 - protein, 23 aa, Entamoeba invadens
DKITSFGISCFESVPLTQITFSN

SEQ ID NO: 2788030 - protein, 22 aa, Entamoeba invadens
DKKAKGYTSATCGNWHDEGSFD

SEQ ID NO: 2788031 - protein, 23 aa, Entamoeba invadens
DKKALCILNLLHVTVKLSETRKN

SEQ ID NO: 2788032 - protein, 17 aa, Entamoeba invadens
DKKCLICNNKYHLNSSY

SEQ ID NO: 2788033 - protein, 17 aa, Entamoeba invadens
DKKCVACSSLTEKCNEC

SEQ ID NO: 2788034 - protein, 26 aa, Entamoeba invadens
DKKEFKFPWKIAEFVISGKRLDKKEN

SEQ ID NO: 2788035 - protein, 24 aa, Entamoeba invadens
DKKFNCSICPTGTYANSTNNKCQQ

SEQ ID NO: 2788036 - protein, 18 aa, Entamoeba invadens
DKKINLLVLKSFSFNTIE

SEQ ID NO: 2788037 - protein, 21 aa, Entamoeba invadens
DKKKKTAICITFQVYYNKVTE

SEQ ID NO: 2788038 - protein, 17 aa, Entamoeba invadens
DKKKRRYSWSEKVGNFF

SEQ ID NO: 2788039 - protein, 24 aa, Entamoeba invadens
DKKKSNGCIAKFEGNFLVGYKQGT

SEQ ID NO: 2788040 - protein, 23 aa, Entamoeba invadens
DKKLKKHRISILDSKTDPTTRQK

SEQ ID NO: 2788041 - protein, 20 aa, Entamoeba invadens
DKKTMFSVKRFYRIHKTGRS

SEQ ID NO: 2788042 - protein, 19 aa, Entamoeba invadens
DKLDYCASLKNLDAVKGAP

SEQ ID NO: 2788043 - protein, 21 aa, Entamoeba invadens
DKLEKAACCELAGKKAKFIII

SEQ ID NO: 2788044 - protein, 20 aa, Entamoeba invadens
DKLFELFSILPSYSFAIYQY

SEQ ID NO: 2788045 - protein, 17 aa, Entamoeba invadens
DKLGALYDAFFRTSANN

SEQ ID NO: 2788046 - protein, 17 aa, Entamoeba invadens
DKLGIIIQQSWEHEPKK

SEQ ID NO: 2788047 - protein, 26 aa, Entamoeba invadens
DKLNISYKMLCARALLKTLDDDNIEI

SEQ ID NO: 2788048 - protein, 20 aa, Entamoeba invadens
DKLRGLDHVSCIPNLDVSVQ

SEQ ID NO: 2788049 - protein, 17 aa, Entamoeba invadens
DKLRIKFMYDAAKGILY

SEQ ID NO: 2788050 - protein, 19 aa, Entamoeba invadens
DKLSCIKKTITSGAIAGLV

SEQ ID NO: 2788051 - protein, 18 aa, Entamoeba invadens
DKLSLALMSVDPKDYGYS

SEQ ID NO: 2788052 - protein, 25 aa, Entamoeba invadens
DKLYVSEYFLLFGDVNVDEMVVSSG

SEQ ID NO: 2788053 - protein, 20 aa, Entamoeba invadens
DKMSCGGFFKTVKNLSDSVL

SEQ ID NO: 2788054 - protein, 27 aa, Entamoeba invadens
DKNEFKFPWKIAEFVISGKRLERMENM

SEQ ID NO: 2788055 - protein, 29 aa, Entamoeba invadens
DKNICHRCLKGFYLSNGICKKCADNCDDC

SEQ ID NO: 2788056 - protein, 23 aa, Entamoeba invadens
DKNIFKFPWKIAEFVNDGKRIEQ

SEQ ID NO: 2788057 - protein, 25 aa, Entamoeba invadens
DKNLFKFPWKIAEFVISGKRLERKE

SEQ ID NO: 2788058 - protein, 26 aa, Entamoeba invadens
DKNSCKECKKDLYLNNGICIDCQTFS

SEQ ID NO: 2788059 - protein, 17 aa, Entamoeba invadens
DKPNCPTGNYVTNYIRA

SEQ ID NO: 2788060 - protein, 23 aa, Entamoeba invadens
DKPNGLMLLSSFVKFFIKLLQHL

SEQ ID NO: 2788061 - protein, 22 aa, Entamoeba invadens
DKPRLAPPFYKTDFACEYPEKQ

SEQ ID NO: 2788062 - protein, 27 aa, Entamoeba invadens
DKQMKTIRACYVFRAHMVGAGLGVIMF

SEQ ID NO: 2788063 - protein, 26 aa, Entamoeba invadens
DKRCEKCSNLGVLDCDGSCIAFESSG

SEQ ID NO: 2788064 - protein, 17 aa, Entamoeba invadens
DKRDVFELVEGCRKNKE

SEQ ID NO: 2788065 - protein, 20 aa, Entamoeba invadens
DKRECAMCVSGMYPNTNGTC

SEQ ID NO: 2788066 - protein, 21 aa, Entamoeba invadens
DKRECAMCVSGMYPNTVSHIC

SEQ ID NO: 2788067 - protein, 22 aa, Entamoeba invadens
DKRECAVCKMGKYPNDSSKVCQ

SEQ ID NO: 2788068 - protein, 22 aa, Entamoeba invadens
DKRECAVCKMGKYPSDSNKICQ

SEQ ID NO: 2788069 - protein, 25 aa, Entamoeba invadens
DKRKRLSKKMCLFKISHSNVEFLSV

SEQ ID NO: 2788070 - protein, 23 aa, Entamoeba invadens
DKRYCVSAICILDPQNGKIISLT

SEQ ID NO: 2788071 - protein, 24 aa, Entamoeba invadens
DKSELKKVTIVWGGSEDIVMENTP

SEQ ID NO: 2788072 - protein, 23 aa, Entamoeba invadens
DKSIWRRRVIQFIGEQINTYLYK

SEQ ID NO: 2788073 - protein, 24 aa, Entamoeba invadens
DKSLCFSCDIGFFKTSAMALCESD

SEQ ID NO: 2788074 - protein, 18 aa, Entamoeba invadens
DKSLTCSVLVLAILSTVF

SEQ ID NO: 2788075 - protein, 25 aa, Entamoeba invadens
DKSNFVCKLQCLFTSNSFLQLSSSM

SEQ ID NO: 2788076 - protein, 30 aa, Entamoeba invadens
DKSSNRIYTCFDFSKELPIMNLEDCKISGE

SEQ ID NO: 2788077 - protein, 18 aa, Entamoeba invadens
DKSVEFYNKIVLPGSTKK

SEQ ID NO: 2788078 - protein, 18 aa, Entamoeba invadens
DKSVLAFNLINTENHNDL

SEQ ID NO: 2788079 - protein, 28 aa, Entamoeba invadens
DKSVRGCIKCSFGYFIENQFCSSCDSKT

SEQ ID NO: 2788080 - protein, 27 aa, Entamoeba invadens
DKSVRGCLKCSFGYFVENQFCSSCDSK

SEQ ID NO: 2788081 - protein, 25 aa, Entamoeba invadens
DKSVRYRAIRAIGCITTHSYTNKEL

SEQ ID NO: 2788082 - protein, 26 aa, Entamoeba invadens
DKSYLPRVLLRLVKTVVLCILLKIQN

SEQ ID NO: 2788083 - protein, 22 aa, Entamoeba invadens
DKTATYSILFCRDLNTKELYVV

SEQ ID NO: 2788084 - protein, 25 aa, Entamoeba invadens
DKTCKEFSNGISIRYKSAPGDVLKI

SEQ ID NO: 2788085 - protein, 25 aa, Entamoeba invadens
DKTEFKFPWKIAEFVINRNRLPKKE

SEQ ID NO: 2788086 - protein, 23 aa, Entamoeba invadens
DKTELKPSISLITRAQAEVMKRE

SEQ ID NO: 2788087 - protein, 20 aa, Entamoeba invadens
DKTICLLCGESYQLIDGKCL

SEQ ID NO: 2788088 - protein, 23 aa, Entamoeba invadens
DKTKLKRVVSCEIPELNNLQNVK

SEQ ID NO: 2788089 - protein, 25 aa, Entamoeba invadens
DKTKRGICVMSLISTFLLSRIIMLY

SEQ ID NO: 2788090 - protein, 23 aa, Entamoeba invadens
DKTTCLSCTVGYYLNSNSCTKCT

SEQ ID NO: 2788091 - protein, 26 aa, Entamoeba invadens
DKTTFPWIIADKICKGERPSLDCIDE

SEQ ID NO: 2788092 - protein, 22 aa, Entamoeba invadens
DKTTRKSVNFALQKVGTEHLCP

SEQ ID NO: 2788093 - protein, 22 aa, Entamoeba invadens
DKTYKCDTCYGVTNILVQCGAS

SEQ ID NO: 2788094 - protein, 18 aa, Entamoeba invadens
DKVCTACVNDCKTCTEET

SEQ ID NO: 2788095 - protein, 20 aa, Entamoeba invadens
DKVEYCSKCEPGYFLYDEDR

SEQ ID NO: 2788096 - protein, 20 aa, Entamoeba invadens
DKVKRIMRKSGIALTNVECT

SEQ ID NO: 2788097 - protein, 18 aa, Entamoeba invadens
DKVSVFFKYFNREISAFV

SEQ ID NO: 2788098 - protein, 19 aa, Entamoeba invadens
DKWLKAEDTFFVENNNKLT

SEQ ID NO: 2788099 - protein, 27 aa, Entamoeba invadens
DKWRGEILCEIGCIFQAISCILTALFY

SEQ ID NO: 2788100 - protein, 18 aa, Entamoeba invadens
DKYMEGMASNSLYKTYAI

SEQ ID NO: 2788101 - protein, 29 aa, Entamoeba invadens
DKYSGVIEYICKFGFIKNILQTMMNSTDL

SEQ ID NO: 2788102 - protein, 24 aa, Entamoeba invadens
DKYYKSIRFMVRYDSDDVKEIPVN

SEQ ID NO: 2788103 - protein, 17 aa, Entamoeba invadens
DLARGGLRTVITRDAEQ

SEQ ID NO: 2788104 - protein, 22 aa, Entamoeba invadens
DLCLGCTDGIMWEGSCYSKHLI

SEQ ID NO: 2788105 - protein, 19 aa, Entamoeba invadens
DLCSVFNCMTCVNNNCIIC

SEQ ID NO: 2788106 - protein, 17 aa, Entamoeba invadens
DLCVGEVIIPSSYSCVS

SEQ ID NO: 2788107 - protein, 21 aa, Entamoeba invadens
DLCVLCSPLVNTLNINGKCKE

SEQ ID NO: 2788108 - protein, 17 aa, Entamoeba invadens
DLDFCFVDTTAMGSKVP

SEQ ID NO: 2788109 - protein, 18 aa, Entamoeba invadens
DLDLVWRVALALGAVPCI

SEQ ID NO: 2788110 - protein, 29 aa, Entamoeba invadens
DLDMIKNIYFDFADCYFENFTVNEQKVDL

SEQ ID NO: 2788111 - protein, 25 aa, Entamoeba invadens
DLDQLKWTFVTRLVGFRSVGTNYTI

SEQ ID NO: 2788112 - protein, 18 aa, Entamoeba invadens
DLECTFKPILKMLQIPRF

SEQ ID NO: 2788113 - protein, 25 aa, Entamoeba invadens
DLEIKTNRLVVCMGKCNLDGNRQNV

SEQ ID NO: 2788114 - protein, 25 aa, Entamoeba invadens
DLESCLDLLLVFPYESVQTVYNTTK

SEQ ID NO: 2788115 - protein, 24 aa, Entamoeba invadens
DLFAHIGVPLSVYFPMQNEGFFGY

SEQ ID NO: 2788116 - protein, 22 aa, Entamoeba invadens
DLFKEIYLVFFIIIYTVFVFVC

SEQ ID NO: 2788117 - protein, 22 aa, Entamoeba invadens
DLFKLKSGVCKELFEDEAPVVP

SEQ ID NO: 2788118 - protein, 28 aa, Entamoeba invadens
DLFLIKEGLEWFACGLVSFLVSHICNII

SEQ ID NO: 2788119 - protein, 19 aa, Entamoeba invadens
DLFNIYGSIEIGDFLEQEK

SEQ ID NO: 2788120 - protein, 25 aa, Entamoeba invadens
DLFSCSRSRVGFLTPKVLETIGVKS

SEQ ID NO: 2788121 - protein, 19 aa, Entamoeba invadens
DLFSRLSVDVINESNMLVL

SEQ ID NO: 2788122 - protein, 18 aa, Entamoeba invadens
DLGRCFPCSSKLHCSTCS

SEQ ID NO: 2788123 - protein, 31 aa, Entamoeba invadens
DLGRIFCCLYILAFFLYFPMRLSKIINALKM

SEQ ID NO: 2788124 - protein, 18 aa, Entamoeba invadens
DLHFSRIKLVYEIVVCLF

SEQ ID NO: 2788125 - protein, 25 aa, Entamoeba invadens
DLHIICFLIPLGIYFLLKDLKDETV

SEQ ID NO: 2788126 - protein, 21 aa, Entamoeba invadens
DLIECVEMCWKPKEKRPSVAA

SEQ ID NO: 2788127 - protein, 19 aa, Entamoeba invadens
DLIHVLKILAPFRGTLIFF

SEQ ID NO: 2788128 - protein, 17 aa, Entamoeba invadens
DLIKCKKMSTKGCLECE

SEQ ID NO: 2788129 - protein, 18 aa, Entamoeba invadens
DLILFPFFNFTRTKELQY

SEQ ID NO: 2788130 - protein, 23 aa, Entamoeba invadens
DLILPSFFTLLANFFVSPSDALA

SEQ ID NO: 2788131 - protein, 19 aa, Entamoeba invadens
DLILRKGIVGQIYNIGTTR

SEQ ID NO: 2788132 - protein, 17 aa, Entamoeba invadens
DLIPRLKDFFNSIITNW

SEQ ID NO: 2788133 - protein, 20 aa, Entamoeba invadens
DLISSLLFFVLGFFCCCIWI

SEQ ID NO: 2788134 - protein, 18 aa, Entamoeba invadens
DLKCADYNGSVCIACQQN

SEQ ID NO: 2788135 - protein, 19 aa, Entamoeba invadens
DLKEFDRNFVLNFESKVSE

SEQ ID NO: 2788136 - protein, 20 aa, Entamoeba invadens
DLKEKLCYVAQNYEEEKKKD

SEQ ID NO: 2788137 - protein, 27 aa, Entamoeba invadens
DLKFKKKRLNFFKLFQFMKKDEVTAQV

SEQ ID NO: 2788138 - protein, 24 aa, Entamoeba invadens
DLKIYWDNVSAFSLEYQVYGRIKF

SEQ ID NO: 2788139 - protein, 22 aa, Entamoeba invadens
DLKKKVDILAYWVAQSLYETIN

SEQ ID NO: 2788140 - protein, 26 aa, Entamoeba invadens
DLKKRVIGAFPLFIVDTIEHIEIGEV

SEQ ID NO: 2788141 - protein, 23 aa, Entamoeba invadens
DLKKSIDLPVRMLAHIPLTYPLI

SEQ ID NO: 2788142 - protein, 26 aa, Entamoeba invadens
DLKVFKYKIVKEFIFNPETTLEVHPS

SEQ ID NO: 2788143 - protein, 18 aa, Entamoeba invadens
DLLCAIFKLVPPKRNNVF

SEQ ID NO: 2788144 - protein, 20 aa, Entamoeba invadens
DLLECTDLLWFIANQTNFGI

SEQ ID NO: 2788145 - protein, 18 aa, Entamoeba invadens
DLLKDIKNGLGVNSTDDM

SEQ ID NO: 2788146 - protein, 17 aa, Entamoeba invadens
DLLKFKVVECYVAGEVE

SEQ ID NO: 2788147 - protein, 21 aa, Entamoeba invadens
DLLPKIVSLKVIFSSSQNDVS

SEQ ID NO: 2788148 - protein, 18 aa, Entamoeba invadens
DLLRELFTVTALKLQSLV

SEQ ID NO: 2788149 - protein, 30 aa, Entamoeba invadens
DLLSRFCVYIPIPWNKWLIFIFSVSRVVFY

SEQ ID NO: 2788150 - protein, 23 aa, Entamoeba invadens
DLLWKHFKKSILPDAKHIAEEVG

SEQ ID NO: 2788151 - protein, 22 aa, Entamoeba invadens
DLMDKMRCPYIINFIGASVTPN

SEQ ID NO: 2788152 - protein, 17 aa, Entamoeba invadens
DLMLDEVDARIDAFEQD

SEQ ID NO: 2788153 - protein, 22 aa, Entamoeba invadens
DLNCEKCSFNANSCFKCKKGYY

SEQ ID NO: 2788154 - protein, 22 aa, Entamoeba invadens
DLNCEKCSFNANSCIECKNRYY

SEQ ID NO: 2788155 - protein, 18 aa, Entamoeba invadens
DLNCLHCQSDTCEECTIG

SEQ ID NO: 2788156 - protein, 18 aa, Entamoeba invadens
DLNCVWYTTIDKCVESRN

SEQ ID NO: 2788157 - protein, 19 aa, Entamoeba invadens
DLNDLLIFDEFYDYMMNFD

SEQ ID NO: 2788158 - protein, 26 aa, Entamoeba invadens
DLNFVMPFIDAFCTFSSTIKESIGDD

SEQ ID NO: 2788159 - protein, 18 aa, Entamoeba invadens
DLNMWNTIIFMKSYQSLI

SEQ ID NO: 2788160 - protein, 18 aa, Entamoeba invadens
DLNNRIGEITKFYFPPFY

SEQ ID NO: 2788161 - protein, 18 aa, Entamoeba invadens
DLPAEIKIAKGGVTQQQM

SEQ ID NO: 2788162 - protein, 25 aa, Entamoeba invadens
DLPLPKEFDCISSPFHNIFIDKKVA

SEQ ID NO: 2788163 - protein, 21 aa, Entamoeba invadens
DLPNCRTCSTSQYKCDICEES

SEQ ID NO: 2788164 - protein, 21 aa, Entamoeba invadens
DLPWRVFIYKFLNTIVDDLFA

SEQ ID NO: 2788165 - protein, 24 aa, Entamoeba invadens
DLQHLKITVSIFKSGVFKKTQTAY

SEQ ID NO: 2788166 - protein, 20 aa, Entamoeba invadens
DLRAESLKYIGLSGPAGTLS

SEQ ID NO: 2788167 - protein, 20 aa, Entamoeba invadens
DLRDVFYFTDVFRTFNESEL

SEQ ID NO: 2788168 - protein, 18 aa, Entamoeba invadens
DLRIKGVKFNELGDAKNH

SEQ ID NO: 2788169 - protein, 19 aa, Entamoeba invadens
DLSCDSCPDDAAICEKCLD

SEQ ID NO: 2788170 - protein, 23 aa, Entamoeba invadens
DLSCVKFTKKAFLDPRSTWLPAE

SEQ ID NO: 2788171 - protein, 26 aa, Entamoeba invadens
DLSLFGEINFSYVFSLLPKHIDDAHL

SEQ ID NO: 2788172 - protein, 17 aa, Entamoeba invadens
DLSLFSCNCENVYAVNS

SEQ ID NO: 2788173 - protein, 21 aa, Entamoeba invadens
DLSLKLSLLLSSEKKTRDTHV

SEQ ID NO: 2788174 - protein, 21 aa, Entamoeba invadens
DLSNCKIKTPKGCVKCNDGFY

SEQ ID NO: 2788175 - protein, 18 aa, Entamoeba invadens
DLSSSVKCMTTFVQLTLN

SEQ ID NO: 2788176 - protein, 21 aa, Entamoeba invadens
DLTCVKEVSFLALYISEDAAL

SEQ ID NO: 2788177 - protein, 34 aa, Entamoeba invadens
DLTGCILCKKGYYNKGFECIPCLSNCDSCLDSLT

SEQ ID NO: 2788178 - protein, 21 aa, Entamoeba invadens
DLTKCLSCVDGYFLSDHICKS

SEQ ID NO: 2788179 - protein, 29 aa, Entamoeba invadens
DLTLVCKLCKGGYAFKEYTTICLDSKETT

SEQ ID NO: 2788180 - protein, 18 aa, Entamoeba invadens
DLTTCFDGVLTIDPQNLT

SEQ ID NO: 2788181 - protein, 20 aa, Entamoeba invadens
DLTTCLSCVDGYFLSDYTCK

SEQ ID NO: 2788182 - protein, 28 aa, Entamoeba invadens
DLTTKESVLKCWLKSRLYNPNYDKSPCF

SEQ ID NO: 2788183 - protein, 25 aa, Entamoeba invadens
DLVCLGKLGTFYVNFLLDNPDKFIP

SEQ ID NO: 2788184 - protein, 18 aa, Entamoeba invadens
DLVESFKVYFKNRDCVFM

SEQ ID NO: 2788185 - protein, 20 aa, Entamoeba invadens
DLVKEFNFKKTEFIFKLNWL

SEQ ID NO: 2788186 - protein, 19 aa, Entamoeba invadens
DLVKGFWFKITGADETLEF

SEQ ID NO: 2788187 - protein, 20 aa, Entamoeba invadens
DLVNEKCLYQCLTTEERVGE

SEQ ID NO: 2788188 - protein, 24 aa, Entamoeba invadens
DLVVPCLAGLLVIHTVVMVTGIKQ

SEQ ID NO: 2788189 - protein, 19 aa, Entamoeba invadens
DLWLTAVGFKNHGYWLNNK

SEQ ID NO: 2788190 - protein, 17 aa, Entamoeba invadens
DLYCFLSSMTFTLDLNG

SEQ ID NO: 2788191 - protein, 20 aa, Entamoeba invadens
DLYDAYGFVRREECDGGVNC

SEQ ID NO: 2788192 - protein, 24 aa, Entamoeba invadens
DLYKGNACVGLKKGFVEQSMEIQI

SEQ ID NO: 2788193 - protein, 20 aa, Entamoeba invadens
DMCIEHCLLCTDKSSCLICD

SEQ ID NO: 2788194 - protein, 19 aa, Entamoeba invadens
DMDKWILSSLMSLVKKVRE

SEQ ID NO: 2788195 - protein, 18 aa, Entamoeba invadens
DMGGLKFQRKSEIYDADK

SEQ ID NO: 2788196 - protein, 22 aa, Entamoeba invadens
DMKINFTVYWSKHLNTLKKIEK

SEQ ID NO: 2788197 - protein, 20 aa, Entamoeba invadens
DMKVRMKRCEGKKEEEKVMD

SEQ ID NO: 2788198 - protein, 41 aa, Entamoeba invadens
DMLDKFRSGYIIYFYGAVLFKNRFALVTEFADFGSLNDLMQ

SEQ ID NO: 2788199 - protein, 18 aa, Entamoeba invadens
DMLKSETLLFFVGGETSR

SEQ ID NO: 2788200 - protein, 31 aa, Entamoeba invadens
DMMKVKYYLKDCVDYSFGRFFGLKQNPFDSV

SEQ ID NO: 2788201 - protein, 18 aa, Entamoeba invadens
DMNPMKRPQFKEIDEVIE

SEQ ID NO: 2788202 - protein, 22 aa, Entamoeba invadens
DMQCVRYSKLGFVDVMKKQNYL

SEQ ID NO: 2788203 - protein, 18 aa, Entamoeba invadens
DMSDTFITIDWTSKNLYN

SEQ ID NO: 2788204 - protein, 24 aa, Entamoeba invadens
DMYVGVEFFFFYLAQTVSMAAMSI

SEQ ID NO: 2788205 - protein, 19 aa, Entamoeba invadens
DMYYIRWLSGHPEVPKNYT

SEQ ID NO: 2788206 - protein, 18 aa, Entamoeba invadens
DNAFKRSQLTQIVLPETP

SEQ ID NO: 2788207 - protein, 19 aa, Entamoeba invadens
DNCDKCTKVGGVEQCTKCR

SEQ ID NO: 2788208 - protein, 20 aa, Entamoeba invadens
DNCGHCIATICTNKTTVDQN

SEQ ID NO: 2788209 - protein, 24 aa, Entamoeba invadens
DNCIKKCYHNFTWQEGIDHSNLCY

SEQ ID NO: 2788210 - protein, 26 aa, Entamoeba invadens
DNCKEPKSVCTMGDFKRYSETSQTTS

SEQ ID NO: 2788211 - protein, 22 aa, Entamoeba invadens
DNCLSCKVGKYLVGKTCENCDE

SEQ ID NO: 2788212 - protein, 18 aa, Entamoeba invadens
DNCLTCNLTNYKTINDNC

SEQ ID NO: 2788213 - protein, 27 aa, Entamoeba invadens
DNCVKMDIWGCLICEPGYYNNDNNCVK

SEQ ID NO: 2788214 - protein, 17 aa, Entamoeba invadens
DNDDCLFDESIWTFDGF

SEQ ID NO: 2788215 - protein, 20 aa, Entamoeba invadens
DNDMCKRCNTTMALCKECNS

SEQ ID NO: 2788216 - protein, 20 aa, Entamoeba invadens
DNDRCISCQMGFFEQKNIYV

SEQ ID NO: 2788217 - protein, 27 aa, Entamoeba invadens
DNEITHYYFAFLIGTFGYFFKKKKLFK

SEQ ID NO: 2788218 - protein, 28 aa, Entamoeba invadens
DNEYEVIDGFCWPKCKGDKTVRYNGVCV

SEQ ID NO: 2788219 - protein, 20 aa, Entamoeba invadens
DNFGCANGFVFFGQDSLIIT

SEQ ID NO: 2788220 - protein, 17 aa, Entamoeba invadens
DNFGRRPILLIGTFGIA

SEQ ID NO: 2788221 - protein, 23 aa, Entamoeba invadens
DNFKHEWLMCVIGIIGSIGAGAI

SEQ ID NO: 2788222 - protein, 28 aa, Entamoeba invadens
DNFKSIVNSVMWGRCVFDNIRKFLQFQL

SEQ ID NO: 2788223 - protein, 18 aa, Entamoeba invadens
DNFLILSLDLYEKVNAKL

SEQ ID NO: 2788224 - protein, 18 aa, Entamoeba invadens
DNFLVFSLDINDKVNAKL

SEQ ID NO: 2788225 - protein, 19 aa, Entamoeba invadens
DNFLVFSLDLNDYVNAKLA

SEQ ID NO: 2788226 - protein, 21 aa, Entamoeba invadens
DNFYATLPFYFDIINEGKSVV

SEQ ID NO: 2788227 - protein, 31 aa, Entamoeba invadens
DNGDGCVDCKCIKGYYPHSGDANCWRVSTGH

SEQ ID NO: 2788228 - protein, 23 aa, Entamoeba invadens
DNGIRICKICKTGFRINPSTGMC

SEQ ID NO: 2788229 - protein, 23 aa, Entamoeba invadens
DNGKCFRCNSAIPRCNTCNDESK

SEQ ID NO: 2788230 - protein, 25 aa, Entamoeba invadens
DNGKVFSGYVAAIVVDKIEKQEEKD

SEQ ID NO: 2788231 - protein, 25 aa, Entamoeba invadens
DNGLFLNKKVEWIVAAVCTGGMIFS

SEQ ID NO: 2788232 - protein, 24 aa, Entamoeba invadens
DNGPIALLRFFVKFSQRKQMPDDM

SEQ ID NO: 2788233 - protein, 33 aa, Entamoeba invadens
DNGVRSCLVCSSGYYPLSGMCVACSATCQQNKC

SEQ ID NO: 2788234 - protein, 19 aa, Entamoeba invadens
DNHCQLEFDNNCKLCSPND

SEQ ID NO: 2788235 - protein, 18 aa, Entamoeba invadens
DNHLLRFGDSQDVFCHLN

SEQ ID NO: 2788236 - protein, 18 aa, Entamoeba invadens
DNILIFSLDVNYNVNAKL

SEQ ID NO: 2788237 - protein, 23 aa, Entamoeba invadens
DNILSGFSPRFELVDSKEGKSVE

SEQ ID NO: 2788238 - protein, 19 aa, Entamoeba invadens
DNILVFSFDLNETVNAKLT

SEQ ID NO: 2788239 - protein, 20 aa, Entamoeba invadens
DNIRCKQCDTLFTNCTLCDT

SEQ ID NO: 2788240 - protein, 26 aa, Entamoeba invadens
DNISGKCLTCYAGYEFTDNTNCEICV

SEQ ID NO: 2788241 - protein, 24 aa, Entamoeba invadens
DNISGKCLTCYAGYEFTGNANCEI

SEQ ID NO: 2788242 - protein, 17 aa, Entamoeba invadens
DNIYYLLPFTFDIDENK

SEQ ID NO: 2788243 - protein, 19 aa, Entamoeba invadens
DNKCLKCNNCGNGNCHQHG

SEQ ID NO: 2788244 - protein, 25 aa, Entamoeba invadens
DNKGCIKCSENGILNSNRICIEIES

SEQ ID NO: 2788245 - protein, 26 aa, Entamoeba invadens
DNKKPPVGWIVFGVIVFVVFVVVIAG

SEQ ID NO: 2788246 - protein, 18 aa, Entamoeba invadens
DNKMFKCGSGEYLSNTNE

SEQ ID NO: 2788247 - protein, 25 aa, Entamoeba invadens
DNKNESNVRCSVDIPDCLYTTNNKC

SEQ ID NO: 2788248 - protein, 19 aa, Entamoeba invadens
DNKWPALNGGFGYGGALKM

SEQ ID NO: 2788249 - protein, 19 aa, Entamoeba invadens
DNLCQKCSMFYENSMYCEF

SEQ ID NO: 2788250 - protein, 25 aa, Entamoeba invadens
DNLDCAKFHGCLRCADMYYIENGVC

SEQ ID NO: 2788251 - protein, 22 aa, Entamoeba invadens
DNLDWSQWVGVIWTGIAVTGCT

SEQ ID NO: 2788252 - protein, 20 aa, Entamoeba invadens
DNLFLRVGFDEKRLYHYKNL

SEQ ID NO: 2788253 - protein, 19 aa, Entamoeba invadens
DNLKIKKGELVCVLGSVGS

SEQ ID NO: 2788254 - protein, 17 aa, Entamoeba invadens
DNLKSKYFIKGKAVTVQ

SEQ ID NO: 2788255 - protein, 23 aa, Entamoeba invadens
DNLMCDKCAYAFNANQNVEINNM

SEQ ID NO: 2788256 - protein, 17 aa, Entamoeba invadens
DNMCISGATGYKFETNK

SEQ ID NO: 2788257 - protein, 23 aa, Entamoeba invadens
DNMVKYIGAFAFFDIAKNPPQPE

SEQ ID NO: 2788258 - protein, 27 aa, Entamoeba invadens
DNNILKDRVCVHFSQIPNCISLENSLC

SEQ ID NO: 2788259 - protein, 21 aa, Entamoeba invadens
DNNLVKVWKYHAVARKVLVQY

SEQ ID NO: 2788260 - protein, 22 aa, Entamoeba invadens
DNPIMGNMCYILGGVNNVYNFG

SEQ ID NO: 2788261 - protein, 29 aa, Entamoeba invadens
DNQRPTVAFFKRGIHLFSNIDQHWWIVFH

SEQ ID NO: 2788262 - protein, 30 aa, Entamoeba invadens
DNQRPTVAFFKRGIHLFSNIDQHWWIVFHR

SEQ ID NO: 2788263 - protein, 17 aa, Entamoeba invadens
DNRHLCKAIILQESDTI

SEQ ID NO: 2788264 - protein, 17 aa, Entamoeba invadens
DNRRYAFHTCYTESTGN

SEQ ID NO: 2788265 - protein, 19 aa, Entamoeba invadens
DNTCLTCANIPSCVECSTT

SEQ ID NO: 2788266 - protein, 26 aa, Entamoeba invadens
DNTCVFGYYGVCLDLIQNIHIHLTHI

SEQ ID NO: 2788267 - protein, 19 aa, Entamoeba invadens
DNTCVFKRDLFCEETFENQ

SEQ ID NO: 2788268 - protein, 30 aa, Entamoeba invadens
DNTFKGCTLLEHISDFSVITSFGQFSFEKT

SEQ ID NO: 2788269 - protein, 17 aa, Entamoeba invadens
DNTKFAFGLSNSSIPNA

SEQ ID NO: 2788270 - protein, 19 aa, Entamoeba invadens
DNTNLCYFGAPGCDQYCHC

SEQ ID NO: 2788271 - protein, 20 aa, Entamoeba invadens
DNTSCIKKSLSGGAIAGIAI

SEQ ID NO: 2788272 - protein, 25 aa, Entamoeba invadens
DNVIPFNVYFFISVRGYKRVNLTIE

SEQ ID NO: 2788273 - protein, 19 aa, Entamoeba invadens
DNVLLEIIVEWTKHWFFNI

SEQ ID NO: 2788274 - protein, 19 aa, Entamoeba invadens
DNVLSFAIGDNVDKSHLAI

SEQ ID NO: 2788275 - protein, 25 aa, Entamoeba invadens
DNVYCLMCVCVVYPLVLIVATNHEI

SEQ ID NO: 2788276 - protein, 22 aa, Entamoeba invadens
DNYGCSLAVFGDLIAVGSSMGN

SEQ ID NO: 2788277 - protein, 18 aa, Entamoeba invadens
DNYGQLALHYAAAVGCPV

SEQ ID NO: 2788278 - protein, 19 aa, Entamoeba invadens
DNYKGCPMKAYSYTTNTGY

SEQ ID NO: 2788279 - protein, 22 aa, Entamoeba invadens
DNYKTFFIALAFTCKDTTDEKF

SEQ ID NO: 2788280 - protein, 21 aa, Entamoeba invadens
DNYLGWRMFRKNNKDYILIVN

SEQ ID NO: 2788281 - protein, 19 aa, Entamoeba invadens
DNYLIFSLDLNEKVNAKLT

SEQ ID NO: 2788282 - protein, 19 aa, Entamoeba invadens
DNYMKCTGLVFTTSAAADD

SEQ ID NO: 2788283 - protein, 20 aa, Entamoeba invadens
DNYSSLKFADFFDFNGNSTL

SEQ ID NO: 2788284 - protein, 22 aa, Entamoeba invadens
DNYTSLLLDWSRFANTRLGPNG

SEQ ID NO: 2788285 - protein, 19 aa, Entamoeba invadens
DNYVFRFFSKNMIMRTDFS

SEQ ID NO: 2788286 - protein, 24 aa, Entamoeba invadens
DPAYLLPLLYRLVNLYINNTKLKF

SEQ ID NO: 2788287 - protein, 18 aa, Entamoeba invadens
DPDFINWMRPAVSSTFRK

SEQ ID NO: 2788288 - protein, 18 aa, Entamoeba invadens
DPDFKCQPENCIVKALVI

SEQ ID NO: 2788289 - protein, 23 aa, Entamoeba invadens
DPDYRLPKYYNMYLSDENFECTQ

SEQ ID NO: 2788290 - protein, 22 aa, Entamoeba invadens
DPENADGVFLVLSRLIVSMCVL

SEQ ID NO: 2788291 - protein, 29 aa, Entamoeba invadens
DPEVICLKPKFACEFSIYIKPLCTCVIKN

SEQ ID NO: 2788292 - protein, 21 aa, Entamoeba invadens
DPEVVSLKRGYACEFSIYLTP

SEQ ID NO: 2788293 - protein, 18 aa, Entamoeba invadens
DPFCRKFSNKQCTTCTVC

SEQ ID NO: 2788294 - protein, 30 aa, Entamoeba invadens
DPFPKEKFRFPWSIADFISAGKRFDRPEEI

SEQ ID NO: 2788295 - protein, 27 aa, Entamoeba invadens
DPFSLEALLFCFNKFFMDYISRSSDSK

SEQ ID NO: 2788296 - protein, 26 aa, Entamoeba invadens
DPFYRTKLGFAVLVEKDWLAFGHQFN

SEQ ID NO: 2788297 - protein, 18 aa, Entamoeba invadens
DPHCKICKTVPIRKSSEH

SEQ ID NO: 2788298 - protein, 19 aa, Entamoeba invadens
DPHHLIGQLFLRVNSHFNP

SEQ ID NO: 2788299 - protein, 24 aa, Entamoeba invadens
DPHYSKFWIGNGINRMKLFCKYSI

SEQ ID NO: 2788300 - protein, 18 aa, Entamoeba invadens
DPIIPGYMFGAAPNAAFF

SEQ ID NO: 2788301 - protein, 19 aa, Entamoeba invadens
DPIRRCVVTIIDKIEPTRY

SEQ ID NO: 2788302 - protein, 24 aa, Entamoeba invadens
DPKEFKWDSTLSIVQNRTGTVKMS

SEQ ID NO: 2788303 - protein, 31 aa, Entamoeba invadens
DPLFKEGFCKHLIPAALHRYDEQPGFDDNVK

SEQ ID NO: 2788304 - protein, 24 aa, Entamoeba invadens
DPLSRHIWKPFVLYNKCKNEFWLH

SEQ ID NO: 2788305 - protein, 26 aa, Entamoeba invadens
DPNAPGNCRSKPIAWWVWLLVTLLVI

SEQ ID NO: 2788306 - protein, 23 aa, Entamoeba invadens
DPNCARSSSIMGCIECNEGYYLD

SEQ ID NO: 2788307 - protein, 23 aa, Entamoeba invadens
DPNCAYGYCSTVDGCTKCIEGYF

SEQ ID NO: 2788308 - protein, 30 aa, Entamoeba invadens
DPNKRPKFPEIRDRIEAIWNGLYKKYLDDK

SEQ ID NO: 2788309 - protein, 20 aa, Entamoeba invadens
DPNLYSWKSLVLNTKSCVEA

SEQ ID NO: 2788310 - protein, 26 aa, Entamoeba invadens
DPNVFCLNCTSLLCGGDLDVYKYSYN

SEQ ID NO: 2788311 - protein, 19 aa, Entamoeba invadens
DPPLECLCNNGYHCDENGI

SEQ ID NO: 2788312 - protein, 24 aa, Entamoeba invadens
DPPLIPLSVCKKLEDLFSTSDASK

SEQ ID NO: 2788313 - protein, 30 aa, Entamoeba invadens
DPPYIVSSFFLKLFGASLFVDVFSNLLLER

SEQ ID NO: 2788314 - protein, 22 aa, Entamoeba invadens
DPQKIPILIEFVAGKGSLVVCL

SEQ ID NO: 2788315 - protein, 23 aa, Entamoeba invadens
DPSNFEFANTIGITLSTKSKSVI

SEQ ID NO: 2788316 - protein, 22 aa, Entamoeba invadens
DPTCSLCPGGTFSNSATSSSCS

SEQ ID NO: 2788317 - protein, 17 aa, Entamoeba invadens
DPTKRPGFDQITKMVIV

SEQ ID NO: 2788318 - protein, 25 aa, Entamoeba invadens
DPTKRSKFLTDFVVNYSIEDDKADV

SEQ ID NO: 2788319 - protein, 18 aa, Entamoeba invadens
DPTVVRATWFSIHNKTPT

SEQ ID NO: 2788320 - protein, 21 aa, Entamoeba invadens
DPVEHIAFFKSFSFEEIGAVV

SEQ ID NO: 2788321 - protein, 17 aa, Entamoeba invadens
DPVYRYFLRELKPASRK

SEQ ID NO: 2788322 - protein, 23 aa, Entamoeba invadens
DPYFLDFLHSCFNVETIERVVVP

SEQ ID NO: 2788323 - protein, 26 aa, Entamoeba invadens
DPYHEKRFKFAWDIVDFVVSGKRLEK

SEQ ID NO: 2788324 - protein, 28 aa, Entamoeba invadens
DQADAFSWGRNEGCSFLYNCSEWRKQNG

SEQ ID NO: 2788325 - protein, 25 aa, Entamoeba invadens
DQCFCNCSGLSSLIIPSSVESIGES

SEQ ID NO: 2788326 - protein, 27 aa, Entamoeba invadens
DQCGLDCYSCLSNEKCTSCDDTFVLKN

SEQ ID NO: 2788327 - protein, 18 aa, Entamoeba invadens
DQCPCSGETCTFTMDPSL

SEQ ID NO: 2788328 - protein, 22 aa, Entamoeba invadens
DQCSYYLNQKCVKCPSKYSSNG

SEQ ID NO: 2788329 - protein, 18 aa, Entamoeba invadens
DQCVKKGDGCVFSSSDEC

SEQ ID NO: 2788330 - protein, 26 aa, Entamoeba invadens
DQDGDCSICYSRLKTKCVAFPCGHKF

SEQ ID NO: 2788331 - protein, 21 aa, Entamoeba invadens
DQEGAFKFDFEDITGDYSCKT

SEQ ID NO: 2788332 - protein, 21 aa, Entamoeba invadens
DQESRMAWFLQDGLVTQEIAK

SEQ ID NO: 2788333 - protein, 25 aa, Entamoeba invadens
DQFKYPWKIADFVMGGNRLKKLEMM

SEQ ID NO: 2788334 - protein, 23 aa, Entamoeba invadens
DQFKYPWKIAEFVMGGNRLKKLE

SEQ ID NO: 2788335 - protein, 29 aa, Entamoeba invadens
DQFLKLKSFKVNCGSLAKKMSTPCSGDAK

SEQ ID NO: 2788336 - protein, 18 aa, Entamoeba invadens
DQFLSPTCKPQVSKYKVP

SEQ ID NO: 2788337 - protein, 28 aa, Entamoeba invadens
DQGLCGSCYAVSVAQQYTTLYAYLTEQN

SEQ ID NO: 2788338 - protein, 17 aa, Entamoeba invadens
DQHWWIVFHRNETLSYS

SEQ ID NO: 2788339 - protein, 17 aa, Entamoeba invadens
DQINLKLVITVPVVIVF

SEQ ID NO: 2788340 - protein, 19 aa, Entamoeba invadens
DQIRGEVLIPRVFQNSEVL

SEQ ID NO: 2788341 - protein, 36 aa, Entamoeba invadens
DQKIEFGEAVAFIAAWFCQLPVYWEEPVVNKQLMYN

SEQ ID NO: 2788342 - protein, 24 aa, Entamoeba invadens
DQLGKLGLKDSFTQNADFSNMSNN

SEQ ID NO: 2788343 - protein, 24 aa, Entamoeba invadens
DQNECIQCANGFVKMFEKCIKVDH

SEQ ID NO: 2788344 - protein, 23 aa, Entamoeba invadens
DQQESYLFLSLGNFLGLLTLGLN

SEQ ID NO: 2788345 - protein, 17 aa, Entamoeba invadens
DQSCAYGKCNSVTGICS

SEQ ID NO: 2788346 - protein, 26 aa, Entamoeba invadens
DQSCLLCNSLFEGCELCTQNMCMKCE

SEQ ID NO: 2788347 - protein, 24 aa, Entamoeba invadens
DQSGCKECNNVLISTGYFVDSTTK

SEQ ID NO: 2788348 - protein, 22 aa, Entamoeba invadens
DQSRCLECFPGHKFDFTTNKCV

SEQ ID NO: 2788349 - protein, 32 aa, Entamoeba invadens
DQVLLYAVSVLSCLTFCVFLSTYMILRNYKSR

SEQ ID NO: 2788350 - protein, 19 aa, Entamoeba invadens
DQYCACATGTTLVGHICIS

SEQ ID NO: 2788351 - protein, 17 aa, Entamoeba invadens
DQYFKQEADCISCDESC

SEQ ID NO: 2788352 - protein, 18 aa, Entamoeba invadens
DQYFYIWIYWEGNELPVQ

SEQ ID NO: 2788353 - protein, 19 aa, Entamoeba invadens
DRCATDFSRKCILCKEGYY

SEQ ID NO: 2788354 - protein, 20 aa, Entamoeba invadens
DRCDICPSGSYSDVASSSCK

SEQ ID NO: 2788355 - protein, 18 aa, Entamoeba invadens
DRCYSCEKGCHMSDFQCQ

SEQ ID NO: 2788356 - protein, 23 aa, Entamoeba invadens
DRDFSGKHIFIYGGSAGVGKALA

SEQ ID NO: 2788357 - protein, 23 aa, Entamoeba invadens
DRDKCETCCRVLFALEYDPNTGN

SEQ ID NO: 2788358 - protein, 20 aa, Entamoeba invadens
DRDWCILLIIVLNVFGLIIA

SEQ ID NO: 2788359 - protein, 17 aa, Entamoeba invadens
DREDACKRFVLRHFHSS

SEQ ID NO: 2788360 - protein, 19 aa, Entamoeba invadens
DREKGICVFSMKKSNIPMK

SEQ ID NO: 2788361 - protein, 36 aa, Entamoeba invadens
DRESEVWWYRDILKMVGWYNIFSLLFIVLFAPQLTL

SEQ ID NO: 2788362 - protein, 21 aa, Entamoeba invadens
DRFETPFLFLTGGTKNECDSN

SEQ ID NO: 2788363 - protein, 19 aa, Entamoeba invadens
DRGLMSLDCSGECTNCLAG

SEQ ID NO: 2788364 - protein, 22 aa, Entamoeba invadens
DRHISGCVLCDGKDSCSKCKNG

SEQ ID NO: 2788365 - protein, 18 aa, Entamoeba invadens
DRIEEVYFNNALLLNKVQ

SEQ ID NO: 2788366 - protein, 20 aa, Entamoeba invadens
DRIWGWRHLTALFVWFFLLF

SEQ ID NO: 2788367 - protein, 22 aa, Entamoeba invadens
DRKCTGCKRDEILLSNATCVKM

SEQ ID NO: 2788368 - protein, 23 aa, Entamoeba invadens
DRKKCSKCVSGYIQNEFLNCVVY

SEQ ID NO: 2788369 - protein, 23 aa, Entamoeba invadens
DRKNEMLHCMALCHNATVNDGKY

SEQ ID NO: 2788370 - protein, 17 aa, Entamoeba invadens
DRKRRPYDFADMKKDDA

SEQ ID NO: 2788371 - protein, 23 aa, Entamoeba invadens
DRKTGICMACRPGSGFVTNIKCE

SEQ ID NO: 2788372 - protein, 21 aa, Entamoeba invadens
DRKVCLYCQPNYILINKKCEA

SEQ ID NO: 2788373 - protein, 17 aa, Entamoeba invadens
DRKYRMVEDVKILNNSD

SEQ ID NO: 2788374 - protein, 24 aa, Entamoeba invadens
DRLAEIIRRKMLILQEQIKTAKIQ

SEQ ID NO: 2788375 - protein, 18 aa, Entamoeba invadens
DRLEALPVAHTCFNTLDL

SEQ ID NO: 2788376 - protein, 25 aa, Entamoeba invadens
DRMNEIKMSLAMEFDDDVKAKEKQM

SEQ ID NO: 2788377 - protein, 21 aa, Entamoeba invadens
DRNARCAIIQNCLLKQSNRCL

SEQ ID NO: 2788378 - protein, 34 aa, Entamoeba invadens
DRNERDCLFECFGIIIGLSRAELCEEFISRVFGR

SEQ ID NO: 2788379 - protein, 19 aa, Entamoeba invadens
DRNGRCAIIPNCSLKRSNR

SEQ ID NO: 2788380 - protein, 19 aa, Entamoeba invadens
DRPNFGVVSTWMVEMVNSL

SEQ ID NO: 2788381 - protein, 24 aa, Entamoeba invadens
DRQLRVCTTIAIAVVADSCAPFTV

SEQ ID NO: 2788382 - protein, 25 aa, Entamoeba invadens
DRQQTCPICKSRVTEDTVIPIYNSS

SEQ ID NO: 2788383 - protein, 24 aa, Entamoeba invadens
DRRNCNYDTFNFKVVGEFEQIAMD

SEQ ID NO: 2788384 - protein, 17 aa, Entamoeba invadens
DRSMKWCAIDTVISLIF

SEQ ID NO: 2788385 - protein, 17 aa, Entamoeba invadens
DRTPKVWLLGYDEDHKP

SEQ ID NO: 2788386 - protein, 22 aa, Entamoeba invadens
DRVILCPNGMFFDESCKNCTTN

SEQ ID NO: 2788387 - protein, 19 aa, Entamoeba invadens
DRVSFILINCGIYEVLQKV

SEQ ID NO: 2788388 - protein, 28 aa, Entamoeba invadens
DRWMSYLLVERGWWLKYCSITKSKSFCP

SEQ ID NO: 2788389 - protein, 22 aa, Entamoeba invadens
DRYDIEISPDFFLLSRGEGIKI

SEQ ID NO: 2788390 - protein, 22 aa, Entamoeba invadens
DRYEICNSYPTLLIVPVDIHKK

SEQ ID NO: 2788391 - protein, 19 aa, Entamoeba invadens
DSAMMLQILFKKSINEQKY

SEQ ID NO: 2788392 - protein, 22 aa, Entamoeba invadens
DSCEKPRNSLCLVCDKQKVANN

SEQ ID NO: 2788393 - protein, 22 aa, Entamoeba invadens
DSCNTLTTFCDRCDTLGVCTSC

SEQ ID NO: 2788394 - protein, 17 aa, Entamoeba invadens
DSDLCITYDKLIGCKNK

SEQ ID NO: 2788395 - protein, 24 aa, Entamoeba invadens
DSELKLKMIETFGMRNSSVIEEII

SEQ ID NO: 2788396 - protein, 35 aa, Entamoeba invadens
DSESYLMAILHTFYLRSALKVVIDVVMRLLATRSI

SEQ ID NO: 2788397 - protein, 18 aa, Entamoeba invadens
DSFDCSLNIYKSGMYLTI

SEQ ID NO: 2788398 - protein, 17 aa, Entamoeba invadens
DSFEYYFFANLRGLSPV

SEQ ID NO: 2788399 - protein, 18 aa, Entamoeba invadens
DSFFDFPGYYDMIKVVAQ

SEQ ID NO: 2788400 - protein, 27 aa, Entamoeba invadens
DSFLSMLCIAAIIGMGLYRFLNFDKHF

SEQ ID NO: 2788401 - protein, 24 aa, Entamoeba invadens
DSFQCILCNTGYFVQDGVCYQNNK

SEQ ID NO: 2788402 - protein, 29 aa, Entamoeba invadens
DSFSKDGGCVICKRGYYRVGLDCYDCDVK

SEQ ID NO: 2788403 - protein, 19 aa, Entamoeba invadens
DSFVAYPFDVLPSKSFGFS

SEQ ID NO: 2788404 - protein, 18 aa, Entamoeba invadens
DSGCFYTLLCLFGGCTIG

SEQ ID NO: 2788405 - protein, 30 aa, Entamoeba invadens
DSGEDFMVVFKYHKQIVLIVVTVMTFTGAV

SEQ ID NO: 2788406 - protein, 21 aa, Entamoeba invadens
DSGICTLCPDGYYSTGKTGSC

SEQ ID NO: 2788407 - protein, 23 aa, Entamoeba invadens
DSGIFCLLLARAIERDTQYYCNI

SEQ ID NO: 2788408 - protein, 20 aa, Entamoeba invadens
DSGLESLSFGENVKKIGNYV

SEQ ID NO: 2788409 - protein, 18 aa, Entamoeba invadens
DSGVCISCSSNGNCSSCT

SEQ ID NO: 2788410 - protein, 23 aa, Entamoeba invadens
DSGYCISCLAGSINNFKTCLICS

SEQ ID NO: 2788411 - protein, 17 aa, Entamoeba invadens
DSGYFLFGNECFKCGET

SEQ ID NO: 2788412 - protein, 20 aa, Entamoeba invadens
DSIAGFWKYKHQPFVLMDIA

SEQ ID NO: 2788413 - protein, 17 aa, Entamoeba invadens
DSIDLLCRASCESEAQD

SEQ ID NO: 2788414 - protein, 26 aa, Entamoeba invadens
DSIVICFKYFPIIVVVLFCIVLIITS

SEQ ID NO: 2788415 - protein, 18 aa, Entamoeba invadens
DSKCIICVDGYFPKNGSC

SEQ ID NO: 2788416 - protein, 24 aa, Entamoeba invadens
DSKCQRCNYGTFNKPYCETCDTLC

SEQ ID NO: 2788417 - protein, 24 aa, Entamoeba invadens
DSKCSKCAFWSVPSSDGMSCESQV

SEQ ID NO: 2788418 - protein, 21 aa, Entamoeba invadens
DSKCTKCSFWKAPNEEGTACD

SEQ ID NO: 2788419 - protein, 19 aa, Entamoeba invadens
DSKEFMHMFVVRMGELSNQ

SEQ ID NO: 2788420 - protein, 22 aa, Entamoeba invadens
DSKKCLKCEDGFVLVNDECVSL

SEQ ID NO: 2788421 - protein, 28 aa, Entamoeba invadens
DSKKCYDCFEGFILKKINAMLVLIIAQN

SEQ ID NO: 2788422 - protein, 21 aa, Entamoeba invadens
DSKTGLTPIMFACKNQEIEIF

SEQ ID NO: 2788423 - protein, 27 aa, Entamoeba invadens
DSLFCKKIPPFWSIVELQFFTPQKAVA

SEQ ID NO: 2788424 - protein, 22 aa, Entamoeba invadens
DSLHCYTCADGYFLPKNYSTSE

SEQ ID NO: 2788425 - protein, 19 aa, Entamoeba invadens
DSLKGSCLYHTEYKTEDKI

SEQ ID NO: 2788426 - protein, 21 aa, Entamoeba invadens
DSLKLKVKFMKDVSKGILYLH

SEQ ID NO: 2788427 - protein, 17 aa, Entamoeba invadens
DSLKVIEDYAFYVSHFT

SEQ ID NO: 2788428 - protein, 20 aa, Entamoeba invadens
DSLLFNYPFIFSVFPYSNLF

SEQ ID NO: 2788429 - protein, 34 aa, Entamoeba invadens
DSNCAICAANFSRRCLICNTGFYPNDSGKCVSCA

SEQ ID NO: 2788430 - protein, 29 aa, Entamoeba invadens
DSNCILNHNCIYGDGTVCIKCENGESHSK

SEQ ID NO: 2788431 - protein, 18 aa, Entamoeba invadens
DSNCVLCLDEYYLKDLQC

SEQ ID NO: 2788432 - protein, 19 aa, Entamoeba invadens
DSNCVLCLEDYYLKDLQCL

SEQ ID NO: 2788433 - protein, 23 aa, Entamoeba invadens
DSNGVCFRCDLNLNCLECDSKNG

SEQ ID NO: 2788434 - protein, 22 aa, Entamoeba invadens
DSNLEVYSCQFEEYNTVRNDSL

SEQ ID NO: 2788435 - protein, 23 aa, Entamoeba invadens
DSNLIFYQFFNMIYFQTTSTLEN

SEQ ID NO: 2788436 - protein, 24 aa, Entamoeba invadens
DSNRKCTLCIAGYYFDLESNTCER

SEQ ID NO: 2788437 - protein, 17 aa, Entamoeba invadens
DSNVGQCYSCLSGYTFN

SEQ ID NO: 2788438 - protein, 38 aa, Entamoeba invadens
DSNVLRPFLFYVVFKKNMIVTIRFNKVLAIDEVKNRIR

SEQ ID NO: 2788439 - protein, 22 aa, Entamoeba invadens
DSPCKALNLYVKNYFKREHIQA

SEQ ID NO: 2788440 - protein, 21 aa, Entamoeba invadens
DSPEGVPYIIEFFKRNSQHPE

SEQ ID NO: 2788441 - protein, 19 aa, Entamoeba invadens
DSPENWVFCVITETENIEK

SEQ ID NO: 2788442 - protein, 17 aa, Entamoeba invadens
DSPFVVDGTNMLKCALF

SEQ ID NO: 2788443 - protein, 17 aa, Entamoeba invadens
DSPHAVFPILILAIGDG

SEQ ID NO: 2788444 - protein, 23 aa, Entamoeba invadens
DSPMFSCEDFPYDVTYTTADPSK

SEQ ID NO: 2788445 - protein, 18 aa, Entamoeba invadens
DSPPKCLSCIENCSNCTA

SEQ ID NO: 2788446 - protein, 22 aa, Entamoeba invadens
DSPSRVCVFCKSFDNKCETCQN

SEQ ID NO: 2788447 - protein, 22 aa, Entamoeba invadens
DSQKSICINDFIVFNYEDQAIT

SEQ ID NO: 2788448 - protein, 18 aa, Entamoeba invadens
DSQTRLSLLRDENTKLVN

SEQ ID NO: 2788449 - protein, 17 aa, Entamoeba invadens
DSRCVTCSPSFARKCVK

SEQ ID NO: 2788450 - protein, 17 aa, Entamoeba invadens
DSRCVTCSPSFVRKCIK

SEQ ID NO: 2788451 - protein, 25 aa, Entamoeba invadens
DSRILYMRKLFKIILNAPVKINTKG

SEQ ID NO: 2788452 - protein, 17 aa, Entamoeba invadens
DSRVLKYSMRSVSKYLP

SEQ ID NO: 2788453 - protein, 19 aa, Entamoeba invadens
DSRVNIVIRVVIPFVILLG

SEQ ID NO: 2788454 - protein, 18 aa, Entamoeba invadens
DSSCLSCQIGYFLTNKMC

SEQ ID NO: 2788455 - protein, 18 aa, Entamoeba invadens
DSSFPKLVSIIMFNLMGW

SEQ ID NO: 2788456 - protein, 25 aa, Entamoeba invadens
DSSKCLSCSFLNGCILCDNTIPNKC

SEQ ID NO: 2788457 - protein, 25 aa, Entamoeba invadens
DSSLLGLTVLCWGNSIGDFVSNVVV

SEQ ID NO: 2788458 - protein, 21 aa, Entamoeba invadens
DSSNVLPIFYASVANTISNTT

SEQ ID NO: 2788459 - protein, 22 aa, Entamoeba invadens
DSSRCLSCNNSLVLSNDNRCVT

SEQ ID NO: 2788460 - protein, 19 aa, Entamoeba invadens
DSSRRCVTCNSGFYPKQYG

SEQ ID NO: 2788461 - protein, 20 aa, Entamoeba invadens
DSTKCLSCVDGYFLSNHICK

SEQ ID NO: 2788462 - protein, 23 aa, Entamoeba invadens
DSTNVQPFYVWDVVTDSFGKSVS

SEQ ID NO: 2788463 - protein, 23 aa, Entamoeba invadens
DSTRKCSVCKAGYYPKTSGDYKC

SEQ ID NO: 2788464 - protein, 25 aa, Entamoeba invadens
DSTVNCKLKFSEMFDLYNMYNFDIS

SEQ ID NO: 2788465 - protein, 20 aa, Entamoeba invadens
DSTYCFECSMGYFRYDYNIC

SEQ ID NO: 2788466 - protein, 17 aa, Entamoeba invadens
DSVFSCADTVSMTQITL

SEQ ID NO: 2788467 - protein, 17 aa, Entamoeba invadens
DSVKIFFNNNVYIETNT

SEQ ID NO: 2788468 - protein, 18 aa, Entamoeba invadens
DSVKKWANEVLIGTEKAD

SEQ ID NO: 2788469 - protein, 20 aa, Entamoeba invadens
DSVLYWKPLFIEELFFNTPI

SEQ ID NO: 2788470 - protein, 23 aa, Entamoeba invadens
DSVQSCLDFAYSNHQNINSGSLK

SEQ ID NO: 2788471 - protein, 17 aa, Entamoeba invadens
DSVRMKVRILPDEFRGD

SEQ ID NO: 2788472 - protein, 17 aa, Entamoeba invadens
DSVSARGTIIFDNSINT

SEQ ID NO: 2788473 - protein, 26 aa, Entamoeba invadens
DSVTDFPGQVAYYFSILQLKIINGYV

SEQ ID NO: 2788474 - protein, 26 aa, Entamoeba invadens
DSVVGVQCGTPWYWILTGVGAPLMLT

SEQ ID NO: 2788475 - protein, 20 aa, Entamoeba invadens
DSVYPLLAIIFKALDMLPLL

SEQ ID NO: 2788476 - protein, 23 aa, Entamoeba invadens
DSYFPYTDLEVVYKHVKIDNENF

SEQ ID NO: 2788477 - protein, 22 aa, Entamoeba invadens
DSYLHCFRVWTGERHGEYVMNN

SEQ ID NO: 2788478 - protein, 28 aa, Entamoeba invadens
DSYVIKLVWLLVCVTIVFMIFHKNQQKE

SEQ ID NO: 2788479 - protein, 21 aa, Entamoeba invadens
DTCDKCSMGTSYMEGTTKKCD

SEQ ID NO: 2788480 - protein, 18 aa, Entamoeba invadens
DTCGNGKIDIGEECDNSF

SEQ ID NO: 2788481 - protein, 20 aa, Entamoeba invadens
DTCLTCGEKYYFSRETNDCI

SEQ ID NO: 2788482 - protein, 18 aa, Entamoeba invadens
DTCLTCNLTNYKTTSGKC

SEQ ID NO: 2788483 - protein, 17 aa, Entamoeba invadens
DTCSDVNCITCENNRCI

SEQ ID NO: 2788484 - protein, 25 aa, Entamoeba invadens
DTCSFKNSTVCLSKLISTGQNFTLK

SEQ ID NO: 2788485 - protein, 18 aa, Entamoeba invadens
DTEAIALCYLLKKKKLRF

SEQ ID NO: 2788486 - protein, 22 aa, Entamoeba invadens
DTESILILFFVFEQLNLQIRPK

SEQ ID NO: 2788487 - protein, 24 aa, Entamoeba invadens
DTFKFPWKIAEFVIHNNRLKRKDP

SEQ ID NO: 2788488 - protein, 18 aa, Entamoeba invadens
DTFKGCKSLLLLNGTEFV

SEQ ID NO: 2788489 - protein, 18 aa, Entamoeba invadens
DTFKNCLELNVVSNLTQV

SEQ ID NO: 2788490 - protein, 26 aa, Entamoeba invadens
DTFSLFCVLCFFIILGYYLDGKLGTM

SEQ ID NO: 2788491 - protein, 23 aa, Entamoeba invadens
DTFVRRQSRVFQRAITPRPTQRE

SEQ ID NO: 2788492 - protein, 23 aa, Entamoeba invadens
DTHDCLKCTLNGVINNKGKCIKM

SEQ ID NO: 2788493 - protein, 22 aa, Entamoeba invadens
DTHNCLKCTLNGVINNEGKCIE

SEQ ID NO: 2788494 - protein, 21 aa, Entamoeba invadens
DTHNCLQCKLNGVINNEGKCI

SEQ ID NO: 2788495 - protein, 28 aa, Entamoeba invadens
DTIAVGKARCNLCISPYVLNGAKCGLCQ

SEQ ID NO: 2788496 - protein, 28 aa, Entamoeba invadens
DTIAVGKARCNLCISPYVLNGTKCGLCQ

SEQ ID NO: 2788497 - protein, 26 aa, Entamoeba invadens
DTIIGCLRCVDGTYLQNNKCEPCDST

SEQ ID NO: 2788498 - protein, 24 aa, Entamoeba invadens
DTIKGDSRAICYCTYNPEIKQDCS

SEQ ID NO: 2788499 - protein, 26 aa, Entamoeba invadens
DTILLCYAEDLVLFNGVHCEKLNAIV

SEQ ID NO: 2788500 - protein, 17 aa, Entamoeba invadens
DTINCFELISFEEQQNA

SEQ ID NO: 2788501 - protein, 28 aa, Entamoeba invadens
DTISVGKARCNLCISPYVLNDTKCELCQ

SEQ ID NO: 2788502 - protein, 22 aa, Entamoeba invadens
DTKCLSCKSGFYQGDNYTCLSS

SEQ ID NO: 2788503 - protein, 20 aa, Entamoeba invadens
DTKCYLRPNPGFTPNEKYED

SEQ ID NO: 2788504 - protein, 25 aa, Entamoeba invadens
DTKLYLKIYDLFYGHFNIQFSYIQG

SEQ ID NO: 2788505 - protein, 24 aa, Entamoeba invadens
DTKSWEFGNTITLTYVSEPGGTIE

SEQ ID NO: 2788506 - protein, 18 aa, Entamoeba invadens
DTLKCVILGGSPLSQDLQ

SEQ ID NO: 2788507 - protein, 24 aa, Entamoeba invadens
DTLKEQFSDFSWDNASEIYDVKTY

SEQ ID NO: 2788508 - protein, 17 aa, Entamoeba invadens
DTLLKFNIGSTHIAQES

SEQ ID NO: 2788509 - protein, 18 aa, Entamoeba invadens
DTLRLGYHTARQALYGIV

SEQ ID NO: 2788510 - protein, 28 aa, Entamoeba invadens
DTMSWILGFERFYICPLRGPIQSFRFNT

SEQ ID NO: 2788511 - protein, 22 aa, Entamoeba invadens
DTNCVLCSTSFDRKCIECQEGK

SEQ ID NO: 2788512 - protein, 24 aa, Entamoeba invadens
DTNGRCVLCAEGTYYNTKKCVPIN

SEQ ID NO: 2788513 - protein, 17 aa, Entamoeba invadens
DTPCTDKECRICTIDNN

SEQ ID NO: 2788514 - protein, 23 aa, Entamoeba invadens
DTQCLLCSNGFYSNGPQCVKCDT

SEQ ID NO: 2788515 - protein, 25 aa, Entamoeba invadens
DTQCTSECNCVFGTAPMKIDNITKC

SEQ ID NO: 2788516 - protein, 25 aa, Entamoeba invadens
DTQYYCNIFKWAIDTKILAEIKKYK

SEQ ID NO: 2788517 - protein, 19 aa, Entamoeba invadens
DTRLFFGILASFHANLLMS

SEQ ID NO: 2788518 - protein, 20 aa, Entamoeba invadens
DTRLKLRIYDNAIFEMEEGN

SEQ ID NO: 2788519 - protein, 19 aa, Entamoeba invadens
DTRTIVWRLEKNRRIILET

SEQ ID NO: 2788520 - protein, 22 aa, Entamoeba invadens
DTSTQTPFCWVCDARYGCGSSP

SEQ ID NO: 2788521 - protein, 27 aa, Entamoeba invadens
DTTGCVKCYFGYTVVDSYCKPCGANCL

SEQ ID NO: 2788522 - protein, 31 aa, Entamoeba invadens
DTTNCLYFANTCRKCEGFLYPSTGSNMCSMC

SEQ ID NO: 2788523 - protein, 24 aa, Entamoeba invadens
DTTNGICTNVFWKVFNEPKGLTCI

SEQ ID NO: 2788524 - protein, 23 aa, Entamoeba invadens
DTTQCIKCSSNGVLNNSGICVEK

SEQ ID NO: 2788525 - protein, 24 aa, Entamoeba invadens
DTTRCIKCADGYYTAEGKCVLCNL

SEQ ID NO: 2788526 - protein, 25 aa, Entamoeba invadens
DTTYFKVYRDWFAFLMTRNPTFFIT

SEQ ID NO: 2788527 - protein, 27 aa, Entamoeba invadens
DTVARMKQRGCNHLMSLLDCDVPLTDD

SEQ ID NO: 2788528 - protein, 24 aa, Entamoeba invadens
DTVDNWKATCLVDETVSNTEITNS

SEQ ID NO: 2788529 - protein, 18 aa, Entamoeba invadens
DTVLRFCSNNGLTNYFDE

SEQ ID NO: 2788530 - protein, 17 aa, Entamoeba invadens
DTWGVALSFLSQGDGVV

SEQ ID NO: 2788531 - protein, 23 aa, Entamoeba invadens
DTYSICLFAGLSDGRIIMSHLPD

SEQ ID NO: 2788532 - protein, 19 aa, Entamoeba invadens
DVCDACRINFVLSEGKCIY

SEQ ID NO: 2788533 - protein, 26 aa, Entamoeba invadens
DVCFQQRFLATFLVYQTLHLVLFHKG

SEQ ID NO: 2788534 - protein, 26 aa, Entamoeba invadens
DVCHSCVESYILIKGTCVHFESVEKC

SEQ ID NO: 2788535 - protein, 19 aa, Entamoeba invadens
DVCKGMWGYTCKDNACVLT

SEQ ID NO: 2788536 - protein, 19 aa, Entamoeba invadens
DVCKVCIGGYYLSNSQCLE

SEQ ID NO: 2788537 - protein, 19 aa, Entamoeba invadens
DVCNICIEDYILIGGMCIH

SEQ ID NO: 2788538 - protein, 18 aa, Entamoeba invadens
DVCQNLKIDHQVILVGYG

SEQ ID NO: 2788539 - protein, 19 aa, Entamoeba invadens
DVCRPCIEITQGRCTICES

SEQ ID NO: 2788540 - protein, 24 aa, Entamoeba invadens
DVCSSHCIHCDGTLENKCIICDTN

SEQ ID NO: 2788541 - protein, 27 aa, Entamoeba invadens
DVDIRMKLRVKMMLDCSKGILYLHSND

SEQ ID NO: 2788542 - protein, 24 aa, Entamoeba invadens
DVDMKLRIKLCLDATKGMSYLHKN

SEQ ID NO: 2788543 - protein, 25 aa, Entamoeba invadens
DVDMKLRIKMCLDATKGVSYLHKNG

SEQ ID NO: 2788544 - protein, 28 aa, Entamoeba invadens
DVDTCVFCPIGYYCPLDGIKIPCNPGNY

SEQ ID NO: 2788545 - protein, 18 aa, Entamoeba invadens
DVECEICTASSSYAILVL

SEQ ID NO: 2788546 - protein, 19 aa, Entamoeba invadens
DVEIKGKFTAFDINITQPI

SEQ ID NO: 2788547 - protein, 23 aa, Entamoeba invadens
DVENACKLLHLIGGDANAFETIL

SEQ ID NO: 2788548 - protein, 22 aa, Entamoeba invadens
DVEPAYIPTLFHLVIDAIVCRR

SEQ ID NO: 2788549 - protein, 20 aa, Entamoeba invadens
DVETALKMLMFDMIVNCHGL

SEQ ID NO: 2788550 - protein, 19 aa, Entamoeba invadens
DVETFKGRMKSIQEVSKGT

SEQ ID NO: 2788551 - protein, 25 aa, Entamoeba invadens
DVFARRLGAGIAFYMLVWVVSIFEP

SEQ ID NO: 2788552 - protein, 41 aa, Entamoeba invadens
DVFAYSIVCYEVWLRAVPYTSFKYKWEVSAYVAAGNRLPIP

SEQ ID NO: 2788553 - protein, 24 aa, Entamoeba invadens
DVFKCIKCNLGSYVKDGVCVNLNK

SEQ ID NO: 2788554 - protein, 17 aa, Entamoeba invadens
DVFKGIFTNTIFIGIEL

SEQ ID NO: 2788555 - protein, 19 aa, Entamoeba invadens
DVFMSRLFKRLKAQVYLRF

SEQ ID NO: 2788556 - protein, 23 aa, Entamoeba invadens
DVGCTQCLNGFYMSALNTCTLCD

SEQ ID NO: 2788557 - protein, 23 aa, Entamoeba invadens
DVGKYLWEKGCEPVCGNCRDGYV

SEQ ID NO: 2788558 - protein, 26 aa, Entamoeba invadens
DVGVRCYKYSYAIAFIPALLYGVIIT

SEQ ID NO: 2788559 - protein, 17 aa, Entamoeba invadens
DVHCKGTTSSYCSTTEG

SEQ ID NO: 2788560 - protein, 23 aa, Entamoeba invadens
DVIECAKMANAHDFIMHLPDKYD

SEQ ID NO: 2788561 - protein, 24 aa, Entamoeba invadens
DVIKGCTKCAVGYFVNAKTCKSCD

SEQ ID NO: 2788562 - protein, 37 aa, Entamoeba invadens
DVILLLPIICIVLYFIGAICKCHFLTIPMFPTAIVFA

SEQ ID NO: 2788563 - protein, 18 aa, Entamoeba invadens
DVIPRPAELFFQHPNLRC

SEQ ID NO: 2788564 - protein, 20 aa, Entamoeba invadens
DVIVAAVIFLLSRKRDVEYP

SEQ ID NO: 2788565 - protein, 17 aa, Entamoeba invadens
DVKNCCENVLYIVDSPQ

SEQ ID NO: 2788566 - protein, 23 aa, Entamoeba invadens
DVKNLRIGHNVSLTLFNSRWISS

SEQ ID NO: 2788567 - protein, 23 aa, Entamoeba invadens
DVKNLRIGHNVSLTLFNSRWTSS

SEQ ID NO: 2788568 - protein, 23 aa, Entamoeba invadens
DVLCTKLRLDSGVFSDEQYVQIV

SEQ ID NO: 2788569 - protein, 17 aa, Entamoeba invadens
DVLESFIKEVEMMDKMR

SEQ ID NO: 2788570 - protein, 22 aa, Entamoeba invadens
DVLFFTDFFKTFGVDNIGWMKE

SEQ ID NO: 2788571 - protein, 29 aa, Entamoeba invadens
DVLRDMIKTIGYFISMSIKEGGDFRKVFI

SEQ ID NO: 2788572 - protein, 19 aa, Entamoeba invadens
DVLTEGFPGEVVFEDFTSV

SEQ ID NO: 2788573 - protein, 21 aa, Entamoeba invadens
DVLTLFKIISFVYFLHPWLID

SEQ ID NO: 2788574 - protein, 18 aa, Entamoeba invadens
DVNCKYCPFHKINCLSCK

SEQ ID NO: 2788575 - protein, 19 aa, Entamoeba invadens
DVNLILSIFLNAISFPVLY

SEQ ID NO: 2788576 - protein, 25 aa, Entamoeba invadens
DVNQCGRYCASYKRGVIDTSHSADC

SEQ ID NO: 2788577 - protein, 23 aa, Entamoeba invadens
DVNREIKNLFSIGNTTNHKVKIQ

SEQ ID NO: 2788578 - protein, 21 aa, Entamoeba invadens
DVPDIKKRLWFGCEKEEEFRL

SEQ ID NO: 2788579 - protein, 23 aa, Entamoeba invadens
DVPDKLSVVTCIGVIQPYIDSQA

SEQ ID NO: 2788580 - protein, 21 aa, Entamoeba invadens
DVPIPTHFFSQFALGTPDELS

SEQ ID NO: 2788581 - protein, 20 aa, Entamoeba invadens
DVPKICFFGMRYVKSQQTRD

SEQ ID NO: 2788582 - protein, 21 aa, Entamoeba invadens
DVPNELSFLITKCWAQELEQR

SEQ ID NO: 2788583 - protein, 19 aa, Entamoeba invadens
DVQHIPQIVDIFMEVYEEL

SEQ ID NO: 2788584 - protein, 34 aa, Entamoeba invadens
DVQKYLPFPVCIGLCVAFLSPLLFTVLASVIPQA

SEQ ID NO: 2788585 - protein, 20 aa, Entamoeba invadens
DVRFSYPIRPLTMILDGLSF

SEQ ID NO: 2788586 - protein, 18 aa, Entamoeba invadens
DVRITDFGLAKKVGDASF

SEQ ID NO: 2788587 - protein, 17 aa, Entamoeba invadens
DVRKRIEMNNVVSKLEC

SEQ ID NO: 2788588 - protein, 29 aa, Entamoeba invadens
DVRMKCAEAIFKSLEMRNLIYLDNDILLQ

SEQ ID NO: 2788589 - protein, 19 aa, Entamoeba invadens
DVSNILACSTFLVYPDQNN

SEQ ID NO: 2788590 - protein, 25 aa, Entamoeba invadens
DVTEPICGMFRKRHGSWYGVRNLLN

SEQ ID NO: 2788591 - protein, 18 aa, Entamoeba invadens
DVTFWPNSHVKVHSCSND

SEQ ID NO: 2788592 - protein, 17 aa, Entamoeba invadens
DVTHILTIGNIVLVVTA

SEQ ID NO: 2788593 - protein, 25 aa, Entamoeba invadens
DVTIWRPPKVLIFHLKRFEFTEKFE

SEQ ID NO: 2788594 - protein, 26 aa, Entamoeba invadens
DVTLKIWDMFLLEGFVWLVKVSAAFL

SEQ ID NO: 2788595 - protein, 18 aa, Entamoeba invadens
DVVFELLENVFTYNNYCI

SEQ ID NO: 2788596 - protein, 25 aa, Entamoeba invadens
DVVLAYRLTQEWTSIVFKSIESDCC

SEQ ID NO: 2788597 - protein, 26 aa, Entamoeba invadens
  misc_feature (24)..(25): Xaa can be any naturally occurring amino acid
DVVSKRLSPCFVQFALCVPNQVCXXL

SEQ ID NO: 2788598 - protein, 19 aa, Entamoeba invadens
DVWSVLPVAMGINIILIGL

SEQ ID NO: 2788599 - protein, 19 aa, Entamoeba invadens
DVYMWAMVIWFIATSIHPF

SEQ ID NO: 2788600 - protein, 25 aa, Entamoeba invadens
DVYSFAITMFEIFIWGEAYPGDRFK

SEQ ID NO: 2788601 - protein, 45 aa, Entamoeba invadens
DVYSFAITMFEVFRLKKAYPIDTFKFPWKIAEFVTAGQRLENREN

SEQ ID NO: 2788602 - protein, 18 aa, Entamoeba invadens
DVYSFAMTAWELFYATEP

SEQ ID NO: 2788603 - protein, 17 aa, Entamoeba invadens
DVYSFGIMAWELYYAEE

SEQ ID NO: 2788604 - protein, 32 aa, Entamoeba invadens
DVYSFGITMFECFKWGDSYPKSEFKFPWKIAE

SEQ ID NO: 2788605 - protein, 27 aa, Entamoeba invadens
DVYSFSICMLEIWKGKDCYPQDKFPDG

SEQ ID NO: 2788606 - protein, 19 aa, Entamoeba invadens
DWERKTCPCEGNECIITFQ

SEQ ID NO: 2788607 - protein, 33 aa, Entamoeba invadens
DWESLPYGEFVFLFDFMHTINIIYLLYISSILF

SEQ ID NO: 2788608 - protein, 20 aa, Entamoeba invadens
DWIMTCFNILFTSLPPGAIA

SEQ ID NO: 2788609 - protein, 22 aa, Entamoeba invadens
DWKAESYDVFNLPKISTIVKTT

SEQ ID NO: 2788610 - protein, 20 aa, Entamoeba invadens
DWKTLRLSFYKTRKLSDIIM

SEQ ID NO: 2788611 - protein, 20 aa, Entamoeba invadens
DWLIILSRIFMIIVVTMSFP

SEQ ID NO: 2788612 - protein, 18 aa, Entamoeba invadens
DWSCCSGVIPAYSNLFKT

SEQ ID NO: 2788613 - protein, 24 aa, Entamoeba invadens
DWTMKNYIFFAVFPVWIIAICMLI

SEQ ID NO: 2788614 - protein, 25 aa, Entamoeba invadens
DWVKMLEMVVMWFLEEVLNREDRGD

SEQ ID NO: 2788615 - protein, 18 aa, Entamoeba invadens
DWVTPKAFEYVKNFQGPI

SEQ ID NO: 2788616 - protein, 23 aa, Entamoeba invadens
DYAFSRRRFLFTGNVDDGNVRVL

SEQ ID NO: 2788617 - protein, 19 aa, Entamoeba invadens
DYCYQCVNGYYSYYNNTGS

SEQ ID NO: 2788618 - protein, 30 aa, Entamoeba invadens
DYDERCILMDYTLKFCKAGFTIGAPDFTVS

SEQ ID NO: 2788619 - protein, 20 aa, Entamoeba invadens
DYDLSEKVCVVNPTVENPDL

SEQ ID NO: 2788620 - protein, 26 aa, Entamoeba invadens
DYEKIGRIAFRAAKYFDSQANDIEEY

SEQ ID NO: 2788621 - protein, 24 aa, Entamoeba invadens
DYEMCKVVCEMILKGFKFSIDKHK

SEQ ID NO: 2788622 - protein, 24 aa, Entamoeba invadens
DYFLRPSPNIPTIFPLEVTLPEYF

SEQ ID NO: 2788623 - protein, 22 aa, Entamoeba invadens
DYFSEKYCSYLIVPAKRAPFGA

SEQ ID NO: 2788624 - protein, 23 aa, Entamoeba invadens
DYGYPIMKFEIDWDRVPTDDTRL

SEQ ID NO: 2788625 - protein, 19 aa, Entamoeba invadens
DYHCSACTSDYVLNKTTEK

SEQ ID NO: 2788626 - protein, 23 aa, Entamoeba invadens
DYIERLPIVMPVIMDDLVSLQID

SEQ ID NO: 2788627 - protein, 29 aa, Entamoeba invadens
DYIRSVCSGSIYKTLKIHIASVYEDMNFQ

SEQ ID NO: 2788628 - protein, 17 aa, Entamoeba invadens
DYIWFGVGQCKSITEET

SEQ ID NO: 2788629 - protein, 25 aa, Entamoeba invadens
DYKDIRRGCSWCTMPNYFDSYCYNP

SEQ ID NO: 2788630 - protein, 20 aa, Entamoeba invadens
DYKKCTRCDFDYGSVTSDNN

SEQ ID NO: 2788631 - protein, 19 aa, Entamoeba invadens
DYKLLFTTHMCPLATNMKC

SEQ ID NO: 2788632 - protein, 18 aa, Entamoeba invadens
DYKYGFNSLLSPISLSTM

SEQ ID NO: 2788633 - protein, 24 aa, Entamoeba invadens
DYLEKCATCYLFFVTKRQLENIQT

SEQ ID NO: 2788634 - protein, 22 aa, Entamoeba invadens
DYLKELYFALPQSFFSTYSKVS

SEQ ID NO: 2788635 - protein, 27 aa, Entamoeba invadens
DYLKLPYKLKVRMLFDTAKGMQFLHEN

SEQ ID NO: 2788636 - protein, 23 aa, Entamoeba invadens
DYLKSAMKRKSFTPLIETLEKLI

SEQ ID NO: 2788637 - protein, 21 aa, Entamoeba invadens
DYLKTPIKIVFSNGNTANVNY

SEQ ID NO: 2788638 - protein, 25 aa, Entamoeba invadens
DYLNSYKGGIVWSTEGKEIGALYIK

SEQ ID NO: 2788639 - protein, 20 aa, Entamoeba invadens
DYLPLSYKLKVRMLFDTARG

SEQ ID NO: 2788640 - protein, 21 aa, Entamoeba invadens
DYLPVKSLHDIIFKCQLRVDG

SEQ ID NO: 2788641 - protein, 23 aa, Entamoeba invadens
DYLRLKRCVQQFSVFSIDKTNIS

SEQ ID NO: 2788642 - protein, 22 aa, Entamoeba invadens
DYLVSEALCYFWIGENNRLFNL

SEQ ID NO: 2788643 - protein, 19 aa, Entamoeba invadens
DYMKFSYKLKVRLLFDTAR

SEQ ID NO: 2788644 - protein, 19 aa, Entamoeba invadens
DYMYAMIFFALYLVFRVVR

SEQ ID NO: 2788645 - protein, 26 aa, Entamoeba invadens
DYNCNFAFSSWCEYAISPMFQVLSPT

SEQ ID NO: 2788646 - protein, 20 aa, Entamoeba invadens
DYNKGVCTLRGWNIISNDDS

SEQ ID NO: 2788647 - protein, 29 aa, Entamoeba invadens
DYPELRKAKRPEGPAVYHGISSPILNPTK

SEQ ID NO: 2788648 - protein, 37 aa, Entamoeba invadens
DYPRCGICVEVIGPTLKRATCTLVGSVVMNFTNPLTM

SEQ ID NO: 2788649 - protein, 20 aa, Entamoeba invadens
DYSLNRWIGILIDTTTIPDI

SEQ ID NO: 2788650 - protein, 23 aa, Entamoeba invadens
DYSRKCTKCGVSNMYPDERTFIC

SEQ ID NO: 2788651 - protein, 21 aa, Entamoeba invadens
DYSRRCVKCLNGYYPDTNGKC

SEQ ID NO: 2788652 - protein, 22 aa, Entamoeba invadens
DYTELKPVLPAIGEGGFGIVFK

SEQ ID NO: 2788653 - protein, 24 aa, Entamoeba invadens
DYTRKCIMCGNGYYPNESGTCVSC

SEQ ID NO: 2788654 - protein, 23 aa, Entamoeba invadens
DYTRNCVVCKPGYYVVNGKCKPC

SEQ ID NO: 2788655 - protein, 18 aa, Entamoeba invadens
DYTSFFKKLLSGNGALFG

SEQ ID NO: 2788656 - protein, 28 aa, Entamoeba invadens
DYTSLICPMSMYLTKSCQVVVEHSTGIK

SEQ ID NO: 2788657 - protein, 27 aa, Entamoeba invadens
DYVKIPYKLKVRMLFDTSRGMQFLHEN

SEQ ID NO: 2788658 - protein, 28 aa, Entamoeba invadens
DYVKIPYKLKVRMLFDTSRGMQFLHENR

SEQ ID NO: 2788659 - protein, 27 aa, Entamoeba invadens
DYVKLPYKLKVRMLYDTSRGMQFLHDN

SEQ ID NO: 2788660 - protein, 28 aa, Entamoeba invadens
DYVKMPYKLKVRMLFDTSRGMQFLHENR

SEQ ID NO: 2788661 - protein, 18 aa, Entamoeba invadens
DYYKCFQCEDNLLLSDDN

SEQ ID NO: 2788662 - protein, 25 aa, Entamoeba invadens
DYYPFIYVMFLCYILLKLMVMLFVS

SEQ ID NO: 2788663 - protein, 17 aa, Entamoeba invadens
EAACLGSTIVPLTCKSY

SEQ ID NO: 2788664 - protein, 18 aa, Entamoeba invadens
EAAFKGSALVSVTLTSSV

SEQ ID NO: 2788665 - protein, 24 aa, Entamoeba invadens
EAAFQCAYCLIDIKHKHPTLDEKA

SEQ ID NO: 2788666 - protein, 17 aa, Entamoeba invadens
EACEFEIFMTIMCTCTI

SEQ ID NO: 2788667 - protein, 17 aa, Entamoeba invadens
EACEFEIFVTLLCTSKI

SEQ ID NO: 2788668 - protein, 23 aa, Entamoeba invadens
EADGYFSYLVCCFVAEKSLVLKA

SEQ ID NO: 2788669 - protein, 22 aa, Entamoeba invadens
EAEKHYAAYFVFKGLGANMVMH

SEQ ID NO: 2788670 - protein, 27 aa, Entamoeba invadens
EAEMLSRFETIFARVIGVSFTRTKVTL

SEQ ID NO: 2788671 - protein, 24 aa, Entamoeba invadens
EAFNWKDKYHALKKAVGIEGDGYF

SEQ ID NO: 2788672 - protein, 24 aa, Entamoeba invadens
EAFPEYPDIISIGLCSMDRDIIEE

SEQ ID NO: 2788673 - protein, 26 aa, Entamoeba invadens
EAFPKQRFNFAWSIADFVTSGKRLEC

SEQ ID NO: 2788674 - protein, 26 aa, Entamoeba invadens
EAFPKSEFKYAWSIADFITSGNRRQR

SEQ ID NO: 2788675 - protein, 26 aa, Entamoeba invadens
EAGICCLHIALYIGLLYDFKCEKLLE

SEQ ID NO: 2788676 - protein, 34 aa, Entamoeba invadens
EAGKCVFIKLNFQPKCSFSTQILFKTVVYENNVV

SEQ ID NO: 2788677 - protein, 19 aa, Entamoeba invadens
EAHELRLRFDSNAEDTFFS

SEQ ID NO: 2788678 - protein, 17 aa, Entamoeba invadens
EAIAIKWTSSSGCDGTI

SEQ ID NO: 2788679 - protein, 19 aa, Entamoeba invadens
EAIHFLPSIVEFFIMKAKE

SEQ ID NO: 2788680 - protein, 23 aa, Entamoeba invadens
EAISRIKINPSFRESDVETLFQK

SEQ ID NO: 2788681 - protein, 18 aa, Entamoeba invadens
EAIYPFQFEFPIISVLTN

SEQ ID NO: 2788682 - protein, 23 aa, Entamoeba invadens
EAKCLTCSSGYYLKGSTCDVCNN

SEQ ID NO: 2788683 - protein, 25 aa, Entamoeba invadens
EAKERLKYMWIIFSIYLKSLIGFYQ

SEQ ID NO: 2788684 - protein, 18 aa, Entamoeba invadens
EAKLRCKYYSPNQLKCIE

SEQ ID NO: 2788685 - protein, 19 aa, Entamoeba invadens
EAKLWKYISQFVFCSAKQQ

SEQ ID NO: 2788686 - protein, 22 aa, Entamoeba invadens
EALICPLTLSIKNWSPVDAECL

SEQ ID NO: 2788687 - protein, 18 aa, Entamoeba invadens
EALNCEYLDAGINPDDLQ

SEQ ID NO: 2788688 - protein, 17 aa, Entamoeba invadens
EALPILDIDGQLRVSLC

SEQ ID NO: 2788689 - protein, 19 aa, Entamoeba invadens
EALSRLNVLPSKFSTKYIF

SEQ ID NO: 2788690 - protein, 24 aa, Entamoeba invadens
EAMKRGMVHIVVFGETDHRNQKEK

SEQ ID NO: 2788691 - protein, 19 aa, Entamoeba invadens
EANDGGACIRCKVRYYLQG

SEQ ID NO: 2788692 - protein, 20 aa, Entamoeba invadens
EANKCLDFAPTTSLEVKLNS

SEQ ID NO: 2788693 - protein, 19 aa, Entamoeba invadens
EAPDTWTIQELDLDTYTTI

SEQ ID NO: 2788694 - protein, 19 aa, Entamoeba invadens
EAPFKIPSLDSSTVSYRRL

SEQ ID NO: 2788695 - protein, 19 aa, Entamoeba invadens
EAPLSFLMFHELLTVFKAT

SEQ ID NO: 2788696 - protein, 25 aa, Entamoeba invadens
EAPNEFTRFISLSSIDIVNSVVPTE

SEQ ID NO: 2788697 - protein, 20 aa, Entamoeba invadens
EAQFNNGLLYLIKSLGYDFT

SEQ ID NO: 2788698 - protein, 20 aa, Entamoeba invadens
EAQRVKYCKDMSLEYMYERQ

SEQ ID NO: 2788699 - protein, 18 aa, Entamoeba invadens
EARVRGMNVDTIRNITRQ

SEQ ID NO: 2788700 - protein, 19 aa, Entamoeba invadens
EARYEMVYCPCVDIDCFYQ

SEQ ID NO: 2788701 - protein, 17 aa, Entamoeba invadens
EASCAKCSGVTCYECKN

SEQ ID NO: 2788702 - protein, 17 aa, Entamoeba invadens
EASSFLYFCDTFLDYYK

SEQ ID NO: 2788703 - protein, 23 aa, Entamoeba invadens
EATRPIIQRIMRISRKQLAKEGI

SEQ ID NO: 2788704 - protein, 25 aa, Entamoeba invadens
EAVHKRPLFMYSRFIFVRILVVVLI

SEQ ID NO: 2788705 - protein, 29 aa, Entamoeba invadens
EAVKKVMCLKYGFFGEALSRHSEREILFR

SEQ ID NO: 2788706 - protein, 20 aa, Entamoeba invadens
EAVKSVLGLKAFDEMDLKTP

SEQ ID NO: 2788707 - protein, 21 aa, Entamoeba invadens
EAVKTCQGAGIKQCNIISSDD

SEQ ID NO: 2788708 - protein, 19 aa, Entamoeba invadens
EAVSTWYPFLHSVVKKDGE

SEQ ID NO: 2788709 - protein, 27 aa, Entamoeba invadens
EAYFHLFPAFCLPWFVKQKKNIPMLNE

SEQ ID NO: 2788710 - protein, 27 aa, Entamoeba invadens
EAYKGKIFKFPWGIAEFVVSGKRLKNE

SEQ ID NO: 2788711 - protein, 19 aa, Entamoeba invadens
EAYKSLSASILIHVVDPFS

SEQ ID NO: 2788712 - protein, 18 aa, Entamoeba invadens
EAYLKYTKCQITHPMKSA

SEQ ID NO: 2788713 - protein, 28 aa, Entamoeba invadens
EAYNKIQFKFPWKIAEFVINRNRLPKKE

SEQ ID NO: 2788714 - protein, 26 aa, Entamoeba invadens
EAYPKKDFKFAWSVADFVSSGKRRAY

SEQ ID NO: 2788715 - protein, 26 aa, Entamoeba invadens
EAYPKKEFKYAWAIADFITSGKRRER

SEQ ID NO: 2788716 - protein, 27 aa, Entamoeba invadens
EAYPKQKFKFAWSIADFVTSGKRLECL

SEQ ID NO: 2788717 - protein, 27 aa, Entamoeba invadens
EAYPKQRFKFAWSIADFVTSGKRLECL

SEQ ID NO: 2788718 - protein, 26 aa, Entamoeba invadens
EAYPKSQFKYSWKIAEFVNDGNRPSL

SEQ ID NO: 2788719 - protein, 28 aa, Entamoeba invadens
EAYPKTLFPFTWCIADKVVLGIRPTAVK

SEQ ID NO: 2788720 - protein, 28 aa, Entamoeba invadens
EAYSKDKFKFAWCIADFVSNGNRFEKDD

SEQ ID NO: 2788721 - protein, 22 aa, Entamoeba invadens
ECAKNTFIYFFFPSSGFKPTCA

SEQ ID NO: 2788722 - protein, 23 aa, Entamoeba invadens
ECAVCKGLSVKTLFDFSPAKKDI

SEQ ID NO: 2788723 - protein, 17 aa, Entamoeba invadens
ECAVVIQGNNNFIILSA

SEQ ID NO: 2788724 - protein, 17 aa, Entamoeba invadens
ECCQCIHSYGFIYLYVV

SEQ ID NO: 2788725 - protein, 23 aa, Entamoeba invadens
ECCSCAYNHCGVCDKVTGDCLTC

SEQ ID NO: 2788726 - protein, 21 aa, Entamoeba invadens
ECDGGDGCIECECQPDWFSQN

SEQ ID NO: 2788727 - protein, 25 aa, Entamoeba invadens
ECDGIKYLWVRNSWGKDWGVENGHF

SEQ ID NO: 2788728 - protein, 19 aa, Entamoeba invadens
ECDKEHMAIGYGLTQCSQC

SEQ ID NO: 2788729 - protein, 20 aa, Entamoeba invadens
ECDKSCAICKNSISCSLCAD

SEQ ID NO: 2788730 - protein, 20 aa, Entamoeba invadens
ECDSGEGCYECECQEGYYVR

SEQ ID NO: 2788731 - protein, 24 aa, Entamoeba invadens
ECEKCPNHCYHCYNTSYCLTCDPQ

SEQ ID NO: 2788732 - protein, 18 aa, Entamoeba invadens
ECEKCTTSGVFGTLVVSV

SEQ ID NO: 2788733 - protein, 19 aa, Entamoeba invadens
ECEKEHMSLGYGLTQCSQC

SEQ ID NO: 2788734 - protein, 23 aa, Entamoeba invadens
ECELCPLKCDTCISETTCVTCNT

SEQ ID NO: 2788735 - protein, 32 aa, Entamoeba invadens
ECETCSFKDCLTCSPYGCLYCQRDLLYDPTLS

SEQ ID NO: 2788736 - protein, 25 aa, Entamoeba invadens
ECFDAYKLKGGVCSENFDAQETPKN

SEQ ID NO: 2788737 - protein, 31 aa, Entamoeba invadens
ECFGFKIPEQCYGPFSYRSHAEWLRSYFSKE

SEQ ID NO: 2788738 - protein, 17 aa, Entamoeba invadens
ECFQCINCLSGNCHQNG

SEQ ID NO: 2788739 - protein, 25 aa, Entamoeba invadens
ECFQILGKYIHEWGYDKSLQNVREK

SEQ ID NO: 2788740 - protein, 24 aa, Entamoeba invadens
ECFVHYKYSNGVLIGTESPTRVLL

SEQ ID NO: 2788741 - protein, 18 aa, Entamoeba invadens
ECGEGCFKCSSPDNCDFC

SEQ ID NO: 2788742 - protein, 18 aa, Entamoeba invadens
ECGELCYNGKSFSSGNEN

SEQ ID NO: 2788743 - protein, 18 aa, Entamoeba invadens
ECICVSFSEAIMHCVEGD

SEQ ID NO: 2788744 - protein, 22 aa, Entamoeba invadens
ECIDANCLDCSYNRSVCIQCPY

SEQ ID NO: 2788745 - protein, 31 aa, Entamoeba invadens
ECIDCKAGYGFEFGRCIICGDKYYSPGGKFW

SEQ ID NO: 2788746 - protein, 17 aa, Entamoeba invadens
ECIETNFVISCQQPMVN

SEQ ID NO: 2788747 - protein, 29 aa, Entamoeba invadens
ECIFKWLVQQPRCPICRDVSLPKHAFIGF

SEQ ID NO: 2788748 - protein, 21 aa, Entamoeba invadens
ECIGPYGGGLLIDLNIFGITM

SEQ ID NO: 2788749 - protein, 24 aa, Entamoeba invadens
ECILKHEKCVLCEQEKCVKCADEY

SEQ ID NO: 2788750 - protein, 24 aa, Entamoeba invadens
ECIPCSKGGCATCQNYSTTLEQKC

SEQ ID NO: 2788751 - protein, 19 aa, Entamoeba invadens
ECIPYSTVCEGGYTYNAVK

SEQ ID NO: 2788752 - protein, 18 aa, Entamoeba invadens
ECISGYFKDGPLCVKCPL

SEQ ID NO: 2788753 - protein, 21 aa, Entamoeba invadens
ECKDLEECSNLIIKYKFFVHL

SEQ ID NO: 2788754 - protein, 26 aa, Entamoeba invadens
ECKKHLPWWLTFIIVLLLIIILITIV

SEQ ID NO: 2788755 - protein, 25 aa, Entamoeba invadens
ECKQMRGRHFAAYVKAAGQIIAVVD

SEQ ID NO: 2788756 - protein, 17 aa, Entamoeba invadens
ECKRNTIERCLKQTELT

SEQ ID NO: 2788757 - protein, 25 aa, Entamoeba invadens
ECKTCTNTTCLTCQSSHYFSGNSCY

SEQ ID NO: 2788758 - protein, 25 aa, Entamoeba invadens
ECLDAFKLKGGICAETFDEDDKLKT

SEQ ID NO: 2788759 - protein, 27 aa, Entamoeba invadens
ECLDAFKLKSGICAESFDEDDKLKTSS

SEQ ID NO: 2788760 - protein, 27 aa, Entamoeba invadens
ECLDAFKMKSGICAESFDEDDKLKTSS

SEQ ID NO: 2788761 - protein, 18 aa, Entamoeba invadens
ECLEHPFLHLLDVEDDID

SEQ ID NO: 2788762 - protein, 20 aa, Entamoeba invadens
ECLESFYLMDGICFPCSLKD

SEQ ID NO: 2788763 - protein, 22 aa, Entamoeba invadens
ECLKCAYGENCLSCNSTMCTAC

SEQ ID NO: 2788764 - protein, 26 aa, Entamoeba invadens
ECLKGIRWVLNMFVTLPLDIKNAGLN

SEQ ID NO: 2788765 - protein, 24 aa, Entamoeba invadens
ECLNSSLFLTFAILFQQVPSLFDT

SEQ ID NO: 2788766 - protein, 18 aa, Entamoeba invadens
ECLQCPDGTISQSGSATC

SEQ ID NO: 2788767 - protein, 23 aa, Entamoeba invadens
ECLTDSYSWIFFPPHSFEGITPS

SEQ ID NO: 2788768 - protein, 18 aa, Entamoeba invadens
ECMSCQMGFVLSNGNCGL

SEQ ID NO: 2788769 - protein, 26 aa, Entamoeba invadens
ECNEMGLETSICYAVDIGVFNDENGE

SEQ ID NO: 2788770 - protein, 27 aa, Entamoeba invadens
ECNGKVCSKCSLPYVLNDNFKCVQCVD

SEQ ID NO: 2788771 - protein, 26 aa, Entamoeba invadens
ECNKIKNSKCVKCSFWNTPNDDGTLC

SEQ ID NO: 2788772 - protein, 22 aa, Entamoeba invadens
ECNSESCLQCDAKTILKNGKCI

SEQ ID NO: 2788773 - protein, 21 aa, Entamoeba invadens
ECPSNCLLCDQRYCFKCSASY

SEQ ID NO: 2788774 - protein, 18 aa, Entamoeba invadens
ECQPCSPNSYSLEGSSNC

SEQ ID NO: 2788775 - protein, 20 aa, Entamoeba invadens
ECQPCSSLHPNCIKCSQKTK

SEQ ID NO: 2788776 - protein, 17 aa, Entamoeba invadens
ECQTCIKESGTCSSCKN

SEQ ID NO: 2788777 - protein, 18 aa, Entamoeba invadens
ECRKETNLGLAIGLPIAL

SEQ ID NO: 2788778 - protein, 26 aa, Entamoeba invadens
ECRPACGTCFDVFKCSTSGKCVKEKV

SEQ ID NO: 2788779 - protein, 26 aa, Entamoeba invadens
ECRPTCGTCFDVFKCSTSGKCVNEKV

SEQ ID NO: 2788780 - protein, 17 aa, Entamoeba invadens
ECSAACLTCSKSGEDCL

SEQ ID NO: 2788781 - protein, 21 aa, Entamoeba invadens
ECSLVSLSNCEMCNNGVTVGT

SEQ ID NO: 2788782 - protein, 19 aa, Entamoeba invadens
ECSSEYYLESGLCHTQPNS

SEQ ID NO: 2788783 - protein, 26 aa, Entamoeba invadens
ECSSMIRIDLNIIISMSENVFSNSLV

SEQ ID NO: 2788784 - protein, 19 aa, Entamoeba invadens
ECTANPLVHFFQTVSKENS

SEQ ID NO: 2788785 - protein, 17 aa, Entamoeba invadens
ECTAVAFGDYAQSIDVI

SEQ ID NO: 2788786 - protein, 20 aa, Entamoeba invadens
ECTEGLKLIVETDLDTLELG

SEQ ID NO: 2788787 - protein, 20 aa, Entamoeba invadens
ECTILFDFVLEILKNKVVRY

SEQ ID NO: 2788788 - protein, 18 aa, Entamoeba invadens
ECTKCSKGNLIKDKTKCV

SEQ ID NO: 2788789 - protein, 17 aa, Entamoeba invadens
ECTKCTKGNLIKDKTKC

SEQ ID NO: 2788790 - protein, 20 aa, Entamoeba invadens
ECTKINLALIIPLSVVGLVV

SEQ ID NO: 2788791 - protein, 17 aa, Entamoeba invadens
ECTLELLNISTRCQECN

SEQ ID NO: 2788792 - protein, 19 aa, Entamoeba invadens
ECVAECPKGYYDGDIICEK

SEQ ID NO: 2788793 - protein, 43 aa, Entamoeba invadens
ECVCNDGFIGRDCHRSCWYNNKWVYGDGVGMCYHGTEHCDDYC

SEQ ID NO: 2788794 - protein, 25 aa, Entamoeba invadens
ECVGYETVCLMLFIFHNLSRDSRIL

SEQ ID NO: 2788795 - protein, 18 aa, Entamoeba invadens
ECVHCDGLCGDHCDAASG

SEQ ID NO: 2788796 - protein, 18 aa, Entamoeba invadens
ECVHCDGLCGDHCDTASG

SEQ ID NO: 2788797 - protein, 22 aa, Entamoeba invadens
ECVHKTNVLAIIFPIIFGILMV

SEQ ID NO: 2788798 - protein, 18 aa, Entamoeba invadens
ECWYPSARFDDIVQKLGQ

SEQ ID NO: 2788799 - protein, 19 aa, Entamoeba invadens
ECYCTKCACGYELSVETHV

SEQ ID NO: 2788800 - protein, 26 aa, Entamoeba invadens
ECYKCSDNCKHCISVDTCGMCEEGYV

SEQ ID NO: 2788801 - protein, 17 aa, Entamoeba invadens
ECYLVIEKCQLCEYNNG

SEQ ID NO: 2788802 - protein, 20 aa, Entamoeba invadens
ECYMCDRGLMSLDCSGECTN

SEQ ID NO: 2788803 - protein, 28 aa, Entamoeba invadens
ECYSALECTKCLDGFILVDSTCNSLSNV

SEQ ID NO: 2788804 - protein, 20 aa, Entamoeba invadens
ECYSDCYSFASDVYAFGVTA

SEQ ID NO: 2788805 - protein, 19 aa, Entamoeba invadens
EDCKIGYGNLIYSCNSCGS

SEQ ID NO: 2788806 - protein, 22 aa, Entamoeba invadens
EDDMLFKWYILHTKMDGLGKIY

SEQ ID NO: 2788807 - protein, 23 aa, Entamoeba invadens
EDEILRLKLSVLKECEVMNKLRN

SEQ ID NO: 2788808 - protein, 35 aa, Entamoeba invadens
EDEKQIAIIVAALFVGFLIVCALLLTVVVIIRKIL

SEQ ID NO: 2788809 - protein, 21 aa, Entamoeba invadens
EDFAAVLPFTMTIETDKKVYL

SEQ ID NO: 2788810 - protein, 19 aa, Entamoeba invadens
EDFGFPWEIAQFVTEGKRP

SEQ ID NO: 2788811 - protein, 23 aa, Entamoeba invadens
EDFGIPCKHCYPVQRADCESTLT

SEQ ID NO: 2788812 - protein, 22 aa, Entamoeba invadens
EDFKLAEQFLIIGGNAEDDTPE

SEQ ID NO: 2788813 - protein, 17 aa, Entamoeba invadens
EDFLNERLFEIIIKELE

SEQ ID NO: 2788814 - protein, 21 aa, Entamoeba invadens
EDGFCSISYCSKCTKWIKASD

SEQ ID NO: 2788815 - protein, 17 aa, Entamoeba invadens
EDGIYFVGIVEGTTGTA

SEQ ID NO: 2788816 - protein, 17 aa, Entamoeba invadens
EDGKLVFQEGILVEAVR

SEQ ID NO: 2788817 - protein, 20 aa, Entamoeba invadens
EDGLASGYCTWIDSAEQGEF

SEQ ID NO: 2788818 - protein, 21 aa, Entamoeba invadens
EDGSTLLCLFGIEDPLRPEVE

SEQ ID NO: 2788819 - protein, 17 aa, Entamoeba invadens
EDGTSVIEWDCINTYDL

SEQ ID NO: 2788820 - protein, 21 aa, Entamoeba invadens
EDHQALMKWSAKLELELVENR

SEQ ID NO: 2788821 - protein, 20 aa, Entamoeba invadens
EDIAKIVIKEDIIREDSNKF

SEQ ID NO: 2788822 - protein, 20 aa, Entamoeba invadens
EDICVFKMSRSNIMMTKLDG

SEQ ID NO: 2788823 - protein, 30 aa, Entamoeba invadens
EDIMCPCHLLAADCRLDYGNIPTTVTVGVD

SEQ ID NO: 2788824 - protein, 23 aa, Entamoeba invadens
EDIRLCSFNVVLWLLPVKFGLSD

SEQ ID NO: 2788825 - protein, 22 aa, Entamoeba invadens
EDIRRWLADRGFNNQKYTAINL

SEQ ID NO: 2788826 - protein, 24 aa, Entamoeba invadens
EDKCLRCVDGFVFKGNNCVDITEG

SEQ ID NO: 2788827 - protein, 22 aa, Entamoeba invadens
EDKCNDCALGYFMNNGECVSCT

SEQ ID NO: 2788828 - protein, 25 aa, Entamoeba invadens
EDKGKVFLFCYAPIILVTTSALAIL

SEQ ID NO: 2788829 - protein, 24 aa, Entamoeba invadens
EDKNGISGWGIWGILFYGIYFVLI

SEQ ID NO: 2788830 - protein, 26 aa, Entamoeba invadens
EDLDMKFCYEHEEFGRKIVDDLKPNG

SEQ ID NO: 2788831 - protein, 21 aa, Entamoeba invadens
EDLFPKFGRKFIVMNPTWSKE

SEQ ID NO: 2788832 - protein, 21 aa, Entamoeba invadens
EDLINKDCMKAVCNEATGVVE

SEQ ID NO: 2788833 - protein, 20 aa, Entamoeba invadens
EDLKYVVLYKNAPSQSANTI

SEQ ID NO: 2788834 - protein, 25 aa, Entamoeba invadens
EDLPAQCFQVLRALQAYDLSPAVMS

SEQ ID NO: 2788835 - protein, 27 aa, Entamoeba invadens
EDNCAARVLIDFNIPFYSSGAVISGGK

SEQ ID NO: 2788836 - protein, 20 aa, Entamoeba invadens
EDNFVAWNFFILYFSQTLTF

SEQ ID NO: 2788837 - protein, 18 aa, Entamoeba invadens
EDNHCLYFGKNRCLKCEE

SEQ ID NO: 2788838 - protein, 25 aa, Entamoeba invadens
EDNICKGKNGYYCVKGEEHKYLWCT

SEQ ID NO: 2788839 - protein, 17 aa, Entamoeba invadens
EDNKGKEGLSWKPLFMY

SEQ ID NO: 2788840 - protein, 19 aa, Entamoeba invadens
EDNPSCFGTAYGVLGRKLL

SEQ ID NO: 2788841 - protein, 17 aa, Entamoeba invadens
EDPFPKNAFAFPWSIAR

SEQ ID NO: 2788842 - protein, 28 aa, Entamoeba invadens
EDQGKEGCIEWICKRGFIPTLLKTLMGT

SEQ ID NO: 2788843 - protein, 18 aa, Entamoeba invadens
EDRFFKRLLRCYLADERS

SEQ ID NO: 2788844 - protein, 18 aa, Entamoeba invadens
EDRVKLIVQDGGDFNLKE

SEQ ID NO: 2788845 - protein, 19 aa, Entamoeba invadens
EDSCLFSSSDECRRCKFGF

SEQ ID NO: 2788846 - protein, 24 aa, Entamoeba invadens
EDSKCTKCSFWKAPNEEGTACDLK

SEQ ID NO: 2788847 - protein, 24 aa, Entamoeba invadens
EDSKCTKCSFWKAPNEEGTACDTK

SEQ ID NO: 2788848 - protein, 18 aa, Entamoeba invadens
EDSKCTKCSFWYSVDESG

SEQ ID NO: 2788849 - protein, 18 aa, Entamoeba invadens
EDTAKFVGALVPFTNDYQ

SEQ ID NO: 2788850 - protein, 19 aa, Entamoeba invadens
EDTYGLSWQGWLFSLLLSF

SEQ ID NO: 2788851 - protein, 19 aa, Entamoeba invadens
EDVFPKSMFPFPWKIAEFV

SEQ ID NO: 2788852 - protein, 28 aa, Entamoeba invadens
EDVLSNFFTLISWCFFSQQIQNVVDTRL

SEQ ID NO: 2788853 - protein, 21 aa, Entamoeba invadens
EDVPQCVIDGSFIKDLVEKKL

SEQ ID NO: 2788854 - protein, 20 aa, Entamoeba invadens
EDYELVKRCLGFHYPQPKSC

SEQ ID NO: 2788855 - protein, 19 aa, Entamoeba invadens
EDYILIGGMCIHYSSLDNC

SEQ ID NO: 2788856 - protein, 28 aa, Entamoeba invadens
EDYIMFSYKLKVRLLFDTARGMQFLHEN

SEQ ID NO: 2788857 - protein, 17 aa, Entamoeba invadens
EDYKCTDALYFYPQSDD

SEQ ID NO: 2788858 - protein, 28 aa, Entamoeba invadens
EDYLKLPYKLKVRMLFDSARGMQFLHEN

SEQ ID NO: 2788859 - protein, 30 aa, Entamoeba invadens
EDYLRMSYKLKLKILFDTARGMQFLHENRI

SEQ ID NO: 2788860 - protein, 26 aa, Entamoeba invadens
EEADKEAYCVWKFKKTNCKKCISHQT

SEQ ID NO: 2788861 - protein, 27 aa, Entamoeba invadens
EECDGGRGCIECQCQFGYSSKSSSDCQ

SEQ ID NO: 2788862 - protein, 20 aa, Entamoeba invadens
EECSCVDNAFNVSFRDFCET

SEQ ID NO: 2788863 - protein, 18 aa, Entamoeba invadens
EECVHIIEGVEIIPEEEP

SEQ ID NO: 2788864 - protein, 19 aa, Entamoeba invadens
EEDLRVTLNRTFEEQKEDL

SEQ ID NO: 2788865 - protein, 31 aa, Entamoeba invadens
EEDRYKRAMFFIRIAFPVPFYQIKGNVAEYN

SEQ ID NO: 2788866 - protein, 24 aa, Entamoeba invadens
EEEKRRVLQIITWLLQERVDNELL

SEQ ID NO: 2788867 - protein, 21 aa, Entamoeba invadens
EEELLKIFSGVLVDEDKNRIK

SEQ ID NO: 2788868 - protein, 23 aa, Entamoeba invadens
EEFQRACYRLIKTFTTCSMVLEQ

SEQ ID NO: 2788869 - protein, 20 aa, Entamoeba invadens
EEFYRFSTELVNTLVVDMNY

SEQ ID NO: 2788870 - protein, 21 aa, Entamoeba invadens
EEGVCKYCKVVYPNDCTTDEC

SEQ ID NO: 2788871 - protein, 26 aa, Entamoeba invadens
EEGVKKFGVCYKCKQTVTLEEIQNRK

SEQ ID NO: 2788872 - protein, 24 aa, Entamoeba invadens
EEGYPGTFYLEFDRCTFLKKEGFN

SEQ ID NO: 2788873 - protein, 17 aa, Entamoeba invadens
EEHIVVISFQMREIIIS

SEQ ID NO: 2788874 - protein, 23 aa, Entamoeba invadens
EEHKYLWCTDTYKGYMNCPKGTH

SEQ ID NO: 2788875 - protein, 23 aa, Entamoeba invadens
EEHKYLWCTDTYKGYMNCSKGTH

SEQ ID NO: 2788876 - protein, 24 aa, Entamoeba invadens
EEHWKLMVDVYLDFSIQDNSKTAV

SEQ ID NO: 2788877 - protein, 24 aa, Entamoeba invadens
EEIEIKLRIKFMLDASKGILYLHT

SEQ ID NO: 2788878 - protein, 21 aa, Entamoeba invadens
EEIFSMFKLFKVFDVNKNVEE

SEQ ID NO: 2788879 - protein, 21 aa, Entamoeba invadens
EEIHLPFAKTLKMKAQKSYFK

SEQ ID NO: 2788880 - protein, 26 aa, Entamoeba invadens
EEIIFKGGLLFYILVIIYIILTRTVI

SEQ ID NO: 2788881 - protein, 25 aa, Entamoeba invadens
EEINRASLYLMVGMVERLDLDSTLQ

SEQ ID NO: 2788882 - protein, 21 aa, Entamoeba invadens
EEIPMLYNIVRLKSSSQIYTD

SEQ ID NO: 2788883 - protein, 17 aa, Entamoeba invadens
EEIVVNVFFKFNSVYMI

SEQ ID NO: 2788884 - protein, 18 aa, Entamoeba invadens
EEKCTVCADGYMKDVANN

SEQ ID NO: 2788885 - protein, 27 aa, Entamoeba invadens
EEKKRHAEVLKRIGALNKNGTKKANYE

SEQ ID NO: 2788886 - protein, 25 aa, Entamoeba invadens
EEKKRKTMCLFTMKKSNIEFMKTLS

SEQ ID NO: 2788887 - protein, 23 aa, Entamoeba invadens
EEKLRKSLVKEFLLKDLKKKEVD

SEQ ID NO: 2788888 - protein, 22 aa, Entamoeba invadens
EEKRNIHLKRLLLRIKNGTPAM

SEQ ID NO: 2788889 - protein, 21 aa, Entamoeba invadens
EEKRWYVKGKGLPIHNDENGG

SEQ ID NO: 2788890 - protein, 30 aa, Entamoeba invadens
EEKSRLDIIDWLHCLFLIVFLIKNNSNKNN

SEQ ID NO: 2788891 - protein, 23 aa, Entamoeba invadens
EEKYHNICVFKMSRSNIAMISIN

SEQ ID NO: 2788892 - protein, 24 aa, Entamoeba invadens
EELGTVLCCPGCFTLVRLESVFDV

SEQ ID NO: 2788893 - protein, 24 aa, Entamoeba invadens
EELKRSDFEGVLRFFAEMHSVTNS

SEQ ID NO: 2788894 - protein, 26 aa, Entamoeba invadens
EELQAFCACTSFLMNMTNYFYDESCW

SEQ ID NO: 2788895 - protein, 17 aa, Entamoeba invadens
EELSILIQQSWEHNPKK

SEQ ID NO: 2788896 - protein, 25 aa, Entamoeba invadens
EELTWWSILELAGFIVLFFSSLIYN

SEQ ID NO: 2788897 - protein, 19 aa, Entamoeba invadens
EELYIKWSNRIKIKSTFVN

SEQ ID NO: 2788898 - protein, 19 aa, Entamoeba invadens
EEMKKICVFNMKRSNISFT

SEQ ID NO: 2788899 - protein, 23 aa, Entamoeba invadens
EEMNQELELLLGTLYEKYKEIKR

SEQ ID NO: 2788900 - protein, 26 aa, Entamoeba invadens
EENMQRVCVVPIWLTHEDYPKVLSSC

SEQ ID NO: 2788901 - protein, 30 aa, Entamoeba invadens
EEPFNRKQFKFSWDIADFVVAGKRLEKPMD

SEQ ID NO: 2788902 - protein, 24 aa, Entamoeba invadens
EEPWKDTKSLFDIKDHVLKGIRPP

SEQ ID NO: 2788903 - protein, 23 aa, Entamoeba invadens
EEQGLKVLPAFDLTQEVLKDLSE

SEQ ID NO: 2788904 - protein, 30 aa, Entamoeba invadens
EEQILKQQTWRWFVCVFSREFKVEQVIMIW

SEQ ID NO: 2788905 - protein, 18 aa, Entamoeba invadens
EEQMKRAGIDGGSRVEHI

SEQ ID NO: 2788906 - protein, 26 aa, Entamoeba invadens
EEQMYRPALVLYQFLGELGIMSAQLN

SEQ ID NO: 2788907 - protein, 18 aa, Entamoeba invadens
EEQRKKTAIFDMDKSNIS

SEQ ID NO: 2788908 - protein, 25 aa, Entamoeba invadens
EEQVCTEIGQIFGLHPLTVEDWFGG

SEQ ID NO: 2788909 - protein, 21 aa, Entamoeba invadens
EEQYNIIALCWCQDPKSRPQM

SEQ ID NO: 2788910 - protein, 23 aa, Entamoeba invadens
EEQYTLIEMCWRYDENNRISSFQ

SEQ ID NO: 2788911 - protein, 20 aa, Entamoeba invadens
EERKIGGAFVPINVDDFKPK

SEQ ID NO: 2788912 - protein, 21 aa, Entamoeba invadens
EERKKVCVFNMKKSNINFSKL

SEQ ID NO: 2788913 - protein, 18 aa, Entamoeba invadens
EESILEHGFFVFTQGTLK

SEQ ID NO: 2788914 - protein, 17 aa, Entamoeba invadens
EESKARIKMLINTALYK

SEQ ID NO: 2788915 - protein, 19 aa, Entamoeba invadens
EESKIPPVIILSYTQYGYI

SEQ ID NO: 2788916 - protein, 18 aa, Entamoeba invadens
EESYLGAGGFGIVYKGTF

SEQ ID NO: 2788917 - protein, 24 aa, Entamoeba invadens
EEVDMKLRVKIMIDAAKGVSYLHE

SEQ ID NO: 2788918 - protein, 25 aa, Entamoeba invadens
EEVIMKLRLKMMLDASKGILYLHEN

SEQ ID NO: 2788919 - protein, 17 aa, Entamoeba invadens
EEVKCKDVPWSAPEVLQ

SEQ ID NO: 2788920 - protein, 25 aa, Entamoeba invadens
EEVMMKLRVKFMIDLGRGLIYLHGC

SEQ ID NO: 2788921 - protein, 26 aa, Entamoeba invadens
EEVNIFFCVFVSLGLHKKLVHKLMKC

SEQ ID NO: 2788922 - protein, 23 aa, Entamoeba invadens
EEVPKYTGLIPRLIIPANKTNEV

SEQ ID NO: 2788923 - protein, 20 aa, Entamoeba invadens
EEVSGLVVPYVIQTKVNGGV

SEQ ID NO: 2788924 - protein, 24 aa, Entamoeba invadens
EEVVIKIRIKMMLDAAKGICYLHT

SEQ ID NO: 2788925 - protein, 28 aa, Entamoeba invadens
EEVVLPGYMFGAAPNWAFYNNATKCGVC

SEQ ID NO: 2788926 - protein, 24 aa, Entamoeba invadens
EEWEIKHGALLVMKYVVAIIDKKN

SEQ ID NO: 2788927 - protein, 22 aa, Entamoeba invadens
EEWKSGWYILPIKDMSTTKEYL

SEQ ID NO: 2788928 - protein, 24 aa, Entamoeba invadens
EEYFMLISICSLLFAIGDTLGRLL

SEQ ID NO: 2788929 - protein, 26 aa, Entamoeba invadens
EEYIHLSEILKFEFFDSPKGEGNKKS

SEQ ID NO: 2788930 - protein, 22 aa, Entamoeba invadens
EEYKLTDILMILKRRYLLENKG

SEQ ID NO: 2788931 - protein, 28 aa, Entamoeba invadens
EEYRYAAELKIDLALMLNLYRPLMKYGE

SEQ ID NO: 2788932 - protein, 47 aa, Entamoeba invadens
EEYVGYCYLIGIAIMQVFTSFCFQLSIKWTFVLSLRLRNGLISMIYA

SEQ ID NO: 2788933 - protein, 21 aa, Entamoeba invadens
EFAKYGSLMAMFTKKKKLDYY

SEQ ID NO: 2788934 - protein, 22 aa, Entamoeba invadens
EFAPLGCLRDHFYKSVPAEMVR

SEQ ID NO: 2788935 - protein, 25 aa, Entamoeba invadens
EFCSLCSTEKCSVCNAEYLEAKEKD

SEQ ID NO: 2788936 - protein, 27 aa, Entamoeba invadens
EFCYTKEPFYLISIVSFLFRYDNIVSL

SEQ ID NO: 2788937 - protein, 24 aa, Entamoeba invadens
EFDERANLLYAFFFSGILLGAIPE

SEQ ID NO: 2788938 - protein, 19 aa, Entamoeba invadens
EFDGGTFLNDIFKMTISKR

SEQ ID NO: 2788939 - protein, 22 aa, Entamoeba invadens
EFDPYFNFRATKYLVEHGPTAF

SEQ ID NO: 2788940 - protein, 18 aa, Entamoeba invadens
EFDRIGFLRNYFKLPQST

SEQ ID NO: 2788941 - protein, 36 aa, Entamoeba invadens
EFDSNCGLCASNFSRKCLICNTGFYPNNSGKCVSCA

SEQ ID NO: 2788942 - protein, 32 aa, Entamoeba invadens
EFEFLHFNIPFGVIGLWGIYFGEAVSQNMNKD

SEQ ID NO: 2788943 - protein, 19 aa, Entamoeba invadens
EFEKEVAMLDKFRSEYIVH

SEQ ID NO: 2788944 - protein, 18 aa, Entamoeba invadens
EFELFLKPLCSCQIDDII

SEQ ID NO: 2788945 - protein, 23 aa, Entamoeba invadens
EFEQIAMDWACYADSMKDKTKLS

SEQ ID NO: 2788946 - protein, 24 aa, Entamoeba invadens
EFEQPQLLLIWDRFVAFPERQMSL

SEQ ID NO: 2788947 - protein, 19 aa, Entamoeba invadens
EFEVFLTPHCTLSLEDKIA

SEQ ID NO: 2788948 - protein, 19 aa, Entamoeba invadens
EFFNISVIVFFYIFFLLYV

SEQ ID NO: 2788949 - protein, 17 aa, Entamoeba invadens
EFGASYFRATKFRVKGK

SEQ ID NO: 2788950 - protein, 32 aa, Entamoeba invadens
EFGGIKLSPTFWWYVGGLVFCLLFCTPCLICT

SEQ ID NO: 2788951 - protein, 26 aa, Entamoeba invadens
EFGKKLPCPEIVPFRLTRELQAPLGY

SEQ ID NO: 2788952 - protein, 18 aa, Entamoeba invadens
EFIEYCIDYIKQLDNHID

SEQ ID NO: 2788953 - protein, 25 aa, Entamoeba invadens
EFIFKFRITNFEGFMLKRADLELTK

SEQ ID NO: 2788954 - protein, 18 aa, Entamoeba invadens
EFIMYRMGGRIGFMSSTH

SEQ ID NO: 2788955 - protein, 24 aa, Entamoeba invadens
EFKDSFNALCYSHLNFCGYFVQTI

SEQ ID NO: 2788956 - protein, 21 aa, Entamoeba invadens
EFKKFLPVLFSIFWFICCGYW

SEQ ID NO: 2788957 - protein, 29 aa, Entamoeba invadens
EFLGGGFILKNSWTFNSGHSLGYFMRNHS

SEQ ID NO: 2788958 - protein, 24 aa, Entamoeba invadens
EFLRIFSFIVARSIYYSVMLLYSI

SEQ ID NO: 2788959 - protein, 27 aa, Entamoeba invadens
EFLYVKVMYSRLISLYTLLEKMVDSNM

SEQ ID NO: 2788960 - protein, 17 aa, Entamoeba invadens
EFMILFEVISAYGTVGY

SEQ ID NO: 2788961 - protein, 23 aa, Entamoeba invadens
EFMKGEVYLSRVIVEQKGILIHE

SEQ ID NO: 2788962 - protein, 17 aa, Entamoeba invadens
EFNKMFFSSYSFLDYYI

SEQ ID NO: 2788963 - protein, 21 aa, Entamoeba invadens
EFRKEVAMLAKFVSPYVIRFY

SEQ ID NO: 2788964 - protein, 26 aa, Entamoeba invadens
EFSDFKFRYRRGLPMVLKGINAKIVA

SEQ ID NO: 2788965 - protein, 25 aa, Entamoeba invadens
EFSDFKFRYRRGLPMVLKGINATIL

SEQ ID NO: 2788966 - protein, 19 aa, Entamoeba invadens
EFSDLFFEIIVFMRYGQKT

SEQ ID NO: 2788967 - protein, 17 aa, Entamoeba invadens
EFSESTHILAFIVISLS

SEQ ID NO: 2788968 - protein, 19 aa, Entamoeba invadens
EFSLFLTPLCNSNMESSFV

SEQ ID NO: 2788969 - protein, 19 aa, Entamoeba invadens
EFSLFLTPLCNSTMDSSFV

SEQ ID NO: 2788970 - protein, 31 aa, Entamoeba invadens
EFTESRFVIRASNCYLELKGKTQVSADTSVT

SEQ ID NO: 2788971 - protein, 20 aa, Entamoeba invadens
EFTKEPEFCVDLFSFGKFNN

SEQ ID NO: 2788972 - protein, 19 aa, Entamoeba invadens
EFTPKGWLRVKEVLGSGVE

SEQ ID NO: 2788973 - protein, 20 aa, Entamoeba invadens
EFTQIPTLQWDDYTHKDLNV

SEQ ID NO: 2788974 - protein, 25 aa, Entamoeba invadens
EFVDFKFRYRRGLPVVLNKISAVVE

SEQ ID NO: 2788975 - protein, 18 aa, Entamoeba invadens
EFVELGYFSTVNKKRVFP

SEQ ID NO: 2788976 - protein, 20 aa, Entamoeba invadens
EFVLKCMKCNEDLSIQQSYT

SEQ ID NO: 2788977 - protein, 20 aa, Entamoeba invadens
EFVNCYPINSTYHILISCNG

SEQ ID NO: 2788978 - protein, 27 aa, Entamoeba invadens
EFWTKMSSSLCPLVLAISFFYHSFDLY

SEQ ID NO: 2788979 - protein, 24 aa, Entamoeba invadens
EGAANCTNCGRGFYSNEGATACTK

SEQ ID NO: 2788980 - protein, 17 aa, Entamoeba invadens
EGAEKWFELERGYITSV

SEQ ID NO: 2788981 - protein, 19 aa, Entamoeba invadens
EGAFGIVFKGKYRGRDVAI

SEQ ID NO: 2788982 - protein, 20 aa, Entamoeba invadens
EGAFGIVLKGFYRGNVVALK

SEQ ID NO: 2788983 - protein, 31 aa, Entamoeba invadens
EGCDLCDAQECLSCANVNHLIENKKKCVEDI

SEQ ID NO: 2788984 - protein, 21 aa, Entamoeba invadens
EGCDVCSTMLYGCSVCQDTYF

SEQ ID NO: 2788985 - protein, 17 aa, Entamoeba invadens
EGCQCLDQLADCGISEF

SEQ ID NO: 2788986 - protein, 30 aa, Entamoeba invadens
EGCYLLYPLEVVSCLGEKTVEVFSKIYLNN

SEQ ID NO: 2788987 - protein, 24 aa, Entamoeba invadens
EGDNRFTYCAVFTLKLIGKLDVIN

SEQ ID NO: 2788988 - protein, 17 aa, Entamoeba invadens
EGEECDGGDGCIECECQ

SEQ ID NO: 2788989 - protein, 23 aa, Entamoeba invadens
EGEEIYFEQVLVKNCKFDIDGKE

SEQ ID NO: 2788990 - protein, 24 aa, Entamoeba invadens
EGEFPIIGADFVKNIQFLKMAATY

SEQ ID NO: 2788991 - protein, 19 aa, Entamoeba invadens
EGEKCKKCNDGYSLDAGGV

SEQ ID NO: 2788992 - protein, 21 aa, Entamoeba invadens
EGEWKICLSEESIKYHCGQNF

SEQ ID NO: 2788993 - protein, 19 aa, Entamoeba invadens
EGFDMSSLLLFKNMKVQTG

SEQ ID NO: 2788994 - protein, 30 aa, Entamoeba invadens
EGFENLQHAFPIGVLYPFNLLVYDGKNKVD

SEQ ID NO: 2788995 - protein, 20 aa, Entamoeba invadens
EGGFGIVFLGHYRGNTVAVK

SEQ ID NO: 2788996 - protein, 20 aa, Entamoeba invadens
EGGFGIVFRGTYRGRDVAIK

SEQ ID NO: 2788997 - protein, 20 aa, Entamoeba invadens
EGGFGIVYRGKYRGNCVAIK

SEQ ID NO: 2788998 - protein, 20 aa, Entamoeba invadens
EGGFGIVYRGYFREAEVAIK

SEQ ID NO: 2788999 - protein, 23 aa, Entamoeba invadens
EGGFGVVYRGDFRGNDVAIKKMK

SEQ ID NO: 2789000 - protein, 18 aa, Entamoeba invadens
EGGFGVVYYGSFHGNEVA

SEQ ID NO: 2789001 - protein, 18 aa, Entamoeba invadens
EGGILVEGITKWFKNIPI

SEQ ID NO: 2789002 - protein, 19 aa, Entamoeba invadens
EGGKCKKCNEKYVIQPNGF

SEQ ID NO: 2789003 - protein, 32 aa, Entamoeba invadens
EGGKCKRCSVGYLYYKENWCISSNNVKCTKAN

SEQ ID NO: 2789004 - protein, 19 aa, Entamoeba invadens
EGGKWRKSMLDAINHSRYF

SEQ ID NO: 2789005 - protein, 22 aa, Entamoeba invadens
EGGNLTIIFSYANSFRIQKDFK

SEQ ID NO: 2789006 - protein, 22 aa, Entamoeba invadens
EGGNLTLCFAYANAFRIQKDFK

SEQ ID NO: 2789007 - protein, 24 aa, Entamoeba invadens
EGGYFPFKQLNVLCVMYDAANKNT

SEQ ID NO: 2789008 - protein, 23 aa, Entamoeba invadens
EGHCSLCSNGYILTNGICENCST

SEQ ID NO: 2789009 - protein, 25 aa, Entamoeba invadens
EGHDAAKKECIESLEKLKTENERLQ

SEQ ID NO: 2789010 - protein, 21 aa, Entamoeba invadens
EGIGKCVKYRNDGCGKGSLLP

SEQ ID NO: 2789011 - protein, 26 aa, Entamoeba invadens
EGIIKTPLKFGVYTLLFKYNKPLQTY

SEQ ID NO: 2789012 - protein, 19 aa, Entamoeba invadens
EGIPLTSLDCKYIVDYQLA

SEQ ID NO: 2789013 - protein, 19 aa, Entamoeba invadens
EGKCIPCSQNHCEKCDASG

SEQ ID NO: 2789014 - protein, 19 aa, Entamoeba invadens
EGKCLKCPDDCGVCESDMA

SEQ ID NO: 2789015 - protein, 20 aa, Entamoeba invadens
EGKCLSCKLGTYSSTMAATK

SEQ ID NO: 2789016 - protein, 17 aa, Entamoeba invadens
EGKENKFCFSLSRRFIM

SEQ ID NO: 2789017 - protein, 21 aa, Entamoeba invadens
EGKFKRYFALGVNSLTPCQCK

SEQ ID NO: 2789018 - protein, 18 aa, Entamoeba invadens
EGKIFGGYVPDELSICSK

SEQ ID NO: 2789019 - protein, 20 aa, Entamoeba invadens
EGKIKKFDILTSDINNMTVI

SEQ ID NO: 2789020 - protein, 21 aa, Entamoeba invadens
EGKQKEKNMMVGMLVGVSNIL

SEQ ID NO: 2789021 - protein, 22 aa, Entamoeba invadens
EGKRLIRVCTIAVPVTQIQSEC

SEQ ID NO: 2789022 - protein, 33 aa, Entamoeba invadens
EGKSFFPSFLGWELYQIVTWYIIFSIFMCLVML

SEQ ID NO: 2789023 - protein, 24 aa, Entamoeba invadens
EGKYDFCIPISLSQIADCKYSLIS

SEQ ID NO: 2789024 - protein, 20 aa, Entamoeba invadens
EGKYDFCIPISQSQIADCKY

SEQ ID NO: 2789025 - protein, 20 aa, Entamoeba invadens
EGLDCKKCDIKCGTCNGKDQ

SEQ ID NO: 2789026 - protein, 18 aa, Entamoeba invadens
EGLGEIWIDDVLLEPTGR

SEQ ID NO: 2789027 - protein, 24 aa, Entamoeba invadens
EGLKNGFFSKGYCNFHIKVDVNSI

SEQ ID NO: 2789028 - protein, 27 aa, Entamoeba invadens
EGLKTKYNCISHVWNIHLRNINNITES

SEQ ID NO: 2789029 - protein, 23 aa, Entamoeba invadens
EGLMCLSCIESTYFLKDHKCLSL

SEQ ID NO: 2789030 - protein, 18 aa, Entamoeba invadens
EGMSFRLYRDSIMPRVLD

SEQ ID NO: 2789031 - protein, 20 aa, Entamoeba invadens
EGNAFFSGLFGKRDLVLFDN

SEQ ID NO: 2789032 - protein, 18 aa, Entamoeba invadens
EGNCLSCDVTNDLNCEPN

SEQ ID NO: 2789033 - protein, 18 aa, Entamoeba invadens
EGNDRWYDALTIAFGLFI

SEQ ID NO: 2789034 - protein, 18 aa, Entamoeba invadens
EGNSQFGGILLKNLLKNV

SEQ ID NO: 2789035 - protein, 25 aa, Entamoeba invadens
EGNYCKYLASGILRIFLLIVQQKEL

SEQ ID NO: 2789036 - protein, 25 aa, Entamoeba invadens
EGNYHFCLPLSLAQIEDCKYSIISK

SEQ ID NO: 2789037 - protein, 24 aa, Entamoeba invadens
EGPFIVRSGTWLSVSARNSTNVTI

SEQ ID NO: 2789038 - protein, 23 aa, Entamoeba invadens
EGPPLPVELLIAPGGVTKYQMEL

SEQ ID NO: 2789039 - protein, 26 aa, Entamoeba invadens
EGPRFKPGWNHFILIISIPLYVYMFI

SEQ ID NO: 2789040 - protein, 19 aa, Entamoeba invadens
EGQFIMKTMCGLYNVGTQR

SEQ ID NO: 2789041 - protein, 23 aa, Entamoeba invadens
EGQSECYECPAGSYQNMTGQISC

SEQ ID NO: 2789042 - protein, 21 aa, Entamoeba invadens
EGQTTCKLCDSSCARCNATNG

SEQ ID NO: 2789043 - protein, 20 aa, Entamoeba invadens
EGQTTCKLCDSSCASCNATD

SEQ ID NO: 2789044 - protein, 20 aa, Entamoeba invadens
EGRCKPCGDVVIGCKTSTKN

SEQ ID NO: 2789045 - protein, 21 aa, Entamoeba invadens
EGSFGIVFKGLFRGYEVAIKK

SEQ ID NO: 2789046 - protein, 21 aa, Entamoeba invadens
EGSFGIVFKGQYRGVCVAIKK

SEQ ID NO: 2789047 - protein, 20 aa, Entamoeba invadens
EGSFGIVFKGTFRENNVAIK

SEQ ID NO: 2789048 - protein, 19 aa, Entamoeba invadens
EGSFGIVFKGTFRGKTVAI

SEQ ID NO: 2789049 - protein, 21 aa, Entamoeba invadens
EGSFGIVFKGTFRGNCVAIKR

SEQ ID NO: 2789050 - protein, 20 aa, Entamoeba invadens
EGSFGIVFKGTFRGNIVAIK

SEQ ID NO: 2789051 - protein, 20 aa, Entamoeba invadens
EGSFGIVFKGTFRGYEVAIK

SEQ ID NO: 2789052 - protein, 20 aa, Entamoeba invadens
EGSFGIVYKGFFRGNIVAIK

SEQ ID NO: 2789053 - protein, 23 aa, Entamoeba invadens
EGSFGIVYKGIFRGHVVAIKKMK

SEQ ID NO: 2789054 - protein, 20 aa, Entamoeba invadens
EGSFGIVYKGIFRGNVVCIK

SEQ ID NO: 2789055 - protein, 20 aa, Entamoeba invadens
EGSFGIVYYGHFRGHEVAIK

SEQ ID NO: 2789056 - protein, 19 aa, Entamoeba invadens
EGSFGKVFKGVFRGNEVAV

SEQ ID NO: 2789057 - protein, 25 aa, Entamoeba invadens
EGSFGVIFKGDFRGNVVAIKKMKQL

SEQ ID NO: 2789058 - protein, 24 aa, Entamoeba invadens
EGSFGVVFKGIFRGNIVAIKKMKN

SEQ ID NO: 2789059 - protein, 21 aa, Entamoeba invadens
EGSFGVVFKGKFGGNTVAIKK

SEQ ID NO: 2789060 - protein, 22 aa, Entamoeba invadens
EGSFGVVFKGKFRENVVAIKKM

SEQ ID NO: 2789061 - protein, 20 aa, Entamoeba invadens
EGSFGVVFKGMYRGSEVAIK

SEQ ID NO: 2789062 - protein, 24 aa, Entamoeba invadens
EGSFGVVFKGSFRGNVVAIKKMKT

SEQ ID NO: 2789063 - protein, 20 aa, Entamoeba invadens
EGSFGVVFKGTFRDNNVAIK

SEQ ID NO: 2789064 - protein, 23 aa, Entamoeba invadens
EGSFGVVFKGVFRGKTVAIKKMK

SEQ ID NO: 2789065 - protein, 24 aa, Entamoeba invadens
EGSFGVVFKGVFRGNSVAIKKLKL

SEQ ID NO: 2789066 - protein, 20 aa, Entamoeba invadens
EGSFGVVFKGVYKGQSVAVK

SEQ ID NO: 2789067 - protein, 26 aa, Entamoeba invadens
EGSFGVVFRGSFRGNKVAIKKLKMCD

SEQ ID NO: 2789068 - protein, 22 aa, Entamoeba invadens
EGSFGVVFRGTFRNNQVAIKLL

SEQ ID NO: 2789069 - protein, 24 aa, Entamoeba invadens
EGSFGVVYKGEFRGNVVAIKKMKE

SEQ ID NO: 2789070 - protein, 23 aa, Entamoeba invadens
EGSFGVVYKGEFRRNVVAIKKVK

SEQ ID NO: 2789071 - protein, 23 aa, Entamoeba invadens
EGSFGVVYRGIYRTNTVAIKKMI

SEQ ID NO: 2789072 - protein, 28 aa, Entamoeba invadens
EGSGRKGLPQSFINRFTSVYVNKMTESD

SEQ ID NO: 2789073 - protein, 21 aa, Entamoeba invadens
EGSLLCSFKTTEKCDKMYYVK

SEQ ID NO: 2789074 - protein, 17 aa, Entamoeba invadens
EGSRLIYHYGKIQSDTN

SEQ ID NO: 2789075 - protein, 22 aa, Entamoeba invadens
EGSSKCAICKDSFFRNDKGKCE

SEQ ID NO: 2789076 - protein, 24 aa, Entamoeba invadens
EGSTFVCSTFDYKGNDSGMLLESI

SEQ ID NO: 2789077 - protein, 23 aa, Entamoeba invadens
EGTEAFIKFIHVVAFAVKCVERL

SEQ ID NO: 2789078 - protein, 19 aa, Entamoeba invadens
EGTFGVVFIGDFRGNKVAI

SEQ ID NO: 2789079 - protein, 19 aa, Entamoeba invadens
EGTFGVVFLGDYRGNKVAI

SEQ ID NO: 2789080 - protein, 27 aa, Entamoeba invadens
EGTGCKTHVVWWVLFIVIVIFLIFILL

SEQ ID NO: 2789081 - protein, 24 aa, Entamoeba invadens
EGTKETQCTYGFWFCTKRTIHCRD

SEQ ID NO: 2789082 - protein, 25 aa, Entamoeba invadens
EGTYGTVYRAEWRKVDVAVKVMKTD

SEQ ID NO: 2789083 - protein, 19 aa, Entamoeba invadens
EGVDAVYLTGGLGYTPIIS

SEQ ID NO: 2789084 - protein, 34 aa, Entamoeba invadens
EGVICGGCLYIVGFIFKFRESRLYKTKENIKWFL

SEQ ID NO: 2789085 - protein, 23 aa, Entamoeba invadens
EGVTFKLSPGYHKMINKTLTITL

SEQ ID NO: 2789086 - protein, 19 aa, Entamoeba invadens
EGVTNCMDVVYSPNANIVA

SEQ ID NO: 2789087 - protein, 19 aa, Entamoeba invadens
EGWMYQIIQGCWDDDPTKR

SEQ ID NO: 2789088 - protein, 23 aa, Entamoeba invadens
EGYKEWFYKMIGLKTCYITSTHV

SEQ ID NO: 2789089 - protein, 18 aa, Entamoeba invadens
EGYSLRGGVCHVLKNIDK

SEQ ID NO: 2789090 - protein, 25 aa, Entamoeba invadens
EGYVLKSNVCYSCGEIFGPCKKCTL

SEQ ID NO: 2789091 - protein, 27 aa, Entamoeba invadens
EHADILFFQGLLDWVAVIILPFLFEHV

SEQ ID NO: 2789092 - protein, 25 aa, Entamoeba invadens
EHGECLSCKNAYYLSEGMCEKTINE

SEQ ID NO: 2789093 - protein, 25 aa, Entamoeba invadens
EHIQLCPKDSFYLFLEEKKKELRNS

SEQ ID NO: 2789094 - protein, 19 aa, Entamoeba invadens
EHLEEVYTSVHWMVRIYKV

SEQ ID NO: 2789095 - protein, 21 aa, Entamoeba invadens
EHLLGKLLVISRWLGRNPVLH

SEQ ID NO: 2789096 - protein, 26 aa, Entamoeba invadens
EHLLWFPFNLLLSFFDLLIISIEIAL

SEQ ID NO: 2789097 - protein, 19 aa, Entamoeba invadens
EHPCLSFSQLITLPEDLNV

SEQ ID NO: 2789098 - protein, 28 aa, Entamoeba invadens
EHPKLAMAIPEFLGYSALSLDTVKVIVR

SEQ ID NO: 2789099 - protein, 20 aa, Entamoeba invadens
EHQFQCAVMFIALSSLAHLT

SEQ ID NO: 2789100 - protein, 18 aa, Entamoeba invadens
EHQIELWDKFITDLSQIQ

SEQ ID NO: 2789101 - protein, 17 aa, Entamoeba invadens
EHSFKLAISEFIGSTLL

SEQ ID NO: 2789102 - protein, 24 aa, Entamoeba invadens
EHSKCTTCGFWHVPDELGKMCVYK

SEQ ID NO: 2789103 - protein, 19 aa, Entamoeba invadens
EHSRVYVLGTIQSFKSVFI

SEQ ID NO: 2789104 - protein, 18 aa, Entamoeba invadens
EHTARLDAKLSYENHKYC

SEQ ID NO: 2789105 - protein, 19 aa, Entamoeba invadens
EHTPLRFFIDRTLKHKIDM

SEQ ID NO: 2789106 - protein, 18 aa, Entamoeba invadens
EHVASGFSQVLVEDSMFG

SEQ ID NO: 2789107 - protein, 17 aa, Entamoeba invadens
EHVRVCAIPKSFSTLNF

SEQ ID NO: 2789108 - protein, 28 aa, Entamoeba invadens
EHYLIALVICFFARFTITSLSVSLPVPV

SEQ ID NO: 2789109 - protein, 20 aa, Entamoeba invadens
EIALSALFVRTKLSSSYVVF

SEQ ID NO: 2789110 - protein, 24 aa, Entamoeba invadens
EIASPNLFNLISIPQVFKIGDQVR

SEQ ID NO: 2789111 - protein, 26 aa, Entamoeba invadens
EIAYGCFLCGIIPLFVSPRTPKEDIK

SEQ ID NO: 2789112 - protein, 19 aa, Entamoeba invadens
EICSCVWYVASYIPYAQTC

SEQ ID NO: 2789113 - protein, 31 aa, Entamoeba invadens
EICSSSTQLALWKNYLMFFPGNLEVDMSNVD

SEQ ID NO: 2789114 - protein, 18 aa, Entamoeba invadens
EICVKKCLIESAQNNIKK

SEQ ID NO: 2789115 - protein, 23 aa, Entamoeba invadens
EICVLCNNLLFGENCEKGVNNCL

SEQ ID NO: 2789116 - protein, 23 aa, Entamoeba invadens
EICYKGKVYSTSWMYSETFDETS

SEQ ID NO: 2789117 - protein, 17 aa, Entamoeba invadens
EIDDLYDAYGFVRREEC

SEQ ID NO: 2789118 - protein, 19 aa, Entamoeba invadens
EIDIKLRVKYMIDAAKGIS

SEQ ID NO: 2789119 - protein, 19 aa, Entamoeba invadens
EIDMKIRVKMMLDASRGIM

SEQ ID NO: 2789120 - protein, 23 aa, Entamoeba invadens
EIDMKLRIKFLLDAAKGIQYLHE

SEQ ID NO: 2789121 - protein, 23 aa, Entamoeba invadens
EIDMKLRIKFMLDTSQGILYLHS

SEQ ID NO: 2789122 - protein, 28 aa, Entamoeba invadens
EIDMKLRLKFMLDVAMGIMYLHENGILH

SEQ ID NO: 2789123 - protein, 24 aa, Entamoeba invadens
EIDMKLRVKFIIDAARGIQYLHSN

SEQ ID NO: 2789124 - protein, 20 aa, Entamoeba invadens
EIDMKLRVKYMIDAAKGISY

SEQ ID NO: 2789125 - protein, 23 aa, Entamoeba invadens
EIDSEHPADCTISAEELMALLEG

SEQ ID NO: 2789126 - protein, 25 aa, Entamoeba invadens
EIDSFLTQRTIILNTVFSDFSLKNV

SEQ ID NO: 2789127 - protein, 18 aa, Entamoeba invadens
EIEEMKKQLGKKIEEGNL

SEQ ID NO: 2789128 - protein, 20 aa, Entamoeba invadens
EIEFKITLLCTAMVKDDVGI

SEQ ID NO: 2789129 - protein, 25 aa, Entamoeba invadens
EIEKRDVCVFKMNKSNLIFHSITKE

SEQ ID NO: 2789130 - protein, 24 aa, Entamoeba invadens
EIEMKLKIKIMLDASKGIQYLHEN

SEQ ID NO: 2789131 - protein, 23 aa, Entamoeba invadens
EIEMKLRIKFLLDAAKGIQYLHE

SEQ ID NO: 2789132 - protein, 30 aa, Entamoeba invadens
EIEMKLRIKMCLDCAQGILYLHENGILHRD

SEQ ID NO: 2789133 - protein, 23 aa, Entamoeba invadens
EIEMKLRVKFMLDGAKGILYLHE

SEQ ID NO: 2789134 - protein, 22 aa, Entamoeba invadens
EIEMKLRVKLLIDASKGILYLH

SEQ ID NO: 2789135 - protein, 36 aa, Entamoeba invadens
  misc_feature (28)..(29): Xaa can be any naturally occurring amino acid
EIFATVCFGLGIALYFDWKLALCVIAKXXMAINSAA

SEQ ID NO: 2789136 - protein, 19 aa, Entamoeba invadens
EIFGIVFGSIIGFIVVILI

SEQ ID NO: 2789137 - protein, 25 aa, Entamoeba invadens
EIFGKELSCVIMGGSPLSSDLQKYL

SEQ ID NO: 2789138 - protein, 21 aa, Entamoeba invadens
EIGCACFYGSVNVLTFVSPKI

SEQ ID NO: 2789139 - protein, 24 aa, Entamoeba invadens
EIGCIRCVDGLFLDNNNICQNCDT

SEQ ID NO: 2789140 - protein, 19 aa, Entamoeba invadens
EIGKLWKERTVLLNQIREE

SEQ ID NO: 2789141 - protein, 21 aa, Entamoeba invadens
EIGKVKLCKTIPGGFVAILEN

SEQ ID NO: 2789142 - protein, 20 aa, Entamoeba invadens
EIGQRIRLYGTFTLVAIFIL

SEQ ID NO: 2789143 - protein, 21 aa, Entamoeba invadens
EIHSLCSNEYVILNMDSSDIS

SEQ ID NO: 2789144 - protein, 18 aa, Entamoeba invadens
EIHYVFSVIQHVRCYLLS

SEQ ID NO: 2789145 - protein, 24 aa, Entamoeba invadens
EIIELKRLGLLWQKAPQKKIRLLL

SEQ ID NO: 2789146 - protein, 24 aa, Entamoeba invadens
EIIENGMCVRCQAELNTRYFNGAK

SEQ ID NO: 2789147 - protein, 23 aa, Entamoeba invadens
EIIIFNSIHGIEFILGCISNTAS

SEQ ID NO: 2789148 - protein, 21 aa, Entamoeba invadens
EIIIFNSIHGIEFVLGCISNT

SEQ ID NO: 2789149 - protein, 33 aa, Entamoeba invadens
EIIKRIRYSLLTIFLCYFVSFMLFPRFLSTTYR

SEQ ID NO: 2789150 - protein, 24 aa, Entamoeba invadens
EIINSKCTKCLFLNSPNKDGVYCE

SEQ ID NO: 2789151 - protein, 19 aa, Entamoeba invadens
EIIQTVALCAQKLYDFTQH

SEQ ID NO: 2789152 - protein, 18 aa, Entamoeba invadens
EIISVFFTTIPVYLVMLF

SEQ ID NO: 2789153 - protein, 25 aa, Entamoeba invadens
EIIVEWTKHWFFNILEFDTAIRVFD

SEQ ID NO: 2789154 - protein, 20 aa, Entamoeba invadens
EIKASAFFDIHLILEKADVE

SEQ ID NO: 2789155 - protein, 18 aa, Entamoeba invadens
EIKGCTTLVNSYCEKCDF

SEQ ID NO: 2789156 - protein, 23 aa, Entamoeba invadens
EIKMQLRIKFLLDASRGIQYLHE

SEQ ID NO: 2789157 - protein, 24 aa, Entamoeba invadens
EIKSLRSSEVINIFTKNVSESSLS

SEQ ID NO: 2789158 - protein, 23 aa, Entamoeba invadens
EIKSVCTKGNFSRMKLVSKEGTG

SEQ ID NO: 2789159 - protein, 19 aa, Entamoeba invadens
EILEHFPDITLTFYQDMEF

SEQ ID NO: 2789160 - protein, 24 aa, Entamoeba invadens
EILKRIDEQVAFHIWIREFKKFLT

SEQ ID NO: 2789161 - protein, 18 aa, Entamoeba invadens
EILNFHGKNLITHFIIGS

SEQ ID NO: 2789162 - protein, 34 aa, Entamoeba invadens
EILYPFFKHILSYLVPNYCKAIFLDTYKQKTGFI

SEQ ID NO: 2789163 - protein, 17 aa, Entamoeba invadens
EINDFTCLFSLTKNSSF

SEQ ID NO: 2789164 - protein, 26 aa, Entamoeba invadens
EINDNFCLLQWSLGCIRCITNMTEPY

SEQ ID NO: 2789165 - protein, 22 aa, Entamoeba invadens
EINIKLRVKYMIDAAKGVSYLH

SEQ ID NO: 2789166 - protein, 24 aa, Entamoeba invadens
EINKEVVGLLLFKEKWFEKLEREN

SEQ ID NO: 2789167 - protein, 18 aa, Entamoeba invadens
EINMKLRVKMILDASKGI

SEQ ID NO: 2789168 - protein, 24 aa, Entamoeba invadens
EIPHLLKLKFLLDASKGIFYLHEN

SEQ ID NO: 2789169 - protein, 23 aa, Entamoeba invadens
EIPRELCEQYLLFSQDEINMRKR

SEQ ID NO: 2789170 - protein, 37 aa, Entamoeba invadens
  misc_feature (31)..(32): Xaa can be any naturally occurring amino acid
EIPVNASCDIWALGCLFYELFTSKMLFWIAXXRRIAQ

SEQ ID NO: 2789171 - protein, 25 aa, Entamoeba invadens
EIRMRRWQDTFGNFTIYCGLVEEQL

SEQ ID NO: 2789172 - protein, 22 aa, Entamoeba invadens
EIRSRGNGIVFLDSITNADFFI

SEQ ID NO: 2789173 - protein, 22 aa, Entamoeba invadens
EISDMFLRYAPDVHLMLKVMWV

SEQ ID NO: 2789174 - protein, 26 aa, Entamoeba invadens
EISELKELWILPVFCIAHMILEFFGS

SEQ ID NO: 2789175 - protein, 26 aa, Entamoeba invadens
EISIVCALVVYPLYIVVTVSYNRCVF

SEQ ID NO: 2789176 - protein, 24 aa, Entamoeba invadens
EISLKMKVKIIWDGARGIKYLHEN

SEQ ID NO: 2789177 - protein, 25 aa, Entamoeba invadens
EISLWKLAVSNVRKNILIGTIPVFP

SEQ ID NO: 2789178 - protein, 18 aa, Entamoeba invadens
EISTCKAFSSCGCVVCSE

SEQ ID NO: 2789179 - protein, 17 aa, Entamoeba invadens
EISTCKTFSSGGCVVYC

SEQ ID NO: 2789180 - protein, 18 aa, Entamoeba invadens
EISTCNAFSSSGCVVCSE

SEQ ID NO: 2789181 - protein, 23 aa, Entamoeba invadens
EITETYFGEWFAKYENVIHNFED

SEQ ID NO: 2789182 - protein, 25 aa, Entamoeba invadens
EITFNTRGTFSWDKYQTVTGKITHE

SEQ ID NO: 2789183 - protein, 25 aa, Entamoeba invadens
EITHSKCSKCLFWYSPNKDGTMCRS

SEQ ID NO: 2789184 - protein, 27 aa, Entamoeba invadens
EITHSKCSKCSFWYSPIEDGTLCESRA

SEQ ID NO: 2789185 - protein, 25 aa, Entamoeba invadens
EITHSKCSKCSFWYTPSGDGTLCES

SEQ ID NO: 2789186 - protein, 19 aa, Entamoeba invadens
EITLICILLIYPLSFSRTL

SEQ ID NO: 2789187 - protein, 23 aa, Entamoeba invadens
EITMKLRVKLAIDSAKGILYLHL

SEQ ID NO: 2789188 - protein, 20 aa, Entamoeba invadens
EIVFLYFTGFFRAMFFTFTI

SEQ ID NO: 2789189 - protein, 24 aa, Entamoeba invadens
EIVKRGINYRGRFCSESEIYIDPT

SEQ ID NO: 2789190 - protein, 20 aa, Entamoeba invadens
EIVRECLEVYHLIFNSLVNQ

SEQ ID NO: 2789191 - protein, 22 aa, Entamoeba invadens
EIVRRKNEVFNFLDESKRSADN

SEQ ID NO: 2789192 - protein, 20 aa, Entamoeba invadens
EIVSKIVVISSMIDVLVGQV

SEQ ID NO: 2789193 - protein, 18 aa, Entamoeba invadens
EIVSMCWKHNPAERYTIE

SEQ ID NO: 2789194 - protein, 20 aa, Entamoeba invadens
EIVSVCLEEKGMMVFTEKNT

SEQ ID NO: 2789195 - protein, 27 aa, Entamoeba invadens
EIWAYRSLSAFLGYLAFAFFITIFCVL

SEQ ID NO: 2789196 - protein, 24 aa, Entamoeba invadens
EIWGTKCVNGIYSLDNCVFVECNS

SEQ ID NO: 2789197 - protein, 20 aa, Entamoeba invadens
EIYARIPIKLESVVSPYIDY

SEQ ID NO: 2789198 - protein, 29 aa, Entamoeba invadens
EIYPSSMFKHAWSIADFVSEGKRRQCLEN

SEQ ID NO: 2789199 - protein, 35 aa, Entamoeba invadens
EIYQFLVKWYAKNGQLFWVYQIIRMMCSIISSTFL

SEQ ID NO: 2789200 - protein, 26 aa, Entamoeba invadens
EIYQIASKCWRQDMNQRVEIGEVVKL

SEQ ID NO: 2789201 - protein, 28 aa, Entamoeba invadens
EIYTKSMFKYPWKIAEFVCSGKRVENSN

SEQ ID NO: 2789202 - protein, 25 aa, Entamoeba invadens
EKAICFDYPKSCVIYNTSDLLNEQI

SEQ ID NO: 2789203 - protein, 17 aa, Entamoeba invadens
EKAKGFIPLITRAVMGI

SEQ ID NO: 2789204 - protein, 28 aa, Entamoeba invadens
EKANGVSCIKCLPSFYREKTVYCTSATN

SEQ ID NO: 2789205 - protein, 24 aa, Entamoeba invadens
EKAVSWQECILCERGYVLNAGSCV

SEQ ID NO: 2789206 - protein, 21 aa, Entamoeba invadens
EKCAVCKDGFVVKNADCIKCA

SEQ ID NO: 2789207 - protein, 18 aa, Entamoeba invadens
EKCAVCRDGFVVKNADCI

SEQ ID NO: 2789208 - protein, 21 aa, Entamoeba invadens
EKCFCGCEALVLHKLPKLKTI

SEQ ID NO: 2789209 - protein, 18 aa, Entamoeba invadens
EKCFKPQTWEVLKMARRS

SEQ ID NO: 2789210 - protein, 19 aa, Entamoeba invadens
EKCGICEDGYFALNGECNL

SEQ ID NO: 2789211 - protein, 18 aa, Entamoeba invadens
EKCIPINKVSKCLEITNS

SEQ ID NO: 2789212 - protein, 18 aa, Entamoeba invadens
EKCISCKYGEVKVTSNMC

SEQ ID NO: 2789213 - protein, 19 aa, Entamoeba invadens
EKCITCKNKYFLDQNTNNC

SEQ ID NO: 2789214 - protein, 22 aa, Entamoeba invadens
EKCIVNGFLYLKGSLQCDLLIC

SEQ ID NO: 2789215 - protein, 30 aa, Entamoeba invadens
EKCKATNGINCLKCLAGELTNNCDLCSVFN

SEQ ID NO: 2789216 - protein, 19 aa, Entamoeba invadens
EKCNYDGCDICEPNYLIVP

SEQ ID NO: 2789217 - protein, 24 aa, Entamoeba invadens
EKCPEHCLSCYFDFLLNDISCTYC

SEQ ID NO: 2789218 - protein, 20 aa, Entamoeba invadens
EKCPVCTISDKYTREDEAKQ

SEQ ID NO: 2789219 - protein, 27 aa, Entamoeba invadens
EKCQSCISGTYLYNGKCVTFFELEGIC

SEQ ID NO: 2789220 - protein, 18 aa, Entamoeba invadens
EKCRRCKPNTILTNEGVC

SEQ ID NO: 2789221 - protein, 19 aa, Entamoeba invadens
EKCSLKYDNSVYCENGKPT

SEQ ID NO: 2789222 - protein, 17 aa, Entamoeba invadens
EKCTIDGCETCETVGNA

SEQ ID NO: 2789223 - protein, 17 aa, Entamoeba invadens
EKCTINGCETCQTVGNA

SEQ ID NO: 2789224 - protein, 22 aa, Entamoeba invadens
EKCTLIPKCVLCTLYGECRECI

SEQ ID NO: 2789225 - protein, 18 aa, Entamoeba invadens
EKCTSCFENMVLYENGLC

SEQ ID NO: 2789226 - protein, 23 aa, Entamoeba invadens
EKDDEVFCIVGIKQIEKCNEQIK

SEQ ID NO: 2789227 - protein, 19 aa, Entamoeba invadens
EKDEFLTRIEAIKKTARSL

SEQ ID NO: 2789228 - protein, 27 aa, Entamoeba invadens
EKDGLALFGAVLGKIYCNGFIAMSVII

SEQ ID NO: 2789229 - protein, 37 aa, Entamoeba invadens
EKDKEKLLECWRYSGVTKTACGFYRSAVTDYNTALGM

SEQ ID NO: 2789230 - protein, 21 aa, Entamoeba invadens
EKDLIFGGFILFTSPLKKESK

SEQ ID NO: 2789231 - protein, 23 aa, Entamoeba invadens
EKDRCISCITGYFLSNYQCEICS

SEQ ID NO: 2789232 - protein, 32 aa, Entamoeba invadens
EKEELSETGVWEYKERLCLTKNVNWLDVKKLM

SEQ ID NO: 2789233 - protein, 23 aa, Entamoeba invadens
EKEFFKKVLLDRKFIPVSLFDHM

SEQ ID NO: 2789234 - protein, 21 aa, Entamoeba invadens
EKEKAHYRRVFHEMTETERIH

SEQ ID NO: 2789235 - protein, 17 aa, Entamoeba invadens
EKEVALLDKFRCKYIVH

SEQ ID NO: 2789236 - protein, 22 aa, Entamoeba invadens
EKEVKASYLLPGDVVLLKQGQR

SEQ ID NO: 2789237 - protein, 17 aa, Entamoeba invadens
EKEVSMLDKFRCEYIVH

SEQ ID NO: 2789238 - protein, 20 aa, Entamoeba invadens
EKFIRLTTYNRYSYRTYVKF

SEQ ID NO: 2789239 - protein, 25 aa, Entamoeba invadens
EKFKGCLRCGDGYYISNSVCVRCEY

SEQ ID NO: 2789240 - protein, 29 aa, Entamoeba invadens
EKFRIYFTRFCQLLAFYGPKVAPKMSFIK

SEQ ID NO: 2789241 - protein, 17 aa, Entamoeba invadens
EKFWLKLINSVSVVCCR

SEQ ID NO: 2789242 - protein, 17 aa, Entamoeba invadens
EKGCNRCAKGMYHEKTT

SEQ ID NO: 2789243 - protein, 19 aa, Entamoeba invadens
EKGGLSVCQPRVCSDTVDN

SEQ ID NO: 2789244 - protein, 19 aa, Entamoeba invadens
EKGIEFLEKLGFDPILVER

SEQ ID NO: 2789245 - protein, 24 aa, Entamoeba invadens
EKGKKIYAVLFVYRAADAKQNTMR

SEQ ID NO: 2789246 - protein, 29 aa, Entamoeba invadens
EKGRVSWRVYYKYLKYGGIIFFLLAMIPF

SEQ ID NO: 2789247 - protein, 19 aa, Entamoeba invadens
EKGSVSIRKLYRYINWFDG

SEQ ID NO: 2789248 - protein, 18 aa, Entamoeba invadens
EKHCASCTQDGYCVGSCD

SEQ ID NO: 2789249 - protein, 22 aa, Entamoeba invadens
EKHFLVFPALFTLVVFFLSALP

SEQ ID NO: 2789250 - protein, 20 aa, Entamoeba invadens
EKIDEGLLFKNEKDEELKIK

SEQ ID NO: 2789251 - protein, 24 aa, Entamoeba invadens
EKIELKKRYVFQLFIGNKSLNIAS

SEQ ID NO: 2789252 - protein, 23 aa, Entamoeba invadens
EKIEMKLRIKLMLDTLNGIIYLH

SEQ ID NO: 2789253 - protein, 24 aa, Entamoeba invadens
EKIETKLLWFLSLMNSLLGRGVSS

SEQ ID NO: 2789254 - protein, 26 aa, Entamoeba invadens
EKIIRAMYSFTFFWYNFMPLTRGTAA

SEQ ID NO: 2789255 - protein, 22 aa, Entamoeba invadens
EKIKKFRAWELVHLYFTGFFRA

SEQ ID NO: 2789256 - protein, 26 aa, Entamoeba invadens
EKIVLLRRKRLVILKSIEQLAKSLDS

SEQ ID NO: 2789257 - protein, 24 aa, Entamoeba invadens
EKKAIRYPYRYGMNQECLSQLFSL

SEQ ID NO: 2789258 - protein, 21 aa, Entamoeba invadens
EKKIIEPLKFIGIPLNNLERW

SEQ ID NO: 2789259 - protein, 21 aa, Entamoeba invadens
EKKNMFNFVVKFVRKNEARVK

SEQ ID NO: 2789260 - protein, 17 aa, Entamoeba invadens
EKKPLCWEQSTIDMTCT

SEQ ID NO: 2789261 - protein, 24 aa, Entamoeba invadens
EKKVSLPFFKAFLSGIGCNAIVCL

SEQ ID NO: 2789262 - protein, 26 aa, Entamoeba invadens
EKKYKGCGFITVGGFLFLRFITPILV

SEQ ID NO: 2789263 - protein, 20 aa, Entamoeba invadens
EKLCRAKLCGNGRIDKLYDS

SEQ ID NO: 2789264 - protein, 19 aa, Entamoeba invadens
EKLEIYKKSYLNFYDVENL

SEQ ID NO: 2789265 - protein, 17 aa, Entamoeba invadens
EKLKVCTYKMSRSNIKM

SEQ ID NO: 2789266 - protein, 24 aa, Entamoeba invadens
EKLLFKIAPDFLVYEPSKISTGVA

SEQ ID NO: 2789267 - protein, 25 aa, Entamoeba invadens
EKLLQIRHGFTIYGNSSIKYSSSQS

SEQ ID NO: 2789268 - protein, 21 aa, Entamoeba invadens
EKLQLERSLLLLSQEKERIAQ

SEQ ID NO: 2789269 - protein, 20 aa, Entamoeba invadens
EKLQNICVFQMKRSNITMTP

SEQ ID NO: 2789270 - protein, 19 aa, Entamoeba invadens
EKLRIKLMIDSAKGLSYLH

SEQ ID NO: 2789271 - protein, 21 aa, Entamoeba invadens
EKLSLAARVIAGISIENPSDV

SEQ ID NO: 2789272 - protein, 22 aa, Entamoeba invadens
EKLYENIQMCWAQEKANRASID

SEQ ID NO: 2789273 - protein, 17 aa, Entamoeba invadens
EKMCLSCSENYYQSNSH

SEQ ID NO: 2789274 - protein, 23 aa, Entamoeba invadens
EKMDFCVLPIALLILLYVVQSPV

SEQ ID NO: 2789275 - protein, 22 aa, Entamoeba invadens
EKMKCTKCIYGYYPDTNKNCVL

SEQ ID NO: 2789276 - protein, 24 aa, Entamoeba invadens
EKMKMKNICVFKMKRSNIDMDNIN

SEQ ID NO: 2789277 - protein, 28 aa, Entamoeba invadens
EKMKRNFGRPVGFYELYKRLIVSDKRDP

SEQ ID NO: 2789278 - protein, 38 aa, Entamoeba invadens
EKMLRRIRNYMVISLLFPPFLFFGAFILLRSPKTELLK

SEQ ID NO: 2789279 - protein, 24 aa, Entamoeba invadens
EKMMKEFIKEVSMLDKFRNEYIVH

SEQ ID NO: 2789280 - protein, 22 aa, Entamoeba invadens
EKMRCFLVAASFDLFNGNNKHC

SEQ ID NO: 2789281 - protein, 22 aa, Entamoeba invadens
EKMRLLTPMKIEIEGIVKKGVF

SEQ ID NO: 2789282 - protein, 20 aa, Entamoeba invadens
EKMTERWMGFDVKNTTNEII

SEQ ID NO: 2789283 - protein, 24 aa, Entamoeba invadens
EKNGECLLCDNGFYLYISKCYSCD

SEQ ID NO: 2789284 - protein, 20 aa, Entamoeba invadens
EKNGECYTCDDHFYATHFGC

SEQ ID NO: 2789285 - protein, 18 aa, Entamoeba invadens
EKNIDWFINHKKDFKKLA

SEQ ID NO: 2789286 - protein, 34 aa, Entamoeba invadens
EKNQGKCLVLSKTCNFLSLVTTVLFILFTSLSIW

SEQ ID NO: 2789287 - protein, 19 aa, Entamoeba invadens
EKNVRIAIHPNVEVLRGFL

SEQ ID NO: 2789288 - protein, 20 aa, Entamoeba invadens
EKPAIFAKKSIKGDTFQYPE

SEQ ID NO: 2789289 - protein, 18 aa, Entamoeba invadens
EKPHKAIMFFRQFFPERF

SEQ ID NO: 2789290 - protein, 18 aa, Entamoeba invadens
EKPQFVVITGDLTDSPNV

SEQ ID NO: 2789291 - protein, 18 aa, Entamoeba invadens
EKPWSWKAFLKSWKSHYF

SEQ ID NO: 2789292 - protein, 21 aa, Entamoeba invadens
EKQDFGRFLTLVLKACEMAAS

SEQ ID NO: 2789293 - protein, 23 aa, Entamoeba invadens
EKQFKFPWKIAEFVTNGKRLEKT

SEQ ID NO: 2789294 - protein, 24 aa, Entamoeba invadens
EKQFKFPWKIAEFVTTGKRLEKTN

SEQ ID NO: 2789295 - protein, 24 aa, Entamoeba invadens
EKQFKYAWDIADFISAGKQLQKHE

SEQ ID NO: 2789296 - protein, 22 aa, Entamoeba invadens
EKRATNLVFLMFGLGFLLLFPW

SEQ ID NO: 2789297 - protein, 17 aa, Entamoeba invadens
EKRGWYLQFVVSIVALI

SEQ ID NO: 2789298 - protein, 23 aa, Entamoeba invadens
EKRLLRYGKSTNIFCHINNTVLT

SEQ ID NO: 2789299 - protein, 22 aa, Entamoeba invadens
EKRSFKAYVMILCYLTRTKMPR

SEQ ID NO: 2789300 - protein, 21 aa, Entamoeba invadens
EKRSVTFPKFSVESSVNMVQQ

SEQ ID NO: 2789301 - protein, 30 aa, Entamoeba invadens
EKRTCKSLGLYERRCDYVNDIYVFEGSTDY

SEQ ID NO: 2789302 - protein, 18 aa, Entamoeba invadens
EKRTCLVTHEDLTRRFLK

SEQ ID NO: 2789303 - protein, 22 aa, Entamoeba invadens
EKSERCTVSIFFDGRRIGSAEG

SEQ ID NO: 2789304 - protein, 25 aa, Entamoeba invadens
EKSGSCTLCSAGYYSVRAASVCLEC

SEQ ID NO: 2789305 - protein, 17 aa, Entamoeba invadens
EKSICVFDMKKSNVLFK

SEQ ID NO: 2789306 - protein, 22 aa, Entamoeba invadens
EKSKETKAFYIVTFEADEAEKF

SEQ ID NO: 2789307 - protein, 19 aa, Entamoeba invadens
EKSKWLVVGSVIVILLGVM

SEQ ID NO: 2789308 - protein, 25 aa, Entamoeba invadens
EKSQFKFPWIIAEYVSNGLRLNRPE

SEQ ID NO: 2789309 - protein, 22 aa, Entamoeba invadens
EKTGNLILDMLAPGSVSRETIS

SEQ ID NO: 2789310 - protein, 17 aa, Entamoeba invadens
EKTHKFRNGRIVSKSTC

SEQ ID NO: 2789311 - protein, 19 aa, Entamoeba invadens
EKTKPIGVLAPFQSFGKKL

SEQ ID NO: 2789312 - protein, 18 aa, Entamoeba invadens
EKTLVAWMNYLYRITFWV

SEQ ID NO: 2789313 - protein, 25 aa, Entamoeba invadens
EKTPAWIIIVVVFFDLGILAFALFV

SEQ ID NO: 2789314 - protein, 17 aa, Entamoeba invadens
EKTRTLFKMSRSNIAFV

SEQ ID NO: 2789315 - protein, 34 aa, Entamoeba invadens
EKTYYLKLPYKLKVRMLFDISRGMQFLHENRILH

SEQ ID NO: 2789316 - protein, 18 aa, Entamoeba invadens
EKVGNFFHKKEKTEKDTT

SEQ ID NO: 2789317 - protein, 24 aa, Entamoeba invadens
EKVIRIPWRRLVITPNPKKPTIWD

SEQ ID NO: 2789318 - protein, 18 aa, Entamoeba invadens
EKVKGGFVRLEYEKSEKD

SEQ ID NO: 2789319 - protein, 17 aa, Entamoeba invadens
EKVKTGYRLPIDVESPL

SEQ ID NO: 2789320 - protein, 18 aa, Entamoeba invadens
EKVLEMCSECLKNGEIFT

SEQ ID NO: 2789321 - protein, 22 aa, Entamoeba invadens
EKVLRNGFGFDLIDPTTGTPYW

SEQ ID NO: 2789322 - protein, 17 aa, Entamoeba invadens
EKVLSAIEQICFVDDII

SEQ ID NO: 2789323 - protein, 23 aa, Entamoeba invadens
EKVNPLLTWYQFKVNSVFKAEML

SEQ ID NO: 2789324 - protein, 24 aa, Entamoeba invadens
EKYEDPYMVWSLRVHDKKDLSKSY

SEQ ID NO: 2789325 - protein, 20 aa, Entamoeba invadens
EKYKKPADVFSFGVTMYEVF

SEQ ID NO: 2789326 - protein, 24 aa, Entamoeba invadens
EKYLRACVSVSFFLSLTLTAVFIS

SEQ ID NO: 2789327 - protein, 24 aa, Entamoeba invadens
EKYRASPLLHLLWIDNIIKKQIEI

SEQ ID NO: 2789328 - protein, 21 aa, Entamoeba invadens
EKYRMPSDIFSFAITMYEIFN

SEQ ID NO: 2789329 - protein, 17 aa, Entamoeba invadens
EKYRNVIEKCWKQNTQE

SEQ ID NO: 2789330 - protein, 19 aa, Entamoeba invadens
EKYYFRNSFGKCVKCVENC

SEQ ID NO: 2789331 - protein, 23 aa, Entamoeba invadens
EKYYKFTSSNFILKIVDTEITYS

SEQ ID NO: 2789332 - protein, 23 aa, Entamoeba invadens
ELACVGCGISYYVTEKGQEKFAK

SEQ ID NO: 2789333 - protein, 24 aa, Entamoeba invadens
ELANCLKYDIFGCVQCENGYFLDR

SEQ ID NO: 2789334 - protein, 19 aa, Entamoeba invadens
ELATKCLMYPDVYSKLPDG

SEQ ID NO: 2789335 - protein, 20 aa, Entamoeba invadens
ELAVEPYLVILKHGDYTTFN

SEQ ID NO: 2789336 - protein, 18 aa, Entamoeba invadens
ELCAHNVIVVSSDIDKIC

SEQ ID NO: 2789337 - protein, 17 aa, Entamoeba invadens
ELCDKKKCTKCISGYSL

SEQ ID NO: 2789338 - protein, 25 aa, Entamoeba invadens
ELCENLKCKFCKENYVLNEVGKCEI

SEQ ID NO: 2789339 - protein, 18 aa, Entamoeba invadens
ELCIAFANHLDWYVTLYS

SEQ ID NO: 2789340 - protein, 26 aa, Entamoeba invadens
ELCLSCSFNECFICESNSFLINGKCQ

SEQ ID NO: 2789341 - protein, 25 aa, Entamoeba invadens
ELCSSFDPYCTVCSQTIRKCTTCTT

SEQ ID NO: 2789342 - protein, 26 aa, Entamoeba invadens
ELDGIWNIDHCLKCDNGFPDNGTCVI

SEQ ID NO: 2789343 - protein, 20 aa, Entamoeba invadens
ELDLLVDVVINFDDIQRNIK

SEQ ID NO: 2789344 - protein, 31 aa, Entamoeba invadens
ELDLSNNFFIEFPLHLCKMTQLIKLDLSMNK

SEQ ID NO: 2789345 - protein, 22 aa, Entamoeba invadens
ELDVETVFACMAIFNSIKLPFQ

SEQ ID NO: 2789346 - protein, 19 aa, Entamoeba invadens
ELEKEVSMLEKFRDDYIVY

SEQ ID NO: 2789347 - protein, 24 aa, Entamoeba invadens
ELERCFYGLMPYTTYFDYYSHSQD

SEQ ID NO: 2789348 - protein, 23 aa, Entamoeba invadens
ELFARKFLERKIKENTRRSERNY

SEQ ID NO: 2789349 - protein, 27 aa, Entamoeba invadens
ELFDQYFYFAICKIVLDQCYFPKMFPV

SEQ ID NO: 2789350 - protein, 22 aa, Entamoeba invadens
ELFEPVCMNDFIAVDMNSSSVK

SEQ ID NO: 2789351 - protein, 24 aa, Entamoeba invadens
ELFKVARTTLLKEVCDEKADNVFF

SEQ ID NO: 2789352 - protein, 26 aa, Entamoeba invadens
ELFLINFPSCFLVNFTSSKTSKKFKR

SEQ ID NO: 2789353 - protein, 25 aa, Entamoeba invadens
ELFLIRSSRKVGILIENQLCPFELL

SEQ ID NO: 2789354 - protein, 33 aa, Entamoeba invadens
ELFPLRLQAFSHLKGALTIPVRNLNAYAAYNDF

SEQ ID NO: 2789355 - protein, 19 aa, Entamoeba invadens
ELFQFSWNISQFVTSGKRL

SEQ ID NO: 2789356 - protein, 23 aa, Entamoeba invadens
ELGYFSRLGFEPKLRKLREGLTL

SEQ ID NO: 2789357 - protein, 18 aa, Entamoeba invadens
ELHWKISAVNVPLYILLF

SEQ ID NO: 2789358 - protein, 17 aa, Entamoeba invadens
ELIKERAKQMIIDLKEK

SEQ ID NO: 2789359 - protein, 20 aa, Entamoeba invadens
ELISTFNLCVGDLVNLDVGD

SEQ ID NO: 2789360 - protein, 21 aa, Entamoeba invadens
ELITVCAGSYSFSVIGSLLQW

SEQ ID NO: 2789361 - protein, 23 aa, Entamoeba invadens
ELKCEPELAFIRPGEAVEFTMTV

SEQ ID NO: 2789362 - protein, 24 aa, Entamoeba invadens
ELKEKLSCVFAVYAKNILLEKITS

SEQ ID NO: 2789363 - protein, 30 aa, Entamoeba invadens
ELKKMMPKEDKWKNVFTFKNNAKELFELGE

SEQ ID NO: 2789364 - protein, 19 aa, Entamoeba invadens
ELLKKIAIKLEDWKETVTR

SEQ ID NO: 2789365 - protein, 23 aa, Entamoeba invadens
ELLKPIMSLCAQKKYSSAFASYK

SEQ ID NO: 2789366 - protein, 27 aa, Entamoeba invadens
ELLKSQLGGIFSFDSWRYYFNVSTTSV

SEQ ID NO: 2789367 - protein, 21 aa, Entamoeba invadens
ELLLRFLEKISATKCHVPFPK

SEQ ID NO: 2789368 - protein, 24 aa, Entamoeba invadens
ELLLYKITVCPSWNRVKSNALLQI

SEQ ID NO: 2789369 - protein, 18 aa, Entamoeba invadens
ELLRNCHYYGLMADSARY

SEQ ID NO: 2789370 - protein, 17 aa, Entamoeba invadens
ELLVYRLSACFVTSIFG

SEQ ID NO: 2789371 - protein, 19 aa, Entamoeba invadens
ELLWCSDVLVVSKTLDFLN

SEQ ID NO: 2789372 - protein, 18 aa, Entamoeba invadens
ELMIDRSIAIYNFKSSKQ

SEQ ID NO: 2789373 - protein, 21 aa, Entamoeba invadens
ELMIKTCDFKGITVDITIPLS

SEQ ID NO: 2789374 - protein, 22 aa, Entamoeba invadens
ELMKIVRQLAWIGLGNFLGGIL

SEQ ID NO: 2789375 - protein, 18 aa, Entamoeba invadens
ELMNLGIVSFTFVLFDMV

SEQ ID NO: 2789376 - protein, 23 aa, Entamoeba invadens
ELNEEFRLSGVFVTTNKVKFNTK

SEQ ID NO: 2789377 - protein, 25 aa, Entamoeba invadens
ELNFVYKVGVSFGYISIIICVLYLV

SEQ ID NO: 2789378 - protein, 22 aa, Entamoeba invadens
ELNWFPRKYKIVTSDYDEYYRN

SEQ ID NO: 2789379 - protein, 22 aa, Entamoeba invadens
ELNWFPRKYKIVTSDYEDYYRN

SEQ ID NO: 2789380 - protein, 25 aa, Entamoeba invadens
ELPTFGIEFVKSLQFLKMASQYIGN

SEQ ID NO: 2789381 - protein, 20 aa, Entamoeba invadens
ELPWMCFGFIGSMIYGALFP

SEQ ID NO: 2789382 - protein, 21 aa, Entamoeba invadens
ELQAPLGYLGVGSRFRATCVD

SEQ ID NO: 2789383 - protein, 33 aa, Entamoeba invadens
ELQVYFPKSFVTGGLFSRCGECLELSSTGGESY

SEQ ID NO: 2789384 - protein, 22 aa, Entamoeba invadens
ELRAKCQLIVLTGCIECIHGYY

SEQ ID NO: 2789385 - protein, 22 aa, Entamoeba invadens
ELRLKRFYISQIRRETNPIKKI

SEQ ID NO: 2789386 - protein, 23 aa, Entamoeba invadens
ELRLKSIPADQVFPIVKPEEIAT

SEQ ID NO: 2789387 - protein, 18 aa, Entamoeba invadens
ELRLSGCALEHLPCSCSK

SEQ ID NO: 2789388 - protein, 25 aa, Entamoeba invadens
ELRMRRWQDTFGNFTIYCGKVEEQL

SEQ ID NO: 2789389 - protein, 19 aa, Entamoeba invadens
ELRRLAIFADKSRFIAEFN

SEQ ID NO: 2789390 - protein, 19 aa, Entamoeba invadens
ELRRMKEVMKHSGETMESS

SEQ ID NO: 2789391 - protein, 22 aa, Entamoeba invadens
ELRWFTFGYGFFFLLSGSVALL

SEQ ID NO: 2789392 - protein, 21 aa, Entamoeba invadens
ELSDSIWSFQFCPCQNSESSV

SEQ ID NO: 2789393 - protein, 22 aa, Entamoeba invadens
ELSELPLTFIGMNRVIITAEMK

SEQ ID NO: 2789394 - protein, 20 aa, Entamoeba invadens
ELSMVFSVTGIFFGFANTFY

SEQ ID NO: 2789395 - protein, 29 aa, Entamoeba invadens
ELSQFASFMVEPMCGAKIDALGMSIDEIV

SEQ ID NO: 2789396 - protein, 30 aa, Entamoeba invadens
ELTFSNRCLKCLTGFLLRDGLCVSDATCLL

SEQ ID NO: 2789397 - protein, 23 aa, Entamoeba invadens
ELTIPLKVIRIVDIVAVSITVFI

SEQ ID NO: 2789398 - protein, 30 aa, Entamoeba invadens
ELTQNCKLCSRKNCYTCSSGFSLVNGKCVN

SEQ ID NO: 2789399 - protein, 25 aa, Entamoeba invadens
ELTQRAPVFFEFFNREISTFITDCF

SEQ ID NO: 2789400 - protein, 20 aa, Entamoeba invadens
ELTSFPYVSPVVHFQETSYP

SEQ ID NO: 2789401 - protein, 19 aa, Entamoeba invadens
ELTTKCWSQSPADRPTFVD

SEQ ID NO: 2789402 - protein, 18 aa, Entamoeba invadens
ELVFKLEFTDAVVNIIEL

SEQ ID NO: 2789403 - protein, 19 aa, Entamoeba invadens
ELVNMFSALVMKLSDDTFK

SEQ ID NO: 2789404 - protein, 19 aa, Entamoeba invadens
ELVPEFYQNTSFLNNKDHV

SEQ ID NO: 2789405 - protein, 18 aa, Entamoeba invadens
ELYEVVCNMSVLCKKVLD

SEQ ID NO: 2789406 - protein, 18 aa, Entamoeba invadens
ELYMSMTRCLAALSKIEK

SEQ ID NO: 2789407 - protein, 30 aa, Entamoeba invadens
ELYNEIQRRVFGYGLSEGCECLNQKGDCNV

SEQ ID NO: 2789408 - protein, 19 aa, Entamoeba invadens
ELYRECFAVVVLDALITVS

SEQ ID NO: 2789409 - protein, 19 aa, Entamoeba invadens
ELYSLYTFFMFLLLTKTVQ

SEQ ID NO: 2789410 - protein, 19 aa, Entamoeba invadens
EMAGFKFTVSDDVLVKKTK

SEQ ID NO: 2789411 - protein, 18 aa, Entamoeba invadens
EMCMDGKCIKCLDNTIYT

SEQ ID NO: 2789412 - protein, 24 aa, Entamoeba invadens
EMCMDGKCIKCLDYAIYTNGECLT

SEQ ID NO: 2789413 - protein, 23 aa, Entamoeba invadens
EMCSICFKNQFLNELGFCVNDGI

SEQ ID NO: 2789414 - protein, 27 aa, Entamoeba invadens
EMEEWGMRCLFKFKKYVILYAVLLILF

SEQ ID NO: 2789415 - protein, 18 aa, Entamoeba invadens
EMELKLREKVLIDVCKGI

SEQ ID NO: 2789416 - protein, 25 aa, Entamoeba invadens
EMERLKICGNFEFSLRNESEKYEHC

SEQ ID NO: 2789417 - protein, 20 aa, Entamoeba invadens
EMFFLHFPRKQELVVPIGII

SEQ ID NO: 2789418 - protein, 21 aa, Entamoeba invadens
EMFVSISVLLGMQGELIDSIE

SEQ ID NO: 2789419 - protein, 18 aa, Entamoeba invadens
EMGVASLRSQINIYTFRY

SEQ ID NO: 2789420 - protein, 18 aa, Entamoeba invadens
EMHFIFKEFIQRMENVFK

SEQ ID NO: 2789421 - protein, 23 aa, Entamoeba invadens
EMIECAKMANAHDFISHLPEGYD

SEQ ID NO: 2789422 - protein, 19 aa, Entamoeba invadens
EMIPRKVTEIIVDADTDNV

SEQ ID NO: 2789423 - protein, 21 aa, Entamoeba invadens
EMKSPAFIRRFVKNVDTSTRL

SEQ ID NO: 2789424 - protein, 17 aa, Entamoeba invadens
EMLCKLAAVSMANASGV

SEQ ID NO: 2789425 - protein, 20 aa, Entamoeba invadens
EMLDKFRCEYIIYFYGAVVI

SEQ ID NO: 2789426 - protein, 18 aa, Entamoeba invadens
EMLKQANVRVWMLTGDKV

SEQ ID NO: 2789427 - protein, 27 aa, Entamoeba invadens
EMMKRCGVGEKCVKKFVGYELGRLRVK

SEQ ID NO: 2789428 - protein, 19 aa, Entamoeba invadens
EMMSKILIINKHQVDRKWW

SEQ ID NO: 2789429 - protein, 23 aa, Entamoeba invadens
EMNDLRSSCMFGKEDMKASEKKG

SEQ ID NO: 2789430 - protein, 24 aa, Entamoeba invadens
EMRLEVFKTDYLYSLSNLYFSLTE

SEQ ID NO: 2789431 - protein, 35 aa, Entamoeba invadens
EMSIFPICVIGATIFLKCCLFLYCRTVNNPAAGAL

SEQ ID NO: 2789432 - protein, 19 aa, Entamoeba invadens
EMSYITAFIPLLAGMSLSY

SEQ ID NO: 2789433 - protein, 25 aa, Entamoeba invadens
EMVGSGWRPFPVLNELKKCIPVQTH

SEQ ID NO: 2789434 - protein, 18 aa, Entamoeba invadens
EMVNGWSSGTGFAGVAGS

SEQ ID NO: 2789435 - protein, 24 aa, Entamoeba invadens
EMYKEFSESASICLSTGERSEFKH

SEQ ID NO: 2789436 - protein, 24 aa, Entamoeba invadens
EMYKRKEDVINEILPFVKHFALGG

SEQ ID NO: 2789437 - protein, 18 aa, Entamoeba invadens
ENALKCKYEAIYGTVNSK

SEQ ID NO: 2789438 - protein, 22 aa, Entamoeba invadens
ENALKRFFMISTSYDENLVNEN

SEQ ID NO: 2789439 - protein, 22 aa, Entamoeba invadens
ENCAQCADDGVTCYKCAFNNGN

SEQ ID NO: 2789440 - protein, 18 aa, Entamoeba invadens
ENCEKCQFFSSSCSKCKE

SEQ ID NO: 2789441 - protein, 26 aa, Entamoeba invadens
ENCGTKSRIAIKFTKNKAQFVGVFSP

SEQ ID NO: 2789442 - protein, 17 aa, Entamoeba invadens
ENCKLLRFPKGESGYAA

SEQ ID NO: 2789443 - protein, 21 aa, Entamoeba invadens
ENCLPKMFLNNRCIQCKPDFY

SEQ ID NO: 2789444 - protein, 21 aa, Entamoeba invadens
ENCLPKMFLNNRCIQCKPNFY

SEQ ID NO: 2789445 - protein, 23 aa, Entamoeba invadens
ENCLSCNDQVCYTCKEGTFLTLD

SEQ ID NO: 2789446 - protein, 21 aa, Entamoeba invadens
ENCLSCNSTMCTACTDSNAEL

SEQ ID NO: 2789447 - protein, 23 aa, Entamoeba invadens
ENDDTWIWITVGVVSGVFVLIVF

SEQ ID NO: 2789448 - protein, 20 aa, Entamoeba invadens
ENDITFKTGISMITILGDSK

SEQ ID NO: 2789449 - protein, 22 aa, Entamoeba invadens
ENDTFCRYCKSPNFELNISQNN

SEQ ID NO: 2789450 - protein, 24 aa, Entamoeba invadens
ENDTSCLLCKDIYHTAAAVSSVYL

SEQ ID NO: 2789451 - protein, 26 aa, Entamoeba invadens
ENERSRIPLSLFFGSLGVKKETNVVD

SEQ ID NO: 2789452 - protein, 18 aa, Entamoeba invadens
ENEVRKDRVCVCKDGYEF

SEQ ID NO: 2789453 - protein, 24 aa, Entamoeba invadens
ENEVSMLDKFRCEYIVHFYGAVFI

SEQ ID NO: 2789454 - protein, 30 aa, Entamoeba invadens
ENFASNLLKLRFCLDVAKGMLYLHSNNVIH

SEQ ID NO: 2789455 - protein, 17 aa, Entamoeba invadens
ENFFPRKTVTFISDNNV

SEQ ID NO: 2789456 - protein, 25 aa, Entamoeba invadens
ENFMYRLRISTQITLPNFFVGDGMS

SEQ ID NO: 2789457 - protein, 21 aa, Entamoeba invadens
ENFWYFVFLCILFLVHFPYNE

SEQ ID NO: 2789458 - protein, 24 aa, Entamoeba invadens
ENGFMKIKIVLRCTHKTYNKTSQT

SEQ ID NO: 2789459 - protein, 27 aa, Entamoeba invadens
ENGICVMDCLFPSCVGGCISPNECGVC

SEQ ID NO: 2789460 - protein, 24 aa, Entamoeba invadens
ENGKCLKCVSGFYLDKLSSTCQLC

SEQ ID NO: 2789461 - protein, 18 aa, Entamoeba invadens
ENGKCLNCTVIANCDKNG

SEQ ID NO: 2789462 - protein, 27 aa, Entamoeba invadens
ENGKCSMCSIGFYLKNGMCEPSNCLIK

SEQ ID NO: 2789463 - protein, 18 aa, Entamoeba invadens
ENGNCVKCSTFIPNCDTC

SEQ ID NO: 2789464 - protein, 25 aa, Entamoeba invadens
ENGRCKKCTYGYVVGSSGLCEEPTD

SEQ ID NO: 2789465 - protein, 24 aa, Entamoeba invadens
ENGWFCPHCKAMQVAKKRIVIDSL

SEQ ID NO: 2789466 - protein, 25 aa, Entamoeba invadens
ENGYFPKNRMCVVCSTLSNCATCKQ

SEQ ID NO: 2789467 - protein, 31 aa, Entamoeba invadens
ENGYIVCPCHLLGVTCSLNYGSFNTTITANT

SEQ ID NO: 2789468 - protein, 22 aa, Entamoeba invadens
ENGYYLDFFIPRCVSCPEMCLS

SEQ ID NO: 2789469 - protein, 23 aa, Entamoeba invadens
ENHKCVSCAIGYALSNNKCIRGS

SEQ ID NO: 2789470 - protein, 18 aa, Entamoeba invadens
ENIAVKLIPTRSMVKSDV

SEQ ID NO: 2789471 - protein, 20 aa, Entamoeba invadens
ENICVFKMSRSNIKMTKFDG

SEQ ID NO: 2789472 - protein, 20 aa, Entamoeba invadens
ENICVFKMSRSNIMMTKLEG

SEQ ID NO: 2789473 - protein, 18 aa, Entamoeba invadens
ENICVFKMSRSNITMTKL

SEQ ID NO: 2789474 - protein, 18 aa, Entamoeba invadens
ENICVFKMSRSNIVMTKL

SEQ ID NO: 2789475 - protein, 18 aa, Entamoeba invadens
ENIFDDFKFERAKLTDFY

SEQ ID NO: 2789476 - protein, 36 aa, Entamoeba invadens
ENIFKGLNWCILRGNCIGLGMGFFMFVNLCTFALGL

SEQ ID NO: 2789477 - protein, 24 aa, Entamoeba invadens
ENIKETFTDFNLCYYCELQSTELI

SEQ ID NO: 2789478 - protein, 18 aa, Entamoeba invadens
ENINGICKAKCLDNDNKI

SEQ ID NO: 2789479 - protein, 18 aa, Entamoeba invadens
ENIRCFECNKSFDDFFVP

SEQ ID NO: 2789480 - protein, 25 aa, Entamoeba invadens
ENITRLPYFKLFRIDTTIPKTPNIC

SEQ ID NO: 2789481 - protein, 18 aa, Entamoeba invadens
ENKCVSCSLNGNCTSCNT

SEQ ID NO: 2789482 - protein, 19 aa, Entamoeba invadens
ENKLCRLQLDVPVVKYSED

SEQ ID NO: 2789483 - protein, 26 aa, Entamoeba invadens
ENKMMFCSLNLEFKNWCKYYAPSTDL

SEQ ID NO: 2789484 - protein, 19 aa, Entamoeba invadens
ENKYRFSGETSPFADIPED

SEQ ID NO: 2789485 - protein, 19 aa, Entamoeba invadens
ENLCILSPNSSEVVWCNVI

SEQ ID NO: 2789486 - protein, 21 aa, Entamoeba invadens
ENLCRGVLGDICLKTSNYFDF

SEQ ID NO: 2789487 - protein, 22 aa, Entamoeba invadens
ENLKLSFKRHVQSLVKTMNETN

SEQ ID NO: 2789488 - protein, 24 aa, Entamoeba invadens
ENLKRIFDDFTFKNVLEREVEDHL

SEQ ID NO: 2789489 - protein, 23 aa, Entamoeba invadens
ENLKRNSVDLVYTMLKNNFIFSQ

SEQ ID NO: 2789490 - protein, 17 aa, Entamoeba invadens
ENLKYFIEIAKKFKPTI

SEQ ID NO: 2789491 - protein, 25 aa, Entamoeba invadens
ENLPGFEFYQWFGAMLEQFEDFGIP

SEQ ID NO: 2789492 - protein, 24 aa, Entamoeba invadens
ENLSPLARFERLYFTFCQQNEYHI

SEQ ID NO: 2789493 - protein, 17 aa, Entamoeba invadens
ENMLYSYRCCGGNPMNC

SEQ ID NO: 2789494 - protein, 22 aa, Entamoeba invadens
ENNCFECGQGYYKSTKYNKCIL

SEQ ID NO: 2789495 - protein, 18 aa, Entamoeba invadens
ENNCLQCGDDYFVNEGGR

SEQ ID NO: 2789496 - protein, 26 aa, Entamoeba invadens
ENNSKCEYCPVGTRLEKNSEFTKCLP

SEQ ID NO: 2789497 - protein, 20 aa, Entamoeba invadens
ENPRAYCLSLNCGNGKIDGN

SEQ ID NO: 2789498 - protein, 17 aa, Entamoeba invadens
ENPSLHADFLIRAIVSY

SEQ ID NO: 2789499 - protein, 19 aa, Entamoeba invadens
ENPVGFSFIHLKWPDNKKD

SEQ ID NO: 2789500 - protein, 18 aa, Entamoeba invadens
ENQCAKCHTNCTLCSEEN

SEQ ID NO: 2789501 - protein, 21 aa, Entamoeba invadens
ENQFKYAWDIVDFVVNGKRLV

SEQ ID NO: 2789502 - protein, 23 aa, Entamoeba invadens
ENQKVEMCLTAFSKLDAQVNELS

SEQ ID NO: 2789503 - protein, 29 aa, Entamoeba invadens
ENQLCRVCFETGKCISFLNFGILSSSGQS

SEQ ID NO: 2789504 - protein, 25 aa, Entamoeba invadens
ENQQLRLTKTLSFNKLTLTPPTQVI

SEQ ID NO: 2789505 - protein, 19 aa, Entamoeba invadens
ENRECLKCHDNCTSCTGYD

SEQ ID NO: 2789506 - protein, 18 aa, Entamoeba invadens
ENSCLTCNTIYYKTNNGD

SEQ ID NO: 2789507 - protein, 24 aa, Entamoeba invadens
ENSDLYSLGVILFYLLFMRIPFDV

SEQ ID NO: 2789508 - protein, 23 aa, Entamoeba invadens
ENSECKPCYSIEGCTICNSNEKV

SEQ ID NO: 2789509 - protein, 24 aa, Entamoeba invadens
ENSECVSCSFLYKANKTYCSQQLT

SEQ ID NO: 2789510 - protein, 23 aa, Entamoeba invadens
ENSETLKQFGLIDEGGYTITNPS

SEQ ID NO: 2789511 - protein, 19 aa, Entamoeba invadens
ENSGFYLLNGRCVVCDSTC

SEQ ID NO: 2789512 - protein, 18 aa, Entamoeba invadens
ENSIGISVGEVMKFELIQ

SEQ ID NO: 2789513 - protein, 25 aa, Entamoeba invadens
ENSKRYVYNFALRFVPFLVTVLYSY

SEQ ID NO: 2789514 - protein, 27 aa, Entamoeba invadens
ENSMEFKEWFPMESIVLGTIEICDDFP

SEQ ID NO: 2789515 - protein, 27 aa, Entamoeba invadens
ENSWYGKEFYCSINQFVAYGVSSLDEL

SEQ ID NO: 2789516 - protein, 26 aa, Entamoeba invadens
ENTAFTRPSVFYTLKGNGLVYYIDTC

SEQ ID NO: 2789517 - protein, 24 aa, Entamoeba invadens
ENTKCPPFVCLSTQQILFGNNGVQ

SEQ ID NO: 2789518 - protein, 24 aa, Entamoeba invadens
ENTKIRICNLLGMYLNATETNLRY

SEQ ID NO: 2789519 - protein, 24 aa, Entamoeba invadens
ENVFKNCLNLVSIDFGGNTVIPPG

SEQ ID NO: 2789520 - protein, 18 aa, Entamoeba invadens
ENVFYLLLEMKICVTIFV

SEQ ID NO: 2789521 - protein, 27 aa, Entamoeba invadens
ENVQWRCGMNIWKNPRSEGGQTLCDSN

SEQ ID NO: 2789522 - protein, 24 aa, Entamoeba invadens
ENYFPYKGKCYLKSDTAVLSLYII

SEQ ID NO: 2789523 - protein, 25 aa, Entamoeba invadens
ENYIFPPPEVFFACDNCTEGRSLES

SEQ ID NO: 2789524 - protein, 23 aa, Entamoeba invadens
ENYLPKYSILWLQTMSVVMRVLS

SEQ ID NO: 2789525 - protein, 26 aa, Entamoeba invadens
EPDKKRPGSCTRKYHIVLITLVTISC

SEQ ID NO: 2789526 - protein, 17 aa, Entamoeba invadens
EPFGFFTRVTHRNLPGE

SEQ ID NO: 2789527 - protein, 22 aa, Entamoeba invadens
EPFKEFKSLFDLKKSVLEGKRP

SEQ ID NO: 2789528 - protein, 20 aa, Entamoeba invadens
EPFKELKSLFDIKKHVTSGL

SEQ ID NO: 2789529 - protein, 33 aa, Entamoeba invadens
EPFLKCSTFIPSRVEVWSCTFPSSVPSSGVSSV

SEQ ID NO: 2789530 - protein, 29 aa, Entamoeba invadens
EPFNRKQFKFSWDIADFVVAGKRLEKPMD

SEQ ID NO: 2789531 - protein, 18 aa, Entamoeba invadens
EPGRRCMKFDQDANYNFM

SEQ ID NO: 2789532 - protein, 17 aa, Entamoeba invadens
EPIGIDGCAVRHNTGGC

SEQ ID NO: 2789533 - protein, 23 aa, Entamoeba invadens
EPIICALTLPFIVFSGNLLVMHT

SEQ ID NO: 2789534 - protein, 20 aa, Entamoeba invadens
EPINAICLVERYSSVLVSDE

SEQ ID NO: 2789535 - protein, 26 aa, Entamoeba invadens
EPIVKKDVPTWVIVILIIIGVFIVII

SEQ ID NO: 2789536 - protein, 26 aa, Entamoeba invadens
EPKIVTLKSGFACEFEIFLTPYCTMN

SEQ ID NO: 2789537 - protein, 27 aa, Entamoeba invadens
EPKIVTLKSGFACEFKVFITPYCTMDL

SEQ ID NO: 2789538 - protein, 25 aa, Entamoeba invadens
EPKKGHGKRTKFEFFSDTVKNGRMI

SEQ ID NO: 2789539 - protein, 21 aa, Entamoeba invadens
EPKLRKRVIVVNVNNMSIGQF

SEQ ID NO: 2789540 - protein, 22 aa, Entamoeba invadens
EPKTKQCLSCNSFDPNCEKCDS

SEQ ID NO: 2789541 - protein, 22 aa, Entamoeba invadens
EPLCTHVLKLLEEFPENEMLVK

SEQ ID NO: 2789542 - protein, 25 aa, Entamoeba invadens
EPLGNPLKGFCNWYGNSNVPNVPFS

SEQ ID NO: 2789543 - protein, 25 aa, Entamoeba invadens
EPMRYTLKPGYAISVKFTIKMLCTA

SEQ ID NO: 2789544 - protein, 24 aa, Entamoeba invadens
EPNCHKMLLNHCVAIAGYGVTDDG

SEQ ID NO: 2789545 - protein, 18 aa, Entamoeba invadens
EPNCKYCDNEKCTVCDDK

SEQ ID NO: 2789546 - protein, 23 aa, Entamoeba invadens
EPNRRCFQCVSGMYPNNDKQCVN

SEQ ID NO: 2789547 - protein, 27 aa, Entamoeba invadens
EPRTFFYIMLGCLGLLILQQIVFKKLK

SEQ ID NO: 2789548 - protein, 23 aa, Entamoeba invadens
EPSHHLLCKFFVWGNPQGLPKDI

SEQ ID NO: 2789549 - protein, 26 aa, Entamoeba invadens
EPSIKRIPLVPSKYYTFISSLVLQTI

SEQ ID NO: 2789550 - protein, 19 aa, Entamoeba invadens
EPSLEMFGLLVSILLLLLR

SEQ ID NO: 2789551 - protein, 21 aa, Entamoeba invadens
EPTNRVKIFFLSLILAMTSFV

SEQ ID NO: 2789552 - protein, 23 aa, Entamoeba invadens
EPVFDPLIFFYARNIELLNQTKG

SEQ ID NO: 2789553 - protein, 24 aa, Entamoeba invadens
EPVTHLKIEQPIECENVMMSAINN

SEQ ID NO: 2789554 - protein, 22 aa, Entamoeba invadens
EPYCPCDGCFITPFKNGEGVVI

SEQ ID NO: 2789555 - protein, 20 aa, Entamoeba invadens
EPYCPCSSVNCYITPFKNIT

SEQ ID NO: 2789556 - protein, 19 aa, Entamoeba invadens
EPYCPCSSVNCYITPLKNI

SEQ ID NO: 2789557 - protein, 20 aa, Entamoeba invadens
EPYNELKSVFDIKKHVEEGK

SEQ ID NO: 2789558 - protein, 27 aa, Entamoeba invadens
EPYNKVDFKFLWNIAEFVISGKRLLKK

SEQ ID NO: 2789559 - protein, 27 aa, Entamoeba invadens
EPYPKQKFKFAWSVADFVTAGKHLEQL

SEQ ID NO: 2789560 - protein, 28 aa, Entamoeba invadens
EPYPKSEFKFAWCIANFVSKGNHLKKVI

SEQ ID NO: 2789561 - protein, 18 aa, Entamoeba invadens
EPYTDFLKRIEVHKYRQE

SEQ ID NO: 2789562 - protein, 18 aa, Entamoeba invadens
EQCIPDSINVVFKTTFAF

SEQ ID NO: 2789563 - protein, 17 aa, Entamoeba invadens
EQDPAMRPSFDTIVKEF

SEQ ID NO: 2789564 - protein, 24 aa, Entamoeba invadens
EQDRCIHCLTGYFVSNYQCENCSE

SEQ ID NO: 2789565 - protein, 19 aa, Entamoeba invadens
EQDRCIRCEINYHLSNYTC

SEQ ID NO: 2789566 - protein, 27 aa, Entamoeba invadens
EQECPKGPFCYTAFYFPYYSFFVGNFV

SEQ ID NO: 2789567 - protein, 31 aa, Entamoeba invadens
EQEDWELWLWFGVICGVIIVFVVIVLGSIII

SEQ ID NO: 2789568 - protein, 21 aa, Entamoeba invadens
EQEGRLGRVLREFNQSDITPL

SEQ ID NO: 2789569 - protein, 33 aa, Entamoeba invadens
EQEKTVCVFKMSRSNIRFIVKLSSSICSNKNKL

SEQ ID NO: 2789570 - protein, 17 aa, Entamoeba invadens
EQFELINMCWKQNSKER

SEQ ID NO: 2789571 - protein, 21 aa, Entamoeba invadens
EQFKYSWDIVDFVVAGKRLEK

SEQ ID NO: 2789572 - protein, 18 aa, Entamoeba invadens
EQFSCSKKVLGHGSLGTV

SEQ ID NO: 2789573 - protein, 21 aa, Entamoeba invadens
EQHCPTGWIVQGDKCLEHCDD

SEQ ID NO: 2789574 - protein, 24 aa, Entamoeba invadens
EQHIRYTKYHIFMLKKAIHQIEYF

SEQ ID NO: 2789575 - protein, 27 aa, Entamoeba invadens
EQIELCCYLSALLTFFVDYEYTNPAFR

SEQ ID NO: 2789576 - protein, 23 aa, Entamoeba invadens
EQIMKDVPLVFGLSNSSIPNADK

SEQ ID NO: 2789577 - protein, 29 aa, Entamoeba invadens
EQKECKQCGPGCSICNSFNQCQACLSTFV

SEQ ID NO: 2789578 - protein, 21 aa, Entamoeba invadens
EQKIPVAVAFPAKSSTDANSP

SEQ ID NO: 2789579 - protein, 19 aa, Entamoeba invadens
EQKLCYDRIPNYTHNIHGY

SEQ ID NO: 2789580 - protein, 19 aa, Entamoeba invadens
EQKLPAVNGGFMFGGVEKV

SEQ ID NO: 2789581 - protein, 30 aa, Entamoeba invadens
EQKSDGWLIWSIWVMMTIVAVITFTVSLMS

SEQ ID NO: 2789582 - protein, 19 aa, Entamoeba invadens
EQLEFPVEMTVELQNELNN

SEQ ID NO: 2789583 - protein, 25 aa, Entamoeba invadens
EQLFRLKHYISFVYDNIFYSIFIWI

SEQ ID NO: 2789584 - protein, 21 aa, Entamoeba invadens
EQLGALSCYLILSKIAIATNC

SEQ ID NO: 2789585 - protein, 19 aa, Entamoeba invadens
EQLRCVGEVAMSEFNYRNS

SEQ ID NO: 2789586 - protein, 24 aa, Entamoeba invadens
EQLRRLHVFGEIFAENGYLVRSDA

SEQ ID NO: 2789587 - protein, 17 aa, Entamoeba invadens
EQMTLMKVVELLSFSTE

SEQ ID NO: 2789588 - protein, 24 aa, Entamoeba invadens
EQNKKIEIEQCRKEKDDLSKQVKE

SEQ ID NO: 2789589 - protein, 25 aa, Entamoeba invadens
EQNSCLKCKPGFYLVDGSCYLCPKN

SEQ ID NO: 2789590 - protein, 23 aa, Entamoeba invadens
EQQYSCCGWYSISTRRCKSLAGL

SEQ ID NO: 2789591 - protein, 21 aa, Entamoeba invadens
EQRLISDLCVDFKLDGNGTIL

SEQ ID NO: 2789592 - protein, 25 aa, Entamoeba invadens
EQSFQWFYKLWRVQGYFNLVITKLY

SEQ ID NO: 2789593 - protein, 20 aa, Entamoeba invadens
EQSIWYSLYVNVRIQYLITS

SEQ ID NO: 2789594 - protein, 20 aa, Entamoeba invadens
EQSKGLWYKVIHDQSKVDEE

SEQ ID NO: 2789595 - protein, 18 aa, Entamoeba invadens
EQTRRVCHCIQNVLEVMH

SEQ ID NO: 2789596 - protein, 17 aa, Entamoeba invadens
EQYCIPMYLGLLGMIAS

SEQ ID NO: 2789597 - protein, 20 aa, Entamoeba invadens
EQYEVLFLFCDIPNYIKMEF

SEQ ID NO: 2789598 - protein, 18 aa, Entamoeba invadens
EQYGCLEGKCDKTICDGS

SEQ ID NO: 2789599 - protein, 20 aa, Entamoeba invadens
EQYGLLPFSVESGSVIALEA

SEQ ID NO: 2789600 - protein, 18 aa, Entamoeba invadens
EQYSIWKMKLVPENRKNA

SEQ ID NO: 2789601 - protein, 20 aa, Entamoeba invadens
ERAILDECEMCVKTNETDYF

SEQ ID NO: 2789602 - protein, 27 aa, Entamoeba invadens
ERAKLTDFYLYKGVFIKFKVKESQITN

SEQ ID NO: 2789603 - protein, 24 aa, Entamoeba invadens
ERAMKEGRIKLFDFGLMDYVKNIA

SEQ ID NO: 2789604 - protein, 27 aa, Entamoeba invadens
ERAPFEFSVKIARGLVEANLDQVCAYA

SEQ ID NO: 2789605 - protein, 17 aa, Entamoeba invadens
ERCLQCKDSNILNIDNT

SEQ ID NO: 2789606 - protein, 17 aa, Entamoeba invadens
ERCLQCKDSNILNTDNT

SEQ ID NO: 2789607 - protein, 17 aa, Entamoeba invadens
ERCPDQNCIYCEDTTQK

SEQ ID NO: 2789608 - protein, 18 aa, Entamoeba invadens
ERCTITTCEKCQSGYIIT

SEQ ID NO: 2789609 - protein, 29 aa, Entamoeba invadens
ERDAIKNPRLFCGIFEEFLRNSAEDESDL

SEQ ID NO: 2789610 - protein, 23 aa, Entamoeba invadens
ERDFANNLLFTFAKTNFIVTGNT

SEQ ID NO: 2789611 - protein, 26 aa, Entamoeba invadens
EREGKFRFGGFWAKQWGDKTKTNSST

SEQ ID NO: 2789612 - protein, 22 aa, Entamoeba invadens
EREGKGKIGFVCYQISQFSPIQ

SEQ ID NO: 2789613 - protein, 18 aa, Entamoeba invadens
EREKIWRSEKWRDITFFM

SEQ ID NO: 2789614 - protein, 19 aa, Entamoeba invadens
ERESLCFAERSSLMASAVE

SEQ ID NO: 2789615 - protein, 22 aa, Entamoeba invadens
ERFKFAWNIADFTSAGKRLVIP

SEQ ID NO: 2789616 - protein, 21 aa, Entamoeba invadens
ERFLHVWDIADFISTGKRLER

SEQ ID NO: 2789617 - protein, 25 aa, Entamoeba invadens
ERFQTQCMPFYLAYFSMSVSTVIFV

SEQ ID NO: 2789618 - protein, 17 aa, Entamoeba invadens
ERFSEIVPGILINKKVL

SEQ ID NO: 2789619 - protein, 28 aa, Entamoeba invadens
ERFSERMVISFGSFWKVEKVFDRHSMTY

SEQ ID NO: 2789620 - protein, 21 aa, Entamoeba invadens
ERFVMYYIFIFEVEGMNVVMY

SEQ ID NO: 2789621 - protein, 19 aa, Entamoeba invadens
ERGLFVFCQSVPCKDCTFA

SEQ ID NO: 2789622 - protein, 18 aa, Entamoeba invadens
ERIDGVCYTKCALNEERV

SEQ ID NO: 2789623 - protein, 20 aa, Entamoeba invadens
ERIPKLMFFNCSTLANVTHT

SEQ ID NO: 2789624 - protein, 22 aa, Entamoeba invadens
ERIRPPRYCPGQVIELNLNAAV

SEQ ID NO: 2789625 - protein, 24 aa, Entamoeba invadens
ERISLKDVMKFPVLYVEMQKGRNL

SEQ ID NO: 2789626 - protein, 22 aa, Entamoeba invadens
ERKCLSCASPYFVGNNGANCVQ

SEQ ID NO: 2789627 - protein, 22 aa, Entamoeba invadens
ERKCLSCASPYFVGNSGANCVQ

SEQ ID NO: 2789628 - protein, 18 aa, Entamoeba invadens
ERKCTSLICQNETFNEEN

SEQ ID NO: 2789629 - protein, 19 aa, Entamoeba invadens
ERKLIEFKYSKSIMQNTLH

SEQ ID NO: 2789630 - protein, 17 aa, Entamoeba invadens
ERKVMKKVPMLDFNRMK

SEQ ID NO: 2789631 - protein, 24 aa, Entamoeba invadens
ERLCRKLTCGDGIVDEGEQCDNTT

SEQ ID NO: 2789632 - protein, 17 aa, Entamoeba invadens
ERLFASRIIGGTFIKTS

SEQ ID NO: 2789633 - protein, 24 aa, Entamoeba invadens
ERLHEWPSYCYLLKSKKNISTFDK

SEQ ID NO: 2789634 - protein, 19 aa, Entamoeba invadens
ERLKVLGIVIQICECSENR

SEQ ID NO: 2789635 - protein, 24 aa, Entamoeba invadens
ERQLICLARGLLSRSKVIILDEAT

SEQ ID NO: 2789636 - protein, 19 aa, Entamoeba invadens
ERQRCALLRNLLQNLQTID

SEQ ID NO: 2789637 - protein, 23 aa, Entamoeba invadens
ERRRMKYSNVLAALRVIVDNFKH

SEQ ID NO: 2789638 - protein, 26 aa, Entamoeba invadens
ERSFLKRNYLLFLVGMYLLLFILPNY

SEQ ID NO: 2789639 - protein, 19 aa, Entamoeba invadens
ERSHFPLIMDFSKRVEAVN

SEQ ID NO: 2789640 - protein, 17 aa, Entamoeba invadens
ERSKVEMRKSTKGEDKE

SEQ ID NO: 2789641 - protein, 25 aa, Entamoeba invadens
ERSRLLPYTLFRLGGAAILLSNKSS

SEQ ID NO: 2789642 - protein, 26 aa, Entamoeba invadens
ERSVECLTCAPGYFRPKEWANDSQFM

SEQ ID NO: 2789643 - protein, 18 aa, Entamoeba invadens
ERSYNSKVAYRCNHDDYT

SEQ ID NO: 2789644 - protein, 19 aa, Entamoeba invadens
ERTAMAYSQLELVKKELEL

SEQ ID NO: 2789645 - protein, 22 aa, Entamoeba invadens
ERTIKDLPLFFVLNTVTITGFA

SEQ ID NO: 2789646 - protein, 24 aa, Entamoeba invadens
ERTNCTWCYDGFYLDSFHGKYNNT

SEQ ID NO: 2789647 - protein, 23 aa, Entamoeba invadens
ERTWHISSEMFKCPSCGGQCDGQ

SEQ ID NO: 2789648 - protein, 18 aa, Entamoeba invadens
ERVDRGFTPYQLVLSRDD

SEQ ID NO: 2789649 - protein, 18 aa, Entamoeba invadens
ERVVDDLLLFPSAILNNL

SEQ ID NO: 2789650 - protein, 28 aa, Entamoeba invadens
ERWSRKKTTFKWTYIIVAVPVLAAVVFI

SEQ ID NO: 2789651 - protein, 17 aa, Entamoeba invadens
ERYELHKPLTLNNNLTL

SEQ ID NO: 2789652 - protein, 23 aa, Entamoeba invadens
ERYIEVRSLLALNTLNYLETELN

SEQ ID NO: 2789653 - protein, 22 aa, Entamoeba invadens
ESAKIPQFLLKKFQSLEISFEN

SEQ ID NO: 2789654 - protein, 25 aa, Entamoeba invadens
ESALRRLAISTGKIRPNEYIALSEQ

SEQ ID NO: 2789655 - protein, 26 aa, Entamoeba invadens
ESAYTIKEAYPFFIAVATMIGSFVLF

SEQ ID NO: 2789656 - protein, 18 aa, Entamoeba invadens
ESCQRYKALDVEDAEENM

SEQ ID NO: 2789657 - protein, 22 aa, Entamoeba invadens
ESCVKASMGYCIQCSESYFIGQ

SEQ ID NO: 2789658 - protein, 23 aa, Entamoeba invadens
ESDIPGCLELLISAQTTHVMFDL

SEQ ID NO: 2789659 - protein, 21 aa, Entamoeba invadens
ESDKIYSLFLGWRNLCSSVFI

SEQ ID NO: 2789660 - protein, 26 aa, Entamoeba invadens
ESDRKCLTCKYGFYQGKDYTCLSSTK

SEQ ID NO: 2789661 - protein, 25 aa, Entamoeba invadens
ESDSKCLSCIDGFYLTKEGTCSACN

SEQ ID NO: 2789662 - protein, 25 aa, Entamoeba invadens
ESDSKCLSCIDGFYLTKEGTCSGCN

SEQ ID NO: 2789663 - protein, 25 aa, Entamoeba invadens
ESDTKCLLCVFGYYQGDNYTCLPST

SEQ ID NO: 2789664 - protein, 26 aa, Entamoeba invadens
ESDTKCLSCKYGFYIGENYTCLPSTE

SEQ ID NO: 2789665 - protein, 22 aa, Entamoeba invadens
ESEEVIKMLLEKELNKLRKRVA

SEQ ID NO: 2789666 - protein, 18 aa, Entamoeba invadens
ESEISLKLLPILRAVTKS

SEQ ID NO: 2789667 - protein, 22 aa, Entamoeba invadens
ESEWKFLLRNIYIFMSSVSSLH

SEQ ID NO: 2789668 - protein, 19 aa, Entamoeba invadens
ESFATIGWGAFRGTGIQIF

SEQ ID NO: 2789669 - protein, 22 aa, Entamoeba invadens
ESFKGSCIDSHIEYMQNYGEYV

SEQ ID NO: 2789670 - protein, 23 aa, Entamoeba invadens
ESFNCNICLFGMYANTTNKKCQQ

SEQ ID NO: 2789671 - protein, 19 aa, Entamoeba invadens
ESFNSSFPLYVEQTEHPCL

SEQ ID NO: 2789672 - protein, 20 aa, Entamoeba invadens
ESFSIWGLPGKFRVEKSFNF

SEQ ID NO: 2789673 - protein, 22 aa, Entamoeba invadens
ESFSVIPLELQEYVVTYSSDIY

SEQ ID NO: 2789674 - protein, 19 aa, Entamoeba invadens
ESFYRMKRYEAIKDEMPVD

SEQ ID NO: 2789675 - protein, 22 aa, Entamoeba invadens
ESGCSLCKDGYYTVNGNECQKC

SEQ ID NO: 2789676 - protein, 17 aa, Entamoeba invadens
ESGMCKLVLNPFGGKRK

SEQ ID NO: 2789677 - protein, 26 aa, Entamoeba invadens
ESGTKCLKCKDGMFIINGDCLHSTID

SEQ ID NO: 2789678 - protein, 23 aa, Entamoeba invadens
ESGTVCYLCPNGFYTSKTGSSIC

SEQ ID NO: 2789679 - protein, 20 aa, Entamoeba invadens
ESGVDTVRWMEKEMKSNALI

SEQ ID NO: 2789680 - protein, 26 aa, Entamoeba invadens
ESGYCVSCPMGSIKNTKICSVCSGGT

SEQ ID NO: 2789681 - protein, 17 aa, Entamoeba invadens
ESHCTKLTSGFCTTCDS

SEQ ID NO: 2789682 - protein, 17 aa, Entamoeba invadens
ESHHCIFATKNFCVKCE

SEQ ID NO: 2789683 - protein, 33 aa, Entamoeba invadens
ESHPTAAAGMVLRGSYYRFYLNKPMHITVKTCT

SEQ ID NO: 2789684 - protein, 18 aa, Entamoeba invadens
ESIIGYVQKDCVEYSQYL

SEQ ID NO: 2789685 - protein, 21 aa, Entamoeba invadens
ESIILLFNCCVSLILGATFFY

SEQ ID NO: 2789686 - protein, 23 aa, Entamoeba invadens
ESIKAVVSKLEFEKTFSDLNGNV

SEQ ID NO: 2789687 - protein, 19 aa, Entamoeba invadens
ESILSEFSLTISVEQNQCV

SEQ ID NO: 2789688 - protein, 18 aa, Entamoeba invadens
ESIPNCLVRGYLPDTLTD

SEQ ID NO: 2789689 - protein, 18 aa, Entamoeba invadens
ESISRVGTYLKRNDKDSV

SEQ ID NO: 2789690 - protein, 19 aa, Entamoeba invadens
ESKCLLCNNNYFLANGVCQ

SEQ ID NO: 2789691 - protein, 23 aa, Entamoeba invadens
ESKDSKCVKCSFWNAPDSSGTYC

SEQ ID NO: 2789692 - protein, 25 aa, Entamoeba invadens
ESKFKCNRRPAVFQLKNPKNDLQKA

SEQ ID NO: 2789693 - protein, 20 aa, Entamoeba invadens
ESKGTVVWLGVDSLSKNFEK

SEQ ID NO: 2789694 - protein, 20 aa, Entamoeba invadens
ESKMKTCLYDVVDYISYAFG

SEQ ID NO: 2789695 - protein, 20 aa, Entamoeba invadens
ESKPLCYSCSVGCVTCIHAQ

SEQ ID NO: 2789696 - protein, 20 aa, Entamoeba invadens
ESKPLCYSCSVGCVTCTNLY

SEQ ID NO: 2789697 - protein, 20 aa, Entamoeba invadens
ESKTKMVIIVTAVVILCISV

SEQ ID NO: 2789698 - protein, 25 aa, Entamoeba invadens
ESKTRCLSCKNGFYQGENYTCLSST

SEQ ID NO: 2789699 - protein, 25 aa, Entamoeba invadens
ESLGELTSKCYLTLPTGGGCAICND

SEQ ID NO: 2789700 - protein, 22 aa, Entamoeba invadens
ESLTTSCGLYFLQNKLLLRYGK

SEQ ID NO: 2789701 - protein, 32 aa, Entamoeba invadens
ESMNWKGYLLMLIPAFCDFLATYLMNFGLIWV

SEQ ID NO: 2789702 - protein, 20 aa, Entamoeba invadens
ESNKCKKCNDGHCNDCTDNN

SEQ ID NO: 2789703 - protein, 24 aa, Entamoeba invadens
ESNRKCAICNNGYYLDNNMCSLCN

SEQ ID NO: 2789704 - protein, 20 aa, Entamoeba invadens
ESNSGFIFTERLPMYTTVKD

SEQ ID NO: 2789705 - protein, 19 aa, Entamoeba invadens
ESNYIKESECLSCEIEHCT

SEQ ID NO: 2789706 - protein, 25 aa, Entamoeba invadens
ESNYIKESECLSCEIEHCTSCLEDL

SEQ ID NO: 2789707 - protein, 22 aa, Entamoeba invadens
ESPCLSTFVQIFERGCVIDFTG

SEQ ID NO: 2789708 - protein, 19 aa, Entamoeba invadens
ESPIAEGAMGKVYIGNYRS

SEQ ID NO: 2789709 - protein, 17 aa, Entamoeba invadens
ESPYLLWESNKGNTYYV

SEQ ID NO: 2789710 - protein, 32 aa, Entamoeba invadens
ESQFMYFHFGSGFPMPSHLIMKGVDKIEISVK

SEQ ID NO: 2789711 - protein, 24 aa, Entamoeba invadens
ESQRDRCGFLSPIKVVFSKVFGAV

SEQ ID NO: 2789712 - protein, 19 aa, Entamoeba invadens
ESRDLICIGNISKYEMKVQ

SEQ ID NO: 2789713 - protein, 17 aa, Entamoeba invadens
ESRELFCVGNFGKNTIK

SEQ ID NO: 2789714 - protein, 20 aa, Entamoeba invadens
ESRELICLGNTTSHRLKIQM

SEQ ID NO: 2789715 - protein, 17 aa, Entamoeba invadens
ESRELICVGNLTERTLK

SEQ ID NO: 2789716 - protein, 22 aa, Entamoeba invadens
ESRPFKTIQACVATLSQTTVPS

SEQ ID NO: 2789717 - protein, 18 aa, Entamoeba invadens
ESRPKECPNGMTDNYKEP

SEQ ID NO: 2789718 - protein, 28 aa, Entamoeba invadens
ESRRCLSCSVASCSRCDTTGKCIECNTS

SEQ ID NO: 2789719 - protein, 27 aa, Entamoeba invadens
ESRRCLSCSVASCSRCDTTGKCVECNT

SEQ ID NO: 2789720 - protein, 26 aa, Entamoeba invadens
ESSCKICDSKSLLKNGVCTLQNRVIL

SEQ ID NO: 2789721 - protein, 20 aa, Entamoeba invadens
ESSCVLCKENLYLSNGKCLK

SEQ ID NO: 2789722 - protein, 21 aa, Entamoeba invadens
ESSECKVCGDGFYSLAGYSKC

SEQ ID NO: 2789723 - protein, 22 aa, Entamoeba invadens
ESSELLFIDSFVIVQMVNNGKV

SEQ ID NO: 2789724 - protein, 24 aa, Entamoeba invadens
ESSENRLSLTFSKIVQKSNYCEFL

SEQ ID NO: 2789725 - protein, 20 aa, Entamoeba invadens
ESSGLFWVVPVITFPIIIGL

SEQ ID NO: 2789726 - protein, 17 aa, Entamoeba invadens
ESSHLAKVMGFSFDPMF

SEQ ID NO: 2789727 - protein, 21 aa, Entamoeba invadens
ESSLSRFVLKSSGNVKVHYFN

SEQ ID NO: 2789728 - protein, 25 aa, Entamoeba invadens
ESSSRCIYCPPGTYTDKAGSSTCYD

SEQ ID NO: 2789729 - protein, 24 aa, Entamoeba invadens
ESSVFECHFSFKGSPDTEFAEGIY

SEQ ID NO: 2789730 - protein, 19 aa, Entamoeba invadens
ESSYQLWLVPFYVGLIFNI

SEQ ID NO: 2789731 - protein, 26 aa, Entamoeba invadens
ESTCKQCYPLCLECFGGSNGNCTSCK

SEQ ID NO: 2789732 - protein, 17 aa, Entamoeba invadens
ESTCKTCSLTQTKCTSC

SEQ ID NO: 2789733 - protein, 24 aa, Entamoeba invadens
ESTCLLCNSNYFLANGICQQTTRC

SEQ ID NO: 2789734 - protein, 20 aa, Entamoeba invadens
ESTCSKCFDGYYYKEDDKTC

SEQ ID NO: 2789735 - protein, 20 aa, Entamoeba invadens
ESTECQYIFNYLGVSVKPTL

SEQ ID NO: 2789736 - protein, 24 aa, Entamoeba invadens
ESTFKGCTSLEVVMSFDKIKEFGI

SEQ ID NO: 2789737 - protein, 25 aa, Entamoeba invadens
ESTLPFTHLDFFKYFLSDKSKETQK

SEQ ID NO: 2789738 - protein, 19 aa, Entamoeba invadens
ESTMSLLMFAFGFLCCCLW

SEQ ID NO: 2789739 - protein, 18 aa, Entamoeba invadens
ESVFCSKIYPVLHQQFCA

SEQ ID NO: 2789740 - protein, 22 aa, Entamoeba invadens
ESVIKIGLSLAVSVIPEGLVAV

SEQ ID NO: 2789741 - protein, 31 aa, Entamoeba invadens
ESVINCEFYTLGMCKKCLFGDKTTDYQICDT

SEQ ID NO: 2789742 - protein, 23 aa, Entamoeba invadens
ESVKCGGLWNGNKIGIMNEHDNL

SEQ ID NO: 2789743 - protein, 24 aa, Entamoeba invadens
ESVLCFKWGYPMYKDIPTPPLVKW

SEQ ID NO: 2789744 - protein, 33 aa, Entamoeba invadens
ESVLRMVFMSENFRTIIIWDLMKVFVDLMETDV

SEQ ID NO: 2789745 - protein, 19 aa, Entamoeba invadens
ESVMSFLFGITLKRKYVPW

SEQ ID NO: 2789746 - protein, 18 aa, Entamoeba invadens
ESVPSIFGLIGLPVVIFF

SEQ ID NO: 2789747 - protein, 30 aa, Entamoeba invadens
ESVQGGVYSECVPIRPFLSYLKASINNKSL

SEQ ID NO: 2789748 - protein, 26 aa, Entamoeba invadens
ESVTFPSYLLTIWDRCFEFCMSLKSI

SEQ ID NO: 2789749 - protein, 19 aa, Entamoeba invadens
ESYCPCSNKYCYMTPLTNI

SEQ ID NO: 2789750 - protein, 18 aa, Entamoeba invadens
ESYVNFTSVFNCEIINSD

SEQ ID NO: 2789751 - protein, 18 aa, Entamoeba invadens
ETCATDFSRVCISCKAGS

SEQ ID NO: 2789752 - protein, 18 aa, Entamoeba invadens
ETCKNCYNSSTIGSFYTE

SEQ ID NO: 2789753 - protein, 21 aa, Entamoeba invadens
ETCNLFFFFEESIFFQQSLSF

SEQ ID NO: 2789754 - protein, 23 aa, Entamoeba invadens
ETCNTTSCLSCITNYILTNENTC

SEQ ID NO: 2789755 - protein, 28 aa, Entamoeba invadens
ETCSTVGGLCLLEGLSLQTDTIKFPENE

SEQ ID NO: 2789756 - protein, 26 aa, Entamoeba invadens
ETDCYKCKSGLFLRDGKWLNCGDLYE

SEQ ID NO: 2789757 - protein, 24 aa, Entamoeba invadens
ETDFKSVLVPSHFQNRELDDISNI

SEQ ID NO: 2789758 - protein, 23 aa, Entamoeba invadens
ETDWKIRHTIPFTQVTDKQDLPL

SEQ ID NO: 2789759 - protein, 17 aa, Entamoeba invadens
ETECFECNEYSFFMVEL

SEQ ID NO: 2789760 - protein, 17 aa, Entamoeba invadens
ETETCYFAPISSVMEFD

SEQ ID NO: 2789761 - protein, 24 aa, Entamoeba invadens
ETETKLSFFYSIEILMNNDFREFI

SEQ ID NO: 2789762 - protein, 20 aa, Entamoeba invadens
ETFAPKGLQTFTLNAKVNTV

SEQ ID NO: 2789763 - protein, 26 aa, Entamoeba invadens
ETFFDARLANCFDDYVLPIMTLQTAI

SEQ ID NO: 2789764 - protein, 25 aa, Entamoeba invadens
ETFKEIVLFLRFVVDTFFLTQNERD

SEQ ID NO: 2789765 - protein, 23 aa, Entamoeba invadens
ETFLKAKKGISFLQGIKEDEMKR

SEQ ID NO: 2789766 - protein, 19 aa, Entamoeba invadens
ETFLYFPLINVLIQPINLV

SEQ ID NO: 2789767 - protein, 25 aa, Entamoeba invadens
ETFSIPHCLIYKGYACDKCENGYYK

SEQ ID NO: 2789768 - protein, 18 aa, Entamoeba invadens
ETFSWKDPFPKVKFGYAW

SEQ ID NO: 2789769 - protein, 18 aa, Entamoeba invadens
ETFYFFCELMEIMGDWFK

SEQ ID NO: 2789770 - protein, 21 aa, Entamoeba invadens
ETHGKLTFFIEIVEKDKCDFK

SEQ ID NO: 2789771 - protein, 17 aa, Entamoeba invadens
ETIEFLIRGGIKVWMIT

SEQ ID NO: 2789772 - protein, 24 aa, Entamoeba invadens
ETIKCSSCGIGYYINNNECKLCGN

SEQ ID NO: 2789773 - protein, 18 aa, Entamoeba invadens
ETILSFDFQSKVLNYSEV

SEQ ID NO: 2789774 - protein, 22 aa, Entamoeba invadens
ETKARASIKLFKEMTTEMKKSS

SEQ ID NO: 2789775 - protein, 22 aa, Entamoeba invadens
ETKCLSCKSGYYQGEDYTYISY

SEQ ID NO: 2789776 - protein, 19 aa, Entamoeba invadens
ETKCTSCYDHFYLNSYTCS

SEQ ID NO: 2789777 - protein, 25 aa, Entamoeba invadens
ETKDECYECNSGFMLNDYKCLPLID

SEQ ID NO: 2789778 - protein, 18 aa, Entamoeba invadens
ETKEFKFDISAQKATTGD

SEQ ID NO: 2789779 - protein, 27 aa, Entamoeba invadens
ETKHNVKLLKIFQCALLSANMNVVEAA

SEQ ID NO: 2789780 - protein, 23 aa, Entamoeba invadens
ETKKCEDGTCLKSPNEAYKCNEL

SEQ ID NO: 2789781 - protein, 21 aa, Entamoeba invadens
ETKKCKECEAGEIFNNVTHLC

SEQ ID NO: 2789782 - protein, 20 aa, Entamoeba invadens
ETKLVFLVMLDKKFRMLEAF

SEQ ID NO: 2789783 - protein, 24 aa, Entamoeba invadens
ETKSSKCVMCRDGFLNNNGMCVED

SEQ ID NO: 2789784 - protein, 20 aa, Entamoeba invadens
ETLKGIPPLNSKFIKSLVLQ

SEQ ID NO: 2789785 - protein, 24 aa, Entamoeba invadens
ETLNLSFALGMRFQDGRSETTTLA

SEQ ID NO: 2789786 - protein, 20 aa, Entamoeba invadens
ETLQRMNYIFTFPTEYSTAV

SEQ ID NO: 2789787 - protein, 23 aa, Entamoeba invadens
ETLRNHPNVFAWYVDDETALCGI

SEQ ID NO: 2789788 - protein, 20 aa, Entamoeba invadens
ETLTCYKREGFIKYSTNLYN

SEQ ID NO: 2789789 - protein, 19 aa, Entamoeba invadens
ETLTSLLLFDKTNAEVRQY

SEQ ID NO: 2789790 - protein, 19 aa, Entamoeba invadens
ETLYVIFFFILKNLRDTLI

SEQ ID NO: 2789791 - protein, 23 aa, Entamoeba invadens
ETMNCEVSWDFGCVRCSESFYSS

SEQ ID NO: 2789792 - protein, 26 aa, Entamoeba invadens
ETMRGFNVYFILNWTTGEHKSSSIYT

SEQ ID NO: 2789793 - protein, 20 aa, Entamoeba invadens
ETNATCLACSTIDKCVTCES

SEQ ID NO: 2789794 - protein, 19 aa, Entamoeba invadens
ETNCLSCIEGTFLTESEIC

SEQ ID NO: 2789795 - protein, 23 aa, Entamoeba invadens
ETNLIKALIILYKFDDTTPQTEI

SEQ ID NO: 2789796 - protein, 24 aa, Entamoeba invadens
ETNLKEVFVPKEIVGKDPIQLRGT

SEQ ID NO: 2789797 - protein, 24 aa, Entamoeba invadens
ETNLRYLSLDAMCSMSAIGCSKEL

SEQ ID NO: 2789798 - protein, 19 aa, Entamoeba invadens
ETNNYLFLKGSFHLITSPT

SEQ ID NO: 2789799 - protein, 20 aa, Entamoeba invadens
ETNTRLFALQVMSSAIHNQW

SEQ ID NO: 2789800 - protein, 24 aa, Entamoeba invadens
ETPDYRFFFIYSIYYYNTTNIIFF

SEQ ID NO: 2789801 - protein, 24 aa, Entamoeba invadens
ETPTECYEIIQSCWDQNPKERLQI

SEQ ID NO: 2789802 - protein, 17 aa, Entamoeba invadens
ETQRLFVTILMKVAKSE

SEQ ID NO: 2789803 - protein, 22 aa, Entamoeba invadens
ETQRSYIGWGISKRPNYVQVEK

SEQ ID NO: 2789804 - protein, 23 aa, Entamoeba invadens
ETRCLECMDHFYLSNYNCNGCES

SEQ ID NO: 2789805 - protein, 18 aa, Entamoeba invadens
ETRFLYTVLVSNWVFEYY

SEQ ID NO: 2789806 - protein, 26 aa, Entamoeba invadens
ETRGLESFPLFIGVSYIEISSYIVVN

SEQ ID NO: 2789807 - protein, 26 aa, Entamoeba invadens
ETSERICGLLFHLRQALTISSLPILK

SEQ ID NO: 2789808 - protein, 21 aa, Entamoeba invadens
ETSGVIKVDFTLSRLETHADI

SEQ ID NO: 2789809 - protein, 19 aa, Entamoeba invadens
ETSKLYLLENATVFSEKDI

SEQ ID NO: 2789810 - protein, 24 aa, Entamoeba invadens
ETSNLKMLLTLSVRCEYPCTQCSN

SEQ ID NO: 2789811 - protein, 21 aa, Entamoeba invadens
ETSRLFKLVIGCVEDVCGTEW

SEQ ID NO: 2789812 - protein, 24 aa, Entamoeba invadens
ETSTKCLSCPQNTYLSNYKCNTNE

SEQ ID NO: 2789813 - protein, 19 aa, Entamoeba invadens
ETSYKPDAFTFEWSLLYII

SEQ ID NO: 2789814 - protein, 21 aa, Entamoeba invadens
ETTARTGLVFISLRGLFVLFS

SEQ ID NO: 2789815 - protein, 19 aa, Entamoeba invadens
ETTCLLCKEGYIMTNGSCV

SEQ ID NO: 2789816 - protein, 24 aa, Entamoeba invadens
ETTCLSCKSGMYLSDYKCNTNKDL

SEQ ID NO: 2789817 - protein, 17 aa, Entamoeba invadens
ETTDCYFVPFSNSLNTP

SEQ ID NO: 2789818 - protein, 24 aa, Entamoeba invadens
ETTKMPFPTWAYKNNNKCLPKKCL

SEQ ID NO: 2789819 - protein, 24 aa, Entamoeba invadens
ETTQQLALCIGNLKGDEVALAQIL

SEQ ID NO: 2789820 - protein, 27 aa, Entamoeba invadens
ETTQSKCSKCSFWYVPNEDGMSCKSRA

SEQ ID NO: 2789821 - protein, 18 aa, Entamoeba invadens
ETTTSFCACIVRKELLPF

SEQ ID NO: 2789822 - protein, 24 aa, Entamoeba invadens
ETVIPILRFILKPTQYTGLLTVTQ

SEQ ID NO: 2789823 - protein, 17 aa, Entamoeba invadens
ETVMQRRGFPHIVTALQ

SEQ ID NO: 2789824 - protein, 21 aa, Entamoeba invadens
ETVNGCLHNDFLVANKRTDHA

SEQ ID NO: 2789825 - protein, 31 aa, Entamoeba invadens
ETWNIKLAILSLCFSSLLILTLLLQIYSTNS

SEQ ID NO: 2789826 - protein, 20 aa, Entamoeba invadens
ETYCIREVVMVLSQRNLSLV

SEQ ID NO: 2789827 - protein, 22 aa, Entamoeba invadens
ETYCISCLYGNYLTSSMTCLTL

SEQ ID NO: 2789828 - protein, 19 aa, Entamoeba invadens
ETYLNDGKCELCNTTHIGC

SEQ ID NO: 2789829 - protein, 17 aa, Entamoeba invadens
ETYRFRCVVKHGVGVLD

SEQ ID NO: 2789830 - protein, 20 aa, Entamoeba invadens
ETYSKILLLESFKKLKYQLI

SEQ ID NO: 2789831 - protein, 23 aa, Entamoeba invadens
EVAHCKRAKNSICAYCSPSKKPS

SEQ ID NO: 2789832 - protein, 27 aa, Entamoeba invadens
EVALGIPYSCAIDMWSLGCLTAVFYFG

SEQ ID NO: 2789833 - protein, 22 aa, Entamoeba invadens
EVAMLDKFRCEFIIHFYGAVFI

SEQ ID NO: 2789834 - protein, 24 aa, Entamoeba invadens
EVAMLDKFRCEYIIHFYGACFMPN

SEQ ID NO: 2789835 - protein, 22 aa, Entamoeba invadens
EVASVIECYYHILLPTEGITSS

SEQ ID NO: 2789836 - protein, 21 aa, Entamoeba invadens
EVASWAPAFPANRFKHPWDVA

SEQ ID NO: 2789837 - protein, 19 aa, Entamoeba invadens
EVAYPSWIFFSMNYGAYLV

SEQ ID NO: 2789838 - protein, 22 aa, Entamoeba invadens
EVAYRCCGFKSFQQDGCAFYPI

SEQ ID NO: 2789839 - protein, 22 aa, Entamoeba invadens
EVCKNIIEMVYLIYHFGHQKVT

SEQ ID NO: 2789840 - protein, 20 aa, Entamoeba invadens
EVCPNFASICIKYGNNTYTL

SEQ ID NO: 2789841 - protein, 30 aa, Entamoeba invadens
EVCVLQIRECFSLFLYHFGLLLATNIPYRA

SEQ ID NO: 2789842 - protein, 26 aa, Entamoeba invadens
EVDDIWKKITIGFGVVSGVLLIVVIG

SEQ ID NO: 2789843 - protein, 23 aa, Entamoeba invadens
EVDIKIRVKMMIDGAKGILYLHN

SEQ ID NO: 2789844 - protein, 24 aa, Entamoeba invadens
EVDIKVRIKLMLDGAKGIYYLHEN

SEQ ID NO: 2789845 - protein, 24 aa, Entamoeba invadens
EVDMKLRIKMMLDASRGIFYLHEN

SEQ ID NO: 2789846 - protein, 23 aa, Entamoeba invadens
EVDMKLRTKFLLDASKGIQYLHE

SEQ ID NO: 2789847 - protein, 20 aa, Entamoeba invadens
EVDMKLRVKMLLDAAKGILY

SEQ ID NO: 2789848 - protein, 25 aa, Entamoeba invadens
EVDMKMRIKFCLDAAKGIQYLHTNG

SEQ ID NO: 2789849 - protein, 17 aa, Entamoeba invadens
EVDRFRVMEIIQEVKNV

SEQ ID NO: 2789850 - protein, 23 aa, Entamoeba invadens
EVFDVPSNIPLIINTESLTMKIS

SEQ ID NO: 2789851 - protein, 22 aa, Entamoeba invadens
EVFKSVNVFELFLWNQKNSKSQ

SEQ ID NO: 2789852 - protein, 18 aa, Entamoeba invadens
EVFLTPFCTMNLCDEIMI

SEQ ID NO: 2789853 - protein, 17 aa, Entamoeba invadens
EVFPVINGKVVRQPQSV

SEQ ID NO: 2789854 - protein, 19 aa, Entamoeba invadens
EVFSSDCQAIIPSRKILGY

SEQ ID NO: 2789855 - protein, 43 aa, Entamoeba invadens
EVFSSFTRKCFSDCFICTDFNYRPQLFNSFFFRFERGQNGIGQ

SEQ ID NO: 2789856 - protein, 21 aa, Entamoeba invadens
EVGCLQCKDGFYTENTKCVRC

SEQ ID NO: 2789857 - protein, 21 aa, Entamoeba invadens
EVGRLPLSVYFNYIKSGSFIL

SEQ ID NO: 2789858 - protein, 24 aa, Entamoeba invadens
EVGYSKCTKCSFWHTPSANGTFCK

SEQ ID NO: 2789859 - protein, 21 aa, Entamoeba invadens
EVHFTRGKWLLFTREERLYHV

SEQ ID NO: 2789860 - protein, 21 aa, Entamoeba invadens
EVIAMKEWYLKETKFNKTIIG

SEQ ID NO: 2789861 - protein, 19 aa, Entamoeba invadens
EVICDCWKQYSSKRLTTEK

SEQ ID NO: 2789862 - protein, 28 aa, Entamoeba invadens
EVICHPITCVYKFKGFNMKSCPMAERNV

SEQ ID NO: 2789863 - protein, 18 aa, Entamoeba invadens
EVICKLKFIDGINDFNML

SEQ ID NO: 2789864 - protein, 18 aa, Entamoeba invadens
EVIEQCWRQDPTERYTST

SEQ ID NO: 2789865 - protein, 21 aa, Entamoeba invadens
EVIGIPISVVFVLIIKKEQNI

SEQ ID NO: 2789866 - protein, 18 aa, Entamoeba invadens
EVIKETPESIALDALLSI

SEQ ID NO: 2789867 - protein, 23 aa, Entamoeba invadens
EVIMKMRIKLMLDTAKGIQYLHA

SEQ ID NO: 2789868 - protein, 20 aa, Entamoeba invadens
EVITLFLSLPFFKTVMFFGL

SEQ ID NO: 2789869 - protein, 17 aa, Entamoeba invadens
EVKHYLPTVPVFLVGTQ

SEQ ID NO: 2789870 - protein, 19 aa, Entamoeba invadens
EVKMKIRVKMMLDGARGIL

SEQ ID NO: 2789871 - protein, 21 aa, Entamoeba invadens
EVKPQELVNVVLQIPKAKKKE

SEQ ID NO: 2789872 - protein, 22 aa, Entamoeba invadens
EVKRLNCSITQFVDVSQQNVTC

SEQ ID NO: 2789873 - protein, 25 aa, Entamoeba invadens
EVKSSKCTKCDFWYETGETQTSCDK

SEQ ID NO: 2789874 - protein, 24 aa, Entamoeba invadens
EVKSSKCTKCDFWYETGVTQTSCD

SEQ ID NO: 2789875 - protein, 20 aa, Entamoeba invadens
EVLDGFQLDIRVGQIVEAGP

SEQ ID NO: 2789876 - protein, 21 aa, Entamoeba invadens
EVLDMVLFVGVWVGMFLLILF

SEQ ID NO: 2789877 - protein, 27 aa, Entamoeba invadens
EVLKTGLKCVMCNTASWLDNDICNSLV

SEQ ID NO: 2789878 - protein, 25 aa, Entamoeba invadens
EVLSKMFVMLCSNATILNRKLVCVD

SEQ ID NO: 2789879 - protein, 19 aa, Entamoeba invadens
EVLSRVIIVMNMITVEMLD

SEQ ID NO: 2789880 - protein, 19 aa, Entamoeba invadens
EVLTWKDPFPKEKFRFPWS

SEQ ID NO: 2789881 - protein, 19 aa, Entamoeba invadens
EVMDLVTLIGKYSIKPSTL

SEQ ID NO: 2789882 - protein, 23 aa, Entamoeba invadens
EVMGKRWVDWILPTVVPGDGIHF

SEQ ID NO: 2789883 - protein, 27 aa, Entamoeba invadens
EVMGTLKICSFSVFFASDEQSFPIRRI

SEQ ID NO: 2789884 - protein, 19 aa, Entamoeba invadens
EVMIVKFLEYMLFDVGADF

SEQ ID NO: 2789885 - protein, 19 aa, Entamoeba invadens
EVMPIFSALVEKISPQGIN

SEQ ID NO: 2789886 - protein, 20 aa, Entamoeba invadens
EVNESAKLFKVVMKDSFIIF

SEQ ID NO: 2789887 - protein, 19 aa, Entamoeba invadens
EVNGLKLEPNFDLTQNIFD

SEQ ID NO: 2789888 - protein, 19 aa, Entamoeba invadens
EVNLSFLFDSTVGYVMEIS

SEQ ID NO: 2789889 - protein, 21 aa, Entamoeba invadens
EVNMFLKIFYQLEMVKTAQFT

SEQ ID NO: 2789890 - protein, 23 aa, Entamoeba invadens
EVNMKLRVKMMIDAAKGIFYLHE

SEQ ID NO: 2789891 - protein, 19 aa, Entamoeba invadens
EVNNLIGIFKKCETKTVDG

SEQ ID NO: 2789892 - protein, 19 aa, Entamoeba invadens
EVNTFFWRQQREVKTYIEC

SEQ ID NO: 2789893 - protein, 25 aa, Entamoeba invadens
EVNTFSVTVLREFESTTVFQTKSIL

SEQ ID NO: 2789894 - protein, 19 aa, Entamoeba invadens
EVPIMLIVTDFDMYRSSTN

SEQ ID NO: 2789895 - protein, 20 aa, Entamoeba invadens
EVPSGVTLSEEYTFLNILSK

SEQ ID NO: 2789896 - protein, 20 aa, Entamoeba invadens
EVPTGYKLVVEAANFDMSTL

SEQ ID NO: 2789897 - protein, 18 aa, Entamoeba invadens
EVQCGSFVSHGHDILAIK

SEQ ID NO: 2789898 - protein, 20 aa, Entamoeba invadens
EVQWSVKNCIIIPVGALFAG

SEQ ID NO: 2789899 - protein, 19 aa, Entamoeba invadens
EVRGWKNFTLFGAGTFILI

SEQ ID NO: 2789900 - protein, 18 aa, Entamoeba invadens
EVRINGICSPRCPQDKQR

SEQ ID NO: 2789901 - protein, 24 aa, Entamoeba invadens
EVRSVCVLPTCYPLIRGVLQNIDR

SEQ ID NO: 2789902 - protein, 20 aa, Entamoeba invadens
EVSALLLRMGNLHFESLWLM

SEQ ID NO: 2789903 - protein, 23 aa, Entamoeba invadens
EVSEPCLRVLKELDMLKTPESCL

SEQ ID NO: 2789904 - protein, 17 aa, Entamoeba invadens
EVSFSLMIAIILNYLRY

SEQ ID NO: 2789905 - protein, 19 aa, Entamoeba invadens
EVSGTLFGLLFEFLLENEI

SEQ ID NO: 2789906 - protein, 22 aa, Entamoeba invadens
EVSMLDKFRCEYIVHFYGACFL

SEQ ID NO: 2789907 - protein, 24 aa, Entamoeba invadens
EVSNSTFMRWQVWQVNRNGEGAMY

SEQ ID NO: 2789908 - protein, 24 aa, Entamoeba invadens
EVSYAQSVSLLWVKYDVMGDSVTM

SEQ ID NO: 2789909 - protein, 24 aa, Entamoeba invadens
EVTMKLRLKIMLDAAKGISYLHEN

SEQ ID NO: 2789910 - protein, 22 aa, Entamoeba invadens
EVTRGVSRMSAFQMCESTNITF

SEQ ID NO: 2789911 - protein, 26 aa, Entamoeba invadens
EVTVIRGFCFYECVALTSVQFPQQIR

SEQ ID NO: 2789912 - protein, 23 aa, Entamoeba invadens
EVVEFPPRDVMIAEIKSSKKAID

SEQ ID NO: 2789913 - protein, 17 aa, Entamoeba invadens
EVVEYSITLLAEQSECV

SEQ ID NO: 2789914 - protein, 19 aa, Entamoeba invadens
EVVFEKCVIFTKPKDNWMT

SEQ ID NO: 2789915 - protein, 20 aa, Entamoeba invadens
EVVKPHPQFMLFATQNPPNT

SEQ ID NO: 2789916 - protein, 23 aa, Entamoeba invadens
EVVKRRRCLQLFGGMNEGALEKQ

SEQ ID NO: 2789917 - protein, 36 aa, Entamoeba invadens
EVVLLIKKLEAFPLMFSTGASVSWPEGTIKIVVDPS

SEQ ID NO: 2789918 - protein, 22 aa, Entamoeba invadens
EVVLRCTNGIYNKTSQRCEDPT

SEQ ID NO: 2789919 - protein, 25 aa, Entamoeba invadens
EVVNLLLDVLFEFGVVLLNARDESD

SEQ ID NO: 2789920 - protein, 19 aa, Entamoeba invadens
EVVTLKSGYACEFSVYVKP

SEQ ID NO: 2789921 - protein, 17 aa, Entamoeba invadens
EVVTLTFPKDLEIKTNR

SEQ ID NO: 2789922 - protein, 20 aa, Entamoeba invadens
EVYCDICTIGYFPEAVCKNC

SEQ ID NO: 2789923 - protein, 27 aa, Entamoeba invadens
EVYPKSEFKFAWSVADFVTSGKRRPCL

SEQ ID NO: 2789924 - protein, 17 aa, Entamoeba invadens
EWIGSLNLTHTWNSLSF

SEQ ID NO: 2789925 - protein, 20 aa, Entamoeba invadens
EWKNPEFGEWCMEKIIGTEK

SEQ ID NO: 2789926 - protein, 21 aa, Entamoeba invadens
EWKSLILSRFMKILQYSNQKI

SEQ ID NO: 2789927 - protein, 23 aa, Entamoeba invadens
EWQTKPPKAMIVLLHGYCGHSGR

SEQ ID NO: 2789928 - protein, 20 aa, Entamoeba invadens
EWSNKIWMRKGFGQKVSDGY

SEQ ID NO: 2789929 - protein, 20 aa, Entamoeba invadens
EYCDGCAKRLVIPAEVSDSP

SEQ ID NO: 2789930 - protein, 19 aa, Entamoeba invadens
EYDDILKKNVQFVVQSQTF

SEQ ID NO: 2789931 - protein, 25 aa, Entamoeba invadens
EYDLLLRFVQTLGMIPISMLTNGPK

SEQ ID NO: 2789932 - protein, 24 aa, Entamoeba invadens
EYDMKSGETIYVFVGAYKNTEDGL

SEQ ID NO: 2789933 - protein, 25 aa, Entamoeba invadens
EYDRCYACGSTVIFGSIDGNVQVNG

SEQ ID NO: 2789934 - protein, 18 aa, Entamoeba invadens
EYECSNCFKSVPNCKKCT

SEQ ID NO: 2789935 - protein, 26 aa, Entamoeba invadens
EYETRFSLRVTPSCAILKKGEACEFH

SEQ ID NO: 2789936 - protein, 17 aa, Entamoeba invadens
EYFGDGCERKCFFNNKW

SEQ ID NO: 2789937 - protein, 20 aa, Entamoeba invadens
EYFNGGSLFNYIAKHQTLSW

SEQ ID NO: 2789938 - protein, 26 aa, Entamoeba invadens
EYFNVPKLNIGMGVWAFPDNIRIYKN

SEQ ID NO: 2789939 - protein, 22 aa, Entamoeba invadens
EYFPQIWLTFRTKECGSMSFTT

SEQ ID NO: 2789940 - protein, 25 aa, Entamoeba invadens
EYFVSESSCKRCLSPCGQCLSESRC

SEQ ID NO: 2789941 - protein, 19 aa, Entamoeba invadens
EYFYVPGMSVFEIVLGVGI

SEQ ID NO: 2789942 - protein, 21 aa, Entamoeba invadens
EYGVCKRCINGYYLDETKCAP

SEQ ID NO: 2789943 - protein, 20 aa, Entamoeba invadens
EYIIHFYGACFIPNHICMVT

SEQ ID NO: 2789944 - protein, 17 aa, Entamoeba invadens
EYIIHFYGACFITNHIC

SEQ ID NO: 2789945 - protein, 17 aa, Entamoeba invadens
EYIIHFYGACVIPNHIC

SEQ ID NO: 2789946 - protein, 25 aa, Entamoeba invadens
EYIILRPLFNKVLPFDIPKKKRRER

SEQ ID NO: 2789947 - protein, 17 aa, Entamoeba invadens
EYILKFDKYTSILNIHE

SEQ ID NO: 2789948 - protein, 23 aa, Entamoeba invadens
EYIPKLLTFSGHVLASVRTAVME

SEQ ID NO: 2789949 - protein, 17 aa, Entamoeba invadens
EYIRRWNTRRRLRLIEF

SEQ ID NO: 2789950 - protein, 19 aa, Entamoeba invadens
EYITHFYGAVFIRSKECMV

SEQ ID NO: 2789951 - protein, 24 aa, Entamoeba invadens
EYKFKCVYSGSTRCGELVIFDQQV

SEQ ID NO: 2789952 - protein, 21 aa, Entamoeba invadens
EYKILFKWYDGPLIEAMKTGE

SEQ ID NO: 2789953 - protein, 19 aa, Entamoeba invadens
EYLEHCLQTVLKFQSDKNV

SEQ ID NO: 2789954 - protein, 25 aa, Entamoeba invadens
EYLISDCPIDFLTLPPVIFAKQVTL

SEQ ID NO: 2789955 - protein, 18 aa, Entamoeba invadens
EYLQAGTILYFKNEDDLF

SEQ ID NO: 2789956 - protein, 18 aa, Entamoeba invadens
EYLQAGTILYFKNENDLF

SEQ ID NO: 2789957 - protein, 25 aa, Entamoeba invadens
EYLVMCWTSTFSIIFLINIFVPGKS

SEQ ID NO: 2789958 - protein, 29 aa, Entamoeba invadens
EYMKWLRKRVVDLMAVFPSYMRVKRFIIV

SEQ ID NO: 2789959 - protein, 24 aa, Entamoeba invadens
EYNYLQRISFKEVHDILTKIFEEK

SEQ ID NO: 2789960 - protein, 20 aa, Entamoeba invadens
EYPIFASFLIFYKDKKKPTF

SEQ ID NO: 2789961 - protein, 25 aa, Entamoeba invadens
EYPVRSMAVYGGRVLCGINRQLRMY

SEQ ID NO: 2789962 - protein, 18 aa, Entamoeba invadens
EYQRRVHRAVLFFYNNTI

SEQ ID NO: 2789963 - protein, 24 aa, Entamoeba invadens
EYQTCSKCSFSYRVSSSGNSCEYS

SEQ ID NO: 2789964 - protein, 18 aa, Entamoeba invadens
EYRTFKFKDGAVINLKTL

SEQ ID NO: 2789965 - protein, 19 aa, Entamoeba invadens
EYSRKISWLIEKFPVDLRP

SEQ ID NO: 2789966 - protein, 23 aa, Entamoeba invadens
EYTCWKYNCGKTGTFYQGDCVQK

SEQ ID NO: 2789967 - protein, 20 aa, Entamoeba invadens
EYTGNLAVVYCYLKSGDEMT

SEQ ID NO: 2789968 - protein, 24 aa, Entamoeba invadens
EYVEEYYQLFILFFGQLLTSLQVF

SEQ ID NO: 2789969 - protein, 31 aa, Entamoeba invadens
EYYECSKTFKGYRPCAPGTKCTASERVDYGY

SEQ ID NO: 2789970 - protein, 22 aa, Entamoeba invadens
EYYEEFVNFILLSGVEQNISKN

SEQ ID NO: 2789971 - protein, 20 aa, Entamoeba invadens
FAAFMVEPFCGKTIPAIGMS

SEQ ID NO: 2789972 - protein, 18 aa, Entamoeba invadens
FAAGDKLGVPRMMDVEDF

SEQ ID NO: 2789973 - protein, 22 aa, Entamoeba invadens
FAAIILPFGLCWYNQDEDNTFC

SEQ ID NO: 2789974 - protein, 18 aa, Entamoeba invadens
FAAQVIMWTDWVATLLSM

SEQ ID NO: 2789975 - protein, 17 aa, Entamoeba invadens
FAAYGSLYGYRTKTRRE

SEQ ID NO: 2789976 - protein, 22 aa, Entamoeba invadens
FACGLCNNFFLNSLWTFPQNVD

SEQ ID NO: 2789977 - protein, 21 aa, Entamoeba invadens
FACIYIWMFLYTVGHSYKKNL

SEQ ID NO: 2789978 - protein, 17 aa, Entamoeba invadens
FADCYFENFTVNEQIVD

SEQ ID NO: 2789979 - protein, 22 aa, Entamoeba invadens
FADEGFIGVDFFIPEPEPDPET

SEQ ID NO: 2789980 - protein, 17 aa, Entamoeba invadens
FADTLEFIETLNVGSSV

SEQ ID NO: 2789981 - protein, 25 aa, Entamoeba invadens
FADVMYGWMKDSIVDLDIDNIPVIE

SEQ ID NO: 2789982 - protein, 18 aa, Entamoeba invadens
FAEDPVLFCYNKDACDAS

SEQ ID NO: 2789983 - protein, 19 aa, Entamoeba invadens
FAEIRGWRNYLLFGGGVVF

SEQ ID NO: 2789984 - protein, 22 aa, Entamoeba invadens
FAELDFRGNGYLVINRLENEKT

SEQ ID NO: 2789985 - protein, 17 aa, Entamoeba invadens
FAENGFLQRSDRRFKTN

SEQ ID NO: 2789986 - protein, 21 aa, Entamoeba invadens
FAESLRSSYKYSTQLSQIDAD

SEQ ID NO: 2789987 - protein, 22 aa, Entamoeba invadens
FAESWGVVPHSVYAPEMYPNYH

SEQ ID NO: 2789988 - protein, 39 aa, Entamoeba invadens
FAFCQNKQLLACHFLWLLKNGVCSLGLKAENVRPNLLIK

SEQ ID NO: 2789989 - protein, 25 aa, Entamoeba invadens
FAFIGVFCGYRLSEVLRCPNDVLGF

SEQ ID NO: 2789990 - protein, 18 aa, Entamoeba invadens
FAFISGVIIFGIYIIGIF

SEQ ID NO: 2789991 - protein, 18 aa, Entamoeba invadens
FAFPLDKLNISYKMLCAR

SEQ ID NO: 2789992 - protein, 23 aa, Entamoeba invadens
FAGCGSAARLLMSDIKKRSFYVF

SEQ ID NO: 2789993 - protein, 24 aa, Entamoeba invadens
FAGEITGNLPVIFPNNSSCHVDMQ

SEQ ID NO: 2789994 - protein, 23 aa, Entamoeba invadens
FAGKTCVCLYSFSKFDKLLDNTQ

SEQ ID NO: 2789995 - protein, 18 aa, Entamoeba invadens
FAGTAVWTFCSCGGLMMM

SEQ ID NO: 2789996 - protein, 23 aa, Entamoeba invadens
FAHQMWITFCFVFCVWNGANYYF

SEQ ID NO: 2789997 - protein, 24 aa, Entamoeba invadens
FAHSPLIIGLCVCYIFIILLFNFA

SEQ ID NO: 2789998 - protein, 24 aa, Entamoeba invadens
FAHYIPRFDINTIYLYNNSTFKIK

SEQ ID NO: 2789999 - protein, 25 aa, Entamoeba invadens
FAILFEIIELAPFIDFPENTKIRIC

SEQ ID NO: 2790000 - protein, 17 aa, Entamoeba invadens
FAINLCLCVTKIVAAVF

SEQ ID NO: 2790001 - protein, 25 aa, Entamoeba invadens
FAIPFCLLDLLFALIIFPKTSKEKS

SEQ ID NO: 2790002 - protein, 39 aa, Entamoeba invadens
FAIPKMPVMWLYCWGMSVVLWVCCWRQRGELTRIVKNRK

SEQ ID NO: 2790003 - protein, 22 aa, Entamoeba invadens
FAISIARLFSYGVYDQVTIDKK

SEQ ID NO: 2790004 - protein, 18 aa, Entamoeba invadens
FAISQSYLSFVIKMSGLE

SEQ ID NO: 2790005 - protein, 41 aa, Entamoeba invadens
FAITMFEAFSWKEAYLIKDFKFPWKIAEFVTAGKRLKRRKK

SEQ ID NO: 2790006 - protein, 26 aa, Entamoeba invadens
FAITMFECFNWQKAYSNMEFKFSWKI

SEQ ID NO: 2790007 - protein, 17 aa, Entamoeba invadens
FAITMFECFSWEEAYPI

SEQ ID NO: 2790008 - protein, 17 aa, Entamoeba invadens
FAITMFETMSWKEAYSH

SEQ ID NO: 2790009 - protein, 42 aa, Entamoeba invadens
FAITMYECFAWRCAYVDLAFKFPWKIAEFVVGGHRLDKPNDV

SEQ ID NO: 2790010 - protein, 28 aa, Entamoeba invadens
FAITMYECFGWGNAFPKEHFSYPWKIAD

SEQ ID NO: 2790011 - protein, 43 aa, Entamoeba invadens
FAITMYECFGWKEAFPKNIYKFAWDIADSIAIGKRPKLDVFNE

SEQ ID NO: 2790012 - protein, 21 aa, Entamoeba invadens
FAITMYECFGWQEAYPSTIFV

SEQ ID NO: 2790013 - protein, 25 aa, Entamoeba invadens
FAITMYECFGWTDAYPKQSFTYAWD

SEQ ID NO: 2790014 - protein, 26 aa, Entamoeba invadens
FAITMYECFIWGVAFPKSEFQYSWNI

SEQ ID NO: 2790015 - protein, 40 aa, Entamoeba invadens
FAITMYECFTWGDAFVSFPNLFPWDVAGLIAKNYRPPLDI

SEQ ID NO: 2790016 - protein, 38 aa, Entamoeba invadens
FAITMYECFTWSDAFPKDVYKYAWDIADSVCYGKRPDL

SEQ ID NO: 2790017 - protein, 23 aa, Entamoeba invadens
FAITMYEIFGWKEPYPKNEFKFA

SEQ ID NO: 2790018 - protein, 21 aa, Entamoeba invadens
FAITMYEVFGWCEAYEHQKFK

SEQ ID NO: 2790019 - protein, 22 aa, Entamoeba invadens
FAITMYEVFGWKEAFGKETFRY

SEQ ID NO: 2790020 - protein, 25 aa, Entamoeba invadens
FAITMYEVFGWNYAYPKETFKFPWK

SEQ ID NO: 2790021 - protein, 24 aa, Entamoeba invadens
FAITMYEVFGWNYAYPKKTFKFPW

SEQ ID NO: 2790022 - protein, 17 aa, Entamoeba invadens
FAKLLDRIEMKFFTQKD

SEQ ID NO: 2790023 - protein, 22 aa, Entamoeba invadens
FAKLRGASFQSYSTFDDIETKV

SEQ ID NO: 2790024 - protein, 23 aa, Entamoeba invadens
FAKTSMFYKMWLKVEDIHAELYM

SEQ ID NO: 2790025 - protein, 18 aa, Entamoeba invadens
FALAFFWSICEYLLSNQI

SEQ ID NO: 2790026 - protein, 32 aa, Entamoeba invadens
FALGAIPCLLTLYFRFSLDFPNKAHTTNKQKI

SEQ ID NO: 2790027 - protein, 32 aa, Entamoeba invadens
FALGITIFECMKWGEAYDGEMFTFTWQVPDYV

SEQ ID NO: 2790028 - protein, 19 aa, Entamoeba invadens
FALLFCYFNSLTKTARAIC

SEQ ID NO: 2790029 - protein, 24 aa, Entamoeba invadens
FALSLAVPVVRIFYNESSPPRTEE

SEQ ID NO: 2790030 - protein, 20 aa, Entamoeba invadens
FALVLFKGIYFWISAPLGIL

SEQ ID NO: 2790031 - protein, 24 aa, Entamoeba invadens
FAMAGPGLMLYTVLKNFFGQNKTK

SEQ ID NO: 2790032 - protein, 27 aa, Entamoeba invadens
FAMMPACWVILIWFCFYFVKPTTVYRN

SEQ ID NO: 2790033 - protein, 41 aa, Entamoeba invadens
FAMTMFECFRWKDAYDKIEFKYPWKIADFVTGGNRLNKSEL

SEQ ID NO: 2790034 - protein, 17 aa, Entamoeba invadens
FAMTMFEIVNWEEAFQK

SEQ ID NO: 2790035 - protein, 41 aa, Entamoeba invadens
FAMTMYECFAWRIAYSDVEFKFPWKIAEFVSLGKRLEKPDY

SEQ ID NO: 2790036 - protein, 40 aa, Entamoeba invadens
FAMTMYECFAWRIAYSDVEFKFPWTIAEFVSLGKRLEKPD

SEQ ID NO: 2790037 - protein, 42 aa, Entamoeba invadens
FAMTMYECFRWKDAYDKIEFKYPWKIADFVTGGNRLNKSELL

SEQ ID NO: 2790038 - protein, 18 aa, Entamoeba invadens
FAMTRMGYSNVIDSALSF

SEQ ID NO: 2790039 - protein, 18 aa, Entamoeba invadens
FANEVAMLDKFRCEYIVY

SEQ ID NO: 2790040 - protein, 27 aa, Entamoeba invadens
FANSMFYQNCGFIGNLLSACYEKGINV

SEQ ID NO: 2790041 - protein, 24 aa, Entamoeba invadens
FAPICMLSPMVGRIGSMRFFIKDE

SEQ ID NO: 2790042 - protein, 17 aa, Entamoeba invadens
FAPTALFILYFQMPSFQ

SEQ ID NO: 2790043 - protein, 20 aa, Entamoeba invadens
FAQLLIRAGNDVGIRVVIVP

SEQ ID NO: 2790044 - protein, 17 aa, Entamoeba invadens
FARCTPSDKCVWLDRSS

SEQ ID NO: 2790045 - protein, 18 aa, Entamoeba invadens
FARKCVNCVAGSYPQTAG

SEQ ID NO: 2790046 - protein, 21 aa, Entamoeba invadens
FARYHRRMHLFSPAITILEDV

SEQ ID NO: 2790047 - protein, 17 aa, Entamoeba invadens
FASFVVNGIVSVQDPPT

SEQ ID NO: 2790048 - protein, 17 aa, Entamoeba invadens
FASFVVNGIVSVRDPPT

SEQ ID NO: 2790049 - protein, 46 aa, Entamoeba invadens
FASTFFGCFSCNMLPWAFARPKFETWWLTRVVPFMFFVFVSMLLLV

SEQ ID NO: 2790050 - protein, 25 aa, Entamoeba invadens
FASYQMFCLYSFPNRVMDILFNTKF

SEQ ID NO: 2790051 - protein, 25 aa, Entamoeba invadens
FATSNVCLKCSSNHLWESTQSKCVA

SEQ ID NO: 2790052 - protein, 33 aa, Entamoeba invadens
FATTRTARFGRKFSVPIRVIVSVGLLIDKWEII

SEQ ID NO: 2790053 - protein, 24 aa, Entamoeba invadens
FATTWCGPGQYLLIDSCLICLAGT

SEQ ID NO: 2790054 - protein, 23 aa, Entamoeba invadens
FATVICLFAYIVFFTTLGFIKDP

SEQ ID NO: 2790055 - protein, 24 aa, Entamoeba invadens
FAVEVPLEFTHRINTMFIVLLIQQ

SEQ ID NO: 2790056 - protein, 25 aa, Entamoeba invadens
FAVFGIWCLINFLVGRRGAAILPLY

SEQ ID NO: 2790057 - protein, 18 aa, Entamoeba invadens
FAVIISFQIAKLSMFVFP

SEQ ID NO: 2790058 - protein, 19 aa, Entamoeba invadens
FAVLISIVIVLAIKATILL

SEQ ID NO: 2790059 - protein, 19 aa, Entamoeba invadens
FAVTMFETFIWDKSYPETN

SEQ ID NO: 2790060 - protein, 22 aa, Entamoeba invadens
FAVTMYECFAWSRSYASNEFLY

SEQ ID NO: 2790061 - protein, 20 aa, Entamoeba invadens
FAWVLNLVVIYCNWFDNQIV

SEQ ID NO: 2790062 - protein, 20 aa, Entamoeba invadens
FAYANAFRIQKDFKEMKVVF

SEQ ID NO: 2790063 - protein, 20 aa, Entamoeba invadens
FAYIEWFVYGVIQAGIFFSL

SEQ ID NO: 2790064 - protein, 20 aa, Entamoeba invadens
FCATSLIVIGIEFTMLIFSD

SEQ ID NO: 2790065 - protein, 18 aa, Entamoeba invadens
FCDGGARCICPMCCHNKC

SEQ ID NO: 2790066 - protein, 23 aa, Entamoeba invadens
FCDINTNCLVSWKNENCQVCDEG

SEQ ID NO: 2790067 - protein, 21 aa, Entamoeba invadens
FCEEAKWSFEGEIVAFADYDN

SEQ ID NO: 2790068 - protein, 19 aa, Entamoeba invadens
FCEKCDIMGICTSCSSKYI

SEQ ID NO: 2790069 - protein, 18 aa, Entamoeba invadens
FCFYGCAIISSVRISQNV

SEQ ID NO: 2790070 - protein, 17 aa, Entamoeba invadens
FCITALLSLAFYYLKNK

SEQ ID NO: 2790071 - protein, 21 aa, Entamoeba invadens
FCLLCALYVFTSLPQPSLLMV

SEQ ID NO: 2790072 - protein, 25 aa, Entamoeba invadens
FCLLIDCLRYIYSVHEHCTLLEKKD

SEQ ID NO: 2790073 - protein, 17 aa, Entamoeba invadens
FCNGCKQVSNFINDSGV

SEQ ID NO: 2790074 - protein, 18 aa, Entamoeba invadens
FCNTKHRFNEGIVTVSSV

SEQ ID NO: 2790075 - protein, 18 aa, Entamoeba invadens
FCNWMKLFKEVFRDKFMV

SEQ ID NO: 2790076 - protein, 21 aa, Entamoeba invadens
FCPCNGCYITPLEFIKQIQVH

SEQ ID NO: 2790077 - protein, 18 aa, Entamoeba invadens
FCQTCLSLECGADKTAYN

SEQ ID NO: 2790078 - protein, 19 aa, Entamoeba invadens
FCRGLSYAANYYRFTSEKG

SEQ ID NO: 2790079 - protein, 17 aa, Entamoeba invadens
FCSDGSYFDTTLKICKS

SEQ ID NO: 2790080 - protein, 22 aa, Entamoeba invadens
FCSGYACNRCNVAGKKVFDYSS

SEQ ID NO: 2790081 - protein, 21 aa, Entamoeba invadens
FCSIVRYSYKIYKMTKDPRLI

SEQ ID NO: 2790082 - protein, 18 aa, Entamoeba invadens
FCSMKYTDLCLECNSTDC

SEQ ID NO: 2790083 - protein, 24 aa, Entamoeba invadens
FCSNAICVVALFSCLCIIIAFYYK

SEQ ID NO: 2790084 - protein, 18 aa, Entamoeba invadens
FCSSCLSGCILSENRCIQ

SEQ ID NO: 2790085 - protein, 24 aa, Entamoeba invadens
FCSSCSSEKCSVCNAEYFEAKGGK

SEQ ID NO: 2790086 - protein, 24 aa, Entamoeba invadens
FCSSCSTEKCSVCNAEYFEPKGGE

SEQ ID NO: 2790087 - protein, 19 aa, Entamoeba invadens
FCTILNIGALLGIDSKEET

SEQ ID NO: 2790088 - protein, 18 aa, Entamoeba invadens
FCTKITLQNCKHISFVNS

SEQ ID NO: 2790089 - protein, 24 aa, Entamoeba invadens
FCTRKSLWWISLIVIPVFLIFVVV

SEQ ID NO: 2790090 - protein, 22 aa, Entamoeba invadens
FCTSCKLNYLLYDGKCYPKATN

SEQ ID NO: 2790091 - protein, 23 aa, Entamoeba invadens
FCTSCKLNYLLYDGLCYPKATNC

SEQ ID NO: 2790092 - protein, 21 aa, Entamoeba invadens
FCTSHILGMKIHYTVYISDNI

SEQ ID NO: 2790093 - protein, 23 aa, Entamoeba invadens
FCVFVTLVLLASVGMTWINASLL

SEQ ID NO: 2790094 - protein, 22 aa, Entamoeba invadens
FCVHCISGYYLYQDSCRECLSS

SEQ ID NO: 2790095 - protein, 20 aa, Entamoeba invadens
FCVLLPLLFMCVVNAQTNTL

SEQ ID NO: 2790096 - protein, 17 aa, Entamoeba invadens
FCVSRIEVNVSYDILNP

SEQ ID NO: 2790097 - protein, 21 aa, Entamoeba invadens
FCVTCEIGYFLKVTVAERMCV

SEQ ID NO: 2790098 - protein, 17 aa, Entamoeba invadens
FCYALLCRCCNNVVKHM

SEQ ID NO: 2790099 - protein, 18 aa, Entamoeba invadens
FCYSTCSFFTKGLNERGE

SEQ ID NO: 2790100 - protein, 20 aa, Entamoeba invadens
FCYSTCSFFTKGLVERGEAI

SEQ ID NO: 2790101 - protein, 18 aa, Entamoeba invadens
FDAHCAKCSSAFDRKCVM

SEQ ID NO: 2790102 - protein, 35 aa, Entamoeba invadens
FDAPLVKCVFCTSDGCTQMVGWKGGVSTLIGIAKR

SEQ ID NO: 2790103 - protein, 18 aa, Entamoeba invadens
FDCMAYKTSGINTLTIDD

SEQ ID NO: 2790104 - protein, 19 aa, Entamoeba invadens
FDDFCVYLEMLPKPFPSEL

SEQ ID NO: 2790105 - protein, 18 aa, Entamoeba invadens
FDDNKNVFQWKRRNAHIH

SEQ ID NO: 2790106 - protein, 19 aa, Entamoeba invadens
FDDTYIIPRIKDYINIQMV

SEQ ID NO: 2790107 - protein, 19 aa, Entamoeba invadens
FDDYCAFTEKFEFDNFDFF

SEQ ID NO: 2790108 - protein, 23 aa, Entamoeba invadens
FDDYREAYRWLAHNTPEGSRIMS

SEQ ID NO: 2790109 - protein, 17 aa, Entamoeba invadens
FDECLNLLNSDNWIVFY

SEQ ID NO: 2790110 - protein, 21 aa, Entamoeba invadens
FDEGFMKKWFGGQTRQEKELA

SEQ ID NO: 2790111 - protein, 22 aa, Entamoeba invadens
FDELIWKINIGVLNSLVDATFV

SEQ ID NO: 2790112 - protein, 25 aa, Entamoeba invadens
FDERLKREFLPLLFVGITHLNQTIF

SEQ ID NO: 2790113 - protein, 21 aa, Entamoeba invadens
FDFADCYFENFTVNKQIVDLY

SEQ ID NO: 2790114 - protein, 17 aa, Entamoeba invadens
FDFFKQCIHNTIMVVSC

SEQ ID NO: 2790115 - protein, 17 aa, Entamoeba invadens
FDFINRLYIYPLDVSFG

SEQ ID NO: 2790116 - protein, 17 aa, Entamoeba invadens
FDFLDGMLDCRDLNEVY

SEQ ID NO: 2790117 - protein, 20 aa, Entamoeba invadens
FDFSNPPIAPGMPMMPPPPP

SEQ ID NO: 2790118 - protein, 18 aa, Entamoeba invadens
FDFTFKWIDKLKWLILIF

SEQ ID NO: 2790119 - protein, 25 aa, Entamoeba invadens
FDGCKSVFLCVIRFLTQDSCRHFYI

SEQ ID NO: 2790120 - protein, 25 aa, Entamoeba invadens
FDGLRKGFYSLGWGVWDGVTGVVAQ

SEQ ID NO: 2790121 - protein, 19 aa, Entamoeba invadens
FDGSTCINCDVSCKSCTNE

SEQ ID NO: 2790122 - protein, 19 aa, Entamoeba invadens
FDGSTCISCDVSCKSCTSE

SEQ ID NO: 2790123 - protein, 17 aa, Entamoeba invadens
FDHEITMLKLLRHETTV

SEQ ID NO: 2790124 - protein, 23 aa, Entamoeba invadens
FDIEMLGLIFVWVLKNLKKEVLV

SEQ ID NO: 2790125 - protein, 21 aa, Entamoeba invadens
FDIFVNVYGFRVMSSGEFYFK

SEQ ID NO: 2790126 - protein, 19 aa, Entamoeba invadens
FDIIEELFYFFLYSWALYI

SEQ ID NO: 2790127 - protein, 19 aa, Entamoeba invadens
FDIIKRCWCQDPAQRIKIE

SEQ ID NO: 2790128 - protein, 17 aa, Entamoeba invadens
FDIKSAVIAGKMPPLDD

SEQ ID NO: 2790129 - protein, 18 aa, Entamoeba invadens
FDILKGNVALLIHIFSVV

SEQ ID NO: 2790130 - protein, 27 aa, Entamoeba invadens
FDIPDLRYAVSVGKCLIVGTKTMLYSI

SEQ ID NO: 2790131 - protein, 21 aa, Entamoeba invadens
FDIPECYKTVESLELIIVRKG

SEQ ID NO: 2790132 - protein, 18 aa, Entamoeba invadens
FDISISIVSLLMLIVMIL

SEQ ID NO: 2790133 - protein, 25 aa, Entamoeba invadens
FDISRGCALNNGYVREEGDDCYLSP

SEQ ID NO: 2790134 - protein, 22 aa, Entamoeba invadens
FDIWLRRNLTSIPYVHVDGLVS

SEQ ID NO: 2790135 - protein, 23 aa, Entamoeba invadens
FDKHGSCTLDVFKGETGPLDYFW

SEQ ID NO: 2790136 - protein, 18 aa, Entamoeba invadens
FDKKECKGWDSYATLTRM

SEQ ID NO: 2790137 - protein, 28 aa, Entamoeba invadens
FDKKGVIGDHDYVIWMGDLNYRIQMDDK

SEQ ID NO: 2790138 - protein, 25 aa, Entamoeba invadens
FDKMCSVDEKWKYSYITFLASMLPN

SEQ ID NO: 2790139 - protein, 24 aa, Entamoeba invadens
FDKMKSSVFVICLHLVNSKVNLEP

SEQ ID NO: 2790140 - protein, 19 aa, Entamoeba invadens
FDKPVGYRYNFLEFTDADT

SEQ ID NO: 2790141 - protein, 23 aa, Entamoeba invadens
FDKYHSICISLFCEEPSHIIDVI

SEQ ID NO: 2790142 - protein, 26 aa, Entamoeba invadens
FDKYPAVLSELCLSSFSELPQDILTD

SEQ ID NO: 2790143 - protein, 17 aa, Entamoeba invadens
FDLCVGDLIYLDVGDIL

SEQ ID NO: 2790144 - protein, 17 aa, Entamoeba invadens
FDLFGYIDLCDFANKYI

SEQ ID NO: 2790145 - protein, 18 aa, Entamoeba invadens
FDLFHFLISIALCVISYV

SEQ ID NO: 2790146 - protein, 23 aa, Entamoeba invadens
FDLKLQRCVELLLDEGSRKIEAL

SEQ ID NO: 2790147 - protein, 29 aa, Entamoeba invadens
FDLPVPYPLLWCRYSFFIVLYPMGVSGEV

SEQ ID NO: 2790148 - protein, 24 aa, Entamoeba invadens
FDLRGYQFIPTYAFQNCKKLEYII

SEQ ID NO: 2790149 - protein, 19 aa, Entamoeba invadens
FDLTEGYVMEISRAEMNEK

SEQ ID NO: 2790150 - protein, 19 aa, Entamoeba invadens
FDLTVDIACWGIRHLDKEV

SEQ ID NO: 2790151 - protein, 26 aa, Entamoeba invadens
FDLVRELPFTLGQCVFKPIHDTSEVK

SEQ ID NO: 2790152 - protein, 24 aa, Entamoeba invadens
FDNAIRISLRLGVVEFSLMLLRII

SEQ ID NO: 2790153 - protein, 26 aa, Entamoeba invadens
FDNKNLPEGFGFEFKKKPLVWAPTTL

SEQ ID NO: 2790154 - protein, 17 aa, Entamoeba invadens
FDNWPFENKSVFVLLLV

SEQ ID NO: 2790155 - protein, 20 aa, Entamoeba invadens
FDPLRWVFNAPMTGVSPSLF

SEQ ID NO: 2790156 - protein, 31 aa, Entamoeba invadens
FDPNCAVCSPTFDRKCIQCDRGYYIINGVCV

SEQ ID NO: 2790157 - protein, 18 aa, Entamoeba invadens
FDPSAPYAKSVWFRVDVE

SEQ ID NO: 2790158 - protein, 19 aa, Entamoeba invadens
FDPYFNYRATKFLLANGLD

SEQ ID NO: 2790159 - protein, 20 aa, Entamoeba invadens
FDQCYYMMLDTYVKFEEKGD

SEQ ID NO: 2790160 - protein, 19 aa, Entamoeba invadens
FDRKCLQCSSGKYPNPTTC

SEQ ID NO: 2790161 - protein, 17 aa, Entamoeba invadens
FDRKCVMCNTGYYPDEI

SEQ ID NO: 2790162 - protein, 19 aa, Entamoeba invadens
FDRKCVMCNTGYYPDEIGV

SEQ ID NO: 2790163 - protein, 17 aa, Entamoeba invadens
FDRKCVTCNTGYYSNEN

SEQ ID NO: 2790164 - protein, 17 aa, Entamoeba invadens
FDRLVLKNDQGVTFNKD

SEQ ID NO: 2790165 - protein, 17 aa, Entamoeba invadens
FDRNFVLNFESKVSEMK

SEQ ID NO: 2790166 - protein, 17 aa, Entamoeba invadens
FDSCLKLTSVDLNGLTQ

SEQ ID NO: 2790167 - protein, 24 aa, Entamoeba invadens
FDSETKYDVGPCVFAGNKQNQYRP

SEQ ID NO: 2790168 - protein, 24 aa, Entamoeba invadens
FDSETPLDYSFCRYPMKYRVGKWF

SEQ ID NO: 2790169 - protein, 17 aa, Entamoeba invadens
FDSKCTTCFSDFSRKCV

SEQ ID NO: 2790170 - protein, 25 aa, Entamoeba invadens
FDSNCGLCATNFSRKCLICKTNLYP

SEQ ID NO: 2790171 - protein, 24 aa, Entamoeba invadens
FDSNCVLCASNFSRKCLICNTGFY

SEQ ID NO: 2790172 - protein, 18 aa, Entamoeba invadens
FDSRCVTCSPSFARKCVN

SEQ ID NO: 2790173 - protein, 19 aa, Entamoeba invadens
FDSTKKVLCDDIAKIWDGV

SEQ ID NO: 2790174 - protein, 23 aa, Entamoeba invadens
FDTFDSGLVWRMYIFMADMHTKY

SEQ ID NO: 2790175 - protein, 18 aa, Entamoeba invadens
FDTLEIRGIPSIDSQVTV

SEQ ID NO: 2790176 - protein, 20 aa, Entamoeba invadens
FDTLMPYYFISDGIVYSQDN

SEQ ID NO: 2790177 - protein, 24 aa, Entamoeba invadens
FDTNEYFIYFWASNMKSGYALFDD

SEQ ID NO: 2790178 - protein, 20 aa, Entamoeba invadens
FDTRLSKCVDLLLEEGIRRN

SEQ ID NO: 2790179 - protein, 23 aa, Entamoeba invadens
FDTTGCAFTYLFAALSGGKVLSY

SEQ ID NO: 2790180 - protein, 17 aa, Entamoeba invadens
FDVFVFFALHIFHKEKR

SEQ ID NO: 2790181 - protein, 17 aa, Entamoeba invadens
FDVISTLTFCGGIVMYL

SEQ ID NO: 2790182 - protein, 17 aa, Entamoeba invadens
FDVSIKMNGAESPFIKR

SEQ ID NO: 2790183 - protein, 17 aa, Entamoeba invadens
FDWKTMTVLVDYFIIGV

SEQ ID NO: 2790184 - protein, 18 aa, Entamoeba invadens
FDYECMNGLKSIQRFDVT

SEQ ID NO: 2790185 - protein, 19 aa, Entamoeba invadens
FDYIQLLSILSIYGIITLY

SEQ ID NO: 2790186 - protein, 23 aa, Entamoeba invadens
FDYRCALINYGYFFVRIGVIIGS

SEQ ID NO: 2790187 - protein, 34 aa, Entamoeba invadens
FEAEGYFAKPICFPERMYKCVLFTLEYNGNYSLL

SEQ ID NO: 2790188 - protein, 27 aa, Entamoeba invadens
FEAFVKPRCTCKIADFINVTILVLKSG

SEQ ID NO: 2790189 - protein, 21 aa, Entamoeba invadens
FEARRVGRVEAKKITFKTQLE

SEQ ID NO: 2790190 - protein, 18 aa, Entamoeba invadens
FECLSCNSTVVLSNSKCF

SEQ ID NO: 2790191 - protein, 18 aa, Entamoeba invadens
FECSMGYFRYDYNICLKC

SEQ ID NO: 2790192 - protein, 17 aa, Entamoeba invadens
FEDFLMASFRVEMTDDP

SEQ ID NO: 2790193 - protein, 23 aa, Entamoeba invadens
FEDIYDCPNDVYSFAMTAWELFY

SEQ ID NO: 2790194 - protein, 25 aa, Entamoeba invadens
FEDVTFKALTGRDVVIQNSKYHDGE

SEQ ID NO: 2790195 - protein, 23 aa, Entamoeba invadens
FEEAKRFLTMLKVSPKEYLEEKG

SEQ ID NO: 2790196 - protein, 25 aa, Entamoeba invadens
FEEGFQYQLCCYAKLTNNTKAFFQF

SEQ ID NO: 2790197 - protein, 17 aa, Entamoeba invadens
FEERLKVLGIVIQICEC

SEQ ID NO: 2790198 - protein, 18 aa, Entamoeba invadens
FEEYFGVKNINSINDYLN

SEQ ID NO: 2790199 - protein, 22 aa, Entamoeba invadens
FEEYIMVIGLDIKTGVQYNEKI

SEQ ID NO: 2790200 - protein, 20 aa, Entamoeba invadens
FEEYKRIKIGEVVQKLELLN

SEQ ID NO: 2790201 - protein, 17 aa, Entamoeba invadens
FEFGRGDFVPRLSVDFV

SEQ ID NO: 2790202 - protein, 25 aa, Entamoeba invadens
FEFNFRFPAIRAKNCYYVVDTNVFL

SEQ ID NO: 2790203 - protein, 17 aa, Entamoeba invadens
FEGIGWCDAYPKGLFAF

SEQ ID NO: 2790204 - protein, 24 aa, Entamoeba invadens
FEGQKNSFAFFIVVLLTIYKSFPK

SEQ ID NO: 2790205 - protein, 17 aa, Entamoeba invadens
FEGTIGLIEIGDYKVPS

SEQ ID NO: 2790206 - protein, 20 aa, Entamoeba invadens
FEHTARLDAKLSYENHKYCQ

SEQ ID NO: 2790207 - protein, 20 aa, Entamoeba invadens
FEICVLKVVEIFLTRKDFPL

SEQ ID NO: 2790208 - protein, 17 aa, Entamoeba invadens
FEIDGNYDLSVDKNIMF

SEQ ID NO: 2790209 - protein, 18 aa, Entamoeba invadens
FEIFITPLCTFKIEDQLK

SEQ ID NO: 2790210 - protein, 18 aa, Entamoeba invadens
FEIFLTPLCTMHLVDEIV

SEQ ID NO: 2790211 - protein, 23 aa, Entamoeba invadens
FEIKNCLEISCFVIDTTMKRRFL

SEQ ID NO: 2790212 - protein, 20 aa, Entamoeba invadens
FEILDGFKKGKLEEISSGIY

SEQ ID NO: 2790213 - protein, 17 aa, Entamoeba invadens
FEILITLICTTKINENF

SEQ ID NO: 2790214 - protein, 21 aa, Entamoeba invadens
FEISKEIFKQAVGYEAHPIES

SEQ ID NO: 2790215 - protein, 17 aa, Entamoeba invadens
FEIVIHVVIRWCVIFTV

SEQ ID NO: 2790216 - protein, 20 aa, Entamoeba invadens
FEIYEMIKNAQFPRVRENLR

SEQ ID NO: 2790217 - protein, 18 aa, Entamoeba invadens
FEKAKKWHEAECQYAKNV

SEQ ID NO: 2790218 - protein, 23 aa, Entamoeba invadens
FEKDGRFAVAAVRKELHPKSSPT

SEQ ID NO: 2790219 - protein, 24 aa, Entamoeba invadens
FEKESCIILLLFLNCSNFISFKEE

SEQ ID NO: 2790220 - protein, 18 aa, Entamoeba invadens
FEKEVAMLDKFRCEYIIH

SEQ ID NO: 2790221 - protein, 23 aa, Entamoeba invadens
FEKKANLLYAFFSYSIFVGLVPF

SEQ ID NO: 2790222 - protein, 23 aa, Entamoeba invadens
FEKKKLVEFLHIFFYELQDENIN

SEQ ID NO: 2790223 - protein, 18 aa, Entamoeba invadens
FEKLRILFITRVDQNYED

SEQ ID NO: 2790224 - protein, 23 aa, Entamoeba invadens
FEKPKVCVLTGSKYNDPDSYDSL

SEQ ID NO: 2790225 - protein, 24 aa, Entamoeba invadens
FEKRFPGIEVLYPNLLSAFERYST

SEQ ID NO: 2790226 - protein, 19 aa, Entamoeba invadens
FEKRHKCCYDYYDEGNCAC

SEQ ID NO: 2790227 - protein, 19 aa, Entamoeba invadens
FEKVHEFLEFLKTRSGKKD

SEQ ID NO: 2790228 - protein, 21 aa, Entamoeba invadens
FEKVRCCKGSADKRVVSLCGG

SEQ ID NO: 2790229 - protein, 22 aa, Entamoeba invadens
FELDGIIAIDFSEEFFEKEGGI

SEQ ID NO: 2790230 - protein, 18 aa, Entamoeba invadens
FELFCQAPSNNLCGKHYN

SEQ ID NO: 2790231 - protein, 17 aa, Entamoeba invadens
FELGEGVVVVGTIGEKI

SEQ ID NO: 2790232 - protein, 19 aa, Entamoeba invadens
FELHCLSVERWLDEDQREA

SEQ ID NO: 2790233 - protein, 17 aa, Entamoeba invadens
FELIKKCWCQNPQTRLK

SEQ ID NO: 2790234 - protein, 19 aa, Entamoeba invadens
FELISLCWDNNPNQRPTFE

SEQ ID NO: 2790235 - protein, 30 aa, Entamoeba invadens
FELKPLQLYIQWCTIRNSTLINIDLVNNTQ

SEQ ID NO: 2790236 - protein, 20 aa, Entamoeba invadens
FELKRADLILTKNYLQTDKV

SEQ ID NO: 2790237 - protein, 21 aa, Entamoeba invadens
FELLLTPKCSCHFSDSISVIT

SEQ ID NO: 2790238 - protein, 22 aa, Entamoeba invadens
FELMRLDFLSGLKDYPLVVELS

SEQ ID NO: 2790239 - protein, 23 aa, Entamoeba invadens
FELPECLENLEINNFTFLDKHGL

SEQ ID NO: 2790240 - protein, 19 aa, Entamoeba invadens
FEMECVISQTLYDMFSEER

SEQ ID NO: 2790241 - protein, 17 aa, Entamoeba invadens
FEMRNKAIISFRYNDRL

SEQ ID NO: 2790242 - protein, 23 aa, Entamoeba invadens
FEMVARIVRLMILFGKDTINSNF

SEQ ID NO: 2790243 - protein, 17 aa, Entamoeba invadens
FEMYIKPNFSCIIDEEI

SEQ ID NO: 2790244 - protein, 19 aa, Entamoeba invadens
FENGIKCLGVLKSKGNKGV

SEQ ID NO: 2790245 - protein, 19 aa, Entamoeba invadens
FENGLCYDISFVSYCVAVS

SEQ ID NO: 2790246 - protein, 18 aa, Entamoeba invadens
FENIKSTIKVTGTSGAIN

SEQ ID NO: 2790247 - protein, 19 aa, Entamoeba invadens
FENLKKFNESLAEKVKEAK

SEQ ID NO: 2790248 - protein, 23 aa, Entamoeba invadens
FENPNTFPLLLAISTTRNGCLVL

SEQ ID NO: 2790249 - protein, 18 aa, Entamoeba invadens
FENSICISCIPYYYLSDN

SEQ ID NO: 2790250 - protein, 17 aa, Entamoeba invadens
FENWTLSIYNVFFTFFP

SEQ ID NO: 2790251 - protein, 21 aa, Entamoeba invadens
FEPAFCYPLNIPNEFFNIQPT

SEQ ID NO: 2790252 - protein, 27 aa, Entamoeba invadens
FEPNCKSCAFNGERKCLTCVNKYKPAS

SEQ ID NO: 2790253 - protein, 17 aa, Entamoeba invadens
FEQEIEIFKKNKREKSK

SEQ ID NO: 2790254 - protein, 28 aa, Entamoeba invadens
FEQFVCSKLRVLYKLNWLQASDLDDIHQ

SEQ ID NO: 2790255 - protein, 20 aa, Entamoeba invadens
FEQIKEGMNFVVEGIAVLEK

SEQ ID NO: 2790256 - protein, 24 aa, Entamoeba invadens
FEQKMCGEVNYYIKCKGATSSQIT

SEQ ID NO: 2790257 - protein, 19 aa, Entamoeba invadens
FERCEYRDLFSALLCCCYA

SEQ ID NO: 2790258 - protein, 25 aa, Entamoeba invadens
FERESFCVVFWKYYAELMNNNIVVD

SEQ ID NO: 2790259 - protein, 25 aa, Entamoeba invadens
FERKCATCLTGSYLSNGPKCTLCDT

SEQ ID NO: 2790260 - protein, 18 aa, Entamoeba invadens
FERKCFTCKTGKYPDEIT

SEQ ID NO: 2790261 - protein, 19 aa, Entamoeba invadens
FERLELRQNKSLVFEINCI

SEQ ID NO: 2790262 - protein, 18 aa, Entamoeba invadens
FESAELLGATSITDLTVS

SEQ ID NO: 2790263 - protein, 19 aa, Entamoeba invadens
FESCTCMKYIGFYPTTNQM

SEQ ID NO: 2790264 - protein, 17 aa, Entamoeba invadens
FESENFFAYPACMPGIF

SEQ ID NO: 2790265 - protein, 17 aa, Entamoeba invadens
FESFSFDEYELYDDLMS

SEQ ID NO: 2790266 - protein, 21 aa, Entamoeba invadens
FESKFNYVFTMYIRDFSTFIM

SEQ ID NO: 2790267 - protein, 18 aa, Entamoeba invadens
FETITWKEAFPKSEFKYP

SEQ ID NO: 2790268 - protein, 21 aa, Entamoeba invadens
FETPTKCISCGNDTFMSDYKC

SEQ ID NO: 2790269 - protein, 21 aa, Entamoeba invadens
FETPTKCISCGNDTFMSNYKC

SEQ ID NO: 2790270 - protein, 18 aa, Entamoeba invadens
FEVFLDKYMEGMASNSLY

SEQ ID NO: 2790271 - protein, 18 aa, Entamoeba invadens
FEVFLTLFCTTDLEDEIL

SEQ ID NO: 2790272 - protein, 19 aa, Entamoeba invadens
FEVFLTPFCTMNLCDEIMI

SEQ ID NO: 2790273 - protein, 17 aa, Entamoeba invadens
FEVFLTPHCTLTLEDKI

SEQ ID NO: 2790274 - protein, 18 aa, Entamoeba invadens
FEVFLTPLCTINLSDEIV

SEQ ID NO: 2790275 - protein, 17 aa, Entamoeba invadens
FEVFLTPLCTMDLSDEV

SEQ ID NO: 2790276 - protein, 26 aa, Entamoeba invadens
FEVKKRLYVEKHFRPHFYALVMPIVK

SEQ ID NO: 2790277 - protein, 17 aa, Entamoeba invadens
FEVKSIFEIIRKNKKKQ

SEQ ID NO: 2790278 - protein, 20 aa, Entamoeba invadens
FEYTSLFLIIVKKLYNCFHC

SEQ ID NO: 2790279 - protein, 19 aa, Entamoeba invadens
FEYVKNFQGPIVIPIIFEI

SEQ ID NO: 2790280 - protein, 17 aa, Entamoeba invadens
FFAEHYSYLLGVANYVH

SEQ ID NO: 2790281 - protein, 32 aa, Entamoeba invadens
FFALGFLLCCLWIMGYCRYRKSPDAQARSFAF

SEQ ID NO: 2790282 - protein, 29 aa, Entamoeba invadens
FFALWKPSFLRRSVVVFSIISTSGLLSSV

SEQ ID NO: 2790283 - protein, 17 aa, Entamoeba invadens
FFASAAWFKHEKVAVNM

SEQ ID NO: 2790284 - protein, 25 aa, Entamoeba invadens
FFATWCGPCKSIAPYFEELARKTPS

SEQ ID NO: 2790285 - protein, 19 aa, Entamoeba invadens
FFCAGLFSSFIGDLFLIKE

SEQ ID NO: 2790286 - protein, 18 aa, Entamoeba invadens
FFCCFQSYSLTWCSSENG

SEQ ID NO: 2790287 - protein, 22 aa, Entamoeba invadens
FFDFSVYFYWLVIPVLMKNLGA

SEQ ID NO: 2790288 - protein, 23 aa, Entamoeba invadens
FFDSSEMFLIFILASFSLICGTM

SEQ ID NO: 2790289 - protein, 21 aa, Entamoeba invadens
FFDTTMALRCVESYKNAQLTY

SEQ ID NO: 2790290 - protein, 23 aa, Entamoeba invadens
FFEAFTWKDAFEDIKYFFEIPEL

SEQ ID NO: 2790291 - protein, 18 aa, Entamoeba invadens
FFEKEMRYIHRWLETKYI

SEQ ID NO: 2790292 - protein, 17 aa, Entamoeba invadens
FFFGKCLRTMKSMATTF

SEQ ID NO: 2790293 - protein, 23 aa, Entamoeba invadens
FFFLGVNFFPVFKPVKSGLDNLG

SEQ ID NO: 2790294 - protein, 18 aa, Entamoeba invadens
FFFLHLYVLIAMPKCKEY

SEQ ID NO: 2790295 - protein, 19 aa, Entamoeba invadens
FFFQIIFVHFVTAFCGDGV

SEQ ID NO: 2790296 - protein, 17 aa, Entamoeba invadens
FFFSYFITVSAWNNAGL

SEQ ID NO: 2790297 - protein, 17 aa, Entamoeba invadens
FFFYCYFSVKVTTFPQF

SEQ ID NO: 2790298 - protein, 17 aa, Entamoeba invadens
FFGEYSMRFDSRANNRV

SEQ ID NO: 2790299 - protein, 18 aa, Entamoeba invadens
FFGMMYGFFYYKFIYAKD

SEQ ID NO: 2790300 - protein, 23 aa, Entamoeba invadens
FFGVWNIYWGRREKLEEMGDTRY

SEQ ID NO: 2790301 - protein, 19 aa, Entamoeba invadens
FFHFIGWWARAMVCRDVGL

SEQ ID NO: 2790302 - protein, 18 aa, Entamoeba invadens
FFHGILIRQFMKILVKDV

SEQ ID NO: 2790303 - protein, 25 aa, Entamoeba invadens
FFHINVKMLLNYGFLLLTKTTSPKI

SEQ ID NO: 2790304 - protein, 18 aa, Entamoeba invadens
FFHIPWDYSLNGSQNRSC

SEQ ID NO: 2790305 - protein, 19 aa, Entamoeba invadens
FFHSKACGLFNITSGDNRL

SEQ ID NO: 2790306 - protein, 19 aa, Entamoeba invadens
FFIDRTLKHKIDMLKQNIT

SEQ ID NO: 2790307 - protein, 25 aa, Entamoeba invadens
FFILGFFCYCIWIVAFCKFKNSGNA

SEQ ID NO: 2790308 - protein, 19 aa, Entamoeba invadens
FFINKESTYLIAFETADEK

SEQ ID NO: 2790309 - protein, 20 aa, Entamoeba invadens
FFIQQIRHPWLIKTISRIVC

SEQ ID NO: 2790310 - protein, 18 aa, Entamoeba invadens
FFISFSCGCLYGCQSCPN

SEQ ID NO: 2790311 - protein, 27 aa, Entamoeba invadens
FFIVCDLSLILPRVGLFLPNKTDDLYL

SEQ ID NO: 2790312 - protein, 25 aa, Entamoeba invadens
FFIVIICILLYYFTVHVVKAIHLKK

SEQ ID NO: 2790313 - protein, 34 aa, Entamoeba invadens
FFIVSFSFCCLACWCIFMLQPTFRCSVITPMKHN

SEQ ID NO: 2790314 - protein, 20 aa, Entamoeba invadens
FFKAEKSGRVYLKVTPLPGL

SEQ ID NO: 2790315 - protein, 17 aa, Entamoeba invadens
FFKFMALIGNKTELLGY

SEQ ID NO: 2790316 - protein, 19 aa, Entamoeba invadens
FFKISNYGSLSLKNAEISF

SEQ ID NO: 2790317 - protein, 19 aa, Entamoeba invadens
FFLERRLALKEAKTGKEVE

SEQ ID NO: 2790318 - protein, 18 aa, Entamoeba invadens
FFLFCVILGGAMEGIYIA

SEQ ID NO: 2790319 - protein, 19 aa, Entamoeba invadens
FFLFLCASLDFLRNDWTAN

SEQ ID NO: 2790320 - protein, 19 aa, Entamoeba invadens
FFLIFFLYFVCGAVVSLHG

SEQ ID NO: 2790321 - protein, 18 aa, Entamoeba invadens
FFLLLKFFTKGLLQFLMM

SEQ ID NO: 2790322 - protein, 18 aa, Entamoeba invadens
FFLQNGRCFSCKKSCATC

SEQ ID NO: 2790323 - protein, 17 aa, Entamoeba invadens
FFLVYVWSKRNRDQNVG

SEQ ID NO: 2790324 - protein, 23 aa, Entamoeba invadens
FFLYLCVIGLLTLLTGLLHFTNN

SEQ ID NO: 2790325 - protein, 18 aa, Entamoeba invadens
FFMCEDVILRRFPYMFNS

SEQ ID NO: 2790326 - protein, 26 aa, Entamoeba invadens
FFNFLPDQYWALAVSSIFVSGFWCIV

SEQ ID NO: 2790327 - protein, 18 aa, Entamoeba invadens
FFNHGIWHMVVWFANFQH

SEQ ID NO: 2790328 - protein, 20 aa, Entamoeba invadens
FFNIPMQFFFILYFFLFTPT

SEQ ID NO: 2790329 - protein, 25 aa, Entamoeba invadens
FFNQRIRIAVPLFIFRTKTTTLDLS

SEQ ID NO: 2790330 - protein, 28 aa, Entamoeba invadens
FFNRTKIVGIWDFCWTLFGLPQIGLNSK

SEQ ID NO: 2790331 - protein, 24 aa, Entamoeba invadens
FFPACFSGPCLEYKTYSKFVSLDL

SEQ ID NO: 2790332 - protein, 22 aa, Entamoeba invadens
FFPCSVVLAVAYVSLQRKNGIE

SEQ ID NO: 2790333 - protein, 29 aa, Entamoeba invadens
FFPIEHKIACLLPLFGPVTLLFAKTLFQT

SEQ ID NO: 2790334 - protein, 17 aa, Entamoeba invadens
FFPLEYPNKNMLKEYTM

SEQ ID NO: 2790335 - protein, 24 aa, Entamoeba invadens
FFPLPDFFNSTSFLHKPSQTKTSA

SEQ ID NO: 2790336 - protein, 24 aa, Entamoeba invadens
FFPNICRSSGLFETCLELIEYPYT

SEQ ID NO: 2790337 - protein, 27 aa, Entamoeba invadens
FFPSNGCAFCKSGYYWKDRDCNKCAFE

SEQ ID NO: 2790338 - protein, 25 aa, Entamoeba invadens
FFQFLFPEEFLKQKVIHNYFEKQKK

SEQ ID NO: 2790339 - protein, 22 aa, Entamoeba invadens
FFQKKRFFYPGVAMALLTVVML

SEQ ID NO: 2790340 - protein, 19 aa, Entamoeba invadens
FFRFLTRLLEGYDEYINFV

SEQ ID NO: 2790341 - protein, 21 aa, Entamoeba invadens
FFRPLVKAIVLITCFYIITFV

SEQ ID NO: 2790342 - protein, 24 aa, Entamoeba invadens
FFSCVLSLVWCDAGSAILYMKECS

SEQ ID NO: 2790343 - protein, 17 aa, Entamoeba invadens
FFSDIKGGCVICSSGYY

SEQ ID NO: 2790344 - protein, 17 aa, Entamoeba invadens
FFSSKIFCFNKTAQIIL

SEQ ID NO: 2790345 - protein, 22 aa, Entamoeba invadens
FFTAFMICTSFTVTSVLLCVAA

SEQ ID NO: 2790346 - protein, 18 aa, Entamoeba invadens
FFTVYCMCHRLNIAEGFM

SEQ ID NO: 2790347 - protein, 19 aa, Entamoeba invadens
FFVAAVAVILIFPRTFFVL

SEQ ID NO: 2790348 - protein, 17 aa, Entamoeba invadens
FFVALIVVVSFIFVIFL

SEQ ID NO: 2790349 - protein, 25 aa, Entamoeba invadens
FFVEIPQLLRVCKIRVFSRDDLPKV

SEQ ID NO: 2790350 - protein, 24 aa, Entamoeba invadens
FFVGFPSFSYVLSMVACGYTIPKM

SEQ ID NO: 2790351 - protein, 21 aa, Entamoeba invadens
FFVGVPFWFAHVSNVYNFPII

SEQ ID NO: 2790352 - protein, 20 aa, Entamoeba invadens
FFVMFQFVRIHLGVLFLITI

SEQ ID NO: 2790353 - protein, 25 aa, Entamoeba invadens
FFVVLCLSADLPGSICYQSDTNNAT

SEQ ID NO: 2790354 - protein, 18 aa, Entamoeba invadens
FFVVVCVVVGVLFIIQPD

SEQ ID NO: 2790355 - protein, 41 aa, Entamoeba invadens
FFWDVLEFFHIVFVFRSEFFERLNLRDAYLSLMRRILLEKD

SEQ ID NO: 2790356 - protein, 23 aa, Entamoeba invadens
FFWLAVCIAEFFVLLIVGFFQIR

SEQ ID NO: 2790357 - protein, 17 aa, Entamoeba invadens
FFWLFLLIVPFILRCGT

SEQ ID NO: 2790358 - protein, 24 aa, Entamoeba invadens
FFYKSRLLVLGALLLFVFSVPHKQ

SEQ ID NO: 2790359 - protein, 17 aa, Entamoeba invadens
FFYNYFRFSSANFTIKF

SEQ ID NO: 2790360 - protein, 17 aa, Entamoeba invadens
FFYTVEHLLWFPFNLLL

SEQ ID NO: 2790361 - protein, 34 aa, Entamoeba invadens
FGAFCKCYKCVIPIFPCALVFGSFAIMMVAFEYP

SEQ ID NO: 2790362 - protein, 17 aa, Entamoeba invadens
FGAFLIVSCVSICMATR

SEQ ID NO: 2790363 - protein, 21 aa, Entamoeba invadens
FGAKCSICKNNYYLNSISKCE

SEQ ID NO: 2790364 - protein, 21 aa, Entamoeba invadens
FGCALCYDGFALINSLCVSCS

SEQ ID NO: 2790365 - protein, 25 aa, Entamoeba invadens
FGCLVCKSGYFMNNFTCVRCVDNCQ

SEQ ID NO: 2790366 - protein, 19 aa, Entamoeba invadens
FGDSITVYCHLIKYNEITK

SEQ ID NO: 2790367 - protein, 20 aa, Entamoeba invadens
FGDVISRGYAINNYLNNLVN

SEQ ID NO: 2790368 - protein, 22 aa, Entamoeba invadens
FGECVFCKTYFGGCEKCSTNEF

SEQ ID NO: 2790369 - protein, 17 aa, Entamoeba invadens
FGEEMAEMYSIASHNAV

SEQ ID NO: 2790370 - protein, 22 aa, Entamoeba invadens
FGELSCPLIYSSYIFAAQVAML

SEQ ID NO: 2790371 - protein, 25 aa, Entamoeba invadens
FGESCKYCNSKQCLQCVGGNVDAEG

SEQ ID NO: 2790372 - protein, 17 aa, Entamoeba invadens
FGFAGTAVWTFCSCGGL

SEQ ID NO: 2790373 - protein, 25 aa, Entamoeba invadens
FGFCTNYYYAISIRLLNGFLNGNVG

SEQ ID NO: 2790374 - protein, 17 aa, Entamoeba invadens
FGFHGVVEFIWLALNNL

SEQ ID NO: 2790375 - protein, 23 aa, Entamoeba invadens
FGFHPGFIMKCLLHYFYFTDDKC

SEQ ID NO: 2790376 - protein, 23 aa, Entamoeba invadens
FGFVLLCAIVWGIVFEDANSSSS

SEQ ID NO: 2790377 - protein, 17 aa, Entamoeba invadens
FGGIYFVTSRMVIKDTI

SEQ ID NO: 2790378 - protein, 17 aa, Entamoeba invadens
FGGLKTLFCCSWCAVPY

SEQ ID NO: 2790379 - protein, 17 aa, Entamoeba invadens
FGGLMKWARSDVSDISV

SEQ ID NO: 2790380 - protein, 27 aa, Entamoeba invadens
FGGNLRVVICAGAPLSQDIAKFFRIVI

SEQ ID NO: 2790381 - protein, 17 aa, Entamoeba invadens
FGGNRCFFINKESTYLI

SEQ ID NO: 2790382 - protein, 18 aa, Entamoeba invadens
FGGSYTFTNFNAIQMATF

SEQ ID NO: 2790383 - protein, 19 aa, Entamoeba invadens
FGGVFKLALADTSGDNVGI

SEQ ID NO: 2790384 - protein, 19 aa, Entamoeba invadens
FGGVLLCVFLILFILVMIP

SEQ ID NO: 2790385 - protein, 17 aa, Entamoeba invadens
FGICVVEYMGFGVIPIA

SEQ ID NO: 2790386 - protein, 17 aa, Entamoeba invadens
FGIFFGVVVYLAKFKNF

SEQ ID NO: 2790387 - protein, 20 aa, Entamoeba invadens
FGIMAWEVFYQEEPYNNLKS

SEQ ID NO: 2790388 - protein, 24 aa, Entamoeba invadens
FGISRILLSLTLVFFGIFTCLSQF

SEQ ID NO: 2790389 - protein, 20 aa, Entamoeba invadens
FGITAWEIFYQEEPFKGFKS

SEQ ID NO: 2790390 - protein, 20 aa, Entamoeba invadens
FGITAWEIFYQEQPYKEFKN

SEQ ID NO: 2790391 - protein, 25 aa, Entamoeba invadens
FGITCYECFIWDKAYKEIKFAFQIA

SEQ ID NO: 2790392 - protein, 20 aa, Entamoeba invadens
FGITGWEIFYQDEPYKSFKS

SEQ ID NO: 2790393 - protein, 28 aa, Entamoeba invadens
FGITIFEVISWKEPYLKDQFKYPWKIAE

SEQ ID NO: 2790394 - protein, 17 aa, Entamoeba invadens
FGITIYEVFGWCEAIPI

SEQ ID NO: 2790395 - protein, 23 aa, Entamoeba invadens
FGITLYETFKWGEAYEKEKFKFP

SEQ ID NO: 2790396 - protein, 21 aa, Entamoeba invadens
FGITMFECFSWENAYPSNQFK

SEQ ID NO: 2790397 - protein, 27 aa, Entamoeba invadens
FGITMYEIFAWKEAYPTKKFKFPWKIA

SEQ ID NO: 2790398 - protein, 23 aa, Entamoeba invadens
FGITMYEVFGWSEAYQNDTFKFP

SEQ ID NO: 2790399 - protein, 19 aa, Entamoeba invadens
FGIVLKCPLLVLSFCIFSI

SEQ ID NO: 2790400 - protein, 22 aa, Entamoeba invadens
FGIVSFKMIYFFISTMLGVVLF

SEQ ID NO: 2790401 - protein, 17 aa, Entamoeba invadens
FGIVYKGTFRKNMVCIK

SEQ ID NO: 2790402 - protein, 24 aa, Entamoeba invadens
FGKGEYSADVFFMIIAVVITIIMF

SEQ ID NO: 2790403 - protein, 29 aa, Entamoeba invadens
FGKHLKFLGKEAFSFTLLKTVELPNSVEV

SEQ ID NO: 2790404 - protein, 18 aa, Entamoeba invadens
FGKLTVFKAGCTNFQCVD

SEQ ID NO: 2790405 - protein, 20 aa, Entamoeba invadens
FGKRIMFIQLIDLFNYYGIR

SEQ ID NO: 2790406 - protein, 19 aa, Entamoeba invadens
FGKRPVVVVKTVLNIQVLM

SEQ ID NO: 2790407 - protein, 18 aa, Entamoeba invadens
FGKRVFEGIVTLTSTTIT

SEQ ID NO: 2790408 - protein, 17 aa, Entamoeba invadens
FGKTEIKNCWGKTKTLE

SEQ ID NO: 2790409 - protein, 21 aa, Entamoeba invadens
FGKYYIIMILPKFMKEAYVTI

SEQ ID NO: 2790410 - protein, 26 aa, Entamoeba invadens
FGLAVMCGVLSIPVAIHGNFPYIFFY

SEQ ID NO: 2790411 - protein, 18 aa, Entamoeba invadens
FGLIGLPVVIFFVSSEKY

SEQ ID NO: 2790412 - protein, 22 aa, Entamoeba invadens
FGLKKYWLMPEVLSHEALEGSA

SEQ ID NO: 2790413 - protein, 30 aa, Entamoeba invadens
FGLLLTILMLWKFRVGQPALLYLVPSMFVG

SEQ ID NO: 2790414 - protein, 19 aa, Entamoeba invadens
FGLLTLMYPFIWQGVLIPF

SEQ ID NO: 2790415 - protein, 20 aa, Entamoeba invadens
FGLTCIGVLISPYMYQRTGM

SEQ ID NO: 2790416 - protein, 22 aa, Entamoeba invadens
FGLTFFFIFFIDRVIVPHHHSS

SEQ ID NO: 2790417 - protein, 17 aa, Entamoeba invadens
FGLVSSKVLHWKMVRNL

SEQ ID NO: 2790418 - protein, 24 aa, Entamoeba invadens
FGMVTCLPGAFSMIRPQAMETVLN

SEQ ID NO: 2790419 - protein, 25 aa, Entamoeba invadens
FGNNIECYGCLIGYYLDKNDCLECP

SEQ ID NO: 2790420 - protein, 17 aa, Entamoeba invadens
FGPAIVTLFAAIFFTIF

SEQ ID NO: 2790421 - protein, 18 aa, Entamoeba invadens
FGPKRAMQLMLILFFIGM

SEQ ID NO: 2790422 - protein, 24 aa, Entamoeba invadens
FGPKRAMQLMVIFLFIGMAFLVLT

SEQ ID NO: 2790423 - protein, 19 aa, Entamoeba invadens
FGPRCMMIIILSLVAIMTC

SEQ ID NO: 2790424 - protein, 19 aa, Entamoeba invadens
FGQIGLRTLFVAKRELSQN

SEQ ID NO: 2790425 - protein, 27 aa, Entamoeba invadens
FGRGDFVPRLSVDFVNIENYLETPWRY

SEQ ID NO: 2790426 - protein, 25 aa, Entamoeba invadens
FGRMCRFWTMWSCWSCLLYFFVAFC

SEQ ID NO: 2790427 - protein, 24 aa, Entamoeba invadens
FGRTFQVSFAHDWNIEVNTCGHAD

SEQ ID NO: 2790428 - protein, 17 aa, Entamoeba invadens
FGSAISLFIATNISESI

SEQ ID NO: 2790429 - protein, 24 aa, Entamoeba invadens
FGSAWNKAECCLVTEFAELGSLST

SEQ ID NO: 2790430 - protein, 24 aa, Entamoeba invadens
FGSLRSVFMSTKFHDVCEKIKVKY

SEQ ID NO: 2790431 - protein, 23 aa, Entamoeba invadens
FGSSALRFYQSVFAPNGYSLFQT

SEQ ID NO: 2790432 - protein, 17 aa, Entamoeba invadens
FGSVFGFTVHAFTINAQ

SEQ ID NO: 2790433 - protein, 17 aa, Entamoeba invadens
FGTAYGVLGRKLLGLSI

SEQ ID NO: 2790434 - protein, 22 aa, Entamoeba invadens
FGTCISCSSGYYVNNTKCVPCS

SEQ ID NO: 2790435 - protein, 17 aa, Entamoeba invadens
FGTIDTWIIYKLTGGKV

SEQ ID NO: 2790436 - protein, 25 aa, Entamoeba invadens
FGVACGGYLVLWMKMHPTIKYKPLI

SEQ ID NO: 2790437 - protein, 24 aa, Entamoeba invadens
FGVILLCCGVAVIILKLKKKKNMD

SEQ ID NO: 2790438 - protein, 25 aa, Entamoeba invadens
FGVKGCCSCCNKPVINNGVLCRFCL

SEQ ID NO: 2790439 - protein, 20 aa, Entamoeba invadens
FGVLKLSRLYYFIQPNPVEY

SEQ ID NO: 2790440 - protein, 21 aa, Entamoeba invadens
FGVNFKGNYSLLIDTKKQNRL

SEQ ID NO: 2790441 - protein, 23 aa, Entamoeba invadens
FGVNVYLLLSWFYEFVVNLHVRR

SEQ ID NO: 2790442 - protein, 21 aa, Entamoeba invadens
FGVSLIYRSGIILFFYKTLIV

SEQ ID NO: 2790443 - protein, 24 aa, Entamoeba invadens
FGVSLPEILVYLGVSRETQPLIVG

SEQ ID NO: 2790444 - protein, 22 aa, Entamoeba invadens
FGVSMYEIVGWCDAFPQTDPMF

SEQ ID NO: 2790445 - protein, 22 aa, Entamoeba invadens
FGVSPPGIFYGRKSLGLTKQEL

SEQ ID NO: 2790446 - protein, 22 aa, Entamoeba invadens
FGVSVLVLFIFFLSCVFVLVLM

SEQ ID NO: 2790447 - protein, 23 aa, Entamoeba invadens
FGVTMYEAFGWSEAYQNDTFKFP

SEQ ID NO: 2790448 - protein, 28 aa, Entamoeba invadens
FGVTMYEVFGWAEAYPINTFKFPWKIAE

SEQ ID NO: 2790449 - protein, 49 aa, Entamoeba invadens
FGVTMYEVFGWTNAYPLDAFKFPWKIAEFVICMKIYRCVGLKKKQTEHL

SEQ ID NO: 2790450 - protein, 39 aa, Entamoeba invadens
FGVTMYEVFGWTNVYPLDAFKFPWKIAEFVMSGKRLERK

SEQ ID NO: 2790451 - protein, 33 aa, Entamoeba invadens
FGVVFMCLFGFNALGCYYGFLVMQGKGGSSNTS

SEQ ID NO: 2790452 - protein, 21 aa, Entamoeba invadens
FGVVFPVIFSVILIVLSILSF

SEQ ID NO: 2790453 - protein, 21 aa, Entamoeba invadens
FGVVYKGTFRGNCVAIKKIKD

SEQ ID NO: 2790454 - protein, 19 aa, Entamoeba invadens
FGVYFSFLTGFLFDHYGTR

SEQ ID NO: 2790455 - protein, 24 aa, Entamoeba invadens
FGYILISICMIRVGITEIVISIGS

SEQ ID NO: 2790456 - protein, 18 aa, Entamoeba invadens
FHAFSVSSIHSWADAQKQ

SEQ ID NO: 2790457 - protein, 17 aa, Entamoeba invadens
FHASVKMVFEFFSHFVL

SEQ ID NO: 2790458 - protein, 17 aa, Entamoeba invadens
FHCELFTVMALKLRLLV

SEQ ID NO: 2790459 - protein, 25 aa, Entamoeba invadens
FHCLFLPIIPSFVVAYKISQASDST

SEQ ID NO: 2790460 - protein, 24 aa, Entamoeba invadens
FHDFYVKLIRLMGGPRDLHLSISM

SEQ ID NO: 2790461 - protein, 18 aa, Entamoeba invadens
FHDRFPTLLVLVYNVVLK

SEQ ID NO: 2790462 - protein, 22 aa, Entamoeba invadens
FHFLISIALCVISYVVTEKDRI

SEQ ID NO: 2790463 - protein, 24 aa, Entamoeba invadens
FHFSFITLCCLFSYAVSQTQCEPG

SEQ ID NO: 2790464 - protein, 30 aa, Entamoeba invadens
FHKFAVRYCKARVGPFGWDYTGNSHLAELH

SEQ ID NO: 2790465 - protein, 30 aa, Entamoeba invadens
FHKGEPWFAHQMCQFLMPYYSRTGNNKMLE

SEQ ID NO: 2790466 - protein, 23 aa, Entamoeba invadens
FHLISFFIFFALFGVVIVLYSAQ

SEQ ID NO: 2790467 - protein, 27 aa, Entamoeba invadens
FHLLLRCMRCLDGVKLINIINLKQYTL

SEQ ID NO: 2790468 - protein, 21 aa, Entamoeba invadens
FHNVQCNCLSSYMNVNNMVTD

SEQ ID NO: 2790469 - protein, 17 aa, Entamoeba invadens
FHRARKLLLEKVNELAK

SEQ ID NO: 2790470 - protein, 25 aa, Entamoeba invadens
FHSIHICVFKEYYIQLIKMLIMSMA

SEQ ID NO: 2790471 - protein, 19 aa, Entamoeba invadens
FHVPYKIKTRLDFNEKTAF

SEQ ID NO: 2790472 - protein, 18 aa, Entamoeba invadens
FHYKECPICMQPFLSKQP

SEQ ID NO: 2790473 - protein, 17 aa, Entamoeba invadens
FHYKPDIAICKDETANM

SEQ ID NO: 2790474 - protein, 17 aa, Entamoeba invadens
FHYLQGIGYYCFPDKVK

SEQ ID NO: 2790475 - protein, 18 aa, Entamoeba invadens
FHYSCDVFVGFVMAALVF

SEQ ID NO: 2790476 - protein, 24 aa, Entamoeba invadens
FIACGIPVSFIIYFAFRNSVMMVT

SEQ ID NO: 2790477 - protein, 23 aa, Entamoeba invadens
FIADYAYKYFLLKNVNGAVTYFI

SEQ ID NO: 2790478 - protein, 17 aa, Entamoeba invadens
FIAGTSLQTFMGDSITQ

SEQ ID NO: 2790479 - protein, 23 aa, Entamoeba invadens
FIAIIAIIWWRRAKSVKAETAAI

SEQ ID NO: 2790480 - protein, 18 aa, Entamoeba invadens
FIALMGFVAARWVGFDTT

SEQ ID NO: 2790481 - protein, 20 aa, Entamoeba invadens
FIAQLYKFVVFTVEFQGNYS

SEQ ID NO: 2790482 - protein, 24 aa, Entamoeba invadens
FIASLFRFGVKLKIDAPLSEANKY

SEQ ID NO: 2790483 - protein, 24 aa, Entamoeba invadens
FIAYSFLRFRLITLGFDIIPAAIN

SEQ ID NO: 2790484 - protein, 22 aa, Entamoeba invadens
FICGPCSRSHIKLQHRTLKKGG

SEQ ID NO: 2790485 - protein, 35 aa, Entamoeba invadens
FICTKCSDTKCLVCTSLQCVLCANDYILNGSVCIK

SEQ ID NO: 2790486 - protein, 20 aa, Entamoeba invadens
FICYAICFRNKPFMYRETAV

SEQ ID NO: 2790487 - protein, 19 aa, Entamoeba invadens
FIDAYMCLMSITGTEMTET

SEQ ID NO: 2790488 - protein, 22 aa, Entamoeba invadens
FIDLPVFWPILLLYFIVLFIVT

SEQ ID NO: 2790489 - protein, 26 aa, Entamoeba invadens
FIEQELKGATVLKCAGSSSITETTKA

SEQ ID NO: 2790490 - protein, 17 aa, Entamoeba invadens
FIETTGFIALNREKCLQ

SEQ ID NO: 2790491 - protein, 17 aa, Entamoeba invadens
FIFDAPVSLEFALGAVS

SEQ ID NO: 2790492 - protein, 20 aa, Entamoeba invadens
FIFFLSCVFVLVLMLFVITL

SEQ ID NO: 2790493 - protein, 17 aa, Entamoeba invadens
FIFFVFFNVVFSANIIC

SEQ ID NO: 2790494 - protein, 17 aa, Entamoeba invadens
FIFFVFFNVVFSANMIC

SEQ ID NO: 2790495 - protein, 17 aa, Entamoeba invadens
FIFLKRDLTWSLFYFDT

SEQ ID NO: 2790496 - protein, 25 aa, Entamoeba invadens
FIFLVCVYFAWVGLLLARLDIPKEW

SEQ ID NO: 2790497 - protein, 19 aa, Entamoeba invadens
FIFLYCATFYFLVATISGI

SEQ ID NO: 2790498 - protein, 22 aa, Entamoeba invadens
FIFPTKFALIFTFGNVLLFVGT

SEQ ID NO: 2790499 - protein, 18 aa, Entamoeba invadens
FIFRDYPLTLAICLFFWV

SEQ ID NO: 2790500 - protein, 24 aa, Entamoeba invadens
FIFSLKILFILCGESEQVISIARD

SEQ ID NO: 2790501 - protein, 26 aa, Entamoeba invadens
FIGDTVGVFGCEICLVLFCITVSVRL

SEQ ID NO: 2790502 - protein, 17 aa, Entamoeba invadens
FIGLIIIYIFQAVCVFF

SEQ ID NO: 2790503 - protein, 20 aa, Entamoeba invadens
FIGNIKMNFVGLKHKLFLVG

SEQ ID NO: 2790504 - protein, 17 aa, Entamoeba invadens
FIGTIVFIVRYRKMKGR

SEQ ID NO: 2790505 - protein, 17 aa, Entamoeba invadens
FIHITISMGLILKNNMG

SEQ ID NO: 2790506 - protein, 24 aa, Entamoeba invadens
FIIGMLTKLGVVFKEKGTKGSTIT

SEQ ID NO: 2790507 - protein, 26 aa, Entamoeba invadens
FIIILCCICPAPSLSVIYSIEYQTAR

SEQ ID NO: 2790508 - protein, 33 aa, Entamoeba invadens
FIIKMPLLHRIACFRDDVVFVIYLYQRWIYPVD

SEQ ID NO: 2790509 - protein, 18 aa, Entamoeba invadens
FIILFMIFIVYTLVATLV

SEQ ID NO: 2790510 - protein, 19 aa, Entamoeba invadens
FIIPIMIYAGVGGFILGSM

SEQ ID NO: 2790511 - protein, 33 aa, Entamoeba invadens
FIIPTCLLLCLFTLNWVRRFPLINKVCVVSLIP

SEQ ID NO: 2790512 - protein, 22 aa, Entamoeba invadens
FIIRKTLPFLHIDKCYDYFGNV

SEQ ID NO: 2790513 - protein, 20 aa, Entamoeba invadens
FIIVCVIATLALIYIVIELS

SEQ ID NO: 2790514 - protein, 23 aa, Entamoeba invadens
FIKAKSGVFFGIPPLGGWILSIA

SEQ ID NO: 2790515 - protein, 23 aa, Entamoeba invadens
FIKDEFFSTLSMVAPLFSLVIYI

SEQ ID NO: 2790516 - protein, 17 aa, Entamoeba invadens
FILGEYFFNSLWMILCL

SEQ ID NO: 2790517 - protein, 26 aa, Entamoeba invadens
FILGKLKEGFDVVGIPDYPVQTFDDL

SEQ ID NO: 2790518 - protein, 19 aa, Entamoeba invadens
FILNFKPQVLFLSPISKAK

SEQ ID NO: 2790519 - protein, 25 aa, Entamoeba invadens
FILPLIWPIIVFKYIKSQSHDEEIW

SEQ ID NO: 2790520 - protein, 19 aa, Entamoeba invadens
FILPLPRYPTSWEEEKSLS

SEQ ID NO: 2790521 - protein, 17 aa, Entamoeba invadens
FILRRLKESVLQDLPPK

SEQ ID NO: 2790522 - protein, 20 aa, Entamoeba invadens
FILSIDFILSLSLCVTHVIT

SEQ ID NO: 2790523 - protein, 23 aa, Entamoeba invadens
FILTCIKGKLNALSTAYLTISHK

SEQ ID NO: 2790524 - protein, 19 aa, Entamoeba invadens
FIMPTKFQITIGFGLIITA

SEQ ID NO: 2790525 - protein, 25 aa, Entamoeba invadens
FIMWLCLAGRICALYFYNTYLTKWG

SEQ ID NO: 2790526 - protein, 25 aa, Entamoeba invadens
FIMWLCLAGRICALYYYNTYLTKWG

SEQ ID NO: 2790527 - protein, 19 aa, Entamoeba invadens
FINALNIRFCNSTCVKFKA

SEQ ID NO: 2790528 - protein, 18 aa, Entamoeba invadens
FINGTKFVYDFVINEQTR

SEQ ID NO: 2790529 - protein, 24 aa, Entamoeba invadens
FINHKLKKFFPFQDFKEQRTKTAN

SEQ ID NO: 2790530 - protein, 24 aa, Entamoeba invadens
FINICLACAFSVRKMFLNVFIMSA

SEQ ID NO: 2790531 - protein, 27 aa, Entamoeba invadens
FINISLAIFFFWKILLVVFFVLFELSF

SEQ ID NO: 2790532 - protein, 17 aa, Entamoeba invadens
FINNTLPGWLLVRISSV

SEQ ID NO: 2790533 - protein, 27 aa, Entamoeba invadens
FINSCPKKIPAGVFIRYINELINDNQI

SEQ ID NO: 2790534 - protein, 22 aa, Entamoeba invadens
FINVVIGNRCMFGYETLSSVEI

SEQ ID NO: 2790535 - protein, 24 aa, Entamoeba invadens
FIPDYLPREFIILINATLRSIIIF

SEQ ID NO: 2790536 - protein, 26 aa, Entamoeba invadens
FIPEDMLRKYSWCLLITNETIKIQCK

SEQ ID NO: 2790537 - protein, 20 aa, Entamoeba invadens
FIPKPIILYMRLRKQQKAHI

SEQ ID NO: 2790538 - protein, 24 aa, Entamoeba invadens
FIPLLPIRVLFFIFSVVGVQVENF

SEQ ID NO: 2790539 - protein, 18 aa, Entamoeba invadens
FIPNEIDERVDIYGYSED

SEQ ID NO: 2790540 - protein, 22 aa, Entamoeba invadens
FIPNHICMVTEFALYGSLQDLI

SEQ ID NO: 2790541 - protein, 17 aa, Entamoeba invadens
FIPTDNMFFFIVSIEAC

SEQ ID NO: 2790542 - protein, 26 aa, Entamoeba invadens
FIQAIPMALLLFAMYAWVTFVLTFFT

SEQ ID NO: 2790543 - protein, 25 aa, Entamoeba invadens
FIQCMLRPKIIPYLDACKKDMWINI

SEQ ID NO: 2790544 - protein, 24 aa, Entamoeba invadens
FIQRICPLSSLFEFHTNKMYLILF

SEQ ID NO: 2790545 - protein, 23 aa, Entamoeba invadens
FIRDFSCLFKRGEVTRLIDTHLD

SEQ ID NO: 2790546 - protein, 23 aa, Entamoeba invadens
FIRDYAYKYFLLKNENGAVTYFQ

SEQ ID NO: 2790547 - protein, 25 aa, Entamoeba invadens
FISDLRDIYVFGDLFATFSTDDLVL

SEQ ID NO: 2790548 - protein, 17 aa, Entamoeba invadens
FISELKNTVVLMMNEPI

SEQ ID NO: 2790549 - protein, 24 aa, Entamoeba invadens
FISEPNGFGFLSLTLFVSLSLLDF

SEQ ID NO: 2790550 - protein, 32 aa, Entamoeba invadens
FISFKRWRIIPSLLCLSAMFFCQSLTRLFVLP

SEQ ID NO: 2790551 - protein, 20 aa, Entamoeba invadens
FISKCLACRFSSLINSECEN

SEQ ID NO: 2790552 - protein, 28 aa, Entamoeba invadens
FISLGCAVGRLISRFCLFTVSERQGIKL

SEQ ID NO: 2790553 - protein, 25 aa, Entamoeba invadens
FISSFCLLGVPLFVNRKSSFTYYLS

SEQ ID NO: 2790554 - protein, 31 aa, Entamoeba invadens
FITGYAIGFSKCWDLTLVILAVAPLMFITIV

SEQ ID NO: 2790555 - protein, 17 aa, Entamoeba invadens
FITMLPVYFIMKYMPNK

SEQ ID NO: 2790556 - protein, 28 aa, Entamoeba invadens
FITNCKEVGHSKCTRCSFWHTPSANDTY

SEQ ID NO: 2790557 - protein, 22 aa, Entamoeba invadens
FITPKCKIMKGQLIRCGGNMDD

SEQ ID NO: 2790558 - protein, 19 aa, Entamoeba invadens
FITPLEMVSGIVINHTSTV

SEQ ID NO: 2790559 - protein, 19 aa, Entamoeba invadens
FITSVSLLAAFVLNKSIQK

SEQ ID NO: 2790560 - protein, 25 aa, Entamoeba invadens
FIVNPRYQLTFELLGTMGADSDFEI

SEQ ID NO: 2790561 - protein, 17 aa, Entamoeba invadens
FIVVGRLGAKSGVNEVA

SEQ ID NO: 2790562 - protein, 21 aa, Entamoeba invadens
FIVVICALLLMYFQHRATIKA

SEQ ID NO: 2790563 - protein, 32 aa, Entamoeba invadens
FIWQRPFLDKGFKYPWNIIKYVTSGERLPRTE

SEQ ID NO: 2790564 - protein, 17 aa, Entamoeba invadens
FIYKFKWTLDTNQVVPI

SEQ ID NO: 2790565 - protein, 19 aa, Entamoeba invadens
FIYPCWEGSTVFGIDLTLE

SEQ ID NO: 2790566 - protein, 17 aa, Entamoeba invadens
FIYRYLKNYDYAFSRRR

SEQ ID NO: 2790567 - protein, 25 aa, Entamoeba invadens
FKADLLKNVIFFFVFIVAFCSIVRY

SEQ ID NO: 2790568 - protein, 24 aa, Entamoeba invadens
FKAKSEALYFISWVCESTTNEVGA

SEQ ID NO: 2790569 - protein, 24 aa, Entamoeba invadens
FKASGLCGKIFEYLSWAPSKRKCD

SEQ ID NO: 2790570 - protein, 21 aa, Entamoeba invadens
FKATRLELFIKNVIDNYDIIL

SEQ ID NO: 2790571 - protein, 21 aa, Entamoeba invadens
FKAVNLKSGAMLLENQLTIPS

SEQ ID NO: 2790572 - protein, 17 aa, Entamoeba invadens
FKAVTYVGFRFALGIAF

SEQ ID NO: 2790573 - protein, 19 aa, Entamoeba invadens
FKCCVCLSTNTGCLDCNGG

SEQ ID NO: 2790574 - protein, 18 aa, Entamoeba invadens
FKCDLGYYPINGKCTPCH

SEQ ID NO: 2790575 - protein, 25 aa, Entamoeba invadens
FKCDTGCIVCKTGLSCIQCDENRIL

SEQ ID NO: 2790576 - protein, 18 aa, Entamoeba invadens
FKCDVSCKTCKDSNTCET

SEQ ID NO: 2790577 - protein, 21 aa, Entamoeba invadens
FKCFDTIRLCIDRNKTVVHAL

SEQ ID NO: 2790578 - protein, 18 aa, Entamoeba invadens
FKCVHYSEIPNCIEATNS

SEQ ID NO: 2790579 - protein, 18 aa, Entamoeba invadens
FKDHANLLAGVHFLTESQ

SEQ ID NO: 2790580 - protein, 25 aa, Entamoeba invadens
FKDICKVFMCCVMMFGKHRGFPERV

SEQ ID NO: 2790581 - protein, 17 aa, Entamoeba invadens
FKDSRTWNTLKNEGTPF

SEQ ID NO: 2790582 - protein, 33 aa, Entamoeba invadens
FKDVHFRYPTRPEIEVLKGLTFEAEKGKTVALV

SEQ ID NO: 2790583 - protein, 20 aa, Entamoeba invadens
FKELALRAKTVVCCRVSPLQ

SEQ ID NO: 2790584 - protein, 19 aa, Entamoeba invadens
FKESEIILDKAIIDSTTEP

SEQ ID NO: 2790585 - protein, 22 aa, Entamoeba invadens
FKEVSLYLVRSGDDNTLYGSST

SEQ ID NO: 2790586 - protein, 25 aa, Entamoeba invadens
FKFAQLDFSVTFARASVKENDIDNA

SEQ ID NO: 2790587 - protein, 19 aa, Entamoeba invadens
FKFIREVLNPPVIGTSVEL

SEQ ID NO: 2790588 - protein, 25 aa, Entamoeba invadens
FKFLPEPIAALLSMKTMMSEIKVNE

SEQ ID NO: 2790589 - protein, 18 aa, Entamoeba invadens
FKFSNYCAQLIIMKIMTT

SEQ ID NO: 2790590 - protein, 25 aa, Entamoeba invadens
FKGDRCVRCKSTFYLTENHMCLNCS

SEQ ID NO: 2790591 - protein, 24 aa, Entamoeba invadens
FKGDRCVRCKSTFYLTENHTCLKC

SEQ ID NO: 2790592 - protein, 20 aa, Entamoeba invadens
FKGFLTRLMCQCGVMQASKE

SEQ ID NO: 2790593 - protein, 20 aa, Entamoeba invadens
FKGSYKISGESYWNQLYCLA

SEQ ID NO: 2790594 - protein, 20 aa, Entamoeba invadens
FKGVVCFYTAIGVDCITFIV

SEQ ID NO: 2790595 - protein, 20 aa, Entamoeba invadens
FKHLFLLGTFSYPNKENQLF

SEQ ID NO: 2790596 - protein, 28 aa, Entamoeba invadens
FKHTFFRYPTRPERCVLDDVSFKIKHGE

SEQ ID NO: 2790597 - protein, 21 aa, Entamoeba invadens
FKIASIMLIALFVYDIFWVFG

SEQ ID NO: 2790598 - protein, 25 aa, Entamoeba invadens
FKIDGKCYFDFSFCYYPQKYRLGRW

SEQ ID NO: 2790599 - protein, 20 aa, Entamoeba invadens
FKIDSNWVIQYSSFKTSYNK

SEQ ID NO: 2790600 - protein, 17 aa, Entamoeba invadens
FKIELHTSSNLMCQSAL

SEQ ID NO: 2790601 - protein, 21 aa, Entamoeba invadens
FKIEVNGILEFFDQIESAETI

SEQ ID NO: 2790602 - protein, 22 aa, Entamoeba invadens
FKIKDIKTMYSINEIKKTMFEH

SEQ ID NO: 2790603 - protein, 17 aa, Entamoeba invadens
FKIKFTFKANGENGEII

SEQ ID NO: 2790604 - protein, 22 aa, Entamoeba invadens
FKIKILKDSCCGLEYLHRHNIL

SEQ ID NO: 2790605 - protein, 22 aa, Entamoeba invadens
FKIKISSPFFDTRLKLRIYDNA

SEQ ID NO: 2790606 - protein, 17 aa, Entamoeba invadens
FKIKMLCTSCVTDDIGI

SEQ ID NO: 2790607 - protein, 20 aa, Entamoeba invadens
FKILVIHCTKEIYNKTSQQC

SEQ ID NO: 2790608 - protein, 20 aa, Entamoeba invadens
FKILVIHCTKEMYNKTSQKC

SEQ ID NO: 2790609 - protein, 22 aa, Entamoeba invadens
FKILVLRCTNGVYNKTSKMCED

SEQ ID NO: 2790610 - protein, 23 aa, Entamoeba invadens
FKILVLRCTNGVYNKTSKMCEDT

SEQ ID NO: 2790611 - protein, 19 aa, Entamoeba invadens
FKIPGADETLEFSTCNSAS

SEQ ID NO: 2790612 - protein, 21 aa, Entamoeba invadens
FKIQSCEVISVIPISYSSSSN

SEQ ID NO: 2790613 - protein, 24 aa, Entamoeba invadens
FKISNCYRYDGWYIKYEKSANGVK

SEQ ID NO: 2790614 - protein, 24 aa, Entamoeba invadens
FKISPTNVILCPGEACEFEGTILP

SEQ ID NO: 2790615 - protein, 18 aa, Entamoeba invadens
FKKEVAMLDKFRSDYIVH

SEQ ID NO: 2790616 - protein, 18 aa, Entamoeba invadens
FKKEVAMLDKMRCDQIIH

SEQ ID NO: 2790617 - protein, 28 aa, Entamoeba invadens
FKKEVAMLEKFRCGYIVHFYGAVFIPSK

SEQ ID NO: 2790618 - protein, 31 aa, Entamoeba invadens
FKKEVSMLDKFRIDYVVNFYGSVFIPNKICM

SEQ ID NO: 2790619 - protein, 25 aa, Entamoeba invadens
FKKLVKLVDSVVCCRVTPKEKAEIT

SEQ ID NO: 2790620 - protein, 21 aa, Entamoeba invadens
FKKNYLCVSCSSLNKCISCSD

SEQ ID NO: 2790621 - protein, 29 aa, Entamoeba invadens
FKKSPELLDLWKFPIFNVYTMNNNRGLLD

SEQ ID NO: 2790622 - protein, 25 aa, Entamoeba invadens
FKKSVFPDSLFSRGILYAKVHPNNT

SEQ ID NO: 2790623 - protein, 22 aa, Entamoeba invadens
FKKTCSNCVGCCVIPYHLKTIE

SEQ ID NO: 2790624 - protein, 24 aa, Entamoeba invadens
FKKTEFIFKLNWLRDEDCNLISTI

SEQ ID NO: 2790625 - protein, 17 aa, Entamoeba invadens
FKKTISMTTNFQMYTIN

SEQ ID NO: 2790626 - protein, 17 aa, Entamoeba invadens
FKKTLYKDFGFDRTVYV

SEQ ID NO: 2790627 - protein, 21 aa, Entamoeba invadens
FKKTVVKMEMDGVDFKNFADN

SEQ ID NO: 2790628 - protein, 19 aa, Entamoeba invadens
FKKVLMSNACSKQVNPASP

SEQ ID NO: 2790629 - protein, 19 aa, Entamoeba invadens
FKLEVSMLDKFRSPYIVHF

SEQ ID NO: 2790630 - protein, 17 aa, Entamoeba invadens
FKLFHLFLLTLGLAFNF

SEQ ID NO: 2790631 - protein, 19 aa, Entamoeba invadens
FKLYHNYILFCAIRNNFVN

SEQ ID NO: 2790632 - protein, 20 aa, Entamoeba invadens
FKMDVSVIPIAFVILLWVIK

SEQ ID NO: 2790633 - protein, 19 aa, Entamoeba invadens
FKMFIPPLVTIFRQKPMYR

SEQ ID NO: 2790634 - protein, 19 aa, Entamoeba invadens
FKMIENWISLISRKVERTC

SEQ ID NO: 2790635 - protein, 20 aa, Entamoeba invadens
FKMSGLTAITFAETVTKFGD

SEQ ID NO: 2790636 - protein, 17 aa, Entamoeba invadens
FKMSGLTAVTFAATVAK

SEQ ID NO: 2790637 - protein, 21 aa, Entamoeba invadens
FKMYEGMGFLYASLKNIRNTE

SEQ ID NO: 2790638 - protein, 25 aa, Entamoeba invadens
FKNAAFFLHLLWYAMICQFTSQRLY

SEQ ID NO: 2790639 - protein, 25 aa, Entamoeba invadens
FKNAVYKINIGQYFGISASSGNDSD

SEQ ID NO: 2790640 - protein, 22 aa, Entamoeba invadens
FKNDSKIIIWGRAQITCSKTIF

SEQ ID NO: 2790641 - protein, 22 aa, Entamoeba invadens
FKNEKCTICEKGYLHTNDNSCI

SEQ ID NO: 2790642 - protein, 20 aa, Entamoeba invadens
FKNEMCVSCTETYGECRVCD

SEQ ID NO: 2790643 - protein, 22 aa, Entamoeba invadens
FKNGKCPVCEDGYFNTPSRVCE

SEQ ID NO: 2790644 - protein, 19 aa, Entamoeba invadens
FKNICFRYPTRPENAVLKG

SEQ ID NO: 2790645 - protein, 22 aa, Entamoeba invadens
FKNPNICTEMPFKIQKGEKSGV

SEQ ID NO: 2790646 - protein, 20 aa, Entamoeba invadens
FKNTILFAVNGMFIEKKTSL

SEQ ID NO: 2790647 - protein, 19 aa, Entamoeba invadens
FKNTYSLCKIPPEVLKTIT

SEQ ID NO: 2790648 - protein, 21 aa, Entamoeba invadens
FKPIKSPRINIDMKEEEQNVP

SEQ ID NO: 2790649 - protein, 17 aa, Entamoeba invadens
FKPILKMLQIPRFNTAI

SEQ ID NO: 2790650 - protein, 26 aa, Entamoeba invadens
FKPNYSVAEPLTWGKGMKKDFFKCSN

SEQ ID NO: 2790651 - protein, 20 aa, Entamoeba invadens
FKPQVLFLSPISKAKTVTAL

SEQ ID NO: 2790652 - protein, 19 aa, Entamoeba invadens
FKPSTPLILQHTVFNSLSE

SEQ ID NO: 2790653 - protein, 26 aa, Entamoeba invadens
FKQLKAEASVNLGFRTVIVEELMLRG

SEQ ID NO: 2790654 - protein, 20 aa, Entamoeba invadens
FKQMKGCQLVDERRGEKVRS

SEQ ID NO: 2790655 - protein, 22 aa, Entamoeba invadens
FKQQYKVLSIIFLFLDVVMVSN

SEQ ID NO: 2790656 - protein, 21 aa, Entamoeba invadens
FKQREKFVARRVENEANNVET

SEQ ID NO: 2790657 - protein, 20 aa, Entamoeba invadens
FKQTCEECGYEFEEAQEVFP

SEQ ID NO: 2790658 - protein, 17 aa, Entamoeba invadens
FKQTYFCIHLITLGLFV

SEQ ID NO: 2790659 - protein, 18 aa, Entamoeba invadens
FKRACMRNLSSVVVVVFV

SEQ ID NO: 2790660 - protein, 18 aa, Entamoeba invadens
FKRCSKCSNGYYLENNSN

SEQ ID NO: 2790661 - protein, 20 aa, Entamoeba invadens
FKRDFVKASSLLVESIGTFA

SEQ ID NO: 2790662 - protein, 20 aa, Entamoeba invadens
FKREHIQALWTIIIAQSPHV

SEQ ID NO: 2790663 - protein, 17 aa, Entamoeba invadens
FKRGCSPSIRRDIPQEL

SEQ ID NO: 2790664 - protein, 24 aa, Entamoeba invadens
FKRIELYIKHLFDIRVLIKNGDFK

SEQ ID NO: 2790665 - protein, 20 aa, Entamoeba invadens
FKRKENINASGIKFSFFKDV

SEQ ID NO: 2790666 - protein, 31 aa, Entamoeba invadens
FKRNGMEIFPNFKFWYGLPRLVLDGMEFTFC

SEQ ID NO: 2790667 - protein, 25 aa, Entamoeba invadens
FKRSFLKCSILYDSIMKDFDVIVPD

SEQ ID NO: 2790668 - protein, 23 aa, Entamoeba invadens
FKRSTSVRINAYKMFLNYINNGQ

SEQ ID NO: 2790669 - protein, 17 aa, Entamoeba invadens
FKSALVGTQNLGIEAIE

SEQ ID NO: 2790670 - protein, 26 aa, Entamoeba invadens
FKSASGKIEIVWIIEKFIRHLVDTQM

SEQ ID NO: 2790671 - protein, 20 aa, Entamoeba invadens
FKSDIIRYLKIKVVNGKRIG

SEQ ID NO: 2790672 - protein, 20 aa, Entamoeba invadens
FKSENGLYCNQNTWFNTSVF

SEQ ID NO: 2790673 - protein, 17 aa, Entamoeba invadens
FKSGCVVCQDGYYRLGL

SEQ ID NO: 2790674 - protein, 21 aa, Entamoeba invadens
FKSKTGIIVSCVLISLFLILI

SEQ ID NO: 2790675 - protein, 17 aa, Entamoeba invadens
FKSLHFGFSLVGSLIGA

SEQ ID NO: 2790676 - protein, 18 aa, Entamoeba invadens
FKSLHFGFSLVGSLIGAG

SEQ ID NO: 2790677 - protein, 19 aa, Entamoeba invadens
FKSNALYSIDTLTLSISTS

SEQ ID NO: 2790678 - protein, 22 aa, Entamoeba invadens
FKSNGKMSLRCSTGEYNDVCLF

SEQ ID NO: 2790679 - protein, 18 aa, Entamoeba invadens
FKSSWEITKFFCEGKRLK

SEQ ID NO: 2790680 - protein, 25 aa, Entamoeba invadens
FKSVKFTEDYGRIVVNNGAVLTIDK

SEQ ID NO: 2790681 - protein, 27 aa, Entamoeba invadens
FKTELSKCKCILKQPKIDSERSTYEEE

SEQ ID NO: 2790682 - protein, 19 aa, Entamoeba invadens
FKTEMSKIFCQVMDIIEVI

SEQ ID NO: 2790683 - protein, 17 aa, Entamoeba invadens
FKTGKFIDRDFGSYEGE

SEQ ID NO: 2790684 - protein, 18 aa, Entamoeba invadens
FKTLRMPSERECIFQTKF

SEQ ID NO: 2790685 - protein, 20 aa, Entamoeba invadens
FKTMPPATVLVWLLTPSSET

SEQ ID NO: 2790686 - protein, 25 aa, Entamoeba invadens
FKTMRVDDVLIRMCPPNMMDYKLTC

SEQ ID NO: 2790687 - protein, 19 aa, Entamoeba invadens
FKTPILRNFIPKPSTHNLM

SEQ ID NO: 2790688 - protein, 19 aa, Entamoeba invadens
FKTTFYLQATMILKNPHLL

SEQ ID NO: 2790689 - protein, 17 aa, Entamoeba invadens
FKTYSGVCKLKNETLGC

SEQ ID NO: 2790690 - protein, 37 aa, Entamoeba invadens
FKVEPEVVLIKRGCACEFSLYLTPLCTCKINTTIQII

SEQ ID NO: 2790691 - protein, 17 aa, Entamoeba invadens
FKVGSIFGGGVYLKTQL

SEQ ID NO: 2790692 - protein, 20 aa, Entamoeba invadens
FKVIECKMGFYSNNTNCVEC

SEQ ID NO: 2790693 - protein, 24 aa, Entamoeba invadens
FKVLLEGHLLRYGASDEIYCHVNH

SEQ ID NO: 2790694 - protein, 19 aa, Entamoeba invadens
FKVLTLCCLMMKTIQNKSV

SEQ ID NO: 2790695 - protein, 19 aa, Entamoeba invadens
FKVSYNLVVEILTHESGCT

SEQ ID NO: 2790696 - protein, 19 aa, Entamoeba invadens
FKWTMSQYITWYITFSLFF

SEQ ID NO: 2790697 - protein, 17 aa, Entamoeba invadens
FKYFNREISAFVSDCIM

SEQ ID NO: 2790698 - protein, 19 aa, Entamoeba invadens
FKYFPCGIGNVNSDNVKIS

SEQ ID NO: 2790699 - protein, 18 aa, Entamoeba invadens
FKYLDIYGQQYSQLRFLF

SEQ ID NO: 2790700 - protein, 20 aa, Entamoeba invadens
FKYNAIYIFNNFKIVLGEMV

SEQ ID NO: 2790701 - protein, 21 aa, Entamoeba invadens
FKYPWKIAEFVISGNRLKKRQ

SEQ ID NO: 2790702 - protein, 20 aa, Entamoeba invadens
FKYTTIVGVILFVFGILYCD

SEQ ID NO: 2790703 - protein, 21 aa, Entamoeba invadens
FKYTVSTTRTGFFLVSKEAIS

SEQ ID NO: 2790704 - protein, 22 aa, Entamoeba invadens
FKYTWKIAEFVISGNRLKKRQE

SEQ ID NO: 2790705 - protein, 20 aa, Entamoeba invadens
FKYVCTDGGLYLYSYIDLEC

SEQ ID NO: 2790706 - protein, 23 aa, Entamoeba invadens
FLACRRLRSLTLRNYFTRFSQIE

SEQ ID NO: 2790707 - protein, 19 aa, Entamoeba invadens
FLAKMCVIHNVIRPSDAVE

SEQ ID NO: 2790708 - protein, 19 aa, Entamoeba invadens
FLANKVCVYKEGIYMDAYY

SEQ ID NO: 2790709 - protein, 21 aa, Entamoeba invadens
FLASSCLWVSFWRKYKEVKTS

SEQ ID NO: 2790710 - protein, 21 aa, Entamoeba invadens
FLAVFFGMFFLFVKPLYNFFF

SEQ ID NO: 2790711 - protein, 17 aa, Entamoeba invadens
FLAVNSFECSVGCLTPC

SEQ ID NO: 2790712 - protein, 18 aa, Entamoeba invadens
FLAYAAECGEIFNSNTDP

SEQ ID NO: 2790713 - protein, 18 aa, Entamoeba invadens
FLAYKMRYNTVFAILTGL

SEQ ID NO: 2790714 - protein, 17 aa, Entamoeba invadens
FLAYPIYYIMKAFPTKR

SEQ ID NO: 2790715 - protein, 17 aa, Entamoeba invadens
FLCFLKWLCSDITITAW

SEQ ID NO: 2790716 - protein, 17 aa, Entamoeba invadens
FLCLFFVSPVSSHDFES

SEQ ID NO: 2790717 - protein, 19 aa, Entamoeba invadens
FLCTCRPTEIVDLMACQCD

SEQ ID NO: 2790718 - protein, 19 aa, Entamoeba invadens
FLDDYTELVRFCADGPSRS

SEQ ID NO: 2790719 - protein, 21 aa, Entamoeba invadens
FLDFLLSWKLFGMLYVVSMMV

SEQ ID NO: 2790720 - protein, 17 aa, Entamoeba invadens
FLDRLGNDLPLIVYFST

SEQ ID NO: 2790721 - protein, 21 aa, Entamoeba invadens
FLDVTKIWKGNEVIDLVEEVK

SEQ ID NO: 2790722 - protein, 24 aa, Entamoeba invadens
FLEAPCGFVSTVGRSTGFDYTKEC

SEQ ID NO: 2790723 - protein, 17 aa, Entamoeba invadens
FLEKAVMLMKKYSPSCV

SEQ ID NO: 2790724 - protein, 22 aa, Entamoeba invadens
FLEKELKMSKLSGVYVTSSDWS

SEQ ID NO: 2790725 - protein, 18 aa, Entamoeba invadens
FLEKTGELCFNIYIEDVV

SEQ ID NO: 2790726 - protein, 23 aa, Entamoeba invadens
FLERFVDFFKLFHLFLLTLGLAF

SEQ ID NO: 2790727 - protein, 17 aa, Entamoeba invadens
FLERIFVPNNLSQYLNT

SEQ ID NO: 2790728 - protein, 26 aa, Entamoeba invadens
FLFAVCIRLALFYVVPMYAIPNRVEF

SEQ ID NO: 2790729 - protein, 18 aa, Entamoeba invadens
FLFFSAIITFFFLFRTSN

SEQ ID NO: 2790730 - protein, 23 aa, Entamoeba invadens
FLFLCCLFTFSCSMYCGGGQYEY

SEQ ID NO: 2790731 - protein, 19 aa, Entamoeba invadens
FLFNVKPNALAIVGAVFIF

SEQ ID NO: 2790732 - protein, 26 aa, Entamoeba invadens
FLFSEFFCYMSSFGFDEHLPHFKEDY

SEQ ID NO: 2790733 - protein, 30 aa, Entamoeba invadens
FLFSKYRSCIVKRYFLLNGVLFLMRSFSIF

SEQ ID NO: 2790734 - protein, 23 aa, Entamoeba invadens
FLFVVPWLAGFIISRKTTNKTVR

SEQ ID NO: 2790735 - protein, 32 aa, Entamoeba invadens
FLGASFYGYFSFNIFRSGCGFSTEANDVDEFK

SEQ ID NO: 2790736 - protein, 21 aa, Entamoeba invadens
FLGCSGISRFVFPRYSGNLPP

SEQ ID NO: 2790737 - protein, 19 aa, Entamoeba invadens
FLGDVMVNLICSIRLFMTT

SEQ ID NO: 2790738 - protein, 24 aa, Entamoeba invadens
FLGEILRSIKFIKYNAWEKPLNSR

SEQ ID NO: 2790739 - protein, 19 aa, Entamoeba invadens
FLGVRLITMGMSFVVTGII

SEQ ID NO: 2790740 - protein, 18 aa, Entamoeba invadens
FLHLKGFVLRMMRMGNAR

SEQ ID NO: 2790741 - protein, 20 aa, Entamoeba invadens
FLHLNIKPGNVMVMSTDLNE

SEQ ID NO: 2790742 - protein, 25 aa, Entamoeba invadens
FLHSRCFRVFILTSLLVFSVLYIVL

SEQ ID NO: 2790743 - protein, 19 aa, Entamoeba invadens
FLHVMCDALGSFVAVIVAL

SEQ ID NO: 2790744 - protein, 17 aa, Entamoeba invadens
FLIALKVLAPDMVFMLR

SEQ ID NO: 2790745 - protein, 19 aa, Entamoeba invadens
FLIDSNFTVKVCDFGFAEV

SEQ ID NO: 2790746 - protein, 26 aa, Entamoeba invadens
FLIFFSVASAFVFPIIFAAPYVGLSI

SEQ ID NO: 2790747 - protein, 17 aa, Entamoeba invadens
FLIHGFWPQSNEGSINC

SEQ ID NO: 2790748 - protein, 20 aa, Entamoeba invadens
FLIHLKFDCVICRHKRENGI

SEQ ID NO: 2790749 - protein, 18 aa, Entamoeba invadens
FLIIPFIISAGFVIVLHY

SEQ ID NO: 2790750 - protein, 22 aa, Entamoeba invadens
FLILCGVCFVALSGYYIYEISV

SEQ ID NO: 2790751 - protein, 17 aa, Entamoeba invadens
FLILCLAVGGFFQTIYV

SEQ ID NO: 2790752 - protein, 18 aa, Entamoeba invadens
FLILCLLNRTLSVVCNSG

SEQ ID NO: 2790753 - protein, 21 aa, Entamoeba invadens
FLILLSLFYFELMRFYLSSSQ

SEQ ID NO: 2790754 - protein, 23 aa, Entamoeba invadens
FLIQRKSIFTSWEYHSHMFSFSF

SEQ ID NO: 2790755 - protein, 18 aa, Entamoeba invadens
FLIRSSKKKAFRTIKDTF

SEQ ID NO: 2790756 - protein, 19 aa, Entamoeba invadens
FLISVVVGVACLFQSPLCD

SEQ ID NO: 2790757 - protein, 17 aa, Entamoeba invadens
FLIYGNMYFMYNCLFGI

SEQ ID NO: 2790758 - protein, 24 aa, Entamoeba invadens
FLIYPCWEGTKFKGIDFSIKTGKD

SEQ ID NO: 2790759 - protein, 17 aa, Entamoeba invadens
FLKERGWSLEYHLEADV

SEQ ID NO: 2790760 - protein, 17 aa, Entamoeba invadens
FLKNCVGRRNYRVFYTM

SEQ ID NO: 2790761 - protein, 18 aa, Entamoeba invadens
FLKNENLFNFGVNPVTNS

SEQ ID NO: 2790762 - protein, 26 aa, Entamoeba invadens
FLKQFQCKKIFLKDWTSPPLKFSSES

SEQ ID NO: 2790763 - protein, 21 aa, Entamoeba invadens
FLKRTKLPYTVWFSKSKSTLQ

SEQ ID NO: 2790764 - protein, 26 aa, Entamoeba invadens
FLLEKLKIVAILSVCDIEPYYSKKYS

SEQ ID NO: 2790765 - protein, 20 aa, Entamoeba invadens
FLLFICIGIILITMFGLWKI

SEQ ID NO: 2790766 - protein, 50 aa, Entamoeba invadens
FLLFLCLSAFYQTEWAISVLEYYNPRALIRFKKCPIKAVALTFDDSPSQA

SEQ ID NO: 2790767 - protein, 32 aa, Entamoeba invadens
FLLFLLVVTCCIFLSTRLDGFVVKIVNEVDVA

SEQ ID NO: 2790768 - protein, 17 aa, Entamoeba invadens
FLLFSWFTPASILKPSI

SEQ ID NO: 2790769 - protein, 20 aa, Entamoeba invadens
FLLGKDRYSFTITQMDIPND

SEQ ID NO: 2790770 - protein, 17 aa, Entamoeba invadens
FLLKYLIINYHKFLFKN

SEQ ID NO: 2790771 - protein, 17 aa, Entamoeba invadens
FLLLASNFWLVLWTDPS

SEQ ID NO: 2790772 - protein, 18 aa, Entamoeba invadens
FLLLGLMLPLLFSFPTTL

SEQ ID NO: 2790773 - protein, 22 aa, Entamoeba invadens
FLLLILCCLVIFTPTYPVYSYS

SEQ ID NO: 2790774 - protein, 27 aa, Entamoeba invadens
FLLLRIPVWILEVLIGFLMLKIHYTDP

SEQ ID NO: 2790775 - protein, 18 aa, Entamoeba invadens
FLLLVVTVIFGFIVPMTS

SEQ ID NO: 2790776 - protein, 17 aa, Entamoeba invadens
FLLSNGRLGRYCDPTTF

SEQ ID NO: 2790777 - protein, 20 aa, Entamoeba invadens
FLLSYSMSFVIMTMLLTIYN

SEQ ID NO: 2790778 - protein, 18 aa, Entamoeba invadens
FLLVCLFNGFLQIEAFIL

SEQ ID NO: 2790779 - protein, 20 aa, Entamoeba invadens
FLMDFCPSVFLIFQHLLNYK

SEQ ID NO: 2790780 - protein, 17 aa, Entamoeba invadens
FLMNGKCVNCDENCDLN

SEQ ID NO: 2790781 - protein, 18 aa, Entamoeba invadens
FLNFCESPDGFNLTRDIT

SEQ ID NO: 2790782 - protein, 18 aa, Entamoeba invadens
FLNLPNIHKVRECSLELY

SEQ ID NO: 2790783 - protein, 18 aa, Entamoeba invadens
FLNQIVLIILSFKLKMDN

SEQ ID NO: 2790784 - protein, 28 aa, Entamoeba invadens
FLNSEYKGRFSYSFKLKVMKDVQCGLSY

SEQ ID NO: 2790785 - protein, 33 aa, Entamoeba invadens
FLNSFFFERIMSLYLALLFRFHVFISTPEMLKK

SEQ ID NO: 2790786 - protein, 18 aa, Entamoeba invadens
FLNVDGFGVIEMNSSSSI

SEQ ID NO: 2790787 - protein, 27 aa, Entamoeba invadens
FLNVIALCVLNVFFLYFIIDIAFNIDT

SEQ ID NO: 2790788 - protein, 27 aa, Entamoeba invadens
FLNYVRMCAIGFMFNFGVYFFWLVIPI

SEQ ID NO: 2790789 - protein, 17 aa, Entamoeba invadens
FLPCFLIIGMMNKPTLG

SEQ ID NO: 2790790 - protein, 28 aa, Entamoeba invadens
FLPSFKEGFCKKLIPAALIQYVEQNPFD

SEQ ID NO: 2790791 - protein, 18 aa, Entamoeba invadens
FLPTCPLHVDHLKTLLTD

SEQ ID NO: 2790792 - protein, 18 aa, Entamoeba invadens
FLQILKNFEVDPMIPQRE

SEQ ID NO: 2790793 - protein, 21 aa, Entamoeba invadens
FLRCSELIFLVVSLIPTSSCV

SEQ ID NO: 2790794 - protein, 19 aa, Entamoeba invadens
FLRFRREQTPFFKQFFPMR

SEQ ID NO: 2790795 - protein, 21 aa, Entamoeba invadens
FLRLTHWATVILRTRPSLVYL

SEQ ID NO: 2790796 - protein, 20 aa, Entamoeba invadens
FLSALCLSKSMKPCDMLNEE

SEQ ID NO: 2790797 - protein, 18 aa, Entamoeba invadens
FLSCGSLSLLTGTEKVVT

SEQ ID NO: 2790798 - protein, 17 aa, Entamoeba invadens
FLSNLIVESCEPGYYTT

SEQ ID NO: 2790799 - protein, 17 aa, Entamoeba invadens
FLSNVCSQCKPNYEEND

SEQ ID NO: 2790800 - protein, 26 aa, Entamoeba invadens
FLSSFCFSRSPKICGIIGSVLVLIFG

SEQ ID NO: 2790801 - protein, 17 aa, Entamoeba invadens
FLSSFVTRIQRIIQGNW

SEQ ID NO: 2790802 - protein, 18 aa, Entamoeba invadens
FLSSNFRPISCLKCTLVP

SEQ ID NO: 2790803 - protein, 20 aa, Entamoeba invadens
FLSTRSRVISLFTPNYNNMT

SEQ ID NO: 2790804 - protein, 17 aa, Entamoeba invadens
FLTELILSPNGVFLNTL

SEQ ID NO: 2790805 - protein, 18 aa, Entamoeba invadens
FLTFCLFCVENHPVTLGD

SEQ ID NO: 2790806 - protein, 17 aa, Entamoeba invadens
FLTGKSYVIDTCGLESA

SEQ ID NO: 2790807 - protein, 21 aa, Entamoeba invadens
FLTHWNFCLLFKEWTNKNKMA

SEQ ID NO: 2790808 - protein, 18 aa, Entamoeba invadens
FLTIPMFPTAIVFAVLSM

SEQ ID NO: 2790809 - protein, 19 aa, Entamoeba invadens
FLTKSGSNFASFGICSLFS

SEQ ID NO: 2790810 - protein, 27 aa, Entamoeba invadens
FLTLEMCIRGAFHLYKPITGNYMNNIL

SEQ ID NO: 2790811 - protein, 19 aa, Entamoeba invadens
FLTNLVKILAELPISLATM

SEQ ID NO: 2790812 - protein, 17 aa, Entamoeba invadens
FLTRIEAIKKTARSLRF

SEQ ID NO: 2790813 - protein, 32 aa, Entamoeba invadens
FLVATRPSYFIYIICAELLLSREELLRSKTPV

SEQ ID NO: 2790814 - protein, 17 aa, Entamoeba invadens
FLVCVVLTLIFDYIDLS

SEQ ID NO: 2790815 - protein, 22 aa, Entamoeba invadens
FLVDVATEFGFLFFTSKMKNKF

SEQ ID NO: 2790816 - protein, 18 aa, Entamoeba invadens
FLVFCSFINGILSAINFS

SEQ ID NO: 2790817 - protein, 29 aa, Entamoeba invadens
FLVFEIKPSFYFMIRFHMKTIDSVNRLFV

SEQ ID NO: 2790818 - protein, 24 aa, Entamoeba invadens
FLVGRRGAAILPLYAIIHKPNELP

SEQ ID NO: 2790819 - protein, 19 aa, Entamoeba invadens
FLVGYKQGTDFFLGSIDSN

SEQ ID NO: 2790820 - protein, 17 aa, Entamoeba invadens
FLVHFFLNGIFCFFALK

SEQ ID NO: 2790821 - protein, 25 aa, Entamoeba invadens
FLVISKCKWFIVVFWILLAIATAYF

SEQ ID NO: 2790822 - protein, 18 aa, Entamoeba invadens
FLVLVVIIPLILCIIKGY

SEQ ID NO: 2790823 - protein, 24 aa, Entamoeba invadens
FLVLYRYYLRRVPKNISVMCKLVT

SEQ ID NO: 2790824 - protein, 24 aa, Entamoeba invadens
FLVNFIICCIPFLSSVIPITAGVP

SEQ ID NO: 2790825 - protein, 20 aa, Entamoeba invadens
FLVRVEPFTSMFIKMNENHY

SEQ ID NO: 2790826 - protein, 18 aa, Entamoeba invadens
FLVTDGICREIEYFHCEK

SEQ ID NO: 2790827 - protein, 18 aa, Entamoeba invadens
FLVTIAFCQVKIRRLWLQ

SEQ ID NO: 2790828 - protein, 20 aa, Entamoeba invadens
FLVVSLFSTMFFFLVSSPYY

SEQ ID NO: 2790829 - protein, 18 aa, Entamoeba invadens
FLVYSITSIYSFKKIQEM

SEQ ID NO: 2790830 - protein, 30 aa, Entamoeba invadens
FLYFFGAFFRLHFFVAVIFPFAVIFACISM

SEQ ID NO: 2790831 - protein, 17 aa, Entamoeba invadens
FLYGIICTICVFIQWSP

SEQ ID NO: 2790832 - protein, 21 aa, Entamoeba invadens
FLYKCEKCPIGTFSSSPKSLS

SEQ ID NO: 2790833 - protein, 17 aa, Entamoeba invadens
FLYKLTGANVRMNWESC

SEQ ID NO: 2790834 - protein, 18 aa, Entamoeba invadens
FLYMCKDSKIAIYDENLK

SEQ ID NO: 2790835 - protein, 26 aa, Entamoeba invadens
FLYNCSEWRKQNGYRCMSGVRRCTND

SEQ ID NO: 2790836 - protein, 26 aa, Entamoeba invadens
FLYSGMLLKKCGKRVVYNNGPEYLCH

SEQ ID NO: 2790837 - protein, 21 aa, Entamoeba invadens
FMADDVPTLFTINSVNTNDRC

SEQ ID NO: 2790838 - protein, 27 aa, Entamoeba invadens
FMCAKCGISNCKKCDATQCVECLTNYT

SEQ ID NO: 2790839 - protein, 22 aa, Entamoeba invadens
FMCALSSILFMFLAIHAYCSKN

SEQ ID NO: 2790840 - protein, 17 aa, Entamoeba invadens
FMCGLIHANYYFAKFFR

SEQ ID NO: 2790841 - protein, 17 aa, Entamoeba invadens
FMEPRVIIVSDPAVDSQ

SEQ ID NO: 2790842 - protein, 21 aa, Entamoeba invadens
FMFAVPFLIYYSLHNAFGDVM

SEQ ID NO: 2790843 - protein, 24 aa, Entamoeba invadens
FMFGPLMYRLFYVLFLPKTTTPKS

SEQ ID NO: 2790844 - protein, 19 aa, Entamoeba invadens
FMFHKFVIINNIKFYSHEE

SEQ ID NO: 2790845 - protein, 19 aa, Entamoeba invadens
FMFHKFVIINNIKFYSNEE

SEQ ID NO: 2790846 - protein, 24 aa, Entamoeba invadens
FMFTLREYPVFFVSAVTINIIAVI

SEQ ID NO: 2790847 - protein, 26 aa, Entamoeba invadens
FMFVLRGTLFISWHLSQRLTFGMLVI

SEQ ID NO: 2790848 - protein, 18 aa, Entamoeba invadens
FMGMTGWALDLLNYPQHR

SEQ ID NO: 2790849 - protein, 19 aa, Entamoeba invadens
FMIAFAVSVVEYFIEVRLF

SEQ ID NO: 2790850 - protein, 18 aa, Entamoeba invadens
FMIAGCVVVVFMSFSDVD

SEQ ID NO: 2790851 - protein, 22 aa, Entamoeba invadens
FMIEVMKSYIWTSIGSNILQVH

SEQ ID NO: 2790852 - protein, 28 aa, Entamoeba invadens
FMIFHNFFIRSSIEMQRLEGLTRSPIFI

SEQ ID NO: 2790853 - protein, 17 aa, Entamoeba invadens
FMIKKADSLSVTFLIMW

SEQ ID NO: 2790854 - protein, 17 aa, Entamoeba invadens
FMKAVLFTLQYEGRGSV

SEQ ID NO: 2790855 - protein, 28 aa, Entamoeba invadens
FMKDVRLRMWGVWSFTAFNAYWFVISFT

SEQ ID NO: 2790856 - protein, 19 aa, Entamoeba invadens
FMLACAYNQLEIARALFQE

SEQ ID NO: 2790857 - protein, 20 aa, Entamoeba invadens
FMLDKFRSEYIVHFYGAVFM

SEQ ID NO: 2790858 - protein, 17 aa, Entamoeba invadens
FMLELLFHSVYVNKSRH

SEQ ID NO: 2790859 - protein, 19 aa, Entamoeba invadens
FMLFPGGGVVSVWYTIIPI

SEQ ID NO: 2790860 - protein, 17 aa, Entamoeba invadens
FMLKRADLELTKNYQQI

SEQ ID NO: 2790861 - protein, 24 aa, Entamoeba invadens
FMLNKEILRGIWLNVTDNKNIHLF

SEQ ID NO: 2790862 - protein, 23 aa, Entamoeba invadens
FMLSWACGFINNTLPGWLLVRIS

SEQ ID NO: 2790863 - protein, 22 aa, Entamoeba invadens
FMMNMSTYFFWLVVPLLLQDRK

SEQ ID NO: 2790864 - protein, 17 aa, Entamoeba invadens
FMQEASMMERIRCQYVV

SEQ ID NO: 2790865 - protein, 17 aa, Entamoeba invadens
FMRENGILDNIVSQDIF

SEQ ID NO: 2790866 - protein, 18 aa, Entamoeba invadens
FMRQFKRRQIDFKKYLQI

SEQ ID NO: 2790867 - protein, 19 aa, Entamoeba invadens
FMRRLSEKKFWVRSYSVVL

SEQ ID NO: 2790868 - protein, 17 aa, Entamoeba invadens
FMSCKSGYMYDDIKKTC

SEQ ID NO: 2790869 - protein, 17 aa, Entamoeba invadens
FMSLKCNSSIHVSPLDY

SEQ ID NO: 2790870 - protein, 19 aa, Entamoeba invadens
FMSNCSRDIFGKVAVVTIC

SEQ ID NO: 2790871 - protein, 25 aa, Entamoeba invadens
FMSNCVMSKSAVLIGNDLHYVKYTD

SEQ ID NO: 2790872 - protein, 19 aa, Entamoeba invadens
FMSVSSLFILLDLNPNSTR

SEQ ID NO: 2790873 - protein, 18 aa, Entamoeba invadens
FMTAGTFKAFLNLLQQDT

SEQ ID NO: 2790874 - protein, 26 aa, Entamoeba invadens
FMVCSFGYLCFLIIFKWCAPVQEGAP

SEQ ID NO: 2790875 - protein, 19 aa, Entamoeba invadens
FMVKLSIEDIVTFFIQNAA

SEQ ID NO: 2790876 - protein, 26 aa, Entamoeba invadens
FMWTFWKRIGLGAFQYIGYQNVTVRF

SEQ ID NO: 2790877 - protein, 17 aa, Entamoeba invadens
FMWTLASSQCFPKGTEA

SEQ ID NO: 2790878 - protein, 21 aa, Entamoeba invadens
FMYYECVNTFILYTNNCVLQK

SEQ ID NO: 2790879 - protein, 17 aa, Entamoeba invadens
FNAAININQKFKILVIH

SEQ ID NO: 2790880 - protein, 18 aa, Entamoeba invadens
FNAIPFMMIFDVVNIVLC

SEQ ID NO: 2790881 - protein, 20 aa, Entamoeba invadens
FNARIKEYFKGKKRQTIVDV

SEQ ID NO: 2790882 - protein, 22 aa, Entamoeba invadens
FNCGEITFKTCTGREEPNDCRE

SEQ ID NO: 2790883 - protein, 30 aa, Entamoeba invadens
FNCIFKVMHYLRYAIIVFWLVCALGFCYPA

SEQ ID NO: 2790884 - protein, 23 aa, Entamoeba invadens
FNDLTNGLSLILFMETLSRNHMK

SEQ ID NO: 2790885 - protein, 26 aa, Entamoeba invadens
FNDLVEVATTLGFEFSEKNTRKSQKT

SEQ ID NO: 2790886 - protein, 22 aa, Entamoeba invadens
FNDMWFTPSFRCLSAVDDNNPI

SEQ ID NO: 2790887 - protein, 19 aa, Entamoeba invadens
FNECTKLATVTGFEAVTSF

SEQ ID NO: 2790888 - protein, 19 aa, Entamoeba invadens
FNELKGGVCVDQPEIDFNN

SEQ ID NO: 2790889 - protein, 19 aa, Entamoeba invadens
FNELVSFTPPFDPLTFTEN

SEQ ID NO: 2790890 - protein, 22 aa, Entamoeba invadens
FNEVPFISAIVWTLFTYFVGHI

SEQ ID NO: 2790891 - protein, 21 aa, Entamoeba invadens
FNEYLQAYAFRDIAKQPPQPP

SEQ ID NO: 2790892 - protein, 23 aa, Entamoeba invadens
FNFANYFYWLVVPLIMNDKGGST

SEQ ID NO: 2790893 - protein, 19 aa, Entamoeba invadens
FNFILEWEFMCLSGESCSR

SEQ ID NO: 2790894 - protein, 17 aa, Entamoeba invadens
FNFISLIFFPITLVVNS

SEQ ID NO: 2790895 - protein, 20 aa, Entamoeba invadens
FNFLMFFGMFLALIVYFVIT

SEQ ID NO: 2790896 - protein, 19 aa, Entamoeba invadens
FNGCTKLATVTGFDAVTSF

SEQ ID NO: 2790897 - protein, 17 aa, Entamoeba invadens
FNGFYLNNYECKKCDPK

SEQ ID NO: 2790898 - protein, 23 aa, Entamoeba invadens
FNGNLPFSMYWSGHYHQSDLQVY

SEQ ID NO: 2790899 - protein, 25 aa, Entamoeba invadens
FNGRSCSLCPAGYFSNGGTQSCTVC

SEQ ID NO: 2790900 - protein, 17 aa, Entamoeba invadens
FNIFPITFIMNCRKNAP

SEQ ID NO: 2790901 - protein, 20 aa, Entamoeba invadens
FNIPFAMLIAVGFFVFLFVN

SEQ ID NO: 2790902 - protein, 20 aa, Entamoeba invadens
FNIQSVCYIDESRLFIRKNG

SEQ ID NO: 2790903 - protein, 19 aa, Entamoeba invadens
FNISFCKISSNKMCLECEE

SEQ ID NO: 2790904 - protein, 27 aa, Entamoeba invadens
FNITWSNLCVYFWKLKVVAFVFPVMVL

SEQ ID NO: 2790905 - protein, 17 aa, Entamoeba invadens
FNKCVECSENSYLYDGE

SEQ ID NO: 2790906 - protein, 20 aa, Entamoeba invadens
FNKDGICVEIEHAEVINQKS

SEQ ID NO: 2790907 - protein, 20 aa, Entamoeba invadens
FNKECFKCDTGCIVCKTGLS

SEQ ID NO: 2790908 - protein, 27 aa, Entamoeba invadens
FNKEGDCKRTSLTTTNFIQRYIITIPS

SEQ ID NO: 2790909 - protein, 23 aa, Entamoeba invadens
FNKEGYRTLLICSKKIDKEYYIN

SEQ ID NO: 2790910 - protein, 24 aa, Entamoeba invadens
FNKFKFRYRRGLPVVLKGITAKIL

SEQ ID NO: 2790911 - protein, 23 aa, Entamoeba invadens
FNKIWYCQKCFTAIHSTCMAAYA

SEQ ID NO: 2790912 - protein, 20 aa, Entamoeba invadens
FNKLCHSFIVLILIILNLVP

SEQ ID NO: 2790913 - protein, 26 aa, Entamoeba invadens
FNKNGCISCAIGYYLSNTECNLCSEN

SEQ ID NO: 2790914 - protein, 26 aa, Entamoeba invadens
FNKNGCVSCAVGYYLLNAECNLCSEN

SEQ ID NO: 2790915 - protein, 17 aa, Entamoeba invadens
FNKVLAIDEVKNRIRMK

SEQ ID NO: 2790916 - protein, 26 aa, Entamoeba invadens
FNKYGCVSCAVGYYLLNAECNLCSEN

SEQ ID NO: 2790917 - protein, 18 aa, Entamoeba invadens
FNLENCCVECENGYYLNA

SEQ ID NO: 2790918 - protein, 17 aa, Entamoeba invadens
FNLFLYVDGLQLPETNS

SEQ ID NO: 2790919 - protein, 20 aa, Entamoeba invadens
FNLIGLFGIVLAILLQEYTQ

SEQ ID NO: 2790920 - protein, 31 aa, Entamoeba invadens
FNLKIRPEVVCFKKGYACEFEAVLIPFCTCQ

SEQ ID NO: 2790921 - protein, 19 aa, Entamoeba invadens
FNLNLSNYMSWNLDIYEWY

SEQ ID NO: 2790922 - protein, 25 aa, Entamoeba invadens
FNLNLSNYMSWNLDIYKWYTIYSNN

SEQ ID NO: 2790923 - protein, 18 aa, Entamoeba invadens
FNLSLPCIIFRNLYNMNG

SEQ ID NO: 2790924 - protein, 21 aa, Entamoeba invadens
FNLTFPCVIFKALANTHTLTL

SEQ ID NO: 2790925 - protein, 26 aa, Entamoeba invadens
FNLVWCYAAACSNEFNDWTEDYATHD

SEQ ID NO: 2790926 - protein, 23 aa, Entamoeba invadens
FNMDKCIFVRCADKYFYNNKTKA

SEQ ID NO: 2790927 - protein, 23 aa, Entamoeba invadens
FNMDKCVFVRCADKYFYNNETKA

SEQ ID NO: 2790928 - protein, 20 aa, Entamoeba invadens
FNMNFFKTAKRYTLNVNTLV

SEQ ID NO: 2790929 - protein, 26 aa, Entamoeba invadens
FNNKVLYCKPTFYFKKTKCDYCGDNC

SEQ ID NO: 2790930 - protein, 18 aa, Entamoeba invadens
FNNLFKCLPLCAVVDNKL

SEQ ID NO: 2790931 - protein, 18 aa, Entamoeba invadens
FNNSFTFNGSNIYNTIAV

SEQ ID NO: 2790932 - protein, 17 aa, Entamoeba invadens
FNNTTFVCVGCFAPYVV

SEQ ID NO: 2790933 - protein, 18 aa, Entamoeba invadens
FNPGCLTCDEESRDYNCT

SEQ ID NO: 2790934 - protein, 17 aa, Entamoeba invadens
FNPVKCLLFPNTYSYCF

SEQ ID NO: 2790935 - protein, 18 aa, Entamoeba invadens
FNQKCVRDVCQAESHSSS

SEQ ID NO: 2790936 - protein, 24 aa, Entamoeba invadens
FNRFVRPYLYFLLEENVNYSRRIK

SEQ ID NO: 2790937 - protein, 24 aa, Entamoeba invadens
FNRIFPQIWIWRHASLYQTINRVL

SEQ ID NO: 2790938 - protein, 18 aa, Entamoeba invadens
FNSACSIKIVDFGTSLFT

SEQ ID NO: 2790939 - protein, 17 aa, Entamoeba invadens
FNSDIIISVDKSSSKKF

SEQ ID NO: 2790940 - protein, 17 aa, Entamoeba invadens
FNSEAIESYLFKIPNLS

SEQ ID NO: 2790941 - protein, 17 aa, Entamoeba invadens
FNSEAIETYLFKIPNLS

SEQ ID NO: 2790942 - protein, 21 aa, Entamoeba invadens
FNSGVCYVLLISNFLRIAFYI

SEQ ID NO: 2790943 - protein, 19 aa, Entamoeba invadens
FNSIFFLRPNSKVMAQNDS

SEQ ID NO: 2790944 - protein, 24 aa, Entamoeba invadens
FNSIVKAVMWGRCVYDNIRKFLQF

SEQ ID NO: 2790945 - protein, 24 aa, Entamoeba invadens
FNSIVKAVVWGRCVYDNIRKFIQF

SEQ ID NO: 2790946 - protein, 17 aa, Entamoeba invadens
FNSLPLQFCMIFLSLFS

SEQ ID NO: 2790947 - protein, 25 aa, Entamoeba invadens
FNSSTRWKKSILDAINHSRFFESGK

SEQ ID NO: 2790948 - protein, 22 aa, Entamoeba invadens
FNSTFCITCDTSVYFLNKNHIC

SEQ ID NO: 2790949 - protein, 17 aa, Entamoeba invadens
FNSTLCLTCNESNNWLL

SEQ ID NO: 2790950 - protein, 25 aa, Entamoeba invadens
FNTAKFCTKCFSSLMHILAQLDDSD

SEQ ID NO: 2790951 - protein, 24 aa, Entamoeba invadens
FNTSYCLSCADGSVLNRVTNTCEK

SEQ ID NO: 2790952 - protein, 19 aa, Entamoeba invadens
FNVFAQCHWFICSNDKRVI

SEQ ID NO: 2790953 - protein, 18 aa, Entamoeba invadens
FNVGIGFMLIFFIGTFAH

SEQ ID NO: 2790954 - protein, 34 aa, Entamoeba invadens
FNVILPYKYKLRVMYDCARGMAFLHQNKIIHLDL

SEQ ID NO: 2790955 - protein, 18 aa, Entamoeba invadens
FNVLFFRQPLSQMIIGRR

SEQ ID NO: 2790956 - protein, 24 aa, Entamoeba invadens
FNVTFKSVCPYNCVNGYCSTAIGG

SEQ ID NO: 2790957 - protein, 24 aa, Entamoeba invadens
FNYFSIKFSFGILTVTDTNIGKPL

SEQ ID NO: 2790958 - protein, 30 aa, Entamoeba invadens
FNYIFKVMHYLRYAIIVFWLVCALGFCYPA

SEQ ID NO: 2790959 - protein, 21 aa, Entamoeba invadens
FNYIGSYLIVRSLKIPWIGET

SEQ ID NO: 2790960 - protein, 21 aa, Entamoeba invadens
FNYSGKCGEVFQYPKNSKRDL

SEQ ID NO: 2790961 - protein, 17 aa, Entamoeba invadens
FNYSGVCSNVFKYQPNN

SEQ ID NO: 2790962 - protein, 18 aa, Entamoeba invadens
FNYYGIRGGLMYMHCFLR

SEQ ID NO: 2790963 - protein, 24 aa, Entamoeba invadens
FPAPLRISEHFVFVTLITESTKPV

SEQ ID NO: 2790964 - protein, 21 aa, Entamoeba invadens
FPCLTCTSSTIYNCDSCVTNY

SEQ ID NO: 2790965 - protein, 17 aa, Entamoeba invadens
FPCSSKLHCSTCSQTSP

SEQ ID NO: 2790966 - protein, 17 aa, Entamoeba invadens
FPDCMYNGTLFDLDLTT

SEQ ID NO: 2790967 - protein, 21 aa, Entamoeba invadens
FPDGESILKFVGNGKRLDIPD

SEQ ID NO: 2790968 - protein, 17 aa, Entamoeba invadens
FPDITLTFYQDMEFDTY

SEQ ID NO: 2790969 - protein, 23 aa, Entamoeba invadens
FPDLKSHIFVSIFFTVIAIVFQY

SEQ ID NO: 2790970 - protein, 23 aa, Entamoeba invadens
FPDNGTCVICPKHYKPNEEYNGC

SEQ ID NO: 2790971 - protein, 23 aa, Entamoeba invadens
FPDSESILRFVGAEKRLDIDDSC

SEQ ID NO: 2790972 - protein, 18 aa, Entamoeba invadens
FPDSFKVGKNVIAIKTKD

SEQ ID NO: 2790973 - protein, 18 aa, Entamoeba invadens
FPDTCYDMSPLYPGKYAK

SEQ ID NO: 2790974 - protein, 22 aa, Entamoeba invadens
FPEKTCKSCRMIYGCELCVNLL

SEQ ID NO: 2790975 - protein, 19 aa, Entamoeba invadens
FPEQCDLLLTASVGKQKAL

SEQ ID NO: 2790976 - protein, 18 aa, Entamoeba invadens
FPFPWKIAEFVTAGNRLK

SEQ ID NO: 2790977 - protein, 17 aa, Entamoeba invadens
FPGCSQTKMTRYNAASH

SEQ ID NO: 2790978 - protein, 21 aa, Entamoeba invadens
FPITSCLAVVALFIMQITGIF

SEQ ID NO: 2790979 - protein, 17 aa, Entamoeba invadens
FPIVGVILCSILVAGII

SEQ ID NO: 2790980 - protein, 20 aa, Entamoeba invadens
FPIVLCSLFVCSQGIVNITL

SEQ ID NO: 2790981 - protein, 24 aa, Entamoeba invadens
FPKDKFKYPWSIADFITSGKRFDK

SEQ ID NO: 2790982 - protein, 23 aa, Entamoeba invadens
FPKHLLNIGNHCFSFCGKLTTIQ

SEQ ID NO: 2790983 - protein, 18 aa, Entamoeba invadens
FPKPSLKGLAVFQDLISI

SEQ ID NO: 2790984 - protein, 24 aa, Entamoeba invadens
FPKSEFKYPWKIADFVNNGNRLQK

SEQ ID NO: 2790985 - protein, 25 aa, Entamoeba invadens
FPKVHPKLASFQALTQFPRYTTNTQ

SEQ ID NO: 2790986 - protein, 25 aa, Entamoeba invadens
FPKVIKHWMFWYVFSMVIFVFSVGG

SEQ ID NO: 2790987 - protein, 21 aa, Entamoeba invadens
FPLESFPSFIVPIQEHIDLIN

SEQ ID NO: 2790988 - protein, 20 aa, Entamoeba invadens
FPLFCGKGVDGWKVEVLLNQ

SEQ ID NO: 2790989 - protein, 27 aa, Entamoeba invadens
FPLGMFITGVTFMFIFFVDRVIVEHSH

SEQ ID NO: 2790990 - protein, 18 aa, Entamoeba invadens
FPLGPALMRPLCTHQSFP

SEQ ID NO: 2790991 - protein, 19 aa, Entamoeba invadens
FPLICVFTHVTLIGHKEKK

SEQ ID NO: 2790992 - protein, 21 aa, Entamoeba invadens
FPLIIPKSVKFLNRISMLTVI

SEQ ID NO: 2790993 - protein, 29 aa, Entamoeba invadens
FPLIVALCCGLGCGAAWMDDRKERKKKKM

SEQ ID NO: 2790994 - protein, 17 aa, Entamoeba invadens
FPLKFLYQQFTMVTNLY

SEQ ID NO: 2790995 - protein, 17 aa, Entamoeba invadens
FPLNQYLPFFILMLSGM

SEQ ID NO: 2790996 - protein, 37 aa, Entamoeba invadens
FPLQLEMCLIGGVALEYGIPVVVWKKGVIFEIGSIDL

SEQ ID NO: 2790997 - protein, 20 aa, Entamoeba invadens
FPMKIPIFEFCGKKELFDSF

SEQ ID NO: 2790998 - protein, 18 aa, Entamoeba invadens
FPNIPTPILLDLNTPLDY

SEQ ID NO: 2790999 - protein, 18 aa, Entamoeba invadens
FPNTICENGFKGNTKITN

SEQ ID NO: 2791000 - protein, 17 aa, Entamoeba invadens
FPPHGDWIEKFFTKGIR

SEQ ID NO: 2791001 - protein, 17 aa, Entamoeba invadens
FPPHSFEGITPSKKITP

SEQ ID NO: 2791002 - protein, 23 aa, Entamoeba invadens
FPPLKLNSIFALKVTSDKVCFYV

SEQ ID NO: 2791003 - protein, 17 aa, Entamoeba invadens
FPQIYKILRLRDGNGLS

SEQ ID NO: 2791004 - protein, 21 aa, Entamoeba invadens
FPQKYPLVYLYFSMIAALVFN

SEQ ID NO: 2791005 - protein, 21 aa, Entamoeba invadens
FPRKQELVVPIGIIAFTCWFC

SEQ ID NO: 2791006 - protein, 19 aa, Entamoeba invadens
FPRMLSFYLYGKGRILSFF

SEQ ID NO: 2791007 - protein, 18 aa, Entamoeba invadens
FPSCCVLTLFMLLTLSLL

SEQ ID NO: 2791008 - protein, 19 aa, Entamoeba invadens
FPSCQSVVGEHCAECQTKH

SEQ ID NO: 2791009 - protein, 25 aa, Entamoeba invadens
FPSGMGELIEKCWGQDPLNRPTFKE

SEQ ID NO: 2791010 - protein, 20 aa, Entamoeba invadens
FPSRQWISLIGQLLISTIII

SEQ ID NO: 2791011 - protein, 25 aa, Entamoeba invadens
FPTFNGKLWPPGFMSFFTMAPFISA

SEQ ID NO: 2791012 - protein, 26 aa, Entamoeba invadens
FPTFNGKLWPPGFMSFFTMAPFISAN

SEQ ID NO: 2791013 - protein, 21 aa, Entamoeba invadens
FPTGIGALLVRKDVITKLSPI

SEQ ID NO: 2791014 - protein, 18 aa, Entamoeba invadens
FPTLLQFFGYFYFFPACF

SEQ ID NO: 2791015 - protein, 25 aa, Entamoeba invadens
FPTNIPFQMVVALVYIFMVSPRHTR

SEQ ID NO: 2791016 - protein, 17 aa, Entamoeba invadens
FPTTFFFHFNETVYFNV

SEQ ID NO: 2791017 - protein, 28 aa, Entamoeba invadens
FPTYRYYIFCITFLFCLLLLVVFYPYFL

SEQ ID NO: 2791018 - protein, 17 aa, Entamoeba invadens
FPVINGKVVRQPQSVLT

SEQ ID NO: 2791019 - protein, 17 aa, Entamoeba invadens
FPVLKTIVIFLVFTNET

SEQ ID NO: 2791020 - protein, 18 aa, Entamoeba invadens
FPWNGVAYTIEWVGIFAV

SEQ ID NO: 2791021 - protein, 20 aa, Entamoeba invadens
FPYDFKFEQQLTFYIINVAN

SEQ ID NO: 2791022 - protein, 20 aa, Entamoeba invadens
FPYIIKSGAESFDLNCIKCI

SEQ ID NO: 2791023 - protein, 18 aa, Entamoeba invadens
FPYIQMLLIFVIASLTIV

SEQ ID NO: 2791024 - protein, 17 aa, Entamoeba invadens
FPYNFTDGTAFLLSNSR

SEQ ID NO: 2791025 - protein, 24 aa, Entamoeba invadens
FPYSWDITNLISRGERPAIELGDG

SEQ ID NO: 2791026 - protein, 20 aa, Entamoeba invadens
FQCGTNCKLLMNKFSIIKAT

SEQ ID NO: 2791027 - protein, 20 aa, Entamoeba invadens
FQFLHACITIFGFLFLLTYT

SEQ ID NO: 2791028 - protein, 17 aa, Entamoeba invadens
FQGFMEAMVLWKKVDNE

SEQ ID NO: 2791029 - protein, 31 aa, Entamoeba invadens
FQGGFFYFFLFKMIFYLFTKKYYIITIFNKK

SEQ ID NO: 2791030 - protein, 19 aa, Entamoeba invadens
FQGYFCLPMLDYVFLSENK

SEQ ID NO: 2791031 - protein, 22 aa, Entamoeba invadens
FQHLPHSWSSFFDTKIEYSHLS

SEQ ID NO: 2791032 - protein, 17 aa, Entamoeba invadens
FQIFKANLAKFRKHNAA

SEQ ID NO: 2791033 - protein, 23 aa, Entamoeba invadens
FQIGKFNAADGFQGFMEAMVLWK

SEQ ID NO: 2791034 - protein, 21 aa, Entamoeba invadens
FQIHSCLPPLFSGTKGMSKKT

SEQ ID NO: 2791035 - protein, 29 aa, Entamoeba invadens
FQIKYRIALTEGYIFLVVFFLLSWYYQPG

SEQ ID NO: 2791036 - protein, 18 aa, Entamoeba invadens
FQILCGRGLPISRNEIKE

SEQ ID NO: 2791037 - protein, 18 aa, Entamoeba invadens
FQILNPISGAKCFDVFSL

SEQ ID NO: 2791038 - protein, 18 aa, Entamoeba invadens
FQIQATNCVLEISNDSNL

SEQ ID NO: 2791039 - protein, 19 aa, Entamoeba invadens
FQITIGFGLIITALVLVLV

SEQ ID NO: 2791040 - protein, 27 aa, Entamoeba invadens
FQIVGWVVSLCIIFFFILLAILIFLIF

SEQ ID NO: 2791041 - protein, 18 aa, Entamoeba invadens
FQKTCCNFTGNNMDDYQS

SEQ ID NO: 2791042 - protein, 17 aa, Entamoeba invadens
FQKTVWTQTLFKTLQQL

SEQ ID NO: 2791043 - protein, 24 aa, Entamoeba invadens
FQLFKKCVEYGIYVTSLFTDTTEN

SEQ ID NO: 2791044 - protein, 18 aa, Entamoeba invadens
FQLPSFPKIEAVMVSGIL

SEQ ID NO: 2791045 - protein, 17 aa, Entamoeba invadens
FQMANFIQKHCCQKNTE

SEQ ID NO: 2791046 - protein, 24 aa, Entamoeba invadens
FQMTGSFRYIFCVYEKLYDSQKNL

SEQ ID NO: 2791047 - protein, 17 aa, Entamoeba invadens
FQNCKKLEYIIGAEQVT

SEQ ID NO: 2791048 - protein, 31 aa, Entamoeba invadens
FQNWVFNTCEILYAWSCIDVFIISVIAAVVE

SEQ ID NO: 2791049 - protein, 18 aa, Entamoeba invadens
FQPLTCGSTYNRIYKDST

SEQ ID NO: 2791050 - protein, 18 aa, Entamoeba invadens
FQQAVLIYLIATAGVKVI

SEQ ID NO: 2791051 - protein, 26 aa, Entamoeba invadens
FQQFKCLVSSFGIDLFGPEPFDTSDM

SEQ ID NO: 2791052 - protein, 29 aa, Entamoeba invadens
FQRIEYKIIRGYYWTCNKSDLLSNEMSKL

SEQ ID NO: 2791053 - protein, 20 aa, Entamoeba invadens
FQRLCDVLHVLTLFQSYFVW

SEQ ID NO: 2791054 - protein, 27 aa, Entamoeba invadens
FQRRNIKLYIAFAMFIFFVVFIGSWVF

SEQ ID NO: 2791055 - protein, 23 aa, Entamoeba invadens
FQSIFLPCIIFNAGFTMKKRNFF

SEQ ID NO: 2791056 - protein, 17 aa, Entamoeba invadens
FQSNSSLVEFCKEPAII

SEQ ID NO: 2791057 - protein, 23 aa, Entamoeba invadens
FQSTRIPFGINFGIGAVGAICST

SEQ ID NO: 2791058 - protein, 26 aa, Entamoeba invadens
FQSVLCLLCITPQYIVYPWLVFLVIS

SEQ ID NO: 2791059 - protein, 24 aa, Entamoeba invadens
FQTKLKMWVESMLLQTQVNKIFPM

SEQ ID NO: 2791060 - protein, 30 aa, Entamoeba invadens
FQTLDNCRICINGKCLQCKDEYYLFTPNNI

SEQ ID NO: 2791061 - protein, 17 aa, Entamoeba invadens
FQTVKDKRLCVCPNPGF

SEQ ID NO: 2791062 - protein, 17 aa, Entamoeba invadens
FQVDGCETCLPNYYLHE

SEQ ID NO: 2791063 - protein, 17 aa, Entamoeba invadens
FQYYHNAVIDFVIQFKN

SEQ ID NO: 2791064 - protein, 20 aa, Entamoeba invadens
FRATCVDVMNVLRTNTDMVM

SEQ ID NO: 2791065 - protein, 21 aa, Entamoeba invadens
FRATEFVFKKQTEFEVFLELF

SEQ ID NO: 2791066 - protein, 17 aa, Entamoeba invadens
FRATKYLVEHGPTAFMN

SEQ ID NO: 2791067 - protein, 17 aa, Entamoeba invadens
FRCAIIDGMFMGMPMFH

SEQ ID NO: 2791068 - protein, 18 aa, Entamoeba invadens
FRCQTDFVPSNGYCKSLS

SEQ ID NO: 2791069 - protein, 26 aa, Entamoeba invadens
FRDNGLRLIFEFAYQVCLQVLSQGQQ

SEQ ID NO: 2791070 - protein, 23 aa, Entamoeba invadens
FRDTYYYLPNCSYAFSSYLRFWD

SEQ ID NO: 2791071 - protein, 20 aa, Entamoeba invadens
FREAAEGFGRAVSINPEFVE

SEQ ID NO: 2791072 - protein, 21 aa, Entamoeba invadens
FREEYDISLGPKCFTLPSAII

SEQ ID NO: 2791073 - protein, 17 aa, Entamoeba invadens
FRELCVRPYTARFTPVQ

SEQ ID NO: 2791074 - protein, 20 aa, Entamoeba invadens
FRFAKYATSCFRRLATRHIH

SEQ ID NO: 2791075 - protein, 21 aa, Entamoeba invadens
FRFILWTLWYCVKLMCTKMVV

SEQ ID NO: 2791076 - protein, 22 aa, Entamoeba invadens
FRFTSGINMKCLFYRNRQLAER

SEQ ID NO: 2791077 - protein, 21 aa, Entamoeba invadens
FRFTTLTIFGSLLISSPNVIT

SEQ ID NO: 2791078 - protein, 22 aa, Entamoeba invadens
FRGDGKRIVGWISSESIIGDVV

SEQ ID NO: 2791079 - protein, 19 aa, Entamoeba invadens
FRGQLKFSRLDMKKGKYSE

SEQ ID NO: 2791080 - protein, 22 aa, Entamoeba invadens
FRHLGKLILFHGRCSLLRNSEL

SEQ ID NO: 2791081 - protein, 19 aa, Entamoeba invadens
FRIFSKIQFDVEGIIGKVV

SEQ ID NO: 2791082 - protein, 18 aa, Entamoeba invadens
FRKCSIDGFCLQEEGDGC

SEQ ID NO: 2791083 - protein, 17 aa, Entamoeba invadens
FRKGMTCSQIDTNGVEW

SEQ ID NO: 2791084 - protein, 20 aa, Entamoeba invadens
FRKLLNYIFFGWKIPKNKIC

SEQ ID NO: 2791085 - protein, 18 aa, Entamoeba invadens
FRKLSIVDNVLYNKKVDG

SEQ ID NO: 2791086 - protein, 24 aa, Entamoeba invadens
FRKSLLVKLEESFKETFNHQRSNR

SEQ ID NO: 2791087 - protein, 30 aa, Entamoeba invadens
FRKSNLWSLFCSFEYFLLGFGHTTYMTIFP

SEQ ID NO: 2791088 - protein, 21 aa, Entamoeba invadens
FRKSNNYSFYEMCCYEQNSKV

SEQ ID NO: 2791089 - protein, 24 aa, Entamoeba invadens
FRLEKYKVPTRMVGSSLYQVFEFL

SEQ ID NO: 2791090 - protein, 20 aa, Entamoeba invadens
  misc_feature (18)..(19): Xaa can be any naturally occurring amino acid
FRLLFHSEYLFQLKQKSXXY

SEQ ID NO: 2791091 - protein, 18 aa, Entamoeba invadens
FRMKNARYPNKDITPEKA

SEQ ID NO: 2791092 - protein, 19 aa, Entamoeba invadens
FRMMECVLSLEMTCVRLEI

SEQ ID NO: 2791093 - protein, 17 aa, Entamoeba invadens
FRNEIMAAITPSMKPFS

SEQ ID NO: 2791094 - protein, 18 aa, Entamoeba invadens
FRNSEGCSSSCKCIASKG

SEQ ID NO: 2791095 - protein, 17 aa, Entamoeba invadens
FRPGSGLPSSFMFDTID

SEQ ID NO: 2791096 - protein, 19 aa, Entamoeba invadens
FRPIARGCVWCEKSFKSFC

SEQ ID NO: 2791097 - protein, 19 aa, Entamoeba invadens
FRQLFSIGNIHLGNDNTSG

SEQ ID NO: 2791098 - protein, 19 aa, Entamoeba invadens
FRQNHIFSTVSLLRAICGV

SEQ ID NO: 2791099 - protein, 22 aa, Entamoeba invadens
FRRAITVNGIYPATVSFLQQLT

SEQ ID NO: 2791100 - protein, 21 aa, Entamoeba invadens
FRRSYWKEITFGNSVTIKRFV

SEQ ID NO: 2791101 - protein, 22 aa, Entamoeba invadens
FRSDFIVHFFGACFLPTKICMV

SEQ ID NO: 2791102 - protein, 20 aa, Entamoeba invadens
FRSDFVVHFYGAVFIPTKTC

SEQ ID NO: 2791103 - protein, 19 aa, Entamoeba invadens
FRSDHIVHFYGAVFIPNKI

SEQ ID NO: 2791104 - protein, 17 aa, Entamoeba invadens
FRSDYIVHFYGAVFVPN

SEQ ID NO: 2791105 - protein, 21 aa, Entamoeba invadens
FRSDYIVNFYGAVFIPNKICM

SEQ ID NO: 2791106 - protein, 20 aa, Entamoeba invadens
FRSDYVVHFYGAVFIPNKIC

SEQ ID NO: 2791107 - protein, 20 aa, Entamoeba invadens
FRSEKCVSCIAGYYPDSNGK

SEQ ID NO: 2791108 - protein, 17 aa, Entamoeba invadens
FRSENIVFFYGAVFIPD

SEQ ID NO: 2791109 - protein, 27 aa, Entamoeba invadens
FRSFDFYLVCLLVVMLSVTPLILRKFI

SEQ ID NO: 2791110 - protein, 25 aa, Entamoeba invadens
FRSFKPENLVSVLWSALILSQGDLY

SEQ ID NO: 2791111 - protein, 28 aa, Entamoeba invadens
FRSIEKVDFCWDKKSVLIIPTLIRNNHW

SEQ ID NO: 2791112 - protein, 20 aa, Entamoeba invadens
FRSMINLWTLIAILAVDFKV

SEQ ID NO: 2791113 - protein, 17 aa, Entamoeba invadens
FRSTLCLLCNNNTNLVS

SEQ ID NO: 2791114 - protein, 19 aa, Entamoeba invadens
FRTTQDWYNNNNVGFEEDL

SEQ ID NO: 2791115 - protein, 22 aa, Entamoeba invadens
FRVEVKMTLSIICPNDCNAEKG

SEQ ID NO: 2791116 - protein, 18 aa, Entamoeba invadens
FRVKLMLDASKGIQYLHS

SEQ ID NO: 2791117 - protein, 23 aa, Entamoeba invadens
FRVLCITCGATLLQNDILEAFNN

SEQ ID NO: 2791118 - protein, 17 aa, Entamoeba invadens
FRVNEDIISMPLEEQVK

SEQ ID NO: 2791119 - protein, 20 aa, Entamoeba invadens
FRVSCLTASCNVVLTLHTNK

SEQ ID NO: 2791120 - protein, 17 aa, Entamoeba invadens
FRVTPEISMLKNGEACE

SEQ ID NO: 2791121 - protein, 17 aa, Entamoeba invadens
FRVVNSYIDFTVQNHIT

SEQ ID NO: 2791122 - protein, 19 aa, Entamoeba invadens
FRVYLSYLSYVFVPVIICS

SEQ ID NO: 2791123 - protein, 20 aa, Entamoeba invadens
FSACTKLKRVDGFNKINSFG

SEQ ID NO: 2791124 - protein, 24 aa, Entamoeba invadens
FSADIQELLLRWMFSTQSATFVVK

SEQ ID NO: 2791125 - protein, 18 aa, Entamoeba invadens
FSAFEFNNSLTLNSIYKT

SEQ ID NO: 2791126 - protein, 17 aa, Entamoeba invadens
FSAIITFFFLFRTSNNT

SEQ ID NO: 2791127 - protein, 19 aa, Entamoeba invadens
FSAKVKQYIDFGSSIEANM

SEQ ID NO: 2791128 - protein, 17 aa, Entamoeba invadens
FSALAFILLCLRIFSGL

SEQ ID NO: 2791129 - protein, 17 aa, Entamoeba invadens
FSALFFAILNRVPEITL

SEQ ID NO: 2791130 - protein, 19 aa, Entamoeba invadens
FSALLHLTATLSFTSQSFC

SEQ ID NO: 2791131 - protein, 17 aa, Entamoeba invadens
FSALQFDFSNPPIAPGM

SEQ ID NO: 2791132 - protein, 18 aa, Entamoeba invadens
FSALSIYNSVAFKSANFN

SEQ ID NO: 2791133 - protein, 18 aa, Entamoeba invadens
FSCAVQIYYDEPIRIYIS

SEQ ID NO: 2791134 - protein, 20 aa, Entamoeba invadens
FSCGCLYGCQSCPNDTCERC

SEQ ID NO: 2791135 - protein, 17 aa, Entamoeba invadens
FSCKKCRYMYGVNDSGL

SEQ ID NO: 2791136 - protein, 23 aa, Entamoeba invadens
FSCLCTIVYLWANRSIPQEKWSH

SEQ ID NO: 2791137 - protein, 21 aa, Entamoeba invadens
FSCSSCLPNYYSYLGSSSCIE

SEQ ID NO: 2791138 - protein, 20 aa, Entamoeba invadens
FSDFLMSGAFYFNEQMELQN

SEQ ID NO: 2791139 - protein, 18 aa, Entamoeba invadens
FSDGYCYSACALLTKGMF

SEQ ID NO: 2791140 - protein, 27 aa, Entamoeba invadens
FSDKPEMWRLIPVIVPFILAGIIVISR

SEQ ID NO: 2791141 - protein, 20 aa, Entamoeba invadens
FSDLLPYVLNCVRLTNPLRN

SEQ ID NO: 2791142 - protein, 20 aa, Entamoeba invadens
FSDMLKLLLWHGRNSYIRTS

SEQ ID NO: 2791143 - protein, 26 aa, Entamoeba invadens
FSDVFSFGILCWEIFYEKRTFEDSKT

SEQ ID NO: 2791144 - protein, 20 aa, Entamoeba invadens
FSEATVRLEKSLEFKDISVI

SEQ ID NO: 2791145 - protein, 18 aa, Entamoeba invadens
FSECGFGKVRYVGRQKKK

SEQ ID NO: 2791146 - protein, 20 aa, Entamoeba invadens
FSEGAFEVFAFLALFIAFLF

SEQ ID NO: 2791147 - protein, 20 aa, Entamoeba invadens
FSEGAFEVFAFLGLFIVFLF

SEQ ID NO: 2791148 - protein, 32 aa, Entamoeba invadens
FSEGIERMGGWFKVVISLIVSLVIVSVGVIVL

SEQ ID NO: 2791149 - protein, 20 aa, Entamoeba invadens
FSEIIRFITLAVMMLFVKKF

SEQ ID NO: 2791150 - protein, 18 aa, Entamoeba invadens
FSEIPFYYLSKYISSLSD

SEQ ID NO: 2791151 - protein, 21 aa, Entamoeba invadens
FSEKTLAMMVSNFLSFQLSSS

SEQ ID NO: 2791152 - protein, 19 aa, Entamoeba invadens
FSENIWVDATVKSVKTEGG

SEQ ID NO: 2791153 - protein, 18 aa, Entamoeba invadens
FSERVSLVVDFKRKILYT

SEQ ID NO: 2791154 - protein, 43 aa, Entamoeba invadens
FSFAISLYETVTWKEAFPKEKFKFPWTVANFITGGKRFERTED

SEQ ID NO: 2791155 - protein, 26 aa, Entamoeba invadens
FSFAISMYEVFIWKDPFPKDKFIFPW

SEQ ID NO: 2791156 - protein, 27 aa, Entamoeba invadens
FSFAITLYECVKWGEAYPKTEFKFPWK

SEQ ID NO: 2791157 - protein, 25 aa, Entamoeba invadens
FSFAITMYECFKWEEAYPINEFKFP

SEQ ID NO: 2791158 - protein, 28 aa, Entamoeba invadens
FSFAVTMYECLKWGEAYGTNDFKFPWKI

SEQ ID NO: 2791159 - protein, 17 aa, Entamoeba invadens
FSFFHMIEVTYLFNRIF

SEQ ID NO: 2791160 - protein, 24 aa, Entamoeba invadens
FSFGVSMFEVCGWCEAYPKESFQF

SEQ ID NO: 2791161 - protein, 40 aa, Entamoeba invadens
FSFGVTLFECYKWGEAYPKNEFKYAWNVVEFIMSGKRLAK

SEQ ID NO: 2791162 - protein, 42 aa, Entamoeba invadens
FSFGVTMFEVFGWCKAYPLDTFKFPWKIAEFVISGKRLERKE

SEQ ID NO: 2791163 - protein, 42 aa, Entamoeba invadens
FSFGVTMFEVFGWCKAYPLDTFKFPWKIAEFVISGKRLERRE

SEQ ID NO: 2791164 - protein, 17 aa, Entamoeba invadens
FSFHIISIFVYYIAIAY

SEQ ID NO: 2791165 - protein, 20 aa, Entamoeba invadens
FSFLTGFLFDHYGTRGALIY

SEQ ID NO: 2791166 - protein, 18 aa, Entamoeba invadens
FSFPRKEGTFGLWSTITI

SEQ ID NO: 2791167 - protein, 23 aa, Entamoeba invadens
FSFRHFSFKDGIFKDCKELETVN

SEQ ID NO: 2791168 - protein, 17 aa, Entamoeba invadens
FSFSFGVLTNGVYEDKY

SEQ ID NO: 2791169 - protein, 17 aa, Entamoeba invadens
FSFSFGVLTNGVYGDKY

SEQ ID NO: 2791170 - protein, 19 aa, Entamoeba invadens
FSFSFKIDFVDDFRESVLD

SEQ ID NO: 2791171 - protein, 20 aa, Entamoeba invadens
FSFTALFLLYLGPITFHILE

SEQ ID NO: 2791172 - protein, 19 aa, Entamoeba invadens
FSGCKKLTTVNGIEKVTSI

SEQ ID NO: 2791173 - protein, 22 aa, Entamoeba invadens
FSGCQKCSQTLRKCETCQNGQY

SEQ ID NO: 2791174 - protein, 18 aa, Entamoeba invadens
FSGCVKLTTVTGFDKITS

SEQ ID NO: 2791175 - protein, 17 aa, Entamoeba invadens
FSGIKITQFLSIETPDI

SEQ ID NO: 2791176 - protein, 25 aa, Entamoeba invadens
FSGIWPYTKLIFLLFSWFTPASILK

SEQ ID NO: 2791177 - protein, 21 aa, Entamoeba invadens
FSGKCAVCNTGFYPNDNGKCV

SEQ ID NO: 2791178 - protein, 19 aa, Entamoeba invadens
FSGKMRKFALLLFGNKTDV

SEQ ID NO: 2791179 - protein, 17 aa, Entamoeba invadens
FSGLLKAVSFHSENHTL

SEQ ID NO: 2791180 - protein, 17 aa, Entamoeba invadens
FSGNEFTQIPTLQWDDY

SEQ ID NO: 2791181 - protein, 23 aa, Entamoeba invadens
FSGTEMWDLEIMFGFDNFTKRYK

SEQ ID NO: 2791182 - protein, 19 aa, Entamoeba invadens
FSGTQEIWGLWRIVQYYAV

SEQ ID NO: 2791183 - protein, 22 aa, Entamoeba invadens
FSHLGKLLLFYGKNAKTQISTL

SEQ ID NO: 2791184 - protein, 24 aa, Entamoeba invadens
FSHLLRLEFVAVLAEDEKVYTING

SEQ ID NO: 2791185 - protein, 25 aa, Entamoeba invadens
FSHVFKDIRLMVSLIGLFFILPITG

SEQ ID NO: 2791186 - protein, 19 aa, Entamoeba invadens
FSIDKTCYYCGGSKFYSTE

SEQ ID NO: 2791187 - protein, 25 aa, Entamoeba invadens
FSIEGYFCFPMVDYIFFDETSKVST

SEQ ID NO: 2791188 - protein, 17 aa, Entamoeba invadens
FSIFRYLLGKNIILVIF

SEQ ID NO: 2791189 - protein, 19 aa, Entamoeba invadens
FSIIFKTNRKYILNGIDVS

SEQ ID NO: 2791190 - protein, 17 aa, Entamoeba invadens
FSIPYYVNFVVKHPDVI

SEQ ID NO: 2791191 - protein, 22 aa, Entamoeba invadens
FSIRSVAVFNCHDIPEQNPIQN

SEQ ID NO: 2791192 - protein, 24 aa, Entamoeba invadens
FSIVLPFFVPYLFFTLGVLVILTI

SEQ ID NO: 2791193 - protein, 17 aa, Entamoeba invadens
FSIVSFFICKLWAFHVK

SEQ ID NO: 2791194 - protein, 20 aa, Entamoeba invadens
FSKCKNWFFAGEILILHVLK

SEQ ID NO: 2791195 - protein, 19 aa, Entamoeba invadens
FSKEFKIKILKDSCCGLEY

SEQ ID NO: 2791196 - protein, 23 aa, Entamoeba invadens
FSKIKCGTYLVARPYQDDVACPK

SEQ ID NO: 2791197 - protein, 17 aa, Entamoeba invadens
FSKQFLVLRQINFTDEN

SEQ ID NO: 2791198 - protein, 33 aa, Entamoeba invadens
FSKRRLEWHYLFLACGYTGIVLVTLYESLSVDA

SEQ ID NO: 2791199 - protein, 26 aa, Entamoeba invadens
FSKSGASSCTQCYPGYYSSSSGSFLC

SEQ ID NO: 2791200 - protein, 17 aa, Entamoeba invadens
FSKVLFPLVSSLGNAQH

SEQ ID NO: 2791201 - protein, 17 aa, Entamoeba invadens
FSKYTSSIFCYDSDEGD

SEQ ID NO: 2791202 - protein, 22 aa, Entamoeba invadens
FSLDACGNCIVNGEIQDKTATC

SEQ ID NO: 2791203 - protein, 23 aa, Entamoeba invadens
FSLDVACLLCKRDVLNMDKWAGE

SEQ ID NO: 2791204 - protein, 22 aa, Entamoeba invadens
FSLEDWFPIQLFGKQFAPKLFF

SEQ ID NO: 2791205 - protein, 20 aa, Entamoeba invadens
FSLFCSTGMSIPKKDGLVSW

SEQ ID NO: 2791206 - protein, 24 aa, Entamoeba invadens
FSLGSWYASMIIRGHGGSKNTSAG

SEQ ID NO: 2791207 - protein, 19 aa, Entamoeba invadens
FSLSGTKFVSFTMSTSKKY

SEQ ID NO: 2791208 - protein, 17 aa, Entamoeba invadens
FSLTSLREIQLLQQIKH

SEQ ID NO: 2791209 - protein, 17 aa, Entamoeba invadens
FSLVFFAVLSVSFFVGF

SEQ ID NO: 2791210 - protein, 17 aa, Entamoeba invadens
FSLVFGGSSDVPCSIGC

SEQ ID NO: 2791211 - protein, 18 aa, Entamoeba invadens
FSLWWPKQKVRIHPLSER

SEQ ID NO: 2791212 - protein, 25 aa, Entamoeba invadens
FSLYFAGVCYVFYIATNVHLLRPLY

SEQ ID NO: 2791213 - protein, 18 aa, Entamoeba invadens
FSLYLTPQCTCHITDTIQ

SEQ ID NO: 2791214 - protein, 17 aa, Entamoeba invadens
FSMGPAIVTLVFAVILT

SEQ ID NO: 2791215 - protein, 21 aa, Entamoeba invadens
FSMKTCDNCSENAITTNGDCS

SEQ ID NO: 2791216 - protein, 21 aa, Entamoeba invadens
FSNASAFLLRAYCTMAEQFLS

SEQ ID NO: 2791217 - protein, 18 aa, Entamoeba invadens
FSNFEIRGNATFGTKNQK

SEQ ID NO: 2791218 - protein, 35 aa, Entamoeba invadens
FSNLFFFSIFNGIFFPFYLKTGSLAFTKCEGNYIS

SEQ ID NO: 2791219 - protein, 18 aa, Entamoeba invadens
FSNLMNWYNETLRYCNLK

SEQ ID NO: 2791220 - protein, 19 aa, Entamoeba invadens
FSNNLMKVGGYTFMASGMK

SEQ ID NO: 2791221 - protein, 22 aa, Entamoeba invadens
FSNNLQYALAIILAVTLDAKLL

SEQ ID NO: 2791222 - protein, 19 aa, Entamoeba invadens
FSNSVTRRVCSNNLNAANF

SEQ ID NO: 2791223 - protein, 19 aa, Entamoeba invadens
FSPERRAMMITSIPRKSTK

SEQ ID NO: 2791224 - protein, 17 aa, Entamoeba invadens
FSPHFNVPFPHFLISSF

SEQ ID NO: 2791225 - protein, 20 aa, Entamoeba invadens
FSPKLEKLGDMSFMQSKMLT

SEQ ID NO: 2791226 - protein, 17 aa, Entamoeba invadens
FSPKSRTSFKEKVAQQN

SEQ ID NO: 2791227 - protein, 39 aa, Entamoeba invadens
FSPMEFKHSWTIEKFICVGRRPPCLIGMDPTLFDIIANC

SEQ ID NO: 2791228 - protein, 17 aa, Entamoeba invadens
FSPVLKTSDSYSSFEEA

SEQ ID NO: 2791229 - protein, 18 aa, Entamoeba invadens
FSQCGIESLEIPDSVSYL

SEQ ID NO: 2791230 - protein, 26 aa, Entamoeba invadens
FSQGDLKLYLLVGGKLRDMTVLRRIE

SEQ ID NO: 2791231 - protein, 19 aa, Entamoeba invadens
FSQIPHLCAFFADVITPNT

SEQ ID NO: 2791232 - protein, 22 aa, Entamoeba invadens
FSQKLSNCVFAIAFEGDIPQLL

SEQ ID NO: 2791233 - protein, 20 aa, Entamoeba invadens
FSQKYTFYFNDVKFIKNPVA

SEQ ID NO: 2791234 - protein, 19 aa, Entamoeba invadens
FSRKCIDCVNGYYPDSNGM

SEQ ID NO: 2791235 - protein, 18 aa, Entamoeba invadens
FSRKCVVCNDGYYAVDGK

SEQ ID NO: 2791236 - protein, 18 aa, Entamoeba invadens
FSRLFIRLFCSFYSYKVN

SEQ ID NO: 2791237 - protein, 29 aa, Entamoeba invadens
FSRLKLYFRPRMGIDAVEKMMLLTHDKAL

SEQ ID NO: 2791238 - protein, 19 aa, Entamoeba invadens
FSSARKRMSTLVFNEDKSV

SEQ ID NO: 2791239 - protein, 17 aa, Entamoeba invadens
FSSENTIGFVLALSTAV

SEQ ID NO: 2791240 - protein, 20 aa, Entamoeba invadens
FSSERARSSVLVKIGERIVL

SEQ ID NO: 2791241 - protein, 20 aa, Entamoeba invadens
FSSFIIEYLVAISICAGLFG

SEQ ID NO: 2791242 - protein, 22 aa, Entamoeba invadens
FSSITFFGVFLFTSEKIFNLKK

SEQ ID NO: 2791243 - protein, 17 aa, Entamoeba invadens
FSSKCPMIALEIKKLLG

SEQ ID NO: 2791244 - protein, 17 aa, Entamoeba invadens
FSSNFDFFFPFLNDSYS

SEQ ID NO: 2791245 - protein, 24 aa, Entamoeba invadens
FSSNYEYYVLLLLKDGVGGQYKLN

SEQ ID NO: 2791246 - protein, 17 aa, Entamoeba invadens
FSSRLYSIVKYEAIIHE

SEQ ID NO: 2791247 - protein, 26 aa, Entamoeba invadens
FSSSDECRRCKFGFTLINAKCESCAD

SEQ ID NO: 2791248 - protein, 33 aa, Entamoeba invadens
FSSYGRIFTGVCSFKLDNCSILPTTKCTVDVHE

SEQ ID NO: 2791249 - protein, 18 aa, Entamoeba invadens
FSTFKYYVLNSIQITNSL

SEQ ID NO: 2791250 - protein, 17 aa, Entamoeba invadens
FSTKRIFNVLNIFLCIP

SEQ ID NO: 2791251 - protein, 21 aa, Entamoeba invadens
FSTQIMNGWFDTFNFFNDFVF

SEQ ID NO: 2791252 - protein, 20 aa, Entamoeba invadens
FSTVTTVLWTYGFASFVFCN

SEQ ID NO: 2791253 - protein, 17 aa, Entamoeba invadens
FSVCRNCTSNSCQTCSS

SEQ ID NO: 2791254 - protein, 20 aa, Entamoeba invadens
FSVENVLVLFSFMISNPESV

SEQ ID NO: 2791255 - protein, 25 aa, Entamoeba invadens
FSVGHPILHWPLFSGKMRKFALLLF

SEQ ID NO: 2791256 - protein, 29 aa, Entamoeba invadens
FSVIAFFPFDLIRYMGIGCALAVTSTLLV

SEQ ID NO: 2791257 - protein, 18 aa, Entamoeba invadens
FSVITSFGQFSFEKTKIS

SEQ ID NO: 2791258 - protein, 19 aa, Entamoeba invadens
FSVLFCFGGMMIEMNKTVI

SEQ ID NO: 2791259 - protein, 17 aa, Entamoeba invadens
FSVLMFVVSICYSLLFR

SEQ ID NO: 2791260 - protein, 18 aa, Entamoeba invadens
FSVLRLVKHAKTIQLFVC

SEQ ID NO: 2791261 - protein, 18 aa, Entamoeba invadens
FSVMDGCDFYEIRTVPSL

SEQ ID NO: 2791262 - protein, 19 aa, Entamoeba invadens
FSVMEGCDFYEIRTVPSLL

SEQ ID NO: 2791263 - protein, 26 aa, Entamoeba invadens
FSVMHFLKYCHFNGFFGEGAVTEAAK

SEQ ID NO: 2791264 - protein, 21 aa, Entamoeba invadens
FSVPFRLPIHSDKIDTTLFEF

SEQ ID NO: 2791265 - protein, 17 aa, Entamoeba invadens
FSVTIYFLSFFFLKSYF

SEQ ID NO: 2791266 - protein, 19 aa, Entamoeba invadens
FSVVGALKYYIKVMPTPVI

SEQ ID NO: 2791267 - protein, 17 aa, Entamoeba invadens
FSWPEDVLESFIKEVEM

SEQ ID NO: 2791268 - protein, 19 aa, Entamoeba invadens
FSYEFNRHILRYCAQQTSM

SEQ ID NO: 2791269 - protein, 19 aa, Entamoeba invadens
FSYEWSMQFIHTASRKYRT

SEQ ID NO: 2791270 - protein, 24 aa, Entamoeba invadens
FSYKGMLCDYGLALGTQFTCLHRV

SEQ ID NO: 2791271 - protein, 24 aa, Entamoeba invadens
FSYPTRLAKVVLHGLDLTIRKGET

SEQ ID NO: 2791272 - protein, 21 aa, Entamoeba invadens
FTAEKKASCPNKDKKMAGVYK

SEQ ID NO: 2791273 - protein, 18 aa, Entamoeba invadens
FTAFNAYWFVISFTGFMI

SEQ ID NO: 2791274 - protein, 22 aa, Entamoeba invadens
FTAGRFCEWIHLKCPGYALKAM

SEQ ID NO: 2791275 - protein, 18 aa, Entamoeba invadens
FTAISIWVIFALPKLPGI

SEQ ID NO: 2791276 - protein, 18 aa, Entamoeba invadens
FTALILIELINVGFSIKR

SEQ ID NO: 2791277 - protein, 18 aa, Entamoeba invadens
FTANCLIYMRNEKIDLTG

SEQ ID NO: 2791278 - protein, 19 aa, Entamoeba invadens
FTAPECFKESSLTAEADVY

SEQ ID NO: 2791279 - protein, 28 aa, Entamoeba invadens
FTASVRFGPINTRPCRFIAETQIIDYQK

SEQ ID NO: 2791280 - protein, 25 aa, Entamoeba invadens
FTCEGWPFQKFCEKCLENVFDARWE

SEQ ID NO: 2791281 - protein, 18 aa, Entamoeba invadens
FTCIECKNGYYLKNGKCE

SEQ ID NO: 2791282 - protein, 19 aa, Entamoeba invadens
FTCKGCDLSCGKSCNNMNG

SEQ ID NO: 2791283 - protein, 20 aa, Entamoeba invadens
FTCLFSLTKNSSFVVQPKCS

SEQ ID NO: 2791284 - protein, 26 aa, Entamoeba invadens
FTCLRQLSDVPLLFLIFSRMLQAQSE

SEQ ID NO: 2791285 - protein, 17 aa, Entamoeba invadens
FTCTSCGNGYFLKDGTC

SEQ ID NO: 2791286 - protein, 19 aa, Entamoeba invadens
FTDEIKIELPFPLNEKHHL

SEQ ID NO: 2791287 - protein, 31 aa, Entamoeba invadens
FTDEIRMKLPFPLTVKHHLLFTVSLVCSDDF

SEQ ID NO: 2791288 - protein, 18 aa, Entamoeba invadens
FTDGTAFLLSNSRLMRFC

SEQ ID NO: 2791289 - protein, 18 aa, Entamoeba invadens
FTDSNGFLATFDCTPLDE

SEQ ID NO: 2791290 - protein, 28 aa, Entamoeba invadens
FTEKEFAEFTVCYYILYYKTISVEVPTT

SEQ ID NO: 2791291 - protein, 17 aa, Entamoeba invadens
FTFASTFFGCFSCNMLP

SEQ ID NO: 2791292 - protein, 24 aa, Entamoeba invadens
FTFEMRCPLDFLLVQLLVACLLEV

SEQ ID NO: 2791293 - protein, 17 aa, Entamoeba invadens
FTFFPIVVFGVFDRDVM

SEQ ID NO: 2791294 - protein, 28 aa, Entamoeba invadens
FTFKGCSKLITFNGFEKINSFGIESFSE

SEQ ID NO: 2791295 - protein, 20 aa, Entamoeba invadens
FTFKSFREAIKIEPTNLLEQ

SEQ ID NO: 2791296 - protein, 18 aa, Entamoeba invadens
FTFLKVFCSFNVKRSNET

SEQ ID NO: 2791297 - protein, 29 aa, Entamoeba invadens
FTFNSELYKDVTISTCFEEFGYQSYLEFT

SEQ ID NO: 2791298 - protein, 23 aa, Entamoeba invadens
FTFQGCTKLKYLINSKYITIILS

SEQ ID NO: 2791299 - protein, 18 aa, Entamoeba invadens
FTFYPLPISMMFDERVDA

SEQ ID NO: 2791300 - protein, 18 aa, Entamoeba invadens
FTGNYSLLFDGRKNNRMQ

SEQ ID NO: 2791301 - protein, 23 aa, Entamoeba invadens
FTGPYCIQTLFSSIDHYKTDCVV

SEQ ID NO: 2791302 - protein, 24 aa, Entamoeba invadens
FTHFNFPSLKAIHVSLRKSNGTNA

SEQ ID NO: 2791303 - protein, 40 aa, Entamoeba invadens
FTIDFTSKVDYSFCYFRQKFRLGQWFKIDLSKVTKDYVMI

SEQ ID NO: 2791304 - protein, 17 aa, Entamoeba invadens
FTIEIKGIVPFEKKKEI

SEQ ID NO: 2791305 - protein, 19 aa, Entamoeba invadens
FTIEVGSAMAIVLFVVMVF

SEQ ID NO: 2791306 - protein, 17 aa, Entamoeba invadens
FTIGYIVGDAVKFNKIV

SEQ ID NO: 2791307 - protein, 24 aa, Entamoeba invadens
FTIIELFATLLLNFENRVIIKSAF

SEQ ID NO: 2791308 - protein, 30 aa, Entamoeba invadens
FTITSPPTFPIRATNCVLKITGSATLSAQS

SEQ ID NO: 2791309 - protein, 18 aa, Entamoeba invadens
FTKCALTLPTGGGCAICK

SEQ ID NO: 2791310 - protein, 17 aa, Entamoeba invadens
FTKDFFIFGEGRKFIEV

SEQ ID NO: 2791311 - protein, 25 aa, Entamoeba invadens
FTKDKCLRCKDGFVFEGNNCVAITE

SEQ ID NO: 2791312 - protein, 24 aa, Entamoeba invadens
FTKDKCLRCNDGFVFEGNNCVKIT

SEQ ID NO: 2791313 - protein, 25 aa, Entamoeba invadens
FTKDNCLRCNDGLVFKGNNCVDITE

SEQ ID NO: 2791314 - protein, 17 aa, Entamoeba invadens
FTKECRPACGTCFDVFK

SEQ ID NO: 2791315 - protein, 17 aa, Entamoeba invadens
FTKIIMLNRGKMIYFGS

SEQ ID NO: 2791316 - protein, 19 aa, Entamoeba invadens
FTKKIEWSAFPVLKTIVIF

SEQ ID NO: 2791317 - protein, 19 aa, Entamoeba invadens
FTKPWKLVLQSGKVDNNIK

SEQ ID NO: 2791318 - protein, 19 aa, Entamoeba invadens
FTKVVRPYVMISGDVSVQV

SEQ ID NO: 2791319 - protein, 17 aa, Entamoeba invadens
FTLDLNGSVVFQGLNFP

SEQ ID NO: 2791320 - protein, 18 aa, Entamoeba invadens
FTLEKKFVLRAFDYLLGK

SEQ ID NO: 2791321 - protein, 17 aa, Entamoeba invadens
FTLFMFGPLMYRLFYVL

SEQ ID NO: 2791322 - protein, 18 aa, Entamoeba invadens
FTLGCIFIVPPLVLNTSP

SEQ ID NO: 2791323 - protein, 17 aa, Entamoeba invadens
FTLGFANIFYIPMAITE

SEQ ID NO: 2791324 - protein, 18 aa, Entamoeba invadens
FTLICFVLYIMNRMHYIA

SEQ ID NO: 2791325 - protein, 26 aa, Entamoeba invadens
FTLIINAFVFYKSLYLLIVIAKVYMN

SEQ ID NO: 2791326 - protein, 23 aa, Entamoeba invadens
FTLKDFCKRCVKDNSTIKCLECF

SEQ ID NO: 2791327 - protein, 24 aa, Entamoeba invadens
FTLKIKICGVIPFTSERKRMGIIV

SEQ ID NO: 2791328 - protein, 21 aa, Entamoeba invadens
FTLLFISSFVFMFVEGGMPES

SEQ ID NO: 2791329 - protein, 21 aa, Entamoeba invadens
FTLLFTCFLIVLLAFLAGLCL

SEQ ID NO: 2791330 - protein, 24 aa, Entamoeba invadens
FTLNLKVLVIYSTLTLNGGVVTIN

SEQ ID NO: 2791331 - protein, 24 aa, Entamoeba invadens
FTLNNKCLECFNNYMIDDNGNCIQ

SEQ ID NO: 2791332 - protein, 17 aa, Entamoeba invadens
FTLPPDNSFIWRYDNET

SEQ ID NO: 2791333 - protein, 18 aa, Entamoeba invadens
FTLTSPPWNCFNPEIISD

SEQ ID NO: 2791334 - protein, 18 aa, Entamoeba invadens
FTNEYIIIQCDITIINVT

SEQ ID NO: 2791335 - protein, 27 aa, Entamoeba invadens
FTNGIKCLKCKTGELANNCNICHDVNC

SEQ ID NO: 2791336 - protein, 19 aa, Entamoeba invadens
FTNLNFKYFPNGFGSSNSK

SEQ ID NO: 2791337 - protein, 27 aa, Entamoeba invadens
FTNPQEVFASFPLDFAPVDGFIVQQPT

SEQ ID NO: 2791338 - protein, 17 aa, Entamoeba invadens
FTPASILKPSIRGGILS

SEQ ID NO: 2791339 - protein, 17 aa, Entamoeba invadens
FTPELDGTFFISQTETG

SEQ ID NO: 2791340 - protein, 18 aa, Entamoeba invadens
FTPGLFPLIRSGSTDIRV

SEQ ID NO: 2791341 - protein, 25 aa, Entamoeba invadens
FTQIPIIQWEFSWHQDLKVKVVCKR

SEQ ID NO: 2791342 - protein, 17 aa, Entamoeba invadens
FTQIPTLQWDDDYTHKD

SEQ ID NO: 2791343 - protein, 24 aa, Entamoeba invadens
FTQRMAYFSSFARYFLNCKDHVAV

SEQ ID NO: 2791344 - protein, 29 aa, Entamoeba invadens
FTRDCFPADCGRCKYGYNCTAQGKCEKVN

SEQ ID NO: 2791345 - protein, 17 aa, Entamoeba invadens
FTRIFERLDNGNLIAIH

SEQ ID NO: 2791346 - protein, 18 aa, Entamoeba invadens
FTRYRDSRVLKYSVRSVS

SEQ ID NO: 2791347 - protein, 19 aa, Entamoeba invadens
FTSCFKDINDGVAMYLFFL

SEQ ID NO: 2791348 - protein, 18 aa, Entamoeba invadens
FTSKHWVVRIYKVLKPNA

SEQ ID NO: 2791349 - protein, 19 aa, Entamoeba invadens
FTSLLIMPAQRCMRYGTML

SEQ ID NO: 2791350 - protein, 33 aa, Entamoeba invadens
FTSQLVERWLCLCVDVIGAFVIFGSVAAASFSS

SEQ ID NO: 2791351 - protein, 19 aa, Entamoeba invadens
FTSSCLSFFDITPLLEINA

SEQ ID NO: 2791352 - protein, 23 aa, Entamoeba invadens
FTSTSALQWKSLVFSSLNEITIY

SEQ ID NO: 2791353 - protein, 17 aa, Entamoeba invadens
FTTCFKSVNTIIFQPPF

SEQ ID NO: 2791354 - protein, 25 aa, Entamoeba invadens
FTTCLSLLYFVDWKVHYKDSVTTKT

SEQ ID NO: 2791355 - protein, 22 aa, Entamoeba invadens
FTTEPNEPLLIFVGGENFIENG

SEQ ID NO: 2791356 - protein, 26 aa, Entamoeba invadens
FTTLPFCVFCVASFPSFSVDSVSRLL

SEQ ID NO: 2791357 - protein, 18 aa, Entamoeba invadens
FTTLYRGECYLTHNYANT

SEQ ID NO: 2791358 - protein, 17 aa, Entamoeba invadens
FTTPCSVKFDTSTNTFS

SEQ ID NO: 2791359 - protein, 19 aa, Entamoeba invadens
FTTVFRFLNVIALCVLNVF

SEQ ID NO: 2791360 - protein, 25 aa, Entamoeba invadens
FTVCEILYAWSCIDVFIISVIAAVL

SEQ ID NO: 2791361 - protein, 17 aa, Entamoeba invadens
FTVESFSVIPLELQEYV

SEQ ID NO: 2791362 - protein, 36 aa, Entamoeba invadens
FTVFGPLCTFIFICICCGYHGSDFLGLVYLTIALTG

SEQ ID NO: 2791363 - protein, 21 aa, Entamoeba invadens
FTVVSLIAFYLYQGLLSFPMQ

SEQ ID NO: 2791364 - protein, 24 aa, Entamoeba invadens
FTVWLLDYYDFRSGGYGAVMRHRF

SEQ ID NO: 2791365 - protein, 17 aa, Entamoeba invadens
FTWKEPYPIENFKFAWS

SEQ ID NO: 2791366 - protein, 25 aa, Entamoeba invadens
FTYGFARAEVVGAFINSVFQISIGF

SEQ ID NO: 2791367 - protein, 21 aa, Entamoeba invadens
FTYRPKGAFPVLLSGELFVIN

SEQ ID NO: 2791368 - protein, 25 aa, Entamoeba invadens
FTYTDVIGGFSIRFPAPLRISEHFV

SEQ ID NO: 2791369 - protein, 22 aa, Entamoeba invadens
FVADLPYLFVVLFSIGDCLFAC

SEQ ID NO: 2791370 - protein, 23 aa, Entamoeba invadens
FVAPRIVPFLDQFGVEKETTMNM

SEQ ID NO: 2791371 - protein, 19 aa, Entamoeba invadens
FVCDSCGQGEVSGKCKESI

SEQ ID NO: 2791372 - protein, 26 aa, Entamoeba invadens
FVCKEKDEMIGFLISFGLTTSPPIWI

SEQ ID NO: 2791373 - protein, 19 aa, Entamoeba invadens
FVCNAAYYTESIFQCVYGV

SEQ ID NO: 2791374 - protein, 19 aa, Entamoeba invadens
FVCNLKASKLRGVASEGMI

SEQ ID NO: 2791375 - protein, 18 aa, Entamoeba invadens
FVDFNLPVQYEMFIGQGC

SEQ ID NO: 2791376 - protein, 27 aa, Entamoeba invadens
FVEHFFDCICDGYNFNIWIFPGITLGL

SEQ ID NO: 2791377 - protein, 23 aa, Entamoeba invadens
FVESNCKRCLITPSGGEEEAKFE

SEQ ID NO: 2791378 - protein, 24 aa, Entamoeba invadens
FVETKCVGHLCIALHTQSTHDKEA

SEQ ID NO: 2791379 - protein, 21 aa, Entamoeba invadens
FVFCALLVAIYWWAKQPQHVY

SEQ ID NO: 2791380 - protein, 22 aa, Entamoeba invadens
FVFCTLSSPLSINIFDVGQADS

SEQ ID NO: 2791381 - protein, 17 aa, Entamoeba invadens
FVFDFVNSYVLCKVPES

SEQ ID NO: 2791382 - protein, 27 aa, Entamoeba invadens
FVFDKCLKFWSGHCVECYAGYHLTSDG

SEQ ID NO: 2791383 - protein, 26 aa, Entamoeba invadens
FVFFHYLVYHARFFDITKYLPGKSAN

SEQ ID NO: 2791384 - protein, 24 aa, Entamoeba invadens
FVFSRTTLVDVFAFRNSGIRAVIT

SEQ ID NO: 2791385 - protein, 36 aa, Entamoeba invadens
FVGARWCGFNSIVRAGWSKMIFTFFLPATVFYQTAT

SEQ ID NO: 2791386 - protein, 25 aa, Entamoeba invadens
FVGAWFCQIPNSWAASTVNKQAMIT

SEQ ID NO: 2791387 - protein, 20 aa, Entamoeba invadens
FVGITIWIVYAISQKHDEIN

SEQ ID NO: 2791388 - protein, 18 aa, Entamoeba invadens
FVGKDGTGRSVQTVVVLP

SEQ ID NO: 2791389 - protein, 17 aa, Entamoeba invadens
FVGNYLFEGKCLSCKLG

SEQ ID NO: 2791390 - protein, 20 aa, Entamoeba invadens
FVGSFAEYFVLSLLSVKKLD

SEQ ID NO: 2791391 - protein, 17 aa, Entamoeba invadens
FVIANGYAKLVKIDIFS

SEQ ID NO: 2791392 - protein, 17 aa, Entamoeba invadens
FVIFIAFYFTKFVSKII

SEQ ID NO: 2791393 - protein, 17 aa, Entamoeba invadens
FVIFYWYTLTYRNIEVE

SEQ ID NO: 2791394 - protein, 28 aa, Entamoeba invadens
FVIIIGIIWWRRVKSVKAETAAIKPFHV

SEQ ID NO: 2791395 - protein, 19 aa, Entamoeba invadens
FVILPLLFVDTGVMFPIIA

SEQ ID NO: 2791396 - protein, 19 aa, Entamoeba invadens
FVIPLEYLSQLLSLFFLLP

SEQ ID NO: 2791397 - protein, 17 aa, Entamoeba invadens
FVISLVISFFYEEINKE

SEQ ID NO: 2791398 - protein, 41 aa, Entamoeba invadens
FVIVWRKKKVLTFVVYCCLILPLIMQCYLVFAHSNEIINGT

SEQ ID NO: 2791399 - protein, 18 aa, Entamoeba invadens
FVKESLKRRGLKAQSGMS

SEQ ID NO: 2791400 - protein, 17 aa, Entamoeba invadens
FVKFFIKLLQHLPKSIA

SEQ ID NO: 2791401 - protein, 17 aa, Entamoeba invadens
FVKKDERVIGMRDITVS

SEQ ID NO: 2791402 - protein, 43 aa, Entamoeba invadens
FVKKEVRAVFEINWKRIFNWLILFWGYTAFECFEQESHLLYEY

SEQ ID NO: 2791403 - protein, 19 aa, Entamoeba invadens
FVKKLKCLTSEYINMGKCE

SEQ ID NO: 2791404 - protein, 19 aa, Entamoeba invadens
FVKLCDIMTVFPTIHSKTT

SEQ ID NO: 2791405 - protein, 21 aa, Entamoeba invadens
FVLAGGYIRLFNSLRTVRRVP

SEQ ID NO: 2791406 - protein, 23 aa, Entamoeba invadens
FVLCTAVSYAALKLFDIPMRKRL

SEQ ID NO: 2791407 - protein, 26 aa, Entamoeba invadens
FVLCTLSMEWCDVGGNIACFIQKPTK

SEQ ID NO: 2791408 - protein, 19 aa, Entamoeba invadens
FVLEILKNKVVRYGVKRTF

SEQ ID NO: 2791409 - protein, 17 aa, Entamoeba invadens
FVLGAMKTPAFMAFGQM

SEQ ID NO: 2791410 - protein, 29 aa, Entamoeba invadens
FVLLFYFRCMKIIVGWLLLSVILLLMFFG

SEQ ID NO: 2791411 - protein, 18 aa, Entamoeba invadens
FVLMGFLALTVVVFIVKG

SEQ ID NO: 2791412 - protein, 24 aa, Entamoeba invadens
FVLNNLRRSLKMNTFDFKPHCGEA

SEQ ID NO: 2791413 - protein, 17 aa, Entamoeba invadens
FVLSVGTLFCFVCISYV

SEQ ID NO: 2791414 - protein, 18 aa, Entamoeba invadens
FVLYLRKCFVRPHARRLG

SEQ ID NO: 2791415 - protein, 17 aa, Entamoeba invadens
FVMCTSFLCEIRSDNNY

SEQ ID NO: 2791416 - protein, 34 aa, Entamoeba invadens
FVMLFERIGQIRLFEDIWCFTPGLFPLIRSGSTD

SEQ ID NO: 2791417 - protein, 18 aa, Entamoeba invadens
FVMLVSLFLNNTPVVAMS

SEQ ID NO: 2791418 - protein, 17 aa, Entamoeba invadens
FVMNCIVGLSAPFFHQK

SEQ ID NO: 2791419 - protein, 19 aa, Entamoeba invadens
FVMPFVWLYMLARCYLFVQ

SEQ ID NO: 2791420 - protein, 19 aa, Entamoeba invadens
FVMPVLCVLMIIFMILSKC

SEQ ID NO: 2791421 - protein, 19 aa, Entamoeba invadens
FVNGLNFPLNQYLPFFILM

SEQ ID NO: 2791422 - protein, 21 aa, Entamoeba invadens
FVNKLFSFVIMYLIRELSTTF

SEQ ID NO: 2791423 - protein, 20 aa, Entamoeba invadens
FVNKNCFKLFIIVHNNKNNR

SEQ ID NO: 2791424 - protein, 17 aa, Entamoeba invadens
FVNSDVRLPEWDMNICD

SEQ ID NO: 2791425 - protein, 19 aa, Entamoeba invadens
FVPAFSIAFVGNYMKHNYV

SEQ ID NO: 2791426 - protein, 22 aa, Entamoeba invadens
FVPKRICLVTEFADFGSLQDLM

SEQ ID NO: 2791427 - protein, 24 aa, Entamoeba invadens
FVPPLDWSALLVLLALLFHFSDIS

SEQ ID NO: 2791428 - protein, 23 aa, Entamoeba invadens
FVPTCGNGGYVKVNVPSVLKDMN

SEQ ID NO: 2791429 - protein, 26 aa, Entamoeba invadens
FVQDRWYPHGSAFSVLLLQKRLLFHI

SEQ ID NO: 2791430 - protein, 23 aa, Entamoeba invadens
FVRELTKLVAIIVGFNLVYFTDT

SEQ ID NO: 2791431 - protein, 17 aa, Entamoeba invadens
FVRIVPFLHIFSESIVS

SEQ ID NO: 2791432 - protein, 23 aa, Entamoeba invadens
FVSACPAFYWGIVWITQQKVFGM

SEQ ID NO: 2791433 - protein, 28 aa, Entamoeba invadens
FVSFNAPRPWEWFTMSSWRCAGADSTFS

SEQ ID NO: 2791434 - protein, 19 aa, Entamoeba invadens
FVSGVVIGMYYDWRLGLCS

SEQ ID NO: 2791435 - protein, 26 aa, Entamoeba invadens
FVSHFKKFSLIYAMIDFLFAKQENPE

SEQ ID NO: 2791436 - protein, 19 aa, Entamoeba invadens
FVSKKMCRKFMYDMAKGIE

SEQ ID NO: 2791437 - protein, 19 aa, Entamoeba invadens
FVSLFIRNFFVLCVVGIIY

SEQ ID NO: 2791438 - protein, 19 aa, Entamoeba invadens
FVSLHGGVCVNTKVVDFNT

SEQ ID NO: 2791439 - protein, 20 aa, Entamoeba invadens
FVSQRILQILFLFYTIVVFF

SEQ ID NO: 2791440 - protein, 20 aa, Entamoeba invadens
FVSSTYFKKGYFTNSEIRQF

SEQ ID NO: 2791441 - protein, 23 aa, Entamoeba invadens
FVTELIGTFLLNFVGDAIYMNFF

SEQ ID NO: 2791442 - protein, 18 aa, Entamoeba invadens
FVTFELTETYTLRISEKT

SEQ ID NO: 2791443 - protein, 17 aa, Entamoeba invadens
FVTIFTQSTWTRTAGFA

SEQ ID NO: 2791444 - protein, 18 aa, Entamoeba invadens
FVTIPFLWISKMYTDKVP

SEQ ID NO: 2791445 - protein, 18 aa, Entamoeba invadens
FVTLKPGYACEFEIIIKP

SEQ ID NO: 2791446 - protein, 18 aa, Entamoeba invadens
FVTLKSVPFSIQFTGNYS

SEQ ID NO: 2791447 - protein, 17 aa, Entamoeba invadens
FVTLPLDIKNAGLNYLT

SEQ ID NO: 2791448 - protein, 33 aa, Entamoeba invadens
FVTNFLFGFSFNFWFIFALRFLNGMLNGNIGVV

SEQ ID NO: 2791449 - protein, 19 aa, Entamoeba invadens
FVTVLSLRVENEYYSKGTG

SEQ ID NO: 2791450 - protein, 19 aa, Entamoeba invadens
FVVCSGIFISGVFVMLFNG

SEQ ID NO: 2791451 - protein, 24 aa, Entamoeba invadens
FVVDASYCELCWVQNCRYCDYNLC

SEQ ID NO: 2791452 - protein, 23 aa, Entamoeba invadens
FVVDFKSTFTLGPFHDFSWTAFV

SEQ ID NO: 2791453 - protein, 18 aa, Entamoeba invadens
FVVDPKKSMLRHMLRSKE

SEQ ID NO: 2791454 - protein, 24 aa, Entamoeba invadens
FVVKFKAICPHKCNADKGWGNCST

SEQ ID NO: 2791455 - protein, 17 aa, Entamoeba invadens
FVVMLFTFVCASIPLNH

SEQ ID NO: 2791456 - protein, 20 aa, Entamoeba invadens
FVVPMIYSLGKYITKATEQD

SEQ ID NO: 2791457 - protein, 17 aa, Entamoeba invadens
FVVRITLWMKESVLKCF

SEQ ID NO: 2791458 - protein, 21 aa, Entamoeba invadens
FVVSCGLFIFTNGWMVMIFSV

SEQ ID NO: 2791459 - protein, 18 aa, Entamoeba invadens
FVVSIVIYYILYGTILLF

SEQ ID NO: 2791460 - protein, 17 aa, Entamoeba invadens
FVVTKAGSVMVYRILLD

SEQ ID NO: 2791461 - protein, 20 aa, Entamoeba invadens
FVYESGYWFALLNVVFLAGV

SEQ ID NO: 2791462 - protein, 19 aa, Entamoeba invadens
FVYYCRILKKIPVECPLED

SEQ ID NO: 2791463 - protein, 22 aa, Entamoeba invadens
FWASNMKSGYALFDDFTITEKD

SEQ ID NO: 2791464 - protein, 21 aa, Entamoeba invadens
FWDFKGMGCPHGISIDNYSND

SEQ ID NO: 2791465 - protein, 22 aa, Entamoeba invadens
FWDFNCSTLKLTNVIGNISSPI

SEQ ID NO: 2791466 - protein, 19 aa, Entamoeba invadens
FWEFNCRHIKLSEVVGNVY

SEQ ID NO: 2791467 - protein, 18 aa, Entamoeba invadens
FWETSWDVLRTNAVSRKA

SEQ ID NO: 2791468 - protein, 22 aa, Entamoeba invadens
FWFKMFCIWYTGEICLSKYIGT

SEQ ID NO: 2791469 - protein, 18 aa, Entamoeba invadens
FWGGLNVFDIYKPGVSEE

SEQ ID NO: 2791470 - protein, 30 aa, Entamoeba invadens
FWLFFYSAMCLIVFGVLKYFGKKDDFLGYH

SEQ ID NO: 2791471 - protein, 24 aa, Entamoeba invadens
FWLFRGKSLLPFTWIAGIVQFGLA

SEQ ID NO: 2791472 - protein, 20 aa, Entamoeba invadens
FWLIFHFFLFQLFIFSEGAC

SEQ ID NO: 2791473 - protein, 20 aa, Entamoeba invadens
FWLIFNFFLFQLFIFSKGAC

SEQ ID NO: 2791474 - protein, 29 aa, Entamoeba invadens
FWLVCALGFCYPALKFLGSTSLFIEPPKG

SEQ ID NO: 2791475 - protein, 29 aa, Entamoeba invadens
FWLVCALGFCYPALKFLGSTSLFVEPPEG

SEQ ID NO: 2791476 - protein, 28 aa, Entamoeba invadens
FWLVFLKRFAYSFVPAFLVFCSVELIVG

SEQ ID NO: 2791477 - protein, 19 aa, Entamoeba invadens
FWRFCASALLYNFAAFLFW

SEQ ID NO: 2791478 - protein, 20 aa, Entamoeba invadens
FWRYCASSLLFNFGAFLFWI

SEQ ID NO: 2791479 - protein, 17 aa, Entamoeba invadens
FWTTIRVDFTYGSCVIP

SEQ ID NO: 2791480 - protein, 17 aa, Entamoeba invadens
FWYTFGLAVMCGVLSIP

SEQ ID NO: 2791481 - protein, 37 aa, Entamoeba invadens
FWYTPRHKGTYCTKKAVWWVIVLCLLVFLVLSIALLI

SEQ ID NO: 2791482 - protein, 26 aa, Entamoeba invadens
FYAVFIAFLVFCCVSIIIGEVKPEVP

SEQ ID NO: 2791483 - protein, 19 aa, Entamoeba invadens
FYCEICDYATDSIDDMENH

SEQ ID NO: 2791484 - protein, 23 aa, Entamoeba invadens
FYCRDCFFDSMAVNGLFLFAFHV

SEQ ID NO: 2791485 - protein, 23 aa, Entamoeba invadens
FYDDICVYKKGIDKNFCKPCTFT

SEQ ID NO: 2791486 - protein, 17 aa, Entamoeba invadens
FYDEAFKFEWMTVYCKA

SEQ ID NO: 2791487 - protein, 18 aa, Entamoeba invadens
FYEGFYVVNPDNLDITCE

SEQ ID NO: 2791488 - protein, 18 aa, Entamoeba invadens
FYEGYTWITPYPVSDFKF

SEQ ID NO: 2791489 - protein, 19 aa, Entamoeba invadens
FYEMCCYEQNSKVLFSFGF

SEQ ID NO: 2791490 - protein, 19 aa, Entamoeba invadens
FYERTKIQLKMMVLACQMI

SEQ ID NO: 2791491 - protein, 17 aa, Entamoeba invadens
FYFIKECFLTMYKKPSN

SEQ ID NO: 2791492 - protein, 24 aa, Entamoeba invadens
FYFLVGLICSWTFGETVVSPITNK

SEQ ID NO: 2791493 - protein, 17 aa, Entamoeba invadens
FYFSQITPLLSFDSTYN

SEQ ID NO: 2791494 - protein, 26 aa, Entamoeba invadens
FYFVLGFFCCCFWACGYSQTKHASDK

SEQ ID NO: 2791495 - protein, 20 aa, Entamoeba invadens
FYGACFIEKHVCMVTEFAQF

SEQ ID NO: 2791496 - protein, 19 aa, Entamoeba invadens
FYGACFIPNHICMVTEFAL

SEQ ID NO: 2791497 - protein, 19 aa, Entamoeba invadens
FYGACFIPSHIEMVTEFAQ

SEQ ID NO: 2791498 - protein, 20 aa, Entamoeba invadens
FYGACVIKSEFCLVTEYAEY

SEQ ID NO: 2791499 - protein, 19 aa, Entamoeba invadens
FYGAVFIRSKECMITEFAL

SEQ ID NO: 2791500 - protein, 19 aa, Entamoeba invadens
FYGAVFIRSKECMVTEFAT

SEQ ID NO: 2791501 - protein, 18 aa, Entamoeba invadens
FYGAVLIPNKYCMVTEFA

SEQ ID NO: 2791502 - protein, 19 aa, Entamoeba invadens
FYGAVLIPNRLCIVTEFSE

SEQ ID NO: 2791503 - protein, 19 aa, Entamoeba invadens
FYGAVLIPSRICMVTEFAE

SEQ ID NO: 2791504 - protein, 26 aa, Entamoeba invadens
FYGHPKEIWISHSIKEALKIDKVGNV

SEQ ID NO: 2791505 - protein, 19 aa, Entamoeba invadens
FYGIVVVLLIPLGVFLLYS

SEQ ID NO: 2791506 - protein, 18 aa, Entamoeba invadens
FYGLAGWALDLLDFSQHR

SEQ ID NO: 2791507 - protein, 17 aa, Entamoeba invadens
FYIDQLDGCLRCKIGYY

SEQ ID NO: 2791508 - protein, 17 aa, Entamoeba invadens
FYIFKVIYWVFSGLQIK

SEQ ID NO: 2791509 - protein, 20 aa, Entamoeba invadens
FYILCYIPPISLTIWSYYRT

SEQ ID NO: 2791510 - protein, 17 aa, Entamoeba invadens
FYIRFFAVVTIFFVLTI

SEQ ID NO: 2791511 - protein, 19 aa, Entamoeba invadens
FYISGFACFPCDLNCKICD

SEQ ID NO: 2791512 - protein, 24 aa, Entamoeba invadens
FYKAREALVDLILILPFIAVIVAL

SEQ ID NO: 2791513 - protein, 17 aa, Entamoeba invadens
FYKDAIVELGTTRVGEV

SEQ ID NO: 2791514 - protein, 21 aa, Entamoeba invadens
FYKKVKIPFVIQELSGDHLND

SEQ ID NO: 2791515 - protein, 28 aa, Entamoeba invadens
FYKNKCFECSNGCLKCVKDGCVLCDFGY

SEQ ID NO: 2791516 - protein, 18 aa, Entamoeba invadens
FYKTRKLSDIIMCVVGVV

SEQ ID NO: 2791517 - protein, 24 aa, Entamoeba invadens
FYKYFPSIIRKNAFRNSGLQSIGY

SEQ ID NO: 2791518 - protein, 17 aa, Entamoeba invadens
FYLCVPFSYVTGLNLSF

SEQ ID NO: 2791519 - protein, 24 aa, Entamoeba invadens
FYLEDVGLFIAMIFGLFDGSTSDE

SEQ ID NO: 2791520 - protein, 30 aa, Entamoeba invadens
FYLGTAIPRCYKCSINCLKCYSEVSCYTCH

SEQ ID NO: 2791521 - protein, 22 aa, Entamoeba invadens
FYLHPELKYYQGFHDVVSILIL

SEQ ID NO: 2791522 - protein, 20 aa, Entamoeba invadens
FYLIKICPFTLSFLQSPLQV

SEQ ID NO: 2791523 - protein, 18 aa, Entamoeba invadens
FYLKNGICTSDDFNCEEY

SEQ ID NO: 2791524 - protein, 17 aa, Entamoeba invadens
FYLLLEMKICVTIFVGF

SEQ ID NO: 2791525 - protein, 24 aa, Entamoeba invadens
FYLNDPYLRLVIVLHEDLSNKYGL

SEQ ID NO: 2791526 - protein, 22 aa, Entamoeba invadens
FYLNEIYVSFSLTKTIINQNVG

SEQ ID NO: 2791527 - protein, 19 aa, Entamoeba invadens
FYLQNGRCFVCENDCLTCR

SEQ ID NO: 2791528 - protein, 28 aa, Entamoeba invadens
FYLVYCIYVTCFLLYLFILFDCIVGETI

SEQ ID NO: 2791529 - protein, 20 aa, Entamoeba invadens
FYMACIAFGGFGEVVMMVYV

SEQ ID NO: 2791530 - protein, 19 aa, Entamoeba invadens
FYMASSWGAYVFINNIIPL

SEQ ID NO: 2791531 - protein, 24 aa, Entamoeba invadens
FYNHHCYRCFSGTYSKGKFSECIF

SEQ ID NO: 2791532 - protein, 18 aa, Entamoeba invadens
FYNSFKFQDYVEATQNTL

SEQ ID NO: 2791533 - protein, 21 aa, Entamoeba invadens
FYNSKCLATMVLKKVDKAQSS

SEQ ID NO: 2791534 - protein, 18 aa, Entamoeba invadens
FYPTIKFTLDELSYTIQQ

SEQ ID NO: 2791535 - protein, 21 aa, Entamoeba invadens
FYQLLLIGGGSIHYMENYEMN

SEQ ID NO: 2791536 - protein, 18 aa, Entamoeba invadens
FYQNTSFLNNKDHVYFGY

SEQ ID NO: 2791537 - protein, 18 aa, Entamoeba invadens
FYQQRRLFVPTILRSIEH

SEQ ID NO: 2791538 - protein, 17 aa, Entamoeba invadens
FYQTGLRTFKLSPLHNL

SEQ ID NO: 2791539 - protein, 21 aa, Entamoeba invadens
FYRFPELRGNSTFIATNSCIE

SEQ ID NO: 2791540 - protein, 19 aa, Entamoeba invadens
FYSACFLPDHLCLVTELAK

SEQ ID NO: 2791541 - protein, 27 aa, Entamoeba invadens
FYSDSCLRLNAKYCSLCPTNYFHSSEN

SEQ ID NO: 2791542 - protein, 23 aa, Entamoeba invadens
FYSDTCLLFSFFVEEGGNSDENT

SEQ ID NO: 2791543 - protein, 19 aa, Entamoeba invadens
FYSFPFKFMLEQLMRFSNI

SEQ ID NO: 2791544 - protein, 25 aa, Entamoeba invadens
FYSLSFGNFVLCFLLNTFAIPNWNY

SEQ ID NO: 2791545 - protein, 20 aa, Entamoeba invadens
FYSRIDPIIVKRVEKEVMIK

SEQ ID NO: 2791546 - protein, 18 aa, Entamoeba invadens
FYSYEFISANEFFPAINA

SEQ ID NO: 2791547 - protein, 17 aa, Entamoeba invadens
FYTAIGVDCITFIVLLT

SEQ ID NO: 2791548 - protein, 19 aa, Entamoeba invadens
FYTTFFKLVGFICILIATY

SEQ ID NO: 2791549 - protein, 18 aa, Entamoeba invadens
FYTVREMTLRINNLSKDK

SEQ ID NO: 2791550 - protein, 17 aa, Entamoeba invadens
FYTVWNFTTLTCHEIAS

SEQ ID NO: 2791551 - protein, 26 aa, Entamoeba invadens
FYVEIRLEPKLGFPSTGVSFLPLLGL

SEQ ID NO: 2791552 - protein, 19 aa, Entamoeba invadens
FYVGDGVAFMPLKLEPRKT

SEQ ID NO: 2791553 - protein, 17 aa, Entamoeba invadens
FYYCWELGYHFHSLVYH

SEQ ID NO: 2791554 - protein, 24 aa, Entamoeba invadens
FYYGTELFPFWIVLFMTLFFANIT

SEQ ID NO: 2791555 - protein, 19 aa, Entamoeba invadens
FYYTRSILFTLCLANEATF

SEQ ID NO: 2791556 - protein, 21 aa, Entamoeba invadens
GAAFCLNCSAGYYSTQGATSC

SEQ ID NO: 2791557 - protein, 20 aa, Entamoeba invadens
GAAIGVPLSIVFVIIVLIAI

SEQ ID NO: 2791558 - protein, 20 aa, Entamoeba invadens
GAASCKPCNAGYYSDNGAVT

SEQ ID NO: 2791559 - protein, 18 aa, Entamoeba invadens
GAAVEFYSPPGLDNIFIP

SEQ ID NO: 2791560 - protein, 19 aa, Entamoeba invadens
GACIRCKVRYYLQGNQCVR

SEQ ID NO: 2791561 - protein, 19 aa, Entamoeba invadens
GACTGCLFNYIYSSTDPKK

SEQ ID NO: 2791562 - protein, 18 aa, Entamoeba invadens
GACTNCWTNYVTNLTLNG

SEQ ID NO: 2791563 - protein, 25 aa, Entamoeba invadens
GAEGECLMCSTDLVLSFDKQKCNVN

SEQ ID NO: 2791564 - protein, 24 aa, Entamoeba invadens
GAERKCSVCKAGYYPKTSDDFKCQ

SEQ ID NO: 2791565 - protein, 23 aa, Entamoeba invadens
GAERKCSVCKAGYYPKTSGDYKC

SEQ ID NO: 2791566 - protein, 25 aa, Entamoeba invadens
GAFACKKCRVSNCAKCDSKVEECQQ

SEQ ID NO: 2791567 - protein, 17 aa, Entamoeba invadens
GAFDYIAKVLIRNLNES

SEQ ID NO: 2791568 - protein, 17 aa, Entamoeba invadens
GAFGLVFKGTYRGLEVA

SEQ ID NO: 2791569 - protein, 18 aa, Entamoeba invadens
GAFGMVFRGTYRTRDVAI

SEQ ID NO: 2791570 - protein, 22 aa, Entamoeba invadens
GAFGVVYRGTYKGIEVAVKKLK

SEQ ID NO: 2791571 - protein, 25 aa, Entamoeba invadens
GAFKYKEIRVGVNLIDRRTFENTKT

SEQ ID NO: 2791572 - protein, 17 aa, Entamoeba invadens
GAFNFLPSIGKYEKIVG

SEQ ID NO: 2791573 - protein, 18 aa, Entamoeba invadens
GAFSMVFRGKYRGEDVAV

SEQ ID NO: 2791574 - protein, 19 aa, Entamoeba invadens
GAFYHVICAVDLCASIVLH

SEQ ID NO: 2791575 - protein, 30 aa, Entamoeba invadens
GAGAAFPFYSLKFVDMLLILMRLEVGTDLT

SEQ ID NO: 2791576 - protein, 17 aa, Entamoeba invadens
GAIESFRIYNVIQYADV

SEQ ID NO: 2791577 - protein, 19 aa, Entamoeba invadens
GAIFLVFAVTVWYFSARDP

SEQ ID NO: 2791578 - protein, 25 aa, Entamoeba invadens
GAIFPFYSIKFMDIMMVMLNMEPGV

SEQ ID NO: 2791579 - protein, 24 aa, Entamoeba invadens
GAIFPFYTLKFIDAYMCLMSITGT

SEQ ID NO: 2791580 - protein, 20 aa, Entamoeba invadens
GAIIFLLTFALKMFFALPKI

SEQ ID NO: 2791581 - protein, 19 aa, Entamoeba invadens
GAKLNFSEATVRLEKSLEF

SEQ ID NO: 2791582 - protein, 29 aa, Entamoeba invadens
GALGMIFCMCSWYTLCVCCIPIYDDDVVY

SEQ ID NO: 2791583 - protein, 21 aa, Entamoeba invadens
GALICVICPDGQYSQELASSA

SEQ ID NO: 2791584 - protein, 18 aa, Entamoeba invadens
GALIYAFVMGTLGYLLYG

SEQ ID NO: 2791585 - protein, 18 aa, Entamoeba invadens
GALKMKRMMDLYVQHMDL

SEQ ID NO: 2791586 - protein, 17 aa, Entamoeba invadens
GALPTLSIKRMSDFIFL

SEQ ID NO: 2791587 - protein, 18 aa, Entamoeba invadens
GAMGAVLFMYYKKKSGYS

SEQ ID NO: 2791588 - protein, 22 aa, Entamoeba invadens
GANGVVYLGLYRGAYVAVKTFN

SEQ ID NO: 2791589 - protein, 17 aa, Entamoeba invadens
GANVIKLAAHLKEYSTL

SEQ ID NO: 2791590 - protein, 17 aa, Entamoeba invadens
GAPDVFSTFVAIFNTGD

SEQ ID NO: 2791591 - protein, 25 aa, Entamoeba invadens
GARCILPKFIHRFLVSEDYNYHRGW

SEQ ID NO: 2791592 - protein, 22 aa, Entamoeba invadens
GASATGCSKCKADTTTCLSCTA

SEQ ID NO: 2791593 - protein, 23 aa, Entamoeba invadens
GASDCRKLCYYNGNFYNDDTEVS

SEQ ID NO: 2791594 - protein, 18 aa, Entamoeba invadens
GASFIPNRICMVTELAKY

SEQ ID NO: 2791595 - protein, 19 aa, Entamoeba invadens
GASICARCSQGYYSNEGAT

SEQ ID NO: 2791596 - protein, 22 aa, Entamoeba invadens
GASICTTCLSGYYSLDGASVCY

SEQ ID NO: 2791597 - protein, 21 aa, Entamoeba invadens
GASQCSKCPVGYYSSNYGSSS

SEQ ID NO: 2791598 - protein, 21 aa, Entamoeba invadens
GASQCTACLVGTYTPTTGTSV

SEQ ID NO: 2791599 - protein, 22 aa, Entamoeba invadens
GASSCKLCNAGSYSNKGATTCT

SEQ ID NO: 2791600 - protein, 17 aa, Entamoeba invadens
GASSCLTCDAGYYSSIR

SEQ ID NO: 2791601 - protein, 24 aa, Entamoeba invadens
GASSCTKCSPGYFASSYGSSSCTK

SEQ ID NO: 2791602 - protein, 21 aa, Entamoeba invadens
GASSCTKCYSGFFASSSGSTS

SEQ ID NO: 2791603 - protein, 21 aa, Entamoeba invadens
GASSCYSCSPGTYSSSGSTSC

SEQ ID NO: 2791604 - protein, 22 aa, Entamoeba invadens
GASVCTKCPLGTYSSLKGSSSC

SEQ ID NO: 2791605 - protein, 19 aa, Entamoeba invadens
GATKLSAFTAKAGIKTIGA

SEQ ID NO: 2791606 - protein, 29 aa, Entamoeba invadens
GATRENMSYFSLWQAMRMPSFYLNCVIAI

SEQ ID NO: 2791607 - protein, 20 aa, Entamoeba invadens
GATSCKDCPVGTMVNDNHSG

SEQ ID NO: 2791608 - protein, 23 aa, Entamoeba invadens
GATTCAPCPVGYYSQFSVSAECT

SEQ ID NO: 2791609 - protein, 17 aa, Entamoeba invadens
GAVFARNKVCMVTEFAT

SEQ ID NO: 2791610 - protein, 24 aa, Entamoeba invadens
GAVFIPRKICIVSEYAKYGSLENL

SEQ ID NO: 2791611 - protein, 21 aa, Entamoeba invadens
GAVKLFCIIAVMYTLVCQFIV

SEQ ID NO: 2791612 - protein, 25 aa, Entamoeba invadens
GAVMFEKRFAIITEFADFGSLQDLM

SEQ ID NO: 2791613 - protein, 17 aa, Entamoeba invadens
GAVMIRNKICMVTELAQ

SEQ ID NO: 2791614 - protein, 17 aa, Entamoeba invadens
GAVPLFVGKVTVNSPNV

SEQ ID NO: 2791615 - protein, 25 aa, Entamoeba invadens
GAVVCSTCLFGYVVSNGVCTNLTEV

SEQ ID NO: 2791616 - protein, 25 aa, Entamoeba invadens
GAWSDRVDSVWGKRRPFLLGGGLIL

SEQ ID NO: 2791617 - protein, 19 aa, Entamoeba invadens
GAYLCRISSPLALNTIQLI

SEQ ID NO: 2791618 - protein, 26 aa, Entamoeba invadens
GAYSHAECVCEFLLAHFMNMNDLSQI

SEQ ID NO: 2791619 - protein, 26 aa, Entamoeba invadens
GAYVFKFVLCSALRQLAYVTVAQTYY

SEQ ID NO: 2791620 - protein, 19 aa, Entamoeba invadens
GCAECGIGYYLDNQECLPC

SEQ ID NO: 2791621 - protein, 21 aa, Entamoeba invadens
GCAFCQSLECSICSTNNNFLI

SEQ ID NO: 2791622 - protein, 35 aa, Entamoeba invadens
GCAGTKWVVCPATNLIKKYVCFGSTECYFVDPTAD

SEQ ID NO: 2791623 - protein, 18 aa, Entamoeba invadens
GCAICKDKYYKQKTDCIS

SEQ ID NO: 2791624 - protein, 18 aa, Entamoeba invadens
GCAICKDQYFKQEADCIS

SEQ ID NO: 2791625 - protein, 21 aa, Entamoeba invadens
GCAKCTDGYFVQNQFCTPCHL

SEQ ID NO: 2791626 - protein, 21 aa, Entamoeba invadens
GCAKCVDSYYLKEGKCYKLTD

SEQ ID NO: 2791627 - protein, 17 aa, Entamoeba invadens
GCAPCKELSHCAKCSED

SEQ ID NO: 2791628 - protein, 21 aa, Entamoeba invadens
GCASCNGYSSTTCFSCKENYY

SEQ ID NO: 2791629 - protein, 25 aa, Entamoeba invadens
GCATCDAFECFSCRDNFVYKNGKCQ

SEQ ID NO: 2791630 - protein, 19 aa, Entamoeba invadens
GCATKCLTNNTCGRCMVGY

SEQ ID NO: 2791631 - protein, 20 aa, Entamoeba invadens
GCAVCKENVCDTCKAGYNTF

SEQ ID NO: 2791632 - protein, 18 aa, Entamoeba invadens
GCDALFGCLQCENETTCT

SEQ ID NO: 2791633 - protein, 25 aa, Entamoeba invadens
GCDYYEIRSVPPLVTLKPGYACEFE

SEQ ID NO: 2791634 - protein, 32 aa, Entamoeba invadens
GCEILSCFIVICVCSYYLVIVVVFSIIVFLIF

SEQ ID NO: 2791635 - protein, 27 aa, Entamoeba invadens
GCEKSGWKWYYYFLLIVGIFIVVIVLI

SEQ ID NO: 2791636 - protein, 17 aa, Entamoeba invadens
GCELCDTGYVISNGRCV

SEQ ID NO: 2791637 - protein, 21 aa, Entamoeba invadens
GCERRVLGWAVGVCIVCGVLF

SEQ ID NO: 2791638 - protein, 17 aa, Entamoeba invadens
GCESCPIGEYKFSETTY

SEQ ID NO: 2791639 - protein, 19 aa, Entamoeba invadens
GCETCISGFPALQCTTCFD

SEQ ID NO: 2791640 - protein, 25 aa, Entamoeba invadens
GCEYRYTVLFIYLAVFVFVYVLLYT

SEQ ID NO: 2791641 - protein, 19 aa, Entamoeba invadens
GCFELQCWKELTNFAKTVK

SEQ ID NO: 2791642 - protein, 26 aa, Entamoeba invadens
GCFGKTCLEGFYGKRIWNVEQQYYEY

SEQ ID NO: 2791643 - protein, 19 aa, Entamoeba invadens
GCFSCTSGGCSACNTGFYF

SEQ ID NO: 2791644 - protein, 19 aa, Entamoeba invadens
GCFTLVRLESVFDVSMKDI

SEQ ID NO: 2791645 - protein, 22 aa, Entamoeba invadens
GCGDAAVTRATWFSVTNTSPEP

SEQ ID NO: 2791646 - protein, 17 aa, Entamoeba invadens
GCGDWGTTRLYKRDMCK

SEQ ID NO: 2791647 - protein, 21 aa, Entamoeba invadens
GCGKQARLVYYLTSPIFVFIT

SEQ ID NO: 2791648 - protein, 24 aa, Entamoeba invadens
GCGSDCKCLPDYTSSDFKCYKVLC

SEQ ID NO: 2791649 - protein, 23 aa, Entamoeba invadens
GCGSDCLCSIGYTADGDGHCVPK

SEQ ID NO: 2791650 - protein, 19 aa, Entamoeba invadens
GCICEFFRALPYAHVIGNS

SEQ ID NO: 2791651 - protein, 29 aa, Entamoeba invadens
GCIKCDFNYYLSRGRCFPCSENCTSCIET

SEQ ID NO: 2791652 - protein, 21 aa, Entamoeba invadens
GCIKCKDAFYVNNKMCSPCNS

SEQ ID NO: 2791653 - protein, 20 aa, Entamoeba invadens
GCIKCSPKTYLNRINSTHTM

SEQ ID NO: 2791654 - protein, 19 aa, Entamoeba invadens
GCISCLDGYYLTNGSCNKC

SEQ ID NO: 2791655 - protein, 21 aa, Entamoeba invadens
GCISCTSGYYLYHKDCAPCSE

SEQ ID NO: 2791656 - protein, 19 aa, Entamoeba invadens
GCISCTSGYYLYYKECAPC

SEQ ID NO: 2791657 - protein, 25 aa, Entamoeba invadens
GCIVAEMFLGIPLFPANSEYDLLLR

SEQ ID NO: 2791658 - protein, 24 aa, Entamoeba invadens
GCKATCPDMYFAKDNMCTSCTQNC

SEQ ID NO: 2791659 - protein, 23 aa, Entamoeba invadens
GCKATCPDMYFAKDNVCTSCTQN

SEQ ID NO: 2791660 - protein, 20 aa, Entamoeba invadens
GCKSLLLLNGTEFVSKIEKG

SEQ ID NO: 2791661 - protein, 20 aa, Entamoeba invadens
GCKTNYILKDGVCIHKSALN

SEQ ID NO: 2791662 - protein, 25 aa, Entamoeba invadens
GCLDCSRVTYCYACDKGYYTISNNT

SEQ ID NO: 2791663 - protein, 22 aa, Entamoeba invadens
GCLDLLPIFLGLTMDDSDPNFF

SEQ ID NO: 2791664 - protein, 20 aa, Entamoeba invadens
GCLECKIGYYKKGADCAQCD

SEQ ID NO: 2791665 - protein, 21 aa, Entamoeba invadens
GCLECKIGYYKKGADCAQCDV

SEQ ID NO: 2791666 - protein, 19 aa, Entamoeba invadens
GCLKCKEGYYISGKDCRQC

SEQ ID NO: 2791667 - protein, 24 aa, Entamoeba invadens
GCLNCTGALLLRKRVCVAPLSERC

SEQ ID NO: 2791668 - protein, 17 aa, Entamoeba invadens
GCLQCKYDVSFDSTLDD

SEQ ID NO: 2791669 - protein, 17 aa, Entamoeba invadens
GCLQERVSVALDLANEI

SEQ ID NO: 2791670 - protein, 17 aa, Entamoeba invadens
GCLSCADQTYSLANSSM

SEQ ID NO: 2791671 - protein, 23 aa, Entamoeba invadens
GCLSCISPYFSREAKCESCNTKC

SEQ ID NO: 2791672 - protein, 25 aa, Entamoeba invadens
GCLTCSATACTQCKDGNAVLNGPAS

SEQ ID NO: 2791673 - protein, 24 aa, Entamoeba invadens
GCLTLKWNMCETFSNIQVQRNKNS

SEQ ID NO: 2791674 - protein, 25 aa, Entamoeba invadens
GCNDQSLYFARWYRLVNRERIPIQV

SEQ ID NO: 2791675 - protein, 18 aa, Entamoeba invadens
GCNKCMKFGSGEVECVEC

SEQ ID NO: 2791676 - protein, 20 aa, Entamoeba invadens
GCNLALCTKLFTIYEIILSD

SEQ ID NO: 2791677 - protein, 20 aa, Entamoeba invadens
GCQKCKFGYFPEEKRCSPCN

SEQ ID NO: 2791678 - protein, 26 aa, Entamoeba invadens
GCRKCNKKMCFECSSDFIIENGNCVL

SEQ ID NO: 2791679 - protein, 22 aa, Entamoeba invadens
GCSGDFYYLDAMNCDEYYEFNG

SEQ ID NO: 2791680 - protein, 20 aa, Entamoeba invadens
GCSKCAAGYYLTAVQFCEKC

SEQ ID NO: 2791681 - protein, 18 aa, Entamoeba invadens
GCSKCIDGYYIYNSNQCA

SEQ ID NO: 2791682 - protein, 20 aa, Entamoeba invadens
GCSSCSGTTWGCEECSRTQN

SEQ ID NO: 2791683 - protein, 29 aa, Entamoeba invadens
GCSSTSRLARMVASLSHEYVYFLFVGINE

SEQ ID NO: 2791684 - protein, 24 aa, Entamoeba invadens
GCSTCLSAESCGSCEETYTKMGEN

SEQ ID NO: 2791685 - protein, 18 aa, Entamoeba invadens
GCSTRLSLFNGVCTSCSG

SEQ ID NO: 2791686 - protein, 19 aa, Entamoeba invadens
GCTECEPGFYTHEYGCASC

SEQ ID NO: 2791687 - protein, 24 aa, Entamoeba invadens
GCTECKNGSFLHERMCTPCQDNCM

SEQ ID NO: 2791688 - protein, 19 aa, Entamoeba invadens
GCTLCKPNYFPKNKTCHLC

SEQ ID NO: 2791689 - protein, 21 aa, Entamoeba invadens
GCTLYKISLTLKKCLLCEDKR

SEQ ID NO: 2791690 - protein, 18 aa, Entamoeba invadens
GCTNFQCVDVSPAVKPAG

SEQ ID NO: 2791691 - protein, 19 aa, Entamoeba invadens
GCTTCLNAFTCLSCSSGLY

SEQ ID NO: 2791692 - protein, 23 aa, Entamoeba invadens
GCTTCSLGYMLKNGICSKCDANP

SEQ ID NO: 2791693 - protein, 24 aa, Entamoeba invadens
GCVCKSSDGVLCKPCQFKGVVCFY

SEQ ID NO: 2791694 - protein, 19 aa, Entamoeba invadens
GCVECNNGYILREPYCESC

SEQ ID NO: 2791695 - protein, 25 aa, Entamoeba invadens
GCVKADGLFCLQCNEGFNPIETLNK

SEQ ID NO: 2791696 - protein, 22 aa, Entamoeba invadens
GCVKCVDGYYRYGLSCERCLDK

SEQ ID NO: 2791697 - protein, 22 aa, Entamoeba invadens
GCVKLLSVNFYAPLTKLLDSLA

SEQ ID NO: 2791698 - protein, 18 aa, Entamoeba invadens
GCVLCSSGFYQVDSLNVE

SEQ ID NO: 2791699 - protein, 27 aa, Entamoeba invadens
GCVRCKEGYFRKEFDCVKCDDECETCQ

SEQ ID NO: 2791700 - protein, 20 aa, Entamoeba invadens
GCVTCSIGYYYDNQYCSSCS

SEQ ID NO: 2791701 - protein, 19 aa, Entamoeba invadens
GCVTCSVGYYYDNQYCSSC

SEQ ID NO: 2791702 - protein, 19 aa, Entamoeba invadens
GCVVCKDGYYRVGLDCFEC

SEQ ID NO: 2791703 - protein, 30 aa, Entamoeba invadens
GCVVCKDGYYRVGLDCFECDLKCGKCLNTN

SEQ ID NO: 2791704 - protein, 29 aa, Entamoeba invadens
GCVVCKDGYYRVGLDCFECDLNCETCNDK

SEQ ID NO: 2791705 - protein, 36 aa, Entamoeba invadens
GCVVCKDGYYRVGLDCLKCDIKCGTCLNLNSCLACN

SEQ ID NO: 2791706 - protein, 29 aa, Entamoeba invadens
GCVVCKDGYYRVGLDCYKCDQKCGKCLNI

SEQ ID NO: 2791707 - protein, 24 aa, Entamoeba invadens
GCYAEKYGRCLSCKDGYYMSNDQT

SEQ ID NO: 2791708 - protein, 27 aa, Entamoeba invadens
GCYQCREGYYRVGLDCIECISNCSTCN

SEQ ID NO: 2791709 - protein, 18 aa, Entamoeba invadens
GCYRCIDGKFLNAESGIC

SEQ ID NO: 2791710 - protein, 19 aa, Entamoeba invadens
GDAAFRKTKLTTITIPTSV

SEQ ID NO: 2791711 - protein, 23 aa, Entamoeba invadens
GDADWWFVACFVGVFFSVVFLCF

SEQ ID NO: 2791712 - protein, 17 aa, Entamoeba invadens
GDAGINMEIEQMSQAMS

SEQ ID NO: 2791713 - protein, 25 aa, Entamoeba invadens
GDANCWRVSTGHLQIVIWSDFLLNH

SEQ ID NO: 2791714 - protein, 18 aa, Entamoeba invadens
GDAPRYWSSLTVLAPIKI

SEQ ID NO: 2791715 - protein, 25 aa, Entamoeba invadens
GDCLFACVLFSIYLFNTEAGTMPPQ

SEQ ID NO: 2791716 - protein, 17 aa, Entamoeba invadens
GDCLNCFKESGECTTCQ

SEQ ID NO: 2791717 - protein, 29 aa, Entamoeba invadens
GDCLPQSEILCWRITCFKMQRNYKFKMFK

SEQ ID NO: 2791718 - protein, 18 aa, Entamoeba invadens
GDCLSCYGGSVITEGRCV

SEQ ID NO: 2791719 - protein, 20 aa, Entamoeba invadens
GDCLSCYQGSVLKNGKCEMC

SEQ ID NO: 2791720 - protein, 20 aa, Entamoeba invadens
GDCTSCFAGFALKDGSCGGC

SEQ ID NO: 2791721 - protein, 28 aa, Entamoeba invadens
GDDGLWSTVCAAGYCDDGFKWDFYNQEC

SEQ ID NO: 2791722 - protein, 25 aa, Entamoeba invadens
GDDGRWSEVCVPTYCDENYYFDFFN

SEQ ID NO: 2791723 - protein, 27 aa, Entamoeba invadens
GDEKNDHSFECMICMDTAQNAVVTQCG

SEQ ID NO: 2791724 - protein, 23 aa, Entamoeba invadens
GDELPDYLSYCGPYVEYNTDHPK

SEQ ID NO: 2791725 - protein, 23 aa, Entamoeba invadens
GDENFGSAFGFIVEHLPSIYNKK

SEQ ID NO: 2791726 - protein, 18 aa, Entamoeba invadens
GDERCKIRCNPEIVSLKK

SEQ ID NO: 2791727 - protein, 19 aa, Entamoeba invadens
GDFDKLYAKFCISEINLMY

SEQ ID NO: 2791728 - protein, 19 aa, Entamoeba invadens
GDFIVHFYGAVLIPNKVCM

SEQ ID NO: 2791729 - protein, 38 aa, Entamoeba invadens
GDFNEFLTLSCVFLRRGIETVKALPLVFSTELPTWIDS

SEQ ID NO: 2791730 - protein, 24 aa, Entamoeba invadens
GDFRCKYCDATCGGKCDTTNGHCT

SEQ ID NO: 2791731 - protein, 23 aa, Entamoeba invadens
GDGCALCKTGYYRVERECLPCDT

SEQ ID NO: 2791732 - protein, 21 aa, Entamoeba invadens
GDGFQCIPCQIGTYSNIPGSE

SEQ ID NO: 2791733 - protein, 21 aa, Entamoeba invadens
GDGIPYLTILLWMGGDAVKTI

SEQ ID NO: 2791734 - protein, 19 aa, Entamoeba invadens
GDGKAVVAHTCNYYTNFDS

SEQ ID NO: 2791735 - protein, 25 aa, Entamoeba invadens
GDGKCLKCKEGSYLSGDVCITVTPD

SEQ ID NO: 2791736 - protein, 24 aa, Entamoeba invadens
GDGKELWFAYIIKYLILFFPVLNL

SEQ ID NO: 2791737 - protein, 29 aa, Entamoeba invadens
GDIFPKNEFKFAWIIADFVSSGKRKEKPI

SEQ ID NO: 2791738 - protein, 18 aa, Entamoeba invadens
GDIFSYVHFPFLVTSVVL

SEQ ID NO: 2791739 - protein, 26 aa, Entamoeba invadens
GDIRVMASLVLLELIQKLDVGRDYQI

SEQ ID NO: 2791740 - protein, 17 aa, Entamoeba invadens
GDKAPIQHILPYIKNTT

SEQ ID NO: 2791741 - protein, 19 aa, Entamoeba invadens
GDKPFRVLFEGSDGTKFEV

SEQ ID NO: 2791742 - protein, 20 aa, Entamoeba invadens
GDKSTLCNYGILTSQSHKCL

SEQ ID NO: 2791743 - protein, 24 aa, Entamoeba invadens
GDKVKGYTSNKCGDWEEQGSSSSG

SEQ ID NO: 2791744 - protein, 24 aa, Entamoeba invadens
GDKVKGYVSNKCGNWVEQASASSG

SEQ ID NO: 2791745 - protein, 31 aa, Entamoeba invadens
GDLCQKCTINSCVSCGLTGVVNSGGSCESIG

SEQ ID NO: 2791746 - protein, 17 aa, Entamoeba invadens
GDLKLFIREIKHVCSYA

SEQ ID NO: 2791747 - protein, 21 aa, Entamoeba invadens
GDLLEAFPIDISESGSLKFDS

SEQ ID NO: 2791748 - protein, 18 aa, Entamoeba invadens
GDLLEIFATVCFGLGIAL

SEQ ID NO: 2791749 - protein, 21 aa, Entamoeba invadens
GDLMETCELFLPSGDKCSVCK

SEQ ID NO: 2791750 - protein, 17 aa, Entamoeba invadens
GDLSARCSVALPTGGGC

SEQ ID NO: 2791751 - protein, 17 aa, Entamoeba invadens
GDLSARCSVVLPKAGGC

SEQ ID NO: 2791752 - protein, 20 aa, Entamoeba invadens
GDLSYKCMPPLFFQVICHLA

SEQ ID NO: 2791753 - protein, 17 aa, Entamoeba invadens
GDLTARCNVSLPKGGGC

SEQ ID NO: 2791754 - protein, 25 aa, Entamoeba invadens
GDMLARLLYFIPIPFNKWVIFGFSC

SEQ ID NO: 2791755 - protein, 18 aa, Entamoeba invadens
GDMSYKYFTTSLIIISVI

SEQ ID NO: 2791756 - protein, 21 aa, Entamoeba invadens
GDNKCKGALIIKDTDNKPLCD

SEQ ID NO: 2791757 - protein, 26 aa, Entamoeba invadens
GDNSAWKLWDFPIFYTTASVDYFASE

SEQ ID NO: 2791758 - protein, 20 aa, Entamoeba invadens
GDPFMNRWFDLTVATNEIYN

SEQ ID NO: 2791759 - protein, 17 aa, Entamoeba invadens
GDPLPPLGSGYYDAVTA

SEQ ID NO: 2791760 - protein, 22 aa, Entamoeba invadens
GDPRYLAPELKTGAVTASSDVY

SEQ ID NO: 2791761 - protein, 24 aa, Entamoeba invadens
GDPTCTKCPVGSFASVEEAKYCQP

SEQ ID NO: 2791762 - protein, 19 aa, Entamoeba invadens
GDQSIDLCFTRDDECKFID

SEQ ID NO: 2791763 - protein, 23 aa, Entamoeba invadens
GDRCYECQDGFYLKDQQCQRCDE

SEQ ID NO: 2791764 - protein, 18 aa, Entamoeba invadens
GDSLFCMTDDASIEAAGS

SEQ ID NO: 2791765 - protein, 19 aa, Entamoeba invadens
GDSVLRPFVQRGKAIRDLI

SEQ ID NO: 2791766 - protein, 24 aa, Entamoeba invadens
GDTCLTCRSGYFKISVESPLCQTY

SEQ ID NO: 2791767 - protein, 19 aa, Entamoeba invadens
GDTCTKCTIGYYLTKGSCI

SEQ ID NO: 2791768 - protein, 18 aa, Entamoeba invadens
GDTFKIKFTFKANGENGE

SEQ ID NO: 2791769 - protein, 17 aa, Entamoeba invadens
GDTFKIKFTFNANGENG

SEQ ID NO: 2791770 - protein, 18 aa, Entamoeba invadens
GDVAREYTTCNLKAAGKL

SEQ ID NO: 2791771 - protein, 23 aa, Entamoeba invadens
GDVGGVVSCYRCGTWRYLWHIAL

SEQ ID NO: 2791772 - protein, 27 aa, Entamoeba invadens
GDVNGNWCIYDSWTLLCLHKAQEGEGI

SEQ ID NO: 2791773 - protein, 28 aa, Entamoeba invadens
GDVRFGFSYCDMCKASLLEVDRLCEKKK

SEQ ID NO: 2791774 - protein, 26 aa, Entamoeba invadens
GDVSAWVSGLLYFFGRFPQAVHIYRK

SEQ ID NO: 2791775 - protein, 22 aa, Entamoeba invadens
GDYLRRMWESLVLVLFLRPFDI

SEQ ID NO: 2791776 - protein, 17 aa, Entamoeba invadens
GEACEFEIFIKPLCSCR

SEQ ID NO: 2791777 - protein, 18 aa, Entamoeba invadens
GEACEFEIFITPLCSCQI

SEQ ID NO: 2791778 - protein, 17 aa, Entamoeba invadens
GEACEFEVFIVPHCTMK

SEQ ID NO: 2791779 - protein, 17 aa, Entamoeba invadens
GEACEFEVFLTLFCTTD

SEQ ID NO: 2791780 - protein, 24 aa, Entamoeba invadens
GEACEFEVFLTPNFTCKIDNKMLI

SEQ ID NO: 2791781 - protein, 19 aa, Entamoeba invadens
GEAFLIPGISIIVKYLENN

SEQ ID NO: 2791782 - protein, 18 aa, Entamoeba invadens
GEAFPCGETAFPKKAEKV

SEQ ID NO: 2791783 - protein, 27 aa, Entamoeba invadens
GEAHGGPTDWKGFALFIDTYDNDRNKD

SEQ ID NO: 2791784 - protein, 18 aa, Entamoeba invadens
GECFGCLKDYVLVKKLPT

SEQ ID NO: 2791785 - protein, 25 aa, Entamoeba invadens
GECGEWTSGIGFLYGIICTICVFIQ

SEQ ID NO: 2791786 - protein, 17 aa, Entamoeba invadens
GECKVCDSNCKTCASES

SEQ ID NO: 2791787 - protein, 17 aa, Entamoeba invadens
GECSGCLSGYYLDGSTC

SEQ ID NO: 2791788 - protein, 17 aa, Entamoeba invadens
GECSYAMDNCASFLCAD

SEQ ID NO: 2791789 - protein, 19 aa, Entamoeba invadens
GECTLCGDLTYSEGGVMQC

SEQ ID NO: 2791790 - protein, 19 aa, Entamoeba invadens
GECTNCLAGFQAVDNSCTE

SEQ ID NO: 2791791 - protein, 23 aa, Entamoeba invadens
GECVAGGIPHCLDYVNKQQCSVC

SEQ ID NO: 2791792 - protein, 18 aa, Entamoeba invadens
GEDEGVYSFGFDEKQVGM

SEQ ID NO: 2791793 - protein, 22 aa, Entamoeba invadens
GEDENRGYCSITTGGCVCKEEY

SEQ ID NO: 2791794 - protein, 17 aa, Entamoeba invadens
GEDEPRCVDMWTGERIG

SEQ ID NO: 2791795 - protein, 17 aa, Entamoeba invadens
GEECSFVLLPYDTLMRM

SEQ ID NO: 2791796 - protein, 29 aa, Entamoeba invadens
GEEETLCTFLCKYKRELIPLILSNKTIEG

SEQ ID NO: 2791797 - protein, 26 aa, Entamoeba invadens
GEEKGAIEMFKWLIEMYYKEEKYNEF

SEQ ID NO: 2791798 - protein, 17 aa, Entamoeba invadens
GEELQYFMHIDVETEIS

SEQ ID NO: 2791799 - protein, 20 aa, Entamoeba invadens
GEEVLYMLRNIALTKRFNLI

SEQ ID NO: 2791800 - protein, 18 aa, Entamoeba invadens
GEFAIFVLGNGVTKMDNI

SEQ ID NO: 2791801 - protein, 19 aa, Entamoeba invadens
GEFCDMCIEHCLLCTDKSS

SEQ ID NO: 2791802 - protein, 18 aa, Entamoeba invadens
GEFERYWHSLTFSGNGYR

SEQ ID NO: 2791803 - protein, 20 aa, Entamoeba invadens
GEFHVAFGKIAYRQQRTNQV

SEQ ID NO: 2791804 - protein, 25 aa, Entamoeba invadens
GEFIPYRYVEELVKQLVVVKSALIV

SEQ ID NO: 2791805 - protein, 30 aa, Entamoeba invadens
GEFKAYKLGKCYYKGDGLYVRYEKKDSNLE

SEQ ID NO: 2791806 - protein, 25 aa, Entamoeba invadens
GEGAFGIVFKGVFRGNSVAVKQMKN

SEQ ID NO: 2791807 - protein, 20 aa, Entamoeba invadens
GEGAFGLVFRGTYRGTEVAI

SEQ ID NO: 2791808 - protein, 21 aa, Entamoeba invadens
GEGSCGIVYKGSFRGNVVAIK

SEQ ID NO: 2791809 - protein, 26 aa, Entamoeba invadens
GEGSFGIVFKGFFRGNIVAIKKMKNL

SEQ ID NO: 2791810 - protein, 21 aa, Entamoeba invadens
GEGSFGIVFKGIFRGNIVAIK

SEQ ID NO: 2791811 - protein, 26 aa, Entamoeba invadens
GEGSFGIVFKGMFRDNVVAIKKMKIG

SEQ ID NO: 2791812 - protein, 28 aa, Entamoeba invadens
GEGSFGIVFKGMFRDSVVAIKKMKINTE

SEQ ID NO: 2791813 - protein, 26 aa, Entamoeba invadens
GEGSFGIVFKGMFRNNVVAIKKMKIN

SEQ ID NO: 2791814 - protein, 27 aa, Entamoeba invadens
GEGSFGIVFKGMFRNNVVAIKKMKINT

SEQ ID NO: 2791815 - protein, 24 aa, Entamoeba invadens
GEGSFGIVYHGEFRGSDVAIKKMK

SEQ ID NO: 2791816 - protein, 20 aa, Entamoeba invadens
GEGSFGIVYQGEFRGSDVAI

SEQ ID NO: 2791817 - protein, 21 aa, Entamoeba invadens
GEGSFGIVYRGKYRNSDVAIK

SEQ ID NO: 2791818 - protein, 22 aa, Entamoeba invadens
GEGSFGIVYRGTFRGNDVAIKV

SEQ ID NO: 2791819 - protein, 25 aa, Entamoeba invadens
GEGSFGVVFKGEFRGNDVAIKKMKT

SEQ ID NO: 2791820 - protein, 23 aa, Entamoeba invadens
GEGSFGVVFLGFYKGNRVAIKKL

SEQ ID NO: 2791821 - protein, 25 aa, Entamoeba invadens
GEGSFGVVFRGRFHDQIVAIKRLKD

SEQ ID NO: 2791822 - protein, 21 aa, Entamoeba invadens
GEGSFGVVMIGTFRDNKVAIK

SEQ ID NO: 2791823 - protein, 19 aa, Entamoeba invadens
GEGVFRNTKFTSITLPSKT

SEQ ID NO: 2791824 - protein, 21 aa, Entamoeba invadens
GEGYCNGSLYEVLKVVLCRQN

SEQ ID NO: 2791825 - protein, 21 aa, Entamoeba invadens
GEGYCNGSLYKVLKVVLCRQN

SEQ ID NO: 2791826 - protein, 17 aa, Entamoeba invadens
GEIEFKHTFFRYPTRPE

SEQ ID NO: 2791827 - protein, 17 aa, Entamoeba invadens
GEIFNARIKEYFKGKKR

SEQ ID NO: 2791828 - protein, 17 aa, Entamoeba invadens
GEIPMEIIWYVIYYTLI

SEQ ID NO: 2791829 - protein, 20 aa, Entamoeba invadens
GEIRLLFNTEFCKTLNTSKL

SEQ ID NO: 2791830 - protein, 26 aa, Entamoeba invadens
GEIWSATCVDGVFDYEHCEFVGCKDG

SEQ ID NO: 2791831 - protein, 28 aa, Entamoeba invadens
GEIYPKSEFKFAWSIADYVTSGKRKERP

SEQ ID NO: 2791832 - protein, 23 aa, Entamoeba invadens
GEKCAICKDGFVVKNADCIKCVD

SEQ ID NO: 2791833 - protein, 25 aa, Entamoeba invadens
GEKCAICKDGFVVKNADCIKCVDKC

SEQ ID NO: 2791834 - protein, 19 aa, Entamoeba invadens
GEKCFNWCSYLSSITIPLG

SEQ ID NO: 2791835 - protein, 17 aa, Entamoeba invadens
GEKCVTCVEGYNIDAGG

SEQ ID NO: 2791836 - protein, 23 aa, Entamoeba invadens
GEKGRRVIGFGIFTLIIVFVFTI

SEQ ID NO: 2791837 - protein, 17 aa, Entamoeba invadens
GEKIGICGRTGSGKSSL

SEQ ID NO: 2791838 - protein, 25 aa, Entamoeba invadens
GEKKARYPFIKMFSLSLCAGLLLGI

SEQ ID NO: 2791839 - protein, 23 aa, Entamoeba invadens
GEKNCKYFVGFMLSMSISMFIVT

SEQ ID NO: 2791840 - protein, 23 aa, Entamoeba invadens
GEKNFPEDCIFIGLCAIYNISGF

SEQ ID NO: 2791841 - protein, 25 aa, Entamoeba invadens
GEKQCVFKEDFAVYFMKKTVLRSTI

SEQ ID NO: 2791842 - protein, 25 aa, Entamoeba invadens
GELAEKCKLFLPSGVDCAACNEGYI

SEQ ID NO: 2791843 - protein, 26 aa, Entamoeba invadens
GELAEKCKLFLPSGVDCAACNEGYIL

SEQ ID NO: 2791844 - protein, 18 aa, Entamoeba invadens
GELCFNIYIEDVVNEEPI

SEQ ID NO: 2791845 - protein, 25 aa, Entamoeba invadens
GELCYLCKWAYVLIENKCHNYSIPC

SEQ ID NO: 2791846 - protein, 22 aa, Entamoeba invadens
GELKCPQCQTPVFVGKDDIPTQ

SEQ ID NO: 2791847 - protein, 21 aa, Entamoeba invadens
GELLCELVILFCFIAFTVLLF

SEQ ID NO: 2791848 - protein, 17 aa, Entamoeba invadens
GELLIRGPSLFKEYFNR

SEQ ID NO: 2791849 - protein, 21 aa, Entamoeba invadens
GELLRQYFVSLGMNKKNFVLN

SEQ ID NO: 2791850 - protein, 22 aa, Entamoeba invadens
GELTCSLCPLFSSLIVDQLGNR

SEQ ID NO: 2791851 - protein, 18 aa, Entamoeba invadens
GEMEGSCNKSKDEIIASV

SEQ ID NO: 2791852 - protein, 22 aa, Entamoeba invadens
GEMKDLMIADTLKYVVGVCDAN

SEQ ID NO: 2791853 - protein, 26 aa, Entamoeba invadens
GENGYAVFHLLRWLPGSEENVERIKT

SEQ ID NO: 2791854 - protein, 24 aa, Entamoeba invadens
GENLYRISSKLSITQNTNDQCVLP

SEQ ID NO: 2791855 - protein, 24 aa, Entamoeba invadens
GENNLRYFVQFLMLVPLNCLFGVL

SEQ ID NO: 2791856 - protein, 22 aa, Entamoeba invadens
GEPPFAKGCELLCGTCRDGFVC

SEQ ID NO: 2791857 - protein, 28 aa, Entamoeba invadens
GEPSLLEKILCCKFCCKSKESGQEEDSE

SEQ ID NO: 2791858 - protein, 28 aa, Entamoeba invadens
GEQSKCRGILGGICLKTTGYFDYKNGEQ

SEQ ID NO: 2791859 - protein, 20 aa, Entamoeba invadens
GEQYPLEWIDQIERHANWNC

SEQ ID NO: 2791860 - protein, 21 aa, Entamoeba invadens
GEREMCWAFGITGFLEAAYNS

SEQ ID NO: 2791861 - protein, 17 aa, Entamoeba invadens
GERSRYGLNTDVGCVCR

SEQ ID NO: 2791862 - protein, 20 aa, Entamoeba invadens
GERTSAVAAMEKMKEEVSAS

SEQ ID NO: 2791863 - protein, 24 aa, Entamoeba invadens
GERYTEFMYYLFISTNEIADFEFS

SEQ ID NO: 2791864 - protein, 17 aa, Entamoeba invadens
GESFLFSLVRNGTLNPK

SEQ ID NO: 2791865 - protein, 19 aa, Entamoeba invadens
GESKSRWVYLRVEETDESD

SEQ ID NO: 2791866 - protein, 18 aa, Entamoeba invadens
GETAFPKKAEKVYTANVL

SEQ ID NO: 2791867 - protein, 25 aa, Entamoeba invadens
GETDWKFRKCIKEFQGLPIAELETS

SEQ ID NO: 2791868 - protein, 20 aa, Entamoeba invadens
GETFNVFFLTNQVKGSQVIL

SEQ ID NO: 2791869 - protein, 18 aa, Entamoeba invadens
GETSSLLLLFKNTSIIGL

SEQ ID NO: 2791870 - protein, 19 aa, Entamoeba invadens
GEVCVPNFIDLMLTLFSVD

SEQ ID NO: 2791871 - protein, 23 aa, Entamoeba invadens
GEVFSVCYFYMYNKYGLKYDNFD

SEQ ID NO: 2791872 - protein, 23 aa, Entamoeba invadens
GEVGCGKSAFFRSLLGNLHKTNG

SEQ ID NO: 2791873 - protein, 27 aa, Entamoeba invadens
GEVMAPCYSKLFFPYNALVIIVLIMGA

SEQ ID NO: 2791874 - protein, 24 aa, Entamoeba invadens
GEVNIKLRLKFLLDGAKGIQYLHE

SEQ ID NO: 2791875 - protein, 31 aa, Entamoeba invadens
GEVNPGFLYLVTFPWLFGIMFGDVGHGIIVT

SEQ ID NO: 2791876 - protein, 26 aa, Entamoeba invadens
GEVYPKNIFKFAWSIADFVTSGKRRE

SEQ ID NO: 2791877 - protein, 17 aa, Entamoeba invadens
GEYINWGYDYVAVKNSS

SEQ ID NO: 2791878 - protein, 23 aa, Entamoeba invadens
GEYRMRWGEWATVFKTALNPLNC

SEQ ID NO: 2791879 - protein, 23 aa, Entamoeba invadens
GEYRRFALCRNIDKEDLINFKDC

SEQ ID NO: 2791880 - protein, 17 aa, Entamoeba invadens
GFACEFEIFITPNCTCN

SEQ ID NO: 2791881 - protein, 17 aa, Entamoeba invadens
GFACEFSLYLTPQCTCH

SEQ ID NO: 2791882 - protein, 19 aa, Entamoeba invadens
GFCAVLMALFGVSIVSIKR

SEQ ID NO: 2791883 - protein, 19 aa, Entamoeba invadens
GFCFSCVSGCILSENHCIP

SEQ ID NO: 2791884 - protein, 33 aa, Entamoeba invadens
GFCQSCKVSHCKKCRGGICFECDENYLLYDSTR

SEQ ID NO: 2791885 - protein, 23 aa, Entamoeba invadens
GFCSLCVAGCVLSGNYCYPCEAG

SEQ ID NO: 2791886 - protein, 17 aa, Entamoeba invadens
GFCSQCLLNYTVTSPIS

SEQ ID NO: 2791887 - protein, 18 aa, Entamoeba invadens
GFCSQCLLNYTVTSPISK

SEQ ID NO: 2791888 - protein, 17 aa, Entamoeba invadens
GFCSQCLVNYTVTSPIS

SEQ ID NO: 2791889 - protein, 18 aa, Entamoeba invadens
GFCTSCILNYVFDTTSSL

SEQ ID NO: 2791890 - protein, 20 aa, Entamoeba invadens
GFDSLFRFLGLNPLVFLAII

SEQ ID NO: 2791891 - protein, 20 aa, Entamoeba invadens
GFDSLFRFLGLNPLVFLAIR

SEQ ID NO: 2791892 - protein, 26 aa, Entamoeba invadens
GFDYFRSSAMALRLEKEDVLGFDGER

SEQ ID NO: 2791893 - protein, 23 aa, Entamoeba invadens
GFEHCVANMFFLPTAQMYGADIT

SEQ ID NO: 2791894 - protein, 28 aa, Entamoeba invadens
GFELPQELMKVMPMIPFNPAHISLLTSY

SEQ ID NO: 2791895 - protein, 28 aa, Entamoeba invadens
GFEPKLRKLREGLTLKPIAGVYCEKNAS

SEQ ID NO: 2791896 - protein, 19 aa, Entamoeba invadens
GFFGYPACIGNDVYKTLFV

SEQ ID NO: 2791897 - protein, 20 aa, Entamoeba invadens
GFFLQAVVLYTDIMGKKRMK

SEQ ID NO: 2791898 - protein, 20 aa, Entamoeba invadens
GFFMSLKFGLFATETTISLI

SEQ ID NO: 2791899 - protein, 23 aa, Entamoeba invadens
GFFPHFLWCWGCFTQTEKDMIDD

SEQ ID NO: 2791900 - protein, 19 aa, Entamoeba invadens
GFFSDEFRCSKLLKCLNGD

SEQ ID NO: 2791901 - protein, 28 aa, Entamoeba invadens
GFFSLYRYANWVDIFLFVFGTFGSFASG

SEQ ID NO: 2791902 - protein, 18 aa, Entamoeba invadens
GFGGDNCIKKCYHNFTWQ

SEQ ID NO: 2791903 - protein, 23 aa, Entamoeba invadens
GFGIVYKGTFRRNFVAIKKMKLT

SEQ ID NO: 2791904 - protein, 24 aa, Entamoeba invadens
GFGLCVLGTLLLFIFLFVGIWIVL

SEQ ID NO: 2791905 - protein, 17 aa, Entamoeba invadens
GFGNVWINAILVAVNLT

SEQ ID NO: 2791906 - protein, 18 aa, Entamoeba invadens
GFGNYRTHFNFSQISSCW

SEQ ID NO: 2791907 - protein, 18 aa, Entamoeba invadens
GFIAILLMINGIYMILSP

SEQ ID NO: 2791908 - protein, 24 aa, Entamoeba invadens
GFIFKEFNERLILDEIKENMCYIA

SEQ ID NO: 2791909 - protein, 18 aa, Entamoeba invadens
GFISRFSQNILEVDITMQ

SEQ ID NO: 2791910 - protein, 18 aa, Entamoeba invadens
GFLDSIFQFMHLENDDKY

SEQ ID NO: 2791911 - protein, 25 aa, Entamoeba invadens
GFLLSKIFWVIFGYILIGLAILTAL

SEQ ID NO: 2791912 - protein, 18 aa, Entamoeba invadens
GFLQEAGFHTDDNIADAM

SEQ ID NO: 2791913 - protein, 22 aa, Entamoeba invadens
GFLSNCGTLIFSESSAKQDISV

SEQ ID NO: 2791914 - protein, 24 aa, Entamoeba invadens
GFLYTRGFLDFLFDNRVIDFIEKK

SEQ ID NO: 2791915 - protein, 25 aa, Entamoeba invadens
GFNDFGGDVKFEFSSGGQNEFAGFD

SEQ ID NO: 2791916 - protein, 21 aa, Entamoeba invadens
GFNPVCAFFKHTSNIMSTSLA

SEQ ID NO: 2791917 - protein, 19 aa, Entamoeba invadens
GFQCIPCQKGTYSSLPGSD

SEQ ID NO: 2791918 - protein, 17 aa, Entamoeba invadens
GFQTVFQFVCISLNLTM

SEQ ID NO: 2791919 - protein, 18 aa, Entamoeba invadens
GFQYLISLMFHKQDKEKV

SEQ ID NO: 2791920 - protein, 21 aa, Entamoeba invadens
GFRASCYNAVRIESVKALVSC

SEQ ID NO: 2791921 - protein, 20 aa, Entamoeba invadens
GFRPLKWSVLIITYVLFMIW

SEQ ID NO: 2791922 - protein, 27 aa, Entamoeba invadens
GFSGMLYWCNFHVIFFVDRVIVEHSHT

SEQ ID NO: 2791923 - protein, 18 aa, Entamoeba invadens
GFSGVFMEKILKNKVENG

SEQ ID NO: 2791924 - protein, 29 aa, Entamoeba invadens
GFSKYGAYGERIFKNCGFVEFDLHGLVIL

SEQ ID NO: 2791925 - protein, 19 aa, Entamoeba invadens
GFSNKVFCHLINKNEFYSE

SEQ ID NO: 2791926 - protein, 17 aa, Entamoeba invadens
GFSSFSFFVISSSSLIA

SEQ ID NO: 2791927 - protein, 29 aa, Entamoeba invadens
GFSSGNLWKFIFLILNFLFLNIIYNKPNK

SEQ ID NO: 2791928 - protein, 18 aa, Entamoeba invadens
GFSTCISCPAGKYSSSTG

SEQ ID NO: 2791929 - protein, 19 aa, Entamoeba invadens
GFSTLKLLPFHEDLIVYIK

SEQ ID NO: 2791930 - protein, 20 aa, Entamoeba invadens
GFVFLLGMFASFGLKLNKHI

SEQ ID NO: 2791931 - protein, 31 aa, Entamoeba invadens
GFVIRPFTKGVCCGCGQSDLDAAYLWLKDKI

SEQ ID NO: 2791932 - protein, 19 aa, Entamoeba invadens
GFVKAVLLCVFVFGGISVM

SEQ ID NO: 2791933 - protein, 27 aa, Entamoeba invadens
GFVMPLCWIACGVMYLKSSVRTERLMG

SEQ ID NO: 2791934 - protein, 18 aa, Entamoeba invadens
GFWGNWKHFLFSPLPPPC

SEQ ID NO: 2791935 - protein, 20 aa, Entamoeba invadens
GFYLGTAILRCYKCSNNCLK

SEQ ID NO: 2791936 - protein, 23 aa, Entamoeba invadens
GGAIFPFFTLKFIDIIMVLMVLS

SEQ ID NO: 2791937 - protein, 22 aa, Entamoeba invadens
GGALPVKICFALYSLMTHYQTT

SEQ ID NO: 2791938 - protein, 36 aa, Entamoeba invadens
GGARLYFDYYLSAEPVRFKLITTFAGGDVSNTFTGW

SEQ ID NO: 2791939 - protein, 21 aa, Entamoeba invadens
GGAVFPFYTLQFMDVLMVMMT

SEQ ID NO: 2791940 - protein, 19 aa, Entamoeba invadens
GGCAICKDKYYKRETDCIS

SEQ ID NO: 2791941 - protein, 19 aa, Entamoeba invadens
GGCAICKDQYYKQEADCIS

SEQ ID NO: 2791942 - protein, 19 aa, Entamoeba invadens
GGCAICKENYYKQKADCIS

SEQ ID NO: 2791943 - protein, 18 aa, Entamoeba invadens
GGCESCPIGEYKFSETTC

SEQ ID NO: 2791944 - protein, 22 aa, Entamoeba invadens
GGCKKCSTANWVVTEPISIRCE

SEQ ID NO: 2791945 - protein, 24 aa, Entamoeba invadens
GGDGIKCVECPEGFYQEKQGMAYC

SEQ ID NO: 2791946 - protein, 26 aa, Entamoeba invadens
GGEKKVKPVRVYKHIKDSLTSSEDTS

SEQ ID NO: 2791947 - protein, 26 aa, Entamoeba invadens
GGFFFSRLGYYISFALVSYTYYYWCK

SEQ ID NO: 2791948 - protein, 18 aa, Entamoeba invadens
GGFFMACYPTITGSTSSS

SEQ ID NO: 2791949 - protein, 20 aa, Entamoeba invadens
GGFGCDHCVCVNGTKKYAKA

SEQ ID NO: 2791950 - protein, 28 aa, Entamoeba invadens
GGFGCYHCLCVNNTYAFAKPRLYCVSST

SEQ ID NO: 2791951 - protein, 18 aa, Entamoeba invadens
GGFGIVFKGKYRDRIVAI

SEQ ID NO: 2791952 - protein, 18 aa, Entamoeba invadens
GGFGIVFMGTYRNNVVAI

SEQ ID NO: 2791953 - protein, 18 aa, Entamoeba invadens
GGFGQKVSNGYVKNSSLL

SEQ ID NO: 2791954 - protein, 17 aa, Entamoeba invadens
GGFGVVYIGKYRNTIVA

SEQ ID NO: 2791955 - protein, 23 aa, Entamoeba invadens
GGFGVVYKGRFRGSLVAIKKMKE

SEQ ID NO: 2791956 - protein, 18 aa, Entamoeba invadens
GGFIPRLFGDYDDEWYSD

SEQ ID NO: 2791957 - protein, 24 aa, Entamoeba invadens
GGFKGTCKNSKCVYTSTGNAQEFC

SEQ ID NO: 2791958 - protein, 26 aa, Entamoeba invadens
GGFLFLRFITPILVMPKRFLSNVTEP

SEQ ID NO: 2791959 - protein, 22 aa, Entamoeba invadens
GGFMPHIFSTFAPRTILVDRHF

SEQ ID NO: 2791960 - protein, 18 aa, Entamoeba invadens
GGGALVFVALTIYYIVGQ

SEQ ID NO: 2791961 - protein, 23 aa, Entamoeba invadens
GGGASGESICYCNATTNNKCFCE

SEQ ID NO: 2791962 - protein, 22 aa, Entamoeba invadens
GGGCAICKDGYFKSGIDCNECD

SEQ ID NO: 2791963 - protein, 18 aa, Entamoeba invadens
GGGCAICNDGFYKQEKDC

SEQ ID NO: 2791964 - protein, 18 aa, Entamoeba invadens
GGGCAICNSGYYREGISC

SEQ ID NO: 2791965 - protein, 21 aa, Entamoeba invadens
GGGCAICRDGYYKVLKDCIVC

SEQ ID NO: 2791966 - protein, 21 aa, Entamoeba invadens
GGGGCAICNSGYYREGISCTP

SEQ ID NO: 2791967 - protein, 17 aa, Entamoeba invadens
GGGKCTIFSNSTLSITV

SEQ ID NO: 2791968 - protein, 20 aa, Entamoeba invadens
GGGKQPIFCLKIISKDHRIL

SEQ ID NO: 2791969 - protein, 26 aa, Entamoeba invadens
GGGTFGIVYRAEWRKVDVAVKVMKSD

SEQ ID NO: 2791970 - protein, 19 aa, Entamoeba invadens
GGGYYRVYISVVMVLVPTI

SEQ ID NO: 2791971 - protein, 26 aa, Entamoeba invadens
GGIIPAMMFLLKFPEYQPTLIQIFVL

SEQ ID NO: 2791972 - protein, 19 aa, Entamoeba invadens
GGIIPILFFLTSQVLFITP

SEQ ID NO: 2791973 - protein, 19 aa, Entamoeba invadens
GGISCSKTNWALIIPLVVV

SEQ ID NO: 2791974 - protein, 20 aa, Entamoeba invadens
GGISCSKTNWALIIPLVVVG

SEQ ID NO: 2791975 - protein, 26 aa, Entamoeba invadens
GGISVMMAFSVWKLSILETIQMMYFA

SEQ ID NO: 2791976 - protein, 21 aa, Entamoeba invadens
GGKAAEFELLLTPKCSCHFSD

SEQ ID NO: 2791977 - protein, 18 aa, Entamoeba invadens
GGKCQMCSANHLMYSDNQ

SEQ ID NO: 2791978 - protein, 25 aa, Entamoeba invadens
GGKGVEGWLRPLLEIPAFQTKLKMW

SEQ ID NO: 2791979 - protein, 20 aa, Entamoeba invadens
GGKLYRICHEGNLLNENTQC

SEQ ID NO: 2791980 - protein, 18 aa, Entamoeba invadens
GGKYVKHKYYLGNSQYAE

SEQ ID NO: 2791981 - protein, 25 aa, Entamoeba invadens
GGLGCIECECQPDWFGHGSADCSSL

SEQ ID NO: 2791982 - protein, 18 aa, Entamoeba invadens
GGLGCQHCMCTEGYVPYE

SEQ ID NO: 2791983 - protein, 18 aa, Entamoeba invadens
GGLITCMLSTRRNDITAF

SEQ ID NO: 2791984 - protein, 33 aa, Entamoeba invadens
GGLITLCFVSLCFFPIDVIFSLGFSAALSIFFT

SEQ ID NO: 2791985 - protein, 17 aa, Entamoeba invadens
GGLKFGKQTSRFRASNF

SEQ ID NO: 2791986 - protein, 36 aa, Entamoeba invadens
GGLMRISFLETFRWNFKFTETTPREFIMNVVDERTD

SEQ ID NO: 2791987 - protein, 19 aa, Entamoeba invadens
GGLTCLMCDYKYRLVDGAC

SEQ ID NO: 2791988 - protein, 17 aa, Entamoeba invadens
GGLYAVVFCPKKQSFSF

SEQ ID NO: 2791989 - protein, 17 aa, Entamoeba invadens
GGMGCDHCFCAEGYKMY

SEQ ID NO: 2791990 - protein, 25 aa, Entamoeba invadens
GGMLKISYFETFNWNYNYNETIPRE

SEQ ID NO: 2791991 - protein, 27 aa, Entamoeba invadens
GGNCFDLGESCFMGFISLVSIQLPDNI

SEQ ID NO: 2791992 - protein, 23 aa, Entamoeba invadens
GGNCTSCKTGSVLFEGKCVLCSP

SEQ ID NO: 2791993 - protein, 23 aa, Entamoeba invadens
GGNGDLIIEFGVVHDEEQIPKCD

SEQ ID NO: 2791994 - protein, 21 aa, Entamoeba invadens
GGNPFEFDMCYNQNCEVLDQF

SEQ ID NO: 2791995 - protein, 18 aa, Entamoeba invadens
GGQICVPSGTPLLKFWAK

SEQ ID NO: 2791996 - protein, 23 aa, Entamoeba invadens
GGRACEFDLYIKPLCTCKITDQM

SEQ ID NO: 2791997 - protein, 21 aa, Entamoeba invadens
GGRCVSCTTGMYFNNQTKTCV

SEQ ID NO: 2791998 - protein, 26 aa, Entamoeba invadens
GGRDVWVCLTCLYVGCSTNESNHIEN

SEQ ID NO: 2791999 - protein, 18 aa, Entamoeba invadens
GGRLLRYGKGQKVYCHLN

SEQ ID NO: 2792000 - protein, 21 aa, Entamoeba invadens
GGSCRVCPVGTYSHGGNDITL

SEQ ID NO: 2792001 - protein, 18 aa, Entamoeba invadens
GGSCVSCTTGMYYNNRIK

SEQ ID NO: 2792002 - protein, 19 aa, Entamoeba invadens
GGSGCAICNSMYYREGISC

SEQ ID NO: 2792003 - protein, 17 aa, Entamoeba invadens
GGSIIVKSGAILRLGKS

SEQ ID NO: 2792004 - protein, 23 aa, Entamoeba invadens
GGSSCALCDFKYFRNAKGMCEKC

SEQ ID NO: 2792005 - protein, 23 aa, Entamoeba invadens
GGSTEGWNPFFLTFDNLGLTPRI

SEQ ID NO: 2792006 - protein, 23 aa, Entamoeba invadens
GGSVSCSYCPSGYYSAYSGSIRC

SEQ ID NO: 2792007 - protein, 22 aa, Entamoeba invadens
GGTASCSKCPTNLFSTNKSSSC

SEQ ID NO: 2792008 - protein, 20 aa, Entamoeba invadens
GGTCHPCYYVTNCAQGCLAS

SEQ ID NO: 2792009 - protein, 25 aa, Entamoeba invadens
GGTFGIVYKAEWRKVDVAVKVMKSD

SEQ ID NO: 2792010 - protein, 19 aa, Entamoeba invadens
GGTFIKTSILNGWQSIVSN

SEQ ID NO: 2792011 - protein, 21 aa, Entamoeba invadens
GGTLLCFSCAENYYLNSAGLC

SEQ ID NO: 2792012 - protein, 23 aa, Entamoeba invadens
GGTSLKILIPEILERIDYFSPNN

SEQ ID NO: 2792013 - protein, 19 aa, Entamoeba invadens
GGVFKNCTNDSYYQWDVKP

SEQ ID NO: 2792014 - protein, 22 aa, Entamoeba invadens
GGVGCAICRDGYYKSQSSCIEC

SEQ ID NO: 2792015 - protein, 24 aa, Entamoeba invadens
GGVGCTSCLCDAGYVPYENPRAYC

SEQ ID NO: 2792016 - protein, 18 aa, Entamoeba invadens
GGVGYKVFIYILALIIPL

SEQ ID NO: 2792017 - protein, 19 aa, Entamoeba invadens
GGVLIEKIASFTLVAKMFE

SEQ ID NO: 2792018 - protein, 18 aa, Entamoeba invadens
GGVSCSKTNWALIIPLVV

SEQ ID NO: 2792019 - protein, 25 aa, Entamoeba invadens
GGVSCSKTNWALIVPLVIVAIIIII

SEQ ID NO: 2792020 - protein, 24 aa, Entamoeba invadens
GGVSRAAYYKIFVPRKVSVQMNTC

SEQ ID NO: 2792021 - protein, 17 aa, Entamoeba invadens
GGVSTLIGIAKRNLIKE

SEQ ID NO: 2792022 - protein, 21 aa, Entamoeba invadens
GGVVKGVSGLVTRPIVGLFDF

SEQ ID NO: 2792023 - protein, 19 aa, Entamoeba invadens
GGVVSVWYTIIPIIGAVVF

SEQ ID NO: 2792024 - protein, 20 aa, Entamoeba invadens
GGVYKVCLSNKFSSFGSART

SEQ ID NO: 2792025 - protein, 17 aa, Entamoeba invadens
GGVYVWTNDNVKNWNPF

SEQ ID NO: 2792026 - protein, 18 aa, Entamoeba invadens
GHAAYAFHGQLFVSLFLI

SEQ ID NO: 2792027 - protein, 18 aa, Entamoeba invadens
GHCFYGCNTLNKGTIPSG

SEQ ID NO: 2792028 - protein, 29 aa, Entamoeba invadens
GHCKHRHLYKLLGVQSILIFIVFKIIEIF

SEQ ID NO: 2792029 - protein, 18 aa, Entamoeba invadens
GHCTGCATNYVLSATNSL

SEQ ID NO: 2792030 - protein, 23 aa, Entamoeba invadens
GHCVKCNSSFYLRENKCLPIIEK

SEQ ID NO: 2792031 - protein, 17 aa, Entamoeba invadens
GHGCLKCADGYENVYDG

SEQ ID NO: 2792032 - protein, 19 aa, Entamoeba invadens
GHGFFIFLFGLSFIIFAKK

SEQ ID NO: 2792033 - protein, 22 aa, Entamoeba invadens
GHGGYVCGDDGLWSKTCQMSYC

SEQ ID NO: 2792034 - protein, 25 aa, Entamoeba invadens
GHGSFGIVYKGDFIVHFYGAVLIPN

SEQ ID NO: 2792035 - protein, 17 aa, Entamoeba invadens
GHLVKYCPEGIDHITEK

SEQ ID NO: 2792036 - protein, 34 aa, Entamoeba invadens
GHMFCWECVSPLLPCPCPFCKSPLTLHSLTYIYD

SEQ ID NO: 2792037 - protein, 18 aa, Entamoeba invadens
GHSAASFNGFGYFSLYVA

SEQ ID NO: 2792038 - protein, 19 aa, Entamoeba invadens
GHSKIKLSNSFLVVDGILV

SEQ ID NO: 2792039 - protein, 25 aa, Entamoeba invadens
GHSTLCLSCPIGTFVSNNKCISNVE

SEQ ID NO: 2792040 - protein, 22 aa, Entamoeba invadens
GHSTRIYCHLVYTSNNTYRYLE

SEQ ID NO: 2792041 - protein, 26 aa, Entamoeba invadens
GHTHIHSLCFLRIIYVDCLFSEALMY

SEQ ID NO: 2792042 - protein, 25 aa, Entamoeba invadens
GIACIPLCIGYSIYSLYYNEFKSWY

SEQ ID NO: 2792043 - protein, 27 aa, Entamoeba invadens
GIAFYYEWKTALCILAVTPVLMVIVFI

SEQ ID NO: 2792044 - protein, 18 aa, Entamoeba invadens
GIAGSGYSAYWLIPLENP

SEQ ID NO: 2792045 - protein, 30 aa, Entamoeba invadens
GICHVECFRCTVCWRIMLGDLSHSEIVKGG

SEQ ID NO: 2792046 - protein, 19 aa, Entamoeba invadens
GICKQCPKATYSPNGTECI

SEQ ID NO: 2792047 - protein, 20 aa, Entamoeba invadens
GICLKCKEGYILDESKKCES

SEQ ID NO: 2792048 - protein, 18 aa, Entamoeba invadens
GICQLKCADGKELYNNNC

SEQ ID NO: 2792049 - protein, 17 aa, Entamoeba invadens
GICSPRCPQDKQRAGDV

SEQ ID NO: 2792050 - protein, 22 aa, Entamoeba invadens
GICTSCALGKVFTDPKTTSCVD

SEQ ID NO: 2792051 - protein, 19 aa, Entamoeba invadens
GICTSCVLNYVFGNPKSKK

SEQ ID NO: 2792052 - protein, 18 aa, Entamoeba invadens
GICVCPSFKYQNSQNTCQ

SEQ ID NO: 2792053 - protein, 21 aa, Entamoeba invadens
GICVSCGDGFYLNSSDDCQPC

SEQ ID NO: 2792054 - protein, 25 aa, Entamoeba invadens
GIDKNFCKPCTFTAKQNELTDNDKF

SEQ ID NO: 2792055 - protein, 18 aa, Entamoeba invadens
GIEIPKMDDFSCSVLFPF

SEQ ID NO: 2792056 - protein, 29 aa, Entamoeba invadens
GIFWWFCSICWIMIIIKMIRREFIQFKLY

SEQ ID NO: 2792057 - protein, 24 aa, Entamoeba invadens
GIGCNAIVCLGVFFSNSAKDVIGK

SEQ ID NO: 2792058 - protein, 18 aa, Entamoeba invadens
GIGTPVYMAFEILNKQHY

SEQ ID NO: 2792059 - protein, 23 aa, Entamoeba invadens
GIIAFTCWFCDKITNLKLRTQDD

SEQ ID NO: 2792060 - protein, 22 aa, Entamoeba invadens
GIICTICVFIQWSPQIYMTFKR

SEQ ID NO: 2792061 - protein, 18 aa, Entamoeba invadens
GIIERIPLINSFSKDGEY

SEQ ID NO: 2792062 - protein, 18 aa, Entamoeba invadens
GIIFCPFLVASFVISLRC

SEQ ID NO: 2792063 - protein, 21 aa, Entamoeba invadens
GIIFEHFEEILAINKQFARIL

SEQ ID NO: 2792064 - protein, 17 aa, Entamoeba invadens
GIIMAVAFSGLFLSNVL

SEQ ID NO: 2792065 - protein, 25 aa, Entamoeba invadens
GIIQCTLCFAPYILNDNKLSCIDAN

SEQ ID NO: 2792066 - protein, 17 aa, Entamoeba invadens
GIISHYHYSFVIKTEVA

SEQ ID NO: 2792067 - protein, 21 aa, Entamoeba invadens
GIITIPVCFSTNYAKDILFTV

SEQ ID NO: 2792068 - protein, 17 aa, Entamoeba invadens
GIIYKCGVGDYLDISNE

SEQ ID NO: 2792069 - protein, 20 aa, Entamoeba invadens
GIKAAHLIVIGAFVPVDQTL

SEQ ID NO: 2792070 - protein, 24 aa, Entamoeba invadens
GIKECILCKSFSILQNKSCLPFDV

SEQ ID NO: 2792071 - protein, 23 aa, Entamoeba invadens
GIKERTGGAYLFFDKYLVTQRER

SEQ ID NO: 2792072 - protein, 33 aa, Entamoeba invadens
GIKGCGRRFAFLVCKRAGIDVNRRAGLLKADEV

SEQ ID NO: 2792073 - protein, 19 aa, Entamoeba invadens
GIKLRKLYMSSLIHQDAAF

SEQ ID NO: 2792074 - protein, 26 aa, Entamoeba invadens
GILLTRIKALLALKAPRGKIWEENFV

SEQ ID NO: 2792075 - protein, 18 aa, Entamoeba invadens
GILPFEPFGFFTRVTHRN

SEQ ID NO: 2792076 - protein, 22 aa, Entamoeba invadens
GILSSCGRRAFYVESLLNGYMC

SEQ ID NO: 2792077 - protein, 18 aa, Entamoeba invadens
GILYCDYLMISLYFQAFF

SEQ ID NO: 2792078 - protein, 19 aa, Entamoeba invadens
GIMFPIVILLVGNVVDTMN

SEQ ID NO: 2792079 - protein, 25 aa, Entamoeba invadens
GIMYFRDFHQSFILFLDFLISHVEH

SEQ ID NO: 2792080 - protein, 26 aa, Entamoeba invadens
GIPDFRSSNGLWKRYDPAVYGTLDTF

SEQ ID NO: 2792081 - protein, 20 aa, Entamoeba invadens
GIPGDFLDRLIIVNTQEYTL

SEQ ID NO: 2792082 - protein, 25 aa, Entamoeba invadens
GIQSFNFILEWEFNVSFKGSHAQED

SEQ ID NO: 2792083 - protein, 20 aa, Entamoeba invadens
GIRELLRLLSRQFFDETKYS

SEQ ID NO: 2792084 - protein, 21 aa, Entamoeba invadens
GIRLKICLNAAKGIFYLHENG

SEQ ID NO: 2792085 - protein, 17 aa, Entamoeba invadens
GIRSSMITMMICASCCF

SEQ ID NO: 2792086 - protein, 18 aa, Entamoeba invadens
GISCTKCQDGLNLFNNSG

SEQ ID NO: 2792087 - protein, 18 aa, Entamoeba invadens
GISDGISFVRFNQTKQEF

SEQ ID NO: 2792088 - protein, 23 aa, Entamoeba invadens
GISELRLISFDYNKLIIKNPNLT

SEQ ID NO: 2792089 - protein, 25 aa, Entamoeba invadens
GISTIWCYDTFYIANGICNDCTLKH

SEQ ID NO: 2792090 - protein, 19 aa, Entamoeba invadens
GITAWEVFYQEEPYKTFKS

SEQ ID NO: 2792091 - protein, 28 aa, Entamoeba invadens
GITGNLEWKGCYKTVCKYDSTNGTYYTE

SEQ ID NO: 2792092 - protein, 23 aa, Entamoeba invadens
GITIPSIHLYPSLVTLNDDLSSF

SEQ ID NO: 2792093 - protein, 23 aa, Entamoeba invadens
GITSMSVCFPFVTLKSVPFSIQF

SEQ ID NO: 2792094 - protein, 21 aa, Entamoeba invadens
GIVCGCFAVLFVFTVSAVFHT

SEQ ID NO: 2792095 - protein, 26 aa, Entamoeba invadens
GIVEKVCQCTNCRCKTVQQYDPRQKV

SEQ ID NO: 2792096 - protein, 24 aa, Entamoeba invadens
GIVLSFYIMLNWFMTLLEYLSIMS

SEQ ID NO: 2792097 - protein, 22 aa, Entamoeba invadens
GIVNEGLFGFLGGVVKGVSGLV

SEQ ID NO: 2792098 - protein, 26 aa, Entamoeba invadens
GIVNLMPLYKMEFFKLLEQQRGMAYQ

SEQ ID NO: 2792099 - protein, 20 aa, Entamoeba invadens
GIVPESRFAKEMMSSNRDLK

SEQ ID NO: 2792100 - protein, 17 aa, Entamoeba invadens
GIVPINLFTQMTNQFCF

SEQ ID NO: 2792101 - protein, 22 aa, Entamoeba invadens
GIVSCALTFLMGATLQIYLSLF

SEQ ID NO: 2792102 - protein, 26 aa, Entamoeba invadens
GIVVKCMKRGYWLLMENVNFCNPTVL

SEQ ID NO: 2792103 - protein, 17 aa, Entamoeba invadens
GIVWGISDNGVLNSAQD

SEQ ID NO: 2792104 - protein, 19 aa, Entamoeba invadens
GIYHGKFIFPYDYPKNPPE

SEQ ID NO: 2792105 - protein, 27 aa, Entamoeba invadens
GIYRYEYRGVSGYSIAISFINMFLAIA

SEQ ID NO: 2792106 - protein, 18 aa, Entamoeba invadens
GKAIEFEVLLSPLCSCKI

SEQ ID NO: 2792107 - protein, 17 aa, Entamoeba invadens
GKAPENVKLRFVGKDGT

SEQ ID NO: 2792108 - protein, 19 aa, Entamoeba invadens
GKCAKCGNDCIACIDDSIC

SEQ ID NO: 2792109 - protein, 18 aa, Entamoeba invadens
GKCAPQIDNCIKYVNVMC

SEQ ID NO: 2792110 - protein, 22 aa, Entamoeba invadens
GKCEKCGIVGCSLCNSTGIDCL

SEQ ID NO: 2792111 - protein, 19 aa, Entamoeba invadens
GKCEKCLYNKVTEKNTCGP

SEQ ID NO: 2792112 - protein, 19 aa, Entamoeba invadens
GKCEMCPSGSFSLNGVCTL

SEQ ID NO: 2792113 - protein, 17 aa, Entamoeba invadens
GKCFMPIDNCLFYQNSI

SEQ ID NO: 2792114 - protein, 20 aa, Entamoeba invadens
GKCFNCKPGYGYNYGQCTLC

SEQ ID NO: 2792115 - protein, 19 aa, Entamoeba invadens
GKCHMCGNAYYYDVATDSC

SEQ ID NO: 2792116 - protein, 19 aa, Entamoeba invadens
GKCIACTSSAILSNGVCSL

SEQ ID NO: 2792117 - protein, 19 aa, Entamoeba invadens
GKCIFAIRDCLKYLSVDVC

SEQ ID NO: 2792118 - protein, 20 aa, Entamoeba invadens
GKCIMCSEGYFLSDGGCKQC

SEQ ID NO: 2792119 - protein, 25 aa, Entamoeba invadens
GKCKECVSGYVLYGGSCSIKEDENC

SEQ ID NO: 2792120 - protein, 18 aa, Entamoeba invadens
GKCKKCSKNYVIQTNGFC

SEQ ID NO: 2792121 - protein, 18 aa, Entamoeba invadens
GKCLLPIEHCILYKNEKC

SEQ ID NO: 2792122 - protein, 20 aa, Entamoeba invadens
GKCLTCQFCHNCGTQTGCSQ

SEQ ID NO: 2792123 - protein, 24 aa, Entamoeba invadens
GKCLTCREGYELTTLGTCTPCNDL

SEQ ID NO: 2792124 - protein, 17 aa, Entamoeba invadens
GKCLTCYNGYSMENEEC

SEQ ID NO: 2792125 - protein, 17 aa, Entamoeba invadens
GKCLYCLDSFVTDVTTK

SEQ ID NO: 2792126 - protein, 23 aa, Entamoeba invadens
GKCNAAELCKYVIQLSEEEVGKG

SEQ ID NO: 2792127 - protein, 31 aa, Entamoeba invadens
GKCPECNDGYFLKELECFPCDESCYTCVNTN

SEQ ID NO: 2792128 - protein, 19 aa, Entamoeba invadens
GKCQSCPSGKYYNPNSKSC

SEQ ID NO: 2792129 - protein, 19 aa, Entamoeba invadens
GKCSICLAGTYTNLKQSYC

SEQ ID NO: 2792130 - protein, 27 aa, Entamoeba invadens
GKCSICSLFECEICEGGICKKCSSDFL

SEQ ID NO: 2792131 - protein, 23 aa, Entamoeba invadens
GKCSKCISGYVIVNGYCQTCPSG

SEQ ID NO: 2792132 - protein, 19 aa, Entamoeba invadens
GKCSVCPSGTYSLNNKCEK

SEQ ID NO: 2792133 - protein, 17 aa, Entamoeba invadens
GKCSVFGDENCERAILD

SEQ ID NO: 2792134 - protein, 18 aa, Entamoeba invadens
GKCTICPVGTYYLDSSCK

SEQ ID NO: 2792135 - protein, 18 aa, Entamoeba invadens
GKCTIFSNSTLSITVASK

SEQ ID NO: 2792136 - protein, 19 aa, Entamoeba invadens
GKCTLCKQNYLLNGDNVCE

SEQ ID NO: 2792137 - protein, 18 aa, Entamoeba invadens
GKCTSCKEGHILTNGLCF

SEQ ID NO: 2792138 - protein, 19 aa, Entamoeba invadens
GKCTSCKNDFILNESSECV

SEQ ID NO: 2792139 - protein, 17 aa, Entamoeba invadens
GKCVACATITNCDTCSS

SEQ ID NO: 2792140 - protein, 21 aa, Entamoeba invadens
GKCVACSTISNCNRCSSETKK

SEQ ID NO: 2792141 - protein, 21 aa, Entamoeba invadens
GKCVACVDGAVLLNGVCSLCI

SEQ ID NO: 2792142 - protein, 21 aa, Entamoeba invadens
GKCVDLSLILKCNEITKSKCM

SEQ ID NO: 2792143 - protein, 23 aa, Entamoeba invadens
GKCVECKSGLLLNLSHSCMSTLD

SEQ ID NO: 2792144 - protein, 18 aa, Entamoeba invadens
GKCVFYKTIQNCIEEKNS

SEQ ID NO: 2792145 - protein, 18 aa, Entamoeba invadens
GKCVKCINNYFLENNTCI

SEQ ID NO: 2792146 - protein, 20 aa, Entamoeba invadens
GKCVSCGFLYGTSCKVCSST

SEQ ID NO: 2792147 - protein, 22 aa, Entamoeba invadens
GKCVSCVVGYAFVVGKCAICPK

SEQ ID NO: 2792148 - protein, 24 aa, Entamoeba invadens
GKCVTCSVPNCLNCEGGKCKKCSK

SEQ ID NO: 2792149 - protein, 21 aa, Entamoeba invadens
GKCYLPPTFSVFFEFFGLFLT

SEQ ID NO: 2792150 - protein, 22 aa, Entamoeba invadens
GKDAFKDCIMLNALNLYSHLTT

SEQ ID NO: 2792151 - protein, 25 aa, Entamoeba invadens
GKDISLLMSFTFQGYFCLPMLDYVF

SEQ ID NO: 2792152 - protein, 22 aa, Entamoeba invadens
GKDSVCLFNYFTYTDLNLTNRE

SEQ ID NO: 2792153 - protein, 21 aa, Entamoeba invadens
GKDVINCFKNAVYKINIGQYF

SEQ ID NO: 2792154 - protein, 26 aa, Entamoeba invadens
GKEARNSGLFAVSWSFGKSIGYVVGG

SEQ ID NO: 2792155 - protein, 23 aa, Entamoeba invadens
GKECKNCIDHCLVCSAADECTMC

SEQ ID NO: 2792156 - protein, 26 aa, Entamoeba invadens
GKEFWKRLGKDWKKFGAVEIKVSVKL

SEQ ID NO: 2792157 - protein, 23 aa, Entamoeba invadens
GKEGGELKALVSTLCKEGIEVEK

SEQ ID NO: 2792158 - protein, 20 aa, Entamoeba invadens
GKEIFEFFRNMSIQLTKAQM

SEQ ID NO: 2792159 - protein, 29 aa, Entamoeba invadens
GKEKTGVIDVRYFICAGILNQNMLKDIMG

SEQ ID NO: 2792160 - protein, 22 aa, Entamoeba invadens
GKEKVSLCYPEYYTFLMDVVHC

SEQ ID NO: 2792161 - protein, 20 aa, Entamoeba invadens
GKELLMKIINGVPMENEKMS

SEQ ID NO: 2792162 - protein, 26 aa, Entamoeba invadens
GKEMPFERPLFFNFLMFFGMFLALIV

SEQ ID NO: 2792163 - protein, 19 aa, Entamoeba invadens
GKFCQKCVIGSFSSEEGSL

SEQ ID NO: 2792164 - protein, 25 aa, Entamoeba invadens
GKFDCLPLPPTVRVDWVGTDDFGGT

SEQ ID NO: 2792165 - protein, 18 aa, Entamoeba invadens
GKFEEGWHINSTDGNVGI

SEQ ID NO: 2792166 - protein, 17 aa, Entamoeba invadens
GKFGMAPNCEDCGVENC

SEQ ID NO: 2792167 - protein, 27 aa, Entamoeba invadens
GKFGYSFCAPTLMVAYITFGVNFKGNY

SEQ ID NO: 2792168 - protein, 22 aa, Entamoeba invadens
GKFIEFMKSIGIDVNGFEPNYC

SEQ ID NO: 2792169 - protein, 17 aa, Entamoeba invadens
GKFISFVTFNYVGTYYR

SEQ ID NO: 2792170 - protein, 19 aa, Entamoeba invadens
GKFNQFFGFLNKEVCYPYY

SEQ ID NO: 2792171 - protein, 29 aa, Entamoeba invadens
GKFVGKWRHSQFITWIVIFSIIHISLAIS

SEQ ID NO: 2792172 - protein, 22 aa, Entamoeba invadens
GKFWCAHCPIKCENCIRESGVC

SEQ ID NO: 2792173 - protein, 20 aa, Entamoeba invadens
GKGFYKENSVCISCNEKFPN

SEQ ID NO: 2792174 - protein, 20 aa, Entamoeba invadens
GKGIEYKKGVGMQNGVDYDK

SEQ ID NO: 2792175 - protein, 21 aa, Entamoeba invadens
GKGSFGLVYRGYWRGLEVAVK

SEQ ID NO: 2792176 - protein, 18 aa, Entamoeba invadens
GKIAAQCGHAAVGCVLKA

SEQ ID NO: 2792177 - protein, 20 aa, Entamoeba invadens
GKICESCPLGYWSNTSSASC

SEQ ID NO: 2792178 - protein, 21 aa, Entamoeba invadens
GKIEKNMPCIFERTKQSDIRT

SEQ ID NO: 2792179 - protein, 17 aa, Entamoeba invadens
GKIKVGWFNFDIDTNVR

SEQ ID NO: 2792180 - protein, 19 aa, Entamoeba invadens
GKIMRDGMCEDVTLDVTSF

SEQ ID NO: 2792181 - protein, 17 aa, Entamoeba invadens
GKISTIINGCYQCRDNY

SEQ ID NO: 2792182 - protein, 29 aa, Entamoeba invadens
GKITVKDGVEFTLKCNYDTFIEASNVGAF

SEQ ID NO: 2792183 - protein, 22 aa, Entamoeba invadens
GKKELNGLFSFIAEHCDNPFIF

SEQ ID NO: 2792184 - protein, 23 aa, Entamoeba invadens
GKKEVSSLVVFKVDGDVLVGEKG

SEQ ID NO: 2792185 - protein, 24 aa, Entamoeba invadens
GKKNLKFFVLFLFYTALALLCNTA

SEQ ID NO: 2792186 - protein, 20 aa, Entamoeba invadens
GKKRYFSFLSEDYRAEITMT

SEQ ID NO: 2792187 - protein, 22 aa, Entamoeba invadens
GKKWDSAGCILRIYELLCQCYQ

SEQ ID NO: 2792188 - protein, 17 aa, Entamoeba invadens
GKLDVYVTERFEGEIQE

SEQ ID NO: 2792189 - protein, 18 aa, Entamoeba invadens
GKLECVKTHFTFLNLVLF

SEQ ID NO: 2792190 - protein, 19 aa, Entamoeba invadens
GKLFKIKRGELMEPKPDEI

SEQ ID NO: 2792191 - protein, 18 aa, Entamoeba invadens
GKLLRYGNSEMIYCHMKF

SEQ ID NO: 2792192 - protein, 22 aa, Entamoeba invadens
GKLQEAFGLFVGPMIDVIICSS

SEQ ID NO: 2792193 - protein, 17 aa, Entamoeba invadens
GKLQMILTFYRFFTFGI

SEQ ID NO: 2792194 - protein, 27 aa, Entamoeba invadens
GKLRRLSNLFMRFLAIYLPHIAIICSI

SEQ ID NO: 2792195 - protein, 22 aa, Entamoeba invadens
GKLTGMRLVGWVFPGELFTVTI

SEQ ID NO: 2792196 - protein, 22 aa, Entamoeba invadens
GKLTGMRLVGWVFPGELFTVTV

SEQ ID NO: 2792197 - protein, 19 aa, Entamoeba invadens
GKLYCSVVAVATNAGKAPE

SEQ ID NO: 2792198 - protein, 28 aa, Entamoeba invadens
GKLYIGTRHLCFLPSKFIGKSATVVSWS

SEQ ID NO: 2792199 - protein, 17 aa, Entamoeba invadens
GKMAFYNCLTLKEVTLS

SEQ ID NO: 2792200 - protein, 17 aa, Entamoeba invadens
GKMLSFSAGVMIYVSFV

SEQ ID NO: 2792201 - protein, 33 aa, Entamoeba invadens
GKMTRYRCFTSFIFMCLKKYYIQLIKMFIMSMT

SEQ ID NO: 2792202 - protein, 25 aa, Entamoeba invadens
GKNCYLCSWEKGCIGCKLTQDILDK

SEQ ID NO: 2792203 - protein, 19 aa, Entamoeba invadens
GKNIFPVCAPTFQLRSIFF

SEQ ID NO: 2792204 - protein, 24 aa, Entamoeba invadens
GKNMKIMTCYFTLFCTTKVRNMKI

SEQ ID NO: 2792205 - protein, 27 aa, Entamoeba invadens
GKNPRVDLYLMIFLKFLTTVIPTMEYD

SEQ ID NO: 2792206 - protein, 20 aa, Entamoeba invadens
GKPDVCITCTDGTNADPTTH

SEQ ID NO: 2792207 - protein, 20 aa, Entamoeba invadens
GKPDVCITCTDGTTADPTTH

SEQ ID NO: 2792208 - protein, 18 aa, Entamoeba invadens
GKPLMLMESVLREEKKKK

SEQ ID NO: 2792209 - protein, 17 aa, Entamoeba invadens
GKPQFPLVFQEDPIGYT

SEQ ID NO: 2792210 - protein, 20 aa, Entamoeba invadens
GKPTWLCPVCRTEYDKPPKA

SEQ ID NO: 2792211 - protein, 19 aa, Entamoeba invadens
GKRCTKCFDNYYFTNTNIN

SEQ ID NO: 2792212 - protein, 21 aa, Entamoeba invadens
GKRCTKCFDSYYFANTNMNND

SEQ ID NO: 2792213 - protein, 21 aa, Entamoeba invadens
GKRCTKCFDSYYFTNTNINND

SEQ ID NO: 2792214 - protein, 30 aa, Entamoeba invadens
GKSAKVYRCNSCGFIMFAIPKKGKERMFSG

SEQ ID NO: 2792215 - protein, 17 aa, Entamoeba invadens
GKSFLLNSITKVNGFSL

SEQ ID NO: 2792216 - protein, 18 aa, Entamoeba invadens
GKSILHMCCESKNVEYIQ

SEQ ID NO: 2792217 - protein, 26 aa, Entamoeba invadens
GKSKILSASWGFKIEKLDHFTAANLI

SEQ ID NO: 2792218 - protein, 20 aa, Entamoeba invadens
GKSNTVWFMYMDKCTTNSNK

SEQ ID NO: 2792219 - protein, 17 aa, Entamoeba invadens
GKSSFLMSILGELEQKK

SEQ ID NO: 2792220 - protein, 17 aa, Entamoeba invadens
GKSSLLMSILGELELKE

SEQ ID NO: 2792221 - protein, 19 aa, Entamoeba invadens
GKSSYNLLCAKKYPDTLKT

SEQ ID NO: 2792222 - protein, 19 aa, Entamoeba invadens
GKSTIIQLIERFYRPEKGV

SEQ ID NO: 2792223 - protein, 26 aa, Entamoeba invadens
GKSVSTRWMGNFSLMIFTTEVLISFI

SEQ ID NO: 2792224 - protein, 27 aa, Entamoeba invadens
GKTADGRCAACQVTYCVMCDGDKGNCI

SEQ ID NO: 2792225 - protein, 28 aa, Entamoeba invadens
GKTAGVYCKWHYIILYLVALLLNLPLII

SEQ ID NO: 2792226 - protein, 28 aa, Entamoeba invadens
GKTALPLIRARCIEVVQHFVLVRQPLLD

SEQ ID NO: 2792227 - protein, 24 aa, Entamoeba invadens
GKTIELKVAFNIKSLIYANVITIT

SEQ ID NO: 2792228 - protein, 21 aa, Entamoeba invadens
GKTIKCNIGYFIKSNKCENCG

SEQ ID NO: 2792229 - protein, 23 aa, Entamoeba invadens
GKTKLNNIVPMYFGEFDKSYVIM

SEQ ID NO: 2792230 - protein, 19 aa, Entamoeba invadens
GKTPKGFLNFCESPDGFNL

SEQ ID NO: 2792231 - protein, 22 aa, Entamoeba invadens
GKTQMKSKMTFFVSTLLVILSM

SEQ ID NO: 2792232 - protein, 20 aa, Entamoeba invadens
GKTSCKACSTSCSSCQATYG

SEQ ID NO: 2792233 - protein, 18 aa, Entamoeba invadens
GKTTDGRCAACQDVNCVM

SEQ ID NO: 2792234 - protein, 19 aa, Entamoeba invadens
GKTTDGRCAACQVTNCVMC

SEQ ID NO: 2792235 - protein, 24 aa, Entamoeba invadens
GKTVKCAQCTKGYFITDDFLCKRC

SEQ ID NO: 2792236 - protein, 22 aa, Entamoeba invadens
GKVCIKEGAVNGVFNSELTIEK

SEQ ID NO: 2792237 - protein, 25 aa, Entamoeba invadens
GKVGVKIGRELLKCVTRALTQNMGI

SEQ ID NO: 2792238 - protein, 18 aa, Entamoeba invadens
GKVKIELTKTVFDDANRV

SEQ ID NO: 2792239 - protein, 17 aa, Entamoeba invadens
GKVNWLRVVPLCLPCSF

SEQ ID NO: 2792240 - protein, 20 aa, Entamoeba invadens
GKYDFCIKAPVTNCKHYHSN

SEQ ID NO: 2792241 - protein, 19 aa, Entamoeba invadens
GKYDFCIPISNTQIADCKY

SEQ ID NO: 2792242 - protein, 24 aa, Entamoeba invadens
GKYDYCLPLSLAQIEDCKYSIISK

SEQ ID NO: 2792243 - protein, 24 aa, Entamoeba invadens
GKYDYCLPLSLAQIEDCKYSYIFK

SEQ ID NO: 2792244 - protein, 22 aa, Entamoeba invadens
GKYFPTKCHRFLKMLNDMGRLK

SEQ ID NO: 2792245 - protein, 25 aa, Entamoeba invadens
GKYGTPPDCKDCVALCDVCSDGTSC

SEQ ID NO: 2792246 - protein, 26 aa, Entamoeba invadens
GKYGTPPDCKDCVALCDVCSDGTSCT

SEQ ID NO: 2792247 - protein, 17 aa, Entamoeba invadens
GKYNFCIPITTTQIDHC

SEQ ID NO: 2792248 - protein, 18 aa, Entamoeba invadens
GKYNWELNDSAMLNIYEY

SEQ ID NO: 2792249 - protein, 23 aa, Entamoeba invadens
GKYPYHGRFYLVIWGLYFFFSRQ

SEQ ID NO: 2792250 - protein, 33 aa, Entamoeba invadens
GKYQISTLIKFCFYKNAAFFLVNMFYAFISNFT

SEQ ID NO: 2792251 - protein, 21 aa, Entamoeba invadens
GKYSFLKFRTIVGNLERDLGI

SEQ ID NO: 2792252 - protein, 19 aa, Entamoeba invadens
GLCFICASGTFYNETGKFC

SEQ ID NO: 2792253 - protein, 18 aa, Entamoeba invadens
GLCKCLYTKLGTNCVLNH

SEQ ID NO: 2792254 - protein, 18 aa, Entamoeba invadens
GLCRKKCTVTSGDYEQCS

SEQ ID NO: 2792255 - protein, 26 aa, Entamoeba invadens
GLCRSCKESSCLICTDSKDNYKCEKC

SEQ ID NO: 2792256 - protein, 18 aa, Entamoeba invadens
GLCTGCLTNYVFEATQSK

SEQ ID NO: 2792257 - protein, 19 aa, Entamoeba invadens
GLDRIELKTSIHLLGGVII

SEQ ID NO: 2792258 - protein, 21 aa, Entamoeba invadens
GLEIIQWDGRVEFFVFPPKQR

SEQ ID NO: 2792259 - protein, 22 aa, Entamoeba invadens
GLELRSVSLFSDIDQRFDIWLR

SEQ ID NO: 2792260 - protein, 25 aa, Entamoeba invadens
GLEPYKFLKDYAEAHTFLKTPHGRF

SEQ ID NO: 2792261 - protein, 18 aa, Entamoeba invadens
GLFGVVLLGKYRGNKVVI

SEQ ID NO: 2792262 - protein, 19 aa, Entamoeba invadens
GLFLRPLNFGFHRDINKNN

SEQ ID NO: 2792263 - protein, 18 aa, Entamoeba invadens
GLFLTLISFFETQDFKVL

SEQ ID NO: 2792264 - protein, 26 aa, Entamoeba invadens
GLFQRLRLLSHYSLSHYLDIIPAKHN

SEQ ID NO: 2792265 - protein, 32 aa, Entamoeba invadens
GLFTRLVIVPAICIGINYLLWYYKFIPTDNMF

SEQ ID NO: 2792266 - protein, 17 aa, Entamoeba invadens
GLGKFVADAWSKKSTKS

SEQ ID NO: 2792267 - protein, 20 aa, Entamoeba invadens
GLGLICLVLTFLEGSFQQIF

SEQ ID NO: 2792268 - protein, 18 aa, Entamoeba invadens
GLGLKPVISATPSYYDKM

SEQ ID NO: 2792269 - protein, 18 aa, Entamoeba invadens
GLHLQNFESAELLGATSI

SEQ ID NO: 2792270 - protein, 23 aa, Entamoeba invadens
GLHNLKFFFLFLLYAFAIVSIHF

SEQ ID NO: 2792271 - protein, 19 aa, Entamoeba invadens
GLINLGFVLYYFVDNILPF

SEQ ID NO: 2792272 - protein, 23 aa, Entamoeba invadens
GLISIWITMAIKVKRFNIIIIGA

SEQ ID NO: 2792273 - protein, 18 aa, Entamoeba invadens
GLIYLRNGWILCVLAIPV

SEQ ID NO: 2792274 - protein, 17 aa, Entamoeba invadens
GLKEKRGTCSTSAATCV

SEQ ID NO: 2792275 - protein, 23 aa, Entamoeba invadens
GLKIRKLYFSSLLRQDSTFYDSQ

SEQ ID NO: 2792276 - protein, 24 aa, Entamoeba invadens
GLKIRKLYFSSLLRQDSTFYDSQE

SEQ ID NO: 2792277 - protein, 28 aa, Entamoeba invadens
GLKSDHCELCLPGFRLEKGNCAPCDEGC

SEQ ID NO: 2792278 - protein, 24 aa, Entamoeba invadens
GLLCLDFNVAIGLYRLDILKYVPK

SEQ ID NO: 2792279 - protein, 23 aa, Entamoeba invadens
GLLKKALGDNALWVAIACSGVLL

SEQ ID NO: 2792280 - protein, 20 aa, Entamoeba invadens
GLLLDHLPVLLLHHQKFAGA

SEQ ID NO: 2792281 - protein, 25 aa, Entamoeba invadens
GLLLKRVRRPVVLPLLISLAIELLS

SEQ ID NO: 2792282 - protein, 20 aa, Entamoeba invadens
GLLLYTFLCFVLFSKYQIKD

SEQ ID NO: 2792283 - protein, 24 aa, Entamoeba invadens
GLLRGRLTSALSYKKYLLSFVVAW

SEQ ID NO: 2792284 - protein, 21 aa, Entamoeba invadens
GLLSTYISLGWCIYTCFVFII

SEQ ID NO: 2792285 - protein, 18 aa, Entamoeba invadens
GLLTCLYSDVTVGKSDTW

SEQ ID NO: 2792286 - protein, 32 aa, Entamoeba invadens
GLLTLCFVSLCFFPLDVVITLGMSAAISIFIT

SEQ ID NO: 2792287 - protein, 24 aa, Entamoeba invadens
  misc_feature (20)..(21): Xaa can be any naturally occurring amino acid
GLLTLCFVSLCFFPLDVVIXXDEC

SEQ ID NO: 2792288 - protein, 18 aa, Entamoeba invadens
GLLVLWTALLITFSLTSK

SEQ ID NO: 2792289 - protein, 23 aa, Entamoeba invadens
GLLVNIIGVFAFRDNGEEDEQEC

SEQ ID NO: 2792290 - protein, 23 aa, Entamoeba invadens
GLMVSGIFTPLGMMIIALLGVLI

SEQ ID NO: 2792291 - protein, 23 aa, Entamoeba invadens
GLMWCLGSLIGSMIGGLLYSPCE

SEQ ID NO: 2792292 - protein, 18 aa, Entamoeba invadens
GLNCIQCNTSNYQIDTGE

SEQ ID NO: 2792293 - protein, 17 aa, Entamoeba invadens
GLNEATNTMSLWMMIFV

SEQ ID NO: 2792294 - protein, 25 aa, Entamoeba invadens
GLNQSIKGWYLFNGLNTTLSFITQL

SEQ ID NO: 2792295 - protein, 26 aa, Entamoeba invadens
GLNVRSGLCKPCYQMFDKCLNCFSNG

SEQ ID NO: 2792296 - protein, 18 aa, Entamoeba invadens
GLPVKWETTRLITVANPT

SEQ ID NO: 2792297 - protein, 30 aa, Entamoeba invadens
GLQTLPALGCCALTTGVARKHPLDVNFLIR

SEQ ID NO: 2792298 - protein, 36 aa, Entamoeba invadens
GLSCFKGCTSLCEICCTSSLRFPRSSLLGIQASFNL

SEQ ID NO: 2792299 - protein, 19 aa, Entamoeba invadens
GLSCGLCGLASGMSIGISG

SEQ ID NO: 2792300 - protein, 19 aa, Entamoeba invadens
GLSCKKCDIKCGTCNNREN

SEQ ID NO: 2792301 - protein, 18 aa, Entamoeba invadens
GLSCLSCRNEYFKLSGSE

SEQ ID NO: 2792302 - protein, 17 aa, Entamoeba invadens
GLSFLNSVMYFGEYSLS

SEQ ID NO: 2792303 - protein, 23 aa, Entamoeba invadens
GLSGLPLKTPKIYNALNCEDIHD

SEQ ID NO: 2792304 - protein, 19 aa, Entamoeba invadens
GLSLCAICETSYFRNANGI

SEQ ID NO: 2792305 - protein, 18 aa, Entamoeba invadens
GLTAMCIVDTITVALTLF

SEQ ID NO: 2792306 - protein, 25 aa, Entamoeba invadens
GLTKFAIGFTYFFSIVAVRTYNEDT

SEQ ID NO: 2792307 - protein, 17 aa, Entamoeba invadens
GLTRSPIFIHFDQTLLG

SEQ ID NO: 2792308 - protein, 21 aa, Entamoeba invadens
GLTVPCLIGVVLNRTDYVGNV

SEQ ID NO: 2792309 - protein, 18 aa, Entamoeba invadens
GLVAASFFNDTFKIDIGT

SEQ ID NO: 2792310 - protein, 18 aa, Entamoeba invadens
GLVFISLRGLFVLFSIAQ

SEQ ID NO: 2792311 - protein, 28 aa, Entamoeba invadens
GLVLGWVHSFIFWKYAVLMYVAGQQLQK

SEQ ID NO: 2792312 - protein, 18 aa, Entamoeba invadens
GLVNPADCTIRYNSTDTD

SEQ ID NO: 2792313 - protein, 18 aa, Entamoeba invadens
GLVSFLVSHICNIIGYSQ

SEQ ID NO: 2792314 - protein, 26 aa, Entamoeba invadens
GLWSKTCQMSYCDIGYKFDRANNNCI

SEQ ID NO: 2792315 - protein, 23 aa, Entamoeba invadens
GLYAKARAGLIKGFTGIDDPYEA

SEQ ID NO: 2792316 - protein, 17 aa, Entamoeba invadens
GLYCKNCKSSTYCDVCE

SEQ ID NO: 2792317 - protein, 20 aa, Entamoeba invadens
GMACTFKFFLQPKCSCTINE

SEQ ID NO: 2792318 - protein, 19 aa, Entamoeba invadens
GMADRGNAIVVGFEGDPEG

SEQ ID NO: 2792319 - protein, 21 aa, Entamoeba invadens
GMCVYCSSVIPRCVSCKGKKC

SEQ ID NO: 2792320 - protein, 22 aa, Entamoeba invadens
GMDEKFLLIAMELMTNGTAREI

SEQ ID NO: 2792321 - protein, 21 aa, Entamoeba invadens
GMELYFFPLFHNFPSLENVTK

SEQ ID NO: 2792322 - protein, 20 aa, Entamoeba invadens
GMFHFFRKSNLWSLFCSFEY

SEQ ID NO: 2792323 - protein, 40 aa, Entamoeba invadens
GMFSCLQLTWTQRMLCCVIFCGLGFLSLFISLSFFIFPTK

SEQ ID NO: 2792324 - protein, 19 aa, Entamoeba invadens
GMGLYRFLNFDKHFENKYK

SEQ ID NO: 2792325 - protein, 17 aa, Entamoeba invadens
GMGSIFPLIAIGVVLLR

SEQ ID NO: 2792326 - protein, 28 aa, Entamoeba invadens
GMIFLRNGWVLCCLAIVIGCISAYEIQS

SEQ ID NO: 2792327 - protein, 18 aa, Entamoeba invadens
GMIKKIHIIDNILVTIAN

SEQ ID NO: 2792328 - protein, 20 aa, Entamoeba invadens
GMISGMPFYIFNLIEELDEE

SEQ ID NO: 2792329 - protein, 24 aa, Entamoeba invadens
GMKKDFFKCSNWPEKAPYYGKNQN

SEQ ID NO: 2792330 - protein, 20 aa, Entamoeba invadens
GMMCLVDYFVIIGVPIIVTT

SEQ ID NO: 2792331 - protein, 19 aa, Entamoeba invadens
GMNCYECLLNCSACNTKDK

SEQ ID NO: 2792332 - protein, 17 aa, Entamoeba invadens
GMPWTMVRKLATTEYLN

SEQ ID NO: 2792333 - protein, 17 aa, Entamoeba invadens
GMQRVGAGITFGEMVRN

SEQ ID NO: 2792334 - protein, 18 aa, Entamoeba invadens
GMSCISCAAFNADCETCD

SEQ ID NO: 2792335 - protein, 25 aa, Entamoeba invadens
GMSCKSRAVWWVILVAVLFVIIMFV

SEQ ID NO: 2792336 - protein, 22 aa, Entamoeba invadens
GMTMYQTFKWNKIYDKTTFPWI

SEQ ID NO: 2792337 - protein, 25 aa, Entamoeba invadens
GMTQLEWGLFWGFSVDYEFKFSGVM

SEQ ID NO: 2792338 - protein, 28 aa, Entamoeba invadens
GMTYWLMAVCSFVFVAFVVFIIAVLVVV

SEQ ID NO: 2792339 - protein, 25 aa, Entamoeba invadens
GMVDYCFKKLSSVLYVLNRGVSCLI

SEQ ID NO: 2792340 - protein, 22 aa, Entamoeba invadens
GMVEKGNAIVVGFEGDPNIEYE

SEQ ID NO: 2792341 - protein, 18 aa, Entamoeba invadens
GMVIFKGGIVVNDFNRFY

SEQ ID NO: 2792342 - protein, 18 aa, Entamoeba invadens
GMVLGYCLLFALCFSCCV

SEQ ID NO: 2792343 - protein, 31 aa, Entamoeba invadens
GMYKGCALNACTEFQCLKCEKGKYFDFDTKK

SEQ ID NO: 2792344 - protein, 26 aa, Entamoeba invadens
GMYTTCLYLSYFMKPHIDEENPTLQD

SEQ ID NO: 2792345 - protein, 32 aa, Entamoeba invadens
GNASFKCDVFSFAICLLEIWLTKSPYDPEVFV

SEQ ID NO: 2792346 - protein, 17 aa, Entamoeba invadens
GNATLSCQDKLEINSLF

SEQ ID NO: 2792347 - protein, 24 aa, Entamoeba invadens
GNCAECPIECTSCISNSKCISCTN

SEQ ID NO: 2792348 - protein, 31 aa, Entamoeba invadens
GNCEECSRGFYLKNGVCLRCPDRCQKCEYNT

SEQ ID NO: 2792349 - protein, 22 aa, Entamoeba invadens
GNCFDCKPGYGFINDKCLICED

SEQ ID NO: 2792350 - protein, 17 aa, Entamoeba invadens
GNCFVLFKEKMTEIHKL

SEQ ID NO: 2792351 - protein, 23 aa, Entamoeba invadens
GNCIKCGINTTFIGNECVNNTKN

SEQ ID NO: 2792352 - protein, 23 aa, Entamoeba invadens
GNCIKCGINTTFIGNKCVNNTEN

SEQ ID NO: 2792353 - protein, 17 aa, Entamoeba invadens
GNCKICGEHCKSCVSQI

SEQ ID NO: 2792354 - protein, 19 aa, Entamoeba invadens
GNCKKCSTANWVVTEPISI

SEQ ID NO: 2792355 - protein, 23 aa, Entamoeba invadens
GNCKKCSTANWVVTEPMSIQCEM

SEQ ID NO: 2792356 - protein, 19 aa, Entamoeba invadens
GNCKKCSTLNFVVTEPISI

SEQ ID NO: 2792357 - protein, 23 aa, Entamoeba invadens
GNCKTCSLSNWVVTEPLSIQCEM

SEQ ID NO: 2792358 - protein, 18 aa, Entamoeba invadens
GNCKVCEYPCVFCSNQTY

SEQ ID NO: 2792359 - protein, 20 aa, Entamoeba invadens
GNCLSCFDGYILNDGKCDTC

SEQ ID NO: 2792360 - protein, 17 aa, Entamoeba invadens
GNCLSCYDGNFLNGKIC

SEQ ID NO: 2792361 - protein, 18 aa, Entamoeba invadens
GNCLSCYDGYILDNGKCE

SEQ ID NO: 2792362 - protein, 20 aa, Entamoeba invadens
GNCLTCRAGSGFVGNNKCEK

SEQ ID NO: 2792363 - protein, 26 aa, Entamoeba invadens
GNCPEFKIKVDYNFVFTNRLTKDVLL

SEQ ID NO: 2792364 - protein, 20 aa, Entamoeba invadens
GNCRSCFSGYVLTSPVSKVC

SEQ ID NO: 2792365 - protein, 19 aa, Entamoeba invadens
GNCRSCLSGNVLTSPVSKV

SEQ ID NO: 2792366 - protein, 21 aa, Entamoeba invadens
GNCRSCLSGYVLTSPVSKVCE

SEQ ID NO: 2792367 - protein, 18 aa, Entamoeba invadens
GNCSICLAGTYTNLKQSY

SEQ ID NO: 2792368 - protein, 23 aa, Entamoeba invadens
GNCTIPQLLGCSINRNGKCLVCG

SEQ ID NO: 2792369 - protein, 19 aa, Entamoeba invadens
GNCTSCKSGNYIHNHYCYP

SEQ ID NO: 2792370 - protein, 22 aa, Entamoeba invadens
GNCVTCLPNYYLNGTLCNSCSS

SEQ ID NO: 2792371 - protein, 19 aa, Entamoeba invadens
GNDATVCLFDYSTSLEEKY

SEQ ID NO: 2792372 - protein, 23 aa, Entamoeba invadens
GNDCVCPRGYYLNEQNWKCYVVI

SEQ ID NO: 2792373 - protein, 20 aa, Entamoeba invadens
GNDILRFFCDVLYQTVIYKD

SEQ ID NO: 2792374 - protein, 18 aa, Entamoeba invadens
GNDVLRMSQLVIEDHLIV

SEQ ID NO: 2792375 - protein, 17 aa, Entamoeba invadens
GNECAKCESTCKTCSLT

SEQ ID NO: 2792376 - protein, 17 aa, Entamoeba invadens
GNECKKCDSNCFTCYIE

SEQ ID NO: 2792377 - protein, 18 aa, Entamoeba invadens
GNECKRCSNDYLMVKENQ

SEQ ID NO: 2792378 - protein, 24 aa, Entamoeba invadens
GNECLACKDGILSDGLCYTYDEIN

SEQ ID NO: 2792379 - protein, 27 aa, Entamoeba invadens
GNECVGCGIANCNYCNSTHCYQCAKVA

SEQ ID NO: 2792380 - protein, 18 aa, Entamoeba invadens
GNEKLCGINVRRDNDLTF

SEQ ID NO: 2792381 - protein, 21 aa, Entamoeba invadens
GNELPVQLFIDGYVSQHVTLD

SEQ ID NO: 2792382 - protein, 19 aa, Entamoeba invadens
GNFEECTHVLEALVKREKE

SEQ ID NO: 2792383 - protein, 22 aa, Entamoeba invadens
GNFIYAFALRHLHIIFIMLIDV

SEQ ID NO: 2792384 - protein, 23 aa, Entamoeba invadens
GNFLCKLLKFATNLGDLVSSILQ

SEQ ID NO: 2792385 - protein, 27 aa, Entamoeba invadens
GNFLEPFCPCYEELCFIVPSGNNAVLN

SEQ ID NO: 2792386 - protein, 26 aa, Entamoeba invadens
GNFPQHIVPFVFNWPSSQNAACYYCA

SEQ ID NO: 2792387 - protein, 24 aa, Entamoeba invadens
GNFRQLRAEASVNLNIRDITVKEL

SEQ ID NO: 2792388 - protein, 19 aa, Entamoeba invadens
GNGDNKCEYSSTGYSIVDC

SEQ ID NO: 2792389 - protein, 21 aa, Entamoeba invadens
GNGFQCIPCQIGTYSNISGSA

SEQ ID NO: 2792390 - protein, 18 aa, Entamoeba invadens
GNGIVFLDSIIRAHSFRF

SEQ ID NO: 2792391 - protein, 28 aa, Entamoeba invadens
GNGKWWVIKHLYELFLFVKGTEASDITF

SEQ ID NO: 2792392 - protein, 17 aa, Entamoeba invadens
GNGTVYRGIYRDRVVAV

SEQ ID NO: 2792393 - protein, 19 aa, Entamoeba invadens
GNGWVPSIRGIGCKFGTDI

SEQ ID NO: 2792394 - protein, 20 aa, Entamoeba invadens
GNICLQCQMGYYLFNGYCKN

SEQ ID NO: 2792395 - protein, 20 aa, Entamoeba invadens
GNIEALLFIHGLDHTLYDAL

SEQ ID NO: 2792396 - protein, 17 aa, Entamoeba invadens
GNIENFWYFVFLCILFL

SEQ ID NO: 2792397 - protein, 20 aa, Entamoeba invadens
GNIKTLCLYENTNIFISKNT

SEQ ID NO: 2792398 - protein, 39 aa, Entamoeba invadens
GNIKTWKILVGIIYRMVICPVVSWVSIYMLYKYQILPQN

SEQ ID NO: 2792399 - protein, 18 aa, Entamoeba invadens
GNILKILVFENTTSSLSG

SEQ ID NO: 2792400 - protein, 17 aa, Entamoeba invadens
GNINCLFVSLSELSNVT

SEQ ID NO: 2792401 - protein, 21 aa, Entamoeba invadens
GNKAIEFEIFIQPKCSCKIED

SEQ ID NO: 2792402 - protein, 17 aa, Entamoeba invadens
GNKFFGADLEFNRDSFI

SEQ ID NO: 2792403 - protein, 24 aa, Entamoeba invadens
GNKKCPPCTHMLLTPLTCRCGKTQ

SEQ ID NO: 2792404 - protein, 26 aa, Entamoeba invadens
  misc_feature (23)..(24): Xaa can be any naturally occurring amino acid
GNKLYRICPRIWAYSVHTEMHCXXTI

SEQ ID NO: 2792405 - protein, 22 aa, Entamoeba invadens
GNKVLYCTDGSFISNSTCQKCV

SEQ ID NO: 2792406 - protein, 23 aa, Entamoeba invadens
GNLPYKIDGDFIARSLVVSRGSY

SEQ ID NO: 2792407 - protein, 19 aa, Entamoeba invadens
GNLTLCFAYANAFRIQKDF

SEQ ID NO: 2792408 - protein, 37 aa, Entamoeba invadens
GNLTSTLLRLSVKIPEVKVVAAVGCCYHKLTERNDFW

SEQ ID NO: 2792409 - protein, 23 aa, Entamoeba invadens
GNMLNDVIINWYIKEVEIRHLNV

SEQ ID NO: 2792410 - protein, 21 aa, Entamoeba invadens
GNMQWCSFIVINVVVFTLLVP

SEQ ID NO: 2792411 - protein, 17 aa, Entamoeba invadens
GNMSWVVVMGIIEGVVF

SEQ ID NO: 2792412 - protein, 24 aa, Entamoeba invadens
GNNECLRCNTSLYLLQNNTCGPCD

SEQ ID NO: 2792413 - protein, 32 aa, Entamoeba invadens
GNNKHCFMCLNRISVCIIGFVALLQHTFENFE

SEQ ID NO: 2792414 - protein, 22 aa, Entamoeba invadens
GNNKHRYVVCRNGDNDPQSDCS

SEQ ID NO: 2792415 - protein, 19 aa, Entamoeba invadens
GNNLRLDLISIKDPVLKEN

SEQ ID NO: 2792416 - protein, 18 aa, Entamoeba invadens
GNPQDNFVAFTFFVLYSA

SEQ ID NO: 2792417 - protein, 18 aa, Entamoeba invadens
GNQELVYMHLYIRLMRKI

SEQ ID NO: 2792418 - protein, 20 aa, Entamoeba invadens
GNQFKYTWQIAEFVNKGNRP

SEQ ID NO: 2792419 - protein, 20 aa, Entamoeba invadens
GNQFWSCLFYSNKLINRYFE

SEQ ID NO: 2792420 - protein, 21 aa, Entamoeba invadens
GNRTIKDLPLFFVSNTVTITG

SEQ ID NO: 2792421 - protein, 21 aa, Entamoeba invadens
GNSKCDKCAFWSAPNDDGTEC

SEQ ID NO: 2792422 - protein, 24 aa, Entamoeba invadens
GNSLYRYFCYSSNFADFYNQKTSL

SEQ ID NO: 2792423 - protein, 35 aa, Entamoeba invadens
GNSYHNWPCWQVRYTVGLYYGFKIEAGKSYAINTC

SEQ ID NO: 2792424 - protein, 23 aa, Entamoeba invadens
GNTEIRYVLRWLQRSLPEKMPFE

SEQ ID NO: 2792425 - protein, 27 aa, Entamoeba invadens
GNTFEFKECLLSGVLTLDIPVTINSEV

SEQ ID NO: 2792426 - protein, 20 aa, Entamoeba invadens
GNTLLSFVVLGLFFEWKNKT

SEQ ID NO: 2792427 - protein, 19 aa, Entamoeba invadens
GNTVIRRSRKFSFATPRTS

SEQ ID NO: 2792428 - protein, 23 aa, Entamoeba invadens
GNVGCAICRDGYYYKDKDCIKCD

SEQ ID NO: 2792429 - protein, 20 aa, Entamoeba invadens
GNVMPLLAFLTMTLLYPDYS

SEQ ID NO: 2792430 - protein, 24 aa, Entamoeba invadens
GNVNLKMKLICWTNFEMNILSTFT

SEQ ID NO: 2792431 - protein, 17 aa, Entamoeba invadens
GNVPFIIDSDFIARSVV

SEQ ID NO: 2792432 - protein, 23 aa, Entamoeba invadens
GNYCYPCEAGTLAIQLTNKCNVC

SEQ ID NO: 2792433 - protein, 22 aa, Entamoeba invadens
GNYISGSSCSRCQAGTYSSDGK

SEQ ID NO: 2792434 - protein, 19 aa, Entamoeba invadens
GNYKGLVDCENFKVYEHTT

SEQ ID NO: 2792435 - protein, 25 aa, Entamoeba invadens
GNYVFKNCKYLETIDLNGILNISEG

SEQ ID NO: 2792436 - protein, 20 aa, Entamoeba invadens
GNYVLSKGLGEYVFQDNKCL

SEQ ID NO: 2792437 - protein, 18 aa, Entamoeba invadens
GPCTAGGKTVKCYCGRKD

SEQ ID NO: 2792438 - protein, 18 aa, Entamoeba invadens
GPDAYRWMAHTYGVNAAN

SEQ ID NO: 2792439 - protein, 21 aa, Entamoeba invadens
GPDCLNSWRGDVCERCKEKTY

SEQ ID NO: 2792440 - protein, 20 aa, Entamoeba invadens
GPFGVEICLVLFSFILSDPT

SEQ ID NO: 2792441 - protein, 18 aa, Entamoeba invadens
GPFLSLPFALLFFVFPIN

SEQ ID NO: 2792442 - protein, 17 aa, Entamoeba invadens
GPFLSTLIIGTIITGSY

SEQ ID NO: 2792443 - protein, 23 aa, Entamoeba invadens
GPHVKLCGCSQVVKADAVQQIKK

SEQ ID NO: 2792444 - protein, 19 aa, Entamoeba invadens
GPIGFYRGFGVGFFKVVPL

SEQ ID NO: 2792445 - protein, 17 aa, Entamoeba invadens
GPISGFVKIEIDAPILD

SEQ ID NO: 2792446 - protein, 21 aa, Entamoeba invadens
GPKGYGIKNVRWNSVGTKLIA

SEQ ID NO: 2792447 - protein, 18 aa, Entamoeba invadens
GPLDYFWMVINLRKNMDI

SEQ ID NO: 2792448 - protein, 24 aa, Entamoeba invadens
GPLFYCVVMVFLIIVFWKSYPPSV

SEQ ID NO: 2792449 - protein, 19 aa, Entamoeba invadens
GPLPATAVPLYLSQLQPFG

SEQ ID NO: 2792450 - protein, 19 aa, Entamoeba invadens
GPNALCFESSLIKAIPFGI

SEQ ID NO: 2792451 - protein, 26 aa, Entamoeba invadens
GPPIYCAGCGMFFGLLAVIVALQGSF

SEQ ID NO: 2792452 - protein, 18 aa, Entamoeba invadens
GPPKVMEDIVLFDTRKGE

SEQ ID NO: 2792453 - protein, 28 aa, Entamoeba invadens
GPPLHLDEFLLRLTGDLSRVDFSNNIMM

SEQ ID NO: 2792454 - protein, 25 aa, Entamoeba invadens
GPSQFPIKCMIAGTFKLEENNSDLY

SEQ ID NO: 2792455 - protein, 18 aa, Entamoeba invadens
GPSSSYMALRYMGETNVS

SEQ ID NO: 2792456 - protein, 17 aa, Entamoeba invadens
GPVCGILSYSIGTALGL

SEQ ID NO: 2792457 - protein, 26 aa, Entamoeba invadens
GQAECIPCPPGTFNQFLAYTFCFPCP

SEQ ID NO: 2792458 - protein, 21 aa, Entamoeba invadens
GQAKFYLIMWEDGKDGAEEII

SEQ ID NO: 2792459 - protein, 20 aa, Entamoeba invadens
GQCALCSSVISDCETCNSGT

SEQ ID NO: 2792460 - protein, 30 aa, Entamoeba invadens
GQCSACSIPNCKYCEGGKCKKCNDNYVVQT

SEQ ID NO: 2792461 - protein, 17 aa, Entamoeba invadens
GQCVPCQIGCYLCSKLG

SEQ ID NO: 2792462 - protein, 20 aa, Entamoeba invadens
GQDEVVDFTSFFYASVNQNM

SEQ ID NO: 2792463 - protein, 22 aa, Entamoeba invadens
GQDVVRRFFAYFNFLSKNVGKY

SEQ ID NO: 2792464 - protein, 19 aa, Entamoeba invadens
GQELKILENLRHPNIVHYY

SEQ ID NO: 2792465 - protein, 21 aa, Entamoeba invadens
GQFFDVCNIFDTLGMPSQKNH

SEQ ID NO: 2792466 - protein, 32 aa, Entamoeba invadens
GQFSYLYKLKVMKDIECGLHYLHEFKLLHLNL

SEQ ID NO: 2792467 - protein, 22 aa, Entamoeba invadens
GQIFGIVFAVVFLVIIIAAFAA

SEQ ID NO: 2792468 - protein, 18 aa, Entamoeba invadens
GQINRLTTDGSFSCVLCK

SEQ ID NO: 2792469 - protein, 23 aa, Entamoeba invadens
GQKQLICIARALLKKTKILIMDE

SEQ ID NO: 2792470 - protein, 25 aa, Entamoeba invadens
GQLFVSLFLICFLENYTFFKTLIGK

SEQ ID NO: 2792471 - protein, 27 aa, Entamoeba invadens
GQNVFGLECCALFIAVVMLFSWWLHDA

SEQ ID NO: 2792472 - protein, 17 aa, Entamoeba invadens
GQPAYFMVPPPYIQMQD

SEQ ID NO: 2792473 - protein, 28 aa, Entamoeba invadens
GQPKRAEGVFKIIFNKVPKHPFAHYLRG

SEQ ID NO: 2792474 - protein, 25 aa, Entamoeba invadens
GQPYVSSMVKIRCVPEMGYCTKNEV

SEQ ID NO: 2792475 - protein, 18 aa, Entamoeba invadens
GQRCPADLVPLHSDTIDP

SEQ ID NO: 2792476 - protein, 17 aa, Entamoeba invadens
GQRSMCWAFSTIFQLEY

SEQ ID NO: 2792477 - protein, 25 aa, Entamoeba invadens
GQSVLWCAQGSLLTRCSKPEKRGRN

SEQ ID NO: 2792478 - protein, 18 aa, Entamoeba invadens
GQTCDLIAIFVVICTCSY

SEQ ID NO: 2792479 - protein, 22 aa, Entamoeba invadens
GQTFPADCVLIYSSHENGISSV

SEQ ID NO: 2792480 - protein, 20 aa, Entamoeba invadens
GQTICKLCDLSCASCNATNG

SEQ ID NO: 2792481 - protein, 19 aa, Entamoeba invadens
GQTICKLCDSSCASCNATD

SEQ ID NO: 2792482 - protein, 20 aa, Entamoeba invadens
GQTTCKLCDLSCASCNATNS

SEQ ID NO: 2792483 - protein, 20 aa, Entamoeba invadens
GQTTCKLCDSSCARCNATDG

SEQ ID NO: 2792484 - protein, 19 aa, Entamoeba invadens
GQTTCKLCDSSCASCNATD

SEQ ID NO: 2792485 - protein, 19 aa, Entamoeba invadens
GQTTCKLCDSSCASCNATN

SEQ ID NO: 2792486 - protein, 26 aa, Entamoeba invadens
GQWLYKNIFFTVGIVIIFLFIVNLFI

SEQ ID NO: 2792487 - protein, 27 aa, Entamoeba invadens
GQYLSGTSCIYCRAGTYSLGGTTTSCT

SEQ ID NO: 2792488 - protein, 22 aa, Entamoeba invadens
GRACEFEIFITPNFTCKIDDQF

SEQ ID NO: 2792489 - protein, 18 aa, Entamoeba invadens
GRCDGCASDKVLINGECV

SEQ ID NO: 2792490 - protein, 19 aa, Entamoeba invadens
GRCGQIVCTPGQFITPEKT

SEQ ID NO: 2792491 - protein, 21 aa, Entamoeba invadens
GRCTLCKNGQFINDYSCDGCV

SEQ ID NO: 2792492 - protein, 21 aa, Entamoeba invadens
GRCVCKPGYGGDDCHMLCYYN

SEQ ID NO: 2792493 - protein, 19 aa, Entamoeba invadens
GRCVIYTSIELCEAAANNS

SEQ ID NO: 2792494 - protein, 19 aa, Entamoeba invadens
GRDAIVTEFAEYGSLSKIW

SEQ ID NO: 2792495 - protein, 27 aa, Entamoeba invadens
GRDLMSYKKGYNCITFPCVMAVAHVIA

SEQ ID NO: 2792496 - protein, 20 aa, Entamoeba invadens
GREMLKEYSEFELSSLGGPL

SEQ ID NO: 2792497 - protein, 26 aa, Entamoeba invadens
GRFCIKAPHLKTIFIENSMEVIFDKM

SEQ ID NO: 2792498 - protein, 23 aa, Entamoeba invadens
GRFCVPDHTAGAWTVYSLLTGLL

SEQ ID NO: 2792499 - protein, 17 aa, Entamoeba invadens
GRFKDKFSNIFESEGGE

SEQ ID NO: 2792500 - protein, 24 aa, Entamoeba invadens
GRFVGEVFETWGWENSLGPSGFAL

SEQ ID NO: 2792501 - protein, 18 aa, Entamoeba invadens
GRGFSTQIMNGWFDTFNF

SEQ ID NO: 2792502 - protein, 18 aa, Entamoeba invadens
GRGVMFISKNYYRIHALS

SEQ ID NO: 2792503 - protein, 19 aa, Entamoeba invadens
GRGVMFISKNYYRVHALSL

SEQ ID NO: 2792504 - protein, 19 aa, Entamoeba invadens
GRIDAVWIWVNGSDPKWRS

SEQ ID NO: 2792505 - protein, 24 aa, Entamoeba invadens
GRIKFFIELNERVLLRGVDTRCVY

SEQ ID NO: 2792506 - protein, 19 aa, Entamoeba invadens
GRITEQFAVLLGKVLLRER

SEQ ID NO: 2792507 - protein, 17 aa, Entamoeba invadens
GRLDFEIKNPIGNIDCF

SEQ ID NO: 2792508 - protein, 18 aa, Entamoeba invadens
GRLGRYCDPTTFKNSSTF

SEQ ID NO: 2792509 - protein, 24 aa, Entamoeba invadens
GRLIGGIMRSCMSTLVSFKTDTRD

SEQ ID NO: 2792510 - protein, 21 aa, Entamoeba invadens
GRLKVQLTTRFGCDKYSIRTE

SEQ ID NO: 2792511 - protein, 18 aa, Entamoeba invadens
GRLKYGFYKDTPTFNDFL

SEQ ID NO: 2792512 - protein, 19 aa, Entamoeba invadens
GRLQRFFVFEQEYDIHCFM

SEQ ID NO: 2792513 - protein, 18 aa, Entamoeba invadens
GRLSYFFYRTQDLARYPL

SEQ ID NO: 2792514 - protein, 18 aa, Entamoeba invadens
GRPRPNMYELVARGDERD

SEQ ID NO: 2792515 - protein, 18 aa, Entamoeba invadens
GRQNFWIYAQDDTQHVNL

SEQ ID NO: 2792516 - protein, 18 aa, Entamoeba invadens
GRRGVVNGKSMWNIPQIF

SEQ ID NO: 2792517 - protein, 19 aa, Entamoeba invadens
GRRKWVFELTNPKDGSYPG

SEQ ID NO: 2792518 - protein, 21 aa, Entamoeba invadens
GRSAMIYQFCLNKFYDKIDTL

SEQ ID NO: 2792519 - protein, 23 aa, Entamoeba invadens
GRSGLDVSQYPVFPWVIKDNKSQ

SEQ ID NO: 2792520 - protein, 26 aa, Entamoeba invadens
GRSHASWKLLLFIMPWIIASVVAISR

SEQ ID NO: 2792521 - protein, 17 aa, Entamoeba invadens
GRTTLVVAHRLSTVRNA

SEQ ID NO: 2792522 - protein, 19 aa, Entamoeba invadens
GRVFLKEFLQTQMFENWKT

SEQ ID NO: 2792523 - protein, 25 aa, Entamoeba invadens
GRVIRFPYKLSDDMLSCIHTTNYGV

SEQ ID NO: 2792524 - protein, 17 aa, Entamoeba invadens
GRVLCGINRQLRMYEIG

SEQ ID NO: 2792525 - protein, 29 aa, Entamoeba invadens
GRVLVEWRGSIKLIEKVLETFNMFCQERL

SEQ ID NO: 2792526 - protein, 25 aa, Entamoeba invadens
GRVRRRLYRKIMYQDAGWFDRSENS

SEQ ID NO: 2792527 - protein, 18 aa, Entamoeba invadens
GSAFYFCVLRKLNKTKLF

SEQ ID NO: 2792528 - protein, 23 aa, Entamoeba invadens
GSARCKGCPVGSFYSSANTCSLC

SEQ ID NO: 2792529 - protein, 23 aa, Entamoeba invadens
GSASCKACAGGTYSNSLLASTNC

SEQ ID NO: 2792530 - protein, 25 aa, Entamoeba invadens
GSASLKMTSNFAVISSFIVFKDNSY

SEQ ID NO: 2792531 - protein, 22 aa, Entamoeba invadens
GSCAFENCGLTSISIPTSVTQI

SEQ ID NO: 2792532 - protein, 20 aa, Entamoeba invadens
GSCKPCPIVCEKCIRESGVC

SEQ ID NO: 2792533 - protein, 24 aa, Entamoeba invadens
GSCMKENYLLVIIFVTIGSGVLLL

SEQ ID NO: 2792534 - protein, 17 aa, Entamoeba invadens
GSCQICPSSCKQCSTDS

SEQ ID NO: 2792535 - protein, 20 aa, Entamoeba invadens
GSCTKDTFCKYGMTTNTQTC

SEQ ID NO: 2792536 - protein, 17 aa, Entamoeba invadens
GSCTLCHDGYYSTGGTA

SEQ ID NO: 2792537 - protein, 22 aa, Entamoeba invadens
GSCTSCSPGTFSNTTRLSSCYK

SEQ ID NO: 2792538 - protein, 34 aa, Entamoeba invadens
GSDLKDKRGGAILLRFLKYYATEFDSRKFGLSVT

SEQ ID NO: 2792539 - protein, 20 aa, Entamoeba invadens
GSDSFSCSHFTDLATKTCVV

SEQ ID NO: 2792540 - protein, 17 aa, Entamoeba invadens
GSEKLIFVASHPFMLHY

SEQ ID NO: 2792541 - protein, 22 aa, Entamoeba invadens
GSELRLGQKYEEVVHQLSNPKI

SEQ ID NO: 2792542 - protein, 24 aa, Entamoeba invadens
GSELVCKGPTISGGYTTEDIEEEF

SEQ ID NO: 2792543 - protein, 34 aa, Entamoeba invadens
GSENFFKMFRFFETIDQILLFWGLVGSLLVGILD

SEQ ID NO: 2792544 - protein, 18 aa, Entamoeba invadens
GSESCTFTTSSITVTTTL

SEQ ID NO: 2792545 - protein, 18 aa, Entamoeba invadens
GSEYYAFVFFTEDVSGTN

SEQ ID NO: 2792546 - protein, 17 aa, Entamoeba invadens
GSFAINLCLCVTKIVAA

SEQ ID NO: 2792547 - protein, 17 aa, Entamoeba invadens
GSFARFFQNKEPPVVAF

SEQ ID NO: 2792548 - protein, 22 aa, Entamoeba invadens
GSFFEWKIPKKYLLTCFSVVLY

SEQ ID NO: 2792549 - protein, 23 aa, Entamoeba invadens
GSFGDVWRAKWRGENIAVKLIPT

SEQ ID NO: 2792550 - protein, 17 aa, Entamoeba invadens
GSFGDVWSATWKGQEIA

SEQ ID NO: 2792551 - protein, 19 aa, Entamoeba invadens
GSFGIVFKGKYRGNIVAIK

SEQ ID NO: 2792552 - protein, 19 aa, Entamoeba invadens
GSFGIVFKGLYRGKTVAIK

SEQ ID NO: 2792553 - protein, 18 aa, Entamoeba invadens
GSFGIVFKGTYRGNVVAI

SEQ ID NO: 2792554 - protein, 19 aa, Entamoeba invadens
GSFGIVFKGTYRRNVVAIK

SEQ ID NO: 2792555 - protein, 19 aa, Entamoeba invadens
GSFGIVWKGIYRHNIVAIK

SEQ ID NO: 2792556 - protein, 17 aa, Entamoeba invadens
GSFGIVYKGEYRGNVVA

SEQ ID NO: 2792557 - protein, 19 aa, Entamoeba invadens
GSFGIVYKGIFRGESVAIK

SEQ ID NO: 2792558 - protein, 17 aa, Entamoeba invadens
GSFGIVYKGKYRNNDVV

SEQ ID NO: 2792559 - protein, 17 aa, Entamoeba invadens
GSFGIVYKGLFKEKIVA

SEQ ID NO: 2792560 - protein, 18 aa, Entamoeba invadens
GSFGIVYKGMYRGNVVAI

SEQ ID NO: 2792561 - protein, 19 aa, Entamoeba invadens
GSFGIVYKGNFRGHVVAIK

SEQ ID NO: 2792562 - protein, 17 aa, Entamoeba invadens
GSFGIVYKGNFRGNVVA

SEQ ID NO: 2792563 - protein, 17 aa, Entamoeba invadens
GSFGIVYKGSFRGNIVA

SEQ ID NO: 2792564 - protein, 18 aa, Entamoeba invadens
GSFGIVYKGVYRGVDVAI

SEQ ID NO: 2792565 - protein, 17 aa, Entamoeba invadens
GSFGIVYLGDFRGNTVA

SEQ ID NO: 2792566 - protein, 17 aa, Entamoeba invadens
GSFGIVYLGEFRGYKVA

SEQ ID NO: 2792567 - protein, 18 aa, Entamoeba invadens
GSFGIVYLGEFRGYKVAI

SEQ ID NO: 2792568 - protein, 20 aa, Entamoeba invadens
GSFGIVYRGKFRGHEVAIKK

SEQ ID NO: 2792569 - protein, 21 aa, Entamoeba invadens
GSFGIVYRGTYRGNIVAIKKM

SEQ ID NO: 2792570 - protein, 17 aa, Entamoeba invadens
GSFGVIFKGHYRGNKVA

SEQ ID NO: 2792571 - protein, 22 aa, Entamoeba invadens
GSFGVVFKGGFRNNIFGCEYIV

SEQ ID NO: 2792572 - protein, 19 aa, Entamoeba invadens
GSFGVVFKGKFREYDVAIK

SEQ ID NO: 2792573 - protein, 18 aa, Entamoeba invadens
GSFGVVFKGKYRENDVAI

SEQ ID NO: 2792574 - protein, 19 aa, Entamoeba invadens
GSFGVVFKGNYRGNLVAIK

SEQ ID NO: 2792575 - protein, 19 aa, Entamoeba invadens
GSFGVVFKGTFNDQIVAIK

SEQ ID NO: 2792576 - protein, 27 aa, Entamoeba invadens
GSFGVVYKGCYRKYIVAIKKLKDIDDD

SEQ ID NO: 2792577 - protein, 17 aa, Entamoeba invadens
GSFGVVYKGIFRGSVVA

SEQ ID NO: 2792578 - protein, 17 aa, Entamoeba invadens
GSFGVVYKGMFRDNVVA

SEQ ID NO: 2792579 - protein, 18 aa, Entamoeba invadens
GSFGVVYKGVFRGNKVAI

SEQ ID NO: 2792580 - protein, 19 aa, Entamoeba invadens
GSFGVVYKGVFRGNKVAIK

SEQ ID NO: 2792581 - protein, 17 aa, Entamoeba invadens
GSFGVVYQGSFRGNIVA

SEQ ID NO: 2792582 - protein, 24 aa, Entamoeba invadens
GSFLCSACKAGTYTLDRGSVSCYT

SEQ ID NO: 2792583 - protein, 22 aa, Entamoeba invadens
GSFLKKELKNLGVVLVVPILRE

SEQ ID NO: 2792584 - protein, 18 aa, Entamoeba invadens
GSFMGITNFCDLWRTRTV

SEQ ID NO: 2792585 - protein, 23 aa, Entamoeba invadens
GSGCAICKSGYYRSGDGCKMCNT

SEQ ID NO: 2792586 - protein, 19 aa, Entamoeba invadens
GSGCAICNSGYYREGISCI

SEQ ID NO: 2792587 - protein, 22 aa, Entamoeba invadens
GSGCMRCERGTYLSGAACVKCP

SEQ ID NO: 2792588 - protein, 20 aa, Entamoeba invadens
GSGDLGDWFYNYQTIDYGNG

SEQ ID NO: 2792589 - protein, 22 aa, Entamoeba invadens
GSGKSTMMAGIFRIEEPAGGLI

SEQ ID NO: 2792590 - protein, 22 aa, Entamoeba invadens
GSGKSTMMAGLFRIEEPAGGCI

SEQ ID NO: 2792591 - protein, 22 aa, Entamoeba invadens
GSGKSTMMAGLFRIENPAGGRI

SEQ ID NO: 2792592 - protein, 30 aa, Entamoeba invadens
GSGPNNCISCFKNYYLTSGYCSKCDLTCNE

SEQ ID NO: 2792593 - protein, 21 aa, Entamoeba invadens
GSGYSAYWLIPLENPIMGKYV

SEQ ID NO: 2792594 - protein, 21 aa, Entamoeba invadens
GSHCKMCMSNYLLSKNNFCVF

SEQ ID NO: 2792595 - protein, 21 aa, Entamoeba invadens
GSHTWPTWGNKNIVEYYEKQR

SEQ ID NO: 2792596 - protein, 20 aa, Entamoeba invadens
GSHVCLLCEIGFYQDGTNQT

SEQ ID NO: 2792597 - protein, 17 aa, Entamoeba invadens
GSIIRRTGGIGGIVSML

SEQ ID NO: 2792598 - protein, 25 aa, Entamoeba invadens
GSILGRLIGEWMVYFGVSNELGPSG

SEQ ID NO: 2792599 - protein, 21 aa, Entamoeba invadens
GSIRKCYTCQSGYYVSNYQCE

SEQ ID NO: 2792600 - protein, 17 aa, Entamoeba invadens
GSITTNFVKVNDVQNTD

SEQ ID NO: 2792601 - protein, 19 aa, Entamoeba invadens
GSKCDICSNSLLLLNGKCI

SEQ ID NO: 2792602 - protein, 19 aa, Entamoeba invadens
GSKCVGCPIGKYNDQLQQT

SEQ ID NO: 2792603 - protein, 17 aa, Entamoeba invadens
GSKLRYVQSYDEVTEEV

SEQ ID NO: 2792604 - protein, 19 aa, Entamoeba invadens
GSKTCKKCEDGYYTINTGS

SEQ ID NO: 2792605 - protein, 25 aa, Entamoeba invadens
GSLDNCTRCSFKNGYYQDLNTSTLS

SEQ ID NO: 2792606 - protein, 19 aa, Entamoeba invadens
GSLFKYPWNIANFVADGGR

SEQ ID NO: 2792607 - protein, 23 aa, Entamoeba invadens
GSLKRVMETYTWQQVSLKLKIKM

SEQ ID NO: 2792608 - protein, 18 aa, Entamoeba invadens
GSLKSVYIDPKFTTLLGI

SEQ ID NO: 2792609 - protein, 19 aa, Entamoeba invadens
GSLKVGKGQCKFIDTDIMF

SEQ ID NO: 2792610 - protein, 19 aa, Entamoeba invadens
GSLLCSFKTTEKCDKTYYV

SEQ ID NO: 2792611 - protein, 22 aa, Entamoeba invadens
GSLLFGVITKLVYNYLTTQEKL

SEQ ID NO: 2792612 - protein, 28 aa, Entamoeba invadens
GSLLIGLVCSISFTFFCGVHPTSFLLIL

SEQ ID NO: 2792613 - protein, 17 aa, Entamoeba invadens
GSLMCSELIIGGETHIV

SEQ ID NO: 2792614 - protein, 18 aa, Entamoeba invadens
GSLPQMGVLEMKKNKSSG

SEQ ID NO: 2792615 - protein, 22 aa, Entamoeba invadens
GSMCTMCNVGLFLTPEGECIPC

SEQ ID NO: 2792616 - protein, 18 aa, Entamoeba invadens
GSNGLFWSVPVMCTDVLV

SEQ ID NO: 2792617 - protein, 18 aa, Entamoeba invadens
GSNNFKLSSTLTQKPTAT

SEQ ID NO: 2792618 - protein, 22 aa, Entamoeba invadens
GSQEWKMPKGFLFDYITCANYF

SEQ ID NO: 2792619 - protein, 24 aa, Entamoeba invadens
GSQFEISNGLFFYRGNSSEQEKMK

SEQ ID NO: 2792620 - protein, 21 aa, Entamoeba invadens
GSQFKCSGFFTGIIEGNAKIT

SEQ ID NO: 2792621 - protein, 26 aa, Entamoeba invadens
GSRFGIPYQYSLIVLLVFQACAIGSL

SEQ ID NO: 2792622 - protein, 20 aa, Entamoeba invadens
GSRMSIWSFLDWLQQGIWQS

SEQ ID NO: 2792623 - protein, 17 aa, Entamoeba invadens
GSRMYQVRMRYFDENNK

SEQ ID NO: 2792624 - protein, 17 aa, Entamoeba invadens
GSSACKICNSTCATCDI

SEQ ID NO: 2792625 - protein, 26 aa, Entamoeba invadens
GSSECSACPNGTVTEDSITCKIDELA

SEQ ID NO: 2792626 - protein, 25 aa, Entamoeba invadens
GSSGCRTCSISCKMCDQTNGNCLSC

SEQ ID NO: 2792627 - protein, 22 aa, Entamoeba invadens
GSSITPAWLRLFYDTPNSPTMS

SEQ ID NO: 2792628 - protein, 21 aa, Entamoeba invadens
GSSKCKVCTAGTYATNGAATC

SEQ ID NO: 2792629 - protein, 26 aa, Entamoeba invadens
GSSNQCTSCVIGIRYLENGYCKSCDS

SEQ ID NO: 2792630 - protein, 26 aa, Entamoeba invadens
GSSSTCLSCKYGTYLVGSFCVTCDTN

SEQ ID NO: 2792631 - protein, 21 aa, Entamoeba invadens
GSSTCKKCIGCLNCDNQNGEC

SEQ ID NO: 2792632 - protein, 22 aa, Entamoeba invadens
GSSTCKSCATGYFANSTGTINC

SEQ ID NO: 2792633 - protein, 24 aa, Entamoeba invadens
GSSTCLSCSPGTYSSKGAAFCLNC

SEQ ID NO: 2792634 - protein, 19 aa, Entamoeba invadens
GSSVCSICVTETCSSCNNQ

SEQ ID NO: 2792635 - protein, 22 aa, Entamoeba invadens
GSTEFTCDGVVRIVKETEAYKY

SEQ ID NO: 2792636 - protein, 23 aa, Entamoeba invadens
GSTFGKFLYRFCFFILSERIGLK

SEQ ID NO: 2792637 - protein, 27 aa, Entamoeba invadens
GSTGLLFFFVFCAFWIGYIYGSKRVQD

SEQ ID NO: 2792638 - protein, 20 aa, Entamoeba invadens
GSTIPLILFVFGFMMPIVWI

SEQ ID NO: 2792639 - protein, 19 aa, Entamoeba invadens
GSTIVPLTCKSYRELQLFI

SEQ ID NO: 2792640 - protein, 18 aa, Entamoeba invadens
GSTLKTKKIWNFTCNATG

SEQ ID NO: 2792641 - protein, 21 aa, Entamoeba invadens
GSTSCKLCDAGTYSSNDGASS

SEQ ID NO: 2792642 - protein, 21 aa, Entamoeba invadens
GSTSCSICSVGKYSSSGSSSC

SEQ ID NO: 2792643 - protein, 20 aa, Entamoeba invadens
GSTTKCSLCTNGMSTDTSLD

SEQ ID NO: 2792644 - protein, 20 aa, Entamoeba invadens
GSVCAICNSGYYREGISCTS

SEQ ID NO: 2792645 - protein, 30 aa, Entamoeba invadens
GSVKSAYLKPEFTELLGMKCLSDCAKGMRF

SEQ ID NO: 2792646 - protein, 26 aa, Entamoeba invadens
GSVLDRLRLAANYYKLCDVNFCIAVY

SEQ ID NO: 2792647 - protein, 24 aa, Entamoeba invadens
GSVLPYCLGKLFGKELAEAYSKKN

SEQ ID NO: 2792648 - protein, 26 aa, Entamoeba invadens
GSVRMPRIIGMVVEYAPFGSLRSVFM

SEQ ID NO: 2792649 - protein, 25 aa, Entamoeba invadens
GSVSCLRKKVRACPNGYYLSGTLCK

SEQ ID NO: 2792650 - protein, 18 aa, Entamoeba invadens
GSYFTYYIIIKKRNEKYQ

SEQ ID NO: 2792651 - protein, 23 aa, Entamoeba invadens
GSYLLVCVAIAVLIRIYSVLRYE

SEQ ID NO: 2792652 - protein, 17 aa, Entamoeba invadens
GSYSFSVIGSLLQWFFN

SEQ ID NO: 2792653 - protein, 19 aa, Entamoeba invadens
GSYSYSSICKMFVGTNDST

SEQ ID NO: 2792654 - protein, 24 aa, Entamoeba invadens
GSYVCILVGLYAFAAFLSLALVFF

SEQ ID NO: 2792655 - protein, 25 aa, Entamoeba invadens
GTAGCKITAIGGHGEYVFSVDGESV

SEQ ID NO: 2792656 - protein, 19 aa, Entamoeba invadens
GTCAIFICLVFCGRVILVY

SEQ ID NO: 2792657 - protein, 18 aa, Entamoeba invadens
GTCIQCMDGYGFNETNEC

SEQ ID NO: 2792658 - protein, 21 aa, Entamoeba invadens
GTCISCLMGYVLYEVASKTCQ

SEQ ID NO: 2792659 - protein, 17 aa, Entamoeba invadens
GTCKVSTSCLSCNSEYY

SEQ ID NO: 2792660 - protein, 18 aa, Entamoeba invadens
GTCKVSTSCLTCHTDYYM

SEQ ID NO: 2792661 - protein, 20 aa, Entamoeba invadens
GTCNKCPQGFYIDYNNRCQK

SEQ ID NO: 2792662 - protein, 19 aa, Entamoeba invadens
GTCSACNTIKGCGKCKSAT

SEQ ID NO: 2792663 - protein, 19 aa, Entamoeba invadens
GTCSGCNTIKGCGKCKSAT

SEQ ID NO: 2792664 - protein, 18 aa, Entamoeba invadens
GTCTKCNYTNWVITNPLS

SEQ ID NO: 2792665 - protein, 18 aa, Entamoeba invadens
GTCTLCLSNYVVTSPLSQ

SEQ ID NO: 2792666 - protein, 18 aa, Entamoeba invadens
GTCTLCLSNYVVTSPLSY

SEQ ID NO: 2792667 - protein, 20 aa, Entamoeba invadens
GTCTTCGSGYYLESNKCIRI

SEQ ID NO: 2792668 - protein, 24 aa, Entamoeba invadens
GTCVDGLSCLSCRNEYFKLSGSEN

SEQ ID NO: 2792669 - protein, 22 aa, Entamoeba invadens
GTCVKCSLKYGELCDVCDDKKC

SEQ ID NO: 2792670 - protein, 24 aa, Entamoeba invadens
GTDSKCLPCPKGTFSSKEKSSSCI

SEQ ID NO: 2792671 - protein, 20 aa, Entamoeba invadens
GTECPCRGVEGCVLDYTEFP

SEQ ID NO: 2792672 - protein, 22 aa, Entamoeba invadens
GTEGKSYYGIMMLYENNEIIRT

SEQ ID NO: 2792673 - protein, 26 aa, Entamoeba invadens
GTEGLRWMKNRCDSIESILETKDEEL

SEQ ID NO: 2792674 - protein, 19 aa, Entamoeba invadens
GTEKMARCDIANEFGCERC

SEQ ID NO: 2792675 - protein, 24 aa, Entamoeba invadens
GTEWRKEDAMFMMPIANILIKTFY

SEQ ID NO: 2792676 - protein, 17 aa, Entamoeba invadens
GTFACLRNLFTNQTMKV

SEQ ID NO: 2792677 - protein, 24 aa, Entamoeba invadens
GTFCKIKAVWWMIIVIVVVCILLI

SEQ ID NO: 2792678 - protein, 18 aa, Entamoeba invadens
GTFCKTKAVWWLILLCII

SEQ ID NO: 2792679 - protein, 23 aa, Entamoeba invadens
GTFFPMPISMMFDERVDAGAAVA

SEQ ID NO: 2792680 - protein, 24 aa, Entamoeba invadens
GTFFPMPISMMFDERVDAGAAVAF

SEQ ID NO: 2792681 - protein, 17 aa, Entamoeba invadens
GTFGIVYFGEFRGDKVA

SEQ ID NO: 2792682 - protein, 24 aa, Entamoeba invadens
GTFGIVYKARWRRQDVAVKMVKTD

SEQ ID NO: 2792683 - protein, 24 aa, Entamoeba invadens
GTFGTVFRAEWRGVDVAVKQMKTD

SEQ ID NO: 2792684 - protein, 17 aa, Entamoeba invadens
GTFGVVYFGKFHGHDVA

SEQ ID NO: 2792685 - protein, 19 aa, Entamoeba invadens
GTFGVVYYGTFRGNKVAIK

SEQ ID NO: 2792686 - protein, 31 aa, Entamoeba invadens; identical to SEQ ID NO: 2739430

SEQ ID NO: 2792687 - protein, 17 aa, Entamoeba invadens
GTFKCNILYSQCENGTF

SEQ ID NO: 2792688 - protein, 17 aa, Entamoeba invadens
GTFLPFLFCTTDQTQHI

SEQ ID NO: 2792689 - protein, 23 aa, Entamoeba invadens
GTFNVKYNLEFNGNAATDNTEDA

SEQ ID NO: 2792690 - protein, 18 aa, Entamoeba invadens
GTGVKWYTIKVMKNEKRV

SEQ ID NO: 2792691 - protein, 20 aa, Entamoeba invadens
GTHFIKRWADILKIKTTTTK

SEQ ID NO: 2792692 - protein, 23 aa, Entamoeba invadens
GTHLGELLDLVWKNEERQNSLLR

SEQ ID NO: 2792693 - protein, 19 aa, Entamoeba invadens
GTHWEYSGNVIKRNFFHDS

SEQ ID NO: 2792694 - protein, 24 aa, Entamoeba invadens
GTIDCTLCPLGYYSNGGASQCTAC

SEQ ID NO: 2792695 - protein, 20 aa, Entamoeba invadens
GTIDDCLTCRNGYYMSGSST

SEQ ID NO: 2792696 - protein, 22 aa, Entamoeba invadens
GTIKDTVCRYAIQTGHRVDRKF

SEQ ID NO: 2792697 - protein, 24 aa, Entamoeba invadens
GTIKIVVSGWIYTRHITLEEDIRF

SEQ ID NO: 2792698 - protein, 19 aa, Entamoeba invadens
GTILFKDRAVIEIKNNLYA

SEQ ID NO: 2792699 - protein, 17 aa, Entamoeba invadens
GTILLFILIGDRQLKKA

SEQ ID NO: 2792700 - protein, 19 aa, Entamoeba invadens
GTKCTSCSFTEYKRSEYEC

SEQ ID NO: 2792701 - protein, 25 aa, Entamoeba invadens
GTKKYAKARFDCMVSTCGNKKWEKG

SEQ ID NO: 2792702 - protein, 20 aa, Entamoeba invadens
GTKLVCPIDFSGNFTDEVTD

SEQ ID NO: 2792703 - protein, 23 aa, Entamoeba invadens
GTKSRLTIMGDLVFDSDYTMPYV

SEQ ID NO: 2792704 - protein, 23 aa, Entamoeba invadens
GTKYGKCYSCMNGYYLFNESCLK

SEQ ID NO: 2792705 - protein, 24 aa, Entamoeba invadens
GTLAIPLAFQFSGYVGGPVLLLVA

SEQ ID NO: 2792706 - protein, 24 aa, Entamoeba invadens
GTLLAEYFLNAGIVHYALEYYKTN

SEQ ID NO: 2792707 - protein, 26 aa, Entamoeba invadens
GTLLIPLVIQFLIKWVQSTTFEIYVG

SEQ ID NO: 2792708 - protein, 19 aa, Entamoeba invadens
GTLLSCGRRVFYVESLLNG

SEQ ID NO: 2792709 - protein, 24 aa, Entamoeba invadens
GTLVKLMINGAVNFGNIHSPNTIY

SEQ ID NO: 2792710 - protein, 19 aa, Entamoeba invadens
GTMCKPCSPQCGKCYDSSS

SEQ ID NO: 2792711 - protein, 17 aa, Entamoeba invadens
GTNCATVLEDARISSSL

SEQ ID NO: 2792712 - protein, 25 aa, Entamoeba invadens
GTNCDKYCRCFEGFKTDPNNPTSCI

SEQ ID NO: 2792713 - protein, 24 aa, Entamoeba invadens
GTNCDSQCRCVEGFVPDPTDPLSC

SEQ ID NO: 2792714 - protein, 17 aa, Entamoeba invadens
GTNEIRRKLVFLKNLKD

SEQ ID NO: 2792715 - protein, 24 aa, Entamoeba invadens
GTNGSFCTIIRCTKSCTIKNSNFE

SEQ ID NO: 2792716 - protein, 24 aa, Entamoeba invadens
GTNIISSLHWRRIIKKYFAPLQIL

SEQ ID NO: 2792717 - protein, 24 aa, Entamoeba invadens
GTNTCSFSGASVCSSCTSSSCSSC

SEQ ID NO: 2792718 - protein, 17 aa, Entamoeba invadens
GTPELFNEVPFVIHNVI

SEQ ID NO: 2792719 - protein, 20 aa, Entamoeba invadens
GTPNLRRKAFPEINSVMPSY

SEQ ID NO: 2792720 - protein, 17 aa, Entamoeba invadens
GTPPFNAYHSFSYSYNS

SEQ ID NO: 2792721 - protein, 18 aa, Entamoeba invadens
GTQCLSCHNGKFLTNYEC

SEQ ID NO: 2792722 - protein, 23 aa, Entamoeba invadens
GTQSCTLCRAGYYSLGGASVCSS

SEQ ID NO: 2792723 - protein, 17 aa, Entamoeba invadens
GTRNCDQYCHCTSGNVL

SEQ ID NO: 2792724 - protein, 25 aa, Entamoeba invadens
GTSCAKKAVWWVIFIGVFLIILVLF

SEQ ID NO: 2792725 - protein, 24 aa, Entamoeba invadens
GTSCEFCGYGCLVGMCDQTKDGYY

SEQ ID NO: 2792726 - protein, 24 aa, Entamoeba invadens
GTSCTKKAVWWVLFIIVLFVIVVL

SEQ ID NO: 2792727 - protein, 21 aa, Entamoeba invadens
GTSECKMCSAGTFSLSGATIC

SEQ ID NO: 2792728 - protein, 29 aa, Entamoeba invadens
GTSKIRVCSISFLRTVPWSKQEDKPLLYQ

SEQ ID NO: 2792729 - protein, 23 aa, Entamoeba invadens
GTSYCDMCPLGFYQSLEGQSECY

SEQ ID NO: 2792730 - protein, 19 aa, Entamoeba invadens
GTTEANIWNFFMRRHSIWV

SEQ ID NO: 2792731 - protein, 23 aa, Entamoeba invadens
GTTITAPIKICFETEATSHLDPN

SEQ ID NO: 2792732 - protein, 17 aa, Entamoeba invadens
GTTLDCTYHSGNFKELD

SEQ ID NO: 2792733 - protein, 26 aa, Entamoeba invadens
GTTPLKNLEMMLAFPEVRCKSPEVVD

SEQ ID NO: 2792734 - protein, 26 aa, Entamoeba invadens
GTTWFKGNGIVLPWYITFIENWREAL

SEQ ID NO: 2792735 - protein, 17 aa, Entamoeba invadens
GTVGCFECECIKGYHRK

SEQ ID NO: 2792736 - protein, 27 aa, Entamoeba invadens
GTVTFQRFSGLHSFGYFNFNSVNVNAM

SEQ ID NO: 2792737 - protein, 18 aa, Entamoeba invadens
GTWFLFDIAFYGNSMSNA

SEQ ID NO: 2792738 - protein, 26 aa, Entamoeba invadens
GTYAGEGFSECKICGEMTYSTVGSSS

SEQ ID NO: 2792739 - protein, 23 aa, Entamoeba invadens
GTYAGSVSFIYIIPISTAFVNFL

SEQ ID NO: 2792740 - protein, 30 aa, Entamoeba invadens
GTYCLRHSVWWVIFICVMFLVGVTSLMVLI

SEQ ID NO: 2792741 - protein, 29 aa, Entamoeba invadens
GTYIKEGTCSVCGTSCNKCYNKDTCLACN

SEQ ID NO: 2792742 - protein, 18 aa, Entamoeba invadens
GTYNLRYFIQFLMLLPSN

SEQ ID NO: 2792743 - protein, 18 aa, Entamoeba invadens
GTYPECNKCLTGCKDCSD

SEQ ID NO: 2792744 - protein, 18 aa, Entamoeba invadens
GTYYNLVKRQSLEEEADQ

SEQ ID NO: 2792745 - protein, 17 aa, Entamoeba invadens
GVACEFSIYLTPNYSSN

SEQ ID NO: 2792746 - protein, 18 aa, Entamoeba invadens
GVACFILHFCFFVLSEQQ

SEQ ID NO: 2792747 - protein, 22 aa, Entamoeba invadens
GVAMTAELTTLLSLGDHFHETT

SEQ ID NO: 2792748 - protein, 24 aa, Entamoeba invadens
GVAQKCPKPIYAKGAEKGSGHNTT

SEQ ID NO: 2792749 - protein, 26 aa, Entamoeba invadens
GVCDFIQKDCEKYATGNFSDLIVQSK

SEQ ID NO: 2792750 - protein, 20 aa, Entamoeba invadens
GVCLSCTSGYYLDATKKCVL

SEQ ID NO: 2792751 - protein, 19 aa, Entamoeba invadens
GVCMSCPAGHYFYLNECLD

SEQ ID NO: 2792752 - protein, 19 aa, Entamoeba invadens
GVCSLCISGTMANQTTNTC

SEQ ID NO: 2792753 - protein, 20 aa, Entamoeba invadens
GVCSLCYSGYTLRNGSCVEC

SEQ ID NO: 2792754 - protein, 20 aa, Entamoeba invadens
GVCSQCPDMTYSSSGSVNCL

SEQ ID NO: 2792755 - protein, 20 aa, Entamoeba invadens
GVCSTCKSGYTFKNSSYCEK

SEQ ID NO: 2792756 - protein, 20 aa, Entamoeba invadens
GVCSTCKSGYTLKNSSYCES

SEQ ID NO: 2792757 - protein, 19 aa, Entamoeba invadens
GVCTCKFGLDNSTKCRECV

SEQ ID NO: 2792758 - protein, 21 aa, Entamoeba invadens
GVCTKCPVGYFGVGGILTCQK

SEQ ID NO: 2792759 - protein, 21 aa, Entamoeba invadens
GVCVFPMKKSNILMKVLGNNI

SEQ ID NO: 2792760 - protein, 18 aa, Entamoeba invadens
GVCVLCEDTFILKNEKCI

SEQ ID NO: 2792761 - protein, 32 aa, Entamoeba invadens
GVDIFYYLAMQPWRHFVWTQKEGNDWVTKTMN

SEQ ID NO: 2792762 - protein, 18 aa, Entamoeba invadens
GVDSIYLCYTEEKDFQQQ

SEQ ID NO: 2792763 - protein, 24 aa, Entamoeba invadens
GVDTFKYKLVFRPKSGRLKPHREI

SEQ ID NO: 2792764 - protein, 24 aa, Entamoeba invadens
GVDVCLKCGGGYYLINGKCDTIPQ

SEQ ID NO: 2792765 - protein, 24 aa, Entamoeba invadens
GVDVCLKCGGGYYLINGKCGTIPR

SEQ ID NO: 2792766 - protein, 17 aa, Entamoeba invadens
GVEGCVLDYTEFPDRDL

SEQ ID NO: 2792767 - protein, 25 aa, Entamoeba invadens
GVELTKRIPLIFSTALSTWIDDSSI

SEQ ID NO: 2792768 - protein, 20 aa, Entamoeba invadens
GVEQCTKCRDSFVLFENSCK

SEQ ID NO: 2792769 - protein, 20 aa, Entamoeba invadens
GVEVMMLLLLDEDKENVNKS

SEQ ID NO: 2792770 - protein, 19 aa, Entamoeba invadens
GVFAGLVYVSFKMTRKPKK

SEQ ID NO: 2792771 - protein, 18 aa, Entamoeba invadens
GVFCMPRLGGETFGALNG

SEQ ID NO: 2792772 - protein, 20 aa, Entamoeba invadens
GVFECTKLSKAIRWLNTRPT

SEQ ID NO: 2792773 - protein, 23 aa, Entamoeba invadens
GVFETCLKQGWLHLTDENEYDYF

SEQ ID NO: 2792774 - protein, 25 aa, Entamoeba invadens
GVFEVFCVVFVFPVIILIAIGSPTK

SEQ ID NO: 2792775 - protein, 22 aa, Entamoeba invadens
GVFFKYELSPYIVINEMMDHSF

SEQ ID NO: 2792776 - protein, 18 aa, Entamoeba invadens
GVFFPVNFYLSLSNTEVT

SEQ ID NO: 2792777 - protein, 20 aa, Entamoeba invadens
GVFGLRIAKMPTRNNTSPST

SEQ ID NO: 2792778 - protein, 17 aa, Entamoeba invadens
GVFGTSFRSLVYINCYP

SEQ ID NO: 2792779 - protein, 42 aa, Entamoeba invadens
GVFSYLMCILICFFTSFFGCCCIGLIFLCIPLVQTAVHSCPE

SEQ ID NO: 2792780 - protein, 20 aa, Entamoeba invadens
GVGAWAFPDSIRVYRQYTKT

SEQ ID NO: 2792781 - protein, 19 aa, Entamoeba invadens
GVGFCPSFGHLQALCIDGI

SEQ ID NO: 2792782 - protein, 24 aa, Entamoeba invadens
GVGFFKVVPLISVQFFAFDQYKKF

SEQ ID NO: 2792783 - protein, 29 aa, Entamoeba invadens
GVGNVRFFVCFLVSFAISLLLAFVVTAPL

SEQ ID NO: 2792784 - protein, 17 aa, Entamoeba invadens
GVGSIIGKVFWPVSYLL

SEQ ID NO: 2792785 - protein, 18 aa, Entamoeba invadens
GVGTPSFMVPEILNGQKY

SEQ ID NO: 2792786 - protein, 19 aa, Entamoeba invadens
GVHYNCLNYITSGLNYLNV

SEQ ID NO: 2792787 - protein, 26 aa, Entamoeba invadens
GVIGKRYICDVLKYLSVMLSIQQIHN

SEQ ID NO: 2792788 - protein, 29 aa, Entamoeba invadens
GVIGLLCLPMTFLAGLWGMNVRVPGQEVA

SEQ ID NO: 2792789 - protein, 20 aa, Entamoeba invadens
GVILAFRTTQDWYNNNNVGF

SEQ ID NO: 2792790 - protein, 25 aa, Entamoeba invadens
GVINRCEYCRAFINPFVNWQVPGTR

SEQ ID NO: 2792791 - protein, 17 aa, Entamoeba invadens
GVIRPIPLNMGGVSETT

SEQ ID NO: 2792792 - protein, 18 aa, Entamoeba invadens
GVITELKGMYEYRHILCI

SEQ ID NO: 2792793 - protein, 22 aa, Entamoeba invadens
GVKCTKCNFGSYIENGKCVEVK

SEQ ID NO: 2792794 - protein, 24 aa, Entamoeba invadens
GVKFIYRMTLLLTAFVIPEDQNKF

SEQ ID NO: 2792795 - protein, 19 aa, Entamoeba invadens
GVKIPFSLKSVSAVVSHTK

SEQ ID NO: 2792796 - protein, 26 aa, Entamoeba invadens
GVLCRKCGSGVIFGKCDICSSGCIHC

SEQ ID NO: 2792797 - protein, 18 aa, Entamoeba invadens
GVLDPTKFIDFFKFKTQN

SEQ ID NO: 2792798 - protein, 19 aa, Entamoeba invadens
GVLEIKDGIELTCTNVDNK

SEQ ID NO: 2792799 - protein, 17 aa, Entamoeba invadens
GVLHYRTQPSYYLHGAL

SEQ ID NO: 2792800 - protein, 19 aa, Entamoeba invadens
GVLKAFAFLFEYIGEKSKD

SEQ ID NO: 2792801 - protein, 22 aa, Entamoeba invadens
GVLKIYGLDFDCCSMHFRTVPA

SEQ ID NO: 2792802 - protein, 17 aa, Entamoeba invadens
GVLKRLNERYHILTQAD

SEQ ID NO: 2792803 - protein, 26 aa, Entamoeba invadens
GVLLPLPVIYCRSGVYNRTSKLCESQ

SEQ ID NO: 2792804 - protein, 20 aa, Entamoeba invadens
GVLSCKSCGTGCGTCSSASA

SEQ ID NO: 2792805 - protein, 18 aa, Entamoeba invadens
GVMALILMDQRPVLKKED

SEQ ID NO: 2792806 - protein, 25 aa, Entamoeba invadens
GVMLSCLYLAYDIHPLYDFTSSNLF

SEQ ID NO: 2792807 - protein, 24 aa, Entamoeba invadens
GVNFAKIGIFGSHFVSHGYAVHGF

SEQ ID NO: 2792808 - protein, 23 aa, Entamoeba invadens
GVNSCASCSISSQNLANNTNWLA

SEQ ID NO: 2792809 - protein, 19 aa, Entamoeba invadens
GVPCFPCNNTCLFGTAVSN

SEQ ID NO: 2792810 - protein, 29 aa, Entamoeba invadens
GVPSPWLQVRILRILRYIPPKKGAEENYL

SEQ ID NO: 2792811 - protein, 19 aa, Entamoeba invadens
GVPVIVIAIFLIVMVILII

SEQ ID NO: 2792812 - protein, 21 aa, Entamoeba invadens
GVSFLPLLGLIGVEGILCVVL

SEQ ID NO: 2792813 - protein, 20 aa, Entamoeba invadens
GVSFPNFLIFVILFFVFHIL

SEQ ID NO: 2792814 - protein, 19 aa, Entamoeba invadens
GVSIFPFFICIFATHNNLS

SEQ ID NO: 2792815 - protein, 19 aa, Entamoeba invadens
GVSKMLFKIIATIPYVGLV

SEQ ID NO: 2792816 - protein, 18 aa, Entamoeba invadens
GVSLPIFKVNAIKFENQE

SEQ ID NO: 2792817 - protein, 17 aa, Entamoeba invadens
GVSPSLFPIISNIIPPH

SEQ ID NO: 2792818 - protein, 24 aa, Entamoeba invadens
GVTEMCKYVRLFRSFCPSESLVML

SEQ ID NO: 2792819 - protein, 21 aa, Entamoeba invadens
GVTFYEGFGWVEAFADVEYTF

SEQ ID NO: 2792820 - protein, 23 aa, Entamoeba invadens
GVTLYECLSWSLAYQPPQFKFPW

SEQ ID NO: 2792821 - protein, 24 aa, Entamoeba invadens
GVTLYECLSWSLAYQPPQFKFPWE

SEQ ID NO: 2792822 - protein, 22 aa, Entamoeba invadens
GVTMYEIFGWCEAYPVKQFKFP

SEQ ID NO: 2792823 - protein, 25 aa, Entamoeba invadens
GVTTYYPLNVCTYVASSYQKYEKVD

SEQ ID NO: 2792824 - protein, 20 aa, Entamoeba invadens
GVVETKCLLRTNRGCSHCSD

SEQ ID NO: 2792825 - protein, 23 aa, Entamoeba invadens
GVVFGIPIVSVFIIVLIIVGIII

SEQ ID NO: 2792826 - protein, 27 aa, Entamoeba invadens
GVVFVVLSLWWFYKAVTFNGYVLKGDH

SEQ ID NO: 2792827 - protein, 25 aa, Entamoeba invadens
GVVGVKIGRELLKCVTRALTQNLGL

SEQ ID NO: 2792828 - protein, 17 aa, Entamoeba invadens
GVVKLSEQCFRGYKEVD

SEQ ID NO: 2792829 - protein, 19 aa, Entamoeba invadens
GVVKVLFSGSVPSLSSIQY

SEQ ID NO: 2792830 - protein, 28 aa, Entamoeba invadens
GVVLQFKLKMQILKDVSKGMSFLHENSI

SEQ ID NO: 2792831 - protein, 20 aa, Entamoeba invadens
GVVNVKYFICAGNLVQSVLK

SEQ ID NO: 2792832 - protein, 17 aa, Entamoeba invadens
GVVRFFYSFSVGVFLSK

SEQ ID NO: 2792833 - protein, 26 aa, Entamoeba invadens
GVVYAGLGAAIGIFLGMIADTLLVII

SEQ ID NO: 2792834 - protein, 18 aa, Entamoeba invadens
GVVYKGTYRRNIVAIKKM

SEQ ID NO: 2792835 - protein, 18 aa, Entamoeba invadens
GVVYKGVYRRNIVAVKQV

SEQ ID NO: 2792836 - protein, 20 aa, Entamoeba invadens
GVWQRTAKRIGIDMSGTNPL

SEQ ID NO: 2792837 - protein, 24 aa, Entamoeba invadens
GVWSESRVGSGVFDYAYDTSRYCS

SEQ ID NO: 2792838 - protein, 17 aa, Entamoeba invadens
GVWYKYTATVLGKLHVN

SEQ ID NO: 2792839 - protein, 19 aa, Entamoeba invadens
GVYAFAGLFVFLTGLIHLC

SEQ ID NO: 2792840 - protein, 20 aa, Entamoeba invadens
GVYQRNMTGFSFHDEPLGTD

SEQ ID NO: 2792841 - protein, 26 aa, Entamoeba invadens
GWAVGVCIVCGVLFICIVLLILFVLY

SEQ ID NO: 2792842 - protein, 30 aa, Entamoeba invadens
GWCKAYPMELFRYSWMIAEFVSDNKRMEKS

SEQ ID NO: 2792843 - protein, 23 aa, Entamoeba invadens
GWCNSCLKGSYMSEGKCLSCSNK

SEQ ID NO: 2792844 - protein, 27 aa, Entamoeba invadens
GWCTAFVECRYVWNIAEKAARGERPPF

SEQ ID NO: 2792845 - protein, 19 aa, Entamoeba invadens
GWDDYKLLRPKREELDLER

SEQ ID NO: 2792846 - protein, 31 aa, Entamoeba invadens
GWECGYRIVFFIHKLLLGCSLYDSVKYNKEE

SEQ ID NO: 2792847 - protein, 17 aa, Entamoeba invadens
GWECTFPGCNSGPKTKY

SEQ ID NO: 2792848 - protein, 18 aa, Entamoeba invadens
GWEEKGKGITFVDKTTLE

SEQ ID NO: 2792849 - protein, 20 aa, Entamoeba invadens
GWFNFAMVVFFFFVSSFLLL

SEQ ID NO: 2792850 - protein, 24 aa, Entamoeba invadens
GWMGNGYIKFSTVFRGLSAGIILG

SEQ ID NO: 2792851 - protein, 29 aa, Entamoeba invadens
GWNMFGVVYEVFFSSTFYLSICVVPILCV

SEQ ID NO: 2792852 - protein, 19 aa, Entamoeba invadens
GWQQYFMIIGAFFWLAVCI

SEQ ID NO: 2792853 - protein, 27 aa, Entamoeba invadens
GWVAKAVCTRSNFKRIMLFKENEITGG

SEQ ID NO: 2792854 - protein, 17 aa, Entamoeba invadens
GWVFPGELFTVTVPQDL

SEQ ID NO: 2792855 - protein, 17 aa, Entamoeba invadens
GWVVKAFDSCWVTGIAL

SEQ ID NO: 2792856 - protein, 20 aa, Entamoeba invadens
GYACEFEIFLTPRCTCKIHE

SEQ ID NO: 2792857 - protein, 23 aa, Entamoeba invadens
GYACELRMYITVFCTTHIKEEIA

SEQ ID NO: 2792858 - protein, 17 aa, Entamoeba invadens
GYAKLTLINNATFTSTS

SEQ ID NO: 2792859 - protein, 22 aa, Entamoeba invadens
GYCKSCKLNYVFNANNKKICSP

SEQ ID NO: 2792860 - protein, 19 aa, Entamoeba invadens
GYCLTCKSGYYNLNGECDY

SEQ ID NO: 2792861 - protein, 17 aa, Entamoeba invadens
GYCRSSCPDGYYENIKV

SEQ ID NO: 2792862 - protein, 18 aa, Entamoeba invadens
GYCRSSCPDGYYENIKVC

SEQ ID NO: 2792863 - protein, 18 aa, Entamoeba invadens
GYCSQCLLNYIVTSPISK

SEQ ID NO: 2792864 - protein, 20 aa, Entamoeba invadens
GYCTSCAPGYVLVLNKDSLT

SEQ ID NO: 2792865 - protein, 21 aa, Entamoeba invadens
GYCTSCGLGMGITTTTCSVCS

SEQ ID NO: 2792866 - protein, 22 aa, Entamoeba invadens
GYCTSCKLGYVLKLDSNSLKCE

SEQ ID NO: 2792867 - protein, 23 aa, Entamoeba invadens
GYCVFMFPKRDYHWFLLGVTTVI

SEQ ID NO: 2792868 - protein, 23 aa, Entamoeba invadens
GYCYKCAMGYTKLPNEKSRNCQQ

SEQ ID NO: 2792869 - protein, 26 aa, Entamoeba invadens
GYDCGVYMLYFIKKFIIYTPDTNEKF

SEQ ID NO: 2792870 - protein, 27 aa, Entamoeba invadens
GYDIFYYLAMQPWRHFVWTRKEGDTWV

SEQ ID NO: 2792871 - protein, 26 aa, Entamoeba invadens
GYDSNIRYGIVWGISDKGVLKSAQDA

SEQ ID NO: 2792872 - protein, 18 aa, Entamoeba invadens
GYEIFNNKCALICDPNEQ

SEQ ID NO: 2792873 - protein, 22 aa, Entamoeba invadens
GYFCNHPFWVVNGFLKSHPEMS

SEQ ID NO: 2792874 - protein, 18 aa, Entamoeba invadens
GYFGMGGGALVFVALTIY

SEQ ID NO: 2792875 - protein, 20 aa, Entamoeba invadens
GYFLSNGRCSKCFETCIKCT

SEQ ID NO: 2792876 - protein, 23 aa, Entamoeba invadens
GYFNLGNLFGFTTMKPHYNEQMK

SEQ ID NO: 2792877 - protein, 18 aa, Entamoeba invadens
GYGIELFSGSIFSVEDGK

SEQ ID NO: 2792878 - protein, 18 aa, Entamoeba invadens
GYGNPLFVGSRGFTIDVQ

SEQ ID NO: 2792879 - protein, 19 aa, Entamoeba invadens
GYGYDSGICTLCHDGYYST

SEQ ID NO: 2792880 - protein, 24 aa, Entamoeba invadens
GYHNFRYFFLFLFYLWVSVLFVVF

SEQ ID NO: 2792881 - protein, 25 aa, Entamoeba invadens
GYHNYRYFFLFLFYVEVGLLCLDFN

SEQ ID NO: 2792882 - protein, 33 aa, Entamoeba invadens
GYIGCAICKDGFFKLRLDCEFCDKSCKQCHNNH

SEQ ID NO: 2792883 - protein, 18 aa, Entamoeba invadens
GYIKLFKMVDGISESDFR

SEQ ID NO: 2792884 - protein, 25 aa, Entamoeba invadens
GYIPFPVIRRFGSFFSPYVVIPWFF

SEQ ID NO: 2792885 - protein, 22 aa, Entamoeba invadens
GYIRLNLDCVMNMYNNSRVFAD

SEQ ID NO: 2792886 - protein, 19 aa, Entamoeba invadens
GYISFRVLIDVSVTSVFFC

SEQ ID NO: 2792887 - protein, 24 aa, Entamoeba invadens
GYKAPERYLYALGFGSAGVLFLYC

SEQ ID NO: 2792888 - protein, 20 aa, Entamoeba invadens
GYKDIYILFVRLFILHIKVL

SEQ ID NO: 2792889 - protein, 20 aa, Entamoeba invadens
GYKILLEVLVKTHAKHVVEV

SEQ ID NO: 2792890 - protein, 19 aa, Entamoeba invadens
GYLLVLIPSFCDFAATYLM

SEQ ID NO: 2792891 - protein, 18 aa, Entamoeba invadens
GYLLVTFVMCSYLQTSLQ

SEQ ID NO: 2792892 - protein, 18 aa, Entamoeba invadens
GYMFGAAPNAAFFDKSNK

SEQ ID NO: 2792893 - protein, 17 aa, Entamoeba invadens
GYMRSFDGSTCINCDVS

SEQ ID NO: 2792894 - protein, 17 aa, Entamoeba invadens
GYMRSFDGSTCISCDVS

SEQ ID NO: 2792895 - protein, 20 aa, Entamoeba invadens
GYNFPVFKFNTIVTTTEVDT

SEQ ID NO: 2792896 - protein, 19 aa, Entamoeba invadens
GYNLIPLKTFLGGTIIGKA

SEQ ID NO: 2792897 - protein, 18 aa, Entamoeba invadens
GYNTWPYKTSNGVKLEFP

SEQ ID NO: 2792898 - protein, 23 aa, Entamoeba invadens
GYPLRFTLIKAIILVFTTAASVV

SEQ ID NO: 2792899 - protein, 23 aa, Entamoeba invadens
GYRSIPYSVFDKMNMIKTPDSSY

SEQ ID NO: 2792900 - protein, 28 aa, Entamoeba invadens
GYSETPRLYLKWVEKMAEEQAIRQNYLE

SEQ ID NO: 2792901 - protein, 24 aa, Entamoeba invadens
GYSYPNCFICQAGYYSSGGTLSCS

SEQ ID NO: 2792902 - protein, 18 aa, Entamoeba invadens
GYSYVHVKMCQMCTLVWV

SEQ ID NO: 2792903 - protein, 17 aa, Entamoeba invadens
GYTMGINIFADKTSEEI

SEQ ID NO: 2792904 - protein, 23 aa, Entamoeba invadens
GYTPRIVEFIHIIGKIAYGYTGY

SEQ ID NO: 2792905 - protein, 18 aa, Entamoeba invadens
GYVLFKRAFAFCFVYSIL

SEQ ID NO: 2792906 - protein, 18 aa, Entamoeba invadens
GYYANGFICTKCSDTKCL

SEQ ID NO: 2792907 - protein, 27 aa, Entamoeba invadens
GYYASEMTCKLCIEHCNVCASEECTTC

SEQ ID NO: 2792908 - protein, 19 aa, Entamoeba invadens
GYYCFPDKVKAAINKKMIP

SEQ ID NO: 2792909 - protein, 19 aa, Entamoeba invadens
GYYIKNGRCVACNPMCRMC

SEQ ID NO: 2792910 - protein, 18 aa, Entamoeba invadens
GYYLDNFMCYKCSENCLS

SEQ ID NO: 2792911 - protein, 17 aa, Entamoeba invadens
GYYLTKTSFDFCNKCYE

SEQ ID NO: 2792912 - protein, 18 aa, Entamoeba invadens
GYYRIGLGCAKCDKKCSL

SEQ ID NO: 2792913 - protein, 17 aa, Entamoeba invadens
GYYRIGLSCEMCAIECG

SEQ ID NO: 2792914 - protein, 19 aa, Entamoeba invadens
GYYRNCWTVINAIFHVFCV

SEQ ID NO: 2792915 - protein, 18 aa, Entamoeba invadens
GYYRNGFDCVECEKTCSI

SEQ ID NO: 2792916 - protein, 21 aa, Entamoeba invadens
GYYRNGLDCVHCDEKCSTCNT

SEQ ID NO: 2792917 - protein, 24 aa, Entamoeba invadens
GYYSKKLYSCYSIYYIFATILSMQ

SEQ ID NO: 2792918 - protein, 24 aa, Entamoeba invadens
GYYSRYAECVKCDSNCLACVDESI

SEQ ID NO: 2792919 - protein, 25 aa, Entamoeba invadens
GYYSRYAECVKCDSNCLACVDESIC

SEQ ID NO: 2792920 - protein, 19 aa, Entamoeba invadens
GYYTTSWEACVPCDRHING

SEQ ID NO: 2792921 - protein, 19 aa, Entamoeba invadens
GYYTTSWNSCVPCNRHING

SEQ ID NO: 2792922 - protein, 22 aa, Entamoeba invadens
HACFEFVSPFVPQSSLKKLYQG

SEQ ID NO: 2792923 - protein, 22 aa, Entamoeba invadens
HACKNCKVGFYFSEASCLSCQL

SEQ ID NO: 2792924 - protein, 26 aa, Entamoeba invadens
HAELFIKKNFQVIVVDECHYLKNPQS

SEQ ID NO: 2792925 - protein, 17 aa, Entamoeba invadens
HAFCKDGPCELTLNVYV

SEQ ID NO: 2792926 - protein, 23 aa, Entamoeba invadens
HAGQTFACVACLALLNRFDVLQK

SEQ ID NO: 2792927 - protein, 20 aa, Entamoeba invadens
HAIELLPIENSIGISVGEVM

SEQ ID NO: 2792928 - protein, 17 aa, Entamoeba invadens
HAITCKDNFILTDNNVC

SEQ ID NO: 2792929 - protein, 23 aa, Entamoeba invadens
HAKKLINVWFHWIPEMIFMVCSF

SEQ ID NO: 2792930 - protein, 19 aa, Entamoeba invadens
HAKTLCLPSYSCLIPQLTN

SEQ ID NO: 2792931 - protein, 19 aa, Entamoeba invadens
HALHSIFFFVVCAIIGFPF

SEQ ID NO: 2792932 - protein, 26 aa, Entamoeba invadens
HAMISWALNMISIFSLQVLPLEESIL

SEQ ID NO: 2792933 - protein, 23 aa, Entamoeba invadens
HANLPMFFSVVFWNLNGVENAAN

SEQ ID NO: 2792934 - protein, 26 aa, Entamoeba invadens
HAQSVELCWWVLCGKTANVCQQCTDK

SEQ ID NO: 2792935 - protein, 18 aa, Entamoeba invadens
HARWIRRYISSSIADDFV

SEQ ID NO: 2792936 - protein, 18 aa, Entamoeba invadens
HASLGRTYLYPCDENSPF

SEQ ID NO: 2792937 - protein, 33 aa, Entamoeba invadens
HATLLWRLVDIFFTIPVTYSFGVTCTYLRSLQQ

SEQ ID NO: 2792938 - protein, 21 aa, Entamoeba invadens
HAVGIRWCSRKSEVYCVQDDM

SEQ ID NO: 2792939 - protein, 24 aa, Entamoeba invadens
HAVHFVLSCWDFFVKRLENNGNQY

SEQ ID NO: 2792940 - protein, 19 aa, Entamoeba invadens
HAVVLRYVEYYKYLAEHVS

SEQ ID NO: 2792941 - protein, 21 aa, Entamoeba invadens
HAYNAHAFCQSFIVSTFKTQK

SEQ ID NO: 2792942 - protein, 21 aa, Entamoeba invadens
HCAKCSSAFDRKCVMCNTGYY

SEQ ID NO: 2792943 - protein, 28 aa, Entamoeba invadens
HCCCGPCCKAKIGFLCPKGSKNYSNCEC

SEQ ID NO: 2792944 - protein, 26 aa, Entamoeba invadens
HCIHCKNSKCVQCDLSFYNLNHTCYP

SEQ ID NO: 2792945 - protein, 20 aa, Entamoeba invadens
HCLRCDYTSCYVCENGYEIQ

SEQ ID NO: 2792946 - protein, 17 aa, Entamoeba invadens
HCLSCRPELEFLNKDNT

SEQ ID NO: 2792947 - protein, 23 aa, Entamoeba invadens
HCNLCSQIDCQLCEENYVKMNNN

SEQ ID NO: 2792948 - protein, 20 aa, Entamoeba invadens
HCPWNYRSYFFLLFWSLMYL

SEQ ID NO: 2792949 - protein, 17 aa, Entamoeba invadens
HCRSCLDGFVLRKYPDN

SEQ ID NO: 2792950 - protein, 18 aa, Entamoeba invadens
HCSSCLDSKLCQRCAPGY

SEQ ID NO: 2792951 - protein, 25 aa, Entamoeba invadens
HCTAGLCDGCKAGSHKDNAFYYCYK

SEQ ID NO: 2792952 - protein, 17 aa, Entamoeba invadens
HCTDCYPSFNLETSQGT

SEQ ID NO: 2792953 - protein, 24 aa, Entamoeba invadens
HCTIKGSGPYPLEMLIKTGCVKTS

SEQ ID NO: 2792954 - protein, 19 aa, Entamoeba invadens
HCTPHCICEEGYITNPKDE

SEQ ID NO: 2792955 - protein, 20 aa, Entamoeba invadens
HCTSCSSGFYLSEATKICTL

SEQ ID NO: 2792956 - protein, 18 aa, Entamoeba invadens
HCTSTCTCEFGYKLISDN

SEQ ID NO: 2792957 - protein, 17 aa, Entamoeba invadens
HCVDGYYPDDGKCKSCL

SEQ ID NO: 2792958 - protein, 17 aa, Entamoeba invadens
HCVQCSDGYYLQMVDNP

SEQ ID NO: 2792959 - protein, 22 aa, Entamoeba invadens
HCVTCAFDYSRRCVKCLNGYYP

SEQ ID NO: 2792960 - protein, 21 aa, Entamoeba invadens
HCVTCAFDYSRRCVKCSNGYY

SEQ ID NO: 2792961 - protein, 17 aa, Entamoeba invadens
HDDLCYFGSNGCDQYCK

SEQ ID NO: 2792962 - protein, 19 aa, Entamoeba invadens
HDFHFWSLPTILWNHVNQN

SEQ ID NO: 2792963 - protein, 24 aa, Entamoeba invadens
HDFIELIPPLSFLAIGQHAELALR

SEQ ID NO: 2792964 - protein, 21 aa, Entamoeba invadens
HDFSLKCPFFPESSLETLKNY

SEQ ID NO: 2792965 - protein, 18 aa, Entamoeba invadens
HDFVFYSYFFQRENVTME

SEQ ID NO: 2792966 - protein, 27 aa, Entamoeba invadens
HDGHTGWRISVKLEKEEIIVKHIKGET

SEQ ID NO: 2792967 - protein, 21 aa, Entamoeba invadens
HDIKEPLNCFIDGIYTDSSII

SEQ ID NO: 2792968 - protein, 18 aa, Entamoeba invadens
HDKQCFNCPFGCDSCDAM

SEQ ID NO: 2792969 - protein, 23 aa, Entamoeba invadens
HDLDRLTSVYIHLFPALVMYCIR

SEQ ID NO: 2792970 - protein, 25 aa, Entamoeba invadens
HDLTERPHCILLFSDVILLIPATKP

SEQ ID NO: 2792971 - protein, 27 aa, Entamoeba invadens
HDLWSTWKLKYHKAYEGTNEIRRKLVF

SEQ ID NO: 2792972 - protein, 26 aa, Entamoeba invadens
HDMYIIFKLNVIFYVQMVFNSSTTYF

SEQ ID NO: 2792973 - protein, 28 aa, Entamoeba invadens
HDNCRICLNNKCTKCGSTVPFLENDKCV

SEQ ID NO: 2792974 - protein, 29 aa, Entamoeba invadens
HDNCRICLNNKCTKCGTAVPFLENDKCVS

SEQ ID NO: 2792975 - protein, 23 aa, Entamoeba invadens
HDTKKRPPIHIVVERLDSFMRSA

SEQ ID NO: 2792976 - protein, 17 aa, Entamoeba invadens
HDTSEVKNMFSILLREY

SEQ ID NO: 2792977 - protein, 24 aa, Entamoeba invadens
HDTYPKLKIEFMFFDINGKEKHVK

SEQ ID NO: 2792978 - protein, 23 aa, Entamoeba invadens
HDVGCAICKRGYFKERNDCVKCD

SEQ ID NO: 2792979 - protein, 22 aa, Entamoeba invadens
HDVIQAMKLYFAAIWAIQTLSY

SEQ ID NO: 2792980 - protein, 21 aa, Entamoeba invadens
HDYHFWSLPTVLWNFINSNQH

SEQ ID NO: 2792981 - protein, 24 aa, Entamoeba invadens
HEDPDLHILYGFRAEAFSKYDPET

SEQ ID NO: 2792982 - protein, 17 aa, Entamoeba invadens
HEDWMPKGLFGVGKQDL

SEQ ID NO: 2792983 - protein, 25 aa, Entamoeba invadens
HEFVMEFMKIFPITTLDYGKIITQI

SEQ ID NO: 2792984 - protein, 18 aa, Entamoeba invadens
HEFWLEIFPDGLVVSKTP

SEQ ID NO: 2792985 - protein, 21 aa, Entamoeba invadens
HEITKLPSLLFNVFDSLIKYD

SEQ ID NO: 2792986 - protein, 20 aa, Entamoeba invadens
HEITMLKLLRHETTVNYIGA

SEQ ID NO: 2792987 - protein, 22 aa, Entamoeba invadens
HEKSYDFGLSMWNSLILSENVF

SEQ ID NO: 2792988 - protein, 23 aa, Entamoeba invadens
HELADLIAKCWDQDPNKRPTFEV

SEQ ID NO: 2792989 - protein, 24 aa, Entamoeba invadens
HENCKTDSWLQCFGTAAIDSYAPI

SEQ ID NO: 2792990 - protein, 19 aa, Entamoeba invadens
HENCLRCSDGYYLSNNKCV

SEQ ID NO: 2792991 - protein, 17 aa, Entamoeba invadens
HENSVLCNYEYSIKCDK

SEQ ID NO: 2792992 - protein, 22 aa, Entamoeba invadens
HEQPVKYVIPWSALTPPKNEGE

SEQ ID NO: 2792993 - protein, 25 aa, Entamoeba invadens
HETFLSERVRLFIRMILDSIEESSV

SEQ ID NO: 2792994 - protein, 20 aa, Entamoeba invadens
HETHKRFIIDMIESQHFNVW

SEQ ID NO: 2792995 - protein, 19 aa, Entamoeba invadens
HETIPWMLFVSTINFLKCT

SEQ ID NO: 2792996 - protein, 27 aa, Entamoeba invadens
HEVAKCTAHLVTAARSKADFDSPTLQK

SEQ ID NO: 2792997 - protein, 24 aa, Entamoeba invadens
HEVEGKTWLGGNMQISDMLKFNGE

SEQ ID NO: 2792998 - protein, 23 aa, Entamoeba invadens
HFENQAWCGLLYTSIMKNPNNIE

SEQ ID NO: 2792999 - protein, 23 aa, Entamoeba invadens
HFFKTEAVETIALFDDGDILDLV

SEQ ID NO: 2793000 - protein, 18 aa, Entamoeba invadens
HFICGSISNWIVQLICAI

SEQ ID NO: 2793001 - protein, 30 aa, Entamoeba invadens
HFILSPHWEFWRLLLVNIYTLWTVPLLLVC

SEQ ID NO: 2793002 - protein, 17 aa, Entamoeba invadens
HFLGIGMGFVMFTIFCS

SEQ ID NO: 2793003 - protein, 23 aa, Entamoeba invadens
HFLPLKKYDSVFSQLRSTGLKVR

SEQ ID NO: 2793004 - protein, 19 aa, Entamoeba invadens
HFMCVCVWVGGRVTSLLPC

SEQ ID NO: 2793005 - protein, 23 aa, Entamoeba invadens
HFMNGFFIMWRLKDCAIGFSALA

SEQ ID NO: 2793006 - protein, 17 aa, Entamoeba invadens
HFNFSQISSCWTLQIVG

SEQ ID NO: 2793007 - protein, 18 aa, Entamoeba invadens
HFNPLPIRTMRFNVETDG

SEQ ID NO: 2793008 - protein, 23 aa, Entamoeba invadens
HFQICLFKINLLNYLKLLKYKKK

SEQ ID NO: 2793009 - protein, 18 aa, Entamoeba invadens
HFSYFIRSILELGYNSEA

SEQ ID NO: 2793010 - protein, 17 aa, Entamoeba invadens
HFTILAMDMLNSRVNYI

SEQ ID NO: 2793011 - protein, 17 aa, Entamoeba invadens
HFVALAMKHVGLTNFCC

SEQ ID NO: 2793012 - protein, 17 aa, Entamoeba invadens
HFVFRPKEETVFYLLTS

SEQ ID NO: 2793013 - protein, 18 aa, Entamoeba invadens
HFVLDFPPPTPFLTQDKI

SEQ ID NO: 2793014 - protein, 18 aa, Entamoeba invadens
HFVYRQLTPLSVLVSSVK

SEQ ID NO: 2793015 - protein, 21 aa, Entamoeba invadens
HFWARYFKLLFVLSKREKDFQ

SEQ ID NO: 2793016 - protein, 19 aa, Entamoeba invadens
HGGHPKNCMHYISEYVGLT

SEQ ID NO: 2793017 - protein, 18 aa, Entamoeba invadens
HGLFIFLLGLAFIIFAKK

SEQ ID NO: 2793018 - protein, 28 aa, Entamoeba invadens
HGLYPGYLLFFFCCGIPYEFCSRRFLRI

SEQ ID NO: 2793019 - protein, 18 aa, Entamoeba invadens
HGNFKSEKSFIMSDSDCK

SEQ ID NO: 2793020 - protein, 25 aa, Entamoeba invadens
HGSIGVVYRALFKGQVVAVKKLKFV

SEQ ID NO: 2793021 - protein, 17 aa, Entamoeba invadens
HGTMSWVNLAMVVYFSI

SEQ ID NO: 2793022 - protein, 24 aa, Entamoeba invadens
HGVYPGYYLAFGMLALHNTVSAKF

SEQ ID NO: 2793023 - protein, 17 aa, Entamoeba invadens
HHCPFLKNCVGRRNYRV

SEQ ID NO: 2793024 - protein, 24 aa, Entamoeba invadens
HHCSQCKACVLKMDHHCPWLGTCV

SEQ ID NO: 2793025 - protein, 20 aa, Entamoeba invadens
HHHIRRFDMNTIYLYNNSTF

SEQ ID NO: 2793026 - protein, 18 aa, Entamoeba invadens
HHICKTSLVFLLRYFELN

SEQ ID NO: 2793027 - protein, 19 aa, Entamoeba invadens
HHKVIKFYTVREMTLRINN

SEQ ID NO: 2793028 - protein, 19 aa, Entamoeba invadens
HHLTWWEIINIFFFEFTDL

SEQ ID NO: 2793029 - protein, 24 aa, Entamoeba invadens
HHMNGVEVIHLFTGKPVFHITLLP

SEQ ID NO: 2793030 - protein, 18 aa, Entamoeba invadens
HIALLCSQFQEFSVGKEW

SEQ ID NO: 2793031 - protein, 17 aa, Entamoeba invadens
HICFMKNLLQTFPDGQF

SEQ ID NO: 2793032 - protein, 17 aa, Entamoeba invadens
HICTACFAPYVTSSDSK

SEQ ID NO: 2793033 - protein, 20 aa, Entamoeba invadens
HIDDTCAIQNSYGCVRCILQ

SEQ ID NO: 2793034 - protein, 17 aa, Entamoeba invadens
HIEKYCQFDEVLKEMGL

SEQ ID NO: 2793035 - protein, 19 aa, Entamoeba invadens
HIFDISSYVKLYHIDHLLA

SEQ ID NO: 2793036 - protein, 23 aa, Entamoeba invadens
HIFIKPLLKRTFLVITTFLITVV

SEQ ID NO: 2793037 - protein, 24 aa, Entamoeba invadens
HIGRNVEYYNWFFVNIILHPQTVY

SEQ ID NO: 2793038 - protein, 25 aa, Entamoeba invadens
HIHLSGKMWAFAIVFEICMISTIYI

SEQ ID NO: 2793039 - protein, 26 aa, Entamoeba invadens
HIIGLIAADIVLCFGGERALRYFCKF

SEQ ID NO: 2793040 - protein, 18 aa, Entamoeba invadens
HILSAYLMREEELKPADK

SEQ ID NO: 2793041 - protein, 25 aa, Entamoeba invadens
HINRKEFPKFCNFFCQKRDEVTWET

SEQ ID NO: 2793042 - protein, 23 aa, Entamoeba invadens
HISDYYLKWCIYATAIRFMFTPL

SEQ ID NO: 2793043 - protein, 18 aa, Entamoeba invadens
HITQRIFFVLDFSFFIVC

SEQ ID NO: 2793044 - protein, 23 aa, Entamoeba invadens
HIVKRIPENVVHIGVRNNLVRIG

SEQ ID NO: 2793045 - protein, 19 aa, Entamoeba invadens
HIVVISFQMREIIISTFPF

SEQ ID NO: 2793046 - protein, 24 aa, Entamoeba invadens
HIYAEGVKEVWSLPESVKEYTLSM

SEQ ID NO: 2793047 - protein, 27 aa, Entamoeba invadens
HIYPTSCTNITCPILSYIYHKSLSENT

SEQ ID NO: 2793048 - protein, 22 aa, Entamoeba invadens
HKCPNCKNLFNQNDYHRHVGSK

SEQ ID NO: 2793049 - protein, 23 aa, Entamoeba invadens
HKEIPICDYGGMGINQTSDGSVE

SEQ ID NO: 2793050 - protein, 19 aa, Entamoeba invadens
HKELLPSYVSFIPNQVIVG

SEQ ID NO: 2793051 - protein, 20 aa, Entamoeba invadens
HKELLPSYVSFIPNQVIVGE

SEQ ID NO: 2793052 - protein, 26 aa, Entamoeba invadens
HKELLVYRLSACFVTSIFGVIGIIFH

SEQ ID NO: 2793053 - protein, 19 aa, Entamoeba invadens
HKGGCIISCMYGDACKTGC

SEQ ID NO: 2793054 - protein, 22 aa, Entamoeba invadens
HKHEINKTITLFAMNKSNINFV

SEQ ID NO: 2793055 - protein, 19 aa, Entamoeba invadens
HKHIECINLLIEKTLLNVP

SEQ ID NO: 2793056 - protein, 22 aa, Entamoeba invadens
HKISCIVVEYYPLGTLDHFLDQ

SEQ ID NO: 2793057 - protein, 18 aa, Entamoeba invadens
HKKMLIEIALFMTGLMYE

SEQ ID NO: 2793058 - protein, 20 aa, Entamoeba invadens
HKLYETFIYLKFKTNSIVLC

SEQ ID NO: 2793059 - protein, 35 aa, Entamoeba invadens
HKMNWLRPLIIPLIKLRPYELLQHLMIITNDLNRM

SEQ ID NO: 2793060 - protein, 18 aa, Entamoeba invadens
HKPLLDRFEDGVLKKFAI

SEQ ID NO: 2793061 - protein, 17 aa, Entamoeba invadens
HKPRSRPTFAEISKELD

SEQ ID NO: 2793062 - protein, 28 aa, Entamoeba invadens
HKQDRYCSVVDLYGCLQCKYDVSFDSTL

SEQ ID NO: 2793063 - protein, 23 aa, Entamoeba invadens
HKQKYRLMYWYKLDYSQVTTKYI

SEQ ID NO: 2793064 - protein, 20 aa, Entamoeba invadens
HKSLWNRKSSANLKEEKQKE

SEQ ID NO: 2793065 - protein, 27 aa, Entamoeba invadens
HKSPVAFMCLKFSPFVILAIYFTIYFI

SEQ ID NO: 2793066 - protein, 17 aa, Entamoeba invadens
HKSRSPLANSLKGSFNS

SEQ ID NO: 2793067 - protein, 18 aa, Entamoeba invadens
HKSYKLIFIGVMYIISIV

SEQ ID NO: 2793068 - protein, 23 aa, Entamoeba invadens
HKTEIRKTTTLFKMKRSNVKFVS

SEQ ID NO: 2793069 - protein, 17 aa, Entamoeba invadens
HKTKFEVVNNFKYFEGV

SEQ ID NO: 2793070 - protein, 19 aa, Entamoeba invadens
HKTNVLAIILPIIFGILIV

SEQ ID NO: 2793071 - protein, 19 aa, Entamoeba invadens
HKTNVLAIVLPIIFTIILI

SEQ ID NO: 2793072 - protein, 27 aa, Entamoeba invadens
HKTNVLSIILPIIFCILIVVIIIITIS

SEQ ID NO: 2793073 - protein, 28 aa, Entamoeba invadens
HKTNVLSIILPIIFCILMVVIIIITISC

SEQ ID NO: 2793074 - protein, 21 aa, Entamoeba invadens
HKTVRMGECDYIRSVCSGSIY

SEQ ID NO: 2793075 - protein, 17 aa, Entamoeba invadens
HKVKRIAQSFVPEFLRL

SEQ ID NO: 2793076 - protein, 20 aa, Entamoeba invadens
HLANKILRGQCMTVSGVERI

SEQ ID NO: 2793077 - protein, 24 aa, Entamoeba invadens
HLASSPKKRGMFIAYFELESLFVP

SEQ ID NO: 2793078 - protein, 19 aa, Entamoeba invadens
HLCDGCELGMIYTTAGICI

SEQ ID NO: 2793079 - protein, 17 aa, Entamoeba invadens
HLCYKCRDNCTLCSSFD

SEQ ID NO: 2793080 - protein, 17 aa, Entamoeba invadens
HLDIKMPIFEISMATCI

SEQ ID NO: 2793081 - protein, 17 aa, Entamoeba invadens
HLFDIRVLIKNGDFKYF

SEQ ID NO: 2793082 - protein, 24 aa, Entamoeba invadens
HLFDTCDMKECVKSYSTDETTLTF

SEQ ID NO: 2793083 - protein, 25 aa, Entamoeba invadens
HLFEPLRGLLLISVSLFVFVLSQYS

SEQ ID NO: 2793084 - protein, 19 aa, Entamoeba invadens
HLFFINAFDEKNCPNADRL

SEQ ID NO: 2793085 - protein, 27 aa, Entamoeba invadens
HLFPALVMYCIRWHTYITVPELTLFNG

SEQ ID NO: 2793086 - protein, 17 aa, Entamoeba invadens
HLGNFIYAFALRHLHII

SEQ ID NO: 2793087 - protein, 30 aa, Entamoeba invadens
HLGTMMVMFPRNLCIKSCRRLGFNSKHWQI

SEQ ID NO: 2793088 - protein, 17 aa, Entamoeba invadens
HLICSVVQKGKPWKFRP

SEQ ID NO: 2793089 - protein, 20 aa, Entamoeba invadens
HLKARVDAYTSIRKVRGGPE

SEQ ID NO: 2793090 - protein, 20 aa, Entamoeba invadens
HLKCPGYALKAMDYIMKYAG

SEQ ID NO: 2793091 - protein, 24 aa, Entamoeba invadens
HLKTDNCATCGSGSCDSCETDYIL

SEQ ID NO: 2793092 - protein, 23 aa, Entamoeba invadens
HLKVCGVYWGLMVLHMLNKVTEE

SEQ ID NO: 2793093 - protein, 26 aa, Entamoeba invadens
HLLGGVMFCILLRYNVFAHFFPVLFK

SEQ ID NO: 2793094 - protein, 18 aa, Entamoeba invadens
HLLMKCLSISQAIYIVLH

SEQ ID NO: 2793095 - protein, 23 aa, Entamoeba invadens
HLLMVTEFARFGSINDVMKHKKS

SEQ ID NO: 2793096 - protein, 26 aa, Entamoeba invadens
HLLPGMVVYCIRWKSDIPIPQELDFV

SEQ ID NO: 2793097 - protein, 26 aa, Entamoeba invadens
HLLPGMVVYCLRWYGTLEVPQELTVW

SEQ ID NO: 2793098 - protein, 18 aa, Entamoeba invadens
HLQPVIIDQFFKVFEQGD

SEQ ID NO: 2793099 - protein, 23 aa, Entamoeba invadens
HLSSVGCLRCRDGYYPNGVLCVT

SEQ ID NO: 2793100 - protein, 22 aa, Entamoeba invadens
HLTDHFKMFFTLPSTYTEKIYL

SEQ ID NO: 2793101 - protein, 20 aa, Entamoeba invadens
HLVAFPILVCISMKYFDDGT

SEQ ID NO: 2793102 - protein, 23 aa, Entamoeba invadens
HLVLQCLKLLDGVIFIQKQILSF

SEQ ID NO: 2793103 - protein, 17 aa, Entamoeba invadens
HLVTVFFDRTIPYDTDM

SEQ ID NO: 2793104 - protein, 27 aa, Entamoeba invadens
HLWLIPAYIACLFRLLKMLREDLGDYV

SEQ ID NO: 2793105 - protein, 17 aa, Entamoeba invadens
HLYIDVCFYSVGSGLFW

SEQ ID NO: 2793106 - protein, 24 aa, Entamoeba invadens
HMIYGCIGIFISFFIYNGMTFCVF

SEQ ID NO: 2793107 - protein, 25 aa, Entamoeba invadens
HMQKVMRPKLFPVFENCADDMWAQV

SEQ ID NO: 2793108 - protein, 20 aa, Entamoeba invadens
HMSVIVKKFVVYKITDFHFL

SEQ ID NO: 2793109 - protein, 22 aa, Entamoeba invadens
HMYSAEALSAFVVADSSTYSVV

SEQ ID NO: 2793110 - protein, 23 aa, Entamoeba invadens
HNFCTSCGVGFYLSSMKICSTCS

SEQ ID NO: 2793111 - protein, 37 aa, Entamoeba invadens
HNFFQFRFFCLRSKRYILKHMIFFKMLFMDFLKDDSF

SEQ ID NO: 2793112 - protein, 20 aa, Entamoeba invadens
HNGCDKCLFDIITTTGVCTN

SEQ ID NO: 2793113 - protein, 24 aa, Entamoeba invadens
HNMSVNCYLVIPSGVTLSVTDIYG

SEQ ID NO: 2793114 - protein, 28 aa, Entamoeba invadens
HNNYCKQCPLDLCSKCKESAVEGTNETK

SEQ ID NO: 2793115 - protein, 20 aa, Entamoeba invadens
HNRFHCCTNLTSVILSSQTT

SEQ ID NO: 2793116 - protein, 24 aa, Entamoeba invadens
HNRISVGNRCRCSILDDGKTFSET

SEQ ID NO: 2793117 - protein, 18 aa, Entamoeba invadens
HNVIKELLFRGSETLKNF

SEQ ID NO: 2793118 - protein, 24 aa, Entamoeba invadens
HNVRRFPEVQGMAIRKFTMKEITS

SEQ ID NO: 2793119 - protein, 22 aa, Entamoeba invadens
HNYPIILACVFLNATGNIMIPI

SEQ ID NO: 2793120 - protein, 18 aa, Entamoeba invadens
HPALKYYADKNVKIEMKI

SEQ ID NO: 2793121 - protein, 22 aa, Entamoeba invadens
HPCTVQYLGFWYEDNRLCVAME

SEQ ID NO: 2793122 - protein, 22 aa, Entamoeba invadens
HPEPPKYILFYFINALILHFHV

SEQ ID NO: 2793123 - protein, 23 aa, Entamoeba invadens
HPETCGLLWKLMTVWVTVSTLRI

SEQ ID NO: 2793124 - protein, 23 aa, Entamoeba invadens
HPFTLLLVFCAAKTTTDCPTSVE

SEQ ID NO: 2793125 - protein, 18 aa, Entamoeba invadens
HPGKFILWNVPFEEHGAF

SEQ ID NO: 2793126 - protein, 18 aa, Entamoeba invadens
HPIHFSVTLKHFSVLMSI

SEQ ID NO: 2793127 - protein, 21 aa, Entamoeba invadens
HPKHRFIILLDNIFRQTLLLS

SEQ ID NO: 2793128 - protein, 19 aa, Entamoeba invadens
HPKRALGVVSLLSMMYVSC

SEQ ID NO: 2793129 - protein, 19 aa, Entamoeba invadens
HPLTRQWLNVVLYVGVVIL

SEQ ID NO: 2793130 - protein, 25 aa, Entamoeba invadens
HPNKDCSYYPFFSLLKIRTCGNVYT

SEQ ID NO: 2793131 - protein, 18 aa, Entamoeba invadens
HPNYSCRIDDKIVLISVD

SEQ ID NO: 2793132 - protein, 32 aa, Entamoeba invadens
HPSIDVPKCPKCGGLMKLDVILFGEKLDQITY

SEQ ID NO: 2793133 - protein, 21 aa, Entamoeba invadens
HPSLIIPNFFEGVLSEKEGEY

SEQ ID NO: 2793134 - protein, 20 aa, Entamoeba invadens
HPVNARFILEDEFLSKNTNK

SEQ ID NO: 2793135 - protein, 24 aa, Entamoeba invadens
HPYQCKSCVTGFYLNTSTYTCEQG

SEQ ID NO: 2793136 - protein, 19 aa, Entamoeba invadens
HQACARSFILALINREAEI

SEQ ID NO: 2793137 - protein, 18 aa, Entamoeba invadens
HQIDCIYSLLNVENDWSN

SEQ ID NO: 2793138 - protein, 24 aa, Entamoeba invadens
HQKFKYPWKIAQFVIKGNHLKRNE

SEQ ID NO: 2793139 - protein, 18 aa, Entamoeba invadens
HQKTLRVGSIHGYVQKGT

SEQ ID NO: 2793140 - protein, 25 aa, Entamoeba invadens
HQLKRYVGAGGNVFFAISQVYTSSV

SEQ ID NO: 2793141 - protein, 22 aa, Entamoeba invadens
HQLNSWFFYQFGDVSNFTTVTA

SEQ ID NO: 2793142 - protein, 18 aa, Entamoeba invadens
HQMDVLNIVFFDGLDVTF

SEQ ID NO: 2793143 - protein, 23 aa, Entamoeba invadens
HQMIFCLLCCSFVNQCVVLATLF

SEQ ID NO: 2793144 - protein, 19 aa, Entamoeba invadens
HQNVLKCSEGFYVSNGHCE

SEQ ID NO: 2793145 - protein, 23 aa, Entamoeba invadens
HQRIKSKYCRVMAANFMTDVLNS

SEQ ID NO: 2793146 - protein, 23 aa, Entamoeba invadens
HQSLRKARRYNLFNQTHCPDNVI

SEQ ID NO: 2793147 - protein, 22 aa, Entamoeba invadens
HRDVVCKHLDYLLKNTTKSFTD

SEQ ID NO: 2793148 - protein, 39 aa, Entamoeba invadens
HRFCGFQNLLILSAFCWCCFRIFDILFSFFFLLYTILNT

SEQ ID NO: 2793149 - protein, 35 aa, Entamoeba invadens
HRFTKMELTGNFALNLKVLVIYSTLTLNGGDVTIN

SEQ ID NO: 2793150 - protein, 25 aa, Entamoeba invadens
HRFTKMELTGNFTLNLKVLVIYSTL

SEQ ID NO: 2793151 - protein, 24 aa, Entamoeba invadens
HRGSVWNFVLWWFYGAYQSLIFFL

SEQ ID NO: 2793152 - protein, 20 aa, Entamoeba invadens
HRKERLNIEMGRAIESSDEI

SEQ ID NO: 2793153 - protein, 26 aa, Entamoeba invadens
HRKVWYPVLLIWKVLYFLNRFTYFRI

SEQ ID NO: 2793154 - protein, 23 aa, Entamoeba invadens
HRKYGDDVVIEWRILSETSQLKN

SEQ ID NO: 2793155 - protein, 21 aa, Entamoeba invadens
HRLYFVIQMLFAFIENNDYVQ

SEQ ID NO: 2793156 - protein, 21 aa, Entamoeba invadens
HRQMCGIVIFMYAKPDIANLM

SEQ ID NO: 2793157 - protein, 34 aa, Entamoeba invadens
HRTLKKGGVPVLLFKQVIDFPLKVLSKLQTLGNL

SEQ ID NO: 2793158 - protein, 41 aa, Entamoeba invadens
HRYAIHFDPKMGILSPRITQKVCVKLTMLCTCSIDEIIDVQ

SEQ ID NO: 2793159 - protein, 21 aa, Entamoeba invadens
HSAELGLMYNNSWPVQGKYVS

SEQ ID NO: 2793160 - protein, 24 aa, Entamoeba invadens
HSEILVKMRIVLQCTTIIHESVYI

SEQ ID NO: 2793161 - protein, 20 aa, Entamoeba invadens
HSFCANYILAPYLWEPLLQK

SEQ ID NO: 2793162 - protein, 19 aa, Entamoeba invadens
HSFDGCEVLDTIIGLESVI

SEQ ID NO: 2793163 - protein, 17 aa, Entamoeba invadens
HSFDVLRSLFSIKTRSP

SEQ ID NO: 2793164 - protein, 19 aa, Entamoeba invadens
HSFGHSKLFWVGERSQWED

SEQ ID NO: 2793165 - protein, 17 aa, Entamoeba invadens
HSFQFFLPIVFPLNDSK

SEQ ID NO: 2793166 - protein, 25 aa, Entamoeba invadens
HSGNFKELDCRKELDQNNFYTFVSN

SEQ ID NO: 2793167 - protein, 27 aa, Entamoeba invadens
HSGRLSVFNYFSGVILKSVTIKSCATG

SEQ ID NO: 2793168 - protein, 27 aa, Entamoeba invadens
HSILDVAACDFFNIAIKTENEISLITT

SEQ ID NO: 2793169 - protein, 18 aa, Entamoeba invadens
HSILKICVYLLICFGITY

SEQ ID NO: 2793170 - protein, 20 aa, Entamoeba invadens
HSKCSKCKFWYSPDEKGTFC

SEQ ID NO: 2793171 - protein, 25 aa, Entamoeba invadens
HSKCVIGAEYYRVYISVVMVLVPTI

SEQ ID NO: 2793172 - protein, 20 aa, Entamoeba invadens
HSKHPSLFRAIFRQEWMQFV

SEQ ID NO: 2793173 - protein, 20 aa, Entamoeba invadens
HSKTGFAIIIIIGYGEYCKE

SEQ ID NO: 2793174 - protein, 23 aa, Entamoeba invadens
HSKTPMWLILLIVFLGFDNIVQL

SEQ ID NO: 2793175 - protein, 17 aa, Entamoeba invadens
HSNIRFARISLNLVSNI

SEQ ID NO: 2793176 - protein, 21 aa, Entamoeba invadens
HSQGIFKNRCIPNITFDKTQI

SEQ ID NO: 2793177 - protein, 26 aa, Entamoeba invadens
HSQIPHCVRLKFFIDSYICSVCEYPY

SEQ ID NO: 2793178 - protein, 28 aa, Entamoeba invadens
HSRQMICFLHLSAFMAIITWMKGGFGQK

SEQ ID NO: 2793179 - protein, 18 aa, Entamoeba invadens
HSSCLKCPENPAICTQCQ

SEQ ID NO: 2793180 - protein, 26 aa, Entamoeba invadens
HSSNSKCDKCTFWRSPSNDGSYCVYH

SEQ ID NO: 2793181 - protein, 23 aa, Entamoeba invadens
HSSVCGKLTDFGTCRNVSERALS

SEQ ID NO: 2793182 - protein, 23 aa, Entamoeba invadens
HSVGCRRCTSGYFLESASQTCSK

SEQ ID NO: 2793183 - protein, 24 aa, Entamoeba invadens
HSVIPLVLFCYIIKPDYSIWKENI

SEQ ID NO: 2793184 - protein, 17 aa, Entamoeba invadens
HSYSFGRMCRFWTMWSC

SEQ ID NO: 2793185 - protein, 21 aa, Entamoeba invadens
HTAALFLCAMFWYHYDEKAPL

SEQ ID NO: 2793186 - protein, 22 aa, Entamoeba invadens
HTCNSCKWSSPSALNPEAYLMN

SEQ ID NO: 2793187 - protein, 24 aa, Entamoeba invadens
HTCNSCKWSSPSALNPVAYLKNSE

SEQ ID NO: 2793188 - protein, 17 aa, Entamoeba invadens
HTFFFFLFINVLVQPIT

SEQ ID NO: 2793189 - protein, 22 aa, Entamoeba invadens
HTHEINKTITLFAMNKSNINFV

SEQ ID NO: 2793190 - protein, 25 aa, Entamoeba invadens
HTHGIPIFRYLTCFVLSNLPLLFLA

SEQ ID NO: 2793191 - protein, 17 aa, Entamoeba invadens
HTLMVMEFAPFGSVKSA

SEQ ID NO: 2793192 - protein, 17 aa, Entamoeba invadens
HTLMVMEFAPYGSVNDM

SEQ ID NO: 2793193 - protein, 22 aa, Entamoeba invadens
HTLRVTPKLNFNIEIFSQITEI

SEQ ID NO: 2793194 - protein, 18 aa, Entamoeba invadens
HTNIPFKFIENTDFVSNS

SEQ ID NO: 2793195 - protein, 17 aa, Entamoeba invadens
HTNKCPLPLDFAVNDCY

SEQ ID NO: 2793196 - protein, 24 aa, Entamoeba invadens
HTNLEVRSSLVLAGSLIVDEIFTA

SEQ ID NO: 2793197 - protein, 24 aa, Entamoeba invadens
HTPNCPKYVFHFEPQVAILRPNAN

SEQ ID NO: 2793198 - protein, 17 aa, Entamoeba invadens
HVCGKVLSCGKHHCTKM

SEQ ID NO: 2793199 - protein, 24 aa, Entamoeba invadens
HVCQHKCHFGPCVCDVKMTKRCRC

SEQ ID NO: 2793200 - protein, 17 aa, Entamoeba invadens
HVCSYASERLYWADLSR

SEQ ID NO: 2793201 - protein, 24 aa, Entamoeba invadens
HVCVKKDECLSCKEGYFKISTEST

SEQ ID NO: 2793202 - protein, 18 aa, Entamoeba invadens
HVDGWTFFWNLREDHTKN

SEQ ID NO: 2793203 - protein, 17 aa, Entamoeba invadens
HVEKICPENCGFHGTCN

SEQ ID NO: 2793204 - protein, 17 aa, Entamoeba invadens
HVELIFRSDNKIAVKLE

SEQ ID NO: 2793205 - protein, 22 aa, Entamoeba invadens
HVFYPFAMIGGMIWAFGNLMTV

SEQ ID NO: 2793206 - protein, 24 aa, Entamoeba invadens
HVGGPERYYAFPGLLTCLYSDVTV

SEQ ID NO: 2793207 - protein, 19 aa, Entamoeba invadens
HVGQELQFTIGLSVQTQQS

SEQ ID NO: 2793208 - protein, 20 aa, Entamoeba invadens
HVKDKLGYLISRTRNTETNF

SEQ ID NO: 2793209 - protein, 26 aa, Entamoeba invadens
HVKMCQMCTLVWVLAVSIVILITFMY

SEQ ID NO: 2793210 - protein, 22 aa, Entamoeba invadens
HVKWCKYRYELLCVGLDDECSS

SEQ ID NO: 2793211 - protein, 19 aa, Entamoeba invadens
HVLCGMLLFGTGSSVTMKL

SEQ ID NO: 2793212 - protein, 17 aa, Entamoeba invadens
HVLGEVFAENGFLVRSD

SEQ ID NO: 2793213 - protein, 23 aa, Entamoeba invadens
HVLKNKVYFLSRMEYSDDGSKTV

SEQ ID NO: 2793214 - protein, 23 aa, Entamoeba invadens
HVPDCPKYVFHFDPQVFILRPNS

SEQ ID NO: 2793215 - protein, 23 aa, Entamoeba invadens
HVPNCPKYVFHFDPQVFILRPYS

SEQ ID NO: 2793216 - protein, 23 aa, Entamoeba invadens
HVPNDLPLFLGFLPFDLPQGKAP

SEQ ID NO: 2793217 - protein, 18 aa, Entamoeba invadens
HVVEVPITFTTRTHGESK

SEQ ID NO: 2793218 - protein, 17 aa, Entamoeba invadens
HVVLRMKTGHFILVQSE

SEQ ID NO: 2793219 - protein, 23 aa, Entamoeba invadens
HVVSLICIIVIYTLTCYIPGYST

SEQ ID NO: 2793220 - protein, 21 aa, Entamoeba invadens
HVYIVRRKNMKVFEDGEELDV

SEQ ID NO: 2793221 - protein, 18 aa, Entamoeba invadens
HWEKRVLYNEIMTGTSSM

SEQ ID NO: 2793222 - protein, 19 aa, Entamoeba invadens
HWFALFFQFIFEIFWPKDT

SEQ ID NO: 2793223 - protein, 20 aa, Entamoeba invadens
HYGTRGALIYAFVMGTLGYL

SEQ ID NO: 2793224 - protein, 29 aa, Entamoeba invadens
HYGYLPCFTDFYAKVVIFTASFFGEYSMR

SEQ ID NO: 2793225 - protein, 25 aa, Entamoeba invadens
HYIRAESVLKLYALYNALEMFNRLL

SEQ ID NO: 2793226 - protein, 17 aa, Entamoeba invadens
HYKKPADVFSFAITMYE

SEQ ID NO: 2793227 - protein, 18 aa, Entamoeba invadens
HYKTCYSCSNGYYLKEEG

SEQ ID NO: 2793228 - protein, 20 aa, Entamoeba invadens
HYLSCLYKQYTLASLFSSVK

SEQ ID NO: 2793229 - protein, 18 aa, Entamoeba invadens
HYSADCKVGEEWYTFSDE

SEQ ID NO: 2793230 - protein, 18 aa, Entamoeba invadens
HYTFDLKLQRCVELLLDE

SEQ ID NO: 2793231 - protein, 23 aa, Entamoeba invadens
HYTHFKVLHFIFSRFEGKNGEKM

SEQ ID NO: 2793232 - protein, 25 aa, Entamoeba invadens
HYVLKHGTCVLCGNGQLDEGEECEL

SEQ ID NO: 2793233 - protein, 19 aa, Entamoeba invadens
HYVVLFSLLLCYASQDRNE

SEQ ID NO: 2793234 - protein, 18 aa, Entamoeba invadens
HYYISGSMNLPGGKGEKY

SEQ ID NO: 2793235 - protein, 23 aa, Entamoeba invadens
IAAEEFYRGLLLLQNFCSLNNEA

SEQ ID NO: 2793236 - protein, 19 aa, Entamoeba invadens
IAAELFTTVWVSFPEYSIF

SEQ ID NO: 2793237 - protein, 18 aa, Entamoeba invadens
IAALNCRTMFFNVSTELD

SEQ ID NO: 2793238 - protein, 26 aa, Entamoeba invadens
IACCAIESRMLFTIPRYLQKVVHERS

SEQ ID NO: 2793239 - protein, 18 aa, Entamoeba invadens
IACFARSEESYLIKEGKF

SEQ ID NO: 2793240 - protein, 17 aa, Entamoeba invadens
IADCKYSLISKSMCVEC

SEQ ID NO: 2793241 - protein, 22 aa, Entamoeba invadens
IADFTFKGCSSIKDIKNIDKVE

SEQ ID NO: 2793242 - protein, 24 aa, Entamoeba invadens
IAEHCKDEETVLGFGLINEPNIQF

SEQ ID NO: 2793243 - protein, 17 aa, Entamoeba invadens
IAEHIFKTVIGSMLELL

SEQ ID NO: 2793244 - protein, 19 aa, Entamoeba invadens
IAETIAFTIFGGNLELTNP

SEQ ID NO: 2793245 - protein, 25 aa, Entamoeba invadens
IAFANHLDWYVTLYSTDTPAIDINI

SEQ ID NO: 2793246 - protein, 17 aa, Entamoeba invadens
IAFFLFVVYGQNCYYNQ

SEQ ID NO: 2793247 - protein, 26 aa, Entamoeba invadens
IAFGCFLFVIACVVIILVLVLKVNKR

SEQ ID NO: 2793248 - protein, 23 aa, Entamoeba invadens
IAFPGFIVSFLLVDRIGRKPLRL

SEQ ID NO: 2793249 - protein, 17 aa, Entamoeba invadens
IAFRLISKFIQNEDQKG

SEQ ID NO: 2793250 - protein, 18 aa, Entamoeba invadens
IAFSGLFLSGLLVLNLFA

SEQ ID NO: 2793251 - protein, 17 aa, Entamoeba invadens
IAFTVLLFLCSAKLGEN

SEQ ID NO: 2793252 - protein, 18 aa, Entamoeba invadens
IAFYIGKPYQTFLLLQSV

SEQ ID NO: 2793253 - protein, 18 aa, Entamoeba invadens
IAGIPLVIVINAYRYPRG

SEQ ID NO: 2793254 - protein, 23 aa, Entamoeba invadens
IAGSIPMGFKFLLNKRLLRYGSS

SEQ ID NO: 2793255 - protein, 20 aa, Entamoeba invadens
IAGSITWLIAMSIISLSWIF

SEQ ID NO: 2793256 - protein, 23 aa, Entamoeba invadens
IAICNACTISKVIERNQRRIKKM

SEQ ID NO: 2793257 - protein, 17 aa, Entamoeba invadens
IAIGRGNVLEWWTPTTC

SEQ ID NO: 2793258 - protein, 23 aa, Entamoeba invadens
IAIIIFFVWRRKRKTMKEREKEI

SEQ ID NO: 2793259 - protein, 24 aa, Entamoeba invadens
IAIIPRILYDITLFIPIVAQKVMI

SEQ ID NO: 2793260 - protein, 19 aa, Entamoeba invadens
IAIPTVITFGTSVFEGITT

SEQ ID NO: 2793261 - protein, 19 aa, Entamoeba invadens
IAISYGDCIKCDAKQHLSQ

SEQ ID NO: 2793262 - protein, 34 aa, Entamoeba invadens
IAIYTSKMARFWFLQRMDWLGAIVSVATVIVIVV

SEQ ID NO: 2793263 - protein, 25 aa, Entamoeba invadens
IAKFFRIVISDGFFVGYGLTETCGM

SEQ ID NO: 2793264 - protein, 20 aa, Entamoeba invadens
IAKYEKRAFFYFDTKERVIA

SEQ ID NO: 2793265 - protein, 18 aa, Entamoeba invadens
IALGAKFLLLGLMLPLLF

SEQ ID NO: 2793266 - protein, 20 aa, Entamoeba invadens
IALLILVYLSFGWMYAKRVE

SEQ ID NO: 2793267 - protein, 23 aa, Entamoeba invadens
IALLLCGLGYLALHQLYSVYNPQ

SEQ ID NO: 2793268 - protein, 17 aa, Entamoeba invadens
IALLLIFFACVFIATSI

SEQ ID NO: 2793269 - protein, 25 aa, Entamoeba invadens
IALMFLVMYLADWRKNNAEQFTTKT

SEQ ID NO: 2793270 - protein, 19 aa, Entamoeba invadens
IALNEFDFLKGYNALLKSL

SEQ ID NO: 2793271 - protein, 24 aa, Entamoeba invadens
IALPFGIVVVGFFFRNYILFVQIV

SEQ ID NO: 2793272 - protein, 25 aa, Entamoeba invadens
IALSGEFNGDVLYLVRTEIQNFVTQ

SEQ ID NO: 2793273 - protein, 18 aa, Entamoeba invadens
IALSIRYGAKNIWNGNKN

SEQ ID NO: 2793274 - protein, 21 aa, Entamoeba invadens
IALSLVLYFGFGRKKIDMNVF

SEQ ID NO: 2793275 - protein, 17 aa, Entamoeba invadens
IALSVSMMFWILYFNSP

SEQ ID NO: 2793276 - protein, 20 aa, Entamoeba invadens
IAMRTEIKFLQILNEQQLAA

SEQ ID NO: 2793277 - protein, 26 aa, Entamoeba invadens
IAMYEIIGWKAAFSMKDPQFNFPWKI

SEQ ID NO: 2793278 - protein, 17 aa, Entamoeba invadens
IANETKLCLPFDDLTQF

SEQ ID NO: 2793279 - protein, 23 aa, Entamoeba invadens
IANHSCCTLDALLKSAWSAIEDF

SEQ ID NO: 2793280 - protein, 22 aa, Entamoeba invadens
IANKCEYCLLGTFSSSPKSLRC

SEQ ID NO: 2793281 - protein, 21 aa, Entamoeba invadens
IANKCEYCLLGTYSSSPKSLQ

SEQ ID NO: 2793282 - protein, 26 aa, Entamoeba invadens
IANMKGKHGVLVKFVLRKELDQMYEM

SEQ ID NO: 2793283 - protein, 22 aa, Entamoeba invadens
IANTRYTWWNFLPMSLFNQFKY

SEQ ID NO: 2793284 - protein, 33 aa, Entamoeba invadens
IAPLQYFQLVHILKFRMGFISSIRTQLQNSMSA

SEQ ID NO: 2793285 - protein, 26 aa, Entamoeba invadens
IAPTIFCFMKGQSYMFGELRKEEVIC

SEQ ID NO: 2793286 - protein, 23 aa, Entamoeba invadens
IAQEGECGFYYVARGNVNNIEPF

SEQ ID NO: 2793287 - protein, 23 aa, Entamoeba invadens
IAQFRFLVKLLLVHGRYNYRRLS

SEQ ID NO: 2793288 - protein, 22 aa, Entamoeba invadens
IAQSKCSKCTFWHIPNNSGTSC

SEQ ID NO: 2793289 - protein, 24 aa, Entamoeba invadens
IARCIQWMQLWMVYAVDKYGVWAI

SEQ ID NO: 2793290 - protein, 24 aa, Entamoeba invadens
IARLSVVCKTIFLTENCNSETAAY

SEQ ID NO: 2793291 - protein, 25 aa, Entamoeba invadens
IASCLKCDDSGCLQCSDGYTVSTDA

SEQ ID NO: 2793292 - protein, 17 aa, Entamoeba invadens
IASCLKRQLAVKDYGSI

SEQ ID NO: 2793293 - protein, 19 aa, Entamoeba invadens
IASPVLYFSLFKKINSLNV

SEQ ID NO: 2793294 - protein, 17 aa, Entamoeba invadens
IASSIFIFIAILNHRKT

SEQ ID NO: 2793295 - protein, 17 aa, Entamoeba invadens
IASTAAIIGGVWIIFGW

SEQ ID NO: 2793296 - protein, 18 aa, Entamoeba invadens
IATCYRKNGQFHRAMSLI

SEQ ID NO: 2793297 - protein, 19 aa, Entamoeba invadens
IATIFYFIITWYFYNKAIY

SEQ ID NO: 2793298 - protein, 20 aa, Entamoeba invadens
IATSLIYWIFGYTYIQKNQV

SEQ ID NO: 2793299 - protein, 17 aa, Entamoeba invadens
IATTIVLVFILFVFVLN

SEQ ID NO: 2793300 - protein, 19 aa, Entamoeba invadens
IAVCTLCYEPFVVLNGKCI

SEQ ID NO: 2793301 - protein, 23 aa, Entamoeba invadens
IAVESLELFCFLIQSDRSFQDII

SEQ ID NO: 2793302 - protein, 18 aa, Entamoeba invadens
IAVILPLNGGGFINLGLD

SEQ ID NO: 2793303 - protein, 18 aa, Entamoeba invadens
IAVLALLLIKLFFTKEID

SEQ ID NO: 2793304 - protein, 18 aa, Entamoeba invadens
IAVLCPKGPLRILVNLAQ

SEQ ID NO: 2793305 - protein, 20 aa, Entamoeba invadens
IAVMFPIVWSTYIGSDTTGA

SEQ ID NO: 2793306 - protein, 18 aa, Entamoeba invadens
IAVSFGVCLSYYYTTMPV

SEQ ID NO: 2793307 - protein, 21 aa, Entamoeba invadens
IAYPTAFKFGQTMKKLELMLK

SEQ ID NO: 2793308 - protein, 21 aa, Entamoeba invadens
ICAIESQLLITVPQYLQEKRI

SEQ ID NO: 2793309 - protein, 17 aa, Entamoeba invadens
ICANGYIKNGSKCVIID

SEQ ID NO: 2793310 - protein, 18 aa, Entamoeba invadens
ICAVDLCASIVLHYKLNT

SEQ ID NO: 2793311 - protein, 23 aa, Entamoeba invadens
ICCCCSCCHCLLFFVLGVLILTF

SEQ ID NO: 2793312 - protein, 26 aa, Entamoeba invadens
ICDLAACLLCGFKLSPPSYKNGVLCF

SEQ ID NO: 2793313 - protein, 19 aa, Entamoeba invadens
ICDNCIKKSGACSSCSSGY

SEQ ID NO: 2793314 - protein, 19 aa, Entamoeba invadens
ICESCPIGCTTCLNAFTCL

SEQ ID NO: 2793315 - protein, 17 aa, Entamoeba invadens
ICESCPVGQYFYINRCL

SEQ ID NO: 2793316 - protein, 17 aa, Entamoeba invadens
ICESCPVGQYLSPNGCL

SEQ ID NO: 2793317 - protein, 18 aa, Entamoeba invadens
ICFDSCISALHELHKTDI

SEQ ID NO: 2793318 - protein, 18 aa, Entamoeba invadens
ICFSCISGYVLSSTSSNQ

SEQ ID NO: 2793319 - protein, 17 aa, Entamoeba invadens
ICFVIFAALAPFGGKIS

SEQ ID NO: 2793320 - protein, 19 aa, Entamoeba invadens
ICGDKYYSPGGKFWCAHCP

SEQ ID NO: 2793321 - protein, 21 aa, Entamoeba invadens
ICGDSGLYFWSQNSACVPTNC

SEQ ID NO: 2793322 - protein, 18 aa, Entamoeba invadens
ICGFEVHSAFLVLTSVTI

SEQ ID NO: 2793323 - protein, 24 aa, Entamoeba invadens
ICGILECFWMKYFGIGNLVIILFL

SEQ ID NO: 2793324 - protein, 22 aa, Entamoeba invadens
ICGPFKRYLLLFFETFSDLKVI

SEQ ID NO: 2793325 - protein, 38 aa, Entamoeba invadens
ICGQTHCVSCAHLTPNCKYCDTASCYLCEEDFVLQDSQ

SEQ ID NO: 2793326 - protein, 28 aa, Entamoeba invadens
ICHKGECPKCAVQVERSCYCGAEKSKFS

SEQ ID NO: 2793327 - protein, 24 aa, Entamoeba invadens
ICIERLYIKHCVNVTNSLCERCNF

SEQ ID NO: 2793328 - protein, 17 aa, Entamoeba invadens
ICIKCGSSINVNGVCTD

SEQ ID NO: 2793329 - protein, 17 aa, Entamoeba invadens
ICILLIYPLSFSRTLDA

SEQ ID NO: 2793330 - protein, 17 aa, Entamoeba invadens
ICIQCKDGYIFGESKNG

SEQ ID NO: 2793331 - protein, 21 aa, Entamoeba invadens
ICITCKAKFYLNDTNDCSPCY

SEQ ID NO: 2793332 - protein, 17 aa, Entamoeba invadens
ICIVTEFAKHGSLMDLI

SEQ ID NO: 2793333 - protein, 17 aa, Entamoeba invadens
ICKAKCLDNDNKIRDVN

SEQ ID NO: 2793334 - protein, 20 aa, Entamoeba invadens
ICKERYYYGQKMCYKCGSSC

SEQ ID NO: 2793335 - protein, 17 aa, Entamoeba invadens
ICKGERPSLDCIDERVR

SEQ ID NO: 2793336 - protein, 17 aa, Entamoeba invadens
ICKNGYYYEQKFCYECD

SEQ ID NO: 2793337 - protein, 25 aa, Entamoeba invadens
ICKNVCVPMEMLAYFKNFNIKLKKS

SEQ ID NO: 2793338 - protein, 17 aa, Entamoeba invadens
ICKQCIDNYVFREIKSV

SEQ ID NO: 2793339 - protein, 17 aa, Entamoeba invadens
ICKSGYYDKNFYLSCPS

SEQ ID NO: 2793340 - protein, 22 aa, Entamoeba invadens
ICLALLGFFGNFTIKIPKKMTS

SEQ ID NO: 2793341 - protein, 19 aa, Entamoeba invadens
ICLENCINFDYLLNFSDAF

SEQ ID NO: 2793342 - protein, 22 aa, Entamoeba invadens
ICLEYLRCPFGFRNSTSKTCER

SEQ ID NO: 2793343 - protein, 25 aa, Entamoeba invadens
ICLFPTLFINFKFFLTQLVINALFV

SEQ ID NO: 2793344 - protein, 25 aa, Entamoeba invadens
ICLLQCGEDLLFSIFRLVNAFPTRE

SEQ ID NO: 2793345 - protein, 17 aa, Entamoeba invadens
ICLSCNEGMFLSDHVCK

SEQ ID NO: 2793346 - protein, 17 aa, Entamoeba invadens
ICLVTEFANYGSLKDLM

SEQ ID NO: 2793347 - protein, 24 aa, Entamoeba invadens
ICLYFCYWYLYHLVAFPILVCISM

SEQ ID NO: 2793348 - protein, 17 aa, Entamoeba invadens
ICMICTMTCRFVDCFTD

SEQ ID NO: 2793349 - protein, 17 aa, Entamoeba invadens
ICMKCKSPYYLYLNEDR

SEQ ID NO: 2793350 - protein, 18 aa, Entamoeba invadens
ICMNCFELIPNCQLCEYN

SEQ ID NO: 2793351 - protein, 17 aa, Entamoeba invadens
ICNCSLFNPTPSISAML

SEQ ID NO: 2793352 - protein, 18 aa, Entamoeba invadens
ICNECKLPFYPSQSGQNI

SEQ ID NO: 2793353 - protein, 19 aa, Entamoeba invadens
ICNECKLPFYPSQSGQNIG

SEQ ID NO: 2793354 - protein, 19 aa, Entamoeba invadens
ICNGCHLADCIYCNMTKES

SEQ ID NO: 2793355 - protein, 26 aa, Entamoeba invadens
ICNIKQKLILKEGVCQQVDPNSDANS

SEQ ID NO: 2793356 - protein, 21 aa, Entamoeba invadens
ICNKCTVSNCKTCDTNNTKCD

SEQ ID NO: 2793357 - protein, 18 aa, Entamoeba invadens
ICNREYVDGMAHILNNID

SEQ ID NO: 2793358 - protein, 23 aa, Entamoeba invadens
ICPDHKIRWYGYLIQFIVLMFPL

SEQ ID NO: 2793359 - protein, 19 aa, Entamoeba invadens
ICQICEPHYTLNINGKCEP

SEQ ID NO: 2793360 - protein, 18 aa, Entamoeba invadens
ICRNREAAFSNFLAHILI

SEQ ID NO: 2793361 - protein, 18 aa, Entamoeba invadens
ICRSCNGPTTSECNSCND

SEQ ID NO: 2793362 - protein, 23 aa, Entamoeba invadens
ICSECLHRFEADYVRQYSPEKFR

SEQ ID NO: 2793363 - protein, 19 aa, Entamoeba invadens
ICSGLSIEICLECLGTSQN

SEQ ID NO: 2793364 - protein, 19 aa, Entamoeba invadens
ICSKCSVKNCITCTTDPTT

SEQ ID NO: 2793365 - protein, 18 aa, Entamoeba invadens
ICSNNCKECILYNKCSSC

SEQ ID NO: 2793366 - protein, 18 aa, Entamoeba invadens
ICSNSLLLLNGKCIKRVD

SEQ ID NO: 2793367 - protein, 17 aa, Entamoeba invadens
ICSSTFKNEKCITCKNK

SEQ ID NO: 2793368 - protein, 26 aa, Entamoeba invadens
ICSYVQLRGSVPVRWSQVPNFKYKPK

SEQ ID NO: 2793369 - protein, 18 aa, Entamoeba invadens
ICTACPKGTYSSNIASSS

SEQ ID NO: 2793370 - protein, 20 aa, Entamoeba invadens
ICTIGYFPEAVCKNCSEISG

SEQ ID NO: 2793371 - protein, 21 aa, Entamoeba invadens
ICTKCLSGYYLQDGECLQIKN

SEQ ID NO: 2793372 - protein, 22 aa, Entamoeba invadens
ICTKEKCQKCVISKYLEEDTCK

SEQ ID NO: 2793373 - protein, 20 aa, Entamoeba invadens
ICTLTTFASVWTPFKKKNSC

SEQ ID NO: 2793374 - protein, 26 aa, Entamoeba invadens
ICTQSWQVCALLTLACGQEKQFIQSG

SEQ ID NO: 2793375 - protein, 18 aa, Entamoeba invadens
ICTTCASGYVLKSTSSTK

SEQ ID NO: 2793376 - protein, 18 aa, Entamoeba invadens
ICTTCASGYVLKTTSSTK

SEQ ID NO: 2793377 - protein, 24 aa, Entamoeba invadens
ICTYQLSYMVGFFIIGYNYINLNV

SEQ ID NO: 2793378 - protein, 17 aa, Entamoeba invadens
ICVELKGTFNYQTHTFE

SEQ ID NO: 2793379 - protein, 18 aa, Entamoeba invadens
ICVICSAGYFSTGGTSYC

SEQ ID NO: 2793380 - protein, 19 aa, Entamoeba invadens
ICVLAVLCYAAYLTYAKKY

SEQ ID NO: 2793381 - protein, 20 aa, Entamoeba invadens
ICVMCPDMQYSFAGSTMCKS

SEQ ID NO: 2793382 - protein, 18 aa, Entamoeba invadens
ICVNCPLGFFQDEVGQRL

SEQ ID NO: 2793383 - protein, 22 aa, Entamoeba invadens
ICVPSGTPLLKFWAKIPNAFWW

SEQ ID NO: 2793384 - protein, 20 aa, Entamoeba invadens
ICVSCGVGYISYNNYCYGCS

SEQ ID NO: 2793385 - protein, 24 aa, Entamoeba invadens
ICVTVVGCLAVFIACLNVFGGFFI

SEQ ID NO: 2793386 - protein, 18 aa, Entamoeba invadens
ICVVEYMGFGVIPIANNS

SEQ ID NO: 2793387 - protein, 25 aa, Entamoeba invadens
ICVYLLICFGITYTLEFTLIPMGGV

SEQ ID NO: 2793388 - protein, 24 aa, Entamoeba invadens
ICYFNCIRLPFMNFGYFVAAALTF

SEQ ID NO: 2793389 - protein, 22 aa, Entamoeba invadens
IDAIVCRRMLHSFLVEGITVLC

SEQ ID NO: 2793390 - protein, 18 aa, Entamoeba invadens
IDAQRMLTGFGVSLQTAK

SEQ ID NO: 2793391 - protein, 23 aa, Entamoeba invadens
IDASQIAFHFAFIVAALMLGASD

SEQ ID NO: 2793392 - protein, 18 aa, Entamoeba invadens
IDASRCFKVTQRPSNVPQ

SEQ ID NO: 2793393 - protein, 21 aa, Entamoeba invadens
IDCINGYIFKGGLCVLPSENQ

SEQ ID NO: 2793394 - protein, 45 aa, Entamoeba invadens
IDCKTWMKECKRFPKFFHCIVALAPIKLVHLVIVLFPTFIDIKNV

SEQ ID NO: 2793395 - protein, 22 aa, Entamoeba invadens
IDCLDFTKARCELEKDSGCPNS

SEQ ID NO: 2793396 - protein, 17 aa, Entamoeba invadens
IDCPVKLVADMSSDILS

SEQ ID NO: 2793397 - protein, 19 aa, Entamoeba invadens
IDDRMPLKYRALVEDCWKQ

SEQ ID NO: 2793398 - protein, 18 aa, Entamoeba invadens
IDEIRKSKMYSMYLKTTE

SEQ ID NO: 2793399 - protein, 24 aa, Entamoeba invadens
IDELPFKLFEKVSYRNLLSWYLGG

SEQ ID NO: 2793400 - protein, 17 aa, Entamoeba invadens
IDFCIKKSRNLEVCEIC

SEQ ID NO: 2793401 - protein, 23 aa, Entamoeba invadens
IDFGTTKCCICVVGQDGIPTVLE

SEQ ID NO: 2793402 - protein, 19 aa, Entamoeba invadens
IDFKCVHFTQISNCISSQN

SEQ ID NO: 2793403 - protein, 19 aa, Entamoeba invadens
IDFKNCFDVNCLDYNNERN

SEQ ID NO: 2793404 - protein, 23 aa, Entamoeba invadens
IDFKVKYRRGLPMILKGINAKIE

SEQ ID NO: 2793405 - protein, 17 aa, Entamoeba invadens
IDFNLPIQYEIFFGQTC

SEQ ID NO: 2793406 - protein, 23 aa, Entamoeba invadens
IDFRDVLFFADFFRTFGANEVNW

SEQ ID NO: 2793407 - protein, 17 aa, Entamoeba invadens
IDFSEEFFEKEGGILLD

SEQ ID NO: 2793408 - protein, 17 aa, Entamoeba invadens
IDFSTAVPNCLIGERGE

SEQ ID NO: 2793409 - protein, 19 aa, Entamoeba invadens
IDFYRKLLKILRVYMKIAK

SEQ ID NO: 2793410 - protein, 21 aa, Entamoeba invadens
IDGDWKYYLDPALSLIVACVV

SEQ ID NO: 2793411 - protein, 20 aa, Entamoeba invadens
IDGDWKYYLDPSLSLVVACV

SEQ ID NO: 2793412 - protein, 17 aa, Entamoeba invadens
IDGKFLNAESGICDDCG

SEQ ID NO: 2793413 - protein, 22 aa, Entamoeba invadens
IDGKGFLSVGFFYPTEMLISQD

SEQ ID NO: 2793414 - protein, 18 aa, Entamoeba invadens
IDGKRDKFLFSITLLENS

SEQ ID NO: 2793415 - protein, 20 aa, Entamoeba invadens
IDGTFSFKIEDGISELRLIS

SEQ ID NO: 2793416 - protein, 17 aa, Entamoeba invadens
IDHCKRSVDSKCVECDF

SEQ ID NO: 2793417 - protein, 23 aa, Entamoeba invadens
IDIGTTKCCICVVGQDGIPTVLE

SEQ ID NO: 2793418 - protein, 17 aa, Entamoeba invadens
IDIKEFILFVFYSLFSF

SEQ ID NO: 2793419 - protein, 23 aa, Entamoeba invadens
IDIKIRLKFMLDGARGIEYLHTN

SEQ ID NO: 2793420 - protein, 22 aa, Entamoeba invadens
IDIKLRKKFLLDGALGISYLHE

SEQ ID NO: 2793421 - protein, 22 aa, Entamoeba invadens
IDIKLRVKMMIDAAKGILYLHE

SEQ ID NO: 2793422 - protein, 17 aa, Entamoeba invadens
IDIKLRVKYCLDASKGI

SEQ ID NO: 2793423 - protein, 19 aa, Entamoeba invadens
IDINESYTLYAERSKDVPL

SEQ ID NO: 2793424 - protein, 23 aa, Entamoeba invadens
IDKAKRVKCYAKHFSLVLDNITL

SEQ ID NO: 2793425 - protein, 22 aa, Entamoeba invadens
IDKGEVFPFLKVLGHNDSKMYQ

SEQ ID NO: 2793426 - protein, 18 aa, Entamoeba invadens
IDKLKVVTVVDGNDPLSP

SEQ ID NO: 2793427 - protein, 27 aa, Entamoeba invadens
IDKSFPLCYSAFPYTASLRSFFAYFKH

SEQ ID NO: 2793428 - protein, 18 aa, Entamoeba invadens
IDKSKIAIYISIGIVCVF

SEQ ID NO: 2793429 - protein, 24 aa, Entamoeba invadens
IDKYIKFGLAFVFFVAISCTTLIE

SEQ ID NO: 2793430 - protein, 18 aa, Entamoeba invadens
IDLACSIMPIKTTLPQGT

SEQ ID NO: 2793431 - protein, 17 aa, Entamoeba invadens
IDLASSFNYKDSFFYNN

SEQ ID NO: 2793432 - protein, 21 aa, Entamoeba invadens
IDLCGKKTFDGFVNIKTMRRL

SEQ ID NO: 2793433 - protein, 17 aa, Entamoeba invadens
IDLDLVIHCYSLSNYAK

SEQ ID NO: 2793434 - protein, 30 aa, Entamoeba invadens
  misc_feature (26)..(27): Xaa can be any naturally occurring amino acid
IDLFQAIKMIRLDIIFILLALMFGWXXLNC

SEQ ID NO: 2793435 - protein, 20 aa, Entamoeba invadens
IDLLCRASCESEAQDIPVAY

SEQ ID NO: 2793436 - protein, 20 aa, Entamoeba invadens
IDLVKGFWFKIPGADETLEF

SEQ ID NO: 2793437 - protein, 20 aa, Entamoeba invadens
IDMALRMLGMFFPLDYLLYG

SEQ ID NO: 2793438 - protein, 31 aa, Entamoeba invadens
IDMGGLRKEWLRVIAESMFNPDYLLFRPTDD

SEQ ID NO: 2793439 - protein, 23 aa, Entamoeba invadens
IDMKKMYVIPNMCHGRIDAVWIW

SEQ ID NO: 2793440 - protein, 23 aa, Entamoeba invadens
IDMKLKLKFLLDGAKGVSYLHEN

SEQ ID NO: 2793441 - protein, 17 aa, Entamoeba invadens
IDMKLRIKMLLDAAKGI

SEQ ID NO: 2793442 - protein, 17 aa, Entamoeba invadens
IDMKLRTKLLLDASIGI

SEQ ID NO: 2793443 - protein, 24 aa, Entamoeba invadens
IDMKLRVIICLDAAKGILYLHENG

SEQ ID NO: 2793444 - protein, 17 aa, Entamoeba invadens
IDMKLRVKFCLDAAKGI

SEQ ID NO: 2793445 - protein, 17 aa, Entamoeba invadens
IDMKLRVKYMIDAAKGI

SEQ ID NO: 2793446 - protein, 19 aa, Entamoeba invadens
IDMTADAFGALQLATNFAA

SEQ ID NO: 2793447 - protein, 25 aa, Entamoeba invadens
IDMTKFKYLSFIVSWEQDGCNLGLA

SEQ ID NO: 2793448 - protein, 29 aa, Entamoeba invadens
IDNCIKMGIWGCLICEPGYYIDGNKCVKC

SEQ ID NO: 2793449 - protein, 17 aa, Entamoeba invadens
IDNCIKYVNGRCVECSS

SEQ ID NO: 2793450 - protein, 17 aa, Entamoeba invadens
IDNCIKYVNVMCVECSF

SEQ ID NO: 2793451 - protein, 23 aa, Entamoeba invadens
IDNCKKYCLTYVKGVAAPNTQCG

SEQ ID NO: 2793452 - protein, 17 aa, Entamoeba invadens
IDNCLFYQNSICLECLK

SEQ ID NO: 2793453 - protein, 24 aa, Entamoeba invadens
IDNCSLQSLYTCYLCEEGHYLLNG

SEQ ID NO: 2793454 - protein, 17 aa, Entamoeba invadens
IDNCVKYVNGMCVECSS

SEQ ID NO: 2793455 - protein, 18 aa, Entamoeba invadens
IDNCVKYVNGRCVECSSK

SEQ ID NO: 2793456 - protein, 17 aa, Entamoeba invadens
IDNESRITLPYRLKVRM

SEQ ID NO: 2793457 - protein, 17 aa, Entamoeba invadens
IDNKWDCVYDISNPDFT

SEQ ID NO: 2793458 - protein, 23 aa, Entamoeba invadens
IDNRANLDIALMKAETSNKKKIL

SEQ ID NO: 2793459 - protein, 21 aa, Entamoeba invadens
IDPLRMVTIWLTQLFIHYVIS

SEQ ID NO: 2793460 - protein, 19 aa, Entamoeba invadens
IDPMEFPKHFISVSNERIE

SEQ ID NO: 2793461 - protein, 17 aa, Entamoeba invadens
IDPNARNTLKCSMKSLP

SEQ ID NO: 2793462 - protein, 21 aa, Entamoeba invadens
IDPPYSLHFFMKFLAQHEEYH

SEQ ID NO: 2793463 - protein, 27 aa, Entamoeba invadens
IDQLDGCLRCKIGYYKENRECLKCHDN

SEQ ID NO: 2793464 - protein, 20 aa, Entamoeba invadens
IDQRWWLSFHRDSTMLYSPY

SEQ ID NO: 2793465 - protein, 23 aa, Entamoeba invadens
IDRPELVWKGKVIYQKTSTMVDH

SEQ ID NO: 2793466 - protein, 17 aa, Entamoeba invadens
IDRTECQYRYTLQGGIV

SEQ ID NO: 2793467 - protein, 21 aa, Entamoeba invadens
IDRVNGFFPNFVETEMRDDFF

SEQ ID NO: 2793468 - protein, 26 aa, Entamoeba invadens
IDSALSFMFSVSWSSVLYLAQDLGIF

SEQ ID NO: 2793469 - protein, 23 aa, Entamoeba invadens
IDSKRKLSNFGIQNRFMSTENNT

SEQ ID NO: 2793470 - protein, 25 aa, Entamoeba invadens
IDSLPIYLIVHLNRFTEVAGSWSKR

SEQ ID NO: 2793471 - protein, 26 aa, Entamoeba invadens
IDSTRCITCPLGYYLSNNTCNTNAKL

SEQ ID NO: 2793472 - protein, 20 aa, Entamoeba invadens
IDTEKGLYIKALKTENEPIY

SEQ ID NO: 2793473 - protein, 32 aa, Entamoeba invadens
IDTEVRISMTFPYPIIISKHFKSFRVVFDSTV

SEQ ID NO: 2793474 - protein, 23 aa, Entamoeba invadens
IDTFWRDLRMFRIQQEARMNEVL

SEQ ID NO: 2793475 - protein, 18 aa, Entamoeba invadens
IDVSMLITFSLQGYFCFP

SEQ ID NO: 2793476 - protein, 18 aa, Entamoeba invadens
IDVTQRFVAFQKGMMCVI

SEQ ID NO: 2793477 - protein, 18 aa, Entamoeba invadens
IDVVMRLLATRSIVGDEI

SEQ ID NO: 2793478 - protein, 19 aa, Entamoeba invadens
IDVVVCWTSYLKKLDSVKL

SEQ ID NO: 2793479 - protein, 17 aa, Entamoeba invadens
IDYCKSANNSKCIECEG

SEQ ID NO: 2793480 - protein, 26 aa, Entamoeba invadens
IDYGAMFLLSWVCGFINNYLPGWLLA

SEQ ID NO: 2793481 - protein, 17 aa, Entamoeba invadens
IDYGELATKCLMYPDVY

SEQ ID NO: 2793482 - protein, 19 aa, Entamoeba invadens
IEACWKHNPKSRMGIEEVV

SEQ ID NO: 2793483 - protein, 20 aa, Entamoeba invadens
IEADGIIGIHRIDSVDYLIL

SEQ ID NO: 2793484 - protein, 25 aa, Entamoeba invadens
IEAEFKIESNIIFSSTSSFTIKNVT

SEQ ID NO: 2793485 - protein, 17 aa, Entamoeba invadens
IEAFKNFIMNDGTNVNL

SEQ ID NO: 2793486 - protein, 19 aa, Entamoeba invadens
IEAGKSYAINTCGDETTNL

SEQ ID NO: 2793487 - protein, 23 aa, Entamoeba invadens
IEAIKDCTSMECAIQDGEYGECG

SEQ ID NO: 2793488 - protein, 25 aa, Entamoeba invadens
IEAKCLTCLSGYYLKGSTCDVCNNV

SEQ ID NO: 2793489 - protein, 25 aa, Entamoeba invadens
IEAKSGCANYYCDISRLGELTISPK

SEQ ID NO: 2793490 - protein, 19 aa, Entamoeba invadens
IEALCIVLLDLIAIRLDTL

SEQ ID NO: 2793491 - protein, 23 aa, Entamoeba invadens
IEAPRLVKSSGYFVMRFLAIYIP

SEQ ID NO: 2793492 - protein, 26 aa, Entamoeba invadens
IEAYLKKQFKFAWDIVDFVVNGKRPN

SEQ ID NO: 2793493 - protein, 20 aa, Entamoeba invadens
IECELFRMYFDLNTISTIEI

SEQ ID NO: 2793494 - protein, 18 aa, Entamoeba invadens
IECGHFSLLDKNGMCSTE

SEQ ID NO: 2793495 - protein, 17 aa, Entamoeba invadens
IECSDTNCKYCPLDTRY

SEQ ID NO: 2793496 - protein, 17 aa, Entamoeba invadens
IEDGISELRLISFDYNK

SEQ ID NO: 2793497 - protein, 17 aa, Entamoeba invadens
IEDIVTFFIQNAAMVKE

SEQ ID NO: 2793498 - protein, 24 aa, Entamoeba invadens
IEDSNVLLCLSVFSYISNVLITGV

SEQ ID NO: 2793499 - protein, 24 aa, Entamoeba invadens
IEEAEPLIGNVFYRGDKITVKFKT

SEQ ID NO: 2793500 - protein, 25 aa, Entamoeba invadens
IEECIKMSELFVARGVKNLIVKLGP

SEQ ID NO: 2793501 - protein, 20 aa, Entamoeba invadens
IEEFFKITGIQKVKQHEEEV

SEQ ID NO: 2793502 - protein, 18 aa, Entamoeba invadens
IEEKLAVVKTVMMRLNAE

SEQ ID NO: 2793503 - protein, 19 aa, Entamoeba invadens
IEEVNRPQGAVGIYDHTTD

SEQ ID NO: 2793504 - protein, 21 aa, Entamoeba invadens
IEFELFLKPLCTMTFNETIML

SEQ ID NO: 2793505 - protein, 19 aa, Entamoeba invadens
IEFFRNCFEKCEEQQLNEF

SEQ ID NO: 2793506 - protein, 21 aa, Entamoeba invadens
IEFQNKFYVGDGVAFMPLKLE

SEQ ID NO: 2793507 - protein, 19 aa, Entamoeba invadens
IEFQNKFYVGDGVPFTPIK

SEQ ID NO: 2793508 - protein, 20 aa, Entamoeba invadens
IEFYCGDGFVYSQYLINKKI

SEQ ID NO: 2793509 - protein, 18 aa, Entamoeba invadens
IEGCKDCLNSEKLCTSCQ

SEQ ID NO: 2793510 - protein, 25 aa, Entamoeba invadens
IEGEVRLSGVTFKYPSRPEQKVLND

SEQ ID NO: 2793511 - protein, 24 aa, Entamoeba invadens
  misc_feature (18)..(19): Xaa can be any naturally occurring amino acid
IEGEVRLSGVTFKYPSRXXVGDKG

SEQ ID NO: 2793512 - protein, 26 aa, Entamoeba invadens
IEGKFDFCLPISPSLYPNCKRLAFST

SEQ ID NO: 2793513 - protein, 23 aa, Entamoeba invadens
IEGKKKSEAIAMKDVMMTHYDKY

SEQ ID NO: 2793514 - protein, 27 aa, Entamoeba invadens
IEGKYPKWLMIKSHIIVYIGNFIGIVF

SEQ ID NO: 2793515 - protein, 17 aa, Entamoeba invadens
IEGLKTNPTLAVILVAV

SEQ ID NO: 2793516 - protein, 17 aa, Entamoeba invadens
IEGNTALSTRLDPTELI

SEQ ID NO: 2793517 - protein, 23 aa, Entamoeba invadens
IEGSSKCALCENSFFRNDKGECE

SEQ ID NO: 2793518 - protein, 38 aa, Entamoeba invadens
IEIAKKFKPTILVGVPRLYEKLLFRINEALKKSKLAAK

SEQ ID NO: 2793519 - protein, 17 aa, Entamoeba invadens
IEIGSSVITCIDIVSSK

SEQ ID NO: 2793520 - protein, 17 aa, Entamoeba invadens
IEIGSSVTTCIDIVSSK

SEQ ID NO: 2793521 - protein, 32 aa, Entamoeba invadens
IEIKPDVVLLRKGECCTFSIAITPYCSGEYTG

SEQ ID NO: 2793522 - protein, 17 aa, Entamoeba invadens
IEITDWYSVIFAPDKFW

SEQ ID NO: 2793523 - protein, 21 aa, Entamoeba invadens
IEKAYEVFNLQILLIEEQYKN

SEQ ID NO: 2793524 - protein, 20 aa, Entamoeba invadens
IEKCNKYSAKMCITCTQNYL

SEQ ID NO: 2793525 - protein, 19 aa, Entamoeba invadens
IEKCWKQKVEERITINEVI

SEQ ID NO: 2793526 - protein, 18 aa, Entamoeba invadens
IEKDDCIGNGCLWKEGVC

SEQ ID NO: 2793527 - protein, 17 aa, Entamoeba invadens
IEKELFLPATSKSFKTR

SEQ ID NO: 2793528 - protein, 17 aa, Entamoeba invadens
IEKITIKVTDQFDSKIC

SEQ ID NO: 2793529 - protein, 22 aa, Entamoeba invadens
IEKKRSVFFGTFIQLFILGVMS

SEQ ID NO: 2793530 - protein, 19 aa, Entamoeba invadens
IEKPWSWKAFLKSWKSHYF

SEQ ID NO: 2793531 - protein, 28 aa, Entamoeba invadens
IEKSSNWKIGLVVGGLILVLVILLILIF

SEQ ID NO: 2793532 - protein, 26 aa, Entamoeba invadens
IEKVEVFIRRCLKQETIPEQQRFEIS

SEQ ID NO: 2793533 - protein, 17 aa, Entamoeba invadens
IEKYCLLTDAYITPIDT

SEQ ID NO: 2793534 - protein, 18 aa, Entamoeba invadens
IEKYTIIVTIEFNSLRKM

SEQ ID NO: 2793535 - protein, 26 aa, Entamoeba invadens
IELALCLFFLVGCVRKTILEHTHLFV

SEQ ID NO: 2793536 - protein, 33 aa, Entamoeba invadens
IELAPLLIHRELKSGAFLFRLQYIMNDKGDSIL

SEQ ID NO: 2793537 - protein, 17 aa, Entamoeba invadens
IELEGTIDIISMGGNCF

SEQ ID NO: 2793538 - protein, 18 aa, Entamoeba invadens
IELFFDTTMALRCVESYK

SEQ ID NO: 2793539 - protein, 17 aa, Entamoeba invadens
IELHTSSNLMCQSALPL

SEQ ID NO: 2793540 - protein, 20 aa, Entamoeba invadens
IELLRKMVLMKGIPSDQNTL

SEQ ID NO: 2793541 - protein, 22 aa, Entamoeba invadens
IELPLCYIYRFLPPNENLKHFV

SEQ ID NO: 2793542 - protein, 17 aa, Entamoeba invadens
IELRFSVICPDHCGEND

SEQ ID NO: 2793543 - protein, 18 aa, Entamoeba invadens
IELRRPGDVYTQIVDGSH

SEQ ID NO: 2793544 - protein, 24 aa, Entamoeba invadens
IELRVRFLIDAGRGIEYLHNNGIL

SEQ ID NO: 2793545 - protein, 23 aa, Entamoeba invadens
IELYWEKRLRMLKDCASGMVYLH

SEQ ID NO: 2793546 - protein, 24 aa, Entamoeba invadens
IEMKWLVDLKEIFARRKKRVKKWF

SEQ ID NO: 2793547 - protein, 19 aa, Entamoeba invadens
IEMMWDLVKEFNFKKTEFI

SEQ ID NO: 2793548 - protein, 25 aa, Entamoeba invadens
IEMSLECIDVYYSLNKEFFLSENFC

SEQ ID NO: 2793549 - protein, 26 aa, Entamoeba invadens
IEMVYSIPLSSVVFSFRFCTSTLVDS

SEQ ID NO: 2793550 - protein, 22 aa, Entamoeba invadens
IENCKQCVGGMCQLCNENYLMY

SEQ ID NO: 2793551 - protein, 26 aa, Entamoeba invadens
IENCTHPSVYGCLRCSSGYFQDDNFQ

SEQ ID NO: 2793552 - protein, 26 aa, Entamoeba invadens
IENCTYPSVYGCLRCSSGYFQDDNFQ

SEQ ID NO: 2793553 - protein, 17 aa, Entamoeba invadens
IENCVEAGISVKMVTGD

SEQ ID NO: 2793554 - protein, 23 aa, Entamoeba invadens
IENGEKFYYYVFVSVSQICDVKI

SEQ ID NO: 2793555 - protein, 19 aa, Entamoeba invadens
IENGMCVRCQTQLNTQYFN

SEQ ID NO: 2793556 - protein, 20 aa, Entamoeba invadens
IENGYYCKFKTINMTNPSQD

SEQ ID NO: 2793557 - protein, 32 aa, Entamoeba invadens
IENIYKLWNGGGFWFIIFKKLSSFFQILVVAT

SEQ ID NO: 2793558 - protein, 27 aa, Entamoeba invadens
IENLLFFPTICGFVGKSECAISDTLNN

SEQ ID NO: 2793559 - protein, 34 aa, Entamoeba invadens
IENVILPLVFFYRKCTAPGCLLNRVVQQIVLIIT

SEQ ID NO: 2793560 - protein, 22 aa, Entamoeba invadens
IEPDLYFKKEGYLGVRSLLNSY

SEQ ID NO: 2793561 - protein, 24 aa, Entamoeba invadens
IEPGVGKTAIWKGLLQPKVKKYKL

SEQ ID NO: 2793562 - protein, 17 aa, Entamoeba invadens
IEPHCPCTGIHCVAVPD

SEQ ID NO: 2793563 - protein, 19 aa, Entamoeba invadens
IEPKPLIEIFDCQKSNGSF

SEQ ID NO: 2793564 - protein, 20 aa, Entamoeba invadens
IEPLAFIPFVIESIKILKRE

SEQ ID NO: 2793565 - protein, 25 aa, Entamoeba invadens
IEPLKGCLDSILTMTGRSFTYKGKE

SEQ ID NO: 2793566 - protein, 23 aa, Entamoeba invadens
IEPRMEFVDVHFGVGCINNCGDH

SEQ ID NO: 2793567 - protein, 29 aa, Entamoeba invadens
IEQHKCLSCSFDNCNICNQNKCLLCENQY

SEQ ID NO: 2793568 - protein, 18 aa, Entamoeba invadens
IEQLKGRIPTSVSVEKHK

SEQ ID NO: 2793569 - protein, 25 aa, Entamoeba invadens
IEQNCKSLLLPISINSVRISSAEHV

SEQ ID NO: 2793570 - protein, 23 aa, Entamoeba invadens
IEQRKIFISFLFDGVRSQSIAQF

SEQ ID NO: 2793571 - protein, 17 aa, Entamoeba invadens
IEQTKGIYEFDKFIQCA

SEQ ID NO: 2793572 - protein, 22 aa, Entamoeba invadens
IERCCLNAKILQFVQASKLDMV

SEQ ID NO: 2793573 - protein, 21 aa, Entamoeba invadens
IEREFKFGSQYNHFMNGFFIM

SEQ ID NO: 2793574 - protein, 24 aa, Entamoeba invadens
IERGLAVYLCSTRENLSIKLEDSF

SEQ ID NO: 2793575 - protein, 23 aa, Entamoeba invadens
IERIDVGCVIFKTTTNTVLTVYA

SEQ ID NO: 2793576 - protein, 17 aa, Entamoeba invadens
IERKFKEIVMGNEKASH

SEQ ID NO: 2793577 - protein, 26 aa, Entamoeba invadens
IERLPIDIKDCFALFTSPEELGIENG

SEQ ID NO: 2793578 - protein, 19 aa, Entamoeba invadens
IERRSRKVVFCAAHSLPVT

SEQ ID NO: 2793579 - protein, 20 aa, Entamoeba invadens
IERYLKLGIINRLTELMTSE

SEQ ID NO: 2793580 - protein, 21 aa, Entamoeba invadens
IERYRECFAVILDYDSIAHVK

SEQ ID NO: 2793581 - protein, 27 aa, Entamoeba invadens
IESGTKCLSCKYGFYQGENHTCLPSTE

SEQ ID NO: 2793582 - protein, 22 aa, Entamoeba invadens
IESKLATALILGCRKYSQNLRY

SEQ ID NO: 2793583 - protein, 17 aa, Entamoeba invadens
IESVFRGYIFLSLINSL

SEQ ID NO: 2793584 - protein, 17 aa, Entamoeba invadens
IESYLFKIPNLSECFVF

SEQ ID NO: 2793585 - protein, 29 aa, Entamoeba invadens
IETCEAMVLLGLVNLRSSLTFEKPHKQNT

SEQ ID NO: 2793586 - protein, 22 aa, Entamoeba invadens
IETIFDILMEWYYVFTSHFTYD

SEQ ID NO: 2793587 - protein, 17 aa, Entamoeba invadens
IETKLRVKMMIDAAKGI

SEQ ID NO: 2793588 - protein, 20 aa, Entamoeba invadens
IETKYPKFQMRFEPSTVCIP

SEQ ID NO: 2793589 - protein, 18 aa, Entamoeba invadens
IETPVVYERGVMNLLIGR

SEQ ID NO: 2793590 - protein, 25 aa, Entamoeba invadens
IETRLEKMWNAFSALQFDFSNPPIA

SEQ ID NO: 2793591 - protein, 24 aa, Entamoeba invadens
IETVKGGGIILVLLSGMTSIKQLY

SEQ ID NO: 2793592 - protein, 22 aa, Entamoeba invadens
IEVDRLYIGFDIESLDDIKPFI

SEQ ID NO: 2793593 - protein, 19 aa, Entamoeba invadens
IEVNVSYDILNPVIKKINP

SEQ ID NO: 2793594 - protein, 17 aa, Entamoeba invadens
IEVSPHFQRLVHESCRR

SEQ ID NO: 2793595 - protein, 20 aa, Entamoeba invadens
IEVWLLTSFHIIALIVLIIL

SEQ ID NO: 2793596 - protein, 24 aa, Entamoeba invadens
IEYFSRLQSLPSFSQNFSYGKQTS

SEQ ID NO: 2793597 - protein, 18 aa, Entamoeba invadens
IEYIGCTECSNTIGSTGI

SEQ ID NO: 2793598 - protein, 17 aa, Entamoeba invadens
IEYRNGDLWTYDKTNDY

SEQ ID NO: 2793599 - protein, 23 aa, Entamoeba invadens
IFAIFRLNLLIIKMRRNAKLRKQ

SEQ ID NO: 2793600 - protein, 19 aa, Entamoeba invadens
IFALIIVTIFKFETRIQLI

SEQ ID NO: 2793601 - protein, 24 aa, Entamoeba invadens
IFARRKKRVKKWFEVGSKKKFTDE

SEQ ID NO: 2793602 - protein, 21 aa, Entamoeba invadens
IFASAFMRFSQALLLGDVMIK

SEQ ID NO: 2793603 - protein, 18 aa, Entamoeba invadens
IFAYCFIGDVVGILLSEE

SEQ ID NO: 2793604 - protein, 20 aa, Entamoeba invadens
IFCEKCKTHYKIPCEDYECE

SEQ ID NO: 2793605 - protein, 24 aa, Entamoeba invadens
IFCEKGISCSRGVCLSTNNELVLN

SEQ ID NO: 2793606 - protein, 18 aa, Entamoeba invadens
IFCIFFCIYLFVSYQHVV

SEQ ID NO: 2793607 - protein, 17 aa, Entamoeba invadens
IFCQLNAICLVQDVELL

SEQ ID NO: 2793608 - protein, 25 aa, Entamoeba invadens
IFDCVKCPLCFLTEPLKMDETTIPG

SEQ ID NO: 2793609 - protein, 18 aa, Entamoeba invadens
IFDIKRSNVRFVKTNSMD

SEQ ID NO: 2793610 - protein, 24 aa, Entamoeba invadens
IFDSKCSKCTFWHSPNKSGTLCNK

SEQ ID NO: 2793611 - protein, 24 aa, Entamoeba invadens
IFDSPITFEFCLGAAGVLIAIANY

SEQ ID NO: 2793612 - protein, 25 aa, Entamoeba invadens
IFEIDFKYGEEWVEGIKPKSLLFTP

SEQ ID NO: 2793613 - protein, 25 aa, Entamoeba invadens
IFEKENYGAFLWKKGVFETTQKGIF

SEQ ID NO: 2793614 - protein, 21 aa, Entamoeba invadens
IFEKKCKIENLIISSISNFWF

SEQ ID NO: 2793615 - protein, 18 aa, Entamoeba invadens
IFELPNTLTGLSIFNTNN

SEQ ID NO: 2793616 - protein, 18 aa, Entamoeba invadens
IFELSIEILIAFVDQPTE

SEQ ID NO: 2793617 - protein, 26 aa, Entamoeba invadens
IFESIEPFTSLGFCEFGKKVIDVIMK

SEQ ID NO: 2793618 - protein, 20 aa, Entamoeba invadens
IFFEGNAKAILSYLLVSNSA

SEQ ID NO: 2793619 - protein, 18 aa, Entamoeba invadens
IFFFIFGLFHHWQYVQTL

SEQ ID NO: 2793620 - protein, 27 aa, Entamoeba invadens
IFFFPKIGKYFLYFSVFFTGFTCFYLI

SEQ ID NO: 2793621 - protein, 25 aa, Entamoeba invadens
IFFHTFWLLCILFCVARTAFELVRL

SEQ ID NO: 2793622 - protein, 26 aa, Entamoeba invadens
IFFILGFFCYCIWIVAFCKFKNSGNA

SEQ ID NO: 2793623 - protein, 17 aa, Entamoeba invadens
IFFISCFLFNKNNYGIL

SEQ ID NO: 2793624 - protein, 17 aa, Entamoeba invadens
IFFKNAAFFLHLLWYAM

SEQ ID NO: 2793625 - protein, 26 aa, Entamoeba invadens
IFFLSVFCIILLLALLIGSAVLISYN

SEQ ID NO: 2793626 - protein, 22 aa, Entamoeba invadens
IFFQFLHCVHVLLIQNQTAFEF

SEQ ID NO: 2793627 - protein, 17 aa, Entamoeba invadens
IFFQLFLLFFLIQSVSA

SEQ ID NO: 2793628 - protein, 21 aa, Entamoeba invadens
IFFTIFSIFVVFSLPEFPFMW

SEQ ID NO: 2793629 - protein, 19 aa, Entamoeba invadens
IFFVICILVNITLVALAVW

SEQ ID NO: 2793630 - protein, 17 aa, Entamoeba invadens
IFFVLGFVFCPGYFCVS

SEQ ID NO: 2793631 - protein, 31 aa, Entamoeba invadens
IFGAIGDRCTFVWGRRRIFLAVGAFIDVLGM

SEQ ID NO: 2793632 - protein, 18 aa, Entamoeba invadens
IFGCIAYDSWCEFEENYV

SEQ ID NO: 2793633 - protein, 17 aa, Entamoeba invadens
IFHAKKDGKSCVFTMEV

SEQ ID NO: 2793634 - protein, 34 aa, Entamoeba invadens
IFHSKRGKPEYSFFKITFSLALSVVSIVFLIVYL

SEQ ID NO: 2793635 - protein, 24 aa, Entamoeba invadens
IFHYMCLSPSMATLLIPIFPLLIT

SEQ ID NO: 2793636 - protein, 25 aa, Entamoeba invadens
IFIADVMLAFYLYNGWSDQLTDKLC

SEQ ID NO: 2793637 - protein, 24 aa, Entamoeba invadens
IFIAIIAIIWWRRAKSVKAETAAI

SEQ ID NO: 2793638 - protein, 24 aa, Entamoeba invadens
IFIDHDFEVCRAFFNTGFSQDYKE

SEQ ID NO: 2793639 - protein, 20 aa, Entamoeba invadens
IFIIYCVIVYLQRKRNLKVF

SEQ ID NO: 2793640 - protein, 23 aa, Entamoeba invadens
IFILGNVVSYVFREKTLQLFLVV

SEQ ID NO: 2793641 - protein, 20 aa, Entamoeba invadens
IFITLRYGKLRTLLMDLNNQ

SEQ ID NO: 2793642 - protein, 23 aa, Entamoeba invadens
IFIVFKIIEIFLFKKTLYKDFGF

SEQ ID NO: 2793643 - protein, 17 aa, Entamoeba invadens
IFIWIAFTLLFVTLAFF

SEQ ID NO: 2793644 - protein, 20 aa, Entamoeba invadens
IFKFPWKIAEFVISGKRRIK

SEQ ID NO: 2793645 - protein, 17 aa, Entamoeba invadens
IFLAYLIFFVIAFFQYL

SEQ ID NO: 2793646 - protein, 17 aa, Entamoeba invadens
IFLCIPLVLYFLPNVGF

SEQ ID NO: 2793647 - protein, 22 aa, Entamoeba invadens
IFLMCTFSALLLTLTVFNTVIH

SEQ ID NO: 2793648 - protein, 22 aa, Entamoeba invadens
IFLMQRIVLVGARSTPFHTTRL

SEQ ID NO: 2793649 - protein, 27 aa, Entamoeba invadens
IFLSMVLRVLMSFSFLLASACYYASTN

SEQ ID NO: 2793650 - protein, 27 aa, Entamoeba invadens
IFLSNFLLDLALEFGYFFDSKLARNTG

SEQ ID NO: 2793651 - protein, 17 aa, Entamoeba invadens
IFLTLSDLFSGERSVLA

SEQ ID NO: 2793652 - protein, 19 aa, Entamoeba invadens
IFLYFNMYLIWTVDFTTTH

SEQ ID NO: 2793653 - protein, 20 aa, Entamoeba invadens
IFMAQAIFIILAMALRMATY

SEQ ID NO: 2793654 - protein, 30 aa, Entamoeba invadens
IFMICSFGYLCFLIIFKWCAPFQEGAPMLT

SEQ ID NO: 2793655 - protein, 19 aa, Entamoeba invadens
IFNNFRMVIGDMIRDKNFI

SEQ ID NO: 2793656 - protein, 22 aa, Entamoeba invadens
IFRRKESWRPQKFNLAEVTVQL

SEQ ID NO: 2793657 - protein, 27 aa, Entamoeba invadens
IFSAVFKFAPLPLFVGWYTILFTVFFN

SEQ ID NO: 2793658 - protein, 22 aa, Entamoeba invadens
IFSEALALYGFIVALVMASTGN

SEQ ID NO: 2793659 - protein, 29 aa, Entamoeba invadens
IFSFAITMFEVFGWSDAYLSETFKFPWKI

SEQ ID NO: 2793660 - protein, 17 aa, Entamoeba invadens
IFSFAITMYECFTWKEP

SEQ ID NO: 2793661 - protein, 18 aa, Entamoeba invadens
IFSFAITMYEIFGWKEPY

SEQ ID NO: 2793662 - protein, 20 aa, Entamoeba invadens
IFSFDKEKFNFFTLNKHISS

SEQ ID NO: 2793663 - protein, 26 aa, Entamoeba invadens
IFSFGVTMFESFGWCNAYPKKDFTYP

SEQ ID NO: 2793664 - protein, 27 aa, Entamoeba invadens
IFSFSILMYECFVWDKAYPTSQFKFPW

SEQ ID NO: 2793665 - protein, 25 aa, Entamoeba invadens
IFSFSIMFFETMTWGLAYPYEMKSW

SEQ ID NO: 2793666 - protein, 18 aa, Entamoeba invadens
IFSIYLKSLIGFYQENGV

SEQ ID NO: 2793667 - protein, 17 aa, Entamoeba invadens
IFSLGTSMYEVFSWKSA

SEQ ID NO: 2793668 - protein, 22 aa, Entamoeba invadens
IFSSPPWNCFTPILYSDNKIPD

SEQ ID NO: 2793669 - protein, 17 aa, Entamoeba invadens
IFTASFFGEYSMRFDSR

SEQ ID NO: 2793670 - protein, 21 aa, Entamoeba invadens
IFTAVCFLFALFCVLFDSKVS

SEQ ID NO: 2793671 - protein, 26 aa, Entamoeba invadens
IFTEIFKGRFRDVVDIQKVEELWRSC

SEQ ID NO: 2793672 - protein, 19 aa, Entamoeba invadens
IFTFIPKFLFFQYKQLTNV

SEQ ID NO: 2793673 - protein, 18 aa, Entamoeba invadens
IFTIFSLLDAFIFHTVGG

SEQ ID NO: 2793674 - protein, 26 aa, Entamoeba invadens
IFTLCELFWRTSFIVIGSIQLCVFLI

SEQ ID NO: 2793675 - protein, 23 aa, Entamoeba invadens
IFTLGCLFYYIGCRKHPYGEPLV

SEQ ID NO: 2793676 - protein, 17 aa, Entamoeba invadens
IFVGVYLVLFWLVFLKR

SEQ ID NO: 2793677 - protein, 26 aa, Entamoeba invadens
IFVSGFWCIVFCQLGVMKFFEVGATD

SEQ ID NO: 2793678 - protein, 17 aa, Entamoeba invadens
IFVSRIISHFFRKSQMC

SEQ ID NO: 2793679 - protein, 18 aa, Entamoeba invadens
IFWEVPFEQKGIITIPVC

SEQ ID NO: 2793680 - protein, 22 aa, Entamoeba invadens
IFYFFYVIICFIIFANKTYRSA

SEQ ID NO: 2793681 - protein, 17 aa, Entamoeba invadens
IFYKYFIKLELYKKSNS

SEQ ID NO: 2793682 - protein, 19 aa, Entamoeba invadens
IFYLKIKHFLYLQNKSLLL

SEQ ID NO: 2793683 - protein, 25 aa, Entamoeba invadens
IFYLSAKKKFEWVVSVIKDIVKEND

SEQ ID NO: 2793684 - protein, 18 aa, Entamoeba invadens
IFYQLEMVKTAQFTLKKF

SEQ ID NO: 2793685 - protein, 24 aa, Entamoeba invadens
IGAGAFCAFFLYIGLMLSAGEKML

SEQ ID NO: 2793686 - protein, 19 aa, Entamoeba invadens
IGAKMNHVELIFRSDNKIA

SEQ ID NO: 2793687 - protein, 19 aa, Entamoeba invadens
IGARAFKGAIKLATVTITN

SEQ ID NO: 2793688 - protein, 18 aa, Entamoeba invadens
IGCCCLISLIILFDYYFY

SEQ ID NO: 2793689 - protein, 18 aa, Entamoeba invadens
IGCLSCKQGYYITPDLTC

SEQ ID NO: 2793690 - protein, 19 aa, Entamoeba invadens
IGCLVSHALGYVSVPIALL

SEQ ID NO: 2793691 - protein, 19 aa, Entamoeba invadens
IGCTECLESFYLMDGICFP

SEQ ID NO: 2793692 - protein, 20 aa, Entamoeba invadens
IGCTLCKPNYFPKNKTCHLC

SEQ ID NO: 2793693 - protein, 18 aa, Entamoeba invadens
IGCVEWLSKYSGIVKENN

SEQ ID NO: 2793694 - protein, 22 aa, Entamoeba invadens
IGCVMCSKGYYLQNYMCHSCSS

SEQ ID NO: 2793695 - protein, 22 aa, Entamoeba invadens
IGDAAFRKTKLVTITIPTTVTT

SEQ ID NO: 2793696 - protein, 18 aa, Entamoeba invadens
IGDESILFFLKSVVPVFT

SEQ ID NO: 2793697 - protein, 17 aa, Entamoeba invadens
IGDLLTWIVEMRNFSVN

SEQ ID NO: 2793698 - protein, 29 aa, Entamoeba invadens
IGDQKDCACGYAFCTTAVMEVRALTDLGI

SEQ ID NO: 2793699 - protein, 23 aa, Entamoeba invadens
IGDSHCGKATLVRNVAQLCGSVL

SEQ ID NO: 2793700 - protein, 25 aa, Entamoeba invadens
IGDSKCSKCSFWYSPSSEGTYCLKK

SEQ ID NO: 2793701 - protein, 19 aa, Entamoeba invadens
IGDYALCRMFVGLQPSVIF

SEQ ID NO: 2793702 - protein, 22 aa, Entamoeba invadens
IGEAFFFVWENFYYLLVPLMVS

SEQ ID NO: 2793703 - protein, 24 aa, Entamoeba invadens
IGEEEIFTVLSFLMSHKYSKNSVE

SEQ ID NO: 2793704 - protein, 18 aa, Entamoeba invadens
IGEFKIYINTIVHACSSS

SEQ ID NO: 2793705 - protein, 22 aa, Entamoeba invadens
IGEGNLALCIGKCSRYVDRHWL

SEQ ID NO: 2793706 - protein, 22 aa, Entamoeba invadens
IGEKLGKSYYRAMSSNNNIKNR

SEQ ID NO: 2793707 - protein, 22 aa, Entamoeba invadens
IGEKNLQLCVGKCSSSAGNHWL

SEQ ID NO: 2793708 - protein, 28 aa, Entamoeba invadens
IGEKVGWFTLLEVFGFIVLTVGILLYTK

SEQ ID NO: 2793709 - protein, 26 aa, Entamoeba invadens
IGENHRPEGLFVYFGCRNECRKNVDD

SEQ ID NO: 2793710 - protein, 18 aa, Entamoeba invadens
IGERCFTRNILRATKNTT

SEQ ID NO: 2793711 - protein, 19 aa, Entamoeba invadens
IGEVLRLSHQYNVIDSENQ

SEQ ID NO: 2793712 - protein, 19 aa, Entamoeba invadens
IGFFARYNYLTDLILYEQQ

SEQ ID NO: 2793713 - protein, 24 aa, Entamoeba invadens
IGFVKEYKLCFVMIAIAPLMAGAA

SEQ ID NO: 2793714 - protein, 26 aa, Entamoeba invadens
IGGAKGVFYYSFFDLVFMNDKGDPFE

SEQ ID NO: 2793715 - protein, 26 aa, Entamoeba invadens
IGGAKGVFYYSYFDFVYMDDKGDPFM

SEQ ID NO: 2793716 - protein, 28 aa, Entamoeba invadens
IGGAKGVFYYSYFDLIRMNSTDPFEERW

SEQ ID NO: 2793717 - protein, 18 aa, Entamoeba invadens
IGGCDGDKTGKCPHPTFI

SEQ ID NO: 2793718 - protein, 26 aa, Entamoeba invadens
IGGCVLSSLIIGFGIYGYTFINVKFI

SEQ ID NO: 2793719 - protein, 18 aa, Entamoeba invadens
IGGDWIFLNIKGLMVTKS

SEQ ID NO: 2793720 - protein, 28 aa, Entamoeba invadens
IGGGTFGIVYRAEWRRVDVAVKVMKTDL

SEQ ID NO: 2793721 - protein, 18 aa, Entamoeba invadens
IGGIVLANFVFYGIINAM

SEQ ID NO: 2793722 - protein, 19 aa, Entamoeba invadens
IGGKLPLKAYKTLVKETCT

SEQ ID NO: 2793723 - protein, 20 aa, Entamoeba invadens
IGGSIFSWSSYNRDIREAMG

SEQ ID NO: 2793724 - protein, 17 aa, Entamoeba invadens
IGGVFVYVFGYGKVVSY

SEQ ID NO: 2793725 - protein, 25 aa, Entamoeba invadens
IGGWPTKIAIYGSFAINLCLCVTKI

SEQ ID NO: 2793726 - protein, 24 aa, Entamoeba invadens
IGHIPRLDAPIVHQDDVVKSTTFA

SEQ ID NO: 2793727 - protein, 17 aa, Entamoeba invadens
IGIDLLWILWLIFGVAY

SEQ ID NO: 2793728 - protein, 19 aa, Entamoeba invadens
IGIEILIGVIVHRRDTIFE

SEQ ID NO: 2793729 - protein, 21 aa, Entamoeba invadens
IGIFCCLFVLIAIPISINTAQ

SEQ ID NO: 2793730 - protein, 24 aa, Entamoeba invadens
IGIFPDWIQALGIKIVERKATLNV

SEQ ID NO: 2793731 - protein, 19 aa, Entamoeba invadens
IGILIVIGMVILRYKEVDI

SEQ ID NO: 2793732 - protein, 19 aa, Entamoeba invadens
IGINFIKVGWICLIFAVPT

SEQ ID NO: 2793733 - protein, 20 aa, Entamoeba invadens
IGIQTGIPRALTLSRKVSFI

SEQ ID NO: 2793734 - protein, 20 aa, Entamoeba invadens
IGIVCVFVILVIISIIVLII

SEQ ID NO: 2793735 - protein, 18 aa, Entamoeba invadens
IGKDNVCMFDFLNYKDLN

SEQ ID NO: 2793736 - protein, 18 aa, Entamoeba invadens
IGKKSEWSSHKDLRVSCN

SEQ ID NO: 2793737 - protein, 23 aa, Entamoeba invadens
IGKKVRWGQLLGIFISVVALIMV

SEQ ID NO: 2793738 - protein, 31 aa, Entamoeba invadens
IGKLRLPLDFIQRILLHISRNVSQISQFVDL

SEQ ID NO: 2793739 - protein, 24 aa, Entamoeba invadens
IGKYEIPETIVIPQSFYEVIAKKK

SEQ ID NO: 2793740 - protein, 31 aa, Entamoeba invadens
IGLASRFKAVRPKNCKFVIDDKIWKEGEVSN

SEQ ID NO: 2793741 - protein, 22 aa, Entamoeba invadens
IGLFAGNLMRMFTTWVEMEGEY

SEQ ID NO: 2793742 - protein, 20 aa, Entamoeba invadens
IGLFISYISAFLFNKMKTLN

SEQ ID NO: 2793743 - protein, 19 aa, Entamoeba invadens
IGLFVSYFSAFIFNKVKSM

SEQ ID NO: 2793744 - protein, 17 aa, Entamoeba invadens
IGLIFCCIPTFADTVHT

SEQ ID NO: 2793745 - protein, 18 aa, Entamoeba invadens
IGLIWWRRTKSVKAETAA

SEQ ID NO: 2793746 - protein, 18 aa, Entamoeba invadens
IGLLAWFVHYNKRVAITR

SEQ ID NO: 2793747 - protein, 21 aa, Entamoeba invadens
IGLLLLLLIFLRRRYRTTPSF

SEQ ID NO: 2793748 - protein, 17 aa, Entamoeba invadens
IGLLVCMLIWSRYARPL

SEQ ID NO: 2793749 - protein, 21 aa, Entamoeba invadens
IGLLVLIGFVLWKLHKTIETQ

SEQ ID NO: 2793750 - protein, 18 aa, Entamoeba invadens
IGLLYDFKCEKLLEMCER

SEQ ID NO: 2793751 - protein, 24 aa, Entamoeba invadens
IGLVSLILIFAMRYVKVDFNIYKT

SEQ ID NO: 2793752 - protein, 25 aa, Entamoeba invadens
IGMCADFTYWFGYVFGFGSAVITFF

SEQ ID NO: 2793753 - protein, 18 aa, Entamoeba invadens
IGMVGVWLTIFSVSDSVL

SEQ ID NO: 2793754 - protein, 32 aa, Entamoeba invadens
IGMYYDWRLGLCSLAIFPILVFFMYMDGYLNS

SEQ ID NO: 2793755 - protein, 17 aa, Entamoeba invadens
IGNIDCFDVISMANNNS

SEQ ID NO: 2793756 - protein, 22 aa, Entamoeba invadens
IGNISIFIHNVVMWKVSNDTSH

SEQ ID NO: 2793757 - protein, 18 aa, Entamoeba invadens
IGNSILYCDDHFYIDNLV

SEQ ID NO: 2793758 - protein, 20 aa, Entamoeba invadens
IGPFMSFLMFLTMVLNKVEL

SEQ ID NO: 2793759 - protein, 26 aa, Entamoeba invadens
IGPGYPPAICKDGFKGNTKITSVKYT

SEQ ID NO: 2793760 - protein, 23 aa, Entamoeba invadens
IGPKEAFLTLGLFNIMRLPLIRF

SEQ ID NO: 2793761 - protein, 23 aa, Entamoeba invadens
IGPLKLVQFVGFDILPILLRLAV

SEQ ID NO: 2793762 - protein, 26 aa, Entamoeba invadens
IGPTLKRATCTLVGSVVMNFTNPLTM

SEQ ID NO: 2793763 - protein, 24 aa, Entamoeba invadens
IGRSCLLCPAGYYSPGGTQSCTLC

SEQ ID NO: 2793764 - protein, 23 aa, Entamoeba invadens
IGSALGGYLARPCIQYPKVFGGI

SEQ ID NO: 2793765 - protein, 24 aa, Entamoeba invadens
IGSAYCFNCLAGTYAAKEGSSSCE

SEQ ID NO: 2793766 - protein, 19 aa, Entamoeba invadens
IGSGCVECECQPGWYATSL

SEQ ID NO: 2793767 - protein, 17 aa, Entamoeba invadens
IGSHLKLDFSVAPIKQS

SEQ ID NO: 2793768 - protein, 18 aa, Entamoeba invadens
IGSKCYTITTGVSVRIEN

SEQ ID NO: 2793769 - protein, 22 aa, Entamoeba invadens
IGSKCYTITTGVSVRIENTQLS

SEQ ID NO: 2793770 - protein, 19 aa, Entamoeba invadens
IGSLKYIWVQSDAATSITD

SEQ ID NO: 2793771 - protein, 22 aa, Entamoeba invadens
IGSLLQWFFNIEKVRVYIFSLM

SEQ ID NO: 2793772 - protein, 18 aa, Entamoeba invadens
IGSTLAFLVTKYISPAAG

SEQ ID NO: 2793773 - protein, 19 aa, Entamoeba invadens
IGTKNGKTYYRAMKTGHPY

SEQ ID NO: 2793774 - protein, 20 aa, Entamoeba invadens
IGTTTECYKCQNGYIRNNNN

SEQ ID NO: 2793775 - protein, 19 aa, Entamoeba invadens
IGTTTECYKCRNNYIRNNN

SEQ ID NO: 2793776 - protein, 17 aa, Entamoeba invadens
IGYFLKVTVAERMCVPC

SEQ ID NO: 2793777 - protein, 22 aa, Entamoeba invadens
IGYRLTDGICVRVHLDECLYYV

SEQ ID NO: 2793778 - protein, 19 aa, Entamoeba invadens
IGYSVWWFYHKQHFQQVHA

SEQ ID NO: 2793779 - protein, 19 aa, Entamoeba invadens
IHAITQFKLDEHQFPTNVV

SEQ ID NO: 2793780 - protein, 19 aa, Entamoeba invadens
IHCLNGFYYNHINTNDISG

SEQ ID NO: 2793781 - protein, 22 aa, Entamoeba invadens
IHFLALSVGLAFTNYFEPDKVV

SEQ ID NO: 2793782 - protein, 17 aa, Entamoeba invadens
IHFMQNFLVNVQVQSTR

SEQ ID NO: 2793783 - protein, 17 aa, Entamoeba invadens
IHFTCFNPSNKRGYVTT

SEQ ID NO: 2793784 - protein, 19 aa, Entamoeba invadens
IHHFLFCGISNFCSSYKNI

SEQ ID NO: 2793785 - protein, 18 aa, Entamoeba invadens
IHIMCHSLGSKFFMQSYL

SEQ ID NO: 2793786 - protein, 22 aa, Entamoeba invadens
IHIRKELQIFTGIDSLHTDINT

SEQ ID NO: 2793787 - protein, 23 aa, Entamoeba invadens
IHISLAISLIMGYGGLIMSGVYI

SEQ ID NO: 2793788 - protein, 18 aa, Entamoeba invadens
IHKTSFVIWQMKGFTRHL

SEQ ID NO: 2793789 - protein, 27 aa, Entamoeba invadens
IHLLCLFRTCPFIPFTLTNYLLAPFVK

SEQ ID NO: 2793790 - protein, 17 aa, Entamoeba invadens
IHMTLFIIVIVILTTSF

SEQ ID NO: 2793791 - protein, 19 aa, Entamoeba invadens
IHNGVVLGYLALFVGILLM

SEQ ID NO: 2793792 - protein, 17 aa, Entamoeba invadens
IHPNVEVLRGFLEIVMI

SEQ ID NO: 2793793 - protein, 25 aa, Entamoeba invadens
IHPPKASKCVLVFQKIAIGVFFIVF

SEQ ID NO: 2793794 - protein, 22 aa, Entamoeba invadens
IHPVLRYSIDFSSNVSIEEYTL

SEQ ID NO: 2793795 - protein, 28 aa, Entamoeba invadens
IHQCGGTISHCFKMLFTGNIETSKCLQC

SEQ ID NO: 2793796 - protein, 26 aa, Entamoeba invadens
IHQFHHLGKLVLFYGKNGKYQISTLI

SEQ ID NO: 2793797 - protein, 17 aa, Entamoeba invadens
IHTCSRCGGQGKVRQQV

SEQ ID NO: 2793798 - protein, 17 aa, Entamoeba invadens
IHTLFSCANHKLISSLE

SEQ ID NO: 2793799 - protein, 17 aa, Entamoeba invadens
IHTTLVSGGQCYAQDML

SEQ ID NO: 2793800 - protein, 25 aa, Entamoeba invadens
IHVPYLIRVKFLFDAARGVEYLHKN

SEQ ID NO: 2793801 - protein, 18 aa, Entamoeba invadens
IHYKTGRPTTMLINNISF

SEQ ID NO: 2793802 - protein, 19 aa, Entamoeba invadens
IIAAFAAFVGYLGYKKYQS

SEQ ID NO: 2793803 - protein, 25 aa, Entamoeba invadens
IIACGGHSLFNWSMESPYSEKSKKG

SEQ ID NO: 2793804 - protein, 17 aa, Entamoeba invadens
IIADFYNYVKVCPDTLV

SEQ ID NO: 2793805 - protein, 18 aa, Entamoeba invadens
IIAEIKRNQTIVIMGETG

SEQ ID NO: 2793806 - protein, 19 aa, Entamoeba invadens
IIAPICAFFAIVFGVYLFV

SEQ ID NO: 2793807 - protein, 27 aa, Entamoeba invadens
IIAVFVVICTCSYYLIIVVVVVLIVFL

SEQ ID NO: 2793808 - protein, 24 aa, Entamoeba invadens
IIAVIIFFVWRRKRQTMKEREKEI

SEQ ID NO: 2793809 - protein, 17 aa, Entamoeba invadens
IIAVIVVLSSVFGLAFL

SEQ ID NO: 2793810 - protein, 22 aa, Entamoeba invadens
IIAVNFLLNFVLGILLLVYLMK

SEQ ID NO: 2793811 - protein, 24 aa, Entamoeba invadens
IICFCYLLFRHIFLYFNMYLIWTV

SEQ ID NO: 2793812 - protein, 18 aa, Entamoeba invadens
IIDTVKFVAIDGEIFLAY

SEQ ID NO: 2793813 - protein, 22 aa, Entamoeba invadens
IIDVMWRYKQFLFLKEKSSDKA

SEQ ID NO: 2793814 - protein, 17 aa, Entamoeba invadens
IIECTKTQFFIQYFDPF

SEQ ID NO: 2793815 - protein, 18 aa, Entamoeba invadens
IIEEAWLQDQKLRCKIQN

SEQ ID NO: 2793816 - protein, 24 aa, Entamoeba invadens
IIEEDIIALYLVFFALADNTLSED

SEQ ID NO: 2793817 - protein, 19 aa, Entamoeba invadens
IIEKCWEENILKRITIQDV

SEQ ID NO: 2793818 - protein, 17 aa, Entamoeba invadens
IIEKIPICFLKEEKEWL

SEQ ID NO: 2793819 - protein, 21 aa, Entamoeba invadens
IIENGMCVRCQTQLNTQYFNG

SEQ ID NO: 2793820 - protein, 17 aa, Entamoeba invadens
IIEPVTIYIKSGYYPFV

SEQ ID NO: 2793821 - protein, 33 aa, Entamoeba invadens
IIFAMFLAIFWRKQKQRAFHFIGVGLIILALIL

SEQ ID NO: 2793822 - protein, 24 aa, Entamoeba invadens
IIFCGDYLYFFVPINWSFPLTSDE

SEQ ID NO: 2793823 - protein, 17 aa, Entamoeba invadens
IIFCVFVTLVLLASVGM

SEQ ID NO: 2793824 - protein, 20 aa, Entamoeba invadens
IIFDGIFDFSCNSVEATSVI

SEQ ID NO: 2793825 - protein, 23 aa, Entamoeba invadens
IIFDISGLLALFLAFTIPSLVEI

SEQ ID NO: 2793826 - protein, 24 aa, Entamoeba invadens
IIFGFLIYYGLRYKKVDIDIYKTQ

SEQ ID NO: 2793827 - protein, 20 aa, Entamoeba invadens
IIFIPFYFLLGVIFIFPMVS

SEQ ID NO: 2793828 - protein, 20 aa, Entamoeba invadens
IIFKWCAPVQEGAPMLTNVF

SEQ ID NO: 2793829 - protein, 20 aa, Entamoeba invadens
IIFLVWRVVKRIHNHRLIQE

SEQ ID NO: 2793830 - protein, 25 aa, Entamoeba invadens
IIFPMCGIMGFLVAILFWLSTLVII

SEQ ID NO: 2793831 - protein, 18 aa, Entamoeba invadens
IIFPNVENSWRMVVKISH

SEQ ID NO: 2793832 - protein, 18 aa, Entamoeba invadens
IIFTIWYTLFWQRKITVV

SEQ ID NO: 2793833 - protein, 17 aa, Entamoeba invadens
IIFVRGIFEIGFIKMKK

SEQ ID NO: 2793834 - protein, 18 aa, Entamoeba invadens
IIGESVFEKTFLVKIDLT

SEQ ID NO: 2793835 - protein, 17 aa, Entamoeba invadens
IIGLKAKLFMLGSSQLT

SEQ ID NO: 2793836 - protein, 18 aa, Entamoeba invadens
IIGTCIALSQLLSSIHKK

SEQ ID NO: 2793837 - protein, 24 aa, Entamoeba invadens
IIGVCSGIFLLIIIVGVCGIVGFV

SEQ ID NO: 2793838 - protein, 19 aa, Entamoeba invadens
IIGVLIIVVSLCLIGTAAF

SEQ ID NO: 2793839 - protein, 19 aa, Entamoeba invadens
IIGYIKIVYYLAFIFIIIG

SEQ ID NO: 2793840 - protein, 24 aa, Entamoeba invadens
IIHCDTCLPGYFKFDSYSCSACFV

SEQ ID NO: 2793841 - protein, 20 aa, Entamoeba invadens
IIHNIKFVKYNGWEDSMKTR

SEQ ID NO: 2793842 - protein, 23 aa, Entamoeba invadens
IIHPFIVAKGIMYFRDFHQSFIL

SEQ ID NO: 2793843 - protein, 22 aa, Entamoeba invadens
IIIGCPLAFLFVVFVLLILLFF

SEQ ID NO: 2793844 - protein, 19 aa, Entamoeba invadens
IIIKRCVFSGNVVMVDNDV

SEQ ID NO: 2793845 - protein, 19 aa, Entamoeba invadens
IIINYCLEPNKYLLFTKRK

SEQ ID NO: 2793846 - protein, 17 aa, Entamoeba invadens
IIIRLKIMIDAFKGILI

SEQ ID NO: 2793847 - protein, 24 aa, Entamoeba invadens
IIKDDVPTWVIVILIIIGIFIVIV

SEQ ID NO: 2793848 - protein, 22 aa, Entamoeba invadens
IIKGKIRGIVNVGAIHKNNEVM

SEQ ID NO: 2793849 - protein, 18 aa, Entamoeba invadens
IIKMIRREFIQFKLYVLK

SEQ ID NO: 2793850 - protein, 18 aa, Entamoeba invadens
IILASALNIFGFANFSLV

SEQ ID NO: 2793851 - protein, 24 aa, Entamoeba invadens
IILATIRFVLGLGIGGEYPLSSSI

SEQ ID NO: 2793852 - protein, 23 aa, Entamoeba invadens
IILHHVIQLILLVVGFSLVCCEF

SEQ ID NO: 2793853 - protein, 17 aa, Entamoeba invadens
IILKKGFACEFEVFLTL

SEQ ID NO: 2793854 - protein, 18 aa, Entamoeba invadens
IILMIEVLVHFVYQNYHL

SEQ ID NO: 2793855 - protein, 18 aa, Entamoeba invadens
IILRCVMQDNKLTMKCLY

SEQ ID NO: 2793856 - protein, 26 aa, Entamoeba invadens
IILVVCGYSFPASLSLDTMKKIYNAF

SEQ ID NO: 2793857 - protein, 18 aa, Entamoeba invadens
IILYSSNNEIVWYNILNI

SEQ ID NO: 2793858 - protein, 25 aa, Entamoeba invadens
IIMFKDLPDCLGLLQLCDDIIIARQ

SEQ ID NO: 2793859 - protein, 18 aa, Entamoeba invadens
IIMIDVFVSYVFELTGYV

SEQ ID NO: 2793860 - protein, 21 aa, Entamoeba invadens
IIMLCKRPHPTKVFWNLVSLF

SEQ ID NO: 2793861 - protein, 24 aa, Entamoeba invadens
IIMLGYLIIRWKDFVYKRKIRSKF

SEQ ID NO: 2793862 - protein, 21 aa, Entamoeba invadens
IIMLWPRIEKLGDPNFRKLSI

SEQ ID NO: 2793863 - protein, 24 aa, Entamoeba invadens
IIMSGTVFWYGERQYILVVSNQVG

SEQ ID NO: 2793864 - protein, 17 aa, Entamoeba invadens
IIMWNSTYLHLNYNYQG

SEQ ID NO: 2793865 - protein, 35 aa, Entamoeba invadens
IINAINFGCCFLLSWVCGFINNFLPGWLLARIGVA

SEQ ID NO: 2793866 - protein, 22 aa, Entamoeba invadens
IINGNCKIRLLNGATKNMGTLY

SEQ ID NO: 2793867 - protein, 17 aa, Entamoeba invadens
IINPVGMGHCMFFDQVP

SEQ ID NO: 2793868 - protein, 18 aa, Entamoeba invadens
IINVIVFILMIFRHSAFS

SEQ ID NO: 2793869 - protein, 21 aa, Entamoeba invadens
IIPKHCFERCTSLQLTTDLCK

SEQ ID NO: 2793870 - protein, 22 aa, Entamoeba invadens
IIQGVGLAMFWSPDETLIGAES

SEQ ID NO: 2793871 - protein, 24 aa, Entamoeba invadens
IIQIRGGQLLSYYSNQKISLNFFV

SEQ ID NO: 2793872 - protein, 26 aa, Entamoeba invadens
IIQKWRCWQLKSWDKMTESLNEDQLI

SEQ ID NO: 2793873 - protein, 25 aa, Entamoeba invadens
IIQRRILDTLPLMFAVIYGELLVSL

SEQ ID NO: 2793874 - protein, 17 aa, Entamoeba invadens
IIRKFANEFPKMPFVAS

SEQ ID NO: 2793875 - protein, 27 aa, Entamoeba invadens
IIRRIGEKWTLVIGGICIVPFLTMNIF

SEQ ID NO: 2793876 - protein, 18 aa, Entamoeba invadens
IIRSALNAKVIFQTITNE

SEQ ID NO: 2793877 - protein, 18 aa, Entamoeba invadens
IIRSLKVPNTFVGKNVSL

SEQ ID NO: 2793878 - protein, 21 aa, Entamoeba invadens
IIRVAMCFFVAAVAVILIFPR

SEQ ID NO: 2793879 - protein, 22 aa, Entamoeba invadens
IISCFLAMVFMFVLRGTLFISW

SEQ ID NO: 2793880 - protein, 25 aa, Entamoeba invadens
IISEKVLPMLSCDNVNSLAKQLKVN

SEQ ID NO: 2793881 - protein, 19 aa, Entamoeba invadens
IISIFGLVFCVLTLPVNYS

SEQ ID NO: 2793882 - protein, 19 aa, Entamoeba invadens
IISKTCLYIALFFLASPWR

SEQ ID NO: 2793883 - protein, 28 aa, Entamoeba invadens
IISRCGQCLRLIGPSNRETICTVSGYFT

SEQ ID NO: 2793884 - protein, 19 aa, Entamoeba invadens
IISSCFRNDVLILETRQHL

SEQ ID NO: 2793885 - protein, 18 aa, Entamoeba invadens
IISTGIFCAILVITATTT

SEQ ID NO: 2793886 - protein, 20 aa, Entamoeba invadens
IISVAISYFVIRKLVNVHNS

SEQ ID NO: 2793887 - protein, 24 aa, Entamoeba invadens
IITLLCVFSPFLFQIDKRIMRSER

SEQ ID NO: 2793888 - protein, 25 aa, Entamoeba invadens
IITQCWCERTDLRLTASQLVAGFAK

SEQ ID NO: 2793889 - protein, 18 aa, Entamoeba invadens
IITRYSRGVLKEKYSIPA

SEQ ID NO: 2793890 - protein, 18 aa, Entamoeba invadens
IIVCNKTEKDVLNWATLG

SEQ ID NO: 2793891 - protein, 27 aa, Entamoeba invadens
IIVEHFYRLTFVYFIFISILCFIPSLE

SEQ ID NO: 2793892 - protein, 25 aa, Entamoeba invadens
IIVIIGVTICWLRKNKNVALETGNN

SEQ ID NO: 2793893 - protein, 25 aa, Entamoeba invadens
IIVIVIICIMTFIVLTTIVFVCIKK

SEQ ID NO: 2793894 - protein, 24 aa, Entamoeba invadens
IIVKKLYNCFHCFYNKSKNLFSKT

SEQ ID NO: 2793895 - protein, 24 aa, Entamoeba invadens
IIVKRLVGEGSFGKVYLGVFRGTQ

SEQ ID NO: 2793896 - protein, 18 aa, Entamoeba invadens
IIVSTPFIGKQFEISLER

SEQ ID NO: 2793897 - protein, 24 aa, Entamoeba invadens
IIVVLCVFVLLCVMLGIIFLAFYF

SEQ ID NO: 2793898 - protein, 18 aa, Entamoeba invadens
IIVVLIFLTLVVIISTLL

SEQ ID NO: 2793899 - protein, 17 aa, Entamoeba invadens
IIVVLLLWYFKKPTTKK

SEQ ID NO: 2793900 - protein, 19 aa, Entamoeba invadens
IIVVVLFCIVLIITSISFQ

SEQ ID NO: 2793901 - protein, 22 aa, Entamoeba invadens
IIVYEADYFWNLWTNGKVDIDG

SEQ ID NO: 2793902 - protein, 17 aa, Entamoeba invadens
IIYCGNLDYSHCQKIKM

SEQ ID NO: 2793903 - protein, 26 aa, Entamoeba invadens
IIYHMWLDILIRAGVSIIPILLCVVY

SEQ ID NO: 2793904 - protein, 18 aa, Entamoeba invadens
IIYKEINFSLTAQLSTRL

SEQ ID NO: 2793905 - protein, 17 aa, Entamoeba invadens
IIYKEINFSLTAQLTTR

SEQ ID NO: 2793906 - protein, 22 aa, Entamoeba invadens
IIYMGGALGEFVTPFCTTYSSS

SEQ ID NO: 2793907 - protein, 17 aa, Entamoeba invadens
IIYSFSFDDSTPVDYGP

SEQ ID NO: 2793908 - protein, 25 aa, Entamoeba invadens
IIYTCLSCKLGYYPTNYGCALCNAG

SEQ ID NO: 2793909 - protein, 24 aa, Entamoeba invadens
IIYTCLSCNLGYYPTNYNCALCNA

SEQ ID NO: 2793910 - protein, 19 aa, Entamoeba invadens
IKADGSWLPPEEYLTEVYL

SEQ ID NO: 2793911 - protein, 18 aa, Entamoeba invadens
IKADGSWLPPEKYLTEVF

SEQ ID NO: 2793912 - protein, 23 aa, Entamoeba invadens
IKADLSKIFGLTGIFGFVLILIL

SEQ ID NO: 2793913 - protein, 23 aa, Entamoeba invadens
IKADVWFIVGLRGFYGCICCIIF

SEQ ID NO: 2793914 - protein, 19 aa, Entamoeba invadens
IKAKLFGEGVKMEQNTQLT

SEQ ID NO: 2793915 - protein, 17 aa, Entamoeba invadens
IKALPRMSAIPKQSTAP

SEQ ID NO: 2793916 - protein, 19 aa, Entamoeba invadens
IKASCVYLMVAGAVCMMSG

SEQ ID NO: 2793917 - protein, 18 aa, Entamoeba invadens
IKATMFKAVKRWREIQSG

SEQ ID NO: 2793918 - protein, 23 aa, Entamoeba invadens
IKAVHAWLNIIIFILQYIMYPKL

SEQ ID NO: 2793919 - protein, 21 aa, Entamoeba invadens
IKCAHMANAFNFINALPNKFD

SEQ ID NO: 2793920 - protein, 17 aa, Entamoeba invadens
IKCGSSINVNGVCTDST

SEQ ID NO: 2793921 - protein, 27 aa, Entamoeba invadens
IKCIDLSELIMNWERFRVNEKMHPLSD

SEQ ID NO: 2793922 - protein, 20 aa, Entamoeba invadens
IKCNPGNYLHDKQCFNCPFG

SEQ ID NO: 2793923 - protein, 17 aa, Entamoeba invadens
IKCSFVMVRCLFGTILY

SEQ ID NO: 2793924 - protein, 18 aa, Entamoeba invadens
IKCTVEGCATCEKVDECT

SEQ ID NO: 2793925 - protein, 17 aa, Entamoeba invadens
IKCTVEGCSTCENVDEC

SEQ ID NO: 2793926 - protein, 23 aa, Entamoeba invadens
IKDGEPQCEGSVIISSNFPNTIC

SEQ ID NO: 2793927 - protein, 23 aa, Entamoeba invadens
IKDKKIPVTLEWANWKNVRRSMD

SEQ ID NO: 2793928 - protein, 29 aa, Entamoeba invadens
IKDKLDAFGKLRVAKMIEDLKVFKYKIVK

SEQ ID NO: 2793929 - protein, 32 aa, Entamoeba invadens
IKDKNRIYVGACTFKLTKCALVSTSDCSIDIH

SEQ ID NO: 2793930 - protein, 24 aa, Entamoeba invadens
IKDLMSRPQLDSVYYSEVEQQKEY

SEQ ID NO: 2793931 - protein, 17 aa, Entamoeba invadens
IKDLPLFFVSNTTSITG

SEQ ID NO: 2793932 - protein, 18 aa, Entamoeba invadens
IKDMKINYTVWFSNNKTN

SEQ ID NO: 2793933 - protein, 17 aa, Entamoeba invadens
IKDNILLGAKEDQKVAD

SEQ ID NO: 2793934 - protein, 19 aa, Entamoeba invadens
IKDQIAVVLIDLSNSQEIV

SEQ ID NO: 2793935 - protein, 17 aa, Entamoeba invadens
IKDRIVKKFIVLYEMDL

SEQ ID NO: 2793936 - protein, 31 aa, Entamoeba invadens
IKECDKWKLCGEWTFKFKASKKELVHVDGES

SEQ ID NO: 2793937 - protein, 18 aa, Entamoeba invadens
IKECLTCQDPYYLSSQKC

SEQ ID NO: 2793938 - protein, 23 aa, Entamoeba invadens
IKEDVCIGCSDMAFLSENKCLTP

SEQ ID NO: 2793939 - protein, 18 aa, Entamoeba invadens
IKEKDIRVNLPLAAPNDM

SEQ ID NO: 2793940 - protein, 21 aa, Entamoeba invadens
IKEKLYVCIDHIYTSSNTINI

SEQ ID NO: 2793941 - protein, 20 aa, Entamoeba invadens
IKELIIKTGGSIYIPITTKT

SEQ ID NO: 2793942 - protein, 18 aa, Entamoeba invadens
IKELKCSHDFVYNRSFEI

SEQ ID NO: 2793943 - protein, 21 aa, Entamoeba invadens
IKELLFRGSETLKNFEKVKGK

SEQ ID NO: 2793944 - protein, 18 aa, Entamoeba invadens
IKERTLLTHLQCALIAFI

SEQ ID NO: 2793945 - protein, 21 aa, Entamoeba invadens
IKESECLSCEIEHCTSCLEDL

SEQ ID NO: 2793946 - protein, 20 aa, Entamoeba invadens
IKEVFIRKNLNDLIFDFDLS

SEQ ID NO: 2793947 - protein, 17 aa, Entamoeba invadens
IKEVSMLDKFRCEYIVH

SEQ ID NO: 2793948 - protein, 29 aa, Entamoeba invadens
IKFARTNEAFNRFVAVALVFDFVVIIAST

SEQ ID NO: 2793949 - protein, 20 aa, Entamoeba invadens
IKFDTLKLINSVAKYPSLVN

SEQ ID NO: 2793950 - protein, 20 aa, Entamoeba invadens
IKFNTELDRLYGINPDHGSK

SEQ ID NO: 2793951 - protein, 22 aa, Entamoeba invadens
IKFNVKLKLLFGTITVTAIAKL

SEQ ID NO: 2793952 - protein, 22 aa, Entamoeba invadens
IKFTELLGGIVVNRRSLDFNEE

SEQ ID NO: 2793953 - protein, 17 aa, Entamoeba invadens
IKFVDIQTGRICSEKPF

SEQ ID NO: 2793954 - protein, 23 aa, Entamoeba invadens
IKGENTLKISIEMLKEDLQRCLN

SEQ ID NO: 2793955 - protein, 23 aa, Entamoeba invadens
IKGGVIVCACYFITIYSFSFVIM

SEQ ID NO: 2793956 - protein, 17 aa, Entamoeba invadens
IKGIVSFDKILCQTEKT

SEQ ID NO: 2793957 - protein, 17 aa, Entamoeba invadens
IKGKEYFQFGVFENESK

SEQ ID NO: 2793958 - protein, 22 aa, Entamoeba invadens
IKGKTLKSSFNIIDLKKRVIGA

SEQ ID NO: 2793959 - protein, 17 aa, Entamoeba invadens
IKGNLYISGISDHKEDI

SEQ ID NO: 2793960 - protein, 18 aa, Entamoeba invadens
IKGSGPYPMEMFIKPGCV

SEQ ID NO: 2793961 - protein, 17 aa, Entamoeba invadens
IKGVVAYNAVMVAAVTL

SEQ ID NO: 2793962 - protein, 17 aa, Entamoeba invadens
IKGYNLQSICFIDEHWI

SEQ ID NO: 2793963 - protein, 22 aa, Entamoeba invadens
IKHDRMTLVVTESIFTPIDITK

SEQ ID NO: 2793964 - protein, 24 aa, Entamoeba invadens
IKHFTLYFWLAIMVIDIVISLIFV

SEQ ID NO: 2793965 - protein, 17 aa, Entamoeba invadens
IKHGETYAFVGASGCGK

SEQ ID NO: 2793966 - protein, 22 aa, Entamoeba invadens
IKHLWPSYYPSFIDEVISTAQL

SEQ ID NO: 2793967 - protein, 20 aa, Entamoeba invadens
IKIELPFPLNEKHHLLFQIR

SEQ ID NO: 2793968 - protein, 18 aa, Entamoeba invadens
IKIFEDLNDLLIFDEFYD

SEQ ID NO: 2793969 - protein, 30 aa, Entamoeba invadens
IKIFVKEEFKAEMFGGVKVMKLGCNETQFV

SEQ ID NO: 2793970 - protein, 18 aa, Entamoeba invadens
IKIGCLNGKMSRYVSENS

SEQ ID NO: 2793971 - protein, 17 aa, Entamoeba invadens
IKIIIDASKGILYLHEN

SEQ ID NO: 2793972 - protein, 19 aa, Entamoeba invadens
IKIKLRVKFMFDASNGILY

SEQ ID NO: 2793973 - protein, 20 aa, Entamoeba invadens
IKILYGCFVDCYRLKTLTLP

SEQ ID NO: 2793974 - protein, 19 aa, Entamoeba invadens
IKIPCSFASETSTALDPDE

SEQ ID NO: 2793975 - protein, 28 aa, Entamoeba invadens
IKIQFSVMDGCDFYKIRTEPSIVILKRN

SEQ ID NO: 2793976 - protein, 17 aa, Entamoeba invadens
IKIRLLFSTIFNLIGLF

SEQ ID NO: 2793977 - protein, 28 aa, Entamoeba invadens
IKIRSLVCGWLLFTINTVRMFFCLENIV

SEQ ID NO: 2793978 - protein, 17 aa, Entamoeba invadens
IKIVLVNVIREMWGDKA

SEQ ID NO: 2793979 - protein, 25 aa, Entamoeba invadens
IKIVNCLYERGGMCVKCKERYYQKD

SEQ ID NO: 2793980 - protein, 36 aa, Entamoeba invadens
IKKDCKIYDICYPVRWCPVCNSFRPPRSYHCKKCGC

SEQ ID NO: 2793981 - protein, 18 aa, Entamoeba invadens
IKKDVPIEIGEVIEKTWN

SEQ ID NO: 2793982 - protein, 23 aa, Entamoeba invadens
IKKEQYNIISLCWCQDPKSRLQI

SEQ ID NO: 2793983 - protein, 19 aa, Entamoeba invadens
IKKETNLFISFGRDQNSYV

SEQ ID NO: 2793984 - protein, 35 aa, Entamoeba invadens
IKKFFKTILRPFVFCWKKLPSIVRFSIKNFFSVPT

SEQ ID NO: 2793985 - protein, 21 aa, Entamoeba invadens
IKKIFYAIIIWYNVNYGTYEM

SEQ ID NO: 2793986 - protein, 25 aa, Entamoeba invadens
IKKLALFQICGFKGTLIHVSALYLA

SEQ ID NO: 2793987 - protein, 27 aa, Entamoeba invadens
IKKRNFDVVKMLLLLGADPFVNCKKWT

SEQ ID NO: 2793988 - protein, 20 aa, Entamoeba invadens
IKKSLRYKFVTDMMRGVLYL

SEQ ID NO: 2793989 - protein, 21 aa, Entamoeba invadens
IKKSNICFIPIGNGLGVNTTE

SEQ ID NO: 2793990 - protein, 23 aa, Entamoeba invadens
IKKSYEHLSRRLSHVEEFLEEEK

SEQ ID NO: 2793991 - protein, 19 aa, Entamoeba invadens
IKKYFTLIFSYIVKQKEGG

SEQ ID NO: 2793992 - protein, 19 aa, Entamoeba invadens
IKLACGIMNMALNKMFLKM

SEQ ID NO: 2793993 - protein, 21 aa, Entamoeba invadens
IKLGLGDFVFYSVLVGRCAMY

SEQ ID NO: 2793994 - protein, 32 aa, Entamoeba invadens
IKLKKKKIEIIRSFILWLRKSYITGVVIVVDI

SEQ ID NO: 2793995 - protein, 20 aa, Entamoeba invadens
IKLLCYISLMALVFWRNYPP

SEQ ID NO: 2793996 - protein, 26 aa, Entamoeba invadens
IKLLLGGKLLRYGTSNKFFCHVEGVT

SEQ ID NO: 2793997 - protein, 18 aa, Entamoeba invadens
IKLLPYIEQIHCKIKSQN

SEQ ID NO: 2793998 - protein, 24 aa, Entamoeba invadens
IKLNFSKHEVITWMEYLGDIDSIA

SEQ ID NO: 2793999 - protein, 18 aa, Entamoeba invadens
IKLPFSLTTIGEGVFNGC

SEQ ID NO: 2794000 - protein, 20 aa, Entamoeba invadens
IKLRIKMMIDAAKGILYLHE

SEQ ID NO: 2794001 - protein, 17 aa, Entamoeba invadens
IKLRSSQQIPIFDLKEL

SEQ ID NO: 2794002 - protein, 21 aa, Entamoeba invadens
IKLRVKYCLDASKGILYLHEN

SEQ ID NO: 2794003 - protein, 22 aa, Entamoeba invadens
IKMFFGKNFLKAIVPIFSTEGD

SEQ ID NO: 2794004 - protein, 30 aa, Entamoeba invadens
IKMFHSLKFYRCSCWSYFPKTPFSSILSAP

SEQ ID NO: 2794005 - protein, 23 aa, Entamoeba invadens
IKMKCFLVVVGTFIKFTKHPLGA

SEQ ID NO: 2794006 - protein, 17 aa, Entamoeba invadens
IKMKIRVKMVLDASKGI

SEQ ID NO: 2794007 - protein, 22 aa, Entamoeba invadens
IKMLIMSMALIRAFVDKKQTEG

SEQ ID NO: 2794008 - protein, 17 aa, Entamoeba invadens
IKMLSGLKHLYTDIYAY

SEQ ID NO: 2794009 - protein, 26 aa, Entamoeba invadens
IKNEDAPDIAMCWDNGSGTNSESKTD

SEQ ID NO: 2794010 - protein, 24 aa, Entamoeba invadens
IKNEMMKIVIGFAVAVLVMTLCSV

SEQ ID NO: 2794011 - protein, 27 aa, Entamoeba invadens
IKNFINWRLILLFPLALVFGFSRSYYY

SEQ ID NO: 2794012 - protein, 18 aa, Entamoeba invadens
IKNFKYNAIYIFNNFKIV

SEQ ID NO: 2794013 - protein, 25 aa, Entamoeba invadens
IKNKKRLFGTLNFLNIQTFNLNGVD

SEQ ID NO: 2794014 - protein, 21 aa, Entamoeba invadens
IKNLECFSNYNLIDNKCLKTL

SEQ ID NO: 2794015 - protein, 21 aa, Entamoeba invadens
IKNLHIIAGGGVYIYGETNVY

SEQ ID NO: 2794016 - protein, 21 aa, Entamoeba invadens
IKNMILPSLFDPITLKQIPTD

SEQ ID NO: 2794017 - protein, 31 aa, Entamoeba invadens
IKNRASLSLDVIWIYKVNIFIDDSGTLEMIS

SEQ ID NO: 2794018 - protein, 27 aa, Entamoeba invadens
IKNSKCNKCSFWYAPSLDGTYCEKKIV

SEQ ID NO: 2794019 - protein, 23 aa, Entamoeba invadens
IKNTGLNLFSWAIQGILKFNPYL

SEQ ID NO: 2794020 - protein, 17 aa, Entamoeba invadens
IKNTINFLRKLKNERII

SEQ ID NO: 2794021 - protein, 18 aa, Entamoeba invadens
IKNVRWNSVGTKLIACDM

SEQ ID NO: 2794022 - protein, 20 aa, Entamoeba invadens
IKNYYTVLSLCISPNEVLSY

SEQ ID NO: 2794023 - protein, 17 aa, Entamoeba invadens
IKPDNFLVFSLDLNDTI

SEQ ID NO: 2794024 - protein, 17 aa, Entamoeba invadens
IKPDNFLVFSLEKEIDV

SEQ ID NO: 2794025 - protein, 21 aa, Entamoeba invadens
IKPDNILIFSIDINEKTNAKL

SEQ ID NO: 2794026 - protein, 23 aa, Entamoeba invadens
IKPDNILVFSLDFNEGVNAKLTD

SEQ ID NO: 2794027 - protein, 24 aa, Entamoeba invadens
IKPDNILVFSLDWKDKVIAKLTDF

SEQ ID NO: 2794028 - protein, 24 aa, Entamoeba invadens
IKPDNLLVFSLDFNERVNAKLTDF

SEQ ID NO: 2794029 - protein, 17 aa, Entamoeba invadens
IKPENVLVFSFDHNNKV

SEQ ID NO: 2794030 - protein, 21 aa, Entamoeba invadens
IKPFISKFHYLYVGGENDIVV

SEQ ID NO: 2794031 - protein, 26 aa, Entamoeba invadens
IKPFVYILCCILGFFIAVAALLYDTW

SEQ ID NO: 2794032 - protein, 20 aa, Entamoeba invadens
IKPPPFYLQMYIKRTSNILT

SEQ ID NO: 2794033 - protein, 22 aa, Entamoeba invadens
IKQCPENDGLCAYIPSQRITPD

SEQ ID NO: 2794034 - protein, 18 aa, Entamoeba invadens
IKQKLILKEGVCQQVDPN

SEQ ID NO: 2794035 - protein, 19 aa, Entamoeba invadens
IKQLGNVFVYIGDVLSLTT

SEQ ID NO: 2794036 - protein, 26 aa, Entamoeba invadens
IKQNFLKKRCKCVMKRAMDHSLFFQA

SEQ ID NO: 2794037 - protein, 28 aa, Entamoeba invadens
IKQPLTLPRRCSVLTLIRISQVRLDLEN

SEQ ID NO: 2794038 - protein, 23 aa, Entamoeba invadens
IKQSGIWVKRTALMILNQKLTDL

SEQ ID NO: 2794039 - protein, 17 aa, Entamoeba invadens
IKQTVGVENYMKKCDSD

SEQ ID NO: 2794040 - protein, 23 aa, Entamoeba invadens
IKRDEMCTSCGNGVLDFDEECDL

SEQ ID NO: 2794041 - protein, 18 aa, Entamoeba invadens
IKRNICGEDVFVYILQDS

SEQ ID NO: 2794042 - protein, 21 aa, Entamoeba invadens
IKRRKFGEIDFLMNYSDFVTT

SEQ ID NO: 2794043 - protein, 25 aa, Entamoeba invadens
IKRSSLWRKVLLLTILSAFLALEMS

SEQ ID NO: 2794044 - protein, 17 aa, Entamoeba invadens
IKSAVIAGKMPPLDDRI

SEQ ID NO: 2794045 - protein, 21 aa, Entamoeba invadens
IKSGDIVICHDILQSVGYIES

SEQ ID NO: 2794046 - protein, 17 aa, Entamoeba invadens
IKSGIKVVKFCLEDVLN

SEQ ID NO: 2794047 - protein, 24 aa, Entamoeba invadens
IKSLALPPHCEFLFGVNQNNEDLT

SEQ ID NO: 2794048 - protein, 33 aa, Entamoeba invadens
IKSLKLVLNLILAWKKGYNAIREALAKKKKEKE

SEQ ID NO: 2794049 - protein, 24 aa, Entamoeba invadens
IKSLLSQEFCKPCTHQKARPTSIS

SEQ ID NO: 2794050 - protein, 19 aa, Entamoeba invadens
IKSNAFKVEIELNVYTQKR

SEQ ID NO: 2794051 - protein, 21 aa, Entamoeba invadens
IKSSLLIRCFQLATSSNKTIR

SEQ ID NO: 2794052 - protein, 17 aa, Entamoeba invadens
IKSTIKVTGTSGAINII

SEQ ID NO: 2794053 - protein, 24 aa, Entamoeba invadens
IKSYVEWYLYGVLQSILFFVLFYF

SEQ ID NO: 2794054 - protein, 17 aa, Entamoeba invadens
IKTALDFYGQICTDEIV

SEQ ID NO: 2794055 - protein, 22 aa, Entamoeba invadens
IKTDIRGISAFALVDGVTIDLA

SEQ ID NO: 2794056 - protein, 19 aa, Entamoeba invadens
IKTGCVKTSFTTSSKSEFV

SEQ ID NO: 2794057 - protein, 18 aa, Entamoeba invadens
IKTGMFFHRNDRFVLQNW

SEQ ID NO: 2794058 - protein, 24 aa, Entamoeba invadens
IKTKVWMCQYMMSILDNEELLFDE

SEQ ID NO: 2794059 - protein, 17 aa, Entamoeba invadens
IKTLCLYENTNVFISKN

SEQ ID NO: 2794060 - protein, 23 aa, Entamoeba invadens
IKTLEIGKVYYIRASSTTNINPI

SEQ ID NO: 2794061 - protein, 18 aa, Entamoeba invadens
IKTLGIKAAHLIVIGAFV

SEQ ID NO: 2794062 - protein, 27 aa, Entamoeba invadens
IKTMSGCALCSKGYFIVNQMCAKCDSK

SEQ ID NO: 2794063 - protein, 27 aa, Entamoeba invadens
IKTPISMLCPAKFFTIYYHPVEYQFVQ

SEQ ID NO: 2794064 - protein, 23 aa, Entamoeba invadens
IKTSEIHIIYSLHAVRSQLMSSC

SEQ ID NO: 2794065 - protein, 17 aa, Entamoeba invadens
IKTSFAINSASPMNVNH

SEQ ID NO: 2794066 - protein, 24 aa, Entamoeba invadens
IKTTICGTLAWIAPEILSGQPYNT

SEQ ID NO: 2794067 - protein, 20 aa, Entamoeba invadens
IKTTKGCISCFNGYYRSNGT

SEQ ID NO: 2794068 - protein, 26 aa, Entamoeba invadens
IKVGCSNGKYSRFVMKDSLIGCECNY

SEQ ID NO: 2794069 - protein, 25 aa, Entamoeba invadens
IKVSIKQKVCHKIKIFHPEFEDEAI

SEQ ID NO: 2794070 - protein, 24 aa, Entamoeba invadens
IKVSNSKCSKCTFWNVPTSSGTSC

SEQ ID NO: 2794071 - protein, 17 aa, Entamoeba invadens
IKVSVKLMKKALTYKAL

SEQ ID NO: 2794072 - protein, 18 aa, Entamoeba invadens
IKVVKFCLEDVLNIPVKL

SEQ ID NO: 2794073 - protein, 21 aa, Entamoeba invadens
IKVWFRKPEMKMVCRCKQHSY

SEQ ID NO: 2794074 - protein, 26 aa, Entamoeba invadens
IKYAELCLRGLVALRKVSERVSDPET

SEQ ID NO: 2794075 - protein, 19 aa, Entamoeba invadens
IKYATQWYGSVLVLLAVLI

SEQ ID NO: 2794076 - protein, 21 aa, Entamoeba invadens
IKYDKGLWYRLIHVTEGQSEA

SEQ ID NO: 2794077 - protein, 17 aa, Entamoeba invadens
IKYKQINDVIAFEKQDE

SEQ ID NO: 2794078 - protein, 17 aa, Entamoeba invadens
ILAAIYLYLGLFLAAGE

SEQ ID NO: 2794079 - protein, 29 aa, Entamoeba invadens
ILAFCIDAFLFLGGVSFYSWIISLILLPF

SEQ ID NO: 2794080 - protein, 21 aa, Entamoeba invadens
ILAIFCGAVYLTLNPDVVSMK

SEQ ID NO: 2794081 - protein, 19 aa, Entamoeba invadens
ILALLKFSLWWPKQKVRIH

SEQ ID NO: 2794082 - protein, 17 aa, Entamoeba invadens
ILCAVFVVSFGSSISDY

SEQ ID NO: 2794083 - protein, 26 aa, Entamoeba invadens
ILCDVIRFTIKNCMKTESNDKFWKGF

SEQ ID NO: 2794084 - protein, 21 aa, Entamoeba invadens
ILCFLLIVFIFVFRYKKIDIN

SEQ ID NO: 2794085 - protein, 22 aa, Entamoeba invadens
ILCGYSEDFSYVEVLKLFTETE

SEQ ID NO: 2794086 - protein, 30 aa, Entamoeba invadens
ILCHGIGGMFLLKCFSAIQVLFSAFNANDD

SEQ ID NO: 2794087 - protein, 20 aa, Entamoeba invadens
ILCLLGWMIYPSIPSDVITE

SEQ ID NO: 2794088 - protein, 20 aa, Entamoeba invadens
ILCLLTMGWMFYSEVQDYYT

SEQ ID NO: 2794089 - protein, 21 aa, Entamoeba invadens
ILCNCASLLLFIPISMTTMAG

SEQ ID NO: 2794090 - protein, 17 aa, Entamoeba invadens
ILDKFRCEYIIHFYGAV

SEQ ID NO: 2794091 - protein, 26 aa, Entamoeba invadens
ILDMNKLTGIGAMFEKLISDSFGREQ

SEQ ID NO: 2794092 - protein, 25 aa, Entamoeba invadens
ILDYFKETLCEWVGKRNFNVILDEK

SEQ ID NO: 2794093 - protein, 20 aa, Entamoeba invadens
ILDYMLRYHNDFSVDLLNEL

SEQ ID NO: 2794094 - protein, 25 aa, Entamoeba invadens
ILEIFIFNTIHAIEFVLGCISNTAS

SEQ ID NO: 2794095 - protein, 17 aa, Entamoeba invadens
ILEMKTVKFVNGEVNVE

SEQ ID NO: 2794096 - protein, 31 aa, Entamoeba invadens
ILEQYPLNWLDWLIICVMVVVHFTICETIKW

SEQ ID NO: 2794097 - protein, 17 aa, Entamoeba invadens
ILFALSAFLIVLVILNY

SEQ ID NO: 2794098 - protein, 25 aa, Entamoeba invadens
ILFCVARTAFELVRLFYDCQIPYIM

SEQ ID NO: 2794099 - protein, 17 aa, Entamoeba invadens
ILFDIIFVIFKENSQLV

SEQ ID NO: 2794100 - protein, 21 aa, Entamoeba invadens
ILFENGLCFDISFVKKCTEIF

SEQ ID NO: 2794101 - protein, 18 aa, Entamoeba invadens
ILFFCIAQSTLIYCNNNS

SEQ ID NO: 2794102 - protein, 23 aa, Entamoeba invadens
ILFFDILKITTLILPNEEHTNKG

SEQ ID NO: 2794103 - protein, 24 aa, Entamoeba invadens
ILFFILLYCMDFLFESTLFRKFNL

SEQ ID NO: 2794104 - protein, 31 aa, Entamoeba invadens
ILFGFGFLLCCLWLVDYCKYRNSKDVQARSI

SEQ ID NO: 2794105 - protein, 31 aa, Entamoeba invadens
ILFGYVRLWAFIPIILCLLFVFANLLSSQVI

SEQ ID NO: 2794106 - protein, 26 aa, Entamoeba invadens
ILFIKCPECLVAMLITPFLGAIESFR

SEQ ID NO: 2794107 - protein, 21 aa, Entamoeba invadens
ILFKREVLKSILSIIILIAVW

SEQ ID NO: 2794108 - protein, 17 aa, Entamoeba invadens
ILFKRKYKTPADIYSFA

SEQ ID NO: 2794109 - protein, 27 aa, Entamoeba invadens
ILFLQLPFVFAFPWINAVVVYVLAFVV

SEQ ID NO: 2794110 - protein, 26 aa, Entamoeba invadens
ILFTICYLCFSLFYNRHVHFDFYVGL

SEQ ID NO: 2794111 - protein, 26 aa, Entamoeba invadens
ILFTPIVHPCSYFYNTVNWPEIATNG

SEQ ID NO: 2794112 - protein, 25 aa, Entamoeba invadens
ILGMVPAVFLKRIYPLEMGKIDQYI

SEQ ID NO: 2794113 - protein, 19 aa, Entamoeba invadens
ILGNRCLKCQNGYYNNKNI

SEQ ID NO: 2794114 - protein, 33 aa, Entamoeba invadens
ILGQYRFDADLMAGLSYSLLPPIFKDVDIDEKS

SEQ ID NO: 2794115 - protein, 24 aa, Entamoeba invadens
ILGTGGAFPGVFRDVSCNVLKIGN

SEQ ID NO: 2794116 - protein, 18 aa, Entamoeba invadens
ILGYGGVIMSCVYTIVFL

SEQ ID NO: 2794117 - protein, 17 aa, Entamoeba invadens
ILHCLLSNNIMCIKCED

SEQ ID NO: 2794118 - protein, 24 aa, Entamoeba invadens
ILHEMCYFKTLSIDVSKKYVDIIG

SEQ ID NO: 2794119 - protein, 20 aa, Entamoeba invadens
ILHIKVLIMSGTFNVDQFKP

SEQ ID NO: 2794120 - protein, 18 aa, Entamoeba invadens
ILICVTFAIVHRKSNKQT

SEQ ID NO: 2794121 - protein, 22 aa, Entamoeba invadens
ILIELIVIFIARIFYRDTDTYH

SEQ ID NO: 2794122 - protein, 21 aa, Entamoeba invadens
ILIFLCYDRVKNILIKLLGIK

SEQ ID NO: 2794123 - protein, 17 aa, Entamoeba invadens
ILIFLSILPFTVSKVIQ

SEQ ID NO: 2794124 - protein, 17 aa, Entamoeba invadens
ILIGILVLTEFRYYLQR

SEQ ID NO: 2794125 - protein, 26 aa, Entamoeba invadens
ILILVAIYFLRKAMRYTTDKVRKNNK

SEQ ID NO: 2794126 - protein, 18 aa, Entamoeba invadens
ILINFTYCLDRFYKTKYF

SEQ ID NO: 2794127 - protein, 25 aa, Entamoeba invadens
ILIPKDFFIMVAIHFTIGLFLINYS

SEQ ID NO: 2794128 - protein, 26 aa, Entamoeba invadens
ILIPMFFPSVVYPLVIVLTLVYIVAC

SEQ ID NO: 2794129 - protein, 19 aa, Entamoeba invadens
ILITSGALFYIYGKQYSTL

SEQ ID NO: 2794130 - protein, 23 aa, Entamoeba invadens
ILIVCFYYYLIVCGMESSLTCST

SEQ ID NO: 2794131 - protein, 24 aa, Entamoeba invadens
ILIVWYCYFALRRKIRKNKEVNEI

SEQ ID NO: 2794132 - protein, 17 aa, Entamoeba invadens
ILKEGVCQQVDPNSDAN

SEQ ID NO: 2794133 - protein, 20 aa, Entamoeba invadens
ILKIKIPRQYIIRLETLMLK

SEQ ID NO: 2794134 - protein, 19 aa, Entamoeba invadens
ILKKAWLPDEDNIEYVPID

SEQ ID NO: 2794135 - protein, 25 aa, Entamoeba invadens
ILKMPKFSINWGGSISKNLQTLGIT

SEQ ID NO: 2794136 - protein, 26 aa, Entamoeba invadens
ILKNKVVRYGVKRTFSFITTYKGDAN

SEQ ID NO: 2794137 - protein, 18 aa, Entamoeba invadens
ILKNRIGNQVVYVNMEAY

SEQ ID NO: 2794138 - protein, 26 aa, Entamoeba invadens
ILKSCILCSPSFVLKNEICVSYTEIP

SEQ ID NO: 2794139 - protein, 21 aa, Entamoeba invadens
ILKWCKVKAIITCVNQNNKCP

SEQ ID NO: 2794140 - protein, 24 aa, Entamoeba invadens
ILLDTVDVLYIWVGSKCAVQTRKL

SEQ ID NO: 2794141 - protein, 17 aa, Entamoeba invadens
ILLFFVIQYKKTDIELF

SEQ ID NO: 2794142 - protein, 23 aa, Entamoeba invadens
ILLFIIMCIIITFKVIEHKRRKK

SEQ ID NO: 2794143 - protein, 26 aa, Entamoeba invadens
ILLFSCIWPYTKLILLFFTWTTPPTI

SEQ ID NO: 2794144 - protein, 18 aa, Entamoeba invadens
ILLKDFYLQKLVEYKDEE

SEQ ID NO: 2794145 - protein, 19 aa, Entamoeba invadens
ILLLCISFLQYKRSISCGK

SEQ ID NO: 2794146 - protein, 28 aa, Entamoeba invadens
ILLLPEALKLLPIFVLGAMKTPAFMAFG

SEQ ID NO: 2794147 - protein, 22 aa, Entamoeba invadens
ILLQVYVVFSWIKEKVSDAQFK

SEQ ID NO: 2794148 - protein, 21 aa, Entamoeba invadens
ILLRRDGLCAICNTTKNTLNK

SEQ ID NO: 2794149 - protein, 18 aa, Entamoeba invadens
ILLTTFITMIFVFTTTFS

SEQ ID NO: 2794150 - protein, 19 aa, Entamoeba invadens
ILLTYLYDYCYDSPNIFAP

SEQ ID NO: 2794151 - protein, 17 aa, Entamoeba invadens
ILMDIAKEHPFINIVST

SEQ ID NO: 2794152 - protein, 28 aa, Entamoeba invadens
ILMGCSVLPHLTPLIGIITPRLTDSESI

SEQ ID NO: 2794153 - protein, 17 aa, Entamoeba invadens
ILMKIGVTALDFSELTL

SEQ ID NO: 2794154 - protein, 24 aa, Entamoeba invadens
ILMNLIICICCCKLCCVDSKPEKV

SEQ ID NO: 2794155 - protein, 27 aa, Entamoeba invadens
ILMNLWEIFPLIAFVVLFWKLPKQNRN

SEQ ID NO: 2794156 - protein, 18 aa, Entamoeba invadens
ILMQRIPQGISMKKLKRD

SEQ ID NO: 2794157 - protein, 25 aa, Entamoeba invadens
ILMSLWMAFQIGRLFFVFYTKIKSI

SEQ ID NO: 2794158 - protein, 25 aa, Entamoeba invadens
ILNEYPEGVIYPYELVITAKTDIDV

SEQ ID NO: 2794159 - protein, 24 aa, Entamoeba invadens
ILNEYPEGVIYPYELVITTKSDID

SEQ ID NO: 2794160 - protein, 19 aa, Entamoeba invadens
ILNGLKYSNKADIFSFAIT

SEQ ID NO: 2794161 - protein, 19 aa, Entamoeba invadens
ILNHLKTVTIYSLKTAEFF

SEQ ID NO: 2794162 - protein, 24 aa, Entamoeba invadens
ILNKTRVPLVFHFPDIPQVVYLNK

SEQ ID NO: 2794163 - protein, 20 aa, Entamoeba invadens
ILNKVCTLSLSLFKTIQGKL

SEQ ID NO: 2794164 - protein, 27 aa, Entamoeba invadens
ILNLALASCMWFELPLIRNLDFKQRVR

SEQ ID NO: 2794165 - protein, 18 aa, Entamoeba invadens
ILNRISEVLIPKRDIVSS

SEQ ID NO: 2794166 - protein, 24 aa, Entamoeba invadens
ILNTIYSLYCEFFFVHEQIQGHNF

SEQ ID NO: 2794167 - protein, 22 aa, Entamoeba invadens
ILNTVFSDFSLKNVVFDYTNTT

SEQ ID NO: 2794168 - protein, 25 aa, Entamoeba invadens
ILPAYEVRGRMFGVDTCEYPAAEGT

SEQ ID NO: 2794169 - protein, 23 aa, Entamoeba invadens
ILPCATVVGCTKLRSQDRREKLW

SEQ ID NO: 2794170 - protein, 20 aa, Entamoeba invadens
ILQIVNICYSLGEAQTKTVA

SEQ ID NO: 2794171 - protein, 20 aa, Entamoeba invadens
ILQNCKFVLVEMVWEELNEK

SEQ ID NO: 2794172 - protein, 19 aa, Entamoeba invadens
ILRIFPLIDWVMQFLTGSL

SEQ ID NO: 2794173 - protein, 19 aa, Entamoeba invadens
ILRNIKFIKYNAWEDPLKH

SEQ ID NO: 2794174 - protein, 18 aa, Entamoeba invadens
ILRNIKFIKYNRWENPLE

SEQ ID NO: 2794175 - protein, 22 aa, Entamoeba invadens
ILRQMSLLLVLFLFFLKAQSDC

SEQ ID NO: 2794176 - protein, 22 aa, Entamoeba invadens
ILRVRFCLNAAKGIQYLHSNGI

SEQ ID NO: 2794177 - protein, 17 aa, Entamoeba invadens
ILSELYHPGVVMMAIVG

SEQ ID NO: 2794178 - protein, 18 aa, Entamoeba invadens
ILSFISMSEICFKFYEYG

SEQ ID NO: 2794179 - protein, 17 aa, Entamoeba invadens
ILSFLGFFMSLKFGLFA

SEQ ID NO: 2794180 - protein, 18 aa, Entamoeba invadens
ILSGQRCELGYRYNSKTQ

SEQ ID NO: 2794181 - protein, 17 aa, Entamoeba invadens
ILSGTLIGMSIPIFDFV

SEQ ID NO: 2794182 - protein, 19 aa, Entamoeba invadens
ILSIEWLIVMVDFYIEKKR

SEQ ID NO: 2794183 - protein, 31 aa, Entamoeba invadens
ILSIFPKFFARRGFIPCIKKCRVWVENKEGS

SEQ ID NO: 2794184 - protein, 17 aa, Entamoeba invadens
ILSNFWRFCASALLYNF

SEQ ID NO: 2794185 - protein, 25 aa, Entamoeba invadens
ILSPRANKIITCYMTLYCTTRIRDL

SEQ ID NO: 2794186 - protein, 28 aa, Entamoeba invadens
ILSQTLWQYACCLTIVFAGRYIPFLEAP

SEQ ID NO: 2794187 - protein, 25 aa, Entamoeba invadens
ILSTQTKLGFSYILGGINSVYNFGF

SEQ ID NO: 2794188 - protein, 18 aa, Entamoeba invadens
ILSTTGCVRCKPGYYIKN

SEQ ID NO: 2794189 - protein, 19 aa, Entamoeba invadens
ILTDPKLRSIIFVMLNGLF

SEQ ID NO: 2794190 - protein, 19 aa, Entamoeba invadens
ILTEGFGFDIFGSMDSEQF

SEQ ID NO: 2794191 - protein, 19 aa, Entamoeba invadens
ILTNEINDIYSFVISILAG

SEQ ID NO: 2794192 - protein, 19 aa, Entamoeba invadens
ILTSLCSYSSQYECLKCTA

SEQ ID NO: 2794193 - protein, 18 aa, Entamoeba invadens
ILTTLGFVSMALCWVITA

SEQ ID NO: 2794194 - protein, 17 aa, Entamoeba invadens
ILVCGDFSVNALESTPG

SEQ ID NO: 2794195 - protein, 17 aa, Entamoeba invadens
ILVDRHFDIMIIGFCVV

SEQ ID NO: 2794196 - protein, 18 aa, Entamoeba invadens
ILVLLIAFVWWRRTKSVK

SEQ ID NO: 2794197 - protein, 20 aa, Entamoeba invadens
ILVMCVLIFLAVFKANSGVF

SEQ ID NO: 2794198 - protein, 18 aa, Entamoeba invadens
ILVSLNLVNLMSVVHILV

SEQ ID NO: 2794199 - protein, 24 aa, Entamoeba invadens
ILVSLRLLLLNALSNILNSMDQES

SEQ ID NO: 2794200 - protein, 18 aa, Entamoeba invadens
ILVSWGLDITNTEMSGQS

SEQ ID NO: 2794201 - protein, 17 aa, Entamoeba invadens
ILWTFSIFLETVAILPQ

SEQ ID NO: 2794202 - protein, 34 aa, Entamoeba invadens
ILYFALGFICFCIWIAGYCRFKNSTDSSAKTFAV

SEQ ID NO: 2794203 - protein, 17 aa, Entamoeba invadens
ILYFFRPLVKAIVLITC

SEQ ID NO: 2794204 - protein, 22 aa, Entamoeba invadens
ILYLKGLTSLKCVNIKNTMCLI

SEQ ID NO: 2794205 - protein, 17 aa, Entamoeba invadens
ILYLMPFENITATVNTI

SEQ ID NO: 2794206 - protein, 22 aa, Entamoeba invadens
ILYLPRRLTSMKLFEINLNGNS

SEQ ID NO: 2794207 - protein, 26 aa, Entamoeba invadens
ILYSQCGWKCGFIPQTSGKILPFEKM

SEQ ID NO: 2794208 - protein, 24 aa, Entamoeba invadens
ILYTLFCFVAIIIAIVVIAQKLRR

SEQ ID NO: 2794209 - protein, 19 aa, Entamoeba invadens
IMAASFPLVHFAQRSLLDT

SEQ ID NO: 2794210 - protein, 27 aa, Entamoeba invadens
IMAFFMYVLCSFGYSFVIRKPTKTQCK

SEQ ID NO: 2794211 - protein, 17 aa, Entamoeba invadens
IMAGCTACTSGTVCTTC

SEQ ID NO: 2794212 - protein, 19 aa, Entamoeba invadens
IMFDFPRMLSFYLYGKGRI

SEQ ID NO: 2794213 - protein, 21 aa, Entamoeba invadens
IMFFVLFFFYGFVNFAYDKNG

SEQ ID NO: 2794214 - protein, 24 aa, Entamoeba invadens
IMFKSISISLGYIIIYSVTSRTSF

SEQ ID NO: 2794215 - protein, 23 aa, Entamoeba invadens
IMGKKRMKIFNGFYSTVSEANDI

SEQ ID NO: 2794216 - protein, 23 aa, Entamoeba invadens
IMGMKIHYTVYWSKHLRTLKEIA

SEQ ID NO: 2794217 - protein, 22 aa, Entamoeba invadens
IMGRLRNPFVAGYMGSVTYLPQ

SEQ ID NO: 2794218 - protein, 19 aa, Entamoeba invadens
IMHFAVYFFALVVFVGYIV

SEQ ID NO: 2794219 - protein, 25 aa, Entamoeba invadens
IMIDAFKGILIIIMLLTNMTFTKGI

SEQ ID NO: 2794220 - protein, 17 aa, Entamoeba invadens
IMILCTLIIGFSSVFFT

SEQ ID NO: 2794221 - protein, 25 aa, Entamoeba invadens
IMILLLLFIRFVFPYCGNGCLECIT

SEQ ID NO: 2794222 - protein, 17 aa, Entamoeba invadens
IMILPKFMKEAYVTIYI

SEQ ID NO: 2794223 - protein, 21 aa, Entamoeba invadens
IMIQFWFGIMSKFSCTSLYED

SEQ ID NO: 2794224 - protein, 20 aa, Entamoeba invadens
IMISKCVKGIFNLDECEFLK

SEQ ID NO: 2794225 - protein, 17 aa, Entamoeba invadens
IMKELWSSIKSYFKDRD

SEQ ID NO: 2794226 - protein, 18 aa, Entamoeba invadens
IMKLPFIGFGLYWMDNIM

SEQ ID NO: 2794227 - protein, 23 aa, Entamoeba invadens
IMLEKFLSISVVSIFDVQMGVFV

SEQ ID NO: 2794228 - protein, 19 aa, Entamoeba invadens
IMLFRNCIYKMGEVVEEEN

SEQ ID NO: 2794229 - protein, 25 aa, Entamoeba invadens
IMLGFVRGFFLVWVLIVVIVVSVNV

SEQ ID NO: 2794230 - protein, 17 aa, Entamoeba invadens
IMNKVCDYFGVYADEEY

SEQ ID NO: 2794231 - protein, 25 aa, Entamoeba invadens
IMRPRAISCVTCYMTLYCTTKLKGM

SEQ ID NO: 2794232 - protein, 18 aa, Entamoeba invadens
IMRPRASGYVTCYMTLYC

SEQ ID NO: 2794233 - protein, 23 aa, Entamoeba invadens
IMSGSIFAFLAILVFLSGRIAAL

SEQ ID NO: 2794234 - protein, 28 aa, Entamoeba invadens
IMSKDRDPYCAYSFLSYSAFNTLKKLFI

SEQ ID NO: 2794235 - protein, 25 aa, Entamoeba invadens
IMSSFLNPYMQGFRIPKKTQDKKDK

SEQ ID NO: 2794236 - protein, 20 aa, Entamoeba invadens
IMTCSICSPTTFNVNGICQT

SEQ ID NO: 2794237 - protein, 17 aa, Entamoeba invadens
IMTENVMKVFETILKNK

SEQ ID NO: 2794238 - protein, 24 aa, Entamoeba invadens
IMTWLRYTNKLDMGSGIIELSNRM

SEQ ID NO: 2794239 - protein, 19 aa, Entamoeba invadens
IMVLIILCVVVIILCSLLY

SEQ ID NO: 2794240 - protein, 25 aa, Entamoeba invadens
IMWTVIYWLSFVVMWTVIPYFMSYP

SEQ ID NO: 2794241 - protein, 27 aa, Entamoeba invadens
IMYLAMGWSCIIYGPAVVYFCPYPLIF

SEQ ID NO: 2794242 - protein, 21 aa, Entamoeba invadens
IMYNYFSSVVLWNMEWTNTYF

SEQ ID NO: 2794243 - protein, 19 aa, Entamoeba invadens
INACSQCLDGYGLYNNKCI

SEQ ID NO: 2794244 - protein, 18 aa, Entamoeba invadens
INAGFVFGGIEKIKRFVE

SEQ ID NO: 2794245 - protein, 28 aa, Entamoeba invadens
INALKATKFSPVFTESLTINGLQVTTLK

SEQ ID NO: 2794246 - protein, 17 aa, Entamoeba invadens
INAPYIFVFVIGGITLG

SEQ ID NO: 2794247 - protein, 19 aa, Entamoeba invadens
INAYGWFIGITFMEKNIST

SEQ ID NO: 2794248 - protein, 18 aa, Entamoeba invadens
INCLYGYDNNCLKCAKDY

SEQ ID NO: 2794249 - protein, 21 aa, Entamoeba invadens
INCSTARLFAMNIHTTQFSRS

SEQ ID NO: 2794250 - protein, 27 aa, Entamoeba invadens
INCVESYYLKGGECVPCDSNCHQCSLD

SEQ ID NO: 2794251 - protein, 17 aa, Entamoeba invadens
INDILSVCDVMMSTFEG

SEQ ID NO: 2794252 - protein, 24 aa, Entamoeba invadens
INDKGLCFTSQWTSNDDSVRMKVR

SEQ ID NO: 2794253 - protein, 17 aa, Entamoeba invadens
INDLLKVCQVMMSTYSG

SEQ ID NO: 2794254 - protein, 26 aa, Entamoeba invadens
INDLTLDQPCCFIAKKVTNLNVNSLG

SEQ ID NO: 2794255 - protein, 25 aa, Entamoeba invadens
INEFPKNRIIFLVSVIFPFVGYYGL

SEQ ID NO: 2794256 - protein, 25 aa, Entamoeba invadens
INEGMSGLINHCWCQSPEERYSFEK

SEQ ID NO: 2794257 - protein, 18 aa, Entamoeba invadens
INEHGICIDAPPNAIDIS

SEQ ID NO: 2794258 - protein, 23 aa, Entamoeba invadens
INELAFFKMCFNVYVLSYSYFRV

SEQ ID NO: 2794259 - protein, 19 aa, Entamoeba invadens
INEMIYAAMALKLPSLDVA

SEQ ID NO: 2794260 - protein, 27 aa, Entamoeba invadens
INEQVKRLHVFGEVFAENGFLQRSDRR

SEQ ID NO: 2794261 - protein, 35 aa, Entamoeba invadens
INEVATNWARYVMLIQTALFKWLYSEVGGDTVEVF

SEQ ID NO: 2794262 - protein, 17 aa, Entamoeba invadens
INEWRKKDCTSDLNDIE

SEQ ID NO: 2794263 - protein, 24 aa, Entamoeba invadens
INFAKRWIRCKSNPEKRGDVDTEI

SEQ ID NO: 2794264 - protein, 26 aa, Entamoeba invadens
INFMYDIAFSLGFFFNSVLSKKSSKC

SEQ ID NO: 2794265 - protein, 17 aa, Entamoeba invadens
INFRCAIIDGMFMGMPM

SEQ ID NO: 2794266 - protein, 19 aa, Entamoeba invadens
INGEFVIRATLSPKESDIG

SEQ ID NO: 2794267 - protein, 27 aa, Entamoeba invadens
INGFRKICPFKNCLFNNSPFFAFIFQQ

SEQ ID NO: 2794268 - protein, 19 aa, Entamoeba invadens
INGGFGYGGAHKIKQVLDI

SEQ ID NO: 2794269 - protein, 18 aa, Entamoeba invadens
INGGIGFGDECILGTEGC

SEQ ID NO: 2794270 - protein, 18 aa, Entamoeba invadens
INGITAIEKYGCGEVLVY

SEQ ID NO: 2794271 - protein, 23 aa, Entamoeba invadens
INGKCAIISNCLLKQSNRCLKCS

SEQ ID NO: 2794272 - protein, 18 aa, Entamoeba invadens
INGKRLRLDESMPSDYAQ

SEQ ID NO: 2794273 - protein, 23 aa, Entamoeba invadens
INGNLPFGGNCQSGIGYYHGKFT

SEQ ID NO: 2794274 - protein, 18 aa, Entamoeba invadens
INGPLYSVGLGFSNLLYK

SEQ ID NO: 2794275 - protein, 24 aa, Entamoeba invadens
INGRCAIIQNCLLKLSNRCLKCSK

SEQ ID NO: 2794276 - protein, 20 aa, Entamoeba invadens
INGTYYLSPRSDCKAPAIAD

SEQ ID NO: 2794277 - protein, 36 aa, Entamoeba invadens
INGVCGMDQYKVYKFESGVTYIAKFFCKSEECTINV

SEQ ID NO: 2794278 - protein, 19 aa, Entamoeba invadens
INGVTPLEFIRTFANKNVG

SEQ ID NO: 2794279 - protein, 23 aa, Entamoeba invadens
INHRLCREYKGVSPYLDYAYVDD

SEQ ID NO: 2794280 - protein, 25 aa, Entamoeba invadens
INIAIFFLDRVDFMQILKTRNIEKI

SEQ ID NO: 2794281 - protein, 20 aa, Entamoeba invadens
INICENRDSLVLILESLTTL

SEQ ID NO: 2794282 - protein, 22 aa, Entamoeba invadens
INIEPRLAVAVVSLSLYVGVVF

SEQ ID NO: 2794283 - protein, 23 aa, Entamoeba invadens
INIFECIKNYFLFNQTCEEQLAQ

SEQ ID NO: 2794284 - protein, 18 aa, Entamoeba invadens
INIGLDIIPFSAFAATLV

SEQ ID NO: 2794285 - protein, 17 aa, Entamoeba invadens
INIKHLLELSGENNENV

SEQ ID NO: 2794286 - protein, 28 aa, Entamoeba invadens
INILVTMVVCAMALGFVGYGYGGVVYAG

SEQ ID NO: 2794287 - protein, 25 aa, Entamoeba invadens
INILYDIALELGFFFDAKLSRKTDK

SEQ ID NO: 2794288 - protein, 18 aa, Entamoeba invadens
INIPLDFVKKNLVFPKSG

SEQ ID NO: 2794289 - protein, 21 aa, Entamoeba invadens
INIPMKSFRSMSSTTDAMYAK

SEQ ID NO: 2794290 - protein, 30 aa, Entamoeba invadens
INKAGRFHVIRGLAVGIGFGAMMFVMMCSL

SEQ ID NO: 2794291 - protein, 25 aa, Entamoeba invadens
INKDYILKIDKLFRYFVMSMSQKLN

SEQ ID NO: 2794292 - protein, 23 aa, Entamoeba invadens
INKELFVNMSMIFLTVFVVPVGL

SEQ ID NO: 2794293 - protein, 23 aa, Entamoeba invadens
INKGETFTFFAYCNDGECKMNID

SEQ ID NO: 2794294 - protein, 26 aa, Entamoeba invadens
INKIKRLDIDLILLKGGVCVDKNVVD

SEQ ID NO: 2794295 - protein, 23 aa, Entamoeba invadens
INKLFKFFVMKMSQNINIRATKS

SEQ ID NO: 2794296 - protein, 24 aa, Entamoeba invadens
INKLFKFFVMKMSQNINIRATKSL

SEQ ID NO: 2794297 - protein, 20 aa, Entamoeba invadens
INLCLCVTKIVAAVFSGSLT

SEQ ID NO: 2794298 - protein, 29 aa, Entamoeba invadens
INLFLRTIKNFPLIFTYNVTSFNNVNPNA

SEQ ID NO: 2794299 - protein, 29 aa, Entamoeba invadens
INLFLRTIKNFPLIFTYNVTSLNNVNPNA

SEQ ID NO: 2794300 - protein, 24 aa, Entamoeba invadens
INLIKRKIVNYTFSLSFCLFCRTN

SEQ ID NO: 2794301 - protein, 17 aa, Entamoeba invadens
INLKMRVKLILDASKGL

SEQ ID NO: 2794302 - protein, 17 aa, Entamoeba invadens
INLKRLFQVKGQRRPYV

SEQ ID NO: 2794303 - protein, 25 aa, Entamoeba invadens
INLPKEYPPLLIALTMGYFFAMITS

SEQ ID NO: 2794304 - protein, 29 aa, Entamoeba invadens
INLRVLPLVLKFIYKVLLFKPHTILQLLF

SEQ ID NO: 2794305 - protein, 20 aa, Entamoeba invadens
INMFECFNPNAILSDITTTY

SEQ ID NO: 2794306 - protein, 21 aa, Entamoeba invadens
INMKLRVKIILNASRGIQYLH

SEQ ID NO: 2794307 - protein, 21 aa, Entamoeba invadens
INMLECFNRKIVSGGQDRQVV

SEQ ID NO: 2794308 - protein, 23 aa, Entamoeba invadens
INMSMCVIGFTIVGVATLLYQKT

SEQ ID NO: 2794309 - protein, 26 aa, Entamoeba invadens
INNFKTCLICSGGTFANAETNTCDFC

SEQ ID NO: 2794310 - protein, 19 aa, Entamoeba invadens
INNHKSFLTYEFKESDNVD

SEQ ID NO: 2794311 - protein, 37 aa, Entamoeba invadens
INNKLCFFSKFRLFKVFRCKKTNYGLVIVLPIMCIVV

SEQ ID NO: 2794312 - protein, 24 aa, Entamoeba invadens
INNTEIWPIFLFLIIQGVGLAMFW

SEQ ID NO: 2794313 - protein, 17 aa, Entamoeba invadens
INPELAVLKHDEACEFE

SEQ ID NO: 2794314 - protein, 25 aa, Entamoeba invadens
INPIFKFNIHYEIIVFVLLTVLFFF

SEQ ID NO: 2794315 - protein, 17 aa, Entamoeba invadens
INPIPLPQENIVFPNFV

SEQ ID NO: 2794316 - protein, 19 aa, Entamoeba invadens
INPKVNWEKLEAIVKEEKT

SEQ ID NO: 2794317 - protein, 18 aa, Entamoeba invadens
INPLCPITTEEMSKLLKL

SEQ ID NO: 2794318 - protein, 26 aa, Entamoeba invadens
INPTYCLSCPLGFYISNNICKTNSEL

SEQ ID NO: 2794319 - protein, 24 aa, Entamoeba invadens
INPYFSCSKIMWLFENVPEAKKLA

SEQ ID NO: 2794320 - protein, 21 aa, Entamoeba invadens
INQTLKWVKKMGGVEAIHKMN

SEQ ID NO: 2794321 - protein, 20 aa, Entamoeba invadens
INRCLSCPDQTYSFANSSMC

SEQ ID NO: 2794322 - protein, 25 aa, Entamoeba invadens
INRKGVAPFSMKVRRKVCLDASKGI

SEQ ID NO: 2794323 - protein, 18 aa, Entamoeba invadens
INRKRLFYLAPLSFIVSV

SEQ ID NO: 2794324 - protein, 21 aa, Entamoeba invadens
INSCVSCGLTGVVNTDGLCLS

SEQ ID NO: 2794325 - protein, 17 aa, Entamoeba invadens
INSCWEQDPAMRPSFDT

SEQ ID NO: 2794326 - protein, 22 aa, Entamoeba invadens
INSDVFEWSGRVNGMGCLSTLV

SEQ ID NO: 2794327 - protein, 23 aa, Entamoeba invadens
INSFCTKCFWGCATCYSQQPYYC

SEQ ID NO: 2794328 - protein, 26 aa, Entamoeba invadens
INSIGSKGVKVWNYDVCDLSAAGDLT

SEQ ID NO: 2794329 - protein, 24 aa, Entamoeba invadens
INSKCNKCSFWHSPNKNGEVCDSQ

SEQ ID NO: 2794330 - protein, 17 aa, Entamoeba invadens
INSLFPIKGGEIGSTNF

SEQ ID NO: 2794331 - protein, 18 aa, Entamoeba invadens
INSNAEFKRIFVSDEKLK

SEQ ID NO: 2794332 - protein, 17 aa, Entamoeba invadens
INSPFFFNEGVVVHITK

SEQ ID NO: 2794333 - protein, 19 aa, Entamoeba invadens
INSPITVNGLVYFNQKLDG

SEQ ID NO: 2794334 - protein, 26 aa, Entamoeba invadens
INSPRKYCWIASLLLISSYEMVLNVF

SEQ ID NO: 2794335 - protein, 25 aa, Entamoeba invadens
INSQCLTCASGFYLEQKECKQCGPG

SEQ ID NO: 2794336 - protein, 26 aa, Entamoeba invadens
INSTRCITCPLGYYLSNNTCNTNAKL

SEQ ID NO: 2794337 - protein, 27 aa, Entamoeba invadens
INTAWLNIVTFPWLFGVMFSDAGHGLF

SEQ ID NO: 2794338 - protein, 27 aa, Entamoeba invadens
INTAWLNIVTFPWLFGVMFSDCGHGFF

SEQ ID NO: 2794339 - protein, 20 aa, Entamoeba invadens
INTEEKILFCVGNTKERTLK

SEQ ID NO: 2794340 - protein, 30 aa, Entamoeba invadens
INTEGNAFVEPDCVKSILDNSNKLTLKYLG

SEQ ID NO: 2794341 - protein, 20 aa, Entamoeba invadens
INTKIWLNGLFIFLYCATFY

SEQ ID NO: 2794342 - protein, 17 aa, Entamoeba invadens
INTKMLNVCEIFKVVIL

SEQ ID NO: 2794343 - protein, 26 aa, Entamoeba invadens
INTVFSQRIELVWKGSKGYSNRKEEP

SEQ ID NO: 2794344 - protein, 18 aa, Entamoeba invadens
INTVLGCISCTSGYYLYH

SEQ ID NO: 2794345 - protein, 19 aa, Entamoeba invadens
INTVLGCISCTSGYYLYYK

SEQ ID NO: 2794346 - protein, 24 aa, Entamoeba invadens
INTYCVLCAIGYSVYNNTCVTYKI

SEQ ID NO: 2794347 - protein, 20 aa, Entamoeba invadens
INVNTRYGYVISIKDKTASS

SEQ ID NO: 2794348 - protein, 17 aa, Entamoeba invadens
INWLRKSYITGVVIVID

SEQ ID NO: 2794349 - protein, 22 aa, Entamoeba invadens
INYILKGNVLFTNDVVLSNLKT

SEQ ID NO: 2794350 - protein, 20 aa, Entamoeba invadens
INYWSNAMYLEYHLRTKTSE

SEQ ID NO: 2794351 - protein, 20 aa, Entamoeba invadens
IPAATNVFIQFAFPQKKDFD

SEQ ID NO: 2794352 - protein, 24 aa, Entamoeba invadens
IPAGKKLRVNTCHKATEGDVKVDV

SEQ ID NO: 2794353 - protein, 25 aa, Entamoeba invadens
IPANTVIICDICFLDSHIESIVIPN

SEQ ID NO: 2794354 - protein, 17 aa, Entamoeba invadens
IPASEFVKTLSQKVEKE

SEQ ID NO: 2794355 - protein, 17 aa, Entamoeba invadens
IPCTGNAKKCHYNAETQ

SEQ ID NO: 2794356 - protein, 21 aa, Entamoeba invadens
IPDCATCKWVGSEISCTSCYE

SEQ ID NO: 2794357 - protein, 23 aa, Entamoeba invadens
IPDFTFKGCTALATVTGIDAVTS

SEQ ID NO: 2794358 - protein, 21 aa, Entamoeba invadens
IPDFTFKGCTPLNDLRNSAKV

SEQ ID NO: 2794359 - protein, 25 aa, Entamoeba invadens
IPDILRKCVNGIIKSGLGVDGLFRK

SEQ ID NO: 2794360 - protein, 21 aa, Entamoeba invadens
IPDSINVVFKTTFAFKQLLTS

SEQ ID NO: 2794361 - protein, 20 aa, Entamoeba invadens
IPEFYYLPQFTMNFNTIDFG

SEQ ID NO: 2794362 - protein, 19 aa, Entamoeba invadens
IPEHICMVTEFALYGSLRD

SEQ ID NO: 2794363 - protein, 20 aa, Entamoeba invadens
IPEKERMTVEIAIPEEEAQR

SEQ ID NO: 2794364 - protein, 26 aa, Entamoeba invadens
IPELLKLRFCQDIARGMEYLHENDIL

SEQ ID NO: 2794365 - protein, 20 aa, Entamoeba invadens
IPELSCYISKEFTGKVNEQT

SEQ ID NO: 2794366 - protein, 19 aa, Entamoeba invadens
IPELVWKGKVVFDNQGEMV

SEQ ID NO: 2794367 - protein, 19 aa, Entamoeba invadens
IPETSSWVCSNTVVTTLDA

SEQ ID NO: 2794368 - protein, 17 aa, Entamoeba invadens
IPEYAKFHVVSRKKFVV

SEQ ID NO: 2794369 - protein, 17 aa, Entamoeba invadens
IPEYIHSHWDLFKRLNQ

SEQ ID NO: 2794370 - protein, 21 aa, Entamoeba invadens
IPFFKMLFLKCNLLYAKYAKK

SEQ ID NO: 2794371 - protein, 19 aa, Entamoeba invadens
IPFGAFICVLIVVISFVIN

SEQ ID NO: 2794372 - protein, 26 aa, Entamoeba invadens
IPFGSKWKQGDVVSICVDFDNKTMKV

SEQ ID NO: 2794373 - protein, 24 aa, Entamoeba invadens
IPFGVTSIGDWCFNECINLRSVTI

SEQ ID NO: 2794374 - protein, 19 aa, Entamoeba invadens
IPFPVCITQARSFLQNFTD

SEQ ID NO: 2794375 - protein, 25 aa, Entamoeba invadens
IPFSKSVTLGVNWPTTKSVCLGPGA

SEQ ID NO: 2794376 - protein, 20 aa, Entamoeba invadens
IPFSSYRKRMSVLLRDKYGG

SEQ ID NO: 2794377 - protein, 24 aa, Entamoeba invadens
IPFWRSVFYLIFRVPFWTFISAFM

SEQ ID NO: 2794378 - protein, 18 aa, Entamoeba invadens
IPFYLNGLLKEINPTFEQ

SEQ ID NO: 2794379 - protein, 25 aa, Entamoeba invadens
IPGRCKGDAASGCLDCKEGYVKNEK

SEQ ID NO: 2794380 - protein, 17 aa, Entamoeba invadens
IPHCSQYSQGRCVLCDD

SEQ ID NO: 2794381 - protein, 27 aa, Entamoeba invadens
IPHESHLPISIGIDWGYDTIVVSTKTQ

SEQ ID NO: 2794382 - protein, 19 aa, Entamoeba invadens
IPHFCIYLLSTAIGHFLVT

SEQ ID NO: 2794383 - protein, 24 aa, Entamoeba invadens
IPHFISLNMLMRFHQVSRNCGESI

SEQ ID NO: 2794384 - protein, 18 aa, Entamoeba invadens
IPIFPCSIFFAVVAAVIV

SEQ ID NO: 2794385 - protein, 17 aa, Entamoeba invadens
IPIKIRLLFSTIFNLIG

SEQ ID NO: 2794386 - protein, 25 aa, Entamoeba invadens
IPIMTRWIVFCLHRIFEKKSKTEPM

SEQ ID NO: 2794387 - protein, 21 aa, Entamoeba invadens
IPINRATAVYAIAKALTLYPD

SEQ ID NO: 2794388 - protein, 17 aa, Entamoeba invadens
IPIRFQTVISSRLDYEE

SEQ ID NO: 2794389 - protein, 24 aa, Entamoeba invadens
IPISIRVNLDISKLIYSFFISTDD

SEQ ID NO: 2794390 - protein, 17 aa, Entamoeba invadens
IPISLVHHVAFSDVEAG

SEQ ID NO: 2794391 - protein, 25 aa, Entamoeba invadens
IPISVGVTMEICRYVQGFVMEMDAD

SEQ ID NO: 2794392 - protein, 21 aa, Entamoeba invadens
IPISVLILIKIVVSTIIVTII

SEQ ID NO: 2794393 - protein, 17 aa, Entamoeba invadens
IPIVFGVAVIVILLVAV

SEQ ID NO: 2794394 - protein, 19 aa, Entamoeba invadens
IPIVSVFIIVFIIIGFLII

SEQ ID NO: 2794395 - protein, 21 aa, Entamoeba invadens
IPIVVVLAVSAVREIVEDLKR

SEQ ID NO: 2794396 - protein, 17 aa, Entamoeba invadens
IPIYFPDKLELVCKEFN

SEQ ID NO: 2794397 - protein, 19 aa, Entamoeba invadens
IPKDCKNNQCFPRYPLNCQ

SEQ ID NO: 2794398 - protein, 23 aa, Entamoeba invadens
IPKKICLVTEFAKYGSLHDLMKI

SEQ ID NO: 2794399 - protein, 23 aa, Entamoeba invadens
IPKKKACEFEIFLTPKCSCKIVD

SEQ ID NO: 2794400 - protein, 25 aa, Entamoeba invadens
IPKKLRMKFCLDSSKGIAYLHQNGI

SEQ ID NO: 2794401 - protein, 17 aa, Entamoeba invadens
IPKKYLLTCFSVVLYRM

SEQ ID NO: 2794402 - protein, 28 aa, Entamoeba invadens
IPKMDDFSCSVLFPFITKKFFINDYNMA

SEQ ID NO: 2794403 - protein, 24 aa, Entamoeba invadens
IPLDILRKKMCILPQEATLFSGTV

SEQ ID NO: 2794404 - protein, 24 aa, Entamoeba invadens
IPLDILRKQMCILPQEATLFSGTV

SEQ ID NO: 2794405 - protein, 17 aa, Entamoeba invadens
IPLIFAWTKTSTQPASK

SEQ ID NO: 2794406 - protein, 21 aa, Entamoeba invadens
IPLIILWVILFILQIGIFIVS

SEQ ID NO: 2794407 - protein, 20 aa, Entamoeba invadens
IPLIKARSGTMEHFIAKELT

SEQ ID NO: 2794408 - protein, 23 aa, Entamoeba invadens
IPLLHMIMMLFLWVTPMTRKVQF

SEQ ID NO: 2794409 - protein, 20 aa, Entamoeba invadens
IPLLVLSAFVLKRTNSESTE

SEQ ID NO: 2794410 - protein, 17 aa, Entamoeba invadens
IPLLWMIYTNAFNLEKN

SEQ ID NO: 2794411 - protein, 19 aa, Entamoeba invadens
IPLSCEITPFAKMFPGEKL

SEQ ID NO: 2794412 - protein, 17 aa, Entamoeba invadens
IPLSTLLVLFWNVPKSK

SEQ ID NO: 2794413 - protein, 19 aa, Entamoeba invadens
IPLSVFVLIECAWGRVPKE

SEQ ID NO: 2794414 - protein, 17 aa, Entamoeba invadens
IPLTYPLISLVTYILKL

SEQ ID NO: 2794415 - protein, 20 aa, Entamoeba invadens
IPLYIKCTVAIVSRESTRKM

SEQ ID NO: 2794416 - protein, 19 aa, Entamoeba invadens
IPMKCILCSQNAYFKTPKT

SEQ ID NO: 2794417 - protein, 19 aa, Entamoeba invadens
IPMSHNWVGYLIRALCLIL

SEQ ID NO: 2794418 - protein, 21 aa, Entamoeba invadens
IPMVIGVTIIRAHSCFAITDA

SEQ ID NO: 2794419 - protein, 19 aa, Entamoeba invadens
IPNAFWWSDKMRARMEAVC

SEQ ID NO: 2794420 - protein, 25 aa, Entamoeba invadens
IPNCFKSLVEDCWRHKMEERPSFDD

SEQ ID NO: 2794421 - protein, 20 aa, Entamoeba invadens
IPNCQICTITSVNVPICTSC

SEQ ID NO: 2794422 - protein, 17 aa, Entamoeba invadens
IPNEMAKELGIPKIEKP

SEQ ID NO: 2794423 - protein, 27 aa, Entamoeba invadens
IPNFLKLTLLFVDFCLLLVSVKSQTKD

SEQ ID NO: 2794424 - protein, 19 aa, Entamoeba invadens
IPNHICMVTEFALYGSLQD

SEQ ID NO: 2794425 - protein, 21 aa, Entamoeba invadens
IPNKICLVTEFALLGSLQDLI

SEQ ID NO: 2794426 - protein, 20 aa, Entamoeba invadens
IPNKICLVTEFALYGSLQDL

SEQ ID NO: 2794427 - protein, 21 aa, Entamoeba invadens
IPNKICLVTEFANYGSLQDLM

SEQ ID NO: 2794428 - protein, 21 aa, Entamoeba invadens
IPNKICLVTEFAPYGSLKDVM

SEQ ID NO: 2794429 - protein, 21 aa, Entamoeba invadens
IPNKMCMVTEFALFGSLQDLM

SEQ ID NO: 2794430 - protein, 18 aa, Entamoeba invadens
IPNLLCSLFCTFFSIWGT

SEQ ID NO: 2794431 - protein, 21 aa, Entamoeba invadens
IPNLSECFVFLGDDFFFYRPT

SEQ ID NO: 2794432 - protein, 21 aa, Entamoeba invadens
IPPGYRFVTIFTQSTWTRTAG

SEQ ID NO: 2794433 - protein, 19 aa, Entamoeba invadens
IPPLLIWTLIWIFFGCFTF

SEQ ID NO: 2794434 - protein, 18 aa, Entamoeba invadens
IPPMKIRVKMMIDGARGV

SEQ ID NO: 2794435 - protein, 18 aa, Entamoeba invadens
IPPMKIRVKMMMDGAKGV

SEQ ID NO: 2794436 - protein, 19 aa, Entamoeba invadens
IPPMKLRVKMMMDGARGVL

SEQ ID NO: 2794437 - protein, 25 aa, Entamoeba invadens
IPQCCQDLLLSCWVSQQDRVIQIDE

SEQ ID NO: 2794438 - protein, 28 aa, Entamoeba invadens
IPQDSFIFALRFFHLAKTFFRLLKIDKS

SEQ ID NO: 2794439 - protein, 17 aa, Entamoeba invadens
IPQGISMKKLKRDILAV

SEQ ID NO: 2794440 - protein, 17 aa, Entamoeba invadens
IPQNVSLSFFVWYLHEV

SEQ ID NO: 2794441 - protein, 24 aa, Entamoeba invadens
IPRCYECSMNCLLCSSEETCLICD

SEQ ID NO: 2794442 - protein, 26 aa, Entamoeba invadens
IPRMSLKPFKIFKCKQFCQMLERISV

SEQ ID NO: 2794443 - protein, 26 aa, Entamoeba invadens
IPRNRAKHPVLFTGKTPKGFLNFCES

SEQ ID NO: 2794444 - protein, 20 aa, Entamoeba invadens
IPRSDEKGAFIVRDEGASTG

SEQ ID NO: 2794445 - protein, 23 aa, Entamoeba invadens
IPRYELLIRDMLKDVGKDFPDLE

SEQ ID NO: 2794446 - protein, 23 aa, Entamoeba invadens
IPRYELLIRDMLKDVGKDFPDVE

SEQ ID NO: 2794447 - protein, 21 aa, Entamoeba invadens
IPSFCDFAATYLMNFGLLFVS

SEQ ID NO: 2794448 - protein, 18 aa, Entamoeba invadens
IPSFITNFITFVILYNNL

SEQ ID NO: 2794449 - protein, 22 aa, Entamoeba invadens
IPSGGCVKCVDGYYRSELSCER

SEQ ID NO: 2794450 - protein, 25 aa, Entamoeba invadens
IPSLLAGLIEKCWKHVPGDRPTFDQ

SEQ ID NO: 2794451 - protein, 17 aa, Entamoeba invadens
IPSSVTYIANFAFKNCS

SEQ ID NO: 2794452 - protein, 17 aa, Entamoeba invadens
IPTCINIGSVTTIPHLF

SEQ ID NO: 2794453 - protein, 25 aa, Entamoeba invadens
IPTFNGFCVISIYILHTKIHVPFLM

SEQ ID NO: 2794454 - protein, 19 aa, Entamoeba invadens
IPTPPLVKWGWIIAISSVV

SEQ ID NO: 2794455 - protein, 26 aa, Entamoeba invadens
IPTSLEFPSGIDLVGYVLKREVKDAH

SEQ ID NO: 2794456 - protein, 19 aa, Entamoeba invadens
IPTTSGIPFLATASNCYEV

SEQ ID NO: 2794457 - protein, 20 aa, Entamoeba invadens
IPTWRTSLYEGVKVKLNLVD

SEQ ID NO: 2794458 - protein, 17 aa, Entamoeba invadens
IPVCIKKGRAVEFTVTV

SEQ ID NO: 2794459 - protein, 19 aa, Entamoeba invadens
IPVCKECSSNCLHCLDNTK

SEQ ID NO: 2794460 - protein, 24 aa, Entamoeba invadens
IPYGCDKGKCVIEDYDCSKHEDFP

SEQ ID NO: 2794461 - protein, 20 aa, Entamoeba invadens
IPYIPSYIMLFVLTFTFLRF

SEQ ID NO: 2794462 - protein, 25 aa, Entamoeba invadens
IPYSLKCAVCERGYYLDLTQRSCKK

SEQ ID NO: 2794463 - protein, 19 aa, Entamoeba invadens
IQALTIKPVHFNWIVVFIG

SEQ ID NO: 2794464 - protein, 21 aa, Entamoeba invadens
IQATLRLLAFFQNVFETKNQE

SEQ ID NO: 2794465 - protein, 20 aa, Entamoeba invadens
IQCKCYTEYIISDDIGLYEN

SEQ ID NO: 2794466 - protein, 25 aa, Entamoeba invadens
IQCTLSCDVLLSGAFEIISDNVVIQ

SEQ ID NO: 2794467 - protein, 32 aa, Entamoeba invadens
IQDNCDICDLMFCTKCLNSFVISQNTKCVTSS

SEQ ID NO: 2794468 - protein, 17 aa, Entamoeba invadens
IQFDFVLAEGVTIEKTN

SEQ ID NO: 2794469 - protein, 19 aa, Entamoeba invadens
IQFSKCGDERCKIRCNPEI

SEQ ID NO: 2794470 - protein, 18 aa, Entamoeba invadens
IQGGSFQSSFSFYPNLEM

SEQ ID NO: 2794471 - protein, 19 aa, Entamoeba invadens
IQGILKFNPYLTADMDSPS

SEQ ID NO: 2794472 - protein, 33 aa, Entamoeba invadens
IQGRAIGCLASLMKRYRYFDEYAQQYLIAQKNE

SEQ ID NO: 2794473 - protein, 20 aa, Entamoeba invadens
IQICTLCYAPYVLSNDKQSC

SEQ ID NO: 2794474 - protein, 17 aa, Entamoeba invadens
IQIKAKFYFFNGKMPAF

SEQ ID NO: 2794475 - protein, 21 aa, Entamoeba invadens
IQIPFSGVFSNHFHVQEVDKC

SEQ ID NO: 2794476 - protein, 24 aa, Entamoeba invadens
IQISYKSSEKFIFESNPQIIFLGE

SEQ ID NO: 2794477 - protein, 19 aa, Entamoeba invadens
IQITFPVYLLTKLDIPFKE

SEQ ID NO: 2794478 - protein, 22 aa, Entamoeba invadens
IQITGCKECVLALTKTKMYKIG

SEQ ID NO: 2794479 - protein, 18 aa, Entamoeba invadens
IQKDAGMCVICSPQTMLQ

SEQ ID NO: 2794480 - protein, 20 aa, Entamoeba invadens
IQKDFKELRVEMEIDGDYEF

SEQ ID NO: 2794481 - protein, 17 aa, Entamoeba invadens
IQKEVFENIPMLYADET

SEQ ID NO: 2794482 - protein, 23 aa, Entamoeba invadens
IQKHVIDIPNTFNGNSIQLGDNS

SEQ ID NO: 2794483 - protein, 26 aa, Entamoeba invadens
IQKLMLRLLLVYSIKHPASGYVQGFD

SEQ ID NO: 2794484 - protein, 24 aa, Entamoeba invadens
IQKTRLILFRLMKIVNDPFSLEAL

SEQ ID NO: 2794485 - protein, 25 aa, Entamoeba invadens
IQLCVKEVPALLIIATKYYDQMIVG

SEQ ID NO: 2794486 - protein, 26 aa, Entamoeba invadens
IQLKESRYFSVESLSVIPLELTSYVV

SEQ ID NO: 2794487 - protein, 27 aa, Entamoeba invadens
IQLKESRYFSVESLSVIPLELTSYVVT

SEQ ID NO: 2794488 - protein, 23 aa, Entamoeba invadens
IQLLNAQCGIFVSDISVNISSST

SEQ ID NO: 2794489 - protein, 17 aa, Entamoeba invadens
IQLVCLMVIVLLLIALA

SEQ ID NO: 2794490 - protein, 18 aa, Entamoeba invadens
IQMPRIFPQITSNRLLIK

SEQ ID NO: 2794491 - protein, 24 aa, Entamoeba invadens
IQNCFRIVNGICVECEDNFQMSRY

SEQ ID NO: 2794492 - protein, 17 aa, Entamoeba invadens
IQNCKICTENICSLCQD

SEQ ID NO: 2794493 - protein, 23 aa, Entamoeba invadens
IQNEMPLCIILRESDDYYKTSEV

SEQ ID NO: 2794494 - protein, 17 aa, Entamoeba invadens
IQNGIKLFSEMDNIIVT

SEQ ID NO: 2794495 - protein, 17 aa, Entamoeba invadens
IQNSYGCVRCILQNYSD

SEQ ID NO: 2794496 - protein, 19 aa, Entamoeba invadens
IQPPCYCIGDLHGNYRDAT

SEQ ID NO: 2794497 - protein, 24 aa, Entamoeba invadens
IQPRCIKVSLTMLGSVVAISFFTG

SEQ ID NO: 2794498 - protein, 28 aa, Entamoeba invadens
IQQCLLLGLLSRFGTFVLERPVKKSKVT

SEQ ID NO: 2794499 - protein, 19 aa, Entamoeba invadens
IQQCWKHNSSQRMNIENVV

SEQ ID NO: 2794500 - protein, 17 aa, Entamoeba invadens
IQQKLILKEGVCQQVDP

SEQ ID NO: 2794501 - protein, 24 aa, Entamoeba invadens
IQRCNYIKFEVLNNANGYNYVNLG

SEQ ID NO: 2794502 - protein, 17 aa, Entamoeba invadens
IQRLPRYLMLIETLIKN

SEQ ID NO: 2794503 - protein, 26 aa, Entamoeba invadens
IQRVESWKKHAMFWLITLTPASVIGC

SEQ ID NO: 2794504 - protein, 24 aa, Entamoeba invadens
IQSFKYKTWFPFYNLYSHSWNGNK

SEQ ID NO: 2794505 - protein, 20 aa, Entamoeba invadens
IQSGIVSLICKQFFSMETDI

SEQ ID NO: 2794506 - protein, 17 aa, Entamoeba invadens
IQSHIPSQLSWKNVSER

SEQ ID NO: 2794507 - protein, 20 aa, Entamoeba invadens
IQSLCFVHPDFFIVNKSTLF

SEQ ID NO: 2794508 - protein, 17 aa, Entamoeba invadens
IQSLILIYMLLSLLFFR

SEQ ID NO: 2794509 - protein, 21 aa, Entamoeba invadens
IQTCSKCFAPYVINDMTSECV

SEQ ID NO: 2794510 - protein, 23 aa, Entamoeba invadens
IQTCSYDHTYFCYSPLDIPTKVF

SEQ ID NO: 2794511 - protein, 21 aa, Entamoeba invadens
IQTESKFGVLEFIIEYKSFWY

SEQ ID NO: 2794512 - protein, 21 aa, Entamoeba invadens
IQTGHRVDRKFGWDTHGLPIE

SEQ ID NO: 2794513 - protein, 21 aa, Entamoeba invadens
IQTQCVEFLKMIFKTFPVEFV

SEQ ID NO: 2794514 - protein, 27 aa, Entamoeba invadens
IQTSVFNRGLLLFLRQCVHKVQDPFYL

SEQ ID NO: 2794515 - protein, 21 aa, Entamoeba invadens
IQVLCKNLVVLGTVSPSTQIC

SEQ ID NO: 2794516 - protein, 17 aa, Entamoeba invadens
IQVLEDYSSVTFDGGKS

SEQ ID NO: 2794517 - protein, 19 aa, Entamoeba invadens
IRAAYRRLSLKYHPDKNKL

SEQ ID NO: 2794518 - protein, 19 aa, Entamoeba invadens
IRCNKGYFIDKNMCKQCSQ

SEQ ID NO: 2794519 - protein, 23 aa, Entamoeba invadens
IRCQCGGLIKPDIVFFNESLPNA

SEQ ID NO: 2794520 - protein, 18 aa, Entamoeba invadens
IRCSSGHYLENGVCPSCQ

SEQ ID NO: 2794521 - protein, 21 aa, Entamoeba invadens
IRDCLKYLSVDVCETCVEGKM

SEQ ID NO: 2794522 - protein, 17 aa, Entamoeba invadens
IRDDEVNLSSGLAQLQT

SEQ ID NO: 2794523 - protein, 18 aa, Entamoeba invadens
IRDIPLIQTIFIYFSNAN

SEQ ID NO: 2794524 - protein, 31 aa, Entamoeba invadens
IRDKAVEMISRFCDVEHTFVLPQAVALFDRF

SEQ ID NO: 2794525 - protein, 23 aa, Entamoeba invadens
IRDKLPEWVFGGLTVEQAQRYLD

SEQ ID NO: 2794526 - protein, 20 aa, Entamoeba invadens
IRDLPIFFTNQINSIDFTFQ

SEQ ID NO: 2794527 - protein, 18 aa, Entamoeba invadens
IRDLPIVFYSGSKALNIL

SEQ ID NO: 2794528 - protein, 17 aa, Entamoeba invadens
IRDLPVVFYSGSNPLNI

SEQ ID NO: 2794529 - protein, 17 aa, Entamoeba invadens
IRDPAFLAFLGFFFYLL

SEQ ID NO: 2794530 - protein, 23 aa, Entamoeba invadens
IRDTPLFFTKMVDLLSGSYGFSN

SEQ ID NO: 2794531 - protein, 19 aa, Entamoeba invadens
IREAMGYSVSELNIIFSVG

SEQ ID NO: 2794532 - protein, 21 aa, Entamoeba invadens
IREIGYFAWIMTKSFETSFSM

SEQ ID NO: 2794533 - protein, 18 aa, Entamoeba invadens
IRFDMLETSFCFVNSHLA

SEQ ID NO: 2794534 - protein, 24 aa, Entamoeba invadens
IRFKEYKCVFPGCSEGLKTKYNCI

SEQ ID NO: 2794535 - protein, 21 aa, Entamoeba invadens
IRFPECPYIARIHGYCLSPLC

SEQ ID NO: 2794536 - protein, 18 aa, Entamoeba invadens
IRFTLNFNTLEKVPLSDE

SEQ ID NO: 2794537 - protein, 33 aa, Entamoeba invadens
IRFVNEPKFEVTLCVGCFYALKSITDVSQYNEV

SEQ ID NO: 2794538 - protein, 31 aa, Entamoeba invadens
IRGGLMYMHCFLRKSLVIHETIPWMLFVSTI

SEQ ID NO: 2794539 - protein, 19 aa, Entamoeba invadens
IRGIGCKFGTDITKRFLDA

SEQ ID NO: 2794540 - protein, 17 aa, Entamoeba invadens
IRGMKIPYTVWFSKSKT

SEQ ID NO: 2794541 - protein, 18 aa, Entamoeba invadens
IRGREEPYIKAVQVSVSP

SEQ ID NO: 2794542 - protein, 19 aa, Entamoeba invadens
IRGSEGCLHTCRCMTDYGF

SEQ ID NO: 2794543 - protein, 19 aa, Entamoeba invadens
IRISPSVVENVKYELAVEP

SEQ ID NO: 2794544 - protein, 17 aa, Entamoeba invadens
IRISVDTLIRVNDALQL

SEQ ID NO: 2794545 - protein, 18 aa, Entamoeba invadens
IRITKILTARGLKMFASN

SEQ ID NO: 2794546 - protein, 18 aa, Entamoeba invadens
IRKCTTCLTGKYPNPSSP

SEQ ID NO: 2794547 - protein, 24 aa, Entamoeba invadens
IRKEECDGGHNCVIDECKCANGYI

SEQ ID NO: 2794548 - protein, 25 aa, Entamoeba invadens
IRKIPQFPFFPTIPIEGFLDDYTEL

SEQ ID NO: 2794549 - protein, 17 aa, Entamoeba invadens
IRKLYVMQGNPLKVGDL

SEQ ID NO: 2794550 - protein, 25 aa, Entamoeba invadens
IRKNLWSYNCFMVYLHCSNGVEYLQ

SEQ ID NO: 2794551 - protein, 19 aa, Entamoeba invadens
IRKSKMYSMYLKTTEPPVI

SEQ ID NO: 2794552 - protein, 24 aa, Entamoeba invadens
IRKVREISERMIIRINARDKEAME

SEQ ID NO: 2794553 - protein, 23 aa, Entamoeba invadens
IRKVRGGPELSVLLSNALEKASR

SEQ ID NO: 2794554 - protein, 17 aa, Entamoeba invadens
IRLMRKIFKHSPKSGEK

SEQ ID NO: 2794555 - protein, 22 aa, Entamoeba invadens
IRLNGYAFTFFVGFPSFSYVLS

SEQ ID NO: 2794556 - protein, 18 aa, Entamoeba invadens
IRMSKGWERELEKHPKSP

SEQ ID NO: 2794557 - protein, 22 aa, Entamoeba invadens
IRNDFEFSLIILCFVTCSVLGQ

SEQ ID NO: 2794558 - protein, 27 aa, Entamoeba invadens
IRNNPRYYNLFYFCFRELCVRPYTARF

SEQ ID NO: 2794559 - protein, 24 aa, Entamoeba invadens
IRNYYNGKCSYIFSTAKNIETVNA

SEQ ID NO: 2794560 - protein, 23 aa, Entamoeba invadens
IRPCACEGLFKYVHPSCLQQYRV

SEQ ID NO: 2794561 - protein, 21 aa, Entamoeba invadens
IRPIAIELLTEIQFEMTSQRN

SEQ ID NO: 2794562 - protein, 18 aa, Entamoeba invadens
IRPKFVIQSKGLHLYSDI

SEQ ID NO: 2794563 - protein, 19 aa, Entamoeba invadens
IRPLTMILDGLSFTAKEGE

SEQ ID NO: 2794564 - protein, 19 aa, Entamoeba invadens
IRQGLFDVLYSGYFGSLSG

SEQ ID NO: 2794565 - protein, 23 aa, Entamoeba invadens
IRQTLKPGYAVSVEFKITMICTA

SEQ ID NO: 2794566 - protein, 17 aa, Entamoeba invadens
IRRKLVFLKNLKDIQLK

SEQ ID NO: 2794567 - protein, 18 aa, Entamoeba invadens
IRRLAVIERAEFENTTLK

SEQ ID NO: 2794568 - protein, 18 aa, Entamoeba invadens
IRSAMKIAPFNLTQTNFQ

SEQ ID NO: 2794569 - protein, 21 aa, Entamoeba invadens
IRSICGGDGYTKRFAKESAST

SEQ ID NO: 2794570 - protein, 17 aa, Entamoeba invadens
IRSQFIINFIGSAITED

SEQ ID NO: 2794571 - protein, 17 aa, Entamoeba invadens
IRSRLSPKLDLGEIHLD

SEQ ID NO: 2794572 - protein, 18 aa, Entamoeba invadens
IRSVPPFVTLKPGYACEF

SEQ ID NO: 2794573 - protein, 17 aa, Entamoeba invadens
IRSVPPLVTLKPGYACE

SEQ ID NO: 2794574 - protein, 19 aa, Entamoeba invadens
IRSYHLCYGNIPDYTNTIK

SEQ ID NO: 2794575 - protein, 17 aa, Entamoeba invadens
IRTVPSLITLKRGEACE

SEQ ID NO: 2794576 - protein, 18 aa, Entamoeba invadens
IRVKKCLYEQLTKLSKKM

SEQ ID NO: 2794577 - protein, 17 aa, Entamoeba invadens
IRVLIGALMMLNGLASH

SEQ ID NO: 2794578 - protein, 17 aa, Entamoeba invadens
IRVLLYFVVAIGNSFNF

SEQ ID NO: 2794579 - protein, 18 aa, Entamoeba invadens
IRVLYDMIDIAALNGYKT

SEQ ID NO: 2794580 - protein, 22 aa, Entamoeba invadens
IRVPHYISNLIIYNSKNVAMTK

SEQ ID NO: 2794581 - protein, 18 aa, Entamoeba invadens
IRVSCITDFCEVQLTVES

SEQ ID NO: 2794582 - protein, 17 aa, Entamoeba invadens
IRVTEEFMENFVGGFPL

SEQ ID NO: 2794583 - protein, 21 aa, Entamoeba invadens
IRVVIPFVILLGIALFLTSNT

SEQ ID NO: 2794584 - protein, 24 aa, Entamoeba invadens
ISAFDLKSICYVSDSLFFIHKNGH

SEQ ID NO: 2794585 - protein, 24 aa, Entamoeba invadens
ISAIAELYMRNGIPDELMFKMIEL

SEQ ID NO: 2794586 - protein, 24 aa, Entamoeba invadens
ISAKRGAGFSGWEYITDGFATMKP

SEQ ID NO: 2794587 - protein, 17 aa, Entamoeba invadens
ISASMLKDHIENNKPLR

SEQ ID NO: 2794588 - protein, 29 aa, Entamoeba invadens
ISCCKKASCFKMVLAIIAPICAFFAIVFG

SEQ ID NO: 2794589 - protein, 24 aa, Entamoeba invadens
ISCDSTKCFTCYDKFVLQDGKCVS

SEQ ID NO: 2794590 - protein, 17 aa, Entamoeba invadens
ISCEQRLCYIGREAFTL

SEQ ID NO: 2794591 - protein, 20 aa, Entamoeba invadens
ISCETSCAPNMCNTSNGNCD

SEQ ID NO: 2794592 - protein, 18 aa, Entamoeba invadens
ISCGEGFYKDVNECKNKN

SEQ ID NO: 2794593 - protein, 20 aa, Entamoeba invadens
ISCLSCSAGEYQDRVGQSRC

SEQ ID NO: 2794594 - protein, 24 aa, Entamoeba invadens
ISCPEDVFSALVFDHLLKQMHMNH

SEQ ID NO: 2794595 - protein, 18 aa, Entamoeba invadens
ISCQMGFFEQKNIYVKCP

SEQ ID NO: 2794596 - protein, 18 aa, Entamoeba invadens
ISCSTFGGQCSKCTGDKC

SEQ ID NO: 2794597 - protein, 27 aa, Entamoeba invadens
ISCVKNRILFENGLCLDISYVSKCLEI

SEQ ID NO: 2794598 - protein, 19 aa, Entamoeba invadens
ISDAINRTGGLALLCSYIL

SEQ ID NO: 2794599 - protein, 18 aa, Entamoeba invadens
ISDAVLAYNVFVKKSNLT

SEQ ID NO: 2794600 - protein, 25 aa, Entamoeba invadens
ISDCWSELYMAPEILKQQKYKKSAD

SEQ ID NO: 2794601 - protein, 24 aa, Entamoeba invadens
ISDFRDVFIFADFFATFSSNDLFF

SEQ ID NO: 2794602 - protein, 21 aa, Entamoeba invadens
ISDGNLCLKCSNGVIRGSCDV

SEQ ID NO: 2794603 - protein, 19 aa, Entamoeba invadens
ISDPVRYEVPGAIENCVEA

SEQ ID NO: 2794604 - protein, 17 aa, Entamoeba invadens
ISDSIVICFKYFPIIVV

SEQ ID NO: 2794605 - protein, 18 aa, Entamoeba invadens
ISDVISCPVASSTTSLNV

SEQ ID NO: 2794606 - protein, 30 aa, Entamoeba invadens
ISDYFPLVRFKRRFLLVMGTITLTVALPLI

SEQ ID NO: 2794607 - protein, 27 aa, Entamoeba invadens
ISECFKYDKMRCDEGYFKNGNSCIDCV

SEQ ID NO: 2794608 - protein, 27 aa, Entamoeba invadens
ISEDVTRYVIKNGITNGCECWNQLADC

SEQ ID NO: 2794609 - protein, 17 aa, Entamoeba invadens
ISEEVNIFFCVFVSLGL

SEQ ID NO: 2794610 - protein, 27 aa, Entamoeba invadens
ISEGLYRISTSDGYYCTYSGKGSDNSA

SEQ ID NO: 2794611 - protein, 24 aa, Entamoeba invadens
ISELPETLSMIFIITTLIRFFLTP

SEQ ID NO: 2794612 - protein, 30 aa, Entamoeba invadens
ISETVPSVFGWCLLYYKASMLIQELHRGEF

SEQ ID NO: 2794613 - protein, 18 aa, Entamoeba invadens
ISFGIKWCKEDGEITCVN

SEQ ID NO: 2794614 - protein, 24 aa, Entamoeba invadens
ISFGNLKGRHTVIISIVSEMITTK

SEQ ID NO: 2794615 - protein, 31 aa, Entamoeba invadens
ISFILFKFVLKSEVLWQVQFGGCIGLNIGLF

SEQ ID NO: 2794616 - protein, 21 aa, Entamoeba invadens
ISFINMFLAIAFASAAIYLIV

SEQ ID NO: 2794617 - protein, 30 aa, Entamoeba invadens
ISFLVLCGSLSFIVTCLLKYKRIDINIYKT

SEQ ID NO: 2794618 - protein, 20 aa, Entamoeba invadens
ISFMESVWWVFKQLYEKQLV

SEQ ID NO: 2794619 - protein, 24 aa, Entamoeba invadens
ISFMLPFHIGNSISIDNNSSTIIN

SEQ ID NO: 2794620 - protein, 23 aa, Entamoeba invadens
ISFPLMCQYFTKWLNTENPSKGI

SEQ ID NO: 2794621 - protein, 22 aa, Entamoeba invadens
ISFTTLRGGVVVNMTEINFNED

SEQ ID NO: 2794622 - protein, 19 aa, Entamoeba invadens
ISFVVEFAEYLSLQDVMEN

SEQ ID NO: 2794623 - protein, 25 aa, Entamoeba invadens
ISGCSFYKNNWCRRTKTSDPAMYFK

SEQ ID NO: 2794624 - protein, 17 aa, Entamoeba invadens
ISGCSLKSDVVGCDGDV

SEQ ID NO: 2794625 - protein, 21 aa, Entamoeba invadens
ISGFVKIEIDAPILDFSIGQK

SEQ ID NO: 2794626 - protein, 19 aa, Entamoeba invadens
ISGILCFDRNKMKKSILDN

SEQ ID NO: 2794627 - protein, 24 aa, Entamoeba invadens
ISGKCKLCQPSLLLGMSDGAFVCT

SEQ ID NO: 2794628 - protein, 17 aa, Entamoeba invadens
ISGMSFVPMVLVDVVPF

SEQ ID NO: 2794629 - protein, 19 aa, Entamoeba invadens
ISGSVELFSDVNFNNNSDF

SEQ ID NO: 2794630 - protein, 25 aa, Entamoeba invadens
ISGVSKPSTFGSIEIVTTNGSVAKL

SEQ ID NO: 2794631 - protein, 18 aa, Entamoeba invadens
ISGYALGFAKSWDLTLVL

SEQ ID NO: 2794632 - protein, 21 aa, Entamoeba invadens
ISGYCRHALQIYKNTHFPISV

SEQ ID NO: 2794633 - protein, 39 aa, Entamoeba invadens
ISHGCLECATGYYLKNRVCYVCASGCYSCTDTNICLKCK

SEQ ID NO: 2794634 - protein, 17 aa, Entamoeba invadens
ISIEGYERIDFKFLVIE

SEQ ID NO: 2794635 - protein, 21 aa, Entamoeba invadens
ISIEKCLKCSSDNFLLNGKCQ

SEQ ID NO: 2794636 - protein, 19 aa, Entamoeba invadens
ISIIKAVHAWLNLFIFILC

SEQ ID NO: 2794637 - protein, 21 aa, Entamoeba invadens
ISIKICAKTVISTRLDPDELK

SEQ ID NO: 2794638 - protein, 20 aa, Entamoeba invadens
ISILAGLVYTFGFVQMMPQL

SEQ ID NO: 2794639 - protein, 17 aa, Entamoeba invadens
ISIMFLNLGTNYIIRSD

SEQ ID NO: 2794640 - protein, 21 aa, Entamoeba invadens
ISIPQLFGFIFCPRHRLPKLN

SEQ ID NO: 2794641 - protein, 26 aa, Entamoeba invadens
ISIPRCGSCMEIIGPSLKSATCTVIG

SEQ ID NO: 2794642 - protein, 20 aa, Entamoeba invadens
ISIPVGLLLIIFKVVITVVC

SEQ ID NO: 2794643 - protein, 19 aa, Entamoeba invadens
ISISYFFQFLFPEEFLKQK

SEQ ID NO: 2794644 - protein, 18 aa, Entamoeba invadens
ISIVCPFTMTFIALLATN

SEQ ID NO: 2794645 - protein, 23 aa, Entamoeba invadens
ISIYKLSFVLVINFVYFGVELAM

SEQ ID NO: 2794646 - protein, 23 aa, Entamoeba invadens
ISKDAFRLLEIVSVTFGNNPIEH

SEQ ID NO: 2794647 - protein, 17 aa, Entamoeba invadens
ISKDFMECIIFDRTLDM

SEQ ID NO: 2794648 - protein, 26 aa, Entamoeba invadens
ISKESLHCVRCWNHTFLQYEDCSDCD

SEQ ID NO: 2794649 - protein, 21 aa, Entamoeba invadens
ISKGSECPDSFTGDYTLQSTK

SEQ ID NO: 2794650 - protein, 23 aa, Entamoeba invadens
ISKILCKKCESLSTFIKELFASL

SEQ ID NO: 2794651 - protein, 22 aa, Entamoeba invadens
ISKLEFKCFCNCRNMSKIDIPN

SEQ ID NO: 2794652 - protein, 19 aa, Entamoeba invadens
ISKMAWIFRGVLLSLFMII

SEQ ID NO: 2794653 - protein, 17 aa, Entamoeba invadens
ISKNYYRVHALSLAAVG

SEQ ID NO: 2794654 - protein, 19 aa, Entamoeba invadens
ISKVCISCRSFDSHCTTCA

SEQ ID NO: 2794655 - protein, 21 aa, Entamoeba invadens
ISKVGGAYCGLFYLLETLEGN

SEQ ID NO: 2794656 - protein, 22 aa, Entamoeba invadens
ISKYPVKFSFAIANGLEDKFTL

SEQ ID NO: 2794657 - protein, 25 aa, Entamoeba invadens
ISLAIELLSSFMLPSGIVMLFIQIF

SEQ ID NO: 2794658 - protein, 26 aa, Entamoeba invadens
ISLFLGISILCLGVFQLIQCDFSMLT

SEQ ID NO: 2794659 - protein, 25 aa, Entamoeba invadens
ISLGPCIWGAFNLVTGWVTGTFGLF

SEQ ID NO: 2794660 - protein, 22 aa, Entamoeba invadens
ISLIMCCINISPKLLETNKTLG

SEQ ID NO: 2794661 - protein, 26 aa, Entamoeba invadens
ISLLICLSCGISTFVLLAVQFLLISF

SEQ ID NO: 2794662 - protein, 25 aa, Entamoeba invadens
ISLLVLLVCMGFIIFYFVIFIILIN

SEQ ID NO: 2794663 - protein, 17 aa, Entamoeba invadens
ISLNLKGRGVMFISKNY

SEQ ID NO: 2794664 - protein, 17 aa, Entamoeba invadens
ISLPGLLFVGLVFLLFT

SEQ ID NO: 2794665 - protein, 19 aa, Entamoeba invadens
ISLVCVFYIGAVLAILCTI

SEQ ID NO: 2794666 - protein, 23 aa, Entamoeba invadens
ISLVGKGAFGKVFLVKEKSTGTL

SEQ ID NO: 2794667 - protein, 18 aa, Entamoeba invadens
ISLYMKWTVEPEDKESLE

SEQ ID NO: 2794668 - protein, 23 aa, Entamoeba invadens
ISLYVSMEIVRIFQAYFINIDGD

SEQ ID NO: 2794669 - protein, 20 aa, Entamoeba invadens
ISMYEVFGWSEPYPKHEFKF

SEQ ID NO: 2794670 - protein, 17 aa, Entamoeba invadens
ISNCKQIENGLCVECKE

SEQ ID NO: 2794671 - protein, 29 aa, Entamoeba invadens
ISNCLEYLSGLCINCKDSFVLIDHQCVQC

SEQ ID NO: 2794672 - protein, 23 aa, Entamoeba invadens
ISNEVKALCGFIQTTLNTNLGNR

SEQ ID NO: 2794673 - protein, 18 aa, Entamoeba invadens
ISNNANWVLGDSIVCAEY

SEQ ID NO: 2794674 - protein, 25 aa, Entamoeba invadens
ISNRCLKCANKFLLQGGLCVSDEIC

SEQ ID NO: 2794675 - protein, 24 aa, Entamoeba invadens
ISNRSKKKLKYRVEPPETYRFRCV

SEQ ID NO: 2794676 - protein, 18 aa, Entamoeba invadens
ISNRYAHFSWMIQFASKK

SEQ ID NO: 2794677 - protein, 23 aa, Entamoeba invadens
ISNSKCLKCTFWHSPNNNGTLCN

SEQ ID NO: 2794678 - protein, 23 aa, Entamoeba invadens
ISNSKCSKCTFWHSPNDNGTFCD

SEQ ID NO: 2794679 - protein, 23 aa, Entamoeba invadens
ISNSKCSKCTIWHSRNDNGTLCD

SEQ ID NO: 2794680 - protein, 25 aa, Entamoeba invadens
ISNTCFKCSTGFLLKDNLCVSNATC

SEQ ID NO: 2794681 - protein, 25 aa, Entamoeba invadens
ISNTCFKCSTGFLLQDNLCVSNATC

SEQ ID NO: 2794682 - protein, 22 aa, Entamoeba invadens
ISNTFPTVWEDFGILRCDKSCE

SEQ ID NO: 2794683 - protein, 17 aa, Entamoeba invadens
ISNTKCFDVFSLNNQSN

SEQ ID NO: 2794684 - protein, 17 aa, Entamoeba invadens
ISPAFLARQSVMKLEKC

SEQ ID NO: 2794685 - protein, 19 aa, Entamoeba invadens
ISPEAYRVISEMWTQKPED

SEQ ID NO: 2794686 - protein, 27 aa, Entamoeba invadens
ISPFEWCNVCIDLLPLTMIDYLTSPMT

SEQ ID NO: 2794687 - protein, 19 aa, Entamoeba invadens
ISPFMYIKTGMSISTISLI

SEQ ID NO: 2794688 - protein, 30 aa, Entamoeba invadens
ISPILSLCMLLRYFYLRFVNKLETSTSDII

SEQ ID NO: 2794689 - protein, 18 aa, Entamoeba invadens
ISPPATVVKLLHLFHIGQ

SEQ ID NO: 2794690 - protein, 21 aa, Entamoeba invadens
ISPTGLCKVVLKEASNERTTC

SEQ ID NO: 2794691 - protein, 19 aa, Entamoeba invadens
ISQCFKPSTPLILQHTVFN

SEQ ID NO: 2794692 - protein, 26 aa, Entamoeba invadens
ISQERVCKMIHPIWESKRKYTYTFPF

SEQ ID NO: 2794693 - protein, 25 aa, Entamoeba invadens
ISQKKCVCSPGYGGDDCHLVCYYNR

SEQ ID NO: 2794694 - protein, 24 aa, Entamoeba invadens
ISQKWEFWGYLVSLICFFVGINTL

SEQ ID NO: 2794695 - protein, 22 aa, Entamoeba invadens
ISRCDEYLRFVLNQKTVSVGTV

SEQ ID NO: 2794696 - protein, 24 aa, Entamoeba invadens
ISRCGSCIEITGPSLKTASCTVVG

SEQ ID NO: 2794697 - protein, 19 aa, Entamoeba invadens
ISRKCVAVGEYFRKVTRID

SEQ ID NO: 2794698 - protein, 27 aa, Entamoeba invadens
ISRLRKRFYRSILRQNIGWFDRKENMV

SEQ ID NO: 2794699 - protein, 18 aa, Entamoeba invadens
ISRNRFWGTPIPIWTDDA

SEQ ID NO: 2794700 - protein, 23 aa, Entamoeba invadens
ISRVAINMSIVFSFFVSTTVMIA

SEQ ID NO: 2794701 - protein, 22 aa, Entamoeba invadens
ISSCGFYKDGKCVECENNSFYL

SEQ ID NO: 2794702 - protein, 24 aa, Entamoeba invadens
ISSENFRYNFSFFSSTQSNVFFTI

SEQ ID NO: 2794703 - protein, 20 aa, Entamoeba invadens
ISSGCLVMMIGFMYLSSYPT

SEQ ID NO: 2794704 - protein, 18 aa, Entamoeba invadens
ISSICLDKNFYFISLNSI

SEQ ID NO: 2794705 - protein, 26 aa, Entamoeba invadens
ISSKFGCLSCEAGFFVEDRKCQNCSS

SEQ ID NO: 2794706 - protein, 22 aa, Entamoeba invadens
ISSKSFLGVWAMLKTNESTKYI

SEQ ID NO: 2794707 - protein, 17 aa, Entamoeba invadens
ISSLGARAFSSCKNLKS

SEQ ID NO: 2794708 - protein, 19 aa, Entamoeba invadens
ISSLISWIHLLFYLLGVGC

SEQ ID NO: 2794709 - protein, 17 aa, Entamoeba invadens
ISSLLKLIYIDFKTAKE

SEQ ID NO: 2794710 - protein, 24 aa, Entamoeba invadens
ISSLPFKVTMPLSKFVAEPQTCTE

SEQ ID NO: 2794711 - protein, 25 aa, Entamoeba invadens
ISSPKRFAIDLSFIGVVISVAFVLL

SEQ ID NO: 2794712 - protein, 27 aa, Entamoeba invadens
ISSQNSLCWKCANGYKLSADKIECFVN

SEQ ID NO: 2794713 - protein, 23 aa, Entamoeba invadens
ISSSPHIRYFALLSEEMNAEMEL

SEQ ID NO: 2794714 - protein, 17 aa, Entamoeba invadens
ISSSVKTDASWVSQVKF

SEQ ID NO: 2794715 - protein, 23 aa, Entamoeba invadens
ISSTFSGYVLEFFLGGLFILILV

SEQ ID NO: 2794716 - protein, 20 aa, Entamoeba invadens
ISSTIPLVFMSKNGYIVGNK

SEQ ID NO: 2794717 - protein, 20 aa, Entamoeba invadens
ISSTPSREATLLFGNTNTAY

SEQ ID NO: 2794718 - protein, 17 aa, Entamoeba invadens
ISSVIAYFVKKELIMSS

SEQ ID NO: 2794719 - protein, 19 aa, Entamoeba invadens
ISSYEEWSKLKVLSSLTTL

SEQ ID NO: 2794720 - protein, 31 aa, Entamoeba invadens
ISSYEVMRSVLILKLVVFVLIHLENVIDNIN

SEQ ID NO: 2794721 - protein, 27 aa, Entamoeba invadens
ISSYIQLRGSIPLKWSQVPNFHYKPDI

SEQ ID NO: 2794722 - protein, 25 aa, Entamoeba invadens
ISTCLDCAVYPTLFVSYLLQKATIA

SEQ ID NO: 2794723 - protein, 17 aa, Entamoeba invadens
ISTFCWGFLVRLFGEKW

SEQ ID NO: 2794724 - protein, 29 aa, Entamoeba invadens
ISTFEYLCILNFFAGRSFVDISQYYIFPW

SEQ ID NO: 2794725 - protein, 19 aa, Entamoeba invadens
ISTFGWKIVLVQPNFYLIT

SEQ ID NO: 2794726 - protein, 24 aa, Entamoeba invadens
ISTFKFPWKIAEFVSSGKRPDISD

SEQ ID NO: 2794727 - protein, 25 aa, Entamoeba invadens
ISTKQCLICDELLYNGNCYHREECI

SEQ ID NO: 2794728 - protein, 25 aa, Entamoeba invadens
ISTQCLSCPSGTYIDENTCKSNSEL

SEQ ID NO: 2794729 - protein, 18 aa, Entamoeba invadens
ISTSRCAKCGDGCDVCLQ

SEQ ID NO: 2794730 - protein, 18 aa, Entamoeba invadens
ISTTVAFNELVSFTPPFD

SEQ ID NO: 2794731 - protein, 25 aa, Entamoeba invadens
ISTYIKTCVLIKKLIDSMKSGESEE

SEQ ID NO: 2794732 - protein, 18 aa, Entamoeba invadens
ISVFGCCFGGLYYTFQSE

SEQ ID NO: 2794733 - protein, 19 aa, Entamoeba invadens
ISVFLLLFVFFTPRIGGAN

SEQ ID NO: 2794734 - protein, 47 aa, Entamoeba invadens
ISVIMSLCFIAFYLKKGRSFPCKCRKCTKQALPNWKKPMTLKRFVFL

SEQ ID NO: 2794735 - protein, 21 aa, Entamoeba invadens
ISVKSGDDWCEVNSVITWYYN

SEQ ID NO: 2794736 - protein, 18 aa, Entamoeba invadens
ISVLEQLRDTLLKVAETK

SEQ ID NO: 2794737 - protein, 18 aa, Entamoeba invadens
ISVLEVFQRKDPFPVEQF

SEQ ID NO: 2794738 - protein, 17 aa, Entamoeba invadens
ISVLGCVLLEKRELLNV

SEQ ID NO: 2794739 - protein, 20 aa, Entamoeba invadens
ISVQLRGLFMAAERSAVTPN

SEQ ID NO: 2794740 - protein, 20 aa, Entamoeba invadens
ISVVCGNILFLSNTPDDEEC

SEQ ID NO: 2794741 - protein, 22 aa, Entamoeba invadens
ISWHYEFYWQMVVACTLNIVPY

SEQ ID NO: 2794742 - protein, 20 aa, Entamoeba invadens
ISWLLFLNKYCINGILCDDM

SEQ ID NO: 2794743 - protein, 31 aa, Entamoeba invadens
ISYALSYFGSRAFPRGSLYLIDIAKDVVVKL

SEQ ID NO: 2794744 - protein, 24 aa, Entamoeba invadens
ISYEPPLIIGLVGFCAVLMALFGV

SEQ ID NO: 2794745 - protein, 26 aa, Entamoeba invadens
ISYKSDRCVLCIDDFLLVDGVCVSCK

SEQ ID NO: 2794746 - protein, 19 aa, Entamoeba invadens
ISYNEFVCNAAYYTESIFQ

SEQ ID NO: 2794747 - protein, 19 aa, Entamoeba invadens
ISYNISFDCYSQIPNYKTI

SEQ ID NO: 2794748 - protein, 17 aa, Entamoeba invadens
ISYSSSVLFSETKNALT

SEQ ID NO: 2794749 - protein, 18 aa, Entamoeba invadens
ITAIPLFYFVFASKSILY

SEQ ID NO: 2794750 - protein, 20 aa, Entamoeba invadens
ITALCLGFIYSWDVSLVILS

SEQ ID NO: 2794751 - protein, 25 aa, Entamoeba invadens
ITALKATTFVPSFSDNLIINALIVD

SEQ ID NO: 2794752 - protein, 17 aa, Entamoeba invadens
ITALLSLAFYYLKNKYG

SEQ ID NO: 2794753 - protein, 18 aa, Entamoeba invadens
ITALRNGHWILLDEINLA

SEQ ID NO: 2794754 - protein, 18 aa, Entamoeba invadens
ITAQCWISIMFLNLGTNY

SEQ ID NO: 2794755 - protein, 23 aa, Entamoeba invadens
ITASLEFVSKVSYFNVENSFVYL

SEQ ID NO: 2794756 - protein, 18 aa, Entamoeba invadens
ITAWEIFYQAEPYKEFKS

SEQ ID NO: 2794757 - protein, 17 aa, Entamoeba invadens
ITAWEIFYQDEPYNELR

SEQ ID NO: 2794758 - protein, 18 aa, Entamoeba invadens
ITAWEIFYQDEPYNELRS

SEQ ID NO: 2794759 - protein, 18 aa, Entamoeba invadens
ITAWEIFYQEEPYKDFKS

SEQ ID NO: 2794760 - protein, 25 aa, Entamoeba invadens
ITCANYFCEIMTWIFFDLMTGIPLM

SEQ ID NO: 2794761 - protein, 18 aa, Entamoeba invadens
ITCATDASRNCILCNTGY

SEQ ID NO: 2794762 - protein, 25 aa, Entamoeba invadens
ITCESGYYVSFGICVKCSVACSECI

SEQ ID NO: 2794763 - protein, 20 aa, Entamoeba invadens
ITCIEIGNSIYFGTDDGELL

SEQ ID NO: 2794764 - protein, 35 aa, Entamoeba invadens
ITCKSCNIKKCQRCVDSKCILCDKSYYSYEGNCKE

SEQ ID NO: 2794765 - protein, 39 aa, Entamoeba invadens
ITCPEDRMARVVEKFEFPMYMIAVIVVFVLVLAVIVVLL

SEQ ID NO: 2794766 - protein, 24 aa, Entamoeba invadens
ITCPPEKRMNNGICECLYTTSGMN

SEQ ID NO: 2794767 - protein, 25 aa, Entamoeba invadens
ITCSHKLVKILIEIVTDFNCLVPLF

SEQ ID NO: 2794768 - protein, 17 aa, Entamoeba invadens
ITCSLLLALVMVLIIVV

SEQ ID NO: 2794769 - protein, 19 aa, Entamoeba invadens
ITCSPDFSRKCKVCTIGYY

SEQ ID NO: 2794770 - protein, 19 aa, Entamoeba invadens
ITCSPDFSRKCKVCVIGFY

SEQ ID NO: 2794771 - protein, 30 aa, Entamoeba invadens
ITCSPNFSRKCKVCAIGFYPDETSGKCVAC

SEQ ID NO: 2794772 - protein, 18 aa, Entamoeba invadens
ITCSSDSSRRCVTCNSGF

SEQ ID NO: 2794773 - protein, 18 aa, Entamoeba invadens
ITCTTCKPGYFKNGTNCA

SEQ ID NO: 2794774 - protein, 19 aa, Entamoeba invadens
ITDDFVLKVKKGFCQEVTT

SEQ ID NO: 2794775 - protein, 40 aa, Entamoeba invadens
ITDDMRWDVLIGCLLCFVISFLLVRFAKIGFVKAVLLCVF

SEQ ID NO: 2794776 - protein, 24 aa, Entamoeba invadens
ITDKKLLVAYPMALYFILFVLLVM

SEQ ID NO: 2794777 - protein, 19 aa, Entamoeba invadens
ITDLKLTYFDTIQSTLGMI

SEQ ID NO: 2794778 - protein, 17 aa, Entamoeba invadens
ITDSIGRYSTNTIGCDC

SEQ ID NO: 2794779 - protein, 23 aa, Entamoeba invadens
ITEFSAAFGNYMINVMFCALFMM

SEQ ID NO: 2794780 - protein, 17 aa, Entamoeba invadens
ITEGCQCLDQLADCGIS

SEQ ID NO: 2794781 - protein, 21 aa, Entamoeba invadens
ITELCPVYSPFFGSMGIAAAI

SEQ ID NO: 2794782 - protein, 24 aa, Entamoeba invadens
ITERWGSSIVFYAKQWRMRIEIIS

SEQ ID NO: 2794783 - protein, 19 aa, Entamoeba invadens
ITESVLPFLADLFRDERLI

SEQ ID NO: 2794784 - protein, 17 aa, Entamoeba invadens
ITFDKTQIKECVSTYCN

SEQ ID NO: 2794785 - protein, 23 aa, Entamoeba invadens
ITFERCSFTFPNGSPLFNEVILT

SEQ ID NO: 2794786 - protein, 27 aa, Entamoeba invadens
ITFKGDELKTGLGLLCILLKTRQTHVN

SEQ ID NO: 2794787 - protein, 33 aa, Entamoeba invadens
ITFLYLFTLCFFKIRWSKIFYWAIYLVGFICLS

SEQ ID NO: 2794788 - protein, 19 aa, Entamoeba invadens
ITFMKGEVDVMRMVLMMEL

SEQ ID NO: 2794789 - protein, 23 aa, Entamoeba invadens
ITFMLHRFIRLFPMQLFGTCLLS

SEQ ID NO: 2794790 - protein, 17 aa, Entamoeba invadens
ITFNGVESVEYILTISD

SEQ ID NO: 2794791 - protein, 26 aa, Entamoeba invadens
ITFNSLHVVKPISFGPNIKVTVTSID

SEQ ID NO: 2794792 - protein, 20 aa, Entamoeba invadens
ITFTSCYNILVGNFIKNLFG

SEQ ID NO: 2794793 - protein, 17 aa, Entamoeba invadens
ITGETALLLTQEKLEDM

SEQ ID NO: 2794794 - protein, 29 aa, Entamoeba invadens
ITGFVIGFIECWDLTLVILSSLPFVVLST

SEQ ID NO: 2794795 - protein, 32 aa, Entamoeba invadens
ITGGCVICADKYYRSGFECFKCSSKCATCQDK

SEQ ID NO: 2794796 - protein, 17 aa, Entamoeba invadens
ITGIHVFCESDRCEHAT

SEQ ID NO: 2794797 - protein, 17 aa, Entamoeba invadens
ITGWGQSGSYVQGIYLD

SEQ ID NO: 2794798 - protein, 20 aa, Entamoeba invadens
ITHCISSQNSLCWECADGYK

SEQ ID NO: 2794799 - protein, 19 aa, Entamoeba invadens
ITHDMTISLIKAVSLNINT

SEQ ID NO: 2794800 - protein, 17 aa, Entamoeba invadens
ITHLEIIHTLFSCANHK

SEQ ID NO: 2794801 - protein, 17 aa, Entamoeba invadens
ITIAQVYIVYTITFIIS

SEQ ID NO: 2794802 - protein, 35 aa, Entamoeba invadens
ITIDKEIYVSLSFPFPVRISKHFKSFRTVFTTSVP

SEQ ID NO: 2794803 - protein, 26 aa, Entamoeba invadens
ITIEFVQKMFNSFVVAMSMKNEQTNK

SEQ ID NO: 2794804 - protein, 19 aa, Entamoeba invadens
ITIETTIKCEILNVYLNTR

SEQ ID NO: 2794805 - protein, 25 aa, Entamoeba invadens
ITIGCICCLFGIAIAIVIAMGCYLA

SEQ ID NO: 2794806 - protein, 24 aa, Entamoeba invadens
ITIILCLWALLVAVIASRKHKKDS

SEQ ID NO: 2794807 - protein, 21 aa, Entamoeba invadens
ITIILSYAFDGCVNLHDFVFS

SEQ ID NO: 2794808 - protein, 17 aa, Entamoeba invadens
ITIKHVVYLKADETSTI

SEQ ID NO: 2794809 - protein, 18 aa, Entamoeba invadens
ITILIIFKVIEMKREEKK

SEQ ID NO: 2794810 - protein, 17 aa, Entamoeba invadens
ITIPTSFSILSLDQTEI

SEQ ID NO: 2794811 - protein, 20 aa, Entamoeba invadens
ITIVVSFVLFFSVKISHHYQ

SEQ ID NO: 2794812 - protein, 21 aa, Entamoeba invadens
ITIYEVFGWCEAIPITTFKFP

SEQ ID NO: 2794813 - protein, 17 aa, Entamoeba invadens
ITKCWDMNPMKRPQFKE

SEQ ID NO: 2794814 - protein, 26 aa, Entamoeba invadens
ITKDCFYKPYVESVALPSLFMLVVII

SEQ ID NO: 2794815 - protein, 19 aa, Entamoeba invadens
ITKIPFKFINKTVGDVLLM

SEQ ID NO: 2794816 - protein, 18 aa, Entamoeba invadens
ITKKVRIFILLYFKMEFV

SEQ ID NO: 2794817 - protein, 29 aa, Entamoeba invadens
ITKNSKFLFDWRVSFVVGSLTFHAFLFMG

SEQ ID NO: 2794818 - protein, 33 aa, Entamoeba invadens
ITKPEGVIFIKGCTNCNRILYTSSSSSPTYSIT

SEQ ID NO: 2794819 - protein, 24 aa, Entamoeba invadens
ITKSKCSKCSFWYKPSKDGTSCES

SEQ ID NO: 2794820 - protein, 23 aa, Entamoeba invadens
ITKYKPKLVCFGHTHNCFGVVKD

SEQ ID NO: 2794821 - protein, 18 aa, Entamoeba invadens
ITLARLVFLSLSSLNTNK

SEQ ID NO: 2794822 - protein, 20 aa, Entamoeba invadens
ITLDSILRCYQIYTKVLSLR

SEQ ID NO: 2794823 - protein, 17 aa, Entamoeba invadens
ITLGLHPKFSFYDYQTY

SEQ ID NO: 2794824 - protein, 29 aa, Entamoeba invadens
ITLGPIMVCTGIFIRMLIFGASKWIIAES

SEQ ID NO: 2794825 - protein, 18 aa, Entamoeba invadens
ITLGWNMFGVVYEVFFSS

SEQ ID NO: 2794826 - protein, 20 aa, Entamoeba invadens
ITLKELLAYGMYAIAAGATI

SEQ ID NO: 2794827 - protein, 22 aa, Entamoeba invadens
ITLKGRTTLKENLVINSDSDTT

SEQ ID NO: 2794828 - protein, 23 aa, Entamoeba invadens
ITLKRKYVPWALILLNVLMGSQL

SEQ ID NO: 2794829 - protein, 17 aa, Entamoeba invadens
ITLKYFFIQTRFRDSRI

SEQ ID NO: 2794830 - protein, 17 aa, Entamoeba invadens
ITLLCTAMVKDDVGIIA

SEQ ID NO: 2794831 - protein, 25 aa, Entamoeba invadens
ITLLKGGESLGWFYGANYLAHRVFF

SEQ ID NO: 2794832 - protein, 17 aa, Entamoeba invadens
ITLPTTIALGIFILPTS

SEQ ID NO: 2794833 - protein, 17 aa, Entamoeba invadens
ITLVEWWFLPFAGVIVF

SEQ ID NO: 2794834 - protein, 19 aa, Entamoeba invadens
ITMANCIKVLEERISETVP

SEQ ID NO: 2794835 - protein, 29 aa, Entamoeba invadens
ITMAVNFDVPCMLGMRLEALENIGVRGVV

SEQ ID NO: 2794836 - protein, 18 aa, Entamoeba invadens
ITMELKLITGMELSNTSS

SEQ ID NO: 2794837 - protein, 23 aa, Entamoeba invadens
ITMFECISWSYAYSKDKFKFPWS

SEQ ID NO: 2794838 - protein, 24 aa, Entamoeba invadens
ITMFECISWSYAYSYDKFKFPWSI

SEQ ID NO: 2794839 - protein, 25 aa, Entamoeba invadens
ITMFECISWSYAYSYDKFKFPWSIA

SEQ ID NO: 2794840 - protein, 28 aa, Entamoeba invadens
ITMFEVFGWCMAYPFTIFKFPWKIAEFV

SEQ ID NO: 2794841 - protein, 17 aa, Entamoeba invadens
ITMGMSFVVTGIIGGAA

SEQ ID NO: 2794842 - protein, 30 aa, Entamoeba invadens
ITMKLKSAEDFPLVLGNAVSLKEETNPTLV

SEQ ID NO: 2794843 - protein, 17 aa, Entamoeba invadens
ITMKYLLLYLLIVVIIF

SEQ ID NO: 2794844 - protein, 20 aa, Entamoeba invadens
ITMLECFLWSNAYPKSIYMY

SEQ ID NO: 2794845 - protein, 19 aa, Entamoeba invadens
ITMLECFLWSNAYPKSVYM

SEQ ID NO: 2794846 - protein, 28 aa, Entamoeba invadens
ITMLECMKWGDAYVGEMFTFAWQVPDFI

SEQ ID NO: 2794847 - protein, 28 aa, Entamoeba invadens
ITMPYKLKIKILIDCARGMQFLHENKIV

SEQ ID NO: 2794848 - protein, 23 aa, Entamoeba invadens
ITMYDIFNWGGLYPVAEFPYPWS

SEQ ID NO: 2794849 - protein, 38 aa, Entamoeba invadens
ITMYECFQWTEAYPKTFFNYPWKIAEFVTAGKRLEKPE

SEQ ID NO: 2794850 - protein, 20 aa, Entamoeba invadens
ITMYECFVWGEAYPKSTFKF

SEQ ID NO: 2794851 - protein, 20 aa, Entamoeba invadens
ITMYEIFGWCEAYPNDTFKF

SEQ ID NO: 2794852 - protein, 21 aa, Entamoeba invadens
ITMYETFSWFEAYRKDQFKFP

SEQ ID NO: 2794853 - protein, 17 aa, Entamoeba invadens
ITMYEVFGWCDVYPKEI

SEQ ID NO: 2794854 - protein, 24 aa, Entamoeba invadens
ITMYEVFGWSNAYPKETFKFPWKI

SEQ ID NO: 2794855 - protein, 29 aa, Entamoeba invadens
ITNCKEVGHSKCTKCSFWHTPSANGTFCN

SEQ ID NO: 2794856 - protein, 37 aa, Entamoeba invadens
ITNCKEVGHSKCTKCSFWYRPNEYGIRCNSHVVWWVI

SEQ ID NO: 2794857 - protein, 34 aa, Entamoeba invadens
ITNCVSFGPNRCKRCSSGFVLKGATCVKGENCLL

SEQ ID NO: 2794858 - protein, 24 aa, Entamoeba invadens
ITNEGNCVVCSYPFVNNNGTCVSR

SEQ ID NO: 2794859 - protein, 17 aa, Entamoeba invadens
ITNGCECWNQLADCAVP

SEQ ID NO: 2794860 - protein, 29 aa, Entamoeba invadens
ITNIFTALCEWEMFGFGLVVNAIQPLEKY

SEQ ID NO: 2794861 - protein, 17 aa, Entamoeba invadens
ITNNSFWGFTAINQNSS

SEQ ID NO: 2794862 - protein, 17 aa, Entamoeba invadens
ITNQTSCRICMLCGAPL

SEQ ID NO: 2794863 - protein, 22 aa, Entamoeba invadens
ITNSKCLACNNSLILNNTKCLT

SEQ ID NO: 2794864 - protein, 20 aa, Entamoeba invadens
ITNSKCSKCAFWYITSKDGT

SEQ ID NO: 2794865 - protein, 22 aa, Entamoeba invadens
ITNSKCSKCSFWHVPESSGTSC

SEQ ID NO: 2794866 - protein, 26 aa, Entamoeba invadens
ITNSKCSKCSFWYTPSEDGASCESQA

SEQ ID NO: 2794867 - protein, 19 aa, Entamoeba invadens
ITNSKCSKCVFWYITSKDG

SEQ ID NO: 2794868 - protein, 17 aa, Entamoeba invadens
ITPFLGAIESFRIYNVI

SEQ ID NO: 2794869 - protein, 17 aa, Entamoeba invadens
ITPKCTFTLEEPTLIMI

SEQ ID NO: 2794870 - protein, 38 aa, Entamoeba invadens
ITPSLLLMFPKFFRIKGMIPCSKFCVRYSDKVGSKFWH

SEQ ID NO: 2794871 - protein, 27 aa, Entamoeba invadens
ITPTYCLSCPPGFYISNNICKTNSELV

SEQ ID NO: 2794872 - protein, 24 aa, Entamoeba invadens
ITQCGGTELKVCKATTTAFECPEL

SEQ ID NO: 2794873 - protein, 21 aa, Entamoeba invadens
ITQCTVCRRQGKEGVNHLIKA

SEQ ID NO: 2794874 - protein, 17 aa, Entamoeba invadens
ITQFILNKVCTLSLSLF

SEQ ID NO: 2794875 - protein, 17 aa, Entamoeba invadens
ITQFLSIETPDIISVSP

SEQ ID NO: 2794876 - protein, 28 aa, Entamoeba invadens
ITQKFLSCEIGNFYAIENIKCGSTTITS

SEQ ID NO: 2794877 - protein, 17 aa, Entamoeba invadens
ITQKGAVQFESENKSTK

SEQ ID NO: 2794878 - protein, 18 aa, Entamoeba invadens
ITQKGAVQFESENKSTKT

SEQ ID NO: 2794879 - protein, 21 aa, Entamoeba invadens
ITRSDIYYDIGNFYLRAIEVK

SEQ ID NO: 2794880 - protein, 24 aa, Entamoeba invadens
ITRSEGTATFVVRGMENVRGEIEV

SEQ ID NO: 2794881 - protein, 17 aa, Entamoeba invadens
ITSCKRGFYILDGKCIG

SEQ ID NO: 2794882 - protein, 20 aa, Entamoeba invadens
ITSCQGCPLNTFSNTTGLDK

SEQ ID NO: 2794883 - protein, 20 aa, Entamoeba invadens
ITSGAFEIFALLAIALAFLF

SEQ ID NO: 2794884 - protein, 26 aa, Entamoeba invadens
ITSIPSVVVYSMFYPTIKFTLDELSY

SEQ ID NO: 2794885 - protein, 19 aa, Entamoeba invadens
ITSIYSFKKIQEMRDMVIQ

SEQ ID NO: 2794886 - protein, 24 aa, Entamoeba invadens
ITSNLSFFIGMAIFLAAISYIPEP

SEQ ID NO: 2794887 - protein, 17 aa, Entamoeba invadens
ITSRCWDVDPAKRPEFK

SEQ ID NO: 2794888 - protein, 18 aa, Entamoeba invadens
ITSVDCFEFAASENAFQS

SEQ ID NO: 2794889 - protein, 18 aa, Entamoeba invadens
ITSWEIFYQQEPFKQLKT

SEQ ID NO: 2794890 - protein, 17 aa, Entamoeba invadens
ITSYCTLHCTTRLRGLK

SEQ ID NO: 2794891 - protein, 18 aa, Entamoeba invadens
ITTCEKCQSGYIITSSGK

SEQ ID NO: 2794892 - protein, 22 aa, Entamoeba invadens
ITTCHSCSSGSILDNGICSTCE

SEQ ID NO: 2794893 - protein, 25 aa, Entamoeba invadens
ITTCTVCLAAYILQTNGTCLMSSNP

SEQ ID NO: 2794894 - protein, 24 aa, Entamoeba invadens
ITTFKFPWKIAEFVTAGKRLERRE

SEQ ID NO: 2794895 - protein, 21 aa, Entamoeba invadens
ITTFNAICHQSILQLHSNIKE

SEQ ID NO: 2794896 - protein, 30 aa, Entamoeba invadens
ITTHPKMPWSTRLNIAVSIAKGMTLLIGQK

SEQ ID NO: 2794897 - protein, 17 aa, Entamoeba invadens
ITTIMALANNTFPNAKK

SEQ ID NO: 2794898 - protein, 19 aa, Entamoeba invadens
ITTLECFLWGEAFPKSTYI

SEQ ID NO: 2794899 - protein, 25 aa, Entamoeba invadens
ITTLKATSFGPVFTDSLTIGALNVA

SEQ ID NO: 2794900 - protein, 26 aa, Entamoeba invadens
ITTSFPSIRLKAEHLNYVFIRSFTED

SEQ ID NO: 2794901 - protein, 19 aa, Entamoeba invadens
ITTSQTWEKIIFYIDNVTL

SEQ ID NO: 2794902 - protein, 17 aa, Entamoeba invadens
ITVETVISTRLDYEDLE

SEQ ID NO: 2794903 - protein, 22 aa, Entamoeba invadens
ITVFKGFLVMAMRGLTDNDCKD

SEQ ID NO: 2794904 - protein, 30 aa, Entamoeba invadens
ITVIPALMFLWRMVIRPLLFKPTTKVYKGT

SEQ ID NO: 2794905 - protein, 23 aa, Entamoeba invadens
ITVKELMLRGKVVISSDQIINND

SEQ ID NO: 2794906 - protein, 18 aa, Entamoeba invadens
ITVLSIFIALIFIVVVVL

SEQ ID NO: 2794907 - protein, 24 aa, Entamoeba invadens
ITVVAAFLLLIAYFYTRPSFTQNE

SEQ ID NO: 2794908 - protein, 24 aa, Entamoeba invadens
ITWFVCGFFFPPLFLYTSNRYKNS

SEQ ID NO: 2794909 - protein, 18 aa, Entamoeba invadens
ITYFLGTLFFSWDKLYLN

SEQ ID NO: 2794910 - protein, 25 aa, Entamoeba invadens
ITYFRPRQEICITSYMTLHCTTKIM

SEQ ID NO: 2794911 - protein, 18 aa, Entamoeba invadens
IVALSAWPNAAFDLCGMC

SEQ ID NO: 2794912 - protein, 24 aa, Entamoeba invadens
IVCDWKGNYSVKWCMNNCVDPLKS

SEQ ID NO: 2794913 - protein, 22 aa, Entamoeba invadens
IVCKDGYFKTGMNCFECAEKCS

SEQ ID NO: 2794914 - protein, 18 aa, Entamoeba invadens
IVCNLCINNYILDNGKCV

SEQ ID NO: 2794915 - protein, 18 aa, Entamoeba invadens
IVDECPRQSGGVDYICSD

SEQ ID NO: 2794916 - protein, 18 aa, Entamoeba invadens
IVDKCWVHNPIKRLDIKE

SEQ ID NO: 2794917 - protein, 18 aa, Entamoeba invadens
IVDLPVFFTNYFQMTTNV

SEQ ID NO: 2794918 - protein, 19 aa, Entamoeba invadens
IVDVKLLLIKNIEKASGTD

SEQ ID NO: 2794919 - protein, 23 aa, Entamoeba invadens
IVDYCTGGALALLGLGLSAMLVN

SEQ ID NO: 2794920 - protein, 25 aa, Entamoeba invadens
IVEEEFKLFVGFGETVVCGQTETFK

SEQ ID NO: 2794921 - protein, 18 aa, Entamoeba invadens
IVEELAFTNPQEVFASFP

SEQ ID NO: 2794922 - protein, 24 aa, Entamoeba invadens
IVESCLKIKNEICVECEESYFLNM

SEQ ID NO: 2794923 - protein, 26 aa, Entamoeba invadens
IVESLSFYICECGKNSARALKAVSEM

SEQ ID NO: 2794924 - protein, 18 aa, Entamoeba invadens
IVFCSVMGIAVFVFFLNQ

SEQ ID NO: 2794925 - protein, 41 aa, Entamoeba invadens
IVFEALRKPISWRTQLGFWIGRIMFFIAFFIVILVTLLYNE

SEQ ID NO: 2794926 - protein, 17 aa, Entamoeba invadens
IVFGHIFYWFEDVFPMY

SEQ ID NO: 2794927 - protein, 23 aa, Entamoeba invadens
IVFGSVFSLVAIVFFVYTWRREK

SEQ ID NO: 2794928 - protein, 17 aa, Entamoeba invadens
IVFILMIFRHSAFSDSA

SEQ ID NO: 2794929 - protein, 22 aa, Entamoeba invadens
IVFNCFVAIGVFGVVSYLLVAT

SEQ ID NO: 2794930 - protein, 26 aa, Entamoeba invadens
IVFPCRRMVTVFCWVVLNATTAFYIQ

SEQ ID NO: 2794931 - protein, 24 aa, Entamoeba invadens
IVFPEVIPQIYFIGNITVYNADIN

SEQ ID NO: 2794932 - protein, 17 aa, Entamoeba invadens
IVFPNFVRGDVKMSQDI

SEQ ID NO: 2794933 - protein, 27 aa, Entamoeba invadens
IVFVILLLVVLCMAFYYFKMKQNTQTI

SEQ ID NO: 2794934 - protein, 17 aa, Entamoeba invadens
IVFYVWQVFPRVLAKYV

SEQ ID NO: 2794935 - protein, 31 aa, Entamoeba invadens
IVGIVVGCVVAFSIFIACLIAFLVYTYNFGR

SEQ ID NO: 2794936 - protein, 22 aa, Entamoeba invadens
IVGKIPSLVFVNGSWTQSHIER

SEQ ID NO: 2794937 - protein, 25 aa, Entamoeba invadens
IVGLVIGCVCAFLIAVVIIGIIIFL

SEQ ID NO: 2794938 - protein, 26 aa, Entamoeba invadens
IVGMFVPLVMCIGCCMIKNPQTRPLI

SEQ ID NO: 2794939 - protein, 21 aa, Entamoeba invadens
IVGNVFIDFELKLCTSFFDNG

SEQ ID NO: 2794940 - protein, 24 aa, Entamoeba invadens
IVHFYGACFLPNYLCLVTELAEFG

SEQ ID NO: 2794941 - protein, 22 aa, Entamoeba invadens
IVHGGLPPVHFKLEQINDLERG

SEQ ID NO: 2794942 - protein, 23 aa, Entamoeba invadens
IVHKISCGVTLRYPTCANPYGLV

SEQ ID NO: 2794943 - protein, 25 aa, Entamoeba invadens
IVIALYRYFVKEVFALSTPVIIFTI

SEQ ID NO: 2794944 - protein, 19 aa, Entamoeba invadens
IVIFGCIFLLIIFTIPMSF

SEQ ID NO: 2794945 - protein, 18 aa, Entamoeba invadens
IVIGCVIFSVYLWIQAIQ

SEQ ID NO: 2794946 - protein, 20 aa, Entamoeba invadens
IVIGSLCLVWGTGMSVDTWQ

SEQ ID NO: 2794947 - protein, 25 aa, Entamoeba invadens
IVIHVVIRWCVIFTVGIVSCALTFL

SEQ ID NO: 2794948 - protein, 21 aa, Entamoeba invadens
IVIIWWKRKKSLAAESTAIKP

SEQ ID NO: 2794949 - protein, 18 aa, Entamoeba invadens
IVILISFIVIIIIITKSV

SEQ ID NO: 2794950 - protein, 17 aa, Entamoeba invadens
IVIPVFLIFVVVLYIVI

SEQ ID NO: 2794951 - protein, 18 aa, Entamoeba invadens
IVIVSVFLAIGFIGLVLN

SEQ ID NO: 2794952 - protein, 25 aa, Entamoeba invadens
IVIWSDFLLNHLIFYFVLFTIIYVK

SEQ ID NO: 2794953 - protein, 20 aa, Entamoeba invadens
IVIYCVLRIVLIVLACVFAK

SEQ ID NO: 2794954 - protein, 23 aa, Entamoeba invadens
IVKGGTCVCVLCKKSGRSGIKRS

SEQ ID NO: 2794955 - protein, 24 aa, Entamoeba invadens
IVKRVYWTKMEYFDREVKTKFKMS

SEQ ID NO: 2794956 - protein, 18 aa, Entamoeba invadens
IVKYGAKYPYGIKQSYEA

SEQ ID NO: 2794957 - protein, 17 aa, Entamoeba invadens
IVLELAPLGSLRTFIEK

SEQ ID NO: 2794958 - protein, 18 aa, Entamoeba invadens
IVLFFIIKFLNLVLKCTK

SEQ ID NO: 2794959 - protein, 25 aa, Entamoeba invadens
IVLFYKEACQFGFNLPRMNDQQLFV

SEQ ID NO: 2794960 - protein, 22 aa, Entamoeba invadens
IVLGFQVMSWRQEVFTDVFEVR

SEQ ID NO: 2794961 - protein, 32 aa, Entamoeba invadens
IVLHSLFYVFYKRIVVAPSIFIALSMLSVSTA

SEQ ID NO: 2794962 - protein, 17 aa, Entamoeba invadens
IVLITCFYIITFVAYIG

SEQ ID NO: 2794963 - protein, 25 aa, Entamoeba invadens
IVLKMKRLLDLSGLFDESKMVNGDP

SEQ ID NO: 2794964 - protein, 22 aa, Entamoeba invadens
IVLLVCGCYIPYVNDILEQYPL

SEQ ID NO: 2794965 - protein, 18 aa, Entamoeba invadens
IVLNELIQKCWVQKQKER

SEQ ID NO: 2794966 - protein, 17 aa, Entamoeba invadens
IVLPFLNKVESICMEMV

SEQ ID NO: 2794967 - protein, 17 aa, Entamoeba invadens
IVLPTVFGCLFVLVVFS

SEQ ID NO: 2794968 - protein, 23 aa, Entamoeba invadens
IVLTKLRFLFDVLTEAEFIKENR

SEQ ID NO: 2794969 - protein, 28 aa, Entamoeba invadens
IVMCLAEERLVYKNGIFSNGYQLKASTG

SEQ ID NO: 2794970 - protein, 17 aa, Entamoeba invadens
IVMKNCCDQLFEQTKIN

SEQ ID NO: 2794971 - protein, 23 aa, Entamoeba invadens
IVMKVPTYDGGFIVFDDFRDSYR

SEQ ID NO: 2794972 - protein, 23 aa, Entamoeba invadens
IVMLIKFIFSFLLLSGYNGTIFF

SEQ ID NO: 2794973 - protein, 24 aa, Entamoeba invadens
IVMNIAYHFDRWNIVNMLAVGYWA

SEQ ID NO: 2794974 - protein, 33 aa, Entamoeba invadens
IVMRYSEEWKKVVWRTGRWIDMDHAYKTMDISF

SEQ ID NO: 2794975 - protein, 17 aa, Entamoeba invadens
IVNCTTDGAATCSGLDN

SEQ ID NO: 2794976 - protein, 19 aa, Entamoeba invadens
IVNDLVFFFTFGKVKISLF

SEQ ID NO: 2794977 - protein, 21 aa, Entamoeba invadens
IVPADCIPLFSSNEEGIVYVE

SEQ ID NO: 2794978 - protein, 27 aa, Entamoeba invadens
IVPALCIGINFGMWYFKMIPSDPLFFF

SEQ ID NO: 2794979 - protein, 25 aa, Entamoeba invadens
IVPDFTFRGCTSLAVLKGSENIISF

SEQ ID NO: 2794980 - protein, 25 aa, Entamoeba invadens
IVPEMKELIRNAGVARIIEIDPIIA

SEQ ID NO: 2794981 - protein, 18 aa, Entamoeba invadens
IVPFAALATTFAFIGIQA

SEQ ID NO: 2794982 - protein, 17 aa, Entamoeba invadens
IVPFAFVCLVVAFVVDY

SEQ ID NO: 2794983 - protein, 24 aa, Entamoeba invadens
IVPHMKMIFWWILTNFGSNKEVLS

SEQ ID NO: 2794984 - protein, 19 aa, Entamoeba invadens
IVPSAHFGLFVGILNIAVL

SEQ ID NO: 2794985 - protein, 23 aa, Entamoeba invadens
IVQKWRVDGSAFKLRTRQKSTTS

SEQ ID NO: 2794986 - protein, 27 aa, Entamoeba invadens
IVQLFKSPVMMAVVLVIIGIVFAMTRM

SEQ ID NO: 2794987 - protein, 17 aa, Entamoeba invadens
IVRSLKIPWIGETTNVY

SEQ ID NO: 2794988 - protein, 24 aa, Entamoeba invadens
IVSCIKGYYVFDSKCLGCSSSLAN

SEQ ID NO: 2794989 - protein, 24 aa, Entamoeba invadens
IVSCVSICMATRFGAFEKVQYNVL

SEQ ID NO: 2794990 - protein, 27 aa, Entamoeba invadens
IVSCYPEYFLLDNACVLCSSKYSNCKL

SEQ ID NO: 2794991 - protein, 37 aa, Entamoeba invadens
IVSECIQPSLPVSDLFKLRVFYQAFVVFKIVGDKSKA

SEQ ID NO: 2794992 - protein, 22 aa, Entamoeba invadens
IVSEYDFDIAFSKNESPIIFTA

SEQ ID NO: 2794993 - protein, 24 aa, Entamoeba invadens
IVSFEVFGPPIVVLMLAIVFSIFS

SEQ ID NO: 2794994 - protein, 25 aa, Entamoeba invadens
IVSHCLICSTLGCMECANGYSTTSS

SEQ ID NO: 2794995 - protein, 24 aa, Entamoeba invadens
IVSHLRPVIILLLHKILQCEKTQQ

SEQ ID NO: 2794996 - protein, 22 aa, Entamoeba invadens
IVSITICKASIYLIVLVLVIVI

SEQ ID NO: 2794997 - protein, 19 aa, Entamoeba invadens
IVSIVWLFCVVQWTACAGL

SEQ ID NO: 2794998 - protein, 21 aa, Entamoeba invadens
IVSLGALCKCSNCETVQQNEK

SEQ ID NO: 2794999 - protein, 17 aa, Entamoeba invadens
IVSSGICVCPSFKYQNS

SEQ ID NO: 2795000 - protein, 22 aa, Entamoeba invadens
IVSSLVSIFVPVVFGSMYFVIC

SEQ ID NO: 2795001 - protein, 17 aa, Entamoeba invadens
IVSVSFGSLFPIAYWSE

SEQ ID NO: 2795002 - protein, 17 aa, Entamoeba invadens
IVSYDWRHESPKLMSYG

SEQ ID NO: 2795003 - protein, 22 aa, Entamoeba invadens
IVTELLPRYGAFLEKHYLSVLN

SEQ ID NO: 2795004 - protein, 19 aa, Entamoeba invadens
IVTIFKFETRIQLILLIQL

SEQ ID NO: 2795005 - protein, 25 aa, Entamoeba invadens
IVTIPPKFACEFSLFLNPLCTSTID

SEQ ID NO: 2795006 - protein, 26 aa, Entamoeba invadens
IVTIPPKFACEFSLFLNPLCTSTIDS

SEQ ID NO: 2795007 - protein, 29 aa, Entamoeba invadens
IVTIPPKFACEFSLFLSPLCTSTIDSTFV

SEQ ID NO: 2795008 - protein, 30 aa, Entamoeba invadens
IVTIPPKFACEFSLFLSPLCTSTIDSTFVV

SEQ ID NO: 2795009 - protein, 18 aa, Entamoeba invadens
IVTLKYGFACEFEIFLTP

SEQ ID NO: 2795010 - protein, 19 aa, Entamoeba invadens
IVVATSFLYNLFCKSSQID

SEQ ID NO: 2795011 - protein, 19 aa, Entamoeba invadens
IVVFSCVFSLESYVEEPGL

SEQ ID NO: 2795012 - protein, 20 aa, Entamoeba invadens
IVVGCVAFFIILVVVFIIVF

SEQ ID NO: 2795013 - protein, 25 aa, Entamoeba invadens
IVVGLPISFCLFKNVIFDPFSTGSF

SEQ ID NO: 2795014 - protein, 23 aa, Entamoeba invadens
IVVSSVFAFFVFVIIFGVLLFFS

SEQ ID NO: 2795015 - protein, 19 aa, Entamoeba invadens
IVVVLSFIPFICIFTYKTS

SEQ ID NO: 2795016 - protein, 23 aa, Entamoeba invadens
IVWIFWRRRVRKINEENDAIKPF

SEQ ID NO: 2795017 - protein, 22 aa, Entamoeba invadens
IVYCIGYFICYFIQTKRKSIGD

SEQ ID NO: 2795018 - protein, 18 aa, Entamoeba invadens
IVYINIMYALIIYTFSQN

SEQ ID NO: 2795019 - protein, 17 aa, Entamoeba invadens
IVYSDKHGFDWSVVKDI

SEQ ID NO: 2795020 - protein, 30 aa, Entamoeba invadens
IVYVFPAYFVFKLTTGWRKILALITGILGI

SEQ ID NO: 2795021 - protein, 18 aa, Entamoeba invadens
IVYYLAFIFIIIGRILYY

SEQ ID NO: 2795022 - protein, 20 aa, Entamoeba invadens
IWGIHPILLFPPCDFKSEEC

SEQ ID NO: 2795023 - protein, 17 aa, Entamoeba invadens
IWHMVVWFANFQHSLAV

SEQ ID NO: 2795024 - protein, 25 aa, Entamoeba invadens
IWIFPGITLGLPFPYIVYDKQNRII

SEQ ID NO: 2795025 - protein, 26 aa, Entamoeba invadens
IWITFLYIVIVCIFRVKCSNIFNRID

SEQ ID NO: 2795026 - protein, 17 aa, Entamoeba invadens
IWIVYAISQKHDEINER

SEQ ID NO: 2795027 - protein, 27 aa, Entamoeba invadens
IWLYITWPWMCCCMVSLNASDPGRISS

SEQ ID NO: 2795028 - protein, 18 aa, Entamoeba invadens
IWNFCFGDGLHLSHFNQP

SEQ ID NO: 2795029 - protein, 21 aa, Entamoeba invadens
IWPLLEKKLYITGEALDGKES

SEQ ID NO: 2795030 - protein, 20 aa, Entamoeba invadens
IWQRIFKVVRFAFISGVIIF

SEQ ID NO: 2795031 - protein, 26 aa, Entamoeba invadens
IWRSEKWRDITFFMCEDVILRRFPYM

SEQ ID NO: 2795032 - protein, 18 aa, Entamoeba invadens
IWRTFRTKRCGSMSLTAN

SEQ ID NO: 2795033 - protein, 23 aa, Entamoeba invadens
IWRYPNFMYDFSIGDVEVVAVFL

SEQ ID NO: 2795034 - protein, 30 aa, Entamoeba invadens
IWTMMICVACGQAPPFSAIMILWANLVVDI

SEQ ID NO: 2795035 - protein, 17 aa, Entamoeba invadens
IWTVYFLYDHIYIGFWL

SEQ ID NO: 2795036 - protein, 24 aa, Entamoeba invadens
IYAFFLKYIHIVLMIFVDVVFCLL

SEQ ID NO: 2795037 - protein, 18 aa, Entamoeba invadens
IYAFGVVMYETFIEKAGY

SEQ ID NO: 2795038 - protein, 17 aa, Entamoeba invadens
IYATKPVRCELPDFMNT

SEQ ID NO: 2795039 - protein, 27 aa, Entamoeba invadens
IYCFDCKKKFCKKCFKQSHKDIYHSIR

SEQ ID NO: 2795040 - protein, 17 aa, Entamoeba invadens
IYDFLCPYYFPERVQTF

SEQ ID NO: 2795041 - protein, 18 aa, Entamoeba invadens
IYDILRDVLKIDILENKI

SEQ ID NO: 2795042 - protein, 17 aa, Entamoeba invadens
IYDIPLIITNEIYSFDC

SEQ ID NO: 2795043 - protein, 22 aa, Entamoeba invadens
IYDRKSLELARTIDERSEKPQK

SEQ ID NO: 2795044 - protein, 18 aa, Entamoeba invadens
IYEVVGWCKAYPTETFKF

SEQ ID NO: 2795045 - protein, 25 aa, Entamoeba invadens
IYFALKRKFGKKEVEGEHKEENQQS

SEQ ID NO: 2795046 - protein, 19 aa, Entamoeba invadens
IYFEGKWATPFDVLPDKMK

SEQ ID NO: 2795047 - protein, 19 aa, Entamoeba invadens
IYFESVCRVTSLSLTSKIL

SEQ ID NO: 2795048 - protein, 17 aa, Entamoeba invadens
IYFETTPTFGYTTNYLT

SEQ ID NO: 2795049 - protein, 18 aa, Entamoeba invadens
IYFLFTWGMTTLFFLFSL

SEQ ID NO: 2795050 - protein, 23 aa, Entamoeba invadens
IYGALFPTFSYFLVESIVTLVKI

SEQ ID NO: 2795051 - protein, 18 aa, Entamoeba invadens
IYGQLALTMALIVGLKRN

SEQ ID NO: 2795052 - protein, 18 aa, Entamoeba invadens
IYGSACLTGCLKPDTCEM

SEQ ID NO: 2795053 - protein, 18 aa, Entamoeba invadens
IYHKIVRNKSFRYFFGEF

SEQ ID NO: 2795054 - protein, 20 aa, Entamoeba invadens
IYHNRFVAGFTIPRPQPLNT

SEQ ID NO: 2795055 - protein, 19 aa, Entamoeba invadens
IYHSYNCKTKVVVTDITDT

SEQ ID NO: 2795056 - protein, 19 aa, Entamoeba invadens
IYHVLLIQCLIKYKEIIAF

SEQ ID NO: 2795057 - protein, 35 aa, Entamoeba invadens
IYIGEFGITKYCFWDRQGEKYVEDFLDICEKHNLN

SEQ ID NO: 2795058 - protein, 20 aa, Entamoeba invadens
IYIGFWLKYRFQMANFIQKH

SEQ ID NO: 2795059 - protein, 18 aa, Entamoeba invadens
IYIGKWVFVPLIVFVVFL

SEQ ID NO: 2795060 - protein, 20 aa, Entamoeba invadens
IYIKNFRYYFVPTPPTSQAE

SEQ ID NO: 2795061 - protein, 19 aa, Entamoeba invadens
IYILGGAKLNFSEATVRLE

SEQ ID NO: 2795062 - protein, 21 aa, Entamoeba invadens
IYISLMLFLWGGSQMLKTSFL

SEQ ID NO: 2795063 - protein, 17 aa, Entamoeba invadens
IYKAIFLGYEKVNTYNT

SEQ ID NO: 2795064 - protein, 23 aa, Entamoeba invadens
IYKDGGCTLCGNGRLDPNEECDL

SEQ ID NO: 2795065 - protein, 24 aa, Entamoeba invadens
IYKKHPNCCQILLMQRAPKYISKG

SEQ ID NO: 2795066 - protein, 17 aa, Entamoeba invadens
IYLDYPIYLIELSVVNE

SEQ ID NO: 2795067 - protein, 17 aa, Entamoeba invadens
IYLIFKGGYTKQWRAWR

SEQ ID NO: 2795068 - protein, 26 aa, Entamoeba invadens
IYLVCIIPAAVIGIFIASKVEMVQMP

SEQ ID NO: 2795069 - protein, 25 aa, Entamoeba invadens
IYMAPEVLLGFKYKTPADVYSFGVS

SEQ ID NO: 2795070 - protein, 25 aa, Entamoeba invadens
IYMIEEIDFFKGWHQTNLVTLDVYD

SEQ ID NO: 2795071 - protein, 26 aa, Entamoeba invadens
IYNDKCLYTDESICFKCITGNSYNKC

SEQ ID NO: 2795072 - protein, 23 aa, Entamoeba invadens
IYNHIPFFIVIAPLLVFILSLFI

SEQ ID NO: 2795073 - protein, 26 aa, Entamoeba invadens
IYNLPNPLLRIAEMCIKLPLHMNKLL

SEQ ID NO: 2795074 - protein, 23 aa, Entamoeba invadens
IYNRSGCPCNGRYCVTTITAEYT

SEQ ID NO: 2795075 - protein, 26 aa, Entamoeba invadens
IYPKEEFKFAWSIADFITSGKRIVKP

SEQ ID NO: 2795076 - protein, 17 aa, Entamoeba invadens
IYQFVLQGHRLKIPREC

SEQ ID NO: 2795077 - protein, 17 aa, Entamoeba invadens
IYQLWDWIMQNQKSAKF

SEQ ID NO: 2795078 - protein, 18 aa, Entamoeba invadens
IYQQFAFSSARKRMSTLV

SEQ ID NO: 2795079 - protein, 22 aa, Entamoeba invadens
IYRALYIANWVFRYATEDSYWS

SEQ ID NO: 2795080 - protein, 24 aa, Entamoeba invadens
IYRIPRLSECFVYLNDDFIFTNYT

SEQ ID NO: 2795081 - protein, 17 aa, Entamoeba invadens
IYRIVMFTILITVVFVQ

SEQ ID NO: 2795082 - protein, 33 aa, Entamoeba invadens
IYSFAITMAETFRWGNVFPLELYPKAWDIADEI

SEQ ID NO: 2795083 - protein, 35 aa, Entamoeba invadens
IYSFAITMFECFGWKEAYPIDTFKYPWKIAEFVIS

SEQ ID NO: 2795084 - protein, 24 aa, Entamoeba invadens
IYSFAITMFEVFGWCEAYPKEMFK

SEQ ID NO: 2795085 - protein, 34 aa, Entamoeba invadens
IYSFGITLFECFGWREAYPVAMFPYAWNIAEFVS

SEQ ID NO: 2795086 - protein, 25 aa, Entamoeba invadens
IYSFGVTMFEVFGWEEPYDKMEFKF

SEQ ID NO: 2795087 - protein, 25 aa, Entamoeba invadens
IYSFGVTMFEVFGWEEPYNKLEFKF

SEQ ID NO: 2795088 - protein, 17 aa, Entamoeba invadens
IYSFGVTMYETFGWENP

SEQ ID NO: 2795089 - protein, 17 aa, Entamoeba invadens
IYSLLNVENDWSNCLNF

SEQ ID NO: 2795090 - protein, 24 aa, Entamoeba invadens
IYSSDCNTRIPGTYSGRTIANITG

SEQ ID NO: 2795091 - protein, 20 aa, Entamoeba invadens
IYSTLTFFGVFAEFIIGFTI

SEQ ID NO: 2795092 - protein, 20 aa, Entamoeba invadens
IYTIPLWFIIVMVLLSIFIL

SEQ ID NO: 2795093 - protein, 27 aa, Entamoeba invadens
IYTKQAFKFPWNVAEFVVAGKRVSRPE

SEQ ID NO: 2795094 - protein, 26 aa, Entamoeba invadens
IYTKRFSILVVLSFVASIILYIIIYT

SEQ ID NO: 2795095 - protein, 25 aa, Entamoeba invadens
IYVAIALVCSWCFTVSTPSPVTLAW

SEQ ID NO: 2795096 - protein, 19 aa, Entamoeba invadens
IYVGILFLLGITIIQILTS

SEQ ID NO: 2795097 - protein, 18 aa, Entamoeba invadens
IYVIFYGHPKEIWISHSI

SEQ ID NO: 2795098 - protein, 19 aa, Entamoeba invadens
IYVISRWALVPLVTTANLL

SEQ ID NO: 2795099 - protein, 25 aa, Entamoeba invadens
IYVKLFECIEMLKLNMKTLSRTKRD

SEQ ID NO: 2795100 - protein, 25 aa, Entamoeba invadens
IYVKWCYSCLNGYYIKEDGLVKICE

SEQ ID NO: 2795101 - protein, 28 aa, Entamoeba invadens
IYVLSCARCCFGPCCVAKHGCICPKDEK

SEQ ID NO: 2795102 - protein, 22 aa, Entamoeba invadens
IYVMDLVSSFVIFSIISCTYRQ

SEQ ID NO: 2795103 - protein, 23 aa, Entamoeba invadens
IYWVFSGLQIKSGYLVLSSKRIL

SEQ ID NO: 2795104 - protein, 30 aa, Entamoeba invadens
IYYANNVCQRWLGVRVELVGCLSLGAIVTV

SEQ ID NO: 2795105 - protein, 18 aa, Entamoeba invadens
IYYKALRLNVLDIEDTGR

SEQ ID NO: 2795106 - protein, 17 aa, Entamoeba invadens
IYYLLPFTFDIDENKTL

SEQ ID NO: 2795107 - protein, 19 aa, Entamoeba invadens
IYYLLPIVLSRPVRQPILG

SEQ ID NO: 2795108 - protein, 17 aa, Entamoeba invadens
KAACPQLVSKCAIQQQG

SEQ ID NO: 2795109 - protein, 23 aa, Entamoeba invadens
KAAFKDCKALFGIPMTNTITTLG

SEQ ID NO: 2795110 - protein, 31 aa, Entamoeba invadens
KAAKRKPFLFKNMRVALSMRSIKLDFFSEVV

SEQ ID NO: 2795111 - protein, 23 aa, Entamoeba invadens
KAAPQKWDFDFGLKGEKPKVDEE

SEQ ID NO: 2795112 - protein, 24 aa, Entamoeba invadens
KACDLCSYGRFPSRSYFYSCAKCN

SEQ ID NO: 2795113 - protein, 39 aa, Entamoeba invadens
KACGMEMQLFLLRWVRLLFCQIFPPQVIKMMWDVIFAFS

SEQ ID NO: 2795114 - protein, 20 aa, Entamoeba invadens
KACIMSDILDQSREKEDTKC

SEQ ID NO: 2795115 - protein, 31 aa, Entamoeba invadens
KACQTPVFDLRWVPELERFKRSQQLNMSTDI

SEQ ID NO: 2795116 - protein, 19 aa, Entamoeba invadens
KADRILVRYKNHLVFNGSL

SEQ ID NO: 2795117 - protein, 24 aa, Entamoeba invadens
KADSELFVDCGYCKLVGDTATYVE

SEQ ID NO: 2795118 - protein, 24 aa, Entamoeba invadens
KADSLSVTFLIMWIAGDITNLLGC

SEQ ID NO: 2795119 - protein, 19 aa, Entamoeba invadens
KADTLIALAGLQGKLDKKY

SEQ ID NO: 2795120 - protein, 17 aa, Entamoeba invadens
KAECLTCKSGYKQESLV

SEQ ID NO: 2795121 - protein, 23 aa, Entamoeba invadens
KAECTKCKSGFGFFNGSCVQCNL

SEQ ID NO: 2795122 - protein, 17 aa, Entamoeba invadens
KAEKFLYIRGSLTGLGI

SEQ ID NO: 2795123 - protein, 21 aa, Entamoeba invadens
KAENVRPNLLIKLLKNDEITI

SEQ ID NO: 2795124 - protein, 19 aa, Entamoeba invadens
KAERALEALQNFDVTHVNV

SEQ ID NO: 2795125 - protein, 24 aa, Entamoeba invadens
KAFDPEKYRSWEIAEFISDGQRPS

SEQ ID NO: 2795126 - protein, 18 aa, Entamoeba invadens
KAFESFSIRKCVETSNVI

SEQ ID NO: 2795127 - protein, 20 aa, Entamoeba invadens
KAFFEMSGQFLTYRVRKVSF

SEQ ID NO: 2795128 - protein, 24 aa, Entamoeba invadens
KAFITRLIELFVIYCCGVTSPVEF

SEQ ID NO: 2795129 - protein, 19 aa, Entamoeba invadens
KAFKGRTVFTSVVLEQITS

SEQ ID NO: 2795130 - protein, 25 aa, Entamoeba invadens
KAGETRVRRDLCGKEELIDRPDQGY

SEQ ID NO: 2795131 - protein, 25 aa, Entamoeba invadens
KAGHKGGFVLKNSWNDTAYGDRPMG

SEQ ID NO: 2795132 - protein, 21 aa, Entamoeba invadens
KAIDTEGTFRLNVYTLTPPIH

SEQ ID NO: 2795133 - protein, 17 aa, Entamoeba invadens
KAIQEFEKEVAMLDKFR

SEQ ID NO: 2795134 - protein, 21 aa, Entamoeba invadens
KAKCTKCIYPFAIKNGKCDWC

SEQ ID NO: 2795135 - protein, 22 aa, Entamoeba invadens
KAKCTKCIYPFAIKNGKCDWCG

SEQ ID NO: 2795136 - protein, 23 aa, Entamoeba invadens
KAKCTKCKTGFGFFNGSCVQCNL

SEQ ID NO: 2795137 - protein, 19 aa, Entamoeba invadens
KAKIAIKLQNGFYISTLLL

SEQ ID NO: 2795138 - protein, 24 aa, Entamoeba invadens
KAKKFSTSLSFIIRSRLSPKLDLG

SEQ ID NO: 2795139 - protein, 23 aa, Entamoeba invadens
KAKKISYEYLYTCMNTKKHDNKD

SEQ ID NO: 2795140 - protein, 20 aa, Entamoeba invadens
KAKLTERFVKITVLKTPLGV

SEQ ID NO: 2795141 - protein, 24 aa, Entamoeba invadens
KALALEMYKKALLTDDVKVPIQNR

SEQ ID NO: 2795142 - protein, 21 aa, Entamoeba invadens
KALALRLAKQGVHLSIAARTD

SEQ ID NO: 2795143 - protein, 24 aa, Entamoeba invadens
KALARSLLELGLKKGDVVGFFSKR

SEQ ID NO: 2795144 - protein, 17 aa, Entamoeba invadens
KALEIDNDFSLPTFPFT

SEQ ID NO: 2795145 - protein, 17 aa, Entamoeba invadens
KALFVQAQFEQSTPRQM

SEQ ID NO: 2795146 - protein, 27 aa, Entamoeba invadens
KALIIVLCLISFLLLIGCGVAAILVFG

SEQ ID NO: 2795147 - protein, 18 aa, Entamoeba invadens
KALPTQVIGLYFTPIESQ

SEQ ID NO: 2795148 - protein, 25 aa, Entamoeba invadens
KALSVFWNFPRACYTGFVFNFANYF

SEQ ID NO: 2795149 - protein, 22 aa, Entamoeba invadens
KAMKSEVTIAVGEINRLKTEHQ

SEQ ID NO: 2795150 - protein, 20 aa, Entamoeba invadens
KANCTACIYPYVLNDTKCGL

SEQ ID NO: 2795151 - protein, 20 aa, Entamoeba invadens
KANIPRLCVTGSPNKILSPR

SEQ ID NO: 2795152 - protein, 32 aa, Entamoeba invadens
KANLKKIVLHQCNFCDLEFPKTVEIVEVEQCA

SEQ ID NO: 2795153 - protein, 23 aa, Entamoeba invadens
KANPFIVSLVLKIYFTSLPQPFF

SEQ ID NO: 2795154 - protein, 22 aa, Entamoeba invadens
KANYEAFQFLLFIGSLSIPSKK

SEQ ID NO: 2795155 - protein, 24 aa, Entamoeba invadens
KAPSARFTYALTLMPFASLNRNPL

SEQ ID NO: 2795156 - protein, 20 aa, Entamoeba invadens
KAPVSFIICYCVSALCDAID

SEQ ID NO: 2795157 - protein, 20 aa, Entamoeba invadens
KAPVSWKYIFMTIAKSIITC

SEQ ID NO: 2795158 - protein, 19 aa, Entamoeba invadens
KARCELEKDSGCPNSILPK

SEQ ID NO: 2795159 - protein, 25 aa, Entamoeba invadens
KARMTWYGLEACEMLVNLFDKNRNY

SEQ ID NO: 2795160 - protein, 17 aa, Entamoeba invadens
KARTHFSFVKWSENQKV

SEQ ID NO: 2795161 - protein, 25 aa, Entamoeba invadens
KASDSKCSKCTFWHSPSADGSYCVT

SEQ ID NO: 2795162 - protein, 23 aa, Entamoeba invadens
KASSKFLCIGLIVVAIVMVIIVL

SEQ ID NO: 2795163 - protein, 36 aa, Entamoeba invadens
KASTDLKRTMWWKNMKLWLIIGGVIALILVIIIIII

SEQ ID NO: 2795164 - protein, 19 aa, Entamoeba invadens
KATILWDIRMGKMVTKSDV

SEQ ID NO: 2795165 - protein, 18 aa, Entamoeba invadens
KAVSEMKEFVLSTMDSTG

SEQ ID NO: 2795166 - protein, 17 aa, Entamoeba invadens
KAVTKFGNMAFKGVTVV

SEQ ID NO: 2795167 - protein, 25 aa, Entamoeba invadens
KAVTTFLFYWYNFMPLSRGTAVTGF

SEQ ID NO: 2795168 - protein, 26 aa, Entamoeba invadens
KAVWWIILIIVTFCLLMIVLVTTTFV

SEQ ID NO: 2795169 - protein, 17 aa, Entamoeba invadens
KAVWWMIVVIVVVCILL

SEQ ID NO: 2795170 - protein, 19 aa, Entamoeba invadens
KAVWWVILIIIVFTIAIIV

SEQ ID NO: 2795171 - protein, 17 aa, Entamoeba invadens
KAVWWVILLIIVIVISI

SEQ ID NO: 2795172 - protein, 20 aa, Entamoeba invadens
KAVWWVLLIVVVFAIIVMAV

SEQ ID NO: 2795173 - protein, 31 aa, Entamoeba invadens
KAYLSFRYRVPFKEVFFFSTLKIVSSSSSQY

SEQ ID NO: 2795174 - protein, 28 aa, Entamoeba invadens
KAYPTSQFKFPWNIAEFIIQGNRLTQPD

SEQ ID NO: 2795175 - protein, 26 aa, Entamoeba invadens
KCAKSVRATFPFVLLLTGGTFMYMSK

SEQ ID NO: 2795176 - protein, 18 aa, Entamoeba invadens
KCANSYVFDGKYKCHADV

SEQ ID NO: 2795177 - protein, 19 aa, Entamoeba invadens
KCASGHCKPNLKCDQCVSH

SEQ ID NO: 2795178 - protein, 18 aa, Entamoeba invadens
KCDAQCYTCTKPGRCDGC

SEQ ID NO: 2795179 - protein, 17 aa, Entamoeba invadens
KCDFTTPSMMRISTYIK

SEQ ID NO: 2795180 - protein, 27 aa, Entamoeba invadens
KCDISNCKKCDAIGCVECLTNYTQSAD

SEQ ID NO: 2795181 - protein, 18 aa, Entamoeba invadens
KCDKCKENYFISDDKCVD

SEQ ID NO: 2795182 - protein, 17 aa, Entamoeba invadens
KCDKCYYNKVSDNKCGP

SEQ ID NO: 2795183 - protein, 19 aa, Entamoeba invadens
KCDKDCLSCSKISTRCLSC

SEQ ID NO: 2795184 - protein, 19 aa, Entamoeba invadens
KCDKETCHICSTGYTPTTT

SEQ ID NO: 2795185 - protein, 18 aa, Entamoeba invadens
KCDKSFYFNLNRQECIKC

SEQ ID NO: 2795186 - protein, 27 aa, Entamoeba invadens
KCDLCIQASKCLVCNATNFKAEDGECL

SEQ ID NO: 2795187 - protein, 27 aa, Entamoeba invadens
KCDSKSGNCTLCFVGNYLFEGKCLSCK

SEQ ID NO: 2795188 - protein, 17 aa, Entamoeba invadens
KCDTSCYECYSLKSEGI

SEQ ID NO: 2795189 - protein, 20 aa, Entamoeba invadens
KCEIDYFVLNGICINKDKQI

SEQ ID NO: 2795190 - protein, 18 aa, Entamoeba invadens
KCEKCIPGYFSNGGTVSC

SEQ ID NO: 2795191 - protein, 22 aa, Entamoeba invadens
KCEKCKPGFWIEKFECVTCETC

SEQ ID NO: 2795192 - protein, 21 aa, Entamoeba invadens
KCEKCNPGFWIENFECVTCET

SEQ ID NO: 2795193 - protein, 18 aa, Entamoeba invadens
KCEKCPTGTFSVKKSNEC

SEQ ID NO: 2795194 - protein, 17 aa, Entamoeba invadens
KCEMCSIPKCIKCSTNS

SEQ ID NO: 2795195 - protein, 21 aa, Entamoeba invadens
KCERCGIVGCSRCNSTGSDCL

SEQ ID NO: 2795196 - protein, 17 aa, Entamoeba invadens
KCERFLADRFVEGVCPY

SEQ ID NO: 2795197 - protein, 18 aa, Entamoeba invadens
KCESCKPNYVLKDSHCVF

SEQ ID NO: 2795198 - protein, 24 aa, Entamoeba invadens
KCESCPDINCNLCDETKSSKCVMC

SEQ ID NO: 2795199 - protein, 19 aa, Entamoeba invadens
KCEVCPAGKYSSFASSTCK

SEQ ID NO: 2795200 - protein, 24 aa, Entamoeba invadens
KCEWSNGINCLKCYEGELNTNCDT

SEQ ID NO: 2795201 - protein, 21 aa, Entamoeba invadens
KCEYKENYCRDYTCSDFMCMT

SEQ ID NO: 2795202 - protein, 19 aa, Entamoeba invadens
KCFEGCALLTSVTGNEAVT

SEQ ID NO: 2795203 - protein, 19 aa, Entamoeba invadens
KCFKEAYDHIIVFDPIKIF

SEQ ID NO: 2795204 - protein, 19 aa, Entamoeba invadens
KCFQSCLSLSSITFSQNLV

SEQ ID NO: 2795205 - protein, 28 aa, Entamoeba invadens
KCFSCSPNYMRSCIKCAAGYYPHQNGTC

SEQ ID NO: 2795206 - protein, 29 aa, Entamoeba invadens
KCFSCSPNYMRSCVKCAAGYYPHQNGTCV

SEQ ID NO: 2795207 - protein, 17 aa, Entamoeba invadens
KCGHMFHRECLQQWFSR

SEQ ID NO: 2795208 - protein, 21 aa, Entamoeba invadens
KCGIADLSVFFTFTDSVQTIL

SEQ ID NO: 2795209 - protein, 23 aa, Entamoeba invadens
KCGLCDLTCGGKCDSTDGHCTGC

SEQ ID NO: 2795210 - protein, 17 aa, Entamoeba invadens
KCGLLNYSNYKEVYCDV

SEQ ID NO: 2795211 - protein, 17 aa, Entamoeba invadens
KCGLLNYSNYNEVYCDI

SEQ ID NO: 2795212 - protein, 33 aa, Entamoeba invadens
KCGNLKFTLKIFAFFLGLVIENVFVFARTKETG

SEQ ID NO: 2795213 - protein, 19 aa, Entamoeba invadens
KCHDCGGRDVWVCLTCLYV

SEQ ID NO: 2795214 - protein, 23 aa, Entamoeba invadens
KCHGFSNFYILNFLTQIGNTMTI

SEQ ID NO: 2795215 - protein, 19 aa, Entamoeba invadens
KCIDGYYKSGLRCIQCKQN

SEQ ID NO: 2795216 - protein, 17 aa, Entamoeba invadens
KCIDGYYLSVKNECVSC

SEQ ID NO: 2795217 - protein, 21 aa, Entamoeba invadens
KCIECSDINCLRCSKSECLKC

SEQ ID NO: 2795218 - protein, 29 aa, Entamoeba invadens
KCIEVSSFKCAKCSFGYTPSDTGLECKKH

SEQ ID NO: 2795219 - protein, 17 aa, Entamoeba invadens
KCIKCIIEGCATCEKVN

SEQ ID NO: 2795220 - protein, 30 aa, Entamoeba invadens
KCIKTYTSGCARCAFGFYYNLMTQRCEKCD

SEQ ID NO: 2795221 - protein, 17 aa, Entamoeba invadens
KCILCSTYCLRCIDDQC

SEQ ID NO: 2795222 - protein, 26 aa, Entamoeba invadens
KCINEAKCLSCEEGLVLVNFNCVAYN

SEQ ID NO: 2795223 - protein, 22 aa, Entamoeba invadens
KCIQCPIGQKLFNNVCTIIMDV

SEQ ID NO: 2795224 - protein, 17 aa, Entamoeba invadens
KCISCSLSNSICVSCSS

SEQ ID NO: 2795225 - protein, 17 aa, Entamoeba invadens
KCISRGISSLQILQQIS

SEQ ID NO: 2795226 - protein, 21 aa, Entamoeba invadens
KCITCAENGVRSCVSCKDTYK

SEQ ID NO: 2795227 - protein, 19 aa, Entamoeba invadens
KCITCKTNFFLLENSTQCL

SEQ ID NO: 2795228 - protein, 19 aa, Entamoeba invadens
KCIYQRNFINQKECIQCED

SEQ ID NO: 2795229 - protein, 18 aa, Entamoeba invadens
KCKAGFSQKNNLCYPPLN

SEQ ID NO: 2795230 - protein, 30 aa, Entamoeba invadens
KCKCIKGYGGSNCHKLCYYDNTWQISPNDN

SEQ ID NO: 2795231 - protein, 23 aa, Entamoeba invadens
KCKDEKCKTCGADLECTECKDNH

SEQ ID NO: 2795232 - protein, 17 aa, Entamoeba invadens
KCKDPLRNPLTNCTSCI

SEQ ID NO: 2795233 - protein, 19 aa, Entamoeba invadens
KCKICKSNEILNAEETCMT

SEQ ID NO: 2795234 - protein, 18 aa, Entamoeba invadens
KCKICKSNEILNTEETCS

SEQ ID NO: 2795235 - protein, 18 aa, Entamoeba invadens
KCKKCKPGMYPDEQSGAC

SEQ ID NO: 2795236 - protein, 18 aa, Entamoeba invadens
KCKKGYYPVNGKCVSNTN

SEQ ID NO: 2795237 - protein, 20 aa, Entamoeba invadens
KCKMGTFKNNVFSCIFQNDC

SEQ ID NO: 2795238 - protein, 18 aa, Entamoeba invadens
KCKQCSKLYGVNYQGQCE

SEQ ID NO: 2795239 - protein, 17 aa, Entamoeba invadens
KCKTCATDFTRKCIECN

SEQ ID NO: 2795240 - protein, 18 aa, Entamoeba invadens
KCKTCATDFTRKCIECNT

SEQ ID NO: 2795241 - protein, 17 aa, Entamoeba invadens
KCKTLWVGQGYGKNSNV

SEQ ID NO: 2795242 - protein, 23 aa, Entamoeba invadens
KCLANSHPTCTICQYNEYVEGSA

SEQ ID NO: 2795243 - protein, 24 aa, Entamoeba invadens
KCLDCFPKSFFKFCEVSKAVVCAR

SEQ ID NO: 2795244 - protein, 23 aa, Entamoeba invadens
KCLDRYGFVNGVCEYCGIDCLEC

SEQ ID NO: 2795245 - protein, 18 aa, Entamoeba invadens
KCLECYNNLILNNAECHT

SEQ ID NO: 2795246 - protein, 19 aa, Entamoeba invadens
KCLKCFPTYVLSPTRESCD

SEQ ID NO: 2795247 - protein, 20 aa, Entamoeba invadens
KCLKCPVGCEECESKMCTSC

SEQ ID NO: 2795248 - protein, 19 aa, Entamoeba invadens
KCLLFPNTYSYCFNNNFNF

SEQ ID NO: 2795249 - protein, 18 aa, Entamoeba invadens
KCLNCKENYFLKDDGSCV

SEQ ID NO: 2795250 - protein, 17 aa, Entamoeba invadens
KCLPKQVLVIPLVILQA

SEQ ID NO: 2795251 - protein, 17 aa, Entamoeba invadens
KCLSCISGYVLQPTGEC

SEQ ID NO: 2795252 - protein, 18 aa, Entamoeba invadens
KCLSCISGYVLQPTGECV

SEQ ID NO: 2795253 - protein, 22 aa, Entamoeba invadens
KCLSCKEGYYLSKYEQDLDNKT

SEQ ID NO: 2795254 - protein, 19 aa, Entamoeba invadens
KCLSCSGALISVGNMCINC

SEQ ID NO: 2795255 - protein, 18 aa, Entamoeba invadens
KCLTCYAGYGLDNNGKCE

SEQ ID NO: 2795256 - protein, 25 aa, Entamoeba invadens
KCLTNCASGMRFLHSSHIMHRDLKP

SEQ ID NO: 2795257 - protein, 20 aa, Entamoeba invadens
KCLVDIFSTFEPLRVNIDKE

SEQ ID NO: 2795258 - protein, 17 aa, Entamoeba invadens
KCMKCKDGFSNQPYCTQ

SEQ ID NO: 2795259 - protein, 17 aa, Entamoeba invadens
KCNLSCSLCNTNSTYGY

SEQ ID NO: 2795260 - protein, 19 aa, Entamoeba invadens
KCNPILRRNYMYKTQTTGN

SEQ ID NO: 2795261 - protein, 18 aa, Entamoeba invadens
KCNPLLRRSYMYKTQTKE

SEQ ID NO: 2795262 - protein, 18 aa, Entamoeba invadens
KCNSCASNFVFSTSNKTC

SEQ ID NO: 2795263 - protein, 20 aa, Entamoeba invadens
KCPSINRLLTNLKEATCYEL

SEQ ID NO: 2795264 - protein, 25 aa, Entamoeba invadens
KCPTEKMLARDAYFGTFIRQRIDWL

SEQ ID NO: 2795265 - protein, 19 aa, Entamoeba invadens
KCQECNSGFILSNNSCVKN

SEQ ID NO: 2795266 - protein, 22 aa, Entamoeba invadens
KCQICIEGKCQKCEEKLLVDTV

SEQ ID NO: 2795267 - protein, 30 aa, Entamoeba invadens
KCQNTDLSIRWKIKKHISLKQDEAIMFFTS

SEQ ID NO: 2795268 - protein, 23 aa, Entamoeba invadens
KCQPDLLMTFGVFSDFIQPPVDS

SEQ ID NO: 2795269 - protein, 21 aa, Entamoeba invadens
KCQPENCIVKALVILENGSNT

SEQ ID NO: 2795270 - protein, 29 aa, Entamoeba invadens
KCRCKKGYGGSNCHKLCYYDNNWQISPND

SEQ ID NO: 2795271 - protein, 17 aa, Entamoeba invadens
KCRCNADTKNLCECDPN

SEQ ID NO: 2795272 - protein, 18 aa, Entamoeba invadens
KCRCNADTKNLCECDQNP

SEQ ID NO: 2795273 - protein, 17 aa, Entamoeba invadens
KCRCNADTNNLCECDQN

SEQ ID NO: 2795274 - protein, 20 aa, Entamoeba invadens
KCRVFVELIGMFSSLGSQIV

SEQ ID NO: 2795275 - protein, 18 aa, Entamoeba invadens
KCSACNTIAGCGKCKSAN

SEQ ID NO: 2795276 - protein, 19 aa, Entamoeba invadens
KCSACNTIAGCGKCKSATE

SEQ ID NO: 2795277 - protein, 23 aa, Entamoeba invadens
KCSDGYYKSGLRCIQCKQNCSLC

SEQ ID NO: 2795278 - protein, 18 aa, Entamoeba invadens
KCSDGYYLSGTECLPCDK

SEQ ID NO: 2795279 - protein, 22 aa, Entamoeba invadens
KCSEGYIRKGGYCYAQTTVDGC

SEQ ID NO: 2795280 - protein, 22 aa, Entamoeba invadens
KCSEHFLLNHLWEYNKNATRKF

SEQ ID NO: 2795281 - protein, 25 aa, Entamoeba invadens
KCSFKTEMFPLFNFEVKEVVKVNDF

SEQ ID NO: 2795282 - protein, 17 aa, Entamoeba invadens
KCSFWHDISEGKESCET

SEQ ID NO: 2795283 - protein, 18 aa, Entamoeba invadens
KCSFWKKPNESGTFCQNS

SEQ ID NO: 2795284 - protein, 25 aa, Entamoeba invadens
KCSLCSESECYVCGDNSTLSNKVCV

SEQ ID NO: 2795285 - protein, 20 aa, Entamoeba invadens
KCSLYCVSYTTGISDTINSA

SEQ ID NO: 2795286 - protein, 19 aa, Entamoeba invadens
KCSPHYQWSLSNNQVELPY

SEQ ID NO: 2795287 - protein, 17 aa, Entamoeba invadens
KCSQSAKVCVACKDDFV

SEQ ID NO: 2795288 - protein, 18 aa, Entamoeba invadens
KCSQSGRCNLCVQNYILK

SEQ ID NO: 2795289 - protein, 19 aa, Entamoeba invadens
KCSRSAKVCVACKEDFVTD

SEQ ID NO: 2795290 - protein, 26 aa, Entamoeba invadens
KCSTCLNGVNCLSCNSTNYKTIKGDC

SEQ ID NO: 2795291 - protein, 23 aa, Entamoeba invadens
KCSTMKSIYCVGCVTNHHIEDYT

SEQ ID NO: 2795292 - protein, 28 aa, Entamoeba invadens
KCSVCSIPNCKCCEGGKCKKCNEKYVIQ

SEQ ID NO: 2795293 - protein, 33 aa, Entamoeba invadens
KCSVCSVPNCNNCEGGKCKKCNKNYVIQTNGFC

SEQ ID NO: 2795294 - protein, 18 aa, Entamoeba invadens
KCTACKDGYFLSNNACVT

SEQ ID NO: 2795295 - protein, 18 aa, Entamoeba invadens
KCTCRINDVISIFINDIK

SEQ ID NO: 2795296 - protein, 17 aa, Entamoeba invadens
KCTDCSVGDSIVLGLGD

SEQ ID NO: 2795297 - protein, 17 aa, Entamoeba invadens
KCTDLLICTKCLDNYIK

SEQ ID NO: 2795298 - protein, 23 aa, Entamoeba invadens
KCTECAVGCQMCRDATSCTNCND

SEQ ID NO: 2795299 - protein, 31 aa, Entamoeba invadens
KCTECTDGFFPRNGRCISCNEIGCQTTSEYC

SEQ ID NO: 2795300 - protein, 17 aa, Entamoeba invadens
KCTFWYIINPYTFNCDQ

SEQ ID NO: 2795301 - protein, 20 aa, Entamoeba invadens
KCTIPIPSFMELYKEQIVQP

SEQ ID NO: 2795302 - protein, 20 aa, Entamoeba invadens
KCTKCSFWYSVSLDTPRCEK

SEQ ID NO: 2795303 - protein, 22 aa, Entamoeba invadens
KCTKISISMCSYANSYACMQCI

SEQ ID NO: 2795304 - protein, 20 aa, Entamoeba invadens
KCTKVGGVEQCTKCRDSFVL

SEQ ID NO: 2795305 - protein, 22 aa, Entamoeba invadens
KCTNCKAGYGFNKTEGSCTTCT

SEQ ID NO: 2795306 - protein, 20 aa, Entamoeba invadens
KCTSCISSLVLFGNGSCVGL

SEQ ID NO: 2795307 - protein, 17 aa, Entamoeba invadens
KCTSCLNDFILNESSEC

SEQ ID NO: 2795308 - protein, 19 aa, Entamoeba invadens
KCTSCPKKALLLEDTGKCV

SEQ ID NO: 2795309 - protein, 20 aa, Entamoeba invadens
KCTSCSFWNAPTSDGKSCEK

SEQ ID NO: 2795310 - protein, 20 aa, Entamoeba invadens
KCTSIPKCVVYICHKCNEID

SEQ ID NO: 2795311 - protein, 24 aa, Entamoeba invadens
KCTSLYSIMGMMYLTTIEDFAFMD

SEQ ID NO: 2795312 - protein, 18 aa, Entamoeba invadens
KCTTDVCTVCNTKSSIVG

SEQ ID NO: 2795313 - protein, 26 aa, Entamoeba invadens
KCVACNMCSPSHCFSTGCSLCNKTNY

SEQ ID NO: 2795314 - protein, 18 aa, Entamoeba invadens
KCVACVSGAVSLNGVCSL

SEQ ID NO: 2795315 - protein, 18 aa, Entamoeba invadens
KCVCPKGTYLKDDNCEKC

SEQ ID NO: 2795316 - protein, 20 aa, Entamoeba invadens
KCVECADGYFMNDDFTCSKC

SEQ ID NO: 2795317 - protein, 20 aa, Entamoeba invadens
KCVECADWNLVESGVCKGVD

SEQ ID NO: 2795318 - protein, 20 aa, Entamoeba invadens
KCVECAKGYIITDDNTCVNE

SEQ ID NO: 2795319 - protein, 19 aa, Entamoeba invadens
KCVECEFGVNLVYDTNQCG

SEQ ID NO: 2795320 - protein, 17 aa, Entamoeba invadens
KCVECFNNYMIDDNGNC

SEQ ID NO: 2795321 - protein, 17 aa, Entamoeba invadens
KCVECLDAFKLKSGICA

SEQ ID NO: 2795322 - protein, 17 aa, Entamoeba invadens
KCVECLDAFQLKNSVCS

SEQ ID NO: 2795323 - protein, 24 aa, Entamoeba invadens
KCVERCAKCSEPTRCTSCDDTYVL

SEQ ID NO: 2795324 - protein, 26 aa, Entamoeba invadens
KCVERCAKCSEQYRCTSCDDTFVLKS

SEQ ID NO: 2795325 - protein, 21 aa, Entamoeba invadens
KCVFVKCKPGFNIIDNGNCAD

SEQ ID NO: 2795326 - protein, 18 aa, Entamoeba invadens
KCVHYSKIPNCIEATDSK

SEQ ID NO: 2795327 - protein, 29 aa, Entamoeba invadens
KCVICSVPNCKYCEGGKCKKCQENYVIQT

SEQ ID NO: 2795328 - protein, 18 aa, Entamoeba invadens
KCVKCADEYVLDKIDDKC

SEQ ID NO: 2795329 - protein, 26 aa, Entamoeba invadens
KCVKCSETFLNCDICDSKGCQQCSSN

SEQ ID NO: 2795330 - protein, 19 aa, Entamoeba invadens
KCVKCSTGQYYNEESSTCE

SEQ ID NO: 2795331 - protein, 27 aa, Entamoeba invadens
KCVKDGCVLCDFGYLLVQQNGVSICDA

SEQ ID NO: 2795332 - protein, 24 aa, Entamoeba invadens
KCVKGNCPDMYFKDGAEKMCKRCT

SEQ ID NO: 2795333 - protein, 28 aa, Entamoeba invadens
KCVKSDDWWTLKFCNITKLEVPEYVDEH

SEQ ID NO: 2795334 - protein, 20 aa, Entamoeba invadens
KCVLCDKSVNCTKCEFNKCV

SEQ ID NO: 2795335 - protein, 17 aa, Entamoeba invadens
KCVLCKNKFVLNANYEC

SEQ ID NO: 2795336 - protein, 17 aa, Entamoeba invadens
KCVNECKTLGYYKKDDS

SEQ ID NO: 2795337 - protein, 17 aa, Entamoeba invadens
KCVNGYYRNGLSCDKCD

SEQ ID NO: 2795338 - protein, 19 aa, Entamoeba invadens
KCVRYTQRRARFEGLGDKA

SEQ ID NO: 2795339 - protein, 25 aa, Entamoeba invadens
KCVSCKAKYFLTDDFKCSRCGDFCA

SEQ ID NO: 2795340 - protein, 19 aa, Entamoeba invadens
KCVTCPIDFSRKCIACQSN

SEQ ID NO: 2795341 - protein, 29 aa, Entamoeba invadens
KCVTCSVPNCKNCEGGKCKKCDENYVIQT

SEQ ID NO: 2795342 - protein, 30 aa, Entamoeba invadens
KCVTCSVPNCKYCEGGKCKKCTENYVIQTN

SEQ ID NO: 2795343 - protein, 22 aa, Entamoeba invadens
KCVYGSGSICYQYINGTYLSQS

SEQ ID NO: 2795344 - protein, 19 aa, Entamoeba invadens
KCWKCCLNNTWADSKTRNE

SEQ ID NO: 2795345 - protein, 40 aa, Entamoeba invadens
KCYDLLAQRYARYFIYPSGYLAIYSRSLSKFFAEWKNYYC

SEQ ID NO: 2795346 - protein, 19 aa, Entamoeba invadens
KCYKQRFETCGTMNQITGC

SEQ ID NO: 2795347 - protein, 20 aa, Entamoeba invadens
KCYMVQILTALQFLHSISVL

SEQ ID NO: 2795348 - protein, 22 aa, Entamoeba invadens
KCYPECEEGWEYVETESVYECK

SEQ ID NO: 2795349 - protein, 19 aa, Entamoeba invadens
KDACLTCNLTNYKTTSGKC

SEQ ID NO: 2795350 - protein, 19 aa, Entamoeba invadens
KDAFKGCTNLVSINLFGNL

SEQ ID NO: 2795351 - protein, 34 aa, Entamoeba invadens
KDAKFLVKMTDHFLYSGHLCIVQELLGPNLYQVI

SEQ ID NO: 2795352 - protein, 21 aa, Entamoeba invadens
KDAKMNGMFQYFLTLIPKKNN

SEQ ID NO: 2795353 - protein, 25 aa, Entamoeba invadens
KDALFDFLKGCFVYEPQNRYTPKQA

SEQ ID NO: 2795354 - protein, 23 aa, Entamoeba invadens
KDCELQVTWILLIVFSILITLLG

SEQ ID NO: 2795355 - protein, 17 aa, Entamoeba invadens
KDCITFNKMMLKFKDDK

SEQ ID NO: 2795356 - protein, 22 aa, Entamoeba invadens
KDCPEAYFAKDKVCTACVDDCK

SEQ ID NO: 2795357 - protein, 18 aa, Entamoeba invadens
KDCTVDGCVKCIIKINGS

SEQ ID NO: 2795358 - protein, 32 aa, Entamoeba invadens
KDCTYCSKSKCFQCKNSLVLYEWTDETNNNAF

SEQ ID NO: 2795359 - protein, 19 aa, Entamoeba invadens
KDDKCIKCDSTISYCNDCY

SEQ ID NO: 2795360 - protein, 25 aa, Entamoeba invadens
KDDTGCLQCEPGFYLHNSRCNKCEM

SEQ ID NO: 2795361 - protein, 25 aa, Entamoeba invadens
KDDVWKKEFVLGFLHTSDLIEWSAL

SEQ ID NO: 2795362 - protein, 23 aa, Entamoeba invadens
KDECKPCTYPCLSCYGTQTNCLS

SEQ ID NO: 2795363 - protein, 24 aa, Entamoeba invadens
KDEDEMKKHLGFFALEESVFSPGP

SEQ ID NO: 2795364 - protein, 33 aa, Entamoeba invadens
KDEFSCYKKTLPVREIIGMIVVFGGLTIVTIVI

SEQ ID NO: 2795365 - protein, 24 aa, Entamoeba invadens
KDEIPRPINLNIPKRGPLKTKNSN

SEQ ID NO: 2795366 - protein, 17 aa, Entamoeba invadens
KDEKCVDGTILQSDKCK

SEQ ID NO: 2795367 - protein, 25 aa, Entamoeba invadens
KDFCFKGLTSLECIKVMNATCLFGK

SEQ ID NO: 2795368 - protein, 18 aa, Entamoeba invadens
KDFCNNILFPYRAKILAI

SEQ ID NO: 2795369 - protein, 18 aa, Entamoeba invadens
KDFKSLFEIKQFVVSGKR

SEQ ID NO: 2795370 - protein, 21 aa, Entamoeba invadens
KDFKYAWNIADFTSSGKRLHI

SEQ ID NO: 2795371 - protein, 19 aa, Entamoeba invadens
KDFMECIIFDRTLDMLTPN

SEQ ID NO: 2795372 - protein, 23 aa, Entamoeba invadens
KDFWKLVLSCVLIITNVVPPELP

SEQ ID NO: 2795373 - protein, 22 aa, Entamoeba invadens
KDGCTMCAIGHYVSGGTCDNCI

SEQ ID NO: 2795374 - protein, 19 aa, Entamoeba invadens
KDGECKFMIGNDRTSLLKI

SEQ ID NO: 2795375 - protein, 18 aa, Entamoeba invadens
KDGFLFGIQHEGRCLIAD

SEQ ID NO: 2795376 - protein, 18 aa, Entamoeba invadens
KDGFVVKNADCIKCADKC

SEQ ID NO: 2795377 - protein, 18 aa, Entamoeba invadens
KDGIFYVSVHLIDTDQPK

SEQ ID NO: 2795378 - protein, 18 aa, Entamoeba invadens
KDGKSCVFTMEVKAPINS

SEQ ID NO: 2795379 - protein, 19 aa, Entamoeba invadens
KDGLFKYYVELYKNVPKCL

SEQ ID NO: 2795380 - protein, 20 aa, Entamoeba invadens
KDGYKKEDTGFCVKDHNENV

SEQ ID NO: 2795381 - protein, 21 aa, Entamoeba invadens
KDGYYRVGLDCFECDQKCKTC

SEQ ID NO: 2795382 - protein, 20 aa, Entamoeba invadens
KDHPIHISVTLKRYTVLMSI

SEQ ID NO: 2795383 - protein, 22 aa, Entamoeba invadens
KDHSGEVIEMFKQVVPKLPKEA

SEQ ID NO: 2795384 - protein, 20 aa, Entamoeba invadens
KDIFPRNVSDAAVYFQNSQV

SEQ ID NO: 2795385 - protein, 19 aa, Entamoeba invadens
KDIKLKRILSHIYGPDKTC

SEQ ID NO: 2795386 - protein, 28 aa, Entamoeba invadens
KDIKTLPLHKLRESIGMVGQEPVLFSES

SEQ ID NO: 2795387 - protein, 19 aa, Entamoeba invadens
KDILKSIMSFVDFSVFVLL

SEQ ID NO: 2795388 - protein, 22 aa, Entamoeba invadens
KDINDGVAMYLFFLCVTTCVGS

SEQ ID NO: 2795389 - protein, 21 aa, Entamoeba invadens
KDIRVNLPLAAPNDMYLGLFF

SEQ ID NO: 2795390 - protein, 20 aa, Entamoeba invadens
KDKCLTCNLTNYKTSSGICL

SEQ ID NO: 2795391 - protein, 18 aa, Entamoeba invadens
KDKIDLVFATDFLVCDHP

SEQ ID NO: 2795392 - protein, 19 aa, Entamoeba invadens
KDKVCTACVADCKTCTDET

SEQ ID NO: 2795393 - protein, 19 aa, Entamoeba invadens
KDLATRIMLIYHICNPSLQ

SEQ ID NO: 2795394 - protein, 19 aa, Entamoeba invadens
KDLDDVSGILSPVLNAMQT

SEQ ID NO: 2795395 - protein, 18 aa, Entamoeba invadens
KDLIAMAMNCIREDLQAL

SEQ ID NO: 2795396 - protein, 19 aa, Entamoeba invadens
KDLKCLKCDEILTNCIKCG

SEQ ID NO: 2795397 - protein, 19 aa, Entamoeba invadens
KDLKNICTFDMSRSNVEMV

SEQ ID NO: 2795398 - protein, 18 aa, Entamoeba invadens
KDLNSIEMLLKFIEDAPT

SEQ ID NO: 2795399 - protein, 24 aa, Entamoeba invadens
KDLNTGFTKLHFLAEIQQTQLDNI

SEQ ID NO: 2795400 - protein, 21 aa, Entamoeba invadens
KDLQCLKCYEILTNCIKCGLL

SEQ ID NO: 2795401 - protein, 19 aa, Entamoeba invadens
KDLQGCVLIGNGVMGMMSL

SEQ ID NO: 2795402 - protein, 20 aa, Entamoeba invadens
KDLQLKWLRSQIGVVGQEPV

SEQ ID NO: 2795403 - protein, 21 aa, Entamoeba invadens
KDLTRILLITLIYYSPTCVAS

SEQ ID NO: 2795404 - protein, 18 aa, Entamoeba invadens
KDMCLTCNSTNYKTTSGK

SEQ ID NO: 2795405 - protein, 17 aa, Entamoeba invadens
KDMEGIIKFVKFYNNLK

SEQ ID NO: 2795406 - protein, 24 aa, Entamoeba invadens
KDMGCAIDFISICVRLFTNNLNED

SEQ ID NO: 2795407 - protein, 21 aa, Entamoeba invadens
KDMKIPYSVWFSRSKKTLEKI

SEQ ID NO: 2795408 - protein, 26 aa, Entamoeba invadens
KDMKYRVSTFNKYYCTYKNDVEGKAT

SEQ ID NO: 2795409 - protein, 24 aa, Entamoeba invadens
KDMPHCGGAYVFFDNILDKGYTPR

SEQ ID NO: 2795410 - protein, 17 aa, Entamoeba invadens
KDMTGCLPIREKYLDCE

SEQ ID NO: 2795411 - protein, 17 aa, Entamoeba invadens
KDMVNEWVEWGSKKSEE

SEQ ID NO: 2795412 - protein, 18 aa, Entamoeba invadens
KDNCLTCARDYYLPKNMS

SEQ ID NO: 2795413 - protein, 20 aa, Entamoeba invadens
KDNDLMWVQVMDRFRILLLS

SEQ ID NO: 2795414 - protein, 20 aa, Entamoeba invadens
KDNFCENAFFLQDQVTLETI

SEQ ID NO: 2795415 - protein, 21 aa, Entamoeba invadens
KDNKLCNKWHIYSTNSECEFV

SEQ ID NO: 2795416 - protein, 24 aa, Entamoeba invadens
KDNLGFEIPVFFNDSIGGLDENFV

SEQ ID NO: 2795417 - protein, 19 aa, Entamoeba invadens
KDNMCISNATGYKFETNKT

SEQ ID NO: 2795418 - protein, 22 aa, Entamoeba invadens
KDNYDICRMDFIGGKSVTFRSF

SEQ ID NO: 2795419 - protein, 29 aa, Entamoeba invadens
KDPFPKDKFIFPWSIADFISAGKRFERPE

SEQ ID NO: 2795420 - protein, 25 aa, Entamoeba invadens
KDPLLRLDALVSIARNRKWAGNAND

SEQ ID NO: 2795421 - protein, 20 aa, Entamoeba invadens
KDPQFVISVLKFLKKAVDES

SEQ ID NO: 2795422 - protein, 17 aa, Entamoeba invadens
KDPTVITNWFKNRIVLE

SEQ ID NO: 2795423 - protein, 23 aa, Entamoeba invadens
KDQCSVCKTGYLLEQVTLKCVNE

SEQ ID NO: 2795424 - protein, 23 aa, Entamoeba invadens
KDQFKFPWKIAEFINQENRLPRI

SEQ ID NO: 2795425 - protein, 25 aa, Entamoeba invadens
KDQFKFPWKIAEFVMGGNRLKKPDM

SEQ ID NO: 2795426 - protein, 26 aa, Entamoeba invadens
KDQFKYPWKIADFVMAGNRLKKPEMM

SEQ ID NO: 2795427 - protein, 19 aa, Entamoeba invadens
KDQFPEWALLPKTSEELMK

SEQ ID NO: 2795428 - protein, 20 aa, Entamoeba invadens
KDRCYQCKTGYYLSNNYCEK

SEQ ID NO: 2795429 - protein, 24 aa, Entamoeba invadens
KDRFKFPWKIAEFVISGKRLERNE

SEQ ID NO: 2795430 - protein, 19 aa, Entamoeba invadens
KDRKREEEIATYKKEESEL

SEQ ID NO: 2795431 - protein, 17 aa, Entamoeba invadens
KDRYSFGQQSVFEVVRH

SEQ ID NO: 2795432 - protein, 25 aa, Entamoeba invadens
KDSESPFYYGFKKFFGYFTLISYII

SEQ ID NO: 2795433 - protein, 24 aa, Entamoeba invadens
KDSILRERLFRYEIESEINEAFNT

SEQ ID NO: 2795434 - protein, 19 aa, Entamoeba invadens
KDSNFWTVSCDGSSIDFHL

SEQ ID NO: 2795435 - protein, 19 aa, Entamoeba invadens
KDSPPKCLSCIENCSNCTA

SEQ ID NO: 2795436 - protein, 22 aa, Entamoeba invadens
KDSRSIMNICFVMNDEYKALEE

SEQ ID NO: 2795437 - protein, 20 aa, Entamoeba invadens
KDSRVCNVVDQYGCLQCRYD

SEQ ID NO: 2795438 - protein, 23 aa, Entamoeba invadens
KDSRWKALVLVSVLTFSMEILFV

SEQ ID NO: 2795439 - protein, 18 aa, Entamoeba invadens
KDSSCILSQWSDIVSNNH

SEQ ID NO: 2795440 - protein, 24 aa, Entamoeba invadens
KDSSCVSCSKISHCLKCNKDGCAE

SEQ ID NO: 2795441 - protein, 17 aa, Entamoeba invadens
KDSSLDCECHFSNGSYS

SEQ ID NO: 2795442 - protein, 21 aa, Entamoeba invadens
KDTCIIPAFIEKLNYKDALFS

SEQ ID NO: 2795443 - protein, 19 aa, Entamoeba invadens
KDTCLTCNLTNYKTNNGEC

SEQ ID NO: 2795444 - protein, 24 aa, Entamoeba invadens
KDTFKGCIFLNEVDGFEKVTYYGD

SEQ ID NO: 2795445 - protein, 23 aa, Entamoeba invadens
KDTIPRKSIEMHLENHFSLHNYG

SEQ ID NO: 2795446 - protein, 18 aa, Entamoeba invadens
KDTLDFFVEVAKYWIKNF

SEQ ID NO: 2795447 - protein, 28 aa, Entamoeba invadens
KDTLIPFVKRYVVWFTVSLTDSYFPYTD

SEQ ID NO: 2795448 - protein, 21 aa, Entamoeba invadens
KDTRLPLPVFTFQVSSLKLTT

SEQ ID NO: 2795449 - protein, 22 aa, Entamoeba invadens
KDTRPQLDFPLKCVCSTKSSLT

SEQ ID NO: 2795450 - protein, 22 aa, Entamoeba invadens
KDTYFRVGLDCVRCLTNCTTCN

SEQ ID NO: 2795451 - protein, 20 aa, Entamoeba invadens
KDVCRTFFPTGGCAVCQTGY

SEQ ID NO: 2795452 - protein, 26 aa, Entamoeba invadens
KDVDMKLRIKMCLDATKGVSYLHKNG

SEQ ID NO: 2795453 - protein, 20 aa, Entamoeba invadens
KDVFWCSFTPLNGPEDDDEF

SEQ ID NO: 2795454 - protein, 24 aa, Entamoeba invadens
KDVKKETKSVVSLSDKGILIQVET

SEQ ID NO: 2795455 - protein, 19 aa, Entamoeba invadens
KDVLKEISFSATSKLTTRL

SEQ ID NO: 2795456 - protein, 17 aa, Entamoeba invadens
KDVLKTRFVYIMRNAVC

SEQ ID NO: 2795457 - protein, 27 aa, Entamoeba invadens
KDVNSCYKPSISIGEIFGIVFGSIIGF

SEQ ID NO: 2795458 - protein, 24 aa, Entamoeba invadens
KDVPWSAPEVLQFGDISTKSDIYS

SEQ ID NO: 2795459 - protein, 24 aa, Entamoeba invadens
KDVQARSIALVSFVFFIISTVFTI

SEQ ID NO: 2795460 - protein, 21 aa, Entamoeba invadens
KDVYLPYIMQFAMKLMASVRM

SEQ ID NO: 2795461 - protein, 19 aa, Entamoeba invadens
KDYEKGIVSFQEFSQIIGV

SEQ ID NO: 2795462 - protein, 22 aa, Entamoeba invadens
KEAATCMICGDIIANSNGKCDN

SEQ ID NO: 2795463 - protein, 17 aa, Entamoeba invadens
KEADKYSLGPFWYTFGL

SEQ ID NO: 2795464 - protein, 21 aa, Entamoeba invadens
KEADPPLPKVHHFKNISLPDN

SEQ ID NO: 2795465 - protein, 23 aa, Entamoeba invadens
KEAELVKFVFAFVLALLKMVTKL

SEQ ID NO: 2795466 - protein, 24 aa, Entamoeba invadens
KEAGIYRLTLKLADEEKSSPLPIV

SEQ ID NO: 2795467 - protein, 27 aa, Entamoeba invadens
KEAGQSKCTKCSFWYIPSANGTYCNSH

SEQ ID NO: 2795468 - protein, 17 aa, Entamoeba invadens
KEAKKVKAISFGFGEKI

SEQ ID NO: 2795469 - protein, 22 aa, Entamoeba invadens
KEAQVCVFLMKRSNVTMIPLPN

SEQ ID NO: 2795470 - protein, 19 aa, Entamoeba invadens
KEARVLCDIDSFNRVSLCV

SEQ ID NO: 2795471 - protein, 31 aa, Entamoeba invadens
KEAYNKNSFKFPWKIAEFVIAGSRLSKRDMM

SEQ ID NO: 2795472 - protein, 17 aa, Entamoeba invadens
KEAYPKEDFKFPWKIAE

SEQ ID NO: 2795473 - protein, 20 aa, Entamoeba invadens
KEAYVVKNGMCLPCASGNFY

SEQ ID NO: 2795474 - protein, 20 aa, Entamoeba invadens
KECDTSAYLDFGRCVDCDNF

SEQ ID NO: 2795475 - protein, 20 aa, Entamoeba invadens
KECEECFPGSVNINGRCKVC

SEQ ID NO: 2795476 - protein, 21 aa, Entamoeba invadens
KECFLCHSECYSCDGPYRTNC

SEQ ID NO: 2795477 - protein, 22 aa, Entamoeba invadens
KECLRCKDPYYLSSPLECNSCP

SEQ ID NO: 2795478 - protein, 20 aa, Entamoeba invadens
KECQPYCGACKTGFQCSSQG

SEQ ID NO: 2795479 - protein, 18 aa, Entamoeba invadens
KECTTCSPPFEIKDGVCV

SEQ ID NO: 2795480 - protein, 27 aa, Entamoeba invadens
KECVAAMFLPFVVQFIESFEDFATWKF

SEQ ID NO: 2795481 - protein, 20 aa, Entamoeba invadens
KECVCVSCNTGYFPEVSCKH

SEQ ID NO: 2795482 - protein, 19 aa, Entamoeba invadens
KEDFCEWFLDVLIPSIERK

SEQ ID NO: 2795483 - protein, 18 aa, Entamoeba invadens
KEDIDAIFYVNRKDDEMT

SEQ ID NO: 2795484 - protein, 20 aa, Entamoeba invadens
KEDKLVLTYADLRKGETKSI

SEQ ID NO: 2795485 - protein, 20 aa, Entamoeba invadens
KEDLCNTCSEILPNCEMCMD

SEQ ID NO: 2795486 - protein, 19 aa, Entamoeba invadens
KEDLELCDIKSAKRSLVVS

SEQ ID NO: 2795487 - protein, 20 aa, Entamoeba invadens
KEDMFRFMMAFLMEIPITLF

SEQ ID NO: 2795488 - protein, 19 aa, Entamoeba invadens
KEDNLRQLLNLAPTHISAL

SEQ ID NO: 2795489 - protein, 26 aa, Entamoeba invadens
KEDSRFKYAWDIADFISAGNRLVIPK

SEQ ID NO: 2795490 - protein, 20 aa, Entamoeba invadens
KEDVLSCGVLFLSPFFENSF

SEQ ID NO: 2795491 - protein, 30 aa, Entamoeba invadens
KEDYVVLPYKLKVRMLFDTARGMEFLHENR

SEQ ID NO: 2795492 - protein, 29 aa, Entamoeba invadens
KEDYVVLPYKLKVRMLFDTARGMQFLHEN

SEQ ID NO: 2795493 - protein, 19 aa, Entamoeba invadens
KEEFEIITQMWWIDPGKRL

SEQ ID NO: 2795494 - protein, 25 aa, Entamoeba invadens
KEEFKFPWKIAEFVISGKRLDKEEN

SEQ ID NO: 2795495 - protein, 24 aa, Entamoeba invadens
KEEFKFPWKIAEFVISGKRLERNE

SEQ ID NO: 2795496 - protein, 25 aa, Entamoeba invadens
KEEHWKMMIDIFLDFSMQDISKAVS

SEQ ID NO: 2795497 - protein, 21 aa, Entamoeba invadens
KEEMLRKSLVNEFLLKDLKKK

SEQ ID NO: 2795498 - protein, 20 aa, Entamoeba invadens
KEESCLKCSFNKTTTETPLE

SEQ ID NO: 2795499 - protein, 17 aa, Entamoeba invadens
KEFDDTYIIPRIKDYIN

SEQ ID NO: 2795500 - protein, 21 aa, Entamoeba invadens
KEFEIFYKLLDVIKKLINTKE

SEQ ID NO: 2795501 - protein, 20 aa, Entamoeba invadens
KEFEKEVAMLDKFRNEYIVH

SEQ ID NO: 2795502 - protein, 17 aa, Entamoeba invadens
KEFEQWKLNGARVKILP

SEQ ID NO: 2795503 - protein, 23 aa, Entamoeba invadens
KEFFKKVLLDRKFIPVSLFDHMT

SEQ ID NO: 2795504 - protein, 23 aa, Entamoeba invadens
KEFGTRLLDCLVVAVKNFKNDVS

SEQ ID NO: 2795505 - protein, 25 aa, Entamoeba invadens
KEFKEWGWCYIFIVVLTLLIVICLL

SEQ ID NO: 2795506 - protein, 21 aa, Entamoeba invadens
KEFTCKATISILTFKQDVEIL

SEQ ID NO: 2795507 - protein, 17 aa, Entamoeba invadens
KEFVLLFFHLYKTLQEF

SEQ ID NO: 2795508 - protein, 17 aa, Entamoeba invadens
KEFWAAKCVNGKYDNTN

SEQ ID NO: 2795509 - protein, 21 aa, Entamoeba invadens
KEGATRCKACLSICNTCDKTT

SEQ ID NO: 2795510 - protein, 23 aa, Entamoeba invadens
KEGATRCKACLSVCNTCDKTTGE

SEQ ID NO: 2795511 - protein, 19 aa, Entamoeba invadens
KEGECIRMSSSCKVTDQYG

SEQ ID NO: 2795512 - protein, 21 aa, Entamoeba invadens
KEGFALINDTCVFQCPIQGSV

SEQ ID NO: 2795513 - protein, 23 aa, Entamoeba invadens
KEGFFSVIPFDAISYFYDTELEL

SEQ ID NO: 2795514 - protein, 22 aa, Entamoeba invadens
KEGFYPLDGICVLCSTIKNCRY

SEQ ID NO: 2795515 - protein, 23 aa, Entamoeba invadens
KEGRKYWVEDNMVYFGDCEKQKI

SEQ ID NO: 2795516 - protein, 18 aa, Entamoeba invadens
KEGTFGLWSTITIDFIVP

SEQ ID NO: 2795517 - protein, 25 aa, Entamoeba invadens
KEGTSILKCLTRIEVENVIYVRTPK

SEQ ID NO: 2795518 - protein, 22 aa, Entamoeba invadens
KEGVRILSFPIGYYEEMLPNNL

SEQ ID NO: 2795519 - protein, 20 aa, Entamoeba invadens
KEHLLSFALTNQIEYKNDHP

SEQ ID NO: 2795520 - protein, 21 aa, Entamoeba invadens
KEHPNPLAAYVFTSDDAFFEK

SEQ ID NO: 2795521 - protein, 25 aa, Entamoeba invadens
KEIANRNDLEFGFGRCISPSGSNGS

SEQ ID NO: 2795522 - protein, 17 aa, Entamoeba invadens
KEIECLEEMLSMLRIPK

SEQ ID NO: 2795523 - protein, 24 aa, Entamoeba invadens
KEIEDYERLLVCMHLSVFYEKMIN

SEQ ID NO: 2795524 - protein, 18 aa, Entamoeba invadens
KEIEEFNEVYPPIDKQGL

SEQ ID NO: 2795525 - protein, 24 aa, Entamoeba invadens
KEIEMKLRIKLMLDTLSGILYLHT

SEQ ID NO: 2795526 - protein, 17 aa, Entamoeba invadens
KEIHAITQFKLDEHQFP

SEQ ID NO: 2795527 - protein, 20 aa, Entamoeba invadens
KEIHAVGLMEDFITTLKKMN

SEQ ID NO: 2795528 - protein, 17 aa, Entamoeba invadens
KEIIKQLCEPYMVKLVD

SEQ ID NO: 2795529 - protein, 19 aa, Entamoeba invadens
KEIIRMIMVADYYEYSPVT

SEQ ID NO: 2795530 - protein, 20 aa, Entamoeba invadens
KEILMFPLILIYFPLFFLQK

SEQ ID NO: 2795531 - protein, 23 aa, Entamoeba invadens
KEISLKQPFVFTTLVTDDQFDEI

SEQ ID NO: 2795532 - protein, 18 aa, Entamoeba invadens
KEITAYYADMMTKIPLDQ

SEQ ID NO: 2795533 - protein, 22 aa, Entamoeba invadens
KEIYKEIKFSLTSKITTRIDPD

SEQ ID NO: 2795534 - protein, 28 aa, Entamoeba invadens
KEIYQHRHVVWYWKSENSLFLYYSSYIF

SEQ ID NO: 2795535 - protein, 24 aa, Entamoeba invadens
KEKFKFPWKIAEFVISGKRLEKKE

SEQ ID NO: 2795536 - protein, 18 aa, Entamoeba invadens
KEKFNFFTLNKHISSNKK

SEQ ID NO: 2795537 - protein, 20 aa, Entamoeba invadens
KEKFYTWILASLVMLLQNLV

SEQ ID NO: 2795538 - protein, 21 aa, Entamoeba invadens
KEKGRCLSCTYGNGLTTTNPP

SEQ ID NO: 2795539 - protein, 21 aa, Entamoeba invadens
KEKHVIFLLNDSIAFVKEKVY

SEQ ID NO: 2795540 - protein, 21 aa, Entamoeba invadens
KEKKKVCVFNMKKSNIKFTKI

SEQ ID NO: 2795541 - protein, 18 aa, Entamoeba invadens
KEKLMGYEGGQVYSVEGQ

SEQ ID NO: 2795542 - protein, 21 aa, Entamoeba invadens
KEKNCLKCEIDYFVLNGICIN

SEQ ID NO: 2795543 - protein, 17 aa, Entamoeba invadens
KEKPNYVEFLFKYLDIY

SEQ ID NO: 2795544 - protein, 20 aa, Entamoeba invadens
KEKRCAVCKDGYYKDKNDCV

SEQ ID NO: 2795545 - protein, 20 aa, Entamoeba invadens
KEKVNCLYRNGGLSEYVLSP

SEQ ID NO: 2795546 - protein, 18 aa, Entamoeba invadens
KELANWACSGNPSAANVG

SEQ ID NO: 2795547 - protein, 21 aa, Entamoeba invadens
KELFSYPWIVATFIAEGKRRP

SEQ ID NO: 2795548 - protein, 18 aa, Entamoeba invadens
KELGEYTICFSVQNAVRY

SEQ ID NO: 2795549 - protein, 26 aa, Entamoeba invadens
KELHCPNRTLSALLMVVKTVSVPLFR

SEQ ID NO: 2795550 - protein, 24 aa, Entamoeba invadens
KELKIVPCLHKGRVLSKPFKNEIQ

SEQ ID NO: 2795551 - protein, 17 aa, Entamoeba invadens
KELKKCETPDEIDKIEK

SEQ ID NO: 2795552 - protein, 20 aa, Entamoeba invadens
KELKRTTTIFEMEKSNVKFI

SEQ ID NO: 2795553 - protein, 38 aa, Entamoeba invadens
KELKTKRPSISWVICKREWKWFLIMYILTVIFDLFCIS

SEQ ID NO: 2795554 - protein, 32 aa, Entamoeba invadens
KELKVPAVMFNWSWDLFRGFPIMTVAFCGHYN

SEQ ID NO: 2795555 - protein, 26 aa, Entamoeba invadens
KELLCTGFACEFEVFLTPHCTLTLED

SEQ ID NO: 2795556 - protein, 17 aa, Entamoeba invadens
KELLFNATHIFNATESY

SEQ ID NO: 2795557 - protein, 18 aa, Entamoeba invadens
KELLPSYVSFIPNQVIVG

SEQ ID NO: 2795558 - protein, 22 aa, Entamoeba invadens
KELMTLCPTYIYPQSMSSDKLL

SEQ ID NO: 2795559 - protein, 27 aa, Entamoeba invadens
KELNEIYIWKVFYSTLIWVLKNINKTT

SEQ ID NO: 2795560 - protein, 20 aa, Entamoeba invadens
KELPAYIATFTSMISNYSSS

SEQ ID NO: 2795561 - protein, 17 aa, Entamoeba invadens
KELPVKIDVFLEKVKIL

SEQ ID NO: 2795562 - protein, 20 aa, Entamoeba invadens
KELQFDFELNGEFEFIISDL

SEQ ID NO: 2795563 - protein, 18 aa, Entamoeba invadens
KELSCQRKPKYVIDVSIA

SEQ ID NO: 2795564 - protein, 24 aa, Entamoeba invadens
KELSECFELIEFCLRERKSEIEEK

SEQ ID NO: 2795565 - protein, 21 aa, Entamoeba invadens
KELSKHTGLLVLRIRNYGTLN

SEQ ID NO: 2795566 - protein, 21 aa, Entamoeba invadens
KEMKVVFDVDGDYEFLITHVL

SEQ ID NO: 2795567 - protein, 22 aa, Entamoeba invadens
KENCLDCSDTFFVSNSKCVSSG

SEQ ID NO: 2795568 - protein, 24 aa, Entamoeba invadens
KENFKYPWDVARFVTTGGRLAQTA

SEQ ID NO: 2795569 - protein, 25 aa, Entamoeba invadens
KENGYRLVMFIIIFMQIIRNVFYYL

SEQ ID NO: 2795570 - protein, 21 aa, Entamoeba invadens
KENHGRYSLTFDKTENVEPEK

SEQ ID NO: 2795571 - protein, 21 aa, Entamoeba invadens
KENHLCCGKGATILARNDDGT

SEQ ID NO: 2795572 - protein, 19 aa, Entamoeba invadens
KENKCVSCSLNGNCTSCNT

SEQ ID NO: 2795573 - protein, 28 aa, Entamoeba invadens
KENKFCFSLSRRFIMLFTELSKLTGVTD

SEQ ID NO: 2795574 - protein, 24 aa, Entamoeba invadens
KENLKRAGLYVFFPFETNCGKGEF

SEQ ID NO: 2795575 - protein, 20 aa, Entamoeba invadens
KENNKSLCRIIIRDALGRWV

SEQ ID NO: 2795576 - protein, 25 aa, Entamoeba invadens
KENSLEISYLFDIFAKIANLNKDPT

SEQ ID NO: 2795577 - protein, 19 aa, Entamoeba invadens
KENSVGVYGCTDCVDGYFI

SEQ ID NO: 2795578 - protein, 21 aa, Entamoeba invadens
KENYSDLILFEIQGSLNDNTN

SEQ ID NO: 2795579 - protein, 18 aa, Entamoeba invadens
KENYYKQKADCISCDESC

SEQ ID NO: 2795580 - protein, 19 aa, Entamoeba invadens
KEPLNCFKDGIYTDSSILD

SEQ ID NO: 2795581 - protein, 17 aa, Entamoeba invadens
KEPSPFAKLKFWKKKEE

SEQ ID NO: 2795582 - protein, 18 aa, Entamoeba invadens
KEPYCPLENDVDWYITPL

SEQ ID NO: 2795583 - protein, 20 aa, Entamoeba invadens
KEPYKEFMSIFEIKNHVIAG

SEQ ID NO: 2795584 - protein, 27 aa, Entamoeba invadens
KEPYPIENFKFAWSIADFVASGKHLAQ

SEQ ID NO: 2795585 - protein, 27 aa, Entamoeba invadens
KEPYPKENFKFAWSIADFVASGKHLAQ

SEQ ID NO: 2795586 - protein, 27 aa, Entamoeba invadens
KEPYPKIRFKFAWDIVDFVASGKRLKK

SEQ ID NO: 2795587 - protein, 27 aa, Entamoeba invadens
KEPYPKNEFKFAWSIANFVTNGNHLLK

SEQ ID NO: 2795588 - protein, 28 aa, Entamoeba invadens
KEPYPKSEFKFAWSIADFVSKGNHLKKG

SEQ ID NO: 2795589 - protein, 27 aa, Entamoeba invadens
KEPYPKSEFKFAWSVADFVSKGNHLKK

SEQ ID NO: 2795590 - protein, 19 aa, Entamoeba invadens
KEQAPRSAIKAKFMLDMAK

SEQ ID NO: 2795591 - protein, 24 aa, Entamoeba invadens
KEQDRCIHCLTGYFVSNYHCENCS

SEQ ID NO: 2795592 - protein, 23 aa, Entamoeba invadens
KEQEQKKRIAAMKKAKILTQNLR

SEQ ID NO: 2795593 - protein, 17 aa, Entamoeba invadens
KEQFPADALLLNSSESN

SEQ ID NO: 2795594 - protein, 17 aa, Entamoeba invadens
KEQIENIEKYKTRMEEL

SEQ ID NO: 2795595 - protein, 18 aa, Entamoeba invadens
KEQSCVIAQALIVYVNHL

SEQ ID NO: 2795596 - protein, 18 aa, Entamoeba invadens
KERAGLLLDHLPVLLLHH

SEQ ID NO: 2795597 - protein, 21 aa, Entamoeba invadens
KERCSSCLENSFLSSDHKCVS

SEQ ID NO: 2795598 - protein, 18 aa, Entamoeba invadens
KERFTYLILKNSNLFETE

SEQ ID NO: 2795599 - protein, 21 aa, Entamoeba invadens
KERKKSGIVITVYVRETDDRF

SEQ ID NO: 2795600 - protein, 21 aa, Entamoeba invadens
KERLADMLMPIVIYMIEEIDF

SEQ ID NO: 2795601 - protein, 18 aa, Entamoeba invadens
KERNFPEVLQSIVLASFE

SEQ ID NO: 2795602 - protein, 19 aa, Entamoeba invadens
KERYEIFGFILTGMDGLRK

SEQ ID NO: 2795603 - protein, 19 aa, Entamoeba invadens
KERYQDWLFEQTCTGFLLY

SEQ ID NO: 2795604 - protein, 20 aa, Entamoeba invadens
KESCLDCSDTFFVSNSKFVS

SEQ ID NO: 2795605 - protein, 21 aa, Entamoeba invadens
KESCLDCSDTFFVSNSQCVSS

SEQ ID NO: 2795606 - protein, 22 aa, Entamoeba invadens
KESDLLWLWIFLGVLAGLLIII

SEQ ID NO: 2795607 - protein, 22 aa, Entamoeba invadens
KESDQYWYGIQFQNTDPSEVTY

SEQ ID NO: 2795608 - protein, 22 aa, Entamoeba invadens
KESEMYLRYIGDVGGVITPNYV

SEQ ID NO: 2795609 - protein, 23 aa, Entamoeba invadens
KESETKAGQVLKNGLPTLEKPQD

SEQ ID NO: 2795610 - protein, 17 aa, Entamoeba invadens
KESEWVRLTSTPNLTSK

SEQ ID NO: 2795611 - protein, 25 aa, Entamoeba invadens
KESFEFLRVVPDFHFNSTSHYDTFS

SEQ ID NO: 2795612 - protein, 17 aa, Entamoeba invadens
KESGYSAELEFHTTGVF

SEQ ID NO: 2795613 - protein, 21 aa, Entamoeba invadens
KESLKTCEDCGVGITTNGSCV

SEQ ID NO: 2795614 - protein, 18 aa, Entamoeba invadens
KESQNCTAFIPSGSGCAV

SEQ ID NO: 2795615 - protein, 20 aa, Entamoeba invadens
KESRELLCVGNIISKTIKIQ

SEQ ID NO: 2795616 - protein, 24 aa, Entamoeba invadens
KESVFTIGIPFIFQKCPVKCSEHF

SEQ ID NO: 2795617 - protein, 23 aa, Entamoeba invadens
KESYYKRFIMTLNMCADAALNSY

SEQ ID NO: 2795618 - protein, 19 aa, Entamoeba invadens
KETKCLWDDEIVGSVIQSR

SEQ ID NO: 2795619 - protein, 17 aa, Entamoeba invadens
KETNYGLVVGVPITVTF

SEQ ID NO: 2795620 - protein, 20 aa, Entamoeba invadens
KETQKLCEFISNTTTKYLGD

SEQ ID NO: 2795621 - protein, 19 aa, Entamoeba invadens
KEVCLKCSDNYFLDTNGNC

SEQ ID NO: 2795622 - protein, 25 aa, Entamoeba invadens
KEVEIGRVYSFNFLPLQFMMMFLSI

SEQ ID NO: 2795623 - protein, 26 aa, Entamoeba invadens
KEVERGLRIKFMFDAARGIQYLHSNN

SEQ ID NO: 2795624 - protein, 21 aa, Entamoeba invadens
KEVFENIPMLYADETPLYIQL

SEQ ID NO: 2795625 - protein, 22 aa, Entamoeba invadens
KEVKCGGPIYRYISNTSDLRCE

SEQ ID NO: 2795626 - protein, 18 aa, Entamoeba invadens
KEVLRVCQVLNQRIIHYD

SEQ ID NO: 2795627 - protein, 20 aa, Entamoeba invadens
KEVLTPKILLLYFLTFLSMT

SEQ ID NO: 2795628 - protein, 19 aa, Entamoeba invadens
KEVLYNACLLFKKLKENEK

SEQ ID NO: 2795629 - protein, 21 aa, Entamoeba invadens
KEVLYSLKIIYVVVFIMDEIM

SEQ ID NO: 2795630 - protein, 17 aa, Entamoeba invadens
KEVMAECEIMGRLRNPF

SEQ ID NO: 2795631 - protein, 29 aa, Entamoeba invadens
KEVPLPCLFSTALAFMFSRDIFSRLQSKK

SEQ ID NO: 2795632 - protein, 27 aa, Entamoeba invadens
KEVRNSGLFAVCWSFGKAIGYAAGGTL

SEQ ID NO: 2795633 - protein, 18 aa, Entamoeba invadens
KEVTSECEIMSKLRNPFI

SEQ ID NO: 2795634 - protein, 19 aa, Entamoeba invadens
KEVVRMVIEVSKYHLKVLI

SEQ ID NO: 2795635 - protein, 32 aa, Entamoeba invadens
KEVYCDVCSIGYFPEAVCKICSEISGCDQCVN

SEQ ID NO: 2795636 - protein, 34 aa, Entamoeba invadens
KEVYPKMETNFFKARVAFVLGVLFNHFEDYGNAE

SEQ ID NO: 2795637 - protein, 17 aa, Entamoeba invadens
KEWGRWYYDQALHNHVF

SEQ ID NO: 2795638 - protein, 20 aa, Entamoeba invadens
KEYMKRFYIGNKGSDEVELQ

SEQ ID NO: 2795639 - protein, 26 aa, Entamoeba invadens
KEYNPVGGCIICNVGYFRENMNCKKC

SEQ ID NO: 2795640 - protein, 22 aa, Entamoeba invadens
KEYPNPCGEYINWGYDYVAVKN

SEQ ID NO: 2795641 - protein, 18 aa, Entamoeba invadens
KFAPESMKLILTAPPNGD

SEQ ID NO: 2795642 - protein, 26 aa, Entamoeba invadens
KFCEVSKAVVCARCSPQQKTKVVVAA

SEQ ID NO: 2795643 - protein, 22 aa, Entamoeba invadens
KFDDIKFGLFVDVMKYQYHRVF

SEQ ID NO: 2795644 - protein, 26 aa, Entamoeba invadens
KFDECLKKYSPIFKILFEKWYGHDAR

SEQ ID NO: 2795645 - protein, 22 aa, Entamoeba invadens
KFDKRGCFLVNLPNEYFGISPK

SEQ ID NO: 2795646 - protein, 27 aa, Entamoeba invadens
KFELRVCPEMVTLRSGYACEFSLFLTP

SEQ ID NO: 2795647 - protein, 18 aa, Entamoeba invadens
KFEYPWLIADFVTSGKRI

SEQ ID NO: 2795648 - protein, 25 aa, Entamoeba invadens
KFFERYLYCESLVITSHFLIYCKLF

SEQ ID NO: 2795649 - protein, 21 aa, Entamoeba invadens
KFFGRKEILSYGGDWERVKSV

SEQ ID NO: 2795650 - protein, 17 aa, Entamoeba invadens
KFFKDLDDVSGILSPVL

SEQ ID NO: 2795651 - protein, 29 aa, Entamoeba invadens
KFFKDMAICIVAPLFPRVFMFFFNLITPP

SEQ ID NO: 2795652 - protein, 26 aa, Entamoeba invadens
KFFLQFMFYASITLFFAIIINGSSLF

SEQ ID NO: 2795653 - protein, 24 aa, Entamoeba invadens
KFFYTFKMPSFVGMIMTIALISTA

SEQ ID NO: 2795654 - protein, 24 aa, Entamoeba invadens
KFGQLTKRVDPFYKALVYCLVLIL

SEQ ID NO: 2795655 - protein, 17 aa, Entamoeba invadens
KFHRFHNCFYFVVVTVV

SEQ ID NO: 2795656 - protein, 25 aa, Entamoeba invadens
KFIALAIRLYLKLMKQAAYNDHVRQ

SEQ ID NO: 2795657 - protein, 18 aa, Entamoeba invadens
KFIETMLFSIGVLKCYDV

SEQ ID NO: 2795658 - protein, 19 aa, Entamoeba invadens
KFIGVFFCAVYISFAISVV

SEQ ID NO: 2795659 - protein, 31 aa, Entamoeba invadens
KFIKSADIFQTFKFPWKIAEFVMSGKRLERR

SEQ ID NO: 2795660 - protein, 25 aa, Entamoeba invadens
KFIPFFKSYFLYISHYETSNKTLAE

SEQ ID NO: 2795661 - protein, 22 aa, Entamoeba invadens
KFIPFQRGICVSSKDIDFNSEH

SEQ ID NO: 2795662 - protein, 20 aa, Entamoeba invadens
KFIPLQGGVCVSIDLIDLNS

SEQ ID NO: 2795663 - protein, 23 aa, Entamoeba invadens
KFIRGLVNFSGFVFRKQGNDCLC

SEQ ID NO: 2795664 - protein, 24 aa, Entamoeba invadens
KFKFEKRSNYSFKDSTKTVLFVQD

SEQ ID NO: 2795665 - protein, 18 aa, Entamoeba invadens
KFKFPWSTAEFVIKGSRL

SEQ ID NO: 2795666 - protein, 30 aa, Entamoeba invadens
KFKNWKTDALHLFGPVPILLLGCIVSSLVS

SEQ ID NO: 2795667 - protein, 18 aa, Entamoeba invadens
KFKSATISRSLKLYNINV

SEQ ID NO: 2795668 - protein, 20 aa, Entamoeba invadens
KFKYDGICGEVFKFPKNSKR

SEQ ID NO: 2795669 - protein, 18 aa, Entamoeba invadens
KFLELLKMKGVEEITIQY

SEQ ID NO: 2795670 - protein, 17 aa, Entamoeba invadens
KFLNGTFNYKWMIKSFD

SEQ ID NO: 2795671 - protein, 19 aa, Entamoeba invadens
KFLYVGWSSGEIQKWSVEA

SEQ ID NO: 2795672 - protein, 19 aa, Entamoeba invadens
KFMEEIRLFIKCGNLLQIP

SEQ ID NO: 2795673 - protein, 19 aa, Entamoeba invadens
KFNESLAEKVKEAKNANEE

SEQ ID NO: 2795674 - protein, 19 aa, Entamoeba invadens
KFNGNYSVLFDARKQNRIC

SEQ ID NO: 2795675 - protein, 22 aa, Entamoeba invadens
KFNYMMCGIIIMVLSMFVILLY

SEQ ID NO: 2795676 - protein, 29 aa, Entamoeba invadens
KFPISFNCWCPSCACGRKCKKCKKDNYEY

SEQ ID NO: 2795677 - protein, 22 aa, Entamoeba invadens
KFPTCGIQLLLKGTNSNEAVCI

SEQ ID NO: 2795678 - protein, 17 aa, Entamoeba invadens
KFQIPFEQYGIFTNSAY

SEQ ID NO: 2795679 - protein, 18 aa, Entamoeba invadens
KFQMRFEPSTVCIPEHQA

SEQ ID NO: 2795680 - protein, 19 aa, Entamoeba invadens
KFQSPLIIWRRKAPLDPNT

SEQ ID NO: 2795681 - protein, 23 aa, Entamoeba invadens
KFQTCTYKRITMVIPNLPDSLKG

SEQ ID NO: 2795682 - protein, 24 aa, Entamoeba invadens
KFRHKEYYAIINICNAVMSPRQSK

SEQ ID NO: 2795683 - protein, 26 aa, Entamoeba invadens
KFRHLTKLVLFYGRNARYQVSSLIKF

SEQ ID NO: 2795684 - protein, 19 aa, Entamoeba invadens
KFRRIHILCHGIGGMFLLK

SEQ ID NO: 2795685 - protein, 23 aa, Entamoeba invadens
KFRSEFVVRFYGAVFARNKVCMV

SEQ ID NO: 2795686 - protein, 26 aa, Entamoeba invadens
KFRTEPELPKGLGIEIEETEIPYIRG

SEQ ID NO: 2795687 - protein, 28 aa, Entamoeba invadens
KFSDEGFRPIVLIKRGLSGLPLKTPKIY

SEQ ID NO: 2795688 - protein, 20 aa, Entamoeba invadens
KFSGKCLRCQENMYYSTIKK

SEQ ID NO: 2795689 - protein, 24 aa, Entamoeba invadens
KFSKPPPCFSQNYKLTFNNLHLNI

SEQ ID NO: 2795690 - protein, 24 aa, Entamoeba invadens
KFSLELKPSYKFTINANTTNFVIK

SEQ ID NO: 2795691 - protein, 19 aa, Entamoeba invadens
KFSSGPVLLTLVLSLLFSG

SEQ ID NO: 2795692 - protein, 25 aa, Entamoeba invadens
KFSTLEGIPVMWSIESVNGTKGNGG

SEQ ID NO: 2795693 - protein, 18 aa, Entamoeba invadens
KFTKRFEQLNVWISHHDN

SEQ ID NO: 2795694 - protein, 18 aa, Entamoeba invadens
KFTLKINPELAVLKHDEA

SEQ ID NO: 2795695 - protein, 30 aa, Entamoeba invadens
KFTLLRLLIERCGGMRRFVEKDCVWKSIAK

SEQ ID NO: 2795696 - protein, 19 aa, Entamoeba invadens
KFTNLVFLFTFGKVETIIK

SEQ ID NO: 2795697 - protein, 17 aa, Entamoeba invadens
KFVEICITILQTNENTP

SEQ ID NO: 2795698 - protein, 19 aa, Entamoeba invadens
KFVFDFVNSYVLCKVPESV

SEQ ID NO: 2795699 - protein, 24 aa, Entamoeba invadens
KFVLYCLLLSYYFVCLATTCLTLF

SEQ ID NO: 2795700 - protein, 24 aa, Entamoeba invadens
KFVRKCQICDLGFYPSKTTGKCIS

SEQ ID NO: 2795701 - protein, 26 aa, Entamoeba invadens
KFVYSCAEIWGGVPVGMFADEIQNGI

SEQ ID NO: 2795702 - protein, 19 aa, Entamoeba invadens
KFWNIPEINGSYCEQHVVW

SEQ ID NO: 2795703 - protein, 17 aa, Entamoeba invadens
KFYMPRTIKRTTVEIKK

SEQ ID NO: 2795704 - protein, 23 aa, Entamoeba invadens
KGCFKCSDGFYLHNSNCVPCKSP

SEQ ID NO: 2795705 - protein, 23 aa, Entamoeba invadens
KGCFKCSDGFYLHNSNCVSCKSP

SEQ ID NO: 2795706 - protein, 19 aa, Entamoeba invadens
KGCGEVAVGNGYYQGLFNI

SEQ ID NO: 2795707 - protein, 23 aa, Entamoeba invadens
KGCQRCFEGFYIDSTECLKCNTN

SEQ ID NO: 2795708 - protein, 17 aa, Entamoeba invadens
KGCQRCYDGYFLSNTLC

SEQ ID NO: 2795709 - protein, 25 aa, Entamoeba invadens
KGCSKRKKIKFSYKEHISVNSQYAK

SEQ ID NO: 2795710 - protein, 17 aa, Entamoeba invadens
KGCSRCAAMYYIKNGVC

SEQ ID NO: 2795711 - protein, 24 aa, Entamoeba invadens
KGDESLRFKITHPCVQDSNYVKEN

SEQ ID NO: 2795712 - protein, 19 aa, Entamoeba invadens
KGDGCVFSSSDECRVCDLG

SEQ ID NO: 2795713 - protein, 22 aa, Entamoeba invadens
KGDRILVYGGLLGIVVILFLIY

SEQ ID NO: 2795714 - protein, 27 aa, Entamoeba invadens
KGDSFTEIYCPCFTANCLIYMRNEKID

SEQ ID NO: 2795715 - protein, 19 aa, Entamoeba invadens
KGDVGVGIFGKEGNQAAVT

SEQ ID NO: 2795716 - protein, 22 aa, Entamoeba invadens
KGEACEFEFFVTLFCTSKIQSF

SEQ ID NO: 2795717 - protein, 18 aa, Entamoeba invadens
KGEACEFEIFIKPLCSCK

SEQ ID NO: 2795718 - protein, 19 aa, Entamoeba invadens
KGEACEFEIFIKPLCSCQI

SEQ ID NO: 2795719 - protein, 19 aa, Entamoeba invadens
KGEACEFEIFITPLCTFKI

SEQ ID NO: 2795720 - protein, 18 aa, Entamoeba invadens
KGEACEFEIIIKPLCSCQ

SEQ ID NO: 2795721 - protein, 20 aa, Entamoeba invadens
KGEACEFEIYITARYTCTID

SEQ ID NO: 2795722 - protein, 17 aa, Entamoeba invadens
KGEACEFHIEVFPLTEC

SEQ ID NO: 2795723 - protein, 30 aa, Entamoeba invadens
KGEACEFSLFICPLCSFTAEEKLVITTCEF

SEQ ID NO: 2795724 - protein, 17 aa, Entamoeba invadens
KGEECDGGDGCIECECQ

SEQ ID NO: 2795725 - protein, 24 aa, Entamoeba invadens
KGEGCEFNICITPLCMCYVDDIML

SEQ ID NO: 2795726 - protein, 28 aa, Entamoeba invadens
KGELPYKVGEIFKKFIPFFKSYFLYISH

SEQ ID NO: 2795727 - protein, 17 aa, Entamoeba invadens
KGELVCVLGSVGSGKSS

SEQ ID NO: 2795728 - protein, 30 aa, Entamoeba invadens
KGEQVIDIFPYVRYETIPFYSMNDGKGFCG

SEQ ID NO: 2795729 - protein, 23 aa, Entamoeba invadens
KGETKSIVFTLVINTCLSTRLDP

SEQ ID NO: 2795730 - protein, 19 aa, Entamoeba invadens
KGEVDVMRMVLMMELTGQP

SEQ ID NO: 2795731 - protein, 24 aa, Entamoeba invadens
KGFACEFEILLTLLCTSKIESKIL

SEQ ID NO: 2795732 - protein, 24 aa, Entamoeba invadens
KGFACEFEVFLTLLCTSKIESAFV

SEQ ID NO: 2795733 - protein, 19 aa, Entamoeba invadens
KGFACEFTLIITPFCTSKI

SEQ ID NO: 2795734 - protein, 20 aa, Entamoeba invadens
KGFACEFTLIITPFCTSKID

SEQ ID NO: 2795735 - protein, 28 aa, Entamoeba invadens
KGFNTATIPLIWVCIVALLFLVIPNFHT

SEQ ID NO: 2795736 - protein, 19 aa, Entamoeba invadens
KGGCFKCKATSTLLNVNPP

SEQ ID NO: 2795737 - protein, 24 aa, Entamoeba invadens
KGGGCAICRDGYYKIFKDCIVCDI

SEQ ID NO: 2795738 - protein, 25 aa, Entamoeba invadens
KGGLECLRIKSIECDKTMHPNENYT

SEQ ID NO: 2795739 - protein, 22 aa, Entamoeba invadens
KGGNCSVQLAVPTGVTKTLAFS

SEQ ID NO: 2795740 - protein, 21 aa, Entamoeba invadens
KGGPLKFEQEIEIFKKNKREK

SEQ ID NO: 2795741 - protein, 19 aa, Entamoeba invadens
KGGYTKQWRAWRILQGINI

SEQ ID NO: 2795742 - protein, 23 aa, Entamoeba invadens
KGHCTACLPGYLLTPDVNNKYYT

SEQ ID NO: 2795743 - protein, 18 aa, Entamoeba invadens
KGIACEFEIFIKPICTCV

SEQ ID NO: 2795744 - protein, 28 aa, Entamoeba invadens
KGIEIWMVISVFDIPYASYFKVESVMKL

SEQ ID NO: 2795745 - protein, 17 aa, Entamoeba invadens
KGIGEKIVYSRSIVSCA

SEQ ID NO: 2795746 - protein, 19 aa, Entamoeba invadens
KGIVGGFVLILLIIMFFTF

SEQ ID NO: 2795747 - protein, 22 aa, Entamoeba invadens
KGIYIRFLFDSDYTMLIDSTSD

SEQ ID NO: 2795748 - protein, 19 aa, Entamoeba invadens
KGKACEFEIFLKPNCSTQI

SEQ ID NO: 2795749 - protein, 21 aa, Entamoeba invadens
KGKACEFEIFLTPNCSTKIDD

SEQ ID NO: 2795750 - protein, 21 aa, Entamoeba invadens
KGKACEFEIFLTPNCSTKIND

SEQ ID NO: 2795751 - protein, 18 aa, Entamoeba invadens
KGKACEFEVYLTPNCSTE

SEQ ID NO: 2795752 - protein, 17 aa, Entamoeba invadens
KGKAVEFEIFIKPLCTC

SEQ ID NO: 2795753 - protein, 23 aa, Entamoeba invadens
KGKAVEFELFLTPNCSTQIEDNI

SEQ ID NO: 2795754 - protein, 17 aa, Entamoeba invadens
KGKAVEFEVFIMPLCST

SEQ ID NO: 2795755 - protein, 22 aa, Entamoeba invadens
KGKCAYCKIQYYLDPINLICKD

SEQ ID NO: 2795756 - protein, 19 aa, Entamoeba invadens
KGKCDNLALLVDFKNGKNV

SEQ ID NO: 2795757 - protein, 17 aa, Entamoeba invadens
KGKCNIKGIVSFDKILC

SEQ ID NO: 2795758 - protein, 33 aa, Entamoeba invadens
KGKDCFKTEMGYCTECRPGFFIQGGDSQECISC

SEQ ID NO: 2795759 - protein, 19 aa, Entamoeba invadens
KGKDLYVFASSVREAVWTG

SEQ ID NO: 2795760 - protein, 28 aa, Entamoeba invadens
KGKEGLSWKPLFMYTRFLVTKIVIPVFL

SEQ ID NO: 2795761 - protein, 21 aa, Entamoeba invadens
KGKIYSHQELRVCVVDNNKVS

SEQ ID NO: 2795762 - protein, 21 aa, Entamoeba invadens
KGKKCILCEMGYFASENGECI

SEQ ID NO: 2795763 - protein, 18 aa, Entamoeba invadens
KGKLLFDETNEFNIHQTS

SEQ ID NO: 2795764 - protein, 25 aa, Entamoeba invadens
KGKLVIRGREVEISLYLGLGNGNKT

SEQ ID NO: 2795765 - protein, 21 aa, Entamoeba invadens
KGKNRDAFLIVFQALMKVNTT

SEQ ID NO: 2795766 - protein, 19 aa, Entamoeba invadens
KGKYSLRLISFDKNKLVLN

SEQ ID NO: 2795767 - protein, 23 aa, Entamoeba invadens
KGLFRRLPVLLIPKSVNDRIEQL

SEQ ID NO: 2795768 - protein, 21 aa, Entamoeba invadens
KGLTMGISFFPTLPLNKDDMI

SEQ ID NO: 2795769 - protein, 24 aa, Entamoeba invadens
KGMCKCLDGYVLYYGGCSMCGNGV

SEQ ID NO: 2795770 - protein, 21 aa, Entamoeba invadens
KGMFRTNIVAVKMMKIPDDDD

SEQ ID NO: 2795771 - protein, 33 aa, Entamoeba invadens
KGMVKAELAPLCMFCGMQLIGFADVQSVKYIRD

SEQ ID NO: 2795772 - protein, 18 aa, Entamoeba invadens
KGNAVLLVYPIILYYTLF

SEQ ID NO: 2795773 - protein, 20 aa, Entamoeba invadens
KGNLYICGISNYKEDIPKIE

SEQ ID NO: 2795774 - protein, 22 aa, Entamoeba invadens
KGNMDTLGFIFTEIFKGRFRDV

SEQ ID NO: 2795775 - protein, 26 aa, Entamoeba invadens
KGNWCSECTIGYGLKTGVCYNCGEGC

SEQ ID NO: 2795776 - protein, 27 aa, Entamoeba invadens
KGNWCSECTIGYGLKTGVCYNCGEGCS

SEQ ID NO: 2795777 - protein, 17 aa, Entamoeba invadens
KGNYCVKCVDDYHIYNG

SEQ ID NO: 2795778 - protein, 23 aa, Entamoeba invadens
KGQKNLWNALPIKDISVADVERS

SEQ ID NO: 2795779 - protein, 18 aa, Entamoeba invadens
KGQLLCYGKCHDEATKSG

SEQ ID NO: 2795780 - protein, 23 aa, Entamoeba invadens
KGQRLPKLKGMDDWAYEIVSMCW

SEQ ID NO: 2795781 - protein, 21 aa, Entamoeba invadens
KGRCLTCKDSFFMTLDNECKA

SEQ ID NO: 2795782 - protein, 25 aa, Entamoeba invadens
KGRCSTCSTSNCAFCEGNQCKHCLS

SEQ ID NO: 2795783 - protein, 19 aa, Entamoeba invadens
KGREMLKEYNELELSSLGG

SEQ ID NO: 2795784 - protein, 18 aa, Entamoeba invadens
KGRPSFAAIVVKLMKVIK

SEQ ID NO: 2795785 - protein, 21 aa, Entamoeba invadens
KGRRNKYRYTIEVTPPVVLLK

SEQ ID NO: 2795786 - protein, 18 aa, Entamoeba invadens
KGRSCVPCATFDSHCVTC

SEQ ID NO: 2795787 - protein, 19 aa, Entamoeba invadens
KGRSCVPCATFDSHCVTCA

SEQ ID NO: 2795788 - protein, 18 aa, Entamoeba invadens
KGRSCVPCATFDSRCVTC

SEQ ID NO: 2795789 - protein, 19 aa, Entamoeba invadens
KGRTCVPCATFDSHCVTCA

SEQ ID NO: 2795790 - protein, 23 aa, Entamoeba invadens
KGRTLCFTEFIAVNMDAENVKQN

SEQ ID NO: 2795791 - protein, 28 aa, Entamoeba invadens
KGRVKLKWRPVHFITWTVILSIIHISFI

SEQ ID NO: 2795792 - protein, 18 aa, Entamoeba invadens
KGSDATCILYEMQADDKV

SEQ ID NO: 2795793 - protein, 19 aa, Entamoeba invadens
KGSENIISFGVSSFENTKL

SEQ ID NO: 2795794 - protein, 18 aa, Entamoeba invadens
KGSIVGCYCTIKEGSVDD

SEQ ID NO: 2795795 - protein, 17 aa, Entamoeba invadens
KGSKGGIIAAVIIGLLA

SEQ ID NO: 2795796 - protein, 19 aa, Entamoeba invadens
KGSPICVSDVLLSSNTSNS

SEQ ID NO: 2795797 - protein, 17 aa, Entamoeba invadens
KGSPITFDLFPFCEEYL

SEQ ID NO: 2795798 - protein, 25 aa, Entamoeba invadens
KGSRLSEGKCVVCQAGTFQSGDSCY

SEQ ID NO: 2795799 - protein, 18 aa, Entamoeba invadens
KGSVKIPCYIESGSCGNV

SEQ ID NO: 2795800 - protein, 19 aa, Entamoeba invadens
KGTCDKPTCVLEKTASKNC

SEQ ID NO: 2795801 - protein, 23 aa, Entamoeba invadens
KGTDSYVCPAPYSASTSDNHETA

SEQ ID NO: 2795802 - protein, 17 aa, Entamoeba invadens
KGTHCGYDGKAPDNQSP

SEQ ID NO: 2795803 - protein, 18 aa, Entamoeba invadens
KGTHCGYDGKVPDNESPC

SEQ ID NO: 2795804 - protein, 24 aa, Entamoeba invadens
KGTIKRKCQGYEVFFVTNSNNEVI

SEQ ID NO: 2795805 - protein, 31 aa, Entamoeba invadens
KGTKKLVYWIPRILFFLLFFVSVEVTFVYNK

SEQ ID NO: 2795806 - protein, 24 aa, Entamoeba invadens
KGVDMKVAVLGATVVVLLGVVAYL

SEQ ID NO: 2795807 - protein, 22 aa, Entamoeba invadens
KGVDVPIRLVIGAIKDEMKLKI

SEQ ID NO: 2795808 - protein, 28 aa, Entamoeba invadens
KGVEVRMKLRFKVCLDAAQGIQYLHTNG

SEQ ID NO: 2795809 - protein, 18 aa, Entamoeba invadens
KGVNTIIITHSYFVANLT

SEQ ID NO: 2795810 - protein, 25 aa, Entamoeba invadens
KGVPVSFKRMYWRKKFQMSDEIVST

SEQ ID NO: 2795811 - protein, 24 aa, Entamoeba invadens
KGVSLEIPKTPAFVSLLSENTLNS

SEQ ID NO: 2795812 - protein, 21 aa, Entamoeba invadens
KGWDVPSVVGILYEKNVEKRV

SEQ ID NO: 2795813 - protein, 23 aa, Entamoeba invadens
KGWTRYVGLFTYRPLYGDYYIFN

SEQ ID NO: 2795814 - protein, 22 aa, Entamoeba invadens
KGYACEFELFITPNFTTTIDST

SEQ ID NO: 2795815 - protein, 20 aa, Entamoeba invadens
KGYEVKAFKDVLCTKPYGIP

SEQ ID NO: 2795816 - protein, 28 aa, Entamoeba invadens
KGYKLIYLRVHFYEMKLLLCGFFLYCIC

SEQ ID NO: 2795817 - protein, 23 aa, Entamoeba invadens
KHCPCSLSENKECTLIVQTPFFE

SEQ ID NO: 2795818 - protein, 20 aa, Entamoeba invadens
KHEWGTVVGNHMYLGSHGRN

SEQ ID NO: 2795819 - protein, 24 aa, Entamoeba invadens
KHFEPFSFLLKRIIRLQPMQVLST

SEQ ID NO: 2795820 - protein, 25 aa, Entamoeba invadens
KHFLLCPKLLAAIVTPDFVVPSDIK

SEQ ID NO: 2795821 - protein, 20 aa, Entamoeba invadens
KHGGYKGIIWTHGNVIEQIK

SEQ ID NO: 2795822 - protein, 20 aa, Entamoeba invadens
KHICTSCLSSQILSANNSCV

SEQ ID NO: 2795823 - protein, 18 aa, Entamoeba invadens
KHIKHIILIANEFLQLQN

SEQ ID NO: 2795824 - protein, 19 aa, Entamoeba invadens
KHIMIACLCLGRKLEEFRF

SEQ ID NO: 2795825 - protein, 24 aa, Entamoeba invadens
KHKGEFKGSIKFPQKPKSGKNEKS

SEQ ID NO: 2795826 - protein, 18 aa, Entamoeba invadens
KHKMCGNGRIDTYYDEDN

SEQ ID NO: 2795827 - protein, 19 aa, Entamoeba invadens
KHKPFELTEKGILILECGM

SEQ ID NO: 2795828 - protein, 18 aa, Entamoeba invadens
KHLAKLVMYHGRMSLYRN

SEQ ID NO: 2795829 - protein, 29 aa, Entamoeba invadens
KHLGDFPIFTIKSVQIFSGNLALKTYSST

SEQ ID NO: 2795830 - protein, 23 aa, Entamoeba invadens
KHNAEIGSKIAFYYNELKLGKEF

SEQ ID NO: 2795831 - protein, 26 aa, Entamoeba invadens
KHNWYKRLASTAVFVILLFSYLFCYI

SEQ ID NO: 2795832 - protein, 26 aa, Entamoeba invadens
KHPLILSFFIIFVLYGIYITGIAIIP

SEQ ID NO: 2795833 - protein, 23 aa, Entamoeba invadens
KHPNCKVCAVDKCYQCKDDKYLK

SEQ ID NO: 2795834 - protein, 25 aa, Entamoeba invadens
KHPNCKVCAVDKCYQCKDDKYLKED

SEQ ID NO: 2795835 - protein, 19 aa, Entamoeba invadens
KHQEGFLIEQWIDEELAKK

SEQ ID NO: 2795836 - protein, 29 aa, Entamoeba invadens
KHQGDFPSAQWVLYVLFGMIMKEISVLSD

SEQ ID NO: 2795837 - protein, 20 aa, Entamoeba invadens
KHQSMSFPGCGDSMNDHTVW

SEQ ID NO: 2795838 - protein, 17 aa, Entamoeba invadens
KHSELKLIYAAAKKCED

SEQ ID NO: 2795839 - protein, 27 aa, Entamoeba invadens
KHSFITLRELFKWADRHASSYEELARD

SEQ ID NO: 2795840 - protein, 24 aa, Entamoeba invadens
KHSKRDSSIFSVVFVLMGFLALTV

SEQ ID NO: 2795841 - protein, 21 aa, Entamoeba invadens
KHTQLCLFIQMYSIIFLSLVL

SEQ ID NO: 2795842 - protein, 18 aa, Entamoeba invadens
KHTVFSIGLKNFGVVVLN

SEQ ID NO: 2795843 - protein, 18 aa, Entamoeba invadens
KHVCSYASERLYWSDMSK

SEQ ID NO: 2795844 - protein, 21 aa, Entamoeba invadens
KHYNAALPLPLRKILLNQMNA

SEQ ID NO: 2795845 - protein, 18 aa, Entamoeba invadens
KIAHCVTYNMTYCMECEE

SEQ ID NO: 2795846 - protein, 24 aa, Entamoeba invadens
KIARKKVSKSWCHGKKEAGDLIPW

SEQ ID NO: 2795847 - protein, 17 aa, Entamoeba invadens
KICKFSLLDALQLFGHE

SEQ ID NO: 2795848 - protein, 21 aa, Entamoeba invadens
KICSLCNMKGYYIDSKSCKKC

SEQ ID NO: 2795849 - protein, 19 aa, Entamoeba invadens
KICSVCSGGTFANMKTNTC

SEQ ID NO: 2795850 - protein, 17 aa, Entamoeba invadens
KICTLCLVTNCTTCSTT

SEQ ID NO: 2795851 - protein, 22 aa, Entamoeba invadens
KIDFYRIVVWFNVDYTTVDMNR

SEQ ID NO: 2795852 - protein, 20 aa, Entamoeba invadens
KIDIGSAVYCFTKINYISNL

SEQ ID NO: 2795853 - protein, 19 aa, Entamoeba invadens
KIDLSVLGWKSLKEHKDCI

SEQ ID NO: 2795854 - protein, 19 aa, Entamoeba invadens
KIDMKGAYDKADFSDDGKV

SEQ ID NO: 2795855 - protein, 18 aa, Entamoeba invadens
KIEAVMVSGILYGKNEIE

SEQ ID NO: 2795856 - protein, 20 aa, Entamoeba invadens
KIEHKFCPLLKTIKYSKKQV

SEQ ID NO: 2795857 - protein, 17 aa, Entamoeba invadens
KIEIERLTALVAEKENE

SEQ ID NO: 2795858 - protein, 20 aa, Entamoeba invadens
KIEIPVRYVLNVQKTMIDTG

SEQ ID NO: 2795859 - protein, 24 aa, Entamoeba invadens
KIENCLYQKFNLCIKCKENYIFKY

SEQ ID NO: 2795860 - protein, 23 aa, Entamoeba invadens
KIFAFVDPFLCYDIKEGEEKKDT

SEQ ID NO: 2795861 - protein, 22 aa, Entamoeba invadens
KIFDYRLLNSFIVILSEKEDNW

SEQ ID NO: 2795862 - protein, 24 aa, Entamoeba invadens
KIFFEMNDFISLFSELLIQRNHFV

SEQ ID NO: 2795863 - protein, 23 aa, Entamoeba invadens
KIFGKRSYGVIGVYSSEKTTDTD

SEQ ID NO: 2795864 - protein, 24 aa, Entamoeba invadens
KIFKVKVCLDISKGMEYLHLNNIV

SEQ ID NO: 2795865 - protein, 20 aa, Entamoeba invadens
KIFLEALKDKTLIILMVAAL

SEQ ID NO: 2795866 - protein, 18 aa, Entamoeba invadens
KIFNIFQEITLKYFFIQT

SEQ ID NO: 2795867 - protein, 20 aa, Entamoeba invadens
KIGCAICMDGYYRKGTECFK

SEQ ID NO: 2795868 - protein, 23 aa, Entamoeba invadens
KIGCDKCSFGFLWNSTTQSCTTV

SEQ ID NO: 2795869 - protein, 18 aa, Entamoeba invadens
KIGCFSCNSTNYKTNGGD

SEQ ID NO: 2795870 - protein, 28 aa, Entamoeba invadens
KIGEKVGWFTFIEVFGFIFLTGGFLLYT

SEQ ID NO: 2795871 - protein, 24 aa, Entamoeba invadens
KIGETRVRRDVCGKDKLIDRPDQG

SEQ ID NO: 2795872 - protein, 26 aa, Entamoeba invadens
KIGKFPRVWGYVCSFIGVCVSVSGLL

SEQ ID NO: 2795873 - protein, 18 aa, Entamoeba invadens
KIGLWICEGNNWSGEWEM

SEQ ID NO: 2795874 - protein, 24 aa, Entamoeba invadens
KIGRELFKCVSRALLSNLNVLMPQ

SEQ ID NO: 2795875 - protein, 18 aa, Entamoeba invadens
KIIETFFGFMVKTIGEVN

SEQ ID NO: 2795876 - protein, 24 aa, Entamoeba invadens
KIIGNGEVHNCPIVIQASTNDILI

SEQ ID NO: 2795877 - protein, 20 aa, Entamoeba invadens
KIINNLLFYFSIAELSRDSK

SEQ ID NO: 2795878 - protein, 24 aa, Entamoeba invadens
KIISEIICGVVLVLFYYWQLGLCI

SEQ ID NO: 2795879 - protein, 21 aa, Entamoeba invadens
KIITAGCCLVIIPLAFITKFT

SEQ ID NO: 2795880 - protein, 24 aa, Entamoeba invadens
KIITLKSGFACEFEIFLTPLCTMH

SEQ ID NO: 2795881 - protein, 22 aa, Entamoeba invadens
KIKAETLLTTILDYEELQEEKK

SEQ ID NO: 2795882 - protein, 21 aa, Entamoeba invadens
KIKDVCIPFTVWFSKQRKTLT

SEQ ID NO: 2795883 - protein, 19 aa, Entamoeba invadens
KIKECLTCQDPYYLSSQKC

SEQ ID NO: 2795884 - protein, 26 aa, Entamoeba invadens
KIKERCDSLVIPLHFPQQAKQSKSTD

SEQ ID NO: 2795885 - protein, 26 aa, Entamoeba invadens
KIKLFSNTVSFVFGTSIGSKISIGTS

SEQ ID NO: 2795886 - protein, 20 aa, Entamoeba invadens
KIKMDKICIFEMKRSNIEMK

SEQ ID NO: 2795887 - protein, 20 aa, Entamoeba invadens
KIKSFSTLQFKGEEVSSQER

SEQ ID NO: 2795888 - protein, 18 aa, Entamoeba invadens
KIKTDICLLPKNKKDVNI

SEQ ID NO: 2795889 - protein, 19 aa, Entamoeba invadens
KILAPFRGTLIFFIVFTII

SEQ ID NO: 2795890 - protein, 17 aa, Entamoeba invadens
KILARVKENFGLVFDAT

SEQ ID NO: 2795891 - protein, 17 aa, Entamoeba invadens
KILEKYPKFVPSKCVKS

SEQ ID NO: 2795892 - protein, 23 aa, Entamoeba invadens
KILENIGRLGLREITINTVECRG

SEQ ID NO: 2795893 - protein, 27 aa, Entamoeba invadens
KILGLSRGCVFCRCTPKQKEKLASFVN

SEQ ID NO: 2795894 - protein, 18 aa, Entamoeba invadens
KILLRRRNLKVFNDEDNL

SEQ ID NO: 2795895 - protein, 24 aa, Entamoeba invadens
KILPELFLKIPMLIKANNDTFYSN

SEQ ID NO: 2795896 - protein, 23 aa, Entamoeba invadens
KILPVFQLRIARPPATVKDIRML

SEQ ID NO: 2795897 - protein, 20 aa, Entamoeba invadens
KILQIFDVRLYYFFYSTTNL

SEQ ID NO: 2795898 - protein, 19 aa, Entamoeba invadens
KILRSKGFFTPKAQPTEAE

SEQ ID NO: 2795899 - protein, 22 aa, Entamoeba invadens
KIMKDVPLVLGLAHSSIPHADK

SEQ ID NO: 2795900 - protein, 26 aa, Entamoeba invadens
KIMRVIRFCIQYEGIFSIVVSTLQEN

SEQ ID NO: 2795901 - protein, 17 aa, Entamoeba invadens
KIMYGQGMKVFSSNSVY

SEQ ID NO: 2795902 - protein, 20 aa, Entamoeba invadens
KINECKGMTFLKDTSKMLSY

SEQ ID NO: 2795903 - protein, 20 aa, Entamoeba invadens
KINGKCILHGGGRDVEVTNN

SEQ ID NO: 2795904 - protein, 19 aa, Entamoeba invadens
KINGVAFLHLYKSHITLNN

SEQ ID NO: 2795905 - protein, 17 aa, Entamoeba invadens
KINIPFDTYKVFFYFRL

SEQ ID NO: 2795906 - protein, 24 aa, Entamoeba invadens
KINIPFREIVAFYVKPEKSSMLLS

SEQ ID NO: 2795907 - protein, 17 aa, Entamoeba invadens
KINRSNISFPFEVCESL

SEQ ID NO: 2795908 - protein, 17 aa, Entamoeba invadens
KINRYLRKYLYTNYQAI

SEQ ID NO: 2795909 - protein, 19 aa, Entamoeba invadens
KIPDFANLMTMVVKTSISA

SEQ ID NO: 2795910 - protein, 24 aa, Entamoeba invadens
KIPITLRFGKLSNLYKEIQKDHPD

SEQ ID NO: 2795911 - protein, 25 aa, Entamoeba invadens
KIPKDCRNNQCIPRYPVTCLEEELF

SEQ ID NO: 2795912 - protein, 22 aa, Entamoeba invadens
KIPLKILRTKMCILPQEATMFS

SEQ ID NO: 2795913 - protein, 20 aa, Entamoeba invadens
KIPPSEFLNQGWTKKNKEEL

SEQ ID NO: 2795914 - protein, 18 aa, Entamoeba invadens
KIPRSVFSGMMMVYSFGL

SEQ ID NO: 2795915 - protein, 26 aa, Entamoeba invadens
KIPSEIKSTLFLSLIIRMVNINQQDK

SEQ ID NO: 2795916 - protein, 27 aa, Entamoeba invadens
KIQFEFLVPFLPLIAWQLSHVDLSWTL

SEQ ID NO: 2795917 - protein, 18 aa, Entamoeba invadens
KIQGSVFINECITDLFEV

SEQ ID NO: 2795918 - protein, 24 aa, Entamoeba invadens
KIQKCNYLKFEVLNNANDANYITL

SEQ ID NO: 2795919 - protein, 25 aa, Entamoeba invadens
KIQLSVWLFYKLSDSIKVETMNKTN

SEQ ID NO: 2795920 - protein, 33 aa, Entamoeba invadens
KIQNCTSFSPTGCLKCSLGSYLSDNICLPCDSF

SEQ ID NO: 2795921 - protein, 33 aa, Entamoeba invadens
KIQNNFGAFCSLDFNSTQTFGFLSNCGTLIFSE

SEQ ID NO: 2795922 - protein, 23 aa, Entamoeba invadens
KIQRKDWLGFCTILDAKYEELDQ

SEQ ID NO: 2795923 - protein, 17 aa, Entamoeba invadens
KIQSFEILHIDFINTQR

SEQ ID NO: 2795924 - protein, 17 aa, Entamoeba invadens
KIRCPYIAGYIGSITYI

SEQ ID NO: 2795925 - protein, 24 aa, Entamoeba invadens
KIRDMKIPFTLWFSKNRQTLTEIA

SEQ ID NO: 2795926 - protein, 22 aa, Entamoeba invadens
KIRELKIPYTVWFSKSLSTLKQ

SEQ ID NO: 2795927 - protein, 21 aa, Entamoeba invadens
KIRLPPKRMLRVSTCNSDTTV

SEQ ID NO: 2795928 - protein, 17 aa, Entamoeba invadens
KIRMEPQIVTLKKQFAC

SEQ ID NO: 2795929 - protein, 25 aa, Entamoeba invadens
KIRNFMFKNCIKLKDVIIKKGVVKI

SEQ ID NO: 2795930 - protein, 25 aa, Entamoeba invadens
KIRNFMFKNCIKLKDVIINNGVVKI

SEQ ID NO: 2795931 - protein, 26 aa, Entamoeba invadens
KIRRLWLQVIGTLAFFGFHGVVEFIW

SEQ ID NO: 2795932 - protein, 19 aa, Entamoeba invadens
KIRTEPSIVILKRNFACEF

SEQ ID NO: 2795933 - protein, 19 aa, Entamoeba invadens
KISLFSLTVCSVLMVNIWS

SEQ ID NO: 2795934 - protein, 18 aa, Entamoeba invadens
KISSLLKLIYIDFKTAKE

SEQ ID NO: 2795935 - protein, 27 aa, Entamoeba invadens
KISTLMKVRFCQDIALGMGYLHQNDIV

SEQ ID NO: 2795936 - protein, 17 aa, Entamoeba invadens
KITEIKIRLNARTKQTT

SEQ ID NO: 2795937 - protein, 17 aa, Entamoeba invadens
KITGIKNTLLFGDNSTQ

SEQ ID NO: 2795938 - protein, 20 aa, Entamoeba invadens
KITITKSGFDKTIPITVDID

SEQ ID NO: 2795939 - protein, 25 aa, Entamoeba invadens
KITLLRFLLQNVMEITRENSIVLFP

SEQ ID NO: 2795940 - protein, 20 aa, Entamoeba invadens
KITLQNCKHISFVNSSEICL

SEQ ID NO: 2795941 - protein, 23 aa, Entamoeba invadens
KITVLKTPLGVILDMNKLTGIGA

SEQ ID NO: 2795942 - protein, 22 aa, Entamoeba invadens
KITVVGGFLIFLAMSSLMTLKC

SEQ ID NO: 2795943 - protein, 17 aa, Entamoeba invadens
KIVESMIISGAPIYVVV

SEQ ID NO: 2795944 - protein, 20 aa, Entamoeba invadens
KIVFPSALLFVLAFGLINKK

SEQ ID NO: 2795945 - protein, 25 aa, Entamoeba invadens
KIVFRGNGKMTLRCSTGEWDDECWF

SEQ ID NO: 2795946 - protein, 25 aa, Entamoeba invadens
KIVFVLKLYYAYGFLMSVFLQITIL

SEQ ID NO: 2795947 - protein, 24 aa, Entamoeba invadens
KIVKQFSFVYSRLVVVGFLIISGL

SEQ ID NO: 2795948 - protein, 18 aa, Entamoeba invadens
KIVTRKNFHFTFDTTQII

SEQ ID NO: 2795949 - protein, 18 aa, Entamoeba invadens
KIWFEALQDKTLIILIVA

SEQ ID NO: 2795950 - protein, 19 aa, Entamoeba invadens
KIYCIFYIIMFFVIFPVYV

SEQ ID NO: 2795951 - protein, 24 aa, Entamoeba invadens
KIYHIPKTVLLYMIELFDQLHSNM

SEQ ID NO: 2795952 - protein, 18 aa, Entamoeba invadens
KIYKGGYMTSIRWLCEEK

SEQ ID NO: 2795953 - protein, 22 aa, Entamoeba invadens
KIYKKIGWDKMSWETRVAEVQK

SEQ ID NO: 2795954 - protein, 31 aa, Entamoeba invadens
KIYYANNVCQRWLGVRVELVGCLSLGAIVTV

SEQ ID NO: 2795955 - protein, 37 aa, Entamoeba invadens
KIYYANNVCQRWLGVRVEMIGCVGLGSVIIFSAIQIA

SEQ ID NO: 2795956 - protein, 21 aa, Entamoeba invadens
KKAHIKLILNMHLNQEGYASQ

SEQ ID NO: 2795957 - protein, 26 aa, Entamoeba invadens
KKAIEIRKTLGLKYVVVLASSQNVNQ

SEQ ID NO: 2795958 - protein, 20 aa, Entamoeba invadens
KKALEFFNVLSRLDGVDPLY

SEQ ID NO: 2795959 - protein, 24 aa, Entamoeba invadens
KKARIMAQLSWAFIVMTWVFAVFT

SEQ ID NO: 2795960 - protein, 17 aa, Entamoeba invadens
KKARVWMSDSDIQFIMK

SEQ ID NO: 2795961 - protein, 23 aa, Entamoeba invadens
KKASVKMGFSILITLGIVCGAFS

SEQ ID NO: 2795962 - protein, 18 aa, Entamoeba invadens
KKAVWWVILIIILFIILN

SEQ ID NO: 2795963 - protein, 21 aa, Entamoeba invadens
KKAVWWVLFIVVLFVIIVMAA

SEQ ID NO: 2795964 - protein, 21 aa, Entamoeba invadens
KKAWWKYVVNAVKILKAQNTT

SEQ ID NO: 2795965 - protein, 17 aa, Entamoeba invadens
KKCDDRAVLKDGICSNE

SEQ ID NO: 2795966 - protein, 31 aa, Entamoeba invadens
KKCDEKCLFCLRGVCSICASNSILINEKCQS

SEQ ID NO: 2795967 - protein, 17 aa, Entamoeba invadens
KKCESEIGCSVCDDGYY

SEQ ID NO: 2795968 - protein, 20 aa, Entamoeba invadens
KKCFAQLRPNTAIIVTACCF

SEQ ID NO: 2795969 - protein, 21 aa, Entamoeba invadens
KKCICKDGFGGDDCHSLCFFN

SEQ ID NO: 2795970 - protein, 17 aa, Entamoeba invadens
KKCLKCQPSNYLLNGKC

SEQ ID NO: 2795971 - protein, 17 aa, Entamoeba invadens
KKCLKCQPSNYLLNVKC

SEQ ID NO: 2795972 - protein, 23 aa, Entamoeba invadens
KKCSKKFFGCYSCEYSPDDGTFN

SEQ ID NO: 2795973 - protein, 17 aa, Entamoeba invadens
KKCTYAFNTNDQVDVKS

SEQ ID NO: 2795974 - protein, 20 aa, Entamoeba invadens
KKCVCNPGYGGDDCHKLCYY

SEQ ID NO: 2795975 - protein, 23 aa, Entamoeba invadens
KKCVKGNCPDMYFKDNAEKMCKR

SEQ ID NO: 2795976 - protein, 27 aa, Entamoeba invadens
KKCVKGNCPEMYFKDGAEKMCKRCTDG

SEQ ID NO: 2795977 - protein, 25 aa, Entamoeba invadens
KKCVKGNCPEMYFKDNAGKMCKRCT

SEQ ID NO: 2795978 - protein, 23 aa, Entamoeba invadens
KKCVKGNCPEMYFKDNEEKICKR

SEQ ID NO: 2795979 - protein, 24 aa, Entamoeba invadens
KKDCPDGYFAKDKVCTACVADCKT

SEQ ID NO: 2795980 - protein, 24 aa, Entamoeba invadens
KKDCPEAYFAKDKVCTACVDDCKT

SEQ ID NO: 2795981 - protein, 19 aa, Entamoeba invadens
KKDECLSCKEGYFKIPSES

SEQ ID NO: 2795982 - protein, 21 aa, Entamoeba invadens
KKDFTYPWKIAEFVIEGKRQN

SEQ ID NO: 2795983 - protein, 18 aa, Entamoeba invadens
KKDFYLKNLECISNSDDV

SEQ ID NO: 2795984 - protein, 23 aa, Entamoeba invadens
KKDKVCGKLVFLMMKNIEEQEKE

SEQ ID NO: 2795985 - protein, 19 aa, Entamoeba invadens
KKDLTPCCVIPVVNSVPRL

SEQ ID NO: 2795986 - protein, 18 aa, Entamoeba invadens
KKDVEGLSILLFLMSTIA

SEQ ID NO: 2795987 - protein, 26 aa, Entamoeba invadens
KKDYEMWKRKKVNINLVMDGESLESA

SEQ ID NO: 2795988 - protein, 23 aa, Entamoeba invadens
KKEAEKILDLFSYIRIDTKDDEV

SEQ ID NO: 2795989 - protein, 19 aa, Entamoeba invadens
KKEETCFEKQMVTPKNEKK

SEQ ID NO: 2795990 - protein, 18 aa, Entamoeba invadens
KKEGYCMSNSASSGFNFI

SEQ ID NO: 2795991 - protein, 24 aa, Entamoeba invadens
KKEKDVLAVFDFIPKGMVKAELAP

SEQ ID NO: 2795992 - protein, 25 aa, Entamoeba invadens
KKEKKTQIEIGRCFRFNSLPLQFCM

SEQ ID NO: 2795993 - protein, 25 aa, Entamoeba invadens
KKENIAVMLFPIVWYAIDEKNYFER

SEQ ID NO: 2795994 - protein, 18 aa, Entamoeba invadens
KKESRFSLSSLKLTDLDN

SEQ ID NO: 2795995 - protein, 25 aa, Entamoeba invadens
KKEVDWKRDGIIAVLCEGVQKESLK

SEQ ID NO: 2795996 - protein, 32 aa, Entamoeba invadens
KKEVKRILWVIAFRSCMNFIVWAIPPAVSFAT

SEQ ID NO: 2795997 - protein, 30 aa, Entamoeba invadens
KKEVKRILWVIAFRSCMNFIVWAIPPTVSF

SEQ ID NO: 2795998 - protein, 28 aa, Entamoeba invadens
KKEVKRILWVIAFRSCMNFIVWAIPTTV

SEQ ID NO: 2795999 - protein, 25 aa, Entamoeba invadens
KKFGKKVSVRNCLAWTDFMNCCTSI

SEQ ID NO: 2796000 - protein, 21 aa, Entamoeba invadens
KKFGPIVEMMRTANWCHETVN

SEQ ID NO: 2796001 - protein, 17 aa, Entamoeba invadens
KKFIIRKTLPFLHIDKC

SEQ ID NO: 2796002 - protein, 21 aa, Entamoeba invadens
KKFNCNICPTGTYANSTNNKC

SEQ ID NO: 2796003 - protein, 25 aa, Entamoeba invadens
KKFNTDWIEGVAILAAVLVASLGSS

SEQ ID NO: 2796004 - protein, 21 aa, Entamoeba invadens
KKFTDEFFEIMSGFESDVQYL

SEQ ID NO: 2796005 - protein, 17 aa, Entamoeba invadens
KKFYRERSIGLERKNSE

SEQ ID NO: 2796006 - protein, 22 aa, Entamoeba invadens
KKGEACEFEIYILPMCTSNTED

SEQ ID NO: 2796007 - protein, 25 aa, Entamoeba invadens
KKGEACEFELYIKPLCCCEIKEDIM

SEQ ID NO: 2796008 - protein, 18 aa, Entamoeba invadens
KKGELVCVLGSVGSGKSS

SEQ ID NO: 2796009 - protein, 18 aa, Entamoeba invadens
KKGELVCVLGSVGSGKTF

SEQ ID NO: 2796010 - protein, 19 aa, Entamoeba invadens
KKGFACEFEIFIKPICKCV

SEQ ID NO: 2796011 - protein, 19 aa, Entamoeba invadens
KKGFACEFEIFIKPVCTCN

SEQ ID NO: 2796012 - protein, 18 aa, Entamoeba invadens
KKGFCVVEPVFNLREATT

SEQ ID NO: 2796013 - protein, 19 aa, Entamoeba invadens
KKGIACEFEIFIKPVCTCN

SEQ ID NO: 2796014 - protein, 20 aa, Entamoeba invadens
KKGLLRRHGSLLLYLHDIYD

SEQ ID NO: 2796015 - protein, 21 aa, Entamoeba invadens
KKGNEVKCMVQMCYLSNHLEP

SEQ ID NO: 2796016 - protein, 24 aa, Entamoeba invadens
KKGRLRKVPTCVLSVLYEMVKMTQ

SEQ ID NO: 2796017 - protein, 19 aa, Entamoeba invadens
KKGVISFTKPLMIPTISGV

SEQ ID NO: 2796018 - protein, 18 aa, Entamoeba invadens
KKHIEKCVIENYIENNNC

SEQ ID NO: 2796019 - protein, 25 aa, Entamoeba invadens
KKHLYLKIYDLFWGHTNIPFKFIEN

SEQ ID NO: 2796020 - protein, 23 aa, Entamoeba invadens
KKHPNLFNLFLFRRSVKQIMKGR

SEQ ID NO: 2796021 - protein, 20 aa, Entamoeba invadens
KKIKFKQYDSVYGIIAEENT

SEQ ID NO: 2796022 - protein, 20 aa, Entamoeba invadens
KKIKVAKKMWDDLKSGKKDE

SEQ ID NO: 2796023 - protein, 19 aa, Entamoeba invadens
KKIMKEVSLVLGLAHSLIP

SEQ ID NO: 2796024 - protein, 22 aa, Entamoeba invadens
KKINEWFDLIFGKKMKDKTYPE

SEQ ID NO: 2796025 - protein, 17 aa, Entamoeba invadens
KKINVLVLKSFSMSNVL

SEQ ID NO: 2796026 - protein, 17 aa, Entamoeba invadens
KKIPLALLKKVSMKKAT

SEQ ID NO: 2796027 - protein, 22 aa, Entamoeba invadens
KKIRRRFFIFVGILVAVLTLPV

SEQ ID NO: 2796028 - protein, 19 aa, Entamoeba invadens
KKITDSGCEQCEDGFYLKD

SEQ ID NO: 2796029 - protein, 21 aa, Entamoeba invadens
KKITPLIPILALNGNGSGDVK

SEQ ID NO: 2796030 - protein, 31 aa, Entamoeba invadens
KKIVFKFKGTPFARLTFNITIEEYNPLIYWA

SEQ ID NO: 2796031 - protein, 21 aa, Entamoeba invadens
KKKCIKCKLNYIVNITGNCEA

SEQ ID NO: 2796032 - protein, 18 aa, Entamoeba invadens
KKKDPKIRERLGIEEESL

SEQ ID NO: 2796033 - protein, 25 aa, Entamoeba invadens
KKKEFKFPWKIAEFVINGNRLEKPE

SEQ ID NO: 2796034 - protein, 19 aa, Entamoeba invadens
KKKERVCVFKISRSNVLMN

SEQ ID NO: 2796035 - protein, 19 aa, Entamoeba invadens
KKKFPLEVFKETMKQIPNN

SEQ ID NO: 2796036 - protein, 17 aa, Entamoeba invadens
KKKIGWIATIGNLICGV

SEQ ID NO: 2796037 - protein, 21 aa, Entamoeba invadens
KKKIIIWDRINPVVVIDPIDI

SEQ ID NO: 2796038 - protein, 20 aa, Entamoeba invadens
KKKKGVSFLSALCLSKSMKP

SEQ ID NO: 2796039 - protein, 22 aa, Entamoeba invadens
KKKKIAIIHIWKEKVFEEKRKL

SEQ ID NO: 2796040 - protein, 19 aa, Entamoeba invadens
KKKKLRFSISNLQNQYYAS

SEQ ID NO: 2796041 - protein, 21 aa, Entamoeba invadens
KKKLFEIALFTAAIMDEGIQP

SEQ ID NO: 2796042 - protein, 17 aa, Entamoeba invadens
KKKLPLGFKYLQKKINV

SEQ ID NO: 2796043 - protein, 19 aa, Entamoeba invadens
KKKMEDFLQIFAFCQNKQL

SEQ ID NO: 2796044 - protein, 22 aa, Entamoeba invadens
KKKVHFAICSALSIASVFYLLV

SEQ ID NO: 2796045 - protein, 18 aa, Entamoeba invadens
KKKYLSFLSEDYRASIIM

SEQ ID NO: 2796046 - protein, 21 aa, Entamoeba invadens
KKKYSEKLLGVWYQYTAPVNG

SEQ ID NO: 2796047 - protein, 30 aa, Entamoeba invadens
KKKYWWKNAKLWVMIVICLIVVLCLVGGVV

SEQ ID NO: 2796048 - protein, 19 aa, Entamoeba invadens
KKLALSKIEKCVITEEIRL

SEQ ID NO: 2796049 - protein, 29 aa, Entamoeba invadens
KKLDDIRRFCAKFGWYMSALQLFDTFIPL

SEQ ID NO: 2796050 - protein, 23 aa, Entamoeba invadens
KKLETRTAAGIAVEAMAKNVPAV

SEQ ID NO: 2796051 - protein, 25 aa, Entamoeba invadens
KKLIKSLMCVSLYKKCDIETPVVYE

SEQ ID NO: 2796052 - protein, 18 aa, Entamoeba invadens
KKLLDMFSTYAIDSSLPK

SEQ ID NO: 2796053 - protein, 18 aa, Entamoeba invadens
KKLLPSKSICAFCESHFF

SEQ ID NO: 2796054 - protein, 17 aa, Entamoeba invadens
KKLPVDFEKCIKVDSVV

SEQ ID NO: 2796055 - protein, 21 aa, Entamoeba invadens
KKLRHPCVLQFFGSGTDANYI

SEQ ID NO: 2796056 - protein, 23 aa, Entamoeba invadens
KKLSGRKGVQQTISFEVDQGCLF

SEQ ID NO: 2796057 - protein, 19 aa, Entamoeba invadens
KKLVKKLCQTFDGCKSVFL

SEQ ID NO: 2796058 - protein, 23 aa, Entamoeba invadens
KKLYRNVFLSVYFDLFHFLISIA

SEQ ID NO: 2796059 - protein, 18 aa, Entamoeba invadens
KKMAILCKNVKRRHYENF

SEQ ID NO: 2796060 - protein, 17 aa, Entamoeba invadens
KKMDEFRKEVAMLAKFV

SEQ ID NO: 2796061 - protein, 29 aa, Entamoeba invadens
KKMDEFRKEVAMLAKFVSPYVIRFYGACF

SEQ ID NO: 2796062 - protein, 21 aa, Entamoeba invadens
KKMENICVFKMGRSNIAMSVL

SEQ ID NO: 2796063 - protein, 21 aa, Entamoeba invadens
KKMENICVFKMNRSNITMSVL

SEQ ID NO: 2796064 - protein, 19 aa, Entamoeba invadens
KKMERLFLAFVAMRQISLF

SEQ ID NO: 2796065 - protein, 18 aa, Entamoeba invadens
KKMINICVFQMKKSNIHF

SEQ ID NO: 2796066 - protein, 21 aa, Entamoeba invadens
KKMIVMEFIKNGSLETIIKKY

SEQ ID NO: 2796067 - protein, 22 aa, Entamoeba invadens
KKMKSLCKDVRRRHYDNLVITT

SEQ ID NO: 2796068 - protein, 23 aa, Entamoeba invadens
KKMKSLCKDVRRRHYDNLVITTD

SEQ ID NO: 2796069 - protein, 18 aa, Entamoeba invadens
KKMNVVFLILFIGAFSTY

SEQ ID NO: 2796070 - protein, 19 aa, Entamoeba invadens
KKMQNVCVFKMSRSNISMI

SEQ ID NO: 2796071 - protein, 24 aa, Entamoeba invadens
KKNCPEAYFAKDKVCTACVDDCKT

SEQ ID NO: 2796072 - protein, 27 aa, Entamoeba invadens
KKNKWSLFCSFEFLLLGFGNSTFFVIF

SEQ ID NO: 2796073 - protein, 19 aa, Entamoeba invadens
KKNMGFDDFCVYLEMLPKP

SEQ ID NO: 2796074 - protein, 19 aa, Entamoeba invadens
KKNSCSKGVDFCEEAKWSF

SEQ ID NO: 2796075 - protein, 18 aa, Entamoeba invadens
KKNSHVWNDLIGVTGTYG

SEQ ID NO: 2796076 - protein, 23 aa, Entamoeba invadens
KKNWKCVFPNCNEPLKTRFNCYA

SEQ ID NO: 2796077 - protein, 19 aa, Entamoeba invadens
KKPADIFSFAITMYECIGW

SEQ ID NO: 2796078 - protein, 17 aa, Entamoeba invadens
KKPADVFSFAITMYECF

SEQ ID NO: 2796079 - protein, 19 aa, Entamoeba invadens
KKPADVFSFAITMYETISW

SEQ ID NO: 2796080 - protein, 24 aa, Entamoeba invadens
KKPESLSITFLVMWLGGDLTNLIG

SEQ ID NO: 2796081 - protein, 30 aa, Entamoeba invadens
KKPFLERLKAFPLWFCKQWTRTDPEGASLF

SEQ ID NO: 2796082 - protein, 19 aa, Entamoeba invadens
KKPRFEAVEEHCSIQSKEI

SEQ ID NO: 2796083 - protein, 18 aa, Entamoeba invadens
KKQDKGMMWLNAIILTLL

SEQ ID NO: 2796084 - protein, 20 aa, Entamoeba invadens
KKQEEPECDLVLEIMSATEF

SEQ ID NO: 2796085 - protein, 24 aa, Entamoeba invadens
KKQHEILMVLPLRERVRLARRFDL

SEQ ID NO: 2796086 - protein, 18 aa, Entamoeba invadens
KKQPNFVFFPFASNCAKK

SEQ ID NO: 2796087 - protein, 21 aa, Entamoeba invadens
KKQQCLDCINPYYLKSENSCL

SEQ ID NO: 2796088 - protein, 21 aa, Entamoeba invadens
KKRAFPLCHIVSSEVIRDIPK

SEQ ID NO: 2796089 - protein, 28 aa, Entamoeba invadens
KKREQSPRMAVKMKFMLDMANGIVYLHS

SEQ ID NO: 2796090 - protein, 25 aa, Entamoeba invadens
KKREQSPRMAVKVKFMLDMAKGISY

SEQ ID NO: 2796091 - protein, 24 aa, Entamoeba invadens
KKRFKHPWEIADFVGKGNHLTYDE

SEQ ID NO: 2796092 - protein, 24 aa, Entamoeba invadens
KKRFKHPWEIANFIGKGDHLTYNE

SEQ ID NO: 2796093 - protein, 19 aa, Entamoeba invadens
KKRIDCSVSPSFEEKRRTK

SEQ ID NO: 2796094 - protein, 20 aa, Entamoeba invadens
KKRIEKNICCLVQEDAFENV

SEQ ID NO: 2796095 - protein, 27 aa, Entamoeba invadens
KKRISLIKAVRAWLNLIIFILLYYSEV

SEQ ID NO: 2796096 - protein, 21 aa, Entamoeba invadens
KKRRYSWSEKVGNFFHKKEKT

SEQ ID NO: 2796097 - protein, 19 aa, Entamoeba invadens
KKRSVVSIVPKLGKALELD

SEQ ID NO: 2796098 - protein, 32 aa, Entamoeba invadens
KKSDAFHMLGLCRIQFIGVLGFSPNFILFNNP

SEQ ID NO: 2796099 - protein, 20 aa, Entamoeba invadens
KKSDETFCVSNFPDENDDIK

SEQ ID NO: 2796100 - protein, 25 aa, Entamoeba invadens
KKSDTRFTYPWGVADYVCSGLRLEK

SEQ ID NO: 2796101 - protein, 27 aa, Entamoeba invadens
KKSEWLRIRATPAFWLKKGTLVVKPNY

SEQ ID NO: 2796102 - protein, 25 aa, Entamoeba invadens
KKSFEDFKGWIGIAERIGTPRVVVI

SEQ ID NO: 2796103 - protein, 22 aa, Entamoeba invadens
KKSGSSKILLAIFFVLTGVTVA

SEQ ID NO: 2796104 - protein, 18 aa, Entamoeba invadens
KKSLTIPGAIFAFATAML

SEQ ID NO: 2796105 - protein, 21 aa, Entamoeba invadens
KKSRLEKNIAVAYSLSMIYSM

SEQ ID NO: 2796106 - protein, 19 aa, Entamoeba invadens
KKSRLLLVLDNLFYLHPEL

SEQ ID NO: 2796107 - protein, 41 aa, Entamoeba invadens
KKSSLLFGIIFKCLVCLYVCCGLCLFAAVRIHYTVDILVGA

SEQ ID NO: 2796108 - protein, 26 aa, Entamoeba invadens
KKSTECVECLFGTILKEGKCVSKSEG

SEQ ID NO: 2796109 - protein, 21 aa, Entamoeba invadens
KKSVCGALCGFYVNERGILDD

SEQ ID NO: 2796110 - protein, 20 aa, Entamoeba invadens
KKTCAEFASLVSKTGLGGEH

SEQ ID NO: 2796111 - protein, 21 aa, Entamoeba invadens
KKTCAEFASLVSKTGLGGEHS

SEQ ID NO: 2796112 - protein, 21 aa, Entamoeba invadens
KKTMLRFLIRSSKKKAFRTIK

SEQ ID NO: 2796113 - protein, 36 aa, Entamoeba invadens
KKTMYPKIVYPFAIVFDITLRFAWVLNLVVIYCNWF

SEQ ID NO: 2796114 - protein, 20 aa, Entamoeba invadens
KKTRELICVGNISKNTIKVQ

SEQ ID NO: 2796115 - protein, 19 aa, Entamoeba invadens
KKTSECLSDIEVDITNSQE

SEQ ID NO: 2796116 - protein, 18 aa, Entamoeba invadens
KKTTARVTIHITQGNQCK

SEQ ID NO: 2796117 - protein, 18 aa, Entamoeba invadens
KKTTCYFLANTEAFTENT

SEQ ID NO: 2796118 - protein, 19 aa, Entamoeba invadens
KKTTQLIRVTELVYPDKTT

SEQ ID NO: 2796119 - protein, 27 aa, Entamoeba invadens
KKTVIFCVCTFYLALVIIACWTYNIYV

SEQ ID NO: 2796120 - protein, 24 aa, Entamoeba invadens
KKVAKRYVSQFVMKMEESRRSVAG

SEQ ID NO: 2796121 - protein, 26 aa, Entamoeba invadens
KKVDPLCPFVPFKIVEPLLTNTLFKN

SEQ ID NO: 2796122 - protein, 23 aa, Entamoeba invadens
KKVEGKMLRGIVFTEEVMIGFEK

SEQ ID NO: 2796123 - protein, 25 aa, Entamoeba invadens
KKVGDSKCTKCSFWHTPSVDGTYCK

SEQ ID NO: 2796124 - protein, 17 aa, Entamoeba invadens
KKVGIALGVVFGVILLC

SEQ ID NO: 2796125 - protein, 20 aa, Entamoeba invadens
KKVKAISFGFGEKIKKVATK

SEQ ID NO: 2796126 - protein, 19 aa, Entamoeba invadens
KKVKCSNVLSSFRSKEYKN

SEQ ID NO: 2796127 - protein, 17 aa, Entamoeba invadens
KKVKYLCHKTGYKCLDA

SEQ ID NO: 2796128 - protein, 19 aa, Entamoeba invadens
KKVLCDDIAKIWDGVVRPE

SEQ ID NO: 2796129 - protein, 18 aa, Entamoeba invadens
KKVLKFVTIPFLWISKMY

SEQ ID NO: 2796130 - protein, 18 aa, Entamoeba invadens
KKVLPSGCDMCNDGFFVD

SEQ ID NO: 2796131 - protein, 26 aa, Entamoeba invadens
KKVLRNCALIHLLRTILWTVNEPIES

SEQ ID NO: 2796132 - protein, 22 aa, Entamoeba invadens
KKVMKLRMKFLLDAAKGIQYLD

SEQ ID NO: 2796133 - protein, 18 aa, Entamoeba invadens
KKVMWWVILMGVILILIV

SEQ ID NO: 2796134 - protein, 23 aa, Entamoeba invadens
KKVNIKLAISLPVAIIILLIVLL

SEQ ID NO: 2796135 - protein, 22 aa, Entamoeba invadens
KKVPKRRVGEENLLLKDNLKSQ

SEQ ID NO: 2796136 - protein, 27 aa, Entamoeba invadens
KKVSPIKGGGCYICKDGFYRGDDQICR

SEQ ID NO: 2796137 - protein, 20 aa, Entamoeba invadens
KKVTLRNCHDPINLEHLSQL

SEQ ID NO: 2796138 - protein, 19 aa, Entamoeba invadens
KKVVGLKLSKVMLNTYGDE

SEQ ID NO: 2796139 - protein, 18 aa, Entamoeba invadens
KKVVWWVVLIVVIFIVVI

SEQ ID NO: 2796140 - protein, 22 aa, Entamoeba invadens
KKVYQRMIAIFKMAFSKEYQGL

SEQ ID NO: 2796141 - protein, 27 aa, Entamoeba invadens
KKWLKNVGVVFKGFFDSVVNDKFKRGD

SEQ ID NO: 2796142 - protein, 23 aa, Entamoeba invadens
KKWSAQIPTKWGLNQVEMNTFKP

SEQ ID NO: 2796143 - protein, 24 aa, Entamoeba invadens
KKYARRGFYISVHRNNIFQDSFSQ

SEQ ID NO: 2796144 - protein, 23 aa, Entamoeba invadens
KKYDIRFTPFRGVIRPKSEKDVK

SEQ ID NO: 2796145 - protein, 22 aa, Entamoeba invadens
KKYENWMFPNLMIGNHDLPRIG

SEQ ID NO: 2796146 - protein, 19 aa, Entamoeba invadens
KKYHFCFTLRNTTRTVMLY

SEQ ID NO: 2796147 - protein, 22 aa, Entamoeba invadens
KKYIKVKKYRAFNFKETGEKKV

SEQ ID NO: 2796148 - protein, 28 aa, Entamoeba invadens
KKYIYLCCMLFVNGLFFITFFRFILLNF

SEQ ID NO: 2796149 - protein, 20 aa, Entamoeba invadens
KKYKMPADVFSFAITMYDIF

SEQ ID NO: 2796150 - protein, 19 aa, Entamoeba invadens
KKYPESVLKHMSENFDFVK

SEQ ID NO: 2796151 - protein, 31 aa, Entamoeba invadens
KKYTERKCWAYWQHLMFGYANLKDDFEKEKG

SEQ ID NO: 2796152 - protein, 19 aa, Entamoeba invadens
KKYTTLQFYMVFESKDNAP

SEQ ID NO: 2796153 - protein, 19 aa, Entamoeba invadens
KKYYLRWHSSLFVIISATY

SEQ ID NO: 2796154 - protein, 20 aa, Entamoeba invadens
KLAELSGVVMGFGFSGYQNG

SEQ ID NO: 2796155 - protein, 18 aa, Entamoeba invadens
KLAFGYKQIEVIGERINA

SEQ ID NO: 2796156 - protein, 20 aa, Entamoeba invadens
KLANVYFLIISIFQAIPGLS

SEQ ID NO: 2796157 - protein, 21 aa, Entamoeba invadens
KLCSIHEFYDMISDRYKDNEK

SEQ ID NO: 2796158 - protein, 18 aa, Entamoeba invadens
KLCSSKFENCEECIFKRC

SEQ ID NO: 2796159 - protein, 22 aa, Entamoeba invadens
KLEFKCFCNCCNMSKIDIPNSV

SEQ ID NO: 2796160 - protein, 23 aa, Entamoeba invadens
KLELYAICFIVLIYAEKNTKSLE

SEQ ID NO: 2796161 - protein, 23 aa, Entamoeba invadens
KLERKRFVGNDVVVLVFKEKENS

SEQ ID NO: 2796162 - protein, 24 aa, Entamoeba invadens
KLEYEILNVFPFSSTTKRMGIILR

SEQ ID NO: 2796163 - protein, 19 aa, Entamoeba invadens
KLFAGRPRPFFFNGCDHSK

SEQ ID NO: 2796164 - protein, 24 aa, Entamoeba invadens
KLFAGRPRPNFYAVYDAGDQADAY

SEQ ID NO: 2796165 - protein, 24 aa, Entamoeba invadens
KLFHFPWDIATFIAKGGRRPKTPN

SEQ ID NO: 2796166 - protein, 23 aa, Entamoeba invadens
KLFILCVVFSFLLMDIATELNVF

SEQ ID NO: 2796167 - protein, 19 aa, Entamoeba invadens
KLFILIPEMDYKQYSVAFT

SEQ ID NO: 2796168 - protein, 23 aa, Entamoeba invadens
KLFLKVGVPILVIFFVIIFGTIS

SEQ ID NO: 2796169 - protein, 24 aa, Entamoeba invadens
KLFRMCKRYKPDYDVVCQLNNESY

SEQ ID NO: 2796170 - protein, 19 aa, Entamoeba invadens
KLGAITHFRSTSGNLPFSR

SEQ ID NO: 2796171 - protein, 17 aa, Entamoeba invadens
KLGDSFRNENFLLAVRT

SEQ ID NO: 2796172 - protein, 19 aa, Entamoeba invadens
KLGKCYPCNLFDANCTECN

SEQ ID NO: 2796173 - protein, 19 aa, Entamoeba invadens
KLGKCYPCNLFDANCVECN

SEQ ID NO: 2796174 - protein, 22 aa, Entamoeba invadens
KLGRIPYFYLFLVALFTAVVTS

SEQ ID NO: 2796175 - protein, 20 aa, Entamoeba invadens
KLGSCIIALICERSVETCKD

SEQ ID NO: 2796176 - protein, 21 aa, Entamoeba invadens
KLGSPFGGGVYVWTNDNVKNW

SEQ ID NO: 2796177 - protein, 19 aa, Entamoeba invadens
KLGTCKICADGYYKSSYGI

SEQ ID NO: 2796178 - protein, 19 aa, Entamoeba invadens
KLGVLAALYIPTLLLTQPL

SEQ ID NO: 2796179 - protein, 20 aa, Entamoeba invadens
KLHEVLVFNVDIWKNFYTIY

SEQ ID NO: 2796180 - protein, 24 aa, Entamoeba invadens
KLHKEVYDWFDIAFNYFGRTSTEK

SEQ ID NO: 2796181 - protein, 30 aa, Entamoeba invadens
KLIEKRLLTLLSLIAFRLDVHVAKRNLKGV

SEQ ID NO: 2796182 - protein, 18 aa, Entamoeba invadens
KLIFKEAAVFVVDTPELA

SEQ ID NO: 2796183 - protein, 19 aa, Entamoeba invadens
KLINFSLQVLRTFGLNLTT

SEQ ID NO: 2796184 - protein, 19 aa, Entamoeba invadens
KLISVFGASMLVDLVGYLL

SEQ ID NO: 2796185 - protein, 34 aa, Entamoeba invadens
KLKCDSFSKSGGCVICKRGYYRVVLDCYDCDVKC

SEQ ID NO: 2796186 - protein, 20 aa, Entamoeba invadens
KLKCSCRVNAQLVVNIQHQE

SEQ ID NO: 2796187 - protein, 25 aa, Entamoeba invadens
KLKDRSEVKRMCEVYMIEVNTDQDV

SEQ ID NO: 2796188 - protein, 23 aa, Entamoeba invadens
KLKDTSIPFVENWLASDEQKEEY

SEQ ID NO: 2796189 - protein, 20 aa, Entamoeba invadens
KLKDTVLFYPSHGKLFKIKR

SEQ ID NO: 2796190 - protein, 27 aa, Entamoeba invadens
KLKFTKFSFFFSFFFRFQETDNLFEIS

SEQ ID NO: 2796191 - protein, 21 aa, Entamoeba invadens
KLKGLELMMVETIKDEKSFGF

SEQ ID NO: 2796192 - protein, 22 aa, Entamoeba invadens
KLKIKMMLDCSLGISYLHNNGI

SEQ ID NO: 2796193 - protein, 18 aa, Entamoeba invadens
KLKKLGMESDLYKELEKE

SEQ ID NO: 2796194 - protein, 19 aa, Entamoeba invadens
KLKNEFCVFGNNIECYGCL

SEQ ID NO: 2796195 - protein, 19 aa, Entamoeba invadens
KLKNERIIRVYGGNTNPEM

SEQ ID NO: 2796196 - protein, 26 aa, Entamoeba invadens
KLKRSIKRNVIFYGILIILMIIFFVL

SEQ ID NO: 2796197 - protein, 18 aa, Entamoeba invadens
KLKTFCLSRSCKEVIGGW

SEQ ID NO: 2796198 - protein, 19 aa, Entamoeba invadens
KLKVRMLYDTARGMQFLHE

SEQ ID NO: 2796199 - protein, 25 aa, Entamoeba invadens
KLKYRVSTVDALYCTYTSEDTTTQE

SEQ ID NO: 2796200 - protein, 18 aa, Entamoeba invadens
KLLEDSLCLRELLENSIE

SEQ ID NO: 2796201 - protein, 28 aa, Entamoeba invadens
KLLELFLYSIGMLFTIYFYAGLLLSSKE

SEQ ID NO: 2796202 - protein, 17 aa, Entamoeba invadens
KLLEMCKIGKYVRYGLC

SEQ ID NO: 2796203 - protein, 19 aa, Entamoeba invadens
KLLLGNKMGFELPKYDVQL

SEQ ID NO: 2796204 - protein, 19 aa, Entamoeba invadens
KLLLGNKMGFELQKYDVQL

SEQ ID NO: 2796205 - protein, 23 aa, Entamoeba invadens
KLLLNGRLLRYGTSNKIFCHVEY

SEQ ID NO: 2796206 - protein, 20 aa, Entamoeba invadens
KLLLPMCYAIQFGGMNSILG

SEQ ID NO: 2796207 - protein, 19 aa, Entamoeba invadens
KLLSFWIVLGCFLFASFLI

SEQ ID NO: 2796208 - protein, 23 aa, Entamoeba invadens
KLMKEFEKEVAMLDKFRNEYIVH

SEQ ID NO: 2796209 - protein, 23 aa, Entamoeba invadens
KLMRFCPIKTIFDNTVTCTLNQY

SEQ ID NO: 2796210 - protein, 22 aa, Entamoeba invadens
KLMRFCPIKTIFNNTVTCTLNQ

SEQ ID NO: 2796211 - protein, 19 aa, Entamoeba invadens
KLMRVCPNSIFPFQKTCCN

SEQ ID NO: 2796212 - protein, 20 aa, Entamoeba invadens
KLMTHPKPFLIEVVKKKMLA

SEQ ID NO: 2796213 - protein, 19 aa, Entamoeba invadens
KLNELRKDNLVFGILSVLL

SEQ ID NO: 2796214 - protein, 21 aa, Entamoeba invadens
KLNIIKCLTCPPEQQMQNGLC

SEQ ID NO: 2796215 - protein, 36 aa, Entamoeba invadens
KLNLPQQVMFGGMFCSIILILLCLIAIIFFGKTDLM

SEQ ID NO: 2796216 - protein, 20 aa, Entamoeba invadens
KLNQMVLILILKKFENRQQV

SEQ ID NO: 2796217 - protein, 31 aa, Entamoeba invadens
KLNWAKARIEEWKTSNGLFGYYMADEPGVSI

SEQ ID NO: 2796218 - protein, 24 aa, Entamoeba invadens
KLPDEIRTKLQICRCSRLVEPTKP

SEQ ID NO: 2796219 - protein, 26 aa, Entamoeba invadens
KLPKDIRSFLVWTSRGTAIGILVSRD

SEQ ID NO: 2796220 - protein, 20 aa, Entamoeba invadens
KLPLICGFVGKAESAVEPDV

SEQ ID NO: 2796221 - protein, 19 aa, Entamoeba invadens
KLPWNCWSDGMTINGKLPE

SEQ ID NO: 2796222 - protein, 17 aa, Entamoeba invadens
KLQCTQCERGFTFLEGR

SEQ ID NO: 2796223 - protein, 19 aa, Entamoeba invadens
KLQEKYCLFDMKKTNIEFV

SEQ ID NO: 2796224 - protein, 18 aa, Entamoeba invadens
KLQFSVVEGCDYYEIRTI

SEQ ID NO: 2796225 - protein, 20 aa, Entamoeba invadens
KLQHELDMGISHSTALRRFE

SEQ ID NO: 2796226 - protein, 27 aa, Entamoeba invadens
KLQNYDAVICIITLFSTSAICRLKKSF

SEQ ID NO: 2796227 - protein, 17 aa, Entamoeba invadens
KLREFFQDRFVITTYMN

SEQ ID NO: 2796228 - protein, 18 aa, Entamoeba invadens
KLRIEEAEDIFAQISAGC

SEQ ID NO: 2796229 - protein, 18 aa, Entamoeba invadens
KLRKCVSDPCTLQDVRKM

SEQ ID NO: 2796230 - protein, 35 aa, Entamoeba invadens
KLRKRELIRLVAFGMFKACLITLMVEIGPFMSFLM

SEQ ID NO: 2796231 - protein, 21 aa, Entamoeba invadens
KLRLKFCLDAAKGIDYLHTNG

SEQ ID NO: 2796232 - protein, 18 aa, Entamoeba invadens
KLRRLKFKVDEIYRSSPT

SEQ ID NO: 2796233 - protein, 20 aa, Entamoeba invadens
KLRSCIRCQKGTYPQNVDPF

SEQ ID NO: 2796234 - protein, 20 aa, Entamoeba invadens
KLRSEFIVYFYGAVFIPSKI

SEQ ID NO: 2796235 - protein, 20 aa, Entamoeba invadens
KLRVKICLDAAKGISYLHEN

SEQ ID NO: 2796236 - protein, 19 aa, Entamoeba invadens
KLRVKMMIDAAKGILYLHE

SEQ ID NO: 2796237 - protein, 19 aa, Entamoeba invadens
KLRVKMMIDAAKGILYLHS

SEQ ID NO: 2796238 - protein, 17 aa, Entamoeba invadens
KLSACYFDIISIMQQYT

SEQ ID NO: 2796239 - protein, 21 aa, Entamoeba invadens
KLSAICPVLGIYGNHDYVGGN

SEQ ID NO: 2796240 - protein, 18 aa, Entamoeba invadens
KLSDIIMCVVGVVTTMAF

SEQ ID NO: 2796241 - protein, 20 aa, Entamoeba invadens
KLSEGTCIECPAGTYQSVDF

SEQ ID NO: 2796242 - protein, 22 aa, Entamoeba invadens
KLSESLSCIFRSFNVPSLSVNT

SEQ ID NO: 2796243 - protein, 19 aa, Entamoeba invadens
KLSLYDVCDSCYSSKETIY

SEQ ID NO: 2796244 - protein, 23 aa, Entamoeba invadens
KLSNVKFILLRGGISVQSKEIDF

SEQ ID NO: 2796245 - protein, 18 aa, Entamoeba invadens
KLSNYQVALSFAQTQSGK

SEQ ID NO: 2796246 - protein, 20 aa, Entamoeba invadens
KLSSSLCSNKRKLIFPDNEN

SEQ ID NO: 2796247 - protein, 19 aa, Entamoeba invadens
KLTEAFPMEKYFKEGCVKL

SEQ ID NO: 2796248 - protein, 20 aa, Entamoeba invadens
KLTEGRVYFLSNIDAPTGLK

SEQ ID NO: 2796249 - protein, 17 aa, Entamoeba invadens
KLTEQWTLLIAMTAEAI

SEQ ID NO: 2796250 - protein, 18 aa, Entamoeba invadens
KLTFVIIDCNGYIYNVTT

SEQ ID NO: 2796251 - protein, 18 aa, Entamoeba invadens
KLTHVIIAAPNIRSAPTM

SEQ ID NO: 2796252 - protein, 25 aa, Entamoeba invadens
KLTIRFDPEIVVLKSGFACEFSIYL

SEQ ID NO: 2796253 - protein, 26 aa, Entamoeba invadens
KLTKEHIRLIFSYICNKAKQASPIIL

SEQ ID NO: 2796254 - protein, 18 aa, Entamoeba invadens
KLTKGFTLNISKINTELV

SEQ ID NO: 2796255 - protein, 32 aa, Entamoeba invadens
KLTKKGRFKKAFYIICSCMIIFVIIVCVGSIV

SEQ ID NO: 2796256 - protein, 19 aa, Entamoeba invadens
KLTSFCFSVANAKKENLND

SEQ ID NO: 2796257 - protein, 20 aa, Entamoeba invadens
KLTSLSVSFCESGEEANTKF

SEQ ID NO: 2796258 - protein, 19 aa, Entamoeba invadens
KLTVTLFTCCAMQIFWSIR

SEQ ID NO: 2796259 - protein, 18 aa, Entamoeba invadens
KLVDIAMFLSSFCFAGVS

SEQ ID NO: 2796260 - protein, 18 aa, Entamoeba invadens
KLVFDFSNPYILCKVPES

SEQ ID NO: 2796261 - protein, 26 aa, Entamoeba invadens
KLVGYSCYYNGCTVANCETCSSSGVC

SEQ ID NO: 2796262 - protein, 25 aa, Entamoeba invadens
KLVINKANVRICLLDQTSLSFRELW

SEQ ID NO: 2796263 - protein, 23 aa, Entamoeba invadens
KLVKCPIVDFWIPESVSLYDKKA

SEQ ID NO: 2796264 - protein, 20 aa, Entamoeba invadens
KLVLCVRKDLKMGKGKIAAQ

SEQ ID NO: 2796265 - protein, 18 aa, Entamoeba invadens
KLVNCLECTTPASGSAKC

SEQ ID NO: 2796266 - protein, 24 aa, Entamoeba invadens
KLVNKLDCSMCWMGKMSTVCISES

SEQ ID NO: 2796267 - protein, 26 aa, Entamoeba invadens
KLWFDEFTFVKGVDRMLFDTPMKFTK

SEQ ID NO: 2796268 - protein, 18 aa, Entamoeba invadens
KLWNGVVLSLFYVVASYK

SEQ ID NO: 2796269 - protein, 27 aa, Entamoeba invadens
KLYAKFCISEINLMYKKLYDTYLSGMF

SEQ ID NO: 2796270 - protein, 19 aa, Entamoeba invadens
KLYISFGCVVGLLLFVAMF

SEQ ID NO: 2796271 - protein, 18 aa, Entamoeba invadens
KLYMSSLIHQDAAFYDFH

SEQ ID NO: 2796272 - protein, 33 aa, Entamoeba invadens
KLYQGVSLFIFWPGILLCKLTVPFDLFYGSAVV

SEQ ID NO: 2796273 - protein, 28 aa, Entamoeba invadens
KLYRFSDTLDLLLLFGGIIGDVANGIMF

SEQ ID NO: 2796274 - protein, 19 aa, Entamoeba invadens
KLYRICQEGNLLNENTQCN

SEQ ID NO: 2796275 - protein, 20 aa, Entamoeba invadens
KLYYLFLSFCKIIGQILDLL

SEQ ID NO: 2796276 - protein, 17 aa, Entamoeba invadens
KMAILCKNVKRRHYENF

SEQ ID NO: 2796277 - protein, 17 aa, Entamoeba invadens
KMASGKSNILCIKVTQI

SEQ ID NO: 2796278 - protein, 19 aa, Entamoeba invadens
KMCIKCLPNTIPDSTTSTC

SEQ ID NO: 2796279 - protein, 21 aa, Entamoeba invadens
KMCVYKFNTWIIVIIVLGLLV

SEQ ID NO: 2796280 - protein, 21 aa, Entamoeba invadens
KMDRMDVFWFRGYKSKKSECD

SEQ ID NO: 2796281 - protein, 18 aa, Entamoeba invadens
KMDVCSKLTDFGTSRCIS

SEQ ID NO: 2796282 - protein, 22 aa, Entamoeba invadens
KMEEIFRSLDLFKDKKASKLIV

SEQ ID NO: 2796283 - protein, 21 aa, Entamoeba invadens
KMEKICVFKMNRSNIAMSVLD

SEQ ID NO: 2796284 - protein, 20 aa, Entamoeba invadens
KMEKVEFLFRKGTPNLRRKA

SEQ ID NO: 2796285 - protein, 22 aa, Entamoeba invadens
KMELALGCLVLFKPAQHIEKKS

SEQ ID NO: 2796286 - protein, 25 aa, Entamoeba invadens
KMFCSCYIIFFFVIFPIYITRLVST

SEQ ID NO: 2796287 - protein, 18 aa, Entamoeba invadens
KMFFALPKIRFLLNRPTV

SEQ ID NO: 2796288 - protein, 32 aa, Entamoeba invadens
KMFFFIGFVFPFSWIFLFFWKVYDKEDMYRMW

SEQ ID NO: 2796289 - protein, 19 aa, Entamoeba invadens
KMFIMSMTLIKAFVDKKQT

SEQ ID NO: 2796290 - protein, 24 aa, Entamoeba invadens
KMGNCSSIKRADSFRFYENSTALL

SEQ ID NO: 2796291 - protein, 19 aa, Entamoeba invadens
KMIPSDPLFFFVVCVESMT

SEQ ID NO: 2796292 - protein, 17 aa, Entamoeba invadens
KMIQYDRFYACGSTAIF

SEQ ID NO: 2796293 - protein, 19 aa, Entamoeba invadens
KMIVMEFIKNGNLETIIKK

SEQ ID NO: 2796294 - protein, 19 aa, Entamoeba invadens
KMKECLTCQDPYYLSSQKC

SEQ ID NO: 2796295 - protein, 24 aa, Entamoeba invadens
KMKELKRRFNVFKMSKTNLDFVEL

SEQ ID NO: 2796296 - protein, 25 aa, Entamoeba invadens
KMKFKWGDAELKNKTYIYLGYILQC

SEQ ID NO: 2796297 - protein, 24 aa, Entamoeba invadens
KMKKECIEVLYSKMLKSMNVESST

SEQ ID NO: 2796298 - protein, 18 aa, Entamoeba invadens
KMKNICVFEMKRSNIEMV

SEQ ID NO: 2796299 - protein, 20 aa, Entamoeba invadens
KMKNYCDYYSKFGGYSGLPY

SEQ ID NO: 2796300 - protein, 19 aa, Entamoeba invadens
KMLDDMAVGLAYLHQNEVL

SEQ ID NO: 2796301 - protein, 21 aa, Entamoeba invadens
KMLDKFRCDYTIYFYGAVMIR

SEQ ID NO: 2796302 - protein, 25 aa, Entamoeba invadens
KMLEKFRCNYIITFLGAVFIPSKTC

SEQ ID NO: 2796303 - protein, 23 aa, Entamoeba invadens
KMLLGGKLLRYGTSNKIFCHVED

SEQ ID NO: 2796304 - protein, 17 aa, Entamoeba invadens
KMLLKNAPILSGINGTV

SEQ ID NO: 2796305 - protein, 31 aa, Entamoeba invadens
KMLMCGKINGIQCMGRFLFVFGDEVPVTILY

SEQ ID NO: 2796306 - protein, 22 aa, Entamoeba invadens
KMLNVCEIFKVVILDEIEMRQE

SEQ ID NO: 2796307 - protein, 24 aa, Entamoeba invadens
KMMCDACKGILYLHENGILHRDIK

SEQ ID NO: 2796308 - protein, 19 aa, Entamoeba invadens
KMNGWAIGVFVVISCLVFS

SEQ ID NO: 2796309 - protein, 18 aa, Entamoeba invadens
KMPLPYLLVFLALVLYEH

SEQ ID NO: 2796310 - protein, 21 aa, Entamoeba invadens
KMQKFVVMLKHLVHESDIETI

SEQ ID NO: 2796311 - protein, 20 aa, Entamoeba invadens
KMQMDIMSRFTLIETTTLVG

SEQ ID NO: 2796312 - protein, 20 aa, Entamoeba invadens
KMQNICVFKMKRSNVAFYDM

SEQ ID NO: 2796313 - protein, 20 aa, Entamoeba invadens
KMRVKICLDSARGLSYLHQN

SEQ ID NO: 2796314 - protein, 19 aa, Entamoeba invadens
KMSEGLIGDEEWRKKMIET

SEQ ID NO: 2796315 - protein, 19 aa, Entamoeba invadens
KMSGLEKGRTQCNVENYGF

SEQ ID NO: 2796316 - protein, 18 aa, Entamoeba invadens
KMSMCCLDAFKHFIVEKV

SEQ ID NO: 2796317 - protein, 19 aa, Entamoeba invadens
KMSSIYQLWDWIMQNQKSA

SEQ ID NO: 2796318 - protein, 19 aa, Entamoeba invadens
KMTNFYSIALFFINLLMAL

SEQ ID NO: 2796319 - protein, 19 aa, Entamoeba invadens
KMVNFKIHWINCENNKVIN

SEQ ID NO: 2796320 - protein, 25 aa, Entamoeba invadens
KMVNLPIIFPPSGVHTLIIASKKNP

SEQ ID NO: 2796321 - protein, 17 aa, Entamoeba invadens
KMWYIPKINNIYLSAFL

SEQ ID NO: 2796322 - protein, 25 aa, Entamoeba invadens
KMYEIARKGLVEALMNHFKRHMQKV

SEQ ID NO: 2796323 - protein, 22 aa, Entamoeba invadens
KMYHLWRAVKFSDKESLKTFSK

SEQ ID NO: 2796324 - protein, 23 aa, Entamoeba invadens
KNAEGMSILLFFSATMANVFYSV

SEQ ID NO: 2796325 - protein, 20 aa, Entamoeba invadens
KNAFAFPWSIARAITSGIRP

SEQ ID NO: 2796326 - protein, 19 aa, Entamoeba invadens
KNANVRRFIHVSTDEVYGQ

SEQ ID NO: 2796327 - protein, 17 aa, Entamoeba invadens
KNATMCYNNVLKRCKYT

SEQ ID NO: 2796328 - protein, 27 aa, Entamoeba invadens
KNAVTSRLKIKFMLDGAKGLFYLHENG

SEQ ID NO: 2796329 - protein, 26 aa, Entamoeba invadens
KNAWNSLKFPYVMFGLYIIYFIYIIT

SEQ ID NO: 2796330 - protein, 21 aa, Entamoeba invadens
KNCACEFEMFITPNFSSQIED

SEQ ID NO: 2796331 - protein, 19 aa, Entamoeba invadens
KNCGCAGVTIVIVKDEVLG

SEQ ID NO: 2796332 - protein, 22 aa, Entamoeba invadens
KNCILCGEKSFISNGKCVSSET

SEQ ID NO: 2796333 - protein, 19 aa, Entamoeba invadens
KNCKCEKGYFLIQKNKCVS

SEQ ID NO: 2796334 - protein, 21 aa, Entamoeba invadens
KNCKGMWGYTCKDNACVLTQL

SEQ ID NO: 2796335 - protein, 17 aa, Entamoeba invadens
KNCKTCFSTSTKCTSCD

SEQ ID NO: 2796336 - protein, 22 aa, Entamoeba invadens
KNCKTCTILFARYCNECNDHFK

SEQ ID NO: 2796337 - protein, 22 aa, Entamoeba invadens
KNCKTCTILFARYCNECSDNFK

SEQ ID NO: 2796338 - protein, 22 aa, Entamoeba invadens
KNCSGTDIWLDRQLYGEGKSFF

SEQ ID NO: 2796339 - protein, 22 aa, Entamoeba invadens
KNCSSCPSGFVLNNNLDGTKKC

SEQ ID NO: 2796340 - protein, 25 aa, Entamoeba invadens
KNCTTKDAYGCIGCEDGFFLLDHLC

SEQ ID NO: 2796341 - protein, 30 aa, Entamoeba invadens
KNDEVKYQISLYLIVLVVFFGFDEMITVLT

SEQ ID NO: 2796342 - protein, 20 aa, Entamoeba invadens
KNDNCYNCPLITNCVQCSPK

SEQ ID NO: 2796343 - protein, 24 aa, Entamoeba invadens
KNDSCLSCGDGLVLNNSLCVPFNQ

SEQ ID NO: 2796344 - protein, 18 aa, Entamoeba invadens
KNEIECVTYGTPSDIYFG

SEQ ID NO: 2796345 - protein, 21 aa, Entamoeba invadens
KNEIMGIAILDKFERTDITQM

SEQ ID NO: 2796346 - protein, 18 aa, Entamoeba invadens
KNENGVLVFPPHFTDGTV

SEQ ID NO: 2796347 - protein, 17 aa, Entamoeba invadens
KNEPECCTLWDDYSVLY

SEQ ID NO: 2796348 - protein, 23 aa, Entamoeba invadens
KNFACEFEVFITPNFSSKIEDEI

SEQ ID NO: 2796349 - protein, 23 aa, Entamoeba invadens
KNFACEFEVFITPNFSSKIEDEV

SEQ ID NO: 2796350 - protein, 21 aa, Entamoeba invadens
KNFDCKIFGFGNNETYYSDIE

SEQ ID NO: 2796351 - protein, 20 aa, Entamoeba invadens
KNFEGVDGWTVNRLIVETDF

SEQ ID NO: 2796352 - protein, 23 aa, Entamoeba invadens
KNFFKKYFKYFVIAAITIILCLW

SEQ ID NO: 2796353 - protein, 18 aa, Entamoeba invadens
KNFHFTFDTTQIIFKNYC

SEQ ID NO: 2796354 - protein, 17 aa, Entamoeba invadens
KNFIPSGCVLRNTEEML

SEQ ID NO: 2796355 - protein, 17 aa, Entamoeba invadens
KNFPLPLDVGYILWNGF

SEQ ID NO: 2796356 - protein, 21 aa, Entamoeba invadens
KNGACTSCITGYVLTTVSSSN

SEQ ID NO: 2796357 - protein, 24 aa, Entamoeba invadens
KNGAIKGCDLCTNFVLTSSNNCTK

SEQ ID NO: 2796358 - protein, 20 aa, Entamoeba invadens
KNGCAKCVDGYFTFKTNQCK

SEQ ID NO: 2796359 - protein, 20 aa, Entamoeba invadens
KNGCSKCLDGYFTLNQNECS

SEQ ID NO: 2796360 - protein, 20 aa, Entamoeba invadens
KNGECLKCSEYIEGCSLCVS

SEQ ID NO: 2796361 - protein, 28 aa, Entamoeba invadens
KNGEFPITLKWKSIDVINIDTTPLNLIT

SEQ ID NO: 2796362 - protein, 21 aa, Entamoeba invadens
KNGFYLDGIYCVKCPQKCLSC

SEQ ID NO: 2796363 - protein, 20 aa, Entamoeba invadens
KNGNCLNCYENMFLLNDGVC

SEQ ID NO: 2796364 - protein, 23 aa, Entamoeba invadens
KNGNCTSCLTGYFLNSNSNKCNV

SEQ ID NO: 2796365 - protein, 18 aa, Entamoeba invadens
KNGVLCFSFVLLLLAAIF

SEQ ID NO: 2796366 - protein, 26 aa, Entamoeba invadens
KNGYFRIPLEKIKLCLSYDSNLNCTV

SEQ ID NO: 2796367 - protein, 17 aa, Entamoeba invadens
KNHLCVSSACASNSSAL

SEQ ID NO: 2796368 - protein, 25 aa, Entamoeba invadens
KNHLVGLHAVELVKSFVRSSDTKQY

SEQ ID NO: 2796369 - protein, 24 aa, Entamoeba invadens
KNHSHVYSLCFIRIIYVDYLVSEA

SEQ ID NO: 2796370 - protein, 23 aa, Entamoeba invadens
KNIAETLLTLGFDDNFCNSLFGV

SEQ ID NO: 2796371 - protein, 24 aa, Entamoeba invadens
KNICVFKMKHSNIRFARISLNLVS

SEQ ID NO: 2796372 - protein, 17 aa, Entamoeba invadens
KNIETFSVYHEYHILLN

SEQ ID NO: 2796373 - protein, 20 aa, Entamoeba invadens
KNIFEFFKQSNLVLNSSQST

SEQ ID NO: 2796374 - protein, 21 aa, Entamoeba invadens
KNIFRFVIVLIECTLKTNYYI

SEQ ID NO: 2796375 - protein, 18 aa, Entamoeba invadens
KNIILIRSTINGMYKENE

SEQ ID NO: 2796376 - protein, 23 aa, Entamoeba invadens
KNILSCLVDLVFDFVSSDFFTGL

SEQ ID NO: 2796377 - protein, 19 aa, Entamoeba invadens
KNIREGFVGIINRKQKPND

SEQ ID NO: 2796378 - protein, 23 aa, Entamoeba invadens
KNITTVCIDRTCECIHDSYYDEK

SEQ ID NO: 2796379 - protein, 17 aa, Entamoeba invadens
KNKAVEFEIFIRPNCSC

SEQ ID NO: 2796380 - protein, 21 aa, Entamoeba invadens
KNKCDICPAGYYSQAMATKCK

SEQ ID NO: 2796381 - protein, 20 aa, Entamoeba invadens
KNKCLTCNLTNYKTQSGKCL

SEQ ID NO: 2796382 - protein, 24 aa, Entamoeba invadens
KNKCVECGNGFVLNEQFMCEKNEN

SEQ ID NO: 2796383 - protein, 20 aa, Entamoeba invadens
KNKDTCLFRENLVKKTGWVP

SEQ ID NO: 2796384 - protein, 19 aa, Entamoeba invadens
KNKEQKGNCTYYNEVNSFC

SEQ ID NO: 2796385 - protein, 26 aa, Entamoeba invadens
KNKQSVCPVCWAGTYSIQNSVACLDC

SEQ ID NO: 2796386 - protein, 20 aa, Entamoeba invadens
KNKWLNVVKYVMELYIQDES

SEQ ID NO: 2796387 - protein, 19 aa, Entamoeba invadens
KNKYGKLCERCTPTYCEKC

SEQ ID NO: 2796388 - protein, 20 aa, Entamoeba invadens
KNLEMSIGFLGVGEIYKQQQ

SEQ ID NO: 2796389 - protein, 17 aa, Entamoeba invadens
KNLFGIVEKCWKQNPLD

SEQ ID NO: 2796390 - protein, 25 aa, Entamoeba invadens
KNLFTILTRGMWYINYSFTYATAAV

SEQ ID NO: 2796391 - protein, 17 aa, Entamoeba invadens
KNLGVVLVVPILREIEN

SEQ ID NO: 2796392 - protein, 21 aa, Entamoeba invadens
KNLLMEKICHCSHLHSELITE

SEQ ID NO: 2796393 - protein, 28 aa, Entamoeba invadens
KNLPLVMSVAYYKRCRNVGNVSEPNVRC

SEQ ID NO: 2796394 - protein, 18 aa, Entamoeba invadens
KNLPRFTTNVTFGTSIPV

SEQ ID NO: 2796395 - protein, 18 aa, Entamoeba invadens
KNLSLLITKSRFPSEVEM

SEQ ID NO: 2796396 - protein, 17 aa, Entamoeba invadens
KNLTCSKCFLNKNNCKL

SEQ ID NO: 2796397 - protein, 21 aa, Entamoeba invadens
KNMILEGGILRDVTFLNSEFV

SEQ ID NO: 2796398 - protein, 17 aa, Entamoeba invadens
KNMKVFKTLRMPSEREC

SEQ ID NO: 2796399 - protein, 17 aa, Entamoeba invadens
KNMMVGMLVGVSNILQI

SEQ ID NO: 2796400 - protein, 19 aa, Entamoeba invadens
KNMVIKIIVKILINSFKVY

SEQ ID NO: 2796401 - protein, 20 aa, Entamoeba invadens
KNNKCSFELTDLYQYEGEKV

SEQ ID NO: 2796402 - protein, 26 aa, Entamoeba invadens
KNNKCVLCKSGYVLNEQFECISSEIC

SEQ ID NO: 2796403 - protein, 20 aa, Entamoeba invadens
KNNNCYNCPLITNCVQCSPK

SEQ ID NO: 2796404 - protein, 20 aa, Entamoeba invadens
KNNNCYTCSLITNCVQCSPK

SEQ ID NO: 2796405 - protein, 22 aa, Entamoeba invadens
KNNPKLFLTWMHQSSNINLNIN

SEQ ID NO: 2796406 - protein, 23 aa, Entamoeba invadens
KNNQCIPRYPLSCTEEDLFGDVF

SEQ ID NO: 2796407 - protein, 20 aa, Entamoeba invadens
KNNRCASCSAIPYCTVCTDE

SEQ ID NO: 2796408 - protein, 20 aa, Entamoeba invadens
KNNRCVGCDALFGCLQCENE

SEQ ID NO: 2796409 - protein, 24 aa, Entamoeba invadens
KNNVCHLCNLIIFNSEICTFTNNQ

SEQ ID NO: 2796410 - protein, 18 aa, Entamoeba invadens
KNNWCRKAQGGYYPVTSS

SEQ ID NO: 2796411 - protein, 21 aa, Entamoeba invadens
KNNYYRIGLDCNKCLSNCSKC

SEQ ID NO: 2796412 - protein, 29 aa, Entamoeba invadens
KNNYYRVGMDCLPCLLNCSMCNIKDKCLT

SEQ ID NO: 2796413 - protein, 25 aa, Entamoeba invadens
KNPMKIQFCVMKGCDYYTIRTEPAL

SEQ ID NO: 2796414 - protein, 25 aa, Entamoeba invadens
KNPQSKRCRELLPVLLNSKRTVLLS

SEQ ID NO: 2796415 - protein, 31 aa, Entamoeba invadens
KNPTRNLFCYYSRITKLFPRAKTLYLPSYLC

SEQ ID NO: 2796416 - protein, 20 aa, Entamoeba invadens
KNQEIEIFKALLRLNPNYFL

SEQ ID NO: 2796417 - protein, 21 aa, Entamoeba invadens
KNQIPCDIGFIFLVISYARFR

SEQ ID NO: 2796418 - protein, 19 aa, Entamoeba invadens
KNRRIILETIVRKMKESNS

SEQ ID NO: 2796419 - protein, 17 aa, Entamoeba invadens
KNRSVLTPVKIVSLKDD

SEQ ID NO: 2796420 - protein, 23 aa, Entamoeba invadens
KNRTDRQLVIWIQCPKKDKFFLQ

SEQ ID NO: 2796421 - protein, 22 aa, Entamoeba invadens
KNRVYNWLGSFIFDDFINSNKM

SEQ ID NO: 2796422 - protein, 25 aa, Entamoeba invadens
KNSDAPSVLVNWALLMYIYYIHTMA

SEQ ID NO: 2796423 - protein, 19 aa, Entamoeba invadens
KNSFLKVFNLLGGHVNIPF

SEQ ID NO: 2796424 - protein, 21 aa, Entamoeba invadens
KNSKCNKCSFWYAPSPDGTYC

SEQ ID NO: 2796425 - protein, 20 aa, Entamoeba invadens
KNSKCTKCEFGYAPSKDGSY

SEQ ID NO: 2796426 - protein, 23 aa, Entamoeba invadens
KNSLELRLLLNIDQTIFTNTQII

SEQ ID NO: 2796427 - protein, 17 aa, Entamoeba invadens
KNSLILKSLLFLLESLL

SEQ ID NO: 2796428 - protein, 19 aa, Entamoeba invadens
KNSSMGFCTQCAESYFIGL

SEQ ID NO: 2796429 - protein, 19 aa, Entamoeba invadens
KNTCLKCAEDTILSDNTCV

SEQ ID NO: 2796430 - protein, 19 aa, Entamoeba invadens
KNTCLLCNFEYRLVDGKCV

SEQ ID NO: 2796431 - protein, 25 aa, Entamoeba invadens
KNTCSKCADGYILKDGYCVHKLDLH

SEQ ID NO: 2796432 - protein, 20 aa, Entamoeba invadens
KNTGCAICKETYYKERSDCL

SEQ ID NO: 2796433 - protein, 24 aa, Entamoeba invadens
KNTNMKGRILIIFPLVIITLLCVF

SEQ ID NO: 2796434 - protein, 17 aa, Entamoeba invadens
KNTNVVETIEWLPKEIN

SEQ ID NO: 2796435 - protein, 21 aa, Entamoeba invadens
KNTQELYGFVSLYNTSCTPSE

SEQ ID NO: 2796436 - protein, 19 aa, Entamoeba invadens
KNTRPCKKTTQLIRVTELV

SEQ ID NO: 2796437 - protein, 23 aa, Entamoeba invadens
KNTWKHAPLYFTVHCGDYNKYEL

SEQ ID NO: 2796438 - protein, 19 aa, Entamoeba invadens
KNVCVFKMSRSNIMMTKLD

SEQ ID NO: 2796439 - protein, 19 aa, Entamoeba invadens
KNVLPSFGTLVSFIMIFTT

SEQ ID NO: 2796440 - protein, 24 aa, Entamoeba invadens
KNVMVYNNFEMIKANALTMENTGI

SEQ ID NO: 2796441 - protein, 17 aa, Entamoeba invadens
KNVNGRLLVGLRWWNKV

SEQ ID NO: 2796442 - protein, 25 aa, Entamoeba invadens
KNVNWKRLYGVSAITVNNNCILKVD

SEQ ID NO: 2796443 - protein, 25 aa, Entamoeba invadens
KNVPKCLFDGLFLFFELFLTQFALT

SEQ ID NO: 2796444 - protein, 17 aa, Entamoeba invadens
KNVTAGAILVVFMSNVI

SEQ ID NO: 2796445 - protein, 18 aa, Entamoeba invadens
KNVTAGAILVVFMSNVIS

SEQ ID NO: 2796446 - protein, 17 aa, Entamoeba invadens
KNWIHNDIEGWRNLVKR

SEQ ID NO: 2796447 - protein, 17 aa, Entamoeba invadens
KNWKCGFQGCNKLPMTR

SEQ ID NO: 2796448 - protein, 23 aa, Entamoeba invadens
KNWKCVFPNCNEPLKTRFNCYAH

SEQ ID NO: 2796449 - protein, 18 aa, Entamoeba invadens
KNYCTGVICSCPQGYYYN

SEQ ID NO: 2796450 - protein, 18 aa, Entamoeba invadens
KNYEDFTARVQIKNGKIV

SEQ ID NO: 2796451 - protein, 20 aa, Entamoeba invadens
KNYFLLYFTVIWIGLNVTSI

SEQ ID NO: 2796452 - protein, 18 aa, Entamoeba invadens
KNYILECRDNYYIEENDL

SEQ ID NO: 2796453 - protein, 21 aa, Entamoeba invadens
KNYKYFILFLWYAPLMLSLGV

SEQ ID NO: 2796454 - protein, 24 aa, Entamoeba invadens
KNYQWKYENGICFVEVIDPSLVLN

SEQ ID NO: 2796455 - protein, 24 aa, Entamoeba invadens
KNYRVSYSGDYCEYVLNIGLYIVL

SEQ ID NO: 2796456 - protein, 19 aa, Entamoeba invadens
KPAQFPIFISFLTLISSLS

SEQ ID NO: 2796457 - protein, 25 aa, Entamoeba invadens
KPASCKRTEMGYCVECVDGYFLSDV

SEQ ID NO: 2796458 - protein, 20 aa, Entamoeba invadens
KPASCKTAEMGYCTECVEGY

SEQ ID NO: 2796459 - protein, 25 aa, Entamoeba invadens
KPDAFTFEWSLLYIIDTANHTIKNV

SEQ ID NO: 2796460 - protein, 19 aa, Entamoeba invadens
KPDNILIFSLDFQNETVSA

SEQ ID NO: 2796461 - protein, 22 aa, Entamoeba invadens
KPDNILIFSMDFCEKVNAKLTD

SEQ ID NO: 2796462 - protein, 20 aa, Entamoeba invadens
KPDNILVVALDFDQKVNAKL

SEQ ID NO: 2796463 - protein, 18 aa, Entamoeba invadens
KPDNILVVSMDWNDSIFG

SEQ ID NO: 2796464 - protein, 18 aa, Entamoeba invadens
KPDSLVFTSSFTEVKRLL

SEQ ID NO: 2796465 - protein, 20 aa, Entamoeba invadens
KPDYCEICNTTAGYTSDCQS

SEQ ID NO: 2796466 - protein, 17 aa, Entamoeba invadens
KPEKAKCRNADPDDSKN

SEQ ID NO: 2796467 - protein, 23 aa, Entamoeba invadens
KPEKRPVFSKIIEWLAPMVQELS

SEQ ID NO: 2796468 - protein, 19 aa, Entamoeba invadens
KPEKTRMSFSGTKGDPKVD

SEQ ID NO: 2796469 - protein, 23 aa, Entamoeba invadens
KPELLKNFLSDVAKVEFLKKKDP

SEQ ID NO: 2796470 - protein, 28 aa, Entamoeba invadens
KPELYKRTITIVVCCVIVVIIIAAFLMV

SEQ ID NO: 2796471 - protein, 17 aa, Entamoeba invadens
KPEMYEGLLPSTISQHI

SEQ ID NO: 2796472 - protein, 21 aa, Entamoeba invadens
KPEYRRFAIDRFKKKYPESVL

SEQ ID NO: 2796473 - protein, 20 aa, Entamoeba invadens
KPEYTLCPGYLLGLTEDDSC

SEQ ID NO: 2796474 - protein, 23 aa, Entamoeba invadens
KPFHIFMCLLFVYHILEFTSSVY

SEQ ID NO: 2796475 - protein, 19 aa, Entamoeba invadens
KPFPSELIIEADLLHKQFV

SEQ ID NO: 2796476 - protein, 17 aa, Entamoeba invadens
KPFPSKKFWTFMSVVSV

SEQ ID NO: 2796477 - protein, 20 aa, Entamoeba invadens
KPGALCFVFLTYAYAKLRLF

SEQ ID NO: 2796478 - protein, 19 aa, Entamoeba invadens
KPGRYGIKFWICADYETGM

SEQ ID NO: 2796479 - protein, 19 aa, Entamoeba invadens
KPHASFVPKKRQKKLTPLA

SEQ ID NO: 2796480 - protein, 18 aa, Entamoeba invadens
KPIECFDPTISTGDQSLE

SEQ ID NO: 2796481 - protein, 17 aa, Entamoeba invadens
KPIGWSGYAGGILKNVG

SEQ ID NO: 2796482 - protein, 19 aa, Entamoeba invadens
KPITCGNGIFDVGEECDGG

SEQ ID NO: 2796483 - protein, 21 aa, Entamoeba invadens
KPKEKRPSVAALKGIANFTHF

SEQ ID NO: 2796484 - protein, 20 aa, Entamoeba invadens
KPKESVVLTITFIARCTTVL

SEQ ID NO: 2796485 - protein, 25 aa, Entamoeba invadens
KPKQIMCKRGFLTRFGYNEKKSVEE

SEQ ID NO: 2796486 - protein, 19 aa, Entamoeba invadens
KPKYNSFIMALRIILSFLG

SEQ ID NO: 2796487 - protein, 25 aa, Entamoeba invadens
KPLITNCPFLWYLLNFLLIIATPLC

SEQ ID NO: 2796488 - protein, 20 aa, Entamoeba invadens
KPLKEWDLESFLPSFKEGFC

SEQ ID NO: 2796489 - protein, 24 aa, Entamoeba invadens
KPLLRLRFCQDVARGMLYLHDNNV

SEQ ID NO: 2796490 - protein, 20 aa, Entamoeba invadens
KPLRLFGFAGTAVWTFCSCG

SEQ ID NO: 2796491 - protein, 26 aa, Entamoeba invadens
KPLYLGVCFFLLFAGYQTTQNYQSGI

SEQ ID NO: 2796492 - protein, 25 aa, Entamoeba invadens
KPNHIFRGGFFFNRGLDDIKSLHTE

SEQ ID NO: 2796493 - protein, 24 aa, Entamoeba invadens
KPNQSRPAPKRVRKMSFQGIRQSI

SEQ ID NO: 2796494 - protein, 19 aa, Entamoeba invadens
KPNRIVSFFMRKKTIFNST

SEQ ID NO: 2796495 - protein, 23 aa, Entamoeba invadens
KPNYVEFLFKYLDIYGQQYSQLR

SEQ ID NO: 2796496 - protein, 18 aa, Entamoeba invadens
KPPVCLILTVFTYEVLGL

SEQ ID NO: 2796497 - protein, 17 aa, Entamoeba invadens
KPQFLLYQNIRIIEFET

SEQ ID NO: 2796498 - protein, 26 aa, Entamoeba invadens
KPSIWKVIFKREWKNFLFMYIMIAIA

SEQ ID NO: 2796499 - protein, 25 aa, Entamoeba invadens
KPTAALCFFPGGGMNIHMDVHRIDM

SEQ ID NO: 2796500 - protein, 24 aa, Entamoeba invadens
KPTFWRALAFFGLAVVFLMVCLMM

SEQ ID NO: 2796501 - protein, 25 aa, Entamoeba invadens
KPTGSDLEYTIKLVVHVDTSGTMYF

SEQ ID NO: 2796502 - protein, 19 aa, Entamoeba invadens
KPTYCGGIGKLYSYIQARY

SEQ ID NO: 2796503 - protein, 20 aa, Entamoeba invadens
KPVEQKWLWTLYTVLTVMSI

SEQ ID NO: 2796504 - protein, 30 aa, Entamoeba invadens
KPVLFKKWELKECYRLSVDKSQSYMYKNKD

SEQ ID NO: 2796505 - protein, 17 aa, Entamoeba invadens
KPVVLELIRRWYNTSTQ

SEQ ID NO: 2796506 - protein, 24 aa, Entamoeba invadens
KPYEKRSWLNGMIVALVIVILLIP

SEQ ID NO: 2796507 - protein, 21 aa, Entamoeba invadens
KPYVFRPRVNAYFENKNDNYY

SEQ ID NO: 2796508 - protein, 25 aa, Entamoeba invadens
KQADCTRLSPAMTNFLFWGIGAIVY

SEQ ID NO: 2796509 - protein, 22 aa, Entamoeba invadens
KQAIFPRGRIPISNTETMNTII

SEQ ID NO: 2796510 - protein, 19 aa, Entamoeba invadens
KQCISCYYGSFLNSKNNTC

SEQ ID NO: 2796511 - protein, 23 aa, Entamoeba invadens
KQCKCCLRYFCSNCIGESKNKFC

SEQ ID NO: 2796512 - protein, 23 aa, Entamoeba invadens
KQCKSCDPSCLMCFETSTKCLSC

SEQ ID NO: 2796513 - protein, 18 aa, Entamoeba invadens
KQCPGFLQEAGFHTDDNI

SEQ ID NO: 2796514 - protein, 20 aa, Entamoeba invadens
KQCRTCLNSNYCFACAEDYY

SEQ ID NO: 2796515 - protein, 24 aa, Entamoeba invadens
KQEKRICVFEMKRSNYSKNGVLTK

SEQ ID NO: 2796516 - protein, 19 aa, Entamoeba invadens
KQELEILKAENLVLQKKVE

SEQ ID NO: 2796517 - protein, 21 aa, Entamoeba invadens
KQEMLFKMICEVLNTFYSYYT

SEQ ID NO: 2796518 - protein, 23 aa, Entamoeba invadens
KQESHMLFWGIVIVVHIGVVLAL

SEQ ID NO: 2796519 - protein, 18 aa, Entamoeba invadens
KQFACEFSIYLTPLCTCK

SEQ ID NO: 2796520 - protein, 17 aa, Entamoeba invadens
KQFDLRYGGGNNYSQII

SEQ ID NO: 2796521 - protein, 24 aa, Entamoeba invadens
KQFKFPWKIAEFVTRGEHLEKQSS

SEQ ID NO: 2796522 - protein, 24 aa, Entamoeba invadens
KQFKFPWKIAEFVTRGERLEKTSS

SEQ ID NO: 2796523 - protein, 21 aa, Entamoeba invadens
KQFKFPWKITEFVTRGEHLEK

SEQ ID NO: 2796524 - protein, 17 aa, Entamoeba invadens
KQFNPSGSCISCVDGYY

SEQ ID NO: 2796525 - protein, 21 aa, Entamoeba invadens
KQGSCLACSAGSYSNGSDKLS

SEQ ID NO: 2796526 - protein, 17 aa, Entamoeba invadens
KQHCLICAHAYDGSVGA

SEQ ID NO: 2796527 - protein, 24 aa, Entamoeba invadens
KQHGDDIYQMFAFSSAKKRMNTLM

SEQ ID NO: 2796528 - protein, 20 aa, Entamoeba invadens
KQIGCLSCTSFDLNCMTCSS

SEQ ID NO: 2796529 - protein, 18 aa, Entamoeba invadens
KQIGCLSCTSFDTNCASC

SEQ ID NO: 2796530 - protein, 26 aa, Entamoeba invadens
KQIGKITWREMMEISTRWRQVSEPND

SEQ ID NO: 2796531 - protein, 17 aa, Entamoeba invadens
KQINDVIAFEKQDEGQE

SEQ ID NO: 2796532 - protein, 23 aa, Entamoeba invadens
KQKKLGRKALCISTHHAKSTQNI

SEQ ID NO: 2796533 - protein, 18 aa, Entamoeba invadens
KQLAKYCDGVIQMSTSRR

SEQ ID NO: 2796534 - protein, 18 aa, Entamoeba invadens
KQLGKKIEEGNLIKKQLD

SEQ ID NO: 2796535 - protein, 25 aa, Entamoeba invadens
KQLKAEASVNLGFRTVIVEELMLRG

SEQ ID NO: 2796536 - protein, 22 aa, Entamoeba invadens
KQLKGRLKMMFLQIPSERVWVG

SEQ ID NO: 2796537 - protein, 20 aa, Entamoeba invadens
KQLKVNACYNLIEEEKPLIA

SEQ ID NO: 2796538 - protein, 24 aa, Entamoeba invadens
KQLKWCKYQDSLSCETLYEECKQE

SEQ ID NO: 2796539 - protein, 17 aa, Entamoeba invadens
KQLSFDSWAVMILWGTL

SEQ ID NO: 2796540 - protein, 24 aa, Entamoeba invadens
KQLTLKLRNTFIINEERTNKPYII

SEQ ID NO: 2796541 - protein, 24 aa, Entamoeba invadens
KQLTLKLRNTFIINEERTNNPYII

SEQ ID NO: 2796542 - protein, 22 aa, Entamoeba invadens
KQMPELVFFSIKFLDVLATKLV

SEQ ID NO: 2796543 - protein, 18 aa, Entamoeba invadens
KQNRICYLQEYIQETDEN

SEQ ID NO: 2796544 - protein, 18 aa, Entamoeba invadens
KQQKCITCTSFDAKCETC

SEQ ID NO: 2796545 - protein, 22 aa, Entamoeba invadens
KQRDWSCYMALTMDHFKNQKAI

SEQ ID NO: 2796546 - protein, 31 aa, Entamoeba invadens
KQRMTLKFYVPRALLCGLLFVFILINFMYNK

SEQ ID NO: 2796547 - protein, 36 aa, Entamoeba invadens
KQSHQLKKAMCWRKWKLYIIGGSIAAIVIIVILIVI

SEQ ID NO: 2796548 - protein, 23 aa, Entamoeba invadens
KQSICKLSDGNTCIVCNDGYIIK

SEQ ID NO: 2796549 - protein, 24 aa, Entamoeba invadens
KQSYCLTCLAGTYSLNGASSCDQC

SEQ ID NO: 2796550 - protein, 24 aa, Entamoeba invadens
KQSYCLTCPAGTYSLDGASSCDQC

SEQ ID NO: 2796551 - protein, 18 aa, Entamoeba invadens
KQTEFEVFLELFKKNWNN

SEQ ID NO: 2796552 - protein, 22 aa, Entamoeba invadens
KQTLFPFEGCDPAYTAPEVLAE

SEQ ID NO: 2796553 - protein, 17 aa, Entamoeba invadens
KQWSNGRIKVMQNVINE

SEQ ID NO: 2796554 - protein, 20 aa, Entamoeba invadens
KRAFFYFDTKERVIALTIDD

SEQ ID NO: 2796555 - protein, 29 aa, Entamoeba invadens
KRAFSKKSFKYAWDIADFVTTGKRLERPD

SEQ ID NO: 2796556 - protein, 22 aa, Entamoeba invadens
KRAPFGAVVQGLVLGWVHSFIF

SEQ ID NO: 2796557 - protein, 19 aa, Entamoeba invadens
KRCDYCGLYCKNCKSSTYC

SEQ ID NO: 2796558 - protein, 19 aa, Entamoeba invadens
KRDGVCTLCGNGVVDVGEE

SEQ ID NO: 2796559 - protein, 20 aa, Entamoeba invadens
KRDHCPWISQCVGENNLRYF

SEQ ID NO: 2796560 - protein, 20 aa, Entamoeba invadens
KRDKFLFSITLLENSETLKQ

SEQ ID NO: 2796561 - protein, 18 aa, Entamoeba invadens
KRDMCKKTSSGSVMFKTS

SEQ ID NO: 2796562 - protein, 19 aa, Entamoeba invadens
KRECAVCKTGKYPNDSSKV

SEQ ID NO: 2796563 - protein, 25 aa, Entamoeba invadens
KREEYKVLCVIPFSSYRKRMSVLLR

SEQ ID NO: 2796564 - protein, 24 aa, Entamoeba invadens
KREKDLRKQYALTHMKQTSPFNKG

SEQ ID NO: 2796565 - protein, 21 aa, Entamoeba invadens
KRERYGYSLVGGWVINTSHLY

SEQ ID NO: 2796566 - protein, 17 aa, Entamoeba invadens
KRESIQVIVQRIEMILN

SEQ ID NO: 2796567 - protein, 24 aa, Entamoeba invadens
KREVLEVLEDLLFEEGFIVLYQKI

SEQ ID NO: 2796568 - protein, 20 aa, Entamoeba invadens
KRFFQPMGEWCISKKKYGDK

SEQ ID NO: 2796569 - protein, 25 aa, Entamoeba invadens
KRFPKALDAKHMWVLTDAAMVISET

SEQ ID NO: 2796570 - protein, 19 aa, Entamoeba invadens
KRFSISVFCPEGKDEEWNN

SEQ ID NO: 2796571 - protein, 22 aa, Entamoeba invadens
KRFTSMQFLYFLPFNHSPQNIL

SEQ ID NO: 2796572 - protein, 21 aa, Entamoeba invadens
KRFTYCVLDEGHIIKNPKTKL

SEQ ID NO: 2796573 - protein, 19 aa, Entamoeba invadens
KRGFIPTLLKTLMGTTSLD

SEQ ID NO: 2796574 - protein, 17 aa, Entamoeba invadens
KRGGLKVWVITGDRLET

SEQ ID NO: 2796575 - protein, 18 aa, Entamoeba invadens
KRGIVVCKYGYYDQTTNT

SEQ ID NO: 2796576 - protein, 21 aa, Entamoeba invadens
KRHIKELKKNIHINKIKRLDI

SEQ ID NO: 2796577 - protein, 19 aa, Entamoeba invadens
KRIDLSVLLMESPFLNLFD

SEQ ID NO: 2796578 - protein, 18 aa, Entamoeba invadens
KRIDPKDVVAHHSPEVQI

SEQ ID NO: 2796579 - protein, 35 aa, Entamoeba invadens
KRIDRLNTLLGQIELRISTLINSRIYQKCLPLQFF

SEQ ID NO: 2796580 - protein, 26 aa, Entamoeba invadens
KRIFQILPTCDWEFDYPYYQLALISK

SEQ ID NO: 2796581 - protein, 24 aa, Entamoeba invadens
KRIHPKIFYYTSLIVHLFNYGVIA

SEQ ID NO: 2796582 - protein, 22 aa, Entamoeba invadens
KRIIRVSLNISLIVFIPSFVLF

SEQ ID NO: 2796583 - protein, 27 aa, Entamoeba invadens
KRISIIKAVHAWLNLIIFILWNLFFIS

SEQ ID NO: 2796584 - protein, 25 aa, Entamoeba invadens
KRITIPDTVRFVFNHAFEDCLNLQE

SEQ ID NO: 2796585 - protein, 20 aa, Entamoeba invadens
KRKAALASEQCWMTTQESFK

SEQ ID NO: 2796586 - protein, 17 aa, Entamoeba invadens
KRKCDFTTPSMMRISTY

SEQ ID NO: 2796587 - protein, 26 aa, Entamoeba invadens
KRKIIEFIKGFGWKLWVLAFIQMSAT

SEQ ID NO: 2796588 - protein, 21 aa, Entamoeba invadens
KRKIYLCSFFFGLAVHMKIYP

SEQ ID NO: 2796589 - protein, 19 aa, Entamoeba invadens
KRKKFKIFADKGAEKNRCW

SEQ ID NO: 2796590 - protein, 21 aa, Entamoeba invadens
KRKLPSLNGGFGYGGVEKMRK

SEQ ID NO: 2796591 - protein, 28 aa, Entamoeba invadens
KRKNIPDVWFEFIKMCWKQNPKERNSIT

SEQ ID NO: 2796592 - protein, 17 aa, Entamoeba invadens
KRKPSFKTEKLNIFESI

SEQ ID NO: 2796593 - protein, 19 aa, Entamoeba invadens
KRKSFAPRKSVIQQPTSKK

SEQ ID NO: 2796594 - protein, 19 aa, Entamoeba invadens
KRKTFKWNAENYAKQFEAF

SEQ ID NO: 2796595 - protein, 19 aa, Entamoeba invadens
KRLAKPDFIAAKYFTIITQ

SEQ ID NO: 2796596 - protein, 19 aa, Entamoeba invadens
KRLGIPTTFNHELADLIAK

SEQ ID NO: 2796597 - protein, 20 aa, Entamoeba invadens
KRLGQLLALGHFPKHIIPFV

SEQ ID NO: 2796598 - protein, 26 aa, Entamoeba invadens
KRLIHKLLKCKLGFFDVTPMGRIVNY

SEQ ID NO: 2796599 - protein, 21 aa, Entamoeba invadens
KRLKGTDLMSLFVEIVNNKIP

SEQ ID NO: 2796600 - protein, 21 aa, Entamoeba invadens
KRLLMTVVPYAFRGDWTRTAT

SEQ ID NO: 2796601 - protein, 20 aa, Entamoeba invadens
KRLLRYGKSTDIFCHLNNSI

SEQ ID NO: 2796602 - protein, 23 aa, Entamoeba invadens
KRLRANFDQKVFFMFVSGIFSIV

SEQ ID NO: 2796603 - protein, 20 aa, Entamoeba invadens
KRLVCLLKDQGEVVAVTGDG

SEQ ID NO: 2796604 - protein, 26 aa, Entamoeba invadens
KRLVGEGTFGKVFLCVFRGQHVALKV

SEQ ID NO: 2796605 - protein, 27 aa, Entamoeba invadens
KRLYHYKNLCCLCVEQSEVSKWLTTIK

SEQ ID NO: 2796606 - protein, 21 aa, Entamoeba invadens
KRMAIDREQRRVIINKPFFFI

SEQ ID NO: 2796607 - protein, 19 aa, Entamoeba invadens
KRMCLECTTNFSVNSEGVC

SEQ ID NO: 2796608 - protein, 20 aa, Entamoeba invadens
KRMEKPCGLDEKYYNLIERC

SEQ ID NO: 2796609 - protein, 18 aa, Entamoeba invadens
KRMFEMKNEITAFRQASQ

SEQ ID NO: 2796610 - protein, 18 aa, Entamoeba invadens
KRNCIVESFVHKFCDFKS

SEQ ID NO: 2796611 - protein, 28 aa, Entamoeba invadens
KRNELKDGLKGGGVMSIYYQINMRREGT

SEQ ID NO: 2796612 - protein, 22 aa, Entamoeba invadens
KRPDISDTIPIVLNELIQKCWV

SEQ ID NO: 2796613 - protein, 22 aa, Entamoeba invadens
KRPDISDTIPIVLNELIQNCWA

SEQ ID NO: 2796614 - protein, 21 aa, Entamoeba invadens
KRPEFKEVALLLQKELSLTVP

SEQ ID NO: 2796615 - protein, 22 aa, Entamoeba invadens
KRPFVQCCVELGIIDYIFDFLK

SEQ ID NO: 2796616 - protein, 21 aa, Entamoeba invadens
KRPIHYFWYYINSIVFHCFVT

SEQ ID NO: 2796617 - protein, 26 aa, Entamoeba invadens
KRPLIPKVCVYRRIIRKCWQHKPRSR

SEQ ID NO: 2796618 - protein, 21 aa, Entamoeba invadens
KRPVDDFGEGVFLNCLNLDHV

SEQ ID NO: 2796619 - protein, 24 aa, Entamoeba invadens
KRQLEEYCVLCGGDMNDSKSLVLV

SEQ ID NO: 2796620 - protein, 27 aa, Entamoeba invadens
KRREQSPRMAVKVKFMFDMAKGISYLH

SEQ ID NO: 2796621 - protein, 20 aa, Entamoeba invadens
KRRFEHARNILATLKIETRK

SEQ ID NO: 2796622 - protein, 21 aa, Entamoeba invadens
KRRLCNVAWAIAQGKLMHRPT

SEQ ID NO: 2796623 - protein, 19 aa, Entamoeba invadens
KRRLPSINGGFGYGGAHKI

SEQ ID NO: 2796624 - protein, 22 aa, Entamoeba invadens
KRSAFMSFVNWFVFGIYQSLVF

SEQ ID NO: 2796625 - protein, 17 aa, Entamoeba invadens
KRSFYVFVTGSEVSDVG

SEQ ID NO: 2796626 - protein, 26 aa, Entamoeba invadens
KRSGTQANFLWKILYDKIGSMGNDGK

SEQ ID NO: 2796627 - protein, 18 aa, Entamoeba invadens
KRSIFGYTNINPANLDTT

SEQ ID NO: 2796628 - protein, 17 aa, Entamoeba invadens
KRSLVTHVVIWTFCFCI

SEQ ID NO: 2796629 - protein, 23 aa, Entamoeba invadens
KRSNRCLKCSNGYLLSENHCQNT

SEQ ID NO: 2796630 - protein, 18 aa, Entamoeba invadens
KRSQCPCNGETCIVNTES

SEQ ID NO: 2796631 - protein, 19 aa, Entamoeba invadens
KRSVDSKCVECDFWYEISD

SEQ ID NO: 2796632 - protein, 26 aa, Entamoeba invadens
KRTIRDLPIFFIYQINTTIFTFQSSY

SEQ ID NO: 2796633 - protein, 20 aa, Entamoeba invadens
KRTVWWVVLLVVFFLLFICI

SEQ ID NO: 2796634 - protein, 24 aa, Entamoeba invadens
KRVHPKIFYYTSLIVHLFNYGIIA

SEQ ID NO: 2796635 - protein, 17 aa, Entamoeba invadens
KRVKWNLKEMNTNLFRS

SEQ ID NO: 2796636 - protein, 22 aa, Entamoeba invadens
KRVNKARLSRGIISLQKTGQVI

SEQ ID NO: 2796637 - protein, 20 aa, Entamoeba invadens
KRVNTLFMIYTFINFIATFA

SEQ ID NO: 2796638 - protein, 25 aa, Entamoeba invadens
KRWSYTEPYCPLGNDVDWYITPLYN

SEQ ID NO: 2796639 - protein, 19 aa, Entamoeba invadens
KRYDIKIELDGGVDNSSVE

SEQ ID NO: 2796640 - protein, 29 aa, Entamoeba invadens
KRYECYQCPDKCLRCVDGKCISCEQNYYY

SEQ ID NO: 2796641 - protein, 19 aa, Entamoeba invadens
KRYGVRAVPTFILFREKKE

SEQ ID NO: 2796642 - protein, 24 aa, Entamoeba invadens
KRYNKTPKCLMHYKDNLEGVLKFM

SEQ ID NO: 2796643 - protein, 20 aa, Entamoeba invadens
KRYVFFFFYNFVVNQISHEN

SEQ ID NO: 2796644 - protein, 21 aa, Entamoeba invadens
KRYVKCLYSYALIPDCSCYIN

SEQ ID NO: 2796645 - protein, 21 aa, Entamoeba invadens
KSADSRLSTLIKTYDSKVISS

SEQ ID NO: 2796646 - protein, 18 aa, Entamoeba invadens
KSAKAFRLIVDKFTYQCG

SEQ ID NO: 2796647 - protein, 27 aa, Entamoeba invadens
KSCDAKSGYCLTCFAGYGFNSGICTQC

SEQ ID NO: 2796648 - protein, 24 aa, Entamoeba invadens
KSCIKCKDGFVLLNGICEINNDCI

SEQ ID NO: 2796649 - protein, 20 aa, Entamoeba invadens
KSCTACPSGTISSRGATICH

SEQ ID NO: 2796650 - protein, 21 aa, Entamoeba invadens
KSCTCITGFNFLSNGLCETCH

SEQ ID NO: 2796651 - protein, 26 aa, Entamoeba invadens
KSCYLKYQKSVICTKKHIEKCVIENY

SEQ ID NO: 2796652 - protein, 18 aa, Entamoeba invadens
KSDFCLRQSDYDRLEDGN

SEQ ID NO: 2796653 - protein, 18 aa, Entamoeba invadens
KSDGKSCLECEPNYLKVT

SEQ ID NO: 2796654 - protein, 26 aa, Entamoeba invadens
KSDIFSFGITCWEVFYQQEPYSEFKS

SEQ ID NO: 2796655 - protein, 26 aa, Entamoeba invadens
KSDINYFVFLGRRINYFDVKDTMFLA

SEQ ID NO: 2796656 - protein, 24 aa, Entamoeba invadens
KSDKCATPECSFCVMETQDNSWCS

SEQ ID NO: 2796657 - protein, 17 aa, Entamoeba invadens
KSDLILSGNLPYKIDGD

SEQ ID NO: 2796658 - protein, 21 aa, Entamoeba invadens
KSDNCLICDYGSFPTALGCTL

SEQ ID NO: 2796659 - protein, 30 aa, Entamoeba invadens
KSDVFSFAICMLEIWIGRDVYPPDKFPDSE

SEQ ID NO: 2796660 - protein, 28 aa, Entamoeba invadens
KSDVFSFAICMLEIWLGSDPYPPAKFPD

SEQ ID NO: 2796661 - protein, 29 aa, Entamoeba invadens
KSDVFSFAICMLEIWLTRDPYPIIEFRDG

SEQ ID NO: 2796662 - protein, 30 aa, Entamoeba invadens
KSDVFSFAICMLEIWVGRDVYPSDKFPDSE

SEQ ID NO: 2796663 - protein, 26 aa, Entamoeba invadens
KSDVFSFAVCCLEIYLRKVPYPKEQF

SEQ ID NO: 2796664 - protein, 31 aa, Entamoeba invadens
KSDVFSYAICMLEIWLCRSPYNVEEFETPES

SEQ ID NO: 2796665 - protein, 24 aa, Entamoeba invadens
KSECLHCEYGAFLFENKCIGTCPV

SEQ ID NO: 2796666 - protein, 28 aa, Entamoeba invadens
KSEEFDHQIRLKICIDSAKGLFYLHTNG

SEQ ID NO: 2796667 - protein, 21 aa, Entamoeba invadens
KSEFVDGWFIKNIYDESEICD

SEQ ID NO: 2796668 - protein, 21 aa, Entamoeba invadens
KSEGILNLASSHLVSITSSES

SEQ ID NO: 2796669 - protein, 23 aa, Entamoeba invadens
KSEIKVVPFGSTQSKLFLPSSDI

SEQ ID NO: 2796670 - protein, 25 aa, Entamoeba invadens
KSEILGMAVGFVFSLLWAVTKHWTF

SEQ ID NO: 2796671 - protein, 22 aa, Entamoeba invadens
KSEIVFDLKLKILKDSTKGIQY

SEQ ID NO: 2796672 - protein, 23 aa, Entamoeba invadens
KSEKFWFTFVAHKTMKVNVSTCF

SEQ ID NO: 2796673 - protein, 25 aa, Entamoeba invadens
KSENDCIHKGLSVDFTIFVVIVSCV

SEQ ID NO: 2796674 - protein, 18 aa, Entamoeba invadens
KSENSLFLYYSSYIFFIF

SEQ ID NO: 2796675 - protein, 23 aa, Entamoeba invadens
KSFDVSTYYGFFVCNTSSTLVGY

SEQ ID NO: 2796676 - protein, 22 aa, Entamoeba invadens
KSFIEIRYGFIFVNSTIIVTNR

SEQ ID NO: 2796677 - protein, 17 aa, Entamoeba invadens
KSFKVLSYVIFMLFTLF

SEQ ID NO: 2796678 - protein, 17 aa, Entamoeba invadens
KSFNYWLVIVLPVACVV

SEQ ID NO: 2796679 - protein, 17 aa, Entamoeba invadens
KSFYVVSAFSIVALLLA

SEQ ID NO: 2796680 - protein, 17 aa, Entamoeba invadens
KSGCASCQTGYFLSNGR

SEQ ID NO: 2796681 - protein, 26 aa, Entamoeba invadens
KSGCFFCKRGFYAINGFCKRCGDNCD

SEQ ID NO: 2796682 - protein, 19 aa, Entamoeba invadens
KSGCGKTSLLKHISEQQHS

SEQ ID NO: 2796683 - protein, 23 aa, Entamoeba invadens
KSGCISCDIGYYLSNAVCFQCSE

SEQ ID NO: 2796684 - protein, 19 aa, Entamoeba invadens
KSGCKRCDLGYFVSSGICM

SEQ ID NO: 2796685 - protein, 18 aa, Entamoeba invadens
KSGGELANKCNILTLSGT

SEQ ID NO: 2796686 - protein, 17 aa, Entamoeba invadens
KSGKCLPQSSIVGCDNV

SEQ ID NO: 2796687 - protein, 19 aa, Entamoeba invadens
KSGKCVSCGTAFANCNTCD

SEQ ID NO: 2796688 - protein, 25 aa, Entamoeba invadens
KSGKWYIKYIKSHLKGAFDTLLQRL

SEQ ID NO: 2796689 - protein, 24 aa, Entamoeba invadens
KSGLELLSKMLLSIFAIMQSHPMS

SEQ ID NO: 2796690 - protein, 17 aa, Entamoeba invadens
KSGMKTACGAYCNNCQY

SEQ ID NO: 2796691 - protein, 17 aa, Entamoeba invadens
KSGRSGLDVSQYPVFPW

SEQ ID NO: 2796692 - protein, 23 aa, Entamoeba invadens
KSGRVYLKVTPLPGLRKDVKTKS

SEQ ID NO: 2796693 - protein, 24 aa, Entamoeba invadens
KSGSLKIGGELGFVGLTVESKFGA

SEQ ID NO: 2796694 - protein, 19 aa, Entamoeba invadens
KSGSLVICKYYFDIYDNTT

SEQ ID NO: 2796695 - protein, 19 aa, Entamoeba invadens
KSGVLPIIHPFIVAKGIMY

SEQ ID NO: 2796696 - protein, 23 aa, Entamoeba invadens
KSGVPIVICIHGLKEVSADWRDL

SEQ ID NO: 2796697 - protein, 26 aa, Entamoeba invadens
KSHLNKCLKCEISFMRVDEIIVKAEY

SEQ ID NO: 2796698 - protein, 20 aa, Entamoeba invadens
KSHPINSFVLKMLGVSNNVF

SEQ ID NO: 2796699 - protein, 19 aa, Entamoeba invadens
KSIAYRIYQIIDRIPDVDV

SEQ ID NO: 2796700 - protein, 18 aa, Entamoeba invadens
KSICAFCESHFFRNAEGE

SEQ ID NO: 2796701 - protein, 26 aa, Entamoeba invadens
KSIGCLKQRLSKCIQCEIGKYFDDKT

SEQ ID NO: 2796702 - protein, 20 aa, Entamoeba invadens
KSIGSFEWVDGIVVKCMKRG

SEQ ID NO: 2796703 - protein, 23 aa, Entamoeba invadens
KSIGYGCFRKCSSLISITIPSSV

SEQ ID NO: 2796704 - protein, 24 aa, Entamoeba invadens
KSILLEFYDLLKLHHVDYSQYKQQ

SEQ ID NO: 2796705 - protein, 17 aa, Entamoeba invadens
KSIQRFDVTANRITTVK

SEQ ID NO: 2796706 - protein, 23 aa, Entamoeba invadens
KSIRMLLTIFCVMYISSYLIYLL

SEQ ID NO: 2796707 - protein, 17 aa, Entamoeba invadens
KSISVKMYLSILSPSQF

SEQ ID NO: 2796708 - protein, 19 aa, Entamoeba invadens
KSITVQRGGPLTFIQDIQI

SEQ ID NO: 2796709 - protein, 28 aa, Entamoeba invadens
KSIWKKMLHFPGWFFSQFSRTDPEGSSL

SEQ ID NO: 2796710 - protein, 19 aa, Entamoeba invadens
KSKCLLRNSNYFLANGICQ

SEQ ID NO: 2796711 - protein, 20 aa, Entamoeba invadens
KSKCMKCSFWNEPSEDGTYC

SEQ ID NO: 2796712 - protein, 19 aa, Entamoeba invadens
KSKHFKNKFSKYSEYPAGN

SEQ ID NO: 2796713 - protein, 17 aa, Entamoeba invadens
KSKITIVQMCYFLVFLR

SEQ ID NO: 2796714 - protein, 18 aa, Entamoeba invadens
KSKMCQFSGMTPDRQIVY

SEQ ID NO: 2796715 - protein, 25 aa, Entamoeba invadens
KSKNGYCILETCGNGKRDGGEECDN

SEQ ID NO: 2796716 - protein, 23 aa, Entamoeba invadens
KSKNSKCSKCTFWKSPNTDGTLC

SEQ ID NO: 2796717 - protein, 19 aa, Entamoeba invadens
KSKRTLIEISNLLKDKSFE

SEQ ID NO: 2796718 - protein, 29 aa, Entamoeba invadens
KSKSGCLLCAGGYYLGTTVPRCIKCSSNC

SEQ ID NO: 2796719 - protein, 27 aa, Entamoeba invadens
KSKSGCLLCAGGYYLGTVIPRCIKCSS

SEQ ID NO: 2796720 - protein, 36 aa, Entamoeba invadens
KSKSSVKFFECFVTPMVVEFNAPFTFVNTTPLELKI

SEQ ID NO: 2796721 - protein, 30 aa, Entamoeba invadens
KSKTGVLYALIRLPLGTSLDMQIDIIDTNP

SEQ ID NO: 2796722 - protein, 21 aa, Entamoeba invadens
KSLQEHYCLFGIASSTEIPYC

SEQ ID NO: 2796723 - protein, 25 aa, Entamoeba invadens
KSLRPFVITCVVLFTVFVTVPCVLI

SEQ ID NO: 2796724 - protein, 21 aa, Entamoeba invadens
KSLSVCLAKPASKVIIYDGYR

SEQ ID NO: 2796725 - protein, 17 aa, Entamoeba invadens
KSLVNEFLLKDLKKKGV

SEQ ID NO: 2796726 - protein, 20 aa, Entamoeba invadens
KSLWHKFALFISNKWYSLIV

SEQ ID NO: 2796727 - protein, 21 aa, Entamoeba invadens
KSLWHKFAVFISNKWYSLIVI

SEQ ID NO: 2796728 - protein, 19 aa, Entamoeba invadens
KSLYLLIVIAKVYMNDTLC

SEQ ID NO: 2796729 - protein, 17 aa, Entamoeba invadens
KSMGYIKLFKMVDGISE

SEQ ID NO: 2796730 - protein, 18 aa, Entamoeba invadens
KSMISVSVGQSFTDGEIM

SEQ ID NO: 2796731 - protein, 18 aa, Entamoeba invadens
KSMLCFVTNTLLLILLTT

SEQ ID NO: 2796732 - protein, 24 aa, Entamoeba invadens
KSMPEYLSSILFVLTFNILDTLVD

SEQ ID NO: 2796733 - protein, 26 aa, Entamoeba invadens
KSMWNIPQIFDWTRYNGGTYPVPTEQ

SEQ ID NO: 2796734 - protein, 25 aa, Entamoeba invadens
KSNACFKCLIGYSLQGITCEYKEKC

SEQ ID NO: 2796735 - protein, 17 aa, Entamoeba invadens
KSNDLFVQMIAIAAGCG

SEQ ID NO: 2796736 - protein, 17 aa, Entamoeba invadens
KSNECVVIDSGVGERLN

SEQ ID NO: 2796737 - protein, 21 aa, Entamoeba invadens
KSNEGGFTFSKYLANFFEPLF

SEQ ID NO: 2796738 - protein, 27 aa, Entamoeba invadens
KSNGEIFRLPSFTYKRIDTHDSSTDIA

SEQ ID NO: 2796739 - protein, 23 aa, Entamoeba invadens
KSNGILCTICYPNFYRDLTTQGN

SEQ ID NO: 2796740 - protein, 20 aa, Entamoeba invadens
KSNHIICFLLSPLDVLLSLT

SEQ ID NO: 2796741 - protein, 18 aa, Entamoeba invadens
KSNIEFMKTLSKDVVTNM

SEQ ID NO: 2796742 - protein, 23 aa, Entamoeba invadens
KSNKAGMIVGIIIAVIVVVAVVA

SEQ ID NO: 2796743 - protein, 23 aa, Entamoeba invadens
KSNKFSIPISRSLRLIRRDDEQH

SEQ ID NO: 2796744 - protein, 22 aa, Entamoeba invadens
KSNRKLNGFKREYDDILKKNVQ

SEQ ID NO: 2796745 - protein, 20 aa, Entamoeba invadens
KSNYIIKFFGAVHVGNSRMI

SEQ ID NO: 2796746 - protein, 18 aa, Entamoeba invadens
KSPCILIVDSLRSSKSSK

SEQ ID NO: 2796747 - protein, 18 aa, Entamoeba invadens
KSPLAYVLLSKKLNYDTR

SEQ ID NO: 2796748 - protein, 17 aa, Entamoeba invadens
KSPNFDKVWRPPLFTPR

SEQ ID NO: 2796749 - protein, 26 aa, Entamoeba invadens
KSPTGCLSCNSGFFVDSQFCVSCDTK

SEQ ID NO: 2796750 - protein, 30 aa, Entamoeba invadens
KSQCHFFAQFAIDMLRRLKVNNDNLFKIIW

SEQ ID NO: 2796751 - protein, 20 aa, Entamoeba invadens
KSQILKSAFLDFMTYFTQDI

SEQ ID NO: 2796752 - protein, 20 aa, Entamoeba invadens
KSQLIFSEYLFLPKNIGLSP

SEQ ID NO: 2796753 - protein, 24 aa, Entamoeba invadens
KSQRRIDKRLGFFSEILKNVKFVK

SEQ ID NO: 2796754 - protein, 21 aa, Entamoeba invadens
KSRLYCLVATCGNKQVDGDEE

SEQ ID NO: 2796755 - protein, 18 aa, Entamoeba invadens
KSSCLTCNTKYFKTTKGD

SEQ ID NO: 2796756 - protein, 31 aa, Entamoeba invadens
KSSCRPKTALGWWFLLRGADRSVLISTCDNN

SEQ ID NO: 2796757 - protein, 23 aa, Entamoeba invadens
KSSEDCKKCPVLVNNNSLKKGSP

SEQ ID NO: 2796758 - protein, 17 aa, Entamoeba invadens
KSSFFVCDDRAYIYGLT

SEQ ID NO: 2796759 - protein, 31 aa, Entamoeba invadens
KSSHRILFIFLIKMFFEDRFLIFYKNKTNRI

SEQ ID NO: 2796760 - protein, 20 aa, Entamoeba invadens
KSSISLLCKRCSVKLISYLK

SEQ ID NO: 2796761 - protein, 21 aa, Entamoeba invadens
KSSNNELYFYNSLKMKLAILV

SEQ ID NO: 2796762 - protein, 23 aa, Entamoeba invadens
KSSPFYIVIGLIAFFITSFKPIN

SEQ ID NO: 2796763 - protein, 20 aa, Entamoeba invadens
KSSQCLSCNASTFLYNSSCL

SEQ ID NO: 2796764 - protein, 20 aa, Entamoeba invadens
KSSQSGYCTSCISGYYLYGA

SEQ ID NO: 2796765 - protein, 23 aa, Entamoeba invadens
KSSSCTKCKAGTYADEQGSSECK

SEQ ID NO: 2796766 - protein, 29 aa, Entamoeba invadens
KSSSKRARLFARLSFTTLFVISLILVCVV

SEQ ID NO: 2796767 - protein, 19 aa, Entamoeba invadens
KSSYLHLHYNFIYNKNFYI

SEQ ID NO: 2796768 - protein, 21 aa, Entamoeba invadens
KSTCLQCIQHNFLLTDSTKCL

SEQ ID NO: 2796769 - protein, 22 aa, Entamoeba invadens
KSTCQLCDLTVVGGKIYDKCAL

SEQ ID NO: 2796770 - protein, 18 aa, Entamoeba invadens
KSTDLYCVHHKKHVCIDC

SEQ ID NO: 2796771 - protein, 26 aa, Entamoeba invadens
KSTFPFLICCILFWGINIVFIVYFAK

SEQ ID NO: 2796772 - protein, 22 aa, Entamoeba invadens
KSTKAPPLFLFLKCICNDLQTE

SEQ ID NO: 2796773 - protein, 21 aa, Entamoeba invadens
KSTKCTPCATGHYTDVNGSTS

SEQ ID NO: 2796774 - protein, 24 aa, Entamoeba invadens
KSTKGCLKCAPKYFLDSQNVCKQC

SEQ ID NO: 2796775 - protein, 30 aa, Entamoeba invadens
KSTLRSGVCTKTDLVKCYFVKEQTNIYDDQ

SEQ ID NO: 2796776 - protein, 22 aa, Entamoeba invadens
KSTNEVPTWAIIVIVLGVIFIF

SEQ ID NO: 2796777 - protein, 23 aa, Entamoeba invadens
KSTRFGCALCNNGYYSVDSINKE

SEQ ID NO: 2796778 - protein, 18 aa, Entamoeba invadens
KSTTDITCDCKFSQFDVD

SEQ ID NO: 2796779 - protein, 21 aa, Entamoeba invadens
KSTYIFPWTIADDVASGKRPI

SEQ ID NO: 2796780 - protein, 20 aa, Entamoeba invadens
KSVCIHCEYGYYAFNGRCQQ

SEQ ID NO: 2796781 - protein, 19 aa, Entamoeba invadens
KSVDCVQCDSFAPWCKTCA

SEQ ID NO: 2796782 - protein, 17 aa, Entamoeba invadens
KSVDQLILLTGKHEDKI

SEQ ID NO: 2796783 - protein, 18 aa, Entamoeba invadens
KSVISCVLCHALCNYLGF

SEQ ID NO: 2796784 - protein, 24 aa, Entamoeba invadens
KSVLYCLIEVIGVKQSNVFVGYDE

SEQ ID NO: 2796785 - protein, 34 aa, Entamoeba invadens
KSVRFPNDMYNFFGIDFHPSFSVEGFIITSVFFN

SEQ ID NO: 2796786 - protein, 27 aa, Entamoeba invadens
KSVRGCLKCSSGYFVENQFCYSCDSKT

SEQ ID NO: 2796787 - protein, 20 aa, Entamoeba invadens
KSVRYLMKRVIELPTNNALK

SEQ ID NO: 2796788 - protein, 22 aa, Entamoeba invadens
KSVVIFCVFGAIVVVSICMICT

SEQ ID NO: 2796789 - protein, 20 aa, Entamoeba invadens
KSWCCCLPLATTKVILSQWR

SEQ ID NO: 2796790 - protein, 22 aa, Entamoeba invadens
KSYAMVCIILFCFIAVVFYVQS

SEQ ID NO: 2796791 - protein, 20 aa, Entamoeba invadens
KSYDFGLSMWNSLILSKNVL

SEQ ID NO: 2796792 - protein, 28 aa, Entamoeba invadens
KTADCGRSNCYECLDSRSCKKCKDGYSP

SEQ ID NO: 2796793 - protein, 18 aa, Entamoeba invadens
KTAEFFIQNVYLFESCNK

SEQ ID NO: 2796794 - protein, 20 aa, Entamoeba invadens
KTAEMGYCTECVEGYFLSDV

SEQ ID NO: 2796795 - protein, 18 aa, Entamoeba invadens
KTAFWLNVYHTMLLHALV

SEQ ID NO: 2796796 - protein, 27 aa, Entamoeba invadens
KTAGVYCKWHYIILYLVAVLLNFPLII

SEQ ID NO: 2796797 - protein, 18 aa, Entamoeba invadens
KTAKNWLEVDFNAENVQI

SEQ ID NO: 2796798 - protein, 23 aa, Entamoeba invadens
KTAKTFYQTMYWINGIPSVAVEY

SEQ ID NO: 2796799 - protein, 20 aa, Entamoeba invadens
KTAMRYDIIFGTIVGFIVLI

SEQ ID NO: 2796800 - protein, 20 aa, Entamoeba invadens
KTAMRYDIIFGTIVGVVILI

SEQ ID NO: 2796801 - protein, 18 aa, Entamoeba invadens
KTAVWWVILLIVVIIAIL

SEQ ID NO: 2796802 - protein, 19 aa, Entamoeba invadens
KTAVWWVILLIVVIIILIT

SEQ ID NO: 2796803 - protein, 18 aa, Entamoeba invadens
KTAVWWVILLIVVVIIAI

SEQ ID NO: 2796804 - protein, 21 aa, Entamoeba invadens
KTAYFSYKYVELVNKQKKQMY

SEQ ID NO: 2796805 - protein, 25 aa, Entamoeba invadens
KTCDSSFFRRCYECQTGYYPSLTTY

SEQ ID NO: 2796806 - protein, 29 aa, Entamoeba invadens
KTCKANCPDGYFAKAKVCTVCPDNCKTCT

SEQ ID NO: 2796807 - protein, 33 aa, Entamoeba invadens
KTCKPNCPDGYFAKAKVCTVCPDNCKTCTEETK

SEQ ID NO: 2796808 - protein, 18 aa, Entamoeba invadens
KTCKSCFEHCAVCSSEVC

SEQ ID NO: 2796809 - protein, 19 aa, Entamoeba invadens
KTCQKCPKGTYSLTPGSAN

SEQ ID NO: 2796810 - protein, 18 aa, Entamoeba invadens
KTCSLKTTKCTSCIYTRV

SEQ ID NO: 2796811 - protein, 21 aa, Entamoeba invadens
KTCTICPAGYFSKSGNATCTI

SEQ ID NO: 2796812 - protein, 17 aa, Entamoeba invadens
KTCTKADDCSACVSGKY

SEQ ID NO: 2796813 - protein, 17 aa, Entamoeba invadens
KTCTTLFERYCNECNDH

SEQ ID NO: 2796814 - protein, 19 aa, Entamoeba invadens
KTCVFKRDIGCEAYTSENK

SEQ ID NO: 2796815 - protein, 26 aa, Entamoeba invadens
KTDIDWIILICRALMIVVVCVAYPII

SEQ ID NO: 2796816 - protein, 27 aa, Entamoeba invadens
KTDIDWIILICRALMIVVVCVAYPIIM

SEQ ID NO: 2796817 - protein, 29 aa, Entamoeba invadens
KTDIEGCQECSKGYYLLGKRCQYCDVLDN

SEQ ID NO: 2796818 - protein, 17 aa, Entamoeba invadens
KTDKWELTFGLKGTKAI

SEQ ID NO: 2796819 - protein, 25 aa, Entamoeba invadens
KTDLMKAIVFCGIALAGFIGAGLVL

SEQ ID NO: 2796820 - protein, 20 aa, Entamoeba invadens
KTDLPFAIRPISNTKLSHSD

SEQ ID NO: 2796821 - protein, 18 aa, Entamoeba invadens
KTECLTCDGQNSIIDGKC

SEQ ID NO: 2796822 - protein, 18 aa, Entamoeba invadens
KTECTKCTDGNGILTPPS

SEQ ID NO: 2796823 - protein, 25 aa, Entamoeba invadens
KTEDLKFYLDESFNFLKETDDESAK

SEQ ID NO: 2796824 - protein, 19 aa, Entamoeba invadens
KTEFSKLVVDLSVVANSFF

SEQ ID NO: 2796825 - protein, 20 aa, Entamoeba invadens
KTEGALMMFSKSRGVDYKQL

SEQ ID NO: 2796826 - protein, 18 aa, Entamoeba invadens
KTEGCPNSILPKMIFTFS

SEQ ID NO: 2796827 - protein, 20 aa, Entamoeba invadens
KTEIGTTYFIKVFCREKACD

SEQ ID NO: 2796828 - protein, 17 aa, Entamoeba invadens
KTEKTRTLFKMSRSNIA

SEQ ID NO: 2796829 - protein, 17 aa, Entamoeba invadens
KTEKWELTFNLAKSKAV

SEQ ID NO: 2796830 - protein, 23 aa, Entamoeba invadens
KTELLLKSVITFPVNSNMIQEQA

SEQ ID NO: 2796831 - protein, 28 aa, Entamoeba invadens
KTELTSGCWCLFAGVIFYTISSVLLVKF

SEQ ID NO: 2796832 - protein, 19 aa, Entamoeba invadens
KTEMGYCTECVSGFFIKNG

SEQ ID NO: 2796833 - protein, 20 aa, Entamoeba invadens
KTEQSISVFFSFKKYIYNPT

SEQ ID NO: 2796834 - protein, 17 aa, Entamoeba invadens
KTESPYLLWESNKGNTY

SEQ ID NO: 2796835 - protein, 25 aa, Entamoeba invadens
KTFAECDFSLALPLTLQTGVELTCN

SEQ ID NO: 2796836 - protein, 18 aa, Entamoeba invadens
KTFFFKTHHNEITSMRYV

SEQ ID NO: 2796837 - protein, 23 aa, Entamoeba invadens
KTFKCTMESIKTFTFKSDANEFN

SEQ ID NO: 2796838 - protein, 20 aa, Entamoeba invadens
KTFLYNKLYEIFSIEKNMAR

SEQ ID NO: 2796839 - protein, 26 aa, Entamoeba invadens
KTFPIIHIPFIIGFLLLSIVLFYYSY

SEQ ID NO: 2796840 - protein, 23 aa, Entamoeba invadens
KTFPLLGRVKLRYLDISNNPLTS

SEQ ID NO: 2796841 - protein, 20 aa, Entamoeba invadens
KTFRSHLVKLIGMVETNQYL

SEQ ID NO: 2796842 - protein, 23 aa, Entamoeba invadens
KTFYRLLFDFCVVTFIFTVTTRH

SEQ ID NO: 2796843 - protein, 17 aa, Entamoeba invadens
KTGCIPYCGSCRDGNVC

SEQ ID NO: 2796844 - protein, 23 aa, Entamoeba invadens
KTGEEWTLLFAWKNVDIKNFMYR

SEQ ID NO: 2796845 - protein, 18 aa, Entamoeba invadens
KTGISMITILGDSKIQQN

SEQ ID NO: 2796846 - protein, 22 aa, Entamoeba invadens
KTGKCPHPTFITINTEVTKQTG

SEQ ID NO: 2796847 - protein, 22 aa, Entamoeba invadens
KTGLKCIMCDSNYRLDNDICNS

SEQ ID NO: 2796848 - protein, 17 aa, Entamoeba invadens
KTGMCTVCIEGYTQFST

SEQ ID NO: 2796849 - protein, 25 aa, Entamoeba invadens
KTGRSEILKKFVLEYQNVPETKHLY

SEQ ID NO: 2796850 - protein, 28 aa, Entamoeba invadens
KTHCLSCGENCKWCRSNSVCDICEEDYI

SEQ ID NO: 2796851 - protein, 22 aa, Entamoeba invadens
KTHCLSCKTGYYFDSNMTCIPK

SEQ ID NO: 2796852 - protein, 25 aa, Entamoeba invadens
KTIGFACFENCEFLTKFSFTHRKYI

SEQ ID NO: 2796853 - protein, 26 aa, Entamoeba invadens
KTIIGAIIFVCIAVVFVVVVLVVVSI

SEQ ID NO: 2796854 - protein, 49 aa, Entamoeba invadens
KTILMVFKSIIKRFWFKGVELKPKNFNVWLQRVFHKEVNASNEWNTLVF

SEQ ID NO: 2796855 - protein, 20 aa, Entamoeba invadens
KTIPAVDAFVSPITHPCTYR

SEQ ID NO: 2796856 - protein, 20 aa, Entamoeba invadens
KTIRITNCYGKCEITNWEDL

SEQ ID NO: 2796857 - protein, 18 aa, Entamoeba invadens
KTKCKTCAPGYNLKSNDE

SEQ ID NO: 2796858 - protein, 24 aa, Entamoeba invadens
KTKFKPRINYNISKKSCAESCKSN

SEQ ID NO: 2796859 - protein, 33 aa, Entamoeba invadens
KTKKLWNFNWCSAFGIICSHFYYYSYNRFFNIF

SEQ ID NO: 2796860 - protein, 24 aa, Entamoeba invadens
KTKKSSRDKLAFVAIHADILENFP

SEQ ID NO: 2796861 - protein, 27 aa, Entamoeba invadens
KTKLSIKLLFFLGFIIPLIWPVIVVMC

SEQ ID NO: 2796862 - protein, 24 aa, Entamoeba invadens
KTKMCGEGVIQLCEKLSGEKFEVT

SEQ ID NO: 2796863 - protein, 27 aa, Entamoeba invadens
KTKPVDFSFLFSFDFADIELPKNTHDS

SEQ ID NO: 2796864 - protein, 17 aa, Entamoeba invadens
KTKSCMRCPSTPLNSVA

SEQ ID NO: 2796865 - protein, 27 aa, Entamoeba invadens
KTKSKKSPRFLALFSKTKSAKIILSPR

SEQ ID NO: 2796866 - protein, 25 aa, Entamoeba invadens
KTKYFFCTLGGYIFGLLLTILMLWK

SEQ ID NO: 2796867 - protein, 17 aa, Entamoeba invadens
KTLEFFKKINVPRPKEV

SEQ ID NO: 2796868 - protein, 19 aa, Entamoeba invadens
KTLGLSIGFGTLGLLLLLV

SEQ ID NO: 2796869 - protein, 24 aa, Entamoeba invadens
KTLKCMEMLNFIGSSNNQVQLIRY

SEQ ID NO: 2796870 - protein, 17 aa, Entamoeba invadens
KTLKGMLRRAITNKIFL

SEQ ID NO: 2796871 - protein, 20 aa, Entamoeba invadens
KTLLFIFSVCCFKTDHNNRQ

SEQ ID NO: 2796872 - protein, 19 aa, Entamoeba invadens
KTLLKMCYENNKLGENCTS

SEQ ID NO: 2796873 - protein, 25 aa, Entamoeba invadens
KTLLPHEMIEAGKLLYRMKYTGKGI

SEQ ID NO: 2796874 - protein, 27 aa, Entamoeba invadens
KTLNILFLIVICSGIFILLISITQQNN

SEQ ID NO: 2796875 - protein, 25 aa, Entamoeba invadens
KTLPGYDRFMCFCIADNEMSDYFKE

SEQ ID NO: 2796876 - protein, 24 aa, Entamoeba invadens
KTLPVGNLILHYVNWMTNLCYLTN

SEQ ID NO: 2796877 - protein, 17 aa, Entamoeba invadens
KTLQLIPPYLVHRPGFE

SEQ ID NO: 2796878 - protein, 25 aa, Entamoeba invadens
KTLRLERISKVFFDGHIIMEFGDVI

SEQ ID NO: 2796879 - protein, 19 aa, Entamoeba invadens
KTLRLLPQANLVGDIEKHK

SEQ ID NO: 2796880 - protein, 20 aa, Entamoeba invadens
KTLYFKPEIFCEYKQALLDT

SEQ ID NO: 2796881 - protein, 26 aa, Entamoeba invadens
KTLYKDFGFDRTVYVFGFVVLNTTLS

SEQ ID NO: 2796882 - protein, 19 aa, Entamoeba invadens
KTMEVCFILPKGSVSDSTV

SEQ ID NO: 2796883 - protein, 19 aa, Entamoeba invadens
KTMEVCFVLPKGSVSDSTV

SEQ ID NO: 2796884 - protein, 26 aa, Entamoeba invadens
KTMFWLKVYCGYGYVMSVFIQCILLM

SEQ ID NO: 2796885 - protein, 17 aa, Entamoeba invadens
KTMHIFGPVSFLIFACL

SEQ ID NO: 2796886 - protein, 22 aa, Entamoeba invadens
KTMKDAELLLKAEIDKREQENA

SEQ ID NO: 2796887 - protein, 17 aa, Entamoeba invadens
KTMMSFYLSNNILVKNC

SEQ ID NO: 2796888 - protein, 25 aa, Entamoeba invadens
KTMMTYIKYGGWFNFAMVVFFFFVS

SEQ ID NO: 2796889 - protein, 23 aa, Entamoeba invadens
KTNCKSHVVWWVILLLTIVAVVI

SEQ ID NO: 2796890 - protein, 25 aa, Entamoeba invadens
KTNDRRWALWFGFVLQIVGIILCLI

SEQ ID NO: 2796891 - protein, 27 aa, Entamoeba invadens
KTNEIFKMVGKWIIFIEHIQLCPKDSF

SEQ ID NO: 2796892 - protein, 23 aa, Entamoeba invadens
KTNFLRYYIGGFMMNMSTYFFWL

SEQ ID NO: 2796893 - protein, 19 aa, Entamoeba invadens
KTNFRKVPFHMPQGAYKLI

SEQ ID NO: 2796894 - protein, 19 aa, Entamoeba invadens
KTNLDEIFKEIELNKTLAG

SEQ ID NO: 2796895 - protein, 18 aa, Entamoeba invadens
KTNLKFSECGFGKVRYVG

SEQ ID NO: 2796896 - protein, 24 aa, Entamoeba invadens
KTNPKRYLIFFLLVFIVILIAILF

SEQ ID NO: 2796897 - protein, 19 aa, Entamoeba invadens
KTNTICFVSDYAFDNDDRY

SEQ ID NO: 2796898 - protein, 18 aa, Entamoeba invadens
KTNVLAIVLPIIFAIILI

SEQ ID NO: 2796899 - protein, 19 aa, Entamoeba invadens
KTNVLSIILPIIFGIFIVV

SEQ ID NO: 2796900 - protein, 24 aa, Entamoeba invadens
KTPDACAVFCKFLERLKSNVQMSQ

SEQ ID NO: 2796901 - protein, 22 aa, Entamoeba invadens
KTPELEVSNGLKPLQKVAKNDE

SEQ ID NO: 2796902 - protein, 21 aa, Entamoeba invadens
KTPFLNGIGCRECKETFYRNG

SEQ ID NO: 2796903 - protein, 24 aa, Entamoeba invadens
KTPFSFKPPEGMLSLMDNKLLRFG

SEQ ID NO: 2796904 - protein, 27 aa, Entamoeba invadens
KTPKLYRPASVVWLYANVMEKLGSEIT

SEQ ID NO: 2796905 - protein, 18 aa, Entamoeba invadens
KTPLLSMSVCESKSMRNM

SEQ ID NO: 2796906 - protein, 27 aa, Entamoeba invadens
KTPNFPSLVCLLFFILLYSYNNYYHTL

SEQ ID NO: 2796907 - protein, 22 aa, Entamoeba invadens
KTPNFTAGSFLVVFMSSLIATQ

SEQ ID NO: 2796908 - protein, 22 aa, Entamoeba invadens
KTPVAFECNEGFVLTNGSCKTT

SEQ ID NO: 2796909 - protein, 22 aa, Entamoeba invadens
KTQGRQTYPFAFTEAMAPIIGN

SEQ ID NO: 2796910 - protein, 27 aa, Entamoeba invadens
KTQIFGLRAIFLCFFFILNEVSYEQKQ

SEQ ID NO: 2796911 - protein, 31 aa, Entamoeba invadens
KTQISTLIKFCFYKNAAFFLVNVFFAMISNY

SEQ ID NO: 2796912 - protein, 25 aa, Entamoeba invadens
KTQKGFLKWFGFSIIIIGVFVCIIG

SEQ ID NO: 2796913 - protein, 24 aa, Entamoeba invadens
KTQLVGLCKRMSGGEQISEKNVSW

SEQ ID NO: 2796914 - protein, 21 aa, Entamoeba invadens
KTRCTECYDGFALSKFTTTNT

SEQ ID NO: 2796915 - protein, 23 aa, Entamoeba invadens
KTREKFCLFEMALSNVQFISTSN

SEQ ID NO: 2796916 - protein, 24 aa, Entamoeba invadens
KTREKFCLFEMALSNVQFISTSNS

SEQ ID NO: 2796917 - protein, 23 aa, Entamoeba invadens
KTRFPLLKVLFFAGFILPLIWPI

SEQ ID NO: 2796918 - protein, 19 aa, Entamoeba invadens
KTRFVYIMRNAVCMGFQNL

SEQ ID NO: 2796919 - protein, 25 aa, Entamoeba invadens
KTRSGCTLCEFGYFIYQNECQKCKD

SEQ ID NO: 2796920 - protein, 24 aa, Entamoeba invadens
KTSAKYCPLCHSLFSLTNRKHRCE

SEQ ID NO: 2796921 - protein, 18 aa, Entamoeba invadens
KTSCAICYDGYLRENGDC

SEQ ID NO: 2796922 - protein, 20 aa, Entamoeba invadens
KTSDDFAWDIVDFVVSGKRL

SEQ ID NO: 2796923 - protein, 25 aa, Entamoeba invadens
KTSERCFRCIMGYYPDVTSKLCTSC

SEQ ID NO: 2796924 - protein, 18 aa, Entamoeba invadens
KTSIFLEKGEQCTLLNKT

SEQ ID NO: 2796925 - protein, 19 aa, Entamoeba invadens
KTSLFSLSVCSVLMVNLWS

SEQ ID NO: 2796926 - protein, 23 aa, Entamoeba invadens
KTSLSNCFCILTGNTLDKNINSF

SEQ ID NO: 2796927 - protein, 26 aa, Entamoeba invadens
KTSSECLRCIEGYYYNGTTCLNCDSA

SEQ ID NO: 2796928 - protein, 20 aa, Entamoeba invadens
KTSTCIRCQFGYQLDAAMNC

SEQ ID NO: 2796929 - protein, 20 aa, Entamoeba invadens
KTSVIKLLFVFLITVLMIPV

SEQ ID NO: 2796930 - protein, 18 aa, Entamoeba invadens
KTSYVPMNTFFVTAENQQ

SEQ ID NO: 2796931 - protein, 28 aa, Entamoeba invadens
KTTADAWCDWVKSVAGLFGLKLNLCVNF

SEQ ID NO: 2796932 - protein, 18 aa, Entamoeba invadens
KTTCLICNSTNYKTSSGD

SEQ ID NO: 2796933 - protein, 24 aa, Entamoeba invadens
KTTCRECLPEYILQKDGTCLKSPN

SEQ ID NO: 2796934 - protein, 19 aa, Entamoeba invadens
KTTDGRCVACQVANCVTCD

SEQ ID NO: 2796935 - protein, 22 aa, Entamoeba invadens
KTTGECLTCYSGYQLNASQSCE

SEQ ID NO: 2796936 - protein, 27 aa, Entamoeba invadens
KTTKYKWWSFVFVFLFNQFKYFINMFF

SEQ ID NO: 2796937 - protein, 19 aa, Entamoeba invadens
KTTLKATEYVLSFEAVTKK

SEQ ID NO: 2796938 - protein, 24 aa, Entamoeba invadens
KTVCGKLTDFGTCRLITEQKLKEK

SEQ ID NO: 2796939 - protein, 17 aa, Entamoeba invadens
KTVEVFSKIYLNNPFSE

SEQ ID NO: 2796940 - protein, 28 aa, Entamoeba invadens
KTVINPKFRGGVVWFRDSSKIEYTLSTR

SEQ ID NO: 2796941 - protein, 18 aa, Entamoeba invadens
KTVLSWVNAEMVCKYTGD

SEQ ID NO: 2796942 - protein, 19 aa, Entamoeba invadens
KTVLYLTINEIVMNRERKL

SEQ ID NO: 2796943 - protein, 17 aa, Entamoeba invadens
KTVSVPLFRLFILNHLF

SEQ ID NO: 2796944 - protein, 18 aa, Entamoeba invadens
KTWEKLSLAARVIAGISI

SEQ ID NO: 2796945 - protein, 17 aa, Entamoeba invadens
KTWHLFESILTLKSNVN

SEQ ID NO: 2796946 - protein, 17 aa, Entamoeba invadens
KTWKFLIQNTIYAKKLA

SEQ ID NO: 2796947 - protein, 20 aa, Entamoeba invadens
KTYGCLECVEGYYFDSSYKC

SEQ ID NO: 2796948 - protein, 18 aa, Entamoeba invadens
KTYLEYFVSGGFVLFTFV

SEQ ID NO: 2796949 - protein, 26 aa, Entamoeba invadens
KTYLITVLICFWFSFALNEFLTNIFK

SEQ ID NO: 2796950 - protein, 17 aa, Entamoeba invadens
KTYLSVCDMSIERDVVV

SEQ ID NO: 2796951 - protein, 19 aa, Entamoeba invadens
KTYRWNIRVLYDMIDIAAL

SEQ ID NO: 2796952 - protein, 27 aa, Entamoeba invadens
KTYTSGCARCGFGFYYNLITQRCEKCN

SEQ ID NO: 2796953 - protein, 18 aa, Entamoeba invadens
KVACMKPTCPNGDKGTCS

SEQ ID NO: 2796954 - protein, 24 aa, Entamoeba invadens
KVADFGESVFREVQSLKQVDLTQN

SEQ ID NO: 2796955 - protein, 23 aa, Entamoeba invadens
KVAETPMSFNFLLTKIDGEINDT

SEQ ID NO: 2796956 - protein, 22 aa, Entamoeba invadens
KVAKGPLKWISLGIFIIGIIMG

SEQ ID NO: 2796957 - protein, 17 aa, Entamoeba invadens
KVAPDCTLNINAHTQIV

SEQ ID NO: 2796958 - protein, 21 aa, Entamoeba invadens
KVAQGVLVRFKVVGMNLHHNP

SEQ ID NO: 2796959 - protein, 19 aa, Entamoeba invadens
KVCLECEKGYYLNEGNVKC

SEQ ID NO: 2796960 - protein, 25 aa, Entamoeba invadens
KVCTLCKEPFYKNCTDFTCVTSCTA

SEQ ID NO: 2796961 - protein, 18 aa, Entamoeba invadens
KVCTVCPDNCKTCTEETK

SEQ ID NO: 2796962 - protein, 20 aa, Entamoeba invadens
KVDCTCMERAGYSIGYNHTC

SEQ ID NO: 2796963 - protein, 23 aa, Entamoeba invadens
KVDEYLGAYAFRDIAKNPPQPSG

SEQ ID NO: 2796964 - protein, 18 aa, Entamoeba invadens
KVDHCISIPNGFCHICEG

SEQ ID NO: 2796965 - protein, 22 aa, Entamoeba invadens
KVDYLDGFNLVWCYAAACSNEF

SEQ ID NO: 2796966 - protein, 21 aa, Entamoeba invadens
KVECNKCTSDVYTACYESLTP

SEQ ID NO: 2796967 - protein, 24 aa, Entamoeba invadens
KVECTEPYPMLWYKMKGDGKYYVA

SEQ ID NO: 2796968 - protein, 22 aa, Entamoeba invadens
KVECVQSWTGWKHGIFADDMQT

SEQ ID NO: 2796969 - protein, 23 aa, Entamoeba invadens
KVELSKCTKCTFWHLPNTSKTLC

SEQ ID NO: 2796970 - protein, 26 aa, Entamoeba invadens
KVFDEYLPAFGFIECELFRMYFDLNT

SEQ ID NO: 2796971 - protein, 31 aa, Entamoeba invadens
KVFENLVCFKDIMKDFNYRGQIEKFLLTAVQ

SEQ ID NO: 2796972 - protein, 23 aa, Entamoeba invadens
KVFFYFRLLLLVTAKKIFIYNFR

SEQ ID NO: 2796973 - protein, 17 aa, Entamoeba invadens
KVFKTPILRNFIPKPST

SEQ ID NO: 2796974 - protein, 17 aa, Entamoeba invadens
KVFLSCLPPQPEAWGLI

SEQ ID NO: 2796975 - protein, 17 aa, Entamoeba invadens
KVFPRMHTKSEFYGVSL

SEQ ID NO: 2796976 - protein, 25 aa, Entamoeba invadens
KVFSFWSYLKWFLLGIFQALVFFIV

SEQ ID NO: 2796977 - protein, 20 aa, Entamoeba invadens
KVFTVLRVLTPINIANFEFT

SEQ ID NO: 2796978 - protein, 27 aa, Entamoeba invadens
KVGEFFSYTGMCITGYVIGFVKEYKLC

SEQ ID NO: 2796979 - protein, 26 aa, Entamoeba invadens
KVGGCKATYGTGCFVVKNAGKKLGEI

SEQ ID NO: 2796980 - protein, 27 aa, Entamoeba invadens
KVGSILRRPLPVFLFALIIPLPQNNIS

SEQ ID NO: 2796981 - protein, 18 aa, Entamoeba invadens
KVGWICLIFAVPTGFISG

SEQ ID NO: 2796982 - protein, 17 aa, Entamoeba invadens
KVHKIELRVRFLIDAGR

SEQ ID NO: 2796983 - protein, 20 aa, Entamoeba invadens
KVICLGCSNNTYLVASENRC

SEQ ID NO: 2796984 - protein, 24 aa, Entamoeba invadens
KVICVRHFITLLFECHKEKKMQKF

SEQ ID NO: 2796985 - protein, 22 aa, Entamoeba invadens
KVIDLGSACFQNYTLYSYIQSR

SEQ ID NO: 2796986 - protein, 23 aa, Entamoeba invadens
KVIKEIPFLVAGFQIKMSSPNNI

SEQ ID NO: 2796987 - protein, 18 aa, Entamoeba invadens
KVIKYKWNQFQLKNKTYI

SEQ ID NO: 2796988 - protein, 23 aa, Entamoeba invadens
KVILCKMPAPREMLMVEENGVVV

SEQ ID NO: 2796989 - protein, 32 aa, Entamoeba invadens
KVIPLVVVCAFVFSLLFIYLIKVMTRLFIILF

SEQ ID NO: 2796990 - protein, 17 aa, Entamoeba invadens
KVIPSFITNFITFVILY

SEQ ID NO: 2796991 - protein, 18 aa, Entamoeba invadens
KVISEIIFDITTLTTNFT

SEQ ID NO: 2796992 - protein, 27 aa, Entamoeba invadens
KVKDSKCTKCAFWFIPSPSGTSCQSKA

SEQ ID NO: 2796993 - protein, 22 aa, Entamoeba invadens
KVKHVFKTRLCIFKDAVRSFNL

SEQ ID NO: 2796994 - protein, 32 aa, Entamoeba invadens
KVKIAECLEEWCGLNTKKEVCVVLGSGGHTSE

SEQ ID NO: 2796995 - protein, 21 aa, Entamoeba invadens
KVKKSFCGDAQYFQSDLNTID

SEQ ID NO: 2796996 - protein, 21 aa, Entamoeba invadens
KVKLGRKAFFDATALESVTST

SEQ ID NO: 2796997 - protein, 24 aa, Entamoeba invadens
KVLCLSCSALSHYIVDGSCEIKPS

SEQ ID NO: 2796998 - protein, 35 aa, Entamoeba invadens
KVLDEVQRQFGLLLDLCYYGPYGIPIWTPIISPVV

SEQ ID NO: 2796999 - protein, 19 aa, Entamoeba invadens
KVLEGKICLLEKENENLKT

SEQ ID NO: 2797000 - protein, 18 aa, Entamoeba invadens
KVLFAVLVSSLFSQVERE

SEQ ID NO: 2797001 - protein, 17 aa, Entamoeba invadens
KVLFKKYIGRPFQKVYF

SEQ ID NO: 2797002 - protein, 23 aa, Entamoeba invadens
KVLKIFCSMLVRYLVPENRNLIS

SEQ ID NO: 2797003 - protein, 22 aa, Entamoeba invadens
KVLLDSHLLRYGDSDKIYCHVN

SEQ ID NO: 2797004 - protein, 18 aa, Entamoeba invadens
KVLSRLDAMIDDITSIED

SEQ ID NO: 2797005 - protein, 19 aa, Entamoeba invadens
KVMMRNTIVKREMIQKQSA

SEQ ID NO: 2797006 - protein, 19 aa, Entamoeba invadens
KVMSCAMFDFVIIATQSEV

SEQ ID NO: 2797007 - protein, 23 aa, Entamoeba invadens
KVNFCFLHNRFEFIHQSDQIISR

SEQ ID NO: 2797008 - protein, 23 aa, Entamoeba invadens
KVNRFGLGCNVEIQLQDKSIWRR

SEQ ID NO: 2797009 - protein, 26 aa, Entamoeba invadens
KVPELQWWATLLIKFAVTSVATFLNI

SEQ ID NO: 2797010 - protein, 17 aa, Entamoeba invadens
KVPKLLIFITGRGPLKE

SEQ ID NO: 2797011 - protein, 26 aa, Entamoeba invadens
KVPNGNGCLVCKVGYYKKGADCAQCD

SEQ ID NO: 2797012 - protein, 27 aa, Entamoeba invadens
KVPSGFGRLTNEYSLFITVKLRELSDG

SEQ ID NO: 2797013 - protein, 24 aa, Entamoeba invadens
KVPSICRKLLSLKVAGVFPAISIL

SEQ ID NO: 2797014 - protein, 25 aa, Entamoeba invadens
KVPYPLPVIIGIDWGYDNIVVSTKT

SEQ ID NO: 2797015 - protein, 18 aa, Entamoeba invadens
KVQFSVIEGCDYYEIRSV

SEQ ID NO: 2797016 - protein, 18 aa, Entamoeba invadens
KVQKEIYNDIKIEGNTAL

SEQ ID NO: 2797017 - protein, 18 aa, Entamoeba invadens
KVQPWYVTLLRRFIRAEV

SEQ ID NO: 2797018 - protein, 33 aa, Entamoeba invadens
KVQQICCFGIPRKVRGFVWYALLLKPEDANDIR

SEQ ID NO: 2797019 - protein, 26 aa, Entamoeba invadens
KVRAYKWIITTLFPSFFWVLEDNIHE

SEQ ID NO: 2797020 - protein, 24 aa, Entamoeba invadens
KVRNMKIPFTMWQSTNKKVLNDIA

SEQ ID NO: 2797021 - protein, 22 aa, Entamoeba invadens
KVRRPTYVVDFFLLFLTCILAV

SEQ ID NO: 2797022 - protein, 17 aa, Entamoeba invadens
KVSCTFQIVGWVVSLCI

SEQ ID NO: 2797023 - protein, 26 aa, Entamoeba invadens
KVSDSKCSKCTFWHSPSIDGSSCVTK

SEQ ID NO: 2797024 - protein, 24 aa, Entamoeba invadens
KVSDSKCTKCTFWHVPDNTKTKCI

SEQ ID NO: 2797025 - protein, 18 aa, Entamoeba invadens
KVSESFRSTAHRYLNIVC

SEQ ID NO: 2797026 - protein, 25 aa, Entamoeba invadens
KVSFSAKCLAAFPPLVLACIKADLS

SEQ ID NO: 2797027 - protein, 29 aa, Entamoeba invadens
KVSLEIGFQYKVCCNVKLDANSNKFFAFA

SEQ ID NO: 2797028 - protein, 17 aa, Entamoeba invadens
KVSNLIMKKRHIKELKK

SEQ ID NO: 2797029 - protein, 18 aa, Entamoeba invadens
KVSWNCFSPSITTEPDLP

SEQ ID NO: 2797030 - protein, 17 aa, Entamoeba invadens
KVTALSFFTHFFAVNAP

SEQ ID NO: 2797031 - protein, 17 aa, Entamoeba invadens
KVTEILNSLLVVSDVIL

SEQ ID NO: 2797032 - protein, 19 aa, Entamoeba invadens
KVTGYLGFVSRIEKKIPPR

SEQ ID NO: 2797033 - protein, 25 aa, Entamoeba invadens
KVTIPSGSSGKVFTVLRVLTPINIA

SEQ ID NO: 2797034 - protein, 20 aa, Entamoeba invadens
KVTLFKSYRKIDGVQFDMDL

SEQ ID NO: 2797035 - protein, 23 aa, Entamoeba invadens
KVTSFLKMRLFRLHPTAVCGGVL

SEQ ID NO: 2797036 - protein, 28 aa, Entamoeba invadens
KVTTTDPVFKRKGADLYTSIEFDSKFKD

SEQ ID NO: 2797037 - protein, 25 aa, Entamoeba invadens
KVVCTECLPGYVLFDDKSCKNITEV

SEQ ID NO: 2797038 - protein, 24 aa, Entamoeba invadens
KVVERYELHKPLTLNNNFTLTIPL

SEQ ID NO: 2797039 - protein, 20 aa, Entamoeba invadens
KVVKARCLLYSTLMEKEGVK

SEQ ID NO: 2797040 - protein, 20 aa, Entamoeba invadens
KVYCTLCADGSVPIDGVCTK

SEQ ID NO: 2797041 - protein, 21 aa, Entamoeba invadens
KVYIFGGAKLNFSEATVKLEK

SEQ ID NO: 2797042 - protein, 23 aa, Entamoeba invadens
KVYLPALNIITAFDLTMPPEVVE

SEQ ID NO: 2797043 - protein, 21 aa, Entamoeba invadens
KVYNFNSVIYKARINKKTDYV

SEQ ID NO: 2797044 - protein, 18 aa, Entamoeba invadens
KVYPRLIMADGMGNLVTG

SEQ ID NO: 2797045 - protein, 20 aa, Entamoeba invadens
KWELTFGLKGTKAIVNKEYT

SEQ ID NO: 2797046 - protein, 17 aa, Entamoeba invadens
KWFNFACMVLYIYGGLW

SEQ ID NO: 2797047 - protein, 25 aa, Entamoeba invadens
KWGKRRPFMLAGNFIVFLGIILQTV

SEQ ID NO: 2797048 - protein, 20 aa, Entamoeba invadens
KWHEAECQYAKNVLRAEEFV

SEQ ID NO: 2797049 - protein, 20 aa, Entamoeba invadens
KWIAPNIISIFGLVFCVLTL

SEQ ID NO: 2797050 - protein, 23 aa, Entamoeba invadens
KWIDKLKWLILIFWLVTTLGLAY

SEQ ID NO: 2797051 - protein, 20 aa, Entamoeba invadens
KWIFVLSLRLRNSIISMIYY

SEQ ID NO: 2797052 - protein, 18 aa, Entamoeba invadens
KWISATFLNYRKEKERNY

SEQ ID NO: 2797053 - protein, 21 aa, Entamoeba invadens
KWIVRFHPDLVFSLSNPDIEN

SEQ ID NO: 2797054 - protein, 27 aa, Entamoeba invadens
KWLLGLYDARWFKILIWMLFTMIGSTL

SEQ ID NO: 2797055 - protein, 27 aa, Entamoeba invadens
KWMIKSFDLKTAIDFSKNGSIVSNVGA

SEQ ID NO: 2797056 - protein, 17 aa, Entamoeba invadens
KWYFAPRKVSNTFYSDD

SEQ ID NO: 2797057 - protein, 19 aa, Entamoeba invadens
KYAARPPLQNVYLLEKVYN

SEQ ID NO: 2797058 - protein, 21 aa, Entamoeba invadens
KYAESYFTSFTEFVTRSPTKV

SEQ ID NO: 2797059 - protein, 18 aa, Entamoeba invadens
KYAYPLFVSTSSFNGLNS

SEQ ID NO: 2797060 - protein, 17 aa, Entamoeba invadens
KYCQLIFIIDGRRDRNM

SEQ ID NO: 2797061 - protein, 19 aa, Entamoeba invadens
KYDCLKCDLTTNMVRGPLG

SEQ ID NO: 2797062 - protein, 19 aa, Entamoeba invadens
KYDLFKACEYDEKARYVAR

SEQ ID NO: 2797063 - protein, 26 aa, Entamoeba invadens
KYDVLYYLAMQPWRHIIWTSFENGVF

SEQ ID NO: 2797064 - protein, 18 aa, Entamoeba invadens
KYEFRVTPEISMLKNGEA

SEQ ID NO: 2797065 - protein, 18 aa, Entamoeba invadens
KYEGMPHVIALCRAVMSN

SEQ ID NO: 2797066 - protein, 19 aa, Entamoeba invadens
KYESCVICNNGFYQVSDSK

SEQ ID NO: 2797067 - protein, 26 aa, Entamoeba invadens
KYEVFYYLTMQPWRHMEWTTIDKNMP

SEQ ID NO: 2797068 - protein, 18 aa, Entamoeba invadens
KYFFRIGAALIYLVISAA

SEQ ID NO: 2797069 - protein, 18 aa, Entamoeba invadens
KYFIGKIFLVMSIYITNR

SEQ ID NO: 2797070 - protein, 21 aa, Entamoeba invadens
KYFPSTIRKNAFRNSGLQSIG

SEQ ID NO: 2797071 - protein, 24 aa, Entamoeba invadens
KYFRKPLFFNFLMFFAMALCTFPY

SEQ ID NO: 2797072 - protein, 20 aa, Entamoeba invadens
KYFVRSSIEMQRLEGITRSP

SEQ ID NO: 2797073 - protein, 19 aa, Entamoeba invadens
KYGEFYMFVTGLLISIGAL

SEQ ID NO: 2797074 - protein, 33 aa, Entamoeba invadens
KYGNCELCTLFSCTLCKIGSVLNNGVCIQSIGC

SEQ ID NO: 2797075 - protein, 18 aa, Entamoeba invadens
KYHGCAICEDRYYWQGRN

SEQ ID NO: 2797076 - protein, 26 aa, Entamoeba invadens
KYHTHCFNCKKCGKRLEEKSFVTIDM

SEQ ID NO: 2797077 - protein, 24 aa, Entamoeba invadens
KYIGLLCGIIVVFLSITRKDIFSY

SEQ ID NO: 2797078 - protein, 19 aa, Entamoeba invadens
KYIGRPFQKVYFWDDNGCV

SEQ ID NO: 2797079 - protein, 17 aa, Entamoeba invadens
KYINIWFHWIPEMIFMI

SEQ ID NO: 2797080 - protein, 20 aa, Entamoeba invadens
KYIQMTSLHIVCYHFEMTPL

SEQ ID NO: 2797081 - protein, 22 aa, Entamoeba invadens
KYIRDVMGKFELIELLQQVVKG

SEQ ID NO: 2797082 - protein, 23 aa, Entamoeba invadens
KYIVNYIRIDVVLPTVMISDVDR

SEQ ID NO: 2797083 - protein, 26 aa, Entamoeba invadens
KYKCVKCLRGCLRCVGNDCLLCDAGY

SEQ ID NO: 2797084 - protein, 22 aa, Entamoeba invadens
KYKFGRPPYFYLLLVALLTATV

SEQ ID NO: 2797085 - protein, 17 aa, Entamoeba invadens
KYKKPSDIFSFSITMYE

SEQ ID NO: 2797086 - protein, 20 aa, Entamoeba invadens
KYKMPCDIFSLGTSMYEVFS

SEQ ID NO: 2797087 - protein, 19 aa, Entamoeba invadens
KYKMPSDIFSFAISMYECF

SEQ ID NO: 2797088 - protein, 19 aa, Entamoeba invadens
KYLKRSPVFVEHITYMWYI

SEQ ID NO: 2797089 - protein, 18 aa, Entamoeba invadens
KYLMIIFHAPLSPKYIFH

SEQ ID NO: 2797090 - protein, 36 aa, Entamoeba invadens
KYLPLGVFQCEKFKLSHYVMWFFVFSYFFIAIILST

SEQ ID NO: 2797091 - protein, 23 aa, Entamoeba invadens
KYMLDCSKGMTMMHTFNTIHRDL

SEQ ID NO: 2797092 - protein, 21 aa, Entamoeba invadens
KYNEFDCNLYAKNRQNKLKLV

SEQ ID NO: 2797093 - protein, 23 aa, Entamoeba invadens
KYNEIDSRFQLVVDLNKFQNFSE

SEQ ID NO: 2797094 - protein, 25 aa, Entamoeba invadens
KYNEIVNMIFEWVVAKLKIRNLFAD

SEQ ID NO: 2797095 - protein, 18 aa, Entamoeba invadens
KYNKCILLGDSPDCTTTN

SEQ ID NO: 2797096 - protein, 20 aa, Entamoeba invadens
KYNYTYRFAQIPVFVLLVLA

SEQ ID NO: 2797097 - protein, 32 aa, Entamoeba invadens
KYPDNCKYCNAIKCLECEKEFHLSPGGICQNV

SEQ ID NO: 2797098 - protein, 22 aa, Entamoeba invadens
KYPSNKCNLTFGAKNKTLKIDE

SEQ ID NO: 2797099 - protein, 19 aa, Entamoeba invadens
KYPVYGLLLANLVVPYYVS

SEQ ID NO: 2797100 - protein, 20 aa, Entamoeba invadens
KYPWNIADLISSGKRLAKPD

SEQ ID NO: 2797101 - protein, 19 aa, Entamoeba invadens
KYQLDRCSQRFCFREKNTC

SEQ ID NO: 2797102 - protein, 17 aa, Entamoeba invadens
KYQSITMRISFPEKIRC

SEQ ID NO: 2797103 - protein, 21 aa, Entamoeba invadens
KYQYNRFSSFIIEYLVAISIC

SEQ ID NO: 2797104 - protein, 35 aa, Entamoeba invadens
KYRNDGCGKGSLLPRMVVTLKKEYMYMLFVSLNEE

SEQ ID NO: 2797105 - protein, 28 aa, Entamoeba invadens
KYRNVVEVMYRFIACGIEMTKTKLNESA

SEQ ID NO: 2797106 - protein, 18 aa, Entamoeba invadens
KYRTWQWVGSADCKKTVD

SEQ ID NO: 2797107 - protein, 17 aa, Entamoeba invadens
KYSAKMCITCTQNYLLS

SEQ ID NO: 2797108 - protein, 23 aa, Entamoeba invadens
KYSELKKAGDVTCFEDVLRNIFE

SEQ ID NO: 2797109 - protein, 20 aa, Entamoeba invadens
KYSIFSFIFVFLYNQFKHVT

SEQ ID NO: 2797110 - protein, 19 aa, Entamoeba invadens
KYSIGPCSFPIRKQVQYRP

SEQ ID NO: 2797111 - protein, 21 aa, Entamoeba invadens
KYSLGPFWYTFGLAVMCGVLS

SEQ ID NO: 2797112 - protein, 18 aa, Entamoeba invadens
KYSLISQSKCVECFDSFK

SEQ ID NO: 2797113 - protein, 18 aa, Entamoeba invadens
KYSNWVDYILLFVGIFGG

SEQ ID NO: 2797114 - protein, 18 aa, Entamoeba invadens
KYSQKTCDQCESNVISSN

SEQ ID NO: 2797115 - protein, 21 aa, Entamoeba invadens
KYSTWEFLERIFVPNNLSQYL

SEQ ID NO: 2797116 - protein, 20 aa, Entamoeba invadens
KYSYIFKSKCVECLDSFKLK

SEQ ID NO: 2797117 - protein, 19 aa, Entamoeba invadens
KYSYKLKGDMFLVEVVGSY

SEQ ID NO: 2797118 - protein, 19 aa, Entamoeba invadens
KYSYNFTDGKGYLISNKKL

SEQ ID NO: 2797119 - protein, 19 aa, Entamoeba invadens
KYTASSMAQWIMKKYSFLP

SEQ ID NO: 2797120 - protein, 20 aa, Entamoeba invadens
KYTKEFFCVANSLKTKCFDK

SEQ ID NO: 2797121 - protein, 18 aa, Entamoeba invadens
KYTKIKERCDSLVIPLHF

SEQ ID NO: 2797122 - protein, 23 aa, Entamoeba invadens
KYTKLDVILLFLIVLFSSLFAFN

SEQ ID NO: 2797123 - protein, 18 aa, Entamoeba invadens
KYTLFWKNSSVLGYDIQT

SEQ ID NO: 2797124 - protein, 18 aa, Entamoeba invadens
KYTLVVVYIFNLGILLTR

SEQ ID NO: 2797125 - protein, 24 aa, Entamoeba invadens
KYVHLYVKFFIRITQLMETMENKK

SEQ ID NO: 2797126 - protein, 19 aa, Entamoeba invadens
KYVNVMCVECSFEYSYDGN

SEQ ID NO: 2797127 - protein, 24 aa, Entamoeba invadens
KYVSSDCKEWIPSTASLLSSYGVP

SEQ ID NO: 2797128 - protein, 19 aa, Entamoeba invadens
KYYNLNGGLCISRDILNMN

SEQ ID NO: 2797129 - protein, 22 aa, Entamoeba invadens
KYYTPKIVRKWNQIVVFSDHFC

SEQ ID NO: 2797130 - protein, 18 aa, Entamoeba invadens
KYYVELYKNVPKCLFDGL

SEQ ID NO: 2797131 - protein, 20 aa, Entamoeba invadens
KYYYTAHGYFYIDADNKVIY

SEQ ID NO: 2797132 - protein, 25 aa, Entamoeba invadens
LAADNCLTCAFGYYYDDTTSDCLYV

SEQ ID NO: 2797133 - protein, 25 aa, Entamoeba invadens
LAAGKCAICPKGTYYMSSVCQSCGD

SEQ ID NO: 2797134 - protein, 24 aa, Entamoeba invadens
LAAGKCTICPKGTYYLSSACQSCG

SEQ ID NO: 2797135 - protein, 19 aa, Entamoeba invadens
LAATLRTWDTIRVQRSSPM

SEQ ID NO: 2797136 - protein, 22 aa, Entamoeba invadens
LAAYPVDLQYPVAFWHVYVGID

SEQ ID NO: 2797137 - protein, 19 aa, Entamoeba invadens
LACEFEVYLTPNFTSKIED

SEQ ID NO: 2797138 - protein, 23 aa, Entamoeba invadens
LACLACGFREVVFIATTTEVLVV

SEQ ID NO: 2797139 - protein, 19 aa, Entamoeba invadens
LACVFKAVTYVGFRFALGI

SEQ ID NO: 2797140 - protein, 19 aa, Entamoeba invadens
LACVVAFLVFIGILIVIGM

SEQ ID NO: 2797141 - protein, 20 aa, Entamoeba invadens
LADEFQCAFFETSAKNNTNL

SEQ ID NO: 2797142 - protein, 17 aa, Entamoeba invadens
LADGNCGVCVKYSEETK

SEQ ID NO: 2797143 - protein, 26 aa, Entamoeba invadens
LAELRKLRVVHHLALQFSQFSQQVSQ

SEQ ID NO: 2797144 - protein, 18 aa, Entamoeba invadens
LAFFPILTLCPKKVLPPP

SEQ ID NO: 2797145 - protein, 21 aa, Entamoeba invadens
LAFILLCLRIFSGLFSRKFVV

SEQ ID NO: 2797146 - protein, 29 aa, Entamoeba invadens
LAFLFCLSMSSQPYVNWVLAFFGGLAGGF

SEQ ID NO: 2797147 - protein, 22 aa, Entamoeba invadens
LAFRALYRAVFYEKIFTKSILI

SEQ ID NO: 2797148 - protein, 18 aa, Entamoeba invadens
LAGFLIEKFHMILNRISE

SEQ ID NO: 2797149 - protein, 31 aa, Entamoeba invadens
LAGIFMFSIAFEWKMIWVMLTWLCIYNTIES

SEQ ID NO: 2797150 - protein, 25 aa, Entamoeba invadens
LAGKKAKFIIIYAVLGIALVGILVG

SEQ ID NO: 2797151 - protein, 18 aa, Entamoeba invadens
LAGLLAPVMGILTDKWRG

SEQ ID NO: 2797152 - protein, 24 aa, Entamoeba invadens
LAGNCVLCADGYFVYNSSCSECND

SEQ ID NO: 2797153 - protein, 26 aa, Entamoeba invadens
LAGYSKCIQCFSISCGVCSKTTGECT

SEQ ID NO: 2797154 - protein, 25 aa, Entamoeba invadens
LAHAPMPFIIGCTSSTFLQLAEEVD

SEQ ID NO: 2797155 - protein, 18 aa, Entamoeba invadens
LAHIFELTIEFCVLVNGG

SEQ ID NO: 2797156 - protein, 23 aa, Entamoeba invadens
LAHTCSFCVFYLILTLQKCPQDL

SEQ ID NO: 2797157 - protein, 41 aa, Entamoeba invadens
LAIAYPMLNLRPGFVNWLCMWGCLVLATLIAQGMFYSISTI

SEQ ID NO: 2797158 - protein, 25 aa, Entamoeba invadens
LAICISVFMLFRFINPIQKLRKEWY

SEQ ID NO: 2797159 - protein, 19 aa, Entamoeba invadens
LAIGLPVMFMLLIIITISV

SEQ ID NO: 2797160 - protein, 21 aa, Entamoeba invadens
LAIILPIIFGILIVVIIIITI

SEQ ID NO: 2797161 - protein, 20 aa, Entamoeba invadens
LAILAPVIICMKDFMWTLAS

SEQ ID NO: 2797162 - protein, 25 aa, Entamoeba invadens
LAISEFIGSTLLGFVLMIATHRKKH

SEQ ID NO: 2797163 - protein, 20 aa, Entamoeba invadens
LAITCSLTLPNGAGCAICND

SEQ ID NO: 2797164 - protein, 40 aa, Entamoeba invadens
LAITIYEVFGWSNAYPIETFKFPWKIAEFVMSGKRLQRKE

SEQ ID NO: 2797165 - protein, 21 aa, Entamoeba invadens
LAIVLPIIFAIILIVVIIIAI

SEQ ID NO: 2797166 - protein, 23 aa, Entamoeba invadens
LAIVLPIVFGFLIIILLIIVIAL

SEQ ID NO: 2797167 - protein, 18 aa, Entamoeba invadens
LAKERLYIPLGVNNTTEN

SEQ ID NO: 2797168 - protein, 18 aa, Entamoeba invadens
LAKFFKFVQNKGNTQQLY

SEQ ID NO: 2797169 - protein, 21 aa, Entamoeba invadens
LAKHGCLCPKDEKSYGTKQWC

SEQ ID NO: 2797170 - protein, 27 aa, Entamoeba invadens
LAKNNRCFKCALGYTLNKRTCEKITNC

SEQ ID NO: 2797171 - protein, 18 aa, Entamoeba invadens
LAKRVLEIIFLFFVGFSR

SEQ ID NO: 2797172 - protein, 25 aa, Entamoeba invadens
LAKVYFKTVFIIKCSDTNLFYEVSL

SEQ ID NO: 2797173 - protein, 21 aa, Entamoeba invadens
LALALSAKILIIFEKHDEDAK

SEQ ID NO: 2797174 - protein, 26 aa, Entamoeba invadens
LALEMSYCFLALYPLSVFHYINTTLL

SEQ ID NO: 2797175 - protein, 18 aa, Entamoeba invadens
LALGSWYGSLVIQGKGGS

SEQ ID NO: 2797176 - protein, 25 aa, Entamoeba invadens
LALKWCKEADKIFCRDEWEKCSIIM

SEQ ID NO: 2797177 - protein, 19 aa, Entamoeba invadens
LALRVDAIWCEYKQGVISY

SEQ ID NO: 2797178 - protein, 26 aa, Entamoeba invadens
LALTCYKMGIVGFFLWNIATIVYFLI

SEQ ID NO: 2797179 - protein, 17 aa, Entamoeba invadens
LALTLTRLFSPFGKLGV

SEQ ID NO: 2797180 - protein, 18 aa, Entamoeba invadens
LALVCALCVFFLIWYAFL

SEQ ID NO: 2797181 - protein, 28 aa, Entamoeba invadens
LALYIVACFAVSLIGGFIPFLIKLVKHQ

SEQ ID NO: 2797182 - protein, 19 aa, Entamoeba invadens
LAMPPLMMVTRCSKDDSAI

SEQ ID NO: 2797183 - protein, 23 aa, Entamoeba invadens
LAMSVCAVVFYFFQKKRFFYPGV

SEQ ID NO: 2797184 - protein, 24 aa, Entamoeba invadens
LAMVLCPAVTLPITSDFFVMNFKE

SEQ ID NO: 2797185 - protein, 20 aa, Entamoeba invadens
LAPFFACLFSSLTPLGVKEF

SEQ ID NO: 2797186 - protein, 25 aa, Entamoeba invadens
LAPTLKRLISAFFELYSYTKKEVNS

SEQ ID NO: 2797187 - protein, 17 aa, Entamoeba invadens
LAQEALCGIGGNDNEDI

SEQ ID NO: 2797188 - protein, 18 aa, Entamoeba invadens
LARPCIQYPKVFGGITFF

SEQ ID NO: 2797189 - protein, 30 aa, Entamoeba invadens
LASDIFRMLFEVFLCLTIRTVSIFGNNYLY

SEQ ID NO: 2797190 - protein, 21 aa, Entamoeba invadens
LASDLKNGVLVKISSSPHIRY

SEQ ID NO: 2797191 - protein, 25 aa, Entamoeba invadens
LASGKCAICPKGTYYMSSVCQSCGE

SEQ ID NO: 2797192 - protein, 19 aa, Entamoeba invadens
LASNCLSCGSGRYLQNGQC

SEQ ID NO: 2797193 - protein, 17 aa, Entamoeba invadens
LASPWRQCILICRPVRF

SEQ ID NO: 2797194 - protein, 21 aa, Entamoeba invadens
LATCLKFSYDSLKCLQCDDGF

SEQ ID NO: 2797195 - protein, 17 aa, Entamoeba invadens
LATVTGFDAVTSFGDSS

SEQ ID NO: 2797196 - protein, 17 aa, Entamoeba invadens
LATVTGFEAVTSFGESS

SEQ ID NO: 2797197 - protein, 24 aa, Entamoeba invadens
LAVFTARLWIHRIGYYQTIQGKDD

SEQ ID NO: 2797198 - protein, 25 aa, Entamoeba invadens
LAVGKCAICPKGTYYMSSVCQSCGE

SEQ ID NO: 2797199 - protein, 17 aa, Entamoeba invadens
LAVNVVEMFGGVEKQLA

SEQ ID NO: 2797200 - protein, 20 aa, Entamoeba invadens
LAVPFAMLYSGWGGGLLLMS

SEQ ID NO: 2797201 - protein, 19 aa, Entamoeba invadens
LAYREAGLILSLGLLLVFY

SEQ ID NO: 2797202 - protein, 19 aa, Entamoeba invadens
LAYYLAFIFILLARLLYFV

SEQ ID NO: 2797203 - protein, 25 aa, Entamoeba invadens
LAYYTLQMAISWYSQRLDWLGIFVS

SEQ ID NO: 2797204 - protein, 17 aa, Entamoeba invadens
LCADTYFYYKKDSDLCI

SEQ ID NO: 2797205 - protein, 17 aa, Entamoeba invadens
LCADTYFYYKRDSDLCI

SEQ ID NO: 2797206 - protein, 23 aa, Entamoeba invadens
LCAFCSYSALALHDFFRYQIRPY

SEQ ID NO: 2797207 - protein, 19 aa, Entamoeba invadens
LCAIASLIFFAFEKENLYV

SEQ ID NO: 2797208 - protein, 20 aa, Entamoeba invadens
LCALIGFVGGFFFGDYLLYP

SEQ ID NO: 2797209 - protein, 23 aa, Entamoeba invadens
LCASKLFGSSAFRTDLFNKGKFI

SEQ ID NO: 2797210 - protein, 25 aa, Entamoeba invadens
LCDELRTVKISSFLRTPYNIVSLEK

SEQ ID NO: 2797211 - protein, 25 aa, Entamoeba invadens
LCDFDKCLKCSQIGVMNRVTGQCEV

SEQ ID NO: 2797212 - protein, 26 aa, Entamoeba invadens
LCDFDKCLKCSQNGIINRVTGQCEVL

SEQ ID NO: 2797213 - protein, 25 aa, Entamoeba invadens
LCDHALECGVVFFKRTQTTMTVSLF

SEQ ID NO: 2797214 - protein, 17 aa, Entamoeba invadens
LCDIGGCEQCSNTTYAC

SEQ ID NO: 2797215 - protein, 25 aa, Entamoeba invadens
LCDINTNCLVSWKNEKCLVCDEGYF

SEQ ID NO: 2797216 - protein, 21 aa, Entamoeba invadens
LCDIPNCFKCSSSSYECLECG

SEQ ID NO: 2797217 - protein, 19 aa, Entamoeba invadens
LCDLFGKYSLSKCCQCNCL

SEQ ID NO: 2797218 - protein, 26 aa, Entamoeba invadens
LCDSNCCLKCLDGFVRYTDTWCISKS

SEQ ID NO: 2797219 - protein, 23 aa, Entamoeba invadens
LCDSSCLTCSSISTQCLSCPSGT

SEQ ID NO: 2797220 - protein, 25 aa, Entamoeba invadens
LCEESFYLQNGRCFVCENDCLTCRN

SEQ ID NO: 2797221 - protein, 21 aa, Entamoeba invadens
LCELGLRGYLLISIASHVHPA

SEQ ID NO: 2797222 - protein, 25 aa, Entamoeba invadens
LCEPNTNCAISFKNGKCPVCVDGYF

SEQ ID NO: 2797223 - protein, 18 aa, Entamoeba invadens
LCESCFATFVLKNGKCVF

SEQ ID NO: 2797224 - protein, 22 aa, Entamoeba invadens
LCESHVVWWVILLGVIFVIIVL

SEQ ID NO: 2797225 - protein, 25 aa, Entamoeba invadens
LCETTSYLASPFVKYCHLDVSTGFY

SEQ ID NO: 2797226 - protein, 18 aa, Entamoeba invadens
LCEVAIVYYLFKSLYGDN

SEQ ID NO: 2797227 - protein, 25 aa, Entamoeba invadens
LCEVKRGSINRERVSSASIIGLHVA

SEQ ID NO: 2797228 - protein, 19 aa, Entamoeba invadens
LCFDISFVKKCTEIFNSKC

SEQ ID NO: 2797229 - protein, 17 aa, Entamoeba invadens
LCFDISFVSKCLEALNS

SEQ ID NO: 2797230 - protein, 19 aa, Entamoeba invadens
LCFENNEYLCIACTQSQIE

SEQ ID NO: 2797231 - protein, 21 aa, Entamoeba invadens
LCGCGICVYDGLCLPETTGFC

SEQ ID NO: 2797232 - protein, 21 aa, Entamoeba invadens
LCGDAMLFTEYYFGYDCSTNN

SEQ ID NO: 2797233 - protein, 18 aa, Entamoeba invadens
LCGDLTYSEGGIMQCQQC

SEQ ID NO: 2797234 - protein, 17 aa, Entamoeba invadens
LCGDLTYSEGGVMQCQQ

SEQ ID NO: 2797235 - protein, 18 aa, Entamoeba invadens
LCGDLTYSEGGVMQCQQC

SEQ ID NO: 2797236 - protein, 19 aa, Entamoeba invadens
LCHSRRRGIGFYPEKHEDE

SEQ ID NO: 2797237 - protein, 21 aa, Entamoeba invadens
LCIDCYPGTYSEFGQPTLCQP

SEQ ID NO: 2797238 - protein, 17 aa, Entamoeba invadens
LCIEGYMLENGNCVEKP

SEQ ID NO: 2797239 - protein, 20 aa, Entamoeba invadens
LCIIPIVMIFGSFSFFIIFP

SEQ ID NO: 2797240 - protein, 21 aa, Entamoeba invadens
LCIKASSGVCISCVDGYTLQN

SEQ ID NO: 2797241 - protein, 17 aa, Entamoeba invadens
LCIKCYSKYFLNKEYPP

SEQ ID NO: 2797242 - protein, 27 aa, Entamoeba invadens
LCKQNMYLKDGMCFGIYVSCANISSSD

SEQ ID NO: 2797243 - protein, 29 aa, Entamoeba invadens
LCKRCSVKLISYLKCLNLMIDVFVMIMPK

SEQ ID NO: 2797244 - protein, 19 aa, Entamoeba invadens
LCKSKLCGNSRIDDLYDSS

SEQ ID NO: 2797245 - protein, 17 aa, Entamoeba invadens
LCKVIKFYIPNDSEFVA

SEQ ID NO: 2797246 - protein, 25 aa, Entamoeba invadens
LCLCIILSVIGLRWFDEPLRTKLNK

SEQ ID NO: 2797247 - protein, 21 aa, Entamoeba invadens
LCLDGFVSMDGLCERKCERDT

SEQ ID NO: 2797248 - protein, 24 aa, Entamoeba invadens
LCLFKKRNQLFISYLPIDVRNTVT

SEQ ID NO: 2797249 - protein, 21 aa, Entamoeba invadens
LCLFMPELINFVISIPQLFGF

SEQ ID NO: 2797250 - protein, 27 aa, Entamoeba invadens
LCLGKERKRGGCLITVYCRDTDAKFAG

SEQ ID NO: 2797251 - protein, 18 aa, Entamoeba invadens
LCLGRKLEEFRFEGEDSV

SEQ ID NO: 2797252 - protein, 21 aa, Entamoeba invadens
LCLKCSSSYLVDNQCQIFDDK

SEQ ID NO: 2797253 - protein, 17 aa, Entamoeba invadens
LCLLEKLADCVKNEEPV

SEQ ID NO: 2797254 - protein, 18 aa, Entamoeba invadens
LCLLLFCLALTLVFMKKV

SEQ ID NO: 2797255 - protein, 21 aa, Entamoeba invadens
LCLPETTGFCTINRFNTFLPN

SEQ ID NO: 2797256 - protein, 21 aa, Entamoeba invadens
LCLPFDDLTQFCLKKTKSGCA

SEQ ID NO: 2797257 - protein, 21 aa, Entamoeba invadens
LCLSCKIGYYYDKSSSTCHAC

SEQ ID NO: 2797258 - protein, 21 aa, Entamoeba invadens
LCLSPPTGFVFLNKIPYWVFT

SEQ ID NO: 2797259 - protein, 29 aa, Entamoeba invadens
LCNVCPDKCKTCYYDFYLNKALCYSCDID

SEQ ID NO: 2797260 - protein, 29 aa, Entamoeba invadens
LCQFLTPKGCLRCFPTYYIDHNNNTCQSC

SEQ ID NO: 2797261 - protein, 29 aa, Entamoeba invadens
LCQKCTINSCVSCGLTGVVNTDGLCESFG

SEQ ID NO: 2797262 - protein, 23 aa, Entamoeba invadens
LCQNSRGSVDWIIDTTTYEENSY

SEQ ID NO: 2797263 - protein, 28 aa, Entamoeba invadens
LCQRCTKHSCVFCGLTGVVNSEGYCLSL

SEQ ID NO: 2797264 - protein, 21 aa, Entamoeba invadens
LCRCLWPFNLLPNMRLNTTTY

SEQ ID NO: 2797265 - protein, 18 aa, Entamoeba invadens
LCSCEIKEKIVCVGLDIQ

SEQ ID NO: 2797266 - protein, 18 aa, Entamoeba invadens
LCSECKFNYKLKDNGSGC

SEQ ID NO: 2797267 - protein, 20 aa, Entamoeba invadens
LCSEKYPNCMVCDMNNCLVC

SEQ ID NO: 2797268 - protein, 22 aa, Entamoeba invadens
LCSISLSLKCTVDTIGNSTCSC

SEQ ID NO: 2797269 - protein, 18 aa, Entamoeba invadens
LCSKNCLGEKNFAQRMYM

SEQ ID NO: 2797270 - protein, 26 aa, Entamoeba invadens
LCSLCNSSSCLKCKDAVLTMEGTCSS

SEQ ID NO: 2797271 - protein, 18 aa, Entamoeba invadens
LCSSCKSGCVLSENHCYP

SEQ ID NO: 2797272 - protein, 17 aa, Entamoeba invadens
LCSVLLFGISQNFDFFG

SEQ ID NO: 2797273 - protein, 22 aa, Entamoeba invadens
LCTCEISDKIAIISCVLKKGTK

SEQ ID NO: 2797274 - protein, 18 aa, Entamoeba invadens
LCTDCAKGYFASDIGTVR

SEQ ID NO: 2797275 - protein, 17 aa, Entamoeba invadens
LCTFAVESVKIFKRQKE

SEQ ID NO: 2797276 - protein, 19 aa, Entamoeba invadens
LCTPCNWGEAAVVGSYNCV

SEQ ID NO: 2797277 - protein, 17 aa, Entamoeba invadens
LCTPTGQCLACDHNYYF

SEQ ID NO: 2797278 - protein, 20 aa, Entamoeba invadens
LCTSCDLGYMILNTKCEECG

SEQ ID NO: 2797279 - protein, 22 aa, Entamoeba invadens
LCTSCLKGYYLNSLMECQSLGE

SEQ ID NO: 2797280 - protein, 18 aa, Entamoeba invadens
LCTSCPSSYILQDHICLP

SEQ ID NO: 2797281 - protein, 19 aa, Entamoeba invadens
LCTSIPMLITQYGQSALEE

SEQ ID NO: 2797282 - protein, 20 aa, Entamoeba invadens
LCTTCSGLATAIGGIIVAFF

SEQ ID NO: 2797283 - protein, 17 aa, Entamoeba invadens
LCTVAIPSDLTSLVSSE

SEQ ID NO: 2797284 - protein, 19 aa, Entamoeba invadens
LCVDAFMGNAYITSFVYEG

SEQ ID NO: 2797285 - protein, 19 aa, Entamoeba invadens
LCVHVVMLLLLVAVYAGLV

SEQ ID NO: 2797286 - protein, 21 aa, Entamoeba invadens
LCVIRECLRESKIVCLDEATA

SEQ ID NO: 2797287 - protein, 22 aa, Entamoeba invadens
LCVITEFCPLFSLRKYMKTNYM

SEQ ID NO: 2797288 - protein, 17 aa, Entamoeba invadens
LCVKCSSDLMVIKDGVC

SEQ ID NO: 2797289 - protein, 18 aa, Entamoeba invadens
LCVLESKVSGYVEGESLW

SEQ ID NO: 2797290 - protein, 17 aa, Entamoeba invadens
LCVMVCIALGAKFLLLG

SEQ ID NO: 2797291 - protein, 20 aa, Entamoeba invadens
LCVSGWKGWSVHGVQSNASV

SEQ ID NO: 2797292 - protein, 21 aa, Entamoeba invadens
LCVTCECAKGKLGNGDECIRN

SEQ ID NO: 2797293 - protein, 24 aa, Entamoeba invadens
LCVTQQCLSGGPGDLQCYRNSEGC

SEQ ID NO: 2797294 - protein, 19 aa, Entamoeba invadens
LCVVLSLLADEKVIVVSKS

SEQ ID NO: 2797295 - protein, 19 aa, Entamoeba invadens
LCVVMEYFNGGSLFNYIAK

SEQ ID NO: 2797296 - protein, 19 aa, Entamoeba invadens
LCYDISFVSNCVAVSNSKC

SEQ ID NO: 2797297 - protein, 17 aa, Entamoeba invadens
LCYSCLSNYVLESGECV

SEQ ID NO: 2797298 - protein, 19 aa, Entamoeba invadens
LCYTCALTNCAYCTSTKCF

SEQ ID NO: 2797299 - protein, 18 aa, Entamoeba invadens
LDAALYLYDSRTREGGIK

SEQ ID NO: 2797300 - protein, 27 aa, Entamoeba invadens
LDAFFIFVMDCILMYEGVLDLVLNSVP

SEQ ID NO: 2797301 - protein, 23 aa, Entamoeba invadens
LDAGECKMCISTLLNCETCSVGT

SEQ ID NO: 2797302 - protein, 18 aa, Entamoeba invadens
LDAKLSYENHKYCQKYQE

SEQ ID NO: 2797303 - protein, 18 aa, Entamoeba invadens
LDAKLSYENHKYCQKYQQ

SEQ ID NO: 2797304 - protein, 18 aa, Entamoeba invadens
LDALPVKMVDKIIKENPD

SEQ ID NO: 2797305 - protein, 20 aa, Entamoeba invadens
LDCEGDLKVINWDDLQNLER

SEQ ID NO: 2797306 - protein, 18 aa, Entamoeba invadens
LDCIPATCGNRKWDEGEE

SEQ ID NO: 2797307 - protein, 26 aa, Entamoeba invadens
LDCLPCSTKICYDCHPISGKCYSPYL

SEQ ID NO: 2797308 - protein, 28 aa, Entamoeba invadens
LDCYRDVKCLVCKPGYYLSNKRCTECTT

SEQ ID NO: 2797309 - protein, 21 aa, Entamoeba invadens
LDDFSFCYLIFQNIGVCESDL

SEQ ID NO: 2797310 - protein, 25 aa, Entamoeba invadens
LDDHVFKYKICFTYSQIRKIFFFVQ

SEQ ID NO: 2797311 - protein, 19 aa, Entamoeba invadens
LDECEFLKCKEGYVQTEKI

SEQ ID NO: 2797312 - protein, 26 aa, Entamoeba invadens
LDECGINFYVAWKLDTSIGKFYGKLI

SEQ ID NO: 2797313 - protein, 23 aa, Entamoeba invadens
LDECLLCKDNYFLLENGTCGEIS

SEQ ID NO: 2797314 - protein, 30 aa, Entamoeba invadens
LDECLYYVYGHCMYCVTGGIVNGTCQDTSP

SEQ ID NO: 2797315 - protein, 18 aa, Entamoeba invadens
LDEGCKYFPVQKVFNEKG

SEQ ID NO: 2797316 - protein, 22 aa, Entamoeba invadens
LDELKKVFARGVGPVIGNSPDE

SEQ ID NO: 2797317 - protein, 17 aa, Entamoeba invadens
LDFAPTTSLEVKLNSFN

SEQ ID NO: 2797318 - protein, 17 aa, Entamoeba invadens
LDFAPVDGFIVQQPTYG

SEQ ID NO: 2797319 - protein, 17 aa, Entamoeba invadens
LDFCYYTNATLIITVIR

SEQ ID NO: 2797320 - protein, 17 aa, Entamoeba invadens
LDFNSACTIKITDFGTS

SEQ ID NO: 2797321 - protein, 20 aa, Entamoeba invadens
LDFVNGFVFPLIFFSIWQTL

SEQ ID NO: 2797322 - protein, 23 aa, Entamoeba invadens
LDGCVLWNSYCITVIYQSRPKEA

SEQ ID NO: 2797323 - protein, 27 aa, Entamoeba invadens
LDGKPWKVSCDRRMLTLTASMKDSIEK

SEQ ID NO: 2797324 - protein, 17 aa, Entamoeba invadens
LDGLKLKLFQTEPTRFA

SEQ ID NO: 2797325 - protein, 26 aa, Entamoeba invadens
LDGNSCLTCGPLYFMTIVGECLLKSS

SEQ ID NO: 2797326 - protein, 18 aa, Entamoeba invadens
LDGSLLLKNQVTFYRNVI

SEQ ID NO: 2797327 - protein, 28 aa, Entamoeba invadens
LDGVFGHWKYPECLSDIKASPNNKKPVA

SEQ ID NO: 2797328 - protein, 18 aa, Entamoeba invadens
LDHHCPFVGSCIGYGNQK

SEQ ID NO: 2797329 - protein, 28 aa, Entamoeba invadens
LDIDGQLRVSLCLSNMLIVKIKIFEDLN

SEQ ID NO: 2797330 - protein, 19 aa, Entamoeba invadens
LDIDSGVCISGEDGCGEYE

SEQ ID NO: 2797331 - protein, 25 aa, Entamoeba invadens
LDIFQLRFLLESGAFPMSSNQKLYI

SEQ ID NO: 2797332 - protein, 21 aa, Entamoeba invadens
LDIKLPYTALHSFSNSVTRRV

SEQ ID NO: 2797333 - protein, 25 aa, Entamoeba invadens
LDILLKRTERVECISVAPKTTQSIP

SEQ ID NO: 2797334 - protein, 30 aa, Entamoeba invadens
LDILNCWRCSLMTWMCCRSCGTCCYVSPYQ

SEQ ID NO: 2797335 - protein, 18 aa, Entamoeba invadens
LDILREVVRVMPKSDKNA

SEQ ID NO: 2797336 - protein, 17 aa, Entamoeba invadens
LDILRKQICILPQEATL

SEQ ID NO: 2797337 - protein, 21 aa, Entamoeba invadens
LDILVKIALNLTVNGSVVSSN

SEQ ID NO: 2797338 - protein, 23 aa, Entamoeba invadens
LDIPDDCLFKETITKCWMQTPRD

SEQ ID NO: 2797339 - protein, 24 aa, Entamoeba invadens
LDISFVPECIEVLNSKCSKCAFWH

SEQ ID NO: 2797340 - protein, 24 aa, Entamoeba invadens
LDISFVPECIEVLNSKCSKCSFWH

SEQ ID NO: 2797341 - protein, 17 aa, Entamoeba invadens
LDISYVLQCIEISNSKC

SEQ ID NO: 2797342 - protein, 22 aa, Entamoeba invadens
LDKCFPCEIGCDGCNSSDGACI

SEQ ID NO: 2797343 - protein, 18 aa, Entamoeba invadens
LDKFRCDYIIYFYGAVLI

SEQ ID NO: 2797344 - protein, 24 aa, Entamoeba invadens
LDKFRSDYIINFFGAVFIPKKRCM

SEQ ID NO: 2797345 - protein, 22 aa, Entamoeba invadens
LDKFRSEFIVHFYGAVFIPNKI

SEQ ID NO: 2797346 - protein, 22 aa, Entamoeba invadens
LDKFRSEFIVYFYGAVFIPNKI

SEQ ID NO: 2797347 - protein, 19 aa, Entamoeba invadens
LDKFRSEYIVHFYGAVFIP

SEQ ID NO: 2797348 - protein, 19 aa, Entamoeba invadens
LDKFRSEYIVYFYGAVFIP

SEQ ID NO: 2797349 - protein, 25 aa, Entamoeba invadens
LDKISAVIPKAEFIPKHKAHLGMVL

SEQ ID NO: 2797350 - protein, 23 aa, Entamoeba invadens
LDKKDIRGILQFYPEGVDSIYLC

SEQ ID NO: 2797351 - protein, 19 aa, Entamoeba invadens
LDKPAGVPENYWDLTTKCW

SEQ ID NO: 2797352 - protein, 26 aa, Entamoeba invadens
LDKPVVLKLRVKFMLDAAKGILYLHN

SEQ ID NO: 2797353 - protein, 34 aa, Entamoeba invadens
LDKVKYCITQLFSLSALWALFSSFSYEWSMQFIH

SEQ ID NO: 2797354 - protein, 22 aa, Entamoeba invadens
LDKYLKFGLAVVFYIFMSLTTL

SEQ ID NO: 2797355 - protein, 19 aa, Entamoeba invadens
LDLACYVHENMMFLHKASR

SEQ ID NO: 2797356 - protein, 17 aa, Entamoeba invadens
LDLLENVTFIGLIVSIG

SEQ ID NO: 2797357 - protein, 17 aa, Entamoeba invadens
LDLLKTAFLNEIYEEDE

SEQ ID NO: 2797358 - protein, 25 aa, Entamoeba invadens
LDLLTSCFKFNFTGTMVDELNDDLA

SEQ ID NO: 2797359 - protein, 19 aa, Entamoeba invadens
LDLLVKLQLVYRQNNSYDI

SEQ ID NO: 2797360 - protein, 19 aa, Entamoeba invadens
LDLNGSVVFQGLNFPYLVF

SEQ ID NO: 2797361 - protein, 23 aa, Entamoeba invadens
LDLRDILRSFALLVPKTGYCQGM

SEQ ID NO: 2797362 - protein, 17 aa, Entamoeba invadens
LDLRSYLIMPVQRLPRY

SEQ ID NO: 2797363 - protein, 18 aa, Entamoeba invadens
LDMKNLINICGDFLIDKK

SEQ ID NO: 2797364 - protein, 25 aa, Entamoeba invadens
LDMPEEMYRLFPFKNKIVEVNGRVF

SEQ ID NO: 2797365 - protein, 22 aa, Entamoeba invadens
LDMVKKLVCKEGIVDPHATKKA

SEQ ID NO: 2797366 - protein, 18 aa, Entamoeba invadens
LDNCRKCSPEGRCAECNT

SEQ ID NO: 2797367 - protein, 17 aa, Entamoeba invadens
LDNCSALDLILKNPNKY

SEQ ID NO: 2797368 - protein, 17 aa, Entamoeba invadens
LDNCTACSSGLLEDGTT

SEQ ID NO: 2797369 - protein, 20 aa, Entamoeba invadens
LDNCVDCIEGFYLDLNNEPN

SEQ ID NO: 2797370 - protein, 19 aa, Entamoeba invadens
LDNGKCFLCSTQFGALCQN

SEQ ID NO: 2797371 - protein, 17 aa, Entamoeba invadens
LDPGWYVPIGSQVCVNC

SEQ ID NO: 2797372 - protein, 21 aa, Entamoeba invadens
LDPIAQVNCCHSLISIIQFLL

SEQ ID NO: 2797373 - protein, 24 aa, Entamoeba invadens
LDQPNIYGVEGFKASFVDNPIALV

SEQ ID NO: 2797374 - protein, 19 aa, Entamoeba invadens
LDRLKCTKVNLALILPLSI

SEQ ID NO: 2797375 - protein, 31 aa, Entamoeba invadens
LDRMFEMATLIPINLYQPFLEKFLSAVEVRP

SEQ ID NO: 2797376 - protein, 19 aa, Entamoeba invadens
LDSDFLCVIASGKKFEGPS

SEQ ID NO: 2797377 - protein, 26 aa, Entamoeba invadens
LDSFKNGVKYHFADHLEVYKGKVGTH

SEQ ID NO: 2797378 - protein, 20 aa, Entamoeba invadens
LDSFKQRNGVCAEFFEENLI

SEQ ID NO: 2797379 - protein, 18 aa, Entamoeba invadens
LDSPIGSLGCKTCQDQYY

SEQ ID NO: 2797380 - protein, 26 aa, Entamoeba invadens
LDSSKTSLWYKLKGDGYMYVANTCNY

SEQ ID NO: 2797381 - protein, 17 aa, Entamoeba invadens
LDSVLHEITKKVGDQPT

SEQ ID NO: 2797382 - protein, 23 aa, Entamoeba invadens
LDSVRLRVFGTMKGKELNTTTIS

SEQ ID NO: 2797383 - protein, 20 aa, Entamoeba invadens
LDSYKLKNGICAENFEQDDI

SEQ ID NO: 2797384 - protein, 30 aa, Entamoeba invadens
LDTETEMFLWLGNKCSLKIRQKITKYVEGM

SEQ ID NO: 2797385 - protein, 18 aa, Entamoeba invadens
LDTFGYKYDKVLFEFSKE

SEQ ID NO: 2797386 - protein, 22 aa, Entamoeba invadens
LDTFKLKNGICAETFDEDDKLK

SEQ ID NO: 2797387 - protein, 27 aa, Entamoeba invadens
LDTFKTRPELFWSMAEEIHKIDAKPND

SEQ ID NO: 2797388 - protein, 17 aa, Entamoeba invadens
LDTSIGKFYGKLITPFD

SEQ ID NO: 2797389 - protein, 26 aa, Entamoeba invadens
LDTTMCLSCVDGYFLSDHICKSNDAL

SEQ ID NO: 2797390 - protein, 26 aa, Entamoeba invadens
LDTTMCLSCVDGYFLSDHICKSNDEL

SEQ ID NO: 2797391 - protein, 22 aa, Entamoeba invadens
LDVAFWLSCKWVWSLSLYLDSF

SEQ ID NO: 2797392 - protein, 22 aa, Entamoeba invadens
LDVDCVDFSKAKCELSKTEGCP

SEQ ID NO: 2797393 - protein, 22 aa, Entamoeba invadens
LDVSEVFSLICYFNCIRYPFMN

SEQ ID NO: 2797394 - protein, 24 aa, Entamoeba invadens
LDVVFRFMPEITFMTCTFGYLCFL

SEQ ID NO: 2797395 - protein, 19 aa, Entamoeba invadens
LDWKVWKTLVFGSVILAIF

SEQ ID NO: 2797396 - protein, 17 aa, Entamoeba invadens
LDYNSACTLKITDFGTS

SEQ ID NO: 2797397 - protein, 22 aa, Entamoeba invadens
LEAGGKFAVEITRLIIKENMAV

SEQ ID NO: 2797398 - protein, 28 aa, Entamoeba invadens
LEAHSTFLLKGKHNFISLSLKTIDSLQL

SEQ ID NO: 2797399 - protein, 21 aa, Entamoeba invadens
LEAKAFISDMVFLGIEKFLQK

SEQ ID NO: 2797400 - protein, 18 aa, Entamoeba invadens
LEANCISKINGRTYKDPP

SEQ ID NO: 2797401 - protein, 17 aa, Entamoeba invadens
LEASRLYAGEVVNEVVD

SEQ ID NO: 2797402 - protein, 18 aa, Entamoeba invadens
LECAKIFNYGLVIILPIV

SEQ ID NO: 2797403 - protein, 20 aa, Entamoeba invadens
LECLKPKKLFNGNCVDVIPN

SEQ ID NO: 2797404 - protein, 17 aa, Entamoeba invadens
LECPIGSYSDNEGASSC

SEQ ID NO: 2797405 - protein, 17 aa, Entamoeba invadens
LECSACQSGMAFESRET

SEQ ID NO: 2797406 - protein, 18 aa, Entamoeba invadens
LECYLVIDYCQLCEYNNG

SEQ ID NO: 2797407 - protein, 17 aa, Entamoeba invadens
LEDHFCVSEMCYSNLLN

SEQ ID NO: 2797408 - protein, 17 aa, Entamoeba invadens
LEEALNVGVEFWLMNKP

SEQ ID NO: 2797409 - protein, 25 aa, Entamoeba invadens
LEECFKNWMPLSWSSGDVILVSSEN

SEQ ID NO: 2797410 - protein, 22 aa, Entamoeba invadens
LEECKTCILNHKFNSTVKKCFK

SEQ ID NO: 2797411 - protein, 26 aa, Entamoeba invadens
LEEDIRFQHAFCIKNDVKSFTVICVD

SEQ ID NO: 2797412 - protein, 22 aa, Entamoeba invadens
LEEEKSEVLVQVKALQETIEKL

SEQ ID NO: 2797413 - protein, 17 aa, Entamoeba invadens
LEEKIKKFRAWELVHLY

SEQ ID NO: 2797414 - protein, 25 aa, Entamoeba invadens
LEELYLFPKMEVFEIYNDPSELRAV

SEQ ID NO: 2797415 - protein, 19 aa, Entamoeba invadens
LEENFPCFVKNLNDHGVDV

SEQ ID NO: 2797416 - protein, 24 aa, Entamoeba invadens
LEFIPLKKYFALLLVMFGVETANS

SEQ ID NO: 2797417 - protein, 26 aa, Entamoeba invadens
LEFLKTESLRNWSDCIYLKEIVLSDF

SEQ ID NO: 2797418 - protein, 19 aa, Entamoeba invadens
LEFTNVIGVVLNFSNPQKV

SEQ ID NO: 2797419 - protein, 20 aa, Entamoeba invadens
LEGIKYLDVRGNLVDQLPQK

SEQ ID NO: 2797420 - protein, 32 aa, Entamoeba invadens
LEGISWKDPYPIEKYKFPWSISQCVTEGKRPE

SEQ ID NO: 2797421 - protein, 34 aa, Entamoeba invadens
LEGISWKDPYPIQKFKFPWSISQWMMEGKRPEIL

SEQ ID NO: 2797422 - protein, 34 aa, Entamoeba invadens
LEGISWKDPYPIQKFKFPWSISQWVIEGKRPEIL

SEQ ID NO: 2797423 - protein, 35 aa, Entamoeba invadens
LEGISWKDPYPIQKFKFPWSISQWVMEGKRPEIFV

SEQ ID NO: 2797424 - protein, 18 aa, Entamoeba invadens
LEGLRFSKNQSRATQYRI

SEQ ID NO: 2797425 - protein, 18 aa, Entamoeba invadens
LEGMSCVESLSISRTLVT

SEQ ID NO: 2797426 - protein, 22 aa, Entamoeba invadens
LEGNGILYFWSQIVVTDNTYVE

SEQ ID NO: 2797427 - protein, 22 aa, Entamoeba invadens
LEGRVSVKLVKLFSFHHLTWWE

SEQ ID NO: 2797428 - protein, 17 aa, Entamoeba invadens
LEGTKFLVFAHHQEMLD

SEQ ID NO: 2797429 - protein, 17 aa, Entamoeba invadens
LEGTSWRSNLHHLSTIV

SEQ ID NO: 2797430 - protein, 25 aa, Entamoeba invadens
LEHLDELFVWQLYRVTPSLRLVPIT

SEQ ID NO: 2797431 - protein, 17 aa, Entamoeba invadens
LEIAKTMQSLFMRWDSD

SEQ ID NO: 2797432 - protein, 33 aa, Entamoeba invadens
LEICIPVLVAHEVFHLLSILSFCTHVISYFYLI

SEQ ID NO: 2797433 - protein, 19 aa, Entamoeba invadens
LEIDNDFSLPTFPFTVYGG

SEQ ID NO: 2797434 - protein, 26 aa, Entamoeba invadens
LEIEGWPEKMETIFYPEIHPHGNSEL

SEQ ID NO: 2797435 - protein, 26 aa, Entamoeba invadens
LEIFRVFTPKVCFDAVFLGTIDVILV

SEQ ID NO: 2797436 - protein, 19 aa, Entamoeba invadens
LEIIFLFFVGFSRSLFFSL

SEQ ID NO: 2797437 - protein, 20 aa, Entamoeba invadens
LEIKNQITFDEFKRRWTNPT

SEQ ID NO: 2797438 - protein, 17 aa, Entamoeba invadens
LEIMFGFDNFTKRYKTE

SEQ ID NO: 2797439 - protein, 28 aa, Entamoeba invadens
LEIPATCPYSRIIKKCWRSKENRRPAFT

SEQ ID NO: 2797440 - protein, 29 aa, Entamoeba invadens
LEIPFLVYLLCIWAFYFIDSELTGMSIIK

SEQ ID NO: 2797441 - protein, 24 aa, Entamoeba invadens
LEISGNLNVIGAFVAKSLTVSSGK

SEQ ID NO: 2797442 - protein, 24 aa, Entamoeba invadens
LEIVPELNTLFGMVKFPTDDLKYH

SEQ ID NO: 2797443 - protein, 22 aa, Entamoeba invadens
LEIYSFGKYYFKNGLEVQQVTL

SEQ ID NO: 2797444 - protein, 23 aa, Entamoeba invadens
LEKEVWKGLKVSGLRTGKTAPFI

SEQ ID NO: 2797445 - protein, 36 aa, Entamoeba invadens
LEKLGWRAETKFEDGLKKTVEWYLSHKNNWERTDEA

SEQ ID NO: 2797446 - protein, 22 aa, Entamoeba invadens
LEKRIGEHRVLLASEEETKKIV

SEQ ID NO: 2797447 - protein, 19 aa, Entamoeba invadens
LEKTKLVFSDVCLVNEVLI

SEQ ID NO: 2797448 - protein, 18 aa, Entamoeba invadens
LEKYPKFVPSKCVKSDDW

SEQ ID NO: 2797449 - protein, 19 aa, Entamoeba invadens
LELAYPVVGLFVLFVHFTK

SEQ ID NO: 2797450 - protein, 20 aa, Entamoeba invadens
LELGNLFLYTQIDTEIEPET

SEQ ID NO: 2797451 - protein, 17 aa, Entamoeba invadens
LELILYVGALALLVLIQ

SEQ ID NO: 2797452 - protein, 22 aa, Entamoeba invadens
LELKKMVCKSFDLKNNSFEHDR

SEQ ID NO: 2797453 - protein, 17 aa, Entamoeba invadens
LELMSVTPLSKVQLKHI

SEQ ID NO: 2797454 - protein, 19 aa, Entamoeba invadens
LELPLRYFLNETYLEERRE

SEQ ID NO: 2797455 - protein, 19 aa, Entamoeba invadens
LELPTSYKSLVINSKNTQP

SEQ ID NO: 2797456 - protein, 17 aa, Entamoeba invadens
LELQEYVVTYSSDIYQV

SEQ ID NO: 2797457 - protein, 18 aa, Entamoeba invadens
LELVKGRFYIYSDGTKSQ

SEQ ID NO: 2797458 - protein, 24 aa, Entamoeba invadens
LEMYKNHPNVFAWYVDDETPECGL

SEQ ID NO: 2797459 - protein, 24 aa, Entamoeba invadens
LEMYSGSVLNQFNKAWSLCKNVTL

SEQ ID NO: 2797460 - protein, 20 aa, Entamoeba invadens
LENSEKFIATATQHWNAYCL

SEQ ID NO: 2797461 - protein, 21 aa, Entamoeba invadens
LENSLCWECADGYKLSDDKIE

SEQ ID NO: 2797462 - protein, 30 aa, Entamoeba invadens
LENVSSRKFICCGPLLSVMNMKDFPSNMVF

SEQ ID NO: 2797463 - protein, 25 aa, Entamoeba invadens
LEPFSRLVALFSFVQLKQPIICVMV

SEQ ID NO: 2797464 - protein, 22 aa, Entamoeba invadens
LEPLELIDFVIRRLCVEVRANL

SEQ ID NO: 2797465 - protein, 18 aa, Entamoeba invadens
LEPLRNLTLFFPSLQLLD

SEQ ID NO: 2797466 - protein, 18 aa, Entamoeba invadens
LEPSLCYGENSALDDYVL

SEQ ID NO: 2797467 - protein, 20 aa, Entamoeba invadens
LEPSNIWFGVGMFYLTIVYI

SEQ ID NO: 2797468 - protein, 17 aa, Entamoeba invadens
LEQDIGWRCANTQEENF

SEQ ID NO: 2797469 - protein, 18 aa, Entamoeba invadens
LEQDIGWRCANTQEENFT

SEQ ID NO: 2797470 - protein, 19 aa, Entamoeba invadens
LEQKATFLLMVTLSITNNA

SEQ ID NO: 2797471 - protein, 18 aa, Entamoeba invadens
LEQLMRFSNIFFIVNTVF

SEQ ID NO: 2797472 - protein, 28 aa, Entamoeba invadens
LERELRPYVTKFRCDTCTGKAIEDTAKF

SEQ ID NO: 2797473 - protein, 17 aa, Entamoeba invadens
LERKMSLYLAKIQDGKV

SEQ ID NO: 2797474 - protein, 23 aa, Entamoeba invadens
LERLKKLHIEVVHAFHNQTEDAS

SEQ ID NO: 2797475 - protein, 26 aa, Entamoeba invadens
LERRRIKKIQEKLCVFDISRSNVKFF

SEQ ID NO: 2797476 - protein, 25 aa, Entamoeba invadens
LERRWSSQVFFNYHLVVFITTTLFS

SEQ ID NO: 2797477 - protein, 17 aa, Entamoeba invadens
LERSCKKYSVGKKLDTI

SEQ ID NO: 2797478 - protein, 17 aa, Entamoeba invadens
LERSYCQNFAFALMSVF

SEQ ID NO: 2797479 - protein, 22 aa, Entamoeba invadens
LESFDLSSLNSRTVILTVNVEK

SEQ ID NO: 2797480 - protein, 26 aa, Entamoeba invadens
LESFSFNFLGLAGWAFDILNFEHTRN

SEQ ID NO: 2797481 - protein, 17 aa, Entamoeba invadens
LESINMYNLLVFLEDPL

SEQ ID NO: 2797482 - protein, 17 aa, Entamoeba invadens
LESKKSYNADITKYSEM

SEQ ID NO: 2797483 - protein, 19 aa, Entamoeba invadens
LESKLPKYYLVKKTFEETT

SEQ ID NO: 2797484 - protein, 17 aa, Entamoeba invadens
LESKVSGYVEGESLWID

SEQ ID NO: 2797485 - protein, 25 aa, Entamoeba invadens
LESPSARLALFFGNRTSENVDLHYS

SEQ ID NO: 2797486 - protein, 26 aa, Entamoeba invadens
LESQSSCAYTHGWSFGTYDAQKAKYT

SEQ ID NO: 2797487 - protein, 22 aa, Entamoeba invadens
LESSQLWISFLSTFYTSKLILN

SEQ ID NO: 2797488 - protein, 22 aa, Entamoeba invadens
LESYQFPFFVFEKLFDHQETCN

SEQ ID NO: 2797489 - protein, 25 aa, Entamoeba invadens
LETELKVCCDVDCDLATITGGLRQV

SEQ ID NO: 2797490 - protein, 18 aa, Entamoeba invadens
LETFEIVGNAIGQPFVIF

SEQ ID NO: 2797491 - protein, 18 aa, Entamoeba invadens
LETMRSPYIVTFIGSCVA

SEQ ID NO: 2797492 - protein, 21 aa, Entamoeba invadens
LETNLKLVGMTAIEDKLQDGV

SEQ ID NO: 2797493 - protein, 17 aa, Entamoeba invadens
LETRALICIGNISKDKI

SEQ ID NO: 2797494 - protein, 19 aa, Entamoeba invadens
LETSFCFVNSHLAAHIEPE

SEQ ID NO: 2797495 - protein, 18 aa, Entamoeba invadens
LETSNALLQFSKELGLFL

SEQ ID NO: 2797496 - protein, 28 aa, Entamoeba invadens
LETTCLFFRNEMCLKCSIRDTNVRTISN

SEQ ID NO: 2797497 - protein, 21 aa, Entamoeba invadens
LETVSSLSFLDRGSSFGQDAR

SEQ ID NO: 2797498 - protein, 25 aa, Entamoeba invadens
LEVIFNFTGIFGFFLLFIIPAVLQI

SEQ ID NO: 2797499 - protein, 17 aa, Entamoeba invadens
LEVLKTTLLNVLKQVSS

SEQ ID NO: 2797500 - protein, 23 aa, Entamoeba invadens
LEVLSKLKVLIFIYLIPISLKCE

SEQ ID NO: 2797501 - protein, 30 aa, Entamoeba invadens
LEVNSTYSVMNWRVGGLLSANRDVEMYDFN

SEQ ID NO: 2797502 - protein, 21 aa, Entamoeba invadens
LEVNTTCPLDCGEHGICSSYS

SEQ ID NO: 2797503 - protein, 18 aa, Entamoeba invadens
LEVPRLDEKYILTETTQK

SEQ ID NO: 2797504 - protein, 17 aa, Entamoeba invadens
LEVSIKTCDMCLNGVIT

SEQ ID NO: 2797505 - protein, 17 aa, Entamoeba invadens
LEYCCLSGIEKEFCKDM

SEQ ID NO: 2797506 - protein, 26 aa, Entamoeba invadens
LEYFVSGGFVLFTFVFLTSLIRCGFR

SEQ ID NO: 2797507 - protein, 19 aa, Entamoeba invadens
LEYGECTKLTPKGVGTFTF

SEQ ID NO: 2797508 - protein, 26 aa, Entamoeba invadens
LEYPDMNCLYRFSLELSNEQSDLEIE

SEQ ID NO: 2797509 - protein, 20 aa, Entamoeba invadens
LEYSGSLTLVSYSGEDLTVH

SEQ ID NO: 2797510 - protein, 18 aa, Entamoeba invadens
LFAASLLFFSICSSSHIT

SEQ ID NO: 2797511 - protein, 26 aa, Entamoeba invadens
LFALAFPLMSSFIIKWLNKEDAGVGM

SEQ ID NO: 2797512 - protein, 26 aa, Entamoeba invadens
LFAVGFFIPCVWFYLIYKYHNSPLKN

SEQ ID NO: 2797513 - protein, 24 aa, Entamoeba invadens
LFAYGGHCFAFLAIVWKTPQLQKL

SEQ ID NO: 2797514 - protein, 19 aa, Entamoeba invadens
LFCTPCLICTLFNCVTVGN

SEQ ID NO: 2797515 - protein, 18 aa, Entamoeba invadens
LFDIITKCWCQNPNERLA

SEQ ID NO: 2797516 - protein, 17 aa, Entamoeba invadens
LFDITALGYQWGGQPFK

SEQ ID NO: 2797517 - protein, 18 aa, Entamoeba invadens
LFDTLPMYVLFDQKFASE

SEQ ID NO: 2797518 - protein, 31 aa, Entamoeba invadens
LFEACKRTKMAIKCYFVLVDIFEATKQIKEL

SEQ ID NO: 2797519 - protein, 27 aa, Entamoeba invadens
LFEFCKYCSPSMCLSCDDSYHLTPEGI

SEQ ID NO: 2797520 - protein, 24 aa, Entamoeba invadens
LFEGCGRISSFSGLSTIKYLYTKS

SEQ ID NO: 2797521 - protein, 24 aa, Entamoeba invadens
LFEGFLDFFKKFLVDYKSNEGIIK

SEQ ID NO: 2797522 - protein, 25 aa, Entamoeba invadens
LFEGKCVLCSPGYYSNEENLTECKE

SEQ ID NO: 2797523 - protein, 18 aa, Entamoeba invadens
LFENEIRGIHSIVNQMKI

SEQ ID NO: 2797524 - protein, 19 aa, Entamoeba invadens
LFENMWIRVLSPLNLKAKL

SEQ ID NO: 2797525 - protein, 22 aa, Entamoeba invadens
LFESETPLTCHILKLNQKTLIT

SEQ ID NO: 2797526 - protein, 17 aa, Entamoeba invadens
LFESIKTLMTFEKMVNS

SEQ ID NO: 2797527 - protein, 19 aa, Entamoeba invadens
LFFGLCLDIKEDFQTSFLS

SEQ ID NO: 2797528 - protein, 28 aa, Entamoeba invadens
LFFINEVFLQLKLLWPSYTPNDNYSYCA

SEQ ID NO: 2797529 - protein, 25 aa, Entamoeba invadens
LFFISYFFYCYKTIPHLHSFFHQTE

SEQ ID NO: 2797530 - protein, 20 aa, Entamoeba invadens
LFFLCELITGIVIHSLALLA

SEQ ID NO: 2797531 - protein, 17 aa, Entamoeba invadens
LFFLNSIDDAGCPNADR

SEQ ID NO: 2797532 - protein, 18 aa, Entamoeba invadens
LFFNRWNMIVFLIISTAV

SEQ ID NO: 2797533 - protein, 19 aa, Entamoeba invadens
LFFVIPMVIGVTIIRAHSC

SEQ ID NO: 2797534 - protein, 26 aa, Entamoeba invadens
LFFVLGFFCCCIWIVVYRKFKHSGND

SEQ ID NO: 2797535 - protein, 19 aa, Entamoeba invadens
LFGDFLIKPEITKIANHSC

SEQ ID NO: 2797536 - protein, 23 aa, Entamoeba invadens
LFGQGIGKFYGKFTFWKDKRLGF

SEQ ID NO: 2797537 - protein, 18 aa, Entamoeba invadens
LFGTFGFLLPNIVERYIE

SEQ ID NO: 2797538 - protein, 33 aa, Entamoeba invadens
LFGVGLPQFSKLVLHIMKIETRFEVAEKQRTEN

SEQ ID NO: 2797539 - protein, 17 aa, Entamoeba invadens
LFHLFLLTLGLAFNFIS

SEQ ID NO: 2797540 - protein, 18 aa, Entamoeba invadens
LFHLNLKLSNVMMKSFSA

SEQ ID NO: 2797541 - protein, 18 aa, Entamoeba invadens
LFHLNLKLSNVMMKSFSV

SEQ ID NO: 2797542 - protein, 17 aa, Entamoeba invadens
LFIEELFFNTPITFNVT

SEQ ID NO: 2797543 - protein, 24 aa, Entamoeba invadens
LFIKNPWNTFSFFTFVMYYIYMMI

SEQ ID NO: 2797544 - protein, 18 aa, Entamoeba invadens
LFILFPFVALCVPSTFFR

SEQ ID NO: 2797545 - protein, 26 aa, Entamoeba invadens
LFIPIVAQKVMIEFGLAWSDIKNGSS

SEQ ID NO: 2797546 - protein, 20 aa, Entamoeba invadens
LFIRLFCSFYSYKVNKTSYN

SEQ ID NO: 2797547 - protein, 20 aa, Entamoeba invadens
LFIVDNLVSIGFNFTSINEF

SEQ ID NO: 2797548 - protein, 17 aa, Entamoeba invadens
LFIVDTIEHIEIGEVKG

SEQ ID NO: 2797549 - protein, 17 aa, Entamoeba invadens
LFIVHALSIYPKFIELL

SEQ ID NO: 2797550 - protein, 17 aa, Entamoeba invadens
LFIYIIAKRIVYRRAKQ

SEQ ID NO: 2797551 - protein, 26 aa, Entamoeba invadens
LFIYLLACLTHLMKVVPLSVVMFVFN

SEQ ID NO: 2797552 - protein, 20 aa, Entamoeba invadens
LFKIVVSFLCSPGCKSGCIA

SEQ ID NO: 2797553 - protein, 20 aa, Entamoeba invadens
LFLAVGVPIIGVFVLVVLLF

SEQ ID NO: 2797554 - protein, 27 aa, Entamoeba invadens
LFLDLTIPVLFGLYLLKTGLRIGLYKK

SEQ ID NO: 2797555 - protein, 21 aa, Entamoeba invadens
LFLDSRITILVRVIVPIIIFF

SEQ ID NO: 2797556 - protein, 26 aa, Entamoeba invadens
LFLFIFRFFFLGALNGKASIKIHFDA

SEQ ID NO: 2797557 - protein, 17 aa, Entamoeba invadens
LFLFVLMKIVLTPKSKN

SEQ ID NO: 2797558 - protein, 17 aa, Entamoeba invadens
LFLGWTANLAFENSNSE

SEQ ID NO: 2797559 - protein, 19 aa, Entamoeba invadens
LFLHFDYTVTIISPKDPHK

SEQ ID NO: 2797560 - protein, 17 aa, Entamoeba invadens
LFLHFFTNTSFYLPEYR

SEQ ID NO: 2797561 - protein, 25 aa, Entamoeba invadens
LFLHICALYLYASGFLITSIRVPTQ

SEQ ID NO: 2797562 - protein, 21 aa, Entamoeba invadens
LFLIWRRRLAVEKERKKSFRP

SEQ ID NO: 2797563 - protein, 17 aa, Entamoeba invadens
LFLKLGEKIVVYKQEWT

SEQ ID NO: 2797564 - protein, 17 aa, Entamoeba invadens
LFLLFLVLFIAFPLTLT

SEQ ID NO: 2797565 - protein, 19 aa, Entamoeba invadens
LFLLLCGEFKIFGGEGSLM

SEQ ID NO: 2797566 - protein, 17 aa, Entamoeba invadens
LFLLWYFIRQHNKRVEE

SEQ ID NO: 2797567 - protein, 21 aa, Entamoeba invadens
LFLLYCGRYITFLGAPCAYVK

SEQ ID NO: 2797568 - protein, 21 aa, Entamoeba invadens
LFLNRCGEWLQIIGPSENIVN

SEQ ID NO: 2797569 - protein, 17 aa, Entamoeba invadens
LFLNWAMFLGMTLCLFI

SEQ ID NO: 2797570 - protein, 18 aa, Entamoeba invadens
LFLSKLLKMESFVKNNEL

SEQ ID NO: 2797571 - protein, 23 aa, Entamoeba invadens
LFLTCILAVFTLALHRFLVDENE

SEQ ID NO: 2797572 - protein, 18 aa, Entamoeba invadens
LFLVDAGLVIISRFPIVE

SEQ ID NO: 2797573 - protein, 17 aa, Entamoeba invadens
LFLVVVFTWASPTKLET

SEQ ID NO: 2797574 - protein, 18 aa, Entamoeba invadens
LFMFTFDVMLTLLLAEIV

SEQ ID NO: 2797575 - protein, 22 aa, Entamoeba invadens
LFMPSMFVTAVMSFVLAIIVGY

SEQ ID NO: 2797576 - protein, 17 aa, Entamoeba invadens
LFNCKRSGQYGCMECEN

SEQ ID NO: 2797577 - protein, 18 aa, Entamoeba invadens
LFNEVPFVIHNVIKELLF

SEQ ID NO: 2797578 - protein, 21 aa, Entamoeba invadens
LFNFASYFYWLVVPLMCVDQG

SEQ ID NO: 2797579 - protein, 18 aa, Entamoeba invadens
LFNFCSIFLQMLRNTTDV

SEQ ID NO: 2797580 - protein, 18 aa, Entamoeba invadens
LFNGRCVVCDLTCKANTC

SEQ ID NO: 2797581 - protein, 18 aa, Entamoeba invadens
LFNQFKYFYNLYFLVTAL

SEQ ID NO: 2797582 - protein, 27 aa, Entamoeba invadens
LFPILCLVIPCILEAFKVTSLAISGFV

SEQ ID NO: 2797583 - protein, 22 aa, Entamoeba invadens
LFPKFGDKFIYYKPGWGPGVRK

SEQ ID NO: 2797584 - protein, 24 aa, Entamoeba invadens
LFPKWKDAYHIVFSFFSEFLKHKP

SEQ ID NO: 2797585 - protein, 20 aa, Entamoeba invadens
LFPTIAGFVSFIAINTNSFV

SEQ ID NO: 2797586 - protein, 26 aa, Entamoeba invadens
LFPYSWDITNLISRGERPTIELGDGE

SEQ ID NO: 2797587 - protein, 17 aa, Entamoeba invadens
LFQCCLHFIQYDPSCTF

SEQ ID NO: 2797588 - protein, 18 aa, Entamoeba invadens
LFQHNWDIADFVTTGKRL

SEQ ID NO: 2797589 - protein, 24 aa, Entamoeba invadens
LFQSAKVFKMFPALLPQLFVSVLG

SEQ ID NO: 2797590 - protein, 19 aa, Entamoeba invadens
LFRYFVMSMSQKLNIVATK

SEQ ID NO: 2797591 - protein, 20 aa, Entamoeba invadens
LFSCLEILLRLEKAKPVYLD

SEQ ID NO: 2797592 - protein, 19 aa, Entamoeba invadens
LFSFCGFFSYGGFKVTNAF

SEQ ID NO: 2797593 - protein, 19 aa, Entamoeba invadens
LFSGNEFTQIPTLQWDDDY

SEQ ID NO: 2797594 - protein, 23 aa, Entamoeba invadens
LFSKEHLELFISYLALVSNSLAA

SEQ ID NO: 2797595 - protein, 31 aa, Entamoeba invadens
LFSRGIPCFIRKSGKVYAVFNNEEILIKKVN

SEQ ID NO: 2797596 - protein, 26 aa, Entamoeba invadens
LFSSILSIILPIVFPSMYFLMCASVV

SEQ ID NO: 2797597 - protein, 19 aa, Entamoeba invadens
LFSSIPFIVLSLYIIGFGV

SEQ ID NO: 2797598 - protein, 18 aa, Entamoeba invadens
LFSSLTPLGVKEFRESAY

SEQ ID NO: 2797599 - protein, 19 aa, Entamoeba invadens
LFTFEEIHLLYFFIQTQFS

SEQ ID NO: 2797600 - protein, 25 aa, Entamoeba invadens
LFTHCNTCSDILCTECEEGYVVNED

SEQ ID NO: 2797601 - protein, 18 aa, Entamoeba invadens
LFTLEYKGRGYVFIDTRA

SEQ ID NO: 2797602 - protein, 18 aa, Entamoeba invadens
LFTLIPMVLIVVFLCINR

SEQ ID NO: 2797603 - protein, 19 aa, Entamoeba invadens
LFTLVYSFQCSPGCPDGCI

SEQ ID NO: 2797604 - protein, 31 aa, Entamoeba invadens
LFTPFFVMRMGFPFIMHLLMLYKFSAELEES

SEQ ID NO: 2797605 - protein, 18 aa, Entamoeba invadens
LFTTGSVAFRLSILLSFL

SEQ ID NO: 2797606 - protein, 19 aa, Entamoeba invadens
LFTVMALKLRLLVNKLGKE

SEQ ID NO: 2797607 - protein, 18 aa, Entamoeba invadens
LFTVTALKLQSLVNKLGK

SEQ ID NO: 2797608 - protein, 19 aa, Entamoeba invadens
LFVCVIFSVYLFKTEEATK

SEQ ID NO: 2797609 - protein, 18 aa, Entamoeba invadens
LFVDKIGRWDLLDFEEIV

SEQ ID NO: 2797610 - protein, 28 aa, Entamoeba invadens
LFVEGKSGVMGWEMIKPSFTALVLGKRS

SEQ ID NO: 2797611 - protein, 24 aa, Entamoeba invadens
LFVEYSTLFLTEFAKNALQDVLQK

SEQ ID NO: 2797612 - protein, 18 aa, Entamoeba invadens
LFVFPVYIIPAGAVAINF

SEQ ID NO: 2797613 - protein, 17 aa, Entamoeba invadens
LFVKMLIVEIFASALGL

SEQ ID NO: 2797614 - protein, 22 aa, Entamoeba invadens
LFVKVGVPILVIFFVLIIGITI

SEQ ID NO: 2797615 - protein, 28 aa, Entamoeba invadens
LFVLGFIFPCFWLINGCMCCCSRVKTGF

SEQ ID NO: 2797616 - protein, 18 aa, Entamoeba invadens
LFVLGGLCAIILFCQDPF

SEQ ID NO: 2797617 - protein, 17 aa, Entamoeba invadens
LFVLIAIPISINTAQLQ

SEQ ID NO: 2797618 - protein, 37 aa, Entamoeba invadens
LFVQCGIVCLEFFFLQFVCVLMLRAFGVREYFIQSLA

SEQ ID NO: 2797619 - protein, 19 aa, Entamoeba invadens
LFVVICVGIILVVLLFVVK

SEQ ID NO: 2797620 - protein, 17 aa, Entamoeba invadens
LFWCYMLAIFTFAVDIV

SEQ ID NO: 2797621 - protein, 18 aa, Entamoeba invadens
LFYLAPLSFIVSVDCFLQ

SEQ ID NO: 2797622 - protein, 18 aa, Entamoeba invadens
LFYTCSKFITFHCGSFVI

SEQ ID NO: 2797623 - protein, 19 aa, Entamoeba invadens
LFYTVCCLLIFIWIEPLAI

SEQ ID NO: 2797624 - protein, 18 aa, Entamoeba invadens
LGAKCSVAIPTGGGCAIC

SEQ ID NO: 2797625 - protein, 23 aa, Entamoeba invadens
LGAKECPIKPFAEKVQKQAVDAI

SEQ ID NO: 2797626 - protein, 18 aa, Entamoeba invadens
LGALPVGLIFDFINRPVP

SEQ ID NO: 2797627 - protein, 20 aa, Entamoeba invadens
LGAPCAYVKHGDFGKFMCAD

SEQ ID NO: 2797628 - protein, 27 aa, Entamoeba invadens
LGCATLFAIRLRRSLNLLKMMDGDEKK

SEQ ID NO: 2797629 - protein, 20 aa, Entamoeba invadens
LGCGAFGVVMKGRYKNNSVA

SEQ ID NO: 2797630 - protein, 20 aa, Entamoeba invadens
LGCICFGPRFQIKYRIALTE

SEQ ID NO: 2797631 - protein, 22 aa, Entamoeba invadens
LGCISCTSGYYLYHKECATCSD

SEQ ID NO: 2797632 - protein, 17 aa, Entamoeba invadens
LGCKNSRNPPKCECDQG

SEQ ID NO: 2797633 - protein, 30 aa, Entamoeba invadens
LGCMMFCIMASNALGTWYGNLVLRGKGGSS

SEQ ID NO: 2797634 - protein, 20 aa, Entamoeba invadens
LGCTTCISGYYLYHRECERC

SEQ ID NO: 2797635 - protein, 21 aa, Entamoeba invadens
LGCYRCIDGKFLNAESGICDD

SEQ ID NO: 2797636 - protein, 22 aa, Entamoeba invadens
LGDEAKKLILPHSVCEYYTQRG

SEQ ID NO: 2797637 - protein, 23 aa, Entamoeba invadens
LGDVFNSFIIIRVAMCFFVAAVA

SEQ ID NO: 2797638 - protein, 33 aa, Entamoeba invadens
LGDVRFKKWSVWQINPDYSWKLFPPGAASVEMN

SEQ ID NO: 2797639 - protein, 21 aa, Entamoeba invadens
LGEAISWATIIQVFGFVVLTF

SEQ ID NO: 2797640 - protein, 27 aa, Entamoeba invadens
LGEDSFGIVFKGIFRGNIVAIKKMKNF

SEQ ID NO: 2797641 - protein, 27 aa, Entamoeba invadens
LGEEIRLQWYLGMIVVICGVTLLLVDN

SEQ ID NO: 2797642 - protein, 30 aa, Entamoeba invadens
LGEIPKGLLGTIGWKVGDQVTYAIEGSVMT

SEQ ID NO: 2797643 - protein, 17 aa, Entamoeba invadens
LGEKCSPHYQWSLSNNQ

SEQ ID NO: 2797644 - protein, 25 aa, Entamoeba invadens
LGELKQRAPVLFKYFNREISAFITD

SEQ ID NO: 2797645 - protein, 18 aa, Entamoeba invadens
LGENIAWVSSPSKLCLVK

SEQ ID NO: 2797646 - protein, 18 aa, Entamoeba invadens
LGERCFWECKNLSSVIIP

SEQ ID NO: 2797647 - protein, 17 aa, Entamoeba invadens
LGFAKSWDLTLVLLCSA

SEQ ID NO: 2797648 - protein, 17 aa, Entamoeba invadens
LGFANIFYIPMAITESF

SEQ ID NO: 2797649 - protein, 21 aa, Entamoeba invadens
LGFRIEIYRNGNIPMFGPLIH

SEQ ID NO: 2797650 - protein, 25 aa, Entamoeba invadens
LGFSNLLYKMWKPTREPTVISMSQY

SEQ ID NO: 2797651 - protein, 17 aa, Entamoeba invadens
LGFTIYLIFKGGYTKQW

SEQ ID NO: 2797652 - protein, 19 aa, Entamoeba invadens
LGFTKSWDLTLIILMVTPI

SEQ ID NO: 2797653 - protein, 19 aa, Entamoeba invadens
LGFVVPFLCASSVFCTRHF

SEQ ID NO: 2797654 - protein, 17 aa, Entamoeba invadens
LGGETFGALNGLYDVFC

SEQ ID NO: 2797655 - protein, 23 aa, Entamoeba invadens
LGGFAIICCSLFVYFVGYVPAQL

SEQ ID NO: 2797656 - protein, 18 aa, Entamoeba invadens
LGGGLVMQFFMLGYIDAL

SEQ ID NO: 2797657 - protein, 18 aa, Entamoeba invadens
LGGISALIPLNGFGEIEF

SEQ ID NO: 2797658 - protein, 20 aa, Entamoeba invadens
LGGNCKVNFTARTIRDIPLF

SEQ ID NO: 2797659 - protein, 39 aa, Entamoeba invadens; identical to SEQ ID NO: 2386587

SEQ ID NO: 2797660 - protein, 17 aa, Entamoeba invadens
LGHGIGANVIKLAAHLK

SEQ ID NO: 2797661 - protein, 17 aa, Entamoeba invadens
LGIAYPTAFKFGQTMKK

SEQ ID NO: 2797662 - protein, 18 aa, Entamoeba invadens
LGIDFKVIGKRIVTKLNP

SEQ ID NO: 2797663 - protein, 19 aa, Entamoeba invadens
LGIDLCELLYRNSNHGFKI

SEQ ID NO: 2797664 - protein, 18 aa, Entamoeba invadens
LGIGMGFVMFTIFCSITL

SEQ ID NO: 2797665 - protein, 19 aa, Entamoeba invadens
LGIHFKKDVKMYFSTLNTI

SEQ ID NO: 2797666 - protein, 25 aa, Entamoeba invadens
LGIIDYIFDFLKVMKSDRFVEVACD

SEQ ID NO: 2797667 - protein, 22 aa, Entamoeba invadens
LGIQEWIAAGMLTLVIVSNIII

SEQ ID NO: 2797668 - protein, 25 aa, Entamoeba invadens
LGIRKPRKSLCIVQSPLRKSKRGSG

SEQ ID NO: 2797669 - protein, 19 aa, Entamoeba invadens
LGITCAFALGTYYAITYSS

SEQ ID NO: 2797670 - protein, 17 aa, Entamoeba invadens
LGIVFGWPHVISVFNGV

SEQ ID NO: 2797671 - protein, 23 aa, Entamoeba invadens
LGKCKKCSINALLSDGLCIPLDV

SEQ ID NO: 2797672 - protein, 24 aa, Entamoeba invadens
LGKCSPTFGCTSCKDGFYNTSLIC

SEQ ID NO: 2797673 - protein, 17 aa, Entamoeba invadens
LGKCVSCLAGYYYNGTA

SEQ ID NO: 2797674 - protein, 18 aa, Entamoeba invadens
LGKEAPYLLVYQLLNQLV

SEQ ID NO: 2797675 - protein, 25 aa, Entamoeba invadens
LGKEKVSLCYIEYCTFLMDVMLCGN

SEQ ID NO: 2797676 - protein, 22 aa, Entamoeba invadens
LGLACVSFCGYIIINELQLEET

SEQ ID NO: 2797677 - protein, 26 aa, Entamoeba invadens
LGLENPRILLTWGQLPVTTHWGILNK

SEQ ID NO: 2797678 - protein, 26 aa, Entamoeba invadens
LGLFQVCTLGAMYRYSKTNTENCYCD

SEQ ID NO: 2797679 - protein, 19 aa, Entamoeba invadens
LGLFVWLTFAPPRVPKGTT

SEQ ID NO: 2797680 - protein, 20 aa, Entamoeba invadens
LGLGCVICLIFTVVVNLTIT

SEQ ID NO: 2797681 - protein, 18 aa, Entamoeba invadens
LGLHPKFSFYDYQTYSNI

SEQ ID NO: 2797682 - protein, 19 aa, Entamoeba invadens
LGLIGCAAIQGYVYYIERK

SEQ ID NO: 2797683 - protein, 29 aa, Entamoeba invadens
LGLIGSFLMGIIWPLYAVISVDYIVVLLS

SEQ ID NO: 2797684 - protein, 17 aa, Entamoeba invadens
LGLKAFDEMDLKTPTPS

SEQ ID NO: 2797685 - protein, 19 aa, Entamoeba invadens
LGLLMPRVISYKEMIRFAI

SEQ ID NO: 2797686 - protein, 32 aa, Entamoeba invadens
LGLLSPFLMCMFSVLVMLVFFFRHHLSRFYFL

SEQ ID NO: 2797687 - protein, 20 aa, Entamoeba invadens
LGLNLPFSCDANFSKMAKGK

SEQ ID NO: 2797688 - protein, 24 aa, Entamoeba invadens
LGLPGDVPALIVLGIFCLLIAGAL

SEQ ID NO: 2797689 - protein, 47 aa, Entamoeba invadens
LGLRRNAMSDVIEWVESVTGWRCQNFLNEWSDGMVVMLIAGENNPLF

SEQ ID NO: 2797690 - protein, 20 aa, Entamoeba invadens
LGLVSRGSAISVVYGENDEK

SEQ ID NO: 2797691 - protein, 26 aa, Entamoeba invadens
LGMFIPTLMCIGCCMIHKPQTRQLQQ

SEQ ID NO: 2797692 - protein, 18 aa, Entamoeba invadens
LGNCLSCRDGYFPHNGKC

SEQ ID NO: 2797693 - protein, 18 aa, Entamoeba invadens
LGNFIVVLLSVYWRKIVK

SEQ ID NO: 2797694 - protein, 18 aa, Entamoeba invadens
LGNIMNVVYLILFADAFS

SEQ ID NO: 2797695 - protein, 24 aa, Entamoeba invadens
LGNVFRKSFEKIHMETSGIVLSEF

SEQ ID NO: 2797696 - protein, 21 aa, Entamoeba invadens
LGPSLCLTCGNSNYKDDATGS

SEQ ID NO: 2797697 - protein, 19 aa, Entamoeba invadens
LGQGLYYYLSRRNIVKREY

SEQ ID NO: 2797698 - protein, 26 aa, Entamoeba invadens
LGQKQLICLARALLKGSKILIMDEAT

SEQ ID NO: 2797699 - protein, 21 aa, Entamoeba invadens
LGSFALFLAIRKWRQKKIRDA

SEQ ID NO: 2797700 - protein, 21 aa, Entamoeba invadens
LGSLCGLLYGEIDNYYPVLMK

SEQ ID NO: 2797701 - protein, 17 aa, Entamoeba invadens
LGSPFGGGVYVMTGGST

SEQ ID NO: 2797702 - protein, 18 aa, Entamoeba invadens
LGSPNAMFVVINNMATKL

SEQ ID NO: 2797703 - protein, 24 aa, Entamoeba invadens
LGSTFGKFLYRFCFFILSERIGLK

SEQ ID NO: 2797704 - protein, 22 aa, Entamoeba invadens
LGSVFELWFPFEAEGYFAKPIC

SEQ ID NO: 2797705 - protein, 27 aa, Entamoeba invadens
LGTKRLSRFGSVLAFIVLTPFIVLFII

SEQ ID NO: 2797706 - protein, 25 aa, Entamoeba invadens
LGTYSLFMMVFCFFREKGSDLKDKR

SEQ ID NO: 2797707 - protein, 19 aa, Entamoeba invadens
LGVAIGVPLSLIFIILVVI

SEQ ID NO: 2797708 - protein, 26 aa, Entamoeba invadens
LGVAMMDFPAKFGLILEGNTTLGEIG

SEQ ID NO: 2797709 - protein, 23 aa, Entamoeba invadens
LGVGCGPFLSSMMDYIGFMLGGS

SEQ ID NO: 2797710 - protein, 23 aa, Entamoeba invadens
LGVIIRYIYPFFVPYITQLLNDL

SEQ ID NO: 2797711 - protein, 17 aa, Entamoeba invadens
LGVKVKELKAMREKREE

SEQ ID NO: 2797712 - protein, 22 aa, Entamoeba invadens
LGVSCLIFIGLFIFAVVRKVMT

SEQ ID NO: 2797713 - protein, 26 aa, Entamoeba invadens
LGVTMFECFSWKEAYPKEDFKYPWKI

SEQ ID NO: 2797714 - protein, 17 aa, Entamoeba invadens
LGVWYGTMIIRGSGGSK

SEQ ID NO: 2797715 - protein, 19 aa, Entamoeba invadens
LGYHTARQALYGIVFGIVV

SEQ ID NO: 2797716 - protein, 17 aa, Entamoeba invadens
LGYMMFYILAFFNLLRR

SEQ ID NO: 2797717 - protein, 19 aa, Entamoeba invadens
LGYSFKILSGTLIGMSIPI

SEQ ID NO: 2797718 - protein, 22 aa, Entamoeba invadens
LGYSLICKRCTIRGTNQKITSL

SEQ ID NO: 2797719 - protein, 19 aa, Entamoeba invadens
LGYVSVPIALLVMLKCRSV

SEQ ID NO: 2797720 - protein, 22 aa, Entamoeba invadens
LGYYRWTFKIQSLQLVQLDTDY

SEQ ID NO: 2797721 - protein, 31 aa, Entamoeba invadens
LHAVEFILKYSLKYTDWLSVESHIVVRYLFD

SEQ ID NO: 2797722 - protein, 22 aa, Entamoeba invadens
LHCVKGKCVLCDKEYIVDVYGN

SEQ ID NO: 2797723 - protein, 17 aa, Entamoeba invadens
LHDIIFKCQLRVDGPMS

SEQ ID NO: 2797724 - protein, 21 aa, Entamoeba invadens
LHDIVNIIYIFTMFVGSYPIQ

SEQ ID NO: 2797725 - protein, 17 aa, Entamoeba invadens
LHFFMKFLAQHEEYHPY

SEQ ID NO: 2797726 - protein, 25 aa, Entamoeba invadens
LHFFPNLVLYYLRWKSNFNIPTKLT

SEQ ID NO: 2797727 - protein, 29 aa, Entamoeba invadens
LHFVFSWQFWWKLFVIVVLTSIPFIAKFI

SEQ ID NO: 2797728 - protein, 23 aa, Entamoeba invadens
LHHCKPPIIHRDLKTNNLLVDDN

SEQ ID NO: 2797729 - protein, 24 aa, Entamoeba invadens
LHHEILRRLDLTLLPNEFLKLLCV

SEQ ID NO: 2797730 - protein, 25 aa, Entamoeba invadens
LHIDKCYDYFGNVVFSYEQLRNEAL

SEQ ID NO: 2797731 - protein, 18 aa, Entamoeba invadens
LHIFFLRLVAEQFEEYVQ

SEQ ID NO: 2797732 - protein, 18 aa, Entamoeba invadens
LHIFGEIFAENGFLVRSD

SEQ ID NO: 2797733 - protein, 25 aa, Entamoeba invadens
LHIFSESIVSLFIGILVGLVLLGLH

SEQ ID NO: 2797734 - protein, 19 aa, Entamoeba invadens
LHKAGGWILNIQNILQASD

SEQ ID NO: 2797735 - protein, 19 aa, Entamoeba invadens
LHKFGPRMMLVIILICTLV

SEQ ID NO: 2797736 - protein, 23 aa, Entamoeba invadens
LHKNCACEFEFFITPNYTCKIED

SEQ ID NO: 2797737 - protein, 17 aa, Entamoeba invadens
LHKPLIGIYKWGPSLAI

SEQ ID NO: 2797738 - protein, 21 aa, Entamoeba invadens
LHLPLTISSLGARAFSSCKNL

SEQ ID NO: 2797739 - protein, 23 aa, Entamoeba invadens
LHLQLSILLKRVVVMRYNDLDSQ

SEQ ID NO: 2797740 - protein, 19 aa, Entamoeba invadens
LHMFGEVFADEGFLVRSDE

SEQ ID NO: 2797741 - protein, 17 aa, Entamoeba invadens
LHMNFFFVLGFVQILTA

SEQ ID NO: 2797742 - protein, 18 aa, Entamoeba invadens
LHMQVLLILSVAIAAIAT

SEQ ID NO: 2797743 - protein, 18 aa, Entamoeba invadens
LHMVFAVSGIFFGLTNTF

SEQ ID NO: 2797744 - protein, 19 aa, Entamoeba invadens
LHNACLKLHAQLLVYKPGC

SEQ ID NO: 2797745 - protein, 26 aa, Entamoeba invadens
LHNTSRSFLHLSFKLKVKVLLDTSKG

SEQ ID NO: 2797746 - protein, 22 aa, Entamoeba invadens
LHPESSSLVWLNGLSLILPDIS

SEQ ID NO: 2797747 - protein, 30 aa, Entamoeba invadens
LHPSNFPKFSCQWLELFSHRSLLYDLAKAP

SEQ ID NO: 2797748 - protein, 17 aa, Entamoeba invadens
LHQEMSYLFKVKVMEDV

SEQ ID NO: 2797749 - protein, 19 aa, Entamoeba invadens
LHQKLHLNMIVNYLFIIPC

SEQ ID NO: 2797750 - protein, 18 aa, Entamoeba invadens
LHQNEIFDIFATNDYSEL

SEQ ID NO: 2797751 - protein, 23 aa, Entamoeba invadens
LHQSGKGKLIFRDYSKASISGFQ

SEQ ID NO: 2797752 - protein, 18 aa, Entamoeba invadens
LHQVNSFCFMCDENHILV

SEQ ID NO: 2797753 - protein, 21 aa, Entamoeba invadens
LHSSMFVNWIFLTSVVLPSNV

SEQ ID NO: 2797754 - protein, 20 aa, Entamoeba invadens
LIACDMAGYVAVYRFTVNDI

SEQ ID NO: 2797755 - protein, 17 aa, Entamoeba invadens
LIAETGILKVFFIFLLT

SEQ ID NO: 2797756 - protein, 24 aa, Entamoeba invadens
LIAFPGFIVSFLLVDRIGRKPLQL

SEQ ID NO: 2797757 - protein, 26 aa, Entamoeba invadens
LIAFRLRFAFEPIVFVSAGSAALTLF

SEQ ID NO: 2797758 - protein, 28 aa, Entamoeba invadens
LIAIFVVICTCSYYLIIVVVFILVAFMC

SEQ ID NO: 2797759 - protein, 18 aa, Entamoeba invadens
LIALMVMYMFQYNKNLTQ

SEQ ID NO: 2797760 - protein, 25 aa, Entamoeba invadens
LIAMALCFFVMLLSFTANVRENSWE

SEQ ID NO: 2797761 - protein, 23 aa, Entamoeba invadens
LIAMDYLEIMISVLIRDDKTQAM

SEQ ID NO: 2797762 - protein, 19 aa, Entamoeba invadens
LIAVGGLIYFWATRRRRVL

SEQ ID NO: 2797763 - protein, 26 aa, Entamoeba invadens
LIAVLPRLIYDVTLFIPIFAQSVMIN

SEQ ID NO: 2797764 - protein, 17 aa, Entamoeba invadens
LICDLYIGSVQPEIDKV

SEQ ID NO: 2797765 - protein, 18 aa, Entamoeba invadens
LICSIISVVGMEERDASL

SEQ ID NO: 2797766 - protein, 21 aa, Entamoeba invadens
LICVLSADFTLPIRESICMTD

SEQ ID NO: 2797767 - protein, 21 aa, Entamoeba invadens
LIDDKLCFDKYPAVLSELCLS

SEQ ID NO: 2797768 - protein, 24 aa, Entamoeba invadens
LIDLNCPALEFVIQCLDALDFTAK

SEQ ID NO: 2797769 - protein, 20 aa, Entamoeba invadens
LIDRLCRTIRDLYVKYYILN

SEQ ID NO: 2797770 - protein, 24 aa, Entamoeba invadens
LIDSCLICLAGTYSYGGTTTSCSL

SEQ ID NO: 2797771 - protein, 26 aa, Entamoeba invadens
LIDTFKFAWKIAEFVSSGERLENRRN

SEQ ID NO: 2797772 - protein, 24 aa, Entamoeba invadens
LIDVEPRLAVAVVSLSLYFGVLIG

SEQ ID NO: 2797773 - protein, 19 aa, Entamoeba invadens
LIEDCWKLPKQRPTFTTIV

SEQ ID NO: 2797774 - protein, 17 aa, Entamoeba invadens
LIEKCWKQKAEERPTFL

SEQ ID NO: 2797775 - protein, 17 aa, Entamoeba invadens
LIELRFVHKKGTYTSFQ

SEQ ID NO: 2797776 - protein, 21 aa, Entamoeba invadens
LIETVVAWGILPGLEKVKTLP

SEQ ID NO: 2797777 - protein, 20 aa, Entamoeba invadens
LIFACLFSSILSIILPIVFP

SEQ ID NO: 2797778 - protein, 29 aa, Entamoeba invadens
LIFFACVFIATSIGIRFIIRKKQLKTMKL

SEQ ID NO: 2797779 - protein, 34 aa, Entamoeba invadens
LIFHYLKPKFISVIYCPMLIFFLAITAHSQCQKL

SEQ ID NO: 2797780 - protein, 23 aa, Entamoeba invadens
LIFSIAVICFFGFREVDILHSIQ

SEQ ID NO: 2797781 - protein, 18 aa, Entamoeba invadens
LIFWRTYPPAIIGISLLL

SEQ ID NO: 2797782 - protein, 24 aa, Entamoeba invadens
LIGENLLRFVAHLYYPITGKYLND

SEQ ID NO: 2797783 - protein, 23 aa, Entamoeba invadens
LIGETCVLPSLGYYLFDGKTNEC

SEQ ID NO: 2797784 - protein, 17 aa, Entamoeba invadens
LIGFLMLKIHYTDPHSK

SEQ ID NO: 2797785 - protein, 27 aa, Entamoeba invadens
LIGGFLILLPFCCFIYKFKWTLDTNQV

SEQ ID NO: 2797786 - protein, 21 aa, Entamoeba invadens
LIGICAGSIPLNILEGDWTVS

SEQ ID NO: 2797787 - protein, 36 aa, Entamoeba invadens
LIGSVMLCLNVTPLIERLLLYLLYFWDRAGLPMAIK

SEQ ID NO: 2797788 - protein, 36 aa, Entamoeba invadens
LIHANYYFAKFFRSMLYWWRIGKIAEMIENYMNQLA

SEQ ID NO: 2797789 - protein, 17 aa, Entamoeba invadens
LIHPFVWQHILIPILPP

SEQ ID NO: 2797790 - protein, 24 aa, Entamoeba invadens
LIHSIPPCFLTFIKFIQSLTALPA

SEQ ID NO: 2797791 - protein, 18 aa, Entamoeba invadens
LIHWTFTKTSFKSILLSD

SEQ ID NO: 2797792 - protein, 17 aa, Entamoeba invadens
LIIFYKRKNSSSSSFSS

SEQ ID NO: 2797793 - protein, 24 aa, Entamoeba invadens
LIIILLVVWYFKRRRNSTNATHAD

SEQ ID NO: 2797794 - protein, 24 aa, Entamoeba invadens
LIILFCVMMTMTIVLWVAVIVKRK

SEQ ID NO: 2797795 - protein, 18 aa, Entamoeba invadens
LIIMKIMTTKDCRCKLLT

SEQ ID NO: 2797796 - protein, 18 aa, Entamoeba invadens
LIINGCQKLSMAGLSSKS

SEQ ID NO: 2797797 - protein, 17 aa, Entamoeba invadens
LIIPLVILGVIIIVIIL

SEQ ID NO: 2797798 - protein, 27 aa, Entamoeba invadens
LIISIILLCFITRVILRKMSQKSLEKT

SEQ ID NO: 2797799 - protein, 24 aa, Entamoeba invadens
LIIVVSGLLVYFLLIKKKKSEFNQ

SEQ ID NO: 2797800 - protein, 25 aa, Entamoeba invadens
LIKEGGRWKSWKRRFFIFDQKTLSY

SEQ ID NO: 2797801 - protein, 24 aa, Entamoeba invadens
LIKEGKVRLPLCPPLDKTIEPYKE

SEQ ID NO: 2797802 - protein, 21 aa, Entamoeba invadens
LIKILHDFRITISPLGCTDTD

SEQ ID NO: 2797803 - protein, 26 aa, Entamoeba invadens
LILFVLGFFCLITWVVNLMLFNRSQV

SEQ ID NO: 2797804 - protein, 19 aa, Entamoeba invadens
LILILPFIAVIVALIGAFC

SEQ ID NO: 2797805 - protein, 24 aa, Entamoeba invadens
LILKDKMCPVGYSLSANGICYESI

SEQ ID NO: 2797806 - protein, 18 aa, Entamoeba invadens
LILKDSWLPPEEFITEIQ

SEQ ID NO: 2797807 - protein, 18 aa, Entamoeba invadens
LILKLSVADGCLFSVTSV

SEQ ID NO: 2797808 - protein, 18 aa, Entamoeba invadens
LILLPDLFQCCLHFIQYD

SEQ ID NO: 2797809 - protein, 19 aa, Entamoeba invadens
LILVGVIVFFVMKKKKSKS

SEQ ID NO: 2797810 - protein, 23 aa, Entamoeba invadens
LILYGVLFKMDWGTKPQITPQDQ

SEQ ID NO: 2797811 - protein, 22 aa, Entamoeba invadens
LINKEMLVYFLIKTTEKHTINR

SEQ ID NO: 2797812 - protein, 17 aa, Entamoeba invadens
LINKLFVSINFQMWLDP

SEQ ID NO: 2797813 - protein, 23 aa, Entamoeba invadens
LINPAYFASFGIFFSVAFSVLGA

SEQ ID NO: 2797814 - protein, 17 aa, Entamoeba invadens
LINPECEDGLHFNTITQ

SEQ ID NO: 2797815 - protein, 18 aa, Entamoeba invadens
LINPECEDGLHFNTITQE

SEQ ID NO: 2797816 - protein, 17 aa, Entamoeba invadens
LINPECEDGLHFNTVTQ

SEQ ID NO: 2797817 - protein, 24 aa, Entamoeba invadens
LIPEFFYLPDFLKNENLFNFGVNP

SEQ ID NO: 2797818 - protein, 17 aa, Entamoeba invadens
LIPKKCILFSLITILHS

SEQ ID NO: 2797819 - protein, 19 aa, Entamoeba invadens
LIPLMGMTVMSTRLDPDEL

SEQ ID NO: 2797820 - protein, 19 aa, Entamoeba invadens
LIPTMALNSSHEFLSDLEI

SEQ ID NO: 2797821 - protein, 19 aa, Entamoeba invadens
LIQARAWFVNVWKMVDEMV

SEQ ID NO: 2797822 - protein, 23 aa, Entamoeba invadens
LIQTRSICALCHINYFRDADGKC

SEQ ID NO: 2797823 - protein, 17 aa, Entamoeba invadens
LIRFCPNGTPLDKDVVC

SEQ ID NO: 2797824 - protein, 18 aa, Entamoeba invadens
LIRRCGVDIISCHIFDIS

SEQ ID NO: 2797825 - protein, 17 aa, Entamoeba invadens
LIRRPKILLLDEATSAL

SEQ ID NO: 2797826 - protein, 17 aa, Entamoeba invadens
LIRSCGLDESGVTEMCK

SEQ ID NO: 2797827 - protein, 21 aa, Entamoeba invadens
LIRTKGFNTFSDWESLPYGEF

SEQ ID NO: 2797828 - protein, 27 aa, Entamoeba invadens
LIRVEWKSFLFCYLFLLISQLGTLLIP

SEQ ID NO: 2797829 - protein, 20 aa, Entamoeba invadens
LIRYCPTGNVIPVVMCTMIS

SEQ ID NO: 2797830 - protein, 24 aa, Entamoeba invadens
LISAKTCRGPCEEKEGVFVKKLYK

SEQ ID NO: 2797831 - protein, 18 aa, Entamoeba invadens
LISDCFALIPDSAYSVRG

SEQ ID NO: 2797832 - protein, 25 aa, Entamoeba invadens
LISDFRDVYIFADFFATFSAQDLVF

SEQ ID NO: 2797833 - protein, 18 aa, Entamoeba invadens
LISLIILFDYYFYIVKNQ

SEQ ID NO: 2797834 - protein, 31 aa, Entamoeba invadens
LISLKKGFACEFSWYLTPLCTCQIFSSIQIV

SEQ ID NO: 2797835 - protein, 24 aa, Entamoeba invadens
LISLLLYFALRYKKADVSIYKQQQ

SEQ ID NO: 2797836 - protein, 20 aa, Entamoeba invadens
LISPFMYIKTGMSISTISLI

SEQ ID NO: 2797837 - protein, 18 aa, Entamoeba invadens
LISQCWDSNLKIRPSIDD

SEQ ID NO: 2797838 - protein, 21 aa, Entamoeba invadens
LISSFMLKYNVLSYWKKGAIL

SEQ ID NO: 2797839 - protein, 26 aa, Entamoeba invadens
LISVYPELLPVVGDVIQLIRSEGTVF

SEQ ID NO: 2797840 - protein, 23 aa, Entamoeba invadens
LITIGAYVSIVWVFYQLDNNETL

SEQ ID NO: 2797841 - protein, 23 aa, Entamoeba invadens
LITIPVGLLINMIALPLIYSQAP

SEQ ID NO: 2797842 - protein, 17 aa, Entamoeba invadens
LITKCPLLLNSLATTPD

SEQ ID NO: 2797843 - protein, 25 aa, Entamoeba invadens
LITLCGKYLIYRNMVGVSRTPSATG

SEQ ID NO: 2797844 - protein, 30 aa, Entamoeba invadens
LITLFFCYFTSLFLLPRFINTVTREANCNN

SEQ ID NO: 2797845 - protein, 20 aa, Entamoeba invadens
LITLFTRFGHSKVITTFAQE

SEQ ID NO: 2797846 - protein, 19 aa, Entamoeba invadens
LITNCKKVGDSKCTKCSFW

SEQ ID NO: 2797847 - protein, 18 aa, Entamoeba invadens
LITPFQWQHVFIPVLPVS

SEQ ID NO: 2797848 - protein, 18 aa, Entamoeba invadens
LITRGYCTETILPLLIDI

SEQ ID NO: 2797849 - protein, 20 aa, Entamoeba invadens
LIVFFWFVEKKLQKHRLTTV

SEQ ID NO: 2797850 - protein, 21 aa, Entamoeba invadens
LIVIACVQWSFVIVNKDEVKD

SEQ ID NO: 2797851 - protein, 18 aa, Entamoeba invadens
LIVKSLLVVLFFAIVFLV

SEQ ID NO: 2797852 - protein, 18 aa, Entamoeba invadens
LIVLKIFKFWKSYLDLSS

SEQ ID NO: 2797853 - protein, 17 aa, Entamoeba invadens
LIVPLVIVAIIIIIVLL

SEQ ID NO: 2797854 - protein, 19 aa, Entamoeba invadens
LIWPVIVVMCITKKSLEEK

SEQ ID NO: 2797855 - protein, 18 aa, Entamoeba invadens
LIYDVTLFIPIFAQSVMI

SEQ ID NO: 2797856 - protein, 18 aa, Entamoeba invadens
LIYGCKECFNVLKNDSLH

SEQ ID NO: 2797857 - protein, 18 aa, Entamoeba invadens
LIYKEAFLPMFSSFLPLD

SEQ ID NO: 2797858 - protein, 19 aa, Entamoeba invadens
LIYQFFVRISDSFGNLENV

SEQ ID NO: 2797859 - protein, 19 aa, Entamoeba invadens
LKAEGQFQITIEHLDTSIP

SEQ ID NO: 2797860 - protein, 25 aa, Entamoeba invadens
LKAIEKYKPTILFSTPRVFEKLNRI

SEQ ID NO: 2797861 - protein, 18 aa, Entamoeba invadens
LKALCYVNEKYMYMSKGG

SEQ ID NO: 2797862 - protein, 24 aa, Entamoeba invadens
LKANTKPRLEGHWKEVKLDSEYKG

SEQ ID NO: 2797863 - protein, 21 aa, Entamoeba invadens
LKARICQDITTALSILHTHNF

SEQ ID NO: 2797864 - protein, 19 aa, Entamoeba invadens
LKCAESTYRTPSYDKCSNQ

SEQ ID NO: 2797865 - protein, 17 aa, Entamoeba invadens
LKCDVGYILSSNECVKT

SEQ ID NO: 2797866 - protein, 17 aa, Entamoeba invadens
LKCDVNFFLSQNKCFSS

SEQ ID NO: 2797867 - protein, 19 aa, Entamoeba invadens
LKCETCKIGYYINNFSCIS

SEQ ID NO: 2797868 - protein, 21 aa, Entamoeba invadens
LKCGHIFCEECIFKWLVQQPR

SEQ ID NO: 2797869 - protein, 18 aa, Entamoeba invadens
LKCIPCENNCVYCANKTF

SEQ ID NO: 2797870 - protein, 17 aa, Entamoeba invadens
LKCIPCNTFNINCSICD

SEQ ID NO: 2797871 - protein, 23 aa, Entamoeba invadens
LKCKEGKSLLDGKCVNITNNCLV

SEQ ID NO: 2797872 - protein, 18 aa, Entamoeba invadens
LKCLFPKECPTGGVNPLT

SEQ ID NO: 2797873 - protein, 21 aa, Entamoeba invadens
LKCNSKTRLVKGCQRLNIDCV

SEQ ID NO: 2797874 - protein, 22 aa, Entamoeba invadens
LKCNSQTRLLNGICLNITSNCQ

SEQ ID NO: 2797875 - protein, 18 aa, Entamoeba invadens
LKCPLLVLSFCIFSIVSF

SEQ ID NO: 2797876 - protein, 22 aa, Entamoeba invadens
LKCSEGFYVSNGHCELCPENCV

SEQ ID NO: 2797877 - protein, 20 aa, Entamoeba invadens
LKCSENFYLYDDGSCIANSN

SEQ ID NO: 2797878 - protein, 19 aa, Entamoeba invadens
LKCSEYIEGCSLCVSELFC

SEQ ID NO: 2797879 - protein, 20 aa, Entamoeba invadens
LKCSHDFVYNRSFEILENGG

SEQ ID NO: 2797880 - protein, 21 aa, Entamoeba invadens
LKCTQVFTVFVGQSIKSFDVS

SEQ ID NO: 2797881 - protein, 20 aa, Entamoeba invadens
LKCVGSFVYFYECNAPRITQ

SEQ ID NO: 2797882 - protein, 19 aa, Entamoeba invadens
LKCVSECKTLGYYKKDDSN

SEQ ID NO: 2797883 - protein, 18 aa, Entamoeba invadens
LKDCVKLTKLHLGNVITF

SEQ ID NO: 2797884 - protein, 19 aa, Entamoeba invadens
LKDEFEVMKIGLWICEGNN

SEQ ID NO: 2797885 - protein, 18 aa, Entamoeba invadens
LKDEYSICFVAMVNAYLL

SEQ ID NO: 2797886 - protein, 20 aa, Entamoeba invadens
LKDGECLQCPNEGKEKCYKC

SEQ ID NO: 2797887 - protein, 21 aa, Entamoeba invadens
LKDGSCHLCKNDSYLSSGNCE

SEQ ID NO: 2797888 - protein, 20 aa, Entamoeba invadens
LKDKCKIALPSGGGCAICKT

SEQ ID NO: 2797889 - protein, 19 aa, Entamoeba invadens
LKDKIVWDVNFESRGATAT

SEQ ID NO: 2797890 - protein, 20 aa, Entamoeba invadens
LKDPKAFKIKVIITGFIGTQ

SEQ ID NO: 2797891 - protein, 18 aa, Entamoeba invadens
LKDRFVDIPHHYDNINRF

SEQ ID NO: 2797892 - protein, 21 aa, Entamoeba invadens
LKDVVFYDSEIEGFTYIEGSM

SEQ ID NO: 2797893 - protein, 27 aa, Entamoeba invadens
LKDWDLWGPMFVCYLLALLLSINSMIA

SEQ ID NO: 2797894 - protein, 22 aa, Entamoeba invadens
LKEADVGLAMGIRGTDVAKQAS

SEQ ID NO: 2797895 - protein, 24 aa, Entamoeba invadens
LKEELDMTIIEWLRLQDYRLPPST

SEQ ID NO: 2797896 - protein, 21 aa, Entamoeba invadens
LKEFKCSKDFVFDRNVSQTAN

SEQ ID NO: 2797897 - protein, 32 aa, Entamoeba invadens
LKEHIFDFLPLESLLSLSLCCKTLKLQILSNT

SEQ ID NO: 2797898 - protein, 23 aa, Entamoeba invadens
LKEIDWKTSFFPLTNFTKTLSFL

SEQ ID NO: 2797899 - protein, 18 aa, Entamoeba invadens
LKEKCPTEKMLARDAYFG

SEQ ID NO: 2797900 - protein, 17 aa, Entamoeba invadens
LKEKFSIPSSILLNEII

SEQ ID NO: 2797901 - protein, 24 aa, Entamoeba invadens
LKELISSIFLPWFNTMKYLQQSFK

SEQ ID NO: 2797902 - protein, 20 aa, Entamoeba invadens
LKENLLLQLIDVCSYTNLVN

SEQ ID NO: 2797903 - protein, 21 aa, Entamoeba invadens
LKEPMGVCANMFISFLNNKDI

SEQ ID NO: 2797904 - protein, 20 aa, Entamoeba invadens
LKESRELLCVGNYSQTPVIL

SEQ ID NO: 2797905 - protein, 20 aa, Entamoeba invadens
LKETRQLLCIGNTKERTLKV

SEQ ID NO: 2797906 - protein, 22 aa, Entamoeba invadens
LKEVKIRFIINMVKIAHMISYV

SEQ ID NO: 2797907 - protein, 21 aa, Entamoeba invadens
LKEYNIKWLREQIGIVMQEPS

SEQ ID NO: 2797908 - protein, 17 aa, Entamoeba invadens
LKFFLVYVWSKRNRDQN

SEQ ID NO: 2797909 - protein, 20 aa, Entamoeba invadens
LKFFPTPLFYAFVPATFLSD

SEQ ID NO: 2797910 - protein, 25 aa, Entamoeba invadens
LKFKSFPPNMLIVGGGTRVSYSQYN

SEQ ID NO: 2797911 - protein, 22 aa, Entamoeba invadens
LKFMKYTGCTSVVGRFTAGTFT

SEQ ID NO: 2797912 - protein, 20 aa, Entamoeba invadens
LKFSGSSSYTMAGCLQSNNN

SEQ ID NO: 2797913 - protein, 20 aa, Entamoeba invadens
LKFTKSINHLTQFKEVNESV

SEQ ID NO: 2797914 - protein, 21 aa, Entamoeba invadens
LKGDHCKLCDPKVDGDKCDPA

SEQ ID NO: 2797915 - protein, 38 aa, Entamoeba invadens
LKGDMFLVEVVGSYLIFYFVVCIWVFVAHHKLTKDIKQ

SEQ ID NO: 2797916 - protein, 20 aa, Entamoeba invadens
LKGDRLPILSTFPQEMGDLI

SEQ ID NO: 2797917 - protein, 26 aa, Entamoeba invadens
LKGEGLRKVAACGGFVVTDMPDGSIV

SEQ ID NO: 2797918 - protein, 18 aa, Entamoeba invadens
LKGFYRGNVVALKKLKQR

SEQ ID NO: 2797919 - protein, 17 aa, Entamoeba invadens
LKGGVCKESFEDEVPVV

SEQ ID NO: 2797920 - protein, 18 aa, Entamoeba invadens
LKGIECIQCHESCASCTS

SEQ ID NO: 2797921 - protein, 20 aa, Entamoeba invadens
LKGKAIEFELFLKPLCSCQI

SEQ ID NO: 2797922 - protein, 35 aa, Entamoeba invadens
LKGMLRRAITNKIFLCVIIIVFLVIIGLVIYFGFF

SEQ ID NO: 2797923 - protein, 26 aa, Entamoeba invadens
LKGMYEYRHILCIIQSLKRVLNLNPQ

SEQ ID NO: 2797924 - protein, 19 aa, Entamoeba invadens
LKGNFPFQKGFMYSLDVDN

SEQ ID NO: 2797925 - protein, 21 aa, Entamoeba invadens
LKGNVALLIHIFSVVKIEIKK

SEQ ID NO: 2797926 - protein, 17 aa, Entamoeba invadens
LKGSVQFENIVFPQTKY

SEQ ID NO: 2797927 - protein, 21 aa, Entamoeba invadens
LKHGTCSLCGNGQLDKGEECE

SEQ ID NO: 2797928 - protein, 18 aa, Entamoeba invadens
LKHQNFVFVFSLGLACVS

SEQ ID NO: 2797929 - protein, 24 aa, Entamoeba invadens
LKHVWKEFMETYFVRTEITLDLDE

SEQ ID NO: 2797930 - protein, 17 aa, Entamoeba invadens
LKICVYLLICFGITYTL

SEQ ID NO: 2797931 - protein, 17 aa, Entamoeba invadens
LKIDCNQIIPADIVPLV

SEQ ID NO: 2797932 - protein, 18 aa, Entamoeba invadens
LKIFSNMCIILNCYGGLW

SEQ ID NO: 2797933 - protein, 17 aa, Entamoeba invadens
LKIGFVKQSMEIEIANE

SEQ ID NO: 2797934 - protein, 19 aa, Entamoeba invadens
LKIKFMVDAAKGLSYLHTN

SEQ ID NO: 2797935 - protein, 18 aa, Entamoeba invadens
LKILRSRMCILPQEATMF

SEQ ID NO: 2797936 - protein, 18 aa, Entamoeba invadens
LKIMYDAAKGIEYLHMNN

SEQ ID NO: 2797937 - protein, 23 aa, Entamoeba invadens
LKIQFSVIEGCDFYEIRTEPKLV

SEQ ID NO: 2797938 - protein, 35 aa, Entamoeba invadens
LKIVTIIKRYTWFHFGSLLFTFLVIILYLFIQQAI

SEQ ID NO: 2797939 - protein, 23 aa, Entamoeba invadens
LKKAEWWVITLIVIVVLFFIVII

SEQ ID NO: 2797940 - protein, 23 aa, Entamoeba invadens
LKKAKKAGFKWRIQTEKPLFPLF

SEQ ID NO: 2797941 - protein, 18 aa, Entamoeba invadens
LKKALGIEDRVMCFVRNE

SEQ ID NO: 2797942 - protein, 21 aa, Entamoeba invadens
LKKEPNDLISFGNKGLENSND

SEQ ID NO: 2797943 - protein, 20 aa, Entamoeba invadens
LKKGCARVFNIPCEFSSERS

SEQ ID NO: 2797944 - protein, 19 aa, Entamoeba invadens
LKKGDLVWQVAFGSGLKCN

SEQ ID NO: 2797945 - protein, 22 aa, Entamoeba invadens
LKKGEACEFQLNITPNYTSTIK

SEQ ID NO: 2797946 - protein, 19 aa, Entamoeba invadens
LKKGEAFEVEVFLTPLCSC

SEQ ID NO: 2797947 - protein, 22 aa, Entamoeba invadens
LKKGFACEFEIFLTPYFSSNIS

SEQ ID NO: 2797948 - protein, 20 aa, Entamoeba invadens
LKKGFACEFEVFLTPLCTMD

SEQ ID NO: 2797949 - protein, 23 aa, Entamoeba invadens
LKKGFACEFEVFLTPNFSSNISD

SEQ ID NO: 2797950 - protein, 19 aa, Entamoeba invadens
LKKGFVINILSKFNKIEGI

SEQ ID NO: 2797951 - protein, 17 aa, Entamoeba invadens
LKKGMACTFKFFLQPKC

SEQ ID NO: 2797952 - protein, 18 aa, Entamoeba invadens
LKKIFHMKKDIYDIVNDM

SEQ ID NO: 2797953 - protein, 32 aa, Entamoeba invadens
LKKKMAVELVAAISLLHSFHFVYRQLTPLSVL

SEQ ID NO: 2797954 - protein, 21 aa, Entamoeba invadens
LKKLEVFNCDEHIIKHINDLS

SEQ ID NO: 2797955 - protein, 17 aa, Entamoeba invadens
LKKLSMAILTGEVDIYE

SEQ ID NO: 2797956 - protein, 28 aa, Entamoeba invadens
LKKLYLCGWCFCCPRTCPAVTDLICCRI

SEQ ID NO: 2797957 - protein, 18 aa, Entamoeba invadens
LKKMFIMFDEGFMKKWFG

SEQ ID NO: 2797958 - protein, 17 aa, Entamoeba invadens
LKKTCVGKFEMGLSRYV

SEQ ID NO: 2797959 - protein, 20 aa, Entamoeba invadens
LKKVLDCLAPLVTANFVTIV

SEQ ID NO: 2797960 - protein, 22 aa, Entamoeba invadens
LKKVLHHYGAFFVGINAMSFDF

SEQ ID NO: 2797961 - protein, 20 aa, Entamoeba invadens
LKKWKREIKQTVGVENYMKK

SEQ ID NO: 2797962 - protein, 18 aa, Entamoeba invadens
LKLCKFQNKIVCVSPTME

SEQ ID NO: 2797963 - protein, 19 aa, Entamoeba invadens
LKLDLKYLVVRNKCKQAIG

SEQ ID NO: 2797964 - protein, 21 aa, Entamoeba invadens
LKLFIREIKHVCSYASERLYW

SEQ ID NO: 2797965 - protein, 18 aa, Entamoeba invadens
LKLFTNYYEYYVITFLFS

SEQ ID NO: 2797966 - protein, 19 aa, Entamoeba invadens
LKLGEKIVVYKQEWTPEIR

SEQ ID NO: 2797967 - protein, 30 aa, Entamoeba invadens
LKLGNAFGAEEKWQGLSIIFDTFKNGKLDV

SEQ ID NO: 2797968 - protein, 18 aa, Entamoeba invadens
LKLHAQLLVYKPGCGLFL

SEQ ID NO: 2797969 - protein, 19 aa, Entamoeba invadens
LKLIHSVVVSNNFGNDNDK

SEQ ID NO: 2797970 - protein, 18 aa, Entamoeba invadens
LKLINSVSVVCCRVTPQV

SEQ ID NO: 2797971 - protein, 18 aa, Entamoeba invadens
LKLKGFYYTLAMQQFGSV

SEQ ID NO: 2797972 - protein, 18 aa, Entamoeba invadens
LKLLEEFPENEMLVKILS

SEQ ID NO: 2797973 - protein, 33 aa, Entamoeba invadens
LKLMFKGDVSVVEFSLRGKIEMAAETNEKASLT

SEQ ID NO: 2797974 - protein, 23 aa, Entamoeba invadens
LKLNCFKGKFTMLLILASTFIAL

SEQ ID NO: 2797975 - protein, 17 aa, Entamoeba invadens
LKLNKHIPKGLQTDWEA

SEQ ID NO: 2797976 - protein, 18 aa, Entamoeba invadens
LKLPLLLEFHSIFGDGHF

SEQ ID NO: 2797977 - protein, 22 aa, Entamoeba invadens
LKLPTCIPLDTLVTATLIQTPQ

SEQ ID NO: 2797978 - protein, 21 aa, Entamoeba invadens
LKLPYTSFYLFVGIKNGKSLE

SEQ ID NO: 2797979 - protein, 19 aa, Entamoeba invadens
LKLQIKFRFHFLTNIHSNQ

SEQ ID NO: 2797980 - protein, 25 aa, Entamoeba invadens
LKLSNRCLKCSKGYSLVAGSCQKST

SEQ ID NO: 2797981 - protein, 17 aa, Entamoeba invadens
LKLSNVMMKSFSVSPSV

SEQ ID NO: 2797982 - protein, 18 aa, Entamoeba invadens
LKMCDAEEAMEEFGKEVS

SEQ ID NO: 2797983 - protein, 19 aa, Entamoeba invadens
LKMCYISLFAFGIGLSGGY

SEQ ID NO: 2797984 - protein, 19 aa, Entamoeba invadens
LKMFLCQIPGRLINKTLTH

SEQ ID NO: 2797985 - protein, 19 aa, Entamoeba invadens
LKMGKGKIAAQCGHAAVGC

SEQ ID NO: 2797986 - protein, 23 aa, Entamoeba invadens
LKMKIKILCDGARGIQYLHENGI

SEQ ID NO: 2797987 - protein, 17 aa, Entamoeba invadens
LKMKMSIIYSMISTGLF

SEQ ID NO: 2797988 - protein, 20 aa, Entamoeba invadens
LKMLLELSNVLLLESGQMFF

SEQ ID NO: 2797989 - protein, 22 aa, Entamoeba invadens
LKMLVKNASGWSDRQVILQMIN

SEQ ID NO: 2797990 - protein, 17 aa, Entamoeba invadens
LKMQFSVMKGCDYYEIR

SEQ ID NO: 2797991 - protein, 26 aa, Entamoeba invadens
LKNDKRWVFWSIIALVVVFVFYCILT

SEQ ID NO: 2797992 - protein, 23 aa, Entamoeba invadens
LKNEMCVHFSKITHCISSQNSLC

SEQ ID NO: 2797993 - protein, 22 aa, Entamoeba invadens
LKNFPLRTVVWLTCYAPVKFIF

SEQ ID NO: 2797994 - protein, 21 aa, Entamoeba invadens
LKNFTCKKCSPNCVYCASQDV

SEQ ID NO: 2797995 - protein, 18 aa, Entamoeba invadens
LKNIKFVKYNSWEKAMEK

SEQ ID NO: 2797996 - protein, 20 aa, Entamoeba invadens
LKNKFACEFSIYVTPFCTTK

SEQ ID NO: 2797997 - protein, 21 aa, Entamoeba invadens
LKNKILYDIARGMNFLHNNSI

SEQ ID NO: 2797998 - protein, 19 aa, Entamoeba invadens
LKNPFIITFIGAVLNNDNQ

SEQ ID NO: 2797999 - protein, 22 aa, Entamoeba invadens
LKNSGLRFIIRAHQSEEMGIGL

SEQ ID NO: 2798000 - protein, 25 aa, Entamoeba invadens
LKNTMKSSCYNFNYWDSLGNSMLIF

SEQ ID NO: 2798001 - protein, 19 aa, Entamoeba invadens
LKPDMCEICNTTVGYTSDC

SEQ ID NO: 2798002 - protein, 21 aa, Entamoeba invadens
LKPDNLLLFSFSPKVQFAAKI

SEQ ID NO: 2798003 - protein, 20 aa, Entamoeba invadens
LKPDNLLVFCIDQVTTRIVN

SEQ ID NO: 2798004 - protein, 31 aa, Entamoeba invadens
LKPDNVLVFSLNIDDAVCFKVSDFGTAGVIT

SEQ ID NO: 2798005 - protein, 20 aa, Entamoeba invadens
LKPDYACEFEISIKPNFTSK

SEQ ID NO: 2798006 - protein, 18 aa, Entamoeba invadens
LKPFVKKDERVIGMRDIT

SEQ ID NO: 2798007 - protein, 21 aa, Entamoeba invadens
LKPGYACEFEIFIKPLCTCST

SEQ ID NO: 2798008 - protein, 20 aa, Entamoeba invadens
LKPGYACEFEIFIKPLCTCV

SEQ ID NO: 2798009 - protein, 21 aa, Entamoeba invadens
LKPGYACEFEIFIKPLCTCVT

SEQ ID NO: 2798010 - protein, 25 aa, Entamoeba invadens
LKPHFACEFEIFLKPNFSTKIEDTI

SEQ ID NO: 2798011 - protein, 18 aa, Entamoeba invadens
LKPHREIKISAFVSPKCT

SEQ ID NO: 2798012 - protein, 19 aa, Entamoeba invadens
LKPNLKFAKARPTTKTQRP

SEQ ID NO: 2798013 - protein, 17 aa, Entamoeba invadens
LKPSMWYDSEFETKFEV

SEQ ID NO: 2798014 - protein, 19 aa, Entamoeba invadens
LKPSTAIPVTFKIKMLCTT

SEQ ID NO: 2798015 - protein, 20 aa, Entamoeba invadens
LKPSTAIPVTFKIKMLCTTS

SEQ ID NO: 2798016 - protein, 17 aa, Entamoeba invadens
LKPTNILVFSLNMKETV

SEQ ID NO: 2798017 - protein, 18 aa, Entamoeba invadens
LKQFDMFPKVPNNVKIKS

SEQ ID NO: 2798018 - protein, 23 aa, Entamoeba invadens
LKQGHSKFRDMCLEYLNIDVDKV

SEQ ID NO: 2798019 - protein, 17 aa, Entamoeba invadens
LKQHASIQNHEFGLIVK

SEQ ID NO: 2798020 - protein, 19 aa, Entamoeba invadens
LKQKICLDTAKGIKYLHSN

SEQ ID NO: 2798021 - protein, 21 aa, Entamoeba invadens
LKQLFPIQRLFLLPEPIDDLY

SEQ ID NO: 2798022 - protein, 21 aa, Entamoeba invadens
LKQRLVPSFCMEKTEEEICTF

SEQ ID NO: 2798023 - protein, 27 aa, Entamoeba invadens
LKRECFYKPYIESMVIPSSFIIISIVI

SEQ ID NO: 2798024 - protein, 22 aa, Entamoeba invadens
LKRIGIPIIVVAIVIIIISTTM

SEQ ID NO: 2798025 - protein, 25 aa, Entamoeba invadens
LKRNWDMPLTFGFVIAAGVYVLKGG

SEQ ID NO: 2798026 - protein, 43 aa, Entamoeba invadens
LKRRKEKRTPWMLWIFWFCVYAGLCAVIFFALKLFNKRDHTHD

SEQ ID NO: 2798027 - protein, 17 aa, Entamoeba invadens
LKRVDGFNKINSFGGFS

SEQ ID NO: 2798028 - protein, 19 aa, Entamoeba invadens
LKSAPFMHGHIQQVYDRVK

SEQ ID NO: 2798029 - protein, 24 aa, Entamoeba invadens
LKSCILCTSGFVLKNEICMSYTEI

SEQ ID NO: 2798030 - protein, 19 aa, Entamoeba invadens
LKSELKGIELITTEVNLFV

SEQ ID NO: 2798031 - protein, 21 aa, Entamoeba invadens
LKSEVRSSAQFREKYTSVSIP

SEQ ID NO: 2798032 - protein, 24 aa, Entamoeba invadens
LKSGCSNFYCNALSYGKVDVIPKE

SEQ ID NO: 2798033 - protein, 21 aa, Entamoeba invadens
LKSGKCVSCGTAFANCNTCDK

SEQ ID NO: 2798034 - protein, 17 aa, Entamoeba invadens
LKSGMYTMMLAASEVFV

SEQ ID NO: 2798035 - protein, 21 aa, Entamoeba invadens
LKSGYACEFEVFITPHCTMSL

SEQ ID NO: 2798036 - protein, 26 aa, Entamoeba invadens
LKSKYFIKGKAVTVQIFFKPERRSFS

SEQ ID NO: 2798037 - protein, 25 aa, Entamoeba invadens
LKSLSFSCFNLFIEVVPLIVKVLQK

SEQ ID NO: 2798038 - protein, 17 aa, Entamoeba invadens
LKSNFACEFSVFVKPLC

SEQ ID NO: 2798039 - protein, 19 aa, Entamoeba invadens
LKSNNSFRPNEVLKPPVCM

SEQ ID NO: 2798040 - protein, 25 aa, Entamoeba invadens
LKSPFCPFMSYLAACSLVYTECTTN

SEQ ID NO: 2798041 - protein, 24 aa, Entamoeba invadens
LKSRKEVILELLMFFININDIFSA

SEQ ID NO: 2798042 - protein, 35 aa, Entamoeba invadens
LKSSEANFVLAWKKLDFGLGYSVRFINDFDNKNRP

SEQ ID NO: 2798043 - protein, 18 aa, Entamoeba invadens
LKTDKWELTFGLQKAKAV

SEQ ID NO: 2798044 - protein, 18 aa, Entamoeba invadens
LKTDKWELTFGLSKTKAI

SEQ ID NO: 2798045 - protein, 18 aa, Entamoeba invadens
LKTDKWVLNFGLVKEHAK

SEQ ID NO: 2798046 - protein, 29 aa, Entamoeba invadens
LKTEMWWKNVKLWIILGVVVAIIVIAIII

SEQ ID NO: 2798047 - protein, 21 aa, Entamoeba invadens
LKTEPMLLCDVLQMKELKEFH

SEQ ID NO: 2798048 - protein, 19 aa, Entamoeba invadens
LKTFYPEDFVPSFFKTLNT

SEQ ID NO: 2798049 - protein, 18 aa, Entamoeba invadens
LKTGLRIGLYKKIVLYLR

SEQ ID NO: 2798050 - protein, 17 aa, Entamoeba invadens
LKTKFELSQELVKDAHS

SEQ ID NO: 2798051 - protein, 20 aa, Entamoeba invadens
LKTKKIWNFTCNATGNSIIN

SEQ ID NO: 2798052 - protein, 29 aa, Entamoeba invadens
LKTKYRLSVSFPISFVLNFLTIILCLPLL

SEQ ID NO: 2798053 - protein, 20 aa, Entamoeba invadens
LKTKYYLKVDFAMIFHMYYS

SEQ ID NO: 2798054 - protein, 19 aa, Entamoeba invadens
LKTLFLIIETYIFVNTIEE

SEQ ID NO: 2798055 - protein, 21 aa, Entamoeba invadens
LKTMCNFDLLKALAPYHEKLL

SEQ ID NO: 2798056 - protein, 22 aa, Entamoeba invadens
LKTTKCTSCIYTRVLQSNEVCY

SEQ ID NO: 2798057 - protein, 22 aa, Entamoeba invadens
LKTTNRFVLFRVILNNYRHEYI

SEQ ID NO: 2798058 - protein, 17 aa, Entamoeba invadens
LKTVVFEKIEILQIMGS

SEQ ID NO: 2798059 - protein, 17 aa, Entamoeba invadens
LKTWFGRNNAYFGTPDT

SEQ ID NO: 2798060 - protein, 25 aa, Entamoeba invadens
LKVAGVFPAISILFVYMMQHVKNVF

SEQ ID NO: 2798061 - protein, 18 aa, Entamoeba invadens
LKVAPCNIIPKSAKQNGA

SEQ ID NO: 2798062 - protein, 20 aa, Entamoeba invadens
LKVDSVLGCLDRNERDCLFE

SEQ ID NO: 2798063 - protein, 17 aa, Entamoeba invadens
LKVFCLLLQKTFITYTE

SEQ ID NO: 2798064 - protein, 25 aa, Entamoeba invadens
LKVFTRFDFYLVIFSVALAAGPSLS

SEQ ID NO: 2798065 - protein, 17 aa, Entamoeba invadens
LKVGIHFVVFVFSVLSS

SEQ ID NO: 2798066 - protein, 21 aa, Entamoeba invadens
LKVIEDYAFYVSHFTSFDLAN

SEQ ID NO: 2798067 - protein, 22 aa, Entamoeba invadens
LKVKILDDMAVALAYLHQNNII

SEQ ID NO: 2798068 - protein, 22 aa, Entamoeba invadens
LKVKILDDMAVALAYLHQNTII

SEQ ID NO: 2798069 - protein, 17 aa, Entamoeba invadens
LKVKILDDMAVALSYLH

SEQ ID NO: 2798070 - protein, 19 aa, Entamoeba invadens
LKVKKGFCQEVTTYKSTFE

SEQ ID NO: 2798071 - protein, 24 aa, Entamoeba invadens
LKVNIWELKCSKVTLNGITGAVYS

SEQ ID NO: 2798072 - protein, 28 aa, Entamoeba invadens
LKVPKRNILKWAPILSFVGAANNFMPNS

SEQ ID NO: 2798073 - protein, 19 aa, Entamoeba invadens
LKVQFSVIEGCDYYEIRSV

SEQ ID NO: 2798074 - protein, 27 aa, Entamoeba invadens
LKVQFSVMEGCDFYEIQTVPSLVSLKP

SEQ ID NO: 2798075 - protein, 21 aa, Entamoeba invadens
LKVQFSVMEGCDYYEIRSVPP

SEQ ID NO: 2798076 - protein, 23 aa, Entamoeba invadens
LKVQFSVMEGCDYYEIRSVPPLV

SEQ ID NO: 2798077 - protein, 19 aa, Entamoeba invadens
LKVQKWKEDITVKRKRSRM

SEQ ID NO: 2798078 - protein, 20 aa, Entamoeba invadens
LKVSGLRTGKTAPFIKKPKI

SEQ ID NO: 2798079 - protein, 17 aa, Entamoeba invadens
LKVVAFVFPVMVLLFSI

SEQ ID NO: 2798080 - protein, 22 aa, Entamoeba invadens
LKVVEIFLTRKDFPLSVDYSPV

SEQ ID NO: 2798081 - protein, 26 aa, Entamoeba invadens
LKVVKALKRRGEVVAMTGDGVNDAPA

SEQ ID NO: 2798082 - protein, 18 aa, Entamoeba invadens
LKWCKIENTIVCVNTNVG

SEQ ID NO: 2798083 - protein, 22 aa, Entamoeba invadens
LKYAEKYIQIIMGVVVNCPVKV

SEQ ID NO: 2798084 - protein, 18 aa, Entamoeba invadens
LKYDMFGCVRCESGYFLN

SEQ ID NO: 2798085 - protein, 17 aa, Entamoeba invadens
LKYFIEIAKKFKPTILV

SEQ ID NO: 2798086 - protein, 21 aa, Entamoeba invadens
LKYGFACEFEIFLTPYCTMQL

SEQ ID NO: 2798087 - protein, 17 aa, Entamoeba invadens
LKYGKCFSNSEVITNCK

SEQ ID NO: 2798088 - protein, 17 aa, Entamoeba invadens
LKYKIRFDPPVIIIPHG

SEQ ID NO: 2798089 - protein, 17 aa, Entamoeba invadens
LKYKLSKDLPRTEVNGI

SEQ ID NO: 2798090 - protein, 20 aa, Entamoeba invadens
LKYLIPKWIAPNIISIFGLV

SEQ ID NO: 2798091 - protein, 17 aa, Entamoeba invadens
LKYLYKLPNGITEKTAS

SEQ ID NO: 2798092 - protein, 19 aa, Entamoeba invadens
LKYNLCYKCGENCSSCDTN

SEQ ID NO: 2798093 - protein, 22 aa, Entamoeba invadens
LKYNVLSYWKKGAILILNSKEK

SEQ ID NO: 2798094 - protein, 20 aa, Entamoeba invadens
LKYPELDAGINSDIIDDLIQ

SEQ ID NO: 2798095 - protein, 17 aa, Entamoeba invadens
LKYRALVEDCWKQGFEE

SEQ ID NO: 2798096 - protein, 20 aa, Entamoeba invadens
LKYTPPNPFVKWINVTFQII

SEQ ID NO: 2798097 - protein, 17 aa, Entamoeba invadens
LLAAFVLNKSIQKVVQM

SEQ ID NO: 2798098 - protein, 24 aa, Entamoeba invadens
LLAGNLTISYGFLISSLLDEVIEL

SEQ ID NO: 2798099 - protein, 20 aa, Entamoeba invadens
LLALLSWYGEITLRKPNTKA

SEQ ID NO: 2798100 - protein, 24 aa, Entamoeba invadens
LLARLDIPKEWPISASNVPLYFLY

SEQ ID NO: 2798101 - protein, 18 aa, Entamoeba invadens
LLATLLIYSFTKYTGKNR

SEQ ID NO: 2798102 - protein, 19 aa, Entamoeba invadens
LLCDFRDVYIFADVYATFS

SEQ ID NO: 2798103 - protein, 18 aa, Entamoeba invadens
LLCLTNFGSYDWDLVSNP

SEQ ID NO: 2798104 - protein, 18 aa, Entamoeba invadens
LLCQLEFYNEKIKTQYQP

SEQ ID NO: 2798105 - protein, 18 aa, Entamoeba invadens
LLCRYGESHCDIDCECDD

SEQ ID NO: 2798106 - protein, 25 aa, Entamoeba invadens
LLCSPGCINGCLFEYTCLGCTEGYD

SEQ ID NO: 2798107 - protein, 19 aa, Entamoeba invadens
LLCSQQMCKTCDSKNGNCT

SEQ ID NO: 2798108 - protein, 20 aa, Entamoeba invadens
LLCVFWWINPIIGCTYFLTV

SEQ ID NO: 2798109 - protein, 25 aa, Entamoeba invadens
LLDALELFEVLKLPHSRKSVKVEEV

SEQ ID NO: 2798110 - protein, 19 aa, Entamoeba invadens
LLDCLIMTLAFYYASSTRV

SEQ ID NO: 2798111 - protein, 18 aa, Entamoeba invadens
LLDFCYFANAGMLLLLFL

SEQ ID NO: 2798112 - protein, 19 aa, Entamoeba invadens
LLDFCYFTNITLIISLFRG

SEQ ID NO: 2798113 - protein, 23 aa, Entamoeba invadens
LLDGAKWKGLLEEIIVLETQGVI

SEQ ID NO: 2798114 - protein, 22 aa, Entamoeba invadens
LLDLERVLLCVIPKLRLSEEDV

SEQ ID NO: 2798115 - protein, 17 aa, Entamoeba invadens
LLDLKFTDTSIRSPKKK

SEQ ID NO: 2798116 - protein, 17 aa, Entamoeba invadens
LLDLSLNPFSVVDFGIT

SEQ ID NO: 2798117 - protein, 20 aa, Entamoeba invadens
LLDLTYFASIDMIEATSSFS

SEQ ID NO: 2798118 - protein, 19 aa, Entamoeba invadens
LLDQTSLSFRELWDMYSDM

SEQ ID NO: 2798119 - protein, 18 aa, Entamoeba invadens
LLDQVICVSLDIHKGEQY

SEQ ID NO: 2798120 - protein, 32 aa, Entamoeba invadens
LLDYLKRKIPFLVKLGGHWSVVIGYDDVGKPE

SEQ ID NO: 2798121 - protein, 18 aa, Entamoeba invadens
LLEALLLCCSLIFTSTLF

SEQ ID NO: 2798122 - protein, 25 aa, Entamoeba invadens
LLEELMCGKGSIRLIRKMCETTQGE

SEQ ID NO: 2798123 - protein, 19 aa, Entamoeba invadens
LLEKLRSQYIVSFIGVCVD

SEQ ID NO: 2798124 - protein, 24 aa, Entamoeba invadens
LLELKRYKKAKIHCARNALRKYKL

SEQ ID NO: 2798125 - protein, 24 aa, Entamoeba invadens
LLELLKMSCLKGFSKEIEKKLRGY

SEQ ID NO: 2798126 - protein, 22 aa, Entamoeba invadens
LLEMKICVTIFVGFGAWAMITL

SEQ ID NO: 2798127 - protein, 19 aa, Entamoeba invadens
LLENEIKCIGVLKRLNERY

SEQ ID NO: 2798128 - protein, 18 aa, Entamoeba invadens
LLENVFTYNNYCILYTST

SEQ ID NO: 2798129 - protein, 22 aa, Entamoeba invadens
LLERKIKWYFVIKSLITTYFGN

SEQ ID NO: 2798130 - protein, 18 aa, Entamoeba invadens
LLETEFLLDLSLNPFSVV

SEQ ID NO: 2798131 - protein, 17 aa, Entamoeba invadens
LLEVKRRFEGWLEQNEM

SEQ ID NO: 2798132 - protein, 18 aa, Entamoeba invadens
LLEVPFISSMFEKHIILR

SEQ ID NO: 2798133 - protein, 18 aa, Entamoeba invadens
LLFAFSFNLDVVGYLHNK

SEQ ID NO: 2798134 - protein, 18 aa, Entamoeba invadens
LLFFNRGLMYFFMIVSII

SEQ ID NO: 2798135 - protein, 24 aa, Entamoeba invadens
LLFGCSFSPILFDFSFQIAVWTSF

SEQ ID NO: 2798136 - protein, 21 aa, Entamoeba invadens
LLFHFPPIWCIGDMERFKQLN

SEQ ID NO: 2798137 - protein, 20 aa, Entamoeba invadens
LLFILCLIIGGFGFTAYKLG

SEQ ID NO: 2798138 - protein, 23 aa, Entamoeba invadens
LLFIYRMVHFHKYYIYAYTSGIY

SEQ ID NO: 2798139 - protein, 17 aa, Entamoeba invadens
LLFKEWDYWLMYDTTVK

SEQ ID NO: 2798140 - protein, 18 aa, Entamoeba invadens
LLFKFSMKLIFQIMMLVI

SEQ ID NO: 2798141 - protein, 21 aa, Entamoeba invadens
LLFKMPACSHILIQNPPSLPS

SEQ ID NO: 2798142 - protein, 25 aa, Entamoeba invadens
LLFKWRKTPMREWYFEHIYIIVVLF

SEQ ID NO: 2798143 - protein, 17 aa, Entamoeba invadens
LLFLRGAYKTVTTPVGT

SEQ ID NO: 2798144 - protein, 17 aa, Entamoeba invadens
LLFVFFITLGIFKQNNT

SEQ ID NO: 2798145 - protein, 18 aa, Entamoeba invadens
LLGGFSVLVFYTLAATCA

SEQ ID NO: 2798146 - protein, 19 aa, Entamoeba invadens
LLGKLKFSGSSSYTMAGCL

SEQ ID NO: 2798147 - protein, 42 aa, Entamoeba invadens
LLGKSLPQKILLGVLFILHYLFLKEVIPIKFSYNKLTDSKYK

SEQ ID NO: 2798148 - protein, 27 aa, Entamoeba invadens
LLGLRCPEVLMTPIILDLNMYVETCED

SEQ ID NO: 2798149 - protein, 18 aa, Entamoeba invadens
LLGSLFVLMQKYIRMIMN

SEQ ID NO: 2798150 - protein, 18 aa, Entamoeba invadens
LLGYASHCLIAGRESYSS

SEQ ID NO: 2798151 - protein, 25 aa, Entamoeba invadens
LLHKFCSKFSVLENIKFYFVTDLPD

SEQ ID NO: 2798152 - protein, 24 aa, Entamoeba invadens
LLHTRVSKNILWHVENELIPTILS

SEQ ID NO: 2798153 - protein, 22 aa, Entamoeba invadens
LLIAGALTLLIKRFFEGKDSTK

SEQ ID NO: 2798154 - protein, 19 aa, Entamoeba invadens
LLICCIAILFLVVKWRMAK

SEQ ID NO: 2798155 - protein, 19 aa, Entamoeba invadens
LLICSILAALSTWRYTVVN

SEQ ID NO: 2798156 - protein, 33 aa, Entamoeba invadens
LLIFLHKIMNLSFCFVSTTLLGFLILGFGVLGI

SEQ ID NO: 2798157 - protein, 24 aa, Entamoeba invadens
LLIFLRRRYRTTPSFPCECSLCCE

SEQ ID NO: 2798158 - protein, 26 aa, Entamoeba invadens
LLIGCGVAAILVFGVWRKNKKRTPQT

SEQ ID NO: 2798159 - protein, 17 aa, Entamoeba invadens
LLIGVVVFVVIKATNAA

SEQ ID NO: 2798160 - protein, 19 aa, Entamoeba invadens
LLIIGNKIQFIFYMRQTAT

SEQ ID NO: 2798161 - protein, 33 aa, Entamoeba invadens
LLILMKREYLFVGFEEWFKLFGLGEKHLAFLAY

SEQ ID NO: 2798162 - protein, 29 aa, Entamoeba invadens
LLIQCLIKYKEIIAFILTALLFPISLGHP

SEQ ID NO: 2798163 - protein, 17 aa, Entamoeba invadens
LLIQNSWEQDPISRCDI

SEQ ID NO: 2798164 - protein, 17 aa, Entamoeba invadens
LLIRGPSLFKEYFNRPE

SEQ ID NO: 2798165 - protein, 17 aa, Entamoeba invadens
LLISVAQLFGKIVTVSC

SEQ ID NO: 2798166 - protein, 17 aa, Entamoeba invadens
LLKEMALLQKLRGANNQ

SEQ ID NO: 2798167 - protein, 18 aa, Entamoeba invadens
LLKEYKILFKWYDGPLIE

SEQ ID NO: 2798168 - protein, 24 aa, Entamoeba invadens
LLKKCKRTDLAKGYVPATTNEDMD

SEQ ID NO: 2798169 - protein, 33 aa, Entamoeba invadens
LLKKKLDVGTVFACIAYFNCIRVPFMNFGYFIS

SEQ ID NO: 2798170 - protein, 24 aa, Entamoeba invadens
LLKKNCFSSCKFLEEITFKKDVKI

SEQ ID NO: 2798171 - protein, 22 aa, Entamoeba invadens
LLKNKAVSILLSFFDTNDEMES

SEQ ID NO: 2798172 - protein, 17 aa, Entamoeba invadens
LLKNYGLKKQALQLKYK

SEQ ID NO: 2798173 - protein, 20 aa, Entamoeba invadens
LLKVVMCISPLILAGFVALT

SEQ ID NO: 2798174 - protein, 17 aa, Entamoeba invadens
LLLAETAQLVFSNFSVS

SEQ ID NO: 2798175 - protein, 27 aa, Entamoeba invadens
LLLAFPRFFKLQSCVPCSKKCVKYTQK

SEQ ID NO: 2798176 - protein, 19 aa, Entamoeba invadens
LLLCCSLIFTSTLFESAFS

SEQ ID NO: 2798177 - protein, 15 aa, Entamoeba invadens
LLLCRFRSHTRNLSI

SEQ ID NO: 2798178 - protein, 20 aa, Entamoeba invadens
LLLDFKRYLTSDIDDIIDVQ

SEQ ID NO: 2798179 - protein, 21 aa, Entamoeba invadens
LLLDPEWRHIEILKNNKEGMI

SEQ ID NO: 2798180 - protein, 31 aa, Entamoeba invadens
LLLEGLEIPEFFKISDANGFKVVKIKITTNV

SEQ ID NO: 2798181 - protein, 31 aa, Entamoeba invadens
LLLEGLEIPEFFKISDANGFKVVKMKITTNV

SEQ ID NO: 2798182 - protein, 17 aa, Entamoeba invadens
LLLEIWHAGIVIMTAVA

SEQ ID NO: 2798183 - protein, 18 aa, Entamoeba invadens
LLLESFKKLKYQLICCDN

SEQ ID NO: 2798184 - protein, 25 aa, Entamoeba invadens
LLLFIKGFGWKLMGLVFLQTTATCS

SEQ ID NO: 2798185 - protein, 25 aa, Entamoeba invadens
LLLFLISAASSWCLTVMTFSKLNVP

SEQ ID NO: 2798186 - protein, 18 aa, Entamoeba invadens
LLLIIAISVTVAIPLFII

SEQ ID NO: 2798187 - protein, 28 aa, Entamoeba invadens
LLLLPATKISISFGFLLSDHTLVNTQLL

SEQ ID NO: 2798188 - protein, 20 aa, Entamoeba invadens
LLLMCCVVCVKCCCCHTTKR

SEQ ID NO: 2798189 - protein, 23 aa, Entamoeba invadens
LLLNFFRRIVIRRKIIGRVIRFP

SEQ ID NO: 2798190 - protein, 19 aa, Entamoeba invadens
LLLNLPLIIPKSVKFLNRI

SEQ ID NO: 2798191 - protein, 17 aa, Entamoeba invadens
LLLRLVHIFPDTKLRVP

SEQ ID NO: 2798192 - protein, 25 aa, Entamoeba invadens
LLLTFLLDRLNTILLAEYVSTISGS

SEQ ID NO: 2798193 - protein, 17 aa, Entamoeba invadens
LLLTLTTSRWCIVGNKI

SEQ ID NO: 2798194 - protein, 29 aa, Entamoeba invadens
LLLVEMKKRKEIFGELFCYLNLKRYSESN

SEQ ID NO: 2798195 - protein, 24 aa, Entamoeba invadens
LLLWNCLYLHLNYNFPNRINFEIV

SEQ ID NO: 2798196 - protein, 21 aa, Entamoeba invadens
LLMDRCEYQTSYNFIDCDQTQ

SEQ ID NO: 2798197 - protein, 32 aa, Entamoeba invadens
LLMFAFGFLCCCLWCVGYCKYKSSTNSNARLF

SEQ ID NO: 2798198 - protein, 27 aa, Entamoeba invadens
LLMGCYAMYCGCVFNEFFGFSIDLFGT

SEQ ID NO: 2798199 - protein, 22 aa, Entamoeba invadens
LLMLFTLVYSFQCSPGCPDGCI

SEQ ID NO: 2798200 - protein, 20 aa, Entamoeba invadens
LLMVCPDVFHGIFSFFTVVT

SEQ ID NO: 2798201 - protein, 18 aa, Entamoeba invadens
LLNCVFLKKFPNGNVTCF

SEQ ID NO: 2798202 - protein, 18 aa, Entamoeba invadens
LLNEIIKLFVSLIGIFVT

SEQ ID NO: 2798203 - protein, 24 aa, Entamoeba invadens
LLNEILKMVMSFVGIAVTHRDTPL

SEQ ID NO: 2798204 - protein, 17 aa, Entamoeba invadens
LLNGRCVVCDSTCKANT

SEQ ID NO: 2798205 - protein, 25 aa, Entamoeba invadens
LLNNEWKSSCDKMKLTFDTSPTPPT

SEQ ID NO: 2798206 - protein, 19 aa, Entamoeba invadens
LLNYKGECGKVFKYPPNNN

SEQ ID NO: 2798207 - protein, 23 aa, Entamoeba invadens
LLPEKWNEIFLIHFKTNNLMKVV

SEQ ID NO: 2798208 - protein, 17 aa, Entamoeba invadens
LLPELIILFCVMMTMTI

SEQ ID NO: 2798209 - protein, 24 aa, Entamoeba invadens
LLPFCTVATLFLVYLVFHGHDKFI

SEQ ID NO: 2798210 - protein, 17 aa, Entamoeba invadens
LLPGVLVYFVYLITFTP

SEQ ID NO: 2798211 - protein, 18 aa, Entamoeba invadens
LLPPLSTILACWVSRLTV

SEQ ID NO: 2798212 - protein, 21 aa, Entamoeba invadens
LLQETIKFVVIFLTSFLLHQQ

SEQ ID NO: 2798213 - protein, 27 aa, Entamoeba invadens
LLQKRLLFHIIYKCYIDVIVINAERMC

SEQ ID NO: 2798214 - protein, 24 aa, Entamoeba invadens
LLRARPFPMRSLVKLAQVIILESK

SEQ ID NO: 2798215 - protein, 20 aa, Entamoeba invadens
LLRKFPLNCSERGFYHLRLL

SEQ ID NO: 2798216 - protein, 23 aa, Entamoeba invadens
LLRLDIIYRSPLYNSFQETLLGL

SEQ ID NO: 2798217 - protein, 22 aa, Entamoeba invadens
LLRPRPDVFSDIELLETIAPPP

SEQ ID NO: 2798218 - protein, 19 aa, Entamoeba invadens
LLSACYEKGINVDFVVNRS

SEQ ID NO: 2798219 - protein, 20 aa, Entamoeba invadens
LLSGRCILGSLKHCREYYNS

SEQ ID NO: 2798220 - protein, 18 aa, Entamoeba invadens
LLSIFGVVFLITFHVTER

SEQ ID NO: 2798221 - protein, 20 aa, Entamoeba invadens
LLSKGLKCLGVVRKFGDETV

SEQ ID NO: 2798222 - protein, 25 aa, Entamoeba invadens
LLSKKSGKCSISLVLDKETSVSLRR

SEQ ID NO: 2798223 - protein, 28 aa, Entamoeba invadens
LLSKLGCCYACKCCPNTVPNCLDILNCW

SEQ ID NO: 2798224 - protein, 19 aa, Entamoeba invadens
LLSLVFPALLSFSATYLQN

SEQ ID NO: 2798225 - protein, 26 aa, Entamoeba invadens
LLSNFWRYTVCSLLYNFGAFLFWIVV

SEQ ID NO: 2798226 - protein, 17 aa, Entamoeba invadens
LLSRLLKDIGFNKKMIE

SEQ ID NO: 2798227 - protein, 18 aa, Entamoeba invadens
LLSTGVAVLGVLFIIAVI

SEQ ID NO: 2798228 - protein, 17 aa, Entamoeba invadens
LLSTIGITPPLFRSIMK

SEQ ID NO: 2798229 - protein, 24 aa, Entamoeba invadens
LLSTWFNKLFLHWSSDVRRGFIHL

SEQ ID NO: 2798230 - protein, 18 aa, Entamoeba invadens
LLTALLYYFDITKFVFSY

SEQ ID NO: 2798231 - protein, 20 aa, Entamoeba invadens
LLTEFCPLFSLRKFMKTNSM

SEQ ID NO: 2798232 - protein, 21 aa, Entamoeba invadens
LLTESMKSVFVLLPKDDKSFE

SEQ ID NO: 2798233 - protein, 20 aa, Entamoeba invadens
LLTFALKMFFALPKIRFLLN

SEQ ID NO: 2798234 - protein, 23 aa, Entamoeba invadens
LLTIMGVCLFIGVGSIIAMIFIK

SEQ ID NO: 2798235 - protein, 17 aa, Entamoeba invadens
LLTKYTVNYQFKLNYNN

SEQ ID NO: 2798236 - protein, 18 aa, Entamoeba invadens
LLTLLIYYEFIKKRFCPK

SEQ ID NO: 2798237 - protein, 24 aa, Entamoeba invadens
LLTLTFLSLISFNLSLFLLFLVLF

SEQ ID NO: 2798238 - protein, 26 aa, Entamoeba invadens
LLTQRFQINLTREVMWCSKLLTNHKL

SEQ ID NO: 2798239 - protein, 27 aa, Entamoeba invadens
LLTSFKMEFWFVWKWIVLLFKREFEQP

SEQ ID NO: 2798240 - protein, 20 aa, Entamoeba invadens
LLTTRVGGLGLNLTAADIVI

SEQ ID NO: 2798241 - protein, 20 aa, Entamoeba invadens
LLVDEAKRFMTIYHQPLLLT

SEQ ID NO: 2798242 - protein, 25 aa, Entamoeba invadens
LLVFSSSIQWCWSNDVVTYNENSAS

SEQ ID NO: 2798243 - protein, 25 aa, Entamoeba invadens
LLVHIRKALLLFSVFPMQTLPDAPK

SEQ ID NO: 2798244 - protein, 23 aa, Entamoeba invadens
LLVIFVALISWRIMRQKSSGKNA

SEQ ID NO: 2798245 - protein, 18 aa, Entamoeba invadens
LLVILSMSKTLYVDQTLG

SEQ ID NO: 2798246 - protein, 18 aa, Entamoeba invadens
LLVLEFITLTPFITITWV

SEQ ID NO: 2798247 - protein, 17 aa, Entamoeba invadens
LLVLGVFGTLAILQFLK

SEQ ID NO: 2798248 - protein, 18 aa, Entamoeba invadens
LLVLWSEFAITINYIQLL

SEQ ID NO: 2798249 - protein, 25 aa, Entamoeba invadens
LLVMLPICLITAELSAAVPGCGGMV

SEQ ID NO: 2798250 - protein, 18 aa, Entamoeba invadens
LLVMTFSIGVVYYFSAGE

SEQ ID NO: 2798251 - protein, 18 aa, Entamoeba invadens
LLVNADPFLKVGDKEPRE

SEQ ID NO: 2798252 - protein, 21 aa, Entamoeba invadens
LLVNCSINLISLELEKIGGDS

SEQ ID NO: 2798253 - protein, 25 aa, Entamoeba invadens
LLVNPRFDDDLDMWRVSGTCNVDKS

SEQ ID NO: 2798254 - protein, 27 aa, Entamoeba invadens
LLVQIATVMYFRFSPVLKTSDSYSSFE

SEQ ID NO: 2798255 - protein, 18 aa, Entamoeba invadens
LLVRVSPEFMFHQISLML

SEQ ID NO: 2798256 - protein, 17 aa, Entamoeba invadens
LLVSLSYSLPSLRSSFS

SEQ ID NO: 2798257 - protein, 18 aa, Entamoeba invadens
LLWILWLIFGVAYSYMLH

SEQ ID NO: 2798258 - protein, 17 aa, Entamoeba invadens
LLWKVLDGIPEEYVTNV

SEQ ID NO: 2798259 - protein, 26 aa, Entamoeba invadens
LLWVRHLPIAFLMRQHLFLLNKNEEI

SEQ ID NO: 2798260 - protein, 19 aa, Entamoeba invadens
LLWYYKFIPTDNMFFFIVS

SEQ ID NO: 2798261 - protein, 17 aa, Entamoeba invadens
LLYCLAVLIRRCGVDII

SEQ ID NO: 2798262 - protein, 24 aa, Entamoeba invadens
LLYCRELLVLSAFVLDICMVPTSA

SEQ ID NO: 2798263 - protein, 26 aa, Entamoeba invadens
LLYIACWLIPFIDRLVPLFGDDIQVV

SEQ ID NO: 2798264 - protein, 18 aa, Entamoeba invadens
LLYIYVLGYEVDFGIPII

SEQ ID NO: 2798265 - protein, 19 aa, Entamoeba invadens
LLYKLKKYILFGEVPSGVT

SEQ ID NO: 2798266 - protein, 20 aa, Entamoeba invadens
LLYKNCLNTNLFKMELIGST

SEQ ID NO: 2798267 - protein, 27 aa, Entamoeba invadens
LLYKSELKSGALFKCVGKSELKTRSDV

SEQ ID NO: 2798268 - protein, 19 aa, Entamoeba invadens
LLYMVYNMFCQIKESGRSQ

SEQ ID NO: 2798269 - protein, 34 aa, Entamoeba invadens
LLYNNWFDICLLFACLLFGTLIIDCVISVSMPAY

SEQ ID NO: 2798270 - protein, 17 aa, Entamoeba invadens
LLYRTSAFLALYDEMYF

SEQ ID NO: 2798271 - protein, 19 aa, Entamoeba invadens
LLYYLCVDPSIITPEVQTS

SEQ ID NO: 2798272 - protein, 30 aa, Entamoeba invadens
LMAAPLIWFGFCFLNFVGLKINYLGLSIVC

SEQ ID NO: 2798273 - protein, 19 aa, Entamoeba invadens
LMAILPFFMVIVIGAVVVG

SEQ ID NO: 2798274 - protein, 25 aa, Entamoeba invadens
LMALVCAIPVAMPFFGQAFGWSVSI

SEQ ID NO: 2798275 - protein, 18 aa, Entamoeba invadens
LMCDYKYRLVDGACLPLD

SEQ ID NO: 2798276 - protein, 23 aa, Entamoeba invadens
LMCSAYGSLWAYVATCVSTLSTL

SEQ ID NO: 2798277 - protein, 17 aa, Entamoeba invadens
LMDAIYIKNFRYYFVPT

SEQ ID NO: 2798278 - protein, 17 aa, Entamoeba invadens
LMEGQNLYPVCGEKGQI

SEQ ID NO: 2798279 - protein, 22 aa, Entamoeba invadens
LMELKGTYYGLVKRQSMEEEVD

SEQ ID NO: 2798280 - protein, 18 aa, Entamoeba invadens
LMFDPNNNITCMSAATFI

SEQ ID NO: 2798281 - protein, 18 aa, Entamoeba invadens
LMFLGGLVSSLGYLLTLL

SEQ ID NO: 2798282 - protein, 25 aa, Entamoeba invadens
LMFQSIPTNIVWFAFTTEPQMEIKI

SEQ ID NO: 2798283 - protein, 34 aa, Entamoeba invadens
LMFVVSICYSLLFRKIEVLVFAIVAIIFVRGIFE

SEQ ID NO: 2798284 - protein, 17 aa, Entamoeba invadens
LMFWKNYPPAISAIVIM

SEQ ID NO: 2798285 - protein, 22 aa, Entamoeba invadens
LMFWLCVGVICFANMENPVIVP

SEQ ID NO: 2798286 - protein, 18 aa, Entamoeba invadens
LMGAICAMFGYLMANIHL

SEQ ID NO: 2798287 - protein, 23 aa, Entamoeba invadens
LMGEIFRPQIFVKNGEECSFVLL

SEQ ID NO: 2798288 - protein, 19 aa, Entamoeba invadens
LMGLVAACVVVYIFFPKQW

SEQ ID NO: 2798289 - protein, 26 aa, Entamoeba invadens
LMGLYSMYCGCLFNEFFGFSIDFFGT

SEQ ID NO: 2798290 - protein, 20 aa, Entamoeba invadens
LMILCVAFIGYFVSNLLGVS

SEQ ID NO: 2798291 - protein, 20 aa, Entamoeba invadens
LMINACCGFASAACYGISAG

SEQ ID NO: 2798292 - protein, 21 aa, Entamoeba invadens
LMIRNYMMLILRGGELQKLGV

SEQ ID NO: 2798293 - protein, 25 aa, Entamoeba invadens
LMITKFTRKILHIFYSKTFEKKTLF

SEQ ID NO: 2798294 - protein, 21 aa, Entamoeba invadens
LMKKAAVFILYYVDSSRREEY

SEQ ID NO: 2798295 - protein, 25 aa, Entamoeba invadens
LMKQDCGWHDIHMGGELSSHVMGEI

SEQ ID NO: 2798296 - protein, 20 aa, Entamoeba invadens
LMLDECFEQLNMIPLIITSN

SEQ ID NO: 2798297 - protein, 27 aa, Entamoeba invadens
LMLDKFRSEFIVKFYGAVFVVSKICFV

SEQ ID NO: 2798298 - protein, 25 aa, Entamoeba invadens
LMLELTPLMAFILYLVFILRKDKLE

SEQ ID NO: 2798299 - protein, 17 aa, Entamoeba invadens
LMLIGGSIFSWSSYNRD

SEQ ID NO: 2798300 - protein, 21 aa, Entamoeba invadens
LMLLFPIAVSFGVCLSYYYTT

SEQ ID NO: 2798301 - protein, 18 aa, Entamoeba invadens
LMMIGFCLSFIVPEGKGV

SEQ ID NO: 2798302 - protein, 18 aa, Entamoeba invadens
LMMVTRCSKDDSAIGDES

SEQ ID NO: 2798303 - protein, 21 aa, Entamoeba invadens
LMNVRLFFAAVVFVVSCLADI

SEQ ID NO: 2798304 - protein, 18 aa, Entamoeba invadens
LMPMREGVDAVYLTGGLG

SEQ ID NO: 2798305 - protein, 27 aa, Entamoeba invadens
LMPNLRGCLWCRNGFFKASDGKNCELC

SEQ ID NO: 2798306 - protein, 24 aa, Entamoeba invadens
LMPVCTFFLGFSFIFGDYLRRMWE

SEQ ID NO: 2798307 - protein, 18 aa, Entamoeba invadens
LMQNKDILSRVILKIGEL

SEQ ID NO: 2798308 - protein, 23 aa, Entamoeba invadens
LMQTRSICAICHINYFRDADGKC

SEQ ID NO: 2798309 - protein, 27 aa, Entamoeba invadens
LMSDEYGFNTIVGWGEAGNTLYELMTK

SEQ ID NO: 2798310 - protein, 20 aa, Entamoeba invadens
LMSRCYKVLQTAARYHTELV

SEQ ID NO: 2798311 - protein, 21 aa, Entamoeba invadens
LMTKLIYWISGMSFVPMVLVD

SEQ ID NO: 2798312 - protein, 17 aa, Entamoeba invadens
LMTLKCGYFLAITVIVG

SEQ ID NO: 2798313 - protein, 28 aa, Entamoeba invadens
LMTLKRKVFGAVMMCGKAIPAGEVLDIA

SEQ ID NO: 2798314 - protein, 22 aa, Entamoeba invadens
LMTRLSYIFLYFFIFSYIIILL

SEQ ID NO: 2798315 - protein, 24 aa, Entamoeba invadens
LMTTNVWDDFKWIVESAQKQFSLM

SEQ ID NO: 2798316 - protein, 27 aa, Entamoeba invadens
LMVVTIISFFIGWHLVMAIGGADMPVV

SEQ ID NO: 2798317 - protein, 20 aa, Entamoeba invadens
LMYPFIWQGVLIPFVPVALQ

SEQ ID NO: 2798318 - protein, 23 aa, Entamoeba invadens
LNAELSTGCIVVFIDEYQQGTFF

SEQ ID NO: 2798319 - protein, 21 aa, Entamoeba invadens
LNAGRCVKCANCLKCDKETCH

SEQ ID NO: 2798320 - protein, 18 aa, Entamoeba invadens
LNAKPMLIAIIPRILYDI

SEQ ID NO: 2798321 - protein, 19 aa, Entamoeba invadens
LNCIRRYLIDWDKEIANYQ

SEQ ID NO: 2798322 - protein, 18 aa, Entamoeba invadens
LNCSLDYTRNCVVCKPGY

SEQ ID NO: 2798323 - protein, 17 aa, Entamoeba invadens
LNCSYGATECLRCPQDY

SEQ ID NO: 2798324 - protein, 23 aa, Entamoeba invadens
LNCTSCPVGKYLSQNRCQSNDKL

SEQ ID NO: 2798325 - protein, 25 aa, Entamoeba invadens
LNCTSLVGCSDCLISGPTCTVCKGG

SEQ ID NO: 2798326 - protein, 19 aa, Entamoeba invadens
LNCYECLLNCSICNTKEKC

SEQ ID NO: 2798327 - protein, 19 aa, Entamoeba invadens
LNDFWDFCEVNSFESALKI

SEQ ID NO: 2798328 - protein, 19 aa, Entamoeba invadens
LNDSESWLMLDECFEQLNM

SEQ ID NO: 2798329 - protein, 25 aa, Entamoeba invadens
LNDTLRLLFPFSFATKSKIFMNKNE

SEQ ID NO: 2798330 - protein, 20 aa, Entamoeba invadens
LNEALECYLKAVVFFCNGQE

SEQ ID NO: 2798331 - protein, 18 aa, Entamoeba invadens
LNECLDCPDNTYSSANSS

SEQ ID NO: 2798332 - protein, 21 aa, Entamoeba invadens
LNECTSCLATHILVDSQCVHF

SEQ ID NO: 2798333 - protein, 19 aa, Entamoeba invadens
LNECTYCVATHILVDSQCV

SEQ ID NO: 2798334 - protein, 23 aa, Entamoeba invadens
LNEGLVHICGYCFNGCNNLKRVE

SEQ ID NO: 2798335 - protein, 24 aa, Entamoeba invadens
LNEIKKLINFTGEAFKEITLFRKL

SEQ ID NO: 2798336 - protein, 20 aa, Entamoeba invadens
LNERGEAIIVGYVGDPEGDI

SEQ ID NO: 2798337 - protein, 31 aa, Entamoeba invadens
LNETMRMFLELRAAMMKKKLIPTMALNSSHE

SEQ ID NO: 2798338 - protein, 22 aa, Entamoeba invadens
LNEYKKSAVVVFAIIVTLPVLT

SEQ ID NO: 2798339 - protein, 18 aa, Entamoeba invadens
LNFEAVIKALVKIDEECT

SEQ ID NO: 2798340 - protein, 19 aa, Entamoeba invadens
LNFGPKLPLISLPKLIHSD

SEQ ID NO: 2798341 - protein, 17 aa, Entamoeba invadens
LNFPYLVFDNLKLKDIK

SEQ ID NO: 2798342 - protein, 24 aa, Entamoeba invadens
LNFVYRVGSSFGYIAIIMCVLYIV

SEQ ID NO: 2798343 - protein, 17 aa, Entamoeba invadens
LNGCNLALCTKLFTIYE

SEQ ID NO: 2798344 - protein, 22 aa, Entamoeba invadens
LNGDQCTLCLTKYPHCKTCNSS

SEQ ID NO: 2798345 - protein, 18 aa, Entamoeba invadens
LNGFCSVALEGCVCNETY

SEQ ID NO: 2798346 - protein, 18 aa, Entamoeba invadens
LNGGFGYGGVEKMRKVLQ

SEQ ID NO: 2798347 - protein, 30 aa, Entamoeba invadens
LNGICKQFIPSGGCVKCIDGYYRSGLSCKK

SEQ ID NO: 2798348 - protein, 22 aa, Entamoeba invadens
LNGKCSVFGDKNCERAILDECE

SEQ ID NO: 2798349 - protein, 27 aa, Entamoeba invadens
LNGKLLRIGSFKKIFCHVSDIKYKDNI

SEQ ID NO: 2798350 - protein, 17 aa, Entamoeba invadens
LNGLLPYYTTTRFLQNS

SEQ ID NO: 2798351 - protein, 18 aa, Entamoeba invadens
LNGNCLVPITNCLLHNNK

SEQ ID NO: 2798352 - protein, 22 aa, Entamoeba invadens
LNGQCIRCIDGYYVTNSTCQKC

SEQ ID NO: 2798353 - protein, 20 aa, Entamoeba invadens
LNGTFNYKWMIKSFDLKTAI

SEQ ID NO: 2798354 - protein, 23 aa, Entamoeba invadens
LNGVCTLCGLGTFSNQNSTSCIE

SEQ ID NO: 2798355 - protein, 21 aa, Entamoeba invadens
LNGVWQCIRLNQMVTQATDIE

SEQ ID NO: 2798356 - protein, 18 aa, Entamoeba invadens
LNHLFELSVEIYKDNEVL

SEQ ID NO: 2798357 - protein, 17 aa, Entamoeba invadens
LNHLWEYNKNATRKFDL

SEQ ID NO: 2798358 - protein, 26 aa, Entamoeba invadens
LNIAVLFAQFLVRCVVVYPLHKGMGN

SEQ ID NO: 2798359 - protein, 17 aa, Entamoeba invadens
LNIELFDGSILEQKSNE

SEQ ID NO: 2798360 - protein, 20 aa, Entamoeba invadens
LNIEMGRAIESSDEIGKLWK

SEQ ID NO: 2798361 - protein, 20 aa, Entamoeba invadens
LNIFWLDSFNSMIFNLLSLI

SEQ ID NO: 2798362 - protein, 23 aa, Entamoeba invadens
LNIGDGNLVLCIGKCSRSADRHW

SEQ ID NO: 2798363 - protein, 20 aa, Entamoeba invadens
LNIIFSVGLFGVYFSFLTGF

SEQ ID NO: 2798364 - protein, 19 aa, Entamoeba invadens
LNIIKCLTCPPEQQMQNGL

SEQ ID NO: 2798365 - protein, 19 aa, Entamoeba invadens
LNIISFIFRLFRAKGYKRF

SEQ ID NO: 2798366 - protein, 17 aa, Entamoeba invadens
LNIKGATQVESFINKDI

SEQ ID NO: 2798367 - protein, 17 aa, Entamoeba invadens
LNILLMRLNMIYNSFSN

SEQ ID NO: 2798368 - protein, 18 aa, Entamoeba invadens
LNINANFYFANDINIENP

SEQ ID NO: 2798369 - protein, 19 aa, Entamoeba invadens
LNINFWEFNCRHIKLSEVV

SEQ ID NO: 2798370 - protein, 18 aa, Entamoeba invadens
LNITEFDKPVGYRYNFLE

SEQ ID NO: 2798371 - protein, 18 aa, Entamoeba invadens
LNIVKELSLSSAKATFNL

SEQ ID NO: 2798372 - protein, 24 aa, Entamoeba invadens
LNIWKCCLYGCIYLVLFQILSIIT

SEQ ID NO: 2798373 - protein, 36 aa, Entamoeba invadens
LNIYFPFFCFMAFGFIDFFASLFLPKSINFPKEESL

SEQ ID NO: 2798374 - protein, 22 aa, Entamoeba invadens
LNKCIKCLLMYIRVEKNTDDSQ

SEQ ID NO: 2798375 - protein, 18 aa, Entamoeba invadens
LNKCVKKSMPAYVIVAIV

SEQ ID NO: 2798376 - protein, 25 aa, Entamoeba invadens
LNKIKCAICLSGYVMNREGNCEKCH

SEQ ID NO: 2798377 - protein, 34 aa, Entamoeba invadens
LNKKWGTLGYIVGEVWKGGIDDLLKYYGTSVDDS

SEQ ID NO: 2798378 - protein, 26 aa, Entamoeba invadens
LNKMFLKMTFMRLFSLPYKLSALQQT

SEQ ID NO: 2798379 - protein, 17 aa, Entamoeba invadens
LNKPEKAKCRNADPDDS

SEQ ID NO: 2798380 - protein, 18 aa, Entamoeba invadens
LNKPSVLMWNATYLHLNY

SEQ ID NO: 2798381 - protein, 24 aa, Entamoeba invadens
LNKRKAKLGFLWGYIAIGLGVIAS

SEQ ID NO: 2798382 - protein, 18 aa, Entamoeba invadens
LNKTGACLTCNENYVKSL

SEQ ID NO: 2798383 - protein, 22 aa, Entamoeba invadens
LNKWPDLMTFLLSDITMAKLKA

SEQ ID NO: 2798384 - protein, 20 aa, Entamoeba invadens
LNLFGAFVLSVGEIIVFDSI

SEQ ID NO: 2798385 - protein, 18 aa, Entamoeba invadens
LNLGKIRADLKIVKPNFI

SEQ ID NO: 2798386 - protein, 17 aa, Entamoeba invadens
LNLGMFVFLPFCEITEG

SEQ ID NO: 2798387 - protein, 24 aa, Entamoeba invadens
LNLKSRPGFFLGVNEFVANVTYCV

SEQ ID NO: 2798388 - protein, 18 aa, Entamoeba invadens
LNLKWLREQIGIVKQEPI

SEQ ID NO: 2798389 - protein, 18 aa, Entamoeba invadens
LNLKWLRNQIGLVGQEPV

SEQ ID NO: 2798390 - protein, 24 aa, Entamoeba invadens
LNLLRRILPYLIDFDYVALYTQIV

SEQ ID NO: 2798391 - protein, 17 aa, Entamoeba invadens
LNLPTITKFFLTVLTTS

SEQ ID NO: 2798392 - protein, 17 aa, Entamoeba invadens
LNMFPFSSSTKRMGVIV

SEQ ID NO: 2798393 - protein, 26 aa, Entamoeba invadens
LNNDFTICRFDFIGGKSITFRSFNGY

SEQ ID NO: 2798394 - protein, 22 aa, Entamoeba invadens
LNNFSLLVVQNWLSLGESVNYI

SEQ ID NO: 2798395 - protein, 19 aa, Entamoeba invadens
LNNICFKCQDGYSMVGTKC

SEQ ID NO: 2798396 - protein, 24 aa, Entamoeba invadens
LNNLLKYPFRFACQMDGREIPIPN

SEQ ID NO: 2798397 - protein, 18 aa, Entamoeba invadens
LNNPRIIMWNSTYLHLNY

SEQ ID NO: 2798398 - protein, 19 aa, Entamoeba invadens
LNNPRIIMWNSTYLHLNYN

SEQ ID NO: 2798399 - protein, 24 aa, Entamoeba invadens
LNNRCIQCKPNFYPNSYGKCSSSI

SEQ ID NO: 2798400 - protein, 19 aa, Entamoeba invadens
LNPEAFVLFKVINEDFINN

SEQ ID NO: 2798401 - protein, 23 aa, Entamoeba invadens
LNPISGAKCFDVFSLNNQSNLDI

SEQ ID NO: 2798402 - protein, 23 aa, Entamoeba invadens
LNPRTAICISVKIKMACTASVSD

SEQ ID NO: 2798403 - protein, 25 aa, Entamoeba invadens
LNQEKRYYFCLPIYTLNINNCKRVL

SEQ ID NO: 2798404 - protein, 19 aa, Entamoeba invadens
LNQKCTLCNEKHVLNNESV

SEQ ID NO: 2798405 - protein, 18 aa, Entamoeba invadens
LNQKFQFNVIPFTIKYDA

SEQ ID NO: 2798406 - protein, 17 aa, Entamoeba invadens
LNQKYRVFGIDSNTLSM

SEQ ID NO: 2798407 - protein, 26 aa, Entamoeba invadens
LNQVCEIKTGFVLLKKYLLELPNPLL

SEQ ID NO: 2798408 - protein, 17 aa, Entamoeba invadens
LNQYLPFFILMLSGMVC

SEQ ID NO: 2798409 - protein, 17 aa, Entamoeba invadens
LNRVSKVLFCIMLALSL

SEQ ID NO: 2798410 - protein, 18 aa, Entamoeba invadens
LNSCLACNSTNYKTNDGE

SEQ ID NO: 2798411 - protein, 24 aa, Entamoeba invadens
LNSCYECTKLFLLINNTCVTQSEV

SEQ ID NO: 2798412 - protein, 24 aa, Entamoeba invadens
LNSCYECTKPFLLINNTCVTQSEE

SEQ ID NO: 2798413 - protein, 20 aa, Entamoeba invadens
LNSECLPCSSGTYKSNSGNS

SEQ ID NO: 2798414 - protein, 17 aa, Entamoeba invadens
LNSEKCITCLENRFLQE

SEQ ID NO: 2798415 - protein, 27 aa, Entamoeba invadens
LNSEYKGRFSYSFKLKVMKDVQCGLSY

SEQ ID NO: 2798416 - protein, 17 aa, Entamoeba invadens
LNSGSLYVFVYSSTGST

SEQ ID NO: 2798417 - protein, 21 aa, Entamoeba invadens
LNSKCSKCTFWHSPNITGTLC

SEQ ID NO: 2798418 - protein, 23 aa, Entamoeba invadens
LNSKCSKCTFWYIPNESGTSCTK

SEQ ID NO: 2798419 - protein, 24 aa, Entamoeba invadens
LNSKKIFSLIAMLVTLIRELSGVY

SEQ ID NO: 2798420 - protein, 18 aa, Entamoeba invadens
LNSLGCFIVVGRLGAKSG

SEQ ID NO: 2798421 - protein, 20 aa, Entamoeba invadens
LNSLLPLFAAVFNERKIIVQ

SEQ ID NO: 2798422 - protein, 19 aa, Entamoeba invadens
LNSSHEFLSDLEIFFDGEN

SEQ ID NO: 2798423 - protein, 25 aa, Entamoeba invadens
LNSSKYGCLRCVDTYYFNNSNKRCE

SEQ ID NO: 2798424 - protein, 26 aa, Entamoeba invadens
LNSTMCLSCVDGFFLSDHICKSNDEL

SEQ ID NO: 2798425 - protein, 17 aa, Entamoeba invadens
LNSTYCEDLFLKLTGRK

SEQ ID NO: 2798426 - protein, 18 aa, Entamoeba invadens
LNTELFINFVDNIGKFVN

SEQ ID NO: 2798427 - protein, 24 aa, Entamoeba invadens
LNTELYYHMVFSLFGLIGNFYEKS

SEQ ID NO: 2798428 - protein, 20 aa, Entamoeba invadens
LNTFKKALFVQAQFEQSTPR

SEQ ID NO: 2798429 - protein, 18 aa, Entamoeba invadens
LNTICFSTDFGFGKDIVD

SEQ ID NO: 2798430 - protein, 26 aa, Entamoeba invadens
LNTIKIYTSLCSFIYKTTQTAPDDHI

SEQ ID NO: 2798431 - protein, 30 aa, Entamoeba invadens
LNTKDEFKIVYGLNCGYGLYNKTTQQCEYQ

SEQ ID NO: 2798432 - protein, 22 aa, Entamoeba invadens
LNTSIYGCLICEYGYYIHTNVC

SEQ ID NO: 2798433 - protein, 18 aa, Entamoeba invadens
LNTTLSIDSPCLTDLRAE

SEQ ID NO: 2798434 - protein, 23 aa, Entamoeba invadens
LNVALNYAELCCILSGYYQKPFL

SEQ ID NO: 2798435 - protein, 22 aa, Entamoeba invadens
LNVDFGLKLQVGVGIGVGSLNL

SEQ ID NO: 2798436 - protein, 18 aa, Entamoeba invadens
LNVGPSIPVCIKKGRAVE

SEQ ID NO: 2798437 - protein, 18 aa, Entamoeba invadens
LNVKCVQFTNSVCQQTSK

SEQ ID NO: 2798438 - protein, 25 aa, Entamoeba invadens
LNVLMPQVMSWRDILRYAYDLLLHK

SEQ ID NO: 2798439 - protein, 28 aa, Entamoeba invadens
LNVRLSSMGLMYPRLRIIHSVLNSSDKM

SEQ ID NO: 2798440 - protein, 20 aa, Entamoeba invadens
LNVSLSLEYCCLSGIEKEFC

SEQ ID NO: 2798441 - protein, 18 aa, Entamoeba invadens
LNVYHTMLLHALVYMKHR

SEQ ID NO: 2798442 - protein, 25 aa, Entamoeba invadens
LNWWPMLVSCFSLIAVAAFFMRSIA

SEQ ID NO: 2798443 - protein, 24 aa, Entamoeba invadens
LNYKAGHILYDFSIGIHHYGYCKR

SEQ ID NO: 2798444 - protein, 19 aa, Entamoeba invadens
LNYKDALFSVAMETKNKVP

SEQ ID NO: 2798445 - protein, 17 aa, Entamoeba invadens
LNYKDCPHHSTQYNANT

SEQ ID NO: 2798446 - protein, 25 aa, Entamoeba invadens
LNYKLFKFVFCLQSMFLNNPQKVFW

SEQ ID NO: 2798447 - protein, 26 aa, Entamoeba invadens
LNYKSFKFVFCLQSMFLNNPQKVFWL

SEQ ID NO: 2798448 - protein, 22 aa, Entamoeba invadens
LNYLGICLKKLGVGIEENVVKS

SEQ ID NO: 2798449 - protein, 23 aa, Entamoeba invadens
LNYNFPNRINFEIVNPNGNTYCF

SEQ ID NO: 2798450 - protein, 19 aa, Entamoeba invadens
LNYPDCLHLSKLYDLGLNY

SEQ ID NO: 2798451 - protein, 19 aa, Entamoeba invadens
LNYRMVIGSNYAFDAQTDN

SEQ ID NO: 2798452 - protein, 17 aa, Entamoeba invadens
LNYSGECGEVFKYRPNN

SEQ ID NO: 2798453 - protein, 21 aa, Entamoeba invadens
LPAELFLGCKKLVVVSTTNGL

SEQ ID NO: 2798454 - protein, 17 aa, Entamoeba invadens
LPAISYTPCQVFCSHCN

SEQ ID NO: 2798455 - protein, 20 aa, Entamoeba invadens
LPATAFMMYNWVWLLGTMIY

SEQ ID NO: 2798456 - protein, 20 aa, Entamoeba invadens
LPATLTTLGEDWIKGVTNLK

SEQ ID NO: 2798457 - protein, 35 aa, Entamoeba invadens
LPAVCFDGKCVSKFDKQCALHCNECVDGKCNSCLS

SEQ ID NO: 2798458 - protein, 17 aa, Entamoeba invadens
LPCDTLCAVRCEKTSGN

SEQ ID NO: 2798459 - protein, 30 aa, Entamoeba invadens
LPCPTNCLHCAKGKCVLCDKEYIVDVNRNC

SEQ ID NO: 2798460 - protein, 22 aa, Entamoeba invadens
LPDAHIPLWRYIIFTTAMFCCV

SEQ ID NO: 2798461 - protein, 18 aa, Entamoeba invadens
LPDDVLWNDFLTIYNKTY

SEQ ID NO: 2798462 - protein, 18 aa, Entamoeba invadens
LPEAFYSDSCLRLNAKYC

SEQ ID NO: 2798463 - protein, 18 aa, Entamoeba invadens
LPECMAIYGNELEIIENE

SEQ ID NO: 2798464 - protein, 24 aa, Entamoeba invadens
LPERIVKILLTKVITLLRYPSYDI

SEQ ID NO: 2798465 - protein, 19 aa, Entamoeba invadens
LPEYMCVDLMSFASDVNSI

SEQ ID NO: 2798466 - protein, 20 aa, Entamoeba invadens
LPFAKTVNVVEAWPYTDAGC

SEQ ID NO: 2798467 - protein, 23 aa, Entamoeba invadens
LPFFVQFPMCLFTAEISLSLPSN

SEQ ID NO: 2798468 - protein, 17 aa, Entamoeba invadens
LPFGKIGILSALAIPAL

SEQ ID NO: 2798469 - protein, 17 aa, Entamoeba invadens
LPFILKFIYELLNPPKY

SEQ ID NO: 2798470 - protein, 17 aa, Entamoeba invadens
LPFKYKKSDVHFMPLDE

SEQ ID NO: 2798471 - protein, 29 aa, Entamoeba invadens
LPFSHKVSIPDAWPLTKAACGKFTQEYRS

SEQ ID NO: 2798472 - protein, 18 aa, Entamoeba invadens
LPFTFKWADFTGYMEPGC

SEQ ID NO: 2798473 - protein, 25 aa, Entamoeba invadens
LPFTGLKGISLISVFSLTLNVMIGT

SEQ ID NO: 2798474 - protein, 18 aa, Entamoeba invadens
LPFVKHFALGGGVGGKEL

SEQ ID NO: 2798475 - protein, 17 aa, Entamoeba invadens
LPGAFFIFLVKVNEPIL

SEQ ID NO: 2798476 - protein, 24 aa, Entamoeba invadens
LPGKFRVEKSFNFFRRSQNFPAQL

SEQ ID NO: 2798477 - protein, 17 aa, Entamoeba invadens
LPGLIFTCDAISGEVEE

SEQ ID NO: 2798478 - protein, 17 aa, Entamoeba invadens
LPGLLFVGLVFLLFTTG

SEQ ID NO: 2798479 - protein, 20 aa, Entamoeba invadens
LPGSVCFTAQIQTIPFFTTM

SEQ ID NO: 2798480 - protein, 17 aa, Entamoeba invadens
LPGWLLVRISSVIYIAA

SEQ ID NO: 2798481 - protein, 17 aa, Entamoeba invadens
LPGYVLISPYCLSCESY

SEQ ID NO: 2798482 - protein, 23 aa, Entamoeba invadens
LPHCPCKDCQLFFQENVSNCKNN

SEQ ID NO: 2798483 - protein, 24 aa, Entamoeba invadens
LPHCPCKDCQLFLQENLINCNNND

SEQ ID NO: 2798484 - protein, 28 aa, Entamoeba invadens
LPICLICGALCDLKLDWVKKVAQLLGDN

SEQ ID NO: 2798485 - protein, 22 aa, Entamoeba invadens
LPILKPTRVLFCVANYKNHNIR

SEQ ID NO: 2798486 - protein, 17 aa, Entamoeba invadens
LPILQRIVTEYHTPWGL

SEQ ID NO: 2798487 - protein, 19 aa, Entamoeba invadens
LPIMCIVVILFIIILLITI

SEQ ID NO: 2798488 - protein, 20 aa, Entamoeba invadens
LPIMCIVVILFIIILLKTII

SEQ ID NO: 2798489 - protein, 17 aa, Entamoeba invadens
LPINCIDQKEGTKESEM

SEQ ID NO: 2798490 - protein, 18 aa, Entamoeba invadens
LPIPPSLYPNCKRLAFST

SEQ ID NO: 2798491 - protein, 17 aa, Entamoeba invadens
LPIPTSVPEELSLLIQQ

SEQ ID NO: 2798492 - protein, 18 aa, Entamoeba invadens
LPISCVLFLLLIIIVLII

SEQ ID NO: 2798493 - protein, 18 aa, Entamoeba invadens
LPISMMFDERVDAGAAVA

SEQ ID NO: 2798494 - protein, 18 aa, Entamoeba invadens
LPISTTLFSNCKRIRFTT

SEQ ID NO: 2798495 - protein, 25 aa, Entamoeba invadens
LPITIRRWVGFKTQSDLVVLMLFYV

SEQ ID NO: 2798496 - protein, 18 aa, Entamoeba invadens
LPITYLITSIDDDTVNLV

SEQ ID NO: 2798497 - protein, 20 aa, Entamoeba invadens
LPIVLSRPVRQPILGDQQKL

SEQ ID NO: 2798498 - protein, 18 aa, Entamoeba invadens
LPIYRLPKNKIRKEYPED

SEQ ID NO: 2798499 - protein, 21 aa, Entamoeba invadens
LPKEKYKAIYINSINEKFPSN

SEQ ID NO: 2798500 - protein, 23 aa, Entamoeba invadens
LPKGAVIPAFSFQSAVSKPFSDG

SEQ ID NO: 2798501 - protein, 23 aa, Entamoeba invadens
LPKPSSMPDWVYSIISQSWEQEP

SEQ ID NO: 2798502 - protein, 17 aa, Entamoeba invadens
LPKQVLVIPLVILQALA

SEQ ID NO: 2798503 - protein, 26 aa, Entamoeba invadens
LPKTRAYIVMMIFRIIFGVLAILSSA

SEQ ID NO: 2798504 - protein, 17 aa, Entamoeba invadens
LPLAVTVSLAYSMKQMC

SEQ ID NO: 2798505 - protein, 17 aa, Entamoeba invadens
LPLIAKYLYLIGLNLGE

SEQ ID NO: 2798506 - protein, 21 aa, Entamoeba invadens
LPLIIPKSVKFLNRISMLSIV

SEQ ID NO: 2798507 - protein, 17 aa, Entamoeba invadens
LPLIITRGNNVFGPHQF

SEQ ID NO: 2798508 - protein, 21 aa, Entamoeba invadens
LPLLCARYFIYTKNGWQYFMI

SEQ ID NO: 2798509 - protein, 27 aa, Entamoeba invadens
LPLLIKHLYCLPEHMIINVIGVLCTEI

SEQ ID NO: 2798510 - protein, 17 aa, Entamoeba invadens
LPLNSLLPLFAAVFNER

SEQ ID NO: 2798511 - protein, 18 aa, Entamoeba invadens
LPLQRKFQSWLYHACEVF

SEQ ID NO: 2798512 - protein, 17 aa, Entamoeba invadens
LPLSWAMANVQTTKQSY

SEQ ID NO: 2798513 - protein, 19 aa, Entamoeba invadens
LPLTSGLLCTYLYNDYIMI

SEQ ID NO: 2798514 - protein, 20 aa, Entamoeba invadens
LPLVIALPISLVFVIVLVTI

SEQ ID NO: 2798515 - protein, 22 aa, Entamoeba invadens
LPLYTNSLYKFPLEGNLYNEFD

SEQ ID NO: 2798516 - protein, 25 aa, Entamoeba invadens
LPMVHLIVMLLLWIFPFNRKFQNWV

SEQ ID NO: 2798517 - protein, 26 aa, Entamoeba invadens
LPMVHMICMLVLWLVPMTRRIQNMMF

SEQ ID NO: 2798518 - protein, 20 aa, Entamoeba invadens
LPNCICADGYEVTEERLCRK

SEQ ID NO: 2798519 - protein, 24 aa, Entamoeba invadens
LPNEFLKLLCVVFYVLKKDTKNSF

SEQ ID NO: 2798520 - protein, 22 aa, Entamoeba invadens
LPNNKRDLWLSAIGINSQKYYE

SEQ ID NO: 2798521 - protein, 20 aa, Entamoeba invadens
LPNYLCLVTELAEFGSIQDV

SEQ ID NO: 2798522 - protein, 17 aa, Entamoeba invadens
LPNYYLHEKHCVLCSES

SEQ ID NO: 2798523 - protein, 19 aa, Entamoeba invadens
LPQCSVCVNGAYMQYCKDV

SEQ ID NO: 2798524 - protein, 19 aa, Entamoeba invadens
LPQENIVFPNFVRGDVKMS

SEQ ID NO: 2798525 - protein, 19 aa, Entamoeba invadens
LPQHFEVFQACEKCNKVID

SEQ ID NO: 2798526 - protein, 23 aa, Entamoeba invadens
LPQKFAELVATMWDTDRAERPSA

SEQ ID NO: 2798527 - protein, 20 aa, Entamoeba invadens
LPQLMFYAGMIAVTTILVCF

SEQ ID NO: 2798528 - protein, 20 aa, Entamoeba invadens
LPQNRARHPVWFSENNNTND

SEQ ID NO: 2798529 - protein, 23 aa, Entamoeba invadens
LPQPRGQEGNNHIEVPTEPEKAE

SEQ ID NO: 2798530 - protein, 21 aa, Entamoeba invadens
LPSDCYTLATSIRFPQLNTET

SEQ ID NO: 2798531 - protein, 18 aa, Entamoeba invadens
LPSDIYSLAMIIYTSLNW

SEQ ID NO: 2798532 - protein, 20 aa, Entamoeba invadens
LPSEDGMYCIYTIPLWFIIV

SEQ ID NO: 2798533 - protein, 22 aa, Entamoeba invadens
LPSGELRKSFKKMLQQSTEEID

SEQ ID NO: 2798534 - protein, 17 aa, Entamoeba invadens
LPSPLPHNEIPNIIDTQ

SEQ ID NO: 2798535 - protein, 23 aa, Entamoeba invadens
LPSPLVGCESCISFDSYCKTCDP

SEQ ID NO: 2798536 - protein, 24 aa, Entamoeba invadens
LPSPRKSHKVGISFHDLSRDSVNA

SEQ ID NO: 2798537 - protein, 17 aa, Entamoeba invadens
LPSQITYGVILVKKSVT

SEQ ID NO: 2798538 - protein, 17 aa, Entamoeba invadens
LPTCSNGVMDDYEECDG

SEQ ID NO: 2798539 - protein, 25 aa, Entamoeba invadens
LPTGDRLPMNLSYCGDYVNYNTERV

SEQ ID NO: 2798540 - protein, 17 aa, Entamoeba invadens
LPTGFTLLAEKRLLRYG

SEQ ID NO: 2798541 - protein, 26 aa, Entamoeba invadens
LPTGGGCAICKNGFYKVEKDCLTCDI

SEQ ID NO: 2798542 - protein, 19 aa, Entamoeba invadens
LPTICTYLYSEILSAMNRI

SEQ ID NO: 2798543 - protein, 22 aa, Entamoeba invadens
LPTKMCLVTEFAKFGSLSYLIS

SEQ ID NO: 2798544 - protein, 22 aa, Entamoeba invadens
LPTKPFNCFEMKLSSSDIGDLQ

SEQ ID NO: 2798545 - protein, 24 aa, Entamoeba invadens
LPTMLKVLLSLAVCGGAVAMVTSM

SEQ ID NO: 2798546 - protein, 20 aa, Entamoeba invadens
LPTPEIPILNFLKEKVPDKN

SEQ ID NO: 2798547 - protein, 19 aa, Entamoeba invadens
LPTQFPFLRVEKKFLEKTG

SEQ ID NO: 2798548 - protein, 17 aa, Entamoeba invadens
LPTSVLNIGNFCFFACC

SEQ ID NO: 2798549 - protein, 17 aa, Entamoeba invadens
LPTTCSVTTNTLKESNG

SEQ ID NO: 2798550 - protein, 20 aa, Entamoeba invadens
LPVAMGINIILIGLAIVKFG

SEQ ID NO: 2798551 - protein, 27 aa, Entamoeba invadens
LPVIIITLLVLRLFKKKKTVAFFHPNC

SEQ ID NO: 2798552 - protein, 28 aa, Entamoeba invadens
LPVILGGLRFVCLDVKPEQIVACSCFKA

SEQ ID NO: 2798553 - protein, 18 aa, Entamoeba invadens
LPVKIDVFLEKVKILGER

SEQ ID NO: 2798554 - protein, 24 aa, Entamoeba invadens
LPVKSEGLFNYTLDGVLACGQRVF

SEQ ID NO: 2798555 - protein, 30 aa, Entamoeba invadens
LPVNAFGVSPLFFKICNFLYLHFNFKNENF

SEQ ID NO: 2798556 - protein, 21 aa, Entamoeba invadens
LPVSCIPDNIKIWRYPNFMYD

SEQ ID NO: 2798557 - protein, 17 aa, Entamoeba invadens
LPVVFFLLFVIFIALTL

SEQ ID NO: 2798558 - protein, 20 aa, Entamoeba invadens
LPVVLTLLFLVFLSVVIYTI

SEQ ID NO: 2798559 - protein, 21 aa, Entamoeba invadens
LPVVLTLLFLVFLSVVTYTNF

SEQ ID NO: 2798560 - protein, 17 aa, Entamoeba invadens
LPYGISCKMMTVVSDSF

SEQ ID NO: 2798561 - protein, 25 aa, Entamoeba invadens
LPYIKSFFVGCCFFLLLVGYQTTQN

SEQ ID NO: 2798562 - protein, 25 aa, Entamoeba invadens
LPYKLKLKMLFDASRGMQFLHDNKI

SEQ ID NO: 2798563 - protein, 31 aa, Entamoeba invadens
LPYKLKVKMMFDCARGMAFLHENRIMHLDLK

SEQ ID NO: 2798564 - protein, 20 aa, Entamoeba invadens
LPYNATELISCGDFFTQTDA

SEQ ID NO: 2798565 - protein, 21 aa, Entamoeba invadens
LPYSEVFFFGEVDFKQSLTFP

SEQ ID NO: 2798566 - protein, 19 aa, Entamoeba invadens
LQAFIRLIKKMAINLFSIG

SEQ ID NO: 2798567 - protein, 20 aa, Entamoeba invadens
LQAFSDFYLPLSPEHEISLK

SEQ ID NO: 2798568 - protein, 32 aa, Entamoeba invadens
LQAQGYFGFPVCIPHKLFKCLVFSIEYIGNYY

SEQ ID NO: 2798569 - protein, 26 aa, Entamoeba invadens
LQATAVFRLKTSWDMLPSKTKNIFDE

SEQ ID NO: 2798570 - protein, 24 aa, Entamoeba invadens
LQAVDVRDSFTFTPLSRIDFTCSV

SEQ ID NO: 2798571 - protein, 26 aa, Entamoeba invadens
LQCALLAFLSIRANVIIAKPQKSTKF

SEQ ID NO: 2798572 - protein, 17 aa, Entamoeba invadens
LQCDSHAIISLTTEDKD

SEQ ID NO: 2798573 - protein, 17 aa, Entamoeba invadens
LQCKTGYFFDSNLECAE

SEQ ID NO: 2798574 - protein, 23 aa, Entamoeba invadens
LQDAIKYLTQFLVKYPKVAGGYI

SEQ ID NO: 2798575 - protein, 17 aa, Entamoeba invadens
LQDKCLFIVNGQCVECE

SEQ ID NO: 2798576 - protein, 26 aa, Entamoeba invadens
LQEDFKFSYPIVISKLNNNTSVTTQS

SEQ ID NO: 2798577 - protein, 18 aa, Entamoeba invadens
LQELPAKIIFPVIGVIYI

SEQ ID NO: 2798578 - protein, 17 aa, Entamoeba invadens
LQERVSVALDLANEIRK

SEQ ID NO: 2798579 - protein, 23 aa, Entamoeba invadens
LQFERAVLIGIMFRLDIDTPHTY

SEQ ID NO: 2798580 - protein, 18 aa, Entamoeba invadens
LQFFPKIPPVKFVFTTCV

SEQ ID NO: 2798581 - protein, 18 aa, Entamoeba invadens
LQFMMMFLSIFAVKHKLI

SEQ ID NO: 2798582 - protein, 19 aa, Entamoeba invadens
LQFRCKYLLLLMTFLLAMT

SEQ ID NO: 2798583 - protein, 18 aa, Entamoeba invadens
LQGSLGMGFVATLGHNKR

SEQ ID NO: 2798584 - protein, 19 aa, Entamoeba invadens
LQHLRKKKLPLGFKYLQKK

SEQ ID NO: 2798585 - protein, 26 aa, Entamoeba invadens
LQIFDKFRLLAANSHVTIKETLTSLL

SEQ ID NO: 2798586 - protein, 20 aa, Entamoeba invadens
LQIFPKKWITSLSTVLTPLY

SEQ ID NO: 2798587 - protein, 17 aa, Entamoeba invadens
LQINPRGYLLFSAKCIS

SEQ ID NO: 2798588 - protein, 21 aa, Entamoeba invadens
LQIYSKFIIRRKWGSKTYTTE

SEQ ID NO: 2798589 - protein, 19 aa, Entamoeba invadens
LQKAYFFKTPILVKMYEMF

SEQ ID NO: 2798590 - protein, 18 aa, Entamoeba invadens
LQKELKYVQTIYGNNFSV

SEQ ID NO: 2798591 - protein, 20 aa, Entamoeba invadens
LQKEVAYCLITDIASLYLDN

SEQ ID NO: 2798592 - protein, 20 aa, Entamoeba invadens
LQKHFQRFFIEVSEEITPDL

SEQ ID NO: 2798593 - protein, 23 aa, Entamoeba invadens
LQKHRLTTVTLFKIKYSNLTFVP

SEQ ID NO: 2798594 - protein, 25 aa, Entamoeba invadens
LQKNRTVVLGFYFFIVVILFPIGVW

SEQ ID NO: 2798595 - protein, 19 aa, Entamoeba invadens
LQLADSFPMEKYFKEGCVK

SEQ ID NO: 2798596 - protein, 17 aa, Entamoeba invadens
LQLESFTPPALNSIIVV

SEQ ID NO: 2798597 - protein, 23 aa, Entamoeba invadens
LQLNLWPALVCFFVAVFTFTLVF

SEQ ID NO: 2798598 - protein, 24 aa, Entamoeba invadens
LQLRCRQMMLGFVGCAICNDLYYK

SEQ ID NO: 2798599 - protein, 21 aa, Entamoeba invadens
LQLRFSFYDMDFCKMTADFTF

SEQ ID NO: 2798600 - protein, 17 aa, Entamoeba invadens
LQLVYRQNNSYDITISP

SEQ ID NO: 2798601 - protein, 46 aa, Entamoeba invadens
LQMFLCIYSGILITIWIARIWLEKTFKWFFSVSLVASFIACLCLFV

SEQ ID NO: 2798602 - protein, 17 aa, Entamoeba invadens
LQMLSINVSFTMNASAD

SEQ ID NO: 2798603 - protein, 20 aa, Entamoeba invadens
LQMSIEFVNTVQLYEEFGSA

SEQ ID NO: 2798604 - protein, 24 aa, Entamoeba invadens
LQNGLTCKRCDDSYYFDNDTQRCE

SEQ ID NO: 2798605 - protein, 26 aa, Entamoeba invadens
LQQMCSCAFHIFALVKNDPVWEKCSK

SEQ ID NO: 2798606 - protein, 18 aa, Entamoeba invadens
LQQSLLLALLSWYGEITL

SEQ ID NO: 2798607 - protein, 23 aa, Entamoeba invadens
LQRGWKKILINIGLDIIPFSAFA

SEQ ID NO: 2798608 - protein, 18 aa, Entamoeba invadens
LQRVIARIDLMLDEVDAR

SEQ ID NO: 2798609 - protein, 24 aa, Entamoeba invadens
LQRVLCGSGRQFKNVMAEQITVTT

SEQ ID NO: 2798610 - protein, 26 aa, Entamoeba invadens
LQSCEICRRGTYSYGKKCVECEEMKY

SEQ ID NO: 2798611 - protein, 20 aa, Entamoeba invadens
LQSKICRNRILKWKNGNIQL

SEQ ID NO: 2798612 - protein, 19 aa, Entamoeba invadens
LQSTLKRKDYMCALQTVSF

SEQ ID NO: 2798613 - protein, 18 aa, Entamoeba invadens
LQTFYGICLILIAQFIQA

SEQ ID NO: 2798614 - protein, 23 aa, Entamoeba invadens
LQTKASWVFWEISYTLPKDNELF

SEQ ID NO: 2798615 - protein, 17 aa, Entamoeba invadens
LQTLGLLNNEWKSSCDK

SEQ ID NO: 2798616 - protein, 27 aa, Entamoeba invadens
LQVGYRFTYTMPLAFVVILAMAKDAYD

SEQ ID NO: 2798617 - protein, 17 aa, Entamoeba invadens
LQVLGFVMLTSGLFIYT

SEQ ID NO: 2798618 - protein, 19 aa, Entamoeba invadens
LQYGICVSSQIIDFNKDVE

SEQ ID NO: 2798619 - protein, 23 aa, Entamoeba invadens
LQYSVPFWHVYVGIDTHLGKSLN

SEQ ID NO: 2798620 - protein, 24 aa, Entamoeba invadens
LQYSVPFWHVYVGIDTHLGKSLNY

SEQ ID NO: 2798621 - protein, 19 aa, Entamoeba invadens
LRAKKFAMFLKEVIEETEE

SEQ ID NO: 2798622 - protein, 18 aa, Entamoeba invadens
LRANRLIADVLRVGVFSK

SEQ ID NO: 2798623 - protein, 20 aa, Entamoeba invadens
LRATRPIPVYLQHLKGKGTH

SEQ ID NO: 2798624 - protein, 18 aa, Entamoeba invadens
LRAVDPFNRVHTLLSSKG

SEQ ID NO: 2798625 - protein, 36 aa, Entamoeba invadens
LRAVGLTKWKVITIYIYEAFCITLSSVIFGTLIGIG

SEQ ID NO: 2798626 - protein, 17 aa, Entamoeba invadens
LRAYCTMAEQFLSDKDA

SEQ ID NO: 2798627 - protein, 18 aa, Entamoeba invadens
LRCDTCADGTYADTTGLP

SEQ ID NO: 2798628 - protein, 21 aa, Entamoeba invadens
LRCEFCSLRYDFDAQKHSFTF

SEQ ID NO: 2798629 - protein, 22 aa, Entamoeba invadens
LRCGCRVCYNWFLTKWTNAIDD

SEQ ID NO: 2798630 - protein, 17 aa, Entamoeba invadens
LRCGGGMGTRVVVQAHP

SEQ ID NO: 2798631 - protein, 17 aa, Entamoeba invadens
LRCHVCGDTCVECAPNY

SEQ ID NO: 2798632 - protein, 17 aa, Entamoeba invadens
LRCKSGTNTTLYNELCS

SEQ ID NO: 2798633 - protein, 18 aa, Entamoeba invadens
LRCSPKHKECTTCSPPFE

SEQ ID NO: 2798634 - protein, 19 aa, Entamoeba invadens
LRCSRGFKLVDGVCLSCSK

SEQ ID NO: 2798635 - protein, 18 aa, Entamoeba invadens
LRCSSKHYLNDGICYSCS

SEQ ID NO: 2798636 - protein, 17 aa, Entamoeba invadens
LRCTEAIYMPIPQSYTF

SEQ ID NO: 2798637 - protein, 17 aa, Entamoeba invadens
LRDELRRSIPEVTMLLL

SEQ ID NO: 2798638 - protein, 18 aa, Entamoeba invadens
LRDFDFLFQKDCPKRLEF

SEQ ID NO: 2798639 - protein, 22 aa, Entamoeba invadens
LRDMPIDGFAYYKGGYKTFKPN

SEQ ID NO: 2798640 - protein, 23 aa, Entamoeba invadens
LRDVTTCKNCLPNTGTVLKDGVC

SEQ ID NO: 2798641 - protein, 19 aa, Entamoeba invadens
LRDYQIYKIVYGMVNALSY

SEQ ID NO: 2798642 - protein, 26 aa, Entamoeba invadens
LREDLKIILRNCWKTHDERWDMEQLM

SEQ ID NO: 2798643 - protein, 17 aa, Entamoeba invadens
LREGGKWFKDDNGKSCK

SEQ ID NO: 2798644 - protein, 20 aa, Entamoeba invadens
LREKYGKGIVLKGDKNADND

SEQ ID NO: 2798645 - protein, 23 aa, Entamoeba invadens
LRELKIHAVLSIGVKPLYNSKKV

SEQ ID NO: 2798646 - protein, 19 aa, Entamoeba invadens
LREVTFPSGVVIKSLCSVI

SEQ ID NO: 2798647 - protein, 17 aa, Entamoeba invadens
LREVTFPSQIVLKSSCA

SEQ ID NO: 2798648 - protein, 17 aa, Entamoeba invadens
LRFKSGVKLNIAGKSLI

SEQ ID NO: 2798649 - protein, 17 aa, Entamoeba invadens
LRFLGVCGIEDRLQDGV

SEQ ID NO: 2798650 - protein, 17 aa, Entamoeba invadens
LRFPHFEQPECVCIVGK

SEQ ID NO: 2798651 - protein, 17 aa, Entamoeba invadens
LRFVGKDGTGRSVQTVV

SEQ ID NO: 2798652 - protein, 22 aa, Entamoeba invadens
LRFVPFLVTVLYSYTLAEKETA

SEQ ID NO: 2798653 - protein, 19 aa, Entamoeba invadens
LRGILDFFIVQQMRDQTLT

SEQ ID NO: 2798654 - protein, 20 aa, Entamoeba invadens
LRGLSPVTMTLIFTEEQGKN

SEQ ID NO: 2798655 - protein, 18 aa, Entamoeba invadens
LRGSEGCGVNCYCASGYK

SEQ ID NO: 2798656 - protein, 19 aa, Entamoeba invadens
LRGTLKRILFEEASGRSRN

SEQ ID NO: 2798657 - protein, 21 aa, Entamoeba invadens
LRIAPEKHPVLLTEAPMNPKA

SEQ ID NO: 2798658 - protein, 19 aa, Entamoeba invadens
LRIDPNIVILKKGVACEFS

SEQ ID NO: 2798659 - protein, 19 aa, Entamoeba invadens
LRIKFMYDAAKGILYLHNN

SEQ ID NO: 2798660 - protein, 21 aa, Entamoeba invadens
LRIKYYATWKLTEGFGQISAC

SEQ ID NO: 2798661 - protein, 30 aa, Entamoeba invadens
LRIRIQLYKAFYKFAAVYIRAYKMSPDKAK

SEQ ID NO: 2798662 - protein, 17 aa, Entamoeba invadens
LRITISFLVSLLEACTV

SEQ ID NO: 2798663 - protein, 21 aa, Entamoeba invadens
LRIVLVVDLFVPVSELFWTGN

SEQ ID NO: 2798664 - protein, 18 aa, Entamoeba invadens
LRKCGIPVYYSIGNHDLW

SEQ ID NO: 2798665 - protein, 17 aa, Entamoeba invadens
LRKCYECQSGYYPSSST

SEQ ID NO: 2798666 - protein, 22 aa, Entamoeba invadens
LRKDKLEVGTVFATICYFNCIR

SEQ ID NO: 2798667 - protein, 25 aa, Entamoeba invadens
LRKEKEIYQMFGFSSLKKRMNTLVW

SEQ ID NO: 2798668 - protein, 21 aa, Entamoeba invadens
LRKEKYKIAADVYSFAVTMFN

SEQ ID NO: 2798669 - protein, 21 aa, Entamoeba invadens
LRKEWYVVVLAFVGWFLAFFV

SEQ ID NO: 2798670 - protein, 17 aa, Entamoeba invadens
LRKIHLYIHSLYKTTHF

SEQ ID NO: 2798671 - protein, 19 aa, Entamoeba invadens
LRKIPYQQFSHTWDVADFV

SEQ ID NO: 2798672 - protein, 19 aa, Entamoeba invadens
LRKKLSGKQQCFWGKMSSV

SEQ ID NO: 2798673 - protein, 24 aa, Entamoeba invadens
LRKNRGECALVLLSYNIDNLTETI

SEQ ID NO: 2798674 - protein, 17 aa, Entamoeba invadens
LRKNSLLVKSFYDVAEN

SEQ ID NO: 2798675 - protein, 21 aa, Entamoeba invadens
LRKSIKNVIDFSRRKWFCFVF

SEQ ID NO: 2798676 - protein, 20 aa, Entamoeba invadens
LRKSYITGVVIVIDIIMNLI

SEQ ID NO: 2798677 - protein, 19 aa, Entamoeba invadens
LRKYCYCRRHVVSNKSDCL

SEQ ID NO: 2798678 - protein, 21 aa, Entamoeba invadens
LRLIAQRYGKKVIIGSTNILR

SEQ ID NO: 2798679 - protein, 17 aa, Entamoeba invadens
LRLILQFVTSVTLNVES

SEQ ID NO: 2798680 - protein, 17 aa, Entamoeba invadens
LRLKFLLDGAKGIQYLH

SEQ ID NO: 2798681 - protein, 17 aa, Entamoeba invadens
LRLKMMLDASKGILYLH

SEQ ID NO: 2798682 - protein, 20 aa, Entamoeba invadens
LRLKYMLDVSKGIMYLHENG

SEQ ID NO: 2798683 - protein, 20 aa, Entamoeba invadens
LRLLNVSSMYLLKANELQPL

SEQ ID NO: 2798684 - protein, 20 aa, Entamoeba invadens
LRLNLSFSSLLPVFYIAVEV

SEQ ID NO: 2798685 - protein, 19 aa, Entamoeba invadens
LRLQIFGYGLDEYVKLAKW

SEQ ID NO: 2798686 - protein, 22 aa, Entamoeba invadens
LRLRSLTILKLFLDDICLQNVP

SEQ ID NO: 2798687 - protein, 22 aa, Entamoeba invadens
LRMLKDCASGMVYLHHCKPPII

SEQ ID NO: 2798688 - protein, 31 aa, Entamoeba invadens
LRMLLFGLSEGVGYFILKFCFFVVSERQGIK

SEQ ID NO: 2798689 - protein, 23 aa, Entamoeba invadens
LRMPSERECIFQTKFRSINCGLL

SEQ ID NO: 2798690 - protein, 17 aa, Entamoeba invadens
LRNEKYNAILIPNASLQ

SEQ ID NO: 2798691 - protein, 25 aa, Entamoeba invadens
LRNESASLIAGRWSVSFEPAEKVKD

SEQ ID NO: 2798692 - protein, 17 aa, Entamoeba invadens
LRNGHWILLDEINLASH

SEQ ID NO: 2798693 - protein, 20 aa, Entamoeba invadens
LRNGKCYSCSSPLDEICFSD

SEQ ID NO: 2798694 - protein, 20 aa, Entamoeba invadens
LRNKELFAMVGTNTARASLV

SEQ ID NO: 2798695 - protein, 18 aa, Entamoeba invadens
LRNKFVLDGARGISYLHT

SEQ ID NO: 2798696 - protein, 17 aa, Entamoeba invadens
LRNKVLFSVDGKLVSND

SEQ ID NO: 2798697 - protein, 17 aa, Entamoeba invadens
LRNLTLFFPSLQLLDLR

SEQ ID NO: 2798698 - protein, 17 aa, Entamoeba invadens
LRNPFIANYMGAVTYLP

SEQ ID NO: 2798699 - protein, 17 aa, Entamoeba invadens
LRNPFIASYMGSVTYLP

SEQ ID NO: 2798700 - protein, 17 aa, Entamoeba invadens
LRNPFIVNYVGSITYIP

SEQ ID NO: 2798701 - protein, 17 aa, Entamoeba invadens
LRPEVEEAVRTCQSAGI

SEQ ID NO: 2798702 - protein, 19 aa, Entamoeba invadens
LRPQPSIQPHGTITSIATY

SEQ ID NO: 2798703 - protein, 20 aa, Entamoeba invadens
LRPRDACFFTIEISPTYSGD

SEQ ID NO: 2798704 - protein, 19 aa, Entamoeba invadens
LRPRTTLATECTRAVHSET

SEQ ID NO: 2798705 - protein, 24 aa, Entamoeba invadens
LRQLPRFMFVQCVVLTIVFDASSK

SEQ ID NO: 2798706 - protein, 18 aa, Entamoeba invadens
LRQPIQFASFTSCPILRH

SEQ ID NO: 2798707 - protein, 19 aa, Entamoeba invadens
LRRAGLKIWVLTGDKKETA

SEQ ID NO: 2798708 - protein, 19 aa, Entamoeba invadens
LRRDLWKTVLSDVDAKNED

SEQ ID NO: 2798709 - protein, 17 aa, Entamoeba invadens
LRRGMCKPIGGQTLYGK

SEQ ID NO: 2798710 - protein, 27 aa, Entamoeba invadens
LRSAEELRKARKLVLDFFSASNYEVVF

SEQ ID NO: 2798711 - protein, 20 aa, Entamoeba invadens
LRSEMPKYQSITMRISFPEK

SEQ ID NO: 2798712 - protein, 19 aa, Entamoeba invadens
LRSQILFCIVWVTRYIDLF

SEQ ID NO: 2798713 - protein, 24 aa, Entamoeba invadens
LRSRHACEFELFIKPTCSCRIDTN

SEQ ID NO: 2798714 - protein, 33 aa, Entamoeba invadens
LRSYLIMPVQRLPRYRLLLSDLLKHTENTFVDY

SEQ ID NO: 2798715 - protein, 33 aa, Entamoeba invadens
LRTDKRFYAKIMKLDIPRIVYAKMVNILPYILI

SEQ ID NO: 2798716 - protein, 18 aa, Entamoeba invadens
LRTKGNVSGGAWSVNFNA

SEQ ID NO: 2798717 - protein, 21 aa, Entamoeba invadens
LRTKLQFYTRDSFNMTSRSDQ

SEQ ID NO: 2798718 - protein, 22 aa, Entamoeba invadens
LRTLCLALQYITDVNGFFGFER

SEQ ID NO: 2798719 - protein, 19 aa, Entamoeba invadens
LRTLILFFVGCVVIVVMGL

SEQ ID NO: 2798720 - protein, 26 aa, Entamoeba invadens
LRTMLRRILRMFLYFHPHGYFQGLND

SEQ ID NO: 2798721 - protein, 22 aa, Entamoeba invadens
LRTNFKPLHGYKFEYGESSHQW

SEQ ID NO: 2798722 - protein, 21 aa, Entamoeba invadens
LRTNLLREIERKFKEIVMGNE

SEQ ID NO: 2798723 - protein, 18 aa, Entamoeba invadens
LRTSKCVRGNWSDDEYLE

SEQ ID NO: 2798724 - protein, 26 aa, Entamoeba invadens
LRVFWEYIKSGSLVMFVIMWICLAGR

SEQ ID NO: 2798725 - protein, 18 aa, Entamoeba invadens
LRVGTSCPHPCTHKCHAG

SEQ ID NO: 2798726 - protein, 18 aa, Entamoeba invadens
LRVKFMFDASNGILYLHE

SEQ ID NO: 2798727 - protein, 17 aa, Entamoeba invadens
LRVKMLLDAARGILYLH

SEQ ID NO: 2798728 - protein, 17 aa, Entamoeba invadens
LRVKYMIDAAKGISYLH

SEQ ID NO: 2798729 - protein, 18 aa, Entamoeba invadens
LRVKYMIDAAKGISYLHT

SEQ ID NO: 2798730 - protein, 20 aa, Entamoeba invadens
LRVLTPINIANFEFTEDPTT

SEQ ID NO: 2798731 - protein, 20 aa, Entamoeba invadens
LRVLTPINIANFEFTEDSTT

SEQ ID NO: 2798732 - protein, 24 aa, Entamoeba invadens
LRVSLGVRVLMMYVLQGLFHPARS

SEQ ID NO: 2798733 - protein, 21 aa, Entamoeba invadens
LRVTGNMGFNMISDFYKNTTT

SEQ ID NO: 2798734 - protein, 18 aa, Entamoeba invadens
LRVVCANVSVVAPMVEPK

SEQ ID NO: 2798735 - protein, 25 aa, Entamoeba invadens
LRVVFSTVTTVLWTYGFASFVFCND

SEQ ID NO: 2798736 - protein, 18 aa, Entamoeba invadens
LRVYTHWVLNYAVYPFMR

SEQ ID NO: 2798737 - protein, 17 aa, Entamoeba invadens
LRYDVIIRLVGAVYTEE

SEQ ID NO: 2798738 - protein, 22 aa, Entamoeba invadens
LRYGNSEMIYCHMKFNTIRDDA

SEQ ID NO: 2798739 - protein, 21 aa, Entamoeba invadens
LRYLLAFLIELPLCYIYRFLP

SEQ ID NO: 2798740 - protein, 19 aa, Entamoeba invadens
LSAAFLYPEYEYMCCFGTD

SEQ ID NO: 2798741 - protein, 23 aa, Entamoeba invadens
LSADLSDSISVYFPMETDALYNS

SEQ ID NO: 2798742 - protein, 25 aa, Entamoeba invadens
LSADNCLTCAFGYYYDYTTSDCLYV

SEQ ID NO: 2798743 - protein, 26 aa, Entamoeba invadens
LSAFLRAFGFLNMFSFLVPVSCLVSL

SEQ ID NO: 2798744 - protein, 25 aa, Entamoeba invadens
LSAFPKSYGIEFIGNMSFAYCTSLT

SEQ ID NO: 2798745 - protein, 19 aa, Entamoeba invadens
LSAGFPAFLLLYVNTIPLF

SEQ ID NO: 2798746 - protein, 24 aa, Entamoeba invadens
LSAMFCGIALMVLVKKRRSQHSAE

SEQ ID NO: 2798747 - protein, 21 aa, Entamoeba invadens
LSAPLAIMAITFYRWSIENNI

SEQ ID NO: 2798748 - protein, 24 aa, Entamoeba invadens
LSAQCVFLVLSIIQWVCYTMCFVA

SEQ ID NO: 2798749 - protein, 19 aa, Entamoeba invadens
LSARCSVALPTGGGCAICR

SEQ ID NO: 2798750 - protein, 17 aa, Entamoeba invadens
LSARCSVVLPKAGGCAI

SEQ ID NO: 2798751 - protein, 17 aa, Entamoeba invadens
LSASCAVSDIYIGENAL

SEQ ID NO: 2798752 - protein, 33 aa, Entamoeba invadens; identical to SEQ ID NO: 2387300

SEQ ID NO: 2798753 - protein, 25 aa, Entamoeba invadens
LSATKWLYPLGKFGVLLGIFVPTLL

SEQ ID NO: 2798754 - protein, 21 aa, Entamoeba invadens
LSAVFLEYVFYLLLGLNNCIT

SEQ ID NO: 2798755 - protein, 21 aa, Entamoeba invadens
LSCAVKSTTCMSCREGYVLQQ

SEQ ID NO: 2798756 - protein, 23 aa, Entamoeba invadens
LSCGCCYAAAIANHGQIMYANMT

SEQ ID NO: 2798757 - protein, 27 aa, Entamoeba invadens
LSCGLKWCKERRSLFCVTKERECSPMY

SEQ ID NO: 2798758 - protein, 26 aa, Entamoeba invadens
LSCIFQIYRKAMCDLNNTNECAIING

SEQ ID NO: 2798759 - protein, 19 aa, Entamoeba invadens
LSCNLGRYLKYNNNCEICD

SEQ ID NO: 2798760 - protein, 23 aa, Entamoeba invadens
LSCPFSYGVSNGYCVKCDASCLE

SEQ ID NO: 2798761 - protein, 19 aa, Entamoeba invadens
LSCQIGYFLTNKMCVSCSQ

SEQ ID NO: 2798762 - protein, 17 aa, Entamoeba invadens
LSCQRRSLLAVVFPIVL

SEQ ID NO: 2798763 - protein, 17 aa, Entamoeba invadens
LSCSKISTRCLSCDKTV

SEQ ID NO: 2798764 - protein, 19 aa, Entamoeba invadens
LSCTSLKMCDMCNITDYVL

SEQ ID NO: 2798765 - protein, 18 aa, Entamoeba invadens
LSCTSLKSCEICNATDYV

SEQ ID NO: 2798766 - protein, 18 aa, Entamoeba invadens
LSCTSSTNCILCDNNLIV

SEQ ID NO: 2798767 - protein, 19 aa, Entamoeba invadens
LSCYNATYCTVCNRGYFLD

SEQ ID NO: 2798768 - protein, 22 aa, Entamoeba invadens
LSDCVKSLIDTCDMKLGENTKN

SEQ ID NO: 2798769 - protein, 25 aa, Entamoeba invadens
LSDDTFKPFFMKLSDNFGEKVKQKK

SEQ ID NO: 2798770 - protein, 23 aa, Entamoeba invadens
LSDEEFQTVFGMTPEAFQALPTW

SEQ ID NO: 2798771 - protein, 23 aa, Entamoeba invadens
LSDFKGKFLMRELLTKEQLQMNT

SEQ ID NO: 2798772 - protein, 19 aa, Entamoeba invadens
LSDFSDVFVFSDAFATFGT

SEQ ID NO: 2798773 - protein, 22 aa, Entamoeba invadens
LSDIFKKTCSLFEKEYTSKTFN

SEQ ID NO: 2798774 - protein, 23 aa, Entamoeba invadens
LSDKKSMCVLAFLNLTYYNYDTS

SEQ ID NO: 2798775 - protein, 25 aa, Entamoeba invadens
LSDKLKLKFLWDASKGILYLHENGI

SEQ ID NO: 2798776 - protein, 25 aa, Entamoeba invadens
LSDLECLKCFTNYFVNETYSCEKTT

SEQ ID NO: 2798777 - protein, 18 aa, Entamoeba invadens
LSDSIFSDFDFQNTQLDI

SEQ ID NO: 2798778 - protein, 28 aa, Entamoeba invadens
LSDTCSFPESFPALYTFDKVCSFENELE

SEQ ID NO: 2798779 - protein, 17 aa, Entamoeba invadens
LSDVCDTTFTIGYSSMS

SEQ ID NO: 2798780 - protein, 31 aa, Entamoeba invadens
LSDVPRKYTSLLLKICIDVTRGLKDLRKREI

SEQ ID NO: 2798781 - protein, 18 aa, Entamoeba invadens
LSDYWKLKVDVEVEKQNS

SEQ ID NO: 2798782 - protein, 23 aa, Entamoeba invadens
LSECYKCSEILHCVECSQNTTEC

SEQ ID NO: 2798783 - protein, 17 aa, Entamoeba invadens
LSEESIKYHCGQNFLEK

SEQ ID NO: 2798784 - protein, 19 aa, Entamoeba invadens
LSEFVKNIFQRSFSDLNVA

SEQ ID NO: 2798785 - protein, 18 aa, Entamoeba invadens
LSEKCGNGILDEGESCDS

SEQ ID NO: 2798786 - protein, 18 aa, Entamoeba invadens
LSEKWMLERTISKHCTLK

SEQ ID NO: 2798787 - protein, 26 aa, Entamoeba invadens
LSENWMGRGGLFGANTSFLGVGIFVV

SEQ ID NO: 2798788 - protein, 26 aa, Entamoeba invadens
LSESRCITCVSGFYIAENENCVELST

SEQ ID NO: 2798789 - protein, 17 aa, Entamoeba invadens
LSEVLCFLFLVIFQGTF

SEQ ID NO: 2798790 - protein, 19 aa, Entamoeba invadens
LSEVLRCPNDVLGFTFVAL

SEQ ID NO: 2798791 - protein, 18 aa, Entamoeba invadens
LSFAFGGIYFVTSRMVIK

SEQ ID NO: 2798792 - protein, 26 aa, Entamoeba invadens
LSFFFLKSYFDLHFVFSWQFWWKLFV

SEQ ID NO: 2798793 - protein, 25 aa, Entamoeba invadens
LSFGLCLDISYVLQCIEISNSKCSK

SEQ ID NO: 2798794 - protein, 46 aa, Entamoeba invadens
LSFIFGETLIRFCGIYLGILLLFWGCSVKYFFDISFMRLFYILTLI

SEQ ID NO: 2798795 - protein, 26 aa, Entamoeba invadens
LSFIKFKPYFPFGFLAVDFFFMLSGF

SEQ ID NO: 2798796 - protein, 19 aa, Entamoeba invadens
LSFLWMIAGMLYFKFTRWV

SEQ ID NO: 2798797 - protein, 22 aa, Entamoeba invadens
LSFNRRYCNELKRCDELERKMR

SEQ ID NO: 2798798 - protein, 23 aa, Entamoeba invadens
LSFRELWDMYSDMTLVNVEGDYK

SEQ ID NO: 2798799 - protein, 22 aa, Entamoeba invadens
LSFSAASLILLILSILFLPNVP

SEQ ID NO: 2798800 - protein, 19 aa, Entamoeba invadens
LSFTDYILFASHRKLQTVQ

SEQ ID NO: 2798801 - protein, 17 aa, Entamoeba invadens
LSGALTLLTLVLVQPSY

SEQ ID NO: 2798802 - protein, 17 aa, Entamoeba invadens
LSGCFVSWYFLVRNESL

SEQ ID NO: 2798803 - protein, 26 aa, Entamoeba invadens
LSGCRTCISGYYLYDGLCVKCGEGCS

SEQ ID NO: 2798804 - protein, 21 aa, Entamoeba invadens
LSGDVCKKCVTFCKTCQLEVA

SEQ ID NO: 2798805 - protein, 17 aa, Entamoeba invadens
LSGELCLSCVLKPECAT

SEQ ID NO: 2798806 - protein, 22 aa, Entamoeba invadens
LSGFGKCRVILCRIITLVEKES

SEQ ID NO: 2798807 - protein, 29 aa, Entamoeba invadens
LSGGPFEGITGWRNWDWDTDFTIRKYLLL

SEQ ID NO: 2798808 - protein, 20 aa, Entamoeba invadens
LSGIVGLLVLWSEFAITINY

SEQ ID NO: 2798809 - protein, 23 aa, Entamoeba invadens
LSGLCTLLSPFLGYIPFPVIRRF

SEQ ID NO: 2798810 - protein, 17 aa, Entamoeba invadens
LSGLRKDKICFRETRAQ

SEQ ID NO: 2798811 - protein, 25 aa, Entamoeba invadens
LSGTDLLDALSFYFGKLYTDHALAT

SEQ ID NO: 2798812 - protein, 17 aa, Entamoeba invadens
LSHCLKQEGDMCTECES

SEQ ID NO: 2798813 - protein, 20 aa, Entamoeba invadens
LSHKIFCLGVTLSRFPEFLG

SEQ ID NO: 2798814 - protein, 28 aa, Entamoeba invadens
LSHTQIRWNELTSVLGLSRTVMNLISSR

SEQ ID NO: 2798815 - protein, 19 aa, Entamoeba invadens
LSICGEFLIKALGSCAIGL

SEQ ID NO: 2798816 - protein, 17 aa, Entamoeba invadens
LSIEDIVTFFIQNAAMV

SEQ ID NO: 2798817 - protein, 17 aa, Entamoeba invadens
LSIEPLAFIPFVIESIK

SEQ ID NO: 2798818 - protein, 21 aa, Entamoeba invadens
LSIIVFCLLFVFFITLGIFKQ

SEQ ID NO: 2798819 - protein, 18 aa, Entamoeba invadens
LSILPFTVSKVIQVSLTG

SEQ ID NO: 2798820 - protein, 26 aa, Entamoeba invadens
LSINPICLVCAGAKIILDLPKTLEYL

SEQ ID NO: 2798821 - protein, 26 aa, Entamoeba invadens
LSIQGFFCFPMVDYIFFGETSKISTQ

SEQ ID NO: 2798822 - protein, 22 aa, Entamoeba invadens
LSKCFYCSMGYYLSNNSCVDCE

SEQ ID NO: 2798823 - protein, 18 aa, Entamoeba invadens
LSKCLICQPKYFLLNGTC

SEQ ID NO: 2798824 - protein, 22 aa, Entamoeba invadens
LSKCSQCNRYPLNQTEIDMQKM

SEQ ID NO: 2798825 - protein, 19 aa, Entamoeba invadens
LSKDLPRTEVNGIFIKPET

SEQ ID NO: 2798826 - protein, 19 aa, Entamoeba invadens
LSKECARGEIGINDECYPN

SEQ ID NO: 2798827 - protein, 24 aa, Entamoeba invadens
LSKFLFCSLLFLSVMMVMKDFCQH

SEQ ID NO: 2798828 - protein, 31 aa, Entamoeba invadens
LSKFTKRWNFLWTLVFYSGFLVITIITTIVL

SEQ ID NO: 2798829 - protein, 20 aa, Entamoeba invadens
LSKHAYCFVPIITMKTSQGS

SEQ ID NO: 2798830 - protein, 17 aa, Entamoeba invadens
LSKIWAKNAVSYDLKVK

SEQ ID NO: 2798831 - protein, 19 aa, Entamoeba invadens
LSKPEMFFLHFPRKQELVV

SEQ ID NO: 2798832 - protein, 17 aa, Entamoeba invadens
LSKPHASFVPKKRQKKL

SEQ ID NO: 2798833 - protein, 23 aa, Entamoeba invadens
LSKSGMTRLLLRMLDITHITNPF

SEQ ID NO: 2798834 - protein, 18 aa, Entamoeba invadens
LSLCNNINIFSLFLKLKI

SEQ ID NO: 2798835 - protein, 17 aa, Entamoeba invadens
LSLEMKNSYSVYNTSDI

SEQ ID NO: 2798836 - protein, 17 aa, Entamoeba invadens
LSLFLLFLVLFIAFPLT

SEQ ID NO: 2798837 - protein, 29 aa, Entamoeba invadens
LSLIDCCVFFTFFVFFQFKSAFIQKLNFI

SEQ ID NO: 2798838 - protein, 24 aa, Entamoeba invadens
LSLKCSLIPILLYLVVTLISINSQ

SEQ ID NO: 2798839 - protein, 17 aa, Entamoeba invadens
LSLKLPTCIPLDTLVTA

SEQ ID NO: 2798840 - protein, 17 aa, Entamoeba invadens
LSLKLTIPSAYGRPKTQ

SEQ ID NO: 2798841 - protein, 23 aa, Entamoeba invadens
LSLLCVTCVVPYAFFYVEDYDED

SEQ ID NO: 2798842 - protein, 18 aa, Entamoeba invadens
LSLLGTLFCCLMDNTIND

SEQ ID NO: 2798843 - protein, 18 aa, Entamoeba invadens
LSLLRATRPIPVYLQHLK

SEQ ID NO: 2798844 - protein, 20 aa, Entamoeba invadens
LSLPFALLFFVFPINFNLSP

SEQ ID NO: 2798845 - protein, 17 aa, Entamoeba invadens
LSLQALTAYFVYIIIFK

SEQ ID NO: 2798846 - protein, 17 aa, Entamoeba invadens
LSLQGLCMKCIGKMNKK

SEQ ID NO: 2798847 - protein, 31 aa, Entamoeba invadens
LSLSFDYRITLCIMCLAPFGVGSFILDAKLN

SEQ ID NO: 2798848 - protein, 18 aa, Entamoeba invadens
LSLVNRKVIFVPPLDWSA

SEQ ID NO: 2798849 - protein, 20 aa, Entamoeba invadens
LSLYFGVLIGNIFQIITATI

SEQ ID NO: 2798850 - protein, 17 aa, Entamoeba invadens
LSMFNALFTARILSNSY

SEQ ID NO: 2798851 - protein, 17 aa, Entamoeba invadens
LSMMTIRLSTMTKCLFC

SEQ ID NO: 2798852 - protein, 22 aa, Entamoeba invadens
LSMQLRLGMIIERRMNTLRFLI

SEQ ID NO: 2798853 - protein, 20 aa, Entamoeba invadens
LSMSLCFFIEKLIELYQRRT

SEQ ID NO: 2798854 - protein, 17 aa, Entamoeba invadens
LSMTSFHPETWTPTWTI

SEQ ID NO: 2798855 - protein, 17 aa, Entamoeba invadens
LSNKFNWFDMFNNDLSG

SEQ ID NO: 2798856 - protein, 19 aa, Entamoeba invadens
LSNKYGLIFNKYPSLKAIQ

SEQ ID NO: 2798857 - protein, 29 aa, Entamoeba invadens
LSNLIYCQRRIRLFVSYSKYSFRLLQLSR

SEQ ID NO: 2798858 - protein, 22 aa, Entamoeba invadens
LSNLPLLFLAYYAITLVVSKTM

SEQ ID NO: 2798859 - protein, 24 aa, Entamoeba invadens
LSNQKCLLCEAGTYKKTEITCDKC

SEQ ID NO: 2798860 - protein, 24 aa, Entamoeba invadens
LSNSSKCTYCYNCTTCEKKTGRCT

SEQ ID NO: 2798861 - protein, 19 aa, Entamoeba invadens
LSNVNFILLRGGISVQSKQ

SEQ ID NO: 2798862 - protein, 17 aa, Entamoeba invadens
LSNYMSWNLDIYEWYTI

SEQ ID NO: 2798863 - protein, 25 aa, Entamoeba invadens
LSPDECALCTPPEYSWDCHRCGEGY

SEQ ID NO: 2798864 - protein, 21 aa, Entamoeba invadens
LSPEKYKDWGYDQAVHNVIFY

SEQ ID NO: 2798865 - protein, 22 aa, Entamoeba invadens
LSPHDFFLNFGMNSGYNTQHAM

SEQ ID NO: 2798866 - protein, 25 aa, Entamoeba invadens
LSPIGCLRCAKGYYTDKENKCSKCN

SEQ ID NO: 2798867 - protein, 17 aa, Entamoeba invadens
LSPKLDLGEIHLDQSPI

SEQ ID NO: 2798868 - protein, 19 aa, Entamoeba invadens
LSPLIPSLMERVINSINCE

SEQ ID NO: 2798869 - protein, 18 aa, Entamoeba invadens
LSPLNLKAKLPIEFMEKW

SEQ ID NO: 2798870 - protein, 22 aa, Entamoeba invadens
LSPRLRVKRAIDFAFQEQSNLE

SEQ ID NO: 2798871 - protein, 29 aa, Entamoeba invadens
LSPRSDCKAPAIADGPSWSAKRTSMKGSV

SEQ ID NO: 2798872 - protein, 19 aa, Entamoeba invadens
LSPSICYNTSCSQIDFVGW

SEQ ID NO: 2798873 - protein, 25 aa, Entamoeba invadens
LSQEKCLLCSPDTYLWSDQICNIST

SEQ ID NO: 2798874 - protein, 22 aa, Entamoeba invadens
LSQKITEIWTKTVIDIGSGKGY

SEQ ID NO: 2798875 - protein, 25 aa, Entamoeba invadens
LSQLTYCFYMFKRQTYPWYSMFITN

SEQ ID NO: 2798876 - protein, 25 aa, Entamoeba invadens
LSQNGLCKAGLYNGSGFYCEECRFG

SEQ ID NO: 2798877 - protein, 17 aa, Entamoeba invadens
LSQRSGAFVNDIVTDIL

SEQ ID NO: 2798878 - protein, 23 aa, Entamoeba invadens
LSQYAWYLLICRKKYSKDKYLNL

SEQ ID NO: 2798879 - protein, 18 aa, Entamoeba invadens
LSRIPRKQLRIEDTSLLV

SEQ ID NO: 2798880 - protein, 24 aa, Entamoeba invadens
LSRLEFNKVTPIRPFRHDHVERFQ

SEQ ID NO: 2798881 - protein, 22 aa, Entamoeba invadens
LSRTSPVSVICYRETEPIADIV

SEQ ID NO: 2798882 - protein, 26 aa, Entamoeba invadens
LSSAKATFNLGGFKAEKITSAVSTEL

SEQ ID NO: 2798883 - protein, 22 aa, Entamoeba invadens
LSSCKEILEFATGSPTVPETLE

SEQ ID NO: 2798884 - protein, 20 aa, Entamoeba invadens
LSSCPSCSAGYYSSSGSTSC

SEQ ID NO: 2798885 - protein, 23 aa, Entamoeba invadens
LSSCSFGSLFDATGATVTFLGTS

SEQ ID NO: 2798886 - protein, 30 aa, Entamoeba invadens
LSSFALGFAKCWDLALVLVAMMPFIMIILF

SEQ ID NO: 2798887 - protein, 18 aa, Entamoeba invadens
LSSFEMKNAATAQLKLPY

SEQ ID NO: 2798888 - protein, 23 aa, Entamoeba invadens
LSSFSGCERCVFGHYLLNHKCYK

SEQ ID NO: 2798889 - protein, 17 aa, Entamoeba invadens
LSSGSCFKSVSPLTMDY

SEQ ID NO: 2798890 - protein, 21 aa, Entamoeba invadens
LSSHLRVKRAINFAREQEQNL

SEQ ID NO: 2798891 - protein, 18 aa, Entamoeba invadens
LSSIDFASECIRWLGAFR

SEQ ID NO: 2798892 - protein, 18 aa, Entamoeba invadens
LSSIRIRNRITLTQWRAV

SEQ ID NO: 2798893 - protein, 36 aa, Entamoeba invadens
LSSLILIFSGIWPYTKLVMMLVCWLMPSTLLTPKYR

SEQ ID NO: 2798894 - protein, 31 aa, Entamoeba invadens
LSSLSLFFLHFWKNGLLFLRGPVLVMFNVVQ

SEQ ID NO: 2798895 - protein, 19 aa, Entamoeba invadens
LSSSLAFSICYPLDVVKRK

SEQ ID NO: 2798896 - protein, 18 aa, Entamoeba invadens
LSSSRSFKAKVLLRSALS

SEQ ID NO: 2798897 - protein, 25 aa, Entamoeba invadens
LSTAICVFAFILLIPYMFLKEHITK

SEQ ID NO: 2798898 - protein, 23 aa, Entamoeba invadens
LSTCLTCKVGYYITDESTCLLCN

SEQ ID NO: 2798899 - protein, 17 aa, Entamoeba invadens
LSTFKAVNLKSGAMLLE

SEQ ID NO: 2798900 - protein, 17 aa, Entamoeba invadens
LSTGMIVFIVIFVIIAL

SEQ ID NO: 2798901 - protein, 17 aa, Entamoeba invadens
LSTGVAVLGVLFIVAVI

SEQ ID NO: 2798902 - protein, 18 aa, Entamoeba invadens
LSTICFVILLGIAVLAYC

SEQ ID NO: 2798903 - protein, 18 aa, Entamoeba invadens
LSTIVAVYVNDIYTATTF

SEQ ID NO: 2798904 - protein, 26 aa, Entamoeba invadens
LSTLIMPVLIQFMTRWVSEENPKTYV

SEQ ID NO: 2798905 - protein, 18 aa, Entamoeba invadens
LSTLKLKSVEYVGEELFE

SEQ ID NO: 2798906 - protein, 23 aa, Entamoeba invadens
LSTNCLSCKIGFYSDNKQCKTCD

SEQ ID NO: 2798907 - protein, 24 aa, Entamoeba invadens
LSTQTELGFSYILGGVNNVYNFGF

SEQ ID NO: 2798908 - protein, 31 aa, Entamoeba invadens
LSTRFLSQHMCKSCYGYCLLAGNDTTQLVCE

SEQ ID NO: 2798909 - protein, 25 aa, Entamoeba invadens
LSTTFYRLCCYIIVYFSFMAKGQSS

SEQ ID NO: 2798910 - protein, 22 aa, Entamoeba invadens
LSTVFCLISYLITTKLKYIQLV

SEQ ID NO: 2798911 - protein, 18 aa, Entamoeba invadens
LSTYEYKNSLILKSLLFL

SEQ ID NO: 2798912 - protein, 17 aa, Entamoeba invadens
LSVDMIGVIPIMVEALK

SEQ ID NO: 2798913 - protein, 17 aa, Entamoeba invadens
LSVKATLTFDSLNVITK

SEQ ID NO: 2798914 - protein, 17 aa, Entamoeba invadens
LSVKKLDFSVVLTNLGY

SEQ ID NO: 2798915 - protein, 18 aa, Entamoeba invadens
LSVREGISPEAYRVISEM

SEQ ID NO: 2798916 - protein, 17 aa, Entamoeba invadens
LSVRGISAYGWYIVLQQ

SEQ ID NO: 2798917 - protein, 17 aa, Entamoeba invadens
LSVSMMFWILYFNSPSA

SEQ ID NO: 2798918 - protein, 19 aa, Entamoeba invadens
LSVTLDWVNYLLTQPKVNI

SEQ ID NO: 2798919 - protein, 39 aa, Entamoeba invadens
LSVVAFILFKFVLKCEVPWQIEFGGCVGLNIGLFLFPIL

SEQ ID NO: 2798920 - protein, 21 aa, Entamoeba invadens
LSYDIFKSWFEKEIPTRMEVF

SEQ ID NO: 2798921 - protein, 19 aa, Entamoeba invadens
LSYGKCYRGKIKHAENCEI

SEQ ID NO: 2798922 - protein, 21 aa, Entamoeba invadens
LSYNIPYIFNNFRMVIGDMIR

SEQ ID NO: 2798923 - protein, 22 aa, Entamoeba invadens
LSYYPIILIISLFYPISLISSI

SEQ ID NO: 2798924 - protein, 23 aa, Entamoeba invadens
LTAKELQKVYSFFSTFRTNEDQV

SEQ ID NO: 2798925 - protein, 17 aa, Entamoeba invadens
LTAKFIHSITCFTGMFL

SEQ ID NO: 2798926 - protein, 24 aa, Entamoeba invadens
LTANPLKLSILFSTMTGLKVITNN

SEQ ID NO: 2798927 - protein, 26 aa, Entamoeba invadens
LTANQARCFYCQCSYIDGSASLVMFA

SEQ ID NO: 2798928 - protein, 26 aa, Entamoeba invadens
LTAPKCLKSPFNLFGSMMNEPVNWRK

SEQ ID NO: 2798929 - protein, 19 aa, Entamoeba invadens
LTARCNVSLPKGGGCAICR

SEQ ID NO: 2798930 - protein, 24 aa, Entamoeba invadens
LTATQWRALVALVIAVITVEGASR

SEQ ID NO: 2798931 - protein, 18 aa, Entamoeba invadens
LTCASGGVRECVKCNTNY

SEQ ID NO: 2798932 - protein, 26 aa, Entamoeba invadens
LTCISNSRKCLSCANDYFLANYKCET

SEQ ID NO: 2798933 - protein, 25 aa, Entamoeba invadens
LTCKKCTTSNCYRCDNSNICLECLY

SEQ ID NO: 2798934 - protein, 18 aa, Entamoeba invadens
LTCKTCREGYNLEKSKCT

SEQ ID NO: 2798935 - protein, 17 aa, Entamoeba invadens
LTCLMCDNQYRLVDGAC

SEQ ID NO: 2798936 - protein, 23 aa, Entamoeba invadens
LTCNKESCEICADGKTLIDGKCE

SEQ ID NO: 2798937 - protein, 17 aa, Entamoeba invadens
LTCNLYSTKCTLCDSSL

SEQ ID NO: 2798938 - protein, 20 aa, Entamoeba invadens
LTCNVCKTGFYFQDTSHCED

SEQ ID NO: 2798939 - protein, 24 aa, Entamoeba invadens
LTCQICNTFSFLIDKGDSVICEVQ

SEQ ID NO: 2798940 - protein, 25 aa, Entamoeba invadens
LTCQICNTISFLIDKGESVICEVQN

SEQ ID NO: 2798941 - protein, 24 aa, Entamoeba invadens
LTCQICNTISFLINKGDSVICEVQ

SEQ ID NO: 2798942 - protein, 20 aa, Entamoeba invadens
LTCRPYYYLSNGYCLKCDPT

SEQ ID NO: 2798943 - protein, 19 aa, Entamoeba invadens
LTCSFKRSCESCLSSKVLL

SEQ ID NO: 2798944 - protein, 19 aa, Entamoeba invadens
LTCSPDFSRNCYICNSGFY

SEQ ID NO: 2798945 - protein, 18 aa, Entamoeba invadens
LTCSTSFEKICTTCINNK

SEQ ID NO: 2798946 - protein, 19 aa, Entamoeba invadens
LTCTIDSCETCLPRYVLKD

SEQ ID NO: 2798947 - protein, 19 aa, Entamoeba invadens
LTCYDRYGEMYDIYELSDM

SEQ ID NO: 2798948 - protein, 22 aa, Entamoeba invadens
LTDGRCTLCQAGTYQNGDVCVE

SEQ ID NO: 2798949 - protein, 27 aa, Entamoeba invadens
LTDKADGDCGFSFMTYAVLRNLFELHE

SEQ ID NO: 2798950 - protein, 19 aa, Entamoeba invadens
LTDKILFLIIRKFANEFPK

SEQ ID NO: 2798951 - protein, 21 aa, Entamoeba invadens
LTDNAFQRFISCHIKQHKITA

SEQ ID NO: 2798952 - protein, 17 aa, Entamoeba invadens
LTDNIQLIIPMLIATVV

SEQ ID NO: 2798953 - protein, 24 aa, Entamoeba invadens
LTEEGRRSLAELFHNAACSKDELD

SEQ ID NO: 2798954 - protein, 18 aa, Entamoeba invadens
LTEHPGEFITWDVPLEEY

SEQ ID NO: 2798955 - protein, 22 aa, Entamoeba invadens
LTEKFVYFGNWTRYFLTCKDYP

SEQ ID NO: 2798956 - protein, 18 aa, Entamoeba invadens
LTEKKCVNGKIYRYTPTN

SEQ ID NO: 2798957 - protein, 17 aa, Entamoeba invadens
LTELLLMNGADMFIENK

SEQ ID NO: 2798958 - protein, 17 aa, Entamoeba invadens
LTENICIFKMNRSNIIM

SEQ ID NO: 2798959 - protein, 18 aa, Entamoeba invadens
LTEPLVFASTILSIVNVA

SEQ ID NO: 2798960 - protein, 21 aa, Entamoeba invadens
LTEQNARFGFSGEIIPFEVDF

SEQ ID NO: 2798961 - protein, 29 aa, Entamoeba invadens
LTESSLFDMISWASTYLFGGNSSLGLNNL

SEQ ID NO: 2798962 - protein, 28 aa, Entamoeba invadens
LTFFQFSFRWFNCCLVREFSIDAIQVIW

SEQ ID NO: 2798963 - protein, 17 aa, Entamoeba invadens
LTFIRFFSFGVMVITCV

SEQ ID NO: 2798964 - protein, 18 aa, Entamoeba invadens
LTFLSFFVVLCLSADLPG

SEQ ID NO: 2798965 - protein, 17 aa, Entamoeba invadens
LTFLTGFVYPISFYILW

SEQ ID NO: 2798966 - protein, 23 aa, Entamoeba invadens
LTFNRRFCNELKRCDELERKMRY

SEQ ID NO: 2798967 - protein, 17 aa, Entamoeba invadens
LTFNVLIIKDLVNINNF

SEQ ID NO: 2798968 - protein, 18 aa, Entamoeba invadens
LTFTRGVGTPSFMVPEIL

SEQ ID NO: 2798969 - protein, 19 aa, Entamoeba invadens
LTFYCCQSPVFPLVEKTSV

SEQ ID NO: 2798970 - protein, 17 aa, Entamoeba invadens
LTFYKDAIVELGTTRVG

SEQ ID NO: 2798971 - protein, 23 aa, Entamoeba invadens
LTFYRFLSFLVMFITCTVQIAYS

SEQ ID NO: 2798972 - protein, 21 aa, Entamoeba invadens
LTGDFILSMMTIRLSTMTKCL

SEQ ID NO: 2798973 - protein, 17 aa, Entamoeba invadens
LTGGLSFQNDDYVQATV

SEQ ID NO: 2798974 - protein, 18 aa, Entamoeba invadens
LTGKTVSCGDGYYPDSDN

SEQ ID NO: 2798975 - protein, 18 aa, Entamoeba invadens
LTHCLRKTKFGCAECEAN

SEQ ID NO: 2798976 - protein, 19 aa, Entamoeba invadens
LTIEGSVIFLGGIKINGNT

SEQ ID NO: 2798977 - protein, 25 aa, Entamoeba invadens
LTIRFDPEIVVLKSGFACEFSLYLT

SEQ ID NO: 2798978 - protein, 17 aa, Entamoeba invadens
LTISPKTMTYVFVEGNP

SEQ ID NO: 2798979 - protein, 23 aa, Entamoeba invadens
LTISPNQLWNGFALPKVSSPNGL

SEQ ID NO: 2798980 - protein, 17 aa, Entamoeba invadens
LTKAACGKFTQEYRSIY

SEQ ID NO: 2798981 - protein, 23 aa, Entamoeba invadens
LTKCPTSICELRSIRSADLSTFT

SEQ ID NO: 2798982 - protein, 24 aa, Entamoeba invadens
LTKCYTCKNGAILEDDKCVFQCPD

SEQ ID NO: 2798983 - protein, 22 aa, Entamoeba invadens
LTKKLPVVIPFEQFGYFARPAC

SEQ ID NO: 2798984 - protein, 33 aa, Entamoeba invadens
LTKMAKLYFSQRMDFLSVFICFVTVGVLVVTKL

SEQ ID NO: 2798985 - protein, 28 aa, Entamoeba invadens
LTKNKKKWCLIFCVKRIIHIFQGGFFYF

SEQ ID NO: 2798986 - protein, 25 aa, Entamoeba invadens
LTKQRLQRELKMCGKSGRSEDSLSN

SEQ ID NO: 2798987 - protein, 24 aa, Entamoeba invadens
LTKSCKTFSIFGNGCYECRDGYYR

SEQ ID NO: 2798988 - protein, 21 aa, Entamoeba invadens
LTKSMCNMCLCNYTENGEWDP

SEQ ID NO: 2798989 - protein, 22 aa, Entamoeba invadens
LTKSNLCVKCSTGYSLENNLCN

SEQ ID NO: 2798990 - protein, 17 aa, Entamoeba invadens
LTKTVLFISENYMKYGN

SEQ ID NO: 2798991 - protein, 26 aa, Entamoeba invadens
LTKVDFQGNMGWRRHIEKGGKHVTVG

SEQ ID NO: 2798992 - protein, 24 aa, Entamoeba invadens
LTKYKYHMISVFFFILVLISLASP

SEQ ID NO: 2798993 - protein, 17 aa, Entamoeba invadens
LTLALTLTQFFSMLFHR

SEQ ID NO: 2798994 - protein, 22 aa, Entamoeba invadens
LTLHPLCFSRYTPCYWRSTVGL

SEQ ID NO: 2798995 - protein, 22 aa, Entamoeba invadens
LTLKRVVQFAMEIYKENTTKEV

SEQ ID NO: 2798996 - protein, 26 aa, Entamoeba invadens
LTLMVGRSRFKSIVFNQRNGKRLINN

SEQ ID NO: 2798997 - protein, 21 aa, Entamoeba invadens
LTLRCYRLATQHLTTIIQLIT

SEQ ID NO: 2798998 - protein, 20 aa, Entamoeba invadens
LTLSLCKLYLIPVVKTLPYF

SEQ ID NO: 2798999 - protein, 23 aa, Entamoeba invadens
LTLSTRNSVIFSFLEQLLDEPET

SEQ ID NO: 2799000 - protein, 17 aa, Entamoeba invadens
LTLTRLFSPFGKLGVLA

SEQ ID NO: 2799001 - protein, 24 aa, Entamoeba invadens
LTLYRFAAIFLMVFTSFISLLSRT

SEQ ID NO: 2799002 - protein, 24 aa, Entamoeba invadens
LTMDLLFKTCLSIDKQELGLFIYN

SEQ ID NO: 2799003 - protein, 34 aa, Entamoeba invadens
LTMISIYVAFALPKLPGMWVYTWTVTILMWASCW

SEQ ID NO: 2799004 - protein, 25 aa, Entamoeba invadens
LTMRDFCVICKLGYTYYNGKCVTSQ

SEQ ID NO: 2799005 - protein, 31 aa, Entamoeba invadens
LTMTPALFLCFPRFFRLQSCVPCSKKCVRYT

SEQ ID NO: 2799006 - protein, 32 aa, Entamoeba invadens
LTNCDIKTSRGCSYCSSGYYLEEQTCFKCDQK

SEQ ID NO: 2799007 - protein, 24 aa, Entamoeba invadens
LTNCQLRFPNPVNILTYKQPSTTT

SEQ ID NO: 2799008 - protein, 23 aa, Entamoeba invadens
LTNCSYVFLALSSIRIRNRITLT

SEQ ID NO: 2799009 - protein, 25 aa, Entamoeba invadens
LTNFKTNSCFEFMKLESIEKSVSCS

SEQ ID NO: 2799010 - protein, 18 aa, Entamoeba invadens
LTNINIPFGVKRLMKECF

SEQ ID NO: 2799011 - protein, 19 aa, Entamoeba invadens
LTNLKEATCYELISVEPPL

SEQ ID NO: 2799012 - protein, 20 aa, Entamoeba invadens
LTNLRHVFATTLFMTSFMYA

SEQ ID NO: 2799013 - protein, 23 aa, Entamoeba invadens
LTNNFKSLNIISSVQTALIQISS

SEQ ID NO: 2799014 - protein, 18 aa, Entamoeba invadens
LTNNQFWGLAAINQNSST

SEQ ID NO: 2799015 - protein, 20 aa, Entamoeba invadens
LTNPIKCITCPPEKRMNNGI

SEQ ID NO: 2799016 - protein, 27 aa, Entamoeba invadens
LTNRTIRDFPLFFVNSFNLADNNYVTN

SEQ ID NO: 2799017 - protein, 26 aa, Entamoeba invadens
LTNRTIRDFPLFFVNTFNLADNNYVT

SEQ ID NO: 2799018 - protein, 25 aa, Entamoeba invadens
LTQCSKCDNEFCFITLDLTGSTTDP

SEQ ID NO: 2799019 - protein, 25 aa, Entamoeba invadens
LTQEGRHAPQIIVPSTFTPYDLDKI

SEQ ID NO: 2799020 - protein, 18 aa, Entamoeba invadens
LTQEVVIPELVWKGKVVF

SEQ ID NO: 2799021 - protein, 18 aa, Entamoeba invadens
LTQGAWRDVVFTNENISV

SEQ ID NO: 2799022 - protein, 21 aa, Entamoeba invadens
LTRLNLGPMYDFLENNKSICM

SEQ ID NO: 2799023 - protein, 32 aa, Entamoeba invadens
LTRRRNRLTGSLCLQLFFIFLLTLLFLRGAYK

SEQ ID NO: 2799024 - protein, 17 aa, Entamoeba invadens
LTSEIFWEVPFEQKGII

SEQ ID NO: 2799025 - protein, 18 aa, Entamoeba invadens
LTSFLDVVHELRVKLYKL

SEQ ID NO: 2799026 - protein, 25 aa, Entamoeba invadens
LTSFSFDFNGLAGWALKILGQSPER

SEQ ID NO: 2799027 - protein, 20 aa, Entamoeba invadens
LTSIVLHFFPNLVLYYLRWK

SEQ ID NO: 2799028 - protein, 20 aa, Entamoeba invadens
LTSLRRIKSNAFKVEIELNV

SEQ ID NO: 2799029 - protein, 20 aa, Entamoeba invadens
LTSLWYMCHMDLDVYCFLIP

SEQ ID NO: 2799030 - protein, 18 aa, Entamoeba invadens
LTSNEIIDGKGFLSVGFF

SEQ ID NO: 2799031 - protein, 20 aa, Entamoeba invadens
LTSTHCVLIFTGNPSLLGLY

SEQ ID NO: 2799032 - protein, 18 aa, Entamoeba invadens
LTTCITCFDGYYLYKNYC

SEQ ID NO: 2799033 - protein, 22 aa, Entamoeba invadens
LTTETTCIFKAADFENDNVCKY

SEQ ID NO: 2799034 - protein, 17 aa, Entamoeba invadens
LTTKEFVDWASQVLRER

SEQ ID NO: 2799035 - protein, 18 aa, Entamoeba invadens
LTTLLSLGDHFHETTDPA

SEQ ID NO: 2799036 - protein, 17 aa, Entamoeba invadens
LTTLLSLGDHFHETTEP

SEQ ID NO: 2799037 - protein, 24 aa, Entamoeba invadens
LTTMKEIIDVVGITDVRPSLGDLV

SEQ ID NO: 2799038 - protein, 20 aa, Entamoeba invadens
LTTNCLSCGSGRYLQNGQCL

SEQ ID NO: 2799039 - protein, 17 aa, Entamoeba invadens
LTTSLTVLFVFGSASFV

SEQ ID NO: 2799040 - protein, 17 aa, Entamoeba invadens
LTTSPLANCMESRNNMC

SEQ ID NO: 2799041 - protein, 18 aa, Entamoeba invadens
LTTSRWCLVGNKIQCDCD

SEQ ID NO: 2799042 - protein, 18 aa, Entamoeba invadens
LTTTDFVLFLLSKPVSKG

SEQ ID NO: 2799043 - protein, 23 aa, Entamoeba invadens
LTTTQWRALLALVVCVISVESAN

SEQ ID NO: 2799044 - protein, 24 aa, Entamoeba invadens
LTTTQWRALLALVVCVTIVESANR

SEQ ID NO: 2799045 - protein, 21 aa, Entamoeba invadens
LTTVWTYRRSLFLIGQATVML

SEQ ID NO: 2799046 - protein, 18 aa, Entamoeba invadens
LTTYCVSAFCLNFSVYFF

SEQ ID NO: 2799047 - protein, 20 aa, Entamoeba invadens
LTVAWTYHRSLILAAQAMFL

SEQ ID NO: 2799048 - protein, 23 aa, Entamoeba invadens
LTVGVSTIWCKNTFYIENESCTS

SEQ ID NO: 2799049 - protein, 19 aa, Entamoeba invadens
LTVICKNYLALLADVNDGE

SEQ ID NO: 2799050 - protein, 21 aa, Entamoeba invadens
LTVKGVEYWSPCFEILEIATT

SEQ ID NO: 2799051 - protein, 18 aa, Entamoeba invadens
LTYFDTIQSTLGMIISKK

SEQ ID NO: 2799052 - protein, 19 aa, Entamoeba invadens
LTYKCIKGYEGVPIGALAE

SEQ ID NO: 2799053 - protein, 18 aa, Entamoeba invadens
LTYKVMFEVFSIVYCIGY

SEQ ID NO: 2799054 - protein, 17 aa, Entamoeba invadens
LTYPSTCQHDLVSSFKY

SEQ ID NO: 2799055 - protein, 23 aa, Entamoeba invadens
LVACFCLWIFLLKGQSLTQMEQL

SEQ ID NO: 2799056 - protein, 18 aa, Entamoeba invadens
LVAFHMIFNAYNIPKNVI

SEQ ID NO: 2799057 - protein, 17 aa, Entamoeba invadens
LVALSFAHQFRGGMEPF

SEQ ID NO: 2799058 - protein, 24 aa, Entamoeba invadens
LVASFIACLCLFVFQPTFKCDVST

SEQ ID NO: 2799059 - protein, 24 aa, Entamoeba invadens
LVAVLFVFGVLFVLIASIVVLTKI

SEQ ID NO: 2799060 - protein, 25 aa, Entamoeba invadens
LVCAALTCLMGFLAYKMRYNTVFAI

SEQ ID NO: 2799061 - protein, 20 aa, Entamoeba invadens
LVCDYNRFMSVNGKCLLQSL

SEQ ID NO: 2799062 - protein, 20 aa, Entamoeba invadens
LVCKKFCCILDRFRYNPIPI

SEQ ID NO: 2799063 - protein, 17 aa, Entamoeba invadens
LVCKKLHEVLVFNVDIW

SEQ ID NO: 2799064 - protein, 24 aa, Entamoeba invadens
LVDPSRFGLFIGVLNTSIIFAKQI

SEQ ID NO: 2799065 - protein, 25 aa, Entamoeba invadens
LVDPWKSRYPLLYKIPNDNNRIINE

SEQ ID NO: 2799066 - protein, 18 aa, Entamoeba invadens
LVDQSGCKECANTQNMRG

SEQ ID NO: 2799067 - protein, 24 aa, Entamoeba invadens
LVECVGELTCCLSPVIAGAISTAT

SEQ ID NO: 2799068 - protein, 18 aa, Entamoeba invadens
LVEDCWKQGFEERPSFSD

SEQ ID NO: 2799069 - protein, 17 aa, Entamoeba invadens
LVEECWRNIPTERPTFN

SEQ ID NO: 2799070 - protein, 19 aa, Entamoeba invadens
LVEELRVFPCTNLKVEDFT

SEQ ID NO: 2799071 - protein, 20 aa, Entamoeba invadens
LVEGITKWFKNIPIEKTKTL

SEQ ID NO: 2799072 - protein, 29 aa, Entamoeba invadens
LVELHKALCIRFKVPFNKARILMFDANKT

SEQ ID NO: 2799073 - protein, 17 aa, Entamoeba invadens
LVEMVVLNIDIWKRVSD

SEQ ID NO: 2799074 - protein, 18 aa, Entamoeba invadens
LVENCLRSDWNKRPTSSI

SEQ ID NO: 2799075 - protein, 24 aa, Entamoeba invadens
LVEPLCMPDFMALNLGSSLLKYTI

SEQ ID NO: 2799076 - protein, 19 aa, Entamoeba invadens
LVERGEAILVGFSGDPEGD

SEQ ID NO: 2799077 - protein, 24 aa, Entamoeba invadens
LVEVLCPLFTCIIVKQTTLLSNTD

SEQ ID NO: 2799078 - protein, 23 aa, Entamoeba invadens
LVFCLWHLCCLQFLCDLMNHKTT

SEQ ID NO: 2799079 - protein, 19 aa, Entamoeba invadens
LVFIAFIGFVGARWCGFNS

SEQ ID NO: 2799080 - protein, 19 aa, Entamoeba invadens
LVFICIVSLTFSQPTKVVL

SEQ ID NO: 2799081 - protein, 18 aa, Entamoeba invadens
LVFIPSVTLDASRKAILF

SEQ ID NO: 2799082 - protein, 18 aa, Entamoeba invadens
LVFLDKYVMEVTFSTFLE

SEQ ID NO: 2799083 - protein, 27 aa, Entamoeba invadens
LVFLVPCLYQLMSIKMFHSLKFYRCSC

SEQ ID NO: 2799084 - protein, 17 aa, Entamoeba invadens
LVFPLICVFTHVTLIGH

SEQ ID NO: 2799085 - protein, 17 aa, Entamoeba invadens
LVFWRNYPPAIIGTSLL

SEQ ID NO: 2799086 - protein, 19 aa, Entamoeba invadens
LVGKKCEYRPFCIKVDNTK

SEQ ID NO: 2799087 - protein, 23 aa, Entamoeba invadens
LVGVPCIGYALALAANIFSVPAV

SEQ ID NO: 2799088 - protein, 20 aa, Entamoeba invadens
LVGVPIWFMHFANIYEIPFL

SEQ ID NO: 2799089 - protein, 18 aa, Entamoeba invadens
LVGVVFFLAPYVSNIDIY

SEQ ID NO: 2799090 - protein, 18 aa, Entamoeba invadens
LVHALYPKEGPVFGYSND

SEQ ID NO: 2799091 - protein, 24 aa, Entamoeba invadens
LVHKLMKCKLGFFDVTPMGRIVNY

SEQ ID NO: 2799092 - protein, 18 aa, Entamoeba invadens
LVIALPVVLVLVTFVIFS

SEQ ID NO: 2799093 - protein, 18 aa, Entamoeba invadens
LVICPSSVRHNWKDEILK

SEQ ID NO: 2799094 - protein, 18 aa, Entamoeba invadens
LVIEKEGYISTATTSFQH

SEQ ID NO: 2799095 - protein, 17 aa, Entamoeba invadens
LVIESEVTLTSTYNLNI

SEQ ID NO: 2799096 - protein, 18 aa, Entamoeba invadens
LVIIVFLFFTFVAIFLIT

SEQ ID NO: 2799097 - protein, 17 aa, Entamoeba invadens
LVIKEKLILTSPYIITN

SEQ ID NO: 2799098 - protein, 21 aa, Entamoeba invadens
LVIMLPLCLVTAELSTTLPCE

SEQ ID NO: 2799099 - protein, 17 aa, Entamoeba invadens
LVIPRQFLSMMIVLIFV

SEQ ID NO: 2799100 - protein, 19 aa, Entamoeba invadens
LVISGGTAPLLFLIVCIIL

SEQ ID NO: 2799101 - protein, 25 aa, Entamoeba invadens
LVITSHFLIYCKLFNTSVNYITPCA

SEQ ID NO: 2799102 - protein, 17 aa, Entamoeba invadens
LVIVINAYRYPRGQDGE

SEQ ID NO: 2799103 - protein, 41 aa, Entamoeba invadens
LVKELKLSFDSIGMFFFPSCMPTFLSKLVVFTITFNGNYSL

SEQ ID NO: 2799104 - protein, 20 aa, Entamoeba invadens
LVKHAKTIQLFVCPVSRGQG

SEQ ID NO: 2799105 - protein, 20 aa, Entamoeba invadens
LVKIMLCLIPTSSCVESVFS

SEQ ID NO: 2799106 - protein, 31 aa, Entamoeba invadens
LVKKGGFMKRMYRKPFDWIEEKAMSFADTIV

SEQ ID NO: 2799107 - protein, 18 aa, Entamoeba invadens
LVKLFSFHHLTWWEIINI

SEQ ID NO: 2799108 - protein, 20 aa, Entamoeba invadens
LVKNCKFDIDGKEKSQFTHT

SEQ ID NO: 2799109 - protein, 28 aa, Entamoeba invadens
LVKNCTFRHSGLMGIYFSGNQSTITHNI

SEQ ID NO: 2799110 - protein, 18 aa, Entamoeba invadens
LVKNHWVKIELDTFDVDK

SEQ ID NO: 2799111 - protein, 18 aa, Entamoeba invadens
LVKNHWVKIQLDTFDVAN

SEQ ID NO: 2799112 - protein, 17 aa, Entamoeba invadens
LVKTSPHYKAPSIDLSF

SEQ ID NO: 2799113 - protein, 20 aa, Entamoeba invadens
LVLFCGFTSLVAFLVDLISV

SEQ ID NO: 2799114 - protein, 18 aa, Entamoeba invadens
LVLFVLCVTLIVILTNYF

SEQ ID NO: 2799115 - protein, 17 aa, Entamoeba invadens
LVLFWLVFLKRFAYSFV

SEQ ID NO: 2799116 - protein, 20 aa, Entamoeba invadens
LVLKEIHFRLSYIFKFLLKT

SEQ ID NO: 2799117 - protein, 25 aa, Entamoeba invadens
LVLKSFSWTKIDGVPAVSYDNQIVI

SEQ ID NO: 2799118 - protein, 24 aa, Entamoeba invadens
LVLKSGETFSVEFPLTFETEVSTY

SEQ ID NO: 2799119 - protein, 19 aa, Entamoeba invadens
LVLLLMFWSIFRVVETMIA

SEQ ID NO: 2799120 - protein, 33 aa, Entamoeba invadens
LVLNKRFQMSFCVIFTVLVLFFVVVCVVVGVLF

SEQ ID NO: 2799121 - protein, 20 aa, Entamoeba invadens
LVLQTCCFCQYKGSTSSCVV

SEQ ID NO: 2799122 - protein, 19 aa, Entamoeba invadens
LVLSLRCQITTKYTFVRGT

SEQ ID NO: 2799123 - protein, 19 aa, Entamoeba invadens
LVLSNAWGLILAILLMGNG

SEQ ID NO: 2799124 - protein, 28 aa, Entamoeba invadens
LVLSRLIVSMCVLNDGFVLVNKLLDHFL

SEQ ID NO: 2799125 - protein, 26 aa, Entamoeba invadens
LVLTTDTAFIWKGRLRNEKYVEYAHN

SEQ ID NO: 2799126 - protein, 23 aa, Entamoeba invadens
LVLTTFCGPDIVELAAQAYSSRT

SEQ ID NO: 2799127 - protein, 17 aa, Entamoeba invadens
LVLWGFWLLTGFVLSIG

SEQ ID NO: 2799128 - protein, 24 aa, Entamoeba invadens
LVMAALLALWAFTAYSRLTKKIRQ

SEQ ID NO: 2799129 - protein, 23 aa, Entamoeba invadens
LVMGTIFLYTWIKHKKKHNDDVK

SEQ ID NO: 2799130 - protein, 19 aa, Entamoeba invadens
LVMPKRFLSNVTEPSQASR

SEQ ID NO: 2799131 - protein, 19 aa, Entamoeba invadens
LVMSLSFPLVHHAQRDIFD

SEQ ID NO: 2799132 - protein, 25 aa, Entamoeba invadens
LVNELRCVLYGNTYNMVFPRKYVLP

SEQ ID NO: 2799133 - protein, 23 aa, Entamoeba invadens
LVNENRISSTIQRIRKNHVDVLC

SEQ ID NO: 2799134 - protein, 19 aa, Entamoeba invadens
LVNFKCLFYSKVDNCISAE

SEQ ID NO: 2799135 - protein, 18 aa, Entamoeba invadens
LVNLFVVILYLSLQEKGD

SEQ ID NO: 2799136 - protein, 23 aa, Entamoeba invadens
LVNPEILTDLAFYSPNTFLPTLT

SEQ ID NO: 2799137 - protein, 19 aa, Entamoeba invadens
LVNRLILKGEVVAVTGDGT

SEQ ID NO: 2799138 - protein, 21 aa, Entamoeba invadens
LVNSFDFNSACTIKITDFGTS

SEQ ID NO: 2799139 - protein, 26 aa, Entamoeba invadens
LVNTCRRIRESWGKCSFKTEMFPLFN

SEQ ID NO: 2799140 - protein, 24 aa, Entamoeba invadens
LVPATTICTCKYLFLGDYVDRGTH

SEQ ID NO: 2799141 - protein, 21 aa, Entamoeba invadens
LVPRCGACIEITGPSMKPITC

SEQ ID NO: 2799142 - protein, 26 aa, Entamoeba invadens
LVPRKWRKTKDKVLLGFLYVGLLCTG

SEQ ID NO: 2799143 - protein, 25 aa, Entamoeba invadens
LVPSIGEFMLKCLYEETVIHRVLKI

SEQ ID NO: 2799144 - protein, 18 aa, Entamoeba invadens
LVPSKRQFFCFSYSPDYF

SEQ ID NO: 2799145 - protein, 18 aa, Entamoeba invadens
LVPSRTRESFAFYNQTIV

SEQ ID NO: 2799146 - protein, 18 aa, Entamoeba invadens
LVPTCLTLALTLTQFFSM

SEQ ID NO: 2799147 - protein, 25 aa, Entamoeba invadens
LVQKRFLRYSGICSICSVYNVTEDV

SEQ ID NO: 2799148 - protein, 22 aa, Entamoeba invadens
LVQLLNCYRIAAGSFSQKLSNC

SEQ ID NO: 2799149 - protein, 24 aa, Entamoeba invadens
LVQQTGFPCGRYMSVGNNILAVKN

SEQ ID NO: 2799150 - protein, 18 aa, Entamoeba invadens
LVRCMNFDGAFGCVPGAE

SEQ ID NO: 2799151 - protein, 18 aa, Entamoeba invadens
LVRFCPIKSMNNTVVCTM

SEQ ID NO: 2799152 - protein, 17 aa, Entamoeba invadens
LVRTQLCGLHEITEFVK

SEQ ID NO: 2799153 - protein, 18 aa, Entamoeba invadens
LVSDCWDENPITRLKIAE

SEQ ID NO: 2799154 - protein, 18 aa, Entamoeba invadens
LVSIGFNFTSINEFTIAT

SEQ ID NO: 2799155 - protein, 18 aa, Entamoeba invadens
LVSKCFNISLSLNPNIQQ

SEQ ID NO: 2799156 - protein, 21 aa, Entamoeba invadens
LVSLKFKKLDDIRRFCAKFGW

SEQ ID NO: 2799157 - protein, 17 aa, Entamoeba invadens
LVSLKMSLCRKEVIEKF

SEQ ID NO: 2799158 - protein, 24 aa, Entamoeba invadens
LVSLKPGFACEFEIFIKPLCTCTT

SEQ ID NO: 2799159 - protein, 24 aa, Entamoeba invadens
LVSLKPGYACEFEIFIKPLCTCST

SEQ ID NO: 2799160 - protein, 24 aa, Entamoeba invadens
LVSLVGVPFMGEWNKKSRSVVTKR

SEQ ID NO: 2799161 - protein, 24 aa, Entamoeba invadens
LVSRNIRTSFDMLRINPQNFSSGI

SEQ ID NO: 2799162 - protein, 24 aa, Entamoeba invadens
LVSVVTCASLYILMAISGNVSFDK

SEQ ID NO: 2799163 - protein, 30 aa, Entamoeba invadens
LVTDCALSLIPLLGPFEWEGVIIPYIPSHL

SEQ ID NO: 2799164 - protein, 26 aa, Entamoeba invadens
LVTEKFPFKQFNFFSVVREKVKTGYR

SEQ ID NO: 2799165 - protein, 25 aa, Entamoeba invadens
LVTGICSPEACGFVTMSKIDGNDNT

SEQ ID NO: 2799166 - protein, 26 aa, Entamoeba invadens
LVTIPTPKWCRYVLFVENSWYGKEFY

SEQ ID NO: 2799167 - protein, 24 aa, Entamoeba invadens
LVTISCIFLFFVLIITVCLTIIIS

SEQ ID NO: 2799168 - protein, 24 aa, Entamoeba invadens
LVTLKPGYACEFEIFIKPLCTCVT

SEQ ID NO: 2799169 - protein, 18 aa, Entamoeba invadens
LVTLKPGYACEFEIIIKP

SEQ ID NO: 2799170 - protein, 23 aa, Entamoeba invadens
LVTLKPGYACEFEVFIKPLCTCV

SEQ ID NO: 2799171 - protein, 25 aa, Entamoeba invadens
LVTQRERFERVWSVNGSLSYDYMGY

SEQ ID NO: 2799172 - protein, 23 aa, Entamoeba invadens
LVVAAVVGAIYWIKSKGSNSAKD

SEQ ID NO: 2799173 - protein, 19 aa, Entamoeba invadens
LVVDLSVVANSFFTKTDFK

SEQ ID NO: 2799174 - protein, 17 aa, Entamoeba invadens
LVVEGKFGYCFDDAQQL

SEQ ID NO: 2799175 - protein, 20 aa, Entamoeba invadens
LVVFGSSFAFFIYKTLMGGL

SEQ ID NO: 2799176 - protein, 25 aa, Entamoeba invadens
LVVFYLFKIVYWLISAVQIRVGYVQ

SEQ ID NO: 2799177 - protein, 20 aa, Entamoeba invadens
LVVIYCNWFDNQIVVKESIS

SEQ ID NO: 2799178 - protein, 23 aa, Entamoeba invadens
LVVLCLAFGLPLVDNLMPVCTFF

SEQ ID NO: 2799179 - protein, 24 aa, Entamoeba invadens
LVVLPDRELYVLANTKIPYTVFTM

SEQ ID NO: 2799180 - protein, 23 aa, Entamoeba invadens
LVVQRKAFVFLFGYILISICMIR

SEQ ID NO: 2799181 - protein, 32 aa, Entamoeba invadens
LVVREANLFYAEFIRDFAMLWRHDDTTKLVIS

SEQ ID NO: 2799182 - protein, 20 aa, Entamoeba invadens
LVVRLSGSFLSLVSSHTVFL

SEQ ID NO: 2799183 - protein, 17 aa, Entamoeba invadens
LVVVFTWASPTKLETET

SEQ ID NO: 2799184 - protein, 27 aa, Entamoeba invadens
LVVYIFPSVFAFKVAKGPLKWISLGIF

SEQ ID NO: 2799185 - protein, 18 aa, Entamoeba invadens
LVVYVFPSYFVFKTQKGF

SEQ ID NO: 2799186 - protein, 25 aa, Entamoeba invadens
LVWYPRPSPPFALASSVMLLMLSNV

SEQ ID NO: 2799187 - protein, 25 aa, Entamoeba invadens
LVYGDLVDVFAFRVNEDIISMPLEE

SEQ ID NO: 2799188 - protein, 26 aa, Entamoeba invadens
LVYINCYPGWFGLKRTLLRSNYLVTS

SEQ ID NO: 2799189 - protein, 17 aa, Entamoeba invadens
LVYRGLKVMPFSTGCCT

SEQ ID NO: 2799190 - protein, 25 aa, Entamoeba invadens
LWALETLQSLFLFALFLYYIILLIC

SEQ ID NO: 2799191 - protein, 24 aa, Entamoeba invadens
LWDVCHECIRKGSLDGDIKKPLPN

SEQ ID NO: 2799192 - protein, 20 aa, Entamoeba invadens
LWEGKRFGALIKEGNENGLV

SEQ ID NO: 2799193 - protein, 17 aa, Entamoeba invadens
LWEQLGFVDRVTEVCES

SEQ ID NO: 2799194 - protein, 19 aa, Entamoeba invadens
LWGILAFAEIRGWRNYLLF

SEQ ID NO: 2799195 - protein, 27 aa, Entamoeba invadens
LWGQFFCQWKNVFYLFLGISVVGVCVI

SEQ ID NO: 2799196 - protein, 21 aa, Entamoeba invadens
LWICEGNNWSGEWEMTESNEK

SEQ ID NO: 2799197 - protein, 19 aa, Entamoeba invadens
LWILWIMSIMYAISYVFFM

SEQ ID NO: 2799198 - protein, 26 aa, Entamoeba invadens
LWKKMSEKVVWFFKQYIRTDHEGVSM

SEQ ID NO: 2799199 - protein, 24 aa, Entamoeba invadens
LWKNYKIILTQGMRDCYLDNPSCV

SEQ ID NO: 2799200 - protein, 26 aa, Entamoeba invadens
LWLSAVSFNSPSSWFAVRDDAVRAFT

SEQ ID NO: 2799201 - protein, 31 aa, Entamoeba invadens
LWLVMGFVCCCFWLFGYCTLKNSNDNGARTI

SEQ ID NO: 2799202 - protein, 17 aa, Entamoeba invadens
LWMAPDYIMTWEKMKND

SEQ ID NO: 2799203 - protein, 24 aa, Entamoeba invadens
LWMASSFIVPCRFEIQQKMFEMIV

SEQ ID NO: 2799204 - protein, 19 aa, Entamoeba invadens
LWMILCLLPPPQAFIEQFK

SEQ ID NO: 2799205 - protein, 19 aa, Entamoeba invadens
LWMRVPLYFVQQYPRREQR

SEQ ID NO: 2799206 - protein, 18 aa, Entamoeba invadens
LWNGKQIPFGSKWKQGDV

SEQ ID NO: 2799207 - protein, 23 aa, Entamoeba invadens
LWNNNIIWEFAKGLSPGMDLTKI

SEQ ID NO: 2799208 - protein, 22 aa, Entamoeba invadens
LWSLRKVMLKQWPFEEVLTALL

SEQ ID NO: 2799209 - protein, 23 aa, Entamoeba invadens
LWSREVCVLLSIYFTYIEINSLR

SEQ ID NO: 2799210 - protein, 22 aa, Entamoeba invadens
LWTFYSLYAWVAYKFDLFGVKD

SEQ ID NO: 2799211 - protein, 19 aa, Entamoeba invadens
LWVLPRYIIPAAINAGNYI

SEQ ID NO: 2799212 - protein, 17 aa, Entamoeba invadens
LWVSFWRKYKEVKTSIK

SEQ ID NO: 2799213 - protein, 19 aa, Entamoeba invadens
LWWISLVVIISIFFVILVI

SEQ ID NO: 2799214 - protein, 18 aa, Entamoeba invadens
LWYEKERTFNIKVVDIYV

SEQ ID NO: 2799215 - protein, 25 aa, Entamoeba invadens
LYAAPRLGTRECVVYMTLKCTTKVK

SEQ ID NO: 2799216 - protein, 18 aa, Entamoeba invadens
LYAESSLNVSSMTVVLTV

SEQ ID NO: 2799217 - protein, 18 aa, Entamoeba invadens
LYATLLLDPEWRHIEILK

SEQ ID NO: 2799218 - protein, 20 aa, Entamoeba invadens
LYCGLWYFGIGFIGAAFGQF

SEQ ID NO: 2799219 - protein, 18 aa, Entamoeba invadens
LYCHTCSAKGICVQCQEP

SEQ ID NO: 2799220 - protein, 19 aa, Entamoeba invadens
LYCLGDLNYNFSIYQNITN

SEQ ID NO: 2799221 - protein, 21 aa, Entamoeba invadens
LYCSLFVMSFILLRPGILCGV

SEQ ID NO: 2799222 - protein, 21 aa, Entamoeba invadens
LYCSTCSQGFFKNGKKCDPCY

SEQ ID NO: 2799223 - protein, 25 aa, Entamoeba invadens
LYDVFCVSVVFPLVLLLSTQREGMN

SEQ ID NO: 2799224 - protein, 24 aa, Entamoeba invadens
LYEAILYHFTKFGISFKILENTLN

SEQ ID NO: 2799225 - protein, 18 aa, Entamoeba invadens
LYEETVIHRVLKICYSIS

SEQ ID NO: 2799226 - protein, 17 aa, Entamoeba invadens
LYENTAIPICFYSDTCL

SEQ ID NO: 2799227 - protein, 22 aa, Entamoeba invadens
LYETFSWKLLYQQFEHVMDIQK

SEQ ID NO: 2799228 - protein, 19 aa, Entamoeba invadens
LYFKALLRQDMEWYDFHEA

SEQ ID NO: 2799229 - protein, 19 aa, Entamoeba invadens
LYFLAIMIICCIPSISTVT

SEQ ID NO: 2799230 - protein, 25 aa, Entamoeba invadens
LYFWDRAGLPMAIKNLLAHKLRNRK

SEQ ID NO: 2799231 - protein, 18 aa, Entamoeba invadens
LYGCKECDTSAYLDFGRC

SEQ ID NO: 2799232 - protein, 21 aa, Entamoeba invadens
LYGECRECISGHYLDNDECHK

SEQ ID NO: 2799233 - protein, 21 aa, Entamoeba invadens
LYGECRQCISGHYLDNNECHK

SEQ ID NO: 2799234 - protein, 21 aa, Entamoeba invadens
LYGLLCANGLHKMMVKNLFGT

SEQ ID NO: 2799235 - protein, 18 aa, Entamoeba invadens
LYGTTSECYKCPNQYIRY

SEQ ID NO: 2799236 - protein, 17 aa, Entamoeba invadens
LYGTTSICSKCRNQYIR

SEQ ID NO: 2799237 - protein, 17 aa, Entamoeba invadens
LYGVSFMLKCPISKTKT

SEQ ID NO: 2799238 - protein, 17 aa, Entamoeba invadens
LYHARYIIVAFWFITFL

SEQ ID NO: 2799239 - protein, 18 aa, Entamoeba invadens
LYHIFSISNDEEYWINPK

SEQ ID NO: 2799240 - protein, 17 aa, Entamoeba invadens
LYHPGNDIFLSFYSQLV

SEQ ID NO: 2799241 - protein, 20 aa, Entamoeba invadens
LYHRPCKQKMVYRSPYTYGI

SEQ ID NO: 2799242 - protein, 30 aa, Entamoeba invadens
LYIFGFFCFGLWILCFLLFYKSSSKRARLF

SEQ ID NO: 2799243 - protein, 24 aa, Entamoeba invadens
LYIKPLREFGHYTLPDGLTDEEPN

SEQ ID NO: 2799244 - protein, 23 aa, Entamoeba invadens
LYILCSSTTLLLAIYKFSNMGIL

SEQ ID NO: 2799245 - protein, 17 aa, Entamoeba invadens
LYILMAISGNVSFDKVS

SEQ ID NO: 2799246 - protein, 25 aa, Entamoeba invadens
LYIPMNLDYVWRVAFALGAIPCLLT

SEQ ID NO: 2799247 - protein, 19 aa, Entamoeba invadens
LYISICLLLSLFFLLYVSF

SEQ ID NO: 2799248 - protein, 19 aa, Entamoeba invadens
LYIWTLVAPIIFPKRNFSN

SEQ ID NO: 2799249 - protein, 26 aa, Entamoeba invadens
LYIYMKRAFSFASFFSLNGQALSKLQ

SEQ ID NO: 2799250 - protein, 21 aa, Entamoeba invadens
LYKERCVAGFNSLQLDCSVVK

SEQ ID NO: 2799251 - protein, 18 aa, Entamoeba invadens
LYKERVVWFSTFTAILLV

SEQ ID NO: 2799252 - protein, 18 aa, Entamoeba invadens
LYKLFPPNYMLNGIPLTM

SEQ ID NO: 2799253 - protein, 21 aa, Entamoeba invadens
LYKQTFLSFSFGEIGVKNTSE

SEQ ID NO: 2799254 - protein, 27 aa, Entamoeba invadens
LYKVIYYKFIRTFFVAVFFVLSGIVGL

SEQ ID NO: 2799255 - protein, 28 aa, Entamoeba invadens
LYLMQKIRRWVVCVIILFIFSLFTPIGA

SEQ ID NO: 2799256 - protein, 23 aa, Entamoeba invadens
LYLPHGLTKIGYGAFENIRVLTA

SEQ ID NO: 2799257 - protein, 22 aa, Entamoeba invadens
LYLPLKDVFNFVCISKNTQSAC

SEQ ID NO: 2799258 - protein, 29 aa, Entamoeba invadens
LYLTKNRCLKCREGFLLKEGHCTYSDCQI

SEQ ID NO: 2799259 - protein, 19 aa, Entamoeba invadens
LYLVFWGFMLFPGGGVVSV

SEQ ID NO: 2799260 - protein, 18 aa, Entamoeba invadens
LYLVSAIYFLFTWGMTTL

SEQ ID NO: 2799261 - protein, 18 aa, Entamoeba invadens
LYMARAFPNLKYFNLNGQ

SEQ ID NO: 2799262 - protein, 20 aa, Entamoeba invadens
LYMFPFQMMRTAEGKPIQML

SEQ ID NO: 2799263 - protein, 18 aa, Entamoeba invadens
LYMVNGKCKECVSGYVLY

SEQ ID NO: 2799264 - protein, 24 aa, Entamoeba invadens
LYNKMKLPILFPHVSSERFFYVFI

SEQ ID NO: 2799265 - protein, 18 aa, Entamoeba invadens
LYPGVGVGGDGAYHATMY

SEQ ID NO: 2799266 - protein, 18 aa, Entamoeba invadens
LYPICEYPLMYNKTNHSC

SEQ ID NO: 2799267 - protein, 19 aa, Entamoeba invadens
LYPKTCVKNKFGGSDRYML

SEQ ID NO: 2799268 - protein, 19 aa, Entamoeba invadens
LYPLIAVLLGDVFESNVFN

SEQ ID NO: 2799269 - protein, 24 aa, Entamoeba invadens
LYPSVKWTFNYAFVPSSFLLEINS

SEQ ID NO: 2799270 - protein, 19 aa, Entamoeba invadens
LYQPDFLLPVLCKMKNSSM

SEQ ID NO: 2799271 - protein, 19 aa, Entamoeba invadens
LYRCKKCQTSFYLSESKHV

SEQ ID NO: 2799272 - protein, 22 aa, Entamoeba invadens
LYRYANWLDLVLLITGILGALA

SEQ ID NO: 2799273 - protein, 34 aa, Entamoeba invadens
LYSILFCIVNLFLFDAKSTFTLGLFHDFSYITII

SEQ ID NO: 2799274 - protein, 19 aa, Entamoeba invadens
LYSTKFPPLRPIFSNFELN

SEQ ID NO: 2799275 - protein, 23 aa, Entamoeba invadens
LYSVYILRCGRSTNIELNYTLHM

SEQ ID NO: 2799276 - protein, 25 aa, Entamoeba invadens
LYTDHRLSPCGVKGTALVFNSSSIQ

SEQ ID NO: 2799277 - protein, 25 aa, Entamoeba invadens
LYTEMIHFLPSVLHRCLRILQDRNR

SEQ ID NO: 2799278 - protein, 26 aa, Entamoeba invadens
LYTKANRCLFCSKGYHLQTNGTCSLI

SEQ ID NO: 2799279 - protein, 26 aa, Entamoeba invadens
LYTKHSCIHVTWGYYLLYAKYGYYRV

SEQ ID NO: 2799280 - protein, 17 aa, Entamoeba invadens
LYTKLGTNCVLNHCVLY

SEQ ID NO: 2799281 - protein, 19 aa, Entamoeba invadens
LYTTDFFGVLSIGAQLFLF

SEQ ID NO: 2799282 - protein, 29 aa, Entamoeba invadens
LYVKMQMRPRLLYYPLLEMLDILIFSKIK

SEQ ID NO: 2799283 - protein, 18 aa, Entamoeba invadens
LYVLRSYLEMEMCGNEIK

SEQ ID NO: 2799284 - protein, 25 aa, Entamoeba invadens
LYVTFVFNKWRIVYSTPSGFPYNPF

SEQ ID NO: 2799285 - protein, 24 aa, Entamoeba invadens
LYVYKRLNELFLFVNGTKPSDIFF

SEQ ID NO: 2799286 - protein, 18 aa, Entamoeba invadens
LYWFCIVFFWNEFYNSFV

SEQ ID NO: 2799287 - protein, 25 aa, Entamoeba invadens
LYYIKVGELFTSFPISSGKDKNIGG

SEQ ID NO: 2799288 - protein, 17 aa, Entamoeba invadens
LYYQFVVCSGIFISGVF

SEQ ID NO: 2799289 - protein, 25 aa, Entamoeba invadens
LYYYDEMYAVLPFILDIVNGDEVIV

SEQ ID NO: 2799290 - protein, 23 aa, Entamoeba invadens
LYYYKIFAFFYWIVGKIPSLVFV

SEQ ID NO: 2799291 - protein, 19 aa, Entamoeba invadens
MACEFKLYLTPACTCKIND

SEQ ID NO: 2799292 - protein, 20 aa, Entamoeba invadens
MAESPKCKDCDVKLMSVDGN

SEQ ID NO: 2799293 - protein, 22 aa, Entamoeba invadens
MAFLAVCAYFATLYIKPLREFG

SEQ ID NO: 2799294 - protein, 17 aa, Entamoeba invadens
MAFYNCLTLKEVTLSNN

SEQ ID NO: 2799295 - protein, 20 aa, Entamoeba invadens
MAHKRLAFGHWVLSQHLLDY

SEQ ID NO: 2799296 - protein, 23 aa, Entamoeba invadens
MAIKVLELLATIASIRKASWQSS

SEQ ID NO: 2799297 - protein, 22 aa, Entamoeba invadens
MAKCGQRFYTLISGLEIDRVLN

SEQ ID NO: 2799298 - protein, 22 aa, Entamoeba invadens
MAKKTFEPLGFVIIIATFCSMF

SEQ ID NO: 2799299 - protein, 20 aa, Entamoeba invadens
MAKLKAVVAILEDSSFSVIS

SEQ ID NO: 2799300 - protein, 22 aa, Entamoeba invadens
MAKNSKCSKCNFWHIPSENGTY

SEQ ID NO: 2799301 - protein, 23 aa, Entamoeba invadens
MALFCYGALWAYGSVFSSSVTLI

SEQ ID NO: 2799302 - protein, 18 aa, Entamoeba invadens
MALFGFGCTVEYRIGTVK

SEQ ID NO: 2799303 - protein, 25 aa, Entamoeba invadens
MALGQFWFFYVFKIYMKYAKQLLRL

SEQ ID NO: 2799304 - protein, 17 aa, Entamoeba invadens
MALHELVLLMNKFDLDK

SEQ ID NO: 2799305 - protein, 20 aa, Entamoeba invadens
MALLIGFSGVGVWVIYSNRN

SEQ ID NO: 2799306 - protein, 24 aa, Entamoeba invadens
MALNLGSSLLKYTIVSDCYAEIPN

SEQ ID NO: 2799307 - protein, 17 aa, Entamoeba invadens
MALVTDIIPVMYKYYTT

SEQ ID NO: 2799308 - protein, 20 aa, Entamoeba invadens
MANCRCAITQGFKKSTNGTC

SEQ ID NO: 2799309 - protein, 18 aa, Entamoeba invadens
MAQWIMKKYSFLPADEIV

SEQ ID NO: 2799310 - protein, 21 aa, Entamoeba invadens
MATKCKDCDSMTWSTEGSATC

SEQ ID NO: 2799311 - protein, 18 aa, Entamoeba invadens
MATLFFLFIGLFKSSVLI

SEQ ID NO: 2799312 - protein, 21 aa, Entamoeba invadens
MATYFCWLILPYLIKEQGGSS

SEQ ID NO: 2799313 - protein, 17 aa, Entamoeba invadens
MCANLAILNSFSVSLFF

SEQ ID NO: 2799314 - protein, 17 aa, Entamoeba invadens
MCATCKFWSHPSDNGLS

SEQ ID NO: 2799315 - protein, 24 aa, Entamoeba invadens
MCFHKYFVRSSIEMQRLEGITRSP

SEQ ID NO: 2799316 - protein, 18 aa, Entamoeba invadens
MCGDGIWVDGEPCDGGVG

SEQ ID NO: 2799317 - protein, 20 aa, Entamoeba invadens
MCGHHCPFHPSICSILGFLD

SEQ ID NO: 2799318 - protein, 18 aa, Entamoeba invadens
MCHGRIDAVWIWVNGSDP

SEQ ID NO: 2799319 - protein, 20 aa, Entamoeba invadens
MCIALLYSAFISRTIVIGIE

SEQ ID NO: 2799320 - protein, 25 aa, Entamoeba invadens
MCIILNCYGGLWAYVATCVTTFVTV

SEQ ID NO: 2799321 - protein, 24 aa, Entamoeba invadens
MCISCSVSSCSVCDTDSTKCDKCS

SEQ ID NO: 2799322 - protein, 25 aa, Entamoeba invadens
MCKIGKYVRYGLCRNIEDDETDAFK

SEQ ID NO: 2799323 - protein, 21 aa, Entamoeba invadens
MCLICFKNQFLNELGFCGNDG

SEQ ID NO: 2799324 - protein, 20 aa, Entamoeba invadens
MCLSSCGICSNKYYCITCKE

SEQ ID NO: 2799325 - protein, 17 aa, Entamoeba invadens
MCLTCHYGYVLSTIDNS

SEQ ID NO: 2799326 - protein, 18 aa, Entamoeba invadens
MCLVTEFAQHGSLSDVMK

SEQ ID NO: 2799327 - protein, 18 aa, Entamoeba invadens
MCMITEFAKYGSLNDLIK

SEQ ID NO: 2799328 - protein, 17 aa, Entamoeba invadens
MCMVTEFAQFGSLQDLI

SEQ ID NO: 2799329 - protein, 18 aa, Entamoeba invadens
MCNGRIDAVWIWVNGSDP

SEQ ID NO: 2799330 - protein, 17 aa, Entamoeba invadens
MCSECLKNGEIFTTTQR

SEQ ID NO: 2799331 - protein, 21 aa, Entamoeba invadens
MCSIISSTFLAYFLAPNHLDG

SEQ ID NO: 2799332 - protein, 21 aa, Entamoeba invadens
MCSKCSISGCYTFQNSQCLQC

SEQ ID NO: 2799333 - protein, 17 aa, Entamoeba invadens
MCSMSAIGCSKELQKYL

SEQ ID NO: 2799334 - protein, 23 aa, Entamoeba invadens
MCSQVHLLWSCTLEVILSLIWLF

SEQ ID NO: 2799335 - protein, 23 aa, Entamoeba invadens
MCSQVHLLWSCTLEVIVSIVWLF

SEQ ID NO: 2799336 - protein, 29 aa, Entamoeba invadens
MCTLKNDKLRYGVCPDGIAVTEDCTCYYT

SEQ ID NO: 2799337 - protein, 24 aa, Entamoeba invadens
MCTTCGVANCGSCTSSEPNKCISC

SEQ ID NO: 2799338 - protein, 18 aa, Entamoeba invadens
MCVFGLSTCEQFNDYEWS

SEQ ID NO: 2799339 - protein, 18 aa, Entamoeba invadens
MCVGCKIGYVPNITTSLQ

SEQ ID NO: 2799340 - protein, 19 aa, Entamoeba invadens
MCVKDKCPEMYYKSETDKM

SEQ ID NO: 2799341 - protein, 28 aa, Entamoeba invadens
MCVKDNCPEMYYKSEADKMCKKCTDKCK

SEQ ID NO: 2799342 - protein, 17 aa, Entamoeba invadens
MCVLIVFIILIVSLVIV

SEQ ID NO: 2799343 - protein, 26 aa, Entamoeba invadens
MCVRDQCIKCAGGFSLVSGVCQTVSK

SEQ ID NO: 2799344 - protein, 29 aa, Entamoeba invadens
MCVTCSVPNCKNCEGGKCKKCSKNYVIQT

SEQ ID NO: 2799345 - protein, 19 aa, Entamoeba invadens
MDADISFAREVYANDNKRD

SEQ ID NO: 2799346 - protein, 29 aa, Entamoeba invadens
MDANEYYKQCGICNGFGIAGSGYPANMLI

SEQ ID NO: 2799347 - protein, 17 aa, Entamoeba invadens
MDCVPRVSNAQCMDALS

SEQ ID NO: 2799348 - protein, 22 aa, Entamoeba invadens
MDDFYFYIFVHLGQFSKVTIEL

SEQ ID NO: 2799349 - protein, 25 aa, Entamoeba invadens
MDDIKEKTCWEIMNLPLDNNINDRV

SEQ ID NO: 2799350 - protein, 17 aa, Entamoeba invadens
MDFYRVIVWFNVDYSTV

SEQ ID NO: 2799351 - protein, 25 aa, Entamoeba invadens
MDHHCPWLGTCVGYRNHKFFVLFLV

SEQ ID NO: 2799352 - protein, 21 aa, Entamoeba invadens
MDISCHMLCIALSLFDSKNAI

SEQ ID NO: 2799353 - protein, 22 aa, Entamoeba invadens
MDKCMMCAAKEKCDKCKENFFL

SEQ ID NO: 2799354 - protein, 21 aa, Entamoeba invadens
MDKGEVLNAFYSMMKILVHLM

SEQ ID NO: 2799355 - protein, 20 aa, Entamoeba invadens
MDMSKVWLLLSESLSTLEAE

SEQ ID NO: 2799356 - protein, 22 aa, Entamoeba invadens
MDNKKFFPLGLYFDQITDTDTS

SEQ ID NO: 2799357 - protein, 19 aa, Entamoeba invadens
MDPEIFKKTFSKISTENCQ

SEQ ID NO: 2799358 - protein, 17 aa, Entamoeba invadens
MDQRVDPSLSITFELMR

SEQ ID NO: 2799359 - protein, 23 aa, Entamoeba invadens
MDSFPFPHYILLNNLNELPNVLA

SEQ ID NO: 2799360 - protein, 34 aa, Entamoeba invadens
MDSLDMLDPILTVFMSFFGVCYLSLSKQELLFVR

SEQ ID NO: 2799361 - protein, 18 aa, Entamoeba invadens
MDSSTLILPFGLELGYNA

SEQ ID NO: 2799362 - protein, 17 aa, Entamoeba invadens
MDVVYSPNANIVAGNNQ

SEQ ID NO: 2799363 - protein, 21 aa, Entamoeba invadens
MDYARLLGIRVFMTEHSLFGL

SEQ ID NO: 2799364 - protein, 17 aa, Entamoeba invadens
MDYKAKFTTEWEKIKKV

SEQ ID NO: 2799365 - protein, 24 aa, Entamoeba invadens
MDYYEILKINVFYMFGYTLLCYFL

SEQ ID NO: 2799366 - protein, 24 aa, Entamoeba invadens
MEAVCNMKYIYGWYSEQCSTNPDK

SEQ ID NO: 2799367 - protein, 21 aa, Entamoeba invadens
MECLHTFRIPLIHRDLKSPNV

SEQ ID NO: 2799368 - protein, 17 aa, Entamoeba invadens
MEFKSNALYSIDTLTLS

SEQ ID NO: 2799369 - protein, 17 aa, Entamoeba invadens
MEGFEWAAQGRLITVFS

SEQ ID NO: 2799370 - protein, 19 aa, Entamoeba invadens
MEGTYLKGGEWGMGASETN

SEQ ID NO: 2799371 - protein, 23 aa, Entamoeba invadens
MEGTYLKGGKWGMGASETNNNVI

SEQ ID NO: 2799372 - protein, 17 aa, Entamoeba invadens
MEIFKKSFSNFIISLHL

SEQ ID NO: 2799373 - protein, 24 aa, Entamoeba invadens
MEIPVNGFRCVTEEVFEGQVVHGI

SEQ ID NO: 2799374 - protein, 20 aa, Entamoeba invadens
MEISGRFVLTQYAFYFIPYV

SEQ ID NO: 2799375 - protein, 21 aa, Entamoeba invadens
MELFLYQIMCNISYLHKNEIL

SEQ ID NO: 2799376 - protein, 17 aa, Entamoeba invadens
MENCIMCTAIDTCEKCK

SEQ ID NO: 2799377 - protein, 20 aa, Entamoeba invadens
MENICVFKMNRSNVVMSVLD

SEQ ID NO: 2799378 - protein, 17 aa, Entamoeba invadens
MENVFKPTINEEMKECV

SEQ ID NO: 2799379 - protein, 24 aa, Entamoeba invadens
MERIRSPFVLGFIGSVVMPDQLCL

SEQ ID NO: 2799380 - protein, 23 aa, Entamoeba invadens
MERIYPIGCFKYTNDTSMKLEVN

SEQ ID NO: 2799381 - protein, 20 aa, Entamoeba invadens
MERKYRIFVLTNRGCAGTVM

SEQ ID NO: 2799382 - protein, 19 aa, Entamoeba invadens
MERTCHGKTIIFCNSPAEV

SEQ ID NO: 2799383 - protein, 18 aa, Entamoeba invadens
METIRSQFIINFIGSAIT

SEQ ID NO: 2799384 - protein, 25 aa, Entamoeba invadens
MEVTTPFQIIWFYKMYTHFLCSLLD

SEQ ID NO: 2799385 - protein, 17 aa, Entamoeba invadens
MEYQISVSGTWSIYTNN

SEQ ID NO: 2799386 - protein, 27 aa, Entamoeba invadens
MEYYDCSFSKLDLCGSGEAEHKCENIE

SEQ ID NO: 2799387 - protein, 29 aa, Entamoeba invadens
MFALSLDWCWEGDVLQCFQKKIKQCDSSF

SEQ ID NO: 2799388 - protein, 21 aa, Entamoeba invadens
MFASFGLKLNKHIPKGLQTDW

SEQ ID NO: 2799389 - protein, 24 aa, Entamoeba invadens
MFCIPQRYFTYFSIPIAFTTFLYI

SEQ ID NO: 2799390 - protein, 24 aa, Entamoeba invadens
MFEGHALDCLDFFTEMMEKNVAIL

SEQ ID NO: 2799391 - protein, 17 aa, Entamoeba invadens
MFEIVNWEEAFQKSDVR

SEQ ID NO: 2799392 - protein, 25 aa, Entamoeba invadens
MFEKHIILRDVVTFVRGIRLSNKAI

SEQ ID NO: 2799393 - protein, 26 aa, Entamoeba invadens
MFEMSLWPLVVLFVFIATTGAIVLFV

SEQ ID NO: 2799394 - protein, 21 aa, Entamoeba invadens
MFENVLKFPVFSPYKGVVGRE

SEQ ID NO: 2799395 - protein, 21 aa, Entamoeba invadens
MFETISWREAFPKSEFKYPWK

SEQ ID NO: 2799396 - protein, 36 aa, Entamoeba invadens
MFETISWREAYPKSEFKFPWKIADFVNGGNRLQKLD

SEQ ID NO: 2799397 - protein, 21 aa, Entamoeba invadens
MFETISWREAYPKSEFKYPWK

SEQ ID NO: 2799398 - protein, 19 aa, Entamoeba invadens
MFETMSWKEAYSHNEFKFP

SEQ ID NO: 2799399 - protein, 18 aa, Entamoeba invadens
MFEVLQWDFVFKKDDERF

SEQ ID NO: 2799400 - protein, 32 aa, Entamoeba invadens
MFFALGFLLCCLWIMGYCRYRKSTDAQARSFA

SEQ ID NO: 2799401 - protein, 33 aa, Entamoeba invadens
MFFALGFLLCCLWIMGYCRYRKSTDAQARSFAV

SEQ ID NO: 2799402 - protein, 24 aa, Entamoeba invadens
MFFDFSVYFYWLVAPVLVKELRAP

SEQ ID NO: 2799403 - protein, 21 aa, Entamoeba invadens
MFFESKFDFVSNIIIKDYSTF

SEQ ID NO: 2799404 - protein, 23 aa, Entamoeba invadens
MFFIVCFWIMFVVAILVMCVLIF

SEQ ID NO: 2799405 - protein, 17 aa, Entamoeba invadens
MFFPLDYLLYGILIGFV

SEQ ID NO: 2799406 - protein, 20 aa, Entamoeba invadens
MFFVTLCFVTLYSKRMALVY

SEQ ID NO: 2799407 - protein, 20 aa, Entamoeba invadens
MFIDFPKYIQMTSLHIVCYH

SEQ ID NO: 2799408 - protein, 17 aa, Entamoeba invadens
MFIFFVVFIGSWVFCGV

SEQ ID NO: 2799409 - protein, 21 aa, Entamoeba invadens
MFIQLIDLFNYYGIRGGLMYM

SEQ ID NO: 2799410 - protein, 17 aa, Entamoeba invadens
MFKKALSKCKYCNKFPT

SEQ ID NO: 2799411 - protein, 21 aa, Entamoeba invadens
MFKTKGGIIVSPYVNTTVSGV

SEQ ID NO: 2799412 - protein, 23 aa, Entamoeba invadens
MFLDGWSIWNGVIGDEFDDKTFI

SEQ ID NO: 2799413 - protein, 34 aa, Entamoeba invadens
MFLECASYVKLRCGVVTMRICEGRNETSCDENQC

SEQ ID NO: 2799414 - protein, 28 aa, Entamoeba invadens
MFMPPELRLDGVIKLKSDVFSYAICMLE

SEQ ID NO: 2799415 - protein, 20 aa, Entamoeba invadens
MFNFGVYFFWLVIPIILKDY

SEQ ID NO: 2799416 - protein, 17 aa, Entamoeba invadens
MFNKGRVKLKWRPVHFI

SEQ ID NO: 2799417 - protein, 18 aa, Entamoeba invadens
MFQNFGIVTEENHIYSGQ

SEQ ID NO: 2799418 - protein, 22 aa, Entamoeba invadens
MFTHWKRFIYVSILILFFQLLD

SEQ ID NO: 2799419 - protein, 22 aa, Entamoeba invadens
MFTIFCSITLGLFYGTVVLRGD

SEQ ID NO: 2799420 - protein, 26 aa, Entamoeba invadens
MFTPIGCLRCAKGYYIDKNNKCSKCN

SEQ ID NO: 2799421 - protein, 24 aa, Entamoeba invadens
MFVFPRYLSIFSIAVFLSTIIIRH

SEQ ID NO: 2799422 - protein, 27 aa, Entamoeba invadens
MFVIMWICLAGRICALYYYNTYFTKWA

SEQ ID NO: 2799423 - protein, 23 aa, Entamoeba invadens
MFVNLCTFALGLFYGTLVISGRG

SEQ ID NO: 2799424 - protein, 24 aa, Entamoeba invadens
MFVQRGSVNIALFIASEKDCQNNT

SEQ ID NO: 2799425 - protein, 17 aa, Entamoeba invadens
MFVRVLGLEGLKITVAN

SEQ ID NO: 2799426 - protein, 18 aa, Entamoeba invadens
MFYILAFFNLLRRPEKAK

SEQ ID NO: 2799427 - protein, 17 aa, Entamoeba invadens
MGDKWFELFEVLLKDVS

SEQ ID NO: 2799428 - protein, 25 aa, Entamoeba invadens
MGEERLCIYPTIGFEDRIELSITKE

SEQ ID NO: 2799429 - protein, 21 aa, Entamoeba invadens
MGELLSMFFGKVVAIIVDVCN

SEQ ID NO: 2799430 - protein, 23 aa, Entamoeba invadens
MGENCVKTGCLMYDSNNICVDCR

SEQ ID NO: 2799431 - protein, 21 aa, Entamoeba invadens
MGFQNLRIAAELTDCSLKGHS

SEQ ID NO: 2799432 - protein, 20 aa, Entamoeba invadens
MGFVAARWVGFDTTVRAGWS

SEQ ID NO: 2799433 - protein, 24 aa, Entamoeba invadens
MGGLTSFYKFSFVPSSSNIIDSSL

SEQ ID NO: 2799434 - protein, 21 aa, Entamoeba invadens
MGIVCAFVILVIVSIIVLIII

SEQ ID NO: 2799435 - protein, 23 aa, Entamoeba invadens
MGKEPVCMFDFLNNVDMNLTDKQ

SEQ ID NO: 2799436 - protein, 20 aa, Entamoeba invadens
MGKNAASWVRSYSQKYEVFY

SEQ ID NO: 2799437 - protein, 30 aa, Entamoeba invadens
MGLLYRKFFGIFPFNLCGRTSSSAFMPDAQ

SEQ ID NO: 2799438 - protein, 32 aa, Entamoeba invadens
MGLPLGFFCCGLSFLFIFFFDRVVATHGGHVS

SEQ ID NO: 2799439 - protein, 25 aa, Entamoeba invadens
MGLVTCDLPPPPALMMEQKQDITCG

SEQ ID NO: 2799440 - protein, 25 aa, Entamoeba invadens
MGMLNCLQCEPGWYLIGQNCYNTTT

SEQ ID NO: 2799441 - protein, 26 aa, Entamoeba invadens
MGNTRAMWNIPQIFDWTVYNKTEKLD

SEQ ID NO: 2799442 - protein, 26 aa, Entamoeba invadens
MGSLFTTLIYCWFKAKKINIVHQNLP

SEQ ID NO: 2799443 - protein, 23 aa, Entamoeba invadens
MGVGVLFPLFAYQFVCLTSVFSQ

SEQ ID NO: 2799444 - protein, 25 aa, Entamoeba invadens
MGVICSFFAIFFVKFVSTIFNTKLY

SEQ ID NO: 2799445 - protein, 25 aa, Entamoeba invadens
MGYCTECKNGFFIRGGDSQECIQCD

SEQ ID NO: 2799446 - protein, 17 aa, Entamoeba invadens
MGYGMVMGYFFAIFTDK

SEQ ID NO: 2799447 - protein, 19 aa, Entamoeba invadens
MGYSNVIDSALSFMFSVSW

SEQ ID NO: 2799448 - protein, 19 aa, Entamoeba invadens
MGYTYFGPMGKRFVITVLS

SEQ ID NO: 2799449 - protein, 27 aa, Entamoeba invadens
MHFAEELLAGIAMGRRSFFQFGVTLEH

SEQ ID NO: 2799450 - protein, 19 aa, Entamoeba invadens
MHSMGYQFFYYVKQNIEAF

SEQ ID NO: 2799451 - protein, 20 aa, Entamoeba invadens
MHYIADIYIGFVFSLFLFKL

SEQ ID NO: 2799452 - protein, 22 aa, Entamoeba invadens
MHYSVDIFIGLLFAFFIFALYH

SEQ ID NO: 2799453 - protein, 19 aa, Entamoeba invadens
MIDFCYFCQIMTIISIFTM

SEQ ID NO: 2799454 - protein, 19 aa, Entamoeba invadens
MIESLRLLANSSLVSQKQF

SEQ ID NO: 2799455 - protein, 19 aa, Entamoeba invadens
MIFIPNSRGIYLKELLLLF

SEQ ID NO: 2799456 - protein, 17 aa, Entamoeba invadens
MIFNLTGLVSFVLVFLV

SEQ ID NO: 2799457 - protein, 17 aa, Entamoeba invadens
MIFRTTSQIAYLFIDGN

SEQ ID NO: 2799458 - protein, 21 aa, Entamoeba invadens
MIFSASFAINFFVRNNSFDLR

SEQ ID NO: 2799459 - protein, 26 aa, Entamoeba invadens
MIFTFSSKRWYFLFVGIHEESNVEVV

SEQ ID NO: 2799460 - protein, 17 aa, Entamoeba invadens
MIGGMIWAFGNLMTVPI

SEQ ID NO: 2799461 - protein, 19 aa, Entamoeba invadens
MIKAWPKWVQMIVGVILAV

SEQ ID NO: 2799462 - protein, 29 aa, Entamoeba invadens
MIKHRLYRFLKRFIKSLCGLMLTLKLYDQ

SEQ ID NO: 2799463 - protein, 22 aa, Entamoeba invadens
MIKKMVCGTECSLDGDMTIGAL

SEQ ID NO: 2799464 - protein, 21 aa, Entamoeba invadens
MIKNAQFPRVRENLREDLKII

SEQ ID NO: 2799465 - protein, 19 aa, Entamoeba invadens
MIKPSFTALVLGKRSKSGN

SEQ ID NO: 2799466 - protein, 17 aa, Entamoeba invadens
MIKQHFGDLVMSIYKEN

SEQ ID NO: 2799467 - protein, 17 aa, Entamoeba invadens
MIKRFGQTIWNYCEVEK

SEQ ID NO: 2799468 - protein, 23 aa, Entamoeba invadens
MIKVHLRTVVKMVDSCHSCYFPE

SEQ ID NO: 2799469 - protein, 17 aa, Entamoeba invadens
MILCCIWSCMASFGFLQ

SEQ ID NO: 2799470 - protein, 24 aa, Entamoeba invadens
MILLVIYLFWLVFSIIRSFSEVRK

SEQ ID NO: 2799471 - protein, 17 aa, Entamoeba invadens
MILTFYRFFTFGIMLVT

SEQ ID NO: 2799472 - protein, 18 aa, Entamoeba invadens
MILYGFSYFWLLTSSDNQ

SEQ ID NO: 2799473 - protein, 32 aa, Entamoeba invadens
MIMHWEFVDKLLFVMFCIWTVYFLYDHIYIGF

SEQ ID NO: 2799474 - protein, 20 aa, Entamoeba invadens
MIMMTIIWVLSMQYAPKTIF

SEQ ID NO: 2799475 - protein, 17 aa, Entamoeba invadens
MINRLFICAICDQKYFR

SEQ ID NO: 2799476 - protein, 24 aa, Entamoeba invadens
MINYVIECRAEFTASNEFLPTFFD

SEQ ID NO: 2799477 - protein, 23 aa, Entamoeba invadens
MIRFNQWFLTFTFILSFILWPYG

SEQ ID NO: 2799478 - protein, 19 aa, Entamoeba invadens
MISIIMFNLMGWDFVGSVT

SEQ ID NO: 2799479 - protein, 29 aa, Entamoeba invadens
MITMMICASCCFFLPFGYQTNLMVMKDGG

SEQ ID NO: 2799480 - protein, 28 aa, Entamoeba invadens
MITSFVCSFGVMFLFTFAFSVYGIAPAL

SEQ ID NO: 2799481 - protein, 22 aa, Entamoeba invadens
MIVIHLFPRLHFLSESIISLTV

SEQ ID NO: 2799482 - protein, 17 aa, Entamoeba invadens
MKADFLGVRLITMGMSF

SEQ ID NO: 2799483 - protein, 17 aa, Entamoeba invadens
MKAGVSIDEIFKQREKF

SEQ ID NO: 2799484 - protein, 17 aa, Entamoeba invadens
MKCAACGEGCMTCSGVA

SEQ ID NO: 2799485 - protein, 19 aa, Entamoeba invadens
MKCDASPVWWVILLAVLAG

SEQ ID NO: 2799486 - protein, 25 aa, Entamoeba invadens
MKCDLSNRWHFDWKCNVTYFTSIGV

SEQ ID NO: 2799487 - protein, 24 aa, Entamoeba invadens
MKCKEYNKRIGMEALKTMFISQAQ

SEQ ID NO: 2799488 - protein, 17 aa, Entamoeba invadens
MKCTVEGCATCEKVDEC

SEQ ID NO: 2799489 - protein, 22 aa, Entamoeba invadens
MKDEICFQKAICLALLGFFGNF

SEQ ID NO: 2799490 - protein, 19 aa, Entamoeba invadens
MKDFCPVLYIPLSSLFQLG

SEQ ID NO: 2799491 - protein, 17 aa, Entamoeba invadens
MKDIKACVIDDVDSTIF

SEQ ID NO: 2799492 - protein, 25 aa, Entamoeba invadens
MKDKMPIESFEFCLQQPLTQTPRYE

SEQ ID NO: 2799493 - protein, 21 aa, Entamoeba invadens
MKDKYIMCHNMSYYVERLFSL

SEQ ID NO: 2799494 - protein, 19 aa, Entamoeba invadens
MKDSLIGCECNYKNGNYSF

SEQ ID NO: 2799495 - protein, 17 aa, Entamoeba invadens
MKEDGCYVCENGYYLSL

SEQ ID NO: 2799496 - protein, 20 aa, Entamoeba invadens
MKELHMEDGALVYSSDSFDA

SEQ ID NO: 2799497 - protein, 29 aa, Entamoeba invadens
MKGWKELRKSTEWKFQYYHNAVIDFVIQF

SEQ ID NO: 2799498 - protein, 20 aa, Entamoeba invadens
MKICSVCSGGTIANMKTNTC

SEQ ID NO: 2799499 - protein, 17 aa, Entamoeba invadens
MKICVTIFVGFAVWAMI

SEQ ID NO: 2799500 - protein, 20 aa, Entamoeba invadens
MKIEIEGIVKKGVFEVVLPE

SEQ ID NO: 2799501 - protein, 18 aa, Entamoeba invadens
MKIIHDMTKGLLYLHKNG

SEQ ID NO: 2799502 - protein, 17 aa, Entamoeba invadens
MKIPYTVWFSESKHTLN

SEQ ID NO: 2799503 - protein, 19 aa, Entamoeba invadens
MKIQFSVVEGCDYYDIRTV

SEQ ID NO: 2799504 - protein, 17 aa, Entamoeba invadens
MKKKVCVNQTRTRRVYS

SEQ ID NO: 2799505 - protein, 22 aa, Entamoeba invadens
MKKKVLRYLVDLMKDSDVLKYF

SEQ ID NO: 2799506 - protein, 18 aa, Entamoeba invadens
MKKKWYFAPRKVSNTFYS

SEQ ID NO: 2799507 - protein, 24 aa, Entamoeba invadens
MKKNRWSLKKATNFVRNCRPIIAP

SEQ ID NO: 2799508 - protein, 25 aa, Entamoeba invadens
MKKRLKFMLDVAMGIMYLHENGILH

SEQ ID NO: 2799509 - protein, 24 aa, Entamoeba invadens
MKKSADVCSIYTLPEDATEKQKKR

SEQ ID NO: 2799510 - protein, 19 aa, Entamoeba invadens
MKLFCKYSIPAVLPEAVIL

SEQ ID NO: 2799511 - protein, 20 aa, Entamoeba invadens
MKLFCQRSIDNFNNNTEAKN

SEQ ID NO: 2799512 - protein, 17 aa, Entamoeba invadens
MKLKIMYDAAKGIEYLH

SEQ ID NO: 2799513 - protein, 21 aa, Entamoeba invadens
MKLKIPSARSGVIKCEMNYVG

SEQ ID NO: 2799514 - protein, 20 aa, Entamoeba invadens
MKLLGVLIFLLIMFYVNGFN

SEQ ID NO: 2799515 - protein, 22 aa, Entamoeba invadens
MKLLLCGFFLYCICGILECFWM

SEQ ID NO: 2799516 - protein, 25 aa, Entamoeba invadens
MKLNEFIRTLILRHRHFLFEGNSQF

SEQ ID NO: 2799517 - protein, 22 aa, Entamoeba invadens
MKLPHLLGSEIYFPSNTTNALP

SEQ ID NO: 2799518 - protein, 19 aa, Entamoeba invadens
MKLRIKMLLDAAKGISYLH

SEQ ID NO: 2799519 - protein, 21 aa, Entamoeba invadens
MKLRVKFCLDAAKGILYLHEN

SEQ ID NO: 2799520 - protein, 25 aa, Entamoeba invadens
MKMKILNDFAVALAFIHENEFIHRD

SEQ ID NO: 2799521 - protein, 19 aa, Entamoeba invadens
MKMKVVLDATRGILYLHEN

SEQ ID NO: 2799522 - protein, 19 aa, Entamoeba invadens
MKMTFPEAFQTVKDKRLCV

SEQ ID NO: 2799523 - protein, 18 aa, Entamoeba invadens
MKNERRFTSILSNKLNKQ

SEQ ID NO: 2799524 - protein, 20 aa, Entamoeba invadens
MKNFECYEQAILIALLNQFC

SEQ ID NO: 2799525 - protein, 17 aa, Entamoeba invadens
MKNGIKVTQLIHGESRD

SEQ ID NO: 2799526 - protein, 21 aa, Entamoeba invadens
MKNGRFDPLLIDFTSMTINTI

SEQ ID NO: 2799527 - protein, 17 aa, Entamoeba invadens
MKNIQFLKMESTYITNF

SEQ ID NO: 2799528 - protein, 17 aa, Entamoeba invadens
MKNRHKWIKLPDAHVPI

SEQ ID NO: 2799529 - protein, 25 aa, Entamoeba invadens
MKNTLIVVGFFAWQMVSIMFFTYFV

SEQ ID NO: 2799530 - protein, 17 aa, Entamoeba invadens
MKNVEEFKKILKTEQKA

SEQ ID NO: 2799531 - protein, 22 aa, Entamoeba invadens
MKNVKSSRVLLFLESLDSKDSY

SEQ ID NO: 2799532 - protein, 21 aa, Entamoeba invadens
MKNYCFCDTYVVGCEKKKAVV

SEQ ID NO: 2799533 - protein, 17 aa, Entamoeba invadens
MKPIKVALVKRTRTVKL

SEQ ID NO: 2799534 - protein, 22 aa, Entamoeba invadens
MKQGYFLAKRDKLYINQISNDG

SEQ ID NO: 2799535 - protein, 17 aa, Entamoeba invadens
MKQMLCVIRECLRESKI

SEQ ID NO: 2799536 - protein, 25 aa, Entamoeba invadens
MKQWITKLWWCTNNLINNTVVLQFM

SEQ ID NO: 2799537 - protein, 28 aa, Entamoeba invadens
MKRGEVDACFSLGCKYCPPHTFRRNHKC

SEQ ID NO: 2799538 - protein, 23 aa, Entamoeba invadens
MKRSNVHFITLLGGVCVSSKEIN

SEQ ID NO: 2799539 - protein, 28 aa, Entamoeba invadens
MKRTTILIWNCRIIFVFFFFLTNQIKAI

SEQ ID NO: 2799540 - protein, 25 aa, Entamoeba invadens
MKRTTRYPLCLSLLNIYNILVSLNL

SEQ ID NO: 2799541 - protein, 18 aa, Entamoeba invadens
MKRVIELPTNNALKVLSL

SEQ ID NO: 2799542 - protein, 18 aa, Entamoeba invadens
MKSCSAVGINRCFPPLLS

SEQ ID NO: 2799543 - protein, 20 aa, Entamoeba invadens
MKSDIGALLASNRNFKMIEN

SEQ ID NO: 2799544 - protein, 24 aa, Entamoeba invadens
MKSKGCLEEVPFQSVVGLMKTLVE

SEQ ID NO: 2799545 - protein, 21 aa, Entamoeba invadens
MKSNALIRPLLFIIKTVLSSY

SEQ ID NO: 2799546 - protein, 19 aa, Entamoeba invadens
MKSNTRWRSINLQYDFIIK

SEQ ID NO: 2799547 - protein, 28 aa, Entamoeba invadens
MKSVANMPWKVFLYKFLNTIVDDLFSFV

SEQ ID NO: 2799548 - protein, 28 aa, Entamoeba invadens
MKSWWTPKKLAGMLFFIAGLLLLINHFG

SEQ ID NO: 2799549 - protein, 26 aa, Entamoeba invadens
MKTDEVCLQLRLKMMRDASKGILYLH

SEQ ID NO: 2799550 - protein, 21 aa, Entamoeba invadens
MKTKICLDASKGILYLHINGI

SEQ ID NO: 2799551 - protein, 21 aa, Entamoeba invadens
MKTKTTIPFLLYGGNADRSVT

SEQ ID NO: 2799552 - protein, 17 aa, Entamoeba invadens
MKTSFVLLSRYPKFLTF

SEQ ID NO: 2799553 - protein, 19 aa, Entamoeba invadens
MKTVGSFTFNNSVLQLDNE

SEQ ID NO: 2799554 - protein, 21 aa, Entamoeba invadens
MKVKKGELVVVIGKVGSGKST

SEQ ID NO: 2799555 - protein, 20 aa, Entamoeba invadens
MKVKLCLDASKGILYLHENG

SEQ ID NO: 2799556 - protein, 19 aa, Entamoeba invadens
MKVQFSVIEGCDYYQVRTV

SEQ ID NO: 2799557 - protein, 18 aa, Entamoeba invadens
MKVRIAFFRFLTRLLEGY

SEQ ID NO: 2799558 - protein, 18 aa, Entamoeba invadens
MKVVFDVDGDYEFLITHV

SEQ ID NO: 2799559 - protein, 23 aa, Entamoeba invadens
MKVYKHVILKNAFQIYKVKEFSL

SEQ ID NO: 2799560 - protein, 34 aa, Entamoeba invadens
MKWLVHFQCRGRFAIQYIKAWIEYIVKNEKDVKN

SEQ ID NO: 2799561 - protein, 18 aa, Entamoeba invadens
MKYAFPLFVQSNVILASS

SEQ ID NO: 2799562 - protein, 17 aa, Entamoeba invadens
MKYGEAAIKMAQTEEEK

SEQ ID NO: 2799563 - protein, 27 aa, Entamoeba invadens
MKYLFFNRWSMLIALLICCVNHFICGS

SEQ ID NO: 2799564 - protein, 21 aa, Entamoeba invadens
MKYVKCGPVDSILTANKDYTA

SEQ ID NO: 2799565 - protein, 17 aa, Entamoeba invadens
MLAHIPLTYPLISLVTY

SEQ ID NO: 2799566 - protein, 19 aa, Entamoeba invadens
MLCTSCVTDDIGIIAMDID

SEQ ID NO: 2799567 - protein, 18 aa, Entamoeba invadens
MLDKFRCDYIIHFYGAVF

SEQ ID NO: 2799568 - protein, 17 aa, Entamoeba invadens
MLDKFRCDYIVHFYGAV

SEQ ID NO: 2799569 - protein, 18 aa, Entamoeba invadens
MLDKFRCDYIVHFYGAVF

SEQ ID NO: 2799570 - protein, 20 aa, Entamoeba invadens
MLDKFRCEYIVHFFGAVFVP

SEQ ID NO: 2799571 - protein, 20 aa, Entamoeba invadens
MLDKFRCEYIVHFYGAVFIP

SEQ ID NO: 2799572 - protein, 18 aa, Entamoeba invadens
MLDKFRCNYIIHFFGACY

SEQ ID NO: 2799573 - protein, 18 aa, Entamoeba invadens
MLDKFRCNYIVHFYGAVF

SEQ ID NO: 2799574 - protein, 19 aa, Entamoeba invadens
MLDKFRSDFIVHFFGACFL

SEQ ID NO: 2799575 - protein, 18 aa, Entamoeba invadens
MLDKFRSDFVVHFYGAVF

SEQ ID NO: 2799576 - protein, 19 aa, Entamoeba invadens
MLDKFRSDYIVNFYGAVFI

SEQ ID NO: 2799577 - protein, 17 aa, Entamoeba invadens
MLDKFRSDYIVYFYGAV

SEQ ID NO: 2799578 - protein, 18 aa, Entamoeba invadens
MLDKFRSDYVVHFYGAVF

SEQ ID NO: 2799579 - protein, 24 aa, Entamoeba invadens
MLDKFRSEYVVHFFGAVFIPTKIC

SEQ ID NO: 2799580 - protein, 18 aa, Entamoeba invadens
MLDKFRSPYIVHFYGAVV

SEQ ID NO: 2799581 - protein, 23 aa, Entamoeba invadens
MLDTIKCEWYCPKISREVSTSKL

SEQ ID NO: 2799582 - protein, 18 aa, Entamoeba invadens
MLECFAWDNPFPKTIYLF

SEQ ID NO: 2799583 - protein, 20 aa, Entamoeba invadens
MLEKVFKPFAEFNVDNSDSC

SEQ ID NO: 2799584 - protein, 20 aa, Entamoeba invadens
MLETGDVFMSRLFKRLKAQV

SEQ ID NO: 2799585 - protein, 18 aa, Entamoeba invadens
MLFDARWMLLAMGMFSIY

SEQ ID NO: 2799586 - protein, 32 aa, Entamoeba invadens
MLFDTPMKFTKLTVGSSMSFAVFKEDLQIENN

SEQ ID NO: 2799587 - protein, 18 aa, Entamoeba invadens
MLFFNFSFGPAIVTLFAA

SEQ ID NO: 2799588 - protein, 30 aa, Entamoeba invadens
MLFIPDLVKVYMIYRFRKIIGSNMDKLNNL

SEQ ID NO: 2799589 - protein, 18 aa, Entamoeba invadens
MLFPRFLSTTYRWFACEE

SEQ ID NO: 2799590 - protein, 25 aa, Entamoeba invadens
MLGDPRLKFLIQLMASSVSGRMMKY

SEQ ID NO: 2799591 - protein, 18 aa, Entamoeba invadens
MLIFFIGTFAHFSGYSLL

SEQ ID NO: 2799592 - protein, 19 aa, Entamoeba invadens
MLIIMCIIIIFKVIEHKKR

SEQ ID NO: 2799593 - protein, 19 aa, Entamoeba invadens
MLIRAGIKIFMITGDKMET

SEQ ID NO: 2799594 - protein, 26 aa, Entamoeba invadens
MLITFSLQGYFCFPLIDYVFFSETSK

SEQ ID NO: 2799595 - protein, 26 aa, Entamoeba invadens
MLKMLPIKQFEKIKVVLRNFAMAGPG

SEQ ID NO: 2799596 - protein, 23 aa, Entamoeba invadens
MLLDGTCTICGTQIADNARVLFT

SEQ ID NO: 2799597 - protein, 18 aa, Entamoeba invadens
MLLFLFFILYEASYVLVY

SEQ ID NO: 2799598 - protein, 17 aa, Entamoeba invadens
MLLNLDYPFIVAFLPID

SEQ ID NO: 2799599 - protein, 24 aa, Entamoeba invadens
MLLSLLFFRFSQFIVSLIIFITTQ

SEQ ID NO: 2799600 - protein, 21 aa, Entamoeba invadens
MLNDLLGLYNHITFLVTTQEE

SEQ ID NO: 2799601 - protein, 24 aa, Entamoeba invadens
MLNRRILRLLLTMSEDSVSVAGKI

SEQ ID NO: 2799602 - protein, 24 aa, Entamoeba invadens
MLPCKHSMCATCIERYMENHNECP

SEQ ID NO: 2799603 - protein, 19 aa, Entamoeba invadens
MLPLIFAGRFIPFLEAPCG

SEQ ID NO: 2799604 - protein, 24 aa, Entamoeba invadens
MLQIPRFNTAIQMKHFNQLRNTIF

SEQ ID NO: 2799605 - protein, 23 aa, Entamoeba invadens
MLQKMRSLFVLEFVGAVLVGEKK

SEQ ID NO: 2799606 - protein, 23 aa, Entamoeba invadens
MLQRPLGFLPMLIVQWTEAKVGI

SEQ ID NO: 2799607 - protein, 21 aa, Entamoeba invadens
MLQYRLSLKSAEDEIATMRTI

SEQ ID NO: 2799608 - protein, 27 aa, Entamoeba invadens
MLSCSRPKYELIIPLTVLGVVLIIVFL

SEQ ID NO: 2799609 - protein, 21 aa, Entamoeba invadens
MLSSIILFWLNKRDLYKHIHN

SEQ ID NO: 2799610 - protein, 18 aa, Entamoeba invadens
MLSVVKWGKIFTDPEFKF

SEQ ID NO: 2799611 - protein, 29 aa, Entamoeba invadens
MLVFLEVRGQLLGFMSKIFDSWVNGNDSL

SEQ ID NO: 2799612 - protein, 21 aa, Entamoeba invadens
MLVKEYFKDLDFVCLQSVSVK

SEQ ID NO: 2799613 - protein, 24 aa, Entamoeba invadens
MLVKFRSEYIVHFFGAVFVPNKVC

SEQ ID NO: 2799614 - protein, 23 aa, Entamoeba invadens
MLVLNGCLMRDCSHLFQSPLANR

SEQ ID NO: 2799615 - protein, 20 aa, Entamoeba invadens
MLYTRGSGCSPVLRHKILAE

SEQ ID NO: 2799616 - protein, 21 aa, Entamoeba invadens
MMCRVRWCPKCESFRPSRSYH

SEQ ID NO: 2799617 - protein, 22 aa, Entamoeba invadens
MMDKMRCPYIINFIGASFTPEH

SEQ ID NO: 2799618 - protein, 31 aa, Entamoeba invadens
MMEIHVTKWDKCFMITFFIVGIFFPPLLLVG

SEQ ID NO: 2799619 - protein, 23 aa, Entamoeba invadens
MMERIRCPFIINFIGSVTTSDTL

SEQ ID NO: 2799620 - protein, 24 aa, Entamoeba invadens
MMFSKSCINFALNININGNSTFTM

SEQ ID NO: 2799621 - protein, 17 aa, Entamoeba invadens
MMGQLYLKAKENGRLVR

SEQ ID NO: 2799622 - protein, 18 aa, Entamoeba invadens
MMIACSFIQKDWMCLLSY

SEQ ID NO: 2799623 - protein, 24 aa, Entamoeba invadens
MMILSGGLWYSAMRKGNKKASVKM

SEQ ID NO: 2799624 - protein, 25 aa, Entamoeba invadens
MMITCISCSLFACMGAMLYIHTRDL

SEQ ID NO: 2799625 - protein, 17 aa, Entamoeba invadens
MMIVCYKDGASHDVFKC

SEQ ID NO: 2799626 - protein, 23 aa, Entamoeba invadens
MMLDSAKGYLIFAHKWHLTQRHQ

SEQ ID NO: 2799627 - protein, 22 aa, Entamoeba invadens
MMLELTSLMAFVLYLVLILLKK

SEQ ID NO: 2799628 - protein, 18 aa, Entamoeba invadens
MMNFSWYGLVVLFQQPHF

SEQ ID NO: 2799629 - protein, 23 aa, Entamoeba invadens
MMRESLRFDKEFSNFENERKSIF

SEQ ID NO: 2799630 - protein, 17 aa, Entamoeba invadens
MMRVWVYSKGFSGMLYW

SEQ ID NO: 2799631 - protein, 17 aa, Entamoeba invadens
MMTCSAFAIFIGALALV

SEQ ID NO: 2799632 - protein, 19 aa, Entamoeba invadens
MMYGFFYYKFIYAKDKRLS

SEQ ID NO: 2799633 - protein, 19 aa, Entamoeba invadens
MMYIILRQFFLLIMNNNKN

SEQ ID NO: 2799634 - protein, 23 aa, Entamoeba invadens
MNALWCLLVMLLIGVSSKTCEAG

SEQ ID NO: 2799635 - protein, 19 aa, Entamoeba invadens
MNCQYSWSNRCLKCEPTTF

SEQ ID NO: 2799636 - protein, 17 aa, Entamoeba invadens
MNDRFCLIIEDGKVLIT

SEQ ID NO: 2799637 - protein, 27 aa, Entamoeba invadens
MNFVGLKHKLFLVGTARLIYVKDSMYQ

SEQ ID NO: 2799638 - protein, 23 aa, Entamoeba invadens
MNGTHRFVMFKRSQVGIIGTFKI

SEQ ID NO: 2799639 - protein, 27 aa, Entamoeba invadens
MNIVYQCLRGIQWVHNRYNLVHRDIKP

SEQ ID NO: 2799640 - protein, 27 aa, Entamoeba invadens
MNKTDGLKTLAYIKARHDEILCIVRSI

SEQ ID NO: 2799641 - protein, 25 aa, Entamoeba invadens
MNKTLLRYGLHNELFCHLENEDVKN

SEQ ID NO: 2799642 - protein, 20 aa, Entamoeba invadens
MNLCSLCSPNSSYVNVGGTC

SEQ ID NO: 2799643 - protein, 19 aa, Entamoeba invadens
MNLFIVINVAIAFLFHFFA

SEQ ID NO: 2799644 - protein, 27 aa, Entamoeba invadens
MNMTYCLSCPPGFYISNNICKTNSELV

SEQ ID NO: 2799645 - protein, 25 aa, Entamoeba invadens
MNNICVSCCSTGNCAFCDENAVESS

SEQ ID NO: 2799646 - protein, 25 aa, Entamoeba invadens
MNNPIEFIRVILLTLTFLSLISFNL

SEQ ID NO: 2799647 - protein, 22 aa, Entamoeba invadens
MNNRGCLTCDIGYYTDSQICFN

SEQ ID NO: 2799648 - protein, 25 aa, Entamoeba invadens
MNNVGCLTCDIGYYTDGQICFECDE

SEQ ID NO: 2799649 - protein, 25 aa, Entamoeba invadens
MNNVIHLYKSVHVEFGKLTKYDSTQ

SEQ ID NO: 2799650 - protein, 17 aa, Entamoeba invadens
MNPPLFLYGTHYSTPAY

SEQ ID NO: 2799651 - protein, 22 aa, Entamoeba invadens
MNSLKTGVDYVYIIREVLVDLV

SEQ ID NO: 2799652 - protein, 23 aa, Entamoeba invadens
MNTQSGFKWSVVTVIVPCAVGTA

SEQ ID NO: 2799653 - protein, 23 aa, Entamoeba invadens
MNYQSCLIHKGLVHTTRHESTNF

SEQ ID NO: 2799654 - protein, 25 aa, Entamoeba invadens
MPDEICGTLAWMAPEILMRKGQTTK

SEQ ID NO: 2799655 - protein, 25 aa, Entamoeba invadens
MPDWYYVVIQGCWKQAAAERYDIKQ

SEQ ID NO: 2799656 - protein, 29 aa, Entamoeba invadens
MPFIVLEENRYFSVESLSVIPLELTSYVV

SEQ ID NO: 2799657 - protein, 18 aa, Entamoeba invadens
MPIWYPVVLFVPALCGII

SEQ ID NO: 2799658 - protein, 21 aa, Entamoeba invadens
MPKTLINVGDFCFSQCHSLEK

SEQ ID NO: 2799659 - protein, 21 aa, Entamoeba invadens
MPLKLSSIIQKCWNQATTERP

SEQ ID NO: 2799660 - protein, 32 aa, Entamoeba invadens
MPLKRKLSALGKWLVLIACVLCLFVVALLVTW

SEQ ID NO: 2799661 - protein, 17 aa, Entamoeba invadens
MPLSRGTAVTGFVFLLG

SEQ ID NO: 2799662 - protein, 25 aa, Entamoeba invadens
MPNLLKVRFCQDIAKGMEYLHENDI

SEQ ID NO: 2799663 - protein, 24 aa, Entamoeba invadens
MPNMIGCALCKEGYYREQSDCVAC

SEQ ID NO: 2799664 - protein, 19 aa, Entamoeba invadens
MPPLFFQVICHLAVTITLV

SEQ ID NO: 2799665 - protein, 21 aa, Entamoeba invadens
MPRIYEGVHMVILIDLNCPAL

SEQ ID NO: 2799666 - protein, 18 aa, Entamoeba invadens
MPRYLYVLMALFIFLYQI

SEQ ID NO: 2799667 - protein, 21 aa, Entamoeba invadens
MPSFYLNCVIAIIMAITPNVM

SEQ ID NO: 2799668 - protein, 25 aa, Entamoeba invadens
MPTREVMKLKGYLLVLIPSFCDFAA

SEQ ID NO: 2799669 - protein, 20 aa, Entamoeba invadens
MPVFSLLGVFTFYATHPDAM

SEQ ID NO: 2799670 - protein, 23 aa, Entamoeba invadens
MPYLELVNDWSLLSINSEMEGLV

SEQ ID NO: 2799671 - protein, 17 aa, Entamoeba invadens
MQFKKGNSTLMIKDNGC

SEQ ID NO: 2799672 - protein, 19 aa, Entamoeba invadens
MQFLFELLDKLKVSKIEHN

SEQ ID NO: 2799673 - protein, 17 aa, Entamoeba invadens
MQFYKTCGTECEKDSND

SEQ ID NO: 2799674 - protein, 19 aa, Entamoeba invadens
MQLATCLFVPTLVFFLFGL

SEQ ID NO: 2799675 - protein, 18 aa, Entamoeba invadens
MQMTFSSPVSVDFVQPSF

SEQ ID NO: 2799676 - protein, 18 aa, Entamoeba invadens
MQNEGFFGYPACIGNDVY

SEQ ID NO: 2799677 - protein, 23 aa, Entamoeba invadens
MQRKVQWSTLRAYVMMKKVMMRD

SEQ ID NO: 2799678 - protein, 35 aa, Entamoeba invadens
MQVILDHMWFYLEIAEKCIIVFVCLAFDKMKRQKN

SEQ ID NO: 2799679 - protein, 21 aa, Entamoeba invadens
MREKGDFWIKNNVEKVITLNS

SEQ ID NO: 2799680 - protein, 24 aa, Entamoeba invadens
MRELGNPCIPYFGSFQNIFEKVLS

SEQ ID NO: 2799681 - protein, 22 aa, Entamoeba invadens
MRFLKCSVGGKVYNTKDGIIDV

SEQ ID NO: 2799682 - protein, 19 aa, Entamoeba invadens
MRFSNIFFIVNTVFTCIPQ

SEQ ID NO: 2799683 - protein, 17 aa, Entamoeba invadens
MRIKLMLDTAKGIQYLH

SEQ ID NO: 2799684 - protein, 17 aa, Entamoeba invadens
MRIKLMLDTARGILYLH

SEQ ID NO: 2799685 - protein, 17 aa, Entamoeba invadens
MRIMGIRGGENIIDPTV

SEQ ID NO: 2799686 - protein, 20 aa, Entamoeba invadens
MRKYLRSIFITHWCATLTYT

SEQ ID NO: 2799687 - protein, 20 aa, Entamoeba invadens
MRMITVWIVSVFIYYAISTN

SEQ ID NO: 2799688 - protein, 23 aa, Entamoeba invadens
MRMNLLLRPTRINKLGNSFMSYD

SEQ ID NO: 2799689 - protein, 25 aa, Entamoeba invadens
MRNQFGEVVKFIYTKDFYPQNVQWL

SEQ ID NO: 2799690 - protein, 24 aa, Entamoeba invadens
MRPRASSCVTCYMTLYCTTKLRGM

SEQ ID NO: 2799691 - protein, 29 aa, Entamoeba invadens
MRRKFVRRPFWLNRILRMRGRRWRGNRRF

SEQ ID NO: 2799692 - protein, 27 aa, Entamoeba invadens
MRSPFRLEVFLAMIVPAFCDFLGGYLM

SEQ ID NO: 2799693 - protein, 21 aa, Entamoeba invadens
MRSSDGSICINCDESCKSCTN

SEQ ID NO: 2799694 - protein, 28 aa, Entamoeba invadens
MRSVYKYAPYIKRYFLATADQVPSYLNA

SEQ ID NO: 2799695 - protein, 18 aa, Entamoeba invadens
MRYDCFKSKQDPELCPQI

SEQ ID NO: 2799696 - protein, 17 aa, Entamoeba invadens
MRYSDIQFTNSIATIVC

SEQ ID NO: 2799697 - protein, 23 aa, Entamoeba invadens
MSAEYLVFFVLAVVMYFSQIVCY

SEQ ID NO: 2799698 - protein, 18 aa, Entamoeba invadens
MSAGGLVLTAIIQVPNSL

SEQ ID NO: 2799699 - protein, 23 aa, Entamoeba invadens
MSAIEIGKLIRARIPQWAKGGLT

SEQ ID NO: 2799700 - protein, 17 aa, Entamoeba invadens
MSANLDVSRLSDTQMSV

SEQ ID NO: 2799701 - protein, 23 aa, Entamoeba invadens
MSATLKAGTAIPVTFKIKMLCTT

SEQ ID NO: 2799702 - protein, 24 aa, Entamoeba invadens
MSCKTCFADNCKKCISNIESTCIE

SEQ ID NO: 2799703 - protein, 17 aa, Entamoeba invadens
MSCVTGFVLSASPSQRC

SEQ ID NO: 2799704 - protein, 21 aa, Entamoeba invadens
MSDAFCYSACSLLTKGLQEKG

SEQ ID NO: 2799705 - protein, 18 aa, Entamoeba invadens
MSDLKITITKSGFDKTIP

SEQ ID NO: 2799706 - protein, 20 aa, Entamoeba invadens
MSEFCLKTEMGYCTECVSGF

SEQ ID NO: 2799707 - protein, 22 aa, Entamoeba invadens
MSESPVCMTDFLAFNYNSETLD

SEQ ID NO: 2799708 - protein, 19 aa, Entamoeba invadens
MSFACGKAVGFLLAGTLSA

SEQ ID NO: 2799709 - protein, 20 aa, Entamoeba invadens
MSFACGKAVGFLSAGTLYGL

SEQ ID NO: 2799710 - protein, 28 aa, Entamoeba invadens
MSFGDKDTKCEFSRVGAINAPYLTIAAL

SEQ ID NO: 2799711 - protein, 17 aa, Entamoeba invadens
MSHVFTFAYQIHVTNGK

SEQ ID NO: 2799712 - protein, 25 aa, Entamoeba invadens
MSIPKKDGLVSWMYYHHNLHNPYFP

SEQ ID NO: 2799713 - protein, 21 aa, Entamoeba invadens
MSITLAWTYKRSLFLIFQTGY

SEQ ID NO: 2799714 - protein, 18 aa, Entamoeba invadens
MSIVYYDGMCQLTIDTSI

SEQ ID NO: 2799715 - protein, 25 aa, Entamoeba invadens
MSKDYCFRCAKNYYFDNTVSGKCLL

SEQ ID NO: 2799716 - protein, 22 aa, Entamoeba invadens
MSKKMYDFICSMWCQKAKERLG

SEQ ID NO: 2799717 - protein, 21 aa, Entamoeba invadens
MSKKWILGSKFGFTTTTKLSK

SEQ ID NO: 2799718 - protein, 19 aa, Entamoeba invadens
MSKLLKLVYGKIEYQIAEM

SEQ ID NO: 2799719 - protein, 17 aa, Entamoeba invadens
MSKMGISSYGWIVVLQQ

SEQ ID NO: 2799720 - protein, 24 aa, Entamoeba invadens
MSKRSSESFFFVSLGDIEDDQHNF

SEQ ID NO: 2799721 - protein, 26 aa, Entamoeba invadens
MSKYAKLCFYCECSVVSESGWVLAMF

SEQ ID NO: 2799722 - protein, 19 aa, Entamoeba invadens
MSLCRKEVIEKFLSQIHSL

SEQ ID NO: 2799723 - protein, 23 aa, Entamoeba invadens
MSLTCKKFSLLISDVTYWHTKLG

SEQ ID NO: 2799724 - protein, 27 aa, Entamoeba invadens
MSLYLGRKILRICPIEYNYDIGCILEQ

SEQ ID NO: 2799725 - protein, 25 aa, Entamoeba invadens
MSLYLGRKILRICPKEYNYDTSCIL

SEQ ID NO: 2799726 - protein, 19 aa, Entamoeba invadens
MSNNLFCYLAVTGYSSTTN

SEQ ID NO: 2799727 - protein, 25 aa, Entamoeba invadens
MSNYCLECGKIVFFENKKRKAALLA

SEQ ID NO: 2799728 - protein, 22 aa, Entamoeba invadens
MSNYDWMSFLGIFFTVAVVAYQ

SEQ ID NO: 2799729 - protein, 25 aa, Entamoeba invadens
MSPECLRGTEGYGYPSDVYSYGVMM

SEQ ID NO: 2799730 - protein, 20 aa, Entamoeba invadens
MSPLYPGKYAKFSISADNTI

SEQ ID NO: 2799731 - protein, 31 aa, Entamoeba invadens
MSQNLRLRVNLDIAKGLALLHSKGFLHLNIK

SEQ ID NO: 2799732 - protein, 18 aa, Entamoeba invadens
MSRLRNPFIANYMGAVTY

SEQ ID NO: 2799733 - protein, 20 aa, Entamoeba invadens
MSSHCIFTIFYRCKKLSTIY

SEQ ID NO: 2799734 - protein, 19 aa, Entamoeba invadens
MSSIFIGSASQLVFTPNAK

SEQ ID NO: 2799735 - protein, 17 aa, Entamoeba invadens
MSSLLLFKNMKVQTGET

SEQ ID NO: 2799736 - protein, 17 aa, Entamoeba invadens
MSSLRFFHYLDYLKQHI

SEQ ID NO: 2799737 - protein, 23 aa, Entamoeba invadens
MSSTKRCLSKLCGNGKKNTYYDY

SEQ ID NO: 2799738 - protein, 18 aa, Entamoeba invadens
MSTANISTFGWKIVLVQP

SEQ ID NO: 2799739 - protein, 26 aa, Entamoeba invadens
MSTDRLYRFDLFVAFDYIGGDAPRYW

SEQ ID NO: 2799740 - protein, 17 aa, Entamoeba invadens
MSTFGWMDMLSICGEFL

SEQ ID NO: 2799741 - protein, 23 aa, Entamoeba invadens
MSTYRGCVVCKAGYMRSSDGSTC

SEQ ID NO: 2799742 - protein, 22 aa, Entamoeba invadens
MSTYRGCVVCKGYMRSFDGSTC

SEQ ID NO: 2799743 - protein, 20 aa, Entamoeba invadens
MSVAFFAAIMNKVCDYFGVY

SEQ ID NO: 2799744 - protein, 17 aa, Entamoeba invadens
MSYKGAEEIQWHEFHDS

SEQ ID NO: 2799745 - protein, 27 aa, Entamoeba invadens
MTAGAALRWIRDMGILKEYNEITEILP

SEQ ID NO: 2799746 - protein, 22 aa, Entamoeba invadens
MTAKLQTLLSLGGHFHETSDTN

SEQ ID NO: 2799747 - protein, 17 aa, Entamoeba invadens
MTAKLTTLLSLGDHFHE

SEQ ID NO: 2799748 - protein, 20 aa, Entamoeba invadens
MTEIRQGLNVYSFKTIEKKL

SEQ ID NO: 2799749 - protein, 20 aa, Entamoeba invadens
MTEQPLRFFKISNYGSLSLK

SEQ ID NO: 2799750 - protein, 17 aa, Entamoeba invadens
MTFDWSHVYTWMRETYG

SEQ ID NO: 2799751 - protein, 19 aa, Entamoeba invadens
MTFFVSTLLVILSMSKTLY

SEQ ID NO: 2799752 - protein, 21 aa, Entamoeba invadens
MTFLLPTWVHTVFNYLAAAGA

SEQ ID NO: 2799753 - protein, 17 aa, Entamoeba invadens
MTFSIEGYFCFPMVDYI

SEQ ID NO: 2799754 - protein, 25 aa, Entamoeba invadens
MTFTKYEFGFCYLFTANKGTSYKYT

SEQ ID NO: 2799755 - protein, 17 aa, Entamoeba invadens
MTGVSPSLFPIISNIIP

SEQ ID NO: 2799756 - protein, 22 aa, Entamoeba invadens
MTHLEHLPKIFVQLPNTLTENF

SEQ ID NO: 2799757 - protein, 18 aa, Entamoeba invadens
MTHNYKWKDMVNEWVEWG

SEQ ID NO: 2799758 - protein, 23 aa, Entamoeba invadens
MTIARLVGGYVLYVFSLVLLPIS

SEQ ID NO: 2799759 - protein, 19 aa, Entamoeba invadens
MTKCAICNTSYFRSNEGTC

SEQ ID NO: 2799760 - protein, 25 aa, Entamoeba invadens
MTKFQLCNVLRFTLFTTPDLTHPIQ

SEQ ID NO: 2799761 - protein, 27 aa, Entamoeba invadens
MTKLLEGMRLYGMMHPINGVLTSASPL

SEQ ID NO: 2799762 - protein, 26 aa, Entamoeba invadens
MTLNCSGLRGVICELIDFGMKRSRRN

SEQ ID NO: 2799763 - protein, 25 aa, Entamoeba invadens
MTLNFKFRAMYDIAHGMYYLHQNDI

SEQ ID NO: 2799764 - protein, 17 aa, Entamoeba invadens
MTLRTAITLLKVGIQIL

SEQ ID NO: 2799765 - protein, 17 aa, Entamoeba invadens
MTLSIQGFFCFPMVDYI

SEQ ID NO: 2799766 - protein, 21 aa, Entamoeba invadens
MTMFEVFQWDFVFKKDDERFQ

SEQ ID NO: 2799767 - protein, 22 aa, Entamoeba invadens
MTMYEAFTWDFAFKNTDVQFKY

SEQ ID NO: 2799768 - protein, 40 aa, Entamoeba invadens
MTMYECFSWSVAYPPEVFKFPWKIAEFVSAGKSLEKRGDM

SEQ ID NO: 2799769 - protein, 24 aa, Entamoeba invadens
MTMYEVLQWDFVFKNDDERFLHVW

SEQ ID NO: 2799770 - protein, 21 aa, Entamoeba invadens
MTNKCNLCFDEHQNSGKCSTT

SEQ ID NO: 2799771 - protein, 17 aa, Entamoeba invadens
MTPMLGMCHDDDSNNRY

SEQ ID NO: 2799772 - protein, 25 aa, Entamoeba invadens
MTSGMPLVKSCVKILMQSAPHDFSI

SEQ ID NO: 2799773 - protein, 23 aa, Entamoeba invadens
MTSVCAPLVFLIILSLLRDFFEQ

SEQ ID NO: 2799774 - protein, 22 aa, Entamoeba invadens
MTTEMFELIKSMWPQDPKDRIT

SEQ ID NO: 2799775 - protein, 17 aa, Entamoeba invadens
MTTKRGSVEIVVSDLNE

SEQ ID NO: 2799776 - protein, 18 aa, Entamoeba invadens
MTVCLAAHEKCKVCAENK

SEQ ID NO: 2799777 - protein, 25 aa, Entamoeba invadens
MTWVWRILIILALELLELSVCMVPA

SEQ ID NO: 2799778 - protein, 23 aa, Entamoeba invadens
MTYADVIVKGFAVSIAIVCTTIC

SEQ ID NO: 2799779 - protein, 23 aa, Entamoeba invadens
MTYADVIVKGFAVSVAIICTTVM

SEQ ID NO: 2799780 - protein, 23 aa, Entamoeba invadens
MTYTFWLFFSFIRTFTERKKLGE

SEQ ID NO: 2799781 - protein, 19 aa, Entamoeba invadens
MVAPLGSTPLFAWSLGNQF

SEQ ID NO: 2799782 - protein, 19 aa, Entamoeba invadens
MVDCLYKTNPSLVITEQTA

SEQ ID NO: 2799783 - protein, 18 aa, Entamoeba invadens
MVEGCWKQDTSARLNFEA

SEQ ID NO: 2799784 - protein, 21 aa, Entamoeba invadens
MVENGILRVKQYASFGSLLLV

SEQ ID NO: 2799785 - protein, 21 aa, Entamoeba invadens
MVFGYSCWKLFDVPVRNLLRK

SEQ ID NO: 2799786 - protein, 20 aa, Entamoeba invadens
MVICVGLCILSVVGTILDEV

SEQ ID NO: 2799787 - protein, 17 aa, Entamoeba invadens
MVIGWSYILLTYILTAL

SEQ ID NO: 2799788 - protein, 26 aa, Entamoeba invadens
MVIMEKRGSISFSKPMMVPTINGIEE

SEQ ID NO: 2799789 - protein, 48 aa, Entamoeba invadens
MVISTVICSLCIAFYFFWKLALCIVVLIPIFGVLLFFDGKLNSANAVP

SEQ ID NO: 2799790 - protein, 28 aa, Entamoeba invadens
MVKLSDECVLEFSVLTGLSLQLTFSVMN

SEQ ID NO: 2799791 - protein, 22 aa, Entamoeba invadens
MVKNTHFLYSFELPPLGITRQI

SEQ ID NO: 2799792 - protein, 17 aa, Entamoeba invadens
MVKQLSKTFGEWSSEYS

SEQ ID NO: 2799793 - protein, 18 aa, Entamoeba invadens
MVKTEKWGLLKKGTLSLY

SEQ ID NO: 2799794 - protein, 39 aa, Entamoeba invadens
MVLFIFKRQASAFVAMIMCVITFIPICYYQVTEESIFKN

SEQ ID NO: 2799795 - protein, 25 aa, Entamoeba invadens
MVLGYIGSLAFIFGIFYILPSSIHD

SEQ ID NO: 2799796 - protein, 22 aa, Entamoeba invadens
MVLYVCIAEFLGFFVGAILAEF

SEQ ID NO: 2799797 - protein, 32 aa, Entamoeba invadens
MVNIKLPLNIEKLHCRLSFYDTNYIKLSADYC

SEQ ID NO: 2799798 - protein, 21 aa, Entamoeba invadens
MVPNIQMGMSISMGLNPFNFI

SEQ ID NO: 2799799 - protein, 18 aa, Entamoeba invadens
MVQWSVFGVYAFVWNVCS

SEQ ID NO: 2799800 - protein, 24 aa, Entamoeba invadens
MVSEKDLLMELLIRMSKKVDKRVG

SEQ ID NO: 2799801 - protein, 18 aa, Entamoeba invadens
MVSICFPASMTRYQTTSI

SEQ ID NO: 2799802 - protein, 19 aa, Entamoeba invadens
MVVFVSQVFIDFFALSTIV

SEQ ID NO: 2799803 - protein, 20 aa, Entamoeba invadens
MVWIPLHFTSSIPFDIVPIT

SEQ ID NO: 2799804 - protein, 24 aa, Entamoeba invadens
MVWSTYRFLLCDFSATSQVVLDRV

SEQ ID NO: 2799805 - protein, 29 aa, Entamoeba invadens
MVYTSVTFFLCFLVCCLVSNLFVEEEQVV

SEQ ID NO: 2799806 - protein, 19 aa, Entamoeba invadens
MWEEYRMRFEGNLCPMTPY

SEQ ID NO: 2799807 - protein, 20 aa, Entamoeba invadens
MWEKDVLILLDIVRDKALIE

SEQ ID NO: 2799808 - protein, 20 aa, Entamoeba invadens
MWILWIMSFMYSFSYVLFWI

SEQ ID NO: 2799809 - protein, 23 aa, Entamoeba invadens
MWNGGSMILYFGHNNFVSVYLFL

SEQ ID NO: 2799810 - protein, 23 aa, Entamoeba invadens
MWSLGCLTAVFYFGVPLFSTKSE

SEQ ID NO: 2799811 - protein, 23 aa, Entamoeba invadens
MWVQVMDRFRILLLSSTEDKNLV

SEQ ID NO: 2799812 - protein, 26 aa, Entamoeba invadens
MYCGATCFFTYFILRHTMEVKQFVIH

SEQ ID NO: 2799813 - protein, 21 aa, Entamoeba invadens
MYCQEAIIWWVILIIVLFIIF

SEQ ID NO: 2799814 - protein, 22 aa, Entamoeba invadens
MYCQEAIIWWVILIIVLFIIFV

SEQ ID NO: 2799815 - protein, 19 aa, Entamoeba invadens
MYCTKCGKYSYATNGKCVE

SEQ ID NO: 2799816 - protein, 20 aa, Entamoeba invadens
MYEAFTWDFAFKNTDVQFKY

SEQ ID NO: 2799817 - protein, 18 aa, Entamoeba invadens
MYEIFTWNEAYPKDHFKF

SEQ ID NO: 2799818 - protein, 36 aa, Entamoeba invadens
MYETFEWRAAYSKDKFKFAWCIADFVSNGNRFEKDD

SEQ ID NO: 2799819 - protein, 20 aa, Entamoeba invadens
MYETFEWREAYSKDKFKFAW

SEQ ID NO: 2799820 - protein, 17 aa, Entamoeba invadens
MYEVFGWCDVYPKEIFK

SEQ ID NO: 2799821 - protein, 24 aa, Entamoeba invadens
MYEVFSWKSAFTEKQFKYAWDIAD

SEQ ID NO: 2799822 - protein, 23 aa, Entamoeba invadens
MYFLMCASVVLSVTLWIFVFINR

SEQ ID NO: 2799823 - protein, 17 aa, Entamoeba invadens
MYIEMVENGILRVKQYA

SEQ ID NO: 2799824 - protein, 17 aa, Entamoeba invadens
MYIGITFFFYFIAQTIV

SEQ ID NO: 2799825 - protein, 23 aa, Entamoeba invadens
MYILGVIICLTMHYLLTKKIRQD

SEQ ID NO: 2799826 - protein, 33 aa, Entamoeba invadens
MYIPNKRQLSLFGRLLAPFGKRFAVVARGGLCT

SEQ ID NO: 2799827 - protein, 22 aa, Entamoeba invadens
MYITFSGFFMVFFTLMTQVKTW

SEQ ID NO: 2799828 - protein, 29 aa, Entamoeba invadens
MYKNIRIGRFEFWASMSYYFKNDTQNKQT

SEQ ID NO: 2799829 - protein, 17 aa, Entamoeba invadens
MYLVITFLYTRVAITYS

SEQ ID NO: 2799830 - protein, 23 aa, Entamoeba invadens
MYMELECNLTLIGATAIEDQLQK

SEQ ID NO: 2799831 - protein, 17 aa, Entamoeba invadens
MYMFEIIGVLIIVVSLC

SEQ ID NO: 2799832 - protein, 23 aa, Entamoeba invadens
MYPICIKGNFSYEAIDDRANESE

SEQ ID NO: 2799833 - protein, 23 aa, Entamoeba invadens
MYPNYHLAANFGLYERVLDHLMP

SEQ ID NO: 2799834 - protein, 20 aa, Entamoeba invadens
MYQVRMRYFDENNKYTGTLY

SEQ ID NO: 2799835 - protein, 20 aa, Entamoeba invadens
MYSSCSECAVVIQGNNNFII

SEQ ID NO: 2799836 - protein, 26 aa, Entamoeba invadens
MYSSDFGDHFMLLSLFLAFRKVGVNR

SEQ ID NO: 2799837 - protein, 22 aa, Entamoeba invadens
MYTECFKLIKTCLQMIQNEGNF

SEQ ID NO: 2799838 - protein, 18 aa, Entamoeba invadens
MYTPLLFVFVHFITSPKG

SEQ ID NO: 2799839 - protein, 24 aa, Entamoeba invadens
MYYNWRPLELPKFVNNIFFQQVEL

SEQ ID NO: 2799840 - protein, 30 aa, Entamoeba invadens
MYYTLPFVYEIRTILDWVFANTSMFYKRWL

SEQ ID NO: 2799841 - protein, 26 aa, Entamoeba invadens
MYYYYLIEWYYLISFNQTQILKNTTT

SEQ ID NO: 2799842 - protein, 32 aa, Entamoeba invadens
NAATRRMLAWKEWLAPRRHLYDRVFISDLRDI

SEQ ID NO: 2799843 - protein, 26 aa, Entamoeba invadens
NACKSGGGCLECKPSYYLMESECVSC

SEQ ID NO: 2799844 - protein, 21 aa, Entamoeba invadens
NADGRGKCINRLCGNRKIDTY

SEQ ID NO: 2799845 - protein, 18 aa, Entamoeba invadens
NADIRFTLNFNTLEKVPL

SEQ ID NO: 2799846 - protein, 18 aa, Entamoeba invadens
NADKVLLFLPGYNYTELS

SEQ ID NO: 2799847 - protein, 24 aa, Entamoeba invadens
NAEKCQDCIAGTVLQNGKCLTIFE

SEQ ID NO: 2799848 - protein, 18 aa, Entamoeba invadens
NAEMPYFVYNLIEELDEE

SEQ ID NO: 2799849 - protein, 24 aa, Entamoeba invadens
NAERCLTCSSAYYMSSDNECLMMS

SEQ ID NO: 2799850 - protein, 20 aa, Entamoeba invadens
NAEVWKFEDIAGITSQGNVL

SEQ ID NO: 2799851 - protein, 17 aa, Entamoeba invadens
NAFCFNTILLILTAFGV

SEQ ID NO: 2799852 - protein, 24 aa, Entamoeba invadens
NAFEEPDCIDGILDDGNELTLKYN

SEQ ID NO: 2799853 - protein, 19 aa, Entamoeba invadens
NAFLLLRVLLLKCSFTRLR

SEQ ID NO: 2799854 - protein, 17 aa, Entamoeba invadens
NAFMFFVTLCFVTLYSK

SEQ ID NO: 2799855 - protein, 23 aa, Entamoeba invadens
NAFPSLCKSSLGICNITYRMVAC

SEQ ID NO: 2799856 - protein, 26 aa, Entamoeba invadens
NAGDAKAMWTYIKYGGYFYFAMVVFF

SEQ ID NO: 2799857 - protein, 17 aa, Entamoeba invadens
NAGSCKNSKCAKQADDG

SEQ ID NO: 2799858 - protein, 25 aa, Entamoeba invadens
NAHYFFKFMLACFQGVLICDIHLYY

SEQ ID NO: 2799859 - protein, 19 aa, Entamoeba invadens
NAIELKDTFVYGTLYESSI

SEQ ID NO: 2799860 - protein, 20 aa, Entamoeba invadens
NAIGNLRDDFSYTVTTTRTG

SEQ ID NO: 2799861 - protein, 18 aa, Entamoeba invadens
NAIKRTTTLFNMSKTNIK

SEQ ID NO: 2799862 - protein, 19 aa, Entamoeba invadens
NAKLRKQFSIFDMKHSNIQ

SEQ ID NO: 2799863 - protein, 22 aa, Entamoeba invadens
NAKRVIAFGVLMFVAIFIFVVL

SEQ ID NO: 2799864 - protein, 21 aa, Entamoeba invadens
NAKSSIKNAIFDRLNYFKNPF

SEQ ID NO: 2799865 - protein, 23 aa, Entamoeba invadens
NALEMFNRLLSAFTLDVHNSLLL

SEQ ID NO: 2799866 - protein, 27 aa, Entamoeba invadens
NALKFETVVSLLYKAAYYNAMLKLLVK

SEQ ID NO: 2799867 - protein, 19 aa, Entamoeba invadens
NALLFEAITTFLMKKVVET

SEQ ID NO: 2799868 - protein, 23 aa, Entamoeba invadens
NALPSFTKSVCPFEMTDRFKLAI

SEQ ID NO: 2799869 - protein, 17 aa, Entamoeba invadens
NALREGGKWFKDDNGKS

SEQ ID NO: 2799870 - protein, 27 aa, Entamoeba invadens
NAMTELLKVRFCQDIAKGMEYLHHNDI

SEQ ID NO: 2799871 - protein, 18 aa, Entamoeba invadens
NANDFAFGFIQNCTPYAD

SEQ ID NO: 2799872 - protein, 45 aa, Entamoeba invadens
NANEVWKSTLFTRAVHFCHIPLCSLAAPLMRIFTTDINFKSIQQS

SEQ ID NO: 2799873 - protein, 20 aa, Entamoeba invadens
NANIKFPLILANKSDFLDIG

SEQ ID NO: 2799874 - protein, 19 aa, Entamoeba invadens
NAQCVQCSVIYGCMECNEN

SEQ ID NO: 2799875 - protein, 18 aa, Entamoeba invadens
NAQMTTIGNYVFKNCKYL

SEQ ID NO: 2799876 - protein, 17 aa, Entamoeba invadens
NASCLNFDISETSHLTP

SEQ ID NO: 2799877 - protein, 24 aa, Entamoeba invadens
NASEIIIWIEPWFLGGILGVGPSL

SEQ ID NO: 2799878 - protein, 32 aa, Entamoeba invadens
NASFKCDVFSFAICILEIWLTKSPYDPDVFAT

SEQ ID NO: 2799879 - protein, 20 aa, Entamoeba invadens
NASQCGFCSDGSYFDTTLKI

SEQ ID NO: 2799880 - protein, 19 aa, Entamoeba invadens
NASWCALKKGINLNTINVF

SEQ ID NO: 2799881 - protein, 25 aa, Entamoeba invadens
NASYTGCYTCTPGYYLNGNSTCNSC

SEQ ID NO: 2799882 - protein, 18 aa, Entamoeba invadens
NATARMFGIISLVFFIIS

SEQ ID NO: 2799883 - protein, 20 aa, Entamoeba invadens
NATCLFGKQCFVGCSNIKSI

SEQ ID NO: 2799884 - protein, 18 aa, Entamoeba invadens
NATCPINTFMYVSSDNIL

SEQ ID NO: 2799885 - protein, 27 aa, Entamoeba invadens
NATDGKCLICAAGYGFDNGVCTLCGDL

SEQ ID NO: 2799886 - protein, 24 aa, Entamoeba invadens
NATERLKYIWIIFALLIKSLIAFY

SEQ ID NO: 2799887 - protein, 24 aa, Entamoeba invadens
NATHCLSCRPILEFLNKDNKCQST

SEQ ID NO: 2799888 - protein, 25 aa, Entamoeba invadens
NATKCGVCYEMVGPVGTLRFRVEDS

SEQ ID NO: 2799889 - protein, 25 aa, Entamoeba invadens
NATLRPGNAMAITFKMKVLCTTSIC

SEQ ID NO: 2799890 - protein, 27 aa, Entamoeba invadens
NATNGKCLICAAGYGFDSGECTLCGDL

SEQ ID NO: 2799891 - protein, 23 aa, Entamoeba invadens
NATPECSSLVFAFTPVSDVINIL

SEQ ID NO: 2799892 - protein, 28 aa, Entamoeba invadens
NATRLRFLGFWICAVLNVFVPKYVSGFD

SEQ ID NO: 2799893 - protein, 19 aa, Entamoeba invadens
NATVCIECEGGLSVSSNGT

SEQ ID NO: 2799894 - protein, 25 aa, Entamoeba invadens
NAVGCAICKVGYYYILKDCRQCETS

SEQ ID NO: 2799895 - protein, 24 aa, Entamoeba invadens
NAVGCAICKVGYYYVSKDCRQCET

SEQ ID NO: 2799896 - protein, 25 aa, Entamoeba invadens
NAVKFEGRVKFSYLIIKSKPISGVY

SEQ ID NO: 2799897 - protein, 19 aa, Entamoeba invadens
NAYKSPVFITNVFINPYGS

SEQ ID NO: 2799898 - protein, 18 aa, Entamoeba invadens
NAYPKSVYMYPWTIADDV

SEQ ID NO: 2799899 - protein, 22 aa, Entamoeba invadens
NAYVKFNLVPTIGQLVVSADFT

SEQ ID NO: 2799900 - protein, 22 aa, Entamoeba invadens
NCAECPIECTSCISNSKCISCT

SEQ ID NO: 2799901 - protein, 28 aa, Entamoeba invadens
NCAHASFGRCIKCERGFYLKGFNCKSLL

SEQ ID NO: 2799902 - protein, 19 aa, Entamoeba invadens
NCAISFKNGKCPVCEDGYF

SEQ ID NO: 2799903 - protein, 18 aa, Entamoeba invadens
NCAKCDNTQCFQCDVDNI

SEQ ID NO: 2799904 - protein, 25 aa, Entamoeba invadens
NCAKCSYDVCSKCKGGYSLEQNMLS

SEQ ID NO: 2799905 - protein, 19 aa, Entamoeba invadens
NCALCNSTLANKNCTSCDK

SEQ ID NO: 2799906 - protein, 21 aa, Entamoeba invadens
NCALIHLLRTIYWASCEPPQS

SEQ ID NO: 2799907 - protein, 21 aa, Entamoeba invadens
NCAQCADDGITCYKCAFNNGN

SEQ ID NO: 2799908 - protein, 17 aa, Entamoeba invadens
NCAYCYNSKCTRCNEGF

SEQ ID NO: 2799909 - protein, 26 aa, Entamoeba invadens
NCDLCTPNECIQCKQGYILSNGQCET

SEQ ID NO: 2799910 - protein, 26 aa, Entamoeba invadens
NCDYLKPEVLLLIIHRLKDGVSDRTA

SEQ ID NO: 2799911 - protein, 24 aa, Entamoeba invadens
NCECMACTIVSVVVLLLVIPFMVV

SEQ ID NO: 2799912 - protein, 24 aa, Entamoeba invadens
NCEKCAIGGCETCETVASAEQCTK

SEQ ID NO: 2799913 - protein, 18 aa, Entamoeba invadens
NCEKCNPNFFVLHVKRII

SEQ ID NO: 2799914 - protein, 24 aa, Entamoeba invadens
NCEKCSLKYGELCDFCDSKKCFNC

SEQ ID NO: 2799915 - protein, 17 aa, Entamoeba invadens
NCEKRYIIENGSGDLGD

SEQ ID NO: 2799916 - protein, 20 aa, Entamoeba invadens
NCEMCMDGKCIKCLDNTIYS

SEQ ID NO: 2799917 - protein, 24 aa, Entamoeba invadens
NCEMYHEFFHFCTATTNSGTTTAD

SEQ ID NO: 2799918 - protein, 24 aa, Entamoeba invadens
NCEVVCMYYIFNIIKEFKEDEDID

SEQ ID NO: 2799919 - protein, 29 aa, Entamoeba invadens
NCEYCTSKEKCILCSSDYYLHEDSCYHST

SEQ ID NO: 2799920 - protein, 25 aa, Entamoeba invadens
NCFKCGKGKCAYCSEGFGLNSQYEC

SEQ ID NO: 2799921 - protein, 21 aa, Entamoeba invadens
NCFYDGVDVFSYICGLINIMF

SEQ ID NO: 2799922 - protein, 24 aa, Entamoeba invadens
NCGETCFCLPGFVPNPSQPNSCKT

SEQ ID NO: 2799923 - protein, 21 aa, Entamoeba invadens
NCGYTVLHYAAFCNDEKVLSA

SEQ ID NO: 2799924 - protein, 25 aa, Entamoeba invadens
NCHNEIGEFILLFLALISGASAFSI

SEQ ID NO: 2799925 - protein, 26 aa, Entamoeba invadens
NCIDCYNERQCLLCEDGYYLQDNGSC

SEQ ID NO: 2799926 - protein, 17 aa, Entamoeba invadens
NCIKCGLLNYSNYKEVY

SEQ ID NO: 2799927 - protein, 26 aa, Entamoeba invadens
NCIKCTEFECILCADNYILSGSVCEK

SEQ ID NO: 2799928 - protein, 29 aa, Entamoeba invadens
NCIKCTNKECVLCANNFVLNNGVCDPKPS

SEQ ID NO: 2799929 - protein, 17 aa, Entamoeba invadens
NCILCEEIAHCASCSQT

SEQ ID NO: 2799930 - protein, 24 aa, Entamoeba invadens
NCILSTMFPYKFDDGTGYLISSQR

SEQ ID NO: 2799931 - protein, 25 aa, Entamoeba invadens
NCIQCTQTTCLQCANGYEMFPHNKC

SEQ ID NO: 2799932 - protein, 19 aa, Entamoeba invadens
NCISCSSGLQLSNGKCSNT

SEQ ID NO: 2799933 - protein, 26 aa, Entamoeba invadens
NCITCSPTWERICIECKTGFYPNTST

SEQ ID NO: 2799934 - protein, 17 aa, Entamoeba invadens
NCIYEMLSNMCYYKKNS

SEQ ID NO: 2799935 - protein, 28 aa, Entamoeba invadens
NCKEFAFGRCMNCSMGYYLNNESPPSCV

SEQ ID NO: 2799936 - protein, 19 aa, Entamoeba invadens
NCKEIKVFLNELRDVKTAA

SEQ ID NO: 2799937 - protein, 24 aa, Entamoeba invadens
NCKKCGVANCKMCNNAETCEECTG

SEQ ID NO: 2799938 - protein, 22 aa, Entamoeba invadens
NCKKYTSFQLVFNRFVRPYLYF

SEQ ID NO: 2799939 - protein, 25 aa, Entamoeba invadens
NCKMCNKNGCILCDDTHSFIIDGVC

SEQ ID NO: 2799940 - protein, 24 aa, Entamoeba invadens
NCKPNVPCEFTFTVTKPMKTPVYV

SEQ ID NO: 2799941 - protein, 23 aa, Entamoeba invadens
NCKQCGQTTFKKCYECETDFRPD

SEQ ID NO: 2799942 - protein, 25 aa, Entamoeba invadens
NCKQCYKDKCLLCDDSLTLLNGMCI

SEQ ID NO: 2799943 - protein, 19 aa, Entamoeba invadens
NCKSCYNATYCTKCPEQYY

SEQ ID NO: 2799944 - protein, 21 aa, Entamoeba invadens
NCKTCATLFGRYCIECNDHFK

SEQ ID NO: 2799945 - protein, 21 aa, Entamoeba invadens
NCKTCATLFGRYCNECNDHFK

SEQ ID NO: 2799946 - protein, 17 aa, Entamoeba invadens
NCKTCAYNKDWCTSCND

SEQ ID NO: 2799947 - protein, 21 aa, Entamoeba invadens
NCKTCRFSYVLIDNQCIKCDS

SEQ ID NO: 2799948 - protein, 28 aa, Entamoeba invadens
NCKTCSTRGSFCLSCYENTFLSESKCII

SEQ ID NO: 2799949 - protein, 25 aa, Entamoeba invadens
NCKVCTKDACTSCTTDSYYVDRNEC

SEQ ID NO: 2799950 - protein, 22 aa, Entamoeba invadens
NCLDSNCIDCSYNSKECLRCQQ

SEQ ID NO: 2799951 - protein, 22 aa, Entamoeba invadens
NCLDSNCIDCSYNSKKCLRCQQ

SEQ ID NO: 2799952 - protein, 24 aa, Entamoeba invadens
NCLECHSIKTCTFCESNHFLLTNS

SEQ ID NO: 2799953 - protein, 19 aa, Entamoeba invadens
NCLECPIGSYSDNEGALSC

SEQ ID NO: 2799954 - protein, 25 aa, Entamoeba invadens
NCLECSNRKCVLCENNNFLNESGDC

SEQ ID NO: 2799955 - protein, 25 aa, Entamoeba invadens
NCLEGDVFYGCFECLSGYFFNSDLD

SEQ ID NO: 2799956 - protein, 19 aa, Entamoeba invadens
NCLKCSSLNLIEGVCGNTD

SEQ ID NO: 2799957 - protein, 21 aa, Entamoeba invadens
NCLKVGYYGCEVCADGYYLSH

SEQ ID NO: 2799958 - protein, 21 aa, Entamoeba invadens
NCLKVGYYGCEVCADGYYLSN

SEQ ID NO: 2799959 - protein, 19 aa, Entamoeba invadens
NCLLAIFIHFIRNRLNSTL

SEQ ID NO: 2799960 - protein, 31 aa, Entamoeba invadens
NCLLIKSNRCLKCMNGFYIRNGVCEPIEKCI

SEQ ID NO: 2799961 - protein, 21 aa, Entamoeba invadens
NCLLINIPNCLRVSSASKCIR

SEQ ID NO: 2799962 - protein, 17 aa, Entamoeba invadens
NCLNCSAGSYSVSGSSN

SEQ ID NO: 2799963 - protein, 30 aa, Entamoeba invadens
NCLRVSSASKCIRCKTGYSVVNGRCQKYDK

SEQ ID NO: 2799964 - protein, 21 aa, Entamoeba invadens
NCLSCKDGILSDGLCYTYDEI

SEQ ID NO: 2799965 - protein, 17 aa, Entamoeba invadens
NCLSCKTGTYLDNYQCL

SEQ ID NO: 2799966 - protein, 17 aa, Entamoeba invadens
NCLSCSVTNSVTKCHNC

SEQ ID NO: 2799967 - protein, 23 aa, Entamoeba invadens
NCLSCTSLKPCEICNVTDYVLKD

SEQ ID NO: 2799968 - protein, 18 aa, Entamoeba invadens
NCLSCYKNYQLINGNCFK

SEQ ID NO: 2799969 - protein, 24 aa, Entamoeba invadens
NCLSNPKVGKGWFLVTNNKIVPKV

SEQ ID NO: 2799970 - protein, 21 aa, Entamoeba invadens
NCLTCLFNSTFCLTCKNGYFV

SEQ ID NO: 2799971 - protein, 20 aa, Entamoeba invadens
NCLTCSLTSQRKCDVCKSNF

SEQ ID NO: 2799972 - protein, 21 aa, Entamoeba invadens
NCLTCTSKACSSCVDGYYLSG

SEQ ID NO: 2799973 - protein, 17 aa, Entamoeba invadens
NCLTCVDLATKCVSCQD

SEQ ID NO: 2799974 - protein, 22 aa, Entamoeba invadens
NCLTCYESSTFCLSCSDNKFLS

SEQ ID NO: 2799975 - protein, 31 aa, Entamoeba invadens
NCLTSSKSGNCFACAEGLHLDGTRSCVSERT

SEQ ID NO: 2799976 - protein, 31 aa, Entamoeba invadens
NCLTSSKSGNCFTCAEGLHLDGTRSCVSEGT

SEQ ID NO: 2799977 - protein, 26 aa, Entamoeba invadens
NCLYWFTTLLCWTAIPFLQSYCSAGD

SEQ ID NO: 2799978 - protein, 23 aa, Entamoeba invadens
NCMGQSPLLLAIKHKHIECINLL

SEQ ID NO: 2799979 - protein, 19 aa, Entamoeba invadens
NCMLPPCNFVIFFNFSYSC

SEQ ID NO: 2799980 - protein, 20 aa, Entamoeba invadens
NCMSCLAGLLYHHSYFSSCY

SEQ ID NO: 2799981 - protein, 18 aa, Entamoeba invadens
NCMTCINTTLCIECEGGF

SEQ ID NO: 2799982 - protein, 24 aa, Entamoeba invadens
NCNKNSYCTLTIKSKNETKISKNY

SEQ ID NO: 2799983 - protein, 26 aa, Entamoeba invadens
NCNLCLYEECTLCKHNFILNNESVCD

SEQ ID NO: 2799984 - protein, 24 aa, Entamoeba invadens
NCNRCSNTTCFQCQKQYIITEQIT

SEQ ID NO: 2799985 - protein, 27 aa, Entamoeba invadens
NCNTCLFNSTFCLSCNNDAFLSDHKCI

SEQ ID NO: 2799986 - protein, 25 aa, Entamoeba invadens
NCNVQNIFGCWRCDNIYYLDKSTKQ

SEQ ID NO: 2799987 - protein, 19 aa, Entamoeba invadens
NCNYKHGFGTCLPTIGKCK

SEQ ID NO: 2799988 - protein, 24 aa, Entamoeba invadens
NCQDCKVTNCKKCSTDGNSCSECT

SEQ ID NO: 2799989 - protein, 23 aa, Entamoeba invadens
NCQKDCRCIDGFITDPKSENDCI

SEQ ID NO: 2799990 - protein, 18 aa, Entamoeba invadens
NCQTCSTQSVGVPMCTTC

SEQ ID NO: 2799991 - protein, 18 aa, Entamoeba invadens
NCQTCSTQSVGVPVCSLC

SEQ ID NO: 2799992 - protein, 18 aa, Entamoeba invadens
NCQTCSTQSVGVPVCTSC

SEQ ID NO: 2799993 - protein, 18 aa, Entamoeba invadens
NCQTCSTQSVGVPVCTTC

SEQ ID NO: 2799994 - protein, 24 aa, Entamoeba invadens
NCRFCSNEKCELCDVNYKINNLGH

SEQ ID NO: 2799995 - protein, 26 aa, Entamoeba invadens
NCRLHLKCLFDERGFCNKCSDGFSLE

SEQ ID NO: 2799996 - protein, 33 aa, Entamoeba invadens
NCSACALDHSRICKTCSYGSYPSPIDGLSCVLC

SEQ ID NO: 2799997 - protein, 18 aa, Entamoeba invadens
NCSCCIDDAILCISLDIK

SEQ ID NO: 2799998 - protein, 18 aa, Entamoeba invadens
NCSICPSSYYSSGGTSLC

SEQ ID NO: 2799999 - protein, 20 aa, Entamoeba invadens
NCSIKDNILLGAKEDQKVTD

SEQ ID NO: 2800000 - protein, 24 aa, Entamoeba invadens
NCSKQFRSVIALTIMASFHVIGAI

SEQ ID NO: 2800001 - protein, 26 aa, Entamoeba invadens
NCSLCTKERCLICSGDTLLSNDVCVF

SEQ ID NO: 2800002 - protein, 19 aa, Entamoeba invadens
NCSNRCYLDLVTSTCISCV

SEQ ID NO: 2800003 - protein, 21 aa, Entamoeba invadens
NCSNVKLNLITANIYTPIRVT

SEQ ID NO: 2800004 - protein, 23 aa, Entamoeba invadens
NCSTCDKLGLGTCQVCKNNNYAQ

SEQ ID NO: 2800005 - protein, 21 aa, Entamoeba invadens
NCSTCFNSTLCLTCNDSNNLV

SEQ ID NO: 2800006 - protein, 20 aa, Entamoeba invadens
NCSTCFNSTLCLTCNNSNNL

SEQ ID NO: 2800007 - protein, 21 aa, Entamoeba invadens
NCSTTAFACGERDQCDPTNSE

SEQ ID NO: 2800008 - protein, 17 aa, Entamoeba invadens
NCTACFDGYGISNSFSC

SEQ ID NO: 2800009 - protein, 19 aa, Entamoeba invadens
NCTACSSGLLEDGTTNCVT

SEQ ID NO: 2800010 - protein, 35 aa, Entamoeba invadens
NCTCGGYSLQIWIHPGVYLGLPFPYPISNKNNQIE

SEQ ID NO: 2800011 - protein, 24 aa, Entamoeba invadens
NCTECKSSFMLKEGVCVECSTSNP

SEQ ID NO: 2800012 - protein, 28 aa, Entamoeba invadens
NCTLCDTLKCTMCQPTYVLVEMSCIYYL

SEQ ID NO: 2800013 - protein, 21 aa, Entamoeba invadens
NCTRLSSIRLPNALPTLSTNC

SEQ ID NO: 2800014 - protein, 23 aa, Entamoeba invadens
NCTSCTNIACNLCETTTGRCTSC

SEQ ID NO: 2800015 - protein, 19 aa, Entamoeba invadens
NCTSCYPGYGLLNGKCEMC

SEQ ID NO: 2800016 - protein, 18 aa, Entamoeba invadens
NCTSCYQDECYTCEANYY

SEQ ID NO: 2800017 - protein, 20 aa, Entamoeba invadens
NCVKCNVTGGYFEDIEMSTP

SEQ ID NO: 2800018 - protein, 21 aa, Entamoeba invadens
NCVLGTIPHCVVYTDKDSCKK

SEQ ID NO: 2800019 - protein, 30 aa, Entamoeba invadens
NCVNCSKMNCLLCDMLGGTLLCFSCAENYY

SEQ ID NO: 2800020 - protein, 20 aa, Entamoeba invadens
NCVTCSVDSSRVCTTCKSGL

SEQ ID NO: 2800021 - protein, 25 aa, Entamoeba invadens
NCYLCSNKKCLKCNDDFFLDNESVC

SEQ ID NO: 2800022 - protein, 17 aa, Entamoeba invadens
NCYPCVLPCATCSGQYN

SEQ ID NO: 2800023 - protein, 20 aa, Entamoeba invadens
NDADCKVFADDGCGTEKKST

SEQ ID NO: 2800024 - protein, 21 aa, Entamoeba invadens
NDAFCLSVVSYACPIPDGMYL

SEQ ID NO: 2800025 - protein, 23 aa, Entamoeba invadens
NDCDVSNCKYCPNDRSVCEKCQS

SEQ ID NO: 2800026 - protein, 23 aa, Entamoeba invadens
NDCDVSNCKYCPNDRSVCEVCQS

SEQ ID NO: 2800027 - protein, 21 aa, Entamoeba invadens
NDCLSCKPGYLLIPKENSSYY

SEQ ID NO: 2800028 - protein, 19 aa, Entamoeba invadens
NDCNLCKNGYVWNTNKCES

SEQ ID NO: 2800029 - protein, 21 aa, Entamoeba invadens
NDCNLCKSGYVWNINKCESVL

SEQ ID NO: 2800030 - protein, 17 aa, Entamoeba invadens
NDCQLFYITKLNIIKCL

SEQ ID NO: 2800031 - protein, 17 aa, Entamoeba invadens
NDCVDGFVPYGTSTEDI

SEQ ID NO: 2800032 - protein, 17 aa, Entamoeba invadens
NDCVKCPTGCDRCENNA

SEQ ID NO: 2800033 - protein, 21 aa, Entamoeba invadens
NDCYDPSLKKGLILQIDSPTY

SEQ ID NO: 2800034 - protein, 23 aa, Entamoeba invadens
NDDKNCYTCISGYYPDNEGKCQK

SEQ ID NO: 2800035 - protein, 22 aa, Entamoeba invadens
NDDSPICRVCRDGFYFKDKKCV

SEQ ID NO: 2800036 - protein, 28 aa, Entamoeba invadens
NDECPKFKLSFFYLQAFVKTVLTIPNYT

SEQ ID NO: 2800037 - protein, 20 aa, Entamoeba invadens
NDFEACLTPDITAKIVITHT

SEQ ID NO: 2800038 - protein, 25 aa, Entamoeba invadens
NDFGCKTCSSGFFFVNKRCVFCSTK

SEQ ID NO: 2800039 - protein, 24 aa, Entamoeba invadens
NDFRVRFSKLLGFEFKSVNATDAL

SEQ ID NO: 2800040 - protein, 17 aa, Entamoeba invadens
NDFTCLFSLTKNSSFVV

SEQ ID NO: 2800041 - protein, 26 aa, Entamoeba invadens
NDGIFNWKKALLVLFQGFLMAFLAVC

SEQ ID NO: 2800042 - protein, 22 aa, Entamoeba invadens
NDGSCLYCATVMHGEGVSNVYL

SEQ ID NO: 2800043 - protein, 24 aa, Entamoeba invadens
NDGVCLSCPAGQYLSQNGCLSCAD

SEQ ID NO: 2800044 - protein, 18 aa, Entamoeba invadens
NDGYYLKLVDNIETGIPS

SEQ ID NO: 2800045 - protein, 19 aa, Entamoeba invadens
NDHPSWMFDYSISNNNEKS

SEQ ID NO: 2800046 - protein, 18 aa, Entamoeba invadens
NDIEGWRNLVKRGLLEAK

SEQ ID NO: 2800047 - protein, 28 aa, Entamoeba invadens
NDISKPRFCFEAIPEFYSCSPLFTNEKN

SEQ ID NO: 2800048 - protein, 23 aa, Entamoeba invadens
NDKCRYMDGSNCITCITGNSNNK

SEQ ID NO: 2800049 - protein, 18 aa, Entamoeba invadens
NDKFWKGFTGDYFFESVC

SEQ ID NO: 2800050 - protein, 18 aa, Entamoeba invadens
NDKLMVIVSLTIMFGIFI

SEQ ID NO: 2800051 - protein, 24 aa, Entamoeba invadens
NDKSTRGLNLFFIDGRKKEEHLGG

SEQ ID NO: 2800052 - protein, 24 aa, Entamoeba invadens
NDKYCLYHQLGIGCIQCYNSITST

SEQ ID NO: 2800053 - protein, 24 aa, Entamoeba invadens
NDLLPMCLFIVIVVSILFLFIDYR

SEQ ID NO: 2800054 - protein, 24 aa, Entamoeba invadens
NDLMKRSKCDLADTALYVESDTPN

SEQ ID NO: 2800055 - protein, 25 aa, Entamoeba invadens
NDLVPIFLERLFAFPLDKLNISYKM

SEQ ID NO: 2800056 - protein, 24 aa, Entamoeba invadens
NDNAIECGNGFYLDDGICKECSSK

SEQ ID NO: 2800057 - protein, 20 aa, Entamoeba invadens
NDNFLLVAMKNYRIVFYLFQ

SEQ ID NO: 2800058 - protein, 18 aa, Entamoeba invadens
NDNVKNWNPFFLTFSNLG

SEQ ID NO: 2800059 - protein, 22 aa, Entamoeba invadens
NDNYYITLGFDFSDHTVARIKG

SEQ ID NO: 2800060 - protein, 26 aa, Entamoeba invadens
NDPKHCFGPTLFLVFSAIAFSVSALI

SEQ ID NO: 2800061 - protein, 22 aa, Entamoeba invadens
NDPQYKVSLWVSSLEGAEQASL

SEQ ID NO: 2800062 - protein, 18 aa, Entamoeba invadens
NDQCIPRYPLTCQEYDLF

SEQ ID NO: 2800063 - protein, 17 aa, Entamoeba invadens
NDQRYSLDVSKLEKLGW

SEQ ID NO: 2800064 - protein, 21 aa, Entamoeba invadens
NDRCIRCEHGYYVSDDKCMTC

SEQ ID NO: 2800065 - protein, 18 aa, Entamoeba invadens
NDRCIRCSPGHYLENGVC

SEQ ID NO: 2800066 - protein, 23 aa, Entamoeba invadens
NDRCIRCSPGHYLENGVCPSCQD

SEQ ID NO: 2800067 - protein, 22 aa, Entamoeba invadens
NDRFDPDLAPSFIVGPRDFLYG

SEQ ID NO: 2800068 - protein, 21 aa, Entamoeba invadens
NDSDHFFCQSLMFEHDTQMTA

SEQ ID NO: 2800069 - protein, 24 aa, Entamoeba invadens
NDTCTAFVRMLFVAIIGLKSAPFM

SEQ ID NO: 2800070 - protein, 26 aa, Entamoeba invadens
NDTFKFPWKIAEFVIHGNRLKRKDPI

SEQ ID NO: 2800071 - protein, 25 aa, Entamoeba invadens
NDTFKFPWKIAEFVIHNNRLKRKDP

SEQ ID NO: 2800072 - protein, 26 aa, Entamoeba invadens
NDTFKFPWKIAEFVIHNNRLKRKDPI

SEQ ID NO: 2800073 - protein, 17 aa, Entamoeba invadens
NDTKICTYLNVLLLEAC

SEQ ID NO: 2800074 - protein, 17 aa, Entamoeba invadens
NDTRITIAQVYIVYTIT

SEQ ID NO: 2800075 - protein, 24 aa, Entamoeba invadens
NDTTKLLWRLARVIDNSAEGSKIP

SEQ ID NO: 2800076 - protein, 18 aa, Entamoeba invadens
NDVCSGVVSSIHVSVKTG

SEQ ID NO: 2800077 - protein, 24 aa, Entamoeba invadens
NDVDEFKLVFSMVGVLTGIVNFNI

SEQ ID NO: 2800078 - protein, 18 aa, Entamoeba invadens
NDVGKFYMRFVGVPVGTK

SEQ ID NO: 2800079 - protein, 18 aa, Entamoeba invadens
NDVLSCGKFFEKLNELTN

SEQ ID NO: 2800080 - protein, 20 aa, Entamoeba invadens
NDWCEVNGVISWYNNVEKCF

SEQ ID NO: 2800081 - protein, 26 aa, Entamoeba invadens
NDWIDCLKELSARVNVSLAKIPKQTV

SEQ ID NO: 2800082 - protein, 17 aa, Entamoeba invadens
NDYEVIAMKEWYLKETK

SEQ ID NO: 2800083 - protein, 26 aa, Entamoeba invadens
NDYFCLNCNINFYMIIGVCYSCEGCN

SEQ ID NO: 2800084 - protein, 22 aa, Entamoeba invadens
NDYKKCTRCDFDYGSVTSDNNC

SEQ ID NO: 2800085 - protein, 29 aa, Entamoeba invadens
NDYLELMTLCWKKQPVFRPDFAEVCQLLS

SEQ ID NO: 2800086 - protein, 23 aa, Entamoeba invadens
NDYRLVGSLFFFRGQLLNDVLSN

SEQ ID NO: 2800087 - protein, 17 aa, Entamoeba invadens
NDYSIGIRVKYGDFVYV

SEQ ID NO: 2800088 - protein, 29 aa, Entamoeba invadens
NDYSIGLRIKYGNFVYCTAGDLGGKYTTQ

SEQ ID NO: 2800089 - protein, 18 aa, Entamoeba invadens
NDYSISLRIQVGDFVYFT

SEQ ID NO: 2800090 - protein, 28 aa, Entamoeba invadens
NDYSYYYSYCPLKLYTNSSFTLNGNGIA

SEQ ID NO: 2800091 - protein, 30 aa, Entamoeba invadens
NDYSYYYSYCSLKLYINSSFTLNRHGVAQI

SEQ ID NO: 2800092 - protein, 21 aa, Entamoeba invadens
NEAKHLGVFFGDITEKLMFWC

SEQ ID NO: 2800093 - protein, 20 aa, Entamoeba invadens
NEAKITFKPTFKIDIGSDVY

SEQ ID NO: 2800094 - protein, 23 aa, Entamoeba invadens
NECKLCGNGCKLCYSVTGQIDKT

SEQ ID NO: 2800095 - protein, 18 aa, Entamoeba invadens
NECLKDTIIGCLRCVDGT

SEQ ID NO: 2800096 - protein, 22 aa, Entamoeba invadens
NECQGFANVIGLFITTGNDTKL

SEQ ID NO: 2800097 - protein, 18 aa, Entamoeba invadens
NECTQCKEPAYAFDCHSC

SEQ ID NO: 2800098 - protein, 17 aa, Entamoeba invadens
NECVKCYNDNFEVSKGK

SEQ ID NO: 2800099 - protein, 29 aa, Entamoeba invadens
NEDEKRLQFCINLDFSLHFHSLPIYYSQS

SEQ ID NO: 2800100 - protein, 23 aa, Entamoeba invadens
NEDIKYALLVEGIRVEKEIKKAA

SEQ ID NO: 2800101 - protein, 25 aa, Entamoeba invadens
NEDLKKVAIRYMFDVDNWIGSKDCL

SEQ ID NO: 2800102 - protein, 23 aa, Entamoeba invadens
NEDVCIKCASGYVIDNGQCTTNK

SEQ ID NO: 2800103 - protein, 17 aa, Entamoeba invadens
NEECIRGSLGCTDNCFC

SEQ ID NO: 2800104 - protein, 25 aa, Entamoeba invadens
NEEEMFKFLYFWKNSTVVVYDTSKS

SEQ ID NO: 2800105 - protein, 17 aa, Entamoeba invadens
NEEISRSLILIAKERSR

SEQ ID NO: 2800106 - protein, 21 aa, Entamoeba invadens
NEEMSHTVLLLAKKAGQTRVN

SEQ ID NO: 2800107 - protein, 20 aa, Entamoeba invadens
NEESPVFCVCFTRFELLQYP

SEQ ID NO: 2800108 - protein, 28 aa, Entamoeba invadens
NEFCLIRGCWDFNKANRMTITTVLEHLL

SEQ ID NO: 2800109 - protein, 21 aa, Entamoeba invadens
NEFCPKCKIYATIYLGNELAN

SEQ ID NO: 2800110 - protein, 17 aa, Entamoeba invadens
NEFDLEQDIGWRCANTQ

SEQ ID NO: 2800111 - protein, 19 aa, Entamoeba invadens
NEFDLEQDIGWRCANTQEE

SEQ ID NO: 2800112 - protein, 22 aa, Entamoeba invadens
NEFLPTFFDLFFKKMTSQEIDT

SEQ ID NO: 2800113 - protein, 22 aa, Entamoeba invadens
NEFNMSSGFSVYFDVETVIKKL

SEQ ID NO: 2800114 - protein, 20 aa, Entamoeba invadens
NEFSDYRFSLITYSKKTEKN

SEQ ID NO: 2800115 - protein, 24 aa, Entamoeba invadens
NEICPNLRLRKNWNPCQTHIESTY

SEQ ID NO: 2800116 - protein, 26 aa, Entamoeba invadens
NEIDMKLRVKICLDAAKGILYLHENG

SEQ ID NO: 2800117 - protein, 24 aa, Entamoeba invadens
NEIECPYWLAQEVICGEPFTQKSD

SEQ ID NO: 2800118 - protein, 25 aa, Entamoeba invadens
NEIIKLRYSAFQSMREHTKTKQQVR

SEQ ID NO: 2800119 - protein, 18 aa, Entamoeba invadens
NEIKCLICEHNFILNGNT

SEQ ID NO: 2800120 - protein, 18 aa, Entamoeba invadens
NEIKCLICEHNFVLNGNT

SEQ ID NO: 2800121 - protein, 21 aa, Entamoeba invadens
NEKCCFSENYILTRTCSVVSD

SEQ ID NO: 2800122 - protein, 17 aa, Entamoeba invadens
NEKCISCITGYYPDSNG

SEQ ID NO: 2800123 - protein, 20 aa, Entamoeba invadens
NEKCTSCDDTFVLKNHMCVY

SEQ ID NO: 2800124 - protein, 20 aa, Entamoeba invadens
NEKCVSCGEGCLTCADSGNC

SEQ ID NO: 2800125 - protein, 23 aa, Entamoeba invadens
NEKFADVINACWQQNPHDRILID

SEQ ID NO: 2800126 - protein, 18 aa, Entamoeba invadens
NEKGCLGGGVGTYYSLGQ

SEQ ID NO: 2800127 - protein, 18 aa, Entamoeba invadens
NEKGRWYRINGVDQTLDI

SEQ ID NO: 2800128 - protein, 20 aa, Entamoeba invadens
NEKHYKDKTSLYTPKESETK

SEQ ID NO: 2800129 - protein, 27 aa, Entamoeba invadens
NEKIVLLRRKRLVILKSIEQLAKSLDS

SEQ ID NO: 2800130 - protein, 24 aa, Entamoeba invadens
NEKMPLKFLPLFRVEHVRVCAIPK

SEQ ID NO: 2800131 - protein, 27 aa, Entamoeba invadens
NEKTELLLKCIITFPVNSNMIQEQAKC

SEQ ID NO: 2800132 - protein, 33 aa, Entamoeba invadens
NELCSYDSPYGCQRCSFGYYLNDLICDKCDETC

SEQ ID NO: 2800133 - protein, 26 aa, Entamoeba invadens
NELERVCDVCFSLITGNSMKEEPKPV

SEQ ID NO: 2800134 - protein, 17 aa, Entamoeba invadens
NELILCSPFLVDSEPVI

SEQ ID NO: 2800135 - protein, 20 aa, Entamoeba invadens
NELIPTILSLVVRPTAETVN

SEQ ID NO: 2800136 - protein, 21 aa, Entamoeba invadens
NELKSILPASVNVPLYENGRY

SEQ ID NO: 2800137 - protein, 17 aa, Entamoeba invadens
NELKSIVRSLQFVANET

SEQ ID NO: 2800138 - protein, 24 aa, Entamoeba invadens
NELLFKRHPELFNETSQNSLQNNT

SEQ ID NO: 2800139 - protein, 20 aa, Entamoeba invadens
NELLKLIAVSTYIGNFIKNL

SEQ ID NO: 2800140 - protein, 21 aa, Entamoeba invadens
NELNTKYGEHFGVNKYALMTT

SEQ ID NO: 2800141 - protein, 26 aa, Entamoeba invadens
NELPGIFKSLLPFISQFDQVFRNRKA

SEQ ID NO: 2800142 - protein, 19 aa, Entamoeba invadens
NELPWNCWSSSFEFNEALP

SEQ ID NO: 2800143 - protein, 21 aa, Entamoeba invadens
NELRMAMKVATPPTIPFIGST

SEQ ID NO: 2800144 - protein, 17 aa, Entamoeba invadens
NELRSVFEIKNHVESGK

SEQ ID NO: 2800145 - protein, 21 aa, Entamoeba invadens
NELSLTFKNVYLTNITVQTLK

SEQ ID NO: 2800146 - protein, 19 aa, Entamoeba invadens
NELVFSLDLNERVNGKLAD

SEQ ID NO: 2800147 - protein, 17 aa, Entamoeba invadens
NEMKKKKNFVKINVEEI

SEQ ID NO: 2800148 - protein, 18 aa, Entamoeba invadens
NENCVFCADGYTWNESST

SEQ ID NO: 2800149 - protein, 20 aa, Entamoeba invadens
NENFLIKAVRLHFKSDTVPI

SEQ ID NO: 2800150 - protein, 18 aa, Entamoeba invadens
NENGCLQCESGYFRNSKR

SEQ ID NO: 2800151 - protein, 27 aa, Entamoeba invadens
NENGCLRCLKSYYLVDLTCKPCSSNCN

SEQ ID NO: 2800152 - protein, 24 aa, Entamoeba invadens
NENNCLTCASGTYRNGIYCSVCDT

SEQ ID NO: 2800153 - protein, 23 aa, Entamoeba invadens
NEPLKTRFNCYAHVWDAHLRAYY

SEQ ID NO: 2800154 - protein, 26 aa, Entamoeba invadens
NEPTEKKFAAAIVKFLMWAEKKFGKK

SEQ ID NO: 2800155 - protein, 24 aa, Entamoeba invadens
NEQCARDGIKDCIQQRYGYYLEAT

SEQ ID NO: 2800156 - protein, 25 aa, Entamoeba invadens
NEQNWKCYVVINIGQLIIITLASIV

SEQ ID NO: 2800157 - protein, 22 aa, Entamoeba invadens
NEQRSICKLVLILIFLPILVRE

SEQ ID NO: 2800158 - protein, 17 aa, Entamoeba invadens
NERCFRCQTDFVPSNGY

SEQ ID NO: 2800159 - protein, 21 aa, Entamoeba invadens
NERDAIFMLKTLKGLHLSDLD

SEQ ID NO: 2800160 - protein, 25 aa, Entamoeba invadens
NERFRCPKALFQPSFLVTEPSSIHE

SEQ ID NO: 2800161 - protein, 19 aa, Entamoeba invadens
NERKCFECISGFYPSNKND

SEQ ID NO: 2800162 - protein, 22 aa, Entamoeba invadens
NERKCTLSVCQNETFKEQNGMC

SEQ ID NO: 2800163 - protein, 23 aa, Entamoeba invadens
NERKVLQYWVYNSYLYSQFLRDV

SEQ ID NO: 2800164 - protein, 17 aa, Entamoeba invadens
NESACRNLVKMIDRDNL

SEQ ID NO: 2800165 - protein, 23 aa, Entamoeba invadens
NESAPRHSVDWWVGDVSLDVEVN

SEQ ID NO: 2800166 - protein, 26 aa, Entamoeba invadens
NESCLKCPFPCNSCYSSTKCLSCGVG

SEQ ID NO: 2800167 - protein, 23 aa, Entamoeba invadens
NESELYWLLECTGIDCFQISNRY

SEQ ID NO: 2800168 - protein, 17 aa, Entamoeba invadens
NESFFLQNGRCFSCKKS

SEQ ID NO: 2800169 - protein, 20 aa, Entamoeba invadens
NESGKFCEVPTCGNNIINDG

SEQ ID NO: 2800170 - protein, 24 aa, Entamoeba invadens
NESIPQRRSLILPETIMTPSGASY

SEQ ID NO: 2800171 - protein, 21 aa, Entamoeba invadens
NESNVRCSVDIPDCLYTTNNK

SEQ ID NO: 2800172 - protein, 26 aa, Entamoeba invadens
NESRITLPYRLKVRMLQDTARGIELL

SEQ ID NO: 2800173 - protein, 31 aa, Entamoeba invadens
NESSCKICDSKSLLKNGVCTPLNGVILSNND

SEQ ID NO: 2800174 - protein, 22 aa, Entamoeba invadens
NESVSFIKLFGKNCETVDSECV

SEQ ID NO: 2800175 - protein, 23 aa, Entamoeba invadens
NESVWFLTIEVIVGFYGVFDKDM

SEQ ID NO: 2800176 - protein, 17 aa, Entamoeba invadens
NESYKIKICPTHFDLEK

SEQ ID NO: 2800177 - protein, 24 aa, Entamoeba invadens
NETAMVGFFSCEFWNGEHKGVDVP

SEQ ID NO: 2800178 - protein, 23 aa, Entamoeba invadens
NETKWKWGEYKQFHMIGYINQSS

SEQ ID NO: 2800179 - protein, 23 aa, Entamoeba invadens
NETLKHFVPYIGYNERSESRHNL

SEQ ID NO: 2800180 - protein, 21 aa, Entamoeba invadens
NETLSDFFIYIGYNEYNEQRR

SEQ ID NO: 2800181 - protein, 23 aa, Entamoeba invadens
NETSECKMCYSSFDNCKLCQKPY

SEQ ID NO: 2800182 - protein, 23 aa, Entamoeba invadens
NETSECKMCYSSFDNCKLCQKTS

SEQ ID NO: 2800183 - protein, 18 aa, Entamoeba invadens
NETYFRIIEYTFKKHNVD

SEQ ID NO: 2800184 - protein, 17 aa, Entamoeba invadens
NEVAGAVTVYFDKYFTS

SEQ ID NO: 2800185 - protein, 21 aa, Entamoeba invadens
NEVLPNCILMKSFNNTNTCLK

SEQ ID NO: 2800186 - protein, 25 aa, Entamoeba invadens
NEVNIKLKIKFMLDASKGLLYLHEN

SEQ ID NO: 2800187 - protein, 25 aa, Entamoeba invadens
NEVNMKLKIKFMLDASKGLLYLHEN

SEQ ID NO: 2800188 - protein, 24 aa, Entamoeba invadens
NEVPSRLQILVNILTRYILLFSYF

SEQ ID NO: 2800189 - protein, 26 aa, Entamoeba invadens
NEVYCDVCSIGYFPEAVCKNCSEING

SEQ ID NO: 2800190 - protein, 27 aa, Entamoeba invadens
NEVYCDVCSIGYFPEAVCKNCSEINGC

SEQ ID NO: 2800191 - protein, 23 aa, Entamoeba invadens
NEWPFEKMRWFSITTQGVPTYAT

SEQ ID NO: 2800192 - protein, 20 aa, Entamoeba invadens
NEYAHYVVLFLASYTQSNHH

SEQ ID NO: 2800193 - protein, 19 aa, Entamoeba invadens
NEYIVHFFGAVLIPNKICM

SEQ ID NO: 2800194 - protein, 21 aa, Entamoeba invadens
NEYKLIFGSIPFYGTNLQRQL

SEQ ID NO: 2800195 - protein, 21 aa, Entamoeba invadens
NEYKYPWKIADEIVSGNRPHY

SEQ ID NO: 2800196 - protein, 19 aa, Entamoeba invadens
NEYNDCLLCQPLTVDALYS

SEQ ID NO: 2800197 - protein, 25 aa, Entamoeba invadens
NEYTDAFATYFLKLDLFAPENQKLL

SEQ ID NO: 2800198 - protein, 31 aa, Entamoeba invadens
NFAPFFVMNFWTAWEIFKQTYFCIHLITLGL

SEQ ID NO: 2800199 - protein, 18 aa, Entamoeba invadens
NFARMKYLFFNRWSMLIA

SEQ ID NO: 2800200 - protein, 18 aa, Entamoeba invadens
NFASFGICSLFSPLKNLE

SEQ ID NO: 2800201 - protein, 21 aa, Entamoeba invadens
NFCCPHWFHYLQGIGYYCFPD

SEQ ID NO: 2800202 - protein, 24 aa, Entamoeba invadens
NFDEFCNRCSLFLEFNDSTSNSIL

SEQ ID NO: 2800203 - protein, 21 aa, Entamoeba invadens
NFDTFVVFPLCKTEDSQNEGQ

SEQ ID NO: 2800204 - protein, 28 aa, Entamoeba invadens
NFDVLCFNSDLTLRWTNNVYKEHALTYV

SEQ ID NO: 2800205 - protein, 19 aa, Entamoeba invadens
NFEAAFKCCGWKTTRPFPP

SEQ ID NO: 2800206 - protein, 18 aa, Entamoeba invadens
NFELLKGICVCKNGYYLS

SEQ ID NO: 2800207 - protein, 28 aa, Entamoeba invadens
NFESELYISVNFPFPIKLSKHYKTFFAS

SEQ ID NO: 2800208 - protein, 20 aa, Entamoeba invadens
NFFFDGGVFKNCTNDSYYQW

SEQ ID NO: 2800209 - protein, 23 aa, Entamoeba invadens
NFFKCGSAALKIFQERLPEWPAY

SEQ ID NO: 2800210 - protein, 17 aa, Entamoeba invadens
NFFKNIVPILSFAVGGC

SEQ ID NO: 2800211 - protein, 29 aa, Entamoeba invadens
NFFLKNFYEILAFCYQLGVFISRSSLPLF

SEQ ID NO: 2800212 - protein, 23 aa, Entamoeba invadens
NFFLRSVCLYFTLLSDPSQNISD

SEQ ID NO: 2800213 - protein, 23 aa, Entamoeba invadens
NFFLRSVCLYFTLLSDPSRNISD

SEQ ID NO: 2800214 - protein, 17 aa, Entamoeba invadens
NFFSFEVYYVSDRVKTM

SEQ ID NO: 2800215 - protein, 24 aa, Entamoeba invadens
NFFTKGGFFLRSPWGNETWENLNS

SEQ ID NO: 2800216 - protein, 19 aa, Entamoeba invadens
NFFVLCVVGIIYIVYLTKM

SEQ ID NO: 2800217 - protein, 22 aa, Entamoeba invadens
NFGALCLKNVLPSFGTLVSFIM

SEQ ID NO: 2800218 - protein, 21 aa, Entamoeba invadens
NFGVCPLQLFTKNHPKRDVER

SEQ ID NO: 2800219 - protein, 23 aa, Entamoeba invadens
NFKCMKCNDGFYNPPLCIPCAAN

SEQ ID NO: 2800220 - protein, 25 aa, Entamoeba invadens
NFKSFEFLLNIYLKLVYKNKSICII

SEQ ID NO: 2800221 - protein, 25 aa, Entamoeba invadens
NFKTLSCLKYYFLNDSKCYKCYEKY

SEQ ID NO: 2800222 - protein, 19 aa, Entamoeba invadens
NFLAFILIERGFVLNMAMT

SEQ ID NO: 2800223 - protein, 28 aa, Entamoeba invadens
NFLEKECKGFESMLRLYTLVKETRADVL

SEQ ID NO: 2800224 - protein, 21 aa, Entamoeba invadens
NFLHYNIKPANVMLMSTDVND

SEQ ID NO: 2800225 - protein, 24 aa, Entamoeba invadens
NFLIRSVCLYFTLLNDPAHRDSSV

SEQ ID NO: 2800226 - protein, 23 aa, Entamoeba invadens
NFLKAELKVAGDFFENILKRIKN

SEQ ID NO: 2800227 - protein, 18 aa, Entamoeba invadens
NFLMGRVIVFKAINYERL

SEQ ID NO: 2800228 - protein, 26 aa, Entamoeba invadens
NFLNFGVCAIGWYLAAVFLNQDMDIN

SEQ ID NO: 2800229 - protein, 17 aa, Entamoeba invadens
NFLRIAFYIGKPYQTFL

SEQ ID NO: 2800230 - protein, 24 aa, Entamoeba invadens
NFLTKCEQLFCKIRFHCLKDDINE

SEQ ID NO: 2800231 - protein, 17 aa, Entamoeba invadens
NFLVFSINLKDNVSAKL

SEQ ID NO: 2800232 - protein, 17 aa, Entamoeba invadens
NFLVFSLDLNEKMNAKL

SEQ ID NO: 2800233 - protein, 18 aa, Entamoeba invadens
NFMWLSLLGDFLSEIYTF

SEQ ID NO: 2800234 - protein, 24 aa, Entamoeba invadens
NFNCLRNVIGKCIQCIDNYYRSTI

SEQ ID NO: 2800235 - protein, 27 aa, Entamoeba invadens
NFNGAKFPLDWICKIQSLSNEKNKFYV

SEQ ID NO: 2800236 - protein, 26 aa, Entamoeba invadens
NFNRCGICVEVIGPTLKRATCTLVGS

SEQ ID NO: 2800237 - protein, 18 aa, Entamoeba invadens
NFPDCRYNSTAFDLDLSM

SEQ ID NO: 2800238 - protein, 23 aa, Entamoeba invadens
NFPEGISQLIADCWDNDPNKRPK

SEQ ID NO: 2800239 - protein, 20 aa, Entamoeba invadens
NFQGPIVIPIIFEITDKEVV

SEQ ID NO: 2800240 - protein, 20 aa, Entamoeba invadens
NFRNECIERLFNFLNRTYQP

SEQ ID NO: 2800241 - protein, 29 aa, Entamoeba invadens
NFRPISCLKCTLVPAIFRNVDFYNHERLE

SEQ ID NO: 2800242 - protein, 21 aa, Entamoeba invadens
NFSEPMCALYEDFHDKNFYKY

SEQ ID NO: 2800243 - protein, 25 aa, Entamoeba invadens
NFSRKCLICKTNLYPNDSGKCVSCA

SEQ ID NO: 2800244 - protein, 25 aa, Entamoeba invadens
NFSRRCIICNTGVYPNDSGKCVSCG

SEQ ID NO: 2800245 - protein, 24 aa, Entamoeba invadens
NFSSFKKSLACFIKDANENSTDPK

SEQ ID NO: 2800246 - protein, 18 aa, Entamoeba invadens
NFTARTIRDIPFFQVNKV

SEQ ID NO: 2800247 - protein, 18 aa, Entamoeba invadens
NFTCVFENKILIISQSLK

SEQ ID NO: 2800248 - protein, 27 aa, Entamoeba invadens
NFTEFRRYMRLYPRMSLLVNTFYAIFD

SEQ ID NO: 2800249 - protein, 18 aa, Entamoeba invadens
NFTEIQKKVAILFEQATT

SEQ ID NO: 2800250 - protein, 18 aa, Entamoeba invadens
NFTVKVCDFGFAEVVSQA

SEQ ID NO: 2800251 - protein, 18 aa, Entamoeba invadens
NFVCRGCVMRSSGTILVL

SEQ ID NO: 2800252 - protein, 19 aa, Entamoeba invadens
NFVEYFYKFQRLIFDLHDL

SEQ ID NO: 2800253 - protein, 28 aa, Entamoeba invadens
NFVGGFPLLFRVLFHLIKDNYLVEYVNF

SEQ ID NO: 2800254 - protein, 20 aa, Entamoeba invadens
NFVRKLCYNFYDAFSSDKDA

SEQ ID NO: 2800255 - protein, 29 aa, Entamoeba invadens
NFVRLCKSIVVPINYWKIAIVASTVMVCV

SEQ ID NO: 2800256 - protein, 20 aa, Entamoeba invadens
NFVTKLALCLTKDVCASLTE

SEQ ID NO: 2800257 - protein, 20 aa, Entamoeba invadens
NFVYTGVCNKVFKYKPNNRR

SEQ ID NO: 2800258 - protein, 17 aa, Entamoeba invadens
NFWNLYTSVAWLIITGI

SEQ ID NO: 2800259 - protein, 24 aa, Entamoeba invadens
NFYLGYPRCRFINGPNLCTCEGPC

SEQ ID NO: 2800260 - protein, 24 aa, Entamoeba invadens
NGACVKCLPKFYLDGNQCKSCSME

SEQ ID NO: 2800261 - protein, 27 aa, Entamoeba invadens
NGAFECSKCPLGFYSDAVGSKTCKKCE

SEQ ID NO: 2800262 - protein, 19 aa, Entamoeba invadens
NGCAICKDGYFKSNGDCNE

SEQ ID NO: 2800263 - protein, 18 aa, Entamoeba invadens
NGCEVCGMVGNAEQCTNC

SEQ ID NO: 2800264 - protein, 27 aa, Entamoeba invadens
NGCKSCSNDECRICKVTEHYIDYGEKC

SEQ ID NO: 2800265 - protein, 18 aa, Entamoeba invadens
NGCLSCPDQTYSFANSSM

SEQ ID NO: 2800266 - protein, 19 aa, Entamoeba invadens
NGCNKCIKGYYTYKQNQCA

SEQ ID NO: 2800267 - protein, 19 aa, Entamoeba invadens
NGCNKCLRGYHTINDKDCK

SEQ ID NO: 2800268 - protein, 17 aa, Entamoeba invadens
NGCSKCLDGFYNKQNEC

SEQ ID NO: 2800269 - protein, 18 aa, Entamoeba invadens
NGCSKCLDGYYTVNNNEC

SEQ ID NO: 2800270 - protein, 19 aa, Entamoeba invadens
NGCSKCQSGYFIKNSNECE

SEQ ID NO: 2800271 - protein, 22 aa, Entamoeba invadens
NGCSLCSPGYQIVRCNTTDFYC

SEQ ID NO: 2800272 - protein, 20 aa, Entamoeba invadens
NGCSMCADGYYTVNTNECKR

SEQ ID NO: 2800273 - protein, 24 aa, Entamoeba invadens
NGCTKCIEGFYIFKTNQCQICIEN

SEQ ID NO: 2800274 - protein, 18 aa, Entamoeba invadens
NGCTQCSDGYFLYKENQC

SEQ ID NO: 2800275 - protein, 24 aa, Entamoeba invadens
NGCTSCPTSFILKNSECVSMDNIN

SEQ ID NO: 2800276 - protein, 22 aa, Entamoeba invadens
NGCYECRDGYYRIGLSCEMCAI

SEQ ID NO: 2800277 - protein, 17 aa, Entamoeba invadens
NGDCYICDYGYYKHSKT

SEQ ID NO: 2800278 - protein, 18 aa, Entamoeba invadens
NGDGWLLIMNSIQPESAS

SEQ ID NO: 2800279 - protein, 18 aa, Entamoeba invadens
NGDKNCLISFYGKSGQSY

SEQ ID NO: 2800280 - protein, 23 aa, Entamoeba invadens
NGDLPSNLILKVDKLYLKDDTTI

SEQ ID NO: 2800281 - protein, 22 aa, Entamoeba invadens
NGDNCLKCDVGYILSSKECVKK

SEQ ID NO: 2800282 - protein, 22 aa, Entamoeba invadens
NGDNCLKCDVGYYLSSKTCVKK

SEQ ID NO: 2800283 - protein, 25 aa, Entamoeba invadens
NGDYKSAEVIWLYLGEVGYSQCTMS

SEQ ID NO: 2800284 - protein, 24 aa, Entamoeba invadens
NGDYLHHIKFLWSHTDQSSSYPDG

SEQ ID NO: 2800285 - protein, 17 aa, Entamoeba invadens
NGECLKCAYGENCLSCN

SEQ ID NO: 2800286 - protein, 20 aa, Entamoeba invadens
NGENCLKCDVGYILSSNECV

SEQ ID NO: 2800287 - protein, 24 aa, Entamoeba invadens
NGENCLKCDVGYILSYKACKKTDE

SEQ ID NO: 2800288 - protein, 24 aa, Entamoeba invadens
NGERVCTLCVDGYYLLQEGSDLQT

SEQ ID NO: 2800289 - protein, 19 aa, Entamoeba invadens
NGESCVKCYDGYKAEKKRR

SEQ ID NO: 2800290 - protein, 23 aa, Entamoeba invadens
NGETCLKCDTGFYLSGSECSKND

SEQ ID NO: 2800291 - protein, 19 aa, Entamoeba invadens
NGEVCSKCRLPYVLNENFK

SEQ ID NO: 2800292 - protein, 24 aa, Entamoeba invadens
NGFKKYTDCFIKKIPLEEFVLTTL

SEQ ID NO: 2800293 - protein, 32 aa, Entamoeba invadens
NGFLLLRVMFIKCSFTKLKKKIPTILNELITI

SEQ ID NO: 2800294 - protein, 18 aa, Entamoeba invadens
NGFPMSKFVSEIIEKEGK

SEQ ID NO: 2800295 - protein, 20 aa, Entamoeba invadens
NGGCFMCADGYYTHEKSCDE

SEQ ID NO: 2800296 - protein, 24 aa, Entamoeba invadens
NGGCKACGNNCSLCYSTTTDTTIC

SEQ ID NO: 2800297 - protein, 19 aa, Entamoeba invadens
NGGIYVFNISVAKVSISCA

SEQ ID NO: 2800298 - protein, 23 aa, Entamoeba invadens
NGGSCRACPVGTWSHGGYGITSC

SEQ ID NO: 2800299 - protein, 26 aa, Entamoeba invadens
NGIAKRLATDKIIMVLIILCVVVIIL

SEQ ID NO: 2800300 - protein, 24 aa, Entamoeba invadens
NGICTLCVCGFVLNENHICISSDN

SEQ ID NO: 2800301 - protein, 17 aa, Entamoeba invadens
NGIFPLKYCDVQLTPYP

SEQ ID NO: 2800302 - protein, 18 aa, Entamoeba invadens
NGILGPGVECIYGNEGCM

SEQ ID NO: 2800303 - protein, 25 aa, Entamoeba invadens
NGILKCDYCFSGSYIEGGYCYSCSN

SEQ ID NO: 2800304 - protein, 24 aa, Entamoeba invadens
NGKAIPGYVAAIVVDKIEKQEEKD

SEQ ID NO: 2800305 - protein, 22 aa, Entamoeba invadens
NGKCEICPAGTLQSGRVCVTCP

SEQ ID NO: 2800306 - protein, 22 aa, Entamoeba invadens
NGKCEICPAGTYQSGRICVMCP

SEQ ID NO: 2800307 - protein, 26 aa, Entamoeba invadens
NGKCITVPLNMFWKNNITFICSEGYY

SEQ ID NO: 2800308 - protein, 22 aa, Entamoeba invadens
NGKCKICPAGTCTDSKQQYCSS

SEQ ID NO: 2800309 - protein, 19 aa, Entamoeba invadens
NGKCKPCDLTCGGSCDTNT

SEQ ID NO: 2800310 - protein, 23 aa, Entamoeba invadens
NGKCLKCSDGYYLDEGNCRLHLK

SEQ ID NO: 2800311 - protein, 23 aa, Entamoeba invadens
NGKCLSCVTGYFFENGVCNKCNK

SEQ ID NO: 2800312 - protein, 21 aa, Entamoeba invadens
NGKCLTCQFCINCNTQTGCKQ

SEQ ID NO: 2800313 - protein, 19 aa, Entamoeba invadens
NGKCTIPISNCESVLNSKC

SEQ ID NO: 2800314 - protein, 24 aa, Entamoeba invadens
NGKCTLCSVGSGLISDGICKKCEA

SEQ ID NO: 2800315 - protein, 19 aa, Entamoeba invadens
NGKCVKISGFVSEDTILSC

SEQ ID NO: 2800316 - protein, 17 aa, Entamoeba invadens
NGKCVLQSGALLSTNYQ

SEQ ID NO: 2800317 - protein, 23 aa, Entamoeba invadens
NGKCVNCVKGFYLDYNTQMCVST

SEQ ID NO: 2800318 - protein, 21 aa, Entamoeba invadens
NGKCVNCVNGFYFDYNTQTCV

SEQ ID NO: 2800319 - protein, 20 aa, Entamoeba invadens
NGKCVPCGEVVIGCIESSNE

SEQ ID NO: 2800320 - protein, 17 aa, Entamoeba invadens
NGKCVSCNEGYYFTSNQ

SEQ ID NO: 2800321 - protein, 17 aa, Entamoeba invadens
NGKECYNSITIIGVTKQ

SEQ ID NO: 2800322 - protein, 19 aa, Entamoeba invadens
NGKECYNSITIIGVTKQST

SEQ ID NO: 2800323 - protein, 25 aa, Entamoeba invadens
NGKKIALQLLKWINRMNLVSLEDGS

SEQ ID NO: 2800324 - protein, 21 aa, Entamoeba invadens
NGKKLKITTCHRGTNVDTLIT

SEQ ID NO: 2800325 - protein, 19 aa, Entamoeba invadens
NGKLRVCGPSITPGYVSGD

SEQ ID NO: 2800326 - protein, 17 aa, Entamoeba invadens
NGLDCKKCDAQCETCVV

SEQ ID NO: 2800327 - protein, 19 aa, Entamoeba invadens
NGLDCYKCDLSCSLCNTNS

SEQ ID NO: 2800328 - protein, 25 aa, Entamoeba invadens
NGLEAVHLFSGKPLVHLSLRATSDA

SEQ ID NO: 2800329 - protein, 20 aa, Entamoeba invadens
NGLFNSFSIVLLVLFFLLNK

SEQ ID NO: 2800330 - protein, 27 aa, Entamoeba invadens
NGLPISFYLERIFALYIPLYIKCTVAI

SEQ ID NO: 2800331 - protein, 23 aa, Entamoeba invadens
NGMCLTCKVGYGLNNGICSKCEN

SEQ ID NO: 2800332 - protein, 19 aa, Entamoeba invadens
NGMCLTCNDGYYLTSQNTC

SEQ ID NO: 2800333 - protein, 21 aa, Entamoeba invadens
NGMCMKCRNGYYMFDSTCYMC

SEQ ID NO: 2800334 - protein, 19 aa, Entamoeba invadens
NGMSCISCAAFNADCETCD

SEQ ID NO: 2800335 - protein, 18 aa, Entamoeba invadens
NGMSCISCAAFNVDCETC

SEQ ID NO: 2800336 - protein, 17 aa, Entamoeba invadens
NGNCFSCLTGFRQNGYY

SEQ ID NO: 2800337 - protein, 18 aa, Entamoeba invadens
NGNCILNINCIVSNGNSC

SEQ ID NO: 2800338 - protein, 21 aa, Entamoeba invadens
NGNCLKCYTNSYVSNGVCMTC

SEQ ID NO: 2800339 - protein, 19 aa, Entamoeba invadens
NGNCLSCYDGYFLNGKICD

SEQ ID NO: 2800340 - protein, 19 aa, Entamoeba invadens
NGNCLSCYDGYFLNGKMCD

SEQ ID NO: 2800341 - protein, 20 aa, Entamoeba invadens
NGNCLSCYDGYFTSGKICDT

SEQ ID NO: 2800342 - protein, 23 aa, Entamoeba invadens
NGNCRSCLSGYVLTSPVSKVCES

SEQ ID NO: 2800343 - protein, 19 aa, Entamoeba invadens
NGNCSISGSLGCYRCIDGK

SEQ ID NO: 2800344 - protein, 22 aa, Entamoeba invadens
NGNCVLCPLITYYSNLTKGCRP

SEQ ID NO: 2800345 - protein, 19 aa, Entamoeba invadens
NGNCVPIPNSLIIVPQTII

SEQ ID NO: 2800346 - protein, 19 aa, Entamoeba invadens
NGNECKKCNSNCFTCSIEK

SEQ ID NO: 2800347 - protein, 26 aa, Entamoeba invadens
NGNEMIKWSVLVIYGLLYGGVSQFTF

SEQ ID NO: 2800348 - protein, 22 aa, Entamoeba invadens
NGNGDCGTLFAKVLQQVFTEDS

SEQ ID NO: 2800349 - protein, 22 aa, Entamoeba invadens
NGNIFSCLDIWYGCGSCTKEKC

SEQ ID NO: 2800350 - protein, 18 aa, Entamoeba invadens
NGNIRFGFNDTEPIIEDC

SEQ ID NO: 2800351 - protein, 17 aa, Entamoeba invadens
NGNRLRKVDSFNDEQYE

SEQ ID NO: 2800352 - protein, 19 aa, Entamoeba invadens
NGNSKKIFCHLNQFDSKTN

SEQ ID NO: 2800353 - protein, 19 aa, Entamoeba invadens
NGNSKKIFCHLNQFDSTTN

SEQ ID NO: 2800354 - protein, 24 aa, Entamoeba invadens
NGPTSSDCLTCYKYGKMTQTPPNR

SEQ ID NO: 2800355 - protein, 24 aa, Entamoeba invadens
NGQGCAFCKSGYYRSGDGCKVCNE

SEQ ID NO: 2800356 - protein, 25 aa, Entamoeba invadens
NGQIFPFNMFIKFFHSKACGLFNIT

SEQ ID NO: 2800357 - protein, 19 aa, Entamoeba invadens
NGRCVACNPMCRMCVSQPN

SEQ ID NO: 2800358 - protein, 22 aa, Entamoeba invadens
NGRCVFCAKFSVLNESRMCGTS

SEQ ID NO: 2800359 - protein, 24 aa, Entamoeba invadens
NGRCVTCYFNYLLVNEVCTQCEEV

SEQ ID NO: 2800360 - protein, 26 aa, Entamoeba invadens
NGRGCSLCPAGYFSPGGISTCTVCRS

SEQ ID NO: 2800361 - protein, 34 aa, Entamoeba invadens
NGRKGIEIFERIKAKICLTEYKTAYLANYLVALG

SEQ ID NO: 2800362 - protein, 24 aa, Entamoeba invadens
NGRSCLLCAAGYFSNGGTSSCTVC

SEQ ID NO: 2800363 - protein, 18 aa, Entamoeba invadens
NGRYRRFRKYQVIGKKIQ

SEQ ID NO: 2800364 - protein, 25 aa, Entamoeba invadens
NGSEIIGLICRFSFDNFVVAQKKLV

SEQ ID NO: 2800365 - protein, 25 aa, Entamoeba invadens
NGSMKISISIGVVFSLFSSGSLVLM

SEQ ID NO: 2800366 - protein, 18 aa, Entamoeba invadens
NGSSCLPTTCSVTTNTLK

SEQ ID NO: 2800367 - protein, 22 aa, Entamoeba invadens
NGSSVPVKWLFYSLNAFCWNLV

SEQ ID NO: 2800368 - protein, 24 aa, Entamoeba invadens
NGTIFKFTFGTFIAYPNMTNSVNS

SEQ ID NO: 2800369 - protein, 18 aa, Entamoeba invadens
NGTRRHEESYAMGEYYIT

SEQ ID NO: 2800370 - protein, 24 aa, Entamoeba invadens
NGTSCVLCTTFIQNCERCTITTCE

SEQ ID NO: 2800371 - protein, 30 aa, Entamoeba invadens
NGVCAFLMTGCLFLYSNFYGMKIRSMYLAA

SEQ ID NO: 2800372 - protein, 22 aa, Entamoeba invadens
NGVCRKCMTGYFLDGTECKLCS

SEQ ID NO: 2800373 - protein, 18 aa, Entamoeba invadens
NGVCVHFSQILNCISSQN

SEQ ID NO: 2800374 - protein, 21 aa, Entamoeba invadens
NGVDGKSRFYIGLPVDPLCEC

SEQ ID NO: 2800375 - protein, 24 aa, Entamoeba invadens
NGVGCAICKDGYYYDQKFCYECDK

SEQ ID NO: 2800376 - protein, 24 aa, Entamoeba invadens
NGVGCAICKDGYYYDQKFCYKCDK

SEQ ID NO: 2800377 - protein, 23 aa, Entamoeba invadens
NGVGCAICKDGYYYEQKFCYECD

SEQ ID NO: 2800378 - protein, 23 aa, Entamoeba invadens
NGVGCAICKNGYYYEQKFCYECD

SEQ ID NO: 2800379 - protein, 18 aa, Entamoeba invadens
NGVISWYNNVEKCFRDYW

SEQ ID NO: 2800380 - protein, 19 aa, Entamoeba invadens
NGVLYFKESEIILDKAIID

SEQ ID NO: 2800381 - protein, 18 aa, Entamoeba invadens
NGVNKCTNAICGFDTMNS

SEQ ID NO: 2800382 - protein, 24 aa, Entamoeba invadens
NGVPPHLPLTIKFEKVHEFLEFLK

SEQ ID NO: 2800383 - protein, 22 aa, Entamoeba invadens
NGWCITCQIGYYKSGTQCKKCN

SEQ ID NO: 2800384 - protein, 24 aa, Entamoeba invadens
NGWILCVLAIPVGFISGFDLQSNV

SEQ ID NO: 2800385 - protein, 23 aa, Entamoeba invadens
NGYCTGCAVNYVFFETNNVKCQN

SEQ ID NO: 2800386 - protein, 17 aa, Entamoeba invadens
NGYELLDGICKTVCGNK

SEQ ID NO: 2800387 - protein, 23 aa, Entamoeba invadens
NGYLRIAAPFFDYSNLDAAKTPA

SEQ ID NO: 2800388 - protein, 23 aa, Entamoeba invadens
NGYLRIAAPFFDYSNLDAAKTTE

SEQ ID NO: 2800389 - protein, 17 aa, Entamoeba invadens
NGYRPKVNLVIPLAIFN

SEQ ID NO: 2800390 - protein, 19 aa, Entamoeba invadens
NHAKLILTFEGVLYQDEVI

SEQ ID NO: 2800391 - protein, 21 aa, Entamoeba invadens
NHCIPCKAGTAANQETNTCDV

SEQ ID NO: 2800392 - protein, 23 aa, Entamoeba invadens
NHCYPCKAGTLAIQLTNKCNVCP

SEQ ID NO: 2800393 - protein, 18 aa, Entamoeba invadens
NHFICGTVSHWIAQLVCA

SEQ ID NO: 2800394 - protein, 24 aa, Entamoeba invadens
NHHKICGFQNVLVLLLMFWSIFRV

SEQ ID NO: 2800395 - protein, 19 aa, Entamoeba invadens
NHIGIAISILVSFLQLGIS

SEQ ID NO: 2800396 - protein, 17 aa, Entamoeba invadens
NHIVHFYGAVLIPNKYC

SEQ ID NO: 2800397 - protein, 26 aa, Entamoeba invadens
NHIYLCARFPGVYPDILDIINKYCDI

SEQ ID NO: 2800398 - protein, 19 aa, Entamoeba invadens
NHKCYKCGENCISCDSSDT

SEQ ID NO: 2800399 - protein, 23 aa, Entamoeba invadens
NHLHKRAGSTFLPEDSSFLIIEL

SEQ ID NO: 2800400 - protein, 20 aa, Entamoeba invadens
NHLSSFVCCLILILFSVLYP

SEQ ID NO: 2800401 - protein, 21 aa, Entamoeba invadens
NHLVGAFLALFGLFVAFTGVN

SEQ ID NO: 2800402 - protein, 29 aa, Entamoeba invadens
NHPKKVHTTFPFKLLVTGGNFLFMETFVK

SEQ ID NO: 2800403 - protein, 24 aa, Entamoeba invadens
NICLKCKDDFVMKKMECVSYRTIN

SEQ ID NO: 2800404 - protein, 17 aa, Entamoeba invadens
NICVFKMSRSNIVMTKL

SEQ ID NO: 2800405 - protein, 25 aa, Entamoeba invadens
NICVPTCYSGNCKYCSPTNPNTCLE

SEQ ID NO: 2800406 - protein, 21 aa, Entamoeba invadens
NIDGDMCFKGKFAEARTSNLN

SEQ ID NO: 2800407 - protein, 17 aa, Entamoeba invadens
NIECLGTRCPVFANDQM

SEQ ID NO: 2800408 - protein, 27 aa, Entamoeba invadens
NIEGFTRLIWRLTNIRSSDGYIPVTII

SEQ ID NO: 2800409 - protein, 30 aa, Entamoeba invadens
NIFEVLSRMLLDICRKRSVGAASFLALMAY

SEQ ID NO: 2800410 - protein, 19 aa, Entamoeba invadens
NIFGPFCVGGELLLFDGGV

SEQ ID NO: 2800411 - protein, 20 aa, Entamoeba invadens
NIFIGGNCFVLFKEKMTEIH

SEQ ID NO: 2800412 - protein, 18 aa, Entamoeba invadens
NIFRGVMRNLCFDIVPNI

SEQ ID NO: 2800413 - protein, 18 aa, Entamoeba invadens
NIFSCLQVIFSTIYLAQE

SEQ ID NO: 2800414 - protein, 18 aa, Entamoeba invadens
NIFTCICFFFYGLNYLVF

SEQ ID NO: 2800415 - protein, 18 aa, Entamoeba invadens
NIFYSIFIWIAFTLLFVT

SEQ ID NO: 2800416 - protein, 22 aa, Entamoeba invadens
NIGCTKCNYGFYVDNGVCNACD

SEQ ID NO: 2800417 - protein, 22 aa, Entamoeba invadens
NIGCVICDDGFYLKSKICVKCG

SEQ ID NO: 2800418 - protein, 23 aa, Entamoeba invadens
NIGDGNLALCIGKCSRYVDRHWL

SEQ ID NO: 2800419 - protein, 19 aa, Entamoeba invadens
NIGEWAWFDRCHVTYLGFL

SEQ ID NO: 2800420 - protein, 18 aa, Entamoeba invadens
NIGTKCLTVTTGVSMMMQ

SEQ ID NO: 2800421 - protein, 28 aa, Entamoeba invadens
NIIGFWMWAYYLSWMRYAFELIMLSQFD

SEQ ID NO: 2800422 - protein, 18 aa, Entamoeba invadens
NIILPMFFMGHSMGGLLT

SEQ ID NO: 2800423 - protein, 21 aa, Entamoeba invadens
NIIPISLFVTMEIVRVVQTWY

SEQ ID NO: 2800424 - protein, 20 aa, Entamoeba invadens
NIKCLQCNDSAFFDIKTTKC

SEQ ID NO: 2800425 - protein, 18 aa, Entamoeba invadens
NIKELPWMCFGFIGSMIY

SEQ ID NO: 2800426 - protein, 23 aa, Entamoeba invadens
NIKKDTRLAFGLSQSSIPSADRV

SEQ ID NO: 2800427 - protein, 28 aa, Entamoeba invadens
NILDKRWRKLCFFDYILYTVGTPTTICN

SEQ ID NO: 2800428 - protein, 19 aa, Entamoeba invadens
NILDTFPIAIFKNTEIEIS

SEQ ID NO: 2800429 - protein, 19 aa, Entamoeba invadens
NILEPMRMITVWIVSVFIY

SEQ ID NO: 2800430 - protein, 18 aa, Entamoeba invadens
NILFPYRAKILAILKLLI

SEQ ID NO: 2800431 - protein, 17 aa, Entamoeba invadens
NILIFSFDLNVKANAKL

SEQ ID NO: 2800432 - protein, 17 aa, Entamoeba invadens
NILIFSLDLNEKVNAKL

SEQ ID NO: 2800433 - protein, 17 aa, Entamoeba invadens
NILIFSLNVNELITAKL

SEQ ID NO: 2800434 - protein, 24 aa, Entamoeba invadens
NILLFLVLFARLWAFIDQKTGGLT

SEQ ID NO: 2800435 - protein, 18 aa, Entamoeba invadens
NILVFSFDLNERVIAKLT

SEQ ID NO: 2800436 - protein, 17 aa, Entamoeba invadens
NILVFSFDVNETVNAKL

SEQ ID NO: 2800437 - protein, 17 aa, Entamoeba invadens
NILVFSIELNDDVNAKL

SEQ ID NO: 2800438 - protein, 17 aa, Entamoeba invadens
NILVFSIELNDGVDAKL

SEQ ID NO: 2800439 - protein, 17 aa, Entamoeba invadens
NILVFSLDLIEKVNSKL

SEQ ID NO: 2800440 - protein, 18 aa, Entamoeba invadens
NILVFSLDLNDTVNAKLT

SEQ ID NO: 2800441 - protein, 17 aa, Entamoeba invadens
NILVISIDFDNNVNAKL

SEQ ID NO: 2800442 - protein, 22 aa, Entamoeba invadens
NILVNYCVGSVCACPSGYIFVD

SEQ ID NO: 2800443 - protein, 25 aa, Entamoeba invadens
NIMLFSNTIAFVFGTSKGSQISIGT

SEQ ID NO: 2800444 - protein, 27 aa, Entamoeba invadens
NIMMPYGRPSIKILDLMNSKYGERLKA

SEQ ID NO: 2800445 - protein, 22 aa, Entamoeba invadens
NIMRELGVELVFFDKKFQGDMS

SEQ ID NO: 2800446 - protein, 27 aa, Entamoeba invadens
NINDCLNCLNGKCITCSDGYLLTTTNQ

SEQ ID NO: 2800447 - protein, 25 aa, Entamoeba invadens
NINKRLLIWDRYAGITLYTSLHNLE

SEQ ID NO: 2800448 - protein, 19 aa, Entamoeba invadens
NINSCLTCNSTNYKTIGGE

SEQ ID NO: 2800449 - protein, 23 aa, Entamoeba invadens
NIPRKKRVVLLNGVLDLLENVTF

SEQ ID NO: 2800450 - protein, 22 aa, Entamoeba invadens
NIPSHFVIPGITSINFEDVESV

SEQ ID NO: 2800451 - protein, 27 aa, Entamoeba invadens
NIPTFSGKWWPSGVMEFFTMAPFITAN

SEQ ID NO: 2800452 - protein, 17 aa, Entamoeba invadens
NIQQNWSGMAFADVFSS

SEQ ID NO: 2800453 - protein, 22 aa, Entamoeba invadens
NISCYIVSLLFVFLICSLGSVG

SEQ ID NO: 2800454 - protein, 21 aa, Entamoeba invadens
NISGFSLFKPILMETKNKVLL

SEQ ID NO: 2800455 - protein, 25 aa, Entamoeba invadens
NISGNLFKLITLCWKQNPQERITIS

SEQ ID NO: 2800456 - protein, 18 aa, Entamoeba invadens
NISLPMFFVEKLKMNETV

SEQ ID NO: 2800457 - protein, 18 aa, Entamoeba invadens
NISNCKHAAYSHSLCLEC

SEQ ID NO: 2800458 - protein, 23 aa, Entamoeba invadens
NISVCKGNILTLINLYNTNTDLN

SEQ ID NO: 2800459 - protein, 18 aa, Entamoeba invadens
NITCESCPDRYEAYKNSC

SEQ ID NO: 2800460 - protein, 24 aa, Entamoeba invadens
NITGKALIIFAFRNVASFERLQEN

SEQ ID NO: 2800461 - protein, 25 aa, Entamoeba invadens
NITKNCLRCAEGFVWNGAGNCMQIP

SEQ ID NO: 2800462 - protein, 17 aa, Entamoeba invadens
NITNCLYTKANRCLFCS

SEQ ID NO: 2800463 - protein, 29 aa, Entamoeba invadens
NITVFGFRREEHFFKPLIFGLFSMIFEVY

SEQ ID NO: 2800464 - protein, 22 aa, Entamoeba invadens
NITVSLYAWFEFKNVELKENCH

SEQ ID NO: 2800465 - protein, 18 aa, Entamoeba invadens
NIVCACFTLIGVVLSFFY

SEQ ID NO: 2800466 - protein, 23 aa, Entamoeba invadens
NIVFKDQIRVFYVFENAIISLIQ

SEQ ID NO: 2800467 - protein, 28 aa, Entamoeba invadens
NIVLCESICSLTLMVNEIAGLNVFGGSV

SEQ ID NO: 2800468 - protein, 23 aa, Entamoeba invadens
NIVPYWRSLVLWKQNRNKKFDKH

SEQ ID NO: 2800469 - protein, 17 aa, Entamoeba invadens
NIWVFKMSRSNMMMTKL

SEQ ID NO: 2800470 - protein, 19 aa, Entamoeba invadens
NIYLNFGALCLKNVLPSFG

SEQ ID NO: 2800471 - protein, 32 aa, Entamoeba invadens
NKAAIYISCAFWAFSAFLFWPAAVGTVGKESK

SEQ ID NO: 2800472 - protein, 18 aa, Entamoeba invadens
NKAIEFEIFIQPKCSCKI

SEQ ID NO: 2800473 - protein, 25 aa, Entamoeba invadens
NKAVCFKEGKIGCGNLMTSSVIAFQ

SEQ ID NO: 2800474 - protein, 24 aa, Entamoeba invadens
NKCCQVKVLLMPLCTFSSQIPLTF

SEQ ID NO: 2800475 - protein, 20 aa, Entamoeba invadens
NKCEYCLPGTFSSSPKSSQC

SEQ ID NO: 2800476 - protein, 19 aa, Entamoeba invadens
NKCEYCPLGTFSSSPKSLQ

SEQ ID NO: 2800477 - protein, 24 aa, Entamoeba invadens
NKCKDEKCKTCGADLECIECKDNH

SEQ ID NO: 2800478 - protein, 17 aa, Entamoeba invadens
NKCKRCSNDYLMVKENQ

SEQ ID NO: 2800479 - protein, 17 aa, Entamoeba invadens
NKCKSGYSWGGYGICVP

SEQ ID NO: 2800480 - protein, 17 aa, Entamoeba invadens
NKCLKCNSKTRLLNDKC

SEQ ID NO: 2800481 - protein, 18 aa, Entamoeba invadens
NKCLPCDTSCTFDFCDTF

SEQ ID NO: 2800482 - protein, 23 aa, Entamoeba invadens
NKCLQCINCAKGFCHQDGCTQCS

SEQ ID NO: 2800483 - protein, 22 aa, Entamoeba invadens
NKCNSTHCFGCDDSLTLSNDQT

SEQ ID NO: 2800484 - protein, 19 aa, Entamoeba invadens
NKCTNDAMCLLCNVDYFLL

SEQ ID NO: 2800485 - protein, 20 aa, Entamoeba invadens
NKCVLVGCKNGLELNQTTGF

SEQ ID NO: 2800486 - protein, 25 aa, Entamoeba invadens
NKCVTCEGCGDKGCSRENKKCYNCP

SEQ ID NO: 2800487 - protein, 22 aa, Entamoeba invadens
NKCVTCPLLTYSTGGKSVCTNC

SEQ ID NO: 2800488 - protein, 24 aa, Entamoeba invadens
NKCYSYRCYQCYNNTMSGCYLCQP

SEQ ID NO: 2800489 - protein, 28 aa, Entamoeba invadens
NKDDNVLCKLRFVNGIIQFNMLKFLLNN

SEQ ID NO: 2800490 - protein, 21 aa, Entamoeba invadens
NKDILSRVILKIGELEKERST

SEQ ID NO: 2800491 - protein, 32 aa, Entamoeba invadens
NKDLFRCLLKLYQQICCSVYFWTGPSVETTSD

SEQ ID NO: 2800492 - protein, 31 aa, Entamoeba invadens
NKECLKVIKRDCRRWIGNIVEFLPNTDKSLL

SEQ ID NO: 2800493 - protein, 23 aa, Entamoeba invadens
NKEGKYDFCIPISQSQIADCKYS

SEQ ID NO: 2800494 - protein, 18 aa, Entamoeba invadens
NKEIPLVMILVGAKMTSN

SEQ ID NO: 2800495 - protein, 24 aa, Entamoeba invadens
NKEITRLQGEFADLQQLRNAEIVQ

SEQ ID NO: 2800496 - protein, 25 aa, Entamoeba invadens
NKELEIPGQMFPIGMSSGYETPYVE

SEQ ID NO: 2800497 - protein, 26 aa, Entamoeba invadens
NKELKLDVHGSVYLRSGKFEVDEMSL

SEQ ID NO: 2800498 - protein, 18 aa, Entamoeba invadens
NKERCCRGFYGLLNHNIN

SEQ ID NO: 2800499 - protein, 21 aa, Entamoeba invadens
NKETRTLLCIGNISKRAQKIQ

SEQ ID NO: 2800500 - protein, 22 aa, Entamoeba invadens
NKEVLSLVFGRVLLSQATRYKF

SEQ ID NO: 2800501 - protein, 21 aa, Entamoeba invadens
NKFDYCLPISTTLFSNCKRIR

SEQ ID NO: 2800502 - protein, 23 aa, Entamoeba invadens
NKFKFPWEIVNFVVAEKRLEKPK

SEQ ID NO: 2800503 - protein, 23 aa, Entamoeba invadens
NKFQLDCCSMPSTLVALDQSCYL

SEQ ID NO: 2800504 - protein, 20 aa, Entamoeba invadens
NKFRCDQIIHFFGSVRMPKI

SEQ ID NO: 2800505 - protein, 24 aa, Entamoeba invadens
NKFRYEIKVAPPVVILKRNEACRF

SEQ ID NO: 2800506 - protein, 18 aa, Entamoeba invadens
NKGCALCKDGYYQQNLDC

SEQ ID NO: 2800507 - protein, 20 aa, Entamoeba invadens
NKGCAVCANGYYRNSTVCVQ

SEQ ID NO: 2800508 - protein, 22 aa, Entamoeba invadens
NKGCQRCGFGYYQEKDSDTCHK

SEQ ID NO: 2800509 - protein, 24 aa, Entamoeba invadens
NKGCQRCSFGYYLEHTNINCVQCS

SEQ ID NO: 2800510 - protein, 18 aa, Entamoeba invadens
NKGECIVTDFAISCQQPM

SEQ ID NO: 2800511 - protein, 23 aa, Entamoeba invadens
NKGFKIPLVLLVSVHFLGVIAIH

SEQ ID NO: 2800512 - protein, 20 aa, Entamoeba invadens
NKGRCLVCSYNYFLTNTVTP

SEQ ID NO: 2800513 - protein, 20 aa, Entamoeba invadens
NKGWCSIITLIFALSIHSFF

SEQ ID NO: 2800514 - protein, 21 aa, Entamoeba invadens
NKHSCISCDIGYYLLIAKCYL

SEQ ID NO: 2800515 - protein, 18 aa, Entamoeba invadens
NKICLVTEFAQYGSLKDL

SEQ ID NO: 2800516 - protein, 20 aa, Entamoeba invadens
NKIISIFFLFGLCNVEGFMR

SEQ ID NO: 2800517 - protein, 20 aa, Entamoeba invadens
NKIKEIIGFNGMVETFNKIV

SEQ ID NO: 2800518 - protein, 17 aa, Entamoeba invadens
NKILKCKFFTEIQVFEE

SEQ ID NO: 2800519 - protein, 18 aa, Entamoeba invadens
NKILKCKFFTETQVFEEG

SEQ ID NO: 2800520 - protein, 17 aa, Entamoeba invadens
NKIYLFPTDSSCVIFNY

SEQ ID NO: 2800521 - protein, 27 aa, Entamoeba invadens
NKKAVWWVILFCVIFTICVLIILMISM

SEQ ID NO: 2800522 - protein, 25 aa, Entamoeba invadens
NKKCDKCKLGFWIDDFECVTCETCG

SEQ ID NO: 2800523 - protein, 24 aa, Entamoeba invadens
NKKCDKCKLGFWIEDFECVTCETC

SEQ ID NO: 2800524 - protein, 21 aa, Entamoeba invadens
NKKCIAIDMILNCFNKNENGC

SEQ ID NO: 2800525 - protein, 20 aa, Entamoeba invadens
NKKCSICPASYYSSGGTSLC

SEQ ID NO: 2800526 - protein, 20 aa, Entamoeba invadens
NKKFCTQKCHIKNKEKIFTK

SEQ ID NO: 2800527 - protein, 30 aa, Entamoeba invadens
NKKFGKMMWRPHLLPSHVAYTMLKTSLLEM

SEQ ID NO: 2800528 - protein, 20 aa, Entamoeba invadens
NKKLSGREAIVIRGFPMITE

SEQ ID NO: 2800529 - protein, 22 aa, Entamoeba invadens
NKKSKLYWVWQVVGMFLSLMLM

SEQ ID NO: 2800530 - protein, 26 aa, Entamoeba invadens
NKKYTLSFVIWRFVFVLVSCVVTGLF

SEQ ID NO: 2800531 - protein, 17 aa, Entamoeba invadens
NKLCLVTEFAQFGSLKD

SEQ ID NO: 2800532 - protein, 29 aa, Entamoeba invadens
NKLCNFCGVSTCETCAISPANKCDTCPTN

SEQ ID NO: 2800533 - protein, 17 aa, Entamoeba invadens
NKLGLSTHNCYYNGNVY

SEQ ID NO: 2800534 - protein, 19 aa, Entamoeba invadens
NKLGNSFMSYDFVYYNLQM

SEQ ID NO: 2800535 - protein, 17 aa, Entamoeba invadens
NKLKCIQCKKDFYLKNL

SEQ ID NO: 2800536 - protein, 24 aa, Entamoeba invadens
NKLLDEFIRHYSLRHNIADEAEDN

SEQ ID NO: 2800537 - protein, 23 aa, Entamoeba invadens
NKLLLRYGKSQEIYCHLTNDNLQ

SEQ ID NO: 2800538 - protein, 18 aa, Entamoeba invadens
NKLLRFGDSITVYCHLIK

SEQ ID NO: 2800539 - protein, 23 aa, Entamoeba invadens
NKLPNLLTFRTMVAKVVGLVLVI

SEQ ID NO: 2800540 - protein, 18 aa, Entamoeba invadens
NKLTWPYDVLVRGKKYTQ

SEQ ID NO: 2800541 - protein, 23 aa, Entamoeba invadens
NKLVELKDVLSFFMDSKDCIKLD

SEQ ID NO: 2800542 - protein, 17 aa, Entamoeba invadens
NKMECRTNDDLLCTNQS

SEQ ID NO: 2800543 - protein, 22 aa, Entamoeba invadens
NKMGCQRCIDLLYFDKQTESCE

SEQ ID NO: 2800544 - protein, 24 aa, Entamoeba invadens
NKMKPSIGLSEGMYACSLNATEKL

SEQ ID NO: 2800545 - protein, 18 aa, Entamoeba invadens
NKMPCVQDLRIVSDVIKK

SEQ ID NO: 2800546 - protein, 24 aa, Entamoeba invadens
NKMPGCLSCSASDICYECINELYY

SEQ ID NO: 2800547 - protein, 24 aa, Entamoeba invadens
NKMVSDFLMCLVLCNTCSKEKDQV

SEQ ID NO: 2800548 - protein, 18 aa, Entamoeba invadens
NKNCLTCENNFFYTHNLK

SEQ ID NO: 2800549 - protein, 19 aa, Entamoeba invadens
NKNCLTCSDPYYLSNQKCL

SEQ ID NO: 2800550 - protein, 23 aa, Entamoeba invadens
NKNCSICPASFYSGGGTSLCSKC

SEQ ID NO: 2800551 - protein, 17 aa, Entamoeba invadens
NKNCVLGTIPHCVVYTD

SEQ ID NO: 2800552 - protein, 23 aa, Entamoeba invadens
NKNCVLGTLPHCITYIDKNSCKT

SEQ ID NO: 2800553 - protein, 22 aa, Entamoeba invadens
NKNCVLGTLPHCITYNNKDSCN

SEQ ID NO: 2800554 - protein, 17 aa, Entamoeba invadens
NKNESNVRCSVDIPDCL

SEQ ID NO: 2800555 - protein, 24 aa, Entamoeba invadens
NKNESNVRCSVDIPDCLYTTNNKC

SEQ ID NO: 2800556 - protein, 18 aa, Entamoeba invadens
NKNGCVSCAVGYYLLNAE

SEQ ID NO: 2800557 - protein, 25 aa, Entamoeba invadens
NKNNKCVLCKIGYVLNEQSECISSE

SEQ ID NO: 2800558 - protein, 28 aa, Entamoeba invadens
NKNNVCVLCKTGFVLNEKFECVYSTNCL

SEQ ID NO: 2800559 - protein, 22 aa, Entamoeba invadens
NKNPLPSFVEKFECSEFQMGPF

SEQ ID NO: 2800560 - protein, 24 aa, Entamoeba invadens
NKNPYRLGKWFKVDMSKITKDQLI

SEQ ID NO: 2800561 - protein, 18 aa, Entamoeba invadens
NKNTHIFETLIIHQEYAD

SEQ ID NO: 2800562 - protein, 18 aa, Entamoeba invadens
NKPKYRFSAPYKLMTTVR

SEQ ID NO: 2800563 - protein, 17 aa, Entamoeba invadens
NKPRIISWNSTYIHLNR

SEQ ID NO: 2800564 - protein, 17 aa, Entamoeba invadens
NKPSVFLYMCKDSKIAI

SEQ ID NO: 2800565 - protein, 22 aa, Entamoeba invadens
NKQCLKKSPSVRLKAETTSLNN

SEQ ID NO: 2800566 - protein, 18 aa, Entamoeba invadens
NKQEECNFLGLKEVSEEL

SEQ ID NO: 2800567 - protein, 18 aa, Entamoeba invadens
NKQGAWYKLTGIKDNVEV

SEQ ID NO: 2800568 - protein, 20 aa, Entamoeba invadens
NKQIDCIIYLSSPVVVQKQP

SEQ ID NO: 2800569 - protein, 24 aa, Entamoeba invadens
NKQLQYRMSIWFTLDLSTSTATLY

SEQ ID NO: 2800570 - protein, 22 aa, Entamoeba invadens
NKQQCLRCSDGYYLSSNKCVPA

SEQ ID NO: 2800571 - protein, 18 aa, Entamoeba invadens
NKRCCGGNSGIAITGMPT

SEQ ID NO: 2800572 - protein, 20 aa, Entamoeba invadens
NKRCIARVFISKCLSANNGT

SEQ ID NO: 2800573 - protein, 18 aa, Entamoeba invadens
NKRCVSCHSTCKTCVGEL

SEQ ID NO: 2800574 - protein, 19 aa, Entamoeba invadens
NKRECAICDNGMYPNTNGK

SEQ ID NO: 2800575 - protein, 24 aa, Entamoeba invadens
NKRISNGNLCYCTLNGDGSTYLET

SEQ ID NO: 2800576 - protein, 35 aa, Entamoeba invadens
NKRMWLKIVIWISCIGFCFLVLLLTLLLLYLDVLH

SEQ ID NO: 2800577 - protein, 17 aa, Entamoeba invadens
NKSDAFLSIDGRYRSHC

SEQ ID NO: 2800578 - protein, 24 aa, Entamoeba invadens
NKSESLIGLQLFFFVLYTILGVNQ

SEQ ID NO: 2800579 - protein, 23 aa, Entamoeba invadens
NKSKCCVKLQLVYIHRKSYKITV

SEQ ID NO: 2800580 - protein, 28 aa, Entamoeba invadens
NKTEFKFPWKIAEFVIGKNRLKIAEPIQ

SEQ ID NO: 2800581 - protein, 18 aa, Entamoeba invadens
NKTEGALLLFSRDRGTDY

SEQ ID NO: 2800582 - protein, 26 aa, Entamoeba invadens
NKTFCLTCAKGNFISKNRCYSNEMLK

SEQ ID NO: 2800583 - protein, 24 aa, Entamoeba invadens
NKTIKCYPVFILLNGQFNVGDGVT

SEQ ID NO: 2800584 - protein, 23 aa, Entamoeba invadens
NKTKMGAAGLVLSSVISSDNYLV

SEQ ID NO: 2800585 - protein, 25 aa, Entamoeba invadens
NKTNFWLLCIFQKKLLTTKQIFETV

SEQ ID NO: 2800586 - protein, 20 aa, Entamoeba invadens
NKTPVKFFFDQVRLDTRDSQ

SEQ ID NO: 2800587 - protein, 25 aa, Entamoeba invadens
NKTRSGCTLCEFGYFIYQNECQKCK

SEQ ID NO: 2800588 - protein, 24 aa, Entamoeba invadens
NKTTCKKCYSPFVVDVYGNCVLCD

SEQ ID NO: 2800589 - protein, 20 aa, Entamoeba invadens
NKVCGCIPTYYGLVDTSHNF

SEQ ID NO: 2800590 - protein, 20 aa, Entamoeba invadens
NKVCTMCAVGYYEHNNACKQ

SEQ ID NO: 2800591 - protein, 19 aa, Entamoeba invadens
NKVCVCIPTYYGLVDTSYN

SEQ ID NO: 2800592 - protein, 18 aa, Entamoeba invadens
NKVENGPKLNVWERNFQL

SEQ ID NO: 2800593 - protein, 26 aa, Entamoeba invadens
NKVRYRSGQWYKLHAPDYEKDGYEFT

SEQ ID NO: 2800594 - protein, 27 aa, Entamoeba invadens
NKVVELFCFSFWISVTVYFYDGLLLSS

SEQ ID NO: 2800595 - protein, 18 aa, Entamoeba invadens
NKWVDLIFGYLQRPPAAF

SEQ ID NO: 2800596 - protein, 30 aa, Entamoeba invadens
NKWVIFGFSCVRCVLYVPIFIYYYNVYTNP

SEQ ID NO: 2800597 - protein, 19 aa, Entamoeba invadens
NKYAFIPIYVLQFYLLFIC

SEQ ID NO: 2800598 - protein, 18 aa, Entamoeba invadens
NKYCRCLTGYITDPKDPK

SEQ ID NO: 2800599 - protein, 20 aa, Entamoeba invadens
NKYDFCLPISTLNINNCKHV

SEQ ID NO: 2800600 - protein, 27 aa, Entamoeba invadens
NKYEGSCAVSVKIAQWGYFKITTGDHQ

SEQ ID NO: 2800601 - protein, 28 aa, Entamoeba invadens
NKYIHKYLWCTDTFKGIMDCPKGTKCGY

SEQ ID NO: 2800602 - protein, 19 aa, Entamoeba invadens
NKYSKIVLFTVEYQGSYSL

SEQ ID NO: 2800603 - protein, 23 aa, Entamoeba invadens
NLAKDGLRTLVFGKKIIPSDVYE

SEQ ID NO: 2800604 - protein, 23 aa, Entamoeba invadens
NLALKGVQFKAAINTQNTTKIIY

SEQ ID NO: 2800605 - protein, 22 aa, Entamoeba invadens
NLCAFLILGLFVILIGLPLVTN

SEQ ID NO: 2800606 - protein, 23 aa, Entamoeba invadens
NLCGCCYAASIANYLQVKHHINN

SEQ ID NO: 2800607 - protein, 17 aa, Entamoeba invadens
NLCGGVIAAFLPSPPKD

SEQ ID NO: 2800608 - protein, 26 aa, Entamoeba invadens
NLCKFCTKDNCIFCEGDIIVSDGKCL

SEQ ID NO: 2800609 - protein, 28 aa, Entamoeba invadens
NLCKFCTKDNCIFCEGGIINCKVTTLNG

SEQ ID NO: 2800610 - protein, 23 aa, Entamoeba invadens
NLCNISLYPNCELQTKSGCLRCE

SEQ ID NO: 2800611 - protein, 30 aa, Entamoeba invadens
NLCQRCTKHSCVSCGLTGVVNSKGSCESVN

SEQ ID NO: 2800612 - protein, 20 aa, Entamoeba invadens
NLCYMRFLYYTVVVLVILFT

SEQ ID NO: 2800613 - protein, 21 aa, Entamoeba invadens
NLDFPTFYLSTSFRNSIFLWN

SEQ ID NO: 2800614 - protein, 22 aa, Entamoeba invadens
NLDLACYIHENMMFLHKASETV

SEQ ID NO: 2800615 - protein, 28 aa, Entamoeba invadens
NLEECKTCILKHKFNSTVKKCFKCGENC

SEQ ID NO: 2800616 - protein, 22 aa, Entamoeba invadens
NLEGVLKFMRENGILDNIVSQD

SEQ ID NO: 2800617 - protein, 22 aa, Entamoeba invadens
NLESTKSITFVPGVRSTHIPLI

SEQ ID NO: 2800618 - protein, 25 aa, Entamoeba invadens
NLETSVCLRCLLFVLNVGKDVSYEA

SEQ ID NO: 2800619 - protein, 28 aa, Entamoeba invadens
NLFCGLKTLPFLFDLVFSSTFKGSYKIS

SEQ ID NO: 2800620 - protein, 20 aa, Entamoeba invadens
NLFIAFSIAWFWVADSVDGI

SEQ ID NO: 2800621 - protein, 21 aa, Entamoeba invadens
NLFVLRFIILLLLNMYSAFTV

SEQ ID NO: 2800622 - protein, 20 aa, Entamoeba invadens
NLGASTSKNLFCSKTESEGT

SEQ ID NO: 2800623 - protein, 18 aa, Entamoeba invadens
NLGSLRRFIKLNKISTLM

SEQ ID NO: 2800624 - protein, 21 aa, Entamoeba invadens
NLICYWITWLGAVFFFNHLFA

SEQ ID NO: 2800625 - protein, 18 aa, Entamoeba invadens
NLIFTGYSKIIFLENSLV

SEQ ID NO: 2800626 - protein, 24 aa, Entamoeba invadens
NLIKNCTYYYGFALVVGINVNFFP

SEQ ID NO: 2800627 - protein, 27 aa, Entamoeba invadens
NLILDVLKYFFGLVFDEEVKKKPKKDY

SEQ ID NO: 2800628 - protein, 32 aa, Entamoeba invadens
NLKAKLPIEFMEKWMNVSLFIACETKTLTHVS

SEQ ID NO: 2800629 - protein, 17 aa, Entamoeba invadens
NLKEFTKDFFIFGEGRK

SEQ ID NO: 2800630 - protein, 18 aa, Entamoeba invadens
NLKFRLHTNWNLAQMVSL

SEQ ID NO: 2800631 - protein, 23 aa, Entamoeba invadens
NLKINKCGFKHSGSNGISVSGQN

SEQ ID NO: 2800632 - protein, 18 aa, Entamoeba invadens
NLKKCRYVPNNQGGYYFI

SEQ ID NO: 2800633 - protein, 24 aa, Entamoeba invadens
NLKLAERLFVAIVMNVSSNQEIVK

SEQ ID NO: 2800634 - protein, 22 aa, Entamoeba invadens
NLKLVITVPVVIVFILFVVVIT

SEQ ID NO: 2800635 - protein, 26 aa, Entamoeba invadens
NLKNKCVLCKSGFLLSENGECLTSTT

SEQ ID NO: 2800636 - protein, 18 aa, Entamoeba invadens
NLKRTKCEVRIAEERSEL

SEQ ID NO: 2800637 - protein, 27 aa, Entamoeba invadens
NLKSTLLKKCFSIMLLASSFYKLHYLT

SEQ ID NO: 2800638 - protein, 20 aa, Entamoeba invadens
NLKTRFETIKGRLETAKNSM

SEQ ID NO: 2800639 - protein, 19 aa, Entamoeba invadens
NLKYCTKCDAYSYTKNGKC

SEQ ID NO: 2800640 - protein, 19 aa, Entamoeba invadens
NLLLNWLKGKYEVVSETIN

SEQ ID NO: 2800641 - protein, 18 aa, Entamoeba invadens
NLLPITWSYVHKMCYTPK

SEQ ID NO: 2800642 - protein, 28 aa, Entamoeba invadens
NLLQLRPSFEFTKDFIIKSRSQFCRNIK

SEQ ID NO: 2800643 - protein, 20 aa, Entamoeba invadens
NLLSKLRNPFIVNYVGSITY

SEQ ID NO: 2800644 - protein, 18 aa, Entamoeba invadens
NLLVFSLDLNDTVNAKLT

SEQ ID NO: 2800645 - protein, 19 aa, Entamoeba invadens
NLNECTYCITGYNLDSTNH

SEQ ID NO: 2800646 - protein, 20 aa, Entamoeba invadens
NLNFCFYIKHISSITNKVTE

SEQ ID NO: 2800647 - protein, 18 aa, Entamoeba invadens
NLNFSVVINNIYNYLGIA

SEQ ID NO: 2800648 - protein, 20 aa, Entamoeba invadens
NLNIAVKMGDHLGQIISGNN

SEQ ID NO: 2800649 - protein, 24 aa, Entamoeba invadens
NLNILRIGFVASLLARSGAIVVCA

SEQ ID NO: 2800650 - protein, 25 aa, Entamoeba invadens
NLNQCPLCAAGYFSLENSPGCTACA

SEQ ID NO: 2800651 - protein, 17 aa, Entamoeba invadens
NLNYLLMEIQLFDYMSP

SEQ ID NO: 2800652 - protein, 22 aa, Entamoeba invadens
NLPEYPRYFVIVTKYLEDLEKS

SEQ ID NO: 2800653 - protein, 18 aa, Entamoeba invadens
NLPEYSAVVYSYLDAEHC

SEQ ID NO: 2800654 - protein, 20 aa, Entamoeba invadens
NLPLSRTIIASRTWMKIQSN

SEQ ID NO: 2800655 - protein, 24 aa, Entamoeba invadens
NLPNTRLGKVFGLIEFCTGYLGLI

SEQ ID NO: 2800656 - protein, 23 aa, Entamoeba invadens
NLQKEVEGIIPFIIDTAKNSKLR

SEQ ID NO: 2800657 - protein, 27 aa, Entamoeba invadens
NLQLRNCRNCIFQLPSTLTGLSIFNTN

SEQ ID NO: 2800658 - protein, 18 aa, Entamoeba invadens
NLRCQACASTCERCITRS

SEQ ID NO: 2800659 - protein, 21 aa, Entamoeba invadens
NLRDVCYSILNFTSIDIELTT

SEQ ID NO: 2800660 - protein, 24 aa, Entamoeba invadens
NLRGWDRWLYTISFYRLSHNAFST

SEQ ID NO: 2800661 - protein, 22 aa, Entamoeba invadens
NLRKKWMLVILHLPNSDKYVFH

SEQ ID NO: 2800662 - protein, 21 aa, Entamoeba invadens
NLRVKFCLDAAKGILYLHENG

SEQ ID NO: 2800663 - protein, 25 aa, Entamoeba invadens
NLSALRFSSFLAILCILYTMFTITI

SEQ ID NO: 2800664 - protein, 24 aa, Entamoeba invadens
NLSCTSCKSGSYLDNGFCNLCDKN

SEQ ID NO: 2800665 - protein, 18 aa, Entamoeba invadens
NLSLCILCQAFDVNCESC

SEQ ID NO: 2800666 - protein, 18 aa, Entamoeba invadens
NLSTRFNYNKVFIQFSEH

SEQ ID NO: 2800667 - protein, 24 aa, Entamoeba invadens
NLSVKEFFSYFTLSSYLIPIACAV

SEQ ID NO: 2800668 - protein, 26 aa, Entamoeba invadens
NLTFKSLTVASEFKLLTVLNTMTMSD

SEQ ID NO: 2800669 - protein, 25 aa, Entamoeba invadens
NLTLECWNPLFIVYVLLLCFISRAF

SEQ ID NO: 2800670 - protein, 25 aa, Entamoeba invadens
NLTMCAFIWEYYCEKVPFFNPVYER

SEQ ID NO: 2800671 - protein, 18 aa, Entamoeba invadens
NLTQSLRRDLWKTVLSDV

SEQ ID NO: 2800672 - protein, 20 aa, Entamoeba invadens
NLVILCFAVRYAVKKTVIFC

SEQ ID NO: 2800673 - protein, 20 aa, Entamoeba invadens
NLVIYFVVSIVIYYILYGTI

SEQ ID NO: 2800674 - protein, 20 aa, Entamoeba invadens
NLVKCYGVDGVAAWTDFSEK

SEQ ID NO: 2800675 - protein, 18 aa, Entamoeba invadens
NLWAPRDIVYGDINESLA

SEQ ID NO: 2800676 - protein, 17 aa, Entamoeba invadens
NLWVFIVFISSFCLLGV

SEQ ID NO: 2800677 - protein, 25 aa, Entamoeba invadens
NLYIICVAFNFDLVKEFGKVTKENL

SEQ ID NO: 2800678 - protein, 19 aa, Entamoeba invadens
NLYQCSSCAEGYYQIQGET

SEQ ID NO: 2800679 - protein, 17 aa, Entamoeba invadens
NLYRPLMKYGEAAIKMA

SEQ ID NO: 2800680 - protein, 24 aa, Entamoeba invadens
NLYYKCVARYPLVVLIKAEGKIFG

SEQ ID NO: 2800681 - protein, 23 aa, Entamoeba invadens
NMANTFALIAGRMFFILRDELRR

SEQ ID NO: 2800682 - protein, 18 aa, Entamoeba invadens
NMDEFLKCMAICHEAVPN

SEQ ID NO: 2800683 - protein, 18 aa, Entamoeba invadens
NMDLAINSTTSFTLYGYI

SEQ ID NO: 2800684 - protein, 18 aa, Entamoeba invadens
NMFCQERLFASRIIGGTF

SEQ ID NO: 2800685 - protein, 18 aa, Entamoeba invadens
NMGPDYWLIAARLMTNIL

SEQ ID NO: 2800686 - protein, 17 aa, Entamoeba invadens
NMISGRFIGFFFNLTQH

SEQ ID NO: 2800687 - protein, 28 aa, Entamoeba invadens
NMKAMNMKSLWLGFLVPRIVFCSIVAVA

SEQ ID NO: 2800688 - protein, 24 aa, Entamoeba invadens
NMKKAIICLPSYFLDNNKCNLCSD

SEQ ID NO: 2800689 - protein, 21 aa, Entamoeba invadens
NMLEKCIFCLVDTEMVKTAFE

SEQ ID NO: 2800690 - protein, 27 aa, Entamoeba invadens
NMLLDILKKCFGFILTEDVKKKPEKDF

SEQ ID NO: 2800691 - protein, 25 aa, Entamoeba invadens
NMLQKMLSPFVVEFVGAVLVGEKKM

SEQ ID NO: 2800692 - protein, 17 aa, Entamoeba invadens
NMLRLKLFTNYYEYYVI

SEQ ID NO: 2800693 - protein, 17 aa, Entamoeba invadens
NMLYNLMYKKYIYLCCM

SEQ ID NO: 2800694 - protein, 22 aa, Entamoeba invadens
NMNECIYCIAGYNLDSTNHKCY

SEQ ID NO: 2800695 - protein, 34 aa, Entamoeba invadens
NMSALGCLLCCLFTWMGCCCIGLIFCCIPTFADT

SEQ ID NO: 2800696 - protein, 18 aa, Entamoeba invadens
NMSDITFNKVQMRNVTFF

SEQ ID NO: 2800697 - protein, 17 aa, Entamoeba invadens
NMTGFSFHDEPLGTDQN

SEQ ID NO: 2800698 - protein, 18 aa, Entamoeba invadens
NMVGCAICQEGYYRKQND

SEQ ID NO: 2800699 - protein, 17 aa, Entamoeba invadens
NMYEVIEISAFTFQGCT

SEQ ID NO: 2800700 - protein, 24 aa, Entamoeba invadens
NMYFACIFVGISITQVIIVVFLGI

SEQ ID NO: 2800701 - protein, 17 aa, Entamoeba invadens
NNACIKCETGFYLTGNE

SEQ ID NO: 2800702 - protein, 24 aa, Entamoeba invadens
NNANRGDLAFSIGTISQLDSNDIV

SEQ ID NO: 2800703 - protein, 18 aa, Entamoeba invadens
NNCILCEEIAHCASCSQT

SEQ ID NO: 2800704 - protein, 24 aa, Entamoeba invadens
NNCILSSMFPYIFMEGLGYLISNQ

SEQ ID NO: 2800705 - protein, 17 aa, Entamoeba invadens
NNCKLCSPNDTYVNNSW

SEQ ID NO: 2800706 - protein, 24 aa, Entamoeba invadens
NNCNAFYGSMCIYKKITKCERGYY

SEQ ID NO: 2800707 - protein, 24 aa, Entamoeba invadens
NNDECFRYANLVLCSVETGEGTSL

SEQ ID NO: 2800708 - protein, 30 aa, Entamoeba invadens
NNDFSEFLFKFTLSDLEGFELIRADLELST

SEQ ID NO: 2800709 - protein, 18 aa, Entamoeba invadens
NNDTIGPCNTCISGYYLE

SEQ ID NO: 2800710 - protein, 21 aa, Entamoeba invadens
NNDVPTWVIAVLVVVGVVVIV

SEQ ID NO: 2800711 - protein, 17 aa, Entamoeba invadens
NNECIQCNSSFILYNSI

SEQ ID NO: 2800712 - protein, 22 aa, Entamoeba invadens
NNECLKCKSSFLLLSNSTCVSV

SEQ ID NO: 2800713 - protein, 19 aa, Entamoeba invadens
NNECVKCYNDNFEVSKGKC

SEQ ID NO: 2800714 - protein, 26 aa, Entamoeba invadens
NNEIRKEFILSFLLGQHFMYFFTHWC

SEQ ID NO: 2800715 - protein, 21 aa, Entamoeba invadens
NNEKCVLCEYNHFFNKTTFSC

SEQ ID NO: 2800716 - protein, 29 aa, Entamoeba invadens
NNEKGSCTSSWWIKEPYIMHDVERLTVQL

SEQ ID NO: 2800717 - protein, 24 aa, Entamoeba invadens
NNEMGGSLAFYVKMLIEKIDLLIT

SEQ ID NO: 2800718 - protein, 25 aa, Entamoeba invadens
NNENWKSVIFNTSFVSITGNYNFTV

SEQ ID NO: 2800719 - protein, 35 aa, Entamoeba invadens
NNESLVDFSFCRSRQKFTFGRWFSVNMSQLEYDQL

SEQ ID NO: 2800720 - protein, 20 aa, Entamoeba invadens
NNFCKNELLSSVKFNSPTGI

SEQ ID NO: 2800721 - protein, 24 aa, Entamoeba invadens
NNFCLSCPNGFYLNTQKMCISCGN

SEQ ID NO: 2800722 - protein, 23 aa, Entamoeba invadens
NNFKWFRPSSFFAKDYMYTIVEK

SEQ ID NO: 2800723 - protein, 25 aa, Entamoeba invadens
NNFLKEVRFKVAYITCHEFVMEFMK

SEQ ID NO: 2800724 - protein, 24 aa, Entamoeba invadens
NNFPRVSFYTFVIFFSIKTLIVFF

SEQ ID NO: 2800725 - protein, 17 aa, Entamoeba invadens
NNGECLQTWNGLPVGST

SEQ ID NO: 2800726 - protein, 23 aa, Entamoeba invadens
NNGIKTFCVVGWDDTFAGGGFII

SEQ ID NO: 2800727 - protein, 24 aa, Entamoeba invadens
NNGLCLICASGTFYNETEKTCQKC

SEQ ID NO: 2800728 - protein, 27 aa, Entamoeba invadens
NNGNCFKCAFGYYISGGECAVCNIEHC

SEQ ID NO: 2800729 - protein, 18 aa, Entamoeba invadens
NNGNLVFSETQMKTDGED

SEQ ID NO: 2800730 - protein, 25 aa, Entamoeba invadens
NNICKLCGVINCYRCTSSTTCTECI

SEQ ID NO: 2800731 - protein, 22 aa, Entamoeba invadens
NNICVLCKTGYILNEKFECANS

SEQ ID NO: 2800732 - protein, 21 aa, Entamoeba invadens
NNICVLCKTGYVLNEKFECVS

SEQ ID NO: 2800733 - protein, 24 aa, Entamoeba invadens
NNIGCALCKSSYYRKGDDCISCDI

SEQ ID NO: 2800734 - protein, 26 aa, Entamoeba invadens
NNILSYCFIDDYFLRVNKNNTKVSRC

SEQ ID NO: 2800735 - protein, 17 aa, Entamoeba invadens
NNKCAQCADNFKVNTEG

SEQ ID NO: 2800736 - protein, 20 aa, Entamoeba invadens
NNKCISCERGYHLSHDICET

SEQ ID NO: 2800737 - protein, 19 aa, Entamoeba invadens
NNKCIVCNNGYYLGDDGMC

SEQ ID NO: 2800738 - protein, 22 aa, Entamoeba invadens
NNKCKKCTIEGCATCTDTNTCS

SEQ ID NO: 2800739 - protein, 24 aa, Entamoeba invadens
NNKCVLCKTGYVLNGQFECISSEI

SEQ ID NO: 2800740 - protein, 22 aa, Entamoeba invadens
NNKCVLTIEMCEAALDSICVLC

SEQ ID NO: 2800741 - protein, 24 aa, Entamoeba invadens
NNKCVTCPLLTYSTGGKSVCTNCD

SEQ ID NO: 2800742 - protein, 23 aa, Entamoeba invadens
NNKEANVTFGIVWILLSVIFQLI

SEQ ID NO: 2800743 - protein, 18 aa, Entamoeba invadens
NNKGCERCSSGYYNINSE

SEQ ID NO: 2800744 - protein, 25 aa, Entamoeba invadens
NNKGCQRCPFGYFLNKNGCEKCTND

SEQ ID NO: 2800745 - protein, 23 aa, Entamoeba invadens
NNKIITCLSGFYLTISGCSKCNE

SEQ ID NO: 2800746 - protein, 19 aa, Entamoeba invadens
NNKKPNCILQNSFGCMKCQ

SEQ ID NO: 2800747 - protein, 25 aa, Entamoeba invadens
NNKLCSKCKIGFVFNSKNECVSKKC

SEQ ID NO: 2800748 - protein, 18 aa, Entamoeba invadens
NNKNEILLSYALANSTIP

SEQ ID NO: 2800749 - protein, 24 aa, Entamoeba invadens
NNKVSFCYPEYYAFLIDVIQCIIV

SEQ ID NO: 2800750 - protein, 22 aa, Entamoeba invadens
NNLCISCPPGTYFENEMCHTND

SEQ ID NO: 2800751 - protein, 17 aa, Entamoeba invadens
NNLCVKCSSDLMVIKDG

SEQ ID NO: 2800752 - protein, 22 aa, Entamoeba invadens
NNLICQSCPVGTYKNTETSCEL

SEQ ID NO: 2800753 - protein, 22 aa, Entamoeba invadens
NNLIYKCFAKYLASIFGTYNKS

SEQ ID NO: 2800754 - protein, 22 aa, Entamoeba invadens
NNLQRIIGRFPRIRSVGEYSKR

SEQ ID NO: 2800755 - protein, 20 aa, Entamoeba invadens
NNLYCVRYFTPLTEYLPALL

SEQ ID NO: 2800756 - protein, 23 aa, Entamoeba invadens
NNLYRFGKYFKIYIPPDKNKHYT

SEQ ID NO: 2800757 - protein, 26 aa, Entamoeba invadens
NNMCAACGVANCNSCTSSEPNKCTSC

SEQ ID NO: 2800758 - protein, 25 aa, Entamoeba invadens
NNMCTACAVANCNTCTSSEPNKCAS

SEQ ID NO: 2800759 - protein, 24 aa, Entamoeba invadens
NNMKCVDMGYPVRYCYHCEKFRKS

SEQ ID NO: 2800760 - protein, 17 aa, Entamoeba invadens
NNNCALCNSTLANKNCT

SEQ ID NO: 2800761 - protein, 19 aa, Entamoeba invadens
NNNCIICNDGYYLGNDGIC

SEQ ID NO: 2800762 - protein, 22 aa, Entamoeba invadens
NNNKCKYSLCGNQQLDSDVVDL

SEQ ID NO: 2800763 - protein, 25 aa, Entamoeba invadens
NNNTNCFTFNFKVDYNWMKKTIGVD

SEQ ID NO: 2800764 - protein, 22 aa, Entamoeba invadens
NNPECTQCFPPFELKEGSCVEC

SEQ ID NO: 2800765 - protein, 17 aa, Entamoeba invadens
NNPKFVFHFDPLVLLVR

SEQ ID NO: 2800766 - protein, 19 aa, Entamoeba invadens
NNPLFTLETIGVVKVFTKV

SEQ ID NO: 2800767 - protein, 17 aa, Entamoeba invadens
NNRCVGCDALFGCSECE

SEQ ID NO: 2800768 - protein, 23 aa, Entamoeba invadens
NNRGRKLVFIFSMQGIGNILAPT

SEQ ID NO: 2800769 - protein, 25 aa, Entamoeba invadens
NNRIYVGKCTFEFTQCTLTPTQKER

SEQ ID NO: 2800770 - protein, 27 aa, Entamoeba invadens
NNRSVLWSFRILRKVRIILRDETHIQK

SEQ ID NO: 2800771 - protein, 24 aa, Entamoeba invadens
NNRYRFGKYYKVYVPPNYNSTKNY

SEQ ID NO: 2800772 - protein, 25 aa, Entamoeba invadens
NNSKCISCGSGFYLDANTLKCSDDI

SEQ ID NO: 2800773 - protein, 25 aa, Entamoeba invadens
NNSNFLGKSQKCWDDEQIKRQLITI

SEQ ID NO: 2800774 - protein, 24 aa, Entamoeba invadens
NNTCAQCPQGMYFNGEACEYCTPN

SEQ ID NO: 2800775 - protein, 23 aa, Entamoeba invadens
NNTDSFFTYSFKIFFGERSCHDL

SEQ ID NO: 2800776 - protein, 19 aa, Entamoeba invadens
NNTELVKWVLYLQMSFVVF

SEQ ID NO: 2800777 - protein, 18 aa, Entamoeba invadens
NNTLPGWLLVRISSVIYI

SEQ ID NO: 2800778 - protein, 23 aa, Entamoeba invadens
NNTRCVPCVSIAEHCAVCDKYSY

SEQ ID NO: 2800779 - protein, 19 aa, Entamoeba invadens
NNTSIWPLFLFLVIQGVGL

SEQ ID NO: 2800780 - protein, 25 aa, Entamoeba invadens
NNVFIKSGVVLLFYTDCFLQLSSQI

SEQ ID NO: 2800781 - protein, 18 aa, Entamoeba invadens
NNVFWSSLQVVSWSIVIT

SEQ ID NO: 2800782 - protein, 20 aa, Entamoeba invadens
NNVHPCYDFNNNSTLVEGLI

SEQ ID NO: 2800783 - protein, 28 aa, Entamoeba invadens
NNVIYCKKGFYSNGTFCLDCKEHDPDCL

SEQ ID NO: 2800784 - protein, 24 aa, Entamoeba invadens
NNVKSDMVIVWGISDKAVLKSAQD

SEQ ID NO: 2800785 - protein, 24 aa, Entamoeba invadens
NNVNSELALVFGISDKAALKNVQN

SEQ ID NO: 2800786 - protein, 24 aa, Entamoeba invadens
NNVVSEMVIVWGISDKGVLKSAQD

SEQ ID NO: 2800787 - protein, 17 aa, Entamoeba invadens
NNWFSLGKRVIALSYRH

SEQ ID NO: 2800788 - protein, 22 aa, Entamoeba invadens
NNYCYGCSTGTYSSNENSDTCY

SEQ ID NO: 2800789 - protein, 27 aa, Entamoeba invadens
NNYDGECLLCLANCKECYNTTYCTSCQ

SEQ ID NO: 2800790 - protein, 18 aa, Entamoeba invadens
NNYECKKCDPKCPTCQSE

SEQ ID NO: 2800791 - protein, 24 aa, Entamoeba invadens
NNYKNTVRFVLRMLRNDTSVIMDG

SEQ ID NO: 2800792 - protein, 17 aa, Entamoeba invadens
NNYSCIQCFPSYVRNSN

SEQ ID NO: 2800793 - protein, 25 aa, Entamoeba invadens
NNYSYRIAQIPVFILLIIAFVFLTL

SEQ ID NO: 2800794 - protein, 24 aa, Entamoeba invadens
NPAFRSGCGLCFNVGLFEETLIEC

SEQ ID NO: 2800795 - protein, 23 aa, Entamoeba invadens
NPANNCKTCWATDKCTSCNDGFY

SEQ ID NO: 2800796 - protein, 32 aa, Entamoeba invadens
NPASELYSDIELYKFIGRVVGKTVYDGEFLDV

SEQ ID NO: 2800797 - protein, 19 aa, Entamoeba invadens
NPAWFAFVVNDHYIGVKSV

SEQ ID NO: 2800798 - protein, 26 aa, Entamoeba invadens
NPDGCILCATGFYLSNGRCVKCDNNC

SEQ ID NO: 2800799 - protein, 27 aa, Entamoeba invadens
NPDIPTQCDMCISGFYLNITTYTCEQG

SEQ ID NO: 2800800 - protein, 23 aa, Entamoeba invadens
NPEVHRRILLGSRMSIWSFLDWL

SEQ ID NO: 2800801 - protein, 20 aa, Entamoeba invadens
NPFEVLRYWFNADWISGADL

SEQ ID NO: 2800802 - protein, 17 aa, Entamoeba invadens
NPFKCVVTGFFKEKEEN

SEQ ID NO: 2800803 - protein, 19 aa, Entamoeba invadens
NPFMTFRMFCMCATFVLFV

SEQ ID NO: 2800804 - protein, 18 aa, Entamoeba invadens
NPHCYVHFNLNKTIYETT

SEQ ID NO: 2800805 - protein, 19 aa, Entamoeba invadens
NPIDCFRTNYARFNVLANE

SEQ ID NO: 2800806 - protein, 23 aa, Entamoeba invadens
NPIERLYLAICTRGTDDSSQYAI

SEQ ID NO: 2800807 - protein, 18 aa, Entamoeba invadens
NPIICALGKYGTYPECNK

SEQ ID NO: 2800808 - protein, 19 aa, Entamoeba invadens
NPINTKWFRVVPSFHTILL

SEQ ID NO: 2800809 - protein, 17 aa, Entamoeba invadens
NPITRLKIAEVISRLKT

SEQ ID NO: 2800810 - protein, 25 aa, Entamoeba invadens
NPKAEAVICYPEFYADIRISDTQTF

SEQ ID NO: 2800811 - protein, 23 aa, Entamoeba invadens
NPKCTLCFSPYFIENGKCVLSYS

SEQ ID NO: 2800812 - protein, 22 aa, Entamoeba invadens
NPKKQSCILCKNFDINCKTCSP

SEQ ID NO: 2800813 - protein, 24 aa, Entamoeba invadens
NPLKTRWYVTLFVFIGWGLSFSIP

SEQ ID NO: 2800814 - protein, 17 aa, Entamoeba invadens
NPLRQISVMMIKLNNLE

SEQ ID NO: 2800815 - protein, 18 aa, Entamoeba invadens
NPNFFVLHVKRIIFYHQL

SEQ ID NO: 2800816 - protein, 19 aa, Entamoeba invadens
NPNTFFLKKERILETQQET

SEQ ID NO: 2800817 - protein, 19 aa, Entamoeba invadens
NPNYFLRDFRGWSIAHHIF

SEQ ID NO: 2800818 - protein, 19 aa, Entamoeba invadens
NPPDISLRKKIMVDASNGI

SEQ ID NO: 2800819 - protein, 24 aa, Entamoeba invadens
NPPLTEYYAMIALGENTQVYQGSL

SEQ ID NO: 2800820 - protein, 25 aa, Entamoeba invadens
NPREKAKEKHVWVAVFERYVDDLIR

SEQ ID NO: 2800821 - protein, 27 aa, Entamoeba invadens
NPRKGIFKWGFFLAFFEAVNNVVYGTI

SEQ ID NO: 2800822 - protein, 18 aa, Entamoeba invadens
NPSCSKLPTLSFAGTSTI

SEQ ID NO: 2800823 - protein, 24 aa, Entamoeba invadens
NPSSIKCSLALNIGTVPNSVNGLI

SEQ ID NO: 2800824 - protein, 18 aa, Entamoeba invadens
NPSTGMCINCDSYCTQCI

SEQ ID NO: 2800825 - protein, 19 aa, Entamoeba invadens
NPTDAFFFYNLGRLLFAVA

SEQ ID NO: 2800826 - protein, 18 aa, Entamoeba invadens
NPTLYGWNVTPPVLTGMD

SEQ ID NO: 2800827 - protein, 32 aa, Entamoeba invadens
NPTRNFLCYFSRLSKFFPHAKTLCLPSYSCLI

SEQ ID NO: 2800828 - protein, 25 aa, Entamoeba invadens
NPTYCLSCPPGFYISNNICKTNSEL

SEQ ID NO: 2800829 - protein, 25 aa, Entamoeba invadens
NPVCYPHVAMKSVVFTMEFIGDYKM

SEQ ID NO: 2800830 - protein, 19 aa, Entamoeba invadens
NPVRSAIRASLKLEVDSRG

SEQ ID NO: 2800831 - protein, 19 aa, Entamoeba invadens
NPYIIVRVGFLFFIAAVAV

SEQ ID NO: 2800832 - protein, 25 aa, Entamoeba invadens
NPYLLFRIADVFFITCVVLVMVLNT

SEQ ID NO: 2800833 - protein, 26 aa, Entamoeba invadens
NPYPKEQFKFAWDIVDFVVSGKRLKK

SEQ ID NO: 2800834 - protein, 23 aa, Entamoeba invadens
NPYYHPAPTTAYRLHSVSETVYA

SEQ ID NO: 2800835 - protein, 38 aa, Entamoeba invadens
NQADCTRLSYSLRNFLFWGIGCIAYLLLYLLLLFLIVI

SEQ ID NO: 2800836 - protein, 39 aa, Entamoeba invadens
NQADCTRLSYSLRNFLFWGIGCIVYLLLYLMLLFLINIL

SEQ ID NO: 2800837 - protein, 17 aa, Entamoeba invadens
NQCKSCSSQCKQCSNAN

SEQ ID NO: 2800838 - protein, 19 aa, Entamoeba invadens
NQCQACLSTFVYSNGKCDS

SEQ ID NO: 2800839 - protein, 19 aa, Entamoeba invadens
NQCSLCKNGYQLNEKLECI

SEQ ID NO: 2800840 - protein, 18 aa, Entamoeba invadens
NQDFKNTILFAVNGMFIE

SEQ ID NO: 2800841 - protein, 25 aa, Entamoeba invadens
NQDIFKFPWKIAEFVTSGQRPERLD

SEQ ID NO: 2800842 - protein, 24 aa, Entamoeba invadens
NQECLSQLFSLWKAVENKLGESIR

SEQ ID NO: 2800843 - protein, 17 aa, Entamoeba invadens
NQFALWRTLWDNFSHEY

SEQ ID NO: 2800844 - protein, 26 aa, Entamoeba invadens
NQFVFKFKMYIFYSLNEIKKLINFTG

SEQ ID NO: 2800845 - protein, 18 aa, Entamoeba invadens
NQHFNMKLNFSGIGIIGD

SEQ ID NO: 2800846 - protein, 17 aa, Entamoeba invadens
NQIIPADIVPLVSTNEN

SEQ ID NO: 2800847 - protein, 25 aa, Entamoeba invadens
NQIKNSKCVKCSFWNIPNDDGTLCE

SEQ ID NO: 2800848 - protein, 18 aa, Entamoeba invadens
NQKCLSCEAGTYKKTETT

SEQ ID NO: 2800849 - protein, 25 aa, Entamoeba invadens
NQKGCLECSYGYFLKNYKCLSCPQN

SEQ ID NO: 2800850 - protein, 17 aa, Entamoeba invadens
NQKGIAYVAHMLNHISQ

SEQ ID NO: 2800851 - protein, 29 aa, Entamoeba invadens
NQKRFLECGDGYFPKVSECIVCTVTNCIR

SEQ ID NO: 2800852 - protein, 24 aa, Entamoeba invadens
NQKTDIPEILPFISNKETTKIKDK

SEQ ID NO: 2800853 - protein, 20 aa, Entamoeba invadens
NQLFIAHAILQIEHPKIGYF

SEQ ID NO: 2800854 - protein, 23 aa, Entamoeba invadens
NQLIGKWSKLVMNVFYSDDFFKK

SEQ ID NO: 2800855 - protein, 18 aa, Entamoeba invadens
NQLYDWNTKQMKLGENDE

SEQ ID NO: 2800856 - protein, 18 aa, Entamoeba invadens
NQRKCINCQSGMYPNTNG

SEQ ID NO: 2800857 - protein, 23 aa, Entamoeba invadens
NQTKLTYFGAFSINRTYQAVISG

SEQ ID NO: 2800858 - protein, 24 aa, Entamoeba invadens
NQTLIDFYMFFSIVAGNTPTDLTR

SEQ ID NO: 2800859 - protein, 24 aa, Entamoeba invadens
NQTSCKKCPIGTFQNETGQSSCTP

SEQ ID NO: 2800860 - protein, 17 aa, Entamoeba invadens
NQTSFNRSVCTQGVDPF

SEQ ID NO: 2800861 - protein, 24 aa, Entamoeba invadens
NQVSCTKCLPSFYREETVYCSPTT

SEQ ID NO: 2800862 - protein, 21 aa, Entamoeba invadens
NQYCRCYEGYITNPNDRTSCI

SEQ ID NO: 2800863 - protein, 18 aa, Entamoeba invadens
NQYCSLCSENTENCTSCD

SEQ ID NO: 2800864 - protein, 24 aa, Entamoeba invadens
NQYCSSCSSAIHNCNKCYSNTDCM

SEQ ID NO: 2800865 - protein, 17 aa, Entamoeba invadens
NQYCSSCSSAIPNCNKC

SEQ ID NO: 2800866 - protein, 23 aa, Entamoeba invadens
NQYCSSCSSAIPNCNKCYSNTDC

SEQ ID NO: 2800867 - protein, 19 aa, Entamoeba invadens
NQYLPKFYGAVFVTTKISF

SEQ ID NO: 2800868 - protein, 22 aa, Entamoeba invadens
NQYYPYYGAFIIYVTVKNSDKG

SEQ ID NO: 2800869 - protein, 19 aa, Entamoeba invadens
NRAQGWMGNGYIKFSTVFR

SEQ ID NO: 2800870 - protein, 24 aa, Entamoeba invadens
NRCIKCPFWQAPSVDGLYCMNSPV

SEQ ID NO: 2800871 - protein, 17 aa, Entamoeba invadens
NRCIPNITFDKTQIKEC

SEQ ID NO: 2800872 - protein, 21 aa, Entamoeba invadens
NRCLKCEEGYSIVDGICQVNK

SEQ ID NO: 2800873 - protein, 18 aa, Entamoeba invadens
NRCMFGYETLSSVEIPTS

SEQ ID NO: 2800874 - protein, 25 aa, Entamoeba invadens
NREFPKKRGELVIGNLLQATPVVTR

SEQ ID NO: 2800875 - protein, 20 aa, Entamoeba invadens
NREISAFITDCIFIEDEKFS

SEQ ID NO: 2800876 - protein, 19 aa, Entamoeba invadens
NREVCRRRVGNYSFNDYNA

SEQ ID NO: 2800877 - protein, 22 aa, Entamoeba invadens
NRFGESLLSHFSGVKQQEIDKV

SEQ ID NO: 2800878 - protein, 24 aa, Entamoeba invadens
NRFKEHICTFPGCTENPKTKYNVI

SEQ ID NO: 2800879 - protein, 22 aa, Entamoeba invadens
NRGESFHRCTLTVSGQGNCNRQ

SEQ ID NO: 2800880 - protein, 17 aa, Entamoeba invadens
NRIECVFKDSEYNGFKY

SEQ ID NO: 2800881 - protein, 21 aa, Entamoeba invadens
NRIMKTMLFTMNFTGDYSIRV

SEQ ID NO: 2800882 - protein, 27 aa, Entamoeba invadens
NRINETICLKGNLMIIAITTSGFVFGS

SEQ ID NO: 2800883 - protein, 19 aa, Entamoeba invadens
NRISIRLRVLFTRGLEETL

SEQ ID NO: 2800884 - protein, 18 aa, Entamoeba invadens
NRKECTKINLALIIPLSV

SEQ ID NO: 2800885 - protein, 24 aa, Entamoeba invadens
NRKHRCEKCYKWVCGNCSKGKIPM

SEQ ID NO: 2800886 - protein, 23 aa, Entamoeba invadens
NRKPEVLDYLGVAFGYTPQLAKF

SEQ ID NO: 2800887 - protein, 27 aa, Entamoeba invadens
NRKRFLNSIRWVWTLVGYAIIGGVFAG

SEQ ID NO: 2800888 - protein, 21 aa, Entamoeba invadens
NRLGRCGEWLELVGPSEQKVD

SEQ ID NO: 2800889 - protein, 20 aa, Entamoeba invadens
NRLHLYKNSFDFDIINPIGN

SEQ ID NO: 2800890 - protein, 17 aa, Entamoeba invadens
NRLKTVKSLLTTTVDSS

SEQ ID NO: 2800891 - protein, 18 aa, Entamoeba invadens
NRLMRFGSSNKFFCHLKG

SEQ ID NO: 2800892 - protein, 21 aa, Entamoeba invadens
NRLTDPYSLLFAGAYLCRISS

SEQ ID NO: 2800893 - protein, 25 aa, Entamoeba invadens
NRLTEPWKSAYPLLYKIPNNNDQIV

SEQ ID NO: 2800894 - protein, 19 aa, Entamoeba invadens
NRMCLKCNQGYYPLKVYPF

SEQ ID NO: 2800895 - protein, 19 aa, Entamoeba invadens
NRNARFGKVKVMLTQIREY

SEQ ID NO: 2800896 - protein, 20 aa, Entamoeba invadens
NRNMTARAFAIVAAALGIPV

SEQ ID NO: 2800897 - protein, 21 aa, Entamoeba invadens
NRNTSICFVGRCGMEQTACER

SEQ ID NO: 2800898 - protein, 23 aa, Entamoeba invadens
NRPRKCKELLQVVHLLKSGSDEE

SEQ ID NO: 2800899 - protein, 18 aa, Entamoeba invadens
NRQCYKCDLICKTCSSSD

SEQ ID NO: 2800900 - protein, 18 aa, Entamoeba invadens
NRQFKVGSIFGGGVYLKT

SEQ ID NO: 2800901 - protein, 20 aa, Entamoeba invadens
NRQNFMLAVDMCLGNTDNEQ

SEQ ID NO: 2800902 - protein, 19 aa, Entamoeba invadens
NRRDLWLTAVGFRDELYWQ

SEQ ID NO: 2800903 - protein, 19 aa, Entamoeba invadens
NRRKKWCVENALNFKALST

SEQ ID NO: 2800904 - protein, 17 aa, Entamoeba invadens
NRTFEFCEMDTISNKST

SEQ ID NO: 2800905 - protein, 17 aa, Entamoeba invadens
NRVAQYFDFVIGELPIV

SEQ ID NO: 2800906 - protein, 22 aa, Entamoeba invadens
NRVEIYYGLVLLKEFSSNVFQS

SEQ ID NO: 2800907 - protein, 27 aa, Entamoeba invadens
NRVEVLKWIKSIACEIVKKPNVVGETP

SEQ ID NO: 2800908 - protein, 19 aa, Entamoeba invadens
NRVKCVLKENVYVQNYLQG

SEQ ID NO: 2800909 - protein, 20 aa, Entamoeba invadens
NRVTRLLKVNGIYRFSLLPS

SEQ ID NO: 2800910 - protein, 19 aa, Entamoeba invadens
NRYGYHLVTVVGYNDNYLA

SEQ ID NO: 2800911 - protein, 24 aa, Entamoeba invadens
NSAFCLTCPAGTFSKEKYEKCTEC

SEQ ID NO: 2800912 - protein, 23 aa, Entamoeba invadens
NSAIKGCDLCKDSILTSSNNCTK

SEQ ID NO: 2800913 - protein, 20 aa, Entamoeba invadens
NSAITIICVIAFSSRLYSIV

SEQ ID NO: 2800914 - protein, 20 aa, Entamoeba invadens
NSCASLFPNCQICSSNSCSQ

SEQ ID NO: 2800915 - protein, 27 aa, Entamoeba invadens
NSCDVSDFFECLIKTLIVGGNNKTLHE

SEQ ID NO: 2800916 - protein, 19 aa, Entamoeba invadens
NSCKLCAAGTYSKQNAPSC

SEQ ID NO: 2800917 - protein, 24 aa, Entamoeba invadens
NSDECLLCKDNYFLLENGTCGEIS

SEQ ID NO: 2800918 - protein, 18 aa, Entamoeba invadens
NSDLCFFGEPWCDQYCHC

SEQ ID NO: 2800919 - protein, 26 aa, Entamoeba invadens
NSDLGCGGSMWIICPTGVKRSNYVCK

SEQ ID NO: 2800920 - protein, 27 aa, Entamoeba invadens
NSDLGCGGSMWIICPTGVKRSNYVCKG

SEQ ID NO: 2800921 - protein, 26 aa, Entamoeba invadens
NSDRCLKCSIGFLLINGKCFNSSDCI

SEQ ID NO: 2800922 - protein, 21 aa, Entamoeba invadens
NSDSCGYYFQPYSTIRFLVSD

SEQ ID NO: 2800923 - protein, 18 aa, Entamoeba invadens
NSDVVLKCQTSHYVSFPS

SEQ ID NO: 2800924 - protein, 17 aa, Entamoeba invadens
NSDWHKVEGAIFGLRAM

SEQ ID NO: 2800925 - protein, 24 aa, Entamoeba invadens
NSDYARALVPFFFRAFSTPGSRGS

SEQ ID NO: 2800926 - protein, 22 aa, Entamoeba invadens
NSECYNCENGFYLVNESCLKCI

SEQ ID NO: 2800927 - protein, 17 aa, Entamoeba invadens
NSEDLKYVVLYKNAPSQ

SEQ ID NO: 2800928 - protein, 21 aa, Entamoeba invadens
NSEGITLPSQITYGVILVKKS

SEQ ID NO: 2800929 - protein, 17 aa, Entamoeba invadens
NSEKCIFSLTNKISLKC

SEQ ID NO: 2800930 - protein, 27 aa, Entamoeba invadens
NSEKCLSCGVDKILLKGSCVDYRTVTH

SEQ ID NO: 2800931 - protein, 19 aa, Entamoeba invadens
NSEKFKMDYYEILKINVFY

SEQ ID NO: 2800932 - protein, 24 aa, Entamoeba invadens
NSESKYTFCLPLSKTNISNCKHAA

SEQ ID NO: 2800933 - protein, 17 aa, Entamoeba invadens
NSEVIFTDHINVVCSSQ

SEQ ID NO: 2800934 - protein, 24 aa, Entamoeba invadens
NSFCLKCSSGYYLSDHQCVSNLEL

SEQ ID NO: 2800935 - protein, 21 aa, Entamoeba invadens
NSFCYLAAIGYFSTINGILEC

SEQ ID NO: 2800936 - protein, 31 aa, Entamoeba invadens
NSFFKEGSSFVFWKRFSVSQRSTFVIKTCSP

SEQ ID NO: 2800937 - protein, 20 aa, Entamoeba invadens
NSFNCYGIYIGTLMIKKSIE

SEQ ID NO: 2800938 - protein, 17 aa, Entamoeba invadens
NSFNKFLIWFEQDADDI

SEQ ID NO: 2800939 - protein, 17 aa, Entamoeba invadens
NSFNKLLSVSGIMADCG

SEQ ID NO: 2800940 - protein, 18 aa, Entamoeba invadens
NSGFYLFNGRCVVCDLTC

SEQ ID NO: 2800941 - protein, 30 aa, Entamoeba invadens
NSGKIEFVDFKFRYRKGLQVVLKNVSTTIQ

SEQ ID NO: 2800942 - protein, 17 aa, Entamoeba invadens
NSGLRTLFIARRVLSGK

SEQ ID NO: 2800943 - protein, 23 aa, Entamoeba invadens
NSGPKLKGLILGMSECVGELTCC

SEQ ID NO: 2800944 - protein, 17 aa, Entamoeba invadens
NSHVRWSTISGLEKLCT

SEQ ID NO: 2800945 - protein, 18 aa, Entamoeba invadens
NSIISMIYYKALRLNVLD

SEQ ID NO: 2800946 - protein, 20 aa, Entamoeba invadens
NSILKFFNVLFFRQPLSQMI

SEQ ID NO: 2800947 - protein, 17 aa, Entamoeba invadens
NSILKKLYLCGWCFCCP

SEQ ID NO: 2800948 - protein, 24 aa, Entamoeba invadens
NSISCSLCADTYFYYKRDSDLCIT

SEQ ID NO: 2800949 - protein, 17 aa, Entamoeba invadens
NSISSVIAYFVKKELIM

SEQ ID NO: 2800950 - protein, 21 aa, Entamoeba invadens
NSKCEKCSFWHSASDDGTYCL

SEQ ID NO: 2800951 - protein, 18 aa, Entamoeba invadens
NSKCGVCSTTLTTNCTKC

SEQ ID NO: 2800952 - protein, 21 aa, Entamoeba invadens
NSKCIKCAFWYSPNSDGTYCR

SEQ ID NO: 2800953 - protein, 25 aa, Entamoeba invadens
NSKCIRCASGFFLNGLVPICEACTI

SEQ ID NO: 2800954 - protein, 18 aa, Entamoeba invadens
NSKCKECDNYYYLNDLGQ

SEQ ID NO: 2800955 - protein, 20 aa, Entamoeba invadens
NSKCKLATCGNGKIDFDDNY

SEQ ID NO: 2800956 - protein, 22 aa, Entamoeba invadens
NSKCLHCDQSFLANGKCLDFSD

SEQ ID NO: 2800957 - protein, 25 aa, Entamoeba invadens
NSKCNKCSFWNAPSLDGTYCEKRAV

SEQ ID NO: 2800958 - protein, 21 aa, Entamoeba invadens
NSKCNRCSFWNAPSLDGTYCE

SEQ ID NO: 2800959 - protein, 20 aa, Entamoeba invadens
NSKCSKCSFWNVPSGDGISC

SEQ ID NO: 2800960 - protein, 23 aa, Entamoeba invadens
NSKCSTCKFWYAPSSDGTSCAKK

SEQ ID NO: 2800961 - protein, 21 aa, Entamoeba invadens
NSKCTKCAFWHTPNYSNTSCH

SEQ ID NO: 2800962 - protein, 21 aa, Entamoeba invadens
NSKCTKCKFWNIPEINGSYCE

SEQ ID NO: 2800963 - protein, 22 aa, Entamoeba invadens
NSKCTNCAFWYSPNEDGTYCET

SEQ ID NO: 2800964 - protein, 18 aa, Entamoeba invadens
NSKCVKCSFWHVPNSTQT

SEQ ID NO: 2800965 - protein, 19 aa, Entamoeba invadens
NSKCVKCTFWHVPTDEGTG

SEQ ID NO: 2800966 - protein, 23 aa, Entamoeba invadens
NSKGEYPIQIVLHRFTKETHRSL

SEQ ID NO: 2800967 - protein, 23 aa, Entamoeba invadens
NSKLLEWDLILFLKPNSLEVQKK

SEQ ID NO: 2800968 - protein, 18 aa, Entamoeba invadens
NSKMYIGGFVKIYNAFEY

SEQ ID NO: 2800969 - protein, 29 aa, Entamoeba invadens
NSKRISSNMIDRMICNLALIEAERAKIKE

SEQ ID NO: 2800970 - protein, 22 aa, Entamoeba invadens
NSKRITGVLCLFKKRNQLFISY

SEQ ID NO: 2800971 - protein, 24 aa, Entamoeba invadens
NSKYSYKHLSVFLLKANAIIKKYP

SEQ ID NO: 2800972 - protein, 20 aa, Entamoeba invadens
NSLALPLLKLFIKINSKKYD

SEQ ID NO: 2800973 - protein, 23 aa, Entamoeba invadens
NSLCFKYTFPCAICKDDIKCDKC

SEQ ID NO: 2800974 - protein, 23 aa, Entamoeba invadens
NSLCVLCSPGYYYNGTQCVSCGA

SEQ ID NO: 2800975 - protein, 17 aa, Entamoeba invadens
NSLDFNSACSIKIVDFG

SEQ ID NO: 2800976 - protein, 17 aa, Entamoeba invadens
NSLDFNSACTIKITDFG

SEQ ID NO: 2800977 - protein, 18 aa, Entamoeba invadens
NSLEIKSSLEFNLAYVRN

SEQ ID NO: 2800978 - protein, 22 aa, Entamoeba invadens
NSLFLNLVFSFTFGKITTNQNK

SEQ ID NO: 2800979 - protein, 18 aa, Entamoeba invadens
NSLGCYLFATSVNTLAYQ

SEQ ID NO: 2800980 - protein, 21 aa, Entamoeba invadens
NSLKFLKEFFSDTGRLKYGFY

SEQ ID NO: 2800981 - protein, 17 aa, Entamoeba invadens
NSLKVDSVLGCLDRNER

SEQ ID NO: 2800982 - protein, 20 aa, Entamoeba invadens
NSLLDHRATVYIPEINMEVK

SEQ ID NO: 2800983 - protein, 17 aa, Entamoeba invadens
NSLLLVFYYKNRKRQIS

SEQ ID NO: 2800984 - protein, 19 aa, Entamoeba invadens
NSLMISENVLYIFNSTNNQ

SEQ ID NO: 2800985 - protein, 25 aa, Entamoeba invadens
NSLMYKLCYYRFGELYTEQNQPSGY

SEQ ID NO: 2800986 - protein, 17 aa, Entamoeba invadens
NSLVIKSDVGAVELTTT

SEQ ID NO: 2800987 - protein, 26 aa, Entamoeba invadens
NSLYELPKWFAVVVISFVVLFLVIMW

SEQ ID NO: 2800988 - protein, 19 aa, Entamoeba invadens
NSLYICIALIIVTMVLYPF

SEQ ID NO: 2800989 - protein, 23 aa, Entamoeba invadens
NSLYRYFCYSSNFADLYNQMTSL

SEQ ID NO: 2800990 - protein, 20 aa, Entamoeba invadens
NSLYVCIVLVALLFVVYPFT

SEQ ID NO: 2800991 - protein, 17 aa, Entamoeba invadens
NSMCLACNNSYYLFNNI

SEQ ID NO: 2800992 - protein, 26 aa, Entamoeba invadens
NSMGCAFCKDGYYWSEWSCLECSAAC

SEQ ID NO: 2800993 - protein, 20 aa, Entamoeba invadens
NSMLIFLILLHLSALALKCT

SEQ ID NO: 2800994 - protein, 25 aa, Entamoeba invadens
NSMSALRAGLYFIYMVNSTSQVIAW

SEQ ID NO: 2800995 - protein, 23 aa, Entamoeba invadens
NSNEPKIWLGFVYAIIVLATQLT

SEQ ID NO: 2800996 - protein, 26 aa, Entamoeba invadens
NSNHGFKIQIIRKFLKQIINSLEILS

SEQ ID NO: 2800997 - protein, 20 aa, Entamoeba invadens
NSNICLECLYGYYKDSTNNC

SEQ ID NO: 2800998 - protein, 24 aa, Entamoeba invadens
NSNLPPGFLFLFGVRANVWAPTNL

SEQ ID NO: 2800999 - protein, 26 aa, Entamoeba invadens
NSNRHDLKWSYIIKMTNFYSIALFFI

SEQ ID NO: 2801000 - protein, 19 aa, Entamoeba invadens
NSNYCFACAEDYYFTDATN

SEQ ID NO: 2801001 - protein, 31 aa, Entamoeba invadens
NSPEFLLDEFLKVLTVNGLNWIQLLVGANKH

SEQ ID NO: 2801002 - protein, 18 aa, Entamoeba invadens
NSPVFKEEVLKSFREVDK

SEQ ID NO: 2801003 - protein, 18 aa, Entamoeba invadens
NSPVWWLIVIIIIIILLV

SEQ ID NO: 2801004 - protein, 21 aa, Entamoeba invadens
NSQCKNCLTKHENSIFCNTNI

SEQ ID NO: 2801005 - protein, 21 aa, Entamoeba invadens
NSQCTKCKFWNSPNIEGKYCE

SEQ ID NO: 2801006 - protein, 24 aa, Entamoeba invadens
NSQCTKCKFWNSPNLEGKCCETKV

SEQ ID NO: 2801007 - protein, 19 aa, Entamoeba invadens
NSQEFVGFVELRSSCNATS

SEQ ID NO: 2801008 - protein, 25 aa, Entamoeba invadens
NSQITIDLTFSWGFSPVVFVDENTE

SEQ ID NO: 2801009 - protein, 18 aa, Entamoeba invadens
NSRCISCSNSNYSVNGYE

SEQ ID NO: 2801010 - protein, 23 aa, Entamoeba invadens
NSRCTSCVNGTYIKEGTCSVCGT

SEQ ID NO: 2801011 - protein, 20 aa, Entamoeba invadens
NSRKCLSCANDYFLANYKCE

SEQ ID NO: 2801012 - protein, 20 aa, Entamoeba invadens
NSRVNYIEFPRKCGLIQCDG

SEQ ID NO: 2801013 - protein, 25 aa, Entamoeba invadens
NSRYFKQLFVYKLMKRTTILIWNCR

SEQ ID NO: 2801014 - protein, 23 aa, Entamoeba invadens
NSSCVTVAFILWIFFNMATINDV

SEQ ID NO: 2801015 - protein, 25 aa, Entamoeba invadens
NSSEFEYPWKIAMFVCNGSRLNQPN

SEQ ID NO: 2801016 - protein, 18 aa, Entamoeba invadens
NSSFCVYCVTGFSISNGK

SEQ ID NO: 2801017 - protein, 18 aa, Entamoeba invadens
NSSLSFKEVDGLTQVAVG

SEQ ID NO: 2801018 - protein, 23 aa, Entamoeba invadens
NSSQKLFVWPLKKVDTIEKVPKI

SEQ ID NO: 2801019 - protein, 25 aa, Entamoeba invadens
NSTAICTKCIFGYYLSSGECISCET

SEQ ID NO: 2801020 - protein, 23 aa, Entamoeba invadens
NSTAIRWFLPLLSLSMKMSSIYQ

SEQ ID NO: 2801021 - protein, 19 aa, Entamoeba invadens
NSTCLKCSEGTYPNGVGKC

SEQ ID NO: 2801022 - protein, 19 aa, Entamoeba invadens
NSTCLKCSEGTYPSGVGKC

SEQ ID NO: 2801023 - protein, 26 aa, Entamoeba invadens
NSTFCLTCKNGYFVNDFKCVPNKELE

SEQ ID NO: 2801024 - protein, 20 aa, Entamoeba invadens
NSTFCLVCPVGEYQDQSGSH

SEQ ID NO: 2801025 - protein, 23 aa, Entamoeba invadens
NSTFKINPNWVIQYSYLKTSSIK

SEQ ID NO: 2801026 - protein, 19 aa, Entamoeba invadens
NSTIFGGLMKWARSDVSDI

SEQ ID NO: 2801027 - protein, 25 aa, Entamoeba invadens
NSTKCLSCVDGYFLSDHICKSNDAL

SEQ ID NO: 2801028 - protein, 22 aa, Entamoeba invadens
NSTNCKCYEGFVPDPDNKGSCK

SEQ ID NO: 2801029 - protein, 24 aa, Entamoeba invadens
NSTSCLSCYSGFYKQEKTCISNSE

SEQ ID NO: 2801030 - protein, 24 aa, Entamoeba invadens
NSTTSFTLYGYIGKVFVTTSTAPY

SEQ ID NO: 2801031 - protein, 22 aa, Entamoeba invadens
NSTYCLSCSTDLYFLNVNNECE

SEQ ID NO: 2801032 - protein, 23 aa, Entamoeba invadens
NSTYCLSCSTDLYFLNVNNECEL

SEQ ID NO: 2801033 - protein, 24 aa, Entamoeba invadens
NSTYCTVCTFGYFKSNGKCVSCDQ

SEQ ID NO: 2801034 - protein, 18 aa, Entamoeba invadens
NSVARILSLYTMEDEKRA

SEQ ID NO: 2801035 - protein, 20 aa, Entamoeba invadens
NSVGCLRCKDQFYYNKTTQL

SEQ ID NO: 2801036 - protein, 26 aa, Entamoeba invadens
NSVIEKCFFIPISEGGVFTMRNNSII

SEQ ID NO: 2801037 - protein, 21 aa, Entamoeba invadens
NSVPWNCWIADMFNSNELPGG

SEQ ID NO: 2801038 - protein, 21 aa, Entamoeba invadens
NSVSCFKCPAGTFSNAGATKC

SEQ ID NO: 2801039 - protein, 30 aa, Entamoeba invadens
NSVSCNFKYATRCSLKFEMSDLGACDTSSC

SEQ ID NO: 2801040 - protein, 17 aa, Entamoeba invadens
NSVWGVANLHDFTQTNI

SEQ ID NO: 2801041 - protein, 17 aa, Entamoeba invadens
NSVYNFGFRINQTDKNH

SEQ ID NO: 2801042 - protein, 24 aa, Entamoeba invadens
NSYCTACPYGTYSKDSATSCTTCP

SEQ ID NO: 2801043 - protein, 20 aa, Entamoeba invadens
NSYECLACKDGYFNIPSEGK

SEQ ID NO: 2801044 - protein, 26 aa, Entamoeba invadens
NSYIELLGSFIFKLSRNNLQMSSSTQ

SEQ ID NO: 2801045 - protein, 17 aa, Entamoeba invadens
NSYPVFDIFSLSLWDIN

SEQ ID NO: 2801046 - protein, 19 aa, Entamoeba invadens
NSYQCSSCAEGYYQIQGET

SEQ ID NO: 2801047 - protein, 24 aa, Entamoeba invadens
NTAFTMLRINPFYSHKTLEQELKL

SEQ ID NO: 2801048 - protein, 24 aa, Entamoeba invadens
NTAFYFCVLMIYQVIATQYLFGII

SEQ ID NO: 2801049 - protein, 22 aa, Entamoeba invadens
NTARVHIAWVKKMVDEYLKENV

SEQ ID NO: 2801050 - protein, 22 aa, Entamoeba invadens
NTCAGLNRYTLLVWIILFLGWT

SEQ ID NO: 2801051 - protein, 22 aa, Entamoeba invadens
NTCFLQRMLSTVMNFNNLTQPP

SEQ ID NO: 2801052 - protein, 22 aa, Entamoeba invadens
NTCLTCANIPSCVKCSTTTNEC

SEQ ID NO: 2801053 - protein, 24 aa, Entamoeba invadens
NTCNKCSLTGCVECEYIESISDVG

SEQ ID NO: 2801054 - protein, 19 aa, Entamoeba invadens
NTCVICPAGTYADQSKEDV

SEQ ID NO: 2801055 - protein, 24 aa, Entamoeba invadens
NTDGYCRGCNFNYVFTQPRGNTCV

SEQ ID NO: 2801056 - protein, 18 aa, Entamoeba invadens
NTDLCYFGAPGCDQYCHC

SEQ ID NO: 2801057 - protein, 23 aa, Entamoeba invadens
NTDLVKGHWFRFIGADQILNFSM

SEQ ID NO: 2801058 - protein, 23 aa, Entamoeba invadens
NTDVQFKYAWSIADFTSSGKRLP

SEQ ID NO: 2801059 - protein, 23 aa, Entamoeba invadens
NTDVQFKYAWSIADFTSSGKRLQ

SEQ ID NO: 2801060 - protein, 18 aa, Entamoeba invadens
NTEECTEGLKLIVETDLD

SEQ ID NO: 2801061 - protein, 23 aa, Entamoeba invadens
NTEGEVVIACEMFVVVTNGTNGI

SEQ ID NO: 2801062 - protein, 24 aa, Entamoeba invadens
NTEIISSALLEWHPDPPVFCFIVL

SEQ ID NO: 2801063 - protein, 17 aa, Entamoeba invadens
NTEILYPFFKHILSYLV

SEQ ID NO: 2801064 - protein, 26 aa, Entamoeba invadens
NTEQKWIFPTAIRFVFLFFVASIFLN

SEQ ID NO: 2801065 - protein, 30 aa, Entamoeba invadens
NTESNHTFFWTVFFVMQFSTVFIAAYLLMK

SEQ ID NO: 2801066 - protein, 21 aa, Entamoeba invadens
NTEVLSCVGGYFVDKTTNVCQ

SEQ ID NO: 2801067 - protein, 17 aa, Entamoeba invadens
NTFKCFDTIRLCIDRNK

SEQ ID NO: 2801068 - protein, 23 aa, Entamoeba invadens
NTFKHINMFSEFIVYCSTENLAS

SEQ ID NO: 2801069 - protein, 28 aa, Entamoeba invadens
NTFKNVFKTILFRMAMKQIMKGQKGNLT

SEQ ID NO: 2801070 - protein, 21 aa, Entamoeba invadens
NTFNFFNKFVFTRNMASTPSD

SEQ ID NO: 2801071 - protein, 18 aa, Entamoeba invadens
NTGCAICRDGYYYHNKDC

SEQ ID NO: 2801072 - protein, 23 aa, Entamoeba invadens
NTGCAKCYDGYYLSGNECLPCDK

SEQ ID NO: 2801073 - protein, 17 aa, Entamoeba invadens
NTGKVFVYFDNILSGFS

SEQ ID NO: 2801074 - protein, 18 aa, Entamoeba invadens
NTIERCLKQTELTCLECE

SEQ ID NO: 2801075 - protein, 27 aa, Entamoeba invadens
NTISAFMTLMFPFVWQHVLIPLLPKSL

SEQ ID NO: 2801076 - protein, 18 aa, Entamoeba invadens
NTISEFRGYIAVELNSNY

SEQ ID NO: 2801077 - protein, 20 aa, Entamoeba invadens
NTIYFKGEWTTPFETAELNF

SEQ ID NO: 2801078 - protein, 20 aa, Entamoeba invadens
NTIYFRGQWETEFNTVDIDF

SEQ ID NO: 2801079 - protein, 19 aa, Entamoeba invadens
NTKCAAGYVFYNKTAFVTQ

SEQ ID NO: 2801080 - protein, 19 aa, Entamoeba invadens
NTKFCMTVYMTLHCSTKIK

SEQ ID NO: 2801081 - protein, 19 aa, Entamoeba invadens
NTKKCIVFVILLLVVLCMA

SEQ ID NO: 2801082 - protein, 21 aa, Entamoeba invadens
NTKQLFLCGVNELISTFYETT

SEQ ID NO: 2801083 - protein, 24 aa, Entamoeba invadens
NTKQYRLVIFVAEVPQNSMCDKPT

SEQ ID NO: 2801084 - protein, 25 aa, Entamoeba invadens
NTKRCISCKLGFILMNGECVNSSNC

SEQ ID NO: 2801085 - protein, 24 aa, Entamoeba invadens
NTKRFCYYCINGFIASNGVCVCPT

SEQ ID NO: 2801086 - protein, 23 aa, Entamoeba invadens
NTKSCLKCNLGYVLIGQDGSYSC

SEQ ID NO: 2801087 - protein, 27 aa, Entamoeba invadens
NTLCAVGTSFGCTRCINGFYYSYNTKT

SEQ ID NO: 2801088 - protein, 25 aa, Entamoeba invadens
NTLCSSCSIYYYLDNGVCTRCTPSC

SEQ ID NO: 2801089 - protein, 26 aa, Entamoeba invadens
NTLCTWCLDSYVLKDGRCVIYTSIEL

SEQ ID NO: 2801090 - protein, 25 aa, Entamoeba invadens
NTLFYFCVLMIYQVIITQYLFGIVT

SEQ ID NO: 2801091 - protein, 26 aa, Entamoeba invadens
NTLIDWWYLPLCAIMINVINFSCTYA

SEQ ID NO: 2801092 - protein, 21 aa, Entamoeba invadens
NTLILMSAFYVEYFQNKKVLQ

SEQ ID NO: 2801093 - protein, 17 aa, Entamoeba invadens
NTLLDFFEEVARHAKQF

SEQ ID NO: 2801094 - protein, 19 aa, Entamoeba invadens
NTLLHFPKLSLKYENVTEK

SEQ ID NO: 2801095 - protein, 17 aa, Entamoeba invadens
NTLLMAVHVLRCYFFFI

SEQ ID NO: 2801096 - protein, 24 aa, Entamoeba invadens
NTLNVSKLFKLFILPMSQNIIISA

SEQ ID NO: 2801097 - protein, 22 aa, Entamoeba invadens
NTLRAITWSVLLERLPSNAQVY

SEQ ID NO: 2801098 - protein, 19 aa, Entamoeba invadens
NTLSLGFRMNPEFMDKVPG

SEQ ID NO: 2801099 - protein, 17 aa, Entamoeba invadens
NTLVFSLDLNEKVNAKL

SEQ ID NO: 2801100 - protein, 24 aa, Entamoeba invadens
NTMSGCYLCQPGYYVSAGNCKQCS

SEQ ID NO: 2801101 - protein, 19 aa, Entamoeba invadens
NTNCISCLEGISFLENGQC

SEQ ID NO: 2801102 - protein, 23 aa, Entamoeba invadens
NTNEAMSAYFVTRVVICCIYAAS

SEQ ID NO: 2801103 - protein, 27 aa, Entamoeba invadens
NTNKCCAQSLFLNCMVYNSYLFVFNIL

SEQ ID NO: 2801104 - protein, 18 aa, Entamoeba invadens
NTNLCYFGAPGCDQYCHC

SEQ ID NO: 2801105 - protein, 22 aa, Entamoeba invadens
NTNLRCLTCNITNYKTSSGDCK

SEQ ID NO: 2801106 - protein, 20 aa, Entamoeba invadens
NTPTEFAEKVLQKYKWFRPG

SEQ ID NO: 2801107 - protein, 24 aa, Entamoeba invadens
NTQCITCGYNYFRNGSVCSPKSGI

SEQ ID NO: 2801108 - protein, 24 aa, Entamoeba invadens
NTQCSKCAFGYSLINSECHKCVSD

SEQ ID NO: 2801109 - protein, 30 aa, Entamoeba invadens
  misc_feature (27)..(28): Xaa can be any naturally occurring amino acid
NTQKSERGHSFWKRLLTYNNYFNVKEXXFF

SEQ ID NO: 2801110 - protein, 19 aa, Entamoeba invadens
NTQVPLFYSENGFNKENTE

SEQ ID NO: 2801111 - protein, 18 aa, Entamoeba invadens
NTRSCLECQKGWYPTQQN

SEQ ID NO: 2801112 - protein, 24 aa, Entamoeba invadens
NTRTLRTTRNFLFSFSIGNEGLLS

SEQ ID NO: 2801113 - protein, 18 aa, Entamoeba invadens
NTSCKLKSIGGGVIAGIV

SEQ ID NO: 2801114 - protein, 19 aa, Entamoeba invadens
NTSFLGVGIFVVFQDNKEV

SEQ ID NO: 2801115 - protein, 18 aa, Entamoeba invadens
NTSGLYWSVPLFTLPIIM

SEQ ID NO: 2801116 - protein, 20 aa, Entamoeba invadens
NTSICMSCISGYYFEDDTCS

SEQ ID NO: 2801117 - protein, 29 aa, Entamoeba invadens
NTSVCTTCEFPCYQAASGLYVQDTTGEKC

SEQ ID NO: 2801118 - protein, 17 aa, Entamoeba invadens
NTTEGKSGWVITNIACV

SEQ ID NO: 2801119 - protein, 29 aa, Entamoeba invadens
NTTLFKRVFTKFVACLKVGSNKVNTRIEE

SEQ ID NO: 2801120 - protein, 24 aa, Entamoeba invadens
NTTNCLECSDNLFPYENKCIDCKK

SEQ ID NO: 2801121 - protein, 24 aa, Entamoeba invadens
NTTQCGYCGEGLYYNTTLGSCDKC

SEQ ID NO: 2801122 - protein, 23 aa, Entamoeba invadens
NTTSVPLDVVWRNNTIKMVPNIQ

SEQ ID NO: 2801123 - protein, 30 aa, Entamoeba invadens
NTVCFLGEVFMEWVGMFLIRKVITTKMGIV

SEQ ID NO: 2801124 - protein, 25 aa, Entamoeba invadens
NTVECRGYLRLADMRKIDVRNVNCE

SEQ ID NO: 2801125 - protein, 25 aa, Entamoeba invadens
NTVFFKVVIWYEVDFITFANNKNSN

SEQ ID NO: 2801126 - protein, 17 aa, Entamoeba invadens
NTVNGLGRKQFRALQEL

SEQ ID NO: 2801127 - protein, 19 aa, Entamoeba invadens
NTVYYKEFIEYCIDYIKQL

SEQ ID NO: 2801128 - protein, 25 aa, Entamoeba invadens
NTWGHLVSFVLNCWDVLVKRLSRRK

SEQ ID NO: 2801129 - protein, 23 aa, Entamoeba invadens
NTYKVDFMFVDLILQQTQIFIDT

SEQ ID NO: 2801130 - protein, 40 aa, Entamoeba invadens
NTYLKKMWMRVLSNKLIICLVGMTLLLAMATLLYYYIFSS

SEQ ID NO: 2801131 - protein, 17 aa, Entamoeba invadens
NVACVNVLCELASRNQL

SEQ ID NO: 2801132 - protein, 24 aa, Entamoeba invadens
NVAKRLQREYNHFFKNAPNDISIH

SEQ ID NO: 2801133 - protein, 20 aa, Entamoeba invadens
NVAQICILTCKIYVKLFECI

SEQ ID NO: 2801134 - protein, 18 aa, Entamoeba invadens
NVCFYNFHNKTIVYNIEQ

SEQ ID NO: 2801135 - protein, 24 aa, Entamoeba invadens
NVCSLCGKTLKTDKLLDIHISEKH

SEQ ID NO: 2801136 - protein, 18 aa, Entamoeba invadens
NVCTKCIAGFELTATTNQ

SEQ ID NO: 2801137 - protein, 22 aa, Entamoeba invadens
NVDCIGCGSIVLSENANLHLTQ

SEQ ID NO: 2801138 - protein, 25 aa, Entamoeba invadens
NVDIKRSMGRYGVILKDNTMEITLT

SEQ ID NO: 2801139 - protein, 21 aa, Entamoeba invadens
NVDIREIYKAIFLGYEKVNTY

SEQ ID NO: 2801140 - protein, 23 aa, Entamoeba invadens
NVDKCIYCENGIVFNNECVPKDK

SEQ ID NO: 2801141 - protein, 23 aa, Entamoeba invadens
NVDKECRSLFCVGNTSKNTIKVQ

SEQ ID NO: 2801142 - protein, 26 aa, Entamoeba invadens
NVDLHYSVECPKGLTLTSGEFNAVVQ

SEQ ID NO: 2801143 - protein, 17 aa, Entamoeba invadens
NVDLIKILHDFRITISP

SEQ ID NO: 2801144 - protein, 17 aa, Entamoeba invadens
NVDMGANPLIISTGIIT

SEQ ID NO: 2801145 - protein, 24 aa, Entamoeba invadens
NVECVECSPPYSWDSISKTCKLCI

SEQ ID NO: 2801146 - protein, 25 aa, Entamoeba invadens
NVEDVEFFKMFSLLNKLEGVNSNEQ

SEQ ID NO: 2801147 - protein, 27 aa, Entamoeba invadens
NVEGKFDFCLPIPPSLYPNCKRLAFST

SEQ ID NO: 2801148 - protein, 27 aa, Entamoeba invadens
NVENSWRMVVKISHCLVDGLTAVRLMQ

SEQ ID NO: 2801149 - protein, 24 aa, Entamoeba invadens
NVESKFDFCLPIPSTVYPNCKRLA

SEQ ID NO: 2801150 - protein, 21 aa, Entamoeba invadens
NVESMAKPFLMCSIEKDGLVL

SEQ ID NO: 2801151 - protein, 22 aa, Entamoeba invadens
NVETDLRLSAKSVAITRTTGTV

SEQ ID NO: 2801152 - protein, 19 aa, Entamoeba invadens
NVEVLRGFLEIVMILGKVK

SEQ ID NO: 2801153 - protein, 25 aa, Entamoeba invadens
NVFIDYDLDICKRMFNTGFTQEYTE

SEQ ID NO: 2801154 - protein, 32 aa, Entamoeba invadens
NVFIYKTLGSFTFYVGFKFVRKSFVYDTNVSV

SEQ ID NO: 2801155 - protein, 18 aa, Entamoeba invadens
NVFLEMFQNFGVVTEANK

SEQ ID NO: 2801156 - protein, 19 aa, Entamoeba invadens
NVFNGCFYAIVPFSNNNYD

SEQ ID NO: 2801157 - protein, 19 aa, Entamoeba invadens
NVFNYPWQIAEFVCSGKRV

SEQ ID NO: 2801158 - protein, 17 aa, Entamoeba invadens
NVFVDFKVKQCASFFQK

SEQ ID NO: 2801159 - protein, 26 aa, Entamoeba invadens
NVFVSRCGWGNMYLYETVLDLLIVLT

SEQ ID NO: 2801160 - protein, 34 aa, Entamoeba invadens
NVFWEHKKGWALGMARGKYGIFPITRSIVVSLEK

SEQ ID NO: 2801161 - protein, 19 aa, Entamoeba invadens
NVGCAICHDGYYYQDKDCI

SEQ ID NO: 2801162 - protein, 17 aa, Entamoeba invadens
NVGCGDAAVTRATWFSV

SEQ ID NO: 2801163 - protein, 18 aa, Entamoeba invadens
NVGDFCFSQCHSLEKISF

SEQ ID NO: 2801164 - protein, 26 aa, Entamoeba invadens
NVGEYTKAMLLYGCQVQNTKKLSYLS

SEQ ID NO: 2801165 - protein, 23 aa, Entamoeba invadens
NVGTELALIFGISDKAALKSVQS

SEQ ID NO: 2801166 - protein, 26 aa, Entamoeba invadens
NVHLYLRNRCAPLAFQLIDAQIEKTV

SEQ ID NO: 2801167 - protein, 21 aa, Entamoeba invadens
NVICKPCISNCEFCNTHSTCL

SEQ ID NO: 2801168 - protein, 23 aa, Entamoeba invadens
NVICKPCISNCQFCNTNSTCLGC

SEQ ID NO: 2801169 - protein, 31 aa, Entamoeba invadens
NVIDFSRRKWFCFVFLIGFVIFSFAIYYGDW

SEQ ID NO: 2801170 - protein, 18 aa, Entamoeba invadens
NVIEKCWKQNTQERCTII

SEQ ID NO: 2801171 - protein, 19 aa, Entamoeba invadens
NVIFFKSDIIRYLKIKVVN

SEQ ID NO: 2801172 - protein, 17 aa, Entamoeba invadens
NVIKIQFTISVNSDKFT

SEQ ID NO: 2801173 - protein, 24 aa, Entamoeba invadens
NVIPRLNYDKLIVGDVYYLYIYDY

SEQ ID NO: 2801174 - protein, 18 aa, Entamoeba invadens
NVISCEYGFYVVNSTSND

SEQ ID NO: 2801175 - protein, 24 aa, Entamoeba invadens
NVISPKCLKCFAPYVISNQMCVLG

SEQ ID NO: 2801176 - protein, 25 aa, Entamoeba invadens
NVITAVCIGLLFALVLLMTICNSIW

SEQ ID NO: 2801177 - protein, 19 aa, Entamoeba invadens
NVIVAFCLRGKDHKSDGQI

SEQ ID NO: 2801178 - protein, 19 aa, Entamoeba invadens
NVKCEKWVFVLPAVTTSIA

SEQ ID NO: 2801179 - protein, 19 aa, Entamoeba invadens
NVKKFDWNVVIISVITVVL

SEQ ID NO: 2801180 - protein, 22 aa, Entamoeba invadens
NVKSVCWKCGKERIGTKPCGCG

SEQ ID NO: 2801181 - protein, 20 aa, Entamoeba invadens
NVKWGCHRCAVGKTLSESRC

SEQ ID NO: 2801182 - protein, 25 aa, Entamoeba invadens
NVLISTGRLKSVIVVGWDDDYPIPR

SEQ ID NO: 2801183 - protein, 17 aa, Entamoeba invadens
NVLKGLYIAIPKGKTMG

SEQ ID NO: 2801184 - protein, 25 aa, Entamoeba invadens
NVLKHSWVLLNILLKAMIVMIHNKK

SEQ ID NO: 2801185 - protein, 24 aa, Entamoeba invadens
NVLKIFTMFIENVFLNLKEANLTQ

SEQ ID NO: 2801186 - protein, 24 aa, Entamoeba invadens
NVLKPECIECNSLEDYYTSSVTSA

SEQ ID NO: 2801187 - protein, 25 aa, Entamoeba invadens
NVLKTDYTFSYPLVIAQLTNTSLFK

SEQ ID NO: 2801188 - protein, 26 aa, Entamoeba invadens
NVLPFTFPVKYFYVFYQQRRLFVPTI

SEQ ID NO: 2801189 - protein, 23 aa, Entamoeba invadens
NVLRRFILCKNIEIDIQNDCSCY

SEQ ID NO: 2801190 - protein, 24 aa, Entamoeba invadens
NVLSSCGFRAFYTINDGYMCYCNN

SEQ ID NO: 2801191 - protein, 19 aa, Entamoeba invadens
NVLSSCGFRAFYTNNDGYM

SEQ ID NO: 2801192 - protein, 27 aa, Entamoeba invadens
NVNNIIPMDVIIRGDMYIGYGTSLNVQ

SEQ ID NO: 2801193 - protein, 23 aa, Entamoeba invadens
NVNWRIRARLMFSSKYKSLLEYL

SEQ ID NO: 2801194 - protein, 19 aa, Entamoeba invadens
NVPLSSFVMRQEIINKSVA

SEQ ID NO: 2801195 - protein, 35 aa, Entamoeba invadens
NVPSKRTSWEFSTWYMKCLEWIGGNLPIVAILGIM

SEQ ID NO: 2801196 - protein, 19 aa, Entamoeba invadens
NVPVGWIVFGVLFYIMCAV

SEQ ID NO: 2801197 - protein, 23 aa, Entamoeba invadens
NVQRLDSTLPFTSQTIPSAWPKT

SEQ ID NO: 2801198 - protein, 24 aa, Entamoeba invadens
NVRCSKFGISKYCYLVGETVADSV

SEQ ID NO: 2801199 - protein, 19 aa, Entamoeba invadens
NVRGKFGYLELYLRGDYTI

SEQ ID NO: 2801200 - protein, 18 aa, Entamoeba invadens
NVSESLKTWFGRNNAYFG

SEQ ID NO: 2801201 - protein, 21 aa, Entamoeba invadens
NVSGVLVLVAFCYQVLKDGKM

SEQ ID NO: 2801202 - protein, 28 aa, Entamoeba invadens
NVSRYHKSVVCLTQIGVFVFVLFSGNFV

SEQ ID NO: 2801203 - protein, 24 aa, Entamoeba invadens
NVTAESFPLLAFLVYGVYSLYSHD

SEQ ID NO: 2801204 - protein, 23 aa, Entamoeba invadens
NVTCFKCDSFSYLFEGRCIKNDV

SEQ ID NO: 2801205 - protein, 24 aa, Entamoeba invadens
NVTEIPKQLGFKFRGTPSKRGYHN

SEQ ID NO: 2801206 - protein, 19 aa, Entamoeba invadens
NVTFHMSVIVKKFVVYKIT

SEQ ID NO: 2801207 - protein, 22 aa, Entamoeba invadens
NVTLMKYSTLFVEYFFITLNGI

SEQ ID NO: 2801208 - protein, 17 aa, Entamoeba invadens
NVTNAWRSGLVGNINIK

SEQ ID NO: 2801209 - protein, 24 aa, Entamoeba invadens
NVTNCKLCSFGNSSSCIECNDRYY

SEQ ID NO: 2801210 - protein, 22 aa, Entamoeba invadens
NVVECKDGFFVQNNICNDCTTN

SEQ ID NO: 2801211 - protein, 21 aa, Entamoeba invadens
NVVECKDGFYVQNNKCNDCTI

SEQ ID NO: 2801212 - protein, 26 aa, Entamoeba invadens
NVVFESCNFVNCIIHLDDLDMIKNIY

SEQ ID NO: 2801213 - protein, 17 aa, Entamoeba invadens
NVVGGLLGRGSAYAMLA

SEQ ID NO: 2801214 - protein, 33 aa, Entamoeba invadens
NVVYSRSNFTFGFFPFSCCVSGADEEYGCDKMV

SEQ ID NO: 2801215 - protein, 23 aa, Entamoeba invadens
NVWSRSYITFCTTYKGQIKVFGI

SEQ ID NO: 2801216 - protein, 27 aa, Entamoeba invadens
NVYDFAKEFLKYFRGFVKIESYITPLV

SEQ ID NO: 2801217 - protein, 20 aa, Entamoeba invadens
NWCSKCPLGTYSNEGSSTCI

SEQ ID NO: 2801218 - protein, 24 aa, Entamoeba invadens
NWDVPRVTIKYEVFPKVSGQRLVA

SEQ ID NO: 2801219 - protein, 25 aa, Entamoeba invadens
NWEADRVSIKYGIMGKLTGMRLVGW

SEQ ID NO: 2801220 - protein, 17 aa, Entamoeba invadens
NWIVIVGCLIFVLMTII

SEQ ID NO: 2801221 - protein, 24 aa, Entamoeba invadens
NWKEVMGSTVFEWFCPLFPSRFNP

SEQ ID NO: 2801222 - protein, 28 aa, Entamoeba invadens
NWKKPMTLKRFVFLIFFAFMLYVTFVFN

SEQ ID NO: 2801223 - protein, 26 aa, Entamoeba invadens
NWLEVYTRIDALLGITSEGYTTHEAV

SEQ ID NO: 2801224 - protein, 22 aa, Entamoeba invadens
NWNYFICFFIITFLLIYVTYFQ

SEQ ID NO: 2801225 - protein, 20 aa, Entamoeba invadens
NWSGMAFADVFSSLLSKGLK

SEQ ID NO: 2801226 - protein, 24 aa, Entamoeba invadens
NWVCVYPGCNVCPKSRYNLTAHVW

SEQ ID NO: 2801227 - protein, 18 aa, Entamoeba invadens
NWVSNYIFLFLGILALGM

SEQ ID NO: 2801228 - protein, 17 aa, Entamoeba invadens
NWWPIKYEIEVTRYEDA

SEQ ID NO: 2801229 - protein, 23 aa, Entamoeba invadens
NWYYLFGTAGCWFFVDIAFYGNS

SEQ ID NO: 2801230 - protein, 20 aa, Entamoeba invadens
NYCKQCPLNSISCANTTHVF

SEQ ID NO: 2801231 - protein, 26 aa, Entamoeba invadens
NYCRSCPLDRCFNCKETGEMNGTVPS

SEQ ID NO: 2801232 - protein, 32 aa, Entamoeba invadens
NYDECARCTAGLCDRCKEGSHKDRAYLYCYKC

SEQ ID NO: 2801233 - protein, 24 aa, Entamoeba invadens
NYEYVEMGFQWGFSPTLFLHGYLD

SEQ ID NO: 2801234 - protein, 23 aa, Entamoeba invadens
NYFNKFLLIISIPFQVVMEYTTP

SEQ ID NO: 2801235 - protein, 28 aa, Entamoeba invadens
NYFRYLEFENVLLFKFFERYLYCESLVI

SEQ ID NO: 2801236 - protein, 24 aa, Entamoeba invadens
NYIKEVFEKYNFDCESKMISSGAI

SEQ ID NO: 2801237 - protein, 17 aa, Entamoeba invadens
NYILIAMALMERGSVHQ

SEQ ID NO: 2801238 - protein, 17 aa, Entamoeba invadens
NYIQIYISIIFVLFCCI

SEQ ID NO: 2801239 - protein, 21 aa, Entamoeba invadens
NYKEGRCVCDERLVDDIQSHI

SEQ ID NO: 2801240 - protein, 29 aa, Entamoeba invadens
NYKLPVNYSLKFFRYFPSSVEFVVQAMSA

SEQ ID NO: 2801241 - protein, 17 aa, Entamoeba invadens
NYKMPADIYSFGMTMYE

SEQ ID NO: 2801242 - protein, 21 aa, Entamoeba invadens
NYKNRFGKWLKLDNSKLTQPY

SEQ ID NO: 2801243 - protein, 20 aa, Entamoeba invadens
NYLIFGCVDSLLGVVELGFE

SEQ ID NO: 2801244 - protein, 17 aa, Entamoeba invadens
NYLIFSLDINDCVNAKL

SEQ ID NO: 2801245 - protein, 18 aa, Entamoeba invadens
NYLSRVGPALALNFIHMV

SEQ ID NO: 2801246 - protein, 23 aa, Entamoeba invadens
NYLVQRFGKGASYIVLGEQIDNL

SEQ ID NO: 2801247 - protein, 19 aa, Entamoeba invadens
NYMCFPGYYRTESGCSECR

SEQ ID NO: 2801248 - protein, 18 aa, Entamoeba invadens
NYNGSVCIECNLNYHIVN

SEQ ID NO: 2801249 - protein, 25 aa, Entamoeba invadens
NYNILCITFQIYFFINGENSNNQNK

SEQ ID NO: 2801250 - protein, 27 aa, Entamoeba invadens
NYNINKMLFVWDRYIGITVNTKLHDLE

SEQ ID NO: 2801251 - protein, 24 aa, Entamoeba invadens
NYPDCLRNGTFFNLTILKNQSEVH

SEQ ID NO: 2801252 - protein, 21 aa, Entamoeba invadens
NYRLCQWATVNLSTFTNTVFV

SEQ ID NO: 2801253 - protein, 17 aa, Entamoeba invadens
NYSNVFGRFEYLVTAFL

SEQ ID NO: 2801254 - protein, 24 aa, Entamoeba invadens
NYSRKCIQCNIGFYPNASGICVHC

SEQ ID NO: 2801255 - protein, 19 aa, Entamoeba invadens
NYTAKYCVGMNCECESGYF

SEQ ID NO: 2801256 - protein, 18 aa, Entamoeba invadens
NYTFKIDSNWVIQYSSFK

SEQ ID NO: 2801257 - protein, 25 aa, Entamoeba invadens
NYTTSKCLTCFNSTFCITCDTSVYF

SEQ ID NO: 2801258 - protein, 32 aa, Entamoeba invadens
NYVVKSPLFLGIWKFVVWDSMDCKIAALNAAS

SEQ ID NO: 2801259 - protein, 20 aa, Entamoeba invadens
NYYLLCVLFCIARTAYEIVR

SEQ ID NO: 2801260 - protein, 22 aa, Entamoeba invadens
NYYSPSCSISCRRCDTTCVTCN

SEQ ID NO: 2801261 - protein, 23 aa, Entamoeba invadens
NYYYAICVRLMCGFLNGNVGVIK

SEQ ID NO: 2801262 - protein, 17 aa, Entamoeba invadens
PAAPTLRGNGMKTNYYL

SEQ ID NO: 2801263 - protein, 20 aa, Entamoeba invadens
PADGLSCFCEQIWETIKDNK

SEQ ID NO: 2801264 - protein, 19 aa, Entamoeba invadens
PADVFSFAITMYECFGWTD

SEQ ID NO: 2801265 - protein, 19 aa, Entamoeba invadens
PADVFSFAITMYEVFGWNY

SEQ ID NO: 2801266 - protein, 23 aa, Entamoeba invadens
PAECSRTEMGYCVECIDTYFLSG

SEQ ID NO: 2801267 - protein, 17 aa, Entamoeba invadens
PAFLAFLGFFFYLLTGA

SEQ ID NO: 2801268 - protein, 21 aa, Entamoeba invadens
PAFSKCRMSSFLNLIFAVIPL

SEQ ID NO: 2801269 - protein, 19 aa, Entamoeba invadens
PAGASKCTYCGGGQYQPSS

SEQ ID NO: 2801270 - protein, 25 aa, Entamoeba invadens
PAGGGCAICKVGYFKAEKDCDVCDE

SEQ ID NO: 2801271 - protein, 25 aa, Entamoeba invadens
PAGGGCAICKVGYYKVEKDCDACDE

SEQ ID NO: 2801272 - protein, 25 aa, Entamoeba invadens
PAGGRCAICKVGYFKAEKDCDVCDE

SEQ ID NO: 2801273 - protein, 18 aa, Entamoeba invadens
PAGKQCVEGSCVIPKTNT

SEQ ID NO: 2801274 - protein, 17 aa, Entamoeba invadens
PAGRKAFIYKRCYENVP

SEQ ID NO: 2801275 - protein, 18 aa, Entamoeba invadens
PAIIKRILQYTMYDYPKD

SEQ ID NO: 2801276 - protein, 24 aa, Entamoeba invadens
PAIKQDCSLACPITENTDCVFEPL

SEQ ID NO: 2801277 - protein, 22 aa, Entamoeba invadens
PAIPLIFGGVFVKTKYGLISKN

SEQ ID NO: 2801278 - protein, 25 aa, Entamoeba invadens
PALKNAHIGLAMGIRGTDVAKQASD

SEQ ID NO: 2801279 - protein, 26 aa, Entamoeba invadens
PALLNKWKLPIFNALTSNAMKGLQDI

SEQ ID NO: 2801280 - protein, 21 aa, Entamoeba invadens
PANRFKHPWDVADFVTSGKRL

SEQ ID NO: 2801281 - protein, 23 aa, Entamoeba invadens
PAQCLTCKTGYYPSTTYPYNCQA

SEQ ID NO: 2801282 - protein, 18 aa, Entamoeba invadens
PAQTILRYLFGKGGEQYF

SEQ ID NO: 2801283 - protein, 23 aa, Entamoeba invadens
PASGDAYPICSIKERTTLSKTNL

SEQ ID NO: 2801284 - protein, 21 aa, Entamoeba invadens
PAVTDLICCRIPFPCSCAEKT

SEQ ID NO: 2801285 - protein, 24 aa, Entamoeba invadens
PAYYWHFKIGIKGTYGTERNQGYE

SEQ ID NO: 2801286 - protein, 20 aa, Entamoeba invadens
PCEKYPSLVSISLFKTYPGL

SEQ ID NO: 2801287 - protein, 20 aa, Entamoeba invadens
PCEYPCTFCSNLTYCTKCDD

SEQ ID NO: 2801288 - protein, 24 aa, Entamoeba invadens
PCFRTCLTCSNNLYNGCLTCGKGR

SEQ ID NO: 2801289 - protein, 18 aa, Entamoeba invadens
PCGANCLYCTTPDVCSLC

SEQ ID NO: 2801290 - protein, 19 aa, Entamoeba invadens
PCGHLSLSLSRGVYIAFSG

SEQ ID NO: 2801291 - protein, 23 aa, Entamoeba invadens
PCKDAECEKCTGGVIGTMIVGLV

SEQ ID NO: 2801292 - protein, 23 aa, Entamoeba invadens
PCKDAECEKCTGGVIGVLVACLA

SEQ ID NO: 2801293 - protein, 22 aa, Entamoeba invadens
PCKKCTLTECLTCEIDNVLEDG

SEQ ID NO: 2801294 - protein, 23 aa, Entamoeba invadens
PCKSHSKTIEWNDLIKSGGINYT

SEQ ID NO: 2801295 - protein, 26 aa, Entamoeba invadens
PCLGGVRGTRGCLCPKAFVKAKGEGY

SEQ ID NO: 2801296 - protein, 19 aa, Entamoeba invadens
PCLNCPIECTYCLYTSGEC

SEQ ID NO: 2801297 - protein, 20 aa, Entamoeba invadens
PCLVINYVILFAISLGLSYL

SEQ ID NO: 2801298 - protein, 17 aa, Entamoeba invadens
PCMAVKVKFMLDMARGI

SEQ ID NO: 2801299 - protein, 21 aa, Entamoeba invadens
PCNDQECIKCTTPQQKNGATK

SEQ ID NO: 2801300 - protein, 18 aa, Entamoeba invadens
PCNGDGSVNCKLKFQSGY

SEQ ID NO: 2801301 - protein, 34 aa, Entamoeba invadens
PCNNRSRLSIGLMWWMLTREILRFRGELARDKTW

SEQ ID NO: 2801302 - protein, 22 aa, Entamoeba invadens
PCNSDLSVICELKLSEQYNSYD

SEQ ID NO: 2801303 - protein, 20 aa, Entamoeba invadens
PCNYPCTFCSNSTYCTKCDQ

SEQ ID NO: 2801304 - protein, 22 aa, Entamoeba invadens
PCQFLIFCMPILFDKTETEAKE

SEQ ID NO: 2801305 - protein, 26 aa, Entamoeba invadens
PCQSNCSLCVTGMVCNLCDSDYILID

SEQ ID NO: 2801306 - protein, 26 aa, Entamoeba invadens
PCQVFCSHCNRLVISHVDYGNGTLVW

SEQ ID NO: 2801307 - protein, 20 aa, Entamoeba invadens
PCSNKYCYMTPLTNISEMLF

SEQ ID NO: 2801308 - protein, 17 aa, Entamoeba invadens
PCTLKRWKLYDKELEAC

SEQ ID NO: 2801309 - protein, 24 aa, Entamoeba invadens
PCVNSYECLARKDGYFNIPGECKL

SEQ ID NO: 2801310 - protein, 20 aa, Entamoeba invadens
PDASPLFSQMYFRGTGVKWY

SEQ ID NO: 2801311 - protein, 22 aa, Entamoeba invadens
PDCGTCTGCADGYYLESNKCVR

SEQ ID NO: 2801312 - protein, 19 aa, Entamoeba invadens
PDCKNCVKITCEKAMHETK

SEQ ID NO: 2801313 - protein, 21 aa, Entamoeba invadens
PDDFAFWAGVRFVIIFDPTYS

SEQ ID NO: 2801314 - protein, 24 aa, Entamoeba invadens
PDECGGHLDALWLWVNGSEEKWVE

SEQ ID NO: 2801315 - protein, 20 aa, Entamoeba invadens
PDEMILFVQLIRYISNDPKQ

SEQ ID NO: 2801316 - protein, 19 aa, Entamoeba invadens
PDFSCPVEHCVVKKMNEDN

SEQ ID NO: 2801317 - protein, 25 aa, Entamoeba invadens
PDFSRKCIQCNIGFYPNASGICVNC

SEQ ID NO: 2801318 - protein, 25 aa, Entamoeba invadens
PDFSRKCKVCAIGFYPDETSGKCVA

SEQ ID NO: 2801319 - protein, 24 aa, Entamoeba invadens
PDFSRKCKVCTIGYYPDEASGKCV

SEQ ID NO: 2801320 - protein, 25 aa, Entamoeba invadens
PDFSRKCKVCVIGFYPDDASGKCVA

SEQ ID NO: 2801321 - protein, 25 aa, Entamoeba invadens
PDFSRNCYICNSGFYPLISGKCTSC

SEQ ID NO: 2801322 - protein, 22 aa, Entamoeba invadens
PDFTFKGCTILATVTGINAVTS

SEQ ID NO: 2801323 - protein, 21 aa, Entamoeba invadens
PDGGRCVYCWDKHPHCAECDS

SEQ ID NO: 2801324 - protein, 18 aa, Entamoeba invadens
PDHCKLKIYFLIYYNNFV

SEQ ID NO: 2801325 - protein, 19 aa, Entamoeba invadens
PDHFSFFLKALERLLIVMQ

SEQ ID NO: 2801326 - protein, 19 aa, Entamoeba invadens
PDHLCLVTELAKYGSIQDL

SEQ ID NO: 2801327 - protein, 27 aa, Entamoeba invadens
PDIEIFVLQVLKWLNRVVEINPVRSAI

SEQ ID NO: 2801328 - protein, 18 aa, Entamoeba invadens
PDKIRSWDIADNVCKGLR

SEQ ID NO: 2801329 - protein, 24 aa, Entamoeba invadens
PDLYLRGALCFFTHFFNTENVAQM

SEQ ID NO: 2801330 - protein, 20 aa, Entamoeba invadens
PDNAFGYTILALIAFFLALF

SEQ ID NO: 2801331 - protein, 20 aa, Entamoeba invadens
PDNFLVFSLDLNDKVNAKLT

SEQ ID NO: 2801332 - protein, 20 aa, Entamoeba invadens
PDNFLVFSLDLNDTINAKLT

SEQ ID NO: 2801333 - protein, 19 aa, Entamoeba invadens
PDNFLVFSLDYGDEITAKL

SEQ ID NO: 2801334 - protein, 19 aa, Entamoeba invadens
PDNFLVFSLEKEIDVNAKL

SEQ ID NO: 2801335 - protein, 17 aa, Entamoeba invadens
PDNFLVFSLESGIDVNA

SEQ ID NO: 2801336 - protein, 19 aa, Entamoeba invadens
PDNIARVLGRLSMLCGLYN

SEQ ID NO: 2801337 - protein, 19 aa, Entamoeba invadens
PDNILAFSLDVNEKVNAKL

SEQ ID NO: 2801338 - protein, 21 aa, Entamoeba invadens
PDNILIFSMDFCEKVNAKLTD

SEQ ID NO: 2801339 - protein, 21 aa, Entamoeba invadens
PDNILIFSMDFCESVNAKLTD

SEQ ID NO: 2801340 - protein, 17 aa, Entamoeba invadens
PDNILVFLLDMNDKINA

SEQ ID NO: 2801341 - protein, 19 aa, Entamoeba invadens
PDNILVFLLNINDKVNAKL

SEQ ID NO: 2801342 - protein, 17 aa, Entamoeba invadens
PDNILVFSLNFNANFPS

SEQ ID NO: 2801343 - protein, 20 aa, Entamoeba invadens
PDNILVFSMDVNERVNAKLT

SEQ ID NO: 2801344 - protein, 17 aa, Entamoeba invadens
PDNILVISIDFDNNVNA

SEQ ID NO: 2801345 - protein, 17 aa, Entamoeba invadens
PDNILVVSMDWNDSVFG

SEQ ID NO: 2801346 - protein, 40 aa, Entamoeba invadens
PDNISRFGIEFRWSWLTIIICIFSNLKFFFVILTHKLKTV

SEQ ID NO: 2801347 - protein, 23 aa, Entamoeba invadens
PDPLHRYAFWYLYDTLSYPLLSI

SEQ ID NO: 2801348 - protein, 23 aa, Entamoeba invadens
PDQIESFGIGVFETCISLKEVTI

SEQ ID NO: 2801349 - protein, 23 aa, Entamoeba invadens
PDTIEAIVILIIWSLDSISEAVS

SEQ ID NO: 2801350 - protein, 17 aa, Entamoeba invadens
PDTYLWSDQICNISTNT

SEQ ID NO: 2801351 - protein, 21 aa, Entamoeba invadens
PDVCSLCKEGLVVESGVCVSY

SEQ ID NO: 2801352 - protein, 20 aa, Entamoeba invadens
PDVRCVIAAFLDSCVITQRY

SEQ ID NO: 2801353 - protein, 17 aa, Entamoeba invadens
PDWCGVFKTIFCLQCER

SEQ ID NO: 2801354 - protein, 18 aa, Entamoeba invadens
PDWFGHGSADCSSLSPAL

SEQ ID NO: 2801355 - protein, 17 aa, Entamoeba invadens
PDWLYQVISLGWDQLPL

SEQ ID NO: 2801356 - protein, 25 aa, Entamoeba invadens
PDYAPTVSAYKCFKTFAKYTNDNGA

SEQ ID NO: 2801357 - protein, 22 aa, Entamoeba invadens
PDYFHFLGDVFVERGLDTTMHI

SEQ ID NO: 2801358 - protein, 22 aa, Entamoeba invadens
PECLECSGNTGLSCYKCAEKYY

SEQ ID NO: 2801359 - protein, 25 aa, Entamoeba invadens
PECLQRLSYGLPMDVFAFGVVMYET

SEQ ID NO: 2801360 - protein, 21 aa, Entamoeba invadens
PECNKCLTGCKDCSDGATCKC

SEQ ID NO: 2801361 - protein, 34 aa, Entamoeba invadens
PEDIYSFGMTMFECFKWGEAYPVEQFEYPWIVAD

SEQ ID NO: 2801362 - protein, 25 aa, Entamoeba invadens
PEDKFKFPWKIAEFVISGQRLEKPK

SEQ ID NO: 2801363 - protein, 18 aa, Entamoeba invadens
PEDLSILIQQSWEHNPKK

SEQ ID NO: 2801364 - protein, 17 aa, Entamoeba invadens
PEDQRPVLYTSVGTLAF

SEQ ID NO: 2801365 - protein, 20 aa, Entamoeba invadens
PEDRMARVVEKSEFPMYMIA

SEQ ID NO: 2801366 - protein, 20 aa, Entamoeba invadens
PEDYWKLVTDCWKDNQDERP

SEQ ID NO: 2801367 - protein, 18 aa, Entamoeba invadens
PEECLKELYTIWKCGGYT

SEQ ID NO: 2801368 - protein, 19 aa, Entamoeba invadens
PEELKRLALGQASISETLK

SEQ ID NO: 2801369 - protein, 18 aa, Entamoeba invadens
PEELSILIQQSWEHNPKK

SEQ ID NO: 2801370 - protein, 20 aa, Entamoeba invadens
PEELSKLIITTSCSEKSEKS

SEQ ID NO: 2801371 - protein, 17 aa, Entamoeba invadens
PEFYSCSPLFTNEKNDT

SEQ ID NO: 2801372 - protein, 19 aa, Entamoeba invadens
PEGLVITFGCFDGSTGCRQ

SEQ ID NO: 2801373 - protein, 20 aa, Entamoeba invadens
PEGRRSRIVAELKYVGIADL

SEQ ID NO: 2801374 - protein, 19 aa, Entamoeba invadens
PEGSTPLAIIPCYGSIWYP

SEQ ID NO: 2801375 - protein, 36 aa, Entamoeba invadens
PEGTIKIVVDPSLPKDVPIFIMRVGLGKNFTAENGV

SEQ ID NO: 2801376 - protein, 22 aa, Entamoeba invadens
PEHCFLCKRGICDICESGKILV

SEQ ID NO: 2801377 - protein, 19 aa, Entamoeba invadens
PEHCLTRNGIWECQLSYYM

SEQ ID NO: 2801378 - protein, 25 aa, Entamoeba invadens
PEHFEVFRMLCRLFAEIVNRSPTNK

SEQ ID NO: 2801379 - protein, 19 aa, Entamoeba invadens
PEHLFNIVEDCWKEKIRER

SEQ ID NO: 2801380 - protein, 29 aa, Entamoeba invadens
PEHTCTVFLEMKSNPILYFSGELISPEND

SEQ ID NO: 2801381 - protein, 34 aa, Entamoeba invadens
PEIGFKPGCEPNCGRCLFGYECSNKGICEKVVSS

SEQ ID NO: 2801382 - protein, 21 aa, Entamoeba invadens
PEIKNKCSQRALVYNSDAPTF

SEQ ID NO: 2801383 - protein, 20 aa, Entamoeba invadens
PEIVSLKRGIACEFSIYIKP

SEQ ID NO: 2801384 - protein, 17 aa, Entamoeba invadens
PEKCATCVLETGKTEVT

SEQ ID NO: 2801385 - protein, 18 aa, Entamoeba invadens
PEKCWTTPLFDKTMVYLV

SEQ ID NO: 2801386 - protein, 20 aa, Entamoeba invadens
PEKFSYLFVMTCVQVGMYFM

SEQ ID NO: 2801387 - protein, 24 aa, Entamoeba invadens
PEKIRCHRVFCVIFELIYQCTTEK

SEQ ID NO: 2801388 - protein, 18 aa, Entamoeba invadens
PEKMRLWGYDQSVHNYLL

SEQ ID NO: 2801389 - protein, 19 aa, Entamoeba invadens
PELIKRAYRKHALKFHPDK

SEQ ID NO: 2801390 - protein, 22 aa, Entamoeba invadens
PELKEHMNYYAFHVKDGQVIWQ

SEQ ID NO: 2801391 - protein, 24 aa, Entamoeba invadens
PELLKFMITECWKPEPSERPNFDN

SEQ ID NO: 2801392 - protein, 24 aa, Entamoeba invadens
PEMLTYIIYEWTHPVSVDDTSIRG

SEQ ID NO: 2801393 - protein, 20 aa, Entamoeba invadens
PEMRNKIVQYVEAINKENEN

SEQ ID NO: 2801394 - protein, 19 aa, Entamoeba invadens
PEMSLLFLNEVLGLLKTVS

SEQ ID NO: 2801395 - protein, 19 aa, Entamoeba invadens
PENLKLLIQNSWEQDPISR

SEQ ID NO: 2801396 - protein, 25 aa, Entamoeba invadens
PEPFRPEEVTAFLVQRLLAKLEEIL

SEQ ID NO: 2801397 - protein, 24 aa, Entamoeba invadens
PEPFRPEEVTAFLVQTLFAKLEEI

SEQ ID NO: 2801398 - protein, 24 aa, Entamoeba invadens
PEPFRPEEVTAFLVQTLLAKLEEI

SEQ ID NO: 2801399 - protein, 20 aa, Entamoeba invadens
PEQILLKIFANVGVDEIKNV

SEQ ID NO: 2801400 - protein, 23 aa, Entamoeba invadens
PEQISEMWELIATLLDNIKNALP

SEQ ID NO: 2801401 - protein, 19 aa, Entamoeba invadens
PEQIVACSCFKAFQDIYVL

SEQ ID NO: 2801402 - protein, 19 aa, Entamoeba invadens
PEQKVVIGARAFKNATKLA

SEQ ID NO: 2801403 - protein, 18 aa, Entamoeba invadens
PERAMIFPLISFAIILFV

SEQ ID NO: 2801404 - protein, 20 aa, Entamoeba invadens
PERRRMSVIIYDGNEITMYS

SEQ ID NO: 2801405 - protein, 26 aa, Entamoeba invadens
PERTNCSWCGEGFYLDTYHGKYNYTC

SEQ ID NO: 2801406 - protein, 19 aa, Entamoeba invadens
PESFKDVYTSAGDVYSFAI

SEQ ID NO: 2801407 - protein, 29 aa, Entamoeba invadens
PETMARFGACLHCLTSLIIAMVYITETKT

SEQ ID NO: 2801408 - protein, 17 aa, Entamoeba invadens
PETQYAIALKSEVRSSA

SEQ ID NO: 2801409 - protein, 25 aa, Entamoeba invadens
PETVIRFGKLYGEIIRKKVLRNCAL

SEQ ID NO: 2801410 - protein, 30 aa, Entamoeba invadens
PEVATLVKGYACEFEIFLTPLCSCYIEDDV

SEQ ID NO: 2801411 - protein, 22 aa, Entamoeba invadens
PEVCLKCIKGYVLSNVTCVKLL

SEQ ID NO: 2801412 - protein, 18 aa, Entamoeba invadens
PEVFHLKLDTSITPYKFT

SEQ ID NO: 2801413 - protein, 20 aa, Entamoeba invadens
PEVFSLKSNNSFRPNEVLKP

SEQ ID NO: 2801414 - protein, 24 aa, Entamoeba invadens
PEVNECPLCKAVLGDKEVVRLPCL

SEQ ID NO: 2801415 - protein, 24 aa, Entamoeba invadens
PEVVTLKSGFACEFSVYVNPLCSC

SEQ ID NO: 2801416 - protein, 20 aa, Entamoeba invadens
PEVVTLKSGYACEFSVYVKP

SEQ ID NO: 2801417 - protein, 19 aa, Entamoeba invadens
PEYTLCPGYLLGLTDDDSC

SEQ ID NO: 2801418 - protein, 19 aa, Entamoeba invadens
PFAKLKFWKKKEEYEPFGH

SEQ ID NO: 2801419 - protein, 18 aa, Entamoeba invadens
PFCLSSMTLIRYVDKDRL

SEQ ID NO: 2801420 - protein, 21 aa, Entamoeba invadens
PFCTCKIRSSLDIIIDDLASG

SEQ ID NO: 2801421 - protein, 20 aa, Entamoeba invadens
PFDRDYIGFAIFDKIKQNFL

SEQ ID NO: 2801422 - protein, 19 aa, Entamoeba invadens
PFDTYKVFFYFRLLLLVTA

SEQ ID NO: 2801423 - protein, 21 aa, Entamoeba invadens
PFEHPMFLTFMMFVGMAICIV

SEQ ID NO: 2801424 - protein, 19 aa, Entamoeba invadens
PFELCKAFATGGLVTSVCG

SEQ ID NO: 2801425 - protein, 20 aa, Entamoeba invadens
PFERMLRFFTYVGVRQPIIC

SEQ ID NO: 2801426 - protein, 17 aa, Entamoeba invadens
PFFFSFVNLILFTICYL

SEQ ID NO: 2801427 - protein, 18 aa, Entamoeba invadens
PFFKTVMFFGLFPMSYII

SEQ ID NO: 2801428 - protein, 25 aa, Entamoeba invadens
PFFRTLPFQPLITFVAMHSGLYTQV

SEQ ID NO: 2801429 - protein, 23 aa, Entamoeba invadens
PFHDFSWTAFLMVLDYSVGGILV

SEQ ID NO: 2801430 - protein, 20 aa, Entamoeba invadens
PFHDFSWTAFVMVLDTSIGG

SEQ ID NO: 2801431 - protein, 20 aa, Entamoeba invadens
PFHPSICSILGFLDILIENY

SEQ ID NO: 2801432 - protein, 26 aa, Entamoeba invadens
PFILKSGTCSLCPTGQYKKDEMTCES

SEQ ID NO: 2801433 - protein, 23 aa, Entamoeba invadens
PFKSACKYLYFDSPFIINSCERV

SEQ ID NO: 2801434 - protein, 25 aa, Entamoeba invadens
PFKVLLEGHLLRYGASDKIYCHVNH

SEQ ID NO: 2801435 - protein, 25 aa, Entamoeba invadens
PFKVLLEGHLLRYGASNKIYCHVNH

SEQ ID NO: 2801436 - protein, 28 aa, Entamoeba invadens
PFLCASSVFCTRHFSGLLKAVSFHSENH

SEQ ID NO: 2801437 - protein, 18 aa, Entamoeba invadens
PFLCDGALQTITVFLTKY

SEQ ID NO: 2801438 - protein, 17 aa, Entamoeba invadens
PFLIEVVKKKMLAIESA

SEQ ID NO: 2801439 - protein, 20 aa, Entamoeba invadens
PFLSMCSIAPLLEHPKIIRL

SEQ ID NO: 2801440 - protein, 18 aa, Entamoeba invadens
PFLTYSNRGWPHCKKCSP

SEQ ID NO: 2801441 - protein, 20 aa, Entamoeba invadens
PFLVASFVISLRCENKKYRM

SEQ ID NO: 2801442 - protein, 17 aa, Entamoeba invadens
PFMDSWNAFGIAGFITS

SEQ ID NO: 2801443 - protein, 23 aa, Entamoeba invadens
PFMWKGKVMNHFINFIHDFAVVT

SEQ ID NO: 2801444 - protein, 22 aa, Entamoeba invadens
PFPLFDCVWSSNGCCGGDPKEL

SEQ ID NO: 2801445 - protein, 29 aa, Entamoeba invadens
PFPVSEYKYPWSISKFVCVGRRLEQPANM

SEQ ID NO: 2801446 - protein, 20 aa, Entamoeba invadens
PFRLTRELQAPLGYLGVGSR

SEQ ID NO: 2801447 - protein, 18 aa, Entamoeba invadens
PFSCKSIEISPVAQVLKQ

SEQ ID NO: 2801448 - protein, 25 aa, Entamoeba invadens
PFSMSLIYVMFCFDKLEKSTTGEEN

SEQ ID NO: 2801449 - protein, 18 aa, Entamoeba invadens
PFSSCPITSVDVLTKSGE

SEQ ID NO: 2801450 - protein, 24 aa, Entamoeba invadens
PFTGCFVCGISVLVSLGAESSVDQ

SEQ ID NO: 2801451 - protein, 25 aa, Entamoeba invadens
PFTPRESCELMYYRDEGMGLPDPAV

SEQ ID NO: 2801452 - protein, 20 aa, Entamoeba invadens
PFTRDGLVIFGKRITESLLS

SEQ ID NO: 2801453 - protein, 23 aa, Entamoeba invadens
PFVECKLPFLISFYPQHLNDING

SEQ ID NO: 2801454 - protein, 20 aa, Entamoeba invadens
PFVGCPLVLFPEWSVKWWRR

SEQ ID NO: 2801455 - protein, 23 aa, Entamoeba invadens
PFVNCKKWTPYEFVLEDSQDSEI

SEQ ID NO: 2801456 - protein, 27 aa, Entamoeba invadens
PFVSEHIEWFYGLWVIYGIIFLVMKLF

SEQ ID NO: 2801457 - protein, 26 aa, Entamoeba invadens
PFVYEIRTILDWTFAKTSMFYKMWLK

SEQ ID NO: 2801458 - protein, 19 aa, Entamoeba invadens
PFYNCCGYKDITNSTFNVT

SEQ ID NO: 2801459 - protein, 23 aa, Entamoeba invadens
PGACDLDPLMVYIGSNLSLAEIV

SEQ ID NO: 2801460 - protein, 25 aa, Entamoeba invadens
PGAYNCPLTNNFKRRIYGYQITEGC

SEQ ID NO: 2801461 - protein, 24 aa, Entamoeba invadens
PGCTKSCLCDLGYTPDPETGLCKM

SEQ ID NO: 2801462 - protein, 25 aa, Entamoeba invadens
PGEACEFEGTILPKCTSKITEKISV

SEQ ID NO: 2801463 - protein, 23 aa, Entamoeba invadens
PGELCDRMYCHIPKNTNYIPEGF

SEQ ID NO: 2801464 - protein, 18 aa, Entamoeba invadens
PGFLLNGIFLFKPNDMLS

SEQ ID NO: 2801465 - protein, 24 aa, Entamoeba invadens
PGGGGCAICNIGYYREGISCTPCD

SEQ ID NO: 2801466 - protein, 25 aa, Entamoeba invadens
PGIGFVQWIICIALALVTLPLGLLN

SEQ ID NO: 2801467 - protein, 23 aa, Entamoeba invadens
PGIIPRKIRMIGITPQRCKTCDE

SEQ ID NO: 2801468 - protein, 20 aa, Entamoeba invadens
PGIPLYFVLVAIVFIIVIFI

SEQ ID NO: 2801469 - protein, 21 aa, Entamoeba invadens
PGKTRIYVCLIHEGKAEETLE

SEQ ID NO: 2801470 - protein, 19 aa, Entamoeba invadens
PGKYAKFSISADNTISAQM

SEQ ID NO: 2801471 - protein, 17 aa, Entamoeba invadens
PGLSNRDLSRFVFSAVL

SEQ ID NO: 2801472 - protein, 24 aa, Entamoeba invadens
PGMISGMMWGVAQVCWFIANTNLP

SEQ ID NO: 2801473 - protein, 24 aa, Entamoeba invadens
PGMPHDIHNVFVLTCNVSMEYEKS

SEQ ID NO: 2801474 - protein, 19 aa, Entamoeba invadens
PGNDIFLSFYSQLVDLIYF

SEQ ID NO: 2801475 - protein, 19 aa, Entamoeba invadens
PGQCYKTRAAVDPVEPSKP

SEQ ID NO: 2801476 - protein, 24 aa, Entamoeba invadens
PGTFLRYLPGDGLRITAVTQIFPS

SEQ ID NO: 2801477 - protein, 20 aa, Entamoeba invadens
PGVLSLPYLVEFLVLSVCII

SEQ ID NO: 2801478 - protein, 18 aa, Entamoeba invadens
PGYEFAIKTPCTLKRWKL

SEQ ID NO: 2801479 - protein, 25 aa, Entamoeba invadens
PGYYIPYLFACVLFVLFSVFVYSTE

SEQ ID NO: 2801480 - protein, 19 aa, Entamoeba invadens
PGYYLTFLLVGFHKDVSNL

SEQ ID NO: 2801481 - protein, 21 aa, Entamoeba invadens
PHAFRSSGILLAILMSITFFA

SEQ ID NO: 2801482 - protein, 17 aa, Entamoeba invadens
PHATYPHVFEIFKNQIL

SEQ ID NO: 2801483 - protein, 18 aa, Entamoeba invadens
PHCISSLKYDCLKCDLTT

SEQ ID NO: 2801484 - protein, 19 aa, Entamoeba invadens
PHCKTCNSSTCLSCSSSFV

SEQ ID NO: 2801485 - protein, 25 aa, Entamoeba invadens
PHCPCFGNNCYIHFESSLSTYTTIG

SEQ ID NO: 2801486 - protein, 24 aa, Entamoeba invadens
PHCPCTTYDGFTCTIYIENSNVDL

SEQ ID NO: 2801487 - protein, 25 aa, Entamoeba invadens
PHCPCYGVNCTLVPNSDFSEVFIND

SEQ ID NO: 2801488 - protein, 19 aa, Entamoeba invadens
PHCSSAYCASCSEMNASNC

SEQ ID NO: 2801489 - protein, 27 aa, Entamoeba invadens
PHCVDEFKGICYRCEDGYSKLSNNTCV

SEQ ID NO: 2801490 - protein, 24 aa, Entamoeba invadens
PHFLPQFLADSFLFDEFDRNVKNG

SEQ ID NO: 2801491 - protein, 18 aa, Entamoeba invadens
PHFYLSVFAMVFMSVLPL

SEQ ID NO: 2801492 - protein, 22 aa, Entamoeba invadens
PHKNHFCLVASKIVYNMTLFLS

SEQ ID NO: 2801493 - protein, 20 aa, Entamoeba invadens
PHNTELLCNNTLLVTSGNKM

SEQ ID NO: 2801494 - protein, 17 aa, Entamoeba invadens
PHPIYLYLVKKGVKDRP

SEQ ID NO: 2801495 - protein, 17 aa, Entamoeba invadens
PHQCITCSSQTALKEGK

SEQ ID NO: 2801496 - protein, 18 aa, Entamoeba invadens
PHQLPGWSKNSTDYLNTY

SEQ ID NO: 2801497 - protein, 24 aa, Entamoeba invadens
PHSFPRALTLLSISASLSYVIPLA

SEQ ID NO: 2801498 - protein, 23 aa, Entamoeba invadens
PHTHSCRFWRCYSHRQSTVLQVP

SEQ ID NO: 2801499 - protein, 21 aa, Entamoeba invadens
PHVFEIFKNQILYQLIEREGS

SEQ ID NO: 2801500 - protein, 27 aa, Entamoeba invadens
PHYVYPWRIVGELIAQLSYELAFHRCL

SEQ ID NO: 2801501 - protein, 21 aa, Entamoeba invadens
PIACAVCLEIAKTMQSLFMRW

SEQ ID NO: 2801502 - protein, 17 aa, Entamoeba invadens
PIAEGAMGKVFIGNYRS

SEQ ID NO: 2801503 - protein, 24 aa, Entamoeba invadens
PIAETDPNCPLAGMPIIKTYQAKV

SEQ ID NO: 2801504 - protein, 18 aa, Entamoeba invadens
PIAKCNFITNSVCLECND

SEQ ID NO: 2801505 - protein, 22 aa, Entamoeba invadens
PIAPKKRYSYLNNDQNFFIFSL

SEQ ID NO: 2801506 - protein, 27 aa, Entamoeba invadens
PIASGDFKSFFSFFGVSKSRTGEVKAL

SEQ ID NO: 2801507 - protein, 20 aa, Entamoeba invadens
PIAVSVQFYNEFRVLNNGIL

SEQ ID NO: 2801508 - protein, 23 aa, Entamoeba invadens
PICSLCLSGMIFFSVMPLLKNSA

SEQ ID NO: 2801509 - protein, 18 aa, Entamoeba invadens
PICTICTSPFVLENDTCI

SEQ ID NO: 2801510 - protein, 26 aa, Entamoeba invadens
PIDTEIRFLFCVGNIKTRKSPIQKIQ

SEQ ID NO: 2801511 - protein, 25 aa, Entamoeba invadens
PIDTEIRLLFCVGNIKTRKSPIQKI

SEQ ID NO: 2801512 - protein, 18 aa, Entamoeba invadens
PIECTYCLYTSGECSSCE

SEQ ID NO: 2801513 - protein, 22 aa, Entamoeba invadens
PIEMVHLYLLIEIVRTVMGWTP

SEQ ID NO: 2801514 - protein, 25 aa, Entamoeba invadens
PIENFKFPWKIADFIMSGKRLERKE

SEQ ID NO: 2801515 - protein, 20 aa, Entamoeba invadens
PIFEFCGKKELFDSFMTTMK

SEQ ID NO: 2801516 - protein, 17 aa, Entamoeba invadens
PIFHFLRESNELFMQIL

SEQ ID NO: 2801517 - protein, 25 aa, Entamoeba invadens
PIFMYSRVMSLYVFLERITTTKTIE

SEQ ID NO: 2801518 - protein, 26 aa, Entamoeba invadens
PIFVCAEAYAAFSCFDPEIYKTVLTK

SEQ ID NO: 2801519 - protein, 24 aa, Entamoeba invadens
PIGEGAFGMVFRGTYRVRDVAIKK

SEQ ID NO: 2801520 - protein, 20 aa, Entamoeba invadens
PIGQLLRITISFLVSLLEAC

SEQ ID NO: 2801521 - protein, 23 aa, Entamoeba invadens
PIGTMCLWISFGTYLIHYVIAQI

SEQ ID NO: 2801522 - protein, 28 aa, Entamoeba invadens
PIHSKCYRCLACFKMIVGDKESPDHRCF

SEQ ID NO: 2801523 - protein, 20 aa, Entamoeba invadens
PIIFTTVIALMFLVMYLADW

SEQ ID NO: 2801524 - protein, 25 aa, Entamoeba invadens
PIIKKLKNILLFRVFGYKGTLVHVM

SEQ ID NO: 2801525 - protein, 28 aa, Entamoeba invadens
PIITALAGLCHFIDFGINAYGWFIGITF

SEQ ID NO: 2801526 - protein, 19 aa, Entamoeba invadens
PIIYLEMAWVYRNQEEPYY

SEQ ID NO: 2801527 - protein, 26 aa, Entamoeba invadens
PILKERKRLELMLERIIKREERNSKE

SEQ ID NO: 2801528 - protein, 17 aa, Entamoeba invadens
PILPYKNLNVLSGSDTF

SEQ ID NO: 2801529 - protein, 19 aa, Entamoeba invadens
PILSNIRKLYVMQGNPLKV

SEQ ID NO: 2801530 - protein, 20 aa, Entamoeba invadens
PILTLCPKKVLPPPQIVTSP

SEQ ID NO: 2801531 - protein, 24 aa, Entamoeba invadens
PINEFKFPWKIAEFVMEGKRLNRC

SEQ ID NO: 2801532 - protein, 23 aa, Entamoeba invadens
PINLFEIVGKCWSYNQLERIGIE

SEQ ID NO: 2801533 - protein, 18 aa, Entamoeba invadens
PINQLSCGCCYAAAIANH

SEQ ID NO: 2801534 - protein, 25 aa, Entamoeba invadens
PINTFKFPWKIAEYVTAGKRPEKRK

SEQ ID NO: 2801535 - protein, 22 aa, Entamoeba invadens
PINTKEKILFCVGNTKERTLKI

SEQ ID NO: 2801536 - protein, 22 aa, Entamoeba invadens
PIQIYEVMDMCWKQNKRERMGI

SEQ ID NO: 2801537 - protein, 25 aa, Entamoeba invadens
PIQKAGDVVFVLKIGVDTVGNIEAE

SEQ ID NO: 2801538 - protein, 23 aa, Entamoeba invadens
PIQLRLCLDAAKGVLYLHTNGII

SEQ ID NO: 2801539 - protein, 20 aa, Entamoeba invadens
PIQLSSWFWYARFKYCCKSS

SEQ ID NO: 2801540 - protein, 20 aa, Entamoeba invadens
PIRESICMTDFVAVDIESLE

SEQ ID NO: 2801541 - protein, 26 aa, Entamoeba invadens
PISDFLKVRFCQDVARGMEYLHENDI

SEQ ID NO: 2801542 - protein, 25 aa, Entamoeba invadens
PISDYLKVRFCQDVAKGMEYLHEND

SEQ ID NO: 2801543 - protein, 21 aa, Entamoeba invadens
PISFDLATIFNYSFIFAYEPN

SEQ ID NO: 2801544 - protein, 24 aa, Entamoeba invadens
PISMRVNLDIAKLVYAFFINKDKE

SEQ ID NO: 2801545 - protein, 29 aa, Entamoeba invadens
PISTLCGLLKAFLMEMSPRFITEKQYETF

SEQ ID NO: 2801546 - protein, 20 aa, Entamoeba invadens
PISYLRCAMANLYRKNYDNA

SEQ ID NO: 2801547 - protein, 18 aa, Entamoeba invadens
PITAGVPIAIILIIAATR

SEQ ID NO: 2801548 - protein, 17 aa, Entamoeba invadens
PITIRFGNVSQIIKEIK

SEQ ID NO: 2801549 - protein, 18 aa, Entamoeba invadens
PITIRYGKLQNIIKEIKK

SEQ ID NO: 2801550 - protein, 18 aa, Entamoeba invadens
PITPEFARNYVITNTNSE

SEQ ID NO: 2801551 - protein, 25 aa, Entamoeba invadens
PITTFKFPWKIAEFVSSGKRPDKSE

SEQ ID NO: 2801552 - protein, 26 aa, Entamoeba invadens
PITTFKFPWKIAEFVSSGKRPDKSET

SEQ ID NO: 2801553 - protein, 19 aa, Entamoeba invadens
PIVCLSCSDGYYLSSSSCN

SEQ ID NO: 2801554 - protein, 25 aa, Entamoeba invadens
PIVKKDVPTWVIVILIIIGIFIVII

SEQ ID NO: 2801555 - protein, 25 aa, Entamoeba invadens
PIVKKDVPTWVIVILIIIGVFIVII

SEQ ID NO: 2801556 - protein, 19 aa, Entamoeba invadens
PIVPICPGEKVTCETTEIY

SEQ ID NO: 2801557 - protein, 17 aa, Entamoeba invadens
PIVRLFSLFTIPYSIAH

SEQ ID NO: 2801558 - protein, 24 aa, Entamoeba invadens
PIWDDKWSALKYTNVIFKTQGKGL

SEQ ID NO: 2801559 - protein, 25 aa, Entamoeba invadens
PIYFICLIQSLGLAMFWSPSEALVG

SEQ ID NO: 2801560 - protein, 24 aa, Entamoeba invadens
PIYFICLIQSLGLAMYWSPTEALV

SEQ ID NO: 2801561 - protein, 18 aa, Entamoeba invadens
PIYRYISNTSDLRCECYL

SEQ ID NO: 2801562 - protein, 19 aa, Entamoeba invadens
PKAEMSFKGVGKVTINVKT

SEQ ID NO: 2801563 - protein, 25 aa, Entamoeba invadens
PKAFIPILLLQAFSLFWVLNTVSGV

SEQ ID NO: 2801564 - protein, 19 aa, Entamoeba invadens
PKANLPDRMYNLISQCWTE

SEQ ID NO: 2801565 - protein, 27 aa, Entamoeba invadens
PKAPLKLANGWPEIILNVVKSYMGIVQ

SEQ ID NO: 2801566 - protein, 21 aa, Entamoeba invadens
PKAQFKFPWNVATGVVNGLRP

SEQ ID NO: 2801567 - protein, 17 aa, Entamoeba invadens
PKASEVVKQKKEQKQAL

SEQ ID NO: 2801568 - protein, 20 aa, Entamoeba invadens
PKAVLSLGKNCFSFCTSMTK

SEQ ID NO: 2801569 - protein, 18 aa, Entamoeba invadens
PKCLPCSPNCEMCDSTGK

SEQ ID NO: 2801570 - protein, 22 aa, Entamoeba invadens
PKCMYGSACINGCYKPDKCERC

SEQ ID NO: 2801571 - protein, 19 aa, Entamoeba invadens
PKCSCHFSDSISVITINLK

SEQ ID NO: 2801572 - protein, 25 aa, Entamoeba invadens
PKDASCGKLIWIVCVMMLVALFGLH

SEQ ID NO: 2801573 - protein, 25 aa, Entamoeba invadens
PKDEFKFPWKIAEFVISGKHLNKSL

SEQ ID NO: 2801574 - protein, 25 aa, Entamoeba invadens
PKDEFKFPWKIAEFVISGKRVNKNP

SEQ ID NO: 2801575 - protein, 26 aa, Entamoeba invadens
PKDFPKRKLFPLLLMLIIEAVSQTII

SEQ ID NO: 2801576 - protein, 20 aa, Entamoeba invadens
PKDGCIECTYGYFLENNTCH

SEQ ID NO: 2801577 - protein, 26 aa, Entamoeba invadens
PKDHFKFPWKIAEFVSNGYRPKVNLV

SEQ ID NO: 2801578 - protein, 17 aa, Entamoeba invadens
PKDNWKYSLVNIPLYIF

SEQ ID NO: 2801579 - protein, 25 aa, Entamoeba invadens
PKDTFKGCILLNEVDGFEKVTYYGD

SEQ ID NO: 2801580 - protein, 20 aa, Entamoeba invadens
PKDYAELVEECWRNIPTERP

SEQ ID NO: 2801581 - protein, 17 aa, Entamoeba invadens
PKEAIFCHKFLNAKTEA

SEQ ID NO: 2801582 - protein, 17 aa, Entamoeba invadens
PKECGIFAVVISSTEAI

SEQ ID NO: 2801583 - protein, 25 aa, Entamoeba invadens
PKEDFKFQWKIAEFVTGGKRLKNVE

SEQ ID NO: 2801584 - protein, 25 aa, Entamoeba invadens
PKEDFKYPWKIAEFVMSGKRLVNSH

SEQ ID NO: 2801585 - protein, 25 aa, Entamoeba invadens
PKEEFKYPWNVASFISSGKRPESIR

SEQ ID NO: 2801586 - protein, 21 aa, Entamoeba invadens
PKEGYTYRGFMFTAFSESTNK

SEQ ID NO: 2801587 - protein, 23 aa, Entamoeba invadens
PKEIAALFFKTLMNQIKMEVPDL

SEQ ID NO: 2801588 - protein, 26 aa, Entamoeba invadens
PKEIFKYPWKIADFVVIGKRVDKKES

SEQ ID NO: 2801589 - protein, 22 aa, Entamoeba invadens
PKEMFKFPWNIAEMVTSGKRLE

SEQ ID NO: 2801590 - protein, 21 aa, Entamoeba invadens
PKENKCIACSTFDSNCLTCAS

SEQ ID NO: 2801591 - protein, 25 aa, Entamoeba invadens
PKEQFRFPWNIADYVTSGKRINRTD

SEQ ID NO: 2801592 - protein, 18 aa, Entamoeba invadens
PKESVILTITFIARCTTV

SEQ ID NO: 2801593 - protein, 25 aa, Entamoeba invadens
PKEYFKFPWTIAEFVIKGLRLPKPD

SEQ ID NO: 2801594 - protein, 26 aa, Entamoeba invadens
PKEYFKFPWTIAEFVIKGLRMPKPDE

SEQ ID NO: 2801595 - protein, 19 aa, Entamoeba invadens
PKFVFHFDPLVLLVRPNHT

SEQ ID NO: 2801596 - protein, 20 aa, Entamoeba invadens
PKFVFHFSPQVVFLRPNTKF

SEQ ID NO: 2801597 - protein, 19 aa, Entamoeba invadens
PKFYGAVFVTTKISFVVEF

SEQ ID NO: 2801598 - protein, 24 aa, Entamoeba invadens
PKGKACEFEVFLLVNCSTQIEDTI

SEQ ID NO: 2801599 - protein, 20 aa, Entamoeba invadens
PKGRSCVLCATFDRHCVTCA

SEQ ID NO: 2801600 - protein, 20 aa, Entamoeba invadens
PKGRSCVPCATFDRHCVTCA

SEQ ID NO: 2801601 - protein, 24 aa, Entamoeba invadens
PKHPVAHEFIEFGLKMVSTNIFTP

SEQ ID NO: 2801602 - protein, 36 aa, Entamoeba invadens
PKIEFLIEMFVWCCLDFEWIYSFVLLDLERVLLCVI

SEQ ID NO: 2801603 - protein, 18 aa, Entamoeba invadens
PKIRERLGIEEESLKCIQ

SEQ ID NO: 2801604 - protein, 25 aa, Entamoeba invadens
PKISTWICGVIWGLWHAPLVYFGHN

SEQ ID NO: 2801605 - protein, 23 aa, Entamoeba invadens
PKIVCLKAGEACEFSLAITPLCT

SEQ ID NO: 2801606 - protein, 26 aa, Entamoeba invadens
PKIVSLKSGFACEFEVFLTPHCTLTL

SEQ ID NO: 2801607 - protein, 25 aa, Entamoeba invadens
PKIVTLKKGFACEFEVYITPYCCLN

SEQ ID NO: 2801608 - protein, 23 aa, Entamoeba invadens
PKIVTLKSGFACEFEKYKKASDV

SEQ ID NO: 2801609 - protein, 26 aa, Entamoeba invadens
PKIVTLKSGFACEFEVFLTPHCTLSL

SEQ ID NO: 2801610 - protein, 25 aa, Entamoeba invadens
PKIVTLKSGFACEFEVFLTPLCTMN

SEQ ID NO: 2801611 - protein, 18 aa, Entamoeba invadens
PKKFRKSNNYSFYEMCCY

SEQ ID NO: 2801612 - protein, 24 aa, Entamoeba invadens
PKKGVLVMSTWTYLILINLITFLI

SEQ ID NO: 2801613 - protein, 22 aa, Entamoeba invadens
PKKHEIKFGFIITLVSITVLYN

SEQ ID NO: 2801614 - protein, 19 aa, Entamoeba invadens
PKKICLVTEFAKFGSLNDL

SEQ ID NO: 2801615 - protein, 18 aa, Entamoeba invadens
PKKICLVTEFAKYKSLND

SEQ ID NO: 2801616 - protein, 24 aa, Entamoeba invadens
PKKKACSVLAKITPKCTFTLEEPT

SEQ ID NO: 2801617 - protein, 24 aa, Entamoeba invadens
PKKWKVKHPKVWLYSARIAASTPP

SEQ ID NO: 2801618 - protein, 33 aa, Entamoeba invadens
PKLFKRLQLVFFLYRILALVLMYTTLIIFFIGS

SEQ ID NO: 2801619 - protein, 20 aa, Entamoeba invadens
PKLKSFPLNFSRCGKYTLNN

SEQ ID NO: 2801620 - protein, 19 aa, Entamoeba invadens
PKLKVVRITSNHYRYYGKG

SEQ ID NO: 2801621 - protein, 19 aa, Entamoeba invadens
PKLLRVMFRLNAKPMLIAV

SEQ ID NO: 2801622 - protein, 21 aa, Entamoeba invadens
PKLVSIIMFNLMGWDFVGNVS

SEQ ID NO: 2801623 - protein, 22 aa, Entamoeba invadens
PKNEFPYPWNVATFVSDGRRQP

SEQ ID NO: 2801624 - protein, 26 aa, Entamoeba invadens
PKNFPKRKLLPLLLMLLIEAMSQTII

SEQ ID NO: 2801625 - protein, 30 aa, Entamoeba invadens
PKNIKRCPRCGGYVNPFCAFEEGGKKMNDV

SEQ ID NO: 2801626 - protein, 18 aa, Entamoeba invadens
PKNIWSIVFFVLVIVAHL

SEQ ID NO: 2801627 - protein, 22 aa, Entamoeba invadens
PKNKFQYAWSIADFVTSGKHLE

SEQ ID NO: 2801628 - protein, 23 aa, Entamoeba invadens
PKNTFKFPWKIAEFVTTGERLPI

SEQ ID NO: 2801629 - protein, 29 aa, Entamoeba invadens
PKNYSKGCAPYCGVCQMGYECNKAARCVP

SEQ ID NO: 2801630 - protein, 20 aa, Entamoeba invadens
PKPFTQRIFSLFPTNIPFQM

SEQ ID NO: 2801631 - protein, 21 aa, Entamoeba invadens
PKPKLLRVMFRLNAKPMLIAI

SEQ ID NO: 2801632 - protein, 18 aa, Entamoeba invadens
PKQRLTIVEMLKRLETLY

SEQ ID NO: 2801633 - protein, 18 aa, Entamoeba invadens
PKRTIYLCIGFTECVFVD

SEQ ID NO: 2801634 - protein, 23 aa, Entamoeba invadens
PKSCIKKEIGIGVIVSIVVGAVV

SEQ ID NO: 2801635 - protein, 24 aa, Entamoeba invadens
PKSEFKFPWKIAEFVTNGNRLKKP

SEQ ID NO: 2801636 - protein, 18 aa, Entamoeba invadens
PKSGRLKPHREIKISAFV

SEQ ID NO: 2801637 - protein, 21 aa, Entamoeba invadens
PKSLRCDPCGDGTYANTTGST

SEQ ID NO: 2801638 - protein, 22 aa, Entamoeba invadens
PKSMFPFPWKIAEFVINGRRLE

SEQ ID NO: 2801639 - protein, 20 aa, Entamoeba invadens
PKSNVCVSCISFDTNCFTCS

SEQ ID NO: 2801640 - protein, 20 aa, Entamoeba invadens
PKSNVCVSCISFDTNCSLCD

SEQ ID NO: 2801641 - protein, 26 aa, Entamoeba invadens
PKSTFKFPWEIPEFVTSGKRLARPEK

SEQ ID NO: 2801642 - protein, 19 aa, Entamoeba invadens
PKTITSLFVLPSTNIDFNR

SEQ ID NO: 2801643 - protein, 24 aa, Entamoeba invadens
PKTKYNCYSHVWDSHLRHLSACPM

SEQ ID NO: 2801644 - protein, 25 aa, Entamoeba invadens
PKTQFKYPWVIAKFVIEGKRLDKKE

SEQ ID NO: 2801645 - protein, 28 aa, Entamoeba invadens
PKTQFMFPWKIAEFVMAGNHLKRINEVP

SEQ ID NO: 2801646 - protein, 17 aa, Entamoeba invadens
PKTRHVIEIKGLDKPLI

SEQ ID NO: 2801647 - protein, 23 aa, Entamoeba invadens
PKTWPSIGSVEFIDFKVKYRRGL

SEQ ID NO: 2801648 - protein, 20 aa, Entamoeba invadens
PKVPWNCFSPTIKTTPNLPD

SEQ ID NO: 2801649 - protein, 29 aa, Entamoeba invadens
PKVVMLKKKFACEFSIYLTPKCTCQINNK

SEQ ID NO: 2801650 - protein, 18 aa, Entamoeba invadens
PKVVMWNINRLHLYKNSF

SEQ ID NO: 2801651 - protein, 17 aa, Entamoeba invadens
PKWVQMIVGVILAVVAG

SEQ ID NO: 2801652 - protein, 23 aa, Entamoeba invadens
PLANRFILGILFFINEVFLQLKL

SEQ ID NO: 2801653 - protein, 18 aa, Entamoeba invadens
PLAVYPIILFFAMLSWLT

SEQ ID NO: 2801654 - protein, 24 aa, Entamoeba invadens
PLCDSFELANSCTFNGNLSITNCS

SEQ ID NO: 2801655 - protein, 20 aa, Entamoeba invadens
PLCISAAVECNKYMSTIPAD

SEQ ID NO: 2801656 - protein, 20 aa, Entamoeba invadens
PLCRDCQASGKTKCDVCELN

SEQ ID NO: 2801657 - protein, 18 aa, Entamoeba invadens
PLCSCKIDEHFVFRSEYI

SEQ ID NO: 2801658 - protein, 17 aa, Entamoeba invadens
PLCSCKINNIIQLISKN

SEQ ID NO: 2801659 - protein, 25 aa, Entamoeba invadens
PLCTFSSQIPLTFPVSINNKSVTPL

SEQ ID NO: 2801660 - protein, 18 aa, Entamoeba invadens
PLCTMITSFVCSFGVMFL

SEQ ID NO: 2801661 - protein, 18 aa, Entamoeba invadens
PLCVGISTVFLAVCFLCV

SEQ ID NO: 2801662 - protein, 18 aa, Entamoeba invadens
PLDILRKRMCIMPQEATL

SEQ ID NO: 2801663 - protein, 24 aa, Entamoeba invadens
PLDSNCLSCGSGRYFENGQCLSCD

SEQ ID NO: 2801664 - protein, 18 aa, Entamoeba invadens
PLEDDFLIVQALKRLENF

SEQ ID NO: 2801665 - protein, 20 aa, Entamoeba invadens
PLEGDFEEWDCSKYAERNPT

SEQ ID NO: 2801666 - protein, 37 aa, Entamoeba invadens
PLEGSSGGFGWCDGLLLRAMKSGSWVLLDELNLASQS

SEQ ID NO: 2801667 - protein, 25 aa, Entamoeba invadens
PLEPFAMKLRIKIMTDLARGVEYLH

SEQ ID NO: 2801668 - protein, 17 aa, Entamoeba invadens
PLFAWSLGNQFPLNIYF

SEQ ID NO: 2801669 - protein, 28 aa, Entamoeba invadens
PLFLDLTIPVLFGLYLLKTGLRIGLYKK

SEQ ID NO: 2801670 - protein, 20 aa, Entamoeba invadens
PLFLNWAMFLGMTLCLIPYV

SEQ ID NO: 2801671 - protein, 20 aa, Entamoeba invadens
PLFWDCNKKLHFIRCASDKF

SEQ ID NO: 2801672 - protein, 18 aa, Entamoeba invadens
PLFYNWFNFLVAIILTVL

SEQ ID NO: 2801673 - protein, 21 aa, Entamoeba invadens
PLGFERRVRNFLKESKLNLEV

SEQ ID NO: 2801674 - protein, 18 aa, Entamoeba invadens
PLGNFGKILLVGSGVGFC

SEQ ID NO: 2801675 - protein, 22 aa, Entamoeba invadens
PLGVNCLECISGYYKVDDKCVP

SEQ ID NO: 2801676 - protein, 17 aa, Entamoeba invadens
PLIFVNACAIVFLLIFG

SEQ ID NO: 2801677 - protein, 25 aa, Entamoeba invadens
PLIGIYKWGPSLAITQALNNLVTFC

SEQ ID NO: 2801678 - protein, 19 aa, Entamoeba invadens
PLIHDILPFGFYVKVGGSD

SEQ ID NO: 2801679 - protein, 18 aa, Entamoeba invadens
PLKGIPFGPQVAKTVTQT

SEQ ID NO: 2801680 - protein, 36 aa, Entamoeba invadens
PLKQRWTSICKNKLLRFAVGELFGSYILLMGTQASG

SEQ ID NO: 2801681 - protein, 18 aa, Entamoeba invadens
PLLHSKRIKYDFKSSIYF

SEQ ID NO: 2801682 - protein, 18 aa, Entamoeba invadens
PLLKFLVVGVIGTLVDVS

SEQ ID NO: 2801683 - protein, 19 aa, Entamoeba invadens
PLLKFWAKIPNAFWWSDKM

SEQ ID NO: 2801684 - protein, 17 aa, Entamoeba invadens
PLLNFAVYCIEWVVNTR

SEQ ID NO: 2801685 - protein, 19 aa, Entamoeba invadens
PLLSALFRAHHMHLLTLIR

SEQ ID NO: 2801686 - protein, 21 aa, Entamoeba invadens
PLLSWCFVNGLNFPLNQYLPF

SEQ ID NO: 2801687 - protein, 19 aa, Entamoeba invadens
PLLTLVTSFSIRENQISVY

SEQ ID NO: 2801688 - protein, 18 aa, Entamoeba invadens
PLLTTHLIYSPKNDFANY

SEQ ID NO: 2801689 - protein, 18 aa, Entamoeba invadens
PLLVELMNIKGLKFEDPT

SEQ ID NO: 2801690 - protein, 23 aa, Entamoeba invadens
PLMLKRQQKGLIIGMSSSTSFMP

SEQ ID NO: 2801691 - protein, 19 aa, Entamoeba invadens
PLMVWTLRMHDVNNISNSH

SEQ ID NO: 2801692 - protein, 22 aa, Entamoeba invadens
PLNNLERWNGEHHVIFENQKID

SEQ ID NO: 2801693 - protein, 20 aa, Entamoeba invadens
PLNSFAILVTIFFKYIDNKI

SEQ ID NO: 2801694 - protein, 22 aa, Entamoeba invadens
PLNYKIPVWFLNRQKDIKDGKN

SEQ ID NO: 2801695 - protein, 17 aa, Entamoeba invadens
PLPPLGSGYYDAVTAIV

SEQ ID NO: 2801696 - protein, 17 aa, Entamoeba invadens
PLPSYFVTLQIDWRKRW

SEQ ID NO: 2801697 - protein, 19 aa, Entamoeba invadens
PLQNCLMYHRFMSNGNYYY

SEQ ID NO: 2801698 - protein, 22 aa, Entamoeba invadens
PLRQLRKRMCILPQESTLFSGT

SEQ ID NO: 2801699 - protein, 17 aa, Entamoeba invadens
PLSIAWSIVCPFSCLNG

SEQ ID NO: 2801700 - protein, 25 aa, Entamoeba invadens
PLSNRCLKCATGFSLKDGLCVSDET

SEQ ID NO: 2801701 - protein, 26 aa, Entamoeba invadens
PLSQITFGCGIDNYYRAEYTKPTILT

SEQ ID NO: 2801702 - protein, 31 aa, Entamoeba invadens
PLSQRTFKFFYFPRFVLIILLESFVVNLYLY

SEQ ID NO: 2801703 - protein, 37 aa, Entamoeba invadens
PLSSCTKGRITSYVGWEKGGSCSFGPKTEEVVLPGYM

SEQ ID NO: 2801704 - protein, 18 aa, Entamoeba invadens
PLSSYTFYNSFKFQDYVE

SEQ ID NO: 2801705 - protein, 27 aa, Entamoeba invadens
PLSYARRAWPIVIVFTSLIILLQMVIQ

SEQ ID NO: 2801706 - protein, 24 aa, Entamoeba invadens
PLVCPSVPEGITFEGIPALMDAIY

SEQ ID NO: 2801707 - protein, 24 aa, Entamoeba invadens
PLVCVGCALMSLTVFKNLFQLLWE

SEQ ID NO: 2801708 - protein, 24 aa, Entamoeba invadens
PLVDCPFTPINFNLNLDVPDTSTS

SEQ ID NO: 2801709 - protein, 26 aa, Entamoeba invadens
PLVHLLGIRYGYFFTTFCTALFYGMY

SEQ ID NO: 2801710 - protein, 18 aa, Entamoeba invadens
PLVLCCLVTMGFGVIFRS

SEQ ID NO: 2801711 - protein, 30 aa, Entamoeba invadens
PLVLFPEWSVKWWRRMYLRLLDLKRWKYIT

SEQ ID NO: 2801712 - protein, 26 aa, Entamoeba invadens
PLVLTCLGLLAACIVALFQPQLYFGL

SEQ ID NO: 2801713 - protein, 19 aa, Entamoeba invadens
PLVTLKKGFACEFEIFLTP

SEQ ID NO: 2801714 - protein, 19 aa, Entamoeba invadens
PLVTLKKGFACEFEVFLTP

SEQ ID NO: 2801715 - protein, 22 aa, Entamoeba invadens
PLYFKGGCVLSDTPGKYQKSKV

SEQ ID NO: 2801716 - protein, 17 aa, Entamoeba invadens
PLYFVFHSGDYTKYIIL

SEQ ID NO: 2801717 - protein, 31 aa, Entamoeba invadens
PLYKEYPGGESVMFKERFSDWASVPIGGKVD

SEQ ID NO: 2801718 - protein, 23 aa, Entamoeba invadens
PMFITMEYFDGGSLFDMIHEKQA

SEQ ID NO: 2801719 - protein, 29 aa, Entamoeba invadens
PMIPISLRVNLEFSKIFYSLLIQFDPNIP

SEQ ID NO: 2801720 - protein, 24 aa, Entamoeba invadens
PMKSETFGYVSFTYRFKEKTHEYT

SEQ ID NO: 2801721 - protein, 24 aa, Entamoeba invadens
PMKTDKWELFFGLKKGKAIVDKVY

SEQ ID NO: 2801722 - protein, 19 aa, Entamoeba invadens
PMNGGGLGDLVASLEDVFA

SEQ ID NO: 2801723 - protein, 20 aa, Entamoeba invadens
PMNGYIRFYGFTKYTTYENY

SEQ ID NO: 2801724 - protein, 18 aa, Entamoeba invadens
PMRFIKQVFDNICQNKNV

SEQ ID NO: 2801725 - protein, 18 aa, Entamoeba invadens
PMTGCVSTAVGNPFVEAL

SEQ ID NO: 2801726 - protein, 21 aa, Entamoeba invadens
PMTLSMRIKMSLDGAKGILYL

SEQ ID NO: 2801727 - protein, 25 aa, Entamoeba invadens
PMVFSSPPWNCFSPKVSTDVPLPGD

SEQ ID NO: 2801728 - protein, 19 aa, Entamoeba invadens
PNASLFLSGSVEFLDTLYI

SEQ ID NO: 2801729 - protein, 19 aa, Entamoeba invadens
PNCKKCTSLSVGKTRCVEC

SEQ ID NO: 2801730 - protein, 20 aa, Entamoeba invadens
PNCKLCRNIINFGIRCEECF

SEQ ID NO: 2801731 - protein, 25 aa, Entamoeba invadens
PNCKSCAFNGERKCLTCVNKYKPAS

SEQ ID NO: 2801732 - protein, 26 aa, Entamoeba invadens
PNCNLCTKLKCSICNNNYVLNNESVC

SEQ ID NO: 2801733 - protein, 21 aa, Entamoeba invadens
PNCQACSTKTVGIPVCITCYS

SEQ ID NO: 2801734 - protein, 17 aa, Entamoeba invadens
PNCSSAFCSECENEVCT

SEQ ID NO: 2801735 - protein, 17 aa, Entamoeba invadens
PNCSYAFSSYLRFWDIS

SEQ ID NO: 2801736 - protein, 22 aa, Entamoeba invadens
PNDENGKCLLAISNCTFQTNTK

SEQ ID NO: 2801737 - protein, 21 aa, Entamoeba invadens
PNDLFKFAWSIADYITGGQRR

SEQ ID NO: 2801738 - protein, 24 aa, Entamoeba invadens
PNECISCGQNSMLKNSLCTNCTED

SEQ ID NO: 2801739 - protein, 24 aa, Entamoeba invadens
PNECTSCIDGFYIIKGESYTCQNY

SEQ ID NO: 2801740 - protein, 25 aa, Entamoeba invadens
PNEDFRFPWDIAMFVSSQKRPEIRG

SEQ ID NO: 2801741 - protein, 20 aa, Entamoeba invadens
PNEIVKFLFLSTKGDHPVLV

SEQ ID NO: 2801742 - protein, 17 aa, Entamoeba invadens
PNELSVILGCDSSECRK

SEQ ID NO: 2801743 - protein, 26 aa, Entamoeba invadens
PNEVLKPPVCMTNFLALNYESKTIKT

SEQ ID NO: 2801744 - protein, 19 aa, Entamoeba invadens
PNFACEFEMFLTPNCTSKI

SEQ ID NO: 2801745 - protein, 28 aa, Entamoeba invadens
PNFDKVWRPPLFTPRRICHIGVLAYIAV

SEQ ID NO: 2801746 - protein, 17 aa, Entamoeba invadens
PNFFSSKIFCFNKTAQI

SEQ ID NO: 2801747 - protein, 24 aa, Entamoeba invadens
PNFHPRFVTIIKINSTIAYSYLGY

SEQ ID NO: 2801748 - protein, 17 aa, Entamoeba invadens
PNFKDWCEDYAFDWKTM

SEQ ID NO: 2801749 - protein, 17 aa, Entamoeba invadens
PNGCTKLSETSSRKVDV

SEQ ID NO: 2801750 - protein, 19 aa, Entamoeba invadens
PNGIRGVVWTHGNIIAQCC

SEQ ID NO: 2801751 - protein, 18 aa, Entamoeba invadens
PNGKCVACSTITSNCTSC

SEQ ID NO: 2801752 - protein, 24 aa, Entamoeba invadens
PNGLYIGIGCYDWVTPKNVACRTT

SEQ ID NO: 2801753 - protein, 25 aa, Entamoeba invadens
PNGNNCLYEAIGIGSTLLSKVGGKI

SEQ ID NO: 2801754 - protein, 21 aa, Entamoeba invadens
PNIIRLMCMRYFAPNYYMILQ

SEQ ID NO: 2801755 - protein, 20 aa, Entamoeba invadens
PNILDFFSFIFFFPGLFSGP

SEQ ID NO: 2801756 - protein, 20 aa, Entamoeba invadens
PNINGIYFIKIKDMKYRVST

SEQ ID NO: 2801757 - protein, 29 aa, Entamoeba invadens
PNITPKRMCELYWDYSIRRRWDSFYTVIE

SEQ ID NO: 2801758 - protein, 26 aa, Entamoeba invadens
PNKCKTIRKGICIDCEEGTTLVGGEC

SEQ ID NO: 2801759 - protein, 18 aa, Entamoeba invadens
PNKCLLCAQNYFKKNKLC

SEQ ID NO: 2801760 - protein, 18 aa, Entamoeba invadens
PNKCLLCAQNYFKKNYLC

SEQ ID NO: 2801761 - protein, 21 aa, Entamoeba invadens
PNKDYYIFVAPYNFDEEGFME

SEQ ID NO: 2801762 - protein, 19 aa, Entamoeba invadens
PNKFLSMSYDWFNDDKSVG

SEQ ID NO: 2801763 - protein, 20 aa, Entamoeba invadens
PNKICLVTEFANYGSLQDLM

SEQ ID NO: 2801764 - protein, 20 aa, Entamoeba invadens
PNKMCMVSEFALFGSLQDLM

SEQ ID NO: 2801765 - protein, 18 aa, Entamoeba invadens
PNKSYCLEQLMGNGTATT

SEQ ID NO: 2801766 - protein, 21 aa, Entamoeba invadens
PNLFTLCGSYTAFNTERDGKD

SEQ ID NO: 2801767 - protein, 22 aa, Entamoeba invadens
PNLGQIAGLIVKYTNTNSKTLT

SEQ ID NO: 2801768 - protein, 23 aa, Entamoeba invadens
PNLNELPLCVIIKPNTTYKTLKA

SEQ ID NO: 2801769 - protein, 19 aa, Entamoeba invadens
PNLSECFVFLGDDFFFYRP

SEQ ID NO: 2801770 - protein, 18 aa, Entamoeba invadens
PNLVTLKSGYACEFEVFI

SEQ ID NO: 2801771 - protein, 19 aa, Entamoeba invadens
PNMIGCAICQEGYYRQQSD

SEQ ID NO: 2801772 - protein, 19 aa, Entamoeba invadens
PNMIGCALCQEGYYREKSD

SEQ ID NO: 2801773 - protein, 17 aa, Entamoeba invadens
PNMKCADFGFDVTEITG

SEQ ID NO: 2801774 - protein, 25 aa, Entamoeba invadens
PNMMDYKLTCLMSGNVMKDYTYGDD

SEQ ID NO: 2801775 - protein, 28 aa, Entamoeba invadens
PNNCIKKGFEWYFGMIIGIVALVIIVII

SEQ ID NO: 2801776 - protein, 23 aa, Entamoeba invadens
PNNCLSCASGYYFNNDGICERKD

SEQ ID NO: 2801777 - protein, 20 aa, Entamoeba invadens
PNNCLSCKTGYYLSNGYCLE

SEQ ID NO: 2801778 - protein, 18 aa, Entamoeba invadens
PNNCVACQFGYYYNTTTN

SEQ ID NO: 2801779 - protein, 19 aa, Entamoeba invadens
PNNFEIEWLAKRIGYKGGE

SEQ ID NO: 2801780 - protein, 25 aa, Entamoeba invadens
PNNYEFIYPLITSWIAPLNVMHIYP

SEQ ID NO: 2801781 - protein, 23 aa, Entamoeba invadens
PNPQDPLNWEVCTEACGKSTEIS

SEQ ID NO: 2801782 - protein, 18 aa, Entamoeba invadens
PNQMCINLLKNLLSLSNS

SEQ ID NO: 2801783 - protein, 18 aa, Entamoeba invadens
PNQVPVYCGFFFIAYSFL

SEQ ID NO: 2801784 - protein, 22 aa, Entamoeba invadens
PNQYIWRVLRNVSENCTEDDLQ

SEQ ID NO: 2801785 - protein, 21 aa, Entamoeba invadens
PNRLLEFYFYGTLYARDYLNI

SEQ ID NO: 2801786 - protein, 21 aa, Entamoeba invadens
PNRQCYQCVSGMYPNDDKQCI

SEQ ID NO: 2801787 - protein, 21 aa, Entamoeba invadens
PNRQCYQCVSGMYPNNNKQCI

SEQ ID NO: 2801788 - protein, 19 aa, Entamoeba invadens
PNSIFPFQKTCCNFTGNNM

SEQ ID NO: 2801789 - protein, 25 aa, Entamoeba invadens
PNSYSTKTGDSWNLLEKCSEGGINR

SEQ ID NO: 2801790 - protein, 17 aa, Entamoeba invadens
PNTRTGKIYVNQLTTSN

SEQ ID NO: 2801791 - protein, 31 aa, Entamoeba invadens
PNVFNPFKFLLRRAVRLFPMQLFSTIMAFTS

SEQ ID NO: 2801792 - protein, 21 aa, Entamoeba invadens
PNVMRLFIQRYIKPSNYELVQ

SEQ ID NO: 2801793 - protein, 18 aa, Entamoeba invadens
PNVPEIELTYAKERYQLS

SEQ ID NO: 2801794 - protein, 18 aa, Entamoeba invadens
PNYACEFEISLKPNFTSN

SEQ ID NO: 2801795 - protein, 19 aa, Entamoeba invadens
PNYGCEFSLFLTPLCNSNM

SEQ ID NO: 2801796 - protein, 24 aa, Entamoeba invadens
PNYGCEFSLFLTPLCNSNMESSFV

SEQ ID NO: 2801797 - protein, 19 aa, Entamoeba invadens
PNYHCLSAIEIGVSAQILY

SEQ ID NO: 2801798 - protein, 22 aa, Entamoeba invadens
PNYSLIIPRVMNVYGSSNITFV

SEQ ID NO: 2801799 - protein, 17 aa, Entamoeba invadens
PNYVFAYICDSCALFDI

SEQ ID NO: 2801800 - protein, 18 aa, Entamoeba invadens
PNYVLKDSHCVFYKEIDH

SEQ ID NO: 2801801 - protein, 20 aa, Entamoeba invadens
PPCGVLRTIRRGATYEEVTE

SEQ ID NO: 2801802 - protein, 22 aa, Entamoeba invadens
PPDKFKFAWDIADFISGKESGE

SEQ ID NO: 2801803 - protein, 19 aa, Entamoeba invadens
PPECLDLLSVKYTLKSLFA

SEQ ID NO: 2801804 - protein, 32 aa, Entamoeba invadens
PPESMARFGACLHCLTCLIVAMVYITETKTIP

SEQ ID NO: 2801805 - protein, 28 aa, Entamoeba invadens
PPFTNPHIFKLFDGHLVKYCPEGIDHIT

SEQ ID NO: 2801806 - protein, 24 aa, Entamoeba invadens
PPIAEVVLCPKCLEDNHAEVAELS

SEQ ID NO: 2801807 - protein, 20 aa, Entamoeba invadens
PPIFLTDGVKCKRVREDNER

SEQ ID NO: 2801808 - protein, 17 aa, Entamoeba invadens
PPIVLWQSNWLHLYTNT

SEQ ID NO: 2801809 - protein, 19 aa, Entamoeba invadens
PPKCLPCSPNCEMCDSTGK

SEQ ID NO: 2801810 - protein, 26 aa, Entamoeba invadens
PPKRNNVFFIDWFVFYSTTFLNTLTL

SEQ ID NO: 2801811 - protein, 23 aa, Entamoeba invadens
PPLCIKPSGSPLLEEQKVEELVE

SEQ ID NO: 2801812 - protein, 22 aa, Entamoeba invadens
PPLCRDCQASGKTKCDVCELNA

SEQ ID NO: 2801813 - protein, 22 aa, Entamoeba invadens
PPLCSECQESGKNKCDVCDSNT

SEQ ID NO: 2801814 - protein, 17 aa, Entamoeba invadens
PPLLLLVLFSFLKTSWR

SEQ ID NO: 2801815 - protein, 17 aa, Entamoeba invadens
PPLMIGLLGYSAVLLLI

SEQ ID NO: 2801816 - protein, 26 aa, Entamoeba invadens
PPLSHCLCVPMSPSFILRTLDANVVP

SEQ ID NO: 2801817 - protein, 24 aa, Entamoeba invadens
PPLVNLKRGFACEFEIYIKPLCSC

SEQ ID NO: 2801818 - protein, 26 aa, Entamoeba invadens
PPLVTLKPGYACEFEIFIKPLCTCVT

SEQ ID NO: 2801819 - protein, 20 aa, Entamoeba invadens
PPRRGSVPMITYMTLNCTTK

SEQ ID NO: 2801820 - protein, 27 aa, Entamoeba invadens
PPRTEEIWKKFAPSLTRKQFDLRYGGG

SEQ ID NO: 2801821 - protein, 22 aa, Entamoeba invadens
PPSAGYRSAYKPSDIFQLNATL

SEQ ID NO: 2801822 - protein, 20 aa, Entamoeba invadens
PPSKVCVFCKTFDNKCETCQ

SEQ ID NO: 2801823 - protein, 17 aa, Entamoeba invadens
PPSPLPLLVSFTNIILE

SEQ ID NO: 2801824 - protein, 19 aa, Entamoeba invadens
PPSRVCVFCKTFDNKCETC

SEQ ID NO: 2801825 - protein, 18 aa, Entamoeba invadens
PPSRVCVFCKTFDNKCVT

SEQ ID NO: 2801826 - protein, 24 aa, Entamoeba invadens
PPSSWPSNGSIEFNKFKFRYRRGL

SEQ ID NO: 2801827 - protein, 23 aa, Entamoeba invadens
PPSWPSTGSVEFSDFKFRYRRGL

SEQ ID NO: 2801828 - protein, 18 aa, Entamoeba invadens
PPTLATLFGIVLVVLYPV

SEQ ID NO: 2801829 - protein, 18 aa, Entamoeba invadens
PPTQKVFPILPYKNLNVL

SEQ ID NO: 2801830 - protein, 23 aa, Entamoeba invadens
PPVFCFIVLEFINSCPKKIPAGV

SEQ ID NO: 2801831 - protein, 27 aa, Entamoeba invadens
PPYPKSEFQFPWNIAEFVAKGNRRLQP

SEQ ID NO: 2801832 - protein, 17 aa, Entamoeba invadens
PQCFKSATTTYWYSLIG

SEQ ID NO: 2801833 - protein, 18 aa, Entamoeba invadens
PQDLLLVIFFTYVFFFES

SEQ ID NO: 2801834 - protein, 19 aa, Entamoeba invadens
PQELTVWTGFVFPWLFYIA

SEQ ID NO: 2801835 - protein, 18 aa, Entamoeba invadens
PQEMTLKKGEAFEVEVFL

SEQ ID NO: 2801836 - protein, 18 aa, Entamoeba invadens
PQESLNCLLSDGKSCLLC

SEQ ID NO: 2801837 - protein, 25 aa, Entamoeba invadens
PQFNFPWKIAEYVMAGKRPKITKNI

SEQ ID NO: 2801838 - protein, 20 aa, Entamoeba invadens
PQIGCKPITCGNGIFDVGEE

SEQ ID NO: 2801839 - protein, 18 aa, Entamoeba invadens
PQISFDFFNPLMLLLTQK

SEQ ID NO: 2801840 - protein, 17 aa, Entamoeba invadens
PQISPIFMYSRVMSLYV

SEQ ID NO: 2801841 - protein, 26 aa, Entamoeba invadens
PQIVTLKSGFACEFEVFITPYCTMDL

SEQ ID NO: 2801842 - protein, 26 aa, Entamoeba invadens
PQIVTLKSGFACEFEVFLTPLCTMDL

SEQ ID NO: 2801843 - protein, 17 aa, Entamoeba invadens
PQKAGPRYGFLAQEVQQ

SEQ ID NO: 2801844 - protein, 28 aa, Entamoeba invadens
PQKFCGWRVVILFGSFWGLVPVISTITT

SEQ ID NO: 2801845 - protein, 22 aa, Entamoeba invadens
PQKGCLTNSCGNNILDDGEECD

SEQ ID NO: 2801846 - protein, 22 aa, Entamoeba invadens
PQKKIRLLLPRHDLFLENLLLW

SEQ ID NO: 2801847 - protein, 19 aa, Entamoeba invadens
PQKVFWLYYLFQFEIELTS

SEQ ID NO: 2801848 - protein, 24 aa, Entamoeba invadens
PQLIMKEPLPFLIDEMRVNEVTTF

SEQ ID NO: 2801849 - protein, 22 aa, Entamoeba invadens
PQLNLPRIVVWNSSSIQLFKTV

SEQ ID NO: 2801850 - protein, 26 aa, Entamoeba invadens
PQLQALRFPIFDSFHKFAVRYCKARV

SEQ ID NO: 2801851 - protein, 20 aa, Entamoeba invadens
PQLYLALLVAFSLLAIGYSV

SEQ ID NO: 2801852 - protein, 18 aa, Entamoeba invadens
PQNCIFANLIEKSWQHKV

SEQ ID NO: 2801853 - protein, 21 aa, Entamoeba invadens
PQNILPWVVTKAVIGGNKPVF

SEQ ID NO: 2801854 - protein, 18 aa, Entamoeba invadens
PQPKCWVQSCMNKPCQFV

SEQ ID NO: 2801855 - protein, 24 aa, Entamoeba invadens
PQQELPWHKKLLIYAKDSGEDFMV

SEQ ID NO: 2801856 - protein, 24 aa, Entamoeba invadens
PQSTVCCKLGHYWDLAEMTSLIIP

SEQ ID NO: 2801857 - protein, 20 aa, Entamoeba invadens
PQSVIPFAWVSPSLSREIIL

SEQ ID NO: 2801858 - protein, 27 aa, Entamoeba invadens
PQTDPMFKYSWCIANFVMDGKRLPKTD

SEQ ID NO: 2801859 - protein, 29 aa, Entamoeba invadens
PQTWYGRLFCALYILSFLIYFPLKLGQIF

SEQ ID NO: 2801860 - protein, 17 aa, Entamoeba invadens
PQVAIGTGLIKIWDSSI

SEQ ID NO: 2801861 - protein, 37 aa, Entamoeba invadens
PQVDALLDIPCHICRCLFLRVIPMDYLVLFVSTLLLE

SEQ ID NO: 2801862 - protein, 19 aa, Entamoeba invadens
PQVEPNCSFQMSSTCISCD

SEQ ID NO: 2801863 - protein, 27 aa, Entamoeba invadens
PQVLYLRPRLSSMHTMTCFMTIHCTTR

SEQ ID NO: 2801864 - protein, 18 aa, Entamoeba invadens
PQYGGLYFDENNQLDYSC

SEQ ID NO: 2801865 - protein, 26 aa, Entamoeba invadens
PRALTLSRKVSFIFSSASYTNVQTEN

SEQ ID NO: 2801866 - protein, 21 aa, Entamoeba invadens
PRASLKPGQFTLVQKVAQTTT

SEQ ID NO: 2801867 - protein, 20 aa, Entamoeba invadens
PRASVCAKLSDFGTTRDITE

SEQ ID NO: 2801868 - protein, 17 aa, Entamoeba invadens
PRDACLFTIEISPTYSG

SEQ ID NO: 2801869 - protein, 20 aa, Entamoeba invadens
PRDLILPDFFFKILPHLKQS

SEQ ID NO: 2801870 - protein, 29 aa, Entamoeba invadens
PRDLLSEFFFRYEVVMSIHCQQSVVIRAR

SEQ ID NO: 2801871 - protein, 21 aa, Entamoeba invadens
PRDLWLSAIEFTKPGYWQFIK

SEQ ID NO: 2801872 - protein, 20 aa, Entamoeba invadens
PRDVVFFEDFFRTFSTDDVG

SEQ ID NO: 2801873 - protein, 22 aa, Entamoeba invadens
PRECVYRDIIKMCWHQKPEKRP

SEQ ID NO: 2801874 - protein, 23 aa, Entamoeba invadens
PREGKDFLLFILIFVSLTTLVVS

SEQ ID NO: 2801875 - protein, 28 aa, Entamoeba invadens
PRFEIITVDILKWFYAFEMLLVVANIVY

SEQ ID NO: 2801876 - protein, 21 aa, Entamoeba invadens
PRFNQPWMIPQFVIEGNRLEK

SEQ ID NO: 2801877 - protein, 20 aa, Entamoeba invadens
PRFTTNVTFGTSIPVSQVQY

SEQ ID NO: 2801878 - protein, 18 aa, Entamoeba invadens
PRGGNLFKSMALSRYYSV

SEQ ID NO: 2801879 - protein, 22 aa, Entamoeba invadens
PRGNCGGGVMVNWRCVYCDQNY

SEQ ID NO: 2801880 - protein, 19 aa, Entamoeba invadens
PRHLLSGLLYNTSGFLFWI

SEQ ID NO: 2801881 - protein, 19 aa, Entamoeba invadens
PRIISWNSTYIHLNRNYRE

SEQ ID NO: 2801882 - protein, 28 aa, Entamoeba invadens
PRIQSSRLKDVWFRKDATYHFDEKEWIR

SEQ ID NO: 2801883 - protein, 20 aa, Entamoeba invadens
PRISCSLMTIDVLDTTGEVS

SEQ ID NO: 2801884 - protein, 25 aa, Entamoeba invadens
PRKGIFKWGFLLGIFEGINVFIYKT

SEQ ID NO: 2801885 - protein, 19 aa, Entamoeba invadens
PRLHIDMEDLLKFKVVECY

SEQ ID NO: 2801886 - protein, 20 aa, Entamoeba invadens
PRLIDTDVLFLAKTNVRKIN

SEQ ID NO: 2801887 - protein, 20 aa, Entamoeba invadens
PRLIMADGMGNLVTGFKHEW

SEQ ID NO: 2801888 - protein, 19 aa, Entamoeba invadens
PRLSILDFNNEVKFKNPNI

SEQ ID NO: 2801889 - protein, 18 aa, Entamoeba invadens
PRLYCVSSTCGNKKWDKG

SEQ ID NO: 2801890 - protein, 24 aa, Entamoeba invadens
PRLYNELVEDCWKQDPGSRPTFDQ

SEQ ID NO: 2801891 - protein, 20 aa, Entamoeba invadens
PRLYTQLIENCWKQDHTKRP

SEQ ID NO: 2801892 - protein, 26 aa, Entamoeba invadens
PRPAELFFQHPNLRCIPKMNQQIVSM

SEQ ID NO: 2801893 - protein, 20 aa, Entamoeba invadens
PRPDQHVSIGCLVHGFFKQV

SEQ ID NO: 2801894 - protein, 20 aa, Entamoeba invadens
PRPTFSPPLQQMAAHKKADA

SEQ ID NO: 2801895 - protein, 23 aa, Entamoeba invadens
PRQFLSMMIVLIFVVSGRRKNYD

SEQ ID NO: 2801896 - protein, 22 aa, Entamoeba invadens
PRQSKMPGVCFKIEAVKKVMCL

SEQ ID NO: 2801897 - protein, 25 aa, Entamoeba invadens
PRSPVCAKLTDFGTCRNVSERNLAS

SEQ ID NO: 2801898 - protein, 17 aa, Entamoeba invadens
PRSRALMIDILKRQQPE

SEQ ID NO: 2801899 - protein, 17 aa, Entamoeba invadens
PRSTWLPAEEYLEEINL

SEQ ID NO: 2801900 - protein, 18 aa, Entamoeba invadens
PRTCPAVTDLICCRIPFP

SEQ ID NO: 2801901 - protein, 20 aa, Entamoeba invadens
PRTERSCVCYMTIYCTTRIR

SEQ ID NO: 2801902 - protein, 21 aa, Entamoeba invadens
PRTLRIEDVMFVLGNDKCIDL

SEQ ID NO: 2801903 - protein, 21 aa, Entamoeba invadens
PRTQKILSLRFSKKERNKNTK

SEQ ID NO: 2801904 - protein, 19 aa, Entamoeba invadens
PRTTYPNCKKFKRILDDNG

SEQ ID NO: 2801905 - protein, 19 aa, Entamoeba invadens
PRTYFKNSLIDFSLLNYKG

SEQ ID NO: 2801906 - protein, 22 aa, Entamoeba invadens
PRYYLVVIGELFYVYTSMLSEK

SEQ ID NO: 2801907 - protein, 20 aa, Entamoeba invadens
PSAVGLRLSKNFMNYNKYYI

SEQ ID NO: 2801908 - protein, 18 aa, Entamoeba invadens
PSCALRLLSTQPNYSYAT

SEQ ID NO: 2801909 - protein, 23 aa, Entamoeba invadens
PSCGMCIPNYCLYNTDNVISCVS

SEQ ID NO: 2801910 - protein, 25 aa, Entamoeba invadens
PSCTSCLPKYYLSGIYCERVIETPL

SEQ ID NO: 2801911 - protein, 18 aa, Entamoeba invadens
PSCVQAWDGYNHGVLSDE

SEQ ID NO: 2801912 - protein, 23 aa, Entamoeba invadens
PSDMPDWLFDLIAASWDQNPSQR

SEQ ID NO: 2801913 - protein, 20 aa, Entamoeba invadens
PSECPTCYNNTACMLCNNAS

SEQ ID NO: 2801914 - protein, 27 aa, Entamoeba invadens
PSEEFAFPWMIADFVFKGNRPPYREGM

SEQ ID NO: 2801915 - protein, 20 aa, Entamoeba invadens
PSEISMGFTAPKEFDHIKSG

SEQ ID NO: 2801916 - protein, 21 aa, Entamoeba invadens
PSFGCITCSDGYYFGSTAKCE

SEQ ID NO: 2801917 - protein, 18 aa, Entamoeba invadens
PSFGVGYGPDGPWTEPVS

SEQ ID NO: 2801918 - protein, 26 aa, Entamoeba invadens
PSGEACEFEILLTLKCTTRMDESKLG

SEQ ID NO: 2801919 - protein, 25 aa, Entamoeba invadens
PSGEACEFEILLTLNCTTKIDENIV

SEQ ID NO: 2801920 - protein, 25 aa, Entamoeba invadens
PSGEACEFEILLTLNCTTNINQSIM

SEQ ID NO: 2801921 - protein, 20 aa, Entamoeba invadens
PSGGCVKCTNGYFRSGLSCE

SEQ ID NO: 2801922 - protein, 24 aa, Entamoeba invadens
PSGGGCAICKTGFYKVSKDCLPCD

SEQ ID NO: 2801923 - protein, 21 aa, Entamoeba invadens
PSGHTCKNCSANCVLCYSENQ

SEQ ID NO: 2801924 - protein, 25 aa, Entamoeba invadens
PSGIGCAICKKGYYKTEKDCKECDG

SEQ ID NO: 2801925 - protein, 25 aa, Entamoeba invadens
PSGIGCAICKMGYYKTEKDCNECDS

SEQ ID NO: 2801926 - protein, 24 aa, Entamoeba invadens
PSGKCIDCAYGHFLDEEYGKCVES

SEQ ID NO: 2801927 - protein, 19 aa, Entamoeba invadens
PSIESSVFSKCVEILILKI

SEQ ID NO: 2801928 - protein, 20 aa, Entamoeba invadens
PSIIGVSGAVVYPPYYQDPL

SEQ ID NO: 2801929 - protein, 22 aa, Entamoeba invadens
PSIKGVSGAVVYPPYYQDPLKV

SEQ ID NO: 2801930 - protein, 26 aa, Entamoeba invadens
PSISKILCKKCESLSTFIKELFASLD

SEQ ID NO: 2801931 - protein, 23 aa, Entamoeba invadens
PSIVLEYAKYCSVGKLIDSETSI

SEQ ID NO: 2801932 - protein, 24 aa, Entamoeba invadens
PSKEVMIAIGMLFELHCLSVERWL

SEQ ID NO: 2801933 - protein, 17 aa, Entamoeba invadens
PSKFADVMYGWMKDSIV

SEQ ID NO: 2801934 - protein, 17 aa, Entamoeba invadens
PSKVCVFCKTFDNKCET

SEQ ID NO: 2801935 - protein, 18 aa, Entamoeba invadens
PSLFRSLIRVEWKSFLFC

SEQ ID NO: 2801936 - protein, 37 aa, Entamoeba invadens
PSLISSLWGIVVFKEIFGWRNFMFFAAGTLVLFVGII

SEQ ID NO: 2801937 - protein, 19 aa, Entamoeba invadens
PSLLLLVACLKEIPTTVLK

SEQ ID NO: 2801938 - protein, 19 aa, Entamoeba invadens
PSLLMVFGLIFSFLGDLLL

SEQ ID NO: 2801939 - protein, 18 aa, Entamoeba invadens
PSLLRALFRMEWKQLLLC

SEQ ID NO: 2801940 - protein, 22 aa, Entamoeba invadens
PSLPDKSCVELFDFFSENVQKN

SEQ ID NO: 2801941 - protein, 22 aa, Entamoeba invadens
PSLPSFFIAAIVKFLTGCKVIV

SEQ ID NO: 2801942 - protein, 21 aa, Entamoeba invadens
PSLQRRAFFNKRATQHQSIDG

SEQ ID NO: 2801943 - protein, 18 aa, Entamoeba invadens
PSLTCIKCNTFDTDCVTC

SEQ ID NO: 2801944 - protein, 17 aa, Entamoeba invadens
PSLYMGLLSIDYTFNPL

SEQ ID NO: 2801945 - protein, 18 aa, Entamoeba invadens
PSMAACWDGKEIASNASM

SEQ ID NO: 2801946 - protein, 18 aa, Entamoeba invadens
PSMWYDSEFETKFEVPSF

SEQ ID NO: 2801947 - protein, 24 aa, Entamoeba invadens
PSNCVSCPYSYFNSNGYCVKCDSS

SEQ ID NO: 2801948 - protein, 32 aa, Entamoeba invadens
PSNDGSYCVYHIKWWLLLVLILFIITVSIFII

SEQ ID NO: 2801949 - protein, 19 aa, Entamoeba invadens
PSNGFKAIFTHPLLFSIVF

SEQ ID NO: 2801950 - protein, 25 aa, Entamoeba invadens
PSPFLKGCEPFCGVCRDGFVCSSQG

SEQ ID NO: 2801951 - protein, 17 aa, Entamoeba invadens
PSQCISCTMYSQCTACK

SEQ ID NO: 2801952 - protein, 17 aa, Entamoeba invadens
PSQLSWKNVSERYQGNG

SEQ ID NO: 2801953 - protein, 20 aa, Entamoeba invadens
PSRNRVKVQFTFKKNEDRKF

SEQ ID NO: 2801954 - protein, 25 aa, Entamoeba invadens
PSSESFKGLVEYIANVFGGIVMLHD

SEQ ID NO: 2801955 - protein, 21 aa, Entamoeba invadens
PSSHTQFWSCFLLLLQYYINS

SEQ ID NO: 2801956 - protein, 16 aa, Entamoeba invadens
PSSIWSMCCSVVEVDY

SEQ ID NO: 2801957 - protein, 20 aa, Entamoeba invadens
PSSKFYYFIVVAIIKEYADD

SEQ ID NO: 2801958 - protein, 21 aa, Entamoeba invadens
PSSLINNRIECVFKDSEYNGF

SEQ ID NO: 2801959 - protein, 17 aa, Entamoeba invadens
PSSPFSCIDCHSSCSSG

SEQ ID NO: 2801960 - protein, 17 aa, Entamoeba invadens
PSSPFSCIDCHSSCSSK

SEQ ID NO: 2801961 - protein, 18 aa, Entamoeba invadens
PSSPFSCIDCHTSCSSGC

SEQ ID NO: 2801962 - protein, 22 aa, Entamoeba invadens
PSSPFSCMYCHLSCSNGCSTTT

SEQ ID NO: 2801963 - protein, 22 aa, Entamoeba invadens
PSSWGTFYFDLHIICFLIPLGI

SEQ ID NO: 2801964 - protein, 22 aa, Entamoeba invadens
PSSWPSTGSVEFSDFKFRYRRG

SEQ ID NO: 2801965 - protein, 17 aa, Entamoeba invadens
PSTFYLEFFPQFVRMPT

SEQ ID NO: 2801966 - protein, 24 aa, Entamoeba invadens
PSTGDCTLCIFGYELVDKNCQICG

SEQ ID NO: 2801967 - protein, 22 aa, Entamoeba invadens
PSTMPEWYYIIVNKCWQTNPLD

SEQ ID NO: 2801968 - protein, 18 aa, Entamoeba invadens
PSTQCLYYSISNCENCQY

SEQ ID NO: 2801969 - protein, 20 aa, Entamoeba invadens
PSVCSSCYDGLYLNSDSECD

SEQ ID NO: 2801970 - protein, 25 aa, Entamoeba invadens
PSVFLFKANTNFSFNSVDNCQSALV

SEQ ID NO: 2801971 - protein, 33 aa, Entamoeba invadens
PSVILGGAAPIMFVCVFIALGIFVRIWCLIPLG

SEQ ID NO: 2801972 - protein, 19 aa, Entamoeba invadens
PSYAREFFKTSTYPPPFTH

SEQ ID NO: 2801973 - protein, 24 aa, Entamoeba invadens
PTAICGTLSWMAPEALLNKPYGTK

SEQ ID NO: 2801974 - protein, 30 aa, Entamoeba invadens
PTCAGIIRYIPRNWKFMQIWNGTLSILVIR

SEQ ID NO: 2801975 - protein, 31 aa, Entamoeba invadens
PTCAGIIRYIPRNWKFMQIWNGTLSILVIRI

SEQ ID NO: 2801976 - protein, 18 aa, Entamoeba invadens
PTCANPYGLVGFYEKTNC

SEQ ID NO: 2801977 - protein, 27 aa, Entamoeba invadens
PTCDFSFKDLYFFVSFCSNAICVVALF

SEQ ID NO: 2801978 - protein, 18 aa, Entamoeba invadens
PTDIAEIVFSYAENGIRG

SEQ ID NO: 2801979 - protein, 22 aa, Entamoeba invadens
PTDQFCSMDDFFGTDSNQHSDE

SEQ ID NO: 2801980 - protein, 19 aa, Entamoeba invadens
PTDSSCVIFNYSLMHQHNM

SEQ ID NO: 2801981 - protein, 24 aa, Entamoeba invadens
PTDYAGLIQSCWKQEGSERPTFDQ

SEQ ID NO: 2801982 - protein, 18 aa, Entamoeba invadens
PTECYAIIQSCWDQNPKE

SEQ ID NO: 2801983 - protein, 19 aa, Entamoeba invadens
PTEKIVLAMYYFPSQTQVE

SEQ ID NO: 2801984 - protein, 19 aa, Entamoeba invadens
PTESHFLAPTLKRLISAFF

SEQ ID NO: 2801985 - protein, 23 aa, Entamoeba invadens
PTESKFISAFIVDIEITKVNKKL

SEQ ID NO: 2801986 - protein, 36 aa, Entamoeba invadens
PTETACLSNKCGWCGTTQTCGYCEDGGEFCTHDGAE

SEQ ID NO: 2801987 - protein, 27 aa, Entamoeba invadens
PTFNGKWWPSGVLDFFTMAPFITANYQ

SEQ ID NO: 2801988 - protein, 25 aa, Entamoeba invadens
PTFSVFFEFFGLFLTYIGSNVLQVV

SEQ ID NO: 2801989 - protein, 21 aa, Entamoeba invadens
PTFYLLLIVAVSFASLPQVVT

SEQ ID NO: 2801990 - protein, 25 aa, Entamoeba invadens
PTGGGCAICKVGYYKVEKDCNECDK

SEQ ID NO: 2801991 - protein, 19 aa, Entamoeba invadens
PTGKCLFGSAYCDEYCHCE

SEQ ID NO: 2801992 - protein, 19 aa, Entamoeba invadens
PTGNVIPVVMCTMISSRYQ

SEQ ID NO: 2801993 - protein, 29 aa, Entamoeba invadens
PTGRFTTLFPLCIVLTISMLKELYEDIKR

SEQ ID NO: 2801994 - protein, 19 aa, Entamoeba invadens
PTHCSACITDFVLENTTIY

SEQ ID NO: 2801995 - protein, 19 aa, Entamoeba invadens
PTIFFNNRGLHLFSNIDQR

SEQ ID NO: 2801996 - protein, 23 aa, Entamoeba invadens
PTIFHWIASFVFRMERKNVLIDG

SEQ ID NO: 2801997 - protein, 23 aa, Entamoeba invadens
PTIFKVSIILYVAFFVNVIFVIL

SEQ ID NO: 2801998 - protein, 25 aa, Entamoeba invadens
PTIQRLIHRIPYLDRVMAFFYKNYN

SEQ ID NO: 2801999 - protein, 17 aa, Entamoeba invadens
PTIVNSIIFLVSNVINA

SEQ ID NO: 2802000 - protein, 19 aa, Entamoeba invadens
PTKASGFFVGPFIMEMGGV

SEQ ID NO: 2802001 - protein, 18 aa, Entamoeba invadens
PTKDFKTTSVLLIQAISN

SEQ ID NO: 2802002 - protein, 25 aa, Entamoeba invadens
PTKSECAICSKSYFRNGTSCSKCID

SEQ ID NO: 2802003 - protein, 22 aa, Entamoeba invadens
PTKVKCGFVAQEMQEVLPDLVQ

SEQ ID NO: 2802004 - protein, 24 aa, Entamoeba invadens
PTKVKCGFVAQEMQEVLPDLVQKD

SEQ ID NO: 2802005 - protein, 18 aa, Entamoeba invadens
PTKYCTICKDGFTFNSTD

SEQ ID NO: 2802006 - protein, 17 aa, Entamoeba invadens
PTLDICIYIPSTKCILN

SEQ ID NO: 2802007 - protein, 25 aa, Entamoeba invadens
PTLILICILLLFSIIVLPIICCCCG

SEQ ID NO: 2802008 - protein, 22 aa, Entamoeba invadens
PTLKFCGGGYVFFDNILDPNFH

SEQ ID NO: 2802009 - protein, 25 aa, Entamoeba invadens
PTLKKRCEMSAEVLAVLRSKRREDA

SEQ ID NO: 2802010 - protein, 20 aa, Entamoeba invadens
PTLPEITGETALLLTQEKLE

SEQ ID NO: 2802011 - protein, 17 aa, Entamoeba invadens
PTLPYKTEFLGVLIKAS

SEQ ID NO: 2802012 - protein, 27 aa, Entamoeba invadens
PTLQELRAMNWLSFIGGAKGVFYYSYF

SEQ ID NO: 2802013 - protein, 26 aa, Entamoeba invadens
PTLQELRVMSWLGFIGGAKGVFYYSY

SEQ ID NO: 2802014 - protein, 25 aa, Entamoeba invadens
PTLSIKRMSDFIFLLYGVFLLLYSV

SEQ ID NO: 2802015 - protein, 20 aa, Entamoeba invadens
PTLVGVVFTLFALMFGAPGV

SEQ ID NO: 2802016 - protein, 23 aa, Entamoeba invadens
PTNPNTCLECYIGFFLEGTSCNT

SEQ ID NO: 2802017 - protein, 25 aa, Entamoeba invadens
PTNQCKRISLVIGCSSEVDKNFGCT

SEQ ID NO: 2802018 - protein, 18 aa, Entamoeba invadens
PTNYCITCQFGYTYNSTD

SEQ ID NO: 2802019 - protein, 22 aa, Entamoeba invadens
PTPIPYKAGCSLYLGADPNTSI

SEQ ID NO: 2802020 - protein, 23 aa, Entamoeba invadens
PTPKMKIKFMLDLARGVEYLHNN

SEQ ID NO: 2802021 - protein, 18 aa, Entamoeba invadens
PTPLKMLTLTGVDKNSPL

SEQ ID NO: 2802022 - protein, 21 aa, Entamoeba invadens
PTPQPHCAFSVKSRCITCESG

SEQ ID NO: 2802023 - protein, 26 aa, Entamoeba invadens
PTQFPFFCAFSFLLIGGGKVVLCIDY

SEQ ID NO: 2802024 - protein, 22 aa, Entamoeba invadens
PTQLKSLFPERSLKEKLAKKNG

SEQ ID NO: 2802025 - protein, 17 aa, Entamoeba invadens
PTSAYACTKDDECDPSN

SEQ ID NO: 2802026 - protein, 19 aa, Entamoeba invadens
PTSCLVARNNFCFECKDTY

SEQ ID NO: 2802027 - protein, 18 aa, Entamoeba invadens
PTSFDWKIIVDNYREISA

SEQ ID NO: 2802028 - protein, 21 aa, Entamoeba invadens
PTSKRAGCLVSNCVSCMDSNF

SEQ ID NO: 2802029 - protein, 21 aa, Entamoeba invadens
PTSSCVESLFSFYRYANKINM

SEQ ID NO: 2802030 - protein, 27 aa, Entamoeba invadens
PTTFCPKCEQLMCGICLEEGVKKFGVC

SEQ ID NO: 2802031 - protein, 17 aa, Entamoeba invadens
PTTIKRRIDLISEVNTE

SEQ ID NO: 2802032 - protein, 17 aa, Entamoeba invadens
PTTLSIGSLKYIWVQSD

SEQ ID NO: 2802033 - protein, 21 aa, Entamoeba invadens
PTTSMWWISASVMVFLIFVAL

SEQ ID NO: 2802034 - protein, 28 aa, Entamoeba invadens
PTVHSCFVIGFKLCLPQLLSFFQIVELL

SEQ ID NO: 2802035 - protein, 34 aa, Entamoeba invadens
PTWLLAFICAPSFLFCVLTLYFGIATDLITVIVA

SEQ ID NO: 2802036 - protein, 17 aa, Entamoeba invadens
PTYPRNVSFPKIPDEYN

SEQ ID NO: 2802037 - protein, 26 aa, Entamoeba invadens
PTYYSTKSGDSWNLLERCSDENVNRL

SEQ ID NO: 2802038 - protein, 20 aa, Entamoeba invadens
PVAGRLPGHMNVLLAEASVP

SEQ ID NO: 2802039 - protein, 24 aa, Entamoeba invadens
PVCERNGFKRFLAFLDGEDLANVM

SEQ ID NO: 2802040 - protein, 23 aa, Entamoeba invadens
PVCGEKGQIQRWMKLDTLTKPVD

SEQ ID NO: 2802041 - protein, 20 aa, Entamoeba invadens
PVCRVSATMARYVLTTQSII

SEQ ID NO: 2802042 - protein, 18 aa, Entamoeba invadens
PVCTSCYSPYVLAFQTKT

SEQ ID NO: 2802043 - protein, 18 aa, Entamoeba invadens
PVCTTCYSPYVLASQTKT

SEQ ID NO: 2802044 - protein, 19 aa, Entamoeba invadens
PVCYTLFALHFFTPQFKTM

SEQ ID NO: 2802045 - protein, 27 aa, Entamoeba invadens
PVEMIDLYGADALRLSLINSPAVRAET

SEQ ID NO: 2802046 - protein, 24 aa, Entamoeba invadens
PVFKDILIQFTMFFATRSELKSEF

SEQ ID NO: 2802047 - protein, 19 aa, Entamoeba invadens
PVGKESRDLICIGNISKYE

SEQ ID NO: 2802048 - protein, 18 aa, Entamoeba invadens
PVGKYKKHDFVFKIVTPS

SEQ ID NO: 2802049 - protein, 21 aa, Entamoeba invadens
PVKKLITMCWSQNPQNRPDFR

SEQ ID NO: 2802050 - protein, 17 aa, Entamoeba invadens
PVLESCSQRMCYEERYA

SEQ ID NO: 2802051 - protein, 17 aa, Entamoeba invadens
PVLKESRELLCVGNYSQ

SEQ ID NO: 2802052 - protein, 18 aa, Entamoeba invadens
PVLYTSVGTLAFVSDTLT

SEQ ID NO: 2802053 - protein, 17 aa, Entamoeba invadens
PVMDMSKVWLLLSESLS

SEQ ID NO: 2802054 - protein, 24 aa, Entamoeba invadens
PVMYKYYTTHLFNAPSKYTDYFIN

SEQ ID NO: 2802055 - protein, 28 aa, Entamoeba invadens
PVNAAMKIRCCLDVAKGMAYLHNNNVTH

SEQ ID NO: 2802056 - protein, 18 aa, Entamoeba invadens
PVNRYFVWTPYLNVSGIS

SEQ ID NO: 2802057 - protein, 25 aa, Entamoeba invadens
PVQKAGDVVFVLKIGVDTVGNIEAE

SEQ ID NO: 2802058 - protein, 17 aa, Entamoeba invadens
PVSTLFVEHFFDCICDG

SEQ ID NO: 2802059 - protein, 23 aa, Entamoeba invadens
PVTQRVSVVVLFLALLVQIATVM

SEQ ID NO: 2802060 - protein, 17 aa, Entamoeba invadens
PVVFAAVPRVLQLIYTG

SEQ ID NO: 2802061 - protein, 19 aa, Entamoeba invadens
PVVGLFVLFVHFTKKGSRL

SEQ ID NO: 2802062 - protein, 18 aa, Entamoeba invadens
PVVLVFMLILLIISIIVV

SEQ ID NO: 2802063 - protein, 26 aa, Entamoeba invadens
PVVQVKAAKCFYEIWKKEERVPLNMD

SEQ ID NO: 2802064 - protein, 20 aa, Entamoeba invadens
PVVVSCWFLNLFRTKKTKLI

SEQ ID NO: 2802065 - protein, 18 aa, Entamoeba invadens
PWDVADFVTSGKRLPQPD

SEQ ID NO: 2802066 - protein, 18 aa, Entamoeba invadens
PWDVAKFVVEGKRLPRKE

SEQ ID NO: 2802067 - protein, 26 aa, Entamoeba invadens
PWMLFFSFLCCAGIGMLGTCLYSIPF

SEQ ID NO: 2802068 - protein, 17 aa, Entamoeba invadens
PWNVATFVSDGRRQPKL

SEQ ID NO: 2802069 - protein, 25 aa, Entamoeba invadens
PWYVTLLRRFIRAEVSQFATTPRRK

SEQ ID NO: 2802070 - protein, 18 aa, Entamoeba invadens
PYAAVILDRMFEMATLIP

SEQ ID NO: 2802071 - protein, 19 aa, Entamoeba invadens
PYADFKSLFEIQNFVKDGK

SEQ ID NO: 2802072 - protein, 18 aa, Entamoeba invadens
PYASITFEELVQYEDDST

SEQ ID NO: 2802073 - protein, 18 aa, Entamoeba invadens
PYCPCDSVNCYITPLENI

SEQ ID NO: 2802074 - protein, 17 aa, Entamoeba invadens
PYCPCKGEKCYITPLED

SEQ ID NO: 2802075 - protein, 24 aa, Entamoeba invadens
PYCSEHLCEWIDLIFGSKQRGKAA

SEQ ID NO: 2802076 - protein, 18 aa, Entamoeba invadens
PYDADLLYVLSAFLRRVD

SEQ ID NO: 2802077 - protein, 23 aa, Entamoeba invadens
PYEKPRLGCLSTLCGNKELDDDE

SEQ ID NO: 2802078 - protein, 17 aa, Entamoeba invadens
PYEYGVIAVNFEYKEGP

SEQ ID NO: 2802079 - protein, 27 aa, Entamoeba invadens
PYGSKLFGYKSFVCYYCAAGEVIKCDD

SEQ ID NO: 2802080 - protein, 17 aa, Entamoeba invadens
PYIRGVIETVDYEKYSN

SEQ ID NO: 2802081 - protein, 17 aa, Entamoeba invadens
PYIYLEITQTGKLNQLY

SEQ ID NO: 2802082 - protein, 18 aa, Entamoeba invadens
PYNDWGFNALPNWVDTKM

SEQ ID NO: 2802083 - protein, 29 aa, Entamoeba invadens
PYNKVDFKFLWKIAEFVISGKGLPNKEII

SEQ ID NO: 2802084 - protein, 29 aa, Entamoeba invadens
PYPEEKFKFPWKIAEIISSGKRLKRIDSI

SEQ ID NO: 2802085 - protein, 25 aa, Entamoeba invadens
PYQGSCFKYPWNIANYVVEGKRLEK

SEQ ID NO: 2802086 - protein, 18 aa, Entamoeba invadens
PYQKSILYLSAIELFMME

SEQ ID NO: 2802087 - protein, 21 aa, Entamoeba invadens
PYRRATYRYTPLLAEMLIPDV

SEQ ID NO: 2802088 - protein, 23 aa, Entamoeba invadens
PYSIFCVLRIFDVFECKKSFRIL

SEQ ID NO: 2802089 - protein, 18 aa, Entamoeba invadens
PYTASLRSFFAYFKHNNM

SEQ ID NO: 2802090 - protein, 18 aa, Entamoeba invadens
PYTCGLCKEGYDNDNSCL

SEQ ID NO: 2802091 - protein, 21 aa, Entamoeba invadens
PYTYMHMKLFDGHFDTERLIG

SEQ ID NO: 2802092 - protein, 27 aa, Entamoeba invadens
PYVGLSIIRFFLGLGIGGEYPLSSTIT

SEQ ID NO: 2802093 - protein, 17 aa, Entamoeba invadens
PYVGYLFSSNSSEITTQ

SEQ ID NO: 2802094 - protein, 24 aa, Entamoeba invadens
PYVIRFYGACFIPNKICMVTELAK

SEQ ID NO: 2802095 - protein, 20 aa, Entamoeba invadens
PYYFSFTLQNLFSKVLLFTF

SEQ ID NO: 2802096 - protein, 25 aa, Entamoeba invadens
QAAAFHAALVFGIFAMIFAIVYMII

SEQ ID NO: 2802097 - protein, 18 aa, Entamoeba invadens
QAAEICLVLTTFCGPDIV

SEQ ID NO: 2802098 - protein, 20 aa, Entamoeba invadens
QAAIKGLGLKPVISATPSYY

SEQ ID NO: 2802099 - protein, 22 aa, Entamoeba invadens
QACEFKFTIIPKCTCAIKQDVS

SEQ ID NO: 2802100 - protein, 17 aa, Entamoeba invadens
QADGCFDLFGYIYSYEL

SEQ ID NO: 2802101 - protein, 28 aa, Entamoeba invadens
QADLRIPLRPQTFFEIMTSRNALTSITT

SEQ ID NO: 2802102 - protein, 25 aa, Entamoeba invadens
QADTCLLCGLGYHLNGKDQCEKNSV

SEQ ID NO: 2802103 - protein, 20 aa, Entamoeba invadens
QAEMFINMCVPNIGENDRIA

SEQ ID NO: 2802104 - protein, 29 aa, Entamoeba invadens
QAFFWSIFFCMVLSYPFDFVLAVITKIDS

SEQ ID NO: 2802105 - protein, 23 aa, Entamoeba invadens
QAGKCYKKRAAVDPVDPPKPVEP

SEQ ID NO: 2802106 - protein, 23 aa, Entamoeba invadens
QAGKCYKKRAAVDPVDPPKTVEP

SEQ ID NO: 2802107 - protein, 18 aa, Entamoeba invadens
QAHCPYDNVEIVTSLKQV

SEQ ID NO: 2802108 - protein, 23 aa, Entamoeba invadens
QAHCPYPNVEIITSLSRVVIGNY

SEQ ID NO: 2802109 - protein, 17 aa, Entamoeba invadens
QAHPKCQRIGRLTTSEG

SEQ ID NO: 2802110 - protein, 24 aa, Entamoeba invadens
QAIKLDLYLSPSLIQLNSILTNTP

SEQ ID NO: 2802111 - protein, 17 aa, Entamoeba invadens
QAITFWTKVCERQDGNE

SEQ ID NO: 2802112 - protein, 21 aa, Entamoeba invadens
QAKIGLRLRQPIQFASFTSCP

SEQ ID NO: 2802113 - protein, 17 aa, Entamoeba invadens
QAKSSAVSFELQMNSPR

SEQ ID NO: 2802114 - protein, 24 aa, Entamoeba invadens
QALKWYELFLPRYFDYHFTVTEAM

SEQ ID NO: 2802115 - protein, 17 aa, Entamoeba invadens
QALTIKPVHFNWIVVFI

SEQ ID NO: 2802116 - protein, 25 aa, Entamoeba invadens
QAQTDLIGCFSFQVDGCETCLPNYY

SEQ ID NO: 2802117 - protein, 24 aa, Entamoeba invadens
QARCTEMGRLIFSCYLMENTGATL

SEQ ID NO: 2802118 - protein, 24 aa, Entamoeba invadens
QASKCCYELCTFYSSLDGTDEDTK

SEQ ID NO: 2802119 - protein, 25 aa, Entamoeba invadens
QAVLNVKIGFIWKVLFVNYVIPNLI

SEQ ID NO: 2802120 - protein, 20 aa, Entamoeba invadens
QAYFCVADPYCLKCDTTTGK

SEQ ID NO: 2802121 - protein, 17 aa, Entamoeba invadens
QCADGFYNYQNSVNCGL

SEQ ID NO: 2802122 - protein, 17 aa, Entamoeba invadens
QCADGFYQTDSVNIEGK

SEQ ID NO: 2802123 - protein, 17 aa, Entamoeba invadens
QCAEGFYLIDSLNNEGK

SEQ ID NO: 2802124 - protein, 25 aa, Entamoeba invadens
QCAEGYFLKDGRCVPCGADCIECGQ

SEQ ID NO: 2802125 - protein, 18 aa, Entamoeba invadens
QCEKCPLGTFTDSNGKDN

SEQ ID NO: 2802126 - protein, 18 aa, Entamoeba invadens
QCERGFTFLEGRTCVNKS

SEQ ID NO: 2802127 - protein, 24 aa, Entamoeba invadens
QCESCTKSNCEICTVYNGDCMKCS

SEQ ID NO: 2802128 - protein, 28 aa, Entamoeba invadens
QCFNCPFGCDSCDAMQCFSCYDEYVFIN

SEQ ID NO: 2802129 - protein, 28 aa, Entamoeba invadens
QCGHMFCWECLREWLDRQQTCPICKSRV

SEQ ID NO: 2802130 - protein, 21 aa, Entamoeba invadens
QCGICNGFGIAGSGYPANMLI

SEQ ID NO: 2802131 - protein, 21 aa, Entamoeba invadens
QCGICNGFGIAGSSYPAYMVI

SEQ ID NO: 2802132 - protein, 20 aa, Entamoeba invadens
QCGSCKIPHICLTCNETNFM

SEQ ID NO: 2802133 - protein, 21 aa, Entamoeba invadens
QCGSSARLLFNDMKRDEFYVM

SEQ ID NO: 2802134 - protein, 17 aa, Entamoeba invadens
QCIECLDSFKLKNGNCS

SEQ ID NO: 2802135 - protein, 19 aa, Entamoeba invadens
QCILCQSGYVLKNKKCVNT

SEQ ID NO: 2802136 - protein, 22 aa, Entamoeba invadens
QCIPCGVGCFSCTSDGCLACNT

SEQ ID NO: 2802137 - protein, 21 aa, Entamoeba invadens
QCIPCGVGCFSCTSGGCSACN

SEQ ID NO: 2802138 - protein, 17 aa, Entamoeba invadens
QCISCTMYSQCTACKDG

SEQ ID NO: 2802139 - protein, 28 aa, Entamoeba invadens
QCKDGYYRVGLNCFECLLNCSTCNTKDK

SEQ ID NO: 2802140 - protein, 17 aa, Entamoeba invadens
QCKDGYYRVGLNCYECF

SEQ ID NO: 2802141 - protein, 21 aa, Entamoeba invadens
QCKEPAYAFDCHSCGDGFYMD

SEQ ID NO: 2802142 - protein, 24 aa, Entamoeba invadens
QCKHVMKYKCNYRSGEVVMYNPKS

SEQ ID NO: 2802143 - protein, 23 aa, Entamoeba invadens
QCKNDCLFCYNTTYCTTCRSGFY

SEQ ID NO: 2802144 - protein, 24 aa, Entamoeba invadens
QCLDALDFTAKVALIAYDDTIHLF

SEQ ID NO: 2802145 - protein, 24 aa, Entamoeba invadens
QCLHFTKVKFCVSALNSRCVKCEG

SEQ ID NO: 2802146 - protein, 23 aa, Entamoeba invadens
QCMKCEVNGCKKCVSENPYKCYE

SEQ ID NO: 2802147 - protein, 26 aa, Entamoeba invadens
QCNTASGWNRYFIKAQTAGSLCTCTA

SEQ ID NO: 2802148 - protein, 17 aa, Entamoeba invadens
QCQKCQHTNCAKCTFDD

SEQ ID NO: 2802149 - protein, 19 aa, Entamoeba invadens
QCRKVNDKYSRCTNDPKIT

SEQ ID NO: 2802150 - protein, 26 aa, Entamoeba invadens
QCRPTCGTCFDVFKCSTSGKCVNEKV

SEQ ID NO: 2802151 - protein, 19 aa, Entamoeba invadens
QCSDGYYLQGYSLGFQSCG

SEQ ID NO: 2802152 - protein, 23 aa, Entamoeba invadens
QCSECSVGFMIDKSKSCSKILTS

SEQ ID NO: 2802153 - protein, 18 aa, Entamoeba invadens
QCSNVVFFFADDRIINGI

SEQ ID NO: 2802154 - protein, 17 aa, Entamoeba invadens
QCSQTLGCMSCIHGYSV

SEQ ID NO: 2802155 - protein, 17 aa, Entamoeba invadens
QCSRLGAVLDMVTDRAG

SEQ ID NO: 2802156 - protein, 26 aa, Entamoeba invadens
QCSSSKCTNCIFGFYLENGECKPCSS

SEQ ID NO: 2802157 - protein, 26 aa, Entamoeba invadens
QCSSSKCTNCIFGFYLENSECKPCYS

SEQ ID NO: 2802158 - protein, 20 aa, Entamoeba invadens
QCTKCDEGFVLNKGECQTKD

SEQ ID NO: 2802159 - protein, 18 aa, Entamoeba invadens
QCTKCEFWNSPNFEKKYC

SEQ ID NO: 2802160 - protein, 25 aa, Entamoeba invadens
QCTLCGENQYSLGYTSPCFPCPIDC

SEQ ID NO: 2802161 - protein, 20 aa, Entamoeba invadens
QCTLKIKSEVLIVSKNLQTN

SEQ ID NO: 2802162 - protein, 18 aa, Entamoeba invadens
QCTPCQIGSYSSSSGSDS

SEQ ID NO: 2802163 - protein, 17 aa, Entamoeba invadens
QCVDGYLLNDGNCEEDA

SEQ ID NO: 2802164 - protein, 17 aa, Entamoeba invadens
QCVFLLINKDFLLPTVF

SEQ ID NO: 2802165 - protein, 18 aa, Entamoeba invadens
QCVQCDWSCGGACADVTG

SEQ ID NO: 2802166 - protein, 21 aa, Entamoeba invadens
QCVYGVECLTGYYNTTTKKCE

SEQ ID NO: 2802167 - protein, 21 aa, Entamoeba invadens
QCVYKRLLGCETYDREKQTCT

SEQ ID NO: 2802168 - protein, 23 aa, Entamoeba invadens
QDAMIIMQRIFRNDCNHDDYLSE

SEQ ID NO: 2802169 - protein, 19 aa, Entamoeba invadens
QDASKRFFAFKEYIQNNTE

SEQ ID NO: 2802170 - protein, 25 aa, Entamoeba invadens
QDAVVFRFIAFRDYITKHIKEIDRV

SEQ ID NO: 2802171 - protein, 25 aa, Entamoeba invadens
QDAVVFRFIAFRNYITKHIKEIDRV

SEQ ID NO: 2802172 - protein, 23 aa, Entamoeba invadens
QDCSLFEALGSFLGLLTLGLNKP

SEQ ID NO: 2802173 - protein, 22 aa, Entamoeba invadens
QDDYKCFVSDVIPLMIAVNQTT

SEQ ID NO: 2802174 - protein, 18 aa, Entamoeba invadens
QDECYTCEANYYLHATKT

SEQ ID NO: 2802175 - protein, 18 aa, Entamoeba invadens
QDESCFNFSIKTCENCSK

SEQ ID NO: 2802176 - protein, 17 aa, Entamoeba invadens
QDFKHLFLLGTFSYPNK

SEQ ID NO: 2802177 - protein, 19 aa, Entamoeba invadens
QDFLVDVVVDKCKKCFFKG

SEQ ID NO: 2802178 - protein, 22 aa, Entamoeba invadens
QDFPTPFPPYVFPSSQNEKSNK

SEQ ID NO: 2802179 - protein, 18 aa, Entamoeba invadens
QDFTCILGSVIVGLALGV

SEQ ID NO: 2802180 - protein, 27 aa, Entamoeba invadens
QDGRALRLLVPFTWYSMDYVDDAKELL

SEQ ID NO: 2802181 - protein, 17 aa, Entamoeba invadens
QDGWPLQVGPMMGKVVV

SEQ ID NO: 2802182 - protein, 17 aa, Entamoeba invadens
QDHFKCEDALVLQGITS

SEQ ID NO: 2802183 - protein, 24 aa, Entamoeba invadens
QDINMKLRIKFVLDASKGLLYLHE

SEQ ID NO: 2802184 - protein, 22 aa, Entamoeba invadens
QDKCNLCATNFVLINSICKSFD

SEQ ID NO: 2802185 - protein, 17 aa, Entamoeba invadens
QDKCSKCDIGYLLVDGE

SEQ ID NO: 2802186 - protein, 25 aa, Entamoeba invadens
QDKHMYRLHFLKMTNECISYLPQSV

SEQ ID NO: 2802187 - protein, 18 aa, Entamoeba invadens
QDKLEINSLFVLKDNSNG

SEQ ID NO: 2802188 - protein, 18 aa, Entamoeba invadens
QDKLEINSLFVLKDNSNV

SEQ ID NO: 2802189 - protein, 23 aa, Entamoeba invadens
QDKSLPCSITILAILSTALGFVG

SEQ ID NO: 2802190 - protein, 23 aa, Entamoeba invadens
QDKVPYEYKWRNLVTTGEDTVLS

SEQ ID NO: 2802191 - protein, 21 aa, Entamoeba invadens
QDLLSEFGYFVEIEKENVDGF

SEQ ID NO: 2802192 - protein, 18 aa, Entamoeba invadens
QDNECVFITPSLETTTKG

SEQ ID NO: 2802193 - protein, 20 aa, Entamoeba invadens
QDNFVAFTFFVLYSAQTIAF

SEQ ID NO: 2802194 - protein, 25 aa, Entamoeba invadens
QDNLMVAVLVKWELIVEESLTFNID

SEQ ID NO: 2802195 - protein, 33 aa, Entamoeba invadens
QDPLKVLGLLKNEWKSSCDKMKLTFDTSPTPPT

SEQ ID NO: 2802196 - protein, 22 aa, Entamoeba invadens
QDPMVAHAIAQNTTYNFPTTPD

SEQ ID NO: 2802197 - protein, 28 aa, Entamoeba invadens
QDPNKRPTFEVIDEFLLKFFDEQLQKHK

SEQ ID NO: 2802198 - protein, 17 aa, Entamoeba invadens
QDPNYRPSINSVVEKLY

SEQ ID NO: 2802199 - protein, 19 aa, Entamoeba invadens
QDPPRRKTYIPSDYNTSFI

SEQ ID NO: 2802200 - protein, 33 aa, Entamoeba invadens
QDQLRLFITNSFLKKKLSVFPCLSAKVEEFLNS

SEQ ID NO: 2802201 - protein, 18 aa, Entamoeba invadens
QDRAFDFIDDVVVNFSKL

SEQ ID NO: 2802202 - protein, 30 aa, Entamoeba invadens
QDRCTKCAVTYRFETNPSFTSKGSPICVSD

SEQ ID NO: 2802203 - protein, 18 aa, Entamoeba invadens
QDTNCLQCTSDEDNQCVL

SEQ ID NO: 2802204 - protein, 20 aa, Entamoeba invadens
QDVCLICSSLYTLQNNSCVI

SEQ ID NO: 2802205 - protein, 19 aa, Entamoeba invadens
QDVPLCISKPVHSYIPNIF

SEQ ID NO: 2802206 - protein, 23 aa, Entamoeba invadens
QDYADIYVGIWIDCKSSTVCTKE

SEQ ID NO: 2802207 - protein, 28 aa, Entamoeba invadens
QDYLKLPYKLKVRMLFDTSKGMQFLHEN

SEQ ID NO: 2802208 - protein, 25 aa, Entamoeba invadens
QDYRAEITMALSIICPNDCNEESGF

SEQ ID NO: 2802209 - protein, 25 aa, Entamoeba invadens
QDYYSEILFTYQVICPNNCYAENGQ

SEQ ID NO: 2802210 - protein, 22 aa, Entamoeba invadens
QEAPNWYLLVPLIVLVLVGLGV

SEQ ID NO: 2802211 - protein, 22 aa, Entamoeba invadens
QEAPNWYLLVPLIVLVLVGLNV

SEQ ID NO: 2802212 - protein, 22 aa, Entamoeba invadens
QEAYSWSTYLFIFQGILILAMS

SEQ ID NO: 2802213 - protein, 19 aa, Entamoeba invadens
QECELCLDKCRLCEDYKDH

SEQ ID NO: 2802214 - protein, 22 aa, Entamoeba invadens
QEDFKCKVCQPGFGQNTLSRCE

SEQ ID NO: 2802215 - protein, 25 aa, Entamoeba invadens
QEDWELWMWFGIITAVIIVFIALVM

SEQ ID NO: 2802216 - protein, 23 aa, Entamoeba invadens
QEEERKKTCLFVMSSSNVKFMKT

SEQ ID NO: 2802217 - protein, 19 aa, Entamoeba invadens
QEEMYRYDQPIITSFSYKQ

SEQ ID NO: 2802218 - protein, 20 aa, Entamoeba invadens
QEFCQKCIPLSCGADSTVYS

SEQ ID NO: 2802219 - protein, 18 aa, Entamoeba invadens
QEFEQWRVSHHKSYTNKA

SEQ ID NO: 2802220 - protein, 23 aa, Entamoeba invadens
QEFISQIILTCWNHDPRIKAIDT

SEQ ID NO: 2802221 - protein, 25 aa, Entamoeba invadens
QEGFSYKLGLLIEAFAIPITGFVIG

SEQ ID NO: 2802222 - protein, 20 aa, Entamoeba invadens
QEGRLGRVLREFNQSDITPL

SEQ ID NO: 2802223 - protein, 19 aa, Entamoeba invadens
QEGYALKNHFCVSVECING

SEQ ID NO: 2802224 - protein, 18 aa, Entamoeba invadens
QEGYKLDIDSGVCISGED

SEQ ID NO: 2802225 - protein, 26 aa, Entamoeba invadens
QEHCIKYKQGVCVQCQSTFYLNSENL

SEQ ID NO: 2802226 - protein, 27 aa, Entamoeba invadens
QEIKPNWPSNGSIEFRNYGFRYRDTLP

SEQ ID NO: 2802227 - protein, 25 aa, Entamoeba invadens
QEIVMKLRVKYCIDGAKGIFYLHEN

SEQ ID NO: 2802228 - protein, 26 aa, Entamoeba invadens
QEIWGLWRIVQYYAVNPTRRLLEEYL

SEQ ID NO: 2802229 - protein, 31 aa, Entamoeba invadens
QEKNICVFKMKRSNISFPYEVNKKLVSNKSK

SEQ ID NO: 2802230 - protein, 24 aa, Entamoeba invadens
QEKQFKSIWAYFFGYWKDPNTENF

SEQ ID NO: 2802231 - protein, 33 aa, Entamoeba invadens
QEKTVCVFKMSRSNIRFIMKLSSSLCSNKRKLI

SEQ ID NO: 2802232 - protein, 25 aa, Entamoeba invadens
QEKYKRPADVYSFAMTMYECFAWRI

SEQ ID NO: 2802233 - protein, 29 aa, Entamoeba invadens
QELHLTRCKNCIFHLPSTLTKLSLYDVCD

SEQ ID NO: 2802234 - protein, 21 aa, Entamoeba invadens
QELLYKWYSSHEMLQSTNQII

SEQ ID NO: 2802235 - protein, 22 aa, Entamoeba invadens
QELYNIITSCWGQNPRERCSSS

SEQ ID NO: 2802236 - protein, 32 aa, Entamoeba invadens
QEMGDLIKECWADACLRPPFTEIETRLEKMWN

SEQ ID NO: 2802237 - protein, 30 aa, Entamoeba invadens
QEMRSCVPLYRPITVILFFLITGLIFIPIG

SEQ ID NO: 2802238 - protein, 17 aa, Entamoeba invadens
QEMSAQQLIDCSKKWTG

SEQ ID NO: 2802239 - protein, 20 aa, Entamoeba invadens
QEMYLRYIIGKKEMSVEEKI

SEQ ID NO: 2802240 - protein, 17 aa, Entamoeba invadens
QEQCKRIVNGICVECTT

SEQ ID NO: 2802241 - protein, 20 aa, Entamoeba invadens
QERCLSCSDGYYLSNNKCVS

SEQ ID NO: 2802242 - protein, 19 aa, Entamoeba invadens
QERINGICQLKCADGKELY

SEQ ID NO: 2802243 - protein, 25 aa, Entamoeba invadens
QERLPEWPAYCYLLKNAKNLEIFDK

SEQ ID NO: 2802244 - protein, 23 aa, Entamoeba invadens
QESKELLCIGNLTKGRVKVQLSA

SEQ ID NO: 2802245 - protein, 25 aa, Entamoeba invadens
QETCTLCLPTDYVLVNSMCQFYSSV

SEQ ID NO: 2802246 - protein, 17 aa, Entamoeba invadens
QETPCYTIDYSDVCVRD

SEQ ID NO: 2802247 - protein, 23 aa, Entamoeba invadens
QETVNLFACEGLRTLVLACRIIG

SEQ ID NO: 2802248 - protein, 25 aa, Entamoeba invadens
QETYKRRIVYETAQPLPSLIRRQII

SEQ ID NO: 2802249 - protein, 22 aa, Entamoeba invadens
QEVSWWMILIIFVLSFVTFIIF

SEQ ID NO: 2802250 - protein, 23 aa, Entamoeba invadens
QEWFFCVLCIYGMLLCLSPPTGF

SEQ ID NO: 2802251 - protein, 21 aa, Entamoeba invadens
QEYTIFISSCFVDGFYRNSMT

SEQ ID NO: 2802252 - protein, 25 aa, Entamoeba invadens
QEYVPFVDVCWYRMSNKKSPMVITS

SEQ ID NO: 2802253 - protein, 18 aa, Entamoeba invadens
QFACEFEIFVTLKCTTKI

SEQ ID NO: 2802254 - protein, 19 aa, Entamoeba invadens
QFAPFGWFVYLFFRRPNGF

SEQ ID NO: 2802255 - protein, 18 aa, Entamoeba invadens
QFARFKEIDNPTVIQNVQ

SEQ ID NO: 2802256 - protein, 20 aa, Entamoeba invadens
QFATDAFRALNLFATECNEE

SEQ ID NO: 2802257 - protein, 26 aa, Entamoeba invadens
QFCDSCKTLTTFCDRCDTLGVCTSCS

SEQ ID NO: 2802258 - protein, 19 aa, Entamoeba invadens
QFDECVCFGVAFDTAKKNG

SEQ ID NO: 2802259 - protein, 26 aa, Entamoeba invadens
QFDGNCSVCALSFERKCSSCEEGYYP

SEQ ID NO: 2802260 - protein, 24 aa, Entamoeba invadens
QFDRCYACGSTAIFGTIDGSVKIK

SEQ ID NO: 2802261 - protein, 19 aa, Entamoeba invadens
QFEEVWGCHNFNEKIPVVN

SEQ ID NO: 2802262 - protein, 17 aa, Entamoeba invadens
QFEFEWENACKLPGHKD

SEQ ID NO: 2802263 - protein, 29 aa, Entamoeba invadens
QFETKHVLKVFGLPGKINMNFDDLKIVIN

SEQ ID NO: 2802264 - protein, 22 aa, Entamoeba invadens
QFFPERFSTLFVMVVTQLFMFL

SEQ ID NO: 2802265 - protein, 18 aa, Entamoeba invadens
QFFPNFGKRIMFIQLIDL

SEQ ID NO: 2802266 - protein, 18 aa, Entamoeba invadens
QFGGCIGLNIGLFLFPVI

SEQ ID NO: 2802267 - protein, 23 aa, Entamoeba invadens
QFIPSCKVGYMFQHVTPLIFVLT

SEQ ID NO: 2802268 - protein, 18 aa, Entamoeba invadens
QFIPSGGCVKCNDGYYRS

SEQ ID NO: 2802269 - protein, 18 aa, Entamoeba invadens
QFIPTGGCVKCKDKYFRN

SEQ ID NO: 2802270 - protein, 30 aa, Entamoeba invadens
QFISLCPNSSIPIVLSKAICEDSKEIAING

SEQ ID NO: 2802271 - protein, 26 aa, Entamoeba invadens
QFKAEGEWTPLIVKFDMGALDGIYTS

SEQ ID NO: 2802272 - protein, 21 aa, Entamoeba invadens
QFKPICSFLNFIIPLIPQNVS

SEQ ID NO: 2802273 - protein, 22 aa, Entamoeba invadens
QFKYPWKIAEFVMAGNRLKKLE

SEQ ID NO: 2802274 - protein, 18 aa, Entamoeba invadens
QFLGEDFDFLVPNVAPVQ

SEQ ID NO: 2802275 - protein, 19 aa, Entamoeba invadens
QFNIMFHVALLLKLLEEEQ

SEQ ID NO: 2802276 - protein, 26 aa, Entamoeba invadens
QFPLYDLFIRLFKMFALPKDLHFALN

SEQ ID NO: 2802277 - protein, 18 aa, Entamoeba invadens
QFPVLKMAKEILEHFPDI

SEQ ID NO: 2802278 - protein, 23 aa, Entamoeba invadens
QFRTELPSSLILQNMIDSNKIGS

SEQ ID NO: 2802279 - protein, 18 aa, Entamoeba invadens
QFVFPWDIAEFISKGQRL

SEQ ID NO: 2802280 - protein, 26 aa, Entamoeba invadens
QFVKFATVCGVSFILRSILFTIGRMY

SEQ ID NO: 2802281 - protein, 19 aa, Entamoeba invadens
QFYPEGVDSIYLCYTEEKD

SEQ ID NO: 2802282 - protein, 28 aa, Entamoeba invadens
QFYVLKMCQILYAWSCIDVFIISVIAAV

SEQ ID NO: 2802283 - protein, 23 aa, Entamoeba invadens
QGCKHPSYIYTFFFVPVYFNFFG

SEQ ID NO: 2802284 - protein, 22 aa, Entamoeba invadens
QGELYRLNALVFAHYIGWVFGY

SEQ ID NO: 2802285 - protein, 25 aa, Entamoeba invadens
QGETCAFVGASGCGKSTTVQLLQRN

SEQ ID NO: 2802286 - protein, 24 aa, Entamoeba invadens
QGGCGSCFSVSNAMALQIKYANLT

SEQ ID NO: 2802287 - protein, 18 aa, Entamoeba invadens
QGGFAFSFIEGDLITALR

SEQ ID NO: 2802288 - protein, 20 aa, Entamoeba invadens
QGGVCQKCNDAFWFDFTTQK

SEQ ID NO: 2802289 - protein, 29 aa, Entamoeba invadens
QGHIRPALRVRTGIFMFLCYAFVGLQTDI

SEQ ID NO: 2802290 - protein, 17 aa, Entamoeba invadens
QGIHSVCAVFISLSFNE

SEQ ID NO: 2802291 - protein, 25 aa, Entamoeba invadens
QGIKIRLLYFRALLRQDSGWYDFHE

SEQ ID NO: 2802292 - protein, 25 aa, Entamoeba invadens
QGIKIRLLYMRSLLRQDSAWYDFQE

SEQ ID NO: 2802293 - protein, 23 aa, Entamoeba invadens
QGIVLPTTIPSYAIIISAMQLTS

SEQ ID NO: 2802294 - protein, 24 aa, Entamoeba invadens
QGKKEFFYQFCYSFIGDTVGVFGC

SEQ ID NO: 2802295 - protein, 22 aa, Entamoeba invadens
QGLRLKALNICNEYDGDFTDIA

SEQ ID NO: 2802296 - protein, 18 aa, Entamoeba invadens
QGLVCFFTGLSGSGKSVV

SEQ ID NO: 2802297 - protein, 19 aa, Entamoeba invadens
QGNIKNCMIYGVSIDGVVS

SEQ ID NO: 2802298 - protein, 24 aa, Entamoeba invadens
QGNWKVMIFFVIFTTCLSLLYFVD

SEQ ID NO: 2802299 - protein, 25 aa, Entamoeba invadens
QGQCGSCYASAMANYIQIRYANISY

SEQ ID NO: 2802300 - protein, 24 aa, Entamoeba invadens
QGQMFPWVIAPAAKIIVSDGSAMK

SEQ ID NO: 2802301 - protein, 20 aa, Entamoeba invadens
QGSFGLVYEGVWRGAEVAVK

SEQ ID NO: 2802302 - protein, 22 aa, Entamoeba invadens
QGTFGIVFRATWRQQEVAVKMV

SEQ ID NO: 2802303 - protein, 21 aa, Entamoeba invadens
QGTFPSAHWVLYAILELIISK

SEQ ID NO: 2802304 - protein, 19 aa, Entamoeba invadens
QGTLKMKVFMLNIIAHMSY

SEQ ID NO: 2802305 - protein, 19 aa, Entamoeba invadens
QGYSHIRSQVSLLVPENML

SEQ ID NO: 2802306 - protein, 30 aa, Entamoeba invadens
QGYYYNSYFRQCFKQVGGVSSIIIAIVCVF

SEQ ID NO: 2802307 - protein, 26 aa, Entamoeba invadens
QHFDRYWKAILFEGSGKRTLSGKSHT

SEQ ID NO: 2802308 - protein, 20 aa, Entamoeba invadens
QHFNVWWYRNKMSELTSKIV

SEQ ID NO: 2802309 - protein, 18 aa, Entamoeba invadens
QHICTACFAPYVTSSDSK

SEQ ID NO: 2802310 - protein, 17 aa, Entamoeba invadens
QHIEMLNTILVIDKDVK

SEQ ID NO: 2802311 - protein, 18 aa, Entamoeba invadens
QHIFELKNTLDLNLPTIT

SEQ ID NO: 2802312 - protein, 24 aa, Entamoeba invadens
QHLLYKMLCNLMVRKVPKITNAVY

SEQ ID NO: 2802313 - protein, 18 aa, Entamoeba invadens
QHMWKTILPDSFFSSEEF

SEQ ID NO: 2802314 - protein, 18 aa, Entamoeba invadens
QHPCDRQGHNNGIYYQYT

SEQ ID NO: 2802315 - protein, 24 aa, Entamoeba invadens
QHSPRLDTPIALKQNIHFETSSTL

SEQ ID NO: 2802316 - protein, 18 aa, Entamoeba invadens
QHTNCAKCTFDDQIENCQ

SEQ ID NO: 2802317 - protein, 22 aa, Entamoeba invadens
QHVVWWVIFIAIVFVIAVITFL

SEQ ID NO: 2802318 - protein, 23 aa, Entamoeba invadens
QIADCKYSLISKSICVECLDSFN

SEQ ID NO: 2802319 - protein, 18 aa, Entamoeba invadens
QIADCKYSLISQSKCVEC

SEQ ID NO: 2802320 - protein, 18 aa, Entamoeba invadens
QIADCKYSLISQSMCVEC

SEQ ID NO: 2802321 - protein, 21 aa, Entamoeba invadens
QICKCFKKIMQNGSYISNSKT

SEQ ID NO: 2802322 - protein, 23 aa, Entamoeba invadens
QICLKCFAPYCVSENKKMCNLAY

SEQ ID NO: 2802323 - protein, 22 aa, Entamoeba invadens
QIDLFIDLCVSKINIDNGELDR

SEQ ID NO: 2802324 - protein, 19 aa, Entamoeba invadens
QIDNCIKYVNGMCVECSSK

SEQ ID NO: 2802325 - protein, 24 aa, Entamoeba invadens
QIDVCVACALGYYPNGEECIPCSK

SEQ ID NO: 2802326 - protein, 20 aa, Entamoeba invadens
QIECKKCPAGSYQSKKGTSY

SEQ ID NO: 2802327 - protein, 30 aa, Entamoeba invadens
QIEKLDALCACNRIAIVVKIDVVNTFVEFN

SEQ ID NO: 2802328 - protein, 18 aa, Entamoeba invadens
QIENGLCVECKESYILNN

SEQ ID NO: 2802329 - protein, 25 aa, Entamoeba invadens
QIERNGLCELCDPVFSSLISISGEC

SEQ ID NO: 2802330 - protein, 21 aa, Entamoeba invadens
QIEVICFLIALKVLAPDMVFM

SEQ ID NO: 2802331 - protein, 17 aa, Entamoeba invadens
QIFAKIFFALLIGSIFF

SEQ ID NO: 2802332 - protein, 28 aa, Entamoeba invadens
QIGKLGFGCALIVFSILVVYWVIDAINY

SEQ ID NO: 2802333 - protein, 27 aa, Entamoeba invadens
QIGLICFIFCYWYIYNLVTFILIFNFQ

SEQ ID NO: 2802334 - protein, 18 aa, Entamoeba invadens
QIGVFVFVLFSGNFVIFA

SEQ ID NO: 2802335 - protein, 24 aa, Entamoeba invadens
QIIMYPFHMIWTFIVFLYNKLKLY

SEQ ID NO: 2802336 - protein, 25 aa, Entamoeba invadens
QIIPTCPAETFSWIFMSPLSPSNLL

SEQ ID NO: 2802337 - protein, 17 aa, Entamoeba invadens
QIIQGCWDDDPTKRMSL

SEQ ID NO: 2802338 - protein, 33 aa, Entamoeba invadens
QIKANLYLGKFMRDLMRFWKLTFVVKLLEIVMD

SEQ ID NO: 2802339 - protein, 26 aa, Entamoeba invadens
QIKLAKCLLPCWKQNFDETDIEAQFE

SEQ ID NO: 2802340 - protein, 20 aa, Entamoeba invadens
QIKMSFDILCPHCLSNDVNV

SEQ ID NO: 2802341 - protein, 22 aa, Entamoeba invadens
QIKNFKELVCIMTSRVDESGFY

SEQ ID NO: 2802342 - protein, 24 aa, Entamoeba invadens
QIKNSKCSKCTFWHTPSVNGTSCV

SEQ ID NO: 2802343 - protein, 24 aa, Entamoeba invadens
QILSCKKPLILRENVCEQCSTLYG

SEQ ID NO: 2802344 - protein, 32 aa, Entamoeba invadens
QIMLDCVFSPAVNWFFKFALQTICPDTLAKLS

SEQ ID NO: 2802345 - protein, 19 aa, Entamoeba invadens
QINIKWKLINFTSICVLDT

SEQ ID NO: 2802346 - protein, 22 aa, Entamoeba invadens
QIPDIPVFYSDMLITIGDSAQY

SEQ ID NO: 2802347 - protein, 33 aa, Entamoeba invadens
QIPNCISSQYSICWECADGYKLRDDKIECFANT

SEQ ID NO: 2802348 - protein, 24 aa, Entamoeba invadens
QIPPMKLRVKMLIDGARGVLYLHE

SEQ ID NO: 2802349 - protein, 21 aa, Entamoeba invadens
QIPSSTLWISFHELPTFELNY

SEQ ID NO: 2802350 - protein, 22 aa, Entamoeba invadens
QIQCKACAINHTLSEDSTKCEL

SEQ ID NO: 2802351 - protein, 22 aa, Entamoeba invadens
QIQDKYIRFMIPKRNVDTDVIE

SEQ ID NO: 2802352 - protein, 22 aa, Entamoeba invadens
QIRCKACAINHTLSEDSTKCEL

SEQ ID NO: 2802353 - protein, 26 aa, Entamoeba invadens
QIRDFSDNCILCLTDEKLININGKCQ

SEQ ID NO: 2802354 - protein, 18 aa, Entamoeba invadens
QIRGCAVQPTTLGCSQCS

SEQ ID NO: 2802355 - protein, 20 aa, Entamoeba invadens
QIRSKHFKKFFTLEKLDPTQ

SEQ ID NO: 2802356 - protein, 26 aa, Entamoeba invadens
QISCFIKRQCKGEGAYTTTLFIEPDR

SEQ ID NO: 2802357 - protein, 18 aa, Entamoeba invadens
QISENYYRCTKTANVDLT

SEQ ID NO: 2802358 - protein, 20 aa, Entamoeba invadens
QISSCWTLQIVGNFDDPFVG

SEQ ID NO: 2802359 - protein, 19 aa, Entamoeba invadens
QITPLINFAKRWIRCKSNP

SEQ ID NO: 2802360 - protein, 17 aa, Entamoeba invadens
QIVRWVILICVIVALLI

SEQ ID NO: 2802361 - protein, 19 aa, Entamoeba invadens
QIVTLKKGFACEFEVFLTP

SEQ ID NO: 2802362 - protein, 25 aa, Entamoeba invadens
QIVTLKSGFACEFEVFLTPYCTMDL

SEQ ID NO: 2802363 - protein, 24 aa, Entamoeba invadens
QIYMPTMLNWMIGGLIGQKSLGVF

SEQ ID NO: 2802364 - protein, 30 aa, Entamoeba invadens
QKAIIKNTCCYFVILGVSAFVAYYLYNGLF

SEQ ID NO: 2802365 - protein, 22 aa, Entamoeba invadens
QKAIRWIEEYKLQFSGTQEIWG

SEQ ID NO: 2802366 - protein, 20 aa, Entamoeba invadens
QKATEIFDTRFEKVEVKNHS

SEQ ID NO: 2802367 - protein, 18 aa, Entamoeba invadens
QKCVSGYHFYQYNTDDFE

SEQ ID NO: 2802368 - protein, 18 aa, Entamoeba invadens
QKDFKELQFDFELNGEFE

SEQ ID NO: 2802369 - protein, 19 aa, Entamoeba invadens
QKDFKEMKVVFDVDGDYEF

SEQ ID NO: 2802370 - protein, 19 aa, Entamoeba invadens
QKDKCIFCKDEYFMSSNTF

SEQ ID NO: 2802371 - protein, 17 aa, Entamoeba invadens
QKDLHLWPYTYEFSQSD

SEQ ID NO: 2802372 - protein, 28 aa, Entamoeba invadens
QKDVKMLATCLGYFFAEVLLFVPEDSVY

SEQ ID NO: 2802373 - protein, 27 aa, Entamoeba invadens
QKEAMWCALCLFQLGEDYARFISPEEK

SEQ ID NO: 2802374 - protein, 23 aa, Entamoeba invadens
QKEIKCTLCNEGYYPAEDGSLCS

SEQ ID NO: 2802375 - protein, 20 aa, Entamoeba invadens
QKEMMEYAKIAGMAMNGYSV

SEQ ID NO: 2802376 - protein, 18 aa, Entamoeba invadens
QKENNIWVTNTMNEDNNI

SEQ ID NO: 2802377 - protein, 25 aa, Entamoeba invadens
QKETYRPYLYLSMTSLSYSTKVLYI

SEQ ID NO: 2802378 - protein, 23 aa, Entamoeba invadens
QKFAKARFDCIVSTCGNKKWDKG

SEQ ID NO: 2802379 - protein, 19 aa, Entamoeba invadens
QKFPEYKVPTVPILTVKSA

SEQ ID NO: 2802380 - protein, 24 aa, Entamoeba invadens
QKFVFFCSIGYLLISYFVTLPMYF

SEQ ID NO: 2802381 - protein, 25 aa, Entamoeba invadens
QKGCVSCLNGFYLNHETCVKCINDC

SEQ ID NO: 2802382 - protein, 18 aa, Entamoeba invadens
QKGNCTYYNEVNSFCEQC

SEQ ID NO: 2802383 - protein, 30 aa, Entamoeba invadens
QKGRGIELLSCLAKSIGKDAFKPYLNGTLT

SEQ ID NO: 2802384 - protein, 20 aa, Entamoeba invadens
QKHAVSWVIAIIVVLCVFVL

SEQ ID NO: 2802385 - protein, 19 aa, Entamoeba invadens
QKIKCLRPNNLSLPLKSIK

SEQ ID NO: 2802386 - protein, 22 aa, Entamoeba invadens
QKILNCLTCTSGISYLNLNGLC

SEQ ID NO: 2802387 - protein, 24 aa, Entamoeba invadens
QKIQSFYLTFGIKGKVESSLKVDS

SEQ ID NO: 2802388 - protein, 18 aa, Entamoeba invadens
QKITQRFSLYKTENKTKV

SEQ ID NO: 2802389 - protein, 23 aa, Entamoeba invadens
QKKAITWFLQKNCMFQADLEGIV

SEQ ID NO: 2802390 - protein, 26 aa, Entamoeba invadens
QKKASRKLLFILLIVGAVFIVLAVIV

SEQ ID NO: 2802391 - protein, 28 aa, Entamoeba invadens
QKKERMVHCWSLLIFLIFGCIAYDSWCE

SEQ ID NO: 2802392 - protein, 24 aa, Entamoeba invadens
QKKFKFPWKIAEFVIKGNHLKIIE

SEQ ID NO: 2802393 - protein, 30 aa, Entamoeba invadens
QKKFSEIFFDLRIWAGCPIDIQVYIISKIT

SEQ ID NO: 2802394 - protein, 17 aa, Entamoeba invadens
QKKSVEVFWEIVETMSV

SEQ ID NO: 2802395 - protein, 20 aa, Entamoeba invadens
QKKVQKLLLIIAISVTVAIP

SEQ ID NO: 2802396 - protein, 22 aa, Entamoeba invadens
QKKYFICSFEKKAWIYLNNKHR

SEQ ID NO: 2802397 - protein, 24 aa, Entamoeba invadens
QKLDSFPLPIFKFIAASTGVVVST

SEQ ID NO: 2802398 - protein, 17 aa, Entamoeba invadens
QKLFPNFQIYAFEVGLP

SEQ ID NO: 2802399 - protein, 21 aa, Entamoeba invadens
QKLILKEGVCQQVDPNSDANS

SEQ ID NO: 2802400 - protein, 27 aa, Entamoeba invadens
QKLKECGWKNGFDKITFANTLKMLGEQ

SEQ ID NO: 2802401 - protein, 26 aa, Entamoeba invadens
QKLLSGIKLTWWLGINLSLVYFFEYI

SEQ ID NO: 2802402 - protein, 22 aa, Entamoeba invadens
QKLPIEQILSFSVVLAAKSSLN

SEQ ID NO: 2802403 - protein, 20 aa, Entamoeba invadens
QKLRCKIQNVVEWLQEVFEE

SEQ ID NO: 2802404 - protein, 19 aa, Entamoeba invadens
QKLSATLKVEGFDTNEYFI

SEQ ID NO: 2802405 - protein, 37 aa, Entamoeba invadens
QKLVKRISGCDGFVLVIVCGTTVFGVVVKAKVEKTGE

SEQ ID NO: 2802406 - protein, 18 aa, Entamoeba invadens
QKMNEELTFKIEESEKER

SEQ ID NO: 2802407 - protein, 21 aa, Entamoeba invadens
QKMPVRFLRFEKISKETSEKG

SEQ ID NO: 2802408 - protein, 23 aa, Entamoeba invadens
QKNFGCLICNNTFYLDELTKQCV

SEQ ID NO: 2802409 - protein, 24 aa, Entamoeba invadens
QKNFGCLICNNTFYLDELTKRCAS

SEQ ID NO: 2802410 - protein, 33 aa, Entamoeba invadens
QKNHIFQILTYFRRLCVHPKLVLDDNHPMKAKV

SEQ ID NO: 2802411 - protein, 17 aa, Entamoeba invadens
QKPKPKLLRVMFRLNAK

SEQ ID NO: 2802412 - protein, 25 aa, Entamoeba invadens
QKRIMGDGVGIWFTNTQIFQGEAHG

SEQ ID NO: 2802413 - protein, 21 aa, Entamoeba invadens
QKRTFVFKQLEAIMEVTQSLK

SEQ ID NO: 2802414 - protein, 20 aa, Entamoeba invadens
QKSCTYKRTLGCETINNNKC

SEQ ID NO: 2802415 - protein, 27 aa, Entamoeba invadens
QKSDVRFKYAWDIADFISAGKRLFIPN

SEQ ID NO: 2802416 - protein, 27 aa, Entamoeba invadens
QKSDVRFKYAWDIADFISAGKRLVIPN

SEQ ID NO: 2802417 - protein, 27 aa, Entamoeba invadens
QKSFPSFRSRFSFSLPHRSKKPAPDDL

SEQ ID NO: 2802418 - protein, 22 aa, Entamoeba invadens
QKSGAFPFYPFVTSKTDYLATT

SEQ ID NO: 2802419 - protein, 20 aa, Entamoeba invadens
QKSLWWISLIVLGGVVLLVI

SEQ ID NO: 2802420 - protein, 24 aa, Entamoeba invadens
QKSNGSFWGDCFDELKGDQKLFVN

SEQ ID NO: 2802421 - protein, 25 aa, Entamoeba invadens
QKSPCKFEDIYLLGSEFQTNALSGA

SEQ ID NO: 2802422 - protein, 20 aa, Entamoeba invadens
QKSRFEFSLGPAVLTGPLAV

SEQ ID NO: 2802423 - protein, 21 aa, Entamoeba invadens
QKSVCLCYFILVNINLLSIAL

SEQ ID NO: 2802424 - protein, 18 aa, Entamoeba invadens
QKSVHCMVVGSATMFYQN

SEQ ID NO: 2802425 - protein, 21 aa, Entamoeba invadens
QKTECVSLWSGERHGFLASDL

SEQ ID NO: 2802426 - protein, 33 aa, Entamoeba invadens
QKTVCVFKGFLRIRCILRIKTILIKKYFSEDTK

SEQ ID NO: 2802427 - protein, 26 aa, Entamoeba invadens
QKTVFPFCFSEGDSLMKQRSLLKEPT

SEQ ID NO: 2802428 - protein, 23 aa, Entamoeba invadens
QKTYRILKQFPFTPERRRMSVII

SEQ ID NO: 2802429 - protein, 22 aa, Entamoeba invadens
QKVVLKKAYLKRITSLKNGEDC

SEQ ID NO: 2802430 - protein, 28 aa, Entamoeba invadens
QKYIWPSALRLFPFVMLVSLFLNNTPVV

SEQ ID NO: 2802431 - protein, 27 aa, Entamoeba invadens
QKYKMPCDVFSLAVSFYEGYTWITPYP

SEQ ID NO: 2802432 - protein, 18 aa, Entamoeba invadens
QKYPIMWMNQIKALHANI

SEQ ID NO: 2802433 - protein, 18 aa, Entamoeba invadens
QKYREVIEQCWRQDPTER

SEQ ID NO: 2802434 - protein, 17 aa, Entamoeba invadens
QLAAFGSGCVRCVDGYY

SEQ ID NO: 2802435 - protein, 20 aa, Entamoeba invadens
QLATVLACQLMLVDVVMRCG

SEQ ID NO: 2802436 - protein, 25 aa, Entamoeba invadens
QLAYCISSGFIPTFLQLILQILSEY

SEQ ID NO: 2802437 - protein, 20 aa, Entamoeba invadens
QLCADYNGVSSFVLGGDIKQ

SEQ ID NO: 2802438 - protein, 18 aa, Entamoeba invadens
QLCAKCYAPYVLSDKKSM

SEQ ID NO: 2802439 - protein, 23 aa, Entamoeba invadens
QLCYFHKWYKFFNFHGKNISRCG

SEQ ID NO: 2802440 - protein, 21 aa, Entamoeba invadens
QLDFALPMIKNMFPYTFTVTR

SEQ ID NO: 2802441 - protein, 23 aa, Entamoeba invadens
QLDKPRIVLWNSSYLHLYSKTAK

SEQ ID NO: 2802442 - protein, 25 aa, Entamoeba invadens
QLDQCKKHRVELEMERLGIEKVKTE

SEQ ID NO: 2802443 - protein, 19 aa, Entamoeba invadens
QLEKVFGFDRVDVLETYKV

SEQ ID NO: 2802444 - protein, 23 aa, Entamoeba invadens
QLERYIILCVMLRSLHPTYQTLT

SEQ ID NO: 2802445 - protein, 18 aa, Entamoeba invadens
QLFYICFTFLVFHNNNLL

SEQ ID NO: 2802446 - protein, 24 aa, Entamoeba invadens
QLGLRITPIPLIIVYGNSTVRPVL

SEQ ID NO: 2802447 - protein, 26 aa, Entamoeba invadens
QLGRLFTECFGRWVVYKISSSSIVHC

SEQ ID NO: 2802448 - protein, 26 aa, Entamoeba invadens
QLGWLNYKYGIYFNGTGTFNFEEVSG

SEQ ID NO: 2802449 - protein, 18 aa, Entamoeba invadens
QLIEKCILAKNNRCFKCA

SEQ ID NO: 2802450 - protein, 20 aa, Entamoeba invadens
QLIFMIGWCFYWVVITVDDA

SEQ ID NO: 2802451 - protein, 25 aa, Entamoeba invadens
QLIGPSEKVVDCMVAGYAIIKTNGS

SEQ ID NO: 2802452 - protein, 27 aa, Entamoeba invadens
QLIPAFKVGMTFTYFAPLVFVVALSIC

SEQ ID NO: 2802453 - protein, 22 aa, Entamoeba invadens
QLISLEYSDLISFLQNLPTSNL

SEQ ID NO: 2802454 - protein, 24 aa, Entamoeba invadens
QLKCEKTWNGWKFGALAEQEKAGV

SEQ ID NO: 2802455 - protein, 21 aa, Entamoeba invadens
QLKDCRNCIFELPNTLTGLSI

SEQ ID NO: 2802456 - protein, 17 aa, Entamoeba invadens
QLLLSEKSLCFDSLSRG

SEQ ID NO: 2802457 - protein, 19 aa, Entamoeba invadens
QLLNPRPTFSPPLQQMAAH

SEQ ID NO: 2802458 - protein, 18 aa, Entamoeba invadens
QLLTSLQVFMFVQYKVMY

SEQ ID NO: 2802459 - protein, 40 aa, Entamoeba invadens
QLLWSEEECCKNPSLMWVIFKKEWKSMLFGYFTIAVYELF

SEQ ID NO: 2802460 - protein, 20 aa, Entamoeba invadens
QLLYKVGEWYVIAIGAATLV

SEQ ID NO: 2802461 - protein, 20 aa, Entamoeba invadens
QLMPLLVIMCEQGIDDSGRI

SEQ ID NO: 2802462 - protein, 26 aa, Entamoeba invadens
QLNKIKCAICLSGYVMNREGNCEKCH

SEQ ID NO: 2802463 - protein, 21 aa, Entamoeba invadens
QLPKPLQIKRFGVMVDGQPGT

SEQ ID NO: 2802464 - protein, 31 aa, Entamoeba invadens
QLRNKEMYSMFGTMCGRSTVITLMLELTPLM

SEQ ID NO: 2802465 - protein, 17 aa, Entamoeba invadens
QLSIGRERLKYEIPHLG

SEQ ID NO: 2802466 - protein, 23 aa, Entamoeba invadens
QLSLDLKVSLSLVNSSSKIFASE

SEQ ID NO: 2802467 - protein, 18 aa, Entamoeba invadens
QLSVKWIFVLSLRLRNSI

SEQ ID NO: 2802468 - protein, 20 aa, Entamoeba invadens
QLSYYTCLILYSVIVLSLSF

SEQ ID NO: 2802469 - protein, 41 aa, Entamoeba invadens
QLTDSFTFEFCIKWVFTLSLRIRNGLIGLIFNKALKLNSAG

SEQ ID NO: 2802470 - protein, 26 aa, Entamoeba invadens
QLTGPSHKIVHCMVVGTINPIYQNVP

SEQ ID NO: 2802471 - protein, 17 aa, Entamoeba invadens
QLTQILAIFPFDEKTYF

SEQ ID NO: 2802472 - protein, 22 aa, Entamoeba invadens
QLVCMPEIITTLTAPQCDVDLK

SEQ ID NO: 2802473 - protein, 19 aa, Entamoeba invadens
QLVPQFLKRVIKSVRPVTE

SEQ ID NO: 2802474 - protein, 18 aa, Entamoeba invadens
QLYLRTYVTPAFGFGTIV

SEQ ID NO: 2802475 - protein, 24 aa, Entamoeba invadens
QMERGTCWDFALIGFLQSNYRQNG

SEQ ID NO: 2802476 - protein, 23 aa, Entamoeba invadens
QMGEALGFQDHWNGLGVLIDTYQ

SEQ ID NO: 2802477 - protein, 30 aa, Entamoeba invadens
QMGISCTLMLSIPVPNGFKYTVSEILPAYE

SEQ ID NO: 2802478 - protein, 19 aa, Entamoeba invadens
QMIKDAFVGIRVNLTQRCD

SEQ ID NO: 2802479 - protein, 20 aa, Entamoeba invadens
QMIKRCIVDPIASGDFKSFF

SEQ ID NO: 2802480 - protein, 25 aa, Entamoeba invadens
QMIMGLCVTNMWFGGYFSFLFCLPF

SEQ ID NO: 2802481 - protein, 22 aa, Entamoeba invadens
QMKMDIVIHITKYCTVNYLKEF

SEQ ID NO: 2802482 - protein, 42 aa, Entamoeba invadens
QMLKTSFLNFFIVSFSFCCLACWCVFMLQPTFECSVTTPMKQ

SEQ ID NO: 2802483 - protein, 25 aa, Entamoeba invadens
QMLSACISCDFGLYLEGDGNCVECP

SEQ ID NO: 2802484 - protein, 22 aa, Entamoeba invadens
QMMPQLFINYKMKSVANMPWKV

SEQ ID NO: 2802485 - protein, 24 aa, Entamoeba invadens
QMRIEGIPNWPMFIDIVGDNPVDV

SEQ ID NO: 2802486 - protein, 24 aa, Entamoeba invadens
QMSNWKWTASYIVLMTQTKKQIIF

SEQ ID NO: 2802487 - protein, 17 aa, Entamoeba invadens
QMYEVYMPHLIKLIKTV

SEQ ID NO: 2802488 - protein, 17 aa, Entamoeba invadens
QMYLQLYFQSFLMLRKS

SEQ ID NO: 2802489 - protein, 19 aa, Entamoeba invadens
QNACLPCYTKYSNCKKCYS

SEQ ID NO: 2802490 - protein, 26 aa, Entamoeba invadens
QNALFMKLFHLCKPTIFANLVKLDKI

SEQ ID NO: 2802491 - protein, 17 aa, Entamoeba invadens
QNCIFANLIEKSWQHQV

SEQ ID NO: 2802492 - protein, 18 aa, Entamoeba invadens
  misc_feature (16)..(17): Xaa can be any naturally occurring amino acid
QNCYLRLNKGFRYKVXXE

SEQ ID NO: 2802493 - protein, 26 aa, Entamoeba invadens
QNDFCLSCPNGYYLSNYVCKSNEILK

SEQ ID NO: 2802494 - protein, 20 aa, Entamoeba invadens
QNEICFDYSLKTCDNCTENI

SEQ ID NO: 2802495 - protein, 18 aa, Entamoeba invadens
QNEKGCLSCNDGYYLEDN

SEQ ID NO: 2802496 - protein, 18 aa, Entamoeba invadens
QNEKGCLSCNDGYYLENN

SEQ ID NO: 2802497 - protein, 18 aa, Entamoeba invadens
QNEKGCLSCNNGYYLENN

SEQ ID NO: 2802498 - protein, 29 aa, Entamoeba invadens
QNEMKKVRVPDCVSLKAFKSVYPNTSPEL

SEQ ID NO: 2802499 - protein, 24 aa, Entamoeba invadens
QNFDGLICILTLLSSSAISRLSKS

SEQ ID NO: 2802500 - protein, 25 aa, Entamoeba invadens
QNFILLLFYFCRNIKKQQLLRLKEP

SEQ ID NO: 2802501 - protein, 19 aa, Entamoeba invadens
QNGCFKCQDGYYIVNTNEC

SEQ ID NO: 2802502 - protein, 19 aa, Entamoeba invadens
QNGCKKCLDGYYNVNYNEC

SEQ ID NO: 2802503 - protein, 20 aa, Entamoeba invadens
QNGCNKCLPGYYTINNKECE

SEQ ID NO: 2802504 - protein, 20 aa, Entamoeba invadens
QNGCNKCLSGYYSVNFNECK

SEQ ID NO: 2802505 - protein, 23 aa, Entamoeba invadens
QNGCSICKPGYYSTNNECGICSN

SEQ ID NO: 2802506 - protein, 19 aa, Entamoeba invadens
QNGCSKCLDGYYTVNYNEC

SEQ ID NO: 2802507 - protein, 19 aa, Entamoeba invadens
QNGCTLCSNTYYVEGKRCG

SEQ ID NO: 2802508 - protein, 21 aa, Entamoeba invadens
QNGFFSWVMIHLFTLAFFLVA

SEQ ID NO: 2802509 - protein, 25 aa, Entamoeba invadens
QNGLCKCLYTLLGTNCVLNHCVLYE

SEQ ID NO: 2802510 - protein, 23 aa, Entamoeba invadens
QNGLTCKRCDDSYYFDNDTQRCE

SEQ ID NO: 2802511 - protein, 18 aa, Entamoeba invadens
QNIFAFPTIIFDSSVEVI

SEQ ID NO: 2802512 - protein, 19 aa, Entamoeba invadens
QNIGCAICNDSFYREKNDC

SEQ ID NO: 2802513 - protein, 25 aa, Entamoeba invadens
QNILYRYISCPNLLFEALFFTAFMI

SEQ ID NO: 2802514 - protein, 17 aa, Entamoeba invadens
QNIPLWWVILLIIITDI

SEQ ID NO: 2802515 - protein, 18 aa, Entamoeba invadens
QNKCLLCENQYILQNTSC

SEQ ID NO: 2802516 - protein, 18 aa, Entamoeba invadens
QNKGRGVVELFYDNFAVL

SEQ ID NO: 2802517 - protein, 22 aa, Entamoeba invadens
QNKKSAMGFLIFNYYGLSEKEP

SEQ ID NO: 2802518 - protein, 23 aa, Entamoeba invadens
QNKRISALQIFSFAITKCLSYHF

SEQ ID NO: 2802519 - protein, 23 aa, Entamoeba invadens
QNKVCGRPDYEYNYIRNNANYTC

SEQ ID NO: 2802520 - protein, 22 aa, Entamoeba invadens
QNKVKCEICSKGYVLQDNECVF

SEQ ID NO: 2802521 - protein, 25 aa, Entamoeba invadens
QNKVLECLEHYYGINNKCIFCSNGC

SEQ ID NO: 2802522 - protein, 17 aa, Entamoeba invadens
QNLPITFSITKFGIDHL

SEQ ID NO: 2802523 - protein, 27 aa, Entamoeba invadens
QNLTSLKVFCFCSSFTTITTLVALNVF

SEQ ID NO: 2802524 - protein, 23 aa, Entamoeba invadens
QNNCSLCSPNYIFKNGECIMITN

SEQ ID NO: 2802525 - protein, 24 aa, Entamoeba invadens
QNNIGATCTLQFSATTTSVGFLSN

SEQ ID NO: 2802526 - protein, 23 aa, Entamoeba invadens
QNNINCFDVFSLPDITILDINTA

SEQ ID NO: 2802527 - protein, 20 aa, Entamoeba invadens
QNNKCPFNYEWSVTDNIVSF

SEQ ID NO: 2802528 - protein, 25 aa, Entamoeba invadens
QNNVLELWSLFDFLMPGFLGTEKEF

SEQ ID NO: 2802529 - protein, 24 aa, Entamoeba invadens
QNQGECGSCYAFGVAQLLETKYAM

SEQ ID NO: 2802530 - protein, 24 aa, Entamoeba invadens
QNQTRNCIQCNYKYYPVLTSGEMK

SEQ ID NO: 2802531 - protein, 24 aa, Entamoeba invadens
QNQVKRFVCRNIFNDPTEYINNSG

SEQ ID NO: 2802532 - protein, 20 aa, Entamoeba invadens
QNQYRPARWLSVNITGVTQL

SEQ ID NO: 2802533 - protein, 19 aa, Entamoeba invadens
QNRCKQCSMGYYSKSNVCT

SEQ ID NO: 2802534 - protein, 18 aa, Entamoeba invadens
QNRCYKCNKKYNVIDAQC

SEQ ID NO: 2802535 - protein, 19 aa, Entamoeba invadens
QNRKLLWKVLDGIPEEYVT

SEQ ID NO: 2802536 - protein, 36 aa, Entamoeba invadens
QNSCLSNKCGWCETNEKCGFCEDGGEFCNIDGTSGC

SEQ ID NO: 2802537 - protein, 17 aa, Entamoeba invadens
QNSISEIWGIKCVNGEY

SEQ ID NO: 2802538 - protein, 24 aa, Entamoeba invadens
QNSMCLSCKNGLIEHIKHCIILYV

SEQ ID NO: 2802539 - protein, 23 aa, Entamoeba invadens
QNSMPDIPYRNWAVRLSTPLLVL

SEQ ID NO: 2802540 - protein, 20 aa, Entamoeba invadens
QNSTCKRCALKYQNCSLCDI

SEQ ID NO: 2802541 - protein, 21 aa, Entamoeba invadens
QNTKFSWKKFKIELQTQSGKI

SEQ ID NO: 2802542 - protein, 18 aa, Entamoeba invadens
QNVECVFEGNSLNEVTVY

SEQ ID NO: 2802543 - protein, 24 aa, Entamoeba invadens
QNVEFKWSGSSVIGADYTFKSGAA

SEQ ID NO: 2802544 - protein, 33 aa, Entamoeba invadens
QNVSGWLLLAWWFFCVFKLRCHVCGDTCVECAP

SEQ ID NO: 2802545 - protein, 17 aa, Entamoeba invadens
QNVSLSFFVWYLHEVQS

SEQ ID NO: 2802546 - protein, 26 aa, Entamoeba invadens
QNVYNIIVGFFIRFYLFKQTCFTTTL

SEQ ID NO: 2802547 - protein, 19 aa, Entamoeba invadens
QNWIPIDFECFKTSMDASA

SEQ ID NO: 2802548 - protein, 22 aa, Entamoeba invadens
QNYDFANAIILSYVANSGDILI

SEQ ID NO: 2802549 - protein, 17 aa, Entamoeba invadens
QNYPFAFLNGFKQLNYS

SEQ ID NO: 2802550 - protein, 22 aa, Entamoeba invadens
QPEAIYKLGLIKTYYDKENKYK

SEQ ID NO: 2802551 - protein, 25 aa, Entamoeba invadens
QPEVVCLKGGSACEFEIVLIPFCTC

SEQ ID NO: 2802552 - protein, 36 aa, Entamoeba invadens
QPFFAFQVFCSVLWMLDDMPIFAFMMLVMLFVFEGM

SEQ ID NO: 2802553 - protein, 27 aa, Entamoeba invadens
QPIEAYVLICALSFVNVMYCGATCFFT

SEQ ID NO: 2802554 - protein, 23 aa, Entamoeba invadens
QPIEMLVEIDVLRDLLDTFYMYP

SEQ ID NO: 2802555 - protein, 17 aa, Entamoeba invadens
QPIHLHLDFSLMSVTDF

SEQ ID NO: 2802556 - protein, 29 aa, Entamoeba invadens
QPINLVIDGSWVKRLFSLYYSMSDFSTLF

SEQ ID NO: 2802557 - protein, 17 aa, Entamoeba invadens
QPIPALIYSTAVWMQMA

SEQ ID NO: 2802558 - protein, 18 aa, Entamoeba invadens
QPKDCKVSALVGEQCTEM

SEQ ID NO: 2802559 - protein, 20 aa, Entamoeba invadens
QPKDMPDWLYQVISLGWDQL

SEQ ID NO: 2802560 - protein, 20 aa, Entamoeba invadens
QPKIIVSIFLQIRTTNRIFG

SEQ ID NO: 2802561 - protein, 22 aa, Entamoeba invadens
QPKLFVGMLICQIFSEALALYG

SEQ ID NO: 2802562 - protein, 24 aa, Entamoeba invadens
QPLFRLTALQAINCVLSKMSDYSQ

SEQ ID NO: 2802563 - protein, 17 aa, Entamoeba invadens
QPNSVYFDPAFYEVVGF

SEQ ID NO: 2802564 - protein, 24 aa, Entamoeba invadens
QPPECKTTEMGYCTGCIDNYFISG

SEQ ID NO: 2802565 - protein, 18 aa, Entamoeba invadens
QPPLITFYYCWELGYHFH

SEQ ID NO: 2802566 - protein, 25 aa, Entamoeba invadens
QPPQFKFPWEIADFVNNGKRLKQHA

SEQ ID NO: 2802567 - protein, 23 aa, Entamoeba invadens
QPQRIFEFIQFFIQTVLTPNEVF

SEQ ID NO: 2802568 - protein, 19 aa, Entamoeba invadens
QPRFDQFKASLSIGENKIS

SEQ ID NO: 2802569 - protein, 22 aa, Entamoeba invadens
QPSFYLICIIAVSVTTLPQIGA

SEQ ID NO: 2802570 - protein, 19 aa, Entamoeba invadens
QPWKIPQFVSSGKRLERPD

SEQ ID NO: 2802571 - protein, 21 aa, Entamoeba invadens
QPYILKLFFFILVGEIPNKSR

SEQ ID NO: 2802572 - protein, 23 aa, Entamoeba invadens
QQAFCPTCNKLVTTKVAHNMSAL

SEQ ID NO: 2802573 - protein, 26 aa, Entamoeba invadens
QQCVKCIDGYFLYERIWKCIRGEINN

SEQ ID NO: 2802574 - protein, 23 aa, Entamoeba invadens
QQEMRVMTWLGFIGGAKGVFYYS

SEQ ID NO: 2802575 - protein, 17 aa, Entamoeba invadens
QQFCKIVSTFFKNIETL

SEQ ID NO: 2802576 - protein, 18 aa, Entamoeba invadens
QQFHLFNFCSIFLQMLRN

SEQ ID NO: 2802577 - protein, 20 aa, Entamoeba invadens
QQFSHTWDVADFVLKGDRLP

SEQ ID NO: 2802578 - protein, 22 aa, Entamoeba invadens
QQGCSLCKDGYFIINSNECEKC

SEQ ID NO: 2802579 - protein, 24 aa, Entamoeba invadens
QQKKGESFWVIYVLVIVFYILFIV

SEQ ID NO: 2802580 - protein, 17 aa, Entamoeba invadens
QQKRISLTSGMSGAKLL

SEQ ID NO: 2802581 - protein, 20 aa, Entamoeba invadens
QQLKCTRCQTGMAFESSEYM

SEQ ID NO: 2802582 - protein, 22 aa, Entamoeba invadens
QQLLDIGLPFAVNVHPTNPTIP

SEQ ID NO: 2802583 - protein, 23 aa, Entamoeba invadens
QQLRVVLKSPKIVKGDKGHRKFG

SEQ ID NO: 2802584 - protein, 26 aa, Entamoeba invadens
QQLWKTVLVCVGPFLSTLIIGTIITG

SEQ ID NO: 2802585 - protein, 17 aa, Entamoeba invadens
QQNPEIHTTILLFQSNA

SEQ ID NO: 2802586 - protein, 23 aa, Entamoeba invadens
QQRGNLFFRQFVPFYEDADNNIV

SEQ ID NO: 2802587 - protein, 24 aa, Entamoeba invadens
QQSFCGICGSYFDQQCKNVSGLVS

SEQ ID NO: 2802588 - protein, 20 aa, Entamoeba invadens
QQSFKPGMKIMAIDKIEGIN

SEQ ID NO: 2802589 - protein, 27 aa, Entamoeba invadens
QQSGCFRCKDGFYLNEEYVCVACDKNC

SEQ ID NO: 2802590 - protein, 24 aa, Entamoeba invadens
QQSLEMLKRAGIRTWMLTGDKVET

SEQ ID NO: 2802591 - protein, 17 aa, Entamoeba invadens
QQSLSFAVKKVFKMLSS

SEQ ID NO: 2802592 - protein, 17 aa, Entamoeba invadens
QQSPDFMFGLPLESPRT

SEQ ID NO: 2802593 - protein, 17 aa, Entamoeba invadens
QQSRPYIYLEITQTGKL

SEQ ID NO: 2802594 - protein, 25 aa, Entamoeba invadens
QQTLGKLCMDWFFTFQEKSDVVYST

SEQ ID NO: 2802595 - protein, 19 aa, Entamoeba invadens
QQVLLRYKGMQLVTMVLVE

SEQ ID NO: 2802596 - protein, 23 aa, Entamoeba invadens
QQVVCPNCQQTVLTTVKYENGVF

SEQ ID NO: 2802597 - protein, 18 aa, Entamoeba invadens
QQVVMWLVKNGFCRVSEL

SEQ ID NO: 2802598 - protein, 18 aa, Entamoeba invadens
QRARRLKDPKAFKIKVII

SEQ ID NO: 2802599 - protein, 25 aa, Entamoeba invadens
QRCGNSWSCETCKTTFVLNSNNTCI

SEQ ID NO: 2802600 - protein, 25 aa, Entamoeba invadens
QRDSFGCGIHGRIMRKFEKNKEYFI

SEQ ID NO: 2802601 - protein, 27 aa, Entamoeba invadens
QRECLRGEDALPRYIQICKKIEEKKRE

SEQ ID NO: 2802602 - protein, 24 aa, Entamoeba invadens
QREKKYDFGLSMWNSLILLENVLY

SEQ ID NO: 2802603 - protein, 19 aa, Entamoeba invadens
QRFEEDFYRKFPIFKLPTE

SEQ ID NO: 2802604 - protein, 18 aa, Entamoeba invadens
QRFTEVYMCYFSIHCYYI

SEQ ID NO: 2802605 - protein, 21 aa, Entamoeba invadens
QRGECQLCSFWYAPNDKGTYC

SEQ ID NO: 2802606 - protein, 23 aa, Entamoeba invadens
QRGFVTVCVIGSMGPPIYLKILL

SEQ ID NO: 2802607 - protein, 26 aa, Entamoeba invadens
QRGSYCDRVGCILCTPCEDGSVQNTT

SEQ ID NO: 2802608 - protein, 23 aa, Entamoeba invadens
QRIALARIIYRNCDIVLLDDVSS

SEQ ID NO: 2802609 - protein, 23 aa, Entamoeba invadens
QRIFFVLDFSFFIVCDLSLILPR

SEQ ID NO: 2802610 - protein, 26 aa, Entamoeba invadens
QRIVTEYHTPWGLCGIDLDKLPVNAF

SEQ ID NO: 2802611 - protein, 20 aa, Entamoeba invadens
QRIYESFVLADLLIAMRKTF

SEQ ID NO: 2802612 - protein, 19 aa, Entamoeba invadens
QRKCSVCRPSGMYPSDSTY

SEQ ID NO: 2802613 - protein, 22 aa, Entamoeba invadens
QRKTTMAVMSIVIGFIHLFIIV

SEQ ID NO: 2802614 - protein, 24 aa, Entamoeba invadens
QRKYKKPADVFSFAITMYECLSWE

SEQ ID NO: 2802615 - protein, 25 aa, Entamoeba invadens
QRLELIQIRLAKEMYDRKQREKNES

SEQ ID NO: 2802616 - protein, 23 aa, Entamoeba invadens
QRLIWRISRGLVLIKSKDLSDNS

SEQ ID NO: 2802617 - protein, 21 aa, Entamoeba invadens
QRLKLIVLGYYKFEITDKSNH

SEQ ID NO: 2802618 - protein, 18 aa, Entamoeba invadens
QRLLSILVSLLITSDCSN

SEQ ID NO: 2802619 - protein, 22 aa, Entamoeba invadens
QRMKFANLILLNSDYEVDTFVD

SEQ ID NO: 2802620 - protein, 17 aa, Entamoeba invadens
QRNRLQFTAKTGTTYYV

SEQ ID NO: 2802621 - protein, 18 aa, Entamoeba invadens
QRQAAWANKGCRTLALSY

SEQ ID NO: 2802622 - protein, 27 aa, Entamoeba invadens
QRQGMLLKRRYFRSLMKQDCGWHDIHM

SEQ ID NO: 2802623 - protein, 23 aa, Entamoeba invadens
QRQKEFAQFLALSKLPKSVTPVL

SEQ ID NO: 2802624 - protein, 19 aa, Entamoeba invadens
QRQSLPLGRSQEFAQQING

SEQ ID NO: 2802625 - protein, 18 aa, Entamoeba invadens
QRRNLPVFFKRDDKSYLT

SEQ ID NO: 2802626 - protein, 29 aa, Entamoeba invadens
QRSLISYVRMPIRLQSYVFNDCHVEYVSK

SEQ ID NO: 2802627 - protein, 25 aa, Entamoeba invadens
QRTDTFKGYSVRGLHVLSDGTYGIL

SEQ ID NO: 2802628 - protein, 18 aa, Entamoeba invadens
QRTTCRTCNLVRPLRASH

SEQ ID NO: 2802629 - protein, 17 aa, Entamoeba invadens
QRVCYIGINGFRVENKV

SEQ ID NO: 2802630 - protein, 24 aa, Entamoeba invadens
QRVDRYFQRFIGWVQLHGVLEGKQ

SEQ ID NO: 2802631 - protein, 20 aa, Entamoeba invadens
QRVEIPLAISARGEVSKIDI

SEQ ID NO: 2802632 - protein, 25 aa, Entamoeba invadens
QRVELKIKKFCSIIRIIEVTQVNLK

SEQ ID NO: 2802633 - protein, 22 aa, Entamoeba invadens
QRVFDLILRQGRPDEEDNVTGG

SEQ ID NO: 2802634 - protein, 20 aa, Entamoeba invadens
QRVGAGITFGEMVRNSTILF

SEQ ID NO: 2802635 - protein, 27 aa, Entamoeba invadens
QRYETKCSLCGLRILPKQKFVVKSGAY

SEQ ID NO: 2802636 - protein, 21 aa, Entamoeba invadens
QSACIRVPNCLEIDTETQGKC

SEQ ID NO: 2802637 - protein, 19 aa, Entamoeba invadens
QSALTVNGFFHFKNLNLES

SEQ ID NO: 2802638 - protein, 25 aa, Entamoeba invadens
QSAMIQSRIEIIPEFYSTPEVFLDM

SEQ ID NO: 2802639 - protein, 22 aa, Entamoeba invadens
QSCEICQRWTYSYGKNCVECEE

SEQ ID NO: 2802640 - protein, 26 aa, Entamoeba invadens
QSCEICRRGTYSYGIECVDCEEMKYQ

SEQ ID NO: 2802641 - protein, 22 aa, Entamoeba invadens
QSCEICRRGTYSYGTKCVDCEE

SEQ ID NO: 2802642 - protein, 17 aa, Entamoeba invadens
QSDLVVLMLFYVCLDCF

SEQ ID NO: 2802643 - protein, 20 aa, Entamoeba invadens
QSFLELLKNYGLKKQALQLK

SEQ ID NO: 2802644 - protein, 17 aa, Entamoeba invadens
QSFLLRMLYLGIYPLDC

SEQ ID NO: 2802645 - protein, 22 aa, Entamoeba invadens
QSGCLKCQDGYHIANTNECQKC

SEQ ID NO: 2802646 - protein, 23 aa, Entamoeba invadens
QSGCLKCQDGYHIANTNECQKCN

SEQ ID NO: 2802647 - protein, 24 aa, Entamoeba invadens
QSGCLQCADGYFVLDQICVLCSFK

SEQ ID NO: 2802648 - protein, 26 aa, Entamoeba invadens
QSGGCVKCIDGYYREGLNCFKCNEKC

SEQ ID NO: 2802649 - protein, 21 aa, Entamoeba invadens
QSGICTTCISGYYIDKTGNCQ

SEQ ID NO: 2802650 - protein, 24 aa, Entamoeba invadens
QSGLGLEVDIIWVLGNLVSVTDFS

SEQ ID NO: 2802651 - protein, 20 aa, Entamoeba invadens
QSGRCNLCVQNYILKNDECV

SEQ ID NO: 2802652 - protein, 26 aa, Entamoeba invadens
QSGSSCKKCDSTYCLSNDGCYPFISN

SEQ ID NO: 2802653 - protein, 27 aa, Entamoeba invadens
QSHKCLRIKSIECGKYFYPSKDFTTCL

SEQ ID NO: 2802654 - protein, 25 aa, Entamoeba invadens
QSIKIRILYFTALMRQDMGWYDHQE

SEQ ID NO: 2802655 - protein, 26 aa, Entamoeba invadens
QSILYRIGLLSDWYSIGFGFISNQNL

SEQ ID NO: 2802656 - protein, 23 aa, Entamoeba invadens
QSINGLEPLQWIRKFAEEQTFLK

SEQ ID NO: 2802657 - protein, 20 aa, Entamoeba invadens
QSKEWLFVFVDIAVGLVTQK

SEQ ID NO: 2802658 - protein, 23 aa, Entamoeba invadens
QSKFPSLCVVVYSTVLEFYADNP

SEQ ID NO: 2802659 - protein, 24 aa, Entamoeba invadens
QSKWRYPRIDPVASNDLYNRLDSS

SEQ ID NO: 2802660 - protein, 17 aa, Entamoeba invadens
QSLAVSMLLQLIKNQDK

SEQ ID NO: 2802661 - protein, 17 aa, Entamoeba invadens
QSLINLNLWTPVKLSHF

SEQ ID NO: 2802662 - protein, 22 aa, Entamoeba invadens
QSLIRLLSCMNIDIFYYFIEQI

SEQ ID NO: 2802663 - protein, 22 aa, Entamoeba invadens
QSLPVEWRVNFFDKFREVSLLH

SEQ ID NO: 2802664 - protein, 26 aa, Entamoeba invadens
QSLTICLFICGFFFVLLWPFAFIASR

SEQ ID NO: 2802665 - protein, 27 aa, Entamoeba invadens
QSLTICLFICGFFFVLLWPFAFIASRK

SEQ ID NO: 2802666 - protein, 23 aa, Entamoeba invadens
QSLVSCLRCKDAYYFNSSSNRCE

SEQ ID NO: 2802667 - protein, 19 aa, Entamoeba invadens
QSMPEFFIGLVGYALIGDV

SEQ ID NO: 2802668 - protein, 20 aa, Entamoeba invadens
QSNFFCCGSTALAQFQERLH

SEQ ID NO: 2802669 - protein, 25 aa, Entamoeba invadens
QSNFFSFKASDFFHLSVKPQLADTD

SEQ ID NO: 2802670 - protein, 23 aa, Entamoeba invadens
QSNIPFLAINAFDDPIAIIPDVT

SEQ ID NO: 2802671 - protein, 25 aa, Entamoeba invadens
QSNRCLKCSKGYLLVAGSCQKSTNC

SEQ ID NO: 2802672 - protein, 25 aa, Entamoeba invadens
QSNRCLKCSKGYSLVAGRCQKSTNC

SEQ ID NO: 2802673 - protein, 19 aa, Entamoeba invadens
QSPMLFVYYCWELGYHTHS

SEQ ID NO: 2802674 - protein, 24 aa, Entamoeba invadens
QSQDCLVCTFGTYSKGGDPTCTKC

SEQ ID NO: 2802675 - protein, 29 aa, Entamoeba invadens
QSQNRFALMHAVKCMSEILSLPSTNQKQK

SEQ ID NO: 2802676 - protein, 21 aa, Entamoeba invadens
QSRLSFDLLQCQKISNFTAKN

SEQ ID NO: 2802677 - protein, 22 aa, Entamoeba invadens
QSRRRLIVCVKKPSFMLTTKNA

SEQ ID NO: 2802678 - protein, 23 aa, Entamoeba invadens
QSSARIANLIPFNSHIPSLPKNI

SEQ ID NO: 2802679 - protein, 21 aa, Entamoeba invadens
QSSCIKCPVGTFMNKTGATSC

SEQ ID NO: 2802680 - protein, 20 aa, Entamoeba invadens
QSSCTPCIAGYFQNKESSTT

SEQ ID NO: 2802681 - protein, 23 aa, Entamoeba invadens
QSSLLSYTWKCETPRKLFEKRTR

SEQ ID NO: 2802682 - protein, 20 aa, Entamoeba invadens
QSTCLACGAGTYSNGTSKIS

SEQ ID NO: 2802683 - protein, 22 aa, Entamoeba invadens
QSTCLICPAGKYSSGYSKISCT

SEQ ID NO: 2802684 - protein, 27 aa, Entamoeba invadens
QSTCLKSKLNRCFNCNQGYSLEDGVCY

SEQ ID NO: 2802685 - protein, 18 aa, Entamoeba invadens
QSTHFKSMVYPLDETNNT

SEQ ID NO: 2802686 - protein, 25 aa, Entamoeba invadens
QSTTCLLCGNGFYSTKGSLNCLSCS

SEQ ID NO: 2802687 - protein, 28 aa, Entamoeba invadens
QSVCILLKMCVISVSLIMFCYMESVTKA

SEQ ID NO: 2802688 - protein, 19 aa, Entamoeba invadens
QSVCLACSTNCYIDGSCTL

SEQ ID NO: 2802689 - protein, 18 aa, Entamoeba invadens
QSVKRAVQLNSHVDMATF

SEQ ID NO: 2802690 - protein, 24 aa, Entamoeba invadens
QSVPCKDCTFASKEAHSYFEDLIS

SEQ ID NO: 2802691 - protein, 25 aa, Entamoeba invadens
QSVVIRARITRMLSVFSTKILPLLS

SEQ ID NO: 2802692 - protein, 20 aa, Entamoeba invadens
QSYHCIRAECPYQNNSIDCG

SEQ ID NO: 2802693 - protein, 18 aa, Entamoeba invadens
QSYWHIFAIIVIYIVVDG

SEQ ID NO: 2802694 - protein, 24 aa, Entamoeba invadens
QTALARLIVDFIFTITYGVDYSPK

SEQ ID NO: 2802695 - protein, 18 aa, Entamoeba invadens
QTCDCVPIGNSIFDQFKS

SEQ ID NO: 2802696 - protein, 20 aa, Entamoeba invadens
QTCLKCFAPYVINDMTSECV

SEQ ID NO: 2802697 - protein, 19 aa, Entamoeba invadens
QTCLSCASGSYKNTETSCE

SEQ ID NO: 2802698 - protein, 17 aa, Entamoeba invadens
QTCNYCYTKNGDVTCNN

SEQ ID NO: 2802699 - protein, 23 aa, Entamoeba invadens
QTCQKCPYGFYKDVYSCKSVEDN

SEQ ID NO: 2802700 - protein, 27 aa, Entamoeba invadens
QTCQQCSLEFGILCEKCDNKGCIKCSE

SEQ ID NO: 2802701 - protein, 21 aa, Entamoeba invadens
QTCTICPAGYFSKSGNATCTI

SEQ ID NO: 2802702 - protein, 19 aa, Entamoeba invadens
QTDGLLFFMAFKRIELYIK

SEQ ID NO: 2802703 - protein, 24 aa, Entamoeba invadens
QTDKCFECGLGMYPSDGNCVTCTS

SEQ ID NO: 2802704 - protein, 17 aa, Entamoeba invadens
QTECKMCDISCASCDAI

SEQ ID NO: 2802705 - protein, 27 aa, Entamoeba invadens
QTEILKHSWLPFEILKKSISQIGADQS

SEQ ID NO: 2802706 - protein, 25 aa, Entamoeba invadens
QTEIPPFRLCLADFGEACVYRNDKE

SEQ ID NO: 2802707 - protein, 27 aa, Entamoeba invadens
QTEKMVFSGFLSFCLSNLKNTMKSSCY

SEQ ID NO: 2802708 - protein, 20 aa, Entamoeba invadens
QTFNHSWDVSDFVIKGGRLD

SEQ ID NO: 2802709 - protein, 27 aa, Entamoeba invadens
QTGVLLLEILLRFYGAAHVEIFSDLLP

SEQ ID NO: 2802710 - protein, 25 aa, Entamoeba invadens
QTIFNWELLSVGTFLQYCISILEHT

SEQ ID NO: 2802711 - protein, 17 aa, Entamoeba invadens
QTIKSREVVLYWEQENW

SEQ ID NO: 2802712 - protein, 26 aa, Entamoeba invadens
QTILCLRFIPWYVVWINIIGHIIYLM

SEQ ID NO: 2802713 - protein, 25 aa, Entamoeba invadens
QTINKLLRCKLGFFDITPIGRIQNL

SEQ ID NO: 2802714 - protein, 18 aa, Entamoeba invadens
QTIPSAWPKTTVISEYNE

SEQ ID NO: 2802715 - protein, 20 aa, Entamoeba invadens
QTIRGSDCVECITGNHINNS

SEQ ID NO: 2802716 - protein, 24 aa, Entamoeba invadens
QTKCTDCLMGYGLKSGNCTKCEKT

SEQ ID NO: 2802717 - protein, 23 aa, Entamoeba invadens
QTKGDLYLGVPMKNGGNYEHPVC

SEQ ID NO: 2802718 - protein, 20 aa, Entamoeba invadens
QTLFKCLKEDVGYIKLETNT

SEQ ID NO: 2802719 - protein, 24 aa, Entamoeba invadens
QTLKELPPHVVIRHVYDGGSECAI

SEQ ID NO: 2802720 - protein, 20 aa, Entamoeba invadens
QTLKPSYAIDVTFTIKPLCT

SEQ ID NO: 2802721 - protein, 23 aa, Entamoeba invadens
QTMKGVICPEGQYVDVNNVCQDC

SEQ ID NO: 2802722 - protein, 28 aa, Entamoeba invadens
QTNCALVRNRFCGICKTGYVITGNGCEP

SEQ ID NO: 2802723 - protein, 18 aa, Entamoeba invadens
QTNENGCYLCENNYFLSS

SEQ ID NO: 2802724 - protein, 24 aa, Entamoeba invadens
QTNSFRPKSLLYFTLSFSAASLIL

SEQ ID NO: 2802725 - protein, 21 aa, Entamoeba invadens
QTRVWPSLLLLVTIVALLSVV

SEQ ID NO: 2802726 - protein, 21 aa, Entamoeba invadens
QTSCLLCTYGYYLDNNSCTRC

SEQ ID NO: 2802727 - protein, 23 aa, Entamoeba invadens
QTSCLSCTPGYYLNGSTCTKCIP

SEQ ID NO: 2802728 - protein, 31 aa, Entamoeba invadens
QTSCRICMLCGAPLCSENYCLIQHGKTCSNG

SEQ ID NO: 2802729 - protein, 35 aa, Entamoeba invadens
QTSDTLLWYVLHSRYTKWIIHQSVATSWKETLLTV

SEQ ID NO: 2802730 - protein, 22 aa, Entamoeba invadens
QTSPVDYGFCYSRQKYTISKWG

SEQ ID NO: 2802731 - protein, 17 aa, Entamoeba invadens
QTTHLKVGGAFNATTLS

SEQ ID NO: 2802732 - protein, 29 aa, Entamoeba invadens
QTTSLLASVVFFKCNMSDITFNKVQMRNV

SEQ ID NO: 2802733 - protein, 24 aa, Entamoeba invadens
QTVECFGGFFPFENTCVSIQNYKK

SEQ ID NO: 2802734 - protein, 17 aa, Entamoeba invadens
QTVLKFQSDKNVPIYIG

SEQ ID NO: 2802735 - protein, 20 aa, Entamoeba invadens
QTVWWVILIVVMFVLIVLFV

SEQ ID NO: 2802736 - protein, 18 aa, Entamoeba invadens
QTYSSIGICLKCKEGYIL

SEQ ID NO: 2802737 - protein, 24 aa, Entamoeba invadens
QVAIKKLRFVEGEAMIDFGKEVDM

SEQ ID NO: 2802738 - protein, 23 aa, Entamoeba invadens
QVCKESKELLCVGNMTSKTLKIQ

SEQ ID NO: 2802739 - protein, 26 aa, Entamoeba invadens
QVCSLFCALGDFIGRLLEFIPKTPPT

SEQ ID NO: 2802740 - protein, 24 aa, Entamoeba invadens
QVCVPCLKTGCIHCQGENGKCLKC

SEQ ID NO: 2802741 - protein, 18 aa, Entamoeba invadens
QVEMKLLFPEASVYLTSQ

SEQ ID NO: 2802742 - protein, 22 aa, Entamoeba invadens
QVEWLYSLDVCYQVTAELFRRN

SEQ ID NO: 2802743 - protein, 28 aa, Entamoeba invadens
QVFFTLRFFLYFEHRWGILIFCATYLLT

SEQ ID NO: 2802744 - protein, 17 aa, Entamoeba invadens
QVFKNEFLVKSGQETYK

SEQ ID NO: 2802745 - protein, 17 aa, Entamoeba invadens
QVFNFISLIFFPITLVV

SEQ ID NO: 2802746 - protein, 25 aa, Entamoeba invadens
QVGTSCFDCAPGTHSDGFTCSPCAS

SEQ ID NO: 2802747 - protein, 19 aa, Entamoeba invadens
QVICNTCQIGYFPEIQCKS

SEQ ID NO: 2802748 - protein, 26 aa, Entamoeba invadens
QVIELNLNAAVGWSVLMELEGGAFRT

SEQ ID NO: 2802749 - protein, 18 aa, Entamoeba invadens
QVIGRIAFIHAVETEETT

SEQ ID NO: 2802750 - protein, 23 aa, Entamoeba invadens
QVISYRDMINFVIFFIKKKLGKT

SEQ ID NO: 2802751 - protein, 23 aa, Entamoeba invadens
QVKKCSIHPNFVIAAEKCRVVVL

SEQ ID NO: 2802752 - protein, 20 aa, Entamoeba invadens
QVLMPPLFVMGKTALPLIRA

SEQ ID NO: 2802753 - protein, 24 aa, Entamoeba invadens
QVLNRMVSGLIYFFVTPLIDIQFH

SEQ ID NO: 2802754 - protein, 25 aa, Entamoeba invadens
QVLRCDGGSIVKCFLQNNTNCLPVC

SEQ ID NO: 2802755 - protein, 20 aa, Entamoeba invadens
QVMCKNLVVLGAVSSTTQIC

SEQ ID NO: 2802756 - protein, 25 aa, Entamoeba invadens
QVQYRPSFWIKVDLAGVVNTQSHYK

SEQ ID NO: 2802757 - protein, 28 aa, Entamoeba invadens
QVRVQRFSICFFKACYFFFTTPMGILLF

SEQ ID NO: 2802758 - protein, 23 aa, Entamoeba invadens
QVSKCLNGYCLKCNSNCNACVGT

SEQ ID NO: 2802759 - protein, 23 aa, Entamoeba invadens
QVSPCGIPTFLISPKNYSAVTSH

SEQ ID NO: 2802760 - protein, 25 aa, Entamoeba invadens
QVVLKYIHCFTIPLLGFMNCLYYAK

SEQ ID NO: 2802761 - protein, 31 aa, Entamoeba invadens
QVVSWSIVITAIFCSFTISFIVGVMGILICA

SEQ ID NO: 2802762 - protein, 17 aa, Entamoeba invadens
QVVWWVILIIVVFIIVL

SEQ ID NO: 2802763 - protein, 19 aa, Entamoeba invadens
QWGTRAAAVFSVVLSGLAP

SEQ ID NO: 2802764 - protein, 25 aa, Entamoeba invadens
QWLANCSNPSVFVFLMDLVDDIATN

SEQ ID NO: 2802765 - protein, 21 aa, Entamoeba invadens
QWLCRLPFQFLFATLYWAYKK

SEQ ID NO: 2802766 - protein, 19 aa, Entamoeba invadens
QWYVDIMLQLISVYGDYIA

SEQ ID NO: 2802767 - protein, 40 aa, Entamoeba invadens
QYCGESNYGLFGRIFGDICAWISGLLYFVGRFPQAWHLYK

SEQ ID NO: 2802768 - protein, 17 aa, Entamoeba invadens
QYCRCESNLILKNHFCI

SEQ ID NO: 2802769 - protein, 18 aa, Entamoeba invadens
QYCSSCSAGTYSQSGASF

SEQ ID NO: 2802770 - protein, 26 aa, Entamoeba invadens
QYDLLIELSNTFGLFIDKHLTETHAV

SEQ ID NO: 2802771 - protein, 24 aa, Entamoeba invadens
QYDPSCTFVNLVFTCLRQLSDVPL

SEQ ID NO: 2802772 - protein, 25 aa, Entamoeba invadens
QYDRFYACGSTAIFGTIDGRAKVMG

SEQ ID NO: 2802773 - protein, 17 aa, Entamoeba invadens
QYELKVIEGCIRQNGDN

SEQ ID NO: 2802774 - protein, 24 aa, Entamoeba invadens
QYEVKQVCNIYVALVKKGYTVTEC

SEQ ID NO: 2802775 - protein, 17 aa, Entamoeba invadens
QYFYMKFEILKIEEDYE

SEQ ID NO: 2802776 - protein, 18 aa, Entamoeba invadens
QYGCISCDIGYYLSNTKC

SEQ ID NO: 2802777 - protein, 18 aa, Entamoeba invadens
QYHCPILSKKLVEIRADI

SEQ ID NO: 2802778 - protein, 19 aa, Entamoeba invadens
QYIDFGSSIEANMPPPPQQ

SEQ ID NO: 2802779 - protein, 23 aa, Entamoeba invadens
QYILELYYQFAMDYISAPQLHMT

SEQ ID NO: 2802780 - protein, 22 aa, Entamoeba invadens
QYITDVNGFFGFERSLYEGISM

SEQ ID NO: 2802781 - protein, 24 aa, Entamoeba invadens
QYITWYITFSLFFTMVIFSILIGS

SEQ ID NO: 2802782 - protein, 19 aa, Entamoeba invadens
QYLCPDVICRIGFVLQATC

SEQ ID NO: 2802783 - protein, 18 aa, Entamoeba invadens
QYLDTVQYLPSFDAFGLD

SEQ ID NO: 2802784 - protein, 23 aa, Entamoeba invadens
QYLLSERSLCFSGLTQGIDYDIP

SEQ ID NO: 2802785 - protein, 23 aa, Entamoeba invadens
QYNKNCLLCLSNYCDLCDDTTYF

SEQ ID NO: 2802786 - protein, 20 aa, Entamoeba invadens
QYNLCFDTRLSKCVDLLLEE

SEQ ID NO: 2802787 - protein, 17 aa, Entamoeba invadens
QYQEKINQFMVAKQKAE

SEQ ID NO: 2802788 - protein, 20 aa, Entamoeba invadens
QYSDGSVCINCHFGDSYNKC

SEQ ID NO: 2802789 - protein, 18 aa, Entamoeba invadens
QYSFGVMMYEVFDQTKPY

SEQ ID NO: 2802790 - protein, 17 aa, Entamoeba invadens
QYSKMYIGGFVKIHDDF

SEQ ID NO: 2802791 - protein, 25 aa, Entamoeba invadens
QYSKTVTFLPAFDAYGMDIYPVNQS

SEQ ID NO: 2802792 - protein, 18 aa, Entamoeba invadens
QYSQGRCVLCDDGYVTTD

SEQ ID NO: 2802793 - protein, 32 aa, Entamoeba invadens
QYTLPKDCRSGDCIPRYPMSCMETEYFGEILK

SEQ ID NO: 2802794 - protein, 25 aa, Entamoeba invadens
QYVTPNHCFECYAGAHLEIRNTDNS

SEQ ID NO: 2802795 - protein, 22 aa, Entamoeba invadens
QYYKNLKWVLENSVEDLDMKFC

SEQ ID NO: 2802796 - protein, 20 aa, Entamoeba invadens
RAAFTISFILLIGYFLGVIF

SEQ ID NO: 2802797 - protein, 17 aa, Entamoeba invadens
RAARILLMIDPAFGGTE

SEQ ID NO: 2802798 - protein, 17 aa, Entamoeba invadens
RACEFQIFITPYCTCDL

SEQ ID NO: 2802799 - protein, 24 aa, Entamoeba invadens
RADGFGVEILPMLKYIGKTQSYAQ

SEQ ID NO: 2802800 - protein, 26 aa, Entamoeba invadens
RAEEIIWILCFMNFISRQSANDVRDA

SEQ ID NO: 2802801 - protein, 21 aa, Entamoeba invadens
RAEMLRELLIKEMKNGRFDPL

SEQ ID NO: 2802802 - protein, 18 aa, Entamoeba invadens
RAFFPLKQNRNFKWTMSQ

SEQ ID NO: 2802803 - protein, 20 aa, Entamoeba invadens
RAFITIRALIEIARDEEFLY

SEQ ID NO: 2802804 - protein, 18 aa, Entamoeba invadens
RAFQLSVTFMSKLLLHIA

SEQ ID NO: 2802805 - protein, 17 aa, Entamoeba invadens
RAFYYFMAISFIGVETA

SEQ ID NO: 2802806 - protein, 18 aa, Entamoeba invadens
RAGIDGGSRVEHILINGV

SEQ ID NO: 2802807 - protein, 22 aa, Entamoeba invadens
RAICYCTYDPAIVQDCVLKCPD

SEQ ID NO: 2802808 - protein, 21 aa, Entamoeba invadens
RAIFRQEWMQFVLIYFTTAIY

SEQ ID NO: 2802809 - protein, 19 aa, Entamoeba invadens
RAILDECEMCVKINETDFF

SEQ ID NO: 2802810 - protein, 18 aa, Entamoeba invadens
RAILNILKEFYINDYVTV

SEQ ID NO: 2802811 - protein, 17 aa, Entamoeba invadens
RAIRIPFMPPPNVEKDK

SEQ ID NO: 2802812 - protein, 21 aa, Entamoeba invadens
RAITFDLLFLIDFTLPKEQEE

SEQ ID NO: 2802813 - protein, 19 aa, Entamoeba invadens
RAKPIPIIFGMLYSQLKCL

SEQ ID NO: 2802814 - protein, 29 aa, Entamoeba invadens
RALEWCLKKIYPKRMETYLVPFSSECGFL

SEQ ID NO: 2802815 - protein, 17 aa, Entamoeba invadens
RALFRTHQDLLWGSIFN

SEQ ID NO: 2802816 - protein, 19 aa, Entamoeba invadens
RALGELCKFGTKCELTCDT

SEQ ID NO: 2802817 - protein, 18 aa, Entamoeba invadens
RALGLLKALLIEILVTES

SEQ ID NO: 2802818 - protein, 17 aa, Entamoeba invadens
RALLRGAKILIMDEATA

SEQ ID NO: 2802819 - protein, 19 aa, Entamoeba invadens
RALYDLCLNFYETEVDAKD

SEQ ID NO: 2802820 - protein, 21 aa, Entamoeba invadens
RANFCKERGFKLVDIGYPARY

SEQ ID NO: 2802821 - protein, 17 aa, Entamoeba invadens
RAQGWMGNGYIKFSTVF

SEQ ID NO: 2802822 - protein, 18 aa, Entamoeba invadens
RARDSVYEIFQRFVKSEV

SEQ ID NO: 2802823 - protein, 21 aa, Entamoeba invadens
RASKYYLKNVVDLFLKTVNGV

SEQ ID NO: 2802824 - protein, 21 aa, Entamoeba invadens
RAVFITDLYLGSTRKLSQDQI

SEQ ID NO: 2802825 - protein, 26 aa, Entamoeba invadens
RAVFKDNMSVYVFIFSLFDSFQGMLL

SEQ ID NO: 2802826 - protein, 22 aa, Entamoeba invadens
RAVSCTLCSDGQYAPKTNSSNC

SEQ ID NO: 2802827 - protein, 21 aa, Entamoeba invadens
RAVVQAHTFIDVPLRYWPFTY

SEQ ID NO: 2802828 - protein, 17 aa, Entamoeba invadens
RAVWSVIIVAFFVCSYC

SEQ ID NO: 2802829 - protein, 19 aa, Entamoeba invadens
RAVWWVILVIVLFILFVLT

SEQ ID NO: 2802830 - protein, 19 aa, Entamoeba invadens
RAVWWVILVVVLFIIFVLS

SEQ ID NO: 2802831 - protein, 20 aa, Entamoeba invadens
RAYHCKKCGSCIKKRDHCPW

SEQ ID NO: 2802832 - protein, 20 aa, Entamoeba invadens
RCAACQDVNCVMCDGDNGNC

SEQ ID NO: 2802833 - protein, 28 aa, Entamoeba invadens
RCALKYQNCSLCDIIRPINCIANYYLSK

SEQ ID NO: 2802834 - protein, 18 aa, Entamoeba invadens
RCDDKCLTCENAFECLSC

SEQ ID NO: 2802835 - protein, 18 aa, Entamoeba invadens
RCDDKYKLSDDMLSCIYT

SEQ ID NO: 2802836 - protein, 22 aa, Entamoeba invadens
RCDDKYYLLFGNCVSCDGNCDT

SEQ ID NO: 2802837 - protein, 26 aa, Entamoeba invadens
RCDETKCVLCANGYKVSQLGKCESVI

SEQ ID NO: 2802838 - protein, 18 aa, Entamoeba invadens
RCDGSYYLSELKCVATNN

SEQ ID NO: 2802839 - protein, 17 aa, Entamoeba invadens
RCDGSYYLSEYKCVATN

SEQ ID NO: 2802840 - protein, 18 aa, Entamoeba invadens
RCEAPRDPAHCISFVRNN

SEQ ID NO: 2802841 - protein, 17 aa, Entamoeba invadens
RCEMGYYPISNGSCIPC

SEQ ID NO: 2802842 - protein, 19 aa, Entamoeba invadens
RCFECNKSFDDFFVPNLIG

SEQ ID NO: 2802843 - protein, 23 aa, Entamoeba invadens
RCFQPCIYEDDFIYTTVLNVTGK

SEQ ID NO: 2802844 - protein, 23 aa, Entamoeba invadens
RCGICPAGKYYGDYSTSWTVLLL

SEQ ID NO: 2802845 - protein, 17 aa, Entamoeba invadens
RCGVLVLILHDLVDMIM

SEQ ID NO: 2802846 - protein, 18 aa, Entamoeba invadens
RCITCADMQYSLTGSTTC

SEQ ID NO: 2802847 - protein, 18 aa, Entamoeba invadens
RCKKSPNFDKVWRPPLFT

SEQ ID NO: 2802848 - protein, 29 aa, Entamoeba invadens
RCLKIKNLLKEWWPQVVKFSKEIYNLRHI

SEQ ID NO: 2802849 - protein, 17 aa, Entamoeba invadens
RCNDGFYLKNNKCLECD

SEQ ID NO: 2802850 - protein, 18 aa, Entamoeba invadens
RCNFCDATCGGKCDTTNG

SEQ ID NO: 2802851 - protein, 18 aa, Entamoeba invadens
RCNGGFYLMNSVCVQCEY

SEQ ID NO: 2802852 - protein, 18 aa, Entamoeba invadens
RCPADRYFDISTLSCMPC

SEQ ID NO: 2802853 - protein, 19 aa, Entamoeba invadens
RCQKGTYPQNVDPFKCVDC

SEQ ID NO: 2802854 - protein, 20 aa, Entamoeba invadens
RCSDGFYLDNLKCIPCENNC

SEQ ID NO: 2802855 - protein, 17 aa, Entamoeba invadens
RCSGCESIYGCIECTSD

SEQ ID NO: 2802856 - protein, 23 aa, Entamoeba invadens
RCSKCADSNCMECKDITDVLIDG

SEQ ID NO: 2802857 - protein, 19 aa, Entamoeba invadens
RCSKCASKYYLTYDTKECV

SEQ ID NO: 2802858 - protein, 22 aa, Entamoeba invadens
RCSLENVGFVKVNFVGVLFENV

SEQ ID NO: 2802859 - protein, 18 aa, Entamoeba invadens
RCSRGFKLVDGVCLPCFK

SEQ ID NO: 2802860 - protein, 26 aa, Entamoeba invadens
RCSTGEWDDECWFEESVLQFNGFPFD

SEQ ID NO: 2802861 - protein, 26 aa, Entamoeba invadens
RCTFLKKEGFNTFKLTKKDGNIVFRK

SEQ ID NO: 2802862 - protein, 20 aa, Entamoeba invadens
RCVCCCYRFMYVVPSVMAKA

SEQ ID NO: 2802863 - protein, 17 aa, Entamoeba invadens
RCVDMWTGERIGVLASS

SEQ ID NO: 2802864 - protein, 26 aa, Entamoeba invadens
RCVGNDCLLCDAGYLLVQQNGVGICD

SEQ ID NO: 2802865 - protein, 20 aa, Entamoeba invadens
RCVLCDSDLQFGYNEMTGEV

SEQ ID NO: 2802866 - protein, 20 aa, Entamoeba invadens
RCVRCKSTFYLTENHTCLNC

SEQ ID NO: 2802867 - protein, 31 aa, Entamoeba invadens
RCVTCSPLFERKCIKCVAGSYPQTAGDFKCK

SEQ ID NO: 2802868 - protein, 31 aa, Entamoeba invadens
RCVTCSPSFARKCVKCVAGSYPQTAGDFRCK

SEQ ID NO: 2802869 - protein, 21 aa, Entamoeba invadens
RCVTCSPSFARKCVNCVAGSY

SEQ ID NO: 2802870 - protein, 29 aa, Entamoeba invadens
RCVTCSPSFVRKCIKCVAGSYPQTAGDFR

SEQ ID NO: 2802871 - protein, 19 aa, Entamoeba invadens
RCYQCQTGYFVKDNKCSKC

SEQ ID NO: 2802872 - protein, 22 aa, Entamoeba invadens
RDAFMSFAKRAEVDVQFENVNL

SEQ ID NO: 2802873 - protein, 17 aa, Entamoeba invadens
RDAYSACMPGKIMRVIR

SEQ ID NO: 2802874 - protein, 25 aa, Entamoeba invadens
RDDQCMWWNVPNCISYIERGVCATC

SEQ ID NO: 2802875 - protein, 18 aa, Entamoeba invadens
RDDTCVTCAHGYKKDVAN

SEQ ID NO: 2802876 - protein, 17 aa, Entamoeba invadens
RDEILFNSLWKAIQSND

SEQ ID NO: 2802877 - protein, 30 aa, Entamoeba invadens
RDELKFMHVFPLCFLHVLFNGYLIILKYFS

SEQ ID NO: 2802878 - protein, 19 aa, Entamoeba invadens
RDENCILCSLFDNNCVECS

SEQ ID NO: 2802879 - protein, 24 aa, Entamoeba invadens
RDFSSFKSSIVIKSIRMKKEVSGT

SEQ ID NO: 2802880 - protein, 17 aa, Entamoeba invadens
RDFWITFAVSLGVSHLV

SEQ ID NO: 2802881 - protein, 22 aa, Entamoeba invadens
RDGCGRTPLHVAVVMNDALSVK

SEQ ID NO: 2802882 - protein, 18 aa, Entamoeba invadens
RDGLTIATLATFSLLDLS

SEQ ID NO: 2802883 - protein, 21 aa, Entamoeba invadens
RDGNCSLCGNGQIDSGEECEN

SEQ ID NO: 2802884 - protein, 22 aa, Entamoeba invadens
RDGSRIHSDFIYLKPINFALFS

SEQ ID NO: 2802885 - protein, 24 aa, Entamoeba invadens
RDHHCPWVNSCVGKNNMKFFLQFM

SEQ ID NO: 2802886 - protein, 19 aa, Entamoeba invadens
RDIFGKVAVVTICVMTFVT

SEQ ID NO: 2802887 - protein, 17 aa, Entamoeba invadens
RDIRVVDHLVDYLKTLP

SEQ ID NO: 2802888 - protein, 27 aa, Entamoeba invadens
RDISSIENCHFCSTDIYESVFSNLTIK

SEQ ID NO: 2802889 - protein, 25 aa, Entamoeba invadens
RDIVIKSGYVLRVCVCGYIIVIVTK

SEQ ID NO: 2802890 - protein, 24 aa, Entamoeba invadens
RDIYYEGNVCVLEYNSIELTINFG

SEQ ID NO: 2802891 - protein, 20 aa, Entamoeba invadens
RDLCLPYIFFVKDAETSRKR

SEQ ID NO: 2802892 - protein, 17 aa, Entamoeba invadens
RDLGCESFSGDKCLNCA

SEQ ID NO: 2802893 - protein, 23 aa, Entamoeba invadens
RDLKPENVLVFSMRKKEKVNAKI

SEQ ID NO: 2802894 - protein, 23 aa, Entamoeba invadens
RDLWKMHPETGFVYSPVGTSFEE

SEQ ID NO: 2802895 - protein, 39 aa, Entamoeba invadens
RDLWLTTYSFEWQWTWMRYRHDVLLSFSLAQAVIPNADR

SEQ ID NO: 2802896 - protein, 19 aa, Entamoeba invadens
RDMKLPYTIWFSESVRTLS

SEQ ID NO: 2802897 - protein, 25 aa, Entamoeba invadens
RDMLSLPFKLSRLVNLTKLNISNNK

SEQ ID NO: 2802898 - protein, 23 aa, Entamoeba invadens
RDNKCDECSFSYVLGKDKVSCTF

SEQ ID NO: 2802899 - protein, 19 aa, Entamoeba invadens
RDPYPIIEFRDGDSVLNFV

SEQ ID NO: 2802900 - protein, 20 aa, Entamoeba invadens
RDRKRYATLPLYESKTPIFD

SEQ ID NO: 2802901 - protein, 19 aa, Entamoeba invadens
RDRVVAVKTMKCANMCDTD

SEQ ID NO: 2802902 - protein, 20 aa, Entamoeba invadens
RDRVVAVKTMKCANMCDTDD

SEQ ID NO: 2802903 - protein, 17 aa, Entamoeba invadens
RDSIDIYQVHHFLETSS

SEQ ID NO: 2802904 - protein, 23 aa, Entamoeba invadens
RDSKCTKCTFWHRPVSYGQYCEA

SEQ ID NO: 2802905 - protein, 25 aa, Entamoeba invadens
RDSLCLTCSEGSYKSDYRCYPNAEL

SEQ ID NO: 2802906 - protein, 18 aa, Entamoeba invadens
RDSRVLKYSVRSVSKYLP

SEQ ID NO: 2802907 - protein, 36 aa, Entamoeba invadens
RDTLDLLFIEICIGMAFSVFCFVGHIALLLRLVHIF

SEQ ID NO: 2802908 - protein, 21 aa, Entamoeba invadens
RDVERSVYYSGIFGKEAMYTI

SEQ ID NO: 2802909 - protein, 20 aa, Entamoeba invadens
RDVIHSMFLDGWSIWNGVIG

SEQ ID NO: 2802910 - protein, 24 aa, Entamoeba invadens
RDVKGENLLLFSLNPHSPVCAKLT

SEQ ID NO: 2802911 - protein, 24 aa, Entamoeba invadens
RDVKGENLLLFSLNPRSPVCAKLT

SEQ ID NO: 2802912 - protein, 19 aa, Entamoeba invadens
RDVKHYKRSIGYVSQTDYL

SEQ ID NO: 2802913 - protein, 17 aa, Entamoeba invadens
RDYCAKKMIPTCYNVLI

SEQ ID NO: 2802914 - protein, 39 aa, Entamoeba invadens
RDYPLTLAICLFFWVPGMIFCYSMMPNVQFTLRLILQFV

SEQ ID NO: 2802915 - protein, 18 aa, Entamoeba invadens
REAFKMDGIFALLNPYNW

SEQ ID NO: 2802916 - protein, 26 aa, Entamoeba invadens
REALKRVFGCQECVTFFRGDGKRIVG

SEQ ID NO: 2802917 - protein, 21 aa, Entamoeba invadens
REANPFIVILVIKLYFLSLSQ

SEQ ID NO: 2802918 - protein, 17 aa, Entamoeba invadens
RECKECNGERVCTLCVD

SEQ ID NO: 2802919 - protein, 20 aa, Entamoeba invadens
RECKECNKLSKMFMQNNLKC

SEQ ID NO: 2802920 - protein, 22 aa, Entamoeba invadens
RECPYRKLIKKCWQRKVDARPS

SEQ ID NO: 2802921 - protein, 17 aa, Entamoeba invadens
RECSLELYNSFLSGREC

SEQ ID NO: 2802922 - protein, 32 aa, Entamoeba invadens
REDKEFYFKLPYKLKVRMLYDTARGMQFLHEN

SEQ ID NO: 2802923 - protein, 20 aa, Entamoeba invadens
REDMKIYVIFYGHPKEIWIS

SEQ ID NO: 2802924 - protein, 18 aa, Entamoeba invadens
REDVAFELICNVMELVIP

SEQ ID NO: 2802925 - protein, 18 aa, Entamoeba invadens
REECTACVLIQLHMYQNV

SEQ ID NO: 2802926 - protein, 22 aa, Entamoeba invadens
REELFGLFRIFRIMDKNRTDDG

SEQ ID NO: 2802927 - protein, 18 aa, Entamoeba invadens
REEPYIKAVQVSVSPNKL

SEQ ID NO: 2802928 - protein, 17 aa, Entamoeba invadens
REFSIDAIQVIWDSFIS

SEQ ID NO: 2802929 - protein, 20 aa, Entamoeba invadens
REGLRGLVYGYRVMTQDEFD

SEQ ID NO: 2802930 - protein, 18 aa, Entamoeba invadens
REGVKLLKNYYYNYPDCV

SEQ ID NO: 2802931 - protein, 23 aa, Entamoeba invadens
REINLKFACCGWKTYNANSCSFT

SEQ ID NO: 2802932 - protein, 20 aa, Entamoeba invadens
REIPPIHAAVFLDSIQGKYP

SEQ ID NO: 2802933 - protein, 23 aa, Entamoeba invadens
REIQCPNAPIIILWSTMILVEIL

SEQ ID NO: 2802934 - protein, 17 aa, Entamoeba invadens
REISAFVSDCIMEGAAD

SEQ ID NO: 2802935 - protein, 25 aa, Entamoeba invadens
REIYVRYSCDVIRAINDEIGESYDK

SEQ ID NO: 2802936 - protein, 24 aa, Entamoeba invadens
REKHWASTVNMIFQVFAYPFISNA

SEQ ID NO: 2802937 - protein, 28 aa, Entamoeba invadens
REKLWAIANLILGIGFVFIAVVVVVLYL

SEQ ID NO: 2802938 - protein, 23 aa, Entamoeba invadens
REKSHFMFDIAFYAFFIGVLAVY

SEQ ID NO: 2802939 - protein, 18 aa, Entamoeba invadens
REKTRVLITQTFQYLPEC

SEQ ID NO: 2802940 - protein, 21 aa, Entamoeba invadens
RELNLRWLRNQIGLVGQEPVL

SEQ ID NO: 2802941 - protein, 29 aa, Entamoeba invadens
RELSQNFVEEWLLRFKAIDPLATDIKEQQ

SEQ ID NO: 2802942 - protein, 17 aa, Entamoeba invadens
RELTLFKIATIKKLTFL

SEQ ID NO: 2802943 - protein, 17 aa, Entamoeba invadens
REMKIPYTVWFSESKHT

SEQ ID NO: 2802944 - protein, 21 aa, Entamoeba invadens
REMKMMFEGFVNFLEDVETLE

SEQ ID NO: 2802945 - protein, 26 aa, Entamoeba invadens
REMVYISVLNYLGFSFLFVKPKKFII

SEQ ID NO: 2802946 - protein, 20 aa, Entamoeba invadens
RENSGFYLLNGICIPCDSTC

SEQ ID NO: 2802947 - protein, 21 aa, Entamoeba invadens
REPTLIFSMPIVRQTQISACI

SEQ ID NO: 2802948 - protein, 17 aa, Entamoeba invadens
REQKLILKLSVADGCLF

SEQ ID NO: 2802949 - protein, 24 aa, Entamoeba invadens
REQRICSLSFLPLGHVFAIVVEFI

SEQ ID NO: 2802950 - protein, 23 aa, Entamoeba invadens
RERFFGMMFPFVLFFLDDSEKIN

SEQ ID NO: 2802951 - protein, 17 aa, Entamoeba invadens
RERGVCVFPMKKSNIPM

SEQ ID NO: 2802952 - protein, 20 aa, Entamoeba invadens
RERKFSTTVATVFGVERTGY

SEQ ID NO: 2802953 - protein, 18 aa, Entamoeba invadens
RERLKYEIPHLGGNNDVI

SEQ ID NO: 2802954 - protein, 18 aa, Entamoeba invadens
RESCLTCNLTNYRTSNDE

SEQ ID NO: 2802955 - protein, 18 aa, Entamoeba invadens
RESCLTCNLTNYRTSNNK

SEQ ID NO: 2802956 - protein, 21 aa, Entamoeba invadens
RESDKVIEWFWNVFGEMEQRQ

SEQ ID NO: 2802957 - protein, 18 aa, Entamoeba invadens
RESGCPCENCRYIINEPD

SEQ ID NO: 2802958 - protein, 17 aa, Entamoeba invadens
RESVWIIIKNTSKYLSF

SEQ ID NO: 2802959 - protein, 17 aa, Entamoeba invadens
RETFQAFCIHAGGRAII

SEQ ID NO: 2802960 - protein, 18 aa, Entamoeba invadens
RETLCYVNRKYLYLNKTN

SEQ ID NO: 2802961 - protein, 20 aa, Entamoeba invadens
RETLIPVNFMIFKVAETPMS

SEQ ID NO: 2802962 - protein, 25 aa, Entamoeba invadens
RETSDICELYLFGICQRCSSQYYSS

SEQ ID NO: 2802963 - protein, 18 aa, Entamoeba invadens
RETSSFDRLVLKNDQGVT

SEQ ID NO: 2802964 - protein, 25 aa, Entamoeba invadens
REVLVDLVFFLPIIAFVLYVFGAFC

SEQ ID NO: 2802965 - protein, 17 aa, Entamoeba invadens
REVTLRRNVTMINFHQR

SEQ ID NO: 2802966 - protein, 17 aa, Entamoeba invadens
REVVLYWEQENWVSNYI

SEQ ID NO: 2802967 - protein, 29 aa, Entamoeba invadens
REVYPRLSNGLMCAVEFVRRREKSYFVSF

SEQ ID NO: 2802968 - protein, 27 aa, Entamoeba invadens
REYHLWVKMFMCMLIGFGGISLLIHVI

SEQ ID NO: 2802969 - protein, 24 aa, Entamoeba invadens
REYLSFKNIYIFSVLDLVANFNFF

SEQ ID NO: 2802970 - protein, 19 aa, Entamoeba invadens
RFAQIPVFVLLVLAFIFLC

SEQ ID NO: 2802971 - protein, 21 aa, Entamoeba invadens
RFASPFSKNCIYEMLSNMCYY

SEQ ID NO: 2802972 - protein, 18 aa, Entamoeba invadens
RFDMNTIYLYNNSTFKIK

SEQ ID NO: 2802973 - protein, 20 aa, Entamoeba invadens
RFDPEIVCTCHITDTIQIVS

SEQ ID NO: 2802974 - protein, 20 aa, Entamoeba invadens
RFEFLGTKMHLHYYGPSNMD

SEQ ID NO: 2802975 - protein, 20 aa, Entamoeba invadens
RFEYLVTAFLVMLYQLFDSL

SEQ ID NO: 2802976 - protein, 24 aa, Entamoeba invadens
RFFDMLWNLICESCYVSLTDVVLF

SEQ ID NO: 2802977 - protein, 26 aa, Entamoeba invadens
RFIESKSFCIKKWKNLIEEYESNINS

SEQ ID NO: 2802978 - protein, 18 aa, Entamoeba invadens
RFIGADQILNFSMCNSKE

SEQ ID NO: 2802979 - protein, 23 aa, Entamoeba invadens
RFKEYRCIFPGCTEGLKTKYNAI

SEQ ID NO: 2802980 - protein, 22 aa, Entamoeba invadens
RFKEYRCIYPGCKEGLKTKYNC

SEQ ID NO: 2802981 - protein, 24 aa, Entamoeba invadens
RFKRIKFNWTKFMKKLDADNETFM

SEQ ID NO: 2802982 - protein, 29 aa, Entamoeba invadens
RFLLFPCILDSHWFLIIVCNKTEKDVLNW

SEQ ID NO: 2802983 - protein, 26 aa, Entamoeba invadens
RFLLVRVYLAESFVVIFAASLLGMVV

SEQ ID NO: 2802984 - protein, 20 aa, Entamoeba invadens
RFLSTTYRWFACEEFGSAYE

SEQ ID NO: 2802985 - protein, 19 aa, Entamoeba invadens
RFLYIATISNMVFDNLNEL

SEQ ID NO: 2802986 - protein, 19 aa, Entamoeba invadens
RFNTIEIFKYTDSIYLKEK

SEQ ID NO: 2802987 - protein, 23 aa, Entamoeba invadens
RFNYKGKCGDVFKYKPNNKKDLW

SEQ ID NO: 2802988 - protein, 25 aa, Entamoeba invadens
RFRCPETLFQPSFLGMEALGIHETT

SEQ ID NO: 2802989 - protein, 31 aa, Entamoeba invadens
RFSKCCERMVFGLRCRYHFVMYHLLLLFMLC

SEQ ID NO: 2802990 - protein, 19 aa, Entamoeba invadens
RFTQPWNIPQFISEGNRLD

SEQ ID NO: 2802991 - protein, 20 aa, Entamoeba invadens
RFTQVLFICRTLYNKYSYTV

SEQ ID NO: 2802992 - protein, 26 aa, Entamoeba invadens
RFVEKDCVWKSIAKQLLLTESMKSVF

SEQ ID NO: 2802993 - protein, 30 aa, Entamoeba invadens
RFVKKYASVYSRYMIVPMICHMIKNKYCAT

SEQ ID NO: 2802994 - protein, 18 aa, Entamoeba invadens
RFVVDTFFLTQNERDEIY

SEQ ID NO: 2802995 - protein, 23 aa, Entamoeba invadens
RFWCVLPLLLFCVVFYVFGSGHV

SEQ ID NO: 2802996 - protein, 23 aa, Entamoeba invadens
RFYIQEFILDSGVSYYLRQLASN

SEQ ID NO: 2802997 - protein, 18 aa, Entamoeba invadens
RGAPPVLVEINFADGKKD

SEQ ID NO: 2802998 - protein, 17 aa, Entamoeba invadens
RGCSPSIRRDIPQELAI

SEQ ID NO: 2802999 - protein, 26 aa, Entamoeba invadens
RGEKSGEVIAAIPPWETFYNFWERVI

SEQ ID NO: 2803000 - protein, 19 aa, Entamoeba invadens
RGEPIVCTVFRIMHGRQSL

SEQ ID NO: 2803001 - protein, 22 aa, Entamoeba invadens
RGERPPFSKAHMLFEDVINSCW

SEQ ID NO: 2803002 - protein, 20 aa, Entamoeba invadens
RGEYEWISYGTVLNTAKALA

SEQ ID NO: 2803003 - protein, 36 aa, Entamoeba invadens
RGFNIACAPLLWVCTFCMLVTIIPNFRSINLLIDQS

SEQ ID NO: 2803004 - protein, 27 aa, Entamoeba invadens
RGFYGCICCIIFFVAFYFMKFLPEALR

SEQ ID NO: 2803005 - protein, 19 aa, Entamoeba invadens
RGGAYICTFILMSTLIYWV

SEQ ID NO: 2803006 - protein, 17 aa, Entamoeba invadens
RGGCVVCKDYYYLDYIT

SEQ ID NO: 2803007 - protein, 24 aa, Entamoeba invadens
RGGLCTFPLKASTAQIVIKIGLEH

SEQ ID NO: 2803008 - protein, 17 aa, Entamoeba invadens
RGGVGIIFKATYKGRTV

SEQ ID NO: 2803009 - protein, 24 aa, Entamoeba invadens
RGHIYCKLCPAGTYSIELGSTNCD

SEQ ID NO: 2803010 - protein, 18 aa, Entamoeba invadens
RGHWIRFEFEDTIEDTKT

SEQ ID NO: 2803011 - protein, 17 aa, Entamoeba invadens
RGIGFYFGPDAVIDFLE

SEQ ID NO: 2803012 - protein, 25 aa, Entamoeba invadens
RGIYLKELLLLFNRYNSSLSQVRTA

SEQ ID NO: 2803013 - protein, 20 aa, Entamoeba invadens
RGKAQRVIYVIFWPLLMLLA

SEQ ID NO: 2803014 - protein, 18 aa, Entamoeba invadens
RGKGKSFRGGITASDVFL

SEQ ID NO: 2803015 - protein, 19 aa, Entamoeba invadens
RGKMMVAVGFIFFSIIIPS

SEQ ID NO: 2803016 - protein, 23 aa, Entamoeba invadens
RGNCVLCNYPNYYIQSSNTNGSC

SEQ ID NO: 2803017 - protein, 18 aa, Entamoeba invadens
RGNGIVFLDSIIRALFFT

SEQ ID NO: 2803018 - protein, 24 aa, Entamoeba invadens
RGNLLSYLGWFCYGTYQSIMYFVL

SEQ ID NO: 2803019 - protein, 18 aa, Entamoeba invadens
RGNVLEWWTPTTCSNIRV

SEQ ID NO: 2803020 - protein, 18 aa, Entamoeba invadens
RGQCMTVSGVERIRNRLS

SEQ ID NO: 2803021 - protein, 18 aa, Entamoeba invadens
RGQKCSKCQIGYTLDESS

SEQ ID NO: 2803022 - protein, 25 aa, Entamoeba invadens
RGRACEFSLYLTPLCTCKITTTIQI

SEQ ID NO: 2803023 - protein, 24 aa, Entamoeba invadens
RGREGCLPNCQCQFSANWFPTKSQ

SEQ ID NO: 2803024 - protein, 18 aa, Entamoeba invadens
RGSFGVVYQGLYRSQKVA

SEQ ID NO: 2803025 - protein, 17 aa, Entamoeba invadens
RGSLGCTDNCFCQNGFK

SEQ ID NO: 2803026 - protein, 21 aa, Entamoeba invadens
RGSVLRKTEYVYCVVCYTGKY

SEQ ID NO: 2803027 - protein, 21 aa, Entamoeba invadens
RGTAVTGFVFLLGMFASFGLK

SEQ ID NO: 2803028 - protein, 25 aa, Entamoeba invadens
RGTRTLKIILLHMQVLLILSVAIAA

SEQ ID NO: 2803029 - protein, 19 aa, Entamoeba invadens
RGVGTPSFMAPEILNGQKY

SEQ ID NO: 2803030 - protein, 20 aa, Entamoeba invadens
RGVKTLWEQLGFVDRVTEVC

SEQ ID NO: 2803031 - protein, 25 aa, Entamoeba invadens
RGVSDFLEFVLLFWVVLLILFSFTE

SEQ ID NO: 2803032 - protein, 19 aa, Entamoeba invadens
RGYFLLTSCMKNSTTSKVT

SEQ ID NO: 2803033 - protein, 22 aa, Entamoeba invadens
RGYVTTCCVAVIQSVPFTTPQT

SEQ ID NO: 2803034 - protein, 21 aa, Entamoeba invadens
RHCMPKLKLIRINGEELEVMK

SEQ ID NO: 2803035 - protein, 25 aa, Entamoeba invadens
RHEKERKKTCLFVMSSSNIKFLKTS

SEQ ID NO: 2803036 - protein, 18 aa, Entamoeba invadens
RHHLSRFYFLVPTIPNTD

SEQ ID NO: 2803037 - protein, 21 aa, Entamoeba invadens
RHISGCVLCDGKDSCSKCKDG

SEQ ID NO: 2803038 - protein, 24 aa, Entamoeba invadens
RHLETSHLWALKTLKEVYLVPMSK

SEQ ID NO: 2803039 - protein, 18 aa, Entamoeba invadens
RHLHIIFIMLIDVYCGST

SEQ ID NO: 2803040 - protein, 19 aa, Entamoeba invadens
RHLPVLYFLSPVITSINES

SEQ ID NO: 2803041 - protein, 20 aa, Entamoeba invadens
RHNFCYSCNDGFMLSNNECV

SEQ ID NO: 2803042 - protein, 19 aa, Entamoeba invadens
RHPWLIKTISRIVCAPFKR

SEQ ID NO: 2803043 - protein, 25 aa, Entamoeba invadens
RHQLMLWYAGLRGAIAIILALQMGN

SEQ ID NO: 2803044 - protein, 17 aa, Entamoeba invadens
RHTRAVFITDLYLGSTR

SEQ ID NO: 2803045 - protein, 25 aa, Entamoeba invadens
RHVGLKEIRFGNAVTKLAGNAFAQT

SEQ ID NO: 2803046 - protein, 22 aa, Entamoeba invadens
RIAFFCFVTLGIFWWVVTTYSV

SEQ ID NO: 2803047 - protein, 22 aa, Entamoeba invadens
RICKKCPLGCSTCFLENDEIKC

SEQ ID NO: 2803048 - protein, 19 aa, Entamoeba invadens
RICSICTTGKYVLSNGRCG

SEQ ID NO: 2803049 - protein, 22 aa, Entamoeba invadens
RICSTCALGPSLCLTCGNSNYK

SEQ ID NO: 2803050 - protein, 22 aa, Entamoeba invadens
RICTKCLSGYYLQDGECLQIKN

SEQ ID NO: 2803051 - protein, 17 aa, Entamoeba invadens
RIDDKIVLISVDMKKGV

SEQ ID NO: 2803052 - protein, 22 aa, Entamoeba invadens
RIECHTFRYTLFTILHTSTIVS

SEQ ID NO: 2803053 - protein, 28 aa, Entamoeba invadens
RIEELLRRINFVISYVMEYLKIFESVLF

SEQ ID NO: 2803054 - protein, 19 aa, Entamoeba invadens
RIEKLFTIMYLRTDKRFYA

SEQ ID NO: 2803055 - protein, 18 aa, Entamoeba invadens
RIEQTKGIYEFDKFIQCA

SEQ ID NO: 2803056 - protein, 17 aa, Entamoeba invadens
RIFLAVGAFIDVLGMGI

SEQ ID NO: 2803057 - protein, 22 aa, Entamoeba invadens
RIFNVLNIFLCIPLVLYFLPNV

SEQ ID NO: 2803058 - protein, 31 aa, Entamoeba invadens
RIIIRDALGRWVWDVEELWVESQLHGGSSSI

SEQ ID NO: 2803059 - protein, 20 aa, Entamoeba invadens
RIKECLTCNDPYYLSSQKCV

SEQ ID NO: 2803060 - protein, 20 aa, Entamoeba invadens
RIKLEADVLYFLQVELEEEY

SEQ ID NO: 2803061 - protein, 22 aa, Entamoeba invadens
RIKPIFRVVVLWVVTFMLVAFV

SEQ ID NO: 2803062 - protein, 26 aa, Entamoeba invadens
RIKYDFKSSIYFARSVMNNIYATVYF

SEQ ID NO: 2803063 - protein, 18 aa, Entamoeba invadens
RILALNCLISAYDLSVLK

SEQ ID NO: 2803064 - protein, 24 aa, Entamoeba invadens
RILKMKPYCICVNDDFEGSIGVSR

SEQ ID NO: 2803065 - protein, 27 aa, Entamoeba invadens
RILVYFLICYCCCIELPITSLSGDQVF

SEQ ID NO: 2803066 - protein, 24 aa, Entamoeba invadens
RIPKDLGNLISRCWEYNYLQRISF

SEQ ID NO: 2803067 - protein, 19 aa, Entamoeba invadens
RIPMNGIVYYPSVIKPMNE

SEQ ID NO: 2803068 - protein, 19 aa, Entamoeba invadens
RIPPCKMAKYIMDPVNLDF

SEQ ID NO: 2803069 - protein, 19 aa, Entamoeba invadens
RIPTDVVIMTDGFCYSACS

SEQ ID NO: 2803070 - protein, 19 aa, Entamoeba invadens
RIQLCISNLICYWITWLGA

SEQ ID NO: 2803071 - protein, 18 aa, Entamoeba invadens
RIRCPFIVNFIGSVITPD

SEQ ID NO: 2803072 - protein, 18 aa, Entamoeba invadens
RIRCPYIVNFIGCVITQD

SEQ ID NO: 2803073 - protein, 19 aa, Entamoeba invadens
RISESLIFVSLVILVAVVV

SEQ ID NO: 2803074 - protein, 19 aa, Entamoeba invadens
RISLTSGMSGAKLLQELNI

SEQ ID NO: 2803075 - protein, 19 aa, Entamoeba invadens
RISNCVIYNNKLCIECEPD

SEQ ID NO: 2803076 - protein, 19 aa, Entamoeba invadens
RISPFRMRPLLKYAEKYIQ

SEQ ID NO: 2803077 - protein, 21 aa, Entamoeba invadens
RITHTFAVELYNYFRTGNGVA

SEQ ID NO: 2803078 - protein, 23 aa, Entamoeba invadens
RIVCYIWRVLFTKGEIVHYKRVY

SEQ ID NO: 2803079 - protein, 25 aa, Entamoeba invadens
RIVITEFFKTLTICQSVDIRREGED

SEQ ID NO: 2803080 - protein, 19 aa, Entamoeba invadens
RIVNCPFKTLPSAVVTSIT

SEQ ID NO: 2803081 - protein, 18 aa, Entamoeba invadens
RIVSCLISQTLLEDADTF

SEQ ID NO: 2803082 - protein, 18 aa, Entamoeba invadens
RIVSNVLACSTILTYTNP

SEQ ID NO: 2803083 - protein, 20 aa, Entamoeba invadens
RIVSYSNIFCVSRIEVNVSY

SEQ ID NO: 2803084 - protein, 24 aa, Entamoeba invadens
RIYELLCQCYQHFRIEKILLTHQM

SEQ ID NO: 2803085 - protein, 18 aa, Entamoeba invadens
RIYRTDSFGKIFEVAYLC

SEQ ID NO: 2803086 - protein, 17 aa, Entamoeba invadens
RKAKTKFFITISRFGNM

SEQ ID NO: 2803087 - protein, 20 aa, Entamoeba invadens
RKAVWWVVVLLVIFVVLILS

SEQ ID NO: 2803088 - protein, 19 aa, Entamoeba invadens
RKCELCIDKSYANPNAPYN

SEQ ID NO: 2803089 - protein, 19 aa, Entamoeba invadens
RKCELCSSGKYPKSTESYK

SEQ ID NO: 2803090 - protein, 23 aa, Entamoeba invadens
RKCLECANGYTLNNGFYGVCIVC

SEQ ID NO: 2803091 - protein, 20 aa, Entamoeba invadens
RKCSVCKAGYYPKTSGDYMC

SEQ ID NO: 2803092 - protein, 19 aa, Entamoeba invadens
RKCSVCKTSGMYPSESTYT

SEQ ID NO: 2803093 - protein, 22 aa, Entamoeba invadens
RKCWICTYPGCKEPPKTRYNCY

SEQ ID NO: 2803094 - protein, 21 aa, Entamoeba invadens
RKDAMKLCEMYVRYVEDTSRG

SEQ ID NO: 2803095 - protein, 21 aa, Entamoeba invadens
RKDKICFRETRAQNRDYQIVL

SEQ ID NO: 2803096 - protein, 18 aa, Entamoeba invadens
RKDLNGMFNKGRVKLKWR

SEQ ID NO: 2803097 - protein, 25 aa, Entamoeba invadens
RKDLNRTALSFSWMLQYCEQSGVLV

SEQ ID NO: 2803098 - protein, 17 aa, Entamoeba invadens
RKDPPQFSTFDADRGSE

SEQ ID NO: 2803099 - protein, 20 aa, Entamoeba invadens
RKDWLNILTLIAGIFVPLIF

SEQ ID NO: 2803100 - protein, 20 aa, Entamoeba invadens
RKDYFNFAMFIKSIEDEVLA

SEQ ID NO: 2803101 - protein, 25 aa, Entamoeba invadens
RKDYLWKEIPPLVSPPLYNMRSRVT

SEQ ID NO: 2803102 - protein, 19 aa, Entamoeba invadens
RKEAISILISLSRSLAIST

SEQ ID NO: 2803103 - protein, 20 aa, Entamoeba invadens
RKEAVLEMDHFFDIILSKIG

SEQ ID NO: 2803104 - protein, 23 aa, Entamoeba invadens
RKEDLLVENVCVFEMSRSNMSMT

SEQ ID NO: 2803105 - protein, 23 aa, Entamoeba invadens
RKEGEIYKYNCWEEIPYENIGIN

SEQ ID NO: 2803106 - protein, 32 aa, Entamoeba invadens
RKEKEDFVILPYKLKVRMLFDTARGMQFLHEN

SEQ ID NO: 2803107 - protein, 32 aa, Entamoeba invadens
RKEKEYYVVLPYKLKVRMLFDTARGMQFLHEN

SEQ ID NO: 2803108 - protein, 27 aa, Entamoeba invadens
RKELPKLFLRIFEDFVFTQEHMQMKQF

SEQ ID NO: 2803109 - protein, 35 aa, Entamoeba invadens
RKENEFYIRFPYKLKIAMLYDISRGMQFLHENLIM

SEQ ID NO: 2803110 - protein, 18 aa, Entamoeba invadens
RKEYAVTLQYLFTATETF

SEQ ID NO: 2803111 - protein, 21 aa, Entamoeba invadens
RKFANEFPKMPFVASSTPFDY

SEQ ID NO: 2803112 - protein, 18 aa, Entamoeba invadens
RKFFPEKFSYLFVMTCVQ

SEQ ID NO: 2803113 - protein, 17 aa, Entamoeba invadens
RKFGLSVTGNFSREERH

SEQ ID NO: 2803114 - protein, 19 aa, Entamoeba invadens
RKFIQRRFFPSLYHLAQEM

SEQ ID NO: 2803115 - protein, 18 aa, Entamoeba invadens
RKFKSIKNINTFDNIPIN

SEQ ID NO: 2803116 - protein, 23 aa, Entamoeba invadens
RKFLRTILFRAAIPQIMKGRKGN

SEQ ID NO: 2803117 - protein, 32 aa, Entamoeba invadens
RKFQSWLYHACEVFYAWSCIDVFVISVIAAIV

SEQ ID NO: 2803118 - protein, 27 aa, Entamoeba invadens
RKGAVVICAVIYYFCFLIAGIFFHTFW

SEQ ID NO: 2803119 - protein, 17 aa, Entamoeba invadens
RKGETIALVGASGCGKS

SEQ ID NO: 2803120 - protein, 23 aa, Entamoeba invadens
RKGNDYNVVLSFSLKNKILYDIA

SEQ ID NO: 2803121 - protein, 25 aa, Entamoeba invadens
RKGVACEFEIYITPNFTCNISSVAK

SEQ ID NO: 2803122 - protein, 21 aa, Entamoeba invadens
RKHIVYGLAIGYPFSVLALTA

SEQ ID NO: 2803123 - protein, 19 aa, Entamoeba invadens
RKIEFYWFHEHSVFYYISA

SEQ ID NO: 2803124 - protein, 19 aa, Entamoeba invadens
RKIKSENIFTPKGNDVKNF

SEQ ID NO: 2803125 - protein, 21 aa, Entamoeba invadens
RKILLKRKAPKVFNDEDNMFF

SEQ ID NO: 2803126 - protein, 22 aa, Entamoeba invadens
RKKAEMNASLFFNKNNENVQWR

SEQ ID NO: 2803127 - protein, 22 aa, Entamoeba invadens
RKKAVWWVITLVILFGVFVLTS

SEQ ID NO: 2803128 - protein, 21 aa, Entamoeba invadens
RKKFGNAILKYVKKIGDHCFG

SEQ ID NO: 2803129 - protein, 25 aa, Entamoeba invadens
RKKIGYPMRKFVIDWSLVPSDTSRI

SEQ ID NO: 2803130 - protein, 19 aa, Entamoeba invadens
RKKIPLFDLSCRNVAKSTN

SEQ ID NO: 2803131 - protein, 17 aa, Entamoeba invadens
RKKLGIFPLKVKDEEFM

SEQ ID NO: 2803132 - protein, 29 aa, Entamoeba invadens
RKKNWLCIFPGCTQCAATHYNVYSHVWDS

SEQ ID NO: 2803133 - protein, 24 aa, Entamoeba invadens
RKKNWLCIFPGCTQKPMCHYNAYS

SEQ ID NO: 2803134 - protein, 25 aa, Entamoeba invadens
RKLASRKMLFSGLLVLVVLTSTLFM

SEQ ID NO: 2803135 - protein, 30 aa, Entamoeba invadens
RKLDFSIVRLGRYMSWHKFIFRDYPLTLAI

SEQ ID NO: 2803136 - protein, 23 aa, Entamoeba invadens
RKLFEKRTRRLLEVASYLDTVYT

SEQ ID NO: 2803137 - protein, 22 aa, Entamoeba invadens
RKLIESYWRCCGYDVISPADCG

SEQ ID NO: 2803138 - protein, 17 aa, Entamoeba invadens
RKLIIMEIMREMLKNNI

SEQ ID NO: 2803139 - protein, 20 aa, Entamoeba invadens
RKLLKILRVYMKIAKYQSYG

SEQ ID NO: 2803140 - protein, 20 aa, Entamoeba invadens
RKLYFKTLLRQDAAWYDAHE

SEQ ID NO: 2803141 - protein, 20 aa, Entamoeba invadens
RKMQNGVTQFARFKEIDNPT

SEQ ID NO: 2803142 - protein, 19 aa, Entamoeba invadens
RKMTKLKFMIDASKGILYL

SEQ ID NO: 2803143 - protein, 18 aa, Entamoeba invadens
RKNCFKSTALEDVSLLKT

SEQ ID NO: 2803144 - protein, 23 aa, Entamoeba invadens
RKNIMKWGPILSFIGAANTCVTS

SEQ ID NO: 2803145 - protein, 23 aa, Entamoeba invadens
RKNTDCIKCPSTMATCLNENQPI

SEQ ID NO: 2803146 - protein, 25 aa, Entamoeba invadens
RKNVKELKNKICVFNMNKSNIPFTG

SEQ ID NO: 2803147 - protein, 19 aa, Entamoeba invadens
RKPFEVVEVILNSKLKISG

SEQ ID NO: 2803148 - protein, 19 aa, Entamoeba invadens
RKPLTEAKRISMSFEGQQQ

SEQ ID NO: 2803149 - protein, 21 aa, Entamoeba invadens
RKPYPNVFYLDDFVPTVVVLK

SEQ ID NO: 2803150 - protein, 43 aa, Entamoeba invadens
RKQKPFVFCYRVLCGIIFYSFRGVIEHIWLRLMYTALKNVDDV

SEQ ID NO: 2803151 - protein, 19 aa, Entamoeba invadens
RKQNRICYLQEYIQEKDEN

SEQ ID NO: 2803152 - protein, 18 aa, Entamoeba invadens
RKQNRICYLQEYIQETDE

SEQ ID NO: 2803153 - protein, 18 aa, Entamoeba invadens
RKRMCIMPQEATLFSGTV

SEQ ID NO: 2803154 - protein, 18 aa, Entamoeba invadens
RKRMLYLRLPSILMQTKS

SEQ ID NO: 2803155 - protein, 23 aa, Entamoeba invadens
RKRQEFLQTLGILLGVLLSLATV

SEQ ID NO: 2803156 - protein, 21 aa, Entamoeba invadens
RKRQISAFVVISLMKRTEDNT

SEQ ID NO: 2803157 - protein, 19 aa, Entamoeba invadens
RKSEMKGFIASAPAYIIKN

SEQ ID NO: 2803158 - protein, 21 aa, Entamoeba invadens
RKSLMVKEHVDVMAPITRKFL

SEQ ID NO: 2803159 - protein, 21 aa, Entamoeba invadens
RKSMQWMAPLYKEYPGGESVM

SEQ ID NO: 2803160 - protein, 17 aa, Entamoeba invadens
RKSVPVDFSKSIEGLPD

SEQ ID NO: 2803161 - protein, 34 aa, Entamoeba invadens
RKTKNKAVNVVGWISFGLFATCFILLTMIPVFVT

SEQ ID NO: 2803162 - protein, 24 aa, Entamoeba invadens
RKTTWLSRCGVLKVFTRFDFYLVI

SEQ ID NO: 2803163 - protein, 17 aa, Entamoeba invadens
RKTVLVYFTATWCRPCT

SEQ ID NO: 2803164 - protein, 29 aa, Entamoeba invadens
RKVALDLGIKHIFVPTFLVYPIQRLPRYL

SEQ ID NO: 2803165 - protein, 24 aa, Entamoeba invadens
RKVERTCDVFKGFFGEKREVMVER

SEQ ID NO: 2803166 - protein, 19 aa, Entamoeba invadens
RKVKSHLHYNLTIKTDAIS

SEQ ID NO: 2803167 - protein, 29 aa, Entamoeba invadens
RKVPNGNGCLWLFMCKDGYYTVNGNECQK

SEQ ID NO: 2803168 - protein, 30 aa, Entamoeba invadens
RKVVNLPYLLRFDFLAILRDFDFLFQKDCP

SEQ ID NO: 2803169 - protein, 18 aa, Entamoeba invadens
RKWIRGCEPQCGTCRDGF

SEQ ID NO: 2803170 - protein, 19 aa, Entamoeba invadens
RKWIRGCEPQCGVCRDGFL

SEQ ID NO: 2803171 - protein, 28 aa, Entamoeba invadens
RKWWLCELKRWGSLHFLSQFFITETTNL

SEQ ID NO: 2803172 - protein, 17 aa, Entamoeba invadens
RKYDWILHISKYEDIVL

SEQ ID NO: 2803173 - protein, 17 aa, Entamoeba invadens
RKYILKFSPKVVVLRRG

SEQ ID NO: 2803174 - protein, 18 aa, Entamoeba invadens
RKYKTPADIYSFAITMYS

SEQ ID NO: 2803175 - protein, 20 aa, Entamoeba invadens
RKYLCSGPLFVVEKLTEVPQ

SEQ ID NO: 2803176 - protein, 20 aa, Entamoeba invadens
RKYYELKELYSITNQSQKYR

SEQ ID NO: 2803177 - protein, 18 aa, Entamoeba invadens
RLAAEKMAQELQRIKEEE

SEQ ID NO: 2803178 - protein, 19 aa, Entamoeba invadens
RLDIYRAKGDVIVRDLTGG

SEQ ID NO: 2803179 - protein, 23 aa, Entamoeba invadens
RLEPVYLMSIVPCLGSLSTLLLF

SEQ ID NO: 2803180 - protein, 17 aa, Entamoeba invadens
RLFIKCGNLLQIPKSKI

SEQ ID NO: 2803181 - protein, 18 aa, Entamoeba invadens
RLFLNCVSPLSSDLMNSL

SEQ ID NO: 2803182 - protein, 17 aa, Entamoeba invadens
RLFVPTILRSIEHFEER

SEQ ID NO: 2803183 - protein, 20 aa, Entamoeba invadens
RLGDEIYNNIAINKSVSTAV

SEQ ID NO: 2803184 - protein, 17 aa, Entamoeba invadens
RLGESFANVRSRLKSKL

SEQ ID NO: 2803185 - protein, 20 aa, Entamoeba invadens
RLGNDLPLIVYFSTKPEYRR

SEQ ID NO: 2803186 - protein, 19 aa, Entamoeba invadens
RLHFLSESIISLTVGISIG

SEQ ID NO: 2803187 - protein, 18 aa, Entamoeba invadens
RLHKEGCQLFIATNSEHQ

SEQ ID NO: 2803188 - protein, 18 aa, Entamoeba invadens
RLHTNWNLAQMVSLFDSR

SEQ ID NO: 2803189 - protein, 17 aa, Entamoeba invadens
RLHWIEFQNKFYVGDGV

SEQ ID NO: 2803190 - protein, 18 aa, Entamoeba invadens
RLHWIEFQNKFYVGDGVA

SEQ ID NO: 2803191 - protein, 18 aa, Entamoeba invadens
RLHWVEFQNKFYLGDGVR

SEQ ID NO: 2803192 - protein, 29 aa, Entamoeba invadens
RLIEERAVPHWAPSSVVSRKKWIDETKAR

SEQ ID NO: 2803193 - protein, 23 aa, Entamoeba invadens
RLIEIDWTTAFFPLTSYTKTLSF

SEQ ID NO: 2803194 - protein, 19 aa, Entamoeba invadens
RLIPCVASLTSLNNSKTDD

SEQ ID NO: 2803195 - protein, 19 aa, Entamoeba invadens
RLIYIYPYSSTSKFMNIQF

SEQ ID NO: 2803196 - protein, 20 aa, Entamoeba invadens
RLKAKECLEHPFLHLLDVED

SEQ ID NO: 2803197 - protein, 18 aa, Entamoeba invadens
RLKRKSPQVEGRRTNRSL

SEQ ID NO: 2803198 - protein, 19 aa, Entamoeba invadens
RLKSWGFNALPNWVDTKMF

SEQ ID NO: 2803199 - protein, 31 aa, Entamoeba invadens
RLKTKCVAFPCGHKFHHSCVISWLQHNAVCP

SEQ ID NO: 2803200 - protein, 19 aa, Entamoeba invadens
RLKTLIVIRKSFRFSLTNK

SEQ ID NO: 2803201 - protein, 27 aa, Entamoeba invadens
RLKYLKCWRQISLVGGFTLMLIGGSIF

SEQ ID NO: 2803202 - protein, 26 aa, Entamoeba invadens
RLLDLKRWKYITGIHYIPFPLVITSG

SEQ ID NO: 2803203 - protein, 21 aa, Entamoeba invadens
RLLDNYPRHLLSGLLYNTSGF

SEQ ID NO: 2803204 - protein, 20 aa, Entamoeba invadens
RLLFPFTMGVFLDKMKQKID

SEQ ID NO: 2803205 - protein, 27 aa, Entamoeba invadens
RLLLEVYESAKLFKVVMKDSFIIFNNE

SEQ ID NO: 2803206 - protein, 17 aa, Entamoeba invadens
RLLPKIDIPRKFSPDYL

SEQ ID NO: 2803207 - protein, 24 aa, Entamoeba invadens
RLMKECAIGIYHLHKLGIVHRDIK

SEQ ID NO: 2803208 - protein, 20 aa, Entamoeba invadens
RLMKLDANFLMLAKVNKQID

SEQ ID NO: 2803209 - protein, 20 aa, Entamoeba invadens
RLMLLNCQFVTKKFTTRNTS

SEQ ID NO: 2803210 - protein, 25 aa, Entamoeba invadens
RLMMVGELCVPGFLKLMKQLYTTRN

SEQ ID NO: 2803211 - protein, 17 aa, Entamoeba invadens
RLMRFCPSNIITPERTV

SEQ ID NO: 2803212 - protein, 25 aa, Entamoeba invadens
RLNGMNGRCAFQLEVDNILSTIAQY

SEQ ID NO: 2803213 - protein, 18 aa, Entamoeba invadens
RLNKVWKNETRTLDCEIK

SEQ ID NO: 2803214 - protein, 22 aa, Entamoeba invadens
RLNTRLNVCEKISIANCKREEQ

SEQ ID NO: 2803215 - protein, 18 aa, Entamoeba invadens
RLPEWDMNICDQLCQNEY

SEQ ID NO: 2803216 - protein, 20 aa, Entamoeba invadens
RLPPPAEWAGFDWGVVESIL

SEQ ID NO: 2803217 - protein, 18 aa, Entamoeba invadens
RLQAVKMVCFAMRRTITM

SEQ ID NO: 2803218 - protein, 18 aa, Entamoeba invadens
RLRAFRNGFNQNITIPSY

SEQ ID NO: 2803219 - protein, 17 aa, Entamoeba invadens
RLRHCVESLNLYEPALW

SEQ ID NO: 2803220 - protein, 26 aa, Entamoeba invadens
RLRRFERNKIALAFNDLVEVATTLGF

SEQ ID NO: 2803221 - protein, 20 aa, Entamoeba invadens
RLSEVLKICGERYGKNDVKI

SEQ ID NO: 2803222 - protein, 20 aa, Entamoeba invadens
RLSKCVSCSSKYYLNAQTGI

SEQ ID NO: 2803223 - protein, 19 aa, Entamoeba invadens
RLSKLALFRDSLKKIRELN

SEQ ID NO: 2803224 - protein, 19 aa, Entamoeba invadens
RLSSCYKCPAGYYNQQYNR

SEQ ID NO: 2803225 - protein, 18 aa, Entamoeba invadens
RLTDCIDSILTIWGSEAK

SEQ ID NO: 2803226 - protein, 20 aa, Entamoeba invadens
RLTKSLLEMTQCYILDTETE

SEQ ID NO: 2803227 - protein, 25 aa, Entamoeba invadens
RLTTDGSFSCVLCKVNELEVQGPTE

SEQ ID NO: 2803228 - protein, 18 aa, Entamoeba invadens
RLVDGMCVGLSLNCKTFN

SEQ ID NO: 2803229 - protein, 26 aa, Entamoeba invadens
RLVLCSMVGGLICRLQPFKYITHFFP

SEQ ID NO: 2803230 - protein, 25 aa, Entamoeba invadens
RLVPECLQTFPVLEKLVLSNCQVNY

SEQ ID NO: 2803231 - protein, 24 aa, Entamoeba invadens
RLVSCGCIPLLFKTLENSENKNED

SEQ ID NO: 2803232 - protein, 32 aa, Entamoeba invadens
RLVSNIYMSVVWLRKYITDFLVEILPIIPADQ

SEQ ID NO: 2803233 - protein, 25 aa, Entamoeba invadens
RLWVFPRYIIYAAFQAYHVIPEGAT

SEQ ID NO: 2803234 - protein, 26 aa, Entamoeba invadens
RLYIEHCVNVTKSLCEQCDFWHNKRD

SEQ ID NO: 2803235 - protein, 25 aa, Entamoeba invadens
RLYMVLWGIIFYCCQQTEVFVQILF

SEQ ID NO: 2803236 - protein, 18 aa, Entamoeba invadens
RLYRDLVEECWRQTQEID

SEQ ID NO: 2803237 - protein, 17 aa, Entamoeba invadens
RLYRTRRDYSFPVDVYS

SEQ ID NO: 2803238 - protein, 21 aa, Entamoeba invadens
RMDIRGESSYQLWLVPFYVGL

SEQ ID NO: 2803239 - protein, 18 aa, Entamoeba invadens
RMEIVVIFQEVFTSIDTF

SEQ ID NO: 2803240 - protein, 24 aa, Entamoeba invadens
RMERARTGFVGKMNGTHRFVMFKR

SEQ ID NO: 2803241 - protein, 20 aa, Entamoeba invadens
RMERLEKMISDFEKVNEKAK

SEQ ID NO: 2803242 - protein, 19 aa, Entamoeba invadens
RMFCMCATFVLFVQSLTFG

SEQ ID NO: 2803243 - protein, 18 aa, Entamoeba invadens
RMIGEGSFGKVYLGLFRG

SEQ ID NO: 2803244 - protein, 19 aa, Entamoeba invadens
RMITTWICSVFLYYVVDEA

SEQ ID NO: 2803245 - protein, 18 aa, Entamoeba invadens
RMKNIYCVYMTRANDACE

SEQ ID NO: 2803246 - protein, 18 aa, Entamoeba invadens
RMKTNPWGYSDDIHPTAS

SEQ ID NO: 2803247 - protein, 26 aa, Entamoeba invadens
RMKYKRPADIYSFAITMYECFIWGVA

SEQ ID NO: 2803248 - protein, 19 aa, Entamoeba invadens
RMMEMNPPLFLYGTHYSTP

SEQ ID NO: 2803249 - protein, 23 aa, Entamoeba invadens
RMRKKEFIVLGVTTFVIIATTLG

SEQ ID NO: 2803250 - protein, 29 aa, Entamoeba invadens
RMRLPYKLKIRMLFDTARGMQFLHENQIL

SEQ ID NO: 2803251 - protein, 17 aa, Entamoeba invadens
RMSQLVIEDHLIVSHGH

SEQ ID NO: 2803252 - protein, 22 aa, Entamoeba invadens
RMSRGMSTFDFRPHSGETGHYS

SEQ ID NO: 2803253 - protein, 19 aa, Entamoeba invadens
RMSSSCKVTDQYGCLECEY

SEQ ID NO: 2803254 - protein, 20 aa, Entamoeba invadens
RMTVVNGWFGGVKMERRGQD

SEQ ID NO: 2803255 - protein, 32 aa, Entamoeba invadens
RMVGSLKYWVESCLFDEAFLKHFKVFLHKLNC

SEQ ID NO: 2803256 - protein, 23 aa, Entamoeba invadens
RNADDVYLLSGITWMSEIENNEG

SEQ ID NO: 2803257 - protein, 23 aa, Entamoeba invadens
RNAMMIYAMVCFDVIKKEENNTK

SEQ ID NO: 2803258 - protein, 19 aa, Entamoeba invadens
RNAVYGFGMLVKVVPPSMR

SEQ ID NO: 2803259 - protein, 18 aa, Entamoeba invadens
RNAYLNWFMAFIGGLAGG

SEQ ID NO: 2803260 - protein, 17 aa, Entamoeba invadens
RNCDQYCHCTSGNVLSN

SEQ ID NO: 2803261 - protein, 22 aa, Entamoeba invadens
RNCKITLVFLIIGIIFCPFLVA

SEQ ID NO: 2803262 - protein, 24 aa, Entamoeba invadens
RNCLKCPFQCSECMYNNSFCLKCS

SEQ ID NO: 2803263 - protein, 22 aa, Entamoeba invadens
RNDLKVVIMSATLDSKLFSNFF

SEQ ID NO: 2803264 - protein, 19 aa, Entamoeba invadens
RNECLKCNINYYLKLGNCN

SEQ ID NO: 2803265 - protein, 24 aa, Entamoeba invadens
RNFDRMFCHWNHNVRVFFCELLLY

SEQ ID NO: 2803266 - protein, 22 aa, Entamoeba invadens
RNFLFCYPTELCLGKERKRGGC

SEQ ID NO: 2803267 - protein, 23 aa, Entamoeba invadens
RNFTNYQCRVHYWLNTSQFEVSG

SEQ ID NO: 2803268 - protein, 18 aa, Entamoeba invadens
RNGCKKCEDGYFLENIRC

SEQ ID NO: 2803269 - protein, 19 aa, Entamoeba invadens
RNGLSRFLIFQTPEITNNV

SEQ ID NO: 2803270 - protein, 19 aa, Entamoeba invadens
RNGNIPMFGPLIHGDIVAY

SEQ ID NO: 2803271 - protein, 19 aa, Entamoeba invadens
RNGVKYSCWDGKYISNNNV

SEQ ID NO: 2803272 - protein, 17 aa, Entamoeba invadens
RNHLCVSDTCLSGNKLD

SEQ ID NO: 2803273 - protein, 24 aa, Entamoeba invadens
RNICHVCVLLYILCQIVFMAWVFY

SEQ ID NO: 2803274 - protein, 19 aa, Entamoeba invadens
RNIFEPIFLSTLNPDKYPE

SEQ ID NO: 2803275 - protein, 18 aa, Entamoeba invadens
RNIFRYMLVLTVHTEDLT

SEQ ID NO: 2803276 - protein, 19 aa, Entamoeba invadens
RNILDPCRMITIWMVSVIL

SEQ ID NO: 2803277 - protein, 20 aa, Entamoeba invadens
RNKAIISFRYNDRLIVYGNG

SEQ ID NO: 2803278 - protein, 20 aa, Entamoeba invadens
RNKCTSCNNSLVLLTNGSCV

SEQ ID NO: 2803279 - protein, 25 aa, Entamoeba invadens
RNKIFSMLFPFVLFMLDESDKLNEW

SEQ ID NO: 2803280 - protein, 23 aa, Entamoeba invadens
RNKRYSQLVLFNYAQRILPMKNT

SEQ ID NO: 2803281 - protein, 17 aa, Entamoeba invadens
RNLCEDAKCNPLTGEVE

SEQ ID NO: 2803282 - protein, 17 aa, Entamoeba invadens
RNLFGKEIINFVKDKYL

SEQ ID NO: 2803283 - protein, 24 aa, Entamoeba invadens
RNLNFTTFFAWMFVSILQGSVIMI

SEQ ID NO: 2803284 - protein, 19 aa, Entamoeba invadens
RNLSKMKWMMVIFHTTNSP

SEQ ID NO: 2803285 - protein, 18 aa, Entamoeba invadens
RNLVLRFAQHGVLSDSSY

SEQ ID NO: 2803286 - protein, 17 aa, Entamoeba invadens
RNMMAATVNFIIGMLTK

SEQ ID NO: 2803287 - protein, 18 aa, Entamoeba invadens
RNMNIAGVFIHVFGDFMG

SEQ ID NO: 2803288 - protein, 23 aa, Entamoeba invadens
RNNICIQCTSTLMVIKDGICVQY

SEQ ID NO: 2803289 - protein, 24 aa, Entamoeba invadens
RNQLIGRWNKLVINTFLSDDFFNK

SEQ ID NO: 2803290 - protein, 25 aa, Entamoeba invadens
RNRHAELFSFLSIDPNIVFDSFIKL

SEQ ID NO: 2803291 - protein, 22 aa, Entamoeba invadens
RNRYVKKGSVINCMCTQDASGN

SEQ ID NO: 2803292 - protein, 25 aa, Entamoeba invadens
RNSECTRCSFWYVPSSDGSYCEQQI

SEQ ID NO: 2803293 - protein, 30 aa, Entamoeba invadens
RNSELIKLCFFKNAAFFLIMLSYSFLSNCT

SEQ ID NO: 2803294 - protein, 26 aa, Entamoeba invadens
RNSMNLKMKWRCWINLDVSISSISMA

SEQ ID NO: 2803295 - protein, 19 aa, Entamoeba invadens
RNSVYSSLVYPSGVHFTST

SEQ ID NO: 2803296 - protein, 20 aa, Entamoeba invadens
RNTFVSFVFSLIRDGYDNRL

SEQ ID NO: 2803297 - protein, 25 aa, Entamoeba invadens
RNTLSFKAAIPFTVLLFFFFLSIFL

SEQ ID NO: 2803298 - protein, 24 aa, Entamoeba invadens
RNTWGASWGEKGYVRISTKVLCAF

SEQ ID NO: 2803299 - protein, 19 aa, Entamoeba invadens
RNVFSRLTQWNILVLKGGN

SEQ ID NO: 2803300 - protein, 31 aa, Entamoeba invadens
RNVTLIKMCFYKNSSFFLILFWYSFFSGYSG

SEQ ID NO: 2803301 - protein, 17 aa, Entamoeba invadens
RNYRISIRQDLSLKLPT

SEQ ID NO: 2803302 - protein, 21 aa, Entamoeba invadens
RNYTLCYNRIPNYEINVHGYN

SEQ ID NO: 2803303 - protein, 23 aa, Entamoeba invadens
RPACIPNKYMKALLFTVQYEGKG

SEQ ID NO: 2803304 - protein, 24 aa, Entamoeba invadens
RPDFAEVCQLLSALIAKKVDITPL

SEQ ID NO: 2803305 - protein, 27 aa, Entamoeba invadens
RPEKLPDVCYSWWVLSSMCILGTVDWI

SEQ ID NO: 2803306 - protein, 17 aa, Entamoeba invadens
RPENLFVSFGCFNNEGY

SEQ ID NO: 2803307 - protein, 25 aa, Entamoeba invadens
RPESVLKSSLKYVFDKFKKNEDYSY

SEQ ID NO: 2803308 - protein, 21 aa, Entamoeba invadens
RPEYAHTFTRIFERLDNGNLI

SEQ ID NO: 2803309 - protein, 25 aa, Entamoeba invadens
RPFCASCKFVRPLRVHHCRRSNCCV

SEQ ID NO: 2803310 - protein, 20 aa, Entamoeba invadens
RPFYPNCTDYVTPVNNTKVY

SEQ ID NO: 2803311 - protein, 21 aa, Entamoeba invadens
RPGILCGVMKMVVFLDYSKFT

SEQ ID NO: 2803312 - protein, 20 aa, Entamoeba invadens
RPHLEKAPAVLYAVVSFLFI

SEQ ID NO: 2803313 - protein, 17 aa, Entamoeba invadens
RPHLVRYYGSFSDDNFV

SEQ ID NO: 2803314 - protein, 21 aa, Entamoeba invadens
RPHPTKVFWNLVSLFCITLIF

SEQ ID NO: 2803315 - protein, 18 aa, Entamoeba invadens
RPIAEGAMGKVYFGNYRS

SEQ ID NO: 2803316 - protein, 23 aa, Entamoeba invadens
RPIGVDCSIGFLLENGEKSDETR

SEQ ID NO: 2803317 - protein, 24 aa, Entamoeba invadens
RPIWETIKYIAMDLVESFKVYFKN

SEQ ID NO: 2803318 - protein, 18 aa, Entamoeba invadens
RPKILNYNLLYSISLIKN

SEQ ID NO: 2803319 - protein, 18 aa, Entamoeba invadens
RPLIMRKTQMTVMSIMLG

SEQ ID NO: 2803320 - protein, 31 aa, Entamoeba invadens
RPLIPKDCVYRRLIRKCWAHKPKNRPAFPEI

SEQ ID NO: 2803321 - protein, 19 aa, Entamoeba invadens
RPMEACEYISLSELDLVKL

SEQ ID NO: 2803322 - protein, 19 aa, Entamoeba invadens
RPNFECITKMIVAMNEDTN

SEQ ID NO: 2803323 - protein, 18 aa, Entamoeba invadens
RPNFETVCKMVIQINEDC

SEQ ID NO: 2803324 - protein, 19 aa, Entamoeba invadens
RPNFYGVIRGGGDHFITVK

SEQ ID NO: 2803325 - protein, 20 aa, Entamoeba invadens
RPNLFVKLANLFHTLYMIAL

SEQ ID NO: 2803326 - protein, 21 aa, Entamoeba invadens
RPRLISFVLSAGINFEMGDKW

SEQ ID NO: 2803327 - protein, 23 aa, Entamoeba invadens
RPSFSDVCDRIVKIGAEEVNVFK

SEQ ID NO: 2803328 - protein, 19 aa, Entamoeba invadens
RPSGMKGPPKKHVVPQSPL

SEQ ID NO: 2803329 - protein, 26 aa, Entamoeba invadens
RPSNHNWKEVMAMTIIDSVVEQTSQN

SEQ ID NO: 2803330 - protein, 24 aa, Entamoeba invadens
RPTAEVVLSLPLFWDCNKKLHFIR

SEQ ID NO: 2803331 - protein, 27 aa, Entamoeba invadens
RPYQSIFIYEFFNTVAWNIDTKHIIPG

SEQ ID NO: 2803332 - protein, 21 aa, Entamoeba invadens
RQAVPKARFVILIQKGYPSYC

SEQ ID NO: 2803333 - protein, 19 aa, Entamoeba invadens
RQCKICKRGMYPDETSKKC

SEQ ID NO: 2803334 - protein, 21 aa, Entamoeba invadens
RQDGIVIWEYFDRGIEVLFNT

SEQ ID NO: 2803335 - protein, 19 aa, Entamoeba invadens
RQFMMAGLAAIEMGQYIRD

SEQ ID NO: 2803336 - protein, 19 aa, Entamoeba invadens
RQKADIALLVKRITNKSIL

SEQ ID NO: 2803337 - protein, 23 aa, Entamoeba invadens
RQKSTYCIFKMKYSNVNFVNSSD

SEQ ID NO: 2803338 - protein, 17 aa, Entamoeba invadens
RQMSLFLVVSIINYHSD

SEQ ID NO: 2803339 - protein, 18 aa, Entamoeba invadens
RQNFGLGVSLYFDFLYYV

SEQ ID NO: 2803340 - protein, 18 aa, Entamoeba invadens
RQNKSLVFEINCIVNNLV

SEQ ID NO: 2803341 - protein, 18 aa, Entamoeba invadens
RQNYPDCTNYMYNDTSFI

SEQ ID NO: 2803342 - protein, 24 aa, Entamoeba invadens
RQQLLGEIPLDFSTIDSVDKFTDI

SEQ ID NO: 2803343 - protein, 26 aa, Entamoeba invadens
RQRCEKYPLGYGVALIIIAIAIFIAL

SEQ ID NO: 2803344 - protein, 23 aa, Entamoeba invadens
RQRQCIKVSLDLIGTTEHLCTFA

SEQ ID NO: 2803345 - protein, 22 aa, Entamoeba invadens
RQTETKRLFAIMTEEHSNDITV

SEQ ID NO: 2803346 - protein, 30 aa, Entamoeba invadens
RQTFEPAFIFSFAFWWKVGVITLVNALPFI

SEQ ID NO: 2803347 - protein, 24 aa, Entamoeba invadens
RQTFSPLPWNCMKYEVKSTHPLPA

SEQ ID NO: 2803348 - protein, 26 aa, Entamoeba invadens
RQVTVRLRYLLSRRTAYFVMKLQVEI

SEQ ID NO: 2803349 - protein, 17 aa, Entamoeba invadens
RQWSCNGSDYILVVNVR

SEQ ID NO: 2803350 - protein, 18 aa, Entamoeba invadens
RRAVIKNHIDTICMCTYE

SEQ ID NO: 2803351 - protein, 17 aa, Entamoeba invadens
RRCELCGNFNYFNNITK

SEQ ID NO: 2803352 - protein, 19 aa, Entamoeba invadens
RRCSVCKTSYYPNSNGICI

SEQ ID NO: 2803353 - protein, 20 aa, Entamoeba invadens
RRCVSGTCIQCMDGYGFNET

SEQ ID NO: 2803354 - protein, 18 aa, Entamoeba invadens
RRDGSCAICNTTKNTFNK

SEQ ID NO: 2803355 - protein, 24 aa, Entamoeba invadens
RRDHHCPWVKNCIGKNNYKYFIQF

SEQ ID NO: 2803356 - protein, 24 aa, Entamoeba invadens
RRDLWKLAPETGFVYSTQETTFDN

SEQ ID NO: 2803357 - protein, 24 aa, Entamoeba invadens
RRDLWKLAPETGFVYSTQETTFEN

SEQ ID NO: 2803358 - protein, 26 aa, Entamoeba invadens
RRDLWKLNPETGFLFSPNETKLDDKI

SEQ ID NO: 2803359 - protein, 19 aa, Entamoeba invadens
RRDYSFPVDVYSYGIVLYE

SEQ ID NO: 2803360 - protein, 20 aa, Entamoeba invadens
RREILGCIKQFLKYTKVFTK

SEQ ID NO: 2803361 - protein, 22 aa, Entamoeba invadens
RREQTPFFKQFFPMRQRKTRVL

SEQ ID NO: 2803362 - protein, 19 aa, Entamoeba invadens
RREVSSFKQDINYVQYVCH

SEQ ID NO: 2803363 - protein, 17 aa, Entamoeba invadens
RRFDYIQLLSILSIYGI

SEQ ID NO: 2803364 - protein, 18 aa, Entamoeba invadens
RRFLKLKFITATNYFVYF

SEQ ID NO: 2803365 - protein, 18 aa, Entamoeba invadens
RRGCDLCDANECFSCQAN

SEQ ID NO: 2803366 - protein, 19 aa, Entamoeba invadens
RRHGSLLLYLHDIYDEKMM

SEQ ID NO: 2803367 - protein, 17 aa, Entamoeba invadens
RRICHIGVLAYIAVQIN

SEQ ID NO: 2803368 - protein, 18 aa, Entamoeba invadens
RRIFFTIFMPCHIILLVQ

SEQ ID NO: 2803369 - protein, 20 aa, Entamoeba invadens
RRIPVINIFLSPFVFSALVC

SEQ ID NO: 2803370 - protein, 20 aa, Entamoeba invadens
RRIPYHAIFGNIIYGVVVVD

SEQ ID NO: 2803371 - protein, 20 aa, Entamoeba invadens
RRKAIKMYKKKGTPYSGVWS

SEQ ID NO: 2803372 - protein, 21 aa, Entamoeba invadens
RRKPYTYGYWFKLVSDTTRKL

SEQ ID NO: 2803373 - protein, 20 aa, Entamoeba invadens
RRKQIVVIVMRDFEVICLNS

SEQ ID NO: 2803374 - protein, 19 aa, Entamoeba invadens
RRKTYIPSDYNTSFIEHFQ

SEQ ID NO: 2803375 - protein, 22 aa, Entamoeba invadens
RRKYILKLLYIYVLGYEVDFGI

SEQ ID NO: 2803376 - protein, 20 aa, Entamoeba invadens
RRLGAQCFSVVLRYLPLHVT

SEQ ID NO: 2803377 - protein, 21 aa, Entamoeba invadens
RRLHVFGEVFSENGFFQRSDA

SEQ ID NO: 2803378 - protein, 17 aa, Entamoeba invadens
RRLKDPKAFKIKVIITG

SEQ ID NO: 2803379 - protein, 28 aa, Entamoeba invadens
RRLKERRTLWFLWAFWLFFYSAMCLIVF

SEQ ID NO: 2803380 - protein, 19 aa, Entamoeba invadens
RRMGQMLALGNFPQHIVPF

SEQ ID NO: 2803381 - protein, 19 aa, Entamoeba invadens
RRMVTGFDGGEFAVDWLDC

SEQ ID NO: 2803382 - protein, 19 aa, Entamoeba invadens
RRREALRRKICLFDIKNSN

SEQ ID NO: 2803383 - protein, 25 aa, Entamoeba invadens
RRRVLLVDFACCWPSDELKMTADGV

SEQ ID NO: 2803384 - protein, 21 aa, Entamoeba invadens
RRSRAPITRRAPTDLTLNVLY

SEQ ID NO: 2803385 - protein, 17 aa, Entamoeba invadens
RRTKITGNFGVVGKEKM

SEQ ID NO: 2803386 - protein, 20 aa, Entamoeba invadens
RRVDLYDARLVEPFKENIIL

SEQ ID NO: 2803387 - protein, 19 aa, Entamoeba invadens
RRVHRAVLFFYNNTIPFFS

SEQ ID NO: 2803388 - protein, 18 aa, Entamoeba invadens
RRVISWGAALLARHSQTK

SEQ ID NO: 2803389 - protein, 20 aa, Entamoeba invadens
RRVYEGLYLITFKRDFVKAS

SEQ ID NO: 2803390 - protein, 20 aa, Entamoeba invadens
RRWFALKDNLCYKCGENCTT

SEQ ID NO: 2803391 - protein, 18 aa, Entamoeba invadens
RRYYLQLFGYYGMVPTSN

SEQ ID NO: 2803392 - protein, 20 aa, Entamoeba invadens
RSCNYCRFNNPYLDTSDVYI

SEQ ID NO: 2803393 - protein, 20 aa, Entamoeba invadens
RSDCKVPVITDGASWSSKRD

SEQ ID NO: 2803394 - protein, 27 aa, Entamoeba invadens
RSDCQGCLDGYLAQGYLKCESFNKTTV

SEQ ID NO: 2803395 - protein, 25 aa, Entamoeba invadens
RSDCSQCILGYFLTQCGDWPVTCRK

SEQ ID NO: 2803396 - protein, 18 aa, Entamoeba invadens
RSDWNKRPTSSIVLDEIQ

SEQ ID NO: 2803397 - protein, 28 aa, Entamoeba invadens
RSEESYLIKEGKFEEGWHINSTDGNVGI

SEQ ID NO: 2803398 - protein, 19 aa, Entamoeba invadens
RSEYGCVQNCYCDTANGFF

SEQ ID NO: 2803399 - protein, 23 aa, Entamoeba invadens
RSFFGILCYVAYVTLFYDYINTL

SEQ ID NO: 2803400 - protein, 24 aa, Entamoeba invadens
RSFICPFTRNFYAPYVFYLFDALM

SEQ ID NO: 2803401 - protein, 19 aa, Entamoeba invadens
RSFTGCPYYSVPIKAEDTD

SEQ ID NO: 2803402 - protein, 26 aa, Entamoeba invadens
RSGECMMPLIVLFSFFIWTYDFFLFR

SEQ ID NO: 2803403 - protein, 18 aa, Entamoeba invadens
RSGGLIVRENVYLDIYGY

SEQ ID NO: 2803404 - protein, 26 aa, Entamoeba invadens
RSIILLCCLCPAPLLNIIYSVEYKAA

SEQ ID NO: 2803405 - protein, 18 aa, Entamoeba invadens
RSISCGKTSYIFIVGSMF

SEQ ID NO: 2803406 - protein, 23 aa, Entamoeba invadens
RSISNCCFKDCIQLTSINFPSSV

SEQ ID NO: 2803407 - protein, 17 aa, Entamoeba invadens
RSKCRRCVSGTCIQCMD

SEQ ID NO: 2803408 - protein, 19 aa, Entamoeba invadens
RSKECMITEFALFGSLKDV

SEQ ID NO: 2803409 - protein, 30 aa, Entamoeba invadens
RSKGFSNVKYYFFKGTFEIQLQGNFTKKVA

SEQ ID NO: 2803410 - protein, 31 aa, Entamoeba invadens
RSKHLISILFCEACAIYGVISGFICFGKLKE

SEQ ID NO: 2803411 - protein, 23 aa, Entamoeba invadens
RSKSAEAFFSIIVILVDEFDSVK

SEQ ID NO: 2803412 - protein, 19 aa, Entamoeba invadens
RSLLLPAFVNILGELNWFP

SEQ ID NO: 2803413 - protein, 23 aa, Entamoeba invadens
RSLSLNFISSVILKVKTSSSTDY

SEQ ID NO: 2803414 - protein, 17 aa, Entamoeba invadens
RSLSSGNIFWVKAPQNK

SEQ ID NO: 2803415 - protein, 19 aa, Entamoeba invadens
RSNCCVDRFDHWCSWVGNT

SEQ ID NO: 2803416 - protein, 19 aa, Entamoeba invadens
RSNCEVCDFGISIGTSCFI

SEQ ID NO: 2803417 - protein, 18 aa, Entamoeba invadens
RSNILPRNDFLRLTHWAT

SEQ ID NO: 2803418 - protein, 18 aa, Entamoeba invadens
RSNIMFYKVNDWLVVNKE

SEQ ID NO: 2803419 - protein, 26 aa, Entamoeba invadens
RSNISFPFEVCESLVSNKSKLTFKDD

SEQ ID NO: 2803420 - protein, 31 aa, Entamoeba invadens
RSNVIYCLLESLALEECYRVFQSQNERRNEK

SEQ ID NO: 2803421 - protein, 28 aa, Entamoeba invadens
RSQLMSSCYLIFKCLEDILSRDEDVKIR

SEQ ID NO: 2803422 - protein, 21 aa, Entamoeba invadens
RSQNFPAQLLFSYPPKNTLND

SEQ ID NO: 2803423 - protein, 17 aa, Entamoeba invadens
RSQVSLLVPENMLAARF

SEQ ID NO: 2803424 - protein, 19 aa, Entamoeba invadens
RSQYIVSFIGVCVDDESIC

SEQ ID NO: 2803425 - protein, 25 aa, Entamoeba invadens
RSRCKKARSTAMLVYHFLFAGGAIT

SEQ ID NO: 2803426 - protein, 17 aa, Entamoeba invadens
RSSKIFGKFSTKPENKY

SEQ ID NO: 2803427 - protein, 22 aa, Entamoeba invadens
RSSRNTHLFFLKPITHIDLTST

SEQ ID NO: 2803428 - protein, 17 aa, Entamoeba invadens
RSSVVPVKGIFDGDLCE

SEQ ID NO: 2803429 - protein, 19 aa, Entamoeba invadens
RSTFTINFMYDIAFSLGFF

SEQ ID NO: 2803430 - protein, 17 aa, Entamoeba invadens
RSTHIPLINTVVSMTAP

SEQ ID NO: 2803431 - protein, 17 aa, Entamoeba invadens
RSVCGLSGSQSCTECEN

SEQ ID NO: 2803432 - protein, 25 aa, Entamoeba invadens
RSVCIQCPYNYYYENGRCIEIINCV

SEQ ID NO: 2803433 - protein, 22 aa, Entamoeba invadens
RSVLERIERILVNKSIQTWTQL

SEQ ID NO: 2803434 - protein, 28 aa, Entamoeba invadens
RSVLYAIVMLYLRSGFYGRVNDMNIESI

SEQ ID NO: 2803435 - protein, 21 aa, Entamoeba invadens
RSVMIYQFCLNKFYDKIDTLT

SEQ ID NO: 2803436 - protein, 25 aa, Entamoeba invadens
RSVTRFEVLGLISLIVSLISGYGYY

SEQ ID NO: 2803437 - protein, 25 aa, Entamoeba invadens
RSVTSFRLTDAFSRKSQTLRHSETA

SEQ ID NO: 2803438 - protein, 19 aa, Entamoeba invadens
RSVVHECEMMSKLRNPFIA

SEQ ID NO: 2803439 - protein, 17 aa, Entamoeba invadens
RSWEGRRIGVLGEEERI

SEQ ID NO: 2803440 - protein, 25 aa, Entamoeba invadens
RSWEVPSPKAILFFQHGYGEHSGRY

SEQ ID NO: 2803441 - protein, 19 aa, Entamoeba invadens
RSYFYKFTLNSAIDIDIST

SEQ ID NO: 2803442 - protein, 34 aa, Entamoeba invadens
RSYLKVPLRCSVLLDHFEWSLKIISMPISSVFSP

SEQ ID NO: 2803443 - protein, 26 aa, Entamoeba invadens
RTAMPRAQMVLLLFHFPPIWCIGDME

SEQ ID NO: 2803444 - protein, 19 aa, Entamoeba invadens
RTANDFPALLEAIYIDIRQ

SEQ ID NO: 2803445 - protein, 18 aa, Entamoeba invadens
RTASNVVASFSFDEEYIK

SEQ ID NO: 2803446 - protein, 19 aa, Entamoeba invadens
RTCSPDSSQKCIFCNQNYY

SEQ ID NO: 2803447 - protein, 19 aa, Entamoeba invadens
RTDYCISCVNGYYWDKQIL

SEQ ID NO: 2803448 - protein, 21 aa, Entamoeba invadens
RTELQTQKWRAFFKSLKGKPD

SEQ ID NO: 2803449 - protein, 19 aa, Entamoeba invadens
RTETWRKLFNYKYKDTYWS

SEQ ID NO: 2803450 - protein, 17 aa, Entamoeba invadens
RTEVLCGNETTFKSEQS

SEQ ID NO: 2803451 - protein, 17 aa, Entamoeba invadens
RTFDCLNTECSITNTSI

SEQ ID NO: 2803452 - protein, 23 aa, Entamoeba invadens
RTFKSIKNMEGFVSTPLNQPNLK

SEQ ID NO: 2803453 - protein, 24 aa, Entamoeba invadens
RTFTYSQCRVHYWLNTSQFNVSGQ

SEQ ID NO: 2803454 - protein, 29 aa, Entamoeba invadens
RTGEIPNTFLCNACGLKVLKKKKKESQTS

SEQ ID NO: 2803455 - protein, 24 aa, Entamoeba invadens
RTGMSLSLIAMVFGGLIPIVHIVV

SEQ ID NO: 2803456 - protein, 22 aa, Entamoeba invadens
RTHHCGFCKKCILKYDHHCAWM

SEQ ID NO: 2803457 - protein, 24 aa, Entamoeba invadens
RTHHCSKCKECVLCMDHHCLYIAN

SEQ ID NO: 2803458 - protein, 19 aa, Entamoeba invadens
RTIDASQRLVRYIQSPTSL

SEQ ID NO: 2803459 - protein, 17 aa, Entamoeba invadens
RTIKDLPLFFVSNTTSI

SEQ ID NO: 2803460 - protein, 17 aa, Entamoeba invadens
RTILRLKYMLDVSKGIM

SEQ ID NO: 2803461 - protein, 20 aa, Entamoeba invadens
RTINDLLLIWNVRKPADKNE

SEQ ID NO: 2803462 - protein, 27 aa, Entamoeba invadens
RTIRDIPLFITRNFVFRIITITTTYDF

SEQ ID NO: 2803463 - protein, 24 aa, Entamoeba invadens
RTIRDLPIFFSYQINMTIFSFQNS

SEQ ID NO: 2803464 - protein, 24 aa, Entamoeba invadens
RTIRDLPIFFTYQINTTIFSFQNS

SEQ ID NO: 2803465 - protein, 22 aa, Entamoeba invadens
RTIRDLPLFFFEKEFSLPANMT

SEQ ID NO: 2803466 - protein, 19 aa, Entamoeba invadens
RTISILSLVLFILMTVSVT

SEQ ID NO: 2803467 - protein, 19 aa, Entamoeba invadens
RTIYECIFCDSGYGLNTLN

SEQ ID NO: 2803468 - protein, 21 aa, Entamoeba invadens
RTKCIQCYKGFVLNQNHCTQL

SEQ ID NO: 2803469 - protein, 37 aa, Entamoeba invadens
RTKDCAMEYLVFLLIGTVCVFSCQYVSPLVHTLIFEF

SEQ ID NO: 2803470 - protein, 22 aa, Entamoeba invadens
RTKPYPCLYLLNSSRINGSSFL

SEQ ID NO: 2803471 - protein, 18 aa, Entamoeba invadens
RTLGIFFNLLLNWLKGKY

SEQ ID NO: 2803472 - protein, 24 aa, Entamoeba invadens
RTLGREVIKDFVLKDVQHIEAPNE

SEQ ID NO: 2803473 - protein, 17 aa, Entamoeba invadens
RTLPESFCLRIKNINIG

SEQ ID NO: 2803474 - protein, 19 aa, Entamoeba invadens
RTLSQYPIYPWVISSYDSA

SEQ ID NO: 2803475 - protein, 19 aa, Entamoeba invadens
RTLWDNFSHEYIMCTLGLI

SEQ ID NO: 2803476 - protein, 32 aa, Entamoeba invadens
RTNANCSLCIGSTCQQCKPTFYLESGVCKTVD

SEQ ID NO: 2803477 - protein, 19 aa, Entamoeba invadens
RTNCTSCYNGYYFYYSSTY

SEQ ID NO: 2803478 - protein, 19 aa, Entamoeba invadens
RTNLKLIIKHTKYTIQNNE

SEQ ID NO: 2803479 - protein, 20 aa, Entamoeba invadens
RTPFHYCVLGGHLQLVKLLR

SEQ ID NO: 2803480 - protein, 20 aa, Entamoeba invadens
RTPGMLLYFGCMNSVGCRTS

SEQ ID NO: 2803481 - protein, 17 aa, Entamoeba invadens
RTPLPLNGQTSYQTYPP

SEQ ID NO: 2803482 - protein, 21 aa, Entamoeba invadens
RTRIDRIGGDWIFLNIKGLMV

SEQ ID NO: 2803483 - protein, 25 aa, Entamoeba invadens
RTRTVDWTSPIFFQIFVKGVTHTFY

SEQ ID NO: 2803484 - protein, 17 aa, Entamoeba invadens
RTTGSFNYPDCRYLSRL

SEQ ID NO: 2803485 - protein, 19 aa, Entamoeba invadens
RTTHIPLINTMVSMEDPTT

SEQ ID NO: 2803486 - protein, 25 aa, Entamoeba invadens
RTTNFFLKNVMEFETGGNFYITKIH

SEQ ID NO: 2803487 - protein, 19 aa, Entamoeba invadens
RTTPSFPCECSLCCEKHFR

SEQ ID NO: 2803488 - protein, 27 aa, Entamoeba invadens
RTTTLKRLGCLPGQYYVNGNCEYCEAG

SEQ ID NO: 2803489 - protein, 21 aa, Entamoeba invadens
RTTVPTLPCYIGLHKYSVGTF

SEQ ID NO: 2803490 - protein, 24 aa, Entamoeba invadens
RTVDCPYKAFPSAIITDFVTDPTT

SEQ ID NO: 2803491 - protein, 20 aa, Entamoeba invadens
RTVFTDVWLPNDIDTQQGFR

SEQ ID NO: 2803492 - protein, 24 aa, Entamoeba invadens
RTVLELNMKLPFINVKPFTVCTWF

SEQ ID NO: 2803493 - protein, 17 aa, Entamoeba invadens
RTVPSLISLKRGEACEF

SEQ ID NO: 2803494 - protein, 19 aa, Entamoeba invadens
RTYFPPKIDVLLTTEMKVF

SEQ ID NO: 2803495 - protein, 26 aa, Entamoeba invadens
RTYGPGCLLWGLLIVLQFAIIGVILK

SEQ ID NO: 2803496 - protein, 28 aa, Entamoeba invadens
RTYVDGCVPLCGVCSGGYVCNKAARCVP

SEQ ID NO: 2803497 - protein, 19 aa, Entamoeba invadens
RVASICFNAKMKINAAKFT

SEQ ID NO: 2803498 - protein, 21 aa, Entamoeba invadens
RVEFIEEFSCLKDCLEADPIT

SEQ ID NO: 2803499 - protein, 22 aa, Entamoeba invadens
RVEIWKGLIVNGLKNKVVALDI

SEQ ID NO: 2803500 - protein, 24 aa, Entamoeba invadens
RVEKIGCLHEKLFLFRSDGNVEIR

SEQ ID NO: 2803501 - protein, 17 aa, Entamoeba invadens
RVEKRKKYYLRWHSSLF

SEQ ID NO: 2803502 - protein, 17 aa, Entamoeba invadens
RVFEGIVTLTSTTITGT

SEQ ID NO: 2803503 - protein, 22 aa, Entamoeba invadens
RVFKKGSDDYMCYCNYTNGAFY

SEQ ID NO: 2803504 - protein, 25 aa, Entamoeba invadens
RVFKVFRTSEEIHFIDYFEKIPQRV

SEQ ID NO: 2803505 - protein, 19 aa, Entamoeba invadens
RVFVYSVAFGNMMYIPLAL

SEQ ID NO: 2803506 - protein, 18 aa, Entamoeba invadens
RVGCAICHSGYFLQDFQC

SEQ ID NO: 2803507 - protein, 19 aa, Entamoeba invadens
RVGIMKQGYFLAKRDKLYI

SEQ ID NO: 2803508 - protein, 19 aa, Entamoeba invadens
RVHNKAAKIRQFAVELLGN

SEQ ID NO: 2803509 - protein, 24 aa, Entamoeba invadens
RVIACKPGFYTQYFKLCNVCPDKC

SEQ ID NO: 2803510 - protein, 19 aa, Entamoeba invadens
RVILRLDDVLAILIPIHNK

SEQ ID NO: 2803511 - protein, 17 aa, Entamoeba invadens
RVIQIGFIFSMCATSVQ

SEQ ID NO: 2803512 - protein, 25 aa, Entamoeba invadens
RVIRYFCQYNRAFKLVQKLLPEQVT

SEQ ID NO: 2803513 - protein, 27 aa, Entamoeba invadens
RVISYKEMIRFAIFFIKQKLGKIPEKE

SEQ ID NO: 2803514 - protein, 21 aa, Entamoeba invadens
RVKDEKVMFEGEWQVVQEALY

SEQ ID NO: 2803515 - protein, 38 aa, Entamoeba invadens
RVKEIGDFCFKNCTCFLNDLYLPYGLTKIGYGAFQNIT

SEQ ID NO: 2803516 - protein, 27 aa, Entamoeba invadens
RVKEIGDFCFKNCTCNSFVDLYLPHGL

SEQ ID NO: 2803517 - protein, 25 aa, Entamoeba invadens
RVKFYLKAILIFSIILTVILAVVRA

SEQ ID NO: 2803518 - protein, 17 aa, Entamoeba invadens
RVKMMLDGARGILYLHE

SEQ ID NO: 2803519 - protein, 23 aa, Entamoeba invadens
RVKNWKCCFPGCDQPPKTRFNCY

SEQ ID NO: 2803520 - protein, 24 aa, Entamoeba invadens
RVKRISLIPIYMLRVFFAKNDTVK

SEQ ID NO: 2803521 - protein, 21 aa, Entamoeba invadens
RVKTMRFRSRLFSEEYNQQTE

SEQ ID NO: 2803522 - protein, 20 aa, Entamoeba invadens
RVKVKMMFDAARGMRFLHEN

SEQ ID NO: 2803523 - protein, 19 aa, Entamoeba invadens
RVKWCKLNNNFSCVEVNKN

SEQ ID NO: 2803524 - protein, 20 aa, Entamoeba invadens
RVLFGMALCHNVTPSLMANG

SEQ ID NO: 2803525 - protein, 20 aa, Entamoeba invadens
RVLLWKSSYLHLHYNFIYNK

SEQ ID NO: 2803526 - protein, 17 aa, Entamoeba invadens
RVLNLPLSRTIIASRTW

SEQ ID NO: 2803527 - protein, 25 aa, Entamoeba invadens
RVLRKKRNITAFPMTFKPLTLPKPK

SEQ ID NO: 2803528 - protein, 19 aa, Entamoeba invadens
RVLRPAYNKLVQFDMIPSG

SEQ ID NO: 2803529 - protein, 17 aa, Entamoeba invadens
RVLSLLATMFGWIGGIV

SEQ ID NO: 2803530 - protein, 18 aa, Entamoeba invadens
RVLTWSYLFIYLLACLTH

SEQ ID NO: 2803531 - protein, 17 aa, Entamoeba invadens
RVPRLCYNESWVCGDDI

SEQ ID NO: 2803532 - protein, 18 aa, Entamoeba invadens
RVQIFIDRSYLLFNSSFK

SEQ ID NO: 2803533 - protein, 18 aa, Entamoeba invadens
RVRDKGKNAEEFSGNAFE

SEQ ID NO: 2803534 - protein, 19 aa, Entamoeba invadens
RVREYKPTSGIFQSSVVAA

SEQ ID NO: 2803535 - protein, 33 aa, Entamoeba invadens
RVSISVNMLFDICLELGFFFTLKKSRKTSSTLR

SEQ ID NO: 2803536 - protein, 18 aa, Entamoeba invadens
RVSKIVCLQDFFFFTKKI

SEQ ID NO: 2803537 - protein, 19 aa, Entamoeba invadens
RVSNAQCMDALSSQNNLAG

SEQ ID NO: 2803538 - protein, 22 aa, Entamoeba invadens
RVSQNLNCYCSIQAGGNLYDES

SEQ ID NO: 2803539 - protein, 28 aa, Entamoeba invadens
RVTAERRGRYVLTIKFKSSETIPITIRE

SEQ ID NO: 2803540 - protein, 20 aa, Entamoeba invadens
RVTGNSFVMHGLEIITGAIK

SEQ ID NO: 2803541 - protein, 18 aa, Entamoeba invadens
RVTHCDICNTCILRYDHH

SEQ ID NO: 2803542 - protein, 29 aa, Entamoeba invadens
RVVGIYLVLVLGMWLWGQFFCQWKNVFYL

SEQ ID NO: 2803543 - protein, 28 aa, Entamoeba invadens
RVVICCMYAVSVLFGIVGLIILLLIKNK

SEQ ID NO: 2803544 - protein, 28 aa, Entamoeba invadens
RVVPLCLPCSFVFWFFGKVLDHPKRIKP

SEQ ID NO: 2803545 - protein, 25 aa, Entamoeba invadens
RVVRARIVSIMSFFSSTIFPLLTQT

SEQ ID NO: 2803546 - protein, 25 aa, Entamoeba invadens
RVVRYYCQFERAFKMVKQLLPGQIS

SEQ ID NO: 2803547 - protein, 26 aa, Entamoeba invadens
RVVVIPANWFSKWMIMLNSKTREPLG

SEQ ID NO: 2803548 - protein, 20 aa, Entamoeba invadens
RWAASGFDGGLSFPVSPIDV

SEQ ID NO: 2803549 - protein, 29 aa, Entamoeba invadens
RWETLRLLIWRVSRGFAIVRSTGLDTGRT

SEQ ID NO: 2803550 - protein, 22 aa, Entamoeba invadens
RWHQKVPFFWTYKPYYEPRTLR

SEQ ID NO: 2803551 - protein, 30 aa, Entamoeba invadens
RWKAYLKKRDVEALFYLPFHPVLLTLFVTP

SEQ ID NO: 2803552 - protein, 24 aa, Entamoeba invadens
RWKDGCAPICGRCRDGFVCTTMGK

SEQ ID NO: 2803553 - protein, 17 aa, Entamoeba invadens
RWTFFLVSCFVSVVIYG

SEQ ID NO: 2803554 - protein, 20 aa, Entamoeba invadens
RWVILICVIVALLILTTVII

SEQ ID NO: 2803555 - protein, 17 aa, Entamoeba invadens
RYAHCLSQARIIQKDGL

SEQ ID NO: 2803556 - protein, 19 aa, Entamoeba invadens
RYAPLSSMYFARMSKALFS

SEQ ID NO: 2803557 - protein, 21 aa, Entamoeba invadens
RYCNNCIMGYFFENGKCLNCT

SEQ ID NO: 2803558 - protein, 19 aa, Entamoeba invadens
RYCRLKGYNTMFVCGTDEY

SEQ ID NO: 2803559 - protein, 21 aa, Entamoeba invadens
RYDIEGWKKLHQDLKPFLKND

SEQ ID NO: 2803560 - protein, 20 aa, Entamoeba invadens
RYDSACFNTKYILYYLFGTN

SEQ ID NO: 2803561 - protein, 18 aa, Entamoeba invadens
RYEESCGNLVLLFNLSMA

SEQ ID NO: 2803562 - protein, 26 aa, Entamoeba invadens
RYEKIYECLSIIFLMSVGVYYGGVAL

SEQ ID NO: 2803563 - protein, 24 aa, Entamoeba invadens
RYERSEISGFYFSKGQFQNKNDTI

SEQ ID NO: 2803564 - protein, 23 aa, Entamoeba invadens
RYFFGEFIGCFILFFCANASPFF

SEQ ID NO: 2803565 - protein, 24 aa, Entamoeba invadens
RYFIMYCLFDFVAYCVLLRLPILF

SEQ ID NO: 2803566 - protein, 19 aa, Entamoeba invadens
RYGLNTDVGCVCRFEGNVY

SEQ ID NO: 2803567 - protein, 28 aa, Entamoeba invadens
RYHMYKELECDLELIGATAIEDQLQEGV

SEQ ID NO: 2803568 - protein, 20 aa, Entamoeba invadens
RYIAPNILTTLGFVSMALCW

SEQ ID NO: 2803569 - protein, 19 aa, Entamoeba invadens
RYICYLPLAHIFELTIEFC

SEQ ID NO: 2803570 - protein, 19 aa, Entamoeba invadens
RYIIVAFWFITFLGLCYPA

SEQ ID NO: 2803571 - protein, 18 aa, Entamoeba invadens
RYINWFDGLMLLLGLCGS

SEQ ID NO: 2803572 - protein, 24 aa, Entamoeba invadens
RYKEWKCTFPGCTEGPKTKYNAVS

SEQ ID NO: 2803573 - protein, 18 aa, Entamoeba invadens
RYLDHSVTLDPFVLYVVE

SEQ ID NO: 2803574 - protein, 19 aa, Entamoeba invadens
RYLLMLMGLYSMYCGCLFN

SEQ ID NO: 2803575 - protein, 21 aa, Entamoeba invadens
RYMAPECFSNYFSYGSDKYAF

SEQ ID NO: 2803576 - protein, 21 aa, Entamoeba invadens
RYNLIWCKDFIPGVNANITLN

SEQ ID NO: 2803577 - protein, 28 aa, Entamoeba invadens
RYNQCQMCKPGFVLKEFGCANMSSILQD

SEQ ID NO: 2803578 - protein, 21 aa, Entamoeba invadens
RYNQTNGWEKLCFNTNTIKNE

SEQ ID NO: 2803579 - protein, 17 aa, Entamoeba invadens
RYPLTCQEYDLFGEILD

SEQ ID NO: 2803580 - protein, 19 aa, Entamoeba invadens
RYQPFFISFGCFNKEQVCR

SEQ ID NO: 2803581 - protein, 20 aa, Entamoeba invadens
RYQQFLNWIDKNSFMMDYRF

SEQ ID NO: 2803582 - protein, 27 aa, Entamoeba invadens
RYQVSSLIKFCFYKNAAFFLLDVSYAF

SEQ ID NO: 2803583 - protein, 20 aa, Entamoeba invadens
RYRCDELITLVLKEFEEDIQ

SEQ ID NO: 2803584 - protein, 18 aa, Entamoeba invadens
RYSKNVFIGCGYGIAGTL

SEQ ID NO: 2803585 - protein, 36 aa, Entamoeba invadens
RYSLKNTKCVECLDAFKLKNGICADTFDEDNKFKTD

SEQ ID NO: 2803586 - protein, 25 aa, Entamoeba invadens
RYSNFKRIYKSVVFEKITHFMDSDS

SEQ ID NO: 2803587 - protein, 20 aa, Entamoeba invadens
RYSQIKTLIAPFLEEKKESI

SEQ ID NO: 2803588 - protein, 32 aa, Entamoeba invadens
RYTPCYWRSTVGLGYCLLCFILDVADYHTDVE

SEQ ID NO: 2803589 - protein, 18 aa, Entamoeba invadens
RYTPKQALTHPFVTGTSM

SEQ ID NO: 2803590 - protein, 19 aa, Entamoeba invadens
RYVDRHWLDVAKFSKDRMP

SEQ ID NO: 2803591 - protein, 19 aa, Entamoeba invadens
RYVDRHWLDVAKFSNNRMP

SEQ ID NO: 2803592 - protein, 29 aa, Entamoeba invadens
RYVYWKFHMAMCVATLFMLQNLSDWSVFK

SEQ ID NO: 2803593 - protein, 21 aa, Entamoeba invadens
RYYRSPEVALGIPYSCAIDMW

SEQ ID NO: 2803594 - protein, 19 aa, Entamoeba invadens
SAALAFFWSPCECLITNES

SEQ ID NO: 2803595 - protein, 19 aa, Entamoeba invadens
SAALGLTIACSVALGYSNI

SEQ ID NO: 2803596 - protein, 18 aa, Entamoeba invadens
SAAVWWKEHFSNRGDAEN

SEQ ID NO: 2803597 - protein, 24 aa, Entamoeba invadens
SACANGFYRIVRLVRYNSGTVLKC

SEQ ID NO: 2803598 - protein, 18 aa, Entamoeba invadens
SACDNFALQCDSFGVLTC

SEQ ID NO: 2803599 - protein, 21 aa, Entamoeba invadens
SACDYVFHFLVRVEPFTSMFI

SEQ ID NO: 2803600 - protein, 25 aa, Entamoeba invadens
SACIPKRENCLFDRLSGCDECSNSY

SEQ ID NO: 2803601 - protein, 24 aa, Entamoeba invadens
SACMPSVFMKAMLFTLEYKGRGYV

SEQ ID NO: 2803602 - protein, 19 aa, Entamoeba invadens
SACSSCKDGEYSLSGSSIC

SEQ ID NO: 2803603 - protein, 19 aa, Entamoeba invadens
SACTLCPSGQYSASSGSSI

SEQ ID NO: 2803604 - protein, 21 aa, Entamoeba invadens
SACVNCGPGTYSNGDNKESCT

SEQ ID NO: 2803605 - protein, 25 aa, Entamoeba invadens
SADLKRLRVAGQIFAENGFLQRSDA

SEQ ID NO: 2803606 - protein, 19 aa, Entamoeba invadens
SADSCALVAQNGWCITCQI

SEQ ID NO: 2803607 - protein, 25 aa, Entamoeba invadens
SAECKSCNTTCKMCDKKTGLCISCD

SEQ ID NO: 2803608 - protein, 20 aa, Entamoeba invadens
SAEIKLEVNTTCPLDCGEHG

SEQ ID NO: 2803609 - protein, 17 aa, Entamoeba invadens
SAERWKIEKIVEQLEII

SEQ ID NO: 2803610 - protein, 27 aa, Entamoeba invadens
SAFEELMFFKWYIKHINMDGTGTMYDS

SEQ ID NO: 2803611 - protein, 23 aa, Entamoeba invadens
SAFENCKVLEQFDINGLESIYKN

SEQ ID NO: 2803612 - protein, 23 aa, Entamoeba invadens
SAFKPFIVVPWTFVSEIIVALPL

SEQ ID NO: 2803613 - protein, 17 aa, Entamoeba invadens
SAFLHTLRLHWIEFQNK

SEQ ID NO: 2803614 - protein, 17 aa, Entamoeba invadens
SAFLHTLRLHWVEFQNK

SEQ ID NO: 2803615 - protein, 19 aa, Entamoeba invadens
SAFLRRVDLYDARLVEPFK

SEQ ID NO: 2803616 - protein, 25 aa, Entamoeba invadens
SAFLVEVFCGILLLLVVFETSTLSS

SEQ ID NO: 2803617 - protein, 18 aa, Entamoeba invadens
SAFSECRYVWNIASKTSN

SEQ ID NO: 2803618 - protein, 18 aa, Entamoeba invadens
SAFVFLESLSLRACQIDD

SEQ ID NO: 2803619 - protein, 24 aa, Entamoeba invadens
SAGKCFPGQMWTTFESVRSASPNA

SEQ ID NO: 2803620 - protein, 17 aa, Entamoeba invadens
SAGKCLFGSANCDQYCQ

SEQ ID NO: 2803621 - protein, 17 aa, Entamoeba invadens
SAGRTSVIIAHRLSTIR

SEQ ID NO: 2803622 - protein, 23 aa, Entamoeba invadens
SAICRLKKSFSFVSPEYAKISQR

SEQ ID NO: 2803623 - protein, 23 aa, Entamoeba invadens
SAITIYVCGIFVLSPPSVDTHPL

SEQ ID NO: 2803624 - protein, 25 aa, Entamoeba invadens
SAKAILECEDGFYLSGNTCVPCLEN

SEQ ID NO: 2803625 - protein, 36 aa, Entamoeba invadens
SAKEFPCGTWNDFSMKSSIVLLGLGLICLVLTFLEG

SEQ ID NO: 2803626 - protein, 31 aa, Entamoeba invadens
SAKKRMNTLMWMKRPDSLRMFTKGAPEMILD

SEQ ID NO: 2803627 - protein, 20 aa, Entamoeba invadens
SAKLGVKGAGFVFKEACNGV

SEQ ID NO: 2803628 - protein, 18 aa, Entamoeba invadens
SAKLNCDVLEAFKDDQFM

SEQ ID NO: 2803629 - protein, 27 aa, Entamoeba invadens
SAKNLWIKGYFKYLWSDSTIAVDNINT

SEQ ID NO: 2803630 - protein, 18 aa, Entamoeba invadens
SALCGFGASLIWSASAVL

SEQ ID NO: 2803631 - protein, 19 aa, Entamoeba invadens
SALEIEVPFSGVFSNTYHS

SEQ ID NO: 2803632 - protein, 17 aa, Entamoeba invadens
SALENAYTLIVLTSDNG

SEQ ID NO: 2803633 - protein, 20 aa, Entamoeba invadens
SALITFVAIFLLRSQMTHSI

SEQ ID NO: 2803634 - protein, 22 aa, Entamoeba invadens
SALKTRTPRAFNRTVSLNIVEI

SEQ ID NO: 2803635 - protein, 20 aa, Entamoeba invadens
SALPIVARFVDCPYKTFPTA

SEQ ID NO: 2803636 - protein, 17 aa, Entamoeba invadens
SALPKFIFGSLLQKCKP

SEQ ID NO: 2803637 - protein, 19 aa, Entamoeba invadens
SALSEMRDVIVNLKYNVLT

SEQ ID NO: 2803638 - protein, 22 aa, Entamoeba invadens
SANARLKRLILRDDDKKMWAII

SEQ ID NO: 2803639 - protein, 17 aa, Entamoeba invadens
SANGRYQMNVQRLDSTL

SEQ ID NO: 2803640 - protein, 18 aa, Entamoeba invadens
SANNGTCVSCSFWYVPST

SEQ ID NO: 2803641 - protein, 18 aa, Entamoeba invadens
SANNICFIKQCENTDKVI

SEQ ID NO: 2803642 - protein, 22 aa, Entamoeba invadens
SANTCSLCDAGLYQNLTAQTEC

SEQ ID NO: 2803643 - protein, 17 aa, Entamoeba invadens
SAQMGYCTNCTDGRFIS

SEQ ID NO: 2803644 - protein, 18 aa, Entamoeba invadens
SARFSFHIISIFVYYIAI

SEQ ID NO: 2803645 - protein, 22 aa, Entamoeba invadens
SARVWGSMCCLLYLFVFLVFGL

SEQ ID NO: 2803646 - protein, 17 aa, Entamoeba invadens
SASKAKGFLNFCEENDG

SEQ ID NO: 2803647 - protein, 25 aa, Entamoeba invadens
SASMSCIRIGQIIPEMGKAQGAAKR

SEQ ID NO: 2803648 - protein, 17 aa, Entamoeba invadens
SASSSVCKKCSGYYQLT

SEQ ID NO: 2803649 - protein, 18 aa, Entamoeba invadens
SATCTMKKVFSCQPHYFL

SEQ ID NO: 2803650 - protein, 37 aa, Entamoeba invadens
SATILRIKGIFQISGGLTKFSDFYMKTSISNKITSEV

SEQ ID NO: 2803651 - protein, 24 aa, Entamoeba invadens
SATLNRWIDLIFGYKSCGEEALKA

SEQ ID NO: 2803652 - protein, 25 aa, Entamoeba invadens
SATTGRFKVDHIVYLNSVGTSEIDL

SEQ ID NO: 2803653 - protein, 25 aa, Entamoeba invadens
SAVATLGAFGYILSVSKVGSLNVKG

SEQ ID NO: 2803654 - protein, 24 aa, Entamoeba invadens
SAVCGKLTDFGTCRNISDRNKMNK

SEQ ID NO: 2803655 - protein, 24 aa, Entamoeba invadens
SAVCGKLTDFGTCRNISDRSVLNK

SEQ ID NO: 2803656 - protein, 20 aa, Entamoeba invadens
SAVGLCIIGSVFVGEAPLNA

SEQ ID NO: 2803657 - protein, 17 aa, Entamoeba invadens
SAVSFELQMNSPRKFTE

SEQ ID NO: 2803658 - protein, 21 aa, Entamoeba invadens
SAVWWRPPSFNTKEGKEKGLC

SEQ ID NO: 2803659 - protein, 18 aa, Entamoeba invadens
SAWKRYVEGRGEFRDPLL

SEQ ID NO: 2803660 - protein, 20 aa, Entamoeba invadens
SAYFRWTVPVPYDKTFYSED

SEQ ID NO: 2803661 - protein, 20 aa, Entamoeba invadens
SAYKQMTIRAMEECRVFERF

SEQ ID NO: 2803662 - protein, 24 aa, Entamoeba invadens
SAYLIFPFLCSFIAIILSFLAVPI

SEQ ID NO: 2803663 - protein, 22 aa, Entamoeba invadens
SAYLTCFFFFIATQGCSGLFQS

SEQ ID NO: 2803664 - protein, 19 aa, Entamoeba invadens
SAYWCSDAQDIPPSFITCD

SEQ ID NO: 2803665 - protein, 22 aa, Entamoeba invadens
SCAGEKCTKCSEGFSLTSDGLE

SEQ ID NO: 2803666 - protein, 26 aa, Entamoeba invadens
SCAKCSGVTCYECKNSSQILLNGICT

SEQ ID NO: 2803667 - protein, 17 aa, Entamoeba invadens
SCAPNMCNTSNGNCDKC

SEQ ID NO: 2803668 - protein, 25 aa, Entamoeba invadens
SCAQTEFLVFCFNKDFTFSSGSKFY

SEQ ID NO: 2803669 - protein, 18 aa, Entamoeba invadens
SCASKFVNCDICEQDRCT

SEQ ID NO: 2803670 - protein, 31 aa, Entamoeba invadens
SCATLGLLYRSCFACGSGCYNNEEALRDYSC

SEQ ID NO: 2803671 - protein, 22 aa, Entamoeba invadens
SCAVSLEVAKFIQTMFMESDTD

SEQ ID NO: 2803672 - protein, 18 aa, Entamoeba invadens
SCCYGDLLQQNTISMDIG

SEQ ID NO: 2803673 - protein, 18 aa, Entamoeba invadens
SCDIGYYLLIAKCYLCSE

SEQ ID NO: 2803674 - protein, 23 aa, Entamoeba invadens
SCDKNGICTKCESLSILSNNMCT

SEQ ID NO: 2803675 - protein, 21 aa, Entamoeba invadens
SCDSIGWYPTFLLKADGVQYR

SEQ ID NO: 2803676 - protein, 19 aa, Entamoeba invadens
SCDSNCFDFGPSCNNINGC

SEQ ID NO: 2803677 - protein, 25 aa, Entamoeba invadens
SCDSNCFDLGPSCHNINGCIKCKDA

SEQ ID NO: 2803678 - protein, 19 aa, Entamoeba invadens
SCDSNCYDIGPSCHNINGC

SEQ ID NO: 2803679 - protein, 22 aa, Entamoeba invadens
SCDSSECYSCSTSDGVLSKSQC

SEQ ID NO: 2803680 - protein, 26 aa, Entamoeba invadens
SCDTCLRFSDCFTCNLTNFKDFEGNC

SEQ ID NO: 2803681 - protein, 25 aa, Entamoeba invadens
SCEICQRGTHSYGIKCVDCEEMKYQ

SEQ ID NO: 2803682 - protein, 20 aa, Entamoeba invadens
SCEICQRGTHSYGTKCDDCE

SEQ ID NO: 2803683 - protein, 18 aa, Entamoeba invadens
SCEKKVVVWFVVIVVIIC

SEQ ID NO: 2803684 - protein, 30 aa, Entamoeba invadens
SCESNCELCESGKCTLCMQNYLLTKDNKCE

SEQ ID NO: 2803685 - protein, 18 aa, Entamoeba invadens
SCETCAMNGCFDCSTTSG

SEQ ID NO: 2803686 - protein, 18 aa, Entamoeba invadens
SCFECTKPYLLVEKQCVT

SEQ ID NO: 2803687 - protein, 17 aa, Entamoeba invadens
SCFEGCTMLTTITNGES

SEQ ID NO: 2803688 - protein, 18 aa, Entamoeba invadens
SCFEGCTSLKTVTSMENV

SEQ ID NO: 2803689 - protein, 24 aa, Entamoeba invadens
SCFLFGVCYIGLYNSLIHADVGFM

SEQ ID NO: 2803690 - protein, 18 aa, Entamoeba invadens
SCFPCSPGTFSTGSVTKC

SEQ ID NO: 2803691 - protein, 22 aa, Entamoeba invadens
SCFSCVTPGYFLSGFSCVQCSE

SEQ ID NO: 2803692 - protein, 21 aa, Entamoeba invadens
SCFSFDPNCIICASDGSRKCI

SEQ ID NO: 2803693 - protein, 18 aa, Entamoeba invadens
SCGAGCKSCNSGQSGKTK

SEQ ID NO: 2803694 - protein, 22 aa, Entamoeba invadens
SCGEECKMCDPTLGCTTCNKGF

SEQ ID NO: 2803695 - protein, 21 aa, Entamoeba invadens
SCGGIEPYSTLVFIYNTAMAK

SEQ ID NO: 2803696 - protein, 20 aa, Entamoeba invadens
SCGKKTLATYVIVLITLACV

SEQ ID NO: 2803697 - protein, 26 aa, Entamoeba invadens
SCGLFFKELWNNSAVSEKERNNFNLV

SEQ ID NO: 2803698 - protein, 17 aa, Entamoeba invadens
SCGNGVLDFDEECDLSV

SEQ ID NO: 2803699 - protein, 21 aa, Entamoeba invadens
SCILVAPGWFYFCPTSLLLWL

SEQ ID NO: 2803700 - protein, 20 aa, Entamoeba invadens
SCITCPDMQYSFAGSTTCKS

SEQ ID NO: 2803701 - protein, 17 aa, Entamoeba invadens
SCKKCKTGSNCLTCESD

SEQ ID NO: 2803702 - protein, 19 aa, Entamoeba invadens
SCKQYPPINVVSFDGTSEV

SEQ ID NO: 2803703 - protein, 32 aa, Entamoeba invadens
SCKSCTKTSCTECLSSYVLRDGVCILKTVFAP

SEQ ID NO: 2803704 - protein, 23 aa, Entamoeba invadens
SCKSEMYKRNIIIIVVCVVVAIF

SEQ ID NO: 2803705 - protein, 19 aa, Entamoeba invadens
SCKTGYYLSNGYCLECNSN

SEQ ID NO: 2803706 - protein, 22 aa, Entamoeba invadens
SCKYCKNSYLLDNQCKNYDNNC

SEQ ID NO: 2803707 - protein, 18 aa, Entamoeba invadens
SCLKCSSGDMKKECNNCG

SEQ ID NO: 2803708 - protein, 17 aa, Entamoeba invadens
SCLKGYYSKEKSEKCEM

SEQ ID NO: 2803709 - protein, 24 aa, Entamoeba invadens
SCLKLTRLQVASLFALSFLGVFRL

SEQ ID NO: 2803710 - protein, 17 aa, Entamoeba invadens
SCLPTTCSVTTNTLKES

SEQ ID NO: 2803711 - protein, 22 aa, Entamoeba invadens
SCLSCRDGVSFLVGNTCLSCVL

SEQ ID NO: 2803712 - protein, 19 aa, Entamoeba invadens
SCLSCYKGSRLSEGKCVVC

SEQ ID NO: 2803713 - protein, 18 aa, Entamoeba invadens
SCLSYSLAPLLAGLLSTY

SEQ ID NO: 2803714 - protein, 27 aa, Entamoeba invadens
SCMDTYCLLCRTVSSNSCIRCIPNYIL

SEQ ID NO: 2803715 - protein, 19 aa, Entamoeba invadens
SCMRCTKTECLTCDGQNSI

SEQ ID NO: 2803716 - protein, 44 aa, Entamoeba invadens
SCNCLFCRMKDVLILNRYIPWITLSRIFFLSLMTLYPSKNYFSV

SEQ ID NO: 2803717 - protein, 18 aa, Entamoeba invadens
SCNPQYYLSSSFTCEPLG

SEQ ID NO: 2803718 - protein, 24 aa, Entamoeba invadens
SCNRCSNTTCFQCQKQYIITEQTT

SEQ ID NO: 2803719 - protein, 23 aa, Entamoeba invadens
SCNSRAVWWVIFISVLFIVIIIL

SEQ ID NO: 2803720 - protein, 17 aa, Entamoeba invadens
SCPADCVGDRVCKDLEG

SEQ ID NO: 2803721 - protein, 31 aa, Entamoeba invadens
SCPILRHVLYFTIYILFQLLLTFLLDRLNTI

SEQ ID NO: 2803722 - protein, 17 aa, Entamoeba invadens
SCREGYYPMDILGKTYC

SEQ ID NO: 2803723 - protein, 18 aa, Entamoeba invadens
SCRSIRPYFIQKATENEK

SEQ ID NO: 2803724 - protein, 20 aa, Entamoeba invadens
SCSDNKFLSSNKCVSIDELT

SEQ ID NO: 2803725 - protein, 18 aa, Entamoeba invadens
SCSECKDSISCYECSNEY

SEQ ID NO: 2803726 - protein, 18 aa, Entamoeba invadens
SCSIVDVPPTYVYTKGLG

SEQ ID NO: 2803727 - protein, 18 aa, Entamoeba invadens
SCSKCKDGLTLNKTSGKC

SEQ ID NO: 2803728 - protein, 18 aa, Entamoeba invadens
SCSLCSAGTFSAAKASSC

SEQ ID NO: 2803729 - protein, 17 aa, Entamoeba invadens
SCSNSNYSVNGYECGQC

SEQ ID NO: 2803730 - protein, 17 aa, Entamoeba invadens
SCSPGSYSNSGASSCTK

SEQ ID NO: 2803731 - protein, 17 aa, Entamoeba invadens
SCSQGKYIDSNQCKTCD

SEQ ID NO: 2803732 - protein, 29 aa, Entamoeba invadens
SCSSCSVSIPYCEKCSLSGDAVKCDVCDA

SEQ ID NO: 2803733 - protein, 17 aa, Entamoeba invadens
SCSSGKCESCKPNYVLK

SEQ ID NO: 2803734 - protein, 17 aa, Entamoeba invadens
SCSSLNKCISCSDELTC

SEQ ID NO: 2803735 - protein, 17 aa, Entamoeba invadens
SCSSLVKCDVCERGYKN

SEQ ID NO: 2803736 - protein, 21 aa, Entamoeba invadens
SCSSSCTCTSCKPGYSYPNCF

SEQ ID NO: 2803737 - protein, 17 aa, Entamoeba invadens
SCSVYGIDCSTCTSLKC

SEQ ID NO: 2803738 - protein, 26 aa, Entamoeba invadens
SCSYRCVTCFGSSYTQCYSCKNGYYL

SEQ ID NO: 2803739 - protein, 25 aa, Entamoeba invadens
SCSYRCVTCYGGLDTQCYSCKNGYY

SEQ ID NO: 2803740 - protein, 31 aa, Entamoeba invadens
SCTETYGECRVCDSFKCLECKSGKIFNQDGK

SEQ ID NO: 2803741 - protein, 20 aa, Entamoeba invadens
SCTFGKGAFLNCQKLTTVTL

SEQ ID NO: 2803742 - protein, 21 aa, Entamoeba invadens
SCTGYDVCQECISGYYYSLST

SEQ ID NO: 2803743 - protein, 18 aa, Entamoeba invadens
SCTICPAGTKPNYYNSTC

SEQ ID NO: 2803744 - protein, 27 aa, Entamoeba invadens
SCTIPIPLKFVSSFTFGNIALTNSNET

SEQ ID NO: 2803745 - protein, 19 aa, Entamoeba invadens
SCTIRCMIINFLVVFASTY

SEQ ID NO: 2803746 - protein, 17 aa, Entamoeba invadens
SCTKCPGGYYSLKTSSN

SEQ ID NO: 2803747 - protein, 18 aa, Entamoeba invadens
SCTLCKSTYYISDNKKCS

SEQ ID NO: 2803748 - protein, 18 aa, Entamoeba invadens
SCTSCGDGTYSKEGATRC

SEQ ID NO: 2803749 - protein, 18 aa, Entamoeba invadens
SCTSCGDGTYSKEGATSC

SEQ ID NO: 2803750 - protein, 18 aa, Entamoeba invadens
SCTSCSVGTYSSTSGSSS

SEQ ID NO: 2803751 - protein, 18 aa, Entamoeba invadens
SCVDGYFLSDHICKSNDE

SEQ ID NO: 2803752 - protein, 19 aa, Entamoeba invadens
SCVDGYFLSNHICKSNDAL

SEQ ID NO: 2803753 - protein, 28 aa, Entamoeba invadens
SCVEANVTFSGHFLIIFLEQVVIQNRSV

SEQ ID NO: 2803754 - protein, 18 aa, Entamoeba invadens
SCVEGSIVWGDNENYGET

SEQ ID NO: 2803755 - protein, 22 aa, Entamoeba invadens
SCVEVKGKMFVPVSSGVMDVVF

SEQ ID NO: 2803756 - protein, 33 aa, Entamoeba invadens
SCVKNRILFENGICLDISYVLQCIEVLNSKCSK

SEQ ID NO: 2803757 - protein, 17 aa, Entamoeba invadens
SCVPLPPGVKYYINDTT

SEQ ID NO: 2803758 - protein, 24 aa, Entamoeba invadens
SCVSCASSNCLNCDVDINSCSVCE

SEQ ID NO: 2803759 - protein, 17 aa, Entamoeba invadens
SCVSGSYFNGDRCEKCP

SEQ ID NO: 2803760 - protein, 20 aa, Entamoeba invadens
SCVTCPDMQYSFAGSTTCKS

SEQ ID NO: 2803761 - protein, 25 aa, Entamoeba invadens
SCVYCCCNSCCHIKCVCCSTKPSKP

SEQ ID NO: 2803762 - protein, 32 aa, Entamoeba invadens
SCYDGSYRSGLECFPCISSCSLCQSKSICYTC

SEQ ID NO: 2803763 - protein, 23 aa, Entamoeba invadens
SCYGDKCFYNTFFMSTFMCALSS

SEQ ID NO: 2803764 - protein, 21 aa, Entamoeba invadens
SCYLTHYIVFGFYEVIVGIIS

SEQ ID NO: 2803765 - protein, 17 aa, Entamoeba invadens
SCYNATYCISCHSRYFL

SEQ ID NO: 2803766 - protein, 19 aa, Entamoeba invadens
SCYNGSYLFNKMCVLCDIN

SEQ ID NO: 2803767 - protein, 20 aa, Entamoeba invadens
SCYRCNNSICKQCNSNPSVC

SEQ ID NO: 2803768 - protein, 19 aa, Entamoeba invadens
SCYYCKYGYHLNSKGICEY

SEQ ID NO: 2803769 - protein, 18 aa, Entamoeba invadens
SCYYDMIIDKPICTICTS

SEQ ID NO: 2803770 - protein, 19 aa, Entamoeba invadens
SDAAWFFYATLKRPVNTHT

SEQ ID NO: 2803771 - protein, 31 aa, Entamoeba invadens
SDAFKEIWEVIKYRKCNYLEDLFSFGRRFDY

SEQ ID NO: 2803772 - protein, 26 aa, Entamoeba invadens
SDAFLAAKMMLVIVCSIKKKVMEKRI

SEQ ID NO: 2803773 - protein, 18 aa, Entamoeba invadens
SDAIYLYTRHFKFDNGNK

SEQ ID NO: 2803774 - protein, 23 aa, Entamoeba invadens
SDARKVFSTVIFQFLIPALVLSQ

SEQ ID NO: 2803775 - protein, 37 aa, Entamoeba invadens
SDCHRCGDGFYPEGFLECVPFDFKYVSTCHKVLYETQ

SEQ ID NO: 2803776 - protein, 18 aa, Entamoeba invadens
SDCLYGERNTCLKCVNGN

SEQ ID NO: 2803777 - protein, 19 aa, Entamoeba invadens
SDCYKCLNCDKHIHSGCVA

SEQ ID NO: 2803778 - protein, 25 aa, Entamoeba invadens
SDDGTICGFDLRSKEIAFRTDSHLS

SEQ ID NO: 2803779 - protein, 26 aa, Entamoeba invadens
SDDIIKLTQPILCFYSTSNMSNLLLD

SEQ ID NO: 2803780 - protein, 18 aa, Entamoeba invadens
SDECLTCFLSSTQCTRCS

SEQ ID NO: 2803781 - protein, 21 aa, Entamoeba invadens
SDEEILIFLFNCVIAMNAVFM

SEQ ID NO: 2803782 - protein, 22 aa, Entamoeba invadens
SDEEMKRVLQLVKFEKDLDYQV

SEQ ID NO: 2803783 - protein, 26 aa, Entamoeba invadens
SDEIDMKLRIKVMFDAAKGISYLHNN

SEQ ID NO: 2803784 - protein, 25 aa, Entamoeba invadens
SDEVIMKMRIKLMLDTAKGIQYLHA

SEQ ID NO: 2803785 - protein, 22 aa, Entamoeba invadens
SDFECLKCFIYYFVNETYSCEK

SEQ ID NO: 2803786 - protein, 19 aa, Entamoeba invadens
SDFFKCLSLCSSCSIEQKD

SEQ ID NO: 2803787 - protein, 21 aa, Entamoeba invadens
SDFFLSFYLNCMVAMASYAMY

SEQ ID NO: 2803788 - protein, 17 aa, Entamoeba invadens
SDFFPFENTCIFTQDYK

SEQ ID NO: 2803789 - protein, 20 aa, Entamoeba invadens
SDFGKVMRKYLRSIFITHWC

SEQ ID NO: 2803790 - protein, 25 aa, Entamoeba invadens
SDFIIHFYGACFIPSHIAMITEFAE

SEQ ID NO: 2803791 - protein, 17 aa, Entamoeba invadens
SDFIVHFYGAVFIPSKI

SEQ ID NO: 2803792 - protein, 25 aa, Entamoeba invadens
SDFLCDKMRVKIMLDASRGIEYLHN

SEQ ID NO: 2803793 - protein, 25 aa, Entamoeba invadens
SDFLCKFLSLLRLYLLLFSALLHLT

SEQ ID NO: 2803794 - protein, 21 aa, Entamoeba invadens
SDFLPSLLYTLLSHIRKALLL

SEQ ID NO: 2803795 - protein, 20 aa, Entamoeba invadens
SDFMCMTCSESATKCDKCYY

SEQ ID NO: 2803796 - protein, 17 aa, Entamoeba invadens
SDFTCLTCKEGYYQDSN

SEQ ID NO: 2803797 - protein, 18 aa, Entamoeba invadens
SDFTNCFELISYQSETQQ

SEQ ID NO: 2803798 - protein, 18 aa, Entamoeba invadens
SDFTTCFELISYQSETQQ

SEQ ID NO: 2803799 - protein, 19 aa, Entamoeba invadens
SDFVFCITALLSLAFYYLK

SEQ ID NO: 2803800 - protein, 17 aa, Entamoeba invadens
SDGECLLRSSIIGCSTE

SEQ ID NO: 2803801 - protein, 26 aa, Entamoeba invadens
SDGFTCSPCASGFFNSISGKICESCP

SEQ ID NO: 2803802 - protein, 21 aa, Entamoeba invadens
SDGILGNVCFYNFHNKTIVYN

SEQ ID NO: 2803803 - protein, 21 aa, Entamoeba invadens
SDGLRCLQCTENFYSIDSINK

SEQ ID NO: 2803804 - protein, 20 aa, Entamoeba invadens
SDGRLRYTFRNTGNTSLSLA

SEQ ID NO: 2803805 - protein, 21 aa, Entamoeba invadens
SDIALGVGILSIFISMVCISL

SEQ ID NO: 2803806 - protein, 21 aa, Entamoeba invadens
SDICAITLTIYGKIFDQTVLQ

SEQ ID NO: 2803807 - protein, 25 aa, Entamoeba invadens
SDICEKDGYMCIMDGTHDKYYYVCS

SEQ ID NO: 2803808 - protein, 20 aa, Entamoeba invadens
SDICYECINELYYLENAICV

SEQ ID NO: 2803809 - protein, 17 aa, Entamoeba invadens
SDIDTSFCYYKDRYRFG

SEQ ID NO: 2803810 - protein, 27 aa, Entamoeba invadens
SDIEKMSWWVVAIFVFLFIVLLLVVGL

SEQ ID NO: 2803811 - protein, 21 aa, Entamoeba invadens
SDIESKCLICKKDYYYYSSNS

SEQ ID NO: 2803812 - protein, 19 aa, Entamoeba invadens
SDIFSFAITMYEIFNWEKC

SEQ ID NO: 2803813 - protein, 17 aa, Entamoeba invadens
SDIFTFSRFIEALPGIL

SEQ ID NO: 2803814 - protein, 21 aa, Entamoeba invadens
SDIIFSHAMIVFFFTIFVMAV

SEQ ID NO: 2803815 - protein, 25 aa, Entamoeba invadens
SDIKGGCVICSSGYYLEDKECQKCQ

SEQ ID NO: 2803816 - protein, 24 aa, Entamoeba invadens
SDIKYMEMCPVLKSADSRLSTLIK

SEQ ID NO: 2803817 - protein, 25 aa, Entamoeba invadens
SDILKLLIGVFSRFVMDAVETGNVT

SEQ ID NO: 2803818 - protein, 20 aa, Entamoeba invadens
SDINSGLILNGIFFISCFLF

SEQ ID NO: 2803819 - protein, 21 aa, Entamoeba invadens
SDKCNLCKKGFGVLAQNKTCG

SEQ ID NO: 2803820 - protein, 20 aa, Entamoeba invadens
SDKQRSCTICESNYYPIQGI

SEQ ID NO: 2803821 - protein, 22 aa, Entamoeba invadens
SDKRECAICQSGMYPNTNGTCT

SEQ ID NO: 2803822 - protein, 22 aa, Entamoeba invadens
SDKRECAVCKPGKYPNDSNKVC

SEQ ID NO: 2803823 - protein, 22 aa, Entamoeba invadens
SDKRECAVCKPGKYPNDSSKVC

SEQ ID NO: 2803824 - protein, 21 aa, Entamoeba invadens
SDKRECAVCRPSKYPNDSNKV

SEQ ID NO: 2803825 - protein, 22 aa, Entamoeba invadens
SDKSFYLSWPRRLQMLHDVAMG

SEQ ID NO: 2803826 - protein, 20 aa, Entamoeba invadens
SDKTLNCELKLFGQISSFEF

SEQ ID NO: 2803827 - protein, 23 aa, Entamoeba invadens
SDKYAFGIIGWELFYMKNAFFDY

SEQ ID NO: 2803828 - protein, 20 aa, Entamoeba invadens
SDKYILVACISFCFIMAASF

SEQ ID NO: 2803829 - protein, 23 aa, Entamoeba invadens
SDLFEKYVRCIKKTLMICNINSR

SEQ ID NO: 2803830 - protein, 24 aa, Entamoeba invadens
SDLGCGGSMWIICPNDPKRTIYLC

SEQ ID NO: 2803831 - protein, 19 aa, Entamoeba invadens
SDLIKCKKMSTKGCLECED

SEQ ID NO: 2803832 - protein, 22 aa, Entamoeba invadens
SDLKCVQGWSGRRHGVLSEDAK

SEQ ID NO: 2803833 - protein, 17 aa, Entamoeba invadens
SDLKFASIYQASGKNTK

SEQ ID NO: 2803834 - protein, 27 aa, Entamoeba invadens
SDLKNLKFCSIQGCELLTELAEKHPKK

SEQ ID NO: 2803835 - protein, 20 aa, Entamoeba invadens
SDLLVKLQLVYRQNNSYDIT

SEQ ID NO: 2803836 - protein, 19 aa, Entamoeba invadens
SDMKQCLIFLTGSIHKEQR

SEQ ID NO: 2803837 - protein, 22 aa, Entamoeba invadens
SDNCLQCKQGFYNTNNSCVALE

SEQ ID NO: 2803838 - protein, 19 aa, Entamoeba invadens
SDNGCIISALGTQSVTGLY

SEQ ID NO: 2803839 - protein, 22 aa, Entamoeba invadens
SDNICLPCDSFSSNCIECDSST

SEQ ID NO: 2803840 - protein, 17 aa, Entamoeba invadens
SDNILVFLLDYNERINA

SEQ ID NO: 2803841 - protein, 20 aa, Entamoeba invadens
SDNNVGFVFVKIDVLDVKKV

SEQ ID NO: 2803842 - protein, 25 aa, Entamoeba invadens
SDNTALCFSCEPFGYYFDSYNCIEC

SEQ ID NO: 2803843 - protein, 22 aa, Entamoeba invadens
SDPCCNRLAPGKCNTYKERMST

SEQ ID NO: 2803844 - protein, 18 aa, Entamoeba invadens
SDPCCNRSAPGKCNTFRD

SEQ ID NO: 2803845 - protein, 19 aa, Entamoeba invadens
SDPLKTRYNLYSHIWDTHL

SEQ ID NO: 2803846 - protein, 22 aa, Entamoeba invadens
SDQCLYCPGGTYSSGSAKTACT

SEQ ID NO: 2803847 - protein, 19 aa, Entamoeba invadens
SDQICNISTNTVCDFHTTS

SEQ ID NO: 2803848 - protein, 17 aa, Entamoeba invadens
SDQKWFGILFGFLVIII

SEQ ID NO: 2803849 - protein, 21 aa, Entamoeba invadens
SDRYLNDGVCLKCEEIYPNCI

SEQ ID NO: 2803850 - protein, 22 aa, Entamoeba invadens
SDSEMWGSPCINNVLDSNNCSF

SEQ ID NO: 2803851 - protein, 23 aa, Entamoeba invadens
SDSEMWGSPCINNVLDSNNCSFM

SEQ ID NO: 2803852 - protein, 17 aa, Entamoeba invadens
SDSMLFKIQGLLNDNTN

SEQ ID NO: 2803853 - protein, 24 aa, Entamoeba invadens
SDSRFKYAWDIADFTSAGKRLVIP

SEQ ID NO: 2803854 - protein, 20 aa, Entamoeba invadens
SDSSCFLCNAGYYCPDGINK

SEQ ID NO: 2803855 - protein, 26 aa, Entamoeba invadens
SDSSRFCTTCKIGLRPNTTSGKCVGC

SEQ ID NO: 2803856 - protein, 23 aa, Entamoeba invadens
SDSTLISAIVFFRGELGQVIVTN

SEQ ID NO: 2803857 - protein, 22 aa, Entamoeba invadens
SDSTLRMFSLVFFAVLSVSFFV

SEQ ID NO: 2803858 - protein, 23 aa, Entamoeba invadens
SDTFKYSFNFTMGKGYLISNKKL

SEQ ID NO: 2803859 - protein, 20 aa, Entamoeba invadens
SDTFPALLWLVMGFVCCCFW

SEQ ID NO: 2803860 - protein, 26 aa, Entamoeba invadens
SDTHLWNPVFLMGILCMQSGAVSADA

SEQ ID NO: 2803861 - protein, 17 aa, Entamoeba invadens
SDTIFLWTDLMEKNNNE

SEQ ID NO: 2803862 - protein, 21 aa, Entamoeba invadens
SDTKCLLCKYRFYMGENCKCI

SEQ ID NO: 2803863 - protein, 24 aa, Entamoeba invadens
SDTKCLSCIDGFYLAGEGKCSACN

SEQ ID NO: 2803864 - protein, 25 aa, Entamoeba invadens
SDTKCLSCKSGFYQGENYSCLPSTD

SEQ ID NO: 2803865 - protein, 23 aa, Entamoeba invadens
SDTKCTACPIGYYLTVEGKCLAC

SEQ ID NO: 2803866 - protein, 24 aa, Entamoeba invadens
SDTKCTACPLGYYLTVDGKCLACD

SEQ ID NO: 2803867 - protein, 23 aa, Entamoeba invadens
SDTKCTKCLYGNYITVEGKCLAC

SEQ ID NO: 2803868 - protein, 24 aa, Entamoeba invadens
SDTKCTKCLYGNYITVEGKCLACD

SEQ ID NO: 2803869 - protein, 19 aa, Entamoeba invadens
SDTKIPLWIDENDKTKVRI

SEQ ID NO: 2803870 - protein, 21 aa, Entamoeba invadens
SDTLFRYGKSDTYCTTNSGTT

SEQ ID NO: 2803871 - protein, 25 aa, Entamoeba invadens
SDTMCLSCKSGFYQGDNYTCLPSTD

SEQ ID NO: 2803872 - protein, 25 aa, Entamoeba invadens
SDTMCLSCKSGFYQGENYTCLPSTD

SEQ ID NO: 2803873 - protein, 23 aa, Entamoeba invadens
SDTPMHCVVELPKSYRAYYTCSP

SEQ ID NO: 2803874 - protein, 22 aa, Entamoeba invadens
SDTTVNCKLKFSKTYNTYNMSD

SEQ ID NO: 2803875 - protein, 24 aa, Entamoeba invadens
SDTYKRFIDCYVYKDVFYDQIGET

SEQ ID NO: 2803876 - protein, 18 aa, Entamoeba invadens
SDVCIKLRIKMMIDAANA

SEQ ID NO: 2803877 - protein, 22 aa, Entamoeba invadens
SDVLECVKEIQLMRRLTHPNVL

SEQ ID NO: 2803878 - protein, 19 aa, Entamoeba invadens
SDVTSSVFIVLQSVEFSGF

SEQ ID NO: 2803879 - protein, 31 aa, Entamoeba invadens
SDVYSFAICMLEIWLTKDVYDPMKFPDSESI

SEQ ID NO: 2803880 - protein, 17 aa, Entamoeba invadens
SDYAQLIQSCWKQDGKE

SEQ ID NO: 2803881 - protein, 18 aa, Entamoeba invadens
SDYIIHFYGAVFIPSKIC

SEQ ID NO: 2803882 - protein, 18 aa, Entamoeba invadens
SDYIIHFYGAVFIPTKTC

SEQ ID NO: 2803883 - protein, 20 aa, Entamoeba invadens
SDYITHFYGAVFIRSKECMI

SEQ ID NO: 2803884 - protein, 29 aa, Entamoeba invadens
SDYKIEIFETFPSYYYRAVHYGKNDCNMT

SEQ ID NO: 2803885 - protein, 17 aa, Entamoeba invadens
SDYVVHFYGAVFIPNKI

SEQ ID NO: 2803886 - protein, 21 aa, Entamoeba invadens
SDYYEGFAILTAVLAVSLIGA

SEQ ID NO: 2803887 - protein, 17 aa, Entamoeba invadens
SEAIESYLFKIPNLSEC

SEQ ID NO: 2803888 - protein, 18 aa, Entamoeba invadens
SEAINILVTMVVCAMALG

SEQ ID NO: 2803889 - protein, 18 aa, Entamoeba invadens
SECFNCATNYILQDTTCL

SEQ ID NO: 2803890 - protein, 21 aa, Entamoeba invadens
SECIFCNASCKFCELTTGKCR

SEQ ID NO: 2803891 - protein, 17 aa, Entamoeba invadens
SECKNCLLKNTNLTKCD

SEQ ID NO: 2803892 - protein, 18 aa, Entamoeba invadens
SECRLCDLTNITLINTNG

SEQ ID NO: 2803893 - protein, 17 aa, Entamoeba invadens
SECRYVWNIASKTSNGE

SEQ ID NO: 2803894 - protein, 20 aa, Entamoeba invadens
SECSSLLFWAYLFSTITLSL

SEQ ID NO: 2803895 - protein, 21 aa, Entamoeba invadens
SECTLEELLECEDFPQEFQSN

SEQ ID NO: 2803896 - protein, 29 aa, Entamoeba invadens
SECVGELTCCLCPLFAGLIATKTNDRRWA

SEQ ID NO: 2803897 - protein, 20 aa, Entamoeba invadens
SEDAACYVQTCSPFISNTVG

SEQ ID NO: 2803898 - protein, 19 aa, Entamoeba invadens
SEDCPRDIFQKANITDKEN

SEQ ID NO: 2803899 - protein, 27 aa, Entamoeba invadens
SEDDICKGKEGFYCLEGNKYIHKYLWC

SEQ ID NO: 2803900 - protein, 26 aa, Entamoeba invadens
SEDDICKGKNGLYCVDDGKHIHEFLV

SEQ ID NO: 2803901 - protein, 23 aa, Entamoeba invadens
SEECLSCGVDEILVKGGCVDYHT

SEQ ID NO: 2803902 - protein, 20 aa, Entamoeba invadens
SEECLSCGVDEVLVKGSCVD

SEQ ID NO: 2803903 - protein, 19 aa, Entamoeba invadens
SEETCLICDINFVLVDNHC

SEQ ID NO: 2803904 - protein, 19 aa, Entamoeba invadens
SEETVKCQIRVQNDNFRTF

SEQ ID NO: 2803905 - protein, 28 aa, Entamoeba invadens
SEFAEGFLCCLFMFIGIVALLIRKLILF

SEQ ID NO: 2803906 - protein, 20 aa, Entamoeba invadens
SEFIIHFYGACFIPEHICMV

SEQ ID NO: 2803907 - protein, 19 aa, Entamoeba invadens
SEFIIHFYGACVIPNHICM

SEQ ID NO: 2803908 - protein, 22 aa, Entamoeba invadens
SEFKILLKIIKFGIKTFSDECT

SEQ ID NO: 2803909 - protein, 17 aa, Entamoeba invadens
SEFLKHKPFELTEKGIL

SEQ ID NO: 2803910 - protein, 26 aa, Entamoeba invadens
SEFPILGLMRKWLKTIYEGGYDNKKM

SEQ ID NO: 2803911 - protein, 25 aa, Entamoeba invadens
SEFTKCLPCSAGTYRDENLITMNDC

SEQ ID NO: 2803912 - protein, 20 aa, Entamoeba invadens
SEFWNYRATPVSSELEALEA

SEQ ID NO: 2803913 - protein, 19 aa, Entamoeba invadens
SEGAFEVFAFLALFIAFLF

SEQ ID NO: 2803914 - protein, 19 aa, Entamoeba invadens
SEGDHVCNIDGTKNLFVVM

SEQ ID NO: 2803915 - protein, 20 aa, Entamoeba invadens
SEGLKWIGSIMNHFKERAGT

SEQ ID NO: 2803916 - protein, 20 aa, Entamoeba invadens
SEGRCKPCDDVVIGCKTSFK

SEQ ID NO: 2803917 - protein, 31 aa, Entamoeba invadens
SEGRGKCSWTEKKCICSPKYGGDDCHLLCYY

SEQ ID NO: 2803918 - protein, 19 aa, Entamoeba invadens
SEGRTTIVVAHRLTTVKNA

SEQ ID NO: 2803919 - protein, 19 aa, Entamoeba invadens
SEGRTTVIVAHRLTTVRHA

SEQ ID NO: 2803920 - protein, 24 aa, Entamoeba invadens
SEGTYKIDILYTFETRDFELENGT

SEQ ID NO: 2803921 - protein, 25 aa, Entamoeba invadens
SEGVCLTCSSGYYIDNSVCKSCSEI

SEQ ID NO: 2803922 - protein, 33 aa, Entamoeba invadens
SEGVFGYPACMPHIFGKMIDFFIEFNMSAVMLM

SEQ ID NO: 2803923 - protein, 17 aa, Entamoeba invadens
SEHDLWSTWKLKYHKAY

SEQ ID NO: 2803924 - protein, 25 aa, Entamoeba invadens
SEHSHIYSLSFVRIIYSNVLLGTII

SEQ ID NO: 2803925 - protein, 19 aa, Entamoeba invadens
SEICLECLDAFKMKDGICA

SEQ ID NO: 2803926 - protein, 19 aa, Entamoeba invadens
SEIDNGIFLGSQHHASDQF

SEQ ID NO: 2803927 - protein, 25 aa, Entamoeba invadens
SEIEADVYWSFSWMLQAIQNQYTFD

SEQ ID NO: 2803928 - protein, 24 aa, Entamoeba invadens
SEIKCLECTSGFYMSENYVCLPST

SEQ ID NO: 2803929 - protein, 17 aa, Entamoeba invadens
SEIKFQIVYNSFLTVVG

SEQ ID NO: 2803930 - protein, 20 aa, Entamoeba invadens
SEIKIPVKFASEMSTALDPD

SEQ ID NO: 2803931 - protein, 22 aa, Entamoeba invadens
SEILELSGILTIFVTGAVMSHH

SEQ ID NO: 2803932 - protein, 18 aa, Entamoeba invadens
SEILETISSWGLDITHVG

SEQ ID NO: 2803933 - protein, 17 aa, Entamoeba invadens
SEINFATDLVKIGEGVF

SEQ ID NO: 2803934 - protein, 26 aa, Entamoeba invadens
SEIPQGELLLRGPSLFKEYFKRPEET

SEQ ID NO: 2803935 - protein, 19 aa, Entamoeba invadens
SEIQNCFDAAVFAEPNYES

SEQ ID NO: 2803936 - protein, 29 aa, Entamoeba invadens
SEISIREANLFYAEFIRDFSCLFKRGEVT

SEQ ID NO: 2803937 - protein, 23 aa, Entamoeba invadens
SEIYMGGYFYIYWSGSVELFDNS

SEQ ID NO: 2803938 - protein, 20 aa, Entamoeba invadens
SEIYTFILVVYIFFHIDHLK

SEQ ID NO: 2803939 - protein, 22 aa, Entamoeba invadens
SEKCAKCSVFEICDKCVDGAIM

SEQ ID NO: 2803940 - protein, 18 aa, Entamoeba invadens
SEKCITCLENRFLQEHEC

SEQ ID NO: 2803941 - protein, 18 aa, Entamoeba invadens
SEKCLKCTDNNYLSNGIC

SEQ ID NO: 2803942 - protein, 25 aa, Entamoeba invadens
SEKCMYGTITNCYKCQDRYTRNDTL

SEQ ID NO: 2803943 - protein, 27 aa, Entamoeba invadens
SEKDRCYQCITGYFLIHNQCEKCLENC

SEQ ID NO: 2803944 - protein, 25 aa, Entamoeba invadens
SEKEFKFPWKIAEFVTSSKRLEKLS

SEQ ID NO: 2803945 - protein, 22 aa, Entamoeba invadens
SEKKCKAKVCGNGMIDKLYDSN

SEQ ID NO: 2803946 - protein, 24 aa, Entamoeba invadens
SEKNMCKKCALNFAQNFTSNFCHL

SEQ ID NO: 2803947 - protein, 25 aa, Entamoeba invadens
SEKNVSWYLGYIVDVCIPFLSMCSI

SEQ ID NO: 2803948 - protein, 20 aa, Entamoeba invadens
SEKQRSCTICESNYYPKQGR

SEQ ID NO: 2803949 - protein, 21 aa, Entamoeba invadens
SEKRNLMNVEWIIDKLKVVTV

SEQ ID NO: 2803950 - protein, 17 aa, Entamoeba invadens
SEKTGKCNSQSNEEQLT

SEQ ID NO: 2803951 - protein, 24 aa, Entamoeba invadens
SEKVCLKCKNSFVLSTNNCVPFNT

SEQ ID NO: 2803952 - protein, 19 aa, Entamoeba invadens
SEKVKRLQKAYFFKTPILV

SEQ ID NO: 2803953 - protein, 23 aa, Entamoeba invadens
SEKVLECSSGFYLAQNSCVDLKQ

SEQ ID NO: 2803954 - protein, 26 aa, Entamoeba invadens
SELIIKGRIFLPLISFQQLCTKYNNY

SEQ ID NO: 2803955 - protein, 17 aa, Entamoeba invadens
SELIKIVLVNVIREMWG

SEQ ID NO: 2803956 - protein, 18 aa, Entamoeba invadens
SELKCKTTIIKIDTFTIT

SEQ ID NO: 2803957 - protein, 44 aa, Entamoeba invadens
SELKELWICPVACAIHIVFQFLGCILVGKILRIPTLENRVFSFT

SEQ ID NO: 2803958 - protein, 17 aa, Entamoeba invadens
SELKKEVTSECEIMSKL

SEQ ID NO: 2803959 - protein, 21 aa, Entamoeba invadens
SELNICFKIMYGCLKSTNMNF

SEQ ID NO: 2803960 - protein, 17 aa, Entamoeba invadens
SELPRVRENECMKRVKD

SEQ ID NO: 2803961 - protein, 22 aa, Entamoeba invadens
SEMKCLLCYDPYYQFNKTCASC

SEQ ID NO: 2803962 - protein, 25 aa, Entamoeba invadens
SEMKNSRLDSFIRYAVQKKPFIEQK

SEQ ID NO: 2803963 - protein, 18 aa, Entamoeba invadens
SEMNGMDLFIRSGKLRVD

SEQ ID NO: 2803964 - protein, 21 aa, Entamoeba invadens
SEMPAVMKIFYNAMKVTKTHI

SEQ ID NO: 2803965 - protein, 24 aa, Entamoeba invadens
SENACKPAMRFDLIRKKDKHVIEV

SEQ ID NO: 2803966 - protein, 23 aa, Entamoeba invadens
SENALKRFFMISTNYDEKLINES

SEQ ID NO: 2803967 - protein, 24 aa, Entamoeba invadens
SENALKRFFMISTSYDENLINEST

SEQ ID NO: 2803968 - protein, 30 aa, Entamoeba invadens
SENFFAYPACMPGIFMKIYVFHIKYIGNYY

SEQ ID NO: 2803969 - protein, 20 aa, Entamoeba invadens
SENGIYCVSKVLGIKYRTKE

SEQ ID NO: 2803970 - protein, 18 aa, Entamoeba invadens
SENKRLLFVGTTDHSTDL

SEQ ID NO: 2803971 - protein, 18 aa, Entamoeba invadens
SENLLYEGRCVHFSIMSG

SEQ ID NO: 2803972 - protein, 18 aa, Entamoeba invadens
SENNASEVWGRLCENEYF

SEQ ID NO: 2803973 - protein, 22 aa, Entamoeba invadens
SENNASEVWGRLCENEYFNMDK

SEQ ID NO: 2803974 - protein, 20 aa, Entamoeba invadens
SENTIGFVLALSTAVVILGG

SEQ ID NO: 2803975 - protein, 18 aa, Entamoeba invadens
SENVVNCMIAGSADISTE

SEQ ID NO: 2803976 - protein, 18 aa, Entamoeba invadens
SENVVNCMVAGYADIQTG

SEQ ID NO: 2803977 - protein, 20 aa, Entamoeba invadens
SENVYCFNNSFTFNGSNIYN

SEQ ID NO: 2803978 - protein, 27 aa, Entamoeba invadens
SEPKLFCTKCTIRAFHVVGDYEDIRLY

SEQ ID NO: 2803979 - protein, 23 aa, Entamoeba invadens
SEPKRYGTDLAFLAAATTFGVVI

SEQ ID NO: 2803980 - protein, 22 aa, Entamoeba invadens
SEPNVKCVIIGSFEFNESVWFL

SEQ ID NO: 2803981 - protein, 21 aa, Entamoeba invadens
SEPPNFFGVVVKRTVITFFLN

SEQ ID NO: 2803982 - protein, 26 aa, Entamoeba invadens
SEPTHCLSCAPTYFFKTNTSECIKMD

SEQ ID NO: 2803983 - protein, 23 aa, Entamoeba invadens
SEPYCPCGGTEDWYITPLPNVTS

SEQ ID NO: 2803984 - protein, 17 aa, Entamoeba invadens
SEQCFRGYKEVDVIRIP

SEQ ID NO: 2803985 - protein, 20 aa, Entamoeba invadens
SEQCKTCMNESYYVKDSSCV

SEQ ID NO: 2803986 - protein, 18 aa, Entamoeba invadens
SEQCVICKSGYFNNNGYC

SEQ ID NO: 2803987 - protein, 17 aa, Entamoeba invadens
SEQKVDCMVAGSIDFEL

SEQ ID NO: 2803988 - protein, 24 aa, Entamoeba invadens
SEQMKEFEREVAMLDKFRSDFIVH

SEQ ID NO: 2803989 - protein, 25 aa, Entamoeba invadens
SEQPNKVSYDWLGIVTTLVSKYMLK

SEQ ID NO: 2803990 - protein, 21 aa, Entamoeba invadens
SERICKQCEFGYFLKDKDCLD

SEQ ID NO: 2803991 - protein, 24 aa, Entamoeba invadens
SERLLKEFVAIFVLMPEMSLLFLN

SEQ ID NO: 2803992 - protein, 24 aa, Entamoeba invadens
SERVIRFRVGSGLIDPETLEPRVP

SEQ ID NO: 2803993 - protein, 22 aa, Entamoeba invadens
SESGEIPVEWESRDVLVDPEIV

SEQ ID NO: 2803994 - protein, 28 aa, Entamoeba invadens
SESGEYCYLKAVWWVFFISSLIFVIILV

SEQ ID NO: 2803995 - protein, 18 aa, Entamoeba invadens
SESILRFVGGGKRLEIPQ

SEQ ID NO: 2803996 - protein, 19 aa, Entamoeba invadens
SESILRFVGGGKRLEIPQN

SEQ ID NO: 2803997 - protein, 20 aa, Entamoeba invadens
SESKLVYGNVKYNAALNTKN

SEQ ID NO: 2803998 - protein, 21 aa, Entamoeba invadens
SESLHEWKKYSGGLDTKNKKT

SEQ ID NO: 2803999 - protein, 23 aa, Entamoeba invadens
SESRLYEAFTLMYSKAFDQKTFD

SEQ ID NO: 2804000 - protein, 18 aa, Entamoeba invadens
SESTHILAFIVISLSILF

SEQ ID NO: 2804001 - protein, 21 aa, Entamoeba invadens
SESYYIILLIYGFFLSVILLY

SEQ ID NO: 2804002 - protein, 25 aa, Entamoeba invadens
SETDFDLGINPSFWVIYRNTTHVTL

SEQ ID NO: 2804003 - protein, 20 aa, Entamoeba invadens
SETFPEFIAGTSLQTFMGDS

SEQ ID NO: 2804004 - protein, 19 aa, Entamoeba invadens
SETKLCLPFDNLINCENKT

SEQ ID NO: 2804005 - protein, 22 aa, Entamoeba invadens
SETKSSNVLSMFSRKTYYIEMM

SEQ ID NO: 2804006 - protein, 17 aa, Entamoeba invadens
SETKWKRSQCPCNGETC

SEQ ID NO: 2804007 - protein, 19 aa, Entamoeba invadens
SEVFSNFVLFDSSEIIVSA

SEQ ID NO: 2804008 - protein, 22 aa, Entamoeba invadens
SEVGCLLCQNGYYTNEYNKCTK

SEQ ID NO: 2804009 - protein, 18 aa, Entamoeba invadens
SEVIKLSDSLICCRVTPL

SEQ ID NO: 2804010 - protein, 21 aa, Entamoeba invadens
SEVIPVLYIINTFFTIDRKMS

SEQ ID NO: 2804011 - protein, 26 aa, Entamoeba invadens
SEVLGCLLCSDGYYKNGMRCSKCNSN

SEQ ID NO: 2804012 - protein, 17 aa, Entamoeba invadens
SEVLQMYNSIITLLDNV

SEQ ID NO: 2804013 - protein, 25 aa, Entamoeba invadens
SEVNIKLRITIFINAAKGISYLHEN

SEQ ID NO: 2804014 - protein, 29 aa, Entamoeba invadens
SEVPLQFICCGIFQLMCDAVIVGQMVHYS

SEQ ID NO: 2804015 - protein, 22 aa, Entamoeba invadens
SEYFVNSAFGIFVLILSLSLLF

SEQ ID NO: 2804016 - protein, 21 aa, Entamoeba invadens
SEYLETILLHLTLVFNHAPST

SEQ ID NO: 2804017 - protein, 22 aa, Entamoeba invadens
SFAICSLEIWLGHDCYSPEKYP

SEQ ID NO: 2804018 - protein, 25 aa, Entamoeba invadens
SFAITMYECFAWKRAFSKKSFKYAW

SEQ ID NO: 2804019 - protein, 26 aa, Entamoeba invadens
SFAITMYECFIWKEAYPKEDFKFPWK

SEQ ID NO: 2804020 - protein, 17 aa, Entamoeba invadens
SFALLLAKVYFKTVFII

SEQ ID NO: 2804021 - protein, 24 aa, Entamoeba invadens
SFANCGFESFSMPDTIYSVGCGAL

SEQ ID NO: 2804022 - protein, 18 aa, Entamoeba invadens
SFAVLSLVFFIISTIIAV

SEQ ID NO: 2804023 - protein, 18 aa, Entamoeba invadens
SFAVLSLVFFIISTIIVV

SEQ ID NO: 2804024 - protein, 21 aa, Entamoeba invadens
SFCPSESLVMLREILESQLEY

SEQ ID NO: 2804025 - protein, 21 aa, Entamoeba invadens
SFCQKCPTGFEPNKGTCLECP

SEQ ID NO: 2804026 - protein, 23 aa, Entamoeba invadens
SFDGDLHFSTVVLLENCVITCPK

SEQ ID NO: 2804027 - protein, 32 aa, Entamoeba invadens
SFDTIFQRGLFRNCSNESYYNWDVESYCLIPQ

SEQ ID NO: 2804028 - protein, 18 aa, Entamoeba invadens
SFEELFFELVYFGSIETR

SEQ ID NO: 2804029 - protein, 23 aa, Entamoeba invadens
SFFDMLGAFTWMVYFAVEVFVFD

SEQ ID NO: 2804030 - protein, 17 aa, Entamoeba invadens
SFFSEILKNIKFVKYNR

SEQ ID NO: 2804031 - protein, 21 aa, Entamoeba invadens
SFFSKERFLFPIVSFGTFALL

SEQ ID NO: 2804032 - protein, 25 aa, Entamoeba invadens
SFFVIPCSLLIIFQYFYYTRIYKPK

SEQ ID NO: 2804033 - protein, 18 aa, Entamoeba invadens
SFGARVKHWFDFLTFSNI

SEQ ID NO: 2804034 - protein, 25 aa, Entamoeba invadens
SFGIMLYEVVGWCTAFVECRYVWNI

SEQ ID NO: 2804035 - protein, 41 aa, Entamoeba invadens
SFGITMYECFMWKEAYPKSIFKFPWMIAEQVINGKRPVFPN

SEQ ID NO: 2804036 - protein, 27 aa, Entamoeba invadens
SFGITMYEVFGWKEAYNKNSFKFPWKI

SEQ ID NO: 2804037 - protein, 20 aa, Entamoeba invadens
SFGIVSRGKFQGRTVAIKKM

SEQ ID NO: 2804038 - protein, 17 aa, Entamoeba invadens
SFGIVYKGIYRGNCVAI

SEQ ID NO: 2804039 - protein, 18 aa, Entamoeba invadens
SFGIVYKGQYRGVCVAIK

SEQ ID NO: 2804040 - protein, 18 aa, Entamoeba invadens
SFGIVYKGQYRGVSVAIK

SEQ ID NO: 2804041 - protein, 18 aa, Entamoeba invadens
SFGLALWGGYIGVSLIAT

SEQ ID NO: 2804042 - protein, 18 aa, Entamoeba invadens
SFGSLFPIAYWSEFYSIA

SEQ ID NO: 2804043 - protein, 23 aa, Entamoeba invadens
SFGVTLFECVTWKNPYPKEQFKF

SEQ ID NO: 2804044 - protein, 23 aa, Entamoeba invadens
SFGVTLFEVCGWCEIYTKSMFKY

SEQ ID NO: 2804045 - protein, 43 aa, Entamoeba invadens
SFGVTMFECLSWRTAFPKSEYPFSWKIAETIISGKRPERTPNV

SEQ ID NO: 2804046 - protein, 18 aa, Entamoeba invadens
SFHKCIKAENGVCVECAN

SEQ ID NO: 2804047 - protein, 21 aa, Entamoeba invadens
SFHPETWTPTWTISSMLEAIR

SEQ ID NO: 2804048 - protein, 18 aa, Entamoeba invadens
SFHTILLSLCESSFTGDL

SEQ ID NO: 2804049 - protein, 19 aa, Entamoeba invadens
SFIAICISQTAMLAFPVLL

SEQ ID NO: 2804050 - protein, 20 aa, Entamoeba invadens
SFILFAMVVLMLVGRIVALY

SEQ ID NO: 2804051 - protein, 19 aa, Entamoeba invadens
SFILLRPGILCGVMKMVVF

SEQ ID NO: 2804052 - protein, 17 aa, Entamoeba invadens
SFILPTPRLLRYCKDIN

SEQ ID NO: 2804053 - protein, 19 aa, Entamoeba invadens
SFINKDIYTIFENKLPKQV

SEQ ID NO: 2804054 - protein, 23 aa, Entamoeba invadens
SFIPCVGCIGWIITCPAACGCIP

SEQ ID NO: 2804055 - protein, 24 aa, Entamoeba invadens
SFIPFICIFTYKTSSNFKVTFNPN

SEQ ID NO: 2804056 - protein, 19 aa, Entamoeba invadens
SFIPKFPFHPTFLGKDKVQ

SEQ ID NO: 2804057 - protein, 24 aa, Entamoeba invadens
SFIPLYYRFFVFIVRFSEQEILTP

SEQ ID NO: 2804058 - protein, 21 aa, Entamoeba invadens
SFIPSNCLVHLNTICFSTDFG

SEQ ID NO: 2804059 - protein, 24 aa, Entamoeba invadens
SFIQKDWMCLLSYMVIGLGITCAF

SEQ ID NO: 2804060 - protein, 25 aa, Entamoeba invadens
SFKLFAGRPRPHFYDRLAQKPSDTI

SEQ ID NO: 2804061 - protein, 20 aa, Entamoeba invadens
SFKLRKARRATKTIKLSKYE

SEQ ID NO: 2804062 - protein, 24 aa, Entamoeba invadens
SFKQETFLSFFLLLVVTVIFGFIV

SEQ ID NO: 2804063 - protein, 23 aa, Entamoeba invadens
SFKQKQCPCFTTLSETCYTTSLT

SEQ ID NO: 2804064 - protein, 21 aa, Entamoeba invadens
SFLCEECPIGAYSSTQKSSTC

SEQ ID NO: 2804065 - protein, 25 aa, Entamoeba invadens
SFLFKKASYSFGIYILGGVVSFVLL

SEQ ID NO: 2804066 - protein, 26 aa, Entamoeba invadens
SFLFNFSAYFLWTVIPLRANDLGASS

SEQ ID NO: 2804067 - protein, 23 aa, Entamoeba invadens
SFLFRYDNIVSLGLENPRILLTW

SEQ ID NO: 2804068 - protein, 27 aa, Entamoeba invadens
SFLGVFRLPLKFQDAKQFPRCLGITDK

SEQ ID NO: 2804069 - protein, 26 aa, Entamoeba invadens
SFLIYFPLKLGQIFTALNERGQSKLF

SEQ ID NO: 2804070 - protein, 20 aa, Entamoeba invadens
SFLKKFKWIGFGSMFTHMAF

SEQ ID NO: 2804071 - protein, 22 aa, Entamoeba invadens
SFLKLSDLQTVFFDIYTVDNAI

SEQ ID NO: 2804072 - protein, 19 aa, Entamoeba invadens
SFLLAHVSYSYGFSQHLSL

SEQ ID NO: 2804073 - protein, 20 aa, Entamoeba invadens
SFLLYWVVSVIFCFIPVMII

SEQ ID NO: 2804074 - protein, 24 aa, Entamoeba invadens
SFLMLRKSLLNEFLLKDLKKKGVD

SEQ ID NO: 2804075 - protein, 18 aa, Entamoeba invadens
SFLNFAFAELNKLFDLND

SEQ ID NO: 2804076 - protein, 24 aa, Entamoeba invadens
SFLPNFKLSYSPSLHVGISAFANI

SEQ ID NO: 2804077 - protein, 20 aa, Entamoeba invadens
SFMMDYRFLLFPCILDSHWF

SEQ ID NO: 2804078 - protein, 18 aa, Entamoeba invadens
SFMPFPMFQIYSSTKAFV

SEQ ID NO: 2804079 - protein, 22 aa, Entamoeba invadens
SFNCNICPVGTYANSANKKCQQ

SEQ ID NO: 2804080 - protein, 20 aa, Entamoeba invadens
SFNFGTAIRLLVKTSSTDTY

SEQ ID NO: 2804081 - protein, 20 aa, Entamoeba invadens
SFNLESCILLIALLTLSNGL

SEQ ID NO: 2804082 - protein, 25 aa, Entamoeba invadens
SFNRLSLFVEHVFKTRFFTPFFIQL

SEQ ID NO: 2804083 - protein, 17 aa, Entamoeba invadens
SFNSMIFNLLSLIDCCV

SEQ ID NO: 2804084 - protein, 17 aa, Entamoeba invadens
SFNTLYSKPSRRVCGEV

SEQ ID NO: 2804085 - protein, 27 aa, Entamoeba invadens
SFPALDAGLPIKFFMAQLMNMENVIGA

SEQ ID NO: 2804086 - protein, 25 aa, Entamoeba invadens
SFPKFRIYFLGGYLIPAAGGCIKYV

SEQ ID NO: 2804087 - protein, 31 aa, Entamoeba invadens
SFPQKRNVTIPKFEIESSFAMNDQLGKLGLK

SEQ ID NO: 2804088 - protein, 23 aa, Entamoeba invadens
SFSDFKSITGYGYISNNTSYYNV

SEQ ID NO: 2804089 - protein, 18 aa, Entamoeba invadens
SFSFDFYGLAGWALDLLD

SEQ ID NO: 2804090 - protein, 24 aa, Entamoeba invadens
SFSFFKVNWFFSYAVASMLFVGGV

SEQ ID NO: 2804091 - protein, 17 aa, Entamoeba invadens
SFSKRSLLEVKRRFEGW

SEQ ID NO: 2804092 - protein, 20 aa, Entamoeba invadens
SFSQLYAFVPEHVVLSVNDN

SEQ ID NO: 2804093 - protein, 26 aa, Entamoeba invadens
SFSVKEMLEIFGFRNCISLLPYNKRK

SEQ ID NO: 2804094 - protein, 22 aa, Entamoeba invadens
SFTEVKRLLLIYNTPLFITFDK

SEQ ID NO: 2804095 - protein, 20 aa, Entamoeba invadens
SFTFFIVALILIYKRNPSFF

SEQ ID NO: 2804096 - protein, 19 aa, Entamoeba invadens
SFTSTMLKMLPIKQFEKIK

SEQ ID NO: 2804097 - protein, 17 aa, Entamoeba invadens
SFTTVAVVLNFVLLNLF

SEQ ID NO: 2804098 - protein, 23 aa, Entamoeba invadens
SFVECLRNSDAFSGDEKVNGLLL

SEQ ID NO: 2804099 - protein, 20 aa, Entamoeba invadens
SFVGLCWSFGAVFGNFLGGV

SEQ ID NO: 2804100 - protein, 19 aa, Entamoeba invadens
SFVHLFKEFNWWPIKYKTD

SEQ ID NO: 2804101 - protein, 31 aa, Entamoeba invadens
SFVLCFTLPCIFQYLSRRKAIKMYKKKGTPY

SEQ ID NO: 2804102 - protein, 18 aa, Entamoeba invadens
SFVLLPYDTLMRMNLLLR

SEQ ID NO: 2804103 - protein, 19 aa, Entamoeba invadens
SFVSCYFIFLIIKTRLAQA

SEQ ID NO: 2804104 - protein, 30 aa, Entamoeba invadens
SFVTLSIICCIYAASVLFGIVGLIIFLLIK

SEQ ID NO: 2804105 - protein, 29 aa, Entamoeba invadens
SFYSVNRFLPFKAPIVFSSSCKNIISEFI

SEQ ID NO: 2804106 - protein, 18 aa, Entamoeba invadens
SGADCYITPLSSVTSFKI

SEQ ID NO: 2804107 - protein, 28 aa, Entamoeba invadens
SGAESFDLNCIKCILEGRQTIDNLYIGN

SEQ ID NO: 2804108 - protein, 19 aa, Entamoeba invadens
SGAILRLGKSTKFVFKNYS

SEQ ID NO: 2804109 - protein, 23 aa, Entamoeba invadens
SGAIVVCAPIAPYREIRDEVRKM

SEQ ID NO: 2804110 - protein, 22 aa, Entamoeba invadens
SGASQCSKCPAGYYSSSRGSAS

SEQ ID NO: 2804111 - protein, 21 aa, Entamoeba invadens
SGASSCTKCPAGYYSSSGSTS

SEQ ID NO: 2804112 - protein, 21 aa, Entamoeba invadens
SGASSCTKCPAGYYSSTSGSF

SEQ ID NO: 2804113 - protein, 26 aa, Entamoeba invadens
SGATECVTCSPGYIRSTFNSEFGCIS

SEQ ID NO: 2804114 - protein, 21 aa, Entamoeba invadens
SGCALPTCGNNAIDEYEECDD

SEQ ID NO: 2804115 - protein, 17 aa, Entamoeba invadens
SGCKGDCISNYTCNTTC

SEQ ID NO: 2804116 - protein, 20 aa, Entamoeba invadens
SGCKSCADGYYLNLANNRCY

SEQ ID NO: 2804117 - protein, 18 aa, Entamoeba invadens
SGCLIASGNICRKCKTGY

SEQ ID NO: 2804118 - protein, 22 aa, Entamoeba invadens
SGCNACPPGTFAANTGSYYCDH

SEQ ID NO: 2804119 - protein, 24 aa, Entamoeba invadens
SGCQKCKVGYFPKEKRCSPCSKMP

SEQ ID NO: 2804120 - protein, 18 aa, Entamoeba invadens
SGCSLCSDGYYLYKTNQC

SEQ ID NO: 2804121 - protein, 17 aa, Entamoeba invadens
SGCTNCIKESGVCSECE

SEQ ID NO: 2804122 - protein, 21 aa, Entamoeba invadens
SGCTTCSTGYFVKNQYCSLCS

SEQ ID NO: 2804123 - protein, 31 aa, Entamoeba invadens
SGCVICKNGYYKTGLNCFECAERCSTCNNEN

SEQ ID NO: 2804124 - protein, 21 aa, Entamoeba invadens
SGCVTCSIGYYYDNQYCSSCS

SEQ ID NO: 2804125 - protein, 17 aa, Entamoeba invadens
SGCYECENGFYISNNLC

SEQ ID NO: 2804126 - protein, 29 aa, Entamoeba invadens
SGCYQCRDGYYRVGLDCIECISNCSTCNT

SEQ ID NO: 2804127 - protein, 18 aa, Entamoeba invadens
SGDGISCESQIVWWVILI

SEQ ID NO: 2804128 - protein, 27 aa, Entamoeba invadens
SGDGVFFQWAMCIGILIVGIFTQMIAG

SEQ ID NO: 2804129 - protein, 25 aa, Entamoeba invadens
SGDRCTICGTNFYLLSNATKCVSFD

SEQ ID NO: 2804130 - protein, 21 aa, Entamoeba invadens
SGEACEFEILITLICTTKINE

SEQ ID NO: 2804131 - protein, 24 aa, Entamoeba invadens
SGEACEFEILLTLKCTTKMDESVL

SEQ ID NO: 2804132 - protein, 24 aa, Entamoeba invadens
SGEACEFEILLTLKCTTKVDDNIV

SEQ ID NO: 2804133 - protein, 18 aa, Entamoeba invadens
SGECIRGSKESEQFAIDG

SEQ ID NO: 2804134 - protein, 21 aa, Entamoeba invadens
SGECIYDRLFSLRKAIEKVVV

SEQ ID NO: 2804135 - protein, 18 aa, Entamoeba invadens
SGEKCVTCVEGYNIDAGG

SEQ ID NO: 2804136 - protein, 19 aa, Entamoeba invadens
SGELCKYGRVTSTISECFK

SEQ ID NO: 2804137 - protein, 18 aa, Entamoeba invadens
SGELNLQGVTSFSTRMDY

SEQ ID NO: 2804138 - protein, 22 aa, Entamoeba invadens
SGEMCVCQFGVLSPIQTTITMV

SEQ ID NO: 2804139 - protein, 25 aa, Entamoeba invadens
SGESCSRRSLPMTATHLLMLPTANV

SEQ ID NO: 2804140 - protein, 21 aa, Entamoeba invadens
SGFDFLPVYITLGVFAGIVLL

SEQ ID NO: 2804141 - protein, 19 aa, Entamoeba invadens
SGFFFVMNCIVGLSAPFFH

SEQ ID NO: 2804142 - protein, 24 aa, Entamoeba invadens
SGGCLKCSNGYFIDSQFCTLCSSK

SEQ ID NO: 2804143 - protein, 19 aa, Entamoeba invadens
SGGCLRCINSYYDDDTSKT

SEQ ID NO: 2804144 - protein, 19 aa, Entamoeba invadens
SGGCVKCIDGYYRSELSCE

SEQ ID NO: 2804145 - protein, 23 aa, Entamoeba invadens
SGGEINWFYSFPGLYKETVPDSV

SEQ ID NO: 2804146 - protein, 17 aa, Entamoeba invadens
SGICLSNLCGFVTDPES

SEQ ID NO: 2804147 - protein, 24 aa, Entamoeba invadens
SGICNTCLYNYVFNEPKGMNCVQC

SEQ ID NO: 2804148 - protein, 20 aa, Entamoeba invadens
SGICPKCSQPQYVVTSPQST

SEQ ID NO: 2804149 - protein, 17 aa, Entamoeba invadens
SGIDFKNCFDVNCLDYN

SEQ ID NO: 2804150 - protein, 19 aa, Entamoeba invadens
SGILLAILMSITFFALCSV

SEQ ID NO: 2804151 - protein, 25 aa, Entamoeba invadens
SGKCECLEGFVLKDSVCTKCGNGVL

SEQ ID NO: 2804152 - protein, 26 aa, Entamoeba invadens
SGKKFEGPSTFKSIAIGSGSDATFAR

SEQ ID NO: 2804153 - protein, 18 aa, Entamoeba invadens
SGKLPIEVLEVLMKYISS

SEQ ID NO: 2804154 - protein, 24 aa, Entamoeba invadens
SGKMLNEYFELIYITFYVWGYLSL

SEQ ID NO: 2804155 - protein, 21 aa, Entamoeba invadens
SGKMSCKLCVDGFSPMYDTTN

SEQ ID NO: 2804156 - protein, 22 aa, Entamoeba invadens
SGKQQCFWGKMSSVDSVKEVAK

SEQ ID NO: 2804157 - protein, 17 aa, Entamoeba invadens
SGKRLGIPTTFNHELAD

SEQ ID NO: 2804158 - protein, 25 aa, Entamoeba invadens
SGKRLKRIDSIPVNLFNFINNSWQQ

SEQ ID NO: 2804159 - protein, 17 aa, Entamoeba invadens
SGKRLSVREGISPEAYR

SEQ ID NO: 2804160 - protein, 24 aa, Entamoeba invadens
SGKTIKCAIGYFIKSNKCENCGEN

SEQ ID NO: 2804161 - protein, 22 aa, Entamoeba invadens
SGKTIKCNIGYFIKSNKCENCG

SEQ ID NO: 2804162 - protein, 20 aa, Entamoeba invadens
SGKVKSCYPPNVGGRVVPLN

SEQ ID NO: 2804163 - protein, 21 aa, Entamoeba invadens
SGLCLDISFVLNCLQVSDSKC

SEQ ID NO: 2804164 - protein, 22 aa, Entamoeba invadens
SGLCNYIGIIVFFVRMDIRGES

SEQ ID NO: 2804165 - protein, 23 aa, Entamoeba invadens
SGLEDWAIALIFLSCVVVIAIIL

SEQ ID NO: 2804166 - protein, 20 aa, Entamoeba invadens
SGLFLGILFLFLIACAMILF

SEQ ID NO: 2804167 - protein, 17 aa, Entamoeba invadens
SGLFPYQTTPNFFSSKI

SEQ ID NO: 2804168 - protein, 21 aa, Entamoeba invadens
SGLHLDYLKGNLFTLASSLVA

SEQ ID NO: 2804169 - protein, 20 aa, Entamoeba invadens
SGLHLLDMLQIIPTCPAETF

SEQ ID NO: 2804170 - protein, 22 aa, Entamoeba invadens
SGLIISLAVMFWVGLTDVSIFG

SEQ ID NO: 2804171 - protein, 18 aa, Entamoeba invadens
SGLKCVSCQNEYRIDNTI

SEQ ID NO: 2804172 - protein, 25 aa, Entamoeba invadens
SGLLGYSAALLIMFVVSFLAIKRFK

SEQ ID NO: 2804173 - protein, 18 aa, Entamoeba invadens
SGLTKCVECLAGYFMNDD

SEQ ID NO: 2804174 - protein, 21 aa, Entamoeba invadens
SGLWCGKVGPFIHIASCVAAN

SEQ ID NO: 2804175 - protein, 18 aa, Entamoeba invadens
SGLWYLFEKLEFKTGKFI

SEQ ID NO: 2804176 - protein, 22 aa, Entamoeba invadens
SGLYLSGTICYSCRAGTYSSGG

SEQ ID NO: 2804177 - protein, 22 aa, Entamoeba invadens
SGNATCTICPAGTYSAEGAANC

SEQ ID NO: 2804178 - protein, 22 aa, Entamoeba invadens
SGNATCTICPAGTYSAEGASIC

SEQ ID NO: 2804179 - protein, 21 aa, Entamoeba invadens
SGNCLTCYAGYEFTGNANCEI

SEQ ID NO: 2804180 - protein, 30 aa, Entamoeba invadens
SGNGYIGAIFRNHVVGIKKVQISLGGNTHD

SEQ ID NO: 2804181 - protein, 25 aa, Entamoeba invadens
SGNGYRTLKGLKHVIANCVFSGTRN

SEQ ID NO: 2804182 - protein, 19 aa, Entamoeba invadens
SGNLPPNFFCKCSSLQNFV

SEQ ID NO: 2804183 - protein, 26 aa, Entamoeba invadens
SGNNELKLKCVLNCDDTKCSFEQQDC

SEQ ID NO: 2804184 - protein, 24 aa, Entamoeba invadens
SGNSEFRILAPFLVDKNVPEEVHR

SEQ ID NO: 2804185 - protein, 27 aa, Entamoeba invadens
SGNYCKKCSTANCAICNANNVCTQCLT

SEQ ID NO: 2804186 - protein, 19 aa, Entamoeba invadens
SGPALEFTEYIAFVDMSMF

SEQ ID NO: 2804187 - protein, 21 aa, Entamoeba invadens
SGPFLFFLHWFALFFQFIFEI

SEQ ID NO: 2804188 - protein, 25 aa, Entamoeba invadens
SGPLIPRINMNATFNIDELIINSNC

SEQ ID NO: 2804189 - protein, 25 aa, Entamoeba invadens
SGPVILRINMNATFNIDELIINSNC

SEQ ID NO: 2804190 - protein, 26 aa, Entamoeba invadens
SGQCECLEGFVLKDSVCTKCGNGVLD

SEQ ID NO: 2804191 - protein, 23 aa, Entamoeba invadens
SGQEVIEPILLVLVIISLILMFV

SEQ ID NO: 2804192 - protein, 18 aa, Entamoeba invadens
SGQPCLVKGNIMNSPIAY

SEQ ID NO: 2804193 - protein, 20 aa, Entamoeba invadens
SGRCERCETHGYVLSDTHDC

SEQ ID NO: 2804194 - protein, 17 aa, Entamoeba invadens
SGRVELYGALRCKKVVL

SEQ ID NO: 2804195 - protein, 25 aa, Entamoeba invadens
SGSCSEMLCMGEADPSLIGCMSGGT

SEQ ID NO: 2804196 - protein, 18 aa, Entamoeba invadens
SGSFSLNGVCTLCGLGTF

SEQ ID NO: 2804197 - protein, 44 aa, Entamoeba invadens
SGSGISLGGDSVWKCKACGLTVSGEKCILCGSFKSNNDEVAQVV

SEQ ID NO: 2804198 - protein, 18 aa, Entamoeba invadens
SGSLKFDSVLSINITPQQ

SEQ ID NO: 2804199 - protein, 24 aa, Entamoeba invadens
SGSSRLAVHASFIMVLLFEAYFFV

SEQ ID NO: 2804200 - protein, 24 aa, Entamoeba invadens
SGTDRTGGAFALILALCQILQSRP

SEQ ID NO: 2804201 - protein, 22 aa, Entamoeba invadens
SGTFKCIEYLYNININNNTNIN

SEQ ID NO: 2804202 - protein, 24 aa, Entamoeba invadens
SGTGCAICKKGYFQTGVNCIECMD

SEQ ID NO: 2804203 - protein, 21 aa, Entamoeba invadens
SGTGCASCFDGSYRSGLECLP

SEQ ID NO: 2804204 - protein, 18 aa, Entamoeba invadens
SGTLKVLVVALVFVLMIA

SEQ ID NO: 2804205 - protein, 21 aa, Entamoeba invadens
SGTSCLICQAGTYSSGGTPTS

SEQ ID NO: 2804206 - protein, 18 aa, Entamoeba invadens
SGTSCRKKVVWWVVFLLV

SEQ ID NO: 2804207 - protein, 23 aa, Entamoeba invadens
SGTSCYYCRAGTYSSGGTTTSCS

SEQ ID NO: 2804208 - protein, 22 aa, Entamoeba invadens
SGTSGCEACFPGYYINVNDPKQ

SEQ ID NO: 2804209 - protein, 17 aa, Entamoeba invadens
SGTTFLHHLLACGENAR

SEQ ID NO: 2804210 - protein, 20 aa, Entamoeba invadens
SGVCTLCGDLTYSEGGIMQC

SEQ ID NO: 2804211 - protein, 20 aa, Entamoeba invadens
SGVCTLCGDLTYSEGGVLRC

SEQ ID NO: 2804212 - protein, 20 aa, Entamoeba invadens
SGVCTLCGDLTYSEGGVMQC

SEQ ID NO: 2804213 - protein, 20 aa, Entamoeba invadens
SGVCTLCGDLTYSGGGVLQC

SEQ ID NO: 2804214 - protein, 20 aa, Entamoeba invadens
SGVCYGCLTNHVFENATQMN

SEQ ID NO: 2804215 - protein, 18 aa, Entamoeba invadens
SGVFKVSYNLVVEILTHE

SEQ ID NO: 2804216 - protein, 36 aa, Entamoeba invadens
SGVGVCVYVLTMSKACKWRFGFTVVTFLIALVLVLI

SEQ ID NO: 2804217 - protein, 20 aa, Entamoeba invadens
SGVLKSAPFFTISSSPLMTW

SEQ ID NO: 2804218 - protein, 17 aa, Entamoeba invadens
SGVLVLKSFSWTKIDGV

SEQ ID NO: 2804219 - protein, 19 aa, Entamoeba invadens
SGVTLVFSSKCGKVTDTTS

SEQ ID NO: 2804220 - protein, 24 aa, Entamoeba invadens
SGVYYMYYHVIFTTFVKLHHDGEY

SEQ ID NO: 2804221 - protein, 19 aa, Entamoeba invadens
SGWTKLGLLFLGASFYGYF

SEQ ID NO: 2804222 - protein, 19 aa, Entamoeba invadens
SGYACNRCTEAGKKVFDYS

SEQ ID NO: 2804223 - protein, 19 aa, Entamoeba invadens
SGYCKLETCGDGIKQSNEE

SEQ ID NO: 2804224 - protein, 24 aa, Entamoeba invadens
SGYCTGCLNGFYPLIGLCKPCDFN

SEQ ID NO: 2804225 - protein, 23 aa, Entamoeba invadens
SGYDEIRMKIGLREKDEQQPLIM

SEQ ID NO: 2804226 - protein, 17 aa, Entamoeba invadens
SGYFLQSLYCFKCADKC

SEQ ID NO: 2804227 - protein, 26 aa, Entamoeba invadens
SGYTLFFIFVIWRVCVLQEEVENQKA

SEQ ID NO: 2804228 - protein, 18 aa, Entamoeba invadens
SHAEWLRSYFSKEVRDDF

SEQ ID NO: 2804229 - protein, 33 aa, Entamoeba invadens
SHCATCAYNGLRSCLVCSVGYYPSSGICTECSK

SEQ ID NO: 2804230 - protein, 18 aa, Entamoeba invadens
SHCVFKNLYFFVTAPLGV

SEQ ID NO: 2804231 - protein, 17 aa, Entamoeba invadens
SHEKIKHFHIIKEEWTP

SEQ ID NO: 2804232 - protein, 24 aa, Entamoeba invadens
SHEVWRLALSICPFIVAGVVAISR

SEQ ID NO: 2804233 - protein, 30 aa, Entamoeba invadens
SHFFYLYYYLRGCSSFGRAFASHAKGKGID

SEQ ID NO: 2804234 - protein, 31 aa, Entamoeba invadens
SHFFYLYYYLRGCSSFGRAFASHAKGKGIDT

SEQ ID NO: 2804235 - protein, 24 aa, Entamoeba invadens
SHFPFKFSSGTGYLISNQRLIRFC

SEQ ID NO: 2804236 - protein, 20 aa, Entamoeba invadens
SHGPLLMAIPMWKNSLVFHD

SEQ ID NO: 2804237 - protein, 17 aa, Entamoeba invadens
SHHCIKCSVSCHTQLVY

SEQ ID NO: 2804238 - protein, 19 aa, Entamoeba invadens
SHIDSRWIVLLVILVVIIF

SEQ ID NO: 2804239 - protein, 17 aa, Entamoeba invadens
SHIKYLPFLKGVTGSKC

SEQ ID NO: 2804240 - protein, 22 aa, Entamoeba invadens
SHIPMNGVILFPSDILEEKNKT

SEQ ID NO: 2804241 - protein, 19 aa, Entamoeba invadens
SHIVWWMIIVIVIICIMTF

SEQ ID NO: 2804242 - protein, 24 aa, Entamoeba invadens
SHIYCLFEKGSLKQRFKVLTLCCL

SEQ ID NO: 2804243 - protein, 23 aa, Entamoeba invadens
SHKEPPFVYWIYFVKSNLFVLNN

SEQ ID NO: 2804244 - protein, 27 aa, Entamoeba invadens
SHKGKEEFTKPLGLRTAPFPSSVPAGS

SEQ ID NO: 2804245 - protein, 20 aa, Entamoeba invadens
SHLAATFLVAKSMSHGIKLV

SEQ ID NO: 2804246 - protein, 19 aa, Entamoeba invadens
SHLKLDFSVAPIKQSTQLN

SEQ ID NO: 2804247 - protein, 25 aa, Entamoeba invadens
SHLNKCLKCEISFMRVDEIIVEAEY

SEQ ID NO: 2804248 - protein, 18 aa, Entamoeba invadens
SHLNWDRFSKDEKKVNAK

SEQ ID NO: 2804249 - protein, 24 aa, Entamoeba invadens
SHLTMSWDRRLRMLKDAASGMFYL

SEQ ID NO: 2804250 - protein, 19 aa, Entamoeba invadens
SHMNICLISNLYAFTISLL

SEQ ID NO: 2804251 - protein, 25 aa, Entamoeba invadens
SHNEFKFPWKIAEFVINGNRLRKVD

SEQ ID NO: 2804252 - protein, 24 aa, Entamoeba invadens
SHNKWLIQLPRHFVSRKSNEGGFT

SEQ ID NO: 2804253 - protein, 33 aa, Entamoeba invadens
SHPCQPISIFGSWYKLRIRENVNYRLYGGVIDG

SEQ ID NO: 2804254 - protein, 19 aa, Entamoeba invadens
SHSPCTPYIGLFLSDLLFT

SEQ ID NO: 2804255 - protein, 18 aa, Entamoeba invadens
SHTITTCAFQSSNKEYAI

SEQ ID NO: 2804256 - protein, 17 aa, Entamoeba invadens
SHTYCKLEDGVWNSTKC

SEQ ID NO: 2804257 - protein, 25 aa, Entamoeba invadens
SHVELLGAFIFKLTKDIFKISSSTQ

SEQ ID NO: 2804258 - protein, 23 aa, Entamoeba invadens
SHVELYSRLSFFNVSSTHYLNNI

SEQ ID NO: 2804259 - protein, 27 aa, Entamoeba invadens
SHYPIELLICLVVALFHIYKSVTNFKI

SEQ ID NO: 2804260 - protein, 25 aa, Entamoeba invadens
SHYSLICELSIRWFLNKEKTYIYGF

SEQ ID NO: 2804261 - protein, 18 aa, Entamoeba invadens
SIACTGCNNNTYLDESLN

SEQ ID NO: 2804262 - protein, 24 aa, Entamoeba invadens
SIAFPGFVVSFLIVDRIGRKPLQL

SEQ ID NO: 2804263 - protein, 22 aa, Entamoeba invadens
SIAHFIVAMVFYFVDFSDHWAY

SEQ ID NO: 2804264 - protein, 18 aa, Entamoeba invadens
SICAGLFGTFGFLLPNIV

SEQ ID NO: 2804265 - protein, 24 aa, Entamoeba invadens
SICLPCSPNWCDVCDGTTGRCVRC

SEQ ID NO: 2804266 - protein, 22 aa, Entamoeba invadens
SICRRENYNRFILKPKKNNQLT

SEQ ID NO: 2804267 - protein, 18 aa, Entamoeba invadens
SICSKCLKGYTITTNGGC

SEQ ID NO: 2804268 - protein, 18 aa, Entamoeba invadens
SICTKCPAGTYSSNGSSA

SEQ ID NO: 2804269 - protein, 18 aa, Entamoeba invadens
SICTKCPAGTYSSTGSST

SEQ ID NO: 2804270 - protein, 18 aa, Entamoeba invadens
SICTTCIDGYYMASDDFC

SEQ ID NO: 2804271 - protein, 20 aa, Entamoeba invadens
SICVKCFDGFVLETTPDNKV

SEQ ID NO: 2804272 - protein, 20 aa, Entamoeba invadens
SICVSCSSGYELDDNYNCIL

SEQ ID NO: 2804273 - protein, 20 aa, Entamoeba invadens
SIDLSFPRSIFFEQEALLEE

SEQ ID NO: 2804274 - protein, 17 aa, Entamoeba invadens
SIEECWNGVLSHTSDVK

SEQ ID NO: 2804275 - protein, 25 aa, Entamoeba invadens
SIEIEMKLRIKLMLDSISGIIYLHT

SEQ ID NO: 2804276 - protein, 24 aa, Entamoeba invadens
SIERICNCFCNFQMLEPTILSLEM

SEQ ID NO: 2804277 - protein, 23 aa, Entamoeba invadens
SIEVSIKNGRRFEEIKNINKNEI

SEQ ID NO: 2804278 - protein, 20 aa, Entamoeba invadens
SIFAIKSFVINGGRLEIDSE

SEQ ID NO: 2804279 - protein, 20 aa, Entamoeba invadens
SIFGCISCEIGYYLSNVECH

SEQ ID NO: 2804280 - protein, 18 aa, Entamoeba invadens
SIFKCLKSDGKSCLECEP

SEQ ID NO: 2804281 - protein, 18 aa, Entamoeba invadens
SIFKESKSPFKGLYGSTP

SEQ ID NO: 2804282 - protein, 25 aa, Entamoeba invadens
SIFLFLFLLCLTFSVVMGAASFQSA

SEQ ID NO: 2804283 - protein, 18 aa, Entamoeba invadens
SIFLTYSVLINYGRVAVV

SEQ ID NO: 2804284 - protein, 19 aa, Entamoeba invadens
SIFPLIAIGVVLLRKLIFV

SEQ ID NO: 2804285 - protein, 18 aa, Entamoeba invadens
SIFRIVRVVIPYFIDLTT

SEQ ID NO: 2804286 - protein, 19 aa, Entamoeba invadens
SIFRVVETMIAFLLIVLDV

SEQ ID NO: 2804287 - protein, 19 aa, Entamoeba invadens
SIFTRFYFIIVFFIVLSAA

SEQ ID NO: 2804288 - protein, 20 aa, Entamoeba invadens
SIGANAFKATGFGTFPFPKG

SEQ ID NO: 2804289 - protein, 23 aa, Entamoeba invadens
SIGCTICSSGFYLKNQLCESCST

SEQ ID NO: 2804290 - protein, 25 aa, Entamoeba invadens
SIGDCLPMNISILVFLGLLIFFNNP

SEQ ID NO: 2804291 - protein, 20 aa, Entamoeba invadens
SIGISIIWCNDEFFIDNNMC

SEQ ID NO: 2804292 - protein, 22 aa, Entamoeba invadens
SIGIVEAFLLIFAAWDLTTKES

SEQ ID NO: 2804293 - protein, 19 aa, Entamoeba invadens
SIGKFYFKKNLVINTQIII

SEQ ID NO: 2804294 - protein, 31 aa, Entamoeba invadens
SIGLLFEGLSSFILFLLYGWVFVLLLFLYSQ

SEQ ID NO: 2804295 - protein, 19 aa, Entamoeba invadens
SIGSYSGFMVMDFGMVSET

SEQ ID NO: 2804296 - protein, 22 aa, Entamoeba invadens
SIICWLVSIFAIVLSVLSCLRP

SEQ ID NO: 2804297 - protein, 26 aa, Entamoeba invadens
SIIIAIVCVFVLILLVGFISVMYNKW

SEQ ID NO: 2804298 - protein, 23 aa, Entamoeba invadens
SIIIPNCVKNVSFLCLACESNYY

SEQ ID NO: 2804299 - protein, 19 aa, Entamoeba invadens
SIILPIIFGIFIVVIIITI

SEQ ID NO: 2804300 - protein, 23 aa, Entamoeba invadens
SIIMLWPRIEKLGDPNFRKLSIV

SEQ ID NO: 2804301 - protein, 26 aa, Entamoeba invadens
SIIVFSCSFRSIRFVVGDMESFEVKG

SEQ ID NO: 2804302 - protein, 24 aa, Entamoeba invadens
SIKKCDKFGTYMLFTTEPNEPLLI

SEQ ID NO: 2804303 - protein, 18 aa, Entamoeba invadens
SIKVKGLCPNDCHENDGN

SEQ ID NO: 2804304 - protein, 18 aa, Entamoeba invadens
SIKVLGNKLMRVCKSGFN

SEQ ID NO: 2804305 - protein, 17 aa, Entamoeba invadens
SILCISMVAGVFEQLDV

SEQ ID NO: 2804306 - protein, 20 aa, Entamoeba invadens
SILFDCCFTQVPLCDINTMK

SEQ ID NO: 2804307 - protein, 18 aa, Entamoeba invadens
SILLALFLIKSFSFSTDG

SEQ ID NO: 2804308 - protein, 18 aa, Entamoeba invadens
SILNRRFKLYGQFKKDVD

SEQ ID NO: 2804309 - protein, 17 aa, Entamoeba invadens
SILPSLSAATWAIRDND

SEQ ID NO: 2804310 - protein, 18 aa, Entamoeba invadens
SILVLILFVVYGQISDVC

SEQ ID NO: 2804311 - protein, 18 aa, Entamoeba invadens
SILYKMYLVITFLYTRVA

SEQ ID NO: 2804312 - protein, 19 aa, Entamoeba invadens
SILYLSAIELFMMEQLGYS

SEQ ID NO: 2804313 - protein, 23 aa, Entamoeba invadens
SILYQDGDFGWTLNDSAFIGYGK

SEQ ID NO: 2804314 - protein, 24 aa, Entamoeba invadens
SINNRIPSKFKRFVLSIKASVLEI

SEQ ID NO: 2804315 - protein, 25 aa, Entamoeba invadens
SIPAFRFLVKLLLVHGRYFYRQNSV

SEQ ID NO: 2804316 - protein, 22 aa, Entamoeba invadens
SIPHADKVIILFKGYNYSELIT

SEQ ID NO: 2804317 - protein, 19 aa, Entamoeba invadens
SIRCLKCGPEYSFNNGDCV

SEQ ID NO: 2804318 - protein, 24 aa, Entamoeba invadens
SIRKCNQCTSGLFPSTLSPFKCVE

SEQ ID NO: 2804319 - protein, 19 aa, Entamoeba invadens
SIRLAVPIPSSFSQENYIP

SEQ ID NO: 2804320 - protein, 20 aa, Entamoeba invadens
SISCSLCADTYFYYKRDSDL

SEQ ID NO: 2804321 - protein, 19 aa, Entamoeba invadens
SISGSLGCYRCIDGKFLNA

SEQ ID NO: 2804322 - protein, 28 aa, Entamoeba invadens
SISKNVRWCFDLNIVFCYQEDFVCPYDN

SEQ ID NO: 2804323 - protein, 25 aa, Entamoeba invadens
SISLEWKTDFQYGKVTLLVFVGVVA

SEQ ID NO: 2804324 - protein, 28 aa, Entamoeba invadens
SISNRCLKCANKFLLRDGLCVSDATCLL

SEQ ID NO: 2804325 - protein, 20 aa, Entamoeba invadens
SISPIALCVIYLVFLVLVGI

SEQ ID NO: 2804326 - protein, 34 aa, Entamoeba invadens
SISSYKWPYIKFIFKMSYAALFFTNKKTYNKKSS

SEQ ID NO: 2804327 - protein, 17 aa, Entamoeba invadens
SISTKFDNCLLCENNTV

SEQ ID NO: 2804328 - protein, 20 aa, Entamoeba invadens
SITCSLCADTYFYYKKDSDL

SEQ ID NO: 2804329 - protein, 25 aa, Entamoeba invadens
SITDKWTYHRSLILAAMTIFMMYLT

SEQ ID NO: 2804330 - protein, 27 aa, Entamoeba invadens
SITGGCVICADKYYRSGFECFECSSKC

SEQ ID NO: 2804331 - protein, 33 aa, Entamoeba invadens
SITGGCVICADKYYRSGFECFKCSSKCATCQDK

SEQ ID NO: 2804332 - protein, 25 aa, Entamoeba invadens
SITHCNTCLPGFFKSDYYSCSACSA

SEQ ID NO: 2804333 - protein, 18 aa, Entamoeba invadens
SITKSSDCVGCVTNHHIE

SEQ ID NO: 2804334 - protein, 25 aa, Entamoeba invadens
SITPYKFTLTLLWLDVELTSTSINP

SEQ ID NO: 2804335 - protein, 25 aa, Entamoeba invadens
SITSLKKFNCLSGFITVNGQGTLTA

SEQ ID NO: 2804336 - protein, 21 aa, Entamoeba invadens
SIVAICFSLALIYLVVQQTET

SEQ ID NO: 2804337 - protein, 20 aa, Entamoeba invadens
SIVCYFSRFESLSGQYCGEI

SEQ ID NO: 2804338 - protein, 22 aa, Entamoeba invadens
SIVNGIGFGVVFMCLFGFNALG

SEQ ID NO: 2804339 - protein, 25 aa, Entamoeba invadens
SIVSLKPGYACEFEIFIKPLCTCTT

SEQ ID NO: 2804340 - protein, 25 aa, Entamoeba invadens
SIVYPRRWYTFAIFIILGIIPLIQL

SEQ ID NO: 2804341 - protein, 30 aa, Entamoeba invadens
SIWVIFALPKLPGIWTVLFLASSCLWVSFW

SEQ ID NO: 2804342 - protein, 26 aa, Entamoeba invadens
SIYEIAWRFGGNSLRTFTKVIQMVYN

SEQ ID NO: 2804343 - protein, 21 aa, Entamoeba invadens
SIYKIIKLCWAQDSNLRLDIM

SEQ ID NO: 2804344 - protein, 20 aa, Entamoeba invadens
SIYLRTYVTPAFGFGTIAVS

SEQ ID NO: 2804345 - protein, 27 aa, Entamoeba invadens
SIYSGYIYGCFNVVLSFVFNDSLNGFL

SEQ ID NO: 2804346 - protein, 17 aa, Entamoeba invadens
SKAFSLSQIEEFEINAV

SEQ ID NO: 2804347 - protein, 18 aa, Entamoeba invadens
SKAKGFLNFCEENDGFDI

SEQ ID NO: 2804348 - protein, 32 aa, Entamoeba invadens
SKAKLYRPLMMYTTFFATRIVMILMILGSIGL

SEQ ID NO: 2804349 - protein, 21 aa, Entamoeba invadens
SKARIKMLINTALYKETTKTP

SEQ ID NO: 2804350 - protein, 23 aa, Entamoeba invadens
SKAVWWVIIISFLFIIFIITLLI

SEQ ID NO: 2804351 - protein, 21 aa, Entamoeba invadens
SKCDKCKVGSYSKDGAVVCEL

SEQ ID NO: 2804352 - protein, 35 aa, Entamoeba invadens
SKCESCADTNCLKCNNNVCGLCQTGYVFNDTKSCE

SEQ ID NO: 2804353 - protein, 19 aa, Entamoeba invadens
SKCIECLDSFKLKNGNCSE

SEQ ID NO: 2804354 - protein, 18 aa, Entamoeba invadens
SKCIKCSFWNEPSLDGTY

SEQ ID NO: 2804355 - protein, 26 aa, Entamoeba invadens
SKCIKCSFWYTPSWDGTFCKTKAVWW

SEQ ID NO: 2804356 - protein, 21 aa, Entamoeba invadens
SKCISCVFGYYLDKNDCLKCP

SEQ ID NO: 2804357 - protein, 18 aa, Entamoeba invadens
SKCKECAVGYYVTEGLTC

SEQ ID NO: 2804358 - protein, 27 aa, Entamoeba invadens
SKCKLKEIYKDLSISRMHFLFSQTNEK

SEQ ID NO: 2804359 - protein, 20 aa, Entamoeba invadens
SKCKTCATDFTRSCVECNTN

SEQ ID NO: 2804360 - protein, 22 aa, Entamoeba invadens
SKCLECYNNLILNNAECRTNYD

SEQ ID NO: 2804361 - protein, 22 aa, Entamoeba invadens
SKCNKCSFWYEFSPNGTYREKK

SEQ ID NO: 2804362 - protein, 25 aa, Entamoeba invadens
SKCSSECKDCFGSSTKCTSCEEGEY

SEQ ID NO: 2804363 - protein, 22 aa, Entamoeba invadens
SKCTSCNNLLVLLGNGSCGGLL

SEQ ID NO: 2804364 - protein, 19 aa, Entamoeba invadens
SKCTTCFSDFSRKCVVCND

SEQ ID NO: 2804365 - protein, 19 aa, Entamoeba invadens
SKCVECLDSFKLKNGNCSE

SEQ ID NO: 2804366 - protein, 22 aa, Entamoeba invadens
SKCVECPNEMLLNGETCILNDD

SEQ ID NO: 2804367 - protein, 19 aa, Entamoeba invadens
SKCVHYSKIPNCIEATDSK

SEQ ID NO: 2804368 - protein, 20 aa, Entamoeba invadens
SKDCIKLDCFHDLSYGQRDN

SEQ ID NO: 2804369 - protein, 18 aa, Entamoeba invadens
SKDEIVGIVVQKLIPQVI

SEQ ID NO: 2804370 - protein, 24 aa, Entamoeba invadens
SKDGSVCKKCIKKYINENGKCVED

SEQ ID NO: 2804371 - protein, 17 aa, Entamoeba invadens
SKDGYCTDGNMGSQTTL

SEQ ID NO: 2804372 - protein, 30 aa, Entamoeba invadens
SKDIFMKLFRMCPTHSYAHYVCGVLYQQNG

SEQ ID NO: 2804373 - protein, 24 aa, Entamoeba invadens
SKDKFKFPWSIAEFVIKGSRLPKP

SEQ ID NO: 2804374 - protein, 22 aa, Entamoeba invadens
SKDLKTILLVYGPFISTIRVDD

SEQ ID NO: 2804375 - protein, 17 aa, Entamoeba invadens
SKDSSNVLPIFYASVAN

SEQ ID NO: 2804376 - protein, 21 aa, Entamoeba invadens
SKDYYFFFSYHPSFKTINFNI

SEQ ID NO: 2804377 - protein, 17 aa, Entamoeba invadens
SKECLRCQQEYYITNDS

SEQ ID NO: 2804378 - protein, 25 aa, Entamoeba invadens
SKEDFRYPWDIVDYVMSGKRQGKPS

SEQ ID NO: 2804379 - protein, 19 aa, Entamoeba invadens
SKEEMVILFDFLVATRPSY

SEQ ID NO: 2804380 - protein, 18 aa, Entamoeba invadens
SKEFKGVNTIIITHSYFV

SEQ ID NO: 2804381 - protein, 17 aa, Entamoeba invadens
SKEIKMRILTLIVPSFL

SEQ ID NO: 2804382 - protein, 19 aa, Entamoeba invadens
SKELLCIGSCCESTLKVQI

SEQ ID NO: 2804383 - protein, 19 aa, Entamoeba invadens
SKEYFKGKILNLPIQTYIY

SEQ ID NO: 2804384 - protein, 20 aa, Entamoeba invadens
SKEYLVFEESLSWNIQSSTF

SEQ ID NO: 2804385 - protein, 21 aa, Entamoeba invadens
SKFRGLTVYQIFVSTFSDGDA

SEQ ID NO: 2804386 - protein, 21 aa, Entamoeba invadens
SKFTLSNVWKNVLLSHTTETN

SEQ ID NO: 2804387 - protein, 19 aa, Entamoeba invadens
SKFVKRFASPFSKNCIYEM

SEQ ID NO: 2804388 - protein, 19 aa, Entamoeba invadens
SKGCKRCLNGYYLDNNECI

SEQ ID NO: 2804389 - protein, 23 aa, Entamoeba invadens
SKGCLKCFDGYYLTIKNECVSCE

SEQ ID NO: 2804390 - protein, 20 aa, Entamoeba invadens
SKGCLKCIDGYYLSVKNECV

SEQ ID NO: 2804391 - protein, 18 aa, Entamoeba invadens
SKGCLRCAATYYIQNGAC

SEQ ID NO: 2804392 - protein, 24 aa, Entamoeba invadens
SKGCLRCCDGYYILNSLCVKCEYP

SEQ ID NO: 2804393 - protein, 24 aa, Entamoeba invadens
SKGCLRCLDGFYLSNSICHPCNYP

SEQ ID NO: 2804394 - protein, 20 aa, Entamoeba invadens
SKGGCFKCEATSTLLNVNPP

SEQ ID NO: 2804395 - protein, 20 aa, Entamoeba invadens
SKGNAGVCNQCLSNYPYYYD

SEQ ID NO: 2804396 - protein, 19 aa, Entamoeba invadens
SKGNYCVKCVDDYHIYNGW

SEQ ID NO: 2804397 - protein, 20 aa, Entamoeba invadens
SKGRTTVVIAHRLSTIQNAD

SEQ ID NO: 2804398 - protein, 18 aa, Entamoeba invadens
SKGSRAFSNLLMITFFTS

SEQ ID NO: 2804399 - protein, 19 aa, Entamoeba invadens
SKGSWSRRYIFDEDYNQPP

SEQ ID NO: 2804400 - protein, 19 aa, Entamoeba invadens
SKGTAGICNRCSSSYPYYY

SEQ ID NO: 2804401 - protein, 18 aa, Entamoeba invadens
SKGVDFCEEAKWSFEGEI

SEQ ID NO: 2804402 - protein, 17 aa, Entamoeba invadens
SKHCTSCDSRSGICTSC

SEQ ID NO: 2804403 - protein, 19 aa, Entamoeba invadens
SKHFKHIKPVFGNMNQETS

SEQ ID NO: 2804404 - protein, 23 aa, Entamoeba invadens
SKHIRQMRCESRKWTIIGTTVGI

SEQ ID NO: 2804405 - protein, 25 aa, Entamoeba invadens
SKHQFRFPWKIAEFVINGKRVEKKD

SEQ ID NO: 2804406 - protein, 17 aa, Entamoeba invadens
SKICIKCGSSINVNGVC

SEQ ID NO: 2804407 - protein, 17 aa, Entamoeba invadens
SKICLVTEFANYGSLKD

SEQ ID NO: 2804408 - protein, 17 aa, Entamoeba invadens
SKIKIKIIIDASKGILY

SEQ ID NO: 2804409 - protein, 20 aa, Entamoeba invadens
SKIMPMYGVVTFVGNFISKS

SEQ ID NO: 2804410 - protein, 20 aa, Entamoeba invadens
SKINSVISFYVHKGGVITLN

SEQ ID NO: 2804411 - protein, 18 aa, Entamoeba invadens
SKISCFNPGCLTCDEESR

SEQ ID NO: 2804412 - protein, 17 aa, Entamoeba invadens
SKKCIPCQTFDANCVTC

SEQ ID NO: 2804413 - protein, 17 aa, Entamoeba invadens
SKKCKIAMPSGGGCAIC

SEQ ID NO: 2804414 - protein, 30 aa, Entamoeba invadens
SKKCLIYSLCGALSFTFCVLLVGIALILLI

SEQ ID NO: 2804415 - protein, 22 aa, Entamoeba invadens
SKKCMICTIGTFSLDSECTECG

SEQ ID NO: 2804416 - protein, 23 aa, Entamoeba invadens
SKKIFRLLFPYFLQSSSIEIIVI

SEQ ID NO: 2804417 - protein, 22 aa, Entamoeba invadens
SKKLEKSIDCDVNSFDCANTEC

SEQ ID NO: 2804418 - protein, 28 aa, Entamoeba invadens
SKKMVAKIKEFLRWEFKRNDKISEWENW

SEQ ID NO: 2804419 - protein, 25 aa, Entamoeba invadens
SKKRYFAIMSQDYFNAITLEYEVIC

SEQ ID NO: 2804420 - protein, 18 aa, Entamoeba invadens
SKLFPVIIFDTFNSRKEN

SEQ ID NO: 2804421 - protein, 19 aa, Entamoeba invadens
SKLIGCSVQLNSKCVQCED

SEQ ID NO: 2804422 - protein, 19 aa, Entamoeba invadens
SKLILMGSFTSKVSKSRDE

SEQ ID NO: 2804423 - protein, 19 aa, Entamoeba invadens
SKLQKLFQCVNSFQTPFTF

SEQ ID NO: 2804424 - protein, 17 aa, Entamoeba invadens
SKLSSGRIDPIQTDEDF

SEQ ID NO: 2804425 - protein, 34 aa, Entamoeba invadens
SKLVRARCRTIMLPKCLASTFVEVFLNIKRSSLW

SEQ ID NO: 2804426 - protein, 25 aa, Entamoeba invadens
SKLYRICFGHNPLSKEIICELDQSD

SEQ ID NO: 2804427 - protein, 25 aa, Entamoeba invadens
SKLYRICFGHNPLSTEIICELDQSD

SEQ ID NO: 2804428 - protein, 22 aa, Entamoeba invadens
SKLYVGDIWSFFTYAQSKMSGQ

SEQ ID NO: 2804429 - protein, 23 aa, Entamoeba invadens
SKMAECIKALALCHNVTPCVTAS

SEQ ID NO: 2804430 - protein, 17 aa, Entamoeba invadens
SKMGVVGFVAWNILTIV

SEQ ID NO: 2804431 - protein, 18 aa, Entamoeba invadens
SKMPNNVHPCYDFNNNST

SEQ ID NO: 2804432 - protein, 21 aa, Entamoeba invadens
SKNCLKATCNETDGTLLWNPI

SEQ ID NO: 2804433 - protein, 21 aa, Entamoeba invadens
SKNDAREYIRINIMALESPYC

SEQ ID NO: 2804434 - protein, 22 aa, Entamoeba invadens
SKNRLFGFVCCYLIQTNKSNYG

SEQ ID NO: 2804435 - protein, 20 aa, Entamoeba invadens
SKNSCIPKGISAEIIAVIVV

SEQ ID NO: 2804436 - protein, 23 aa, Entamoeba invadens
SKNTIKVQFVFKHNIHSTTKYTL

SEQ ID NO: 2804437 - protein, 25 aa, Entamoeba invadens
SKPRNLPCKAFYLKGFNNPLKPIFL

SEQ ID NO: 2804438 - protein, 29 aa, Entamoeba invadens
SKPVWWVIMISCFISVFIVVCVIAVIYFV

SEQ ID NO: 2804439 - protein, 23 aa, Entamoeba invadens
SKQMKIKICIDASRGIQYLHSNG

SEQ ID NO: 2804440 - protein, 23 aa, Entamoeba invadens
SKQRLALLWKTFLVQQVTIKEKL

SEQ ID NO: 2804441 - protein, 22 aa, Entamoeba invadens
SKRANDMFTYYFDGKITVEDFV

SEQ ID NO: 2804442 - protein, 18 aa, Entamoeba invadens
SKRDLWLSAVSFNSPSSW

SEQ ID NO: 2804443 - protein, 20 aa, Entamoeba invadens
SKRQFFCFSYSPDYFNIFFL

SEQ ID NO: 2804444 - protein, 24 aa, Entamoeba invadens
SKSAYCYDCLAGTYADEIGSSTCK

SEQ ID NO: 2804445 - protein, 26 aa, Entamoeba invadens
SKSCSKILTSLCSYSSRYECLKCTTQ

SEQ ID NO: 2804446 - protein, 17 aa, Entamoeba invadens
SKSCVECGINYFINESG

SEQ ID NO: 2804447 - protein, 18 aa, Entamoeba invadens
SKSFSRLGNFATKRFSSK

SEQ ID NO: 2804448 - protein, 20 aa, Entamoeba invadens
SKSICAFCESHFYRNAEGEC

SEQ ID NO: 2804449 - protein, 23 aa, Entamoeba invadens
SKSKFKRFYVHKGGVITLNGMTD

SEQ ID NO: 2804450 - protein, 22 aa, Entamoeba invadens
SKSNKCILCSTQYLLNENYTCE

SEQ ID NO: 2804451 - protein, 17 aa, Entamoeba invadens
SKSPFKGLYGSTPLFQN

SEQ ID NO: 2804452 - protein, 22 aa, Entamoeba invadens
SKSQCFDFSYSTTEISFPNIQT

SEQ ID NO: 2804453 - protein, 26 aa, Entamoeba invadens
SKSSLCLSCQSGFYLGVNNTCISNDL

SEQ ID NO: 2804454 - protein, 24 aa, Entamoeba invadens
SKSVTRLTPFLLFFFTMAILFVFA

SEQ ID NO: 2804455 - protein, 20 aa, Entamoeba invadens
SKTAVWWLILLIVVIVISIL

SEQ ID NO: 2804456 - protein, 17 aa, Entamoeba invadens
SKTCPDEYKSYMGTIYS

SEQ ID NO: 2804457 - protein, 20 aa, Entamoeba invadens
SKTELLSFDMLFFALLFIQS

SEQ ID NO: 2804458 - protein, 23 aa, Entamoeba invadens
SKTETIAGFAYSQFVDFTFETNA

SEQ ID NO: 2804459 - protein, 21 aa, Entamoeba invadens
SKTGLKCLVCDSKYRLDNNIC

SEQ ID NO: 2804460 - protein, 17 aa, Entamoeba invadens
SKTHPLYFVFHSGDYTK

SEQ ID NO: 2804461 - protein, 21 aa, Entamoeba invadens
SKTIFLKWENEISFEKTTCLP

SEQ ID NO: 2804462 - protein, 24 aa, Entamoeba invadens
SKTIKMCLSCAANMISTGTSCVAC

SEQ ID NO: 2804463 - protein, 26 aa, Entamoeba invadens
SKTIWNFSKKFGVNEMFSLFVDYSPL

SEQ ID NO: 2804464 - protein, 25 aa, Entamoeba invadens
SKTKAGSCTLCPNGYYNKVEKQGSC

SEQ ID NO: 2804465 - protein, 19 aa, Entamoeba invadens
SKTLHKWISATFLNYRKEK

SEQ ID NO: 2804466 - protein, 18 aa, Entamoeba invadens
SKTNWALIIPLVVIGILL

SEQ ID NO: 2804467 - protein, 30 aa, Entamoeba invadens
SKVDIFNLGCLFYFIALKRHPFGELIDRPK

SEQ ID NO: 2804468 - protein, 29 aa, Entamoeba invadens
SKVGEELRFKKALDLYKMVHIMERETMWK

SEQ ID NO: 2804469 - protein, 25 aa, Entamoeba invadens
SKVLHWKMVRNLMRTSLSYFDVTPL

SEQ ID NO: 2804470 - protein, 19 aa, Entamoeba invadens
SKVLKEWKNPEFGEWCMEK

SEQ ID NO: 2804471 - protein, 17 aa, Entamoeba invadens
SKVSFLIFHYLKPKFIS

SEQ ID NO: 2804472 - protein, 23 aa, Entamoeba invadens
SKVTTQLAIEWGYYDDAYLTLVR

SEQ ID NO: 2804473 - protein, 20 aa, Entamoeba invadens
SKVVCPVCKKDVFDDNNIGN

SEQ ID NO: 2804474 - protein, 22 aa, Entamoeba invadens
SKVWDVVVGITFITGAMFLQAT

SEQ ID NO: 2804475 - protein, 17 aa, Entamoeba invadens
SKWLLKYILNIPVSAFK

SEQ ID NO: 2804476 - protein, 19 aa, Entamoeba invadens
SKYCSRCADPYYLNNLICQ

SEQ ID NO: 2804477 - protein, 29 aa, Entamoeba invadens
SKYFYIHACLTYLALNHHYSFIILNKKRT

SEQ ID NO: 2804478 - protein, 21 aa, Entamoeba invadens
SKYILCLGIYRALYIANWVFR

SEQ ID NO: 2804479 - protein, 21 aa, Entamoeba invadens
SKYKYSIMGGWTLESSHLYIG

SEQ ID NO: 2804480 - protein, 18 aa, Entamoeba invadens
SKYLCLECSTNCLECSNR

SEQ ID NO: 2804481 - protein, 22 aa, Entamoeba invadens
SKYLPYIKHYFLVTADQVPDFI

SEQ ID NO: 2804482 - protein, 20 aa, Entamoeba invadens
SKYPELPYAIFFNYGTSHFG

SEQ ID NO: 2804483 - protein, 17 aa, Entamoeba invadens
SLADAHCKVGYSDSGCL

SEQ ID NO: 2804484 - protein, 18 aa, Entamoeba invadens
SLAGILVPIENPWSWKAF

SEQ ID NO: 2804485 - protein, 17 aa, Entamoeba invadens
SLAGLLVPIEKPWSWKA

SEQ ID NO: 2804486 - protein, 23 aa, Entamoeba invadens
SLAISAYEVIGWVDCYPKKLFHF

SEQ ID NO: 2804487 - protein, 41 aa, Entamoeba invadens
SLAITMYEVFCWREAYNKTEFKFPWKIVEFVISGKRLQNLE

SEQ ID NO: 2804488 - protein, 19 aa, Entamoeba invadens
SLALSGWYGSLLMMGKGKT

SEQ ID NO: 2804489 - protein, 23 aa, Entamoeba invadens
SLCDVNCLICLQNGCTLCSNTYY

SEQ ID NO: 2804490 - protein, 23 aa, Entamoeba invadens
SLCDVNCLICLQNGCTSCSNTYY

SEQ ID NO: 2804491 - protein, 24 aa, Entamoeba invadens
SLCEIFKKFGDCMDLINYKYHYSD

SEQ ID NO: 2804492 - protein, 18 aa, Entamoeba invadens
SLCKQCSAGSYSSFGSSS

SEQ ID NO: 2804493 - protein, 22 aa, Entamoeba invadens
SLCTKCKNGFVFNAKNECVESH

SEQ ID NO: 2804494 - protein, 18 aa, Entamoeba invadens
SLDVSKLEKLGWRAETKF

SEQ ID NO: 2804495 - protein, 18 aa, Entamoeba invadens
SLECSICSTNNNFLITNT

SEQ ID NO: 2804496 - protein, 20 aa, Entamoeba invadens
SLEELGYWDGVKALRKEFPY

SEQ ID NO: 2804497 - protein, 25 aa, Entamoeba invadens
SLEIYCTNFNYLLMEIQLFDYMSHS

SEQ ID NO: 2804498 - protein, 19 aa, Entamoeba invadens
SLEIYWRNLNYLLMEIQLF

SEQ ID NO: 2804499 - protein, 18 aa, Entamoeba invadens
SLEKLPLKYLDISSNNFS

SEQ ID NO: 2804500 - protein, 20 aa, Entamoeba invadens
SLELVEHFNCILVGVEHDNE

SEQ ID NO: 2804501 - protein, 19 aa, Entamoeba invadens
SLEMTCVRLEIVLISVSNV

SEQ ID NO: 2804502 - protein, 18 aa, Entamoeba invadens
SLENAGVKRIHIMCHSLG

SEQ ID NO: 2804503 - protein, 21 aa, Entamoeba invadens
SLETITFILGEYFFNSLWMIL

SEQ ID NO: 2804504 - protein, 17 aa, Entamoeba invadens
SLFDSFQGMLLFLHNNS

SEQ ID NO: 2804505 - protein, 25 aa, Entamoeba invadens
SLFDSRLMFFFGFALPFTSLSFFCS

SEQ ID NO: 2804506 - protein, 17 aa, Entamoeba invadens
SLFFVFLISPSRGLEGC

SEQ ID NO: 2804507 - protein, 21 aa, Entamoeba invadens
SLFIHSCHLLTALMVKEVRTD

SEQ ID NO: 2804508 - protein, 17 aa, Entamoeba invadens
SLFKFTIFGMSFSFMLV

SEQ ID NO: 2804509 - protein, 24 aa, Entamoeba invadens
SLFLDSRITIFLRVIVPLLIFINM

SEQ ID NO: 2804510 - protein, 19 aa, Entamoeba invadens
SLFLFKLYHNYILFCAIRN

SEQ ID NO: 2804511 - protein, 25 aa, Entamoeba invadens
SLFLIGLVALVFGLLFAYYSTSSPH

SEQ ID NO: 2804512 - protein, 20 aa, Entamoeba invadens
SLFSFYRYANKINMKVKTAD

SEQ ID NO: 2804513 - protein, 22 aa, Entamoeba invadens
SLFSLTFANIFVAKSKISLPQN

SEQ ID NO: 2804514 - protein, 25 aa, Entamoeba invadens
SLFTCCLYKTIMCFKTDQKCSSSSY

SEQ ID NO: 2804515 - protein, 24 aa, Entamoeba invadens
SLGELSVKCNLTLPTGGGCAICND

SEQ ID NO: 2804516 - protein, 23 aa, Entamoeba invadens
SLGEYCFGCCSALNNVVIPSNVT

SEQ ID NO: 2804517 - protein, 21 aa, Entamoeba invadens
SLGGNCKVNFTARTIRDIPFF

SEQ ID NO: 2804518 - protein, 26 aa, Entamoeba invadens
SLGHPILMFVVVLVWYASPKLIKNEM

SEQ ID NO: 2804519 - protein, 19 aa, Entamoeba invadens
SLGKIFLCLVLMWNDPLPI

SEQ ID NO: 2804520 - protein, 20 aa, Entamoeba invadens
SLGKSCFDNCFNLKEIEMPK

SEQ ID NO: 2804521 - protein, 20 aa, Entamoeba invadens
SLGLWYASMIIRGHGGSKNT

SEQ ID NO: 2804522 - protein, 37 aa, Entamoeba invadens
SLGMTIYTTMLWKEPFPKILFPYAWSVADFVTSGQML

SEQ ID NO: 2804523 - protein, 23 aa, Entamoeba invadens
SLGPKCFTLPSAIIVTILSVVMS

SEQ ID NO: 2804524 - protein, 21 aa, Entamoeba invadens
SLGQLSFKWCTSLTSIDISNV

SEQ ID NO: 2804525 - protein, 25 aa, Entamoeba invadens
SLGQRQLICLARALLKNSKILIMDE

SEQ ID NO: 2804526 - protein, 27 aa, Entamoeba invadens
SLGQRQLVCLARALLKGSKILIMDEAT

SEQ ID NO: 2804527 - protein, 26 aa, Entamoeba invadens
SLHADFLIRAIVSYNCNNTVLNQIIK

SEQ ID NO: 2804528 - protein, 19 aa, Entamoeba invadens
SLIALMVMYMFQYNNILTQ

SEQ ID NO: 2804529 - protein, 18 aa, Entamoeba invadens
SLICGGFFMACYPTITGS

SEQ ID NO: 2804530 - protein, 17 aa, Entamoeba invadens
SLICVFQALLKCNAEYF

SEQ ID NO: 2804531 - protein, 21 aa, Entamoeba invadens
SLIDCCVFFTFLCFSNLSAFI

SEQ ID NO: 2804532 - protein, 17 aa, Entamoeba invadens
SLIIKMKIIIDASKGIL

SEQ ID NO: 2804533 - protein, 23 aa, Entamoeba invadens
SLIKEFLIACARADPPILYEEGK

SEQ ID NO: 2804534 - protein, 19 aa, Entamoeba invadens
SLILPSALMIIVFLIVVVV

SEQ ID NO: 2804535 - protein, 23 aa, Entamoeba invadens
SLIPEVPLTFLFYEFILGSKVFN

SEQ ID NO: 2804536 - protein, 23 aa, Entamoeba invadens
SLIPHADKVIILFKGYNYSQLIT

SEQ ID NO: 2804537 - protein, 17 aa, Entamoeba invadens
SLIPKGVLDAMRKVIEE

SEQ ID NO: 2804538 - protein, 19 aa, Entamoeba invadens
SLIQSFRQLFSIGNIHLGN

SEQ ID NO: 2804539 - protein, 17 aa, Entamoeba invadens
SLITAFVNRVWPKEIAP

SEQ ID NO: 2804540 - protein, 17 aa, Entamoeba invadens
SLITLIITFLWLRVKSK

SEQ ID NO: 2804541 - protein, 20 aa, Entamoeba invadens
SLIYICMGLGMIISTFCWGF

SEQ ID NO: 2804542 - protein, 31 aa, Entamoeba invadens
SLKEIYDTMLLRIRINGVIASDKFDFMFNTI

SEQ ID NO: 2804543 - protein, 18 aa, Entamoeba invadens
SLKHFKLKNVKTLPTGVF

SEQ ID NO: 2804544 - protein, 18 aa, Entamoeba invadens
SLKKSGYFECEACNGDFN

SEQ ID NO: 2804545 - protein, 20 aa, Entamoeba invadens
SLKLKILLDVSRGMEYLHIN

SEQ ID NO: 2804546 - protein, 33 aa, Entamoeba invadens
SLKQKSCFVNLFIKGGIVGKLMALFIDDKVGNE

SEQ ID NO: 2804547 - protein, 22 aa, Entamoeba invadens
SLKSLNSGDAFVLDPGKNSGVI

SEQ ID NO: 2804548 - protein, 21 aa, Entamoeba invadens
SLKWCKIENTIICVYTNVGCP

SEQ ID NO: 2804549 - protein, 18 aa, Entamoeba invadens
SLLALILCLTRMSPESPV

SEQ ID NO: 2804550 - protein, 18 aa, Entamoeba invadens
SLLAYAILGSFFEWKIPK

SEQ ID NO: 2804551 - protein, 20 aa, Entamoeba invadens
SLLCSFKTTEKCDATYYVKE

SEQ ID NO: 2804552 - protein, 18 aa, Entamoeba invadens
SLLCSFKTTEKCDKTYYV

SEQ ID NO: 2804553 - protein, 26 aa, Entamoeba invadens
SLLDKLRGPYIVSFVGACYLPTKMCI

SEQ ID NO: 2804554 - protein, 23 aa, Entamoeba invadens
SLLELYDGMRLFLYDNSSLYFDV

SEQ ID NO: 2804555 - protein, 17 aa, Entamoeba invadens
SLLFLYYRKLYLLIYQL

SEQ ID NO: 2804556 - protein, 18 aa, Entamoeba invadens
SLLFPFPPTQKVFPILPY

SEQ ID NO: 2804557 - protein, 17 aa, Entamoeba invadens
SLLFWAYLCSIVTLSGW

SEQ ID NO: 2804558 - protein, 24 aa, Entamoeba invadens
SLLGMVVGCLVGFTMTLQIILFTQ

SEQ ID NO: 2804559 - protein, 26 aa, Entamoeba invadens
SLLHLFGEWNWWPKRYDIKIELDGGV

SEQ ID NO: 2804560 - protein, 23 aa, Entamoeba invadens
SLLLEGWWLFIIIIGVIIVSLVW

SEQ ID NO: 2804561 - protein, 18 aa, Entamoeba invadens
SLLLFFTRCLSLKWCGNG

SEQ ID NO: 2804562 - protein, 18 aa, Entamoeba invadens
SLLLPAIVNILGELNWFP

SEQ ID NO: 2804563 - protein, 26 aa, Entamoeba invadens
SLLNMFPVFFSKRGFIPCIKKCQNWA

SEQ ID NO: 2804564 - protein, 18 aa, Entamoeba invadens
SLLQYNDFISVIQLSADL

SEQ ID NO: 2804565 - protein, 20 aa, Entamoeba invadens
SLLRRMVSTLGPIPDTMLEK

SEQ ID NO: 2804566 - protein, 19 aa, Entamoeba invadens
SLLSYEICLSGEALSYILT

SEQ ID NO: 2804567 - protein, 23 aa, Entamoeba invadens
SLLVKSCTSLKLASKLSNLIKNA

SEQ ID NO: 2804568 - protein, 26 aa, Entamoeba invadens
SLLVLEFITLTPFITITWVKGSQEEL

SEQ ID NO: 2804569 - protein, 31 aa, Entamoeba invadens
SLMLPVMALGLFWFFYVFKIYMKYAKQLLRL

SEQ ID NO: 2804570 - protein, 21 aa, Entamoeba invadens
SLMVRWRIYFRNWGMCYSCIG

SEQ ID NO: 2804571 - protein, 22 aa, Entamoeba invadens
SLNCNICLPGTYAHATNKKCMQ

SEQ ID NO: 2804572 - protein, 17 aa, Entamoeba invadens
SLNFKFIKRQAMAERTE

SEQ ID NO: 2804573 - protein, 20 aa, Entamoeba invadens
SLNGGFAFGGADKMKEVLNI

SEQ ID NO: 2804574 - protein, 20 aa, Entamoeba invadens
SLNGICVLCHSNCLTCDTQS

SEQ ID NO: 2804575 - protein, 19 aa, Entamoeba invadens
SLNKEFFLSENFCGKIEEW

SEQ ID NO: 2804576 - protein, 21 aa, Entamoeba invadens
SLNLTHTWNSLSFGDNFPGMI

SEQ ID NO: 2804577 - protein, 25 aa, Entamoeba invadens
SLNTCTLCYSGYYLQNGACNSCSQK

SEQ ID NO: 2804578 - protein, 19 aa, Entamoeba invadens
SLNTLRVFLLISKDCNTAF

SEQ ID NO: 2804579 - protein, 26 aa, Entamoeba invadens
SLNYLSPRLNEFFGHKLDFSNIGVLG

SEQ ID NO: 2804580 - protein, 25 aa, Entamoeba invadens
SLPPLKVVAFEGIFGVIETVCVMCP

SEQ ID NO: 2804581 - protein, 21 aa, Entamoeba invadens
SLPRWLHDLFVSVITSDSPEG

SEQ ID NO: 2804582 - protein, 24 aa, Entamoeba invadens
SLPSKRVNLGFFVFIGGQVLMATG

SEQ ID NO: 2804583 - protein, 20 aa, Entamoeba invadens
SLPWNCYDPTFLFSAPLPSN

SEQ ID NO: 2804584 - protein, 20 aa, Entamoeba invadens
SLQCSTCADGTYANTTGSTS

SEQ ID NO: 2804585 - protein, 18 aa, Entamoeba invadens
SLQCSTCADGTYASTTGS

SEQ ID NO: 2804586 - protein, 18 aa, Entamoeba invadens
SLQIGSCFLNCGIFDSNI

SEQ ID NO: 2804587 - protein, 18 aa, Entamoeba invadens
SLQQLKLNKLFRAEQQHV

SEQ ID NO: 2804588 - protein, 17 aa, Entamoeba invadens
SLQTYIGVMTFQSFSTT

SEQ ID NO: 2804589 - protein, 21 aa, Entamoeba invadens
SLRHPCVLQFFGSGMDEKFLL

SEQ ID NO: 2804590 - protein, 24 aa, Entamoeba invadens
SLRREILLRIVIGQKIMLLLLLKH

SEQ ID NO: 2804591 - protein, 18 aa, Entamoeba invadens
SLSCLYSKVFAFTTRYEY

SEQ ID NO: 2804592 - protein, 26 aa, Entamoeba invadens
SLSGNMPFHVQGDFLARSVVVSRGGH

SEQ ID NO: 2804593 - protein, 25 aa, Entamoeba invadens
SLSGRCLTCAFGNYMKDDLTYCIHG

SEQ ID NO: 2804594 - protein, 18 aa, Entamoeba invadens
SLSKFFAEWKNYYCMPPT

SEQ ID NO: 2804595 - protein, 19 aa, Entamoeba invadens
SLSKIWGKYLINLELKVKL

SEQ ID NO: 2804596 - protein, 25 aa, Entamoeba invadens
SLSLALQWCWERGVIQCFSDNVTNC

SEQ ID NO: 2804597 - protein, 20 aa, Entamoeba invadens
SLSLCAGLLLGIGGLFSIII

SEQ ID NO: 2804598 - protein, 24 aa, Entamoeba invadens
SLSMKGKVVSFLDFVGRKLVKSFV

SEQ ID NO: 2804599 - protein, 24 aa, Entamoeba invadens
SLSPRLAIQNAFQFGLIVASAVII

SEQ ID NO: 2804600 - protein, 24 aa, Entamoeba invadens
SLSRLSSDILDHFVLQHCEETFVR

SEQ ID NO: 2804601 - protein, 18 aa, Entamoeba invadens
SLTLARLVQVDFSSVNET

SEQ ID NO: 2804602 - protein, 27 aa, Entamoeba invadens
SLTPILPCFLCDGGLMILSRMPLLNRD

SEQ ID NO: 2804603 - protein, 25 aa, Entamoeba invadens
SLTTEWKIDLTLKLLVVVSLDRFGD

SEQ ID NO: 2804604 - protein, 18 aa, Entamoeba invadens
SLTVCSVLMVNIWSHDVG

SEQ ID NO: 2804605 - protein, 17 aa, Entamoeba invadens
SLTVYRDGLTIATLATF

SEQ ID NO: 2804606 - protein, 18 aa, Entamoeba invadens
SLVCCEFFVHPQENGKLL

SEQ ID NO: 2804607 - protein, 18 aa, Entamoeba invadens
SLVDEIMSTLGFTKTPLN

SEQ ID NO: 2804608 - protein, 17 aa, Entamoeba invadens
SLVFLLRYFELNSARQE

SEQ ID NO: 2804609 - protein, 21 aa, Entamoeba invadens
SLVFLRPGKAIEFVVTVHPMC

SEQ ID NO: 2804610 - protein, 22 aa, Entamoeba invadens
SLVSCLRCKDAYYFNSSTNRCE

SEQ ID NO: 2804611 - protein, 20 aa, Entamoeba invadens
SLVSCLRCKNSYYFNSSTNK

SEQ ID NO: 2804612 - protein, 25 aa, Entamoeba invadens
SLVSLKPGFACEFEIFIKPLCTCTT

SEQ ID NO: 2804613 - protein, 29 aa, Entamoeba invadens
SLVTYCAAPMPFIIGCLKNLYPNVQKECG

SEQ ID NO: 2804614 - protein, 19 aa, Entamoeba invadens
SLVVILFLLVFAILASGYV

SEQ ID NO: 2804615 - protein, 24 aa, Entamoeba invadens
SLYLACAEAFLLFFIITRFPQNNH

SEQ ID NO: 2804616 - protein, 19 aa, Entamoeba invadens
SLYMNVDVVLLCFSISNKP

SEQ ID NO: 2804617 - protein, 19 aa, Entamoeba invadens
SLYRAATLSLVLSYQTETK

SEQ ID NO: 2804618 - protein, 22 aa, Entamoeba invadens
SLYSHYKYVFLLIVGDTADLFM

SEQ ID NO: 2804619 - protein, 18 aa, Entamoeba invadens
SLYSTMIDECWKQKPEAR

SEQ ID NO: 2804620 - protein, 39 aa, Entamoeba invadens
SMCSKCSGWYIPGENGLYCKYKVPVWFIIVIIIVILLFI

SEQ ID NO: 2804621 - protein, 19 aa, Entamoeba invadens
SMCTLIVIVVLKIQNDIQT

SEQ ID NO: 2804622 - protein, 21 aa, Entamoeba invadens
SMCWAFSTIFQLEYAYNKKLA

SEQ ID NO: 2804623 - protein, 18 aa, Entamoeba invadens
SMDIKRSSKIFGKFSTKP

SEQ ID NO: 2804624 - protein, 23 aa, Entamoeba invadens
SMFEIYCAGLFVFVMNILLICWH

SEQ ID NO: 2804625 - protein, 20 aa, Entamoeba invadens
SMFLAFAMLYIGSVGSTKKE

SEQ ID NO: 2804626 - protein, 18 aa, Entamoeba invadens
SMFLAFSLLYLGAEGETK

SEQ ID NO: 2804627 - protein, 20 aa, Entamoeba invadens
SMFPFQFSTGTGYLLSNNKL

SEQ ID NO: 2804628 - protein, 34 aa, Entamoeba invadens
SMGIAIYEIITWKFPYQNMRSWDVADFVASGKRM

SEQ ID NO: 2804629 - protein, 19 aa, Entamoeba invadens
SMHGWSVYNIYSEFSRLKL

SEQ ID NO: 2804630 - protein, 20 aa, Entamoeba invadens
SMIFVFKPFVWVVSVTPLPY

SEQ ID NO: 2804631 - protein, 17 aa, Entamoeba invadens
SMINERMYLVFKTKFND

SEQ ID NO: 2804632 - protein, 17 aa, Entamoeba invadens
SMINERMYLVFKTTFND

SEQ ID NO: 2804633 - protein, 19 aa, Entamoeba invadens
SMIVCPPTLTGHWKHEIEA

SEQ ID NO: 2804634 - protein, 18 aa, Entamoeba invadens
SMIYSMIIDMCVNKYSCL

SEQ ID NO: 2804635 - protein, 26 aa, Entamoeba invadens
SMKYKRPADIYSFAITMYECFIWGVA

SEQ ID NO: 2804636 - protein, 20 aa, Entamoeba invadens
SMLDKFRCDYIICMVTEFAE

SEQ ID NO: 2804637 - protein, 20 aa, Entamoeba invadens
SMLDKFRCDYIIHFYGACVI

SEQ ID NO: 2804638 - protein, 20 aa, Entamoeba invadens
SMLDKFRCEYIVHFYGAVFV

SEQ ID NO: 2804639 - protein, 20 aa, Entamoeba invadens
SMLDKFRSPFIVHFFGAVFI

SEQ ID NO: 2804640 - protein, 21 aa, Entamoeba invadens
SMLIVCPHCLQRDSNEEWYTL

SEQ ID NO: 2804641 - protein, 17 aa, Entamoeba invadens
SMLRIPKSMQVEDTQLD

SEQ ID NO: 2804642 - protein, 31 aa, Entamoeba invadens
SMMCSGVISLICFFSAFFFDQVLLYAVSVLS

SEQ ID NO: 2804643 - protein, 27 aa, Entamoeba invadens
SMNCEVSWDFGCLRCSESFYSSKYKCE

SEQ ID NO: 2804644 - protein, 24 aa, Entamoeba invadens
SMNDGKGFCGYKYKANAPENTKVE

SEQ ID NO: 2804645 - protein, 24 aa, Entamoeba invadens
SMPKARIVTILYNFVPHNCPIDIR

SEQ ID NO: 2804646 - protein, 17 aa, Entamoeba invadens
SMRSVFTYLPYIKNYFI

SEQ ID NO: 2804647 - protein, 22 aa, Entamoeba invadens
SMSCGIQDMYLSTNVQKMVLSA

SEQ ID NO: 2804648 - protein, 19 aa, Entamoeba invadens
SMSGWSVVVVGFLRQNEVV

SEQ ID NO: 2804649 - protein, 23 aa, Entamoeba invadens
SMSLLNFMHLVGIYYYGKYKPDE

SEQ ID NO: 2804650 - protein, 17 aa, Entamoeba invadens
SMSWKEYKKSVRIENTI

SEQ ID NO: 2804651 - protein, 18 aa, Entamoeba invadens
SMTFCAMMFLSLLLCGEF

SEQ ID NO: 2804652 - protein, 17 aa, Entamoeba invadens
SMVACGYTIPKMSMADL

SEQ ID NO: 2804653 - protein, 25 aa, Entamoeba invadens
SMVVCFKYFPIIVIVLFGIVLIITG

SEQ ID NO: 2804654 - protein, 27 aa, Entamoeba invadens
SMYFVICGCFLFTIVLWVFVICNKNEI

SEQ ID NO: 2804655 - protein, 25 aa, Entamoeba invadens
SNAELEAVCKVMSLGGDRCYECQDG

SEQ ID NO: 2804656 - protein, 19 aa, Entamoeba invadens
SNATGILSIISYAIIGILI

SEQ ID NO: 2804657 - protein, 25 aa, Entamoeba invadens
SNATIRGGATLTLMVGRSRFKSIVF

SEQ ID NO: 2804658 - protein, 26 aa, Entamoeba invadens
SNAVLSRISSLQIFKAVRDIRTRSAL

SEQ ID NO: 2804659 - protein, 19 aa, Entamoeba invadens
SNCCGWKAFNPSACAAPNI

SEQ ID NO: 2804660 - protein, 18 aa, Entamoeba invadens
SNCEVCDFGISIGTSCFI

SEQ ID NO: 2804661 - protein, 22 aa, Entamoeba invadens
SNCFKCDAGFSRFCSECKTGYY

SEQ ID NO: 2804662 - protein, 20 aa, Entamoeba invadens
SNCHICPVGTYANSANNKCQ

SEQ ID NO: 2804663 - protein, 17 aa, Entamoeba invadens
SNCKIPFLNDIGCVECD

SEQ ID NO: 2804664 - protein, 24 aa, Entamoeba invadens
SNCKLCTQNSCEKCFNEYEVGVDG

SEQ ID NO: 2804665 - protein, 19 aa, Entamoeba invadens
SNCKTCALTSPENSCDSTC

SEQ ID NO: 2804666 - protein, 19 aa, Entamoeba invadens
SNCLSCKTGTYLDNYQCLS

SEQ ID NO: 2804667 - protein, 18 aa, Entamoeba invadens
SNCQKCVITPAGGEVVNE

SEQ ID NO: 2804668 - protein, 28 aa, Entamoeba invadens
SNCSLTNGVNCIKCLNGELANNCETCKD

SEQ ID NO: 2804669 - protein, 19 aa, Entamoeba invadens
SNCTICPAGTYSNTGSTSC

SEQ ID NO: 2804670 - protein, 19 aa, Entamoeba invadens
SNCYKCVDLYIKENTSCVY

SEQ ID NO: 2804671 - protein, 28 aa, Entamoeba invadens
SNDEMKWVLNCLEKIMLDITHSQLNHIA

SEQ ID NO: 2804672 - protein, 22 aa, Entamoeba invadens
SNDKGFIVIVVFIIFGIVLIVV

SEQ ID NO: 2804673 - protein, 21 aa, Entamoeba invadens
SNDKWRVLVFDDFCSQLLSMY

SEQ ID NO: 2804674 - protein, 26 aa, Entamoeba invadens
SNDVKWCFNNSVLKCVLHSEECLYNS

SEQ ID NO: 2804675 - protein, 18 aa, Entamoeba invadens
SNDYLGIMASVYRYLKET

SEQ ID NO: 2804676 - protein, 17 aa, Entamoeba invadens
SNECKFCDYGCNSCDKS

SEQ ID NO: 2804677 - protein, 19 aa, Entamoeba invadens
SNECLACKDGYFNIPSECK

SEQ ID NO: 2804678 - protein, 19 aa, Entamoeba invadens
SNECLACKDGYFNIPSEGK

SEQ ID NO: 2804679 - protein, 19 aa, Entamoeba invadens
SNECLECNDFTYANQTGSS

SEQ ID NO: 2804680 - protein, 18 aa, Entamoeba invadens
SNECLVCKDGYFNIPSES

SEQ ID NO: 2804681 - protein, 24 aa, Entamoeba invadens
SNECVGCGVSISCLDSFVKYTDTW

SEQ ID NO: 2804682 - protein, 23 aa, Entamoeba invadens
SNEIRLKIKMKIIIDTSKGILYL

SEQ ID NO: 2804683 - protein, 20 aa, Entamoeba invadens
SNEKCLKCEDGYTLENGGCK

SEQ ID NO: 2804684 - protein, 17 aa, Entamoeba invadens
SNFACEFSVFVKPLCSC

SEQ ID NO: 2804685 - protein, 22 aa, Entamoeba invadens
SNFAFDGCVNFKGFSNEIESFA

SEQ ID NO: 2804686 - protein, 20 aa, Entamoeba invadens
SNFCHLFNISFCKISSNKMC

SEQ ID NO: 2804687 - protein, 17 aa, Entamoeba invadens
SNFDFFFPFLNDSYSVA

SEQ ID NO: 2804688 - protein, 17 aa, Entamoeba invadens
SNFKYSLNLKGVIESKC

SEQ ID NO: 2804689 - protein, 20 aa, Entamoeba invadens
SNFLCIKCPAGTYKNEIGNS

SEQ ID NO: 2804690 - protein, 40 aa, Entamoeba invadens
SNFSPIFAISNLRIDDMVLRVGGLVQFFSILNFGFDSDKY

SEQ ID NO: 2804691 - protein, 26 aa, Entamoeba invadens
SNFSRKCLICNTGFYPNDSGKCVSCA

SEQ ID NO: 2804692 - protein, 21 aa, Entamoeba invadens
SNGCSIKLFVKDGTSVTLKKA

SEQ ID NO: 2804693 - protein, 21 aa, Entamoeba invadens
SNGECLACPEMTYTDKEASPY

SEQ ID NO: 2804694 - protein, 18 aa, Entamoeba invadens
SNGFKAIFTHPLLLSIVF

SEQ ID NO: 2804695 - protein, 21 aa, Entamoeba invadens
SNGIISYGVFETCLKQGWLHL

SEQ ID NO: 2804696 - protein, 21 aa, Entamoeba invadens
SNGKCIACKDGFYYPSVDGFC

SEQ ID NO: 2804697 - protein, 20 aa, Entamoeba invadens
SNGKCVERLLSIRLTTFQNT

SEQ ID NO: 2804698 - protein, 22 aa, Entamoeba invadens
SNGKFIRKEECDGGVNCNITCQ

SEQ ID NO: 2804699 - protein, 18 aa, Entamoeba invadens
SNGNCFSCITGFRQNGYY

SEQ ID NO: 2804700 - protein, 23 aa, Entamoeba invadens
SNGNCNLCPIGTSLSNGKCTSCS

SEQ ID NO: 2804701 - protein, 24 aa, Entamoeba invadens
SNGNCNLCPIGTSLSNGKCTSCSE

SEQ ID NO: 2804702 - protein, 17 aa, Entamoeba invadens
SNGNDCYKCIDGKEKRD

SEQ ID NO: 2804703 - protein, 32 aa, Entamoeba invadens
SNGPRGGNIPTWKILIGLAYRMVVFPVVAWVA

SEQ ID NO: 2804704 - protein, 24 aa, Entamoeba invadens
SNGVFKLFVGYSVSEEIKAKLFGE

SEQ ID NO: 2804705 - protein, 24 aa, Entamoeba invadens
SNGYCSKCINGLIQIDSTSLNCQT

SEQ ID NO: 2804706 - protein, 18 aa, Entamoeba invadens
SNGYRPGMDNVRREMITE

SEQ ID NO: 2804707 - protein, 18 aa, Entamoeba invadens
SNIAMKILSGDVLTNKSE

SEQ ID NO: 2804708 - protein, 25 aa, Entamoeba invadens
SNIITIKVSPTFQVRAQDCILNVET

SEQ ID NO: 2804709 - protein, 17 aa, Entamoeba invadens
SNIKFIPLQGGVCVSID

SEQ ID NO: 2804710 - protein, 19 aa, Entamoeba invadens
SNIKSIIVSTPFIGKQFEI

SEQ ID NO: 2804711 - protein, 26 aa, Entamoeba invadens
SNIMQCLSEVLAPFFISSFLDNNIFS

SEQ ID NO: 2804712 - protein, 25 aa, Entamoeba invadens
SNINALPALCHLFLSSNDTIANIAL

SEQ ID NO: 2804713 - protein, 18 aa, Entamoeba invadens
SNISFPYTISSNLISNKN

SEQ ID NO: 2804714 - protein, 20 aa, Entamoeba invadens
SNKCIKCLPMYIKVEKNTID

SEQ ID NO: 2804715 - protein, 18 aa, Entamoeba invadens
SNKCLKCDSTCYNCTGSA

SEQ ID NO: 2804716 - protein, 19 aa, Entamoeba invadens
SNKCTSCINSRVLIANGSC

SEQ ID NO: 2804717 - protein, 20 aa, Entamoeba invadens
SNKCTSCVDSLVLLANGSCV

SEQ ID NO: 2804718 - protein, 26 aa, Entamoeba invadens
SNKDLRLSFFNEILRNIKFIKYNRWE

SEQ ID NO: 2804719 - protein, 22 aa, Entamoeba invadens
SNKEVLEMASLYDCLYSRRDVY

SEQ ID NO: 2804720 - protein, 25 aa, Entamoeba invadens
SNKFACLQCFPLFYTNNNNTTTIEN

SEQ ID NO: 2804721 - protein, 20 aa, Entamoeba invadens
SNKFFAFAIEESFNNTWITG

SEQ ID NO: 2804722 - protein, 17 aa, Entamoeba invadens
SNKFKSATISRSLKLYN

SEQ ID NO: 2804723 - protein, 18 aa, Entamoeba invadens
SNKLYGCYSCEYTSEAAL

SEQ ID NO: 2804724 - protein, 19 aa, Entamoeba invadens
SNKSLLSLMRIKLEADVLY

SEQ ID NO: 2804725 - protein, 18 aa, Entamoeba invadens
SNKTCAKCNTSLCQTCYS

SEQ ID NO: 2804726 - protein, 29 aa, Entamoeba invadens
SNKTCSKCDTSLCQTCYSLTYCLTCSVNK

SEQ ID NO: 2804727 - protein, 19 aa, Entamoeba invadens
SNKVCSAAVFSNEYTACCL

SEQ ID NO: 2804728 - protein, 27 aa, Entamoeba invadens
SNKYIYVFTCMTILVSFFFGKTTLLPL

SEQ ID NO: 2804729 - protein, 20 aa, Entamoeba invadens
SNKYPNIVFNFDVIGEVVIN

SEQ ID NO: 2804730 - protein, 21 aa, Entamoeba invadens
SNKYTCLQCFPLYNTNNNITN

SEQ ID NO: 2804731 - protein, 20 aa, Entamoeba invadens
SNLCTRCLIGYKVSPSNPSV

SEQ ID NO: 2804732 - protein, 24 aa, Entamoeba invadens
SNLGCPICTSGYYKDGLDCTQCDV

SEQ ID NO: 2804733 - protein, 17 aa, Entamoeba invadens
SNLILKNHFCITPECLS

SEQ ID NO: 2804734 - protein, 17 aa, Entamoeba invadens
SNLKCLHATLTADAQDL

SEQ ID NO: 2804735 - protein, 25 aa, Entamoeba invadens
SNLLKPKFLPLVPLLFLNDDKAETS

SEQ ID NO: 2804736 - protein, 22 aa, Entamoeba invadens
SNLLTKCGRRAILKTSIDTLCD

SEQ ID NO: 2804737 - protein, 20 aa, Entamoeba invadens
SNLRNCFTKKFSTGHPKWTK

SEQ ID NO: 2804738 - protein, 19 aa, Entamoeba invadens
SNLSSLCNSFFILETGIKE

SEQ ID NO: 2804739 - protein, 21 aa, Entamoeba invadens
SNMCINCFELIQNCQLCKYNN

SEQ ID NO: 2804740 - protein, 25 aa, Entamoeba invadens
SNMKRKWYFCPRKVSKTNWVESVDN

SEQ ID NO: 2804741 - protein, 25 aa, Entamoeba invadens
SNNCLTCRPGLAVRYGTCYDCQITN

SEQ ID NO: 2804742 - protein, 18 aa, Entamoeba invadens
SNNEIVWYNILNITTASS

SEQ ID NO: 2804743 - protein, 18 aa, Entamoeba invadens
SNNLCVTCECAKGKLGNG

SEQ ID NO: 2804744 - protein, 25 aa, Entamoeba invadens
SNNNIKNRCELSCTSEGVCDFIQKD

SEQ ID NO: 2804745 - protein, 24 aa, Entamoeba invadens
SNQARCFYCQCSYIDGSASLVMFA

SEQ ID NO: 2804746 - protein, 24 aa, Entamoeba invadens
SNQARCFYCQCSYVDGTASLVMFA

SEQ ID NO: 2804747 - protein, 24 aa, Entamoeba invadens
SNQFKFPWKIAEFVTGGNRLKRKQ

SEQ ID NO: 2804748 - protein, 18 aa, Entamoeba invadens
SNQWEYNGILSLPITYLI

SEQ ID NO: 2804749 - protein, 26 aa, Entamoeba invadens
SNRCRKCDNGYLLKEMKCVTVDNCVD

SEQ ID NO: 2804750 - protein, 21 aa, Entamoeba invadens
SNRETICTVSGYFTMSSSSNT

SEQ ID NO: 2804751 - protein, 23 aa, Entamoeba invadens
SNRIYVGECSFALSKCTAVDTVE

SEQ ID NO: 2804752 - protein, 21 aa, Entamoeba invadens
SNRLNLSWTCWGVSRVVCRTL

SEQ ID NO: 2804753 - protein, 30 aa, Entamoeba invadens
SNSATFRPEIFCIRESVMLLNEGNFYEIEA

SEQ ID NO: 2804754 - protein, 19 aa, Entamoeba invadens
SNSCSQCSEGFNFDYISNT

SEQ ID NO: 2804755 - protein, 20 aa, Entamoeba invadens
SNSKCSKCTFWHSPNDNGTF

SEQ ID NO: 2804756 - protein, 21 aa, Entamoeba invadens
SNSKCSRCTFWHSPNDNGTFC

SEQ ID NO: 2804757 - protein, 21 aa, Entamoeba invadens
SNSKCSRCTFWHSTNDNGTLC

SEQ ID NO: 2804758 - protein, 21 aa, Entamoeba invadens
SNSKCSRCTFWHSTNGNGTLC

SEQ ID NO: 2804759 - protein, 20 aa, Entamoeba invadens
SNSPLSFLLGDKIVANMECL

SEQ ID NO: 2804760 - protein, 19 aa, Entamoeba invadens
SNTEFPCEIDIEKLKKFDG

SEQ ID NO: 2804761 - protein, 26 aa, Entamoeba invadens
SNTFKGISAYVFWLVYGLYQSVVLFV

SEQ ID NO: 2804762 - protein, 24 aa, Entamoeba invadens
SNTGCIRCNPGYFLNSMKLCEKCQ

SEQ ID NO: 2804763 - protein, 25 aa, Entamoeba invadens
SNTIGRLVFYLALLEPIFLEKSVED

SEQ ID NO: 2804764 - protein, 24 aa, Entamoeba invadens
SNTKVIFCKNSFYLNYEENNCEKC

SEQ ID NO: 2804765 - protein, 24 aa, Entamoeba invadens
SNTKVIFCKNSFYLNYEENVCENC

SEQ ID NO: 2804766 - protein, 19 aa, Entamoeba invadens
SNTKYGVVIGIPIALIIII

SEQ ID NO: 2804767 - protein, 32 aa, Entamoeba invadens
SNTQCKFVILLKISQIPFRFSCSTESECDAWN

SEQ ID NO: 2804768 - protein, 22 aa, Entamoeba invadens
SNTRWCYHELIVDKLINNFKDF

SEQ ID NO: 2804769 - protein, 18 aa, Entamoeba invadens
SNTSCVVCKDGYFVDTNG

SEQ ID NO: 2804770 - protein, 27 aa, Entamoeba invadens
SNTVIRADYFFQFGFSEFNKTYNIIDQ

SEQ ID NO: 2804771 - protein, 20 aa, Entamoeba invadens
SNTYLPWSITFSINAAGPGL

SEQ ID NO: 2804772 - protein, 22 aa, Entamoeba invadens
SNVASNFSFRGRSLVILASSQK

SEQ ID NO: 2804773 - protein, 19 aa, Entamoeba invadens
SNVCTKCPVGYYANVVGSS

SEQ ID NO: 2804774 - protein, 17 aa, Entamoeba invadens
SNVFFEFIALAFLFVAM

SEQ ID NO: 2804775 - protein, 29 aa, Entamoeba invadens
SNVFKIPVFVKKHCAELNISGSGVLVTEE

SEQ ID NO: 2804776 - protein, 19 aa, Entamoeba invadens
SNYALKVLIGKEVLIDNVI

SEQ ID NO: 2804777 - protein, 23 aa, Entamoeba invadens
SNYEYISLCPNSTVITDLSTASY

SEQ ID NO: 2804778 - protein, 23 aa, Entamoeba invadens
SNYFKLKIMIDALRGIEYLHLNG

SEQ ID NO: 2804779 - protein, 25 aa, Entamoeba invadens
SPDDMYMGHCFRIVSNVLACSTILT

SEQ ID NO: 2804780 - protein, 26 aa, Entamoeba invadens
SPDFLRKCKVCAIGFYPDETSGKCVA

SEQ ID NO: 2804781 - protein, 27 aa, Entamoeba invadens
SPDFTRKCVICVSGYFVFENRCKKCDD

SEQ ID NO: 2804782 - protein, 21 aa, Entamoeba invadens
SPECTTCYSPYVVENRKCVLS

SEQ ID NO: 2804783 - protein, 21 aa, Entamoeba invadens
SPEIVGMLFLFLSSLTRPLFG

SEQ ID NO: 2804784 - protein, 25 aa, Entamoeba invadens
SPESPVDFPGLFPYLLQNNPSSESF

SEQ ID NO: 2804785 - protein, 18 aa, Entamoeba invadens
SPETFKLLTEKVNEFDLE

SEQ ID NO: 2804786 - protein, 24 aa, Entamoeba invadens
SPFFARTQLEAGLVIFFVLVPLVR

SEQ ID NO: 2804787 - protein, 34 aa, Entamoeba invadens
SPFLERFANYPVYFIEAIKLYLLVSESVNQLNCG

SEQ ID NO: 2804788 - protein, 25 aa, Entamoeba invadens
SPFLKGCEPACGICRDGFICSSLGK

SEQ ID NO: 2804789 - protein, 19 aa, Entamoeba invadens
SPFYFCLKTLTLLVLLSLL

SEQ ID NO: 2804790 - protein, 25 aa, Entamoeba invadens
SPHIVKLPIEFSTQFFADNLDSNEI

SEQ ID NO: 2804791 - protein, 23 aa, Entamoeba invadens
SPHRIKLQFSVMDNCDYYSIRTL

SEQ ID NO: 2804792 - protein, 18 aa, Entamoeba invadens
SPIAEGAMGKVFIGNYRS

SEQ ID NO: 2804793 - protein, 18 aa, Entamoeba invadens
SPIEIESFMNLRFKSKSS

SEQ ID NO: 2804794 - protein, 21 aa, Entamoeba invadens
SPIEMKGILAVFPVIVTTLII

SEQ ID NO: 2804795 - protein, 28 aa, Entamoeba invadens
SPIETIRYLYIFGRRGAGILTEPCLVIN

SEQ ID NO: 2804796 - protein, 21 aa, Entamoeba invadens
SPISLSTMKAIDCGNPSSHFY

SEQ ID NO: 2804797 - protein, 18 aa, Entamoeba invadens
SPKFAVTGTLSFYNSTFS

SEQ ID NO: 2804798 - protein, 23 aa, Entamoeba invadens
SPKMFLRKSLSPIMGLKNHETES

SEQ ID NO: 2804799 - protein, 24 aa, Entamoeba invadens
SPKYRFYFEPQIVYLSPKRNKEIT

SEQ ID NO: 2804800 - protein, 18 aa, Entamoeba invadens
SPLANSLKGSFNSEDDPS

SEQ ID NO: 2804801 - protein, 21 aa, Entamoeba invadens
SPLECNSCPTGFFKSSESGCG

SEQ ID NO: 2804802 - protein, 18 aa, Entamoeba invadens
SPLFYIIGLLVCMLIWSR

SEQ ID NO: 2804803 - protein, 17 aa, Entamoeba invadens
SPLKYEDIFPLDLSEKP

SEQ ID NO: 2804804 - protein, 25 aa, Entamoeba invadens
SPLNMKHCVTELVNMFSALVMKLSD

SEQ ID NO: 2804805 - protein, 26 aa, Entamoeba invadens
SPLPFCVVFGLPLKFLIIPFIISAGF

SEQ ID NO: 2804806 - protein, 24 aa, Entamoeba invadens
SPLQWKQHWCDLFRDEMLIHKDAN

SEQ ID NO: 2804807 - protein, 23 aa, Entamoeba invadens
SPLRIDGSVYFKGQIVIESTEYV

SEQ ID NO: 2804808 - protein, 19 aa, Entamoeba invadens
SPMPFSMSINMLGGVALLL

SEQ ID NO: 2804809 - protein, 20 aa, Entamoeba invadens
SPNECSICRTPAYQSDCHRC

SEQ ID NO: 2804810 - protein, 19 aa, Entamoeba invadens
SPNELKKLLQLEGYQNVIK

SEQ ID NO: 2804811 - protein, 17 aa, Entamoeba invadens
SPNGCYFYYNADGVLCC

SEQ ID NO: 2804812 - protein, 18 aa, Entamoeba invadens
SPNHCIFVLTGPVGDDGE

SEQ ID NO: 2804813 - protein, 23 aa, Entamoeba invadens
SPPLICPPGYFYVKGECVQSTHW

SEQ ID NO: 2804814 - protein, 19 aa, Entamoeba invadens
SPPSCVSCMENCYSCTTSS

SEQ ID NO: 2804815 - protein, 22 aa, Entamoeba invadens
SPPWNCFNPEIISDIQLPQNLT

SEQ ID NO: 2804816 - protein, 22 aa, Entamoeba invadens
SPQCFLRPFITNIVAQYLLCVF

SEQ ID NO: 2804817 - protein, 23 aa, Entamoeba invadens
SPQSPCVYGYHFSSKMPNNVHPC

SEQ ID NO: 2804818 - protein, 19 aa, Entamoeba invadens
SPRRGCLRETCGNKHLDEG

SEQ ID NO: 2804819 - protein, 19 aa, Entamoeba invadens
SPSGCLRCEDGYFLLSTWC

SEQ ID NO: 2804820 - protein, 20 aa, Entamoeba invadens
SPSKCDKCVLGFYPETNMCK

SEQ ID NO: 2804821 - protein, 22 aa, Entamoeba invadens
SPSKLCLVKYFGYTGAQFKALI

SEQ ID NO: 2804822 - protein, 38 aa, Entamoeba invadens
SPSLLRTLFRVEWKHLLLCYGCLLFSQITTLVIPILIQ

SEQ ID NO: 2804823 - protein, 20 aa, Entamoeba invadens
SPSNCICILKSGTIDDNSNS

SEQ ID NO: 2804824 - protein, 19 aa, Entamoeba invadens
SPSQFIAVLCIAAKYQQKL

SEQ ID NO: 2804825 - protein, 24 aa, Entamoeba invadens
SPSRGINVLHLFSLQKTDAEALNK

SEQ ID NO: 2804826 - protein, 20 aa, Entamoeba invadens
SPSTWGGLVFQQRQDEDIVL

SEQ ID NO: 2804827 - protein, 26 aa, Entamoeba invadens
SPSVVMRCLFRLRPFTDLIYKEMSGR

SEQ ID NO: 2804828 - protein, 21 aa, Entamoeba invadens
SPTACYCQYDLVTKQTCTFNC

SEQ ID NO: 2804829 - protein, 25 aa, Entamoeba invadens
SPTALDMYIGIVFFFYFLAQTVVMV

SEQ ID NO: 2804830 - protein, 30 aa, Entamoeba invadens
SPTDMTTHLKIRFCQDIARGMEYLHQNDIV

SEQ ID NO: 2804831 - protein, 32 aa, Entamoeba invadens
SPTGGCVICSSGYYRYGFDCVECDIKCSTCNY

SEQ ID NO: 2804832 - protein, 17 aa, Entamoeba invadens
SPTIKKAILVPLTQLIT

SEQ ID NO: 2804833 - protein, 17 aa, Entamoeba invadens
SPTRPYVGYLFSSNSSE

SEQ ID NO: 2804834 - protein, 22 aa, Entamoeba invadens
SPTVFCALFLLGGSLANGPKGG

SEQ ID NO: 2804835 - protein, 23 aa, Entamoeba invadens
SPVCAKLTDFGTCRNISERNLAA

SEQ ID NO: 2804836 - protein, 24 aa, Entamoeba invadens
SPVCAKLTDFGTCRNISERNLASK

SEQ ID NO: 2804837 - protein, 24 aa, Entamoeba invadens
SPVCAKLTDFGTCRNISERSLQSK

SEQ ID NO: 2804838 - protein, 24 aa, Entamoeba invadens
SPVFSSKLLVLARILLKSTSESCT

SEQ ID NO: 2804839 - protein, 19 aa, Entamoeba invadens
SPVHKWEIVLKMKRLLDLS

SEQ ID NO: 2804840 - protein, 29 aa, Entamoeba invadens
SPVPKYELFPVIVIFIIMCIVLYLFTKLF

SEQ ID NO: 2804841 - protein, 19 aa, Entamoeba invadens
SPVWKRMFPENVFQIVCAD

SEQ ID NO: 2804842 - protein, 24 aa, Entamoeba invadens
SPWRQCILICRPVRFSTTAFHVIG

SEQ ID NO: 2804843 - protein, 17 aa, Entamoeba invadens
SPYIIRFFGAVHIGNSR

SEQ ID NO: 2804844 - protein, 26 aa, Entamoeba invadens
SPYPLYEVMRRMLLVIYENCPSSEES

SEQ ID NO: 2804845 - protein, 24 aa, Entamoeba invadens
SQAFPAQHSIVFRSFKPENLVSVL

SEQ ID NO: 2804846 - protein, 22 aa, Entamoeba invadens
SQASRRSLMLVAKVMQAIANQS

SEQ ID NO: 2804847 - protein, 19 aa, Entamoeba invadens
SQCISCKDGFYLGENKKCI

SEQ ID NO: 2804848 - protein, 17 aa, Entamoeba invadens
SQCKTCLEGYILVGTTC

SEQ ID NO: 2804849 - protein, 18 aa, Entamoeba invadens
SQCSSCYDGLYLNSDFEC

SEQ ID NO: 2804850 - protein, 23 aa, Entamoeba invadens
SQCSTGFKVLYGEGPIKQCDVIY

SEQ ID NO: 2804851 - protein, 19 aa, Entamoeba invadens
SQCTKCTFWKAPNDNGDGC

SEQ ID NO: 2804852 - protein, 23 aa, Entamoeba invadens
SQDFLCAIVHEFVVSFIEYNILY

SEQ ID NO: 2804853 - protein, 25 aa, Entamoeba invadens
SQDVCLICSSLYSLQNGSCFITSNN

SEQ ID NO: 2804854 - protein, 21 aa, Entamoeba invadens
SQDVCLICSSLYTLQNNSCVI

SEQ ID NO: 2804855 - protein, 22 aa, Entamoeba invadens
SQEEKPVLVILQFMNQEKSFSK

SEQ ID NO: 2804856 - protein, 26 aa, Entamoeba invadens
SQFEFKRIECDSLRVRNTHFLISGNS

SEQ ID NO: 2804857 - protein, 25 aa, Entamoeba invadens
SQFVQRIGNFLGEISYSMYLTHSYI

SEQ ID NO: 2804858 - protein, 22 aa, Entamoeba invadens
SQGYFSHPVCMNSSVYKVLHFE

SEQ ID NO: 2804859 - protein, 23 aa, Entamoeba invadens
SQHKYSIAIAFFFLGEAIQEAVN

SEQ ID NO: 2804860 - protein, 23 aa, Entamoeba invadens
SQHPEISLLLSFDIDPTNYNFND

SEQ ID NO: 2804861 - protein, 30 aa, Entamoeba invadens
SQIAKCKEVKESKCTKCEFWNSPNAEGTLC

SEQ ID NO: 2804862 - protein, 18 aa, Entamoeba invadens
SQIGGLILQFFHILSEAL

SEQ ID NO: 2804863 - protein, 25 aa, Entamoeba invadens
SQIIYYRYVKNWIKQRKRENKMEKI

SEQ ID NO: 2804864 - protein, 17 aa, Entamoeba invadens
SQIRSFKQLEVTNSQTT

SEQ ID NO: 2804865 - protein, 19 aa, Entamoeba invadens
SQKAVIGARAFKGAIKLAT

SEQ ID NO: 2804866 - protein, 18 aa, Entamoeba invadens
SQKTIRMKKITTVKKDGK

SEQ ID NO: 2804867 - protein, 22 aa, Entamoeba invadens
SQKVIPMSILKKCHVISKHKKD

SEQ ID NO: 2804868 - protein, 19 aa, Entamoeba invadens
SQLDVECWNTFDLYFRSIE

SEQ ID NO: 2804869 - protein, 22 aa, Entamoeba invadens
SQLISFKFCLSGIYDEIKKECI

SEQ ID NO: 2804870 - protein, 19 aa, Entamoeba invadens
SQLIVFPSGYSVLIDLGEV

SEQ ID NO: 2804871 - protein, 19 aa, Entamoeba invadens
SQMRYKFLIDGAKGIQYLH

SEQ ID NO: 2804872 - protein, 19 aa, Entamoeba invadens
SQNELVARLCLQIWSEIGG

SEQ ID NO: 2804873 - protein, 21 aa, Entamoeba invadens
SQNFSCDDFSYSIEYQDTSAA

SEQ ID NO: 2804874 - protein, 22 aa, Entamoeba invadens
SQNNECVYLWTGQRYGVLAESQ

SEQ ID NO: 2804875 - protein, 22 aa, Entamoeba invadens
SQNQFFNLWALIAEHCKDEETV

SEQ ID NO: 2804876 - protein, 21 aa, Entamoeba invadens
SQNSLCWECADGYKLRDDKIE

SEQ ID NO: 2804877 - protein, 20 aa, Entamoeba invadens
SQNSLCWECADGYKLSDDKI

SEQ ID NO: 2804878 - protein, 21 aa, Entamoeba invadens
SQNSLCWECADGYKLSDDKIE

SEQ ID NO: 2804879 - protein, 18 aa, Entamoeba invadens
SQNSLCWECTDNYKLSDD

SEQ ID NO: 2804880 - protein, 20 aa, Entamoeba invadens
SQPLFWSFKKRLDFLQKASD

SEQ ID NO: 2804881 - protein, 19 aa, Entamoeba invadens
SQPSVFVGIFLFVENVIQT

SEQ ID NO: 2804882 - protein, 23 aa, Entamoeba invadens
SQPYILKFFFFKLVGEIPNKSRI

SEQ ID NO: 2804883 - protein, 24 aa, Entamoeba invadens
SQQCTSTGCKQCIANETCSSCSEL

SEQ ID NO: 2804884 - protein, 19 aa, Entamoeba invadens
SQRGCVICNDGYYQDQNDC

SEQ ID NO: 2804885 - protein, 18 aa, Entamoeba invadens
SQRMCYEERYAFIYDKTR

SEQ ID NO: 2804886 - protein, 17 aa, Entamoeba invadens
SQSCSFPNIILTNTTVS

SEQ ID NO: 2804887 - protein, 25 aa, Entamoeba invadens
SQSGCLKCLTGFYQQNQFCVTYNLT

SEQ ID NO: 2804888 - protein, 19 aa, Entamoeba invadens
SQSQMNCMIAGYRNYDRPN

SEQ ID NO: 2804889 - protein, 19 aa, Entamoeba invadens
SQSQMNCMIAGYRNYERPT

SEQ ID NO: 2804890 - protein, 20 aa, Entamoeba invadens
SQSVILFKRSTSVRINAYKM

SEQ ID NO: 2804891 - protein, 27 aa, Entamoeba invadens
SQSVKSCPCIFGLLKLEYFGKYSKHPK

SEQ ID NO: 2804892 - protein, 25 aa, Entamoeba invadens
SQTCYKMGIVGFFLWNIATIFYFII

SEQ ID NO: 2804893 - protein, 17 aa, Entamoeba invadens
SQTEGFIYVVLTVASPK

SEQ ID NO: 2804894 - protein, 22 aa, Entamoeba invadens
SQTEGVIQCFAFVFRANRNVLV

SEQ ID NO: 2804895 - protein, 25 aa, Entamoeba invadens
SQVGIIGTFKIHFHVTPQAKESVFT

SEQ ID NO: 2804896 - protein, 26 aa, Entamoeba invadens
SQVPNFKYKPKIAICKDETENVEGMR

SEQ ID NO: 2804897 - protein, 23 aa, Entamoeba invadens
SQYFLCLNDFITLEMVKRKFKNN

SEQ ID NO: 2804898 - protein, 17 aa, Entamoeba invadens
SQYFYYKYIRQRIVDKC

SEQ ID NO: 2804899 - protein, 17 aa, Entamoeba invadens
SQYKFGVLYAKQKQTTE

SEQ ID NO: 2804900 - protein, 24 aa, Entamoeba invadens
SQYPQRIILNFSPHQLPGWSKNST

SEQ ID NO: 2804901 - protein, 19 aa, Entamoeba invadens
SRAVWSVIIVAFFVCSYCF

SEQ ID NO: 2804902 - protein, 19 aa, Entamoeba invadens
SRAYKWLPLIYGLTSQDFL

SEQ ID NO: 2804903 - protein, 29 aa, Entamoeba invadens
SRCAAMYYIKNGVCVKCEYPCTRCSNLTF

SEQ ID NO: 2804904 - protein, 18 aa, Entamoeba invadens
SRCEICKIGFKLVDETTC

SEQ ID NO: 2804905 - protein, 19 aa, Entamoeba invadens
SRCKDMFTYICMDGKCVVK

SEQ ID NO: 2804906 - protein, 24 aa, Entamoeba invadens
SRCLPNYYLDNGICVACLLKEGCA

SEQ ID NO: 2804907 - protein, 23 aa, Entamoeba invadens
SRCSECSFWYAVDPQTYKCKESA

SEQ ID NO: 2804908 - protein, 18 aa, Entamoeba invadens
SRDLICIGNSSPHRIKLQ

SEQ ID NO: 2804909 - protein, 25 aa, Entamoeba invadens
SRDLSLKVQFQWICTSIFQGTLIIL

SEQ ID NO: 2804910 - protein, 25 aa, Entamoeba invadens
SRDVICIGNGYAGTIQLSFLTVDEV

SEQ ID NO: 2804911 - protein, 17 aa, Entamoeba invadens
SREALIYIHGLNHTLVD

SEQ ID NO: 2804912 - protein, 19 aa, Entamoeba invadens
SREECEIVMKNCCDQLFEQ

SEQ ID NO: 2804913 - protein, 23 aa, Entamoeba invadens
SREFKVEQVIMIWDRLVSDPRAN

SEQ ID NO: 2804914 - protein, 18 aa, Entamoeba invadens
SREKAAFFEDYFAISVVE

SEQ ID NO: 2804915 - protein, 24 aa, Entamoeba invadens
SRELEIFSLFVSFFITSSSSAKNL

SEQ ID NO: 2804916 - protein, 19 aa, Entamoeba invadens
SRFKCSDFGKVMRKYLRSI

SEQ ID NO: 2804917 - protein, 18 aa, Entamoeba invadens
SRGLGFLLLGCAWSVTEV

SEQ ID NO: 2804918 - protein, 24 aa, Entamoeba invadens
SRGYKHFAEMNLGYDGDWAVASKY

SEQ ID NO: 2804919 - protein, 17 aa, Entamoeba invadens
SRHKFLYTYSFIPTLLV

SEQ ID NO: 2804920 - protein, 19 aa, Entamoeba invadens
SRIENFSSIVLEDLSKAYF

SEQ ID NO: 2804921 - protein, 19 aa, Entamoeba invadens
SRIFPPRFNLTLKDTMYLS

SEQ ID NO: 2804922 - protein, 24 aa, Entamoeba invadens
SRIKTIDCFIIFQLLMGILVLIYG

SEQ ID NO: 2804923 - protein, 17 aa, Entamoeba invadens
SRIMEFRRKGLSTKLSV

SEQ ID NO: 2804924 - protein, 18 aa, Entamoeba invadens
SRKCILCKEGYYINTATN

SEQ ID NO: 2804925 - protein, 17 aa, Entamoeba invadens
SRKKWMMVIFHTPNNPK

SEQ ID NO: 2804926 - protein, 22 aa, Entamoeba invadens
SRKVVFCAAHSLPVTYHIIDSF

SEQ ID NO: 2804927 - protein, 21 aa, Entamoeba invadens
SRKWTIIGIAVGIVITLIIII

SEQ ID NO: 2804928 - protein, 22 aa, Entamoeba invadens
SRLCITCKSGLRPNTTSGKCVG

SEQ ID NO: 2804929 - protein, 26 aa, Entamoeba invadens
SRLFIRKNGHLISRCGTLMAIVGPTQ

SEQ ID NO: 2804930 - protein, 17 aa, Entamoeba invadens
SRLGAVLDMVTDRAGTT

SEQ ID NO: 2804931 - protein, 22 aa, Entamoeba invadens
SRLLRLEFISVLAEGDHIFQLN

SEQ ID NO: 2804932 - protein, 23 aa, Entamoeba invadens
SRLNRLWQSPRRCFVLDDNINPD

SEQ ID NO: 2804933 - protein, 20 aa, Entamoeba invadens
SRLTQWNILVLKGGNVRPLN

SEQ ID NO: 2804934 - protein, 17 aa, Entamoeba invadens
SRLVYRKGVDLAVGVIP

SEQ ID NO: 2804935 - protein, 19 aa, Entamoeba invadens
SRLYCLAATCGNKRIDGDE

SEQ ID NO: 2804936 - protein, 34 aa, Entamoeba invadens
SRMSSALRNFLFWGIGCIAYLLLYLFLLFLIVIL

SEQ ID NO: 2804937 - protein, 20 aa, Entamoeba invadens
SRMTIELAFVLIMYAVMKCC

SEQ ID NO: 2804938 - protein, 20 aa, Entamoeba invadens
SRNAYLNWFMAFVGGLAAGF

SEQ ID NO: 2804939 - protein, 26 aa, Entamoeba invadens
SRNEFKIKAIDPLSGIELWNMTIGEY

SEQ ID NO: 2804940 - protein, 25 aa, Entamoeba invadens
SRNNMCLKCNNTLMVVKDGVCVLYE

SEQ ID NO: 2804941 - protein, 19 aa, Entamoeba invadens
SRNSSRICENCIKGMYPET

SEQ ID NO: 2804942 - protein, 17 aa, Entamoeba invadens
SRNVEINKLLPITFSTE

SEQ ID NO: 2804943 - protein, 23 aa, Entamoeba invadens
SRPRRPTQTSIRMSRSSETKKKR

SEQ ID NO: 2804944 - protein, 26 aa, Entamoeba invadens
SRRGWCEDCLKALSGIQISEFGIADR

SEQ ID NO: 2804945 - protein, 20 aa, Entamoeba invadens
SRRKIKCGGLTPTEKNENLP

SEQ ID NO: 2804946 - protein, 22 aa, Entamoeba invadens
SRRVCGEVKDGLKGVYYTFKAN

SEQ ID NO: 2804947 - protein, 19 aa, Entamoeba invadens
SRSADRHWLNVAKFSSNRM

SEQ ID NO: 2804948 - protein, 20 aa, Entamoeba invadens
SRSILKRKVRKVAVEQGTKA

SEQ ID NO: 2804949 - protein, 18 aa, Entamoeba invadens
SRSLILIAKERSRCDGGV

SEQ ID NO: 2804950 - protein, 18 aa, Entamoeba invadens
SRSPTSGVFTQIRASREK

SEQ ID NO: 2804951 - protein, 24 aa, Entamoeba invadens
SRTERKCLLCLSGVSYLSNGMCAL

SEQ ID NO: 2804952 - protein, 24 aa, Entamoeba invadens
SRTERKCLLCQSGVSYLSNGMCAL

SEQ ID NO: 2804953 - protein, 24 aa, Entamoeba invadens
SRTKATILGGIFPKVNDLNILFEP

SEQ ID NO: 2804954 - protein, 27 aa, Entamoeba invadens
SRTQYGKKCFFFRYVPDADNEDWGLFL

SEQ ID NO: 2804955 - protein, 20 aa, Entamoeba invadens
SRTRESFAFYNQTIVAQNRP

SEQ ID NO: 2804956 - protein, 19 aa, Entamoeba invadens
SRVCIECVDGFYLDNNKCN

SEQ ID NO: 2804957 - protein, 23 aa, Entamoeba invadens
SRVCISCKAGSYLVNGRCQTCDS

SEQ ID NO: 2804958 - protein, 17 aa, Entamoeba invadens
SRVCVACKSFDQNCKTC

SEQ ID NO: 2804959 - protein, 17 aa, Entamoeba invadens
SRVCVACKSFDQNCKVC

SEQ ID NO: 2804960 - protein, 21 aa, Entamoeba invadens
SRVTPFWLSLAKEVMMTNLGQ

SEQ ID NO: 2804961 - protein, 18 aa, Entamoeba invadens
SRWGEMIAKEMLNITRIE

SEQ ID NO: 2804962 - protein, 20 aa, Entamoeba invadens
SRYCNNCNIGYFFENGKCVK

SEQ ID NO: 2804963 - protein, 18 aa, Entamoeba invadens
SRYLLYPVDLDFGQRNGA

SEQ ID NO: 2804964 - protein, 20 aa, Entamoeba invadens
SRYYLEQGRCYECSDHCLNC

SEQ ID NO: 2804965 - protein, 19 aa, Entamoeba invadens
SSAFLNCAFMYTTTNSGTT

SEQ ID NO: 2804966 - protein, 17 aa, Entamoeba invadens
SSALAFLNPIKSFLTTG

SEQ ID NO: 2804967 - protein, 17 aa, Entamoeba invadens
SSALGLRCNLVMPQNKG

SEQ ID NO: 2804968 - protein, 25 aa, Entamoeba invadens
SSALKEVFSGVSFYNGQLQLYDSNE

SEQ ID NO: 2804969 - protein, 18 aa, Entamoeba invadens
SSALQLRCKYMIPKEKRC

SEQ ID NO: 2804970 - protein, 21 aa, Entamoeba invadens
SSALTEYWIEFFIFPELKTNP

SEQ ID NO: 2804971 - protein, 18 aa, Entamoeba invadens
SSCKCIASKGYVFGKDGY

SEQ ID NO: 2804972 - protein, 20 aa, Entamoeba invadens
SSCKVCLKCDAQCYTCTKPG

SEQ ID NO: 2804973 - protein, 20 aa, Entamoeba invadens
SSCLKCTMCTSCISTTGKCL

SEQ ID NO: 2804974 - protein, 27 aa, Entamoeba invadens
SSCLVLKSDILPIVLSFDGMTFNENIK

SEQ ID NO: 2804975 - protein, 18 aa, Entamoeba invadens
SSCNPCNAGSYSNEGAKT

SEQ ID NO: 2804976 - protein, 22 aa, Entamoeba invadens
SSCPRTTKVLLLMSSPPDDTFV

SEQ ID NO: 2804977 - protein, 18 aa, Entamoeba invadens
SSCSQCPTGSYSPESSSR

SEQ ID NO: 2804978 - protein, 26 aa, Entamoeba invadens
SSCTKGRITYYTSWADGGSCNYGPRT

SEQ ID NO: 2804979 - protein, 19 aa, Entamoeba invadens
SSCTVCRSGSYSLGGASTC

SEQ ID NO: 2804980 - protein, 19 aa, Entamoeba invadens
SSCYSCSAGTYGPSSGASS

SEQ ID NO: 2804981 - protein, 32 aa, Entamoeba invadens
SSDANHLIWLVVIPAFLVVVLLLLAAVFLSFK

SEQ ID NO: 2804982 - protein, 18 aa, Entamoeba invadens
SSDCPLCRTEIDFEISED

SEQ ID NO: 2804983 - protein, 20 aa, Entamoeba invadens
SSDGSTCIGCDVSCKSCTNE

SEQ ID NO: 2804984 - protein, 20 aa, Entamoeba invadens
SSDGSTCISCDVSCKSCTNE

SEQ ID NO: 2804985 - protein, 22 aa, Entamoeba invadens
SSDIKTGMFIKLRHNEIVPADC

SEQ ID NO: 2804986 - protein, 24 aa, Entamoeba invadens
SSDIYFLASPCMKYLDRKNYSIKN

SEQ ID NO: 2804987 - protein, 22 aa, Entamoeba invadens
SSDKKRSCSICKSNYYPIQGRC

SEQ ID NO: 2804988 - protein, 21 aa, Entamoeba invadens
SSDKQRSCTICESNYYPKQGL

SEQ ID NO: 2804989 - protein, 21 aa, Entamoeba invadens
SSDKQRSCTICESNYYPKQGQ

SEQ ID NO: 2804990 - protein, 18 aa, Entamoeba invadens
SSDSGLCVSDVLSTKVSN

SEQ ID NO: 2804991 - protein, 21 aa, Entamoeba invadens
SSDTPLRFNHKIRIKPIAQKA

SEQ ID NO: 2804992 - protein, 25 aa, Entamoeba invadens
SSDVCIKLKIKMMIDAANGISYLYS

SEQ ID NO: 2804993 - protein, 27 aa, Entamoeba invadens
SSEARCLCKSGYGGDDCHLLCYYHDNW

SEQ ID NO: 2804994 - protein, 19 aa, Entamoeba invadens
SSECIKCIDNYYIQLGQCT

SEQ ID NO: 2804995 - protein, 27 aa, Entamoeba invadens
SSECKVCGDGFFSKSGYSKCIQCVSTS

SEQ ID NO: 2804996 - protein, 19 aa, Entamoeba invadens
SSECLSCSSDLISNGEKCI

SEQ ID NO: 2804997 - protein, 17 aa, Entamoeba invadens
SSEECRRPIILDVGQGG

SEQ ID NO: 2804998 - protein, 22 aa, Entamoeba invadens
SSEGRCSACANDLRLNADGTLC

SEQ ID NO: 2804999 - protein, 24 aa, Entamoeba invadens
SSELCSVPSSFFCTNEDLKGIDSS

SEQ ID NO: 2805000 - protein, 22 aa, Entamoeba invadens
SSERFFYVFISIEGYERIDFKF

SEQ ID NO: 2805001 - protein, 19 aa, Entamoeba invadens
SSETKWKRSQCPCNGETCI

SEQ ID NO: 2805002 - protein, 25 aa, Entamoeba invadens
SSFAKLHATFPCLREQIAKIFIKYQ

SEQ ID NO: 2805003 - protein, 17 aa, Entamoeba invadens
SSFCAICEGMYYRTNEG

SEQ ID NO: 2805004 - protein, 18 aa, Entamoeba invadens
SSFCLSCETGYFINDNAC

SEQ ID NO: 2805005 - protein, 21 aa, Entamoeba invadens
SSFDCLRCIDNYYFDSNTRSC

SEQ ID NO: 2805006 - protein, 19 aa, Entamoeba invadens
SSFEISFRYEEHTFAAKDD

SEQ ID NO: 2805007 - protein, 20 aa, Entamoeba invadens
SSFFKMLLFNQHEFKSQFFH

SEQ ID NO: 2805008 - protein, 19 aa, Entamoeba invadens
SSFIKTAKVLTTFSKKVII

SEQ ID NO: 2805009 - protein, 17 aa, Entamoeba invadens
SSFMLKEGVCVECSTSN

SEQ ID NO: 2805010 - protein, 21 aa, Entamoeba invadens
SSFMRLGFKGTYEGDCFGFLF

SEQ ID NO: 2805011 - protein, 24 aa, Entamoeba invadens
SSFRRRCYECNKGYYPSQYTEKCE

SEQ ID NO: 2805012 - protein, 26 aa, Entamoeba invadens
SSFSYGRRRPFMIAGLVVFVIGGVVI

SEQ ID NO: 2805013 - protein, 20 aa, Entamoeba invadens
SSGAARCTVCNYGYYQPKEG

SEQ ID NO: 2805014 - protein, 23 aa, Entamoeba invadens
SSGKCEICGIGFYSQNSKCVSCS

SEQ ID NO: 2805015 - protein, 20 aa, Entamoeba invadens
SSGKWALRKVRSRKKRECIH

SEQ ID NO: 2805016 - protein, 27 aa, Entamoeba invadens
SSGPRGGKIRWYVIIIGLFTRLVIVPA

SEQ ID NO: 2805017 - protein, 28 aa, Entamoeba invadens
SSHCASCFNSTICLSCTNATDSLVNHNC

SEQ ID NO: 2805018 - protein, 20 aa, Entamoeba invadens
SSICTNCFKPYILTNSKCKL

SEQ ID NO: 2805019 - protein, 24 aa, Entamoeba invadens
SSICTSCLNGSYSLDGASKCMPCI

SEQ ID NO: 2805020 - protein, 18 aa, Entamoeba invadens
SSIEGCLNNATSFGCSKC

SEQ ID NO: 2805021 - protein, 20 aa, Entamoeba invadens
SSIESCLECADGYFKFSGDS

SEQ ID NO: 2805022 - protein, 21 aa, Entamoeba invadens
SSIHPTFFVNYFMYLDTESPS

SEQ ID NO: 2805023 - protein, 17 aa, Entamoeba invadens
SSIIRRLRKTDTKQTPS

SEQ ID NO: 2805024 - protein, 18 aa, Entamoeba invadens
SSIIRRLRKTDTKQTPSP

SEQ ID NO: 2805025 - protein, 21 aa, Entamoeba invadens
SSILFLPFLILLSLFYFELMR

SEQ ID NO: 2805026 - protein, 18 aa, Entamoeba invadens
SSILYRAGVFTGSNGLFW

SEQ ID NO: 2805027 - protein, 24 aa, Entamoeba invadens
SSIRQCALFFLNFFVTTQLAYCIS

SEQ ID NO: 2805028 - protein, 17 aa, Entamoeba invadens
SSIRVVGIYLVLVLGMW

SEQ ID NO: 2805029 - protein, 24 aa, Entamoeba invadens
SSISNFWFKKGLGVTSVTITDNTL

SEQ ID NO: 2805030 - protein, 24 aa, Entamoeba invadens
SSIVCSFLVLGLSFLAVVTVSISS

SEQ ID NO: 2805031 - protein, 19 aa, Entamoeba invadens
SSKCAICDTSYFRNFEGKC

SEQ ID NO: 2805032 - protein, 18 aa, Entamoeba invadens
SSKCAICEDSFFRNDRGE

SEQ ID NO: 2805033 - protein, 17 aa, Entamoeba invadens
SSKCTKCSFWYSVSLDT

SEQ ID NO: 2805034 - protein, 24 aa, Entamoeba invadens
SSKEILKTYGPFFVICCVLLAIVL

SEQ ID NO: 2805035 - protein, 25 aa, Entamoeba invadens
SSKFGESLLFFGDRLFVGSPDFSVV

SEQ ID NO: 2805036 - protein, 25 aa, Entamoeba invadens
SSKGVLFVHYLCRNGFITTSKIVCI

SEQ ID NO: 2805037 - protein, 17 aa, Entamoeba invadens
SSKIFCFNKTAQIILTK

SEQ ID NO: 2805038 - protein, 23 aa, Entamoeba invadens
SSKNCLICTIGTYSLNSKCTECG

SEQ ID NO: 2805039 - protein, 24 aa, Entamoeba invadens
SSKRSKCLECFNVFQMKDGKCAEK

SEQ ID NO: 2805040 - protein, 17 aa, Entamoeba invadens
SSLCLVSSLYIYFFEQA

SEQ ID NO: 2805041 - protein, 18 aa, Entamoeba invadens
SSLEFRLIVQMVSTNYKE

SEQ ID NO: 2805042 - protein, 18 aa, Entamoeba invadens
SSLETCYVSAEGNRFEKS

SEQ ID NO: 2805043 - protein, 28 aa, Entamoeba invadens
SSLIFQNECKLVFNKYLYINFITVNSST

SEQ ID NO: 2805044 - protein, 17 aa, Entamoeba invadens
SSLKFIFYGITQQKYQI

SEQ ID NO: 2805045 - protein, 28 aa, Entamoeba invadens
SSLKNGAARRCLVDLFLTETMLCNQNVD

SEQ ID NO: 2805046 - protein, 19 aa, Entamoeba invadens
SSLLGFEKVRCCKGSADKR

SEQ ID NO: 2805047 - protein, 26 aa, Entamoeba invadens
SSLLLCGGMTLFAFVVFPLFPSKNNL

SEQ ID NO: 2805048 - protein, 20 aa, Entamoeba invadens
SSLLRATKCQNFEVLFNSST

SEQ ID NO: 2805049 - protein, 20 aa, Entamoeba invadens
SSLLSALIHLFSAFWESSSK

SEQ ID NO: 2805050 - protein, 25 aa, Entamoeba invadens
SSLPLFKLKPVWILTIFQFSLCVLM

SEQ ID NO: 2805051 - protein, 19 aa, Entamoeba invadens
SSLSPALTNFLFWGVGSIS

SEQ ID NO: 2805052 - protein, 18 aa, Entamoeba invadens
SSLVCCKLYFKLVSVSQK

SEQ ID NO: 2805053 - protein, 20 aa, Entamoeba invadens
SSMACLTCVAGTYSTPSSLC

SEQ ID NO: 2805054 - protein, 23 aa, Entamoeba invadens
SSMAKKLWKPLSYVITVATILGV

SEQ ID NO: 2805055 - protein, 23 aa, Entamoeba invadens
SSMIILVLAYRSWALASPAIPPM

SEQ ID NO: 2805056 - protein, 22 aa, Entamoeba invadens
SSNCVACDFGMYINEYGLCVEC

SEQ ID NO: 2805057 - protein, 23 aa, Entamoeba invadens
SSNCVTCGFGYYNSSGACVILEG

SEQ ID NO: 2805058 - protein, 22 aa, Entamoeba invadens
SSNETFTLCLQKLLLDTNNMPS

SEQ ID NO: 2805059 - protein, 23 aa, Entamoeba invadens
SSNGNCLLCSSGLNRSERICNQC

SEQ ID NO: 2805060 - protein, 19 aa, Entamoeba invadens
SSNNELYYLNSLKMKLSIL

SEQ ID NO: 2805061 - protein, 25 aa, Entamoeba invadens
SSNNKCLKCSPGQEVSKDLSSCEKE

SEQ ID NO: 2805062 - protein, 25 aa, Entamoeba invadens
SSNSCIRCIPNYILTNNNCCSIKEE

SEQ ID NO: 2805063 - protein, 25 aa, Entamoeba invadens
SSNSCKRCSTTFGELCDLCDFDKCL

SEQ ID NO: 2805064 - protein, 26 aa, Entamoeba invadens
SSNSCKRCSTTFGELCDLCDFDKCLK

SEQ ID NO: 2805065 - protein, 27 aa, Entamoeba invadens
SSNSKCSGCSFWYEVGQDFTSCETKAV

SEQ ID NO: 2805066 - protein, 28 aa, Entamoeba invadens
SSNVEPRLSVALVCLAIYIGVFSGVIVQ

SEQ ID NO: 2805067 - protein, 18 aa, Entamoeba invadens
SSPFSCVYCHETCSEGCS

SEQ ID NO: 2805068 - protein, 24 aa, Entamoeba invadens
SSPHRISIFDAFWNTKYEHSAPLQ

SEQ ID NO: 2805069 - protein, 19 aa, Entamoeba invadens
SSPLRFIAFLICLATTIFT

SEQ ID NO: 2805070 - protein, 44 aa, Entamoeba invadens
SSPNGGECLTCPSGFERGEFGCIWCKAGFYKGGDGIKCVECPEG

SEQ ID NO: 2805071 - protein, 20 aa, Entamoeba invadens
SSPNGLKLATSVVTIISSEE

SEQ ID NO: 2805072 - protein, 23 aa, Entamoeba invadens
SSPRKRGTFIVAFEGDDEVNVHC

SEQ ID NO: 2805073 - protein, 28 aa, Entamoeba invadens
SSPSLYSKICNFGAQIVIGGKVSCDKIT

SEQ ID NO: 2805074 - protein, 23 aa, Entamoeba invadens
SSQFFRDIFPIIASLAAIHPKLF

SEQ ID NO: 2805075 - protein, 27 aa, Entamoeba invadens
SSQNSLCWECADGFKLSDDKIECFANT

SEQ ID NO: 2805076 - protein, 22 aa, Entamoeba invadens
SSQNSLCWECADGYKLSADKIE

SEQ ID NO: 2805077 - protein, 22 aa, Entamoeba invadens
SSQNSLCWECADGYKLSDDKIE

SEQ ID NO: 2805078 - protein, 26 aa, Entamoeba invadens
SSQTFAYKFFYFRLTGDVPLGSRILF

SEQ ID NO: 2805079 - protein, 28 aa, Entamoeba invadens
SSRKSKFIRPGVIAVRMTYSSFFSNKSE

SEQ ID NO: 2805080 - protein, 20 aa, Entamoeba invadens
SSSCDPCPSGTYTSNVESTT

SEQ ID NO: 2805081 - protein, 22 aa, Entamoeba invadens
SSSCFYGYPGSFCEIKKVGEDF

SEQ ID NO: 2805082 - protein, 23 aa, Entamoeba invadens
SSSCLKCPKGHFTSSEGSTSCNA

SEQ ID NO: 2805083 - protein, 22 aa, Entamoeba invadens
SSSCTLCGMGTYSTAHSSSCKN

SEQ ID NO: 2805084 - protein, 20 aa, Entamoeba invadens
SSSCTLCPDGSYNPSKGSDQ

SEQ ID NO: 2805085 - protein, 17 aa, Entamoeba invadens
SSSCTSCSVGTYSSTSG

SEQ ID NO: 2805086 - protein, 17 aa, Entamoeba invadens
SSSDGWVAKAVCTRSNF

SEQ ID NO: 2805087 - protein, 28 aa, Entamoeba invadens
SSSDLFWNFTRMEIGGFNSKVDFTYNDI

SEQ ID NO: 2805088 - protein, 26 aa, Entamoeba invadens
SSSGCLKCANGVYTLNKECYKCSDNC

SEQ ID NO: 2805089 - protein, 17 aa, Entamoeba invadens
SSSNCLINGCLSECIST

SEQ ID NO: 2805090 - protein, 22 aa, Entamoeba invadens
SSSNCLSCNLGRYLDGNNCKTC

SEQ ID NO: 2805091 - protein, 23 aa, Entamoeba invadens
SSSNCLSCNLGRYLDVNNCKTCD

SEQ ID NO: 2805092 - protein, 20 aa, Entamoeba invadens
SSSNCLSCNLGRYLKYNNNC

SEQ ID NO: 2805093 - protein, 22 aa, Entamoeba invadens
SSSNGCHKCISGYFSNSILQCD

SEQ ID NO: 2805094 - protein, 19 aa, Entamoeba invadens
SSSSLWMRVPLYFVQQYPR

SEQ ID NO: 2805095 - protein, 20 aa, Entamoeba invadens
SSSTCLSCKTGTYLVGSFCV

SEQ ID NO: 2805096 - protein, 23 aa, Entamoeba invadens
SSSYEILAGLSLDDQQFVAIKKD

SEQ ID NO: 2805097 - protein, 20 aa, Entamoeba invadens
SSTCISCPAGTYSSTKNANT

SEQ ID NO: 2805098 - protein, 25 aa, Entamoeba invadens
SSTCKSCLPNSFSYEKSSTCTSCDS

SEQ ID NO: 2805099 - protein, 19 aa, Entamoeba invadens
SSTCTWCPNGSYNPTVGQS

SEQ ID NO: 2805100 - protein, 19 aa, Entamoeba invadens
SSTDIARAYTFLHDGIARP

SEQ ID NO: 2805101 - protein, 19 aa, Entamoeba invadens
SSTFLKGIECIQCHESCAS

SEQ ID NO: 2805102 - protein, 19 aa, Entamoeba invadens
SSTGKAASFVDIKANETVY

SEQ ID NO: 2805103 - protein, 29 aa, Entamoeba invadens
SSTGSRWEAFKWALISGICEPFGALCVGT

SEQ ID NO: 2805104 - protein, 25 aa, Entamoeba invadens
SSTKCLSCAYSNMSVVNDKCILNEQ

SEQ ID NO: 2805105 - protein, 24 aa, Entamoeba invadens
SSTKCLSCGVGYYLTDNTCKSNDL

SEQ ID NO: 2805106 - protein, 23 aa, Entamoeba invadens
SSTKCVTCGRGTYSSSGSAYCTD

SEQ ID NO: 2805107 - protein, 24 aa, Entamoeba invadens
SSTKCVTCSRGTYSSSGSAYCNDC

SEQ ID NO: 2805108 - protein, 23 aa, Entamoeba invadens
SSTKCVTCSRGTYSSSGSAYCTN

SEQ ID NO: 2805109 - protein, 20 aa, Entamoeba invadens
SSTLVKLALTKKFDFMDERS

SEQ ID NO: 2805110 - protein, 31 aa, Entamoeba invadens
SSTPKLIHRNIKRPIPIKKTVFALESDEPSP

SEQ ID NO: 2805111 - protein, 18 aa, Entamoeba invadens
SSTPSLFTLIPMVLIVVF

SEQ ID NO: 2805112 - protein, 20 aa, Entamoeba invadens
SSTSCLRCSENFILHSGVCI

SEQ ID NO: 2805113 - protein, 20 aa, Entamoeba invadens
SSTSCLRCSENFILQSGVCI

SEQ ID NO: 2805114 - protein, 23 aa, Entamoeba invadens
SSTSIPTWLIAVIVTVVFIVMIV

SEQ ID NO: 2805115 - protein, 20 aa, Entamoeba invadens
SSTTCSSCAEGYYLNGTSCL

SEQ ID NO: 2805116 - protein, 23 aa, Entamoeba invadens
SSTVCTKESFTISTMVRAKTAGD

SEQ ID NO: 2805117 - protein, 20 aa, Entamoeba invadens
SSTVLRAFFELSFEVKKRLY

SEQ ID NO: 2805118 - protein, 19 aa, Entamoeba invadens
SSTYCLICNLTTSFLNANN

SEQ ID NO: 2805119 - protein, 21 aa, Entamoeba invadens
SSVCITCLFEYYLKEKTCKPC

SEQ ID NO: 2805120 - protein, 21 aa, Entamoeba invadens
SSVEAICAIFALAPLSFEQKF

SEQ ID NO: 2805121 - protein, 17 aa, Entamoeba invadens
SSVGLYIAPFFPLVLGA

SEQ ID NO: 2805122 - protein, 21 aa, Entamoeba invadens
SSVKSIGAFCFSYCSKLSSVV

SEQ ID NO: 2805123 - protein, 19 aa, Entamoeba invadens
SSVKTDASWVSQVKFTEAN

SEQ ID NO: 2805124 - protein, 24 aa, Entamoeba invadens
SSVLCVILSLSIIKYSALGDIQGI

SEQ ID NO: 2805125 - protein, 18 aa, Entamoeba invadens
SSVLDRLIAVWVKSKENV

SEQ ID NO: 2805126 - protein, 19 aa, Entamoeba invadens
SSVMVPLVDFILRVIGSHR

SEQ ID NO: 2805127 - protein, 27 aa, Entamoeba invadens
SSVSGCLQCSIGFYLYHKECYKCDESC

SEQ ID NO: 2805128 - protein, 26 aa, Entamoeba invadens
SSVVFSIVCGFIFFSSLYIGYFSWFN

SEQ ID NO: 2805129 - protein, 25 aa, Entamoeba invadens
SSYECLECGTGFYVESGNCTKLCGT

SEQ ID NO: 2805130 - protein, 19 aa, Entamoeba invadens
SSYFPRFSPHFNVPFPHFL

SEQ ID NO: 2805131 - protein, 24 aa, Entamoeba invadens
SSYLPCPDRTAILLKHHSPVTVIQ

SEQ ID NO: 2805132 - protein, 19 aa, Entamoeba invadens
SSYSSSSCKTCYSKYYLSN

SEQ ID NO: 2805133 - protein, 19 aa, Entamoeba invadens
SSYTQCYSCKNGYYLKDPN

SEQ ID NO: 2805134 - protein, 25 aa, Entamoeba invadens
STAFPICVLCSQTLRQCQTCSTGFY

SEQ ID NO: 2805135 - protein, 17 aa, Entamoeba invadens
STATSFKCKKCLAECQN

SEQ ID NO: 2805136 - protein, 21 aa, Entamoeba invadens
STAVISCSVGYYLSDQNCVNC

SEQ ID NO: 2805137 - protein, 18 aa, Entamoeba invadens
STCAASGCTACENNLILV

SEQ ID NO: 2805138 - protein, 18 aa, Entamoeba invadens
STCFPKTLVNTAIEISTK

SEQ ID NO: 2805139 - protein, 17 aa, Entamoeba invadens
STCGGKCDPTDGHCTGC

SEQ ID NO: 2805140 - protein, 18 aa, Entamoeba invadens
STCITCNENTFLLTNSTQ

SEQ ID NO: 2805141 - protein, 18 aa, Entamoeba invadens
STCITCYENTFLLTNSTQ

SEQ ID NO: 2805142 - protein, 19 aa, Entamoeba invadens
STCIVCSAGTYSLSGSSKC

SEQ ID NO: 2805143 - protein, 23 aa, Entamoeba invadens
STCKLCADGFYSLAGYSKCIQCF

SEQ ID NO: 2805144 - protein, 17 aa, Entamoeba invadens
STCKYVLLNGYEDLKKC

SEQ ID NO: 2805145 - protein, 18 aa, Entamoeba invadens
STCLQCVQYNFLLTDSTK

SEQ ID NO: 2805146 - protein, 24 aa, Entamoeba invadens
STCPVKWFECEKCYENYRKKWDVL

SEQ ID NO: 2805147 - protein, 18 aa, Entamoeba invadens
STCSKCFEGYYYKEDDKT

SEQ ID NO: 2805148 - protein, 30 aa, Entamoeba invadens
STCSLDYSRKCLICKTGYYPGSDGVCKLCD

SEQ ID NO: 2805149 - protein, 29 aa, Entamoeba invadens
STCSPDFSRKCVICSAGYYVDTSNNKCKQ

SEQ ID NO: 2805150 - protein, 18 aa, Entamoeba invadens
STCSSCFAGTYSSSSGST

SEQ ID NO: 2805151 - protein, 22 aa, Entamoeba invadens
STCSSCNSAFFLNETSLCEPTS

SEQ ID NO: 2805152 - protein, 24 aa, Entamoeba invadens
STCTNCARGYYSLQKASVCTICRA

SEQ ID NO: 2805153 - protein, 24 aa, Entamoeba invadens
STCVTEGKTPFGIVKNIITFASTD

SEQ ID NO: 2805154 - protein, 24 aa, Entamoeba invadens
STCYPETLISPRIIVGTMCGNDVL

SEQ ID NO: 2805155 - protein, 19 aa, Entamoeba invadens
STDIFCKYVRMLETKVQMH

SEQ ID NO: 2805156 - protein, 18 aa, Entamoeba invadens
STEAYKFNSILNGISGDV

SEQ ID NO: 2805157 - protein, 21 aa, Entamoeba invadens
STECLSCNSGYYLSNGECRVC

SEQ ID NO: 2805158 - protein, 24 aa, Entamoeba invadens
STEGKGLWYKFIGTTALPNKAGYN

SEQ ID NO: 2805159 - protein, 19 aa, Entamoeba invadens
STEIDWLIIVSRILMIIVV

SEQ ID NO: 2805160 - protein, 18 aa, Entamoeba invadens
STELKYTPPNPFVKWINV

SEQ ID NO: 2805161 - protein, 20 aa, Entamoeba invadens
STETCLYCADNWYVNNNTCS

SEQ ID NO: 2805162 - protein, 24 aa, Entamoeba invadens
STETFRYDWNFGVVRITKSVRVTV

SEQ ID NO: 2805163 - protein, 25 aa, Entamoeba invadens
STFCLSCKDGMFLSDHKCITNNDLD

SEQ ID NO: 2805164 - protein, 24 aa, Entamoeba invadens
STFCYNCFFNNLIINNGVCVNSNC

SEQ ID NO: 2805165 - protein, 24 aa, Entamoeba invadens
STFGAEMNFHLSVTKSVITSSVNI

SEQ ID NO: 2805166 - protein, 17 aa, Entamoeba invadens
STFKISLVQIISTCLAL

SEQ ID NO: 2805167 - protein, 17 aa, Entamoeba invadens
STFKYSIRTEPQIASIP

SEQ ID NO: 2805168 - protein, 21 aa, Entamoeba invadens
STFSKCSKCAFWHKPSVDGTF

SEQ ID NO: 2805169 - protein, 17 aa, Entamoeba invadens
STGCSLCNKTNYYPDEF

SEQ ID NO: 2805170 - protein, 24 aa, Entamoeba invadens
STGEAPCLTRCVAHLIPRVNRLCC

SEQ ID NO: 2805171 - protein, 25 aa, Entamoeba invadens
STGGFKVVGTYLVYLSTLKCQVGHL

SEQ ID NO: 2805172 - protein, 21 aa, Entamoeba invadens
STGIFGYRFCATFAECVFISL

SEQ ID NO: 2805173 - protein, 20 aa, Entamoeba invadens
STGISTIWCNDEFYIDNGVC

SEQ ID NO: 2805174 - protein, 24 aa, Entamoeba invadens
STGKCLTCYNGYYIDNEECVEIKH

SEQ ID NO: 2805175 - protein, 18 aa, Entamoeba invadens
STGLFPICEIGRYRRYTQ

SEQ ID NO: 2805176 - protein, 22 aa, Entamoeba invadens
STGNCQAGLFGDSFQCILCNTG

SEQ ID NO: 2805177 - protein, 23 aa, Entamoeba invadens
STGYCLSCVTGFVLSASPSQHCI

SEQ ID NO: 2805178 - protein, 17 aa, Entamoeba invadens
STGYCMSCVTGFVLSAS

SEQ ID NO: 2805179 - protein, 32 aa, Entamoeba invadens
STHCALSSPFGCIRCGDGYFLSHNKNCEICDG

SEQ ID NO: 2805180 - protein, 23 aa, Entamoeba invadens
STHHSCVLCNDGFLLLNNSCETA

SEQ ID NO: 2805181 - protein, 25 aa, Entamoeba invadens
STHLKEHWIYIIVGYFIMPVFSLLG

SEQ ID NO: 2805182 - protein, 20 aa, Entamoeba invadens
STICDYCPFLTYSNRGWPHC

SEQ ID NO: 2805183 - protein, 20 aa, Entamoeba invadens
STICIVMPVIMFFSYMMYGG

SEQ ID NO: 2805184 - protein, 24 aa, Entamoeba invadens
STIELKKPLFIIGLPRSGTTFLHH

SEQ ID NO: 2805185 - protein, 19 aa, Entamoeba invadens
STIFNDFIWTFRLFTTPRD

SEQ ID NO: 2805186 - protein, 25 aa, Entamoeba invadens
STINFLKCTEKLLQISVEGITMANC

SEQ ID NO: 2805187 - protein, 17 aa, Entamoeba invadens
STITFKKGGSIIVKSGA

SEQ ID NO: 2805188 - protein, 23 aa, Entamoeba invadens
STKCLKCKSNFFISNYHCFTNQD

SEQ ID NO: 2805189 - protein, 22 aa, Entamoeba invadens
STKCLSCPHNTFLSNYKCNTNK

SEQ ID NO: 2805190 - protein, 20 aa, Entamoeba invadens
STKCLSCPPNTYLSNNNCNT

SEQ ID NO: 2805191 - protein, 22 aa, Entamoeba invadens
STKCYTCDGGFYLFNYACFECM

SEQ ID NO: 2805192 - protein, 18 aa, Entamoeba invadens
STKFCLNCDKQRGVCSEC

SEQ ID NO: 2805193 - protein, 23 aa, Entamoeba invadens
STKKELEKVFGYSKLPADKFLSI

SEQ ID NO: 2805194 - protein, 19 aa, Entamoeba invadens
STKKLDCEGDLKVINWDDL

SEQ ID NO: 2805195 - protein, 30 aa, Entamoeba invadens
STKLFDVFAMLSVLGCQFFVVKYEFSIELT

SEQ ID NO: 2805196 - protein, 22 aa, Entamoeba invadens
STKMCLSCAGNMISTGTSCVEC

SEQ ID NO: 2805197 - protein, 23 aa, Entamoeba invadens
STKTPCVIAFTFSYDNENSKIRM

SEQ ID NO: 2805198 - protein, 26 aa, Entamoeba invadens
STKTPFLMWYFFSFKNNVPHMVNNKN

SEQ ID NO: 2805199 - protein, 22 aa, Entamoeba invadens
STKTPFLMWYFFSVKNNIPHMV

SEQ ID NO: 2805200 - protein, 20 aa, Entamoeba invadens
STKTVGIPVCITCYSPYQIN

SEQ ID NO: 2805201 - protein, 20 aa, Entamoeba invadens
STKVDWPVVIPKMYESLKQH

SEQ ID NO: 2805202 - protein, 24 aa, Entamoeba invadens
STKVKFKFVIDSAKGIEYLHSNGI

SEQ ID NO: 2805203 - protein, 18 aa, Entamoeba invadens
STKVRYRILYVLDALGKW

SEQ ID NO: 2805204 - protein, 20 aa, Entamoeba invadens
STKYLFRFLNNIFQLNTLIL

SEQ ID NO: 2805205 - protein, 19 aa, Entamoeba invadens
STLCSSGFFSDEFRCSKLL

SEQ ID NO: 2805206 - protein, 35 aa, Entamoeba invadens
STLEFFWGVDMFVYRKARINYHFIFDMNNYKYSFL

SEQ ID NO: 2805207 - protein, 17 aa, Entamoeba invadens
STLERADGFGVEILPML

SEQ ID NO: 2805208 - protein, 30 aa, Entamoeba invadens
STLFDAFYILRSEDWYMHLLMTPLGISTCA

SEQ ID NO: 2805209 - protein, 23 aa, Entamoeba invadens
STLFLNRCGEWLQIVGPSENVVN

SEQ ID NO: 2805210 - protein, 17 aa, Entamoeba invadens
STLFQWSIEGSFISLGE

SEQ ID NO: 2805211 - protein, 20 aa, Entamoeba invadens
STLFVAYSMVYLRLLAKGIS

SEQ ID NO: 2805212 - protein, 36 aa, Entamoeba invadens
STLKGAGCTVANCYSCSSSSLSTCTACYYKYYLENN

SEQ ID NO: 2805213 - protein, 23 aa, Entamoeba invadens
STLKKLDAVNVVITGEVTIEGEA

SEQ ID NO: 2805214 - protein, 24 aa, Entamoeba invadens
STLLRCCRQWILNGIEIDFESVIT

SEQ ID NO: 2805215 - protein, 18 aa, Entamoeba invadens
STLQPNCLECVSYNGNHC

SEQ ID NO: 2805216 - protein, 19 aa, Entamoeba invadens
STLRLCSKICTYFNESKDT

SEQ ID NO: 2805217 - protein, 26 aa, Entamoeba invadens
STLTFCGGIVMYLTFYSLYFVMYSLP

SEQ ID NO: 2805218 - protein, 27 aa, Entamoeba invadens
STLVCKLCKGGYAFKENTSICLDSKEI

SEQ ID NO: 2805219 - protein, 18 aa, Entamoeba invadens
STMCKSCSSTCLSCDDTN

SEQ ID NO: 2805220 - protein, 33 aa, Entamoeba invadens
STMQFKSMHLFMILQVLGSIVFYHSSGEMCVCQ

SEQ ID NO: 2805221 - protein, 19 aa, Entamoeba invadens
STMTGCLKCGGSGQCTFCS

SEQ ID NO: 2805222 - protein, 23 aa, Entamoeba invadens
STMTKCLFCENSRLLPDNMCHIN

SEQ ID NO: 2805223 - protein, 28 aa, Entamoeba invadens
STMYEVIWRLVLVFANCVVLVFFLWSLR

SEQ ID NO: 2805224 - protein, 21 aa, Entamoeba invadens
STNVVKGRGIGVVVATGKVTE

SEQ ID NO: 2805225 - protein, 17 aa, Entamoeba invadens
STNYKTSFGDCLPRYTI

SEQ ID NO: 2805226 - protein, 25 aa, Entamoeba invadens
STPAYVVFFLVRLVPEFMLHLQNGV

SEQ ID NO: 2805227 - protein, 20 aa, Entamoeba invadens
STQCTSCGNGNVLIDGNCYS

SEQ ID NO: 2805228 - protein, 24 aa, Entamoeba invadens
STQLKVRICQDIAKGMDYLHQNNI

SEQ ID NO: 2805229 - protein, 18 aa, Entamoeba invadens
STRESLYFLFFNSNVLNN

SEQ ID NO: 2805230 - protein, 18 aa, Entamoeba invadens
STRFIYDFGSAVAGKSLL

SEQ ID NO: 2805231 - protein, 20 aa, Entamoeba invadens
STRFLLPRYILNNLRHEHIG

SEQ ID NO: 2805232 - protein, 21 aa, Entamoeba invadens
STSAKTAWLGGFHTINTDYTY

SEQ ID NO: 2805233 - protein, 22 aa, Entamoeba invadens
STSCLTCAAGTYSASGSSSCSI

SEQ ID NO: 2805234 - protein, 24 aa, Entamoeba invadens
STSCSSCPKGTFSNYGSSSCSNCP

SEQ ID NO: 2805235 - protein, 35 aa, Entamoeba invadens
STSFKLSVLYNLPLNYVISLKFVWVKNEQIETEYC

SEQ ID NO: 2805236 - protein, 20 aa, Entamoeba invadens
STSKCSPCLIQHCKTCDTSS

SEQ ID NO: 2805237 - protein, 25 aa, Entamoeba invadens
STSKFPSFFGRETFPDNIARVLGRL

SEQ ID NO: 2805238 - protein, 26 aa, Entamoeba invadens
STSTKCTSCGILFVLLTNGSCVNYSK

SEQ ID NO: 2805239 - protein, 25 aa, Entamoeba invadens
STSVCLICADGYYLYNGACVPCTTK

SEQ ID NO: 2805240 - protein, 19 aa, Entamoeba invadens
STSVDWLIILSRIFMIIVV

SEQ ID NO: 2805241 - protein, 17 aa, Entamoeba invadens
STTAEYINKCLLLTNSG

SEQ ID NO: 2805242 - protein, 24 aa, Entamoeba invadens
STTCILCSTGFVLDVNNKCVAKTT

SEQ ID NO: 2805243 - protein, 20 aa, Entamoeba invadens
STTCMSCREGYVLQQYGGNV

SEQ ID NO: 2805244 - protein, 17 aa, Entamoeba invadens
STTCVACPSGSYNPYPN

SEQ ID NO: 2805245 - protein, 24 aa, Entamoeba invadens
STTCVACSVSMCATCTKETAATKC

SEQ ID NO: 2805246 - protein, 24 aa, Entamoeba invadens
STTERKCILCQYDFAYLVNDVCVL

SEQ ID NO: 2805247 - protein, 22 aa, Entamoeba invadens
STTICKLTLKNSTTMKITKNYD

SEQ ID NO: 2805248 - protein, 29 aa, Entamoeba invadens
STTKVNAPFLFMGGLFLGAAGVFVRPFDG

SEQ ID NO: 2805249 - protein, 27 aa, Entamoeba invadens
STTSILECLDGFYLNDGVCHKCTENVV

SEQ ID NO: 2805250 - protein, 23 aa, Entamoeba invadens
STTSWSGISLFSFKVNSNYYRVT

SEQ ID NO: 2805251 - protein, 24 aa, Entamoeba invadens
STVCGKLTDFGTCRNISERSLSAK

SEQ ID NO: 2805252 - protein, 26 aa, Entamoeba invadens
STVLFHFKKRITFLISGIVQIIVFVM

SEQ ID NO: 2805253 - protein, 17 aa, Entamoeba invadens
STVLHLFSNFVVPQNVL

SEQ ID NO: 2805254 - protein, 25 aa, Entamoeba invadens
STVVTLRAALLIIYRTTTNSLLVKS

SEQ ID NO: 2805255 - protein, 17 aa, Entamoeba invadens
STYCFSCSDGCFFDDVE

SEQ ID NO: 2805256 - protein, 19 aa, Entamoeba invadens
STYCSSCPSSPTLCESCID

SEQ ID NO: 2805257 - protein, 23 aa, Entamoeba invadens
STYMCWLVLPLLMKERGDADPFM

SEQ ID NO: 2805258 - protein, 26 aa, Entamoeba invadens
STYMGIEPVCMFDFLKNKDVNLTNKR

SEQ ID NO: 2805259 - protein, 23 aa, Entamoeba invadens
STYQAKVSFDFERMKVSIRLKII

SEQ ID NO: 2805260 - protein, 19 aa, Entamoeba invadens
STYRGCVVCKDGFMRNIDG

SEQ ID NO: 2805261 - protein, 18 aa, Entamoeba invadens
SVAIKKMRGSAVTEDQLK

SEQ ID NO: 2805262 - protein, 22 aa, Entamoeba invadens
SVAQCLSCRFGSILHLNDKTNL

SEQ ID NO: 2805263 - protein, 26 aa, Entamoeba invadens
SVAQRILKCIFQYLLSLLETIVRYVN

SEQ ID NO: 2805264 - protein, 20 aa, Entamoeba invadens
SVASLQCVACRTFDTNCVKC

SEQ ID NO: 2805265 - protein, 24 aa, Entamoeba invadens
SVCIKCKIGYILRNGLCSMYYNIF

SEQ ID NO: 2805266 - protein, 19 aa, Entamoeba invadens
SVCQGRIDAVWLWVNGSDE

SEQ ID NO: 2805267 - protein, 20 aa, Entamoeba invadens
SVCRTCPPGTFSDGTDSKCL

SEQ ID NO: 2805268 - protein, 20 aa, Entamoeba invadens
SVCSEDDFSCDVVINVSCAF

SEQ ID NO: 2805269 - protein, 19 aa, Entamoeba invadens
SVCVIGRMSKIIVTGDVNG

SEQ ID NO: 2805270 - protein, 22 aa, Entamoeba invadens
SVCYNCPNLQYSLGSASQCKQC

SEQ ID NO: 2805271 - protein, 17 aa, Entamoeba invadens
SVDCFLQLFLRNTTNDF

SEQ ID NO: 2805272 - protein, 20 aa, Entamoeba invadens
SVDCTGCLAGYSPRGYLTCE

SEQ ID NO: 2805273 - protein, 17 aa, Entamoeba invadens
SVDRRKPYTYGYWFKLV

SEQ ID NO: 2805274 - protein, 23 aa, Entamoeba invadens
SVECLMCARKYYLKEGNCYESQK

SEQ ID NO: 2805275 - protein, 18 aa, Entamoeba invadens
SVELSGTMNRYYTGTLGL

SEQ ID NO: 2805276 - protein, 19 aa, Entamoeba invadens
SVEVFWEIVETMSVETLKA

SEQ ID NO: 2805277 - protein, 21 aa, Entamoeba invadens
SVEYKEFLQTFVVPNGELIDL

SEQ ID NO: 2805278 - protein, 27 aa, Entamoeba invadens
SVFAHQRIELIDWKKIKIRYSPPEILD

SEQ ID NO: 2805279 - protein, 18 aa, Entamoeba invadens
SVFDPHCKICATDFSRKC

SEQ ID NO: 2805280 - protein, 17 aa, Entamoeba invadens
SVFELISLCWDNNPNQR

SEQ ID NO: 2805281 - protein, 23 aa, Entamoeba invadens
SVFEVAFDLGIPVSLYVINRTQS

SEQ ID NO: 2805282 - protein, 25 aa, Entamoeba invadens
SVFRGTVVEVCWNRVEKLVVSKEIE

SEQ ID NO: 2805283 - protein, 27 aa, Entamoeba invadens
SVFSIHYFLFVCFSLWIPQIYQNFVSN

SEQ ID NO: 2805284 - protein, 24 aa, Entamoeba invadens
SVFVGGVCTLWFNKITIIQIVHVT

SEQ ID NO: 2805285 - protein, 20 aa, Entamoeba invadens
SVGAASFLALMAYFQELQMT

SEQ ID NO: 2805286 - protein, 25 aa, Entamoeba invadens
SVGASCCLLVWAYLVRKQNKNFVMG

SEQ ID NO: 2805287 - protein, 26 aa, Entamoeba invadens
SVGCGYDECSYCNWANTCTQCYSGSH

SEQ ID NO: 2805288 - protein, 26 aa, Entamoeba invadens
SVGDFCVLCVHGFVLRNGTCYKYHKS

SEQ ID NO: 2805289 - protein, 32 aa, Entamoeba invadens
SVGFALGIAFYFDWRVSACVLAATPIFIISIV

SEQ ID NO: 2805290 - protein, 32 aa, Entamoeba invadens
SVGFGIGVAFYFDWRIALCVIAVTPILITVVF

SEQ ID NO: 2805291 - protein, 19 aa, Entamoeba invadens
SVGGVAWSTYFRYFSAGGF

SEQ ID NO: 2805292 - protein, 20 aa, Entamoeba invadens
SVGKRPRLVNLLDKQYQVVI

SEQ ID NO: 2805293 - protein, 18 aa, Entamoeba invadens
SVGMNCLQEPGINQRVVP

SEQ ID NO: 2805294 - protein, 24 aa, Entamoeba invadens
SVGNFYFKGGISIETASLKDSTNF

SEQ ID NO: 2805295 - protein, 20 aa, Entamoeba invadens
SVGTLFCFVCISYVCMVDTL

SEQ ID NO: 2805296 - protein, 17 aa, Entamoeba invadens
SVHFCPQTRIISRGKTK

SEQ ID NO: 2805297 - protein, 25 aa, Entamoeba invadens
SVIANILALWAFYPSFRGPSHTHSA

SEQ ID NO: 2805298 - protein, 24 aa, Entamoeba invadens
SVIIGVIMFIYFGRKNPNRSNPYN

SEQ ID NO: 2805299 - protein, 21 aa, Entamoeba invadens
SVINFYKLRGIGNLIKEIMLK

SEQ ID NO: 2805300 - protein, 20 aa, Entamoeba invadens
SVIPRCKTCIENCTKCSNQY

SEQ ID NO: 2805301 - protein, 17 aa, Entamoeba invadens
SVISSTIPLVFMSKNGY

SEQ ID NO: 2805302 - protein, 27 aa, Entamoeba invadens
SVITLFPFDIIRWIGFGCTLCVATTLI

SEQ ID NO: 2805303 - protein, 21 aa, Entamoeba invadens
SVIYLLCVFVLVSFGLVTILY

SEQ ID NO: 2805304 - protein, 23 aa, Entamoeba invadens
SVKKESFSILTLYTDNHINFQYG

SEQ ID NO: 2805305 - protein, 26 aa, Entamoeba invadens
SVKTQLKSGTFAFKEACNGVVLTDLP

SEQ ID NO: 2805306 - protein, 24 aa, Entamoeba invadens
SVLCLLPLLIVMIFLILPSLIKCI

SEQ ID NO: 2805307 - protein, 28 aa, Entamoeba invadens
SVLGIFCAFVITLVCSKIRLLMLRVHLD

SEQ ID NO: 2805308 - protein, 19 aa, Entamoeba invadens
SVLGQFLIYRLIHLANTLL

SEQ ID NO: 2805309 - protein, 25 aa, Entamoeba invadens
SVLGSTFCFKSLYIDEILLKSIDGK

SEQ ID NO: 2805310 - protein, 20 aa, Entamoeba invadens
SVLHRCLRILQDRNREEIFS

SEQ ID NO: 2805311 - protein, 17 aa, Entamoeba invadens
SVLLFPITSCLAVVALF

SEQ ID NO: 2805312 - protein, 20 aa, Entamoeba invadens
SVLLFPSFVANYFPINLYHA

SEQ ID NO: 2805313 - protein, 21 aa, Entamoeba invadens
SVLLSFAFAFFIPVKTVQIGT

SEQ ID NO: 2805314 - protein, 19 aa, Entamoeba invadens
SVLMVGVFCMPRLGGETFG

SEQ ID NO: 2805315 - protein, 25 aa, Entamoeba invadens
SVLPPEWYISVSMGIVVSLVWFYYT

SEQ ID NO: 2805316 - protein, 17 aa, Entamoeba invadens
SVLPRLLMEQLAKTNNT

SEQ ID NO: 2805317 - protein, 26 aa, Entamoeba invadens
SVLTCEFKKVLVLSVSLFFVLMSGAL

SEQ ID NO: 2805318 - protein, 22 aa, Entamoeba invadens
SVMELWKKLDVFEELTDDGAKS

SEQ ID NO: 2805319 - protein, 17 aa, Entamoeba invadens
SVMKFMCTDDIFFYVTV

SEQ ID NO: 2805320 - protein, 17 aa, Entamoeba invadens
SVMYKKDITITVRTCSS

SEQ ID NO: 2805321 - protein, 20 aa, Entamoeba invadens
SVNGSLSYDYMGYVVAMDQN

SEQ ID NO: 2805322 - protein, 27 aa, Entamoeba invadens
SVNVLNRLKTVIIYSLETAEFFVKNVR

SEQ ID NO: 2805323 - protein, 24 aa, Entamoeba invadens
SVPFYVCALVAYVPPLLLLVLFSF

SEQ ID NO: 2805324 - protein, 27 aa, Entamoeba invadens
SVPVMCTDVLVGLCLDYDIFLFTRVLE

SEQ ID NO: 2805325 - protein, 24 aa, Entamoeba invadens
SVQALQRILGEYVFDRLNSFEDEF

SEQ ID NO: 2805326 - protein, 20 aa, Entamoeba invadens
SVQHSLPFLGELTAAVNSCV

SEQ ID NO: 2805327 - protein, 26 aa, Entamoeba invadens
SVQISCAYCSPGVCSTSKGQCVCEGN

SEQ ID NO: 2805328 - protein, 28 aa, Entamoeba invadens
SVQTVVVLPFRAGIVAKPGNLRIKTGTE

SEQ ID NO: 2805329 - protein, 17 aa, Entamoeba invadens
SVRAMQILGMMFLAHKN

SEQ ID NO: 2805330 - protein, 18 aa, Entamoeba invadens
SVRENICFLTSYDKKQYQ

SEQ ID NO: 2805331 - protein, 26 aa, Entamoeba invadens
SVRGESSLKCTLEKSSVFSQVQKFSE

SEQ ID NO: 2805332 - protein, 24 aa, Entamoeba invadens
SVRMPKIIGMVIEYAPYGSLRNNF

SEQ ID NO: 2805333 - protein, 20 aa, Entamoeba invadens
SVRSQMCIFNEVLANKVPFF

SEQ ID NO: 2805334 - protein, 20 aa, Entamoeba invadens
SVRTFKCTKENEFTFGETFS

SEQ ID NO: 2805335 - protein, 25 aa, Entamoeba invadens
SVSENITLCLYKGSNCTTWDDTGAC

SEQ ID NO: 2805336 - protein, 26 aa, Entamoeba invadens
SVSGCLQCSIGYYLYHKECYRCDDKC

SEQ ID NO: 2805337 - protein, 23 aa, Entamoeba invadens
SVSGCVMCSIGFYQVDSLNVEGK

SEQ ID NO: 2805338 - protein, 18 aa, Entamoeba invadens
SVSGTWSIYTNNLEVLVG

SEQ ID NO: 2805339 - protein, 17 aa, Entamoeba invadens
SVSIAGDITCTYLYLTT

SEQ ID NO: 2805340 - protein, 25 aa, Entamoeba invadens
SVSREWKFFGIINMKHFFLMTRPEK

SEQ ID NO: 2805341 - protein, 26 aa, Entamoeba invadens
SVSSCPICPAGTFSPAGASKCTYCGG

SEQ ID NO: 2805342 - protein, 23 aa, Entamoeba invadens
SVSSCPICPAGTYSSSGASSCTK

SEQ ID NO: 2805343 - protein, 17 aa, Entamoeba invadens
SVSSFSFASTFYFLTFS

SEQ ID NO: 2805344 - protein, 24 aa, Entamoeba invadens
SVTFKQIYTTTGFIVNPRYQLTFE

SEQ ID NO: 2805345 - protein, 18 aa, Entamoeba invadens
SVTGKRFDGVVSLDAKNV

SEQ ID NO: 2805346 - protein, 27 aa, Entamoeba invadens
SVTGSGCYRCKIGFYRVGLNCYKCQEK

SEQ ID NO: 2805347 - protein, 24 aa, Entamoeba invadens
SVTKCTPCSMGYYSRYSGSAVCTP

SEQ ID NO: 2805348 - protein, 18 aa, Entamoeba invadens
SVTLIMWKYPLKKFGECS

SEQ ID NO: 2805349 - protein, 23 aa, Entamoeba invadens
SVTLKAAVSVLRLLLSHDNLNLT

SEQ ID NO: 2805350 - protein, 25 aa, Entamoeba invadens
SVTLVVGVAYFWYRSFGFHPGFIMK

SEQ ID NO: 2805351 - protein, 18 aa, Entamoeba invadens
SVTRQIYFGKDAKINLLE

SEQ ID NO: 2805352 - protein, 22 aa, Entamoeba invadens
SVTSFFFTYAFLASFTGATREN

SEQ ID NO: 2805353 - protein, 24 aa, Entamoeba invadens
SVVACKRCKNGYVISNQKCVEMKS

SEQ ID NO: 2805354 - protein, 24 aa, Entamoeba invadens
SVVFPIFCVLSVGLLQYQNSVLSH

SEQ ID NO: 2805355 - protein, 20 aa, Entamoeba invadens
SVVIVFPCILLIATRSKIHS

SEQ ID NO: 2805356 - protein, 19 aa, Entamoeba invadens
SVVKDCWRQKMYDRIPIEE

SEQ ID NO: 2805357 - protein, 25 aa, Entamoeba invadens
SVVKESLSLFAKRMEAIHLPTELSY

SEQ ID NO: 2805358 - protein, 17 aa, Entamoeba invadens
SVVLSCERVEFFRDHAV

SEQ ID NO: 2805359 - protein, 26 aa, Entamoeba invadens
SVVLYRMLFGLAFGLIVYFGFQKWIG

SEQ ID NO: 2805360 - protein, 17 aa, Entamoeba invadens
SVVNSFKKTSGIPLSKV

SEQ ID NO: 2805361 - protein, 27 aa, Entamoeba invadens
SVVSYACPIPDGMYLESYQFPFFVFEK

SEQ ID NO: 2805362 - protein, 20 aa, Entamoeba invadens
SVVVPSGWAKLGAAALNNSV

SEQ ID NO: 2805363 - protein, 20 aa, Entamoeba invadens
SVVYFYSLYKNFIVVATSFL

SEQ ID NO: 2805364 - protein, 26 aa, Entamoeba invadens
SVYIDPKFTTLLGIKILLDVSKGMDF

SEQ ID NO: 2805365 - protein, 22 aa, Entamoeba invadens
SVYWLVRNGVVFGCKAGTYLTN

SEQ ID NO: 2805366 - protein, 19 aa, Entamoeba invadens
SWCPRSAERWKIEKIVEQL

SEQ ID NO: 2805367 - protein, 21 aa, Entamoeba invadens
SWDVSLVILSFVPITFISSMF

SEQ ID NO: 2805368 - protein, 27 aa, Entamoeba invadens
SWECYPISCPIAICAGAEKGVEYFVSV

SEQ ID NO: 2805369 - protein, 19 aa, Entamoeba invadens
SWEIAPSHRLGIHNLIHPM

SEQ ID NO: 2805370 - protein, 17 aa, Entamoeba invadens
SWEITKFFCEGKRLKKT

SEQ ID NO: 2805371 - protein, 39 aa, Entamoeba invadens
SWFEKEIPTRMEVFLIHIRRALMLFSHYPFLPKDPIVEI

SEQ ID NO: 2805372 - protein, 26 aa, Entamoeba invadens
SWNYPDCRYNHSLFDLDIQKFKNYEN

SEQ ID NO: 2805373 - protein, 25 aa, Entamoeba invadens
SWSFGKCFGFLFGGLLKTALGTNSL

SEQ ID NO: 2805374 - protein, 18 aa, Entamoeba invadens
SWSLGKAIGFVLGGPMKS

SEQ ID NO: 2805375 - protein, 21 aa, Entamoeba invadens
SWSNRCLKCEPTTFFNGEFCD

SEQ ID NO: 2805376 - protein, 20 aa, Entamoeba invadens
SWTNSCTIPSTFEIRKSAQI

SEQ ID NO: 2805377 - protein, 23 aa, Entamoeba invadens
SWYSQRLDWLGIFVSMCTLIVIV

SEQ ID NO: 2805378 - protein, 18 aa, Entamoeba invadens
SYANSFRIQKDFKELQFD

SEQ ID NO: 2805379 - protein, 24 aa, Entamoeba invadens
SYCATCFNSSYTGCYTCNNGYYLT

SEQ ID NO: 2805380 - protein, 25 aa, Entamoeba invadens
SYCNNCLRIGALVLVLHDIVDAIMY

SEQ ID NO: 2805381 - protein, 17 aa, Entamoeba invadens
SYCQCAENYTLIGHDCI

SEQ ID NO: 2805382 - protein, 18 aa, Entamoeba invadens
SYCTKCQFWYSPSSDKTN

SEQ ID NO: 2805383 - protein, 18 aa, Entamoeba invadens
SYCTLHCTTRLRGLKIPY

SEQ ID NO: 2805384 - protein, 20 aa, Entamoeba invadens
SYDFGLSMWNSLMISENVLY

SEQ ID NO: 2805385 - protein, 22 aa, Entamoeba invadens
SYDGIKVACEFLEESRFVLETS

SEQ ID NO: 2805386 - protein, 24 aa, Entamoeba invadens
SYDKFKFPWSIAEFVIKGSRLPKP

SEQ ID NO: 2805387 - protein, 22 aa, Entamoeba invadens
SYDLLCYARQTIVPGGGEVVLP

SEQ ID NO: 2805388 - protein, 25 aa, Entamoeba invadens
SYEAHATEAFALFSQLLYSKIVSIK

SEQ ID NO: 2805389 - protein, 18 aa, Entamoeba invadens
SYEAYRLFVPIILSPSLM

SEQ ID NO: 2805390 - protein, 19 aa, Entamoeba invadens
SYECLACKDGYFNIQSEGK

SEQ ID NO: 2805391 - protein, 18 aa, Entamoeba invadens
SYFDELKSVFPPTRLKFN

SEQ ID NO: 2805392 - protein, 18 aa, Entamoeba invadens
SYFFLLFWSVMYLAYIMV

SEQ ID NO: 2805393 - protein, 24 aa, Entamoeba invadens
SYFGTALLYFIGYIFPLIWMVQLF

SEQ ID NO: 2805394 - protein, 22 aa, Entamoeba invadens
SYFGTALLYFVGYIFPLIWMVQ

SEQ ID NO: 2805395 - protein, 17 aa, Entamoeba invadens
SYFLSIITFEISVSSNV

SEQ ID NO: 2805396 - protein, 19 aa, Entamoeba invadens
SYFVFKTQKGFLKWFGFSI

SEQ ID NO: 2805397 - protein, 26 aa, Entamoeba invadens
SYFYCNICGLNWIFPCVTMSFICYEY

SEQ ID NO: 2805398 - protein, 18 aa, Entamoeba invadens
SYGCKSCETNSTFCDECK

SEQ ID NO: 2805399 - protein, 20 aa, Entamoeba invadens
SYGGPCFNLLIGLGSGVLAR

SEQ ID NO: 2805400 - protein, 26 aa, Entamoeba invadens
SYGGPDCRKLCYYNGAFTIDSTNKCM

SEQ ID NO: 2805401 - protein, 31 aa, Entamoeba invadens
SYGLVMTLFCIWKLLNSFIHLVGLTSNRGTS

SEQ ID NO: 2805402 - protein, 29 aa, Entamoeba invadens
SYGPNRCKRCSSGFVLKGATCVKGENCLL

SEQ ID NO: 2805403 - protein, 25 aa, Entamoeba invadens
SYHCKKCGKCILRRDHHCPWIGQCV

SEQ ID NO: 2805404 - protein, 17 aa, Entamoeba invadens
SYIEPHCPCTGIHCVAV

SEQ ID NO: 2805405 - protein, 26 aa, Entamoeba invadens
SYIFSNGKCLLSFKPITTVIDSPYKE

SEQ ID NO: 2805406 - protein, 23 aa, Entamoeba invadens
SYISDLFLWHGRTAYKRTATLSH

SEQ ID NO: 2805407 - protein, 29 aa, Entamoeba invadens
SYKDPALCKTVLRLHKKWINVSTVALEWV

SEQ ID NO: 2805408 - protein, 19 aa, Entamoeba invadens
SYLAVDFFFLVSGFFVSYT

SEQ ID NO: 2805409 - protein, 24 aa, Entamoeba invadens
SYLCLIPQLIYFNFSFIEVKDFND

SEQ ID NO: 2805410 - protein, 26 aa, Entamoeba invadens
SYLSPRLIKCVTFITLYLLLIVVLYQ

SEQ ID NO: 2805411 - protein, 17 aa, Entamoeba invadens
SYMKLPHLLGSEIYFPS

SEQ ID NO: 2805412 - protein, 20 aa, Entamoeba invadens
SYNCVPCKPGYYANSSVSSC

SEQ ID NO: 2805413 - protein, 18 aa, Entamoeba invadens
SYNDVEWNEMASSSFTTS

SEQ ID NO: 2805414 - protein, 23 aa, Entamoeba invadens
SYNIIKNVCLYASDAGAIYSGRR

SEQ ID NO: 2805415 - protein, 17 aa, Entamoeba invadens
SYNKFILPENAVLQSSA

SEQ ID NO: 2805416 - protein, 20 aa, Entamoeba invadens
SYNLCLRAPLITNNGDDFKA

SEQ ID NO: 2805417 - protein, 27 aa, Entamoeba invadens
SYPFCWRSDTPLIYRAIPSWFVNVESF

SEQ ID NO: 2805418 - protein, 19 aa, Entamoeba invadens
SYPFTNSSSFIFTEQNHNS

SEQ ID NO: 2805419 - protein, 29 aa, Entamoeba invadens
SYPKDEFKYPWDVVTFVTKGWRLKLNGLN

SEQ ID NO: 2805420 - protein, 18 aa, Entamoeba invadens
SYPLRTLAIFYFITVADI

SEQ ID NO: 2805421 - protein, 22 aa, Entamoeba invadens
SYRCKKCQTSFYLSESKCVNYS

SEQ ID NO: 2805422 - protein, 19 aa, Entamoeba invadens
SYRKSFIMRSKMLFSTTPS

SEQ ID NO: 2805423 - protein, 19 aa, Entamoeba invadens
SYSCLSCSDGYFTISGESN

SEQ ID NO: 2805424 - protein, 18 aa, Entamoeba invadens
SYSDVEWNEMTSSYFSTT

SEQ ID NO: 2805425 - protein, 18 aa, Entamoeba invadens
SYSFSVVAWELFYAEEPF

SEQ ID NO: 2805426 - protein, 18 aa, Entamoeba invadens
SYSGLFCTQCDIHYYLAL

SEQ ID NO: 2805427 - protein, 19 aa, Entamoeba invadens
SYSQMILKVNQPIFVSSPK

SEQ ID NO: 2805428 - protein, 24 aa, Entamoeba invadens
SYSTEFFSYFSSIHPTFFVNYFMY

SEQ ID NO: 2805429 - protein, 23 aa, Entamoeba invadens
SYSVCTSCKFGYYLENTQCYSCR

SEQ ID NO: 2805430 - protein, 28 aa, Entamoeba invadens
SYTDCLYPNCLDCSIDRKVCLYCQPNYI

SEQ ID NO: 2805431 - protein, 25 aa, Entamoeba invadens
SYTKDKFKFCWNVVDFVTKGSRLEQ

SEQ ID NO: 2805432 - protein, 22 aa, Entamoeba invadens
SYVDRWGYDQTLLNALVIDKQQ

SEQ ID NO: 2805433 - protein, 23 aa, Entamoeba invadens
SYVFPCAFVLAARRIGKAKGRNE

SEQ ID NO: 2805434 - protein, 18 aa, Entamoeba invadens
SYVLFGLALCMILVIGGV

SEQ ID NO: 2805435 - protein, 20 aa, Entamoeba invadens
SYVLGLFLQFLMIITDRIIY

SEQ ID NO: 2805436 - protein, 20 aa, Entamoeba invadens
SYVLICLIVQIKIVEIIVIV

SEQ ID NO: 2805437 - protein, 33 aa, Entamoeba invadens
SYVLNCWSGYFIGQSFKCVSCRQGYIKVGDLCK

SEQ ID NO: 2805438 - protein, 19 aa, Entamoeba invadens
SYVNVPLFVTKIIDLTSVT

SEQ ID NO: 2805439 - protein, 32 aa, Entamoeba invadens
SYYTLQMAKSWYSQRLDWLGIILAVATVTGIV

SEQ ID NO: 2805440 - protein, 32 aa, Entamoeba invadens
SYYTLQMAKSWYSQRLDWLGIIVSIITVLVIV

SEQ ID NO: 2805441 - protein, 25 aa, Entamoeba invadens
TAASGTSVWWFSFVVSEHTLGVKSV

SEQ ID NO: 2805442 - protein, 27 aa, Entamoeba invadens
TAASKLNLFEEFDCNLYAKDGTNQLKL

SEQ ID NO: 2805443 - protein, 25 aa, Entamoeba invadens
TAAYILKIIYFRGVVRENCNLIMKV

SEQ ID NO: 2805444 - protein, 20 aa, Entamoeba invadens
TACESCPSGFYLSKENKCVS

SEQ ID NO: 2805445 - protein, 18 aa, Entamoeba invadens
TACLSCYEGYYLTNSAQE

SEQ ID NO: 2805446 - protein, 21 aa, Entamoeba invadens
TACRLIPLLLLFGISEDLCNV

SEQ ID NO: 2805447 - protein, 21 aa, Entamoeba invadens
TACTIVKFIALGVYGLGCEDG

SEQ ID NO: 2805448 - protein, 17 aa, Entamoeba invadens
TAEAPISMLDDFTSIAT

SEQ ID NO: 2805449 - protein, 20 aa, Entamoeba invadens
TAECRYVFSGNGVYVDNQDD

SEQ ID NO: 2805450 - protein, 23 aa, Entamoeba invadens
TAEIPGYFPYYYNYIVVQSAAVE

SEQ ID NO: 2805451 - protein, 21 aa, Entamoeba invadens
TAESVLSGYIHRIVKPEDDGK

SEQ ID NO: 2805452 - protein, 17 aa, Entamoeba invadens
TAFAKFRTETILWGDWM

SEQ ID NO: 2805453 - protein, 23 aa, Entamoeba invadens
TAFCKEIKISARSKLSTRLDPDD

SEQ ID NO: 2805454 - protein, 22 aa, Entamoeba invadens
TAFEFAESMTKIGAKAFFSNMM

SEQ ID NO: 2805455 - protein, 20 aa, Entamoeba invadens
TAFFWCDYVLKNVYNVSIKL

SEQ ID NO: 2805456 - protein, 26 aa, Entamoeba invadens
TAFLNKASQCGICYEAVGELGSVRFM

SEQ ID NO: 2805457 - protein, 20 aa, Entamoeba invadens
TAFPGEVVTLTFPKDLEIKT

SEQ ID NO: 2805458 - protein, 24 aa, Entamoeba invadens
TAFPNCVLCSQTLRQCKTCSIGLY

SEQ ID NO: 2805459 - protein, 24 aa, Entamoeba invadens
TAFPNCVLCSQTLRQCQTCSIGLY

SEQ ID NO: 2805460 - protein, 25 aa, Entamoeba invadens
TAFQKAFLFTCVFAFQSLLLYVIKT

SEQ ID NO: 2805461 - protein, 25 aa, Entamoeba invadens
TAFTVEFKPLIPMNRMNKVLMTPFL

SEQ ID NO: 2805462 - protein, 26 aa, Entamoeba invadens
TAGLSECLGCLAGFYSLKNASSCTPC

SEQ ID NO: 2805463 - protein, 17 aa, Entamoeba invadens
TAIPCNKLQDDTMYTPD

SEQ ID NO: 2805464 - protein, 26 aa, Entamoeba invadens
TAIPLIVCPLICCFLPPLLEKVFGSD

SEQ ID NO: 2805465 - protein, 25 aa, Entamoeba invadens
TAIRVFDFIIWNGFDCGALTVIVTV

SEQ ID NO: 2805466 - protein, 22 aa, Entamoeba invadens
TALKCQIGYGFTLGGTCKPCEA

SEQ ID NO: 2805467 - protein, 20 aa, Entamoeba invadens
TALLLGILYWFNNRKKVNYG

SEQ ID NO: 2805468 - protein, 29 aa, Entamoeba invadens
TALLYAFGYIFPVVWIFQLFLIFNPAPQT

SEQ ID NO: 2805469 - protein, 25 aa, Entamoeba invadens
TAMLAFPVLLIFIVRWVNSNEPKIW

SEQ ID NO: 2805470 - protein, 17 aa, Entamoeba invadens
TANCDVCDKDDKCTKCK

SEQ ID NO: 2805471 - protein, 27 aa, Entamoeba invadens
TAPDWKCLLESNFVPTCGNGGYVKVNV

SEQ ID NO: 2805472 - protein, 26 aa, Entamoeba invadens
TAPLCSIALRPLRLLSTIGITPPLFR

SEQ ID NO: 2805473 - protein, 25 aa, Entamoeba invadens
TAPVLKRNFLNLGVLEDLMRQCEVQ

SEQ ID NO: 2805474 - protein, 17 aa, Entamoeba invadens
TASCKKCKTGSNCLTCE

SEQ ID NO: 2805475 - protein, 29 aa, Entamoeba invadens
TASGLYRFTFRINLVLSKCHGFSNFYILN

SEQ ID NO: 2805476 - protein, 26 aa, Entamoeba invadens
TASREIYLGAAFVFWVLFNVKVFEEL

SEQ ID NO: 2805477 - protein, 18 aa, Entamoeba invadens
TASSVVRPQVSMSTSKLF

SEQ ID NO: 2805478 - protein, 23 aa, Entamoeba invadens
TASTFVLCVFIVFSTIIGLIELQ

SEQ ID NO: 2805479 - protein, 24 aa, Entamoeba invadens
TASTLLWYPNIIFFGKVSLDNPFT

SEQ ID NO: 2805480 - protein, 17 aa, Entamoeba invadens
TATKFIGNYILKNFTTN

SEQ ID NO: 2805481 - protein, 22 aa, Entamoeba invadens
TATYCKKCTTANCLECNNNNEC

SEQ ID NO: 2805482 - protein, 19 aa, Entamoeba invadens
TATYYEWHKVCLASSDSTH

SEQ ID NO: 2805483 - protein, 24 aa, Entamoeba invadens
TAVFAEDCFKCEKDGLYCVKDGKH

SEQ ID NO: 2805484 - protein, 19 aa, Entamoeba invadens
TAVPLYLSQLQPFGVLQSI

SEQ ID NO: 2805485 - protein, 17 aa, Entamoeba invadens
TAVWWVILLIIVIVISI

SEQ ID NO: 2805486 - protein, 17 aa, Entamoeba invadens
TAWELFYQEEPFKEFKS

SEQ ID NO: 2805487 - protein, 21 aa, Entamoeba invadens
TAWKAFWGRKKMDVAAIPTLS

SEQ ID NO: 2805488 - protein, 27 aa, Entamoeba invadens
TAYPPQRFKFSWNIADFVTEGKRLEKP

SEQ ID NO: 2805489 - protein, 17 aa, Entamoeba invadens
TAYRKTMNFKKREVLEV

SEQ ID NO: 2805490 - protein, 20 aa, Entamoeba invadens
TAYSRTSYNLAVAQTDLVAR

SEQ ID NO: 2805491 - protein, 41 aa, Entamoeba invadens
TCAGIYRYLPKKWKFTTMWNGRVAIMAIRFTILLLTTLFAS

SEQ ID NO: 2805492 - protein, 26 aa, Entamoeba invadens
TCAKCNTSLCQTCYSSSYCLTCAENK

SEQ ID NO: 2805493 - protein, 20 aa, Entamoeba invadens
TCDGDGKPDVCITCTDGTNA

SEQ ID NO: 2805494 - protein, 20 aa, Entamoeba invadens
TCDGDGKPDVCITCTDGTTA

SEQ ID NO: 2805495 - protein, 17 aa, Entamoeba invadens
TCDIGYYTDSQICFNCN

SEQ ID NO: 2805496 - protein, 26 aa, Entamoeba invadens
TCDIISGKCLTCYAGYGFGHNGNCEI

SEQ ID NO: 2805497 - protein, 28 aa, Entamoeba invadens
TCDQFASFKSGCVVCKDGYYRVGLDCFK

SEQ ID NO: 2805498 - protein, 25 aa, Entamoeba invadens
TCDSKSGVCLSCYAGSKLSEGTCIE

SEQ ID NO: 2805499 - protein, 23 aa, Entamoeba invadens
TCDSTLGCIMCNKGFYPESKTCS

SEQ ID NO: 2805500 - protein, 19 aa, Entamoeba invadens
TCDTCKAGTYAGQGSSECK

SEQ ID NO: 2805501 - protein, 24 aa, Entamoeba invadens
TCDTSSSCLLCFSDYLNTSLLCEF

SEQ ID NO: 2805502 - protein, 20 aa, Entamoeba invadens
TCDVKSGLCSKCVQNNVVTS

SEQ ID NO: 2805503 - protein, 28 aa, Entamoeba invadens
TCEKCTSIPKCVLCTLYGECRQCIYGHY

SEQ ID NO: 2805504 - protein, 31 aa, Entamoeba invadens
TCESCLDLTMCLSCVDGFFLSDHICKSNDAL

SEQ ID NO: 2805505 - protein, 19 aa, Entamoeba invadens
TCETCSGPLASNCLSCGSG

SEQ ID NO: 2805506 - protein, 20 aa, Entamoeba invadens
TCETCSGPLDSNCLSCGSGR

SEQ ID NO: 2805507 - protein, 18 aa, Entamoeba invadens
TCEYKYYKVDGECKKCEV

SEQ ID NO: 2805508 - protein, 17 aa, Entamoeba invadens
TCFLVVLFASVRYNKRI

SEQ ID NO: 2805509 - protein, 27 aa, Entamoeba invadens
TCFNATYCLSCRPILEFLNKDNKCELT

SEQ ID NO: 2805510 - protein, 26 aa, Entamoeba invadens
TCFNATYCLSCRPTLEFLNKDNKCES

SEQ ID NO: 2805511 - protein, 18 aa, Entamoeba invadens
TCFNSTYCLSCRPELEFL

SEQ ID NO: 2805512 - protein, 21 aa, Entamoeba invadens
TCGFALGIAFYYEWKTALCIL

SEQ ID NO: 2805513 - protein, 21 aa, Entamoeba invadens
TCGHTDMLTAIHVIYENGGKC

SEQ ID NO: 2805514 - protein, 31 aa, Entamoeba invadens
TCGILYWVTKKFKLGWKIPTLTLVLLLTSFV

SEQ ID NO: 2805515 - protein, 17 aa, Entamoeba invadens
TCGKGRYLNNNQCVSCD

SEQ ID NO: 2805516 - protein, 25 aa, Entamoeba invadens
TCGKKRIVTGYIRNAFMLLQSRVVV

SEQ ID NO: 2805517 - protein, 26 aa, Entamoeba invadens
TCHSVECPFWLAPEVIKTSQFELESD

SEQ ID NO: 2805518 - protein, 18 aa, Entamoeba invadens
TCIECPAGTYQSVDFSSC

SEQ ID NO: 2805519 - protein, 21 aa, Entamoeba invadens
TCIECTSGFILDGGICTSIKI

SEQ ID NO: 2805520 - protein, 24 aa, Entamoeba invadens
TCIEFCGATEETSRIPVATESREL

SEQ ID NO: 2805521 - protein, 20 aa, Entamoeba invadens
TCIIAIPALIYSIFADRMLP

SEQ ID NO: 2805522 - protein, 28 aa, Entamoeba invadens
TCIKEFSSIISICLGGFIGVALLAIYAI

SEQ ID NO: 2805523 - protein, 22 aa, Entamoeba invadens
TCIPCITFDKNCLVCSTDYSPK

SEQ ID NO: 2805524 - protein, 21 aa, Entamoeba invadens
TCIRCKNTLLVNGSCIGVDSN

SEQ ID NO: 2805525 - protein, 25 aa, Entamoeba invadens
TCISCSVSLCSVCDADSTKCEKCSA

SEQ ID NO: 2805526 - protein, 22 aa, Entamoeba invadens
TCIVSSKITTEWCKYSDKIECV

SEQ ID NO: 2805527 - protein, 18 aa, Entamoeba invadens
TCKCTTKNCALCDNNNAC

SEQ ID NO: 2805528 - protein, 17 aa, Entamoeba invadens
TCKIRYDIDSNDTIGDW

SEQ ID NO: 2805529 - protein, 28 aa, Entamoeba invadens
TCKNGISCLKCSLNYFYDIEENLLCNSY

SEQ ID NO: 2805530 - protein, 22 aa, Entamoeba invadens
TCKQCSLPYTLSEGICKYCYEA

SEQ ID NO: 2805531 - protein, 19 aa, Entamoeba invadens
TCKTGYYLSNGYCVPCNSN

SEQ ID NO: 2805532 - protein, 19 aa, Entamoeba invadens
TCKTPCGIDQIRYTDDTCG

SEQ ID NO: 2805533 - protein, 19 aa, Entamoeba invadens
TCKYCKNSYLLNNQCENYD

SEQ ID NO: 2805534 - protein, 20 aa, Entamoeba invadens
TCLCVIGIVPFIFIQMGVLP

SEQ ID NO: 2805535 - protein, 25 aa, Entamoeba invadens
TCLECPQNCLRCVEHKCVSCETDYY

SEQ ID NO: 2805536 - protein, 18 aa, Entamoeba invadens
TCLHCIIITAPLFLLTLF

SEQ ID NO: 2805537 - protein, 17 aa, Entamoeba invadens
TCLKCASEYFLLTNSTK

SEQ ID NO: 2805538 - protein, 20 aa, Entamoeba invadens
TCLKCKNGFALDGTTCQSCS

SEQ ID NO: 2805539 - protein, 17 aa, Entamoeba invadens
TCLKCLPYTYYDNNSKN

SEQ ID NO: 2805540 - protein, 17 aa, Entamoeba invadens
TCLLCNNNYFLANGVCQ

SEQ ID NO: 2805541 - protein, 20 aa, Entamoeba invadens
TCLLGLIPDIFFLIQRKSIF

SEQ ID NO: 2805542 - protein, 17 aa, Entamoeba invadens
TCLMCKDSFILSPNACN

SEQ ID NO: 2805543 - protein, 23 aa, Entamoeba invadens
TCLTIVFVYGCASMVFCNDYFDF

SEQ ID NO: 2805544 - protein, 19 aa, Entamoeba invadens
TCLVTEFAEHGSLYSLIKT

SEQ ID NO: 2805545 - protein, 20 aa, Entamoeba invadens
TCNCVFCRMKETLLQNKYIP

SEQ ID NO: 2805546 - protein, 21 aa, Entamoeba invadens
TCNGAKCLKYNDEGCGKSSTG

SEQ ID NO: 2805547 - protein, 17 aa, Entamoeba invadens
TCNKCATISHCIDYAND

SEQ ID NO: 2805548 - protein, 24 aa, Entamoeba invadens
TCNLEHFKTYSGVCKLKNETLGCS

SEQ ID NO: 2805549 - protein, 20 aa, Entamoeba invadens
TCNSSTCLSCSSSFVYDYEL

SEQ ID NO: 2805550 - protein, 26 aa, Entamoeba invadens
TCNYCPFPCSACYYPGVNGNCSKCYT

SEQ ID NO: 2805551 - protein, 19 aa, Entamoeba invadens
TCPCEGNECIITFQKQKKV

SEQ ID NO: 2805552 - protein, 17 aa, Entamoeba invadens
TCQICGIDKLYIIDNGS

SEQ ID NO: 2805553 - protein, 20 aa, Entamoeba invadens
TCQICSLKTFNFNNIKCEIA

SEQ ID NO: 2805554 - protein, 25 aa, Entamoeba invadens
TCRPDGSCMSVCFGGFNQDDDCSTC

SEQ ID NO: 2805555 - protein, 17 aa, Entamoeba invadens
TCRSCLNAFYLDNGICS

SEQ ID NO: 2805556 - protein, 27 aa, Entamoeba invadens
TCSEILPNCEMCMDGKCIKCLDNTIYT

SEQ ID NO: 2805557 - protein, 21 aa, Entamoeba invadens
TCSGCNPQAVVLCSDNTLIYQ

SEQ ID NO: 2805558 - protein, 20 aa, Entamoeba invadens
TCSKMGVIGFVAWNILTIVY

SEQ ID NO: 2805559 - protein, 22 aa, Entamoeba invadens
TCSNCIPGTYSMNGSKYCSECP

SEQ ID NO: 2805560 - protein, 21 aa, Entamoeba invadens
TCSNGNVVFFDFFYSAVCIMT

SEQ ID NO: 2805561 - protein, 23 aa, Entamoeba invadens
TCSRCKNTTCKQCRGDGNECTAC

SEQ ID NO: 2805562 - protein, 19 aa, Entamoeba invadens
TCSSCGVGYHINTNNSCSS

SEQ ID NO: 2805563 - protein, 23 aa, Entamoeba invadens
TCSSCGVTNCYTCQSSTTCKTCY

SEQ ID NO: 2805564 - protein, 30 aa, Entamoeba invadens
TCSSCIADYCLTCFEGYMLVDGRCISSTTT

SEQ ID NO: 2805565 - protein, 17 aa, Entamoeba invadens
TCSSCKDGEYSLSGSSA

SEQ ID NO: 2805566 - protein, 17 aa, Entamoeba invadens
TCSSRESCLTCKNGDVL

SEQ ID NO: 2805567 - protein, 17 aa, Entamoeba invadens
TCSSYGICESCISSEVL

SEQ ID NO: 2805568 - protein, 18 aa, Entamoeba invadens
TCSTCLTKYFPNSGQCAL

SEQ ID NO: 2805569 - protein, 17 aa, Entamoeba invadens
TCSVCNDDSFLIDDTKK

SEQ ID NO: 2805570 - protein, 18 aa, Entamoeba invadens
TCSVSSYKCTDCYDGYFT

SEQ ID NO: 2805571 - protein, 24 aa, Entamoeba invadens
TCTACYTPFYLKDGVCIHCDNNCK

SEQ ID NO: 2805572 - protein, 20 aa, Entamoeba invadens
TCTFGYLCFLILVKWIHFIP

SEQ ID NO: 2805573 - protein, 21 aa, Entamoeba invadens
TCTGKCLFYTLKILNDCSLTV

SEQ ID NO: 2805574 - protein, 17 aa, Entamoeba invadens
TCTKCLAGYFSKSGDAT

SEQ ID NO: 2805575 - protein, 18 aa, Entamoeba invadens
TCTKCPAGYFSKSGDATC

SEQ ID NO: 2805576 - protein, 19 aa, Entamoeba invadens
TCTKCSADLKFKEDEKNCT

SEQ ID NO: 2805577 - protein, 18 aa, Entamoeba invadens
TCTLCGDLTYSEGGVLQC

SEQ ID NO: 2805578 - protein, 18 aa, Entamoeba invadens
TCTSCITGASLIDNKCVT

SEQ ID NO: 2805579 - protein, 18 aa, Entamoeba invadens
TCTTPTLCQVCSNGFTLV

SEQ ID NO: 2805580 - protein, 18 aa, Entamoeba invadens
TCTTPTTCQLCLNGFSLV

SEQ ID NO: 2805581 - protein, 18 aa, Entamoeba invadens
TCTYKRDLGCESFSGDKC

SEQ ID NO: 2805582 - protein, 20 aa, Entamoeba invadens
TCVDCPVGSLLLEDTKTCIK

SEQ ID NO: 2805583 - protein, 18 aa, Entamoeba invadens
TCVDGLSCLSCRNEYFKL

SEQ ID NO: 2805584 - protein, 23 aa, Entamoeba invadens
TCVGDLNYIFSIFKNITTLNIDC

SEQ ID NO: 2805585 - protein, 20 aa, Entamoeba invadens
TCVKDKCPEMYYKSEADKMC

SEQ ID NO: 2805586 - protein, 21 aa, Entamoeba invadens
TCVKSQCGTVGYEMDENGKCY

SEQ ID NO: 2805587 - protein, 25 aa, Entamoeba invadens
TCVNASYCLSCPNNSFLNAQNQCEP

SEQ ID NO: 2805588 - protein, 35 aa, Entamoeba invadens
TCVPTTNGIRWGVCIVPEFIMCFLIIGVSCAMFVH

SEQ ID NO: 2805589 - protein, 18 aa, Entamoeba invadens
TCVSCSFWYVPSTDGTFC

SEQ ID NO: 2805590 - protein, 23 aa, Entamoeba invadens
TCVSCSVSSCSVCDTDSTKCDKC

SEQ ID NO: 2805591 - protein, 30 aa, Entamoeba invadens
TCYDCQITNCFKCFYDAQGYKCNACYEGFY

SEQ ID NO: 2805592 - protein, 18 aa, Entamoeba invadens
TCYIVFQLDVEYCYTYLY

SEQ ID NO: 2805593 - protein, 20 aa, Entamoeba invadens
TCYKEECFITLDNFKEKSYF

SEQ ID NO: 2805594 - protein, 20 aa, Entamoeba invadens
TCYKQECFITLENFNEKSYF

SEQ ID NO: 2805595 - protein, 19 aa, Entamoeba invadens
TCYMTLYCTTKLKGMKIPY

SEQ ID NO: 2805596 - protein, 17 aa, Entamoeba invadens
TCYPCSVSCKTCIETPS

SEQ ID NO: 2805597 - protein, 18 aa, Entamoeba invadens
TDAECLKMADDGCSKTST

SEQ ID NO: 2805598 - protein, 24 aa, Entamoeba invadens
TDAVSHRTSIRFVPQSGTLSPGVG

SEQ ID NO: 2805599 - protein, 22 aa, Entamoeba invadens
TDAWCCLVTVIYFSYLFGFLHQ

SEQ ID NO: 2805600 - protein, 25 aa, Entamoeba invadens
TDAYPKQSFTYAWDIVDFVVNGKRL

SEQ ID NO: 2805601 - protein, 20 aa, Entamoeba invadens
TDCDDYYTTRICKNTINIDF

SEQ ID NO: 2805602 - protein, 17 aa, Entamoeba invadens
TDCVVIVDRDFKFYIEG

SEQ ID NO: 2805603 - protein, 25 aa, Entamoeba invadens
TDCYKCKNKLFLRDGKCLSCGDIYN

SEQ ID NO: 2805604 - protein, 21 aa, Entamoeba invadens
TDCYKCVDFATNNCGDDGYIV

SEQ ID NO: 2805605 - protein, 25 aa, Entamoeba invadens
TDDGYYLNGEFVFHKKITMAEYLNP

SEQ ID NO: 2805606 - protein, 19 aa, Entamoeba invadens
TDECIQCKNSSNYSIGVTI

SEQ ID NO: 2805607 - protein, 21 aa, Entamoeba invadens
TDFDPKCAICASDSSRNCVTC

SEQ ID NO: 2805608 - protein, 28 aa, Entamoeba invadens
TDFECVKCLYPCLRCVTSSSLCVQCSEG

SEQ ID NO: 2805609 - protein, 22 aa, Entamoeba invadens
TDFEFLKNCFVHMKDEPDIEKN

SEQ ID NO: 2805610 - protein, 27 aa, Entamoeba invadens
TDFFGCARNSLKPSVGMSEGDHVCNID

SEQ ID NO: 2805611 - protein, 17 aa, Entamoeba invadens
TDFKGIMTENVMKVFET

SEQ ID NO: 2805612 - protein, 20 aa, Entamoeba invadens
TDFKSAKYIGLKFDTFPYFG

SEQ ID NO: 2805613 - protein, 23 aa, Entamoeba invadens
TDFPTEFSQFLGLKELDLSDNKL

SEQ ID NO: 2805614 - protein, 19 aa, Entamoeba invadens
TDFSRKCVECLTGYYPDLL

SEQ ID NO: 2805615 - protein, 17 aa, Entamoeba invadens
TDFSSRIIIGKSCTEEV

SEQ ID NO: 2805616 - protein, 17 aa, Entamoeba invadens
TDGCSSTSRLARMVASL

SEQ ID NO: 2805617 - protein, 19 aa, Entamoeba invadens
TDGECYRSLGGTIKLNKKS

SEQ ID NO: 2805618 - protein, 24 aa, Entamoeba invadens
TDGISKCILFCFSNDLCCYLVIRP

SEQ ID NO: 2805619 - protein, 22 aa, Entamoeba invadens
TDGKCSKCTFWHSPSENGTYCT

SEQ ID NO: 2805620 - protein, 22 aa, Entamoeba invadens
TDGNCKLLTSGVLLDTTLKQRK

SEQ ID NO: 2805621 - protein, 24 aa, Entamoeba invadens
TDGTCKKCNFGVGCATCNKTECTK

SEQ ID NO: 2805622 - protein, 18 aa, Entamoeba invadens
TDGTRSCIQCISTYYISD

SEQ ID NO: 2805623 - protein, 28 aa, Entamoeba invadens
TDHCNMFGLVLICCLTAFSKQTETEKYT

SEQ ID NO: 2805624 - protein, 29 aa, Entamoeba invadens
TDHCNMFGLVLICCLTAFSKQTETEKYTT

SEQ ID NO: 2805625 - protein, 22 aa, Entamoeba invadens
TDHINFAAGYDWVLSQSPYNEV

SEQ ID NO: 2805626 - protein, 28 aa, Entamoeba invadens
TDHTILLMKGCARGVYYLHKLGIVHRDL

SEQ ID NO: 2805627 - protein, 19 aa, Entamoeba invadens
TDIDHSMLLYKTSADDETR

SEQ ID NO: 2805628 - protein, 25 aa, Entamoeba invadens
TDIIKNPLFISSLLRATKCQNFEVL

SEQ ID NO: 2805629 - protein, 22 aa, Entamoeba invadens
TDIRFVFPDTFINDASCFEFVS

SEQ ID NO: 2805630 - protein, 28 aa, Entamoeba invadens
TDIYSFAIVCYEVFLRKIPYQQFSHTWD

SEQ ID NO: 2805631 - protein, 22 aa, Entamoeba invadens
TDKDVLYLPKYVQIPQHDISRY

SEQ ID NO: 2805632 - protein, 24 aa, Entamoeba invadens
TDKLRPVVWKVLSGYLPEDTSLHE

SEQ ID NO: 2805633 - protein, 22 aa, Entamoeba invadens
TDKYFEALRMAFGTQAIFPGPI

SEQ ID NO: 2805634 - protein, 24 aa, Entamoeba invadens
TDKYRVSKWFKVDMNTFRSEYIQF

SEQ ID NO: 2805635 - protein, 19 aa, Entamoeba invadens
TDLIASICYYVTKCVSTFH

SEQ ID NO: 2805636 - protein, 18 aa, Entamoeba invadens
TDLMLDIIEKIRSGEIGR

SEQ ID NO: 2805637 - protein, 22 aa, Entamoeba invadens
TDLPNVCLMEKIYRLALVGKEP

SEQ ID NO: 2805638 - protein, 23 aa, Entamoeba invadens
TDLYNVIDMCWSKNPVERMKIED

SEQ ID NO: 2805639 - protein, 20 aa, Entamoeba invadens
TDLYSLTPYQAMKRAIFNSP

SEQ ID NO: 2805640 - protein, 17 aa, Entamoeba invadens
TDNLFLQNDFVWLLQSL

SEQ ID NO: 2805641 - protein, 20 aa, Entamoeba invadens
TDPALMCRISFILQATCSLT

SEQ ID NO: 2805642 - protein, 27 aa, Entamoeba invadens
TDPEFKFPWKIAKFISSGKRPEIPKDL

SEQ ID NO: 2805643 - protein, 21 aa, Entamoeba invadens
TDPLMRYLIVLHILFGELQNW

SEQ ID NO: 2805644 - protein, 27 aa, Entamoeba invadens
TDPYPKEYFKFAWSIADFVASGKNLDK

SEQ ID NO: 2805645 - protein, 20 aa, Entamoeba invadens
TDQFCFSACNAFAKQFREKN

SEQ ID NO: 2805646 - protein, 20 aa, Entamoeba invadens
TDQFKTPWDVAKFVVEGKRL

SEQ ID NO: 2805647 - protein, 18 aa, Entamoeba invadens
TDQNGLCHRVIQNCFRIV

SEQ ID NO: 2805648 - protein, 29 aa, Entamoeba invadens
TDRIYCFVSEFPFINALFAMLEDMERYDF

SEQ ID NO: 2805649 - protein, 24 aa, Entamoeba invadens
TDRTKCFACGEIMAGCTACTSGTV

SEQ ID NO: 2805650 - protein, 18 aa, Entamoeba invadens
TDSELFVNCGVCKLVNNK

SEQ ID NO: 2805651 - protein, 23 aa, Entamoeba invadens
TDSELNVNCGICKWDATQNKVVF

SEQ ID NO: 2805652 - protein, 17 aa, Entamoeba invadens
TDSFLLDNMCFNFWDSC

SEQ ID NO: 2805653 - protein, 25 aa, Entamoeba invadens
TDSKCSKCAFWSVPSSDGMSCESQV

SEQ ID NO: 2805654 - protein, 32 aa, Entamoeba invadens
TDSKYKPILTFFLSIYPLWDCHNPQHNTVIEL

SEQ ID NO: 2805655 - protein, 25 aa, Entamoeba invadens
TDSTKCFSCSIFNGCTLCDNTTPNK

SEQ ID NO: 2805656 - protein, 23 aa, Entamoeba invadens
TDSTRKCIVCNSGYYPKSDDDFR

SEQ ID NO: 2805657 - protein, 25 aa, Entamoeba invadens
TDSTRKCIVCSSGYYPKNDGDFRCR

SEQ ID NO: 2805658 - protein, 21 aa, Entamoeba invadens
TDSVVSPMVFFLSSTKTTAKY

SEQ ID NO: 2805659 - protein, 22 aa, Entamoeba invadens
TDTCSQCGNGVYNDGEECEKTD

SEQ ID NO: 2805660 - protein, 22 aa, Entamoeba invadens
TDTEGTFRLNVYTLIPPTHSTC

SEQ ID NO: 2805661 - protein, 19 aa, Entamoeba invadens
TDVAIQWNIDEHKIEECDI

SEQ ID NO: 2805662 - protein, 23 aa, Entamoeba invadens
TDVKRVYCKFCYEEISPDQSVAF

SEQ ID NO: 2805663 - protein, 25 aa, Entamoeba invadens
TDVKVKISLAMINYVIECRAEFTAS

SEQ ID NO: 2805664 - protein, 19 aa, Entamoeba invadens
TDVLIGGSIQCIRCGNTSP

SEQ ID NO: 2805665 - protein, 21 aa, Entamoeba invadens
TDVNWGYGFRYEVLSKYDNDT

SEQ ID NO: 2805666 - protein, 24 aa, Entamoeba invadens
TDVQFKHAWSIADFTTSGKRLQIP

SEQ ID NO: 2805667 - protein, 22 aa, Entamoeba invadens
TDWIEGFAILLAVLAVSLGGSA

SEQ ID NO: 2805668 - protein, 23 aa, Entamoeba invadens
TDWIEGLAILCAVFVVSFGSSIS

SEQ ID NO: 2805669 - protein, 24 aa, Entamoeba invadens
TDYKIPVNLGLDFTNYVSTRQWSC

SEQ ID NO: 2805670 - protein, 21 aa, Entamoeba invadens
TDYPMLKWTVIALLLVSVLLN

SEQ ID NO: 2805671 - protein, 25 aa, Entamoeba invadens
TDYQCLKCATGNYFSVESRSCVTTC

SEQ ID NO: 2805672 - protein, 26 aa, Entamoeba invadens
TDYSFTNLFAFSGFVPIGSYIILRSA

SEQ ID NO: 2805673 - protein, 26 aa, Entamoeba invadens
TDYSRKCIKCNAGFYIVNGLCQKCDS

SEQ ID NO: 2805674 - protein, 36 aa, Entamoeba invadens
TDYSRRAFYRLGLFSLLLHEVMLEFNMSWNNNGKEE

SEQ ID NO: 2805675 - protein, 24 aa, Entamoeba invadens
TEAKCIKSRSDGCGADSKLSKMVV

SEQ ID NO: 2805676 - protein, 27 aa, Entamoeba invadens
TEAQFKFPWNVVDFVLKGNRESKPDGM

SEQ ID NO: 2805677 - protein, 26 aa, Entamoeba invadens
TEASPYICCLFLLVAPMYSQLISLPY

SEQ ID NO: 2805678 - protein, 18 aa, Entamoeba invadens
TEATAIMDTRFQRIDLRN

SEQ ID NO: 2805679 - protein, 17 aa, Entamoeba invadens
TECESEYAITVQGRCVF

SEQ ID NO: 2805680 - protein, 17 aa, Entamoeba invadens
TECILCNAGSKLSGTTC

SEQ ID NO: 2805681 - protein, 19 aa, Entamoeba invadens
TECKECPSLYYTSINGSIS

SEQ ID NO: 2805682 - protein, 20 aa, Entamoeba invadens
TECKEKYYVNDNMCSLCHTS

SEQ ID NO: 2805683 - protein, 19 aa, Entamoeba invadens
TECKEKYYVNDNMCSPCHT

SEQ ID NO: 2805684 - protein, 17 aa, Entamoeba invadens
TECKSCDIGHYSSTYKS

SEQ ID NO: 2805685 - protein, 20 aa, Entamoeba invadens
TECQYRYTLQGGIVTMSVTN

SEQ ID NO: 2805686 - protein, 23 aa, Entamoeba invadens
TECSDECKTCLNKANNCLTCPEG

SEQ ID NO: 2805687 - protein, 21 aa, Entamoeba invadens
TECTECVKGYFLNLSECYKCS

SEQ ID NO: 2805688 - protein, 17 aa, Entamoeba invadens
TECTSCIATHILVDSQC

SEQ ID NO: 2805689 - protein, 19 aa, Entamoeba invadens
TECVEGFYLEGGECKTCDT

SEQ ID NO: 2805690 - protein, 17 aa, Entamoeba invadens
TECYLDMQYDLLIELSN

SEQ ID NO: 2805691 - protein, 20 aa, Entamoeba invadens
TEDFYFYIFIHLGQLSKAKI

SEQ ID NO: 2805692 - protein, 24 aa, Entamoeba invadens
TEDGLGRISFKWFGEEENDDDDVS

SEQ ID NO: 2805693 - protein, 23 aa, Entamoeba invadens
TEDKCLRCNDGFVFEGNNCVNIT

SEQ ID NO: 2805694 - protein, 18 aa, Entamoeba invadens
TEDKLCSIHEFYDMISDR

SEQ ID NO: 2805695 - protein, 27 aa, Entamoeba invadens
TEDLSGLFKWYWRGHWGDEKMGLLRLI

SEQ ID NO: 2805696 - protein, 18 aa, Entamoeba invadens
TEDVCLRCELGKYYEPTS

SEQ ID NO: 2805697 - protein, 22 aa, Entamoeba invadens
TEFAKFGSLMAMIKKKKKLDKY

SEQ ID NO: 2805698 - protein, 19 aa, Entamoeba invadens
TEFIPFGALSKLHQKENFP

SEQ ID NO: 2805699 - protein, 17 aa, Entamoeba invadens
TEFLKGDSFTEIYCPCF

SEQ ID NO: 2805700 - protein, 20 aa, Entamoeba invadens
TEFLKPLKYSPFENIISYGQ

SEQ ID NO: 2805701 - protein, 19 aa, Entamoeba invadens
TEFNTICGTIDLSLTSKYT

SEQ ID NO: 2805702 - protein, 20 aa, Entamoeba invadens
TEFPELTGPEWKKIQENGAH

SEQ ID NO: 2805703 - protein, 21 aa, Entamoeba invadens
TEFSSEVNLLFQNASSSMQQI

SEQ ID NO: 2805704 - protein, 21 aa, Entamoeba invadens
TEFTADVFLIIKSVHGTHKVF

SEQ ID NO: 2805705 - protein, 21 aa, Entamoeba invadens
TEFWCNTCSAGYFLYYVGSGV

SEQ ID NO: 2805706 - protein, 17 aa, Entamoeba invadens
TEGCLDCVDGYYSSDKM

SEQ ID NO: 2805707 - protein, 23 aa, Entamoeba invadens
TEGEASCLRCEDSFYFDDQSTPM

SEQ ID NO: 2805708 - protein, 34 aa, Entamoeba invadens
TEGICQSCSIYGEACLECQISGCELCDTGYVISN

SEQ ID NO: 2805709 - protein, 20 aa, Entamoeba invadens
TEGKSGWVITNIACVYQSNI

SEQ ID NO: 2805710 - protein, 23 aa, Entamoeba invadens
TEGRCVPCQAGTYRKGNSCYPCG

SEQ ID NO: 2805711 - protein, 19 aa, Entamoeba invadens
TEGRSLVNHFCITNECLSG

SEQ ID NO: 2805712 - protein, 20 aa, Entamoeba invadens
TEHRHMISPLIFDFGNTTED

SEQ ID NO: 2805713 - protein, 19 aa, Entamoeba invadens
TEICPIKTLIIDNTVASTN

SEQ ID NO: 2805714 - protein, 17 aa, Entamoeba invadens
TEIEISKKYIAATYLIT

SEQ ID NO: 2805715 - protein, 17 aa, Entamoeba invadens
TEIFSMQIIQKMEEFEY

SEQ ID NO: 2805716 - protein, 18 aa, Entamoeba invadens
TEIIKQWYEYYVVLCAPY

SEQ ID NO: 2805717 - protein, 26 aa, Entamoeba invadens
TEISHPRISLFFFFSLVSVGLFVAYL

SEQ ID NO: 2805718 - protein, 24 aa, Entamoeba invadens
TEKFLFITWGIFFLLTIPSVVVFS

SEQ ID NO: 2805719 - protein, 20 aa, Entamoeba invadens
TEKGILILECGMFISQITCG

SEQ ID NO: 2805720 - protein, 37 aa, Entamoeba invadens
TEKLKMRVEPPIVCIRKGEICEFKICITPQFTTNLDN

SEQ ID NO: 2805721 - protein, 20 aa, Entamoeba invadens
TEKLREKYCLFDMKNTNIDF

SEQ ID NO: 2805722 - protein, 20 aa, Entamoeba invadens
TELFLPFISLTGYKAPERYL

SEQ ID NO: 2805723 - protein, 20 aa, Entamoeba invadens
TELIKGLVMDHGTRHPGMPH

SEQ ID NO: 2805724 - protein, 43 aa, Entamoeba invadens
TELIVNCYLLLSWVYEFIVSLHIKRFMLPISFITLIVTFIPLV

SEQ ID NO: 2805725 - protein, 20 aa, Entamoeba invadens
TELKISYLAHNTCYIHNEPK

SEQ ID NO: 2805726 - protein, 25 aa, Entamoeba invadens
TELLKEDFRFFSLYNYSIVFMTVGL

SEQ ID NO: 2805727 - protein, 27 aa, Entamoeba invadens
TELQKRWLVTYSINWLPFVSLSKDFSE

SEQ ID NO: 2805728 - protein, 20 aa, Entamoeba invadens
TEMKELICSLFDTPQKHGFY

SEQ ID NO: 2805729 - protein, 19 aa, Entamoeba invadens
TENAFTLYVGCFNNENKCR

SEQ ID NO: 2805730 - protein, 24 aa, Entamoeba invadens
TENCDACSTLSVGVSNRTSCMANH

SEQ ID NO: 2805731 - protein, 25 aa, Entamoeba invadens
TENCNACSPISVGVSNCTTCMANHV

SEQ ID NO: 2805732 - protein, 26 aa, Entamoeba invadens
TENEVFCVLRITRIVLLISTLEFFWG

SEQ ID NO: 2805733 - protein, 31 aa, Entamoeba invadens
TENGVACAIWFFILACLSFFMTGIFGLITSL

SEQ ID NO: 2805734 - protein, 24 aa, Entamoeba invadens
TENIMKFKACSVGKGSYGYKDLIE

SEQ ID NO: 2805735 - protein, 23 aa, Entamoeba invadens
TENKARRGYGYKVVSETKLNNMS

SEQ ID NO: 2805736 - protein, 23 aa, Entamoeba invadens
TENMTFLHLMRWAKYVGKNGESA

SEQ ID NO: 2805737 - protein, 26 aa, Entamoeba invadens
TENPIMGSICLLANVAEMSTNSYVMF

SEQ ID NO: 2805738 - protein, 24 aa, Entamoeba invadens
TENVIPFDVYFFVSVRGFQTVNVT

SEQ ID NO: 2805739 - protein, 26 aa, Entamoeba invadens
TENVKRLHVYGEIFAENGFLQRSDKR

SEQ ID NO: 2805740 - protein, 22 aa, Entamoeba invadens
TEPIIKQYFFKNSKIDSYNGKL

SEQ ID NO: 2805741 - protein, 28 aa, Entamoeba invadens
TEPKIVTLKSGFACEFEMYIKPNFSCII

SEQ ID NO: 2805742 - protein, 28 aa, Entamoeba invadens
TEPKIVTLKSGFACEFEVFITPYCTMDL

SEQ ID NO: 2805743 - protein, 27 aa, Entamoeba invadens
TEPKLVNLKSGFACEFEIFITPHCTLN

SEQ ID NO: 2805744 - protein, 28 aa, Entamoeba invadens
TEPKLVTLKSGYACEFEVFLTPLCTINL

SEQ ID NO: 2805745 - protein, 22 aa, Entamoeba invadens
TEPYCPPSSMPYYLTPLKNITS

SEQ ID NO: 2805746 - protein, 20 aa, Entamoeba invadens
TEQTWDILHLLLFITTLVSL

SEQ ID NO: 2805747 - protein, 23 aa, Entamoeba invadens
TERKCITCSSGYYVLNGFCKACS

SEQ ID NO: 2805748 - protein, 17 aa, Entamoeba invadens
TERRCQKGFFLSDNYCW

SEQ ID NO: 2805749 - protein, 18 aa, Entamoeba invadens
TERTEAATQFTIFSDCCQ

SEQ ID NO: 2805750 - protein, 17 aa, Entamoeba invadens
TESCTWSSVKFGSVCVS

SEQ ID NO: 2805751 - protein, 28 aa, Entamoeba invadens
TESDTRYFCKIFGWEIDAEIAKYIQSFK

SEQ ID NO: 2805752 - protein, 24 aa, Entamoeba invadens
TESECDAWNSIIFDQIEKMKEVVK

SEQ ID NO: 2805753 - protein, 17 aa, Entamoeba invadens
TESEVVDLIQIQGQLDA

SEQ ID NO: 2805754 - protein, 18 aa, Entamoeba invadens
TESIKFDTLKLINSVAKY

SEQ ID NO: 2805755 - protein, 24 aa, Entamoeba invadens
TESRSFCFNSDFVFGPMLVYNETL

SEQ ID NO: 2805756 - protein, 33 aa, Entamoeba invadens
TESSCLNNKCGWCRATQTCGYCSNGGEFCTYEG

SEQ ID NO: 2805757 - protein, 25 aa, Entamoeba invadens
TESTLVIPCVSRFSNVNNIIPMDVI

SEQ ID NO: 2805758 - protein, 25 aa, Entamoeba invadens
TESVKRLHVYGEIFAENGFLQRSDR

SEQ ID NO: 2805759 - protein, 28 aa, Entamoeba invadens
TETILPLLIDIRLWRGVEYLFDYFVQEL

SEQ ID NO: 2805760 - protein, 23 aa, Entamoeba invadens
TETNFTLFVGMVEAFDCEMTVSM

SEQ ID NO: 2805761 - protein, 21 aa, Entamoeba invadens
TETYCQICLEGYYGIQVPGNN

SEQ ID NO: 2805762 - protein, 17 aa, Entamoeba invadens
TEVLDTRFERFVVKNNS

SEQ ID NO: 2805763 - protein, 23 aa, Entamoeba invadens
TEVPQNWMYFFLFNDRLVETEVL

SEQ ID NO: 2805764 - protein, 24 aa, Entamoeba invadens
TEVSERCSLVYSLIGGSDQCVEKN

SEQ ID NO: 2805765 - protein, 21 aa, Entamoeba invadens
TEVSWIKDLMTTMSIKEEQHQ

SEQ ID NO: 2805766 - protein, 20 aa, Entamoeba invadens
TEYFPAVNIVVKGNVNVKNI

SEQ ID NO: 2805767 - protein, 20 aa, Entamoeba invadens
TEYISHILGLIGSFLMGIIW

SEQ ID NO: 2805768 - protein, 20 aa, Entamoeba invadens
TEYIYCIVCYTGKNTKQALN

SEQ ID NO: 2805769 - protein, 23 aa, Entamoeba invadens
TEYLVRRCCAFYLGSNINFTVNK

SEQ ID NO: 2805770 - protein, 19 aa, Entamoeba invadens
TEYSVPFVRTARVNKTTQD

SEQ ID NO: 2805771 - protein, 18 aa, Entamoeba invadens
TFAVCMLHSFYVTQLANY

SEQ ID NO: 2805772 - protein, 17 aa, Entamoeba invadens
TFCDKYFECSKCENDNI

SEQ ID NO: 2805773 - protein, 26 aa, Entamoeba invadens
TFCKNAPVWWVIFLVVVWCFIVMVVA

SEQ ID NO: 2805774 - protein, 18 aa, Entamoeba invadens
TFCLKCDVNFFLSQNKCF

SEQ ID NO: 2805775 - protein, 20 aa, Entamoeba invadens
TFCQVCLPLTCGGDSTVYKY

SEQ ID NO: 2805776 - protein, 17 aa, Entamoeba invadens
TFCTICATTNYSINSSG

SEQ ID NO: 2805777 - protein, 28 aa, Entamoeba invadens
TFDEIKIELPFPLKNGHFLVFTIQEIAD

SEQ ID NO: 2805778 - protein, 19 aa, Entamoeba invadens
TFDGTKFEEYMCENFAHDE

SEQ ID NO: 2805779 - protein, 19 aa, Entamoeba invadens
TFECQKCENGLILINSNCK

SEQ ID NO: 2805780 - protein, 28 aa, Entamoeba invadens
TFEETMFFKWYIKHIKMDATGTMYDSAL

SEQ ID NO: 2805781 - protein, 19 aa, Entamoeba invadens
TFESGWADYLFGYTDADIR

SEQ ID NO: 2805782 - protein, 22 aa, Entamoeba invadens
TFFDVIVKFVLKYIGLLCGIIV

SEQ ID NO: 2805783 - protein, 26 aa, Entamoeba invadens
TFFGVFAEFIIGFTIAAEQEERQARK

SEQ ID NO: 2805784 - protein, 25 aa, Entamoeba invadens
TFFKLERFRKIVILKRGSSCDNLVE

SEQ ID NO: 2805785 - protein, 18 aa, Entamoeba invadens
TFFLLAYCIVFRNKPIVY

SEQ ID NO: 2805786 - protein, 23 aa, Entamoeba invadens
TFFNEMFELVNFMFSEQIIDECW

SEQ ID NO: 2805787 - protein, 18 aa, Entamoeba invadens
TFFTLCLSEIDPWIDNTK

SEQ ID NO: 2805788 - protein, 20 aa, Entamoeba invadens
TFGCSMCSDGYYTVNENQCA

SEQ ID NO: 2805789 - protein, 18 aa, Entamoeba invadens
TFGKAVTKFGNMAFKGVT

SEQ ID NO: 2805790 - protein, 26 aa, Entamoeba invadens
TFGKCGFSWIPVVIIVLIFGCLFFVY

SEQ ID NO: 2805791 - protein, 26 aa, Entamoeba invadens
TFGRMCRFWTMWSCWACLLYFFVAFC

SEQ ID NO: 2805792 - protein, 20 aa, Entamoeba invadens
TFGVIDCGKGQYSYGPSCDT

SEQ ID NO: 2805793 - protein, 18 aa, Entamoeba invadens
TFHFCFKFLHSTFLSVII

SEQ ID NO: 2805794 - protein, 24 aa, Entamoeba invadens
TFHSKMLLCKNVTIEVRNHSLINT

SEQ ID NO: 2805795 - protein, 20 aa, Entamoeba invadens
TFIDVPLRYWPFTYIAEIAF

SEQ ID NO: 2805796 - protein, 18 aa, Entamoeba invadens
TFILCFYSATLVMNLNTQ

SEQ ID NO: 2805797 - protein, 23 aa, Entamoeba invadens
TFISACFTNLWFLVSLGLSVGSF

SEQ ID NO: 2805798 - protein, 20 aa, Entamoeba invadens
TFKCTSCASSQVLISTEICV

SEQ ID NO: 2805799 - protein, 26 aa, Entamoeba invadens
TFKEQRAKFYAAQMVLAIEHLHNQGV

SEQ ID NO: 2805800 - protein, 26 aa, Entamoeba invadens
TFKFLPEPIAALLSMKTMMSEIKVNE

SEQ ID NO: 2805801 - protein, 20 aa, Entamoeba invadens
TFKFPWKIAEFVIHNNRLKR

SEQ ID NO: 2805802 - protein, 17 aa, Entamoeba invadens
TFLGEVKITCPVNSASF

SEQ ID NO: 2805803 - protein, 20 aa, Entamoeba invadens
TFLGLCYPAVKFMSSTTLLI

SEQ ID NO: 2805804 - protein, 23 aa, Entamoeba invadens
TFLHETLHALGFSSSTGTRKVSK

SEQ ID NO: 2805805 - protein, 22 aa, Entamoeba invadens
TFLKLAQTMSFEYSANMMMSRG

SEQ ID NO: 2805806 - protein, 21 aa, Entamoeba invadens
TFLLSRIIMLYGLNITVPSLK

SEQ ID NO: 2805807 - protein, 17 aa, Entamoeba invadens
TFLNILDTFPIAIFKNT

SEQ ID NO: 2805808 - protein, 18 aa, Entamoeba invadens
TFLRFFFTPYRVIIVKRF

SEQ ID NO: 2805809 - protein, 20 aa, Entamoeba invadens
TFLWLGKYTYTYTFSGSCCF

SEQ ID NO: 2805810 - protein, 22 aa, Entamoeba invadens
TFLWVLACGILLVSTGAVHFAK

SEQ ID NO: 2805811 - protein, 24 aa, Entamoeba invadens
TFLYTRVAITYSFVPFMIYTFEDS

SEQ ID NO: 2805812 - protein, 18 aa, Entamoeba invadens
TFMGCSVLNNVSRTQKVA

SEQ ID NO: 2805813 - protein, 24 aa, Entamoeba invadens
TFMSKLLLHIAMFVSEFRQENDQI

SEQ ID NO: 2805814 - protein, 25 aa, Entamoeba invadens
TFNIFFCKTETFVLGINSISKPTIT

SEQ ID NO: 2805815 - protein, 18 aa, Entamoeba invadens
TFNKLAINRCTRFVNPTK

SEQ ID NO: 2805816 - protein, 25 aa, Entamoeba invadens
TFNSARLDLLTALDTLAMAKSKTGS

SEQ ID NO: 2805817 - protein, 29 aa, Entamoeba invadens
TFNVNWKHLLIAFLLLIGFIVCVKTLRTP

SEQ ID NO: 2805818 - protein, 21 aa, Entamoeba invadens
TFNYSGVCGKVFTSPPNGPDD

SEQ ID NO: 2805819 - protein, 27 aa, Entamoeba invadens
TFPKLKKVCLEMCSFALHFPNKLQKLD

SEQ ID NO: 2805820 - protein, 22 aa, Entamoeba invadens
TFPMRESFVFLEAVKKSFTTQY

SEQ ID NO: 2805821 - protein, 20 aa, Entamoeba invadens
TFPRIKMMKMKDLTFVNKIA

SEQ ID NO: 2805822 - protein, 24 aa, Entamoeba invadens
TFQYGDTVLLHFDKEELLEFFYYP

SEQ ID NO: 2805823 - protein, 20 aa, Entamoeba invadens
TFSRTCIKCISGFYPNKVTG

SEQ ID NO: 2805824 - protein, 31 aa, Entamoeba invadens
TFSRYSFSFGTARFTALTAFIDTIDFFTNSS

SEQ ID NO: 2805825 - protein, 23 aa, Entamoeba invadens
TFSSVIAAFTFRAIYNTYINRPS

SEQ ID NO: 2805826 - protein, 18 aa, Entamoeba invadens
TFSTFGFNAITDVKTIDG

SEQ ID NO: 2805827 - protein, 20 aa, Entamoeba invadens
TFSVESRATLFVSTCTQTLL

SEQ ID NO: 2805828 - protein, 23 aa, Entamoeba invadens
TFSVRCEKCCLQVTTNEIVVPAR

SEQ ID NO: 2805829 - protein, 25 aa, Entamoeba invadens
TFSVSFYGVSAWAYLNGNHKIKLLK

SEQ ID NO: 2805830 - protein, 17 aa, Entamoeba invadens
TFTAFISVNCSCKVVDH

SEQ ID NO: 2805831 - protein, 18 aa, Entamoeba invadens
TFTFPMFCTIVTRLSSSI

SEQ ID NO: 2805832 - protein, 18 aa, Entamoeba invadens
TFTLILFHFLVLIFLLVE

SEQ ID NO: 2805833 - protein, 23 aa, Entamoeba invadens
TFTLKSSALFVLLKKAIFTAGTT

SEQ ID NO: 2805834 - protein, 17 aa, Entamoeba invadens
TFTRGVGTPSFMAPEIL

SEQ ID NO: 2805835 - protein, 19 aa, Entamoeba invadens
TFVCASIPLNHFVNSQTLT

SEQ ID NO: 2805836 - protein, 18 aa, Entamoeba invadens
TFVFPWNIAEFVSRGLRP

SEQ ID NO: 2805837 - protein, 22 aa, Entamoeba invadens
TFVIPVRIPVFFSTDLATDSKK

SEQ ID NO: 2805838 - protein, 27 aa, Entamoeba invadens
TFVKIYTCCFEIIEPTVFTKCNQTLAV

SEQ ID NO: 2805839 - protein, 23 aa, Entamoeba invadens
TFVPKFMRFYLSQMTNIYFLCNL

SEQ ID NO: 2805840 - protein, 24 aa, Entamoeba invadens
TFVVKLLEIVMDWYASGGNVKTDV

SEQ ID NO: 2805841 - protein, 25 aa, Entamoeba invadens
TFWKDKRLGFFGEIIHNIKFVKYNG

SEQ ID NO: 2805842 - protein, 19 aa, Entamoeba invadens
TFYETLKWGEAYDKEEFKF

SEQ ID NO: 2805843 - protein, 20 aa, Entamoeba invadens
TFYETLKWGEAYDKEEFKFP

SEQ ID NO: 2805844 - protein, 19 aa, Entamoeba invadens
TFYETLKWGEAYDKKEFKF

SEQ ID NO: 2805845 - protein, 20 aa, Entamoeba invadens
TFYETLKWGEAYDKNEFKFP

SEQ ID NO: 2805846 - protein, 19 aa, Entamoeba invadens
TGAFSVHLIVGGLVLIFIV

SEQ ID NO: 2805847 - protein, 23 aa, Entamoeba invadens
TGCAGKCKPGFFAQNSSQINCTA

SEQ ID NO: 2805848 - protein, 17 aa, Entamoeba invadens
TGCAPVLRHKVWNTKLF

SEQ ID NO: 2805849 - protein, 19 aa, Entamoeba invadens
TGCASCYDGSYRSGLECFP

SEQ ID NO: 2805850 - protein, 19 aa, Entamoeba invadens
TGCETCLPNYLLVNNQCVK

SEQ ID NO: 2805851 - protein, 24 aa, Entamoeba invadens
TGCGLCKSGYVFKDKNCLKCHESC

SEQ ID NO: 2805852 - protein, 30 aa, Entamoeba invadens
TGCVKYSKYGCISCVIGYYLSNAVCFQCSE

SEQ ID NO: 2805853 - protein, 22 aa, Entamoeba invadens
TGDCNICSVGYFASYDACELCP

SEQ ID NO: 2805854 - protein, 18 aa, Entamoeba invadens
TGDCSICPSGQKEVDSIC

SEQ ID NO: 2805855 - protein, 20 aa, Entamoeba invadens
TGDILECWNQSGDCGAAKDN

SEQ ID NO: 2805856 - protein, 30 aa, Entamoeba invadens
TGDMGEGLLQLLLKEFKSALVGTQNLGIEA

SEQ ID NO: 2805857 - protein, 22 aa, Entamoeba invadens
TGEFCLVCKNLSYTKNLISHSC

SEQ ID NO: 2805858 - protein, 19 aa, Entamoeba invadens
TGEKCCTRIGLASYSNDAV

SEQ ID NO: 2805859 - protein, 22 aa, Entamoeba invadens
TGETCSKCSVGYILVNNKQCLK

SEQ ID NO: 2805860 - protein, 19 aa, Entamoeba invadens
TGETLCVLKELRVIEEKCD

SEQ ID NO: 2805861 - protein, 23 aa, Entamoeba invadens
TGFDEKCDYCFAPTVLTLKNTCV

SEQ ID NO: 2805862 - protein, 23 aa, Entamoeba invadens
TGFDLCGSIACFAPFTPSKKTIL

SEQ ID NO: 2805863 - protein, 20 aa, Entamoeba invadens
TGFIEINAGFVFGGIEKIKR

SEQ ID NO: 2805864 - protein, 18 aa, Entamoeba invadens
TGFLLRVGLIMYGMYQDK

SEQ ID NO: 2805865 - protein, 20 aa, Entamoeba invadens
TGGFVRFKDCQSLRNKVVKI

SEQ ID NO: 2805866 - protein, 23 aa, Entamoeba invadens
TGGGCAICKDGFYKVEKDCISCD

SEQ ID NO: 2805867 - protein, 24 aa, Entamoeba invadens
TGGGCAICKDGFYKVEKDCISCDE

SEQ ID NO: 2805868 - protein, 24 aa, Entamoeba invadens
TGGGCAICKDGYYKIFKDCIVCDV

SEQ ID NO: 2805869 - protein, 24 aa, Entamoeba invadens
TGGGCAICKVGYFKVEKDCDACDE

SEQ ID NO: 2805870 - protein, 20 aa, Entamoeba invadens
TGGGCAVCKDGYYKENKDCL

SEQ ID NO: 2805871 - protein, 24 aa, Entamoeba invadens
TGGYEMLKVLLIVEKKLEWMSKLL

SEQ ID NO: 2805872 - protein, 19 aa, Entamoeba invadens
TGGYSFGMRIMGIRGGENI

SEQ ID NO: 2805873 - protein, 17 aa, Entamoeba invadens
TGHCTSIEKCLIYSSSY

SEQ ID NO: 2805874 - protein, 23 aa, Entamoeba invadens
TGICKTCSSGLIFKNPLSTICEP

SEQ ID NO: 2805875 - protein, 19 aa, Entamoeba invadens
TGIDCLRCDKTHFSTALPT

SEQ ID NO: 2805876 - protein, 18 aa, Entamoeba invadens
TGIFPLPINITLCGDAYL

SEQ ID NO: 2805877 - protein, 18 aa, Entamoeba invadens
TGIKPEWLNKQGCSDKAQ

SEQ ID NO: 2805878 - protein, 23 aa, Entamoeba invadens
TGKAEIVPGVLFIDEVHMLDLEC

SEQ ID NO: 2805879 - protein, 24 aa, Entamoeba invadens
TGKCFKCLDGFYLVSGQCALCNKT

SEQ ID NO: 2805880 - protein, 24 aa, Entamoeba invadens
TGKCFKCLDGFYLVSGQCALCNNT

SEQ ID NO: 2805881 - protein, 25 aa, Entamoeba invadens
TGKCFKCLDGFYLVSGQCALCNNTI

SEQ ID NO: 2805882 - protein, 20 aa, Entamoeba invadens
TGKCLSCRKGRGMVNGICED

SEQ ID NO: 2805883 - protein, 17 aa, Entamoeba invadens
TGKCLSCSSNSVFSEDK

SEQ ID NO: 2805884 - protein, 22 aa, Entamoeba invadens
TGKCSVCASGFTKPVSDNQICD

SEQ ID NO: 2805885 - protein, 21 aa, Entamoeba invadens
TGKCTSCPAGRYLTNLNQCPL

SEQ ID NO: 2805886 - protein, 24 aa, Entamoeba invadens
TGKCTSCSIGSGFVSDGICEQCKA

SEQ ID NO: 2805887 - protein, 23 aa, Entamoeba invadens
TGKEFYINVTIYFILLARTCLIK

SEQ ID NO: 2805888 - protein, 26 aa, Entamoeba invadens
TGKPFPLGFRTHRCLVGDNKGLVFGE

SEQ ID NO: 2805889 - protein, 24 aa, Entamoeba invadens
TGLGIAVAMFIMFGSFSLGSWYAS

SEQ ID NO: 2805890 - protein, 17 aa, Entamoeba invadens
TGLKIYVKESFTGTFGI

SEQ ID NO: 2805891 - protein, 17 aa, Entamoeba invadens
TGLKKTCVGKFEMGLSR

SEQ ID NO: 2805892 - protein, 17 aa, Entamoeba invadens
TGLLLSCSQRVFVSSES

SEQ ID NO: 2805893 - protein, 23 aa, Entamoeba invadens
TGLQKLFETYAFKDILKNPPQPA

SEQ ID NO: 2805894 - protein, 19 aa, Entamoeba invadens
TGLQLVYLFIIFTCLCVIG

SEQ ID NO: 2805895 - protein, 21 aa, Entamoeba invadens
TGLTRPSECNTYITLTQSSSP

SEQ ID NO: 2805896 - protein, 18 aa, Entamoeba invadens
TGMCSVCASGFTKPASDN

SEQ ID NO: 2805897 - protein, 25 aa, Entamoeba invadens
TGMRGRSKYLYRIIQDIYFPPKDFD

SEQ ID NO: 2805898 - protein, 25 aa, Entamoeba invadens
TGMWNICYLVLIGSIIYVFDNAISL

SEQ ID NO: 2805899 - protein, 26 aa, Entamoeba invadens
TGNCVDCLPGYILNNGKCSICLAGTY

SEQ ID NO: 2805900 - protein, 22 aa, Entamoeba invadens
TGNCVDCLSGYILNNGNCSICL

SEQ ID NO: 2805901 - protein, 23 aa, Entamoeba invadens
TGNKVISCNSGFYLENNICKECE

SEQ ID NO: 2805902 - protein, 33 aa, Entamoeba invadens
TGNTNRFEKVYSFRGNSSYGYRGYSVGMDDKML

SEQ ID NO: 2805903 - protein, 24 aa, Entamoeba invadens
TGQCIACSIGCQFCDGTTGNCTRC

SEQ ID NO: 2805904 - protein, 18 aa, Entamoeba invadens
TGQCLACDHNYYFHRTTN

SEQ ID NO: 2805905 - protein, 26 aa, Entamoeba invadens
TGRSCQFTIPWWCILLLVIFILLVVI

SEQ ID NO: 2805906 - protein, 18 aa, Entamoeba invadens
TGRTVSWDASFLIFLSLI

SEQ ID NO: 2805907 - protein, 17 aa, Entamoeba invadens
TGSDFTTCFELISYQSE

SEQ ID NO: 2805908 - protein, 20 aa, Entamoeba invadens
TGSFFLECVYGNMQTLAECV

SEQ ID NO: 2805909 - protein, 23 aa, Entamoeba invadens
TGSGCAICKSGYYRSGNGCNVCN

SEQ ID NO: 2805910 - protein, 24 aa, Entamoeba invadens
TGSGCAICKSGYYRSGNGCQVCNI

SEQ ID NO: 2805911 - protein, 21 aa, Entamoeba invadens
TGSGCYQCYDGYYRNGNDCKH

SEQ ID NO: 2805912 - protein, 25 aa, Entamoeba invadens
TGSLAGLFLVCLSIIGMTLIIINNI

SEQ ID NO: 2805913 - protein, 27 aa, Entamoeba invadens
TGSVAFRLSILLSFLFFMIFSVFDVKF

SEQ ID NO: 2805914 - protein, 25 aa, Entamoeba invadens
TGTKCFPTSLGAVFSLPDFGKYSAQ

SEQ ID NO: 2805915 - protein, 31 aa, Entamoeba invadens
TGTLICFQVVLGLQLLLIFSKLGVHRALLTQ

SEQ ID NO: 2805916 - protein, 25 aa, Entamoeba invadens
TGTQCFLLYDITSFTGAVKHAKSCL

SEQ ID NO: 2805917 - protein, 21 aa, Entamoeba invadens
TGVACSVLLALGAVSSSCYSS

SEQ ID NO: 2805918 - protein, 19 aa, Entamoeba invadens
TGVAVLGVLFIIAVIIICV

SEQ ID NO: 2805919 - protein, 18 aa, Entamoeba invadens
TGVCLSCIEGYYLEYGKC

SEQ ID NO: 2805920 - protein, 19 aa, Entamoeba invadens
TGVFRGCTSLEEIEGLSAV

SEQ ID NO: 2805921 - protein, 18 aa, Entamoeba invadens
TGVPLLYSCVCIVMQMVP

SEQ ID NO: 2805922 - protein, 26 aa, Entamoeba invadens
TGVPMFECVNIVFGMYNLGVVRISKE

SEQ ID NO: 2805923 - protein, 24 aa, Entamoeba invadens
TGYCKSCLQNYVFVSATSLVCESC

SEQ ID NO: 2805924 - protein, 24 aa, Entamoeba invadens
TGYCKSCLSNYVFVSATSLVCENC

SEQ ID NO: 2805925 - protein, 24 aa, Entamoeba invadens
TGYCKSCLSNYVFVSATSLVCESC

SEQ ID NO: 2805926 - protein, 22 aa, Entamoeba invadens
TGYCMSCATGFVLSASPSQHCI

SEQ ID NO: 2805927 - protein, 21 aa, Entamoeba invadens
THALLLLKALHDFPIEVSPHF

SEQ ID NO: 2805928 - protein, 18 aa, Entamoeba invadens
THCKSILAITHLSNKIVQ

SEQ ID NO: 2805929 - protein, 18 aa, Entamoeba invadens
THCLSCKENTYFQNNKCL

SEQ ID NO: 2805930 - protein, 18 aa, Entamoeba invadens
THCLTCNSSSFLNSQSMC

SEQ ID NO: 2805931 - protein, 20 aa, Entamoeba invadens
THCTFPYKMDVFGNINCLFV

SEQ ID NO: 2805932 - protein, 29 aa, Entamoeba invadens
THDNCALCEGGLCKRCSENYLMTSLNKCV

SEQ ID NO: 2805933 - protein, 29 aa, Entamoeba invadens
THENCRICLDGKCTKCGTTAQYLENDKCV

SEQ ID NO: 2805934 - protein, 18 aa, Entamoeba invadens
THFERLKKVLPQTTILNH

SEQ ID NO: 2805935 - protein, 23 aa, Entamoeba invadens
THFKDIKSGVLYINNKSVNGASV

SEQ ID NO: 2805936 - protein, 34 aa, Entamoeba invadens
THFKSKNLVCGIAFALPVLLAFTIAITRTRDHYH

SEQ ID NO: 2805937 - protein, 18 aa, Entamoeba invadens
THHIETSTDFVIFENQKK

SEQ ID NO: 2805938 - protein, 17 aa, Entamoeba invadens
THISFYKSCQVVVNDSV

SEQ ID NO: 2805939 - protein, 29 aa, Entamoeba invadens
THIYPWKATKWLCGVFVIILIINSIIEMS

SEQ ID NO: 2805940 - protein, 20 aa, Entamoeba invadens
THLAEGFAIESVFRGYIFLS

SEQ ID NO: 2805941 - protein, 24 aa, Entamoeba invadens
THLKGCAVIGNYGCEMCDDGYSLI

SEQ ID NO: 2805942 - protein, 28 aa, Entamoeba invadens
THLKVVEDIGVLKPVVFAAVPRVLQLIY

SEQ ID NO: 2805943 - protein, 19 aa, Entamoeba invadens
THLQCALIAFISAKADIKL

SEQ ID NO: 2805944 - protein, 28 aa, Entamoeba invadens
THLYFKQLLRYGNLTDFFCHVEHFDYMK

SEQ ID NO: 2805945 - protein, 18 aa, Entamoeba invadens
THPCTYRLESFEKGHVMN

SEQ ID NO: 2805946 - protein, 28 aa, Entamoeba invadens
THQKCQICIEGKCQKCEEKLFVDTVKDV

SEQ ID NO: 2805947 - protein, 25 aa, Entamoeba invadens
TIALVKCWDLALVVISALPFMFLAL

SEQ ID NO: 2805948 - protein, 17 aa, Entamoeba invadens
TIANLTGIFAFLLSYVF

SEQ ID NO: 2805949 - protein, 19 aa, Entamoeba invadens
TICDNAVCCLACKERYILM

SEQ ID NO: 2805950 - protein, 18 aa, Entamoeba invadens
TIDSIFILFMKLYHSNKE

SEQ ID NO: 2805951 - protein, 24 aa, Entamoeba invadens
TIEELKLPSLRKMEVGEGYKKRPQ

SEQ ID NO: 2805952 - protein, 18 aa, Entamoeba invadens
TIEILQIVNICYSLGEAQ

SEQ ID NO: 2805953 - protein, 23 aa, Entamoeba invadens
TIEILWRQLFFVFFVEDGNLIRK

SEQ ID NO: 2805954 - protein, 18 aa, Entamoeba invadens
TIEMKIAFNLKTLQFSNV

SEQ ID NO: 2805955 - protein, 24 aa, Entamoeba invadens
TIENKEVPKFCAVACEDGGIRILT

SEQ ID NO: 2805956 - protein, 25 aa, Entamoeba invadens
TIFGEKPLNVVIRVAIEKVKKCILK

SEQ ID NO: 2805957 - protein, 23 aa, Entamoeba invadens
TIFLEIIALLVLNAKNYEAFQNN

SEQ ID NO: 2805958 - protein, 24 aa, Entamoeba invadens
TIFRMKRSNVHFISLQYGICVSSQ

SEQ ID NO: 2805959 - protein, 24 aa, Entamoeba invadens
TIFYNGRILDRISFVNEEEVNTTV

SEQ ID NO: 2805960 - protein, 17 aa, Entamoeba invadens
TIGAKFGIVSTLEEAIK

SEQ ID NO: 2805961 - protein, 18 aa, Entamoeba invadens
TIGASLSFTKLVIESEVT

SEQ ID NO: 2805962 - protein, 24 aa, Entamoeba invadens
TIGDIPLFITHNFDQRNFTITATN

SEQ ID NO: 2805963 - protein, 24 aa, Entamoeba invadens
TIGEEIGWRLFLFPEMSKILNPKI

SEQ ID NO: 2805964 - protein, 23 aa, Entamoeba invadens
TIGKIIVNDGVEFTLKCYGDTFI

SEQ ID NO: 2805965 - protein, 20 aa, Entamoeba invadens
TIGTIKPGVTKLILVGKNKS

SEQ ID NO: 2805966 - protein, 23 aa, Entamoeba invadens
TIHCTLCFAPYILNDNKLSCIDA

SEQ ID NO: 2805967 - protein, 27 aa, Entamoeba invadens
TIHQPRPLIFEKFTKIIMLNRGKMIYF

SEQ ID NO: 2805968 - protein, 18 aa, Entamoeba invadens
TIIADGCVNMFSSLYEIQ

SEQ ID NO: 2805969 - protein, 20 aa, Entamoeba invadens
TIIFLFKAYYLFRTLLVENV

SEQ ID NO: 2805970 - protein, 17 aa, Entamoeba invadens
TIIKGNLFISGISDHKE

SEQ ID NO: 2805971 - protein, 25 aa, Entamoeba invadens
TIITSFLCWLSYWRCDWKDDVTQWC

SEQ ID NO: 2805972 - protein, 21 aa, Entamoeba invadens
TIIVNRLWINKGVNMSMNGNA

SEQ ID NO: 2805973 - protein, 20 aa, Entamoeba invadens
TIKCSVCSAGTYSVVNKCEF

SEQ ID NO: 2805974 - protein, 21 aa, Entamoeba invadens
TIKIPPVYVPANWDEGLDTKS

SEQ ID NO: 2805975 - protein, 19 aa, Entamoeba invadens
TIKNLKQFVSNEMLLKIPV

SEQ ID NO: 2805976 - protein, 17 aa, Entamoeba invadens
TIKTGYGNPLFVGSRGF

SEQ ID NO: 2805977 - protein, 17 aa, Entamoeba invadens
TILACWVSRLTVWSPGM

SEQ ID NO: 2805978 - protein, 24 aa, Entamoeba invadens
TILEKFEYGTCFTGTTGSVVSNFI

SEQ ID NO: 2805979 - protein, 26 aa, Entamoeba invadens
TILEVFKDGVPLNFGTAIDDFCQKQY

SEQ ID NO: 2805980 - protein, 18 aa, Entamoeba invadens
TILFSFIAICISQTAMLA

SEQ ID NO: 2805981 - protein, 24 aa, Entamoeba invadens
TILHYSKFMFDRLFYLEDVGLFIA

SEQ ID NO: 2805982 - protein, 23 aa, Entamoeba invadens
TILKSCTYYSYDLQIQGKSLNIT

SEQ ID NO: 2805983 - protein, 18 aa, Entamoeba invadens
TILPDSFFSSEEFQRVLV

SEQ ID NO: 2805984 - protein, 31 aa, Entamoeba invadens
TILYLMKKLNGWIALVAILFIFSCFTPLGTL

SEQ ID NO: 2805985 - protein, 20 aa, Entamoeba invadens
TIMAFDFKGVTSIGSSAFLN

SEQ ID NO: 2805986 - protein, 25 aa, Entamoeba invadens
TINEFKMSSGFSVYFDVETVIKSLT

SEQ ID NO: 2805987 - protein, 26 aa, Entamoeba invadens
TINEKFFWETCWEILRANAVTRKPMM

SEQ ID NO: 2805988 - protein, 19 aa, Entamoeba invadens
TINFKFNFVLNFDRNNNKY

SEQ ID NO: 2805989 - protein, 24 aa, Entamoeba invadens
TINFKSDVPFLINFDNSCTTDNYL

SEQ ID NO: 2805990 - protein, 27 aa, Entamoeba invadens
TINKRWRNVICRETCFLTFTTIVEDQV

SEQ ID NO: 2805991 - protein, 21 aa, Entamoeba invadens
TIPETRYTLFKNIESRMLERN

SEQ ID NO: 2805992 - protein, 25 aa, Entamoeba invadens
TIPGIGEVIFYYDIRYGTGEQKHHV

SEQ ID NO: 2805993 - protein, 17 aa, Entamoeba invadens
TIPLGVTSFSDWCFSGC

SEQ ID NO: 2805994 - protein, 26 aa, Entamoeba invadens
TIPSCQTCQGGFCTLCEIGFYRDNTK

SEQ ID NO: 2805995 - protein, 28 aa, Entamoeba invadens
TIPSGSSGKIFTVLRVLTPINIANFEFT

SEQ ID NO: 2805996 - protein, 23 aa, Entamoeba invadens
TIPSRSAVYLSIPLCITAQEMAL

SEQ ID NO: 2805997 - protein, 17 aa, Entamoeba invadens
TIQDFPIIITTRVDTIN

SEQ ID NO: 2805998 - protein, 25 aa, Entamoeba invadens
TIQSGIPLYSAMAFDYSDKKECALK

SEQ ID NO: 2805999 - protein, 17 aa, Entamoeba invadens
TIQWEFSLHQDLKVKIV

SEQ ID NO: 2806000 - protein, 25 aa, Entamoeba invadens
TIRDFPLIITHSFLFSQWINLNSTN

SEQ ID NO: 2806001 - protein, 18 aa, Entamoeba invadens
TIRDIPFFQVNKVSNFSG

SEQ ID NO: 2806002 - protein, 24 aa, Entamoeba invadens
TIRDIPLFITRNFDQRNFTITTTN

SEQ ID NO: 2806003 - protein, 19 aa, Entamoeba invadens
TIRDLPIFFTNQINTTIFS

SEQ ID NO: 2806004 - protein, 23 aa, Entamoeba invadens
TIRDLPIFFTYQINSTKFSFQSL

SEQ ID NO: 2806005 - protein, 18 aa, Entamoeba invadens
TIRLYELIITFCAHLMFE

SEQ ID NO: 2806006 - protein, 17 aa, Entamoeba invadens
TIRWRMEQLSIPAASLP

SEQ ID NO: 2806007 - protein, 19 aa, Entamoeba invadens
TISCTSCPSGSYSGSGASS

SEQ ID NO: 2806008 - protein, 24 aa, Entamoeba invadens
TISENLKRLHVMGQIMAENGFLQR

SEQ ID NO: 2806009 - protein, 17 aa, Entamoeba invadens
TISIGIDFGTSKIVISY

SEQ ID NO: 2806010 - protein, 24 aa, Entamoeba invadens
TISKGFWTPTFVKLNRVFESTDTV

SEQ ID NO: 2806011 - protein, 17 aa, Entamoeba invadens
TISKLRCTQLINSDVSK

SEQ ID NO: 2806012 - protein, 21 aa, Entamoeba invadens
TISPRPVFKSQIDDTVNDDQT

SEQ ID NO: 2806013 - protein, 19 aa, Entamoeba invadens
TISRIVCAPFKRVYFKDFW

SEQ ID NO: 2806014 - protein, 18 aa, Entamoeba invadens
TISSWGLDITHVGGEIAL

SEQ ID NO: 2806015 - protein, 22 aa, Entamoeba invadens
TISTLNGFDEWDCNKYVETNPS

SEQ ID NO: 2806016 - protein, 17 aa, Entamoeba invadens
TITDLRNTTLINTIFTN

SEQ ID NO: 2806017 - protein, 19 aa, Entamoeba invadens
TITIIFLFFFRQHKKAQIE

SEQ ID NO: 2806018 - protein, 22 aa, Entamoeba invadens
TITKPKAVEFFNKFNEYLQAYA

SEQ ID NO: 2806019 - protein, 18 aa, Entamoeba invadens
TITLKMKKIKSIKFNNIE

SEQ ID NO: 2806020 - protein, 24 aa, Entamoeba invadens
TITPCPSGSIFIQECIQCDNGKYQ

SEQ ID NO: 2806021 - protein, 18 aa, Entamoeba invadens
TITYVLDCFVKGKEKKIA

SEQ ID NO: 2806022 - protein, 20 aa, Entamoeba invadens
TIVFVCIKKIIKKIELKKRE

SEQ ID NO: 2806023 - protein, 30 aa, Entamoeba invadens
TIVGCFTIPMPENFSVINFNGFAYPLNGPA

SEQ ID NO: 2806024 - protein, 26 aa, Entamoeba invadens
TIVQMCYFLVFLRLVLITLFDFTQEL

SEQ ID NO: 2806025 - protein, 18 aa, Entamoeba invadens
TIVVSFVLFFSVKISHHY

SEQ ID NO: 2806026 - protein, 20 aa, Entamoeba invadens
TIWKDLKFDKKGVIGDHDYV

SEQ ID NO: 2806027 - protein, 19 aa, Entamoeba invadens
TIYFKGEWTTPFETAELNF

SEQ ID NO: 2806028 - protein, 22 aa, Entamoeba invadens
TKACGYKFSRYMIEPTRLGFGN

SEQ ID NO: 2806029 - protein, 17 aa, Entamoeba invadens
TKAEVCYQIDTVNNCVK

SEQ ID NO: 2806030 - protein, 23 aa, Entamoeba invadens
TKAVWWLILLCIIFVLVIISALL

SEQ ID NO: 2806031 - protein, 20 aa, Entamoeba invadens
TKAVWWVLLIVIVISVLFVI

SEQ ID NO: 2806032 - protein, 21 aa, Entamoeba invadens
TKCAPGYRSYQKFSITGIHVF

SEQ ID NO: 2806033 - protein, 18 aa, Entamoeba invadens
TKCEKALCTSCYSDYSQC

SEQ ID NO: 2806034 - protein, 19 aa, Entamoeba invadens
TKCKICKSNEFLNSEETCS

SEQ ID NO: 2806035 - protein, 20 aa, Entamoeba invadens
TKCKICKSNEILNAEETCST

SEQ ID NO: 2806036 - protein, 18 aa, Entamoeba invadens
TKCLGCEEGYLLANGSCT

SEQ ID NO: 2806037 - protein, 17 aa, Entamoeba invadens
TKCLPKDGCIECTYGYF

SEQ ID NO: 2806038 - protein, 24 aa, Entamoeba invadens
TKCLSCALNYFLDLGRCFPCSSKL

SEQ ID NO: 2806039 - protein, 17 aa, Entamoeba invadens
TKCLSCENGYYQGDNYK

SEQ ID NO: 2806040 - protein, 18 aa, Entamoeba invadens
TKCLSCPQNMYLSNYNCN

SEQ ID NO: 2806041 - protein, 20 aa, Entamoeba invadens
TKCLSCPQNMYLSNYNCNTN

SEQ ID NO: 2806042 - protein, 19 aa, Entamoeba invadens
TKCPCNLHNGFVTVSTKMC

SEQ ID NO: 2806043 - protein, 19 aa, Entamoeba invadens
TKCRATCPSGQTASNNNMC

SEQ ID NO: 2806044 - protein, 17 aa, Entamoeba invadens
TKCSAMNDRFCLIIEDG

SEQ ID NO: 2806045 - protein, 20 aa, Entamoeba invadens
TKCTACLSGYYLDDNNNKCT

SEQ ID NO: 2806046 - protein, 18 aa, Entamoeba invadens
TKCTECKTGMLIEDTGKC

SEQ ID NO: 2806047 - protein, 18 aa, Entamoeba invadens
TKCTECKTGMLIEDTGRC

SEQ ID NO: 2806048 - protein, 24 aa, Entamoeba invadens
TKCTECLDGYGLKEGNCTNCEKKN

SEQ ID NO: 2806049 - protein, 25 aa, Entamoeba invadens
TKCTKCTIEGCSKCSGATICNECIN

SEQ ID NO: 2806050 - protein, 26 aa, Entamoeba invadens
TKCTRFNSLILKDSWLPPEKFITEIK

SEQ ID NO: 2806051 - protein, 23 aa, Entamoeba invadens
TKCTTCPEMTYTLSYGSFACLLC

SEQ ID NO: 2806052 - protein, 19 aa, Entamoeba invadens
TKCTVCAVNKCYECKDKTY

SEQ ID NO: 2806053 - protein, 18 aa, Entamoeba invadens
TKCVECLDAFKLKGGICA

SEQ ID NO: 2806054 - protein, 18 aa, Entamoeba invadens
TKCVEGTYLQSGECVAGG

SEQ ID NO: 2806055 - protein, 25 aa, Entamoeba invadens
TKDGKRLVVPVTYYIKQTPDVDKSG

SEQ ID NO: 2806056 - protein, 21 aa, Entamoeba invadens
TKDKCLTCNLTNYKTQSGKCL

SEQ ID NO: 2806057 - protein, 23 aa, Entamoeba invadens
TKDSKCSLCTFWYSPSDDGTYCS

SEQ ID NO: 2806058 - protein, 17 aa, Entamoeba invadens
TKDVCNFIINFNEIDIK

SEQ ID NO: 2806059 - protein, 25 aa, Entamoeba invadens
TKDVLIRLGYDIIRGIFYLHYKGII

SEQ ID NO: 2806060 - protein, 17 aa, Entamoeba invadens
TKECASWDQSVFNEFNS

SEQ ID NO: 2806061 - protein, 21 aa, Entamoeba invadens
TKECLSCSGNLIVNGDTCISC

SEQ ID NO: 2806062 - protein, 31 aa, Entamoeba invadens
TKEDFLRLPYKLKVRMLFDTARGMEFLHENK

SEQ ID NO: 2806063 - protein, 32 aa, Entamoeba invadens
TKEDFLRLPYKLKVRMLFDTARGMEFLHENKI

SEQ ID NO: 2806064 - protein, 18 aa, Entamoeba invadens
TKEFVDWASQVLRERRFV

SEQ ID NO: 2806065 - protein, 18 aa, Entamoeba invadens
TKEFYDYQQSYLICTLIK

SEQ ID NO: 2806066 - protein, 30 aa, Entamoeba invadens
TKEKFCIGNCSRKLIKINISVIENNEKYEF

SEQ ID NO: 2806067 - protein, 26 aa, Entamoeba invadens
TKELLEYIIETFLKVIINENVPVLMK

SEQ ID NO: 2806068 - protein, 24 aa, Entamoeba invadens
TKELRKVCIFKMSRSNIAFISKLG

SEQ ID NO: 2806069 - protein, 24 aa, Entamoeba invadens
TKELRKVCIFKMSRSNIAFVSKLG

SEQ ID NO: 2806070 - protein, 29 aa, Entamoeba invadens
TKEMFWTLWMIFGMLNFLLFLLVVTCCIF

SEQ ID NO: 2806071 - protein, 27 aa, Entamoeba invadens
TKENIKWFLEIGMKYIMIEIVQDAVLN

SEQ ID NO: 2806072 - protein, 27 aa, Entamoeba invadens
TKENLCLRGKCDPCKIYVIPNALESSK

SEQ ID NO: 2806073 - protein, 19 aa, Entamoeba invadens
TKESVCKFTHFAERGKDAE

SEQ ID NO: 2806074 - protein, 21 aa, Entamoeba invadens
TKETLDLTTFVLNKTVETTPE

SEQ ID NO: 2806075 - protein, 20 aa, Entamoeba invadens
TKFRCDQIIHFFGSVRMARI

SEQ ID NO: 2806076 - protein, 24 aa, Entamoeba invadens
TKFRISSSDGYYCTYSGKDDSNNA

SEQ ID NO: 2806077 - protein, 17 aa, Entamoeba invadens
TKFVLSGLFLLFVKHKD

SEQ ID NO: 2806078 - protein, 24 aa, Entamoeba invadens
TKGCLKCLDGYFLQNLSLILTCEK

SEQ ID NO: 2806079 - protein, 24 aa, Entamoeba invadens
TKGCLRCFGGYYLSDRMCVKCEYP

SEQ ID NO: 2806080 - protein, 25 aa, Entamoeba invadens
TKGCLRCFSGYYLADRTCVKCEYPC

SEQ ID NO: 2806081 - protein, 19 aa, Entamoeba invadens
TKGEAWRKNLLETVKRKGN

SEQ ID NO: 2806082 - protein, 18 aa, Entamoeba invadens
TKHNFAFYEISLKNDENV

SEQ ID NO: 2806083 - protein, 19 aa, Entamoeba invadens
TKHNFHIASSLSIQNKGVF

SEQ ID NO: 2806084 - protein, 19 aa, Entamoeba invadens
TKICLVTEFADYGSLQNLI

SEQ ID NO: 2806085 - protein, 20 aa, Entamoeba invadens
TKIDLTHTWNDLSFGEGSKT

SEQ ID NO: 2806086 - protein, 31 aa, Entamoeba invadens
TKIGLSCFKGCISLCEICCSSSLQFPLSSLF

SEQ ID NO: 2806087 - protein, 18 aa, Entamoeba invadens
TKIGRAQIEASFLKGNGM

SEQ ID NO: 2806088 - protein, 20 aa, Entamoeba invadens
TKIIYGRSCVNIYYDKTTQS

SEQ ID NO: 2806089 - protein, 22 aa, Entamoeba invadens
TKIKATLPLLRKIVLGRDAGQT

SEQ ID NO: 2806090 - protein, 28 aa, Entamoeba invadens
TKILKVMFSVGWFPHIFMSIAKMCKTTP

SEQ ID NO: 2806091 - protein, 17 aa, Entamoeba invadens
TKIPFPVCITQARSFLQ

SEQ ID NO: 2806092 - protein, 20 aa, Entamoeba invadens
TKIQLKMMVLACQMIKENVC

SEQ ID NO: 2806093 - protein, 18 aa, Entamoeba invadens
TKISISLPKLHLLMTSYI

SEQ ID NO: 2806094 - protein, 17 aa, Entamoeba invadens
TKITGNFGVVGKEKMFK

SEQ ID NO: 2806095 - protein, 26 aa, Entamoeba invadens
TKIYTCNKCVPGFIFNTTSKMCNICS

SEQ ID NO: 2806096 - protein, 17 aa, Entamoeba invadens
TKKCTKISISMCSYANS

SEQ ID NO: 2806097 - protein, 22 aa, Entamoeba invadens
TKKCYKCKVGYYLTSSGTCSSC

SEQ ID NO: 2806098 - protein, 18 aa, Entamoeba invadens
TKKIRVFFSKGSRAFSNL

SEQ ID NO: 2806099 - protein, 23 aa, Entamoeba invadens
TKKMENICVFKMSRSNIAMSVLN

SEQ ID NO: 2806100 - protein, 25 aa, Entamoeba invadens
TKKMIDCWSSFVLPEEEWSLESKKS

SEQ ID NO: 2806101 - protein, 17 aa, Entamoeba invadens
TKKSCKVYMTLYCTTQV

SEQ ID NO: 2806102 - protein, 24 aa, Entamoeba invadens
TKKYAKARFDCMLATCGNKKWDKG

SEQ ID NO: 2806103 - protein, 18 aa, Entamoeba invadens
TKLAPLFEISYIFDEIGN

SEQ ID NO: 2806104 - protein, 24 aa, Entamoeba invadens
TKLEPVFMMSIIPHFISLNMLMRF

SEQ ID NO: 2806105 - protein, 18 aa, Entamoeba invadens
TKLFKLQIAPSCTSDESD

SEQ ID NO: 2806106 - protein, 21 aa, Entamoeba invadens
TKLKCSKCSFWNVPSEDGASC

SEQ ID NO: 2806107 - protein, 19 aa, Entamoeba invadens
TKLLDGGKLLKTFVEKDKE

SEQ ID NO: 2806108 - protein, 17 aa, Entamoeba invadens
TKLLIDGRLLRLGSSNK

SEQ ID NO: 2806109 - protein, 24 aa, Entamoeba invadens
TKLLKFKCTNLFSVCVSPSGKVGE

SEQ ID NO: 2806110 - protein, 24 aa, Entamoeba invadens
TKLLKGVFFSVNFDGDHSLLIDTT

SEQ ID NO: 2806111 - protein, 17 aa, Entamoeba invadens
TKLPCLLINGVMNDGFV

SEQ ID NO: 2806112 - protein, 17 aa, Entamoeba invadens
TKLPEFTPKGWLRVKEV

SEQ ID NO: 2806113 - protein, 20 aa, Entamoeba invadens
TKLPVTWTHGVFNKVYRTKC

SEQ ID NO: 2806114 - protein, 20 aa, Entamoeba invadens
TKLPYKCFAGDIYLKEITSP

SEQ ID NO: 2806115 - protein, 25 aa, Entamoeba invadens
TKLSKAIRWLNTRPTDFCVELISFQ

SEQ ID NO: 2806116 - protein, 19 aa, Entamoeba invadens
TKLTSGFCTTCDSSTFLKG

SEQ ID NO: 2806117 - protein, 24 aa, Entamoeba invadens
TKMGEKYGGLKLSGCGVDEVPSVT

SEQ ID NO: 2806118 - protein, 18 aa, Entamoeba invadens
TKMSSTVFYTQFHVYTLL

SEQ ID NO: 2806119 - protein, 17 aa, Entamoeba invadens
TKNCALCDNNNACTKCI

SEQ ID NO: 2806120 - protein, 21 aa, Entamoeba invadens
TKNGCAKCVDGYFTFKTNQCK

SEQ ID NO: 2806121 - protein, 18 aa, Entamoeba invadens
TKNIKFEIVEGLTKGNLK

SEQ ID NO: 2806122 - protein, 18 aa, Entamoeba invadens
TKNMKMLYPLIVIVEQII

SEQ ID NO: 2806123 - protein, 24 aa, Entamoeba invadens
TKNPRKPTEIVLMSDAFCYSACSL

SEQ ID NO: 2806124 - protein, 23 aa, Entamoeba invadens
TKNSGFKKAVFKISNCYRYDGWY

SEQ ID NO: 2806125 - protein, 25 aa, Entamoeba invadens
TKNVCLKCILEFILDNGICIEDANC

SEQ ID NO: 2806126 - protein, 23 aa, Entamoeba invadens
TKPCSSGFCSTVSSLSFAYDGIF

SEQ ID NO: 2806127 - protein, 17 aa, Entamoeba invadens
TKPDCLVSVISNSHIEH

SEQ ID NO: 2806128 - protein, 20 aa, Entamoeba invadens
TKPEYCLFCDLNFYNSNGYC

SEQ ID NO: 2806129 - protein, 22 aa, Entamoeba invadens
TKPFSLKLMRISIFPKSSTFIE

SEQ ID NO: 2806130 - protein, 18 aa, Entamoeba invadens
TKPLGFVPRKCVPQTRNV

SEQ ID NO: 2806131 - protein, 23 aa, Entamoeba invadens
TKPREALVPLVHVVWNGTEKPND

SEQ ID NO: 2806132 - protein, 23 aa, Entamoeba invadens
TKPSDIFFSFSLDYIYNDNYYSI

SEQ ID NO: 2806133 - protein, 18 aa, Entamoeba invadens
TKPYGIPITEVFCKANNM

SEQ ID NO: 2806134 - protein, 24 aa, Entamoeba invadens
TKQRYNGFCKVPFPDRTCDICDDG

SEQ ID NO: 2806135 - protein, 18 aa, Entamoeba invadens
TKRCASCDSSCLTCVETS

SEQ ID NO: 2806136 - protein, 18 aa, Entamoeba invadens
TKRKDVLKEISFSATSKL

SEQ ID NO: 2806137 - protein, 22 aa, Entamoeba invadens
TKSDCLRQVGTFCVKCDTNYFV

SEQ ID NO: 2806138 - protein, 24 aa, Entamoeba invadens
TKSGCIICATGYYLDENNCEKCDE

SEQ ID NO: 2806139 - protein, 21 aa, Entamoeba invadens
TKSGKCLPQSCLVGCDNVTSD

SEQ ID NO: 2806140 - protein, 17 aa, Entamoeba invadens
TKSKKCLIYSLCGALSF

SEQ ID NO: 2806141 - protein, 22 aa, Entamoeba invadens
TKSRVCVACKLFDPSCKTCSSD

SEQ ID NO: 2806142 - protein, 18 aa, Entamoeba invadens
TKSVGIPLCNSCYSPFAL

SEQ ID NO: 2806143 - protein, 22 aa, Entamoeba invadens
TKTCKKGNLANCMIYDVKNGAV

SEQ ID NO: 2806144 - protein, 21 aa, Entamoeba invadens
TKTHIKTVIDIVRLLLPDNKQ

SEQ ID NO: 2806145 - protein, 18 aa, Entamoeba invadens
TKTKVEVVREISKQIFES

SEQ ID NO: 2806146 - protein, 23 aa, Entamoeba invadens
TKTLIGCLWCENGYYVDNYICKT

SEQ ID NO: 2806147 - protein, 18 aa, Entamoeba invadens
TKTLKECNAFSELLYMVY

SEQ ID NO: 2806148 - protein, 18 aa, Entamoeba invadens
TKTNRFTQVLFICRTLYN

SEQ ID NO: 2806149 - protein, 18 aa, Entamoeba invadens
TKTQFFIQYFDPFANEEL

SEQ ID NO: 2806150 - protein, 23 aa, Entamoeba invadens
TKTRRVFVYSISFGNTMYIPLAL

SEQ ID NO: 2806151 - protein, 20 aa, Entamoeba invadens
TKVCEWCPVTFYSDKYKCVK

SEQ ID NO: 2806152 - protein, 20 aa, Entamoeba invadens
TKVCLVTEFAHYGSLQDSIK

SEQ ID NO: 2806153 - protein, 26 aa, Entamoeba invadens
TKVDRPRFVNCTDYIPTNTTVDTNTT

SEQ ID NO: 2806154 - protein, 23 aa, Entamoeba invadens
  misc_feature (15)..(16): Xaa can be any naturally occurring amino acid
TKVDRPRFVNCTDYXXVDDNNKY

SEQ ID NO: 2806155 - protein, 20 aa, Entamoeba invadens
TKVGLKFGFGTNNIQFSNCF

SEQ ID NO: 2806156 - protein, 23 aa, Entamoeba invadens
TKVIKLPWFKYEVSEDVEPLNSS

SEQ ID NO: 2806157 - protein, 24 aa, Entamoeba invadens
TKVKEMKIPFTVWFSKSKKTLQQI

SEQ ID NO: 2806158 - protein, 20 aa, Entamoeba invadens
TKVRIMRAGFLIGVGAMIMI

SEQ ID NO: 2806159 - protein, 24 aa, Entamoeba invadens
TKVTCLTCQPTLYNGQGRDPTKQC

SEQ ID NO: 2806160 - protein, 23 aa, Entamoeba invadens
TKVTLKDAVLFVGNLAKDQSATY

SEQ ID NO: 2806161 - protein, 30 aa, Entamoeba invadens
TKVVWWVILLCVLFMVFIGVLLITIGIFSM

SEQ ID NO: 2806162 - protein, 18 aa, Entamoeba invadens
TKWDVWGYDQCLHNSVIY

SEQ ID NO: 2806163 - protein, 23 aa, Entamoeba invadens
TKYARPRETVIFLGNVPSKYDGK

SEQ ID NO: 2806164 - protein, 25 aa, Entamoeba invadens
TKYDSVWMRGYWLIFSQDQAVKGTI

SEQ ID NO: 2806165 - protein, 18 aa, Entamoeba invadens
TKYIAFDKISCVDKCTIG

SEQ ID NO: 2806166 - protein, 28 aa, Entamoeba invadens
TKYLNCDLCDSVKCFRCSSTYELSSDNT

SEQ ID NO: 2806167 - protein, 24 aa, Entamoeba invadens
TKYLRFVELVKLFFVGISRGSFFT

SEQ ID NO: 2806168 - protein, 28 aa, Entamoeba invadens
TKYQKVFICFPLSPAVRFVGFVFSFLVG

SEQ ID NO: 2806169 - protein, 23 aa, Entamoeba invadens
TKYSEKYYNEFLFKAKSEALYFI

SEQ ID NO: 2806170 - protein, 34 aa, Entamoeba invadens
TLACGYLYGLWFGQFVSFMGCFLGAFVSYLIGRF

SEQ ID NO: 2806171 - protein, 20 aa, Entamoeba invadens
TLATILKIVMVTTIVCLVWL

SEQ ID NO: 2806172 - protein, 23 aa, Entamoeba invadens
TLCATHAVWWVILLVVLLTLVVV

SEQ ID NO: 2806173 - protein, 17 aa, Entamoeba invadens
TLCDLKYRLDSTGHCTS

SEQ ID NO: 2806174 - protein, 18 aa, Entamoeba invadens
TLCEINFILLNGVCSHFS

SEQ ID NO: 2806175 - protein, 18 aa, Entamoeba invadens
TLCKECIQNCKICTENIC

SEQ ID NO: 2806176 - protein, 18 aa, Entamoeba invadens
TLCLKCSENFYLYDDGSC

SEQ ID NO: 2806177 - protein, 17 aa, Entamoeba invadens
TLCLRMLLFGLSEGVGY

SEQ ID NO: 2806178 - protein, 22 aa, Entamoeba invadens
TLCLSCKIGYYYDKSSSKCHAC

SEQ ID NO: 2806179 - protein, 19 aa, Entamoeba invadens
TLCMCEVILFGFSIGSFFV

SEQ ID NO: 2806180 - protein, 24 aa, Entamoeba invadens
TLCPNVYNPLSWDSCVAMNPGPTG

SEQ ID NO: 2806181 - protein, 21 aa, Entamoeba invadens
TLCSILRLYSLLCGLRKPNSM

SEQ ID NO: 2806182 - protein, 17 aa, Entamoeba invadens
TLCSTKFTLCDRCNITT

SEQ ID NO: 2806183 - protein, 25 aa, Entamoeba invadens
TLCTSCPNGGATCDICLDEYSAEDN

SEQ ID NO: 2806184 - protein, 19 aa, Entamoeba invadens
TLDALKWFSIGAVICVAYT

SEQ ID NO: 2806185 - protein, 22 aa, Entamoeba invadens
TLDFPHVFKEGVASLLSNGKLM

SEQ ID NO: 2806186 - protein, 17 aa, Entamoeba invadens
TLDVCFNNSEILQYFTI

SEQ ID NO: 2806187 - protein, 18 aa, Entamoeba invadens
TLDWNLGASTSKNLFCSK

SEQ ID NO: 2806188 - protein, 24 aa, Entamoeba invadens
TLEASLRVPILFSESNTEKMVYIF

SEQ ID NO: 2806189 - protein, 20 aa, Entamoeba invadens
TLEGNKFEEYMCDEFAHDEM

SEQ ID NO: 2806190 - protein, 29 aa, Entamoeba invadens
TLEILSLAIWLCYFWKGYQNVIESNVAFQ

SEQ ID NO: 2806191 - protein, 19 aa, Entamoeba invadens
TLEIPTSSLTVHFVLLSTD

SEQ ID NO: 2806192 - protein, 18 aa, Entamoeba invadens
TLEKCLFMIVSSQCEDSY

SEQ ID NO: 2806193 - protein, 17 aa, Entamoeba invadens
TLENCEWVSEYGCAVCY

SEQ ID NO: 2806194 - protein, 18 aa, Entamoeba invadens
TLENCEWVSEYGCAVCYD

SEQ ID NO: 2806195 - protein, 18 aa, Entamoeba invadens
TLENCEWVSEYGYAVCYN

SEQ ID NO: 2806196 - protein, 25 aa, Entamoeba invadens
TLEVTFPFTRYGKFGYSFCAPTLMV

SEQ ID NO: 2806197 - protein, 19 aa, Entamoeba invadens
TLFCKINGPLTFKEFQEKF

SEQ ID NO: 2806198 - protein, 23 aa, Entamoeba invadens
TLFLKVGVPILVIFFVIIFGTIS

SEQ ID NO: 2806199 - protein, 20 aa, Entamoeba invadens
TLFLPMTFIAALFGMNVTVP

SEQ ID NO: 2806200 - protein, 19 aa, Entamoeba invadens
TLFQLIVKFNKIISIFFLF

SEQ ID NO: 2806201 - protein, 26 aa, Entamoeba invadens
TLFQSHFGSFFSFSGTSVVRITASAL

SEQ ID NO: 2806202 - protein, 21 aa, Entamoeba invadens
TLGCSSCDFGYFVDSTGRCAK

SEQ ID NO: 2806203 - protein, 23 aa, Entamoeba invadens
TLGCTLCPDGHFIENKRCSPCDS

SEQ ID NO: 2806204 - protein, 19 aa, Entamoeba invadens
TLGDLGAKCSVAIPTGGGC

SEQ ID NO: 2806205 - protein, 17 aa, Entamoeba invadens
TLGDLGAKCSVTIPTGG

SEQ ID NO: 2806206 - protein, 17 aa, Entamoeba invadens
TLGELTNKCHLTLPTGI

SEQ ID NO: 2806207 - protein, 25 aa, Entamoeba invadens
TLGIVCGAFSFLVGSSIRVVGIYLV

SEQ ID NO: 2806208 - protein, 23 aa, Entamoeba invadens
TLGNKISALGLKFDFFQNNASSE

SEQ ID NO: 2806209 - protein, 20 aa, Entamoeba invadens
TLGYGCFCNSTTSFEQWDCS

SEQ ID NO: 2806210 - protein, 24 aa, Entamoeba invadens
TLHSPVQCTKGFLLNSHTKECDSL

SEQ ID NO: 2806211 - protein, 19 aa, Entamoeba invadens
TLIAICFTPLVYVMVFPLT

SEQ ID NO: 2806212 - protein, 18 aa, Entamoeba invadens
TLIDGKCEDASTGKGYLA

SEQ ID NO: 2806213 - protein, 18 aa, Entamoeba invadens
TLIFLSFTVFTAFSNECK

SEQ ID NO: 2806214 - protein, 26 aa, Entamoeba invadens
TLIGIGVACLVNLQFILFLQLPFVFA

SEQ ID NO: 2806215 - protein, 21 aa, Entamoeba invadens
TLIKMTLPINCIDQKEGTKES

SEQ ID NO: 2806216 - protein, 37 aa, Entamoeba invadens
TLILPTRYPLLGGWKTSFEVNYHFPLKNIIATSGEKM

SEQ ID NO: 2806217 - protein, 24 aa, Entamoeba invadens
TLIPEKYRQCLILLPDLFQCCLHF

SEQ ID NO: 2806218 - protein, 31 aa, Entamoeba invadens
TLIRKVFVVPKFVKFFCELQIDIFCGQQINF

SEQ ID NO: 2806219 - protein, 18 aa, Entamoeba invadens
TLITICRNREAAFSNFLA

SEQ ID NO: 2806220 - protein, 20 aa, Entamoeba invadens
TLITKEFYAVFIAFLVFCCV

SEQ ID NO: 2806221 - protein, 17 aa, Entamoeba invadens
TLIYWVFGYSYIQKNQS

SEQ ID NO: 2806222 - protein, 17 aa, Entamoeba invadens
TLKKLAVISPHYLSALS

SEQ ID NO: 2806223 - protein, 20 aa, Entamoeba invadens
TLKPSTAVQITFRITMLCTA

SEQ ID NO: 2806224 - protein, 33 aa, Entamoeba invadens
TLKVFSNTISFVFKTRVGSQLTIGTSYLTRSDF

SEQ ID NO: 2806225 - protein, 18 aa, Entamoeba invadens
TLKYCTTSLFLVYFCSNY

SEQ ID NO: 2806226 - protein, 24 aa, Entamoeba invadens
TLLFVTLAFFWTRIVSPAAAGSGV

SEQ ID NO: 2806227 - protein, 24 aa, Entamoeba invadens
TLLICITLAENLICPPGCTTNCNA

SEQ ID NO: 2806228 - protein, 24 aa, Entamoeba invadens
TLLLFCLFCKGKIEGWGILVPFTV

SEQ ID NO: 2806229 - protein, 24 aa, Entamoeba invadens
TLLPQLPELVPMFFDLLPETGDED

SEQ ID NO: 2806230 - protein, 17 aa, Entamoeba invadens
TLLSYAVLGFFFEWKNK

SEQ ID NO: 2806231 - protein, 33 aa, Entamoeba invadens
TLMALPRYPLMSGWKTEFMIGHDIAANVIQKDG

SEQ ID NO: 2806232 - protein, 32 aa, Entamoeba invadens
TLMFFILGFCIACFWLMAFVVSRKGKSVSTRW

SEQ ID NO: 2806233 - protein, 22 aa, Entamoeba invadens
TLMKDTFFDKEHVKGDNKELKL

SEQ ID NO: 2806234 - protein, 32 aa, Entamoeba invadens
TLMLCKRESSLYFQHFPKYCELCKRAVNMIRT

SEQ ID NO: 2806235 - protein, 25 aa, Entamoeba invadens
TLNEFKMSSGFSVYFDVETVIKSLK

SEQ ID NO: 2806236 - protein, 25 aa, Entamoeba invadens
TLNEFKMSSGFSVYFDVETVIKSLT

SEQ ID NO: 2806237 - protein, 23 aa, Entamoeba invadens
TLNFKGRASLILTENSSIILQDA

SEQ ID NO: 2806238 - protein, 18 aa, Entamoeba invadens
TLNNGVCFEMNMDCLYTR

SEQ ID NO: 2806239 - protein, 24 aa, Entamoeba invadens
TLNSPRNLIFQDLTISKIVKINSP

SEQ ID NO: 2806240 - protein, 25 aa, Entamoeba invadens
TLPHKLEVWSYFRKEWNIYTNTEIR

SEQ ID NO: 2806241 - protein, 17 aa, Entamoeba invadens
TLPLIIQNGVCAISHDL

SEQ ID NO: 2806242 - protein, 21 aa, Entamoeba invadens
TLPYFIVLALLNYSTPAIQRR

SEQ ID NO: 2806243 - protein, 17 aa, Entamoeba invadens
TLQAEQEKEAAFAAAQE

SEQ ID NO: 2806244 - protein, 23 aa, Entamoeba invadens
TLQYEGRGSVFIDTRDDNRIVYM

SEQ ID NO: 2806245 - protein, 19 aa, Entamoeba invadens
TLRHLKNMLLQMGDPKEQF

SEQ ID NO: 2806246 - protein, 26 aa, Entamoeba invadens
TLRQCKTCSIGLYPLHTSPYTCQQCH

SEQ ID NO: 2806247 - protein, 25 aa, Entamoeba invadens
TLRQCQTCSIGLYPLHTSPYTCQQC

SEQ ID NO: 2806248 - protein, 25 aa, Entamoeba invadens
TLRQGECVPCSGLFTHCNTCSDILC

SEQ ID NO: 2806249 - protein, 25 aa, Entamoeba invadens
TLSFDRRFVNEIKRCEEIERILRVF

SEQ ID NO: 2806250 - protein, 24 aa, Entamoeba invadens
TLSGLWGGNIFKWASFTCLTLYTY

SEQ ID NO: 2806251 - protein, 24 aa, Entamoeba invadens
TLSPRIPIFSVFLKDMISIQQFDT

SEQ ID NO: 2806252 - protein, 17 aa, Entamoeba invadens
TLSVPWTIFVFVFKPVF

SEQ ID NO: 2806253 - protein, 23 aa, Entamoeba invadens
TLTAICCIISIAKMPSHLKVVDT

SEQ ID NO: 2806254 - protein, 17 aa, Entamoeba invadens
TLTGIWKNGQLVGPFES

SEQ ID NO: 2806255 - protein, 30 aa, Entamoeba invadens
TLTLSFIFKLWFFRDNVRIHSGLIMKVLFN

SEQ ID NO: 2806256 - protein, 18 aa, Entamoeba invadens
TLTNCQLGTLAINKVDNI

SEQ ID NO: 2806257 - protein, 24 aa, Entamoeba invadens
TLTVGDTTKFVWVHNSAVDTSPQC

SEQ ID NO: 2806258 - protein, 26 aa, Entamoeba invadens
TLVCKLCKGGYAFKENTGICLDSKET

SEQ ID NO: 2806259 - protein, 24 aa, Entamoeba invadens
TLVDWWYLPLCAVVINAIAFPSIF

SEQ ID NO: 2806260 - protein, 18 aa, Entamoeba invadens
TLVKNHWVKIELDTFDVD

SEQ ID NO: 2806261 - protein, 21 aa, Entamoeba invadens
TLVPRLIPRDIFLSAKTGNLT

SEQ ID NO: 2806262 - protein, 21 aa, Entamoeba invadens
TLYEGVSFNFAFPQEKFEYPW

SEQ ID NO: 2806263 - protein, 19 aa, Entamoeba invadens
TLYETLKWGEAYDKEEFKF

SEQ ID NO: 2806264 - protein, 20 aa, Entamoeba invadens
TLYPQFNVMWVFIVYILLLL

SEQ ID NO: 2806265 - protein, 19 aa, Entamoeba invadens
TMCECFKWGDVYDKNIFKF

SEQ ID NO: 2806266 - protein, 17 aa, Entamoeba invadens
TMCECFQWEKAFDPEKY

SEQ ID NO: 2806267 - protein, 22 aa, Entamoeba invadens
TMCISCPSGYYLTSEHTCKEVG

SEQ ID NO: 2806268 - protein, 17 aa, Entamoeba invadens
TMELSREEAMLVATNTC

SEQ ID NO: 2806269 - protein, 20 aa, Entamoeba invadens
TMFECFGWCNAFPPDKFKFA

SEQ ID NO: 2806270 - protein, 18 aa, Entamoeba invadens
TMFECFSWEEAYPITTFK

SEQ ID NO: 2806271 - protein, 33 aa, Entamoeba invadens
TMFECMIWGNAFLKESFPYAWDIVDFVVNGKRH

SEQ ID NO: 2806272 - protein, 25 aa, Entamoeba invadens
TMFEVFQWDFVFKKMMRGFNTSGIS

SEQ ID NO: 2806273 - protein, 24 aa, Entamoeba invadens
TMGRCLSCKLSFYLTQDSPPKCLP

SEQ ID NO: 2806274 - protein, 19 aa, Entamoeba invadens
TMGSTSCKKCNVLCQGPCE

SEQ ID NO: 2806275 - protein, 19 aa, Entamoeba invadens
TMIVFECNEGFVLTNGSCK

SEQ ID NO: 2806276 - protein, 19 aa, Entamoeba invadens
TMKCTQCYSPFVLTSSGHC

SEQ ID NO: 2806277 - protein, 21 aa, Entamoeba invadens
TMKKLELMLKFSKKNYSIKKW

SEQ ID NO: 2806278 - protein, 19 aa, Entamoeba invadens
TMKKVFSCQPHYFLKNNRC

SEQ ID NO: 2806279 - protein, 20 aa, Entamoeba invadens
TMKKVLSCQPHYFLKNNRCV

SEQ ID NO: 2806280 - protein, 24 aa, Entamoeba invadens
TMKRCIKCVDGYRENIGSCIAFPQ

SEQ ID NO: 2806281 - protein, 22 aa, Entamoeba invadens
TMKYKEYISMVLYLLDDIDRVN

SEQ ID NO: 2806282 - protein, 17 aa, Entamoeba invadens
TMLLPKNIETFSVYHEY

SEQ ID NO: 2806283 - protein, 18 aa, Entamoeba invadens
TMMLPSQRGCVICNDGYY

SEQ ID NO: 2806284 - protein, 23 aa, Entamoeba invadens
TMMTYIKYGGWFNFAMVVFFFFV

SEQ ID NO: 2806285 - protein, 20 aa, Entamoeba invadens
TMNLNEWIDLVFGVDQQNRQ

SEQ ID NO: 2806286 - protein, 24 aa, Entamoeba invadens
TMNSMKLYVMMGVFTVVSLIAFYL

SEQ ID NO: 2806287 - protein, 26 aa, Entamoeba invadens
TMSFIKYEFKFCYLFTTNKKTSYKYV

SEQ ID NO: 2806288 - protein, 26 aa, Entamoeba invadens
TMSGCASCSKGYFILNQMCVKCDSKT

SEQ ID NO: 2806289 - protein, 31 aa, Entamoeba invadens
TMTGKIVLENVCFRYPTRPNISVLRGISTVI

SEQ ID NO: 2806290 - protein, 29 aa, Entamoeba invadens
TMVAKVVGLVLVIGCGIWAGKEGPFIHIA

SEQ ID NO: 2806291 - protein, 29 aa, Entamoeba invadens
TMVYYDCGFSKLELCGSATTQHTCDAINC

SEQ ID NO: 2806292 - protein, 20 aa, Entamoeba invadens
TMYECFTWADVFPKTQFKYP

SEQ ID NO: 2806293 - protein, 21 aa, Entamoeba invadens
TMYECLIWANPFPKDKFKYPW

SEQ ID NO: 2806294 - protein, 19 aa, Entamoeba invadens
TMYELITWSEAYPKSQFKY

SEQ ID NO: 2806295 - protein, 19 aa, Entamoeba invadens
TMYEMFIWGDIFPKNEFKF

SEQ ID NO: 2806296 - protein, 19 aa, Entamoeba invadens
TMYETFGWENPYNKVDFKF

SEQ ID NO: 2806297 - protein, 20 aa, Entamoeba invadens
TMYETFKWGEAYDKERFRFP

SEQ ID NO: 2806298 - protein, 18 aa, Entamoeba invadens
TMYETVSWSHAFKKEDFG

SEQ ID NO: 2806299 - protein, 29 aa, Entamoeba invadens
TMYLTKMAKLWMGQRMDWLGVFITSVTVL

SEQ ID NO: 2806300 - protein, 18 aa, Entamoeba invadens
TMYVPFFEISVMRQIVDP

SEQ ID NO: 2806301 - protein, 17 aa, Entamoeba invadens
TNAKRRVRDKGKNAEEF

SEQ ID NO: 2806302 - protein, 23 aa, Entamoeba invadens
TNANCPVGNYIPSYILSTQTKLG

SEQ ID NO: 2806303 - protein, 25 aa, Entamoeba invadens
TNCAICSGTTCTKCNDGYYLSSGSC

SEQ ID NO: 2806304 - protein, 28 aa, Entamoeba invadens
TNCAIKTPIGCLWCENGYYLDNYICKNC

SEQ ID NO: 2806305 - protein, 27 aa, Entamoeba invadens
TNCAVDIDIYFGCSLCDDGYFVNNKIC

SEQ ID NO: 2806306 - protein, 19 aa, Entamoeba invadens
TNCDACPSGSFSSSEGSSQ

SEQ ID NO: 2806307 - protein, 24 aa, Entamoeba invadens
TNCDTCPFGSYSLIGATFCTACTS

SEQ ID NO: 2806308 - protein, 17 aa, Entamoeba invadens
TNCILCDNNLIVKNGFC

SEQ ID NO: 2806309 - protein, 22 aa, Entamoeba invadens
TNCISCISAYYWLDTSTNKCKH

SEQ ID NO: 2806310 - protein, 18 aa, Entamoeba invadens
TNCKKCTTTNCVACNNSN

SEQ ID NO: 2806311 - protein, 20 aa, Entamoeba invadens
TNCKLCRNIINFGIRCEECF

SEQ ID NO: 2806312 - protein, 27 aa, Entamoeba invadens
TNCLCDFSSTCAFVFEDDDVHIKVPQF

SEQ ID NO: 2806313 - protein, 18 aa, Entamoeba invadens
TNCLKYDMFGCVRCESGY

SEQ ID NO: 2806314 - protein, 23 aa, Entamoeba invadens
TNCLPICGDSGLSSWNKNGQCIS

SEQ ID NO: 2806315 - protein, 17 aa, Entamoeba invadens
TNCNSSFCFDNIGCTKC

SEQ ID NO: 2806316 - protein, 25 aa, Entamoeba invadens
TNCPYGKTIRKCWRKKETKRPTFKE

SEQ ID NO: 2806317 - protein, 18 aa, Entamoeba invadens
TNCVLEISNDSNLAVLND

SEQ ID NO: 2806318 - protein, 24 aa, Entamoeba invadens
TNCVPSCAISGCIEQNNETCYTPD

SEQ ID NO: 2806319 - protein, 30 aa, Entamoeba invadens
TNCVSCFNISYCLSCADGSVLNRVTNTCEK

SEQ ID NO: 2806320 - protein, 17 aa, Entamoeba invadens
TNCVSYSLYGCKECDTS

SEQ ID NO: 2806321 - protein, 24 aa, Entamoeba invadens
TNDFKFPWKIAEFVNDGHRLPKTA

SEQ ID NO: 2806322 - protein, 18 aa, Entamoeba invadens
TNDVFKYITYEQMVTYII

SEQ ID NO: 2806323 - protein, 17 aa, Entamoeba invadens
TNDVMWVTIMKGRVENN

SEQ ID NO: 2806324 - protein, 18 aa, Entamoeba invadens
TNECAKCDDNCMTCSVSN

SEQ ID NO: 2806325 - protein, 21 aa, Entamoeba invadens
TNECFTCQSGYYLDNTNCVPN

SEQ ID NO: 2806326 - protein, 17 aa, Entamoeba invadens
TNECLRCQQHYDIDING

SEQ ID NO: 2806327 - protein, 22 aa, Entamoeba invadens
TNEYPISLILPMNGGGLGDLVA

SEQ ID NO: 2806328 - protein, 25 aa, Entamoeba invadens
TNFLFWGVGSISYFILYMLILIISL

SEQ ID NO: 2806329 - protein, 17 aa, Entamoeba invadens
TNFVLRQNFGLGVSLYF

SEQ ID NO: 2806330 - protein, 17 aa, Entamoeba invadens
TNGCFEWTTSNPTIVKL

SEQ ID NO: 2806331 - protein, 21 aa, Entamoeba invadens
TNGCKLCAAGTYSEHNATSCT

SEQ ID NO: 2806332 - protein, 20 aa, Entamoeba invadens
TNGFLNSRISAVKFATTSQV

SEQ ID NO: 2806333 - protein, 29 aa, Entamoeba invadens
TNGINCIKCYKGELNANCGSCSDVNCMIC

SEQ ID NO: 2806334 - protein, 24 aa, Entamoeba invadens
TNGKCFTCAAGYGFDNGTCTLCGD

SEQ ID NO: 2806335 - protein, 22 aa, Entamoeba invadens
TNGKCLGCKIGFGKADNTGDCL

SEQ ID NO: 2806336 - protein, 22 aa, Entamoeba invadens
TNGKFIRKEECDGGVNCNITCQ

SEQ ID NO: 2806337 - protein, 19 aa, Entamoeba invadens
TNGNCKLLTSGVLLDNTLK

SEQ ID NO: 2806338 - protein, 37 aa, Entamoeba invadens
TNGNCLSCYKGSRLSEGRCLPCQAGTFQSGNSCYPCG

SEQ ID NO: 2806339 - protein, 19 aa, Entamoeba invadens
TNGSIPTSLEFPSGIDLVG

SEQ ID NO: 2806340 - protein, 19 aa, Entamoeba invadens
TNGYRCIFEEGFDKEKITG

SEQ ID NO: 2806341 - protein, 19 aa, Entamoeba invadens
TNHSNGIAFWFTQTPLKLG

SEQ ID NO: 2806342 - protein, 20 aa, Entamoeba invadens
TNIFEQCWDLAIIDFGGSTR

SEQ ID NO: 2806343 - protein, 19 aa, Entamoeba invadens
TNINVPLFFSGHSMGGLIT

SEQ ID NO: 2806344 - protein, 17 aa, Entamoeba invadens
TNIPLVFETELSTHLDP

SEQ ID NO: 2806345 - protein, 21 aa, Entamoeba invadens
TNITISLPTGFTLLAEKRLLR

SEQ ID NO: 2806346 - protein, 25 aa, Entamoeba invadens
TNKAEYLYRLAVFLDNKRYVTQQNK

SEQ ID NO: 2806347 - protein, 17 aa, Entamoeba invadens
TNKCHLTLPTGIGCAIC

SEQ ID NO: 2806348 - protein, 22 aa, Entamoeba invadens
TNKCILCNTGYYLNDDSVCEIN

SEQ ID NO: 2806349 - protein, 21 aa, Entamoeba invadens
TNKDYKQRYNIEISTAANSVV

SEQ ID NO: 2806350 - protein, 23 aa, Entamoeba invadens
TNKGYKLPLFTGVNKDNYLGWRM

SEQ ID NO: 2806351 - protein, 17 aa, Entamoeba invadens
TNKKCLTIGDGMNDIPM

SEQ ID NO: 2806352 - protein, 19 aa, Entamoeba invadens
TNLDFKYFPCGIGNVNSDN

SEQ ID NO: 2806353 - protein, 25 aa, Entamoeba invadens
TNLGCSLCADGYYQFKNRMCERCST

SEQ ID NO: 2806354 - protein, 20 aa, Entamoeba invadens
TNLIFSFTFGKIVTNSKKDE

SEQ ID NO: 2806355 - protein, 17 aa, Entamoeba invadens
TNLKLIVGHNNYIIQNN

SEQ ID NO: 2806356 - protein, 17 aa, Entamoeba invadens
TNLKQILVPGYFIGTPI

SEQ ID NO: 2806357 - protein, 24 aa, Entamoeba invadens
TNLLCNLCPGFMNLVLSLCATMLT

SEQ ID NO: 2806358 - protein, 24 aa, Entamoeba invadens
TNLPEWTTWMLLIGMAIYDLIAVL

SEQ ID NO: 2806359 - protein, 23 aa, Entamoeba invadens
TNMKCTKCPIGSFSSSNASLSCT

SEQ ID NO: 2806360 - protein, 26 aa, Entamoeba invadens
TNMKKAIVCLPSYFLDNNKCNLCSDF

SEQ ID NO: 2806361 - protein, 19 aa, Entamoeba invadens
TNMLFMIVYINIMYALIIY

SEQ ID NO: 2806362 - protein, 18 aa, Entamoeba invadens
TNMNFCLLQLYGKNLFVE

SEQ ID NO: 2806363 - protein, 18 aa, Entamoeba invadens
TNNCAQCDSASGICSVCE

SEQ ID NO: 2806364 - protein, 18 aa, Entamoeba invadens
TNNCDLCSVFNCMTCVNN

SEQ ID NO: 2806365 - protein, 17 aa, Entamoeba invadens
TNNCGRIGVLVLLLHDI

SEQ ID NO: 2806366 - protein, 29 aa, Entamoeba invadens
TNNEVPGWAIAIIVVFAVCTVIVLVLLIL

SEQ ID NO: 2806367 - protein, 24 aa, Entamoeba invadens
TNNTCLKCTTSHYITNGKCEVCGQ

SEQ ID NO: 2806368 - protein, 28 aa, Entamoeba invadens
TNNYCKACAFQSIFLFLVFFISSLPFLI

SEQ ID NO: 2806369 - protein, 26 aa, Entamoeba invadens
TNNYGRCLRCTSGFYLETTINNPIST

SEQ ID NO: 2806370 - protein, 26 aa, Entamoeba invadens
TNPIRLKIRIKLMLDAARGMQYLHEN

SEQ ID NO: 2806371 - protein, 20 aa, Entamoeba invadens
TNPKFVFHFDPQYLIIHSRN

SEQ ID NO: 2806372 - protein, 22 aa, Entamoeba invadens
TNPKSRLSYLISENQVDTKKQV

SEQ ID NO: 2806373 - protein, 18 aa, Entamoeba invadens
TNPLQCLVQISLQNNNIN

SEQ ID NO: 2806374 - protein, 25 aa, Entamoeba invadens
TNQCVSCSYGYFLDRDGICVVNNFK

SEQ ID NO: 2806375 - protein, 23 aa, Entamoeba invadens
TNRYELFTIPKFQDFNFISDNCL

SEQ ID NO: 2806376 - protein, 19 aa, Entamoeba invadens
TNSALSFQACFSQFTLTVE

SEQ ID NO: 2806377 - protein, 20 aa, Entamoeba invadens
TNSCKLCVSGMYSEQNAPSC

SEQ ID NO: 2806378 - protein, 31 aa, Entamoeba invadens
TNSCLTCNTGFFPHDAVCLLCSTKNCSSCDN

SEQ ID NO: 2806379 - protein, 19 aa, Entamoeba invadens
TNSELFVNCGVCKLVNNKV

SEQ ID NO: 2806380 - protein, 24 aa, Entamoeba invadens
TNSFRFQRVLGVRNCQANFFENIS

SEQ ID NO: 2806381 - protein, 22 aa, Entamoeba invadens
TNSKCKLCMNGYYYSNKKCFVN

SEQ ID NO: 2806382 - protein, 23 aa, Entamoeba invadens
TNSKCTKCAFWYTVNANGMKCDA

SEQ ID NO: 2806383 - protein, 20 aa, Entamoeba invadens
TNSKCTKCTFWHTPNYSNTS

SEQ ID NO: 2806384 - protein, 25 aa, Entamoeba invadens
TNSKCTSCSFWHIPSASYTSCKTKV

SEQ ID NO: 2806385 - protein, 18 aa, Entamoeba invadens
TNSKIYFNMKVELDTLDI

SEQ ID NO: 2806386 - protein, 25 aa, Entamoeba invadens
TNSNARLFAILSLVFFIISTVAVSL

SEQ ID NO: 2806387 - protein, 22 aa, Entamoeba invadens
TNSRCKLATCGNGKIDFDDNYY

SEQ ID NO: 2806388 - protein, 22 aa, Entamoeba invadens
TNSRFNQFVLFMIVFQTVVCLL

SEQ ID NO: 2806389 - protein, 26 aa, Entamoeba invadens
TNSTFCLSCPEGTFLNDHKCITNEEL

SEQ ID NO: 2806390 - protein, 20 aa, Entamoeba invadens
TNTCDNCPAGTFSKPSSMEC

SEQ ID NO: 2806391 - protein, 26 aa, Entamoeba invadens
TNTGCSICKIGYYRKGTNCYQCPEHV

SEQ ID NO: 2806392 - protein, 18 aa, Entamoeba invadens
TNTLKWAKVFQDARRFVD

SEQ ID NO: 2806393 - protein, 18 aa, Entamoeba invadens
TNTMCLVISYGDCTKCDS

SEQ ID NO: 2806394 - protein, 22 aa, Entamoeba invadens
TNTNCFGFLLSSREFVSKRRES

SEQ ID NO: 2806395 - protein, 21 aa, Entamoeba invadens
TNVFLEMFQNFGIVTEENHIY

SEQ ID NO: 2806396 - protein, 19 aa, Entamoeba invadens
TNVNLSLCILDVFSRTIRD

SEQ ID NO: 2806397 - protein, 17 aa, Entamoeba invadens
TNWGFLFGNYVASKGLG

SEQ ID NO: 2806398 - protein, 17 aa, Entamoeba invadens
TNWNCFFEQNMTCKYQK

SEQ ID NO: 2806399 - protein, 19 aa, Entamoeba invadens
TNWTIAFKSLHFGFSLVGS

SEQ ID NO: 2806400 - protein, 20 aa, Entamoeba invadens
TNWTIAFKSLHFGFSLVGSL

SEQ ID NO: 2806401 - protein, 23 aa, Entamoeba invadens
TNYGVVIGFPIACVVVFVIVIIA

SEQ ID NO: 2806402 - protein, 23 aa, Entamoeba invadens
TNYIKTPICGRIIAGLELDIEPS

SEQ ID NO: 2806403 - protein, 21 aa, Entamoeba invadens
TNYKCTVCPASYYSIGGKSKC

SEQ ID NO: 2806404 - protein, 22 aa, Entamoeba invadens
TNYPVLRMFWGILTEMKFSLLS

SEQ ID NO: 2806405 - protein, 22 aa, Entamoeba invadens
TNYSLVCAKGYFVDFGKKCSEC

SEQ ID NO: 2806406 - protein, 23 aa, Entamoeba invadens
TNYTTKSKLCYKINKATQKLVDY

SEQ ID NO: 2806407 - protein, 27 aa, Entamoeba invadens
TPAADGYCWTYKCDAISGYCIKNTRGT

SEQ ID NO: 2806408 - protein, 18 aa, Entamoeba invadens
TPAIPKNLSLLITKSRFP

SEQ ID NO: 2806409 - protein, 18 aa, Entamoeba invadens
TPAQRLSKLALFRDSLKK

SEQ ID NO: 2806410 - protein, 28 aa, Entamoeba invadens
TPCCLQRIKYMRMFFFIIFFWSTSSQVL

SEQ ID NO: 2806411 - protein, 25 aa, Entamoeba invadens
TPCTPRIYMKAIFFTLTLNSSYSVL

SEQ ID NO: 2806412 - protein, 20 aa, Entamoeba invadens
TPDECGLCDITKGYRSDCQG

SEQ ID NO: 2806413 - protein, 24 aa, Entamoeba invadens
TPEEVKCVLILLSIVLIAQMGAIR

SEQ ID NO: 2806414 - protein, 25 aa, Entamoeba invadens
TPEGCTFCSPGFFLQFSECQKCTEN

SEQ ID NO: 2806415 - protein, 20 aa, Entamoeba invadens
TPEKCLSCNNNYYLENNKCN

SEQ ID NO: 2806416 - protein, 18 aa, Entamoeba invadens
TPESIALDALLSILLSVV

SEQ ID NO: 2806417 - protein, 27 aa, Entamoeba invadens
TPFGECPSCLDGFFLNSLTCYPCSVSC

SEQ ID NO: 2806418 - protein, 24 aa, Entamoeba invadens
TPFKMRKDVFQKFLMMITKLNATD

SEQ ID NO: 2806419 - protein, 22 aa, Entamoeba invadens
TPFNSRGKWLVFSPEEASYTIQ

SEQ ID NO: 2806420 - protein, 19 aa, Entamoeba invadens
TPFTFFGILEDFRNQCIGI

SEQ ID NO: 2806421 - protein, 20 aa, Entamoeba invadens
TPGGCILCNEGFYLQNWKCH

SEQ ID NO: 2806422 - protein, 27 aa, Entamoeba invadens
TPGTYSFCFDNSMSLYTGKLVEFKLQT

SEQ ID NO: 2806423 - protein, 19 aa, Entamoeba invadens
TPICPKYVFYFDPQVLIIP

SEQ ID NO: 2806424 - protein, 23 aa, Entamoeba invadens
TPILDFLNSFVFHRYMYFILCIM

SEQ ID NO: 2806425 - protein, 20 aa, Entamoeba invadens
TPILVALRFNHPEIALEIVK

SEQ ID NO: 2806426 - protein, 23 aa, Entamoeba invadens
TPISIPETIEYISIDTILGELET

SEQ ID NO: 2806427 - protein, 17 aa, Entamoeba invadens
TPITILLLFALLCILCN

SEQ ID NO: 2806428 - protein, 20 aa, Entamoeba invadens
TPKCKKCPNNFLSVDGNNYY

SEQ ID NO: 2806429 - protein, 21 aa, Entamoeba invadens
TPKFIGCKMYLTGVCVECEKD

SEQ ID NO: 2806430 - protein, 18 aa, Entamoeba invadens
TPKISQRYDYCTFNNEEN

SEQ ID NO: 2806431 - protein, 23 aa, Entamoeba invadens
TPLDTLEGISFILSSLKTSLKSA

SEQ ID NO: 2806432 - protein, 19 aa, Entamoeba invadens
TPLHIACLCGYQQITEILL

SEQ ID NO: 2806433 - protein, 17 aa, Entamoeba invadens
TPLKITRYDSVRHLDEI

SEQ ID NO: 2806434 - protein, 18 aa, Entamoeba invadens
TPLLFDSFGNFLVYGTDC

SEQ ID NO: 2806435 - protein, 17 aa, Entamoeba invadens
TPLLSFDSTYNFNKPQL

SEQ ID NO: 2806436 - protein, 19 aa, Entamoeba invadens
TPLMTALRKNRGECALVLL

SEQ ID NO: 2806437 - protein, 28 aa, Entamoeba invadens
TPLSLIVCTSMLYYLLGNAIFYGLFALF

SEQ ID NO: 2806438 - protein, 22 aa, Entamoeba invadens
TPLSRLQTMFDMLSQQRNQDAL

SEQ ID NO: 2806439 - protein, 22 aa, Entamoeba invadens
TPLTMFCCCCLVFGMMTDLTSL

SEQ ID NO: 2806440 - protein, 19 aa, Entamoeba invadens
TPMKSVCEKYMLQLVEKTQ

SEQ ID NO: 2806441 - protein, 18 aa, Entamoeba invadens
TPNFSDMGSPFLFQKKNF

SEQ ID NO: 2806442 - protein, 21 aa, Entamoeba invadens
TPNIFKSIRIIFASNAGGKLF

SEQ ID NO: 2806443 - protein, 19 aa, Entamoeba invadens
TPNIGLYWYLFTNMFQEYS

SEQ ID NO: 2806444 - protein, 23 aa, Entamoeba invadens
TPQCAQYGYSQCKIGEDNCLINC

SEQ ID NO: 2806445 - protein, 25 aa, Entamoeba invadens
TPQFYQLICLLNFQESPVMFLHIVN

SEQ ID NO: 2806446 - protein, 22 aa, Entamoeba invadens
TPRGRVRFLLRPSGAVGCNTVN

SEQ ID NO: 2806447 - protein, 20 aa, Entamoeba invadens
TPSDKCVWLDRSSKTFGYCP

SEQ ID NO: 2806448 - protein, 24 aa, Entamoeba invadens
TPSFCLTCQNGFYLNNQHECISNE

SEQ ID NO: 2806449 - protein, 18 aa, Entamoeba invadens
TPSFKIASIMLIALFVYD

SEQ ID NO: 2806450 - protein, 29 aa, Entamoeba invadens
TPSISKYSMRSWLACKRSNLDKDECTHLR

SEQ ID NO: 2806451 - protein, 19 aa, Entamoeba invadens
TPSNAMFWAVFFVTQIFTV

SEQ ID NO: 2806452 - protein, 20 aa, Entamoeba invadens
TPSRKCCYTCDDVIEAYKER

SEQ ID NO: 2806453 - protein, 22 aa, Entamoeba invadens
TPSRLKVWMPIINTVFSQRIEL

SEQ ID NO: 2806454 - protein, 19 aa, Entamoeba invadens
TPSTCVLCADDYFMNISGC

SEQ ID NO: 2806455 - protein, 23 aa, Entamoeba invadens
TPTRLKLSLQFYNEHRIERNGTL

SEQ ID NO: 2806456 - protein, 23 aa, Entamoeba invadens
TPVAFECNEGFVLINGSCIDINQ

SEQ ID NO: 2806457 - protein, 21 aa, Entamoeba invadens
TPVAFECNEGFVLTNGSCKAT

SEQ ID NO: 2806458 - protein, 20 aa, Entamoeba invadens
TPVAKLFFKKMSKVKNTRHL

SEQ ID NO: 2806459 - protein, 20 aa, Entamoeba invadens
TPVAWIVVGVLTFILFLVII

SEQ ID NO: 2806460 - protein, 18 aa, Entamoeba invadens
TPVFSFVYPFAINLSTFL

SEQ ID NO: 2806461 - protein, 25 aa, Entamoeba invadens
TPVKKRSENVFGFVCDDQLCLMHLS

SEQ ID NO: 2806462 - protein, 29 aa, Entamoeba invadens
TPVNCTIDQAFECFDSITITEEDSVSLKN

SEQ ID NO: 2806463 - protein, 23 aa, Entamoeba invadens
TPWNCLDPEIGFVFEDEQVVWVG

SEQ ID NO: 2806464 - protein, 34 aa, Entamoeba invadens
TPYTFKCIGNYWVAGFLFILSFVFFVMCTVFLVL

SEQ ID NO: 2806465 - protein, 23 aa, Entamoeba invadens
TPYTKTRWGIFVVTLLLFIYRMV

SEQ ID NO: 2806466 - protein, 27 aa, Entamoeba invadens
TQAPGVLCSYGILKKGGLECLRIKSIE

SEQ ID NO: 2806467 - protein, 27 aa, Entamoeba invadens
TQAVWWVIFVCVFFRMIEHKRRKKAQK

SEQ ID NO: 2806468 - protein, 26 aa, Entamoeba invadens
TQAVWWVIFVCVFFVLIVILLFIIMC

SEQ ID NO: 2806469 - protein, 25 aa, Entamoeba invadens
TQAVWWVIFVCVFFVVIVILMLIIM

SEQ ID NO: 2806470 - protein, 29 aa, Entamoeba invadens
TQCAESYFIGLGMQCIKCNTSCASCESET

SEQ ID NO: 2806471 - protein, 17 aa, Entamoeba invadens
TQCDLGFYLDGTGSCTT

SEQ ID NO: 2806472 - protein, 23 aa, Entamoeba invadens
TQCDPNCRIGYCSHDNGCTNCKD

SEQ ID NO: 2806473 - protein, 23 aa, Entamoeba invadens
TQCDPNCRIGYCSHDNGCTSCKD

SEQ ID NO: 2806474 - protein, 24 aa, Entamoeba invadens
TQCGDWPVTCRKVRDNSTCSFVCG

SEQ ID NO: 2806475 - protein, 19 aa, Entamoeba invadens
TQCRICSFGFYKKSGKCYS

SEQ ID NO: 2806476 - protein, 25 aa, Entamoeba invadens
TQCSSCLNSTYCFRCSSTHYFGEKE

SEQ ID NO: 2806477 - protein, 17 aa, Entamoeba invadens
TQDFCKRVKYDVCLQNV

SEQ ID NO: 2806478 - protein, 23 aa, Entamoeba invadens
TQDMKCVEWWNSLVKSPEKFQKV

SEQ ID NO: 2806479 - protein, 24 aa, Entamoeba invadens
TQEMCKFTLNRKCVECVNNYTIDD

SEQ ID NO: 2806480 - protein, 25 aa, Entamoeba invadens
TQEMPRLFLRVKLMLDASKGILYLH

SEQ ID NO: 2806481 - protein, 20 aa, Entamoeba invadens
TQEMREVAERELAKTQEELK

SEQ ID NO: 2806482 - protein, 23 aa, Entamoeba invadens
TQESFKAISKRGKQVEQLNQAST

SEQ ID NO: 2806483 - protein, 19 aa, Entamoeba invadens
TQEYLEFVNRLGTIERVDD

SEQ ID NO: 2806484 - protein, 19 aa, Entamoeba invadens
TQFETYVSIIFKNETSEKQ

SEQ ID NO: 2806485 - protein, 25 aa, Entamoeba invadens
TQFFNRTRLGLKIYYDHLVNDKFKT

SEQ ID NO: 2806486 - protein, 19 aa, Entamoeba invadens
TQFIPSGGCVKCNDGYYRS

SEQ ID NO: 2806487 - protein, 19 aa, Entamoeba invadens
TQFKYPWDIVNYISNGKRL

SEQ ID NO: 2806488 - protein, 26 aa, Entamoeba invadens
TQFVPSGGCVKCINGYYRNGLSCEKC

SEQ ID NO: 2806489 - protein, 18 aa, Entamoeba invadens
TQGKCSMCIDGYYVDEKS

SEQ ID NO: 2806490 - protein, 17 aa, Entamoeba invadens
TQIARDILVEANQRHLK

SEQ ID NO: 2806491 - protein, 17 aa, Entamoeba invadens
TQIEFEFACCGFDNETT

SEQ ID NO: 2806492 - protein, 17 aa, Entamoeba invadens
TQIKECVSTYCNANNDD

SEQ ID NO: 2806493 - protein, 17 aa, Entamoeba invadens
TQILAIFPFDEKTYFSL

SEQ ID NO: 2806494 - protein, 17 aa, Entamoeba invadens
TQILRVDMLNIFRDSSL

SEQ ID NO: 2806495 - protein, 18 aa, Entamoeba invadens
TQIPRCFKCDSNCDNCVT

SEQ ID NO: 2806496 - protein, 23 aa, Entamoeba invadens
TQIQNKCFQRALVYVGGSDSFSC

SEQ ID NO: 2806497 - protein, 19 aa, Entamoeba invadens
TQKIYGCYQCNYTTDDALS

SEQ ID NO: 2806498 - protein, 18 aa, Entamoeba invadens
TQLDFSWSSTDDLPLEIL

SEQ ID NO: 2806499 - protein, 25 aa, Entamoeba invadens
TQLDQLRIGKNIKIGNFKNTQTYTV

SEQ ID NO: 2806500 - protein, 25 aa, Entamoeba invadens
TQLFPSQFYLLSLFGFISDQLLVKN

SEQ ID NO: 2806501 - protein, 18 aa, Entamoeba invadens
TQLGKEIFEFFRNMSIQL

SEQ ID NO: 2806502 - protein, 23 aa, Entamoeba invadens
TQLKRVNCSREFVMNRTASIQDG

SEQ ID NO: 2806503 - protein, 25 aa, Entamoeba invadens
TQLNISICFNHDFTFTTLFSCGLLV

SEQ ID NO: 2806504 - protein, 17 aa, Entamoeba invadens
TQLPVVRYLLLKTQFVD

SEQ ID NO: 2806505 - protein, 21 aa, Entamoeba invadens
TQLQGVVMLIEIVRPEEKSVL

SEQ ID NO: 2806506 - protein, 18 aa, Entamoeba invadens
TQLTDFIVMILIVGTIIS

SEQ ID NO: 2806507 - protein, 20 aa, Entamoeba invadens
TQNSMCFFCKNECYLYENKC

SEQ ID NO: 2806508 - protein, 24 aa, Entamoeba invadens
TQPNQFLTWAFMILLLSLASFYAF

SEQ ID NO: 2806509 - protein, 19 aa, Entamoeba invadens
TQPRRVAAITLAQRVSKEI

SEQ ID NO: 2806510 - protein, 18 aa, Entamoeba invadens
TQPYLGIDALYIIHSHDE

SEQ ID NO: 2806511 - protein, 24 aa, Entamoeba invadens
TQQRMIFLWMVWLVMNQHTTVFGF

SEQ ID NO: 2806512 - protein, 17 aa, Entamoeba invadens
TQRFCFREKNTIVYNKV

SEQ ID NO: 2806513 - protein, 20 aa, Entamoeba invadens
TQRKGFKFLPTPIAVESLEL

SEQ ID NO: 2806514 - protein, 23 aa, Entamoeba invadens
TQSGCLQCEKGYYSVNGNECAKC

SEQ ID NO: 2806515 - protein, 24 aa, Entamoeba invadens
TQSGCSKCALGFYTYKNNQCKSCN

SEQ ID NO: 2806516 - protein, 18 aa, Entamoeba invadens
TQSNCVVQFSGDVFNLQN

SEQ ID NO: 2806517 - protein, 17 aa, Entamoeba invadens
TQTKMILLNSLSNFGSI

SEQ ID NO: 2806518 - protein, 23 aa, Entamoeba invadens
TQTKYDFGPCISRGEKQNRYRPE

SEQ ID NO: 2806519 - protein, 18 aa, Entamoeba invadens
TQTLRSYLKVPLRCSVLL

SEQ ID NO: 2806520 - protein, 26 aa, Entamoeba invadens
TQVKTWNWWTVFSFVISFLLFILFVL

SEQ ID NO: 2806521 - protein, 20 aa, Entamoeba invadens
TQWRAVGGIVVSVVAVVNGA

SEQ ID NO: 2806522 - protein, 18 aa, Entamoeba invadens
TQYAIALKSEVRSSAQFR

SEQ ID NO: 2806523 - protein, 25 aa, Entamoeba invadens
TQYSGGGFYCRLCDKGYHLSVDGVC

SEQ ID NO: 2806524 - protein, 19 aa, Entamoeba invadens
TRAHLLCQLEFYNEKIKTQ

SEQ ID NO: 2806525 - protein, 22 aa, Entamoeba invadens
TRCHPYYFLVSPFCISCPKNCM

SEQ ID NO: 2806526 - protein, 20 aa, Entamoeba invadens
TRCLECMDHFYLSNYNCDIC

SEQ ID NO: 2806527 - protein, 21 aa, Entamoeba invadens
TRCLECMDHFYLSNYNCDICK

SEQ ID NO: 2806528 - protein, 21 aa, Entamoeba invadens
TRDGVHFNNKCFEYKCVETCT

SEQ ID NO: 2806529 - protein, 23 aa, Entamoeba invadens
TRDLKWGTKVPMEGFENKVFYVW

SEQ ID NO: 2806530 - protein, 27 aa, Entamoeba invadens
TRDLLRLYYICFLNAFDVTEFEKLLSE

SEQ ID NO: 2806531 - protein, 23 aa, Entamoeba invadens
TRECIFCNGGYFIKEGSCSSCTP

SEQ ID NO: 2806532 - protein, 21 aa, Entamoeba invadens
TREKNDFIKWGFYQTNPDFTV

SEQ ID NO: 2806533 - protein, 28 aa, Entamoeba invadens
TRFAYKLFIKIYYKNVWTQDDIRVLIGA

SEQ ID NO: 2806534 - protein, 20 aa, Entamoeba invadens
TRFVTGYSLWPIVHSPNVIG

SEQ ID NO: 2806535 - protein, 17 aa, Entamoeba invadens
TRFYRNSEKFKMDYYEI

SEQ ID NO: 2806536 - protein, 18 aa, Entamoeba invadens
TRGFGIFFGLVFTLLGAV

SEQ ID NO: 2806537 - protein, 20 aa, Entamoeba invadens
TRGKKMVFIFTMRGIGNLIA

SEQ ID NO: 2806538 - protein, 27 aa, Entamoeba invadens
TRGNCLILADGLKGKWFTFTSEKDVSL

SEQ ID NO: 2806539 - protein, 19 aa, Entamoeba invadens
TRGTLKVGITNLVSVVPAI

SEQ ID NO: 2806540 - protein, 24 aa, Entamoeba invadens
TRIAMPDCRIVFLLFSSIPSTCVG

SEQ ID NO: 2806541 - protein, 25 aa, Entamoeba invadens
TRIAMPDCRIVFLLFSSIPSTCVGN

SEQ ID NO: 2806542 - protein, 24 aa, Entamoeba invadens
TRICTKCLSGFYLQDGECLQIKNC

SEQ ID NO: 2806543 - protein, 25 aa, Entamoeba invadens
TRIRDLRIPYSVWFASSRSILESVA

SEQ ID NO: 2806544 - protein, 19 aa, Entamoeba invadens
TRKCLSCNKGKYPSSVYPY

SEQ ID NO: 2806545 - protein, 22 aa, Entamoeba invadens
TRKEAYLQILSRKTRKYMPKHI

SEQ ID NO: 2806546 - protein, 17 aa, Entamoeba invadens
TRLCIFKDAVRSFNLES

SEQ ID NO: 2806547 - protein, 18 aa, Entamoeba invadens
TRLHPALAQVFLDHKDYV

SEQ ID NO: 2806548 - protein, 20 aa, Entamoeba invadens
TRLRGLKIPYTVWFSKSRKP

SEQ ID NO: 2806549 - protein, 26 aa, Entamoeba invadens
TRLSSYGVDCVQTYGSVLVVGLFGQN

SEQ ID NO: 2806550 - protein, 17 aa, Entamoeba invadens
TRLTNLVAVVSFNPNYV

SEQ ID NO: 2806551 - protein, 25 aa, Entamoeba invadens
TRLVDGMCVGLALNCKTFNSENYCV

SEQ ID NO: 2806552 - protein, 19 aa, Entamoeba invadens
TRLYWLSKTLSLSFYAQVK

SEQ ID NO: 2806553 - protein, 18 aa, Entamoeba invadens
TRMICPVYYKVSVTEGVI

SEQ ID NO: 2806554 - protein, 24 aa, Entamoeba invadens
TRMTRFWTYFGMWSCGLYFAINFL

SEQ ID NO: 2806555 - protein, 19 aa, Entamoeba invadens
TRNAISRFILLSSNNPVID

SEQ ID NO: 2806556 - protein, 23 aa, Entamoeba invadens
TRNDRCYLCSSGFTENGECISCD

SEQ ID NO: 2806557 - protein, 19 aa, Entamoeba invadens
TRPPIMCELTVPKTKEQIP

SEQ ID NO: 2806558 - protein, 20 aa, Entamoeba invadens
TRPYKMFSLPVALFCLTPLT

SEQ ID NO: 2806559 - protein, 25 aa, Entamoeba invadens
TRQYTLFVVWGFYFVLYLRKCFVRP

SEQ ID NO: 2806560 - protein, 30 aa, Entamoeba invadens
TRRMFAWKEWLYPRRHLYDRVFISDLRDIY

SEQ ID NO: 2806561 - protein, 18 aa, Entamoeba invadens
TRRPVIQPNSGFMAQLAE

SEQ ID NO: 2806562 - protein, 29 aa, Entamoeba invadens
TRSCLKCSPECKTCLSTATTCLSCYNETY

SEQ ID NO: 2806563 - protein, 23 aa, Entamoeba invadens
TRSCTLCKSTFYISDHKKCSKCD

SEQ ID NO: 2806564 - protein, 25 aa, Entamoeba invadens
TRSTWPVIQAMNWMSYALKNPEKYG

SEQ ID NO: 2806565 - protein, 17 aa, Entamoeba invadens
TRSVMWATQNLVRAYDV

SEQ ID NO: 2806566 - protein, 22 aa, Entamoeba invadens
TRTCKRCKENTYLTSSKNCRNC

SEQ ID NO: 2806567 - protein, 24 aa, Entamoeba invadens
TRTCYCVCCGYITTTKHIWEKTEH

SEQ ID NO: 2806568 - protein, 20 aa, Entamoeba invadens
TRTKFASSIIGSRGIGDLVY

SEQ ID NO: 2806569 - protein, 20 aa, Entamoeba invadens
TRTPPCKMAKYIMDPVNLDY

SEQ ID NO: 2806570 - protein, 19 aa, Entamoeba invadens
TRTRLSIVTDDTYDVYTSQ

SEQ ID NO: 2806571 - protein, 19 aa, Entamoeba invadens
TRVRLLRFLQFGKNEVADY

SEQ ID NO: 2806572 - protein, 21 aa, Entamoeba invadens
TRWFYHQLLVKFCFENFEKIE

SEQ ID NO: 2806573 - protein, 18 aa, Entamoeba invadens
TSAFLALYDEMYFDKQTF

SEQ ID NO: 2806574 - protein, 21 aa, Entamoeba invadens
TSALLYWKPLFAEDLLLNVPD

SEQ ID NO: 2806575 - protein, 35 aa, Entamoeba invadens
TSAVKLKRAMWWKNVKLYLIAGAVLLIFLLVLLLA

SEQ ID NO: 2806576 - protein, 18 aa, Entamoeba invadens
TSCATGLVYDSPKSKVCV

SEQ ID NO: 2806577 - protein, 23 aa, Entamoeba invadens
TSCDKHAVWWIILIIVILLLILF

SEQ ID NO: 2806578 - protein, 19 aa, Entamoeba invadens
TSCFEGCTVLATITNGESI

SEQ ID NO: 2806579 - protein, 19 aa, Entamoeba invadens
TSCFRRLATRHIHLSGKMW

SEQ ID NO: 2806580 - protein, 17 aa, Entamoeba invadens
TSCILCDSSYYLFNETC

SEQ ID NO: 2806581 - protein, 21 aa, Entamoeba invadens
TSCLDCPSFYFTKSTTSVECQ

SEQ ID NO: 2806582 - protein, 17 aa, Entamoeba invadens
TSCNFCIQGSFQNETGK

SEQ ID NO: 2806583 - protein, 22 aa, Entamoeba invadens
TSCNLNSLKWCDSCIDGYYLTT

SEQ ID NO: 2806584 - protein, 18 aa, Entamoeba invadens
TSCPADCVGDRVCKDLEG

SEQ ID NO: 2806585 - protein, 20 aa, Entamoeba invadens
TSCRLNVVSIFFLSVFCIIL

SEQ ID NO: 2806586 - protein, 19 aa, Entamoeba invadens
TSCSTCPAGTFSSSGSSSC

SEQ ID NO: 2806587 - protein, 17 aa, Entamoeba invadens
TSCSVCADGYFIIESES

SEQ ID NO: 2806588 - protein, 18 aa, Entamoeba invadens
TSCSVCADGYFIIESESR

SEQ ID NO: 2806589 - protein, 18 aa, Entamoeba invadens
TSCTSCPAGTYSSTGASS

SEQ ID NO: 2806590 - protein, 19 aa, Entamoeba invadens
TSCYGGLNGQCYGCNYGYY

SEQ ID NO: 2806591 - protein, 32 aa, Entamoeba invadens
TSDFLCKFLSLPRLPLPLFSALLHLTATLSFT

SEQ ID NO: 2806592 - protein, 24 aa, Entamoeba invadens
TSDGCLACNTGFYLKDGVCTTCPN

SEQ ID NO: 2806593 - protein, 27 aa, Entamoeba invadens
TSDIPMFIACISFCLVMSLSFPLVHHA

SEQ ID NO: 2806594 - protein, 24 aa, Entamoeba invadens
TSDMFKYSFNFTMGKGYLISNKKL

SEQ ID NO: 2806595 - protein, 24 aa, Entamoeba invadens
TSDMLLNYSICLSDDFQFSTAFEC

SEQ ID NO: 2806596 - protein, 18 aa, Entamoeba invadens
TSEILCGSNDIGNERLAP

SEQ ID NO: 2806597 - protein, 19 aa, Entamoeba invadens
TSELRRTRNVIILEGNSEV

SEQ ID NO: 2806598 - protein, 26 aa, Entamoeba invadens
TSEPFNYTAFCFMNGTNFVPWYDRGM

SEQ ID NO: 2806599 - protein, 24 aa, Entamoeba invadens
TSERKCIVCKTGFYPDSNGVCFRC

SEQ ID NO: 2806600 - protein, 18 aa, Entamoeba invadens
TSEWRTGEIPNTFLCNAC

SEQ ID NO: 2806601 - protein, 18 aa, Entamoeba invadens
TSFCKKCNSTQCIQCKEQ

SEQ ID NO: 2806602 - protein, 22 aa, Entamoeba invadens
TSFEIDNSFNLVFYLNSGFDVF

SEQ ID NO: 2806603 - protein, 41 aa, Entamoeba invadens
TSFEVFWRITLLIVMCVATLFFLYVLRGIPFKTWSLEQKAT

SEQ ID NO: 2806604 - protein, 20 aa, Entamoeba invadens
TSFGDCLPRYTIEGCDVEVT

SEQ ID NO: 2806605 - protein, 28 aa, Entamoeba invadens
TSFVLLSRYPKFLTFEAKAEVFRKRMRK

SEQ ID NO: 2806606 - protein, 17 aa, Entamoeba invadens
TSFWFKMFCIWYTGEIC

SEQ ID NO: 2806607 - protein, 35 aa, Entamoeba invadens
TSGGCSVCSDGYYKNGLDCFNCYISCSSCISLPTK

SEQ ID NO: 2806608 - protein, 21 aa, Entamoeba invadens
TSGICSQCLVNYTITSPISKV

SEQ ID NO: 2806609 - protein, 21 aa, Entamoeba invadens
TSGICTACIINYVFEETKSKV

SEQ ID NO: 2806610 - protein, 22 aa, Entamoeba invadens
TSGSCLPRSLLYESCDVEITEN

SEQ ID NO: 2806611 - protein, 19 aa, Entamoeba invadens
TSGTEVNNLIGIFKKCETK

SEQ ID NO: 2806612 - protein, 22 aa, Entamoeba invadens
TSIGLFLFWMLLGKSLPQKILL

SEQ ID NO: 2806613 - protein, 29 aa, Entamoeba invadens
TSIKRNRLKGGRNLKVYFVCESYIAIGES

SEQ ID NO: 2806614 - protein, 20 aa, Entamoeba invadens
TSKCVTCSKGTYSSSRSAYC

SEQ ID NO: 2806615 - protein, 24 aa, Entamoeba invadens
TSKIYTETIVSFKSNVFKIPVFVK

SEQ ID NO: 2806616 - protein, 27 aa, Entamoeba invadens
TSKSQSGCLLCDTGFYIDNQRCLPCNS

SEQ ID NO: 2806617 - protein, 27 aa, Entamoeba invadens
TSKSQSGCLLCNTGFYIDNQKCLPCNT

SEQ ID NO: 2806618 - protein, 24 aa, Entamoeba invadens
TSKVDLFYLFFLLLPFLVLVVIIP

SEQ ID NO: 2806619 - protein, 26 aa, Entamoeba invadens
TSKYNAISFFPLVLIEQFRKLANVYF

SEQ ID NO: 2806620 - protein, 20 aa, Entamoeba invadens
TSLCSKCATGFYSLSGSSGC

SEQ ID NO: 2806621 - protein, 17 aa, Entamoeba invadens
TSLDMIGNISIFIHNVV

SEQ ID NO: 2806622 - protein, 17 aa, Entamoeba invadens
TSLEMRKFGALEKEKDV

SEQ ID NO: 2806623 - protein, 34 aa, Entamoeba invadens
TSLFIACLLEAFAPYEWQHLLIPFLPVKLTELTQ

SEQ ID NO: 2806624 - protein, 29 aa, Entamoeba invadens
TSLHSAFTLRWLYTAAHPIFIVLSIILFV

SEQ ID NO: 2806625 - protein, 28 aa, Entamoeba invadens
TSLIRCGFRLCYFIFLIQWTNTINTTLP

SEQ ID NO: 2806626 - protein, 17 aa, Entamoeba invadens
TSLLATHCTFPYKMDVF

SEQ ID NO: 2806627 - protein, 25 aa, Entamoeba invadens
TSLLCISGWLGYFLRYSHPDIAKLT

SEQ ID NO: 2806628 - protein, 26 aa, Entamoeba invadens
TSLMYARCLIVGFGVNMALFGFGEMV

SEQ ID NO: 2806629 - protein, 20 aa, Entamoeba invadens
TSLTAFPAVKSFDMGLRVFA

SEQ ID NO: 2806630 - protein, 17 aa, Entamoeba invadens
TSLYEGVKVKLNLVDYL

SEQ ID NO: 2806631 - protein, 19 aa, Entamoeba invadens
TSLYGMAIKFFPFLKSLSF

SEQ ID NO: 2806632 - protein, 24 aa, Entamoeba invadens
TSMFPFQFTDGYAYLLSNNKLMRF

SEQ ID NO: 2806633 - protein, 26 aa, Entamoeba invadens
TSMILKFWKEACEFAKNGDFDEAANK

SEQ ID NO: 2806634 - protein, 23 aa, Entamoeba invadens
TSNCKSCLSGYVFTTPLSEKCES

SEQ ID NO: 2806635 - protein, 25 aa, Entamoeba invadens
TSNEKCVLCTTGYYLNSSFECEKCD

SEQ ID NO: 2806636 - protein, 26 aa, Entamoeba invadens
TSNIFRISFYFGERYDTFLLIQSVVL

SEQ ID NO: 2806637 - protein, 21 aa, Entamoeba invadens
TSNKCLPCYYTKLCASCSNST

SEQ ID NO: 2806638 - protein, 17 aa, Entamoeba invadens
TSNNCFEFATSDYQFDI

SEQ ID NO: 2806639 - protein, 19 aa, Entamoeba invadens
TSNPQIVFLRKGEACEFEI

SEQ ID NO: 2806640 - protein, 18 aa, Entamoeba invadens
TSNPRLIYIYPYSSTSKF

SEQ ID NO: 2806641 - protein, 25 aa, Entamoeba invadens
TSNQARCFYCQCSYIDGGASLVMFA

SEQ ID NO: 2806642 - protein, 22 aa, Entamoeba invadens
TSNRCMSCFELIPNCQLCEYNN

SEQ ID NO: 2806643 - protein, 17 aa, Entamoeba invadens
TSPEIVEELAFTNPQEV

SEQ ID NO: 2806644 - protein, 19 aa, Entamoeba invadens
TSPHYKAPSIDLSFPRSIF

SEQ ID NO: 2806645 - protein, 26 aa, Entamoeba invadens
TSPLKKYICLSSDFIFTVSNEILLFD

SEQ ID NO: 2806646 - protein, 26 aa, Entamoeba invadens
TSPQCIKDDCSVECFQLPPPGSSSDV

SEQ ID NO: 2806647 - protein, 19 aa, Entamoeba invadens
TSPTRPYVGYLFSSNSSEI

SEQ ID NO: 2806648 - protein, 17 aa, Entamoeba invadens
TSPWKDQFPEWALLPKT

SEQ ID NO: 2806649 - protein, 17 aa, Entamoeba invadens
TSQCALCDISYFRNTNG

SEQ ID NO: 2806650 - protein, 24 aa, Entamoeba invadens
TSQCISCLPGYYFSEDQKNCFDCS

SEQ ID NO: 2806651 - protein, 20 aa, Entamoeba invadens
TSQCVKWNLIVNCKSYDLKT

SEQ ID NO: 2806652 - protein, 17 aa, Entamoeba invadens
TSQIAYLFIDGNVMQSV

SEQ ID NO: 2806653 - protein, 18 aa, Entamoeba invadens
TSQKLPIVNVERVTFNDF

SEQ ID NO: 2806654 - protein, 26 aa, Entamoeba invadens
TSQLKSGRIIPEFKKVFTEAIDDSLK

SEQ ID NO: 2806655 - protein, 25 aa, Entamoeba invadens
TSQNCGKCPIGYGLIRNTDSKITCV

SEQ ID NO: 2806656 - protein, 20 aa, Entamoeba invadens
TSQNSAGRQLSQWANDMEQK

SEQ ID NO: 2806657 - protein, 19 aa, Entamoeba invadens
TSQVIAWIFIIPIMIYAGV

SEQ ID NO: 2806658 - protein, 22 aa, Entamoeba invadens
TSQVSFTFVPAFSIAFVGNYMK

SEQ ID NO: 2806659 - protein, 17 aa, Entamoeba invadens
TSRCLTCEMGHFLDTNY

SEQ ID NO: 2806660 - protein, 22 aa, Entamoeba invadens
TSRGFPYITFIILFMIFIVYTL

SEQ ID NO: 2806661 - protein, 24 aa, Entamoeba invadens
TSRNFKELLSIILSTGNYLNSDYP

SEQ ID NO: 2806662 - protein, 24 aa, Entamoeba invadens
TSSADPALGFLMYKYAKNHNKKIH

SEQ ID NO: 2806663 - protein, 25 aa, Entamoeba invadens
TSSASCYICPAGYYRGATDEGCKSC

SEQ ID NO: 2806664 - protein, 25 aa, Entamoeba invadens
TSSFNLNCRKCSLNGEETISTITLG

SEQ ID NO: 2806665 - protein, 24 aa, Entamoeba invadens
TSSFSKNSLLCLAHPNCLSNPKVG

SEQ ID NO: 2806666 - protein, 19 aa, Entamoeba invadens
TSSGCLQCSNGYYLGKVIP

SEQ ID NO: 2806667 - protein, 18 aa, Entamoeba invadens
TSSIFCYDSDEGDCAIES

SEQ ID NO: 2806668 - protein, 32 aa, Entamoeba invadens
TSSKFLLNSVIEFSAYLTYEFGKELHNVVDMM

SEQ ID NO: 2806669 - protein, 23 aa, Entamoeba invadens
TSSLRQYRLAVFTTEVPENSICT

SEQ ID NO: 2806670 - protein, 22 aa, Entamoeba invadens
TSSLYFIFSIMVLPFLPTCPLH

SEQ ID NO: 2806671 - protein, 23 aa, Entamoeba invadens
TSSPFSCTFCHSTCVYDCSPITG

SEQ ID NO: 2806672 - protein, 25 aa, Entamoeba invadens
TSSRCLSCGVGYGVDKNGQCQKCID

SEQ ID NO: 2806673 - protein, 24 aa, Entamoeba invadens
TSSRYCYKCKSGMYPDTSIGKCKP

SEQ ID NO: 2806674 - protein, 17 aa, Entamoeba invadens
TSSSSVWYEFKFMERVQ

SEQ ID NO: 2806675 - protein, 27 aa, Entamoeba invadens
TSSTNCILCNSSLIVKNGFCVSGSNVS

SEQ ID NO: 2806676 - protein, 18 aa, Entamoeba invadens
TSSVCLPLATFASAPSSV

SEQ ID NO: 2806677 - protein, 24 aa, Entamoeba invadens
TSSVLPVSMPIHFLVWPLEQRADI

SEQ ID NO: 2806678 - protein, 25 aa, Entamoeba invadens
TSTDCLSCASGLYLNDSTHQCIDCD

SEQ ID NO: 2806679 - protein, 18 aa, Entamoeba invadens
TSTECLLHPTSLLQQQQI

SEQ ID NO: 2806680 - protein, 25 aa, Entamoeba invadens
TSTFCLSCKAGTFLSDHKCITNNDL

SEQ ID NO: 2806681 - protein, 26 aa, Entamoeba invadens
TSTFCLSCKDGMFLSDHKCITNNDLD

SEQ ID NO: 2806682 - protein, 21 aa, Entamoeba invadens
TSTKCLSCEIGYYQGDNYKCL

SEQ ID NO: 2806683 - protein, 25 aa, Entamoeba invadens
TSTKCLSCLSGAFLTDNVCNTNDDL

SEQ ID NO: 2806684 - protein, 23 aa, Entamoeba invadens
TSTKCLSCPHNTFLSNYKCNTNE

SEQ ID NO: 2806685 - protein, 24 aa, Entamoeba invadens
TSTKCLSCPPNMYLSNYKCNTNNE

SEQ ID NO: 2806686 - protein, 22 aa, Entamoeba invadens
TSTKCLSCPQNTYLSNYKCNTN

SEQ ID NO: 2806687 - protein, 23 aa, Entamoeba invadens
TSTKCLSCSQNTYLSIYKCNTNE

SEQ ID NO: 2806688 - protein, 24 aa, Entamoeba invadens
TSTQCLSCYYSSYLTNYKCISNDN

SEQ ID NO: 2806689 - protein, 25 aa, Entamoeba invadens
TSTSTQCILELISPSGSITSSITQN

SEQ ID NO: 2806690 - protein, 20 aa, Entamoeba invadens
TSVCTSCFDEFYLKENECHK

SEQ ID NO: 2806691 - protein, 19 aa, Entamoeba invadens
TSVFFSYDFTFTSTSALQW

SEQ ID NO: 2806692 - protein, 26 aa, Entamoeba invadens
TSVGCTQCADGYYLVRGNQCAKCFTT

SEQ ID NO: 2806693 - protein, 17 aa, Entamoeba invadens
TSVGLFLAFSILGIIPV

SEQ ID NO: 2806694 - protein, 19 aa, Entamoeba invadens
TSVHFYSLLLILFTFAVLI

SEQ ID NO: 2806695 - protein, 21 aa, Entamoeba invadens
TSVIEWDCINTYDLSVRTFKC

SEQ ID NO: 2806696 - protein, 21 aa, Entamoeba invadens
TSVIGQYKFFRNIKLADSTSE

SEQ ID NO: 2806697 - protein, 21 aa, Entamoeba invadens
TSVIINFKFIKSEIYTSTTTF

SEQ ID NO: 2806698 - protein, 18 aa, Entamoeba invadens
TSVKGVNVIGDWSLISCG

SEQ ID NO: 2806699 - protein, 21 aa, Entamoeba invadens
TSVSFHSFVLIVILMVSLTHS

SEQ ID NO: 2806700 - protein, 24 aa, Entamoeba invadens
TSYCLTCKVGFGLSQNRCKQCSMG

SEQ ID NO: 2806701 - protein, 23 aa, Entamoeba invadens
TSYQWCVEGLLISISKFDMNTTI

SEQ ID NO: 2806702 - protein, 17 aa, Entamoeba invadens
TTAGCMLCEGGHYLSNN

SEQ ID NO: 2806703 - protein, 18 aa, Entamoeba invadens
TTAHFKVTIPSGSSGKVF

SEQ ID NO: 2806704 - protein, 22 aa, Entamoeba invadens
TTAYLRLVSKRGTLNLNSSKII

SEQ ID NO: 2806705 - protein, 20 aa, Entamoeba invadens
TTCASGYYYSSFDCVKCEDK

SEQ ID NO: 2806706 - protein, 23 aa, Entamoeba invadens
TTCILCSTGFVLDVNNKCVAKTT

SEQ ID NO: 2806707 - protein, 20 aa, Entamoeba invadens
TTCISCYFGFVLNVQTSHCD

SEQ ID NO: 2806708 - protein, 23 aa, Entamoeba invadens
TTCISCYFGYKISCAKFLSDGGC

SEQ ID NO: 2806709 - protein, 22 aa, Entamoeba invadens
TTCISCYFWFVLNVQTSHCDLI

SEQ ID NO: 2806710 - protein, 20 aa, Entamoeba invadens
TTCLICKDNYYLSSYSCILG

SEQ ID NO: 2806711 - protein, 21 aa, Entamoeba invadens
TTCLSCKSGYYLNNNTCSTTA

SEQ ID NO: 2806712 - protein, 18 aa, Entamoeba invadens
TTCPIGSSIINGTCGTCE

SEQ ID NO: 2806713 - protein, 23 aa, Entamoeba invadens
TTCPKDYILFEGKCYQTPKELTI

SEQ ID NO: 2806714 - protein, 19 aa, Entamoeba invadens
TTCQLCLNGFSLVNGSCVS

SEQ ID NO: 2806715 - protein, 18 aa, Entamoeba invadens
TTCRSCLNAFYLDNGICS

SEQ ID NO: 2806716 - protein, 18 aa, Entamoeba invadens
TTCSPTFERKCVTCDTGY

SEQ ID NO: 2806717 - protein, 18 aa, Entamoeba invadens
TTCSPTYERKCVTCDTGY

SEQ ID NO: 2806718 - protein, 19 aa, Entamoeba invadens
TTCSSCLKGYYSKEKSEKC

SEQ ID NO: 2806719 - protein, 17 aa, Entamoeba invadens
TTCSTTFERRCVTCDTK

SEQ ID NO: 2806720 - protein, 24 aa, Entamoeba invadens
TTCTECALGCSLCSSKTICLLCSE

SEQ ID NO: 2806721 - protein, 22 aa, Entamoeba invadens
TTCTTCSYSYFLSGSECLKCDD

SEQ ID NO: 2806722 - protein, 23 aa, Entamoeba invadens
TTCTVCNIASVLHDGSCVSVSNF

SEQ ID NO: 2806723 - protein, 21 aa, Entamoeba invadens
TTCVKCKENGFLSESACIEHS

SEQ ID NO: 2806724 - protein, 23 aa, Entamoeba invadens
TTDCYYCVDGYYISSFECLSCSS

SEQ ID NO: 2806725 - protein, 23 aa, Entamoeba invadens
TTDEYKGSLSLPKLYRFSDTLDL

SEQ ID NO: 2806726 - protein, 20 aa, Entamoeba invadens
TTDFFSMWYSSEKIFSNLPY

SEQ ID NO: 2806727 - protein, 26 aa, Entamoeba invadens
TTDRGCLLCIAGYYLSHRECQVCSSS

SEQ ID NO: 2806728 - protein, 18 aa, Entamoeba invadens
TTDRKACGSGKYYIKTLE

SEQ ID NO: 2806729 - protein, 19 aa, Entamoeba invadens
TTDVLYKWESLPYSARPKF

SEQ ID NO: 2806730 - protein, 27 aa, Entamoeba invadens
TTEDIHPFLSVFALLFAKSYASLPTNV

SEQ ID NO: 2806731 - protein, 18 aa, Entamoeba invadens
TTEECSFNIIPMSTRVSA

SEQ ID NO: 2806732 - protein, 17 aa, Entamoeba invadens
TTEGVILVHILKQPFSS

SEQ ID NO: 2806733 - protein, 17 aa, Entamoeba invadens
TTFCEKCDIMGICTSCS

SEQ ID NO: 2806734 - protein, 20 aa, Entamoeba invadens
TTFCYTCLTNEYSISTLNYN

SEQ ID NO: 2806735 - protein, 17 aa, Entamoeba invadens
TTFEIYVGILFLLGITI

SEQ ID NO: 2806736 - protein, 18 aa, Entamoeba invadens
TTFFFHFNETVYFNVMEI

SEQ ID NO: 2806737 - protein, 23 aa, Entamoeba invadens
TTFFLNRCGGWLQLIGPSENVVN

SEQ ID NO: 2806738 - protein, 19 aa, Entamoeba invadens
TTFLSCGLFFKELWNNSAV

SEQ ID NO: 2806739 - protein, 23 aa, Entamoeba invadens
TTFPTTFFFHFNKTVYFNSMELR

SEQ ID NO: 2806740 - protein, 20 aa, Entamoeba invadens
TTFRIYKCTQGILLLTNTYI

SEQ ID NO: 2806741 - protein, 17 aa, Entamoeba invadens
TTFRPKEIAALFFKTLM

SEQ ID NO: 2806742 - protein, 17 aa, Entamoeba invadens
TTGCSLNDNVYCTACNS

SEQ ID NO: 2806743 - protein, 17 aa, Entamoeba invadens
TTGICFSCISGYVLSST

SEQ ID NO: 2806744 - protein, 25 aa, Entamoeba invadens
TTGKCLSCSVGCGFVSDGICKACEA

SEQ ID NO: 2806745 - protein, 22 aa, Entamoeba invadens
TTGVCYRCNSGFYLTPIYTKGV

SEQ ID NO: 2806746 - protein, 23 aa, Entamoeba invadens
TTHKEEFELIAVIPFDSDRKRMS

SEQ ID NO: 2806747 - protein, 23 aa, Entamoeba invadens
TTIFKCSKYIYLFGTSQLLLNKK

SEQ ID NO: 2806748 - protein, 17 aa, Entamoeba invadens
TTIGNYVFKNCKYLETI

SEQ ID NO: 2806749 - protein, 17 aa, Entamoeba invadens
TTIKATVDLVWRVWGAL

SEQ ID NO: 2806750 - protein, 18 aa, Entamoeba invadens
TTILLKLIHSVVVSNNFG

SEQ ID NO: 2806751 - protein, 30 aa, Entamoeba invadens
TTIPSYVAEFARLGGMDVILEKVTKCEGNV

SEQ ID NO: 2806752 - protein, 19 aa, Entamoeba invadens
TTKCCICAVGQDGILTVLE

SEQ ID NO: 2806753 - protein, 18 aa, Entamoeba invadens
TTKGCLQCSDGYFLTNLS

SEQ ID NO: 2806754 - protein, 26 aa, Entamoeba invadens
TTKGCLRCFSGYYLADRMCVKCEYPC

SEQ ID NO: 2806755 - protein, 27 aa, Entamoeba invadens
TTKGCLRCLSGYYLADRMCVKCEYPCV

SEQ ID NO: 2806756 - protein, 26 aa, Entamoeba invadens
TTKGCLRCLSGYYLTDRMCVKCEYPC

SEQ ID NO: 2806757 - protein, 25 aa, Entamoeba invadens
TTKGSCAYCKVCVGTTLLCSECNDG

SEQ ID NO: 2806758 - protein, 18 aa, Entamoeba invadens
TTKKCVAILRVNDINKIT

SEQ ID NO: 2806759 - protein, 21 aa, Entamoeba invadens
TTKLKGMKIPYTVWFSHSRGT

SEQ ID NO: 2806760 - protein, 20 aa, Entamoeba invadens
TTKLKGMKIPYTVWFSKSRG

SEQ ID NO: 2806761 - protein, 20 aa, Entamoeba invadens
TTKLKGMKIPYTVWFSQSRG

SEQ ID NO: 2806762 - protein, 23 aa, Entamoeba invadens
TTKTEKCLLCSSDNVLNSLGSCV

SEQ ID NO: 2806763 - protein, 40 aa, Entamoeba invadens
TTKYLGDLKIEFCEVVGSGWRPSPVLNEIKKCVPIQTHLN

SEQ ID NO: 2806764 - protein, 18 aa, Entamoeba invadens
TTLCIECEGGFSVSSNCT

SEQ ID NO: 2806765 - protein, 28 aa, Entamoeba invadens
TTLFGFCLLCLTILISLLIVLFLELGLS

SEQ ID NO: 2806766 - protein, 24 aa, Entamoeba invadens
TTLFKRIGIYIAVVLSICLLGYAS

SEQ ID NO: 2806767 - protein, 22 aa, Entamoeba invadens
TTLFRIGDAFAQNPLTQIKDDQ

SEQ ID NO: 2806768 - protein, 19 aa, Entamoeba invadens
TTLFSCGLLVFSSPNEITI

SEQ ID NO: 2806769 - protein, 26 aa, Entamoeba invadens
TTLHSCLLCASFTRKSTNRLSKFESE

SEQ ID NO: 2806770 - protein, 21 aa, Entamoeba invadens
TTLIEFPEGMELFKEYTKGFY

SEQ ID NO: 2806771 - protein, 23 aa, Entamoeba invadens
TTLKCIQSWSGRRHGVFSENEKA

SEQ ID NO: 2806772 - protein, 26 aa, Entamoeba invadens
TTLKGCLRCSDGYYLTVTNLCLPCQN

SEQ ID NO: 2806773 - protein, 26 aa, Entamoeba invadens
TTLKRVPKCYSECFTFFKSVLYCLIE

SEQ ID NO: 2806774 - protein, 23 aa, Entamoeba invadens
TTLPRFALVLYWFAFPYNFMNYR

SEQ ID NO: 2806775 - protein, 17 aa, Entamoeba invadens
TTLTIAETIAFTIFGGN

SEQ ID NO: 2806776 - protein, 18 aa, Entamoeba invadens
TTLYDISPVSSWRLGVLI

SEQ ID NO: 2806777 - protein, 18 aa, Entamoeba invadens
TTMALSREECEIVMKNCC

SEQ ID NO: 2806778 - protein, 30 aa, Entamoeba invadens
TTMKRRFLDEFSCLYAKLTKENRIFSNKAV

SEQ ID NO: 2806779 - protein, 17 aa, Entamoeba invadens
TTNCGICNFVGKCTSCL

SEQ ID NO: 2806780 - protein, 18 aa, Entamoeba invadens
TTNCGLCDRSTCMKCLDG

SEQ ID NO: 2806781 - protein, 20 aa, Entamoeba invadens
TTNCTSCSPGSYSNSGASSC

SEQ ID NO: 2806782 - protein, 17 aa, Entamoeba invadens
TTNIPVSYIQYFPSYAN

SEQ ID NO: 2806783 - protein, 21 aa, Entamoeba invadens
TTNKCKLCFDEHQNSGKCSTT

SEQ ID NO: 2806784 - protein, 19 aa, Entamoeba invadens
TTPSLPVFSLFSNTTVSST

SEQ ID NO: 2806785 - protein, 24 aa, Entamoeba invadens
TTQICLSCVPHCKNCNDAKTCVVC

SEQ ID NO: 2806786 - protein, 18 aa, Entamoeba invadens
TTRCTFIPLFNPIEQSSE

SEQ ID NO: 2806787 - protein, 17 aa, Entamoeba invadens
TTRLNFTAATAMDKATK

SEQ ID NO: 2806788 - protein, 18 aa, Entamoeba invadens
TTRLNFTAATAMDKTTKN

SEQ ID NO: 2806789 - protein, 17 aa, Entamoeba invadens
TTRLYKRDMCKKTSSGS

SEQ ID NO: 2806790 - protein, 31 aa, Entamoeba invadens
TTSCSTPSPYGCLSCSVGYYLDDGKCQVCNK

SEQ ID NO: 2806791 - protein, 20 aa, Entamoeba invadens
TTSCTFCPAGTYSSTGASSC

SEQ ID NO: 2806792 - protein, 25 aa, Entamoeba invadens
TTSEYCPFGALWGSFMGITNFCDLW

SEQ ID NO: 2806793 - protein, 25 aa, Entamoeba invadens
TTSGKRPNIFGGVCIDCDSTCVVNN

SEQ ID NO: 2806794 - protein, 18 aa, Entamoeba invadens
TTSGYQRMFVCNKKVPIS

SEQ ID NO: 2806795 - protein, 19 aa, Entamoeba invadens
TTSISCFVLLVGMFVITYG

SEQ ID NO: 2806796 - protein, 17 aa, Entamoeba invadens
TTSKMFFLLFILIIVVT

SEQ ID NO: 2806797 - protein, 27 aa, Entamoeba invadens
TTSLFLVYFCSNYIFPGMLNNFNITTS

SEQ ID NO: 2806798 - protein, 27 aa, Entamoeba invadens
TTSLLASVVFFKCNMSDITFNKVQMRN

SEQ ID NO: 2806799 - protein, 24 aa, Entamoeba invadens
TTSPEMLCEACAEGYVLDLGGHCV

SEQ ID NO: 2806800 - protein, 19 aa, Entamoeba invadens
TTSSLKCETCKIGYYINNF

SEQ ID NO: 2806801 - protein, 18 aa, Entamoeba invadens
TTSVFKRLLMTVVPYAFR

SEQ ID NO: 2806802 - protein, 29 aa, Entamoeba invadens
TTSWKDGKAFCALFHYYHPEVIDFEKTKT

SEQ ID NO: 2806803 - protein, 22 aa, Entamoeba invadens
TTTCLSCTAGYYLASGSCTECA

SEQ ID NO: 2806804 - protein, 22 aa, Entamoeba invadens
TTTCLSCTAGYYLGSGSCTECA

SEQ ID NO: 2806805 - protein, 17 aa, Entamoeba invadens
TTTCTNCQIGTYYDSYY

SEQ ID NO: 2806806 - protein, 17 aa, Entamoeba invadens
TTTFCRGLSYAANYYRF

SEQ ID NO: 2806807 - protein, 24 aa, Entamoeba invadens
TTTKCLLCNSGFMLSLSGTCVVHS

SEQ ID NO: 2806808 - protein, 19 aa, Entamoeba invadens
TTTKCLTCDSNYYLSNNVC

SEQ ID NO: 2806809 - protein, 19 aa, Entamoeba invadens
TTTPILFKTWMQFLHFVGN

SEQ ID NO: 2806810 - protein, 33 aa, Entamoeba invadens
TTTPKSISWLFIIRICSMLILFVISFIHALVPL

SEQ ID NO: 2806811 - protein, 24 aa, Entamoeba invadens
TTTQCTECAFGYYISGNTCSKCDS

SEQ ID NO: 2806812 - protein, 26 aa, Entamoeba invadens
TTTRECLECLPAYYKYRVNESDYCLS

SEQ ID NO: 2806813 - protein, 24 aa, Entamoeba invadens
TTTSCSFCSPGYFSGSGSSLCKQC

SEQ ID NO: 2806814 - protein, 24 aa, Entamoeba invadens
TTTSCSFCSPGYYSGSGASSCTKC

SEQ ID NO: 2806815 - protein, 23 aa, Entamoeba invadens
TTVLKCKYCGQGLVTSTDLMSCE

SEQ ID NO: 2806816 - protein, 20 aa, Entamoeba invadens
TTVLPDRFGVYTILINYTKP

SEQ ID NO: 2806817 - protein, 23 aa, Entamoeba invadens
TTVPCVLHAQSIVEGKTFKMQHN

SEQ ID NO: 2806818 - protein, 26 aa, Entamoeba invadens
TTYLKVCAIIGNLCNYGCEMCDDLYS

SEQ ID NO: 2806819 - protein, 20 aa, Entamoeba invadens
TVALVYKIIGGVGMLALVIV

SEQ ID NO: 2806820 - protein, 25 aa, Entamoeba invadens
TVARIKGKFKVYIFSSTITSYRGYV

SEQ ID NO: 2806821 - protein, 22 aa, Entamoeba invadens
TVAVVGFVYFKRQNIKSQYIDL

SEQ ID NO: 2806822 - protein, 21 aa, Entamoeba invadens
TVCATKVRLYLNEKFEEKEEL

SEQ ID NO: 2806823 - protein, 20 aa, Entamoeba invadens
TVCCIGVGVFIYIVILIVLL

SEQ ID NO: 2806824 - protein, 18 aa, Entamoeba invadens
TVCGVLILIWFVVMVVVV

SEQ ID NO: 2806825 - protein, 17 aa, Entamoeba invadens
TVCLFDYSTSLEEKYEC

SEQ ID NO: 2806826 - protein, 23 aa, Entamoeba invadens
TVCVFVFLGALSFLIEVITHKIE

SEQ ID NO: 2806827 - protein, 29 aa, Entamoeba invadens
TVCVQCPFPMVYCSSSFEALSCSNNYILY

SEQ ID NO: 2806828 - protein, 26 aa, Entamoeba invadens
TVDFEMTRIVPLFLAVYIFVDSPCKA

SEQ ID NO: 2806829 - protein, 29 aa, Entamoeba invadens
TVDNCLECFPTWVGCALCEQGYTLMYRTV

SEQ ID NO: 2806830 - protein, 23 aa, Entamoeba invadens
TVDQKTCRSCYGAETPSRKCCYT

SEQ ID NO: 2806831 - protein, 17 aa, Entamoeba invadens
TVECGGICHVECFRCTV

SEQ ID NO: 2806832 - protein, 23 aa, Entamoeba invadens
TVECLKGFFPFENTCVSIQDYKK

SEQ ID NO: 2806833 - protein, 19 aa, Entamoeba invadens
TVELPLDFLQNSKSWNGDT

SEQ ID NO: 2806834 - protein, 23 aa, Entamoeba invadens
TVESIPFLFLHASYLQNKTPSSF

SEQ ID NO: 2806835 - protein, 25 aa, Entamoeba invadens
TVFEFAVKGLEIFGMKEHLDFDLVQ

SEQ ID NO: 2806836 - protein, 18 aa, Entamoeba invadens
TVFFEAGNGFSFGEIHCY

SEQ ID NO: 2806837 - protein, 19 aa, Entamoeba invadens
TVFGCLFVLVVFSIIIFAV

SEQ ID NO: 2806838 - protein, 21 aa, Entamoeba invadens
TVFMRFFLKRKLEGVKTEYVV

SEQ ID NO: 2806839 - protein, 27 aa, Entamoeba invadens
TVFPGLMFTSAFIFKFLAFFNLIVDVR

SEQ ID NO: 2806840 - protein, 18 aa, Entamoeba invadens
TVFPNCVKCPIDERKCLQ

SEQ ID NO: 2806841 - protein, 32 aa, Entamoeba invadens
TVGIYFSLVLKWRELWEMVRYRRIVWEWRTFH

SEQ ID NO: 2806842 - protein, 25 aa, Entamoeba invadens
TVGKCAICQKGTYYMRSVCQSCGEM

SEQ ID NO: 2806843 - protein, 26 aa, Entamoeba invadens
TVGVILPFIVCFFIATPHLDLSQLVN

SEQ ID NO: 2806844 - protein, 20 aa, Entamoeba invadens
TVIAPFYFYLVYCIYVTCFL

SEQ ID NO: 2806845 - protein, 17 aa, Entamoeba invadens
TVIKGNLYISGISDHKE

SEQ ID NO: 2806846 - protein, 23 aa, Entamoeba invadens
TVISCGYLVYYFVYLMVRRIYPN

SEQ ID NO: 2806847 - protein, 18 aa, Entamoeba invadens
TVITCYYLNLNSHWALAL

SEQ ID NO: 2806848 - protein, 18 aa, Entamoeba invadens
TVITFFLNFILFIFAVIC

SEQ ID NO: 2806849 - protein, 26 aa, Entamoeba invadens
TVITNWFKNRIVLETNLVLPGVLRRQ

SEQ ID NO: 2806850 - protein, 17 aa, Entamoeba invadens
TVIYWIFGYSFIQRNQV

SEQ ID NO: 2806851 - protein, 26 aa, Entamoeba invadens
TVKCVYPNVWCPLSVLTEPFTGEEVQ

SEQ ID NO: 2806852 - protein, 25 aa, Entamoeba invadens
TVKHCLKYFEGRCVECEDEFFLTNG

SEQ ID NO: 2806853 - protein, 24 aa, Entamoeba invadens
TVKLIDFGSACFENHTFYQYIQSR

SEQ ID NO: 2806854 - protein, 22 aa, Entamoeba invadens
TVKQRMGLIVLNVIKENSTPIV

SEQ ID NO: 2806855 - protein, 20 aa, Entamoeba invadens
TVKVSFSLKSGEVMKYTVET

SEQ ID NO: 2806856 - protein, 20 aa, Entamoeba invadens
TVKVVSCVDGYYPNDQSCLL

SEQ ID NO: 2806857 - protein, 21 aa, Entamoeba invadens
TVLCTLKFQSSFLLVANLFEK

SEQ ID NO: 2806858 - protein, 19 aa, Entamoeba invadens
TVLEIAPTEFSFRIFSKEI

SEQ ID NO: 2806859 - protein, 20 aa, Entamoeba invadens
TVLFGYKLSWFYLLCLVCLS

SEQ ID NO: 2806860 - protein, 23 aa, Entamoeba invadens
TVLSLESMSFWSLTPSKQEALNA

SEQ ID NO: 2806861 - protein, 21 aa, Entamoeba invadens
TVLSLKAGGVIQTLQNIQIEE

SEQ ID NO: 2806862 - protein, 24 aa, Entamoeba invadens
TVLYAAALMEVFYLIVSPNLIDKQ

SEQ ID NO: 2806863 - protein, 18 aa, Entamoeba invadens
TVLYEYIAALLFTTVFRF

SEQ ID NO: 2806864 - protein, 25 aa, Entamoeba invadens
TVMKTPQAYCSIFFDDALQSLEMVH

SEQ ID NO: 2806865 - protein, 18 aa, Entamoeba invadens
TVNFIIGMLTKLGVVFKE

SEQ ID NO: 2806866 - protein, 23 aa, Entamoeba invadens
TVNGDAPVIFSIDTLTVGKTFEF

SEQ ID NO: 2806867 - protein, 20 aa, Entamoeba invadens
TVNRRSHLNWDRFSKDEKKV

SEQ ID NO: 2806868 - protein, 18 aa, Entamoeba invadens
TVNVWGCEDVKLHEEINT

SEQ ID NO: 2806869 - protein, 21 aa, Entamoeba invadens
TVPYYFKFVPLTSLSQKSQIK

SEQ ID NO: 2806870 - protein, 31 aa, Entamoeba invadens
TVQIRFRYGYEVEYWFKLFEELVDMAHNRRA

SEQ ID NO: 2806871 - protein, 26 aa, Entamoeba invadens
TVQQIWGWGCSHMMSGLQGWNSNTKT

SEQ ID NO: 2806872 - protein, 25 aa, Entamoeba invadens
TVQRFPFSSMLKRMSVVASIFNFQS

SEQ ID NO: 2806873 - protein, 23 aa, Entamoeba invadens
TVQTLKFTPVFVYGTCLSSKIAS

SEQ ID NO: 2806874 - protein, 20 aa, Entamoeba invadens
TVRCSACPAGTYASSTGSRE

SEQ ID NO: 2806875 - protein, 24 aa, Entamoeba invadens
TVRLRAADKVSILVIGILLVCLVI

SEQ ID NO: 2806876 - protein, 17 aa, Entamoeba invadens
TVRRLGAQCFSVVLRYL

SEQ ID NO: 2806877 - protein, 18 aa, Entamoeba invadens
TVRVGIAHCDVCFPPFSP

SEQ ID NO: 2806878 - protein, 19 aa, Entamoeba invadens
TVSTVLWIYGLASFVFCND

SEQ ID NO: 2806879 - protein, 22 aa, Entamoeba invadens
TVSVCVFVLILLCVVTLLCVVL

SEQ ID NO: 2806880 - protein, 34 aa, Entamoeba invadens
TVSYRGEYTVAFITPRYPLFGGWSATLMVTHSIT

SEQ ID NO: 2806881 - protein, 21 aa, Entamoeba invadens
TVTCGDQAYLELMAKNGQEYF

SEQ ID NO: 2806882 - protein, 21 aa, Entamoeba invadens
TVTCPICLCDIESESDAVVTA

SEQ ID NO: 2806883 - protein, 29 aa, Entamoeba invadens
TVTFSMQVLCMLCDKHSLSVDEVQDKITL

SEQ ID NO: 2806884 - protein, 22 aa, Entamoeba invadens
TVTICDVCFMDSHIESIVIPNT

SEQ ID NO: 2806885 - protein, 24 aa, Entamoeba invadens
TVTILMWASCWRKRNELTQTIKSR

SEQ ID NO: 2806886 - protein, 25 aa, Entamoeba invadens
TVTIPADAAGKVFAILRVLTPINVA

SEQ ID NO: 2806887 - protein, 18 aa, Entamoeba invadens
TVTIYSLKTAEFFIQNVY

SEQ ID NO: 2806888 - protein, 24 aa, Entamoeba invadens
TVTLKKFTSGFIENTGTLTIQGAT

SEQ ID NO: 2806889 - protein, 25 aa, Entamoeba invadens
TVVFAELYWTPGILRQAEDRVHRIG

SEQ ID NO: 2806890 - protein, 18 aa, Entamoeba invadens
TVVGIPFIINEKVLNNLE

SEQ ID NO: 2806891 - protein, 23 aa, Entamoeba invadens
TVVPKANGFILYKAASNEQLTIT

SEQ ID NO: 2806892 - protein, 24 aa, Entamoeba invadens
TVVSEFDFDIAFSKNESPIIFTAH

SEQ ID NO: 2806893 - protein, 20 aa, Entamoeba invadens
TVVYMFWLVFAVIRSFSEAR

SEQ ID NO: 2806894 - protein, 19 aa, Entamoeba invadens
TVYLFYRINLQAQFDSIYE

SEQ ID NO: 2806895 - protein, 22 aa, Entamoeba invadens
TVYPYKCILCDITCNGQCDAIT

SEQ ID NO: 2806896 - protein, 31 aa, Entamoeba invadens
TWCQSRYQKEFGFKCVFLIVRKSVEQNGKKD

SEQ ID NO: 2806897 - protein, 21 aa, Entamoeba invadens
TWCRPCTLICSLFEKLSSQNK

SEQ ID NO: 2806898 - protein, 18 aa, Entamoeba invadens
TWCTLVLCIVWGGILMGF

SEQ ID NO: 2806899 - protein, 18 aa, Entamoeba invadens
TWDVADFVLKGDRLPILS

SEQ ID NO: 2806900 - protein, 19 aa, Entamoeba invadens
TWIKIAINSVLLGFSLTNS

SEQ ID NO: 2806901 - protein, 18 aa, Entamoeba invadens
TWNSLSFGDNFPGMIKPM

SEQ ID NO: 2806902 - protein, 17 aa, Entamoeba invadens
TWSEQYGLLPFSVESGS

SEQ ID NO: 2806903 - protein, 19 aa, Entamoeba invadens
TWSSVKFGSVCVSKYSVNC

SEQ ID NO: 2806904 - protein, 18 aa, Entamoeba invadens
TYACCLLAYLPPALLIII

SEQ ID NO: 2806905 - protein, 23 aa, Entamoeba invadens
TYACLECNEGFYVLNKKCQICSD

SEQ ID NO: 2806906 - protein, 24 aa, Entamoeba invadens
TYAIGGLCYLYFMYTFTRKDRDFS

SEQ ID NO: 2806907 - protein, 24 aa, Entamoeba invadens
TYCDSFCRCYEGYIPDPNDNTSCI

SEQ ID NO: 2806908 - protein, 17 aa, Entamoeba invadens
TYCLKKAEWWVITLIVI

SEQ ID NO: 2806909 - protein, 17 aa, Entamoeba invadens
TYCSKTAVWWVILLIVV

SEQ ID NO: 2806910 - protein, 17 aa, Entamoeba invadens
TYCYKCNTNTFIIKNGV

SEQ ID NO: 2806911 - protein, 23 aa, Entamoeba invadens
TYCYNCFFNNLIINNGVCVNSNC

SEQ ID NO: 2806912 - protein, 18 aa, Entamoeba invadens
TYENIKWSKIAREKLESF

SEQ ID NO: 2806913 - protein, 20 aa, Entamoeba invadens
TYERKCITCTNGMYAKDGVC

SEQ ID NO: 2806914 - protein, 24 aa, Entamoeba invadens
TYGCLICGDGYYLHTNICDKCDDN

SEQ ID NO: 2806915 - protein, 18 aa, Entamoeba invadens
TYGCQRCVDGYYLDSQML

SEQ ID NO: 2806916 - protein, 24 aa, Entamoeba invadens
TYGIFPEKPFFVYNLIEELDEEGE

SEQ ID NO: 2806917 - protein, 20 aa, Entamoeba invadens
TYGVVLPALLPKYTTVNNAL

SEQ ID NO: 2806918 - protein, 17 aa, Entamoeba invadens
TYHLKKKLVAKIVVLSI

SEQ ID NO: 2806919 - protein, 19 aa, Entamoeba invadens
TYHSWRYISLTGNSSLIPP

SEQ ID NO: 2806920 - protein, 19 aa, Entamoeba invadens
TYIETMCLMLPNFDEKCVA

SEQ ID NO: 2806921 - protein, 23 aa, Entamoeba invadens
TYILKLLPLFLFTLFIQTVSTTP

SEQ ID NO: 2806922 - protein, 26 aa, Entamoeba invadens
TYKRAVCQSCTLGKYILKNGVCLPKD

SEQ ID NO: 2806923 - protein, 22 aa, Entamoeba invadens
TYKRGICYPNNCGNGIVESVVS

SEQ ID NO: 2806924 - protein, 32 aa, Entamoeba invadens
TYKVWAKDMVLLYFWQGRTCAVLDKGTCARLT

SEQ ID NO: 2806925 - protein, 22 aa, Entamoeba invadens
TYLDRKKMQWGYDQSLLNVLMY

SEQ ID NO: 2806926 - protein, 20 aa, Entamoeba invadens
TYLFSNVIAMTFKFSKNAKI

SEQ ID NO: 2806927 - protein, 24 aa, Entamoeba invadens
TYLIFPFLCSFIAIILSFLAVPIS

SEQ ID NO: 2806928 - protein, 20 aa, Entamoeba invadens
TYLILPRAMLALNLTAMFAI

SEQ ID NO: 2806929 - protein, 27 aa, Entamoeba invadens
TYLIRRIFRILPIQVFATFFCGTWYIL

SEQ ID NO: 2806930 - protein, 23 aa, Entamoeba invadens
TYLKEFSEYFVAKVYGDPHSNLV

SEQ ID NO: 2806931 - protein, 21 aa, Entamoeba invadens
TYLKGCVLTILGVIISYIVVT

SEQ ID NO: 2806932 - protein, 18 aa, Entamoeba invadens
TYLRLNIGFIRNFMDKKK

SEQ ID NO: 2806933 - protein, 26 aa, Entamoeba invadens
TYNFGICTSCNFGYYLSDFICVRCTD

SEQ ID NO: 2806934 - protein, 28 aa, Entamoeba invadens
TYNPEIKQDCSLACPITENTDCVFEPSQ

SEQ ID NO: 2806935 - protein, 27 aa, Entamoeba invadens
TYPLETFKFPWKIAEFVTSGERMKKTD

SEQ ID NO: 2806936 - protein, 23 aa, Entamoeba invadens
TYPLVCVPTCEIPFGRENEVPTV

SEQ ID NO: 2806937 - protein, 17 aa, Entamoeba invadens
TYPSLFFLINPFSGTGK

SEQ ID NO: 2806938 - protein, 23 aa, Entamoeba invadens
TYPVGGLCYYLSAPDSVFELAQN

SEQ ID NO: 2806939 - protein, 18 aa, Entamoeba invadens
TYPWYSMFITNGISSVTM

SEQ ID NO: 2806940 - protein, 19 aa, Entamoeba invadens
TYQEFNSDIIISVDKSSSK

SEQ ID NO: 2806941 - protein, 21 aa, Entamoeba invadens
TYQFIVGGAMGIIYYDFTDLH

SEQ ID NO: 2806942 - protein, 26 aa, Entamoeba invadens
TYQSTYLLWFFLKFLHLGGNLCDVEK

SEQ ID NO: 2806943 - protein, 24 aa, Entamoeba invadens
TYRAEAGQDYYLFVGAMETGSDGM

SEQ ID NO: 2806944 - protein, 19 aa, Entamoeba invadens
TYRGCVICKEGYMRSSDGS

SEQ ID NO: 2806945 - protein, 18 aa, Entamoeba invadens
TYRGCVVCKDGYMRSSDG

SEQ ID NO: 2806946 - protein, 19 aa, Entamoeba invadens
TYRGCVVCKEGYLRSSDGS

SEQ ID NO: 2806947 - protein, 19 aa, Entamoeba invadens
TYRGCVVCKEGYMRSSDGS

SEQ ID NO: 2806948 - protein, 20 aa, Entamoeba invadens
TYRRKCKNLVDFITTKDLLD

SEQ ID NO: 2806949 - protein, 18 aa, Entamoeba invadens
TYSNCDICDLNNCQQCSS

SEQ ID NO: 2806950 - protein, 18 aa, Entamoeba invadens
TYSPTFIFFICFQLGHCT

SEQ ID NO: 2806951 - protein, 17 aa, Entamoeba invadens
TYSSIDICIQCKDGYIF

SEQ ID NO: 2806952 - protein, 23 aa, Entamoeba invadens
TYTPLCICMYTLLCLIPIHFLTL

SEQ ID NO: 2806953 - protein, 20 aa, Entamoeba invadens
TYVVVWVWYIYHFNFGLVLL

SEQ ID NO: 2806954 - protein, 21 aa, Entamoeba invadens
TYYAVLCLKNLITNLPERIVK

SEQ ID NO: 2806955 - protein, 18 aa, Entamoeba invadens
TYYGRDVLQFAIGSGNIQ

SEQ ID NO: 2806956 - protein, 28 aa, Entamoeba invadens
TYYRAMKTGHPYQNFCQLNCDAEGTCTF

SEQ ID NO: 2806957 - protein, 25 aa, Entamoeba invadens
VAAALGIPVLLPFLKAVCWSKKSWY

SEQ ID NO: 2806958 - protein, 22 aa, Entamoeba invadens
VAAPQLHLTWMTRLAQQHRDRG

SEQ ID NO: 2806959 - protein, 17 aa, Entamoeba invadens
VAAVCTGGMIFSFMFSA

SEQ ID NO: 2806960 - protein, 27 aa, Entamoeba invadens
VAAYAYSVMCPYFFFPPASFDEITTAG

SEQ ID NO: 2806961 - protein, 18 aa, Entamoeba invadens
VACADFDANCRVCASSGE

SEQ ID NO: 2806962 - protein, 24 aa, Entamoeba invadens
VACERKLSVWWVILVAVLFLLIVL

SEQ ID NO: 2806963 - protein, 26 aa, Entamoeba invadens
VACKDGYYRIGLDCFGCDQKCKTCNN

SEQ ID NO: 2806964 - protein, 26 aa, Entamoeba invadens
VACKEGYYREGLNCFFCDIKCSSCNN

SEQ ID NO: 2806965 - protein, 17 aa, Entamoeba invadens
VACLLRGSLLFASESHK

SEQ ID NO: 2806966 - protein, 20 aa, Entamoeba invadens
VACSIDASKLDNCVDCIEGF

SEQ ID NO: 2806967 - protein, 17 aa, Entamoeba invadens
VACTAFDPNCFICDSSF

SEQ ID NO: 2806968 - protein, 17 aa, Entamoeba invadens
VACVVVFVVIFISIITI

SEQ ID NO: 2806969 - protein, 18 aa, Entamoeba invadens
VADGCLFSVTSVLPVVIS

SEQ ID NO: 2806970 - protein, 17 aa, Entamoeba invadens
VADLPWRVFIYKFLNTI

SEQ ID NO: 2806971 - protein, 24 aa, Entamoeba invadens
VADLRKCHITMLLFVIFYWYTLTY

SEQ ID NO: 2806972 - protein, 24 aa, Entamoeba invadens
VADSKLKRMTFRLITDKIVQIVII

SEQ ID NO: 2806973 - protein, 20 aa, Entamoeba invadens
VAEFPYPWSVAEFVGKGKRL

SEQ ID NO: 2806974 - protein, 17 aa, Entamoeba invadens
VAEFVSGGRRLAQSSRI

SEQ ID NO: 2806975 - protein, 24 aa, Entamoeba invadens
VAELRARNIITPKWPNCPTASTFK

SEQ ID NO: 2806976 - protein, 17 aa, Entamoeba invadens
VAFCKQLSLLLFDPSFI

SEQ ID NO: 2806977 - protein, 23 aa, Entamoeba invadens
VAFDLGIPPSFYVIYRNESSVTI

SEQ ID NO: 2806978 - protein, 19 aa, Entamoeba invadens
VAFGFPTVCKNAVECPSET

SEQ ID NO: 2806979 - protein, 18 aa, Entamoeba invadens
VAFIVVFQVFKAMDADIS

SEQ ID NO: 2806980 - protein, 17 aa, Entamoeba invadens
VAFLRYVILAAPMIPIS

SEQ ID NO: 2806981 - protein, 22 aa, Entamoeba invadens
VAFNLKAICYVSPSKFFIHKDS

SEQ ID NO: 2806982 - protein, 22 aa, Entamoeba invadens
VAFPGFIVAYFVINRINKKWLQ

SEQ ID NO: 2806983 - protein, 25 aa, Entamoeba invadens
VAFPKSEFQYSWNIVDFVASGKRRQ

SEQ ID NO: 2806984 - protein, 19 aa, Entamoeba invadens
VAGAVTVYFDKYFTSGLTD

SEQ ID NO: 2806985 - protein, 26 aa, Entamoeba invadens
VAGEYKLSKLFGMSYKGAEEIQWHEF

SEQ ID NO: 2806986 - protein, 19 aa, Entamoeba invadens
VAHLIPRVNRLCCCDVPVP

SEQ ID NO: 2806987 - protein, 27 aa, Entamoeba invadens
VAICVYVACGWCIFAIARMHYSVDIFI

SEQ ID NO: 2806988 - protein, 17 aa, Entamoeba invadens
VAIDGEIFLAYVTTLFR

SEQ ID NO: 2806989 - protein, 19 aa, Entamoeba invadens
VAIDRCPFFHFSDSVLDYL

SEQ ID NO: 2806990 - protein, 20 aa, Entamoeba invadens
VAIEKVKKCILKVPLLTVMK

SEQ ID NO: 2806991 - protein, 33 aa, Entamoeba invadens
VAIFNYFAAWAFCVGWGISIAVSFFLKKKKRDD

SEQ ID NO: 2806992 - protein, 18 aa, Entamoeba invadens
VAILPEHLGNLVSGDIGY

SEQ ID NO: 2806993 - protein, 20 aa, Entamoeba invadens
VAIPLFIIFHITTRPHSFTC

SEQ ID NO: 2806994 - protein, 18 aa, Entamoeba invadens
VAIPTPHCISSLKYDCLK

SEQ ID NO: 2806995 - protein, 29 aa, Entamoeba invadens
VAIYFSCAFWAFSALTFWPSAVGNVGKEA

SEQ ID NO: 2806996 - protein, 17 aa, Entamoeba invadens
VAKETQKLCEFISNTTT

SEQ ID NO: 2806997 - protein, 18 aa, Entamoeba invadens
VALFQPQLYFGLFLFVAV

SEQ ID NO: 2806998 - protein, 32 aa, Entamoeba invadens
VALLNFKFFLAESALNFSIYFFGAKFGQLTKR

SEQ ID NO: 2806999 - protein, 25 aa, Entamoeba invadens
VALNMKVKFCLDGAKGVFYLHENGV

SEQ ID NO: 2807000 - protein, 40 aa, Entamoeba invadens
VALQGSFPFMWGFFMVSSLCFWTSFQFAPRGKFNSKSQFG

SEQ ID NO: 2807001 - protein, 22 aa, Entamoeba invadens
VALRIAFVKFNVWSAMSKTETL

SEQ ID NO: 2807002 - protein, 17 aa, Entamoeba invadens
VALRLKDMRALGANANI

SEQ ID NO: 2807003 - protein, 19 aa, Entamoeba invadens
VALSHQWKGNHYDIGEQFT

SEQ ID NO: 2807004 - protein, 24 aa, Entamoeba invadens
VALWPFCTSCYWPITTGTCGLEAE

SEQ ID NO: 2807005 - protein, 24 aa, Entamoeba invadens
VAMLADIYISIGLYDSAYQLLSLK

SEQ ID NO: 2807006 - protein, 22 aa, Entamoeba invadens
VAMLDKFRCEYIIHFYGAVFIP

SEQ ID NO: 2807007 - protein, 17 aa, Entamoeba invadens
VAMLTFFFFLKTAINVL

SEQ ID NO: 2807008 - protein, 23 aa, Entamoeba invadens
VAMMPFIMIILFFLEFGVSKLTQ

SEQ ID NO: 2807009 - protein, 20 aa, Entamoeba invadens
VAMNCMKRYIAGSITLGPIM

SEQ ID NO: 2807010 - protein, 26 aa, Entamoeba invadens
VANEVAWFFINFCEKGGEGTETVLYK

SEQ ID NO: 2807011 - protein, 26 aa, Entamoeba invadens
VANKELKIPLIIDGQVIVDGIIEEDI

SEQ ID NO: 2807012 - protein, 27 aa, Entamoeba invadens
VANSKCSKCSFWYVPSESGTFCNTKAV

SEQ ID NO: 2807013 - protein, 21 aa, Entamoeba invadens
VANVICWIPGTAFFYTVEHLL

SEQ ID NO: 2807014 - protein, 17 aa, Entamoeba invadens
VAQVCWFIANTNLPYVV

SEQ ID NO: 2807015 - protein, 26 aa, Entamoeba invadens
VASIVPICIMLTFSCIRELFDEIRKY

SEQ ID NO: 2807016 - protein, 17 aa, Entamoeba invadens
VATCFLVVLFASVRYNK

SEQ ID NO: 2807017 - protein, 25 aa, Entamoeba invadens
VATDSCKKCGLKCSQCKISNSCELC

SEQ ID NO: 2807018 - protein, 26 aa, Entamoeba invadens
VATLRCSINAVKFLHFFNSNAKKTVF

SEQ ID NO: 2807019 - protein, 23 aa, Entamoeba invadens
VATVLFLLSFVMDFMSGHKMDIP

SEQ ID NO: 2807020 - protein, 23 aa, Entamoeba invadens
VAVFIIKCVIFKLKENEINAETC

SEQ ID NO: 2807021 - protein, 17 aa, Entamoeba invadens
VAVLGVLFIVAVIIIGA

SEQ ID NO: 2807022 - protein, 24 aa, Entamoeba invadens
VAVLRKGLACEFEIYITPHYTCTI

SEQ ID NO: 2807023 - protein, 18 aa, Entamoeba invadens
VAVMCVLIVFIILIVSLV

SEQ ID NO: 2807024 - protein, 24 aa, Entamoeba invadens
VAVMFPVVWAAYWGKDPLGQERGQ

SEQ ID NO: 2807025 - protein, 23 aa, Entamoeba invadens
VAVTKFRCYMAYFSTIGIAVINN

SEQ ID NO: 2807026 - protein, 24 aa, Entamoeba invadens
VAVVTICVMTFVTLGFEHCVANMF

SEQ ID NO: 2807027 - protein, 18 aa, Entamoeba invadens
VAYGFCVGSALTMANPIP

SEQ ID NO: 2807028 - protein, 25 aa, Entamoeba invadens
VAYSEDFFAILFFPIEHKIACLLPL

SEQ ID NO: 2807029 - protein, 20 aa, Entamoeba invadens
VAYSYMLHISFFFFSPLSFI

SEQ ID NO: 2807030 - protein, 21 aa, Entamoeba invadens
VAYTIEWVGIFAVSKAFYAMF

SEQ ID NO: 2807031 - protein, 19 aa, Entamoeba invadens
VCAIPKSFSTLNFSFDGCI

SEQ ID NO: 2807032 - protein, 23 aa, Entamoeba invadens
VCAKCKAGYGFDKYHKCVTCDAS

SEQ ID NO: 2807033 - protein, 28 aa, Entamoeba invadens
VCAKSQGGRCLTCIEGYLLTKIGECEKC

SEQ ID NO: 2807034 - protein, 17 aa, Entamoeba invadens
VCANGYYRNSTVCVQCP

SEQ ID NO: 2807035 - protein, 23 aa, Entamoeba invadens
VCANVTIPVFLWIVTFIVLVIIL

SEQ ID NO: 2807036 - protein, 25 aa, Entamoeba invadens
VCAPFKRVYFKDFWLADQMTSIAPA

SEQ ID NO: 2807037 - protein, 29 aa, Entamoeba invadens
VCAPTFQLRSIFFNVEFASNYSLVISTLE

SEQ ID NO: 2807038 - protein, 26 aa, Entamoeba invadens
VCASEECTTCADAFVYDNETKKCETC

SEQ ID NO: 2807039 - protein, 26 aa, Entamoeba invadens
VCATCVKSGSCILCNSERYMSCESVC

SEQ ID NO: 2807040 - protein, 17 aa, Entamoeba invadens
VCAVFISLSFNEAICSE

SEQ ID NO: 2807041 - protein, 28 aa, Entamoeba invadens
VCDKCIRESGACSLCFSGFKKVGGECTS

SEQ ID NO: 2807042 - protein, 22 aa, Entamoeba invadens
VCDRNGFKRFLYFNTNETTNTS

SEQ ID NO: 2807043 - protein, 18 aa, Entamoeba invadens
VCDSCGQGEVSGKCKENQ

SEQ ID NO: 2807044 - protein, 20 aa, Entamoeba invadens
VCDSCGTNAFYNATTKKCEN

SEQ ID NO: 2807045 - protein, 18 aa, Entamoeba invadens
VCEICAPGYNLNLNDEFC

SEQ ID NO: 2807046 - protein, 17 aa, Entamoeba invadens
VCEKCYYNKVNEKNNCG

SEQ ID NO: 2807047 - protein, 24 aa, Entamoeba invadens
VCERFKYKRFLFFEKSYKTTYLSY

SEQ ID NO: 2807048 - protein, 21 aa, Entamoeba invadens
VCERNGYKRFLAVLDEKITGN

SEQ ID NO: 2807049 - protein, 19 aa, Entamoeba invadens
VCETCPTLTYSTGGDSYCS

SEQ ID NO: 2807050 - protein, 18 aa, Entamoeba invadens
VCEVCPNSASICINNGNN

SEQ ID NO: 2807051 - protein, 19 aa, Entamoeba invadens
VCEYPCVFCSNQTYCTKCD

SEQ ID NO: 2807052 - protein, 17 aa, Entamoeba invadens
VCFEMNMDCLYTRNDRC

SEQ ID NO: 2807053 - protein, 17 aa, Entamoeba invadens
VCFGCAPHFFLSSQRCV

SEQ ID NO: 2807054 - protein, 19 aa, Entamoeba invadens
VCGDGFYSLAGYSKCIQCV

SEQ ID NO: 2807055 - protein, 19 aa, Entamoeba invadens
VCGDSIYIYDILKKKNKIY

SEQ ID NO: 2807056 - protein, 18 aa, Entamoeba invadens
VCGEMCWSVTGDNDITWG

SEQ ID NO: 2807057 - protein, 20 aa, Entamoeba invadens
VCGFINNYLPGWLLARAGVL

SEQ ID NO: 2807058 - protein, 17 aa, Entamoeba invadens
VCGIFLVMFLIWNENGD

SEQ ID NO: 2807059 - protein, 22 aa, Entamoeba invadens
VCGKLTDFGTCRSISESALNIK

SEQ ID NO: 2807060 - protein, 20 aa, Entamoeba invadens
VCGQFALGLVSRGSAISVVY

SEQ ID NO: 2807061 - protein, 21 aa, Entamoeba invadens
VCIQFIPSGGCVKCTNGYFRS

SEQ ID NO: 2807062 - protein, 20 aa, Entamoeba invadens
VCISCDTITISGRCATIKNC

SEQ ID NO: 2807063 - protein, 17 aa, Entamoeba invadens
VCISCPSGQYSASSGSS

SEQ ID NO: 2807064 - protein, 19 aa, Entamoeba invadens
VCISESRITALYVGEDYIL

SEQ ID NO: 2807065 - protein, 17 aa, Entamoeba invadens
VCITCSVEYYLNMNSCI

SEQ ID NO: 2807066 - protein, 28 aa, Entamoeba invadens
VCITFECFLCPLELLKRLLSHIKQISPF

SEQ ID NO: 2807067 - protein, 25 aa, Entamoeba invadens
VCIVGYCVFPIFLGAIVTTVCTLSW

SEQ ID NO: 2807068 - protein, 18 aa, Entamoeba invadens
VCIVLRKFRETESACELF

SEQ ID NO: 2807069 - protein, 23 aa, Entamoeba invadens
VCKECVGGFYLYNSECFTFNNSE

SEQ ID NO: 2807070 - protein, 18 aa, Entamoeba invadens
VCKEGYYTTSWNSCVPCN

SEQ ID NO: 2807071 - protein, 20 aa, Entamoeba invadens
VCKETKDLVCVGNSGTKVVK

SEQ ID NO: 2807072 - protein, 17 aa, Entamoeba invadens
VCKFTHFAERGKDAEMV

SEQ ID NO: 2807073 - protein, 23 aa, Entamoeba invadens
VCKMSRLDSRVSLLTLFTPQTLF

SEQ ID NO: 2807074 - protein, 21 aa, Entamoeba invadens
VCKRANCHDFISGMPDGYDTL

SEQ ID NO: 2807075 - protein, 17 aa, Entamoeba invadens
VCMAPIRRFNKIWYCQK

SEQ ID NO: 2807076 - protein, 17 aa, Entamoeba invadens
VCMLHSFYVTQLANYIK

SEQ ID NO: 2807077 - protein, 18 aa, Entamoeba invadens
VCMTCPAGQYFNINKCLD

SEQ ID NO: 2807078 - protein, 17 aa, Entamoeba invadens
VCNDDSFLIDDTKKCSK

SEQ ID NO: 2807079 - protein, 17 aa, Entamoeba invadens
VCNDGYYRVGFDCYECD

SEQ ID NO: 2807080 - protein, 19 aa, Entamoeba invadens
VCNLAPKVINVFSNALLFE

SEQ ID NO: 2807081 - protein, 17 aa, Entamoeba invadens
VCNTGFYPNDNGKCVSC

SEQ ID NO: 2807082 - protein, 25 aa, Entamoeba invadens
VCPFEMTDRFKLAIRQIDKLPLRET

SEQ ID NO: 2807083 - protein, 24 aa, Entamoeba invadens
VCPTLETCWNRKLRDYQIYKIVYG

SEQ ID NO: 2807084 - protein, 26 aa, Entamoeba invadens
VCQDGYYRLGLDCFKCNEKCSTCNNR

SEQ ID NO: 2807085 - protein, 18 aa, Entamoeba invadens
VCQKMIMMTIIWVLSMQY

SEQ ID NO: 2807086 - protein, 24 aa, Entamoeba invadens
VCQSFPRSSVCFLNNKYLFQFSRL

SEQ ID NO: 2807087 - protein, 25 aa, Entamoeba invadens
VCRGEVKPFPPFVQDRWYPHGSAFS

SEQ ID NO: 2807088 - protein, 18 aa, Entamoeba invadens
VCRKCRKGLSMGTCDNCD

SEQ ID NO: 2807089 - protein, 25 aa, Entamoeba invadens
VCSICPSRCFGCKVNEDLDLQSTTD

SEQ ID NO: 2807090 - protein, 18 aa, Entamoeba invadens
VCSIDLVKGFWFKIPGAD

SEQ ID NO: 2807091 - protein, 24 aa, Entamoeba invadens
VCSIDLVKGFWFKIPGADETLEIS

SEQ ID NO: 2807092 - protein, 18 aa, Entamoeba invadens
VCSIDLVKGFWFKITGAD

SEQ ID NO: 2807093 - protein, 21 aa, Entamoeba invadens
VCSKACAMTSLEMKSYGEVEK

SEQ ID NO: 2807094 - protein, 17 aa, Entamoeba invadens
VCSKCFQESNHVGHNYF

SEQ ID NO: 2807095 - protein, 17 aa, Entamoeba invadens
VCSLCNSGTMANQTTNI

SEQ ID NO: 2807096 - protein, 17 aa, Entamoeba invadens
VCSLCNSGTMANQTTNK

SEQ ID NO: 2807097 - protein, 18 aa, Entamoeba invadens
VCSLGCICFGPRFQIKYR

SEQ ID NO: 2807098 - protein, 18 aa, Entamoeba invadens
VCSPEITLGDILVLHFTS

SEQ ID NO: 2807099 - protein, 17 aa, Entamoeba invadens
VCSPQYYKSGFNCYTNM

SEQ ID NO: 2807100 - protein, 23 aa, Entamoeba invadens
VCSTDLTKGHWFRFTGADQTLNI

SEQ ID NO: 2807101 - protein, 17 aa, Entamoeba invadens
VCTECLFTSSPNGQLVN

SEQ ID NO: 2807102 - protein, 18 aa, Entamoeba invadens
VCTECLTGSFVNETGSCI

SEQ ID NO: 2807103 - protein, 19 aa, Entamoeba invadens
VCTHCKSPLLLNVTDKKCE

SEQ ID NO: 2807104 - protein, 19 aa, Entamoeba invadens
VCTKRNLSRYITCPKNQKF

SEQ ID NO: 2807105 - protein, 18 aa, Entamoeba invadens
VCTLCATEYVLVNNKCLS

SEQ ID NO: 2807106 - protein, 17 aa, Entamoeba invadens
VCTNCTRGFMLSYGECK

SEQ ID NO: 2807107 - protein, 23 aa, Entamoeba invadens
VCTTCSSSVCTSCQSGYYLSNGI

SEQ ID NO: 2807108 - protein, 18 aa, Entamoeba invadens
VCVFKMSRSNIMMTKLDG

SEQ ID NO: 2807109 - protein, 18 aa, Entamoeba invadens
VCVFPMKKSNIPMKVLGN

SEQ ID NO: 2807110 - protein, 17 aa, Entamoeba invadens
VCVIIAVLIILSVVGVQ

SEQ ID NO: 2807111 - protein, 20 aa, Entamoeba invadens
VCVLCLDGYVLDNNYNCIKS

SEQ ID NO: 2807112 - protein, 19 aa, Entamoeba invadens
VCVNGAYMQYCKDVVLHKT

SEQ ID NO: 2807113 - protein, 25 aa, Entamoeba invadens
VCVPCKREGCQRCFRYDGECIECNS

SEQ ID NO: 2807114 - protein, 17 aa, Entamoeba invadens
VCVSCFDLIQNCQLCKY

SEQ ID NO: 2807115 - protein, 22 aa, Entamoeba invadens
VCVSCTSISCKTCMSTTGKCTS

SEQ ID NO: 2807116 - protein, 17 aa, Entamoeba invadens
VCVYDIRCPSFADDNVC

SEQ ID NO: 2807117 - protein, 20 aa, Entamoeba invadens
VCVYPCVYCSNSTFCTKCDS

SEQ ID NO: 2807118 - protein, 17 aa, Entamoeba invadens
VCVYSWQFIAMVGTPSL

SEQ ID NO: 2807119 - protein, 25 aa, Entamoeba invadens
VCYSGWSDIKWLPVYFADEESDLTI

SEQ ID NO: 2807120 - protein, 22 aa, Entamoeba invadens
VDAGAAVAFVGAWFCQIPNSWA

SEQ ID NO: 2807121 - protein, 25 aa, Entamoeba invadens
VDAIWASQHFEFFKEYIEKIEKLSC

SEQ ID NO: 2807122 - protein, 17 aa, Entamoeba invadens
VDAKLGAITHFRSTSGN

SEQ ID NO: 2807123 - protein, 17 aa, Entamoeba invadens
VDAKLMMRANIEQNNTK

SEQ ID NO: 2807124 - protein, 24 aa, Entamoeba invadens
VDAKSCGLFHYLYLHKDIFGKEQF

SEQ ID NO: 2807125 - protein, 24 aa, Entamoeba invadens
VDALCKRQSFVRLFITQDEHLLNS

SEQ ID NO: 2807126 - protein, 23 aa, Entamoeba invadens
VDALFHLCLVPSLLSIFGSPTSG

SEQ ID NO: 2807127 - protein, 26 aa, Entamoeba invadens
VDAREFLSFPVYPLLFNTVRSVFLKS

SEQ ID NO: 2807128 - protein, 17 aa, Entamoeba invadens
VDARNRLTKSLLEMTQC

SEQ ID NO: 2807129 - protein, 18 aa, Entamoeba invadens
VDASKGRVCQVYDSDKKC

SEQ ID NO: 2807130 - protein, 18 aa, Entamoeba invadens
VDCAACKDGYLLVNMDCV

SEQ ID NO: 2807131 - protein, 19 aa, Entamoeba invadens
VDCAACKDGYLLVNMDCVK

SEQ ID NO: 2807132 - protein, 19 aa, Entamoeba invadens
VDCSEFVATFGNFVENTST

SEQ ID NO: 2807133 - protein, 31 aa, Entamoeba invadens
VDCSTRGCSICTPDSCSNCVDNFYIKFSECV

SEQ ID NO: 2807134 - protein, 29 aa, Entamoeba invadens
VDCVLKKLSLCVCCKMTFDCQAKEIRLWT

SEQ ID NO: 2807135 - protein, 18 aa, Entamoeba invadens
VDDCSACITGKLFEEGTM

SEQ ID NO: 2807136 - protein, 21 aa, Entamoeba invadens
VDDFLKRTGLYSIVETYGSAM

SEQ ID NO: 2807137 - protein, 19 aa, Entamoeba invadens
VDDYIWPLLEKKLYITGEA

SEQ ID NO: 2807138 - protein, 19 aa, Entamoeba invadens
VDEFTFWKKSYSYDAQMLY

SEQ ID NO: 2807139 - protein, 17 aa, Entamoeba invadens
VDEKEKRINEKDEEIER

SEQ ID NO: 2807140 - protein, 18 aa, Entamoeba invadens
VDETTPCGFENFCRETLI

SEQ ID NO: 2807141 - protein, 24 aa, Entamoeba invadens
VDEYKISDFIGYNWDVEELQFNNK

SEQ ID NO: 2807142 - protein, 19 aa, Entamoeba invadens
VDFFLANMMNYEFIHKLGK

SEQ ID NO: 2807143 - protein, 21 aa, Entamoeba invadens
VDFKSTFTLGPFHDFSWTAFL

SEQ ID NO: 2807144 - protein, 19 aa, Entamoeba invadens
VDFRNTSVIEVQRPKPQGL

SEQ ID NO: 2807145 - protein, 17 aa, Entamoeba invadens
VDFSMEIIVTKVFYYFI

SEQ ID NO: 2807146 - protein, 28 aa, Entamoeba invadens
VDFYEFFLRELLAPFVVNENIKNFSENE

SEQ ID NO: 2807147 - protein, 18 aa, Entamoeba invadens
VDGCTKCIEGYFPQNYRC

SEQ ID NO: 2807148 - protein, 23 aa, Entamoeba invadens
VDGDPLLTCAYLEAIKTSSEAEV

SEQ ID NO: 2807149 - protein, 24 aa, Entamoeba invadens
VDGLIKVHLCPNVVSTPITCKEVI

SEQ ID NO: 2807150 - protein, 23 aa, Entamoeba invadens
VDGNCFRCIGGTILIDGKCVRDT

SEQ ID NO: 2807151 - protein, 23 aa, Entamoeba invadens
VDGQFCVRCKSGFYKTGTTCLQC

SEQ ID NO: 2807152 - protein, 24 aa, Entamoeba invadens
VDGVYKAKCNEMWIGEKYGHAHEE

SEQ ID NO: 2807153 - protein, 18 aa, Entamoeba invadens
VDGWKVEVLLNQEILINM

SEQ ID NO: 2807154 - protein, 18 aa, Entamoeba invadens
VDHCISILNGFCHICEGG

SEQ ID NO: 2807155 - protein, 25 aa, Entamoeba invadens
VDHNCGYSKLDLCGSEGAEHNCENI

SEQ ID NO: 2807156 - protein, 32 aa, Entamoeba invadens
VDIFAFGIVMYEVWTWKTAYANDDFKYLWKIA

SEQ ID NO: 2807157 - protein, 33 aa, Entamoeba invadens
VDIFYYLAMQPWRHFVWTQKENNIWVTNTMNED

SEQ ID NO: 2807158 - protein, 23 aa, Entamoeba invadens
VDILVGALISFLGFSLYHTYILL

SEQ ID NO: 2807159 - protein, 29 aa, Entamoeba invadens
VDIQLSLPLYFIKKFFGFFNVTSYMIPIS

SEQ ID NO: 2807160 - protein, 17 aa, Entamoeba invadens
VDIQTGRICSEKPFEKG

SEQ ID NO: 2807161 - protein, 17 aa, Entamoeba invadens
VDISDSIVICFKYFPII

SEQ ID NO: 2807162 - protein, 21 aa, Entamoeba invadens
VDISTCFAKTVIDTGVEVSTG

SEQ ID NO: 2807163 - protein, 21 aa, Entamoeba invadens
VDITIPLSCEKMYVTETTKMN

SEQ ID NO: 2807164 - protein, 23 aa, Entamoeba invadens
VDKCKKCFFKGNFGIIEKKNLLK

SEQ ID NO: 2807165 - protein, 17 aa, Entamoeba invadens
VDKDSSLDCECHFSNGS

SEQ ID NO: 2807166 - protein, 17 aa, Entamoeba invadens
VDKDSTLDCECHFSNGS

SEQ ID NO: 2807167 - protein, 17 aa, Entamoeba invadens
VDKGVVTFISKKNNLDN

SEQ ID NO: 2807168 - protein, 22 aa, Entamoeba invadens
VDKKLRIDLHFSTAETGKTAFF

SEQ ID NO: 2807169 - protein, 24 aa, Entamoeba invadens
VDKTGGLKFAGRFLLPDTPQKYIW

SEQ ID NO: 2807170 - protein, 18 aa, Entamoeba invadens
VDLACSIMPIRTTLPQGT

SEQ ID NO: 2807171 - protein, 24 aa, Entamoeba invadens
VDLICFLIYFILSLMNLFFTYKTG

SEQ ID NO: 2807172 - protein, 23 aa, Entamoeba invadens
VDLKRRLVEKYGKDVGLLVVNQK

SEQ ID NO: 2807173 - protein, 29 aa, Entamoeba invadens
VDMDFQWGFSPSVFVNGNFDIKLTKEIDR

SEQ ID NO: 2807174 - protein, 22 aa, Entamoeba invadens
VDMKIRIKMMIDASKGILYLHS

SEQ ID NO: 2807175 - protein, 18 aa, Entamoeba invadens
VDMKLRMKFLLDAAKGIQ

SEQ ID NO: 2807176 - protein, 17 aa, Entamoeba invadens
VDMLNIFRDSSLLFLSS

SEQ ID NO: 2807177 - protein, 25 aa, Entamoeba invadens
VDMSFVLTCCMVCMSLYYVKLPKTY

SEQ ID NO: 2807178 - protein, 30 aa, Entamoeba invadens
VDPSGCTTCIPGYYISKGKCVSCEQITSNC

SEQ ID NO: 2807179 - protein, 19 aa, Entamoeba invadens
VDPSLSITFELMRLDFLSG

SEQ ID NO: 2807180 - protein, 19 aa, Entamoeba invadens
VDQNLSIHFMQNFLVNVQV

SEQ ID NO: 2807181 - protein, 17 aa, Entamoeba invadens
VDREKHTVFSIGLKNFG

SEQ ID NO: 2807182 - protein, 29 aa, Entamoeba invadens
VDRGSFGVECVLTLFLFMIAFPNSLYLAR

SEQ ID NO: 2807183 - protein, 18 aa, Entamoeba invadens
VDRMLFDTPMKFTKLTVG

SEQ ID NO: 2807184 - protein, 18 aa, Entamoeba invadens
VDRSELFLGETESDILII

SEQ ID NO: 2807185 - protein, 19 aa, Entamoeba invadens
VDRYFRFTSGINMKCLFYR

SEQ ID NO: 2807186 - protein, 18 aa, Entamoeba invadens
VDSLRFEFLGTKMHLHYY

SEQ ID NO: 2807187 - protein, 27 aa, Entamoeba invadens
VDTEMYMKYVTSFNVESMAKPFLMCSI

SEQ ID NO: 2807188 - protein, 24 aa, Entamoeba invadens
VDTQCLFCSNGFYSNGPQCVQCDT

SEQ ID NO: 2807189 - protein, 23 aa, Entamoeba invadens
VDVGETFIIPDFTFKGCSKLITF

SEQ ID NO: 2807190 - protein, 18 aa, Entamoeba invadens
VDVLKGFELEINKGEIVA

SEQ ID NO: 2807191 - protein, 18 aa, Entamoeba invadens
VDVPYIYRDLSIVDEYAF

SEQ ID NO: 2807192 - protein, 33 aa, Entamoeba invadens
VDYDFCYYRQKFRIGKWFRLKIMEIDSKFVEFD

SEQ ID NO: 2807193 - protein, 17 aa, Entamoeba invadens
VDYNWMKKTIGVDVANA

SEQ ID NO: 2807194 - protein, 28 aa, Entamoeba invadens
VEALFLPKFRVFRIIKKIIKKIQIRGFI

SEQ ID NO: 2807195 - protein, 36 aa, Entamoeba invadens
VEASKLCPEIVWTPSMKRLFCLIVECVKNKEPALLI

SEQ ID NO: 2807196 - protein, 24 aa, Entamoeba invadens
VECCYSGKMLYNLPSVTKVHERVC

SEQ ID NO: 2807197 - protein, 17 aa, Entamoeba invadens
VECKDGFYVQNNVCNDC

SEQ ID NO: 2807198 - protein, 17 aa, Entamoeba invadens
VECKTNYILSDGICIHK

SEQ ID NO: 2807199 - protein, 26 aa, Entamoeba invadens
VECLDAFKLKGGICAETFDENNKLKT

SEQ ID NO: 2807200 - protein, 26 aa, Entamoeba invadens
VECLDAFKLKNGICAETFDEDDKLKT

SEQ ID NO: 2807201 - protein, 19 aa, Entamoeba invadens
VECLECSSGYYSENGAVEC

SEQ ID NO: 2807202 - protein, 17 aa, Entamoeba invadens
VECPSECTSCLNSEKCI

SEQ ID NO: 2807203 - protein, 24 aa, Entamoeba invadens
VECPSGCLKECFLSNVCSQCKPNY

SEQ ID NO: 2807204 - protein, 17 aa, Entamoeba invadens
VECPVTCKSCFNSSYCL

SEQ ID NO: 2807205 - protein, 26 aa, Entamoeba invadens
VECRNIKTCTFCELNHFLLTNSSACI

SEQ ID NO: 2807206 - protein, 23 aa, Entamoeba invadens
VECRNIKTCTFCESNYLLLTNSS

SEQ ID NO: 2807207 - protein, 19 aa, Entamoeba invadens
VECSENSYLYDGECHSTIN

SEQ ID NO: 2807208 - protein, 19 aa, Entamoeba invadens
VECSSLFSDCIECNSESCL

SEQ ID NO: 2807209 - protein, 22 aa, Entamoeba invadens
VECVECYPPYFWDSIGKTCKLC

SEQ ID NO: 2807210 - protein, 24 aa, Entamoeba invadens
VEDRCIHCEIGFYVSNFICEKCAE

SEQ ID NO: 2807211 - protein, 18 aa, Entamoeba invadens
VEECWRQTQEIDLLSIIL

SEQ ID NO: 2807212 - protein, 24 aa, Entamoeba invadens
VEEWPDIWKLTPAKVKSGNEVSLI

SEQ ID NO: 2807213 - protein, 27 aa, Entamoeba invadens
VEFFTCKKSRLFLVSIYDFIRSIVSFH

SEQ ID NO: 2807214 - protein, 17 aa, Entamoeba invadens
VEFPLTFETEVSTYLDP

SEQ ID NO: 2807215 - protein, 17 aa, Entamoeba invadens
VEFYENVKIYGKNTDFI

SEQ ID NO: 2807216 - protein, 23 aa, Entamoeba invadens
VEGKFDFCLPIPPSLYPNCKRLA

SEQ ID NO: 2807217 - protein, 23 aa, Entamoeba invadens
VEGKFDFCLPIPPTLYPNCKRLA

SEQ ID NO: 2807218 - protein, 23 aa, Entamoeba invadens
VEGKFDFCLPIPPTVYPNCKRLA

SEQ ID NO: 2807219 - protein, 23 aa, Entamoeba invadens
VEGKFDFCLPIPSTVYPNCKRLA

SEQ ID NO: 2807220 - protein, 23 aa, Entamoeba invadens
VEGKYQCNLCCSGFYLNTTTHVC

SEQ ID NO: 2807221 - protein, 22 aa, Entamoeba invadens
VEGQCSATLLVQRILRSSEECR

SEQ ID NO: 2807222 - protein, 26 aa, Entamoeba invadens
VEGRWRLLVYAMQFIVVPLIRTHTKE

SEQ ID NO: 2807223 - protein, 20 aa, Entamoeba invadens
VEHFHLIVLLLIFLNAYVTQ

SEQ ID NO: 2807224 - protein, 17 aa, Entamoeba invadens
VEHKCVSCETDYYYNES

SEQ ID NO: 2807225 - protein, 18 aa, Entamoeba invadens
VEIELNVYTQKRIMGDGV

SEQ ID NO: 2807226 - protein, 20 aa, Entamoeba invadens
VEIFYNFVRKLCYNFYDAFS

SEQ ID NO: 2807227 - protein, 17 aa, Entamoeba invadens
VEIRPKFVIQSKGLHLY

SEQ ID NO: 2807228 - protein, 25 aa, Entamoeba invadens
VEIVEKPCFCGKGSVKIPCYIESGS

SEQ ID NO: 2807229 - protein, 33 aa, Entamoeba invadens
VEKKGIVFIFMLRISPIFPFPVLNYTLGPVCGI

SEQ ID NO: 2807230 - protein, 20 aa, Entamoeba invadens
VEKLTFQKWQVWTLNEKLEG

SEQ ID NO: 2807231 - protein, 26 aa, Entamoeba invadens
VEKSEFPMYMIAVIVIFILILAVIVA

SEQ ID NO: 2807232 - protein, 34 aa, Entamoeba invadens
VEKVLKLILLLLYHRRDFNMSSLTMMMYVQPIVG

SEQ ID NO: 2807233 - protein, 24 aa, Entamoeba invadens
VEKWLNHLLCLDASNTLLHVTTTP

SEQ ID NO: 2807234 - protein, 22 aa, Entamoeba invadens
VELDFLNLLLSFNRFGYQDTSL

SEQ ID NO: 2807235 - protein, 28 aa, Entamoeba invadens
VELIAVNLIDEFLMKNVEEFKKILKTEQ

SEQ ID NO: 2807236 - protein, 27 aa, Entamoeba invadens
VELLLLCYPIFFLFLVFYKDKKSKNFK

SEQ ID NO: 2807237 - protein, 26 aa, Entamoeba invadens
VELMSLFNRIICWVLMISHNFVNSDD

SEQ ID NO: 2807238 - protein, 31 aa, Entamoeba invadens
VELNLAPKVLKEFVVACARQILTEFTYSEQL

SEQ ID NO: 2807239 - protein, 24 aa, Entamoeba invadens
VELTKRIPLIFSTALSTWIDNSSI

SEQ ID NO: 2807240 - protein, 18 aa, Entamoeba invadens
VELYLRSTIHLSNVEEKY

SEQ ID NO: 2807241 - protein, 22 aa, Entamoeba invadens
VEMKTASVASGFITVDNDLIFL

SEQ ID NO: 2807242 - protein, 19 aa, Entamoeba invadens
VEMSCIYYLDIEHCTQSDS

SEQ ID NO: 2807243 - protein, 19 aa, Entamoeba invadens
VEMYSLIEDCWKQDQEDRL

SEQ ID NO: 2807244 - protein, 19 aa, Entamoeba invadens
VENCRYCDHDMCFDCYDGY

SEQ ID NO: 2807245 - protein, 17 aa, Entamoeba invadens
VENCVTCIQPSLRGYPF

SEQ ID NO: 2807246 - protein, 26 aa, Entamoeba invadens
VENIEKCFGLFDFKALKIAKEQKAKL

SEQ ID NO: 2807247 - protein, 23 aa, Entamoeba invadens
VENKLRIKFMYDAAKGILYLHNN

SEQ ID NO: 2807248 - protein, 20 aa, Entamoeba invadens
VENSAYCGYYYVPYDVFKFG

SEQ ID NO: 2807249 - protein, 20 aa, Entamoeba invadens
VEPEVVLIKRGRACEFSLYL

SEQ ID NO: 2807250 - protein, 17 aa, Entamoeba invadens
VEPFCGKTIPAIGMSFD

SEQ ID NO: 2807251 - protein, 24 aa, Entamoeba invadens
VEQFLKLKYSRIFLNPEKDAMDAS

SEQ ID NO: 2807252 - protein, 18 aa, Entamoeba invadens
VEQSFLWEHMLLMKHPHP

SEQ ID NO: 2807253 - protein, 20 aa, Entamoeba invadens
VERACFKCDLGYYPINGKCT

SEQ ID NO: 2807254 - protein, 17 aa, Entamoeba invadens
VERCLGIVSLLSTSSFF

SEQ ID NO: 2807255 - protein, 22 aa, Entamoeba invadens
VERGYFRFVAFSVAMESCNMML

SEQ ID NO: 2807256 - protein, 18 aa, Entamoeba invadens
VERGYRVRVNNNWMLCSG

SEQ ID NO: 2807257 - protein, 18 aa, Entamoeba invadens
VERKEPGYEFAIKTPCTL

SEQ ID NO: 2807258 - protein, 17 aa, Entamoeba invadens
VERLLSIRLTTFQNTRC

SEQ ID NO: 2807259 - protein, 23 aa, Entamoeba invadens
VESCAPSFCKTVKNSFFITTDST

SEQ ID NO: 2807260 - protein, 19 aa, Entamoeba invadens
VESETKMVFCVGNASRNVS

SEQ ID NO: 2807261 - protein, 26 aa, Entamoeba invadens
VESLELIIVRKGIRFNTEGEVVIACE

SEQ ID NO: 2807262 - protein, 23 aa, Entamoeba invadens
VESLNLYEPALWLVLLNIVRNLV

SEQ ID NO: 2807263 - protein, 21 aa, Entamoeba invadens
VESLTSLKQNDEWMTITNNIS

SEQ ID NO: 2807264 - protein, 26 aa, Entamoeba invadens
VESRPLLRKSSSLSLTRSSLQRRSSS

SEQ ID NO: 2807265 - protein, 20 aa, Entamoeba invadens
VESYLPFFLLSDFAQELYSN

SEQ ID NO: 2807266 - protein, 23 aa, Entamoeba invadens
VETALKLLEAWEVTKNPVVNSEA

SEQ ID NO: 2807267 - protein, 18 aa, Entamoeba invadens
VETKAGTPEGVFEDLAVG

SEQ ID NO: 2807268 - protein, 27 aa, Entamoeba invadens
VETKEFPKWTIALIVIFVVALVVVVLI

SEQ ID NO: 2807269 - protein, 19 aa, Entamoeba invadens
VETLLLIQCTLKIKSEVLI

SEQ ID NO: 2807270 - protein, 21 aa, Entamoeba invadens
VETLVKFRSEYIVHFYGAVFI

SEQ ID NO: 2807271 - protein, 17 aa, Entamoeba invadens
VEVFSKIYLNNPFSEIP

SEQ ID NO: 2807272 - protein, 22 aa, Entamoeba invadens
VEVKSEKSELVFEKVKSEKSET

SEQ ID NO: 2807273 - protein, 25 aa, Entamoeba invadens
VEVLICLRLEKVFGISADILGVSLI

SEQ ID NO: 2807274 - protein, 18 aa, Entamoeba invadens
VEVTSAAVKPVFVKLNKI

SEQ ID NO: 2807275 - protein, 20 aa, Entamoeba invadens
VEVVLFWVFVIVWRKKKVLT

SEQ ID NO: 2807276 - protein, 25 aa, Entamoeba invadens
VEVWQYKMWISIVMSLILGGVCIGI

SEQ ID NO: 2807277 - protein, 18 aa, Entamoeba invadens
VEWTFDLVPQFLKMPTLS

SEQ ID NO: 2807278 - protein, 24 aa, Entamoeba invadens
VEYFAFYLSFDFTKKITIFPSYFK

SEQ ID NO: 2807279 - protein, 19 aa, Entamoeba invadens
VEYLRRLGTLNMLHSGRSG

SEQ ID NO: 2807280 - protein, 20 aa, Entamoeba invadens
VEYRDLQALLIKMSSLDEEV

SEQ ID NO: 2807281 - protein, 23 aa, Entamoeba invadens
VEYRICDFMHTLYETFYVDLSFV

SEQ ID NO: 2807282 - protein, 17 aa, Entamoeba invadens
VEYYPLGTLDHFLDQQV

SEQ ID NO: 2807283 - protein, 34 aa, Entamoeba invadens
VFAFGLSLLECMKWRQAYEKPEFNYMWQVADFVS

SEQ ID NO: 2807284 - protein, 17 aa, Entamoeba invadens
VFAFGVVMYETFVEHGA

SEQ ID NO: 2807285 - protein, 18 aa, Entamoeba invadens
VFAPVYFCVVTLLLCLIA

SEQ ID NO: 2807286 - protein, 24 aa, Entamoeba invadens
VFAYKWIVLLFRRFIDDKYIFRIW

SEQ ID NO: 2807287 - protein, 25 aa, Entamoeba invadens
VFCGHPIFGTMLLRYFEQENKSNVA

SEQ ID NO: 2807288 - protein, 20 aa, Entamoeba invadens
VFCGLNCKIQVPSFNQHIKI

SEQ ID NO: 2807289 - protein, 17 aa, Entamoeba invadens
VFCSNSYNAAVHDSNVF

SEQ ID NO: 2807290 - protein, 18 aa, Entamoeba invadens
VFCSVMATVMFYRHQEDW

SEQ ID NO: 2807291 - protein, 18 aa, Entamoeba invadens
VFDFKNTYSLCKIPPEVL

SEQ ID NO: 2807292 - protein, 24 aa, Entamoeba invadens
VFDGGNFNRFWAKMEFKGNGGRTL

SEQ ID NO: 2807293 - protein, 19 aa, Entamoeba invadens
VFDPSCCYGDLLQQNTISM

SEQ ID NO: 2807294 - protein, 24 aa, Entamoeba invadens
VFDRSCAKFSTPRVGTLVTSAGPI

SEQ ID NO: 2807295 - protein, 25 aa, Entamoeba invadens
VFEFDRCYACGSSVVVGITEKAIKL

SEQ ID NO: 2807296 - protein, 18 aa, Entamoeba invadens
VFEIKFNGNYSVLFDARK

SEQ ID NO: 2807297 - protein, 18 aa, Entamoeba invadens
VFEMKRSNIEMVQINSVL

SEQ ID NO: 2807298 - protein, 24 aa, Entamoeba invadens
VFEMKSLVFDGGVDYVATRDLKTV

SEQ ID NO: 2807299 - protein, 17 aa, Entamoeba invadens
VFFCFFFIFFCFHFSIF

SEQ ID NO: 2807300 - protein, 19 aa, Entamoeba invadens
VFFGCFYWIGVFFVIMFWI

SEQ ID NO: 2807301 - protein, 19 aa, Entamoeba invadens
VFFLCFYWAGLFFVVMFWI

SEQ ID NO: 2807302 - protein, 21 aa, Entamoeba invadens
VFFNCHICPAGTYANSTNNKC

SEQ ID NO: 2807303 - protein, 30 aa, Entamoeba invadens
VFFNDKICTEFTYKLPRGVVVSASALCGEL

SEQ ID NO: 2807304 - protein, 18 aa, Entamoeba invadens
VFFVFKAPVSFIICYCVS

SEQ ID NO: 2807305 - protein, 17 aa, Entamoeba invadens
VFFWNEFYNSFVTIMVC

SEQ ID NO: 2807306 - protein, 23 aa, Entamoeba invadens
VFGACFSIGLILVVFTQSELFTS

SEQ ID NO: 2807307 - protein, 17 aa, Entamoeba invadens
VFGCNWIGIWLASKTLR

SEQ ID NO: 2807308 - protein, 17 aa, Entamoeba invadens
VFGVYAFVWNVCSQNCF

SEQ ID NO: 2807309 - protein, 20 aa, Entamoeba invadens
VFIASISGILCFDRNKMKKS

SEQ ID NO: 2807310 - protein, 23 aa, Entamoeba invadens
VFICFLMFYVLIMFDALRKPIKQ

SEQ ID NO: 2807311 - protein, 17 aa, Entamoeba invadens
VFIGCGYGIAGTLGVSG

SEQ ID NO: 2807312 - protein, 19 aa, Entamoeba invadens
VFIRKELRTQHDACKLATE

SEQ ID NO: 2807313 - protein, 24 aa, Entamoeba invadens
VFITFVKDCMLVFEDIIEFATTAN

SEQ ID NO: 2807314 - protein, 17 aa, Entamoeba invadens
VFKDCKKLKTVTITGHT

SEQ ID NO: 2807315 - protein, 18 aa, Entamoeba invadens
VFKGIFRGNIVAIKKLKF

SEQ ID NO: 2807316 - protein, 20 aa, Entamoeba invadens
VFKNESLCAGPQLNDPIVPF

SEQ ID NO: 2807317 - protein, 21 aa, Entamoeba invadens
VFKYLNIQNAIQWVNTTPIDF

SEQ ID NO: 2807318 - protein, 18 aa, Entamoeba invadens
VFLAIGFIGLVLNKRFQM

SEQ ID NO: 2807319 - protein, 17 aa, Entamoeba invadens
VFLCFLVPTFSQFTMFV

SEQ ID NO: 2807320 - protein, 25 aa, Entamoeba invadens
VFLEKEFYLLLGIKICVTIFVGFAV

SEQ ID NO: 2807321 - protein, 24 aa, Entamoeba invadens
VFLENVFYLLLGMKICVTIFVGFA

SEQ ID NO: 2807322 - protein, 23 aa, Entamoeba invadens
VFLESLIRLSQCGVFSVEMSAVK

SEQ ID NO: 2807323 - protein, 21 aa, Entamoeba invadens
VFLFFTFVAIFLITRTILAHF

SEQ ID NO: 2807324 - protein, 25 aa, Entamoeba invadens
VFLIIATPFLFVWNKLPSIVRFSIK

SEQ ID NO: 2807325 - protein, 23 aa, Entamoeba invadens
VFLMVYFVQSWIVMASDSNEMSP

SEQ ID NO: 2807326 - protein, 19 aa, Entamoeba invadens
VFLRAILFRMVIKQIMKGR

SEQ ID NO: 2807327 - protein, 20 aa, Entamoeba invadens
VFLVVCRNGGLAVYNETFAV

SEQ ID NO: 2807328 - protein, 27 aa, Entamoeba invadens
VFNEVLKFIICLVMLKFVHHKENLFFH

SEQ ID NO: 2807329 - protein, 18 aa, Entamoeba invadens
VFNIFKGFFSLSGDKIKT

SEQ ID NO: 2807330 - protein, 18 aa, Entamoeba invadens
VFNKRKVRMDDVFEVEMK

SEQ ID NO: 2807331 - protein, 18 aa, Entamoeba invadens
VFPSMYFLMCASVVLSVT

SEQ ID NO: 2807332 - protein, 21 aa, Entamoeba invadens
VFPVINGKVLRKMPVQLTPSN

SEQ ID NO: 2807333 - protein, 24 aa, Entamoeba invadens
VFQACAIGSLVLCTIYQRKKDFGD

SEQ ID NO: 2807334 - protein, 19 aa, Entamoeba invadens
VFQALLKCNAEYFFDTTGC

SEQ ID NO: 2807335 - protein, 24 aa, Entamoeba invadens
VFQMKRSNIHFVFLQNGICVSSKE

SEQ ID NO: 2807336 - protein, 19 aa, Entamoeba invadens
VFQMLYRLFIRPFLNPNPI

SEQ ID NO: 2807337 - protein, 19 aa, Entamoeba invadens
VFQTICYTAAITKMNEQMK

SEQ ID NO: 2807338 - protein, 22 aa, Entamoeba invadens
VFSDLWKPYLEITLRDFEENKN

SEQ ID NO: 2807339 - protein, 22 aa, Entamoeba invadens
VFSDLWKPYLEITLRDIEENKN

SEQ ID NO: 2807340 - protein, 17 aa, Entamoeba invadens
VFSDVCLVNEVLIAVQS

SEQ ID NO: 2807341 - protein, 18 aa, Entamoeba invadens
VFSFGITAWEIFYQEQPY

SEQ ID NO: 2807342 - protein, 24 aa, Entamoeba invadens
VFSFGVTMFEMFGWCEIYSKNVFN

SEQ ID NO: 2807343 - protein, 40 aa, Entamoeba invadens
VFSFKSQGFFGFPICLKDKLFKVILFTVNFTGNFNLALDG

SEQ ID NO: 2807344 - protein, 17 aa, Entamoeba invadens
VFSHGPLLMAIPMWKNS

SEQ ID NO: 2807345 - protein, 18 aa, Entamoeba invadens
VFSLCFLLALSALLYGTM

SEQ ID NO: 2807346 - protein, 19 aa, Entamoeba invadens
VFSNLLLERKFIFISESLQ

SEQ ID NO: 2807347 - protein, 19 aa, Entamoeba invadens
VFSQTLPFYVEKVYRFCSE

SEQ ID NO: 2807348 - protein, 24 aa, Entamoeba invadens
VFSYAITILEIWIGKCPYSPLLFP

SEQ ID NO: 2807349 - protein, 18 aa, Entamoeba invadens
VFSYICGLINIMFWMFAQ

SEQ ID NO: 2807350 - protein, 18 aa, Entamoeba invadens
VFTDMCVCVQCTNDTLLV

SEQ ID NO: 2807351 - protein, 22 aa, Entamoeba invadens
VFTFPFKFLYYQYKLLTNVYFL

SEQ ID NO: 2807352 - protein, 20 aa, Entamoeba invadens
VFTHKFVRFGVYKDGEVYTE

SEQ ID NO: 2807353 - protein, 25 aa, Entamoeba invadens
VFTMFRYATWYEVVFNLIAVVVSLV

SEQ ID NO: 2807354 - protein, 18 aa, Entamoeba invadens
VFVGILIMEVPKELKQLL

SEQ ID NO: 2807355 - protein, 18 aa, Entamoeba invadens
VFVGYFSMIILKGAVPNS

SEQ ID NO: 2807356 - protein, 28 aa, Entamoeba invadens
VFVIFSLRVVRPLLVVLMFELYWFCIVF

SEQ ID NO: 2807357 - protein, 19 aa, Entamoeba invadens
VFVLIECAWGRVPKERISI

SEQ ID NO: 2807358 - protein, 19 aa, Entamoeba invadens
VFVLLPYISKRVHIIAQNT

SEQ ID NO: 2807359 - protein, 19 aa, Entamoeba invadens
VFVSMRFIFSPTLCLFIGG

SEQ ID NO: 2807360 - protein, 18 aa, Entamoeba invadens
VFVSYVFELTGYVRDILS

SEQ ID NO: 2807361 - protein, 21 aa, Entamoeba invadens
VFWCAFKLQNNKIRGMNTLMF

SEQ ID NO: 2807362 - protein, 22 aa, Entamoeba invadens
VFYRSLCLTRVLPEEQVLWFGK

SEQ ID NO: 2807363 - protein, 32 aa, Entamoeba invadens
VFYYCASRLIDFWGIFICCVVIATAAFFEDVN

SEQ ID NO: 2807364 - protein, 24 aa, Entamoeba invadens
VGACFACLSVPFYGFIKSNVSGTK

SEQ ID NO: 2807365 - protein, 19 aa, Entamoeba invadens
VGAFMARRIISAIHLPTVL

SEQ ID NO: 2807366 - protein, 19 aa, Entamoeba invadens
VGALSYEIEYIFKDNKLCN

SEQ ID NO: 2807367 - protein, 19 aa, Entamoeba invadens
VGCDGCYVFSAIEMASILF

SEQ ID NO: 2807368 - protein, 18 aa, Entamoeba invadens
VGCGVSVSICQLSKTKMI

SEQ ID NO: 2807369 - protein, 21 aa, Entamoeba invadens
VGCMYCPPGTYSNRLRSTQCE

SEQ ID NO: 2807370 - protein, 22 aa, Entamoeba invadens
VGCVVCTILFTIGALIIIHTLF

SEQ ID NO: 2807371 - protein, 23 aa, Entamoeba invadens
VGDCAHTALRGCDICHENYFLKN

SEQ ID NO: 2807372 - protein, 21 aa, Entamoeba invadens
VGDFLGRCLQFFPKIPPVKFV

SEQ ID NO: 2807373 - protein, 17 aa, Entamoeba invadens
VGDGKMYLIDTCSTVNT

SEQ ID NO: 2807374 - protein, 17 aa, Entamoeba invadens
VGDGMPFTSIKLEPRKS

SEQ ID NO: 2807375 - protein, 19 aa, Entamoeba invadens
VGDLCLYDSDAMKFYGKGI

SEQ ID NO: 2807376 - protein, 18 aa, Entamoeba invadens
VGDSFKTIYFIISEVPLQ

SEQ ID NO: 2807377 - protein, 23 aa, Entamoeba invadens
VGEGKRCPGALFVVNEAEVVKAF

SEQ ID NO: 2807378 - protein, 21 aa, Entamoeba invadens
VGELPKLLRIFEIGVRGLVDK

SEQ ID NO: 2807379 - protein, 26 aa, Entamoeba invadens
VGELYPRVGCFKVLDGKYVQYSTSGS

SEQ ID NO: 2807380 - protein, 24 aa, Entamoeba invadens
VGEQSVRKRVWAFFSNVLEKPQLA

SEQ ID NO: 2807381 - protein, 24 aa, Entamoeba invadens
VGESGEIFIECPFYVKNLTKTPKV

SEQ ID NO: 2807382 - protein, 18 aa, Entamoeba invadens
VGEVMKFELIQIGDRGRV

SEQ ID NO: 2807383 - protein, 18 aa, Entamoeba invadens
VGEWYVIAIGAATLVVCE

SEQ ID NO: 2807384 - protein, 24 aa, Entamoeba invadens
VGFSIKRWNWLILSSELFSVTIYF

SEQ ID NO: 2807385 - protein, 20 aa, Entamoeba invadens
VGGDVSRLSGFTFDIKLMNV

SEQ ID NO: 2807386 - protein, 18 aa, Entamoeba invadens
VGGELLLFDGGVLLFETK

SEQ ID NO: 2807387 - protein, 18 aa, Entamoeba invadens
VGGGWRRMLIVTGAAVPP

SEQ ID NO: 2807388 - protein, 24 aa, Entamoeba invadens
VGGLLGRGSAYAMLARFQEAIVDF

SEQ ID NO: 2807389 - protein, 19 aa, Entamoeba invadens
VGHIALLLRLVHIFPDTKL

SEQ ID NO: 2807390 - protein, 19 aa, Entamoeba invadens
VGIALGVVFGVILLCCGVA

SEQ ID NO: 2807391 - protein, 27 aa, Entamoeba invadens
VGIAMTFYKLSRVFSFNFQGNGHFVEY

SEQ ID NO: 2807392 - protein, 25 aa, Entamoeba invadens
VGIFFPPLLLVGLIAKRKYKNSQKL

SEQ ID NO: 2807393 - protein, 19 aa, Entamoeba invadens
VGILCFITSVVLLVVLIIL

SEQ ID NO: 2807394 - protein, 17 aa, Entamoeba invadens
VGIPRECVYRDIIKMCW

SEQ ID NO: 2807395 - protein, 30 aa, Entamoeba invadens
VGISIGLVCLVLYHFGIDFIFNSRSFAHIF

SEQ ID NO: 2807396 - protein, 27 aa, Entamoeba invadens
VGISTVFLAVCFLCVLQSAVSQVPSVF

SEQ ID NO: 2807397 - protein, 20 aa, Entamoeba invadens
VGITCEFLFVVPAFVSKISK

SEQ ID NO: 2807398 - protein, 20 aa, Entamoeba invadens
VGKCAMCPTGTYYLSSVCQS

SEQ ID NO: 2807399 - protein, 17 aa, Entamoeba invadens
VGKCFKQMVKYLTEDDE

SEQ ID NO: 2807400 - protein, 17 aa, Entamoeba invadens
VGKCLSCNTMANCTKCQ

SEQ ID NO: 2807401 - protein, 17 aa, Entamoeba invadens
VGKECREIVKAMLLDFS

SEQ ID NO: 2807402 - protein, 22 aa, Entamoeba invadens
VGKIGGVIDCIGRGVKISLILQ

SEQ ID NO: 2807403 - protein, 21 aa, Entamoeba invadens
VGKNETRGCMPWTGTLNDELG

SEQ ID NO: 2807404 - protein, 20 aa, Entamoeba invadens
VGLCKECFEGWYLESDITNS

SEQ ID NO: 2807405 - protein, 17 aa, Entamoeba invadens
VGLDCFECDLKCEKCLN

SEQ ID NO: 2807406 - protein, 18 aa, Entamoeba invadens
VGLDCYDCDVKCETCNNN

SEQ ID NO: 2807407 - protein, 24 aa, Entamoeba invadens
VGLFPTLYQRRIFPTSKPQQNGDI

SEQ ID NO: 2807408 - protein, 25 aa, Entamoeba invadens
VGLFVAYLCVFGWHEVSIEDKYTFE

SEQ ID NO: 2807409 - protein, 18 aa, Entamoeba invadens
VGLIFDFINRPVPLKEPQ

SEQ ID NO: 2807410 - protein, 23 aa, Entamoeba invadens
VGLLYNECFGIAFDIFGTAWDKQ

SEQ ID NO: 2807411 - protein, 19 aa, Entamoeba invadens
VGLNLFVDVIWRFLETPFK

SEQ ID NO: 2807412 - protein, 18 aa, Entamoeba invadens
VGLNSLWGKTKESLSQDK

SEQ ID NO: 2807413 - protein, 17 aa, Entamoeba invadens
VGLPSRQLFCVGSTKYK

SEQ ID NO: 2807414 - protein, 18 aa, Entamoeba invadens
VGLSMFWSPDETLIGAES

SEQ ID NO: 2807415 - protein, 18 aa, Entamoeba invadens
VGLSRIFKCKEITKSKCS

SEQ ID NO: 2807416 - protein, 19 aa, Entamoeba invadens
VGLVVEYAPLGSLRNIFMN

SEQ ID NO: 2807417 - protein, 18 aa, Entamoeba invadens
VGLYLDKLFELFSILPSY

SEQ ID NO: 2807418 - protein, 17 aa, Entamoeba invadens
VGMFKTKGGIIVSPYVN

SEQ ID NO: 2807419 - protein, 19 aa, Entamoeba invadens
VGMIIKLKKDDVVPADIIP

SEQ ID NO: 2807420 - protein, 18 aa, Entamoeba invadens
VGMKCSNLFYGCYSCDYK

SEQ ID NO: 2807421 - protein, 35 aa, Entamoeba invadens
VGMTLYETFKWGYAYDPEKIKSWDIADNVCKGLRP

SEQ ID NO: 2807422 - protein, 23 aa, Entamoeba invadens
VGNIFVYFCLIKMFNVNFVLILI

SEQ ID NO: 2807423 - protein, 25 aa, Entamoeba invadens
VGNKAFEFAKGWFGQAVASMTAQPT

SEQ ID NO: 2807424 - protein, 24 aa, Entamoeba invadens
VGNKGRSTLKMQFTQQVNEKYDIQ

SEQ ID NO: 2807425 - protein, 19 aa, Entamoeba invadens
VGNNLILFFCKMNFTVTGN

SEQ ID NO: 2807426 - protein, 18 aa, Entamoeba invadens
VGPALALNFIHMVNFTQS

SEQ ID NO: 2807427 - protein, 20 aa, Entamoeba invadens
VGPECTLRCKLFNYNTLLLT

SEQ ID NO: 2807428 - protein, 24 aa, Entamoeba invadens
VGQAECNLCPLGTYQNFRGTTQCK

SEQ ID NO: 2807429 - protein, 31 aa, Entamoeba invadens
VGQFVPFGWFVYLFFRWPNGFYNIKKGDHKM

SEQ ID NO: 2807430 - protein, 17 aa, Entamoeba invadens
VGQSHVSQRIFAWREYL

SEQ ID NO: 2807431 - protein, 19 aa, Entamoeba invadens
VGRFPQAWHLYKTKNAEGM

SEQ ID NO: 2807432 - protein, 24 aa, Entamoeba invadens
VGRKLVKSFVPFTVCVVAKNNELC

SEQ ID NO: 2807433 - protein, 21 aa, Entamoeba invadens
VGRPICPLGNFGKILLVGSGV

SEQ ID NO: 2807434 - protein, 19 aa, Entamoeba invadens
VGSAMAIVLFVVMVFTKQQ

SEQ ID NO: 2807435 - protein, 21 aa, Entamoeba invadens
VGSCFVIPLSVVIISQIIYYR

SEQ ID NO: 2807436 - protein, 20 aa, Entamoeba invadens
VGSCPGYLLVLFIFIFIVFA

SEQ ID NO: 2807437 - protein, 19 aa, Entamoeba invadens
VGSFLGMIIMFVVPVEDVF

SEQ ID NO: 2807438 - protein, 18 aa, Entamoeba invadens
VGSGFLLHLFGSMFQTIA

SEQ ID NO: 2807439 - protein, 17 aa, Entamoeba invadens
VGSIFGGGVYLKTQLDF

SEQ ID NO: 2807440 - protein, 24 aa, Entamoeba invadens
VGSIKGEFLVSVVVLILYGLGQYT

SEQ ID NO: 2807441 - protein, 23 aa, Entamoeba invadens
VGSKARTAILTTLRQMPQNIILP

SEQ ID NO: 2807442 - protein, 24 aa, Entamoeba invadens
VGSVCACPSGYIFVDGDCLSSLDT

SEQ ID NO: 2807443 - protein, 17 aa, Entamoeba invadens
VGTDVWSVLPVAMGINI

SEQ ID NO: 2807444 - protein, 20 aa, Entamoeba invadens
VGVACLFQSPLCDSFELANS

SEQ ID NO: 2807445 - protein, 19 aa, Entamoeba invadens
VGVCGIVGFVIYRKKTQRS

SEQ ID NO: 2807446 - protein, 18 aa, Entamoeba invadens
VGVFLFVVICVGIILVVL

SEQ ID NO: 2807447 - protein, 18 aa, Entamoeba invadens
VGVILWFSVLVIIISAFF

SEQ ID NO: 2807448 - protein, 19 aa, Entamoeba invadens
VGVSTIWCNGTFYIENESC

SEQ ID NO: 2807449 - protein, 18 aa, Entamoeba invadens
VGWVFPGELFTVTVPQDL

SEQ ID NO: 2807450 - protein, 19 aa, Entamoeba invadens
VGWVFPGELFTVTVPQDLN

SEQ ID NO: 2807451 - protein, 17 aa, Entamoeba invadens
VGYINGIIFVYLFNTEK

SEQ ID NO: 2807452 - protein, 28 aa, Entamoeba invadens
VGYNGKFLWNSKVSRLFLAKEDQTHKSN

SEQ ID NO: 2807453 - protein, 23 aa, Entamoeba invadens
VGYSKCTKCSFWHTPSANGTYCN

SEQ ID NO: 2807454 - protein, 22 aa, Entamoeba invadens
VGYYYFWWLDAVGGIVLSFYIM

SEQ ID NO: 2807455 - protein, 19 aa, Entamoeba invadens
VHCGGLLDGKYVLSCGTDA

SEQ ID NO: 2807456 - protein, 17 aa, Entamoeba invadens
VHDLQKKTCLFSMNSSN

SEQ ID NO: 2807457 - protein, 23 aa, Entamoeba invadens
VHFFLNGIFCFFALKTKSMLICG

SEQ ID NO: 2807458 - protein, 17 aa, Entamoeba invadens
VHFISFQGGICVSSEQI

SEQ ID NO: 2807459 - protein, 24 aa, Entamoeba invadens
VHFIVIQLALKWAKEAAGSDYKIP

SEQ ID NO: 2807460 - protein, 25 aa, Entamoeba invadens
VHFTICETIKWILRIIIKKKENKAM

SEQ ID NO: 2807461 - protein, 23 aa, Entamoeba invadens
VHHKKHVCIDCMFKTHAVCTMSK

SEQ ID NO: 2807462 - protein, 24 aa, Entamoeba invadens
VHLLGVRGVYGFQLLKYSVPDLSD

SEQ ID NO: 2807463 - protein, 17 aa, Entamoeba invadens
VHLLRPLYFIASALCGF

SEQ ID NO: 2807464 - protein, 19 aa, Entamoeba invadens
VHNPIKRLDIKEVIKQLDN

SEQ ID NO: 2807465 - protein, 17 aa, Entamoeba invadens
VHNSLKFLKEFFSDTGR

SEQ ID NO: 2807466 - protein, 26 aa, Entamoeba invadens
VHNSLRCLTCAEAFYFDESTKQCVNC

SEQ ID NO: 2807467 - protein, 26 aa, Entamoeba invadens
VHNSLRCLTCAEVFYFDESTKQCVNC

SEQ ID NO: 2807468 - protein, 24 aa, Entamoeba invadens
VHRPGFEGYDSWVISHLYDITQSC

SEQ ID NO: 2807469 - protein, 31 aa, Entamoeba invadens
VHSKNVKYDDRWTLKFCNITNVEVPEDVDEL

SEQ ID NO: 2807470 - protein, 18 aa, Entamoeba invadens
VHVNIWIAVIVPLAAIAI

SEQ ID NO: 2807471 - protein, 35 aa, Entamoeba invadens
VHVVTPNKVRLVWKEIRGTWQWINGRTYEVKPELV

SEQ ID NO: 2807472 - protein, 26 aa, Entamoeba invadens
VIAAGFKMDLNFSDLIEQCIDLYEMW

SEQ ID NO: 2807473 - protein, 17 aa, Entamoeba invadens
VIAGVAIFIKNKRHHNA

SEQ ID NO: 2807474 - protein, 18 aa, Entamoeba invadens
VIAGVAIFIKNKRHHNAS

SEQ ID NO: 2807475 - protein, 18 aa, Entamoeba invadens
VIAMTFKFSKNAKIHILS

SEQ ID NO: 2807476 - protein, 19 aa, Entamoeba invadens
VICDEFEYYLTAIIKGNTD

SEQ ID NO: 2807477 - protein, 18 aa, Entamoeba invadens
VICGPIFVLYTLYMILTN

SEQ ID NO: 2807478 - protein, 18 aa, Entamoeba invadens
VICKPCISNCEYCNTNST

SEQ ID NO: 2807479 - protein, 24 aa, Entamoeba invadens
VICLLAALFCCIFLPDLPFILLGL

SEQ ID NO: 2807480 - protein, 26 aa, Entamoeba invadens
VICPAICIGINFALWYYGIVPSDPMF

SEQ ID NO: 2807481 - protein, 18 aa, Entamoeba invadens
VICSTCSVGYYPEIYCKQ

SEQ ID NO: 2807482 - protein, 18 aa, Entamoeba invadens
VICSTCTVGYYPDIYCKQ

SEQ ID NO: 2807483 - protein, 24 aa, Entamoeba invadens
VICSWMAISITNIFPGTKLLLGGK

SEQ ID NO: 2807484 - protein, 25 aa, Entamoeba invadens
VICSWMAISITNIFPGTKLLLGGKL

SEQ ID NO: 2807485 - protein, 19 aa, Entamoeba invadens
VIDHLLRVCVENMGNIETN

SEQ ID NO: 2807486 - protein, 29 aa, Entamoeba invadens
VIDIKKYRTVLMIVELCKVIKFYIPNDSE

SEQ ID NO: 2807487 - protein, 26 aa, Entamoeba invadens
VIDPECYEHWDDLVLQNLEPSEKLLT

SEQ ID NO: 2807488 - protein, 19 aa, Entamoeba invadens
VIDRVPPIDKMTCTQNGIE

SEQ ID NO: 2807489 - protein, 29 aa, Entamoeba invadens
VIDVSIAVCGVGLWIILYIFLMIGFFARY

SEQ ID NO: 2807490 - protein, 20 aa, Entamoeba invadens
VIEELRRTIVLRSKIEKRTC

SEQ ID NO: 2807491 - protein, 19 aa, Entamoeba invadens
VIEISAFTFQGCTKLKYLI

SEQ ID NO: 2807492 - protein, 20 aa, Entamoeba invadens
VIEPILIQWNPKPSIYIYVM

SEQ ID NO: 2807493 - protein, 27 aa, Entamoeba invadens
VIETVCVMCPLGFFLPGSDYSTMTHNS

SEQ ID NO: 2807494 - protein, 25 aa, Entamoeba invadens
VIEVSKYHLKVLISFVDQLIEVTTF

SEQ ID NO: 2807495 - protein, 25 aa, Entamoeba invadens
VIFECVFGIIIFWRYKYQVSHFTSS

SEQ ID NO: 2807496 - protein, 20 aa, Entamoeba invadens
VIFEFCYPEALVGTQKERYE

SEQ ID NO: 2807497 - protein, 19 aa, Entamoeba invadens
VIFKDLWLENDVFASLCEI

SEQ ID NO: 2807498 - protein, 25 aa, Entamoeba invadens
VIFPSTLLGSGMPWTMVRKLATTEY

SEQ ID NO: 2807499 - protein, 18 aa, Entamoeba invadens
VIFSVYLFKTEEATKPQI

SEQ ID NO: 2807500 - protein, 18 aa, Entamoeba invadens
VIFTTALTIGWVFGLSTV

SEQ ID NO: 2807501 - protein, 18 aa, Entamoeba invadens
VIGFEMFSKVKVNELLRW

SEQ ID NO: 2807502 - protein, 23 aa, Entamoeba invadens
VIGFIHLFIIVWIVIVITVVVSS

SEQ ID NO: 2807503 - protein, 18 aa, Entamoeba invadens
VIGIPISVLILIKIVVST

SEQ ID NO: 2807504 - protein, 17 aa, Entamoeba invadens
VIGIPITVLILLVIFIL

SEQ ID NO: 2807505 - protein, 17 aa, Entamoeba invadens
VIGIPITVLILLVIFMT

SEQ ID NO: 2807506 - protein, 22 aa, Entamoeba invadens
VIGIPVALIFIMIFLLFLLVYL

SEQ ID NO: 2807507 - protein, 19 aa, Entamoeba invadens
VIGNILWTIGINAIQLSYR

SEQ ID NO: 2807508 - protein, 20 aa, Entamoeba invadens
VIGVQGWLGFAIFFGTTGLI

SEQ ID NO: 2807509 - protein, 17 aa, Entamoeba invadens
VIHAMIMRLVRKTILPL

SEQ ID NO: 2807510 - protein, 24 aa, Entamoeba invadens
VIHPHRLKIFVIYMTVFCTTKMLG

SEQ ID NO: 2807511 - protein, 18 aa, Entamoeba invadens
VIHWDRDLSPLIIENNTK

SEQ ID NO: 2807512 - protein, 18 aa, Entamoeba invadens
VIICMKDFMWTLASSQCF

SEQ ID NO: 2807513 - protein, 19 aa, Entamoeba invadens
VIIEFCWKGHGEELTWWSI

SEQ ID NO: 2807514 - protein, 20 aa, Entamoeba invadens
VIIICVLLTLFVLSHKKQQE

SEQ ID NO: 2807515 - protein, 18 aa, Entamoeba invadens
VIIIKCSFVMVRCLFGTI

SEQ ID NO: 2807516 - protein, 26 aa, Entamoeba invadens
VIIITLIICFSVKYIMQYMKLEEQRK

SEQ ID NO: 2807517 - protein, 31 aa, Entamoeba invadens
VIISMKMKNSFKRFISAVADIFYLSAKKKFE

SEQ ID NO: 2807518 - protein, 19 aa, Entamoeba invadens
VIIVAFFVCSYCFDSIIVS

SEQ ID NO: 2807519 - protein, 28 aa, Entamoeba invadens
VIIVAFFVCSYCFDSIIVSLVVVTKNIF

SEQ ID NO: 2807520 - protein, 19 aa, Entamoeba invadens
VIIVCALALIITYAIGGLC

SEQ ID NO: 2807521 - protein, 23 aa, Entamoeba invadens
VIIVKRFFLLQGVIFMLRSLSIF

SEQ ID NO: 2807522 - protein, 27 aa, Entamoeba invadens
VIIVSLVWYLARPCLGGVRGTRGCLCP

SEQ ID NO: 2807523 - protein, 26 aa, Entamoeba invadens
VIIVTLIICFSVKYIMQYMKLEEQRE

SEQ ID NO: 2807524 - protein, 18 aa, Entamoeba invadens
VIIYKLYYLFLSFCKIIG

SEQ ID NO: 2807525 - protein, 17 aa, Entamoeba invadens
VIKASKCMKCKDGFSNQ

SEQ ID NO: 2807526 - protein, 25 aa, Entamoeba invadens
VIKEFSRLSPMVLFQQSLHFLKTDV

SEQ ID NO: 2807527 - protein, 19 aa, Entamoeba invadens
VIKEGKFEEGWHINSTDGN

SEQ ID NO: 2807528 - protein, 33 aa, Entamoeba invadens
VIKIDMPKPILATWQFYVGMLSVIVAAMAVGYV

SEQ ID NO: 2807529 - protein, 24 aa, Entamoeba invadens
VIKIKLRVKFMFDAAKGILYLHEN

SEQ ID NO: 2807530 - protein, 24 aa, Entamoeba invadens
VIKNGDAEGVAWFDAITVEPYTDF

SEQ ID NO: 2807531 - protein, 18 aa, Entamoeba invadens
VILFCFIAFTVLLFLCSA

SEQ ID NO: 2807532 - protein, 25 aa, Entamoeba invadens
VILKPRASRIVTCYMTIYCTTKLKG

SEQ ID NO: 2807533 - protein, 18 aa, Entamoeba invadens
VILLYRYFLFSVEYFSKT

SEQ ID NO: 2807534 - protein, 17 aa, Entamoeba invadens
VILRRYFFLQGVIYFIR

SEQ ID NO: 2807535 - protein, 22 aa, Entamoeba invadens
VILSVVCLNTGYGIDPMTKSLL

SEQ ID NO: 2807536 - protein, 19 aa, Entamoeba invadens
VILVCVFFASAAWFKHEKV

SEQ ID NO: 2807537 - protein, 24 aa, Entamoeba invadens
VIMLKKKFACEFSIYSKPKCTCQI

SEQ ID NO: 2807538 - protein, 19 aa, Entamoeba invadens
VIMSCVYTIVFLLVSGVIF

SEQ ID NO: 2807539 - protein, 22 aa, Entamoeba invadens
VIMTAVAILLYFRVITTSQAFA

SEQ ID NO: 2807540 - protein, 20 aa, Entamoeba invadens
VINASFITRVVICCMYAVSV

SEQ ID NO: 2807541 - protein, 23 aa, Entamoeba invadens
VINAVVCWYSYYNKLLLLKTFSK

SEQ ID NO: 2807542 - protein, 18 aa, Entamoeba invadens
VINFRLLFHSEYLFQLKQ

SEQ ID NO: 2807543 - protein, 19 aa, Entamoeba invadens
VINNGVLCRFCLALFHHSC

SEQ ID NO: 2807544 - protein, 17 aa, Entamoeba invadens
VINSFTMIWEVGECSVS

SEQ ID NO: 2807545 - protein, 25 aa, Entamoeba invadens
VINVSLLGFFVWKMLLFLFFILYEA

SEQ ID NO: 2807546 - protein, 23 aa, Entamoeba invadens
VIQGCTKCAVGYFVNSKICKSCD

SEQ ID NO: 2807547 - protein, 23 aa, Entamoeba invadens
VIQGCTKCAVGYFVNSKMCKSCD

SEQ ID NO: 2807548 - protein, 18 aa, Entamoeba invadens
VIQGVGLSMFWSPDETLI

SEQ ID NO: 2807549 - protein, 17 aa, Entamoeba invadens
VIQKCWKHNPIERLEVS

SEQ ID NO: 2807550 - protein, 24 aa, Entamoeba invadens
VIQLSEIVWCFGPLDGLVVSFFFY

SEQ ID NO: 2807551 - protein, 27 aa, Entamoeba invadens
VIRHHRLYHAYFRYFARYSVNDPRAAM

SEQ ID NO: 2807552 - protein, 24 aa, Entamoeba invadens
VISALPFMFLALFAIGKTTAYSNG

SEQ ID NO: 2807553 - protein, 23 aa, Entamoeba invadens
VISCSGIYPLLSINSFEANNTLQ

SEQ ID NO: 2807554 - protein, 24 aa, Entamoeba invadens
VISFFSIAISYTFANKEGLAQILE

SEQ ID NO: 2807555 - protein, 20 aa, Entamoeba invadens
VISKRCSRCLSPCTLCSGPG

SEQ ID NO: 2807556 - protein, 25 aa, Entamoeba invadens
VISKRIVKTKMVLPSGMQRSIVIGQ

SEQ ID NO: 2807557 - protein, 24 aa, Entamoeba invadens
VISKSGKCAIMLFSSTQQTCVKCR

SEQ ID NO: 2807558 - protein, 24 aa, Entamoeba invadens
VISTPRYGKDFLFQPKEGTTSTIG

SEQ ID NO: 2807559 - protein, 22 aa, Entamoeba invadens
VITCVHFPSIFILVFLLIPFTK

SEQ ID NO: 2807560 - protein, 29 aa, Entamoeba invadens
VITECIFRYALAFLIIRIFISLFTIIAII

SEQ ID NO: 2807561 - protein, 21 aa, Entamoeba invadens
VITGVCINPTLGFEYLVPTVI

SEQ ID NO: 2807562 - protein, 27 aa, Entamoeba invadens
VITIPLVLNCVLFVPTLNTYLIGSISQ

SEQ ID NO: 2807563 - protein, 26 aa, Entamoeba invadens
VITKDKIRCCPPPLVTRMHILSNESG

SEQ ID NO: 2807564 - protein, 31 aa, Entamoeba invadens
VITSFCFQMSIKWMFVLSLRLRNGLIAMIYA

SEQ ID NO: 2807565 - protein, 27 aa, Entamoeba invadens
VIVALIGAFCKLHFLVIPIFPCSIFFA

SEQ ID NO: 2807566 - protein, 17 aa, Entamoeba invadens
VIVALLIAYVVHVYIVR

SEQ ID NO: 2807567 - protein, 17 aa, Entamoeba invadens
VIVALLILTTVIILVVI

SEQ ID NO: 2807568 - protein, 18 aa, Entamoeba invadens
VIVEDSGFVSKAIRYQEG

SEQ ID NO: 2807569 - protein, 25 aa, Entamoeba invadens
VIVFVGCVIALVWITYQNRSTEKQN

SEQ ID NO: 2807570 - protein, 28 aa, Entamoeba invadens
VIVITCFLFLVSLCFGSNMGFERPVTTL

SEQ ID NO: 2807571 - protein, 18 aa, Entamoeba invadens
VIVVLAFLITFRKYKLAD

SEQ ID NO: 2807572 - protein, 17 aa, Entamoeba invadens
VIVVMCITKKSLEEKLW

SEQ ID NO: 2807573 - protein, 20 aa, Entamoeba invadens
VIYSCYRCNFTTLGDNKRLE

SEQ ID NO: 2807574 - protein, 21 aa, Entamoeba invadens
VIYSCYRCNFTTLGDNKRLEC

SEQ ID NO: 2807575 - protein, 19 aa, Entamoeba invadens
VIYVNGFLLLRVMFIKCSF

SEQ ID NO: 2807576 - protein, 18 aa, Entamoeba invadens
VKALKEKRTCLVTHEDLT

SEQ ID NO: 2807577 - protein, 25 aa, Entamoeba invadens
VKALLLKRKYLIVVLEQVTIVHKIS

SEQ ID NO: 2807578 - protein, 21 aa, Entamoeba invadens
VKAQGGCELLCAYNSNCLTGC

SEQ ID NO: 2807579 - protein, 33 aa, Entamoeba invadens
VKASGFKVSFEGGPLPWYMDKGLYFTNMSTTNS

SEQ ID NO: 2807580 - protein, 18 aa, Entamoeba invadens
VKATLTFDSLNVITKTFK

SEQ ID NO: 2807581 - protein, 22 aa, Entamoeba invadens
VKCANCLKCDKETCHICSTGYT

SEQ ID NO: 2807582 - protein, 17 aa, Entamoeba invadens
VKCAVEGCTTCVNGEPN

SEQ ID NO: 2807583 - protein, 25 aa, Entamoeba invadens
VKCKEGYKRVGALCVRLTDQRCQIG

SEQ ID NO: 2807584 - protein, 17 aa, Entamoeba invadens
VKCPSNCIGDYTCKDLE

SEQ ID NO: 2807585 - protein, 20 aa, Entamoeba invadens
VKCSETYSNCDICDLNNCQQ

SEQ ID NO: 2807586 - protein, 17 aa, Entamoeba invadens
VKCTHYWNKTYDNSEPS

SEQ ID NO: 2807587 - protein, 19 aa, Entamoeba invadens
VKCTNGYYRFEFQCEKCDP

SEQ ID NO: 2807588 - protein, 22 aa, Entamoeba invadens
VKCTNSAILQCDDFYYLTSNKT

SEQ ID NO: 2807589 - protein, 21 aa, Entamoeba invadens
VKCVAPGTGETLCVLKELRVI

SEQ ID NO: 2807590 - protein, 17 aa, Entamoeba invadens
VKDFIIFGIPLVFFSLV

SEQ ID NO: 2807591 - protein, 26 aa, Entamoeba invadens
VKDFILRLVSKLGEYFAYTDFENSMK

SEQ ID NO: 2807592 - protein, 21 aa, Entamoeba invadens
VKDGKCAPCTELKNCEICKGT

SEQ ID NO: 2807593 - protein, 23 aa, Entamoeba invadens
VKDIGKYCIQWCLNDFKNIRIDT

SEQ ID NO: 2807594 - protein, 18 aa, Entamoeba invadens
VKDKCPDNYFTVERTCKA

SEQ ID NO: 2807595 - protein, 21 aa, Entamoeba invadens
VKDSRCVRCTFWHAPREDGSG

SEQ ID NO: 2807596 - protein, 23 aa, Entamoeba invadens
VKECKSKFMWNDAIEQKIEILNF

SEQ ID NO: 2807597 - protein, 20 aa, Entamoeba invadens
VKELKAMREKREEMLKECEA

SEQ ID NO: 2807598 - protein, 20 aa, Entamoeba invadens
VKEMKIIGGKHHMKGEVRSE

SEQ ID NO: 2807599 - protein, 18 aa, Entamoeba invadens
VKEMSANLDVSRLSDTQM

SEQ ID NO: 2807600 - protein, 17 aa, Entamoeba invadens
VKESDWERKTCPCEGNE

SEQ ID NO: 2807601 - protein, 20 aa, Entamoeba invadens
VKESGCRVISVVATNMNVQP

SEQ ID NO: 2807602 - protein, 18 aa, Entamoeba invadens
VKESKCTQNSVSEIWGTK

SEQ ID NO: 2807603 - protein, 23 aa, Entamoeba invadens
VKFKSEFIVHFFGAVFVPNKVCM

SEQ ID NO: 2807604 - protein, 19 aa, Entamoeba invadens
VKFLNRISMLTVISAVIAS

SEQ ID NO: 2807605 - protein, 19 aa, Entamoeba invadens
VKFSRAIKKTVAVLVDVVD

SEQ ID NO: 2807606 - protein, 18 aa, Entamoeba invadens
VKFVLRKELDQMYEMEVN

SEQ ID NO: 2807607 - protein, 17 aa, Entamoeba invadens
VKGAGFVFKEACNGVIL

SEQ ID NO: 2807608 - protein, 28 aa, Entamoeba invadens
VKGFSIGCAIVLTTICSIFIFDAQIDLT

SEQ ID NO: 2807609 - protein, 23 aa, Entamoeba invadens
VKGGFIIKNSWGLVGHSIQYWMQ

SEQ ID NO: 2807610 - protein, 18 aa, Entamoeba invadens
VKGIFNLDECEFLKCKEG

SEQ ID NO: 2807611 - protein, 19 aa, Entamoeba invadens
VKGNITVTVVNNFPVTSFG

SEQ ID NO: 2807612 - protein, 22 aa, Entamoeba invadens
VKGSQVILVIDVLRRAGEDIQT

SEQ ID NO: 2807613 - protein, 18 aa, Entamoeba invadens
VKHLINPRSWFKRANSEI

SEQ ID NO: 2807614 - protein, 18 aa, Entamoeba invadens
VKHMFSIVHGLYLKYIPA

SEQ ID NO: 2807615 - protein, 23 aa, Entamoeba invadens
VKHPDVILTWSFLMVMMTIISLI

SEQ ID NO: 2807616 - protein, 23 aa, Entamoeba invadens
VKHPNMSTTIFKASVVEFESEKD

SEQ ID NO: 2807617 - protein, 17 aa, Entamoeba invadens
VKICVDGAKGISYLHEN

SEQ ID NO: 2807618 - protein, 17 aa, Entamoeba invadens
VKIEVFELVTFSFSTLT

SEQ ID NO: 2807619 - protein, 17 aa, Entamoeba invadens
VKIGFQLVVKNIEFTFC

SEQ ID NO: 2807620 - protein, 27 aa, Entamoeba invadens
VKIIGEYCFNRCIKLKNVIIPSSVRSI

SEQ ID NO: 2807621 - protein, 20 aa, Entamoeba invadens
VKIKAIFDKTLKVFSNTISF

SEQ ID NO: 2807622 - protein, 23 aa, Entamoeba invadens
VKILAELPISLATMQLPESNVVR

SEQ ID NO: 2807623 - protein, 19 aa, Entamoeba invadens
VKILDDMAVALSYLHQNMV

SEQ ID NO: 2807624 - protein, 18 aa, Entamoeba invadens
VKIPTLVFTPTFVYGTCL

SEQ ID NO: 2807625 - protein, 17 aa, Entamoeba invadens
VKISKKNKNVFERAMKE

SEQ ID NO: 2807626 - protein, 24 aa, Entamoeba invadens
VKIVASALLCLSIYASELKETLLP

SEQ ID NO: 2807627 - protein, 21 aa, Entamoeba invadens
VKIVFFFIEIRLVLCSMVGGL

SEQ ID NO: 2807628 - protein, 29 aa, Entamoeba invadens
VKIYAFIAADCFDIFGFREIHAGADSDII

SEQ ID NO: 2807629 - protein, 26 aa, Entamoeba invadens
VKKCILKVPLLTVMKGGNVQTEIDGE

SEQ ID NO: 2807630 - protein, 20 aa, Entamoeba invadens
VKKDECLSCKEGYFKISTES

SEQ ID NO: 2807631 - protein, 31 aa, Entamoeba invadens
VKKDQAHFLFKFAGTCGDSKRFMQWRLNDPN

SEQ ID NO: 2807632 - protein, 32 aa, Entamoeba invadens
VKKFPSGDGFFLQWMMCIGILIIGTFTMLIRA

SEQ ID NO: 2807633 - protein, 25 aa, Entamoeba invadens
VKKRHGRWTKFGSRAIAIFPPFILT

SEQ ID NO: 2807634 - protein, 22 aa, Entamoeba invadens
VKKRKTLLWILTYFLGCMTITK

SEQ ID NO: 2807635 - protein, 22 aa, Entamoeba invadens
VKKSKCTKCTFWHEASESGEYC

SEQ ID NO: 2807636 - protein, 23 aa, Entamoeba invadens
VKKSKCTKCTFWHEASESGEYCY

SEQ ID NO: 2807637 - protein, 21 aa, Entamoeba invadens
VKKSMPAYVIVAIVVSITLFF

SEQ ID NO: 2807638 - protein, 21 aa, Entamoeba invadens
VKKYTTLQFYMVFESKDNAPV

SEQ ID NO: 2807639 - protein, 26 aa, Entamoeba invadens
VKLFHFPLYFGLMCFTLEIALDVFHF

SEQ ID NO: 2807640 - protein, 17 aa, Entamoeba invadens
VKLLEIFTENKFVEKFK

SEQ ID NO: 2807641 - protein, 20 aa, Entamoeba invadens
VKLLSVNFYAPLTKLLDSLA

SEQ ID NO: 2807642 - protein, 18 aa, Entamoeba invadens
VKLLVLTFCELFKGTKIP

SEQ ID NO: 2807643 - protein, 17 aa, Entamoeba invadens
VKLSDYLSLIFTGVDES

SEQ ID NO: 2807644 - protein, 17 aa, Entamoeba invadens
VKLTELLLMNGADMFIE

SEQ ID NO: 2807645 - protein, 26 aa, Entamoeba invadens
VKLWGYRALSALLLYIFITFLTLFLC

SEQ ID NO: 2807646 - protein, 30 aa, Entamoeba invadens
VKMPTLHRISCFRDDLIFVAYLYQRKIYPV

SEQ ID NO: 2807647 - protein, 20 aa, Entamoeba invadens
VKMVFEFFSHFVLTSYFFEF

SEQ ID NO: 2807648 - protein, 25 aa, Entamoeba invadens
VKNDAFLFCFTHFAIVTALLFHDIM

SEQ ID NO: 2807649 - protein, 22 aa, Entamoeba invadens
VKNGMCLPCASGNFYNKTEKNC

SEQ ID NO: 2807650 - protein, 17 aa, Entamoeba invadens
VKNHWVKIQLDTFDVAN

SEQ ID NO: 2807651 - protein, 17 aa, Entamoeba invadens
VKNMFSILLREYKTIRG

SEQ ID NO: 2807652 - protein, 20 aa, Entamoeba invadens
VKPFTVCTWFSIQKFPEYKV

SEQ ID NO: 2807653 - protein, 18 aa, Entamoeba invadens
VKPKSRFNLLLLEPGEQY

SEQ ID NO: 2807654 - protein, 20 aa, Entamoeba invadens
VKPNALAIVGAVFIFISVFL

SEQ ID NO: 2807655 - protein, 20 aa, Entamoeba invadens
VKPSERGIGFYFGPDAVIDF

SEQ ID NO: 2807656 - protein, 17 aa, Entamoeba invadens
VKQCASFFQKGFPQDYE

SEQ ID NO: 2807657 - protein, 25 aa, Entamoeba invadens
VKQFGLILHELFIKITFTLDDLLGM

SEQ ID NO: 2807658 - protein, 24 aa, Entamoeba invadens
VKQFKFPWKIVEYVVSGERLPCLD

SEQ ID NO: 2807659 - protein, 24 aa, Entamoeba invadens
VKQFKFPWKIVEYVVSGERLPCLG

SEQ ID NO: 2807660 - protein, 25 aa, Entamoeba invadens
VKQILRFNKWWELFNPFAKQVDINQ

SEQ ID NO: 2807661 - protein, 21 aa, Entamoeba invadens
VKQNIEAFVYFKGYNSTEYSV

SEQ ID NO: 2807662 - protein, 17 aa, Entamoeba invadens
VKQRPKVLVNSEEGPVN

SEQ ID NO: 2807663 - protein, 20 aa, Entamoeba invadens
VKQSQCTKCEFWYTPRHKGT

SEQ ID NO: 2807664 - protein, 25 aa, Entamoeba invadens
VKQSVLLCEICNTKSLLKENDTATF

SEQ ID NO: 2807665 - protein, 21 aa, Entamoeba invadens
VKQYRIVAFALEIPANSMCSA

SEQ ID NO: 2807666 - protein, 30 aa, Entamoeba invadens
VKRHKHVFYRKQVCCGVCDMCMGAVVGNVI

SEQ ID NO: 2807667 - protein, 35 aa, Entamoeba invadens
VKRIAQSFVPEFLRLPVWMLLLGIDINESYTLYAE

SEQ ID NO: 2807668 - protein, 22 aa, Entamoeba invadens
VKRKPSLMTWLNISKETNLVDI

SEQ ID NO: 2807669 - protein, 17 aa, Entamoeba invadens
VKRMVKEFFGLAENEIK

SEQ ID NO: 2807670 - protein, 20 aa, Entamoeba invadens
VKRVVPISSSPGVDVQKKKN

SEQ ID NO: 2807671 - protein, 17 aa, Entamoeba invadens
VKRWREIQSGKQVSLET

SEQ ID NO: 2807672 - protein, 28 aa, Entamoeba invadens
VKSACNVANCFTCISWNDYFCLNCNINF

SEQ ID NO: 2807673 - protein, 24 aa, Entamoeba invadens
VKSFLTNYTYYFGFTEKKKTVITV

SEQ ID NO: 2807674 - protein, 18 aa, Entamoeba invadens
VKSGCFKYSIRSVPQLFT

SEQ ID NO: 2807675 - protein, 22 aa, Entamoeba invadens
VKSNFSSLCNSFFISETGIKEC

SEQ ID NO: 2807676 - protein, 22 aa, Entamoeba invadens
VKSNLPTIVLILRSIYFALKRK

SEQ ID NO: 2807677 - protein, 17 aa, Entamoeba invadens
VKSPRTLAIPNLASLLE

SEQ ID NO: 2807678 - protein, 22 aa, Entamoeba invadens
VKSSCGITCGFVLDDPNSLNPI

SEQ ID NO: 2807679 - protein, 18 aa, Entamoeba invadens
VKSTHPLPAGIKIGSVRT

SEQ ID NO: 2807680 - protein, 26 aa, Entamoeba invadens
VKTDEFFTLVWWRWTIFSFIATLFMI

SEQ ID NO: 2807681 - protein, 21 aa, Entamoeba invadens
VKTFLCSKDIMGLEKEDKARF

SEQ ID NO: 2807682 - protein, 20 aa, Entamoeba invadens
VKTILFRIVHNFLEDPDEFV

SEQ ID NO: 2807683 - protein, 20 aa, Entamoeba invadens
VKTKICLDSSKGILYLHENG

SEQ ID NO: 2807684 - protein, 18 aa, Entamoeba invadens
VKTLCDFWIEGDARLIIE

SEQ ID NO: 2807685 - protein, 17 aa, Entamoeba invadens
VKTLRCKDSQLSIGGGL

SEQ ID NO: 2807686 - protein, 25 aa, Entamoeba invadens
VKTQIKSGTFAFKEACYGVVLTDLP

SEQ ID NO: 2807687 - protein, 25 aa, Entamoeba invadens
VKTQLKSGTFSFKEACNGVVLTDLP

SEQ ID NO: 2807688 - protein, 26 aa, Entamoeba invadens
VKTQLKSGTFSFKEACNGVVLTDLPN

SEQ ID NO: 2807689 - protein, 18 aa, Entamoeba invadens
VKTVTCTLILNSYSNSSY

SEQ ID NO: 2807690 - protein, 17 aa, Entamoeba invadens
VKVDVLVGDKCREVSRY

SEQ ID NO: 2807691 - protein, 23 aa, Entamoeba invadens
VKVKETWPQGLLATGVIVTFATY

SEQ ID NO: 2807692 - protein, 19 aa, Entamoeba invadens
VKVLRTVTYSDLAFESSQI

SEQ ID NO: 2807693 - protein, 25 aa, Entamoeba invadens
VKVLSDWLQKSCLSLVVAYQRVLEV

SEQ ID NO: 2807694 - protein, 19 aa, Entamoeba invadens
VKVPLCMTPRKIVESETVE

SEQ ID NO: 2807695 - protein, 18 aa, Entamoeba invadens
VKVQFTFKKNEDRKFKMR

SEQ ID NO: 2807696 - protein, 32 aa, Entamoeba invadens
VKYCCAKIVDFWGIFFCCVFIAMAAFLENINI

SEQ ID NO: 2807697 - protein, 23 aa, Entamoeba invadens
VKYCHLDVSTGFYGLRYTPSEMK

SEQ ID NO: 2807698 - protein, 22 aa, Entamoeba invadens
VKYLCDMARGILYLHNNGIVHR

SEQ ID NO: 2807699 - protein, 17 aa, Entamoeba invadens
VKYPSLQYHQIYLTCSP

SEQ ID NO: 2807700 - protein, 19 aa, Entamoeba invadens
VLAAEAIAHCVLADRSVLK

SEQ ID NO: 2807701 - protein, 18 aa, Entamoeba invadens
VLAAVVFIIYSFCKTSKT

SEQ ID NO: 2807702 - protein, 27 aa, Entamoeba invadens
VLAPKRLGCTLEIITTIVIAFLVLLFL

SEQ ID NO: 2807703 - protein, 20 aa, Entamoeba invadens
VLARAVLLLHHMSFIEKVIP

SEQ ID NO: 2807704 - protein, 18 aa, Entamoeba invadens
VLATRWKVFLSCLPPQPE

SEQ ID NO: 2807705 - protein, 22 aa, Entamoeba invadens
VLAVLIATLLFFVCQKRGNNNF

SEQ ID NO: 2807706 - protein, 25 aa, Entamoeba invadens
VLCDNSSTCILCFTEFMLDVNNNCV

SEQ ID NO: 2807707 - protein, 26 aa, Entamoeba invadens
VLCLFVVALLVTWLFIKNGKMDWDDT

SEQ ID NO: 2807708 - protein, 23 aa, Entamoeba invadens
VLCLSLRPISRLHYLTSTSEHDL

SEQ ID NO: 2807709 - protein, 20 aa, Entamoeba invadens
VLCRFCLALFHHSCVTESNQ

SEQ ID NO: 2807710 - protein, 17 aa, Entamoeba invadens
VLCSESTEHCVACDQYT

SEQ ID NO: 2807711 - protein, 17 aa, Entamoeba invadens
VLCTLYGECRECISGHY

SEQ ID NO: 2807712 - protein, 19 aa, Entamoeba invadens
VLCVAFRKDLHKISFTEFI

SEQ ID NO: 2807713 - protein, 17 aa, Entamoeba invadens
VLDGMEFTFCCKKPGSE

SEQ ID NO: 2807714 - protein, 26 aa, Entamoeba invadens
VLDKGTCARLTVDLHKTIESETKEIR

SEQ ID NO: 2807715 - protein, 25 aa, Entamoeba invadens
VLDMYGCGLPVFARGYPALKTELVV

SEQ ID NO: 2807716 - protein, 30 aa, Entamoeba invadens
VLDQCYFPKMFPVLIPSFSLVEYFTKSEEL

SEQ ID NO: 2807717 - protein, 22 aa, Entamoeba invadens
VLDRRTCSFYKEIAECNEAVNS

SEQ ID NO: 2807718 - protein, 27 aa, Entamoeba invadens
VLDSVCIFLIYRISYIYSDGHANDIYD

SEQ ID NO: 2807719 - protein, 19 aa, Entamoeba invadens
VLDVLPISMQFNLLKDIKN

SEQ ID NO: 2807720 - protein, 31 aa, Entamoeba invadens
VLDYKIEILETFPAYYYRAVYYGKNDCNMTA

SEQ ID NO: 2807721 - protein, 29 aa, Entamoeba invadens
VLEAIKLLSVKTRVVVIWNSNIEELQYET

SEQ ID NO: 2807722 - protein, 23 aa, Entamoeba invadens
VLEKYEFVDHIILEIPETTPQDV

SEQ ID NO: 2807723 - protein, 24 aa, Entamoeba invadens
VLELIDLWFELCRTVQFQEFIGIV

SEQ ID NO: 2807724 - protein, 21 aa, Entamoeba invadens
VLFCGFCSAPESYSRAYKWLP

SEQ ID NO: 2807725 - protein, 18 aa, Entamoeba invadens
VLFFAGFILPLIWPIIVF

SEQ ID NO: 2807726 - protein, 17 aa, Entamoeba invadens
VLFGKDLLEKVYHASIV

SEQ ID NO: 2807727 - protein, 39 aa, Entamoeba invadens
VLFHGRECLYRNSLLIKLCFYKNIAMFFVLFYLAFLNNF

SEQ ID NO: 2807728 - protein, 26 aa, Entamoeba invadens
VLFIGLSKIQGHICIVTEFVPGDLDH

SEQ ID NO: 2807729 - protein, 20 aa, Entamoeba invadens
VLFIIELIFRTPATVFGGLF

SEQ ID NO: 2807730 - protein, 18 aa, Entamoeba invadens
VLFIISIFVIIIAMSIYF

SEQ ID NO: 2807731 - protein, 24 aa, Entamoeba invadens
VLFKMFGASMVNYFIQLFPILLGI

SEQ ID NO: 2807732 - protein, 25 aa, Entamoeba invadens
VLFLDPNVFILLAFSDDCQVLDDLD

SEQ ID NO: 2807733 - protein, 24 aa, Entamoeba invadens
VLFNLAFPCVIFRSLSNTRTLDIN

SEQ ID NO: 2807734 - protein, 23 aa, Entamoeba invadens
VLFPEFLIHIVLTFLFIPHMNWL

SEQ ID NO: 2807735 - protein, 25 aa, Entamoeba invadens
VLFSIFWFICCGYWNSVFQVFAQER

SEQ ID NO: 2807736 - protein, 24 aa, Entamoeba invadens
VLFTICVLFPFVVFVCFGVFSPDA

SEQ ID NO: 2807737 - protein, 17 aa, Entamoeba invadens
VLFTRSWMNKMQNQNFE

SEQ ID NO: 2807738 - protein, 18 aa, Entamoeba invadens
VLFTVEYQGSYSLLLNGK

SEQ ID NO: 2807739 - protein, 17 aa, Entamoeba invadens
VLFVFGSASFVFCTDYF

SEQ ID NO: 2807740 - protein, 21 aa, Entamoeba invadens
VLFVIVIVCAIIFAGLSTFLP

SEQ ID NO: 2807741 - protein, 21 aa, Entamoeba invadens
VLGCTLCPDGHFIENKKCSPC

SEQ ID NO: 2807742 - protein, 20 aa, Entamoeba invadens
VLGDICLKTSNYFDFVNGKS

SEQ ID NO: 2807743 - protein, 19 aa, Entamoeba invadens
VLGGVTFNRLLIRSKSVPT

SEQ ID NO: 2807744 - protein, 21 aa, Entamoeba invadens
VLGIICLVVLIVAYYIVNKKV

SEQ ID NO: 2807745 - protein, 28 aa, Entamoeba invadens
VLGKAVACFVMVWLAFVTMIIFLYVKYH

SEQ ID NO: 2807746 - protein, 18 aa, Entamoeba invadens
VLHKFILDMANGIFYLHN

SEQ ID NO: 2807747 - protein, 23 aa, Entamoeba invadens
VLHKRVVPWALHFLKCPQKDVYV

SEQ ID NO: 2807748 - protein, 22 aa, Entamoeba invadens
VLHPYASYVLVFKIMYGDNEQL

SEQ ID NO: 2807749 - protein, 25 aa, Entamoeba invadens
VLICDIHLYYVWKFYYGTELFPFWI

SEQ ID NO: 2807750 - protein, 19 aa, Entamoeba invadens
VLICVLFFKTKRTDLSVYK

SEQ ID NO: 2807751 - protein, 26 aa, Entamoeba invadens
VLICVNLALKLGFFFVVPEYFFSAAS

SEQ ID NO: 2807752 - protein, 18 aa, Entamoeba invadens
VLIDEAGVVVLQIKNYGT

SEQ ID NO: 2807753 - protein, 19 aa, Entamoeba invadens
VLIDVSVTSVFFCFADTFL

SEQ ID NO: 2807754 - protein, 18 aa, Entamoeba invadens
VLIFLCVVAIIILIPTIY

SEQ ID NO: 2807755 - protein, 20 aa, Entamoeba invadens
VLILRSIYFALKRKFGKKEV

SEQ ID NO: 2807756 - protein, 28 aa, Entamoeba invadens
VLILSPMLLCFLISFQLFFHKETLFYSS

SEQ ID NO: 2807757 - protein, 18 aa, Entamoeba invadens
VLIMSGTFNVDQFKPICS

SEQ ID NO: 2807758 - protein, 17 aa, Entamoeba invadens
VLINSLFPIKGGEIGST

SEQ ID NO: 2807759 - protein, 19 aa, Entamoeba invadens
VLIPLFVVTVCSNYIRQYL

SEQ ID NO: 2807760 - protein, 17 aa, Entamoeba invadens
VLISIAMVVIMTIVLIK

SEQ ID NO: 2807761 - protein, 19 aa, Entamoeba invadens
VLITFLIRFLSASAQSEIF

SEQ ID NO: 2807762 - protein, 23 aa, Entamoeba invadens
VLKELPMRFIHFALQAKSVICCR

SEQ ID NO: 2807763 - protein, 17 aa, Entamoeba invadens
VLKRLGYSFKILSGTLI

SEQ ID NO: 2807764 - protein, 23 aa, Entamoeba invadens
VLKRMFWGLIPFFGNFFKQTETN

SEQ ID NO: 2807765 - protein, 18 aa, Entamoeba invadens
VLKSFSFNTIEEYISIYN

SEQ ID NO: 2807766 - protein, 17 aa, Entamoeba invadens
VLKSIGPNYDCLVIETI

SEQ ID NO: 2807767 - protein, 18 aa, Entamoeba invadens
VLKTTLLNVLKQVSSNFQ

SEQ ID NO: 2807768 - protein, 20 aa, Entamoeba invadens
VLLCVFVFGGISVMMAFSVW

SEQ ID NO: 2807769 - protein, 31 aa, Entamoeba invadens
VLLEYFHVIFVLRKQFFEKLGMSEEYDTLYR

SEQ ID NO: 2807770 - protein, 18 aa, Entamoeba invadens
VLLFFSLRYKKVDINIYK

SEQ ID NO: 2807771 - protein, 17 aa, Entamoeba invadens
VLLFVCLPFSFRREEQP

SEQ ID NO: 2807772 - protein, 17 aa, Entamoeba invadens
VLLGRVPALAALYRMNQ

SEQ ID NO: 2807773 - protein, 26 aa, Entamoeba invadens
VLLIICILGSFVAFSFAVPHYTYNKD

SEQ ID NO: 2807774 - protein, 35 aa, Entamoeba invadens
VLLIKKPEAFPLMFSTGASVSWPEGTIKIVVDPSL

SEQ ID NO: 2807775 - protein, 19 aa, Entamoeba invadens
VLLLLCISGSVSYTCLTNL

SEQ ID NO: 2807776 - protein, 19 aa, Entamoeba invadens
VLLMCIGFHQIMFKHSTTK

SEQ ID NO: 2807777 - protein, 25 aa, Entamoeba invadens
VLLSIFILICIVFVTYFIVQKTIKL

SEQ ID NO: 2807778 - protein, 17 aa, Entamoeba invadens
VLLYRGCENEVREFVWK

SEQ ID NO: 2807779 - protein, 24 aa, Entamoeba invadens
VLMCTIFSREWIKVSGSASVDVKK

SEQ ID NO: 2807780 - protein, 23 aa, Entamoeba invadens
VLMFKCLLLSPLSIYTILIPEFV

SEQ ID NO: 2807781 - protein, 25 aa, Entamoeba invadens
VLMWLCLAGRICALYYYNSYLTLWG

SEQ ID NO: 2807782 - protein, 36 aa, Entamoeba invadens
VLNEILMSLPLLKPHRRCALLYALSYFKKTKMCGEG

SEQ ID NO: 2807783 - protein, 24 aa, Entamoeba invadens
VLNGGKCQLCPSGKYYNLNSKSCL

SEQ ID NO: 2807784 - protein, 17 aa, Entamoeba invadens
VLNNFLFYDFIVNCYFL

SEQ ID NO: 2807785 - protein, 24 aa, Entamoeba invadens
VLNSKCSKCAFWHSPNITGTLCDK

SEQ ID NO: 2807786 - protein, 24 aa, Entamoeba invadens
VLNSKCSKCSFWHSPNITGTLCNK

SEQ ID NO: 2807787 - protein, 24 aa, Entamoeba invadens
VLNSKCSKCTFWHSPNKSGTTCNK

SEQ ID NO: 2807788 - protein, 26 aa, Entamoeba invadens
VLPFELKMKMLLDIAKGMHFLHYNNM

SEQ ID NO: 2807789 - protein, 22 aa, Entamoeba invadens
VLPFEYLTNFLIVSNGRLIRYC

SEQ ID NO: 2807790 - protein, 17 aa, Entamoeba invadens
VLPNIYINVDITFPNMK

SEQ ID NO: 2807791 - protein, 22 aa, Entamoeba invadens
VLQLILFVLHGWVIYNPNLKEV

SEQ ID NO: 2807792 - protein, 17 aa, Entamoeba invadens
VLQSIVLASFENIPTPT

SEQ ID NO: 2807793 - protein, 25 aa, Entamoeba invadens
VLRFKKTLRKCCCCVIPYHLKTIDI

SEQ ID NO: 2807794 - protein, 22 aa, Entamoeba invadens
VLSLPIFFAIFLLQCVLPTAVI

SEQ ID NO: 2807795 - protein, 22 aa, Entamoeba invadens
VLSLRPEHEINRVVNAIDSIFD

SEQ ID NO: 2807796 - protein, 26 aa, Entamoeba invadens
VLSRKSKELLTRFVGNVSLYLFFFTM

SEQ ID NO: 2807797 - protein, 17 aa, Entamoeba invadens
VLSSGTGCASCFDGSYR

SEQ ID NO: 2807798 - protein, 18 aa, Entamoeba invadens
VLSSIAIPNCFLGNREDF

SEQ ID NO: 2807799 - protein, 20 aa, Entamoeba invadens
VLSTIFAFTFVKGLWKVPYI

SEQ ID NO: 2807800 - protein, 19 aa, Entamoeba invadens
VLTEFRYYLQREVTPQLIV

SEQ ID NO: 2807801 - protein, 25 aa, Entamoeba invadens
VLTELFKFLPVCDLSIREEVIVKIC

SEQ ID NO: 2807802 - protein, 18 aa, Entamoeba invadens
VLTFWRFFCFSLMALTCL

SEQ ID NO: 2807803 - protein, 17 aa, Entamoeba invadens
VLTKMWGQKGNDRIDIS

SEQ ID NO: 2807804 - protein, 21 aa, Entamoeba invadens
VLTLIKCLMKLSDISESDTCI

SEQ ID NO: 2807805 - protein, 20 aa, Entamoeba invadens
VLTLPVNYSNVFGRFEYLVT

SEQ ID NO: 2807806 - protein, 19 aa, Entamoeba invadens
VLTPEEFVRAGDFLVDKYR

SEQ ID NO: 2807807 - protein, 20 aa, Entamoeba invadens
VLTPEHFVALAMKHVGLTNF

SEQ ID NO: 2807808 - protein, 20 aa, Entamoeba invadens
VLTQYAFYFIPYVEENIATK

SEQ ID NO: 2807809 - protein, 24 aa, Entamoeba invadens
VLTSGCWTLFAGVIVYTVASLFIT

SEQ ID NO: 2807810 - protein, 24 aa, Entamoeba invadens
VLTVHPKPLFAIRRVMDKVLLHYS

SEQ ID NO: 2807811 - protein, 18 aa, Entamoeba invadens
VLVAFCYQVLKDGKMKYI

SEQ ID NO: 2807812 - protein, 19 aa, Entamoeba invadens
VLVEKDWLAFGHQFNQRLG

SEQ ID NO: 2807813 - protein, 17 aa, Entamoeba invadens
VLVEPKCTCRINDVISI

SEQ ID NO: 2807814 - protein, 18 aa, Entamoeba invadens
VLVFEMFCGNISKMFKSS

SEQ ID NO: 2807815 - protein, 22 aa, Entamoeba invadens
VLVKSMCLPFNMIAECKAARNS

SEQ ID NO: 2807816 - protein, 17 aa, Entamoeba invadens
VLVPLLLLIPASCSNKY

SEQ ID NO: 2807817 - protein, 31 aa, Entamoeba invadens
VLVRKICVYCDFKYEKCCLYIDTYNDKGVIF

SEQ ID NO: 2807818 - protein, 18 aa, Entamoeba invadens
VLVSSQIRARVCDFYTSV

SEQ ID NO: 2807819 - protein, 20 aa, Entamoeba invadens
VLVVVIFMRQFKRRQIDFKK

SEQ ID NO: 2807820 - protein, 23 aa, Entamoeba invadens
VLVWKSLYIHLNYNFDYNKNFII

SEQ ID NO: 2807821 - protein, 28 aa, Entamoeba invadens
VLWCNTFAGLILRIFNMLFLYKIPIKIR

SEQ ID NO: 2807822 - protein, 23 aa, Entamoeba invadens
VLWRLKNLKKFRIFLKDLNSIEM

SEQ ID NO: 2807823 - protein, 20 aa, Entamoeba invadens
VLYDPKRLLGLSLEEIPEDE

SEQ ID NO: 2807824 - protein, 17 aa, Entamoeba invadens
VLYELKVIDELSRPLYK

SEQ ID NO: 2807825 - protein, 24 aa, Entamoeba invadens
VLYFLNRFTYFRIFVTELIGTFLL

SEQ ID NO: 2807826 - protein, 18 aa, Entamoeba invadens
VLYIPPHRKGVITLFATL

SEQ ID NO: 2807827 - protein, 23 aa, Entamoeba invadens
VLYIRPRMASTYTITCYMTIHCT

SEQ ID NO: 2807828 - protein, 24 aa, Entamoeba invadens
VLYIRPRMASTYTMTCYMTIHCTT

SEQ ID NO: 2807829 - protein, 36 aa, Entamoeba invadens
VLYLLRQRIKVLPSFPCTCSRCLEKKAKLTRRRNRL

SEQ ID NO: 2807830 - protein, 24 aa, Entamoeba invadens
VLYPHPWCIADDVAVGKRPKTVDR

SEQ ID NO: 2807831 - protein, 19 aa, Entamoeba invadens
VLYRENLKYFIEIAKKFKP

SEQ ID NO: 2807832 - protein, 23 aa, Entamoeba invadens
VLYRENLKYFIEIAKKFKPTLVV

SEQ ID NO: 2807833 - protein, 18 aa, Entamoeba invadens
VLYRKLVEQCWKQNGCER

SEQ ID NO: 2807834 - protein, 23 aa, Entamoeba invadens
VLYSICIAMVFVVYLITQILILK

SEQ ID NO: 2807835 - protein, 25 aa, Entamoeba invadens
VMAADFKGQCVIFDYKNKEHIVKRI

SEQ ID NO: 2807836 - protein, 24 aa, Entamoeba invadens
VMAGELEFACPATATNNAYIVGSD

SEQ ID NO: 2807837 - protein, 19 aa, Entamoeba invadens
VMAKALIIAFFTLRESKSN

SEQ ID NO: 2807838 - protein, 21 aa, Entamoeba invadens
VMAPKAGSITTNFVKVNDVQN

SEQ ID NO: 2807839 - protein, 24 aa, Entamoeba invadens
VMAYSNLFAVPTFLVISLVTGDLA

SEQ ID NO: 2807840 - protein, 18 aa, Entamoeba invadens
VMCESGFNLSNGICEPVD

SEQ ID NO: 2807841 - protein, 19 aa, Entamoeba invadens
VMCHSEYRLVNGVCSELDQ

SEQ ID NO: 2807842 - protein, 19 aa, Entamoeba invadens
VMFEIFHWGNPYSKDKFPF

SEQ ID NO: 2807843 - protein, 18 aa, Entamoeba invadens
VMFFYDIFWVFGSVLVPV

SEQ ID NO: 2807844 - protein, 23 aa, Entamoeba invadens
VMFTIFCSITLGLFYGTVVLRGD

SEQ ID NO: 2807845 - protein, 17 aa, Entamoeba invadens
VMGEGYCNGSLYKVLKV

SEQ ID NO: 2807846 - protein, 28 aa, Entamoeba invadens
VMIASIFFYWFFPHEFKLHDAVQGLFAN

SEQ ID NO: 2807847 - protein, 24 aa, Entamoeba invadens
VMITASFRFCMYLQQQKKVFDEYL

SEQ ID NO: 2807848 - protein, 23 aa, Entamoeba invadens
VMKDGRCVLLAFEKNYDKFLKSL

SEQ ID NO: 2807849 - protein, 23 aa, Entamoeba invadens
VMKEKRKIWTFIEVSMRTSDVDE

SEQ ID NO: 2807850 - protein, 19 aa, Entamoeba invadens
VMLCGNWGVDISFVERSIT

SEQ ID NO: 2807851 - protein, 32 aa, Entamoeba invadens
VMLDKKFRMLEAFPVKDLELIGVMQSDKSNKA

SEQ ID NO: 2807852 - protein, 25 aa, Entamoeba invadens
VMLKKKFACEFSIYLKPECTCRINN

SEQ ID NO: 2807853 - protein, 18 aa, Entamoeba invadens
VMLLPKPLVVEVGQSKTY

SEQ ID NO: 2807854 - protein, 25 aa, Entamoeba invadens
VMLSDLIIGVGMVFVWTVQSEYASV

SEQ ID NO: 2807855 - protein, 17 aa, Entamoeba invadens
VMLYFGFSVFSLLTKKV

SEQ ID NO: 2807856 - protein, 26 aa, Entamoeba invadens
VMMMKKGLKYAKKQICLTNFEFLAPY

SEQ ID NO: 2807857 - protein, 17 aa, Entamoeba invadens
VMMSCLFFFVASFVRSN

SEQ ID NO: 2807858 - protein, 18 aa, Entamoeba invadens
VMMYEVFDQTKPYKTDQF

SEQ ID NO: 2807859 - protein, 26 aa, Entamoeba invadens
VMNMKDFPSNMVFVFLFNDLLIETKV

SEQ ID NO: 2807860 - protein, 17 aa, Entamoeba invadens
VMNVLRTNTDMVMAILD

SEQ ID NO: 2807861 - protein, 17 aa, Entamoeba invadens
VMRNLCFDIVPNIDEKS

SEQ ID NO: 2807862 - protein, 24 aa, Entamoeba invadens
VMSKRPIHYFWYYINSIVFHCFVT

SEQ ID NO: 2807863 - protein, 22 aa, Entamoeba invadens
VMSLLQRLLRKFPLNCSERGFY

SEQ ID NO: 2807864 - protein, 26 aa, Entamoeba invadens
VMSSKAKVVGVCKFIEKMILEGTKFL

SEQ ID NO: 2807865 - protein, 21 aa, Entamoeba invadens
VMTALLCLSGILTFLLSIVSM

SEQ ID NO: 2807866 - protein, 26 aa, Entamoeba invadens
VMTSGMPLVKSCVKILMQSAPHDFSI

SEQ ID NO: 2807867 - protein, 17 aa, Entamoeba invadens
VMTTMYSFFDFIGDVLG

SEQ ID NO: 2807868 - protein, 18 aa, Entamoeba invadens
VMVEYRFVTPVISNYAQN

SEQ ID NO: 2807869 - protein, 25 aa, Entamoeba invadens
VMVGPSQRPIVCMVAGFMNLKVNNT

SEQ ID NO: 2807870 - protein, 20 aa, Entamoeba invadens
VMVNWRCVYCDQNYFYYPSD

SEQ ID NO: 2807871 - protein, 23 aa, Entamoeba invadens
VMVRCLFGTILYQLMDILMNNGD

SEQ ID NO: 2807872 - protein, 20 aa, Entamoeba invadens
VMWVVNCFMVSLDIPIGVYR

SEQ ID NO: 2807873 - protein, 19 aa, Entamoeba invadens
VNAAPVLISPRPLEWIHNN

SEQ ID NO: 2807874 - protein, 24 aa, Entamoeba invadens
VNAECIRKGASFLNLYQNNYDMLV

SEQ ID NO: 2807875 - protein, 17 aa, Entamoeba invadens
VNAKICDFVNSIYLKEE

SEQ ID NO: 2807876 - protein, 25 aa, Entamoeba invadens
VNASNEWNTLVFWETIMNYLKPNSI

SEQ ID NO: 2807877 - protein, 24 aa, Entamoeba invadens
VNATYAINCAKNYFMLKMGVCLFG

SEQ ID NO: 2807878 - protein, 30 aa, Entamoeba invadens
VNCAGYVLGACRMCSEGTYLSAGECGENCN

SEQ ID NO: 2807879 - protein, 17 aa, Entamoeba invadens
VNCEVCEDGYAFMDNGT

SEQ ID NO: 2807880 - protein, 24 aa, Entamoeba invadens
VNCGTELIVGFNICRTKKDGCYNM

SEQ ID NO: 2807881 - protein, 29 aa, Entamoeba invadens
VNCKKCVVGGVRMCYRCEMGYYPISNGSC

SEQ ID NO: 2807882 - protein, 21 aa, Entamoeba invadens
VNCKLKLSNKFNWFDMFNNDL

SEQ ID NO: 2807883 - protein, 23 aa, Entamoeba invadens
VNCKLKLSNKFNWFDMFNNDLSG

SEQ ID NO: 2807884 - protein, 27 aa, Entamoeba invadens
VNCMTCKNSECIICHDNYYLGNDGICH

SEQ ID NO: 2807885 - protein, 22 aa, Entamoeba invadens
VNDPRAAMNMLHKVKRIAQSFV

SEQ ID NO: 2807886 - protein, 24 aa, Entamoeba invadens
VNDYSTKIADGFYRISSTTNTVTP

SEQ ID NO: 2807887 - protein, 17 aa, Entamoeba invadens
VNEGISLVLKRVFNCER

SEQ ID NO: 2807888 - protein, 23 aa, Entamoeba invadens
VNEILCGGIMKILGNLFSVKTRK

SEQ ID NO: 2807889 - protein, 20 aa, Entamoeba invadens
VNEKCLLKCDPFTTERYGEE

SEQ ID NO: 2807890 - protein, 21 aa, Entamoeba invadens
VNEMNRICFDSCISALHELHK

SEQ ID NO: 2807891 - protein, 22 aa, Entamoeba invadens
VNEPILRMYAMQSIILNGVMMY

SEQ ID NO: 2807892 - protein, 25 aa, Entamoeba invadens
VNETLKVYRPLVIEVTKIRFNIYPE

SEQ ID NO: 2807893 - protein, 19 aa, Entamoeba invadens
VNFEEIFQLLNRMHKLFKS

SEQ ID NO: 2807894 - protein, 17 aa, Entamoeba invadens
VNFKGNYSLMVDSTRVN

SEQ ID NO: 2807895 - protein, 24 aa, Entamoeba invadens
VNGCTQCLDGFYIATPFCLSCQEN

SEQ ID NO: 2807896 - protein, 23 aa, Entamoeba invadens
VNGECVMPIGILLTNMKKAIICL

SEQ ID NO: 2807897 - protein, 23 aa, Entamoeba invadens
VNGECVMPIGILLTNMKKAIVCL

SEQ ID NO: 2807898 - protein, 24 aa, Entamoeba invadens
VNGIYRFSLLPSFSQMRFSSVEKK

SEQ ID NO: 2807899 - protein, 21 aa, Entamoeba invadens
VNGKCIFPNEIDSVIVEPQKF

SEQ ID NO: 2807900 - protein, 24 aa, Entamoeba invadens
VNGNCLRCKVGFYLEDGNCERCVK

SEQ ID NO: 2807901 - protein, 22 aa, Entamoeba invadens
VNGRGCYSCKSGYYREKLDCEP

SEQ ID NO: 2807902 - protein, 17 aa, Entamoeba invadens
VNGSIETYGKMSFLGQC

SEQ ID NO: 2807903 - protein, 23 aa, Entamoeba invadens
VNHCVPPELFLKQTQNSAAEETE

SEQ ID NO: 2807904 - protein, 17 aa, Entamoeba invadens
VNIKLYDLCMKQFVSDV

SEQ ID NO: 2807905 - protein, 23 aa, Entamoeba invadens
VNILTRYILLFSYFPINETIDVY

SEQ ID NO: 2807906 - protein, 20 aa, Entamoeba invadens
VNIRAFVFLMALIRSSKIDP

SEQ ID NO: 2807907 - protein, 18 aa, Entamoeba invadens
VNITSSLCISCIDEYQKV

SEQ ID NO: 2807908 - protein, 19 aa, Entamoeba invadens
VNKCYECKDKTYLKEDLFE

SEQ ID NO: 2807909 - protein, 22 aa, Entamoeba invadens
VNKEIKNLFSIGNTTPHHVKIQ

SEQ ID NO: 2807910 - protein, 18 aa, Entamoeba invadens
VNKIRCGNRVIVTGGNDK

SEQ ID NO: 2807911 - protein, 18 aa, Entamoeba invadens
VNKKCVMCESGFNLSNGI

SEQ ID NO: 2807912 - protein, 21 aa, Entamoeba invadens
VNKYSCLIWKDLIGTSQKVAT

SEQ ID NO: 2807913 - protein, 19 aa, Entamoeba invadens
VNLDHCKTVVLGMSVCAVC

SEQ ID NO: 2807914 - protein, 24 aa, Entamoeba invadens
VNLHNPILMKLRIKFMSDSAKGIE

SEQ ID NO: 2807915 - protein, 17 aa, Entamoeba invadens
VNLKITIETTIKCEILN

SEQ ID NO: 2807916 - protein, 23 aa, Entamoeba invadens
VNLRGESFWAEFQLFKKCVEYGI

SEQ ID NO: 2807917 - protein, 17 aa, Entamoeba invadens
VNLSCLRSWEGRRIGVL

SEQ ID NO: 2807918 - protein, 18 aa, Entamoeba invadens
VNLSFLFDLTEGYVMEIS

SEQ ID NO: 2807919 - protein, 29 aa, Entamoeba invadens
VNLYKRSSLIVSMHLLRTFFITLDPPLIP

SEQ ID NO: 2807920 - protein, 24 aa, Entamoeba invadens
VNMKCNEFTIPILVKSTTVSVSKQ

SEQ ID NO: 2807921 - protein, 17 aa, Entamoeba invadens
VNMKFRVKLMLDASKGI

SEQ ID NO: 2807922 - protein, 25 aa, Entamoeba invadens
VNMKLRVKFMLDCSKGINGFRKICP

SEQ ID NO: 2807923 - protein, 24 aa, Entamoeba invadens
VNMLDKFRCGYIVHFYGAVFIPNK

SEQ ID NO: 2807924 - protein, 24 aa, Entamoeba invadens
VNNELEMARAIALNAKGIITDRPD

SEQ ID NO: 2807925 - protein, 23 aa, Entamoeba invadens
VNNKCIKCWDLFDNCGVCNQTEK

SEQ ID NO: 2807926 - protein, 17 aa, Entamoeba invadens
VNNKILFENGLCFDISF

SEQ ID NO: 2807927 - protein, 23 aa, Entamoeba invadens
VNNKTCQLCRSFDPNCDVCGDRN

SEQ ID NO: 2807928 - protein, 23 aa, Entamoeba invadens
VNNRTCQLCRSFDPNCDVCGDNK

SEQ ID NO: 2807929 - protein, 18 aa, Entamoeba invadens
VNNVIYFDGFITDECNQE

SEQ ID NO: 2807930 - protein, 24 aa, Entamoeba invadens
VNQFWNFAASLAISATFVSTLHVI

SEQ ID NO: 2807931 - protein, 26 aa, Entamoeba invadens
VNRCRKCDNGYILKEMKCVTVDNCVD

SEQ ID NO: 2807932 - protein, 17 aa, Entamoeba invadens
VNRLCCCDVPVPGMKKL

SEQ ID NO: 2807933 - protein, 22 aa, Entamoeba invadens
VNRRLARCQIVVLSRRSTPNVL

SEQ ID NO: 2807934 - protein, 36 aa, Entamoeba invadens
VNRVWPKEIAPLCAWRIVYLLSMCIALLYSAFISRT

SEQ ID NO: 2807935 - protein, 19 aa, Entamoeba invadens
VNSCFKCLKNYVLINKKCY

SEQ ID NO: 2807936 - protein, 21 aa, Entamoeba invadens
VNSKCSKCSFWYIPESSGTSC

SEQ ID NO: 2807937 - protein, 20 aa, Entamoeba invadens
VNSLDFNSACTIKITDFGTS

SEQ ID NO: 2807938 - protein, 21 aa, Entamoeba invadens
VNSLDFNSACTIKITDFGTSR

SEQ ID NO: 2807939 - protein, 17 aa, Entamoeba invadens
VNSLKFTYSQDITSALL

SEQ ID NO: 2807940 - protein, 26 aa, Entamoeba invadens
VNSLNEFKALLGLIALGADSYYLSLE

SEQ ID NO: 2807941 - protein, 24 aa, Entamoeba invadens
VNSNKFKFSIGFVNTGYSVTDRSF

SEQ ID NO: 2807942 - protein, 27 aa, Entamoeba invadens
VNSPFEIVDFIPFDVSIKMNGAESPFI

SEQ ID NO: 2807943 - protein, 22 aa, Entamoeba invadens
VNSRIGVLLYFMALLPDSLIPK

SEQ ID NO: 2807944 - protein, 19 aa, Entamoeba invadens
VNTFPDCRYNSSLFDLNLT

SEQ ID NO: 2807945 - protein, 18 aa, Entamoeba invadens
VNTFYDVEAAFSCIDSVI

SEQ ID NO: 2807946 - protein, 17 aa, Entamoeba invadens
VNTKLPVTWTHGVFNKV

SEQ ID NO: 2807947 - protein, 24 aa, Entamoeba invadens
VNTSCFVLCFSLVYLDSYKNLKTR

SEQ ID NO: 2807948 - protein, 17 aa, Entamoeba invadens
VNTSLLCISGWLGYFLR

SEQ ID NO: 2807949 - protein, 29 aa, Entamoeba invadens
VNTVWVLQCYVCVYSFFISDMTTKSFEIS

SEQ ID NO: 2807950 - protein, 17 aa, Entamoeba invadens
VNVIGDWSLISCGEEKA

SEQ ID NO: 2807951 - protein, 19 aa, Entamoeba invadens
VNVTNSLCEQCDFWHNKRD

SEQ ID NO: 2807952 - protein, 19 aa, Entamoeba invadens
VNVVEAWPYTDAGCTRFPE

SEQ ID NO: 2807953 - protein, 21 aa, Entamoeba invadens
VNWGVLFLGWLAYTSFAMVNN

SEQ ID NO: 2807954 - protein, 21 aa, Entamoeba invadens
VNWWNKIPFIRNISVTLFMII

SEQ ID NO: 2807955 - protein, 22 aa, Entamoeba invadens
VNYFPYDFFSPMTTLTYFDVSR

SEQ ID NO: 2807956 - protein, 25 aa, Entamoeba invadens
VNYGSCFLLSWLCGFINDQIAGWIL

SEQ ID NO: 2807957 - protein, 19 aa, Entamoeba invadens
VNYICKRCDLNVANCLLCS

SEQ ID NO: 2807958 - protein, 22 aa, Entamoeba invadens
VNYITPCASFIYPQTLQTYTKV

SEQ ID NO: 2807959 - protein, 27 aa, Entamoeba invadens
VNYLKLYGYSCCPCFIPPPCSPANSHR

SEQ ID NO: 2807960 - protein, 19 aa, Entamoeba invadens
VPAFCDFLGGYLMNVGLLY

SEQ ID NO: 2807961 - protein, 26 aa, Entamoeba invadens
VPALKAAHIGLAMGIRGTDVAKRVSD

SEQ ID NO: 2807962 - protein, 21 aa, Entamoeba invadens
VPATDGYCWTYKCDSNSGYCI

SEQ ID NO: 2807963 - protein, 17 aa, Entamoeba invadens
VPDGGRCVYCWDKHPHC

SEQ ID NO: 2807964 - protein, 22 aa, Entamoeba invadens
VPDGGRCVYCWDKHPHCAECDS

SEQ ID NO: 2807965 - protein, 20 aa, Entamoeba invadens
VPDIFQFFVGTIFIFSSGSM

SEQ ID NO: 2807966 - protein, 27 aa, Entamoeba invadens
VPDLQYGLLVLFAFWFFHGIIDTITGV

SEQ ID NO: 2807967 - protein, 18 aa, Entamoeba invadens
VPDLVVLKKGEGCEFNIC

SEQ ID NO: 2807968 - protein, 25 aa, Entamoeba invadens
VPDYYWKLLTSCWSQKEEDRPDIDA

SEQ ID NO: 2807969 - protein, 18 aa, Entamoeba invadens
VPELVWKGKVVFNSQTTM

SEQ ID NO: 2807970 - protein, 24 aa, Entamoeba invadens
VPELVWKGSVTFTEQGTMVYYDCG

SEQ ID NO: 2807971 - protein, 19 aa, Entamoeba invadens
VPFFGTDFISIFPSVSVIV

SEQ ID NO: 2807972 - protein, 19 aa, Entamoeba invadens
VPFSIQFTGNYSLLLNATQ

SEQ ID NO: 2807973 - protein, 18 aa, Entamoeba invadens
VPGFPVIVEDSGFVSKAI

SEQ ID NO: 2807974 - protein, 20 aa, Entamoeba invadens
VPIALLVMLKCRSVIGQLVK

SEQ ID NO: 2807975 - protein, 25 aa, Entamoeba invadens
VPISPYCRDGYKINGITAIEKYGCG

SEQ ID NO: 2807976 - protein, 23 aa, Entamoeba invadens
VPITLRYGKLQNIIKEIKKENPD

SEQ ID NO: 2807977 - protein, 20 aa, Entamoeba invadens
VPKNTMRYILKCNSEDGPLS

SEQ ID NO: 2807978 - protein, 21 aa, Entamoeba invadens
VPKRICLVTEFADFGSLQDLM

SEQ ID NO: 2807979 - protein, 22 aa, Entamoeba invadens
VPKSNIGMGVWAFPDNIRIYQK

SEQ ID NO: 2807980 - protein, 25 aa, Entamoeba invadens
VPKTGYCQGMSFLAGQILLITDIPE

SEQ ID NO: 2807981 - protein, 21 aa, Entamoeba invadens
VPKTRIVGNEGFVVRKMSCYE

SEQ ID NO: 2807982 - protein, 25 aa, Entamoeba invadens
VPKVHYQWRCGYIQYVSTIVVTDFI

SEQ ID NO: 2807983 - protein, 22 aa, Entamoeba invadens
VPLCIIMFAALFRELREDIRRY

SEQ ID NO: 2807984 - protein, 24 aa, Entamoeba invadens
VPLNCLFGVLIQIGYIIKMLAGFG

SEQ ID NO: 2807985 - protein, 19 aa, Entamoeba invadens
VPLSMTFVIIVFIVAIIII

SEQ ID NO: 2807986 - protein, 25 aa, Entamoeba invadens
VPLVCLPIICGLSLDYDIFLFSRIK

SEQ ID NO: 2807987 - protein, 18 aa, Entamoeba invadens
VPLYRIPFIPSLFAQNYF

SEQ ID NO: 2807988 - protein, 19 aa, Entamoeba invadens
VPMCTTCYSPYVLASQSKT

SEQ ID NO: 2807989 - protein, 18 aa, Entamoeba invadens
VPNFKFPRLTWVVEDYHQ

SEQ ID NO: 2807990 - protein, 24 aa, Entamoeba invadens
VPNKGCILKTCGNGLVEGDEICDG

SEQ ID NO: 2807991 - protein, 26 aa, Entamoeba invadens
VPNTQRKICKSFLKSDSSCRSQSQLC

SEQ ID NO: 2807992 - protein, 17 aa, Entamoeba invadens
VPNTVRLRKDEACEFEV

SEQ ID NO: 2807993 - protein, 21 aa, Entamoeba invadens
VPPKLEKRVYKGVPVSFKRMY

SEQ ID NO: 2807994 - protein, 27 aa, Entamoeba invadens
VPPVRAECAYSFLPYDVVKRYMQLNPF

SEQ ID NO: 2807995 - protein, 18 aa, Entamoeba invadens
VPQFTRTLGIIMAKNLTI

SEQ ID NO: 2807996 - protein, 21 aa, Entamoeba invadens
VPQIMAEFMKNIQFLKMESTY

SEQ ID NO: 2807997 - protein, 17 aa, Entamoeba invadens
VPSESGTFCNTKAVWWV

SEQ ID NO: 2807998 - protein, 24 aa, Entamoeba invadens
VPSGCYKRAYNLIQYCTQKIYGCY

SEQ ID NO: 2807999 - protein, 22 aa, Entamoeba invadens
VPSGGCVKCVNGYYRNGLSCDK

SEQ ID NO: 2808000 - protein, 24 aa, Entamoeba invadens
VPSGGCVKCVNGYYRNRLFCDKCD

SEQ ID NO: 2808001 - protein, 23 aa, Entamoeba invadens
VPSVCKQLRSRGYGIYIESGAGL

SEQ ID NO: 2808002 - protein, 25 aa, Entamoeba invadens
VPSVVGLIVICVLFIGTIVFIVRYR

SEQ ID NO: 2808003 - protein, 21 aa, Entamoeba invadens
VPSYCIDFLLSNMAKNCSTIL

SEQ ID NO: 2808004 - protein, 18 aa, Entamoeba invadens
VPTGYTLIVGSAHFNISN

SEQ ID NO: 2808005 - protein, 18 aa, Entamoeba invadens
VPTIELINFGVFDLTSNI

SEQ ID NO: 2808006 - protein, 17 aa, Entamoeba invadens
VPVASFNYTCEVMNSRC

SEQ ID NO: 2808007 - protein, 20 aa, Entamoeba invadens
VPVCSLCYSPYVLASQSKTC

SEQ ID NO: 2808008 - protein, 20 aa, Entamoeba invadens
VPVLLPVIFSFFSTHDLAQL

SEQ ID NO: 2808009 - protein, 17 aa, Entamoeba invadens
VPVSIEYYLPGQDLNCF

SEQ ID NO: 2808010 - protein, 25 aa, Entamoeba invadens
VPWNCFQPRLEAVGKKIIFQQYDNV

SEQ ID NO: 2808011 - protein, 25 aa, Entamoeba invadens
VPWNCFQPRLEAVGKKIKFKQYDSV

SEQ ID NO: 2808012 - protein, 26 aa, Entamoeba invadens
VPYTNSIDWWGLGILIYEMLFGAVPF

SEQ ID NO: 2808013 - protein, 21 aa, Entamoeba invadens
VPYVGCFLGDILFTDDGLKST

SEQ ID NO: 2808014 - protein, 23 aa, Entamoeba invadens
VQAAIRFVLYFYKLVSISTRSTT

SEQ ID NO: 2808015 - protein, 31 aa, Entamoeba invadens
VQCRLPLFTLFFLLFFLQRVFSMCPQGYFIN

SEQ ID NO: 2808016 - protein, 17 aa, Entamoeba invadens
VQCSPTYERKCITCTNG

SEQ ID NO: 2808017 - protein, 19 aa, Entamoeba invadens
VQDPYMRYTVTQAKEVLEQ

SEQ ID NO: 2808018 - protein, 18 aa, Entamoeba invadens
VQFIESFEDFATWKFIKN

SEQ ID NO: 2808019 - protein, 17 aa, Entamoeba invadens
VQFSVMEGCDFYEIRTV

SEQ ID NO: 2808020 - protein, 23 aa, Entamoeba invadens
VQFTCSEPSVLMLTTQDVFESDF

SEQ ID NO: 2808021 - protein, 29 aa, Entamoeba invadens
VQFTKGCTPFCGVCPMGQVCTTSGVCIVR

SEQ ID NO: 2808022 - protein, 19 aa, Entamoeba invadens
VQFTLRLILQFVTSVTLNV

SEQ ID NO: 2808023 - protein, 19 aa, Entamoeba invadens
VQFYNEFRVLNNGILSFTV

SEQ ID NO: 2808024 - protein, 18 aa, Entamoeba invadens
VQGCDGINACLRCNTGFY

SEQ ID NO: 2808025 - protein, 18 aa, Entamoeba invadens
VQGFWLKFDLSTLENDTL

SEQ ID NO: 2808026 - protein, 19 aa, Entamoeba invadens
VQGTIAFGCKQAAVRDLNE

SEQ ID NO: 2808027 - protein, 19 aa, Entamoeba invadens
VQIHFAPKVHLKIESMTHI

SEQ ID NO: 2808028 - protein, 18 aa, Entamoeba invadens
VQIKFKWSPEELSNKTFI

SEQ ID NO: 2808029 - protein, 18 aa, Entamoeba invadens
VQIVERMLLLLIKKDSAL

SEQ ID NO: 2808030 - protein, 19 aa, Entamoeba invadens
VQKDCVEYSQYLTLQVPQS

SEQ ID NO: 2808031 - protein, 17 aa, Entamoeba invadens
VQKDGECKFMIGNDRTS

SEQ ID NO: 2808032 - protein, 25 aa, Entamoeba invadens
VQKECIDIALGTLISFKGNETSFTE

SEQ ID NO: 2808033 - protein, 25 aa, Entamoeba invadens
VQKGDSRLAKFLIENGINREIQDSN

SEQ ID NO: 2808034 - protein, 35 aa, Entamoeba invadens
VQKKAESFIMLFVRKEILGSFVLPNMKPVEIPDPS

SEQ ID NO: 2808035 - protein, 25 aa, Entamoeba invadens
VQLFPSPKFFFEWMNYTSKHSGLFN

SEQ ID NO: 2808036 - protein, 17 aa, Entamoeba invadens
VQLLKGDGLVKCIEEKV

SEQ ID NO: 2808037 - protein, 17 aa, Entamoeba invadens
VQLRIHNAFTIITDATS

SEQ ID NO: 2808038 - protein, 19 aa, Entamoeba invadens
VQLTRIPIFHFLRESNELF

SEQ ID NO: 2808039 - protein, 21 aa, Entamoeba invadens
VQLWQGMAFGNQRINGRKNGV

SEQ ID NO: 2808040 - protein, 23 aa, Entamoeba invadens
VQMFKNCVCYGIAIDTTHKNGSE

SEQ ID NO: 2808041 - protein, 27 aa, Entamoeba invadens
VQMKLLCHPLRIEFIEKFNQIFAQSNN

SEQ ID NO: 2808042 - protein, 17 aa, Entamoeba invadens
VQMKSDIGALLASNRNF

SEQ ID NO: 2808043 - protein, 22 aa, Entamoeba invadens
VQMRKVEMLCVGDLLARTTEIG

SEQ ID NO: 2808044 - protein, 17 aa, Entamoeba invadens
VQMVGRVLVEWRGSIKL

SEQ ID NO: 2808045 - protein, 17 aa, Entamoeba invadens
VQNAGDAKAMWTYIKYG

SEQ ID NO: 2808046 - protein, 17 aa, Entamoeba invadens
VQNCAHASFGRCIKCER

SEQ ID NO: 2808047 - protein, 33 aa, Entamoeba invadens
VQNCRYCDYNLCYDCLRGYYLYNNECYKCSSIC

SEQ ID NO: 2808048 - protein, 27 aa, Entamoeba invadens
VQNSIKWKLPFTALKISESFVDVKNPD

SEQ ID NO: 2808049 - protein, 19 aa, Entamoeba invadens
VQQRGLWLSMDGYNLMIYI

SEQ ID NO: 2808050 - protein, 20 aa, Entamoeba invadens
VQRGKLILNIGVVKEQSSNE

SEQ ID NO: 2808051 - protein, 17 aa, Entamoeba invadens
VQRSEFNLLLKYIKDNQ

SEQ ID NO: 2808052 - protein, 30 aa, Entamoeba invadens
VQSFGIDLFSGFPAWSSWEYIVSEAMANRY

SEQ ID NO: 2808053 - protein, 24 aa, Entamoeba invadens
VQSLCREDFFFKKFEKNLEKPRKN

SEQ ID NO: 2808054 - protein, 19 aa, Entamoeba invadens
VQSNCQITFSFNTPIEDVT

SEQ ID NO: 2808055 - protein, 18 aa, Entamoeba invadens
VQTLRFLKTQLDNFRKKE

SEQ ID NO: 2808056 - protein, 33 aa, Entamoeba invadens
VQTTFKKTYAFRFWLRVLHLVGNLTLIQDNKVF

SEQ ID NO: 2808057 - protein, 18 aa, Entamoeba invadens
VQYLPSFDAFGLDIYPIN

SEQ ID NO: 2808058 - protein, 24 aa, Entamoeba invadens
VQYRCGYDPILEYVGYLSLSSSFF

SEQ ID NO: 2808059 - protein, 17 aa, Entamoeba invadens
VQYSRPPTRVFRVKNGG

SEQ ID NO: 2808060 - protein, 25 aa, Entamoeba invadens
VQYVCHLFDSFTLFIIIISRNTSIQ

SEQ ID NO: 2808061 - protein, 18 aa, Entamoeba invadens
VQYYRFEGTIGLIEIGDY

SEQ ID NO: 2808062 - protein, 18 aa, Entamoeba invadens
VRCIARYYINDLFTCSQC

SEQ ID NO: 2808063 - protein, 17 aa, Entamoeba invadens
VRCKSTFYLTENHACLK

SEQ ID NO: 2808064 - protein, 23 aa, Entamoeba invadens
VRCNDKYYLLFGKCVSCDDNCDA

SEQ ID NO: 2808065 - protein, 18 aa, Entamoeba invadens
VRDGCLKLLGIAFAGFVS

SEQ ID NO: 2808066 - protein, 18 aa, Entamoeba invadens
VRDPLVLEYVNDFFDPRT

SEQ ID NO: 2808067 - protein, 22 aa, Entamoeba invadens
VRDPPTASGYVIIAQNPKHQVF

SEQ ID NO: 2808068 - protein, 26 aa, Entamoeba invadens
VREFIPGCVPICGVCKSGFVCNKAAR

SEQ ID NO: 2808069 - protein, 21 aa, Entamoeba invadens
VREFIQGAIYGGRCMTRDNKN

SEQ ID NO: 2808070 - protein, 23 aa, Entamoeba invadens
VRENECMKRVKDVLVLDEKNGMN

SEQ ID NO: 2808071 - protein, 17 aa, Entamoeba invadens
VRENICFLTSYDKKQYQ

SEQ ID NO: 2808072 - protein, 17 aa, Entamoeba invadens
VRENVCFLTSYDKKQYK

SEQ ID NO: 2808073 - protein, 21 aa, Entamoeba invadens
VRGISAYGWYIVLQQPSFYLI

SEQ ID NO: 2808074 - protein, 17 aa, Entamoeba invadens
VRGRLSYFFYRTQDLAR

SEQ ID NO: 2808075 - protein, 19 aa, Entamoeba invadens
VRHRRRKGREMLKEYNELE

SEQ ID NO: 2808076 - protein, 28 aa, Entamoeba invadens
VRIFILLYFKMEFVFLLKKIDYNSDCEE

SEQ ID NO: 2808077 - protein, 17 aa, Entamoeba invadens
VRINKTCTLNCPSNMGP

SEQ ID NO: 2808078 - protein, 17 aa, Entamoeba invadens
VRISFVFFIIGVAVILI

SEQ ID NO: 2808079 - protein, 23 aa, Entamoeba invadens
VRISPGAEFCVKHEYGAGMYDPE

SEQ ID NO: 2808080 - protein, 25 aa, Entamoeba invadens
VRISTKVLCAFGYYTTSFGSTGLMY

SEQ ID NO: 2808081 - protein, 19 aa, Entamoeba invadens
VRITLWMKESVLKCFDYTF

SEQ ID NO: 2808082 - protein, 21 aa, Entamoeba invadens
VRIWCLIPLGVLIVGLILNAL

SEQ ID NO: 2808083 - protein, 26 aa, Entamoeba invadens
VRLLSNKIKMCFSNVVSYVERIQTTQ

SEQ ID NO: 2808084 - protein, 17 aa, Entamoeba invadens
VRLSCITWDRSLSFRPE

SEQ ID NO: 2808085 - protein, 17 aa, Entamoeba invadens
VRLVPEFMLHLQNGVFD

SEQ ID NO: 2808086 - protein, 18 aa, Entamoeba invadens
VRMFTRYGLLSIYVPSAQ

SEQ ID NO: 2808087 - protein, 17 aa, Entamoeba invadens
VRMKVRILPDEFRGDDD

SEQ ID NO: 2808088 - protein, 21 aa, Entamoeba invadens
VRMMAGILFKNMFKGRGKTNE

SEQ ID NO: 2808089 - protein, 17 aa, Entamoeba invadens
VRNEPRQQTVIVVLRNF

SEQ ID NO: 2808090 - protein, 29 aa, Entamoeba invadens
VRPVLYNDFEGVLYFFAFGDELPETGDVI

SEQ ID NO: 2808091 - protein, 18 aa, Entamoeba invadens
VRRCREDVARYSLNEKKM

SEQ ID NO: 2808092 - protein, 19 aa, Entamoeba invadens
VRRCSSCSNGYYIKEDGLV

SEQ ID NO: 2808093 - protein, 18 aa, Entamoeba invadens
VRREECDGGVNCGETCFC

SEQ ID NO: 2808094 - protein, 20 aa, Entamoeba invadens
VRRKVCLDASKGILYLHENG

SEQ ID NO: 2808095 - protein, 17 aa, Entamoeba invadens
VRRPEFTTISAVFSPVI

SEQ ID NO: 2808096 - protein, 25 aa, Entamoeba invadens
VRSAFGDGLAHVWEEQRFCEENSPY

SEQ ID NO: 2808097 - protein, 18 aa, Entamoeba invadens
VRSLGVMMEELFQNENAT

SEQ ID NO: 2808098 - protein, 24 aa, Entamoeba invadens
VRSMPVPECFIGLKVEAVTLALIR

SEQ ID NO: 2808099 - protein, 21 aa, Entamoeba invadens
VRSPFDYKTVETINVPFYLAN

SEQ ID NO: 2808100 - protein, 25 aa, Entamoeba invadens
VRSPLYKTRFFWFTLFTSILLIMHL

SEQ ID NO: 2808101 - protein, 25 aa, Entamoeba invadens
VRTACVWVVMVIIEFCWKGHGEELT

SEQ ID NO: 2808102 - protein, 17 aa, Entamoeba invadens
VRTDARFVGCKFSKEIN

SEQ ID NO: 2808103 - protein, 19 aa, Entamoeba invadens
VRVFFCELLLYKITVCPSW

SEQ ID NO: 2808104 - protein, 17 aa, Entamoeba invadens
VRVLKGAEIVFGKDSNF

SEQ ID NO: 2808105 - protein, 19 aa, Entamoeba invadens
VRWFITYPAGFKFNENYNN

SEQ ID NO: 2808106 - protein, 26 aa, Entamoeba invadens
VRYDVEYKFALNLEVGIEAIDYENVA

SEQ ID NO: 2808107 - protein, 20 aa, Entamoeba invadens
VRYLINNGVPFYKNVNNGFV

SEQ ID NO: 2808108 - protein, 22 aa, Entamoeba invadens
VSADFTNTIAFIAPTGISNTLG

SEQ ID NO: 2808109 - protein, 23 aa, Entamoeba invadens
VSAFAILKLVFIAFIGFVGARWC

SEQ ID NO: 2808110 - protein, 30 aa, Entamoeba invadens
VSAMLFARMKRGLLPLVHGGTFTFEKDTTK

SEQ ID NO: 2808111 - protein, 24 aa, Entamoeba invadens
VSCGMATPVGCIRCDGNTFLNVST

SEQ ID NO: 2808112 - protein, 18 aa, Entamoeba invadens
VSCKKCYPPYYMSNNLCI

SEQ ID NO: 2808113 - protein, 19 aa, Entamoeba invadens
VSCNKCTLGYISAANATKC

SEQ ID NO: 2808114 - protein, 17 aa, Entamoeba invadens
VSCSSTSPTCLKCIEGQ

SEQ ID NO: 2808115 - protein, 19 aa, Entamoeba invadens
VSCSYQCIRGCDGINACSW

SEQ ID NO: 2808116 - protein, 18 aa, Entamoeba invadens
VSCTAIPNCKKCSQSEMK

SEQ ID NO: 2808117 - protein, 20 aa, Entamoeba invadens
VSCVFIGVAVISFLSNSVDT

SEQ ID NO: 2808118 - protein, 18 aa, Entamoeba invadens
VSCYCIFSSTPDYSIIKT

SEQ ID NO: 2808119 - protein, 19 aa, Entamoeba invadens
VSCYTCAAGTYSTDGASNC

SEQ ID NO: 2808120 - protein, 19 aa, Entamoeba invadens
VSDNVFVYFSYVMIVLNNF

SEQ ID NO: 2808121 - protein, 23 aa, Entamoeba invadens
VSDSKCSKCTFWHSPNANGTFCN

SEQ ID NO: 2808122 - protein, 23 aa, Entamoeba invadens
VSDSKCSKCTFWHVPDNTKTKCI

SEQ ID NO: 2808123 - protein, 21 aa, Entamoeba invadens
VSDSKCTKCTFWHVPDYTKTK

SEQ ID NO: 2808124 - protein, 29 aa, Entamoeba invadens
VSEALPAFGEFMLFIGYGMEKNGKTIEDR

SEQ ID NO: 2808125 - protein, 26 aa, Entamoeba invadens
VSEAVWWVILLCVFFVVILLVLLVVL

SEQ ID NO: 2808126 - protein, 20 aa, Entamoeba invadens
VSECIVCTVTNCIRCTETTC

SEQ ID NO: 2808127 - protein, 24 aa, Entamoeba invadens
VSEIVKRKAVFLANIAHINELNTK

SEQ ID NO: 2808128 - protein, 23 aa, Entamoeba invadens
VSEKRKGLMMGLVECVGELTCCL

SEQ ID NO: 2808129 - protein, 25 aa, Entamoeba invadens
VSESKCSKCTFWRSPSIDGSSCVTK

SEQ ID NO: 2808130 - protein, 22 aa, Entamoeba invadens
VSETKCDFCFNKISNCQSCEST

SEQ ID NO: 2808131 - protein, 18 aa, Entamoeba invadens
VSFFMSIRVSNFSIAPLQ

SEQ ID NO: 2808132 - protein, 26 aa, Entamoeba invadens
VSFFVFCGLCLCGKSYDTDSCCNKIC

SEQ ID NO: 2808133 - protein, 27 aa, Entamoeba invadens
VSFGGWICPVLSFLASLVLFVYASFSI

SEQ ID NO: 2808134 - protein, 25 aa, Entamoeba invadens
VSFGKVVACSLALAQIDAQYSFFIV

SEQ ID NO: 2808135 - protein, 18 aa, Entamoeba invadens
VSFHIKVKICVDGAKGIS

SEQ ID NO: 2808136 - protein, 17 aa, Entamoeba invadens
VSFHLIKTLVVYINSTK

SEQ ID NO: 2808137 - protein, 23 aa, Entamoeba invadens
VSFKEKLMWTGVTLLIFLVCSQI

SEQ ID NO: 2808138 - protein, 22 aa, Entamoeba invadens
VSFLGVSGFIAYKVFLKKKTDN

SEQ ID NO: 2808139 - protein, 23 aa, Entamoeba invadens
VSFLKEITCDIMTFHSAIVSVVD

SEQ ID NO: 2808140 - protein, 21 aa, Entamoeba invadens
VSFLLYWVVSVIFCFIPVMVI

SEQ ID NO: 2808141 - protein, 26 aa, Entamoeba invadens
VSFLPVCIAGIIALISYNIYIIAITY

SEQ ID NO: 2808142 - protein, 17 aa, Entamoeba invadens
VSFQEFSQIIGVVDPSV

SEQ ID NO: 2808143 - protein, 24 aa, Entamoeba invadens
VSFREIIVDFTLIITVVPLFLYFF

SEQ ID NO: 2808144 - protein, 22 aa, Entamoeba invadens
VSGCVLCSSGFYQVDSLNVEGK

SEQ ID NO: 2808145 - protein, 17 aa, Entamoeba invadens
VSGDIFSYVHFPFLVTS

SEQ ID NO: 2808146 - protein, 22 aa, Entamoeba invadens
VSGEFYMNYPLVNYIQEKVECS

SEQ ID NO: 2808147 - protein, 18 aa, Entamoeba invadens
VSGRCELCKEGFVFDASN

SEQ ID NO: 2808148 - protein, 24 aa, Entamoeba invadens
VSGSLCYVCKPGYFRVGLDCQSCK

SEQ ID NO: 2808149 - protein, 21 aa, Entamoeba invadens
VSGSNCVLCLEEYYLKDLQCL

SEQ ID NO: 2808150 - protein, 27 aa, Entamoeba invadens
VSGSPSFFSCSDFEFSAEYITNTPKYT

SEQ ID NO: 2808151 - protein, 32 aa, Entamoeba invadens
VSGSYTFFDLCWRFAFIFYSVIVVLAFLITFR

SEQ ID NO: 2808152 - protein, 25 aa, Entamoeba invadens
VSHIDFKNSFGYIKDNYKYIVTSLK

SEQ ID NO: 2808153 - protein, 17 aa, Entamoeba invadens
VSIAAFSGLSLRGENTK

SEQ ID NO: 2808154 - protein, 23 aa, Entamoeba invadens
VSICTCAFLYLLMAISGNVSFDK

SEQ ID NO: 2808155 - protein, 17 aa, Entamoeba invadens
VSIFFLSVFCIILLLAL

SEQ ID NO: 2808156 - protein, 20 aa, Entamoeba invadens
VSIFMGLYFYGKKKPEDKGY

SEQ ID NO: 2808157 - protein, 24 aa, Entamoeba invadens
VSIGKSCFKYCSKLSYIEIPDCVQ

SEQ ID NO: 2808158 - protein, 23 aa, Entamoeba invadens
VSIHFRLSILVLVSHQKVPNFSY

SEQ ID NO: 2808159 - protein, 17 aa, Entamoeba invadens
VSIKELIIKTGGSIYIP

SEQ ID NO: 2808160 - protein, 17 aa, Entamoeba invadens
VSILCGYSEDFSYVEVL

SEQ ID NO: 2808161 - protein, 19 aa, Entamoeba invadens
VSILFIFMELFLYQIMCNI

SEQ ID NO: 2808162 - protein, 18 aa, Entamoeba invadens
VSILRWVLLFDLFGSVVY

SEQ ID NO: 2808163 - protein, 24 aa, Entamoeba invadens
VSIPICVSDSLPLQTNVFVTKEYV

SEQ ID NO: 2808164 - protein, 18 aa, Entamoeba invadens
VSISFTALILIELINVGF

SEQ ID NO: 2808165 - protein, 25 aa, Entamoeba invadens
VSISKKEAILWLIGGVQQYLGAYLK

SEQ ID NO: 2808166 - protein, 23 aa, Entamoeba invadens
VSKCCLEGILYLHKNKVFHGNLK

SEQ ID NO: 2808167 - protein, 35 aa, Entamoeba invadens
VSKFLLGGVVAFWLLCFLNTFFLLFASTEITILCF

SEQ ID NO: 2808168 - protein, 26 aa, Entamoeba invadens
VSKISKRGGVIFLRFENLNDSAYFRW

SEQ ID NO: 2808169 - protein, 24 aa, Entamoeba invadens
VSKKEVTDIFSLSFAFGGIYFVTS

SEQ ID NO: 2808170 - protein, 25 aa, Entamoeba invadens
VSKMSDLFVELSIRLEFENNNFEIN

SEQ ID NO: 2808171 - protein, 27 aa, Entamoeba invadens
VSKVLFCIMLALSLLMVCPDVFHGIFS

SEQ ID NO: 2808172 - protein, 21 aa, Entamoeba invadens
VSLCRNLRQMIVFKYQQTIIQ

SEQ ID NO: 2808173 - protein, 17 aa, Entamoeba invadens
VSLEAHSTFLLKGKHNF

SEQ ID NO: 2808174 - protein, 23 aa, Entamoeba invadens
VSLELCKFLQGLFIEHDDDMKIR

SEQ ID NO: 2808175 - protein, 17 aa, Entamoeba invadens
VSLFACLTLFTHGDSFE

SEQ ID NO: 2808176 - protein, 37 aa, Entamoeba invadens
VSLFVVIGGICIVMRGMLHLNFKVIVSVQVIFLVCVV

SEQ ID NO: 2808177 - protein, 25 aa, Entamoeba invadens
VSLGKLCFFSCRKLSSVIIPSSVTS

SEQ ID NO: 2808178 - protein, 21 aa, Entamoeba invadens
VSLILFCVLMARLWEGIYTIV

SEQ ID NO: 2808179 - protein, 17 aa, Entamoeba invadens
VSLILFLIGAFFNLIIL

SEQ ID NO: 2808180 - protein, 25 aa, Entamoeba invadens
VSLKFKETYYDGGFLIQDNGIINVY

SEQ ID NO: 2808181 - protein, 17 aa, Entamoeba invadens
VSLLAAFVLNKSIQKVV

SEQ ID NO: 2808182 - protein, 26 aa, Entamoeba invadens
VSLLKCAVNLSFLFIAVVYQRNMFGV

SEQ ID NO: 2808183 - protein, 25 aa, Entamoeba invadens
VSLSEECLCTLLIPQMSTLNSYSCP

SEQ ID NO: 2808184 - protein, 24 aa, Entamoeba invadens
VSLSKRTAVEFEIFVKPNCSCKIN

SEQ ID NO: 2808185 - protein, 26 aa, Entamoeba invadens
VSLTTCSLCSIWVTLFIYTKRLNIYV

SEQ ID NO: 2808186 - protein, 28 aa, Entamoeba invadens
VSMALKLFNKRKCYGLIIENGFTSLYGM

SEQ ID NO: 2808187 - protein, 19 aa, Entamoeba invadens
VSMFLDDRISIIIRVIVPL

SEQ ID NO: 2808188 - protein, 20 aa, Entamoeba invadens
VSMLDKFRCDFIVHFYSACF

SEQ ID NO: 2808189 - protein, 19 aa, Entamoeba invadens
VSMLVKFKSEFIVHFFGAV

SEQ ID NO: 2808190 - protein, 25 aa, Entamoeba invadens
VSMLYKFRSEFIVHFYGAVFIPNKV

SEQ ID NO: 2808191 - protein, 24 aa, Entamoeba invadens
VSNASPSANCFGGFEETIIVDDNK

SEQ ID NO: 2808192 - protein, 22 aa, Entamoeba invadens
VSNCTLGDVVFQYMFLADFELI

SEQ ID NO: 2808193 - protein, 17 aa, Entamoeba invadens
VSNECVQLWTGKRYGAL

SEQ ID NO: 2808194 - protein, 17 aa, Entamoeba invadens
VSNGLDFLNCSVYEADF

SEQ ID NO: 2808195 - protein, 26 aa, Entamoeba invadens
VSNSKCSKCAFWYLPTNDGILCKKKV

SEQ ID NO: 2808196 - protein, 21 aa, Entamoeba invadens
VSNSKCSKCTFWNTPSQNGTS

SEQ ID NO: 2808197 - protein, 26 aa, Entamoeba invadens
VSNTLRVVNRYGHFLTKISDVISCPV

SEQ ID NO: 2808198 - protein, 19 aa, Entamoeba invadens
VSNTQCKVCELCYPGMKLV

SEQ ID NO: 2808199 - protein, 18 aa, Entamoeba invadens
VSPAVKCPILVNKTKLMF

SEQ ID NO: 2808200 - protein, 19 aa, Entamoeba invadens
VSPHVFNYIGSYLIVRSLK

SEQ ID NO: 2808201 - protein, 24 aa, Entamoeba invadens
VSPKKSFLRFILKSKSHMVSKNLK

SEQ ID NO: 2808202 - protein, 25 aa, Entamoeba invadens
VSPRRIKVVPMLKKYNGGFISNRVT

SEQ ID NO: 2808203 - protein, 17 aa, Entamoeba invadens
VSPRTQKILSLRFSKKE

SEQ ID NO: 2808204 - protein, 24 aa, Entamoeba invadens
VSPYRLDLAITRKLLVFSSNLGLQ

SEQ ID NO: 2808205 - protein, 18 aa, Entamoeba invadens
VSQCSITDSIGRYSTNTI

SEQ ID NO: 2808206 - protein, 17 aa, Entamoeba invadens
VSQFMCGLIHANYYFAK

SEQ ID NO: 2808207 - protein, 24 aa, Entamoeba invadens
VSQYFPKFVNFVTLSLVCKKFNKI

SEQ ID NO: 2808208 - protein, 21 aa, Entamoeba invadens
VSRCGEFLQLVGPYQKQVICM

SEQ ID NO: 2808209 - protein, 17 aa, Entamoeba invadens
VSRPCKADVLTEIAKLL

SEQ ID NO: 2808210 - protein, 24 aa, Entamoeba invadens
VSSCDGGSIVKCFLQNNTNCLPIC

SEQ ID NO: 2808211 - protein, 24 aa, Entamoeba invadens
VSSCDGGSIVKCFLQNNTNCLPVC

SEQ ID NO: 2808212 - protein, 17 aa, Entamoeba invadens
VSSCMALVISIAILATK

SEQ ID NO: 2808213 - protein, 25 aa, Entamoeba invadens
VSSECQKLRLAMTFNTTSQQWQNKK

SEQ ID NO: 2808214 - protein, 30 aa, Entamoeba invadens
VSSELISVCGIPFVIILSYFILHKTFSISQ

SEQ ID NO: 2808215 - protein, 20 aa, Entamoeba invadens
VSSETKWKRSQCPCNGETCI

SEQ ID NO: 2808216 - protein, 26 aa, Entamoeba invadens
VSSFEICDPCFFTAFRDAVMEGRKYV

SEQ ID NO: 2808217 - protein, 23 aa, Entamoeba invadens
VSSGKCISCNELTQNCKLCSRKN

SEQ ID NO: 2808218 - protein, 17 aa, Entamoeba invadens
VSSIIIAIVCVFVLILL

SEQ ID NO: 2808219 - protein, 18 aa, Entamoeba invadens
VSSIPIYFNKVLHPCSGD

SEQ ID NO: 2808220 - protein, 22 aa, Entamoeba invadens
VSSLCIYVGIFVHLNTRIEDLE

SEQ ID NO: 2808221 - protein, 20 aa, Entamoeba invadens
VSSLICSTGYILHNKLCVLP

SEQ ID NO: 2808222 - protein, 24 aa, Entamoeba invadens
VSSLISFERFVFIASISGILCFDR

SEQ ID NO: 2808223 - protein, 24 aa, Entamoeba invadens
VSSPVWWVIVLVIIFGVLVIVMIV

SEQ ID NO: 2808224 - protein, 21 aa, Entamoeba invadens
VSSRFNERFVLSLSDNLCSVV

SEQ ID NO: 2808225 - protein, 17 aa, Entamoeba invadens
VSSRMYGFIKINTTATA

SEQ ID NO: 2808226 - protein, 21 aa, Entamoeba invadens
VSSSFDCLRCTDNYYFDSNTR

SEQ ID NO: 2808227 - protein, 17 aa, Entamoeba invadens
VSTDFYFEKGVVLEKLF

SEQ ID NO: 2808228 - protein, 19 aa, Entamoeba invadens
VSTIKFWAYLVSECYIGCE

SEQ ID NO: 2808229 - protein, 23 aa, Entamoeba invadens
VSTKIPGCVTIKTELNTELFINF

SEQ ID NO: 2808230 - protein, 18 aa, Entamoeba invadens
VSTLRIKYYATWKLTEGF

SEQ ID NO: 2808231 - protein, 17 aa, Entamoeba invadens
VSTNVLINIKDFGSDAV

SEQ ID NO: 2808232 - protein, 29 aa, Entamoeba invadens
VSTVLCTLVLICLQPFVFLAINGEEKSFN

SEQ ID NO: 2808233 - protein, 22 aa, Entamoeba invadens
VSTYPDGRCVVCSTADGAESWF

SEQ ID NO: 2808234 - protein, 26 aa, Entamoeba invadens
VSVGNARCSFCYSPYVPNVAGNCILC

SEQ ID NO: 2808235 - protein, 18 aa, Entamoeba invadens
VSVKLMKKALTYKALLKE

SEQ ID NO: 2808236 - protein, 20 aa, Entamoeba invadens
VSVLIPTMIKVHFTLETLGV

SEQ ID NO: 2808237 - protein, 18 aa, Entamoeba invadens
VSVPFLLTLSYKDLTVKN

SEQ ID NO: 2808238 - protein, 18 aa, Entamoeba invadens
VSVVEYFIEVRLFPDLKS

SEQ ID NO: 2808239 - protein, 24 aa, Entamoeba invadens
VSVVKELCRVFGVPPQRRKEVYTL

SEQ ID NO: 2808240 - protein, 26 aa, Entamoeba invadens
VSWSFGKCFGFLFGGMLKTALGMNSL

SEQ ID NO: 2808241 - protein, 17 aa, Entamoeba invadens
VSYFDLLVYCHKKIQQK

SEQ ID NO: 2808242 - protein, 21 aa, Entamoeba invadens
VSYYCLFGYAYIVYVVVIPLC

SEQ ID NO: 2808243 - protein, 21 aa, Entamoeba invadens
VTACCFVLFFIIIAIVGVLLA

SEQ ID NO: 2808244 - protein, 18 aa, Entamoeba invadens
VTCAASFERKCVTCMTGK

SEQ ID NO: 2808245 - protein, 25 aa, Entamoeba invadens
VTCASGYSRRCVKCSNGYYPDSNGK

SEQ ID NO: 2808246 - protein, 20 aa, Entamoeba invadens
VTCGASVMGCSKCKEDKTTC

SEQ ID NO: 2808247 - protein, 23 aa, Entamoeba invadens
VTCLECYPPYMASNGICILCNDY

SEQ ID NO: 2808248 - protein, 22 aa, Entamoeba invadens
VTCLECYPPYMASNGICTLCID

SEQ ID NO: 2808249 - protein, 17 aa, Entamoeba invadens
VTCQNGGNRICVTCTAG

SEQ ID NO: 2808250 - protein, 19 aa, Entamoeba invadens
VTDAFVYYCRILKKIPVEC

SEQ ID NO: 2808251 - protein, 24 aa, Entamoeba invadens
VTDEMFHVIQACWDDIPQNRLTAE

SEQ ID NO: 2808252 - protein, 19 aa, Entamoeba invadens
VTDKHLGIVFGWPHVISVF

SEQ ID NO: 2808253 - protein, 17 aa, Entamoeba invadens
VTDRSFYIYAYSIPVDE

SEQ ID NO: 2808254 - protein, 21 aa, Entamoeba invadens
VTEKLRIKFLLDAAKGVFYLH

SEQ ID NO: 2808255 - protein, 18 aa, Entamoeba invadens
VTFFFSFVLLLLVSLSLW

SEQ ID NO: 2808256 - protein, 18 aa, Entamoeba invadens
VTFHKSALDKCYYVNDSS

SEQ ID NO: 2808257 - protein, 24 aa, Entamoeba invadens
VTFLDLFEPLRMIFFNKESLCTRQ

SEQ ID NO: 2808258 - protein, 20 aa, Entamoeba invadens
VTFPKAICYFVHNLFGSTPV

SEQ ID NO: 2808259 - protein, 25 aa, Entamoeba invadens
VTFPLDFMGEYLLTFSSQAFPAQHS

SEQ ID NO: 2808260 - protein, 23 aa, Entamoeba invadens
VTGAAAIPREFVIDSMTVDFAKS

SEQ ID NO: 2808261 - protein, 19 aa, Entamoeba invadens
VTGCAKCDSYRCFQCADTY

SEQ ID NO: 2808262 - protein, 20 aa, Entamoeba invadens
VTGGSFKFVDKVLLTTLESD

SEQ ID NO: 2808263 - protein, 21 aa, Entamoeba invadens
VTGICLVCSNTIYTLNITASI

SEQ ID NO: 2808264 - protein, 20 aa, Entamoeba invadens
VTGLCSYSLISQVPQCSVCS

SEQ ID NO: 2808265 - protein, 18 aa, Entamoeba invadens
VTHRVTWICKQFLRTDDG

SEQ ID NO: 2808266 - protein, 19 aa, Entamoeba invadens
VTIAYWIVKGLLFHEGKNK

SEQ ID NO: 2808267 - protein, 17 aa, Entamoeba invadens
VTIKNLHIIAGGGVYIY

SEQ ID NO: 2808268 - protein, 25 aa, Entamoeba invadens
VTIMVCLLCLLIAVILTILSSSIFL

SEQ ID NO: 2808269 - protein, 23 aa, Entamoeba invadens
VTIPELLKKLCLNVLQITNGKST

SEQ ID NO: 2808270 - protein, 27 aa, Entamoeba invadens
VTIPSGSSGKIFTVLRVLSPINTANFE

SEQ ID NO: 2808271 - protein, 25 aa, Entamoeba invadens
VTIPSGSSGKIFTVLRVSSPINTAN

SEQ ID NO: 2808272 - protein, 31 aa, Entamoeba invadens
VTISRLFEWEWARKSIPIMMGVGGVMSSFGT

SEQ ID NO: 2808273 - protein, 21 aa, Entamoeba invadens
VTITVCRASIYLIILAIVIAI

SEQ ID NO: 2808274 - protein, 17 aa, Entamoeba invadens
VTIWLTQLFIHYVISDK

SEQ ID NO: 2808275 - protein, 23 aa, Entamoeba invadens
VTKCKTCSIGYYVLNGVCVSCTT

SEQ ID NO: 2808276 - protein, 25 aa, Entamoeba invadens
VTKDCGYSKLDICANKDVENECENI

SEQ ID NO: 2808277 - protein, 32 aa, Entamoeba invadens
VTKGCLTCDAIKCLSCALGEVVDSLGKCSICS

SEQ ID NO: 2808278 - protein, 17 aa, Entamoeba invadens
VTKGWRLKLNGLNEKFA

SEQ ID NO: 2808279 - protein, 17 aa, Entamoeba invadens
VTKLEHFVLGFRLSLQC

SEQ ID NO: 2808280 - protein, 22 aa, Entamoeba invadens
VTKSKCSKCTFWHVPSDDGTYC

SEQ ID NO: 2808281 - protein, 23 aa, Entamoeba invadens
VTKSKCSKCTFWHVPSDDGTYCN

SEQ ID NO: 2808282 - protein, 23 aa, Entamoeba invadens
VTLAKMTGLRFVNGSVSDVDFKQ

SEQ ID NO: 2808283 - protein, 24 aa, Entamoeba invadens
VTLAKMTGLRFVNGSVSDVDFKQS

SEQ ID NO: 2808284 - protein, 21 aa, Entamoeba invadens
VTLDASRKAILFLVGQTPLNN

SEQ ID NO: 2808285 - protein, 21 aa, Entamoeba invadens
VTLFAAIFFTIFSIFVVFSLP

SEQ ID NO: 2808286 - protein, 25 aa, Entamoeba invadens
VTLHLTCTHLPVGVPTPQIIENPVE

SEQ ID NO: 2808287 - protein, 24 aa, Entamoeba invadens
VTLKISPKTRVVVCDENDQYALCC

SEQ ID NO: 2808288 - protein, 17 aa, Entamoeba invadens
VTLKPDYACEFEISIKP

SEQ ID NO: 2808289 - protein, 21 aa, Entamoeba invadens
VTLQFTEYFFKQNIPPATQWK

SEQ ID NO: 2808290 - protein, 24 aa, Entamoeba invadens
VTLRKGYCCEFHIYLKPMCTCRVV

SEQ ID NO: 2808291 - protein, 22 aa, Entamoeba invadens
VTLRRISLVIIDQASFSLVFKI

SEQ ID NO: 2808292 - protein, 18 aa, Entamoeba invadens
VTLRRNVTMINFHQRIDY

SEQ ID NO: 2808293 - protein, 25 aa, Entamoeba invadens
VTLSRFPEFLGYNVKYLNISLRLYK

SEQ ID NO: 2808294 - protein, 20 aa, Entamoeba invadens
VTLTQWRALTLLVIGVVLVE

SEQ ID NO: 2808295 - protein, 24 aa, Entamoeba invadens
VTLYEVLSWSEAYPSSKFKFPWKI

SEQ ID NO: 2808296 - protein, 19 aa, Entamoeba invadens
VTMCGGVVRVVMGMIICGT

SEQ ID NO: 2808297 - protein, 23 aa, Entamoeba invadens
VTMEKRGIISFTKPMKVPIINGL

SEQ ID NO: 2808298 - protein, 27 aa, Entamoeba invadens
VTMFELFKWGNAYSEKYFPYPWNVVDF

SEQ ID NO: 2808299 - protein, 25 aa, Entamoeba invadens
VTMISLCVLCFGYLLYFLLLLFIVC

SEQ ID NO: 2808300 - protein, 21 aa, Entamoeba invadens
VTMTLPFVISLVISFFYEEIN

SEQ ID NO: 2808301 - protein, 18 aa, Entamoeba invadens
VTMYECFTWTESYTKDKF

SEQ ID NO: 2808302 - protein, 18 aa, Entamoeba invadens
VTMYETFGWCEAYDKTEF

SEQ ID NO: 2808303 - protein, 21 aa, Entamoeba invadens
VTMYEVFGWQDPYSLKRFKYP

SEQ ID NO: 2808304 - protein, 19 aa, Entamoeba invadens
VTNCIRCTETTCLLCKEGY

SEQ ID NO: 2808305 - protein, 23 aa, Entamoeba invadens
VTNNNCTYCIGCANHCINGFKCA

SEQ ID NO: 2808306 - protein, 29 aa, Entamoeba invadens
VTPFPGINFVQWMFCLFLSAMSLVVGQFA

SEQ ID NO: 2808307 - protein, 17 aa, Entamoeba invadens
VTPLPGLRKDVKTKSLK

SEQ ID NO: 2808308 - protein, 18 aa, Entamoeba invadens
VTPSFVYQIQQIVTDISQ

SEQ ID NO: 2808309 - protein, 23 aa, Entamoeba invadens
VTPSLREYKGFSVPEVSPSTPSS

SEQ ID NO: 2808310 - protein, 22 aa, Entamoeba invadens
VTQSKCSKCTFWHIPNGSGTSC

SEQ ID NO: 2808311 - protein, 22 aa, Entamoeba invadens
VTRCGQCLELTGSTQNPFKCVV

SEQ ID NO: 2808312 - protein, 24 aa, Entamoeba invadens
VTRQCRSGVGSLILFTPSHDYMKT

SEQ ID NO: 2808313 - protein, 20 aa, Entamoeba invadens
VTRSAQFNASWTKTVDSCTE

SEQ ID NO: 2808314 - protein, 19 aa, Entamoeba invadens
VTRYVVFEVDKKYSTNELF

SEQ ID NO: 2808315 - protein, 18 aa, Entamoeba invadens
VTSCKALYANTPVVVKDL

SEQ ID NO: 2808316 - protein, 25 aa, Entamoeba invadens
VTSGLRLRFETCINEGMSGLINHCW

SEQ ID NO: 2808317 - protein, 25 aa, Entamoeba invadens
VTSLGKECFNGCCSLSSITIPSNVV

SEQ ID NO: 2808318 - protein, 22 aa, Entamoeba invadens
VTSLKTDLFLIGPKGLTFYSLP

SEQ ID NO: 2808319 - protein, 25 aa, Entamoeba invadens
VTSNMCAFCYELIPNCQFCEYNNGS

SEQ ID NO: 2808320 - protein, 18 aa, Entamoeba invadens
VTSSDWSCCSGVIPAYSN

SEQ ID NO: 2808321 - protein, 26 aa, Entamoeba invadens
VTSSKCTRCSFWYSVSDTGLYCEKAV

SEQ ID NO: 2808322 - protein, 25 aa, Entamoeba invadens
VTSVCGIVFLLLRWFLSKQTTFLDK

SEQ ID NO: 2808323 - protein, 23 aa, Entamoeba invadens
VTTDCYRQLPVTFNGDKNCLISF

SEQ ID NO: 2808324 - protein, 19 aa, Entamoeba invadens
VTTGIRLTLTIEFGNVITT

SEQ ID NO: 2808325 - protein, 24 aa, Entamoeba invadens
VTTIAFVVFISFTAVVIGLAVGLS

SEQ ID NO: 2808326 - protein, 22 aa, Entamoeba invadens
VTTLPWNCWSSSFVFSDDLPNG

SEQ ID NO: 2808327 - protein, 17 aa, Entamoeba invadens
VTVALIFIVFAIIITSI

SEQ ID NO: 2808328 - protein, 21 aa, Entamoeba invadens
VTVEELRREFDIEKTVVNSSD

SEQ ID NO: 2808329 - protein, 17 aa, Entamoeba invadens
VTVIFGFIVPMTSVHFY

SEQ ID NO: 2808330 - protein, 19 aa, Entamoeba invadens
VTVKNCTNVTFSNFKIYNS

SEQ ID NO: 2808331 - protein, 18 aa, Entamoeba invadens
VTVQIFFKPERRSFSNGC

SEQ ID NO: 2808332 - protein, 19 aa, Entamoeba invadens
VTVRFPFEEYGLFEYPTCI

SEQ ID NO: 2808333 - protein, 21 aa, Entamoeba invadens
VTVSACAVVLFLVQPDYTCNI

SEQ ID NO: 2808334 - protein, 24 aa, Entamoeba invadens
VTYLPQVCMVIQFFALGSLGEYLR

SEQ ID NO: 2808335 - protein, 30 aa, Entamoeba invadens
VTYRHCFFLICGIVVLLLILYGVLFKMDWG

SEQ ID NO: 2808336 - protein, 25 aa, Entamoeba invadens
VTYVGFRFALGIAFYPFEVGGTYMN

SEQ ID NO: 2808337 - protein, 23 aa, Entamoeba invadens
VVAFAVKCVERLVSFSENTIVFK

SEQ ID NO: 2808338 - protein, 18 aa, Entamoeba invadens
VVAISFFTGEAIKIMKKL

SEQ ID NO: 2808339 - protein, 20 aa, Entamoeba invadens
VVAMSIPLIFAWTKTSTQPA

SEQ ID NO: 2808340 - protein, 22 aa, Entamoeba invadens
VVCFNLLGKVIWETNVGGPVLQ

SEQ ID NO: 2808341 - protein, 26 aa, Entamoeba invadens
VVCFQEVFKELNWRREKLLKKAKKAG

SEQ ID NO: 2808342 - protein, 18 aa, Entamoeba invadens
VVCKDRYYLTDDFKCSKC

SEQ ID NO: 2808343 - protein, 17 aa, Entamoeba invadens
VVDIYVWDGIYLALNKV

SEQ ID NO: 2808344 - protein, 24 aa, Entamoeba invadens
VVEGASGIKCIKCVTNYILIAGSC

SEQ ID NO: 2808345 - protein, 17 aa, Entamoeba invadens
VVFCVIGSMVIHKDKSI

SEQ ID NO: 2808346 - protein, 19 aa, Entamoeba invadens
VVFKGVYKGQSVAVKKLKN

SEQ ID NO: 2808347 - protein, 21 aa, Entamoeba invadens
VVFPSRSWIVAVPQKYSKTFP

SEQ ID NO: 2808348 - protein, 42 aa, Entamoeba invadens
VVFQKLIGMWLYVWGITALLWICVWWQRWELKEIYQHRHVVW

SEQ ID NO: 2808349 - protein, 22 aa, Entamoeba invadens
VVFSETWCSKVVPIYQPFTYGV

SEQ ID NO: 2808350 - protein, 33 aa, Entamoeba invadens
VVFSLPEFPFMWGYCWFTTILSYLSLWNTRDEL

SEQ ID NO: 2808351 - protein, 17 aa, Entamoeba invadens
VVFTMEFIGDYKMLMDA

SEQ ID NO: 2808352 - protein, 20 aa, Entamoeba invadens
VVFYIPVFCYYYIPYTTPWY

SEQ ID NO: 2808353 - protein, 23 aa, Entamoeba invadens
VVGAPLTYFGMVFLCELGLRGYL

SEQ ID NO: 2808354 - protein, 20 aa, Entamoeba invadens
VVGFSLCYVNFLSSRFNTDK

SEQ ID NO: 2808355 - protein, 18 aa, Entamoeba invadens
VVGFVAWNILTIVYFIYT

SEQ ID NO: 2808356 - protein, 18 aa, Entamoeba invadens
VVGIPIVSVFIIILIIIS

SEQ ID NO: 2808357 - protein, 18 aa, Entamoeba invadens
VVGIPIVSVFIIVFIIIG

SEQ ID NO: 2808358 - protein, 18 aa, Entamoeba invadens
VVGIPIVSVFIIVLINIS

SEQ ID NO: 2808359 - protein, 18 aa, Entamoeba invadens
VVGIPIVSVFIIVLVIIS

SEQ ID NO: 2808360 - protein, 22 aa, Entamoeba invadens
VVGIPIVSVFVIILIIISIIVI

SEQ ID NO: 2808361 - protein, 22 aa, Entamoeba invadens
VVGIPIVSVFVIVLVIIGIIVI

SEQ ID NO: 2808362 - protein, 24 aa, Entamoeba invadens
VVGKCAICPKGTYYTSSMCQSCNE

SEQ ID NO: 2808363 - protein, 17 aa, Entamoeba invadens
VVGLPIVCVIVLVVIIV

SEQ ID NO: 2808364 - protein, 25 aa, Entamoeba invadens
VVGNVIGCRLCFKTYHEGCVNVAAL

SEQ ID NO: 2808365 - protein, 26 aa, Entamoeba invadens
VVGSLAFWVICCSVILIINKFRNPTR

SEQ ID NO: 2808366 - protein, 19 aa, Entamoeba invadens
VVGVLTFILFLVIIGGAMG

SEQ ID NO: 2808367 - protein, 17 aa, Entamoeba invadens
VVHELRVKLYKLKLQVK

SEQ ID NO: 2808368 - protein, 17 aa, Entamoeba invadens
VVHGFRMEVPDLSENPN

SEQ ID NO: 2808369 - protein, 17 aa, Entamoeba invadens
VVIAGILVVIFLKTKKA

SEQ ID NO: 2808370 - protein, 19 aa, Entamoeba invadens
VVIAIALIIFYKRKNSSSS

SEQ ID NO: 2808371 - protein, 18 aa, Entamoeba invadens
VVICCIYAASVYYKHVMI

SEQ ID NO: 2808372 - protein, 26 aa, Entamoeba invadens
VVICLIIPFCVFIKDFSWNEEDNEII

SEQ ID NO: 2808373 - protein, 26 aa, Entamoeba invadens
VVICMIIPFCVFIKDFSWNENDNELI

SEQ ID NO: 2808374 - protein, 21 aa, Entamoeba invadens
VVIGIPITVLILFVLFITMNI

SEQ ID NO: 2808375 - protein, 17 aa, Entamoeba invadens
VVIHRNSKFNVFANHDF

SEQ ID NO: 2808376 - protein, 21 aa, Entamoeba invadens
VVIICLFIFVGVIAGIIALST

SEQ ID NO: 2808377 - protein, 17 aa, Entamoeba invadens
VVIKRRKFGEIDFLMNY

SEQ ID NO: 2808378 - protein, 18 aa, Entamoeba invadens
VVILCTTLLFYSVKIAIQ

SEQ ID NO: 2808379 - protein, 19 aa, Entamoeba invadens
VVILRKIRDDEVNLSSGLA

SEQ ID NO: 2808380 - protein, 24 aa, Entamoeba invadens
VVIMFLCMFLFKETFLDIVSISFT

SEQ ID NO: 2808381 - protein, 18 aa, Entamoeba invadens
VVINNIYNYLGIAYNKTV

SEQ ID NO: 2808382 - protein, 23 aa, Entamoeba invadens
VVIPLCAIPFWYVQIPLVCVGCA

SEQ ID NO: 2808383 - protein, 18 aa, Entamoeba invadens
VVIQREFWTILFSFIAIC

SEQ ID NO: 2808384 - protein, 19 aa, Entamoeba invadens
VVIVFLSILGIVMVVIIIL

SEQ ID NO: 2808385 - protein, 25 aa, Entamoeba invadens
VVIVSCVFVPAFVMAFAMLIFFITR

SEQ ID NO: 2808386 - protein, 24 aa, Entamoeba invadens
VVKGNLKYLEEWRSYYEMDKRLWN

SEQ ID NO: 2808387 - protein, 19 aa, Entamoeba invadens
VVKIAAIRFFSRLNDTETF

SEQ ID NO: 2808388 - protein, 23 aa, Entamoeba invadens
VVKSFGICLKCINNLQLSQSHIC

SEQ ID NO: 2808389 - protein, 25 aa, Entamoeba invadens
VVKYEFSIELTLGVFALCISLLNYN

SEQ ID NO: 2808390 - protein, 28 aa, Entamoeba invadens
VVLKKEFFRIIVWFNVEFETVDRNKSPN

SEQ ID NO: 2808391 - protein, 21 aa, Entamoeba invadens
VVLKKYYKGLVEITLPMCTDE

SEQ ID NO: 2808392 - protein, 25 aa, Entamoeba invadens
VVLLSVYWRKIVKKCMDMYLFTLST

SEQ ID NO: 2808393 - protein, 17 aa, Entamoeba invadens
VVLPSGEACEFEILLTL

SEQ ID NO: 2808394 - protein, 22 aa, Entamoeba invadens
VVLSVTLWIFVFINRKEAVKFL

SEQ ID NO: 2808395 - protein, 18 aa, Entamoeba invadens
VVLTFKLKPDVLLCNGPG

SEQ ID NO: 2808396 - protein, 29 aa, Entamoeba invadens
VVLYVFWLLYVVCRSCSEGKKIGKTKRKL

SEQ ID NO: 2808397 - protein, 22 aa, Entamoeba invadens
VVMGTLKAVFKIKGTNEDVLNH

SEQ ID NO: 2808398 - protein, 17 aa, Entamoeba invadens
VVMKMRIKLMLDTAKGI

SEQ ID NO: 2808399 - protein, 18 aa, Entamoeba invadens
VVMLGMSVVNSFKKTSGI

SEQ ID NO: 2808400 - protein, 35 aa, Entamoeba invadens
VVMLKKKFACEFSIYLKPKCTCRINNTICIVSKNL

SEQ ID NO: 2808401 - protein, 25 aa, Entamoeba invadens
VVMNCLFIVWIYWNRYDIEGWKKLH

SEQ ID NO: 2808402 - protein, 19 aa, Entamoeba invadens
VVMYEIFVWGPPYPKSEFQ

SEQ ID NO: 2808403 - protein, 25 aa, Entamoeba invadens
VVNDFNRFYSFSSFQIENVTTLQRS

SEQ ID NO: 2808404 - protein, 22 aa, Entamoeba invadens
VVNKCEFCSFGTFSSSPKSLQC

SEQ ID NO: 2808405 - protein, 26 aa, Entamoeba invadens
VVNPIQFSLKGTKVYFSVPSTILGVD

SEQ ID NO: 2808406 - protein, 17 aa, Entamoeba invadens
VVNTFRVKIVLAVANVV

SEQ ID NO: 2808407 - protein, 20 aa, Entamoeba invadens
VVNVFFKFNSVYMITESGRI

SEQ ID NO: 2808408 - protein, 28 aa, Entamoeba invadens
VVPFADELKRHFSLRHTKTKFKPRINYN

SEQ ID NO: 2808409 - protein, 17 aa, Entamoeba invadens
VVPFRLIDLPKYMVEDK

SEQ ID NO: 2808410 - protein, 20 aa, Entamoeba invadens
VVPICFNWPSGKHSFSKHKK

SEQ ID NO: 2808411 - protein, 25 aa, Entamoeba invadens
VVPKEKKKNCGYCITCQLRSDDIIK

SEQ ID NO: 2808412 - protein, 18 aa, Entamoeba invadens
VVPPSLYTDQIIRLELFD

SEQ ID NO: 2808413 - protein, 18 aa, Entamoeba invadens
VVPSEGKVTISVKPIVID

SEQ ID NO: 2808414 - protein, 22 aa, Entamoeba invadens
VVQKDSECKFMIGNDRASLLKI

SEQ ID NO: 2808415 - protein, 31 aa, Entamoeba invadens
VVRKFEFKPSVSLKCLFVREANVNVRVTLVE

SEQ ID NO: 2808416 - protein, 19 aa, Entamoeba invadens
VVRMHFLLFVLFEDFTEFV

SEQ ID NO: 2808417 - protein, 26 aa, Entamoeba invadens
VVRYRIIKGRRLLKEYNEEDLTSLGG

SEQ ID NO: 2808418 - protein, 24 aa, Entamoeba invadens
VVSDALNFFALFLLTTYTLSSEYF

SEQ ID NO: 2808419 - protein, 22 aa, Entamoeba invadens
VVSESGWVLAMFSDYENNTFSL

SEQ ID NO: 2808420 - protein, 23 aa, Entamoeba invadens
VVSKVTALTAWMVVQIVIGILCI

SEQ ID NO: 2808421 - protein, 17 aa, Entamoeba invadens
VVSLCLIGTAAFCPGAQ

SEQ ID NO: 2808422 - protein, 18 aa, Entamoeba invadens
VVSLRLSAVLNVSREALG

SEQ ID NO: 2808423 - protein, 22 aa, Entamoeba invadens
VVSMFWFMWLMLMSQLWQMSTQ

SEQ ID NO: 2808424 - protein, 24 aa, Entamoeba invadens
VVSMRWGLLYLLPLIFTVFSAQVY

SEQ ID NO: 2808425 - protein, 18 aa, Entamoeba invadens
VVSRGAYVILDFEKNLTN

SEQ ID NO: 2808426 - protein, 19 aa, Entamoeba invadens
VVSRKGKSVSTRWMGNFSL

SEQ ID NO: 2808427 - protein, 18 aa, Entamoeba invadens
VVSTIWFNERAYREMENS

SEQ ID NO: 2808428 - protein, 24 aa, Entamoeba invadens
VVSVYFFKFFSIFFKFFQFLPNSR

SEQ ID NO: 2808429 - protein, 21 aa, Entamoeba invadens
VVTKGMKWCRYGNVIRCVIEE

SEQ ID NO: 2808430 - protein, 23 aa, Entamoeba invadens
VVTLKYDFACEFSVFVTPLCSCN

SEQ ID NO: 2808431 - protein, 24 aa, Entamoeba invadens
VVTLKYDFACEFSVFVTPLCSCNI

SEQ ID NO: 2808432 - protein, 24 aa, Entamoeba invadens
VVTRTKPRFIVGMEQLYPFTKFVE

SEQ ID NO: 2808433 - protein, 25 aa, Entamoeba invadens
VVVAIYAFWLVFGIIRTYSETKKLG

SEQ ID NO: 2808434 - protein, 18 aa, Entamoeba invadens
VVVDLFLHRELDAKKEVS

SEQ ID NO: 2808435 - protein, 27 aa, Entamoeba invadens
VVVKKFKLSWTEEARSFFVERLGEVTQ

SEQ ID NO: 2808436 - protein, 17 aa, Entamoeba invadens
VVVLCLIVACVLSAMFC

SEQ ID NO: 2808437 - protein, 17 aa, Entamoeba invadens
VVVPFSVIILNDKHAVI

SEQ ID NO: 2808438 - protein, 17 aa, Entamoeba invadens
VVVSFRGTYSLDDCVHD

SEQ ID NO: 2808439 - protein, 18 aa, Entamoeba invadens
VVVSVLFVILVCVFFASA

SEQ ID NO: 2808440 - protein, 18 aa, Entamoeba invadens
VVWWVILICVTFAIVHRK

SEQ ID NO: 2808441 - protein, 31 aa, Entamoeba invadens
VVYIFACTRCCFGPCCLAKHGCLCPKDEKSY

SEQ ID NO: 2808442 - protein, 19 aa, Entamoeba invadens
VVYKGMFRDNVVAIKKMKA

SEQ ID NO: 2808443 - protein, 25 aa, Entamoeba invadens
VVYTFNSDFDKFLALTDQCKKLFDE

SEQ ID NO: 2808444 - protein, 20 aa, Entamoeba invadens
VVYVDTRFGQNLTPESLSNY

SEQ ID NO: 2808445 - protein, 19 aa, Entamoeba invadens
VVYVFPFCVIYPIVKNITL

SEQ ID NO: 2808446 - protein, 26 aa, Entamoeba invadens
VWAVMFCIVILRGGGKMDSVVGVQCG

SEQ ID NO: 2808447 - protein, 19 aa, Entamoeba invadens
VWGYDQCLHNSVIYSRQLD

SEQ ID NO: 2808448 - protein, 19 aa, Entamoeba invadens
VWKGIYRHNIVAIKKMKEM

SEQ ID NO: 2808449 - protein, 25 aa, Entamoeba invadens
VWQRFKGFLPNIAVIACCAIESRML

SEQ ID NO: 2808450 - protein, 17 aa, Entamoeba invadens
VWRLFTPFFVMRMGFPF

SEQ ID NO: 2808451 - protein, 24 aa, Entamoeba invadens
VWRVASALGAVPCILTLYHRIIMP

SEQ ID NO: 2808452 - protein, 19 aa, Entamoeba invadens
VWVEFGCPCRGDFCDVNAS

SEQ ID NO: 2808453 - protein, 20 aa, Entamoeba invadens
VWWVILVAVLFVFGVLFVLI

SEQ ID NO: 2808454 - protein, 26 aa, Entamoeba invadens
VWWVVLISILFCFLSIVFILISLYYF

SEQ ID NO: 2808455 - protein, 24 aa, Entamoeba invadens
VWYLHEVQSLFKILPNSLVLIEED

SEQ ID NO: 2808456 - protein, 20 aa, Entamoeba invadens
VYAFGISVLEVFQRKDPFPV

SEQ ID NO: 2808457 - protein, 26 aa, Entamoeba invadens
VYALGITFFEAFAWEEACVDVKYFFE

SEQ ID NO: 2808458 - protein, 27 aa, Entamoeba invadens
VYALGITFFEAFAWEEAYVDVKYFFEI

SEQ ID NO: 2808459 - protein, 18 aa, Entamoeba invadens
VYCFLIPAVQSFSNGTQN

SEQ ID NO: 2808460 - protein, 19 aa, Entamoeba invadens
VYCSVYFKNVYDSEAFKQT

SEQ ID NO: 2808461 - protein, 20 aa, Entamoeba invadens
VYDNILKFVMYLLSANSSEI

SEQ ID NO: 2808462 - protein, 19 aa, Entamoeba invadens
VYECLGWCNAYPISEFKFP

SEQ ID NO: 2808463 - protein, 20 aa, Entamoeba invadens
VYEIFQRFVKSEVKKEEKKI

SEQ ID NO: 2808464 - protein, 19 aa, Entamoeba invadens
VYESPKFTDILATKCLTDV

SEQ ID NO: 2808465 - protein, 36 aa, Entamoeba invadens
VYFAVTGRFPFLWIFFVLAAICFWMSHQFSPNGSFS

SEQ ID NO: 2808466 - protein, 17 aa, Entamoeba invadens
VYFWQYYLKLLVPGKTR

SEQ ID NO: 2808467 - protein, 18 aa, Entamoeba invadens
VYGCQRCSNGYYLNNVLE

SEQ ID NO: 2808468 - protein, 17 aa, Entamoeba invadens
VYGCTDCVDGYFIDQSN

SEQ ID NO: 2808469 - protein, 24 aa, Entamoeba invadens
VYGDHCELCLTGYFLNNGKCTACS

SEQ ID NO: 2808470 - protein, 26 aa, Entamoeba invadens
VYGTYKECFQCKMGYTLNNNSCETPE

SEQ ID NO: 2808471 - protein, 18 aa, Entamoeba invadens
VYHGSSFESTTLTAGQWM

SEQ ID NO: 2808472 - protein, 39 aa, Entamoeba invadens
VYICPMSIMMLWPRVEKFGSPEFRKLSVIDNIIYNKVVE

SEQ ID NO: 2808473 - protein, 17 aa, Entamoeba invadens
VYIFVHSQFGQYITEDF

SEQ ID NO: 2808474 - protein, 24 aa, Entamoeba invadens
VYIKDLNVLFVFTMQVSGNTLLQI

SEQ ID NO: 2808475 - protein, 20 aa, Entamoeba invadens
VYIVRRKNMKVFEEGEEIAV

SEQ ID NO: 2808476 - protein, 18 aa, Entamoeba invadens
VYKGFFRGNIVAIKKMKS

SEQ ID NO: 2808477 - protein, 17 aa, Entamoeba invadens
VYKGIFRGKSVAIKKMK

SEQ ID NO: 2808478 - protein, 18 aa, Entamoeba invadens
VYKGIFRGSVVAIKRLKN

SEQ ID NO: 2808479 - protein, 18 aa, Entamoeba invadens
VYKGSFRGICVAIKKMKE

SEQ ID NO: 2808480 - protein, 20 aa, Entamoeba invadens
VYKLSFLLLVNLLFFLCELI

SEQ ID NO: 2808481 - protein, 19 aa, Entamoeba invadens
VYKQRGIVHQMMRNYEKAR

SEQ ID NO: 2808482 - protein, 27 aa, Entamoeba invadens
VYLCIPAIVLFLFKIVRYGVSDMINFW

SEQ ID NO: 2808483 - protein, 18 aa, Entamoeba invadens
VYLECIREAKAQDAKENL

SEQ ID NO: 2808484 - protein, 17 aa, Entamoeba invadens
VYLERMEPTIIPVPNGM

SEQ ID NO: 2808485 - protein, 21 aa, Entamoeba invadens
VYLGITFRMMECVLSLEMTCV

SEQ ID NO: 2808486 - protein, 17 aa, Entamoeba invadens
VYLGLYLLKALLTKADN

SEQ ID NO: 2808487 - protein, 17 aa, Entamoeba invadens
VYLSDAPFLYSPSIIAL

SEQ ID NO: 2808488 - protein, 18 aa, Entamoeba invadens
VYLSFGWMYAKRVEKKQE

SEQ ID NO: 2808489 - protein, 17 aa, Entamoeba invadens
VYLTGYVLMRFIDTPVR

SEQ ID NO: 2808490 - protein, 23 aa, Entamoeba invadens
VYMIIEIYGFFGVENPKRGTINN

SEQ ID NO: 2808491 - protein, 23 aa, Entamoeba invadens
VYMMYFPIMFYYLMGNRVVETGD

SEQ ID NO: 2808492 - protein, 18 aa, Entamoeba invadens
VYMYPWTIADDVASGKRP

SEQ ID NO: 2808493 - protein, 19 aa, Entamoeba invadens
VYNVYKYRTLYGDYDKEKT

SEQ ID NO: 2808494 - protein, 18 aa, Entamoeba invadens
VYPLVGFGIIMLCKRPHP

SEQ ID NO: 2808495 - protein, 21 aa, Entamoeba invadens
VYPYKCILCDITCNGQCDATT

SEQ ID NO: 2808496 - protein, 19 aa, Entamoeba invadens
VYRCSICKNGYGFNSGDVC

SEQ ID NO: 2808497 - protein, 18 aa, Entamoeba invadens
VYRGKYRGNCVAIKRMKN

SEQ ID NO: 2808498 - protein, 24 aa, Entamoeba invadens
VYSCAETWGGVPVGVFAEIIQNGV

SEQ ID NO: 2808499 - protein, 19 aa, Entamoeba invadens
VYSDGKYNWELNDSAMLNI

SEQ ID NO: 2808500 - protein, 23 aa, Entamoeba invadens
VYSFAITAWEVFYQEEPYKDFKS

SEQ ID NO: 2808501 - protein, 23 aa, Entamoeba invadens
VYSFAITAWEVFYQREPYNDFKS

SEQ ID NO: 2808502 - protein, 25 aa, Entamoeba invadens
VYSFAITMFEVFGWQDAYNQDIFKF

SEQ ID NO: 2808503 - protein, 17 aa, Entamoeba invadens
VYSFAVTMFECFGWCNA

SEQ ID NO: 2808504 - protein, 23 aa, Entamoeba invadens
VYSFGILCWEFFYEQRTFEKSKT

SEQ ID NO: 2808505 - protein, 23 aa, Entamoeba invadens
VYSFGILCWEFFYEQRTFGKYKT

SEQ ID NO: 2808506 - protein, 25 aa, Entamoeba invadens
VYSFGISMFEVFGWCEAYPKTQFMF

SEQ ID NO: 2808507 - protein, 18 aa, Entamoeba invadens
VYSFGITAWEIFYQEEPF

SEQ ID NO: 2808508 - protein, 18 aa, Entamoeba invadens
VYSFGITAWEVFYQEEPY

SEQ ID NO: 2808509 - protein, 22 aa, Entamoeba invadens
VYSFGIVLWEFLTRKRPYGKMD

SEQ ID NO: 2808510 - protein, 23 aa, Entamoeba invadens
VYSFGIVMWEFLTRDVPYKNVPP

SEQ ID NO: 2808511 - protein, 27 aa, Entamoeba invadens
VYSLSIDWCWEGDVLNCFQKIIEQCDS

SEQ ID NO: 2808512 - protein, 19 aa, Entamoeba invadens
VYSSLSFVPVMFLAYILGS

SEQ ID NO: 2808513 - protein, 24 aa, Entamoeba invadens
VYSYAITILEIWIGKCPYNPLQFP

SEQ ID NO: 2808514 - protein, 25 aa, Entamoeba invadens
VYSYAITLLELWKGKEIYNKNIFSD

SEQ ID NO: 2808515 - protein, 25 aa, Entamoeba invadens
VYSYKGFKMLTGIYCKSGYYYNKTL

SEQ ID NO: 2808516 - protein, 20 aa, Entamoeba invadens
VYTDKSCIVSEEFPTLTSNQ

SEQ ID NO: 2808517 - protein, 27 aa, Entamoeba invadens
VYTFLRFRLVTLGGFIIPAAFQGRFCV

SEQ ID NO: 2808518 - protein, 24 aa, Entamoeba invadens
VYTRNSYGFLVVYSITDRVLFDEL

SEQ ID NO: 2808519 - protein, 25 aa, Entamoeba invadens
VYTVLGLICSLCFGKKTVSPITSNW

SEQ ID NO: 2808520 - protein, 25 aa, Entamoeba invadens
VYVLLLCFISRAFNIFPITFIMNCR

SEQ ID NO: 2808521 - protein, 18 aa, Entamoeba invadens
VYWCKFKSIVKPEEDNKY

SEQ ID NO: 2808522 - protein, 25 aa, Entamoeba invadens
VYYYKYTATTGFVFKMYTVPPVLEN

SEQ ID NO: 2808523 - protein, 18 aa, Entamoeba invadens
VYYYLTLSDRVNFTAKLP

SEQ ID NO: 2808524 - protein, 18 aa, Entamoeba invadens
WAEIAVLFLLLVPLPAIL

SEQ ID NO: 2808525 - protein, 19 aa, Entamoeba invadens
WAEKGYRTLSLSFKDMEPA

SEQ ID NO: 2808526 - protein, 24 aa, Entamoeba invadens
WAGFDWGVVESILLGSVNRVNEQS

SEQ ID NO: 2808527 - protein, 17 aa, Entamoeba invadens
WAHVPFVGMITIALTDY

SEQ ID NO: 2808528 - protein, 17 aa, Entamoeba invadens
WAISRNRFWGTPIPIWT

SEQ ID NO: 2808529 - protein, 18 aa, Entamoeba invadens
WALLMYIYYIHTMAAIKV

SEQ ID NO: 2808530 - protein, 17 aa, Entamoeba invadens
WATIIQVFGFVVLTFGF

SEQ ID NO: 2808531 - protein, 17 aa, Entamoeba invadens
WAVMILWGTLCMCEVIL

SEQ ID NO: 2808532 - protein, 18 aa, Entamoeba invadens
WCAIDTVISLIFFGTIEF

SEQ ID NO: 2808533 - protein, 19 aa, Entamoeba invadens
WCFEFKVRIVIDEVVEELE

SEQ ID NO: 2808534 - protein, 21 aa, Entamoeba invadens
WCGVFKTIFCLQCERFQQGDA

SEQ ID NO: 2808535 - protein, 30 aa, Entamoeba invadens
WCKAYPTETFKFPWKIAEFVMSGKRLERRE

SEQ ID NO: 2808536 - protein, 29 aa, Entamoeba invadens
WCNAYPISEFKFPWSIAEFVTSKKRLSKT

SEQ ID NO: 2808537 - protein, 22 aa, Entamoeba invadens
WCNELPQHLQFHYFISINPKFK

SEQ ID NO: 2808538 - protein, 20 aa, Entamoeba invadens
WCSPCNSSLCSICTDGKESS

SEQ ID NO: 2808539 - protein, 17 aa, Entamoeba invadens
WCVENALNFKALSTALS

SEQ ID NO: 2808540 - protein, 20 aa, Entamoeba invadens
WDCVTRSSVLTLVLTQDIVY

SEQ ID NO: 2808541 - protein, 17 aa, Entamoeba invadens
WDIKPKKRILCDEIVKR

SEQ ID NO: 2808542 - protein, 18 aa, Entamoeba invadens
WDLESFLPSFKEGFCKKL

SEQ ID NO: 2808543 - protein, 20 aa, Entamoeba invadens
WDLKITPDMVFLRKNQAVNL

SEQ ID NO: 2808544 - protein, 26 aa, Entamoeba invadens
WDNPFPKTIYLFAWSIADEISVGKRP

SEQ ID NO: 2808545 - protein, 26 aa, Entamoeba invadens
WDNPFPKTIYPFAWSIADEISVGKRP

SEQ ID NO: 2808546 - protein, 17 aa, Entamoeba invadens
WDRCFEFCMSLKSIKIA

SEQ ID NO: 2808547 - protein, 18 aa, Entamoeba invadens
WDSFYTVIEDIEILPNGN

SEQ ID NO: 2808548 - protein, 18 aa, Entamoeba invadens
WDTDFTIRKYLLLTPSGY

SEQ ID NO: 2808549 - protein, 19 aa, Entamoeba invadens
WDTLKESFEFLRVVPDFHF

SEQ ID NO: 2808550 - protein, 19 aa, Entamoeba invadens
WDVDPAKRPEFKEVALLLQ

SEQ ID NO: 2808551 - protein, 18 aa, Entamoeba invadens
WDVSDFVIKGGRLDIPKN

SEQ ID NO: 2808552 - protein, 31 aa, Entamoeba invadens
WDYRGNVIKYNRIYNLTGWGKSNSYVQGIYM

SEQ ID NO: 2808553 - protein, 23 aa, Entamoeba invadens
WEADRVTIKYGIMGKLTGMRLVG

SEQ ID NO: 2808554 - protein, 20 aa, Entamoeba invadens
WECADGYKLRDDKIECFTDN

SEQ ID NO: 2808555 - protein, 19 aa, Entamoeba invadens
WECADGYKLSADKIECFAN

SEQ ID NO: 2808556 - protein, 26 aa, Entamoeba invadens
WEDPFPKTIFCYAWSVADHISTGKRP

SEQ ID NO: 2808557 - protein, 23 aa, Entamoeba invadens
WEEEINVNVSLRFFDLNYESAWL

SEQ ID NO: 2808558 - protein, 23 aa, Entamoeba invadens
WEEVPIIFVCLTIILSYLTIIVV

SEQ ID NO: 2808559 - protein, 25 aa, Entamoeba invadens
WEFNLRDVLRYCKLYSEYSQRIDTD

SEQ ID NO: 2808560 - protein, 18 aa, Entamoeba invadens
WEGCVGCNDIMCSSCQQN

SEQ ID NO: 2808561 - protein, 21 aa, Entamoeba invadens
WEGKKLSSFKVNSDYYRVTNL

SEQ ID NO: 2808562 - protein, 21 aa, Entamoeba invadens
WEIVFLYFTGFFRAMFFTFTI

SEQ ID NO: 2808563 - protein, 20 aa, Entamoeba invadens
WEKPMVKKTLAKRVLEIIFL

SEQ ID NO: 2808564 - protein, 17 aa, Entamoeba invadens
WEKSVRVLGCSTPGRDF

SEQ ID NO: 2808565 - protein, 19 aa, Entamoeba invadens
WELLEPFKDCVRYFSYASS

SEQ ID NO: 2808566 - protein, 19 aa, Entamoeba invadens
WELVHLYFTGFFRALFYMV

SEQ ID NO: 2808567 - protein, 24 aa, Entamoeba invadens
WENKTCEFCFVIPKGEIIKKSMHK

SEQ ID NO: 2808568 - protein, 20 aa, Entamoeba invadens
WEPLLKYVIPPTIAPNVITL

SEQ ID NO: 2808569 - protein, 17 aa, Entamoeba invadens
WEQPLFLLVEFFYNKQM

SEQ ID NO: 2808570 - protein, 21 aa, Entamoeba invadens
WESAILPTNWFERGFQFLHAC

SEQ ID NO: 2808571 - protein, 25 aa, Entamoeba invadens
WETVIPPQQFVGAPINQFFDFQFTS

SEQ ID NO: 2808572 - protein, 19 aa, Entamoeba invadens
WEWMNCFMTAGTFKAFLNL

SEQ ID NO: 2808573 - protein, 23 aa, Entamoeba invadens
WEYNGILSLPITYLITSIDDDTV

SEQ ID NO: 2808574 - protein, 21 aa, Entamoeba invadens
WEYTTIMGFTIAMMENMFEPE

SEQ ID NO: 2808575 - protein, 23 aa, Entamoeba invadens
WFCKEMRIKAYVQIMRSYLAVRL

SEQ ID NO: 2808576 - protein, 20 aa, Entamoeba invadens
WFCQMPSSWAASTVNKRDMI

SEQ ID NO: 2808577 - protein, 26 aa, Entamoeba invadens
WFDGLMLLLGLCGSLAAGILQPMMML

SEQ ID NO: 2808578 - protein, 24 aa, Entamoeba invadens
WFDPDSWYPLGRNIGTTVFPGLMF

SEQ ID NO: 2808579 - protein, 19 aa, Entamoeba invadens
WFFAGEILILHVLKEQPNA

SEQ ID NO: 2808580 - protein, 28 aa, Entamoeba invadens
WFFQKYKIKFAIVFSLFCVVLVTVSACA

SEQ ID NO: 2808581 - protein, 18 aa, Entamoeba invadens
WFLQRSDWIGALISIVTV

SEQ ID NO: 2808582 - protein, 18 aa, Entamoeba invadens
WFLYCFSKKESRAIPLCL

SEQ ID NO: 2808583 - protein, 19 aa, Entamoeba invadens
WFRVVPSFHTILLSLCESS

SEQ ID NO: 2808584 - protein, 19 aa, Entamoeba invadens
WFVYGVIQAGIFFSLFYFV

SEQ ID NO: 2808585 - protein, 18 aa, Entamoeba invadens
WFWYARFKYCCKSSRVKS

SEQ ID NO: 2808586 - protein, 17 aa, Entamoeba invadens
WFYEFVVNLHVRRFMLP

SEQ ID NO: 2808587 - protein, 17 aa, Entamoeba invadens
WFYFCPTSLLLWLFTGG

SEQ ID NO: 2808588 - protein, 17 aa, Entamoeba invadens
WFYLIYKYHNSPLKNDK

SEQ ID NO: 2808589 - protein, 26 aa, Entamoeba invadens
WFYLLCLVCLSVFFANSINMYAGVNG

SEQ ID NO: 2808590 - protein, 17 aa, Entamoeba invadens
WGEAYPKTEFKFPWKIA

SEQ ID NO: 2808591 - protein, 21 aa, Entamoeba invadens
WGEDIRYALNIEGEKKAGAGG

SEQ ID NO: 2808592 - protein, 20 aa, Entamoeba invadens
WGGLYPVAEFPYPWSVAEFV

SEQ ID NO: 2808593 - protein, 20 aa, Entamoeba invadens
WGGQPFKWFNFACMVLYIYG

SEQ ID NO: 2808594 - protein, 31 aa, Entamoeba invadens
WGTPYIYKSLCVIQSPFLDFLLSWKLFGMLY

SEQ ID NO: 2808595 - protein, 17 aa, Entamoeba invadens
WGTTRLYKRDMCKKTSS

SEQ ID NO: 2808596 - protein, 22 aa, Entamoeba invadens
WGVGKTTWWAFIIKYLILLFPI

SEQ ID NO: 2808597 - protein, 18 aa, Entamoeba invadens
WHGYYLVFRSFDFYLVCL

SEQ ID NO: 2808598 - protein, 18 aa, Entamoeba invadens
WHKVCLASSDSTHVGVYV

SEQ ID NO: 2808599 - protein, 18 aa, Entamoeba invadens
WHLKNLQKIRIFLKDLNF

SEQ ID NO: 2808600 - protein, 18 aa, Entamoeba invadens
WHPKLDFRIVVLHKNDIS

SEQ ID NO: 2808601 - protein, 21 aa, Entamoeba invadens
WICEGGKMPRAGHPLIDPERT

SEQ ID NO: 2808602 - protein, 18 aa, Entamoeba invadens
WICTSIFQGTLIILVALI

SEQ ID NO: 2808603 - protein, 19 aa, Entamoeba invadens
WIDKNSFMMDYRFLLFPCI

SEQ ID NO: 2808604 - protein, 23 aa, Entamoeba invadens
WIFSVLCGMVSILVGQIALFIPV

SEQ ID NO: 2808605 - protein, 18 aa, Entamoeba invadens
WIGFGSMFTHMAFALACQ

SEQ ID NO: 2808606 - protein, 17 aa, Entamoeba invadens
WIGKCPYSPLLFPDNES

SEQ ID NO: 2808607 - protein, 17 aa, Entamoeba invadens
WIHNDIEGWRNLVKRGL

SEQ ID NO: 2808608 - protein, 23 aa, Entamoeba invadens
WIIAICMLIGYGVLSRVVERQMT

SEQ ID NO: 2808609 - protein, 18 aa, Entamoeba invadens
WIKCDIQKALLCSENYKT

SEQ ID NO: 2808610 - protein, 17 aa, Entamoeba invadens
WILRIIIKKKENKAMLF

SEQ ID NO: 2808611 - protein, 17 aa, Entamoeba invadens
WILSSLMSLVKKVREEM

SEQ ID NO: 2808612 - protein, 24 aa, Entamoeba invadens
WINVFSQLILSFVMTCNEENIEEI

SEQ ID NO: 2808613 - protein, 24 aa, Entamoeba invadens
WINVSTVALEWVKLSVVIQKTCLD

SEQ ID NO: 2808614 - protein, 18 aa, Entamoeba invadens
WIPGTAFFYTVEHLLWFP

SEQ ID NO: 2808615 - protein, 18 aa, Entamoeba invadens
WIQLNFGKKGVCSIQGLV

SEQ ID NO: 2808616 - protein, 20 aa, Entamoeba invadens
WIRRYISSSIADDFVQRNIS

SEQ ID NO: 2808617 - protein, 18 aa, Entamoeba invadens
WISASVMVFLIFVALFGA

SEQ ID NO: 2808618 - protein, 25 aa, Entamoeba invadens
WISRENLRFGNIIGEDGEEWKSGWY

SEQ ID NO: 2808619 - protein, 20 aa, Entamoeba invadens
WITSMFDGFIVLKVPFPLSY

SEQ ID NO: 2808620 - protein, 26 aa, Entamoeba invadens
WIVFICIVCLLAIIFAVFGIWCLINF

SEQ ID NO: 2808621 - protein, 18 aa, Entamoeba invadens
WIYACSLTYIDMVIQCRL

SEQ ID NO: 2808622 - protein, 17 aa, Entamoeba invadens
WIYDFQGSYSIGKRRQT

SEQ ID NO: 2808623 - protein, 17 aa, Entamoeba invadens
WKCAECSDGYYLENGDC

SEQ ID NO: 2808624 - protein, 21 aa, Entamoeba invadens
WKCGFQGCNKLPMTRYNAYAH

SEQ ID NO: 2808625 - protein, 27 aa, Entamoeba invadens
WKDPFPKVKFGYAWNVANFVSSGKHLE

SEQ ID NO: 2808626 - protein, 27 aa, Entamoeba invadens
WKDPYPKEFFKFAWSIADFVASGKHLP

SEQ ID NO: 2808627 - protein, 29 aa, Entamoeba invadens
WKEAFPKSEFKYPWKIADFVNNGNRLQKV

SEQ ID NO: 2808628 - protein, 22 aa, Entamoeba invadens
WKEVMGGNVLVWLIPFFANPNS

SEQ ID NO: 2808629 - protein, 26 aa, Entamoeba invadens
WKHQLMLWYAGLRGAIAILLSLTMGS

SEQ ID NO: 2808630 - protein, 17 aa, Entamoeba invadens
WKIAEFVIHNNRLKRKD

SEQ ID NO: 2808631 - protein, 32 aa, Entamoeba invadens
WKIELYFLDLTLMFWIAIAMTIALVILGIIML

SEQ ID NO: 2808632 - protein, 19 aa, Entamoeba invadens
WKKIKMLGSVGEVRTPGVR

SEQ ID NO: 2808633 - protein, 28 aa, Entamoeba invadens
WKKLLTRWSTMIWRCDENIPKSNGAQGN

SEQ ID NO: 2808634 - protein, 19 aa, Entamoeba invadens
WKLINFTSICVLDTNNGIY

SEQ ID NO: 2808635 - protein, 21 aa, Entamoeba invadens
WKLTFFYCWELGYHFHSLVHH

SEQ ID NO: 2808636 - protein, 23 aa, Entamoeba invadens
WKNCGICNGFGVLGYGFSANYVL

SEQ ID NO: 2808637 - protein, 21 aa, Entamoeba invadens
WKNEKCLVCDEGYFHDVNNSC

SEQ ID NO: 2808638 - protein, 17 aa, Entamoeba invadens
WKNFTLFGAGTFILIIG

SEQ ID NO: 2808639 - protein, 18 aa, Entamoeba invadens
WKQKSERLAREKQEKEKQ

SEQ ID NO: 2808640 - protein, 17 aa, Entamoeba invadens
WKTLKVSGCGAATSTHE

SEQ ID NO: 2808641 - protein, 17 aa, Entamoeba invadens
WKTMTVLVDYFIIGVTI

SEQ ID NO: 2808642 - protein, 18 aa, Entamoeba invadens
WKWGNFGVLFSHISVAFS

SEQ ID NO: 2808643 - protein, 18 aa, Entamoeba invadens
WKYISQFVFCSAKQQELN

SEQ ID NO: 2808644 - protein, 17 aa, Entamoeba invadens
WKYPLKKFGECSTTMSE

SEQ ID NO: 2808645 - protein, 17 aa, Entamoeba invadens
WKYQGVVPITAKCRSVK

SEQ ID NO: 2808646 - protein, 17 aa, Entamoeba invadens
WKYSYITFLASMLPNTI

SEQ ID NO: 2808647 - protein, 28 aa, Entamoeba invadens
WKYTKNMWVKGYFKYMWADNTAQIVSID

SEQ ID NO: 2808648 - protein, 18 aa, Entamoeba invadens
WLAKRIGYKGGECDGGNI

SEQ ID NO: 2808649 - protein, 17 aa, Entamoeba invadens
WLDYLWMASSFIVPCRF

SEQ ID NO: 2808650 - protein, 21 aa, Entamoeba invadens
WLFCVVQWTACAGLVIMFIAC

SEQ ID NO: 2808651 - protein, 25 aa, Entamoeba invadens
WLILMWFLLYFMLRVQSIGPAVLGK

SEQ ID NO: 2808652 - protein, 19 aa, Entamoeba invadens
WLLARAGVLIYIFACLLLM

SEQ ID NO: 2808653 - protein, 18 aa, Entamoeba invadens
WLLIPSFIGLIIIYIFQA

SEQ ID NO: 2808654 - protein, 19 aa, Entamoeba invadens
WLNCIGALLSVCSVPLYAL

SEQ ID NO: 2808655 - protein, 17 aa, Entamoeba invadens
WLPFVSLSKDFSEKEYT

SEQ ID NO: 2808656 - protein, 19 aa, Entamoeba invadens
WLTAVGFRDELYWQNIKKD

SEQ ID NO: 2808657 - protein, 19 aa, Entamoeba invadens
WLTAVGIRDVEYWDKIRDN

SEQ ID NO: 2808658 - protein, 19 aa, Entamoeba invadens
WLVKNGFCRVSELHNGFYG

SEQ ID NO: 2808659 - protein, 20 aa, Entamoeba invadens
WMEKEMKSNALIRPLLFIIK

SEQ ID NO: 2808660 - protein, 23 aa, Entamoeba invadens
WMGNGYIKFSTVFRGISAGIILG

SEQ ID NO: 2808661 - protein, 24 aa, Entamoeba invadens
WMKMHPTIKYKPLISYATALMVEP

SEQ ID NO: 2808662 - protein, 30 aa, Entamoeba invadens
WMLKIDIMVQFKIKIYIRKMNYKTRKRENE

SEQ ID NO: 2808663 - protein, 19 aa, Entamoeba invadens
WMNYLYRITFWVQVLCEVI

SEQ ID NO: 2808664 - protein, 20 aa, Entamoeba invadens
WMVCTFCFIAPMIVLGVVLL

SEQ ID NO: 2808665 - protein, 25 aa, Entamoeba invadens
WMVPFIQLVCAFAIYPEFGSHFEEA

SEQ ID NO: 2808666 - protein, 17 aa, Entamoeba invadens
WNAYCLKNNNQITSIVS

SEQ ID NO: 2808667 - protein, 32 aa, Entamoeba invadens
WNDISKFAVYVLRSIARFILYVYKNVRHVFVD

SEQ ID NO: 2808668 - protein, 18 aa, Entamoeba invadens
WNEKLVFQFPLEKIVKMY

SEQ ID NO: 2808669 - protein, 17 aa, Entamoeba invadens
WNFFMRRHSIWVRINEV

SEQ ID NO: 2808670 - protein, 19 aa, Entamoeba invadens
WNFPIDWISFSFLLFNFGV

SEQ ID NO: 2808671 - protein, 28 aa, Entamoeba invadens
WNIKLLAGICSEEFWSIIYKEMNTLALP

SEQ ID NO: 2808672 - protein, 19 aa, Entamoeba invadens
WNKIIWKKTNWKGESLQCT

SEQ ID NO: 2808673 - protein, 18 aa, Entamoeba invadens
WNKNVIMAINMKSTAVEF

SEQ ID NO: 2808674 - protein, 19 aa, Entamoeba invadens
WNLDIKYALLLESDSPESR

SEQ ID NO: 2808675 - protein, 20 aa, Entamoeba invadens
WNLDIYKWYTIYSNNPMMWI

SEQ ID NO: 2808676 - protein, 29 aa, Entamoeba invadens
WNRNGCACDGEYCHLIFKRDGVEEYTINN

SEQ ID NO: 2808677 - protein, 18 aa, Entamoeba invadens
WNSVEFCHCGDFMLESAG

SEQ ID NO: 2808678 - protein, 18 aa, Entamoeba invadens
WNTADGRVLLAILKVICS

SEQ ID NO: 2808679 - protein, 19 aa, Entamoeba invadens
WNTKMIFVWVKASFETEKT

SEQ ID NO: 2808680 - protein, 17 aa, Entamoeba invadens
WNVADYIASGRRRELQS

SEQ ID NO: 2808681 - protein, 17 aa, Entamoeba invadens
WNVATGVVNGLRPNISS

SEQ ID NO: 2808682 - protein, 19 aa, Entamoeba invadens
WNYDVCDLSAAGDLTISSD

SEQ ID NO: 2808683 - protein, 23 aa, Entamoeba invadens
WNYPDCRYNHSLYDLDLTNDVDN

SEQ ID NO: 2808684 - protein, 17 aa, Entamoeba invadens
WNYRYTFNPNLVMWTIF

SEQ ID NO: 2808685 - protein, 26 aa, Entamoeba invadens
WPKQVAPLCAWRVVYLGFMCADLLYS

SEQ ID NO: 2808686 - protein, 17 aa, Entamoeba invadens
WPLFLFLVIQGVGLSMF

SEQ ID NO: 2808687 - protein, 26 aa, Entamoeba invadens
WPTINLRFNYDIFKEGFDCVGIDDYP

SEQ ID NO: 2808688 - protein, 19 aa, Entamoeba invadens
WPTLFCENGVAIKQMIIVP

SEQ ID NO: 2808689 - protein, 19 aa, Entamoeba invadens
WPTSLKFEIAKKFVEFFVT

SEQ ID NO: 2808690 - protein, 17 aa, Entamoeba invadens
WPVVIPKMYESLKQHER

SEQ ID NO: 2808691 - protein, 17 aa, Entamoeba invadens
WQGWIFSVLCGMVSILV

SEQ ID NO: 2808692 - protein, 22 aa, Entamoeba invadens
WQIPAESNLCYFGSKDCDQYCQ

SEQ ID NO: 2808693 - protein, 18 aa, Entamoeba invadens
WQLSHVDLSWTLTQPQNN

SEQ ID NO: 2808694 - protein, 24 aa, Entamoeba invadens
WQSIVLPFLLGLILPVVSNIVPIR

SEQ ID NO: 2808695 - protein, 20 aa, Entamoeba invadens
WRALVMTGTIFKQGDLYDFS

SEQ ID NO: 2808696 - protein, 17 aa, Entamoeba invadens
WRAWRILQGINILVLVL

SEQ ID NO: 2808697 - protein, 17 aa, Entamoeba invadens
WRDELLLNSLFYERQYF

SEQ ID NO: 2808698 - protein, 19 aa, Entamoeba invadens
WRDILRYAYDLLLHKIGKR

SEQ ID NO: 2808699 - protein, 22 aa, Entamoeba invadens
WRDTFIRLSSYILGEYASLVVK

SEQ ID NO: 2808700 - protein, 30 aa, Entamoeba invadens
WREAFPKSEFKYPWKIPDFVNGGNRLQKID

SEQ ID NO: 2808701 - protein, 18 aa, Entamoeba invadens
WRFFCFSLMALTCLVHIF

SEQ ID NO: 2808702 - protein, 20 aa, Entamoeba invadens
WRHFVWTYNDNGVWVTKTMN

SEQ ID NO: 2808703 - protein, 21 aa, Entamoeba invadens
WRPTTIVCFQFNDALYDLFLD

SEQ ID NO: 2808704 - protein, 19 aa, Entamoeba invadens
WRYTVVNPDTGFWYLDSYL

SEQ ID NO: 2808705 - protein, 20 aa, Entamoeba invadens
WSACAGLLVMLISVFLNIVI

SEQ ID NO: 2808706 - protein, 19 aa, Entamoeba invadens
WSDKLPLLLIQSESDSISS

SEQ ID NO: 2808707 - protein, 17 aa, Entamoeba invadens
WSFPSLDAGLPCTSGAG

SEQ ID NO: 2808708 - protein, 23 aa, Entamoeba invadens
WSGIWCYPCYAVVTSLLLCVTSF

SEQ ID NO: 2808709 - protein, 17 aa, Entamoeba invadens
WSGRVNGMGCLSTLVTL

SEQ ID NO: 2808710 - protein, 25 aa, Entamoeba invadens
WSGWQYKQMFNLLAFGAMLVVSIGL

SEQ ID NO: 2808711 - protein, 23 aa, Entamoeba invadens
WSLCASLEYACLAFLNTTFITIY

SEQ ID NO: 2808712 - protein, 17 aa, Entamoeba invadens
WSLLISVLFWNINGVDG

SEQ ID NO: 2808713 - protein, 22 aa, Entamoeba invadens
WSNCLNFIYVIVCVIDKSCNNI

SEQ ID NO: 2808714 - protein, 17 aa, Entamoeba invadens
WSNGRIKVMQNVINEYG

SEQ ID NO: 2808715 - protein, 18 aa, Entamoeba invadens
WSQCPFFDLYDLKPNNKA

SEQ ID NO: 2808716 - protein, 22 aa, Entamoeba invadens
WSSIPKPISFQMFNKTIRNLLN

SEQ ID NO: 2808717 - protein, 19 aa, Entamoeba invadens
WSSRLKILLQTNFLYFINT

SEQ ID NO: 2808718 - protein, 18 aa, Entamoeba invadens
WSSVLYLAQDLGIFSTLL

SEQ ID NO: 2808719 - protein, 17 aa, Entamoeba invadens
WSTISGLEKLCTYSESG

SEQ ID NO: 2808720 - protein, 26 aa, Entamoeba invadens
WSTYFRYFSAGGFFWLFLLIVPFILR

SEQ ID NO: 2808721 - protein, 27 aa, Entamoeba invadens
WSVPERIFWYWIMLHLTYYEMIWSLFK

SEQ ID NO: 2808722 - protein, 25 aa, Entamoeba invadens
WSVSISRFILIIPFNTYEDTTNVVR

SEQ ID NO: 2808723 - protein, 17 aa, Entamoeba invadens
WSYNIFHKIHVIAFGCI

SEQ ID NO: 2808724 - protein, 23 aa, Entamoeba invadens
WSYTEPYCPLGNDVDWYITPLYN

SEQ ID NO: 2808725 - protein, 21 aa, Entamoeba invadens
WTCKKCDDNNCKTCEISTDEK

SEQ ID NO: 2808726 - protein, 21 aa, Entamoeba invadens
WTCKKCDDNNCKTCEISTKET

SEQ ID NO: 2808727 - protein, 18 aa, Entamoeba invadens
WTDMFPNMFDEIATGPSL

SEQ ID NO: 2808728 - protein, 28 aa, Entamoeba invadens
WTDPYPKQSFMFAWSIADFISSGKRLEI

SEQ ID NO: 2808729 - protein, 19 aa, Entamoeba invadens
WTFPDCRYNSSLFDLDLTT

SEQ ID NO: 2808730 - protein, 26 aa, Entamoeba invadens
WTFVSEIIVALPLYYSHFAVEGNDRW

SEQ ID NO: 2808731 - protein, 18 aa, Entamoeba invadens
WTGQCIGTYNLRYFIQFL

SEQ ID NO: 2808732 - protein, 17 aa, Entamoeba invadens
WTKKEIVNEGVEFYENV

SEQ ID NO: 2808733 - protein, 17 aa, Entamoeba invadens
WTKTVIDIGSGKGYLLH

SEQ ID NO: 2808734 - protein, 20 aa, Entamoeba invadens
WTKVFCKLLAFVPGILFACA

SEQ ID NO: 2808735 - protein, 18 aa, Entamoeba invadens
WTLDCNKIQEGSKLVFVG

SEQ ID NO: 2808736 - protein, 19 aa, Entamoeba invadens
WTLDFGLKSSKAIVDTAYT

SEQ ID NO: 2808737 - protein, 18 aa, Entamoeba invadens
WTLNFGHAGSKVVIDQPY

SEQ ID NO: 2808738 - protein, 18 aa, Entamoeba invadens
WTLTQQFLDDEFAGLTGA

SEQ ID NO: 2808739 - protein, 17 aa, Entamoeba invadens
WTNNVYKEHALTYVEEV

SEQ ID NO: 2808740 - protein, 23 aa, Entamoeba invadens
WTQTGMVVGLLFSVLMFVVSICY

SEQ ID NO: 2808741 - protein, 22 aa, Entamoeba invadens
WTRTAGFAGLDFGRISSGCLVM

SEQ ID NO: 2808742 - protein, 18 aa, Entamoeba invadens
WTSIVFKSIESDCCSKSH

SEQ ID NO: 2808743 - protein, 24 aa, Entamoeba invadens
WTTEFFDQRVAFLGTTIVDLQSQV

SEQ ID NO: 2808744 - protein, 25 aa, Entamoeba invadens
WVDRNCLMLDKFSGKCLRCQENMYY

SEQ ID NO: 2808745 - protein, 22 aa, Entamoeba invadens
WVEFQNKFYLGDGVRFVPFAFK

SEQ ID NO: 2808746 - protein, 18 aa, Entamoeba invadens
WVFNAPMTGVSPSLFPII

SEQ ID NO: 2808747 - protein, 18 aa, Entamoeba invadens
WVGIFAVSKAFYAMFNVV

SEQ ID NO: 2808748 - protein, 25 aa, Entamoeba invadens
WVGYLIRALCLILMFLSNASGGFFF

SEQ ID NO: 2808749 - protein, 19 aa, Entamoeba invadens
WVILICVIVALLILTIKNI

SEQ ID NO: 2808750 - protein, 21 aa, Entamoeba invadens
WVILLCVLFIISIFVIIIAMS

SEQ ID NO: 2808751 - protein, 19 aa, Entamoeba invadens
WVILLCVLFVIVIFIIIIA

SEQ ID NO: 2808752 - protein, 18 aa, Entamoeba invadens
WVKKMGGVEAIHKMNEEK

SEQ ID NO: 2808753 - protein, 18 aa, Entamoeba invadens
WVLENSVEDLDMKFCYEH

SEQ ID NO: 2808754 - protein, 18 aa, Entamoeba invadens
WVLLFDLFGSVVYAFLYY

SEQ ID NO: 2808755 - protein, 17 aa, Entamoeba invadens
WVLYLQMSFVVFVFSCA

SEQ ID NO: 2808756 - protein, 18 aa, Entamoeba invadens
WVVVMGIIEGVVFLLYNI

SEQ ID NO: 2808757 - protein, 18 aa, Entamoeba invadens
WWFLPFAGVIVFVIAFPA

SEQ ID NO: 2808758 - protein, 19 aa, Entamoeba invadens
WWSFIPVAYLLQFKYTYNI

SEQ ID NO: 2808759 - protein, 18 aa, Entamoeba invadens
WWVYKHKNELFLFVNGTE

SEQ ID NO: 2808760 - protein, 21 aa, Entamoeba invadens
WYCVVPLIGAVVFCVIGSMVI

SEQ ID NO: 2808761 - protein, 23 aa, Entamoeba invadens
WYEDNRLCVAMEYFSKKSLFDVL

SEQ ID NO: 2808762 - protein, 23 aa, Entamoeba invadens
WYEYYVVLCAPYILIFENEEKFR

SEQ ID NO: 2808763 - protein, 21 aa, Entamoeba invadens
WYFEHIYIIVVLFFALLFDST

SEQ ID NO: 2808764 - protein, 24 aa, Entamoeba invadens
WYFILSCLTFFITGVLGLVVGILC

SEQ ID NO: 2808765 - protein, 21 aa, Entamoeba invadens
WYFSARDPDIFLVGFATATPP

SEQ ID NO: 2808766 - protein, 18 aa, Entamoeba invadens
WYFVSIYFIGLMVSGIFT

SEQ ID NO: 2808767 - protein, 20 aa, Entamoeba invadens
WYGHDARLLYEMRSAYLESL

SEQ ID NO: 2808768 - protein, 17 aa, Entamoeba invadens
WYGSLVIQGKGGSHNGS

SEQ ID NO: 2808769 - protein, 18 aa, Entamoeba invadens
WYLPRRLTINTLLKTPNI

SEQ ID NO: 2808770 - protein, 17 aa, Entamoeba invadens
WYNYTINIFKLFLHFFT

SEQ ID NO: 2808771 - protein, 22 aa, Entamoeba invadens
WYSMIFKLNQKYRVFGIDSNTL

SEQ ID NO: 2808772 - protein, 23 aa, Entamoeba invadens
WYTEPVVNWYQGYSHIRSQVSLL

SEQ ID NO: 2808773 - protein, 20 aa, Entamoeba invadens
WYTLFWQRKITVVGGFLIFL

SEQ ID NO: 2808774 - protein, 19 aa, Entamoeba invadens
WYTPESFFDLAVFLFFADC

SEQ ID NO: 2808775 - protein, 18 aa, Entamoeba invadens
WYYDQALHNHVFYTYYYN

SEQ ID NO: 2808776 - protein, 17 aa, Entamoeba invadens
WYYLFGTAGCWFFFDIA

SEQ ID NO: 2808777 - protein, 20 aa, Entamoeba invadens
YAALYIAPTIFCFMKGQSYM

SEQ ID NO: 2808778 - protein, 19 aa, Entamoeba invadens
YAAMALKLPSLDVAEQTAK

SEQ ID NO: 2808779 - protein, 17 aa, Entamoeba invadens
YACEGRVLTVFSAGRYG

SEQ ID NO: 2808780 - protein, 23 aa, Entamoeba invadens
YACNISEGFPIVGVILCSILVAG

SEQ ID NO: 2808781 - protein, 21 aa, Entamoeba invadens
YADEEYNEWILYTTGIYLVCI

SEQ ID NO: 2808782 - protein, 24 aa, Entamoeba invadens
YADFKVAVVCYKRNIFRYMLVLTV

SEQ ID NO: 2808783 - protein, 24 aa, Entamoeba invadens
YADFKVAVVCYKRNIFRYMLVSTS

SEQ ID NO: 2808784 - protein, 22 aa, Entamoeba invadens
YADTLPRWTVKSVALTPTSYIG

SEQ ID NO: 2808785 - protein, 22 aa, Entamoeba invadens
YADVIVKGFAVSVAIVLTTLLS

SEQ ID NO: 2808786 - protein, 17 aa, Entamoeba invadens
YADVSILAFTPMMAFTG

SEQ ID NO: 2808787 - protein, 18 aa, Entamoeba invadens
YAEHLVTVFFDRTIPYDT

SEQ ID NO: 2808788 - protein, 25 aa, Entamoeba invadens
YAELPSILLRNVLQAILIPMYPQYA

SEQ ID NO: 2808789 - protein, 26 aa, Entamoeba invadens
YAFFVKGTVCFLCHILYIWTLVAPII

SEQ ID NO: 2808790 - protein, 17 aa, Entamoeba invadens
YAFSMVLVEHFAFSIVS

SEQ ID NO: 2808791 - protein, 17 aa, Entamoeba invadens
YAFVKIDALNIVKQLSK

SEQ ID NO: 2808792 - protein, 20 aa, Entamoeba invadens
YAIEITEDWAAYDRNETLDA

SEQ ID NO: 2808793 - protein, 24 aa, Entamoeba invadens
YAIESMSFVSLRSAPLAEESFKTK

SEQ ID NO: 2808794 - protein, 17 aa, Entamoeba invadens
YAILTLEVMTRKVPYLS

SEQ ID NO: 2808795 - protein, 24 aa, Entamoeba invadens
YALGITLLECMKWDEAYENKTFVY

SEQ ID NO: 2808796 - protein, 19 aa, Entamoeba invadens
YALQFKWAFTSITSKIRCI

SEQ ID NO: 2808797 - protein, 27 aa, Entamoeba invadens
YAMGFALCWDLTLVILCMSPFTMMSMM

SEQ ID NO: 2808798 - protein, 23 aa, Entamoeba invadens
YAMSGMMGELYVSRELRSEMPKY

SEQ ID NO: 2808799 - protein, 23 aa, Entamoeba invadens
YANLCKLSSTFHALCVSNNSNVK

SEQ ID NO: 2808800 - protein, 17 aa, Entamoeba invadens
YANSYACMQCISDATLD

SEQ ID NO: 2808801 - protein, 21 aa, Entamoeba invadens
YANYVFKCLFNQFKYFYNLYF

SEQ ID NO: 2808802 - protein, 30 aa, Entamoeba invadens
YAPLMLSLGVCWHANGFWRDFVEQHHQMGT

SEQ ID NO: 2808803 - protein, 19 aa, Entamoeba invadens
YARDGKWGMGASETNNNVI

SEQ ID NO: 2808804 - protein, 18 aa, Entamoeba invadens
YASAAFVKKVMRLTLEAP

SEQ ID NO: 2808805 - protein, 17 aa, Entamoeba invadens
YASFVVKGIVSVTNPPL

SEQ ID NO: 2808806 - protein, 17 aa, Entamoeba invadens
YATALRIQKDFKELRVE

SEQ ID NO: 2808807 - protein, 22 aa, Entamoeba invadens
YATDCVFYSNGLCKKCSENYYT

SEQ ID NO: 2808808 - protein, 18 aa, Entamoeba invadens
YAVHGFACIYIWMFLYTV

SEQ ID NO: 2808809 - protein, 17 aa, Entamoeba invadens
YAVINCRTILATLSVPS

SEQ ID NO: 2808810 - protein, 22 aa, Entamoeba invadens
YAVQFVLCYLVFPIVQTYTCVG

SEQ ID NO: 2808811 - protein, 40 aa, Entamoeba invadens
YAVSMFEIVKWGPAFPKGKFKHAWDIANFVTSGQRPEIVK

SEQ ID NO: 2808812 - protein, 17 aa, Entamoeba invadens
YAVTLQYLFTATETFIT

SEQ ID NO: 2808813 - protein, 25 aa, Entamoeba invadens
YAVYPFMRFEFIPSVTMMYRTYFLG

SEQ ID NO: 2808814 - protein, 17 aa, Entamoeba invadens
YAYDLLLHKIGKRGKQD

SEQ ID NO: 2808815 - protein, 21 aa, Entamoeba invadens
YCAPQNFPAYFAQNFILLLFY

SEQ ID NO: 2808816 - protein, 23 aa, Entamoeba invadens
YCATCFNSSYTGCYTCNDGYYLT

SEQ ID NO: 2808817 - protein, 18 aa, Entamoeba invadens
YCDIDTFNIYPFVSPISG

SEQ ID NO: 2808818 - protein, 18 aa, Entamoeba invadens
YCDINSIVIVNGEFHIRI

SEQ ID NO: 2808819 - protein, 17 aa, Entamoeba invadens
YCDKVAITECSQGKDAA

SEQ ID NO: 2808820 - protein, 18 aa, Entamoeba invadens
YCESCKEGSYSTGGSSEC

SEQ ID NO: 2808821 - protein, 18 aa, Entamoeba invadens
YCEYDMAVCLSKHPKCKV

SEQ ID NO: 2808822 - protein, 18 aa, Entamoeba invadens
YCEYDMAVCLSKHPNCKV

SEQ ID NO: 2808823 - protein, 18 aa, Entamoeba invadens
YCEYDMTVCLAAHEKCKV

SEQ ID NO: 2808824 - protein, 36 aa, Entamoeba invadens
YCEYDMTVCLAAHPKCKVCAVDKCYQCQENKYLKED

SEQ ID NO: 2808825 - protein, 26 aa, Entamoeba invadens
YCFCHRLNVAEVFLWNTADGRVLLAI

SEQ ID NO: 2808826 - protein, 19 aa, Entamoeba invadens
YCFYGCSCLSSITIPLSVT

SEQ ID NO: 2808827 - protein, 20 aa, Entamoeba invadens
YCGLCLKDYFDYGIRPYPFM

SEQ ID NO: 2808828 - protein, 26 aa, Entamoeba invadens
YCGLIMFRKTYPWYMLSTFGALGSAF

SEQ ID NO: 2808829 - protein, 19 aa, Entamoeba invadens
YCGNLDYSHCQKIKMNTTD

SEQ ID NO: 2808830 - protein, 20 aa, Entamoeba invadens
YCGSFLILSLIFYFISFLFF

SEQ ID NO: 2808831 - protein, 21 aa, Entamoeba invadens
YCIPMYLGLLGMIASMVSNGY

SEQ ID NO: 2808832 - protein, 20 aa, Entamoeba invadens
YCIQCTSLSKCLICQPKYFL

SEQ ID NO: 2808833 - protein, 21 aa, Entamoeba invadens
YCITMTFLSLVFWKNNPASVI

SEQ ID NO: 2808834 - protein, 17 aa, Entamoeba invadens
YCKCKDGYTLTGHLCAS

SEQ ID NO: 2808835 - protein, 17 aa, Entamoeba invadens
YCKPCGANCLYCTTPDV

SEQ ID NO: 2808836 - protein, 18 aa, Entamoeba invadens
YCKSSVVWWVIFLVVIFV

SEQ ID NO: 2808837 - protein, 18 aa, Entamoeba invadens
YCKWKSDAKTVWCKDSVY

SEQ ID NO: 2808838 - protein, 18 aa, Entamoeba invadens
YCLLFALCFSCCVANVRK

SEQ ID NO: 2808839 - protein, 21 aa, Entamoeba invadens
YCLRCNDTTCLLCDQNYILSG

SEQ ID NO: 2808840 - protein, 21 aa, Entamoeba invadens
YCLSCTSTSFLDSTMVCKSLG

SEQ ID NO: 2808841 - protein, 19 aa, Entamoeba invadens
YCLSPLCVVMEYFNGGSLF

SEQ ID NO: 2808842 - protein, 23 aa, Entamoeba invadens
YCLTCSVNKFLSGHQCKSNENLI

SEQ ID NO: 2808843 - protein, 17 aa, Entamoeba invadens
YCNDCLAGTYADDIESS

SEQ ID NO: 2808844 - protein, 18 aa, Entamoeba invadens
YCNDFKLICDLYIGSVQP

SEQ ID NO: 2808845 - protein, 20 aa, Entamoeba invadens
YCNICANGFVATKGICVCPE

SEQ ID NO: 2808846 - protein, 23 aa, Entamoeba invadens
YCNNLKCEYCHFNTKRCISCKLG

SEQ ID NO: 2808847 - protein, 17 aa, Entamoeba invadens
YCNSCVFINNQIRCKAC

SEQ ID NO: 2808848 - protein, 21 aa, Entamoeba invadens
YCPCFGCFITPLEMVSGIVIN

SEQ ID NO: 2808849 - protein, 18 aa, Entamoeba invadens
YCQLFMLYENVVFVQLIR

SEQ ID NO: 2808850 - protein, 20 aa, Entamoeba invadens
YCSALSFVDPLVVREANLFY

SEQ ID NO: 2808851 - protein, 23 aa, Entamoeba invadens
YCSECDEGFYLKGDKFTNILCAT

SEQ ID NO: 2808852 - protein, 25 aa, Entamoeba invadens
YCSEVLKTPFLRYSGVMLGLSLIVY

SEQ ID NO: 2808853 - protein, 19 aa, Entamoeba invadens
YCSKCKNSHVLVFKECYLI

SEQ ID NO: 2808854 - protein, 21 aa, Entamoeba invadens
YCSSCSSAIPNCNKCYSNTDC

SEQ ID NO: 2808855 - protein, 18 aa, Entamoeba invadens
YCSVHAKSSILLLPEALK

SEQ ID NO: 2808856 - protein, 20 aa, Entamoeba invadens
YCTCNLCKPDYLLNNGKCSP

SEQ ID NO: 2808857 - protein, 21 aa, Entamoeba invadens
YCTECKNGFFIQGVDSQDCIK

SEQ ID NO: 2808858 - protein, 22 aa, Entamoeba invadens
YCTECVSGFFIKNGESQQCSQC

SEQ ID NO: 2808859 - protein, 17 aa, Entamoeba invadens
YCTGCLSNYVFISSTSM

SEQ ID NO: 2808860 - protein, 31 aa, Entamoeba invadens
YCTIKADGTAFVEPDCVVGILDDTNALTLKY

SEQ ID NO: 2808861 - protein, 20 aa, Entamoeba invadens
YCTPCGNGFYSTEGSSNCLS

SEQ ID NO: 2808862 - protein, 20 aa, Entamoeba invadens
YCTRCEPGFELFNGTCLCHS

SEQ ID NO: 2808863 - protein, 21 aa, Entamoeba invadens
YCTSCKSGFYLDKLGNCKSLG

SEQ ID NO: 2808864 - protein, 22 aa, Entamoeba invadens
YCTSCKSGFYLDKLGNCKSLGA

SEQ ID NO: 2808865 - protein, 18 aa, Entamoeba invadens
YCTSCKTGYAYKSDDGSC

SEQ ID NO: 2808866 - protein, 20 aa, Entamoeba invadens
YCTSCSFNYVLYDENNLKCQ

SEQ ID NO: 2808867 - protein, 19 aa, Entamoeba invadens
YCVDTEMGFCVLCTDGYFL

SEQ ID NO: 2808868 - protein, 18 aa, Entamoeba invadens
YCVHKLDLHYSFDSTKTN

SEQ ID NO: 2808869 - protein, 20 aa, Entamoeba invadens
YCVKETNYGLVVGVPLSVTF

SEQ ID NO: 2808870 - protein, 18 aa, Entamoeba invadens
YCVLTLLYCGIMFVACTN

SEQ ID NO: 2808871 - protein, 25 aa, Entamoeba invadens
YCVRFGRKKIAIFFISLFYFALVLV

SEQ ID NO: 2808872 - protein, 27 aa, Entamoeba invadens
YCVTCAFDYSRKCVKCSNGYYPDPNGK

SEQ ID NO: 2808873 - protein, 20 aa, Entamoeba invadens
YCYSCATGCKTCFGEETRQC

SEQ ID NO: 2808874 - protein, 26 aa, Entamoeba invadens
YDAIQRLIWRISRGLVLIKSTDLSEN

SEQ ID NO: 2808875 - protein, 25 aa, Entamoeba invadens
YDAKKSYECLSSWMKYVKIPFPVLL

SEQ ID NO: 2808876 - protein, 18 aa, Entamoeba invadens
YDCSKFELCEQCNSTNCI

SEQ ID NO: 2808877 - protein, 20 aa, Entamoeba invadens
YDDGEFYEGFYVVNPDNLDI

SEQ ID NO: 2808878 - protein, 23 aa, Entamoeba invadens
YDEEINKFVGFFLQAVVLYTDIM

SEQ ID NO: 2808879 - protein, 17 aa, Entamoeba invadens
YDEEYTWCFPPTKASGF

SEQ ID NO: 2808880 - protein, 25 aa, Entamoeba invadens
YDEIKVKLPTPISFTTTLVFTIEEF

SEQ ID NO: 2808881 - protein, 24 aa, Entamoeba invadens
YDFDVFSFFFTKSFDCEPLIKHFC

SEQ ID NO: 2808882 - protein, 17 aa, Entamoeba invadens
YDFQGSYSIGKRRQTTC

SEQ ID NO: 2808883 - protein, 18 aa, Entamoeba invadens
YDGCAICKDGYKRSTDGK

SEQ ID NO: 2808884 - protein, 18 aa, Entamoeba invadens
YDGCAICKDGYKRSTDGT

SEQ ID NO: 2808885 - protein, 20 aa, Entamoeba invadens
YDGCSACGNGKVDIDINEEC

SEQ ID NO: 2808886 - protein, 18 aa, Entamoeba invadens
YDGKIPCDESPCIYPPHS

SEQ ID NO: 2808887 - protein, 18 aa, Entamoeba invadens
YDGLCLPETTGFCTINRF

SEQ ID NO: 2808888 - protein, 19 aa, Entamoeba invadens
YDIFIGVFFCIIYLMYTVG

SEQ ID NO: 2808889 - protein, 17 aa, Entamoeba invadens
YDIGPSCHNINGCIKCK

SEQ ID NO: 2808890 - protein, 17 aa, Entamoeba invadens
YDIIFGTIVGVVILIIL

SEQ ID NO: 2808891 - protein, 25 aa, Entamoeba invadens
YDIYYYLAMQPWRHFVWTYNDNGVW

SEQ ID NO: 2808892 - protein, 26 aa, Entamoeba invadens
YDKEDMYRMWAWKALSMLLLYCTLMF

SEQ ID NO: 2808893 - protein, 26 aa, Entamoeba invadens
YDKMEFKFPWKIAEFVISGKRLPKEE

SEQ ID NO: 2808894 - protein, 26 aa, Entamoeba invadens
YDKNMFKFPWKIAEFVISGKRLEKNE

SEQ ID NO: 2808895 - protein, 26 aa, Entamoeba invadens
YDKNVFKFPWKIAEFVISGKRLERNE

SEQ ID NO: 2808896 - protein, 17 aa, Entamoeba invadens
YDLCMKQFVSDVYYALN

SEQ ID NO: 2808897 - protein, 21 aa, Entamoeba invadens
YDLKNELYQTIFIAKKIILKT

SEQ ID NO: 2808898 - protein, 19 aa, Entamoeba invadens
YDLTETVPREFIPNEIDER

SEQ ID NO: 2808899 - protein, 28 aa, Entamoeba invadens
YDMDFCKMTADFTFDISASMLKDHIENN

SEQ ID NO: 2808900 - protein, 24 aa, Entamoeba invadens
YDMSAGLIHGWSYEALVKETCDCV

SEQ ID NO: 2808901 - protein, 22 aa, Entamoeba invadens
YDNACPCYHDITGKGGNCSVQL

SEQ ID NO: 2808902 - protein, 20 aa, Entamoeba invadens
YDNAIFKSFNSFQMYEDAIF

SEQ ID NO: 2808903 - protein, 18 aa, Entamoeba invadens
YDNARYTYYINVIPTLNK

SEQ ID NO: 2808904 - protein, 21 aa, Entamoeba invadens
YDNCLYCKTGFGFNATNNCLP

SEQ ID NO: 2808905 - protein, 26 aa, Entamoeba invadens
YDNINRFFTLQGMRVLAFGYKNVERK

SEQ ID NO: 2808906 - protein, 22 aa, Entamoeba invadens
YDNNRGRILIYFDHKLTDLTPR

SEQ ID NO: 2808907 - protein, 17 aa, Entamoeba invadens
YDNTNCVFYDCTPGYEL

SEQ ID NO: 2808908 - protein, 17 aa, Entamoeba invadens
YDPMKFPDSESILRFVG

SEQ ID NO: 2808909 - protein, 21 aa, Entamoeba invadens
YDPSTPLAITIDMFHPKLSQK

SEQ ID NO: 2808910 - protein, 18 aa, Entamoeba invadens
YDQKGFCVTCEIGYFLKV

SEQ ID NO: 2808911 - protein, 18 aa, Entamoeba invadens
YDQNCLNCSYGATECLRC

SEQ ID NO: 2808912 - protein, 23 aa, Entamoeba invadens
YDRKELSRMSGVTWQTIEERIKD

SEQ ID NO: 2808913 - protein, 21 aa, Entamoeba invadens
YDRVKIYLMFFISGSDAMDVA

SEQ ID NO: 2808914 - protein, 20 aa, Entamoeba invadens
YDRVLLCKNGTYPSGHTCKN

SEQ ID NO: 2808915 - protein, 25 aa, Entamoeba invadens
YDSFICMFNSWGIIGIMIIFAIAVL

SEQ ID NO: 2808916 - protein, 19 aa, Entamoeba invadens
YDSKKSLWHKFAVFISNKW

SEQ ID NO: 2808917 - protein, 23 aa, Entamoeba invadens
YDSKKWFVALECFLTNTETCYKW

SEQ ID NO: 2808918 - protein, 29 aa, Entamoeba invadens
YDSLKCLQCDDGFYLINFVCNKCPTECST

SEQ ID NO: 2808919 - protein, 29 aa, Entamoeba invadens
YDSQCGRRIVPVVAALFVMSCECYDVQYD

SEQ ID NO: 2808920 - protein, 25 aa, Entamoeba invadens
YDSTEPRICFYIIFNTKECLINDLI

SEQ ID NO: 2808921 - protein, 19 aa, Entamoeba invadens
YDSVICAASTCTIGTIKPG

SEQ ID NO: 2808922 - protein, 23 aa, Entamoeba invadens
YDTDSCCNKICWLDVTNSDLAAL

SEQ ID NO: 2808923 - protein, 28 aa, Entamoeba invadens
YDTYLSGMFDFIYKYILNYTSIGLFLFW

SEQ ID NO: 2808924 - protein, 21 aa, Entamoeba invadens
YDVFKFGNTRFLNYGDDTIAF

SEQ ID NO: 2808925 - protein, 18 aa, Entamoeba invadens
YDVFLFSRIMEFRRKGLS

SEQ ID NO: 2808926 - protein, 28 aa, Entamoeba invadens
YDVHCPTCEKCKLFSCQEFSSMLLQLIS

SEQ ID NO: 2808927 - protein, 18 aa, Entamoeba invadens
YDVHFRKLLNYIFFGWKI

SEQ ID NO: 2808928 - protein, 19 aa, Entamoeba invadens
YDVPGFLDSIFQFMHLEND

SEQ ID NO: 2808929 - protein, 21 aa, Entamoeba invadens
YDVVERCWAQDAVQRPSISEV

SEQ ID NO: 2808930 - protein, 25 aa, Entamoeba invadens
YDYFSFDFYCCINNTKTLANTGTYA

SEQ ID NO: 2808931 - protein, 20 aa, Entamoeba invadens
YDYNICLKCSEGCLDCREMD

SEQ ID NO: 2808932 - protein, 17 aa, Entamoeba invadens
YDYYKFILKTPLQSPTL

SEQ ID NO: 2808933 - protein, 17 aa, Entamoeba invadens
YECFGWEDVFPKSMFPF

SEQ ID NO: 2808934 - protein, 20 aa, Entamoeba invadens
YECHLRLKALGYLFNNIKLT

SEQ ID NO: 2808935 - protein, 18 aa, Entamoeba invadens
YECLGNIYLDQNVKKRKT

SEQ ID NO: 2808936 - protein, 24 aa, Entamoeba invadens
YEDKCGTSECIQCTENSCLNIFIL

SEQ ID NO: 2808937 - protein, 18 aa, Entamoeba invadens
YEDKKCLRCSSKHYLNDG

SEQ ID NO: 2808938 - protein, 20 aa, Entamoeba invadens
YEDQYVIWGFFIFTTVGIYF

SEQ ID NO: 2808939 - protein, 18 aa, Entamoeba invadens
YEDSQCTASCNCAYGTEK

SEQ ID NO: 2808940 - protein, 21 aa, Entamoeba invadens
YEDYVRCSWVTDRPDIYFERA

SEQ ID NO: 2808941 - protein, 18 aa, Entamoeba invadens
YEEMRFILIETVKKRLRA

SEQ ID NO: 2808942 - protein, 25 aa, Entamoeba invadens
YEENDLKVILSFCQCVNVSSERNEK

SEQ ID NO: 2808943 - protein, 18 aa, Entamoeba invadens
YEERYAFIYDKTRKMIYT

SEQ ID NO: 2808944 - protein, 20 aa, Entamoeba invadens
YEFLRNGVVFGCKTGTYLTK

SEQ ID NO: 2808945 - protein, 29 aa, Entamoeba invadens
YEGIFEFSLKISRCTSFFNTFVIGFTGEP

SEQ ID NO: 2808946 - protein, 27 aa, Entamoeba invadens
YEGIKRCFSMRRLIYWVIEALVVSALV

SEQ ID NO: 2808947 - protein, 17 aa, Entamoeba invadens
YEGLLPSTISQHINNVL

SEQ ID NO: 2808948 - protein, 29 aa, Entamoeba invadens
YEICTYCYPNFYLDNGICLFCQFCSSCNS

SEQ ID NO: 2808949 - protein, 27 aa, Entamoeba invadens
YEICTYCYPNFYLDNGKCLSCQFCSSC

SEQ ID NO: 2808950 - protein, 27 aa, Entamoeba invadens
YEIFCGQFIRLKMCPQCKKIADKYIEY

SEQ ID NO: 2808951 - protein, 25 aa, Entamoeba invadens
YEIIVLPAMKFIGALSTKSDRVSFI

SEQ ID NO: 2808952 - protein, 20 aa, Entamoeba invadens
YEIRSVPPLVNLKRGEACEF

SEQ ID NO: 2808953 - protein, 17 aa, Entamoeba invadens
YEIRSVPPLVTLKPGYA

SEQ ID NO: 2808954 - protein, 17 aa, Entamoeba invadens
YEKEKHVIFLLNDSIAF

SEQ ID NO: 2808955 - protein, 20 aa, Entamoeba invadens
YEKGHCIECSMGCNVCDKNS

SEQ ID NO: 2808956 - protein, 23 aa, Entamoeba invadens
YEKYKEFCVDGMVLYEKSCIGNK

SEQ ID NO: 2808957 - protein, 19 aa, Entamoeba invadens
YELFIKQLIKNIPSYHKER

SEQ ID NO: 2808958 - protein, 17 aa, Entamoeba invadens
YELWRLITPIFLHAGII

SEQ ID NO: 2808959 - protein, 26 aa, Entamoeba invadens
YEMFPHNKCVLKTCGQDIYKSSDVNG

SEQ ID NO: 2808960 - protein, 18 aa, Entamoeba invadens
YEMIAVKFITNMVKTYAK

SEQ ID NO: 2808961 - protein, 26 aa, Entamoeba invadens
YENAMPARWYRFVGDGKMYLIDTCST

SEQ ID NO: 2808962 - protein, 23 aa, Entamoeba invadens
YENDGSCLHCKWTDPNGNTAEAY

SEQ ID NO: 2808963 - protein, 24 aa, Entamoeba invadens
YENFLKAMLKHVGKNFEELGELKK

SEQ ID NO: 2808964 - protein, 17 aa, Entamoeba invadens
YENGAALQSWIGMTNAD

SEQ ID NO: 2808965 - protein, 26 aa, Entamoeba invadens
YENGKLTLPIGMYFSVITEEEMDLMN

SEQ ID NO: 2808966 - protein, 18 aa, Entamoeba invadens
YENGLCYDISFVSNCVAV

SEQ ID NO: 2808967 - protein, 19 aa, Entamoeba invadens
YENGLCYDISFVSNCVAVS

SEQ ID NO: 2808968 - protein, 25 aa, Entamoeba invadens
YENKCVVCGSGYFMEDSFCFNCVPN

SEQ ID NO: 2808969 - protein, 22 aa, Entamoeba invadens
YENNCCGWKTLKVSGCGAATST

SEQ ID NO: 2808970 - protein, 23 aa, Entamoeba invadens
YENRLSFSSVDAMLLDGTCTICG

SEQ ID NO: 2808971 - protein, 18 aa, Entamoeba invadens
YENYRKKWDVLLLDDLLV

SEQ ID NO: 2808972 - protein, 19 aa, Entamoeba invadens
YEPLPFDSFTRISRIAITD

SEQ ID NO: 2808973 - protein, 19 aa, Entamoeba invadens
YEPSQRLTIEKVLSQPLFW

SEQ ID NO: 2808974 - protein, 26 aa, Entamoeba invadens
YEQCPCVGIDCLFRFNSNTIEIQNEN

SEQ ID NO: 2808975 - protein, 17 aa, Entamoeba invadens
YERKCVTCDTGYYPSSN

SEQ ID NO: 2808976 - protein, 26 aa, Entamoeba invadens
YERTPRISTVFPLFSNVFYNFAEDAK

SEQ ID NO: 2808977 - protein, 17 aa, Entamoeba invadens
YETFNWGDAYPKNKFQY

SEQ ID NO: 2808978 - protein, 25 aa, Entamoeba invadens
YETFPESFVNVGFTRDCFPADCGRC

SEQ ID NO: 2808979 - protein, 17 aa, Entamoeba invadens
YETLKWGDAYDKNMFKF

SEQ ID NO: 2808980 - protein, 17 aa, Entamoeba invadens
YETVWKKMFDILYIYNG

SEQ ID NO: 2808981 - protein, 17 aa, Entamoeba invadens
YEVKSTHPLPAGIKIGS

SEQ ID NO: 2808982 - protein, 22 aa, Entamoeba invadens
YEVLSIYLLPCRPLINITYFLA

SEQ ID NO: 2808983 - protein, 21 aa, Entamoeba invadens
YEVSDTMPVYSFQKNYQQILL

SEQ ID NO: 2808984 - protein, 21 aa, Entamoeba invadens
YEVSSPYSGIFPLGPALMRPL

SEQ ID NO: 2808985 - protein, 19 aa, Entamoeba invadens
YEVYEKNTFVFPWNIAEFV

SEQ ID NO: 2808986 - protein, 26 aa, Entamoeba invadens
YEYYVITFLFSFLFIQALHYGISNII

SEQ ID NO: 2808987 - protein, 33 aa, Entamoeba invadens
YFAKKEFRIPIDFFIDKRLNVLLKQYHPSVLDI

SEQ ID NO: 2808988 - protein, 23 aa, Entamoeba invadens
YFAPYKSMRGFDFLADELYKVLQ

SEQ ID NO: 2808989 - protein, 25 aa, Entamoeba invadens
YFARMSKALFSRVTPFWLSLAKEVM

SEQ ID NO: 2808990 - protein, 18 aa, Entamoeba invadens
YFASWKLAELSGVVMGFG

SEQ ID NO: 2808991 - protein, 19 aa, Entamoeba invadens
YFATLYIKPLREFGHYTLP

SEQ ID NO: 2808992 - protein, 25 aa, Entamoeba invadens
YFCICYIPTFVNFIFSMAFLAPSTP

SEQ ID NO: 2808993 - protein, 24 aa, Entamoeba invadens
YFDLILCWTYDLFICIGAFAVVFG

SEQ ID NO: 2808994 - protein, 24 aa, Entamoeba invadens
YFDVKSFTCMSCKDFCSMCSTATN

SEQ ID NO: 2808995 - protein, 19 aa, Entamoeba invadens
YFEHLLDSLSMVVDKYKIL

SEQ ID NO: 2808996 - protein, 23 aa, Entamoeba invadens
YFEIQCDLCARPIGENFFNRAQE

SEQ ID NO: 2808997 - protein, 34 aa, Entamoeba invadens
YFEKEWKVCLPEEAIKYHCGQTFLEKAYKVQRHE

SEQ ID NO: 2808998 - protein, 17 aa, Entamoeba invadens
YFFANLRGLSPVTMTLI

SEQ ID NO: 2808999 - protein, 19 aa, Entamoeba invadens
YFFDTTLVCRICDESCGNC

SEQ ID NO: 2809000 - protein, 32 aa, Entamoeba invadens
YFFEFFSHFVLCFFRNLFRTFLLPPSYPQNIY

SEQ ID NO: 2809001 - protein, 17 aa, Entamoeba invadens
YFFKQDMYFPFNQQAYF

SEQ ID NO: 2809002 - protein, 26 aa, Entamoeba invadens
YFFKQNIPPATQWKIFKYMVTHYEEL

SEQ ID NO: 2809003 - protein, 18 aa, Entamoeba invadens
YFGALGCDQYCHCRTGMT

SEQ ID NO: 2809004 - protein, 18 aa, Entamoeba invadens
YFGAPGCDQYCHCNEGYI

SEQ ID NO: 2809005 - protein, 18 aa, Entamoeba invadens
YFGGWSYVTLILIVIQGV

SEQ ID NO: 2809006 - protein, 27 aa, Entamoeba invadens
YFICDMLFVLGFQIRWVQFNKRRDVPP

SEQ ID NO: 2809007 - protein, 39 aa, Entamoeba invadens
YFIEIAKKFKPTLVVGVPRFYEKILMRLNEVLKKSKLAA

SEQ ID NO: 2809008 - protein, 20 aa, Entamoeba invadens
YFIEQIKVYALPLIISDKTT

SEQ ID NO: 2809009 - protein, 23 aa, Entamoeba invadens
YFIILLMCGVVFILVYTYFLLFG

SEQ ID NO: 2809010 - protein, 25 aa, Entamoeba invadens
YFILFGNLCLMGFRAVAVLRSYNIF

SEQ ID NO: 2809011 - protein, 26 aa, Entamoeba invadens
YFINRIVFRIKMCIYKKREQRQYAHF

SEQ ID NO: 2809012 - protein, 24 aa, Entamoeba invadens
YFINRSIYQWIFQRFTEVYMCYFS

SEQ ID NO: 2809013 - protein, 22 aa, Entamoeba invadens
YFIRGLCVFTTILPDPSGRKST

SEQ ID NO: 2809014 - protein, 17 aa, Entamoeba invadens
YFIRNDFEFSLIILCFV

SEQ ID NO: 2809015 - protein, 25 aa, Entamoeba invadens
YFISSLRLLYIISISYLYHIYIYII

SEQ ID NO: 2809016 - protein, 18 aa, Entamoeba invadens
YFITCVLAVFVIVMYIMV

SEQ ID NO: 2809017 - protein, 18 aa, Entamoeba invadens
YFITIILFVYHLRHNLLA

SEQ ID NO: 2809018 - protein, 28 aa, Entamoeba invadens
YFKDRDCVFMFISWCLMLSALSVVNGLF

SEQ ID NO: 2809019 - protein, 17 aa, Entamoeba invadens
YFKFYVLAIFVFYIPVA

SEQ ID NO: 2809020 - protein, 27 aa, Entamoeba invadens
YFKGDRCVQCKSTFYLTENYACLKCSE

SEQ ID NO: 2809021 - protein, 24 aa, Entamoeba invadens
YFKLPGSKSKLWVSYDNLTNCETK

SEQ ID NO: 2809022 - protein, 26 aa, Entamoeba invadens
YFKNENDLFVLPSFFNHVHLRAININ

SEQ ID NO: 2809023 - protein, 27 aa, Entamoeba invadens
YFKNRDCVFMFISWCATLSSLAVVNGL

SEQ ID NO: 2809024 - protein, 29 aa, Entamoeba invadens
YFLHSSSFIKWNFKYLVVLLSVFLVSTVL

SEQ ID NO: 2809025 - protein, 25 aa, Entamoeba invadens
YFLLLESKTSWGIVPGFAELTDVYL

SEQ ID NO: 2809026 - protein, 17 aa, Entamoeba invadens
YFLNKTCVYLFSGNAVT

SEQ ID NO: 2809027 - protein, 28 aa, Entamoeba invadens
YFLSRFVWDIFCLFAILVHILCMRNRGY

SEQ ID NO: 2809028 - protein, 26 aa, Entamoeba invadens
YFNGAKCVLCDKSVNCTKCEFNKCVE

SEQ ID NO: 2809029 - protein, 25 aa, Entamoeba invadens
YFPTKHGFKRGFWFKFTATQKTHII

SEQ ID NO: 2809030 - protein, 23 aa, Entamoeba invadens
YFPTTLKRLFLRQNTVVPDLTHL

SEQ ID NO: 2809031 - protein, 24 aa, Entamoeba invadens
YFQTEFKGDYSIRIDTLKGGKNNY

SEQ ID NO: 2809032 - protein, 20 aa, Entamoeba invadens
YFRKEWNIYTNTEIRKTTSE

SEQ ID NO: 2809033 - protein, 17 aa, Entamoeba invadens
YFSDCPILHKFTSKKMC

SEQ ID NO: 2809034 - protein, 32 aa, Entamoeba invadens
YFSGICNLFNVWLDIKCEYYYLIESNFDQSTM

SEQ ID NO: 2809035 - protein, 27 aa, Entamoeba invadens
YFSKGGEIARALLWCVSNVSSEGTLLA

SEQ ID NO: 2809036 - protein, 26 aa, Entamoeba invadens
YFTALFFEHLEKFCINLVRSINTLNF

SEQ ID NO: 2809037 - protein, 24 aa, Entamoeba invadens
YFTEGKRVWKKCLNTQSYDTNKQN

SEQ ID NO: 2809038 - protein, 24 aa, Entamoeba invadens
YFTNCLKLVLIVLFWVFVLAPEET

SEQ ID NO: 2809039 - protein, 17 aa, Entamoeba invadens
YFTSYVVFVVFSIYNHI

SEQ ID NO: 2809040 - protein, 28 aa, Entamoeba invadens
YFVAKAGIKFGFRFEFSIIVLALYQIIA

SEQ ID NO: 2809041 - protein, 23 aa, Entamoeba invadens
YFVSACFFLIFSIGIIAGCLLIW

SEQ ID NO: 2809042 - protein, 31 aa, Entamoeba invadens
YFVTLQIDWRKRWPFILCSLFIGQLLVVLGF

SEQ ID NO: 2809043 - protein, 21 aa, Entamoeba invadens
YFVYFRFLWIKLGLENDEGKQ

SEQ ID NO: 2809044 - protein, 18 aa, Entamoeba invadens
YFYANAISIGAAIIVTFL

SEQ ID NO: 2809045 - protein, 23 aa, Entamoeba invadens
YFYNSLKMKLAILVGVVQMTVGI

SEQ ID NO: 2809046 - protein, 18 aa, Entamoeba invadens
YGACFMPNKICMVTEYAQ

SEQ ID NO: 2809047 - protein, 21 aa, Entamoeba invadens
YGCISCKIGYYLSNAECHQCS

SEQ ID NO: 2809048 - protein, 18 aa, Entamoeba invadens
YGCLQCKTGYFFDSNLEC

SEQ ID NO: 2809049 - protein, 22 aa, Entamoeba invadens
YGDHCERCNPSYFLKDGKCAKC

SEQ ID NO: 2809050 - protein, 18 aa, Entamoeba invadens
YGDHCERCNPSYYLSDGK

SEQ ID NO: 2809051 - protein, 24 aa, Entamoeba invadens
YGDRCNKCTHVSCTTCDNNYRLTE

SEQ ID NO: 2809052 - protein, 18 aa, Entamoeba invadens
YGDSKLLCRYGESGCDED

SEQ ID NO: 2809053 - protein, 18 aa, Entamoeba invadens
YGDTFRLEYKISVTPKGE

SEQ ID NO: 2809054 - protein, 21 aa, Entamoeba invadens
YGECRQCIYGHYLDNDECHKC

SEQ ID NO: 2809055 - protein, 21 aa, Entamoeba invadens
YGEGKSFFIAGVVLILVGILM

SEQ ID NO: 2809056 - protein, 23 aa, Entamoeba invadens
YGGCSSCYGGLNGQCYGCNNGFF

SEQ ID NO: 2809057 - protein, 17 aa, Entamoeba invadens
YGGDNCHEKCYYKNKWT

SEQ ID NO: 2809058 - protein, 19 aa, Entamoeba invadens
YGGFNCIYYDINWEESSYL

SEQ ID NO: 2809059 - protein, 17 aa, Entamoeba invadens
YGGIIFFLLAMIPFAMR

SEQ ID NO: 2809060 - protein, 23 aa, Entamoeba invadens
YGGLKNSILLIFGLFGSLGVGVL

SEQ ID NO: 2809061 - protein, 30 aa, Entamoeba invadens
YGGTTTSCSLCFPGTFSKSGASSCTQCYPG

SEQ ID NO: 2809062 - protein, 17 aa, Entamoeba invadens
YGGVPTTVLLLIGGLMI

SEQ ID NO: 2809063 - protein, 22 aa, Entamoeba invadens
YGHAWRMYNFYLIYSTDWTILQ

SEQ ID NO: 2809064 - protein, 17 aa, Entamoeba invadens
YGIAIAASNAWGLMMVI

SEQ ID NO: 2809065 - protein, 22 aa, Entamoeba invadens
YGIEYKYPWNIANAVVSGKRPS

SEQ ID NO: 2809066 - protein, 24 aa, Entamoeba invadens
YGISTIFRKLLLSIYPNFVNYYII

SEQ ID NO: 2809067 - protein, 21 aa, Entamoeba invadens
YGITAWEIFYQREPYFELKSV

SEQ ID NO: 2809068 - protein, 30 aa, Entamoeba invadens
YGITLYEVMNWGGLYPLDQFPFPWSVAEFV

SEQ ID NO: 2809069 - protein, 24 aa, Entamoeba invadens
YGIVAGGLSCFFTLSVLIEILAPV

SEQ ID NO: 2809070 - protein, 17 aa, Entamoeba invadens
YGKCLRCSAGYGYVSSL

SEQ ID NO: 2809071 - protein, 20 aa, Entamoeba invadens
YGKCMLCGVDYTFKHVREHS

SEQ ID NO: 2809072 - protein, 21 aa, Entamoeba invadens
YGKGFSLYGFGYVVYTTVMLT

SEQ ID NO: 2809073 - protein, 17 aa, Entamoeba invadens
YGKSDTYCTTNSGTTFV

SEQ ID NO: 2809074 - protein, 21 aa, Entamoeba invadens
YGKSIILVLWGFWLLTGFVLS

SEQ ID NO: 2809075 - protein, 18 aa, Entamoeba invadens
YGLDEYVKLAKWVKKYHV

SEQ ID NO: 2809076 - protein, 26 aa, Entamoeba invadens
YGLEAGVCKLCPAGTFANSSSCVTCG

SEQ ID NO: 2809077 - protein, 26 aa, Entamoeba invadens
YGLSSGKCLICLSGTRSLFSRCVSCE

SEQ ID NO: 2809078 - protein, 31 aa, Entamoeba invadens
YGNEGFLLMLCYYLGCAITLTKLQKKGKNQK

SEQ ID NO: 2809079 - protein, 29 aa, Entamoeba invadens
YGNEGFLLMMLYYLGCYITLLKPQKAGRN

SEQ ID NO: 2809080 - protein, 39 aa, Entamoeba invadens
YGNGTLVWIICCVLCIIGLPCCACIPCCITDMKDAYHKC

SEQ ID NO: 2809081 - protein, 27 aa, Entamoeba invadens
YGNLNIELRLPLKYSLPSFNTTIYPMF

SEQ ID NO: 2809082 - protein, 25 aa, Entamoeba invadens
YGNYGAECKVCYPPFELIEGSCVEC

SEQ ID NO: 2809083 - protein, 28 aa, Entamoeba invadens
YGNYGTECKICYPPFELFEGSCVECKSY

SEQ ID NO: 2809084 - protein, 33 aa, Entamoeba invadens
YGQCSACSIPNCKYCEGGKCKKCNDNYVVQTNG

SEQ ID NO: 2809085 - protein, 17 aa, Entamoeba invadens
YGRVTSTISECFKYDKM

SEQ ID NO: 2809086 - protein, 25 aa, Entamoeba invadens
YGSKLFGYKSFVCYYCAAGEVIKCD

SEQ ID NO: 2809087 - protein, 18 aa, Entamoeba invadens
YGTCFGRVSLIGTDLYNK

SEQ ID NO: 2809088 - protein, 17 aa, Entamoeba invadens
YGTCLSSKIASVQIQTE

SEQ ID NO: 2809089 - protein, 31 aa, Entamoeba invadens
YGTFHFPSCMPSMLFKMAIFTIEFSGNYSVR

SEQ ID NO: 2809090 - protein, 24 aa, Entamoeba invadens
YGTKQWCIFLILMIVSSLLLVPFF

SEQ ID NO: 2809091 - protein, 20 aa, Entamoeba invadens
YGTLDSLITCSCRFNISEYI

SEQ ID NO: 2809092 - protein, 19 aa, Entamoeba invadens
YGTSHFGFHVRFRDLARGG

SEQ ID NO: 2809093 - protein, 18 aa, Entamoeba invadens
YGTSNKFFCHVEGVTNKI

SEQ ID NO: 2809094 - protein, 18 aa, Entamoeba invadens
YGTSTNCYKCQDRYITNE

SEQ ID NO: 2809095 - protein, 19 aa, Entamoeba invadens
YGTSTNCYKCQTRYNRTGN

SEQ ID NO: 2809096 - protein, 17 aa, Entamoeba invadens
YGTYSCHDDEIWACQSS

SEQ ID NO: 2809097 - protein, 20 aa, Entamoeba invadens
YGVCVLCEDSLILKGEKCIP

SEQ ID NO: 2809098 - protein, 21 aa, Entamoeba invadens
YGVGCAICRDGYYKSQSSCIE

SEQ ID NO: 2809099 - protein, 24 aa, Entamoeba invadens
YGVLGRKLLGLSIEDTTRQYLTSC

SEQ ID NO: 2809100 - protein, 23 aa, Entamoeba invadens
YGYFRAEILGALTNGIFLLSVGL

SEQ ID NO: 2809101 - protein, 17 aa, Entamoeba invadens
YGYIIAFLLFVAISLPF

SEQ ID NO: 2809102 - protein, 21 aa, Entamoeba invadens
YGYPIRKFEIDWDRVPTSEDA

SEQ ID NO: 2809103 - protein, 29 aa, Entamoeba invadens
YGYTEMGLRLGGSPLKIFSNMCIILNCYG

SEQ ID NO: 2809104 - protein, 22 aa, Entamoeba invadens
YHCLKIMAVLMAPFTPFFSEFC

SEQ ID NO: 2809105 - protein, 24 aa, Entamoeba invadens
YHCNGCSTNSWGTQICDKCEENYY

SEQ ID NO: 2809106 - protein, 17 aa, Entamoeba invadens
YHECIRMSDCDKLHSSM

SEQ ID NO: 2809107 - protein, 25 aa, Entamoeba invadens
YHEHKYRVGKWYAFDSNEMTKDHFK

SEQ ID NO: 2809108 - protein, 17 aa, Entamoeba invadens
YHFGLLLATNIPYRALS

SEQ ID NO: 2809109 - protein, 22 aa, Entamoeba invadens
YHIMLFLCFNFYIISIFSKDKF

SEQ ID NO: 2809110 - protein, 20 aa, Entamoeba invadens
YHISKSVCVKCEYPCTYCSN

SEQ ID NO: 2809111 - protein, 27 aa, Entamoeba invadens
YHNITCGGFTLIVDEKWLKNNTKCTDN

SEQ ID NO: 2809112 - protein, 28 aa, Entamoeba invadens
YHNITCGGFTLIVDEKWLKNNTKCTDNG

SEQ ID NO: 2809113 - protein, 28 aa, Entamoeba invadens
YHPHICVGDGYGALVLFQIITAGKYDGH

SEQ ID NO: 2809114 - protein, 18 aa, Entamoeba invadens
YHSDCKKEKCFIKTSSPN

SEQ ID NO: 2809115 - protein, 18 aa, Entamoeba invadens
YHSQLAIDVHRTYGNIFK

SEQ ID NO: 2809116 - protein, 17 aa, Entamoeba invadens
YHTNLFLAVGVPIIGVF

SEQ ID NO: 2809117 - protein, 27 aa, Entamoeba invadens
YHVNCFRCSCCGRVIIGDKLTTTDELK

SEQ ID NO: 2809118 - protein, 17 aa, Entamoeba invadens
YHWYKCYTVPSDEIPID

SEQ ID NO: 2809119 - protein, 18 aa, Entamoeba invadens
YIAALIAVLLFKFYHHYI

SEQ ID NO: 2809120 - protein, 18 aa, Entamoeba invadens
YIAALLFTTVFRFLNVIA

SEQ ID NO: 2809121 - protein, 24 aa, Entamoeba invadens
YIACVRLQAFFLGYYRWTFKIQSL

SEQ ID NO: 2809122 - protein, 21 aa, Entamoeba invadens
YIAEIAFKYCAFWEIPILSYL

SEQ ID NO: 2809123 - protein, 21 aa, Entamoeba invadens
YICGLINIMFWMFAQFPQIYQ

SEQ ID NO: 2809124 - protein, 22 aa, Entamoeba invadens
YICKRDEVWTSLVLSSTGRVTY

SEQ ID NO: 2809125 - protein, 34 aa, Entamoeba invadens
YICPMSIMMLWPRVEKFGSPDFRKLSVIDNIIYN

SEQ ID NO: 2809126 - protein, 20 aa, Entamoeba invadens
YICVYQLTFMVAFFVLGYNF

SEQ ID NO: 2809127 - protein, 19 aa, Entamoeba invadens
YICYLPLAHIFEFTIEICV

SEQ ID NO: 2809128 - protein, 22 aa, Entamoeba invadens
YIDKALWHKWGHDQAVHNVLYY

SEQ ID NO: 2809129 - protein, 19 aa, Entamoeba invadens
YIDRFGLPCSETLVCASKC

SEQ ID NO: 2809130 - protein, 18 aa, Entamoeba invadens
YIECDAMTLTFGLNKNYN

SEQ ID NO: 2809131 - protein, 18 aa, Entamoeba invadens
YIEHCVNVTNSLCEQCDF

SEQ ID NO: 2809132 - protein, 17 aa, Entamoeba invadens
YIEMMIFWVTLMAAPLI

SEQ ID NO: 2809133 - protein, 23 aa, Entamoeba invadens
YIEQCLSFIFNIWNRATVIVGLD

SEQ ID NO: 2809134 - protein, 22 aa, Entamoeba invadens
YIFFPKQWLSLITYILIGLSII

SEQ ID NO: 2809135 - protein, 17 aa, Entamoeba invadens
YIFKGVCVSCFSKYGNC

SEQ ID NO: 2809136 - protein, 24 aa, Entamoeba invadens
YIFKVSVPMLDMIFQYLIAQDEPV

SEQ ID NO: 2809137 - protein, 19 aa, Entamoeba invadens
YIFLCFTFIYFTYSQSCSF

SEQ ID NO: 2809138 - protein, 19 aa, Entamoeba invadens
YIFLMIGFFARYNYLTDLI

SEQ ID NO: 2809139 - protein, 32 aa, Entamoeba invadens
YIFVTICVSLLIGLCCINCQIFTKKNENRLKD

SEQ ID NO: 2809140 - protein, 18 aa, Entamoeba invadens
YIFYSFMKIVIKSLSYVL

SEQ ID NO: 2809141 - protein, 45 aa, Entamoeba invadens
YIGFFIVLFAIRFILTRGRLVVLRRYFFLMGINFLIRSVCLYFTL

SEQ ID NO: 2809142 - protein, 25 aa, Entamoeba invadens
YIGFVRFSFSFLFGVLLEKVQVEKK

SEQ ID NO: 2809143 - protein, 19 aa, Entamoeba invadens
YIGNIFYAFFYRKLSAQMT

SEQ ID NO: 2809144 - protein, 24 aa, Entamoeba invadens
YIGSIHCELCAVYIDTGSLFAPKF

SEQ ID NO: 2809145 - protein, 24 aa, Entamoeba invadens
YIHSCVYLGFNGCFGVLISWIQIM

SEQ ID NO: 2809146 - protein, 18 aa, Entamoeba invadens
YIIDNIFYFLPFNFNIDE

SEQ ID NO: 2809147 - protein, 20 aa, Entamoeba invadens
YIIENGSGDLGDWFYNYQTI

SEQ ID NO: 2809148 - protein, 18 aa, Entamoeba invadens
YIIFTTAMFCCVVLCILS

SEQ ID NO: 2809149 - protein, 25 aa, Entamoeba invadens
YIIHSFFKRYLVPFELLKRNISGSH

SEQ ID NO: 2809150 - protein, 23 aa, Entamoeba invadens
YIIIGGISLFFLIVFIPEMLTYI

SEQ ID NO: 2809151 - protein, 18 aa, Entamoeba invadens
YIIINKGGSITIDEFSGL

SEQ ID NO: 2809152 - protein, 18 aa, Entamoeba invadens
YIIPAGAVAINFVPDTVA

SEQ ID NO: 2809153 - protein, 23 aa, Entamoeba invadens
YIIPRPAIVNLRSVVKRQTITMD

SEQ ID NO: 2809154 - protein, 19 aa, Entamoeba invadens
YIIWVPSCCVIYAMEPALQ

SEQ ID NO: 2809155 - protein, 17 aa, Entamoeba invadens
YIKDALKSFALSGVLSI

SEQ ID NO: 2809156 - protein, 20 aa, Entamoeba invadens
YIKSGSFILFAMVVLMLVGR

SEQ ID NO: 2809157 - protein, 22 aa, Entamoeba invadens
YIKTNFLTLDFLGGIINVINRE

SEQ ID NO: 2809158 - protein, 17 aa, Entamoeba invadens
YILFLLVIGVSRNAYLN

SEQ ID NO: 2809159 - protein, 20 aa, Entamoeba invadens
YILLKRLVDGDAQFHVSKST

SEQ ID NO: 2809160 - protein, 17 aa, Entamoeba invadens
YILPNIVCACFTLIGVV

SEQ ID NO: 2809161 - protein, 25 aa, Entamoeba invadens
YILSFYYHLSINILYYPIAYWYYYK

SEQ ID NO: 2809162 - protein, 29 aa, Entamoeba invadens
YILSKCIKCLPGYFLIQGKCGNCIPNCAE

SEQ ID NO: 2809163 - protein, 26 aa, Entamoeba invadens
YILTDGRCTPCWAGTIQNGDMCVECP

SEQ ID NO: 2809164 - protein, 18 aa, Entamoeba invadens
YIMACSLAGILVPIENPW

SEQ ID NO: 2809165 - protein, 17 aa, Entamoeba invadens
YIMCTLGLIGGIGGGAI

SEQ ID NO: 2809166 - protein, 24 aa, Entamoeba invadens
YIMLFCLIFFKKIGSSLVPAFLVF

SEQ ID NO: 2809167 - protein, 17 aa, Entamoeba invadens
YINKCLLLTNSGGCVVC

SEQ ID NO: 2809168 - protein, 19 aa, Entamoeba invadens
YINKNGVIFSCEKDEFLDI

SEQ ID NO: 2809169 - protein, 19 aa, Entamoeba invadens
YIPEGFLIHGFWPQSNEGS

SEQ ID NO: 2809170 - protein, 27 aa, Entamoeba invadens
YIPFLEAPCGFARTMNRSAGDDFSDVC

SEQ ID NO: 2809171 - protein, 24 aa, Entamoeba invadens
YIPHISVICAIVIAAYPSIKTKFS

SEQ ID NO: 2809172 - protein, 18 aa, Entamoeba invadens
YIPPISLTIWSYYRTVFT

SEQ ID NO: 2809173 - protein, 24 aa, Entamoeba invadens
YIPSKKVLFAFSVFSSVFLCFLVP

SEQ ID NO: 2809174 - protein, 18 aa, Entamoeba invadens
YIPWITLARLVFLSLSSL

SEQ ID NO: 2809175 - protein, 22 aa, Entamoeba invadens
YIQNGVCVKCEYPCTHCSNLTF

SEQ ID NO: 2809176 - protein, 32 aa, Entamoeba invadens
YIQPCVKLIFSMCLYKTNLLIEFIKSLKQIRV

SEQ ID NO: 2809177 - protein, 17 aa, Entamoeba invadens
YIQVFNFISLIFFPITL

SEQ ID NO: 2809178 - protein, 23 aa, Entamoeba invadens
YISAPQLHMTWMSKLAQQHRKKL

SEQ ID NO: 2809179 - protein, 18 aa, Entamoeba invadens
YISLFAFGIGLSGGYYCQ

SEQ ID NO: 2809180 - protein, 18 aa, Entamoeba invadens
YISLMALVFWRNYPPAII

SEQ ID NO: 2809181 - protein, 18 aa, Entamoeba invadens
YISNSVCVRCEYPCTHCS

SEQ ID NO: 2809182 - protein, 18 aa, Entamoeba invadens
YITCNGINRYFASGAPKH

SEQ ID NO: 2809183 - protein, 22 aa, Entamoeba invadens
YITDSRLGAVILALLLAVLKCA

SEQ ID NO: 2809184 - protein, 22 aa, Entamoeba invadens
YITHFFPFTFIRKYRKMPLPYL

SEQ ID NO: 2809185 - protein, 29 aa, Entamoeba invadens
YITQYKGFFAILMEWAVIVFVGCVIALVW

SEQ ID NO: 2809186 - protein, 22 aa, Entamoeba invadens
YIVAICLKFLTKVLYWTKVTLK

SEQ ID NO: 2809187 - protein, 18 aa, Entamoeba invadens
YIVFILLIDMVVSYDQCN

SEQ ID NO: 2809188 - protein, 19 aa, Entamoeba invadens
YIVHFYGAILLPRKLAIVT

SEQ ID NO: 2809189 - protein, 24 aa, Entamoeba invadens
YIVITFLFRRFIKIQQDNTLDLKE

SEQ ID NO: 2809190 - protein, 26 aa, Entamoeba invadens
YIVLLVCCICKYIILCKEINFEQQEA

SEQ ID NO: 2809191 - protein, 18 aa, Entamoeba invadens
YIVLPIIVVLIFLTLVVI

SEQ ID NO: 2809192 - protein, 18 aa, Entamoeba invadens
YIVVEYYLIPSCNNCSKV

SEQ ID NO: 2809193 - protein, 25 aa, Entamoeba invadens
YIVYSILFQSRWVIKLIAKYEKRAF

SEQ ID NO: 2809194 - protein, 35 aa, Entamoeba invadens
YIYKNELFEVFGVRYFEVRAGYGWYNIGVLDQKNY

SEQ ID NO: 2809195 - protein, 21 aa, Entamoeba invadens
YIYRGNMWTAYAPDKLGRTFY

SEQ ID NO: 2809196 - protein, 21 aa, Entamoeba invadens
YKAHCIDCYPPYLLETNQGTC

SEQ ID NO: 2809197 - protein, 27 aa, Entamoeba invadens
YKCFFFMVWLFLCFIESKLFVSFKLSC

SEQ ID NO: 2809198 - protein, 25 aa, Entamoeba invadens
YKCPECPYDCSLEYGECTKLTPKGV

SEQ ID NO: 2809199 - protein, 21 aa, Entamoeba invadens
YKCRRMKGEVVQYVPTGTNGE

SEQ ID NO: 2809200 - protein, 17 aa, Entamoeba invadens
YKCSVCPKECLTCKFNN

SEQ ID NO: 2809201 - protein, 19 aa, Entamoeba invadens
YKDFKSLFEIKTFVSEGKR

SEQ ID NO: 2809202 - protein, 25 aa, Entamoeba invadens
YKDGASHDVFKCSRYSNDCKFIISI

SEQ ID NO: 2809203 - protein, 21 aa, Entamoeba invadens
YKDHPNVFAWYVDDETPLCGI

SEQ ID NO: 2809204 - protein, 19 aa, Entamoeba invadens
YKDKSCFVAEEFPTLTANQ

SEQ ID NO: 2809205 - protein, 18 aa, Entamoeba invadens
YKDNIFGISYVEPYCPLD

SEQ ID NO: 2809206 - protein, 22 aa, Entamoeba invadens
YKDSCGFCEENPALKCGNDTYI

SEQ ID NO: 2809207 - protein, 19 aa, Entamoeba invadens
YKDWLCTFPGCTEPPKTKY

SEQ ID NO: 2809208 - protein, 19 aa, Entamoeba invadens
YKEDRCVLSNEYLCLHCSE

SEQ ID NO: 2809209 - protein, 24 aa, Entamoeba invadens
YKEEIFPGIPIPIILDSNTPLDYS

SEQ ID NO: 2809210 - protein, 25 aa, Entamoeba invadens
YKEGIPLIFVLKCRRCDELVDTGYD

SEQ ID NO: 2809211 - protein, 21 aa, Entamoeba invadens
YKELLKYGIDYIKRMTNAEYR

SEQ ID NO: 2809212 - protein, 20 aa, Entamoeba invadens
YKFVRLLALQSFCIGLLDCL

SEQ ID NO: 2809213 - protein, 19 aa, Entamoeba invadens
YKFVTDMMRGVLYLHSNGI

SEQ ID NO: 2809214 - protein, 17 aa, Entamoeba invadens
YKGMYRGNVVAIKKMKQ

SEQ ID NO: 2809215 - protein, 23 aa, Entamoeba invadens
YKGNACIGLKIGFVKQSMEIEIA

SEQ ID NO: 2809216 - protein, 20 aa, Entamoeba invadens
YKIIGGVGMLALVIVAIVEL

SEQ ID NO: 2809217 - protein, 19 aa, Entamoeba invadens
YKILDVFSFNSDRKRQSVV

SEQ ID NO: 2809218 - protein, 21 aa, Entamoeba invadens
YKILKELDVDYVLVIFGGVVG

SEQ ID NO: 2809219 - protein, 20 aa, Entamoeba invadens
YKILRLRDGNGLSPSFLLIL

SEQ ID NO: 2809220 - protein, 17 aa, Entamoeba invadens
YKITQKGAVQFESENKS

SEQ ID NO: 2809221 - protein, 26 aa, Entamoeba invadens
YKKEDFKFVWSIADFVSGGKRLQNIA

SEQ ID NO: 2809222 - protein, 18 aa, Entamoeba invadens
YKKEPQFNDLFTYKKEVL

SEQ ID NO: 2809223 - protein, 19 aa, Entamoeba invadens
YKKFFKSKTGIIVSCVLIS

SEQ ID NO: 2809224 - protein, 17 aa, Entamoeba invadens
YKKGVGMQNGVDYDKMM

SEQ ID NO: 2809225 - protein, 20 aa, Entamoeba invadens
YKKKHIYHNLILRFESTKQQ

SEQ ID NO: 2809226 - protein, 17 aa, Entamoeba invadens
YKKLLTFIETYKDHPNV

SEQ ID NO: 2809227 - protein, 21 aa, Entamoeba invadens
YKKRLEQSPSLISREDVGIIF

SEQ ID NO: 2809228 - protein, 24 aa, Entamoeba invadens
YKKYLLSFVVAWMVSIALNIMGIV

SEQ ID NO: 2809229 - protein, 26 aa, Entamoeba invadens
YKKYPIRGGMCNVAMLVGKKAGTKFF

SEQ ID NO: 2809230 - protein, 28 aa, Entamoeba invadens
YKLADWIFEVRWTFALLIVLVIQNNPFY

SEQ ID NO: 2809231 - protein, 20 aa, Entamoeba invadens
YKLDHFCTVLGNSLGYHNFR

SEQ ID NO: 2809232 - protein, 25 aa, Entamoeba invadens
YKLFPDLPRTFTFVVILFVVHYVLL

SEQ ID NO: 2809233 - protein, 27 aa, Entamoeba invadens
YKLIKRVTLTKLLKCTLLDVYHYNKKF

SEQ ID NO: 2809234 - protein, 23 aa, Entamoeba invadens
YKLKLRILYDTARGMEFLHENKI

SEQ ID NO: 2809235 - protein, 21 aa, Entamoeba invadens
YKLKVRLLFDTARGMQFLHEN

SEQ ID NO: 2809236 - protein, 22 aa, Entamoeba invadens
YKLKVRMLFDTARGMQFLHENR

SEQ ID NO: 2809237 - protein, 17 aa, Entamoeba invadens
YKLLAPMMKNQRLKYCM

SEQ ID NO: 2809238 - protein, 19 aa, Entamoeba invadens
YKLTGANVRMNWESCCKEK

SEQ ID NO: 2809239 - protein, 24 aa, Entamoeba invadens
YKMKGDGKYYVAHTCSPYTNIDTA

SEQ ID NO: 2809240 - protein, 17 aa, Entamoeba invadens
YKMMSPQQLLDCEVNGE

SEQ ID NO: 2809241 - protein, 17 aa, Entamoeba invadens
YKMPSDIFSFAISMYEC

SEQ ID NO: 2809242 - protein, 18 aa, Entamoeba invadens
YKMPSDIFSFAISMYECF

SEQ ID NO: 2809243 - protein, 17 aa, Entamoeba invadens
YKMPSDIFSFAITMYEC

SEQ ID NO: 2809244 - protein, 17 aa, Entamoeba invadens
YKMPSDIFSFAITMYEI

SEQ ID NO: 2809245 - protein, 17 aa, Entamoeba invadens
YKMPSDIFSFAITMYET

SEQ ID NO: 2809246 - protein, 18 aa, Entamoeba invadens
YKMPSDIFSFAITMYETF

SEQ ID NO: 2809247 - protein, 18 aa, Entamoeba invadens
YKMSSYIYSFGVTMYETF

SEQ ID NO: 2809248 - protein, 17 aa, Entamoeba invadens
YKMYLVITFLYTRVAIT

SEQ ID NO: 2809249 - protein, 21 aa, Entamoeba invadens
YKNAAFFLLDVSYAFMSNFTC

SEQ ID NO: 2809250 - protein, 21 aa, Entamoeba invadens
YKNCKEFTNEYIIIQCDITII

SEQ ID NO: 2809251 - protein, 28 aa, Entamoeba invadens
YKNCVAVECPFWLAPEVVNTSVFEVESD

SEQ ID NO: 2809252 - protein, 17 aa, Entamoeba invadens
YKNEGAYAFITGATSGV

SEQ ID NO: 2809253 - protein, 26 aa, Entamoeba invadens
YKNKDNWCNFTFMLELLFHSVYVNKS

SEQ ID NO: 2809254 - protein, 20 aa, Entamoeba invadens
YKNNIGLCLPQSLINGCAVH

SEQ ID NO: 2809255 - protein, 30 aa, Entamoeba invadens
YKNNNKCLPKKCLLGGVGGGVFFCSNGESC

SEQ ID NO: 2809256 - protein, 28 aa, Entamoeba invadens
YKNNRIGRFEFWASMSYYFKNDTQTKQT

SEQ ID NO: 2809257 - protein, 18 aa, Entamoeba invadens
YKNNTGKVFVYFDNILSG

SEQ ID NO: 2809258 - protein, 18 aa, Entamoeba invadens
YKNREYYSPLNALFWLLD

SEQ ID NO: 2809259 - protein, 25 aa, Entamoeba invadens
YKNSEGKNYCSICSDGFVMNNGQCV

SEQ ID NO: 2809260 - protein, 17 aa, Entamoeba invadens
YKNSFDFDIINPIGNEH

SEQ ID NO: 2809261 - protein, 19 aa, Entamoeba invadens
YKNSPQMRLGFVAQEVKQV

SEQ ID NO: 2809262 - protein, 20 aa, Entamoeba invadens
YKNWMKFIAAELGDEKAIEE

SEQ ID NO: 2809263 - protein, 19 aa, Entamoeba invadens
YKPDIAICKDETANMEVMR

SEQ ID NO: 2809264 - protein, 18 aa, Entamoeba invadens
YKQGTDFFLGSIDSNAKI

SEQ ID NO: 2809265 - protein, 22 aa, Entamoeba invadens
YKRDCYEVSYIKKEYIYNLITS

SEQ ID NO: 2809266 - protein, 24 aa, Entamoeba invadens
YKRIGFYLWLAVCAVLAIVFFLID

SEQ ID NO: 2809267 - protein, 19 aa, Entamoeba invadens
YKSFSCILSNFSALKSRPV

SEQ ID NO: 2809268 - protein, 20 aa, Entamoeba invadens
YKSRVKLDITITCPQECGEN

SEQ ID NO: 2809269 - protein, 18 aa, Entamoeba invadens
YKTAVFIENVTFYDNTAV

SEQ ID NO: 2809270 - protein, 17 aa, Entamoeba invadens
YKTCYSCSNGYYLKEEG

SEQ ID NO: 2809271 - protein, 26 aa, Entamoeba invadens
YKTENKTKVFAIKHFDIVADQLKDKI

SEQ ID NO: 2809272 - protein, 18 aa, Entamoeba invadens
YKTFCIDTFVVLTKLLRT

SEQ ID NO: 2809273 - protein, 19 aa, Entamoeba invadens
YKTIPLISGINFNMEQLQI

SEQ ID NO: 2809274 - protein, 20 aa, Entamoeba invadens
YKTQSGKCLPQISLVGCSVE

SEQ ID NO: 2809275 - protein, 24 aa, Entamoeba invadens
YKTTESIASFCFDQENDLFIYTTL

SEQ ID NO: 2809276 - protein, 36 aa, Entamoeba invadens
YKTTKCWKNFEWVDVKWKDIFLGDIIMVRRKEQFPA

SEQ ID NO: 2809277 - protein, 19 aa, Entamoeba invadens
YKTVETINVPFYLANETRL

SEQ ID NO: 2809278 - protein, 22 aa, Entamoeba invadens
YKTVLLKANYYYNFILQNYNAG

SEQ ID NO: 2809279 - protein, 17 aa, Entamoeba invadens
YKWKGRITEQFAVLLGK

SEQ ID NO: 2809280 - protein, 21 aa, Entamoeba invadens
YKWVCGNCSKGKIPMPPKNEL

SEQ ID NO: 2809281 - protein, 21 aa, Entamoeba invadens
YKYDKLRCDDGYYVSEMSCVK

SEQ ID NO: 2809282 - protein, 19 aa, Entamoeba invadens
YKYHCCGWTKQSLQYCGAV

SEQ ID NO: 2809283 - protein, 25 aa, Entamoeba invadens
YKYPSYLTPFKWYFVSIYFIGLMVS

SEQ ID NO: 2809284 - protein, 18 aa, Entamoeba invadens
YKYSCPMGVSNIIKMAIS

SEQ ID NO: 2809285 - protein, 20 aa, Entamoeba invadens
YKYTWMDADESFLISEYFTT

SEQ ID NO: 2809286 - protein, 23 aa, Entamoeba invadens
YLADALSFLKLVYLSDAPFLYSP

SEQ ID NO: 2809287 - protein, 23 aa, Entamoeba invadens
YLAIELLQGLFLNDKQNFVDTQK

SEQ ID NO: 2809288 - protein, 19 aa, Entamoeba invadens
YLAIRWKAYLKKRDVEALF

SEQ ID NO: 2809289 - protein, 18 aa, Entamoeba invadens
YLAKSWDCYDRIPNSKTE

SEQ ID NO: 2809290 - protein, 17 aa, Entamoeba invadens
YLANYLVALGILKGNFP

SEQ ID NO: 2809291 - protein, 25 aa, Entamoeba invadens
YLAPEGFKDVYTYAGDVYSFGITGW

SEQ ID NO: 2809292 - protein, 18 aa, Entamoeba invadens
YLAVDFFFLLSGFVLSFS

SEQ ID NO: 2809293 - protein, 23 aa, Entamoeba invadens
YLCAEFNLRPASWTTDDVYIVGF

SEQ ID NO: 2809294 - protein, 29 aa, Entamoeba invadens
YLCGSMALLCFLSCFLLPIMTKNKKNEEK

SEQ ID NO: 2809295 - protein, 29 aa, Entamoeba invadens
YLDKIKWRDLLNIPVKWRQLSEPNDQVYW

SEQ ID NO: 2809296 - protein, 22 aa, Entamoeba invadens
YLDNWLCSKCSINCDSCYNTTY

SEQ ID NO: 2809297 - protein, 19 aa, Entamoeba invadens
YLDRVMAFFYKNYNHQTFV

SEQ ID NO: 2809298 - protein, 17 aa, Entamoeba invadens
YLEDGVCKKCDTTLSNC

SEQ ID NO: 2809299 - protein, 25 aa, Entamoeba invadens
YLEGSTCYKCYIGCLSCTSGKNGYC

SEQ ID NO: 2809300 - protein, 26 aa, Entamoeba invadens
YLELLYCHNWFYPILAFMVLGIVVIF

SEQ ID NO: 2809301 - protein, 19 aa, Entamoeba invadens
YLELYLRGDYTISINSTED

SEQ ID NO: 2809302 - protein, 20 aa, Entamoeba invadens
YLESGVCKTVDCGSGIYYEG

SEQ ID NO: 2809303 - protein, 18 aa, Entamoeba invadens
YLEVKPKYNSFIMALRII

SEQ ID NO: 2809304 - protein, 22 aa, Entamoeba invadens
YLFEKLEFKTGKFIDRDFGSYE

SEQ ID NO: 2809305 - protein, 19 aa, Entamoeba invadens
YLFFNRWTMLFFMTTALIN

SEQ ID NO: 2809306 - protein, 21 aa, Entamoeba invadens
YLFGTAGCWFFFDIAFYGNSM

SEQ ID NO: 2809307 - protein, 18 aa, Entamoeba invadens
YLFILARIGIVCCPIYDK

SEQ ID NO: 2809308 - protein, 29 aa, Entamoeba invadens
YLFLPSRWVMKLWPVLIVFTLAEIVTLLI

SEQ ID NO: 2809309 - protein, 28 aa, Entamoeba invadens
YLFRNEDWMPAALFGRGKSDLMLIYENF

SEQ ID NO: 2809310 - protein, 40 aa, Entamoeba invadens
YLFSGVCEKCSGSFTFCEVCNKDACLKCSRDTVLVDKKCV

SEQ ID NO: 2809311 - protein, 23 aa, Entamoeba invadens
YLGALELRFCNWTTVKPGSKIEE

SEQ ID NO: 2809312 - protein, 20 aa, Entamoeba invadens
YLGVSVKPTLSQNLDEIKDK

SEQ ID NO: 2809313 - protein, 26 aa, Entamoeba invadens
YLHNFDLLVVISFVFGKSAIHRLKKT

SEQ ID NO: 2809314 - protein, 18 aa, Entamoeba invadens
YLILFSYFSGVVINGIII

SEQ ID NO: 2809315 - protein, 22 aa, Entamoeba invadens
YLISSFYIQLGFNDVLNKIKPY

SEQ ID NO: 2809316 - protein, 23 aa, Entamoeba invadens
YLISYLSAVPMTFIPVWQSIVLP

SEQ ID NO: 2809317 - protein, 18 aa, Entamoeba invadens
YLKGEAYSTVKKPLSQIN

SEQ ID NO: 2809318 - protein, 18 aa, Entamoeba invadens
YLKGESYQTLKITKEQLT

SEQ ID NO: 2809319 - protein, 19 aa, Entamoeba invadens
YLKLFIGVLNLECFSSDVT

SEQ ID NO: 2809320 - protein, 18 aa, Entamoeba invadens
YLKPDCKNCVKITCEKAM

SEQ ID NO: 2809321 - protein, 19 aa, Entamoeba invadens
YLKSVKTLCDFWIEGDARL

SEQ ID NO: 2809322 - protein, 22 aa, Entamoeba invadens
YLKTVYFPSSLVDFDMEYIYNQ

SEQ ID NO: 2809323 - protein, 20 aa, Entamoeba invadens
YLLEKECVRALLTTPELTIE

SEQ ID NO: 2809324 - protein, 25 aa, Entamoeba invadens
YLLFALWCSLSFCYNSLDKIIKSFG

SEQ ID NO: 2809325 - protein, 24 aa, Entamoeba invadens
YLLFICLFAFLYLKCFESKLVVSD

SEQ ID NO: 2809326 - protein, 26 aa, Entamoeba invadens
YLLKSLKLKLAMQVFSIVLYHILILV

SEQ ID NO: 2809327 - protein, 17 aa, Entamoeba invadens
YLLRRQWSNLIIENYRR

SEQ ID NO: 2809328 - protein, 22 aa, Entamoeba invadens
YLLTCYFMFIGSVGVSELFQFI

SEQ ID NO: 2809329 - protein, 19 aa, Entamoeba invadens
YLLTLCALIGFVGGFFFGD

SEQ ID NO: 2809330 - protein, 17 aa, Entamoeba invadens
YLLYPVISISSVLCVIL

SEQ ID NO: 2809331 - protein, 23 aa, Entamoeba invadens
YLMHFGPFFCDGISPTAQGFLLK

SEQ ID NO: 2809332 - protein, 27 aa, Entamoeba invadens
YLMQKIRRWVVCVIILFIFSLFTPIGA

SEQ ID NO: 2809333 - protein, 20 aa, Entamoeba invadens
YLMTCIFVCFNKVYTMQYFI

SEQ ID NO: 2809334 - protein, 26 aa, Entamoeba invadens
YLNERRCYPCSVGCATCDAFECFSCR

SEQ ID NO: 2809335 - protein, 26 aa, Entamoeba invadens
YLNGRQCIPCTLGCISCDSTKCFTCY

SEQ ID NO: 2809336 - protein, 21 aa, Entamoeba invadens
YLNGTCSLCGNGIKEEGEECD

SEQ ID NO: 2809337 - protein, 19 aa, Entamoeba invadens
YLNIGLMFAALAFNDPIDL

SEQ ID NO: 2809338 - protein, 26 aa, Entamoeba invadens
YLNIVCSICPPAVLYKFIPSVDNLKK

SEQ ID NO: 2809339 - protein, 19 aa, Entamoeba invadens
YLNNCGRCGVLVLILHDLV

SEQ ID NO: 2809340 - protein, 17 aa, Entamoeba invadens
YLNNGICIDCQTFSSNC

SEQ ID NO: 2809341 - protein, 24 aa, Entamoeba invadens
YLNSYKGGSVWSIEGKEIGALYMK

SEQ ID NO: 2809342 - protein, 19 aa, Entamoeba invadens
YLPHIAHTPFLNTLTIQTK

SEQ ID NO: 2809343 - protein, 18 aa, Entamoeba invadens
YLPNGERGEYEWISYGTV

SEQ ID NO: 2809344 - protein, 23 aa, Entamoeba invadens
YLPRPFHQYPFKTTMALSREECE

SEQ ID NO: 2809345 - protein, 24 aa, Entamoeba invadens
YLPTTECVYTFFLISRTCGEAVTS

SEQ ID NO: 2809346 - protein, 18 aa, Entamoeba invadens
YLQSCADTLVLANPDVHL

SEQ ID NO: 2809347 - protein, 23 aa, Entamoeba invadens
YLRHPSYFGWFWWSIATQIVMLN

SEQ ID NO: 2809348 - protein, 20 aa, Entamoeba invadens
YLRKCYECQIGYYPSSSTNM

SEQ ID NO: 2809349 - protein, 22 aa, Entamoeba invadens
YLRLWEKIVIPVVFILVLGLMF

SEQ ID NO: 2809350 - protein, 21 aa, Entamoeba invadens
YLRVKAISGFSPFVITSYTQR

SEQ ID NO: 2809351 - protein, 25 aa, Entamoeba invadens
YLRVKLCLDAAMGILYLHENGILHR

SEQ ID NO: 2809352 - protein, 21 aa, Entamoeba invadens
YLRVNPPLKRKSGLGDTFNSR

SEQ ID NO: 2809353 - protein, 22 aa, Entamoeba invadens
YLSCTRCPFGYIAPLKNSSSCI

SEQ ID NO: 2809354 - protein, 19 aa, Entamoeba invadens
YLSDDKMRFGFIAQELKEV

SEQ ID NO: 2809355 - protein, 18 aa, Entamoeba invadens
YLSFVIKMSGLEKGRTQC

SEQ ID NO: 2809356 - protein, 24 aa, Entamoeba invadens
YLSGCISCASKHCTECDSQSGICT

SEQ ID NO: 2809357 - protein, 25 aa, Entamoeba invadens
YLSGTSCYYCRAGTYSSGGTTTSCS

SEQ ID NO: 2809358 - protein, 22 aa, Entamoeba invadens
YLSGVDCVECKDGYYSVKGTVD

SEQ ID NO: 2809359 - protein, 17 aa, Entamoeba invadens
YLSQLLSLFFLLPNYPD

SEQ ID NO: 2809360 - protein, 20 aa, Entamoeba invadens
YLTAHCILKICKRVEERVGT

SEQ ID NO: 2809361 - protein, 25 aa, Entamoeba invadens
YLTDLRLGMHYPLGSVVMLTETADY

SEQ ID NO: 2809362 - protein, 17 aa, Entamoeba invadens
YLVALGILKGNFPFQKG

SEQ ID NO: 2809363 - protein, 25 aa, Entamoeba invadens
YLVDALRFDFAFSADYPPLFEKINS

SEQ ID NO: 2809364 - protein, 19 aa, Entamoeba invadens
YLVPTVIAPFYFYLVYCIY

SEQ ID NO: 2809365 - protein, 29 aa, Entamoeba invadens
YLYIEGRVLPTLVLQCLNTLSSIGGKLPL

SEQ ID NO: 2809366 - protein, 18 aa, Entamoeba invadens
YLYIHAYNAHAFCQSFIV

SEQ ID NO: 2809367 - protein, 22 aa, Entamoeba invadens
YLYPSPLKGVAPLDCVNDKCTP

SEQ ID NO: 2809368 - protein, 20 aa, Entamoeba invadens
YLYRNMDIITPFSKYAPSFL

SEQ ID NO: 2809369 - protein, 19 aa, Entamoeba invadens
YMAPEIFRGGVLRNKSDVY

SEQ ID NO: 2809370 - protein, 18 aa, Entamoeba invadens
YMAPEILNGLKYSNKADI

SEQ ID NO: 2809371 - protein, 24 aa, Entamoeba invadens
YMCDGDNGYYCKFVEFDINDPHED

SEQ ID NO: 2809372 - protein, 30 aa, Entamoeba invadens
YMDANEYYKQCGICNGFGIAGSGYPANMLI

SEQ ID NO: 2809373 - protein, 27 aa, Entamoeba invadens
YMDKFDIKICYIPTLVGVVFTLFALMF

SEQ ID NO: 2809374 - protein, 30 aa, Entamoeba invadens
YMESTEYYKQCGICNGFGIAGSGYSAYWLI

SEQ ID NO: 2809375 - protein, 17 aa, Entamoeba invadens
YMFIFSFTSPYACNISE

SEQ ID NO: 2809376 - protein, 25 aa, Entamoeba invadens
YMGENCKCIPRTGLLGKCDKISQIT

SEQ ID NO: 2809377 - protein, 17 aa, Entamoeba invadens
YMGYSFYTMFFPPSAGY

SEQ ID NO: 2809378 - protein, 20 aa, Entamoeba invadens
YMHLYIRLMRKIFKHSPKSG

SEQ ID NO: 2809379 - protein, 17 aa, Entamoeba invadens
YMKAVFFTLTLNSTYSV

SEQ ID NO: 2809380 - protein, 25 aa, Entamoeba invadens
YMKDEFSELLAYKCLTNCASGMRFL

SEQ ID NO: 2809381 - protein, 19 aa, Entamoeba invadens
YMKEHCKVAYAERVFDSRV

SEQ ID NO: 2809382 - protein, 17 aa, Entamoeba invadens
YMLVLFTSICFSSSPSC

SEQ ID NO: 2809383 - protein, 20 aa, Entamoeba invadens
YMMQCFVLCFLFVIKNLKTQ

SEQ ID NO: 2809384 - protein, 17 aa, Entamoeba invadens
YMNCSKGTHCGYDGKVP

SEQ ID NO: 2809385 - protein, 17 aa, Entamoeba invadens
YMSGWDLVFPDDHNDYE

SEQ ID NO: 2809386 - protein, 28 aa, Entamoeba invadens
YMYEDRMYFCYTFIIRGIMTLVFTSSLS

SEQ ID NO: 2809387 - protein, 26 aa, Entamoeba invadens
YNALKPVVICEGCIFNTKTFLYLDDT

SEQ ID NO: 2809388 - protein, 26 aa, Entamoeba invadens
YNANVFCFNNTFTFSGTNVYYEIITS

SEQ ID NO: 2809389 - protein, 18 aa, Entamoeba invadens
YNAPKCYMTLREILHEMC

SEQ ID NO: 2809390 - protein, 18 aa, Entamoeba invadens
YNCSKFELCEQCNSTNCI

SEQ ID NO: 2809391 - protein, 19 aa, Entamoeba invadens
YNCTGCSTGSCSANSCLSG

SEQ ID NO: 2809392 - protein, 17 aa, Entamoeba invadens
YNCWKSRVEKRKKYYLR

SEQ ID NO: 2809393 - protein, 28 aa, Entamoeba invadens
YNDDFKIRFSFQNGRFVSPFIAIHSKGV

SEQ ID NO: 2809394 - protein, 22 aa, Entamoeba invadens
YNDDLYKWFFDKSVSPDKTTTR

SEQ ID NO: 2809395 - protein, 24 aa, Entamoeba invadens
YNDDLYKWFFDKSVSPDKTTTRCT

SEQ ID NO: 2809396 - protein, 20 aa, Entamoeba invadens
YNDIKIEGNTALSTRLDPTE

SEQ ID NO: 2809397 - protein, 17 aa, Entamoeba invadens
YNDNGVWVTKTMNEDNN

SEQ ID NO: 2809398 - protein, 17 aa, Entamoeba invadens
YNECKDPQIIKGSTNIY

SEQ ID NO: 2809399 - protein, 23 aa, Entamoeba invadens
YNEEFKNAILFVIKGKLTNKNNV

SEQ ID NO: 2809400 - protein, 21 aa, Entamoeba invadens
YNEFLYTVAMLADIYISIGLY

SEQ ID NO: 2809401 - protein, 22 aa, Entamoeba invadens
YNEKECHYNCCLSSPSVVMRCL

SEQ ID NO: 2809402 - protein, 21 aa, Entamoeba invadens
YNELRSVFEIKNYVESGKRLK

SEQ ID NO: 2809403 - protein, 17 aa, Entamoeba invadens
YNETIKFGKTHPMRQNP

SEQ ID NO: 2809404 - protein, 22 aa, Entamoeba invadens
YNEWVFKAFGFHVGLFHSIVRT

SEQ ID NO: 2809405 - protein, 17 aa, Entamoeba invadens
YNFGEFVERLYSLIDKA

SEQ ID NO: 2809406 - protein, 18 aa, Entamoeba invadens
YNFPDCNYNSSLFDLNLT

SEQ ID NO: 2809407 - protein, 17 aa, Entamoeba invadens
YNFTDGTAFLLSNSRLM

SEQ ID NO: 2809408 - protein, 17 aa, Entamoeba invadens
YNGCLTCGKGRYLNNNQ

SEQ ID NO: 2809409 - protein, 17 aa, Entamoeba invadens
YNGCVLAAPNQWKVQLF

SEQ ID NO: 2809410 - protein, 22 aa, Entamoeba invadens
YNGDCMKCSSGYYGVNGECILI

SEQ ID NO: 2809411 - protein, 25 aa, Entamoeba invadens
YNGICLSCPDLTYSVMGSIECAICD

SEQ ID NO: 2809412 - protein, 19 aa, Entamoeba invadens
YNGYIIKFSFGIVTIKNSY

SEQ ID NO: 2809413 - protein, 18 aa, Entamoeba invadens
YNHICIVTEFLGIDLCEL

SEQ ID NO: 2809414 - protein, 20 aa, Entamoeba invadens
YNIKSLCFVHPDYLIVNKST

SEQ ID NO: 2809415 - protein, 17 aa, Entamoeba invadens
YNILVGNFIKNLFGLPR

SEQ ID NO: 2809416 - protein, 29 aa, Entamoeba invadens
YNKEIPADGLSVFTKQVWEAIKKNKDLDL

SEQ ID NO: 2809417 - protein, 27 aa, Entamoeba invadens
YNKLEFKFPWKIAEYVISGKRLPKKES

SEQ ID NO: 2809418 - protein, 24 aa, Entamoeba invadens
YNKNCLICPASYYSSGGTSLCSKC

SEQ ID NO: 2809419 - protein, 27 aa, Entamoeba invadens
YNKQKYRIGKWFKFEMNESIVEQLILS

SEQ ID NO: 2809420 - protein, 26 aa, Entamoeba invadens
YNKQKYRIGKWFKYDMDNLTTDVVKL

SEQ ID NO: 2809421 - protein, 23 aa, Entamoeba invadens
YNKTCFSCIYFKMVKYNFIYFTF

SEQ ID NO: 2809422 - protein, 25 aa, Entamoeba invadens
YNKTREGLTLFGLYVTSFMLVLLVF

SEQ ID NO: 2809423 - protein, 26 aa, Entamoeba invadens
YNKVDFKFPWKIAEFVISGKRLLKRE

SEQ ID NO: 2809424 - protein, 19 aa, Entamoeba invadens
YNKWSKKGKKMIVVDGTSY

SEQ ID NO: 2809425 - protein, 25 aa, Entamoeba invadens
YNLGRLLFAVAMSFSALFFAILNRV

SEQ ID NO: 2809426 - protein, 17 aa, Entamoeba invadens
YNLLLILGAMSEEDKVS

SEQ ID NO: 2809427 - protein, 29 aa, Entamoeba invadens
YNLNGGASFVLECKKCTLSGTETITTLKM

SEQ ID NO: 2809428 - protein, 19 aa, Entamoeba invadens
YNLYSHSWNGNKYGRVFHV

SEQ ID NO: 2809429 - protein, 21 aa, Entamoeba invadens
YNMFFGKTFTRFVRQEKYTSI

SEQ ID NO: 2809430 - protein, 25 aa, Entamoeba invadens
YNNFSFDLTHNFVFPTTITKIRNHN

SEQ ID NO: 2809431 - protein, 19 aa, Entamoeba invadens
YNNGCIKCNSSTYLSHGKC

SEQ ID NO: 2809432 - protein, 25 aa, Entamoeba invadens
YNNLIMKYQWCATLLNSPFNSNNEY

SEQ ID NO: 2809433 - protein, 19 aa, Entamoeba invadens
YNPFIEGFYLMFGIHKTTY

SEQ ID NO: 2809434 - protein, 17 aa, Entamoeba invadens
YNQLSWGLMKNGFNPVC

SEQ ID NO: 2809435 - protein, 22 aa, Entamoeba invadens
YNRCVFEKSKLYVPLDHHVEGE

SEQ ID NO: 2809436 - protein, 17 aa, Entamoeba invadens
YNRDIREAMGYSVSELN

SEQ ID NO: 2809437 - protein, 30 aa, Entamoeba invadens
YNRTVWIKTNWWWILIIFVVLALCVFVCGW

SEQ ID NO: 2809438 - protein, 17 aa, Entamoeba invadens
YNRYSYRTYVKFLDGKS

SEQ ID NO: 2809439 - protein, 23 aa, Entamoeba invadens
YNSQCIMCDWWYVINASATGCEK

SEQ ID NO: 2809440 - protein, 19 aa, Entamoeba invadens
YNSYLYSQFLRDVCTSETT

SEQ ID NO: 2809441 - protein, 24 aa, Entamoeba invadens
YNSYTGYCNLCYQNYLFDNGKCYP

SEQ ID NO: 2809442 - protein, 17 aa, Entamoeba invadens
YNTCFRDHWNYKDGDFN

SEQ ID NO: 2809443 - protein, 17 aa, Entamoeba invadens
YNTNLAIATEKHINKNK

SEQ ID NO: 2809444 - protein, 26 aa, Entamoeba invadens
YNTPKFKFPWKIAEFVISGNRLEKAV

SEQ ID NO: 2809445 - protein, 18 aa, Entamoeba invadens
YNTTLVFKKESPFKLFVS

SEQ ID NO: 2809446 - protein, 25 aa, Entamoeba invadens
YNTTMVCYWLLFIIAMITGLIPATE

SEQ ID NO: 2809447 - protein, 17 aa, Entamoeba invadens
YNTVFAILTGLSLSLYS

SEQ ID NO: 2809448 - protein, 19 aa, Entamoeba invadens
YNVACFIPSLFFFCTIVLL

SEQ ID NO: 2809449 - protein, 18 aa, Entamoeba invadens
YNVNWICYAHNLKTPGSL

SEQ ID NO: 2809450 - protein, 20 aa, Entamoeba invadens
YNYTRMSAIFFGKGGKIATI

SEQ ID NO: 2809451 - protein, 25 aa, Entamoeba invadens
YNYVPLRFLYSLLFVNKKNRNLISM

SEQ ID NO: 2809452 - protein, 19 aa, Entamoeba invadens
YPCQQNCRVCQNSKSCVEC

SEQ ID NO: 2809453 - protein, 19 aa, Entamoeba invadens
YPDNYLKIDVDSFYTYYST

SEQ ID NO: 2809454 - protein, 17 aa, Entamoeba invadens
YPDVALFTIMQNIENII

SEQ ID NO: 2809455 - protein, 22 aa, Entamoeba invadens
YPEYEYMCCFGTDCVNLTKLTF

SEQ ID NO: 2809456 - protein, 30 aa, Entamoeba invadens
YPFTFKHCPCFGELCTIHFDNTDQFYSINN

SEQ ID NO: 2809457 - protein, 19 aa, Entamoeba invadens
YPGVFTYKVVNVMDNTTEN

SEQ ID NO: 2809458 - protein, 24 aa, Entamoeba invadens
YPHCPCTQSNCIVQFSVNNFNIKE

SEQ ID NO: 2809459 - protein, 20 aa, Entamoeba invadens
YPHCPCTQSNCVVQFSGDVF

SEQ ID NO: 2809460 - protein, 22 aa, Entamoeba invadens
YPHKLSKAIFFEVFLTSEEWIL

SEQ ID NO: 2809461 - protein, 38 aa, Entamoeba invadens
YPHPFRIAYELPVKLPFHYPLWKAMIAITLLLTPIALD

SEQ ID NO: 2809462 - protein, 28 aa, Entamoeba invadens
YPIEFTKDLFLTHAYKALEMFAKARMTW

SEQ ID NO: 2809463 - protein, 17 aa, Entamoeba invadens
YPIIGFISSIPMLDDYF

SEQ ID NO: 2809464 - protein, 23 aa, Entamoeba invadens
YPIKNFFRLVRFIVGSLDEVSMM

SEQ ID NO: 2809465 - protein, 27 aa, Entamoeba invadens
YPIKSFEYPWCIADFVTQGKRMEKPCG

SEQ ID NO: 2809466 - protein, 17 aa, Entamoeba invadens
YPIPWPQSYWHIFAIIV

SEQ ID NO: 2809467 - protein, 17 aa, Entamoeba invadens
YPIQGICVPCDYGCTTC

SEQ ID NO: 2809468 - protein, 26 aa, Entamoeba invadens
YPKDVFKYPWDIAAFVTNGKRKEIKK

SEQ ID NO: 2809469 - protein, 26 aa, Entamoeba invadens
YPKEDFKFPWKIAEFVNSGKRFENTQ

SEQ ID NO: 2809470 - protein, 26 aa, Entamoeba invadens
YPKEEFKFPWKIAEFVMNGKHPVIRP

SEQ ID NO: 2809471 - protein, 28 aa, Entamoeba invadens
YPKETFKFPWKIAEFVTLGKRLQKKDNI

SEQ ID NO: 2809472 - protein, 20 aa, Entamoeba invadens
YPKIILLVVANLQFYANLLG

SEQ ID NO: 2809473 - protein, 28 aa, Entamoeba invadens
YPKKTFKFPWKIAEFVTLGKRLERKENI

SEQ ID NO: 2809474 - protein, 25 aa, Entamoeba invadens
YPKNEFKYSWNIVNFVASGKRRQKP

SEQ ID NO: 2809475 - protein, 26 aa, Entamoeba invadens
YPKSEFKYPWKIADFVNGGNRLQKLD

SEQ ID NO: 2809476 - protein, 25 aa, Entamoeba invadens
YPKTEFKFPWKIAEFVNKGNRLNKA

SEQ ID NO: 2809477 - protein, 21 aa, Entamoeba invadens
YPLDCIQFDCLMLTLNSVLEE

SEQ ID NO: 2809478 - protein, 24 aa, Entamoeba invadens
YPLGVSLTSLFAWVYFLFGVLLFC

SEQ ID NO: 2809479 - protein, 17 aa, Entamoeba invadens
YPLYYTFFKRESFVNSN

SEQ ID NO: 2809480 - protein, 22 aa, Entamoeba invadens
YPMKDDVVLRYKLNSDTFDITN

SEQ ID NO: 2809481 - protein, 20 aa, Entamoeba invadens
YPMQWSRGDNIAFLFMGQEL

SEQ ID NO: 2809482 - protein, 17 aa, Entamoeba invadens
YPNCEYPLMYNKTNHSC

SEQ ID NO: 2809483 - protein, 24 aa, Entamoeba invadens
YPPLELYLHYLFIVHGLENYRNKI

SEQ ID NO: 2809484 - protein, 18 aa, Entamoeba invadens
YPQFLWRYSSLSNKVIPH

SEQ ID NO: 2809485 - protein, 25 aa, Entamoeba invadens
YPQKFRQGRWFKFNLSQMTKDHLAI

SEQ ID NO: 2809486 - protein, 25 aa, Entamoeba invadens
YPQKYRLGRWFKINMTQFTMDHFNV

SEQ ID NO: 2809487 - protein, 17 aa, Entamoeba invadens
YPQRLYILTPQPFNTSI

SEQ ID NO: 2809488 - protein, 22 aa, Entamoeba invadens
YPSEMYYSFPGIASLVNFVVTV

SEQ ID NO: 2809489 - protein, 25 aa, Entamoeba invadens
YPSKFLFNAMLKRVLVSKTDAHYVA

SEQ ID NO: 2809490 - protein, 17 aa, Entamoeba invadens
YPTCYNVTGHLNGNVSE

SEQ ID NO: 2809491 - protein, 26 aa, Entamoeba invadens
YPTKKFKFPWKIAEFVMSGKRVEKIE

SEQ ID NO: 2809492 - protein, 25 aa, Entamoeba invadens
YPVCAPGKLMKALIFTMDFSGDYSV

SEQ ID NO: 2809493 - protein, 18 aa, Entamoeba invadens
YPVFDIFSLSLWDINSTV

SEQ ID NO: 2809494 - protein, 25 aa, Entamoeba invadens
YPVIFKNVIKMGILHFEKLNGKTAF

SEQ ID NO: 2809495 - protein, 19 aa, Entamoeba invadens
YPVNNCVFIKCNNGYIRDS

SEQ ID NO: 2809496 - protein, 26 aa, Entamoeba invadens
YPVSDFKFPWHIANFVIEGKRLPKPS

SEQ ID NO: 2809497 - protein, 27 aa, Entamoeba invadens
YPWRSHVYGFGFLRIVLVVDLFVPVSE

SEQ ID NO: 2809498 - protein, 19 aa, Entamoeba invadens
YPYNCLYCSASCGGNCNNQ

SEQ ID NO: 2809499 - protein, 32 aa, Entamoeba invadens
YQAKNLLAFDVICFYSFFFLICCCEQNELRAD

SEQ ID NO: 2809500 - protein, 18 aa, Entamoeba invadens
YQCDSCVTGYYLDQTTKT

SEQ ID NO: 2809501 - protein, 26 aa, Entamoeba invadens
YQCKDGYYRVGMDCFNCLSNCTTCNT

SEQ ID NO: 2809502 - protein, 24 aa, Entamoeba invadens
YQCKDGYYRVGMNCYECLLNCSAC

SEQ ID NO: 2809503 - protein, 20 aa, Entamoeba invadens
YQCKGCDAGFYANRVTDRCD

SEQ ID NO: 2809504 - protein, 19 aa, Entamoeba invadens
YQCPDKCLHCVDGKCISCE

SEQ ID NO: 2809505 - protein, 26 aa, Entamoeba invadens
YQFERFVQCVKLLPVLILGKANDQIV

SEQ ID NO: 2809506 - protein, 20 aa, Entamoeba invadens
YQGSVLKNGKCEMCPSGSFS

SEQ ID NO: 2809507 - protein, 17 aa, Entamoeba invadens
YQGVVPITAKCRSVKRK

SEQ ID NO: 2809508 - protein, 17 aa, Entamoeba invadens
YQHKLYFNHFVKVHSKN

SEQ ID NO: 2809509 - protein, 18 aa, Entamoeba invadens
YQHVWNSVEFCHCGDFML

SEQ ID NO: 2809510 - protein, 20 aa, Entamoeba invadens
YQIHSCLPPLYSGTKGMSKK

SEQ ID NO: 2809511 - protein, 18 aa, Entamoeba invadens
YQILRVIAKLVSMIEKHR

SEQ ID NO: 2809512 - protein, 17 aa, Entamoeba invadens
YQILVSWGLDITNTEMS

SEQ ID NO: 2809513 - protein, 25 aa, Entamoeba invadens
YQKTMCIPYLFSRLVYICDFFLISF

SEQ ID NO: 2809514 - protein, 26 aa, Entamoeba invadens
YQLFHPRCLLQMIFAGCMKQTKVVLV

SEQ ID NO: 2809515 - protein, 17 aa, Entamoeba invadens
YQLKVKILDDMAVALSY

SEQ ID NO: 2809516 - protein, 22 aa, Entamoeba invadens
YQLRIEPDIVILKKGVACEFSI

SEQ ID NO: 2809517 - protein, 24 aa, Entamoeba invadens
YQMSSGISIFGWFLASVLLFSAAV

SEQ ID NO: 2809518 - protein, 24 aa, Entamoeba invadens
YQNLLIIAGICFTFVSFFMFVCAV

SEQ ID NO: 2809519 - protein, 26 aa, Entamoeba invadens
YQPPQFKFPWEIADFVNNSNRLKQTP

SEQ ID NO: 2809520 - protein, 24 aa, Entamoeba invadens
YQQITEILLVFGLTMTDTTTMGRT

SEQ ID NO: 2809521 - protein, 24 aa, Entamoeba invadens
YQQYCKKCVVGYYVTQDLKCAKCP

SEQ ID NO: 2809522 - protein, 18 aa, Entamoeba invadens
YQRRCYECQIGYYPSLTT

SEQ ID NO: 2809523 - protein, 17 aa, Entamoeba invadens
YQRTHLFDKFQKVSPQE

SEQ ID NO: 2809524 - protein, 20 aa, Entamoeba invadens
YQSFGLPLIITRGNNVFGPH

SEQ ID NO: 2809525 - protein, 23 aa, Entamoeba invadens
YQSTYTNCIFKRFKSNSTDLYKT

SEQ ID NO: 2809526 - protein, 21 aa, Entamoeba invadens
YQSVGPFSYRYSCSCQNYLKN

SEQ ID NO: 2809527 - protein, 17 aa, Entamoeba invadens
YQTIVLSAEYIRRWNTR

SEQ ID NO: 2809528 - protein, 22 aa, Entamoeba invadens
YQTQLFVYQSIRVESLNIIQSY

SEQ ID NO: 2809529 - protein, 17 aa, Entamoeba invadens
YQVGSSFIEIISKSILY

SEQ ID NO: 2809530 - protein, 18 aa, Entamoeba invadens
YQVIKEARVRGMNVDTIR

SEQ ID NO: 2809531 - protein, 17 aa, Entamoeba invadens
YQVPDYYVVKAKINRYL

SEQ ID NO: 2809532 - protein, 17 aa, Entamoeba invadens
YQVWCPLGPVRADRMSP

SEQ ID NO: 2809533 - protein, 17 aa, Entamoeba invadens
YQYPAKSPLVYVALSEK

SEQ ID NO: 2809534 - protein, 17 aa, Entamoeba invadens
YRACVKCASGFYKDSYN

SEQ ID NO: 2809535 - protein, 23 aa, Entamoeba invadens
YRAEITMTLSIICPNDCNEESGF

SEQ ID NO: 2809536 - protein, 18 aa, Entamoeba invadens
YRCEDGYQVLRCDGGSIV

SEQ ID NO: 2809537 - protein, 26 aa, Entamoeba invadens
YRCGTWRYLWHIALGDKWKNTIVSVV

SEQ ID NO: 2809538 - protein, 19 aa, Entamoeba invadens
YREGLNCFKCNEKCSTCLN

SEQ ID NO: 2809539 - protein, 21 aa, Entamoeba invadens
YREGLPLVLKGVSAVIHDKEK

SEQ ID NO: 2809540 - protein, 21 aa, Entamoeba invadens
YREGLPLVLKGVSAVINDNEK

SEQ ID NO: 2809541 - protein, 25 aa, Entamoeba invadens
YREKMKLFGIFVCINVIFVVFVQCA

SEQ ID NO: 2809542 - protein, 21 aa, Entamoeba invadens
YRENLPLVLKGVSVHIQDKEK

SEQ ID NO: 2809543 - protein, 17 aa, Entamoeba invadens
YRFEGTIGLIEIGDYKV

SEQ ID NO: 2809544 - protein, 17 aa, Entamoeba invadens
YRFRCVVKHGVGVLDRG

SEQ ID NO: 2809545 - protein, 17 aa, Entamoeba invadens
YRFSAPYKLMTTVRISH

SEQ ID NO: 2809546 - protein, 21 aa, Entamoeba invadens
YRIPFIPSLFAQNYFYIDFAN

SEQ ID NO: 2809547 - protein, 17 aa, Entamoeba invadens
YRISYSSSVLFSETKNA

SEQ ID NO: 2809548 - protein, 20 aa, Entamoeba invadens
YRKFPIFKLPTEVWYIEPYG

SEQ ID NO: 2809549 - protein, 27 aa, Entamoeba invadens
YRKGTECFKCPVGVELCVFTQNVVQPI

SEQ ID NO: 2809550 - protein, 17 aa, Entamoeba invadens
YRKTMNFKKREVLEVLE

SEQ ID NO: 2809551 - protein, 19 aa, Entamoeba invadens
YRLEMGHCVLCTTQNCSEC

SEQ ID NO: 2809552 - protein, 18 aa, Entamoeba invadens
YRLFVPIILSPSLMSLLL

SEQ ID NO: 2809553 - protein, 20 aa, Entamoeba invadens
YRLIHLANTLLLTAVTNTRK

SEQ ID NO: 2809554 - protein, 26 aa, Entamoeba invadens
YRLIPIFCILFGMAAVSIYGLIEGHL

SEQ ID NO: 2809555 - protein, 19 aa, Entamoeba invadens
YRLQLYFQSVINKFVNNDE

SEQ ID NO: 2809556 - protein, 20 aa, Entamoeba invadens
YRLSACFVTSIFGVIGIIFH

SEQ ID NO: 2809557 - protein, 23 aa, Entamoeba invadens
YRMVVFPVVAWVATYLMYRYRVL

SEQ ID NO: 2809558 - protein, 20 aa, Entamoeba invadens
YRNELKYAIHKPCVPYVGCF

SEQ ID NO: 2809559 - protein, 19 aa, Entamoeba invadens
YRNLLSWYLGGEIPELVEE

SEQ ID NO: 2809560 - protein, 23 aa, Entamoeba invadens
YRNQAGKCLCILLSCSSNQIVFI

SEQ ID NO: 2809561 - protein, 20 aa, Entamoeba invadens
YRPKVNLVIPLAIFNVIDGC

SEQ ID NO: 2809562 - protein, 25 aa, Entamoeba invadens
YRRIVWEWRTFHFITISIFLFLFLL

SEQ ID NO: 2809563 - protein, 21 aa, Entamoeba invadens
YRRLSYVIIYSFYKNIVMYLT

SEQ ID NO: 2809564 - protein, 19 aa, Entamoeba invadens
YRRSFWMTYPFTQLNLDTQ

SEQ ID NO: 2809565 - protein, 17 aa, Entamoeba invadens
YRRSLFLIGQATVMLLF

SEQ ID NO: 2809566 - protein, 22 aa, Entamoeba invadens
YRSGLECLPCISSCSSCQSKSM

SEQ ID NO: 2809567 - protein, 23 aa, Entamoeba invadens
YRSLPVAIKRFRWEDLDTNEMED

SEQ ID NO: 2809568 - protein, 23 aa, Entamoeba invadens
YRSYQKFSITGIHVFCESDRCEH

SEQ ID NO: 2809569 - protein, 22 aa, Entamoeba invadens
YRTNCTRCYDGFYLESRYSSYN

SEQ ID NO: 2809570 - protein, 19 aa, Entamoeba invadens
YRTSTGLILSIFSVMVYVV

SEQ ID NO: 2809571 - protein, 17 aa, Entamoeba invadens
YRVGLDCLPCLSNCSTC

SEQ ID NO: 2809572 - protein, 34 aa, Entamoeba invadens
YRVVDLCVRLNIPYHFSIGVSVFVVFLTFIFVVN

SEQ ID NO: 2809573 - protein, 18 aa, Entamoeba invadens
YRYCACSLLYNFGAFLFW

SEQ ID NO: 2809574 - protein, 20 aa, Entamoeba invadens
YRYDQPIITSFSYKQDPPRR

SEQ ID NO: 2809575 - protein, 20 aa, Entamoeba invadens
YRYLKNYDYAFSRRRFLFTG

SEQ ID NO: 2809576 - protein, 18 aa, Entamoeba invadens
YRYRGMDKIKFGFIAQEL

SEQ ID NO: 2809577 - protein, 17 aa, Entamoeba invadens
YSAPECYSDCYSFASDV

SEQ ID NO: 2809578 - protein, 17 aa, Entamoeba invadens
YSCKTCNSKSYFVNSTT

SEQ ID NO: 2809579 - protein, 34 aa, Entamoeba invadens
YSCNTCSFGGPGNCRTCKSYYYYSNGYCLKCSPN

SEQ ID NO: 2809580 - protein, 17 aa, Entamoeba invadens
YSCQTINGCKDCEPTKK

SEQ ID NO: 2809581 - protein, 24 aa, Entamoeba invadens
YSCRAFGAFVIFPVVFFSKTIFLY

SEQ ID NO: 2809582 - protein, 22 aa, Entamoeba invadens
YSCSIKHPFELCKAFATGGLVT

SEQ ID NO: 2809583 - protein, 21 aa, Entamoeba invadens
YSDKHGFDWSVVKDIIVQYSG

SEQ ID NO: 2809584 - protein, 17 aa, Entamoeba invadens
YSDLGLYDNVCVNLQNS

SEQ ID NO: 2809585 - protein, 18 aa, Entamoeba invadens
YSDRGCGSNARLIERLSD

SEQ ID NO: 2809586 - protein, 17 aa, Entamoeba invadens
YSDVEWNEMASSSFTTS

SEQ ID NO: 2809587 - protein, 17 aa, Entamoeba invadens
YSECKSCGEMTYSTAGS

SEQ ID NO: 2809588 - protein, 17 aa, Entamoeba invadens
YSECKSCGEMTYSTGGS

SEQ ID NO: 2809589 - protein, 20 aa, Entamoeba invadens
YSEEVPREYLIDVVDEQIFL

SEQ ID NO: 2809590 - protein, 20 aa, Entamoeba invadens
YSEFKSIFEIKNFVKSGNRL

SEQ ID NO: 2809591 - protein, 18 aa, Entamoeba invadens
YSEGYSFLSTAKLDYFEG

SEQ ID NO: 2809592 - protein, 18 aa, Entamoeba invadens
YSEIETISTCLGIYENWF

SEQ ID NO: 2809593 - protein, 22 aa, Entamoeba invadens
YSFAITAWEIFYQKEPYKEFMS

SEQ ID NO: 2809594 - protein, 33 aa, Entamoeba invadens
YSFAITMFECFGWKEAYPIDTFKYTWKIAEFVI

SEQ ID NO: 2809595 - protein, 17 aa, Entamoeba invadens
YSFAITMFECFSWEEAY

SEQ ID NO: 2809596 - protein, 43 aa, Entamoeba invadens
YSFAITMFECFSWKDAYPITTFKFPWKIAEFVSSGKRPDISDT

SEQ ID NO: 2809597 - protein, 17 aa, Entamoeba invadens
YSFAITMYECFQWTEAY

SEQ ID NO: 2809598 - protein, 22 aa, Entamoeba invadens
YSFAIVMWEFLARKEPYPDIPR

SEQ ID NO: 2809599 - protein, 17 aa, Entamoeba invadens
YSFGIMAWEVFYQEEPY

SEQ ID NO: 2809600 - protein, 17 aa, Entamoeba invadens
YSFGITGWEIFYQDEPY

SEQ ID NO: 2809601 - protein, 24 aa, Entamoeba invadens
YSFGITLYEVFGWCEAYQQKKFKF

SEQ ID NO: 2809602 - protein, 26 aa, Entamoeba invadens
YSFGLSVFECITWIEAYLKKQFKFAW

SEQ ID NO: 2809603 - protein, 25 aa, Entamoeba invadens
YSFGMSLYEVIGWCSAFSECRYVWN

SEQ ID NO: 2809604 - protein, 28 aa, Entamoeba invadens
YSFGMTLCYIIKWNDPFDGMNFVGIPKF

SEQ ID NO: 2809605 - protein, 23 aa, Entamoeba invadens
YSFGVSLFECVTWKEPYPKIRFK

SEQ ID NO: 2809606 - protein, 24 aa, Entamoeba invadens
YSFGVSLFECVTWKEPYPKIRFKF

SEQ ID NO: 2809607 - protein, 23 aa, Entamoeba invadens
YSFGVSMYECFIWQRPFLDKGFK

SEQ ID NO: 2809608 - protein, 42 aa, Entamoeba invadens
YSFGVTMFECFAWKEAYKGLKFKFAWNIADFIIKGKRLENTG

SEQ ID NO: 2809609 - protein, 18 aa, Entamoeba invadens
YSFIKGITSFGEYSMSNT

SEQ ID NO: 2809610 - protein, 23 aa, Entamoeba invadens
YSFLCALLSEYITKYFVTGNTDY

SEQ ID NO: 2809611 - protein, 43 aa, Entamoeba invadens
YSFSITMFECFGWREAYPTAQFKYSWDVADFVACGNRLSKPSD

SEQ ID NO: 2809612 - protein, 40 aa, Entamoeba invadens
YSGDFDGFLTLSCVFLRCGIETVKALPLIFSTELSTWIDS

SEQ ID NO: 2809613 - protein, 22 aa, Entamoeba invadens
YSGSSYLLLLSMFTINIYLNYF

SEQ ID NO: 2809614 - protein, 23 aa, Entamoeba invadens
YSGSWDILMDWGLMQKSYNFLRK

SEQ ID NO: 2809615 - protein, 17 aa, Entamoeba invadens
YSGVCSNVFKYQPNNKR

SEQ ID NO: 2809616 - protein, 30 aa, Entamoeba invadens
YSHGTFRTARCLKCGMKFDNTNVFIENITK

SEQ ID NO: 2809617 - protein, 23 aa, Entamoeba invadens
YSHIWDTHLRKVLTETQPGVYED

SEQ ID NO: 2809618 - protein, 22 aa, Entamoeba invadens
YSIRPTAWPWLDNEISQAKKAH

SEQ ID NO: 2809619 - protein, 23 aa, Entamoeba invadens
YSISLICGVVRVFSDTKNYTLKC

SEQ ID NO: 2809620 - protein, 18 aa, Entamoeba invadens
YSITRFLYIATISNMVFD

SEQ ID NO: 2809621 - protein, 24 aa, Entamoeba invadens
YSIVLFCILALYTHSDFFNEHLNA

SEQ ID NO: 2809622 - protein, 18 aa, Entamoeba invadens
YSKCVGLWEPLKFKHQKT

SEQ ID NO: 2809623 - protein, 21 aa, Entamoeba invadens
YSKCYEMSSFFGYANVRCRNC

SEQ ID NO: 2809624 - protein, 18 aa, Entamoeba invadens
YSKHPKHRFIILLDNIFR

SEQ ID NO: 2809625 - protein, 17 aa, Entamoeba invadens
YSKNRIFMAQAIFIILA

SEQ ID NO: 2809626 - protein, 24 aa, Entamoeba invadens
YSKTRATPYLSLKRTFEVENLVKT

SEQ ID NO: 2809627 - protein, 25 aa, Entamoeba invadens
YSKYLGAFCLFCFVTQMYYKYQRRI

SEQ ID NO: 2809628 - protein, 18 aa, Entamoeba invadens
YSLAIFMFECMSWEEAYK

SEQ ID NO: 2809629 - protein, 26 aa, Entamoeba invadens
YSLAISFFEIIGWAEPFAKSTFKYPW

SEQ ID NO: 2809630 - protein, 23 aa, Entamoeba invadens
YSLGITIWELFYQRYPFEEYYDA

SEQ ID NO: 2809631 - protein, 27 aa, Entamoeba invadens
YSLGVTMFECFMWKEAYKGKIFKFPWG

SEQ ID NO: 2809632 - protein, 19 aa, Entamoeba invadens
YSLHPGEAITIEFKIKMLC

SEQ ID NO: 2809633 - protein, 19 aa, Entamoeba invadens
YSLKRFFMLTTSYDENLVN

SEQ ID NO: 2809634 - protein, 24 aa, Entamoeba invadens
YSLKRFKYPWTIADFVTSGNRLEN

SEQ ID NO: 2809635 - protein, 18 aa, Entamoeba invadens
YSLNLKGVIESKCQIRDN

SEQ ID NO: 2809636 - protein, 18 aa, Entamoeba invadens
YSLSKCCQCNCLITNQTS

SEQ ID NO: 2809637 - protein, 19 aa, Entamoeba invadens
YSLVWKQKPIFVKTFSKAQ

SEQ ID NO: 2809638 - protein, 17 aa, Entamoeba invadens
YSMLRVCSLMLKEQNNK

SEQ ID NO: 2809639 - protein, 19 aa, Entamoeba invadens
YSMMYKMCYHNFYKASNGY

SEQ ID NO: 2809640 - protein, 27 aa, Entamoeba invadens
YSMSGCLVCATGYYLDNWLCSKCSINC

SEQ ID NO: 2809641 - protein, 19 aa, Entamoeba invadens
YSNILWKEISKQSVIGVNK

SEQ ID NO: 2809642 - protein, 28 aa, Entamoeba invadens
YSNMEFKFSWKIAEFVIFGHRLDNNRNI

SEQ ID NO: 2809643 - protein, 17 aa, Entamoeba invadens
YSNSILFEIWGTLYDNT

SEQ ID NO: 2809644 - protein, 22 aa, Entamoeba invadens
YSNVLNLLGIVCRLTDRVFEEY

SEQ ID NO: 2809645 - protein, 26 aa, Entamoeba invadens
YSPDEWKKKCWDLFINIVSDVAPVKF

SEQ ID NO: 2809646 - protein, 25 aa, Entamoeba invadens
YSPEGCLNCTSGYYLDAGNCHTCNE

SEQ ID NO: 2809647 - protein, 26 aa, Entamoeba invadens
YSPTECFRCALGYSVLQGNCTIPQLL

SEQ ID NO: 2809648 - protein, 21 aa, Entamoeba invadens
YSQFLRDVCTSETTKVVQMKK

SEQ ID NO: 2809649 - protein, 19 aa, Entamoeba invadens
YSRKCVKCSNGYYPDSNGK

SEQ ID NO: 2809650 - protein, 18 aa, Entamoeba invadens
YSRRCVKCSNGYYPDSNG

SEQ ID NO: 2809651 - protein, 19 aa, Entamoeba invadens
YSRRCVTCSNGYYPDSNGK

SEQ ID NO: 2809652 - protein, 26 aa, Entamoeba invadens
YSSCNACGVGCAYCTFNQNGYCQTCL

SEQ ID NO: 2809653 - protein, 26 aa, Entamoeba invadens
YSSGFFGVRLLIEMLRVSVEKLFGKR

SEQ ID NO: 2809654 - protein, 26 aa, Entamoeba invadens
YSSIRASSCSICLAGTYSNKGSSTCT

SEQ ID NO: 2809655 - protein, 25 aa, Entamoeba invadens
YSSKYECLKCNLELSLVKVSGKSVC

SEQ ID NO: 2809656 - protein, 21 aa, Entamoeba invadens
YSSTRLAWCVLIVSIVLFAFS

SEQ ID NO: 2809657 - protein, 23 aa, Entamoeba invadens
YSSVLKFPVLNPYKNTEKDGDSF

SEQ ID NO: 2809658 - protein, 17 aa, Entamoeba invadens
YSTAWRGFTDWGDVVYY

SEQ ID NO: 2809659 - protein, 18 aa, Entamoeba invadens
YSTCLKCSEGTYPNGVGK

SEQ ID NO: 2809660 - protein, 22 aa, Entamoeba invadens
YSTCWRLAHSELEIENFNEKMP

SEQ ID NO: 2809661 - protein, 21 aa, Entamoeba invadens
YSTLELFNFSVLMTSGQITTQ

SEQ ID NO: 2809662 - protein, 17 aa, Entamoeba invadens
YSTLVFIYNTAMAKLRE

SEQ ID NO: 2809663 - protein, 19 aa, Entamoeba invadens
YSTNCLYGTTSICSKCRNQ

SEQ ID NO: 2809664 - protein, 20 aa, Entamoeba invadens
YSTSKYRFGKWFELDMSTFG

SEQ ID NO: 2809665 - protein, 23 aa, Entamoeba invadens
YSVCSSRNSVWLGGLSVPQLNYI

SEQ ID NO: 2809666 - protein, 20 aa, Entamoeba invadens
YSVHSMPTFILFKNGSEFDR

SEQ ID NO: 2809667 - protein, 29 aa, Entamoeba invadens
YSVPIPDFSCYRVKCVERGYRVRVNNNWM

SEQ ID NO: 2809668 - protein, 24 aa, Entamoeba invadens
YSVRLPRSVLTDRPIELKDFPMDQ

SEQ ID NO: 2809669 - protein, 19 aa, Entamoeba invadens
YSVSELNIIFSVGLFGVYF

SEQ ID NO: 2809670 - protein, 17 aa, Entamoeba invadens
YSYCAPQNFPAYFAQNF

SEQ ID NO: 2809671 - protein, 24 aa, Entamoeba invadens
YSYFKGDVAQFAWYYGQVSPCGIP

SEQ ID NO: 2809672 - protein, 18 aa, Entamoeba invadens
YSYNFTYGKGYLISNKKL

SEQ ID NO: 2809673 - protein, 18 aa, Entamoeba invadens
YSYRCCGGNPMNCAEAAP

SEQ ID NO: 2809674 - protein, 25 aa, Entamoeba invadens
YTADGKGGCTMSCIYGSACLTGCLK

SEQ ID NO: 2809675 - protein, 18 aa, Entamoeba invadens
YTCESCIDVIMPLKSTLY

SEQ ID NO: 2809676 - protein, 20 aa, Entamoeba invadens
YTCKKCKGHFAECLTENTPT

SEQ ID NO: 2809677 - protein, 22 aa, Entamoeba invadens
YTCKKCPPHFVDCLTDKTPLPG

SEQ ID NO: 2809678 - protein, 17 aa, Entamoeba invadens
YTCSSNMEKTCLTCERG

SEQ ID NO: 2809679 - protein, 17 aa, Entamoeba invadens
YTCTKPGRCDGCASDKV

SEQ ID NO: 2809680 - protein, 20 aa, Entamoeba invadens
YTDKITFSNLMNWYNETLRY

SEQ ID NO: 2809681 - protein, 24 aa, Entamoeba invadens
YTEFRYSVVGKYVYPVIFHNQFWL

SEQ ID NO: 2809682 - protein, 18 aa, Entamoeba invadens
YTEIFLGQMSMLYTRRVD

SEQ ID NO: 2809683 - protein, 19 aa, Entamoeba invadens
YTEKSFLLLIELKNCMFSN

SEQ ID NO: 2809684 - protein, 22 aa, Entamoeba invadens
YTETNFTLFVGMVDAYDCVITV

SEQ ID NO: 2809685 - protein, 26 aa, Entamoeba invadens
YTFFKRESFVNSNWFFALWYFILSCL

SEQ ID NO: 2809686 - protein, 18 aa, Entamoeba invadens
YTFIFCLYLFNKSIYVHH

SEQ ID NO: 2809687 - protein, 21 aa, Entamoeba invadens
YTFKANYSLILLVSTDDLTSF

SEQ ID NO: 2809688 - protein, 17 aa, Entamoeba invadens
YTFKQIINTFTFPLLTT

SEQ ID NO: 2809689 - protein, 18 aa, Entamoeba invadens
YTFLKSSFGRFTYAMETL

SEQ ID NO: 2809690 - protein, 20 aa, Entamoeba invadens
YTFNPNLVMWTIFYEYVYAL

SEQ ID NO: 2809691 - protein, 24 aa, Entamoeba invadens
YTFSLSFCLFCRTNMLQCLFVDND

SEQ ID NO: 2809692 - protein, 17 aa, Entamoeba invadens
YTFVPWNIMVMTILTGI

SEQ ID NO: 2809693 - protein, 18 aa, Entamoeba invadens
YTFYKIIVWYIVSLNEYK

SEQ ID NO: 2809694 - protein, 25 aa, Entamoeba invadens
YTGDEFKFPWSIANFVASGKRLSVR

SEQ ID NO: 2809695 - protein, 26 aa, Entamoeba invadens
YTGGELYYYPKFQGMESLKLQKDMMN

SEQ ID NO: 2809696 - protein, 18 aa, Entamoeba invadens
YTICFSVQNAVRYDVEYK

SEQ ID NO: 2809697 - protein, 24 aa, Entamoeba invadens
YTIFELFWRLVFIIFSCLCTIVYL

SEQ ID NO: 2809698 - protein, 17 aa, Entamoeba invadens
YTIIPIIGAVVFIVIGS

SEQ ID NO: 2809699 - protein, 19 aa, Entamoeba invadens
YTIIVTIEFNSLRKMMSIL

SEQ ID NO: 2809700 - protein, 32 aa, Entamoeba invadens
YTIKSPLKTVCWECIEYPLPLKNALLTWSSVI

SEQ ID NO: 2809701 - protein, 19 aa, Entamoeba invadens
YTIPARSNINIQLVGINNV

SEQ ID NO: 2809702 - protein, 26 aa, Entamoeba invadens
YTKHQFRFPWKIAEFVINGKRVEKKE

SEQ ID NO: 2809703 - protein, 23 aa, Entamoeba invadens
YTLDEIRLILSVRAEEEGVKLTA

SEQ ID NO: 2809704 - protein, 22 aa, Entamoeba invadens
YTLLCLIPIHFLTLFTFYIQAF

SEQ ID NO: 2809705 - protein, 18 aa, Entamoeba invadens
YTLLCYFLGFIPQYYPQY

SEQ ID NO: 2809706 - protein, 26 aa, Entamoeba invadens
YTLLSHIRKALLLFTNFPMIFIPNSR

SEQ ID NO: 2809707 - protein, 18 aa, Entamoeba invadens
YTLMEILWTFSIFLETVA

SEQ ID NO: 2809708 - protein, 29 aa, Entamoeba invadens
YTLQMAKIWYSQRLEWLGFTISTLTVLLI

SEQ ID NO: 2809709 - protein, 18 aa, Entamoeba invadens
YTLSEGICKYCYEANEHC

SEQ ID NO: 2809710 - protein, 17 aa, Entamoeba invadens
YTNFKMTVNILKNNVIK

SEQ ID NO: 2809711 - protein, 25 aa, Entamoeba invadens
YTNGKCTRCNPRFYLDTYKCYECST

SEQ ID NO: 2809712 - protein, 18 aa, Entamoeba invadens
YTNIKFAFQIANHVCEGK

SEQ ID NO: 2809713 - protein, 22 aa, Entamoeba invadens
YTPNTFCQIFFLCILIFGVLFW

SEQ ID NO: 2809714 - protein, 19 aa, Entamoeba invadens
YTQEGMYIYKYVSSDCKEW

SEQ ID NO: 2809715 - protein, 19 aa, Entamoeba invadens
YTQLRCEFITDFQFEIVDV

SEQ ID NO: 2809716 - protein, 24 aa, Entamoeba invadens
YTQMRFKCGLFFCKLAVGNYITIN

SEQ ID NO: 2809717 - protein, 25 aa, Entamoeba invadens
YTQQFPDLYPKTAFKKTANKTPMKS

SEQ ID NO: 2809718 - protein, 24 aa, Entamoeba invadens
YTQRTRLGKWFSLDITTITDQYIV

SEQ ID NO: 2809719 - protein, 20 aa, Entamoeba invadens
YTRELICFGNKNAFTVKLQI

SEQ ID NO: 2809720 - protein, 26 aa, Entamoeba invadens
YTSVGCLRCAKGYYGDRNNKCNKCNT

SEQ ID NO: 2809721 - protein, 18 aa, Entamoeba invadens
YTSVHWMVRIYKVKKENN

SEQ ID NO: 2809722 - protein, 25 aa, Entamoeba invadens
YTTAGICIPCPEGTYSSNNLCVKCP

SEQ ID NO: 2809723 - protein, 18 aa, Entamoeba invadens
YTTCNLKAAGKLEVGTSV

SEQ ID NO: 2809724 - protein, 17 aa, Entamoeba invadens
YTTFPGIQNVQSKGEFF

SEQ ID NO: 2809725 - protein, 17 aa, Entamoeba invadens
YTTLKLPQCSVCVNGAY

SEQ ID NO: 2809726 - protein, 17 aa, Entamoeba invadens
YTTSGMNCVLNYCSVFE

SEQ ID NO: 2809727 - protein, 24 aa, Entamoeba invadens
YTYKCDAKSGYCIKDKKGSAKCPS

SEQ ID NO: 2809728 - protein, 25 aa, Entamoeba invadens
YVACAEAFVTFFAMTLFPQNNHLKE

SEQ ID NO: 2809729 - protein, 21 aa, Entamoeba invadens
YVCLLCGTAKPISGSNECPTR

SEQ ID NO: 2809730 - protein, 17 aa, Entamoeba invadens
YVDECYGFVTLLLGTLF

SEQ ID NO: 2809731 - protein, 24 aa, Entamoeba invadens
YVDLCILRNKFPSSVSLALDITNF

SEQ ID NO: 2809732 - protein, 18 aa, Entamoeba invadens
YVEARVGETLSISLHLFD

SEQ ID NO: 2809733 - protein, 26 aa, Entamoeba invadens
YVERLFSLYLPIMVGYHVYISTDVLY

SEQ ID NO: 2809734 - protein, 26 aa, Entamoeba invadens
YVERLFSLYLPIMVGYQVYVSTDVLY

SEQ ID NO: 2809735 - protein, 28 aa, Entamoeba invadens
YVGDISQRCKIFLPDGLRCAVCQMGYVL

SEQ ID NO: 2809736 - protein, 25 aa, Entamoeba invadens
YVGPLAIYVLCYFISIALGFPNLVQ

SEQ ID NO: 2809737 - protein, 18 aa, Entamoeba invadens
YVHCLKCKDPLRNPLTNC

SEQ ID NO: 2809738 - protein, 17 aa, Entamoeba invadens
YVHCTECVDVLREPTTN

SEQ ID NO: 2809739 - protein, 22 aa, Entamoeba invadens
YVIIGFSCSFTFGTNTKTPVTH

SEQ ID NO: 2809740 - protein, 24 aa, Entamoeba invadens
YVIRFYGACFIPNRICMVTELAKH

SEQ ID NO: 2809741 - protein, 23 aa, Entamoeba invadens
YVISRSAYQWTFQRVTEVYMMYF

SEQ ID NO: 2809742 - protein, 17 aa, Entamoeba invadens
YVKESFTGTFGIVDVMK

SEQ ID NO: 2809743 - protein, 18 aa, Entamoeba invadens
YVKLAKWVKKYHVKSSHN

SEQ ID NO: 2809744 - protein, 26 aa, Entamoeba invadens
YVKMPYKLKVRMLFDTSRGMQFLHEN

SEQ ID NO: 2809745 - protein, 27 aa, Entamoeba invadens
YVKMPYKLKVRMLFDTSRGMQFLHENR

SEQ ID NO: 2809746 - protein, 20 aa, Entamoeba invadens
YVKNCISLILSEFETISYKV

SEQ ID NO: 2809747 - protein, 19 aa, Entamoeba invadens
YVKVCPDTLVEPSFSLFLE

SEQ ID NO: 2809748 - protein, 20 aa, Entamoeba invadens
YVLFICYILSMITSVRASCP

SEQ ID NO: 2809749 - protein, 23 aa, Entamoeba invadens
YVLFLCFFSRALNVFPISFLMNF

SEQ ID NO: 2809750 - protein, 18 aa, Entamoeba invadens
YVLNCVRLTNPLRNVKIV

SEQ ID NO: 2809751 - protein, 24 aa, Entamoeba invadens
YVLNRGVSCLIVPKNLRETDIGIF

SEQ ID NO: 2809752 - protein, 26 aa, Entamoeba invadens
YVLSSGFSNKRCCGGNSGIAIEGQPT

SEQ ID NO: 2809753 - protein, 17 aa, Entamoeba invadens
YVLVFGHVISVVLTLLV

SEQ ID NO: 2809754 - protein, 19 aa, Entamoeba invadens
YVPHILKLAFDLMSSECDE

SEQ ID NO: 2809755 - protein, 18 aa, Entamoeba invadens
YVPLSGSITSVWQNYKSG

SEQ ID NO: 2809756 - protein, 25 aa, Entamoeba invadens
YVQIYDCRDYYSALGNKAFKQAGFE

SEQ ID NO: 2809757 - protein, 26 aa, Entamoeba invadens
YVSELLKYYGIVYLKNRVETIRLKDD

SEQ ID NO: 2809758 - protein, 27 aa, Entamoeba invadens
YVSVCIWPFCTSIFWSVTTGTIGFESP

SEQ ID NO: 2809759 - protein, 17 aa, Entamoeba invadens
YVTPAFGFGTIVVKKLI

SEQ ID NO: 2809760 - protein, 19 aa, Entamoeba invadens
YVVAASLFLCMKLEDCRNR

SEQ ID NO: 2809761 - protein, 23 aa, Entamoeba invadens
YVVFLCIFAPFKFQNESTGENTP

SEQ ID NO: 2809762 - protein, 18 aa, Entamoeba invadens
YVVHFYGACFVPNKICMV

SEQ ID NO: 2809763 - protein, 23 aa, Entamoeba invadens
YVVKTFFRYFGLMSYLIPISCAV

SEQ ID NO: 2809764 - protein, 23 aa, Entamoeba invadens
YVVYLCSALGLFVVTILIFLCYD

SEQ ID NO: 2809765 - protein, 26 aa, Entamoeba invadens
YVWQVFPRVLAKYVGLDTFFNFLPDQ

SEQ ID NO: 2809766 - protein, 20 aa, Entamoeba invadens
YWALPIPLFILSLFYSTEAI

SEQ ID NO: 2809767 - protein, 19 aa, Entamoeba invadens
YWANLDFKTSSMFSSANLY

SEQ ID NO: 2809768 - protein, 18 aa, Entamoeba invadens
YWGAPNCDQYCKCTGGKT

SEQ ID NO: 2809769 - protein, 20 aa, Entamoeba invadens
YWHRAVHIGLLFTPTTNMYP

SEQ ID NO: 2809770 - protein, 18 aa, Entamoeba invadens
YWLIAARLMTNILQAVED

SEQ ID NO: 2809771 - protein, 37 aa, Entamoeba invadens
YWNQGFLKYWRLIEIPNFLLCAPAVIISLIVCGYYLV

SEQ ID NO: 2809772 - protein, 21 aa, Entamoeba invadens
YWSPCFEILEIATTYFMKNSK

SEQ ID NO: 2809773 - protein, 21 aa, Entamoeba invadens
YWSPLVWVCGIVQTVLYADYF

SEQ ID NO: 2809774 - protein, 20 aa, Entamoeba invadens
YWYLAVDIQLSLPLYFIKKF

SEQ ID NO: 2809775 - protein, 18 aa, Entamoeba invadens
YYADKNVKIEMKIEDSNN

SEQ ID NO: 2809776 - protein, 25 aa, Entamoeba invadens
YYASQWLGIAAFCLYLTSLVLYVPP

SEQ ID NO: 2809777 - protein, 18 aa, Entamoeba invadens
YYCAAGEVIKCDDGYVHY

SEQ ID NO: 2809778 - protein, 24 aa, Entamoeba invadens
YYCEYDMAVCLAAHTKCTVCAVNK

SEQ ID NO: 2809779 - protein, 23 aa, Entamoeba invadens
YYDDFYAYLPFVIDIVEGEYIFT

SEQ ID NO: 2809780 - protein, 31 aa, Entamoeba invadens
YYDECGHCTALLCDGCKTGAYKDNAWYYCYK

SEQ ID NO: 2809781 - protein, 19 aa, Entamoeba invadens
YYDEKRKFLYVGWSSGEIQ

SEQ ID NO: 2809782 - protein, 17 aa, Entamoeba invadens
YYDRKWLVDNTNLCYFG

SEQ ID NO: 2809783 - protein, 21 aa, Entamoeba invadens
YYEIRSVPPLVTLKPGYACEF

SEQ ID NO: 2809784 - protein, 24 aa, Entamoeba invadens
YYERFLFCKDTMLSISIIHSIRKL

SEQ ID NO: 2809785 - protein, 18 aa, Entamoeba invadens
YYFFYGFYILFSIILCLL

SEQ ID NO: 2809786 - protein, 19 aa, Entamoeba invadens
YYFLNGMCERLLFYRFNSK

SEQ ID NO: 2809787 - protein, 20 aa, Entamoeba invadens
YYFNECFIIVLATFFAVLFQ

SEQ ID NO: 2809788 - protein, 26 aa, Entamoeba invadens
YYFSFRVTEMSRFVGLPIGRTVLIKP

SEQ ID NO: 2809789 - protein, 19 aa, Entamoeba invadens
YYFVCLATTCLTLFHGYHT

SEQ ID NO: 2809790 - protein, 39 aa, Entamoeba invadens
YYFYKNKCFECSNGCLKCVKEGCVLCDTGYLLVQQNGVD

SEQ ID NO: 2809791 - protein, 26 aa, Entamoeba invadens
YYGAFTICVVVLYFALFVASDFMGYH

SEQ ID NO: 2809792 - protein, 18 aa, Entamoeba invadens
YYGTKQCDSDCNCVNNTI

SEQ ID NO: 2809793 - protein, 17 aa, Entamoeba invadens
YYHNAVIDFVIQFKNPE

SEQ ID NO: 2809794 - protein, 23 aa, Entamoeba invadens
YYIENGVCVKCEYPCTHCSNLTF

SEQ ID NO: 2809795 - protein, 21 aa, Entamoeba invadens
YYIENGVCVKCEYPCTYCSNL

SEQ ID NO: 2809796 - protein, 21 aa, Entamoeba invadens
YYIENGVCVQCEYPCIHCSNL

SEQ ID NO: 2809797 - protein, 33 aa, Entamoeba invadens
YYIILLICMSFKYIPHRGAILLAIGVGLGQFCC

SEQ ID NO: 2809798 - protein, 17 aa, Entamoeba invadens
YYIPRTEVLCGNETTFK

SEQ ID NO: 2809799 - protein, 22 aa, Entamoeba invadens
YYIRKSSVFFLVYSITSIYSFK

SEQ ID NO: 2809800 - protein, 24 aa, Entamoeba invadens
YYKDRYRFGKWFKLLYNIKNSSHI

SEQ ID NO: 2809801 - protein, 18 aa, Entamoeba invadens
YYKNRKRQISAFVVISLM

SEQ ID NO: 2809802 - protein, 26 aa, Entamoeba invadens
YYKQKYRLARWFKINLNQFTEDHFLI

SEQ ID NO: 2809803 - protein, 17 aa, Entamoeba invadens
YYLDPALSLIVACVVMS

SEQ ID NO: 2809804 - protein, 18 aa, Entamoeba invadens
YYLDPSLSLVVACVVMTS

SEQ ID NO: 2809805 - protein, 18 aa, Entamoeba invadens
YYLIIVVVVVLIVFLAFH

SEQ ID NO: 2809806 - protein, 23 aa, Entamoeba invadens
YYLKDGKCEACLFGCALCYNSSV

SEQ ID NO: 2809807 - protein, 21 aa, Entamoeba invadens
YYLKGEAYASIKKPLAQINGL

SEQ ID NO: 2809808 - protein, 22 aa, Entamoeba invadens
YYLKGEAYASIKKPLAQINGLF

SEQ ID NO: 2809809 - protein, 23 aa, Entamoeba invadens
YYLKGEAYASIKKPLAQINGLFL

SEQ ID NO: 2809810 - protein, 19 aa, Entamoeba invadens
YYLNAGQCVQCDWSCGGAC

SEQ ID NO: 2809811 - protein, 26 aa, Entamoeba invadens
YYLNSLKMKLSILIGVFHMIFGIILS

SEQ ID NO: 2809812 - protein, 19 aa, Entamoeba invadens
YYLQNGRCINCKESCATCE

SEQ ID NO: 2809813 - protein, 22 aa, Entamoeba invadens
YYMECVNYVPDLLADVTLNCSG

SEQ ID NO: 2809814 - protein, 24 aa, Entamoeba invadens
YYNEFKSWYSFVLSSFVGVIYTFG

SEQ ID NO: 2809815 - protein, 17 aa, Entamoeba invadens
YYNGMIFCEKCKTHYKI

SEQ ID NO: 2809816 - protein, 24 aa, Entamoeba invadens
YYNLYCFAMGFLMISYNKGVEQKK

SEQ ID NO: 2809817 - protein, 25 aa, Entamoeba invadens
YYNTSCFVLCFSLVYMDSYKSLKTL

SEQ ID NO: 2809818 - protein, 17 aa, Entamoeba invadens
YYPIAYWYYYKFYFLLV

SEQ ID NO: 2809819 - protein, 22 aa, Entamoeba invadens
YYPKQGLCVPCDYGCTTCSSAT

SEQ ID NO: 2809820 - protein, 26 aa, Entamoeba invadens
YYQYKTGLCLFAIVPLALLVIYLNGK

SEQ ID NO: 2809821 - protein, 25 aa, Entamoeba invadens
YYSFTPYCYVHFFLNKSVTENMGMF

SEQ ID NO: 2809822 - protein, 21 aa, Entamoeba invadens
YYSHYAMKYVKCGPVDSILTA

SEQ ID NO: 2809823 - protein, 25 aa, Entamoeba invadens
YYSVLGRTNWKVAVEIDGTQITTVD

SEQ ID NO: 2809824 - protein, 22 aa, Entamoeba invadens
YYSYTPHCYVHFYINSTSYITS

SEQ ID NO: 2809825 - protein, 25 aa, Entamoeba invadens
YYTCRSCIVSILWKYLAFSVKCALK

SEQ ID NO: 2809826 - protein, 30 aa, Entamoeba invadens
YYTPVERLLWFKSHGFIHLLMKCLSISQAI

SEQ ID NO: 2809827 - protein, 19 aa, Entamoeba invadens
YYTSTLGYGCFCNSTTSFE

SEQ ID NO: 2809828 - protein, 18 aa, Entamoeba invadens
YYTTRICKNTINIDFLNS

SEQ ID NO: 2809829 - protein, 19 aa, Entamoeba invadens
YYVCSNSYEGFLPCPKGER

SEQ ID NO: 2809830 - protein, 18 aa, Entamoeba invadens
YYVENGICIKDCDLEGNC

SEQ ID NO: 2809831 - protein, 26 aa, Entamoeba invadens
YYVNSLKMKLSILIGVFHMIFGIILS

SEQ ID NO: 2809832 - protein, 27 aa, Entamoeba invadens
YYWQLGLCIIAIFPVLLFFLFWNGYLN

SEQ ID NO: 2809833 - protein, 30 aa, Entamoeba invadens
YYYKNVVFESCNFVNCIFYLDDVHSAKNID

SEQ ID NO: 2809834 - protein, 25 aa, Entamoeba invadens
YYYYKELFLNTVFGFICPSKNVNIT

SEQ ID NO: 2809835 - protein, 21 aa, Entamoeba invadens
GCLRCLSGYYLADRMCVKCEY

SEQ ID NO: 2809836 - protein, 22 aa, Entamoeba invadens
CNKCTDGVLFRCYGVDGVAAWS

SEQ ID NO: 2809837 - protein, 18 aa, Entamoeba invadens
EDRMARVVEKFEFPMYMI

SEQ ID NO: 2809838 - protein, 23 aa, Entamoeba invadens
FDGKEFLDSWALLNTAGTDIELQ

SEQ ID NO: 2809839 - protein, 19 aa, Entamoeba invadens
FGIVYRAEWRRVDVAVKVM

SEQ ID NO: 2809840 - protein, 18 aa, Entamoeba invadens
GEACEFEILLTLKCTTKM

SEQ ID NO: 2809841 - protein, 21 aa, Entamoeba invadens
NEFKMSSGFSVYFDVETVIKS

SEQ ID NO: 2809842 - protein, 18 aa, Entamoeba invadens
PKDVPIFIMRVGLGKNFT

SEQ ID NO: 2809843 - protein, 22 aa, Entamoeba invadens
QYYCNIFKWAIDANILAEIKKY

SEQ ID NO: 2809844 - protein, 22 aa, Entamoeba invadens
STDCLSCASGLYLNDSTHQCID

SEQ ID NO: 2809845 - protein, 25 aa, Entamoeba invadens
VYSFAICMLEIWLGRDPYDPAKFPD

SEQ ID NO: 2809846 - protein, 17 aa, Entamoeba invadens
AEKCKLFLPSGVDCATC

SEQ ID NO: 2809847 - protein, 17 aa, Entamoeba invadens
CEVEDPFNIDHFGCTAY

SEQ ID NO: 2809848 - protein, 20 aa, Entamoeba invadens
CIECKNCKQGFCGNETGCYE

SEQ ID NO: 2809849 - protein, 20 aa, Entamoeba invadens
CLRCLSGYYLADHMCVKCDY

SEQ ID NO: 2809850 - protein, 24 aa, Entamoeba invadens
CRLCKNEKCSICDNNFILKNESFC

SEQ ID NO: 2809851 - protein, 18 aa, Entamoeba invadens
CSLCEVEDPFNIDHFGCT

SEQ ID NO: 2809852 - protein, 20 aa, Entamoeba invadens
DAFKLKGGICAETFDEDDKL

SEQ ID NO: 2809853 - protein, 24 aa, Entamoeba invadens
DISGKGGDCLIHLETTSATPVTVM

SEQ ID NO: 2809854 - protein, 23 aa, Entamoeba invadens
EAFPLMFSTGASVSWPEGTIKIV

SEQ ID NO: 2809855 - protein, 17 aa, Entamoeba invadens
ESCFTCAFGYYFDTTNN

SEQ ID NO: 2809856 - protein, 17 aa, Entamoeba invadens
ESECLSCEIEHCTSCLE

SEQ ID NO: 2809857 - protein, 18 aa, Entamoeba invadens
FACKKCRVSNCAKCDSKV

SEQ ID NO: 2809858 - protein, 20 aa, Entamoeba invadens
FEFPMYMIAVIIIFVLVLAV

SEQ ID NO: 2809859 - protein, 18 aa, Entamoeba invadens
FFEIIGWAEPFPKKRFKH

SEQ ID NO: 2809860 - protein, 17 aa, Entamoeba invadens
FGKFLYRFCFFILSERI

SEQ ID NO: 2809861 - protein, 17 aa, Entamoeba invadens
FKFPWKIAEFVISGKRL

SEQ ID NO: 2809862 - protein, 17 aa, Entamoeba invadens
FMLDVAMGIMYLHENGI

SEQ ID NO: 2809863 - protein, 19 aa, Entamoeba invadens
FNYSGVCGDVFKYGPNTKR

SEQ ID NO: 2809864 - protein, 19 aa, Entamoeba invadens
FVRKCVKCVAGSYPQTAGD

SEQ ID NO: 2809865 - protein, 18 aa, Entamoeba invadens
GECQLCPSGKYYNPNSKS

SEQ ID NO: 2809866 - protein, 18 aa, Entamoeba invadens
GFACEFEILLTLSCTSKI

SEQ ID NO: 2809867 - protein, 24 aa, Entamoeba invadens
GFLLCCLWIMGYCRYRKSTDAQAR

SEQ ID NO: 2809868 - protein, 20 aa, Entamoeba invadens
GGGCAICKVGYYKVEKDCDA

SEQ ID NO: 2809869 - protein, 25 aa, Entamoeba invadens
GPNRCKRCSSGFVLKGATCVKGENC

SEQ ID NO: 2809870 - protein, 19 aa, Entamoeba invadens
HCLRCFKSNCLLCKVNYQI

SEQ ID NO: 2809871 - protein, 18 aa, Entamoeba invadens
IAMPDCRIVFLLFSSIPS

SEQ ID NO: 2809872 - protein, 21 aa, Entamoeba invadens
IEVFCGLPFIETTGFIALNRE

SEQ ID NO: 2809873 - protein, 17 aa, Entamoeba invadens
IFTKVFLRRQVRAYQWV

SEQ ID NO: 2809874 - protein, 20 aa, Entamoeba invadens
IGFVKCWDLSLVILSIAPFM

SEQ ID NO: 2809875 - protein, 19 aa, Entamoeba invadens
IHKLLKCKLGFFDVTPMGR

SEQ ID NO: 2809876 - protein, 22 aa, Entamoeba invadens
ILKCSYLLNKQCVECEIGKFLT

SEQ ID NO: 2809877 - protein, 20 aa, Entamoeba invadens
ILKREWKRFLFMYLMVAIYD

SEQ ID NO: 2809878 - protein, 24 aa, Entamoeba invadens
ITFPMKLRLKFLIDAAKGIEYLHN

SEQ ID NO: 2809879 - protein, 22 aa, Entamoeba invadens
IVLLRRKRLVILKSIEQLAKSL

SEQ ID NO: 2809880 - protein, 19 aa, Entamoeba invadens
KCFKCLDGFYLVSGQCALC

SEQ ID NO: 2809881 - protein, 20 aa, Entamoeba invadens
KEQFRFPWKIAEYVTHGKHP

SEQ ID NO: 2809882 - protein, 25 aa, Entamoeba invadens
KEVKRILWVIAFRSCMNFIVWAIPP

SEQ ID NO: 2809883 - protein, 17 aa, Entamoeba invadens
KGIEVFCGLPFIETTGF

SEQ ID NO: 2809884 - protein, 22 aa, Entamoeba invadens
KHQFRFPWKIAEFVINGKRVEK

SEQ ID NO: 2809885 - protein, 23 aa, Entamoeba invadens
KIENCLYQKFNLCIKCKENYIFK

SEQ ID NO: 2809886 - protein, 19 aa, Entamoeba invadens
KLRIKMCLDATKGVSYLHK

SEQ ID NO: 2809887 - protein, 19 aa, Entamoeba invadens
KVMHYLRYAIIVFWLVCAL

SEQ ID NO: 2809888 - protein, 22 aa, Entamoeba invadens
LFLFLLRRLFRKMQKRNIEQNY

SEQ ID NO: 2809889 - protein, 19 aa, Entamoeba invadens
LIIPRSVKFLSRISTLTLV

SEQ ID NO: 2809890 - protein, 23 aa, Entamoeba invadens
LKCSPECKTCLSTATTCLSCYNE

SEQ ID NO: 2809891 - protein, 25 aa, Entamoeba invadens
LKVMKDVQCGLSYLHGFKLFHLNLK

SEQ ID NO: 2809892 - protein, 18 aa, Entamoeba invadens
LMLRGKVVIFSDEKIDND

SEQ ID NO: 2809893 - protein, 17 aa, Entamoeba invadens
LTCKRCDDSYYFDNDTQ

SEQ ID NO: 2809894 - protein, 20 aa, Entamoeba invadens
MKYKRPADIYSFAITMYECF

SEQ ID NO: 2809895 - protein, 23 aa, Entamoeba invadens
NKIKCAICLSGYVMNREGNCEKC

SEQ ID NO: 2809896 - protein, 21 aa, Entamoeba invadens
NKIQFKFPWKIAEFVINRNRL

SEQ ID NO: 2809897 - protein, 22 aa, Entamoeba invadens
NLCLFLSVLCFILLAILSVSEK

SEQ ID NO: 2809898 - protein, 18 aa, Entamoeba invadens
PADIYSFAITMYECFIWG

SEQ ID NO: 2809899 - protein, 20 aa, Entamoeba invadens
QLKAEASVNLGFRTVIVEEL

SEQ ID NO: 2809900 - protein, 23 aa, Entamoeba invadens
QSIKIWGYRALSALLLYGFVAFM

SEQ ID NO: 2809901 - protein, 17 aa, Entamoeba invadens
RALSALLLYGFVAFMSC

SEQ ID NO: 2809902 - protein, 24 aa, Entamoeba invadens
SKDKFKFAWCIADFVSNGNRFEKD

SEQ ID NO: 2809903 - protein, 18 aa, Entamoeba invadens
SNVRCSVDIPDCLYTTNN

SEQ ID NO: 2809904 - protein, 22 aa, Entamoeba invadens
STHCITCPLGYYLSNNTCNTNA

SEQ ID NO: 2809905 - protein, 22 aa, Entamoeba invadens
STRCITCPLGYYLSNNTCNTNA

SEQ ID NO: 2809906 - protein, 21 aa, Entamoeba invadens
SVRGCLKCSSGYFVENQFCSS

SEQ ID NO: 2809907 - protein, 17 aa, Entamoeba invadens
TCSPLFVRKCVKCVAGS

SEQ ID NO: 2809908 - protein, 22 aa, Entamoeba invadens
TDLLKVRFCQDIAKGMEYLHHN

SEQ ID NO: 2809909 - protein, 19 aa, Entamoeba invadens
TFFKFPWKIAEFVTSGKRL

SEQ ID NO: 2809910 - protein, 17 aa, Entamoeba invadens
TKNKAVNVVGWISFGLF

SEQ ID NO: 2809911 - protein, 18 aa, Entamoeba invadens
TKVFLRRQVRAYQWVGVA

SEQ ID NO: 2809912 - protein, 24 aa, Entamoeba invadens
VGGCSLCLSGYFLKDGKCHPLSES

SEQ ID NO: 2809913 - protein, 17 aa, Entamoeba invadens
VLCDKSVNCTKCEFNKC

SEQ ID NO: 2809914 - protein, 19 aa, Entamoeba invadens
VLYLIGWVFPVIWMVQLFF

SEQ ID NO: 2809915 - protein, 19 aa, Entamoeba invadens
VQFKHAWSIADFTSSGKRL

SEQ ID NO: 2809916 - protein, 21 aa, Entamoeba invadens
YPTCMPTFLSKIVIFTITFDA

SEQ ID NO: 2809917 - protein, 17 aa, Entamoeba invadens
YSIEWGGSVKKDLINLG

SEQ ID NO: 2809918 - protein, 23 aa, Entamoeba invadens
YWMLQRMDWLGVFICFVTVTVLV

SEQ ID NO: 2809919 - protein, 19 aa, Entamoeba invadens
YYYLRGCSSFGRAFASHAK

SEQ ID NO: 2809920 - protein, 23 aa, Entamoeba invadens
AADNCLTCAFGYYYDDTTSDCLY

SEQ ID NO: 2809921 - protein, 20 aa, Entamoeba invadens
AAGFKMDLNFSDLIEQCIDL

SEQ ID NO: 2809922 - protein, 17 aa, Entamoeba invadens
AALGIPVLLPFLKAVCW

SEQ ID NO: 2809923 - protein, 20 aa, Entamoeba invadens
AALTCLMGFLAYKMRYNTVF

SEQ ID NO: 2809924 - protein, 25 aa, Entamoeba invadens
ACAPLLWVCTFCMLVTIIPNFRSIN

SEQ ID NO: 2809925 - protein, 17 aa, Entamoeba invadens
ACDGEYCHLIFKRDGVE

SEQ ID NO: 2809926 - protein, 21 aa, Entamoeba invadens
ACIPLCIGYSIYSLYYNEFKS

SEQ ID NO: 2809927 - protein, 25 aa, Entamoeba invadens
ACLSNKCGWCGTTQTCGYCEDGGEF

SEQ ID NO: 2809928 - protein, 18 aa, Entamoeba invadens
ADAAGKVFAILRVLTPIN

SEQ ID NO: 2809929 - protein, 17 aa, Entamoeba invadens
ADAFSWGRNEGCSFLYN

SEQ ID NO: 2809930 - protein, 22 aa, Entamoeba invadens
ADAWCDWVKSVAGLFGLKLNLC

SEQ ID NO: 2809931 - protein, 20 aa, Entamoeba invadens
ADFKGQCVIFDYKNKEHIVK

SEQ ID NO: 2809932 - protein, 17 aa, Entamoeba invadens
ADFLIRAIVSYNCNNTV

SEQ ID NO: 2809933 - protein, 21 aa, Entamoeba invadens
ADGDCGFSFMTYAVLRNLFEL

SEQ ID NO: 2809934 - protein, 18 aa, Entamoeba invadens
ADGLSVFTKQVWEAIKKN

SEQ ID NO: 2809935 - protein, 18 aa, Entamoeba invadens
ADKAFGFVMFFVVVILVI

SEQ ID NO: 2809936 - protein, 19 aa, Entamoeba invadens
ADLKRLRVAGQIFAENGFL

SEQ ID NO: 2809937 - protein, 18 aa, Entamoeba invadens
ADTNCLKCNNNVCGLCQT

SEQ ID NO: 2809938 - protein, 20 aa, Entamoeba invadens
ADVMLAFYLYNGWSDQLTDK

SEQ ID NO: 2809939 - protein, 19 aa, Entamoeba invadens
AECKVCYPPFELIEGSCVE

SEQ ID NO: 2809940 - protein, 18 aa, Entamoeba invadens
AEERLVYKNGIFSNGYQL

SEQ ID NO: 2809941 - protein, 17 aa, Entamoeba invadens
AEFKIESNIIFSSTSSF

SEQ ID NO: 2809942 - protein, 29 aa, Entamoeba invadens
AEGYFAYPVCFQTRMYKCILFTLEYDGNY

SEQ ID NO: 2809943 - protein, 17 aa, Entamoeba invadens
AEKCKLFLPSGVDCAAC

SEQ ID NO: 2809944 - protein, 18 aa, Entamoeba invadens
AEKCKLFLPSGVDCAACN

SEQ ID NO: 2809945 - protein, 18 aa, Entamoeba invadens
AELRARNIITPKWPNCPT

SEQ ID NO: 2809946 - protein, 17 aa, Entamoeba invadens
AELSTGCIVVFIDEYQQ

SEQ ID NO: 2809947 - protein, 19 aa, Entamoeba invadens
AEMLSRFETIFARVIGVSF

SEQ ID NO: 2809948 - protein, 17 aa, Entamoeba invadens
AFAPYEWQHLLIPFLPV

SEQ ID NO: 2809949 - protein, 19 aa, Entamoeba invadens
AFFPFIMSFIFMWTVAYSL

SEQ ID NO: 2809950 - protein, 18 aa, Entamoeba invadens
AFKLKGGICAETFDENNK

SEQ ID NO: 2809951 - protein, 20 aa, Entamoeba invadens
AFKLKSGICAESFDEDDKLK

SEQ ID NO: 2809952 - protein, 17 aa, Entamoeba invadens
AFLIVLVILNYVKVQVI

SEQ ID NO: 2809953 - protein, 21 aa, Entamoeba invadens
AFLRAFGFLNMFSFLVPVSCL

SEQ ID NO: 2809954 - protein, 24 aa, Entamoeba invadens
AFPKNIYKFAWDIADSIAIGKRPK

SEQ ID NO: 2809955 - protein, 22 aa, Entamoeba invadens
AFPLMFSTGASVSWPEGTIKIV

SEQ ID NO: 2809956 - protein, 19 aa, Entamoeba invadens
AFPVLLIFIVRWVNSNEPK

SEQ ID NO: 2809957 - protein, 18 aa, Entamoeba invadens
AFQCAYCLIDIKHKHPTL

SEQ ID NO: 2809958 - protein, 17 aa, Entamoeba invadens
AFSKKSFKYAWDIADFV

SEQ ID NO: 2809959 - protein, 24 aa, Entamoeba invadens
AFYYEWKTALCILAVTPVLMVIVF

SEQ ID NO: 2809960 - protein, 21 aa, Entamoeba invadens
AGAALRWIRDMGILKEYNEIT

SEQ ID NO: 2809961 - protein, 23 aa, Entamoeba invadens
AGEYKLSKLFGMSYKGAEEIQWH

SEQ ID NO: 2809962 - protein, 19 aa, Entamoeba invadens
AGICCLHIALYIGLLYDFK

SEQ ID NO: 2809963 - protein, 20 aa, Entamoeba invadens
AGICIPCPEGTYSSNNLCVK

SEQ ID NO: 2809964 - protein, 18 aa, Entamoeba invadens
AGKCAICPKGTYYMSSVC

SEQ ID NO: 2809965 - protein, 17 aa, Entamoeba invadens
AGLILRIFNMLFLYKIP

SEQ ID NO: 2809966 - protein, 18 aa, Entamoeba invadens
AGLNRYTLLVWIILFLGW

SEQ ID NO: 2809967 - protein, 17 aa, Entamoeba invadens
AGTKWVVCPATNLIKKY

SEQ ID NO: 2809968 - protein, 17 aa, Entamoeba invadens
AGVFPAISILFVYMMQH

SEQ ID NO: 2809969 - protein, 22 aa, Entamoeba invadens
AGVYCKWHYIILYLVALLLNLP

SEQ ID NO: 2809970 - protein, 21 aa, Entamoeba invadens
AGVYCKWHYIILYLVAVLLNF

SEQ ID NO: 2809971 - protein, 18 aa, Entamoeba invadens
AHFLFKFAGTCGDSKRFM

SEQ ID NO: 2809972 - protein, 21 aa, Entamoeba invadens
AHGDKGAGMFATFVGTGKKYI

SEQ ID NO: 2809973 - protein, 23 aa, Entamoeba invadens
AHGGPTDWKGFALFIDTYDNDRN

SEQ ID NO: 2809974 - protein, 17 aa, Entamoeba invadens
AHKTFLLFILIKIVFIN

SEQ ID NO: 2809975 - protein, 17 aa, Entamoeba invadens
AICKCHFLTIPMFPTAI

SEQ ID NO: 2809976 - protein, 19 aa, Entamoeba invadens
AIEMFKWLIEMYYKEEKYN

SEQ ID NO: 2809977 - protein, 21 aa, Entamoeba invadens
AIHFDPKMGILSPRITQKVCV

SEQ ID NO: 2809978 - protein, 19 aa, Entamoeba invadens
AIKCLSCALGEVVDSLGKC

SEQ ID NO: 2809979 - protein, 18 aa, Entamoeba invadens
AILSLCFSSLLILTLLLQ

SEQ ID NO: 2809980 - protein, 19 aa, Entamoeba invadens
AIYCWLKFSPPKIEKTEKK

SEQ ID NO: 2809981 - protein, 19 aa, Entamoeba invadens
AKATFNLGGFKAEKITSAV

SEQ ID NO: 2809982 - protein, 17 aa, Entamoeba invadens
AKCIKSRSDGCGADSKL

SEQ ID NO: 2809983 - protein, 17 aa, Entamoeba invadens
AKCLAAFPPLVLACIKA

SEQ ID NO: 2809984 - protein, 17 aa, Entamoeba invadens
AKFCTKCFSSLMHILAQ

SEQ ID NO: 2809985 - protein, 17 aa, Entamoeba invadens
AKFIIIYAVLGIALVGI

SEQ ID NO: 2809986 - protein, 19 aa, Entamoeba invadens
AKFPLDWICKIQSLSNEKN

SEQ ID NO: 2809987 - protein, 22 aa, Entamoeba invadens
AKGVFYYSYFDLIRMNSTDPFE

SEQ ID NO: 2809988 - protein, 23 aa, Entamoeba invadens
AKKEFRIPIDFFIDKRLNVLLKQ

SEQ ID NO: 2809989 - protein, 18 aa, Entamoeba invadens
AKKKFEWVVSVIKDIVKE

SEQ ID NO: 2809990 - protein, 22 aa, Entamoeba invadens
AKLTDFYLYKGVFIKFKVKESQ

SEQ ID NO: 2809991 - protein, 28 aa, Entamoeba invadens
AKNLLAFDVICFYSFFFLICCCEQNELR

SEQ ID NO: 2809992 - protein, 20 aa, Entamoeba invadens
AKSEALYFISWVCESTTNEV

SEQ ID NO: 2809993 - protein, 20 aa, Entamoeba invadens
AKSGCANYYCDISRLGELTI

SEQ ID NO: 2809994 - protein, 17 aa, Entamoeba invadens
ALARLIVDFIFTITYGV

SEQ ID NO: 2809995 - protein, 19 aa, Entamoeba invadens
ALCKTVLRLHKKWINVSTV

SEQ ID NO: 2809996 - protein, 18 aa, Entamoeba invadens
ALCLFQLGEDYARFISPE

SEQ ID NO: 2809997 - protein, 18 aa, Entamoeba invadens
ALFDFLKGCFVYEPQNRY

SEQ ID NO: 2809998 - protein, 19 aa, Entamoeba invadens
ALGCCALTTGVARKHPLDV

SEQ ID NO: 2809999 - protein, 18 aa, Entamoeba invadens
ALGRWVWDVEELWVESQL

SEQ ID NO: 2810000 - protein, 21 aa, Entamoeba invadens
ALKAAHIGLAMGIRGTDVAKR

SEQ ID NO: 2810001 - protein, 17 aa, Entamoeba invadens
ALLALLLYYIFKVHKKQ

SEQ ID NO: 2810002 - protein, 19 aa, Entamoeba invadens
ALLCDGCKTGAYKDNAWYY

SEQ ID NO: 2810003 - protein, 23 aa, Entamoeba invadens
ALMFLWRMVIRPLLFKPTTKVYK

SEQ ID NO: 2810004 - protein, 24 aa, Entamoeba invadens
ALPAFGEFMLFIGYGMEKNGKTIE

SEQ ID NO: 2810005 - protein, 19 aa, Entamoeba invadens
ALSLIPLLGPFEWEGVIIP

SEQ ID NO: 2810006 - protein, 19 aa, Entamoeba invadens
ALTLSRKVSFIFSSASYTN

SEQ ID NO: 2810007 - protein, 18 aa, Entamoeba invadens
ALVKCWDLALVVISALPF

SEQ ID NO: 2810008 - protein, 24 aa, Entamoeba invadens
  misc_feature (16)..(17): Xaa can be any naturally occurring amino acid
ALYFDWKLALCVIAKXXMAINSAA

SEQ ID NO: 2810009 - protein, 23 aa, Entamoeba invadens
AMFTLPWYLTWFIHSISSVEVGV

SEQ ID NO: 2810010 - protein, 22 aa, Entamoeba invadens
AMKRGMVHIVVFGETDHRNQKE

SEQ ID NO: 2810011 - protein, 22 aa, Entamoeba invadens
AMSPRVGALFQMIGTVLSAIVL

SEQ ID NO: 2810012 - protein, 17 aa, Entamoeba invadens
AMTAELTTLLSLGDHFH

SEQ ID NO: 2810013 - protein, 18 aa, Entamoeba invadens
ANFPRWLFVGDITGPART

SEQ ID NO: 2810014 - protein, 23 aa, Entamoeba invadens
ANKELKIPLIIDGQVIVDGIIEE

SEQ ID NO: 2810015 - protein, 19 aa, Entamoeba invadens
ANLFYAEFIRDFSCLFKRG

SEQ ID NO: 2810016 - protein, 22 aa, Entamoeba invadens
APGVLCSYGILKKGGLECLRIK

SEQ ID NO: 2810017 - protein, 19 aa, Entamoeba invadens
APKCLKSPFNLFGSMMNEP

SEQ ID NO: 2810018 - protein, 18 aa, Entamoeba invadens
APVLKRNFLNLGVLEDLM

SEQ ID NO: 2810019 - protein, 18 aa, Entamoeba invadens
AQECLSCANVNHLIENKK

SEQ ID NO: 2810020 - protein, 18 aa, Entamoeba invadens
AQHSIVFRSFKPENLVSV

SEQ ID NO: 2810021 - protein, 17 aa, Entamoeba invadens
AQKCPKPIYAKGAEKGS

SEQ ID NO: 2810022 - protein, 22 aa, Entamoeba invadens
AQRILKCIFQYLLSLLETIVRY

SEQ ID NO: 2810023 - protein, 18 aa, Entamoeba invadens
ARCKGCPVGSFYSSANTC

SEQ ID NO: 2810024 - protein, 22 aa, Entamoeba invadens
ARCTAGLCDRCKEGSHKDRAYL

SEQ ID NO: 2810025 - protein, 19 aa, Entamoeba invadens
ARFGRKFSVPIRVIVSVGL

SEQ ID NO: 2810026 - protein, 20 aa, Entamoeba invadens
ARVLIDFNIPFYSSGAVISG

SEQ ID NO: 2810027 - protein, 17 aa, Entamoeba invadens
ARWCGFNSIVRAGWSKM

SEQ ID NO: 2810028 - protein, 18 aa, Entamoeba invadens
ARWYRFVGDGKMYLIDTC

SEQ ID NO: 2810029 - protein, 17 aa, Entamoeba invadens
ARYPFIKMFSLSLCAGL

SEQ ID NO: 2810030 - protein, 19 aa, Entamoeba invadens
ASCCLLVWAYLVRKQNKNF

SEQ ID NO: 2810031 - protein, 18 aa, Entamoeba invadens
ASCVGFLLKNWRRVPHAF

SEQ ID NO: 2810032 - protein, 19 aa, Entamoeba invadens
ASECIRWLGAFRFILWTLW

SEQ ID NO: 2810033 - protein, 21 aa, Entamoeba invadens
ASFSFGFGMPGFFMSYGNNNN

SEQ ID NO: 2810034 - protein, 17 aa, Entamoeba invadens
ASGDAYPICSIKERTTL

SEQ ID NO: 2810035 - protein, 22 aa, Entamoeba invadens
ASGLYRFTFRINLVLSKCHGFS

SEQ ID NO: 2810036 - protein, 17 aa, Entamoeba invadens
ASLYLMVGMVERLDLDS

SEQ ID NO: 2810037 - protein, 20 aa, Entamoeba invadens
ASMSCIRIGQIIPEMGKAQG

SEQ ID NO: 2810038 - protein, 26 aa, Entamoeba invadens
ASNLLKLRFCLDVAKGMLYLHSNNVI

SEQ ID NO: 2810039 - protein, 19 aa, Entamoeba invadens
ASSCSICLAGTYSNKGSST

SEQ ID NO: 2810040 - protein, 22 aa, Entamoeba invadens
ATAVFRLKTSWDMLPSKTKNIF

SEQ ID NO: 2810041 - protein, 18 aa, Entamoeba invadens
ATILGGIFPKVNDLNILF

SEQ ID NO: 2810042 - protein, 17 aa, Entamoeba invadens
ATLGAFGYILSVSKVGS

SEQ ID NO: 2810043 - protein, 23 aa, Entamoeba invadens
ATLRPGNAMAITFKMKVLCTTSI

SEQ ID NO: 2810044 - protein, 19 aa, Entamoeba invadens
ATNLIKKYVCFGSTECYFV

SEQ ID NO: 2810045 - protein, 17 aa, Entamoeba invadens
ATRCFNCSNGHYLMNGS

SEQ ID NO: 2810046 - protein, 18 aa, Entamoeba invadens
ATSFGPVFTDSLTIGALN

SEQ ID NO: 2810047 - protein, 17 aa, Entamoeba invadens
ATVLLRVRFVKSTIWKT

SEQ ID NO: 2810048 - protein, 20 aa, Entamoeba invadens
ATVMYFRFSPVLKTSDSYSS

SEQ ID NO: 2810049 - protein, 21 aa, Entamoeba invadens
AVCDRFGYKRFLLFKEGENYE

SEQ ID NO: 2810050 - protein, 17 aa, Entamoeba invadens
AVCNMKYIYGWYSEQCS

SEQ ID NO: 2810051 - protein, 19 aa, Entamoeba invadens
AVCTIALKCTIDTTQAPNC

SEQ ID NO: 2810052 - protein, 18 aa, Entamoeba invadens
AVDSTALYSEWDCNKYAQ

SEQ ID NO: 2810053 - protein, 18 aa, Entamoeba invadens
AVGVCIVCGVLFICIVLL

SEQ ID NO: 2810054 - protein, 20 aa, Entamoeba invadens
AVLTDGCWYLFAGVVLYTIT

SEQ ID NO: 2810055 - protein, 23 aa, Entamoeba invadens
AVTGRFPFLWIFFVLAAICFWMS

SEQ ID NO: 2810056 - protein, 19 aa, Entamoeba invadens
AYCFNCLAGTYAAKEGSSS

SEQ ID NO: 2810057 - protein, 17 aa, Entamoeba invadens
AYFVFKLTTGWRKILAL

SEQ ID NO: 2810058 - protein, 18 aa, Entamoeba invadens
AYILKIIYFRGVVRENCN

SEQ ID NO: 2810059 - protein, 24 aa, Entamoeba invadens
AYPKKEFKYAWAIADFITSGKRRE

SEQ ID NO: 2810060 - protein, 31 aa, Entamoeba invadens
AYSIVCYEVWLRAVPYTSFKYKWEVSAYVAA

SEQ ID NO: 2810061 - protein, 20 aa, Entamoeba invadens
CAACGVANCNSCTSSEPNKC

SEQ ID NO: 2810062 - protein, 18 aa, Entamoeba invadens
CACDGEFCELIAGAVNPF

SEQ ID NO: 2810063 - protein, 18 aa, Entamoeba invadens
CADKYYRSGFECFKCSSK

SEQ ID NO: 2810064 - protein, 20 aa, Entamoeba invadens
CAFWAFSAFLFWPAAVGTVG

SEQ ID NO: 2810065 - protein, 18 aa, Entamoeba invadens
CAFWAFSALTFWPSAVGN

SEQ ID NO: 2810066 - protein, 17 aa, Entamoeba invadens
CAICKKGYYKTEKDCKE

SEQ ID NO: 2810067 - protein, 17 aa, Entamoeba invadens
CAIESRMLFTIPRYLQK

SEQ ID NO: 2810068 - protein, 19 aa, Entamoeba invadens
CALNACTEFQCLKCEKGKY

SEQ ID NO: 2810069 - protein, 18 aa, Entamoeba invadens
CAPYCGVCQMGYECNKAA

SEQ ID NO: 2810070 - protein, 20 aa, Entamoeba invadens
CATCAYNGLRSCLVCSVGYY

SEQ ID NO: 2810071 - protein, 19 aa, Entamoeba invadens
CAVNLSFLFIAVVYQRNMF

SEQ ID NO: 2810072 - protein, 19 aa, Entamoeba invadens
CAYCSPGVCSTSKGQCVCE

SEQ ID NO: 2810073 - protein, 21 aa, Entamoeba invadens
CCGLSFLFIFFFDRVVATHGG

SEQ ID NO: 2810074 - protein, 19 aa, Entamoeba invadens
CCLYILAFFLYFPMRLSKI

SEQ ID NO: 2810075 - protein, 19 aa, Entamoeba invadens
CCYELCTFYSSLDGTDEDT

SEQ ID NO: 2810076 - protein, 17 aa, Entamoeba invadens
CDACSTLSVGVSNRTSC

SEQ ID NO: 2810077 - protein, 23 aa, Entamoeba invadens
CDAKSGYCLTCFAGYGFNSGICT

SEQ ID NO: 2810078 - protein, 22 aa, Entamoeba invadens
CDFSFKDLYFFVSFCSNAICVV

SEQ ID NO: 2810079 - protein, 21 aa, Entamoeba invadens
CDHALECGVVFFKRTQTTMTV

SEQ ID NO: 2810080 - protein, 17 aa, Entamoeba invadens
CDLSNRWHFDWKCNVTY

SEQ ID NO: 2810081 - protein, 25 aa, Entamoeba invadens
CDSKSGNCTLCFVGNYLFEGKCLSC

SEQ ID NO: 2810082 - protein, 20 aa, Entamoeba invadens
CDSLKCFICENGYDLKSDGM

SEQ ID NO: 2810083 - protein, 25 aa, Entamoeba invadens
CDVFSFAICLLEIWLTKSPYDPEVF

SEQ ID NO: 2810084 - protein, 19 aa, Entamoeba invadens
CDVIRFTIKNCMKTESNDK

SEQ ID NO: 2810085 - protein, 18 aa, Entamoeba invadens
CEDGTCLKSPNEAYKCNE

SEQ ID NO: 2810086 - protein, 17 aa, Entamoeba invadens
CEICRRGTYSYGIECVD

SEQ ID NO: 2810087 - protein, 20 aa, Entamoeba invadens
CEIKTGFVLLKKYLLELPNP

SEQ ID NO: 2810088 - protein, 19 aa, Entamoeba invadens
CEILYAWSCIDVFIISVIA

SEQ ID NO: 2810089 - protein, 17 aa, Entamoeba invadens
CEPNCGRCLFGYECSNK

SEQ ID NO: 2810090 - protein, 18 aa, Entamoeba invadens
CETIKWILRIIIKKKENK

SEQ ID NO: 2810091 - protein, 18 aa, Entamoeba invadens
CEYCRAFINPFVNWQVPG

SEQ ID NO: 2810092 - protein, 19 aa, Entamoeba invadens
CFAWKEAYKGLKFKFAWNI

SEQ ID NO: 2810093 - protein, 17 aa, Entamoeba invadens
CFCLWIFLLKGQSLTQM

SEQ ID NO: 2810094 - protein, 19 aa, Entamoeba invadens
CFEGFILKKINAMLVLIIA

SEQ ID NO: 2810095 - protein, 21 aa, Entamoeba invadens
CFFLICGIVVLLLILYGVLFK

SEQ ID NO: 2810096 - protein, 19 aa, Entamoeba invadens
CFFPIDVIFSLGFSAALSI

SEQ ID NO: 2810097 - protein, 19 aa, Entamoeba invadens
CFFPLDVVITLGMSAAISI

SEQ ID NO: 2810098 - protein, 18 aa, Entamoeba invadens
CFFSCRKLSSVIIPSSVT

SEQ ID NO: 2810099 - protein, 20 aa, Entamoeba invadens
CFIAFYLKKGRSFPCKCRKC

SEQ ID NO: 2810100 - protein, 23 aa, Entamoeba invadens
CFKGCTSLCEICCTSSLRFPRSS

SEQ ID NO: 2810101 - protein, 17 aa, Entamoeba invadens
CFKSLVEDCWRHKMEER

SEQ ID NO: 2810102 - protein, 20 aa, Entamoeba invadens
CFQPRLEAVGKKIKFKQYDS

SEQ ID NO: 2810103 - protein, 18 aa, Entamoeba invadens
CFVSEFPFINALFAMLED

SEQ ID NO: 2810104 - protein, 20 aa, Entamoeba invadens
CGATCFFTYFILRHTMEVKQ

SEQ ID NO: 2810105 - protein, 26 aa, Entamoeba invadens
CGGCLYIVGFIFKFRESRLYKTKENI

SEQ ID NO: 2810106 - protein, 19 aa, Entamoeba invadens
CGLGCGAAWMDDRKERKKK

SEQ ID NO: 2810107 - protein, 19 aa, Entamoeba invadens
CGPCCKAKIGFLCPKGSKN

SEQ ID NO: 2810108 - protein, 19 aa, Entamoeba invadens
CGSCSDVNCMICENNKCIV

SEQ ID NO: 2810109 - protein, 19 aa, Entamoeba invadens
CGTELIVGFNICRTKKDGC

SEQ ID NO: 2810110 - protein, 19 aa, Entamoeba invadens
CGTKSRIAIKFTKNKAQFV

SEQ ID NO: 2810111 - protein, 20 aa, Entamoeba invadens
CGVAAILVFGVWRKNKKRTP

SEQ ID NO: 2810112 - protein, 17 aa, Entamoeba invadens
CGVVTMRICEGRNETSC

SEQ ID NO: 2810113 - protein, 17 aa, Entamoeba invadens
CHKLCYYNKVWQTDNTN

SEQ ID NO: 2810114 - protein, 17 aa, Entamoeba invadens
CHLFDSFTLFIIIISRN

SEQ ID NO: 2810115 - protein, 18 aa, Entamoeba invadens
CIGFCFLVLLLTLLLLYL

SEQ ID NO: 2810116 - protein, 20 aa, Entamoeba invadens
CIGMAFSVFCFVGHIALLLR

SEQ ID NO: 2810117 - protein, 20 aa, Entamoeba invadens
CIKCSFWYTPSWDGTFCKTK

SEQ ID NO: 2810118 - protein, 19 aa, Entamoeba invadens
CIYSGILITIWIARIWLEK

SEQ ID NO: 2810119 - protein, 18 aa, Entamoeba invadens
CKCIKGYGGSNCHKLCYY

SEQ ID NO: 2810120 - protein, 18 aa, Entamoeba invadens
CKCVKKLTGKICLSIGDG

SEQ ID NO: 2810121 - protein, 19 aa, Entamoeba invadens
CKHPSYIYTFFFVPVYFNF

SEQ ID NO: 2810122 - protein, 17 aa, Entamoeba invadens
CKICPAGTCTDSKQQYC

SEQ ID NO: 2810123 - protein, 27 aa, Entamoeba invadens
CKKCSGLKCILCKGNSVINYNGFCYTP

SEQ ID NO: 2810124 - protein, 25 aa, Entamoeba invadens
CKKCVVGGVRMCYRCEMGYYPISNG

SEQ ID NO: 2810125 - protein, 23 aa, Entamoeba invadens
CKKHLPWWLTFIIVLLLIIILIT

SEQ ID NO: 2810126 - protein, 23 aa, Entamoeba invadens
CKLKEIYKDLSISRMHFLFSQTN

SEQ ID NO: 2810127 - protein, 18 aa, Entamoeba invadens
CKLVYGRGLDWNVTVVDV

SEQ ID NO: 2810128 - protein, 17 aa, Entamoeba invadens
CKNDNCALCVGGKCQMC

SEQ ID NO: 2810129 - protein, 18 aa, Entamoeba invadens
CKRDEVWTSLVLSSTGRV

SEQ ID NO: 2810130 - protein, 18 aa, Entamoeba invadens
CLCLILFFSEFKNIYFQI

SEQ ID NO: 2810131 - protein, 22 aa, Entamoeba invadens
CLECFPTWVGCALCEQGYTLMY

SEQ ID NO: 2810132 - protein, 18 aa, Entamoeba invadens
CLEEVPFQSVVGLMKTLV

SEQ ID NO: 2810133 - protein, 19 aa, Entamoeba invadens
CLEGFVLKDSVCTKCGNGV

SEQ ID NO: 2810134 - protein, 20 aa, Entamoeba invadens
  misc_feature (17)..(18): Xaa can be any naturally occurring amino acid
CLFYELFTSKMLFWIAXXRR

SEQ ID NO: 2810135 - protein, 17 aa, Entamoeba invadens
CLIFFKKIGSSLVPAFL

SEQ ID NO: 2810136 - protein, 21 aa, Entamoeba invadens
CLIRGCWDFNKANRMTITTVL

SEQ ID NO: 2810137 - protein, 23 aa, Entamoeba invadens
CLKVIKRDCRRWIGNIVEFLPNT

SEQ ID NO: 2810138 - protein, 19 aa, Entamoeba invadens
CLLCDSTLCTKCVDNYILK

SEQ ID NO: 2810139 - protein, 17 aa, Entamoeba invadens
CLLCEAGTYKKTEITCD

SEQ ID NO: 2810140 - protein, 23 aa, Entamoeba invadens
CLLIDCLRYIYSVHEHCTLLEKK

SEQ ID NO: 2810141 - protein, 20 aa, Entamoeba invadens
CLPCSTKICYDCHPISGKCY

SEQ ID NO: 2810142 - protein, 19 aa, Entamoeba invadens
CLQCDDGFYLINFVCNKCP

SEQ ID NO: 2810143 - protein, 17 aa, Entamoeba invadens
CLQCIPGSYSTPGSSKC

SEQ ID NO: 2810144 - protein, 20 aa, Entamoeba invadens
CLRCFSGYYLADRMCVKCEY

SEQ ID NO: 2810145 - protein, 20 aa, Entamoeba invadens
CLRCFSGYYLADRTCVKCEY

SEQ ID NO: 2810146 - protein, 17 aa, Entamoeba invadens
CLRCKIGYYKENRECLK

SEQ ID NO: 2810147 - protein, 19 aa, Entamoeba invadens
CLRGIQWVHNRYNLVHRDI

SEQ ID NO: 2810148 - protein, 19 aa, Entamoeba invadens
CLSCGVGYGVDKNGQCQKC

SEQ ID NO: 2810149 - protein, 19 aa, Entamoeba invadens
CLSCKSGMYLSDYKCNTNK

SEQ ID NO: 2810150 - protein, 20 aa, Entamoeba invadens
CLSCPNGYYLSNYVCKSNEI

SEQ ID NO: 2810151 - protein, 18 aa, Entamoeba invadens
CLTLKWNMCETFSNIQVQ

SEQ ID NO: 2810152 - protein, 17 aa, Entamoeba invadens
CLVCLYVCCGLCLFAAV

SEQ ID NO: 2810153 - protein, 17 aa, Entamoeba invadens
CLVCSVGYYPSSGICTE

SEQ ID NO: 2810154 - protein, 18 aa, Entamoeba invadens
CLVIHIIKFYRDEQRSLA

SEQ ID NO: 2810155 - protein, 19 aa, Entamoeba invadens
CLVIPCILEAFKVTSLAIS

SEQ ID NO: 2810156 - protein, 22 aa, Entamoeba invadens
CMSFKYIPHRGAILLAIGVGLG

SEQ ID NO: 2810157 - protein, 20 aa, Entamoeba invadens
CNDGYFLKELECFPCDESCY

SEQ ID NO: 2810158 - protein, 18 aa, Entamoeba invadens
CNFLSLVTTVLFILFTSL

SEQ ID NO: 2810159 - protein, 19 aa, Entamoeba invadens
CNKKMCFECSSDFIIENGN

SEQ ID NO: 2810160 - protein, 23 aa, Entamoeba invadens
CNLCTKLKCSICNNNYVLNNESV

SEQ ID NO: 2810161 - protein, 22 aa, Entamoeba invadens
CNMFGLVLICCLTAFSKQTETE

SEQ ID NO: 2810162 - protein, 23 aa, Entamoeba invadens
CNMFGLVLICCLTAFSKQTETEK

SEQ ID NO: 2810163 - protein, 24 aa, Entamoeba invadens
CNTASGWNRYFIKAQTAGSLCTCT

SEQ ID NO: 2810164 - protein, 18 aa, Entamoeba invadens
CNTFAGLILRIFNMLFLY

SEQ ID NO: 2810165 - protein, 20 aa, Entamoeba invadens
CNVANCFTCISWNDYFCLNC

SEQ ID NO: 2810166 - protein, 20 aa, Entamoeba invadens
CPCHLLGVTCSLNYGSFNTT

SEQ ID NO: 2810167 - protein, 20 aa, Entamoeba invadens
CPDKCKTCYYDFYLNKALCY

SEQ ID NO: 2810168 - protein, 18 aa, Entamoeba invadens
CPEFKIKVDYNFVFTNRL

SEQ ID NO: 2810169 - protein, 19 aa, Entamoeba invadens
CPKLLAAIVTPDFVVPSDI

SEQ ID NO: 2810170 - protein, 19 aa, Entamoeba invadens
CPLDRCFNCKETGEMNGTV

SEQ ID NO: 2810171 - protein, 17 aa, Entamoeba invadens
CPNGGATCDICLDEYSA

SEQ ID NO: 2810172 - protein, 20 aa, Entamoeba invadens
CPNSSIPIVLSKAICEDSKE

SEQ ID NO: 2810173 - protein, 21 aa, Entamoeba invadens
CQDVYKRIGISGVVTKLECID

SEQ ID NO: 2810174 - protein, 17 aa, Entamoeba invadens
CQWKNVFYLFLGISVVG

SEQ ID NO: 2810175 - protein, 17 aa, Entamoeba invadens
CRKLCYYNGNFYNDDTE

SEQ ID NO: 2810176 - protein, 19 aa, Entamoeba invadens
CRPACGTCFDVFKCSTSGK

SEQ ID NO: 2810177 - protein, 19 aa, Entamoeba invadens
CRPTCGTCFDVFKCSTSGK

SEQ ID NO: 2810178 - protein, 21 aa, Entamoeba invadens
CRSCKESSCLICTDSKDNYKC

SEQ ID NO: 2810179 - protein, 22 aa, Entamoeba invadens
CRSRQKFTFGRWFSVNMSQLEY

SEQ ID NO: 2810180 - protein, 23 aa, Entamoeba invadens
CSACSIPNCKYCEGGKCKKCNDN

SEQ ID NO: 2810181 - protein, 25 aa, Entamoeba invadens
CSACSIPNCKYCEGGKCKKCNDNYV

SEQ ID NO: 2810182 - protein, 19 aa, Entamoeba invadens
CSFGGPGNCRTCKSYYYYS

SEQ ID NO: 2810183 - protein, 19 aa, Entamoeba invadens
CSFPESFPALYTFDKVCSF

SEQ ID NO: 2810184 - protein, 18 aa, Entamoeba invadens
CSHCNRLVISHVDYGNGT

SEQ ID NO: 2810185 - protein, 17 aa, Entamoeba invadens
CSIYVALVPSDFVEAGY

SEQ ID NO: 2810186 - protein, 19 aa, Entamoeba invadens
CSLFCALGDFIGRLLEFIP

SEQ ID NO: 2810187 - protein, 17 aa, Entamoeba invadens
CSNRKCVLCENNNFLNE

SEQ ID NO: 2810188 - protein, 18 aa, Entamoeba invadens
CSSGRSCIMLLLSLAKEM

SEQ ID NO: 2810189 - protein, 17 aa, Entamoeba invadens
CSVLFPFITKKFFINDY

SEQ ID NO: 2810190 - protein, 19 aa, Entamoeba invadens
CSVLPHLTPLIGIITPRLT

SEQ ID NO: 2810191 - protein, 23 aa, Entamoeba invadens
CSVPNCKYCEGGKCKKCTENYVI

SEQ ID NO: 2810192 - protein, 25 aa, Entamoeba invadens
CTDGFFPRNGRCISCNEIGCQTTSE

SEQ ID NO: 2810193 - protein, 20 aa, Entamoeba invadens
CTKDNCIFCEGGIINCKVTT

SEQ ID NO: 2810194 - protein, 18 aa, Entamoeba invadens
CTKGRITYYTSWADGGSC

SEQ ID NO: 2810195 - protein, 26 aa, Entamoeba invadens
CTLKNDKLRYGVCPDGIAVTEDCTCY

SEQ ID NO: 2810196 - protein, 21 aa, Entamoeba invadens
CTLMLSIPVPNGFKYTVSEIL

SEQ ID NO: 2810197 - protein, 17 aa, Entamoeba invadens
CTLSMEWCDVGGNIACF

SEQ ID NO: 2810198 - protein, 22 aa, Entamoeba invadens
CTSKEKCILCSSDYYLHEDSCY

SEQ ID NO: 2810199 - protein, 17 aa, Entamoeba invadens
CVCSPGYGGDDCHLVCY

SEQ ID NO: 2810200 - protein, 17 aa, Entamoeba invadens
CVDCLPGYILNNGKCSI

SEQ ID NO: 2810201 - protein, 22 aa, Entamoeba invadens
CVDEFKGICYRCEDGYSKLSNN

SEQ ID NO: 2810202 - protein, 19 aa, Entamoeba invadens
CVECSPPYSWDSISKTCKL

SEQ ID NO: 2810203 - protein, 17 aa, Entamoeba invadens
CVEVIGPTLKRATCTLV

SEQ ID NO: 2810204 - protein, 17 aa, Entamoeba invadens
CVFGYYGVCLDLIQNIH

SEQ ID NO: 2810205 - protein, 20 aa, Entamoeba invadens
CVFKMSRSNIRFIMKLSSSL

SEQ ID NO: 2810206 - protein, 22 aa, Entamoeba invadens
CVFKMSRSNIRFIVKLSSSICS

SEQ ID NO: 2810207 - protein, 17 aa, Entamoeba invadens
CVFSCQYVSPLVHTLIF

SEQ ID NO: 2810208 - protein, 20 aa, Entamoeba invadens
CVKEVPALLIIATKYYDQMI

SEQ ID NO: 2810209 - protein, 18 aa, Entamoeba invadens
CVKGNCPEMYFKDNEEKI

SEQ ID NO: 2810210 - protein, 18 aa, Entamoeba invadens
CVLLRLPILFNFITIGNE

SEQ ID NO: 2810211 - protein, 25 aa, Entamoeba invadens
CVNCSKMNCLLCDMLGGTLLCFSCA

SEQ ID NO: 2810212 - protein, 20 aa, Entamoeba invadens
CVNLALKLGFFFVVPEYFFS

SEQ ID NO: 2810213 - protein, 18 aa, Entamoeba invadens
CVPCLKTGCIHCQGENGK

SEQ ID NO: 2810214 - protein, 24 aa, Entamoeba invadens
CVPLYRPITVILFFLITGLIFIPI

SEQ ID NO: 2810215 - protein, 20 aa, Entamoeba invadens
CVPSCAISGCIEQNNETCYT

SEQ ID NO: 2810216 - protein, 19 aa, Entamoeba invadens
CVSCGYGFFSNNGICEQCS

SEQ ID NO: 2810217 - protein, 19 aa, Entamoeba invadens
CVTCSVPNCLNCEGGKCKK

SEQ ID NO: 2810218 - protein, 18 aa, Entamoeba invadens
CVTGFYFQLGNCVTCPNT

SEQ ID NO: 2810219 - protein, 22 aa, Entamoeba invadens
CWKGFMLHFFFCFLHKWVASLF

SEQ ID NO: 2810220 - protein, 17 aa, Entamoeba invadens
CWSELYMAPEILKQQKY

SEQ ID NO: 2810221 - protein, 18 aa, Entamoeba invadens
CWYNNKWVYGDGVGMCYH

SEQ ID NO: 2810222 - protein, 26 aa, Entamoeba invadens
CYFRQKFRLGQWFKIDLSKVTKDYVM

SEQ ID NO: 2810223 - protein, 20 aa, Entamoeba invadens
CYKPSISIGEIFGIVFGSII

SEQ ID NO: 2810224 - protein, 17 aa, Entamoeba invadens
CYLIFKCLEDILSRDED

SEQ ID NO: 2810225 - protein, 17 aa, Entamoeba invadens
CYLKYQKSVICTKKHIE

SEQ ID NO: 2810226 - protein, 20 aa, Entamoeba invadens
CYTKEPFYLISIVSFLFRYD

SEQ ID NO: 2810227 - protein, 19 aa, Entamoeba invadens
CYYRQKFRIGKWFRLKIME

SEQ ID NO: 2810228 - protein, 19 aa, Entamoeba invadens
CYYRQKFRVGQWLKMNMSQ

SEQ ID NO: 2810229 - protein, 17 aa, Entamoeba invadens
DAEGVAWFDAITVEPYT

SEQ ID NO: 2810230 - protein, 21 aa, Entamoeba invadens
DAFKFPWKIAEFVTAGKRLER

SEQ ID NO: 2810231 - protein, 24 aa, Entamoeba invadens
DAFVSFPNLFPWDVAGLIAKNYRP

SEQ ID NO: 2810232 - protein, 18 aa, Entamoeba invadens
DARWFKILIWMLFTMIGS

SEQ ID NO: 2810233 - protein, 22 aa, Entamoeba invadens
DCHQLCYYYGWQVSNTDGLCYF

SEQ ID NO: 2810234 - protein, 19 aa, Entamoeba invadens
DCKCIKGYYPHSGDANCWR

SEQ ID NO: 2810235 - protein, 20 aa, Entamoeba invadens
DCLPLPPTVRVDWVGTDDFG

SEQ ID NO: 2810236 - protein, 19 aa, Entamoeba invadens
DCRKLCYYNGAFTIDSTNK

SEQ ID NO: 2810237 - protein, 17 aa, Entamoeba invadens
DCSRVTYCYACDKGYYT

SEQ ID NO: 2810238 - protein, 17 aa, Entamoeba invadens
DCTLCIFGYELVDKNCQ

SEQ ID NO: 2810239 - protein, 24 aa, Entamoeba invadens
DDFKIRFSFQNGRFVSPFIAIHSK

SEQ ID NO: 2810240 - protein, 17 aa, Entamoeba invadens
DDFYLLVRVFRRDDGNS

SEQ ID NO: 2810241 - protein, 24 aa, Entamoeba invadens
DDIRRFCAKFGWYMSALQLFDTFI

SEQ ID NO: 2810242 - protein, 23 aa, Entamoeba invadens
DDIWKKITIGFGVVSGVLLIVVI

SEQ ID NO: 2810243 - protein, 17 aa, Entamoeba invadens
DDKLCFDKYPAVLSELC

SEQ ID NO: 2810244 - protein, 17 aa, Entamoeba invadens
DDLYKWFFDKSVSPDKT

SEQ ID NO: 2810245 - protein, 18 aa, Entamoeba invadens
DDLYKWFFDKSVSPDKTT

SEQ ID NO: 2810246 - protein, 20 aa, Entamoeba invadens
DDPIKRPSIIDVVEKLETFN

SEQ ID NO: 2810247 - protein, 18 aa, Entamoeba invadens
DDSFGLKLLTNVLMSATM

SEQ ID NO: 2810248 - protein, 18 aa, Entamoeba invadens
DDVWKKEFVLGFLHTSDL

SEQ ID NO: 2810249 - protein, 19 aa, Entamoeba invadens
DEFKFPWSIANFVASGKRL

SEQ ID NO: 2810250 - protein, 24 aa, Entamoeba invadens
DEIDMKLRIKVMFDAAKGISYLHN

SEQ ID NO: 2810251 - protein, 18 aa, Entamoeba invadens
DFAEVCQLLSALIAKKVD

SEQ ID NO: 2810252 - protein, 18 aa, Entamoeba invadens
DFFAILFFPIEHKIACLL

SEQ ID NO: 2810253 - protein, 17 aa, Entamoeba invadens
DFFPLFWQTLLPMLQVN

SEQ ID NO: 2810254 - protein, 19 aa, Entamoeba invadens
DFKSIRFMVRYENDDVKEL

SEQ ID NO: 2810255 - protein, 18 aa, Entamoeba invadens
DFLFQFALDMLKRMKNKN

SEQ ID NO: 2810256 - protein, 19 aa, Entamoeba invadens
DFLRLPYKLKVRMLFDTAR

SEQ ID NO: 2810257 - protein, 20 aa, Entamoeba invadens
DFLRLPYKLKVRMLFDTARG

SEQ ID NO: 2810258 - protein, 20 aa, Entamoeba invadens
DFRSSNGLWKRYDPAVYGTL

SEQ ID NO: 2810259 - protein, 19 aa, Entamoeba invadens
DFRYPWDIVDYVMSGKRQG

SEQ ID NO: 2810260 - protein, 20 aa, Entamoeba invadens
DFYLVCLLVVMLSVTPLILR

SEQ ID NO: 2810261 - protein, 23 aa, Entamoeba invadens
DGFFLQWMMCIGILIIGTFTMLI

SEQ ID NO: 2810262 - protein, 25 aa, Entamoeba invadens
DGFLTLSCVFLRCGIETVKALPLIF

SEQ ID NO: 2810263 - protein, 23 aa, Entamoeba invadens
DGFTCSPCASGFFNSISGKICES

SEQ ID NO: 2810264 - protein, 17 aa, Entamoeba invadens
DGGCTLCGNGRLDPNEE

SEQ ID NO: 2810265 - protein, 21 aa, Entamoeba invadens
DGGRGCIECQCQFGYSSKSSS

SEQ ID NO: 2810266 - protein, 21 aa, Entamoeba invadens
DGKRLVVPVTYYIKQTPDVDK

SEQ ID NO: 2810267 - protein, 18 aa, Entamoeba invadens
DGLAHVWEEQRFCEENSP

SEQ ID NO: 2810268 - protein, 24 aa, Entamoeba invadens
DGLWSTVCAAGYCDDGFKWDFYNQ

SEQ ID NO: 2810269 - protein, 22 aa, Entamoeba invadens
DGNCSVCALSFERKCSSCEEGY

SEQ ID NO: 2810270 - protein, 25 aa, Entamoeba invadens
DGRALRLLVPFTWYSMDYVDDAKEL

SEQ ID NO: 2810271 - protein, 19 aa, Entamoeba invadens
DGYCRGCNFNYVFTQPRGN

SEQ ID NO: 2810272 - protein, 18 aa, Entamoeba invadens
DGYFSYLVCCFVAEKSLV

SEQ ID NO: 2810273 - protein, 19 aa, Entamoeba invadens
DGYYRLGLDCFKCNEKCST

SEQ ID NO: 2810274 - protein, 19 aa, Entamoeba invadens
DHCELCLTGYFLNNGKCTA

SEQ ID NO: 2810275 - protein, 23 aa, Entamoeba invadens
DHNCGYSKLDLCGSEGAEHNCEN

SEQ ID NO: 2810276 - protein, 22 aa, Entamoeba invadens
DHVFKYKICFTYSQIRKIFFFV

SEQ ID NO: 2810277 - protein, 19 aa, Entamoeba invadens
DIFYYLAMQPWRHFVWTQK

SEQ ID NO: 2810278 - protein, 17 aa, Entamoeba invadens
DINCNLCDETKSSKCVM

SEQ ID NO: 2810279 - protein, 18 aa, Entamoeba invadens
DIYSFGMTMFECFKWGEA

SEQ ID NO: 2810280 - protein, 17 aa, Entamoeba invadens
DKADGDCGFSFMTYAVL

SEQ ID NO: 2810281 - protein, 18 aa, Entamoeba invadens
DKCKLGFWIDDFECVTCE

SEQ ID NO: 2810282 - protein, 18 aa, Entamoeba invadens
DKCLKCSQNGIINRVTGQ

SEQ ID NO: 2810283 - protein, 19 aa, Entamoeba invadens
DKIRCCPPPLVTRMHILSN

SEQ ID NO: 2810284 - protein, 19 aa, Entamoeba invadens
DKLFKVILFTVNFTGNFNL

SEQ ID NO: 2810285 - protein, 23 aa, Entamoeba invadens
DKPEMWRLIPVIVPFILAGIIVI

SEQ ID NO: 2810286 - protein, 17 aa, Entamoeba invadens
DLAACLLCGFKLSPPSY

SEQ ID NO: 2810287 - protein, 18 aa, Entamoeba invadens
DLFIRLFKMFALPKDLHF

SEQ ID NO: 2810288 - protein, 19 aa, Entamoeba invadens
DLFSGFPAWSSWEYIVSEA

SEQ ID NO: 2810289 - protein, 17 aa, Entamoeba invadens
DLIHVLKILAPFRGTLI

SEQ ID NO: 2810290 - protein, 25 aa, Entamoeba invadens
DLIKECWADACLRPPFTEIETRLEK

SEQ ID NO: 2810291 - protein, 28 aa, Entamoeba invadens
DLKDKRGGAILLRFLKYYATEFDSRKFG

SEQ ID NO: 2810292 - protein, 23 aa, Entamoeba invadens
DLLIELSNTFGLFIDKHLTETHA

SEQ ID NO: 2810293 - protein, 20 aa, Entamoeba invadens
DLLLRFVQTLGMIPISMLTN

SEQ ID NO: 2810294 - protein, 19 aa, Entamoeba invadens
DLNRTALSFSWMLQYCEQS

SEQ ID NO: 2810295 - protein, 22 aa, Entamoeba invadens
DLSGLFKWYWRGHWGDEKMGLL

SEQ ID NO: 2810296 - protein, 20 aa, Entamoeba invadens
DLTMCLSCVDGFFLSDHICK

SEQ ID NO: 2810297 - protein, 24 aa, Entamoeba invadens
DMKYRVSTFNKYYCTYKNDVEGKA

SEQ ID NO: 2810298 - protein, 19 aa, Entamoeba invadens
DMVGFNWKHLTAVVDYLIT

SEQ ID NO: 2810299 - protein, 20 aa, Entamoeba invadens
DMWIPRVLIFGAILDCLVLG

SEQ ID NO: 2810300 - protein, 18 aa, Entamoeba invadens
DMYGCGLPVFARGYPALK

SEQ ID NO: 2810301 - protein, 18 aa, Entamoeba invadens
DNGTCVICPKHYKPNEEY

SEQ ID NO: 2810302 - protein, 23 aa, Entamoeba invadens
DNICKGKNGYYCVKGEEHKYLWC

SEQ ID NO: 2810303 - protein, 23 aa, Entamoeba invadens
DNKNLPEGFGFEFKKKPLVWAPT

SEQ ID NO: 2810304 - protein, 17 aa, Entamoeba invadens
DNLGFRMTIKYNDSIGG

SEQ ID NO: 2810305 - protein, 18 aa, Entamoeba invadens
DPEKYRSWEIAEFISDGQ

SEQ ID NO: 2810306 - protein, 22 aa, Entamoeba invadens
DPFPKTIFCYAWSVADHISTGK

SEQ ID NO: 2810307 - protein, 24 aa, Entamoeba invadens
DPFPKVKFGYAWNVANFVSSGKHL

SEQ ID NO: 2810308 - protein, 17 aa, Entamoeba invadens
DPLCPFVPFKIVEPLLT

SEQ ID NO: 2810309 - protein, 17 aa, Entamoeba invadens
DPNCPLAGMPIIKTYQA

SEQ ID NO: 2810310 - protein, 17 aa, Entamoeba invadens
DPYFNFRATKYLVEHGP

SEQ ID NO: 2810311 - protein, 20 aa, Entamoeba invadens
DQSLYFARWYRLVNRERIPI

SEQ ID NO: 2810312 - protein, 23 aa, Entamoeba invadens
DRGCLLCIAGYYLSHRECQVCSS

SEQ ID NO: 2810313 - protein, 19 aa, Entamoeba invadens
DRLYRFDLFVAFDYIGGDA

SEQ ID NO: 2810314 - protein, 17 aa, Entamoeba invadens
DRQLVIWIQCPKKDKFF

SEQ ID NO: 2810315 - protein, 20 aa, Entamoeba invadens
DRYWKAILFEGSGKRTLSGK

SEQ ID NO: 2810316 - protein, 18 aa, Entamoeba invadens
DSFGIVFKGIFRGNIVAI

SEQ ID NO: 2810317 - protein, 18 aa, Entamoeba invadens
DSFPLPIFKFIAASTGVV

SEQ ID NO: 2810318 - protein, 17 aa, Entamoeba invadens
DSIGWYPTFLLKADGVQ

SEQ ID NO: 2810319 - protein, 19 aa, Entamoeba invadens
DSKCSKCTFWHSPSIDGSS

SEQ ID NO: 2810320 - protein, 20 aa, Entamoeba invadens
DSVWMRGYWLIFSQDQAVKG

SEQ ID NO: 2810321 - protein, 17 aa, Entamoeba invadens
DSYVCPAPYSASTSDNH

SEQ ID NO: 2810322 - protein, 17 aa, Entamoeba invadens
DTCLRFSDCFTCNLTNF

SEQ ID NO: 2810323 - protein, 18 aa, Entamoeba invadens
DTEIRFLFCVGNIKTRKS

SEQ ID NO: 2810324 - protein, 24 aa, Entamoeba invadens
DTFKTRPELFWSMAEEIHKIDAKP

SEQ ID NO: 2810325 - protein, 17 aa, Entamoeba invadens
DTGCLQCEPGFYLHNSR

SEQ ID NO: 2810326 - protein, 19 aa, Entamoeba invadens
DTKCLSCKYGFYIGENYTC

SEQ ID NO: 2810327 - protein, 17 aa, Entamoeba invadens
DTLKCTMCQPTYVLVEM

SEQ ID NO: 2810328 - protein, 18 aa, Entamoeba invadens
DTNCKYCPLDTRYCVQCH

SEQ ID NO: 2810329 - protein, 22 aa, Entamoeba invadens
DTRYFCKIFGWEIDAEIAKYIQ

SEQ ID NO: 2810330 - protein, 17 aa, Entamoeba invadens
DTTKFVWVHNSAVDTSP

SEQ ID NO: 2810331 - protein, 19 aa, Entamoeba invadens
DTTKLLWRLARVIDNSAEG

SEQ ID NO: 2810332 - protein, 21 aa, Entamoeba invadens
DVCIKLKIKMMIDAANGISYL

SEQ ID NO: 2810333 - protein, 18 aa, Entamoeba invadens
DVCYSWWVLSSMCILGTV

SEQ ID NO: 2810334 - protein, 25 aa, Entamoeba invadens
DVFSFAICILEIWLTKSPYDPDVFA

SEQ ID NO: 2810335 - protein, 26 aa, Entamoeba invadens
DVFSFAICMLEIWIGRDVYPPDKFPD

SEQ ID NO: 2810336 - protein, 25 aa, Entamoeba invadens
DVFSFAICMLEIWLGSDPYPPAKFP

SEQ ID NO: 2810337 - protein, 26 aa, Entamoeba invadens
DVFSFAICMLEIWLTRDPYPIIEFRD

SEQ ID NO: 2810338 - protein, 26 aa, Entamoeba invadens
DVFSFAICMLEIWVGRDVYPSDKFPD

SEQ ID NO: 2810339 - protein, 19 aa, Entamoeba invadens
DVFSFAVCCLEIYLRKVPY

SEQ ID NO: 2810340 - protein, 17 aa, Entamoeba invadens
DVISFRYKPNWNANQLS

SEQ ID NO: 2810341 - protein, 18 aa, Entamoeba invadens
DVKWCFNNSVLKCVLHSE

SEQ ID NO: 2810342 - protein, 17 aa, Entamoeba invadens
DVLCFNSDLTLRWTNNV

SEQ ID NO: 2810343 - protein, 20 aa, Entamoeba invadens
DVRLRMWGVWSFTAFNAYWF

SEQ ID NO: 2810344 - protein, 18 aa, Entamoeba invadens
DVVERCWAQDAVQRPSIS

SEQ ID NO: 2810345 - protein, 17 aa, Entamoeba invadens
DVVFVLKIGVDTVGNIE

SEQ ID NO: 2810346 - protein, 20 aa, Entamoeba invadens
DYQCLKCATGNYFSVESRSC

SEQ ID NO: 2810347 - protein, 20 aa, Entamoeba invadens
DYRITLCIMCLAPFGVGSFI

SEQ ID NO: 2810348 - protein, 19 aa, Entamoeba invadens
DYYSGGICRKCPGKKMTDG

SEQ ID NO: 2810349 - protein, 18 aa, Entamoeba invadens
EACEFSLFICPLCSFTAE

SEQ ID NO: 2810350 - protein, 20 aa, Entamoeba invadens
EACSKCYECFSLNIQHKCVL

SEQ ID NO: 2810351 - protein, 24 aa, Entamoeba invadens
EADKEAYCVWKFKKTNCKKCISHQ

SEQ ID NO: 2810352 - protein, 20 aa, Entamoeba invadens
EAGIYRLTLKLADEEKSSPL

SEQ ID NO: 2810353 - protein, 18 aa, Entamoeba invadens
EAMWCALCLFQLGEDYAR

SEQ ID NO: 2810354 - protein, 20 aa, Entamoeba invadens
EASLRVPILFSESNTEKMVY

SEQ ID NO: 2810355 - protein, 18 aa, Entamoeba invadens
EAVWWVILLCVFFVVILL

SEQ ID NO: 2810356 - protein, 24 aa, Entamoeba invadens
EAYPTAQFKYSWDVADFVACGNRL

SEQ ID NO: 2810357 - protein, 17 aa, Entamoeba invadens
ECATGYYLKNRVCYVCA

SEQ ID NO: 2810358 - protein, 23 aa, Entamoeba invadens
ECCKNPSLMWVIFKKEWKSMLFG

SEQ ID NO: 2810359 - protein, 25 aa, Entamoeba invadens
ECDKWKLCGEWTFKFKASKKELVHV

SEQ ID NO: 2810360 - protein, 20 aa, Entamoeba invadens
ECFAWRIAYSDVEFKFPWKI

SEQ ID NO: 2810361 - protein, 20 aa, Entamoeba invadens
ECFAWRIAYSDVEFKFPWTI

SEQ ID NO: 2810362 - protein, 17 aa, Entamoeba invadens
ECFKNWMPLSWSSGDVI

SEQ ID NO: 2810363 - protein, 19 aa, Entamoeba invadens
ECFLCVKGAFYLVDGKCEN

SEQ ID NO: 2810364 - protein, 19 aa, Entamoeba invadens
ECKNGSFLHERMCTPCQDN

SEQ ID NO: 2810365 - protein, 23 aa, Entamoeba invadens
ECKQCGPGCSICNSFNQCQACLS

SEQ ID NO: 2810366 - protein, 24 aa, Entamoeba invadens
ECPKFKLSFFYLQAFVKTVLTIPN

SEQ ID NO: 2810367 - protein, 22 aa, Entamoeba invadens
EDAPDIAMCWDNGSGTNSESKT

SEQ ID NO: 2810368 - protein, 25 aa, Entamoeba invadens
EDDICKGKEGFYCLEGNKYIHKYLW

SEQ ID NO: 2810369 - protein, 24 aa, Entamoeba invadens
EDDICKGKNGLYCVDDGKHIHEFL

SEQ ID NO: 2810370 - protein, 19 aa, Entamoeba invadens
EDLKIILRNCWKTHDERWD

SEQ ID NO: 2810371 - protein, 18 aa, Entamoeba invadens
EDVCIGCSDMAFLSENKC

SEQ ID NO: 2810372 - protein, 17 aa, Entamoeba invadens
EDVEFFKMFSLLNKLEG

SEQ ID NO: 2810373 - protein, 20 aa, Entamoeba invadens
EDYERLLVCMHLSVFYEKMI

SEQ ID NO: 2810374 - protein, 18 aa, Entamoeba invadens
EECLTCFEGFYLKEEKCA

SEQ ID NO: 2810375 - protein, 21 aa, Entamoeba invadens
EEFKFPWKIAEFVISGKRLDK

SEQ ID NO: 2810376 - protein, 23 aa, Entamoeba invadens
EEHWKMMIDIFLDFSMQDISKAV

SEQ ID NO: 2810377 - protein, 24 aa, Entamoeba invadens
EELLRRINFVISYVMEYLKIFESV

SEQ ID NO: 2810378 - protein, 22 aa, Entamoeba invadens
EELYLFPKMEVFEIYNDPSELR

SEQ ID NO: 2810379 - protein, 21 aa, Entamoeba invadens
EEMFKFLYFWKNSTVVVYDTS

SEQ ID NO: 2810380 - protein, 19 aa, Entamoeba invadens
EEVKCVLILLSIVLIAQMG

SEQ ID NO: 2810381 - protein, 21 aa, Entamoeba invadens
EEYKVLCVIPFSSYRKRMSVL

SEQ ID NO: 2810382 - protein, 21 aa, Entamoeba invadens
EFCKYCSPSMCLSCDDSYHLT

SEQ ID NO: 2810383 - protein, 18 aa, Entamoeba invadens
EFEYPWKIAMFVCNGSRL

SEQ ID NO: 2810384 - protein, 24 aa, Entamoeba invadens
EFGCIWCKAGFYKGGDGIKCVECP

SEQ ID NO: 2810385 - protein, 22 aa, Entamoeba invadens
EFIPGCVPICGVCKSGFVCNKA

SEQ ID NO: 2810386 - protein, 20 aa, Entamoeba invadens
EFKFPWKIAEFVIGKNRLKI

SEQ ID NO: 2810387 - protein, 20 aa, Entamoeba invadens
EFKFPWKIAEFVISGKRLDK

SEQ ID NO: 2810388 - protein, 20 aa, Entamoeba invadens
EFKFPWKIAEFVSLGKRLEK

SEQ ID NO: 2810389 - protein, 19 aa, Entamoeba invadens
EFKFPWKIVEFVISGKRLQ

SEQ ID NO: 2810390 - protein, 18 aa, Entamoeba invadens
EFPCGTWNDFSMKSSIVL

SEQ ID NO: 2810391 - protein, 18 aa, Entamoeba invadens
EFQYSWNIVDFVASGKRR

SEQ ID NO: 2810392 - protein, 21 aa, Entamoeba invadens
EFVDFKFRYRKGLQVVLKNVS

SEQ ID NO: 2810393 - protein, 18 aa, Entamoeba invadens
EFYTLGMCKKCLFGDKTT

SEQ ID NO: 2810394 - protein, 20 aa, Entamoeba invadens
EGAFGIVFKGVFRGNSVAVK

SEQ ID NO: 2810395 - protein, 19 aa, Entamoeba invadens
EGEVRLSGVTFKYPSRPEQ

SEQ ID NO: 2810396 - protein, 19 aa, Entamoeba invadens
  misc_feature (17)..(18): Xaa can be any naturally occurring amino acid
EGEVRLSGVTFKYPSRXXV

SEQ ID NO: 2810397 - protein, 19 aa, Entamoeba invadens
EGFLCCLFMFIGIVALLIR

SEQ ID NO: 2810398 - protein, 19 aa, Entamoeba invadens
EGFQYQLCCYAKLTNNTKA

SEQ ID NO: 2810399 - protein, 24 aa, Entamoeba invadens
EGFTRLIWRLTNIRSSDGYIPVTI

SEQ ID NO: 2810400 - protein, 18 aa, Entamoeba invadens
EGHLLRYGASDEIYCHVN

SEQ ID NO: 2810401 - protein, 24 aa, Entamoeba invadens
EGIFEFSLKISRCTSFFNTFVIGF

SEQ ID NO: 2810402 - protein, 19 aa, Entamoeba invadens
EGKVRLPLCPPLDKTIEPY

SEQ ID NO: 2810403 - protein, 21 aa, Entamoeba invadens
EGKYPKWLMIKSHIIVYIGNF

SEQ ID NO: 2810404 - protein, 19 aa, Entamoeba invadens
EGLRWMKNRCDSIESILET

SEQ ID NO: 2810405 - protein, 20 aa, Entamoeba invadens
EGLYRISTSDGYYCTYSGKG

SEQ ID NO: 2810406 - protein, 23 aa, Entamoeba invadens
EGPRFKPGWNHFILIISIPLYVY

SEQ ID NO: 2810407 - protein, 18 aa, Entamoeba invadens
EGPSTFKSIAIGSGSDAT

SEQ ID NO: 2810408 - protein, 20 aa, Entamoeba invadens
EGSFGVVFRGRFHDQIVAIK

SEQ ID NO: 2810409 - protein, 20 aa, Entamoeba invadens
EGTYKIDILYTFETRDFELE

SEQ ID NO: 2810410 - protein, 18 aa, Entamoeba invadens
EGVKEVWSLPESVKEYTL

SEQ ID NO: 2810411 - protein, 18 aa, Entamoeba invadens
EGVLKFMRENGILDNIVS

SEQ ID NO: 2810412 - protein, 18 aa, Entamoeba invadens
EGYFCFPMVDYIFFDETS

SEQ ID NO: 2810413 - protein, 17 aa, Entamoeba invadens
EHIRLIFSYICNKAKQA

SEQ ID NO: 2810414 - protein, 18 aa, Entamoeba invadens
EHKYRVGKWYAFDSNEMT

SEQ ID NO: 2810415 - protein, 19 aa, Entamoeba invadens
EIFPGIPIPIILDSNTPLD

SEQ ID NO: 2810416 - protein, 24 aa, Entamoeba invadens
EIIFKGGLLFYILVIIYIILTRTV

SEQ ID NO: 2810417 - protein, 21 aa, Entamoeba invadens
EIKTNRLVVCMGKCNLDGNRQ

SEQ ID NO: 2810418 - protein, 26 aa, Entamoeba invadens
EILSLAIWLCYFWKGYQNVIESNVAF

SEQ ID NO: 2810419 - protein, 24 aa, Entamoeba invadens
EIPACKKLRVNTCNKKTTARVTIH

SEQ ID NO: 2810420 - protein, 20 aa, Entamoeba invadens
EIRMKLPFPLTVKHHLLFTV

SEQ ID NO: 2810421 - protein, 17 aa, Entamoeba invadens
EIVNMIFEWVVAKLKIR

SEQ ID NO: 2810422 - protein, 21 aa, Entamoeba invadens
EIYVRYSCDVIRAINDEIGES

SEQ ID NO: 2810423 - protein, 17 aa, Entamoeba invadens
EKCSLKYGELCDFCDSK

SEQ ID NO: 2810424 - protein, 24 aa, Entamoeba invadens
EKDRCYQCITGYFLIHNQCEKCLE

SEQ ID NO: 2810425 - protein, 17 aa, Entamoeba invadens
EKFFWETCWEILRANAV

SEQ ID NO: 2810426 - protein, 21 aa, Entamoeba invadens
EKFPFKQFNFFSVVREKVKTG

SEQ ID NO: 2810427 - protein, 21 aa, Entamoeba invadens
EKGSCTSSWWIKEPYIMHDVE

SEQ ID NO: 2810428 - protein, 20 aa, Entamoeba invadens
EKIGRIAFRAAKYFDSQAND

SEQ ID NO: 2810429 - protein, 17 aa, Entamoeba invadens
EKLPDVCYSWWVLSSMC

SEQ ID NO: 2810430 - protein, 24 aa, Entamoeba invadens
EKMVFSGFLSFCLSNLKNTMKSSC

SEQ ID NO: 2810431 - protein, 18 aa, Entamoeba invadens
EKMWNAFSALQFDFSNPP

SEQ ID NO: 2810432 - protein, 18 aa, Entamoeba invadens
EKQIAIIVAALFVGFLIV

SEQ ID NO: 2810433 - protein, 22 aa, Entamoeba invadens
EKRLQFCINLDFSLHFHSLPIY

SEQ ID NO: 2810434 - protein, 24 aa, Entamoeba invadens
EKSGWKWYYYFLLIVGIFIVVIVL

SEQ ID NO: 2810435 - protein, 19 aa, Entamoeba invadens
EKVDFCWDKKSVLIIPTLI

SEQ ID NO: 2810436 - protein, 18 aa, Entamoeba invadens
EKVVWFFKQYIRTDHEGV

SEQ ID NO: 2810437 - protein, 20 aa, Entamoeba invadens
ELECDLELIGATAIEDQLQE

SEQ ID NO: 2810438 - protein, 26 aa, Entamoeba invadens
ELKTKRPSISWVICKREWKWFLIMYI

SEQ ID NO: 2810439 - protein, 21 aa, Entamoeba invadens
ELLKIRFEMIYKYFDDKSLVL

SEQ ID NO: 2810440 - protein, 22 aa, Entamoeba invadens
ELLYCHNWFYPILAFMVLGIVV

SEQ ID NO: 2810441 - protein, 19 aa, Entamoeba invadens
ELMFFKWYIKHINMDGTGT

SEQ ID NO: 2810442 - protein, 20 aa, Entamoeba invadens
ELMTLCWKKQPVFRPDFAEV

SEQ ID NO: 2810443 - protein, 24 aa, Entamoeba invadens
ELQKRWLVTYSINWLPFVSLSKDF

SEQ ID NO: 2810444 - protein, 20 aa, Entamoeba invadens
ELRAMNWLSFIGGAKGVFYY

SEQ ID NO: 2810445 - protein, 19 aa, Entamoeba invadens
ELRKVCIFKMSRSNIAFIS

SEQ ID NO: 2810446 - protein, 19 aa, Entamoeba invadens
ELRKVCIFKMSRSNIAFVS

SEQ ID NO: 2810447 - protein, 18 aa, Entamoeba invadens
ELSKCKCILKQPKIDSER

SEQ ID NO: 2810448 - protein, 25 aa, Entamoeba invadens
ELWLWFGVICGVIIVFVVIVLGSII

SEQ ID NO: 2810449 - protein, 21 aa, Entamoeba invadens
ELYPRVGCFKVLDGKYVQYST

SEQ ID NO: 2810450 - protein, 20 aa, Entamoeba invadens
EMSLWPLVVLFVFIATTGAI

SEQ ID NO: 2810451 - protein, 19 aa, Entamoeba invadens
EMWKRKKVNINLVMDGESL

SEQ ID NO: 2810452 - protein, 17 aa, Entamoeba invadens
EMYSGSVLNQFNKAWSL

SEQ ID NO: 2810453 - protein, 17 aa, Entamoeba invadens
ENFKFAWSIADFVASGK

SEQ ID NO: 2810454 - protein, 23 aa, Entamoeba invadens
ENGKLTLPIGMYFSVITEEEMDL

SEQ ID NO: 2810455 - protein, 23 aa, Entamoeba invadens
ENGYRLVMFIIIFMQIIRNVFYY

SEQ ID NO: 2810456 - protein, 20 aa, Entamoeba invadens
ENIAVMLFPIVWYAIDEKNY

SEQ ID NO: 2810457 - protein, 18 aa, Entamoeba invadens
ENLYRISSKLSITQNTND

SEQ ID NO: 2810458 - protein, 20 aa, Entamoeba invadens
ENWKSVIFNTSFVSITGNYN

SEQ ID NO: 2810459 - protein, 22 aa, Entamoeba invadens
ENWMGRGGLFGANTSFLGVGIF

SEQ ID NO: 2810460 - protein, 25 aa, Entamoeba invadens
EPEKRGQCVLSVFGCLCNSGYGYEE

SEQ ID NO: 2810461 - protein, 22 aa, Entamoeba invadens
EPFSRLVALFSFVQLKQPIICV

SEQ ID NO: 2810462 - protein, 17 aa, Entamoeba invadens
EPKRYGTDLAFLAAATT

SEQ ID NO: 2810463 - protein, 21 aa, Entamoeba invadens
EPPEIRECFDMEEVKQESDED

SEQ ID NO: 2810464 - protein, 25 aa, Entamoeba invadens
EPYPKIRFKFAWDIVDFVASGKRLK

SEQ ID NO: 2810465 - protein, 21 aa, Entamoeba invadens
EQCSVCKTGFLLEQVTLKCVS

SEQ ID NO: 2810466 - protein, 19 aa, Entamoeba invadens
EQFLKLKYSRIFLNPEKDA

SEQ ID NO: 2810467 - protein, 20 aa, Entamoeba invadens
EQFRFPWNIADYVTSGKRIN

SEQ ID NO: 2810468 - protein, 22 aa, Entamoeba invadens
EQKWIFPTAIRFVFLFFVASIF

SEQ ID NO: 2810469 - protein, 19 aa, Entamoeba invadens
EQMYRPALVLYQFLGELGI

SEQ ID NO: 2810470 - protein, 18 aa, Entamoeba invadens
EQNWKCYVVINIGQLIII

SEQ ID NO: 2810471 - protein, 21 aa, Entamoeba invadens
ERLKREFLPLLFVGITHLNQT

SEQ ID NO: 2810472 - protein, 23 aa, Entamoeba invadens
ERLKRLFGEVGMGHLLVLAVGAI

SEQ ID NO: 2810473 - protein, 19 aa, Entamoeba invadens
ERMVFGLRCRYHFVMYHLL

SEQ ID NO: 2810474 - protein, 17 aa, Entamoeba invadens
ERPHCILLFSDVILLIP

SEQ ID NO: 2810475 - protein, 25 aa, Entamoeba invadens
ESEVWWYRDILKMVGWYNIFSLLFI

SEQ ID NO: 2810476 - protein, 17 aa, Entamoeba invadens
ESFWVIYVLVIVFYILF

SEQ ID NO: 2810477 - protein, 21 aa, Entamoeba invadens
ESPSARLALFFGNRTSENVDL

SEQ ID NO: 2810478 - protein, 20 aa, Entamoeba invadens
ESPVDFPGLFPYLLQNNPSS

SEQ ID NO: 2810479 - protein, 24 aa, Entamoeba invadens
ESQSSCAYTHGWSFGTYDAQKAKY

SEQ ID NO: 2810480 - protein, 18 aa, Entamoeba invadens
ETELKVCCDVDCDLATIT

SEQ ID NO: 2810481 - protein, 18 aa, Entamoeba invadens
ETFGYVSFTYRFKEKTHE

SEQ ID NO: 2810482 - protein, 17 aa, Entamoeba invadens
ETFKFPWKIAEFVTLGK

SEQ ID NO: 2810483 - protein, 20 aa, Entamoeba invadens
ETMFFKWYIKHIKMDATGTM

SEQ ID NO: 2810484 - protein, 18 aa, Entamoeba invadens
EVFCGILLLLVVFETSTL

SEQ ID NO: 2810485 - protein, 19 aa, Entamoeba invadens
EVFLQLKLLWPSYTPNDNY

SEQ ID NO: 2810486 - protein, 17 aa, Entamoeba invadens
EVIKLLLTKSVILSVNS

SEQ ID NO: 2810487 - protein, 18 aa, Entamoeba invadens
EVILKMRIKLILDTAKGI

SEQ ID NO: 2810488 - protein, 19 aa, Entamoeba invadens
EVMIAIGMLFELHCLSVER

SEQ ID NO: 2810489 - protein, 24 aa, Entamoeba invadens
EVRNSGLFAVCWSFGKAIGYAAGG

SEQ ID NO: 2810490 - protein, 23 aa, Entamoeba invadens
EVRRFCNKFGWYFSALQLFDTFI

SEQ ID NO: 2810491 - protein, 22 aa, Entamoeba invadens
EVSSFKCAKCSFGYTPSDTGLE

SEQ ID NO: 2810492 - protein, 24 aa, Entamoeba invadens
EWKHLLLCYGCLLFSQITTLVIPI

SEQ ID NO: 2810493 - protein, 17 aa, Entamoeba invadens
EYCYLKAVWWVFFISSL

SEQ ID NO: 2810494 - protein, 22 aa, Entamoeba invadens
EYLCILNFFAGRSFVDISQYYI

SEQ ID NO: 2810495 - protein, 19 aa, Entamoeba invadens
EYLYRLAVFLDNKRYVTQQ

SEQ ID NO: 2810496 - protein, 19 aa, Entamoeba invadens
EYPFSWKIAETIISGKRPE

SEQ ID NO: 2810497 - protein, 17 aa, Entamoeba invadens
EYRRFAIDRFKKKYPES

SEQ ID NO: 2810498 - protein, 24 aa, Entamoeba invadens
EYYDCSFSKLDLCGSGEAEHKCEN

SEQ ID NO: 2810499 - protein, 21 aa, Entamoeba invadens
EYYKQCGICNGFGIAGSGYPA

SEQ ID NO: 2810500 - protein, 21 aa, Entamoeba invadens
EYYKQCGICNGFGIAGSGYSA

SEQ ID NO: 2810501 - protein, 18 aa, Entamoeba invadens
FAAWAFCVGWGISIAVSF

SEQ ID NO: 2810502 - protein, 17 aa, Entamoeba invadens
FACEFEILLTLLCTSKI

SEQ ID NO: 2810503 - protein, 18 aa, Entamoeba invadens
FACLQCFPLFYTNNNNTT

SEQ ID NO: 2810504 - protein, 20 aa, Entamoeba invadens
FADCVFRYVTYFAKVLVILF

SEQ ID NO: 2810505 - protein, 25 aa, Entamoeba invadens
FAFGLSLLECMKWRQAYEKPEFNYM

SEQ ID NO: 2810506 - protein, 18 aa, Entamoeba invadens
FAFPWMIADFVFKGNRPP

SEQ ID NO: 2810507 - protein, 20 aa, Entamoeba invadens
FAGRPRPNFYAVYDAGDQAD

SEQ ID NO: 2810508 - protein, 17 aa, Entamoeba invadens
FAHQMCQFLMPYYSRTG

SEQ ID NO: 2810509 - protein, 17 aa, Entamoeba invadens
FAISLYETVTWKEAFPK

SEQ ID NO: 2810510 - protein, 19 aa, Entamoeba invadens
FAKEFLKYFRGFVKIESYI

SEQ ID NO: 2810511 - protein, 20 aa, Entamoeba invadens
FALWCSLSFCYNSLDKIIKS

SEQ ID NO: 2810512 - protein, 23 aa, Entamoeba invadens
FANTCRKCEGFLYPSTGSNMCSM

SEQ ID NO: 2810513 - protein, 18 aa, Entamoeba invadens
FAQLDFSVTFARASVKEN

SEQ ID NO: 2810514 - protein, 17 aa, Entamoeba invadens
FARRLGAGIAFYMLVWV

SEQ ID NO: 2810515 - protein, 20 aa, Entamoeba invadens
FCFKGLTSLECIKVMNATCL

SEQ ID NO: 2810516 - protein, 17 aa, Entamoeba invadens
FCFSFWISVTVYFYDGL

SEQ ID NO: 2810517 - protein, 17 aa, Entamoeba invadens
FCFYECVALTSVQFPQQ

SEQ ID NO: 2810518 - protein, 22 aa, Entamoeba invadens
FCIDAFLFLGGVSFYSWIISLI

SEQ ID NO: 2810519 - protein, 20 aa, Entamoeba invadens
FCIMASNALGTWYGNLVLRG

SEQ ID NO: 2810520 - protein, 17 aa, Entamoeba invadens
FCIVILRGGGKMDSVVG

SEQ ID NO: 2810521 - protein, 19 aa, Entamoeba invadens
FCLLCALYVFTSLPQPSLL

SEQ ID NO: 2810522 - protein, 17 aa, Entamoeba invadens
FCLLQWSLGCIRCITNM

SEQ ID NO: 2810523 - protein, 20 aa, Entamoeba invadens
FCLNCTSLLCGGDLDVYKYS

SEQ ID NO: 2810524 - protein, 26 aa, Entamoeba invadens
FCLRSKRYILKHMIFFKMLFMDFLKD

SEQ ID NO: 2810525 - protein, 19 aa, Entamoeba invadens
FCLSCKAGTFLSDHKCITN

SEQ ID NO: 2810526 - protein, 17 aa, Entamoeba invadens
FCLSCPEGTFLNDHKCI

SEQ ID NO: 2810527 - protein, 20 aa, Entamoeba invadens
FCLSCPNGFYLNSQKTCMSC

SEQ ID NO: 2810528 - protein, 17 aa, Entamoeba invadens
FCLTCPAGTFSKEKYEK

SEQ ID NO: 2810529 - protein, 20 aa, Entamoeba invadens
FCMCSWYTLCVCCIPIYDDD

SEQ ID NO: 2810530 - protein, 18 aa, Entamoeba invadens
FCNVSTCFLCQNGFVLKD

SEQ ID NO: 2810531 - protein, 17 aa, Entamoeba invadens
FCTKCFWGCATCYSQQP

SEQ ID NO: 2810532 - protein, 17 aa, Entamoeba invadens
FCVVFGLPLKFLIIPFI

SEQ ID NO: 2810533 - protein, 19 aa, Entamoeba invadens
FCVVFWKYYAELMNNNIVV

SEQ ID NO: 2810534 - protein, 23 aa, Entamoeba invadens
FCVYAGLCAVIFFALKLFNKRDH

SEQ ID NO: 2810535 - protein, 17 aa, Entamoeba invadens
FCYCIWIVAFCKFKNSG

SEQ ID NO: 2810536 - protein, 17 aa, Entamoeba invadens
FCYNCFFNNLIINNGVC

SEQ ID NO: 2810537 - protein, 17 aa, Entamoeba invadens
FCYYSRITKLFPRAKTL

SEQ ID NO: 2810538 - protein, 21 aa, Entamoeba invadens
FDARLANCFDDYVLPIMTLQT

SEQ ID NO: 2810539 - protein, 19 aa, Entamoeba invadens
FDFYCCINNTKTLANTGTY

SEQ ID NO: 2810540 - protein, 20 aa, Entamoeba invadens
FDKQCALHCNECVDGKCNSC

SEQ ID NO: 2810541 - protein, 25 aa, Entamoeba invadens
FDKVWRPPLFTPRRICHIGVLAYIA

SEQ ID NO: 2810542 - protein, 19 aa, Entamoeba invadens
FDLVKMCWRQEPKERPTMR

SEQ ID NO: 2810543 - protein, 17 aa, Entamoeba invadens
FDNSMSLYTGKLVEFKL

SEQ ID NO: 2810544 - protein, 18 aa, Entamoeba invadens
FDPICNVIWDKTILNDVG

SEQ ID NO: 2810545 - protein, 19 aa, Entamoeba invadens
FDRCYACGSSVVVGITEKA

SEQ ID NO: 2810546 - protein, 22 aa, Entamoeba invadens
FDSRLMFFFGFALPFTSLSFFC

SEQ ID NO: 2810547 - protein, 20 aa, Entamoeba invadens
FECFGWKEAYPIDTFKYTWK

SEQ ID NO: 2810548 - protein, 19 aa, Entamoeba invadens
FEDFKGWIGIAERIGTPRV

SEQ ID NO: 2810549 - protein, 28 aa, Entamoeba invadens
FEFLHFNIPFGVIGLWGIYFGEAVSQNM

SEQ ID NO: 2810550 - protein, 18 aa, Entamoeba invadens
FEGITGWRNWDWDTDFTI

SEQ ID NO: 2810551 - protein, 20 aa, Entamoeba invadens
FEICDPCFFTAFRDAVMEGR

SEQ ID NO: 2810552 - protein, 17 aa, Entamoeba invadens
FEIESSFAMNDQLGKLG

SEQ ID NO: 2810553 - protein, 19 aa, Entamoeba invadens
FEIIELAPFIDFPENTKIR

SEQ ID NO: 2810554 - protein, 18 aa, Entamoeba invadens
FEKKCVKCGIGYYVEENG

SEQ ID NO: 2810555 - protein, 17 aa, Entamoeba invadens
FENGICLDISYVLQCIE

SEQ ID NO: 2810556 - protein, 25 aa, Entamoeba invadens
FEPAFIFSFAFWWKVGVITLVNALP

SEQ ID NO: 2810557 - protein, 18 aa, Entamoeba invadens
FETIFARVIGVSFTRTKV

SEQ ID NO: 2810558 - protein, 17 aa, Entamoeba invadens
FEVFGVRYFEVRAGYGW

SEQ ID NO: 2810559 - protein, 25 aa, Entamoeba invadens
FEVFWRITLLIVMCVATLFFLYVLR

SEQ ID NO: 2810560 - protein, 17 aa, Entamoeba invadens
FEVRWTFALLIVLVIQN

SEQ ID NO: 2810561 - protein, 17 aa, Entamoeba invadens
FEWEWARKSIPIMMGVG

SEQ ID NO: 2810562 - protein, 17 aa, Entamoeba invadens
FEWKMIWVMLTWLCIYN

SEQ ID NO: 2810563 - protein, 18 aa, Entamoeba invadens
FEYPWCIADFVTQGKRME

SEQ ID NO: 2810564 - protein, 21 aa, Entamoeba invadens
FFCFGLWILCFLLFYKSSSKR

SEQ ID NO: 2810565 - protein, 21 aa, Entamoeba invadens
FFCYFTSLFLLPRFINTVTRE

SEQ ID NO: 2810566 - protein, 18 aa, Entamoeba invadens
FFEIIGWAEPFAKSTFKY

SEQ ID NO: 2810567 - protein, 24 aa, Entamoeba invadens
FFFLCLRIRPTIFLGVPRVYEKII

SEQ ID NO: 2810568 - protein, 17 aa, Entamoeba invadens
FFFQIIFVHFVTAFCGD

SEQ ID NO: 2810569 - protein, 18 aa, Entamoeba invadens
FFHIVFVFRSEFFERLNL

SEQ ID NO: 2810570 - protein, 17 aa, Entamoeba invadens
FFIEFPLHLCKMTQLIK

SEQ ID NO: 2810571 - protein, 17 aa, Entamoeba invadens
FFIKVCLKTLSACKMLS

SEQ ID NO: 2810572 - protein, 31 aa, Entamoeba invadens
FFKTILRPFVFCWKKLPSIVRFSIKNFFSVP

SEQ ID NO: 2810573 - protein, 18 aa, Entamoeba invadens
FFKTLTICQSVDIRREGE

SEQ ID NO: 2810574 - protein, 18 aa, Entamoeba invadens
FFLHFWKNGLLFLRGPVL

SEQ ID NO: 2810575 - protein, 18 aa, Entamoeba invadens
FFNYPWKIAEFVTAGKRL

SEQ ID NO: 2810576 - protein, 25 aa, Entamoeba invadens
FFQFSFRWFNCCLVREFSIDAIQVI

SEQ ID NO: 2810577 - protein, 20 aa, Entamoeba invadens
FFRIIVWFNVEFETVDRNKS

SEQ ID NO: 2810578 - protein, 18 aa, Entamoeba invadens
FFSAFFFDQVLLYAVSVL

SEQ ID NO: 2810579 - protein, 18 aa, Entamoeba invadens
FFVFCITVVYLLSDYWKL

SEQ ID NO: 2810580 - protein, 17 aa, Entamoeba invadens
FFYRKCTAPGCLLNRVV

SEQ ID NO: 2810581 - protein, 23 aa, Entamoeba invadens
FGACLHCLTCLIVAMVYITETKT

SEQ ID NO: 2810582 - protein, 20 aa, Entamoeba invadens
FGAEEKWQGLSIIFDTFKNG

SEQ ID NO: 2810583 - protein, 23 aa, Entamoeba invadens
FGAFFRLHFFVAVIFPFAVIFAC

SEQ ID NO: 2810584 - protein, 25 aa, Entamoeba invadens
FGAIGDRCTFVWGRRRIFLAVGAFI

SEQ ID NO: 2810585 - protein, 17 aa, Entamoeba invadens
FGCLSCEAGFFVEDRKC

SEQ ID NO: 2810586 - protein, 23 aa, Entamoeba invadens
FGECPSCLDGFFLNSLTCYPCSV

SEQ ID NO: 2810587 - protein, 26 aa, Entamoeba invadens
FGFSFNFWFIFALRFLNGMLNGNIGV

SEQ ID NO: 2810588 - protein, 20 aa, Entamoeba invadens
FGHWKYPECLSDIKASPNNK

SEQ ID NO: 2810589 - protein, 28 aa, Entamoeba invadens
FGIGVAFYFDWRIALCVIAVTPILITVV

SEQ ID NO: 2810590 - protein, 20 aa, Entamoeba invadens
FGIVYRAEWRKVDVAVKVMK

SEQ ID NO: 2810591 - protein, 20 aa, Entamoeba invadens
FGIVYRAEWRRVDVAVKVMK

SEQ ID NO: 2810592 - protein, 20 aa, Entamoeba invadens
FGIWCLINFLVGRRGAAILP

SEQ ID NO: 2810593 - protein, 17 aa, Entamoeba invadens
FGKVVACSLALAQIDAQ

SEQ ID NO: 2810594 - protein, 17 aa, Entamoeba invadens
FGMFKACLITLMVEIGP

SEQ ID NO: 2810595 - protein, 18 aa, Entamoeba invadens
FGPINTRPCRFIAETQII

SEQ ID NO: 2810596 - protein, 22 aa, Entamoeba invadens
FGPLCTFIFICICCGYHGSDFL

SEQ ID NO: 2810597 - protein, 20 aa, Entamoeba invadens
FGTVFRAEWRGVDVAVKQMK

SEQ ID NO: 2810598 - protein, 19 aa, Entamoeba invadens
FGVFAEFIIGFTIAAEQEE

SEQ ID NO: 2810599 - protein, 17 aa, Entamoeba invadens
FGVRLLIEMLRVSVEKL

SEQ ID NO: 2810600 - protein, 19 aa, Entamoeba invadens
FGVSPLFFKICNFLYLHFN

SEQ ID NO: 2810601 - protein, 17 aa, Entamoeba invadens
FGWAEAYPINTFKFPWK

SEQ ID NO: 2810602 - protein, 17 aa, Entamoeba invadens
FHFSFITLCCLFSYAVS

SEQ ID NO: 2810603 - protein, 35 aa, Entamoeba invadens
FHGRECLYRNSLLIKLCFYKNIAMFFVLFYLAFLN

SEQ ID NO: 2810604 - protein, 17 aa, Entamoeba invadens
FHMLGLCRIQFIGVLGF

SEQ ID NO: 2810605 - protein, 23 aa, Entamoeba invadens
FICVGRRPPCLIGMDPTLFDIIA

SEQ ID NO: 2810606 - protein, 17 aa, Entamoeba invadens
FIFNTIHAIEFVLGCIS

SEQ ID NO: 2810607 - protein, 17 aa, Entamoeba invadens
FIIMCIIITFKVIEHKR

SEQ ID NO: 2810608 - protein, 17 aa, Entamoeba invadens
FIKEVSMLDKFRNEYIV

SEQ ID NO: 2810609 - protein, 24 aa, Entamoeba invadens
FIKGCTNCNRILYTSSSSSPTYSI

SEQ ID NO: 2810610 - protein, 18 aa, Entamoeba invadens
FILSCLTFFITGVLGLVV

SEQ ID NO: 2810611 - protein, 23 aa, Entamoeba invadens
FIPVCIAGILALIAYHIYILAIS

SEQ ID NO: 2810612 - protein, 21 aa, Entamoeba invadens
FISSLRLLYIISISYLYHIYI

SEQ ID NO: 2810613 - protein, 23 aa, Entamoeba invadens
FISVIYCPMLIFFLAITAHSQCQ

SEQ ID NO: 2810614 - protein, 26 aa, Entamoeba invadens
FIVLKVPFPLSYRFKLITQQGMGFLD

SEQ ID NO: 2810615 - protein, 28 aa, Entamoeba invadens
FIVSFSFCCLACWCVFMLQPTFECSVTT

SEQ ID NO: 2810616 - protein, 17 aa, Entamoeba invadens
FIYSKKAKICFFFFFLF

SEQ ID NO: 2810617 - protein, 17 aa, Entamoeba invadens
FKAICPHKCNADKGWGN

SEQ ID NO: 2810618 - protein, 17 aa, Entamoeba invadens
FKASDFFHLSVKPQLAD

SEQ ID NO: 2810619 - protein, 20 aa, Entamoeba invadens
FKCNRRPAVFQLKNPKNDLQ

SEQ ID NO: 2810620 - protein, 17 aa, Entamoeba invadens
FKDCLTCSPYGCLYCQR

SEQ ID NO: 2810621 - protein, 17 aa, Entamoeba invadens
FKETYYDGGFLIQDNGI

SEQ ID NO: 2810622 - protein, 20 aa, Entamoeba invadens
FKEWGWCYIFIVVLTLLIVI

SEQ ID NO: 2810623 - protein, 20 aa, Entamoeba invadens
FKFAPLPLFVGWYTILFTVF

SEQ ID NO: 2810624 - protein, 17 aa, Entamoeba invadens
FKFAWNIVDFVVSGKRL

SEQ ID NO: 2810625 - protein, 17 aa, Entamoeba invadens
FKFAWSIADFVASGKHL

SEQ ID NO: 2810626 - protein, 18 aa, Entamoeba invadens
FKFPWKIADFVNGGNRLQ

SEQ ID NO: 2810627 - protein, 17 aa, Entamoeba invadens
FKFPWKIAEFVIAGSRL

SEQ ID NO: 2810628 - protein, 19 aa, Entamoeba invadens
FKFPWKIAEFVICMKIYRC

SEQ ID NO: 2810629 - protein, 17 aa, Entamoeba invadens
FKFPWKIAEFVTSGQRP

SEQ ID NO: 2810630 - protein, 19 aa, Entamoeba invadens
FKFPWKIAEFVTSSKRLEK

SEQ ID NO: 2810631 - protein, 21 aa, Entamoeba invadens
FKFPWKIAEIISSGKRLKRID

SEQ ID NO: 2810632 - protein, 21 aa, Entamoeba invadens
FKFVLCSALRQLAYVTVAQTY

SEQ ID NO: 2810633 - protein, 23 aa, Entamoeba invadens
FKGDELKTGLGLLCILLKTRQTH

SEQ ID NO: 2810634 - protein, 17 aa, Entamoeba invadens
FKGLVEYIANVFGGIVM

SEQ ID NO: 2810635 - protein, 19 aa, Entamoeba invadens
FKIQIIRKFLKQIINSLEI

SEQ ID NO: 2810636 - protein, 27 aa, Entamoeba invadens
FKKNTKSGVWFKFFGKKGGNVTVETCG

SEQ ID NO: 2810637 - protein, 17 aa, Entamoeba invadens
FKLKGGICAETFDEDDK

SEQ ID NO: 2810638 - protein, 19 aa, Entamoeba invadens
FKLSWTEEARSFFVERLGE

SEQ ID NO: 2810639 - protein, 19 aa, Entamoeba invadens
FKLWFFRDNVRIHSGLIMK

SEQ ID NO: 2810640 - protein, 18 aa, Entamoeba invadens
FKMGISYLPTLPLNESDL

SEQ ID NO: 2810641 - protein, 17 aa, Entamoeba invadens
FKMKSGICAESFDEDDK

SEQ ID NO: 2810642 - protein, 27 aa, Entamoeba invadens
FKNCTCFLNDLYLPYGLTKIGYGAFQN

SEQ ID NO: 2810643 - protein, 20 aa, Entamoeba invadens
FKNWMPLSWSSGDVILVSSE

SEQ ID NO: 2810644 - protein, 17 aa, Entamoeba invadens
FKPPEGMLSLMDNKLLR

SEQ ID NO: 2810645 - protein, 17 aa, Entamoeba invadens
FKSDVPFLINFDNSCTT

SEQ ID NO: 2810646 - protein, 22 aa, Entamoeba invadens
FKSIVKSVLWGRCVFDNIRKFL

SEQ ID NO: 2810647 - protein, 17 aa, Entamoeba invadens
FKSIWAYFFGYWKDPNT

SEQ ID NO: 2810648 - protein, 22 aa, Entamoeba invadens
FKSKNLVCGIAFALPVLLAFTI

SEQ ID NO: 2810649 - protein, 17 aa, Entamoeba invadens
FKSSIYFARSVMNNIYA

SEQ ID NO: 2810650 - protein, 20 aa, Entamoeba invadens
FKTCLICSGGTFANAETNTC

SEQ ID NO: 2810651 - protein, 19 aa, Entamoeba invadens
FKVADGLFYNVETLQKITK

SEQ ID NO: 2810652 - protein, 17 aa, Entamoeba invadens
FKVVISLIVSLVIVSVG

SEQ ID NO: 2810653 - protein, 18 aa, Entamoeba invadens
FKYGEEWVEGIKPKSLLF

SEQ ID NO: 2810654 - protein, 20 aa, Entamoeba invadens
FKYKEIRVGVNLIDRRTFEN

SEQ ID NO: 2810655 - protein, 18 aa, Entamoeba invadens
FKYPWKIADFVNGGNRLQ

SEQ ID NO: 2810656 - protein, 17 aa, Entamoeba invadens
FKYPWKIAEFVCSGKRV

SEQ ID NO: 2810657 - protein, 19 aa, Entamoeba invadens
FLCEMSIVFLCLGSSKKLH

SEQ ID NO: 2810658 - protein, 19 aa, Entamoeba invadens
FLCFPRFFRLQSCVPCSKK

SEQ ID NO: 2810659 - protein, 19 aa, Entamoeba invadens
FLDEFSCLYAKLTKENRIF

SEQ ID NO: 2810660 - protein, 26 aa, Entamoeba invadens
FLDIRWRYKLILSFCASILVVVLYPG

SEQ ID NO: 2810661 - protein, 20 aa, Entamoeba invadens
FLDPNVFILLAFSDDCQVLD

SEQ ID NO: 2810662 - protein, 22 aa, Entamoeba invadens
FLEAPCGFARTMNRSAGDDFSD

SEQ ID NO: 2810663 - protein, 25 aa, Entamoeba invadens
FLEKECKGFESMLRLYTLVKETRAD

SEQ ID NO: 2810664 - protein, 23 aa, Entamoeba invadens
FLEKEFYLLLGIKICVTIFVGFA

SEQ ID NO: 2810665 - protein, 21 aa, Entamoeba invadens
FLETPFKFRIEKTVSIENNLP

SEQ ID NO: 2810666 - protein, 19 aa, Entamoeba invadens
FLFGVCYIGLYNSLIHADV

SEQ ID NO: 2810667 - protein, 17 aa, Entamoeba invadens
FLFVIACVVIILVLVLK

SEQ ID NO: 2810668 - protein, 17 aa, Entamoeba invadens
FLGIPLFPANSEYDLLL

SEQ ID NO: 2810669 - protein, 20 aa, Entamoeba invadens
FLGKEAFSFTLLKTVELPNS

SEQ ID NO: 2810670 - protein, 23 aa, Entamoeba invadens
FLHSRCFRVFILTSLLVFSVLYI

SEQ ID NO: 2810671 - protein, 17 aa, Entamoeba invadens
FLIFFLYFVCGAVVSLH

SEQ ID NO: 2810672 - protein, 20 aa, Entamoeba invadens
FLKVRFCQDVARGMEYLHEN

SEQ ID NO: 2810673 - protein, 23 aa, Entamoeba invadens
FLLLFPWLVAFIISRKTKNKAVN

SEQ ID NO: 2810674 - protein, 24 aa, Entamoeba invadens
FLLLFPWLVAFIISRKTKNKAVNV

SEQ ID NO: 2810675 - protein, 17 aa, Entamoeba invadens
FLLLILCCLVIFTPTYP

SEQ ID NO: 2810676 - protein, 18 aa, Entamoeba invadens
FLLRLTGDLSRVDFSNNI

SEQ ID NO: 2810677 - protein, 24 aa, Entamoeba invadens
FLNFGVCAIGWYLAAVFLNQDMDI

SEQ ID NO: 2810678 - protein, 22 aa, Entamoeba invadens
FLNKASQCGICYEAVGELGSVR

SEQ ID NO: 2810679 - protein, 18 aa, Entamoeba invadens
FLPLESLLSLSLCCKTLK

SEQ ID NO: 2810680 - protein, 20 aa, Entamoeba invadens
FLPVCIAGIIALISYNIYII

SEQ ID NO: 2810681 - protein, 23 aa, Entamoeba invadens
FLQLPFVFAFPWINAVVVYVLAF

SEQ ID NO: 2810682 - protein, 20 aa, Entamoeba invadens
FLSCEIGNFYAIENIKCGST

SEQ ID NO: 2810683 - protein, 20 aa, Entamoeba invadens
FLSERVRLFIRMILDSIEES

SEQ ID NO: 2810684 - protein, 20 aa, Entamoeba invadens
FLSMVLRVLMSFSFLLASAC

SEQ ID NO: 2810685 - protein, 21 aa, Entamoeba invadens
FLSVFCIILLLALLIGSAVLI

SEQ ID NO: 2810686 - protein, 19 aa, Entamoeba invadens
FLVAFDVFVFFALHIFHKE

SEQ ID NO: 2810687 - protein, 18 aa, Entamoeba invadens
FLVLCGSLSFIVTCLLKY

SEQ ID NO: 2810688 - protein, 18 aa, Entamoeba invadens
FLVPCLYQLMSIKMFHSL

SEQ ID NO: 2810689 - protein, 19 aa, Entamoeba invadens
FLVSLCFGSNMGFERPVTT

SEQ ID NO: 2810690 - protein, 23 aa, Entamoeba invadens
FLVYLLCIWAFYFIDSELTGMSI

SEQ ID NO: 2810691 - protein, 17 aa, Entamoeba invadens
FLYFEHRWGILIFCATY

SEQ ID NO: 2810692 - protein, 17 aa, Entamoeba invadens
FMLISICSLLFAIGDTL

SEQ ID NO: 2810693 - protein, 18 aa, Entamoeba invadens
FMLLKWIRDPLLVSGGLE

SEQ ID NO: 2810694 - protein, 19 aa, Entamoeba invadens
FMVVFKYHKQIVLIVVTVM

SEQ ID NO: 2810695 - protein, 22 aa, Entamoeba invadens
FMYDIAFSLGFFFNSVLSKKSS

SEQ ID NO: 2810696 - protein, 18 aa, Entamoeba invadens
FMYFHFGSGFPMPSHLIM

SEQ ID NO: 2810697 - protein, 22 aa, Entamoeba invadens
FNAPRPWEWFTMSSWRCAGADS

SEQ ID NO: 2810698 - protein, 17 aa, Entamoeba invadens
FNCSTLKLTNVIGNISS

SEQ ID NO: 2810699 - protein, 25 aa, Entamoeba invadens
FNDKICTEFTYKLPRGVVVSASALC

SEQ ID NO: 2810700 - protein, 25 aa, Entamoeba invadens
FNEVLKFIICLVMLKFVHHKENLFF

SEQ ID NO: 2810701 - protein, 18 aa, Entamoeba invadens
FNFRFPAIRAKNCYYVVD

SEQ ID NO: 2810702 - protein, 17 aa, Entamoeba invadens
FNGKLWPPGFMSFFTMA

SEQ ID NO: 2810703 - protein, 20 aa, Entamoeba invadens
FNLGCLFYFIALKRHPFGEL

SEQ ID NO: 2810704 - protein, 17 aa, Entamoeba invadens
FNLLLSFFDLLIISIEI

SEQ ID NO: 2810705 - protein, 18 aa, Entamoeba invadens
FNLNCRKCSLNGEETIST

SEQ ID NO: 2810706 - protein, 18 aa, Entamoeba invadens
FNSLHVVKPISFGPNIKV

SEQ ID NO: 2810707 - protein, 23 aa, Entamoeba invadens
FNYRPQLFNSFFFRFERGQNGIG

SEQ ID NO: 2810708 - protein, 19 aa, Entamoeba invadens
FPADCGRCKYGYNCTAQGK

SEQ ID NO: 2810709 - protein, 21 aa, Entamoeba invadens
FPCKCRKCTKQALPNWKKPMT

SEQ ID NO: 2810710 - protein, 21 aa, Entamoeba invadens
FPFFCFMAFGFIDFFASLFLP

SEQ ID NO: 2810711 - protein, 17 aa, Entamoeba invadens
FPGTFSKSGASSCTQCY

SEQ ID NO: 2810712 - protein, 24 aa, Entamoeba invadens
FPIKRFKRRFFIVIGSIIAIILLP

SEQ ID NO: 2810713 - protein, 25 aa, Entamoeba invadens
FPIKRFKRRFFIVIGSIIAIILLPF

SEQ ID NO: 2810714 - protein, 22 aa, Entamoeba invadens
FPILGLMRKWLKTIYEGGYDNK

SEQ ID NO: 2810715 - protein, 19 aa, Entamoeba invadens
FPITLKWKSIDVINIDTTP

SEQ ID NO: 2810716 - protein, 25 aa, Entamoeba invadens
FPKEKFRFPWSIADFISAGKRFDRP

SEQ ID NO: 2810717 - protein, 22 aa, Entamoeba invadens
FPKHIIPFVFSWPSCSNPFLYC

SEQ ID NO: 2810718 - protein, 21 aa, Entamoeba invadens
FPKKRGELVIGNLLQATPVVT

SEQ ID NO: 2810719 - protein, 20 aa, Entamoeba invadens
FPLIITHSFLFSQWINLNST

SEQ ID NO: 2810720 - protein, 19 aa, Entamoeba invadens
FPLLFRVLFHLIKDNYLVE

SEQ ID NO: 2810721 - protein, 21 aa, Entamoeba invadens
FPLMFSTGASVSWPEGTIKIV

SEQ ID NO: 2810722 - protein, 17 aa, Entamoeba invadens
FPMYMIAVIVIFILILA

SEQ ID NO: 2810723 - protein, 18 aa, Entamoeba invadens
FPSGIDLVGYVLKREVKD

SEQ ID NO: 2810724 - protein, 20 aa, Entamoeba invadens
FPSTYPSAGILIIRNGITQS

SEQ ID NO: 2810725 - protein, 17 aa, Entamoeba invadens
FPWKIAEFVTLGKRLQK

SEQ ID NO: 2810726 - protein, 26 aa, Entamoeba invadens
FQCRGRFAIQYIKAWIEYIVKNEKDV

SEQ ID NO: 2810727 - protein, 18 aa, Entamoeba invadens
FQFPWKVAEFVSGGRRLA

SEQ ID NO: 2810728 - protein, 17 aa, Entamoeba invadens
FQFPWNIAEFVAKGNRR

SEQ ID NO: 2810729 - protein, 19 aa, Entamoeba invadens
FQILGKYIHEWGYDKSLQN

SEQ ID NO: 2810730 - protein, 22 aa, Entamoeba invadens
FQMKRSNIHFVFLQNGICVSSK

SEQ ID NO: 2810731 - protein, 31 aa, Entamoeba invadens
FQNLLILSAFCWCCFRIFDILFSFFFLLYTI

SEQ ID NO: 2810732 - protein, 17 aa, Entamoeba invadens
FQPKCSFSTQILFKTVV

SEQ ID NO: 2810733 - protein, 28 aa, Entamoeba invadens
FQSWLYHACEVFYAWSCIDVFVISVIAA

SEQ ID NO: 2810734 - protein, 18 aa, Entamoeba invadens
FRCLLKLYQQICCSVYFW

SEQ ID NO: 2810735 - protein, 17 aa, Entamoeba invadens
FRILAPFLVDKNVPEEV

SEQ ID NO: 2810736 - protein, 18 aa, Entamoeba invadens
FRKEVAMLAKFVSPYVIR

SEQ ID NO: 2810737 - protein, 17 aa, Entamoeba invadens
FRLKKAYPIDTFKFPWK

SEQ ID NO: 2810738 - protein, 17 aa, Entamoeba invadens
FRPDRICFSSSGNTLLS

SEQ ID NO: 2810739 - protein, 20 aa, Entamoeba invadens
FRPEEVTAFLVQRLLAKLEE

SEQ ID NO: 2810740 - protein, 19 aa, Entamoeba invadens
FRRRCYECNKGYYPSQYTE

SEQ ID NO: 2810741 - protein, 17 aa, Entamoeba invadens
FRSRFSFSLPHRSKKPA

SEQ ID NO: 2810742 - protein, 17 aa, Entamoeba invadens
FRVEWKHLLLCYGCLLF

SEQ ID NO: 2810743 - protein, 21 aa, Entamoeba invadens
FRYLEFENVLLFKFFERYLYC

SEQ ID NO: 2810744 - protein, 17 aa, Entamoeba invadens
FRYRKGLQVVLKNVSTT

SEQ ID NO: 2810745 - protein, 19 aa, Entamoeba invadens
FRYSVVGKYVYPVIFHNQF

SEQ ID NO: 2810746 - protein, 25 aa, Entamoeba invadens
FSDEGFRPIVLIKRGLSGLPLKTPK

SEQ ID NO: 2810747 - protein, 20 aa, Entamoeba invadens
FSDNCILCLTDEKLININGK

SEQ ID NO: 2810748 - protein, 17 aa, Entamoeba invadens
FSESASICLSTGERSEF

SEQ ID NO: 2810749 - protein, 19 aa, Entamoeba invadens
FSFLCCAGIGMLGTCLYSI

SEQ ID NO: 2810750 - protein, 19 aa, Entamoeba invadens
FSFSSIVAFVDAFNKKNVA

SEQ ID NO: 2810751 - protein, 24 aa, Entamoeba invadens
FSITMFECFGWREAYPTAQFKYSW

SEQ ID NO: 2810752 - protein, 24 aa, Entamoeba invadens
FSLEALLFCFNKFFMDYISRSSDS

SEQ ID NO: 2810753 - protein, 21 aa, Entamoeba invadens
FSLFCVLCFFIILGYYLDGKL

SEQ ID NO: 2810754 - protein, 17 aa, Entamoeba invadens
FSLGCKYCPPHTFRRNH

SEQ ID NO: 2810755 - protein, 25 aa, Entamoeba invadens
FSNRCLKCLTGFLLRDGLCVSDATC

SEQ ID NO: 2810756 - protein, 20 aa, Entamoeba invadens
FSNTVSFVFGTSIGSKISIG

SEQ ID NO: 2810757 - protein, 17 aa, Entamoeba invadens
FSPAVNWFFKFALQTIC

SEQ ID NO: 2810758 - protein, 19 aa, Entamoeba invadens
FSRKCKVCAIGFYPDDASG

SEQ ID NO: 2810759 - protein, 20 aa, Entamoeba invadens
FSRKCKVCAIGFYPDETSGK

SEQ ID NO: 2810760 - protein, 19 aa, Entamoeba invadens
FSRKCKVCVIGFYPDDASG

SEQ ID NO: 2810761 - protein, 23 aa, Entamoeba invadens
FSRKCLICNTGFYPNDSGKCVSC

SEQ ID NO: 2810762 - protein, 23 aa, Entamoeba invadens
FSRKCLICNTGFYPNNSGKCVSC

SEQ ID NO: 2810763 - protein, 20 aa, Entamoeba invadens
FSRKCVICSAGYYVDTSNNK

SEQ ID NO: 2810764 - protein, 17 aa, Entamoeba invadens
FSSFLAILCILYTMFTI

SEQ ID NO: 2810765 - protein, 25 aa, Entamoeba invadens
FSVGLKIKICFDVAKGMKYLHSNNI

SEQ ID NO: 2810766 - protein, 24 aa, Entamoeba invadens
FSVKEMLEIFGFRNCISLLPYNKR

SEQ ID NO: 2810767 - protein, 18 aa, Entamoeba invadens
FSVLCGMVSILVGQIALF

SEQ ID NO: 2810768 - protein, 18 aa, Entamoeba invadens
FSYPWKIADFISAGSRPS

SEQ ID NO: 2810769 - protein, 29 aa, Entamoeba invadens
FTESRFVIRASNCYLELKGKTQVSADTSV

SEQ ID NO: 2810770 - protein, 17 aa, Entamoeba invadens
FTFEWSLLYIIDTANHT

SEQ ID NO: 2810771 - protein, 18 aa, Entamoeba invadens
FTFNFKVDYNWMKKTIGV

SEQ ID NO: 2810772 - protein, 23 aa, Entamoeba invadens
FTICYLCFSLFYNRHVHFDFYVG

SEQ ID NO: 2810773 - protein, 17 aa, Entamoeba invadens
FTKCLPCSAGTYRDENL

SEQ ID NO: 2810774 - protein, 22 aa, Entamoeba invadens
FTKMELTGNFALNLKVLVIYST

SEQ ID NO: 2810775 - protein, 19 aa, Entamoeba invadens
FTKMELTGNFTLNLKVLVI

SEQ ID NO: 2810776 - protein, 18 aa, Entamoeba invadens
FTLTLLWLDVELTSTSIN

SEQ ID NO: 2810777 - protein, 17 aa, Entamoeba invadens
FTLYGYIGKVFVTTSTA

SEQ ID NO: 2810778 - protein, 18 aa, Entamoeba invadens
FTMLRINPFYSHKTLEQE

SEQ ID NO: 2810779 - protein, 18 aa, Entamoeba invadens
FTNLFAFSGFVPIGSYII

SEQ ID NO: 2810780 - protein, 20 aa, Entamoeba invadens
FTPNVKFIFQFIKTEVEKKY

SEQ ID NO: 2810781 - protein, 20 aa, Entamoeba invadens
FTPYCYVHFFLNKSVTENMG

SEQ ID NO: 2810782 - protein, 22 aa, Entamoeba invadens
FTRKCVICVSGYFVFENRCKKC

SEQ ID NO: 2810783 - protein, 18 aa, Entamoeba invadens
FTSFCFQLSIKWTFVLSL

SEQ ID NO: 2810784 - protein, 18 aa, Entamoeba invadens
FTSLLSIWITFLYIVIVC

SEQ ID NO: 2810785 - protein, 17 aa, Entamoeba invadens
FTTLRGGVVVNMTEINF

SEQ ID NO: 2810786 - protein, 17 aa, Entamoeba invadens
FTVCYYILYYKTISVEV

SEQ ID NO: 2810787 - protein, 20 aa, Entamoeba invadens
FVCKLQCLFTSNSFLQLSSS

SEQ ID NO: 2810788 - protein, 17 aa, Entamoeba invadens
FVDCPYKTFPTAIITQI

SEQ ID NO: 2810789 - protein, 18 aa, Entamoeba invadens
FVDFKFRYRRGLPVVLNK

SEQ ID NO: 2810790 - protein, 19 aa, Entamoeba invadens
FVDKLLFVMFCIWTVYFLY

SEQ ID NO: 2810791 - protein, 20 aa, Entamoeba invadens
FVFFCSIGYLLISYFVTLPM

SEQ ID NO: 2810792 - protein, 19 aa, Entamoeba invadens
FVFKFKMYIFYSLNEIKKL

SEQ ID NO: 2810793 - protein, 18 aa, Entamoeba invadens
FVFPRYLSIFSIAVFLST

SEQ ID NO: 2810794 - protein, 18 aa, Entamoeba invadens
FVGLKHKLFLVGTARLIY

SEQ ID NO: 2810795 - protein, 21 aa, Entamoeba invadens
FVICGCFLFTIVLWVFVICNK

SEQ ID NO: 2810796 - protein, 17 aa, Entamoeba invadens
FVIPWLVGFIISRKTTN

SEQ ID NO: 2810797 - protein, 17 aa, Entamoeba invadens
FVITLVCSKIRLLMLRV

SEQ ID NO: 2810798 - protein, 19 aa, Entamoeba invadens
FVLAAICFWMSHQFSPNGS

SEQ ID NO: 2810799 - protein, 17 aa, Entamoeba invadens
FVLTCCMVCMSLYYVKL

SEQ ID NO: 2810800 - protein, 17 aa, Entamoeba invadens
FVMFCIWTVYFLYDHIY

SEQ ID NO: 2810801 - protein, 18 aa, Entamoeba invadens
FVNEPKFEVTLCVGCFYA

SEQ ID NO: 2810802 - protein, 18 aa, Entamoeba invadens
FVRKCIKCVAGSYPQTAG

SEQ ID NO: 2810803 - protein, 17 aa, Entamoeba invadens
FVSDVLVCFAVMIYENK

SEQ ID NO: 2810804 - protein, 23 aa, Entamoeba invadens
FVSEIIVALPLYYSHFAVEGNDR

SEQ ID NO: 2810805 - protein, 21 aa, Entamoeba invadens
FVSRCGWGNMYLYETVLDLLI

SEQ ID NO: 2810806 - protein, 22 aa, Entamoeba invadens
FVWDIICLFAILLHVSMMRSNG

SEQ ID NO: 2810807 - protein, 21 aa, Entamoeba invadens
FVYEIRTILDWTFAKTSMFYK

SEQ ID NO: 2810808 - protein, 21 aa, Entamoeba invadens
FVYEIRTILDWVFANTSMFYK

SEQ ID NO: 2810809 - protein, 17 aa, Entamoeba invadens
FVYRKARINYHFIFDMN

SEQ ID NO: 2810810 - protein, 17 aa, Entamoeba invadens
FWLIFHFFLFQLFIFSE

SEQ ID NO: 2810811 - protein, 17 aa, Entamoeba invadens
FWLIFNFFLFQLFIFSK

SEQ ID NO: 2810812 - protein, 18 aa, Entamoeba invadens
FWLLCIFQKKLLTTKQIF

SEQ ID NO: 2810813 - protein, 18 aa, Entamoeba invadens
FWSYLKWFLLGIFQALVF

SEQ ID NO: 2810814 - protein, 19 aa, Entamoeba invadens
FWTAWEIFKQTYFCIHLIT

SEQ ID NO: 2810815 - protein, 18 aa, Entamoeba invadens
FWTLWMIFGMLNFLLFLL

SEQ ID NO: 2810816 - protein, 19 aa, Entamoeba invadens
FYFRCMKIIVGWLLLSVIL

SEQ ID NO: 2810817 - protein, 17 aa, Entamoeba invadens
FYGVSAWAYLNGNHKIK

SEQ ID NO: 2810818 - protein, 18 aa, Entamoeba invadens
FYKFAAVYIRAYKMSPDK

SEQ ID NO: 2810819 - protein, 17 aa, Entamoeba invadens
FYLDESFNFLKETDDES

SEQ ID NO: 2810820 - protein, 17 aa, Entamoeba invadens
FYLDNGICLFCQFCSSC

SEQ ID NO: 2810821 - protein, 23 aa, Entamoeba invadens
FYVFYKRIVVAPSIFIALSMLSV

SEQ ID NO: 2810822 - protein, 17 aa, Entamoeba invadens
FYVPRALLCGLLFVFIL

SEQ ID NO: 2810823 - protein, 19 aa, Entamoeba invadens
FYVYSGEEWHEWFISSIED

SEQ ID NO: 2810824 - protein, 19 aa, Entamoeba invadens
FYYDWKVNFGIIQKESNGN

SEQ ID NO: 2810825 - protein, 27 aa, Entamoeba invadens
GAFCKCYKCVIPIFPCALVFGSFAIMM

SEQ ID NO: 2810826 - protein, 24 aa, Entamoeba invadens
GAFECSKCPLGFYSDAVGSKTCKK

SEQ ID NO: 2810827 - protein, 18 aa, Entamoeba invadens
GCAICKVGYFKVEKDCDA

SEQ ID NO: 2810828 - protein, 18 aa, Entamoeba invadens
GCAICKVGYYKVEKDCNE

SEQ ID NO: 2810829 - protein, 18 aa, Entamoeba invadens
GCAICKVGYYYVSKDCRQ

SEQ ID NO: 2810830 - protein, 20 aa, Entamoeba invadens
GCFLCGIIPLFVSPRTPKED

SEQ ID NO: 2810831 - protein, 20 aa, Entamoeba invadens
GCGGSMWIICPTGVKRSNYV

SEQ ID NO: 2810832 - protein, 21 aa, Entamoeba invadens
GCGGSMWIICPTGVKRSNYVC

SEQ ID NO: 2810833 - protein, 19 aa, Entamoeba invadens
GCIICATGYYLDENNCEKC

SEQ ID NO: 2810834 - protein, 20 aa, Entamoeba invadens
GCIRCVDGLFLDNNNICQNC

SEQ ID NO: 2810835 - protein, 18 aa, Entamoeba invadens
GCKATYGTGCFVVKNAGK

SEQ ID NO: 2810836 - protein, 18 aa, Entamoeba invadens
GCKSCLNGYVSNFGSSEC

SEQ ID NO: 2810837 - protein, 21 aa, Entamoeba invadens
GCLQCSIGYYLYHKECYRCDD

SEQ ID NO: 2810838 - protein, 22 aa, Entamoeba invadens
GCLRCLKSYYLVDLTCKPCSSN

SEQ ID NO: 2810839 - protein, 23 aa, Entamoeba invadens
GCQKCTKSGCTLCENNSSLILNG

SEQ ID NO: 2810840 - protein, 17 aa, Entamoeba invadens
GCQRCPFGYFLNKNGCE

SEQ ID NO: 2810841 - protein, 17 aa, Entamoeba invadens
GCRVCYLSLVGQMSECD

SEQ ID NO: 2810842 - protein, 17 aa, Entamoeba invadens
GCSFWYEVGQDFTSCET

SEQ ID NO: 2810843 - protein, 18 aa, Entamoeba invadens
GCTFCSPGFFLQFSECQK

SEQ ID NO: 2810844 - protein, 19 aa, Entamoeba invadens
GCTLLEHISDFSVITSFGQ

SEQ ID NO: 2810845 - protein, 17 aa, Entamoeba invadens
GCYAMYCGCVFNEFFGF

SEQ ID NO: 2810846 - protein, 25 aa, Entamoeba invadens
GDAECSACIPGYVLLGNKTCQTTED

SEQ ID NO: 2810847 - protein, 17 aa, Entamoeba invadens
GDAYPICSIKERTTLSK

SEQ ID NO: 2810848 - protein, 20 aa, Entamoeba invadens
GDFPNVISIPSFYQPKQIET

SEQ ID NO: 2810849 - protein, 22 aa, Entamoeba invadens
GDFVPRLSVDFVNIENYLETPW

SEQ ID NO: 2810850 - protein, 21 aa, Entamoeba invadens
GDPRLKFLIQLMASSVSGRMM

SEQ ID NO: 2810851 - protein, 25 aa, Entamoeba invadens
GDQKDCACGYAFCTTAVMEVRALTD

SEQ ID NO: 2810852 - protein, 21 aa, Entamoeba invadens
GDSRLAKFLIENGINREIQDS

SEQ ID NO: 2810853 - protein, 24 aa, Entamoeba invadens
GDSVWKCKACGLTVSGEKCILCGS

SEQ ID NO: 2810854 - protein, 18 aa, Entamoeba invadens
GDVAQFAWYYGQVSPCGI

SEQ ID NO: 2810855 - protein, 19 aa, Entamoeba invadens
GDVVFVLKIGVDTVGNIEA

SEQ ID NO: 2810856 - protein, 21 aa, Entamoeba invadens
GDYLHHIKFLWSHTDQSSSYP

SEQ ID NO: 2810857 - protein, 18 aa, Entamoeba invadens
GEACEFEILLTLKCTTKV

SEQ ID NO: 2810858 - protein, 18 aa, Entamoeba invadens
GEACEFEILLTLKCTTRM

SEQ ID NO: 2810859 - protein, 18 aa, Entamoeba invadens
GEACEFEILLTLNCTTKI

SEQ ID NO: 2810860 - protein, 18 aa, Entamoeba invadens
GEACEFEILLTLNCTTNI

SEQ ID NO: 2810861 - protein, 17 aa, Entamoeba invadens
GEECKMCDPTLGCTTCN

SEQ ID NO: 2810862 - protein, 24 aa, Entamoeba invadens
GEEIRLQWYLGMIVVICGVTLLLV

SEQ ID NO: 2810863 - protein, 19 aa, Entamoeba invadens
GEERLCIYPTIGFEDRIEL

SEQ ID NO: 2810864 - protein, 18 aa, Entamoeba invadens
GEEWHEWFISSIEDLPLI

SEQ ID NO: 2810865 - protein, 21 aa, Entamoeba invadens
GEGLRKVAACGGFVVTDMPDG

SEQ ID NO: 2810866 - protein, 17 aa, Entamoeba invadens
GEGYTPCRLDFIGGKSI

SEQ ID NO: 2810867 - protein, 22 aa, Entamoeba invadens
GEIFRLPSFTYKRIDTHDSSTD

SEQ ID NO: 2810868 - protein, 22 aa, Entamoeba invadens
GESGEIFIECPFYVKNLTKTPK

SEQ ID NO: 2810869 - protein, 20 aa, Entamoeba invadens
GESSLKCTLEKSSVFSQVQK

SEQ ID NO: 2810870 - protein, 17 aa, Entamoeba invadens
GETFSVEFPLTFETEVS

SEQ ID NO: 2810871 - protein, 20 aa, Entamoeba invadens
GEVFMEWVGMFLIRKVITTK

SEQ ID NO: 2810872 - protein, 20 aa, Entamoeba invadens
GEWTSGIGFLYGIICTICVF

SEQ ID NO: 2810873 - protein, 18 aa, Entamoeba invadens
GFACEFSWYLTPLCTCQI

SEQ ID NO: 2810874 - protein, 25 aa, Entamoeba invadens
GFALGIAFYFDWRVSACVLAATPIF

SEQ ID NO: 2810875 - protein, 17 aa, Entamoeba invadens
GFFCFPMVDYIFFGETS

SEQ ID NO: 2810876 - protein, 24 aa, Entamoeba invadens
GFFFSRLGYYISFALVSYTYYYWC

SEQ ID NO: 2810877 - protein, 18 aa, Entamoeba invadens
GFIECWDLTLVILSSLPF

SEQ ID NO: 2810878 - protein, 20 aa, Entamoeba invadens
GFIFPCFWLINGCMCCCSRV

SEQ ID NO: 2810879 - protein, 25 aa, Entamoeba invadens
GFIGRDCHRSCWYNNKWVYGDGVGM

SEQ ID NO: 2810880 - protein, 17 aa, Entamoeba invadens
GFLDFFKKFLVDYKSNE

SEQ ID NO: 2810881 - protein, 19 aa, Entamoeba invadens
GFLILLPFCCFIYKFKWTL

SEQ ID NO: 2810882 - protein, 24 aa, Entamoeba invadens
GFLLCCLWIMGYCRYRKSPDAQAR

SEQ ID NO: 2810883 - protein, 22 aa, Entamoeba invadens
GFLLCCLWLVDYCKYRNSKDVQ

SEQ ID NO: 2810884 - protein, 18 aa, Entamoeba invadens
GFLLMMLYYLGCYITLLK

SEQ ID NO: 2810885 - protein, 25 aa, Entamoeba invadens
GFMKRMYRKPFDWIEEKAMSFADTI

SEQ ID NO: 2810886 - protein, 18 aa, Entamoeba invadens
GFPFIMHLLMLYKFSAEL

SEQ ID NO: 2810887 - protein, 24 aa, Entamoeba invadens
GFVNWLCMWGCLVLATLIAQGMFY

SEQ ID NO: 2810888 - protein, 24 aa, Entamoeba invadens
GFWIGRIMFFIAFFIVILVTLLYN

SEQ ID NO: 2810889 - protein, 19 aa, Entamoeba invadens
GFWTPTFVKLNRVFESTDT

SEQ ID NO: 2810890 - protein, 20 aa, Entamoeba invadens
GGCAICKVGYFKAEKDCDVC

SEQ ID NO: 2810891 - protein, 19 aa, Entamoeba invadens
GGCAICKVGYYKVEKDCDA

SEQ ID NO: 2810892 - protein, 22 aa, Entamoeba invadens
GGCVICADKYYRSGFECFECSS

SEQ ID NO: 2810893 - protein, 24 aa, Entamoeba invadens
GGCVICADKYYRSGFECFKCSSKC

SEQ ID NO: 2810894 - protein, 21 aa, Entamoeba invadens
GGCVICKRGYYRVGLDCYDCD

SEQ ID NO: 2810895 - protein, 18 aa, Entamoeba invadens
GGESLGWFYGANYLAHRV

SEQ ID NO: 2810896 - protein, 17 aa, Entamoeba invadens
GGFTLIVDEKWLKNNTK

SEQ ID NO: 2810897 - protein, 17 aa, Entamoeba invadens
GGLRKEWLRVIAESMFN

SEQ ID NO: 2810898 - protein, 18 aa, Entamoeba invadens
GGMFLLKCFSAIQVLFSA

SEQ ID NO: 2810899 - protein, 21 aa, Entamoeba invadens
GGQGCKDCKCLPNYRVKRGKG

SEQ ID NO: 2810900 - protein, 19 aa, Entamoeba invadens
GHCTALLCDGCKTGAYKDN

SEQ ID NO: 2810901 - protein, 18 aa, Entamoeba invadens
GHIPRLDAPIVHQDDVVK

SEQ ID NO: 2810902 - protein, 17 aa, Entamoeba invadens
GHLDALWLWVNGSEEKW

SEQ ID NO: 2810903 - protein, 18 aa, Entamoeba invadens
GHPKEIWISHSIKEALKI

SEQ ID NO: 2810904 - protein, 19 aa, Entamoeba invadens
GIFFCCVFIAMAAFLENIN

SEQ ID NO: 2810905 - protein, 17 aa, Entamoeba invadens
GIFKSLLPFISQFDQVF

SEQ ID NO: 2810906 - protein, 17 aa, Entamoeba invadens
GIFQISGGLTKFSDFYM

SEQ ID NO: 2810907 - protein, 20 aa, Entamoeba invadens
GIGCAICKMGYYKTEKDCNE

SEQ ID NO: 2810908 - protein, 18 aa, Entamoeba invadens
GIKFGFRFEFSIIVLALY

SEQ ID NO: 2810909 - protein, 17 aa, Entamoeba invadens
GILCGVMKMVVFLDYSK

SEQ ID NO: 2810910 - protein, 17 aa, Entamoeba invadens
GILLCKLTVPFDLFYGS

SEQ ID NO: 2810911 - protein, 23 aa, Entamoeba invadens
GIPAEVWRYYLLMNRPEQSDTIF

SEQ ID NO: 2810912 - protein, 17 aa, Entamoeba invadens
GIVWGISDNGVLNSAQD

SEQ ID NO: 2810913 - protein, 18 aa, Entamoeba invadens
GIVYRAEWRRVDVAVKVM

SEQ ID NO: 2810914 - protein, 20 aa, Entamoeba invadens
GKAIPGYVAAIVVDKIEKQE

SEQ ID NO: 2810915 - protein, 20 aa, Entamoeba invadens
GKARCNLCISPYVLNDTKCE

SEQ ID NO: 2810916 - protein, 20 aa, Entamoeba invadens
GKARCNLCISPYVLNGAKCG

SEQ ID NO: 2810917 - protein, 20 aa, Entamoeba invadens
GKARCNLCISPYVLNGTKCG

SEQ ID NO: 2810918 - protein, 17 aa, Entamoeba invadens
GKCLTCYKGYYIENEEC

SEQ ID NO: 2810919 - protein, 18 aa, Entamoeba invadens
GKCLTCYKGYYIENEECV

SEQ ID NO: 2810920 - protein, 19 aa, Entamoeba invadens
GKCQLCPSGKYYNLNSKSC

SEQ ID NO: 2810921 - protein, 17 aa, Entamoeba invadens
GKCTFEFTQCTLTPTQK

SEQ ID NO: 2810922 - protein, 17 aa, Entamoeba invadens
GKCVACFTIPNCNACSS

SEQ ID NO: 2810923 - protein, 21 aa, Entamoeba invadens
GKCVLCSPGYYSNEENLTECK

SEQ ID NO: 2810924 - protein, 17 aa, Entamoeba invadens
GKCYFDFSFCYYPQKYR

SEQ ID NO: 2810925 - protein, 17 aa, Entamoeba invadens
GKCYSCMNGYYLFNESC

SEQ ID NO: 2810926 - protein, 20 aa, Entamoeba invadens
GKEGCIEWICKRGFIPTLLK

SEQ ID NO: 2810927 - protein, 20 aa, Entamoeba invadens
GKEKVSLCYIEYCTFLMDVM

SEQ ID NO: 2810928 - protein, 17 aa, Entamoeba invadens
GKFDFCLPIPPSLYPNC

SEQ ID NO: 2810929 - protein, 18 aa, Entamoeba invadens
GKFLWNSKVSRLFLAKED

SEQ ID NO: 2810930 - protein, 18 aa, Entamoeba invadens
GKHGVLVKFVLRKELDQM

SEQ ID NO: 2810931 - protein, 18 aa, Entamoeba invadens
GKLAWCFFDSNSGEIEET

SEQ ID NO: 2810932 - protein, 17 aa, Entamoeba invadens
GKLKEGFDVVGIPDYPV

SEQ ID NO: 2810933 - protein, 27 aa, Entamoeba invadens
GKLRLPLDFIQRILLHISRNVSQISQF

SEQ ID NO: 2810934 - protein, 19 aa, Entamoeba invadens
GKMLNEYFELIYITFYVWG

SEQ ID NO: 2810935 - protein, 20 aa, Entamoeba invadens
GKVFSGYVAAIVVDKIEKQE

SEQ ID NO: 2810936 - protein, 22 aa, Entamoeba invadens
GKWECKDGFVLRDNVCTQCGNG

SEQ ID NO: 2810937 - protein, 17 aa, Entamoeba invadens
GKYIHEWGYDKSLQNVR

SEQ ID NO: 2810938 - protein, 19 aa, Entamoeba invadens
GLCRIQFIGVLGFSPNFIL

SEQ ID NO: 2810939 - protein, 17 aa, Entamoeba invadens
GLCYLYFMYTFTRKDRD

SEQ ID NO: 2810940 - protein, 20 aa, Entamoeba invadens
GLESFPLFIGVSYIEISSYI

SEQ ID NO: 2810941 - protein, 19 aa, Entamoeba invadens
GLFAFVAGCIFFRNHESPK

SEQ ID NO: 2810942 - protein, 18 aa, Entamoeba invadens
GLFFKELWNNSAVSEKER

SEQ ID NO: 2810943 - protein, 19 aa, Entamoeba invadens
GLFGRIFGDICAWISGLLY

SEQ ID NO: 2810944 - protein, 19 aa, Entamoeba invadens
GLILLCGTLVIRCVLCGMF

SEQ ID NO: 2810945 - protein, 25 aa, Entamoeba invadens
GLLFEGLSSFILFLLYGWVFVLLLF

SEQ ID NO: 2810946 - protein, 23 aa, Entamoeba invadens
GLSECLGCLAGFYSLKNASSCTP

SEQ ID NO: 2810947 - protein, 24 aa, Entamoeba invadens
GLSVKRWSFYLAVGFVLSFVLSIV

SEQ ID NO: 2810948 - protein, 18 aa, Entamoeba invadens
GMCKKCLFGDKTTDYQIC

SEQ ID NO: 2810949 - protein, 21 aa, Entamoeba invadens
GMLKISYFETFNWNYNYNETI

SEQ ID NO: 2810950 - protein, 22 aa, Entamoeba invadens
GMLYWCNFHVIFFVDRVIVEHS

SEQ ID NO: 2810951 - protein, 29 aa, Entamoeba invadens
GMVKAELAPLCMFCGMQLIGFADVQSVKY

SEQ ID NO: 2810952 - protein, 19 aa, Entamoeba invadens
GMVVYCIRWKSDIPIPQEL

SEQ ID NO: 2810953 - protein, 23 aa, Entamoeba invadens
GMYEYRHILCIIQSLKRVLNLNP

SEQ ID NO: 2810954 - protein, 25 aa, Entamoeba invadens
GMYYDWRLGLCSLAIFPILVFFMYM

SEQ ID NO: 2810955 - protein, 21 aa, Entamoeba invadens
GNARCSFCYSPYVPNVAGNCI

SEQ ID NO: 2810956 - protein, 18 aa, Entamoeba invadens
GNCTSCLTGYFLNSNSNK

SEQ ID NO: 2810957 - protein, 18 aa, Entamoeba invadens
GNDCLLCDAGYLLVQQNG

SEQ ID NO: 2810958 - protein, 18 aa, Entamoeba invadens
GNEAKSWDRKGCACDGEF

SEQ ID NO: 2810959 - protein, 17 aa, Entamoeba invadens
GNFKVADGLFYNVETLQ

SEQ ID NO: 2810960 - protein, 17 aa, Entamoeba invadens
GNFYFKGGISIETASLK

SEQ ID NO: 2810961 - protein, 17 aa, Entamoeba invadens
GNLKGRHTVIISIVSEM

SEQ ID NO: 2810962 - protein, 17 aa, Entamoeba invadens
GNNCLYEAIGIGSTLLS

SEQ ID NO: 2810963 - protein, 24 aa, Entamoeba invadens
GNQCKSCSMEFCNYCNSTFCYQCG

SEQ ID NO: 2810964 - protein, 29 aa, Entamoeba invadens
GNTNRFEKVYSFRGNSSYGYRGYSVGMDD

SEQ ID NO: 2810965 - protein, 22 aa, Entamoeba invadens
GNWKVMIFFVIFTTCLSLLYFV

SEQ ID NO: 2810966 - protein, 17 aa, Entamoeba invadens
GPYIVSFVGACYLPTKM

SEQ ID NO: 2810967 - protein, 19 aa, Entamoeba invadens
GQQGRWEKYYVFKVNRDMS

SEQ ID NO: 2810968 - protein, 23 aa, Entamoeba invadens
GQTHCVSCAHLTPNCKYCDTASC

SEQ ID NO: 2810969 - protein, 18 aa, Entamoeba invadens
GRFSYSFKLKVMKDVQCG

SEQ ID NO: 2810970 - protein, 19 aa, Entamoeba invadens
GRFSYSFKLKVMKDVQCGL

SEQ ID NO: 2810971 - protein, 18 aa, Entamoeba invadens
GRGKCSWTEKKCICSPKY

SEQ ID NO: 2810972 - protein, 18 aa, Entamoeba invadens
GRHAPQIIVPSTFTPYDL

SEQ ID NO: 2810973 - protein, 21 aa, Entamoeba invadens
GRLFCALYILSFLIYFPLKLG

SEQ ID NO: 2810974 - protein, 23 aa, Entamoeba invadens
GRLFTECFGRWVVYKISSSSIVH

SEQ ID NO: 2810975 - protein, 19 aa, Entamoeba invadens
GRLIGEWMVYFGVSNELGP

SEQ ID NO: 2810976 - protein, 25 aa, Entamoeba invadens
GRRWDWPGTVIKYNYIYNITGWGQS

SEQ ID NO: 2810977 - protein, 19 aa, Entamoeba invadens
GRSCLLCAAGYFSNGGTSS

SEQ ID NO: 2810978 - protein, 20 aa, Entamoeba invadens
GRSCSLCPAGYFSNGGTQSC

SEQ ID NO: 2810979 - protein, 21 aa, Entamoeba invadens
GRSEILKKFVLEYQNVPETKH

SEQ ID NO: 2810980 - protein, 18 aa, Entamoeba invadens
GSFGIVFKGFFRGNIVAI

SEQ ID NO: 2810981 - protein, 17 aa, Entamoeba invadens
GSFGIVFKGIFRGNIVA

SEQ ID NO: 2810982 - protein, 18 aa, Entamoeba invadens
GSFGIVFKGIFRGNIVAI

SEQ ID NO: 2810983 - protein, 18 aa, Entamoeba invadens
GSFGIVFKGMFRDNVVAI

SEQ ID NO: 2810984 - protein, 19 aa, Entamoeba invadens
GSFGIVFKGMFRDSVVAIK

SEQ ID NO: 2810985 - protein, 18 aa, Entamoeba invadens
GSFGIVFKGMFRNNVVAI

SEQ ID NO: 2810986 - protein, 19 aa, Entamoeba invadens
GSFGIVFKGMFRNNVVAIK

SEQ ID NO: 2810987 - protein, 17 aa, Entamoeba invadens
GSFGVVFKGEFRGNDVA

SEQ ID NO: 2810988 - protein, 22 aa, Entamoeba invadens
GSGYPANMLIPFDNPIMGKFVV

SEQ ID NO: 2810989 - protein, 19 aa, Entamoeba invadens
GSIKGEFLVSVVVLILYGL

SEQ ID NO: 2810990 - protein, 17 aa, Entamoeba invadens
GSIKLIEKVLETFNMFC

SEQ ID NO: 2810991 - protein, 19 aa, Entamoeba invadens
GSLSFIVTCLLKYKRIDIN

SEQ ID NO: 2810992 - protein, 23 aa, Entamoeba invadens
GSSCKKCDSTYCLSNDGCYPFIS

SEQ ID NO: 2810993 - protein, 25 aa, Entamoeba invadens
GSVAFRLSILLSFLFFMIFSVFDVK

SEQ ID NO: 2810994 - protein, 21 aa, Entamoeba invadens
GTECKICYPPFELFEGSCVEC

SEQ ID NO: 2810995 - protein, 18 aa, Entamoeba invadens
GTELFPFWIVLFMTLFFA

SEQ ID NO: 2810996 - protein, 20 aa, Entamoeba invadens
GTISHCFKMLFTGNIETSKC

SEQ ID NO: 2810997 - protein, 20 aa, Entamoeba invadens
GTKCLKCKDGMFIINGDCLH

SEQ ID NO: 2810998 - protein, 20 aa, Entamoeba invadens
GTKCLSCKYGFYQGENHTCL

SEQ ID NO: 2810999 - protein, 34 aa, Entamoeba invadens
GTLVWIICCVLCIIGLPCCACIPCCITDMKDAYH

SEQ ID NO: 2811000 - protein, 24 aa, Entamoeba invadens
GTVSVCYYLFIRKGYFCLVKNNKK

SEQ ID NO: 2811001 - protein, 19 aa, Entamoeba invadens
GTYSFCFDNSMSLYTGKLV

SEQ ID NO: 2811002 - protein, 17 aa, Entamoeba invadens
GVATRVYVPLTIADEKG

SEQ ID NO: 2811003 - protein, 18 aa, Entamoeba invadens
GVATRVYVPLTIADEKGT

SEQ ID NO: 2811004 - protein, 19 aa, Entamoeba invadens
GVCCGCGQSDLDAAYLWLK

SEQ ID NO: 2811005 - protein, 19 aa, Entamoeba invadens
GVCIVPEFIMCFLIIGVSC

SEQ ID NO: 2811006 - protein, 18 aa, Entamoeba invadens
GVCKLCPAGTFANSSSCV

SEQ ID NO: 2811007 - protein, 23 aa, Entamoeba invadens
GVFFQWAMCIGILIVGIFTQMIA

SEQ ID NO: 2811008 - protein, 25 aa, Entamoeba invadens
GVFGYPACMPHIFGKMIDFFIEFNM

SEQ ID NO: 2811009 - protein, 19 aa, Entamoeba invadens
GVGEKCVKKFVGYELGRLR

SEQ ID NO: 2811010 - protein, 19 aa, Entamoeba invadens
GVIDVRYFICAGILNQNML

SEQ ID NO: 2811011 - protein, 18 aa, Entamoeba invadens
GVILPFIVCFFIATPHLD

SEQ ID NO: 2811012 - protein, 21 aa, Entamoeba invadens
GVISLICFFSAFFFDQVLLYA

SEQ ID NO: 2811013 - protein, 19 aa, Entamoeba invadens
GVRCYKYSYAIAFIPALLY

SEQ ID NO: 2811014 - protein, 22 aa, Entamoeba invadens
GVRYFEVRAGYGWYNIGVLDQK

SEQ ID NO: 2811015 - protein, 19 aa, Entamoeba invadens
GVSCIKCLPSFYREKTVYC

SEQ ID NO: 2811016 - protein, 21 aa, Entamoeba invadens
GVSLPEILVYLGVSRETQPLI

SEQ ID NO: 2811017 - protein, 17 aa, Entamoeba invadens
GVSTIWCKNTFYIENES

SEQ ID NO: 2811018 - protein, 17 aa, Entamoeba invadens
GVTFMFIFFVDRVIVEH

SEQ ID NO: 2811019 - protein, 17 aa, Entamoeba invadens
GVVFRGSFRGNKVAIKK

SEQ ID NO: 2811020 - protein, 21 aa, Entamoeba invadens
GWICPVLSFLASLVLFVYASF

SEQ ID NO: 2811021 - protein, 19 aa, Entamoeba invadens
GWKELRKSTEWKFQYYHNA

SEQ ID NO: 2811022 - protein, 19 aa, Entamoeba invadens
GWLIWSIWVMMTIVAVITF

SEQ ID NO: 2811023 - protein, 26 aa, Entamoeba invadens
GWLLLAWWFFCVFKLRCHVCGDTCVE

SEQ ID NO: 2811024 - protein, 17 aa, Entamoeba invadens
GWLNYKYGIYFNGTGTF

SEQ ID NO: 2811025 - protein, 19 aa, Entamoeba invadens
GWSDIKWLPVYFADEESDL

SEQ ID NO: 2811026 - protein, 18 aa, Entamoeba invadens
GWVLCCLAIVIGCISAYE

SEQ ID NO: 2811027 - protein, 18 aa, Entamoeba invadens
GYCNLCYQNYLFDNGKCY

SEQ ID NO: 2811028 - protein, 18 aa, Entamoeba invadens
GYGGSNCHKLCYYDNTWQ

SEQ ID NO: 2811029 - protein, 19 aa, Entamoeba invadens
GYPSSSCLFDYFTPNDQVG

SEQ ID NO: 2811030 - protein, 18 aa, Entamoeba invadens
GYSCCPCFIPPPCSPANS

SEQ ID NO: 2811031 - protein, 17 aa, Entamoeba invadens
HATFPCLREQIAKIFIK

SEQ ID NO: 2811032 - protein, 20 aa, Entamoeba invadens
HCFNCKKCGKRLEEKSFVTI

SEQ ID NO: 2811033 - protein, 17 aa, Entamoeba invadens
HCMYCVTGGIVNGTCQD

SEQ ID NO: 2811034 - protein, 20 aa, Entamoeba invadens
HCPCFGNNCYIHFESSLSTY

SEQ ID NO: 2811035 - protein, 18 aa, Entamoeba invadens
HCPCKDCQLFFQENVSNC

SEQ ID NO: 2811036 - protein, 24 aa, Entamoeba invadens
HCRLCKNEKCLICDNNFILNNESV

SEQ ID NO: 2811037 - protein, 17 aa, Entamoeba invadens
HEKRFKFAWDIVDFVVS

SEQ ID NO: 2811038 - protein, 18 aa, Entamoeba invadens
HFPFKFSSGTGYLISNQR

SEQ ID NO: 2811039 - protein, 17 aa, Entamoeba invadens
HGFKIQIIRKFLKQIIN

SEQ ID NO: 2811040 - protein, 17 aa, Entamoeba invadens
HHCPWLGTCVGYRNHKF

SEQ ID NO: 2811041 - protein, 20 aa, Entamoeba invadens
HILSYLVPNYCKAIFLDTYK

SEQ ID NO: 2811042 - protein, 23 aa, Entamoeba invadens
HKALCIRFKVPFNKARILMFDAN

SEQ ID NO: 2811043 - protein, 17 aa, Entamoeba invadens
HKIKLTLLWSGLQTLPA

SEQ ID NO: 2811044 - protein, 22 aa, Entamoeba invadens
HKQKFRIGKWFKINMDNLITSQ

SEQ ID NO: 2811045 - protein, 19 aa, Entamoeba invadens
HLDELFVWQLYRVTPSLRL

SEQ ID NO: 2811046 - protein, 21 aa, Entamoeba invadens
HLLGIRYGYFFTTFCTALFYG

SEQ ID NO: 2811047 - protein, 19 aa, Entamoeba invadens
HLLIAFLLLIGFIVCVKTL

SEQ ID NO: 2811048 - protein, 19 aa, Entamoeba invadens
HLLWFPFNLLLSFFDLLII

SEQ ID NO: 2811049 - protein, 21 aa, Entamoeba invadens
HLWVKMFMCMLIGFGGISLLI

SEQ ID NO: 2811050 - protein, 22 aa, Entamoeba invadens
HLYLRNRCAPLAFQLIDAQIEK

SEQ ID NO: 2811051 - protein, 21 aa, Entamoeba invadens
HNEIGEFILLFLALISGASAF

SEQ ID NO: 2811052 - protein, 18 aa, Entamoeba invadens
HNEKCLLTSASRCWKCSE

SEQ ID NO: 2811053 - protein, 23 aa, Entamoeba invadens
HNFDLLVVISFVFGKSAIHRLKK

SEQ ID NO: 2811054 - protein, 24 aa, Entamoeba invadens
HNSLRCLTCAEVFYFDESTKQCVN

SEQ ID NO: 2811055 - protein, 18 aa, Entamoeba invadens
HNTSRSFLHLSFKLKVKV

SEQ ID NO: 2811056 - protein, 24 aa, Entamoeba invadens
HNWYKRLASTAVFVILLFSYLFCY

SEQ ID NO: 2811057 - protein, 19 aa, Entamoeba invadens
HPILMFVVVLVWYASPKLI

SEQ ID NO: 2811058 - protein, 21 aa, Entamoeba invadens
HPITCVYKFKGFNMKSCPMAE

SEQ ID NO: 2811059 - protein, 19 aa, Entamoeba invadens
HPPKASKCVLVFQKIAIGV

SEQ ID NO: 2811060 - protein, 19 aa, Entamoeba invadens
HPSVYGCLRCSSGYFQDDN

SEQ ID NO: 2811061 - protein, 17 aa, Entamoeba invadens
HSCVFCGLTGVVNSEGY

SEQ ID NO: 2811062 - protein, 18 aa, Entamoeba invadens
HSCVSCGLTGVVNSKGSC

SEQ ID NO: 2811063 - protein, 18 aa, Entamoeba invadens
HSFIFWKYAVLMYVAGQQ

SEQ ID NO: 2811064 - protein, 17 aa, Entamoeba invadens
HSFPRALTLLSISASLS

SEQ ID NO: 2811065 - protein, 23 aa, Entamoeba invadens
HSIHICVFKEYYIQLIKMLIMSM

SEQ ID NO: 2811066 - protein, 25 aa, Entamoeba invadens
HSKCYRCLACFKMIVGDKESPDHRC

SEQ ID NO: 2811067 - protein, 22 aa, Entamoeba invadens
HSSSFIKWNFKYLVVLLSVFLV

SEQ ID NO: 2811068 - protein, 18 aa, Entamoeba invadens
HSTFLLKGKHNFISLSLK

SEQ ID NO: 2811069 - protein, 18 aa, Entamoeba invadens
HSVECPFWLAPEVIKTSQ

SEQ ID NO: 2811070 - protein, 18 aa, Entamoeba invadens
HSVWWVIFICVMFLVGVT

SEQ ID NO: 2811071 - protein, 18 aa, Entamoeba invadens
HVVIRWCVIFTVGIVSCA

SEQ ID NO: 2811072 - protein, 24 aa, Entamoeba invadens
HWSCGINFLLHRLFFQFFDNHKIT

SEQ ID NO: 2811073 - protein, 17 aa, Entamoeba invadens
IAFEWKMIWVMLTWLCI

SEQ ID NO: 2811074 - protein, 17 aa, Entamoeba invadens
IAFFPFDLIRYMGIGCA

SEQ ID NO: 2811075 - protein, 25 aa, Entamoeba invadens
IAIYEIITWKFPYQNMRSWDVADFV

SEQ ID NO: 2811076 - protein, 24 aa, Entamoeba invadens
IAKKRLPRLFAWKQFHSYIRELGI

SEQ ID NO: 2811077 - protein, 17 aa, Entamoeba invadens
IALELGFFFDAKLSRKT

SEQ ID NO: 2811078 - protein, 23 aa, Entamoeba invadens
IAMALCFFVMLLSFTANVRENSW

SEQ ID NO: 2811079 - protein, 17 aa, Entamoeba invadens
IANLILGIGFVFIAVVV

SEQ ID NO: 2811080 - protein, 22 aa, Entamoeba invadens
IANRNDLEFGFGRCISPSGSNG

SEQ ID NO: 2811081 - protein, 18 aa, Entamoeba invadens
IAQIPVFILLIIAFVFLT

SEQ ID NO: 2811082 - protein, 21 aa, Entamoeba invadens
IASYYQREWPLLVICPSSVRH

SEQ ID NO: 2811083 - protein, 23 aa, Entamoeba invadens
IAVGKARCNLCISPYVLNDTKCE

SEQ ID NO: 2811084 - protein, 21 aa, Entamoeba invadens
IAVVVGVVFFLKKRNSVIPYS

SEQ ID NO: 2811085 - protein, 19 aa, Entamoeba invadens
ICASCCFFLPFGYQTNLMV

SEQ ID NO: 2811086 - protein, 20 aa, Entamoeba invadens
ICDVCGVDGSFRMRVSNTLR

SEQ ID NO: 2811087 - protein, 17 aa, Entamoeba invadens
ICELKWEFCKTQKNKLI

SEQ ID NO: 2811088 - protein, 20 aa, Entamoeba invadens
ICFIFCYWYIYNLVTFILIF

SEQ ID NO: 2811089 - protein, 22 aa, Entamoeba invadens
ICISVFMLFRFINPIQKLRKEW

SEQ ID NO: 2811090 - protein, 20 aa, Entamoeba invadens
ICKREWKWFLIMYILTVIFD

SEQ ID NO: 2811091 - protein, 17 aa, Entamoeba invadens
ICLELGFFFTLKKSRKT

SEQ ID NO: 2811092 - protein, 19 aa, Entamoeba invadens
ICLICGALCDLKLDWVKKV

SEQ ID NO: 2811093 - protein, 18 aa, Entamoeba invadens
ICLSCPDLTYSVMGSIEC

SEQ ID NO: 2811094 - protein, 17 aa, Entamoeba invadens
ICLTITMVVTFVALTVM

SEQ ID NO: 2811095 - protein, 19 aa, Entamoeba invadens
ICPNLRLRKNWNPCQTHIE

SEQ ID NO: 2811096 - protein, 17 aa, Entamoeba invadens
ICRSSGLFETCLELIEY

SEQ ID NO: 2811097 - protein, 17 aa, Entamoeba invadens
ICTKCIFGYYLSSGECI

SEQ ID NO: 2811098 - protein, 17 aa, Entamoeba invadens
ICTNVFWKVFNEPKGLT

SEQ ID NO: 2811099 - protein, 18 aa, Entamoeba invadens
ICTSCNFGYYLSDFICVR

SEQ ID NO: 2811100 - protein, 21 aa, Entamoeba invadens
ICVACGQAPPFSAIMILWANL

SEQ ID NO: 2811101 - protein, 25 aa, Entamoeba invadens
ICVYCDFKYEKCCLYIDTYNDKGVI

SEQ ID NO: 2811102 - protein, 18 aa, Entamoeba invadens
IDFHPSFSVEGFIITSVF

SEQ ID NO: 2811103 - protein, 24 aa, Entamoeba invadens
IDGQLRVSLCLSNMLIVKIKIFED

SEQ ID NO: 2811104 - protein, 19 aa, Entamoeba invadens
IDHYYRYIPLLTFNSPSPL

SEQ ID NO: 2811105 - protein, 19 aa, Entamoeba invadens
IDIKDCFALFTSPEELGIE

SEQ ID NO: 2811106 - protein, 18 aa, Entamoeba invadens
IDIPRLVSKLVISNADGV

SEQ ID NO: 2811107 - protein, 27 aa, Entamoeba invadens
IDKEIYVSLSFPFPVRISKHFKSFRTV

SEQ ID NO: 2811108 - protein, 21 aa, Entamoeba invadens
IDLSELIMNWERFRVNEKMHP

SEQ ID NO: 2811109 - protein, 20 aa, Entamoeba invadens
IDQAFECFDSITITEEDSVS

SEQ ID NO: 2811110 - protein, 27 aa, Entamoeba invadens
IDVPKCPKCGGLMKLDVILFGEKLDQI

SEQ ID NO: 2811111 - protein, 22 aa, Entamoeba invadens
IEADVYWSFSWMLQAIQNQYTF

SEQ ID NO: 2811112 - protein, 23 aa, Entamoeba invadens
IEAYVLICALSFVNVMYCGATCF

SEQ ID NO: 2811113 - protein, 17 aa, Entamoeba invadens
IECDSLRVRNTHFLISG

SEQ ID NO: 2811114 - protein, 18 aa, Entamoeba invadens
IECYGCLIGYYLDKNDCL

SEQ ID NO: 2811115 - protein, 21 aa, Entamoeba invadens
IEFKYPWKIADFVTGGNRLNK

SEQ ID NO: 2811116 - protein, 19 aa, Entamoeba invadens
IEFTKDLFLTHAYKALEMF

SEQ ID NO: 2811117 - protein, 24 aa, Entamoeba invadens
IEHKIACLLPLFGPVTLLFAKTLF

SEQ ID NO: 2811118 - protein, 20 aa, Entamoeba invadens
IEIFERIKAKICLTEYKTAY

SEQ ID NO: 2811119 - protein, 20 aa, Entamoeba invadens
IEIFETFPSYYYRAVHYGKN

SEQ ID NO: 2811120 - protein, 18 aa, Entamoeba invadens
IEIWMVISVFDIPYASYF

SEQ ID NO: 2811121 - protein, 25 aa, Entamoeba invadens
IEKRLLTLLSLIAFRLDVHVAKRNL

SEQ ID NO: 2811122 - protein, 17 aa, Entamoeba invadens
IELKKPLFIIGLPRSGT

SEQ ID NO: 2811123 - protein, 20 aa, Entamoeba invadens
IELKSDWYKRCFLDGRLEEG

SEQ ID NO: 2811124 - protein, 19 aa, Entamoeba invadens
IELLSCLAKSIGKDAFKPY

SEQ ID NO: 2811125 - protein, 18 aa, Entamoeba invadens
IENCLYQKFNLCIKCKEN

SEQ ID NO: 2811126 - protein, 20 aa, Entamoeba invadens
IEPFTSLGFCEFGKKVIDVI

SEQ ID NO: 2811127 - protein, 17 aa, Entamoeba invadens
IEPILLVLVIISLILMF

SEQ ID NO: 2811128 - protein, 18 aa, Entamoeba invadens
IESIEFPEPLDFSTATKT

SEQ ID NO: 2811129 - protein, 17 aa, Entamoeba invadens
IESNIIFSSTSSFTIKN

SEQ ID NO: 2811130 - protein, 17 aa, Entamoeba invadens
IESRMLFTIPRYLQKVV

SEQ ID NO: 2811131 - protein, 22 aa, Entamoeba invadens
IFACTRCCFGPCCLAKHGCLCP

SEQ ID NO: 2811132 - protein, 24 aa, Entamoeba invadens
IFAFGIVMYEVWTWKTAYANDDFK

SEQ ID NO: 2811133 - protein, 19 aa, Entamoeba invadens
IFCAFVITLVCSKIRLLML

SEQ ID NO: 2811134 - protein, 17 aa, Entamoeba invadens
IFFCMVLSYPFDFVLAV

SEQ ID NO: 2811135 - protein, 17 aa, Entamoeba invadens
IFFSFSLDYIYNDNYYS

SEQ ID NO: 2811136 - protein, 17 aa, Entamoeba invadens
IFISFLFDGVRSQSIAQ

SEQ ID NO: 2811137 - protein, 17 aa, Entamoeba invadens
IFKFRITNFEGFMLKRA

SEQ ID NO: 2811138 - protein, 18 aa, Entamoeba invadens
IFLIYRISYIYSDGHAND

SEQ ID NO: 2811139 - protein, 19 aa, Entamoeba invadens
IFLRRRYRTTPSFPCECSL

SEQ ID NO: 2811140 - protein, 23 aa, Entamoeba invadens
IFMKLFRMCPTHSYAHYVCGVLY

SEQ ID NO: 2811141 - protein, 20 aa, Entamoeba invadens
IFQILTYFRRLCVHPKLVLD

SEQ ID NO: 2811142 - protein, 18 aa, Entamoeba invadens
IFQLRFLLESGAFPMSSN

SEQ ID NO: 2811143 - protein, 17 aa, Entamoeba invadens
IFQTFKFPWKIAEFVMS

SEQ ID NO: 2811144 - protein, 18 aa, Entamoeba invadens
IFSLIAMLVTLIRELSGV

SEQ ID NO: 2811145 - protein, 18 aa, Entamoeba invadens
IFYYLAMQPWRHFVWTQK

SEQ ID NO: 2811146 - protein, 17 aa, Entamoeba invadens
IGCAICKKGYYKTEKDC

SEQ ID NO: 2811147 - protein, 20 aa, Entamoeba invadens
IGCAICKVGYYYVSKDCRQC

SEQ ID NO: 2811148 - protein, 17 aa, Entamoeba invadens
IGCLASLMKRYRYFDEY

SEQ ID NO: 2811149 - protein, 18 aa, Entamoeba invadens
IGCLKQRLSKCIQCEIGK

SEQ ID NO: 2811150 - protein, 19 aa, Entamoeba invadens
IGDIPLFITHNFDQRNFTI

SEQ ID NO: 2811151 - protein, 19 aa, Entamoeba invadens
IGFSKCWDLTLVILAVAPL

SEQ ID NO: 2811152 - protein, 23 aa, Entamoeba invadens
IGFWMWAYYLSWMRYAFELIMLS

SEQ ID NO: 2811153 - protein, 17 aa, Entamoeba invadens
IGINFALWYYGIVPSDP

SEQ ID NO: 2811154 - protein, 17 aa, Entamoeba invadens
IGINYLLWYYKFIPTDN

SEQ ID NO: 2811155 - protein, 17 aa, Entamoeba invadens
IGIPIIVVAIVIIIIST

SEQ ID NO: 2811156 - protein, 21 aa, Entamoeba invadens
IGLCEKCFICGLNGDGRKGFV

SEQ ID NO: 2811157 - protein, 17 aa, Entamoeba invadens
IGLIAADIVLCFGGERA

SEQ ID NO: 2811158 - protein, 24 aa, Entamoeba invadens
IGLLCLPMTFLAGLWGMNVRVPGQ

SEQ ID NO: 2811159 - protein, 18 aa, Entamoeba invadens
IGSFKKIFCHVSDIKYKD

SEQ ID NO: 2811160 - protein, 19 aa, Entamoeba invadens
IGVACLVNLQFILFLQLPF

SEQ ID NO: 2811161 - protein, 23 aa, Entamoeba invadens
IHKYLWCTDTFKGIMDCPKGTKC

SEQ ID NO: 2811162 - protein, 20 aa, Entamoeba invadens
IHPFLSVFALLFAKSYASLP

SEQ ID NO: 2811163 - protein, 20 aa, Entamoeba invadens
IIGIIWWRRVKSVKAETAAI

SEQ ID NO: 2811164 - protein, 17 aa, Entamoeba invadens
IIITLLVLRLFKKKKTV

SEQ ID NO: 2811165 - protein, 18 aa, Entamoeba invadens
IIKLRYSAFQSMREHTKT

SEQ ID NO: 2811166 - protein, 22 aa, Entamoeba invadens
IIKNTCCYFVILGVSAFVAYYL

SEQ ID NO: 2811167 - protein, 17 aa, Entamoeba invadens
IIKSLVCVILIINTSLL

SEQ ID NO: 2811168 - protein, 23 aa, Entamoeba invadens
IILLCCLCPAPLLNIIYSVEYKA

SEQ ID NO: 2811169 - protein, 17 aa, Entamoeba invadens
IILLLFLNCSNFISFKE

SEQ ID NO: 2811170 - protein, 17 aa, Entamoeba invadens
IILPFGLCWYNQDEDNT

SEQ ID NO: 2811171 - protein, 17 aa, Entamoeba invadens
IIPFCVFIKDFSWNEND

SEQ ID NO: 2811172 - protein, 19 aa, Entamoeba invadens
IISSALLEWHPDPPVFCFI

SEQ ID NO: 2811173 - protein, 18 aa, Entamoeba invadens
IIVLPAMKFIGALSTKSD

SEQ ID NO: 2811174 - protein, 17 aa, Entamoeba invadens
IKCLKCKTGELANNCNI

SEQ ID NO: 2811175 - protein, 17 aa, Entamoeba invadens
IKCYFVLVDIFEATKQI

SEQ ID NO: 2811176 - protein, 17 aa, Entamoeba invadens
IKFNWTKFMKKLDADNE

SEQ ID NO: 2811177 - protein, 21 aa, Entamoeba invadens
IKGEIFGGINQRVFDLILRQG

SEQ ID NO: 2811178 - protein, 18 aa, Entamoeba invadens
IKGKEYGLKWDVLLDTEA

SEQ ID NO: 2811179 - protein, 21 aa, Entamoeba invadens
IKHLYCLPEHMIINVIGVLCT

SEQ ID NO: 2811180 - protein, 18 aa, Entamoeba invadens
IKHWMFWYVFSMVIFVFS

SEQ ID NO: 2811181 - protein, 18 aa, Entamoeba invadens
IKICGVIPFTSERKRMGI

SEQ ID NO: 2811182 - protein, 21 aa, Entamoeba invadens
IKIYTSLCSFIYKTTQTAPDD

SEQ ID NO: 2811183 - protein, 21 aa, Entamoeba invadens
IKKYRTVLMIVELCKVIKFYI

SEQ ID NO: 2811184 - protein, 18 aa, Entamoeba invadens
IKLFSNTVSFVFGTSIGS

SEQ ID NO: 2811185 - protein, 20 aa, Entamoeba invadens
IKLLAGICSEEFWSIIYKEM

SEQ ID NO: 2811186 - protein, 23 aa, Entamoeba invadens
IKLSPTFWWYVGGLVFCLLFCTP

SEQ ID NO: 2811187 - protein, 19 aa, Entamoeba invadens
IKLTLLWSGLQTLPALGCC

SEQ ID NO: 2811188 - protein, 20 aa, Entamoeba invadens
IKLVWLLVCVTIVFMIFHKN

SEQ ID NO: 2811189 - protein, 18 aa, Entamoeba invadens
IKMPLLHRIACFRDDVVF

SEQ ID NO: 2811190 - protein, 20 aa, Entamoeba invadens
IKNRCELSCTSEGVCDFIQK

SEQ ID NO: 2811191 - protein, 22 aa, Entamoeba invadens
IKRCFSMRRLIYWVIEALVVSA

SEQ ID NO: 2811192 - protein, 17 aa, Entamoeba invadens
IKSLMCVSLYKKCDIET

SEQ ID NO: 2811193 - protein, 21 aa, Entamoeba invadens
IKSLRSSEVINIFTKNVSESS

SEQ ID NO: 2811194 - protein, 17 aa, Entamoeba invadens
IKVSPTFQVRAQDCILN

SEQ ID NO: 2811195 - protein, 19 aa, Entamoeba invadens
ILATIRFVLGLGIGGEYPL

SEQ ID NO: 2811196 - protein, 22 aa, Entamoeba invadens
ILCLRFIPWYVVWINIIGHIIY

SEQ ID NO: 2811197 - protein, 24 aa, Entamoeba invadens
ILDVLKYFFGLVFDEEVKKKPKKD

SEQ ID NO: 2811198 - protein, 19 aa, Entamoeba invadens
ILECFWMKYFGIGNLVIIL

SEQ ID NO: 2811199 - protein, 17 aa, Entamoeba invadens
ILFEIIELAPFIDFPEN

SEQ ID NO: 2811200 - protein, 19 aa, Entamoeba invadens
ILFESGLCFDISFVSKCLE

SEQ ID NO: 2811201 - protein, 17 aa, Entamoeba invadens
ILFFLLFFVSVEVTFVY

SEQ ID NO: 2811202 - protein, 17 aa, Entamoeba invadens
ILFKFNYDYVFGENYGS

SEQ ID NO: 2811203 - protein, 18 aa, Entamoeba invadens
ILGGLRFVCLDVKPEQIV

SEQ ID NO: 2811204 - protein, 17 aa, Entamoeba invadens
ILIGLAYRMVVFPVVAW

SEQ ID NO: 2811205 - protein, 26 aa, Entamoeba invadens
ILKQQTWRWFVCVFSREFKVEQVIMI

SEQ ID NO: 2811206 - protein, 18 aa, Entamoeba invadens
ILKVPLLTVMKGGNVQTE

SEQ ID NO: 2811207 - protein, 20 aa, Entamoeba invadens
ILKYSLKYTDWLSVESHIVV

SEQ ID NO: 2811208 - protein, 18 aa, Entamoeba invadens
ILLILSVVFLIVFTKKIL

SEQ ID NO: 2811209 - protein, 17 aa, Entamoeba invadens
ILLRIVIGQKIMLLLLL

SEQ ID NO: 2811210 - protein, 17 aa, Entamoeba invadens
ILLTWGQLPVTTHWGIL

SEQ ID NO: 2811211 - protein, 21 aa, Entamoeba invadens
ILLYFKMEFVFLLKKIDYNSD

SEQ ID NO: 2811212 - protein, 20 aa, Entamoeba invadens
ILMDYTLKFCKAGFTIGAPD

SEQ ID NO: 2811213 - protein, 18 aa, Entamoeba invadens
ILMSLPLLKPHRRCALLY

SEQ ID NO: 2811214 - protein, 18 aa, Entamoeba invadens
ILMYECFVWDKAYPTSQF

SEQ ID NO: 2811215 - protein, 22 aa, Entamoeba invadens
ILPTRYPLLGGWKTSFEVNYHF

SEQ ID NO: 2811216 - protein, 23 aa, Entamoeba invadens
ILSYCFIDDYFLRVNKNNTKVSR

SEQ ID NO: 2811217 - protein, 19 aa, Entamoeba invadens
IMGSICLLANVAEMSTNSY

SEQ ID NO: 2811218 - protein, 18 aa, Entamoeba invadens
IMHWEFVDKLLFVMFCIW

SEQ ID NO: 2811219 - protein, 18 aa, Entamoeba invadens
IMTRWIVFCLHRIFEKKS

SEQ ID NO: 2811220 - protein, 17 aa, Entamoeba invadens
IMYPFHMIWTFIVFLYN

SEQ ID NO: 2811221 - protein, 18 aa, Entamoeba invadens
INALPALCHLFLSSNDTI

SEQ ID NO: 2811222 - protein, 18 aa, Entamoeba invadens
INDGVAMYLFFLCVTTCV

SEQ ID NO: 2811223 - protein, 19 aa, Entamoeba invadens
INFGCCFLLSWVCGFINNF

SEQ ID NO: 2811224 - protein, 17 aa, Entamoeba invadens
INICLACAFSVRKMFLN

SEQ ID NO: 2811225 - protein, 18 aa, Entamoeba invadens
INPDYSWKLFPPGAASVE

SEQ ID NO: 2811226 - protein, 23 aa, Entamoeba invadens
INPKFRGGVVWFRDSSKIEYTLS

SEQ ID NO: 2811227 - protein, 21 aa, Entamoeba invadens
INRFFTLQGMRVLAFGYKNVE

SEQ ID NO: 2811228 - protein, 22 aa, Entamoeba invadens
INWKRIFNWLILFWGYTAFECF

SEQ ID NO: 2811229 - protein, 20 aa, Entamoeba invadens
IPAIVLFLFKIVRYGVSDMI

SEQ ID NO: 2811230 - protein, 25 aa, Entamoeba invadens
IPCFIRKSGKVYAVFNNEEILIKKV

SEQ ID NO: 2811231 - protein, 18 aa, Entamoeba invadens
IPCSLLIIFQYFYYTRIY

SEQ ID NO: 2811232 - protein, 23 aa, Entamoeba invadens
IPDLRYAVSVGKCLIVGTKTMLY

SEQ ID NO: 2811233 - protein, 17 aa, Entamoeba invadens
IPEQCYGPFSYRSHAEW

SEQ ID NO: 2811234 - protein, 17 aa, Entamoeba invadens
IPFLFLHASYLQNKTPS

SEQ ID NO: 2811235 - protein, 20 aa, Entamoeba invadens
IPFVKRYVVWFTVSLTDSYF

SEQ ID NO: 2811236 - protein, 24 aa, Entamoeba invadens
IPISLRVNLEFSKIFYSLLIQFDP

SEQ ID NO: 2811237 - protein, 17 aa, Entamoeba invadens
IPKFEIESSFAMNDQLG

SEQ ID NO: 2811238 - protein, 19 aa, Entamoeba invadens
IPKGLLGTIGWKVGDQVTY

SEQ ID NO: 2811239 - protein, 21 aa, Entamoeba invadens
IPKRENCLFDRLSGCDECSNS

SEQ ID NO: 2811240 - protein, 24 aa, Entamoeba invadens
IPLCSLAAPLMRIFTTDINFKSIQ

SEQ ID NO: 2811241 - protein, 18 aa, Entamoeba invadens
IPLKILRTKMCILPQEAT

SEQ ID NO: 2811242 - protein, 17 aa, Entamoeba invadens
IPMHVIRTLQIIEEEVA

SEQ ID NO: 2811243 - protein, 17 aa, Entamoeba invadens
IPPFWSIVELQFFTPQK

SEQ ID NO: 2811244 - protein, 17 aa, Entamoeba invadens
IPPKFACEFSLFLNPLC

SEQ ID NO: 2811245 - protein, 18 aa, Entamoeba invadens
IPQELAICYSDGEIKVFF

SEQ ID NO: 2811246 - protein, 19 aa, Entamoeba invadens
IPQIFDWTRYNGGTYPVPT

SEQ ID NO: 2811247 - protein, 17 aa, Entamoeba invadens
IPRCYKCSINCLKCYSE

SEQ ID NO: 2811248 - protein, 20 aa, Entamoeba invadens
IPTLMCIGCCMIHKPQTRQL

SEQ ID NO: 2811249 - protein, 20 aa, Entamoeba invadens
IPTRMEVFLIHIRRALMLFS

SEQ ID NO: 2811250 - protein, 18 aa, Entamoeba invadens
IPVLFGLYLLKTGLRIGL

SEQ ID NO: 2811251 - protein, 19 aa, Entamoeba invadens
IPVNLGLDFTNYVSTRQWS

SEQ ID NO: 2811252 - protein, 17 aa, Entamoeba invadens
IPVTYSFGVTCTYLRSL

SEQ ID NO: 2811253 - protein, 18 aa, Entamoeba invadens
IQCTLCFAPYILNDNKLS

SEQ ID NO: 2811254 - protein, 19 aa, Entamoeba invadens
IQKCNYLKFEVLNNANDAN

SEQ ID NO: 2811255 - protein, 26 aa, Entamoeba invadens
IQNNFGAFCSLDFNSTQTFGFLSNCG

SEQ ID NO: 2811256 - protein, 19 aa, Entamoeba invadens
IQPSLPVSDLFKLRVFYQA

SEQ ID NO: 2811257 - protein, 17 aa, Entamoeba invadens
IQWEFSWHQDLKVKVVC

SEQ ID NO: 2811258 - protein, 19 aa, Entamoeba invadens
IRCGFRLCYFIFLIQWTNT

SEQ ID NO: 2811259 - protein, 18 aa, Entamoeba invadens
IRCKACAINHTLSEDSTK

SEQ ID NO: 2811260 - protein, 18 aa, Entamoeba invadens
IRDFPLIITHSFLFSQWI

SEQ ID NO: 2811261 - protein, 18 aa, Entamoeba invadens
IRDIPLFITRNFDQRNFT

SEQ ID NO: 2811262 - protein, 22 aa, Entamoeba invadens
IRDIPLFITRNFVFRIITITTT

SEQ ID NO: 2811263 - protein, 18 aa, Entamoeba invadens
IRDLPIFFTYQINTTIFS

SEQ ID NO: 2811264 - protein, 22 aa, Entamoeba invadens
IRESGACSLCFSGFKKVGGECT

SEQ ID NO: 2811265 - protein, 19 aa, Entamoeba invadens
IRFLFCVGNIKTRKSPIQK

SEQ ID NO: 2811266 - protein, 17 aa, Entamoeba invadens
IRFPYKLSDDMLSCIHT

SEQ ID NO: 2811267 - protein, 20 aa, Entamoeba invadens
IRFQHAFCIKNDVKSFTVIC

SEQ ID NO: 2811268 - protein, 24 aa, Entamoeba invadens
IRIGRFEFWASMSYYFKNDTQNKQ

SEQ ID NO: 2811269 - protein, 18 aa, Entamoeba invadens
IRLPYRLKVRMLYDTAKG

SEQ ID NO: 2811270 - protein, 19 aa, Entamoeba invadens
IRPEVVCFKKGYACEFEAV

SEQ ID NO: 2811271 - protein, 17 aa, Entamoeba invadens
IRVFDFIIWNGFDCGAL

SEQ ID NO: 2811272 - protein, 17 aa, Entamoeba invadens
IRWLGAFRFILWTLWYC

SEQ ID NO: 2811273 - protein, 17 aa, Entamoeba invadens
IRWVLNMFVTLPLDIKN

SEQ ID NO: 2811274 - protein, 20 aa, Entamoeba invadens
IRYFCQYNRAFKLVQKLLPE

SEQ ID NO: 2811275 - protein, 17 aa, Entamoeba invadens
ISAYVFWLVYGLYQSVV

SEQ ID NO: 2811276 - protein, 24 aa, Entamoeba invadens
ISCLKCTLVPAIFRNVDFYNHERL

SEQ ID NO: 2811277 - protein, 18 aa, Entamoeba invadens
ISCSVSSCSVCDTDSTKC

SEQ ID NO: 2811278 - protein, 17 aa, Entamoeba invadens
ISFRYKPNWNANQLSLL

SEQ ID NO: 2811279 - protein, 23 aa, Entamoeba invadens
ISFYVCIAISFSVSCYCIFSSTP

SEQ ID NO: 2811280 - protein, 17 aa, Entamoeba invadens
ISGAKCFDVFSLNNQSN

SEQ ID NO: 2811281 - protein, 18 aa, Entamoeba invadens
ISGCDGFVLVIVCGTTVF

SEQ ID NO: 2811282 - protein, 22 aa, Entamoeba invadens
ISHPRISLFFFFSLVSVGLFVA

SEQ ID NO: 2811283 - protein, 22 aa, Entamoeba invadens
ISIILLCFITRVILRKMSQKSL

SEQ ID NO: 2811284 - protein, 24 aa, Entamoeba invadens
ISILFCEACAIYGVISGFICFGKL

SEQ ID NO: 2811285 - protein, 21 aa, Entamoeba invadens
ISKPRFCFEAIPEFYSCSPLF

SEQ ID NO: 2811286 - protein, 17 aa, Entamoeba invadens
ISLCPNSSIPIVLSKAI

SEQ ID NO: 2811287 - protein, 19 aa, Entamoeba invadens
ISLIKAVRAWLNLIIFILL

SEQ ID NO: 2811288 - protein, 20 aa, Entamoeba invadens
ISLYETVTWKEAFPKEKFKF

SEQ ID NO: 2811289 - protein, 22 aa, Entamoeba invadens
ISNCKKCDAIGCVECLTNYTQS

SEQ ID NO: 2811290 - protein, 19 aa, Entamoeba invadens
ISNGNLCYCTLNGDGSTYL

SEQ ID NO: 2811291 - protein, 19 aa, Entamoeba invadens
ISPNQLWNGFALPKVSSPN

SEQ ID NO: 2811292 - protein, 18 aa, Entamoeba invadens
ISQIPFRFSCSTESECDA

SEQ ID NO: 2811293 - protein, 18 aa, Entamoeba invadens
ISRGCALNNGYVREEGDD

SEQ ID NO: 2811294 - protein, 22 aa, Entamoeba invadens
ISSFCLLGVPLFVNRKSSFTYY

SEQ ID NO: 2811295 - protein, 19 aa, Entamoeba invadens
ISVCGIPFVIILSYFILHK

SEQ ID NO: 2811296 - protein, 17 aa, Entamoeba invadens
ISVNMLFDICLELGFFF

SEQ ID NO: 2811297 - protein, 17 aa, Entamoeba invadens
ITCGYNYFRNGSVCSPK

SEQ ID NO: 2811298 - protein, 20 aa, Entamoeba invadens
ITFECFLCPLELLKRLLSHI

SEQ ID NO: 2811299 - protein, 19 aa, Entamoeba invadens
ITLIICFSVKYIMQYMKLE

SEQ ID NO: 2811300 - protein, 20 aa, Entamoeba invadens
ITLLECFKWKEAYGGENFRY

SEQ ID NO: 2811301 - protein, 18 aa, Entamoeba invadens
ITLLELWKGKEIYNKNIF

SEQ ID NO: 2811302 - protein, 19 aa, Entamoeba invadens
ITLLRFLLQNVMEITRENS

SEQ ID NO: 2811303 - protein, 17 aa, Entamoeba invadens
ITLRFGKLSNLYKEIQK

SEQ ID NO: 2811304 - protein, 20 aa, Entamoeba invadens
ITLYECVKWGEAYPKTEFKF

SEQ ID NO: 2811305 - protein, 17 aa, Entamoeba invadens
ITMALSIICPNDCNEES

SEQ ID NO: 2811306 - protein, 19 aa, Entamoeba invadens
ITMFECFNWQKAYSNMEFK

SEQ ID NO: 2811307 - protein, 18 aa, Entamoeba invadens
ITMFEVFGWSDAYLSETF

SEQ ID NO: 2811308 - protein, 20 aa, Entamoeba invadens
ITMFEVFGWSQAYLIDTFKF

SEQ ID NO: 2811309 - protein, 20 aa, Entamoeba invadens
ITMFEVFGWSQAYRIDTFKF

SEQ ID NO: 2811310 - protein, 20 aa, Entamoeba invadens
ITMFEVFRLKKAYPIDTFKF

SEQ ID NO: 2811311 - protein, 17 aa, Entamoeba invadens
ITMYEVFGWKEAYNKNS

SEQ ID NO: 2811312 - protein, 23 aa, Entamoeba invadens
ITSLKKFNCLSGFITVNGQGTLT

SEQ ID NO: 2811313 - protein, 23 aa, Entamoeba invadens
ITWSNLCVYFWKLKVVAFVFPVM

SEQ ID NO: 2811314 - protein, 25 aa, Entamoeba invadens
IVALIGAFCKLHFLVIPIFPCSIFF

SEQ ID NO: 2811315 - protein, 18 aa, Entamoeba invadens
IVCFIVLEFKHFFPEDIS

SEQ ID NO: 2811316 - protein, 17 aa, Entamoeba invadens
IVCGVLFICIVLLILFV

SEQ ID NO: 2811317 - protein, 18 aa, Entamoeba invadens
IVCSICPPAVLYKFIPSV

SEQ ID NO: 2811318 - protein, 17 aa, Entamoeba invadens
IVCTSMLYYLLGNAIFY

SEQ ID NO: 2811319 - protein, 18 aa, Entamoeba invadens
IVFKGMFRDSVVAIKKMK

SEQ ID NO: 2811320 - protein, 20 aa, Entamoeba invadens
IVFSCSFRSIRFVVGDMESF

SEQ ID NO: 2811321 - protein, 23 aa, Entamoeba invadens
IVLCLFSTIGILLCFIMVAFNEK

SEQ ID NO: 2811322 - protein, 17 aa, Entamoeba invadens
IVPELNTLFGMVKFPTD

SEQ ID NO: 2811323 - protein, 19 aa, Entamoeba invadens
IVPICIMLTFSCIRELFDE

SEQ ID NO: 2811324 - protein, 28 aa, Entamoeba invadens
IVSFSFCCLACWCIFMLQPTFRCSVITP

SEQ ID NO: 2811325 - protein, 18 aa, Entamoeba invadens
IVTFPWLFGVMFSDCGHG

SEQ ID NO: 2811326 - protein, 18 aa, Entamoeba invadens
IVYPRRWYTFAIFIILGI

SEQ ID NO: 2811327 - protein, 19 aa, Entamoeba invadens
IVYQCLRGIQWVHNRYNLV

SEQ ID NO: 2811328 - protein, 19 aa, Entamoeba invadens
IVYRAKWRKVEIAVKVLKT

SEQ ID NO: 2811329 - protein, 19 aa, Entamoeba invadens
IWGLWRIVQYYAVNPTRRL

SEQ ID NO: 2811330 - protein, 20 aa, Entamoeba invadens
IWIARIWLEKTFKWFFSVSL

SEQ ID NO: 2811331 - protein, 18 aa, Entamoeba invadens
IWIFLVFASICFWMSHQF

SEQ ID NO: 2811332 - protein, 17 aa, Entamoeba invadens
IYCKLCPAGTYSIELGS

SEQ ID NO: 2811333 - protein, 18 aa, Entamoeba invadens
IYCPCFTANCLIYMRNEK

SEQ ID NO: 2811334 - protein, 20 aa, Entamoeba invadens
IYCQRRIRLFVSYSKYSFRL

SEQ ID NO: 2811335 - protein, 25 aa, Entamoeba invadens
IYDTMLLRIRINGVIASDKFDFMFN

SEQ ID NO: 2811336 - protein, 24 aa, Entamoeba invadens
IYFTRFCQLLAFYGPKVAPKMSFI

SEQ ID NO: 2811337 - protein, 18 aa, Entamoeba invadens
IYLGAAFVFWVLFNVKVF

SEQ ID NO: 2811338 - protein, 17 aa, Entamoeba invadens
IYMGGYFYIYWSGSVEL

SEQ ID NO: 2811339 - protein, 24 aa, Entamoeba invadens
IYPKSEFKFAWSIADYVTSGKRKE

SEQ ID NO: 2811340 - protein, 22 aa, Entamoeba invadens
IYRMVICPVVSWVSIYMLYKYQ

SEQ ID NO: 2811341 - protein, 21 aa, Entamoeba invadens
KAFEFAKGWFGQAVASMTAQP

SEQ ID NO: 2811342 - protein, 17 aa, Entamoeba invadens
KAGDVVFVLKIGVDTVG

SEQ ID NO: 2811343 - protein, 23 aa, Entamoeba invadens
KAIEIRKTLGLKYVVVLASSQNV

SEQ ID NO: 2811344 - protein, 18 aa, Entamoeba invadens
KAKVVGVCKFIEKMILEG

SEQ ID NO: 2811345 - protein, 20 aa, Entamoeba invadens
KANRCLFCSKGYHLQTNGTC

SEQ ID NO: 2811346 - protein, 20 aa, Entamoeba invadens
KANRCLSCSKGYHLQTNGTC

SEQ ID NO: 2811347 - protein, 17 aa, Entamoeba invadens
KAQEPIYMFSFGPAPVV

SEQ ID NO: 2811348 - protein, 17 aa, Entamoeba invadens
KAVVCARCSPQQKTKVV

SEQ ID NO: 2811349 - protein, 17 aa, Entamoeba invadens
KCANKFLLRDGLCVSDA

SEQ ID NO: 2811350 - protein, 20 aa, Entamoeba invadens
KCAVTYRFETNPSFTSKGSP

SEQ ID NO: 2811351 - protein, 21 aa, Entamoeba invadens
KCCAQSLFLNCMVYNSYLFVF

SEQ ID NO: 2811352 - protein, 17 aa, Entamoeba invadens
KCDECSFSYVLGKDKVS

SEQ ID NO: 2811353 - protein, 22 aa, Entamoeba invadens
KCECLEGFVLKDSVCTKCGNGV

SEQ ID NO: 2811354 - protein, 20 aa, Entamoeba invadens
KCESCPDINCNLCDETKSSK

SEQ ID NO: 2811355 - protein, 18 aa, Entamoeba invadens
KCFKCLDGFYLVSGQCAL

SEQ ID NO: 2811356 - protein, 20 aa, Entamoeba invadens
KCFQCKNSLVLYEWTDETNN

SEQ ID NO: 2811357 - protein, 20 aa, Entamoeba invadens
KCFSDCFICTDFNYRPQLFN

SEQ ID NO: 2811358 - protein, 20 aa, Entamoeba invadens
KCGFSWIPVVIIVLIFGCLF

SEQ ID NO: 2811359 - protein, 19 aa, Entamoeba invadens
KCIQCFSISCGVCSKTTGE

SEQ ID NO: 2811360 - protein, 22 aa, Entamoeba invadens
KCITVPLNMFWKNNITFICSEG

SEQ ID NO: 2811361 - protein, 18 aa, Entamoeba invadens
KCKVCAVDKCYQCQENKY

SEQ ID NO: 2811362 - protein, 20 aa, Entamoeba invadens
KCLFYFEWIPVIVLLLTIIV

SEQ ID NO: 2811363 - protein, 17 aa, Entamoeba invadens
KCLICAAGYGFDNGVCT

SEQ ID NO: 2811364 - protein, 17 aa, Entamoeba invadens
KCLKCKEGSYLSGDVCI

SEQ ID NO: 2811365 - protein, 17 aa, Entamoeba invadens
KCLKFWSGHCVECYAGY

SEQ ID NO: 2811366 - protein, 17 aa, Entamoeba invadens
KCLLESNFVPTCGNGGY

SEQ ID NO: 2811367 - protein, 18 aa, Entamoeba invadens
KCLSCLSGAFLTDNVCNT

SEQ ID NO: 2811368 - protein, 19 aa, Entamoeba invadens
KCLSCSFDNCNICNQNKCL

SEQ ID NO: 2811369 - protein, 19 aa, Entamoeba invadens
KCLTCREGYELTTLGTCTP

SEQ ID NO: 2811370 - protein, 17 aa, Entamoeba invadens
KCLTCYAGYGFGHNGNC

SEQ ID NO: 2811371 - protein, 24 aa, Entamoeba invadens
KCQKCSVSGCKRCSDGETCDMCNG

SEQ ID NO: 2811372 - protein, 26 aa, Entamoeba invadens
KCSDTKCLVCTSLQCVLCANDYILNG

SEQ ID NO: 2811373 - protein, 19 aa, Entamoeba invadens
KCSETFLNCDICDSKGCQQ

SEQ ID NO: 2811374 - protein, 18 aa, Entamoeba invadens
KCSFWYRPNEYGIRCNSH

SEQ ID NO: 2811375 - protein, 18 aa, Entamoeba invadens
KCTKGVLDLNGFCTLNSG

SEQ ID NO: 2811376 - protein, 17 aa, Entamoeba invadens
KCVLCKIGYVLNEQSEC

SEQ ID NO: 2811377 - protein, 23 aa, Entamoeba invadens
KCVYPNVWCPLSVLTEPFTGEEV

SEQ ID NO: 2811378 - protein, 17 aa, Entamoeba invadens
KDAVPFIFVTLFALFIL

SEQ ID NO: 2811379 - protein, 18 aa, Entamoeba invadens
KDCFYKPYVESVALPSLF

SEQ ID NO: 2811380 - protein, 19 aa, Entamoeba invadens
KDFFIMVAIHFTIGLFLIN

SEQ ID NO: 2811381 - protein, 20 aa, Entamoeba invadens
KDGCVLCDFGYLLVQQNGVS

SEQ ID NO: 2811382 - protein, 21 aa, Entamoeba invadens
KDGFFKLRLDCEFCDKSCKQC

SEQ ID NO: 2811383 - protein, 19 aa, Entamoeba invadens
KDGLKGGGVMSIYYQINMR

SEQ ID NO: 2811384 - protein, 21 aa, Entamoeba invadens
KDGYYRYGLQCFSCNIKCSTC

SEQ ID NO: 2811385 - protein, 23 aa, Entamoeba invadens
KDIYPKDRFKFAWNIVDFVVSGK

SEQ ID NO: 2811386 - protein, 17 aa, Entamoeba invadens
KDKCLRCNDGFVFEGNN

SEQ ID NO: 2811387 - protein, 20 aa, Entamoeba invadens
KDNYRFGKWIKIKSTDFSTK

SEQ ID NO: 2811388 - protein, 24 aa, Entamoeba invadens
KDRDCVFMFISWCLMLSALSVVNG

SEQ ID NO: 2811389 - protein, 20 aa, Entamoeba invadens
KDSKCTKCAFWFIPSPSGTS

SEQ ID NO: 2811390 - protein, 17 aa, Entamoeba invadens
KDVFKYPWDIAAFVTNG

SEQ ID NO: 2811391 - protein, 17 aa, Entamoeba invadens
KDVPIFIMRVGLGKNFT

SEQ ID NO: 2811392 - protein, 17 aa, Entamoeba invadens
KEAILWLIGGVQQYLGA

SEQ ID NO: 2811393 - protein, 27 aa, Entamoeba invadens
KEAYKGLKFKFAWNIADFIIKGKRLEN

SEQ ID NO: 2811394 - protein, 17 aa, Entamoeba invadens
KECVSGYVLYGGSCSIK

SEQ ID NO: 2811395 - protein, 22 aa, Entamoeba invadens
KEDFKFVWSIADFVSGGKRLQN

SEQ ID NO: 2811396 - protein, 18 aa, Entamoeba invadens
KEECDGGHNCVIDECKCA

SEQ ID NO: 2811397 - protein, 20 aa, Entamoeba invadens
KEEFKFPWKIAEFVMNGKHP

SEQ ID NO: 2811398 - protein, 17 aa, Entamoeba invadens
KEFFYQFCYSFIGDTVG

SEQ ID NO: 2811399 - protein, 19 aa, Entamoeba invadens
KEFILSFLLGQHFMYFFTH

SEQ ID NO: 2811400 - protein, 21 aa, Entamoeba invadens
KEFKFPWKIAEFVISGKRLDK

SEQ ID NO: 2811401 - protein, 17 aa, Entamoeba invadens
KEFVLGFLHTSDLIEWS

SEQ ID NO: 2811402 - protein, 18 aa, Entamoeba invadens
KEGDCKRTSLTTTNFIQR

SEQ ID NO: 2811403 - protein, 18 aa, Entamoeba invadens
KEGFCKKLIPAALIQYVE

SEQ ID NO: 2811404 - protein, 19 aa, Entamoeba invadens
KEGFRTLLFAKREITETYF

SEQ ID NO: 2811405 - protein, 19 aa, Entamoeba invadens
KEGLSWKPLFMYTRFLVTK

SEQ ID NO: 2811406 - protein, 20 aa, Entamoeba invadens
KEGSSFVFWKRFSVSQRSTF

SEQ ID NO: 2811407 - protein, 21 aa, Entamoeba invadens
KEGTCSVCGTSCNKCYNKDTC

SEQ ID NO: 2811408 - protein, 19 aa, Entamoeba invadens
KEGYFRKEFDCVKCDDECE

SEQ ID NO: 2811409 - protein, 20 aa, Entamoeba invadens
KEIFGWRNFMFFAAGTLVLF

SEQ ID NO: 2811410 - protein, 18 aa, Entamoeba invadens
KEIIAWILLIEYIVRLFV

SEQ ID NO: 2811411 - protein, 17 aa, Entamoeba invadens
KEIRFGNAVTKLAGNAF

SEQ ID NO: 2811412 - protein, 20 aa, Entamoeba invadens
KEKFKHAWDVANFITTDKRP

SEQ ID NO: 2811413 - protein, 24 aa, Entamoeba invadens
KEKLLECWRYSGVTKTACGFYRSA

SEQ ID NO: 2811414 - protein, 17 aa, Entamoeba invadens
KEMFGMFMMSYAPLTKE

SEQ ID NO: 2811415 - protein, 20 aa, Entamoeba invadens
KENIKWFLEIGMKYIMIEIV

SEQ ID NO: 2811416 - protein, 24 aa, Entamoeba invadens
KEPFPKILFPYAWSVADFVTSGQM

SEQ ID NO: 2811417 - protein, 21 aa, Entamoeba invadens
KEPKSVCTMGDFKRYSETSQT

SEQ ID NO: 2811418 - protein, 23 aa, Entamoeba invadens
KERCDSLVIPLHFPQQAKQSKST

SEQ ID NO: 2811419 - protein, 22 aa, Entamoeba invadens
KERFRFPWKIAEFVMSGKRLEK

SEQ ID NO: 2811420 - protein, 21 aa, Entamoeba invadens
KERKRGGCLITVYCRDTDAKF

SEQ ID NO: 2811421 - protein, 21 aa, Entamoeba invadens
KETFRYPWKIAEFVTSGKHLE

SEQ ID NO: 2811422 - protein, 22 aa, Entamoeba invadens
KETYRPYLYLSMTSLSYSTKVL

SEQ ID NO: 2811423 - protein, 24 aa, Entamoeba invadens
KEVKRILWVIAFRSCMNFIVWAIP

SEQ ID NO: 2811424 - protein, 17 aa, Entamoeba invadens
KEVPKFCAVACEDGGIR

SEQ ID NO: 2811425 - protein, 18 aa, Entamoeba invadens
KEVRAVFEINWKRIFNWL

SEQ ID NO: 2811426 - protein, 20 aa, Entamoeba invadens
KEVVWWLILIIVIVFLIILI

SEQ ID NO: 2811427 - protein, 18 aa, Entamoeba invadens
KEWKCTFPGCTEGPKTKY

SEQ ID NO: 2811428 - protein, 18 aa, Entamoeba invadens
KEYKCVFPGCSEGLKTKY

SEQ ID NO: 2811429 - protein, 19 aa, Entamoeba invadens
KEYNKRIGMEALKTMFISQ

SEQ ID NO: 2811430 - protein, 17 aa, Entamoeba invadens
KFACEFSLFLNPLCTST

SEQ ID NO: 2811431 - protein, 23 aa, Entamoeba invadens
KFCGWRVVILFGSFWGLVPVIST

SEQ ID NO: 2811432 - protein, 18 aa, Entamoeba invadens
KFDFCLPISPSLYPNCKR

SEQ ID NO: 2811433 - protein, 20 aa, Entamoeba invadens
KFDIKICYIPTLVGVVFTLF

SEQ ID NO: 2811434 - protein, 23 aa, Entamoeba invadens
KFEVTLCVGCFYALKSITDVSQY

SEQ ID NO: 2811435 - protein, 25 aa, Entamoeba invadens
KFFLAESALNFSIYFFGAKFGQLTK

SEQ ID NO: 2811436 - protein, 17 aa, Entamoeba invadens
KFFRIVISDGFFVGYGL

SEQ ID NO: 2811437 - protein, 22 aa, Entamoeba invadens
KFFYFPRFVLIILLESFVVNLY

SEQ ID NO: 2811438 - protein, 22 aa, Entamoeba invadens
KFIEISVAFSLFFGALFAGLCP

SEQ ID NO: 2811439 - protein, 19 aa, Entamoeba invadens
KFNCSICPTGTYANSTNNK

SEQ ID NO: 2811440 - protein, 23 aa, Entamoeba invadens
KFSEIFFDLRIWAGCPIDIQVYI

SEQ ID NO: 2811441 - protein, 24 aa, Entamoeba invadens
KFTKFSFFFSFFFRFQETDNLFEI

SEQ ID NO: 2811442 - protein, 17 aa, Entamoeba invadens
KFTKRWNFLWTLVFYSG

SEQ ID NO: 2811443 - protein, 23 aa, Entamoeba invadens
KGCLRCLSGYYLADRMCVKCEYP

SEQ ID NO: 2811444 - protein, 20 aa, Entamoeba invadens
KGCSKLITFNGFEKINSFGI

SEQ ID NO: 2811445 - protein, 22 aa, Entamoeba invadens
KGCTPFCGVCPMGQVCTTSGVC

SEQ ID NO: 2811446 - protein, 18 aa, Entamoeba invadens
KGGCVICSSGYYLEDKEC

SEQ ID NO: 2811447 - protein, 20 aa, Entamoeba invadens
KGGEIARALLWCVSNVSSEG

SEQ ID NO: 2811448 - protein, 20 aa, Entamoeba invadens
KGIFKWGFLLGIFEGINVFI

SEQ ID NO: 2811449 - protein, 18 aa, Entamoeba invadens
KGISCSRGVCLSTNNELV

SEQ ID NO: 2811450 - protein, 17 aa, Entamoeba invadens
KGKEEFTKPLGLRTAPF

SEQ ID NO: 2811451 - protein, 21 aa, Entamoeba invadens
KGKFKHAWDIANFVTSGQRPE

SEQ ID NO: 2811452 - protein, 19 aa, Entamoeba invadens
KGKVFLFCYAPIILVTTSA

SEQ ID NO: 2811453 - protein, 17 aa, Entamoeba invadens
KGLPQSFINRFTSVYVN

SEQ ID NO: 2811454 - protein, 17 aa, Entamoeba invadens
KGLWYSFKGTGEAVVVD

SEQ ID NO: 2811455 - protein, 19 aa, Entamoeba invadens
KGPFCYTAFYFPYYSFFVG

SEQ ID NO: 2811456 - protein, 18 aa, Entamoeba invadens
KGRFRDVVDIQKVEELWR

SEQ ID NO: 2811457 - protein, 19 aa, Entamoeba invadens
KGRSFPCKCRKCTKQALPN

SEQ ID NO: 2811458 - protein, 19 aa, Entamoeba invadens
KGSLLPRMVVTLKKEYMYM

SEQ ID NO: 2811459 - protein, 19 aa, Entamoeba invadens
KGTCARLTVDLHKTIESET

SEQ ID NO: 2811460 - protein, 24 aa, Entamoeba invadens
KGTECFKCPVGVELCVFTQNVVQP

SEQ ID NO: 2811461 - protein, 20 aa, Entamoeba invadens
KGVFYYSFFDLVFMNDKGDP

SEQ ID NO: 2811462 - protein, 20 aa, Entamoeba invadens
KGVFYYSYFDFVYMDDKGDP

SEQ ID NO: 2811463 - protein, 20 aa, Entamoeba invadens
KGYYNKGFECIPCLSNCDSC

SEQ ID NO: 2811464 - protein, 21 aa, Entamoeba invadens
KHCPCFGELCTIHFDNTDQFY

SEQ ID NO: 2811465 - protein, 18 aa, Entamoeba invadens
KHEFKFPWKIAEFVMGGN

SEQ ID NO: 2811466 - protein, 20 aa, Entamoeba invadens
KHSWVLLNILLKAMIVMIHN

SEQ ID NO: 2811467 - protein, 22 aa, Entamoeba invadens
KHVFYRKQVCCGVCDMCMGAVV

SEQ ID NO: 2811468 - protein, 25 aa, Entamoeba invadens
KIEFGEAVAFIAAWFCQLPVYWEEP

SEQ ID NO: 2811469 - protein, 22 aa, Entamoeba invadens
KIEFKYPWKIADFVTGGNRLNK

SEQ ID NO: 2811470 - protein, 18 aa, Entamoeba invadens
KIEIVWIIEKFIRHLVDT

SEQ ID NO: 2811471 - protein, 20 aa, Entamoeba invadens
KIELPFPLKNGHFLVFTIQE

SEQ ID NO: 2811472 - protein, 17 aa, Entamoeba invadens
KIGKYFLYFSVFFTGFT

SEQ ID NO: 2811473 - protein, 22 aa, Entamoeba invadens
KIGKYVRYGLCRNIEDDETDAF

SEQ ID NO: 2811474 - protein, 17 aa, Entamoeba invadens
KIIEFIKGFGWKLWVLA

SEQ ID NO: 2811475 - protein, 17 aa, Entamoeba invadens
KIKEFLRWEFKRNDKIS

SEQ ID NO: 2811476 - protein, 18 aa, Entamoeba invadens
KILNDFAVALAFIHENEF

SEQ ID NO: 2811477 - protein, 23 aa, Entamoeba invadens
KISKRGGVIFLRFENLNDSAYFR

SEQ ID NO: 2811478 - protein, 22 aa, Entamoeba invadens
KIVLHQCNFCDLEFPKTVEIVE

SEQ ID NO: 2811479 - protein, 22 aa, Entamoeba invadens
KKAIRYPYRYGMNQECLSQLFS

SEQ ID NO: 2811480 - protein, 17 aa, Entamoeba invadens
KKAKFIIIYAVLGIALV

SEQ ID NO: 2811481 - protein, 17 aa, Entamoeba invadens
KKARYPFIKMFSLSLCA

SEQ ID NO: 2811482 - protein, 19 aa, Entamoeba invadens
KKCGVANCKMCNNAETCEE

SEQ ID NO: 2811483 - protein, 19 aa, Entamoeba invadens
KKCYDCFEGFILKKINAML

SEQ ID NO: 2811484 - protein, 18 aa, Entamoeba invadens
KKGFEWYFGMIIGIVALV

SEQ ID NO: 2811485 - protein, 17 aa, Entamoeba invadens
KKHRVELEMERLGIEKV

SEQ ID NO: 2811486 - protein, 18 aa, Entamoeba invadens
KKIYPKRMETYLVPFSSE

SEQ ID NO: 2811487 - protein, 18 aa, Entamoeba invadens
KKKCWDLFINIVSDVAPV

SEQ ID NO: 2811488 - protein, 24 aa, Entamoeba invadens
KKKKIEIIRSFILWLRKSYITGVV

SEQ ID NO: 2811489 - protein, 19 aa, Entamoeba invadens
KKKNCGYCITCQLRSDDII

SEQ ID NO: 2811490 - protein, 19 aa, Entamoeba invadens
KKKVLTFVVYCCLILPLIM

SEQ ID NO: 2811491 - protein, 21 aa, Entamoeba invadens
KKLDVGTVFACIAYFNCIRVP

SEQ ID NO: 2811492 - protein, 18 aa, Entamoeba invadens
KKLEAFPLMFSTGASVSW

SEQ ID NO: 2811493 - protein, 22 aa, Entamoeba invadens
KKLKDFLIFRVMKVTWKKSQFF

SEQ ID NO: 2811494 - protein, 25 aa, Entamoeba invadens
KKLWNFNWCSAFGIICSHFYYYSYN

SEQ ID NO: 2811495 - protein, 19 aa, Entamoeba invadens
KKRLNFFKLFQFMKKDEVT

SEQ ID NO: 2811496 - protein, 26 aa, Entamoeba invadens
KKTKSGCLRPEWDVSFGSWEETINEV

SEQ ID NO: 2811497 - protein, 18 aa, Entamoeba invadens
KKTLRKCCCCVIPYHLKT

SEQ ID NO: 2811498 - protein, 18 aa, Entamoeba invadens
KKVLRYLVDLMKDSDVLK

SEQ ID NO: 2811499 - protein, 26 aa, Entamoeba invadens
KLCPEIVWTPSMKRLFCLIVECVKNK

SEQ ID NO: 2811500 - protein, 22 aa, Entamoeba invadens
KLEFKFPWKIAEYVISGKRLPK

SEQ ID NO: 2811501 - protein, 18 aa, Entamoeba invadens
KLFVWPLKKVDTIEKVPK

SEQ ID NO: 2811502 - protein, 18 aa, Entamoeba invadens
KLGFAVLVEKDWLAFGHQ

SEQ ID NO: 2811503 - protein, 17 aa, Entamoeba invadens
KLIYLRVHFYEMKLLLC

SEQ ID NO: 2811504 - protein, 19 aa, Entamoeba invadens
KLKIRMLFDTARGMQFLHE

SEQ ID NO: 2811505 - protein, 20 aa, Entamoeba invadens
KLKNILLFRVFGYKGTLVHV

SEQ ID NO: 2811506 - protein, 17 aa, Entamoeba invadens
KLKRMTFRLITDKIVQI

SEQ ID NO: 2811507 - protein, 18 aa, Entamoeba invadens
KLLFILLIVGAVFIVLAV

SEQ ID NO: 2811508 - protein, 18 aa, Entamoeba invadens
KLLSVKTRVVVIWNSNIE

SEQ ID NO: 2811509 - protein, 22 aa, Entamoeba invadens
KLRIKICLDAAMGVQYLHSNGI

SEQ ID NO: 2811510 - protein, 22 aa, Entamoeba invadens
KLRIKMCLDCAQGILYLHENGI

SEQ ID NO: 2811511 - protein, 20 aa, Entamoeba invadens
KLRVLYKLNWLQASDLDDIH

SEQ ID NO: 2811512 - protein, 17 aa, Entamoeba invadens
KLSNFGIQNRFMSTENN

SEQ ID NO: 2811513 - protein, 17 aa, Entamoeba invadens
KLVKLVDSVVCCRVTPK

SEQ ID NO: 2811514 - protein, 17 aa, Entamoeba invadens
KLWGYRALSALLLYLVI

SEQ ID NO: 2811515 - protein, 24 aa, Entamoeba invadens
KLYLCGWCFCCPRTCPAVTDLICC

SEQ ID NO: 2811516 - protein, 24 aa, Entamoeba invadens
KLYWDGLCDWVLFTGECCENLHTY

SEQ ID NO: 2811517 - protein, 22 aa, Entamoeba invadens
KMEFKFPWKIAEFVISGKRLPK

SEQ ID NO: 2811518 - protein, 19 aa, Entamoeba invadens
KMGIWGCLICEPGYYIDGN

SEQ ID NO: 2811519 - protein, 21 aa, Entamoeba invadens
KMIDCWSSFVLPEEEWSLESK

SEQ ID NO: 2811520 - protein, 18 aa, Entamoeba invadens
KMKLFGIFVCINVIFVVF

SEQ ID NO: 2811521 - protein, 19 aa, Entamoeba invadens
KMLATCLGYFFAEVLLFVP

SEQ ID NO: 2811522 - protein, 18 aa, Entamoeba invadens
KMMKEFIKEVSMLDKFRN

SEQ ID NO: 2811523 - protein, 20 aa, Entamoeba invadens
KMRVEPPIVCIRKGEICEFK

SEQ ID NO: 2811524 - protein, 20 aa, Entamoeba invadens
KMWAIICCLCCILLLVIFLA

SEQ ID NO: 2811525 - protein, 18 aa, Entamoeba invadens
KNCLICPASYYSSGGTSL

SEQ ID NO: 2811526 - protein, 19 aa, Entamoeba invadens
KNENDLFVLPSFFNHVHLR

SEQ ID NO: 2811527 - protein, 20 aa, Entamoeba invadens
KNGKCPVCVDGYFNTPARVC

SEQ ID NO: 2811528 - protein, 18 aa, Entamoeba invadens
KNIMKWGPILSFIGAANT

SEQ ID NO: 2811529 - protein, 22 aa, Entamoeba invadens
KNKCVLCKSGFLLSENGECLTS

SEQ ID NO: 2811530 - protein, 24 aa, Entamoeba invadens
KNKWSLFCSFEFLLLGFGNSTFFV

SEQ ID NO: 2811531 - protein, 17 aa, Entamoeba invadens
KNMCKKCALNFAQNFTS

SEQ ID NO: 2811532 - protein, 23 aa, Entamoeba invadens
KNNRCFKCALGYTLNKRTCEKIT

SEQ ID NO: 2811533 - protein, 20 aa, Entamoeba invadens
KNPRLFCGIFEEFLRNSAED

SEQ ID NO: 2811534 - protein, 19 aa, Entamoeba invadens
KNRDCVFMFISWCATLSSL

SEQ ID NO: 2811535 - protein, 19 aa, Entamoeba invadens
KNSKCVKCSFWNTPNDDGT

SEQ ID NO: 2811536 - protein, 19 aa, Entamoeba invadens
KNSKCVQCDLSFYNLNHTC

SEQ ID NO: 2811537 - protein, 20 aa, Entamoeba invadens
KNSRLDSFIRYAVQKKPFIE

SEQ ID NO: 2811538 - protein, 22 aa, Entamoeba invadens
KNVFKTILFRMAMKQIMKGQKG

SEQ ID NO: 2811539 - protein, 19 aa, Entamoeba invadens
KNVSWYLGYIVDVCIPFLS

SEQ ID NO: 2811540 - protein, 18 aa, Entamoeba invadens
KNWLCIFPGCTQKPMCHY

SEQ ID NO: 2811541 - protein, 17 aa, Entamoeba invadens
KPEAFPLMFSTGASVSW

SEQ ID NO: 2811542 - protein, 24 aa, Entamoeba invadens
KPKNFNVWLQRVFHKEVNASNEWN

SEQ ID NO: 2811543 - protein, 22 aa, Entamoeba invadens
KPNWPSNGSIEFRNYGFRYRDT

SEQ ID NO: 2811544 - protein, 23 aa, Entamoeba invadens
KPNYSVAEPLTWGKGMKKDFFKC

SEQ ID NO: 2811545 - protein, 18 aa, Entamoeba invadens
KPPVCMTNFLALNYESKT

SEQ ID NO: 2811546 - protein, 21 aa, Entamoeba invadens
KPSFLRRSVVVFSIISTSGLL

SEQ ID NO: 2811547 - protein, 22 aa, Entamoeba invadens
KPVVLKLRVKFMLDAAKGILYL

SEQ ID NO: 2811548 - protein, 19 aa, Entamoeba invadens
KQFIPSGGCVKCIDGYYRS

SEQ ID NO: 2811549 - protein, 18 aa, Entamoeba invadens
KQFKFAWDIVDFVVNGKR

SEQ ID NO: 2811550 - protein, 20 aa, Entamoeba invadens
KQFKFSWDIADFVVAGKRLE

SEQ ID NO: 2811551 - protein, 24 aa, Entamoeba invadens
KQKYRIGKWFKFEMNESIVEQLIL

SEQ ID NO: 2811552 - protein, 22 aa, Entamoeba invadens
KQKYRIGKWFKYDMDNLTTDVV

SEQ ID NO: 2811553 - protein, 19 aa, Entamoeba invadens
KQLLLCILAMFISQLSTLI

SEQ ID NO: 2811554 - protein, 23 aa, Entamoeba invadens
KQMKTIRACYVFRAHMVGAGLGV

SEQ ID NO: 2811555 - protein, 17 aa, Entamoeba invadens
KQYRLVIFVAEVPQNSM

SEQ ID NO: 2811556 - protein, 18 aa, Entamoeba invadens
KRAMWWKNVKLYLIAGAV

SEQ ID NO: 2811557 - protein, 19 aa, Entamoeba invadens
KRFKFAWDIVDFVVSGKRL

SEQ ID NO: 2811558 - protein, 19 aa, Entamoeba invadens
KRGSISFSKPMMVPTINGI

SEQ ID NO: 2811559 - protein, 21 aa, Entamoeba invadens
KRHAEVLKRIGALNKNGTKKA

SEQ ID NO: 2811560 - protein, 19 aa, Entamoeba invadens
KRLCVCPNPGFTEQLQKFK

SEQ ID NO: 2811561 - protein, 19 aa, Entamoeba invadens
KRLELMLERIIKREERNSK

SEQ ID NO: 2811562 - protein, 20 aa, Entamoeba invadens
KRLSKKMCLFKISHSNVEFL

SEQ ID NO: 2811563 - protein, 17 aa, Entamoeba invadens
KRPADVYSFAMTMYECF

SEQ ID NO: 2811564 - protein, 24 aa, Entamoeba invadens
KRPSSVSSRFCWILIFVLLNSLLV

SEQ ID NO: 2811565 - protein, 21 aa, Entamoeba invadens
KRPTFEVIDEFLLKFFDEQLQ

SEQ ID NO: 2811566 - protein, 20 aa, Entamoeba invadens
KRSENVFGFVCDDQLCLMHL

SEQ ID NO: 2811567 - protein, 23 aa, Entamoeba invadens
KRSNRCFKCSKGYLLVAGSCQKS

SEQ ID NO: 2811568 - protein, 17 aa, Entamoeba invadens
KRTSWEFSTWYMKCLEW

SEQ ID NO: 2811569 - protein, 25 aa, Entamoeba invadens
KRWRIIPSLLCLSAMFFCQSLTRLF

SEQ ID NO: 2811570 - protein, 19 aa, Entamoeba invadens
KRYYFCLPIYTLNINNCKR

SEQ ID NO: 2811571 - protein, 19 aa, Entamoeba invadens
KSADVCSIYTLPEDATEKQ

SEQ ID NO: 2811572 - protein, 18 aa, Entamoeba invadens
KSAQKWFVIGGHFLGIGM

SEQ ID NO: 2811573 - protein, 19 aa, Entamoeba invadens
KSAQKWFVIGGHFLGIGMG

SEQ ID NO: 2811574 - protein, 17 aa, Entamoeba invadens
KSECAICSKSYFRNGTS

SEQ ID NO: 2811575 - protein, 24 aa, Entamoeba invadens
KSEWLRIRATPAFWLKKGTLVVKP

SEQ ID NO: 2811576 - protein, 24 aa, Entamoeba invadens
KSFFPSFLGWELYQIVTWYIIFSI

SEQ ID NO: 2811577 - protein, 18 aa, Entamoeba invadens
KSFFRKYWPWLLGAGVLF

SEQ ID NO: 2811578 - protein, 24 aa, Entamoeba invadens
KSGCLLCAGGYYLGTTVPRCIKCS

SEQ ID NO: 2811579 - protein, 24 aa, Entamoeba invadens
KSGCLLCAGGYYLGTVIPRCIKCS

SEQ ID NO: 2811580 - protein, 19 aa, Entamoeba invadens
KSGETIYVFVGAYKNTEDG

SEQ ID NO: 2811581 - protein, 19 aa, Entamoeba invadens
KSGKCAIMLFSSTQQTCVK

SEQ ID NO: 2811582 - protein, 19 aa, Entamoeba invadens
KSGKCSISLVLDKETSVSL

SEQ ID NO: 2811583 - protein, 19 aa, Entamoeba invadens
KSGNCFTCAEGLHLDGTRS

SEQ ID NO: 2811584 - protein, 18 aa, Entamoeba invadens
KSGVCLSCYAGSKLSEGT

SEQ ID NO: 2811585 - protein, 17 aa, Entamoeba invadens
KSICDVCGVDGSFRMRV

SEQ ID NO: 2811586 - protein, 17 aa, Entamoeba invadens
KSISWLFIIRICSMLIL

SEQ ID NO: 2811587 - protein, 21 aa, Entamoeba invadens
KSIVNSVMWGRCVFDNIRKFL

SEQ ID NO: 2811588 - protein, 24 aa, Entamoeba invadens
KSKFIRPGVIAVRMTYSSFFSNKS

SEQ ID NO: 2811589 - protein, 23 aa, Entamoeba invadens
KSKKSPRFLALFSKTKSAKIILS

SEQ ID NO: 2811590 - protein, 18 aa, Entamoeba invadens
KSLGLYERRCDYVNDIYV

SEQ ID NO: 2811591 - protein, 17 aa, Entamoeba invadens
KSNCEICTVYNGDCMKC

SEQ ID NO: 2811592 - protein, 18 aa, Entamoeba invadens
KSNCLLCKVNYQINSLFG

SEQ ID NO: 2811593 - protein, 18 aa, Entamoeba invadens
KSNCLLCKVNYQINSSFG

SEQ ID NO: 2811594 - protein, 20 aa, Entamoeba invadens
KSNKCGICYEMVGLSGTLRF

SEQ ID NO: 2811595 - protein, 26 aa, Entamoeba invadens
KSNLWSLFCSFEYFLLGFGHTTYMTI

SEQ ID NO: 2811596 - protein, 25 aa, Entamoeba invadens
KSNRCLKCMNGFYIRNGVCEPIEKC

SEQ ID NO: 2811597 - protein, 20 aa, Entamoeba invadens
KSQFKYSWKIAEFVNDGNRP

SEQ ID NO: 2811598 - protein, 19 aa, Entamoeba invadens
KSQGGRCLTCIEGYLLTKI

SEQ ID NO: 2811599 - protein, 22 aa, Entamoeba invadens
KSQSGCLLCDTGFYIDNQRCLP

SEQ ID NO: 2811600 - protein, 24 aa, Entamoeba invadens
KSQSGCLLCNTGFYIDNQKCLPCN

SEQ ID NO: 2811601 - protein, 24 aa, Entamoeba invadens
KSSNWKIGLVVGGLILVLVILLIL

SEQ ID NO: 2811602 - protein, 18 aa, Entamoeba invadens
KSVEFCLSANNSKCTECE

SEQ ID NO: 2811603 - protein, 21 aa, Entamoeba invadens
KSVKFTEDYGRIVVNNGAVLT

SEQ ID NO: 2811604 - protein, 26 aa, Entamoeba invadens
KSVRGCIKCSFGYFIENQFCSSCDSK

SEQ ID NO: 2811605 - protein, 19 aa, Entamoeba invadens
KSWEFGNTITLTYVSEPGG

SEQ ID NO: 2811606 - protein, 17 aa, Entamoeba invadens
KSWYSFVLSSFVGVIYT

SEQ ID NO: 2811607 - protein, 20 aa, Entamoeba invadens
KTDALHLFGPVPILLLGCIV

SEQ ID NO: 2811608 - protein, 24 aa, Entamoeba invadens
KTELLLKCIITFPVNSNMIQEQAK

SEQ ID NO: 2811609 - protein, 25 aa, Entamoeba invadens
KTEMWWKNVKLWIILGVVVAIIVIA

SEQ ID NO: 2811610 - protein, 20 aa, Entamoeba invadens
KTIKCAIGYFIKSNKCENCG

SEQ ID NO: 2811611 - protein, 23 aa, Entamoeba invadens
KTKRGICVMSLISTFLLSRIIML

SEQ ID NO: 2811612 - protein, 19 aa, Entamoeba invadens
KTKYNCISHVWNIHLRNIN

SEQ ID NO: 2811613 - protein, 19 aa, Entamoeba invadens
KTRAYIVMMIFRIIFGVLA

SEQ ID NO: 2811614 - protein, 20 aa, Entamoeba invadens
KTTFPWIIADKICKGERPSL

SEQ ID NO: 2811615 - protein, 20 aa, Entamoeba invadens
KTVTFLPAFDAYGMDIYPVN

SEQ ID NO: 2811616 - protein, 20 aa, Entamoeba invadens
KTWKILVGIIYRMVICPVVS

SEQ ID NO: 2811617 - protein, 25 aa, Entamoeba invadens
KTYDRCLYCTTGVLINESCFNYTAI

SEQ ID NO: 2811618 - protein, 18 aa, Entamoeba invadens
KVCQCTNCRCKTVQQYDP

SEQ ID NO: 2811619 - protein, 20 aa, Entamoeba invadens
KVDFKFPWKIAEFVISGKRL

SEQ ID NO: 2811620 - protein, 22 aa, Entamoeba invadens
KVFKYKIVKEFIFNPETTLEVH

SEQ ID NO: 2811621 - protein, 18 aa, Entamoeba invadens
KVGEIFKKFIPFFKSYFL

SEQ ID NO: 2811622 - protein, 25 aa, Entamoeba invadens
KVGYIWLLVCCLVLSDVLVFFFILG

SEQ ID NO: 2811623 - protein, 22 aa, Entamoeba invadens
KVHTTFPFKLLVTGGNFLFMET

SEQ ID NO: 2811624 - protein, 18 aa, Entamoeba invadens
KVKFCLDGAKGVFYLHEN

SEQ ID NO: 2811625 - protein, 24 aa, Entamoeba invadens
KVKYCITQLFSLSALWALFSSFSY

SEQ ID NO: 2811626 - protein, 17 aa, Entamoeba invadens
KVLECLEHYYGINNKCI

SEQ ID NO: 2811627 - protein, 17 aa, Entamoeba invadens
KVMKDIECGLHYLHEFK

SEQ ID NO: 2811628 - protein, 23 aa, Entamoeba invadens
KVPNGNGCLWLFMCKDGYYTVNG

SEQ ID NO: 2811629 - protein, 19 aa, Entamoeba invadens
KVRGFVWYALLLKPEDAND

SEQ ID NO: 2811630 - protein, 19 aa, Entamoeba invadens
KVRVPDCVSLKAFKSVYPN

SEQ ID NO: 2811631 - protein, 20 aa, Entamoeba invadens
KVSESFSMKCFNLFYGCYSR

SEQ ID NO: 2811632 - protein, 26 aa, Entamoeba invadens
KVSHCKKCRGGICFECDENYLLYDST

SEQ ID NO: 2811633 - protein, 17 aa, Entamoeba invadens
KVVACSLALAQIDAQYS

SEQ ID NO: 2811634 - protein, 20 aa, Entamoeba invadens
KWELKECYRLSVDKSQSYMY

SEQ ID NO: 2811635 - protein, 18 aa, Entamoeba invadens
KWQGLSIIFDTFKNGKLD

SEQ ID NO: 2811636 - protein, 22 aa, Entamoeba invadens
KWRDLLNIPVKWRQLSEPNDQV

SEQ ID NO: 2811637 - protein, 19 aa, Entamoeba invadens
KWSVWQINPDYSWKLFPPG

SEQ ID NO: 2811638 - protein, 20 aa, Entamoeba invadens
KWVLNCLEKIMLDITHSQLN

SEQ ID NO: 2811639 - protein, 19 aa, Entamoeba invadens
KYCRCFEGFKTDPNNPTSC

SEQ ID NO: 2811640 - protein, 19 aa, Entamoeba invadens
KYCSSSLCQQCYPGYYTQQ

SEQ ID NO: 2811641 - protein, 22 aa, Entamoeba invadens
KYDDRWTLKFCNITNVEVPEDV

SEQ ID NO: 2811642 - protein, 19 aa, Entamoeba invadens
KYDKMRCDEGYFKNGNSCI

SEQ ID NO: 2811643 - protein, 19 aa, Entamoeba invadens
KYEFGFCYLFTANKGTSYK

SEQ ID NO: 2811644 - protein, 21 aa, Entamoeba invadens
KYELFPVIVIFIIMCIVLYLF

SEQ ID NO: 2811645 - protein, 18 aa, Entamoeba invadens
KYFFCTLGGYIFGLLLTI

SEQ ID NO: 2811646 - protein, 22 aa, Entamoeba invadens
KYKGCGFITVGGFLFLRFITPI

SEQ ID NO: 2811647 - protein, 17 aa, Entamoeba invadens
KYKRPADVYSFAMTMYE

SEQ ID NO: 2811648 - protein, 18 aa, Entamoeba invadens
KYQISLYLIVLVVFFGFD

SEQ ID NO: 2811649 - protein, 25 aa, Entamoeba invadens
KYQISTLIKFCFYKNAAFFLVNMFY

SEQ ID NO: 2811650 - protein, 26 aa, Entamoeba invadens
KYTERKCWAYWQHLMFGYANLKDDFE

SEQ ID NO: 2811651 - protein, 20 aa, Entamoeba invadens
KYYKSIRFMVRYDSDDVKEI

SEQ ID NO: 2811652 - protein, 29 aa, Entamoeba invadens
LAFICAPSFLFCVLTLYFGIATDLITVIV

SEQ ID NO: 2811653 - protein, 22 aa, Entamoeba invadens
LAFKFPWKIAEFVVGGHRLDKP

SEQ ID NO: 2811654 - protein, 17 aa, Entamoeba invadens
LAFRALYRAVFYEKIFT

SEQ ID NO: 2811655 - protein, 18 aa, Entamoeba invadens
LAGLFLVCLSIIGMTLII

SEQ ID NO: 2811656 - protein, 17 aa, Entamoeba invadens
LALCLFFLVGCVRKTIL

SEQ ID NO: 2811657 - protein, 19 aa, Entamoeba invadens
LALQWCWERGVIQCFSDNV

SEQ ID NO: 2811658 - protein, 21 aa, Entamoeba invadens
LAMAIPEFLGYSALSLDTVKV

SEQ ID NO: 2811659 - protein, 18 aa, Entamoeba invadens
LATDKIIMVLIILCVVVI

SEQ ID NO: 2811660 - protein, 25 aa, Entamoeba invadens
LAWKKLDFGLGYSVRFINDFDNKNR

SEQ ID NO: 2811661 - protein, 21 aa, Entamoeba invadens
LCCICPAPSLSVIYSIEYQTA

SEQ ID NO: 2811662 - protein, 19 aa, Entamoeba invadens
LCESICSLTLMVNEIAGLN

SEQ ID NO: 2811663 - protein, 19 aa, Entamoeba invadens
LCFLSCFLLPIMTKNKKNE

SEQ ID NO: 2811664 - protein, 17 aa, Entamoeba invadens
LCFTSQWTSNDDSVRMK

SEQ ID NO: 2811665 - protein, 20 aa, Entamoeba invadens
LCGGMTLFAFVVFPLFPSKN

SEQ ID NO: 2811666 - protein, 17 aa, Entamoeba invadens
LCGRSSVVTLMLELSPF

SEQ ID NO: 2811667 - protein, 21 aa, Entamoeba invadens
LCGSCYAVSVAQQYTTLYAYL

SEQ ID NO: 2811668 - protein, 20 aa, Entamoeba invadens
LCIFPGCTQCAATHYNVYSH

SEQ ID NO: 2811669 - protein, 21 aa, Entamoeba invadens
LCIGINFGMWYFKMIPSDPLF

SEQ ID NO: 2811670 - protein, 17 aa, Entamoeba invadens
LCIKHVVWWVILLCLLF

SEQ ID NO: 2811671 - protein, 18 aa, Entamoeba invadens
LCISGWLGYFLRYSHPDI

SEQ ID NO: 2811672 - protein, 25 aa, Entamoeba invadens
LCLSCSFNECFICESNSFLINGKCQ

SEQ ID NO: 2811673 - protein, 19 aa, Entamoeba invadens
LCLTTTFAYNWEPNNPVPS

SEQ ID NO: 2811674 - protein, 18 aa, Entamoeba invadens
LCNVLRFTLFTTPDLTHP

SEQ ID NO: 2811675 - protein, 21 aa, Entamoeba invadens
LCRKCGSGVIFGKCDICSSGC

SEQ ID NO: 2811676 - protein, 20 aa, Entamoeba invadens
LCSKCKIGFVFNSKNECVSK

SEQ ID NO: 2811677 - protein, 20 aa, Entamoeba invadens
LCTFPYLLLKYMFNPEMGKP

SEQ ID NO: 2811678 - protein, 25 aa, Entamoeba invadens
LCTLFSCTLCKIGSVLNNGVCIQSI

SEQ ID NO: 2811679 - protein, 19 aa, Entamoeba invadens
LCWIACGVMYLKSSVRTER

SEQ ID NO: 2811680 - protein, 19 aa, Entamoeba invadens
LCYFSRLSKFFPHAKTLCL

SEQ ID NO: 2811681 - protein, 19 aa, Entamoeba invadens
LCYLCKWAYVLIENKCHNY

SEQ ID NO: 2811682 - protein, 20 aa, Entamoeba invadens
LCYPIFFLFLVFYKDKKSKN

SEQ ID NO: 2811683 - protein, 21 aa, Entamoeba invadens
LDAFKLKNGICADTFDEDNKF

SEQ ID NO: 2811684 - protein, 17 aa, Entamoeba invadens
LDAPIVHQDDVVKSTTF

SEQ ID NO: 2811685 - protein, 19 aa, Entamoeba invadens
LDFMGEYLLTFSSQAFPAQ

SEQ ID NO: 2811686 - protein, 17 aa, Entamoeba invadens
LDIDLILLKGGVCVDKN

SEQ ID NO: 2811687 - protein, 21 aa, Entamoeba invadens
LDILKKCFGFILTEDVKKKPE

SEQ ID NO: 2811688 - protein, 17 aa, Entamoeba invadens
LDILRKKMCILPQEATL

SEQ ID NO: 2811689 - protein, 24 aa, Entamoeba invadens
LDKFRSGYIIYFYGAVLFKNRFAL

SEQ ID NO: 2811690 - protein, 24 aa, Entamoeba invadens
LDKRWRKLCFFDYILYTVGTPTTI

SEQ ID NO: 2811691 - protein, 18 aa, Entamoeba invadens
LDLKRWKYITGIHYIPFP

SEQ ID NO: 2811692 - protein, 18 aa, Entamoeba invadens
LDLWKFPIFNVYTMNNNR

SEQ ID NO: 2811693 - protein, 23 aa, Entamoeba invadens
LDMKFCYEHEEFGRKIVDDLKPN

SEQ ID NO: 2811694 - protein, 21 aa, Entamoeba invadens
LDNCRICINGKCLQCKDEYYL

SEQ ID NO: 2811695 - protein, 21 aa, Entamoeba invadens
LDNCTRCSFKNGYYQDLNTST

SEQ ID NO: 2811696 - protein, 17 aa, Entamoeba invadens
LDPILTVFMSFFGVCYL

SEQ ID NO: 2811697 - protein, 18 aa, Entamoeba invadens
LDTPELYELIALIAAPPK

SEQ ID NO: 2811698 - protein, 23 aa, Entamoeba invadens
LDTPELYELIALIAAPPKENNTT

SEQ ID NO: 2811699 - protein, 18 aa, Entamoeba invadens
LDTPIALKQNIHFETSST

SEQ ID NO: 2811700 - protein, 19 aa, Entamoeba invadens
LDVAACDFFNIAIKTENEI

SEQ ID NO: 2811701 - protein, 23 aa, Entamoeba invadens
LDYFKETLCEWVGKRNFNVILDE

SEQ ID NO: 2811702 - protein, 27 aa, Entamoeba invadens
LDYKIEILETFPAYYYRAVYYGKNDCN

SEQ ID NO: 2811703 - protein, 19 aa, Entamoeba invadens
LEAPCGFVSTVGRSTGFDY

SEQ ID NO: 2811704 - protein, 19 aa, Entamoeba invadens
LECTKCLDGFILVDSTCNS

SEQ ID NO: 2811705 - protein, 23 aa, Entamoeba invadens
LECYRTRWELIIPFVVIGVLILI

SEQ ID NO: 2811706 - protein, 20 aa, Entamoeba invadens
LEFFGSLLLGTLLRIPKLDN

SEQ ID NO: 2811707 - protein, 23 aa, Entamoeba invadens
LEIGFQYKVCCNVKLDANSNKFF

SEQ ID NO: 2811708 - protein, 18 aa, Entamoeba invadens
LEISYLFDIFAKIANLNK

SEQ ID NO: 2811709 - protein, 18 aa, Entamoeba invadens
LEKCATCYLFFVTKRQLE

SEQ ID NO: 2811710 - protein, 17 aa, Entamoeba invadens
LELYYQFAMDYISAPQL

SEQ ID NO: 2811711 - protein, 19 aa, Entamoeba invadens
LEMCIRGAFHLYKPITGNY

SEQ ID NO: 2811712 - protein, 23 aa, Entamoeba invadens
LEMSYCFLALYPLSVFHYINTTL

SEQ ID NO: 2811713 - protein, 18 aa, Entamoeba invadens
LENPRILLTWGQLPVTTH

SEQ ID NO: 2811714 - protein, 19 aa, Entamoeba invadens
LEPFCPCYEELCFIVPSGN

SEQ ID NO: 2811715 - protein, 18 aa, Entamoeba invadens
LERFRKIVILKRGSSCDN

SEQ ID NO: 2811716 - protein, 17 aa, Entamoeba invadens
LESLLSLSLCCKTLKLQ

SEQ ID NO: 2811717 - protein, 23 aa, Entamoeba invadens
LETSVCLRCLLFVLNVGKDVSYE

SEQ ID NO: 2811718 - protein, 17 aa, Entamoeba invadens
LEVDIIWVLGNLVSVTD

SEQ ID NO: 2811719 - protein, 21 aa, Entamoeba invadens
LEVYTRIDALLGITSEGYTTH

SEQ ID NO: 2811720 - protein, 17 aa, Entamoeba invadens
LFAFPWKIAEYVNNGKR

SEQ ID NO: 2811721 - protein, 17 aa, Entamoeba invadens
LFAIRFILTRGRLVVLR

SEQ ID NO: 2811722 - protein, 18 aa, Entamoeba invadens
LFATLLLNFENRVIIKSA

SEQ ID NO: 2811723 - protein, 22 aa, Entamoeba invadens
LFAVCIRLALFYVVPMYAIPNR

SEQ ID NO: 2811724 - protein, 17 aa, Entamoeba invadens
LFDGLFLFFELFLTQFA

SEQ ID NO: 2811725 - protein, 19 aa, Entamoeba invadens
LFDMISWASTYLFGGNSSL

SEQ ID NO: 2811726 - protein, 24 aa, Entamoeba invadens
LFGFCLLCLTILISLLIVLFLELG

SEQ ID NO: 2811727 - protein, 22 aa, Entamoeba invadens
LFGVGGCNRCIFGTYLDFNTLK

SEQ ID NO: 2811728 - protein, 18 aa, Entamoeba invadens
LFHIIYKCYIDVIVINAE

SEQ ID NO: 2811729 - protein, 17 aa, Entamoeba invadens
LFHLCKPTIFANLVKLD

SEQ ID NO: 2811730 - protein, 22 aa, Entamoeba invadens
LFHPRCLLQMIFAGCMKQTKVV

SEQ ID NO: 2811731 - protein, 19 aa, Entamoeba invadens
LFIEICIGMAFSVFCFVGH

SEQ ID NO: 2811732 - protein, 18 aa, Entamoeba invadens
LFIFWPGILLCKLTVPFD

SEQ ID NO: 2811733 - protein, 24 aa, Entamoeba invadens
LFIKCPECLVAMLITPFLGAIESF

SEQ ID NO: 2811734 - protein, 17 aa, Entamoeba invadens
LFLKIPMLIKANNDTFY

SEQ ID NO: 2811735 - protein, 23 aa, Entamoeba invadens
LFLPKFRVFRIIKKIIKKIQIRG

SEQ ID NO: 2811736 - protein, 18 aa, Entamoeba invadens
LFPFTWCIADKVVLGIRP

SEQ ID NO: 2811737 - protein, 23 aa, Entamoeba invadens
LFQRLRLLSHYSLSHYLDIIPAK

SEQ ID NO: 2811738 - protein, 17 aa, Entamoeba invadens
LFQSRWVIKLIAKYEKR

SEQ ID NO: 2811739 - protein, 21 aa, Entamoeba invadens
LFRLKHYISFVYDNIFYSIFI

SEQ ID NO: 2811740 - protein, 22 aa, Entamoeba invadens
LFSCSRSRVGFLTPKVLETIGV

SEQ ID NO: 2811741 - protein, 18 aa, Entamoeba invadens
LFSFLSIDPNIVFDSFIK

SEQ ID NO: 2811742 - protein, 18 aa, Entamoeba invadens
LFSLLLHEVMLEFNMSWN

SEQ ID NO: 2811743 - protein, 19 aa, Entamoeba invadens
LFVAYLCVFGWHEVSIEDK

SEQ ID NO: 2811744 - protein, 19 aa, Entamoeba invadens
LFVIPWLVGFIISRKTTNK

SEQ ID NO: 2811745 - protein, 18 aa, Entamoeba invadens
LFVLGFFCLITWVVNLML

SEQ ID NO: 2811746 - protein, 23 aa, Entamoeba invadens
LFVRKEILGSFVLPNMKPVEIPD

SEQ ID NO: 2811747 - protein, 18 aa, Entamoeba invadens
LFYFCVLMIYQVIITQYL

SEQ ID NO: 2811748 - protein, 17 aa, Entamoeba invadens
LGAFGYILSVSKVGSLN

SEQ ID NO: 2811749 - protein, 22 aa, Entamoeba invadens
LGCAVGRLISRFCLFTVSERQG

SEQ ID NO: 2811750 - protein, 18 aa, Entamoeba invadens
LGCGIFLAMYFLFGLSFI

SEQ ID NO: 2811751 - protein, 18 aa, Entamoeba invadens
LGFECLRVLSPTVNIGKV

SEQ ID NO: 2811752 - protein, 20 aa, Entamoeba invadens
LGKLCMDWFFTFQEKSDVVY

SEQ ID NO: 2811753 - protein, 17 aa, Entamoeba invadens
LGMHYPLGSVVMLTETA

SEQ ID NO: 2811754 - protein, 18 aa, Entamoeba invadens
LGNPCIPYFGSFQNIFEK

SEQ ID NO: 2811755 - protein, 17 aa, Entamoeba invadens
LGQIAGLIVKYTNTNSK

SEQ ID NO: 2811756 - protein, 17 aa, Entamoeba invadens
LGREVIKDFVLKDVQHI

SEQ ID NO: 2811757 - protein, 18 aa, Entamoeba invadens
LGRKILRICPKEYNYDTS

SEQ ID NO: 2811758 - protein, 17 aa, Entamoeba invadens
LGRWFKINMTQFTMDHF

SEQ ID NO: 2811759 - protein, 17 aa, Entamoeba invadens
LGTRECVVYMTLKCTTK

SEQ ID NO: 2811760 - protein, 18 aa, Entamoeba invadens
LHCRLSFYDTNYIKLSAD

SEQ ID NO: 2811761 - protein, 23 aa, Entamoeba invadens
LHIICFLIPLGIYFLLKDLKDET

SEQ ID NO: 2811762 - protein, 19 aa, Entamoeba invadens
LHRISCFRDDLIFVAYLYQ

SEQ ID NO: 2811763 - protein, 20 aa, Entamoeba invadens
LHSRYTKWIIHQSVATSWKE

SEQ ID NO: 2811764 - protein, 17 aa, Entamoeba invadens
LHVYGEIFAENGYLVRS

SEQ ID NO: 2811765 - protein, 23 aa, Entamoeba invadens
LIALVICFFARFTITSLSVSLPV

SEQ ID NO: 2811766 - protein, 17 aa, Entamoeba invadens
LICLLNFQESPVMFLHI

SEQ ID NO: 2811767 - protein, 17 aa, Entamoeba invadens
LICSLCFGKKTVSPITS

SEQ ID NO: 2811768 - protein, 18 aa, Entamoeba invadens
LIFEKFTKIIMLNRGKMI

SEQ ID NO: 2811769 - protein, 18 aa, Entamoeba invadens
LIGCFSFQVDGCETCLPN

SEQ ID NO: 2811770 - protein, 19 aa, Entamoeba invadens
LIGIYKWGPSLAITQALNN

SEQ ID NO: 2811771 - protein, 22 aa, Entamoeba invadens
LIGLVCSISFTFFCGVHPTSFL

SEQ ID NO: 2811772 - protein, 21 aa, Entamoeba invadens
LIHKLLKCKLGFFDVTPMGRI

SEQ ID NO: 2811773 - protein, 19 aa, Entamoeba invadens
LIHRELKSGAFLFRLQYIM

SEQ ID NO: 2811774 - protein, 20 aa, Entamoeba invadens
LIHRNIKRPIPIKKTVFALE

SEQ ID NO: 2811775 - protein, 22 aa, Entamoeba invadens
LIICILGSFVAFSFAVPHYTYN

SEQ ID NO: 2811776 - protein, 18 aa, Entamoeba invadens
LIIGVGMVFVWTVQSEYA

SEQ ID NO: 2811777 - protein, 22 aa, Entamoeba invadens
LIIKGRIFLPLISFQQLCTKYN

SEQ ID NO: 2811778 - protein, 24 aa, Entamoeba invadens
LIIVLCLISFLLLIGCGVAAILVF

SEQ ID NO: 2811779 - protein, 18 aa, Entamoeba invadens
LIKLCFFKNAAFFLIMLS

SEQ ID NO: 2811780 - protein, 18 aa, Entamoeba invadens
LIKLRPYELLQHLMIITN

SEQ ID NO: 2811781 - protein, 25 aa, Entamoeba invadens
LIKRGCACEFSLYLTPLCTCKINTT

SEQ ID NO: 2811782 - protein, 17 aa, Entamoeba invadens
LILPRVGLFLPNKTDDL

SEQ ID NO: 2811783 - protein, 21 aa, Entamoeba invadens
LINFPSCFLVNFTSSKTSKKF

SEQ ID NO: 2811784 - protein, 18 aa, Entamoeba invadens
LIPKDFFIMVAIHFTIGL

SEQ ID NO: 2811785 - protein, 18 aa, Entamoeba invadens
LIQIRLAKEMYDRKQREK

SEQ ID NO: 2811786 - protein, 19 aa, Entamoeba invadens
LISSIFLPWFNTMKYLQQS

SEQ ID NO: 2811787 - protein, 18 aa, Entamoeba invadens
LITLCFVSLCFFPIDVIF

SEQ ID NO: 2811788 - protein, 21 aa, Entamoeba invadens
LITNCPFLWYLLNFLLIIATP

SEQ ID NO: 2811789 - protein, 19 aa, Entamoeba invadens
LIVCAITIPIAVYFTKDKV

SEQ ID NO: 2811790 - protein, 22 aa, Entamoeba invadens
LIVNCYLLLSWVYEFIVSLHIK

SEQ ID NO: 2811791 - protein, 22 aa, Entamoeba invadens
LIWFGFCFLNFVGLKINYLGLS

SEQ ID NO: 2811792 - protein, 19 aa, Entamoeba invadens
LIYFPLKLGQIFTALNERG

SEQ ID NO: 2811793 - protein, 17 aa, Entamoeba invadens
LKCDYCFSGSYIEGGYC

SEQ ID NO: 2811794 - protein, 18 aa, Entamoeba invadens
LKCEISFMRVDEIIVKAE

SEQ ID NO: 2811795 - protein, 25 aa, Entamoeba invadens
LKCTSRGKCLLCKDGYRLTNNKCEA

SEQ ID NO: 2811796 - protein, 21 aa, Entamoeba invadens
LKDRVCVHFSQIPNCISLENS

SEQ ID NO: 2811797 - protein, 24 aa, Entamoeba invadens
LKERRTLWFLWAFWLFFYSAMCLI

SEQ ID NO: 2811798 - protein, 17 aa, Entamoeba invadens
LKFKETYYDGGFLIQDN

SEQ ID NO: 2811799 - protein, 20 aa, Entamoeba invadens
LKFMHVFPLCFLHVLFNGYL

SEQ ID NO: 2811800 - protein, 17 aa, Entamoeba invadens
LKFWSGHCVECYAGYHL

SEQ ID NO: 2811801 - protein, 19 aa, Entamoeba invadens
LKILINCAEGFCLAIDDPI

SEQ ID NO: 2811802 - protein, 19 aa, Entamoeba invadens
LKITVSIFKSGVFKKTQTA

SEQ ID NO: 2811803 - protein, 19 aa, Entamoeba invadens
LKIWDMFLLEGFVWLVKVS

SEQ ID NO: 2811804 - protein, 17 aa, Entamoeba invadens
LKKIVLHQCNFCDLEFP

SEQ ID NO: 2811805 - protein, 25 aa, Entamoeba invadens
LKKMRAHRGLRHYWGLRVRGQHTKT

SEQ ID NO: 2811806 - protein, 21 aa, Entamoeba invadens
LKLDVHGSVYLRSGKFEVDEM

SEQ ID NO: 2811807 - protein, 17 aa, Entamoeba invadens
LKLKGFYYTLAMQQFGS

SEQ ID NO: 2811808 - protein, 18 aa, Entamoeba invadens
LKLKILFDTARGMQFLHE

SEQ ID NO: 2811809 - protein, 19 aa, Entamoeba invadens
LKLRNTFIINEERTNKPYI

SEQ ID NO: 2811810 - protein, 18 aa, Entamoeba invadens
LKLRNTFIINEERTNNPY

SEQ ID NO: 2811811 - protein, 17 aa, Entamoeba invadens
LKLSLQFYNEHRIERNG

SEQ ID NO: 2811812 - protein, 18 aa, Entamoeba invadens
LKLTLLFVDFCLLLVSVK

SEQ ID NO: 2811813 - protein, 20 aa, Entamoeba invadens
LKLYQQICCSVYFWTGPSVE

SEQ ID NO: 2811814 - protein, 19 aa, Entamoeba invadens
LKMLLTLSVRCEYPCTQCS

SEQ ID NO: 2811815 - protein, 20 aa, Entamoeba invadens
LKNAHIGLAMGIRGTDVAKQ

SEQ ID NO: 2811816 - protein, 19 aa, Entamoeba invadens
LKNLKFCSIQGCELLTELA

SEQ ID NO: 2811817 - protein, 17 aa, Entamoeba invadens
LKQVRPGMDLSRISFPS

SEQ ID NO: 2811818 - protein, 18 aa, Entamoeba invadens
LKRRFNVFKMSKTNLDFV

SEQ ID NO: 2811819 - protein, 28 aa, Entamoeba invadens
LKRTMWWKNMKLWLIIGGVIALILVIII

SEQ ID NO: 2811820 - protein, 18 aa, Entamoeba invadens
LKSAYLFREVELNDTDKC

SEQ ID NO: 2811821 - protein, 18 aa, Entamoeba invadens
LKSFSWTKIDGVPAVSYD

SEQ ID NO: 2811822 - protein, 19 aa, Entamoeba invadens
LKSGAFLFRLQYIMNDKGD

SEQ ID NO: 2811823 - protein, 24 aa, Entamoeba invadens
LKTIYFAFFVSFFVTYNVMRVITQ

SEQ ID NO: 2811824 - protein, 26 aa, Entamoeba invadens
LKTNLPRLGKIYIFNLHVCFWPQVMK

SEQ ID NO: 2811825 - protein, 19 aa, Entamoeba invadens
LKTPFLRYSGVMLGLSLIV

SEQ ID NO: 2811826 - protein, 18 aa, Entamoeba invadens
LKVILSFCQCVNVSSERN

SEQ ID NO: 2811827 - protein, 28 aa, Entamoeba invadens
LKVPAVMFNWSWDLFRGFPIMTVAFCGH

SEQ ID NO: 2811828 - protein, 19 aa, Entamoeba invadens
LKVQFQWICTSIFQGTLII

SEQ ID NO: 2811829 - protein, 17 aa, Entamoeba invadens
LKVRFCQDIAKGMEYLH

SEQ ID NO: 2811830 - protein, 20 aa, Entamoeba invadens
LKVYCGYGYVMSVFIQCILL

SEQ ID NO: 2811831 - protein, 18 aa, Entamoeba invadens
LKYHKAYEGTNEIRRKLV

SEQ ID NO: 2811832 - protein, 20 aa, Entamoeba invadens
LKYLKCWRQISLVGGFTLML

SEQ ID NO: 2811833 - protein, 20 aa, Entamoeba invadens
LKYRVSTVDALYCTYTSEDT

SEQ ID NO: 2811834 - protein, 17 aa, Entamoeba invadens
LLASVVFFKCNMSDITF

SEQ ID NO: 2811835 - protein, 19 aa, Entamoeba invadens
LLCLVCLSVFFANSINMYA

SEQ ID NO: 2811836 - protein, 18 aa, Entamoeba invadens
LLDALSFYFGKLYTDHAL

SEQ ID NO: 2811837 - protein, 19 aa, Entamoeba invadens
LLDLCYYGPYGIPIWTPII

SEQ ID NO: 2811838 - protein, 23 aa, Entamoeba invadens
LLEGIKWRECFEGNQFKYTWQIA

SEQ ID NO: 2811839 - protein, 23 aa, Entamoeba invadens
LLEKLKIVAILSVCDIEPYYSKK

SEQ ID NO: 2811840 - protein, 17 aa, Entamoeba invadens
LLESNFVPTCGNGGYVK

SEQ ID NO: 2811841 - protein, 17 aa, Entamoeba invadens
LLFAVAMSFSALFFAIL

SEQ ID NO: 2811842 - protein, 18 aa, Entamoeba invadens
LLFFLGFIIPLIWPVIVV

SEQ ID NO: 2811843 - protein, 20 aa, Entamoeba invadens
LLGTIGWKVGDQVTYAIEGS

SEQ ID NO: 2811844 - protein, 20 aa, Entamoeba invadens
LLHRIACFRDDVVFVIYLYQ

SEQ ID NO: 2811845 - protein, 22 aa, Entamoeba invadens
LLICLSCGISTFVLLAVQFLLI

SEQ ID NO: 2811846 - protein, 18 aa, Entamoeba invadens
LLIWRVSRGFAIVRSTGL

SEQ ID NO: 2811847 - protein, 23 aa, Entamoeba invadens
LLKFLFYTIHSFRFNDELLQQFV

SEQ ID NO: 2811848 - protein, 17 aa, Entamoeba invadens
LLKMPKYSIEWGGSVKK

SEQ ID NO: 2811849 - protein, 18 aa, Entamoeba invadens
LLKMPKYSIEWGGSVKKD

SEQ ID NO: 2811850 - protein, 21 aa, Entamoeba invadens
LLKNEWKSSCDKMKLTFDTSP

SEQ ID NO: 2811851 - protein, 24 aa, Entamoeba invadens
LLKPHRRCALLYALSYFKKTKMCG

SEQ ID NO: 2811852 - protein, 20 aa, Entamoeba invadens
LLLEILLRFYGAAHVEIFSD

SEQ ID NO: 2811853 - protein, 18 aa, Entamoeba invadens
LLLPIICIVLYFIGAICK

SEQ ID NO: 2811854 - protein, 17 aa, Entamoeba invadens
LLLRAMKSGSWVLLDEL

SEQ ID NO: 2811855 - protein, 23 aa, Entamoeba invadens
LLLRCMRCLDGVKLINIINLKQY

SEQ ID NO: 2811856 - protein, 17 aa, Entamoeba invadens
LLLRVMFIKCSFTKLKK

SEQ ID NO: 2811857 - protein, 19 aa, Entamoeba invadens
LLLSLASFYAFKLARSTKK

SEQ ID NO: 2811858 - protein, 19 aa, Entamoeba invadens
LLMFPKFFRIKGMIPCSKF

SEQ ID NO: 2811859 - protein, 18 aa, Entamoeba invadens
LLMSFTFQGYFCLPMLDY

SEQ ID NO: 2811860 - protein, 18 aa, Entamoeba invadens
LLNKWKLPIFNALTSNAM

SEQ ID NO: 2811861 - protein, 24 aa, Entamoeba invadens
LLPEALKLLPIFVLGAMKTPAFMA

SEQ ID NO: 2811862 - protein, 17 aa, Entamoeba invadens
LLPVVGDVIQLIRSEGT

SEQ ID NO: 2811863 - protein, 22 aa, Entamoeba invadens
LLRKGECCTFSIAITPYCSGEY

SEQ ID NO: 2811864 - protein, 31 aa, Entamoeba invadens
LLRQRIKVLPSFPCTCSRCLEKKAKLTRRRN

SEQ ID NO: 2811865 - protein, 17 aa, Entamoeba invadens
LLSFAFAFFIPVKTVQI

SEQ ID NO: 2811866 - protein, 17 aa, Entamoeba invadens
LLSKMLLSIFAIMQSHP

SEQ ID NO: 2811867 - protein, 17 aa, Entamoeba invadens
LLSWVCGFINNFLPGWL

SEQ ID NO: 2811868 - protein, 25 aa, Entamoeba invadens
LLTGKFRFGYVFGFTFVGSFAEYFV

SEQ ID NO: 2811869 - protein, 19 aa, Entamoeba invadens
LLTLYFRFSLDFPNKAHTT

SEQ ID NO: 2811870 - protein, 21 aa, Entamoeba invadens
LLVCCICKYIILCKEINFEQQ

SEQ ID NO: 2811871 - protein, 19 aa, Entamoeba invadens
LLWICVWWQRWELKEIYQH

SEQ ID NO: 2811872 - protein, 26 aa, Entamoeba invadens
LLWRLVDIFFTIPVTYSFGVTCTYLR

SEQ ID NO: 2811873 - protein, 29 aa, Entamoeba invadens
LMFAFGFLCCCLWCVGYCKYKSSTNSNAR

SEQ ID NO: 2811874 - protein, 21 aa, Entamoeba invadens
LMFKGDVSVVEFSLRGKIEMA

SEQ ID NO: 2811875 - protein, 23 aa, Entamoeba invadens
LMVGRSRFKSIVFNQRNGKRLIN

SEQ ID NO: 2811876 - protein, 19 aa, Entamoeba invadens
LMYARCLIVGFGVNMALFG

SEQ ID NO: 2811877 - protein, 21 aa, Entamoeba invadens
LMYMHCFLRKSLVIHETIPWM

SEQ ID NO: 2811878 - protein, 17 aa, Entamoeba invadens
LNELFLFVNGTKPSDIF

SEQ ID NO: 2811879 - protein, 25 aa, Entamoeba invadens
LNGKLRFGDVYGFSILAVFVEYLFL

SEQ ID NO: 2811880 - protein, 19 aa, Entamoeba invadens
LNIEKLHCRLSFYDTNYIK

SEQ ID NO: 2811881 - protein, 17 aa, Entamoeba invadens
LNIGMGVWAFPDNIRIY

SEQ ID NO: 2811882 - protein, 21 aa, Entamoeba invadens
LNNKCGWCRATQTCGYCSNGG

SEQ ID NO: 2811883 - protein, 18 aa, Entamoeba invadens
LNPETGFLFSPNETKLDD

SEQ ID NO: 2811884 - protein, 22 aa, Entamoeba invadens
LNSYKGGSVWSIEGKEIGALYM

SEQ ID NO: 2811885 - protein, 19 aa, Entamoeba invadens
LNTGFTKLHFLAEIQQTQL

SEQ ID NO: 2811886 - protein, 17 aa, Entamoeba invadens
LNTLFGMVKFPTDDLKY

SEQ ID NO: 2811887 - protein, 21 aa, Entamoeba invadens
LNVKIGFIWKVLFVNYVIPNL

SEQ ID NO: 2811888 - protein, 23 aa, Entamoeba invadens
LNYLSPRLNEFFGHKLDFSNIGV

SEQ ID NO: 2811889 - protein, 19 aa, Entamoeba invadens
LPCFTDFYAKVVIFTASFF

SEQ ID NO: 2811890 - protein, 18 aa, Entamoeba invadens
LPCSPNWCDVCDGTTGRC

SEQ ID NO: 2811891 - protein, 17 aa, Entamoeba invadens
LPDCLGLLQLCDDIIIA

SEQ ID NO: 2811892 - protein, 17 aa, Entamoeba invadens
LPFCVVFGLPLKFLIIP

SEQ ID NO: 2811893 - protein, 19 aa, Entamoeba invadens
LPFIVCFFIATPHLDLSQL

SEQ ID NO: 2811894 - protein, 19 aa, Entamoeba invadens
LPFTFPVKYFYVFYQQRRL

SEQ ID NO: 2811895 - protein, 20 aa, Entamoeba invadens
LPGFEFYQWFGAMLEQFEDF

SEQ ID NO: 2811896 - protein, 18 aa, Entamoeba invadens
LPIICGLSLDYDIFLFSR

SEQ ID NO: 2811897 - protein, 21 aa, Entamoeba invadens
LPISFYLERIFALYIPLYIKC

SEQ ID NO: 2811898 - protein, 24 aa, Entamoeba invadens
LPKDCRSGDCIPRYPMSCMETEYF

SEQ ID NO: 2811899 - protein, 20 aa, Entamoeba invadens
LPKLFLRIFEDFVFTQEHMQ

SEQ ID NO: 2811900 - protein, 17 aa, Entamoeba invadens
LPKLPGIWTVLFLASSC

SEQ ID NO: 2811901 - protein, 19 aa, Entamoeba invadens
LPLPVIYCRSGVYNRTSKL

SEQ ID NO: 2811902 - protein, 20 aa, Entamoeba invadens
LPLVMSVAYYKRCRNVGNVS

SEQ ID NO: 2811903 - protein, 17 aa, Entamoeba invadens
LPMNISILVFLGLLIFF

SEQ ID NO: 2811904 - protein, 21 aa, Entamoeba invadens
LPNLRRLEIKAGRVALNENLP

SEQ ID NO: 2811905 - protein, 18 aa, Entamoeba invadens
LPQLMFYAGMIAVTTILV

SEQ ID NO: 2811906 - protein, 21 aa, Entamoeba invadens
LPTTECVYTFFLISRTCGEAV

SEQ ID NO: 2811907 - protein, 25 aa, Entamoeba invadens
LPVPYPLLWCRYSFFIVLYPMGVSG

SEQ ID NO: 2811908 - protein, 19 aa, Entamoeba invadens
LPVSMPIHFLVWPLEQRAD

SEQ ID NO: 2811909 - protein, 23 aa, Entamoeba invadens
LQELRVMSWLGFIGGAKGVFYYS

SEQ ID NO: 2811910 - protein, 17 aa, Entamoeba invadens
LQFKLKMQILKDVSKGM

SEQ ID NO: 2811911 - protein, 22 aa, Entamoeba invadens
LQGSFPFMWGFFMVSSLCFWTS

SEQ ID NO: 2811912 - protein, 19 aa, Entamoeba invadens
LQHAFPIGVLYPFNLLVYD

SEQ ID NO: 2811913 - protein, 23 aa, Entamoeba invadens
LQLRPSFEFTKDFIIKSRSQFCR

SEQ ID NO: 2811914 - protein, 19 aa, Entamoeba invadens
LQLTWTQRMLCCVIFCGLG

SEQ ID NO: 2811915 - protein, 18 aa, Entamoeba invadens
LRCLSGYYLTDRMCVKCE

SEQ ID NO: 2811916 - protein, 17 aa, Entamoeba invadens
LRCSVLLDHFEWSLKII

SEQ ID NO: 2811917 - protein, 20 aa, Entamoeba invadens
LRFLGFWICAVLNVFVPKYV

SEQ ID NO: 2811918 - protein, 19 aa, Entamoeba invadens
LRGSYYRFYLNKPMHITVK

SEQ ID NO: 2811919 - protein, 18 aa, Entamoeba invadens
LRGYPFIYSFAIQNYDAI

SEQ ID NO: 2811920 - protein, 21 aa, Entamoeba invadens
LRHVLYFTIYILFQLLLTFLL

SEQ ID NO: 2811921 - protein, 18 aa, Entamoeba invadens
LRIPYSVWFASSRSILES

SEQ ID NO: 2811922 - protein, 17 aa, Entamoeba invadens
LRISEHFVFVTLITEST

SEQ ID NO: 2811923 - protein, 20 aa, Entamoeba invadens
LRKAKRPEGPAVYHGISSPI

SEQ ID NO: 2811924 - protein, 18 aa, Entamoeba invadens
LRKCKVCAIGFYPDETSG

SEQ ID NO: 2811925 - protein, 18 aa, Entamoeba invadens
LRKLRVVHHLALQFSQFS

SEQ ID NO: 2811926 - protein, 18 aa, Entamoeba invadens
LRKVSYCVLQRSIYLLNT

SEQ ID NO: 2811927 - protein, 17 aa, Entamoeba invadens
LRLDCEFCDKSCKQCHN

SEQ ID NO: 2811928 - protein, 17 aa, Entamoeba invadens
LRLFPFVMLVSLFLNNT

SEQ ID NO: 2811929 - protein, 19 aa, Entamoeba invadens
LRLLIERCGGMRRFVEKDC

SEQ ID NO: 2811930 - protein, 20 aa, Entamoeba invadens
LRLYYICFLNAFDVTEFEKL

SEQ ID NO: 2811931 - protein, 19 aa, Entamoeba invadens
LRMKFCLDSSKGIAYLHQN

SEQ ID NO: 2811932 - protein, 19 aa, Entamoeba invadens
LRNCRNCIFQLPSTLTGLS

SEQ ID NO: 2811933 - protein, 20 aa, Entamoeba invadens
LRPFVITCVVLFTVFVTVPC

SEQ ID NO: 2811934 - protein, 23 aa, Entamoeba invadens
LRQGECVPCSGLFTHCNTCSDIL

SEQ ID NO: 2811935 - protein, 24 aa, Entamoeba invadens
LRRFERNKIALAFNDLVEVATTLG

SEQ ID NO: 2811936 - protein, 17 aa, Entamoeba invadens
LRVKFMIDLGRGLIYLH

SEQ ID NO: 2811937 - protein, 18 aa, Entamoeba invadens
LRVKICLDAAKGILYLHE

SEQ ID NO: 2811938 - protein, 20 aa, Entamoeba invadens
LRVLMSFSFLLASACYYAST

SEQ ID NO: 2811939 - protein, 18 aa, Entamoeba invadens
LRYFYLRFVNKLETSTSD

SEQ ID NO: 2811940 - protein, 20 aa, Entamoeba invadens
LRYLLAFLIELPLCYIYRFL

SEQ ID NO: 2811941 - protein, 17 aa, Entamoeba invadens
LSASWGFKIEKLDHFTA

SEQ ID NO: 2811942 - protein, 25 aa, Entamoeba invadens
LSCFKGCISLCEICCSSSLQFPLSS

SEQ ID NO: 2811943 - protein, 25 aa, Entamoeba invadens
LSCGLKWCKERRSLFCVTKERECSP

SEQ ID NO: 2811944 - protein, 22 aa, Entamoeba invadens
LSDECVLEFSVLTGLSLQLTFS

SEQ ID NO: 2811945 - protein, 18 aa, Entamoeba invadens
LSECFELIEFCLRERKSE

SEQ ID NO: 2811946 - protein, 19 aa, Entamoeba invadens
LSEECLCTLLIPQMSTLNS

SEQ ID NO: 2811947 - protein, 20 aa, Entamoeba invadens
LSEGVGYFILKFCFFVVSER

SEQ ID NO: 2811948 - protein, 18 aa, Entamoeba invadens
LSFFNEILRNIKFIKYNR

SEQ ID NO: 2811949 - protein, 17 aa, Entamoeba invadens
LSFIFKLWFFRDNVRIH

SEQ ID NO: 2811950 - protein, 19 aa, Entamoeba invadens
LSFSCFNLFIEVVPLIVKV

SEQ ID NO: 2811951 - protein, 22 aa, Entamoeba invadens
LSHCLCVPMSPSFILRTLDANV

SEQ ID NO: 2811952 - protein, 20 aa, Entamoeba invadens
LSIDWCWEGDVLNCFQKIIE

SEQ ID NO: 2811953 - protein, 25 aa, Entamoeba invadens
LSIFPKFFARRGFIPCIKKCRVWVE

SEQ ID NO: 2811954 - protein, 25 aa, Entamoeba invadens
LSKCIKCLPGYFLIQGKCGNCIPNC

SEQ ID NO: 2811955 - protein, 17 aa, Entamoeba invadens
LSLCLTTTFAYNWEPNN

SEQ ID NO: 2811956 - protein, 18 aa, Entamoeba invadens
LSLGVCWHANGFWRDFVE

SEQ ID NO: 2811957 - protein, 17 aa, Entamoeba invadens
LSNFWRYTVCSLLYNFG

SEQ ID NO: 2811958 - protein, 19 aa, Entamoeba invadens
LSPFLAFALFLSFIITKKT

SEQ ID NO: 2811959 - protein, 18 aa, Entamoeba invadens
LSRHIWKPFVLYNKCKNE

SEQ ID NO: 2811960 - protein, 22 aa, Entamoeba invadens
LSSGKCLICLSGTRSLFSRCVS

SEQ ID NO: 2811961 - protein, 18 aa, Entamoeba invadens
LSSYGVDCVQTYGSVLVV

SEQ ID NO: 2811962 - protein, 21 aa, Entamoeba invadens
LSVFECITWIEAYLKKQFKFA

SEQ ID NO: 2811963 - protein, 23 aa, Entamoeba invadens
LTCEFKKVLVLSVSLFFVLMSGA

SEQ ID NO: 2811964 - protein, 18 aa, Entamoeba invadens
LTCSPYGCLYCQRDLLYD

SEQ ID NO: 2811965 - protein, 20 aa, Entamoeba invadens
LTDLRLGMHYPLGSVVMLTE

SEQ ID NO: 2811966 - protein, 21 aa, Entamoeba invadens
LTILMLWKFRVGQPALLYLVP

SEQ ID NO: 2811967 - protein, 17 aa, Entamoeba invadens
LTIPVLFGLYLLKTGLR

SEQ ID NO: 2811968 - protein, 17 aa, Entamoeba invadens
LTISYGFLISSLLDEVI

SEQ ID NO: 2811969 - protein, 17 aa, Entamoeba invadens
LTITMVVTFVALTVMVA

SEQ ID NO: 2811970 - protein, 19 aa, Entamoeba invadens
LTKMAKLWMGQRMDWLGVF

SEQ ID NO: 2811971 - protein, 17 aa, Entamoeba invadens
LTKRIPLIFSTALSTWI

SEQ ID NO: 2811972 - protein, 21 aa, Entamoeba invadens
LTLDQPCCFIAKKVTNLNVNS

SEQ ID NO: 2811973 - protein, 23 aa, Entamoeba invadens
LTLECWNPLFIVYVLLLCFISRA

SEQ ID NO: 2811974 - protein, 17 aa, Entamoeba invadens
LTLMFWIAIAMTIALVI

SEQ ID NO: 2811975 - protein, 20 aa, Entamoeba invadens
LTPKGCLKCVNGFYLDNSKN

SEQ ID NO: 2811976 - protein, 20 aa, Entamoeba invadens
LTRCKNCIFHLPSTLTKLSL

SEQ ID NO: 2811977 - protein, 18 aa, Entamoeba invadens
LTSASRCWKCSEGNVNTN

SEQ ID NO: 2811978 - protein, 19 aa, Entamoeba invadens
LTSCFKFNFTGTMVDELND

SEQ ID NO: 2811979 - protein, 17 aa, Entamoeba invadens
LTSGCWCLFAGVIFYTI

SEQ ID NO: 2811980 - protein, 23 aa, Entamoeba invadens
LTSLKVFCFCSSFTTITTLVALN

SEQ ID NO: 2811981 - protein, 17 aa, Entamoeba invadens
LTTCSLCSIWVTLFIYT

SEQ ID NO: 2811982 - protein, 18 aa, Entamoeba invadens
LTVASEFKLLTVLNTMTM

SEQ ID NO: 2811983 - protein, 20 aa, Entamoeba invadens
LTVFMSFFGVCYLSLSKQEL

SEQ ID NO: 2811984 - protein, 23 aa, Entamoeba invadens
LVAHEVFHLLSILSFCTHVISYF

SEQ ID NO: 2811985 - protein, 19 aa, Entamoeba invadens
LVCKLCKGGYAFKENTSIC

SEQ ID NO: 2811986 - protein, 19 aa, Entamoeba invadens
LVCKRAGIDVNRRAGLLKA

SEQ ID NO: 2811987 - protein, 18 aa, Entamoeba invadens
LVCLVLYHFGIDFIFNSR

SEQ ID NO: 2811988 - protein, 17 aa, Entamoeba invadens
LVCMGFIIFYFVIFIIL

SEQ ID NO: 2811989 - protein, 18 aa, Entamoeba invadens
LVDSVVCCRVTPKEKAEI

SEQ ID NO: 2811990 - protein, 18 aa, Entamoeba invadens
LVDVFAFRVNEDIISMPL

SEQ ID NO: 2811991 - protein, 20 aa, Entamoeba invadens
LVFASICFWMSHQFAPKGSF

SEQ ID NO: 2811992 - protein, 18 aa, Entamoeba invadens
LVFLKRFAYSFVPAFLVF

SEQ ID NO: 2811993 - protein, 17 aa, Entamoeba invadens
LVFSSSIQWCWSNDVVT

SEQ ID NO: 2811994 - protein, 19 aa, Entamoeba invadens
LVGEGTFGKVFLCVFRGQH

SEQ ID NO: 2811995 - protein, 24 aa, Entamoeba invadens
LVHILKFRMGFISSIRTQLQNSMS

SEQ ID NO: 2811996 - protein, 21 aa, Entamoeba invadens
LVIDGSWVKRLFSLYYSMSDF

SEQ ID NO: 2811997 - protein, 21 aa, Entamoeba invadens
LVITCLLLFYLFALIKMFVIR

SEQ ID NO: 2811998 - protein, 18 aa, Entamoeba invadens
LVKCVFCTSDGCTQMVGW

SEQ ID NO: 2811999 - protein, 18 aa, Entamoeba invadens
LVKLMINGAVNFGNIHSP

SEQ ID NO: 2812000 - protein, 17 aa, Entamoeba invadens
LVLGNAVSLKEETNPTL

SEQ ID NO: 2812001 - protein, 18 aa, Entamoeba invadens
LVLNCVLFVPTLNTYLIG

SEQ ID NO: 2812002 - protein, 23 aa, Entamoeba invadens
LVLTCLGLLAACIVALFQPQLYF

SEQ ID NO: 2812003 - protein, 17 aa, Entamoeba invadens
LVLYQFLGELGIMSAQL

SEQ ID NO: 2812004 - protein, 19 aa, Entamoeba invadens
LVMYCIRWHTYITVPELTL

SEQ ID NO: 2812005 - protein, 23 aa, Entamoeba invadens
LVRELPFTLGQCVFKPIHDTSEV

SEQ ID NO: 2812006 - protein, 17 aa, Entamoeba invadens
LVRFAKIGFVKAVLLCV

SEQ ID NO: 2812007 - protein, 18 aa, Entamoeba invadens
LVSLRLLLLNALSNILNS

SEQ ID NO: 2812008 - protein, 19 aa, Entamoeba invadens
LVTCDLPPPPALMMEQKQD

SEQ ID NO: 2812009 - protein, 18 aa, Entamoeba invadens
LVTFPWLFGIMFGDVGHG

SEQ ID NO: 2812010 - protein, 24 aa, Entamoeba invadens
LVVTCCIFLSTRLDGFVVKIVNEV

SEQ ID NO: 2812011 - protein, 20 aa, Entamoeba invadens
LVVVCAFVFSLLFIYLIKVM

SEQ ID NO: 2812012 - protein, 22 aa, Entamoeba invadens
LVWCYAAACSNEFNDWTEDYAT

SEQ ID NO: 2812013 - protein, 24 aa, Entamoeba invadens
LWLLKNGVCSLGLKAENVRPNLLI

SEQ ID NO: 2812014 - protein, 18 aa, Entamoeba invadens
LWYAGLRGAIAIILALQM

SEQ ID NO: 2812015 - protein, 18 aa, Entamoeba invadens
LWYAGLRGAIAILLSLTM

SEQ ID NO: 2812016 - protein, 18 aa, Entamoeba invadens
LYEVIGWCSAFSECRYVW

SEQ ID NO: 2812017 - protein, 17 aa, Entamoeba invadens
LYFCYWYLYHLVAFPIL

SEQ ID NO: 2812018 - protein, 18 aa, Entamoeba invadens
LYFSQRMDFLSVFICFVT

SEQ ID NO: 2812019 - protein, 24 aa, Entamoeba invadens
LYHYKNLCCLCVEQSEVSKWLTTI

SEQ ID NO: 2812020 - protein, 17 aa, Entamoeba invadens
LYIFGRRGAGILTEPCL

SEQ ID NO: 2812021 - protein, 20 aa, Entamoeba invadens
LYLGVCFFLLFAGYQTTQNY

SEQ ID NO: 2812022 - protein, 17 aa, Entamoeba invadens
LYLIVLVVFFGFDEMIT

SEQ ID NO: 2812023 - protein, 18 aa, Entamoeba invadens
LYPNCLDCSIDRKVCLYC

SEQ ID NO: 2812024 - protein, 17 aa, Entamoeba invadens
LYYAYGFLMSVFLQITI

SEQ ID NO: 2812025 - protein, 19 aa, Entamoeba invadens
MAETFRWGNVFPLELYPKA

SEQ ID NO: 2812026 - protein, 17 aa, Entamoeba invadens
MAICIVAPLFPRVFMFF

SEQ ID NO: 2812027 - protein, 17 aa, Entamoeba invadens
MAKIWYSQRLEWLGFTI

SEQ ID NO: 2812028 - protein, 18 aa, Entamoeba invadens
MALPRYPLMSGWKTEFMI

SEQ ID NO: 2812029 - protein, 18 aa, Entamoeba invadens
MAVILLRLLVYFHEHVSD

SEQ ID NO: 2812030 - protein, 17 aa, Entamoeba invadens
MAYFSSFARYFLNCKDH

SEQ ID NO: 2812031 - protein, 21 aa, Entamoeba invadens
MCADFTYWFGYVFGFGSAVIT

SEQ ID NO: 2812032 - protein, 18 aa, Entamoeba invadens
MCAFIWEYYCEKVPFFNP

SEQ ID NO: 2812033 - protein, 24 aa, Entamoeba invadens
MCAKCGISNCKKCDATQCVECLTN

SEQ ID NO: 2812034 - protein, 17 aa, Entamoeba invadens
MCLNRISVCIIGFVALL

SEQ ID NO: 2812035 - protein, 17 aa, Entamoeba invadens
MCTDVLVGLCLDYDIFL

SEQ ID NO: 2812036 - protein, 18 aa, Entamoeba invadens
MCTLVWVLAVSIVILITF

SEQ ID NO: 2812037 - protein, 21 aa, Entamoeba invadens
MCVITFIPICYYQVTEESIFK

SEQ ID NO: 2812038 - protein, 18 aa, Entamoeba invadens
MDDFSCSVLFPFITKKFF

SEQ ID NO: 2812039 - protein, 18 aa, Entamoeba invadens
MDIWGCLICEPGYYNNDN

SEQ ID NO: 2812040 - protein, 21 aa, Entamoeba invadens
MDYKLTCLMSGNVMKDYTYGD

SEQ ID NO: 2812041 - protein, 24 aa, Entamoeba invadens
MEEWGMRCLFKFKKYVILYAVLLI

SEQ ID NO: 2812042 - protein, 19 aa, Entamoeba invadens
MEFKEWFPMESIVLGTIEI

SEQ ID NO: 2812043 - protein, 21 aa, Entamoeba invadens
MEFKFSWKIAEFVIFGHRLDN

SEQ ID NO: 2812044 - protein, 23 aa, Entamoeba invadens
MEFKHSWTIEKFICVGRRPPCLI

SEQ ID NO: 2812045 - protein, 22 aa, Entamoeba invadens
MEPLGVLMIRFGDAANMYALFL

SEQ ID NO: 2812046 - protein, 22 aa, Entamoeba invadens
MFALSLDWCWEGDVLQCFQKKI

SEQ ID NO: 2812047 - protein, 23 aa, Entamoeba invadens
MFEAFSWKEAYLIKDFKFPWKIA

SEQ ID NO: 2812048 - protein, 23 aa, Entamoeba invadens
MFECFGWKEAYPIDTFKYPWKIA

SEQ ID NO: 2812049 - protein, 19 aa, Entamoeba invadens
MFELFKWGNAYSEKYFPYP

SEQ ID NO: 2812050 - protein, 23 aa, Entamoeba invadens
MFFFPSCMPTFLSKLVVFTITFN

SEQ ID NO: 2812051 - protein, 29 aa, Entamoeba invadens
MFFILGFCIACFWLMAFVVSRKGKSVSTR

SEQ ID NO: 2812052 - protein, 23 aa, Entamoeba invadens
MFGFSFNFWWAVVCRFISGFVNG

SEQ ID NO: 2812053 - protein, 19 aa, Entamoeba invadens
MFKFPWKIAEFVISGKRLE

SEQ ID NO: 2812054 - protein, 17 aa, Entamoeba invadens
MFKNCIKLKDVIINNGV

SEQ ID NO: 2812055 - protein, 18 aa, Entamoeba invadens
MFLPFVVQFIESFEDFAT

SEQ ID NO: 2812056 - protein, 20 aa, Entamoeba invadens
MFPHNKCVLKTCGQDIYKSS

SEQ ID NO: 2812057 - protein, 19 aa, Entamoeba invadens
MFRFFETIDQILLFWGLVG

SEQ ID NO: 2812058 - protein, 22 aa, Entamoeba invadens
MGCAFCKDGYYWSEWSCLECSA

SEQ ID NO: 2812059 - protein, 23 aa, Entamoeba invadens
MGFALCWDLTLVILCMSPFTMMS

SEQ ID NO: 2812060 - protein, 19 aa, Entamoeba invadens
MGGSLAFYVKMLIEKIDLL

SEQ ID NO: 2812061 - protein, 21 aa, Entamoeba invadens
MGIEPVCMFDFLKNKDVNLTN

SEQ ID NO: 2812062 - protein, 18 aa, Entamoeba invadens
MGILSPRITQKVCVKLTM

SEQ ID NO: 2812063 - protein, 18 aa, Entamoeba invadens
MGLRLGGSPLKIFSNMCI

SEQ ID NO: 2812064 - protein, 20 aa, Entamoeba invadens
MGTLKICSFSVFFASDEQSF

SEQ ID NO: 2812065 - protein, 18 aa, Entamoeba invadens
MGWSCIIYGPAVVYFCPY

SEQ ID NO: 2812066 - protein, 22 aa, Entamoeba invadens
MIEEIDFFKGWHQTNLVTLDVY

SEQ ID NO: 2812067 - protein, 17 aa, Entamoeba invadens
MILEFFGSLLLGTLLRI

SEQ ID NO: 2812068 - protein, 18 aa, Entamoeba invadens
MISWALNMISIFSLQVLP

SEQ ID NO: 2812069 - protein, 23 aa, Entamoeba invadens
MITCISCSLFACMGAMLYIHTRD

SEQ ID NO: 2812070 - protein, 17 aa, Entamoeba invadens
MKCFNLFYGCYSRDYKL

SEQ ID NO: 2812071 - protein, 18 aa, Entamoeba invadens
MKDLMIADTLKYVVGVCD

SEQ ID NO: 2812072 - protein, 19 aa, Entamoeba invadens
MKISISIGVVFSLFSSGSL

SEQ ID NO: 2812073 - protein, 22 aa, Entamoeba invadens
MKKAIVCLPSYFLDNNKCNLCS

SEQ ID NO: 2812074 - protein, 23 aa, Entamoeba invadens
MKKLNGWIALVAILFIFSCFTPL

SEQ ID NO: 2812075 - protein, 22 aa, Entamoeba invadens
MKLLCHPLRIEFIEKFNQIFAQ

SEQ ID NO: 2812076 - protein, 21 aa, Entamoeba invadens
MKLRLKFMLDVAMGIMYLHEN

SEQ ID NO: 2812077 - protein, 23 aa, Entamoeba invadens
MKWLRKRVVDLMAVFPSYMRVKR

SEQ ID NO: 2812078 - protein, 21 aa, Entamoeba invadens
MKYRVGKWFKLNMTPIKNNYI

SEQ ID NO: 2812079 - protein, 19 aa, Entamoeba invadens
MLAWKEWLAPRRHLYDRVF

SEQ ID NO: 2812080 - protein, 17 aa, Entamoeba invadens
MLFEVFLCLTIRTVSIF

SEQ ID NO: 2812081 - protein, 18 aa, Entamoeba invadens
MLFFSFLCCAGIGMLGTC

SEQ ID NO: 2812082 - protein, 18 aa, Entamoeba invadens
MLFGLAFGLIVYFGFQKW

SEQ ID NO: 2812083 - protein, 18 aa, Entamoeba invadens
MLFVWDRYIGITVNTKLH

SEQ ID NO: 2812084 - protein, 17 aa, Entamoeba invadens
MLLCKNVTIEVRNHSLI

SEQ ID NO: 2812085 - protein, 17 aa, Entamoeba invadens
MLLLVSWLLSGFYLMPT

SEQ ID NO: 2812086 - protein, 17 aa, Entamoeba invadens
MLNCLQCEPGWYLIGQN

SEQ ID NO: 2812087 - protein, 20 aa, Entamoeba invadens
MLRRILRMFLYFHPHGYFQG

SEQ ID NO: 2812088 - protein, 19 aa, Entamoeba invadens
MMDFPAKFGLILEGNTTLG

SEQ ID NO: 2812089 - protein, 17 aa, Entamoeba invadens
MMICVACGQAPPFSAIM

SEQ ID NO: 2812090 - protein, 28 aa, Entamoeba invadens
MMKVKYYLKDCVDYSFGRFFGLKQNPFD

SEQ ID NO: 2812091 - protein, 19 aa, Entamoeba invadens
MNCLYRFSLELSNEQSDLE

SEQ ID NO: 2812092 - protein, 17 aa, Entamoeba invadens
MNLIICICCCKLCCVDS

SEQ ID NO: 2812093 - protein, 24 aa, Entamoeba invadens
MNLWEIFPLIAFVVLFWKLPKQNR

SEQ ID NO: 2812094 - protein, 21 aa, Entamoeba invadens
MNMKSLWLGFLVPRIVFCSIV

SEQ ID NO: 2812095 - protein, 18 aa, Entamoeba invadens
MNQELELLLGTLYEKYKE

SEQ ID NO: 2812096 - protein, 17 aa, Entamoeba invadens
MPLCWIACGVMYLKSSV

SEQ ID NO: 2812097 - protein, 21 aa, Entamoeba invadens
MPPELRLDGVIKLKSDVFSYA

SEQ ID NO: 2812098 - protein, 22 aa, Entamoeba invadens
MQKIRRWVVCVIILFIFSLFTP

SEQ ID NO: 2812099 - protein, 23 aa, Entamoeba invadens
MQKIRRWVVCVIILFIFSLFTPI

SEQ ID NO: 2812100 - protein, 20 aa, Entamoeba invadens
MQVLCMLCDKHSLSVDEVQD

SEQ ID NO: 2812101 - protein, 19 aa, Entamoeba invadens
MRIKFCLDAAKGIQYLHTN

SEQ ID NO: 2812102 - protein, 22 aa, Entamoeba invadens
MSGCALCSKGYFIVNQMCAKCD

SEQ ID NO: 2812103 - protein, 23 aa, Entamoeba invadens
MSGCLVCATGYYLDNWLCSKCSI

SEQ ID NO: 2812104 - protein, 25 aa, Entamoeba invadens
MSIMMLWPRVEKFGSPEFRKLSVID

SEQ ID NO: 2812105 - protein, 17 aa, Entamoeba invadens
MSIVFLCLGSSKKLHEK

SEQ ID NO: 2812106 - protein, 21 aa, Entamoeba invadens
MSKACKWRFGFTVVTFLIALV

SEQ ID NO: 2812107 - protein, 25 aa, Entamoeba invadens
MSKDRDPYCAYSFLSYSAFNTLKKL

SEQ ID NO: 2812108 - protein, 25 aa, Entamoeba invadens
MSSALRNFLFWGIGCIAYLLLYLFL

SEQ ID NO: 2812109 - protein, 22 aa, Entamoeba invadens
MSWILGFERFYICPLRGPIQSF

SEQ ID NO: 2812110 - protein, 23 aa, Entamoeba invadens
MTELLKVRFCQDIAKGMEYLHHN

SEQ ID NO: 2812111 - protein, 20 aa, Entamoeba invadens
MTFYKLSRVFSFNFQGNGHF

SEQ ID NO: 2812112 - protein, 21 aa, Entamoeba invadens
MTLFCIWKLLNSFIHLVGLTS

SEQ ID NO: 2812113 - protein, 20 aa, Entamoeba invadens
MTMFECFKWGEAYPVEQFEY

SEQ ID NO: 2812114 - protein, 23 aa, Entamoeba invadens
MTMFECFRWKDAYDKIEFKYPWK

SEQ ID NO: 2812115 - protein, 23 aa, Entamoeba invadens
MTMYECFRWKDAYDKIEFKYPWK

SEQ ID NO: 2812116 - protein, 19 aa, Entamoeba invadens
MTRIVPLFLAVYIFVDSPC

SEQ ID NO: 2812117 - protein, 25 aa, Entamoeba invadens
MTTHLKIRFCQDIARGMEYLHQNDI

SEQ ID NO: 2812118 - protein, 18 aa, Entamoeba invadens
MVGGLICRLQPFKYITHF

SEQ ID NO: 2812119 - protein, 17 aa, Entamoeba invadens
MVHLYLLIEIVRTVMGW

SEQ ID NO: 2812120 - protein, 19 aa, Entamoeba invadens
MVHMICMLVLWLVPMTRRI

SEQ ID NO: 2812121 - protein, 22 aa, Entamoeba invadens
MVLRVGGLVQFFSILNFGFDSD

SEQ ID NO: 2812122 - protein, 18 aa, Entamoeba invadens
MWNICYLVLIGSIIYVFD

SEQ ID NO: 2812123 - protein, 17 aa, Entamoeba invadens
MYAVLPFILDIVNGDEV

SEQ ID NO: 2812124 - protein, 17 aa, Entamoeba invadens
MYECLRWKEAYDKQTFK

SEQ ID NO: 2812125 - protein, 18 aa, Entamoeba invadens
MYEVFGWKSSYPKDEFKY

SEQ ID NO: 2812126 - protein, 21 aa, Entamoeba invadens
MYEVIWRLVLVFANCVVLVFF

SEQ ID NO: 2812127 - protein, 18 aa, Entamoeba invadens
MYIIFKLNVIFYVQMVFN

SEQ ID NO: 2812128 - protein, 17 aa, Entamoeba invadens
MYKELECDLELIGATAI

SEQ ID NO: 2812129 - protein, 19 aa, Entamoeba invadens
MYVLCSFGYSFVIRKPTKT

SEQ ID NO: 2812130 - protein, 25 aa, Entamoeba invadens
NAAMKIRCCLDVAKGMAYLHNNNVT

SEQ ID NO: 2812131 - protein, 19 aa, Entamoeba invadens
NACVLRFSPHTKFIVSRGA

SEQ ID NO: 2812132 - protein, 23 aa, Entamoeba invadens
NAFTCLSCSSGLYLNEHQCNNNT

SEQ ID NO: 2812133 - protein, 20 aa, Entamoeba invadens
NAFVEPDCVKSILDNSNKLT

SEQ ID NO: 2812134 - protein, 21 aa, Entamoeba invadens
NAIRISLRLGVVEFSLMLLRI

SEQ ID NO: 2812135 - protein, 19 aa, Entamoeba invadens
NALKRFFMISTNYDEKLIN

SEQ ID NO: 2812136 - protein, 19 aa, Entamoeba invadens
NALKRFFMISTSYDENLIN

SEQ ID NO: 2812137 - protein, 20 aa, Entamoeba invadens
NASPSANCFGGFEETIIVDD

SEQ ID NO: 2812138 - protein, 21 aa, Entamoeba invadens
NCALCEGGLCKRCSENYLMTS

SEQ ID NO: 2812139 - protein, 24 aa, Entamoeba invadens
NCFDLGESCFMGFISLVSIQLPDN

SEQ ID NO: 2812140 - protein, 20 aa, Entamoeba invadens
NCGRCLFGYECSNKGICEKV

SEQ ID NO: 2812141 - protein, 18 aa, Entamoeba invadens
NCHKMLLNHCVAIAGYGV

SEQ ID NO: 2812142 - protein, 19 aa, Entamoeba invadens
NCIGLGMGFFMFVNLCTFA

SEQ ID NO: 2812143 - protein, 24 aa, Entamoeba invadens
NCKLCSRKNCYTCSSGFSLVNGKC

SEQ ID NO: 2812144 - protein, 25 aa, Entamoeba invadens
NCLCDFSSTCAFVFEDDDVHIKVPQ

SEQ ID NO: 2812145 - protein, 18 aa, Entamoeba invadens
NCLFCRMKDVLILNRYIP

SEQ ID NO: 2812146 - protein, 23 aa, Entamoeba invadens
NCLHCAKGKCVLCDKEYIVDVNR

SEQ ID NO: 2812147 - protein, 17 aa, Entamoeba invadens
NCLKLVLIVLFWVFVLA

SEQ ID NO: 2812148 - protein, 17 aa, Entamoeba invadens
NCLSCLDGKCINCLDGY

SEQ ID NO: 2812149 - protein, 18 aa, Entamoeba invadens
NCNACSPISVGVSNCTTC

SEQ ID NO: 2812150 - protein, 19 aa, Entamoeba invadens
NCQLRFPNPVNILTYKQPS

SEQ ID NO: 2812151 - protein, 28 aa, Entamoeba invadens
NCRTCLLNSTFCLSCPEGTFLSNHKCVT

SEQ ID NO: 2812152 - protein, 19 aa, Entamoeba invadens
NCTLCDFKRCYSCEENYKL

SEQ ID NO: 2812153 - protein, 22 aa, Entamoeba invadens
NCTYPSVYGCLRCSSGYFQDDN

SEQ ID NO: 2812154 - protein, 22 aa, Entamoeba invadens
NCVAVECPFWLAPEVVNTSVFE

SEQ ID NO: 2812155 - protein, 20 aa, Entamoeba invadens
NCVSCGYGFFSNNGICEQCS

SEQ ID NO: 2812156 - protein, 18 aa, Entamoeba invadens
NCWEHCAADRVCIDEVVL

SEQ ID NO: 2812157 - protein, 17 aa, Entamoeba invadens
NDCLFCYNTTYCTTCRS

SEQ ID NO: 2812158 - protein, 22 aa, Entamoeba invadens
NDECFRYANLVLCSVETGEGTS

SEQ ID NO: 2812159 - protein, 17 aa, Entamoeba invadens
NDFISLFSELLIQRNHF

SEQ ID NO: 2812160 - protein, 19 aa, Entamoeba invadens
NDISKFAVYVLRSIARFIL

SEQ ID NO: 2812161 - protein, 19 aa, Entamoeba invadens
NDKGLCFTSQWTSNDDSVR

SEQ ID NO: 2812162 - protein, 17 aa, Entamoeba invadens
NDNCALCVGGKCQMCSA

SEQ ID NO: 2812163 - protein, 18 aa, Entamoeba invadens
NDNCALCVGGKCQMCSAN

SEQ ID NO: 2812164 - protein, 22 aa, Entamoeba invadens
NDRRWALWFGFVLQIVGIILCL

SEQ ID NO: 2812165 - protein, 23 aa, Entamoeba invadens
NDTLRLLFPFSFATKSKIFMNKN

SEQ ID NO: 2812166 - protein, 17 aa, Entamoeba invadens
NECIQCKQGYILSNGQC

SEQ ID NO: 2812167 - protein, 21 aa, Entamoeba invadens
NECSLCKTGYVLSQYLACLIS

SEQ ID NO: 2812168 - protein, 23 aa, Entamoeba invadens
NEDFRFPWDIAMFVSSQKRPEIR

SEQ ID NO: 2812169 - protein, 21 aa, Entamoeba invadens
NEFKFPWKIAEFVISGKRLER

SEQ ID NO: 2812170 - protein, 17 aa, Entamoeba invadens
NEFKFPWKIAEFVMEGK

SEQ ID NO: 2812171 - protein, 27 aa, Entamoeba invadens
NEGFLLMLCYYLGCAITLTKLQKKGKN

SEQ ID NO: 2812172 - protein, 23 aa, Entamoeba invadens
NEGMSGLINHCWCQSPEERYSFE

SEQ ID NO: 2812173 - protein, 21 aa, Entamoeba invadens
NEGYYRFGLDCVKCDSKCFTC

SEQ ID NO: 2812174 - protein, 17 aa, Entamoeba invadens
NEKCGFCEDGGEFCNID

SEQ ID NO: 2812175 - protein, 18 aa, Entamoeba invadens
NELFEVFGVRYFEVRAGY

SEQ ID NO: 2812176 - protein, 17 aa, Entamoeba invadens
NEMMKIVIGFAVAVLVM

SEQ ID NO: 2812177 - protein, 22 aa, Entamoeba invadens
NERDCLFECFGIIIGLSRAELC

SEQ ID NO: 2812178 - protein, 17 aa, Entamoeba invadens
NERRCYPCSVGCATCDA

SEQ ID NO: 2812179 - protein, 18 aa, Entamoeba invadens
NETICLKGNLMIIAITTS

SEQ ID NO: 2812180 - protein, 25 aa, Entamoeba invadens
NEVPGWAIAIIVVFAVCTVIVLVLL

SEQ ID NO: 2812181 - protein, 22 aa, Entamoeba invadens
NEVWKSTLFTRAVHFCHIPLCS

SEQ ID NO: 2812182 - protein, 25 aa, Entamoeba invadens
NEYEVIDGFCWPKCKGDKTVRYNGV

SEQ ID NO: 2812183 - protein, 17 aa, Entamoeba invadens
NFCFLHNRFEFIHQSDQ

SEQ ID NO: 2812184 - protein, 21 aa, Entamoeba invadens
NFCLSCPNGFYLNSQKTCMSC

SEQ ID NO: 2812185 - protein, 21 aa, Entamoeba invadens
NFCLTCPGGMFVSNGVCKQNG

SEQ ID NO: 2812186 - protein, 20 aa, Entamoeba invadens
NFCRKCTSGVLYGVCDVCSS

SEQ ID NO: 2812187 - protein, 25 aa, Entamoeba invadens
NFFAYPACMPGIFMKIYVFHIKYIG

SEQ ID NO: 2812188 - protein, 18 aa, Entamoeba invadens
NFILEWEFNVSFKGSHAQ

SEQ ID NO: 2812189 - protein, 19 aa, Entamoeba invadens
NFINWRLILLFPLALVFGF

SEQ ID NO: 2812190 - protein, 21 aa, Entamoeba invadens
NFLLDLALEFGYFFDSKLARN

SEQ ID NO: 2812191 - protein, 17 aa, Entamoeba invadens
NFSSLCNSFFISETGIK

SEQ ID NO: 2812192 - protein, 18 aa, Entamoeba invadens
NFYVAWKLDTSIGKFYGK

SEQ ID NO: 2812193 - protein, 19 aa, Entamoeba invadens
NGISGWGIWGILFYGIYFV

SEQ ID NO: 2812194 - protein, 22 aa, Entamoeba invadens
NGKCLKCVSGFYLDKLSSTCQL

SEQ ID NO: 2812195 - protein, 18 aa, Entamoeba invadens
NGKCPVCVDGYFNTPARV

SEQ ID NO: 2812196 - protein, 18 aa, Entamoeba invadens
NGKCSVFGDKNCERAILD

SEQ ID NO: 2812197 - protein, 22 aa, Entamoeba invadens
NGLCLECKWGSFLEDGKCVSTC

SEQ ID NO: 2812198 - protein, 18 aa, Entamoeba invadens
NGLYIGIGCYDWVTPKNV

SEQ ID NO: 2812199 - protein, 24 aa, Entamoeba invadens
NGNCFKCAFGYYISGGECAVCNIE

SEQ ID NO: 2812200 - protein, 21 aa, Entamoeba invadens
NGQLFWVYQIIRMMCSIISST

SEQ ID NO: 2812201 - protein, 21 aa, Entamoeba invadens
NGRCKKCTYGYVVGSSGLCEE

SEQ ID NO: 2812202 - protein, 19 aa, Entamoeba invadens
NGVACAIWFFILACLSFFM

SEQ ID NO: 2812203 - protein, 17 aa, Entamoeba invadens
NGYAVFHLLRWLPGSEE

SEQ ID NO: 2812204 - protein, 20 aa, Entamoeba invadens
NHTFFWTVFFVMQFSTVFIA

SEQ ID NO: 2812205 - protein, 26 aa, Entamoeba invadens
NICHRCLKGFYLSNGICKKCADNCDD

SEQ ID NO: 2812206 - protein, 19 aa, Entamoeba invadens
NIDHCLKCDNGFPDNGTCV

SEQ ID NO: 2812207 - protein, 20 aa, Entamoeba invadens
NIFFCKTETFVLGINSISKP

SEQ ID NO: 2812208 - protein, 18 aa, Entamoeba invadens
NIFFCVFVSLGLHKKLVH

SEQ ID NO: 2812209 - protein, 18 aa, Entamoeba invadens
NIFKFPWKIAEFVNDGKR

SEQ ID NO: 2812210 - protein, 17 aa, Entamoeba invadens
NIFRISFYFGERYDTFL

SEQ ID NO: 2812211 - protein, 24 aa, Entamoeba invadens
NIIKEYRDIGAFSIDWKDLKKLRE

SEQ ID NO: 2812212 - protein, 17 aa, Entamoeba invadens
NIKTCTFCELNHFLLTN

SEQ ID NO: 2812213 - protein, 19 aa, Entamoeba invadens
NILALWAFYPSFRGPSHTH

SEQ ID NO: 2812214 - protein, 21 aa, Entamoeba invadens
NIPTWKILIGLAYRMVVFPVV

SEQ ID NO: 2812215 - protein, 21 aa, Entamoeba invadens
NISGKCLMCYAGYGLGHNGNC

SEQ ID NO: 2812216 - protein, 25 aa, Entamoeba invadens
NISRFGIEFRWSWLTIIICIFSNLK

SEQ ID NO: 2812217 - protein, 19 aa, Entamoeba invadens
NIVTFPWLFGVMFSDAGHG

SEQ ID NO: 2812218 - protein, 17 aa, Entamoeba invadens
NKCFECSNGCLKCVKEG

SEQ ID NO: 2812219 - protein, 17 aa, Entamoeba invadens
NKCSLTGCVECEYIESI

SEQ ID NO: 2812220 - protein, 19 aa, Entamoeba invadens
NKEQCLLCQDGYYLQNNGS

SEQ ID NO: 2812221 - protein, 17 aa, Entamoeba invadens
NKFDPICNVIWDKTILN

SEQ ID NO: 2812222 - protein, 19 aa, Entamoeba invadens
NKFKFSIGFVNTGYSVTDR

SEQ ID NO: 2812223 - protein, 19 aa, Entamoeba invadens
NKIKMCFSNVVSYVERIQT

SEQ ID NO: 2812224 - protein, 17 aa, Entamoeba invadens
NKKCLKCNDDFFLDNES

SEQ ID NO: 2812225 - protein, 23 aa, Entamoeba invadens
NKKKWCLIFCVKRIIHIFQGGFF

SEQ ID NO: 2812226 - protein, 19 aa, Entamoeba invadens
NKLTGIGAMFEKLISDSFG

SEQ ID NO: 2812227 - protein, 19 aa, Entamoeba invadens
NKTKVFAIKHFDIVADQLK

SEQ ID NO: 2812228 - protein, 19 aa, Entamoeba invadens
NKTLLRYGLHNELFCHLEN

SEQ ID NO: 2812229 - protein, 23 aa, Entamoeba invadens
NKTREGLTLFGLYVTSFMLVLLV

SEQ ID NO: 2812230 - protein, 23 aa, Entamoeba invadens
NKVDFKFLWKIAEFVISGKGLPN

SEQ ID NO: 2812231 - protein, 21 aa, Entamoeba invadens
NKVDFKFLWNIAEFVISGKRL

SEQ ID NO: 2812232 - protein, 18 aa, Entamoeba invadens
NLEMMLAFPEVRCKSPEV

SEQ ID NO: 2812233 - protein, 18 aa, Entamoeba invadens
NLFEEFDCNLYAKDGTNQ

SEQ ID NO: 2812234 - protein, 19 aa, Entamoeba invadens
NLFKFPWKIAEFVISGKRL

SEQ ID NO: 2812235 - protein, 18 aa, Entamoeba invadens
NLIIKYKFFVHLIQKVKS

SEQ ID NO: 2812236 - protein, 17 aa, Entamoeba invadens
NLIKALIILYKFDDTTP

SEQ ID NO: 2812237 - protein, 18 aa, Entamoeba invadens
NLKEVFVPKEIVGKDPIQ

SEQ ID NO: 2812238 - protein, 19 aa, Entamoeba invadens
NLKFTLKIFAFFLGLVIEN

SEQ ID NO: 2812239 - protein, 19 aa, Entamoeba invadens
NLKRAGLYVFFPFETNCGK

SEQ ID NO: 2812240 - protein, 21 aa, Entamoeba invadens
NLKSRPGFFLGVNEFVANVTY

SEQ ID NO: 2812241 - protein, 18 aa, Entamoeba invadens
NLLVFSLDFNERVNAKLT

SEQ ID NO: 2812242 - protein, 24 aa, Entamoeba invadens
NLNIELRLPLKYSLPSFNTTIYPM

SEQ ID NO: 2812243 - protein, 21 aa, Entamoeba invadens
NLRGCLWCRNGFFKASDGKNC

SEQ ID NO: 2812244 - protein, 20 aa, Entamoeba invadens
NLRKCLKCFAPYYLSSDGLL

SEQ ID NO: 2812245 - protein, 19 aa, Entamoeba invadens
NLRVVICAGAPLSQDIAKF

SEQ ID NO: 2812246 - protein, 19 aa, Entamoeba invadens
NLYCFAMGFLMISYNKGVE

SEQ ID NO: 2812247 - protein, 20 aa, Entamoeba invadens
NMIVTIRFNKVLAIDEVKNR

SEQ ID NO: 2812248 - protein, 22 aa, Entamoeba invadens
NMKDFPSNMVFVFLFNDLLIET

SEQ ID NO: 2812249 - protein, 17 aa, Entamoeba invadens
NMKIMTCYFTLFCTTKV

SEQ ID NO: 2812250 - protein, 19 aa, Entamoeba invadens
NMSYFSLWQAMRMPSFYLN

SEQ ID NO: 2812251 - protein, 25 aa, Entamoeba invadens
NMTYCLSCPPGFYISNNICKTNSEL

SEQ ID NO: 2812252 - protein, 22 aa, Entamoeba invadens
NNELKLKCVLNCDDTKCSFEQQ

SEQ ID NO: 2812253 - protein, 17 aa, Entamoeba invadens
NNIGATCTLQFSATTTS

SEQ ID NO: 2812254 - protein, 19 aa, Entamoeba invadens
NNKCLKCSPGQEVSKDLSS

SEQ ID NO: 2812255 - protein, 18 aa, Entamoeba invadens
NNKCVLCKRNYYFNNNGI

SEQ ID NO: 2812256 - protein, 24 aa, Entamoeba invadens
NNKLCFFSKFRLFKVFRCKKTNYG

SEQ ID NO: 2812257 - protein, 21 aa, Entamoeba invadens
NNMCLKCNNTLMVVKDGVCVL

SEQ ID NO: 2812258 - protein, 26 aa, Entamoeba invadens
NNNKCLPKKCLLGGVGGGVFFCSNGE

SEQ ID NO: 2812259 - protein, 22 aa, Entamoeba invadens
NNTEIWPIFLFLIIQGVGLAMF

SEQ ID NO: 2812260 - protein, 25 aa, Entamoeba invadens
NNYCKACAFQSIFLFLVFFISSLPF

SEQ ID NO: 2812261 - protein, 25 aa, Entamoeba invadens
NNYCKQCPLDLCSKCKESAVEGTNE

SEQ ID NO: 2812262 - protein, 17 aa, Entamoeba invadens
NPFPKTIYLFAWSIADE

SEQ ID NO: 2812263 - protein, 17 aa, Entamoeba invadens
NPFPKTIYPFAWSIADE

SEQ ID NO: 2812264 - protein, 23 aa, Entamoeba invadens
NPIRLKIRIKLMLDAARGMQYLH

SEQ ID NO: 2812265 - protein, 17 aa, Entamoeba invadens
NPKELWPPVLFTYMLSM

SEQ ID NO: 2812266 - protein, 18 aa, Entamoeba invadens
NPKYRIGKWIKLNMTLVK

SEQ ID NO: 2812267 - protein, 24 aa, Entamoeba invadens
NPTYCLSCPLGFYISNNICKTNSE

SEQ ID NO: 2812268 - protein, 21 aa, Entamoeba invadens
NQCPLCAAGYFSLENSPGCTA

SEQ ID NO: 2812269 - protein, 23 aa, Entamoeba invadens
NQQLRLTKTLSFNKLTLTPPTQV

SEQ ID NO: 2812270 - protein, 18 aa, Entamoeba invadens
NQSIKGWYLFNGLNTTLS

SEQ ID NO: 2812271 - protein, 22 aa, Entamoeba invadens
NRCLKCREGFLLKEGHCTYSDC

SEQ ID NO: 2812272 - protein, 18 aa, Entamoeba invadens
NRFCGICKTGYVITGNGC

SEQ ID NO: 2812273 - protein, 19 aa, Entamoeba invadens
NRHAELFSFLSIDPNIVFD

SEQ ID NO: 2812274 - protein, 20 aa, Entamoeba invadens
NRHDLKWSYIIKMTNFYSIA

SEQ ID NO: 2812275 - protein, 20 aa, Entamoeba invadens
NRIVFRIKMCIYKKREQRQY

SEQ ID NO: 2812276 - protein, 21 aa, Entamoeba invadens
NRIYTCFDFSKELPIMNLEDC

SEQ ID NO: 2812277 - protein, 20 aa, Entamoeba invadens
NRIYVGKCTFEFTQCTLTPT

SEQ ID NO: 2812278 - protein, 18 aa, Entamoeba invadens
NRRILRLLLTMSEDSVSV

SEQ ID NO: 2812279 - protein, 24 aa, Entamoeba invadens
NRTKIVGIWDFCWTLFGLPQIGLN

SEQ ID NO: 2812280 - protein, 21 aa, Entamoeba invadens
NSCKRCSTTFGELCDLCDFDK

SEQ ID NO: 2812281 - protein, 19 aa, Entamoeba invadens
NSDLTLRWTNNVYKEHALT

SEQ ID NO: 2812282 - protein, 18 aa, Entamoeba invadens
NSECIICHDNYYLGNDGI

SEQ ID NO: 2812283 - protein, 18 aa, Entamoeba invadens
NSKCSKCTFWHTPSVNGT

SEQ ID NO: 2812284 - protein, 18 aa, Entamoeba invadens
NSLIPSICCLLIYFMKGT

SEQ ID NO: 2812285 - protein, 23 aa, Entamoeba invadens
NSLRCLTCAEAFYFDESTKQCVN

SEQ ID NO: 2812286 - protein, 19 aa, Entamoeba invadens
NSMNLKMKWRCWINLDVSI

SEQ ID NO: 2812287 - protein, 24 aa, Entamoeba invadens
NSPFEIVDFIPFDVSIKMNGAESP

SEQ ID NO: 2812288 - protein, 23 aa, Entamoeba invadens
NSQCLTCASGFYLEQKECKQCGP

SEQ ID NO: 2812289 - protein, 22 aa, Entamoeba invadens
NSRGGVCSICPKETYLNDGKCE

SEQ ID NO: 2812290 - protein, 18 aa, Entamoeba invadens
NSTFMRWQVWQVNRNGEG

SEQ ID NO: 2812291 - protein, 20 aa, Entamoeba invadens
NSTMCLSCVDGFFLSDHICK

SEQ ID NO: 2812292 - protein, 18 aa, Entamoeba invadens
NSVCFLCDPLYYNRFGCI

SEQ ID NO: 2812293 - protein, 18 aa, Entamoeba invadens
NTFPTVWEDFGILRCDKS

SEQ ID NO: 2812294 - protein, 17 aa, Entamoeba invadens
NTIAFVFGTSKGSQISI

SEQ ID NO: 2812295 - protein, 22 aa, Entamoeba invadens
NTIGRLVFYLALLEPIFLEKSV

SEQ ID NO: 2812296 - protein, 17 aa, Entamoeba invadens
NTIKVQFVFKHNIHSTT

SEQ ID NO: 2812297 - protein, 17 aa, Entamoeba invadens
NTISFVFKTRVGSQLTI

SEQ ID NO: 2812298 - protein, 27 aa, Entamoeba invadens
NTKDEFKIVYGLNCGYGLYNKTTQQCE

SEQ ID NO: 2812299 - protein, 18 aa, Entamoeba invadens
NTMKSSCYNFNYWDSLGN

SEQ ID NO: 2812300 - protein, 19 aa, Entamoeba invadens
NTSCFVLCFSLVYMDSYKS

SEQ ID NO: 2812301 - protein, 24 aa, Entamoeba invadens
NTVFSQRIELVWKGSKGYSNRKEE

SEQ ID NO: 2812302 - protein, 18 aa, Entamoeba invadens
NVCQRWLGVRVELVGCLS

SEQ ID NO: 2812303 - protein, 18 aa, Entamoeba invadens
NVCQRWLGVRVEMIGCVG

SEQ ID NO: 2812304 - protein, 20 aa, Entamoeba invadens
NVCVPMEMLAYFKNFNIKLK

SEQ ID NO: 2812305 - protein, 17 aa, Entamoeba invadens
NVFCLNCTSLLCGGDLD

SEQ ID NO: 2812306 - protein, 19 aa, Entamoeba invadens
NVFKFPWKIAEFVISGKRL

SEQ ID NO: 2812307 - protein, 18 aa, Entamoeba invadens
NVLFVFRPDRICFSSSGN

SEQ ID NO: 2812308 - protein, 20 aa, Entamoeba invadens
NVLNRLKTVIIYSLETAEFF

SEQ ID NO: 2812309 - protein, 22 aa, Entamoeba invadens
NVLRPFLFYVVFKKNMIVTIRF

SEQ ID NO: 2812310 - protein, 17 aa, Entamoeba invadens
NVNCGICKWDATQNKVV

SEQ ID NO: 2812311 - protein, 23 aa, Entamoeba invadens
NVNWKRLYGVSAITVNNNCILKV

SEQ ID NO: 2812312 - protein, 20 aa, Entamoeba invadens
NVPKCLFDGLFLFFELFLTQ

SEQ ID NO: 2812313 - protein, 22 aa, Entamoeba invadens
NVRSGLCKPCYQMFDKCLNCFS

SEQ ID NO: 2812314 - protein, 23 aa, Entamoeba invadens
NVSSRKFICCGPLLSVMNMKDFP

SEQ ID NO: 2812315 - protein, 17 aa, Entamoeba invadens
NVTIPVFLWIVTFIVLV

SEQ ID NO: 2812316 - protein, 20 aa, Entamoeba invadens
NYCKKCSTANCAICNANNVC

SEQ ID NO: 2812317 - protein, 18 aa, Entamoeba invadens
NYGAFLWKKGVFETTQKG

SEQ ID NO: 2812318 - protein, 18 aa, Entamoeba invadens
NYPDCRYNHSLFDLDIQK

SEQ ID NO: 2812319 - protein, 18 aa, Entamoeba invadens
NYTAFCFMNGTNFVPWYD

SEQ ID NO: 2812320 - protein, 23 aa, Entamoeba invadens
NYVPLRFLYSLLFVNKKNRNLIS

SEQ ID NO: 2812321 - protein, 17 aa, Entamoeba invadens
NYYNGKCSYIFSTAKNI

SEQ ID NO: 2812322 - protein, 17 aa, Entamoeba invadens
PAVFLKRIYPLEMGKID

SEQ ID NO: 2812323 - protein, 20 aa, Entamoeba invadens
PCHLLAADCRLDYGNIPTTV

SEQ ID NO: 2812324 - protein, 17 aa, Entamoeba invadens
PCIWGAFNLVTGWVTGT

SEQ ID NO: 2812325 - protein, 20 aa, Entamoeba invadens
PDCLRNGTFFNLTILKNQSE

SEQ ID NO: 2812326 - protein, 20 aa, Entamoeba invadens
PDFIHFLPLVMKRVVNILEE

SEQ ID NO: 2812327 - protein, 24 aa, Entamoeba invadens
PDGCILCATGFYLSNGRCVKCDNN

SEQ ID NO: 2812328 - protein, 17 aa, Entamoeba invadens
PDGYFAKAKVCTVCPDN

SEQ ID NO: 2812329 - protein, 19 aa, Entamoeba invadens
PDGYFAKAKVCTVCPDNCK

SEQ ID NO: 2812330 - protein, 18 aa, Entamoeba invadens
PDKACPCYNDISGKGGDC

SEQ ID NO: 2812331 - protein, 19 aa, Entamoeba invadens
PDKACPCYNDISGKGGDCL

SEQ ID NO: 2812332 - protein, 21 aa, Entamoeba invadens
PDLYLRGALCFFTHFFNTENV

SEQ ID NO: 2812333 - protein, 19 aa, Entamoeba invadens
PDQYWALAVSSIFVSGFWC

SEQ ID NO: 2812334 - protein, 21 aa, Entamoeba invadens
PDYRFFFIYSIYYYNTTNIIF

SEQ ID NO: 2812335 - protein, 18 aa, Entamoeba invadens
PECYEHWDDLVLQNLEPS

SEQ ID NO: 2812336 - protein, 22 aa, Entamoeba invadens
PEDMLRKYSWCLLITNETIKIQ

SEQ ID NO: 2812337 - protein, 20 aa, Entamoeba invadens
PEEMYRLFPFKNKIVEVNGR

SEQ ID NO: 2812338 - protein, 22 aa, Entamoeba invadens
PEFKFPWKIAKFISSGKRPEIP

SEQ ID NO: 2812339 - protein, 18 aa, Entamoeba invadens
PEGFKDVYTYAGDVYSFG

SEQ ID NO: 2812340 - protein, 17 aa, Entamoeba invadens
PELFLKIPMLIKANNDT

SEQ ID NO: 2812341 - protein, 24 aa, Entamoeba invadens
PELLKLRFCQDIARGMEYLHENDI

SEQ ID NO: 2812342 - protein, 17 aa, Entamoeba invadens
PELNTLFGMVKFPTDDL

SEQ ID NO: 2812343 - protein, 20 aa, Entamoeba invadens
PELYELIALIAAPPKENNTT

SEQ ID NO: 2812344 - protein, 20 aa, Entamoeba invadens
PESLSITFLVMWLGGDLTNL

SEQ ID NO: 2812345 - protein, 24 aa, Entamoeba invadens
PEVICLKPKFACEFSIYIKPLCTC

SEQ ID NO: 2812346 - protein, 19 aa, Entamoeba invadens
PEVLDYLGVAFGYTPQLAK

SEQ ID NO: 2812347 - protein, 24 aa, Entamoeba invadens
PFADELKRHFSLRHTKTKFKPRIN

SEQ ID NO: 2812348 - protein, 25 aa, Entamoeba invadens
PFFAFQVFCSVLWMLDDMPIFAFMM

SEQ ID NO: 2812349 - protein, 20 aa, Entamoeba invadens
PFIQLVCAFAIYPEFGSHFE

SEQ ID NO: 2812350 - protein, 18 aa, Entamoeba invadens
PFLFFGAFILLRSPKTEL

SEQ ID NO: 2812351 - protein, 20 aa, Entamoeba invadens
PFLKGCEPFCGVCRDGFVCS

SEQ ID NO: 2812352 - protein, 25 aa, Entamoeba invadens
PFNRKQFKFSWDIADFVVAGKRLEK

SEQ ID NO: 2812353 - protein, 19 aa, Entamoeba invadens
PFPCSACYYPGVNGNCSKC

SEQ ID NO: 2812354 - protein, 26 aa, Entamoeba invadens
PFVFCYRVLCGIIFYSFRGVIEHIWL

SEQ ID NO: 2812355 - protein, 19 aa, Entamoeba invadens
PFYLISIVSFLFRYDNIVS

SEQ ID NO: 2812356 - protein, 18 aa, Entamoeba invadens
PFYYGFKKFFGYFTLISY

SEQ ID NO: 2812357 - protein, 18 aa, Entamoeba invadens
PGGESVMFKERFSDWASV

SEQ ID NO: 2812358 - protein, 18 aa, Entamoeba invadens
PGQMFPIGMSSGYETPYV

SEQ ID NO: 2812359 - protein, 22 aa, Entamoeba invadens
PGYPPAICKDGFKGNTKITSVK

SEQ ID NO: 2812360 - protein, 21 aa, Entamoeba invadens
PHCPCKDCQLFLQENLINCNN

SEQ ID NO: 2812361 - protein, 25 aa, Entamoeba invadens
PHESHLPISIGIDWGYDTIVVSTKT

SEQ ID NO: 2812362 - protein, 24 aa, Entamoeba invadens
PHICVGDGYGALVLFQIITAGKYD

SEQ ID NO: 2812363 - protein, 17 aa, Entamoeba invadens
PHMFLFWGFGSVGVLSL

SEQ ID NO: 2812364 - protein, 17 aa, Entamoeba invadens
PIFCVLSVGLLQYQNSV

SEQ ID NO: 2812365 - protein, 20 aa, Entamoeba invadens
PIGCLRCAKGYYTDKENKCS

SEQ ID NO: 2812366 - protein, 24 aa, Entamoeba invadens
PILHLVSLFALWFLPLQRKFQSWL

SEQ ID NO: 2812367 - protein, 19 aa, Entamoeba invadens
PKARIVTILYNFVPHNCPI

SEQ ID NO: 2812368 - protein, 18 aa, Entamoeba invadens
PKCAVQVERSCYCGAEKS

SEQ ID NO: 2812369 - protein, 17 aa, Entamoeba invadens
PKCLKCFAPYVISNQMC

SEQ ID NO: 2812370 - protein, 18 aa, Entamoeba invadens
PKEDKWKNVFTFKNNAKE

SEQ ID NO: 2812371 - protein, 22 aa, Entamoeba invadens
PKEEFKFAWSIADFITSGKRIV

SEQ ID NO: 2812372 - protein, 20 aa, Entamoeba invadens
PKEFFKFAWSIADFVASGKH

SEQ ID NO: 2812373 - protein, 19 aa, Entamoeba invadens
PKFACEFSLFLNPLCTSTI

SEQ ID NO: 2812374 - protein, 19 aa, Entamoeba invadens
PKFACEFSLFLSPLCTSTI

SEQ ID NO: 2812375 - protein, 20 aa, Entamoeba invadens
PKFETWWLTRVVPFMFFVFV

SEQ ID NO: 2812376 - protein, 18 aa, Entamoeba invadens
PKFPEIRDRIEAIWNGLY

SEQ ID NO: 2812377 - protein, 21 aa, Entamoeba invadens
PKFSCQWLELFSHRSLLYDLA

SEQ ID NO: 2812378 - protein, 17 aa, Entamoeba invadens
PKIVYPFAIVFDITLRF

SEQ ID NO: 2812379 - protein, 21 aa, Entamoeba invadens
PKKDFKFAWSVADFVSSGKRR

SEQ ID NO: 2812380 - protein, 20 aa, Entamoeba invadens
PKLFCTKCTIRAFHVVGDYE

SEQ ID NO: 2812381 - protein, 24 aa, Entamoeba invadens
PKLKKVCLEMCSFALHFPNKLQKL

SEQ ID NO: 2812382 - protein, 21 aa, Entamoeba invadens
PKLYRPASVVWLYANVMEKLG

SEQ ID NO: 2812383 - protein, 28 aa, Entamoeba invadens
PKMPVMWLYCWGMSVVLWVCCWRQRGEL

SEQ ID NO: 2812384 - protein, 23 aa, Entamoeba invadens
PKNEFKFAWIIADFVSSGKRKEK

SEQ ID NO: 2812385 - protein, 25 aa, Entamoeba invadens
PKNIFKYSWKIAEFVTAGKRVENIN

SEQ ID NO: 2812386 - protein, 25 aa, Entamoeba invadens
PKNIFKYSWKIAEFVTAGKRVENVN

SEQ ID NO: 2812387 - protein, 22 aa, Entamoeba invadens
PKQKFKFAWSIADFVTSGKRLE

SEQ ID NO: 2812388 - protein, 22 aa, Entamoeba invadens
PKQRFKFAWSIADFVTSGKRLE

SEQ ID NO: 2812389 - protein, 17 aa, Entamoeba invadens
PKQSFMFAWSIADFISS

SEQ ID NO: 2812390 - protein, 23 aa, Entamoeba invadens
PKQVAPLCAWRVVYLGFMCADLL

SEQ ID NO: 2812391 - protein, 20 aa, Entamoeba invadens
PKRMCELYWDYSIRRRWDSF

SEQ ID NO: 2812392 - protein, 24 aa, Entamoeba invadens
PKSEFKFAWCIANFVSKGNHLKKV

SEQ ID NO: 2812393 - protein, 22 aa, Entamoeba invadens
PKSEFKFAWSVADFVSKGNHLK

SEQ ID NO: 2812394 - protein, 22 aa, Entamoeba invadens
PKSEFKFAWSVADFVTSGKRRP

SEQ ID NO: 2812395 - protein, 22 aa, Entamoeba invadens
PKSEFKYAWSIADFITSGNRRQ

SEQ ID NO: 2812396 - protein, 18 aa, Entamoeba invadens
PKSPFNMRGVNVVLVPRK

SEQ ID NO: 2812397 - protein, 19 aa, Entamoeba invadens
PLFFKICNFLYLHFNFKNE

SEQ ID NO: 2812398 - protein, 17 aa, Entamoeba invadens
PLFNKVLPFDIPKKKRR

SEQ ID NO: 2812399 - protein, 18 aa, Entamoeba invadens
PLIIPLIKLRPYELLQHL

SEQ ID NO: 2812400 - protein, 21 aa, Entamoeba invadens
PLKKYICLSSDFIFTVSNEIL

SEQ ID NO: 2812401 - protein, 24 aa, Entamoeba invadens
PLPCLFSTALAFMFSRDIFSRLQS

SEQ ID NO: 2812402 - protein, 22 aa, Entamoeba invadens
PLQFICCGIFQLMCDAVIVGQM

SEQ ID NO: 2812403 - protein, 17 aa, Entamoeba invadens
PLQYFQLVHILKFRMGF

SEQ ID NO: 2812404 - protein, 17 aa, Entamoeba invadens
PLTEYYAMIALGENTQV

SEQ ID NO: 2812405 - protein, 17 aa, Entamoeba invadens
PLTLAICLFFWVPGMIF

SEQ ID NO: 2812406 - protein, 20 aa, Entamoeba invadens
PLVLKFIYKVLLFKPHTILQ

SEQ ID NO: 2812407 - protein, 18 aa, Entamoeba invadens
PLVMCIGCCMIKNPQTRP

SEQ ID NO: 2812408 - protein, 22 aa, Entamoeba invadens
PMKYRVGKWFKINMTDITNRFL

SEQ ID NO: 2812409 - protein, 22 aa, Entamoeba invadens
PMKYRVGKWFKLNMTPIKNNYM

SEQ ID NO: 2812410 - protein, 20 aa, Entamoeba invadens
PMNLDYVWRVAFALGAIPCL

SEQ ID NO: 2812411 - protein, 21 aa, Entamoeba invadens
PNHIFRGGFFFNRGLDDIKSL

SEQ ID NO: 2812412 - protein, 20 aa, Entamoeba invadens
PNKVSYDWLGIVTTLVSKYM

SEQ ID NO: 2812413 - protein, 19 aa, Entamoeba invadens
PNNCKRCVNQKCVLCEDKY

SEQ ID NO: 2812414 - protein, 18 aa, Entamoeba invadens
PNQWKVQLFFVIFFFMLF

SEQ ID NO: 2812415 - protein, 18 aa, Entamoeba invadens
PPFAKGCELLCGTCRDGF

SEQ ID NO: 2812416 - protein, 17 aa, Entamoeba invadens
PPFVYWIYFVKSNLFVL

SEQ ID NO: 2812417 - protein, 24 aa, Entamoeba invadens
PPIYCAGCGMFFGLLAVIVALQGS

SEQ ID NO: 2812418 - protein, 20 aa, Entamoeba invadens
PPKFACEFSLFLSPLCTSTI

SEQ ID NO: 2812419 - protein, 17 aa, Entamoeba invadens
PPKVLIFHLKRFEFTEK

SEQ ID NO: 2812420 - protein, 22 aa, Entamoeba invadens
PPLIPLSVCKKLEDLFSTSDAS

SEQ ID NO: 2812421 - protein, 17 aa, Entamoeba invadens
PPVGWIVFGVIVFVVFV

SEQ ID NO: 2812422 - protein, 17 aa, Entamoeba invadens
PQFKFPWEIADFVNNGK

SEQ ID NO: 2812423 - protein, 18 aa, Entamoeba invadens
PQFKFPWEIADFVNNSNR

SEQ ID NO: 2812424 - protein, 18 aa, Entamoeba invadens
PQFYQLICLLNFQESPVM

SEQ ID NO: 2812425 - protein, 17 aa, Entamoeba invadens
PQIWIWRHASLYQTINR

SEQ ID NO: 2812426 - protein, 19 aa, Entamoeba invadens
PQNCLRCVEHKCVSCETDY

SEQ ID NO: 2812427 - protein, 19 aa, Entamoeba invadens
PRASRIVTCYMTIYCTTKL

SEQ ID NO: 2812428 - protein, 20 aa, Entamoeba invadens
PRLIKCVTFITLYLLLIVVL

SEQ ID NO: 2812429 - protein, 17 aa, Entamoeba invadens
PRMAVKMKFMLDMANGI

SEQ ID NO: 2812430 - protein, 19 aa, Entamoeba invadens
PRRCSVLTLIRISQVRLDL

SEQ ID NO: 2812431 - protein, 20 aa, Entamoeba invadens
PRVDLYLMIFLKFLTTVIPT

SEQ ID NO: 2812432 - protein, 20 aa, Entamoeba invadens
PSFFSCSDFEFSAEYITNTP

SEQ ID NO: 2812433 - protein, 18 aa, Entamoeba invadens
PSFWIKVDLAGVVNTQSH

SEQ ID NO: 2812434 - protein, 17 aa, Entamoeba invadens
PSFYFMIRFHMKTIDSV

SEQ ID NO: 2812435 - protein, 19 aa, Entamoeba invadens
PSGMGELIEKCWGQDPLNR

SEQ ID NO: 2812436 - protein, 20 aa, Entamoeba invadens
PSHKIVHCMVVGTINPIYQN

SEQ ID NO: 2812437 - protein, 17 aa, Entamoeba invadens
PSIGEFMLKCLYEETVI

SEQ ID NO: 2812438 - protein, 19 aa, Entamoeba invadens
PSLLAGLIEKCWKHVPGDR

SEQ ID NO: 2812439 - protein, 25 aa, Entamoeba invadens
PSLLKHPFKVLAYICVTQFTLGLLS

SEQ ID NO: 2812440 - protein, 24 aa, Entamoeba invadens
PSNHNWKEVMAMTIIDSVVEQTSQ

SEQ ID NO: 2812441 - protein, 17 aa, Entamoeba invadens
PSPPFALASSVMLLMLS

SEQ ID NO: 2812442 - protein, 19 aa, Entamoeba invadens
PSQRPIVCMVAGFMNLKVN

SEQ ID NO: 2812443 - protein, 20 aa, Entamoeba invadens
PTCEKCKLFSCQEFSSMLLQ

SEQ ID NO: 2812444 - protein, 21 aa, Entamoeba invadens
PTECFRCALGYSVLQGNCTIP

SEQ ID NO: 2812445 - protein, 22 aa, Entamoeba invadens
PTHCLSCAPTYFFKTNTSECIK

SEQ ID NO: 2812446 - protein, 19 aa, Entamoeba invadens
PTINLRFNYDIFKEGFDCV

SEQ ID NO: 2812447 - protein, 20 aa, Entamoeba invadens
PTRPEIEVLKGLTFEAEKGK

SEQ ID NO: 2812448 - protein, 22 aa, Entamoeba invadens
PTVAFFKRGIHLFSNIDQHWWI

SEQ ID NO: 2812449 - protein, 18 aa, Entamoeba invadens
PTVVIYKRGLHLFSNIDQ

SEQ ID NO: 2812450 - protein, 23 aa, Entamoeba invadens
PTYCLSCPPGFYISNNICKTNSE

SEQ ID NO: 2812451 - protein, 19 aa, Entamoeba invadens
PVDSFSFSSIVAFVDAFNK

SEQ ID NO: 2812452 - protein, 24 aa, Entamoeba invadens
PVFDLRWVPELERFKRSQQLNMST

SEQ ID NO: 2812453 - protein, 18 aa, Entamoeba invadens
PVNYSLKFFRYFPSSVEF

SEQ ID NO: 2812454 - protein, 17 aa, Entamoeba invadens
PWNTFSFFTFVMYYIYM

SEQ ID NO: 2812455 - protein, 17 aa, Entamoeba invadens
PYFLDFLHSCFNVETIE

SEQ ID NO: 2812456 - protein, 17 aa, Entamoeba invadens
PYFPFGFLAVDFFFMLS

SEQ ID NO: 2812457 - protein, 22 aa, Entamoeba invadens
PYGCQRCSFGYYLNDLICDKCD

SEQ ID NO: 2812458 - protein, 17 aa, Entamoeba invadens
PYILKFFFFKLVGEIPN

SEQ ID NO: 2812459 - protein, 20 aa, Entamoeba invadens
PYRLDLAITRKLLVFSSNLG

SEQ ID NO: 2812460 - protein, 22 aa, Entamoeba invadens
PYTKLVMMLVCWLMPSTLLTPK

SEQ ID NO: 2812461 - protein, 17 aa, Entamoeba invadens
PYYFKFVPLTSLSQKSQ

SEQ ID NO: 2812462 - protein, 18 aa, Entamoeba invadens
QAECNLCPLGTYQNFRGT

SEQ ID NO: 2812463 - protein, 24 aa, Entamoeba invadens
QAFSHLKGALTIPVRNLNAYAAYN

SEQ ID NO: 2812464 - protein, 18 aa, Entamoeba invadens
QALQRILGEYVFDRLNSF

SEQ ID NO: 2812465 - protein, 24 aa, Entamoeba invadens
QAVWWVIFVCVFFRMIEHKRRKKA

SEQ ID NO: 2812466 - protein, 18 aa, Entamoeba invadens
QAVWWVIFVCVFFVLIVI

SEQ ID NO: 2812467 - protein, 22 aa, Entamoeba invadens
QAYRLKLLWCEFEPCAVLYDGM

SEQ ID NO: 2812468 - protein, 17 aa, Entamoeba invadens
QCGICNGFGIAGSGYPA

SEQ ID NO: 2812469 - protein, 17 aa, Entamoeba invadens
QCGICNGFGIAGSSYPA

SEQ ID NO: 2812470 - protein, 19 aa, Entamoeba invadens
QCISCLPGYYFSEDQKNCF

SEQ ID NO: 2812471 - protein, 23 aa, Entamoeba invadens
QCPCVGIDCLFRFNSNTIEIQNE

SEQ ID NO: 2812472 - protein, 20 aa, Entamoeba invadens
QDVYKRLGINDVVTKLESIN

SEQ ID NO: 2812473 - protein, 23 aa, Entamoeba invadens
QEDFKFSYPIVISKLNNNTSVTT

SEQ ID NO: 2812474 - protein, 19 aa, Entamoeba invadens
QEKCLLCSPDTYLWSDQIC

SEQ ID NO: 2812475 - protein, 18 aa, Entamoeba invadens
QEMFVCFLCIIIFGKFLL

SEQ ID NO: 2812476 - protein, 22 aa, Entamoeba invadens
QEMPRLFLRVKLMLDASKGILY

SEQ ID NO: 2812477 - protein, 18 aa, Entamoeba invadens
QEPIYMFSFGPAPVVLYI

SEQ ID NO: 2812478 - protein, 20 aa, Entamoeba invadens
QEYAAAFGFDYCAKEENQGK

SEQ ID NO: 2812479 - protein, 18 aa, Entamoeba invadens
QFKHAWSIADFTTSGKRL

SEQ ID NO: 2812480 - protein, 20 aa, Entamoeba invadens
QFLCVLWTFASRVYTMVNTN

SEQ ID NO: 2812481 - protein, 20 aa, Entamoeba invadens
QFLGCILVGKILRIPTLENR

SEQ ID NO: 2812482 - protein, 18 aa, Entamoeba invadens
QFMFPWKIAEFVMAGNHL

SEQ ID NO: 2812483 - protein, 18 aa, Entamoeba invadens
QFPLCVKLAGLILLCGTL

SEQ ID NO: 2812484 - protein, 25 aa, Entamoeba invadens
QFVKFATVCGVSFILRSILFTIGRM

SEQ ID NO: 2812485 - protein, 18 aa, Entamoeba invadens
QGCAFCKSGYYRSGDGCK

SEQ ID NO: 2812486 - protein, 22 aa, Entamoeba invadens
QGDLKLYLLVGGKLRDMTVLRR

SEQ ID NO: 2812487 - protein, 19 aa, Entamoeba invadens
QGMLLKRRYFRSLMKQDCG

SEQ ID NO: 2812488 - protein, 21 aa, Entamoeba invadens
QGSCFKYPWNIANYVVEGKRL

SEQ ID NO: 2812489 - protein, 24 aa, Entamoeba invadens
QHPTHCFCEYSIGLCEKCFICGLN

SEQ ID NO: 2812490 - protein, 20 aa, Entamoeba invadens
QIDFVGWIAICVAIVVILFV

SEQ ID NO: 2812491 - protein, 24 aa, Entamoeba invadens
QIDWRKRWPFILCSLFIGQLLVVL

SEQ ID NO: 2812492 - protein, 20 aa, Entamoeba invadens
QKAFLFTCVFAFQSLLLYVI

SEQ ID NO: 2812493 - protein, 17 aa, Entamoeba invadens
QKDCEKYATGNFSDLIV

SEQ ID NO: 2812494 - protein, 17 aa, Entamoeba invadens
QKIPILIEFVAGKGSLV

SEQ ID NO: 2812495 - protein, 18 aa, Entamoeba invadens
QKITEIWTKTVIDIGSGK

SEQ ID NO: 2812496 - protein, 22 aa, Entamoeba invadens
QKKAESFIMLFVRKEILGSFVL

SEQ ID NO: 2812497 - protein, 24 aa, Entamoeba invadens
QKLMLRLLLVYSIKHPASGYVQGF

SEQ ID NO: 2812498 - protein, 19 aa, Entamoeba invadens
QKVFICFPLSPAVRFVGFV

SEQ ID NO: 2812499 - protein, 28 aa, Entamoeba invadens
QKYLPFPVCIGLCVAFLSPLLFTVLASV

SEQ ID NO: 2812500 - protein, 18 aa, Entamoeba invadens
QLDCCSMPSTLVALDQSC

SEQ ID NO: 2812501 - protein, 19 aa, Entamoeba invadens
QLDQLRIGKNIKIGNFKNT

SEQ ID NO: 2812502 - protein, 27 aa, Entamoeba invadens
QLEMCLIGGVALEYGIPVVVWKKGVIF

SEQ ID NO: 2812503 - protein, 20 aa, Entamoeba invadens
QLFLLRWVRLLFCQIFPPQV

SEQ ID NO: 2812504 - protein, 18 aa, Entamoeba invadens
QLICLARALLKGSKILIM

SEQ ID NO: 2812505 - protein, 17 aa, Entamoeba invadens
QLKRLHVYGEIFAENGY

SEQ ID NO: 2812506 - protein, 24 aa, Entamoeba invadens
QLQALRFPIFDSFHKFAVRYCKAR

SEQ ID NO: 2812507 - protein, 20 aa, Entamoeba invadens
QLQYRMSIWFTLDLSTSTAT

SEQ ID NO: 2812508 - protein, 17 aa, Entamoeba invadens
QLSILLKRVVVMRYNDL

SEQ ID NO: 2812509 - protein, 18 aa, Entamoeba invadens
QMCKPGFVLKEFGCANMS

SEQ ID NO: 2812510 - protein, 23 aa, Entamoeba invadens
QMCSCAFHIFALVKNDPVWEKCS

SEQ ID NO: 2812511 - protein, 21 aa, Entamoeba invadens
QMPIALLCVFLLLAEALFLNW

SEQ ID NO: 2812512 - protein, 20 aa, Entamoeba invadens
QMRPRLLYYPLLEMLDILIF

SEQ ID NO: 2812513 - protein, 17 aa, Entamoeba invadens
QMVLLLFHFPPIWCIGD

SEQ ID NO: 2812514 - protein, 22 aa, Entamoeba invadens
QNFLKKRCKCVMKRAMDHSLFF

SEQ ID NO: 2812515 - protein, 18 aa, Entamoeba invadens
QNIFGCWRCDNIYYLDKS

SEQ ID NO: 2812516 - protein, 18 aa, Entamoeba invadens
QNKCFQRALVYVGGSDSF

SEQ ID NO: 2812517 - protein, 24 aa, Entamoeba invadens
QNSIKWKLPFTALKISESFVDVKN

SEQ ID NO: 2812518 - protein, 17 aa, Entamoeba invadens
QNSKVLFSFGFYDDICV

SEQ ID NO: 2812519 - protein, 18 aa, Entamoeba invadens
QNSLCWECADGFKLSDDK

SEQ ID NO: 2812520 - protein, 21 aa, Entamoeba invadens
QNVVLWSWFFFDIIIRSTVEY

SEQ ID NO: 2812521 - protein, 25 aa, Entamoeba invadens
QPCVKLIFSMCLYKTNLLIEFIKSL

SEQ ID NO: 2812522 - protein, 19 aa, Entamoeba invadens
QPISIFGSWYKLRIRENVN

SEQ ID NO: 2812523 - protein, 24 aa, Entamoeba invadens
QPKRAEGVFKIIFNKVPKHPFAHY

SEQ ID NO: 2812524 - protein, 20 aa, Entamoeba invadens
QPKWEIFLIIFLFVFEVSKI

SEQ ID NO: 2812525 - protein, 17 aa, Entamoeba invadens
QPQLLLIWDRFVAFPER

SEQ ID NO: 2812526 - protein, 19 aa, Entamoeba invadens
QQCSLEFGILCEKCDNKGC

SEQ ID NO: 2812527 - protein, 17 aa, Entamoeba invadens
QQFPDLYPKTAFKKTAN

SEQ ID NO: 2812528 - protein, 22 aa, Entamoeba invadens
QQITEILLVFGLTMTDTTTMGR

SEQ ID NO: 2812529 - protein, 18 aa, Entamoeba invadens
QQIWGWGCSHMMSGLQGW

SEQ ID NO: 2812530 - protein, 19 aa, Entamoeba invadens
QRFNFAWSIADFVTSGKRL

SEQ ID NO: 2812531 - protein, 21 aa, Entamoeba invadens
QRFQINLTREVMWCSKLLTNH

SEQ ID NO: 2812532 - protein, 21 aa, Entamoeba invadens
QRFSGLHSFGYFNFNSVNVNA

SEQ ID NO: 2812533 - protein, 20 aa, Entamoeba invadens
QRQLICLARALLKNSKILIM

SEQ ID NO: 2812534 - protein, 20 aa, Entamoeba invadens
QRQLVCLARALLKGSKILIM

SEQ ID NO: 2812535 - protein, 24 aa, Entamoeba invadens
QRRNIKLYIAFAMFIFFVVFIGSW

SEQ ID NO: 2812536 - protein, 20 aa, Entamoeba invadens
QRRVFGYGLSEGCECLNQKG

SEQ ID NO: 2812537 - protein, 21 aa, Entamoeba invadens
QSEILCWRITCFKMQRNYKFK

SEQ ID NO: 2812538 - protein, 19 aa, Entamoeba invadens
QSFMFAWSIADFISSGKRL

SEQ ID NO: 2812539 - protein, 18 aa, Entamoeba invadens
QSGCSKCALGFYTYKNNQ

SEQ ID NO: 2812540 - protein, 17 aa, Entamoeba invadens
QSGIPLYSAMAFDYSDK

SEQ ID NO: 2812541 - protein, 28 aa, Entamoeba invadens
QSHQLKKAMCWRKWKLYIIGGSIAAIVI

SEQ ID NO: 2812542 - protein, 21 aa, Entamoeba invadens
QSIFIYEFFNTVAWNIDTKHI

SEQ ID NO: 2812543 - protein, 22 aa, Entamoeba invadens
QSSRLKDVWFRKDATYHFDEKE

SEQ ID NO: 2812544 - protein, 25 aa, Entamoeba invadens
QSVKSCPCIFGLLKLEYFGKYSKHP

SEQ ID NO: 2812545 - protein, 18 aa, Entamoeba invadens
QSVSLLWVKYDVMGDSVT

SEQ ID NO: 2812546 - protein, 18 aa, Entamoeba invadens
QTALFKWLYSEVGGDTVE

SEQ ID NO: 2812547 - protein, 19 aa, Entamoeba invadens
QTCSKCSFSYRVSSSGNSC

SEQ ID NO: 2812548 - protein, 17 aa, Entamoeba invadens
QTEFLVFCFNKDFTFSS

SEQ ID NO: 2812549 - protein, 17 aa, Entamoeba invadens
QTQCMPFYLAYFSMSVS

SEQ ID NO: 2812550 - protein, 17 aa, Entamoeba invadens
QVCCGVCDMCMGAVVGN

SEQ ID NO: 2812551 - protein, 17 aa, Entamoeba invadens
QVCEIKTGFVLLKKYLL

SEQ ID NO: 2812552 - protein, 20 aa, Entamoeba invadens
QVKRFVCRNIFNDPTEYINN

SEQ ID NO: 2812553 - protein, 20 aa, Entamoeba invadens
QWGFSPSVFVNGNFDIKLTK

SEQ ID NO: 2812554 - protein, 22 aa, Entamoeba invadens
QYKTGLCLFAIVPLALLVIYLN

SEQ ID NO: 2812555 - protein, 21 aa, Entamoeba invadens
QYYCNIFKWAIDTKILAEIKK

SEQ ID NO: 2812556 - protein, 19 aa, Entamoeba invadens
RAESVLKLYALYNALEMFN

SEQ ID NO: 2812557 - protein, 18 aa, Entamoeba invadens
RAISCVTCYMTLYCTTKL

SEQ ID NO: 2812558 - protein, 18 aa, Entamoeba invadens
RAKFYAAQMVLAIEHLHN

SEQ ID NO: 2812559 - protein, 20 aa, Entamoeba invadens
RALAAFAIYFGLGWFIGFCC

SEQ ID NO: 2812560 - protein, 17 aa, Entamoeba invadens
RALSALLLYLVISFMTC

SEQ ID NO: 2812561 - protein, 20 aa, Entamoeba invadens
RAMYSFTFFWYNFMPLTRGT

SEQ ID NO: 2812562 - protein, 18 aa, Entamoeba invadens
RANKIITCYMTLYCTTRI

SEQ ID NO: 2812563 - protein, 25 aa, Entamoeba invadens
RAPFEFSVKIARGLVEANLDQVCAY

SEQ ID NO: 2812564 - protein, 25 aa, Entamoeba invadens
RASLSLDVIWIYKVNIFIDDSGTLE

SEQ ID NO: 2812565 - protein, 19 aa, Entamoeba invadens
RASSCVTCYMTLYCTTKLR

SEQ ID NO: 2812566 - protein, 18 aa, Entamoeba invadens
RATFPFVLLLTGGTFMYM

SEQ ID NO: 2812567 - protein, 17 aa, Entamoeba invadens
RCASGFFLNGLVPICEA

SEQ ID NO: 2812568 - protein, 19 aa, Entamoeba invadens
RCEKCSNLGVLDCDGSCIA

SEQ ID NO: 2812569 - protein, 24 aa, Entamoeba invadens
RCGTWRYLWHIALGDKWKNTIVSV

SEQ ID NO: 2812570 - protein, 17 aa, Entamoeba invadens
RCIEGYYYNGTTCLNCD

SEQ ID NO: 2812571 - protein, 20 aa, Entamoeba invadens
RCILPKFIHRFLVSEDYNYH

SEQ ID NO: 2812572 - protein, 19 aa, Entamoeba invadens
RCISCKLGFILMNGECVNS

SEQ ID NO: 2812573 - protein, 18 aa, Entamoeba invadens
RCLFRLRPFTDLIYKEMS

SEQ ID NO: 2812574 - protein, 22 aa, Entamoeba invadens
RCLSCSVASCSRCDTTGKCIEC

SEQ ID NO: 2812575 - protein, 22 aa, Entamoeba invadens
RCLSCSVASCSRCDTTGKCVEC

SEQ ID NO: 2812576 - protein, 17 aa, Entamoeba invadens
RCPETLFQPSFLGMEAL

SEQ ID NO: 2812577 - protein, 21 aa, Entamoeba invadens
RCPRCGGYVNPFCAFEEGGKK

SEQ ID NO: 2812578 - protein, 19 aa, Entamoeba invadens
RCSTCSTSNCAFCEGNQCK

SEQ ID NO: 2812579 - protein, 17 aa, Entamoeba invadens
RCSVKLISYLKCLNLMI

SEQ ID NO: 2812580 - protein, 19 aa, Entamoeba invadens
RCYACGSTVIFGSIDGNVQ

SEQ ID NO: 2812581 - protein, 18 aa, Entamoeba invadens
RDHHCPWVKNCIGKNNYK

SEQ ID NO: 2812582 - protein, 25 aa, Entamoeba invadens
RDLLSEFFFRYEVVMSIHCQQSVVI

SEQ ID NO: 2812583 - protein, 17 aa, Entamoeba invadens
RDLRIPYSVWFASSRSI

SEQ ID NO: 2812584 - protein, 23 aa, Entamoeba invadens
RDNCKSCTSSVCLVCDTNYKNVN

SEQ ID NO: 2812585 - protein, 24 aa, Entamoeba invadens
RDNGLRLIFEFAYQVCLQVLSQGQ

SEQ ID NO: 2812586 - protein, 19 aa, Entamoeba invadens
RDQCIKCAGGFSLVSGVCQ

SEQ ID NO: 2812587 - protein, 22 aa, Entamoeba invadens
RDVKCLVCKPGYYLSNKRCTEC

SEQ ID NO: 2812588 - protein, 17 aa, Entamoeba invadens
RDVWVCLTCLYVGCSTN

SEQ ID NO: 2812589 - protein, 23 aa, Entamoeba invadens
RECFYKPYIESMVIPSSFIIISI

SEQ ID NO: 2812590 - protein, 17 aa, Entamoeba invadens
REEHFFKPLIFGLFSMI

SEQ ID NO: 2812591 - protein, 24 aa, Entamoeba invadens
REGKFRFGGFWAKQWGDKTKTNSS

SEQ ID NO: 2812592 - protein, 17 aa, Entamoeba invadens
REILLRIVIGQKIMLLL

SEQ ID NO: 2812593 - protein, 20 aa, Entamoeba invadens
RELIRLVAFGMFKACLITLM

SEQ ID NO: 2812594 - protein, 18 aa, Entamoeba invadens
RENLRFGNIIGEDGEEWK

SEQ ID NO: 2812595 - protein, 27 aa, Entamoeba invadens
RERKEKRLEVLVSLILFVLGFFCLITW

SEQ ID NO: 2812596 - protein, 18 aa, Entamoeba invadens
RERLFRYEIESEINEAFN

SEQ ID NO: 2812597 - protein, 18 aa, Entamoeba invadens
REVIKDFVLKDVQHIEAP

SEQ ID NO: 2812598 - protein, 22 aa, Entamoeba invadens
RFLNSIRWVWTLVGYAIIGGVF

SEQ ID NO: 2812599 - protein, 27 aa, Entamoeba invadens
RFLSQHMCKSCYGYCLLAGNDTTQLVC

SEQ ID NO: 2812600 - protein, 19 aa, Entamoeba invadens
RFQMSFCVIFTVLVLFFVV

SEQ ID NO: 2812601 - protein, 19 aa, Entamoeba invadens
RFSDCFTCNLTNFKDFEGN

SEQ ID NO: 2812602 - protein, 21 aa, Entamoeba invadens
RFSICFFKACYFFFTTPMGIL

SEQ ID NO: 2812603 - protein, 19 aa, Entamoeba invadens
RFYEKILMRLNEVLKKSKL

SEQ ID NO: 2812604 - protein, 17 aa, Entamoeba invadens
RGNLFFRQFVPFYEDAD

SEQ ID NO: 2812605 - protein, 18 aa, Entamoeba invadens
RGNWSDDEYLEFIDKEAE

SEQ ID NO: 2812606 - protein, 17 aa, Entamoeba invadens
RGTFSWDKYQTVTGKIT

SEQ ID NO: 2812607 - protein, 20 aa, Entamoeba invadens
RHLTKLVLFYGRNARYQVSS

SEQ ID NO: 2812608 - protein, 19 aa, Entamoeba invadens
RIALTEGYIFLVVFFLLSW

SEQ ID NO: 2812609 - protein, 20 aa, Entamoeba invadens
RIAYELPVKLPFHYPLWKAM

SEQ ID NO: 2812610 - protein, 17 aa, Entamoeba invadens
RIDSIPVNLFNFINNSW

SEQ ID NO: 2812611 - protein, 25 aa, Entamoeba invadens
RIFGDICAWISGLLYFVGRFPQAWH

SEQ ID NO: 2812612 - protein, 22 aa, Entamoeba invadens
RIFTGVCSFKLDNCSILPTTKC

SEQ ID NO: 2812613 - protein, 18 aa, Entamoeba invadens
RIGKWFRLKIMEIDSKFV

SEQ ID NO: 2812614 - protein, 23 aa, Entamoeba invadens
RIGRFEFWASMSYYFKNDTQTKQ

SEQ ID NO: 2812615 - protein, 22 aa, Entamoeba invadens
RILVYFLICYCCCIELPITSLS

SEQ ID NO: 2812616 - protein, 18 aa, Entamoeba invadens
RIPSKFKRFVLSIKASVL

SEQ ID NO: 2812617 - protein, 19 aa, Entamoeba invadens
RIQCRSCLDKNVLNDGKCQ

SEQ ID NO: 2812618 - protein, 17 aa, Entamoeba invadens
RISVCIIGFVALLQHTF

SEQ ID NO: 2812619 - protein, 20 aa, Entamoeba invadens
RITQKVCVKLTMLCTCSIDE

SEQ ID NO: 2812620 - protein, 17 aa, Entamoeba invadens
RIVGELIAQLSYELAFH

SEQ ID NO: 2812621 - protein, 21 aa, Entamoeba invadens
RKCWICTYPGCKEPPKTRYNC

SEQ ID NO: 2812622 - protein, 19 aa, Entamoeba invadens
RKDLKGCVALAPAFYMKPH

SEQ ID NO: 2812623 - protein, 20 aa, Entamoeba invadens
RKEFPKFCNFFCQKRDEVTW

SEQ ID NO: 2812624 - protein, 23 aa, Entamoeba invadens
RKEKEIYQMFGFSSLKKRMNTLV

SEQ ID NO: 2812625 - protein, 24 aa, Entamoeba invadens
RKGIFKWGFFLAFFEAVNNVVYGT

SEQ ID NO: 2812626 - protein, 19 aa, Entamoeba invadens
RKIPFLVKLGGHWSVVIGY

SEQ ID NO: 2812627 - protein, 17 aa, Entamoeba invadens
RKKRVVLLNGVLDLLEN

SEQ ID NO: 2812628 - protein, 21 aa, Entamoeba invadens
RKKTTFKWTYIIVAVPVLAAV

SEQ ID NO: 2812629 - protein, 23 aa, Entamoeba invadens
RKPFLFKNMRVALSMRSIKLDFF

SEQ ID NO: 2812630 - protein, 20 aa, Entamoeba invadens
RKTWWICVTFSICIVLFIIL

SEQ ID NO: 2812631 - protein, 17 aa, Entamoeba invadens
RKYITDFLVEILPIIPA

SEQ ID NO: 2812632 - protein, 19 aa, Entamoeba invadens
RKYTSLLLKICIDVTRGLK

SEQ ID NO: 2812633 - protein, 19 aa, Entamoeba invadens
RLALIGSQLIFFDFFKVVD

SEQ ID NO: 2812634 - protein, 18 aa, Entamoeba invadens
RLARWFKINLNQFTEDHF

SEQ ID NO: 2812635 - protein, 18 aa, Entamoeba invadens
RLCKSIVVPINYWKIAIV

SEQ ID NO: 2812636 - protein, 20 aa, Entamoeba invadens
RLDIIDWLHCLFLIVFLIKN

SEQ ID NO: 2812637 - protein, 19 aa, Entamoeba invadens
RLGAGIAFYMLVWVVSIFE

SEQ ID NO: 2812638 - protein, 18 aa, Entamoeba invadens
RLHLKCLFDERGFCNKCS

SEQ ID NO: 2812639 - protein, 19 aa, Entamoeba invadens
RLHVYGEIFAENGFLQRSD

SEQ ID NO: 2812640 - protein, 20 aa, Entamoeba invadens
RLIVSMCVLNDGFVLVNKLL

SEQ ID NO: 2812641 - protein, 20 aa, Entamoeba invadens
RLKAFPLWFCKQWTRTDPEG

SEQ ID NO: 2812642 - protein, 18 aa, Entamoeba invadens
RLKICGNFEFSLRNESEK

SEQ ID NO: 2812643 - protein, 18 aa, Entamoeba invadens
RLLDLSGLFDESKMVNGD

SEQ ID NO: 2812644 - protein, 17 aa, Entamoeba invadens
RLRFAFEPIVFVSAGSA

SEQ ID NO: 2812645 - protein, 20 aa, Entamoeba invadens
RLSNGLMCAVEFVRRREKSY

SEQ ID NO: 2812646 - protein, 26 aa, Entamoeba invadens
RLSYSLRNFLFWGIGCIAYLLLYLLL

SEQ ID NO: 2812647 - protein, 24 aa, Entamoeba invadens
RLVVLRRYFFLMGINFLIRSVCLY

SEQ ID NO: 2812648 - protein, 22 aa, Entamoeba invadens
RLYRFLKRFIKSLCGLMLTLKL

SEQ ID NO: 2812649 - protein, 20 aa, Entamoeba invadens
RMFAWKEWLYPRRHLYDRVF

SEQ ID NO: 2812650 - protein, 19 aa, Entamoeba invadens
RMKQRGCNHLMSLLDCDVP

SEQ ID NO: 2812651 - protein, 23 aa, Entamoeba invadens
RMNEIKMSLAMEFDDDVKAKEKQ

SEQ ID NO: 2812652 - protein, 27 aa, Entamoeba invadens
RMVFMSENFRTIIIWDLMKVFVDLMET

SEQ ID NO: 2812653 - protein, 18 aa, Entamoeba invadens
RMWLKIVIWISCIGFCFL

SEQ ID NO: 2812654 - protein, 21 aa, Entamoeba invadens
RNFDVVKMLLLLGADPFVNCK

SEQ ID NO: 2812655 - protein, 18 aa, Entamoeba invadens
RNFGRPVGFYELYKRLIV

SEQ ID NO: 2812656 - protein, 24 aa, Entamoeba invadens
RNGMEIFPNFKFWYGLPRLVLDGM

SEQ ID NO: 2812657 - protein, 19 aa, Entamoeba invadens
RNRLKGGRNLKVYFVCESY

SEQ ID NO: 2812658 - protein, 19 aa, Entamoeba invadens
RNTLKCSMKSLPSFWYNIQ

SEQ ID NO: 2812659 - protein, 17 aa, Entamoeba invadens
RNVEYYNWFFVNIILHP

SEQ ID NO: 2812660 - protein, 18 aa, Entamoeba invadens
RPKTALGWWFLLRGADRS

SEQ ID NO: 2812661 - protein, 20 aa, Entamoeba invadens
RPSPDGSKCLFYFEWIPVIV

SEQ ID NO: 2812662 - protein, 18 aa, Entamoeba invadens
RPTCGTCFDVFKCSTSGK

SEQ ID NO: 2812663 - protein, 19 aa, Entamoeba invadens
RQGRWFKFNLSQMTKDHLA

SEQ ID NO: 2812664 - protein, 17 aa, Entamoeba invadens
RRCIICNTGVYPNDSGK

SEQ ID NO: 2812665 - protein, 20 aa, Entamoeba invadens
RRIRESWGKCSFKTEMFPLF

SEQ ID NO: 2812666 - protein, 26 aa, Entamoeba invadens
RRKEKRTPWMLWIFWFCVYAGLCAVI

SEQ ID NO: 2812667 - protein, 18 aa, Entamoeba invadens
RRKESWRPQKFNLAEVTV

SEQ ID NO: 2812668 - protein, 21 aa, Entamoeba invadens
RRKWFCFVFLIGFVIFSFAIY

SEQ ID NO: 2812669 - protein, 19 aa, Entamoeba invadens
RRMLLLVSWLLSGFYLMPT

SEQ ID NO: 2812670 - protein, 18 aa, Entamoeba invadens
RRPTQTSIRMSRSSETKK

SEQ ID NO: 2812671 - protein, 19 aa, Entamoeba invadens
RRYMRLYPRMSLLVNTFYA

SEQ ID NO: 2812672 - protein, 23 aa, Entamoeba invadens
RSCQFTIPWWCILLLVIFILLVV

SEQ ID NO: 2812673 - protein, 22 aa, Entamoeba invadens
RSDCKAPAIADGPSWSAKRTSM

SEQ ID NO: 2812674 - protein, 23 aa, Entamoeba invadens
RSFLKRNYLLFLVGMYLLLFILP

SEQ ID NO: 2812675 - protein, 18 aa, Entamoeba invadens
RSMGRYGVILKDNTMEIT

SEQ ID NO: 2812676 - protein, 22 aa, Entamoeba invadens
RSPFRLEVFLAMIVPAFCDFLG

SEQ ID NO: 2812677 - protein, 21 aa, Entamoeba invadens
RSRIPLSLFFGSLGVKKETNV

SEQ ID NO: 2812678 - protein, 20 aa, Entamoeba invadens
RSTVGLGYCLLCFILDVADY

SEQ ID NO: 2812679 - protein, 24 aa, Entamoeba invadens
RSVECLTCAPGYFRPKEWANDSQF

SEQ ID NO: 2812680 - protein, 19 aa, Entamoeba invadens
RTARCLKCGMKFDNTNVFI

SEQ ID NO: 2812681 - protein, 22 aa, Entamoeba invadens
RTEPELPKGLGIEIEETEIPYI

SEQ ID NO: 2812682 - protein, 20 aa, Entamoeba invadens
RTIKNFPLIFTYNVTSFNNV

SEQ ID NO: 2812683 - protein, 20 aa, Entamoeba invadens
RTIKNFPLIFTYNVTSLNNV

SEQ ID NO: 2812684 - protein, 19 aa, Entamoeba invadens
RTLCFTEFIAVNMDAENVK

SEQ ID NO: 2812685 - protein, 17 aa, Entamoeba invadens
RVCYVCASGCYSCTDTN

SEQ ID NO: 2812686 - protein, 24 aa, Entamoeba invadens
RVEVLKWIKSIACEIVKKPNVVGE

SEQ ID NO: 2812687 - protein, 17 aa, Entamoeba invadens
RVFTKFVACLKVGSNKV

SEQ ID NO: 2812688 - protein, 17 aa, Entamoeba invadens
RVFTPKVCFDAVFLGTI

SEQ ID NO: 2812689 - protein, 17 aa, Entamoeba invadens
RVFVYSISFGNTMYIPL

SEQ ID NO: 2812690 - protein, 23 aa, Entamoeba invadens
RVIFCISPTAFLVVLFGITALVL

SEQ ID NO: 2812691 - protein, 17 aa, Entamoeba invadens
RVKFCLDAAKGILYLHE

SEQ ID NO: 2812692 - protein, 25 aa, Entamoeba invadens
RVKLKWRPVHFITWTVILSIIHISF

SEQ ID NO: 2812693 - protein, 17 aa, Entamoeba invadens
RVKYCIDGAKGIFYLHE

SEQ ID NO: 2812694 - protein, 17 aa, Entamoeba invadens
RVSTGHLQIVIWSDFLL

SEQ ID NO: 2812695 - protein, 19 aa, Entamoeba invadens
RWEAFKWALISGICEPFGA

SEQ ID NO: 2812696 - protein, 19 aa, Entamoeba invadens
RWKYITGIHYIPFPLVITS

SEQ ID NO: 2812697 - protein, 20 aa, Entamoeba invadens
RWTSICKNKLLRFAVGELFG

SEQ ID NO: 2812698 - protein, 18 aa, Entamoeba invadens
RYIIYAAFQAYHVIPEGA

SEQ ID NO: 2812699 - protein, 17 aa, Entamoeba invadens
RYIPWITLSRIFFLSLM

SEQ ID NO: 2812700 - protein, 17 aa, Entamoeba invadens
RYLLSRRTAYFVMKLQV

SEQ ID NO: 2812701 - protein, 24 aa, Entamoeba invadens
RYQKEFGFKCVFLIVRKSVEQNGK

SEQ ID NO: 2812702 - protein, 25 aa, Entamoeba invadens
RYRCFTSFIFMCLKKYYIQLIKMFI

SEQ ID NO: 2812703 - protein, 23 aa, Entamoeba invadens
RYRVPFKEVFFFSTLKIVSSSSS

SEQ ID NO: 2812704 - protein, 17 aa, Entamoeba invadens
RYSLLTIFLCYFVSFML

SEQ ID NO: 2812705 - protein, 20 aa, Entamoeba invadens
RYYNLFYFCFRELCVRPYTA

SEQ ID NO: 2812706 - protein, 22 aa, Entamoeba invadens
SADNCLTCAFGYYYDYTTSDCL

SEQ ID NO: 2812707 - protein, 21 aa, Entamoeba invadens
SAEDFPLVLGNAVSLKEETNP

SEQ ID NO: 2812708 - protein, 20 aa, Entamoeba invadens
SAEPVRFKLITTFAGGDVSN

SEQ ID NO: 2812709 - protein, 18 aa, Entamoeba invadens
SAFTLRWLYTAAHPIFIV

SEQ ID NO: 2812710 - protein, 24 aa, Entamoeba invadens
SAGYCVKCIKGFYSIGGTVGECTR

SEQ ID NO: 2812711 - protein, 26 aa, Entamoeba invadens
SAKVYRCNSCGFIMFAIPKKGKERMF

SEQ ID NO: 2812712 - protein, 28 aa, Entamoeba invadens
SALGCLLCCLFTWMGCCCIGLIFCCIPT

SEQ ID NO: 2812713 - protein, 18 aa, Entamoeba invadens
SALKEVFSGVSFYNGQLQ

SEQ ID NO: 2812714 - protein, 17 aa, Entamoeba invadens
SALKVVIDVVMRLLATR

SEQ ID NO: 2812715 - protein, 21 aa, Entamoeba invadens
SASCYICPAGYYRGATDEGCK

SEQ ID NO: 2812716 - protein, 18 aa, Entamoeba invadens
SAVFKFAPLPLFVGWYTI

SEQ ID NO: 2812717 - protein, 19 aa, Entamoeba invadens
SAYCYDCLAGTYADEIGSS

SEQ ID NO: 2812718 - protein, 20 aa, Entamoeba invadens
SAYLKPEFTELLGMKCLSDC

SEQ ID NO: 2812719 - protein, 24 aa, Entamoeba invadens
SAYTIKEAYPFFIAVATMIGSFVL

SEQ ID NO: 2812720 - protein, 20 aa, Entamoeba invadens
SCLKCKPGFYLVDGSCYLCP

SEQ ID NO: 2812721 - protein, 20 aa, Entamoeba invadens
SCLTCGPLYFMTIVGECLLK

SEQ ID NO: 2812722 - protein, 17 aa, Entamoeba invadens
SCNSGVCIFDYTKTTKS

SEQ ID NO: 2812723 - protein, 24 aa, Entamoeba invadens
SCRICMLCGAPLCSENYCLIQHGK

SEQ ID NO: 2812724 - protein, 18 aa, Entamoeba invadens
SCSFNYKFVDGVCTQCAE

SEQ ID NO: 2812725 - protein, 17 aa, Entamoeba invadens
SCSKGYFILNQMCVKCD

SEQ ID NO: 2812726 - protein, 21 aa, Entamoeba invadens
SCSRPKYELIIPLTVLGVVLI

SEQ ID NO: 2812727 - protein, 18 aa, Entamoeba invadens
SCSSCPKGTFSNYGSSSC

SEQ ID NO: 2812728 - protein, 21 aa, Entamoeba invadens
SCTKGRITSYVGWEKGGSCSF

SEQ ID NO: 2812729 - protein, 22 aa, Entamoeba invadens
SDFKFRYRRGLPMVLKGINAKI

SEQ ID NO: 2812730 - protein, 22 aa, Entamoeba invadens
SDFKFRYRRGLPMVLKGINATI

SEQ ID NO: 2812731 - protein, 21 aa, Entamoeba invadens
SDHCELCLPGFRLEKGNCAPC

SEQ ID NO: 2812732 - protein, 17 aa, Entamoeba invadens
SDIFFSFSLDYIYNDNY

SEQ ID NO: 2812733 - protein, 17 aa, Entamoeba invadens
SDLKWLILKCWEYKYLQ

SEQ ID NO: 2812734 - protein, 17 aa, Entamoeba invadens
SDMVIVWGISDKAVLKS

SEQ ID NO: 2812735 - protein, 20 aa, Entamoeba invadens
SDNITICFSCEPFGYYFDNN

SEQ ID NO: 2812736 - protein, 23 aa, Entamoeba invadens
SDRCLKCSIGFLLINGKCFNSSD

SEQ ID NO: 2812737 - protein, 23 aa, Entamoeba invadens
SDRKCLTCKYGFYQGKDYTCLSS

SEQ ID NO: 2812738 - protein, 17 aa, Entamoeba invadens
SDSCLRLNAKYCSLCPT

SEQ ID NO: 2812739 - protein, 23 aa, Entamoeba invadens
SDTKCLLCVFGYYQGDNYTCLPS

SEQ ID NO: 2812740 - protein, 18 aa, Entamoeba invadens
SDVLVCFAVMIYENKLIS

SEQ ID NO: 2812741 - protein, 22 aa, Entamoeba invadens
SDVRFKYAWDIADFISAGKRLF

SEQ ID NO: 2812742 - protein, 23 aa, Entamoeba invadens
SDVRFKYAWDIADFISAGKRLVI

SEQ ID NO: 2812743 - protein, 18 aa, Entamoeba invadens
SEANFVLAWKKLDFGLGY

SEQ ID NO: 2812744 - protein, 17 aa, Entamoeba invadens
SECNCVFGTAPMKIDNI

SEQ ID NO: 2812745 - protein, 18 aa, Entamoeba invadens
SEECTTCADAFVYDNETK

SEQ ID NO: 2812746 - protein, 17 aa, Entamoeba invadens
SEFFCYMSSFGFDEHLP

SEQ ID NO: 2812747 - protein, 17 aa, Entamoeba invadens
SEFIVKFYGAVFVVSKI

SEQ ID NO: 2812748 - protein, 17 aa, Entamoeba invadens
SEFKYPWKIADFVNNGN

SEQ ID NO: 2812749 - protein, 17 aa, Entamoeba invadens
SEHLCEWIDLIFGSKQR

SEQ ID NO: 2812750 - protein, 17 aa, Entamoeba invadens
SEIHIIYSLHAVRSQLM

SEQ ID NO: 2812751 - protein, 20 aa, Entamoeba invadens
SEIKSTLFLSLIIRMVNINQ

SEQ ID NO: 2812752 - protein, 18 aa, Entamoeba invadens
SEILGMAVGFVFSLLWAV

SEQ ID NO: 2812753 - protein, 22 aa, Entamoeba invadens
SELCSVPSSFFCTNEDLKGIDS

SEQ ID NO: 2812754 - protein, 23 aa, Entamoeba invadens
SELKELWILPVFCIAHMILEFFG

SEQ ID NO: 2812755 - protein, 21 aa, Entamoeba invadens
SELKLKMIETFGMRNSSVIEE

SEQ ID NO: 2812756 - protein, 20 aa, Entamoeba invadens
SELYISVNFPFPIKLSKHYK

SEQ ID NO: 2812757 - protein, 27 aa, Entamoeba invadens
SELYSDIELYKFIGRVVGKTVYDGEFL

SEQ ID NO: 2812758 - protein, 20 aa, Entamoeba invadens
SEMTCKLCIEHCNVCASEEC

SEQ ID NO: 2812759 - protein, 21 aa, Entamoeba invadens
SENRLSLTFSKIVQKSNYCEF

SEQ ID NO: 2812760 - protein, 19 aa, Entamoeba invadens
SERCFRCIMGYYPDVTSKL

SEQ ID NO: 2812761 - protein, 21 aa, Entamoeba invadens
SESLIGLQLFFFVLYTILGVN

SEQ ID NO: 2812762 - protein, 19 aa, Entamoeba invadens
SESMTKCAFSLVDDIVDAL

SEQ ID NO: 2812763 - protein, 23 aa, Entamoeba invadens
SESRCITCVSGFYIAENENCVEL

SEQ ID NO: 2812764 - protein, 18 aa, Entamoeba invadens
SEVKRMCEVYMIEVNTDQ

SEQ ID NO: 2812765 - protein, 17 aa, Entamoeba invadens
SEYKYPWSISKFVCVGR

SEQ ID NO: 2812766 - protein, 18 aa, Entamoeba invadens
SFCIKKWKNLIEEYESNI

SEQ ID NO: 2812767 - protein, 19 aa, Entamoeba invadens
SFCRCYEGYIPDPNDNTSC

SEQ ID NO: 2812768 - protein, 24 aa, Entamoeba invadens
SFDIKCSICLSGFERKCFTCKTGK

SEQ ID NO: 2812769 - protein, 18 aa, Entamoeba invadens
SFDRRFVNEIKRCEEIER

SEQ ID NO: 2812770 - protein, 18 aa, Entamoeba invadens
SFEFLRVVPDFHFNSTSH

SEQ ID NO: 2812771 - protein, 24 aa, Entamoeba invadens
SFGITLFECFGWREAYPVAMFPYA

SEQ ID NO: 2812772 - protein, 20 aa, Entamoeba invadens
SFGKCFGFLFGGLLKTALGT

SEQ ID NO: 2812773 - protein, 18 aa, Entamoeba invadens
SFGTARFTALTAFIDTID

SEQ ID NO: 2812774 - protein, 21 aa, Entamoeba invadens
SFIKYEFKFCYLFTTNKKTSY

SEQ ID NO: 2812775 - protein, 23 aa, Entamoeba invadens
SFITLRELFKWADRHASSYEELA

SEQ ID NO: 2812776 - protein, 20 aa, Entamoeba invadens
SFKNSTVCLSKLISTGQNFT

SEQ ID NO: 2812777 - protein, 17 aa, Entamoeba invadens
SFKRWRIIPSLLCLSAM

SEQ ID NO: 2812778 - protein, 20 aa, Entamoeba invadens
SFLETFRWNFKFTETTPREF

SEQ ID NO: 2812779 - protein, 17 aa, Entamoeba invadens
SFLLFGYEDMDSESGQF

SEQ ID NO: 2812780 - protein, 18 aa, Entamoeba invadens
SFVNVGFTRDCFPADCGR

SEQ ID NO: 2812781 - protein, 18 aa, Entamoeba invadens
SFVTGGLFSRCGECLELS

SEQ ID NO: 2812782 - protein, 17 aa, Entamoeba invadens
SFYFGERYDTFLLIQSV

SEQ ID NO: 2812783 - protein, 18 aa, Entamoeba invadens
SGCTLCEFGYFIYQNECQ

SEQ ID NO: 2812784 - protein, 23 aa, Entamoeba invadens
SGCTTCIPGYYISKGKCVSCEQI

SEQ ID NO: 2812785 - protein, 21 aa, Entamoeba invadens
SGCYRCKIGFYRVGLNCYKCQ

SEQ ID NO: 2812786 - protein, 22 aa, Entamoeba invadens
SGGCVICKRGYYRVVLDCYDCD

SEQ ID NO: 2812787 - protein, 20 aa, Entamoeba invadens
SGICIICPIGTYSLDSQCIE

SEQ ID NO: 2812788 - protein, 19 aa, Entamoeba invadens
SGKCAICPKGTYYMSSVCQ

SEQ ID NO: 2812789 - protein, 17 aa, Entamoeba invadens
SGLECFPCISSCSLCQS

SEQ ID NO: 2812790 - protein, 17 aa, Entamoeba invadens
SGMRFLHSSHIMHRDLK

SEQ ID NO: 2812791 - protein, 18 aa, Entamoeba invadens
SGNCFACAEGLHLDGTRS

SEQ ID NO: 2812792 - protein, 18 aa, Entamoeba invadens
SGNCFTCAEGLHLDGTRS

SEQ ID NO: 2812793 - protein, 20 aa, Entamoeba invadens
SGNLFKLITLCWKQNPQERI

SEQ ID NO: 2812794 - protein, 17 aa, Entamoeba invadens
SGNWCYECSDGYYHHGV

SEQ ID NO: 2812795 - protein, 19 aa, Entamoeba invadens
SGRCLTCAFGNYMKDDLTY

SEQ ID NO: 2812796 - protein, 22 aa, Entamoeba invadens
SGSGCAVCYYGYFKVNATCHKC

SEQ ID NO: 2812797 - protein, 19 aa, Entamoeba invadens
SGTCSLCPTGQYKKDEMTC

SEQ ID NO: 2812798 - protein, 17 aa, Entamoeba invadens
SGTSVWWFSFVVSEHTL

SEQ ID NO: 2812799 - protein, 27 aa, Entamoeba invadens
SGWYIPGENGLYCKYKVPVWFIIVIII

SEQ ID NO: 2812800 - protein, 19 aa, Entamoeba invadens
SGYYRLGLNCLRCSEKCST

SEQ ID NO: 2812801 - protein, 21 aa, Entamoeba invadens
SHASWKLLLFIMPWIIASVVA

SEQ ID NO: 2812802 - protein, 17 aa, Entamoeba invadens
SHLWALKTLKEVYLVPM

SEQ ID NO: 2812803 - protein, 17 aa, Entamoeba invadens
SIARLFSYGVYDQVTID

SEQ ID NO: 2812804 - protein, 22 aa, Entamoeba invadens
SIAVCGVGLWIILYIFLMIGFF

SEQ ID NO: 2812805 - protein, 18 aa, Entamoeba invadens
SICCLLIYFMKGTYKIEY

SEQ ID NO: 2812806 - protein, 18 aa, Entamoeba invadens
SICSLFECEICEGGICKK

SEQ ID NO: 2812807 - protein, 19 aa, Entamoeba invadens
SIENCHFCSTDIYESVFSN

SEQ ID NO: 2812808 - protein, 18 aa, Entamoeba invadens
SIGCAIVLTTICSIFIFD

SEQ ID NO: 2812809 - protein, 20 aa, Entamoeba invadens
SIICCIYAASVLFGIVGLII

SEQ ID NO: 2812810 - protein, 22 aa, Entamoeba invadens
SIKRIPLVPSKYYTFISSLVLQ

SEQ ID NO: 2812811 - protein, 17 aa, Entamoeba invadens
SILLRNVLQAILIPMYP

SEQ ID NO: 2812812 - protein, 23 aa, Entamoeba invadens
SIMMLWPRVEKFGSPDFRKLSVI

SEQ ID NO: 2812813 - protein, 18 aa, Entamoeba invadens
SINAVKFLHFFNSNAKKT

SEQ ID NO: 2812814 - protein, 18 aa, Entamoeba invadens
SIPICVSDSLPLQTNVFV

SEQ ID NO: 2812815 - protein, 18 aa, Entamoeba invadens
SIRCLTCKSGYYMKGDGC

SEQ ID NO: 2812816 - protein, 18 aa, Entamoeba invadens
SIRCLTCKSGYYMKGDVC

SEQ ID NO: 2812817 - protein, 18 aa, Entamoeba invadens
SIRLKAEHLNYVFIRSFT

SEQ ID NO: 2812818 - protein, 17 aa, Entamoeba invadens
SIVLLGLGLICLVLTFL

SEQ ID NO: 2812819 - protein, 22 aa, Entamoeba invadens
SKCISCGSGFYLDANTLKCSDD

SEQ ID NO: 2812820 - protein, 17 aa, Entamoeba invadens
SKCLECFNVFQMKDGKC

SEQ ID NO: 2812821 - protein, 18 aa, Entamoeba invadens
SKCLPCPKGTFSSKEKSS

SEQ ID NO: 2812822 - protein, 20 aa, Entamoeba invadens
SKCRGILGGICLKTTGYFDY

SEQ ID NO: 2812823 - protein, 17 aa, Entamoeba invadens
SKCSKCTFWHSPNDNGT

SEQ ID NO: 2812824 - protein, 17 aa, Entamoeba invadens
SKCSKCTIWHSRNDNGT

SEQ ID NO: 2812825 - protein, 18 aa, Entamoeba invadens
SKCTSCSFWHIPSASYTS

SEQ ID NO: 2812826 - protein, 18 aa, Entamoeba invadens
SKCVKCSFWNIPNDDGTL

SEQ ID NO: 2812827 - protein, 20 aa, Entamoeba invadens
SKFLFDWRVSFVVGSLTFHA

SEQ ID NO: 2812828 - protein, 17 aa, Entamoeba invadens
SKGFWTPTFVKLNRVFE

SEQ ID NO: 2812829 - protein, 19 aa, Entamoeba invadens
SKGVKVWNYDVCDLSAAGD

SEQ ID NO: 2812830 - protein, 18 aa, Entamoeba invadens
SKILCKKCESLSTFIKEL

SEQ ID NO: 2812831 - protein, 18 aa, Entamoeba invadens
SKKFFGCYSCEYLPDDGT

SEQ ID NO: 2812832 - protein, 21 aa, Entamoeba invadens
SKKSFKYAWDIADFVTTGKRL

SEQ ID NO: 2812833 - protein, 18 aa, Entamoeba invadens
SKLFGYKSFVCYYCAAGE

SEQ ID NO: 2812834 - protein, 21 aa, Entamoeba invadens
SKNVRWCFDLNIVFCYQEDFV

SEQ ID NO: 2812835 - protein, 19 aa, Entamoeba invadens
SKPESFLLFGYEDMDSESG

SEQ ID NO: 2812836 - protein, 19 aa, Entamoeba invadens
SKPSTFGSIEIVTTNGSVA

SEQ ID NO: 2812837 - protein, 19 aa, Entamoeba invadens
SKRCSKCTKGVLDLNGFCT

SEQ ID NO: 2812838 - protein, 18 aa, Entamoeba invadens
SKRCSKCTKGVLDSNGYC

SEQ ID NO: 2812839 - protein, 18 aa, Entamoeba invadens
SKTFKGYRPCAPGTKCTA

SEQ ID NO: 2812840 - protein, 20 aa, Entamoeba invadens
SKYAKLCFYCECSVVSESGW

SEQ ID NO: 2812841 - protein, 22 aa, Entamoeba invadens
SKYLGAFCLFCFVTQMYYKYQR

SEQ ID NO: 2812842 - protein, 19 aa, Entamoeba invadens
SLCMLLRYFYLRFVNKLET

SEQ ID NO: 2812843 - protein, 17 aa, Entamoeba invadens
SLCSIWVTLFIYTKRLN

SEQ ID NO: 2812844 - protein, 18 aa, Entamoeba invadens
SLCVLCFGYLLYFLLLLF

SEQ ID NO: 2812845 - protein, 20 aa, Entamoeba invadens
SLELKPSYKFTINANTTNFV

SEQ ID NO: 2812846 - protein, 20 aa, Entamoeba invadens
SLFGEINFSYVFSLLPKHID

SEQ ID NO: 2812847 - protein, 19 aa, Entamoeba invadens
SLFLICFLENYTFFKTLIG

SEQ ID NO: 2812848 - protein, 21 aa, Entamoeba invadens
SLFLIGLVALVFGLLFAYYST

SEQ ID NO: 2812849 - protein, 19 aa, Entamoeba invadens
SLHIKRFMLPISFITLIVT

SEQ ID NO: 2812850 - protein, 22 aa, Entamoeba invadens
SLICPMSMYLTKSCQVVVEHST

SEQ ID NO: 2812851 - protein, 18 aa, Entamoeba invadens
SLKCAVCERGYYLDLTQR

SEQ ID NO: 2812852 - protein, 21 aa, Entamoeba invadens
SLLEKILCCKFCCKSKESGQE

SEQ ID NO: 2812853 - protein, 17 aa, Entamoeba invadens
SLLFPPFLFFGAFILLR

SEQ ID NO: 2812854 - protein, 17 aa, Entamoeba invadens
SLLLPISINSVRISSAE

SEQ ID NO: 2812855 - protein, 18 aa, Entamoeba invadens
SLLSLSLCCKTLKLQILS

SEQ ID NO: 2812856 - protein, 27 aa, Entamoeba invadens
SLPEFPFMWGYCWFTTILSYLSLWNTR

SEQ ID NO: 2812857 - protein, 25 aa, Entamoeba invadens
SLPYGEFVFLFDFMHTINIIYLLYI

SEQ ID NO: 2812858 - protein, 18 aa, Entamoeba invadens
SLQCVLCANDYILNGSVC

SEQ ID NO: 2812859 - protein, 18 aa, Entamoeba invadens
SLSLFAKRMEAIHLPTEL

SEQ ID NO: 2812860 - protein, 18 aa, Entamoeba invadens
SLSNCFCILTGNTLDKNI

SEQ ID NO: 2812861 - protein, 17 aa, Entamoeba invadens
SLTCKKFSLLISDVTYW

SEQ ID NO: 2812862 - protein, 17 aa, Entamoeba invadens
SLTSLKQNDEWMTITNN

SEQ ID NO: 2812863 - protein, 25 aa, Entamoeba invadens
SLVLKWRELWEMVRYRRIVWEWRTF

SEQ ID NO: 2812864 - protein, 19 aa, Entamoeba invadens
SMALLCFLSCFLLPIMTKN

SEQ ID NO: 2812865 - protein, 19 aa, Entamoeba invadens
SMCSIGFYLKNGMCEPSNC

SEQ ID NO: 2812866 - protein, 20 aa, Entamoeba invadens
SMFEIVKWGPAFPKGKFKHA

SEQ ID NO: 2812867 - protein, 17 aa, Entamoeba invadens
SMFYKMWLKVEDIHAEL

SEQ ID NO: 2812868 - protein, 23 aa, Entamoeba invadens
SMLDKFRIDYVVNFYGSVFIPNK

SEQ ID NO: 2812869 - protein, 23 aa, Entamoeba invadens
SMSALRAGLYFIYMVNSTSQVIA

SEQ ID NO: 2812870 - protein, 22 aa, Entamoeba invadens
SMSLIYVMFCFDKLEKSTTGEE

SEQ ID NO: 2812871 - protein, 19 aa, Entamoeba invadens
SNELFEWKHVFGDVIKGGL

SEQ ID NO: 2812872 - protein, 18 aa, Entamoeba invadens
SNFKRIYKSVVFEKITHF

SEQ ID NO: 2812873 - protein, 20 aa, Entamoeba invadens
SNGCAFCKSGYYWKDRDCNK

SEQ ID NO: 2812874 - protein, 19 aa, Entamoeba invadens
SNISFPFEVCESLVSNKSK

SEQ ID NO: 2812875 - protein, 18 aa, Entamoeba invadens
SNKCGWCETNEKCGFCED

SEQ ID NO: 2812876 - protein, 22 aa, Entamoeba invadens
SNKLIICLVGMTLLLAMATLLY

SEQ ID NO: 2812877 - protein, 17 aa, Entamoeba invadens
SNLKMLLTLSVRCEYPC

SEQ ID NO: 2812878 - protein, 17 aa, Entamoeba invadens
SNNELYFYNSLKMKLAI

SEQ ID NO: 2812879 - protein, 23 aa, Entamoeba invadens
SNNKYTLSYSWKDVKLTSTVTTP

SEQ ID NO: 2812880 - protein, 17 aa, Entamoeba invadens
SNNYSFYEMCCYEQNSK

SEQ ID NO: 2812881 - protein, 19 aa, Entamoeba invadens
SNQKCLLCEAGTYKKTEIT

SEQ ID NO: 2812882 - protein, 18 aa, Entamoeba invadens
SNRCLKCSDGYLLTENHC

SEQ ID NO: 2812883 - protein, 19 aa, Entamoeba invadens
SNRCLKCSNGYLLSEGYCQ

SEQ ID NO: 2812884 - protein, 23 aa, Entamoeba invadens
SNSCKRCSTTFGELCDLCDFDKC

SEQ ID NO: 2812885 - protein, 25 aa, Entamoeba invadens
SNVEPRLSVALVCLAIYIGVFSGVI

SEQ ID NO: 2812886 - protein, 26 aa, Entamoeba invadens
SNVIYCLLESLALEECYRVFQSQNER

SEQ ID NO: 2812887 - protein, 19 aa, Entamoeba invadens
SNVRCSVDIPDCLYTTNNK

SEQ ID NO: 2812888 - protein, 22 aa, Entamoeba invadens
SNYCLECGKIVFFENKKRKAAL

SEQ ID NO: 2812889 - protein, 23 aa, Entamoeba invadens
SPHWEFWRLLLVNIYTLWTVPLL

SEQ ID NO: 2812890 - protein, 22 aa, Entamoeba invadens
SPLKTVCWECIEYPLPLKNALL

SEQ ID NO: 2812891 - protein, 20 aa, Entamoeba invadens
SPMLLCFLISFQLFFHKETL

SEQ ID NO: 2812892 - protein, 27 aa, Entamoeba invadens
SPNGGECLTCPSGFERGEFGCIWCKAG

SEQ ID NO: 2812893 - protein, 18 aa, Entamoeba invadens
SPRKRGTFIVAFEGDDEV

SEQ ID NO: 2812894 - protein, 23 aa, Entamoeba invadens
SPRKYCWIASLLLISSYEMVLNV

SEQ ID NO: 2812895 - protein, 18 aa, Entamoeba invadens
SPRMAVKVKFMFDMAKGI

SEQ ID NO: 2812896 - protein, 20 aa, Entamoeba invadens
SPYICCLFLLVAPMYSQLIS

SEQ ID NO: 2812897 - protein, 21 aa, Entamoeba invadens
SQCGWKCGFIPQTSGKILPFE

SEQ ID NO: 2812898 - protein, 17 aa, Entamoeba invadens
SQCRCVEGFVPDPTDPL

SEQ ID NO: 2812899 - protein, 21 aa, Entamoeba invadens
SQCSVCAPGFYTSFNKQCEEC

SEQ ID NO: 2812900 - protein, 24 aa, Entamoeba invadens
SQERVCKMIHPIWESKRKYTYTFP

SEQ ID NO: 2812901 - protein, 19 aa, Entamoeba invadens
SQFKFPWIIAEYVSNGLRL

SEQ ID NO: 2812902 - protein, 19 aa, Entamoeba invadens
SQFPIKCMIAGTFKLEENN

SEQ ID NO: 2812903 - protein, 19 aa, Entamoeba invadens
SQLGGIFSFDSWRYYFNVS

SEQ ID NO: 2812904 - protein, 24 aa, Entamoeba invadens
SQLKSGRIIPEFKKVFTEAIDDSL

SEQ ID NO: 2812905 - protein, 19 aa, Entamoeba invadens
SQNCSLSYCDYNYYVDITD

SEQ ID NO: 2812906 - protein, 17 aa, Entamoeba invadens
SQRCKIFLPDGLRCAVC

SEQ ID NO: 2812907 - protein, 24 aa, Entamoeba invadens
SQTLWQYACCLTIVFAGRYIPFLE

SEQ ID NO: 2812908 - protein, 19 aa, Entamoeba invadens
SQYSICWECADGYKLRDDK

SEQ ID NO: 2812909 - protein, 19 aa, Entamoeba invadens
SRFKYAWDIADFISAGNRL

SEQ ID NO: 2812910 - protein, 19 aa, Entamoeba invadens
SRFPEFLGYNVKYLNISLR

SEQ ID NO: 2812911 - protein, 24 aa, Entamoeba invadens
SRFVWDIFCLFAILVHILCMRNRG

SEQ ID NO: 2812912 - protein, 19 aa, Entamoeba invadens
SRGFYLKNGVCLRCPDRCQ

SEQ ID NO: 2812913 - protein, 19 aa, Entamoeba invadens
SRITLPYRLKVRMLQDTAR

SEQ ID NO: 2812914 - protein, 18 aa, Entamoeba invadens
SRKCKVCAIGFYPDETSG

SEQ ID NO: 2812915 - protein, 25 aa, Entamoeba invadens
SRKKFVVVCVCVFVFWIIYYKFIKG

SEQ ID NO: 2812916 - protein, 23 aa, Entamoeba invadens
SRKSKELLTRFVGNVSLYLFFFT

SEQ ID NO: 2812917 - protein, 19 aa, Entamoeba invadens
SRLSIGLMWWMLTREILRF

SEQ ID NO: 2812918 - protein, 18 aa, Entamoeba invadens
SRRCLICNTGFYPNDSGK

SEQ ID NO: 2812919 - protein, 24 aa, Entamoeba invadens
SRYHKSVVCLTQIGVFVFVLFSGN

SEQ ID NO: 2812920 - protein, 17 aa, Entamoeba invadens
SRYPKFLTFEAKAEVFR

SEQ ID NO: 2812921 - protein, 17 aa, Entamoeba invadens
SSCKTCVAGFVLVNYIC

SEQ ID NO: 2812922 - protein, 17 aa, Entamoeba invadens
SSCLLCFSDYLNTSLLC

SEQ ID NO: 2812923 - protein, 19 aa, Entamoeba invadens
SSCPICPAGTFSPAGASKC

SEQ ID NO: 2812924 - protein, 20 aa, Entamoeba invadens
SSDIDTGFCFYKNKYRFGKW

SEQ ID NO: 2812925 - protein, 20 aa, Entamoeba invadens
SSECSACPNGTVTEDSITCK

SEQ ID NO: 2812926 - protein, 19 aa, Entamoeba invadens
SSFCFSRSPKICGIIGSVL

SEQ ID NO: 2812927 - protein, 19 aa, Entamoeba invadens
SSFDCLRCIDNYYFDSNTR

SEQ ID NO: 2812928 - protein, 17 aa, Entamoeba invadens
SSGFIPTFLQLILQILS

SEQ ID NO: 2812929 - protein, 24 aa, Entamoeba invadens
SSGNLWKFIFLILNFLFLNIIYNK

SEQ ID NO: 2812930 - protein, 18 aa, Entamoeba invadens
SSIQWCWSNDVVTYNENS

SEQ ID NO: 2812931 - protein, 18 aa, Entamoeba invadens
SSKCTKCDFWYETGETQT

SEQ ID NO: 2812932 - protein, 19 aa, Entamoeba invadens
SSKCTKCDFWYETGVTQTS

SEQ ID NO: 2812933 - protein, 20 aa, Entamoeba invadens
SSKFKFPWKIAEFVVQGNRR

SEQ ID NO: 2812934 - protein, 18 aa, Entamoeba invadens
SSLCLSCQSGFYLGVNNT

SEQ ID NO: 2812935 - protein, 21 aa, Entamoeba invadens
SSMFKHAWSIADFVSEGKRRQ

SEQ ID NO: 2812936 - protein, 23 aa, Entamoeba invadens
SSPKRFAIDLSFIGVVISVAFVL

SEQ ID NO: 2812937 - protein, 24 aa, Entamoeba invadens
SSRKCIKCKLGLYPKEENQFTCQA

SEQ ID NO: 2812938 - protein, 20 aa, Entamoeba invadens
SSRVLKPVCWKDLNVFTDPT

SEQ ID NO: 2812939 - protein, 20 aa, Entamoeba invadens
SSSKCTNCIFGFYLENGECK

SEQ ID NO: 2812940 - protein, 20 aa, Entamoeba invadens
SSSKCTNCIFGFYLENSECK

SEQ ID NO: 2812941 - protein, 20 aa, Entamoeba invadens
SSSRCIYCPPGTYTDKAGSS

SEQ ID NO: 2812942 - protein, 22 aa, Entamoeba invadens
SSVKFFECFVTPMVVEFNAPFT

SEQ ID NO: 2812943 - protein, 21 aa, Entamoeba invadens
SSVSSRFCWILIFVLLNSLLV

SEQ ID NO: 2812944 - protein, 25 aa, Entamoeba invadens
SSYIQLRGSIPLKWSQVPNFHYKPD

SEQ ID NO: 2812945 - protein, 20 aa, Entamoeba invadens
SSYKWPYIKFIFKMSYAALF

SEQ ID NO: 2812946 - protein, 18 aa, Entamoeba invadens
STCFLCQNGFVLKDGICQ

SEQ ID NO: 2812947 - protein, 19 aa, Entamoeba invadens
STCFPRTLVNTGLEMTSGC

SEQ ID NO: 2812948 - protein, 18 aa, Entamoeba invadens
STCILCFTEFMLDVNNNC

SEQ ID NO: 2812949 - protein, 23 aa, Entamoeba invadens
STCTSLKCTLCLNNTVFDGTKCT

SEQ ID NO: 2812950 - protein, 20 aa, Entamoeba invadens
STCYLCLDGYFLSNGICVSI

SEQ ID NO: 2812951 - protein, 20 aa, Entamoeba invadens
STDCLKCLHSILNTNGECVN

SEQ ID NO: 2812952 - protein, 17 aa, Entamoeba invadens
STKCFSCSIFNGCTLCD

SEQ ID NO: 2812953 - protein, 19 aa, Entamoeba invadens
STKCLSCGVGYYLTDNTCK

SEQ ID NO: 2812954 - protein, 23 aa, Entamoeba invadens
STLCGLLKAFLMEMSPRFITEKQ

SEQ ID NO: 2812955 - protein, 22 aa, Entamoeba invadens
STLCLSCPIGTFVSNNKCISNV

SEQ ID NO: 2812956 - protein, 18 aa, Entamoeba invadens
STMCLSCVDGFFLSDHIC

SEQ ID NO: 2812957 - protein, 20 aa, Entamoeba invadens
STRKCIVCSSGYYPKNDGDF

SEQ ID NO: 2812958 - protein, 25 aa, Entamoeba invadens
STSNWCKKCLNGFYMKNGNCEKVTD

SEQ ID NO: 2812959 - protein, 18 aa, Entamoeba invadens
STTCLLCGNGFYSTKGSL

SEQ ID NO: 2812960 - protein, 17 aa, Entamoeba invadens
STVFPLFSNVFYNFAED

SEQ ID NO: 2812961 - protein, 24 aa, Entamoeba invadens
STVGGLCLLEGLSLQTDTIKFPEN

SEQ ID NO: 2812962 - protein, 40 aa, Entamoeba invadens
STVICSLCIAFYFFWKLALCIVVLIPIFGVLLFFDGKLNS

SEQ ID NO: 2812963 - protein, 18 aa, Entamoeba invadens
SVAKRWSAVFSLSNLLLH

SEQ ID NO: 2812964 - protein, 19 aa, Entamoeba invadens
SVCIWPFCTAVFWPVATGT

SEQ ID NO: 2812965 - protein, 18 aa, Entamoeba invadens
SVCPVCWAGTYSIQNSVA

SEQ ID NO: 2812966 - protein, 17 aa, Entamoeba invadens
SVEFCLSANNSKCTECE

SEQ ID NO: 2812967 - protein, 18 aa, Entamoeba invadens
SVFAFKVAKGPLKWISLG

SEQ ID NO: 2812968 - protein, 17 aa, Entamoeba invadens
SVFNYFSGVILKSVTIK

SEQ ID NO: 2812969 - protein, 22 aa, Entamoeba invadens
SVGCLRCAKGYYGDRNNKCNKC

SEQ ID NO: 2812970 - protein, 18 aa, Entamoeba invadens
SVGNRCRCSILDDGKTFS

SEQ ID NO: 2812971 - protein, 19 aa, Entamoeba invadens
SVLCLLCITPQYIVYPWLV

SEQ ID NO: 2812972 - protein, 20 aa, Entamoeba invadens
SVLGRTNWKVAVEIDGTQIT

SEQ ID NO: 2812973 - protein, 20 aa, Entamoeba invadens
SVLKSSLKYVFDKFKKNEDY

SEQ ID NO: 2812974 - protein, 18 aa, Entamoeba invadens
SVLRMVFMSENFRTIIIW

SEQ ID NO: 2812975 - protein, 20 aa, Entamoeba invadens
SVLWSFRILRKVRIILRDET

SEQ ID NO: 2812976 - protein, 18 aa, Entamoeba invadens
SVLYCLIEVIGVKQSNVF

SEQ ID NO: 2812977 - protein, 19 aa, Entamoeba invadens
SVMHFLKYCHFNGFFGEGA

SEQ ID NO: 2812978 - protein, 17 aa, Entamoeba invadens
SVMLCLNVTPLIERLLL

SEQ ID NO: 2812979 - protein, 18 aa, Entamoeba invadens
SVQSCLDFAYSNHQNINS

SEQ ID NO: 2812980 - protein, 28 aa, Entamoeba invadens
SVRFPNDMYNFFGIDFHPSFSVEGFIIT

SEQ ID NO: 2812981 - protein, 24 aa, Entamoeba invadens
SVRGCLKCSFGYFVENQFCSSCDS

SEQ ID NO: 2812982 - protein, 20 aa, Entamoeba invadens
SVRGCLKCSSGYFVENQFCY

SEQ ID NO: 2812983 - protein, 25 aa, Entamoeba invadens
SVSGCLQCSIGFYLYHKECYKCDES

SEQ ID NO: 2812984 - protein, 23 aa, Entamoeba invadens
SVSTRWMGNFSLMIFTTEVLISF

SEQ ID NO: 2812985 - protein, 18 aa, Entamoeba invadens
SVTGWRCQNFLNEWSDGM

SEQ ID NO: 2812986 - protein, 23 aa, Entamoeba invadens
SVVFSIVCGFIFFSSLYIGYFSW

SEQ ID NO: 2812987 - protein, 20 aa, Entamoeba invadens
SVVWLRKYITDFLVEILPII

SEQ ID NO: 2812988 - protein, 18 aa, Entamoeba invadens
SWCGEGFYLDTYHGKYNY

SEQ ID NO: 2812989 - protein, 20 aa, Entamoeba invadens
SWDRKGCACDGEFCELIAGA

SEQ ID NO: 2812990 - protein, 20 aa, Entamoeba invadens
SWQFWWKLFVIVVLTSIPFI

SEQ ID NO: 2812991 - protein, 24 aa, Entamoeba invadens
SWWTPKKLAGMLFFIAGLLLLINH

SEQ ID NO: 2812992 - protein, 23 aa, Entamoeba invadens
SYARRAWPIVIVFTSLIILLQMV

SEQ ID NO: 2812993 - protein, 27 aa, Entamoeba invadens
SYHNWPCWQVRYTVGLYYGFKIEAGKS

SEQ ID NO: 2812994 - protein, 19 aa, Entamoeba invadens
SYQKFSITGIHVFCESDRC

SEQ ID NO: 2812995 - protein, 25 aa, Entamoeba invadens
SYTFFDLCWRFAFIFYSVIVVLAFL

SEQ ID NO: 2812996 - protein, 17 aa, Entamoeba invadens
TAALCFFPGGGMNIHMD

SEQ ID NO: 2812997 - protein, 18 aa, Entamoeba invadens
TAFTRPSVFYTLKGNGLV

SEQ ID NO: 2812998 - protein, 18 aa, Entamoeba invadens
TAFVRMLFVAIIGLKSAP

SEQ ID NO: 2812999 - protein, 17 aa, Entamoeba invadens
TAIEFNAPFSLVEYKSN

SEQ ID NO: 2813000 - protein, 20 aa, Entamoeba invadens
TALCEWEMFGFGLVVNAIQP

SEQ ID NO: 2813001 - protein, 18 aa, Entamoeba invadens
TALSFSWMLQYCEQSGVL

SEQ ID NO: 2813002 - protein, 17 aa, Entamoeba invadens
TCEGCGDKGCSRENKKC

SEQ ID NO: 2813003 - protein, 18 aa, Entamoeba invadens
TCKSCLPNSFSYEKSSTC

SEQ ID NO: 2813004 - protein, 17 aa, Entamoeba invadens
TCKSGMFLNAQFECEES

SEQ ID NO: 2813005 - protein, 20 aa, Entamoeba invadens
TCLLCGLGYHLNGKDQCEKN

SEQ ID NO: 2813006 - protein, 26 aa, Entamoeba invadens
TCLLLCLFTLNWVRRFPLINKVCVVS

SEQ ID NO: 2813007 - protein, 17 aa, Entamoeba invadens
TCLSGYYLKGSTCDVCN

SEQ ID NO: 2813008 - protein, 21 aa, Entamoeba invadens
TCLSLLYFVDWKVHYKDSVTT

SEQ ID NO: 2813009 - protein, 17 aa, Entamoeba invadens
TCSLCSIWVTLFIYTKR

SEQ ID NO: 2813010 - protein, 17 aa, Entamoeba invadens
TCVKSGSCILCNSERYM

SEQ ID NO: 2813011 - protein, 20 aa, Entamoeba invadens
TDCYKCKTGLFLRDGKCLSC

SEQ ID NO: 2813012 - protein, 23 aa, Entamoeba invadens
TDEFFTLVWWRWTIFSFIATLFM

SEQ ID NO: 2813013 - protein, 18 aa, Entamoeba invadens
TDEVCLQLRLKMMRDASK

SEQ ID NO: 2813014 - protein, 19 aa, Entamoeba invadens
TDFDLGINPSFWVIYRNTT

SEQ ID NO: 2813015 - protein, 19 aa, Entamoeba invadens
TDFKSVLVPSHFQNRELDD

SEQ ID NO: 2813016 - protein, 21 aa, Entamoeba invadens
TDGRCTPCWAGTIQNGDMCVE

SEQ ID NO: 2813017 - protein, 20 aa, Entamoeba invadens
TDKSIWLGIKCRFIQFCVDL

SEQ ID NO: 2813018 - protein, 24 aa, Entamoeba invadens
TDLLKIRFCQDIARGMEYLHQNDI

SEQ ID NO: 2813019 - protein, 22 aa, Entamoeba invadens
TDPMFKYSWCIANFVMDGKRLP

SEQ ID NO: 2813020 - protein, 25 aa, Entamoeba invadens
TDSFTFEFCIKWVFTLSLRIRNGLI

SEQ ID NO: 2813021 - protein, 17 aa, Entamoeba invadens
TDTFKEWDCDNDDDISM

SEQ ID NO: 2813022 - protein, 19 aa, Entamoeba invadens
TDTFKGYSVRGLHVLSDGT

SEQ ID NO: 2813023 - protein, 17 aa, Entamoeba invadens
TDYAGLIQSCWKQEGSE

SEQ ID NO: 2813024 - protein, 25 aa, Entamoeba invadens
TECIFRYALAFLIIRIFISLFTIIA

SEQ ID NO: 2813025 - protein, 22 aa, Entamoeba invadens
TEEIWKKFAPSLTRKQFDLRYG

SEQ ID NO: 2813026 - protein, 19 aa, Entamoeba invadens
TEFKFPWKIAEFVINRNRL

SEQ ID NO: 2813027 - protein, 18 aa, Entamoeba invadens
TEFQCLKCEKGKYFDFDT

SEQ ID NO: 2813028 - protein, 17 aa, Entamoeba invadens
TEIISSALLEWHPDPPV

SEQ ID NO: 2813029 - protein, 24 aa, Entamoeba invadens
TEILKHSWLPFEILKKSISQIGAD

SEQ ID NO: 2813030 - protein, 20 aa, Entamoeba invadens
TEKKFAAAIVKFLMWAEKKF

SEQ ID NO: 2813031 - protein, 22 aa, Entamoeba invadens
TEMFLWLGNKCSLKIRQKITKY

SEQ ID NO: 2813032 - protein, 17 aa, Entamoeba invadens
TEMYMKYVTSFNVESMA

SEQ ID NO: 2813033 - protein, 17 aa, Entamoeba invadens
TESRYSKWYTLEGTGRY

SEQ ID NO: 2813034 - protein, 23 aa, Entamoeba invadens
TFEFKECLLSGVLTLDIPVTINS

SEQ ID NO: 2813035 - protein, 24 aa, Entamoeba invadens
TFHFPSCMPSMLFKMAIFTIEFSG

SEQ ID NO: 2813036 - protein, 24 aa, Entamoeba invadens
TFKKTYAFRFWLRVLHLVGNLTLI

SEQ ID NO: 2813037 - protein, 21 aa, Entamoeba invadens
TFLRFRLVTLGGFIIPAAFQG

SEQ ID NO: 2813038 - protein, 21 aa, Entamoeba invadens
TFNGFCVISIYILHTKIHVPF

SEQ ID NO: 2813039 - protein, 18 aa, Entamoeba invadens
TFNGKLWPPGFMSFFTMA

SEQ ID NO: 2813040 - protein, 21 aa, Entamoeba invadens
TFSGKWWPSGVMEFFTMAPFI

SEQ ID NO: 2813041 - protein, 17 aa, Entamoeba invadens
TFSPLPWNCMKYEVKST

SEQ ID NO: 2813042 - protein, 18 aa, Entamoeba invadens
TGCLKCSLGSYLSDNICL

SEQ ID NO: 2813043 - protein, 21 aa, Entamoeba invadens
TGCSICKIGYYRKGTNCYQCP

SEQ ID NO: 2813044 - protein, 23 aa, Entamoeba invadens
TGCVKCYFGYTVVDSYCKPCGAN

SEQ ID NO: 2813045 - protein, 18 aa, Entamoeba invadens
TGDRLPMNLSYCGDYVNY

SEQ ID NO: 2813046 - protein, 20 aa, Entamoeba invadens
TIDLTFSWGFSPVVFVDENT

SEQ ID NO: 2813047 - protein, 19 aa, Entamoeba invadens
TIFECMKWGEAYDGEMFTF

SEQ ID NO: 2813048 - protein, 18 aa, Entamoeba invadens
TIFFFVFWRFLRGTLNGT

SEQ ID NO: 2813049 - protein, 18 aa, Entamoeba invadens
TIFLKCCLFLYCRTVNNP

SEQ ID NO: 2813050 - protein, 20 aa, Entamoeba invadens
TIKCYPVFILLNGQFNVGDG

SEQ ID NO: 2813051 - protein, 23 aa, Entamoeba invadens
TILLCYAEDLVLFNGVHCEKLNA

SEQ ID NO: 2813052 - protein, 22 aa, Entamoeba invadens
TILLMKGCARGVYYLHKLGIVH

SEQ ID NO: 2813053 - protein, 28 aa, Entamoeba invadens
TILMVFKSIIKRFWFKGVELKPKNFNVW

SEQ ID NO: 2813054 - protein, 19 aa, Entamoeba invadens
TILRIKGIFQISGGLTKFS

SEQ ID NO: 2813055 - protein, 20 aa, Entamoeba invadens
TIMVCLLCLLIAVILTILSS

SEQ ID NO: 2813056 - protein, 24 aa, Entamoeba invadens
TIPIPLKFVSSFTFGNIALTNSNE

SEQ ID NO: 2813057 - protein, 21 aa, Entamoeba invadens
TIPTPKWCRYVLFVENSWYGK

SEQ ID NO: 2813058 - protein, 19 aa, Entamoeba invadens
TIRDFPLFFVNSFNLADNN

SEQ ID NO: 2813059 - protein, 19 aa, Entamoeba invadens
TIRDFPLFFVNTFNLADNN

SEQ ID NO: 2813060 - protein, 20 aa, Entamoeba invadens
TIRDLPIFFIYQINTTIFTF

SEQ ID NO: 2813061 - protein, 19 aa, Entamoeba invadens
TIRDLPIFFSYQINMTIFS

SEQ ID NO: 2813062 - protein, 21 aa, Entamoeba invadens
TIVPSLCRYYRLYNIAHQLQK

SEQ ID NO: 2813063 - protein, 20 aa, Entamoeba invadens
TIYEVFGWSNAYPIETFKFP

SEQ ID NO: 2813064 - protein, 21 aa, Entamoeba invadens
TKAGSCTLCPNGYYNKVEKQG

SEQ ID NO: 2813065 - protein, 22 aa, Entamoeba invadens
TKANRCLFCSKGYHLQTNGTCS

SEQ ID NO: 2813066 - protein, 17 aa, Entamoeba invadens
TKCKNDNCALCVGGKCQ

SEQ ID NO: 2813067 - protein, 17 aa, Entamoeba invadens
TKCKSGFGFFNGSCVQC

SEQ ID NO: 2813068 - protein, 19 aa, Entamoeba invadens
TKCLLCNSGFMLSLSGTCV

SEQ ID NO: 2813069 - protein, 19 aa, Entamoeba invadens
TKCLSCAYSNMSVVNDKCI

SEQ ID NO: 2813070 - protein, 17 aa, Entamoeba invadens
TKCVLCANGYKVSQLGK

SEQ ID NO: 2813071 - protein, 17 aa, Entamoeba invadens
TKDAYGCIGCEDGFFLL

SEQ ID NO: 2813072 - protein, 23 aa, Entamoeba invadens
TKDCGYSKLDICANKDVENECEN

SEQ ID NO: 2813073 - protein, 23 aa, Entamoeba invadens
TKEFPKWTIALIVIFVVALVVVV

SEQ ID NO: 2813074 - protein, 19 aa, Entamoeba invadens
TKIRICNLLGMYLNATETN

SEQ ID NO: 2813075 - protein, 20 aa, Entamoeba invadens
TKISISFGFLLSDHTLVNTQ

SEQ ID NO: 2813076 - protein, 18 aa, Entamoeba invadens
TKLSFFYSIEILMNNDFR

SEQ ID NO: 2813077 - protein, 18 aa, Entamoeba invadens
TKLWGYRALSALLLYLVI

SEQ ID NO: 2813078 - protein, 19 aa, Entamoeba invadens
TKMAIKCYFVLVDIFEATK

SEQ ID NO: 2813079 - protein, 24 aa, Entamoeba invadens
TKPVDFSFLFSFDFADIELPKNTH

SEQ ID NO: 2813080 - protein, 19 aa, Entamoeba invadens
TKQCLICDELLYNGNCYHR

SEQ ID NO: 2813081 - protein, 22 aa, Entamoeba invadens
TKRFSILVVLSFVASIILYIII

SEQ ID NO: 2813082 - protein, 24 aa, Entamoeba invadens
TKRLSRFGSVLAFIVLTPFIVLFI

SEQ ID NO: 2813083 - protein, 22 aa, Entamoeba invadens
TKRSKFLTDFVVNYSIEDDKAD

SEQ ID NO: 2813084 - protein, 18 aa, Entamoeba invadens
TKVWMCQYMMSILDNEEL

SEQ ID NO: 2813085 - protein, 23 aa, Entamoeba invadens
TKWDKCFMITFFIVGIFFPPLLL

SEQ ID NO: 2813086 - protein, 17 aa, Entamoeba invadens
TKWVVCPATNLIKKYVC

SEQ ID NO: 2813087 - protein, 23 aa, Entamoeba invadens
TKYLGDLKIEFCEVVGSGWRPSP

SEQ ID NO: 2813088 - protein, 23 aa, Entamoeba invadens
TKYRLSVSFPISFVLNFLTIILC

SEQ ID NO: 2813089 - protein, 20 aa, Entamoeba invadens
TLCELFWRTSFIVIGSIQLC

SEQ ID NO: 2813090 - protein, 24 aa, Entamoeba invadens
TLCFFKIRWSKIFYWAIYLVGFIC

SEQ ID NO: 2813091 - protein, 18 aa, Entamoeba invadens
TLCYIIKWNDPFDGMNFV

SEQ ID NO: 2813092 - protein, 22 aa, Entamoeba invadens
TLFCVFKFRFLLVIIISIILQL

SEQ ID NO: 2813093 - protein, 20 aa, Entamoeba invadens
TLFFLLFFLQRVFSMCPQGY

SEQ ID NO: 2813094 - protein, 17 aa, Entamoeba invadens
TLGCLFYYIGCRKHPYG

SEQ ID NO: 2813095 - protein, 25 aa, Entamoeba invadens
TLGSFTFYVGFKFVRKSFVYDTNVS

SEQ ID NO: 2813096 - protein, 23 aa, Entamoeba invadens
TLHSCLLCASFTRKSTNRLSKFE

SEQ ID NO: 2813097 - protein, 20 aa, Entamoeba invadens
TLILICILLLFSIIVLPIIC

SEQ ID NO: 2813098 - protein, 18 aa, Entamoeba invadens
TLKQFGLIDEGGYTITNP

SEQ ID NO: 2813099 - protein, 21 aa, Entamoeba invadens
TLKRLGCLPGQYYVNGNCEYC

SEQ ID NO: 2813100 - protein, 20 aa, Entamoeba invadens
TLNRWIDLIFGYKSCGEEAL

SEQ ID NO: 2813101 - protein, 22 aa, Entamoeba invadens
TLPFCVFCVASFPSFSVDSVSR

SEQ ID NO: 2813102 - protein, 20 aa, Entamoeba invadens
TLPLHKLRESIGMVGQEPVL

SEQ ID NO: 2813103 - protein, 17 aa, Entamoeba invadens
TLYECLSWSLAYQPPQF

SEQ ID NO: 2813104 - protein, 20 aa, Entamoeba invadens
TLYEVMNWGGLYPLDQFPFP

SEQ ID NO: 2813105 - protein, 18 aa, Entamoeba invadens
TMCLSCKSGFYQGDNYTC

SEQ ID NO: 2813106 - protein, 21 aa, Entamoeba invadens
TMCLSCKSGFYQGENYTCLPS

SEQ ID NO: 2813107 - protein, 20 aa, Entamoeba invadens
TMFECFKWGDSYPKSEFKFP

SEQ ID NO: 2813108 - protein, 27 aa, Entamoeba invadens
TMFECFSWKDAYPITTFKFPWKIAEFV

SEQ ID NO: 2813109 - protein, 24 aa, Entamoeba invadens
TMRGFNVYFILNWTTGEHKSSSIY

SEQ ID NO: 2813110 - protein, 19 aa, Entamoeba invadens
TMWNGRVAIMAIRFTILLL

SEQ ID NO: 2813111 - protein, 23 aa, Entamoeba invadens
TMYECFAWRCAYVDLAFKFPWKI

SEQ ID NO: 2813112 - protein, 17 aa, Entamoeba invadens
TMYECFGWGNAFPKEHF

SEQ ID NO: 2813113 - protein, 19 aa, Entamoeba invadens
TMYECFIWGVAFPKSEFQY

SEQ ID NO: 2813114 - protein, 18 aa, Entamoeba invadens
TMYECFIWGVAYPKNEFK

SEQ ID NO: 2813115 - protein, 21 aa, Entamoeba invadens
TMYECFTWGDAFVSFPNLFPW

SEQ ID NO: 2813116 - protein, 22 aa, Entamoeba invadens
TMYEVFCWREAYNKTEFKFPWK

SEQ ID NO: 2813117 - protein, 18 aa, Entamoeba invadens
TMYEVFGWAEAYPINTFK

SEQ ID NO: 2813118 - protein, 18 aa, Entamoeba invadens
TMYEVFGWNYAYPKETFK

SEQ ID NO: 2813119 - protein, 20 aa, Entamoeba invadens
TNCILCNSSLIVKNGFCVSG

SEQ ID NO: 2813120 - protein, 24 aa, Entamoeba invadens
TNFFKARVAFVLGVLFNHFEDYGN

SEQ ID NO: 2813121 - protein, 18 aa, Entamoeba invadens
TNGINCLKCLAGELTNNC

SEQ ID NO: 2813122 - protein, 20 aa, Entamoeba invadens
TNKECVLCANNFVLNNGVCD

SEQ ID NO: 2813123 - protein, 21 aa, Entamoeba invadens
TNKIFLCVIIIVFLVIIGLVI

SEQ ID NO: 2813124 - protein, 23 aa, Entamoeba invadens
TNQCKRISLVIGCSSEVDKNFGC

SEQ ID NO: 2813125 - protein, 19 aa, Entamoeba invadens
TPDACAVFCKFLERLKSNV

SEQ ID NO: 2813126 - protein, 17 aa, Entamoeba invadens
TPFLMWYFFSFKNNVPH

SEQ ID NO: 2813127 - protein, 21 aa, Entamoeba invadens
TPIGCLRCAKGYYIDKNNKCS

SEQ ID NO: 2813128 - protein, 24 aa, Entamoeba invadens
TPILPCFLCDGGLMILSRMPLLNR

SEQ ID NO: 2813129 - protein, 24 aa, Entamoeba invadens
TPKERILWCYKKDLGFSTNAKRRV

SEQ ID NO: 2813130 - protein, 24 aa, Entamoeba invadens
TPNFPSLVCLLFFILLYSYNNYYH

SEQ ID NO: 2813131 - protein, 30 aa, Entamoeba invadens
TPNKVRLVWKEIRGTWQWINGRTYEVKPEL

SEQ ID NO: 2813132 - protein, 25 aa, Entamoeba invadens
TPTYCLSCPPGFYISNNICKTNSEL

SEQ ID NO: 2813133 - protein, 17 aa, Entamoeba invadens
TPVERLLWFKSHGFIHL

SEQ ID NO: 2813134 - protein, 23 aa, Entamoeba invadens
TPVGQCFICILMILGRHRGFPTQ

SEQ ID NO: 2813135 - protein, 21 aa, Entamoeba invadens
TPYSGRKGLWYSFKGTGEAVV

SEQ ID NO: 2813136 - protein, 18 aa, Entamoeba invadens
TQAEWWVILIIIISLILL

SEQ ID NO: 2813137 - protein, 18 aa, Entamoeba invadens
TQCFLLYDITSFTGAVKH

SEQ ID NO: 2813138 - protein, 18 aa, Entamoeba invadens
TQCTYGFWFCTKRTIHCR

SEQ ID NO: 2813139 - protein, 17 aa, Entamoeba invadens
TQFKYPWVIAKFVIEGK

SEQ ID NO: 2813140 - protein, 23 aa, Entamoeba invadens
TQFPFFCAFSFLLIGGGKVVLCI

SEQ ID NO: 2813141 - protein, 24 aa, Entamoeba invadens
TQIRWNELTSVLGLSRTVMNLISS

SEQ ID NO: 2813142 - protein, 24 aa, Entamoeba invadens
TQISTLIKFCFYKNAAFFLVNVFF

SEQ ID NO: 2813143 - protein, 25 aa, Entamoeba invadens
TQKSERGHSFWKRLLTYNNYFNVKE

SEQ ID NO: 2813144 - protein, 17 aa, Entamoeba invadens
TQPILCFYSTSNMSNLL

SEQ ID NO: 2813145 - protein, 17 aa, Entamoeba invadens
TQRKICKSFLKSDSSCR

SEQ ID NO: 2813146 - protein, 19 aa, Entamoeba invadens
TQSGFKWSVVTVIVPCAVG

SEQ ID NO: 2813147 - protein, 18 aa, Entamoeba invadens
TQTKLGFSYILGGINSVY

SEQ ID NO: 2813148 - protein, 17 aa, Entamoeba invadens
TQTPFCWVCDARYGCGS

SEQ ID NO: 2813149 - protein, 18 aa, Entamoeba invadens
TRFNSLILKDSWLPPEKF

SEQ ID NO: 2813150 - protein, 19 aa, Entamoeba invadens
TRFTYPWGVADYVCSGLRL

SEQ ID NO: 2813151 - protein, 19 aa, Entamoeba invadens
TRGLNLFFIDGRKKEEHLG

SEQ ID NO: 2813152 - protein, 17 aa, Entamoeba invadens
TRKCIMCGNGYYPNESG

SEQ ID NO: 2813153 - protein, 18 aa, Entamoeba invadens
TRKILHIFYSKTFEKKTL

SEQ ID NO: 2813154 - protein, 18 aa, Entamoeba invadens
TRLGLKIYYDHLVNDKFK

SEQ ID NO: 2813155 - protein, 28 aa, Entamoeba invadens
TRLSYSLRNFLFWGIGCIVYLLLYLMLL

SEQ ID NO: 2813156 - protein, 17 aa, Entamoeba invadens
TRTARFGRKFSVPIRVI

SEQ ID NO: 2813157 - protein, 18 aa, Entamoeba invadens
TRVRFSVLLSLPVVSSYP

SEQ ID NO: 2813158 - protein, 18 aa, Entamoeba invadens
TSCIYCRAGTYSLGGTTT

SEQ ID NO: 2813159 - protein, 17 aa, Entamoeba invadens
TSFCFQMSIKWMFVLSL

SEQ ID NO: 2813160 - protein, 23 aa, Entamoeba invadens
TSFKMEFWFVWKWIVLLFKREFE

SEQ ID NO: 2813161 - protein, 24 aa, Entamoeba invadens
TSFVCSFGVMFLFTFAFSVYGIAP

SEQ ID NO: 2813162 - protein, 18 aa, Entamoeba invadens
TSGLRLRFETCINEGMSG

SEQ ID NO: 2813163 - protein, 21 aa, Entamoeba invadens
TSKECSICKTGFYLQSGVCVT

SEQ ID NO: 2813164 - protein, 24 aa, Entamoeba invadens
TSNWCKKCLNGFYMKNGNCEKVTD

SEQ ID NO: 2813165 - protein, 20 aa, Entamoeba invadens
TSQFKFPWNIAEFIIQGNRL

SEQ ID NO: 2813166 - protein, 17 aa, Entamoeba invadens
TSSSCLLCFSDYLNTSL

SEQ ID NO: 2813167 - protein, 24 aa, Entamoeba invadens
TSTKCTSCGILFVLLTNGSCVNYS

SEQ ID NO: 2813168 - protein, 21 aa, Entamoeba invadens
TSTQCILELISPSGSITSSIT

SEQ ID NO: 2813169 - protein, 22 aa, Entamoeba invadens
TSVCGIVFLLLRWFLSKQTTFL

SEQ ID NO: 2813170 - protein, 17 aa, Entamoeba invadens
TSYEISRQWVFTSESKR

SEQ ID NO: 2813171 - protein, 19 aa, Entamoeba invadens
TTCEFPCYQAASGLYVQDT

SEQ ID NO: 2813172 - protein, 17 aa, Entamoeba invadens
TTCTKCYDGYYLSSGSC

SEQ ID NO: 2813173 - protein, 19 aa, Entamoeba invadens
TTCTVCLAAYILQTNGTCL

SEQ ID NO: 2813174 - protein, 21 aa, Entamoeba invadens
TTDTAFIWKGRLRNEKYVEYA

SEQ ID NO: 2813175 - protein, 22 aa, Entamoeba invadens
TTLFPLCIVLTISMLKELYEDI

SEQ ID NO: 2813176 - protein, 18 aa, Entamoeba invadens
TTLKATSFGPVFTDSLTI

SEQ ID NO: 2813177 - protein, 17 aa, Entamoeba invadens
TTLVDVFAFRNSGIRAV

SEQ ID NO: 2813178 - protein, 17 aa, Entamoeba invadens
TTMVCYWLLFIIAMITG

SEQ ID NO: 2813179 - protein, 23 aa, Entamoeba invadens
TTRECLECLPAYYKYRVNESDYC

SEQ ID NO: 2813180 - protein, 20 aa, Entamoeba invadens
TTSCSLCFPGTFSKSGASSC

SEQ ID NO: 2813181 - protein, 24 aa, Entamoeba invadens
TTSILECLDGFYLNDGVCHKCTEN

SEQ ID NO: 2813182 - protein, 21 aa, Entamoeba invadens
TVAFFKRGIHLFSNIDQHWWI

SEQ ID NO: 2813183 - protein, 20 aa, Entamoeba invadens
TVCVFVFLGALSFLIEVITH

SEQ ID NO: 2813184 - protein, 21 aa, Entamoeba invadens
TVCVMCPLGFFLPGSDYSTMT

SEQ ID NO: 2813185 - protein, 20 aa, Entamoeba invadens
TVIFCVCTFYLALVIIACWT

SEQ ID NO: 2813186 - protein, 23 aa, Entamoeba invadens
TVIRADYFFQFGFSEFNKTYNII

SEQ ID NO: 2813187 - protein, 20 aa, Entamoeba invadens
TVIRGFCFYECVALTSVQFP

SEQ ID NO: 2813188 - protein, 20 aa, Entamoeba invadens
TVIYWLSFVVMWTVIPYFMS

SEQ ID NO: 2813189 - protein, 18 aa, Entamoeba invadens
TVKCAQCTKGYFITDDFL

SEQ ID NO: 2813190 - protein, 17 aa, Entamoeba invadens
TVLGLICSLCFGKKTVS

SEQ ID NO: 2813191 - protein, 18 aa, Entamoeba invadens
TVLICFWFSFALNEFLTN

SEQ ID NO: 2813192 - protein, 18 aa, Entamoeba invadens
TVLVCVGPFLSTLIIGTI

SEQ ID NO: 2813193 - protein, 22 aa, Entamoeba invadens
TVVTLRAALLIIYRTTTNSLLV

SEQ ID NO: 2813194 - protein, 17 aa, Entamoeba invadens
TWKAVGVANAFAFIYDE

SEQ ID NO: 2813195 - protein, 23 aa, Entamoeba invadens
TWVWRILIILALELLELSVCMVP

SEQ ID NO: 2813196 - protein, 20 aa, Entamoeba invadens
TYFKVYRDWFAFLMTRNPTF

SEQ ID NO: 2813197 - protein, 24 aa, Entamoeba invadens
TYGPGCLLWGLLIVLQFAIIGVIL

SEQ ID NO: 2813198 - protein, 17 aa, Entamoeba invadens
TYIFPWTIADDVASGKR

SEQ ID NO: 2813199 - protein, 20 aa, Entamoeba invadens
TYKRFIDCYVYKDVFYDQIG

SEQ ID NO: 2813200 - protein, 20 aa, Entamoeba invadens
TYLLWFFLKFLHLGGNLCDV

SEQ ID NO: 2813201 - protein, 21 aa, Entamoeba invadens
TYSLFMMVFCFFREKGSDLKD

SEQ ID NO: 2813202 - protein, 25 aa, Entamoeba invadens
TYTSGCARCAFGFYYNLMTQRCEKC

SEQ ID NO: 2813203 - protein, 25 aa, Entamoeba invadens
TYTSGCARCGFGFYYNLITQRCEKC

SEQ ID NO: 2813204 - protein, 18 aa, Entamoeba invadens
VAAISLLHSFHFVYRQLT

SEQ ID NO: 2813205 - protein, 18 aa, Entamoeba invadens
VACSVLLALGAVSSSCYS

SEQ ID NO: 2813206 - protein, 17 aa, Entamoeba invadens
VAFNFDLVKEFGKVTKE

SEQ ID NO: 2813207 - protein, 25 aa, Entamoeba invadens
VAFWLLCFLNTFFLLFASTEITILC

SEQ ID NO: 2813208 - protein, 18 aa, Entamoeba invadens
VAINMSIVFSFFVSTTVM

SEQ ID NO: 2813209 - protein, 17 aa, Entamoeba invadens
VAPLFPRVFMFFFNLIT

SEQ ID NO: 2813210 - protein, 19 aa, Entamoeba invadens
VCCGLCLFAAVRIHYTVDI

SEQ ID NO: 2813211 - protein, 18 aa, Entamoeba invadens
VCDVCFSLITGNSMKEEP

SEQ ID NO: 2813212 - protein, 17 aa, Entamoeba invadens
VCHECIRKGSLDGDIKK

SEQ ID NO: 2813213 - protein, 19 aa, Entamoeba invadens
VCILLKMCVISVSLIMFCY

SEQ ID NO: 2813214 - protein, 18 aa, Entamoeba invadens
VCIWPFCTSIFWSVTTGT

SEQ ID NO: 2813215 - protein, 18 aa, Entamoeba invadens
VCKLCKGGYAFKEYTTIC

SEQ ID NO: 2813216 - protein, 17 aa, Entamoeba invadens
VCNEGYYRFGLDCVKCD

SEQ ID NO: 2813217 - protein, 17 aa, Entamoeba invadens
VCQRWLGVRVELVGCLS

SEQ ID NO: 2813218 - protein, 17 aa, Entamoeba invadens
VCQSCTLGKYILKNGVC

SEQ ID NO: 2813219 - protein, 21 aa, Entamoeba invadens
VCTKTDLVKCYFVKEQTNIYD

SEQ ID NO: 2813220 - protein, 20 aa, Entamoeba invadens
VCVGCALMSLTVFKNLFQLL

SEQ ID NO: 2813221 - protein, 17 aa, Entamoeba invadens
VCVYRRIIRKCWQHKPR

SEQ ID NO: 2813222 - protein, 17 aa, Entamoeba invadens
VCYEMVGPVGTLRFRVE

SEQ ID NO: 2813223 - protein, 18 aa, Entamoeba invadens
VDPSRFGLFIGVLNTSII

SEQ ID NO: 2813224 - protein, 22 aa, Entamoeba invadens
VDRPRFVNCTDYIPTNTTVDTN

SEQ ID NO: 2813225 - protein, 18 aa, Entamoeba invadens
  misc_feature (13)..(14): Xaa can be any naturally occurring amino acid
VDRPRFVNCTDYXXVDDN

SEQ ID NO: 2813226 - protein, 18 aa, Entamoeba invadens
VDVLYIWVGSKCAVQTRK

SEQ ID NO: 2813227 - protein, 17 aa, Entamoeba invadens
VDVPIRLVIGAIKDEMK

SEQ ID NO: 2813228 - protein, 19 aa, Entamoeba invadens
VECFLRLLLMLLLSLLLKS

SEQ ID NO: 2813229 - protein, 24 aa, Entamoeba invadens
VECFRCTVCWRIMLGDLSHSEIVK

SEQ ID NO: 2813230 - protein, 20 aa, Entamoeba invadens
VEEIRPAFQVVMTEKEVSDI

SEQ ID NO: 2813231 - protein, 23 aa, Entamoeba invadens
VEGKSGVMGWEMIKPSFTALVLG

SEQ ID NO: 2813232 - protein, 22 aa, Entamoeba invadens
VEHFYRLTFVYFIFISILCFIP

SEQ ID NO: 2813233 - protein, 18 aa, Entamoeba invadens
VEKFEFPMYMIAVIIIFV

SEQ ID NO: 2813234 - protein, 23 aa, Entamoeba invadens
VEKFEFPMYMIAVIIIFVLVLAV

SEQ ID NO: 2813235 - protein, 23 aa, Entamoeba invadens
VEKFEFPMYMIAVIVVFVLVLAV

SEQ ID NO: 2813236 - protein, 22 aa, Entamoeba invadens
VELLGAFIFKLTKDIFKISSST

SEQ ID NO: 2813237 - protein, 23 aa, Entamoeba invadens
VESLSFYICECGKNSARALKAVS

SEQ ID NO: 2813238 - protein, 17 aa, Entamoeba invadens
VEVATTLGFEFSEKNTR

SEQ ID NO: 2813239 - protein, 21 aa, Entamoeba invadens
VEVFIRRCLKQETIPEQQRFE

SEQ ID NO: 2813240 - protein, 19 aa, Entamoeba invadens
VEVMYRFIACGIEMTKTKL

SEQ ID NO: 2813241 - protein, 25 aa, Entamoeba invadens
VEVRMKLRFKVCLDAAQGIQYLHTN

SEQ ID NO: 2813242 - protein, 17 aa, Entamoeba invadens
VEYYNWFFVNIILHPQT

SEQ ID NO: 2813243 - protein, 18 aa, Entamoeba invadens
VFCGYRLSEVLRCPNDVL

SEQ ID NO: 2813244 - protein, 19 aa, Entamoeba invadens
VFCVLRITRIVLLISTLEF

SEQ ID NO: 2813245 - protein, 24 aa, Entamoeba invadens
VFDRIPALIGVVWMLHCEKTEEIK

SEQ ID NO: 2813246 - protein, 22 aa, Entamoeba invadens
VFEFAVKGLEIFGMKEHLDFDL

SEQ ID NO: 2813247 - protein, 19 aa, Entamoeba invadens
VFIATSIGIRFIIRKKQLK

SEQ ID NO: 2813248 - protein, 22 aa, Entamoeba invadens
VFICIVCLLAIIFAVFGIWCLI

SEQ ID NO: 2813249 - protein, 25 aa, Entamoeba invadens
VFIFMLRISPIFPFPVLNYTLGPVC

SEQ ID NO: 2813250 - protein, 17 aa, Entamoeba invadens
VFILLAFSDDCQVLDDL

SEQ ID NO: 2813251 - protein, 22 aa, Entamoeba invadens
VFKVFRTSEEIHFIDYFEKIPQ

SEQ ID NO: 2813252 - protein, 25 aa, Entamoeba invadens
VFNPFKFLLRRAVRLFPMQLFSTIM

SEQ ID NO: 2813253 - protein, 27 aa, Entamoeba invadens
VFQCEKFKLSHYVMWFFVFSYFFIAII

SEQ ID NO: 2813254 - protein, 23 aa, Entamoeba invadens
VFRGTVVEVCWNRVEKLVVSKEI

SEQ ID NO: 2813255 - protein, 17 aa, Entamoeba invadens
VFSGVSFYNGQLQLYDS

SEQ ID NO: 2813256 - protein, 25 aa, Entamoeba invadens
VFSYAICMLEIWLCRSPYNVEEFET

SEQ ID NO: 2813257 - protein, 18 aa, Entamoeba invadens
VFSYLMCILICFFTSFFG

SEQ ID NO: 2813258 - protein, 18 aa, Entamoeba invadens
VFVLKLYYAYGFLMSVFL

SEQ ID NO: 2813259 - protein, 21 aa, Entamoeba invadens
VGCAICKVGYYYILKDCRQCE

SEQ ID NO: 2813260 - protein, 18 aa, Entamoeba invadens
VGCRRCTSGYFLESASQT

SEQ ID NO: 2813261 - protein, 17 aa, Entamoeba invadens
VGDSKCTKCSFWHTPSV

SEQ ID NO: 2813262 - protein, 22 aa, Entamoeba invadens
VGELTCCLCPLFAGLIATKTND

SEQ ID NO: 2813263 - protein, 18 aa, Entamoeba invadens
VGFEEWFKLFGLGEKHLA

SEQ ID NO: 2813264 - protein, 21 aa, Entamoeba invadens
VGFFIPCVWFYLIYKYHNSPL

SEQ ID NO: 2813265 - protein, 21 aa, Entamoeba invadens
VGGCSLCLSGYYLKDGKCHPL

SEQ ID NO: 2813266 - protein, 18 aa, Entamoeba invadens
VGKCAICPKGTYYMSSVC

SEQ ID NO: 2813267 - protein, 18 aa, Entamoeba invadens
VGKFPFIWIFLVFASICF

SEQ ID NO: 2813268 - protein, 22 aa, Entamoeba invadens
VGLSIIRFFLGLGIGGEYPLSS

SEQ ID NO: 2813269 - protein, 17 aa, Entamoeba invadens
VGMTFTYFAPLVFVVAL

SEQ ID NO: 2813270 - protein, 24 aa, Entamoeba invadens
VGSILRRPLPVFLFALIIPLPQNN

SEQ ID NO: 2813271 - protein, 17 aa, Entamoeba invadens
VGVFGCEICLVLFCITV

SEQ ID NO: 2813272 - protein, 25 aa, Entamoeba invadens
VGVPRLYEKLLFRINEALKKSKLAA

SEQ ID NO: 2813273 - protein, 19 aa, Entamoeba invadens
VGYCVFPIFLGAIVTTVCT

SEQ ID NO: 2813274 - protein, 24 aa, Entamoeba invadens
VGYLYCCFCTSLLDRNKEKKEKEK

SEQ ID NO: 2813275 - protein, 17 aa, Entamoeba invadens
VHFQCRGRFAIQYIKAW

SEQ ID NO: 2813276 - protein, 21 aa, Entamoeba invadens
VHKRPLFMYSRFIFVRILVVV

SEQ ID NO: 2813277 - protein, 17 aa, Entamoeba invadens
VHPCSYFYNTVNWPEIA

SEQ ID NO: 2813278 - protein, 19 aa, Entamoeba invadens
VHPKIFYYTSLIVHLFNYG

SEQ ID NO: 2813279 - protein, 23 aa, Entamoeba invadens
VHSCFVIGFKLCLPQLLSFFQIV

SEQ ID NO: 2813280 - protein, 18 aa, Entamoeba invadens
VHYQWRCGYIQYVSTIVV

SEQ ID NO: 2813281 - protein, 20 aa, Entamoeba invadens
VICSFFAIFFVKFVSTIFNT

SEQ ID NO: 2813282 - protein, 19 aa, Entamoeba invadens
VIDIFPYVRYETIPFYSMN

SEQ ID NO: 2813283 - protein, 18 aa, Entamoeba invadens
VIEKCFFIPISEGGVFTM

SEQ ID NO: 2813284 - protein, 18 aa, Entamoeba invadens
VIFVCVFFVLIVILLFII

SEQ ID NO: 2813285 - protein, 19 aa, Entamoeba invadens
VIGAFPLFIVDTIEHIEIG

SEQ ID NO: 2813286 - protein, 20 aa, Entamoeba invadens
VIKYNRIYNLTGWGKSNSYV

SEQ ID NO: 2813287 - protein, 19 aa, Entamoeba invadens
VIMSLCFIAFYLKKGRSFP

SEQ ID NO: 2813288 - protein, 17 aa, Entamoeba invadens
VIQAMNWMSYALKNPEK

SEQ ID NO: 2813289 - protein, 19 aa, Entamoeba invadens
VITEFFKTLTICQSVDIRR

SEQ ID NO: 2813290 - protein, 19 aa, Entamoeba invadens
VIVVKLMLVGIVLYPIYIV

SEQ ID NO: 2813291 - protein, 18 aa, Entamoeba invadens
VIVWRKKKVLTFVVYCCL

SEQ ID NO: 2813292 - protein, 21 aa, Entamoeba invadens
VKADGLFCLQCNEGFNPIETL

SEQ ID NO: 2813293 - protein, 17 aa, Entamoeba invadens
VKALCGFIQTTLNTNLG

SEQ ID NO: 2813294 - protein, 20 aa, Entamoeba invadens
VKCLYPCLRCVTSSSLCVQC

SEQ ID NO: 2813295 - protein, 24 aa, Entamoeba invadens
VKDGVEFTLKCNYDTFIEASNVGA

SEQ ID NO: 2813296 - protein, 20 aa, Entamoeba invadens
VKEEFKAEMFGGVKVMKLGC

SEQ ID NO: 2813297 - protein, 22 aa, Entamoeba invadens
VKFYLKAILIFSIILTVILAVV

SEQ ID NO: 2813298 - protein, 17 aa, Entamoeba invadens
VKGNCPEMYFKDNAGKM

SEQ ID NO: 2813299 - protein, 17 aa, Entamoeba invadens
VKGYFKYMWADNTAQIV

SEQ ID NO: 2813300 - protein, 17 aa, Entamoeba invadens
VKHPKVWLYSARIAAST

SEQ ID NO: 2813301 - protein, 18 aa, Entamoeba invadens
VKLFECIEMLKLNMKTLS

SEQ ID NO: 2813302 - protein, 18 aa, Entamoeba invadens
VKLGGHWSVVIGYDDVGK

SEQ ID NO: 2813303 - protein, 17 aa, Entamoeba invadens
VKLLKIFQCALLSANMN

SEQ ID NO: 2813304 - protein, 19 aa, Entamoeba invadens
VKLPFHYPLWKAMIAITLL

SEQ ID NO: 2813305 - protein, 20 aa, Entamoeba invadens
VKMCQMCTLVWVLAVSIVIL

SEQ ID NO: 2813306 - protein, 18 aa, Entamoeba invadens
VKMLEMVVMWFLEEVLNR

SEQ ID NO: 2813307 - protein, 17 aa, Entamoeba invadens
VKNRILFENGLCLDISY

SEQ ID NO: 2813308 - protein, 22 aa, Entamoeba invadens
VKRLHVFGEVFAENGFLQRSDR

SEQ ID NO: 2813309 - protein, 23 aa, Entamoeba invadens
VKSDDWWTLKFCNITKLEVPEYV

SEQ ID NO: 2813310 - protein, 20 aa, Entamoeba invadens
VKTWNWWTVFSFVISFLLFI

SEQ ID NO: 2813311 - protein, 20 aa, Entamoeba invadens
VLCFFRNLFRTFLLPPSYPQ

SEQ ID NO: 2813312 - protein, 23 aa, Entamoeba invadens
VLCFTLPCIFQYLSRRKAIKMYK

SEQ ID NO: 2813313 - protein, 17 aa, Entamoeba invadens
VLCKLRFVNGIIQFNML

SEQ ID NO: 2813314 - protein, 18 aa, Entamoeba invadens
VLCTLKFQSSFLLVANLF

SEQ ID NO: 2813315 - protein, 18 aa, Entamoeba invadens
VLFFSVKISHHYQTKKVY

SEQ ID NO: 2813316 - protein, 19 aa, Entamoeba invadens
VLFHFKKRITFLISGIVQI

SEQ ID NO: 2813317 - protein, 22 aa, Entamoeba invadens
VLGFFCCCIWIVVYRKFKHSGN

SEQ ID NO: 2813318 - protein, 20 aa, Entamoeba invadens
VLICLRLEKVFGISADILGV

SEQ ID NO: 2813319 - protein, 19 aa, Entamoeba invadens
VLKEFVVACARQILTEFTY

SEQ ID NO: 2813320 - protein, 21 aa, Entamoeba invadens
VLKHGTCVLCGNGQLDEGEEC

SEQ ID NO: 2813321 - protein, 24 aa, Entamoeba invadens
VLKKLSLCVCCKMTFDCQAKEIRL

SEQ ID NO: 2813322 - protein, 18 aa, Entamoeba invadens
VLKVFGLPGKINMNFDDL

SEQ ID NO: 2813323 - protein, 23 aa, Entamoeba invadens
VLPIICCCCGLSLSPPQKGQKEY

SEQ ID NO: 2813324 - protein, 17 aa, Entamoeba invadens
VLQVLKWLNRVVEINPV

SEQ ID NO: 2813325 - protein, 22 aa, Entamoeba invadens
VLSCARCCFGPCCVAKHGCICP

SEQ ID NO: 2813326 - protein, 24 aa, Entamoeba invadens
VLSNFFTLISWCFFSQQIQNVVDT

SEQ ID NO: 2813327 - protein, 17 aa, Entamoeba invadens
VLYRMLFGLAFGLIVYF

SEQ ID NO: 2813328 - protein, 20 aa, Entamoeba invadens
VMALGLFWFFYVFKIYMKYA

SEQ ID NO: 2813329 - protein, 18 aa, Entamoeba invadens
VMDCLFPSCVGGCISPNE

SEQ ID NO: 2813330 - protein, 19 aa, Entamoeba invadens
VMFIKCSFTKLKKKIPTIL

SEQ ID NO: 2813331 - protein, 19 aa, Entamoeba invadens
VMFPVVWAAYWGKDPLGQE

SEQ ID NO: 2813332 - protein, 17 aa, Entamoeba invadens
VMGSTVFEWFCPLFPSR

SEQ ID NO: 2813333 - protein, 17 aa, Entamoeba invadens
VMMKLRVKFMIDLGRGL

SEQ ID NO: 2813334 - protein, 26 aa, Entamoeba invadens
VNASCDIWALGCLFYELFTSKMLFWI

SEQ ID NO: 2813335 - protein, 18 aa, Entamoeba invadens
VNCCVRIGAPQIFIVSHL

SEQ ID NO: 2813336 - protein, 24 aa, Entamoeba invadens
VNCFRCSCCGRVIIGDKLTTTDEL

SEQ ID NO: 2813337 - protein, 22 aa, Entamoeba invadens
VNFNFPLEFLKPMEPNFDELFE

SEQ ID NO: 2813338 - protein, 24 aa, Entamoeba invadens
VNGNWCIYDSWTLLCLHKAQEGEG

SEQ ID NO: 2813339 - protein, 17 aa, Entamoeba invadens
VNLDIAKGLALLHSKGF

SEQ ID NO: 2813340 - protein, 20 aa, Entamoeba invadens
VNLMPLYKMEFFKLLEQQRG

SEQ ID NO: 2813341 - protein, 19 aa, Entamoeba invadens
VNMIFEWVVAKLKIRNLFA

SEQ ID NO: 2813342 - protein, 19 aa, Entamoeba invadens
VNMLFDICLELGFFFTLKK

SEQ ID NO: 2813343 - protein, 19 aa, Entamoeba invadens
VNPGFLYLVTFPWLFGIMF

SEQ ID NO: 2813344 - protein, 21 aa, Entamoeba invadens
VNREIKNLFSIGNTTNHKVKI

SEQ ID NO: 2813345 - protein, 22 aa, Entamoeba invadens
VNRFLPFKAPIVFSSSCKNIIS

SEQ ID NO: 2813346 - protein, 25 aa, Entamoeba invadens
VNSLNEFKALLGLIALGADSYYLSL

SEQ ID NO: 2813347 - protein, 18 aa, Entamoeba invadens
VNTFSVTVLREFESTTVF

SEQ ID NO: 2813348 - protein, 18 aa, Entamoeba invadens
VNWFFKFALQTICPDTLA

SEQ ID NO: 2813349 - protein, 18 aa, Entamoeba invadens
VPCEFTFTVTKPMKTPVY

SEQ ID NO: 2813350 - protein, 23 aa, Entamoeba invadens
VPEMKELIRNAGVARIIEIDPII

SEQ ID NO: 2813351 - protein, 23 aa, Entamoeba invadens
VPERIFWYWIMLHLTYYEMIWSL

SEQ ID NO: 2813352 - protein, 18 aa, Entamoeba invadens
VPKCYSECFTFFKSVLYC

SEQ ID NO: 2813353 - protein, 25 aa, Entamoeba invadens
VPLCLPCSFVFWFFGKVLDHPKRIK

SEQ ID NO: 2813354 - protein, 21 aa, Entamoeba invadens
VPMFECVNIVFGMYNLGVVRI

SEQ ID NO: 2813355 - protein, 18 aa, Entamoeba invadens
VPNCKYCEGGKCKKCQEN

SEQ ID NO: 2813356 - protein, 20 aa, Entamoeba invadens
VPNCKYCEGGKCKRCNEKYV

SEQ ID NO: 2813357 - protein, 25 aa, Entamoeba invadens
VPSPWLQVRILRILRYIPPKKGAEE

SEQ ID NO: 2813358 - protein, 19 aa, Entamoeba invadens
VPSVFGWCLLYYKASMLIQ

SEQ ID NO: 2813359 - protein, 21 aa, Entamoeba invadens
VPYPLPVIIGIDWGYDNIVVS

SEQ ID NO: 2813360 - protein, 25 aa, Entamoeba invadens
VQCPFPMVYCSSSFEALSCSNNYIL

SEQ ID NO: 2813361 - protein, 28 aa, Entamoeba invadens
VQIRFRYGYEVEYWFKLFEELVDMAHNR

SEQ ID NO: 2813362 - protein, 18 aa, Entamoeba invadens
VQLFFVIFFFMLFAIFIP

SEQ ID NO: 2813363 - protein, 21 aa, Entamoeba invadens
VQRLPRYRLLLSDLLKHTENT

SEQ ID NO: 2813364 - protein, 19 aa, Entamoeba invadens
VQRQFGLLLDLCYYGPYGI

SEQ ID NO: 2813365 - protein, 22 aa, Entamoeba invadens
VQWRCGMNIWKNPRSEGGQTLC

SEQ ID NO: 2813366 - protein, 23 aa, Entamoeba invadens
VRAECAYSFLPYDVVKRYMQLNP

SEQ ID NO: 2813367 - protein, 19 aa, Entamoeba invadens
VRFFVCFLVSFAISLLLAF

SEQ ID NO: 2813368 - protein, 21 aa, Entamoeba invadens
VRLQISMSIARGMELFTTRKQ

SEQ ID NO: 2813369 - protein, 22 aa, Entamoeba invadens
VRMPRIIGMVVEYAPFGSLRSV

SEQ ID NO: 2813370 - protein, 17 aa, Entamoeba invadens
VRSGTWLSVSARNSTNV

SEQ ID NO: 2813371 - protein, 20 aa, Entamoeba invadens
VRYCKARVGPFGWDYTGNSH

SEQ ID NO: 2813372 - protein, 17 aa, Entamoeba invadens
VRYETIPFYSMNDGKGF

SEQ ID NO: 2813373 - protein, 19 aa, Entamoeba invadens
VRYRAIRAIGCITTHSYTN

SEQ ID NO: 2813374 - protein, 20 aa, Entamoeba invadens
VSAWVSGLLYFFGRFPQAVH

SEQ ID NO: 2813375 - protein, 17 aa, Entamoeba invadens
VSCTSISCKTCMSTTGK

SEQ ID NO: 2813376 - protein, 17 aa, Entamoeba invadens
VSDFFECLIKTLIVGGN

SEQ ID NO: 2813377 - protein, 20 aa, Entamoeba invadens
VSDFKFPWHIANFVIEGKRL

SEQ ID NO: 2813378 - protein, 17 aa, Entamoeba invadens
VSERCSLVYSLIGGSDQ

SEQ ID NO: 2813379 - protein, 17 aa, Entamoeba invadens
VSESFSMKCSNLFYGCY

SEQ ID NO: 2813380 - protein, 20 aa, Entamoeba invadens
VSGEKCILCGSFKSNNDEVA

SEQ ID NO: 2813381 - protein, 24 aa, Entamoeba invadens
VSHFKKFSLIYAMIDFLFAKQENP

SEQ ID NO: 2813382 - protein, 21 aa, Entamoeba invadens
VSICYSLLFRKIEVLVFAIVA

SEQ ID NO: 2813383 - protein, 20 aa, Entamoeba invadens
VSIPDAWPLTKAACGKFTQE

SEQ ID NO: 2813384 - protein, 23 aa, Entamoeba invadens
  misc_feature (22)..(23): Xaa can be any naturally occurring amino acid
VSKRLSPCFVQFALCVPNQVCXX

SEQ ID NO: 2813385 - protein, 17 aa, Entamoeba invadens
VSLEIPKTPAFVSLLSE

SEQ ID NO: 2813386 - protein, 19 aa, Entamoeba invadens
VSLVLNCFCVFSRVLRIHP

SEQ ID NO: 2813387 - protein, 19 aa, Entamoeba invadens
VSSDCKEWIPSTASLLSSY

SEQ ID NO: 2813388 - protein, 22 aa, Entamoeba invadens
VSSLCFWTSFQFAPRGKFNSKS

SEQ ID NO: 2813389 - protein, 18 aa, Entamoeba invadens
VTCECAKGKLGNGDECIR

SEQ ID NO: 2813390 - protein, 18 aa, Entamoeba invadens
VTCSPSFVRKCIKCVAGS

SEQ ID NO: 2813391 - protein, 17 aa, Entamoeba invadens
VTCSVPNCKYCEGGKCK

SEQ ID NO: 2813392 - protein, 23 aa, Entamoeba invadens
VTDFPGQVAYYFSILQLKIINGY

SEQ ID NO: 2813393 - protein, 18 aa, Entamoeba invadens
VTDIFSLSFAFGGIYFVT

SEQ ID NO: 2813394 - protein, 19 aa, Entamoeba invadens
VTFPSYLLTIWDRCFEFCM

SEQ ID NO: 2813395 - protein, 18 aa, Entamoeba invadens
VTIWRPPKVLIFHLKRFE

SEQ ID NO: 2813396 - protein, 19 aa, Entamoeba invadens
VTKKFKLGWKIPTLTLVLL

SEQ ID NO: 2813397 - protein, 20 aa, Entamoeba invadens
VTLFECYKWGEAYPKNEFKY

SEQ ID NO: 2813398 - protein, 19 aa, Entamoeba invadens
VTLIICFSVKYIMQYMKLE

SEQ ID NO: 2813399 - protein, 17 aa, Entamoeba invadens
VTLLRRFIRAEVSQFAT

SEQ ID NO: 2813400 - protein, 19 aa, Entamoeba invadens
VTLYECLSWSLAYQPPQFK

SEQ ID NO: 2813401 - protein, 23 aa, Entamoeba invadens
VTMFECLSWRTAFPKSEYPFSWK

SEQ ID NO: 2813402 - protein, 20 aa, Entamoeba invadens
VTMYECLKWGEAYGTNDFKF

SEQ ID NO: 2813403 - protein, 18 aa, Entamoeba invadens
VTMYEVFGWSEAYQNDTF

SEQ ID NO: 2813404 - protein, 20 aa, Entamoeba invadens
VTPMVVEFNAPFTFVNTTPL

SEQ ID NO: 2813405 - protein, 21 aa, Entamoeba invadens
VTSRLKIKFMLDGAKGLFYLH

SEQ ID NO: 2813406 - protein, 18 aa, Entamoeba invadens
VTTFLFYWYNFMPLSRGT

SEQ ID NO: 2813407 - protein, 19 aa, Entamoeba invadens
VTTPFQIIWFYKMYTHFLC

SEQ ID NO: 2813408 - protein, 24 aa, Entamoeba invadens
VTTRKCIKCKIGFRPDIYYPNNCI

SEQ ID NO: 2813409 - protein, 18 aa, Entamoeba invadens
VTVLREFESTTVFQTKSI

SEQ ID NO: 2813410 - protein, 20 aa, Entamoeba invadens
VVACKRCKNGYVISNQKCVE

SEQ ID NO: 2813411 - protein, 17 aa, Entamoeba invadens
VVCKTIFLTENCNSETA

SEQ ID NO: 2813412 - protein, 19 aa, Entamoeba invadens
VVCSTCLFGYVVSNGVCTN

SEQ ID NO: 2813413 - protein, 20 aa, Entamoeba invadens
VVEFSLRGKIEMAAETNEKA

SEQ ID NO: 2813414 - protein, 19 aa, Entamoeba invadens
VVEKFEFPMYMIAVIIIFV

SEQ ID NO: 2813415 - protein, 23 aa, Entamoeba invadens
VVFAELYWTPGILRQAEDRVHRI

SEQ ID NO: 2813416 - protein, 20 aa, Entamoeba invadens
VVFESCNFVNCIFYLDDVHS

SEQ ID NO: 2813417 - protein, 20 aa, Entamoeba invadens
VVFESCNFVNCIIHLDDLDM

SEQ ID NO: 2813418 - protein, 18 aa, Entamoeba invadens
VVFMCLFGFNALGCYYGF

SEQ ID NO: 2813419 - protein, 23 aa, Entamoeba invadens
VVGSGWRPSPVLNEIKKCVPIQT

SEQ ID NO: 2813420 - protein, 18 aa, Entamoeba invadens
VVGTYLVYLSTLKCQVGH

SEQ ID NO: 2813421 - protein, 21 aa, Entamoeba invadens
VVICTCSYYLIIVVVFILVAF

SEQ ID NO: 2813422 - protein, 21 aa, Entamoeba invadens
VVICTCSYYLIIVVVVVLIVF

SEQ ID NO: 2813423 - protein, 24 aa, Entamoeba invadens
VVLPGYMFGAAPNWAFYNNATKCG

SEQ ID NO: 2813424 - protein, 18 aa, Entamoeba invadens
VVPINYWKIAIVASTVMV

SEQ ID NO: 2813425 - protein, 21 aa, Entamoeba invadens
VVRARIVSIMSFFSSTIFPLL

SEQ ID NO: 2813426 - protein, 24 aa, Entamoeba invadens
VVRPECFKRAPITKFFDLEFTSLP

SEQ ID NO: 2813427 - protein, 19 aa, Entamoeba invadens
VVRYYCQFERAFKMVKQLL

SEQ ID NO: 2813428 - protein, 17 aa, Entamoeba invadens
VVSEFDFDIAFSKNESP

SEQ ID NO: 2813429 - protein, 22 aa, Entamoeba invadens
VVTACGLVVIFGMIIAKFAKKK

SEQ ID NO: 2813430 - protein, 23 aa, Entamoeba invadens
VVVIPANWFSKWMIMLNSKTREP

SEQ ID NO: 2813431 - protein, 18 aa, Entamoeba invadens
VVVYSMFYPTIKFTLDEL

SEQ ID NO: 2813432 - protein, 17 aa, Entamoeba invadens
VVYCLRWYGTLEVPQEL

SEQ ID NO: 2813433 - protein, 24 aa, Entamoeba invadens
VVYSRSNFTFGFFPFSCCVSGADE

SEQ ID NO: 2813434 - protein, 19 aa, Entamoeba invadens
VWCCLDFEWIYSFVLLDLE

SEQ ID NO: 2813435 - protein, 18 aa, Entamoeba invadens
VWDDFKWIVESAQKQFSL

SEQ ID NO: 2813436 - protein, 20 aa, Entamoeba invadens
VWIKTNWWWILIIFVVLALC

SEQ ID NO: 2813437 - protein, 18 aa, Entamoeba invadens
VWILEVLIGFLMLKIHYT

SEQ ID NO: 2813438 - protein, 19 aa, Entamoeba invadens
VWQYKMWISIVMSLILGGV

SEQ ID NO: 2813439 - protein, 23 aa, Entamoeba invadens
VWVLQCYVCVYSFFISDMTTKSF

SEQ ID NO: 2813440 - protein, 17 aa, Entamoeba invadens
VWVVMVIIEFCWKGHGE

SEQ ID NO: 2813441 - protein, 18 aa, Entamoeba invadens
VWYPRPSPPFALASSVML

SEQ ID NO: 2813442 - protein, 18 aa, Entamoeba invadens
VYCDVCSIGYFPEAVCKI

SEQ ID NO: 2813443 - protein, 19 aa, Entamoeba invadens
VYIDPKFTTLLGIKILLDV

SEQ ID NO: 2813444 - protein, 19 aa, Entamoeba invadens
VYMLYFIKKFIIYTPDTNE

SEQ ID NO: 2813445 - protein, 17 aa, Entamoeba invadens
VYNPLSWDSCVAMNPGP

SEQ ID NO: 2813446 - protein, 22 aa, Entamoeba invadens
VYSECVPIRPFLSYLKASINNK

SEQ ID NO: 2813447 - protein, 24 aa, Entamoeba invadens
VYSFAICMLEIWLTKDVYDPMKFP

SEQ ID NO: 2813448 - protein, 24 aa, Entamoeba invadens
VYSFSICMLEIWKGKDCYPQDKFP

SEQ ID NO: 2813449 - protein, 19 aa, Entamoeba invadens
VYVACGWCIFAIARMHYSV

SEQ ID NO: 2813450 - protein, 25 aa, Entamoeba invadens
VYYDCGFSKLELCGSATTQHTCDAI

SEQ ID NO: 2813451 - protein, 19 aa, Entamoeba invadens
WCEDCLKALSGIQISEFGI

SEQ ID NO: 2813452 - protein, 17 aa, Entamoeba invadens
WDIADSIAIGKRPKLDV

SEQ ID NO: 2813453 - protein, 20 aa, Entamoeba invadens
WDVLEFFHIVFVFRSEFFER

SEQ ID NO: 2813454 - protein, 30 aa, Entamoeba invadens
WDVLIGCLLCFVISFLLVRFAKIGFVKAVL

SEQ ID NO: 2813455 - protein, 20 aa, Entamoeba invadens
WECVSPLLPCPCPFCKSPLT

SEQ ID NO: 2813456 - protein, 20 aa, Entamoeba invadens
WEKGGSCSFGPKTEEVVLPG

SEQ ID NO: 2813457 - protein, 19 aa, Entamoeba invadens
WEVPSPKAILFFQHGYGEH

SEQ ID NO: 2813458 - protein, 19 aa, Entamoeba invadens
WFLEIGMKYIMIEIVQDAV

SEQ ID NO: 2813459 - protein, 18 aa, Entamoeba invadens
WFTLLEVFGFIVLTVGIL

SEQ ID NO: 2813460 - protein, 24 aa, Entamoeba invadens
WFYLEIAEKCIIVFVCLAFDKMKR

SEQ ID NO: 2813461 - protein, 20 aa, Entamoeba invadens
WGITALLWICVWWQRWELKE

SEQ ID NO: 2813462 - protein, 18 aa, Entamoeba invadens
WGLFWGFSVDYEFKFSGV

SEQ ID NO: 2813463 - protein, 18 aa, Entamoeba invadens
WGNVFPLELYPKAWDIAD

SEQ ID NO: 2813464 - protein, 18 aa, Entamoeba invadens
WGTLGYIVGEVWKGGIDD

SEQ ID NO: 2813465 - protein, 17 aa, Entamoeba invadens
WGYRALAAFAIYFGLGW

SEQ ID NO: 2813466 - protein, 17 aa, Entamoeba invadens
WIFEVRWTFALLIVLVI

SEQ ID NO: 2813467 - protein, 18 aa, Entamoeba invadens
WIIAFCVAMKDILVDYYF

SEQ ID NO: 2813468 - protein, 17 aa, Entamoeba invadens
WIILICRALMIVVVCVA

SEQ ID NO: 2813469 - protein, 17 aa, Entamoeba invadens
WIITTLFPSFFWVLEDN

SEQ ID NO: 2813470 - protein, 20 aa, Entamoeba invadens
WIKGYFKYLWSDSTIAVDNI

SEQ ID NO: 2813471 - protein, 17 aa, Entamoeba invadens
WKALVLVSVLTFSMEIL

SEQ ID NO: 2813472 - protein, 19 aa, Entamoeba invadens
WKCYVVINIGQLIIITLAS

SEQ ID NO: 2813473 - protein, 22 aa, Entamoeba invadens
WKDGKAFCALFHYYHPEVIDFE

SEQ ID NO: 2813474 - protein, 21 aa, Entamoeba invadens
WKFHMAMCVATLFMLQNLSDW

SEQ ID NO: 2813475 - protein, 23 aa, Entamoeba invadens
WKKMLHFPGWFFSQFSRTDPEGS

SEQ ID NO: 2813476 - protein, 20 aa, Entamoeba invadens
WKLAVSNVRKNILIGTIPVF

SEQ ID NO: 2813477 - protein, 18 aa, Entamoeba invadens
WKLWDFPIFYTTASVDYF

SEQ ID NO: 2813478 - protein, 21 aa, Entamoeba invadens
WKNAKLWVMIVICLIVVLCLV

SEQ ID NO: 2813479 - protein, 17 aa, Entamoeba invadens
WKNFEWVDVKWKDIFLG

SEQ ID NO: 2813480 - protein, 19 aa, Entamoeba invadens
WKTSFEVNYHFPLKNIIAT

SEQ ID NO: 2813481 - protein, 17 aa, Entamoeba invadens
WKVNFGIIQKESNGNVT

SEQ ID NO: 2813482 - protein, 27 aa, Entamoeba invadens
WLFFYSAMCLIVFGVLKYFGKKDDFLG

SEQ ID NO: 2813483 - protein, 17 aa, Entamoeba invadens
WLIPAYIACLFRLLKML

SEQ ID NO: 2813484 - protein, 24 aa, Entamoeba invadens
WLVCALGFCYPALKFLGSTSLFIE

SEQ ID NO: 2813485 - protein, 24 aa, Entamoeba invadens
WLVCALGFCYPALKFLGSTSLFVE

SEQ ID NO: 2813486 - protein, 18 aa, Entamoeba invadens
WLVLIACVLCLFVVALLV

SEQ ID NO: 2813487 - protein, 28 aa, Entamoeba invadens
WLVMGFVCCCFWLFGYCTLKNSNDNGAR

SEQ ID NO: 2813488 - protein, 17 aa, Entamoeba invadens
WMGQRMDWLGVFITSVT

SEQ ID NO: 2813489 - protein, 28 aa, Entamoeba invadens
WMKECKRFPKFFHCIVALAPIKLVHLVI

SEQ ID NO: 2813490 - protein, 17 aa, Entamoeba invadens
WMKNRCDSIESILETKD

SEQ ID NO: 2813491 - protein, 28 aa, Entamoeba invadens
WMLKIDIMVQFKIKIYIRKMNYKTRKRE

SEQ ID NO: 2813492 - protein, 20 aa, Entamoeba invadens
WMRYRHDVLLSFSLAQAVIP

SEQ ID NO: 2813493 - protein, 23 aa, Entamoeba invadens
WMSYLLVERGWWLKYCSITKSKS

SEQ ID NO: 2813494 - protein, 17 aa, Entamoeba invadens
WNFLWTLVFYSGFLVIT

SEQ ID NO: 2813495 - protein, 19 aa, Entamoeba invadens
WNYFICFFIITFLLIYVTY

SEQ ID NO: 2813496 - protein, 30 aa, Entamoeba invadens
WPKEIAPLCAWRIVYLLSMCIALLYSAFIS

SEQ ID NO: 2813497 - protein, 23 aa, Entamoeba invadens
WPSCSNPFLYCCAANVSSDNAVH

SEQ ID NO: 2813498 - protein, 17 aa, Entamoeba invadens
WPSNGSIEFNKFKFRYR

SEQ ID NO: 2813499 - protein, 17 aa, Entamoeba invadens
WPTKIAIYGSFAINLCL

SEQ ID NO: 2813500 - protein, 19 aa, Entamoeba invadens
WQLGLCIIAIFPVLLFFLF

SEQ ID NO: 2813501 - protein, 20 aa, Entamoeba invadens
WRLILLFPLALVFGFSRSYY

SEQ ID NO: 2813502 - protein, 17 aa, Entamoeba invadens
WRNWDWDTDFTIRKYLL

SEQ ID NO: 2813503 - protein, 17 aa, Entamoeba invadens
WRPPKVLIFHLKRFEFT

SEQ ID NO: 2813504 - protein, 19 aa, Entamoeba invadens
WRQCILICRPVRFSTTAFH

SEQ ID NO: 2813505 - protein, 17 aa, Entamoeba invadens
WRQISLVGGFTLMLIGG

SEQ ID NO: 2813506 - protein, 21 aa, Entamoeba invadens
WSFGKCFGFLFGGMLKTALGM

SEQ ID NO: 2813507 - protein, 18 aa, Entamoeba invadens
WSTWKLKYHKAYEGTNEI

SEQ ID NO: 2813508 - protein, 17 aa, Entamoeba invadens
WTEKKCICSPKYGGDDC

SEQ ID NO: 2813509 - protein, 17 aa, Entamoeba invadens
WVFPRYIIYAAFQAYHV

SEQ ID NO: 2813510 - protein, 21 aa, Entamoeba invadens
WVIFKKEWKSMLFGYFTIAVY

SEQ ID NO: 2813511 - protein, 20 aa, Entamoeba invadens
WVKRYSVVFDFGVYNKLKEN

SEQ ID NO: 2813512 - protein, 17 aa, Entamoeba invadens
WVLNMFVTLPLDIKNAG

SEQ ID NO: 2813513 - protein, 17 aa, Entamoeba invadens
WVRHLPIAFLMRQHLFL

SEQ ID NO: 2813514 - protein, 23 aa, Entamoeba invadens
WWFCSICWIMIIIKMIRREFIQF

SEQ ID NO: 2813515 - protein, 25 aa, Entamoeba invadens
WWLCELKRWGSLHFLSQFFITETTN

SEQ ID NO: 2813516 - protein, 21 aa, Entamoeba invadens
WWVIKHLYELFLFVKGTEASD

SEQ ID NO: 2813517 - protein, 19 aa, Entamoeba invadens
WWWPLCRYGSMLSVSFFSL

SEQ ID NO: 2813518 - protein, 22 aa, Entamoeba invadens
YAAELKIDLALMLNLYRPLMKY

SEQ ID NO: 2813519 - protein, 20 aa, Entamoeba invadens
YAELCLRGLVALRKVSERVS

SEQ ID NO: 2813520 - protein, 17 aa, Entamoeba invadens
YAICVRLMCGFLNGNVG

SEQ ID NO: 2813521 - protein, 18 aa, Entamoeba invadens
YARRGFYISVHRNNIFQD

SEQ ID NO: 2813522 - protein, 19 aa, Entamoeba invadens
YASVYSRYMIVPMICHMIK

SEQ ID NO: 2813523 - protein, 19 aa, Entamoeba invadens
YATRCSLKFEMSDLGACDT

SEQ ID NO: 2813524 - protein, 20 aa, Entamoeba invadens
YAVFHLLRWLPGSEENVERI

SEQ ID NO: 2813525 - protein, 23 aa, Entamoeba invadens
YAYSVMCPYFFFPPASFDEITTA

SEQ ID NO: 2813526 - protein, 25 aa, Entamoeba invadens
YCCAKIVDFWGIFFCCVFIAMAAFL

SEQ ID NO: 2813527 - protein, 17 aa, Entamoeba invadens
YCKPTFYFKKTKCDYCG

SEQ ID NO: 2813528 - protein, 22 aa, Entamoeba invadens
YCNNCLRIGALVLVLHDIVDAI

SEQ ID NO: 2813529 - protein, 18 aa, Entamoeba invadens
YCPCDGCFITPFKNGEGV

SEQ ID NO: 2813530 - protein, 20 aa, Entamoeba invadens
YCTACPYGTYSKDSATSCTT

SEQ ID NO: 2813531 - protein, 17 aa, Entamoeba invadens
YCTGCAVNYVFFETNNV

SEQ ID NO: 2813532 - protein, 20 aa, Entamoeba invadens
YCVSCPMGSIKNTKICSVCS

SEQ ID NO: 2813533 - protein, 22 aa, Entamoeba invadens
YCVYHIKWWLLLVLILFIITVS

SEQ ID NO: 2813534 - protein, 19 aa, Entamoeba invadens
YCYPNFYLDNGICLFCQFC

SEQ ID NO: 2813535 - protein, 17 aa, Entamoeba invadens
YDECSYCNWANTCTQCY

SEQ ID NO: 2813536 - protein, 20 aa, Entamoeba invadens
YDIFKSIPFYLLSTMTPETL

SEQ ID NO: 2813537 - protein, 24 aa, Entamoeba invadens
YDSNIRYGIVWGISDKGVLKSAQD

SEQ ID NO: 2813538 - protein, 21 aa, Entamoeba invadens
YECLECGTGFYVESGNCTKLC

SEQ ID NO: 2813539 - protein, 22 aa, Entamoeba invadens
YEDRMYFCYTFIIRGIMTLVFT

SEQ ID NO: 2813540 - protein, 18 aa, Entamoeba invadens
YEECTLCKHNFILNNESV

SEQ ID NO: 2813541 - protein, 17 aa, Entamoeba invadens
YEFYESVCLLKCKKNQE

SEQ ID NO: 2813542 - protein, 18 aa, Entamoeba invadens
YEIAWRFGGNSLRTFTKV

SEQ ID NO: 2813543 - protein, 18 aa, Entamoeba invadens
YEIIGWKAAFSMKDPQFN

SEQ ID NO: 2813544 - protein, 21 aa, Entamoeba invadens
YELAFHRCLFEGITDVLFEKV

SEQ ID NO: 2813545 - protein, 20 aa, Entamoeba invadens
YELPKWFAVVVISFVVLFLV

SEQ ID NO: 2813546 - protein, 18 aa, Entamoeba invadens
YETFEWRAAYSKDKFKFA

SEQ ID NO: 2813547 - protein, 23 aa, Entamoeba invadens
YETKCSLCGLRILPKQKFVVKSG

SEQ ID NO: 2813548 - protein, 28 aa, Entamoeba invadens
YFAKFFRSMLYWWRIGKIAEMIENYMNQ

SEQ ID NO: 2813549 - protein, 31 aa, Entamoeba invadens
YFALGFICFCIWIAGYCRFKNSTDSSAKTFA

SEQ ID NO: 2813550 - protein, 17 aa, Entamoeba invadens
YFAREFFYQKLLGKDYP

SEQ ID NO: 2813551 - protein, 18 aa, Entamoeba invadens
YFDYYLSAEPVRFKLITT

SEQ ID NO: 2813552 - protein, 22 aa, Entamoeba invadens
YFHLFPAFCLPWFVKQKKNIPM

SEQ ID NO: 2813553 - protein, 18 aa, Entamoeba invadens
YFIEAIKLYLLVSESVNQ

SEQ ID NO: 2813554 - protein, 22 aa, Entamoeba invadens
YFPLVRFKRRFLLVMGTITLTV

SEQ ID NO: 2813555 - protein, 19 aa, Entamoeba invadens
YFRRLCVHPKLVLDDNHPM

SEQ ID NO: 2813556 - protein, 17 aa, Entamoeba invadens
YFSRLQSLPSFSQNFSY

SEQ ID NO: 2813557 - protein, 24 aa, Entamoeba invadens
YFVLGFFCCCFWACGYSQTKHASD

SEQ ID NO: 2813558 - protein, 23 aa, Entamoeba invadens
YFYIHACLTYLALNHHYSFIILN

SEQ ID NO: 2813559 - protein, 17 aa, Entamoeba invadens
YGAECKVCYPPFELIEG

SEQ ID NO: 2813560 - protein, 18 aa, Entamoeba invadens
YGCLSCSVGYYLDDGKCQ

SEQ ID NO: 2813561 - protein, 18 aa, Entamoeba invadens
YGECRVCDSFKCLECKSG

SEQ ID NO: 2813562 - protein, 22 aa, Entamoeba invadens
YGRCLRCTSGFYLETTINNPIS

SEQ ID NO: 2813563 - protein, 17 aa, Entamoeba invadens
YGRIFTGVCSFKLDNCS

SEQ ID NO: 2813564 - protein, 18 aa, Entamoeba invadens
YGRPSIKILDLMNSKYGE

SEQ ID NO: 2813565 - protein, 17 aa, Entamoeba invadens
YGTDLAFLAAATTFGVV

SEQ ID NO: 2813566 - protein, 17 aa, Entamoeba invadens
YGTVYRAEWRKVDVAVK

SEQ ID NO: 2813567 - protein, 18 aa, Entamoeba invadens
YHAYFRYFARYSVNDPRA

SEQ ID NO: 2813568 - protein, 21 aa, Entamoeba invadens
YHLKLRILFDTARGMQFLHEN

SEQ ID NO: 2813569 - protein, 18 aa, Entamoeba invadens
YIAPNILTTLGFVSMALC

SEQ ID NO: 2813570 - protein, 18 aa, Entamoeba invadens
YICDVLKYLSVMLSIQQI

SEQ ID NO: 2813571 - protein, 18 aa, Entamoeba invadens
YIEHCVNVTKSLCEQCDF

SEQ ID NO: 2813572 - protein, 21 aa, Entamoeba invadens
YIELLGSFIFKLSRNNLQMSS

SEQ ID NO: 2813573 - protein, 17 aa, Entamoeba invadens
YIFRIWDAVFAFPSSKF

SEQ ID NO: 2813574 - protein, 24 aa, Entamoeba invadens
YIFSNGKCLLSFKPITTVIDSPYK

SEQ ID NO: 2813575 - protein, 17 aa, Entamoeba invadens
YIICVAFNFDLVKEFGK

SEQ ID NO: 2813576 - protein, 19 aa, Entamoeba invadens
YIKVGELFTSFPISSGKDK

SEQ ID NO: 2813577 - protein, 18 aa, Entamoeba invadens
YIPEAIIIPFFVFCITVV

SEQ ID NO: 2813578 - protein, 27 aa, Entamoeba invadens
YIRFPYKLKIAMLYDISRGMQFLHENL

SEQ ID NO: 2813579 - protein, 18 aa, Entamoeba invadens
YIYGCFNVVLSFVFNDSL

SEQ ID NO: 2813580 - protein, 24 aa, Entamoeba invadens
YIYMKRAFSFASFFSLNGQALSKL

SEQ ID NO: 2813581 - protein, 19 aa, Entamoeba invadens
YKEACQFGFNLPRMNDQQL

SEQ ID NO: 2813582 - protein, 17 aa, Entamoeba invadens
YKEIKFSLTSKITTRID

SEQ ID NO: 2813583 - protein, 21 aa, Entamoeba invadens
YKEMIRFAIFFIKQKLGKIPE

SEQ ID NO: 2813584 - protein, 17 aa, Entamoeba invadens
YKFALNLEVGIEAIDYE

SEQ ID NO: 2813585 - protein, 17 aa, Entamoeba invadens
YKGCYRKYIVAIKKLKD

SEQ ID NO: 2813586 - protein, 17 aa, Entamoeba invadens
YKGRFSYSFKLKVMKDV

SEQ ID NO: 2813587 - protein, 19 aa, Entamoeba invadens
YKISDFIGYNWDVEELQFN

SEQ ID NO: 2813588 - protein, 19 aa, Entamoeba invadens
YKLCYYRFGELYTEQNQPS

SEQ ID NO: 2813589 - protein, 23 aa, Entamoeba invadens
YKLKVRMLFDISRGMQFLHENRI

SEQ ID NO: 2813590 - protein, 18 aa, Entamoeba invadens
YKLKVRMLFDTSRGMQFL

SEQ ID NO: 2813591 - protein, 22 aa, Entamoeba invadens
YKMPCDVFSLAVSFYEGYTWIT

SEQ ID NO: 2813592 - protein, 18 aa, Entamoeba invadens
YKNGLDCFNCYISCSSCI

SEQ ID NO: 2813593 - protein, 22 aa, Entamoeba invadens
YKRSSLIVSMHLLRTFFITLDP

SEQ ID NO: 2813594 - protein, 20 aa, Entamoeba invadens
YKSAEVIWLYLGEVGYSQCT

SEQ ID NO: 2813595 - protein, 23 aa, Entamoeba invadens
YKSELKSGALFKCVGKSELKTRS

SEQ ID NO: 2813596 - protein, 17 aa, Entamoeba invadens
YKSLCVIQSPFLDFLLS

SEQ ID NO: 2813597 - protein, 18 aa, Entamoeba invadens
YKTLIIASVVTFFVSYNV

SEQ ID NO: 2813598 - protein, 23 aa, Entamoeba invadens
YKVYKFESGVTYIAKFFCKSEEC

SEQ ID NO: 2813599 - protein, 18 aa, Entamoeba invadens
YKYSYAIAFIPALLYGVI

SEQ ID NO: 2813600 - protein, 17 aa, Entamoeba invadens
YLFFRWPNGFYNIKKGD

SEQ ID NO: 2813601 - protein, 26 aa, Entamoeba invadens
YLGKFMRDLMRFWKLTFVVKLLEIVM

SEQ ID NO: 2813602 - protein, 17 aa, Entamoeba invadens
YLIEWYYLISFNQTQIL

SEQ ID NO: 2813603 - protein, 17 aa, Entamoeba invadens
YLIGIAIMQVFTSFCFQ

SEQ ID NO: 2813604 - protein, 20 aa, Entamoeba invadens
YLKVRFCQDVAKGMEYLHEN

SEQ ID NO: 2813605 - protein, 17 aa, Entamoeba invadens
YLLMLIPAFCDFLATYL

SEQ ID NO: 2813606 - protein, 17 aa, Entamoeba invadens
YLLRFDFLAILRDFDFL

SEQ ID NO: 2813607 - protein, 21 aa, Entamoeba invadens
YLMCILICFFTSFFGCCCIGL

SEQ ID NO: 2813608 - protein, 22 aa, Entamoeba invadens
YLNSYKGGIVWSTEGKEIGALY

SEQ ID NO: 2813609 - protein, 19 aa, Entamoeba invadens
YLPAFGFIECELFRMYFDL

SEQ ID NO: 2813610 - protein, 19 aa, Entamoeba invadens
YLPKTWKFTTLWNGRLAIL

SEQ ID NO: 2813611 - protein, 17 aa, Entamoeba invadens
YLPQVCMVIQFFALGSL

SEQ ID NO: 2813612 - protein, 17 aa, Entamoeba invadens
YLRLVIVLHEDLSNKYG

SEQ ID NO: 2813613 - protein, 18 aa, Entamoeba invadens
YLRPRLSSMHTMTCFMTI

SEQ ID NO: 2813614 - protein, 17 aa, Entamoeba invadens
YLSIFSIAVFLSTIIIR

SEQ ID NO: 2813615 - protein, 18 aa, Entamoeba invadens
YLSPRLIKCVTFITLYLL

SEQ ID NO: 2813616 - protein, 18 aa, Entamoeba invadens
YLSSILFVLTFNILDTLV

SEQ ID NO: 2813617 - protein, 17 aa, Entamoeba invadens
YLVLIGSIIYVFDNAIS

SEQ ID NO: 2813618 - protein, 18 aa, Entamoeba invadens
YMGHCFRIVSNVLACSTI

SEQ ID NO: 2813619 - protein, 19 aa, Entamoeba invadens
YMKPHIMYFLSFLIVAILF

SEQ ID NO: 2813620 - protein, 19 aa, Entamoeba invadens
YMRKLFKIILNAPVKINTK

SEQ ID NO: 2813621 - protein, 17 aa, Entamoeba invadens
YNEIVNMIFEWVVAKLK

SEQ ID NO: 2813622 - protein, 19 aa, Entamoeba invadens
YNGILSLPITYLITSIDDD

SEQ ID NO: 2813623 - protein, 20 aa, Entamoeba invadens
YNGLRSCLVCSVGYYPSSGI

SEQ ID NO: 2813624 - protein, 22 aa, Entamoeba invadens
YNIIVGFFIRFYLFKQTCFTTT

SEQ ID NO: 2813625 - protein, 17 aa, Entamoeba invadens
YNKTPKCLMHYKDNLEG

SEQ ID NO: 2813626 - protein, 25 aa, Entamoeba invadens
YNLPLNYVISLKFVWVKNEQIETEY

SEQ ID NO: 2813627 - protein, 25 aa, Entamoeba invadens
YNNWFDICLLFACLLFGTLIIDCVI

SEQ ID NO: 2813628 - protein, 23 aa, Entamoeba invadens
YNPEIKQDCSLACPITENTDCVF

SEQ ID NO: 2813629 - protein, 17 aa, Entamoeba invadens
YNPRALIRFKKCPIKAV

SEQ ID NO: 2813630 - protein, 18 aa, Entamoeba invadens
YNQTNGWEKLCFNTNTIK

SEQ ID NO: 2813631 - protein, 23 aa, Entamoeba invadens
YNSYFRQCFKQVGGVSSIIIAIV

SEQ ID NO: 2813632 - protein, 21 aa, Entamoeba invadens
YNTSCYFYWIVVPLLFNEQGA

SEQ ID NO: 2813633 - protein, 23 aa, Entamoeba invadens
YPFCWRSDTPLIYRAIPSWFVNV

SEQ ID NO: 2813634 - protein, 18 aa, Entamoeba invadens
YPFFKHILSYLVPNYCKA

SEQ ID NO: 2813635 - protein, 20 aa, Entamoeba invadens
YPFMRFEFIPSVTMMYRTYF

SEQ ID NO: 2813636 - protein, 17 aa, Entamoeba invadens
YPHPWCIADDVAVGKRP

SEQ ID NO: 2813637 - protein, 20 aa, Entamoeba invadens
YPISCPIAICAGAEKGVEYF

SEQ ID NO: 2813638 - protein, 23 aa, Entamoeba invadens
YPISEFKFPWSIAEFVTSKKRLS

SEQ ID NO: 2813639 - protein, 21 aa, Entamoeba invadens
YPKEYFKFAWSIADFVASGKN

SEQ ID NO: 2813640 - protein, 23 aa, Entamoeba invadens
YPKNEFKFAWSIANFVTNGNHLL

SEQ ID NO: 2813641 - protein, 23 aa, Entamoeba invadens
YPKQKFKFAWSVADFVTAGKHLE

SEQ ID NO: 2813642 - protein, 23 aa, Entamoeba invadens
YPKSEFKFAWSIADFVSKGNHLK

SEQ ID NO: 2813643 - protein, 17 aa, Entamoeba invadens
YPLWKAMIAITLLLTPI

SEQ ID NO: 2813644 - protein, 18 aa, Entamoeba invadens
YPLYEVMRRMLLVIYENC

SEQ ID NO: 2813645 - protein, 20 aa, Entamoeba invadens
YPMELFRYSWMIAEFVSDNK

SEQ ID NO: 2813646 - protein, 20 aa, Entamoeba invadens
YPMLNLRPGFVNWLCMWGCL

SEQ ID NO: 2813647 - protein, 25 aa, Entamoeba invadens
YPPEVFKFPWKIAEFVSAGKSLEKR

SEQ ID NO: 2813648 - protein, 20 aa, Entamoeba invadens
YPTSCTNITCPILSYIYHKS

SEQ ID NO: 2813649 - protein, 19 aa, Entamoeba invadens
YPWSISKFVCVGRRLEQPA

SEQ ID NO: 2813650 - protein, 24 aa, Entamoeba invadens
YQVSSLIKFCFYKNAAFFLLDVSY

SEQ ID NO: 2813651 - protein, 18 aa, Entamoeba invadens
YRICPRIWAYSVHTEMHC

SEQ ID NO: 2813652 - protein, 18 aa, Entamoeba invadens
YRIGKWIKLNMTLVKAPF

SEQ ID NO: 2813653 - protein, 19 aa, Entamoeba invadens
YRKCTAPGCLLNRVVQQIV

SEQ ID NO: 2813654 - protein, 18 aa, Entamoeba invadens
YRLTQEWTSIVFKSIESD

SEQ ID NO: 2813655 - protein, 18 aa, Entamoeba invadens
YRMLGRLAMLLFFLELSA

SEQ ID NO: 2813656 - protein, 18 aa, Entamoeba invadens
YRMWAWKALSMLLLYCTL

SEQ ID NO: 2813657 - protein, 19 aa, Entamoeba invadens
YRYEYRGVSGYSIAISFIN

SEQ ID NO: 2813658 - protein, 26 aa, Entamoeba invadens
YSEEWKKVVWRTGRWIDMDHAYKTMD

SEQ ID NO: 2813659 - protein, 25 aa, Entamoeba invadens
YSETPRLYLKWVEKMAEEQAIRQNY

SEQ ID NO: 2813660 - protein, 22 aa, Entamoeba invadens
YSGVIEYICKFGFIKNILQTMM

SEQ ID NO: 2813661 - protein, 22 aa, Entamoeba invadens
YSHAECVCEFLLAHFMNMNDLS

SEQ ID NO: 2813662 - protein, 24 aa, Entamoeba invadens
YSILFCIVNLFLFDAKSTFTLGLF

SEQ ID NO: 2813663 - protein, 24 aa, Entamoeba invadens
YSKKAKICFFFFFLFSTILFLQGI

SEQ ID NO: 2813664 - protein, 17 aa, Entamoeba invadens
YSPHMFLFWGFGSVGVL

SEQ ID NO: 2813665 - protein, 22 aa, Entamoeba invadens
YSRCLSCSDSLFLVGNTCQTMN

SEQ ID NO: 2813666 - protein, 22 aa, Entamoeba invadens
YSRKCIKCNAGFYIVNGLCQKC

SEQ ID NO: 2813667 - protein, 20 aa, Entamoeba invadens
YSRKCLICKTGYYPGSDGVC

SEQ ID NO: 2813668 - protein, 17 aa, Entamoeba invadens
YSVMNWRVGGLLSANRD

SEQ ID NO: 2813669 - protein, 18 aa, Entamoeba invadens
YTCCFEIIEPTVFTKCNQ

SEQ ID NO: 2813670 - protein, 21 aa, Entamoeba invadens
YTDVIGGFSIRFPAPLRISEH

SEQ ID NO: 2813671 - protein, 18 aa, Entamoeba invadens
YTKAMLLYGCQVQNTKKL

SEQ ID NO: 2813672 - protein, 20 aa, Entamoeba invadens
YTKNMWVKGYFKYMWADNTA

SEQ ID NO: 2813673 - protein, 28 aa, Entamoeba invadens
YTSKMARFWFLQRMDWLGAIVSVATVIV

SEQ ID NO: 2813674 - protein, 19 aa, Entamoeba invadens
YTTMLWKEPFPKILFPYAW

SEQ ID NO: 2813675 - protein, 20 aa, Entamoeba invadens
YVAEFARLGGMDVILEKVTK

SEQ ID NO: 2813676 - protein, 25 aa, Entamoeba invadens
YVAFALPKLPGMWVYTWTVTILMWA

SEQ ID NO: 2813677 - protein, 23 aa, Entamoeba invadens
YVEIRLEPKLGFPSTGVSFLPLL

SEQ ID NO: 2813678 - protein, 18 aa, Entamoeba invadens
YVGAGGNVFFAISQVYTS

SEQ ID NO: 2813679 - protein, 17 aa, Entamoeba invadens
YVITFLFSFLFIQALHY

SEQ ID NO: 2813680 - protein, 18 aa, Entamoeba invadens
YVLKDHKCVLCNEVDKTC

SEQ ID NO: 2813681 - protein, 17 aa, Entamoeba invadens
YVSNKCGNWVEQASASS

SEQ ID NO: 2813682 - protein, 18 aa, Entamoeba invadens
YVTLKWLLTKGANPNAEN

SEQ ID NO: 2813683 - protein, 18 aa, Entamoeba invadens
YVVLPYKLKVRMLFDTAR

SEQ ID NO: 2813684 - protein, 20 aa, Entamoeba invadens
YWIPRILFFLLFFVSVEVTF

SEQ ID NO: 2813685 - protein, 22 aa, Entamoeba invadens
YWLMAVCSFVFVAFVVFIIAVL

SEQ ID NO: 2813686 - protein, 19 aa, Entamoeba invadens
YWVESCLFDEAFLKHFKVF

SEQ ID NO: 2813687 - protein, 17 aa, Entamoeba invadens
YWWKNAKLWVMIVICLI

SEQ ID NO: 2813688 - protein, 25 aa, Entamoeba invadens
YYCASRLIDFWGIFICCVVIATAAF

SEQ ID NO: 2813689 - protein, 19 aa, Entamoeba invadens
YYKNLKWVLENSVEDLDMK

SEQ ID NO: 2813690 - protein, 20 aa, Entamoeba invadens
YYKQCGICNGFGIAGSGYPA

SEQ ID NO: 2813691 - protein, 18 aa, Entamoeba invadens
YYLNGEFVFHKKITMAEY

SEQ ID NO: 2813692 - protein, 18 aa, Entamoeba invadens
YYQLFILFFGQLLTSLQV

SEQ ID NO: 2813693 - protein, 17 aa, Entamoeba invadens
YYRVGMDCIKCLSNCSI

SEQ ID NO: 2813694 - protein, 20 aa, Entamoeba invadens
YYSYCPLKLYTNSSFTLNGN

SEQ ID NO: 2813695 - protein, 20 aa, Entamoeba invadens
YYVYGHCMYCVTGGIVNGTC

SEQ ID NO: 2813696 - protein, 17 aa, Entamoeba invadens
YYYPKFQGMESLKLQKD

SEQ ID NO: 2813697 - protein, 25 aa, Entamoeba invadens
DKFRSEYIVHFYGAVFIPNKVCMVT

SEQ ID NO: 2813698 - protein, 19 aa, Entamoeba invadens
YLHENGILHRDIKPDNILV

SEQ ID NO: 2813699 - protein, 23 aa, Entamoeba invadens
GKCLSCISGYVLQPTGECVGCEG

SEQ ID NO: 2813700 - protein, 17 aa, Entamoeba invadens
KFRSEYIVHFYGAVFIP

SEQ ID NO: 2813701 - protein, 18 aa, Entamoeba invadens
LHENGILHRDIKPDNILV

SEQ ID NO: 2813702 - protein, 18 aa, Entamoeba invadens
QRIAIARALIRNPKILLL

SEQ ID NO: 2813703 - protein, 17 aa, Entamoeba invadens
YECLACKDGYFNIPSEG

SEQ ID NO: 2813704 - protein, 24 aa, Entamoeba invadens
ACFQEDFFFRYTILNEDGKNKLVK

SEQ ID NO: 2813705 - protein, 20 aa, Entamoeba invadens
ADYVNNQHICTTCFAPYVTS

SEQ ID NO: 2813706 - protein, 18 aa, Entamoeba invadens
ARGVLYLHENGILHRDIK

SEQ ID NO: 2813707 - protein, 22 aa, Entamoeba invadens
CEFEIFIQPLCTCKIEESVMIT

SEQ ID NO: 2813708 - protein, 27 aa, Entamoeba invadens
CITYEPIAYCLIYNKDHTCKTCNYGYK

SEQ ID NO: 2813709 - protein, 30 aa, Entamoeba invadens
CKDLNSCITCKPEFFLIPSESLVCQNYSSL

SEQ ID NO: 2813710 - protein, 17 aa, Entamoeba invadens
CLRCEDFYFYSSSTNKC

SEQ ID NO: 2813711 - protein, 24 aa, Entamoeba invadens
CTDGVLFRCYGVDGVAAWSDPTEK

SEQ ID NO: 2813712 - protein, 20 aa, Entamoeba invadens
DAKINLLENAYFTIQGPTTK

SEQ ID NO: 2813713 - protein, 25 aa, Entamoeba invadens
DKFRSEYIVHFYGAVFIPNKICMVT

SEQ ID NO: 2813714 - protein, 26 aa, Entamoeba invadens
DKFRSEYIVHFYGAVFIPSKICMVTE

SEQ ID NO: 2813715 - protein, 27 aa, Entamoeba invadens
DYTHCGGKALYRLYAIDKCKKTGTGSV

SEQ ID NO: 2813716 - protein, 26 aa, Entamoeba invadens
ERDTQYYCNIFKWAIDANILAEIKKY

SEQ ID NO: 2813717 - protein, 20 aa, Entamoeba invadens
FTRKCVTCVSGYFVFENKCK

SEQ ID NO: 2813718 - protein, 18 aa, Entamoeba invadens
GCLRCLSGYYLADRMCVK

SEQ ID NO: 2813719 - protein, 32 aa, Entamoeba invadens
ILDNEVVLLIKKPEAFPLMFSTGASVSWPEGT

SEQ ID NO: 2813720 - protein, 22 aa, Entamoeba invadens
KFACEFSIYLTPKCTCQINNKI

SEQ ID NO: 2813721 - protein, 27 aa, Entamoeba invadens
KFRCEYLVHFYGAVFIPNRICMVTEFA

SEQ ID NO: 2813722 - protein, 23 aa, Entamoeba invadens
KFRSEYIVHFYGAVFIPNKVCMV

SEQ ID NO: 2813723 - protein, 23 aa, Entamoeba invadens
KGENLLVFSLNPHSPVCAKLTDF

SEQ ID NO: 2813724 - protein, 23 aa, Entamoeba invadens
KKLGEGSFGIVYKGTYRGNVVAI

SEQ ID NO: 2813725 - protein, 26 aa, Entamoeba invadens
KKPLAQINGLFLSSFEPAKGKVDTLI

SEQ ID NO: 2813726 - protein, 22 aa, Entamoeba invadens
KLGEGSFGIVYKGTYRGNVVAI

SEQ ID NO: 2813727 - protein, 20 aa, Entamoeba invadens
LCRNIINFGIRCEECFPPFV

SEQ ID NO: 2813728 - protein, 17 aa, Entamoeba invadens
LHENGILHRDIKPDNIL

SEQ ID NO: 2813729 - protein, 18 aa, Entamoeba invadens
LPQVSMVIQFFVLGSLGE

SEQ ID NO: 2813730 - protein, 22 aa, Entamoeba invadens
MGKLTGMRLVGWVFPGELFTVT

SEQ ID NO: 2813731 - protein, 24 aa, Entamoeba invadens
MTSAMFFALGFLLCCLWIMGYCRY

SEQ ID NO: 2813732 - protein, 24 aa, Entamoeba invadens
NGCQKCIFGYFPDEKRCSPCDTIP

SEQ ID NO: 2813733 - protein, 17 aa, Entamoeba invadens
PGYACEFEIFIKPLCTC

SEQ ID NO: 2813734 - protein, 24 aa, Entamoeba invadens
RTDSGIFCLLLARAIERDTQYYCN

SEQ ID NO: 2813735 - protein, 18 aa, Entamoeba invadens
SPDFTRKCVTCVSGYFVF

SEQ ID NO: 2813736 - protein, 19 aa, Entamoeba invadens
SSSCLSCKSGKYFVAQNKT

SEQ ID NO: 2813737 - protein, 25 aa, Entamoeba invadens
TAAIKPFHVGSDLELLLLGADNEKF

SEQ ID NO: 2813738 - protein, 17 aa, Entamoeba invadens
TCQICKVNYLMYSTNRC

SEQ ID NO: 2813739 - protein, 33 aa, Entamoeba invadens
VYSFAMTMYEAFTWDFAFKNTDVQFKHAWSIAD

SEQ ID NO: 2813740 - protein, 20 aa, Entamoeba invadens
YIPQVSMVIQFFILGSLGEY

SEQ ID NO: 2813741 - protein, 17 aa, Entamoeba invadens
YNVIPKCQIADYVNNQH

SEQ ID NO: 2813742 - protein, 22 aa, Entamoeba invadens
YSYPVDVYAFGIVLYETYIEKN

SEQ ID NO: 2813743 - protein, 18 aa, Entamoeba invadens
YVVHFYGAVFIPNKICMV

SEQ ID NO: 2813744 - protein, 17 aa, Entamoeba invadens
ALLLYLVISFMTCYIVF

SEQ ID NO: 2813745 - protein, 20 aa, Entamoeba invadens
ALSALLLYGFVAFMSCYLVF

SEQ ID NO: 2813746 - protein, 24 aa, Entamoeba invadens
APSKKRLLKMPKYSIEWGGSVKKD

SEQ ID NO: 2813747 - protein, 53 aa, Entamoeba invadens
ARVVEKFEFPMYMIAVIIIFVLVLAVIVALLIAYVVHVYIVRKRNMKVFEEGE

SEQ ID NO: 2813748 - protein, 19 aa, Entamoeba invadens
ARVWGTMCCLIYVVVFLVF

SEQ ID NO: 2813749 - protein, 19 aa, Entamoeba invadens
ASSSYAILVLFALALILLF

SEQ ID NO: 2813750 - protein, 33 aa, Entamoeba invadens
AVVVALVVALIAVSIGLFKTYQLVSSAMKNVVN

SEQ ID NO: 2813751 - protein, 18 aa, Entamoeba invadens
CDYGYGLNNNKCEKCGTG

SEQ ID NO: 2813752 - protein, 26 aa, Entamoeba invadens
CEDKEDWYITPFANITFLKITVDSTK

SEQ ID NO: 2813753 - protein, 19 aa, Entamoeba invadens
CIEGYFPQNYRCTKCGVTC

SEQ ID NO: 2813754 - protein, 19 aa, Entamoeba invadens
CKPGFWIEDFECVTCETCG

SEQ ID NO: 2813755 - protein, 24 aa, Entamoeba invadens
CNRNGVIRYLLFDTGYAGVTDNTE

SEQ ID NO: 2813756 - protein, 17 aa, Entamoeba invadens
CTSCGNGYFLKDGTCSL

SEQ ID NO: 2813757 - protein, 19 aa, Entamoeba invadens
CVDNCELGFFKKNDTNCDK

SEQ ID NO: 2813758 - protein, 19 aa, Entamoeba invadens
CWCTIPTERIEIGEVVTLV

SEQ ID NO: 2813759 - protein, 18 aa, Entamoeba invadens
CYYNSTFCMSCRSGTFLS

SEQ ID NO: 2813760 - protein, 23 aa, Entamoeba invadens
DAGAAVAFVGAWFCQMPSSWAGS

SEQ ID NO: 2813761 - protein, 27 aa, Entamoeba invadens
DAPKSTGILFIFLTFCFQMIACSSSEC

SEQ ID NO: 2813762 - protein, 25 aa, Entamoeba invadens
DDMEDWYITPLPNMTSLYVKINSPK

SEQ ID NO: 2813763 - protein, 17 aa, Entamoeba invadens
DDSGSFCKTAMRYDIIF

SEQ ID NO: 2813764 - protein, 17 aa, Entamoeba invadens
DELKKERKLGEGSFGIV

SEQ ID NO: 2813765 - protein, 25 aa, Entamoeba invadens
DGTKKQTILFKFNYDYVFGENYGSG

SEQ ID NO: 2813766 - protein, 47 aa, Entamoeba invadens
DGTYCEKRAVWWVILVVVLFIIFVLSILVIVLIFSTKRILKMIHTKE

SEQ ID NO: 2813767 - protein, 28 aa, Entamoeba invadens
DIVFSTHSIFVAFLLLYVGSMAETKKQL

SEQ ID NO: 2813768 - protein, 19 aa, Entamoeba invadens
DKFKFAWCIADFVSNGNRF

SEQ ID NO: 2813769 - protein, 26 aa, Entamoeba invadens
DKFRCDYIIHFYGAVFIPSKVCMVTE

SEQ ID NO: 2813770 - protein, 26 aa, Entamoeba invadens
DKFRNEYIVHFYGAVFIPSHICMVSE

SEQ ID NO: 2813771 - protein, 26 aa, Entamoeba invadens
DKFRSEYIIHFYGAVFIESKVCMVTE

SEQ ID NO: 2813772 - protein, 27 aa, Entamoeba invadens
DKFRSEYIVHFYGAVSIPSKVCMVTEF

SEQ ID NO: 2813773 - protein, 44 aa, Entamoeba invadens
DKKTNYGLVVVLPILCILLLVIILFIIIITTLIVIHRNHKKEQE

SEQ ID NO: 2813774 - protein, 18 aa, Entamoeba invadens
DLSARCSVVLPKAGGCAI

SEQ ID NO: 2813775 - protein, 28 aa, Entamoeba invadens
DSIIHTLNYLYIYGATLLMNSYTKIIGL

SEQ ID NO: 2813776 - protein, 19 aa, Entamoeba invadens
DVIQKCWCTIPTERIEIGE

SEQ ID NO: 2813777 - protein, 17 aa, Entamoeba invadens
DWLGVFICFVTVTVLVI

SEQ ID NO: 2813778 - protein, 39 aa, Entamoeba invadens
DYYEIRTVPSLVSLKPGFACEFEIFIKPLCTCTTKEDVM

SEQ ID NO: 2813779 - protein, 22 aa, Entamoeba invadens
EFEIFITPLCSCIIKEKIVCVG

SEQ ID NO: 2813780 - protein, 18 aa, Entamoeba invadens
EFKYPWKIADFVNNGNRL

SEQ ID NO: 2813781 - protein, 25 aa, Entamoeba invadens
EGCDYYEIRSVPPLVTLKPGYACEF

SEQ ID NO: 2813782 - protein, 21 aa, Entamoeba invadens
EGSFGIVYKGTFRGNVVCIKK

SEQ ID NO: 2813783 - protein, 24 aa, Entamoeba invadens
ESCFTCAFGYYFDTTNNDCIYVGE

SEQ ID NO: 2813784 - protein, 26 aa, Entamoeba invadens
FAGLKPKIMKMKYTKYPYWGTKETFT

SEQ ID NO: 2813785 - protein, 23 aa, Entamoeba invadens
FAITAWELFYQEEPYMHFKSIFE

SEQ ID NO: 2813786 - protein, 23 aa, Entamoeba invadens
FEGKHLFMHFWRKKHPIVEDAKE

SEQ ID NO: 2813787 - protein, 26 aa, Entamoeba invadens
FKINRSNIMFYKVNDWLVVNKEKMLF

SEQ ID NO: 2813788 - protein, 19 aa, Entamoeba invadens
FKSLSAVTELLIPTVTEFG

SEQ ID NO: 2813789 - protein, 17 aa, Entamoeba invadens
FLDSWALLNTAGTDIEL

SEQ ID NO: 2813790 - protein, 17 aa, Entamoeba invadens
FMSCYLVFQSAYYNCYY

SEQ ID NO: 2813791 - protein, 25 aa, Entamoeba invadens
FTTTTFIQDFLFNASLATLPSPLTT

SEQ ID NO: 2813792 - protein, 20 aa, Entamoeba invadens
FVNSYVLCKVPESVYLTFTK

SEQ ID NO: 2813793 - protein, 21 aa, Entamoeba invadens
GCDCYQIGTLPSIVTLKQGKA

SEQ ID NO: 2813794 - protein, 18 aa, Entamoeba invadens
GCITCFNGYYRSDGTCHK

SEQ ID NO: 2813795 - protein, 27 aa, Entamoeba invadens
GDCMDLINYKYHYSDKFDPFNFGYGYP

SEQ ID NO: 2813796 - protein, 22 aa, Entamoeba invadens
GDGFQCIPCQIGTYSNIPGSEK

SEQ ID NO: 2813797 - protein, 39 aa, Entamoeba invadens
GESWNDWSYLQLAGFFFLLEGLFLYNGYLRIAAPFFDYS

SEQ ID NO: 2813798 - protein, 23 aa, Entamoeba invadens
GFKDINYWRKIRADTILSMGLAK

SEQ ID NO: 2813799 - protein, 24 aa, Entamoeba invadens
GGCSLCLSGYFLKDGKCHPLSESN

SEQ ID NO: 2813800 - protein, 21 aa, Entamoeba invadens
GIVYLGEFRGYKVAIKKMKEG

SEQ ID NO: 2813801 - protein, 26 aa, Entamoeba invadens
GSGYPANMLIPLDNPIMGKFVVDTSN

SEQ ID NO: 2813802 - protein, 22 aa, Entamoeba invadens
GVCLTCYSGYQLNASQSCEICR

SEQ ID NO: 2813803 - protein, 17 aa, Entamoeba invadens
GVSIISALCVVIIIAVT

SEQ ID NO: 2813804 - protein, 17 aa, Entamoeba invadens
GYCVNCVIGYGLAAGKC

SEQ ID NO: 2813805 - protein, 17 aa, Entamoeba invadens
HENGILHRDIKPDNILI

SEQ ID NO: 2813806 - protein, 17 aa, Entamoeba invadens
HENGILHRDIKPDNLLV

SEQ ID NO: 2813807 - protein, 17 aa, Entamoeba invadens
HENSILHRDIKPDNILI

SEQ ID NO: 2813808 - protein, 18 aa, Entamoeba invadens
IFLYCFVCFGLIGYLFTR

SEQ ID NO: 2813809 - protein, 29 aa, Entamoeba invadens
IIFSLISLIFFIILTFDTTSHLSKNKINK

SEQ ID NO: 2813810 - protein, 19 aa, Entamoeba invadens
IISALCVVIIIAVTLGVVL

SEQ ID NO: 2813811 - protein, 35 aa, Entamoeba invadens
ILKREWKRFLFMYLMVAIYDLFSIAFPLECQFITK

SEQ ID NO: 2813812 - protein, 21 aa, Entamoeba invadens
ILPSIGLYWCKDKHKIVCVNT

SEQ ID NO: 2813813 - protein, 17 aa, Entamoeba invadens
INSLLSNMTFTKGIGTP

SEQ ID NO: 2813814 - protein, 26 aa, Entamoeba invadens
IPVKKPTSLVFLIGNEKKRKLKFQFT

SEQ ID NO: 2813815 - protein, 34 aa, Entamoeba invadens
IRFEPSIVTIPPKFACEFSLFLSPLCTSTIDSTF

SEQ ID NO: 2813816 - protein, 17 aa, Entamoeba invadens
ISCGAGCKQCIGGQSGK

SEQ ID NO: 2813817 - protein, 29 aa, Entamoeba invadens
ISITNIFPGTKLLLGGKLLRYGTSNKIFC

SEQ ID NO: 2813818 - protein, 38 aa, Entamoeba invadens
IVIGSIAFFVIVLGSFLIIFIFVFRYKKIDINIYKTQQ

SEQ ID NO: 2813819 - protein, 20 aa, Entamoeba invadens
IWGYRALSALLLYGFVAFMS

SEQ ID NO: 2813820 - protein, 24 aa, Entamoeba invadens
KCAICNDNLYVVEDTYKCVAKCDS

SEQ ID NO: 2813821 - protein, 24 aa, Entamoeba invadens
KCKETYYLDLTGKCGLDCPEGSKK

SEQ ID NO: 2813822 - protein, 22 aa, Entamoeba invadens
KCTKCIYPFAIKNGKCDWCGSG

SEQ ID NO: 2813823 - protein, 25 aa, Entamoeba invadens
KEKEDYVVLPYKLKVRMLFDTARGM

SEQ ID NO: 2813824 - protein, 35 aa, Entamoeba invadens
KEVAMLAKFVSPYVIRFYGACFIPNRICMVTELAK

SEQ ID NO: 2813825 - protein, 26 aa, Entamoeba invadens
KFRCEYIVHFYGAVFIPSRICMVTEF

SEQ ID NO: 2813826 - protein, 24 aa, Entamoeba invadens
KFRSEYVVHFYGAVFIPSKVCMVT

SEQ ID NO: 2813827 - protein, 20 aa, Entamoeba invadens
KGCLRCLSGYYLADRMCVKC

SEQ ID NO: 2813828 - protein, 18 aa, Entamoeba invadens
KGILYLHSNGILHRDIKP

SEQ ID NO: 2813829 - protein, 23 aa, Entamoeba invadens
KIPNCIYQIIYSNNTMICKECLP

SEQ ID NO: 2813830 - protein, 18 aa, Entamoeba invadens
KIVKPFIVSIPPQNTPIQ

SEQ ID NO: 2813831 - protein, 20 aa, Entamoeba invadens
KIYGESLLCLPFENMTNCEN

SEQ ID NO: 2813832 - protein, 24 aa, Entamoeba invadens
KKLGEGSFGIVYKGSYRGNVVAIK

SEQ ID NO: 2813833 - protein, 25 aa, Entamoeba invadens
KLRKSLVNEFLLKDLKKKGVEMVYL

SEQ ID NO: 2813834 - protein, 18 aa, Entamoeba invadens
KMCEGCNDGYYLSGESCL

SEQ ID NO: 2813835 - protein, 18 aa, Entamoeba invadens
KPGYACEFEIFIKPLCTC

SEQ ID NO: 2813836 - protein, 20 aa, Entamoeba invadens
KQRIAIARALIRNPKILILD

SEQ ID NO: 2813837 - protein, 25 aa, Entamoeba invadens
KSADIYSFGVTFYETLKWGEAYDKE

SEQ ID NO: 2813838 - protein, 18 aa, Entamoeba invadens
KVDTLIVAAQRDLASKVK

SEQ ID NO: 2813839 - protein, 30 aa, Entamoeba invadens
KVLYLIGWVFPVIWMVQLFFIFSSNQSIKI

SEQ ID NO: 2813840 - protein, 33 aa, Entamoeba invadens
KYRNWEIVFLYFTGFFRAMFFTFTIDVGPMMAV

SEQ ID NO: 2813841 - protein, 30 aa, Entamoeba invadens
LAEIKKYKYPTFFPFFMSYSHTYNGNKYGR

SEQ ID NO: 2813842 - protein, 18 aa, Entamoeba invadens
LAINIVGMILWLALFFAN

SEQ ID NO: 2813843 - protein, 50 aa, Entamoeba invadens
LAKSLDSFLIQYLYIRIQALTIKPVHFNWIVVFIGYFFAIEIQLINQMDT

SEQ ID NO: 2813844 - protein, 19 aa, Entamoeba invadens
LCISPYVLNDTKCELCQPN

SEQ ID NO: 2813845 - protein, 18 aa, Entamoeba invadens
LDGYVKNGMSCISCAAFN

SEQ ID NO: 2813846 - protein, 27 aa, Entamoeba invadens
LDKFRCDYIIHFYGAVFIPSKVCMVTE

SEQ ID NO: 2813847 - protein, 28 aa, Entamoeba invadens
LDKFRSDYIVHFYGAVFIPNKVCMVTEY

SEQ ID NO: 2813848 - protein, 29 aa, Entamoeba invadens
LDKFRSDYLVHFYGAVFIPNKICMVTEFA

SEQ ID NO: 2813849 - protein, 27 aa, Entamoeba invadens
LDKFRSEYIVHFYGAVFIPNKVCMVTE

SEQ ID NO: 2813850 - protein, 18 aa, Entamoeba invadens
LHENGILHRDIKPDNLLV

SEQ ID NO: 2813851 - protein, 25 aa, Entamoeba invadens
LHENNILHRDIKPDNFLVFCIDNSM

SEQ ID NO: 2813852 - protein, 21 aa, Entamoeba invadens
LHRDIKPDNILIFSLDNNERV

SEQ ID NO: 2813853 - protein, 18 aa, Entamoeba invadens
LHSNGILHRDIKPDNILV

SEQ ID NO: 2813854 - protein, 20 aa, Entamoeba invadens
LIFFICELVTGIVIHSLALL

SEQ ID NO: 2813855 - protein, 26 aa, Entamoeba invadens
LKSGYACEFSIYLTPHCTCKIDNTLQ

SEQ ID NO: 2813856 - protein, 18 aa, Entamoeba invadens
LPQVSMVIQFFVLGALGE

SEQ ID NO: 2813857 - protein, 22 aa, Entamoeba invadens
LSNVGLLWIPASIWQMLRGSMT

SEQ ID NO: 2813858 - protein, 17 aa, Entamoeba invadens
LTAEPMRYTLKPGYAIS

SEQ ID NO: 2813859 - protein, 18 aa, Entamoeba invadens
LTSLLDPLTDQKNLMFHG

SEQ ID NO: 2813860 - protein, 25 aa, Entamoeba invadens
MCCLIYVVVFLVFGLGLFQGKICDF

SEQ ID NO: 2813861 - protein, 21 aa, Entamoeba invadens
MERIRCPYIVNFIGSVVTTDT

SEQ ID NO: 2813862 - protein, 29 aa, Entamoeba invadens
MLDKFRSDYIIHFYGACYIPSHVCMVTEF

SEQ ID NO: 2813863 - protein, 23 aa, Entamoeba invadens
MMERIRCPYIVNFIGSVVTTDTL

SEQ ID NO: 2813864 - protein, 34 aa, Entamoeba invadens
MMYECLGWCNAYPKTFFKFPWKIAEFVTSGKRLE

SEQ ID NO: 2813865 - protein, 25 aa, Entamoeba invadens
MPSDLKWLILKCWEYKYLQRITLRE

SEQ ID NO: 2813866 - protein, 17 aa, Entamoeba invadens
NAQCISCGAGCKQCIGG

SEQ ID NO: 2813867 - protein, 19 aa, Entamoeba invadens
NCIEKCPVQYFKPTDKKTC

SEQ ID NO: 2813868 - protein, 21 aa, Entamoeba invadens
NDDAAKSIFAFLALVAIFLMF

SEQ ID NO: 2813869 - protein, 29 aa, Entamoeba invadens
NFEKYPPLTITFPMKLRLKFLIDAAKGIE

SEQ ID NO: 2813870 - protein, 17 aa, Entamoeba invadens
NGANAVFAIMALVVMAF

SEQ ID NO: 2813871 - protein, 22 aa, Entamoeba invadens
NIDGFIIVYSITSKPSFIYACV

SEQ ID NO: 2813872 - protein, 28 aa, Entamoeba invadens
NLCLFLSVLCFILLAILSVSEKRNKRLR

SEQ ID NO: 2813873 - protein, 17 aa, Entamoeba invadens
NMTFTKGVGTPKYMAPE

SEQ ID NO: 2813874 - protein, 21 aa, Entamoeba invadens
NNFCLSCPNGFYLNSQKTCMS

SEQ ID NO: 2813875 - protein, 20 aa, Entamoeba invadens
NNVIFKCKESQYLDNNNSCH

SEQ ID NO: 2813876 - protein, 24 aa, Entamoeba invadens
NRVFKNFLIGQICAFIEIGNSLYR

SEQ ID NO: 2813877 - protein, 23 aa, Entamoeba invadens
NSKYEIYFENNCIEKCPVQYFKP

SEQ ID NO: 2813878 - protein, 35 aa, Entamoeba invadens
NVKYNKIFIILFALGFLFVIPWLVGFIISRKTTNK

SEQ ID NO: 2813879 - protein, 23 aa, Entamoeba invadens
NVPSVTRQIYFGKDAKINLLENA

SEQ ID NO: 2813880 - protein, 29 aa, Entamoeba invadens
NYLDTETCTNCYPSFALDGKVCKKCDTGC

SEQ ID NO: 2813881 - protein, 24 aa, Entamoeba invadens
PAGNYIPSYILSTQTELGFSYILG

SEQ ID NO: 2813882 - protein, 19 aa, Entamoeba invadens
PEILKKNHYKKPADIYSFA

SEQ ID NO: 2813883 - protein, 24 aa, Entamoeba invadens
PKDVPIFIMRVGLGKNFTAENGVK

SEQ ID NO: 2813884 - protein, 25 aa, Entamoeba invadens
PKDVPIFIMRVGLGKNFTAENGVKF

SEQ ID NO: 2813885 - protein, 17 aa, Entamoeba invadens
PLKTDKWELTFGLQKAK

SEQ ID NO: 2813886 - protein, 20 aa, Entamoeba invadens
PNFVFFPFASNCAKKGYGCY

SEQ ID NO: 2813887 - protein, 17 aa, Entamoeba invadens
QLLLIGVSSEKCEAGYY

SEQ ID NO: 2813888 - protein, 19 aa, Entamoeba invadens
QLRQNCVVELIGAVYTEGE

SEQ ID NO: 2813889 - protein, 18 aa, Entamoeba invadens
QMSFVKIVKPFIVSIPPQ

SEQ ID NO: 2813890 - protein, 22 aa, Entamoeba invadens
QNQLYLRTYVTPAFGFGTIAVK

SEQ ID NO: 2813891 - protein, 31 aa, Entamoeba invadens
QYWCSQCNSGYFPYYYNCVPCGYMEGCTSCS

SEQ ID NO: 2813892 - protein, 34 aa, Entamoeba invadens
RATNLVFLMFGLGFLLLFPWLVAFIISRKTKNKA

SEQ ID NO: 2813893 - protein, 23 aa, Entamoeba invadens
RCEYIVHFYGAVLIPSKMCLVTE

SEQ ID NO: 2813894 - protein, 26 aa, Entamoeba invadens
RDTKEDFLRLPYKLKVRMLFDTARGM

SEQ ID NO: 2813895 - protein, 24 aa, Entamoeba invadens
RFKRRFFIVIGSIIAIILLPFVSY

SEQ ID NO: 2813896 - protein, 18 aa, Entamoeba invadens
RFKYPWDIIDFVNKGNRI

SEQ ID NO: 2813897 - protein, 19 aa, Entamoeba invadens
RKCELCSSGKYPKPSENYK

SEQ ID NO: 2813898 - protein, 26 aa, Entamoeba invadens
RKDKRDYIKLPYKLKVRMLFDTTRGM

SEQ ID NO: 2813899 - protein, 19 aa, Entamoeba invadens
RKLGEGSFGIVYKGAYRGN

SEQ ID NO: 2813900 - protein, 24 aa, Entamoeba invadens
RQCQTCSTGFYPLQTSPYTCQQCH

SEQ ID NO: 2813901 - protein, 23 aa, Entamoeba invadens
RSIRDIPILFTKSVLISSLTSTS

SEQ ID NO: 2813902 - protein, 25 aa, Entamoeba invadens
RSRNKYMMVIFHTPNTPKYVFHFDP

SEQ ID NO: 2813903 - protein, 18 aa, Entamoeba invadens
RTYTLPYNITTRLNFTAA

SEQ ID NO: 2813904 - protein, 48 aa, Entamoeba invadens
SCSKTNWALIIPLVVVGVIIIVLIFIAIIAIIWWRRAKSVKAETAAIK

SEQ ID NO: 2813905 - protein, 23 aa, Entamoeba invadens
SCVTCAFGYYFDTTSNDCIYVGE

SEQ ID NO: 2813906 - protein, 17 aa, Entamoeba invadens
SCYLVFQSAYYNCYYDR

SEQ ID NO: 2813907 - protein, 37 aa, Entamoeba invadens
SEPDASRRMLLLVSWLLSGFYLMPTGIKKPYNPVLGE

SEQ ID NO: 2813908 - protein, 17 aa, Entamoeba invadens
SFGIVYKGSFRGNIVAI

SEQ ID NO: 2813909 - protein, 17 aa, Entamoeba invadens
SFMGYYVGKWVYVPLVV

SEQ ID NO: 2813910 - protein, 27 aa, Entamoeba invadens
SGCTALESINLYSPLTSLLDPLTDQKN

SEQ ID NO: 2813911 - protein, 26 aa, Entamoeba invadens
SGCTLCEFGYFIYQNECQKCKDNCTS

SEQ ID NO: 2813912 - protein, 21 aa, Entamoeba invadens
SGKTIKCNIGYFIKSNKCENC

SEQ ID NO: 2813913 - protein, 22 aa, Entamoeba invadens
SIKVFYVKYIAAELTQRAPVFF

SEQ ID NO: 2813914 - protein, 19 aa, Entamoeba invadens
SKCLSCIDGFYLTKEGTCS

SEQ ID NO: 2813915 - protein, 35 aa, Entamoeba invadens
SLNVEGKFDFCLPIPPSLYPNCKRLAFSTSKCVEC

SEQ ID NO: 2813916 - protein, 29 aa, Entamoeba invadens
SLYLTKMAKYWMLQRMDWLGVFICFVTVT

SEQ ID NO: 2813917 - protein, 23 aa, Entamoeba invadens
SNTTFSLHIFSSLTLEGNAKLFA

SEQ ID NO: 2813918 - protein, 24 aa, Entamoeba invadens
SPDFTRKCVTCVSGYFVFENKCKK

SEQ ID NO: 2813919 - protein, 20 aa, Entamoeba invadens
SRKCIQCNIGFYPNASGICV

SEQ ID NO: 2813920 - protein, 42 aa, Entamoeba invadens
SSCETQAVWWFIVLVLLFVFFVVFVVIVALYFTVKKMIAHKL

SEQ ID NO: 2813921 - protein, 22 aa, Entamoeba invadens
SSKKIFCHLYNFDLTTQKMMFF

SEQ ID NO: 2813922 - protein, 26 aa, Entamoeba invadens
SSTPLFNKLLGGKLYRSYLNSNNVDT

SEQ ID NO: 2813923 - protein, 20 aa, Entamoeba invadens
STIDSTFVVSYLFTTSDGTS

SEQ ID NO: 2813924 - protein, 23 aa, Entamoeba invadens
STIDSTFVVSYLFTTSDSTTCAY

SEQ ID NO: 2813925 - protein, 25 aa, Entamoeba invadens
TCEPLGDLFTKCELTLPTGGGCAIC

SEQ ID NO: 2813926 - protein, 24 aa, Entamoeba invadens
TEDTHLCYATCPATYYTSTADNMC

SEQ ID NO: 2813927 - protein, 18 aa, Entamoeba invadens
TEFAKFGSFLDLIKKRRN

SEQ ID NO: 2813928 - protein, 20 aa, Entamoeba invadens
TELKPIMPPIGEGAFGMVFR

SEQ ID NO: 2813929 - protein, 19 aa, Entamoeba invadens
TFLSKIVIFTITFDANYSL

SEQ ID NO: 2813930 - protein, 19 aa, Entamoeba invadens
TFVCVRCFAPYAVSTNSKS

SEQ ID NO: 2813931 - protein, 27 aa, Entamoeba invadens
TGIASPPMFIVLYSFMGYYVGKWVYVP

SEQ ID NO: 2813932 - protein, 40 aa, Entamoeba invadens
TICKASIYLVILVLVIAIIFVCLYIFVSKPIIELQRLEGI

SEQ ID NO: 2813933 - protein, 29 aa, Entamoeba invadens
TICLFICGFFFVLLWPFAFIASRKSRNQS

SEQ ID NO: 2813934 - protein, 27 aa, Entamoeba invadens
TIGIYYYPTCMPTFLSKIVIFTITFDA

SEQ ID NO: 2813935 - protein, 21 aa, Entamoeba invadens
TIRILNYSTFVVKNIFEMIAG

SEQ ID NO: 2813936 - protein, 22 aa, Entamoeba invadens
TQRAFAQIYIVRNIWQAQNANL

SEQ ID NO: 2813937 - protein, 22 aa, Entamoeba invadens
TSLLASVVFFKCNMSDITFNKV

SEQ ID NO: 2813938 - protein, 17 aa, Entamoeba invadens
TTKYELFNSIWAEQSVQ

SEQ ID NO: 2813939 - protein, 23 aa, Entamoeba invadens
TTYCTTCRSGFYLSADMSCKSLG

SEQ ID NO: 2813940 - protein, 26 aa, Entamoeba invadens
TVLDGYILIINNLQYSFPVKISGNVQ

SEQ ID NO: 2813941 - protein, 19 aa, Entamoeba invadens
TYCTSCESGFYLDSKNRCQ

SEQ ID NO: 2813942 - protein, 19 aa, Entamoeba invadens
TYCVKCKIGLVLRSGVCSE

SEQ ID NO: 2813943 - protein, 19 aa, Entamoeba invadens
VCTKCDVGFYFNGNSCSEC

SEQ ID NO: 2813944 - protein, 18 aa, Entamoeba invadens
VDSYYLKEGKCYKLTDSN

SEQ ID NO: 2813945 - protein, 25 aa, Entamoeba invadens
VDVKLRIKFLFDAAKGIFYLHENGV

SEQ ID NO: 2813946 - protein, 23 aa, Entamoeba invadens
VIRNQIVYMCETGKYLTVDNKCQ

SEQ ID NO: 2813947 - protein, 23 aa, Entamoeba invadens
VKCDYPCVYCSNRTFCTKCDDYS

SEQ ID NO: 2813948 - protein, 24 aa, Entamoeba invadens
VLCDQLQLVTCEKGYFIKKNRCVG

SEQ ID NO: 2813949 - protein, 17 aa, Entamoeba invadens
VLEGCDHYEIRTVPTLI

SEQ ID NO: 2813950 - protein, 17 aa, Entamoeba invadens
YDGYFMNGKMCDTCSAG

SEQ ID NO: 2813951 - protein, 24 aa, Entamoeba invadens
YDKNHLYFCTRFPGSSPSIGEIVN

SEQ ID NO: 2813952 - protein, 37 aa, Entamoeba invadens
YECFTWTNAYPKEQFKFPWTIAEFVIKGLRLPKPDEM

SEQ ID NO: 2813953 - protein, 17 aa, Entamoeba invadens
YHNITCGGFTLIVDEKW

SEQ ID NO: 2813954 - protein, 22 aa, Entamoeba invadens
YSDKFDPFNFGYGYPQSEEFMA

SEQ ID NO: 2813955 - protein, 25 aa, Entamoeba invadens
YSKNKYMMVIFHTPNNPKYVFHFEP

SEQ ID NO: 2813956 - protein, 18 aa, Entamoeba invadens
YYTTSWGACVPCDRHISG

SEQ ID NO: 2813957 - protein, 32 aa, Entamoeba invadens
YYVGKWVYVPLVVLAFFLIVNLCYGRVNTFFY

SEQ ID NO: 2813958 - protein, 21 aa, Entamoeba invadens
AAADLKFLTLTATKLSCNKDQ

SEQ ID NO: 2813959 - protein, 19 aa, Entamoeba invadens
AAAIPLPIVKKLLGNYIVI

SEQ ID NO: 2813960 - protein, 24 aa, Entamoeba invadens
AAAIPREFVIDSMTVDFAKSGYVD

SEQ ID NO: 2813961 - protein, 29 aa, Entamoeba invadens
AAALGIPVLLPFLKAVCWSKKSWYARHTG

SEQ ID NO: 2813962 - protein, 18 aa, Entamoeba invadens
AACDFFNIAIKTENEISL

SEQ ID NO: 2813963 - protein, 46 aa, Entamoeba invadens
AADVYSFAITMYEIFGWCEAYPNDTFKFPWKIAEFVIHGNRLKRKD

SEQ ID NO: 2813964 - protein, 25 aa, Entamoeba invadens
AADVYSFGITMYEVFGWSEAYQNDT

SEQ ID NO: 2813965 - protein, 25 aa, Entamoeba invadens
AADVYSFGVTMYETFKWGEAYDKER

SEQ ID NO: 2813966 - protein, 30 aa, Entamoeba invadens
AADVYSLAVTLFETLIWGEAYTGDEFKFPW

SEQ ID NO: 2813967 - protein, 24 aa, Entamoeba invadens
AAELIKRKINLKKTIYLPENFFEN

SEQ ID NO: 2813968 - protein, 28 aa, Entamoeba invadens
AAELLFLLLHHMSKIHHFLFCGISNFCS

SEQ ID NO: 2813969 - protein, 26 aa, Entamoeba invadens
AAGAIFLVFAVTVWYFSARDPDIFLV

SEQ ID NO: 2813970 - protein, 22 aa, Entamoeba invadens
AAGFYLLFVIGCGIWSGIQIFK

SEQ ID NO: 2813971 - protein, 29 aa, Entamoeba invadens
AAGTVSVCYYLFIRKGYFCLVKNNKKIPN

SEQ ID NO: 2813972 - protein, 43 aa, Entamoeba invadens
AAIGVPLSIVFVIIVLIAIIIVIVYLLFMRHKEKEKLQNICVF

SEQ ID NO: 2813973 - protein, 27 aa, Entamoeba invadens
AAIPFTVLLFFFFLSIFLNVLLTMEKT

SEQ ID NO: 2813974 - protein, 27 aa, Entamoeba invadens
AAKCIVCEDLFTNNYYLADGKGHCKDY

SEQ ID NO: 2813975 - protein, 23 aa, Entamoeba invadens
AAKRKPFLFKNMRVALSMRSIKL

SEQ ID NO: 2813976 - protein, 23 aa, Entamoeba invadens
AAKVLFRLYGLCIMFIALWILLY

SEQ ID NO: 2813977 - protein, 18 aa, Entamoeba invadens
AALGKTNVFRIRFGDTGN

SEQ ID NO: 2813978 - protein, 28 aa, Entamoeba invadens
AALIDFAFVLLFFHWKFFNIACLLPFFV

SEQ ID NO: 2813979 - protein, 25 aa, Entamoeba invadens
AALLSGFFILLFYIIAATCAEIDNY

SEQ ID NO: 2813980 - protein, 18 aa, Entamoeba invadens
AALRWIRDMGILKEYNEI

SEQ ID NO: 2813981 - protein, 31 aa, Entamoeba invadens
AALTNAFLDILISSFGYSMKYLKSKGATKTV

SEQ ID NO: 2813982 - protein, 19 aa, Entamoeba invadens
AARILLMIDPAFGGTEETF

SEQ ID NO: 2813983 - protein, 18 aa, Entamoeba invadens
AASSLLCGSALLFSVLLV

SEQ ID NO: 2813984 - protein, 26 aa, Entamoeba invadens
AATGYFDMIFFYDSGNVKKYSVCAKN

SEQ ID NO: 2813985 - protein, 36 aa, Entamoeba invadens
AAVILDRMFEMATLIPINLYQPFLEKFLSAVEVRPQ

SEQ ID NO: 2813986 - protein, 24 aa, Entamoeba invadens
AAVKPVFVKLNKITKLSLVACSDV

SEQ ID NO: 2813987 - protein, 34 aa, Entamoeba invadens
AAVVVALIVALIAVSIGLFKTYQLVSSAMKNVVN

SEQ ID NO: 2813988 - protein, 28 aa, Entamoeba invadens
AAVVVILFIIVILTILIVKKVIYQKVRV

SEQ ID NO: 2813989 - protein, 17 aa, Entamoeba invadens
ACCLLAYLPPALLIIIF

SEQ ID NO: 2813990 - protein, 20 aa, Entamoeba invadens
ACDGTYYSLGGFSTSCDYDQ

SEQ ID NO: 2813991 - protein, 37 aa, Entamoeba invadens
ACDTKAVWWMLLIVIVISILVVILIVAVVIVKTNHII

SEQ ID NO: 2813992 - protein, 23 aa, Entamoeba invadens
ACEFEIFIKPLCSCKIKENVLVI

SEQ ID NO: 2813993 - protein, 20 aa, Entamoeba invadens
ACEFEIFIRPNYTCKITDDA

SEQ ID NO: 2813994 - protein, 18 aa, Entamoeba invadens
ACEFEVFLTPHCTLTLED

SEQ ID NO: 2813995 - protein, 19 aa, Entamoeba invadens
ACEFEVFLTPHCTLTLEDK

SEQ ID NO: 2813996 - protein, 20 aa, Entamoeba invadens
ACEFSIYIKPLCTCVIKNKI

SEQ ID NO: 2813997 - protein, 20 aa, Entamoeba invadens
ACEFSIYLTPKCTCQINNKI

SEQ ID NO: 2813998 - protein, 21 aa, Entamoeba invadens
ACEFSIYVKPLCSCKINSTIH

SEQ ID NO: 2813999 - protein, 37 aa, Entamoeba invadens
ACEFSLAITPLCTCSIQNPIKIIFVDLKTGKEKTVQI

SEQ ID NO: 2814000 - protein, 23 aa, Entamoeba invadens
ACEFSMYLTPLCTCQIISSIQIV

SEQ ID NO: 2814001 - protein, 20 aa, Entamoeba invadens
ACEFSVNIKPLCSCKINSTI

SEQ ID NO: 2814002 - protein, 20 aa, Entamoeba invadens
ACEIELFITPHCTCTIEDTI

SEQ ID NO: 2814003 - protein, 18 aa, Entamoeba invadens
ACELLCPHSFDVLRSLFS

SEQ ID NO: 2814004 - protein, 17 aa, Entamoeba invadens
ACIGLIGIIAKGSADTG

SEQ ID NO: 2814005 - protein, 20 aa, Entamoeba invadens
ACKDGFFMDDTKTKCITCDR

SEQ ID NO: 2814006 - protein, 26 aa, Entamoeba invadens
ACKMTKYWFLQRSDWIGALISIVTVI

SEQ ID NO: 2814007 - protein, 17 aa, Entamoeba invadens
ACNLGYTTTTYYNTDDH

SEQ ID NO: 2814008 - protein, 24 aa, Entamoeba invadens
ACNSSTFCFYTKSQSYTTRNGELI

SEQ ID NO: 2814009 - protein, 20 aa, Entamoeba invadens
ACSLCFSGFKKVGGECTSCA

SEQ ID NO: 2814010 - protein, 29 aa, Entamoeba invadens
ACVILFVVLLFFTYFIGAFWLIGINIVLY

SEQ ID NO: 2814011 - protein, 17 aa, Entamoeba invadens
ACVTCQFGYYLSSNICM

SEQ ID NO: 2814012 - protein, 25 aa, Entamoeba invadens
ACWNKLQLLVLTRKTEKFENDEFEK

SEQ ID NO: 2814013 - protein, 17 aa, Entamoeba invadens
ACYTCNDGYYYSGSSTC

SEQ ID NO: 2814014 - protein, 17 aa, Entamoeba invadens
ACYVHEKMMFLHTSSRT

SEQ ID NO: 2814015 - protein, 19 aa, Entamoeba invadens
ACYVHENMMFLHKASRTVN

SEQ ID NO: 2814016 - protein, 25 aa, Entamoeba invadens
ADAMPLCVDAFMGNAYITSFVYEGT

SEQ ID NO: 2814017 - protein, 53 aa, Entamoeba invadens
ADCTRLSYSLRNFLFWGIGCIAYLLLYLLLLFLIVILYIKLTGKIKKELDDEK

SEQ ID NO: 2814018 - protein, 53 aa, Entamoeba invadens
ADCTRLSYSLRNFLFWGIGCIVYLLLYLMLLFLINILYVKLTQKIKKELDDEK

SEQ ID NO: 2814019 - protein, 36 aa, Entamoeba invadens
ADEFQKTQIFGLRAIFLCFFFILNEVSYEQKQQYIK

SEQ ID NO: 2814020 - protein, 18 aa, Entamoeba invadens
ADGFYSLAGYSKCIQCFS

SEQ ID NO: 2814021 - protein, 49 aa, Entamoeba invadens
ADGSYCVTKAVWWVIFIIVLIVVLLLIILLIVIVVIIKMILDKLHKREV

SEQ ID NO: 2814022 - protein, 21 aa, Entamoeba invadens
ADGVLCCNVSYIVVPLECGNT

SEQ ID NO: 2814023 - protein, 18 aa, Entamoeba invadens
ADIFSFAITLYECVKWGE

SEQ ID NO: 2814024 - protein, 21 aa, Entamoeba invadens
ADIFSFGVTMYETFGWCEAYD

SEQ ID NO: 2814025 - protein, 43 aa, Entamoeba invadens
ADIFSFSILMYECFVWDKAYPTSQFKFPWNIAEFIIQGNRLTQ

SEQ ID NO: 2814026 - protein, 25 aa, Entamoeba invadens
ADIQELLLRWMFSTQSATFVVKSAF

SEQ ID NO: 2814027 - protein, 33 aa, Entamoeba invadens
ADIQQHATLLWRLVDIFFTIPVTYSFGVTCTYL

SEQ ID NO: 2814028 - protein, 25 aa, Entamoeba invadens
ADITQFILNKVCTLSLSLFKTIQGK

SEQ ID NO: 2814029 - protein, 34 aa, Entamoeba invadens
ADIYSFAITMYECFIWGVAFPKSEFQYSWNIVDF

SEQ ID NO: 2814030 - protein, 34 aa, Entamoeba invadens
ADIYSFAITMYECFIWGVAYPKNEFKYSWNIVNF

SEQ ID NO: 2814031 - protein, 17 aa, Entamoeba invadens
ADIYSFGITMFETFSWS

SEQ ID NO: 2814032 - protein, 27 aa, Entamoeba invadens
ADKFVFADILMYFNKTKFMIIQDETEV

SEQ ID NO: 2814033 - protein, 25 aa, Entamoeba invadens
ADKMKVKIILDATKGILYLHENGIL

SEQ ID NO: 2814034 - protein, 25 aa, Entamoeba invadens
ADKMKVKIILDATYGVKYLHENGIL

SEQ ID NO: 2814035 - protein, 18 aa, Entamoeba invadens
ADLHIYVTVNYTASTFGS

SEQ ID NO: 2814036 - protein, 27 aa, Entamoeba invadens
ADLLECTDLLWFIANQTNFGILSISKL

SEQ ID NO: 2814037 - protein, 24 aa, Entamoeba invadens
ADLPYLFVVLFSIGDCLFACVLFS

SEQ ID NO: 2814038 - protein, 24 aa, Entamoeba invadens
ADLSRIHLFDLTGGFVRFKDCQSL

SEQ ID NO: 2814039 - protein, 25 aa, Entamoeba invadens
ADNCLTCAFGYYYDDTTSDCLYVGE

SEQ ID NO: 2814040 - protein, 26 aa, Entamoeba invadens
ADNTWLTPCIFTISSNRNIHHLPLLF

SEQ ID NO: 2814041 - protein, 17 aa, Entamoeba invadens
ADRSVLKCYGCESPYVI

SEQ ID NO: 2814042 - protein, 21 aa, Entamoeba invadens
ADRVLLLMPGIHINNFVELTE

SEQ ID NO: 2814043 - protein, 21 aa, Entamoeba invadens
ADTCLLCGLGYHLNGKDQCEK

SEQ ID NO: 2814044 - protein, 28 aa, Entamoeba invadens
ADTRTKPYPCLYLLNSSRINGSSFLFGD

SEQ ID NO: 2814045 - protein, 22 aa, Entamoeba invadens
ADVELHCKYYSLNKTKCIECQD

SEQ ID NO: 2814046 - protein, 42 aa, Entamoeba invadens
ADVFSFAITMLECFLWCDAYPKEQFRFPWNIADYVTSGKRIN

SEQ ID NO: 2814047 - protein, 31 aa, Entamoeba invadens
ADVFSFAITMLECFLWSNAYPKSVYMYPWTI

SEQ ID NO: 2814048 - protein, 42 aa, Entamoeba invadens
ADVFSFGVTMFEVFGWCKAYPLDTFKFPWKIAEFVISGKRLE

SEQ ID NO: 2814049 - protein, 24 aa, Entamoeba invadens
ADVFSLAVTFYEALVWGEVYPKSE

SEQ ID NO: 2814050 - protein, 36 aa, Entamoeba invadens
ADVFSLAVTFYETLVWGEIYPSSMFKHAWSIADFVS

SEQ ID NO: 2814051 - protein, 32 aa, Entamoeba invadens
ADVYSFAITMFEIFIWGEAYPGDRFKYPWDII

SEQ ID NO: 2814052 - protein, 18 aa, Entamoeba invadens
ADVYSFAITMYECFGWTD

SEQ ID NO: 2814053 - protein, 44 aa, Entamoeba invadens
ADVYSFAITMYETFSWFEAYRKDQFKFPWKIAEFINQENRLPRI

SEQ ID NO: 2814054 - protein, 28 aa, Entamoeba invadens
ADVYSFGITMFECFKWGDSYPKSEFKFP

SEQ ID NO: 2814055 - protein, 21 aa, Entamoeba invadens
ADWIFEVRWTFALLIVLVIQN

SEQ ID NO: 2814056 - protein, 24 aa, Entamoeba invadens
ADWWFVACFVGVFFSVVFLCFHII

SEQ ID NO: 2814057 - protein, 26 aa, Entamoeba invadens
ADYSIPAFRFLVKLLLVHGRYFYRQN

SEQ ID NO: 2814058 - protein, 20 aa, Entamoeba invadens
ADYVNNQHICTACFAPYVTS

SEQ ID NO: 2814059 - protein, 18 aa, Entamoeba invadens
AEAQFKHPPVPRKPVEGE

SEQ ID NO: 2814060 - protein, 18 aa, Entamoeba invadens
AEDEPCYYLITTTAANIY

SEQ ID NO: 2814061 - protein, 20 aa, Entamoeba invadens
AEDLMLFEDGTLYEGFEILN

SEQ ID NO: 2814062 - protein, 18 aa, Entamoeba invadens
AEFGSLCDLIKKCRKNIK

SEQ ID NO: 2814063 - protein, 36 aa, Entamoeba invadens
AEGFLCCLFMFIGIVALLIRKLILFAPALVSQFPQN

SEQ ID NO: 2814064 - protein, 40 aa, Entamoeba invadens
AEGIYHGKFIFPYDYPKNPPEVYFLTPSGRFVVNQKICLS

SEQ ID NO: 2814065 - protein, 17 aa, Entamoeba invadens
AEGQFIMKTMCGLYNVG

SEQ ID NO: 2814066 - protein, 34 aa, Entamoeba invadens
AEGYFAYPVCFQTRMYKCILFTLEYDGNYSLLID

SEQ ID NO: 2814067 - protein, 22 aa, Entamoeba invadens
AEHLMHRYIIVSKTGHAFTKNF

SEQ ID NO: 2814068 - protein, 36 aa, Entamoeba invadens
AEIAKYIQSFKYKTWFPFYNLYSHSWNGNKYGRVFH

SEQ ID NO: 2814069 - protein, 19 aa, Entamoeba invadens
AEICVLCNNLLFGENCEKG

SEQ ID NO: 2814070 - protein, 20 aa, Entamoeba invadens
AEIDIKLRKKFLLDGALGIS

SEQ ID NO: 2814071 - protein, 25 aa, Entamoeba invadens
AEIPGYFPYYYNYIVVQSAAVEYFV

SEQ ID NO: 2814072 - protein, 23 aa, Entamoeba invadens
AEKFLYIRGSLTGLGIAVAMFIM

SEQ ID NO: 2814073 - protein, 25 aa, Entamoeba invadens
AEKSPKLSPLFKTPSPTLNTQVVEA

SEQ ID NO: 2814074 - protein, 20 aa, Entamoeba invadens
AELEKVIFDKLLYSFDEQTS

SEQ ID NO: 2814075 - protein, 31 aa, Entamoeba invadens
AELIPSQDFFPLFWQTLLPMLQVNDTGVACS

SEQ ID NO: 2814076 - protein, 29 aa, Entamoeba invadens
AELKIDLALMLNLYRPLMKYGEAAIKMAQ

SEQ ID NO: 2814077 - protein, 27 aa, Entamoeba invadens
AELVKFVFAFVLALLKMVTKLEHFVLG

SEQ ID NO: 2814078 - protein, 30 aa, Entamoeba invadens
AENIYSTLTFFGVFAEFIIGFTIAAEQEER

SEQ ID NO: 2814079 - protein, 23 aa, Entamoeba invadens
AEQTLKINQLIEEKEKNEKGGEE

SEQ ID NO: 2814080 - protein, 27 aa, Entamoeba invadens
AERNPTTTAYLRLVSKRGTLNLNSSKI

SEQ ID NO: 2814081 - protein, 18 aa, Entamoeba invadens
AESLKYIGLSGPAGTLSY

SEQ ID NO: 2814082 - protein, 23 aa, Entamoeba invadens
AESNYLHKPIGGIFMTNRMCVVY

SEQ ID NO: 2814083 - protein, 36 aa, Entamoeba invadens
AESTLFDAFYILRSEDWYMHLLMTPLGISTCALLTQ

SEQ ID NO: 2814084 - protein, 23 aa, Entamoeba invadens
AETAPYMLKIEDTKLFIKSGTPV

SEQ ID NO: 2814085 - protein, 29 aa, Entamoeba invadens
AETGILKVFFIFLLTLFIVPVPPCLDIRG

SEQ ID NO: 2814086 - protein, 21 aa, Entamoeba invadens
AEVWVSTLITWVGSNEVIFPK

SEQ ID NO: 2814087 - protein, 23 aa, Entamoeba invadens
AEYLYRLAVFLDNKRYVTQQNKM

SEQ ID NO: 2814088 - protein, 27 aa, Entamoeba invadens
AFAPYEWQHLLIPFLPVKLTELTQTPT

SEQ ID NO: 2814089 - protein, 23 aa, Entamoeba invadens
AFCAFFLYIGLMLSAGEKMLTRM

SEQ ID NO: 2814090 - protein, 28 aa, Entamoeba invadens
AFCFMNGTNFVPWYDRGMTDYPFTAPNC

SEQ ID NO: 2814091 - protein, 19 aa, Entamoeba invadens
AFCYIKLECFKAAITDAEK

SEQ ID NO: 2814092 - protein, 23 aa, Entamoeba invadens
AFDNKVPELLKFMITECWKPEPS

SEQ ID NO: 2814093 - protein, 17 aa, Entamoeba invadens
AFELLLQHNCRTGLELT

SEQ ID NO: 2814094 - protein, 22 aa, Entamoeba invadens
AFFLILAVTFLSKITHAVCFEQ

SEQ ID NO: 2814095 - protein, 18 aa, Entamoeba invadens
AFGHWVLSQHLLDYYERF

SEQ ID NO: 2814096 - protein, 20 aa, Entamoeba invadens
AFGIVLYETYIEKNAFENDE

SEQ ID NO: 2814097 - protein, 17 aa, Entamoeba invadens
AFGIVLYETYIEKNAYE

SEQ ID NO: 2814098 - protein, 18 aa, Entamoeba invadens
AFGIVLYETYIEKNAYEN

SEQ ID NO: 2814099 - protein, 32 aa, Entamoeba invadens
AFGTNFCVVLIIVIVFLAATFYLVTHYIKFQT

SEQ ID NO: 2814100 - protein, 28 aa, Entamoeba invadens
AFIFVFSGIVFYLKYVFGNHLLVTRKEA

SEQ ID NO: 2814101 - protein, 17 aa, Entamoeba invadens
AFISDMVFLGIEKFLQK

SEQ ID NO: 2814102 - protein, 26 aa, Entamoeba invadens
AFKATGFGTFPFPKGSMTSIGDLAFQ

SEQ ID NO: 2814103 - protein, 22 aa, Entamoeba invadens
AFKPFIVVPWTFVSEIIVALPL

SEQ ID NO: 2814104 - protein, 17 aa, Entamoeba invadens
AFKVGMTFTYFAPLVFV

SEQ ID NO: 2814105 - protein, 20 aa, Entamoeba invadens
AFLFRLQYIMNDKGDSILSC

SEQ ID NO: 2814106 - protein, 25 aa, Entamoeba invadens
AFLHTLRLHWIEFQNKFYVGDGVAF

SEQ ID NO: 2814107 - protein, 22 aa, Entamoeba invadens
AFLIVLVILNYVKVQVIVNLMN

SEQ ID NO: 2814108 - protein, 21 aa, Entamoeba invadens
AFLMEIPITLFLRYLPDNPRL

SEQ ID NO: 2814109 - protein, 21 aa, Entamoeba invadens
AFLNTTFITIYPLLMIASVGH

SEQ ID NO: 2814110 - protein, 20 aa, Entamoeba invadens
AFMLMSDFLLNRGPSLDGAC

SEQ ID NO: 2814111 - protein, 26 aa, Entamoeba invadens
AFNVKIIMLLMIIFVKLLRIYKLEKM

SEQ ID NO: 2814112 - protein, 21 aa, Entamoeba invadens
AFPSIFIVAKLFRLEHKTTRV

SEQ ID NO: 2814113 - protein, 17 aa, Entamoeba invadens
AFSAFLFWPAAVGTVGK

SEQ ID NO: 2814114 - protein, 21 aa, Entamoeba invadens
AFSIVALLLALVATGYQFSLF

SEQ ID NO: 2814115 - protein, 17 aa, Entamoeba invadens
AFSLPLTPNAFLAQEPL

SEQ ID NO: 2814116 - protein, 17 aa, Entamoeba invadens
AFSLPQQLTIPASVSGE

SEQ ID NO: 2814117 - protein, 17 aa, Entamoeba invadens
AFSVLLLLSITLLLINH

SEQ ID NO: 2814118 - protein, 24 aa, Entamoeba invadens
AFTHLLVGIFFYMYVIFDTLDGKQ

SEQ ID NO: 2814119 - protein, 23 aa, Entamoeba invadens
AFTICVVVLYFALFVASDFMGYH

SEQ ID NO: 2814120 - protein, 25 aa, Entamoeba invadens
AFVFSLLFIYLIKVMTRLFIILFGV

SEQ ID NO: 2814121 - protein, 21 aa, Entamoeba invadens
AFVLLSYFVSLLLSFGISLVC

SEQ ID NO: 2814122 - protein, 25 aa, Entamoeba invadens
AFVQKFLTLYRFAAIFLMVFTSFIS

SEQ ID NO: 2814123 - protein, 18 aa, Entamoeba invadens
AFWAFSAFLFWPAAVGTV

SEQ ID NO: 2814124 - protein, 19 aa, Entamoeba invadens
AFYDINEWLVSNKKTLVFV

SEQ ID NO: 2814125 - protein, 22 aa, Entamoeba invadens
AFYLTLLLLVFISIATFSILIN

SEQ ID NO: 2814126 - protein, 24 aa, Entamoeba invadens
AGAIFPFYTLKFIDAYMCLMSITG

SEQ ID NO: 2814127 - protein, 23 aa, Entamoeba invadens
AGAKIILDLPKTLEYLETSGVSV

SEQ ID NO: 2814128 - protein, 20 aa, Entamoeba invadens
AGCCLVIIPLAFITKFTLFG

SEQ ID NO: 2814129 - protein, 20 aa, Entamoeba invadens
AGCIYLYKTFGIVHRDLKPQ

SEQ ID NO: 2814130 - protein, 20 aa, Entamoeba invadens
AGCWFFVDIAFYGNSMFNST

SEQ ID NO: 2814131 - protein, 18 aa, Entamoeba invadens
AGDLNPAFYIFVSVKGNE

SEQ ID NO: 2814132 - protein, 23 aa, Entamoeba invadens
AGDVFSFAVLSWELFYAKEPYKD

SEQ ID NO: 2814133 - protein, 22 aa, Entamoeba invadens
AGESLVLKLTLKESAKRDATLM

SEQ ID NO: 2814134 - protein, 30 aa, Entamoeba invadens
AGEVDVTIWRPPKVLIFHLKRFEFTEKFER

SEQ ID NO: 2814135 - protein, 38 aa, Entamoeba invadens
AGFGLCVLGTLLLFIFLFVGIWIVLFLAKLDIPKDNWK

SEQ ID NO: 2814136 - protein, 17 aa, Entamoeba invadens
AGFLIVLVPIKVASKCK

SEQ ID NO: 2814137 - protein, 23 aa, Entamoeba invadens
AGFLLNNYAMIVSGALIGSSGAI

SEQ ID NO: 2814138 - protein, 21 aa, Entamoeba invadens
AGFPAFLLLYVNTIPLFFYHT

SEQ ID NO: 2814139 - protein, 23 aa, Entamoeba invadens
AGFYKIINFSFISVALLVLTGVM

SEQ ID NO: 2814140 - protein, 18 aa, Entamoeba invadens
AGGKFAVEITRLIIKENM

SEQ ID NO: 2814141 - protein, 18 aa, Entamoeba invadens
AGIIRYIPRNWKFMQIWN

SEQ ID NO: 2814142 - protein, 21 aa, Entamoeba invadens
AGKLAIVIFSVLCGTLGLSQI

SEQ ID NO: 2814143 - protein, 29 aa, Entamoeba invadens
AGLASWEIVLIVVVPLVSVILISVIAVVI

SEQ ID NO: 2814144 - protein, 25 aa, Entamoeba invadens
AGLKPKIMKMKYTKYPYWGTKESFT

SEQ ID NO: 2814145 - protein, 25 aa, Entamoeba invadens
AGLLLDHLPVLLLHHQKFAGALEEY

SEQ ID NO: 2814146 - protein, 17 aa, Entamoeba invadens
AGLMSASIGLLILVLLL

SEQ ID NO: 2814147 - protein, 23 aa, Entamoeba invadens
AGLSTFLPLFRILRKQPMELFRE

SEQ ID NO: 2814148 - protein, 27 aa, Entamoeba invadens
AGMLLLLFLIYLFGIVGPLFEIIFINM

SEQ ID NO: 2814149 - protein, 26 aa, Entamoeba invadens
AGNILNNLVYIVLSLVLSGFQQIYDK

SEQ ID NO: 2814150 - protein, 25 aa, Entamoeba invadens
AGNLLYLAIELFSPALYDSCVESLR

SEQ ID NO: 2814151 - protein, 21 aa, Entamoeba invadens
AGNYIPSYILSTQTELGFSYI

SEQ ID NO: 2814152 - protein, 31 aa, Entamoeba invadens
AGRCRKLSRWYIYVIVAAVVVILFIIVILTI

SEQ ID NO: 2814153 - protein, 26 aa, Entamoeba invadens
AGRSYRTLSQYPIYPWVISSYDSADL

SEQ ID NO: 2814154 - protein, 24 aa, Entamoeba invadens
AGRVLIPVTLYADAGIVTQAKSVD

SEQ ID NO: 2814155 - protein, 27 aa, Entamoeba invadens
AGRVRRRLYRKIMYQDAGWFDRSENSV

SEQ ID NO: 2814156 - protein, 26 aa, Entamoeba invadens
AGSGYSAYWLIPLENPIMGKYVVDTT

SEQ ID NO: 2814157 - protein, 31 aa, Entamoeba invadens
AGSVKPFFRTLPFQPLITFVAMHSGLYTQVS

SEQ ID NO: 2814158 - protein, 21 aa, Entamoeba invadens
AGTKLLLNGRLLRYGTSNKIF

SEQ ID NO: 2814159 - protein, 24 aa, Entamoeba invadens
AGTLALIFFIICIVKINFGYVRRQ

SEQ ID NO: 2814160 - protein, 22 aa, Entamoeba invadens
AGTQLLMDGKLLRYGNSKKIFC

SEQ ID NO: 2814161 - protein, 25 aa, Entamoeba invadens
AGTTLFFYVMSIITALWVLENMARS

SEQ ID NO: 2814162 - protein, 24 aa, Entamoeba invadens
AGVEKFMYFFKNAFDIYENIVEST

SEQ ID NO: 2814163 - protein, 23 aa, Entamoeba invadens
AGVKKWTLAVYNDAACTDQTSTP

SEQ ID NO: 2814164 - protein, 17 aa, Entamoeba invadens
AGVMIYVSFVDVLYGGI

SEQ ID NO: 2814165 - protein, 30 aa, Entamoeba invadens
AGVVIVSVILFLIIFFGLTHKKIDIDTFKH

SEQ ID NO: 2814166 - protein, 48 aa, Entamoeba invadens
AGVYPLSILILVFSGIWPYTKLIFLLFSWFTPASILKPSIRGGILSVL

SEQ ID NO: 2814167 - protein, 26 aa, Entamoeba invadens
AGWSRLIFTFFMPAIVFYQTATAISE

SEQ ID NO: 2814168 - protein, 31 aa, Entamoeba invadens
AGYNTDGVLLPLPVIYCRSGVYNRTSKLCES

SEQ ID NO: 2814169 - protein, 20 aa, Entamoeba invadens
AGYVAVYRFTVNDITLVMSE

SEQ ID NO: 2814170 - protein, 23 aa, Entamoeba invadens
AHAYLIATTLSRLLRLHKDILSI

SEQ ID NO: 2814171 - protein, 17 aa, Entamoeba invadens
AHFKLSQTNITWSHVDG

SEQ ID NO: 2814172 - protein, 17 aa, Entamoeba invadens
AHHMHLLTLIRLKMKKE

SEQ ID NO: 2814173 - protein, 19 aa, Entamoeba invadens
AHISVVCGNILFLSNTPDD

SEQ ID NO: 2814174 - protein, 34 aa, Entamoeba invadens
AHNMSALGCLLCCLFTWMGCCCIGLIFCCIPTFA

SEQ ID NO: 2814175 - protein, 20 aa, Entamoeba invadens
AHPVLKTKYYLKVDFAMIFH

SEQ ID NO: 2814176 - protein, 22 aa, Entamoeba invadens
AHTPLFALYFLSNEVKKDLING

SEQ ID NO: 2814177 - protein, 25 aa, Entamoeba invadens
AHVGGPERYYAFPGLLTCLYSDVTV

SEQ ID NO: 2814178 - protein, 19 aa, Entamoeba invadens
AHWVLYAILELIISKFNVL

SEQ ID NO: 2814179 - protein, 33 aa, Entamoeba invadens
AIAFSVSALIVPLIKPLYLIESVLIVIACVQWS

SEQ ID NO: 2814180 - protein, 22 aa, Entamoeba invadens
AIASLIFFAFEKENLYVRAHAL

SEQ ID NO: 2814181 - protein, 17 aa, Entamoeba invadens
AIATKMFSLLRSKPNAK

SEQ ID NO: 2814182 - protein, 27 aa, Entamoeba invadens
AICDNITFSFYLKGQSRLIIYESYVDF

SEQ ID NO: 2814183 - protein, 20 aa, Entamoeba invadens
AICKDGYYYDQKFCYKCDKS

SEQ ID NO: 2814184 - protein, 17 aa, Entamoeba invadens
AICMLEIWVGRDVYPSD

SEQ ID NO: 2814185 - protein, 20 aa, Entamoeba invadens
AICYKCNTGYYLENNTCIIE

SEQ ID NO: 2814186 - protein, 36 aa, Entamoeba invadens
AIDAPYPIMQWVLRSIVLVCFFALSITFFFVRLLQN

SEQ ID NO: 2814187 - protein, 18 aa, Entamoeba invadens
AIDIPLFCILGASFGLST

SEQ ID NO: 2814188 - protein, 20 aa, Entamoeba invadens
AIEAIRSPQLHFTWMCELSQ

SEQ ID NO: 2814189 - protein, 27 aa, Entamoeba invadens
AIEKYKPTILFSTPRVFEKLNRIAKQK

SEQ ID NO: 2814190 - protein, 19 aa, Entamoeba invadens
AIEMFKWLIEMYYKEEKYN

SEQ ID NO: 2814191 - protein, 18 aa, Entamoeba invadens
AIEWGYYDDAYLTLVRQH

SEQ ID NO: 2814192 - protein, 26 aa, Entamoeba invadens
AIFAGKKYIQPFLDANLQTIAHEDID

SEQ ID NO: 2814193 - protein, 27 aa, Entamoeba invadens
AIFMPFTLSFFLVFYSVISAAILGLIS

SEQ ID NO: 2814194 - protein, 23 aa, Entamoeba invadens
AIFPPFILTMFSSSLKIIFDVSG

SEQ ID NO: 2814195 - protein, 20 aa, Entamoeba invadens
AIFSDLRDVFYFTDVFRTFN

SEQ ID NO: 2814196 - protein, 33 aa, Entamoeba invadens
AIFSIFVVYIGPLSIIMLWPRIEKLGDPNFRKL

SEQ ID NO: 2814197 - protein, 20 aa, Entamoeba invadens
AIFTSLLMPLTDLKQLSKLV

SEQ ID NO: 2814198 - protein, 21 aa, Entamoeba invadens
AIGAGRFLLVRVYLAESFVVI

SEQ ID NO: 2814199 - protein, 23 aa, Entamoeba invadens
AIGEAFFFVWENFYYLLVPLMVS

SEQ ID NO: 2814200 - protein, 24 aa, Entamoeba invadens
AIGKDVFYIVYKDATTQLYCLASL

SEQ ID NO: 2814201 - protein, 43 aa, Entamoeba invadens
AIGLPVVFVVLIIILIALTIVGMYFLYLHFREEKKMINVCVFK

SEQ ID NO: 2814202 - protein, 25 aa, Entamoeba invadens
AIGSVLYATLLLDPEWRHIEILKNN

SEQ ID NO: 2814203 - protein, 35 aa, Entamoeba invadens
AIGVPVAVTIVLLLLIISIIIVVIVLVQRKKLEKK

SEQ ID NO: 2814204 - protein, 28 aa, Entamoeba invadens
AIHLKTENMTFLHLMRWAKYVGKNGESA

SEQ ID NO: 2814205 - protein, 20 aa, Entamoeba invadens
AIILGCVMVFYFVKNGYVLA

SEQ ID NO: 2814206 - protein, 29 aa, Entamoeba invadens
AIIVAALFVGFLIVCALLLTVVVIIRKIL

SEQ ID NO: 2814207 - protein, 22 aa, Entamoeba invadens
AIIVIAIIIVIIILATTLKKKS

SEQ ID NO: 2814208 - protein, 25 aa, Entamoeba invadens
AIIVTFVIFVLLQFGLLACICMHTP

SEQ ID NO: 2814209 - protein, 17 aa, Entamoeba invadens
AIKIFITTLSATKSHLQ

SEQ ID NO: 2814210 - protein, 21 aa, Entamoeba invadens
AIKNPRLFCGIFEEFLRNSAE

SEQ ID NO: 2814211 - protein, 21 aa, Entamoeba invadens
AILFFLPFMSFLSGIKIVKQF

SEQ ID NO: 2814212 - protein, 62 aa, Entamoeba invadens
AILGSTLSVLFVIIVVVIILLIVFFWFVEKKLQKHRLTTVTLFKIKYSNLTFVPLSDTSPLE

SEQ ID NO: 2814213 - protein, 21 aa, Entamoeba invadens
AILMNTLKFLDAPIPLDLNIQ

SEQ ID NO: 2814214 - protein, 17 aa, Entamoeba invadens
AILSDILPKYTTVTDAI

SEQ ID NO: 2814215 - protein, 49 aa, Entamoeba invadens
AILYTDWMWYNIFVEMLQTPYFYLLVILITFLLTAKDLLWKHFKKSILP

SEQ ID NO: 2814216 - protein, 17 aa, Entamoeba invadens
AIMIFFFINVITMNYIL

SEQ ID NO: 2814217 - protein, 20 aa, Entamoeba invadens
AINRIQKRKIIKKLIIILVK

SEQ ID NO: 2814218 - protein, 29 aa, Entamoeba invadens
AIPTIVPILLVTPLDLDLVWRVASALGAV

SEQ ID NO: 2814219 - protein, 20 aa, Entamoeba invadens
AISKFHVYLNLQVESALSTK

SEQ ID NO: 2814220 - protein, 38 aa, Entamoeba invadens
AISMYECFGWEDVFPKSMFPFPWKIAEFVINGRRLEKK

SEQ ID NO: 2814221 - protein, 27 aa, Entamoeba invadens
AISVYWALPIPLFILSLFYSTEAIVDF

SEQ ID NO: 2814222 - protein, 24 aa, Entamoeba invadens
AITETFFYYFDIKRKSAKSMKHKQ

SEQ ID NO: 2814223 - protein, 17 aa, Entamoeba invadens
AITMFECFSWKDAYPIT

SEQ ID NO: 2814224 - protein, 17 aa, Entamoeba invadens
AITMFETISWREAYPKS

SEQ ID NO: 2814225 - protein, 34 aa, Entamoeba invadens
AITMLECFAWDNPFPKTIYLFAWSIADEISVGKR

SEQ ID NO: 2814226 - protein, 26 aa, Entamoeba invadens
AITMYECFTWSDAFPKDVYKYAWDIA

SEQ ID NO: 2814227 - protein, 17 aa, Entamoeba invadens
AITMYETFIWGDAFPQN

SEQ ID NO: 2814228 - protein, 26 aa, Entamoeba invadens
AIVGVLLVIFLFKFFEYSIQMSNNYS

SEQ ID NO: 2814229 - protein, 23 aa, Entamoeba invadens
AIVIPWMIYYYTVLARKLDVGEQ

SEQ ID NO: 2814230 - protein, 18 aa, Entamoeba invadens
AIVLFLFKIVRYGVSDMI

SEQ ID NO: 2814231 - protein, 40 aa, Entamoeba invadens
AIVLSLFSVYFAVTGRFPFLWIFFVLAAICFWMSHQFSPN

SEQ ID NO: 2814232 - protein, 27 aa, Entamoeba invadens
AIVLWELVTEKFPFKQFNFFSVVREKV

SEQ ID NO: 2814233 - protein, 20 aa, Entamoeba invadens
AIVSLFVMKLKEHQKRFKTL

SEQ ID NO: 2814234 - protein, 23 aa, Entamoeba invadens
AIVTAFLELNKIYRFRVVCSNPE

SEQ ID NO: 2814235 - protein, 35 aa, Entamoeba invadens
AIYQNQYWCSQCNPGYFPYYYNCVPCGYMEGCTSC

SEQ ID NO: 2814236 - protein, 30 aa, Entamoeba invadens
AIYTSKMARFWFLQRMDWLGAIVSVATVIV

SEQ ID NO: 2814237 - protein, 20 aa, Entamoeba invadens
AKARAGLIKGFTGIDDPYEA

SEQ ID NO: 2814238 - protein, 23 aa, Entamoeba invadens
AKCLTCLSGYYLKGSTCDVCNNV

SEQ ID NO: 2814239 - protein, 20 aa, Entamoeba invadens
AKCLTCSSGYYLKGSTCDVC

SEQ ID NO: 2814240 - protein, 18 aa, Entamoeba invadens
AKCNECYPPYTLSSNGKS

SEQ ID NO: 2814241 - protein, 18 aa, Entamoeba invadens
AKCNECYPPYTLSSNSKS

SEQ ID NO: 2814242 - protein, 18 aa, Entamoeba invadens
AKCNNCYPPYTLSSNGKS

SEQ ID NO: 2814243 - protein, 21 aa, Entamoeba invadens
AKDILFTVQFKGDYYILIDST

SEQ ID NO: 2814244 - protein, 26 aa, Entamoeba invadens
AKDKYLYYFFASIPTYTKKMSFSILI

SEQ ID NO: 2814245 - protein, 20 aa, Entamoeba invadens
AKEVAYYKSRIWKCSKHYSN

SEQ ID NO: 2814246 - protein, 24 aa, Entamoeba invadens
AKFRRIHILCHGIGGMFLLKCFSA

SEQ ID NO: 2814247 - protein, 31 aa, Entamoeba invadens
AKFTNWYLRLLVPQWRLFLFSAASGLMELTC

SEQ ID NO: 2814248 - protein, 38 aa, Entamoeba invadens
AKGDKISLKTIYFAFFVSFFVTYNVMRVITQISSLGNK

SEQ ID NO: 2814249 - protein, 19 aa, Entamoeba invadens
AKGILYLHENDILHRDIKP

SEQ ID NO: 2814250 - protein, 18 aa, Entamoeba invadens
AKGILYLHENGILHRDIK

SEQ ID NO: 2814251 - protein, 19 aa, Entamoeba invadens
AKGILYLHENGILHRDIKP

SEQ ID NO: 2814252 - protein, 19 aa, Entamoeba invadens
AKGILYLHSNGILHRDIKP

SEQ ID NO: 2814253 - protein, 38 aa, Entamoeba invadens
AKIIIRLKIMIDAFKGILIIIMLLTNMTFTKGIGTPKY

SEQ ID NO: 2814254 - protein, 25 aa, Entamoeba invadens
AKIQLQYFWFAEDAQLYADAYDLAE

SEQ ID NO: 2814255 - protein, 24 aa, Entamoeba invadens
AKITWRHQLMLWYAGLRGAIAIIL

SEQ ID NO: 2814256 - protein, 23 aa, Entamoeba invadens
AKKTVFSKVLFPLVSSLGNAQHE

SEQ ID NO: 2814257 - protein, 21 aa, Entamoeba invadens
AKLRLFVFPVYIIPAGAVAIN

SEQ ID NO: 2814258 - protein, 25 aa, Entamoeba invadens
AKLSYPKTLRKMEFSFCNDLSVVDD

SEQ ID NO: 2814259 - protein, 25 aa, Entamoeba invadens
AKMVNILPYILIKHIDKIPLYDTKG

SEQ ID NO: 2814260 - protein, 31 aa, Entamoeba invadens
AKNRSTFTINFMYDIAFSLGFFFNSVLSKKS

SEQ ID NO: 2814261 - protein, 36 aa, Entamoeba invadens
AKPMLIAVLPRLIYDVTLFIPIFAQSVMINFGTKWN

SEQ ID NO: 2814262 - protein, 18 aa, Entamoeba invadens
AKRKLLLKFDEYLRVITV

SEQ ID NO: 2814263 - protein, 23 aa, Entamoeba invadens
AKSDLFNILTAPVPVAAPVQPTQ

SEQ ID NO: 2814264 - protein, 36 aa, Entamoeba invadens
AKSSLDKKFWFYDPNGYPFFLLGTDHINFAAGYDWV

SEQ ID NO: 2814265 - protein, 19 aa, Entamoeba invadens
AKTKFFITISRFGNMQFTN

SEQ ID NO: 2814266 - protein, 18 aa, Entamoeba invadens
AKTVTALITILCTTKIRG

SEQ ID NO: 2814267 - protein, 26 aa, Entamoeba invadens
AKVYPLAILIMLFSGVWPYAKLAVLL

SEQ ID NO: 2814268 - protein, 25 aa, Entamoeba invadens
AKYALLYIIVMRLQRKTNVLVLSFL

SEQ ID NO: 2814269 - protein, 24 aa, Entamoeba invadens
AKYGSLQHLIFNTKTRKVPREAVR

SEQ ID NO: 2814270 - protein, 17 aa, Entamoeba invadens
ALAFFGLAVVFLMVCLM

SEQ ID NO: 2814271 - protein, 17 aa, Entamoeba invadens
ALAFNDLVEVATTLGFE

SEQ ID NO: 2814272 - protein, 32 aa, Entamoeba invadens
ALALYDKLLFTTQPLTLFLMASIMLINQEVLV

SEQ ID NO: 2814273 - protein, 26 aa, Entamoeba invadens
ALCTKLFTIYEIILSDGLNGDLKLIT

SEQ ID NO: 2814274 - protein, 20 aa, Entamoeba invadens
ALCYDGFALINSLCVSCSDL

SEQ ID NO: 2814275 - protein, 27 aa, Entamoeba invadens
ALDMYIGIVFFFYFLAQTVVMVGMSLT

SEQ ID NO: 2814276 - protein, 23 aa, Entamoeba invadens
ALEKKLLELKRYKKAKIHCARNA

SEQ ID NO: 2814277 - protein, 25 aa, Entamoeba invadens
ALEMSYCFLALYPLSVFHYINTTLL

SEQ ID NO: 2814278 - protein, 17 aa, Entamoeba invadens
ALFCAKQLHTIVHQSFV

SEQ ID NO: 2814279 - protein, 19 aa, Entamoeba invadens
ALFNKITIPTTNTLVINKL

SEQ ID NO: 2814280 - protein, 17 aa, Entamoeba invadens
ALGFMQPVLPQTNEYIV

SEQ ID NO: 2814281 - protein, 30 aa, Entamoeba invadens
ALGGGLVMQFFMLGYIDALVYLLEINPTTP

SEQ ID NO: 2814282 - protein, 26 aa, Entamoeba invadens
ALGLFVVTILIFLCYDRVKNILIKLL

SEQ ID NO: 2814283 - protein, 26 aa, Entamoeba invadens
ALGVLLIDGDWKYYLDPSLSLVVACV

SEQ ID NO: 2814284 - protein, 24 aa, Entamoeba invadens
ALGYVLPIIWMVQLFFIFSRNVNV

SEQ ID NO: 2814285 - protein, 19 aa, Entamoeba invadens
ALHLIVNDKFLWVNVDEEK

SEQ ID NO: 2814286 - protein, 22 aa, Entamoeba invadens
ALHQLNIPFYLNGLLKEINPTF

SEQ ID NO: 2814287 - protein, 22 aa, Entamoeba invadens
ALHYVIDYCPGGELYALMQSSK

SEQ ID NO: 2814288 - protein, 32 aa, Entamoeba invadens
ALISSILLVVFLLFLCLSAFYQTEWAISVLEY

SEQ ID NO: 2814289 - protein, 26 aa, Entamoeba invadens
ALIVLGIFCLLIAGALTLLIKRFFEG

SEQ ID NO: 2814290 - protein, 26 aa, Entamoeba invadens
ALKCDPLLFYDYLLINAQKIGKNSQI

SEQ ID NO: 2814291 - protein, 26 aa, Entamoeba invadens
ALKDKYFTCQPLPLLPEKFVNSLVII

SEQ ID NO: 2814292 - protein, 21 aa, Entamoeba invadens
ALKRFFMISTNYDEKLINEST

SEQ ID NO: 2814293 - protein, 22 aa, Entamoeba invadens
ALKVNKADTLIALAGLQGKLDK

SEQ ID NO: 2814294 - protein, 31 aa, Entamoeba invadens
ALLELTERFVMYYIFIFEVEGMNVVMYNNSH

SEQ ID NO: 2814295 - protein, 41 aa, Entamoeba invadens
ALLFDEFCYTKEPFYLISIVSFLFRYDNIVSLGLENPRILL

SEQ ID NO: 2814296 - protein, 27 aa, Entamoeba invadens
ALLILSLVVYVFYLLAVFITTKYSREL

SEQ ID NO: 2814297 - protein, 21 aa, Entamoeba invadens
ALLIYGLIFFNNPFCFLEYMT

SEQ ID NO: 2814298 - protein, 20 aa, Entamoeba invadens
ALLKIKHERLLKSMKQRDIG

SEQ ID NO: 2814299 - protein, 27 aa, Entamoeba invadens
ALLNRFDVLQKEKLSWWLAERQTETGG

SEQ ID NO: 2814300 - protein, 17 aa, Entamoeba invadens
ALLPFVCSEACVGFLLV

SEQ ID NO: 2814301 - protein, 18 aa, Entamoeba invadens
ALLPLFAALLSESFGVFS

SEQ ID NO: 2814302 - protein, 24 aa, Entamoeba invadens
ALLQTICFVIFAALAPFGGKISDL

SEQ ID NO: 2814303 - protein, 36 aa, Entamoeba invadens
ALLYAFGYIFPVVWIFQLFLIFNPAPQTKLWGYRAL

SEQ ID NO: 2814304 - protein, 18 aa, Entamoeba invadens
ALMELEGLFYKLVKNQEM

SEQ ID NO: 2814305 - protein, 19 aa, Entamoeba invadens
ALMFLVMYLADWRKNNAEQ

SEQ ID NO: 2814306 - protein, 20 aa, Entamoeba invadens
ALMFPTCAGIYRYLPKTWKF

SEQ ID NO: 2814307 - protein, 18 aa, Entamoeba invadens
ALNEFLTNIFKLFAGRPR

SEQ ID NO: 2814308 - protein, 31 aa, Entamoeba invadens
ALNKMFLKMTFMRLFSLPYKLSALQQTVFIK

SEQ ID NO: 2814309 - protein, 28 aa, Entamoeba invadens
ALNKNYILTPILYPNCEYPLMYNKTNHS

SEQ ID NO: 2814310 - protein, 26 aa, Entamoeba invadens
ALNKTFLKECGITHILSVAPYQPMYP

SEQ ID NO: 2814311 - protein, 24 aa, Entamoeba invadens
ALNNSVGYFCNHPFWVVNGFLKSH

SEQ ID NO: 2814312 - protein, 25 aa, Entamoeba invadens
ALPAFGEFMLFIGYGMEKNGKTIED

SEQ ID NO: 2814313 - protein, 32 aa, Entamoeba invadens
ALPISCVLFLLLIIIVLIILIFVLIIKKKEIE

SEQ ID NO: 2814314 - protein, 18 aa, Entamoeba invadens
ALPLIRARCIEVVQHFVL

SEQ ID NO: 2814315 - protein, 32 aa, Entamoeba invadens
ALQGSFPFMWGFFMVSSLCFWTSFQFAPRGKF

SEQ ID NO: 2814316 - protein, 29 aa, Entamoeba invadens
ALQNIMLFYLFFALFVFILTSILAFGMVW

SEQ ID NO: 2814317 - protein, 23 aa, Entamoeba invadens
ALRDIFVLCSVGEYRRFALCRNI

SEQ ID NO: 2814318 - protein, 17 aa, Entamoeba invadens
ALRKYKLVNQKKIEDLK

SEQ ID NO: 2814319 - protein, 23 aa, Entamoeba invadens
ALRQRLPFCLTSRDQYVCAAPAA

SEQ ID NO: 2814320 - protein, 24 aa, Entamoeba invadens
ALRVRTGIFMFLCYAFVGLQTDIF

SEQ ID NO: 2814321 - protein, 26 aa, Entamoeba invadens
ALSKFIQFILFGWNLMHILFAYPEVR

SEQ ID NO: 2814322 - protein, 18 aa, Entamoeba invadens
ALSQYTCTTAETLDFPTA

SEQ ID NO: 2814323 - protein, 21 aa, Entamoeba invadens
ALSSFYKFDLADDAHVLLSTC

SEQ ID NO: 2814324 - protein, 20 aa, Entamoeba invadens
ALSVFWNFPRACYTGFVFNF

SEQ ID NO: 2814325 - protein, 19 aa, Entamoeba invadens
ALTAWMVVQIVIGILCIII

SEQ ID NO: 2814326 - protein, 24 aa, Entamoeba invadens
ALTEYWIEFFIFPELKTNPYIYIT

SEQ ID NO: 2814327 - protein, 30 aa, Entamoeba invadens
ALTGITIPSIHLYPSLVTLNDDLSSFTNIF

SEQ ID NO: 2814328 - protein, 29 aa, Entamoeba invadens
ALTVLLYVLTFLCGYLPTHKIVPDPLDPL

SEQ ID NO: 2814329 - protein, 23 aa, Entamoeba invadens
ALTVLMCTIFSREWIKVSGSASV

SEQ ID NO: 2814330 - protein, 18 aa, Entamoeba invadens
ALVFFIWNNTQKCLPKQV

SEQ ID NO: 2814331 - protein, 18 aa, Entamoeba invadens
ALVGLLADKFVFADILMY

SEQ ID NO: 2814332 - protein, 24 aa, Entamoeba invadens
ALVKMFVLILYGFSRDIAIHRYTF

SEQ ID NO: 2814333 - protein, 25 aa, Entamoeba invadens
ALVLFKGIYFWISAPLGILLFKHED

SEQ ID NO: 2814334 - protein, 37 aa, Entamoeba invadens
ALVLNSLLVQLFFWVFYILAFFFPQIIIKTTPPDTFF

SEQ ID NO: 2814335 - protein, 25 aa, Entamoeba invadens
ALVRLMFQSIPTNIVWFAFTTEPQM

SEQ ID NO: 2814336 - protein, 35 aa, Entamoeba invadens
ALVVSLVIVFIVIFIIIVVVIISAIIWKKRREQKQ

SEQ ID NO: 2814337 - protein, 20 aa, Entamoeba invadens
ALYVVFLCIFAPFKFQNEST

SEQ ID NO: 2814338 - protein, 18 aa, Entamoeba invadens
AMAITFKMKVLCTTSICD

SEQ ID NO: 2814339 - protein, 18 aa, Entamoeba invadens
AMCFLIYGNMYFMYNCLF

SEQ ID NO: 2814340 - protein, 29 aa, Entamoeba invadens
AMCSVIIVVVLVVLYIRRRKECSIDKYKS

SEQ ID NO: 2814341 - protein, 25 aa, Entamoeba invadens
AMDPWMLFFSFLCCAGIGMLGTCLY

SEQ ID NO: 2814342 - protein, 17 aa, Entamoeba invadens
AMKIGYFGMGGGALVFV

SEQ ID NO: 2814343 - protein, 21 aa, Entamoeba invadens
AMKVISLLLHLMTTLKNAEDE

SEQ ID NO: 2814344 - protein, 21 aa, Entamoeba invadens
AMKYCYLFEMTKGGLTCLMCD

SEQ ID NO: 2814345 - protein, 17 aa, Entamoeba invadens
AMLAAVGVAIVSLAIHF

SEQ ID NO: 2814346 - protein, 28 aa, Entamoeba invadens
AMLDKFRCEYIVAFYGAVFIPSKVCMVT

SEQ ID NO: 2814347 - protein, 26 aa, Entamoeba invadens
AMLTSPLWFLLFAIYGMGSIFPLIAI

SEQ ID NO: 2814348 - protein, 22 aa, Entamoeba invadens
AMNDRFCLIIEDGKVLITNRIG

SEQ ID NO: 2814349 - protein, 28 aa, Entamoeba invadens
AMPRAQMVLLLFHFPPIWCIGDMERFKQ

SEQ ID NO: 2814350 - protein, 39 aa, Entamoeba invadens
AMQTNLENLYYPLVSFFQSYSFSILTNFLSTLKKNIIDL

SEQ ID NO: 2814351 - protein, 22 aa, Entamoeba invadens
AMSIPLIFAWTKTSTQPASKLL

SEQ ID NO: 2814352 - protein, 24 aa, Entamoeba invadens
AMTMFECFRWKDAYDKIEFKYPWK

SEQ ID NO: 2814353 - protein, 28 aa, Entamoeba invadens
ANAIGFSLLIITFFFSLSLSKISGFLLS

SEQ ID NO: 2814354 - protein, 34 aa, Entamoeba invadens
ANALGPIVIAVLAVLIATLLFFVCQKRGNNNFNN

SEQ ID NO: 2814355 - protein, 18 aa, Entamoeba invadens
ANAYILVVLFFNLSGMTI

SEQ ID NO: 2814356 - protein, 24 aa, Entamoeba invadens
ANDAALLVVSLYKTVLSWVNAEMV

SEQ ID NO: 2814357 - protein, 17 aa, Entamoeba invadens
ANDFIHFGGTLLSSVYL

SEQ ID NO: 2814358 - protein, 24 aa, Entamoeba invadens
ANDQTFVIFFSFIPKMEDKTMNLH

SEQ ID NO: 2814359 - protein, 20 aa, Entamoeba invadens
ANEELIRIMKVSSSIIATHE

SEQ ID NO: 2814360 - protein, 19 aa, Entamoeba invadens
ANFDQKVFFMFVSGIFSIV

SEQ ID NO: 2814361 - protein, 25 aa, Entamoeba invadens
ANFFVYLLAFFYLPTPSKKLWNKAK

SEQ ID NO: 2814362 - protein, 20 aa, Entamoeba invadens
ANFWDFNCSTLKLTNVIGNI

SEQ ID NO: 2814363 - protein, 18 aa, Entamoeba invadens
ANGLLYLHTNGIVHRDIK

SEQ ID NO: 2814364 - protein, 53 aa, Entamoeba invadens
ANGTFCKIKAVWWMIIVIVVVCILLIILITTILFIIIKIVIKNIIMKKREKTT

SEQ ID NO: 2814365 - protein, 22 aa, Entamoeba invadens
ANIFIADVMLAFYLYNGWSDQL

SEQ ID NO: 2814366 - protein, 28 aa, Entamoeba invadens
ANIMYSLVLFLISIVIFALYVLIELRFV

SEQ ID NO: 2814367 - protein, 22 aa, Entamoeba invadens
ANINTLLFVGNAINPTGVTISC

SEQ ID NO: 2814368 - protein, 33 aa, Entamoeba invadens
ANKHLSFIDLCRTLYFVIPNLSVPHIPMQQLFG

SEQ ID NO: 2814369 - protein, 31 aa, Entamoeba invadens
ANKNNYFIDNIYYLLPFTFDIDENKTLRLLP

SEQ ID NO: 2814370 - protein, 24 aa, Entamoeba invadens
ANKPSVFLYMCKDSKIAIYDENLK

SEQ ID NO: 2814371 - protein, 29 aa, Entamoeba invadens
ANKYIGFFIVLFAIRFILTRGRLVVLRRY

SEQ ID NO: 2814372 - protein, 26 aa, Entamoeba invadens
ANKYIIELLILYMSLLDNYQKFEATI

SEQ ID NO: 2814373 - protein, 19 aa, Entamoeba invadens
ANKYTLFRVWIFTIKDYFF

SEQ ID NO: 2814374 - protein, 26 aa, Entamoeba invadens
ANLESGCWLLFVAVVLYTIVTIAMMQ

SEQ ID NO: 2814375 - protein, 49 aa, Entamoeba invadens
ANNFGQWLYKNIFFTVGIVIIFLFIVNLFIYIIAKRIVYRRAKQIARNL

SEQ ID NO: 2814376 - protein, 20 aa, Entamoeba invadens
ANNYPNEIFILTANKLTTND

SEQ ID NO: 2814377 - protein, 23 aa, Entamoeba invadens
ANPNLLLRAELLSFVTNFPVVVD

SEQ ID NO: 2814378 - protein, 26 aa, Entamoeba invadens
ANQRNIRILMNVIVTHIAHTTINVKK

SEQ ID NO: 2814379 - protein, 26 aa, Entamoeba invadens
ANSEYDLLLRFVQTLGMIPISMLTNG

SEQ ID NO: 2814380 - protein, 23 aa, Entamoeba invadens
ANTLLMYALYISEKYYYNIAVNY

SEQ ID NO: 2814381 - protein, 47 aa, Entamoeba invadens
ANTNYGMIVGLLVVCVVVFVIIIITTVTLVVLILVFNKKDDKHTENI

SEQ ID NO: 2814382 - protein, 29 aa, Entamoeba invadens
ANVTFGIVWILLSVIFQLITTLAGEFGKK

SEQ ID NO: 2814383 - protein, 17 aa, Entamoeba invadens
ANYSLLLSTKRPNKLNY

SEQ ID NO: 2814384 - protein, 32 aa, Entamoeba invadens
APAFSDIMFFVLFFFYGFVNFAYDKNGRHAEF

SEQ ID NO: 2814385 - protein, 45 aa, Entamoeba invadens
APAFYMKPHIMYFLSFLIVAILFFAPLIMLPVPPNDKFFPDEESK

SEQ ID NO: 2814386 - protein, 25 aa, Entamoeba invadens
APDDHIFLFVDFFLANMMNYEFIHK

SEQ ID NO: 2814387 - protein, 25 aa, Entamoeba invadens
APDFSMLYNVIALTLAVFALGVGNT

SEQ ID NO: 2814388 - protein, 27 aa, Entamoeba invadens
APDIPLMVTEWSFPALDAGLPSLVGAG

SEQ ID NO: 2814389 - protein, 19 aa, Entamoeba invadens
APDMVFMLRGNHECSRVNG

SEQ ID NO: 2814390 - protein, 18 aa, Entamoeba invadens
APEILKKDKYKKPADIYS

SEQ ID NO: 2814391 - protein, 18 aa, Entamoeba invadens
APEILLKEKYKKSADIYS

SEQ ID NO: 2814392 - protein, 24 aa, Entamoeba invadens
APFGWFVYLFFRRPNGFYNIKKGD

SEQ ID NO: 2814393 - protein, 23 aa, Entamoeba invadens
APGRTIADYPLFASSNRITYLEY

SEQ ID NO: 2814394 - protein, 17 aa, Entamoeba invadens
APITKFFDLEFTSLPHF

SEQ ID NO: 2814395 - protein, 22 aa, Entamoeba invadens
APKEIFIPRKLLEVQKDVLLQE

SEQ ID NO: 2814396 - protein, 18 aa, Entamoeba invadens
APKRRATVASAAEAIRKA

SEQ ID NO: 2814397 - protein, 28 aa, Entamoeba invadens
APMTVTFVIIVFIVAIIMVIISMIQKRK

SEQ ID NO: 2814398 - protein, 53 aa, Entamoeba invadens
APNDKGTYCEKSPVWWVIFLIVIFCLVILVFVLTLIIFIVYKVVSKYIRNKKL

SEQ ID NO: 2814399 - protein, 24 aa, Entamoeba invadens
APNSTIPKIYYLHDFLSSPPVEDF

SEQ ID NO: 2814400 - protein, 24 aa, Entamoeba invadens
APPHYVYPWRIVGELIAQLSYELA

SEQ ID NO: 2814401 - protein, 21 aa, Entamoeba invadens
APPKTLPTEPPLKTSLRVFVT

SEQ ID NO: 2814402 - protein, 20 aa, Entamoeba invadens
APQKWDFDFGLKGEKPKVDE

SEQ ID NO: 2814403 - protein, 21 aa, Entamoeba invadens
APQTPNFIRKGKPSRFAPPNQ

SEQ ID NO: 2814404 - protein, 18 aa, Entamoeba invadens
APQTTDPVFFYLSQKERS

SEQ ID NO: 2814405 - protein, 44 aa, Entamoeba invadens
APSDIYSFAITMLEVLMWGPIYTKQAFKFPWNVAEFVVAGKRVS

SEQ ID NO: 2814406 - protein, 18 aa, Entamoeba invadens
APSHLFFLNSIDDAGCPN

SEQ ID NO: 2814407 - protein, 26 aa, Entamoeba invadens
APTLQELRVMSWLGFIGGAKGVFYYS

SEQ ID NO: 2814408 - protein, 31 aa, Entamoeba invadens
APTTTYLLILLWISLFIYVMYIITFTMMSFF

SEQ ID NO: 2814409 - protein, 25 aa, Entamoeba invadens
APVGFLFYALYFFAINKKTQLTFVG

SEQ ID NO: 2814410 - protein, 23 aa, Entamoeba invadens
AQCFSVVLRYLPLHVTPPADLPD

SEQ ID NO: 2814411 - protein, 19 aa, Entamoeba invadens
AQCSSCKNGFYLKSGKCEQ

SEQ ID NO: 2814412 - protein, 25 aa, Entamoeba invadens
AQDCTYLSRYFDFYVNPKQDKIPYE

SEQ ID NO: 2814413 - protein, 36 aa, Entamoeba invadens
AQGYFGFPVCIPHKLFKCLVFSIEYIGNYYLVFDGT

SEQ ID NO: 2814414 - protein, 19 aa, Entamoeba invadens
AQICILTCKIYVKLFECIE

SEQ ID NO: 2814415 - protein, 41 aa, Entamoeba invadens
AQKTLIPCKTVRLVQTVLLVIIVLLGRMVMALNALPAKQVH

SEQ ID NO: 2814416 - protein, 21 aa, Entamoeba invadens
AQNALLIFSVIDQKPWISSNR

SEQ ID NO: 2814417 - protein, 25 aa, Entamoeba invadens
AQRYARYFIYPSGYLAIYSRSLSKF

SEQ ID NO: 2814418 - protein, 23 aa, Entamoeba invadens
AQTNFFFHGKVQPTTLPTTTSPI

SEQ ID NO: 2814419 - protein, 24 aa, Entamoeba invadens
AQVEHICLLMMIVCYKDGASHDVF

SEQ ID NO: 2814420 - protein, 23 aa, Entamoeba invadens
AQVNLFFHGTVEPTTLPTKESPI

SEQ ID NO: 2814421 - protein, 21 aa, Entamoeba invadens
AQWVMYAILIDIIKGYKSNMD

SEQ ID NO: 2814422 - protein, 33 aa, Entamoeba invadens
AQYAQYIWMIKPFVYILCCILGFFIAVAALLYD

SEQ ID NO: 2814423 - protein, 20 aa, Entamoeba invadens
AREFLSFPVYPLLFNTVRSV

SEQ ID NO: 2814424 - protein, 18 aa, Entamoeba invadens
ARGILYLHSNGILHRDIK

SEQ ID NO: 2814425 - protein, 19 aa, Entamoeba invadens
ARHWSCGINFLLHRLFFQF

SEQ ID NO: 2814426 - protein, 21 aa, Entamoeba invadens
ARLYDIFKSIPFYLLSTMTPE

SEQ ID NO: 2814427 - protein, 19 aa, Entamoeba invadens
ARMEAYLSRVLKVQAPSLT

SEQ ID NO: 2814428 - protein, 34 aa, Entamoeba invadens
ARPKFETWWLTRVVPFMFFVFVSMLLLVLQASGV

SEQ ID NO: 2814429 - protein, 25 aa, Entamoeba invadens
ARSFAFLSLVFFIISTIIAVFVVGF

SEQ ID NO: 2814430 - protein, 17 aa, Entamoeba invadens
ARSLDNTILKFLKKFNL

SEQ ID NO: 2814431 - protein, 27 aa, Entamoeba invadens
ARSTAMLVYHFLFAGGAITFKGAKQSN

SEQ ID NO: 2814432 - protein, 54 aa, Entamoeba invadens
ARSVETKEFPKWTIALIVIFVVALVVVVLIFIIYCVIVYLQRKRNLKVFEEGEE

SEQ ID NO: 2814433 - protein, 50 aa, Entamoeba invadens
ARTEYISHILGLIGSFLMGIIWPLYAVISVDYIVVLLSLHPGVDLTEEQA

SEQ ID NO: 2814434 - protein, 23 aa, Entamoeba invadens
ARTKKLLVIPTLKTVSLINYDKV

SEQ ID NO: 2814435 - protein, 24 aa, Entamoeba invadens
ARVLIDFNIPFYSSGAVISGGKIA

SEQ ID NO: 2814436 - protein, 51 aa, Entamoeba invadens
ARVVEKFEFPMYMIAVIIIFVLVLAVIVALLIAYVVHVYIVRKRNMKVFEE

SEQ ID NO: 2814437 - protein, 51 aa, Entamoeba invadens
ARVVEKFEFPMYMIAVIVVFVLVLAVIVVLLIVYMVHVYIVRRKNMKVFED

SEQ ID NO: 2814438 - protein, 22 aa, Entamoeba invadens
ARYPLVVLIKAEGKIFGGYVPD

SEQ ID NO: 2814439 - protein, 23 aa, Entamoeba invadens
ARYTYYINVIPTLNKYPTHTTRS

SEQ ID NO: 2814440 - protein, 26 aa, Entamoeba invadens
ASACANGFYRIVRLVRYNSGTVLKCS

SEQ ID NO: 2814441 - protein, 22 aa, Entamoeba invadens
ASALNIFGFANFSLVSETQLEA

SEQ ID NO: 2814442 - protein, 38 aa, Entamoeba invadens
ASCESQAVWWVILVAVLFVFGVLFVLIASIVVLTKIIL

SEQ ID NO: 2814443 - protein, 18 aa, Entamoeba invadens
ASCYNAVRIESVKALVSC

SEQ ID NO: 2814444 - protein, 20 aa, Entamoeba invadens
ASDFSRKCVTCRGGKYPKDG

SEQ ID NO: 2814445 - protein, 27 aa, Entamoeba invadens
ASDQKWFGILFGFLVIIISAFSSFMGQ

SEQ ID NO: 2814446 - protein, 25 aa, Entamoeba invadens
ASEAYSIRYKLLLDASKGIEYLHNN

SEQ ID NO: 2814447 - protein, 44 aa, Entamoeba invadens
ASESGEYCYLKAVWWVFFISSLIFVIILVVALVIIVLSVQYFVE

SEQ ID NO: 2814448 - protein, 24 aa, Entamoeba invadens
ASEVTLLHNWFSLTSTSDIESSIL

SEQ ID NO: 2814449 - protein, 22 aa, Entamoeba invadens
ASEYFIELMNIRGFSTIGYLML

SEQ ID NO: 2814450 - protein, 36 aa, Entamoeba invadens
ASFDNVTINLFLRTIKNFPLIFTYNVTSFNNVNPNA

SEQ ID NO: 2814451 - protein, 31 aa, Entamoeba invadens
ASFPPAFFTLKNIKIVKLLKTNFKQLSYLFG

SEQ ID NO: 2814452 - protein, 20 aa, Entamoeba invadens
ASGFSRKCVTCRGGKYPKDG

SEQ ID NO: 2814453 - protein, 24 aa, Entamoeba invadens
ASGKIEIVWIIEKFIRHLVDTQMT

SEQ ID NO: 2814454 - protein, 18 aa, Entamoeba invadens
ASGMFYLHSSTPPIIHRD

SEQ ID NO: 2814455 - protein, 31 aa, Entamoeba invadens
ASHKDFPILNTYLQPAQTLYIFVKLEENNEV

SEQ ID NO: 2814456 - protein, 24 aa, Entamoeba invadens
ASIKKSRVILSNNRITFADDAQLL

SEQ ID NO: 2814457 - protein, 21 aa, Entamoeba invadens
ASKGILYLHSNNILHRDIKPD

SEQ ID NO: 2814458 - protein, 21 aa, Entamoeba invadens
ASKNKWYFAPRKCSNERYDDT

SEQ ID NO: 2814459 - protein, 38 aa, Entamoeba invadens
ASKSFDFTFKWIDKLKWLILIFWLVTTLGLAYCAFEFL

SEQ ID NO: 2814460 - protein, 23 aa, Entamoeba invadens
ASLFIVHALSIYPKFIELLVNYD

SEQ ID NO: 2814461 - protein, 27 aa, Entamoeba invadens
ASLFSMIFVFKPFVWVVSVTPLPYIVY

SEQ ID NO: 2814462 - protein, 29 aa, Entamoeba invadens
ASLQLLIPFFAITLVLFYYNKFPSKVFVG

SEQ ID NO: 2814463 - protein, 25 aa, Entamoeba invadens
ASMVNYFIQLFPILLGIIKKRNSSV

SEQ ID NO: 2814464 - protein, 24 aa, Entamoeba invadens
ASNFDTLMPYYFISDGIVYSQDNF

SEQ ID NO: 2814465 - protein, 23 aa, Entamoeba invadens
ASNFSRKCLICNTGFYPNNSGKC

SEQ ID NO: 2814466 - protein, 24 aa, Entamoeba invadens
ASNGIRICTNCTAGYFPQSDGRCG

SEQ ID NO: 2814467 - protein, 22 aa, Entamoeba invadens
ASNLIIKSGFLKIVNMYTSTSF

SEQ ID NO: 2814468 - protein, 25 aa, Entamoeba invadens
ASNMYFICYIILFQNKPFIYKQTIL

SEQ ID NO: 2814469 - protein, 23 aa, Entamoeba invadens
ASNNCLTCRPGLAVRYGTCYDCQ

SEQ ID NO: 2814470 - protein, 18 aa, Entamoeba invadens
ASNYFYVDFYSRIDPIIV

SEQ ID NO: 2814471 - protein, 22 aa, Entamoeba invadens
ASPVMFIVLFVLIWNNMGKWVY

SEQ ID NO: 2814472 - protein, 20 aa, Entamoeba invadens
ASRGILYLHENGILHRDIKP

SEQ ID NO: 2814473 - protein, 22 aa, Entamoeba invadens
ASRKAILFLVGQTPLNNIAWKK

SEQ ID NO: 2814474 - protein, 18 aa, Entamoeba invadens
ASRRQYNFDLVLDKDLEK

SEQ ID NO: 2814475 - protein, 26 aa, Entamoeba invadens
ASSFIIAFLILFIATIFMASVTLVSF

SEQ ID NO: 2814476 - protein, 24 aa, Entamoeba invadens
ASSFLYFCDTFLDYYKGTIVEMRD

SEQ ID NO: 2814477 - protein, 25 aa, Entamoeba invadens
ASSIFIFIAILNHRKTEKLREKYCL

SEQ ID NO: 2814478 - protein, 25 aa, Entamoeba invadens
ASSQVSSIPIYFNKVLHPCSGDYQE

SEQ ID NO: 2814479 - protein, 26 aa, Entamoeba invadens
ASSSSLWMRVPLYFVQQYPRREQRIC

SEQ ID NO: 2814480 - protein, 31 aa, Entamoeba invadens
ASTTLPRFALVLYWFAFPYNFMNYRVDATLI

SEQ ID NO: 2814481 - protein, 17 aa, Entamoeba invadens
ASVQYPCLLNMGNALYK

SEQ ID NO: 2814482 - protein, 23 aa, Entamoeba invadens
ASYSPYYNVLGAVLCFDYTDKIT

SEQ ID NO: 2814483 - protein, 24 aa, Entamoeba invadens
ATACRLIPLLLLFGISEDLCNVAT

SEQ ID NO: 2814484 - protein, 25 aa, Entamoeba invadens
ATAQLKLPYTSFYLFVGIKNGKSLE

SEQ ID NO: 2814485 - protein, 32 aa, Entamoeba invadens
ATCDANDICLTCPSPYIFNASTKACDAPQSDC

SEQ ID NO: 2814486 - protein, 24 aa, Entamoeba invadens
ATCTMKKVFSCQPHYFLKNNRCVG

SEQ ID NO: 2814487 - protein, 25 aa, Entamoeba invadens
ATCTMKKVLSCQPHYFLKNNRCVGC

SEQ ID NO: 2814488 - protein, 24 aa, Entamoeba invadens
ATDNFCFVLEKFPHIISGVKNIFG

SEQ ID NO: 2814489 - protein, 24 aa, Entamoeba invadens
ATDYSRKCIQCRSNYYPKTVGDFR

SEQ ID NO: 2814490 - protein, 19 aa, Entamoeba invadens
ATDYYHYAVGYIELSRGCM

SEQ ID NO: 2814491 - protein, 26 aa, Entamoeba invadens
ATESDTRYFCKIFGWEIDAEIAKYIQ

SEQ ID NO: 2814492 - protein, 32 aa, Entamoeba invadens
ATFGPSLNSLGMKAFFGTKLTSFDLLNVVKIS

SEQ ID NO: 2814493 - protein, 24 aa, Entamoeba invadens
ATFLNQFCFFVLSERQGIKIRLLY

SEQ ID NO: 2814494 - protein, 30 aa, Entamoeba invadens
ATFNLTLMFFILGFCIACFWLMAFVVSRKG

SEQ ID NO: 2814495 - protein, 18 aa, Entamoeba invadens
ATGYYLDNWLCSKCSINC

SEQ ID NO: 2814496 - protein, 19 aa, Entamoeba invadens
ATIFLAFTLFLIFVAFQNL

SEQ ID NO: 2814497 - protein, 23 aa, Entamoeba invadens
ATILRIKGIFQISGGLTKFSDFY

SEQ ID NO: 2814498 - protein, 22 aa, Entamoeba invadens
ATKFLQYLTFVLYQCTVRNGNS

SEQ ID NO: 2814499 - protein, 22 aa, Entamoeba invadens
ATKLLYYNNSLYIRAAFDKQNY

SEQ ID NO: 2814500 - protein, 20 aa, Entamoeba invadens
ATKMFSLLRSKPNAKFGIIA

SEQ ID NO: 2814501 - protein, 23 aa, Entamoeba invadens
ATKYLLPLVLLLIFAIAEDVSSS

SEQ ID NO: 2814502 - protein, 33 aa, Entamoeba invadens
ATLDDYHHLILNQFFQRTSTLQWDRPIQFISNE

SEQ ID NO: 2814503 - protein, 24 aa, Entamoeba invadens
ATLIGYLLLIVLLQIVMVVAQKRF

SEQ ID NO: 2814504 - protein, 26 aa, Entamoeba invadens
ATLIIPGTLALLSKLTVPPKLKLLIE

SEQ ID NO: 2814505 - protein, 18 aa, Entamoeba invadens
ATLKRTIVAFLDMFCAVG

SEQ ID NO: 2814506 - protein, 18 aa, Entamoeba invadens
ATLNIFWLDSFNSMIFNS

SEQ ID NO: 2814507 - protein, 23 aa, Entamoeba invadens
ATLTLCGLFLLYYHETYPLFSSK

SEQ ID NO: 2814508 - protein, 17 aa, Entamoeba invadens
ATMYIYPMDDPIELYIY

SEQ ID NO: 2814509 - protein, 24 aa, Entamoeba invadens
ATNFSRKCLICKTNLYPNDSGKCV

SEQ ID NO: 2814510 - protein, 27 aa, Entamoeba invadens
ATNTMSLWMMIFVIGTVIASSLYQVIS

SEQ ID NO: 2814511 - protein, 22 aa, Entamoeba invadens
ATNYILQDTTCLDLSLIEHCVS

SEQ ID NO: 2814512 - protein, 20 aa, Entamoeba invadens
ATPPTIPFIGSTLTDLIYTA

SEQ ID NO: 2814513 - protein, 19 aa, Entamoeba invadens
ATQFIRDYAYKYFLLKNEN

SEQ ID NO: 2814514 - protein, 17 aa, Entamoeba invadens
ATRIFKCDTCEGVLLNY

SEQ ID NO: 2814515 - protein, 28 aa, Entamoeba invadens
ATRLRFLGFWICAVLNVFVPKYVSGFDY

SEQ ID NO: 2814516 - protein, 25 aa, Entamoeba invadens
ATSDKPIFYGITPLTINGTNPNLVS

SEQ ID NO: 2814517 - protein, 23 aa, Entamoeba invadens
ATTCAPCPVGYYSQFSVSAECTE

SEQ ID NO: 2814518 - protein, 26 aa, Entamoeba invadens
ATTCISCYFWFVLNVQTSHCDLIEDI

SEQ ID NO: 2814519 - protein, 25 aa, Entamoeba invadens
ATTCSRCYYGYYLTSSTNTCNACSS

SEQ ID NO: 2814520 - protein, 20 aa, Entamoeba invadens
ATVAAITTFLITMRRASSQN

SEQ ID NO: 2814521 - protein, 25 aa, Entamoeba invadens
ATYGSLFVVGAYRYDNNRGRILIYF

SEQ ID NO: 2814522 - protein, 21 aa, Entamoeba invadens
ATYKYLQEVTWRDTFIRLSSY

SEQ ID NO: 2814523 - protein, 24 aa, Entamoeba invadens
ATYLNTILRKIFLLNSTYAVYLYS

SEQ ID NO: 2814524 - protein, 19 aa, Entamoeba invadens
ATYWNYFFPPFSKTFCFYV

SEQ ID NO: 2814525 - protein, 21 aa, Entamoeba invadens
AVAILLYFRVITTSQAFAGFS

SEQ ID NO: 2814526 - protein, 40 aa, Entamoeba invadens
AVAISLFEVFCWEDPFPKNAFAFPWSIARAITSGIRPQYT

SEQ ID NO: 2814527 - protein, 23 aa, Entamoeba invadens
AVAMFIMFGSFSLGSWYASMIIR

SEQ ID NO: 2814528 - protein, 24 aa, Entamoeba invadens
AVANFLIFNSFSLGLWYASMIIRG

SEQ ID NO: 2814529 - protein, 21 aa, Entamoeba invadens
AVATFFFFVGIFLILIKFTFI

SEQ ID NO: 2814530 - protein, 30 aa, Entamoeba invadens
AVAVALCVWFIDGDWKYYLDPALSLIVACV

SEQ ID NO: 2814531 - protein, 31 aa, Entamoeba invadens
AVAVILIFPRTFFVLYISVALWPFCTSCYWP

SEQ ID NO: 2814532 - protein, 18 aa, Entamoeba invadens
AVCFLFALFCVLFDSKVS

SEQ ID NO: 2814533 - protein, 24 aa, Entamoeba invadens
AVDRLLPFFETNIIPFNSDGAERL

SEQ ID NO: 2814534 - protein, 19 aa, Entamoeba invadens
AVEFEIFVTPLCTCSISET

SEQ ID NO: 2814535 - protein, 30 aa, Entamoeba invadens
AVEGRWRLLVYAMQFIVVPLIRTHTKEFNG

SEQ ID NO: 2814536 - protein, 18 aa, Entamoeba invadens
AVEYLVRCMNFDGAFGCV

SEQ ID NO: 2814537 - protein, 23 aa, Entamoeba invadens
AVFKFDQCYYMMLDTYVKFEEKG

SEQ ID NO: 2814538 - protein, 25 aa, Entamoeba invadens
AVFTARLWIHRIGYYQTIQGKDDPL

SEQ ID NO: 2814539 - protein, 17 aa, Entamoeba invadens
AVGSFVDLLLPTTLNGN

SEQ ID NO: 2814540 - protein, 33 aa, Entamoeba invadens
AVGSRLMDYGWQTSFFPLPDFFNSTSFLHKPSQ

SEQ ID NO: 2814541 - protein, 25 aa, Entamoeba invadens
AVHASFIMVLLFEAYFFVMFQFVRI

SEQ ID NO: 2814542 - protein, 25 aa, Entamoeba invadens
AVHNVIFYTYYFNKNYIYYNDTNQI

SEQ ID NO: 2814543 - protein, 18 aa, Entamoeba invadens
AVIFLFVVLIRVTRKTQD

SEQ ID NO: 2814544 - protein, 29 aa, Entamoeba invadens
AVILTMISIYVAFALPKLPGMWVYTWTVT

SEQ ID NO: 2814545 - protein, 25 aa, Entamoeba invadens
AVITSIVFVVYFIEKKMRQKKIKKT

SEQ ID NO: 2814546 - protein, 23 aa, Entamoeba invadens
AVKEGLWFLLEDVDTAPGDVISL

SEQ ID NO: 2814547 - protein, 27 aa, Entamoeba invadens
AVKSNTLVLLQFFFKDGKLLKKRNSNG

SEQ ID NO: 2814548 - protein, 20 aa, Entamoeba invadens
AVLHREVVRFVKIGKLGGGD

SEQ ID NO: 2814549 - protein, 22 aa, Entamoeba invadens
AVLIYPYYYEILTKNIEYHPFT

SEQ ID NO: 2814550 - protein, 36 aa, Entamoeba invadens
AVLLYIFGFFCFGLWILCFLLFYKSSSKRARLFARL

SEQ ID NO: 2814551 - protein, 25 aa, Entamoeba invadens
AVLTDGCWYLFAGVVLYTITAIAIT

SEQ ID NO: 2814552 - protein, 17 aa, Entamoeba invadens
AVLTFKIAIKRLQKYFM

SEQ ID NO: 2814553 - protein, 22 aa, Entamoeba invadens
AVLWSIIPLLFMASDEVGGFGW

SEQ ID NO: 2814554 - protein, 17 aa, Entamoeba invadens
AVMFNWSWDLFRGFPIM

SEQ ID NO: 2814555 - protein, 28 aa, Entamoeba invadens
AVNVPLYILLFFYMLNLPNTRLGKVFGL

SEQ ID NO: 2814556 - protein, 27 aa, Entamoeba invadens
AVPCILTLYHRIIMPMPKKKVAAKATK

SEQ ID NO: 2814557 - protein, 17 aa, Entamoeba invadens
AVQYIFVHAKYAAAPLD

SEQ ID NO: 2814558 - protein, 29 aa, Entamoeba invadens
AVRIKICHDFARALLYLHSNGILHRDIKP

SEQ ID NO: 2814559 - protein, 29 aa, Entamoeba invadens
AVRNGFHIILLYFLTLGRFSKLDCLSQGE

SEQ ID NO: 2814560 - protein, 18 aa, Entamoeba invadens
AVSIGVFKTYQLVSSAMK

SEQ ID NO: 2814561 - protein, 42 aa, Entamoeba invadens
AVSITVFITLFLLFDYFLRPSPNIPTIFPLEVTLPEYFDDQM

SEQ ID NO: 2814562 - protein, 18 aa, Entamoeba invadens
AVSLTLYATGIVSLISLP

SEQ ID NO: 2814563 - protein, 40 aa, Entamoeba invadens
AVSQTPIHVFLTHNFFTDISYVSLIRPYILIDCDDEFVRE

SEQ ID NO: 2814564 - protein, 18 aa, Entamoeba invadens
AVSRRFFVYKKYLSELVE

SEQ ID NO: 2814565 - protein, 26 aa, Entamoeba invadens
AVSYISPNLILKSYQFTYITDPKPDQ

SEQ ID NO: 2814566 - protein, 54 aa, Entamoeba invadens
AVTIHSKTPMWLILLIVFLGFDNIVQLFKSPVMMAVVLVIIGIVFAMTRMGYSN

SEQ ID NO: 2814567 - protein, 32 aa, Entamoeba invadens
AVTMFNVMVWDAPYQGSLFKYPWNIANFVADG

SEQ ID NO: 2814568 - protein, 22 aa, Entamoeba invadens
AVTTIIIPTVTTFGIHVFDGIT

SEQ ID NO: 2814569 - protein, 24 aa, Entamoeba invadens
AVTYLPQVSMVIQFFILGSLGEYI

SEQ ID NO: 2814570 - protein, 24 aa, Entamoeba invadens
AVVGSYNCVPCKPGYYANSSVSSC

SEQ ID NO: 2814571 - protein, 25 aa, Entamoeba invadens
AVVSDFLLVMTFSIGVVYYFSAGEF

SEQ ID NO: 2814572 - protein, 31 aa, Entamoeba invadens
AVVVVFLVVVIIITLFVLIRQTRPKRPDWNV

SEQ ID NO: 2814573 - protein, 27 aa, Entamoeba invadens
AVVYFCPYPLIFYLFSGGVSYAIGTIF

SEQ ID NO: 2814574 - protein, 31 aa, Entamoeba invadens
AVVYPPYYQDPLKVLGLLKNEWKSSCDKMKL

SEQ ID NO: 2814575 - protein, 17 aa, Entamoeba invadens
AVWSVIIVAFFVCSYCF

SEQ ID NO: 2814576 - protein, 20 aa, Entamoeba invadens
AVWTAVTLSFCESPTLTSCD

SEQ ID NO: 2814577 - protein, 25 aa, Entamoeba invadens
AVYAFTSIWFLICTVYAIVLRFKKT

SEQ ID NO: 2814578 - protein, 27 aa, Entamoeba invadens
AVYVSLVVFLLLFYTVCCLLIFIWIEP

SEQ ID NO: 2814579 - protein, 20 aa, Entamoeba invadens
AWCCLVTVIYFSYLFGFLHQ

SEQ ID NO: 2814580 - protein, 17 aa, Entamoeba invadens
AWCESYSKEDFRYPWDI

SEQ ID NO: 2814581 - protein, 20 aa, Entamoeba invadens
AWEEAYVDVKYFFEIAERVC

SEQ ID NO: 2814582 - protein, 26 aa, Entamoeba invadens
AWTNLYFYFYVMLAAMYVLQFVIPPL

SEQ ID NO: 2814583 - protein, 19 aa, Entamoeba invadens
AWWKYVVNAVKILKAQNTT

SEQ ID NO: 2814584 - protein, 22 aa, Entamoeba invadens
AWYAYPIQYMVLLFPVINLCNS

SEQ ID NO: 2814585 - protein, 17 aa, Entamoeba invadens
AYALSQTGICNTYVTID

SEQ ID NO: 2814586 - protein, 29 aa, Entamoeba invadens
AYAVKKFFGFFNLISYTIPISVGVTMEIC

SEQ ID NO: 2814587 - protein, 23 aa, Entamoeba invadens
AYDKNMFKFPWKIAEFVISGKRL

SEQ ID NO: 2814588 - protein, 23 aa, Entamoeba invadens
AYEHQKFKYPWKIAQFVIKGNHL

SEQ ID NO: 2814589 - protein, 17 aa, Entamoeba invadens
AYFEKYIGMTCVEMRYE

SEQ ID NO: 2814590 - protein, 19 aa, Entamoeba invadens
AYFSSFARYFLNCKDHVAV

SEQ ID NO: 2814591 - protein, 18 aa, Entamoeba invadens
AYILQKKVQKLLLIIAIS

SEQ ID NO: 2814592 - protein, 23 aa, Entamoeba invadens
AYINFFNLLLVIILWRVGSLVNK

SEQ ID NO: 2814593 - protein, 17 aa, Entamoeba invadens
AYKALEMFAKARMTWYG

SEQ ID NO: 2814594 - protein, 24 aa, Entamoeba invadens
AYKGDAFEYMWSIASFVMDGKRLE

SEQ ID NO: 2814595 - protein, 19 aa, Entamoeba invadens
AYKVWSFNVDSLEISGNLN

SEQ ID NO: 2814596 - protein, 33 aa, Entamoeba invadens
AYLANYLVALGILKGNFPFQKGFMYSLDVDNVE

SEQ ID NO: 2814597 - protein, 24 aa, Entamoeba invadens
AYLPPALLIIIFSVKKKSLLFLVF

SEQ ID NO: 2814598 - protein, 30 aa, Entamoeba invadens
AYLSFRYRVPFKEVFFFSTLKIVSSSSSQY

SEQ ID NO: 2814599 - protein, 22 aa, Entamoeba invadens
AYLSLMRRILLEKDKVGMLSPS

SEQ ID NO: 2814600 - protein, 19 aa, Entamoeba invadens
AYNQDIFKFPWKIAEFVTS

SEQ ID NO: 2814601 - protein, 18 aa, Entamoeba invadens
AYPKEDFKYPWKIAEFVM

SEQ ID NO: 2814602 - protein, 30 aa, Entamoeba invadens
AYPNDLQYSVPFWHVYVGIDTHLGKSLNYE

SEQ ID NO: 2814603 - protein, 24 aa, Entamoeba invadens
AYPSWIFFSMNYGAYLVFPLICVF

SEQ ID NO: 2814604 - protein, 25 aa, Entamoeba invadens
AYQCDSCVTGYYLDQTTKTCHQGGD

SEQ ID NO: 2814605 - protein, 38 aa, Entamoeba invadens
AYQINNFLVLWFYYFFALIVYFFPFLSVPGKVTRADFP

SEQ ID NO: 2814606 - protein, 24 aa, Entamoeba invadens
AYQTQMILSINYIKTMLSTSYFTF

SEQ ID NO: 2814607 - protein, 23 aa, Entamoeba invadens
AYSSEFFTTQFLLDLQSLMLEES

SEQ ID NO: 2814608 - protein, 17 aa, Entamoeba invadens
AYTFLHDGIARPAFVQL

SEQ ID NO: 2814609 - protein, 17 aa, Entamoeba invadens
AYVLFILCNCASLLLFI

SEQ ID NO: 2814610 - protein, 22 aa, Entamoeba invadens
AYVNLYCFFLTILCLPSQENTE

SEQ ID NO: 2814611 - protein, 40 aa, Entamoeba invadens
AYVPPLLLLVLFSFLKTSWRYFLLSFLALAFAISLCAAVV

SEQ ID NO: 2814612 - protein, 19 aa, Entamoeba invadens
AYYFSILQLKIINGYVNTS

SEQ ID NO: 2814613 - protein, 41 aa, Entamoeba invadens
AYYNSPLIPFWRSVFYLIFRVPFWTFISAFMSALSALLHFR

SEQ ID NO: 2814614 - protein, 20 aa, Entamoeba invadens
CAAMNRGFLSVILGIGTHKT

SEQ ID NO: 2814615 - protein, 18 aa, Entamoeba invadens
CADGYYLESNKCVRIPNC

SEQ ID NO: 2814616 - protein, 19 aa, Entamoeba invadens
CAEAFYFDESTKQCVNCNS

SEQ ID NO: 2814617 - protein, 29 aa, Entamoeba invadens
CAFQSIFLFLVFFISSLPFLILCLAVGGF

SEQ ID NO: 2814618 - protein, 18 aa, Entamoeba invadens
CAGGTYSNSLLASTNCLK

SEQ ID NO: 2814619 - protein, 22 aa, Entamoeba invadens
CAICKDGFFKLRLDCEFCDKSC

SEQ ID NO: 2814620 - protein, 23 aa, Entamoeba invadens
CAICNDKLYVVEDTYKCVAKCDS

SEQ ID NO: 2814621 - protein, 20 aa, Entamoeba invadens
CAICPMGTYYLRSVCQSCGE

SEQ ID NO: 2814622 - protein, 30 aa, Entamoeba invadens
CAIHIVFQFLGCILVGKILRIPTLENRVFS

SEQ ID NO: 2814623 - protein, 21 aa, Entamoeba invadens
CAKGYYLTYASCLKCIEGCLD

SEQ ID NO: 2814624 - protein, 26 aa, Entamoeba invadens
CAKIVDFWGIFFCCVFIAMAAFLENI

SEQ ID NO: 2814625 - protein, 19 aa, Entamoeba invadens
CALALIITYAIGGLCYLYF

SEQ ID NO: 2814626 - protein, 17 aa, Entamoeba invadens
CALCKSSYYRKGDDCIS

SEQ ID NO: 2814627 - protein, 18 aa, Entamoeba invadens
CALLLTVVVIIRKILNSK

SEQ ID NO: 2814628 - protein, 18 aa, Entamoeba invadens
CALSSILFMFLAIHAYCS

SEQ ID NO: 2814629 - protein, 24 aa, Entamoeba invadens
CAMEYLVFLLIGTVCVFSCQYVSP

SEQ ID NO: 2814630 - protein, 44 aa, Entamoeba invadens
CAMLFDFRLLFLSFLFANASLLFLYYRKLYLLIYQLQHNFTQAE

SEQ ID NO: 2814631 - protein, 17 aa, Entamoeba invadens
CANYILAPYLWEPLLQK

SEQ ID NO: 2814632 - protein, 18 aa, Entamoeba invadens
CASGYYLESNKCVRIPNC

SEQ ID NO: 2814633 - protein, 24 aa, Entamoeba invadens
CASNFSRKCLICNTGFYPNDSGKC

SEQ ID NO: 2814634 - protein, 27 aa, Entamoeba invadens
CASQPYILKFFFFKLVGEIPNKSRILF

SEQ ID NO: 2814635 - protein, 26 aa, Entamoeba invadens
CATDFTRKCIACKPNYYIKTSGDYKC

SEQ ID NO: 2814636 - protein, 28 aa, Entamoeba invadens
CATFAGVVFFIIIGVSIYSALKYKKIDV

SEQ ID NO: 2814637 - protein, 19 aa, Entamoeba invadens
CATGYYLNNNLCTACTAGC

SEQ ID NO: 2814638 - protein, 35 aa, Entamoeba invadens
CAVIYYFCFLIAGIFFHTFWLLCILFCVARTAFEL

SEQ ID NO: 2814639 - protein, 19 aa, Entamoeba invadens
CCCYRFMYVVPSVMAKALI

SEQ ID NO: 2814640 - protein, 46 aa, Entamoeba invadens
CCETKVVWWVILISVLIIIVIFVVMFIVIVLIIRTILAHLHQKEVE

SEQ ID NO: 2814641 - protein, 24 aa, Entamoeba invadens
CCHCLLFFVLGVLILTFGLHNDNS

SEQ ID NO: 2814642 - protein, 17 aa, Entamoeba invadens
CCICKYIILCKEINFEQ

SEQ ID NO: 2814643 - protein, 23 aa, Entamoeba invadens
CCKLGHYWDLAEMTSLIIPKIEA

SEQ ID NO: 2814644 - protein, 26 aa, Entamoeba invadens
CCKNPSLMWVIFKKEWKSMLFGYFTI

SEQ ID NO: 2814645 - protein, 22 aa, Entamoeba invadens
CCLEIYLRKVPYPKEQFPDTES

SEQ ID NO: 2814646 - protein, 32 aa, Entamoeba invadens
CCMSARTIILRLLLSTWFNKLFLHWSSDVRRG

SEQ ID NO: 2814647 - protein, 17 aa, Entamoeba invadens
CCNKLIKTLPTICTYLY

SEQ ID NO: 2814648 - protein, 25 aa, Entamoeba invadens
CCQVKVLLMPLCTFSSQIPLTFPVS

SEQ ID NO: 2814649 - protein, 18 aa, Entamoeba invadens
CCTSIPSPLVRFIHAAHL

SEQ ID NO: 2814650 - protein, 26 aa, Entamoeba invadens
CCVFFTFFVFFQFKSAFIQKLNFIQI

SEQ ID NO: 2814651 - protein, 30 aa, Entamoeba invadens
CCVRIGAPQIFIVSHLLGGISALIPLNGFG

SEQ ID NO: 2814652 - protein, 20 aa, Entamoeba invadens
CDDGFYLKSKICVKCGEECI

SEQ ID NO: 2814653 - protein, 24 aa, Entamoeba invadens
CDDIEDWYIAPLPNVKSLFVEINK

SEQ ID NO: 2814654 - protein, 17 aa, Entamoeba invadens
CDHYEIRSVPTLISLKK

SEQ ID NO: 2814655 - protein, 25 aa, Entamoeba invadens
CDIHLYYVWKFYYGTELFPFWIVLF

SEQ ID NO: 2814656 - protein, 19 aa, Entamoeba invadens
CDIYLIRTVPTLITLKRNE

SEQ ID NO: 2814657 - protein, 31 aa, Entamoeba invadens
CDKCEWKFKLVGKKCEYRPFCIKVDNTKCTE

SEQ ID NO: 2814658 - protein, 22 aa, Entamoeba invadens
CDKYSIRTVPQLVTLKKGEACE

SEQ ID NO: 2814659 - protein, 22 aa, Entamoeba invadens
CDLCSYGRFPSRSYFYSCAKCN

SEQ ID NO: 2814660 - protein, 17 aa, Entamoeba invadens
CDLFGKYSLSKCCQCNC

SEQ ID NO: 2814661 - protein, 20 aa, Entamoeba invadens
CDLIAIFVVICTCSYYLIIV

SEQ ID NO: 2814662 - protein, 21 aa, Entamoeba invadens
CDMFYYLGHSSPQVCLLCTED

SEQ ID NO: 2814663 - protein, 46 aa, Entamoeba invadens
CDQEVSWWMILIIFVLSFVTFIIFLLIVGYFINRIVFRIKMCIYKK

SEQ ID NO: 2814664 - protein, 27 aa, Entamoeba invadens
CDQIYGYCTSCKLGYVLKLDKQSLICE

SEQ ID NO: 2814665 - protein, 52 aa, Entamoeba invadens
CDSQPEAWFIVILIVIILLIILLLVLAIYVLSRMYLIYDKRKRLSKKMCLFK

SEQ ID NO: 2814666 - protein, 19 aa, Entamoeba invadens
CDSSFFRRCYECQTGYYPS

SEQ ID NO: 2814667 - protein, 25 aa, Entamoeba invadens
CDTANGFHLLFDQITCVKCPENCNK

SEQ ID NO: 2814668 - protein, 18 aa, Entamoeba invadens
CDTGFYIDNQRCLPCNSK

SEQ ID NO: 2814669 - protein, 17 aa, Entamoeba invadens
CDYIRILFLVVGVFFVF

SEQ ID NO: 2814670 - protein, 25 aa, Entamoeba invadens
CDYSYNVIPKCQIADYANSQHICTT

SEQ ID NO: 2814671 - protein, 17 aa, Entamoeba invadens
CDYYEIRSVPPLVTLKP

SEQ ID NO: 2814672 - protein, 18 aa, Entamoeba invadens
CDYYEIRSVPPLVTLKPG

SEQ ID NO: 2814673 - protein, 17 aa, Entamoeba invadens
CDYYTIRTEPALVNLKS

SEQ ID NO: 2814674 - protein, 21 aa, Entamoeba invadens
CEAGYYLSAGYCVKCIKGFYS

SEQ ID NO: 2814675 - protein, 19 aa, Entamoeba invadens
CEDGFYIDSQYCSKCDEVC

SEQ ID NO: 2814676 - protein, 19 aa, Entamoeba invadens
CEDGYYLDNYICKNCSENC

SEQ ID NO: 2814677 - protein, 18 aa, Entamoeba invadens
CEDGYYWSATDKKCYECS

SEQ ID NO: 2814678 - protein, 22 aa, Entamoeba invadens
CEECEIGHFYSAALKSCVLCSD

SEQ ID NO: 2814679 - protein, 17 aa, Entamoeba invadens
CEEDCPDAYFKGDGVCT

SEQ ID NO: 2814680 - protein, 22 aa, Entamoeba invadens
CEEEYILNSYLLCENRIDQDHC

SEQ ID NO: 2814681 - protein, 41 aa, Entamoeba invadens
CEEKLNLAIVISLPIIATIVIIIIVVVSVTAFIILNEKHKQ

SEQ ID NO: 2814682 - protein, 21 aa, Entamoeba invadens
CEEMRFYNIILQYILSVQNKD

SEQ ID NO: 2814683 - protein, 20 aa, Entamoeba invadens
CEFDLYIKPLCTCKITDQMH

SEQ ID NO: 2814684 - protein, 23 aa, Entamoeba invadens
CEFEAVLIPFCTCQIKNTIQIVS

SEQ ID NO: 2814685 - protein, 19 aa, Entamoeba invadens
CEFEIFIKPICKCVIHSNI

SEQ ID NO: 2814686 - protein, 21 aa, Entamoeba invadens
CEFEIFIKPLCSCKIDEHFVF

SEQ ID NO: 2814687 - protein, 19 aa, Entamoeba invadens
CEFEIFIKPLCTCSTKEDV

SEQ ID NO: 2814688 - protein, 21 aa, Entamoeba invadens
CEFEIFITPLCSCQINDKIAI

SEQ ID NO: 2814689 - protein, 23 aa, Entamoeba invadens
CEFEIFITPNFTCKIDDQFVVTC

SEQ ID NO: 2814690 - protein, 19 aa, Entamoeba invadens
CEFEIFLTPRCTCKIHETL

SEQ ID NO: 2814691 - protein, 19 aa, Entamoeba invadens
CEFEIIVVPYCTCKLKDIF

SEQ ID NO: 2814692 - protein, 23 aa, Entamoeba invadens
CEFEIVLIPFCTCQIRNTIQIVS

SEQ ID NO: 2814693 - protein, 19 aa, Entamoeba invadens
CEFEIYIKPLCSCEIKEDI

SEQ ID NO: 2814694 - protein, 20 aa, Entamoeba invadens
CEFEIYITPLCCCNIKDGIL

SEQ ID NO: 2814695 - protein, 20 aa, Entamoeba invadens
CEFSLFLNPLCTSTIDSTFI

SEQ ID NO: 2814696 - protein, 19 aa, Entamoeba invadens
CEFSLFLTPLCNSNMESSF

SEQ ID NO: 2814697 - protein, 23 aa, Entamoeba invadens
CEHPKSCTILIRGSDDQIIEQLK

SEQ ID NO: 2814698 - protein, 17 aa, Entamoeba invadens
CEIGFYQDGTNQTFCKE

SEQ ID NO: 2814699 - protein, 32 aa, Entamoeba invadens
CEIKTGFVLLKKYLLELPNPLLNEGICAKLDQ

SEQ ID NO: 2814700 - protein, 22 aa, Entamoeba invadens
CEILKSCILCSPSFVLKNEICV

SEQ ID NO: 2814701 - protein, 18 aa, Entamoeba invadens
CEKCLAGYYLHSETKTCK

SEQ ID NO: 2814702 - protein, 47 aa, Entamoeba invadens
CEKYPLGYGVALIIIAIAIFIALLIVLCIMLYVYYQYRSKQLEETRA

SEQ ID NO: 2814703 - protein, 19 aa, Entamoeba invadens
CELGEYVDFYLLSSKIVVG

SEQ ID NO: 2814704 - protein, 23 aa, Entamoeba invadens
CELTEDFFLKCKKEMPNMVGCAI

SEQ ID NO: 2814705 - protein, 27 aa, Entamoeba invadens
CELVILFCFIAFTVLLFLCSAKLGENG

SEQ ID NO: 2814706 - protein, 18 aa, Entamoeba invadens
CELYSIRTVPSLVTLKNN

SEQ ID NO: 2814707 - protein, 17 aa, Entamoeba invadens
CENAFKDNTYITSFVYE

SEQ ID NO: 2814708 - protein, 17 aa, Entamoeba invadens
CENGYFKNKTNSCEGCS

SEQ ID NO: 2814709 - protein, 20 aa, Entamoeba invadens
CENGYYLDFFIPRCVSCPEM

SEQ ID NO: 2814710 - protein, 17 aa, Entamoeba invadens
CENPYTLVGDNCEYRPY

SEQ ID NO: 2814711 - protein, 19 aa, Entamoeba invadens
CENRFYPNELGLCVPCTKI

SEQ ID NO: 2814712 - protein, 23 aa, Entamoeba invadens
CEPLGNLFTKCELTLPTGGGCAI

SEQ ID NO: 2814713 - protein, 18 aa, Entamoeba invadens
CEQGYTLMYRTVNSQKQY

SEQ ID NO: 2814714 - protein, 26 aa, Entamoeba invadens
CERFKYKRFLFFEKSYKTTYLSYTAC

SEQ ID NO: 2814715 - protein, 26 aa, Entamoeba invadens
CERNNIHRYLLFLPTETNSGNFQNTN

SEQ ID NO: 2814716 - protein, 22 aa, Entamoeba invadens
CESCIDVIMPLKSTFYCMSNVL

SEQ ID NO: 2814717 - protein, 22 aa, Entamoeba invadens
CESCIDVIMPLKSTLYCMSNVP

SEQ ID NO: 2814718 - protein, 18 aa, Entamoeba invadens
CESNYYPKQGRCVPCDYG

SEQ ID NO: 2814719 - protein, 28 aa, Entamoeba invadens
CETHKIKLTLLWSGLQTLPALGCCALTT

SEQ ID NO: 2814720 - protein, 18 aa, Entamoeba invadens
CEVICFVFLIVFQGSFTN

SEQ ID NO: 2814721 - protein, 24 aa, Entamoeba invadens
CEVIPEGIYHIIQLSWKQNPKERI

SEQ ID NO: 2814722 - protein, 24 aa, Entamoeba invadens
CEVVTAIPNCKLMFNLKATCAVCD

SEQ ID NO: 2814723 - protein, 26 aa, Entamoeba invadens
CEWVGKRNFNVILDEKFANLTTNRIN

SEQ ID NO: 2814724 - protein, 22 aa, Entamoeba invadens
CEYIVHFYGAVFIPSNVCMLTE

SEQ ID NO: 2814725 - protein, 22 aa, Entamoeba invadens
CEYPCTYCSNLTYCTKCNAYSY

SEQ ID NO: 2814726 - protein, 18 aa, Entamoeba invadens
CEYPLIYNKTNHSCYTSV

SEQ ID NO: 2814727 - protein, 18 aa, Entamoeba invadens
CEYVSVVMLLCLECNKSN

SEQ ID NO: 2814728 - protein, 19 aa, Entamoeba invadens
CFALETLPETISWTKIGSK

SEQ ID NO: 2814729 - protein, 17 aa, Entamoeba invadens
CFCNFQMLEPTILSLEM

SEQ ID NO: 2814730 - protein, 27 aa, Entamoeba invadens
CFDSFYSVNRFLPFKAPIVFSSSCKNI

SEQ ID NO: 2814731 - protein, 17 aa, Entamoeba invadens
CFDYTFYVLVNSSKIFI

SEQ ID NO: 2814732 - protein, 24 aa, Entamoeba invadens
CFEGYYLNFITGWCSPCNSSLCSI

SEQ ID NO: 2814733 - protein, 18 aa, Entamoeba invadens
CFEPYYLSDDNISCLLAY

SEQ ID NO: 2814734 - protein, 21 aa, Entamoeba invadens
CFEQLNMIPLIITSNPINIHV

SEQ ID NO: 2814735 - protein, 17 aa, Entamoeba invadens
CFFFRYVPDADNEDWGL

SEQ ID NO: 2814736 - protein, 17 aa, Entamoeba invadens
CFGCGAIVLLLTCVMFL

SEQ ID NO: 2814737 - protein, 26 aa, Entamoeba invadens
CFGKKLLSFWIVLGCFLFASFLIDQN

SEQ ID NO: 2814738 - protein, 24 aa, Entamoeba invadens
CFILPTIFFFVFWRFLRGTLNGTA

SEQ ID NO: 2814739 - protein, 17 aa, Entamoeba invadens
CFKSATTTYWYSLIGDG

SEQ ID NO: 2814740 - protein, 17 aa, Entamoeba invadens
CFLFVLVCSQNTNTEQE

SEQ ID NO: 2814741 - protein, 23 aa, Entamoeba invadens
CFMQAVIFLLRGFSVFATLLPCP

SEQ ID NO: 2814742 - protein, 19 aa, Entamoeba invadens
CFNATHCLSCRPILEFLNK

SEQ ID NO: 2814743 - protein, 19 aa, Entamoeba invadens
CFNATYCLSCRPILEFLNK

SEQ ID NO: 2814744 - protein, 17 aa, Entamoeba invadens
CFNSTHCLSCRPELEFL

SEQ ID NO: 2814745 - protein, 24 aa, Entamoeba invadens
CFNTKYILYYLFGTNKIVEFVLVI

SEQ ID NO: 2814746 - protein, 25 aa, Entamoeba invadens
CFRDDLIFVAYLYQRKIYPVDDMRM

SEQ ID NO: 2814747 - protein, 19 aa, Entamoeba invadens
CFSVITLFPFDIIRWIGFG

SEQ ID NO: 2814748 - protein, 20 aa, Entamoeba invadens
CFSVVLYRMLFGLAFGLIVY

SEQ ID NO: 2814749 - protein, 21 aa, Entamoeba invadens
CFVEVIDPSLVLNNCEYCEYD

SEQ ID NO: 2814750 - protein, 37 aa, Entamoeba invadens
CFYKPYVESVALPSLFMLVVIIVLTLVIYVLSCARCC

SEQ ID NO: 2814751 - protein, 24 aa, Entamoeba invadens
CGADYILVNRKCVYYTTVEFCMSA

SEQ ID NO: 2814752 - protein, 24 aa, Entamoeba invadens
CGDSIYIYDILKKKNKIYSQKLER

SEQ ID NO: 2814753 - protein, 23 aa, Entamoeba invadens
CGEDLLFSIFRLVNAFPTRERVN

SEQ ID NO: 2814754 - protein, 28 aa, Entamoeba invadens
CGFFFIAYSFLRFRLITLGFDIIPAAIN

SEQ ID NO: 2814755 - protein, 18 aa, Entamoeba invadens
CGGGYYLINGKCDTIPQC

SEQ ID NO: 2814756 - protein, 20 aa, Entamoeba invadens
CGICEDGYYALNGECNLFSN

SEQ ID NO: 2814757 - protein, 26 aa, Entamoeba invadens
CGIVGGIFTIFSLLDAFIFHTVGGLF

SEQ ID NO: 2814758 - protein, 28 aa, Entamoeba invadens
CGKQARLVYYLTSPIFVFITGATQLDTG

SEQ ID NO: 2814759 - protein, 24 aa, Entamoeba invadens
CGKSTIIGLLQRLYEPVDGKIMID

SEQ ID NO: 2814760 - protein, 18 aa, Entamoeba invadens
CGSGYYLESNKCIRIPNC

SEQ ID NO: 2814761 - protein, 18 aa, Entamoeba invadens
CGSSPPRSYFYKFTLNSA

SEQ ID NO: 2814762 - protein, 25 aa, Entamoeba invadens
CGVAAILVFGVWRKNKKRTPQTKFK

SEQ ID NO: 2814763 - protein, 17 aa, Entamoeba invadens
CGVGFYLSSMKICSTCS

SEQ ID NO: 2814764 - protein, 25 aa, Entamoeba invadens
CGVSFILRSILFTIGRMYVPDQFPY

SEQ ID NO: 2814765 - protein, 25 aa, Entamoeba invadens
CGYYFQPYSTIRFLVSDYKAWGYES

SEQ ID NO: 2814766 - protein, 24 aa, Entamoeba invadens
CGYYYVPYDVFKFGNTRFLNYGDD

SEQ ID NO: 2814767 - protein, 17 aa, Entamoeba invadens
CHECVGNFELLKGICVC

SEQ ID NO: 2814768 - protein, 22 aa, Entamoeba invadens
CHFNTKRCISCKLGFILMNGEC

SEQ ID NO: 2814769 - protein, 17 aa, Entamoeba invadens
CHLLCYYNRVWQIDNTS

SEQ ID NO: 2814770 - protein, 18 aa, Entamoeba invadens
CHLVCYYNRIWQVNNTDL

SEQ ID NO: 2814771 - protein, 18 aa, Entamoeba invadens
CHMDLDVYCFLIPAVQSF

SEQ ID NO: 2814772 - protein, 29 aa, Entamoeba invadens
CHNEIGEFILLFLALISGASAFSISQMDN

SEQ ID NO: 2814773 - protein, 18 aa, Entamoeba invadens
CHPGYVKVQGHCISLADA

SEQ ID NO: 2814774 - protein, 18 aa, Entamoeba invadens
CIAGYYPDSNGKCMLCDN

SEQ ID NO: 2814775 - protein, 21 aa, Entamoeba invadens
CIALMYALKFRKPKTQIYKEV

SEQ ID NO: 2814776 - protein, 37 aa, Entamoeba invadens
CICDGYNFNIWIFPGITLGLPFPYIVYDKQNRIIKVF

SEQ ID NO: 2814777 - protein, 35 aa, Entamoeba invadens
CIDAFLFLGGVSFYSWIISLILLPFCTVATLFLVY

SEQ ID NO: 2814778 - protein, 17 aa, Entamoeba invadens
CIDGCNDCLGLSTCLTC

SEQ ID NO: 2814779 - protein, 17 aa, Entamoeba invadens
CIDGFYLADEGKCSACN

SEQ ID NO: 2814780 - protein, 17 aa, Entamoeba invadens
CIDGFYLAGEGKCSACN

SEQ ID NO: 2814781 - protein, 17 aa, Entamoeba invadens
CIDGFYLTKEGTCSACN

SEQ ID NO: 2814782 - protein, 18 aa, Entamoeba invadens
CIEGYLLTKIGECEKCSS

SEQ ID NO: 2814783 - protein, 50 aa, Entamoeba invadens
CIEINKALFISLLTIGLVIFVSIIIAIIGLVIAFIMFKRKEKKKMKNICI

SEQ ID NO: 2814784 - protein, 50 aa, Entamoeba invadens
CIENKKLFVKVGVPILVIFFVLIIGITITIIFLFFFRQHKKAQIEASKVC

SEQ ID NO: 2814785 - protein, 32 aa, Entamoeba invadens
CIFKVMHYLRYAIIVFWLVCALGFCYPALKFL

SEQ ID NO: 2814786 - protein, 18 aa, Entamoeba invadens
CIFLIYRISYIYSDGHAN

SEQ ID NO: 2814787 - protein, 24 aa, Entamoeba invadens
CIFNLMKTWEKLSLAARVIAGISI

SEQ ID NO: 2814788 - protein, 29 aa, Entamoeba invadens
CIFRYALAFLIIRIFISLFTIIAIITATT

SEQ ID NO: 2814789 - protein, 24 aa, Entamoeba invadens
CIFSNLKFFFVILTHKLKTVGVYN

SEQ ID NO: 2814790 - protein, 24 aa, Entamoeba invadens
CIGINYLLWYYKFIPTDNMFFFIV

SEQ ID NO: 2814791 - protein, 18 aa, Entamoeba invadens
CIGLIFCCIPTFADTVHT

SEQ ID NO: 2814792 - protein, 33 aa, Entamoeba invadens
CIGNYWVAGFLFILSFVFFVMCTVFLVLEKIQD

SEQ ID NO: 2814793 - protein, 24 aa, Entamoeba invadens
CIGWCDAYPQDKYKYPWNIADLIS

SEQ ID NO: 2814794 - protein, 17 aa, Entamoeba invadens
CIHCSNLTFCTKCDQYS

SEQ ID NO: 2814795 - protein, 18 aa, Entamoeba invadens
CIHPITRKSFVDSTIVIT

SEQ ID NO: 2814796 - protein, 23 aa, Entamoeba invadens
CIIPAFIEKLNYKDALFSVAMET

SEQ ID NO: 2814797 - protein, 18 aa, Entamoeba invadens
CIIYLMYTVGILAVAQMK

SEQ ID NO: 2814798 - protein, 18 aa, Entamoeba invadens
CIIYYSVGQETPCYTIDY

SEQ ID NO: 2814799 - protein, 19 aa, Entamoeba invadens
CIKCKDAFYVNNKMCSPCN

SEQ ID NO: 2814800 - protein, 22 aa, Entamoeba invadens
CIKCYSKYFLNKVYPPQCESCG

SEQ ID NO: 2814801 - protein, 46 aa, Entamoeba invadens
CIKKINYGVIISVPILSLILLLVITFFIVLIPVIVISKRKERKKKE

SEQ ID NO: 2814802 - protein, 25 aa, Entamoeba invadens
CIKMGIWGCLICEPGYYIDGNKCVK

SEQ ID NO: 2814803 - protein, 36 aa, Entamoeba invadens
CIKQYPVSVIYVNGFLLLRVMFIKCSFTKLKKKIPT

SEQ ID NO: 2814804 - protein, 17 aa, Entamoeba invadens
CILCKPFSILQNKSCLL

SEQ ID NO: 2814805 - protein, 18 aa, Entamoeba invadens
CINGYHLDTKACIKCATG

SEQ ID NO: 2814806 - protein, 24 aa, Entamoeba invadens
CIPNKYMKALLFTVQYEGKGYVFI

SEQ ID NO: 2814807 - protein, 17 aa, Entamoeba invadens
CIQCDRGYYIINGVCVK

SEQ ID NO: 2814808 - protein, 29 aa, Entamoeba invadens
CIQVISLFPFFSRLFIRLFCSFYSYKVNK

SEQ ID NO: 2814809 - protein, 24 aa, Entamoeba invadens
CIRYPFMNFGYFVAAVLTFKIAIK

SEQ ID NO: 2814810 - protein, 18 aa, Entamoeba invadens
CISGFVFMRGSCRKCPTG

SEQ ID NO: 2814811 - protein, 23 aa, Entamoeba invadens
CISGWLGYFLRYSHPDIAKLTLY

SEQ ID NO: 2814812 - protein, 18 aa, Entamoeba invadens
CISGYFKDGPLCVKCPLN

SEQ ID NO: 2814813 - protein, 19 aa, Entamoeba invadens
CISGYGLDKKFNCSICPTG

SEQ ID NO: 2814814 - protein, 19 aa, Entamoeba invadens
CISGYYFEDDTCSKDELCV

SEQ ID NO: 2814815 - protein, 17 aa, Entamoeba invadens
CISGYYPSLGKCNKCDS

SEQ ID NO: 2814816 - protein, 48 aa, Entamoeba invadens
CISHKNYFMIIGVPVIVVVIVILIILVVAGILGFYISKKLKKIEKHRN

SEQ ID NO: 2814817 - protein, 33 aa, Entamoeba invadens
CISPFLERFANYPVYFIEAIKLYLLVSESVNQL

SEQ ID NO: 2814818 - protein, 17 aa, Entamoeba invadens
CITCKIGYTFNSTLNGC

SEQ ID NO: 2814819 - protein, 26 aa, Entamoeba invadens
CITTFFGFAVFAMITLGILIGMESLS

SEQ ID NO: 2814820 - protein, 22 aa, Entamoeba invadens
CIVCEESFVNGYYLADKEGHCK

SEQ ID NO: 2814821 - protein, 23 aa, Entamoeba invadens
CIYDRLFSLRKAIEKVVVLLYFG

SEQ ID NO: 2814822 - protein, 35 aa, Entamoeba invadens
CKDGNAILINTSEPTNYCITCQFGYTYNSTDGSCA

SEQ ID NO: 2814823 - protein, 26 aa, Entamoeba invadens
CKDGYYISGYFLFLKCIQCDPNCKTC

SEQ ID NO: 2814824 - protein, 32 aa, Entamoeba invadens
CKDLNSCITCKLNYFLIPSEMLTCQSYSGLVG

SEQ ID NO: 2814825 - protein, 19 aa, Entamoeba invadens
CKEGFLLTSSMCEKCEKQE

SEQ ID NO: 2814826 - protein, 17 aa, Entamoeba invadens
CKEGFMFDALNECKESG

SEQ ID NO: 2814827 - protein, 18 aa, Entamoeba invadens
CKEGYFKVNGNCFPCYSG

SEQ ID NO: 2814828 - protein, 18 aa, Entamoeba invadens
CKEGYFLEENMCHKCSEI

SEQ ID NO: 2814829 - protein, 24 aa, Entamoeba invadens
CKEKSLIYLNCEIVSSLNSKCLEC

SEQ ID NO: 2814830 - protein, 18 aa, Entamoeba invadens
CKETYYLDLTDKCGLDCP

SEQ ID NO: 2814831 - protein, 43 aa, Entamoeba invadens
CKFIDKYGYIIAFLLFVAISLPFLVIPVVIWINKFSCRQKDMY

SEQ ID NO: 2814832 - protein, 24 aa, Entamoeba invadens
CKGHFMECLTADTPMPGTSLYDNW

SEQ ID NO: 2814833 - protein, 24 aa, Entamoeba invadens
CKIPSQLFVISFDGQTQKLLFSKL

SEQ ID NO: 2814834 - protein, 18 aa, Entamoeba invadens
CKKCDYSCNYYGGCVGDK

SEQ ID NO: 2814835 - protein, 18 aa, Entamoeba invadens
CKKDCPDGYFAKDKVCTA

SEQ ID NO: 2814836 - protein, 36 aa, Entamoeba invadens
CKKYTSFQLVFNRFVRPYLYFLLEENVNYSRRIKVN

SEQ ID NO: 2814837 - protein, 25 aa, Entamoeba invadens
CKLLMNKFSIIKATRTWFLTESSVE

SEQ ID NO: 2814838 - protein, 20 aa, Entamoeba invadens
CKLLVAERSIRDFPLYNNNT

SEQ ID NO: 2814839 - protein, 18 aa, Entamoeba invadens
CKMVNFKIHWINCENNKV

SEQ ID NO: 2814840 - protein, 18 aa, Entamoeba invadens
CKPAMRFDLIRKKDKHVI

SEQ ID NO: 2814841 - protein, 19 aa, Entamoeba invadens
CKPGFWIEKFECVTCETCG

SEQ ID NO: 2814842 - protein, 19 aa, Entamoeba invadens
CKPTFYLESGVCKTVDCGS

SEQ ID NO: 2814843 - protein, 30 aa, Entamoeba invadens
CKQDQTTCLLCKYGYHWDNNSCTRCAPGCT

SEQ ID NO: 2814844 - protein, 18 aa, Entamoeba invadens
CKQNYLIVPQTKECLFYD

SEQ ID NO: 2814845 - protein, 24 aa, Entamoeba invadens
CKRCSVGYLYYKENWCISSNNVKC

SEQ ID NO: 2814846 - protein, 20 aa, Entamoeba invadens
CKSEFVLKLNMLCSHDTNCV

SEQ ID NO: 2814847 - protein, 19 aa, Entamoeba invadens
CKSTLNPFYGYEPAPNSSE

SEQ ID NO: 2814848 - protein, 17 aa, Entamoeba invadens
CKTCKPGYAYYPSTGCT

SEQ ID NO: 2814849 - protein, 22 aa, Entamoeba invadens
CKTIPNCKYLKIVKSKEQCLNC

SEQ ID NO: 2814850 - protein, 17 aa, Entamoeba invadens
CKYGFYQGENHTCLPST

SEQ ID NO: 2814851 - protein, 18 aa, Entamoeba invadens
CKYKRELIPLILSNKTIE

SEQ ID NO: 2814852 - protein, 18 aa, Entamoeba invadens
CLACDKEHMAIGFGTTQC

SEQ ID NO: 2814853 - protein, 17 aa, Entamoeba invadens
CLCIIIAFYYKTLKEKA

SEQ ID NO: 2814854 - protein, 21 aa, Entamoeba invadens
CLCLILFFSEFKNIYFQINVF

SEQ ID NO: 2814855 - protein, 25 aa, Entamoeba invadens
CLCVTGMFWYLYFKSPSAVFRVDDG

SEQ ID NO: 2814856 - protein, 19 aa, Entamoeba invadens
CLDGFYNKQNECFLCNETC

SEQ ID NO: 2814857 - protein, 18 aa, Entamoeba invadens
CLDGYLAQGYLKCESFNK

SEQ ID NO: 2814858 - protein, 18 aa, Entamoeba invadens
CLDGYYLDKMTCKKCEEP

SEQ ID NO: 2814859 - protein, 18 aa, Entamoeba invadens
CLDGYYLTNNSCNKCENN

SEQ ID NO: 2814860 - protein, 23 aa, Entamoeba invadens
CLECDKEHMAIGYGLTQCSQCVD

SEQ ID NO: 2814861 - protein, 21 aa, Entamoeba invadens
CLEFFFLQFVCVLMLRAFGVR

SEQ ID NO: 2814862 - protein, 21 aa, Entamoeba invadens
CLEFLLYFIELQENSKRYVYN

SEQ ID NO: 2814863 - protein, 20 aa, Entamoeba invadens
CLFCSKGYHLQTNGTCSLIN

SEQ ID NO: 2814864 - protein, 26 aa, Entamoeba invadens
CLFNNSPFFAFIFQQNFKSFEFLLNI

SEQ ID NO: 2814865 - protein, 21 aa, Entamoeba invadens
CLFSEALMYFWIGENKKKFLI

SEQ ID NO: 2814866 - protein, 19 aa, Entamoeba invadens
CLGEDMYLNVYKTCGKCET

SEQ ID NO: 2814867 - protein, 21 aa, Entamoeba invadens
CLGSLSTLLLFHQVSKKCDEA

SEQ ID NO: 2814868 - protein, 29 aa, Entamoeba invadens
CLHNKKIQYVLFSELIYTTKPFIRSVLAL

SEQ ID NO: 2814869 - protein, 18 aa, Entamoeba invadens
CLIALTLSAESCYMIDET

SEQ ID NO: 2814870 - protein, 17 aa, Entamoeba invadens
CLLCAKGYYANGSSCVK

SEQ ID NO: 2814871 - protein, 17 aa, Entamoeba invadens
CLLFCTNAVDSTDCYQL

SEQ ID NO: 2814872 - protein, 20 aa, Entamoeba invadens
CLLFGTLIIDCVISVSMPAY

SEQ ID NO: 2814873 - protein, 17 aa, Entamoeba invadens
CLLYNSTGFCTSCKLNY

SEQ ID NO: 2814874 - protein, 27 aa, Entamoeba invadens
CLNEDFRFTTLTIFGSLLISSPNVITI

SEQ ID NO: 2814875 - protein, 19 aa, Entamoeba invadens
CLPCDTSCTFDFCDTFIGC

SEQ ID NO: 2814876 - protein, 18 aa, Entamoeba invadens
CLQCDKDHMAIGFGTTQC

SEQ ID NO: 2814877 - protein, 18 aa, Entamoeba invadens
CLQCSDGYFLTNLSLIST

SEQ ID NO: 2814878 - protein, 50 aa, Entamoeba invadens
CLQYTNLGLALGLPISLVFILIIMIMFGLFVIIFFIRKHQYKKMKERTVC

SEQ ID NO: 2814879 - protein, 19 aa, Entamoeba invadens
CLRCEDLYFYSSSTNKCEK

SEQ ID NO: 2814880 - protein, 17 aa, Entamoeba invadens
CLRCKNSYYFNSSTNKC

SEQ ID NO: 2814881 - protein, 22 aa, Entamoeba invadens
CLRCLDGYYLDKMTCKKCEEPC

SEQ ID NO: 2814882 - protein, 25 aa, Entamoeba invadens
CLRCSDGYYIFNSFCVKCEYPCTYC

SEQ ID NO: 2814883 - protein, 27 aa, Entamoeba invadens
CLRCSDGYYIFNSLCVKCEYPCKHCSN

SEQ ID NO: 2814884 - protein, 28 aa, Entamoeba invadens
CLRQLSDVPLLFLIFSRMLQAQSEMGEE

SEQ ID NO: 2814885 - protein, 22 aa, Entamoeba invadens
CLRRGMCKPIGGQTLYGKLDNT

SEQ ID NO: 2814886 - protein, 26 aa, Entamoeba invadens
CLSCATNYVFLPSPLVGCESCISFDS

SEQ ID NO: 2814887 - protein, 18 aa, Entamoeba invadens
CLSCFTNYFLLANNTQCI

SEQ ID NO: 2814888 - protein, 24 aa, Entamoeba invadens
CLSCKDGYYQILSESALCQDYTTL

SEQ ID NO: 2814889 - protein, 26 aa, Entamoeba invadens
CLSCQTEYFKLPGSKSKLWVSYDNLT

SEQ ID NO: 2814890 - protein, 20 aa, Entamoeba invadens
CLSCTPKYNLSIDKLSCFKH

SEQ ID NO: 2814891 - protein, 36 aa, Entamoeba invadens
CLSCYNATYCISCHSKYFLDLFMKCQTLGELANRCE

SEQ ID NO: 2814892 - protein, 19 aa, Entamoeba invadens
CLSFITLALASCCIVLLFV

SEQ ID NO: 2814893 - protein, 18 aa, Entamoeba invadens
CLSGYFRSYAQTQNKCLA

SEQ ID NO: 2814894 - protein, 31 aa, Entamoeba invadens
CLSPSMATLLIPIFPLLITPFLSVMNSNHEN

SEQ ID NO: 2814895 - protein, 18 aa, Entamoeba invadens
CLSTYYLEDGICKQLPNC

SEQ ID NO: 2814896 - protein, 17 aa, Entamoeba invadens
CLTCAEAFYFDESTKQC

SEQ ID NO: 2814897 - protein, 19 aa, Entamoeba invadens
CLTCERGIYYNSGLCTVCD

SEQ ID NO: 2814898 - protein, 25 aa, Entamoeba invadens
CLTCGPLYFMTIVGECLLKSSVEGC

SEQ ID NO: 2814899 - protein, 22 aa, Entamoeba invadens
CLTEDFWFTKDLSLGSLLIKSS

SEQ ID NO: 2814900 - protein, 33 aa, Entamoeba invadens
CLVFSIMGSLFTTLIYCWFKAKKINIVHQNLPF

SEQ ID NO: 2814901 - protein, 17 aa, Entamoeba invadens
CLVGTYTPTTGTSVCVS

SEQ ID NO: 2814902 - protein, 29 aa, Entamoeba invadens
CLVKALEQMPPNIKFFDLTAQTHKTLNTT

SEQ ID NO: 2814903 - protein, 30 aa, Entamoeba invadens
CLYITNYRIVFIPDTLPTLVQKRFLRYSGI

SEQ ID NO: 2814904 - protein, 24 aa, Entamoeba invadens
CMFFPMISVYLTYLFTHTPLTVDL

SEQ ID NO: 2814905 - protein, 22 aa, Entamoeba invadens
CMKCPAGYYSYFSGSSGCTPCA

SEQ ID NO: 2814906 - protein, 18 aa, Entamoeba invadens
CMKGYYKTGGYCYACYTG

SEQ ID NO: 2814907 - protein, 18 aa, Entamoeba invadens
CMNGYYPDSEGECNKCDT

SEQ ID NO: 2814908 - protein, 28 aa, Entamoeba invadens
CMNKPCQFVVRITLWMKESVLKCFDYTF

SEQ ID NO: 2814909 - protein, 29 aa, Entamoeba invadens
CMQISGNIFPLFMLKDYILKTVHLNKKLI

SEQ ID NO: 2814910 - protein, 25 aa, Entamoeba invadens
CMRCKDGYYIINSLCVRCEYPCTQC

SEQ ID NO: 2814911 - protein, 21 aa, Entamoeba invadens
CMVTEFAAFRSLQDLIKHKKS

SEQ ID NO: 2814912 - protein, 18 aa, Entamoeba invadens
CNAAYYTESIFQCVYGVE

SEQ ID NO: 2814913 - protein, 20 aa, Entamoeba invadens
CNAPYVLNNDYLECLLAYSN

SEQ ID NO: 2814914 - protein, 18 aa, Entamoeba invadens
CNDGYYLENNKCVKCANN

SEQ ID NO: 2814915 - protein, 38 aa, Entamoeba invadens
CNDISYLFMSLVFIALLLIFFACVFIATSIGIRFIIRK

SEQ ID NO: 2814916 - protein, 19 aa, Entamoeba invadens
CNEGYYIKTPYCEKCPQNC

SEQ ID NO: 2814917 - protein, 23 aa, Entamoeba invadens
CNFLMGRVIVFKAINYERLMILM

SEQ ID NO: 2814918 - protein, 24 aa, Entamoeba invadens
CNGRIDAVWIWVNGSDPTWCSNLN

SEQ ID NO: 2814919 - protein, 28 aa, Entamoeba invadens
CNIELIPEFFYLPDFLKNENLFNFGVNP

SEQ ID NO: 2814920 - protein, 17 aa, Entamoeba invadens
CNILVDPQIVVLKKGFA

SEQ ID NO: 2814921 - protein, 19 aa, Entamoeba invadens
CNIYYPTTKTFGKGALLCA

SEQ ID NO: 2814922 - protein, 22 aa, Entamoeba invadens
CNKCQIGYYKYLRECRPCKDDC

SEQ ID NO: 2814923 - protein, 23 aa, Entamoeba invadens
CNKCTFWYIINPYTFNCDQEVSW

SEQ ID NO: 2814924 - protein, 17 aa, Entamoeba invadens
CNKCYEICKTCSNAWSC

SEQ ID NO: 2814925 - protein, 24 aa, Entamoeba invadens
CNKFGWYFSALQLFDTFIPLVPVS

SEQ ID NO: 2814926 - protein, 23 aa, Entamoeba invadens
CNKLLVELLKRYPDMLTSSMQRC

SEQ ID NO: 2814927 - protein, 17 aa, Entamoeba invadens
CNKNPIRFDLEEDPPIG

SEQ ID NO: 2814928 - protein, 18 aa, Entamoeba invadens
CNLGRYLKYNNNCEICDI

SEQ ID NO: 2814929 - protein, 18 aa, Entamoeba invadens
CNLNYYMSAPNTCTSCHL

SEQ ID NO: 2814930 - protein, 18 aa, Entamoeba invadens
CNNGYYLENNKCVKCSNN

SEQ ID NO: 2814931 - protein, 23 aa, Entamoeba invadens
CNNGYYLTQVSKCLNGYCLKCNS

SEQ ID NO: 2814932 - protein, 17 aa, Entamoeba invadens
CNNMYPGLQILFEDDVE

SEQ ID NO: 2814933 - protein, 47 aa, Entamoeba invadens
CNNQYPNWLIAVISICVILFCVFIGVIIMLIIFQVIMHRYKKNREEK

SEQ ID NO: 2814934 - protein, 26 aa, Entamoeba invadens
CNQIYVKWCYSCLNGYYIKEDGLVKI

SEQ ID NO: 2814935 - protein, 27 aa, Entamoeba invadens
CNQNTWFNTSVFFSYDFTFTSTSALQW

SEQ ID NO: 2814936 - protein, 23 aa, Entamoeba invadens
CNQSYYRLYNSLSKLCLPYESLT

SEQ ID NO: 2814937 - protein, 19 aa, Entamoeba invadens
CNSSFYLRENKCLPIIEKC

SEQ ID NO: 2814938 - protein, 18 aa, Entamoeba invadens
CNSSYYLTITGMCKPKSD

SEQ ID NO: 2814939 - protein, 23 aa, Entamoeba invadens
CNTKSCLKCNLGYVLIGQDGSYS

SEQ ID NO: 2814940 - protein, 19 aa, Entamoeba invadens
CNTNYYRLSTTQKLCLPFS

SEQ ID NO: 2814941 - protein, 18 aa, Entamoeba invadens
CNVGYSYDLYNKNCLICP

SEQ ID NO: 2814942 - protein, 44 aa, Entamoeba invadens
CPAETFSWIFMSPLSPSNLLKPKFLPLVPLLFLNDDKAETSVTP

SEQ ID NO: 2814943 - protein, 19 aa, Entamoeba invadens
CPAGRYLTNLNQCPLCAAG

SEQ ID NO: 2814944 - protein, 18 aa, Entamoeba invadens
CPDSYYFYKNKCFECSNG

SEQ ID NO: 2814945 - protein, 19 aa, Entamoeba invadens
CPEYLYDIAAIDDKYRISY

SEQ ID NO: 2814946 - protein, 20 aa, Entamoeba invadens
CPKYVFHFDPQVFILRPNSS

SEQ ID NO: 2814947 - protein, 20 aa, Entamoeba invadens
CPKYVFHFDPQVFILRPYSS

SEQ ID NO: 2814948 - protein, 17 aa, Entamoeba invadens
CPKYVFHFEPQVAILRP

SEQ ID NO: 2814949 - protein, 17 aa, Entamoeba invadens
CPLGNDVDWYITPLYNV

SEQ ID NO: 2814950 - protein, 17 aa, Entamoeba invadens
CPLWSLMYEYIGNIFYA

SEQ ID NO: 2814951 - protein, 18 aa, Entamoeba invadens
CPNGYYLNKNSCEKCLND

SEQ ID NO: 2814952 - protein, 18 aa, Entamoeba invadens
CPNGYYLNKNSCEKCVND

SEQ ID NO: 2814953 - protein, 17 aa, Entamoeba invadens
CPNLRLRKNWNPCQTHI

SEQ ID NO: 2814954 - protein, 23 aa, Entamoeba invadens
CPPHFVDCLTDKTPLPGSSIFKN

SEQ ID NO: 2814955 - protein, 25 aa, Entamoeba invadens
CPQDLLLVIFFTYVFFFESTTENKE

SEQ ID NO: 2814956 - protein, 17 aa, Entamoeba invadens
CPQKCLSCYSPYGCTAC

SEQ ID NO: 2814957 - protein, 19 aa, Entamoeba invadens
CQDGLFLNTNTCGHCPYCD

SEQ ID NO: 2814958 - protein, 18 aa, Entamoeba invadens
CQDGYYLQNNGSCSHVSD

SEQ ID NO: 2814959 - protein, 22 aa, Entamoeba invadens
CQDVYNPLLNNLTFYDDGKATL

SEQ ID NO: 2814960 - protein, 22 aa, Entamoeba invadens
CQECISGYYYSLSTSLCLSQDE

SEQ ID NO: 2814961 - protein, 43 aa, Entamoeba invadens
CQELKKVWIYVVVSIAVLVFLLVVLFLLSVIALILFKKKKDMN

SEQ ID NO: 2814962 - protein, 19 aa, Entamoeba invadens
CQIGYFPEIQCKSCELIYG

SEQ ID NO: 2814963 - protein, 23 aa, Entamoeba invadens
CQKCSKNYLLLETTQLCVASCTN

SEQ ID NO: 2814964 - protein, 50 aa, Entamoeba invadens
CQKDFNYAAVITPIVIGVILILIIIFVFLLVYFLVKKHNSKYYKNLTRDQ

SEQ ID NO: 2814965 - protein, 25 aa, Entamoeba invadens
CQKDYGYPIMKFEIDWDRVPTDDTR

SEQ ID NO: 2814966 - protein, 49 aa, Entamoeba invadens
CQKHAVSWVIAIIVVLCVFVLLCVMLGIIFLAFYFLKKSMKNQRPKDVN

SEQ ID NO: 2814967 - protein, 18 aa, Entamoeba invadens
CQMGYYLSGSNCKKCVSG

SEQ ID NO: 2814968 - protein, 23 aa, Entamoeba invadens
CQNCINVLLAGESARICTECKDG

SEQ ID NO: 2814969 - protein, 27 aa, Entamoeba invadens
CQNKSFLFGVGLPQFSKLVLHIMKIET

SEQ ID NO: 2814970 - protein, 30 aa, Entamoeba invadens
CQNRGYGWKLYWDGLCDWVLFTGECCENLH

SEQ ID NO: 2814971 - protein, 27 aa, Entamoeba invadens
CQNSVYYFKTSPSNCICILKSGTIDDN

SEQ ID NO: 2814972 - protein, 18 aa, Entamoeba invadens
CQNYYYSVVNTSGLFCVE

SEQ ID NO: 2814973 - protein, 23 aa, Entamoeba invadens
CQRCINGYYYSKGECLKCEYPCI

SEQ ID NO: 2814974 - protein, 24 aa, Entamoeba invadens
CQRCYDGYFLSDTICVKCLNDCLS

SEQ ID NO: 2814975 - protein, 23 aa, Entamoeba invadens
CQSCTLGKYILKNGVCLPKDASC

SEQ ID NO: 2814976 - protein, 18 aa, Entamoeba invadens
CQSMDPHIPITPTNPLYL

SEQ ID NO: 2814977 - protein, 18 aa, Entamoeba invadens
CQTGYYLTDPYCFKCAEN

SEQ ID NO: 2814978 - protein, 23 aa, Entamoeba invadens
CQTLGDLAARCSVALPTGGGCAI

SEQ ID NO: 2814979 - protein, 22 aa, Entamoeba invadens
CRAFINPFVNWQVPGTRFVCNF

SEQ ID NO: 2814980 - protein, 18 aa, Entamoeba invadens
CRENSGFYLLNGRCVACD

SEQ ID NO: 2814981 - protein, 46 aa, Entamoeba invadens
CRKKAVWWVITLVILFGVFVLTSFIIIFISTFKCIFKKIHTKELEK

SEQ ID NO: 2814982 - protein, 37 aa, Entamoeba invadens
CRLNVVSIFFLSVFCIILLLALLIGSAVLISYNVIKK

SEQ ID NO: 2814983 - protein, 17 aa, Entamoeba invadens
CRLQLDVPVVKYSEDNV

SEQ ID NO: 2814984 - protein, 19 aa, Entamoeba invadens
CRLSFPHCELCDPSKWGCM

SEQ ID NO: 2814985 - protein, 25 aa, Entamoeba invadens
CRNIKLIAYFMFELYGRRLNELYMS

SEQ ID NO: 2814986 - protein, 18 aa, Entamoeba invadens
CRNIKTCTFCELNHFLLT

SEQ ID NO: 2814987 - protein, 21 aa, Entamoeba invadens
CRNREAAFSNFLAHILIEHNF

SEQ ID NO: 2814988 - protein, 24 aa, Entamoeba invadens
CRNWLHYLWMIFLGGFAIICCSLF

SEQ ID NO: 2814989 - protein, 17 aa, Entamoeba invadens
CRTIMLPKCLASTFVEV

SEQ ID NO: 2814990 - protein, 18 aa, Entamoeba invadens
CSANCLTCYESSTFCLSC

SEQ ID NO: 2814991 - protein, 24 aa, Entamoeba invadens
CSCWSYFPKTPFSSILSAPIIVLV

SEQ ID NO: 2814992 - protein, 17 aa, Entamoeba invadens
CSDDSSLILLWRDELLL

SEQ ID NO: 2814993 - protein, 17 aa, Entamoeba invadens
CSDFFLRNSANPNFTIS

SEQ ID NO: 2814994 - protein, 19 aa, Entamoeba invadens
CSDGFYLDNLKCIPCENNC

SEQ ID NO: 2814995 - protein, 17 aa, Entamoeba invadens
CSDGYFLTNLSLISTCE

SEQ ID NO: 2814996 - protein, 17 aa, Entamoeba invadens
CSDITITAWKAFWGRKK

SEQ ID NO: 2814997 - protein, 21 aa, Entamoeba invadens
CSEHLCEWIDLIFGSKQRGKA

SEQ ID NO: 2814998 - protein, 21 aa, Entamoeba invadens
CSENRISWYNPGHPIQSIEIP

SEQ ID NO: 2814999 - protein, 18 aa, Entamoeba invadens
CSFEFLLLGFGNSTFFVI

SEQ ID NO: 2815000 - protein, 18 aa, Entamoeba invadens
CSFEYFLLGFGHTTYMTI

SEQ ID NO: 2815001 - protein, 20 aa, Entamoeba invadens
CSFLYLVSAIYFLFTWGMTT

SEQ ID NO: 2815002 - protein, 20 aa, Entamoeba invadens
CSFLYNCSEWRKQNGYRCMS

SEQ ID NO: 2815003 - protein, 19 aa, Entamoeba invadens
CSGAFETLVAALILAFMLI

SEQ ID NO: 2815004 - protein, 17 aa, Entamoeba invadens
CSGCTTGYYLNGDKCTK

SEQ ID NO: 2815005 - protein, 21 aa, Entamoeba invadens
CSICPASFYSGGGTSLCSKCA

SEQ ID NO: 2815006 - protein, 23 aa, Entamoeba invadens
CSICPASYYSIGGTSLCSKCETN

SEQ ID NO: 2815007 - protein, 17 aa, Entamoeba invadens
CSIFLFTLLTMIFVRIV

SEQ ID NO: 2815008 - protein, 20 aa, Entamoeba invadens
CSILRLYSLLCGLRKPNSME

SEQ ID NO: 2815009 - protein, 62 aa, Entamoeba invadens
CSKCAFWHKPSVDGTFCDLSPVWWVILLIILFILFVLIILATTIGIIFKKILKKLRKKEVEK

SEQ ID NO: 2815010 - protein, 21 aa, Entamoeba invadens
CSKCAFWYITSKDGTLCESQI

SEQ ID NO: 2815011 - protein, 23 aa, Entamoeba invadens
CSKCNFWHIPSENGTYCISKAVW

SEQ ID NO: 2815012 - protein, 24 aa, Entamoeba invadens
CSKCNFWHIPSSDGTYCITKSVWW

SEQ ID NO: 2815013 - protein, 20 aa, Entamoeba invadens
CSKCTFWHVPSDDGTYCNSK

SEQ ID NO: 2815014 - protein, 21 aa, Entamoeba invadens
CSKCTFWHVPSDDGTYCNSKA

SEQ ID NO: 2815015 - protein, 24 aa, Entamoeba invadens
CSKCTFWYTPSENGTFCVKKAVWW

SEQ ID NO: 2815016 - protein, 23 aa, Entamoeba invadens
CSKFSVLENIKFYFVTDLPDDIE

SEQ ID NO: 2815017 - protein, 26 aa, Entamoeba invadens
CSKKKNMMIIFHTPNNPKYIFHFEPQ

SEQ ID NO: 2815018 - protein, 22 aa, Entamoeba invadens
CSKLRVLYKLNWLQASDLDDIH

SEQ ID NO: 2815019 - protein, 28 aa, Entamoeba invadens
CSKSQTYDFFFYRPTPPDFYVKEDKLVI

SEQ ID NO: 2815020 - protein, 29 aa, Entamoeba invadens
CSKSQTYDFFFYRPTPPTFYAKEDKLVIH

SEQ ID NO: 2815021 - protein, 22 aa, Entamoeba invadens
CSLCADTYFYYKKDSDLCITYD

SEQ ID NO: 2815022 - protein, 23 aa, Entamoeba invadens
CSLCADTYFYYKKDSDLCITYDK

SEQ ID NO: 2815023 - protein, 22 aa, Entamoeba invadens
CSLCADTYFYYKRDSDLCITYD

SEQ ID NO: 2815024 - protein, 17 aa, Entamoeba invadens
CSLCPAGYFSNGGTQSC

SEQ ID NO: 2815025 - protein, 25 aa, Entamoeba invadens
CSLFCTFFSIWGTLFLVVILATCDN

SEQ ID NO: 2815026 - protein, 28 aa, Entamoeba invadens
CSMKSLPSFWYNIQLTESVDLIATTNSI

SEQ ID NO: 2815027 - protein, 21 aa, Entamoeba invadens
CSMYYNIFDCMTYLDNFGCEE

SEQ ID NO: 2815028 - protein, 18 aa, Entamoeba invadens
CSPGYIRSTFNSEFGCIS

SEQ ID NO: 2815029 - protein, 21 aa, Entamoeba invadens
CSPSFVRKCIKCVAGSYPQTA

SEQ ID NO: 2815030 - protein, 21 aa, Entamoeba invadens
CSQCIIGYYLDNNKCYSCQTI

SEQ ID NO: 2815031 - protein, 23 aa, Entamoeba invadens
CSQCILGYFLTQCGDWPVTCRKV

SEQ ID NO: 2815032 - protein, 17 aa, Entamoeba invadens
CSQCSEGYYLDSTKNLC

SEQ ID NO: 2815033 - protein, 34 aa, Entamoeba invadens
CSQDNRMCLKCNQGYYPLKVYPFTCELCNETCKD

SEQ ID NO: 2815034 - protein, 23 aa, Entamoeba invadens
CSQKDHEYIPRRNLQTLFNCSTN

SEQ ID NO: 2815035 - protein, 33 aa, Entamoeba invadens
CSQKLVKRISGCDGFVLVIVCGTTVFGVVVKAK

SEQ ID NO: 2815036 - protein, 32 aa, Entamoeba invadens
CSQNILKFDKLKFLKTYTLLNALNLDGNYIEL

SEQ ID NO: 2815037 - protein, 52 aa, Entamoeba invadens
CSRMSSALRNFLFWGIGCIAYLLLYLFLLFLIVILYVRITQKIKKELDDEKL

SEQ ID NO: 2815038 - protein, 45 aa, Entamoeba invadens
CSRPKYELIIPLTVLGVVLIIVFLVGVGLLIWRERRRYVYEVDQK

SEQ ID NO: 2815039 - protein, 17 aa, Entamoeba invadens
CSRVTYCYACDKGYYTI

SEQ ID NO: 2815040 - protein, 22 aa, Entamoeba invadens
CSSCLPNYYSYLGSSSCIECDS

SEQ ID NO: 2815041 - protein, 17 aa, Entamoeba invadens
CSSEYFCTSCETTKVLL

SEQ ID NO: 2815042 - protein, 18 aa, Entamoeba invadens
CSSGLIFKNPLSTICEPC

SEQ ID NO: 2815043 - protein, 18 aa, Entamoeba invadens
CSSGYYLKGSTCDVCNNV

SEQ ID NO: 2815044 - protein, 27 aa, Entamoeba invadens
CSSQPYILKLFFFILVGEIPNKSRILF

SEQ ID NO: 2815045 - protein, 28 aa, Entamoeba invadens
CSSQTNCISCISAYYWLDTSTNKCKHCS

SEQ ID NO: 2815046 - protein, 26 aa, Entamoeba invadens
CSVCEYPYYPFNEKCLPVDNLFGCVE

SEQ ID NO: 2815047 - protein, 18 aa, Entamoeba invadens
CSVGYYLEKRRCHKCMEH

SEQ ID NO: 2815048 - protein, 26 aa, Entamoeba invadens
CSVKRLLPPLSTILACWVSRLTVWSP

SEQ ID NO: 2815049 - protein, 33 aa, Entamoeba invadens
CSVKYFFDISFMRLFYILTLICVTATLSCVILI

SEQ ID NO: 2815050 - protein, 33 aa, Entamoeba invadens
CSVTFKGLFNVFSFRTITLGLHPKFSFYDYQTY

SEQ ID NO: 2815051 - protein, 18 aa, Entamoeba invadens
CSYGYGLNVRSGLCKPCY

SEQ ID NO: 2815052 - protein, 17 aa, Entamoeba invadens
CSYYIHYYILSFTNLFT

SEQ ID NO: 2815053 - protein, 18 aa, Entamoeba invadens
CTACLVGTYTPTTGTSVC

SEQ ID NO: 2815054 - protein, 37 aa, Entamoeba invadens
CTCGGYSLQIWIHPGVYLGLPFPYPISNKNNQIEKVF

SEQ ID NO: 2815055 - protein, 31 aa, Entamoeba invadens
CTCSYYLIIVVVFILVAFMCFHKYFVRSSIE

SEQ ID NO: 2815056 - protein, 34 aa, Entamoeba invadens
CTCSYYLIIVVVVVLIVFLAFHKYFVRSSIEMQR

SEQ ID NO: 2815057 - protein, 24 aa, Entamoeba invadens
CTDCNDGFYLNDKTCTKCPTNCSA

SEQ ID NO: 2815058 - protein, 24 aa, Entamoeba invadens
CTDDIFFYVTVMTALLCLSGILTF

SEQ ID NO: 2815059 - protein, 21 aa, Entamoeba invadens
CTDLLICTKCLDNYIKMENGN

SEQ ID NO: 2815060 - protein, 27 aa, Entamoeba invadens
CTETILPLLIDIRLWRGVEYLFDYFVQ

SEQ ID NO: 2815061 - protein, 22 aa, Entamoeba invadens
CTFGKGAFLNCQKLTTVTLTAH

SEQ ID NO: 2815062 - protein, 27 aa, Entamoeba invadens
CTFVTRRIPYHAIFGNIIYGVVVVDLK

SEQ ID NO: 2815063 - protein, 21 aa, Entamoeba invadens
CTGALLLRKRVCVAPLSERCE

SEQ ID NO: 2815064 - protein, 22 aa, Entamoeba invadens
CTGCNEGYYLKGNTCTRCGSNC

SEQ ID NO: 2815065 - protein, 25 aa, Entamoeba invadens
CTGFLLYFLILFNNPMVYLEYQFRN

SEQ ID NO: 2815066 - protein, 19 aa, Entamoeba invadens
CTGGVVGILVACLAVALFF

SEQ ID NO: 2815067 - protein, 25 aa, Entamoeba invadens
CTGIFIRMLIFGASKWIIAESPLFY

SEQ ID NO: 2815068 - protein, 23 aa, Entamoeba invadens
CTIDSCETCLPRYVLKDHKCVLC

SEQ ID NO: 2815069 - protein, 25 aa, Entamoeba invadens
CTIGVDVCLKCGGGYYLINGKCDTI

SEQ ID NO: 2815070 - protein, 25 aa, Entamoeba invadens
CTIGVDVCLKCGGGYYLINGKCGTI

SEQ ID NO: 2815071 - protein, 18 aa, Entamoeba invadens
CTIGYYPDEASGKCVACS

SEQ ID NO: 2815072 - protein, 21 aa, Entamoeba invadens
CTKCAFWFIPSPSGTSCQSKA

SEQ ID NO: 2815073 - protein, 26 aa, Entamoeba invadens
CTKCDIERCYSCELNYILLDGICIAK

SEQ ID NO: 2815074 - protein, 22 aa, Entamoeba invadens
CTKCNTKFNLVADTLKCVNKCS

SEQ ID NO: 2815075 - protein, 22 aa, Entamoeba invadens
CTKCTDGYKMQLSTMTCVKGDE

SEQ ID NO: 2815076 - protein, 17 aa, Entamoeba invadens
CTKNLCLLCLSNLYFLD

SEQ ID NO: 2815077 - protein, 47 aa, Entamoeba invadens
CTKVNLALIIPLVVVGLILIIIIIAVIIFFVWRRKRQTMKEREKEIK

SEQ ID NO: 2815078 - protein, 48 aa, Entamoeba invadens
CTKVNLALIIPLVVVGLLLIIIVIAIIIFFVWRRKRKTMKEREKEIKP

SEQ ID NO: 2815079 - protein, 20 aa, Entamoeba invadens
CTLCKTGYFLTIDNICALCT

SEQ ID NO: 2815080 - protein, 27 aa, Entamoeba invadens
CTLEVILSLIWLFYLVQWSACAGLLVM

SEQ ID NO: 2815081 - protein, 20 aa, Entamoeba invadens
CTLIPKCVLCTLYGECRECI

SEQ ID NO: 2815082 - protein, 17 aa, Entamoeba invadens
CTLLIPQMSTLNSYSCP

SEQ ID NO: 2815083 - protein, 17 aa, Entamoeba invadens
CTMCINGKYPSSSSPFS

SEQ ID NO: 2815084 - protein, 25 aa, Entamoeba invadens
CTMNLSDKIMIISLNLKSGKQNSTS

SEQ ID NO: 2815085 - protein, 17 aa, Entamoeba invadens
CTNDATCLLYNVDYFLL

SEQ ID NO: 2815086 - protein, 21 aa, Entamoeba invadens
CTQCNTNFYLVADTSKCVEKC

SEQ ID NO: 2815087 - protein, 40 aa, Entamoeba invadens
CTRLSPAMTNFLFWGIGAIVYMVMYILGVIICLTMHYLLT

SEQ ID NO: 2815088 - protein, 25 aa, Entamoeba invadens
CTSCKMYYYLTNGYCQPCDSKCFKC

SEQ ID NO: 2815089 - protein, 25 aa, Entamoeba invadens
CTSCNNSFILLPTSSLISTCVPFNE

SEQ ID NO: 2815090 - protein, 25 aa, Entamoeba invadens
CTSCNNSFILLPTSSLLSTCVPFNE

SEQ ID NO: 2815091 - protein, 22 aa, Entamoeba invadens
CTSCYNGTYLYDNKCLPCDTSC

SEQ ID NO: 2815092 - protein, 24 aa, Entamoeba invadens
CTSCYNGYYFYYSSTYNRTCIPCM

SEQ ID NO: 2815093 - protein, 18 aa, Entamoeba invadens
CTSFYRPPELFLGEERYD

SEQ ID NO: 2815094 - protein, 24 aa, Entamoeba invadens
CTSIPKCVLCTLYGECRQCISGHY

SEQ ID NO: 2815095 - protein, 26 aa, Entamoeba invadens
CTSIPKCVLCTLYGECRQCIYGHYLD

SEQ ID NO: 2815096 - protein, 17 aa, Entamoeba invadens
CTSLTHVNFPLVKSISS

SEQ ID NO: 2815097 - protein, 21 aa, Entamoeba invadens
CTTCFDGYYRSGNSCFACLEG

SEQ ID NO: 2815098 - protein, 23 aa, Entamoeba invadens
CTTCNSGYILTDGKCTPCRAGTY

SEQ ID NO: 2815099 - protein, 23 aa, Entamoeba invadens
CTTRIRDLRIPYSVWFASSRSIL

SEQ ID NO: 2815100 - protein, 17 aa, Entamoeba invadens
CTYYYCRECYPYFFRNS

SEQ ID NO: 2815101 - protein, 17 aa, Entamoeba invadens
CVAVLVVIIITIVTIVF

SEQ ID NO: 2815102 - protein, 25 aa, Entamoeba invadens
CVAYPIIMYPTCAGIIRYIPRNWKF

SEQ ID NO: 2815103 - protein, 26 aa, Entamoeba invadens
CVAYPIIMYPTCAGIIRYIPRNWKFM

SEQ ID NO: 2815104 - protein, 39 aa, Entamoeba invadens
CVDDKKLFLKVGVPILVIFFVIIFGTISVILLQKTKKEE

SEQ ID NO: 2815105 - protein, 18 aa, Entamoeba invadens
CVDGYYLSSYECLSCSST

SEQ ID NO: 2815106 - protein, 18 aa, Entamoeba invadens
CVDGYYSLGGTLSCLACP

SEQ ID NO: 2815107 - protein, 49 aa, Entamoeba invadens
CVDQPNYILIISVTVALIFIVFAIIITSILIVYLTKLKHKKNEERKKVC

SEQ ID NO: 2815108 - protein, 23 aa, Entamoeba invadens
CVEAKLWKYISQFVFCSAKQQEL

SEQ ID NO: 2815109 - protein, 20 aa, Entamoeba invadens
CVECLDTFKLKYGNCSENFD

SEQ ID NO: 2815110 - protein, 48 aa, Entamoeba invadens
CVEDKLIKLKRIGIPIIVVAIVIIIISTTMIYILFNVYSNNKNKKKTQ

SEQ ID NO: 2815111 - protein, 37 aa, Entamoeba invadens
CVEDKLIKLNQIGIPIIVVAIVIIIISTITTYILFNV

SEQ ID NO: 2815112 - protein, 33 aa, Entamoeba invadens
CVEDKLITLKRIGIPIIVVAIVIIIISTTTTCI

SEQ ID NO: 2815113 - protein, 34 aa, Entamoeba invadens
CVEDKLITLKRIGIPIIVVAIVIIIISTTTTYIL

SEQ ID NO: 2815114 - protein, 24 aa, Entamoeba invadens
CVFAFILLIPYMFLKEHITKPPIR

SEQ ID NO: 2815115 - protein, 19 aa, Entamoeba invadens
CVFAVNYGIIIGCPLAFLF

SEQ ID NO: 2815116 - protein, 19 aa, Entamoeba invadens
CVFKMKHSNIRFARISLNL

SEQ ID NO: 2815117 - protein, 20 aa, Entamoeba invadens
CVFKMKRSNITFYDINEWLV

SEQ ID NO: 2815118 - protein, 25 aa, Entamoeba invadens
CVGLNIGLFLFPILETFDPENGISH

SEQ ID NO: 2815119 - protein, 51 aa, Entamoeba invadens
CVHKTNVLAIILPIIFGILIVVIIIITISFILFYIHYRKEEKLRKSLVNEF

SEQ ID NO: 2815120 - protein, 51 aa, Entamoeba invadens
CVHKTNVLAIVLPIIFAIILIVVIIIAIGCVLFYIHYKKEEKLRNSLVNEF

SEQ ID NO: 2815121 - protein, 50 aa, Entamoeba invadens
CVHKTNVLSIILPIIFCILIVVIIIITISCILFYIHYRKEEKLRKSLVNE

SEQ ID NO: 2815122 - protein, 50 aa, Entamoeba invadens
CVHKTNVLSIILPIIFCILMVVIIIITISCILFYIHYRKEEKLKKSLVNE

SEQ ID NO: 2815123 - protein, 27 aa, Entamoeba invadens
CVIAPWNFPINLSLIPVAGALACGNTV

SEQ ID NO: 2815124 - protein, 18 aa, Entamoeba invadens
CVIGIRYLENGYCKSCDS

SEQ ID NO: 2815125 - protein, 18 aa, Entamoeba invadens
CVIQINYLSLTSLQLDKY

SEQ ID NO: 2815126 - protein, 25 aa, Entamoeba invadens
CVIVVIIIAAFLMVVIGRKIIKSRL

SEQ ID NO: 2815127 - protein, 23 aa, Entamoeba invadens
CVKCHDGYYLDKGICSQCPSECP

SEQ ID NO: 2815128 - protein, 17 aa, Entamoeba invadens
CVKCIKGFYSIGGTVGE

SEQ ID NO: 2815129 - protein, 23 aa, Entamoeba invadens
CVKCSDSYLLNLDNTCKKTCETG

SEQ ID NO: 2815130 - protein, 18 aa, Entamoeba invadens
CVKGYYLDTDKCKQCDSK

SEQ ID NO: 2815131 - protein, 30 aa, Entamoeba invadens
CVKLTSVNFYAPLTSLLDPLTDQKNLFFHG

SEQ ID NO: 2815132 - protein, 37 aa, Entamoeba invadens
CVKTWNWYMVLGYIGSLAFIFGIFYILPSSIHDTSYI

SEQ ID NO: 2815133 - protein, 17 aa, Entamoeba invadens
CVLCSKGYFILNQMCAK

SEQ ID NO: 2815134 - protein, 17 aa, Entamoeba invadens
CVLCSPGYYSNEENLTE

SEQ ID NO: 2815135 - protein, 18 aa, Entamoeba invadens
CVLGFYPETNMCKSCLNI

SEQ ID NO: 2815136 - protein, 25 aa, Entamoeba invadens
CVLLYILCQIVFMAWVFYYFSILNQ

SEQ ID NO: 2815137 - protein, 24 aa, Entamoeba invadens
CVLNVFFLYFIIDIAFNIDTFRLI

SEQ ID NO: 2815138 - protein, 19 aa, Entamoeba invadens
CVLNYVFGNPKSKKCIPCQ

SEQ ID NO: 2815139 - protein, 22 aa, Entamoeba invadens
CVMCSKGYYLQNYMCHSCSSNC

SEQ ID NO: 2815140 - protein, 20 aa, Entamoeba invadens
CVMKPIVISAKVDYFYVMGN

SEQ ID NO: 2815141 - protein, 17 aa, Entamoeba invadens
CVMNMTYCLSCPPGFYI

SEQ ID NO: 2815142 - protein, 18 aa, Entamoeba invadens
CVMVFYFVKNGYVLAIAS

SEQ ID NO: 2815143 - protein, 17 aa, Entamoeba invadens
CVNGFYLDNSKNCVKCS

SEQ ID NO: 2815144 - protein, 51 aa, Entamoeba invadens
CVNNALISVLIPILVLIFLCVVAIIILIPTIYLLRLYLKQKKVDKKICVFN

SEQ ID NO: 2815145 - protein, 17 aa, Entamoeba invadens
CVPFNQIKYCTSAHNSR

SEQ ID NO: 2815146 - protein, 19 aa, Entamoeba invadens
CVPMMKTVPIYPSNYNQNC

SEQ ID NO: 2815147 - protein, 23 aa, Entamoeba invadens
CVQCSDSYLLNLDNTCKKTCETG

SEQ ID NO: 2815148 - protein, 19 aa, Entamoeba invadens
CVRCLPTTLLGISNSETVC

SEQ ID NO: 2815149 - protein, 18 aa, Entamoeba invadens
CVRCVVCMYWMCYSQNPI

SEQ ID NO: 2815150 - protein, 25 aa, Entamoeba invadens
CVRLQAFFLGYYRWTFKIQSLQLVQ

SEQ ID NO: 2815151 - protein, 33 aa, Entamoeba invadens
CVSAFCLNFSVYFFWLIVPIMMRNLGASPLEIG

SEQ ID NO: 2815152 - protein, 19 aa, Entamoeba invadens
CVSCFDLIQNCQLCKYNNG

SEQ ID NO: 2815153 - protein, 17 aa, Entamoeba invadens
CVSCFNDQLYIANGTCA

SEQ ID NO: 2815154 - protein, 48 aa, Entamoeba invadens
CVSHKNYFMIIGVPVIVVVLVILIILTVACIVIFKISNKLRKRKKQSN

SEQ ID NO: 2815155 - protein, 26 aa, Entamoeba invadens
CVSLILFLIGAFFNLIILFNHRNYVD

SEQ ID NO: 2815156 - protein, 17 aa, Entamoeba invadens
CVSNCPLNYGKDSEYKK

SEQ ID NO: 2815157 - protein, 27 aa, Entamoeba invadens
CVTCSPLFERKCIKCVAGCYPQTAGDF

SEQ ID NO: 2815158 - protein, 26 aa, Entamoeba invadens
CVTIFVGFAVWAMITLAILIGIESLS

SEQ ID NO: 2815159 - protein, 29 aa, Entamoeba invadens
CVTLIIMLAILWFPLLLMSSAAPNFAQPL

SEQ ID NO: 2815160 - protein, 20 aa, Entamoeba invadens
CVTNYILIAGSCYEKLLKKC

SEQ ID NO: 2815161 - protein, 26 aa, Entamoeba invadens
CVTVAFILWIFFNMATINDVYAIYLK

SEQ ID NO: 2815162 - protein, 26 aa, Entamoeba invadens
CVVKTDNFVLYIKNNNLIPIEIENVT

SEQ ID NO: 2815163 - protein, 17 aa, Entamoeba invadens
CVVKTDNLVLYIKNNNL

SEQ ID NO: 2815164 - protein, 33 aa, Entamoeba invadens
CVVPLLFLAVFVNVLIIFRYDPTLFSYTEMPFP

SEQ ID NO: 2815165 - protein, 17 aa, Entamoeba invadens
CVVPQNVEFKWSGSSVI

SEQ ID NO: 2815166 - protein, 21 aa, Entamoeba invadens
CVVRYDHHCAWLSCIGLHNVR

SEQ ID NO: 2815167 - protein, 19 aa, Entamoeba invadens
CVYSWQFIAMVGTPSLTFA

SEQ ID NO: 2815168 - protein, 21 aa, Entamoeba invadens
CWCLFAGVIFYTISSVLLVKF

SEQ ID NO: 2815169 - protein, 34 aa, Entamoeba invadens
CWDLALVLVAMMPFIMIILFFLEFGVSKLTQKAD

SEQ ID NO: 2815170 - protein, 17 aa, Entamoeba invadens
CWEYKYLQRITLRETHE

SEQ ID NO: 2815171 - protein, 29 aa, Entamoeba invadens
CWKGFMLHFFFCFLHKWVASLFGNHLQNV

SEQ ID NO: 2815172 - protein, 23 aa, Entamoeba invadens
CWQISLMRIITNIDFDLSLHIFQ

SEQ ID NO: 2815173 - protein, 25 aa, Entamoeba invadens
CWYSYYNKLLLLKTFSKPPVCLILT

SEQ ID NO: 2815174 - protein, 18 aa, Entamoeba invadens
CYDGLYLNSDFECDYCSS

SEQ ID NO: 2815175 - protein, 25 aa, Entamoeba invadens
CYIHENMMFLHKASETVNRCGQWIQ

SEQ ID NO: 2815176 - protein, 28 aa, Entamoeba invadens
CYITPFKNITFFNLYIDTLPINSQHKTN

SEQ ID NO: 2815177 - protein, 27 aa, Entamoeba invadens
CYITPLKNITFFNLYIDTPPINSQHKT

SEQ ID NO: 2815178 - protein, 39 aa, Entamoeba invadens
CYKMGIVGFFLWNIATIFYFIITWYFYNKAIYITGAATM

SEQ ID NO: 2815179 - protein, 39 aa, Entamoeba invadens
CYKMGIVGFFLWNIATIVYFLITWYYYNRAIYITGAATM

SEQ ID NO: 2815180 - protein, 25 aa, Entamoeba invadens
CYKRAYNLIQYCTQKIYGCYQCNYT

SEQ ID NO: 2815181 - protein, 17 aa, Entamoeba invadens
CYLFVQFVAYFFQVFLS

SEQ ID NO: 2815182 - protein, 23 aa, Entamoeba invadens
CYLHESLIGKCQIFHKLTGGCVK

SEQ ID NO: 2815183 - protein, 24 aa, Entamoeba invadens
CYNTSYCLTCDPQYYLSSTFTCEP

SEQ ID NO: 2815184 - protein, 17 aa, Entamoeba invadens
CYNTTYCTSCQLGYYLS

SEQ ID NO: 2815185 - protein, 30 aa, Entamoeba invadens
CYNTTYCTSCQLGYYLSSTFTCEPLGDLFT

SEQ ID NO: 2815186 - protein, 22 aa, Entamoeba invadens
CYPATHCLMYDISRPGKCISCE

SEQ ID NO: 2815187 - protein, 17 aa, Entamoeba invadens
CYPGYGLLNGKCEMCKV

SEQ ID NO: 2815188 - protein, 24 aa, Entamoeba invadens
CYRCGTWRYLWHIALGDKWKNTIV

SEQ ID NO: 2815189 - protein, 17 aa, Entamoeba invadens
CYRYDGWYIKYEKSANG

SEQ ID NO: 2815190 - protein, 17 aa, Entamoeba invadens
CYSGYQLNALQSCEICQ

SEQ ID NO: 2815191 - protein, 43 aa, Entamoeba invadens
CYSHVSLTPILPCFLCDGGLMILSRMPLLNRDQYVFKKSVFPD

SEQ ID NO: 2815192 - protein, 24 aa, Entamoeba invadens
CYTHLFLTDYIIDVRINAILSIDP

SEQ ID NO: 2815193 - protein, 20 aa, Entamoeba invadens
CYTISHYFEILFLDNKVSTQ

SEQ ID NO: 2815194 - protein, 27 aa, Entamoeba invadens
CYTPKTRYICYLPLAHIFELTIEFCVL

SEQ ID NO: 2815195 - protein, 19 aa, Entamoeba invadens
CYVGFYKYNETCYVCPEGC

SEQ ID NO: 2815196 - protein, 31 aa, Entamoeba invadens
CYYKDRYRFGKWFKLLYNIKNSSHILFEFSQ

SEQ ID NO: 2815197 - protein, 21 aa, Entamoeba invadens
CYYRQKFRVGQWLKMNMSQVT

SEQ ID NO: 2815198 - protein, 29 aa, Entamoeba invadens
DAAKCIVCEDLFTNNYYLADGKGHCKDYV

SEQ ID NO: 2815199 - protein, 31 aa, Entamoeba invadens
DAATGKDYFIARNTWGSWWGENGGFARISTE

SEQ ID NO: 2815200 - protein, 21 aa, Entamoeba invadens
DAAWFFYATLKRPVNTHTYKL

SEQ ID NO: 2815201 - protein, 36 aa, Entamoeba invadens
DACKEGYYLSFSFDQDYPFYGVCKKCPNGCSSCNFL

SEQ ID NO: 2815202 - protein, 21 aa, Entamoeba invadens
DADMMLYFIKASCVYLMVAGA

SEQ ID NO: 2815203 - protein, 25 aa, Entamoeba invadens
DAECSACIPGYVLLGNKTCQTTEDV

SEQ ID NO: 2815204 - protein, 21 aa, Entamoeba invadens
DAFKIVLLPELQNQFTSNIPE

SEQ ID NO: 2815205 - protein, 20 aa, Entamoeba invadens
DAFLYFTYPSVSKMSDLFVE

SEQ ID NO: 2815206 - protein, 24 aa, Entamoeba invadens
DAGAAVAFVGAWFCQIPNSWAAST

SEQ ID NO: 2815207 - protein, 23 aa, Entamoeba invadens
DAGAAVAFVGAWFCQMPSSWAAS

SEQ ID NO: 2815208 - protein, 25 aa, Entamoeba invadens
DAIDSITPCFDWISSSTTISLDSIY

SEQ ID NO: 2815209 - protein, 20 aa, Entamoeba invadens
DAIINLYENAYFTIQGPIIK

SEQ ID NO: 2815210 - protein, 24 aa, Entamoeba invadens
DAIKPFKVTSDLELLLLGADNKNF

SEQ ID NO: 2815211 - protein, 17 aa, Entamoeba invadens
DAIKRVLMVLKTFVYFL

SEQ ID NO: 2815212 - protein, 20 aa, Entamoeba invadens
DAINMKMRVKIMLDASRGIL

SEQ ID NO: 2815213 - protein, 25 aa, Entamoeba invadens
DAISNLIMQLIFKTAVEHPQQTLFH

SEQ ID NO: 2815214 - protein, 26 aa, Entamoeba invadens
DAKSCGLFHYLYLHKDIFGKEQFLGE

SEQ ID NO: 2815215 - protein, 26 aa, Entamoeba invadens
DAMEYLCYMLLYLHDSVNRRRNPNYI

SEQ ID NO: 2815216 - protein, 20 aa, Entamoeba invadens
DAMPLCENAFKDNTYITSFV

SEQ ID NO: 2815217 - protein, 24 aa, Entamoeba invadens
DANGKALYWRPSELSALENEAKGL

SEQ ID NO: 2815218 - protein, 21 aa, Entamoeba invadens
DAQELLIILLDELNLGMFVFL

SEQ ID NO: 2815219 - protein, 32 aa, Entamoeba invadens
DAQKHSFTFFIVALILIYKRNPSFFEFNQLFL

SEQ ID NO: 2815220 - protein, 32 aa, Entamoeba invadens
DAQYSFFIVLLITLLAVIIWILLLTVYNRYYS

SEQ ID NO: 2815221 - protein, 17 aa, Entamoeba invadens
DASKRMFAFHDFVLHNR

SEQ ID NO: 2815222 - protein, 25 aa, Entamoeba invadens
DASQIAFHFAFIVAALMLGASDNID

SEQ ID NO: 2815223 - protein, 28 aa, Entamoeba invadens
DASQQNIHFFPLLPNFPTGNNTTRLVLS

SEQ ID NO: 2815224 - protein, 27 aa, Entamoeba invadens
DATALAQLFRLVPATTICTCKYLFLGD

SEQ ID NO: 2815225 - protein, 25 aa, Entamoeba invadens
DATCLLYNVDYFLLSDHAQCIPYKN

SEQ ID NO: 2815226 - protein, 22 aa, Entamoeba invadens
DATFVLIKKMCYFAIANMVAGM

SEQ ID NO: 2815227 - protein, 21 aa, Entamoeba invadens
DATRGILYLHENGILHRDIKP

SEQ ID NO: 2815228 - protein, 25 aa, Entamoeba invadens
DATSPILIPQFPFNGVYQTAKTGTK

SEQ ID NO: 2815229 - protein, 18 aa, Entamoeba invadens
DAVVFRFIAFRNYITKHI

SEQ ID NO: 2815230 - protein, 25 aa, Entamoeba invadens
DAYDKNVFKFPWKIAEFVISGKRLE

SEQ ID NO: 2815231 - protein, 31 aa, Entamoeba invadens
DCAIGFSALAFILLCLRIFSGLFSRKFVVLQ

SEQ ID NO: 2815232 - protein, 17 aa, Entamoeba invadens
DCCKRRGIRRYFFSFFV

SEQ ID NO: 2815233 - protein, 26 aa, Entamoeba invadens
DCDMNIYFRTIRDTPLFFTKMVDLLS

SEQ ID NO: 2815234 - protein, 44 aa, Entamoeba invadens
DCFIKKIPLEEFVLTTLIPFFKMLFLKCNLLYAKYAKKTIKYTV

SEQ ID NO: 2815235 - protein, 27 aa, Entamoeba invadens
DCGIKKCFKLINFNTLPFKNNIGIQYI

SEQ ID NO: 2815236 - protein, 28 aa, Entamoeba invadens
DCILPLFVLLAYILFVCFSFGVVGLYWV

SEQ ID NO: 2815237 - protein, 19 aa, Entamoeba invadens
DCLPLPPTVRVDWVGTDDF

SEQ ID NO: 2815238 - protein, 18 aa, Entamoeba invadens
DCLRCIDNYYFDSNTRSC

SEQ ID NO: 2815239 - protein, 18 aa, Entamoeba invadens
DCLRCTDNYYFDSNTRSC

SEQ ID NO: 2815240 - protein, 20 aa, Entamoeba invadens
DCLSGYILNNGNCSICLAGT

SEQ ID NO: 2815241 - protein, 24 aa, Entamoeba invadens
DCNFFALWKPSFLRRSVVVFSIIS

SEQ ID NO: 2815242 - protein, 17 aa, Entamoeba invadens
DCNLCKNGYVWNTNKCE

SEQ ID NO: 2815243 - protein, 26 aa, Entamoeba invadens
DCPHIFQHIFFLKLTHVIIAAPNIRS

SEQ ID NO: 2815244 - protein, 32 aa, Entamoeba invadens
DCQSKSLQMAVLLLLLIGLSYGYWGEVNNEIR

SEQ ID NO: 2815245 - protein, 18 aa, Entamoeba invadens
DCQYISTILLNNYILIIK

SEQ ID NO: 2815246 - protein, 21 aa, Entamoeba invadens
DCSDGYYLSGTTCTKCKTGCS

SEQ ID NO: 2815247 - protein, 23 aa, Entamoeba invadens
DCSKCFEGFYLNGTTCALCNNKC

SEQ ID NO: 2815248 - protein, 17 aa, Entamoeba invadens
DCTGCLAGYSPRGYLTC

SEQ ID NO: 2815249 - protein, 22 aa, Entamoeba invadens
DCTLCIFGYELVDKNCQICGVG

SEQ ID NO: 2815250 - protein, 22 aa, Entamoeba invadens
DCTSCFAGFALKDGSCGGCAKG

SEQ ID NO: 2815251 - protein, 24 aa, Entamoeba invadens
DCTSIINSLLSFLYQMIQTAGDDY

SEQ ID NO: 2815252 - protein, 17 aa, Entamoeba invadens
DCYQCKDGYYYEGNGKC

SEQ ID NO: 2815253 - protein, 20 aa, Entamoeba invadens
DDAANSIFAFLALFAIFLMF

SEQ ID NO: 2815254 - protein, 17 aa, Entamoeba invadens
DDAKYIFKSIEAISFMV

SEQ ID NO: 2815255 - protein, 26 aa, Entamoeba invadens
DDCADDYFLYAPLNPLCQSYDTLSGC

SEQ ID NO: 2815256 - protein, 26 aa, Entamoeba invadens
DDCADDYYLYAPLNPLCQSYDTLIGC

SEQ ID NO: 2815257 - protein, 25 aa, Entamoeba invadens
DDCADDYYLYTPLNPLCQSYDTLIG

SEQ ID NO: 2815258 - protein, 21 aa, Entamoeba invadens
DDCHLLCYYNNIWQIPAESNL

SEQ ID NO: 2815259 - protein, 24 aa, Entamoeba invadens
DDCHQLCYYYGWQVSNTDGLCYFG

SEQ ID NO: 2815260 - protein, 24 aa, Entamoeba invadens
DDDEKKMLLLKRKVKSHLHYNLTI

SEQ ID NO: 2815261 - protein, 22 aa, Entamoeba invadens
DDDLDHMMPFSTGKWGCGSMLG

SEQ ID NO: 2815262 - protein, 23 aa, Entamoeba invadens
DDDMWIPRVLIFGAILDCLVLGI

SEQ ID NO: 2815263 - protein, 17 aa, Entamoeba invadens
DDDPLWIQLPKEIYFVV

SEQ ID NO: 2815264 - protein, 26 aa, Entamoeba invadens
DDDTWIWITIGVVGGVLFLAVVIAII

SEQ ID NO: 2815265 - protein, 26 aa, Entamoeba invadens
DDEAKTLWMVALRIAFVKFNVWSAMS

SEQ ID NO: 2815266 - protein, 37 aa, Entamoeba invadens
DDEIQFFPNFGKRIMFIQLIDLFNYYGIRGGLMYMHC

SEQ ID NO: 2815267 - protein, 31 aa, Entamoeba invadens
DDEKRELYHMLYYNKGYYRVFENLKGEYCHS

SEQ ID NO: 2815268 - protein, 25 aa, Entamoeba invadens
DDENTICELYLFNGIQSNTFYFGNI

SEQ ID NO: 2815269 - protein, 26 aa, Entamoeba invadens
DDEVMKYFYIFVGMSGIAFISTYLHK

SEQ ID NO: 2815270 - protein, 24 aa, Entamoeba invadens
DDFLDIRWRYKLILSFCASILVVV

SEQ ID NO: 2815271 - protein, 27 aa, Entamoeba invadens
DDGEIEWMYYFRKYNSKFFYPTQICNY

SEQ ID NO: 2815272 - protein, 21 aa, Entamoeba invadens
DDGFYLINFVCNKCPTECSTC

SEQ ID NO: 2815273 - protein, 22 aa, Entamoeba invadens
DDGFYLSHLKCLPCEYPCTFCS

SEQ ID NO: 2815274 - protein, 48 aa, Entamoeba invadens
DDGTFCSKKAVWWVILLIIVIVISIPVLVIVLVLFVMVKVIKHKRDSK

SEQ ID NO: 2815275 - protein, 48 aa, Entamoeba invadens
DDGTLCESHVVWWVILLGVIFVIIVLIIITILIVFITKIVLDRKHQKD

SEQ ID NO: 2815276 - protein, 35 aa, Entamoeba invadens
DDGTYCLRHSVWWVIFICVMFLVGVTSLMVLITSF

SEQ ID NO: 2815277 - protein, 52 aa, Entamoeba invadens
DDGTYCNSKAVWWVILIIVLFILLVVIIVIILIMILFNYLLQRKHEKKLEKT

SEQ ID NO: 2815278 - protein, 53 aa, Entamoeba invadens
DDGTYCNSKAVWWVILIIVLFLLLVVIIVIILIMILFNYLLQRKHEKKLEKTT

SEQ ID NO: 2815279 - protein, 43 aa, Entamoeba invadens
DDGTYCSKTAVWWVILLIVVIIAILVLVTVLVFFVMVKVIKNK

SEQ ID NO: 2815280 - protein, 20 aa, Entamoeba invadens
DDGVLFWVYSEIEETRLFFI

SEQ ID NO: 2815281 - protein, 18 aa, Entamoeba invadens
DDILLISVNLKSGVTETN

SEQ ID NO: 2815282 - protein, 21 aa, Entamoeba invadens
DDIPLSVFVLIECAWGRVPKE

SEQ ID NO: 2815283 - protein, 23 aa, Entamoeba invadens
DDKEDWYITPLQNVTSLYVEIDP

SEQ ID NO: 2815284 - protein, 24 aa, Entamoeba invadens
DDKERFTYLILKNSNLFETEDIHE

SEQ ID NO: 2815285 - protein, 26 aa, Entamoeba invadens
DDKSKALFQSITFVNTLTLLSTMSVY

SEQ ID NO: 2815286 - protein, 17 aa, Entamoeba invadens
DDLFISITRTKDLFSLK

SEQ ID NO: 2815287 - protein, 17 aa, Entamoeba invadens
DDLFMLFQSLGNQIGDE

SEQ ID NO: 2815288 - protein, 21 aa, Entamoeba invadens
DDLLAVMVDLLKKGKIKSSIL

SEQ ID NO: 2815289 - protein, 22 aa, Entamoeba invadens
DDLPLEILSVYFNGNISANEEM

SEQ ID NO: 2815290 - protein, 25 aa, Entamoeba invadens
DDLSYNNYFFFKTHNKKYKTIYCNK

SEQ ID NO: 2815291 - protein, 21 aa, Entamoeba invadens
DDLYLQLVISKIPGIGQLLVE

SEQ ID NO: 2815292 - protein, 23 aa, Entamoeba invadens
DDMEKIWHHTFYNELRIAPEKHP

SEQ ID NO: 2815293 - protein, 23 aa, Entamoeba invadens
DDMMVFIIEKLSSNFLKYPTNID

SEQ ID NO: 2815294 - protein, 20 aa, Entamoeba invadens
DDNVIMLFKYEDGGLHEIES

SEQ ID NO: 2815295 - protein, 23 aa, Entamoeba invadens
DDQLCLMHLSILDTLFGFSNVKI

SEQ ID NO: 2815296 - protein, 24 aa, Entamoeba invadens
DDQSRCLECFPGHKFDFTTNKCVS

SEQ ID NO: 2815297 - protein, 23 aa, Entamoeba invadens
DDQSVRILMKLLERSEGFKLENE

SEQ ID NO: 2815298 - protein, 23 aa, Entamoeba invadens
DDSSRKCIKCKLGLYPKEENQFT

SEQ ID NO: 2815299 - protein, 25 aa, Entamoeba invadens
DDSVDFFEVFLQNATVTFQSKNVRY

SEQ ID NO: 2815300 - protein, 17 aa, Entamoeba invadens
DDVLPFKGLSEKAIQNL

SEQ ID NO: 2815301 - protein, 24 aa, Entamoeba invadens
DDVPRIMALKLKDPLLRLDALVSI

SEQ ID NO: 2815302 - protein, 30 aa, Entamoeba invadens
DDVRVNITLLFNYFSIKFSFGILTVTDTNI

SEQ ID NO: 2815303 - protein, 25 aa, Entamoeba invadens
DDVTDRFFLTTQTPFVRKEVYHVTW

SEQ ID NO: 2815304 - protein, 24 aa, Entamoeba invadens
DDVVFVIYLYQRWIYPVDKNRMDS

SEQ ID NO: 2815305 - protein, 25 aa, Entamoeba invadens
DDYTMTFFNIFITSLPPIFVACTDR

SEQ ID NO: 2815306 - protein, 26 aa, Entamoeba invadens
DDYVMTFFNILFTQIQPILIGVFDRD

SEQ ID NO: 2815307 - protein, 26 aa, Entamoeba invadens
DDYYISKMLFFHKLVVILENVVSKKT

SEQ ID NO: 2815308 - protein, 18 aa, Entamoeba invadens
DDYYKDMTGCLPIREKYL

SEQ ID NO: 2815309 - protein, 26 aa, Entamoeba invadens
DEACEFEIFIIPNYTTKIDSKMVVIA

SEQ ID NO: 2815310 - protein, 40 aa, Entamoeba invadens
DEACQMAMHIPYIPYTIFSIPFAQFPLLKNPCVDIQEEVS

SEQ ID NO: 2815311 - protein, 18 aa, Entamoeba invadens
DEATIKCLILKEIEIRFD

SEQ ID NO: 2815312 - protein, 19 aa, Entamoeba invadens
DECFLCVKGAFYLVDGKCE

SEQ ID NO: 2815313 - protein, 25 aa, Entamoeba invadens
DECPSAMPITLPFTALHTFNSKKTT

SEQ ID NO: 2815314 - protein, 24 aa, Entamoeba invadens
DECTACMAEYILEGGKCNGAHAIF

SEQ ID NO: 2815315 - protein, 27 aa, Entamoeba invadens
DECTACMAEYKLEGGKCSGAHAISAIM

SEQ ID NO: 2815316 - protein, 24 aa, Entamoeba invadens
DECYGFVTLLLGTLFSLVLSHVVV

SEQ ID NO: 2815317 - protein, 25 aa, Entamoeba invadens
DEEILIFLFNCVIAMNAVFMNYVVK

SEQ ID NO: 2815318 - protein, 24 aa, Entamoeba invadens
DEEKMVVLFEFLVDVATEFGFLFF

SEQ ID NO: 2815319 - protein, 29 aa, Entamoeba invadens
DEFKYPWDVVTFVTKGWRLKLNGLNEKFA

SEQ ID NO: 2815320 - protein, 45 aa, Entamoeba invadens
DEFNGYFLHNETCLYRDFTSLLSIWITFLYIVIVCIFRVKCSNIF

SEQ ID NO: 2815321 - protein, 22 aa, Entamoeba invadens
DEGFRPIVLIKRGLSGLPLKTP

SEQ ID NO: 2815322 - protein, 17 aa, Entamoeba invadens
DEGQYLEEGVCKYCKVV

SEQ ID NO: 2815323 - protein, 24 aa, Entamoeba invadens
DEGSLLFIGKNQGSLPSGITSVCE

SEQ ID NO: 2815324 - protein, 29 aa, Entamoeba invadens
DEHFVFRSEYIIHFYGACVIPNHICMVTE

SEQ ID NO: 2815325 - protein, 25 aa, Entamoeba invadens
DEIKIELPFPLKNGHFLVFTIQEIA

SEQ ID NO: 2815326 - protein, 24 aa, Entamoeba invadens
DEIKIELPFPLNEKHHLLFQIRDI

SEQ ID NO: 2815327 - protein, 23 aa, Entamoeba invadens
DEIKLICEGSFGMVYKGTFRGKE

SEQ ID NO: 2815328 - protein, 18 aa, Entamoeba invadens
DEKCDYCFAPTVLTLKNT

SEQ ID NO: 2815329 - protein, 23 aa, Entamoeba invadens
DEKEKYLKPYWYPKSIGEQNPIL

SEQ ID NO: 2815330 - protein, 23 aa, Entamoeba invadens
DEKFNQPWTIPQFVIEGNRLPKP

SEQ ID NO: 2815331 - protein, 21 aa, Entamoeba invadens
DEKIRFLAVNFSKIDMATAAV

SEQ ID NO: 2815332 - protein, 33 aa, Entamoeba invadens
DEKNKYYYDDFYAYLPFVIDIVEGEYIFTKNPS

SEQ ID NO: 2815333 - protein, 25 aa, Entamoeba invadens
DELNEFYEVVFTKEYYLMKNENGCV

SEQ ID NO: 2815334 - protein, 27 aa, Entamoeba invadens
DELPTPFGFMKLLEKKLVGIHTFLYKR

SEQ ID NO: 2815335 - protein, 17 aa, Entamoeba invadens
DEMYIPNKRQLSLFGRL

SEQ ID NO: 2815336 - protein, 50 aa, Entamoeba invadens
DENAISYCPKLTYIGDEAFYQTGLRTFKLSPLHNLVLGTSIFESTQYLTT

SEQ ID NO: 2815337 - protein, 23 aa, Entamoeba invadens
DENGSAVWWRPPSFNTKEGKEKG

SEQ ID NO: 2815338 - protein, 25 aa, Entamoeba invadens
DENLFSDFIVAMKYFIVVLKQQYMC

SEQ ID NO: 2815339 - protein, 21 aa, Entamoeba invadens
DENMLWKILVDNKSVLWRLKN

SEQ ID NO: 2815340 - protein, 17 aa, Entamoeba invadens
DENVYNCMFIVASLPII

SEQ ID NO: 2815341 - protein, 34 aa, Entamoeba invadens
DEPSIKRIPLVPSKYYTFISSLVLQTIVVVLTIN

SEQ ID NO: 2815342 - protein, 24 aa, Entamoeba invadens
DEQTQYYVLSLRVLFGVVGMNENL

SEQ ID NO: 2815343 - protein, 25 aa, Entamoeba invadens
DERANLLYAFFFSGILLGAIPEIIK

SEQ ID NO: 2815344 - protein, 22 aa, Entamoeba invadens
DERFNQPWMIPQFVIEGKRLDK

SEQ ID NO: 2815345 - protein, 22 aa, Entamoeba invadens
DERFNQPWMIPQFVIEGKRLEK

SEQ ID NO: 2815346 - protein, 23 aa, Entamoeba invadens
DERFNQPWMIPQFVIEGKRLERT

SEQ ID NO: 2815347 - protein, 22 aa, Entamoeba invadens
DERFNQPWMIPQFVIEGNRLDK

SEQ ID NO: 2815348 - protein, 23 aa, Entamoeba invadens
DERFNQPWMIPQFVIEGNRLDKP

SEQ ID NO: 2815349 - protein, 22 aa, Entamoeba invadens
DERFNQPWMIPQFVIEGQRLDK

SEQ ID NO: 2815350 - protein, 28 aa, Entamoeba invadens
DERTDVYMWAMVIWFIATSIHPFQEISD

SEQ ID NO: 2815351 - protein, 23 aa, Entamoeba invadens
DESGIHYVVLFSLLLCYASQDRN

SEQ ID NO: 2815352 - protein, 17 aa, Entamoeba invadens
DESILFFLKSVVPVFTS

SEQ ID NO: 2815353 - protein, 22 aa, Entamoeba invadens
DESPCIYPPHSTESTSKSIVTP

SEQ ID NO: 2815354 - protein, 28 aa, Entamoeba invadens
DEVEKSYYVFFLVDIEILCTCKPDEFLM

SEQ ID NO: 2815355 - protein, 27 aa, Entamoeba invadens
DEVFIKRFFDMLWNLICESCYVSLTDV

SEQ ID NO: 2815356 - protein, 22 aa, Entamoeba invadens
DEWEKCSIIMWSDENNSIFIPE

SEQ ID NO: 2815357 - protein, 25 aa, Entamoeba invadens
DEYLELPYHLKLRILFDTARGMQFL

SEQ ID NO: 2815358 - protein, 19 aa, Entamoeba invadens
DEYLRVITVLLKKPIRPEF

SEQ ID NO: 2815359 - protein, 24 aa, Entamoeba invadens
DFCEKRINWIKYWNKKRKDNNSFN

SEQ ID NO: 2815360 - protein, 25 aa, Entamoeba invadens
DFCGQDYFCYLYNTGTCDPACAVDN

SEQ ID NO: 2815361 - protein, 17 aa, Entamoeba invadens
DFCGTPLDQMGCGCCYA

SEQ ID NO: 2815362 - protein, 21 aa, Entamoeba invadens
DFCLHHSLRYENQTLFIGLQN

SEQ ID NO: 2815363 - protein, 23 aa, Entamoeba invadens
DFCQKDYGYPIRKFEIDWDRVPT

SEQ ID NO: 2815364 - protein, 17 aa, Entamoeba invadens
DFDFLFTNNTLNESLYT

SEQ ID NO: 2815365 - protein, 21 aa, Entamoeba invadens
DFDGFLLIRHKIDEGVIQITG

SEQ ID NO: 2815366 - protein, 17 aa, Entamoeba invadens
DFDLFYSETPYTGTLPN

SEQ ID NO: 2815367 - protein, 25 aa, Entamoeba invadens
DFEDVRFSYPIRPLTMILDGLSFTA

SEQ ID NO: 2815368 - protein, 24 aa, Entamoeba invadens
DFEDYEHVILPYYLDAIMSPNQQT

SEQ ID NO: 2815369 - protein, 17 aa, Entamoeba invadens
DFGAFKTLLETKKNELI

SEQ ID NO: 2815370 - protein, 25 aa, Entamoeba invadens
DFGKVMRKYLRSIFITHWCATLTYT

SEQ ID NO: 2815371 - protein, 22 aa, Entamoeba invadens
DFHIMVLSHPYSTPGVLAYAAS

SEQ ID NO: 2815372 - protein, 27 aa, Entamoeba invadens
DFIDAMDELTLFKIPISNTPQISFEGK

SEQ ID NO: 2815373 - protein, 26 aa, Entamoeba invadens
DFIQNWFFVEIPQLLRVCKIRVFSRD

SEQ ID NO: 2815374 - protein, 19 aa, Entamoeba invadens
DFIYLKKEIIDEALYNGLV

SEQ ID NO: 2815375 - protein, 17 aa, Entamoeba invadens
DFKVAVVCYKRNIFRYM

SEQ ID NO: 2815376 - protein, 29 aa, Entamoeba invadens
DFKVAVVCYKRNIFRYMLVSTSQTEDFTN

SEQ ID NO: 2815377 - protein, 17 aa, Entamoeba invadens
DFLLVIGTSLKVAPCNI

SEQ ID NO: 2815378 - protein, 20 aa, Entamoeba invadens
DFMGLPLGFFCCGLSFLFIF

SEQ ID NO: 2815379 - protein, 19 aa, Entamoeba invadens
DFNTFVFDLPNPQTVLTIS

SEQ ID NO: 2815380 - protein, 17 aa, Entamoeba invadens
DFPFFRYVTVPANSSHI

SEQ ID NO: 2815381 - protein, 18 aa, Entamoeba invadens
DFQCKLLYRTGLGDETYL

SEQ ID NO: 2815382 - protein, 18 aa, Entamoeba invadens
DFRMKKLKTLLDQFNRYL

SEQ ID NO: 2815383 - protein, 21 aa, Entamoeba invadens
DFRTILRLKYMLDVSKGIMYL

SEQ ID NO: 2815384 - protein, 25 aa, Entamoeba invadens
DFSDWYSLVLNDQMQYILTTKSGNN

SEQ ID NO: 2815385 - protein, 18 aa, Entamoeba invadens
DFSIFAKLLTKYTVNYQF

SEQ ID NO: 2815386 - protein, 23 aa, Entamoeba invadens
DFSKSKFKRFYVHKGGVITLNGM

SEQ ID NO: 2815387 - protein, 30 aa, Entamoeba invadens
DFSLVFVLVTVILFYFWPVYQTIEDRSLLT

SEQ ID NO: 2815388 - protein, 26 aa, Entamoeba invadens
DFSVVSRLVSCGCIPLLFKTLENSEN

SEQ ID NO: 2815389 - protein, 24 aa, Entamoeba invadens
DFTNQTCLLLLTSSSSFTMESACR

SEQ ID NO: 2815390 - protein, 28 aa, Entamoeba invadens
DFTQYLHDFHFWSLPTILWNHVNQNQVK

SEQ ID NO: 2815391 - protein, 17 aa, Entamoeba invadens
DFTRKCISCKPNYYIKT

SEQ ID NO: 2815392 - protein, 26 aa, Entamoeba invadens
DFTSNKIWVYFNYSLQIFEQPKHHKK

SEQ ID NO: 2815393 - protein, 25 aa, Entamoeba invadens
DFVSISFYKMFGFPTGVGALIIKKE

SEQ ID NO: 2815394 - protein, 23 aa, Entamoeba invadens
DFYQINIWYEMTYSRTCRVTHPN

SEQ ID NO: 2815395 - protein, 23 aa, Entamoeba invadens
DGCILCATGFYLSNGRCVKCDNN

SEQ ID NO: 2815396 - protein, 26 aa, Entamoeba invadens
DGCSLCETGFYLNLYHKCVPCMDNCQ

SEQ ID NO: 2815397 - protein, 24 aa, Entamoeba invadens
DGCTKCMDGFLLIDKNCFKCKDPC

SEQ ID NO: 2815398 - protein, 22 aa, Entamoeba invadens
DGCTLCQDLYFPKNKTCHSCVE

SEQ ID NO: 2815399 - protein, 18 aa, Entamoeba invadens
DGCYVCENGYYLSLGRCI

SEQ ID NO: 2815400 - protein, 49 aa, Entamoeba invadens
DGDHCDTHAVWWFILIWVLFVIIVVIIITLIICFSVKYIMQYMKLEEQR

SEQ ID NO: 2815401 - protein, 49 aa, Entamoeba invadens
DGDHCDTHAVWWFILIWVLFVIIVVIIVTLIICFSVKYIMQYMKLEEQR

SEQ ID NO: 2815402 - protein, 30 aa, Entamoeba invadens
DGDNSAWKLWDFPIFYTTASVDYFASEGSH

SEQ ID NO: 2815403 - protein, 33 aa, Entamoeba invadens
DGEIFNHLYLLLQSFKYFILPTNKKLCQPTEES

SEQ ID NO: 2815404 - protein, 21 aa, Entamoeba invadens
DGENWILSIGSLVPAQDVQQI

SEQ ID NO: 2815405 - protein, 18 aa, Entamoeba invadens
DGEYFCEFLKQTQFNKKK

SEQ ID NO: 2815406 - protein, 19 aa, Entamoeba invadens
DGEYTGMFLSPTAQTFLPF

SEQ ID NO: 2815407 - protein, 25 aa, Entamoeba invadens
DGFGVEILPMLKYIGKTQSYAQFFT

SEQ ID NO: 2815408 - protein, 17 aa, Entamoeba invadens
DGFYLGTAILRCYKCSN

SEQ ID NO: 2815409 - protein, 17 aa, Entamoeba invadens
DGGACIRCKVRYYLQGN

SEQ ID NO: 2815410 - protein, 27 aa, Entamoeba invadens
DGGCAICQNGYYWQGRNCYKCGNNCTT

SEQ ID NO: 2815411 - protein, 24 aa, Entamoeba invadens
DGGKEWINVFSQLILSFVMTCNEE

SEQ ID NO: 2815412 - protein, 18 aa, Entamoeba invadens
DGGRCVYCWDKHPHCAEC

SEQ ID NO: 2815413 - protein, 19 aa, Entamoeba invadens
DGICLYYTEIEFCTSAYNG

SEQ ID NO: 2815414 - protein, 20 aa, Entamoeba invadens
DGICVKLCDFGMAVKGYDKM

SEQ ID NO: 2815415 - protein, 46 aa, Entamoeba invadens
DGIFNWKKALLVLFQGFLMAFLAVCAYFATLYIKPLREFGHYTLPD

SEQ ID NO: 2815416 - protein, 17 aa, Entamoeba invadens
DGIYMSSSSDLFWNFTR

SEQ ID NO: 2815417 - protein, 26 aa, Entamoeba invadens
DGKCEACLFGCALCYNSSVCITCLFE

SEQ ID NO: 2815418 - protein, 34 aa, Entamoeba invadens
DGKCYFDFSFCYYPQKYRLGRWFKINMTQFTMDH

SEQ ID NO: 2815419 - protein, 23 aa, Entamoeba invadens
DGKKRYFSFLSEDYRAEITMTLS

SEQ ID NO: 2815420 - protein, 23 aa, Entamoeba invadens
DGKLAWCFFDSNSGEIEETNFEF

SEQ ID NO: 2815421 - protein, 25 aa, Entamoeba invadens
DGKRDKFLFSITLLENSETLKQFGL

SEQ ID NO: 2815422 - protein, 26 aa, Entamoeba invadens
DGKSRFYIGLPVDPLCECKSLGSTDL

SEQ ID NO: 2815423 - protein, 43 aa, Entamoeba invadens
DGLECYRTRWELIIPFVVIGVLILIVIVITFVVVILVRKRKSA

SEQ ID NO: 2815424 - protein, 18 aa, Entamoeba invadens
DGLSFILKQIPSVSFCEF

SEQ ID NO: 2815425 - protein, 54 aa, Entamoeba invadens
DGLYCESTPVWWVIMLCVVVGVFMFVVILVMIIWMTIVVLRNAIRNKALDKMVF

SEQ ID NO: 2815426 - protein, 31 aa, Entamoeba invadens
DGLYTYLRHPSYFGWFWWSIATQIVMLNPVS

SEQ ID NO: 2815427 - protein, 17 aa, Entamoeba invadens
DGLYWGVPLVCLPIICG

SEQ ID NO: 2815428 - protein, 51 aa, Entamoeba invadens
DGMMCLVDYFVIIGVPIIVTTIVIFIIIIVIVVLIYFLQKRRKEIEKRDVC

SEQ ID NO: 2815429 - protein, 27 aa, Entamoeba invadens
DGRALRLLVPFTWYSMDYVDDAKELLI

SEQ ID NO: 2815430 - protein, 18 aa, Entamoeba invadens
DGSISIFCLTAAFICVVV

SEQ ID NO: 2815431 - protein, 50 aa, Entamoeba invadens
DGSYCEQQIVWWVVLISILFCFLSIVFILISLYYFIKKIVKKNKMIEMEN

SEQ ID NO: 2815432 - protein, 46 aa, Entamoeba invadens
DGTFCMKKNVWWVILLIIFLLFIISFIIICIVVYEILKILQRIHQK

SEQ ID NO: 2815433 - protein, 46 aa, Entamoeba invadens
DGTLCESRAVWWVILVVVLFVLIVFVILIISIIVVTKIILNKLHTH

SEQ ID NO: 2815434 - protein, 49 aa, Entamoeba invadens
DGTLCNTQVVWWVILIIVIIILIIIVTIFIIIAIIIKQLLSKIHKKELA

SEQ ID NO: 2815435 - protein, 19 aa, Entamoeba invadens
DGTLLWNPITCDQKVIVDD

SEQ ID NO: 2815436 - protein, 45 aa, Entamoeba invadens
DGTMCRSQTVWWVILIVVVFVVIVLFVLIVTIIIVTKIILNKFHT

SEQ ID NO: 2815437 - protein, 25 aa, Entamoeba invadens
DGTPNPMNDPWHFSVSLKEGEELKK

SEQ ID NO: 2815438 - protein, 50 aa, Entamoeba invadens
DGTYCASQVVWWVILIIVVFIIVLLIVVITVVYFVLNSISKLIREKSVEK

SEQ ID NO: 2815439 - protein, 50 aa, Entamoeba invadens
DGTYCEKKIVLWVVLVIVLFIIFVLSILVIALIFSMKRILKMIHTKELKR

SEQ ID NO: 2815440 - protein, 47 aa, Entamoeba invadens
DGTYCEKRAVWWVILVIVLFILFVLTFLIIVLVFSVKNVLKMIHTKE

SEQ ID NO: 2815441 - protein, 48 aa, Entamoeba invadens
DGTYCETHIVWWVIILVVILSIVILISFIVIIIIITKSVFEKFQQKTY

SEQ ID NO: 2815442 - protein, 23 aa, Entamoeba invadens
DGVECFTLLLLWSLDRMSSQFNQ

SEQ ID NO: 2815443 - protein, 19 aa, Entamoeba invadens
DGVVLLNNFQYDEATIKCL

SEQ ID NO: 2815444 - protein, 19 aa, Entamoeba invadens
DGYFLQNLSLILTCEKCST

SEQ ID NO: 2815445 - protein, 30 aa, Entamoeba invadens
DGYGECDGIKYLWVRNSWGKDWGVENGHFK

SEQ ID NO: 2815446 - protein, 20 aa, Entamoeba invadens
DGYNFATLTLNVRKVDLINV

SEQ ID NO: 2815447 - protein, 22 aa, Entamoeba invadens
DHCELCLPGFRLEKGNCAPCDE

SEQ ID NO: 2815448 - protein, 24 aa, Entamoeba invadens
DHCELCLTGYFLNNGKCTACSVGC

SEQ ID NO: 2815449 - protein, 18 aa, Entamoeba invadens
DHCESCESGFYLFNGGCK

SEQ ID NO: 2815450 - protein, 26 aa, Entamoeba invadens
DHCKLKIYFLIYYNNFVNIHCKIFHD

SEQ ID NO: 2815451 - protein, 24 aa, Entamoeba invadens
DHCNMFGLVLICCLTAFSKQTETE

SEQ ID NO: 2815452 - protein, 25 aa, Entamoeba invadens
DHCNMFGLVLICCLTAFSKQTETEK

SEQ ID NO: 2815453 - protein, 24 aa, Entamoeba invadens
DHCVWQCLIQSKEWLFVFVDIAVG

SEQ ID NO: 2815454 - protein, 17 aa, Entamoeba invadens
DHDYVYFLFVGINEEYS

SEQ ID NO: 2815455 - protein, 20 aa, Entamoeba invadens
DHFCFSACSLFTYHFSEKKS

SEQ ID NO: 2815456 - protein, 25 aa, Entamoeba invadens
DHHLMFGCIRQNGETCLKCDTGFYL

SEQ ID NO: 2815457 - protein, 28 aa, Entamoeba invadens
DHKSRKLFYYFLINLLFMFVEVAYGWWS

SEQ ID NO: 2815458 - protein, 21 aa, Entamoeba invadens
DHPSFKPLVNLKSLGLSFESG

SEQ ID NO: 2815459 - protein, 19 aa, Entamoeba invadens
DHRVIHKMSMFTNSTFHTS

SEQ ID NO: 2815460 - protein, 25 aa, Entamoeba invadens
DHTELLPIMPAIGEGAFGIVFKGKY

SEQ ID NO: 2815461 - protein, 30 aa, Entamoeba invadens
DHYGYVNKSGLWYLFEKLEFKTGKFIDRDF

SEQ ID NO: 2815462 - protein, 23 aa, Entamoeba invadens
DIAKFILEIYPEMAVLKSGEACE

SEQ ID NO: 2815463 - protein, 24 aa, Entamoeba invadens
DICAWISGLLYFVGRFPQAWHLYK

SEQ ID NO: 2815464 - protein, 22 aa, Entamoeba invadens
DICSKCDPGFVGYLSSKGVCTP

SEQ ID NO: 2815465 - protein, 19 aa, Entamoeba invadens
DICVKCKEGYYLNGTECLQ

SEQ ID NO: 2815466 - protein, 23 aa, Entamoeba invadens
DIDNNLLFLGSGGPYVLYMEKGN

SEQ ID NO: 2815467 - protein, 23 aa, Entamoeba invadens
DIDNPRVLLWKSSYLHLHYNFIY

SEQ ID NO: 2815468 - protein, 36 aa, Entamoeba invadens
DIEKMSWWVVAIFVFLFIVLLLVVGLVLSGTMNVVQ

SEQ ID NO: 2815469 - protein, 36 aa, Entamoeba invadens
DIFFSFSLDYIYNDNYYSIPRYAATGYFDMIFFYDS

SEQ ID NO: 2815470 - protein, 22 aa, Entamoeba invadens
DIFGCVQCENGYFLDRGKCEIC

SEQ ID NO: 2815471 - protein, 35 aa, Entamoeba invadens
DIFSFAITMYETFTWKEPYPKSEFKFAWSIADFVS

SEQ ID NO: 2815472 - protein, 22 aa, Entamoeba invadens
DIFVMLFDARYLLLLMGCYAMY

SEQ ID NO: 2815473 - protein, 18 aa, Entamoeba invadens
DIGYYRFDYTCHPCSANC

SEQ ID NO: 2815474 - protein, 27 aa, Entamoeba invadens
DIHKTSFVIWQMKGFTRHLISMGVTIS

SEQ ID NO: 2815475 - protein, 22 aa, Entamoeba invadens
DIIAVFVVICTCSYYLIIVVVV

SEQ ID NO: 2815476 - protein, 25 aa, Entamoeba invadens
DIIKKIFYAIIIWYNVNYGTYEMNK

SEQ ID NO: 2815477 - protein, 18 aa, Entamoeba invadens
DIILFIFMNKKCKDVVDS

SEQ ID NO: 2815478 - protein, 18 aa, Entamoeba invadens
DIIYCKDGYYIDNSECIS

SEQ ID NO: 2815479 - protein, 18 aa, Entamoeba invadens
DIKEVLGVSAYFKPTQTA

SEQ ID NO: 2815480 - protein, 22 aa, Entamoeba invadens
DIKPDNFLVFSLDLNDTINAKL

SEQ ID NO: 2815481 - protein, 18 aa, Entamoeba invadens
DIKPDNFLVFSLESGIDV

SEQ ID NO: 2815482 - protein, 25 aa, Entamoeba invadens
DIKPDNILVADIYSFAITMFETISW

SEQ ID NO: 2815483 - protein, 20 aa, Entamoeba invadens
DIKPDNILVFSLDLNEKVNA

SEQ ID NO: 2815484 - protein, 17 aa, Entamoeba invadens
DIKPDNILVISLDLNEK

SEQ ID NO: 2815485 - protein, 27 aa, Entamoeba invadens
DIKPDNLLIFSLYFSTQIIAKLTDFGS

SEQ ID NO: 2815486 - protein, 17 aa, Entamoeba invadens
DIKPDNLLVFLLDLNDK

SEQ ID NO: 2815487 - protein, 22 aa, Entamoeba invadens
DIKPDNLLVFSLDIDELINAKL

SEQ ID NO: 2815488 - protein, 17 aa, Entamoeba invadens
DIKPDNLLVFSLDINDK

SEQ ID NO: 2815489 - protein, 17 aa, Entamoeba invadens
DIKPDNLLVFSLDLDDK

SEQ ID NO: 2815490 - protein, 25 aa, Entamoeba invadens
DIKPDNLLVFSLDLGATVNAKVTDF

SEQ ID NO: 2815491 - protein, 25 aa, Entamoeba invadens
DIKPDNLLVFSLDLGTTINAKLTDF

SEQ ID NO: 2815492 - protein, 23 aa, Entamoeba invadens
DIKPFISKFHYLYVGGENDIVVT

SEQ ID NO: 2815493 - protein, 41 aa, Entamoeba invadens
DIKRKVVNLPYLLRFDFLAILRDFDFLFQKDCPKRLEFEDT

SEQ ID NO: 2815494 - protein, 24 aa, Entamoeba invadens
DIKSDNFLVFSLDLNEKMNAKLTD

SEQ ID NO: 2815495 - protein, 26 aa, Entamoeba invadens
DIKSDNILVFLLDYNERINAKLTDFG

SEQ ID NO: 2815496 - protein, 18 aa, Entamoeba invadens
DIKTDNILVFSIDKGIPV

SEQ ID NO: 2815497 - protein, 18 aa, Entamoeba invadens
DIKYFFEIPELISKGKRP

SEQ ID NO: 2815498 - protein, 19 aa, Entamoeba invadens
DILCLKLFGFILTLSVLVD

SEQ ID NO: 2815499 - protein, 19 aa, Entamoeba invadens
DILIGRYFPFTSDAAFAGF

SEQ ID NO: 2815500 - protein, 24 aa, Entamoeba invadens
DILNIFIDALYQPIHFLDHNKYSE

SEQ ID NO: 2815501 - protein, 21 aa, Entamoeba invadens
DILNWWPMLVSCFSLIAVAAF

SEQ ID NO: 2815502 - protein, 17 aa, Entamoeba invadens
DILYLYFAQVTAVNQVN

SEQ ID NO: 2815503 - protein, 26 aa, Entamoeba invadens
DINKVFYMQYFLGELKQRAPVLFKYF

SEQ ID NO: 2815504 - protein, 36 aa, Entamoeba invadens
DIPEDSLWIFTFFMKDLNLYGLFSDGLPLLNFAVYC

SEQ ID NO: 2815505 - protein, 17 aa, Entamoeba invadens
DIPFLINLFGKNIVPSS

SEQ ID NO: 2815506 - protein, 23 aa, Entamoeba invadens
DIPYRNWAVRLSTPLLVLPHEHF

SEQ ID NO: 2815507 - protein, 17 aa, Entamoeba invadens
DIQKRLPSALRTKLKDF

SEQ ID NO: 2815508 - protein, 19 aa, Entamoeba invadens
DIQSVIDTFWRDLRMFRIQ

SEQ ID NO: 2815509 - protein, 31 aa, Entamoeba invadens
DISDKKLLGHFQLHIFFLRLVAEQFEEYVQD

SEQ ID NO: 2815510 - protein, 27 aa, Entamoeba invadens
DIVDFKGWHLPVYPITLSSDMALTSLD

SEQ ID NO: 2815511 - protein, 20 aa, Entamoeba invadens
DIVFTLPHCPCKDCQLFFQE

SEQ ID NO: 2815512 - protein, 18 aa, Entamoeba invadens
DIVFTLPHCPCKDCQLFL

SEQ ID NO: 2815513 - protein, 24 aa, Entamoeba invadens
DIWKNFYTIYYDPSTLHSNKVFPK

SEQ ID NO: 2815514 - protein, 22 aa, Entamoeba invadens
DIYAYGVTLLEGIKWRECFEGN

SEQ ID NO: 2815515 - protein, 17 aa, Entamoeba invadens
DIYFENKCLQECPSGYF

SEQ ID NO: 2815516 - protein, 17 aa, Entamoeba invadens
DIYFLASPCMKYLDRKN

SEQ ID NO: 2815517 - protein, 17 aa, Entamoeba invadens
DIYGYINVNRYKTLQIL

SEQ ID NO: 2815518 - protein, 19 aa, Entamoeba invadens
DIYLLKWNEHYTMTFPEAL

SEQ ID NO: 2815519 - protein, 17 aa, Entamoeba invadens
DIYSFVISILAGLVYTF

SEQ ID NO: 2815520 - protein, 24 aa, Entamoeba invadens
DIYTKIPERAFFSSTPSFPLELSK

SEQ ID NO: 2815521 - protein, 19 aa, Entamoeba invadens
DKCILEDTTYFIYSSGTNM

SEQ ID NO: 2815522 - protein, 25 aa, Entamoeba invadens
DKCSNDFYYLKCDLPAPINPSDNSQ

SEQ ID NO: 2815523 - protein, 26 aa, Entamoeba invadens
DKCTKCKTNFYLVADTLKCVEKCPEG

SEQ ID NO: 2815524 - protein, 18 aa, Entamoeba invadens
DKCVCKEGYYTTSWNSCV

SEQ ID NO: 2815525 - protein, 22 aa, Entamoeba invadens
DKEAYCVWKFKKTNCKKCISHQ

SEQ ID NO: 2815526 - protein, 27 aa, Entamoeba invadens
DKEDYLRMSYKLKLKILFDTARGMQFL

SEQ ID NO: 2815527 - protein, 18 aa, Entamoeba invadens
DKETFLCKSKKNYGLIIA

SEQ ID NO: 2815528 - protein, 30 aa, Entamoeba invadens
DKEYLICQQLYYIYLNYLKLPDVDSNSVTT

SEQ ID NO: 2815529 - protein, 19 aa, Entamoeba invadens
DKFHHSFIYCFDCKKKFCK

SEQ ID NO: 2815530 - protein, 29 aa, Entamoeba invadens
DKFKSEYIIHFYGAVFIPTRMCLVTEYAP

SEQ ID NO: 2815531 - protein, 25 aa, Entamoeba invadens
DKFKSEYIVHFYGAVFVPNKICMVT

SEQ ID NO: 2815532 - protein, 38 aa, Entamoeba invadens
DKFNPYIVVRISFVFFIIGVAVILIFPSSIPALYVSVC

SEQ ID NO: 2815533 - protein, 27 aa, Entamoeba invadens
DKFRCDFIVHFYSACFLPDHLCLVTEL

SEQ ID NO: 2815534 - protein, 27 aa, Entamoeba invadens
DKFRCDYIIHFYGAVFIPNKICMVTEF

SEQ ID NO: 2815535 - protein, 25 aa, Entamoeba invadens
DKFRCDYIVHFFGAVFVSSEMCMVT

SEQ ID NO: 2815536 - protein, 26 aa, Entamoeba invadens
DKFRCEYIVHFFGAVFVPNKICMVTQ

SEQ ID NO: 2815537 - protein, 27 aa, Entamoeba invadens
DKFRCEYIVHFYGAVFIPNKVCMVTEF

SEQ ID NO: 2815538 - protein, 27 aa, Entamoeba invadens
DKFRCEYLVHFYGAVFVPNRICMVTEF

SEQ ID NO: 2815539 - protein, 21 aa, Entamoeba invadens
DKFRCGYIVHFYGAVFIPNKV

SEQ ID NO: 2815540 - protein, 30 aa, Entamoeba invadens
DKFRCNYIVHFYGAVFIPTKICLVTEFADY

SEQ ID NO: 2815541 - protein, 25 aa, Entamoeba invadens
DKFRNDYIVHFYGAVFITKKECIVT

SEQ ID NO: 2815542 - protein, 25 aa, Entamoeba invadens
DKFRNEYIVHFYGAVFIPNKMCMVT

SEQ ID NO: 2815543 - protein, 25 aa, Entamoeba invadens
DKFRNEYIVHFYGAVFIPTKVCMVT

SEQ ID NO: 2815544 - protein, 26 aa, Entamoeba invadens
DKFRNEYIVHFYGAVLIPNKICMVTE

SEQ ID NO: 2815545 - protein, 24 aa, Entamoeba invadens
DKFRSDFIVHFFGACFLPTKICMV

SEQ ID NO: 2815546 - protein, 31 aa, Entamoeba invadens
DKFRSDYIIHFYGAVFIPSKICMVLEYAQFG

SEQ ID NO: 2815547 - protein, 25 aa, Entamoeba invadens
DKFRSDYIIHFYGAVFIPSKVCMVT

SEQ ID NO: 2815548 - protein, 25 aa, Entamoeba invadens
DKFRSDYIIHFYSAVFIPNKVCMVT

SEQ ID NO: 2815549 - protein, 26 aa, Entamoeba invadens
DKFRSDYIVHFFGAVFMPSKICMVTE

SEQ ID NO: 2815550 - protein, 26 aa, Entamoeba invadens
DKFRSDYIVHFYGAVFIPKQLCMVTE

SEQ ID NO: 2815551 - protein, 29 aa, Entamoeba invadens
DKFRSDYIVHFYGAVFIPNKICLVTEFAL

SEQ ID NO: 2815552 - protein, 25 aa, Entamoeba invadens
DKFRSDYIVHFYGAVFIPNKVCMVT

SEQ ID NO: 2815553 - protein, 26 aa, Entamoeba invadens
DKFRSDYIVHFYGAVFVPKKICMVTE

SEQ ID NO: 2815554 - protein, 21 aa, Entamoeba invadens
DKFRSDYIVNFYGAVFIPNKI

SEQ ID NO: 2815555 - protein, 26 aa, Entamoeba invadens
DKFRSDYLVHFYGAVFIPNKICMVTE

SEQ ID NO: 2815556 - protein, 25 aa, Entamoeba invadens
DKFRSDYLVHFYGAVFIPNKVCMVT

SEQ ID NO: 2815557 - protein, 26 aa, Entamoeba invadens
DKFRSEFIIHFYGACVIPNHICMVTE

SEQ ID NO: 2815558 - protein, 25 aa, Entamoeba invadens
DKFRSEFIVHFYGAVFIPNKICMVT

SEQ ID NO: 2815559 - protein, 25 aa, Entamoeba invadens
DKFRSEFIVHFYGAVFVTTKICIVT

SEQ ID NO: 2815560 - protein, 25 aa, Entamoeba invadens
DKFRSEFVIHFYGACYIPSHICMVT

SEQ ID NO: 2815561 - protein, 26 aa, Entamoeba invadens
DKFRSEFVVHFYGAVFARNKVCMVTE

SEQ ID NO: 2815562 - protein, 24 aa, Entamoeba invadens
DKFRSEFVVRFYGAVFARNKVCMV

SEQ ID NO: 2815563 - protein, 28 aa, Entamoeba invadens
DKFRSENIVFFYGAVFIPDKICMVTEYA

SEQ ID NO: 2815564 - protein, 26 aa, Entamoeba invadens
DKFRSEYIIHFYGAVFIASKICMVTE

SEQ ID NO: 2815565 - protein, 26 aa, Entamoeba invadens
DKFRSEYIIHFYGAVFIPNKICIVTE

SEQ ID NO: 2815566 - protein, 26 aa, Entamoeba invadens
DKFRSEYIIHFYGAVFIPNKICMVTE

SEQ ID NO: 2815567 - protein, 26 aa, Entamoeba invadens
DKFRSEYIVHFFGAVFIPTKICMVTE

SEQ ID NO: 2815568 - protein, 26 aa, Entamoeba invadens
DKFRSEYIVHFFGAVLIPNKICMVTE

SEQ ID NO: 2815569 - protein, 31 aa, Entamoeba invadens
DKFRSEYIVHFYGAILLPRKLAIVTKYAKYG

SEQ ID NO: 2815570 - protein, 31 aa, Entamoeba invadens
DKFRSEYIVHFYGAVFIPKKICLVTEFAKYG

SEQ ID NO: 2815571 - protein, 27 aa, Entamoeba invadens
DKFRSEYIVHFYGAVFIPKKICMVTEY

SEQ ID NO: 2815572 - protein, 26 aa, Entamoeba invadens
DKFRSEYIVHFYGAVFIPNKICMVTE

SEQ ID NO: 2815573 - protein, 27 aa, Entamoeba invadens
DKFRSEYIVHFYGAVFIPNKICMVTEF

SEQ ID NO: 2815574 - protein, 28 aa, Entamoeba invadens
DKFRSEYIVHFYGAVFIPNKICMVTEFA

SEQ ID NO: 2815575 - protein, 27 aa, Entamoeba invadens
DKFRSEYIVHFYGAVFIPNKLCMVTEF

SEQ ID NO: 2815576 - protein, 28 aa, Entamoeba invadens
DKFRSEYIVHFYGAVFIPNKLCMVTEFA

SEQ ID NO: 2815577 - protein, 27 aa, Entamoeba invadens
DKFRSEYIVHFYGAVFIPNKLCMVTEY

SEQ ID NO: 2815578 - protein, 26 aa, Entamoeba invadens
DKFRSEYIVHFYGAVFIPNKTCMVTE

SEQ ID NO: 2815579 - protein, 29 aa, Entamoeba invadens
DKFRSEYIVHFYGAVFIPNKVCLVTEFAQ

SEQ ID NO: 2815580 - protein, 26 aa, Entamoeba invadens
DKFRSEYIVHFYGAVFIPNKVCMVTE

SEQ ID NO: 2815581 - protein, 25 aa, Entamoeba invadens
DKFRSEYIVHFYGAVFIPSKVCMVT

SEQ ID NO: 2815582 - protein, 27 aa, Entamoeba invadens
DKFRSEYIVHFYGAVFMPSKICMVTEF

SEQ ID NO: 2815583 - protein, 26 aa, Entamoeba invadens
DKFRSEYIVHFYGAVFVPNKVCMVTE

SEQ ID NO: 2815584 - protein, 28 aa, Entamoeba invadens
DKFRSEYIVHFYGAVLIPNRLCIVTEFS

SEQ ID NO: 2815585 - protein, 24 aa, Entamoeba invadens
DKFRSEYIVYFYGAVFIPSKVCMV

SEQ ID NO: 2815586 - protein, 26 aa, Entamoeba invadens
DKFRSEYVVHFFGAVFIPTKICMVTE

SEQ ID NO: 2815587 - protein, 25 aa, Entamoeba invadens
DKFRSEYVVHFYGAVFIPNKVCMVT

SEQ ID NO: 2815588 - protein, 26 aa, Entamoeba invadens
DKFRSKYIVHFYGAVFIPSKVCMVTE

SEQ ID NO: 2815589 - protein, 26 aa, Entamoeba invadens
DKFRSQYIVHFYGAVFIPNKICMVTE

SEQ ID NO: 2815590 - protein, 32 aa, Entamoeba invadens
DKGMMWLNAIILTLLFLFSFGFVGYQMNKNER

SEQ ID NO: 2815591 - protein, 25 aa, Entamoeba invadens
DKHVIEVLPPLLVPAFERKSDGSEL

SEQ ID NO: 2815592 - protein, 23 aa, Entamoeba invadens
DKIAIISCVLKKGTKKSGNVSLK

SEQ ID NO: 2815593 - protein, 27 aa, Entamoeba invadens
DKIETLLSCLIAKKTMLRFLIRSSKKK

SEQ ID NO: 2815594 - protein, 40 aa, Entamoeba invadens
DKINMIKILLIVIFGCIILLILITIIMSFVGLYIIQTHHL

SEQ ID NO: 2815595 - protein, 34 aa, Entamoeba invadens
DKITSFGEMSFLLTSLPKLNFSPKLEKLGDMSFM

SEQ ID NO: 2815596 - protein, 26 aa, Entamoeba invadens
DKKKDDIIFALMLDKIANILKSIGYA

SEQ ID NO: 2815597 - protein, 31 aa, Entamoeba invadens
DKKNKYIIDNIFYFLPFNFNIDENKNTRLSV

SEQ ID NO: 2815598 - protein, 24 aa, Entamoeba invadens
DKLAAAQVMALRRAKRRNMERLTL

SEQ ID NO: 2815599 - protein, 24 aa, Entamoeba invadens
DKLLLNDFWDFCEVNSFESALKIC

SEQ ID NO: 2815600 - protein, 25 aa, Entamoeba invadens
DKMKSPYIIRFFGAVHIGNSRMIIM

SEQ ID NO: 2815601 - protein, 25 aa, Entamoeba invadens
DKMKVKIILDATYGIKYLHENGILH

SEQ ID NO: 2815602 - protein, 37 aa, Entamoeba invadens
DKNFFKKYFKYFVIAAITIILCLWALLVAVIASRKHK

SEQ ID NO: 2815603 - protein, 17 aa, Entamoeba invadens
DKNKTIFLMEKSNIVFS

SEQ ID NO: 2815604 - protein, 23 aa, Entamoeba invadens
DKNVELIYLAPELLHHEKYDLPS

SEQ ID NO: 2815605 - protein, 26 aa, Entamoeba invadens
DKPIFQSIIMFLSMSLCFFIEKLIEL

SEQ ID NO: 2815606 - protein, 17 aa, Entamoeba invadens
DKPIFVTNYSDTPLNFV

SEQ ID NO: 2815607 - protein, 26 aa, Entamoeba invadens
DKPPIVLWQSNWLHLYSNVTNKAFFI

SEQ ID NO: 2815608 - protein, 22 aa, Entamoeba invadens
DKSFCILFLNNCNFGMPGIEFA

SEQ ID NO: 2815609 - protein, 18 aa, Entamoeba invadens
DKSFPLCYSAFPYTASLR

SEQ ID NO: 2815610 - protein, 28 aa, Entamoeba invadens
DKTCIDIFYLIPNCKNGYYDNATLKCTE

SEQ ID NO: 2815611 - protein, 22 aa, Entamoeba invadens
DKTMISGLIFSEAKELLFNATH

SEQ ID NO: 2815612 - protein, 48 aa, Entamoeba invadens
DKTMPLKRKLSALGKWLVLIACVLCLFVVALLVTWLFIKNGKMDWDDT

SEQ ID NO: 2815613 - protein, 25 aa, Entamoeba invadens
DKTMVYLVDALRFDFAFSADYPPLF

SEQ ID NO: 2815614 - protein, 21 aa, Entamoeba invadens
DKTWEVVVDLFLHRELDAKKE

SEQ ID NO: 2815615 - protein, 24 aa, Entamoeba invadens
DKTYSMLLNGKLLRIGSFKKIFCH

SEQ ID NO: 2815616 - protein, 20 aa, Entamoeba invadens
DKVFCLLMLLIIVIFVYFMN

SEQ ID NO: 2815617 - protein, 25 aa, Entamoeba invadens
DKVSILVIGILLVCLVIVILLAIFL

SEQ ID NO: 2815618 - protein, 23 aa, Entamoeba invadens
DKYYNHYAKYYTKCGPVESILTS

SEQ ID NO: 2815619 - protein, 23 aa, Entamoeba invadens
DLACSIMPIRTTLPQGTKLLIDG

SEQ ID NO: 2815620 - protein, 25 aa, Entamoeba invadens
DLALTYSLFLSKLLKMESFVKNNEL

SEQ ID NO: 2815621 - protein, 21 aa, Entamoeba invadens
DLARYPLIFVNACAIVFLLIF

SEQ ID NO: 2815622 - protein, 22 aa, Entamoeba invadens
DLCILRNKFPSSVSLALDITNF

SEQ ID NO: 2815623 - protein, 26 aa, Entamoeba invadens
DLECTFKPILKMLQIPRFNTAIQMKH

SEQ ID NO: 2815624 - protein, 21 aa, Entamoeba invadens
DLELYVNLEKKLMELKTILKQ

SEQ ID NO: 2815625 - protein, 27 aa, Entamoeba invadens
DLFKEIYLVFFIIIYTVFVFVCPSILI

SEQ ID NO: 2815626 - protein, 17 aa, Entamoeba invadens
DLFKKCLVTLPNGNGCA

SEQ ID NO: 2815627 - protein, 20 aa, Entamoeba invadens
DLFLYTKITITNEIQFVKNA

SEQ ID NO: 2815628 - protein, 32 aa, Entamoeba invadens
DLFNVYFTHTYINDKYYYTAHGYFYIDADNKV

SEQ ID NO: 2815629 - protein, 25 aa, Entamoeba invadens
DLGFQLPSFALFRTFDEIRKKMMRE

SEQ ID NO: 2815630 - protein, 25 aa, Entamoeba invadens
DLGINPSFWVIYRNTTHVTLQFADF

SEQ ID NO: 2815631 - protein, 21 aa, Entamoeba invadens
DLIHVLKILAPFRGTLIFFIV

SEQ ID NO: 2815632 - protein, 23 aa, Entamoeba invadens
DLINPYLLFRIADVFFITCVVLV

SEQ ID NO: 2815633 - protein, 24 aa, Entamoeba invadens
DLIQNIHIHLTHILSLVNCYTTLA

SEQ ID NO: 2815634 - protein, 23 aa, Entamoeba invadens
DLISVIFFPVQMLSVFFGGLERA

SEQ ID NO: 2815635 - protein, 21 aa, Entamoeba invadens
DLIVKITIALLLCGLGYLALH

SEQ ID NO: 2815636 - protein, 21 aa, Entamoeba invadens
DLIYSLLDKMWCFDFKDRIKI

SEQ ID NO: 2815637 - protein, 26 aa, Entamoeba invadens
DLKFKKKRLNFFKLFQFMKKDEVTAQ

SEQ ID NO: 2815638 - protein, 17 aa, Entamoeba invadens
DLKKELEKSEANLKIEI

SEQ ID NO: 2815639 - protein, 20 aa, Entamoeba invadens
DLKKQPNFVFFPFASNCAKK

SEQ ID NO: 2815640 - protein, 19 aa, Entamoeba invadens
DLKNELYQTIFIAKKIILK

SEQ ID NO: 2815641 - protein, 18 aa, Entamoeba invadens
DLLDFEEIVLFASKLELY

SEQ ID NO: 2815642 - protein, 23 aa, Entamoeba invadens
DLLITFNQLYTTASFIVTPRYQL

SEQ ID NO: 2815643 - protein, 28 aa, Entamoeba invadens
DLLRNKTLLIGIFISIVLLVCGCYIPYV

SEQ ID NO: 2815644 - protein, 21 aa, Entamoeba invadens
DLMAGLSYSLLPPIFKDVDID

SEQ ID NO: 2815645 - protein, 19 aa, Entamoeba invadens
DLMKAIVFCGIALAGFIGA

SEQ ID NO: 2815646 - protein, 19 aa, Entamoeba invadens
DLNGLTHIATKMFSACVAL

SEQ ID NO: 2815647 - protein, 21 aa, Entamoeba invadens
DLNGLTQLTTKIFSGCTALKT

SEQ ID NO: 2815648 - protein, 24 aa, Entamoeba invadens
DLNGYILPLLQAFSDFYLPLSPEH

SEQ ID NO: 2815649 - protein, 36 aa, Entamoeba invadens
DLNKIVIVTIAIFASFCLISLFRSILTQEKPHFDIP

SEQ ID NO: 2815650 - protein, 18 aa, Entamoeba invadens
DLPDVQILLLVSKTSKIL

SEQ ID NO: 2815651 - protein, 21 aa, Entamoeba invadens
DLPLFLGFLPFDLPQGKAPEP

SEQ ID NO: 2815652 - protein, 19 aa, Entamoeba invadens
DLPLIVYFSTKPEYRRFAI

SEQ ID NO: 2815653 - protein, 24 aa, Entamoeba invadens
DLPRTFTFVVILFVVHYVLLTLHP

SEQ ID NO: 2815654 - protein, 17 aa, Entamoeba invadens
DLPVMFNINSIYIDFTN

SEQ ID NO: 2815655 - protein, 25 aa, Entamoeba invadens
DLQDLVRYVFVIIAFSFSCRFSYKI

SEQ ID NO: 2815656 - protein, 25 aa, Entamoeba invadens
DLQIFPKKWITSLSTVLTPLYSTVP

SEQ ID NO: 2815657 - protein, 20 aa, Entamoeba invadens
DLQIQFKQLTPSTEYILLTT

SEQ ID NO: 2815658 - protein, 19 aa, Entamoeba invadens
DLQMLLLGADNEKFPLKTD

SEQ ID NO: 2815659 - protein, 24 aa, Entamoeba invadens
DLQNVFPSVLLSLLSGLQIIIYSS

SEQ ID NO: 2815660 - protein, 26 aa, Entamoeba invadens
DLQVLFDSSPFWYFVVSAAMVTRDYK

SEQ ID NO: 2815661 - protein, 17 aa, Entamoeba invadens
DLQVYTSALIIGTFQMR

SEQ ID NO: 2815662 - protein, 25 aa, Entamoeba invadens
DLSFLTPLIILVISAVTLVLTIINF

SEQ ID NO: 2815663 - protein, 22 aa, Entamoeba invadens
DLSGLFYYFQGNGKKLKITTCH

SEQ ID NO: 2815664 - protein, 31 aa, Entamoeba invadens
DLSNNFFIEFPLHLCKMTQLIKLDLSMNKLI

SEQ ID NO: 2815665 - protein, 23 aa, Entamoeba invadens
DLSSILIFLFLLSVCLFVSYVEI

SEQ ID NO: 2815666 - protein, 27 aa, Entamoeba invadens
DLTDIIKNPLFISSLLRATKCQNFEVL

SEQ ID NO: 2815667 - protein, 26 aa, Entamoeba invadens
DLTERPHCILLFSDVILLIPATKPQK

SEQ ID NO: 2815668 - protein, 31 aa, Entamoeba invadens
DLTFVALWSIFLYIIDIPPIAFRLISKFIQN

SEQ ID NO: 2815669 - protein, 25 aa, Entamoeba invadens
DLTLLVFSLCFLLALSALLYGTMGQ

SEQ ID NO: 2815670 - protein, 22 aa, Entamoeba invadens
DLVKGFWFKIKGARQTILISTC

SEQ ID NO: 2815671 - protein, 19 aa, Entamoeba invadens
DLVKGFWFKIPGADETLEF

SEQ ID NO: 2815672 - protein, 22 aa, Entamoeba invadens
DLVKGHWFRFIGADQILNFSMC

SEQ ID NO: 2815673 - protein, 28 aa, Entamoeba invadens
DLVYSTHSMFLAFAMLYIGSVGSTKKEL

SEQ ID NO: 2815674 - protein, 27 aa, Entamoeba invadens
DLYDLILPSFFTLLANFFVSPSDALAL

SEQ ID NO: 2815675 - protein, 24 aa, Entamoeba invadens
DLYEVYVVLTFYKLLMSSTGEAPC

SEQ ID NO: 2815676 - protein, 35 aa, Entamoeba invadens
DMAICIVAPLFPRVFMFFFNLITPPKIAKLERNTG

SEQ ID NO: 2815677 - protein, 32 aa, Entamoeba invadens
DMALRMLGMFFPLDYLLYGILIGFVIFSTLNG

SEQ ID NO: 2815678 - protein, 18 aa, Entamoeba invadens
DMCFDCYDGYYTFNYHCY

SEQ ID NO: 2815679 - protein, 17 aa, Entamoeba invadens
DMCLPFCKKCSGLKCIL

SEQ ID NO: 2815680 - protein, 21 aa, Entamoeba invadens
DMEYYIVLMSYPISGKPGTAN

SEQ ID NO: 2815681 - protein, 17 aa, Entamoeba invadens
DMFPNVFHPLFQTEKLG

SEQ ID NO: 2815682 - protein, 17 aa, Entamoeba invadens
DMIIPQRMTSLTFVVSI

SEQ ID NO: 2815683 - protein, 19 aa, Entamoeba invadens
DMKLRTKLLLDASIGIQYL

SEQ ID NO: 2815684 - protein, 19 aa, Entamoeba invadens
DMKLRVKMLLDAAKGILYL

SEQ ID NO: 2815685 - protein, 17 aa, Entamoeba invadens
DMKSSFSIFLNTKINNL

SEQ ID NO: 2815686 - protein, 20 aa, Entamoeba invadens
DMLSLPFKLSRLVNLTKLNI

SEQ ID NO: 2815687 - protein, 18 aa, Entamoeba invadens
DMLVRGGIKVWVITGDKE

SEQ ID NO: 2815688 - protein, 21 aa, Entamoeba invadens
DMNQLSPHLLAGALKMFLCQI

SEQ ID NO: 2815689 - protein, 22 aa, Entamoeba invadens
DMQPLCEGAFMNNQLITNFVYE

SEQ ID NO: 2815690 - protein, 26 aa, Entamoeba invadens
DMQTRLKMMLDSAKGYLIFAHKWHLT

SEQ ID NO: 2815691 - protein, 38 aa, Entamoeba invadens
DMRWDVLIGCLLCFVISFLLVRFAKIGFVKAVLLCVFV

SEQ ID NO: 2815692 - protein, 17 aa, Entamoeba invadens
DMTGCLPIREKYLDCEH

SEQ ID NO: 2815693 - protein, 17 aa, Entamoeba invadens
DMTIIEWLRLQDYRLPP

SEQ ID NO: 2815694 - protein, 25 aa, Entamoeba invadens
DMYLGLFFFVFYFAQTIAMIVMSLT

SEQ ID NO: 2815695 - protein, 22 aa, Entamoeba invadens
DNCTCTDCFLNYHPSVDHLCET

SEQ ID NO: 2815696 - protein, 27 aa, Entamoeba invadens
DNDDRYFYNFIILKNTTLYSTIDIGFW

SEQ ID NO: 2815697 - protein, 33 aa, Entamoeba invadens
DNDTFMMMTTALRWLPYAHLINNKVFIVHGGLP

SEQ ID NO: 2815698 - protein, 29 aa, Entamoeba invadens
DNENEKIVLLRRKRLVILKSIEQLAKSLD

SEQ ID NO: 2815699 - protein, 23 aa, Entamoeba invadens
DNEYMNVYLLDKCYYTGGNTYTK

SEQ ID NO: 2815700 - protein, 22 aa, Entamoeba invadens
DNFDKYLFIDFNSGYNIFTIKS

SEQ ID NO: 2815701 - protein, 22 aa, Entamoeba invadens
DNFEKYLFIDLNSGYNIFTIKS

SEQ ID NO: 2815702 - protein, 21 aa, Entamoeba invadens
DNFFDGCELLTSITGFDSITS

SEQ ID NO: 2815703 - protein, 26 aa, Entamoeba invadens
DNFKHEWLMCVIGIIGSIGAGAIFPF

SEQ ID NO: 2815704 - protein, 24 aa, Entamoeba invadens
DNFKTLSCLKYYFLNDSKCYKCYE

SEQ ID NO: 2815705 - protein, 18 aa, Entamoeba invadens
DNFLIVSLDQNVKVNGKL

SEQ ID NO: 2815706 - protein, 23 aa, Entamoeba invadens
DNFVYLAITYCPYTLDDYLERLE

SEQ ID NO: 2815707 - protein, 23 aa, Entamoeba invadens
DNGIRICKICKTGFRINPSTGMC

SEQ ID NO: 2815708 - protein, 51 aa, Entamoeba invadens
DNGLSCENAPVWWVFFVLFLVVLGVIGLLVLIGFVLWKLHKTIETQKVEEN

SEQ ID NO: 2815709 - protein, 20 aa, Entamoeba invadens
DNGSAWTIPMLLALLCLAML

SEQ ID NO: 2815710 - protein, 48 aa, Entamoeba invadens
DNGTLCDEHVVWWVLFIIILFAIFVIIIFILSFVLTIKHIDNKMHQKE

SEQ ID NO: 2815711 - protein, 38 aa, Entamoeba invadens
DNGTLCNKKAVWWVLFIVVLFVIIVMAAVITSIVFVVY

SEQ ID NO: 2815712 - protein, 26 aa, Entamoeba invadens
DNICSKCVLGYYPLNGICQTCSSLKC

SEQ ID NO: 2815713 - protein, 31 aa, Entamoeba invadens
DNIFALFIFIYSLMYFLIYKEAFLPMFSSFL

SEQ ID NO: 2815714 - protein, 30 aa, Entamoeba invadens
DNIIAIVDTYDTTYKFCKYKGVNSFFEELV

SEQ ID NO: 2815715 - protein, 23 aa, Entamoeba invadens
DNIKIWRYPNFMYDFSIGDVEVV

SEQ ID NO: 2815716 - protein, 18 aa, Entamoeba invadens
DNILIFSLDSNVVVNAKL

SEQ ID NO: 2815717 - protein, 21 aa, Entamoeba invadens
DNILIVSLDFNTKVFGKLTDF

SEQ ID NO: 2815718 - protein, 23 aa, Entamoeba invadens
DNIQVLMPPLFVMGKTALPLIRA

SEQ ID NO: 2815719 - protein, 25 aa, Entamoeba invadens
DNIRKFLQFQLTVNVSALALCVIGS

SEQ ID NO: 2815720 - protein, 24 aa, Entamoeba invadens
DNIRKFLQFQLTVNVSAVGLCIIG

SEQ ID NO: 2815721 - protein, 27 aa, Entamoeba invadens
DNITDLKYYYIFLRTKDYAFADFYLEI

SEQ ID NO: 2815722 - protein, 28 aa, Entamoeba invadens
DNKMLLLGSLLIYGYPLVINVIINTLRF

SEQ ID NO: 2815723 - protein, 23 aa, Entamoeba invadens
DNKNFPLVIVSGKIQITSYTTSS

SEQ ID NO: 2815724 - protein, 22 aa, Entamoeba invadens
DNKRMLLLMNQMKFTYCGIVHV

SEQ ID NO: 2815725 - protein, 30 aa, Entamoeba invadens
DNLFLQNDFVWLLQSLYQAKFRRIHILCHG

SEQ ID NO: 2815726 - protein, 40 aa, Entamoeba invadens
DNNNLMTKLIYWISGMSFVPMVLVDVVPFRLIDLPKYMVE

SEQ ID NO: 2815727 - protein, 43 aa, Entamoeba invadens
DNNTLIISISIVVGFVVLLLLVIFVALISWRIMRQKSSGKNAK

SEQ ID NO: 2815728 - protein, 17 aa, Entamoeba invadens
DNQRPTVAFFKRGIHLF

SEQ ID NO: 2815729 - protein, 20 aa, Entamoeba invadens
DNSKLLFQGQLYTYNNIKVV

SEQ ID NO: 2815730 - protein, 23 aa, Entamoeba invadens
DNTFHPLQLQPSNPNWHIHDDQE

SEQ ID NO: 2815731 - protein, 25 aa, Entamoeba invadens
DNTNIILCLQGFYYNSHNLQCESCK

SEQ ID NO: 2815732 - protein, 53 aa, Entamoeba invadens
DNTSCITQAVWWVILLIVIFIVFIIICLIILMIIALTKYFDYLRLKRCVQQFS

SEQ ID NO: 2815733 - protein, 51 aa, Entamoeba invadens
DNTSCITQAVWWVILLIVIVVVVIIILVIVAVIVLVIKYLNHQKIEKTREK

SEQ ID NO: 2815734 - protein, 27 aa, Entamoeba invadens
DNVAATIIFGPIPFGADITLTNHSVLD

SEQ ID NO: 2815735 - protein, 21 aa, Entamoeba invadens
DNVAYPLLYKNAIQKNLQVVS

SEQ ID NO: 2815736 - protein, 25 aa, Entamoeba invadens
DNVDTQLFVIITQAWQQSTTARSDI

SEQ ID NO: 2815737 - protein, 20 aa, Entamoeba invadens
DNVFISKCLACRFSSLINSE

SEQ ID NO: 2815738 - protein, 20 aa, Entamoeba invadens
DNVFPKHVPLLKINQFLAAK

SEQ ID NO: 2815739 - protein, 21 aa, Entamoeba invadens
DNVILVSFYYNGLTFTFAKNA

SEQ ID NO: 2815740 - protein, 23 aa, Entamoeba invadens
DNVITLKALSFSKLSVLKGSCAV

SEQ ID NO: 2815741 - protein, 27 aa, Entamoeba invadens
DNVKNWNPFFLTFSNLGLAPRINYGET

SEQ ID NO: 2815742 - protein, 21 aa, Entamoeba invadens
DNVVMKLNCSITQFIDVSEPN

SEQ ID NO: 2815743 - protein, 21 aa, Entamoeba invadens
DNVVYLMQLLASSLTTLTGNL

SEQ ID NO: 2815744 - protein, 23 aa, Entamoeba invadens
DNVYLTHTFYKKVKIPFVIQELS

SEQ ID NO: 2815745 - protein, 23 aa, Entamoeba invadens
DNYIQIYISIIFVLFCCIAEEIV

SEQ ID NO: 2815746 - protein, 24 aa, Entamoeba invadens
DNYKTFFIALAFTCKDTTDEKFKF

SEQ ID NO: 2815747 - protein, 30 aa, Entamoeba invadens
DNYPLYSVQLSAIYYRVTTDRNYIYCTSST

SEQ ID NO: 2815748 - protein, 21 aa, Entamoeba invadens
DNYQFCTKITLQNCKHISFVN

SEQ ID NO: 2815749 - protein, 26 aa, Entamoeba invadens
DNYVEHYCPCFGCFITPLEMVSGIVI

SEQ ID NO: 2815750 - protein, 23 aa, Entamoeba invadens
DNYVLYFKNINDLFRITFEELDK

SEQ ID NO: 2815751 - protein, 19 aa, Entamoeba invadens
DNYYYMYFDEGYGTKFNKF

SEQ ID NO: 2815752 - protein, 24 aa, Entamoeba invadens
DPAKEVIKLLLTKSVILSVNSLNE

SEQ ID NO: 2815753 - protein, 31 aa, Entamoeba invadens
DPANFNWWRITDLVDYFIIAVTIVVVAVPEG

SEQ ID NO: 2815754 - protein, 18 aa, Entamoeba invadens
DPCRMITIWMVSVILYYS

SEQ ID NO: 2815755 - protein, 29 aa, Entamoeba invadens
DPETYGCICEFFRALPYAHVIGNSIFVVH

SEQ ID NO: 2815756 - protein, 25 aa, Entamoeba invadens
DPFDEKMFLYSWDITNLISKGQRPK

SEQ ID NO: 2815757 - protein, 28 aa, Entamoeba invadens
DPKLRSIIFVMLNGLFTTLHKFVFKLSN

SEQ ID NO: 2815758 - protein, 19 aa, Entamoeba invadens
DPLAYIRNFAESYTFLKSS

SEQ ID NO: 2815759 - protein, 21 aa, Entamoeba invadens
DPMNYIPFKRDIYYEGNVCVL

SEQ ID NO: 2815760 - protein, 22 aa, Entamoeba invadens
DPPDFSVITLGRERSPSPPPQP

SEQ ID NO: 2815761 - protein, 20 aa, Entamoeba invadens
DPPGLYCIPCKEFDQNCKQC

SEQ ID NO: 2815762 - protein, 22 aa, Entamoeba invadens
DPRFNQPWMIPQFVIEGNRLEK

SEQ ID NO: 2815763 - protein, 47 aa, Entamoeba invadens
DPSLYLRFPTTHYFTKTIALLPYTFRIIDSKYYLIPNPSNKYYDIKV

SEQ ID NO: 2815764 - protein, 25 aa, Entamoeba invadens
DPTALPTPIPYKAGCSLYLGADPNT

SEQ ID NO: 2815765 - protein, 18 aa, Entamoeba invadens
DPTKRMSLFLLCGRSRNI

SEQ ID NO: 2815766 - protein, 31 aa, Entamoeba invadens
DPTSSLYFIFSIMVLPFLPTCPLHVDHLKTL

SEQ ID NO: 2815767 - protein, 18 aa, Entamoeba invadens
DPVFFYLSQKERSTTSWS

SEQ ID NO: 2815768 - protein, 21 aa, Entamoeba invadens
DPYCAYSFLSYSAFNTLKKLF

SEQ ID NO: 2815769 - protein, 19 aa, Entamoeba invadens
DQCSVCKTGYLLEQVTLKC

SEQ ID NO: 2815770 - protein, 22 aa, Entamoeba invadens
DQEMPYLELVNDWSLLSINSEM

SEQ ID NO: 2815771 - protein, 27 aa, Entamoeba invadens
DQFGNYIIMLLTKYPIFIEDYINYVIV

SEQ ID NO: 2815772 - protein, 20 aa, Entamoeba invadens
DQFVFTLLKLKNALADNDDV

SEQ ID NO: 2815773 - protein, 23 aa, Entamoeba invadens
DQGNIYWCQKGNQYGFNSIILNN

SEQ ID NO: 2815774 - protein, 26 aa, Entamoeba invadens
DQIDFLFSMFGYSISFLNEHLAHDAE

SEQ ID NO: 2815775 - protein, 19 aa, Entamoeba invadens
DQIIHFYGSIRSKQLIAIV

SEQ ID NO: 2815776 - protein, 24 aa, Entamoeba invadens
DQKNLFFHGTVQPTTLPTKESPIN

SEQ ID NO: 2815777 - protein, 30 aa, Entamoeba invadens
DQKSINFYFQNPLITVLYVKVSSSSTLLYF

SEQ ID NO: 2815778 - protein, 28 aa, Entamoeba invadens
DQLHSNMMILLPLLIFNVFALVDEKQVV

SEQ ID NO: 2815779 - protein, 19 aa, Entamoeba invadens
DQLMLLVNELPVILKTMRT

SEQ ID NO: 2815780 - protein, 23 aa, Entamoeba invadens
DQNGKLLIFINKTIFDCCGWVTK

SEQ ID NO: 2815781 - protein, 36 aa, Entamoeba invadens
DQNKFYGSLFFVFCALLVAIYWWAKQPQHVYLVSFA

SEQ ID NO: 2815782 - protein, 25 aa, Entamoeba invadens
DQNKMQFVTLLRNLSPHSLENIRKE

SEQ ID NO: 2815783 - protein, 23 aa, Entamoeba invadens
DQNLTFFQFSFRWFNCCLVREFS

SEQ ID NO: 2815784 - protein, 26 aa, Entamoeba invadens
DQQYGYCTSCKLGYVLKLDKQSLICE

SEQ ID NO: 2815785 - protein, 25 aa, Entamoeba invadens
DQQYGYCTSCKLGYVLKLDSNSLKC

SEQ ID NO: 2815786 - protein, 23 aa, Entamoeba invadens
DQRYSLDVSKLEKLGWRAETKFE

SEQ ID NO: 2815787 - protein, 24 aa, Entamoeba invadens
DQSLHNWLIYSRKLDFLKPVLESC

SEQ ID NO: 2815788 - protein, 25 aa, Entamoeba invadens
DQTHKSNLALFLYSLENEDQKEVQP

SEQ ID NO: 2815789 - protein, 18 aa, Entamoeba invadens
DQTLLILIASAVVSLILA

SEQ ID NO: 2815790 - protein, 17 aa, Entamoeba invadens
DQTLPQHSFYFSGAINF

SEQ ID NO: 2815791 - protein, 27 aa, Entamoeba invadens
DQTRGWFYSLLVLSTALFDKPPFKNLI

SEQ ID NO: 2815792 - protein, 29 aa, Entamoeba invadens
DQTSCLLCTYGYYLDNNSCTRCAPGCTEC

SEQ ID NO: 2815793 - protein, 24 aa, Entamoeba invadens
DQVFTDIFIPQNQEFFYFVVSTKP

SEQ ID NO: 2815794 - protein, 20 aa, Entamoeba invadens
DQYSLYLAALLPLIVFVIFP

SEQ ID NO: 2815795 - protein, 18 aa, Entamoeba invadens
DRCCRCETGYFVLDNKCF

SEQ ID NO: 2815796 - protein, 20 aa, Entamoeba invadens
DRCLKCSIGFLLINGKCFNS

SEQ ID NO: 2815797 - protein, 17 aa, Entamoeba invadens
DRDEHLSLPYKLKVRML

SEQ ID NO: 2815798 - protein, 26 aa, Entamoeba invadens
DRDEKKIYVIFYKTPKEIWISHSTKE

SEQ ID NO: 2815799 - protein, 28 aa, Entamoeba invadens
DREDMKIYVIFYGHPKEIWISHSIKEAL

SEQ ID NO: 2815800 - protein, 27 aa, Entamoeba invadens
DRGIEVLFNTLFVVIGYVLHTNDISDD

SEQ ID NO: 2815801 - protein, 25 aa, Entamoeba invadens
DRGLLTMLLEYTPLEALAVFIESSN

SEQ ID NO: 2815802 - protein, 19 aa, Entamoeba invadens
DRIMCSTKVLIFENEIPVQ

SEQ ID NO: 2815803 - protein, 29 aa, Entamoeba invadens
DRIQKLMLRLLLVYSIKHPASGYVQGFDS

SEQ ID NO: 2815804 - protein, 26 aa, Entamoeba invadens
DRIYCFVSEFPFINALFAMLEDMERY

SEQ ID NO: 2815805 - protein, 24 aa, Entamoeba invadens
DRKCGRCPLGEYFDTVNFHCKTCR

SEQ ID NO: 2815806 - protein, 24 aa, Entamoeba invadens
DRKCLTCKYGFYQGKDYTCLSSTK

SEQ ID NO: 2815807 - protein, 20 aa, Entamoeba invadens
DRLCYECESGYYPGINKICT

SEQ ID NO: 2815808 - protein, 18 aa, Entamoeba invadens
DRLGNDLPLIVYFSTKPE

SEQ ID NO: 2815809 - protein, 19 aa, Entamoeba invadens
DRMMEMNPPLFLYGTHYST

SEQ ID NO: 2815810 - protein, 30 aa, Entamoeba invadens
DRNLQLFTMSLYLGRKILRICPIEYNYDIG

SEQ ID NO: 2815811 - protein, 22 aa, Entamoeba invadens
DRNPPYCICDNGVYLDPDTNKC

SEQ ID NO: 2815812 - protein, 19 aa, Entamoeba invadens
DRPIIIRSALNAKVIFQTI

SEQ ID NO: 2815813 - protein, 23 aa, Entamoeba invadens
DRRWALWFGFVLQIVGIILCLIT

SEQ ID NO: 2815814 - protein, 22 aa, Entamoeba invadens
DRTIQLAFIYGSSFFMSQDFRQ

SEQ ID NO: 2815815 - protein, 24 aa, Entamoeba invadens
DRYERSEISGFYFSKGQFQNKNDT

SEQ ID NO: 2815816 - protein, 23 aa, Entamoeba invadens
DRYNSYLLLYLMGVENDSFFQVV

SEQ ID NO: 2815817 - protein, 24 aa, Entamoeba invadens
DSAFYAIRVLFICVSYVILRFRYP

SEQ ID NO: 2815818 - protein, 19 aa, Entamoeba invadens
DSCLTCKTEYFKLSGMENK

SEQ ID NO: 2815819 - protein, 22 aa, Entamoeba invadens
DSCNTCEVSYKLVGDNCEYRPY

SEQ ID NO: 2815820 - protein, 30 aa, Entamoeba invadens
DSDASVYQRIIYLSSFTLPSKISNLNTNKL

SEQ ID NO: 2815821 - protein, 23 aa, Entamoeba invadens
DSDIQFIMKLISKLLKAQKCQES

SEQ ID NO: 2815822 - protein, 23 aa, Entamoeba invadens
DSDKFLFPRFPQGTLSLFVDQSS

SEQ ID NO: 2815823 - protein, 18 aa, Entamoeba invadens
DSDLFSYDLYVSIQNLDL

SEQ ID NO: 2815824 - protein, 29 aa, Entamoeba invadens
DSDSAYLIFPFLCSFIAIILSFLAVPISA

SEQ ID NO: 2815825 - protein, 31 aa, Entamoeba invadens
DSESPFYYGFKKFFGYFTLISYIIPISCQVS

SEQ ID NO: 2815826 - protein, 26 aa, Entamoeba invadens
DSFDPLFKEGFCKHLIPAALHRYDEQ

SEQ ID NO: 2815827 - protein, 17 aa, Entamoeba invadens
DSFFKMLDKMKYIIIIF

SEQ ID NO: 2815828 - protein, 25 aa, Entamoeba invadens
DSFGKYYWKSLLFEDRNAPLAIYTD

SEQ ID NO: 2815829 - protein, 24 aa, Entamoeba invadens
DSFKDKVSVFFKYFNREISAFVSD

SEQ ID NO: 2815830 - protein, 23 aa, Entamoeba invadens
DSFKTIYFIISEVPLQFICCGIF

SEQ ID NO: 2815831 - protein, 21 aa, Entamoeba invadens
DSFTFEFCIKWVFTLSLRIRN

SEQ ID NO: 2815832 - protein, 30 aa, Entamoeba invadens
DSGDLDAFFIFVMDCILMYEGVLDLVLNSV

SEQ ID NO: 2815833 - protein, 28 aa, Entamoeba invadens
DSGLFLGILFLFLIACAMILFGAFVGIF

SEQ ID NO: 2815834 - protein, 18 aa, Entamoeba invadens
DSGLTILYLMKKLNGWIA

SEQ ID NO: 2815835 - protein, 19 aa, Entamoeba invadens
DSIDFLEDLLYLQGINVAH

SEQ ID NO: 2815836 - protein, 24 aa, Entamoeba invadens
DSIIMSGTVFWYGERQYILVVSNQ

SEQ ID NO: 2815837 - protein, 17 aa, Entamoeba invadens
DSIIRAHSFRFSENSTL

SEQ ID NO: 2815838 - protein, 28 aa, Entamoeba invadens
DSINYTLFVFEWNTIIISLQKSYTLTSN

SEQ ID NO: 2815839 - protein, 24 aa, Entamoeba invadens
DSKCIICVDGYFPKNGSCETCAMN

SEQ ID NO: 2815840 - protein, 28 aa, Entamoeba invadens
DSKFVRKCQICDLGFYPSKTTGKCISCD

SEQ ID NO: 2815841 - protein, 24 aa, Entamoeba invadens
DSKKSFYIYFFATAFLIGENLLRF

SEQ ID NO: 2815842 - protein, 26 aa, Entamoeba invadens
DSKYKPILTFFLSIYPLWDCHNPQHN

SEQ ID NO: 2815843 - protein, 25 aa, Entamoeba invadens
DSLKQLVDYFILAVTIVVAAVPEGL

SEQ ID NO: 2815844 - protein, 22 aa, Entamoeba invadens
DSMFYFFFGIAQESTTTVSLNF

SEQ ID NO: 2815845 - protein, 28 aa, Entamoeba invadens
DSNAILELLYVVLTVFPVLRKDAIESED

SEQ ID NO: 2815846 - protein, 22 aa, Entamoeba invadens
DSNIRYGIVWGISDKGVLKSAQ

SEQ ID NO: 2815847 - protein, 20 aa, Entamoeba invadens
DSNVFYLEEGVCKRCSNSIS

SEQ ID NO: 2815848 - protein, 19 aa, Entamoeba invadens
DSNYLRKCYECQIGYYPSS

SEQ ID NO: 2815849 - protein, 19 aa, Entamoeba invadens
DSNYVAKIYGFILSPLCVV

SEQ ID NO: 2815850 - protein, 18 aa, Entamoeba invadens
DSPFYFVIVGKHNLPIFF

SEQ ID NO: 2815851 - protein, 17 aa, Entamoeba invadens
DSQLIEMMWDLVKEFNF

SEQ ID NO: 2815852 - protein, 19 aa, Entamoeba invadens
DSRCKDMFTYICMDGKCVV

SEQ ID NO: 2815853 - protein, 31 aa, Entamoeba invadens
DSRITILVRVIVPIIIFFNIGIFITSNTGIG

SEQ ID NO: 2815854 - protein, 24 aa, Entamoeba invadens
DSSAAFFIFLVCLQALIHNNESSF

SEQ ID NO: 2815855 - protein, 22 aa, Entamoeba invadens
DSSCFICDSSFNRVHTCNGACN

SEQ ID NO: 2815856 - protein, 46 aa, Entamoeba invadens
DSSDANHLIWLVVIPAFLVVVLLLLAAVFLSFKLRKYIANKRQFHR

SEQ ID NO: 2815857 - protein, 27 aa, Entamoeba invadens
DSSEDWYITPLNNVTILLIQPSSIKTE

SEQ ID NO: 2815858 - protein, 30 aa, Entamoeba invadens
DSSLILLWRDELLLNSLFYERQYFGKGTPE

SEQ ID NO: 2815859 - protein, 24 aa, Entamoeba invadens
DSSSTILFWCYMLTIVTMAVNIIV

SEQ ID NO: 2815860 - protein, 23 aa, Entamoeba invadens
DSSTLILPFGLELGYNAVLSLHN

SEQ ID NO: 2815861 - protein, 25 aa, Entamoeba invadens
DSSTSVPFILWYDSGNCLVDTIHFY

SEQ ID NO: 2815862 - protein, 29 aa, Entamoeba invadens
DSTESIILYIDYPFTFKHCPCFGELCTIH

SEQ ID NO: 2815863 - protein, 21 aa, Entamoeba invadens
DSTHLFVLKSTAPPKSTLFTT

SEQ ID NO: 2815864 - protein, 23 aa, Entamoeba invadens
DSTNDIPIKFYLSKKTLDFGNPT

SEQ ID NO: 2815865 - protein, 26 aa, Entamoeba invadens
DSTSTILFWCYMLAIFTFAVDIVITM

SEQ ID NO: 2815866 - protein, 20 aa, Entamoeba invadens
DSVIKYDKGLWYRLIHVTEG

SEQ ID NO: 2815867 - protein, 47 aa, Entamoeba invadens
DSVKLGVVIGIPISVLILIKIVVSTIIVTIIILILHNKEEEKYHNIC

SEQ ID NO: 2815868 - protein, 27 aa, Entamoeba invadens
DSVPIHIEILLTYLYDYCYDSPNIFAP

SEQ ID NO: 2815869 - protein, 50 aa, Entamoeba invadens
DSVYLGVVIGVPLSLVVVLILIVSIIIVLIYFLLMKKQEEVKMRNICVFP

SEQ ID NO: 2815870 - protein, 20 aa, Entamoeba invadens
DSYTLWRCYASGVSQKSKAT

SEQ ID NO: 2815871 - protein, 26 aa, Entamoeba invadens
DSYVMTLMIMAFYFDVPLPIHHPENV

SEQ ID NO: 2815872 - protein, 29 aa, Entamoeba invadens
DSYYLSLEGFLVLYRTYFKFTDTQQRMIF

SEQ ID NO: 2815873 - protein, 28 aa, Entamoeba invadens
DTAFQEIFFFYVFFTLFVFFLCVVICKA

SEQ ID NO: 2815874 - protein, 27 aa, Entamoeba invadens
DTCTAFVRMLFVAIIGLKSAPFMHGHI

SEQ ID NO: 2815875 - protein, 18 aa, Entamoeba invadens
DTCTKCNAGYALNNGACV

SEQ ID NO: 2815876 - protein, 24 aa, Entamoeba invadens
DTDLPQLIFLFNNAFQMSSEEDKE

SEQ ID NO: 2815877 - protein, 28 aa, Entamoeba invadens
DTDNVIPFNVYFFISVRGYKRVNLTIEF

SEQ ID NO: 2815878 - protein, 17 aa, Entamoeba invadens
DTDPIFEKVIHDTYPKL

SEQ ID NO: 2815879 - protein, 23 aa, Entamoeba invadens
DTFIGCTLCKPNYFPKNKTCHLC

SEQ ID NO: 2815880 - protein, 20 aa, Entamoeba invadens
DTFRIFGTMNPGGDFGKREL

SEQ ID NO: 2815881 - protein, 20 aa, Entamoeba invadens
DTFTLPLFNENIYVSLIDLN

SEQ ID NO: 2815882 - protein, 24 aa, Entamoeba invadens
DTGCLQCEPGFYLHNSRCNKCEMR

SEQ ID NO: 2815883 - protein, 23 aa, Entamoeba invadens
DTIEAIVILIIWSLDSISEAVSR

SEQ ID NO: 2815884 - protein, 17 aa, Entamoeba invadens
DTIHFYMTGINNQWGLY

SEQ ID NO: 2815885 - protein, 31 aa, Entamoeba invadens
DTIVICCVIALFVFLLAGFLIVLVPIKVASK

SEQ ID NO: 2815886 - protein, 24 aa, Entamoeba invadens
DTKIFNQPWVIPQFVIEGKRLERP

SEQ ID NO: 2815887 - protein, 19 aa, Entamoeba invadens
DTKLGLILGASISAFIVLL

SEQ ID NO: 2815888 - protein, 22 aa, Entamoeba invadens
DTKLRCKYYSPNQLKCIECLNA

SEQ ID NO: 2815889 - protein, 30 aa, Entamoeba invadens
DTKSFKIMCTLVSSLIINIPKDLASIWVSL

SEQ ID NO: 2815890 - protein, 24 aa, Entamoeba invadens
DTKTSACIACDLNYVLIGKRCVKT

SEQ ID NO: 2815891 - protein, 30 aa, Entamoeba invadens
DTLDFFVEVAKYWIKNFDIDGWRLDVANEI

SEQ ID NO: 2815892 - protein, 26 aa, Entamoeba invadens
DTLLVELIKHLWPSYYPSFIDEVIST

SEQ ID NO: 2815893 - protein, 17 aa, Entamoeba invadens
DTLMDFVFEHYIVVILG

SEQ ID NO: 2815894 - protein, 28 aa, Entamoeba invadens
DTLSNVINLFFHGTAAPAALPTDLNSKL

SEQ ID NO: 2815895 - protein, 27 aa, Entamoeba invadens
DTMYNALVIILLYQKYMTKGVFVLKKN

SEQ ID NO: 2815896 - protein, 27 aa, Entamoeba invadens
DTNATTCISCYFGFVLNVQTSHCDSSE

SEQ ID NO: 2815897 - protein, 27 aa, Entamoeba invadens
DTNFGNMEFSYLRYLFSGNDLTQIPTI

SEQ ID NO: 2815898 - protein, 23 aa, Entamoeba invadens
DTNGVYIQTFFISVLDAKYVTKN

SEQ ID NO: 2815899 - protein, 19 aa, Entamoeba invadens
DTNLYYLLIAQQQKVQTLV

SEQ ID NO: 2815900 - protein, 26 aa, Entamoeba invadens
DTNNDPIVIFFPMNAGGFIGAEDFLY

SEQ ID NO: 2815901 - protein, 26 aa, Entamoeba invadens
DTNTDPIVVFLPLNGGGYVDAEVYLY

SEQ ID NO: 2815902 - protein, 29 aa, Entamoeba invadens
DTPENITRLPYFKLFRIDTTIPKTPNICE

SEQ ID NO: 2815903 - protein, 48 aa, Entamoeba invadens
DTPRCEKKAVWWVILLIVLFLLILLILLFVVLFSIIIKVLYVVEHHQI

SEQ ID NO: 2815904 - protein, 26 aa, Entamoeba invadens
DTQENDLMIIIFKTLLEEFRRVNEFS

SEQ ID NO: 2815905 - protein, 23 aa, Entamoeba invadens
DTQQYPLFTLYNGFDVFNKDVLL

SEQ ID NO: 2815906 - protein, 27 aa, Entamoeba invadens
DTQVNHFYYIFISIQGFVHTDIDFTVR

SEQ ID NO: 2815907 - protein, 25 aa, Entamoeba invadens
DTRKKEVKRILWVIAFRSCMNFIVW

SEQ ID NO: 2815908 - protein, 25 aa, Entamoeba invadens
DTSDQRLRRFERNKIALAFNDLVEV

SEQ ID NO: 2815909 - protein, 30 aa, Entamoeba invadens
DTSITPYKFTLTLLWLDVELTSTSINPMNE

SEQ ID NO: 2815910 - protein, 22 aa, Entamoeba invadens
DTTCYLCDFTTLLKGVCNEMNE

SEQ ID NO: 2815911 - protein, 23 aa, Entamoeba invadens
DTTFYLVDSMVYLSFNNNSLIMF

SEQ ID NO: 2815912 - protein, 17 aa, Entamoeba invadens
DTTTCSGALYPLPDIIY

SEQ ID NO: 2815913 - protein, 47 aa, Entamoeba invadens
DTYCNSHVVWWVILIGVLLIIVILIVTILVIVLIVKHVSKYLKEKSI

SEQ ID NO: 2815914 - protein, 45 aa, Entamoeba invadens
DTYLSGMFDFIYKYILNYTSIGLFLFWMLLGKSLPQKILLGVLFI

SEQ ID NO: 2815915 - protein, 23 aa, Entamoeba invadens
DVCKVCIGGYYLSNSQCLECPAG

SEQ ID NO: 2815916 - protein, 22 aa, Entamoeba invadens
DVCLKCQQTYYLDSNYKCKKCT

SEQ ID NO: 2815917 - protein, 22 aa, Entamoeba invadens
DVCLTCPSPYIFNASTKECDAP

SEQ ID NO: 2815918 - protein, 21 aa, Entamoeba invadens
DVCYSILNFTSIDIELTTTGT

SEQ ID NO: 2815919 - protein, 21 aa, Entamoeba invadens
DVEFSYLRYLFSGNEFTQIPT

SEQ ID NO: 2815920 - protein, 30 aa, Entamoeba invadens
DVFAYGMVLYETFSWKLLYQQFEHVMDIQK

SEQ ID NO: 2815921 - protein, 21 aa, Entamoeba invadens
DVFKCIKCNLGSYVKDGVCVN

SEQ ID NO: 2815922 - protein, 24 aa, Entamoeba invadens
DVFLLKPNYCCEVLISVLPTCTFK

SEQ ID NO: 2815923 - protein, 20 aa, Entamoeba invadens
DVFMSRLFKRLKAQVYLRFH

SEQ ID NO: 2815924 - protein, 25 aa, Entamoeba invadens
DVFSFAICILEIWLTKSPYDPDVFA

SEQ ID NO: 2815925 - protein, 38 aa, Entamoeba invadens
DVFSFAITMYECLIWANPFPKDKFKYPWSIADFITSGK

SEQ ID NO: 2815926 - protein, 37 aa, Entamoeba invadens
DVFSFAITMYEVFGWNYAYPKETFKFPWKIAEFVTLG

SEQ ID NO: 2815927 - protein, 33 aa, Entamoeba invadens
DVFSFAVVMYEIFVWGPPYPKSEFQFPWNIAEF

SEQ ID NO: 2815928 - protein, 25 aa, Entamoeba invadens
DVFSIGLLYLYLTLKCIPSKTKYIH

SEQ ID NO: 2815929 - protein, 27 aa, Entamoeba invadens
DVGDYDTTYLFCKYKGVNTFFEDVVPA

SEQ ID NO: 2815930 - protein, 34 aa, Entamoeba invadens
DVHMWQHFLVIVPPIFLMIFALPFCLSSMTLIRY

SEQ ID NO: 2815931 - protein, 26 aa, Entamoeba invadens
DVILIVWYCYFALRRKIRKNKEVNEI

SEQ ID NO: 2815932 - protein, 18 aa, Entamoeba invadens
DVIMVLFKMFGASMVNYF

SEQ ID NO: 2815933 - protein, 19 aa, Entamoeba invadens
DVITKLSPIYFGGGTVYSS

SEQ ID NO: 2815934 - protein, 17 aa, Entamoeba invadens
DVKIQDELLYKLKKYIL

SEQ ID NO: 2815935 - protein, 27 aa, Entamoeba invadens
DVKMYNIIVLCWSQHPLERLKIEEVVS

SEQ ID NO: 2815936 - protein, 28 aa, Entamoeba invadens
DVKMYNIIVLCWSQHPLERLKIEEVVSM

SEQ ID NO: 2815937 - protein, 27 aa, Entamoeba invadens
DVLERGMLLIFKGLYILCSSTTLLLAI

SEQ ID NO: 2815938 - protein, 20 aa, Entamoeba invadens
DVLIGCSQIFTIGLPGAEVL

SEQ ID NO: 2815939 - protein, 21 aa, Entamoeba invadens
DVLITFLIRFLSASAQSEIFN

SEQ ID NO: 2815940 - protein, 27 aa, Entamoeba invadens
DVLLQSLNLFFLFPETIKKVKQSLEIY

SEQ ID NO: 2815941 - protein, 26 aa, Entamoeba invadens
DVLLQSLNLFFLFPETIKNVKQSLEI

SEQ ID NO: 2815942 - protein, 28 aa, Entamoeba invadens
DVLRDLLDTFYMYPPIEFIVKNEEKEVT

SEQ ID NO: 2815943 - protein, 28 aa, Entamoeba invadens
DVNETGWFYFIIGLFTLIVVITLFHKYL

SEQ ID NO: 2815944 - protein, 24 aa, Entamoeba invadens
DVNQYTLTMIKFNSPLTINFKSDV

SEQ ID NO: 2815945 - protein, 24 aa, Entamoeba invadens
DVNSYIRFHPFVIDKKSFDGMKHV

SEQ ID NO: 2815946 - protein, 23 aa, Entamoeba invadens
DVPLHLRVKICLDAARGISYLHN

SEQ ID NO: 2815947 - protein, 27 aa, Entamoeba invadens
DVPLTDDLFYILITNILDALQSTRSDI

SEQ ID NO: 2815948 - protein, 18 aa, Entamoeba invadens
DVPRHTLMVMEFAPYGSV

SEQ ID NO: 2815949 - protein, 20 aa, Entamoeba invadens
DVPYIYRDLSIVDEYAFSGT

SEQ ID NO: 2815950 - protein, 24 aa, Entamoeba invadens
DVQTVENTLLLLQSLMNGKSKTEI

SEQ ID NO: 2815951 - protein, 26 aa, Entamoeba invadens
DVRFKKWSVWQINPDYSWKLFPPGAA

SEQ ID NO: 2815952 - protein, 24 aa, Entamoeba invadens
DVRKHLGPLLINPGNRKPEVLDYL

SEQ ID NO: 2815953 - protein, 27 aa, Entamoeba invadens
DVSFHIIFIPFYFLLGVIFIFPMVSFF

SEQ ID NO: 2815954 - protein, 25 aa, Entamoeba invadens
DVSGIIAFFLAFTLPCIYVFMSLYR

SEQ ID NO: 2815955 - protein, 33 aa, Entamoeba invadens
DVSISSYKWPYIKFIFKMSYAALFFTNKKTYNK

SEQ ID NO: 2815956 - protein, 22 aa, Entamoeba invadens
DVSQYPVFPWVIKDNKSQSIDL

SEQ ID NO: 2815957 - protein, 34 aa, Entamoeba invadens
DVTLKIWDMFLLEGFVWLVKVSAAFLLIHSDLFN

SEQ ID NO: 2815958 - protein, 18 aa, Entamoeba invadens
DVTPLGRLLNYFSRDLRF

SEQ ID NO: 2815959 - protein, 24 aa, Entamoeba invadens
DVTRFRLLNIYLSSLSLNKSNALS

SEQ ID NO: 2815960 - protein, 19 aa, Entamoeba invadens
DVTSLYQPLLLIFGEENFA

SEQ ID NO: 2815961 - protein, 24 aa, Entamoeba invadens
DVVEMTIFALTKRVLFISETTVSV

SEQ ID NO: 2815962 - protein, 32 aa, Entamoeba invadens
DVVGFFSKRRLEWHYLFLACGYTGIVLVTLYE

SEQ ID NO: 2815963 - protein, 19 aa, Entamoeba invadens
DVVLAYRLTQEWTSIVFKS

SEQ ID NO: 2815964 - protein, 26 aa, Entamoeba invadens
DVVTVPYYFKFVPLTSLSQKSQIKLR

SEQ ID NO: 2815965 - protein, 20 aa, Entamoeba invadens
DVVYLFRRRYVMQHTGLEFF

SEQ ID NO: 2815966 - protein, 17 aa, Entamoeba invadens
DVWKKEFVLGFLHTSDL

SEQ ID NO: 2815967 - protein, 22 aa, Entamoeba invadens
DVYSFAITMFEVFRLKKAYPID

SEQ ID NO: 2815968 - protein, 17 aa, Entamoeba invadens
DVYSFAITMYECFVWGE

SEQ ID NO: 2815969 - protein, 28 aa, Entamoeba invadens
DVYSFGMTLCYIIKWNDPFDGMNFVGIP

SEQ ID NO: 2815970 - protein, 28 aa, Entamoeba invadens
DVYSYAITILEIWIGKCPYNPLQFPDNE

SEQ ID NO: 2815971 - protein, 26 aa, Entamoeba invadens
DWDLWGPMFVCYLLALLLSINSMIAN

SEQ ID NO: 2815972 - protein, 20 aa, Entamoeba invadens
DWLHCLFLIVFLIKNNSNKN

SEQ ID NO: 2815973 - protein, 27 aa, Entamoeba invadens
DWLQTDGLLFFMAFKRIELYIKHLFDI

SEQ ID NO: 2815974 - protein, 23 aa, Entamoeba invadens
DWNIIAYYISFVMVGILVITGVK

SEQ ID NO: 2815975 - protein, 21 aa, Entamoeba invadens
DWSHVYTWMRETYGYQIANEY

SEQ ID NO: 2815976 - protein, 17 aa, Entamoeba invadens
DWYLIPGSEKTLLVSTC

SEQ ID NO: 2815977 - protein, 20 aa, Entamoeba invadens
DYDELIENIKLGEGSFGIVF

SEQ ID NO: 2815978 - protein, 19 aa, Entamoeba invadens
DYEFLITHVLHDTSLTTLN

SEQ ID NO: 2815979 - protein, 19 aa, Entamoeba invadens
DYFNIFFLTFFKFFNSINL

SEQ ID NO: 2815980 - protein, 24 aa, Entamoeba invadens
DYGFIDVEILLRVTPLPTTSSSEP

SEQ ID NO: 2815981 - protein, 29 aa, Entamoeba invadens
DYGNGTLVWIICCVLCIIGLPCCACIPCC

SEQ ID NO: 2815982 - protein, 26 aa, Entamoeba invadens
DYHVDFEMIKLYLKGPTTSDAFQMGK

SEQ ID NO: 2815983 - protein, 20 aa, Entamoeba invadens
DYIVHFYGAVMLKKKRCLVT

SEQ ID NO: 2815984 - protein, 21 aa, Entamoeba invadens
DYIYSLLEYKLFFGETVLICI

SEQ ID NO: 2815985 - protein, 24 aa, Entamoeba invadens
DYKEFCIDVISFRYKPNWNANQLS

SEQ ID NO: 2815986 - protein, 19 aa, Entamoeba invadens
DYLGIMASVYRYLKETEDG

SEQ ID NO: 2815987 - protein, 29 aa, Entamoeba invadens
DYMKVNLHNPILMKLRIKFMSDSAKGIEY

SEQ ID NO: 2815988 - protein, 23 aa, Entamoeba invadens
DYNDLYFANIFVGQTAMSCTQLQ

SEQ ID NO: 2815989 - protein, 17 aa, Entamoeba invadens
DYNNGIIQCTLCFAPYI

SEQ ID NO: 2815990 - protein, 21 aa, Entamoeba invadens
DYRCALINYGYFFVRIGVIIG

SEQ ID NO: 2815991 - protein, 26 aa, Entamoeba invadens
DYRLESKLPKYYLVKKTFEETTTCLF

SEQ ID NO: 2815992 - protein, 23 aa, Entamoeba invadens
DYSNSILFEIWGTLYDNTDTLTV

SEQ ID NO: 2815993 - protein, 25 aa, Entamoeba invadens
DYSRKCIKCNAGFYIVNGLCQKCDS

SEQ ID NO: 2815994 - protein, 24 aa, Entamoeba invadens
DYSYNVIPKCQIADYVNSQHICTT

SEQ ID NO: 2815995 - protein, 26 aa, Entamoeba invadens
DYTFSYPLVIAQLTNTSLFKSNADLT

SEQ ID NO: 2815996 - protein, 26 aa, Entamoeba invadens
DYTQENYLIVPFYYSNSQPNPQYSNN

SEQ ID NO: 2815997 - protein, 20 aa, Entamoeba invadens
DYVAVEHNCLHYNLIEHCTT

SEQ ID NO: 2815998 - protein, 17 aa, Entamoeba invadens
DYVKLVILFVSHAGVLL

SEQ ID NO: 2815999 - protein, 18 aa, Entamoeba invadens
DYVLKDGICLYYTEIEFC

SEQ ID NO: 2816000 - protein, 19 aa, Entamoeba invadens
DYVLKDGICLYYTEIEFCT

SEQ ID NO: 2816001 - protein, 24 aa, Entamoeba invadens
DYVLKDGICLYYTEIEFCTSANNG

SEQ ID NO: 2816002 - protein, 24 aa, Entamoeba invadens
DYVLYLLFILGLIDTFSVLYVPLH

SEQ ID NO: 2816003 - protein, 19 aa, Entamoeba invadens
DYVNNQHICTACFAPYITS

SEQ ID NO: 2816004 - protein, 19 aa, Entamoeba invadens
DYVNNQHICTACFAPYVTS

SEQ ID NO: 2816005 - protein, 19 aa, Entamoeba invadens
DYYLVPINDVYMIFVRSEL

SEQ ID NO: 2816006 - protein, 23 aa, Entamoeba invadens
DYYVGDWWGIWSSTRVQQGLRVR

SEQ ID NO: 2816007 - protein, 26 aa, Entamoeba invadens
EAATNYKIIYFSYNTNYYLSNGGQSL

SEQ ID NO: 2816008 - protein, 17 aa, Entamoeba invadens
EACEFEIFVTPHCSLKL

SEQ ID NO: 2816009 - protein, 25 aa, Entamoeba invadens
EACEFEVFLTLFCTTDLEDEILLIS

SEQ ID NO: 2816010 - protein, 21 aa, Entamoeba invadens
EACLYQPDFLLPVLCKMKNSS

SEQ ID NO: 2816011 - protein, 25 aa, Entamoeba invadens
EACWRQIVLLALTRKGKDYEIEPLM

SEQ ID NO: 2816012 - protein, 31 aa, Entamoeba invadens
EADKYSLGPFWYTFGLAVMCGVLSIPVAIHG

SEQ ID NO: 2816013 - protein, 30 aa, Entamoeba invadens
EADTQLFPSQFYLLSLFGFISDQLLVKNLV

SEQ ID NO: 2816014 - protein, 24 aa, Entamoeba invadens
EAESLLQYNFSMGPAIVTLVFAVI

SEQ ID NO: 2816015 - protein, 26 aa, Entamoeba invadens
EAFPKSEFKYPWKIPDFVNGGNRLQK

SEQ ID NO: 2816016 - protein, 24 aa, Entamoeba invadens
EAFRLKICLDAAKGILYLHTNGIL

SEQ ID NO: 2816017 - protein, 17 aa, Entamoeba invadens
EAFTWKDAFEDIKYFFE

SEQ ID NO: 2816018 - protein, 24 aa, Entamoeba invadens
EAGDLIPWTLTQQFLDDEFAGLTG

SEQ ID NO: 2816019 - protein, 24 aa, Entamoeba invadens
EAIQQGMVFVVLSSFGYSFELKRP

SEQ ID NO: 2816020 - protein, 29 aa, Entamoeba invadens
EAKKSTRFLLPRYILNNLRHEHIGILIGA

SEQ ID NO: 2816021 - protein, 17 aa, Entamoeba invadens
EAKLRCKYYSPNQLKCI

SEQ ID NO: 2816022 - protein, 21 aa, Entamoeba invadens
EAKWYGIVVQWIVLLSPPINL

SEQ ID NO: 2816023 - protein, 24 aa, Entamoeba invadens
EALGSFLGLLTLGLNKPLRTNRLM

SEQ ID NO: 2816024 - protein, 27 aa, Entamoeba invadens
EALILLLAILFYYIFAKSLPSVDDIKF

SEQ ID NO: 2816025 - protein, 22 aa, Entamoeba invadens
EALVLHKLPKLKTIGRFAFERT

SEQ ID NO: 2816026 - protein, 21 aa, Entamoeba invadens
EALVVSALVFFVPFSACVTED

SEQ ID NO: 2816027 - protein, 21 aa, Entamoeba invadens
EANLFYAEFIRDFAMLWRHDD

SEQ ID NO: 2816028 - protein, 25 aa, Entamoeba invadens
EANVICKILYVYNKTRIIVDNFTPN

SEQ ID NO: 2816029 - protein, 19 aa, Entamoeba invadens
EANVICNYLIIVDNFTSNK

SEQ ID NO: 2816030 - protein, 19 aa, Entamoeba invadens
EAPILTGRMAHVITKNLKK

SEQ ID NO: 2816031 - protein, 22 aa, Entamoeba invadens
EAPTEMMYFPQLKAVCTAEEIN

SEQ ID NO: 2816032 - protein, 40 aa, Entamoeba invadens
EAPTGAIIFLLTFALKMFFALPKIRFLLNRPTVELYKLPD

SEQ ID NO: 2816033 - protein, 22 aa, Entamoeba invadens
EAPVRYNIVIFSTFHKYIPPFI

SEQ ID NO: 2816034 - protein, 33 aa, Entamoeba invadens
EAQKKYFICSFEKKAWIYLNNKHRFLGVENHPE

SEQ ID NO: 2816035 - protein, 17 aa, Entamoeba invadens
EAQQGAEYYIYISEASK

SEQ ID NO: 2816036 - protein, 21 aa, Entamoeba invadens
EARLNLIELITKDIVNFDAEI

SEQ ID NO: 2816037 - protein, 28 aa, Entamoeba invadens
EASISIFYFFYVIICFIIFANKTYRSAP

SEQ ID NO: 2816038 - protein, 23 aa, Entamoeba invadens
EASNILFPQIIFGVLDCSGLNDK

SEQ ID NO: 2816039 - protein, 24 aa, Entamoeba invadens
EASPYICCLFLLVAPMYSQLISLP

SEQ ID NO: 2816040 - protein, 24 aa, Entamoeba invadens
EASSCLAGFYLDVDTCVFCPIGYY

SEQ ID NO: 2816041 - protein, 21 aa, Entamoeba invadens
EASSFLQYITGGYSLKSVGDN

SEQ ID NO: 2816042 - protein, 34 aa, Entamoeba invadens
EATNSRTMWFSILTMIIVVLLTLFQVNSLKNFFL

SEQ ID NO: 2816043 - protein, 28 aa, Entamoeba invadens
EATTLLIEEFEGTLFPFKCGSASHLEKV

SEQ ID NO: 2816044 - protein, 28 aa, Entamoeba invadens
EAVAFIAAWFCQLPVYWEEPVVNKQLMY

SEQ ID NO: 2816045 - protein, 17 aa, Entamoeba invadens
EAVRKGYWIVLDELNLA

SEQ ID NO: 2816046 - protein, 19 aa, Entamoeba invadens
EAYDKQTFKFPWKIAEFVI

SEQ ID NO: 2816047 - protein, 22 aa, Entamoeba invadens
EAYFCFHMILFAISFFIQNESP

SEQ ID NO: 2816048 - protein, 26 aa, Entamoeba invadens
EAYIQPLYNIFVVAVRQFFFSGPSNT

SEQ ID NO: 2816049 - protein, 31 aa, Entamoeba invadens
EAYNKTEFKFPWKIAEFVIGKNRLKIAEPIQ

SEQ ID NO: 2816050 - protein, 20 aa, Entamoeba invadens
EAYPISTFKFPWKIAEFVSS

SEQ ID NO: 2816051 - protein, 17 aa, Entamoeba invadens
EAYPITTFKFPWKIAEF

SEQ ID NO: 2816052 - protein, 18 aa, Entamoeba invadens
EAYPKEEFKFPWKIAEFV

SEQ ID NO: 2816053 - protein, 25 aa, Entamoeba invadens
EAYPKSEFKYPWKIADFVNGGNRLQ

SEQ ID NO: 2816054 - protein, 26 aa, Entamoeba invadens
EAYPKTQFMFPWKIAEFVMAGNHLKR

SEQ ID NO: 2816055 - protein, 30 aa, Entamoeba invadens
EAYQNDTFKFPWKIAEFVIHNNRLKRKDPI

SEQ ID NO: 2816056 - protein, 31 aa, Entamoeba invadens
EAYQNDTFKFPWKIAEFVIHNNRLKRKDPIE

SEQ ID NO: 2816057 - protein, 26 aa, Entamoeba invadens
EAYTGDEFKFPWSIANFVASGKRLSV

SEQ ID NO: 2816058 - protein, 18 aa, Entamoeba invadens
EAYYFQDPVKFKGKYVRA

SEQ ID NO: 2816059 - protein, 23 aa, Entamoeba invadens
ECASLLFWAYLCSIVTLSGWLVV

SEQ ID NO: 2816060 - protein, 25 aa, Entamoeba invadens
ECCIFPLMFLIIPLALVPAMTVIVL

SEQ ID NO: 2816061 - protein, 33 aa, Entamoeba invadens
ECDKPNGLMLLSSFVKFFIKLLQHLPKSIAKEM

SEQ ID NO: 2816062 - protein, 24 aa, Entamoeba invadens
ECDTSNCFITIQSYLKLVTVDLLS

SEQ ID NO: 2816063 - protein, 18 aa, Entamoeba invadens
ECEYPHPVFNIFKGFFSL

SEQ ID NO: 2816064 - protein, 17 aa, Entamoeba invadens
ECFDACDDGYFKDTINE

SEQ ID NO: 2816065 - protein, 26 aa, Entamoeba invadens
ECFGWCNAFPPDKFKFAWDIADFISG

SEQ ID NO: 2816066 - protein, 19 aa, Entamoeba invadens
ECFSGYFLTSSYTCELCSA

SEQ ID NO: 2816067 - protein, 20 aa, Entamoeba invadens
ECHLRLKALGYLFNNIKLTQ

SEQ ID NO: 2816068 - protein, 18 aa, Entamoeba invadens
ECHTFRYTLFTILHTSTI

SEQ ID NO: 2816069 - protein, 18 aa, Entamoeba invadens
ECISGYYPSLGKCNKCDS

SEQ ID NO: 2816070 - protein, 26 aa, Entamoeba invadens
ECISWSYAYSYDKFKFPWSIAEFVIK

SEQ ID NO: 2816071 - protein, 41 aa, Entamoeba invadens
ECKRFPKFFHCIVALAPIKLVHLVIVLFPTFIDIKNVKGST

SEQ ID NO: 2816072 - protein, 21 aa, Entamoeba invadens
ECKTCILKHKFNSTVKKCFKC

SEQ ID NO: 2816073 - protein, 18 aa, Entamoeba invadens
ECKTYIEPTQTKTFTTLK

SEQ ID NO: 2816074 - protein, 18 aa, Entamoeba invadens
ECLDLLSVKYTLKSLFAA

SEQ ID NO: 2816075 - protein, 17 aa, Entamoeba invadens
ECLECLPAYYKYRVNES

SEQ ID NO: 2816076 - protein, 22 aa, Entamoeba invadens
ECLKDYMWFGEGKCLPYNATEL

SEQ ID NO: 2816077 - protein, 18 aa, Entamoeba invadens
ECLLSGVLTLDIPVTINS

SEQ ID NO: 2816078 - protein, 18 aa, Entamoeba invadens
ECLLVFNKELYVNFITVN

SEQ ID NO: 2816079 - protein, 18 aa, Entamoeba invadens
ECLTCFEGFYLKEEKCAN

SEQ ID NO: 2816080 - protein, 25 aa, Entamoeba invadens
ECLTDSYSWIFFPPHSFEGITPSKK

SEQ ID NO: 2816081 - protein, 34 aa, Entamoeba invadens
ECSPQYQWSLFYNQVEQELFYSYTKQITKNSIVA

SEQ ID NO: 2816082 - protein, 18 aa, Entamoeba invadens
ECTACIANYILQSDKTCV

SEQ ID NO: 2816083 - protein, 18 aa, Entamoeba invadens
ECTACMAEYKLEGGKCNG

SEQ ID NO: 2816084 - protein, 19 aa, Entamoeba invadens
ECTACMAEYKLEGGKCNGT

SEQ ID NO: 2816085 - protein, 18 aa, Entamoeba invadens
ECTACMAEYTLEGGKCNG

SEQ ID NO: 2816086 - protein, 19 aa, Entamoeba invadens
ECTKLFLLINNTCVTQSEV

SEQ ID NO: 2816087 - protein, 26 aa, Entamoeba invadens
ECVCKAGYYTTSWGSCIPCDRHISGC

SEQ ID NO: 2816088 - protein, 52 aa, Entamoeba invadens
ECVHKTNVLAIIFPIIFGILMVVLIIITISCILFYIHYRKEEMLRKSLVNEF

SEQ ID NO: 2816089 - protein, 40 aa, Entamoeba invadens
ECVSEAVWWVILLCVFFVVILLVLLVVLTTVIINKLVKKQ

SEQ ID NO: 2816090 - protein, 19 aa, Entamoeba invadens
ECYEGKFDLTLRLCSPCTD

SEQ ID NO: 2816091 - protein, 18 aa, Entamoeba invadens
ECYEQAILIALLNQFCSI

SEQ ID NO: 2816092 - protein, 18 aa, Entamoeba invadens
ECYNCENGFYLVNESCLK

SEQ ID NO: 2816093 - protein, 17 aa, Entamoeba invadens
EDADTFLRVCQLIYVCF

SEQ ID NO: 2816094 - protein, 25 aa, Entamoeba invadens
EDAETRQICYCTFNPVIQQDCILSC

SEQ ID NO: 2816095 - protein, 27 aa, Entamoeba invadens
EDDVKLNISKLYKQTFLSFSFGEIGVK

SEQ ID NO: 2816096 - protein, 32 aa, Entamoeba invadens
EDELMKIVRQLAWIGLGNFLGGILKTICFNIL

SEQ ID NO: 2816097 - protein, 25 aa, Entamoeba invadens
EDERPILVEPLKYDKLMKTSKVVKV

SEQ ID NO: 2816098 - protein, 22 aa, Entamoeba invadens
EDFEFYHTLYTDDCTLLIPHVI

SEQ ID NO: 2816099 - protein, 20 aa, Entamoeba invadens
EDFGCRRPTYMCDGDNGYYC

SEQ ID NO: 2816100 - protein, 18 aa, Entamoeba invadens
EDFLQIFAFCQNKQLLAC

SEQ ID NO: 2816101 - protein, 38 aa, Entamoeba invadens
EDFQTSFLSFIIPTCLLLCLFTLNWVRRFPLINKVCVV

SEQ ID NO: 2816102 - protein, 17 aa, Entamoeba invadens
EDGFALKDNLCHKCGEN

SEQ ID NO: 2816103 - protein, 17 aa, Entamoeba invadens
EDGFALKDNLCHKCGKN

SEQ ID NO: 2816104 - protein, 27 aa, Entamoeba invadens
EDGKYPVYGLLLANLVVPYYVSKKRYR

SEQ ID NO: 2816105 - protein, 25 aa, Entamoeba invadens
EDGSTLLCLFGIEDPLRPEVEEAVR

SEQ ID NO: 2816106 - protein, 46 aa, Entamoeba invadens
EDGTYCETQAVWWVIFLMVLLFIIIFVSLIVIIIITTKKIMQKLHK

SEQ ID NO: 2816107 - protein, 17 aa, Entamoeba invadens
EDGYYINSQYCFKCDEV

SEQ ID NO: 2816108 - protein, 19 aa, Entamoeba invadens
EDGYYLLSGRCILGSLKHC

SEQ ID NO: 2816109 - protein, 26 aa, Entamoeba invadens
EDIAYNETYFRIIEYTFKKHNVDVVL

SEQ ID NO: 2816110 - protein, 24 aa, Entamoeba invadens
EDKETYFRRSYWKEITFGNSVTIK

SEQ ID NO: 2816111 - protein, 17 aa, Entamoeba invadens
EDKFFIFTEQPIGLSVD

SEQ ID NO: 2816112 - protein, 34 aa, Entamoeba invadens
EDKSKLPKNPLLGFYLPIIPNTNPVRYEPTCEAC

SEQ ID NO: 2816113 - protein, 23 aa, Entamoeba invadens
EDKTFMGVSYFDLLVYCHKKIQQ

SEQ ID NO: 2816114 - protein, 18 aa, Entamoeba invadens
EDLLKVNVESRELLCIGN

SEQ ID NO: 2816115 - protein, 17 aa, Entamoeba invadens
EDLLRCFPVLHKQLDVR

SEQ ID NO: 2816116 - protein, 18 aa, Entamoeba invadens
EDLMFNLTLTDDSIFHIF

SEQ ID NO: 2816117 - protein, 27 aa, Entamoeba invadens
EDLNDLLIFDEFYDYMMNFDITITDFA

SEQ ID NO: 2816118 - protein, 23 aa, Entamoeba invadens
EDLPELLHLAYNIAIQNQKKGPY

SEQ ID NO: 2816119 - protein, 20 aa, Entamoeba invadens
EDLPFYEYITVFPAVNGTSD

SEQ ID NO: 2816120 - protein, 38 aa, Entamoeba invadens
EDNEITHYYFAFLIGTFGYFFKKKKLFKNMLDTIKCEW

SEQ ID NO: 2816121 - protein, 23 aa, Entamoeba invadens
EDNLLDQWLVAEYLPSMLNTLLV

SEQ ID NO: 2816122 - protein, 35 aa, Entamoeba invadens
EDNQSIVLLSFVLLLCPLLSALFRAHHMHLLTLIR

SEQ ID NO: 2816123 - protein, 24 aa, Entamoeba invadens
EDRKFKMRCKPSMVTLAGGRACEF

SEQ ID NO: 2816124 - protein, 20 aa, Entamoeba invadens
EDRYYLNTIIPRCYPCQSNC

SEQ ID NO: 2816125 - protein, 29 aa, Entamoeba invadens
EDSLLFNYPFIFSVFPYSNLFFSSFQGWN

SEQ ID NO: 2816126 - protein, 41 aa, Entamoeba invadens
EDSLTLCIMKTFTQALFAAAVEFLLPLRLKHSYHDGHTGWR

SEQ ID NO: 2816127 - protein, 31 aa, Entamoeba invadens
EDSVYPLLAIIFKALDMLPLLHSKRIKYDFK

SEQ ID NO: 2816128 - protein, 23 aa, Entamoeba invadens
EDSYFLQCFVYSYKLITTTSNLL

SEQ ID NO: 2816129 - protein, 22 aa, Entamoeba invadens
EDTFRYFLTLDRTVFDITFIDT

SEQ ID NO: 2816130 - protein, 26 aa, Entamoeba invadens
EDTKYYFLNGMCERLLFYRFNSKEDE

SEQ ID NO: 2816131 - protein, 39 aa, Entamoeba invadens
EDTSKVDLFYLFFLLLPFLVLVVIIPLILCIIKGYQYTQ

SEQ ID NO: 2816132 - protein, 27 aa, Entamoeba invadens
EDVLSCGVLFLSPFFENSFSIAFLMRE

SEQ ID NO: 2816133 - protein, 17 aa, Entamoeba invadens
EDYSCKKCDYSCNYYGG

SEQ ID NO: 2816134 - protein, 31 aa, Entamoeba invadens
EDYTPTTMFLLYFNLIMNRKMTITKGLNVYK

SEQ ID NO: 2816135 - protein, 20 aa, Entamoeba invadens
EDYVKMPYKLKVRMLFDTSR

SEQ ID NO: 2816136 - protein, 21 aa, Entamoeba invadens
EDYVKMPYKLKVRMLFDTSRG

SEQ ID NO: 2816137 - protein, 17 aa, Entamoeba invadens
EEAAFVLPLLFATQKDQ

SEQ ID NO: 2816138 - protein, 19 aa, Entamoeba invadens
EEAQLANGILAILKGHGFD

SEQ ID NO: 2816139 - protein, 20 aa, Entamoeba invadens
EECFKNWMPLSWSSGDVILV

SEQ ID NO: 2816140 - protein, 25 aa, Entamoeba invadens
EECGSLLFFAYLSAIATLSGWMAVI

SEQ ID NO: 2816141 - protein, 30 aa, Entamoeba invadens
EECLKGIRWVLNMFVTLPLDIKNAGLNYLT

SEQ ID NO: 2816142 - protein, 30 aa, Entamoeba invadens
EEDSNVLRPFLFYVVFKKNMIVTIRFNKVL

SEQ ID NO: 2816143 - protein, 23 aa, Entamoeba invadens
EEEFRFQIFKANLAKFRKHNAAN

SEQ ID NO: 2816144 - protein, 29 aa, Entamoeba invadens
EEEIPHLLKLKFLLDASKGIFYLHENNIL

SEQ ID NO: 2816145 - protein, 28 aa, Entamoeba invadens
EEETMRGFNVYFILNWTTGEHKSSSIYT

SEQ ID NO: 2816146 - protein, 26 aa, Entamoeba invadens
EEFEIITQMWWIDPGKRLQIDNFVIF

SEQ ID NO: 2816147 - protein, 23 aa, Entamoeba invadens
EEFKMVIFLFIICGGVVFGRDTV

SEQ ID NO: 2816148 - protein, 17 aa, Entamoeba invadens
EEGKKFVFEAWINKPEE

SEQ ID NO: 2816149 - protein, 19 aa, Entamoeba invadens
EEGTMKCVDNCELGFFKKN

SEQ ID NO: 2816150 - protein, 20 aa, Entamoeba invadens
EEHAVHFVLSCWDFFVKRLE

SEQ ID NO: 2816151 - protein, 24 aa, Entamoeba invadens
EEIGRLLTRIYPYTIHKKLETRTA

SEQ ID NO: 2816152 - protein, 23 aa, Entamoeba invadens
EEIGWRLFLFPEMSKILNPKIST

SEQ ID NO: 2816153 - protein, 17 aa, Entamoeba invadens
EEIHFFPFHSNGQRVAC

SEQ ID NO: 2816154 - protein, 21 aa, Entamoeba invadens
EEINKFVGFFLQAVVLYTDIM

SEQ ID NO: 2816155 - protein, 24 aa, Entamoeba invadens
EEINNLFIRVLLEMALNADALERP

SEQ ID NO: 2816156 - protein, 30 aa, Entamoeba invadens
EEIVFKLNNTLLHFPKLSLKYENVTEKTVF

SEQ ID NO: 2816157 - protein, 18 aa, Entamoeba invadens
EEIVLFASKLELYAICFI

SEQ ID NO: 2816158 - protein, 17 aa, Entamoeba invadens
EEKIKLYQTFRSVRWDP

SEQ ID NO: 2816159 - protein, 22 aa, Entamoeba invadens
EEKPIFIKSLTNLSLQDSEDIF

SEQ ID NO: 2816160 - protein, 23 aa, Entamoeba invadens
EEKRRVLQIITWLLQERVDNELL

SEQ ID NO: 2816161 - protein, 31 aa, Entamoeba invadens
EEKTAFWLNVYHTMLLHALVYMKHRPYLEHK

SEQ ID NO: 2816162 - protein, 28 aa, Entamoeba invadens
EEKYTLRVLPPVAVLRKGLACEFEIYIT

SEQ ID NO: 2816163 - protein, 28 aa, Entamoeba invadens
EELMKKFAIITTLFTPLIFASTAFGMNV

SEQ ID NO: 2816164 - protein, 17 aa, Entamoeba invadens
EELPTLTDPMKLYQISE

SEQ ID NO: 2816165 - protein, 34 aa, Entamoeba invadens
EELVDLQMRYFYDAVPYPIYLRSLEDISTHQYIY

SEQ ID NO: 2816166 - protein, 27 aa, Entamoeba invadens
EEMKKFRLYTVVAPLVDLLVTLSNWYI

SEQ ID NO: 2816167 - protein, 23 aa, Entamoeba invadens
EEMMKRGIALNKYFISLTQNPDK

SEQ ID NO: 2816168 - protein, 26 aa, Entamoeba invadens
EEMYPKDVFKYPWDIAAFVTNGKRKE

SEQ ID NO: 2816169 - protein, 24 aa, Entamoeba invadens
EENLRFIYHCFSGCVNLAAVEVTI

SEQ ID NO: 2816170 - protein, 23 aa, Entamoeba invadens
EENMYFVIMSYIISLMPLSVKKD

SEQ ID NO: 2816171 - protein, 30 aa, Entamoeba invadens
EENYEILQQSLLLALLSWYGEITLRKPNTK

SEQ ID NO: 2816172 - protein, 26 aa, Entamoeba invadens
EEPYNKLEFKFPWKIAEYVISGKRLP

SEQ ID NO: 2816173 - protein, 36 aa, Entamoeba invadens
EEQKSDGWLIWSIWVMMTIVAVITFTVSLMSLIFFK

SEQ ID NO: 2816174 - protein, 27 aa, Entamoeba invadens
EEQMYRPALVLYQFLGELGIMSAQLNA

SEQ ID NO: 2816175 - protein, 17 aa, Entamoeba invadens
EEQYNIIALCWCQDPKS

SEQ ID NO: 2816176 - protein, 28 aa, Entamoeba invadens
EERTNKPYIIVWQNTFPTYPKFYNYNYE

SEQ ID NO: 2816177 - protein, 21 aa, Entamoeba invadens
EESILIRIYVKEWYSMIFKLN

SEQ ID NO: 2816178 - protein, 33 aa, Entamoeba invadens
EESLTFNIDFYRKLLKILRVYMKIAKYQSYGLG

SEQ ID NO: 2816179 - protein, 23 aa, Entamoeba invadens
EETLFRGVFIPFLMTHGWGQKFA

SEQ ID NO: 2816180 - protein, 32 aa, Entamoeba invadens
EETQTKIMAFFMYVLCSFGYSFVIRKPTKTQC

SEQ ID NO: 2816181 - protein, 25 aa, Entamoeba invadens
EEVHKQIVLLLLNLIVMENGVLDPM

SEQ ID NO: 2816182 - protein, 23 aa, Entamoeba invadens
EEVVIKIRIKMMLDAAKGICYLH

SEQ ID NO: 2816183 - protein, 24 aa, Entamoeba invadens
EEWKSGWYILPIKDMSTTKEYLLC

SEQ ID NO: 2816184 - protein, 19 aa, Entamoeba invadens
EEYKLDKETFLCKSKKNYG

SEQ ID NO: 2816185 - protein, 17 aa, Entamoeba invadens
EEYKVLCVIPFSSYRKR

SEQ ID NO: 2816186 - protein, 31 aa, Entamoeba invadens
EEYNEWILYTTGIYLVCIIPAAVIGIFIASK

SEQ ID NO: 2816187 - protein, 26 aa, Entamoeba invadens
EEYTHVYPVIFKNVIKMGILHFEKLN

SEQ ID NO: 2816188 - protein, 26 aa, Entamoeba invadens
EFAHKTFLLFILIKIVFINLCYCTIS

SEQ ID NO: 2816189 - protein, 36 aa, Entamoeba invadens
EFAKFGSLHDLIRNKPLEPFAMKLRIKIMTDLARGV

SEQ ID NO: 2816190 - protein, 17 aa, Entamoeba invadens
EFAKFGSLSYLISKKKI

SEQ ID NO: 2816191 - protein, 27 aa, Entamoeba invadens
EFALKTIQQLLFAFSFNLDVVGYLHNK

SEQ ID NO: 2816192 - protein, 27 aa, Entamoeba invadens
EFCNLGSLRRFIKLNKISTLMKVRFCQ

SEQ ID NO: 2816193 - protein, 19 aa, Entamoeba invadens
EFCPLFSLRKFMKTNSMST

SEQ ID NO: 2816194 - protein, 23 aa, Entamoeba invadens
EFCVDLFSFGKFNNALKIASNMI

SEQ ID NO: 2816195 - protein, 32 aa, Entamoeba invadens
EFDISISIVSLLMLIVMILKKGGILTQKTCKR

SEQ ID NO: 2816196 - protein, 19 aa, Entamoeba invadens
EFDKRMERLEKMISDFEKV

SEQ ID NO: 2816197 - protein, 23 aa, Entamoeba invadens
EFDLSNDDFFLFKEFELKYSKKY

SEQ ID NO: 2816198 - protein, 19 aa, Entamoeba invadens
EFEIFIKPLCSCQIDESIV

SEQ ID NO: 2816199 - protein, 17 aa, Entamoeba invadens
EFEIFITPLCSCQINDK

SEQ ID NO: 2816200 - protein, 22 aa, Entamoeba invadens
EFEIFMTIMCTCTITDCIFIIA

SEQ ID NO: 2816201 - protein, 19 aa, Entamoeba invadens
EFEILLTLLCTSKIESKIL

SEQ ID NO: 2816202 - protein, 26 aa, Entamoeba invadens
EFEITHPLNLTLMKDTFFDKEHVKGD

SEQ ID NO: 2816203 - protein, 27 aa, Entamoeba invadens
EFEKESCIILLLFLNCSNFISFKEEEA

SEQ ID NO: 2816204 - protein, 17 aa, Entamoeba invadens
EFELFIKPLCSCQIKEN

SEQ ID NO: 2816205 - protein, 21 aa, Entamoeba invadens
EFELLLTPKCSCHFSDSISVI

SEQ ID NO: 2816206 - protein, 17 aa, Entamoeba invadens
EFEVFITPYCTMDLSDE

SEQ ID NO: 2816207 - protein, 20 aa, Entamoeba invadens
EFFIQNVYLFESCNKITLCF

SEQ ID NO: 2816208 - protein, 28 aa, Entamoeba invadens
EFGAETLFSQILPLLLSITLEQQERHLL

SEQ ID NO: 2816209 - protein, 17 aa, Entamoeba invadens
EFHVIFRPKCTCNIKKE

SEQ ID NO: 2816210 - protein, 20 aa, Entamoeba invadens
EFISLEFVLATFKASFLEID

SEQ ID NO: 2816211 - protein, 19 aa, Entamoeba invadens
EFKFPWKIAEFVNKGNRLN

SEQ ID NO: 2816212 - protein, 20 aa, Entamoeba invadens
EFKFPWKIAEFVSLGKRLEK

SEQ ID NO: 2816213 - protein, 20 aa, Entamoeba invadens
EFKIFIQPLCTCKVNETIDV

SEQ ID NO: 2816214 - protein, 17 aa, Entamoeba invadens
EFKIRLPPKRMLRVSTC

SEQ ID NO: 2816215 - protein, 26 aa, Entamoeba invadens
EFLACRRLRSLTLRNYFTRFSQIENV

SEQ ID NO: 2816216 - protein, 26 aa, Entamoeba invadens
EFLLMTFWEIIPLSTLLVLFWNVPKS

SEQ ID NO: 2816217 - protein, 18 aa, Entamoeba invadens
EFLQYIKSLPVYHDPLEL

SEQ ID NO: 2816218 - protein, 32 aa, Entamoeba invadens
EFLVVSLFSTMFFFLVSSPYYTTLRYTYNDLV

SEQ ID NO: 2816219 - protein, 21 aa, Entamoeba invadens
EFNSMFVKLWADNGDCLSWEY

SEQ ID NO: 2816220 - protein, 19 aa, Entamoeba invadens
EFPFYINKHRREALQGIWI

SEQ ID NO: 2816221 - protein, 20 aa, Entamoeba invadens
EFQCLKCEKGKYFDFDTKKC

SEQ ID NO: 2816222 - protein, 29 aa, Entamoeba invadens
EFQMLQPGKTYFYSLKTPITLKIYSINDD

SEQ ID NO: 2816223 - protein, 25 aa, Entamoeba invadens
EFSGNAFELFLSTTDIRYVFYNETH

SEQ ID NO: 2816224 - protein, 18 aa, Entamoeba invadens
EFSLFICPLCSFTAEEKL

SEQ ID NO: 2816225 - protein, 18 aa, Entamoeba invadens
EFSLFLNPLCTSTIDSTF

SEQ ID NO: 2816226 - protein, 25 aa, Entamoeba invadens
EFSRLSPMVLFQQSLHFLKTDVWLN

SEQ ID NO: 2816227 - protein, 24 aa, Entamoeba invadens
EFSSGVNMKYFFMRNRPKAERMYI

SEQ ID NO: 2816228 - protein, 24 aa, Entamoeba invadens
EFSSGVNMKYFFMRNRPKAERMYV

SEQ ID NO: 2816229 - protein, 17 aa, Entamoeba invadens
EFSVFVKPLCSCKINNT

SEQ ID NO: 2816230 - protein, 40 aa, Entamoeba invadens
EFSVGHPILHWPLFSGKMRKFALLLFGNKTDVTLALNAGL

SEQ ID NO: 2816231 - protein, 17 aa, Entamoeba invadens
EFSVYVNPLCSCKINST

SEQ ID NO: 2816232 - protein, 17 aa, Entamoeba invadens
EFTKCLPCSAGTYRDEN

SEQ ID NO: 2816233 - protein, 31 aa, Entamoeba invadens
EFTKTVDPAYLLPLLYRLVNLYINNTKLKFN

SEQ ID NO: 2816234 - protein, 23 aa, Entamoeba invadens
EFTNEYIIIQCDITIINVTVEDR

SEQ ID NO: 2816235 - protein, 31 aa, Entamoeba invadens
EFVAEYWHRAVHIGLLFTPTTNMYPISMCFD

SEQ ID NO: 2816236 - protein, 18 aa, Entamoeba invadens
EFVDGWFIKNIYDESEIC

SEQ ID NO: 2816237 - protein, 26 aa, Entamoeba invadens
EFVDKLFTGLLRMKTKQGGKQWNYLS

SEQ ID NO: 2816238 - protein, 17 aa, Entamoeba invadens
EFVLAGDTILLKLNDIK

SEQ ID NO: 2816239 - protein, 19 aa, Entamoeba invadens
EFVVFTHKFVRFGVYKDGE

SEQ ID NO: 2816240 - protein, 23 aa, Entamoeba invadens
EFYENVIKLFEKYLPNPTAVEQF

SEQ ID NO: 2816241 - protein, 21 aa, Entamoeba invadens
EFYIKDLRIKGVKFNELGDAK

SEQ ID NO: 2816242 - protein, 21 aa, Entamoeba invadens
EGAIINFFHLILTRPDKLGAL

SEQ ID NO: 2816243 - protein, 24 aa, Entamoeba invadens
EGCILCNESFFLQNGRCFSCKESC

SEQ ID NO: 2816244 - protein, 23 aa, Entamoeba invadens
EGCILCNESFFLQNGRCFSCKKS

SEQ ID NO: 2816245 - protein, 19 aa, Entamoeba invadens
EGCLNCTSGYYLDAGNCHT

SEQ ID NO: 2816246 - protein, 18 aa, Entamoeba invadens
EGCVLCEESFYLQNGRCF

SEQ ID NO: 2816247 - protein, 24 aa, Entamoeba invadens
EGEREMCWAFGITGFLEAAYNSEA

SEQ ID NO: 2816248 - protein, 18 aa, Entamoeba invadens
EGETLFQGVTFLENIFDD

SEQ ID NO: 2816249 - protein, 29 aa, Entamoeba invadens
EGFDTNEYFIYFWASNMKSGYALFDDFTI

SEQ ID NO: 2816250 - protein, 27 aa, Entamoeba invadens
EGFENKVFYVWFDAPIGYLSITANYTD

SEQ ID NO: 2816251 - protein, 26 aa, Entamoeba invadens
EGGRESFFLFLCASLDFLRNDWTANS

SEQ ID NO: 2816252 - protein, 37 aa, Entamoeba invadens
EGISWKDPYPIQKFKFPWSISQWMMEGKRPEILVDNE

SEQ ID NO: 2816253 - protein, 35 aa, Entamoeba invadens
EGISWKDPYPIQKFKFPWSISQWVMEGKRPEIFVD

SEQ ID NO: 2816254 - protein, 19 aa, Entamoeba invadens
EGITKWFKNIPIEKTKTLK

SEQ ID NO: 2816255 - protein, 20 aa, Entamoeba invadens
EGIVNNKILFFTKSANALPD

SEQ ID NO: 2816256 - protein, 20 aa, Entamoeba invadens
EGKCIQCTTGYYLTSQFTCA

SEQ ID NO: 2816257 - protein, 17 aa, Entamoeba invadens
EGKIKKFDILTSDINNM

SEQ ID NO: 2816258 - protein, 18 aa, Entamoeba invadens
EGKLNLIINLLELNKKAI

SEQ ID NO: 2816259 - protein, 32 aa, Entamoeba invadens
EGKNPRVDLYLMIFLKFLTTVIPTMEYDYGRD

SEQ ID NO: 2816260 - protein, 33 aa, Entamoeba invadens
EGKSFFIAGVVLILVGILMNLIICICCCKLCCV

SEQ ID NO: 2816261 - protein, 21 aa, Entamoeba invadens
EGKSIIWDLLKQVRPGMDLSR

SEQ ID NO: 2816262 - protein, 22 aa, Entamoeba invadens
EGKSIIWDLLKQVRPGMDLSRI

SEQ ID NO: 2816263 - protein, 22 aa, Entamoeba invadens
EGKVYYVLRIATKDFRNITFFS

SEQ ID NO: 2816264 - protein, 23 aa, Entamoeba invadens
EGKYDFWYYYNNCDGECLLCSTN

SEQ ID NO: 2816265 - protein, 24 aa, Entamoeba invadens
EGKYDYCLPLSLAQIEDCKYSIIS

SEQ ID NO: 2816266 - protein, 19 aa, Entamoeba invadens
EGLIYYICVTVVGCLAVFI

SEQ ID NO: 2816267 - protein, 22 aa, Entamoeba invadens
EGMSFRLYRDSIMPRVLDQIVS

SEQ ID NO: 2816268 - protein, 30 aa, Entamoeba invadens
EGNLYFGTIDTWIIYKLTGGKVHATDVSNA

SEQ ID NO: 2816269 - protein, 17 aa, Entamoeba invadens
EGPSTFKSIAIGSGSDA

SEQ ID NO: 2816270 - protein, 27 aa, Entamoeba invadens
EGQQQSALLCLLYHEGYNIQFSVPRKS

SEQ ID NO: 2816271 - protein, 29 aa, Entamoeba invadens
EGRRVYDNILKFVMYLLSANSSEIWTMMI

SEQ ID NO: 2816272 - protein, 18 aa, Entamoeba invadens
EGSCAVSVKIAQWGYFKI

SEQ ID NO: 2816273 - protein, 19 aa, Entamoeba invadens
EGSFGIVYKGAYRGNVVAI

SEQ ID NO: 2816274 - protein, 21 aa, Entamoeba invadens
EGSFGIVYKGIFRGNVVCIKK

SEQ ID NO: 2816275 - protein, 20 aa, Entamoeba invadens
EGSFGIVYKGIYRGSEVAIK

SEQ ID NO: 2816276 - protein, 22 aa, Entamoeba invadens
EGSFGIVYKGLFKGNVVAIKNM

SEQ ID NO: 2816277 - protein, 19 aa, Entamoeba invadens
EGSFGIVYKGTFRGNVVAI

SEQ ID NO: 2816278 - protein, 20 aa, Entamoeba invadens
EGSFGIVYKGTFRGSVVAIK

SEQ ID NO: 2816279 - protein, 20 aa, Entamoeba invadens
EGSIFTLNSQKLLFNEVYGY

SEQ ID NO: 2816280 - protein, 27 aa, Entamoeba invadens
EGSPFLPQAILPQLLAFLPVVGDHEEE

SEQ ID NO: 2816281 - protein, 25 aa, Entamoeba invadens
EGSYKTMLLKANYYYNFILQNYNAG

SEQ ID NO: 2816282 - protein, 26 aa, Entamoeba invadens
EGSYKTMLLKANYYYNFILQNYNAGA

SEQ ID NO: 2816283 - protein, 26 aa, Entamoeba invadens
EGTKCVMYLHYLLLKHPTSGISESNV

SEQ ID NO: 2816284 - protein, 17 aa, Entamoeba invadens
EGTMKCVDNCELGFFKK

SEQ ID NO: 2816285 - protein, 18 aa, Entamoeba invadens
EGTTEFLKPLKYSPFENI

SEQ ID NO: 2816286 - protein, 24 aa, Entamoeba invadens
EGTYKIDILYTFETRDFELENGTS

SEQ ID NO: 2816287 - protein, 17 aa, Entamoeba invadens
EGVFLNCLNLDHVYLGG

SEQ ID NO: 2816288 - protein, 25 aa, Entamoeba invadens
EGVYETLLFFDRKLFDIEIYDGTSS

SEQ ID NO: 2816289 - protein, 25 aa, Entamoeba invadens
EGYPGTFYLEFDRCTFLKKEGFNTF

SEQ ID NO: 2816290 - protein, 35 aa, Entamoeba invadens
EGYYEIIQLGLRITPIPLIIVYGNSTVRPVLYNDF

SEQ ID NO: 2816291 - protein, 19 aa, Entamoeba invadens
EGYYLLLGSCKMLSEIHCK

SEQ ID NO: 2816292 - protein, 21 aa, Entamoeba invadens
EHDLWSTWKLKYHKAYEGTNE

SEQ ID NO: 2816293 - protein, 25 aa, Entamoeba invadens
EHGPTAFMNWFDPDSWYPLGRNIGT

SEQ ID NO: 2816294 - protein, 19 aa, Entamoeba invadens
EHIKHCIILYVKNVFQNMK

SEQ ID NO: 2816295 - protein, 24 aa, Entamoeba invadens
EHILNKKLVFLDKFRLKNLQLKDC

SEQ ID NO: 2816296 - protein, 54 aa, Entamoeba invadens
EHIQKDYPLFLDLTIPVLFGLYLLKTGLRIGLYKKIVLYLRNEKTELLLKSVIT

SEQ ID NO: 2816297 - protein, 35 aa, Entamoeba invadens
EHITLLDNAKIWLAFLNVQHPYLYLDWDDTQPKNQ

SEQ ID NO: 2816298 - protein, 26 aa, Entamoeba invadens
EHMAALFVMILLQVYVVFSWIKEKVS

SEQ ID NO: 2816299 - protein, 17 aa, Entamoeba invadens
EHNCLHYNLIEHCTTAK

SEQ ID NO: 2816300 - protein, 17 aa, Entamoeba invadens
EHPFVLFCGTGELEKKR

SEQ ID NO: 2816301 - protein, 29 aa, Entamoeba invadens
EHRQVFNTLFLLFPKPNVKLLVLTFCELF

SEQ ID NO: 2816302 - protein, 19 aa, Entamoeba invadens
EHSLLIMNALYSLEGKDFK

SEQ ID NO: 2816303 - protein, 22 aa, Entamoeba invadens
EIALGMKYSCSIDMWSVGCIVA

SEQ ID NO: 2816304 - protein, 27 aa, Entamoeba invadens
EIAQSIVQFILLNFDILKGNVALLIHI

SEQ ID NO: 2816305 - protein, 19 aa, Entamoeba invadens
EICRGGVGIIFKATYKGRT

SEQ ID NO: 2816306 - protein, 20 aa, Entamoeba invadens
EICRGGVGIIFKATYKGRTV

SEQ ID NO: 2816307 - protein, 26 aa, Entamoeba invadens
EIDEKFYILITRIDTTNIPYLYISGN

SEQ ID NO: 2816308 - protein, 25 aa, Entamoeba invadens
EIDNSFNLVFYLNSGFDVFNLTMAE

SEQ ID NO: 2816309 - protein, 24 aa, Entamoeba invadens
EIDNYYPVLMKNVKQWLANCSNPS

SEQ ID NO: 2816310 - protein, 26 aa, Entamoeba invadens
EIDSFLTQRTIILNTVFSDFSLKNVV

SEQ ID NO: 2816311 - protein, 40 aa, Entamoeba invadens
EIEDIKLMYLAMFYILKHLSYDIFKSWFEKEIPTRMEVFL

SEQ ID NO: 2816312 - protein, 23 aa, Entamoeba invadens
EIEFKHTFFRYPTRPERCVLDDV

SEQ ID NO: 2816313 - protein, 39 aa, Entamoeba invadens
EIEIFKALLRLNPNYFLRDFRGWSIAHHIFFEKRIDLSV

SEQ ID NO: 2816314 - protein, 18 aa, Entamoeba invadens
EIEKKVELFDFPKNADKK

SEQ ID NO: 2816315 - protein, 24 aa, Entamoeba invadens
EIEKYMKMLLGLIHIMLVIEFVCN

SEQ ID NO: 2816316 - protein, 26 aa, Entamoeba invadens
EIEMKLRIKFLLDAAKGIQYLHENGI

SEQ ID NO: 2816317 - protein, 25 aa, Entamoeba invadens
EIEMKLRIKLMLDSISGIIYLHTNG

SEQ ID NO: 2816318 - protein, 35 aa, Entamoeba invadens
EIEPLMKAVTTFLFYWYNFMPLSRGTAVTGFVFLL

SEQ ID NO: 2816319 - protein, 19 aa, Entamoeba invadens
EIFIKPLCSCHLEEDIMVI

SEQ ID NO: 2816320 - protein, 19 aa, Entamoeba invadens
EIFIKPLCSCKIEEDVMLI

SEQ ID NO: 2816321 - protein, 27 aa, Entamoeba invadens
EIFKMVGKWIIFIEHIQLCPKDSFYLF

SEQ ID NO: 2816322 - protein, 30 aa, Entamoeba invadens
EIFNSNNPWMVPFIQLVCAFAIYPEFGSHF

SEQ ID NO: 2816323 - protein, 18 aa, Entamoeba invadens
EIFPGIPIPIILDSNTPL

SEQ ID NO: 2816324 - protein, 23 aa, Entamoeba invadens
EIFPLIAFVVLFWKLPKQNRNIT

SEQ ID NO: 2816325 - protein, 24 aa, Entamoeba invadens
EIFQQAIKLDLYLSPSLIQLNSIL

SEQ ID NO: 2816326 - protein, 35 aa, Entamoeba invadens
EIGDYTVEALFLPKFRVFRIIKKIIKKIQIRGFIN

SEQ ID NO: 2816327 - protein, 33 aa, Entamoeba invadens
EIGRCFRFNSLPLQFCMIFLSLFSVKYNVTNAW

SEQ ID NO: 2816328 - protein, 26 aa, Entamoeba invadens
EIHELVMSLLQRLLRKFPLNCSERGF

SEQ ID NO: 2816329 - protein, 24 aa, Entamoeba invadens
EIIASLQKILLPLSVKYPSLQYHQ

SEQ ID NO: 2816330 - protein, 32 aa, Entamoeba invadens
EIIFKGGLLFYILVIIYIILTRTVIAWFFAAE

SEQ ID NO: 2816331 - protein, 18 aa, Entamoeba invadens
EIIKRIRYSLLTIFLCYF

SEQ ID NO: 2816332 - protein, 23 aa, Entamoeba invadens
EIINIKLRVKFILDASKGILYLH

SEQ ID NO: 2816333 - protein, 21 aa, Entamoeba invadens
EIIQIAPSVFLFKANTNFSFN

SEQ ID NO: 2816334 - protein, 24 aa, Entamoeba invadens
EIKEEYLIAEGPFGTVYLATFRAA

SEQ ID NO: 2816335 - protein, 25 aa, Entamoeba invadens
EIKIDFYRIVVWFNVDYTTVDMNRN

SEQ ID NO: 2816336 - protein, 18 aa, Entamoeba invadens
EIKIKPLCTCRIDSSIKI

SEQ ID NO: 2816337 - protein, 20 aa, Entamoeba invadens
EIKLIGEGSFGVVYKGTFRG

SEQ ID NO: 2816338 - protein, 20 aa, Entamoeba invadens
EIKMQLRIKFLLDASRGIQY

SEQ ID NO: 2816339 - protein, 18 aa, Entamoeba invadens
EILKMKHYKKPSDIYSFA

SEQ ID NO: 2816340 - protein, 19 aa, Entamoeba invadens
EILLRLEKAKPVYLDAIVN

SEQ ID NO: 2816341 - protein, 22 aa, Entamoeba invadens
EILSSMLNIPLFRINLSEHTDI

SEQ ID NO: 2816342 - protein, 19 aa, Entamoeba invadens
EINCLTLVDFTLRNNYNEV

SEQ ID NO: 2816343 - protein, 21 aa, Entamoeba invadens
EINIKIKIKFMSDAVRGIKYL

SEQ ID NO: 2816344 - protein, 41 aa, Entamoeba invadens
EINITKILLIVIFGCIILLLFFTIIMILVGLYIIQTHHLNV

SEQ ID NO: 2816345 - protein, 33 aa, Entamoeba invadens
EINKDYILKIDKLFRYFVMSMSQKLNIVATKSV

SEQ ID NO: 2816346 - protein, 25 aa, Entamoeba invadens
EINTAWLNIVTFPWLFGVMFSDAGH

SEQ ID NO: 2816347 - protein, 36 aa, Entamoeba invadens
EIQCPNAPIIILWSTMILVEILMMSIVVLIAQTGCS

SEQ ID NO: 2816348 - protein, 29 aa, Entamoeba invadens
EIRFDESVIVLNFFLNNTKVIFQNTKQVF

SEQ ID NO: 2816349 - protein, 24 aa, Entamoeba invadens
EIRKAQFYFEGDGYVFHLLIGHVN

SEQ ID NO: 2816350 - protein, 25 aa, Entamoeba invadens
EIRKEFILSFLLGQHFMYFFTHWCD

SEQ ID NO: 2816351 - protein, 24 aa, Entamoeba invadens
EIRSVPPLVTLKPGYACEFEIFIK

SEQ ID NO: 2816352 - protein, 17 aa, Entamoeba invadens
EISEVMIISLLNLAEAQ

SEQ ID NO: 2816353 - protein, 30 aa, Entamoeba invadens
EISHPRISLFFFFSLVSVGLFVAYLCVFGW

SEQ ID NO: 2816354 - protein, 24 aa, Entamoeba invadens
EISKMAWIFRGVLLSLFMIIRITN

SEQ ID NO: 2816355 - protein, 42 aa, Entamoeba invadens
EISLFPNTLDLRSYLIMPVQRLPRYRLLLSDLLKHTENTFVD

SEQ ID NO: 2816356 - protein, 21 aa, Entamoeba invadens
EISPDFFLLSRGEGIKIDFSI

SEQ ID NO: 2816357 - protein, 27 aa, Entamoeba invadens
EITMSKNFMFLVFQDGLFRYYVNSKST

SEQ ID NO: 2816358 - protein, 25 aa, Entamoeba invadens
EIVHPGLMLLFTSILLVFLGIITAQ

SEQ ID NO: 2816359 - protein, 23 aa, Entamoeba invadens
EIVINAAFLLLRELSAHVSFDQH

SEQ ID NO: 2816360 - protein, 26 aa, Entamoeba invadens
EIVNMIFEWVVAKLKIRNLFADGISD

SEQ ID NO: 2816361 - protein, 24 aa, Entamoeba invadens
EIVQCANFLATTQNWWCGADNENT

SEQ ID NO: 2816362 - protein, 33 aa, Entamoeba invadens
EIVRVLKQLFPIQRLFLLPEPIDDLYRFTNLDQ

SEQ ID NO: 2816363 - protein, 18 aa, Entamoeba invadens
EIVSPLMTIFLNHQRIDV

SEQ ID NO: 2816364 - protein, 22 aa, Entamoeba invadens
EIWMVISVFDIPYASYFKVESV

SEQ ID NO: 2816365 - protein, 26 aa, Entamoeba invadens
EKAKMIVDMWNLSSVVFSIVCGFIFF

SEQ ID NO: 2816366 - protein, 42 aa, Entamoeba invadens
EKAQEPIYMFSFGPAPVVLYIAAIMTMMCVILPFTYEDQYVI

SEQ ID NO: 2816367 - protein, 19 aa, Entamoeba invadens
EKCILLNENGEFTNKVIQC

SEQ ID NO: 2816368 - protein, 23 aa, Entamoeba invadens
EKCISCITGYYPDSNGKCILCDN

SEQ ID NO: 2816369 - protein, 23 aa, Entamoeba invadens
EKCLHSFYLGYTTFSLKLKEQDY

SEQ ID NO: 2816370 - protein, 24 aa, Entamoeba invadens
EKCVDFWVGDWWGIWTDSWDQALR

SEQ ID NO: 2816371 - protein, 18 aa, Entamoeba invadens
EKCVFWYTPSKNGMYCQE

SEQ ID NO: 2816372 - protein, 24 aa, Entamoeba invadens
EKCVFWYTPSKNGMYCQEAPNWYL

SEQ ID NO: 2816373 - protein, 65 aa, Entamoeba invadens
EKCVFWYTPSKNGMYCQEAPNWYLLVPLIVLVLVGLGVLIVLFLFLLRRLFRKMQKRNIEQNYTI

SEQ ID NO: 2816374 - protein, 19 aa, Entamoeba invadens
EKCVKCKNGYYPYTNGTCI

SEQ ID NO: 2816375 - protein, 20 aa, Entamoeba invadens
EKCVSCIAGYYPDSNGKCML

SEQ ID NO: 2816376 - protein, 18 aa, Entamoeba invadens
EKCWKHVPGDRPTFDQIT

SEQ ID NO: 2816377 - protein, 28 aa, Entamoeba invadens
EKDGDSFEYYFFANLRGLSPVTMTLIFT

SEQ ID NO: 2816378 - protein, 22 aa, Entamoeba invadens
EKDVLAVFDFIPKGMVKAELAP

SEQ ID NO: 2816379 - protein, 27 aa, Entamoeba invadens
EKDYMYAMIFFALYLVFRVVRSALLDL

SEQ ID NO: 2816380 - protein, 23 aa, Entamoeba invadens
EKEDYVKIPYKLKVRMLFDTSRG

SEQ ID NO: 2816381 - protein, 28 aa, Entamoeba invadens
EKEFAEFTVCYYILYYKTISVEVPTTNT

SEQ ID NO: 2816382 - protein, 20 aa, Entamoeba invadens
EKEFFKKVLLDRKFIPVSLF

SEQ ID NO: 2816383 - protein, 22 aa, Entamoeba invadens
EKEFFKKVLLDRKFIPVSLFDH

SEQ ID NO: 2816384 - protein, 24 aa, Entamoeba invadens
EKEIDLKMKIKFMLDCGRGVAYLH

SEQ ID NO: 2816385 - protein, 21 aa, Entamoeba invadens
EKEKEICIFNMKKSNISFTKL

SEQ ID NO: 2816386 - protein, 24 aa, Entamoeba invadens
EKEKHVIFLLNDSIAFVKEKVYIQ

SEQ ID NO: 2816387 - protein, 37 aa, Entamoeba invadens
EKEKHYFFNLTDKIMLLFFERNVVYLRLLMNEYNEFV

SEQ ID NO: 2816388 - protein, 24 aa, Entamoeba invadens
EKEMDNFFNLFNDTSIEGNPNANK

SEQ ID NO: 2816389 - protein, 24 aa, Entamoeba invadens
EKESYLNVPFYSKGTSKFYNAKRA

SEQ ID NO: 2816390 - protein, 28 aa, Entamoeba invadens
EKFKSDYIVHFYGAVFIPTKMCLVSEFA

SEQ ID NO: 2816391 - protein, 26 aa, Entamoeba invadens
EKFRNEYIIHFYGAVFIPNKICMVTE

SEQ ID NO: 2816392 - protein, 25 aa, Entamoeba invadens
EKFRSDYIIHFYGAVYLGDERAIIT

SEQ ID NO: 2816393 - protein, 21 aa, Entamoeba invadens
EKGICVFSMKKSNIPMKVLGN

SEQ ID NO: 2816394 - protein, 19 aa, Entamoeba invadens
EKGMLISNTLFRMGGAAIL

SEQ ID NO: 2816395 - protein, 27 aa, Entamoeba invadens
EKGNYPCQFLIFCMPILFDKTETEAKE

SEQ ID NO: 2816396 - protein, 24 aa, Entamoeba invadens
EKGRIQMYEVYMPHLIKLIKTVDL

SEQ ID NO: 2816397 - protein, 17 aa, Entamoeba invadens
EKGVVLEKLFLQTSNEQ

SEQ ID NO: 2816398 - protein, 20 aa, Entamoeba invadens
EKGWLIIDTLCCMESAAAGL

SEQ ID NO: 2816399 - protein, 26 aa, Entamoeba invadens
EKHFLVFPALFTLVVFFLSALPGSLD

SEQ ID NO: 2816400 - protein, 25 aa, Entamoeba invadens
EKHLAFLAYGYIYSKILFSPEKVAP

SEQ ID NO: 2816401 - protein, 21 aa, Entamoeba invadens
EKHYAAYFVFKGLGANMVMHT

SEQ ID NO: 2816402 - protein, 19 aa, Entamoeba invadens
EKIIGFYSLFPALKNMYPT

SEQ ID NO: 2816403 - protein, 19 aa, Entamoeba invadens
EKILDLFSYIRIDTKDDEV

SEQ ID NO: 2816404 - protein, 36 aa, Entamoeba invadens
EKIRYKTLIIASVVTFFVSYNVMRIIFGISSLGNKN

SEQ ID NO: 2816405 - protein, 25 aa, Entamoeba invadens
EKISATKCHVPFPKMQRTPFQRLET

SEQ ID NO: 2816406 - protein, 26 aa, Entamoeba invadens
EKKKLVEFLHIFFYELQDENINSTVL

SEQ ID NO: 2816407 - protein, 25 aa, Entamoeba invadens
EKKLYIYLPAIVDKVWISQTTSLLV

SEQ ID NO: 2816408 - protein, 21 aa, Entamoeba invadens
EKKMIVMEFIKNGSLETIIKK

SEQ ID NO: 2816409 - protein, 32 aa, Entamoeba invadens
EKKTKLSIKLLFFLGFIIPLIWPVIVVMCITK

SEQ ID NO: 2816410 - protein, 31 aa, Entamoeba invadens
EKLDGFIPGYKPLKLLAQTLMWKTKTQNDFF

SEQ ID NO: 2816411 - protein, 19 aa, Entamoeba invadens
EKLFDILKVMWNQSSRERC

SEQ ID NO: 2816412 - protein, 18 aa, Entamoeba invadens
EKLGEGSFGIVYKGKYRG

SEQ ID NO: 2816413 - protein, 26 aa, Entamoeba invadens
EKLLELYYSCLAKTALYFILALNDAD

SEQ ID NO: 2816414 - protein, 29 aa, Entamoeba invadens
EKLNNEFIINFYGAVFIPGRVCIVTEFAN

SEQ ID NO: 2816415 - protein, 23 aa, Entamoeba invadens
EKLPDVCYSWWVLSSMCILGTVD

SEQ ID NO: 2816416 - protein, 24 aa, Entamoeba invadens
EKLWGYRALAAFAIYFGLGWFIGF

SEQ ID NO: 2816417 - protein, 25 aa, Entamoeba invadens
EKMADVYSFGITIYECYYGHLAYSK

SEQ ID NO: 2816418 - protein, 31 aa, Entamoeba invadens
EKMGTTFYGYLVKKFLYKLTGANVRMNWESC

SEQ ID NO: 2816419 - protein, 17 aa, Entamoeba invadens
EKMWNAFSALQFDFSNP

SEQ ID NO: 2816420 - protein, 23 aa, Entamoeba invadens
EKNDFIKWGFYQTNPDFTVDDVE

SEQ ID NO: 2816421 - protein, 27 aa, Entamoeba invadens
EKNELFDQYFYFAICKIVLDQCYFPKM

SEQ ID NO: 2816422 - protein, 30 aa, Entamoeba invadens
EKNKKIFVINILYDIALELGFFFDAKLSRK

SEQ ID NO: 2816423 - protein, 25 aa, Entamoeba invadens
EKNKKIFVQHLLIDLLEMKGFSFES

SEQ ID NO: 2816424 - protein, 24 aa, Entamoeba invadens
EKNTFVFPWNIAEFVSRGLRPSQP

SEQ ID NO: 2816425 - protein, 24 aa, Entamoeba invadens
EKNYDKFLKSLYKVHLISLEQYIS

SEQ ID NO: 2816426 - protein, 24 aa, Entamoeba invadens
EKPEDIVLPYKLKVKMMFDCARGM

SEQ ID NO: 2816427 - protein, 19 aa, Entamoeba invadens
EKPFFVYNLIEELDEEGEY

SEQ ID NO: 2816428 - protein, 26 aa, Entamoeba invadens
EKPRKNIMKWGPILSFIGAANTCVTS

SEQ ID NO: 2816429 - protein, 23 aa, Entamoeba invadens
EKQGFPLVLKEKILDDLAAAIHI

SEQ ID NO: 2816430 - protein, 24 aa, Entamoeba invadens
EKRGIISFTKPMKVPIINGLEESG

SEQ ID NO: 2816431 - protein, 19 aa, Entamoeba invadens
EKRIFFTSCTTKPTVAECI

SEQ ID NO: 2816432 - protein, 23 aa, Entamoeba invadens
EKRKKYYLRWHSSLFVIISATYN

SEQ ID NO: 2816433 - protein, 36 aa, Entamoeba invadens
EKRKVSLGRLLGRDYVFPVLGEVYKVLYKVRQNESD

SEQ ID NO: 2816434 - protein, 25 aa, Entamoeba invadens
EKSEVLVQVKALQETIEKLKMENEE

SEQ ID NO: 2816435 - protein, 22 aa, Entamoeba invadens
EKSKILLGKYRSIPVAVKLFKF

SEQ ID NO: 2816436 - protein, 22 aa, Entamoeba invadens
EKSSFFKMLLFNQHEFKSQFFH

SEQ ID NO: 2816437 - protein, 26 aa, Entamoeba invadens
EKSTKYLFRFLNNIFQLNTLILEKCY

SEQ ID NO: 2816438 - protein, 17 aa, Entamoeba invadens
EKTRNLIQQLIPSGFIN

SEQ ID NO: 2816439 - protein, 28 aa, Entamoeba invadens
EKVCTCMYEYNFYSYPFSPDSPSFNDCE

SEQ ID NO: 2816440 - protein, 27 aa, Entamoeba invadens
EKVIRIPWRRLVITPNPKKPTIWDDMK

SEQ ID NO: 2816441 - protein, 26 aa, Entamoeba invadens
EKVLGEGSFGIVYKGTFRGNVVAIKK

SEQ ID NO: 2816442 - protein, 26 aa, Entamoeba invadens
EKVPELQWWATLLIKFAVTSVATFLN

SEQ ID NO: 2816443 - protein, 26 aa, Entamoeba invadens
EKVPIYMRNYYPQVFSVNQAGSHANQ

SEQ ID NO: 2816444 - protein, 17 aa, Entamoeba invadens
EKYKMPCDIYSLAISFF

SEQ ID NO: 2816445 - protein, 34 aa, Entamoeba invadens
EKYLRPKLLQQNQLKLLYFIVLSAVDPAKYLQKI

SEQ ID NO: 2816446 - protein, 21 aa, Entamoeba invadens
EKYMYSTFYSACDYVFHFLVR

SEQ ID NO: 2816447 - protein, 26 aa, Entamoeba invadens
EKYSLRVFPAIVLLKKGEACEFQLNI

SEQ ID NO: 2816448 - protein, 20 aa, Entamoeba invadens
EKYYISFNPQIITIPPNYGC

SEQ ID NO: 2816449 - protein, 26 aa, Entamoeba invadens
ELALKSPFCPFMSYLAACSLVYTECT

SEQ ID NO: 2816450 - protein, 18 aa, Entamoeba invadens
ELAPLCMFCGMQLIGFAD

SEQ ID NO: 2816451 - protein, 18 aa, Entamoeba invadens
ELCDWNRNCFVCSSSFIL

SEQ ID NO: 2816452 - protein, 18 aa, Entamoeba invadens
ELCIAFANHLDWYVTLYS

SEQ ID NO: 2816453 - protein, 20 aa, Entamoeba invadens
ELCREGFVFDASNECKENSI

SEQ ID NO: 2816454 - protein, 34 aa, Entamoeba invadens
ELCSILLFVRVIIIKCSFVMVRCLFGTILYQLMD

SEQ ID NO: 2816455 - protein, 17 aa, Entamoeba invadens
ELDQLMLLVNELPVILK

SEQ ID NO: 2816456 - protein, 22 aa, Entamoeba invadens
ELDTKCVWYTPQGKCPECNDGY

SEQ ID NO: 2816457 - protein, 19 aa, Entamoeba invadens
ELEENLKVKWGKEKSLLAT

SEQ ID NO: 2816458 - protein, 21 aa, Entamoeba invadens
ELEIFSLFVSFFITSSSSAKN

SEQ ID NO: 2816459 - protein, 17 aa, Entamoeba invadens
ELFCVIASQYYDYTVGL

SEQ ID NO: 2816460 - protein, 23 aa, Entamoeba invadens
ELFPFWIVLFMTLFFANITLVMM

SEQ ID NO: 2816461 - protein, 17 aa, Entamoeba invadens
ELFTVMALKLRLLVNKL

SEQ ID NO: 2816462 - protein, 17 aa, Entamoeba invadens
ELGYSLNNSKCEKCKDS

SEQ ID NO: 2816463 - protein, 25 aa, Entamoeba invadens
ELIGYFENFMWLSLLGDFLSEIYTF

SEQ ID NO: 2816464 - protein, 29 aa, Entamoeba invadens
ELIIFCGDYLYFFVPINWSFPLTSDEKNV

SEQ ID NO: 2816465 - protein, 26 aa, Entamoeba invadens
ELIIKGRIFLPLISFQQLCTKYNNYI

SEQ ID NO: 2816466 - protein, 33 aa, Entamoeba invadens
ELISLKKGFACEFSWYLTPLCTCQIFSSIQIVA

SEQ ID NO: 2816467 - protein, 25 aa, Entamoeba invadens
ELKFMHVFPLCFLHVLFNGYLIILK

SEQ ID NO: 2816468 - protein, 19 aa, Entamoeba invadens
ELKPIMPPIGEGAFGMVFR

SEQ ID NO: 2816469 - protein, 17 aa, Entamoeba invadens
ELKPVMPPIGEGAFGMV

SEQ ID NO: 2816470 - protein, 23 aa, Entamoeba invadens
ELLHIDFGYIFEFGKKLPCPEIV

SEQ ID NO: 2816471 - protein, 18 aa, Entamoeba invadens
ELLIPTVTEFGTHVFDSC

SEQ ID NO: 2816472 - protein, 17 aa, Entamoeba invadens
ELLKRLLSHIKQISPFI

SEQ ID NO: 2816473 - protein, 18 aa, Entamoeba invadens
ELLLIEHFMYTYYGNKEM

SEQ ID NO: 2816474 - protein, 18 aa, Entamoeba invadens
ELMKYTKLPCLLINGVMN

SEQ ID NO: 2816475 - protein, 25 aa, Entamoeba invadens
ELMLFQTQVIPLIKRNVKKAIKMKE

SEQ ID NO: 2816476 - protein, 17 aa, Entamoeba invadens
ELMYLCHNPDDFAFWAG

SEQ ID NO: 2816477 - protein, 23 aa, Entamoeba invadens
ELNKYFNVTIWVEKFGLFGDRTG

SEQ ID NO: 2816478 - protein, 27 aa, Entamoeba invadens
ELNMKLPFINVKPFTVCTWFSIQKFPE

SEQ ID NO: 2816479 - protein, 24 aa, Entamoeba invadens
ELNNPRIIMWNSTYLHLNYNYQGR

SEQ ID NO: 2816480 - protein, 22 aa, Entamoeba invadens
ELNNPRIIMWNSTYLHLNYNYT

SEQ ID NO: 2816481 - protein, 19 aa, Entamoeba invadens
ELNNPRIVLWNSTYLHLNL

SEQ ID NO: 2816482 - protein, 17 aa, Entamoeba invadens
ELNYILLDGICIAKSEI

SEQ ID NO: 2816483 - protein, 19 aa, Entamoeba invadens
ELPDYLSYCGPYVEYNTDH

SEQ ID NO: 2816484 - protein, 19 aa, Entamoeba invadens
ELPELDVIWIRVADSVTGV

SEQ ID NO: 2816485 - protein, 20 aa, Entamoeba invadens
ELPFKLFEKVSYRNLLSWYL

SEQ ID NO: 2816486 - protein, 25 aa, Entamoeba invadens
ELPGIFKSLLPFISQFDQVFRNRKA

SEQ ID NO: 2816487 - protein, 20 aa, Entamoeba invadens
ELPLCYIYRFLPPNENLKHF

SEQ ID NO: 2816488 - protein, 25 aa, Entamoeba invadens
ELQKYIIIAFILMPFFIRLIAFIFY

SEQ ID NO: 2816489 - protein, 20 aa, Entamoeba invadens
ELRLISFDYNKLIIKNPNLT

SEQ ID NO: 2816490 - protein, 28 aa, Entamoeba invadens
ELRWFTFGYGFFFLLSGSVALLLKKVSS

SEQ ID NO: 2816491 - protein, 27 aa, Entamoeba invadens
ELSCPLIYSSYIFAAQVAMLYIPDGEM

SEQ ID NO: 2816492 - protein, 23 aa, Entamoeba invadens
ELSEFFLVYLPVLTEYLEVMPFD

SEQ ID NO: 2816493 - protein, 23 aa, Entamoeba invadens
ELSKLLLEILGENKWNIVEICNQ

SEQ ID NO: 2816494 - protein, 21 aa, Entamoeba invadens
ELSVLLSNALEKASRGALMES

SEQ ID NO: 2816495 - protein, 17 aa, Entamoeba invadens
ELTESGCLRCLDGYYLD

SEQ ID NO: 2816496 - protein, 17 aa, Entamoeba invadens
ELTLPNIEILELGEGVF

SEQ ID NO: 2816497 - protein, 26 aa, Entamoeba invadens
ELTMNIITGILFLICVLAVLCYAAYL

SEQ ID NO: 2816498 - protein, 24 aa, Entamoeba invadens
ELTPNINGIYFIKIKDMKYRVSTF

SEQ ID NO: 2816499 - protein, 25 aa, Entamoeba invadens
ELTQRAPVFFEFFNREISTFITDCV

SEQ ID NO: 2816500 - protein, 26 aa, Entamoeba invadens
ELVAKRVYFRLLLSTNLLDETLEEKV

SEQ ID NO: 2816501 - protein, 17 aa, Entamoeba invadens
ELVDIDKSFVFFKDFFY

SEQ ID NO: 2816502 - protein, 17 aa, Entamoeba invadens
ELVFLRPNKAMEFTIKI

SEQ ID NO: 2816503 - protein, 38 aa, Entamoeba invadens
ELVMVHLFSHKIYPPLELYLHYLFIVHGLENYRNKIPG

SEQ ID NO: 2816504 - protein, 19 aa, Entamoeba invadens
ELVPMFFDLLPETGDEDSV

SEQ ID NO: 2816505 - protein, 26 aa, Entamoeba invadens
ELVTKFPQNVYALCGTLLTVSDSIYL

SEQ ID NO: 2816506 - protein, 27 aa, Entamoeba invadens
ELVTMLSWVFIIVFAAVIHGQWFSVLN

SEQ ID NO: 2816507 - protein, 34 aa, Entamoeba invadens
ELYISVNFPFPIKLSKHYKTFFASLSVNIVFLEL

SEQ ID NO: 2816508 - protein, 18 aa, Entamoeba invadens
ELYLFGICQRCSSQYYSS

SEQ ID NO: 2816509 - protein, 23 aa, Entamoeba invadens
ELYNMRFFANFPENYFVKNIYSD

SEQ ID NO: 2816510 - protein, 18 aa, Entamoeba invadens
ELYVKYDNTYLFICGIGK

SEQ ID NO: 2816511 - protein, 26 aa, Entamoeba invadens
EMATDDFYLLVRVFRRDDGNSMMVTM

SEQ ID NO: 2816512 - protein, 18 aa, Entamoeba invadens
EMDSVYSSTKTAMLAAVG

SEQ ID NO: 2816513 - protein, 18 aa, Entamoeba invadens
EMECVISQTLYDMFSEER

SEQ ID NO: 2816514 - protein, 17 aa, Entamoeba invadens
EMEIFKKSFSNFIISLH

SEQ ID NO: 2816515 - protein, 23 aa, Entamoeba invadens
EMEKLLFDFFKQCIHNTIMVVSC

SEQ ID NO: 2816516 - protein, 24 aa, Entamoeba invadens
EMGCLLCQNGYYTNEYNKCTKCGD

SEQ ID NO: 2816517 - protein, 18 aa, Entamoeba invadens
EMGLLVNPLFPVTSQEMG

SEQ ID NO: 2816518 - protein, 25 aa, Entamoeba invadens
EMGQYIRDKLPEWVFGGLTVEQAQR

SEQ ID NO: 2816519 - protein, 20 aa, Entamoeba invadens
EMHEIWLQQYSTQKGNLIKN

SEQ ID NO: 2816520 - protein, 33 aa, Entamoeba invadens
EMHQMVYFEFGKYYIIMILPKFMKEAYVTIYIK

SEQ ID NO: 2816521 - protein, 22 aa, Entamoeba invadens
EMIKTTICGTLAWIAPEILSGQ

SEQ ID NO: 2816522 - protein, 22 aa, Entamoeba invadens
EMKGILAVFPVIVTTLIIVMLT

SEQ ID NO: 2816523 - protein, 23 aa, Entamoeba invadens
EMKKICVFNMKRSNISFTNLNES

SEQ ID NO: 2816524 - protein, 24 aa, Entamoeba invadens
EMKMVNLPIIFPPSGVHTLIIASK

SEQ ID NO: 2816525 - protein, 28 aa, Entamoeba invadens
EMKSNALIRPLLFIIKTVLSSYELNLPA

SEQ ID NO: 2816526 - protein, 28 aa, Entamoeba invadens
EMLDKFRCEYIIYFYGAVVIPNKMCMVT

SEQ ID NO: 2816527 - protein, 17 aa, Entamoeba invadens
EMLIKEGVRILSFPIGY

SEQ ID NO: 2816528 - protein, 26 aa, Entamoeba invadens
EMLRKSLVNEFLLKDLKKKGVDMVYL

SEQ ID NO: 2816529 - protein, 24 aa, Entamoeba invadens
EMLVINITPEFILVLNEIAKNWSK

SEQ ID NO: 2816530 - protein, 46 aa, Entamoeba invadens
EMLVKILSIIERLKNFPKTDPLMRYLIVLHILFGELQNWETVAAKY

SEQ ID NO: 2816531 - protein, 25 aa, Entamoeba invadens
EMMERIRCPFIVNFIGSVITPDTLC

SEQ ID NO: 2816532 - protein, 18 aa, Entamoeba invadens
EMMIFWVTLMAAPLIWFG

SEQ ID NO: 2816533 - protein, 32 aa, Entamoeba invadens
EMMKSWWTPKKLAGMLFFIAGLLLLINHFGTN

SEQ ID NO: 2816534 - protein, 29 aa, Entamoeba invadens
EMPQFAVRVKLMLDASKGILYLHSNNILH

SEQ ID NO: 2816535 - protein, 20 aa, Entamoeba invadens
EMPRFAVRVKLMLDASKGIS

SEQ ID NO: 2816536 - protein, 27 aa, Entamoeba invadens
EMTSKQLDFALPMIKNMFPYTFTVTRQ

SEQ ID NO: 2816537 - protein, 31 aa, Entamoeba invadens
EMVMHLVGITTFKFLPEPIAALLSMKTMMSE

SEQ ID NO: 2816538 - protein, 20 aa, Entamoeba invadens
EMWDLEIMFGFDNFTKRYKT

SEQ ID NO: 2816539 - protein, 18 aa, Entamoeba invadens
EMWKKMERLFLAFVAMRQ

SEQ ID NO: 2816540 - protein, 33 aa, Entamoeba invadens
EMYAIITGVILYTLFCFVAIIIAIVVIAQKLRR

SEQ ID NO: 2816541 - protein, 26 aa, Entamoeba invadens
EMYIGITFFFYFIAQTIVMICMSFTT

SEQ ID NO: 2816542 - protein, 18 aa, Entamoeba invadens
EMYYSFPGIASLVNFVVT

SEQ ID NO: 2816543 - protein, 24 aa, Entamoeba invadens
ENADFTITALTYNSGSALSGIAQA

SEQ ID NO: 2816544 - protein, 21 aa, Entamoeba invadens
ENAFFTMYGYSSVLNSENLIF

SEQ ID NO: 2816545 - protein, 25 aa, Entamoeba invadens
ENCLKCDVGYILSYKACKKTDENCN

SEQ ID NO: 2816546 - protein, 25 aa, Entamoeba invadens
ENCQKLNPIIQPMLNHLKMCVENTE

SEQ ID NO: 2816547 - protein, 25 aa, Entamoeba invadens
ENDENIIVLLYKTTYLFIDGIVPQT

SEQ ID NO: 2816548 - protein, 22 aa, Entamoeba invadens
ENDILIICCYLQIIVTNTLAAI

SEQ ID NO: 2816549 - protein, 23 aa, Entamoeba invadens
ENDYLYLPDSFYNLPIAAKKRIS

SEQ ID NO: 2816550 - protein, 25 aa, Entamoeba invadens
ENEFYIRFPYKLKIAMLYDISRGMQ

SEQ ID NO: 2816551 - protein, 19 aa, Entamoeba invadens
ENEKYYFYVASALPEDTGY

SEQ ID NO: 2816552 - protein, 28 aa, Entamoeba invadens
ENFQYTQFIQKIQSFYLTFGIKGKVESS

SEQ ID NO: 2816553 - protein, 27 aa, Entamoeba invadens
ENGDNRMRLPYKLKIRMLFDTARGMQF

SEQ ID NO: 2816554 - protein, 25 aa, Entamoeba invadens
ENGEKFYYYVFVSVSQICDVKIEVE

SEQ ID NO: 2816555 - protein, 26 aa, Entamoeba invadens
ENGKKIALQLLKWINRMNLVSLEDGS

SEQ ID NO: 2816556 - protein, 17 aa, Entamoeba invadens
ENGLYLDNNNCILCEEI

SEQ ID NO: 2816557 - protein, 17 aa, Entamoeba invadens
ENGLYLNNNNCILCEEI

SEQ ID NO: 2816558 - protein, 35 aa, Entamoeba invadens
ENGVFSLKHCDILLTPYPTLPTILSSTTLIEFPEG

SEQ ID NO: 2816559 - protein, 17 aa, Entamoeba invadens
ENGYFLDRGKCEICAKN

SEQ ID NO: 2816560 - protein, 17 aa, Entamoeba invadens
ENGYFLNSQMECKSLGD

SEQ ID NO: 2816561 - protein, 26 aa, Entamoeba invadens
ENICLSCQDPYYLFNQTCLSCASGSY

SEQ ID NO: 2816562 - protein, 25 aa, Entamoeba invadens
ENIEGFTRLIWRLTNIRSSDGYIPV

SEQ ID NO: 2816563 - protein, 27 aa, Entamoeba invadens
ENIFTCICFFFYGLNYLVFFNGVVNVG

SEQ ID NO: 2816564 - protein, 24 aa, Entamoeba invadens
ENIKVSFHLIKTLVVYINSTKSVI

SEQ ID NO: 2816565 - protein, 17 aa, Entamoeba invadens
ENINIELLLYILALFIL

SEQ ID NO: 2816566 - protein, 27 aa, Entamoeba invadens
ENINKWVDLIFGYLQRPPAAFDADNVF

SEQ ID NO: 2816567 - protein, 23 aa, Entamoeba invadens
ENISHSTFIFRNGQILSIIDNNQ

SEQ ID NO: 2816568 - protein, 20 aa, Entamoeba invadens
ENIVHFYGAVFIPNHICMVT

SEQ ID NO: 2816569 - protein, 24 aa, Entamoeba invadens
ENIVHFYGAVFIPNKVCLVTEFAQ

SEQ ID NO: 2816570 - protein, 30 aa, Entamoeba invadens
ENKFCFSLSRRFIMLFTELSKLTGVTDPKK

SEQ ID NO: 2816571 - protein, 19 aa, Entamoeba invadens
ENLILTLIDTFKVSTERTI

SEQ ID NO: 2816572 - protein, 21 aa, Entamoeba invadens
ENLKRAGLYVFFPFETNCGKG

SEQ ID NO: 2816573 - protein, 20 aa, Entamoeba invadens
ENLLFFPTICGFVGKSECAI

SEQ ID NO: 2816574 - protein, 27 aa, Entamoeba invadens
ENLQLERYIILCVMLRSLHPTYQTLTN

SEQ ID NO: 2816575 - protein, 21 aa, Entamoeba invadens
ENMINFLFSLVDVGVVANACR

SEQ ID NO: 2816576 - protein, 33 aa, Entamoeba invadens
ENMKFWKSLNTLPKLNTLILGIIGLDVKDLMES

SEQ ID NO: 2816577 - protein, 28 aa, Entamoeba invadens
ENNLYYYDEMYAVLPFILDIVNGDEVIV

SEQ ID NO: 2816578 - protein, 24 aa, Entamoeba invadens
ENNPLFPYEFLMDNAFYLFVNSVI

SEQ ID NO: 2816579 - protein, 18 aa, Entamoeba invadens
ENNYFYVRFFAIVMIFFI

SEQ ID NO: 2816580 - protein, 23 aa, Entamoeba invadens
ENPTPYFFISKKFKTLEIPVQST

SEQ ID NO: 2816581 - protein, 36 aa, Entamoeba invadens
ENPYQKSILYLSAIELFMMEQLGYSFLISSNIRNKK

SEQ ID NO: 2816582 - protein, 22 aa, Entamoeba invadens
ENQRLELIQIRLAKEMYDRKQR

SEQ ID NO: 2816583 - protein, 25 aa, Entamoeba invadens
ENSIYTIPMIMKALDSLWKNHPDLP

SEQ ID NO: 2816584 - protein, 23 aa, Entamoeba invadens
ENSLNEIYIVGSAILMSDKSLGM

SEQ ID NO: 2816585 - protein, 24 aa, Entamoeba invadens
ENSNTYIFVTICVSLLIGLCCINC

SEQ ID NO: 2816586 - protein, 34 aa, Entamoeba invadens
ENSQCEVVFYSLTLQLVPQFLKRVIKSVRPVTER

SEQ ID NO: 2816587 - protein, 24 aa, Entamoeba invadens
ENTAIPICFYSDTCLLFSFFVEEG

SEQ ID NO: 2816588 - protein, 19 aa, Entamoeba invadens
ENTCQYDIKISNLMLTCQY

SEQ ID NO: 2816589 - protein, 25 aa, Entamoeba invadens
ENTNPILVILPMNGGGYADLEANFE

SEQ ID NO: 2816590 - protein, 23 aa, Entamoeba invadens
ENTTPPLCIKPSGSPLLEEQKVE

SEQ ID NO: 2816591 - protein, 18 aa, Entamoeba invadens
ENVELFHPSFMLSADYFS

SEQ ID NO: 2816592 - protein, 25 aa, Entamoeba invadens
ENVQYFNNFAFFDSGLESLSFGENV

SEQ ID NO: 2816593 - protein, 21 aa, Entamoeba invadens
ENVVLQFTKVVRPYVMISGDV

SEQ ID NO: 2816594 - protein, 18 aa, Entamoeba invadens
ENYFKTIYDTGLCQPYAN

SEQ ID NO: 2816595 - protein, 28 aa, Entamoeba invadens
EPEKMKTSFVLLSRYPKFLTFEAKAEVF

SEQ ID NO: 2816596 - protein, 25 aa, Entamoeba invadens
EPEKSLIGYFRYIFEIPSLSGETVT

SEQ ID NO: 2816597 - protein, 19 aa, Entamoeba invadens
EPEVVLIKRGCACEFSLYL

SEQ ID NO: 2816598 - protein, 25 aa, Entamoeba invadens
  misc_feature (25)..(25): Xaa can be any naturally occurring amino acid
EPFALFEKTIFPDVPVIIGVGLFGX

SEQ ID NO: 2816599 - protein, 19 aa, Entamoeba invadens
EPFDLAVTNIPFVSTISTS

SEQ ID NO: 2816600 - protein, 18 aa, Entamoeba invadens
EPFQKFLSLLIAGLKMTD

SEQ ID NO: 2816601 - protein, 35 aa, Entamoeba invadens
EPILLALVVVSILIMFIPKPIILYMRLRKQQKAHI

SEQ ID NO: 2816602 - protein, 56 aa, Entamoeba invadens
EPIVKKDVPTWVIVILIIIGIFIVIILILFVVFVIVARKILLKRKAPKVFNDEDNM

SEQ ID NO: 2816603 - protein, 49 aa, Entamoeba invadens
EPIVKKDVPTWVIVILIIIGVFIVIILILFVVFIVVARKILLRRRNLKV

SEQ ID NO: 2816604 - protein, 50 aa, Entamoeba invadens
EPIVKKDVPTWVIVILIIIGVFIVIILILFVVFIVVARKILLRRRNLKVF

SEQ ID NO: 2816605 - protein, 22 aa, Entamoeba invadens
EPLGNLFTKCKLTLPTGGGCAI

SEQ ID NO: 2816606 - protein, 19 aa, Entamoeba invadens
EPMDLEAPILTGRMAHVIT

SEQ ID NO: 2816607 - protein, 26 aa, Entamoeba invadens
EPNGFGFLSLTLFVSLSLLDFFSSQL

SEQ ID NO: 2816608 - protein, 21 aa, Entamoeba invadens
EPPLIIGLVGFCAVLMALFGV

SEQ ID NO: 2816609 - protein, 17 aa, Entamoeba invadens
EPQVLFLRPSVTKVITV

SEQ ID NO: 2816610 - protein, 19 aa, Entamoeba invadens
EPQVVIIPPRRGSVPMITY

SEQ ID NO: 2816611 - protein, 19 aa, Entamoeba invadens
EPRTTYPNCKKFKRILDDN

SEQ ID NO: 2816612 - protein, 25 aa, Entamoeba invadens
EPSETPVFSFAYPSAINLSIFLNLK

SEQ ID NO: 2816613 - protein, 21 aa, Entamoeba invadens
EPTEKIVLAMYYFPSQTQVEE

SEQ ID NO: 2816614 - protein, 20 aa, Entamoeba invadens
EPVFMMSIIPHFISLNMLMR

SEQ ID NO: 2816615 - protein, 17 aa, Entamoeba invadens
EPVLFACTIKQNILLGA

SEQ ID NO: 2816616 - protein, 25 aa, Entamoeba invadens
EPYDKMEFKFPWKIAEFVISGKRLP

SEQ ID NO: 2816617 - protein, 17 aa, Entamoeba invadens
EPYPKSEFKFAWSVADF

SEQ ID NO: 2816618 - protein, 26 aa, Entamoeba invadens
EPYSKDQFKYPWKIADFVMGGNRLKK

SEQ ID NO: 2816619 - protein, 26 aa, Entamoeba invadens
EPYSKDQFKYPWKIAEFVMAGNRLKK

SEQ ID NO: 2816620 - protein, 26 aa, Entamoeba invadens
EPYVNILEGCYLLYPLEVVSCLGEKT

SEQ ID NO: 2816621 - protein, 25 aa, Entamoeba invadens
EQACMQVYRYLLDKVRKGNPVTQMK

SEQ ID NO: 2816622 - protein, 18 aa, Entamoeba invadens
EQCLLCQDGYYLQNNGSC

SEQ ID NO: 2816623 - protein, 30 aa, Entamoeba invadens
EQDDEWVYIVRRWFALKDNLCYKCGENCTT

SEQ ID NO: 2816624 - protein, 33 aa, Entamoeba invadens
EQDNFLLGILFFVLLIFFLPCSFIYAYYFSILL

SEQ ID NO: 2816625 - protein, 26 aa, Entamoeba invadens
EQEALLEELYLFPKMEVFEIYNDPSE

SEQ ID NO: 2816626 - protein, 29 aa, Entamoeba invadens
EQEDWELWMWFGIITAVIIVFIALVMGTI

SEQ ID NO: 2816627 - protein, 23 aa, Entamoeba invadens
EQEKFQFVMLHFIKNFPTDVKNV

SEQ ID NO: 2816628 - protein, 25 aa, Entamoeba invadens
EQEKMKILITSGALFYIYGKQYSTL

SEQ ID NO: 2816629 - protein, 23 aa, Entamoeba invadens
EQEQKKRIAAMKKAKILTQNLRD

SEQ ID NO: 2816630 - protein, 17 aa, Entamoeba invadens
EQFDSRILTFHLNSLLL

SEQ ID NO: 2816631 - protein, 26 aa, Entamoeba invadens
EQFRKLANVYFLIISIFQAIPGLSPT

SEQ ID NO: 2816632 - protein, 19 aa, Entamoeba invadens
EQFRLLLACELLCPHSFDV

SEQ ID NO: 2816633 - protein, 23 aa, Entamoeba invadens
EQGDLLRQPFASVVFQAMCIVVD

SEQ ID NO: 2816634 - protein, 27 aa, Entamoeba invadens
EQHQKFIEILQKLNKIYLFPTDSSCVI

SEQ ID NO: 2816635 - protein, 25 aa, Entamoeba invadens
EQIFSPPMIVALPKKIHYTRLSLDD

SEQ ID NO: 2816636 - protein, 23 aa, Entamoeba invadens
EQKKYQLLMFSSKQILFTGNYEL

SEQ ID NO: 2816637 - protein, 25 aa, Entamoeba invadens
EQLDIFQLRFLLESGAFPMSSNQKL

SEQ ID NO: 2816638 - protein, 27 aa, Entamoeba invadens
EQLHLNTFTIFTRQWLTEGAKATLFVQ

SEQ ID NO: 2816639 - protein, 18 aa, Entamoeba invadens
EQLMALKGFYYTLAMQQY

SEQ ID NO: 2816640 - protein, 23 aa, Entamoeba invadens
EQNCKSLLLPISINSVRISSAEH

SEQ ID NO: 2816641 - protein, 23 aa, Entamoeba invadens
EQNIFAFPTIIFDSSVEVIFTKD

SEQ ID NO: 2816642 - protein, 38 aa, Entamoeba invadens
EQPKTLFSFLKRFTSMQFLYFLPFNHSPQNILHSGRCN

SEQ ID NO: 2816643 - protein, 26 aa, Entamoeba invadens
EQPNTYLFVVVFVLVAIAPLLIRNTC

SEQ ID NO: 2816644 - protein, 26 aa, Entamoeba invadens
EQRHNLPMYYYLNDTIVQTLFFDSTL

SEQ ID NO: 2816645 - protein, 23 aa, Entamoeba invadens
EQSFLWEHMLLMKHPHPKVALLA

SEQ ID NO: 2816646 - protein, 22 aa, Entamoeba invadens
EQSIVLHFFPINDPAILQIRDL

SEQ ID NO: 2816647 - protein, 53 aa, Entamoeba invadens
EQSKRQFVLKHLNKNKLIWVYKRFYQLDYHSMRTLIFLSFTVFTAFSNECKPP

SEQ ID NO: 2816648 - protein, 55 aa, Entamoeba invadens
EQSKRQFVLKHLNKNKLIWVYKRFYQLDYHSMRTLIFLSITVFTAFSDECKPPVE

SEQ ID NO: 2816649 - protein, 34 aa, Entamoeba invadens
EQTQKFQIMILLNVFLMVYFVQSWIVMASDSNEM

SEQ ID NO: 2816650 - protein, 25 aa, Entamoeba invadens
EQTWDILHLLLFITTLVSLLSKKGF

SEQ ID NO: 2816651 - protein, 29 aa, Entamoeba invadens
EQVLYFVCALFFIVFFVNGALQMEKIFLT

SEQ ID NO: 2816652 - protein, 18 aa, Entamoeba invadens
EQWDCSNKYFINKKTFKC

SEQ ID NO: 2816653 - protein, 26 aa, Entamoeba invadens
EQYDHLMISMSKLAFFSQTKNFIQLR

SEQ ID NO: 2816654 - protein, 24 aa, Entamoeba invadens
ERCDSLVIPLHFPQQAKQSKSTDE

SEQ ID NO: 2816655 - protein, 28 aa, Entamoeba invadens
ERCGSLDVLQIKRLIFDLYNIDVQESAV

SEQ ID NO: 2816656 - protein, 30 aa, Entamoeba invadens
ERCLSCKNGYFRIPLEKIKLCLSYDSNLNC

SEQ ID NO: 2816657 - protein, 21 aa, Entamoeba invadens
ERDIKLIYSLTKPCLEKVNLP

SEQ ID NO: 2816658 - protein, 26 aa, Entamoeba invadens
ERDTQYYCNIFKWAIDTKILAEIKKY

SEQ ID NO: 2816659 - protein, 17 aa, Entamoeba invadens
ERESFCVVFWKYYAELM

SEQ ID NO: 2816660 - protein, 23 aa, Entamoeba invadens
ERFKFAWNIADFTSAGKRLVIPE

SEQ ID NO: 2816661 - protein, 17 aa, Entamoeba invadens
ERFNQPWMIPQFVIEGN

SEQ ID NO: 2816662 - protein, 27 aa, Entamoeba invadens
ERGEFGCIWCKAGFYKGGDGIKCVECP

SEQ ID NO: 2816663 - protein, 33 aa, Entamoeba invadens
ERGVMNLLIGRSNVIYCLLESLALEECYRVFQS

SEQ ID NO: 2816664 - protein, 17 aa, Entamoeba invadens
ERGYFRFVAFSVAMESC

SEQ ID NO: 2816665 - protein, 25 aa, Entamoeba invadens
ERIEKLFTIMYLRTDKRFYAKIMKL

SEQ ID NO: 2816666 - protein, 17 aa, Entamoeba invadens
ERIRSPFVLGFIGSVVM

SEQ ID NO: 2816667 - protein, 24 aa, Entamoeba invadens
ERKCVTCMTGKYPKLDGKCYECDL

SEQ ID NO: 2816668 - protein, 23 aa, Entamoeba invadens
ERKIKWYFVIKSLITTYFGNLIG

SEQ ID NO: 2816669 - protein, 20 aa, Entamoeba invadens
ERKLGEGSFGIVYKGTYRGN

SEQ ID NO: 2816670 - protein, 22 aa, Entamoeba invadens
ERKLGEGSFGIVYKGTYRGNVV

SEQ ID NO: 2816671 - protein, 23 aa, Entamoeba invadens
ERKYKYYIYISVTQLCDVKLNLS

SEQ ID NO: 2816672 - protein, 24 aa, Entamoeba invadens
ERLERWWFILTDMRNSVVLNAAHG

SEQ ID NO: 2816673 - protein, 24 aa, Entamoeba invadens
ERLIKFDLSSLFDLAFYSININHS

SEQ ID NO: 2816674 - protein, 24 aa, Entamoeba invadens
ERLKREFLPLLFVGITHLNQTIFS

SEQ ID NO: 2816675 - protein, 28 aa, Entamoeba invadens
ERLSDGYYYYIFISATLIIQFNVTFKSV

SEQ ID NO: 2816676 - protein, 24 aa, Entamoeba invadens
ERMINPFIRTDLFVWMVNTQLPKL

SEQ ID NO: 2816677 - protein, 18 aa, Entamoeba invadens
ERMLNDLLGLYNHITFLV

SEQ ID NO: 2816678 - protein, 39 aa, Entamoeba invadens
ERNLYIAYQSVLMLLLSPSTSFIIGKPSHRATKTLNFIV

SEQ ID NO: 2816679 - protein, 23 aa, Entamoeba invadens
ERNQPAPLPYFPPTAHTQTNTTT

SEQ ID NO: 2816680 - protein, 23 aa, Entamoeba invadens
ERQRSFVITLLSLIVTKDGKLNP

SEQ ID NO: 2816681 - protein, 48 aa, Entamoeba invadens
ERRVLGWAVGVCIVCGVLFICIVLLILFVLYRYYEKRQIIIQYKRENG

SEQ ID NO: 2816682 - protein, 25 aa, Entamoeba invadens
ERSFCNWMKLFKEVFRDKFMVEVNA

SEQ ID NO: 2816683 - protein, 21 aa, Entamoeba invadens
ERSRIPLSLFFGSLGVKKETN

SEQ ID NO: 2816684 - protein, 24 aa, Entamoeba invadens
ERTEGMPDNYWNLLNKCWAQEAEK

SEQ ID NO: 2816685 - protein, 27 aa, Entamoeba invadens
ERTIKDLPLFFVLNTVTITGFAAFQHE

SEQ ID NO: 2816686 - protein, 24 aa, Entamoeba invadens
ERTIRDIPLIQTTVLFFSNVNTIV

SEQ ID NO: 2816687 - protein, 27 aa, Entamoeba invadens
ERTNNPYIIVWQNTFPTYPKFYNYNYE

SEQ ID NO: 2816688 - protein, 18 aa, Entamoeba invadens
ERVKLYCKYKKVIDMLYP

SEQ ID NO: 2816689 - protein, 26 aa, Entamoeba invadens
ERVLTDFLYFNAPVDTVLYPDLYTEM

SEQ ID NO: 2816690 - protein, 44 aa, Entamoeba invadens
ERWSRKKTTFKWTYIIVAVPVLAAVVFIIYSFCKTSKTSTGQKT

SEQ ID NO: 2816691 - protein, 25 aa, Entamoeba invadens
ERYKSLFSVVKYIPPIFLTDGVKCK

SEQ ID NO: 2816692 - protein, 23 aa, Entamoeba invadens
ERYTEFMYYLFISTNEIADFEFS

SEQ ID NO: 2816693 - protein, 23 aa, Entamoeba invadens
ESCLDLLLVFPYESVQTVYNTTK

SEQ ID NO: 2816694 - protein, 24 aa, Entamoeba invadens
ESDDLIIPTGLFSAVFIITPADIT

SEQ ID NO: 2816695 - protein, 25 aa, Entamoeba invadens
ESDTHLWNPVFLMGILCMQSGAVSA

SEQ ID NO: 2816696 - protein, 26 aa, Entamoeba invadens
ESDVYSFGMILWELSTLSSPFPQFKF

SEQ ID NO: 2816697 - protein, 30 aa, Entamoeba invadens
ESESDDLTWLWITLGVVGGVVLIAAIILII

SEQ ID NO: 2816698 - protein, 21 aa, Entamoeba invadens
ESFIMLFVRKEILGSFVLPNM

SEQ ID NO: 2816699 - protein, 19 aa, Entamoeba invadens
ESFPLFIGVSYIEISSYIV

SEQ ID NO: 2816700 - protein, 17 aa, Entamoeba invadens
ESGDVVTVPYYFKFVPL

SEQ ID NO: 2816701 - protein, 47 aa, Entamoeba invadens
ESGTFCNTKAVWWFILIIIIFVLVIITMFVVCIYIILIKIQKNRHRK

SEQ ID NO: 2816702 - protein, 17 aa, Entamoeba invadens
ESGYYLDSINKCQTLGD

SEQ ID NO: 2816703 - protein, 21 aa, Entamoeba invadens
ESICKYVLLNGYEDLKMCLSC

SEQ ID NO: 2816704 - protein, 19 aa, Entamoeba invadens
ESIGFYLSSLEPLAKEVCD

SEQ ID NO: 2816705 - protein, 26 aa, Entamoeba invadens
ESIKNMILPSLFDPITLKQIPTDTNA

SEQ ID NO: 2816706 - protein, 27 aa, Entamoeba invadens
ESINFIVDILFVMGYSLRCSIKGGRKD

SEQ ID NO: 2816707 - protein, 19 aa, Entamoeba invadens
ESINMYNLLVFLEDPLDSQ

SEQ ID NO: 2816708 - protein, 18 aa, Entamoeba invadens
ESITLFFTNNLTSSCIGN

SEQ ID NO: 2816709 - protein, 26 aa, Entamoeba invadens
ESKIQKLYFTPQRFIDKEYSQYGFSN

SEQ ID NO: 2816710 - protein, 25 aa, Entamoeba invadens
ESKTKMVIIVTAVVILCISVAFWIE

SEQ ID NO: 2816711 - protein, 28 aa, Entamoeba invadens
ESLLKEYKILFKWYDGPLIEAMKTGEMF

SEQ ID NO: 2816712 - protein, 29 aa, Entamoeba invadens
ESLNLYEPALWLVLLNIVRNLVVDEGLCD

SEQ ID NO: 2816713 - protein, 17 aa, Entamoeba invadens
ESLTFNLVAFALPLIVG

SEQ ID NO: 2816714 - protein, 17 aa, Entamoeba invadens
ESLTFNLVAFLLPLIVG

SEQ ID NO: 2816715 - protein, 28 aa, Entamoeba invadens
ESLTTTDFVLFLLSKPVSKGTISPLSYK

SEQ ID NO: 2816716 - protein, 26 aa, Entamoeba invadens
ESMFNPDYLLFRPTDDGQFQANPASE

SEQ ID NO: 2816717 - protein, 29 aa, Entamoeba invadens
ESNDYRLVGSLFFFRGQLLNDVLSNTVQT

SEQ ID NO: 2816718 - protein, 22 aa, Entamoeba invadens
ESNFILINEVCNPLAVVQYCVS

SEQ ID NO: 2816719 - protein, 17 aa, Entamoeba invadens
ESNFILINEVCNPLSVV

SEQ ID NO: 2816720 - protein, 24 aa, Entamoeba invadens
ESNGITHYLTFGQWIVALEEKNGV

SEQ ID NO: 2816721 - protein, 27 aa, Entamoeba invadens
ESNVAFQIVLTKLRFLFDVLTEAEFIK

SEQ ID NO: 2816722 - protein, 17 aa, Entamoeba invadens
ESNYYLLNITFCQQCDT

SEQ ID NO: 2816723 - protein, 24 aa, Entamoeba invadens
ESNYYPKQGLCVPCDYGCTTCSSA

SEQ ID NO: 2816724 - protein, 17 aa, Entamoeba invadens
ESPLSEIDGCLLYDIKI

SEQ ID NO: 2816725 - protein, 21 aa, Entamoeba invadens
ESQHFNVWWYRNKMSELTSKI

SEQ ID NO: 2816726 - protein, 24 aa, Entamoeba invadens
ESQNYSIRLFYTSNMPIILHSALT

SEQ ID NO: 2816727 - protein, 23 aa, Entamoeba invadens
ESRLYEAFTLMYSKAFDQKTFDL

SEQ ID NO: 2816728 - protein, 23 aa, Entamoeba invadens
ESSDDLMFCLITLLQQIERQITT

SEQ ID NO: 2816729 - protein, 30 aa, Entamoeba invadens
ESSEEDLTWLWITLGVVGGVLLIAVIILVV

SEQ ID NO: 2816730 - protein, 18 aa, Entamoeba invadens
ESSFVINYFIFANDSKTC

SEQ ID NO: 2816731 - protein, 25 aa, Entamoeba invadens
ESSGLFWVVPVITFPIIIGLSSDYD

SEQ ID NO: 2816732 - protein, 22 aa, Entamoeba invadens
ESSQFFRDIFPIIASLAAIHPK

SEQ ID NO: 2816733 - protein, 23 aa, Entamoeba invadens
ESSVMVPLVDFILRVIGSHRGKL

SEQ ID NO: 2816734 - protein, 24 aa, Entamoeba invadens
ESSYQLWLVPFYVGLIFNIITHVF

SEQ ID NO: 2816735 - protein, 20 aa, Entamoeba invadens
ESTCKYVLLNGYEDLKKCLS

SEQ ID NO: 2816736 - protein, 26 aa, Entamoeba invadens
ESTECQYIFNYLGVSVKPTLSQNLDE

SEQ ID NO: 2816737 - protein, 23 aa, Entamoeba invadens
ESTGLTNVYFSTALKKLGDGAFK

SEQ ID NO: 2816738 - protein, 29 aa, Entamoeba invadens
ESTLPFTHLDFFKYFLSDKSKETQKKMLE

SEQ ID NO: 2816739 - protein, 31 aa, Entamoeba invadens
ESTTKVNAPFLFMGGLFLGAAGVFVRPFDGV

SEQ ID NO: 2816740 - protein, 20 aa, Entamoeba invadens
ESTWLLEEILGLDASYEKLN

SEQ ID NO: 2816741 - protein, 18 aa, Entamoeba invadens
ESVFTIGIPFIFQKCPVK

SEQ ID NO: 2816742 - protein, 19 aa, Entamoeba invadens
ESVIVNKLFRMCKRYKPDY

SEQ ID NO: 2816743 - protein, 21 aa, Entamoeba invadens
ESVLKCWLKSRLYNPNYDKSP

SEQ ID NO: 2816744 - protein, 23 aa, Entamoeba invadens
ESVMFKERFSDWASVPIGGKVDI

SEQ ID NO: 2816745 - protein, 28 aa, Entamoeba invadens
ESVTFPSYLLTIWDRCFEFCMSLKSIKI

SEQ ID NO: 2816746 - protein, 17 aa, Entamoeba invadens
ESWEWMNCFMTAGTFKA

SEQ ID NO: 2816747 - protein, 20 aa, Entamoeba invadens
ESYCLIPQKQSILKNKGVFV

SEQ ID NO: 2816748 - protein, 17 aa, Entamoeba invadens
ESYGYFEQEYCPCKMCQ

SEQ ID NO: 2816749 - protein, 22 aa, Entamoeba invadens
ESYILKVYPIVTSADLFVLLIK

SEQ ID NO: 2816750 - protein, 25 aa, Entamoeba invadens
ESYLMYDKSYLPRVLLRLVKTVVLC

SEQ ID NO: 2816751 - protein, 24 aa, Entamoeba invadens
ESYSQMILKVNQPIFVSSPKTAKN

SEQ ID NO: 2816752 - protein, 31 aa, Entamoeba invadens
ESYTSFFFGEVLSMFLLYLSIARGKLNTTQI

SEQ ID NO: 2816753 - protein, 26 aa, Entamoeba invadens
ESYTSYMKLPHLLGSEIYFPSNTTNA

SEQ ID NO: 2816754 - protein, 25 aa, Entamoeba invadens
ESYVLNCWSGYFIGQSFKCVSCRQG

SEQ ID NO: 2816755 - protein, 23 aa, Entamoeba invadens
ETAKIPCYVIINNLNKDSYGVVL

SEQ ID NO: 2816756 - protein, 24 aa, Entamoeba invadens
ETCLGFVVPFLCASSVFCTRHFSG

SEQ ID NO: 2816757 - protein, 18 aa, Entamoeba invadens
ETCMCYYGYYPKVVGEYS

SEQ ID NO: 2816758 - protein, 18 aa, Entamoeba invadens
ETEFVLDLSLNPFSVVDF

SEQ ID NO: 2816759 - protein, 22 aa, Entamoeba invadens
ETFSWSCAYPEDKFKFPWKIAE

SEQ ID NO: 2816760 - protein, 19 aa, Entamoeba invadens
ETFYNFWERVISISQTVVN

SEQ ID NO: 2816761 - protein, 24 aa, Entamoeba invadens
ETHCCGIIPLMKLFDKTPPTQVIN

SEQ ID NO: 2816762 - protein, 18 aa, Entamoeba invadens
ETHWFNLFNCEEGNYLAI

SEQ ID NO: 2816763 - protein, 35 aa, Entamoeba invadens
ETINGLLKYHKLYETFIYLKFKTNSIVLCLDSEDA

SEQ ID NO: 2816764 - protein, 22 aa, Entamoeba invadens
ETIPITIRELPFYHISKPSGEK

SEQ ID NO: 2816765 - protein, 23 aa, Entamoeba invadens
ETISLCVLFIIAGGMMIACSFIQ

SEQ ID NO: 2816766 - protein, 17 aa, Entamoeba invadens
ETISWREAYPKSEFKFP

SEQ ID NO: 2816767 - protein, 17 aa, Entamoeba invadens
ETISWTKIGSKAFYQCY

SEQ ID NO: 2816768 - protein, 30 aa, Entamoeba invadens
ETIVGYVALLFSVLLFGSFLVPVKKFEAGD

SEQ ID NO: 2816769 - protein, 28 aa, Entamoeba invadens
ETLATILKIVMVTTIVCLVWLCYVIIMA

SEQ ID NO: 2816770 - protein, 19 aa, Entamoeba invadens
ETLPQLDKIIFLTPSNKSN

SEQ ID NO: 2816771 - protein, 21 aa, Entamoeba invadens
ETLQRMNYIFTFPTEYSTAVC

SEQ ID NO: 2816772 - protein, 21 aa, Entamoeba invadens
ETNNYLFLKGSFHLITSPTRP

SEQ ID NO: 2816773 - protein, 24 aa, Entamoeba invadens
ETNPTLVPNTLRFYLPGENLTCLW

SEQ ID NO: 2816774 - protein, 31 aa, Entamoeba invadens
ETNTDLQFFYNAFIFLTATDSLLSLQGLCMK

SEQ ID NO: 2816775 - protein, 20 aa, Entamoeba invadens
ETNTFYCYISSKVYFENDSH

SEQ ID NO: 2816776 - protein, 25 aa, Entamoeba invadens
ETPDYRFFFIYSIYYYNTTNIIFFN

SEQ ID NO: 2816777 - protein, 24 aa, Entamoeba invadens
ETQDHPEYILLTKFINSYDGLIDV

SEQ ID NO: 2816778 - protein, 20 aa, Entamoeba invadens
ETQDIYCINYRLVDEAYQCD

SEQ ID NO: 2816779 - protein, 23 aa, Entamoeba invadens
ETQKTYTPVPKINKLKISQFSPK

SEQ ID NO: 2816780 - protein, 25 aa, Entamoeba invadens
ETQMCKTCELGYYLVSDTNECVASC

SEQ ID NO: 2816781 - protein, 23 aa, Entamoeba invadens
ETQNALLDFLKRCLTFDPKERMT

SEQ ID NO: 2816782 - protein, 30 aa, Entamoeba invadens
ETQRSLISYVRMPIRLQSYVFNDCHVEYVS

SEQ ID NO: 2816783 - protein, 23 aa, Entamoeba invadens
ETRCTPIRGIGHCLQYSFNELKV

SEQ ID NO: 2816784 - protein, 19 aa, Entamoeba invadens
ETRFLYTVLVSNWVFEYYE

SEQ ID NO: 2816785 - protein, 20 aa, Entamoeba invadens
ETRGLESFPLFIGVSYIEIS

SEQ ID NO: 2816786 - protein, 24 aa, Entamoeba invadens
ETRKQILYALYRMLYDNKQALGDA

SEQ ID NO: 2816787 - protein, 23 aa, Entamoeba invadens
ETRKRKEAEKQNEILKLLVDEKE

SEQ ID NO: 2816788 - protein, 33 aa, Entamoeba invadens
ETRTVITPQQELPWHKKLLIYAKDSGEDFMVVF

SEQ ID NO: 2816789 - protein, 23 aa, Entamoeba invadens
ETSEKYLQLFRYELKDIKEVLMK

SEQ ID NO: 2816790 - protein, 36 aa, Entamoeba invadens
ETSKILWRNNYNINKMLFVWDRYIGITVNTKLHDLE

SEQ ID NO: 2816791 - protein, 32 aa, Entamoeba invadens
ETSKYIQVFNFISLIFFPITLVVNSFGCNIRV

SEQ ID NO: 2816792 - protein, 17 aa, Entamoeba invadens
ETSLFCEHRVTLLVFYI

SEQ ID NO: 2816793 - protein, 24 aa, Entamoeba invadens
ETSLSPMRVPLMNSILPTSDSFNC

SEQ ID NO: 2816794 - protein, 24 aa, Entamoeba invadens
ETSYPQRLYILTPQPFNTSIQNYF

SEQ ID NO: 2816795 - protein, 22 aa, Entamoeba invadens
ETTIITHGLPYPDNLKVANELE

SEQ ID NO: 2816796 - protein, 24 aa, Entamoeba invadens
ETTKMPFPTWAYKNNNKCLPKKCL

SEQ ID NO: 2816797 - protein, 26 aa, Entamoeba invadens
ETVALKLYMTEFKLYDLNTLKATNCT

SEQ ID NO: 2816798 - protein, 17 aa, Entamoeba invadens
ETVCYFLVNVMYTIIAM

SEQ ID NO: 2816799 - protein, 18 aa, Entamoeba invadens
ETVKGGGIILVLLSGMTS

SEQ ID NO: 2816800 - protein, 26 aa, Entamoeba invadens
ETVNPSLWRQSQLIRIDGLFELIPNK

SEQ ID NO: 2816801 - protein, 26 aa, Entamoeba invadens
ETWKDTYPLETFKFPWKIAEFVTSGE

SEQ ID NO: 2816802 - protein, 17 aa, Entamoeba invadens
ETYGVVLPALLPKYTTV

SEQ ID NO: 2816803 - protein, 22 aa, Entamoeba invadens
ETYLFKIPNLSECFVFLGDDFF

SEQ ID NO: 2816804 - protein, 24 aa, Entamoeba invadens
ETYSTLIVPFYRENEIDFLKPLDK

SEQ ID NO: 2816805 - protein, 18 aa, Entamoeba invadens
EVAFDLGIPVSLYVINRT

SEQ ID NO: 2816806 - protein, 29 aa, Entamoeba invadens
EVALSLYLFFTMIYLNLIKLTILERIVDL

SEQ ID NO: 2816807 - protein, 34 aa, Entamoeba invadens
EVAMLAKFVSPYVIRFYGACFIPNRICMVTELAK

SEQ ID NO: 2816808 - protein, 23 aa, Entamoeba invadens
EVCLKCIKGYVLSNVTCVKLLTS

SEQ ID NO: 2816809 - protein, 26 aa, Entamoeba invadens
EVDMKLRMKFLLDAAKGIQYLHENGI

SEQ ID NO: 2816810 - protein, 28 aa, Entamoeba invadens
EVDMLDKFRNIKPDNLLVFSLDANEKVN

SEQ ID NO: 2816811 - protein, 34 aa, Entamoeba invadens
EVDMLDKFRSGYIIYFYGAVLFKNRFALVTEFAD

SEQ ID NO: 2816812 - protein, 29 aa, Entamoeba invadens
EVEFETVIPILRFILKPTQYTGLLTVTQV

SEQ ID NO: 2816813 - protein, 26 aa, Entamoeba invadens
EVEMHLRIKFILDASKGILYLHENGI

SEQ ID NO: 2816814 - protein, 32 aa, Entamoeba invadens
EVEMLDKFRSDFLVIFYGACLIPNKICIVTEF

SEQ ID NO: 2816815 - protein, 19 aa, Entamoeba invadens
EVENKYTTLLFYNISRVYK

SEQ ID NO: 2816816 - protein, 25 aa, Entamoeba invadens
EVETKMRIIIILDGAKGIQYLHENS

SEQ ID NO: 2816817 - protein, 25 aa, Entamoeba invadens
EVETKMRIIIILDGARGIQYLHENG

SEQ ID NO: 2816818 - protein, 21 aa, Entamoeba invadens
EVETKMRIKIILDAARGIQYL

SEQ ID NO: 2816819 - protein, 26 aa, Entamoeba invadens
EVETNIFHFLTMHDVYKSFSCILSNF

SEQ ID NO: 2816820 - protein, 19 aa, Entamoeba invadens
EVEYWFKLFEELVDMAHNR

SEQ ID NO: 2816821 - protein, 29 aa, Entamoeba invadens
EVFGWTNAYPLDAFKFPWKIAEFVICMKI

SEQ ID NO: 2816822 - protein, 19 aa, Entamoeba invadens
EVFLTPFCTMKLHDEIMIV

SEQ ID NO: 2816823 - protein, 17 aa, Entamoeba invadens
EVFMTYNINLELIHTEE

SEQ ID NO: 2816824 - protein, 18 aa, Entamoeba invadens
EVFPFLKVLGHNDSKMYQ

SEQ ID NO: 2816825 - protein, 19 aa, Entamoeba invadens
EVFQLINRKLQKKGSITTI

SEQ ID NO: 2816826 - protein, 30 aa, Entamoeba invadens
EVGCDAMFTLPWYLTWFIHSISSVEVGVRL

SEQ ID NO: 2816827 - protein, 24 aa, Entamoeba invadens
EVGCLLCQNGYYTNEYNKCTKCGD

SEQ ID NO: 2816828 - protein, 22 aa, Entamoeba invadens
EVIDNLHFEMKCGTWRVKTDLK

SEQ ID NO: 2816829 - protein, 25 aa, Entamoeba invadens
EVIMKLRLKMMLDASKGILYLHENG

SEQ ID NO: 2816830 - protein, 18 aa, Entamoeba invadens
EVIWFYLNSISIGAGIVA

SEQ ID NO: 2816831 - protein, 23 aa, Entamoeba invadens
EVKLNSFNKLLSVSGIMADCGKR

SEQ ID NO: 2816832 - protein, 33 aa, Entamoeba invadens
EVKMLEKFRCNYIITFLGAVFIPSKTCIVMEYA

SEQ ID NO: 2816833 - protein, 22 aa, Entamoeba invadens
EVKNMFSILLREYKTIRGVAKD

SEQ ID NO: 2816834 - protein, 18 aa, Entamoeba invadens
EVKRILWVIAFRSCMNFI

SEQ ID NO: 2816835 - protein, 18 aa, Entamoeba invadens
EVKRLIKKNWYYLFGTAG

SEQ ID NO: 2816836 - protein, 28 aa, Entamoeba invadens
EVKYQISLYLIVLVVFFGFDEMITVLTN

SEQ ID NO: 2816837 - protein, 20 aa, Entamoeba invadens
EVLCFLFLVIFQGTFTNIDG

SEQ ID NO: 2816838 - protein, 46 aa, Entamoeba invadens
EVLDKRHYKFPADIYSYAITMYEIEKWGHAFPKEKFKHAWDVANFI

SEQ ID NO: 2816839 - protein, 24 aa, Entamoeba invadens
EVLKSILSIIILIAVWAVMFCIVI

SEQ ID NO: 2816840 - protein, 17 aa, Entamoeba invadens
EVLLKKKYKTPADIFSF

SEQ ID NO: 2816841 - protein, 21 aa, Entamoeba invadens
EVLNYYNGIYHFQRNTFEFTP

SEQ ID NO: 2816842 - protein, 26 aa, Entamoeba invadens
EVLSKLKVLIFIYLIPISLKCEQNKE

SEQ ID NO: 2816843 - protein, 18 aa, Entamoeba invadens
EVMFRKHYKKPADIYSFG

SEQ ID NO: 2816844 - protein, 20 aa, Entamoeba invadens
EVMLLFLGILIPKDFFIMVA

SEQ ID NO: 2816845 - protein, 39 aa, Entamoeba invadens
EVNAAPVLISPRPLEWIHNNRIPLFHVGALLTTQKTSTS

SEQ ID NO: 2816846 - protein, 26 aa, Entamoeba invadens
EVNIKLKIKFMLDASKGLLYLHENGI

SEQ ID NO: 2816847 - protein, 24 aa, Entamoeba invadens
EVNKPELRFDLDASMVPVGKESRD

SEQ ID NO: 2816848 - protein, 20 aa, Entamoeba invadens
EVNLSIVEFIRDLYSVMDIQ

SEQ ID NO: 2816849 - protein, 28 aa, Entamoeba invadens
EVPNNYEFIYPLITSWIAPLNVMHIYPD

SEQ ID NO: 2816850 - protein, 24 aa, Entamoeba invadens
EVPNVLDLLPLQKTPITKKPEEKV

SEQ ID NO: 2816851 - protein, 36 aa, Entamoeba invadens
EVPSRLQILVNILTRYILLFSYFPINETIDVYEEVD

SEQ ID NO: 2816852 - protein, 27 aa, Entamoeba invadens
EVQMPIALLCVFLLLAEALFLNWGVVA

SEQ ID NO: 2816853 - protein, 39 aa, Entamoeba invadens
EVRDDHGCVLIPQNILPWVVTKAVIGGNKPVFEMRKNFK

SEQ ID NO: 2816854 - protein, 21 aa, Entamoeba invadens
EVRSSLVLAGSLIVDEIFTAS

SEQ ID NO: 2816855 - protein, 18 aa, Entamoeba invadens
EVSESCFLFSAGTSKYIH

SEQ ID NO: 2816856 - protein, 23 aa, Entamoeba invadens
EVSIIGWFKVSLGDYKILAIKRN

SEQ ID NO: 2816857 - protein, 28 aa, Entamoeba invadens
EVSKMRNICVFPMKKSNINMFTLEGSVV

SEQ ID NO: 2816858 - protein, 27 aa, Entamoeba invadens
EVSMLDKFRIDYVVNFYGSVFIPNKIC

SEQ ID NO: 2816859 - protein, 30 aa, Entamoeba invadens
EVSMLDKFRSPYIVHFYGAVVIPNKICMVT

SEQ ID NO: 2816860 - protein, 25 aa, Entamoeba invadens
EVSSIFFEVLIYLLDEFEKVKDFHY

SEQ ID NO: 2816861 - protein, 25 aa, Entamoeba invadens
EVTKILFTPIVHPCSYFYNTVNWPE

SEQ ID NO: 2816862 - protein, 27 aa, Entamoeba invadens
EVTNTHALLLLKALHDFPIEVSPHFQR

SEQ ID NO: 2816863 - protein, 29 aa, Entamoeba invadens
EVTQYFHDYHFWSLPTVLWNFINSNQHKR

SEQ ID NO: 2816864 - protein, 29 aa, Entamoeba invadens
EVTYLFNRIFPQIWIWRHASLYQTINRVL

SEQ ID NO: 2816865 - protein, 20 aa, Entamoeba invadens
EVVGDFFMICQNGTFSIFSE

SEQ ID NO: 2816866 - protein, 25 aa, Entamoeba invadens
EVVKMRNICVFPMKKSNVKMVTLEG

SEQ ID NO: 2816867 - protein, 27 aa, Entamoeba invadens
EVVLFWVFVIVWRKKKVLTFVVYCCLI

SEQ ID NO: 2816868 - protein, 21 aa, Entamoeba invadens
EVVMKMRIKLMLDTAKGIQYL

SEQ ID NO: 2816869 - protein, 24 aa, Entamoeba invadens
EVVNLLLDVLFEFGVVLLNARDES

SEQ ID NO: 2816870 - protein, 30 aa, Entamoeba invadens
EVYEKSQFKFPWIIAEYVSNGLRLNRPENV

SEQ ID NO: 2816871 - protein, 18 aa, Entamoeba invadens
EVYIKPLCTCKIDDLFVM

SEQ ID NO: 2816872 - protein, 17 aa, Entamoeba invadens
EVYKYLESLAKKLGVEH

SEQ ID NO: 2816873 - protein, 29 aa, Entamoeba invadens
EVYMCGLNIILNLLYIGFMNQNIAVMALF

SEQ ID NO: 2816874 - protein, 18 aa, Entamoeba invadens
EVYPKSEFKFAWSVADFV

SEQ ID NO: 2816875 - protein, 18 aa, Entamoeba invadens
EVYWCKFKSIVKPEEDNK

SEQ ID NO: 2816876 - protein, 23 aa, Entamoeba invadens
EWKIDLTLKLLVVVSLDRFGDFI

SEQ ID NO: 2816877 - protein, 17 aa, Entamoeba invadens
EWLGFTISTLTVLLIVI

SEQ ID NO: 2816878 - protein, 19 aa, Entamoeba invadens
EWNEKLVFQFPLEKIVKMY

SEQ ID NO: 2816879 - protein, 17 aa, Entamoeba invadens
EWNINEVKYKSTCQLCD

SEQ ID NO: 2816880 - protein, 18 aa, Entamoeba invadens
EWPDIWKLTPAKVKSGNE

SEQ ID NO: 2816881 - protein, 20 aa, Entamoeba invadens
EWPLLVICPSSVRHNWKDEI

SEQ ID NO: 2816882 - protein, 25 aa, Entamoeba invadens
EWSDGMVVMLIAGENNPLFTLETIG

SEQ ID NO: 2816883 - protein, 25 aa, Entamoeba invadens
EWVAKTLPWLMFLGGLVSSLGYLLT

SEQ ID NO: 2816884 - protein, 33 aa, Entamoeba invadens
EWYVVVLAFVGWFLAFFVPLLLPIDLASSFNYK

SEQ ID NO: 2816885 - protein, 20 aa, Entamoeba invadens
EYAAVLYYYERNKCDLVEGK

SEQ ID NO: 2816886 - protein, 23 aa, Entamoeba invadens
EYADLFVHFFKFTDKLCDDADKM

SEQ ID NO: 2816887 - protein, 18 aa, Entamoeba invadens
EYAFLNQNLLEKITFETT

SEQ ID NO: 2816888 - protein, 24 aa, Entamoeba invadens
EYCKCLVGVVFFLAPYVSNIDIYS

SEQ ID NO: 2816889 - protein, 18 aa, Entamoeba invadens
EYCLFCDLNFYNSNGYCL

SEQ ID NO: 2816890 - protein, 19 aa, Entamoeba invadens
EYESVVFKLFAQATICNLN

SEQ ID NO: 2816891 - protein, 28 aa, Entamoeba invadens
EYFELIYITFYVWGYLSLGVCALEIVLE

SEQ ID NO: 2816892 - protein, 34 aa, Entamoeba invadens
EYFKKQYRVKFYLKAILIFSIILTVILAVVRAVF

SEQ ID NO: 2816893 - protein, 25 aa, Entamoeba invadens
EYGCAVCYDGYYQNKYYKCSKCNDL

SEQ ID NO: 2816894 - protein, 25 aa, Entamoeba invadens
EYGYAVCYNGYYQNKYYKCTKCNDL

SEQ ID NO: 2816895 - protein, 34 aa, Entamoeba invadens
EYILGFFPIQLVCLMVIVLLLIALAFQSLLMGIR

SEQ ID NO: 2816896 - protein, 18 aa, Entamoeba invadens
EYIMVIGLDIKTGVQYNE

SEQ ID NO: 2816897 - protein, 18 aa, Entamoeba invadens
EYIVHFYGAVFIENKVSV

SEQ ID NO: 2816898 - protein, 20 aa, Entamoeba invadens
EYIVHFYGAVFIPNKICLVT

SEQ ID NO: 2816899 - protein, 19 aa, Entamoeba invadens
EYIVHFYGAVFIPNKVCMV

SEQ ID NO: 2816900 - protein, 18 aa, Entamoeba invadens
EYIVYFYGAVMFEKRFAI

SEQ ID NO: 2816901 - protein, 31 aa, Entamoeba invadens
EYKIFNIFQEITLKYFFIQTRFRDSRITLEE

SEQ ID NO: 2816902 - protein, 26 aa, Entamoeba invadens
EYKLTDILMILKRRYLLENKGVEIVM

SEQ ID NO: 2816903 - protein, 17 aa, Entamoeba invadens
EYKWRNLVTTGEDTVLS

SEQ ID NO: 2816904 - protein, 26 aa, Entamoeba invadens
EYLHNFDLLVVISFVFGKSAIHRLKK

SEQ ID NO: 2816905 - protein, 17 aa, Entamoeba invadens
EYLMYLNVKSGRSGLDV

SEQ ID NO: 2816906 - protein, 21 aa, Entamoeba invadens
EYLVFFVLAVVMYFSQIVCYQ

SEQ ID NO: 2816907 - protein, 28 aa, Entamoeba invadens
EYNGQHFDRYWKAILFEGSGKRTLSGKS

SEQ ID NO: 2816908 - protein, 17 aa, Entamoeba invadens
EYNHFFNKTTFSCETVE

SEQ ID NO: 2816909 - protein, 39 aa, Entamoeba invadens
EYNPNIQYFIYFNFIVNKTNFWLLCIFQKKLLTTKQIFE

SEQ ID NO: 2816910 - protein, 17 aa, Entamoeba invadens
EYPCTFCSNLTYCTKCD

SEQ ID NO: 2816911 - protein, 19 aa, Entamoeba invadens
EYPCTYCSNLTYCTKCDAY

SEQ ID NO: 2816912 - protein, 26 aa, Entamoeba invadens
EYPYPFTHRHCPLPYDSAYVNHFNVI

SEQ ID NO: 2816913 - protein, 21 aa, Entamoeba invadens
EYSLFITVKLRELSDGSFFVS

SEQ ID NO: 2816914 - protein, 24 aa, Entamoeba invadens
EYSRKISWLIEKFPVDLRPRVMSG

SEQ ID NO: 2816915 - protein, 29 aa, Entamoeba invadens
EYTDAFATYFLKLDLFAPENQKLLQIFKD

SEQ ID NO: 2816916 - protein, 24 aa, Entamoeba invadens
EYTDILMKLLPSGELRKSFKKMLQ

SEQ ID NO: 2816917 - protein, 18 aa, Entamoeba invadens
EYTLLNEMWRFDAQSRIK

SEQ ID NO: 2816918 - protein, 23 aa, Entamoeba invadens
EYTPFTFFGILEDFRNQCIGILE

SEQ ID NO: 2816919 - protein, 25 aa, Entamoeba invadens
EYTVAFITPRYPLFGGWSATLMVTH

SEQ ID NO: 2816920 - protein, 31 aa, Entamoeba invadens
EYVGTVYLVSYLYIEGRVLPTLVLQCLNTLS

SEQ ID NO: 2816921 - protein, 19 aa, Entamoeba invadens
EYVLVNLQCLHFTKVEHCV

SEQ ID NO: 2816922 - protein, 25 aa, Entamoeba invadens
EYVNYVVVIFQKVLLPLVQQDSIEE

SEQ ID NO: 2816923 - protein, 33 aa, Entamoeba invadens
EYYNNHLGMSFINWPFNYLVIACFCKKCVSFVF

SEQ ID NO: 2816924 - protein, 17 aa, Entamoeba invadens
EYYTLIHKIANGLAHYG

SEQ ID NO: 2816925 - protein, 17 aa, Entamoeba invadens
FACEFEVFITPYCTMDL

SEQ ID NO: 2816926 - protein, 20 aa, Entamoeba invadens
FACEFEVFLTPHCTLSLEDK

SEQ ID NO: 2816927 - protein, 23 aa, Entamoeba invadens
FACEFEVFLTPLCTMNLSDEIVI

SEQ ID NO: 2816928 - protein, 21 aa, Entamoeba invadens
FACEFSIYLKPKCTCRINNTI

SEQ ID NO: 2816929 - protein, 24 aa, Entamoeba invadens
FACEFSMYLTPLCTCQIISSIQIV

SEQ ID NO: 2816930 - protein, 28 aa, Entamoeba invadens
FACPINPIPLPQENIVFPNFVRGDVKMS

SEQ ID NO: 2816931 - protein, 18 aa, Entamoeba invadens
FAFLFEYIGEKSKDYIYS

SEQ ID NO: 2816932 - protein, 24 aa, Entamoeba invadens
FAFTQLCLLLFCLALTLVFMKKVF

SEQ ID NO: 2816933 - protein, 25 aa, Entamoeba invadens
FAGDVLLERILFTENVIRLGKNALK

SEQ ID NO: 2816934 - protein, 27 aa, Entamoeba invadens
FAGIIGLYGLIICIMLFINVSKDDYSL

SEQ ID NO: 2816935 - protein, 34 aa, Entamoeba invadens
FAGLTSLQQITFYKYFPSIIRKNAFRNSGLQSIG

SEQ ID NO: 2816936 - protein, 34 aa, Entamoeba invadens
FAGLTSLQQITFYKYFPSTIRKNAFRNSGLQSIG

SEQ ID NO: 2816937 - protein, 17 aa, Entamoeba invadens
FAHDEMILLFNGTSFTS

SEQ ID NO: 2816938 - protein, 19 aa, Entamoeba invadens
FAHQRIELIDWKKIKIRYS

SEQ ID NO: 2816939 - protein, 19 aa, Entamoeba invadens
FAICMLEIWIGRDVYPPDK

SEQ ID NO: 2816940 - protein, 17 aa, Entamoeba invadens
FAIKTPCTLKRWKLYDK

SEQ ID NO: 2816941 - protein, 19 aa, Entamoeba invadens
FAIQAFNFNKPLKKLQIGY

SEQ ID NO: 2816942 - protein, 35 aa, Entamoeba invadens
FAISMYECFTWKDPYPKEFFKFAWSIADFVASGKH

SEQ ID NO: 2816943 - protein, 24 aa, Entamoeba invadens
FAITMFETISWREAFPKSEFKYPW

SEQ ID NO: 2816944 - protein, 23 aa, Entamoeba invadens
FAITMFETISWREAYPKSEFKYP

SEQ ID NO: 2816945 - protein, 18 aa, Entamoeba invadens
FAITMFETITWKEAFPKS

SEQ ID NO: 2816946 - protein, 30 aa, Entamoeba invadens
FAITMYECFGWKEAFPKNIYKFAWDIADSI

SEQ ID NO: 2816947 - protein, 37 aa, Entamoeba invadens
FAITMYECFIWKEAYPKEDFKFPWKIAEFVNSGKRFE

SEQ ID NO: 2816948 - protein, 37 aa, Entamoeba invadens
FAITTLECFLWGEAFPKSTYIFPWTIADDVASGKRPI

SEQ ID NO: 2816949 - protein, 25 aa, Entamoeba invadens
FAKQIMFIVNYFLFRDLYVYPNPLG

SEQ ID NO: 2816950 - protein, 20 aa, Entamoeba invadens
FALGIAFYFDWRVSACVLAA

SEQ ID NO: 2816951 - protein, 18 aa, Entamoeba invadens
FALIFLLVYAVFSVIFYI

SEQ ID NO: 2816952 - protein, 20 aa, Entamoeba invadens
FALLFCYFNSLTKTARAICP

SEQ ID NO: 2816953 - protein, 17 aa, Entamoeba invadens
FALLPFSMIASIVCGLL

SEQ ID NO: 2816954 - protein, 20 aa, Entamoeba invadens
FALVSYTYYYWCKMFCENEI

SEQ ID NO: 2816955 - protein, 18 aa, Entamoeba invadens
FAMKLSNVKFILLRGGIS

SEQ ID NO: 2816956 - protein, 24 aa, Entamoeba invadens
FAMTMFEVFQWDFVFKKMMRGFNT

SEQ ID NO: 2816957 - protein, 37 aa, Entamoeba invadens
FAMTMYECFRWKDAYDKIEFKYPWKIADFVTGGNRLN

SEQ ID NO: 2816958 - protein, 32 aa, Entamoeba invadens
FAMTMYECFSWSVAYPPEVFKFPWKIAEFVSA

SEQ ID NO: 2816959 - protein, 23 aa, Entamoeba invadens
FAMTMYEVLQWDFVFKNDDERFL

SEQ ID NO: 2816960 - protein, 25 aa, Entamoeba invadens
FANTEIALSALFVRTKLSSSYVVFG

SEQ ID NO: 2816961 - protein, 20 aa, Entamoeba invadens
FANVLLYIRGMSTFQKLLLV

SEQ ID NO: 2816962 - protein, 17 aa, Entamoeba invadens
FAPWCKTCASNSSRICV

SEQ ID NO: 2816963 - protein, 23 aa, Entamoeba invadens
FAQFGVCMDYLKASYHYSSKLDT

SEQ ID NO: 2816964 - protein, 19 aa, Entamoeba invadens
FATAMLHFAPGLTPAIYVS

SEQ ID NO: 2816965 - protein, 24 aa, Entamoeba invadens
FATYAFLNLLYYFAPIYSTFGNQK

SEQ ID NO: 2816966 - protein, 27 aa, Entamoeba invadens
FATYLPGIILWSFILLAIGGFIVVMLY

SEQ ID NO: 2816967 - protein, 17 aa, Entamoeba invadens
FAVLAFFIATLITKEFY

SEQ ID NO: 2816968 - protein, 17 aa, Entamoeba invadens
FAVLISLVVLCLAFGLP

SEQ ID NO: 2816969 - protein, 30 aa, Entamoeba invadens
FAVSSLISFERFVFIASISGILCFDRNKMK

SEQ ID NO: 2816970 - protein, 33 aa, Entamoeba invadens
FAVTMFECMIWGNAFLKESFPYAWDIVDFVVNG

SEQ ID NO: 2816971 - protein, 30 aa, Entamoeba invadens
FAVTMLLFTLFVVGFVLFQSRFKCSDFGKV

SEQ ID NO: 2816972 - protein, 25 aa, Entamoeba invadens
FAWENAYPNDLFKFAWSIADYITGG

SEQ ID NO: 2816973 - protein, 24 aa, Entamoeba invadens
FCAPTLMVAYITFGVNFKGNYSLL

SEQ ID NO: 2816974 - protein, 24 aa, Entamoeba invadens
FCCLACWCIFMLQPTFRCSVITPM

SEQ ID NO: 2816975 - protein, 17 aa, Entamoeba invadens
FCCPHWFHYLQGIGYYC

SEQ ID NO: 2816976 - protein, 27 aa, Entamoeba invadens
FCEIMTWIFFDLMTGIPLMGVAFSFCG

SEQ ID NO: 2816977 - protein, 19 aa, Entamoeba invadens
FCEYGSIQDLMKKHKEKIL

SEQ ID NO: 2816978 - protein, 24 aa, Entamoeba invadens
FCFFFIFFCFHFSIFCFLFSPIFL

SEQ ID NO: 2816979 - protein, 17 aa, Entamoeba invadens
FCFFGNEKSLFTATSSN

SEQ ID NO: 2816980 - protein, 29 aa, Entamoeba invadens
FCFKEQWIKQFYLKTIPLIPQFKYQSTAT

SEQ ID NO: 2816981 - protein, 17 aa, Entamoeba invadens
FCFLCNEEYILIDGVCV

SEQ ID NO: 2816982 - protein, 27 aa, Entamoeba invadens
FCFYKNKYRFGKWFKLLYNVKNSSHVR

SEQ ID NO: 2816983 - protein, 22 aa, Entamoeba invadens
FCGHPIFGTMLLRYFEQENKSN

SEQ ID NO: 2816984 - protein, 23 aa, Entamoeba invadens
FCIDTFVVLTKLLRTIIQRRILD

SEQ ID NO: 2816985 - protein, 50 aa, Entamoeba invadens
FCKEKTKIWVYIVILFSIILLIIIIISIIILPLYFIFKKHKNTEEKTIFK

SEQ ID NO: 2816986 - protein, 27 aa, Entamoeba invadens
FCKKIPPFWSIVELQFFTPQKAVASDE

SEQ ID NO: 2816987 - protein, 48 aa, Entamoeba invadens
FCKTALRYDIIFGTIVGFIVFIVLLIVLIIVIIYRIKLHKTEEKKMRN

SEQ ID NO: 2816988 - protein, 18 aa, Entamoeba invadens
FCLLFCTPCLICTLFNCV

SEQ ID NO: 2816989 - protein, 17 aa, Entamoeba invadens
FCLSCNTNYVFRVTFSS

SEQ ID NO: 2816990 - protein, 17 aa, Entamoeba invadens
FCLTCKNGYFVNDFKCV

SEQ ID NO: 2816991 - protein, 18 aa, Entamoeba invadens
FCLTINPSVVVLKQGEAC

SEQ ID NO: 2816992 - protein, 25 aa, Entamoeba invadens
FCNYFILFGNLCLMGFRAVAVLRSY

SEQ ID NO: 2816993 - protein, 18 aa, Entamoeba invadens
FCPLLKTIKYSKKQVKRI

SEQ ID NO: 2816994 - protein, 23 aa, Entamoeba invadens
FCSNSFGIKLLISSSSKLIIETD

SEQ ID NO: 2816995 - protein, 19 aa, Entamoeba invadens
FCSQLLSMYFVVADLRKCH

SEQ ID NO: 2816996 - protein, 17 aa, Entamoeba invadens
FCTSCEDGYYLSENKCI

SEQ ID NO: 2816997 - protein, 19 aa, Entamoeba invadens
FCTSKIQSFFLLVATAFDT

SEQ ID NO: 2816998 - protein, 19 aa, Entamoeba invadens
FCTTCSDGFYLSPESRRYG

SEQ ID NO: 2816999 - protein, 20 aa, Entamoeba invadens
FCVCTFYLALVIIACWTYNI

SEQ ID NO: 2817000 - protein, 24 aa, Entamoeba invadens
FCVMKGCDYYTIRTEPALVNLKSG

SEQ ID NO: 2817001 - protein, 20 aa, Entamoeba invadens
FCVNYPLIYLQMVWAQKYSE

SEQ ID NO: 2817002 - protein, 18 aa, Entamoeba invadens
FCVSVVFPLVLLLSTQRE

SEQ ID NO: 2817003 - protein, 19 aa, Entamoeba invadens
FCVVFWKYYAELMNNNIVV

SEQ ID NO: 2817004 - protein, 18 aa, Entamoeba invadens
FCYPALKFLGSTSLFVEP

SEQ ID NO: 2817005 - protein, 17 aa, Entamoeba invadens
FCYSPLDIPTKVFVFSE

SEQ ID NO: 2817006 - protein, 20 aa, Entamoeba invadens
FCYYNPKYRIGKWIKLNMTL

SEQ ID NO: 2817007 - protein, 17 aa, Entamoeba invadens
FDATGATVTFLGTSSIA

SEQ ID NO: 2817008 - protein, 19 aa, Entamoeba invadens
FDCLRCIDNYYFDSNTRSC

SEQ ID NO: 2817009 - protein, 24 aa, Entamoeba invadens
FDDKTFIEWLNNQFLLSKTSFDEI

SEQ ID NO: 2817010 - protein, 30 aa, Entamoeba invadens
FDDNNIGNPLFVKLLEIFTENKFVEKFKEA

SEQ ID NO: 2817011 - protein, 24 aa, Entamoeba invadens
FDEFVFFHFIGWWARAMVCRDVGL

SEQ ID NO: 2817012 - protein, 28 aa, Entamoeba invadens
FDEPFPVFYDEAFKFEWMTVYCKASLYN

SEQ ID NO: 2817013 - protein, 19 aa, Entamoeba invadens
FDFAFSSIPFNFTLNNDKF

SEQ ID NO: 2817014 - protein, 17 aa, Entamoeba invadens
FDFPRMLSFYLYGKGRI

SEQ ID NO: 2817015 - protein, 28 aa, Entamoeba invadens
FDGFIVLKVPFPLSYRFKLITQQGMGFL

SEQ ID NO: 2817016 - protein, 18 aa, Entamoeba invadens
FDGILCKMGVITNNVLSC

SEQ ID NO: 2817017 - protein, 17 aa, Entamoeba invadens
FDGYYIKDSKCLECGGN

SEQ ID NO: 2817018 - protein, 19 aa, Entamoeba invadens
FDHVALLVFGIFNVFISNS

SEQ ID NO: 2817019 - protein, 30 aa, Entamoeba invadens
FDIIEELFYFFLYSWALYILAMTYNFVTVP

SEQ ID NO: 2817020 - protein, 18 aa, Entamoeba invadens
FDIKICYIPTLVGVVFTL

SEQ ID NO: 2817021 - protein, 18 aa, Entamoeba invadens
FDILMEWYYVFTSHFTYD

SEQ ID NO: 2817022 - protein, 26 aa, Entamoeba invadens
FDIYADTLPRWTVKSVALTPTSYIGS

SEQ ID NO: 2817023 - protein, 19 aa, Entamoeba invadens
FDKICIECKFGYYKDVDGC

SEQ ID NO: 2817024 - protein, 51 aa, Entamoeba invadens
FDKNEKTILMVFKSIIKRFWFKGVELKPKNFNVWLQRVFHKEVNASNEWNT

SEQ ID NO: 2817025 - protein, 23 aa, Entamoeba invadens
FDKRGCFLVNLPNEYFGISPKEF

SEQ ID NO: 2817026 - protein, 22 aa, Entamoeba invadens
FDLHVLIVIAPAGLYYCFKKFD

SEQ ID NO: 2817027 - protein, 25 aa, Entamoeba invadens
FDLLPSLCVLLLLSGLRYYFSKRFF

SEQ ID NO: 2817028 - protein, 33 aa, Entamoeba invadens
FDMIAKSLILIQKPFLVKLLYSKNRIFMAQAIF

SEQ ID NO: 2817029 - protein, 17 aa, Entamoeba invadens
FDPMIKSTKFRIFHRAE

SEQ ID NO: 2817030 - protein, 30 aa, Entamoeba invadens
FDQNVVLWSWFFFDIIIRSTVEYLHEQMDK

SEQ ID NO: 2817031 - protein, 23 aa, Entamoeba invadens
FDSRLMFFFGFALPFTSLSFFCS

SEQ ID NO: 2817032 - protein, 17 aa, Entamoeba invadens
FDSTKILLGSKLYRICY

SEQ ID NO: 2817033 - protein, 25 aa, Entamoeba invadens
FDTFLDLLMPTKSVVIFCVFGAIVV

SEQ ID NO: 2817034 - protein, 18 aa, Entamoeba invadens
FDTIFQRGLFRNCSNESY

SEQ ID NO: 2817035 - protein, 28 aa, Entamoeba invadens
FDTIINAFALIIYLYSALPMDFEKTVLH

SEQ ID NO: 2817036 - protein, 20 aa, Entamoeba invadens
FDTLPMYVLFDQKFASELCS

SEQ ID NO: 2817037 - protein, 25 aa, Entamoeba invadens
FDTNEYPISLILPMNGGGLGDLVAS

SEQ ID NO: 2817038 - protein, 21 aa, Entamoeba invadens
FDTVHMMFVIRFSTFCWSVAD

SEQ ID NO: 2817039 - protein, 28 aa, Entamoeba invadens
FDVKDTMFLAFAGFYYDILNITKVCCDK

SEQ ID NO: 2817040 - protein, 20 aa, Entamoeba invadens
FDVTPLGRLLNYFSRDLRFV

SEQ ID NO: 2817041 - protein, 42 aa, Entamoeba invadens
FDVVKAILFITALLFIALNIISFIFRLFRAKGYKRFVELRLK

SEQ ID NO: 2817042 - protein, 17 aa, Entamoeba invadens
FDYSTITLLILNCIFVA

SEQ ID NO: 2817043 - protein, 17 aa, Entamoeba invadens
FEAFAWEEAYVDVKYFF

SEQ ID NO: 2817044 - protein, 18 aa, Entamoeba invadens
FECFAWKEAYKGLKFKFA

SEQ ID NO: 2817045 - protein, 36 aa, Entamoeba invadens
FECFDYNEILKPQKLLFNTYNTMFLNDIISPMPKSE

SEQ ID NO: 2817046 - protein, 26 aa, Entamoeba invadens
FECISWSYAYSKDKFKFPWSIAEFVI

SEQ ID NO: 2817047 - protein, 27 aa, Entamoeba invadens
FECISWSYAYSYDKFKFPWSIAEFVIK

SEQ ID NO: 2817048 - protein, 24 aa, Entamoeba invadens
FECTKLSKAIRWLNTRPTDFCVEL

SEQ ID NO: 2817049 - protein, 18 aa, Entamoeba invadens
FECVSCENGTFKNTEKGC

SEQ ID NO: 2817050 - protein, 20 aa, Entamoeba invadens
FECVTWKNPYPKEQFKFAWD

SEQ ID NO: 2817051 - protein, 20 aa, Entamoeba invadens
FEDVTLITRTIYGRAVYSGC

SEQ ID NO: 2817052 - protein, 28 aa, Entamoeba invadens
FEEDFYRKFPIFKLPTEVWYIEPYGEEL

SEQ ID NO: 2817053 - protein, 17 aa, Entamoeba invadens
FEEVLTALLIYGLIFFN

SEQ ID NO: 2817054 - protein, 36 aa, Entamoeba invadens
FEGLSSFILFLLYGWVFVLLLFLYSQVHPPLYKERV

SEQ ID NO: 2817055 - protein, 26 aa, Entamoeba invadens
FEGNAKAVLFYLLVSNSTTLSMKEYS

SEQ ID NO: 2817056 - protein, 27 aa, Entamoeba invadens
FEGRVKFSYLIIKSKPISGVYNLNDWT

SEQ ID NO: 2817057 - protein, 19 aa, Entamoeba invadens
FEHCVANMFFLPTAQMYGA

SEQ ID NO: 2817058 - protein, 18 aa, Entamoeba invadens
FEHLLDSLSMVVDKYKIL

SEQ ID NO: 2817059 - protein, 24 aa, Entamoeba invadens
FEHSVANMFFLPLAQMYGAKINML

SEQ ID NO: 2817060 - protein, 25 aa, Entamoeba invadens
FEHTFPFLFLLIDCLLFAQGSKHID

SEQ ID NO: 2817061 - protein, 20 aa, Entamoeba invadens
FEIFIKPLCSCHLEEDIMVI

SEQ ID NO: 2817062 - protein, 19 aa, Entamoeba invadens
FEIFIKPLCSCRIEECIMV

SEQ ID NO: 2817063 - protein, 20 aa, Entamoeba invadens
FEIFITPLCTFKIEDQLKVI

SEQ ID NO: 2817064 - protein, 18 aa, Entamoeba invadens
FEIFLKPYCSCQINDEIL

SEQ ID NO: 2817065 - protein, 30 aa, Entamoeba invadens
FEINWKRIFNWLILFWGYTAFECFEQESHL

SEQ ID NO: 2817066 - protein, 18 aa, Entamoeba invadens
FEIVDVKLLLIKNIEKAS

SEQ ID NO: 2817067 - protein, 29 aa, Entamoeba invadens
FEKIKVVLRNFAMAGPGLMLYTVLKNFFG

SEQ ID NO: 2817068 - protein, 49 aa, Entamoeba invadens
FEKKYCETKVVWWVILISVLVIIVFLFFTFVAIFLITRTILAHFHQKEV

SEQ ID NO: 2817069 - protein, 28 aa, Entamoeba invadens
FEKLQTHRLYFVIQMLFAFIENNDYVQT

SEQ ID NO: 2817070 - protein, 17 aa, Entamoeba invadens
FEKTMWVYLYTTPHTRQ

SEQ ID NO: 2817071 - protein, 20 aa, Entamoeba invadens
FELFLTPNYTTKINTTIALV

SEQ ID NO: 2817072 - protein, 18 aa, Entamoeba invadens
FELIPNKVYQFRGYDVAN

SEQ ID NO: 2817073 - protein, 26 aa, Entamoeba invadens
FELTFLDVVTVIYFFVNQKNYSEDEN

SEQ ID NO: 2817074 - protein, 18 aa, Entamoeba invadens
FEMFGWCEIYSKNVFNYP

SEQ ID NO: 2817075 - protein, 24 aa, Entamoeba invadens
FEMRCPLDFLLVQLLVACLLEVPF

SEQ ID NO: 2817076 - protein, 19 aa, Entamoeba invadens
FEMTPLLNIVRVSFFMSIR

SEQ ID NO: 2817077 - protein, 18 aa, Entamoeba invadens
FEMYVTLCRANDFPLFCG

SEQ ID NO: 2817078 - protein, 20 aa, Entamoeba invadens
FENIYSYGQIILFGTPGYST

SEQ ID NO: 2817079 - protein, 18 aa, Entamoeba invadens
FENLFYNSKCLATMVLKK

SEQ ID NO: 2817080 - protein, 21 aa, Entamoeba invadens
FENLKKFNESLAEKVKEAKNA

SEQ ID NO: 2817081 - protein, 18 aa, Entamoeba invadens
FENNYSPSKKRIFQILPT

SEQ ID NO: 2817082 - protein, 36 aa, Entamoeba invadens
FENSKEFVLLFFHLYKTLQEFLNNPAPYPLCYKSHG

SEQ ID NO: 2817083 - protein, 26 aa, Entamoeba invadens
FEPAFIFSFAFWWKVGVITLVNALPF

SEQ ID NO: 2817084 - protein, 20 aa, Entamoeba invadens
FEPKLRKLREGLTLKPIAGV

SEQ ID NO: 2817085 - protein, 18 aa, Entamoeba invadens
FEQFVCSKLRVLYKLNWL

SEQ ID NO: 2817086 - protein, 24 aa, Entamoeba invadens
FEQNDVFLKLHNYNYEKFDISCYN

SEQ ID NO: 2817087 - protein, 20 aa, Entamoeba invadens
FEQQLTFYIINVANTLTFSS

SEQ ID NO: 2817088 - protein, 23 aa, Entamoeba invadens
FEQSIWYSLYVNVRIQYLITSTN

SEQ ID NO: 2817089 - protein, 30 aa, Entamoeba invadens
FERNKKVFFINFLVDLATLMDFELVSIVSR

SEQ ID NO: 2817090 - protein, 29 aa, Entamoeba invadens
FERPLFFNFLMFFGMFLALIVYFVITIVK

SEQ ID NO: 2817091 - protein, 29 aa, Entamoeba invadens
FESCNNMMFLHLPATLTTLGEDWIKGVTN

SEQ ID NO: 2817092 - protein, 24 aa, Entamoeba invadens
FESFGWCNAYPKKDFTYPWKIAEF

SEQ ID NO: 2817093 - protein, 18 aa, Entamoeba invadens
FESFNRRINIKAGSLKLG

SEQ ID NO: 2817094 - protein, 33 aa, Entamoeba invadens
FESWSKLLKKVQPWYVTLLRRFIRAEVSQFATT

SEQ ID NO: 2817095 - protein, 18 aa, Entamoeba invadens
FETVPNKDYYIFVAPYNF

SEQ ID NO: 2817096 - protein, 23 aa, Entamoeba invadens
FETYNPIISDWFVRGKEIIIHNT

SEQ ID NO: 2817097 - protein, 20 aa, Entamoeba invadens
FEVFGPPIVVLMLAIVFSIF

SEQ ID NO: 2817098 - protein, 17 aa, Entamoeba invadens
FEVFGWEEPYNKLEFKF

SEQ ID NO: 2817099 - protein, 18 aa, Entamoeba invadens
FEVFIVPLCTSHLTDNIM

SEQ ID NO: 2817100 - protein, 18 aa, Entamoeba invadens
FEVGITCEFLFVVPAFVS

SEQ ID NO: 2817101 - protein, 25 aa, Entamoeba invadens
FEYTRKTMMSFYLSNNILVKNCTFR

SEQ ID NO: 2817102 - protein, 18 aa, Entamoeba invadens
FFAILNRVPEITLCASNV

SEQ ID NO: 2817103 - protein, 27 aa, Entamoeba invadens
FFAISRSLVIKAPFTNAPIKTKGAAQI

SEQ ID NO: 2817104 - protein, 24 aa, Entamoeba invadens
FFATRIVMILMILGSIGLIVTGFF

SEQ ID NO: 2817105 - protein, 23 aa, Entamoeba invadens
FFATWCGPCKSIAPYFEELARKT

SEQ ID NO: 2817106 - protein, 19 aa, Entamoeba invadens
FFCCFQSYSLTWCSSENGT

SEQ ID NO: 2817107 - protein, 23 aa, Entamoeba invadens
FFCCGLSFLFIFFFDRVVATHGG

SEQ ID NO: 2817108 - protein, 18 aa, Entamoeba invadens
FFCLITWVVNLMLFNRSQ

SEQ ID NO: 2817109 - protein, 18 aa, Entamoeba invadens
FFCVLCIYGMLLCLSPPT

SEQ ID NO: 2817110 - protein, 19 aa, Entamoeba invadens
FFDITKYLPGKSANNIFAY

SEQ ID NO: 2817111 - protein, 21 aa, Entamoeba invadens
FFDSFVFYYSYYLLYLIVNSI

SEQ ID NO: 2817112 - protein, 20 aa, Entamoeba invadens
FFEAFAWKDAFGDVKYFFEI

SEQ ID NO: 2817113 - protein, 17 aa, Entamoeba invadens
FFEHFWQRQNSIDKKLS

SEQ ID NO: 2817114 - protein, 21 aa, Entamoeba invadens
FFEMNDFISLFSELLIQRNHF

SEQ ID NO: 2817115 - protein, 22 aa, Entamoeba invadens
FFFALSYSLYWCQSGEDKVECF

SEQ ID NO: 2817116 - protein, 22 aa, Entamoeba invadens
FFFLLVALPLVYMFAPLYNNYL

SEQ ID NO: 2817117 - protein, 21 aa, Entamoeba invadens
FFFQIIFVHFVTAFCGDGVRD

SEQ ID NO: 2817118 - protein, 17 aa, Entamoeba invadens
FFHLILTRPDKLGALYD

SEQ ID NO: 2817119 - protein, 26 aa, Entamoeba invadens
FFIGFYLSTILSLIINVYGCDQVKCD

SEQ ID NO: 2817120 - protein, 19 aa, Entamoeba invadens
FFILFIVFGSLVGVSLFVS

SEQ ID NO: 2817121 - protein, 18 aa, Entamoeba invadens
FFISLSFGCVLHNITLSA

SEQ ID NO: 2817122 - protein, 18 aa, Entamoeba invadens
FFIVCFWIMFVVAILVMC

SEQ ID NO: 2817123 - protein, 38 aa, Entamoeba invadens
FFKKEKWYRDISIYKLSFVLVINFVYFGVELAMGLYLK

SEQ ID NO: 2817124 - protein, 30 aa, Entamoeba invadens
FFKKSPELLDLWKFPIFNVYTMNNNRGLLD

SEQ ID NO: 2817125 - protein, 25 aa, Entamoeba invadens
FFKMCFNVYVLSYSYFRVLDNANVE

SEQ ID NO: 2817126 - protein, 18 aa, Entamoeba invadens
FFLCFVAIACAGAVNETE

SEQ ID NO: 2817127 - protein, 22 aa, Entamoeba invadens
FFLFYITYAVTTKHCYAFDSND

SEQ ID NO: 2817128 - protein, 21 aa, Entamoeba invadens
FFLIFFLYFVCGAVVSLHGLT

SEQ ID NO: 2817129 - protein, 17 aa, Entamoeba invadens
FFLIPSEQLLCQDYSNL

SEQ ID NO: 2817130 - protein, 21 aa, Entamoeba invadens
FFLLYATFFITAYAGKDHIDV

SEQ ID NO: 2817131 - protein, 18 aa, Entamoeba invadens
FFLRVSTSIFENWMSDSD

SEQ ID NO: 2817132 - protein, 17 aa, Entamoeba invadens
FFLVNMFYAFISNFTVQ

SEQ ID NO: 2817133 - protein, 19 aa, Entamoeba invadens
FFLVSVIIIYFFSSPFTIK

SEQ ID NO: 2817134 - protein, 18 aa, Entamoeba invadens
FFMICQNGTFSIFSETGK

SEQ ID NO: 2817135 - protein, 18 aa, Entamoeba invadens
FFNEILRNIKFIKYNRWE

SEQ ID NO: 2817136 - protein, 17 aa, Entamoeba invadens
FFNLIKNCTYYYGFALV

SEQ ID NO: 2817137 - protein, 17 aa, Entamoeba invadens
FFNVLSRLDGVDPLYLY

SEQ ID NO: 2817138 - protein, 17 aa, Entamoeba invadens
FFPFQDFKEQRTKTANP

SEQ ID NO: 2817139 - protein, 17 aa, Entamoeba invadens
FFQNFFSTSRPTSKLRL

SEQ ID NO: 2817140 - protein, 22 aa, Entamoeba invadens
FFRIWVAFIGLLIFLTGLIHLC

SEQ ID NO: 2817141 - protein, 19 aa, Entamoeba invadens
FFSFFGMIDKLAILGIFIS

SEQ ID NO: 2817142 - protein, 17 aa, Entamoeba invadens
FFSLFPALLPQLVVTFL

SEQ ID NO: 2817143 - protein, 39 aa, Entamoeba invadens
FFTWWNTIMQNVSGWLLLAWWFFCVFKLRCHVCGDTCVE

SEQ ID NO: 2817144 - protein, 18 aa, Entamoeba invadens
FFVALIVVVSFIFVIFLV

SEQ ID NO: 2817145 - protein, 18 aa, Entamoeba invadens
FFVFFEESDFIHINPLEI

SEQ ID NO: 2817146 - protein, 35 aa, Entamoeba invadens
FFVIAVFFLCFYWAGLFFVVMFWIAFSVAILVVVA

SEQ ID NO: 2817147 - protein, 23 aa, Entamoeba invadens
FFVLHIALLVFYFVNFRDHPFRP

SEQ ID NO: 2817148 - protein, 21 aa, Entamoeba invadens
FFVLLFLIKSYCQTIENYCQV

SEQ ID NO: 2817149 - protein, 25 aa, Entamoeba invadens
FFYEFVIILCILIETLLFIAHALLS

SEQ ID NO: 2817150 - protein, 21 aa, Entamoeba invadens
FGCLICNNTFYLDELTKQCVS

SEQ ID NO: 2817151 - protein, 18 aa, Entamoeba invadens
FGCLVCKSGYFMNNFTCV

SEQ ID NO: 2817152 - protein, 17 aa, Entamoeba invadens
FGDAANMYALFLALFIV

SEQ ID NO: 2817153 - protein, 26 aa, Entamoeba invadens
FGDIFNVMLQYLPYSDVIGGKLDVYV

SEQ ID NO: 2817154 - protein, 18 aa, Entamoeba invadens
FGDVKFVRTQKSLFKKHY

SEQ ID NO: 2817155 - protein, 25 aa, Entamoeba invadens
FGDYAFMGTKLTTITFPTTAVTTFG

SEQ ID NO: 2817156 - protein, 25 aa, Entamoeba invadens
FGERTVLSLFRFLDKIPVTPYHITL

SEQ ID NO: 2817157 - protein, 43 aa, Entamoeba invadens
FGFDEMITVLTNPLLFILCLIIGGFGFTAYKLGLGGVVTSYMT

SEQ ID NO: 2817158 - protein, 19 aa, Entamoeba invadens
FGFGFLLCCLWLVDYCKYR

SEQ ID NO: 2817159 - protein, 31 aa, Entamoeba invadens
FGFRREEHFFKPLIFGLFSMIFEVYNQLSKI

SEQ ID NO: 2817160 - protein, 18 aa, Entamoeba invadens
FGGHVNIPFMFTVNKTLS

SEQ ID NO: 2817161 - protein, 22 aa, Entamoeba invadens
FGGITFFETFPYILPNIVCACF

SEQ ID NO: 2817162 - protein, 26 aa, Entamoeba invadens
FGGKHSFITLRELFKWADRHASSYEE

SEQ ID NO: 2817163 - protein, 17 aa, Entamoeba invadens
FGGLMKWARSDVSDISV

SEQ ID NO: 2817164 - protein, 27 aa, Entamoeba invadens
FGGSDRYMLLSNYLYTYAYNNINCTSL

SEQ ID NO: 2817165 - protein, 24 aa, Entamoeba invadens
FGGWICPVLSFLASLVLFVYASFS

SEQ ID NO: 2817166 - protein, 18 aa, Entamoeba invadens
FGHSKLFWVGERSQWEDI

SEQ ID NO: 2817167 - protein, 27 aa, Entamoeba invadens
FGIFAMIFAIVYMIIEIYGFFGVENPK

SEQ ID NO: 2817168 - protein, 25 aa, Entamoeba invadens
FGIGNLVIILFLFLPSSILSISSSN

SEQ ID NO: 2817169 - protein, 31 aa, Entamoeba invadens
FGIGVAFYFDWRIALCVIAVTPILITVVFLN

SEQ ID NO: 2817170 - protein, 20 aa, Entamoeba invadens
FGIGVFEWIASLETVNLGGL

SEQ ID NO: 2817171 - protein, 18 aa, Entamoeba invadens
FGIGYWGWSDVAYYSDIV

SEQ ID NO: 2817172 - protein, 24 aa, Entamoeba invadens
FGIIGWELFYMKNAFFDYSNEEEI

SEQ ID NO: 2817173 - protein, 19 aa, Entamoeba invadens
FGIIMWELAHRQKPYEKLK

SEQ ID NO: 2817174 - protein, 34 aa, Entamoeba invadens
FGIKTPISMLCPAKFFTIYYHPVEYQFVQKTATG

SEQ ID NO: 2817175 - protein, 30 aa, Entamoeba invadens
FGILCAIISLIWFCIWVFNWVMALIKAQSQ

SEQ ID NO: 2817176 - protein, 33 aa, Entamoeba invadens
FGITMYEVFGWCKAYPITTFKFPWKIAEFVTAG

SEQ ID NO: 2817177 - protein, 22 aa, Entamoeba invadens
FGIVMWEFLTRDVPYKNVPPQS

SEQ ID NO: 2817178 - protein, 25 aa, Entamoeba invadens
FGKELGYYYFLLQPDGEKFENLDKN

SEQ ID NO: 2817179 - protein, 26 aa, Entamoeba invadens
FGKFLYRFCFFILSERIGLKIRKLYF

SEQ ID NO: 2817180 - protein, 23 aa, Entamoeba invadens
FGKMMWRPHLLPSHVAYTMLKTS

SEQ ID NO: 2817181 - protein, 19 aa, Entamoeba invadens
FGKVYLGLFRGTQVALKIL

SEQ ID NO: 2817182 - protein, 23 aa, Entamoeba invadens
FGLFVSILRWVLLFDLFGSVVYA

SEQ ID NO: 2817183 - protein, 17 aa, Entamoeba invadens
FGLIQQFITYRMDSLDM

SEQ ID NO: 2817184 - protein, 18 aa, Entamoeba invadens
FGLISIWITMAIKVKRFN

SEQ ID NO: 2817185 - protein, 19 aa, Entamoeba invadens
FGLPFAYFTAGIPLSAIAI

SEQ ID NO: 2817186 - protein, 26 aa, Entamoeba invadens
FGLSEGVGYFILKFCFFVVSERQGIK

SEQ ID NO: 2817187 - protein, 24 aa, Entamoeba invadens
FGLTTSPPIWIYDASDFKAQEQKA

SEQ ID NO: 2817188 - protein, 17 aa, Entamoeba invadens
FGLVYKGIYKTNKVAVK

SEQ ID NO: 2817189 - protein, 31 aa, Entamoeba invadens; identical to SEQ ID NO: 2593692

SEQ ID NO: 2817190 - protein, 17 aa, Entamoeba invadens
FGMIFQTLAAFISGYAL

SEQ ID NO: 2817191 - protein, 17 aa, Entamoeba invadens
FGPFCVGGELLLFDGGV

SEQ ID NO: 2817192 - protein, 20 aa, Entamoeba invadens
FGPHQFPEKLIPKFITLLDR

SEQ ID NO: 2817193 - protein, 19 aa, Entamoeba invadens
FGQLLALGNFPEHVVPICF

SEQ ID NO: 2817194 - protein, 26 aa, Entamoeba invadens
FGRKFSVPIRVIVSVGLLIDKWEIIP

SEQ ID NO: 2817195 - protein, 23 aa, Entamoeba invadens
FGSARAISLYKTALTLTKQIGTL

SEQ ID NO: 2817196 - protein, 24 aa, Entamoeba invadens
FGSFSFFIIFPEQCDLLLTASVGK

SEQ ID NO: 2817197 - protein, 26 aa, Entamoeba invadens
FGSIIGFIVVILVLIGIIVLIVKTDK

SEQ ID NO: 2817198 - protein, 27 aa, Entamoeba invadens
FGSIIGFIVVILVLIGIIVLIVKTDKV

SEQ ID NO: 2817199 - protein, 23 aa, Entamoeba invadens
FGSKYIVHFYGAVFIPSKVCMVT

SEQ ID NO: 2817200 - protein, 28 aa, Entamoeba invadens
FGSYNSMTFPIAPKKRYSYLNNDQNFFI

SEQ ID NO: 2817201 - protein, 32 aa, Entamoeba invadens
FGTALLYFIGYIFPLIWMVQLFYIFSKDENTK

SEQ ID NO: 2817202 - protein, 18 aa, Entamoeba invadens
FGTARFTALTAFIDTIDF

SEQ ID NO: 2817203 - protein, 26 aa, Entamoeba invadens
FGTAYGIMTYLILPRAMLALNLTAMF

SEQ ID NO: 2817204 - protein, 25 aa, Entamoeba invadens
FGVEICLVLFSFILSDPTHLYASRG

SEQ ID NO: 2817205 - protein, 23 aa, Entamoeba invadens
FGVGFFKVVPLISVQFFAFDQYK

SEQ ID NO: 2817206 - protein, 20 aa, Entamoeba invadens
FGVLSIGAQLFLFEGGLLVL

SEQ ID NO: 2817207 - protein, 32 aa, Entamoeba invadens
FGVSLFECVTWKEPYPKIRFKFAWDIVDFVAS

SEQ ID NO: 2817208 - protein, 35 aa, Entamoeba invadens
FGVSMYECFIWQRPFLDKGFKYPWNIIKYVTSGER

SEQ ID NO: 2817209 - protein, 30 aa, Entamoeba invadens
FGVTLYECLSWSLAYQPPQFKFPWEIADFV

SEQ ID NO: 2817210 - protein, 25 aa, Entamoeba invadens
FGVTMFECLSWRTAFPKSEYPFSWK

SEQ ID NO: 2817211 - protein, 21 aa, Entamoeba invadens
FGVVYLGYFRGNKVAVKHMRN

SEQ ID NO: 2817212 - protein, 18 aa, Entamoeba invadens
FGVVYQGLYRSQKVAIKK

SEQ ID NO: 2817213 - protein, 17 aa, Entamoeba invadens
FGWCEAYPVKQFKFPWK

SEQ ID NO: 2817214 - protein, 18 aa, Entamoeba invadens
FGWCPIFFVRDYDPSIEE

SEQ ID NO: 2817215 - protein, 25 aa, Entamoeba invadens
FGYHYMLTLFFTFIARFCLIAMSVS

SEQ ID NO: 2817216 - protein, 25 aa, Entamoeba invadens
FHDRFPTLLVLVYNVVLKFYPDELI

SEQ ID NO: 2817217 - protein, 24 aa, Entamoeba invadens
FHFSFITLCCLFSYAVSQTQCEPG

SEQ ID NO: 2817218 - protein, 18 aa, Entamoeba invadens
FHFSPQVVFLRPNTKFCM

SEQ ID NO: 2817219 - protein, 17 aa, Entamoeba invadens
FHGKNLITHFIIGSKDV

SEQ ID NO: 2817220 - protein, 27 aa, Entamoeba invadens
FHGNEDILYYVTPIEQLVFVGQNYSNE

SEQ ID NO: 2817221 - protein, 22 aa, Entamoeba invadens
FHHLTWWEIINIFFFEFTDLDE

SEQ ID NO: 2817222 - protein, 25 aa, Entamoeba invadens
FHLLLRCMRCLDGVKLINIINLKQY

SEQ ID NO: 2817223 - protein, 26 aa, Entamoeba invadens
FHLNSLLLVFYYKNRKRQISAFVVIS

SEQ ID NO: 2817224 - protein, 17 aa, Entamoeba invadens
FHREFITMIQSVNDLSL

SEQ ID NO: 2817225 - protein, 17 aa, Entamoeba invadens
FHRNFIFTRQNLLTKNL

SEQ ID NO: 2817226 - protein, 23 aa, Entamoeba invadens
FHSFVLIVILMVSLTHSVVIGVS

SEQ ID NO: 2817227 - protein, 18 aa, Entamoeba invadens
FHTANLFTIQLLDETKVP

SEQ ID NO: 2817228 - protein, 17 aa, Entamoeba invadens
FHVFPCLKPKDVRKTPL

SEQ ID NO: 2817229 - protein, 18 aa, Entamoeba invadens
FIAGILFVVSIGLTIASL

SEQ ID NO: 2817230 - protein, 26 aa, Entamoeba invadens
FIARAFYQSFGLPLIITRGNNVFGPH

SEQ ID NO: 2817231 - protein, 27 aa, Entamoeba invadens
FIASPAVYFPFVIVVLPVVIVPHMKMI

SEQ ID NO: 2817232 - protein, 30 aa, Entamoeba invadens
FICHGVDTFKYKLVFRPKSGRLKPHREIKI

SEQ ID NO: 2817233 - protein, 18 aa, Entamoeba invadens
FICLVFCGRVILVYYGGY

SEQ ID NO: 2817234 - protein, 24 aa, Entamoeba invadens
FIDEYNRMIVNGEPIFPIGSALDN

SEQ ID NO: 2817235 - protein, 39 aa, Entamoeba invadens
  misc_feature (27)..(28): Xaa can be any naturally occurring amino acid
FIDLFQAIKMIRLDIIFILLALMFGWXXLNCAVVIAQFI

SEQ ID NO: 2817236 - protein, 23 aa, Entamoeba invadens
FIECELFRMYFDLNTISTIEILQ

SEQ ID NO: 2817237 - protein, 17 aa, Entamoeba invadens
FIEEIYFGNKLAFGYKQ

SEQ ID NO: 2817238 - protein, 25 aa, Entamoeba invadens
FIEGKYPKWLMIKSHIIVYIGNFIG

SEQ ID NO: 2817239 - protein, 18 aa, Entamoeba invadens
FIEYDKDTLIKMIKEIGE

SEQ ID NO: 2817240 - protein, 18 aa, Entamoeba invadens
FIFADFFATFSSNDLFFT

SEQ ID NO: 2817241 - protein, 23 aa, Entamoeba invadens
FIFFVFFNVVFSANIICEVGYYV

SEQ ID NO: 2817242 - protein, 22 aa, Entamoeba invadens
FIFFVFFNVVFSANMICEVRYY

SEQ ID NO: 2817243 - protein, 20 aa, Entamoeba invadens
FIFKLNWLRDEDCNLISTIS

SEQ ID NO: 2817244 - protein, 17 aa, Entamoeba invadens
FIFLIIKTRLAQADPII

SEQ ID NO: 2817245 - protein, 18 aa, Entamoeba invadens
FIFVISMIYKSNAEIKCL

SEQ ID NO: 2817246 - protein, 30 aa, Entamoeba invadens
FIGAICKCHFLTIPMFPTAIVFAVLSMILV

SEQ ID NO: 2817247 - protein, 18 aa, Entamoeba invadens
FIGRLLEFIPKTPPTKVI

SEQ ID NO: 2817248 - protein, 26 aa, Entamoeba invadens
FIGVFFFVVFLMFTIGFISVANFKFL

SEQ ID NO: 2817249 - protein, 21 aa, Entamoeba invadens
FIHTNYTWYAVFINDTQYNTW

SEQ ID NO: 2817250 - protein, 17 aa, Entamoeba invadens
FIHVVAFAVKCVERLVS

SEQ ID NO: 2817251 - protein, 50 aa, Entamoeba invadens
FIIDNHSFITTLKFWLLLVWGKCKTLNILFLIVICSGIFILLISITQQNN

SEQ ID NO: 2817252 - protein, 27 aa, Entamoeba invadens
FIIEYKSFWYVLFTNVLHFLAMGIEVV

SEQ ID NO: 2817253 - protein, 19 aa, Entamoeba invadens
FIIFQLLMGILVLIYGFLF

SEQ ID NO: 2817254 - protein, 22 aa, Entamoeba invadens
FIIKMPLLHRIACFRDDVVFVI

SEQ ID NO: 2817255 - protein, 18 aa, Entamoeba invadens
FIILFVAISIALNQFTNP

SEQ ID NO: 2817256 - protein, 25 aa, Entamoeba invadens
FIISTNFGVLLYISNKLAPSYITTN

SEQ ID NO: 2817257 - protein, 26 aa, Entamoeba invadens
FIKFKPYFPFGFLAVDFFFMLSGFLV

SEQ ID NO: 2817258 - protein, 19 aa, Entamoeba invadens
FILKQIPSVSFCEFLLRIH

SEQ ID NO: 2817259 - protein, 19 aa, Entamoeba invadens
FILTDSKQLKWCKYQDSLS

SEQ ID NO: 2817260 - protein, 17 aa, Entamoeba invadens
FIMKTMCGLYNVGTQRG

SEQ ID NO: 2817261 - protein, 17 aa, Entamoeba invadens
FIMTCSEDTFIEGTNTG

SEQ ID NO: 2817262 - protein, 18 aa, Entamoeba invadens
FIMVAYLAIRWKAYLKKR

SEQ ID NO: 2817263 - protein, 27 aa, Entamoeba invadens
FINDNMWILWIMSFMYSFSYVLFWIPI

SEQ ID NO: 2817264 - protein, 26 aa, Entamoeba invadens
FINFVQYAQLLWLLTTAVEFLLAQME

SEQ ID NO: 2817265 - protein, 18 aa, Entamoeba invadens
FINHRLCREYKGVSPYLD

SEQ ID NO: 2817266 - protein, 29 aa, Entamoeba invadens
FIPEDMLRKYSWCLLITNETIKIQCKDGN

SEQ ID NO: 2817267 - protein, 24 aa, Entamoeba invadens
FIQADLRIPLRPQTFFEIMTSRNA

SEQ ID NO: 2817268 - protein, 17 aa, Entamoeba invadens
FIQNMLLYIILQNTQAA

SEQ ID NO: 2817269 - protein, 25 aa, Entamoeba invadens
FIQSGLSAHFLRFAPTALFILYFQM

SEQ ID NO: 2817270 - protein, 27 aa, Entamoeba invadens
FIQTACFADFFMKKIIFTKNASLLANY

SEQ ID NO: 2817271 - protein, 18 aa, Entamoeba invadens
FIQVTYFITIVALPMVHL

SEQ ID NO: 2817272 - protein, 21 aa, Entamoeba invadens
FIQYDPSCTFVNLVFTCLRQL

SEQ ID NO: 2817273 - protein, 17 aa, Entamoeba invadens
FISSFVFMFVEGGMPES

SEQ ID NO: 2817274 - protein, 18 aa, Entamoeba invadens
FISVMYNKWSKKGKKMIV

SEQ ID NO: 2817275 - protein, 18 aa, Entamoeba invadens
FITISRFGNMQFTNALSL

SEQ ID NO: 2817276 - protein, 27 aa, Entamoeba invadens
FITNFITFVILYNNLVPISLYVSMEIV

SEQ ID NO: 2817277 - protein, 17 aa, Entamoeba invadens
FITPNFTTTIDSTIAIV

SEQ ID NO: 2817278 - protein, 23 aa, Entamoeba invadens
FIVLAVIVAIILAVHFSKKDNGN

SEQ ID NO: 2817279 - protein, 23 aa, Entamoeba invadens
FIVMPLALLILLYVVQSPVLLTI

SEQ ID NO: 2817280 - protein, 18 aa, Entamoeba invadens
FIVVQYYVTDILKLLDKS

SEQ ID NO: 2817281 - protein, 23 aa, Entamoeba invadens
FIVVYFVFFILRHKNFKVSFKTA

SEQ ID NO: 2817282 - protein, 20 aa, Entamoeba invadens
FIWEYYCEKVPFFNPVYERV

SEQ ID NO: 2817283 - protein, 24 aa, Entamoeba invadens
FIYKYLRHPSYTGWFYWSVFSQVV

SEQ ID NO: 2817284 - protein, 19 aa, Entamoeba invadens
FIYLVNSYELNCYPVGYNQ

SEQ ID NO: 2817285 - protein, 18 aa, Entamoeba invadens
FKCDTCEGVLLNYQMQQC

SEQ ID NO: 2817286 - protein, 18 aa, Entamoeba invadens
FKCKDYYTGLIDGNGYKC

SEQ ID NO: 2817287 - protein, 24 aa, Entamoeba invadens
FKDCKALFGIPMTNTITTLGDNAF

SEQ ID NO: 2817288 - protein, 30 aa, Entamoeba invadens
FKDFIQCMLRPKIIPYLDACKKDMWINIRN

SEQ ID NO: 2817289 - protein, 39 aa, Entamoeba invadens
FKDNMSVYVFIFSLFDSFQGMLLFLHNNSSLYFDVYDKT

SEQ ID NO: 2817290 - protein, 26 aa, Entamoeba invadens
FKDQIRVFYVFENAIISLIQVPWVEN

SEQ ID NO: 2817291 - protein, 24 aa, Entamoeba invadens
FKEDFAVYFMKKTVLRSTIESQGV

SEQ ID NO: 2817292 - protein, 26 aa, Entamoeba invadens
FKEPSPFAKLKFWKKKEEYEPFGHSE

SEQ ID NO: 2817293 - protein, 35 aa, Entamoeba invadens
FKEWGWCYIFIVVLTLLIVICLLLSGFFIGKRVTN

SEQ ID NO: 2817294 - protein, 18 aa, Entamoeba invadens
FKFAWSIADFITSGKRIV

SEQ ID NO: 2817295 - protein, 20 aa, Entamoeba invadens
FKFLFFNRWNMIVFLIISTA

SEQ ID NO: 2817296 - protein, 17 aa, Entamoeba invadens
FKFLWNIAEFVISGKRL

SEQ ID NO: 2817297 - protein, 17 aa, Entamoeba invadens
FKFPWKIAEFVISGKRL

SEQ ID NO: 2817298 - protein, 18 aa, Entamoeba invadens
FKFPWKIAEFVTSGERMK

SEQ ID NO: 2817299 - protein, 18 aa, Entamoeba invadens
FKFPWKIAEFVTTGERLP

SEQ ID NO: 2817300 - protein, 17 aa, Entamoeba invadens
FKFPWKIVEYVISGERL

SEQ ID NO: 2817301 - protein, 17 aa, Entamoeba invadens
FKFPWNVVDFVLKGNRE

SEQ ID NO: 2817302 - protein, 23 aa, Entamoeba invadens
FKFSNYCAQLIIMKIMTTKDCRC

SEQ ID NO: 2817303 - protein, 31 aa, Entamoeba invadens
FKFYVLAIFVFYIPVALLNFKFFLAESALNF

SEQ ID NO: 2817304 - protein, 30 aa, Entamoeba invadens
FKGFPLGMFITGVTFMFIFFVDRVIVEHSH

SEQ ID NO: 2817305 - protein, 25 aa, Entamoeba invadens
FKGKYRGNIVAIKKMKIGSGDNSQI

SEQ ID NO: 2817306 - protein, 27 aa, Entamoeba invadens
FKGNRPPYREGMSKILYSVIEKAWCMN

SEQ ID NO: 2817307 - protein, 17 aa, Entamoeba invadens
FKGVFRGNSVAVKQMKN

SEQ ID NO: 2817308 - protein, 35 aa, Entamoeba invadens
FKHTQLCLFIQMYSIIFLSLVLSVLSTTSCYVKDE

SEQ ID NO: 2817309 - protein, 20 aa, Entamoeba invadens
FKINYIVLFFIMFLSSFLVS

SEQ ID NO: 2817310 - protein, 18 aa, Entamoeba invadens
FKIPNLSECFVFLGDDFF

SEQ ID NO: 2817311 - protein, 27 aa, Entamoeba invadens
FKKFDFNMLFLIIYSVSVFYFSCVMSR

SEQ ID NO: 2817312 - protein, 24 aa, Entamoeba invadens
FKLKHTNMIFVKMADGLTIHTRNE

SEQ ID NO: 2817313 - protein, 18 aa, Entamoeba invadens
FKLLAGNQLLRYGESNRL

SEQ ID NO: 2817314 - protein, 17 aa, Entamoeba invadens
FKLRLDCEFCDKSCKQC

SEQ ID NO: 2817315 - protein, 19 aa, Entamoeba invadens
FKMELIGSTLVLIENCVLT

SEQ ID NO: 2817316 - protein, 26 aa, Entamoeba invadens
FKMSRSNVIFYKVNDWLVSNKEILIF

SEQ ID NO: 2817317 - protein, 25 aa, Entamoeba invadens
FKPAQFPIFISFLTLISSLSSFTIV

SEQ ID NO: 2817318 - protein, 41 aa, Entamoeba invadens
FKQIGIPIIVIIIVIVIVMITLFCVIIYVFNRHQDNKKTRD

SEQ ID NO: 2817319 - protein, 18 aa, Entamoeba invadens
FKQLYTRNFTNCSTTAFA

SEQ ID NO: 2817320 - protein, 19 aa, Entamoeba invadens
FKQQQPIYYLYINGSSKIE

SEQ ID NO: 2817321 - protein, 18 aa, Entamoeba invadens
FKRMYWRKKFQMSDEIVS

SEQ ID NO: 2817322 - protein, 31 aa, Entamoeba invadens
FKRTRKLFLYLILFVFLSGALTLLTLVLVQP

SEQ ID NO: 2817323 - protein, 25 aa, Entamoeba invadens
FKSISVKMYLSILSPSQFVTQNITN

SEQ ID NO: 2817324 - protein, 19 aa, Entamoeba invadens
FKTLKINWATLPTPSEENS

SEQ ID NO: 2817325 - protein, 28 aa, Entamoeba invadens
FKTMPPATVLVWLLTPSSETTKGITISI

SEQ ID NO: 2817326 - protein, 25 aa, Entamoeba invadens
FKTQKGFLKWFGFSIIIIGVFVCII

SEQ ID NO: 2817327 - protein, 17 aa, Entamoeba invadens
FKVLLEGHLLRYGASDK

SEQ ID NO: 2817328 - protein, 19 aa, Entamoeba invadens
FKVLLEGHLLRYGASNKIY

SEQ ID NO: 2817329 - protein, 18 aa, Entamoeba invadens
FKYAWDIADFISAGNRLV

SEQ ID NO: 2817330 - protein, 28 aa, Entamoeba invadens
FKYSNWVDYILLFVGIFGGLAVGILNPL

SEQ ID NO: 2817331 - protein, 19 aa, Entamoeba invadens
FLAFVVYIIAAMAVLVVCY

SEQ ID NO: 2817332 - protein, 34 aa, Entamoeba invadens
FLAVFFGMFFLFVKPLYNFFFTGPLRIVGNTMKL

SEQ ID NO: 2817333 - protein, 18 aa, Entamoeba invadens
FLAVNSFECSVGCLTPCV

SEQ ID NO: 2817334 - protein, 17 aa, Entamoeba invadens
FLCDPLYYNRFGCIPCP

SEQ ID NO: 2817335 - protein, 19 aa, Entamoeba invadens
FLCLFFVSPVSSHDFESFS

SEQ ID NO: 2817336 - protein, 19 aa, Entamoeba invadens
FLCVVYSFSKKINICKSGY

SEQ ID NO: 2817337 - protein, 18 aa, Entamoeba invadens
FLDLSMKCQTLGELAKRC

SEQ ID NO: 2817338 - protein, 22 aa, Entamoeba invadens
FLEFVKTAQPLFSIFVANHKTI

SEQ ID NO: 2817339 - protein, 17 aa, Entamoeba invadens
FLEVRGQLLGFMSKIFD

SEQ ID NO: 2817340 - protein, 22 aa, Entamoeba invadens
FLFDHYGTRGALIYAFVMGTLG

SEQ ID NO: 2817341 - protein, 31 aa, Entamoeba invadens
FLFFFLLLSKYIFFKKVFFPIYSQIVKRDKY

SEQ ID NO: 2817342 - protein, 27 aa, Entamoeba invadens
FLFFSAIITFFFLFRTSNNTLKYTSNI

SEQ ID NO: 2817343 - protein, 18 aa, Entamoeba invadens
FLFFVVPQLVMVFYALTK

SEQ ID NO: 2817344 - protein, 20 aa, Entamoeba invadens
FLFGIQHEGRCLIADEMGLG

SEQ ID NO: 2817345 - protein, 22 aa, Entamoeba invadens
FLFLCCLFTFSCSMYCGGGQYE

SEQ ID NO: 2817346 - protein, 17 aa, Entamoeba invadens
FLFSNIHADVCFEIDTQ

SEQ ID NO: 2817347 - protein, 19 aa, Entamoeba invadens
FLFSPIPPPFPLLKSKPKK

SEQ ID NO: 2817348 - protein, 19 aa, Entamoeba invadens
FLFTLFNVPISGTEVTELE

SEQ ID NO: 2817349 - protein, 18 aa, Entamoeba invadens
FLFVIAYIFLPFFQAHLS

SEQ ID NO: 2817350 - protein, 18 aa, Entamoeba invadens
FLGMTLCLFIYFFQFYVL

SEQ ID NO: 2817351 - protein, 18 aa, Entamoeba invadens
FLHDNNIIHRDIKGENVL

SEQ ID NO: 2817352 - protein, 18 aa, Entamoeba invadens
FLHHNQIIHRDIKGENVL

SEQ ID NO: 2817353 - protein, 32 aa, Entamoeba invadens
FLHISSLISWIHLLFYLLGVGCGPFLSSMMDY

SEQ ID NO: 2817354 - protein, 21 aa, Entamoeba invadens
FLHLSAFMAIITWMKGGFGQK

SEQ ID NO: 2817355 - protein, 24 aa, Entamoeba invadens
FLHTLRLHWIEFQNKFYVGDGVPF

SEQ ID NO: 2817356 - protein, 23 aa, Entamoeba invadens
FLHTLRLHWVEFQNKFYLGDGVR

SEQ ID NO: 2817357 - protein, 23 aa, Entamoeba invadens
FLIEKFHMILNRISEVLIPKRDI

SEQ ID NO: 2817358 - protein, 25 aa, Entamoeba invadens
FLIERYRECFAVILDYDSIAHVKNP

SEQ ID NO: 2817359 - protein, 25 aa, Entamoeba invadens
FLIKEGLEWFACGLVSFLVSHICNI

SEQ ID NO: 2817360 - protein, 21 aa, Entamoeba invadens
FLILCLLNRTLSVVCNSGQYQ

SEQ ID NO: 2817361 - protein, 17 aa, Entamoeba invadens
FLIMWIAGDITNLLGCI

SEQ ID NO: 2817362 - protein, 18 aa, Entamoeba invadens
FLIQTQCVEFLKMIFKTF

SEQ ID NO: 2817363 - protein, 17 aa, Entamoeba invadens
FLIRTEPTLVTLKKGFA

SEQ ID NO: 2817364 - protein, 18 aa, Entamoeba invadens
FLISFSFSVNPNNRAQKK

SEQ ID NO: 2817365 - protein, 25 aa, Entamoeba invadens
FLKSHPKRVVLQRLPFNFYNPHTAI

SEQ ID NO: 2817366 - protein, 25 aa, Entamoeba invadens
FLLAVRTCLLPVFRKAKSEISEDLR

SEQ ID NO: 2817367 - protein, 24 aa, Entamoeba invadens
FLLFLFFRLIPCVASLTSLNNSKT

SEQ ID NO: 2817368 - protein, 21 aa, Entamoeba invadens
FLLLFCYTTLSIDNWCQRTKN

SEQ ID NO: 2817369 - protein, 26 aa, Entamoeba invadens
FLLLILCCLVIFTPTYPVYSYSTEEH

SEQ ID NO: 2817370 - protein, 18 aa, Entamoeba invadens
FLLLTCSYSFSTVFNFSS

SEQ ID NO: 2817371 - protein, 18 aa, Entamoeba invadens
FLLPNYTCNIEDKIACVC

SEQ ID NO: 2817372 - protein, 19 aa, Entamoeba invadens
FLLTFAQSICVLCCTNYTS

SEQ ID NO: 2817373 - protein, 24 aa, Entamoeba invadens
FLMSKRAFFPLKQNRNFKWTMSQY

SEQ ID NO: 2817374 - protein, 21 aa, Entamoeba invadens
FLNGCILCDNTIPNKCLLCAQ

SEQ ID NO: 2817375 - protein, 25 aa, Entamoeba invadens
FLNGTFNYKWMIKSFDLKTAIDFSK

SEQ ID NO: 2817376 - protein, 19 aa, Entamoeba invadens
FLNWAMFLGMTLCLFIYFF

SEQ ID NO: 2817377 - protein, 18 aa, Entamoeba invadens
FLPIVFPLNDSKLSVRHF

SEQ ID NO: 2817378 - protein, 18 aa, Entamoeba invadens
FLPKTDLVFNLNSKVGTV

SEQ ID NO: 2817379 - protein, 27 aa, Entamoeba invadens
FLPSRWVMKLWPVLIVFTLAEIVTLLI

SEQ ID NO: 2817380 - protein, 29 aa, Entamoeba invadens
FLPTLTTKILPELFLKIPMLIKANNDTFY

SEQ ID NO: 2817381 - protein, 19 aa, Entamoeba invadens
FLRIAFYIGKPYQTFLLLQ

SEQ ID NO: 2817382 - protein, 19 aa, Entamoeba invadens
FLRLKYLKCWRQISLVGGF

SEQ ID NO: 2817383 - protein, 19 aa, Entamoeba invadens
FLRVCQLIYVCFTAKHLSQ

SEQ ID NO: 2817384 - protein, 17 aa, Entamoeba invadens
FLSKLVVFTITFNGNYS

SEQ ID NO: 2817385 - protein, 27 aa, Entamoeba invadens
FLSLFISLSFFIFPTKFALIFTFGNVL

SEQ ID NO: 2817386 - protein, 28 aa, Entamoeba invadens
FLSLPFALLFFVFPINFNLSPTQIAVFA

SEQ ID NO: 2817387 - protein, 27 aa, Entamoeba invadens
FLSLVTTVLFILFTSLSIWDDVLNDMM

SEQ ID NO: 2817388 - protein, 18 aa, Entamoeba invadens
FLSPISKAKTVTALITIL

SEQ ID NO: 2817389 - protein, 32 aa, Entamoeba invadens
FLSTLYAFFHLPLVFFLTTPIPLFTFACLVFA

SEQ ID NO: 2817390 - protein, 18 aa, Entamoeba invadens
FLSYVLSQNNVPMCTSVN

SEQ ID NO: 2817391 - protein, 17 aa, Entamoeba invadens
FLTLQKNRTVVLGFYFF

SEQ ID NO: 2817392 - protein, 19 aa, Entamoeba invadens
FLTPLCSCFIKEKVQLRIF

SEQ ID NO: 2817393 - protein, 19 aa, Entamoeba invadens
FLTTPQRKMAFRLLTITVA

SEQ ID NO: 2817394 - protein, 27 aa, Entamoeba invadens
FLVDVATEFGFLFFTSKMKNKFNRNKI

SEQ ID NO: 2817395 - protein, 18 aa, Entamoeba invadens
FLVDVFPATVVTLRKGRA

SEQ ID NO: 2817396 - protein, 34 aa, Entamoeba invadens
FLVEVVGSYLIFYFVVCIWVFVAHHKLTKDIKQE

SEQ ID NO: 2817397 - protein, 17 aa, Entamoeba invadens
FLVFDNFVTILSDVPRK

SEQ ID NO: 2817398 - protein, 21 aa, Entamoeba invadens
FLVILGMFLESFSFNFLGLAG

SEQ ID NO: 2817399 - protein, 25 aa, Entamoeba invadens
FLVITFSILVIMGSLIYGMILGAIT

SEQ ID NO: 2817400 - protein, 19 aa, Entamoeba invadens
FLVKMTDHFLYSGHLCIVQ

SEQ ID NO: 2817401 - protein, 18 aa, Entamoeba invadens
FLVSLIGFYLIRVRHMSN

SEQ ID NO: 2817402 - protein, 17 aa, Entamoeba invadens
FLVVDKKVLQFALTNDN

SEQ ID NO: 2817403 - protein, 20 aa, Entamoeba invadens
FLVVVLAEDLMLFEDGTLYE

SEQ ID NO: 2817404 - protein, 19 aa, Entamoeba invadens
FLVVYSITDRVLFDELDHF

SEQ ID NO: 2817405 - protein, 19 aa, Entamoeba invadens
FLYDHIYIGFWLKYRFQMA

SEQ ID NO: 2817406 - protein, 18 aa, Entamoeba invadens
FLYTRGFLDFLFDNRVID

SEQ ID NO: 2817407 - protein, 30 aa, Entamoeba invadens
FMENFVGGFPLLFRVLFHLIKDNYLVEYVN

SEQ ID NO: 2817408 - protein, 26 aa, Entamoeba invadens
FMFILIPSLLLTLTTSRWCIVGNKIQ

SEQ ID NO: 2817409 - protein, 20 aa, Entamoeba invadens
FMFSEGAFEVFAFLALFIAF

SEQ ID NO: 2817410 - protein, 18 aa, Entamoeba invadens
FMFVSLHQPTLFVFILPI

SEQ ID NO: 2817411 - protein, 20 aa, Entamoeba invadens
FMGRLRVKMFDSILSQEIGF

SEQ ID NO: 2817412 - protein, 25 aa, Entamoeba invadens
FMKTNDCQLFYITKLNIIKCLTCPP

SEQ ID NO: 2817413 - protein, 20 aa, Entamoeba invadens
FMLDVAMGIMYLHENGILHR

SEQ ID NO: 2817414 - protein, 18 aa, Entamoeba invadens
FMMAFLMEIPITLFLRYL

SEQ ID NO: 2817415 - protein, 17 aa, Entamoeba invadens
FMMYLTVLVLVFNPYVI

SEQ ID NO: 2817416 - protein, 24 aa, Entamoeba invadens
FMNRMISFNFGTAIRLLVKTSSTD

SEQ ID NO: 2817417 - protein, 31 aa, Entamoeba invadens
FMTLSIQGFFCFPMVDYIFFGETSKISTQWK

SEQ ID NO: 2817418 - protein, 17 aa, Entamoeba invadens
FMVAFFVLGYNFINLNT

SEQ ID NO: 2817419 - protein, 17 aa, Entamoeba invadens
FMYEILVEFLYPRGVMK

SEQ ID NO: 2817420 - protein, 18 aa, Entamoeba invadens
FMYFSFDNDHFTGVTVRS

SEQ ID NO: 2817421 - protein, 20 aa, Entamoeba invadens
FMYSFSYVLFWIPIQTSISR

SEQ ID NO: 2817422 - protein, 24 aa, Entamoeba invadens
FNCDQRIFVFGKTKITTLNIKQGC

SEQ ID NO: 2817423 - protein, 30 aa, Entamoeba invadens
FNCQKDNYFLYYIYLIAVVYSIYIIAFFIL

SEQ ID NO: 2817424 - protein, 20 aa, Entamoeba invadens
FNCYSIKTLNLPDSLKMIGS

SEQ ID NO: 2817425 - protein, 18 aa, Entamoeba invadens
FNEDKSVHMFLKGAPEAV

SEQ ID NO: 2817426 - protein, 20 aa, Entamoeba invadens
FNEFVYDIYFNEFTPDFLEH

SEQ ID NO: 2817427 - protein, 17 aa, Entamoeba invadens
FNEILRNIKFIKYNRWE

SEQ ID NO: 2817428 - protein, 25 aa, Entamoeba invadens
FNEKMPLKFLPLFRVEHVRVCAIPK

SEQ ID NO: 2817429 - protein, 25 aa, Entamoeba invadens
FNEKTPTFALLYPALNVAINQCVSK

SEQ ID NO: 2817430 - protein, 17 aa, Entamoeba invadens
FNELKVCLECEKGYYLN

SEQ ID NO: 2817431 - protein, 28 aa, Entamoeba invadens
FNELVSFTPPFDPLTFTENFRTSGPVSA

SEQ ID NO: 2817432 - protein, 23 aa, Entamoeba invadens
FNESVWFLTIEVIVGFYGVFDKD

SEQ ID NO: 2817433 - protein, 17 aa, Entamoeba invadens
FNFAFPQEKFEYPWKIA

SEQ ID NO: 2817434 - protein, 17 aa, Entamoeba invadens
FNFAMFIKSIEDEVLAF

SEQ ID NO: 2817435 - protein, 26 aa, Entamoeba invadens
FNFGAFLFWIVVPLIATRQGASNLDL

SEQ ID NO: 2817436 - protein, 27 aa, Entamoeba invadens
FNGKLWPPGFMSFFTMAPFISANFQVH

SEQ ID NO: 2817437 - protein, 27 aa, Entamoeba invadens
FNGLILPAILYIFWQIVYLIITEGFKK

SEQ ID NO: 2817438 - protein, 19 aa, Entamoeba invadens
FNGQEFGMLYDVVGYIKSG

SEQ ID NO: 2817439 - protein, 24 aa, Entamoeba invadens
FNGTIFKFTFGTFIAYPNMTNSVN

SEQ ID NO: 2817440 - protein, 17 aa, Entamoeba invadens
FNGYLYNSTMCVKCNEI

SEQ ID NO: 2817441 - protein, 21 aa, Entamoeba invadens
FNIFAYCFIGDVVGILLSEEA

SEQ ID NO: 2817442 - protein, 34 aa, Entamoeba invadens
FNIHYEIIVFVLLTVLFFFIRTYSFTKLKVTFEE

SEQ ID NO: 2817443 - protein, 32 aa, Entamoeba invadens
FNISVIVFFYIFFLLYVLIIFEFYKNGKGTKK

SEQ ID NO: 2817444 - protein, 19 aa, Entamoeba invadens
FNKARILMFDANKTPLIVQ

SEQ ID NO: 2817445 - protein, 17 aa, Entamoeba invadens
FNKITIPTTNTLVINKL

SEQ ID NO: 2817446 - protein, 26 aa, Entamoeba invadens
FNKMFFSSYSFLDYYIRKSSVFFLVY

SEQ ID NO: 2817447 - protein, 26 aa, Entamoeba invadens
FNMKRSNILMIPLCDSLCTNKEILKF

SEQ ID NO: 2817448 - protein, 17 aa, Entamoeba invadens
FNMKRSNIPMFSLCDSL

SEQ ID NO: 2817449 - protein, 18 aa, Entamoeba invadens
FNMLITNMTFTKGIGTPK

SEQ ID NO: 2817450 - protein, 18 aa, Entamoeba invadens
FNMLSFLHISSLISWIHL

SEQ ID NO: 2817451 - protein, 43 aa, Entamoeba invadens
FNMRGVNVVLVPRKWRKTKDKVLLGFLYVGLLCTGVLATMYVV

SEQ ID NO: 2817452 - protein, 26 aa, Entamoeba invadens
FNNKKYFILLLLYNTLMSSFVVFINS

SEQ ID NO: 2817453 - protein, 23 aa, Entamoeba invadens
FNNNQCEYSYYYCNTIISNCVGC

SEQ ID NO: 2817454 - protein, 24 aa, Entamoeba invadens
FNNTIYFSRFLGIVNSNPVYSKID

SEQ ID NO: 2817455 - protein, 25 aa, Entamoeba invadens
FNNVKNSIFIYKNSTFFKTNETRIS

SEQ ID NO: 2817456 - protein, 19 aa, Entamoeba invadens
FNNVTHLCDGCELGMIYTT

SEQ ID NO: 2817457 - protein, 20 aa, Entamoeba invadens
FNQNIKLFIGEKYGFSCTNN

SEQ ID NO: 2817458 - protein, 19 aa, Entamoeba invadens
FNQPWMIPQFVIEGNRLDK

SEQ ID NO: 2817459 - protein, 28 aa, Entamoeba invadens
FNSFSIVLLVLFFLLNKELLPELQNEEL

SEQ ID NO: 2817460 - protein, 17 aa, Entamoeba invadens
FNSLHVVKPISFGPNIK

SEQ ID NO: 2817461 - protein, 18 aa, Entamoeba invadens
FNSWGIIGIMIIFAIAVL

SEQ ID NO: 2817462 - protein, 19 aa, Entamoeba invadens
FNTLKKLFILIPEMDYKQY

SEQ ID NO: 2817463 - protein, 20 aa, Entamoeba invadens
FNTLLAYILFLIAAALCLLH

SEQ ID NO: 2817464 - protein, 17 aa, Entamoeba invadens
FNTMYSYSSRRVCGETI

SEQ ID NO: 2817465 - protein, 35 aa, Entamoeba invadens
FNTNGILRMMDQTNLWTTFLSLKNSSELFISGQSI

SEQ ID NO: 2817466 - protein, 18 aa, Entamoeba invadens
FNTVNFQNNTFFLMSNSE

SEQ ID NO: 2817467 - protein, 25 aa, Entamoeba invadens
FNVAVTLIILLLSSLVRSNTSKCSS

SEQ ID NO: 2817468 - protein, 33 aa, Entamoeba invadens
FNVDQFKPICSFLNFIIPLIPQNVSLSFFVWYL

SEQ ID NO: 2817469 - protein, 19 aa, Entamoeba invadens
FNVLFISKKIQIDGVVFTL

SEQ ID NO: 2817470 - protein, 20 aa, Entamoeba invadens
FNVSCVIYTILIVQLVHKLQ

SEQ ID NO: 2817471 - protein, 30 aa, Entamoeba invadens
FNYITYFIQMLFFVLFITLSFAEETLKTSK

SEQ ID NO: 2817472 - protein, 23 aa, Entamoeba invadens
FPEHVVPICFNWPSGKHSFSKHK

SEQ ID NO: 2817473 - protein, 25 aa, Entamoeba invadens
FPEKLIPKFITLLDRGMNCSIHGNG

SEQ ID NO: 2817474 - protein, 25 aa, Entamoeba invadens
FPENTKIRICNLLGMYLNATETNLR

SEQ ID NO: 2817475 - protein, 17 aa, Entamoeba invadens
FPFQLPTWKLTFFYCWE

SEQ ID NO: 2817476 - protein, 19 aa, Entamoeba invadens
FPGQVAYYFSILQLKIING

SEQ ID NO: 2817477 - protein, 19 aa, Entamoeba invadens
FPIAYWSEFYSIAPAIAVA

SEQ ID NO: 2817478 - protein, 28 aa, Entamoeba invadens
FPIEDVVLYFITYLKNMKPKLFKKEDIE

SEQ ID NO: 2817479 - protein, 19 aa, Entamoeba invadens
FPISFNCWCPSCACGRKCK

SEQ ID NO: 2817480 - protein, 31 aa, Entamoeba invadens
FPKNRIIFLVSVIFPFVGYYGLFALTTNNRR

SEQ ID NO: 2817481 - protein, 30 aa, Entamoeba invadens
FPLCYSAFPYTASLRSFFAYFKHNNMITKS

SEQ ID NO: 2817482 - protein, 20 aa, Entamoeba invadens
FPLIPYIPFFLSKNRTKLFQ

SEQ ID NO: 2817483 - protein, 26 aa, Entamoeba invadens
FPLNQYLPFFILMLSGMVCALLIFVT

SEQ ID NO: 2817484 - protein, 19 aa, Entamoeba invadens
FPMKIPIFEFCGKKELFDS

SEQ ID NO: 2817485 - protein, 22 aa, Entamoeba invadens
FPMTTINNLYLSNVLFGQIPKP

SEQ ID NO: 2817486 - protein, 18 aa, Entamoeba invadens
FPNAKKLVLLLPGEENKD

SEQ ID NO: 2817487 - protein, 18 aa, Entamoeba invadens
FPNFKQYIDMSFDKRMKE

SEQ ID NO: 2817488 - protein, 22 aa, Entamoeba invadens
FPNPVNILTYKQPSTTTPKLIS

SEQ ID NO: 2817489 - protein, 25 aa, Entamoeba invadens
FPQHIVPFVFNWPSSQNAACYYCAA

SEQ ID NO: 2817490 - protein, 24 aa, Entamoeba invadens
FPQNILYRYISCPNLLFEALFFTA

SEQ ID NO: 2817491 - protein, 31 aa, Entamoeba invadens
FPRLCLTAFLFNFASYFYWLVVPLMCVDQGG

SEQ ID NO: 2817492 - protein, 17 aa, Entamoeba invadens
FPRWLFVGDITGPARTA

SEQ ID NO: 2817493 - protein, 24 aa, Entamoeba invadens
FPSAQWVLYVLFGMIMKEISVLSD

SEQ ID NO: 2817494 - protein, 24 aa, Entamoeba invadens
FPSSKFYYFIVVAIIKEYADDIID

SEQ ID NO: 2817495 - protein, 33 aa, Entamoeba invadens
FPTYRYYIFCITFLFCLLLLVVFYPYFLLHVFG

SEQ ID NO: 2817496 - protein, 17 aa, Entamoeba invadens
FPVVAWVATYLMYRYRV

SEQ ID NO: 2817497 - protein, 19 aa, Entamoeba invadens
FPVYPLLFNTVRSVFLKSS

SEQ ID NO: 2817498 - protein, 25 aa, Entamoeba invadens
FQADGCFDLFGYIYSYELDETETSK

SEQ ID NO: 2817499 - protein, 19 aa, Entamoeba invadens
FQCGTNCKLLMNKFSIIKA

SEQ ID NO: 2817500 - protein, 18 aa, Entamoeba invadens
FQCILCNTGYFVQDGVCY

SEQ ID NO: 2817501 - protein, 32 aa, Entamoeba invadens
FQEESHFWARYFKLLFVLSKREKDFQKFIHTR

SEQ ID NO: 2817502 - protein, 19 aa, Entamoeba invadens
FQFFVGTIFIFSSGSMLCV

SEQ ID NO: 2817503 - protein, 17 aa, Entamoeba invadens
FQFPWKVAEFVSGGRRL

SEQ ID NO: 2817504 - protein, 32 aa, Entamoeba invadens
FQGCTKLKYLINSKYITIILSYAFDGCVNLHD

SEQ ID NO: 2817505 - protein, 33 aa, Entamoeba invadens
FQIRCVSPVMQIVRPLGVIRLWGAQIVNRDISQ

SEQ ID NO: 2817506 - protein, 23 aa, Entamoeba invadens
FQIVVRMHFLLFVLFEDFTEFVN

SEQ ID NO: 2817507 - protein, 19 aa, Entamoeba invadens
FQKDGFLFGIQHEGRCLIA

SEQ ID NO: 2817508 - protein, 17 aa, Entamoeba invadens
FQKNYQQILLTRPTRKT

SEQ ID NO: 2817509 - protein, 40 aa, Entamoeba invadens
FQKSSHRILFIFLIKMFFEDRFLIFYKNKTNRINFKKYFP

SEQ ID NO: 2817510 - protein, 36 aa, Entamoeba invadens
FQLDVLRTMLRRILRMFLYFHPHGYFQGLNDIVSIA

SEQ ID NO: 2817511 - protein, 25 aa, Entamoeba invadens
FQLFYSSFSFFCEKGNYLGADNECH

SEQ ID NO: 2817512 - protein, 25 aa, Entamoeba invadens
FQMKKSNIHFFKINEWLVSNRKVLE

SEQ ID NO: 2817513 - protein, 24 aa, Entamoeba invadens
FQMSFCVIFTVLVLFFVVVCVVVG

SEQ ID NO: 2817514 - protein, 36 aa, Entamoeba invadens
FQNIEPLLESFLFPGKFLYDNILPPKTSFDQLNEEL

SEQ ID NO: 2817515 - protein, 23 aa, Entamoeba invadens
FQNNKCLLCSPYCTTNKCDTVQG

SEQ ID NO: 2817516 - protein, 17 aa, Entamoeba invadens
FQWSIEGSFISLGEDDI

SEQ ID NO: 2817517 - protein, 17 aa, Entamoeba invadens
FRAIFRQEWMQFVLIYF

SEQ ID NO: 2817518 - protein, 32 aa, Entamoeba invadens
FRAIKKRNFDVVKMLLLLGADPFVNCKKWTPY

SEQ ID NO: 2817519 - protein, 37 aa, Entamoeba invadens
FRAWELVHLYFTGFFRALFYMVTIDVGPMMAILMFVA

SEQ ID NO: 2817520 - protein, 23 aa, Entamoeba invadens
FRCDQIIHFFGSVRMPKIIGMVI

SEQ ID NO: 2817521 - protein, 17 aa, Entamoeba invadens
FRCDYIIHFYGACVIKS

SEQ ID NO: 2817522 - protein, 26 aa, Entamoeba invadens
FRCDYIVHFYGAVFFPNKICMVTEFA

SEQ ID NO: 2817523 - protein, 19 aa, Entamoeba invadens
FRCDYIVHFYGAVFIPTKI

SEQ ID NO: 2817524 - protein, 17 aa, Entamoeba invadens
FRCEATTACWFTSQYLV

SEQ ID NO: 2817525 - protein, 19 aa, Entamoeba invadens
FRCEYIVHFYGAVFIPSKF

SEQ ID NO: 2817526 - protein, 23 aa, Entamoeba invadens
FRCEYIVHFYGAVFIPSKVCMVT

SEQ ID NO: 2817527 - protein, 18 aa, Entamoeba invadens
FRCEYIVHFYGAVFIPTK

SEQ ID NO: 2817528 - protein, 26 aa, Entamoeba invadens
FRCEYIVHFYGAVLIPSKMCLVTEFA

SEQ ID NO: 2817529 - protein, 24 aa, Entamoeba invadens
FRCKYLLLLMTFLLAMTAFVLYYQ

SEQ ID NO: 2817530 - protein, 25 aa, Entamoeba invadens
FRDYNRLRFRIFDNAIFEMEQNTEL

SEQ ID NO: 2817531 - protein, 37 aa, Entamoeba invadens
FRFEFSIIVLALYQIIAILVLILLAVYQPFLELEVAN

SEQ ID NO: 2817532 - protein, 18 aa, Entamoeba invadens
FRFVAFSVAMESCNMMLL

SEQ ID NO: 2817533 - protein, 17 aa, Entamoeba invadens
FRGLTVYQIFVSTFSDG

SEQ ID NO: 2817534 - protein, 18 aa, Entamoeba invadens
FRKEVFQLINRKLQKKGS

SEQ ID NO: 2817535 - protein, 38 aa, Entamoeba invadens
FRKSTFPFLICCILFWGINIVFIVYFAKKRNSTKYLIN

SEQ ID NO: 2817536 - protein, 25 aa, Entamoeba invadens
FRNLIIVYLITFMSIDYSMLVDLTF

SEQ ID NO: 2817537 - protein, 28 aa, Entamoeba invadens
FRPHFYALVMPIVKVLDFLLFTRIKDEI

SEQ ID NO: 2817538 - protein, 33 aa, Entamoeba invadens
FRQEWMQFVLIYFTTAIYELFALAFPLMSSFII

SEQ ID NO: 2817539 - protein, 29 aa, Entamoeba invadens
FRRWHQKVPFFWTYKPYYEPRTLRMPMSD

SEQ ID NO: 2817540 - protein, 20 aa, Entamoeba invadens
FRSCMNFIVWAIPPAVSFAT

SEQ ID NO: 2817541 - protein, 26 aa, Entamoeba invadens
FRSCMNFIVWAIPPTVSFVTYLILII

SEQ ID NO: 2817542 - protein, 17 aa, Entamoeba invadens
FRSEYIVHFYGAVFIEN

SEQ ID NO: 2817543 - protein, 25 aa, Entamoeba invadens
FRSEYIVHFYGAVFVALKKCMVTEF

SEQ ID NO: 2817544 - protein, 24 aa, Entamoeba invadens
FRSEYIVHFYGAVFVPSKTCMVTE

SEQ ID NO: 2817545 - protein, 28 aa, Entamoeba invadens
FRSLSSGNIFWVKAPQNKGNKLVIYEFN

SEQ ID NO: 2817546 - protein, 23 aa, Entamoeba invadens
FRVEWKHLLLCYGCLLFSQITTL

SEQ ID NO: 2817547 - protein, 32 aa, Entamoeba invadens
FSDCGHGFFIFLFGLSFIIFAKKLQGKAMNDI

SEQ ID NO: 2817548 - protein, 28 aa, Entamoeba invadens
FSEFKNIYFQINVFSFVAKLFSIFLTNS

SEQ ID NO: 2817549 - protein, 27 aa, Entamoeba invadens
FSESSLKFIFYGITQQKYQISFSPSRG

SEQ ID NO: 2817550 - protein, 25 aa, Entamoeba invadens
FSETVALVYKIIGGVGMLALVIVAI

SEQ ID NO: 2817551 - protein, 26 aa, Entamoeba invadens
FSEVVKHFLLCPKLLAAIVTPDFVVP

SEQ ID NO: 2817552 - protein, 40 aa, Entamoeba invadens
FSFAISMYEVFIWKDPFPKDKFIFPWSIADFISAGKRFER

SEQ ID NO: 2817553 - protein, 27 aa, Entamoeba invadens
FSFAITMYETFTWKEPYPKSEFKFAWC

SEQ ID NO: 2817554 - protein, 25 aa, Entamoeba invadens
FSFDLTHNFVFPTTITKIRNHNIWY

SEQ ID NO: 2817555 - protein, 53 aa, Entamoeba invadens
FSFEVFGPAIWILTTAILFSIFTIIVPFLLPELIILFCVMMTMTIVLWVAVIV

SEQ ID NO: 2817556 - protein, 20 aa, Entamoeba invadens
FSFGVTMYEVFGWTNAYPLD

SEQ ID NO: 2817557 - protein, 19 aa, Entamoeba invadens
FSFGVTMYEVFGWTNVYPL

SEQ ID NO: 2817558 - protein, 17 aa, Entamoeba invadens
FSFLSIDPNIVFDSFIK

SEQ ID NO: 2817559 - protein, 37 aa, Entamoeba invadens
FSFLSVFLVFFSFIPLYYRFFVFIVRFSEQEILTPNN

SEQ ID NO: 2817560 - protein, 25 aa, Entamoeba invadens
FSFLVGLFLLFITLPLTGIYSTKPI

SEQ ID NO: 2817561 - protein, 18 aa, Entamoeba invadens
FSFNFLGLAGWAFDILNF

SEQ ID NO: 2817562 - protein, 25 aa, Entamoeba invadens
FSFVAKLFSIFLTNSGIKRKHATVH

SEQ ID NO: 2817563 - protein, 21 aa, Entamoeba invadens
FSFVLCFTLPCIFQYLSRRKA

SEQ ID NO: 2817564 - protein, 17 aa, Entamoeba invadens
FSFWISVTVYFYDGLLL

SEQ ID NO: 2817565 - protein, 18 aa, Entamoeba invadens
FSGECDVGYFPFDNYCWS

SEQ ID NO: 2817566 - protein, 22 aa, Entamoeba invadens
FSGHFLIIFLEQVVIQNRSVVF

SEQ ID NO: 2817567 - protein, 19 aa, Entamoeba invadens
FSGNFVIFADFISAKTLSN

SEQ ID NO: 2817568 - protein, 21 aa, Entamoeba invadens
FSHEYIMCTLGLIGGIGGGAI

SEQ ID NO: 2817569 - protein, 28 aa, Entamoeba invadens
FSIAPLQYFQLVHILKFRMGFISSIRTQ

SEQ ID NO: 2817570 - protein, 17 aa, Entamoeba invadens
FSIIFLINIFVPGKSPR

SEQ ID NO: 2817571 - protein, 18 aa, Entamoeba invadens
FSIRVFSLTCRLIDCLKI

SEQ ID NO: 2817572 - protein, 35 aa, Entamoeba invadens
FSIYNHIPFFIVIAPLLVFILSLFIATDDFPHMYY

SEQ ID NO: 2817573 - protein, 17 aa, Entamoeba invadens
FSKIFYSLLIQFDPNIP

SEQ ID NO: 2817574 - protein, 26 aa, Entamoeba invadens
FSKKRSWFHLLPIVLFMTLLLFCLFC

SEQ ID NO: 2817575 - protein, 25 aa, Entamoeba invadens
FSKNKYLMIIFHTPNSPKYVFYFDP

SEQ ID NO: 2817576 - protein, 25 aa, Entamoeba invadens
FSKNKYMMIIFHVPQSPKYTFYFDP

SEQ ID NO: 2817577 - protein, 21 aa, Entamoeba invadens
FSKQFLVLRQINFTDENFIFD

SEQ ID NO: 2817578 - protein, 25 aa, Entamoeba invadens
FSKSNACFKCLIGYSLQGITCEYKE

SEQ ID NO: 2817579 - protein, 24 aa, Entamoeba invadens
FSKTKIIPLQCQTNYIFETTSNQC

SEQ ID NO: 2817580 - protein, 20 aa, Entamoeba invadens
FSLFLVIVALAIVGGSAFAG

SEQ ID NO: 2817581 - protein, 17 aa, Entamoeba invadens
FSLFSVATKSFDNCQPG

SEQ ID NO: 2817582 - protein, 19 aa, Entamoeba invadens
FSLICYFNCIRYPFMNFGY

SEQ ID NO: 2817583 - protein, 17 aa, Entamoeba invadens
FSMFFYNPLPIKNTKIF

SEQ ID NO: 2817584 - protein, 19 aa, Entamoeba invadens
FSMKCSNLFYGCYSCDYKQ

SEQ ID NO: 2817585 - protein, 34 aa, Entamoeba invadens
FSMKLIFQIMMLVIGLFLLIFVSGLIPYAIDSYS

SEQ ID NO: 2817586 - protein, 39 aa, Entamoeba invadens
FSMMCSGVISLICFFSAFFFDQVLLYAVSVLSCLTFCVF

SEQ ID NO: 2817587 - protein, 31 aa, Entamoeba invadens
FSMSEAFPIEQFPFPWKIAEFVTAGNRLKKT

SEQ ID NO: 2817588 - protein, 19 aa, Entamoeba invadens
FSNFYILNFLTQIGNTMTI

SEQ ID NO: 2817589 - protein, 26 aa, Entamoeba invadens
FSNIDQRYWIVYRRQSNMPYSPYFFI

SEQ ID NO: 2817590 - protein, 21 aa, Entamoeba invadens
FSNLLYKMWKPTREPTVISMS

SEQ ID NO: 2817591 - protein, 49 aa, Entamoeba invadens
FSNTNYGLVIVLPVVIVFLSILGIVMVVIIILVILRKHQEVSKMRNICV

SEQ ID NO: 2817592 - protein, 19 aa, Entamoeba invadens
FSPIELFKVARTTLLKEVC

SEQ ID NO: 2817593 - protein, 17 aa, Entamoeba invadens
FSPLLPILIAIYPQAFP

SEQ ID NO: 2817594 - protein, 25 aa, Entamoeba invadens
FSPNNFEIEWLAKRIGYKGGECDGG

SEQ ID NO: 2817595 - protein, 24 aa, Entamoeba invadens
FSPVILTLLWLIVAFFHVVGVFCK

SEQ ID NO: 2817596 - protein, 25 aa, Entamoeba invadens
FSQGDLKLYLLVGGKLRDMTVLRRI

SEQ ID NO: 2817597 - protein, 23 aa, Entamoeba invadens
FSQKYTFYFNDVKFIKNPVAVED

SEQ ID NO: 2817598 - protein, 17 aa, Entamoeba invadens
FSQYLKDYLEFIQATQN

SEQ ID NO: 2817599 - protein, 26 aa, Entamoeba invadens
FSRLVYICDFFLISFTLFYWAHDFTN

SEQ ID NO: 2817600 - protein, 19 aa, Entamoeba invadens
FSRVTPFWLSLAKEVMMTN

SEQ ID NO: 2817601 - protein, 24 aa, Entamoeba invadens
FSSGSFLLYIYDSASIGYQFTTKI

SEQ ID NO: 2817602 - protein, 24 aa, Entamoeba invadens
FSSNYEYYVLLLLKDGVGGQYKLN

SEQ ID NO: 2817603 - protein, 24 aa, Entamoeba invadens
FSTIGYLMLINYYLDYASADTLMV

SEQ ID NO: 2817604 - protein, 19 aa, Entamoeba invadens
FSTVFRGISAGIILGGGID

SEQ ID NO: 2817605 - protein, 19 aa, Entamoeba invadens
FSTWYMKCLEWIGGNLPIV

SEQ ID NO: 2817606 - protein, 26 aa, Entamoeba invadens
FSVDFDTICSLPIDKPSRDLLCVGNN

SEQ ID NO: 2817607 - protein, 19 aa, Entamoeba invadens
FSVFLLIAASLAAYPVDLQ

SEQ ID NO: 2817608 - protein, 17 aa, Entamoeba invadens
FSVGLFGVYFSFLTGFL

SEQ ID NO: 2817609 - protein, 24 aa, Entamoeba invadens
FSVMKGCDYYTIRTEPALVNLKSG

SEQ ID NO: 2817610 - protein, 33 aa, Entamoeba invadens
FSVTPFPGINFVQWMFCLFLSAMSLVVGQFAIR

SEQ ID NO: 2817611 - protein, 23 aa, Entamoeba invadens
FSVVACEIGYYTFNGTCHKCSDK

SEQ ID NO: 2817612 - protein, 25 aa, Entamoeba invadens
FSWKDAYPITTFKFPWKIAEFVSSG

SEQ ID NO: 2817613 - protein, 23 aa, Entamoeba invadens
FSWKEAYLIKDFKFPWKIAEFVT

SEQ ID NO: 2817614 - protein, 29 aa, Entamoeba invadens
FSWTKAYADHKFVYPWQVADFVVGGQRLQ

SEQ ID NO: 2817615 - protein, 36 aa, Entamoeba invadens
FSYGITLYEVMNWGGLYPLDQFPFPWSVAEFVNQGK

SEQ ID NO: 2817616 - protein, 25 aa, Entamoeba invadens
FSYLMCILICFFTSFFGCCCIGLIF

SEQ ID NO: 2817617 - protein, 17 aa, Entamoeba invadens
FTAAYLFDSIKNSQIIV

SEQ ID NO: 2817618 - protein, 25 aa, Entamoeba invadens
FTALCEWEMFGFGLVVNAIQPLEKY

SEQ ID NO: 2817619 - protein, 24 aa, Entamoeba invadens
FTCEKCVKGYYLDIDKCKQCDSKC

SEQ ID NO: 2817620 - protein, 24 aa, Entamoeba invadens
FTCEPLGDLFTKCALTLPTGGGCA

SEQ ID NO: 2817621 - protein, 26 aa, Entamoeba invadens
FTCEPLGDLFTKCDLTLPTGGGCAIC

SEQ ID NO: 2817622 - protein, 27 aa, Entamoeba invadens
FTCEPLGDLFTKCDLTLPTGGGCAICK

SEQ ID NO: 2817623 - protein, 26 aa, Entamoeba invadens
FTCEPLGDLFTKCDLTLPTGGGCAVC

SEQ ID NO: 2817624 - protein, 26 aa, Entamoeba invadens
FTCEPLGDLFTKCELTLPTGGGCAIC

SEQ ID NO: 2817625 - protein, 21 aa, Entamoeba invadens
FTCNSMYFLDNGKCFRCNSAI

SEQ ID NO: 2817626 - protein, 17 aa, Entamoeba invadens
FTCSSGCQSTCIANYTC

SEQ ID NO: 2817627 - protein, 31 aa, Entamoeba invadens; identical to SEQ ID NO: 2791287

SEQ ID NO: 2817628 - protein, 38 aa, Entamoeba invadens
FTDNNYGLIVGIPIMCVVVMVVVIIATVIIVVLIVFKK

SEQ ID NO: 2817629 - protein, 30 aa, Entamoeba invadens
FTDTQQRMIFLWMVWLVMNQHTTVFGFNAS

SEQ ID NO: 2817630 - protein, 23 aa, Entamoeba invadens
FTDYRNFLFCYPTELCLGKERKR

SEQ ID NO: 2817631 - protein, 29 aa, Entamoeba invadens
FTEFRRYMRLYPRMSLLVNTFYAIFDDTV

SEQ ID NO: 2817632 - protein, 19 aa, Entamoeba invadens
FTEHGIIVFMLALIAHVVC

SEQ ID NO: 2817633 - protein, 31 aa, Entamoeba invadens
FTEVKRLLLIYNTPLFITFDKSTIRPMHRCD

SEQ ID NO: 2817634 - protein, 25 aa, Entamoeba invadens
FTEWDCTNTYYLNKKIFKCTNTNVA

SEQ ID NO: 2817635 - protein, 17 aa, Entamoeba invadens
FTFIPFDTIPLVTLLLS

SEQ ID NO: 2817636 - protein, 18 aa, Entamoeba invadens
FTFNIKQYNMILSIIIVI

SEQ ID NO: 2817637 - protein, 18 aa, Entamoeba invadens
FTFPLLTTHLIYSPKNDF

SEQ ID NO: 2817638 - protein, 21 aa, Entamoeba invadens
FTFVPAFSIAFVGNYMKHNYV

SEQ ID NO: 2817639 - protein, 20 aa, Entamoeba invadens
FTGDLFIETALFSLYDSSVI

SEQ ID NO: 2817640 - protein, 23 aa, Entamoeba invadens
FTGNYELFKLYKPPNEVKDIVWM

SEQ ID NO: 2817641 - protein, 28 aa, Entamoeba invadens
FTGRVVSVPFLLTLSYKDLTVKNIEKVI

SEQ ID NO: 2817642 - protein, 19 aa, Entamoeba invadens
FTHFNFPSLKAIHVSLRKS

SEQ ID NO: 2817643 - protein, 21 aa, Entamoeba invadens
FTIENAYMWLSQQPLVDHPCH

SEQ ID NO: 2817644 - protein, 18 aa, Entamoeba invadens
FTIFTAFSNDCNPPVENC

SEQ ID NO: 2817645 - protein, 17 aa, Entamoeba invadens
FTIGVLGALGGGLVMQF

SEQ ID NO: 2817646 - protein, 17 aa, Entamoeba invadens
FTILYFGFYYTNFPNSW

SEQ ID NO: 2817647 - protein, 18 aa, Entamoeba invadens
FTIRKYLLLTPSGYGEML

SEQ ID NO: 2817648 - protein, 28 aa, Entamoeba invadens
FTITIISLLILPLTFFKNLSALRFSSFL

SEQ ID NO: 2817649 - protein, 20 aa, Entamoeba invadens
FTIVVVLSFIPFICIFTYKT

SEQ ID NO: 2817650 - protein, 19 aa, Entamoeba invadens
FTKDLFLTHAYKALEMFAK

SEQ ID NO: 2817651 - protein, 19 aa, Entamoeba invadens
FTKGFYRQASAHAALGQLP

SEQ ID NO: 2817652 - protein, 23 aa, Entamoeba invadens
FTKPGYWQFIKESVYFTLGLLNS

SEQ ID NO: 2817653 - protein, 24 aa, Entamoeba invadens
FTKPLGLRTAPFPSSVPAGSDKGY

SEQ ID NO: 2817654 - protein, 18 aa, Entamoeba invadens
FTKVFKKIPNKEIQKRFQ

SEQ ID NO: 2817655 - protein, 24 aa, Entamoeba invadens
FTLAYFEAMLVYKVNYDQADAFSW

SEQ ID NO: 2817656 - protein, 26 aa, Entamoeba invadens
FTLKSSALFVLLKKAIFTAGTTTLQS

SEQ ID NO: 2817657 - protein, 18 aa, Entamoeba invadens
FTLLTMIFVRIVPFLHIF

SEQ ID NO: 2817658 - protein, 17 aa, Entamoeba invadens
FTLPHCPCKDCQLFLQE

SEQ ID NO: 2817659 - protein, 20 aa, Entamoeba invadens
FTLRVSPELISLKKGFACEF

SEQ ID NO: 2817660 - protein, 19 aa, Entamoeba invadens
FTLVMKLINKLFVSINFQM

SEQ ID NO: 2817661 - protein, 18 aa, Entamoeba invadens
FTLYLLPVLCFCVMTGES

SEQ ID NO: 2817662 - protein, 19 aa, Entamoeba invadens
FTMLLLFFDSLVVVMYFSA

SEQ ID NO: 2817663 - protein, 25 aa, Entamoeba invadens
FTNKHFYTLFDKHLVRYCPDSFDRN

SEQ ID NO: 2817664 - protein, 20 aa, Entamoeba invadens
FTNLWFLVSLGLSVGSFVSC

SEQ ID NO: 2817665 - protein, 19 aa, Entamoeba invadens
FTNPVFVGVVYFVNVLMTE

SEQ ID NO: 2817666 - protein, 36 aa, Entamoeba invadens
FTNPYLESLILPSALMIIVFLIVVVVFIMCGCVHCC

SEQ ID NO: 2817667 - protein, 18 aa, Entamoeba invadens
FTQKNYFRYLEFENVLLF

SEQ ID NO: 2817668 - protein, 23 aa, Entamoeba invadens
FTQVLFICRTLYNKYSYTVRYID

SEQ ID NO: 2817669 - protein, 18 aa, Entamoeba invadens
FTRDGLVIFGKRITESLL

SEQ ID NO: 2817670 - protein, 17 aa, Entamoeba invadens
FTRKMRGKILYDAARGL

SEQ ID NO: 2817671 - protein, 49 aa, Entamoeba invadens
FTSCETKAVWWVLLLVVLCALFIVVVLMVSFVGITIWIVYAISQKHDEI

SEQ ID NO: 2817672 - protein, 18 aa, Entamoeba invadens
FTSGCTAALRLIGESYPF

SEQ ID NO: 2817673 - protein, 26 aa, Entamoeba invadens
FTSGFFWSVLFLIVSLFVNALFQALT

SEQ ID NO: 2817674 - protein, 29 aa, Entamoeba invadens
FTSLYGMAIKFFPFLKSLSFVVKDKWDNL

SEQ ID NO: 2817675 - protein, 19 aa, Entamoeba invadens
FTSQYLVNCIGAVTSNQVF

SEQ ID NO: 2817676 - protein, 23 aa, Entamoeba invadens
FTTDFFSMWYSSEKIFSNLPYYL

SEQ ID NO: 2817677 - protein, 19 aa, Entamoeba invadens
FTTLPFCVFCVASFPSFSV

SEQ ID NO: 2817678 - protein, 25 aa, Entamoeba invadens
FTTNVFVSMRFIFSPTLCLFIGGCL

SEQ ID NO: 2817679 - protein, 27 aa, Entamoeba invadens
FTTQHQLTLFLHFDYTVTIISPKDPHK

SEQ ID NO: 2817680 - protein, 25 aa, Entamoeba invadens
FTTVWVSFPEYSIFSFNMNKTIQID

SEQ ID NO: 2817681 - protein, 33 aa, Entamoeba invadens
FTVFSHIAYFGSLIFYFLWGMGYGIVAAIPKIT

SEQ ID NO: 2817682 - protein, 18 aa, Entamoeba invadens
FTVFTAFSDECKPPFDNC

SEQ ID NO: 2817683 - protein, 19 aa, Entamoeba invadens
FTVFTAFSIECKPPVKNCH

SEQ ID NO: 2817684 - protein, 20 aa, Entamoeba invadens
FTVFTAFSTSPNECEPDVVN

SEQ ID NO: 2817685 - protein, 29 aa, Entamoeba invadens
FTVHNLNIDKLILDFKWINTEFTQIDTTI

SEQ ID NO: 2817686 - protein, 20 aa, Entamoeba invadens
FTVKIIPTTNWIVDDFFVQE

SEQ ID NO: 2817687 - protein, 19 aa, Entamoeba invadens
FTVLILIELLNIGFTIRRW

SEQ ID NO: 2817688 - protein, 26 aa, Entamoeba invadens
FTVVSLIAFYLYQGLLSFPMQNLGQS

SEQ ID NO: 2817689 - protein, 19 aa, Entamoeba invadens
FTYRPKGAFPVLLSGELFV

SEQ ID NO: 2817690 - protein, 17 aa, Entamoeba invadens
FTYWFGYVFGFGSAVIT

SEQ ID NO: 2817691 - protein, 19 aa, Entamoeba invadens
FVADFLALFLCEMSIVFLC

SEQ ID NO: 2817692 - protein, 21 aa, Entamoeba invadens
FVAFTFFVLYSAQTIAFIVMS

SEQ ID NO: 2817693 - protein, 17 aa, Entamoeba invadens
FVAFYFMKFLPEALREN

SEQ ID NO: 2817694 - protein, 33 aa, Entamoeba invadens
FVAWNILTIVYFIYTWFYFNKAIYLTGAATLGE

SEQ ID NO: 2817695 - protein, 34 aa, Entamoeba invadens
FVAWNILTIVYFIYTWFYFNKAIYLTGAATLGEL

SEQ ID NO: 2817696 - protein, 18 aa, Entamoeba invadens
FVAYFFQVFLSLFTKTSP

SEQ ID NO: 2817697 - protein, 24 aa, Entamoeba invadens
FVAYPFDVLPSKSFGFSADEVLFE

SEQ ID NO: 2817698 - protein, 17 aa, Entamoeba invadens
FVAYSISKNVRWCFDLN

SEQ ID NO: 2817699 - protein, 19 aa, Entamoeba invadens
FVCSFGVMFLFTFAFSVYG

SEQ ID NO: 2817700 - protein, 19 aa, Entamoeba invadens
FVCTSGVTGVALVAFLGVL

SEQ ID NO: 2817701 - protein, 26 aa, Entamoeba invadens
FVDFFKLFHLFLLTLGLAFNFISTTE

SEQ ID NO: 2817702 - protein, 20 aa, Entamoeba invadens
FVDKIGRWDLLDFEEIVLFA

SEQ ID NO: 2817703 - protein, 17 aa, Entamoeba invadens
FVDLLLIGTLWLMCRKR

SEQ ID NO: 2817704 - protein, 18 aa, Entamoeba invadens
FVDYYYLVGKNQKSFGFI

SEQ ID NO: 2817705 - protein, 19 aa, Entamoeba invadens
FVECRYVWNIAEKAARGER

SEQ ID NO: 2817706 - protein, 26 aa, Entamoeba invadens
FVEKNVFVFIILSYFLIMAGVVYDMI

SEQ ID NO: 2817707 - protein, 18 aa, Entamoeba invadens
FVEYLLIDSKGKPPKQNI

SEQ ID NO: 2817708 - protein, 19 aa, Entamoeba invadens
FVFCTLSSPLSINIFDVGQ

SEQ ID NO: 2817709 - protein, 20 aa, Entamoeba invadens
FVFEHYIVVILGILTLLGTK

SEQ ID NO: 2817710 - protein, 19 aa, Entamoeba invadens
FVFHFDPQYLIIHSRNIKH

SEQ ID NO: 2817711 - protein, 25 aa, Entamoeba invadens
FVFHRYMYFILCIMKKPMNDANCTV

SEQ ID NO: 2817712 - protein, 27 aa, Entamoeba invadens
FVFLGDDFFFYRPTPPDYYFKGEKLVI

SEQ ID NO: 2817713 - protein, 17 aa, Entamoeba invadens
FVFLTITFFTDIVAALV

SEQ ID NO: 2817714 - protein, 19 aa, Entamoeba invadens
FVFVKIDVLDVKKVNTKQG

SEQ ID NO: 2817715 - protein, 26 aa, Entamoeba invadens
FVGGFFFGDYLLYPVISISSVLCVIL

SEQ ID NO: 2817716 - protein, 21 aa, Entamoeba invadens
FVGITTFYYKGTSALTTCTNL

SEQ ID NO: 2817717 - protein, 17 aa, Entamoeba invadens
FVGTWWHEAISVGNTVT

SEQ ID NO: 2817718 - protein, 18 aa, Entamoeba invadens
FVGTWWHEAISVGNTVTG

SEQ ID NO: 2817719 - protein, 28 aa, Entamoeba invadens
FVGVYLVLFWLVFLKRFAYSFVPAFLVF

SEQ ID NO: 2817720 - protein, 19 aa, Entamoeba invadens
FVGYISSEGVCTACNSAYN

SEQ ID NO: 2817721 - protein, 19 aa, Entamoeba invadens
FVGYLSSKGMCTPCYPDYK

SEQ ID NO: 2817722 - protein, 23 aa, Entamoeba invadens
FVHTGMNQLLYNSYKLPEDVLVA

SEQ ID NO: 2817723 - protein, 19 aa, Entamoeba invadens
FVHYLCRNGFITTSKIVCI

SEQ ID NO: 2817724 - protein, 24 aa, Entamoeba invadens
FVIGFGFFMLLFFVGGRAREDSVV

SEQ ID NO: 2817725 - protein, 18 aa, Entamoeba invadens
FVIKLMGLVFNNKDLFRC

SEQ ID NO: 2817726 - protein, 17 aa, Entamoeba invadens
FVINILSKFNKIEGITP

SEQ ID NO: 2817727 - protein, 27 aa, Entamoeba invadens
FVISFIVYFFMYFLASNKSPFATITEE

SEQ ID NO: 2817728 - protein, 25 aa, Entamoeba invadens
FVISSNEMVFVNYYGLIGGKDMKES

SEQ ID NO: 2817729 - protein, 19 aa, Entamoeba invadens
FVKCWDLSLVILSIAPFMI

SEQ ID NO: 2817730 - protein, 26 aa, Entamoeba invadens
FVKEYKLCFVMIAIAPLMAGAAGIFA

SEQ ID NO: 2817731 - protein, 24 aa, Entamoeba invadens
FVKGVDRMLFDTPMKFTKLTVGSS

SEQ ID NO: 2817732 - protein, 18 aa, Entamoeba invadens
FVKPYFTCVFEENILIIS

SEQ ID NO: 2817733 - protein, 28 aa, Entamoeba invadens
FVKQFGLILHELFIKITFTLDDLLGMNE

SEQ ID NO: 2817734 - protein, 18 aa, Entamoeba invadens
FVKYEIMCKPFTGTIKPK

SEQ ID NO: 2817735 - protein, 17 aa, Entamoeba invadens
FVLCTLSMEWCDVGGNI

SEQ ID NO: 2817736 - protein, 20 aa, Entamoeba invadens
FVLGFFCCCIWIVVYRKFKH

SEQ ID NO: 2817737 - protein, 20 aa, Entamoeba invadens
FVLKQFVMTSPSTFFTRAFN

SEQ ID NO: 2817738 - protein, 18 aa, Entamoeba invadens
FVLLITSTNSAVFTWSSG

SEQ ID NO: 2817739 - protein, 23 aa, Entamoeba invadens
FVLLVLGFLLYTKVIKIPCWFNY

SEQ ID NO: 2817740 - protein, 31 aa, Entamoeba invadens
FVLNSVLVFITYFFIIKLPKIDLSVLGWKSL

SEQ ID NO: 2817741 - protein, 18 aa, Entamoeba invadens
FVLRKYPDNYLKIDVDSF

SEQ ID NO: 2817742 - protein, 24 aa, Entamoeba invadens
FVMEFMKIFPITTLDYGKIITQIH

SEQ ID NO: 2817743 - protein, 24 aa, Entamoeba invadens
FVMNKSNIKFIPLQGGVCVSIDLI

SEQ ID NO: 2817744 - protein, 18 aa, Entamoeba invadens
FVNFIFSMAFLAPSTPML

SEQ ID NO: 2817745 - protein, 30 aa, Entamoeba invadens
FVNSNWFFALWYFILSCLTFFITGVLGLVV

SEQ ID NO: 2817746 - protein, 21 aa, Entamoeba invadens
FVNYYIIHFSIFTAVCFLFAL

SEQ ID NO: 2817747 - protein, 19 aa, Entamoeba invadens
FVPITFISSMFIGGSVGVL

SEQ ID NO: 2817748 - protein, 29 aa, Entamoeba invadens
FVPSFSDNLIINALIVDILELPTSYKSLV

SEQ ID NO: 2817749 - protein, 34 aa, Entamoeba invadens
FVQFPTKMSSFTPPPYLVPLNLIVLYDVSSSNEQ

SEQ ID NO: 2817750 - protein, 23 aa, Entamoeba invadens
FVQYISLALLNPNPLLLGFTVLS

SEQ ID NO: 2817751 - protein, 30 aa, Entamoeba invadens
FVRLCKSIVVPINYWKIAIVASTVMVCVVA

SEQ ID NO: 2817752 - protein, 18 aa, Entamoeba invadens
FVRLLALQSFCIGLLDCL

SEQ ID NO: 2817753 - protein, 25 aa, Entamoeba invadens
FVRNNCFLCEPYYFLMNKTCTKCPD

SEQ ID NO: 2817754 - protein, 19 aa, Entamoeba invadens
FVRPFDGVFGLFKSFSDGI

SEQ ID NO: 2817755 - protein, 21 aa, Entamoeba invadens
FVSFMLFPRFLSTTYRWFACE

SEQ ID NO: 2817756 - protein, 25 aa, Entamoeba invadens
FVSIKRIMNFLLTLELKPVESSSDF

SEQ ID NO: 2817757 - protein, 17 aa, Entamoeba invadens
FVSILLVTNLKIVTIIK

SEQ ID NO: 2817758 - protein, 25 aa, Entamoeba invadens
FVSINFQMWLDPKNISIIKALCHSF

SEQ ID NO: 2817759 - protein, 17 aa, Entamoeba invadens
FVSLLLSFGISLVCVFY

SEQ ID NO: 2817760 - protein, 28 aa, Entamoeba invadens
FVSTTLLGFLILGFGVLGIVYAVQPSFK

SEQ ID NO: 2817761 - protein, 27 aa, Entamoeba invadens
FVSTYFFIDVIAVLALLLIKLFFTKEI

SEQ ID NO: 2817762 - protein, 22 aa, Entamoeba invadens
FVTGFSLGFTKSWDLTLIILMV

SEQ ID NO: 2817763 - protein, 23 aa, Entamoeba invadens
FVTTPFYLELTIFVGLLISIDTF

SEQ ID NO: 2817764 - protein, 18 aa, Entamoeba invadens
FVVDRWGSKLYLWSDEFY

SEQ ID NO: 2817765 - protein, 31 aa, Entamoeba invadens
FVVGVILSLVISFFLVFKKKPKATPLVPEVT

SEQ ID NO: 2817766 - protein, 17 aa, Entamoeba invadens
FVVIPIFFNFVLSVFSC

SEQ ID NO: 2817767 - protein, 22 aa, Entamoeba invadens
FVVMLFTFVCASIPLNHFVNSQ

SEQ ID NO: 2817768 - protein, 19 aa, Entamoeba invadens
FVVVITVIVSLYIYRTKRK

SEQ ID NO: 2817769 - protein, 25 aa, Entamoeba invadens
FVWASFNFLMILLTAFSVSSTLTNH

SEQ ID NO: 2817770 - protein, 21 aa, Entamoeba invadens
FVWGRRRIFLAVGAFIDVLGM

SEQ ID NO: 2817771 - protein, 18 aa, Entamoeba invadens
FVYGTLYESSISTLSITG

SEQ ID NO: 2817772 - protein, 18 aa, Entamoeba invadens
FVYNNLIMKYQWCATLLN

SEQ ID NO: 2817773 - protein, 20 aa, Entamoeba invadens
FWCLVLGDWCLIETGVYTCI

SEQ ID NO: 2817774 - protein, 27 aa, Entamoeba invadens
FWCNTCSAGYFLYYVGSGVQTCMPCAN

SEQ ID NO: 2817775 - protein, 18 aa, Entamoeba invadens
FWGILTEMKFSLLSLTFI

SEQ ID NO: 2817776 - protein, 26 aa, Entamoeba invadens
FWIGRIMFFIAFFIVILVTLLYNEGF

SEQ ID NO: 2817777 - protein, 28 aa, Entamoeba invadens
FWLIFHFFLFQLFIFSEGACPSNYNIIS

SEQ ID NO: 2817778 - protein, 27 aa, Entamoeba invadens
FWLIFNFFLFQLFIFSKGACPSNYNII

SEQ ID NO: 2817779 - protein, 20 aa, Entamoeba invadens
FWSIIYKEMNTLALPYILII

SEQ ID NO: 2817780 - protein, 17 aa, Entamoeba invadens
FWTTIRVDFTYGSCVIP

SEQ ID NO: 2817781 - protein, 19 aa, Entamoeba invadens
FYAHLYSFAADFVLMYFTI

SEQ ID NO: 2817782 - protein, 23 aa, Entamoeba invadens
FYAMFNVVFFCFLFFVDDSFTKQ

SEQ ID NO: 2817783 - protein, 20 aa, Entamoeba invadens
FYEALVWGEVYPKSEFKFAW

SEQ ID NO: 2817784 - protein, 29 aa, Entamoeba invadens
FYGILIILMIIFFVLYYVFFKGDNIFASA

SEQ ID NO: 2817785 - protein, 18 aa, Entamoeba invadens
FYGINEWLVSNKETIIFA

SEQ ID NO: 2817786 - protein, 20 aa, Entamoeba invadens
FYGVSAWAYLNGNHKIKLLK

SEQ ID NO: 2817787 - protein, 19 aa, Entamoeba invadens
FYHLLVVITLVLAVMTTMT

SEQ ID NO: 2817788 - protein, 36 aa, Entamoeba invadens
FYIPVFCYYYIPYTTPWYMFFIMLLFSFTNGYVSAW

SEQ ID NO: 2817789 - protein, 17 aa, Entamoeba invadens
FYLASLVAQVQTLLLAM

SEQ ID NO: 2817790 - protein, 19 aa, Entamoeba invadens
FYLGYPRCRFINGPNLCTC

SEQ ID NO: 2817791 - protein, 17 aa, Entamoeba invadens
FYLLIQFINQVTAVANG

SEQ ID NO: 2817792 - protein, 18 aa, Entamoeba invadens
FYLTFSTQILSTTIDTPE

SEQ ID NO: 2817793 - protein, 18 aa, Entamoeba invadens
FYNIKRLLGKTFEELQDE

SEQ ID NO: 2817794 - protein, 25 aa, Entamoeba invadens
FYQNGLYLILKATISVGTVILYLPT

SEQ ID NO: 2817795 - protein, 20 aa, Entamoeba invadens
FYRSILRQNIGWFDRKENMV

SEQ ID NO: 2817796 - protein, 22 aa, Entamoeba invadens
FYVEQTEWNIKLLAGICSEEFW

SEQ ID NO: 2817797 - protein, 25 aa, Entamoeba invadens
FYVESLLNGYMCYCNYTNGVWDPSD

SEQ ID NO: 2817798 - protein, 18 aa, Entamoeba invadens
FYVIQQGVLLAFINSYCG

SEQ ID NO: 2817799 - protein, 25 aa, Entamoeba invadens
FYVRFFAIVMIFFITSLVGLVASVF

SEQ ID NO: 2817800 - protein, 28 aa, Entamoeba invadens
GAAIGIFLGMIADTLLVIIYSSDMYKKK

SEQ ID NO: 2817801 - protein, 47 aa, Entamoeba invadens
GAAPIMFVCVFIALGIFVRIWCLIPLGVLIVGLILNALFGQGIGKFY

SEQ ID NO: 2817802 - protein, 21 aa, Entamoeba invadens
GACIRCKVRYYLQGNQCVRCG

SEQ ID NO: 2817803 - protein, 19 aa, Entamoeba invadens
GACISCIPGYGFYNHHCYR

SEQ ID NO: 2817804 - protein, 20 aa, Entamoeba invadens
GACTCSFNDIFDTCKKCVST

SEQ ID NO: 2817805 - protein, 23 aa, Entamoeba invadens
GACTGCLFNYIYSSTDPKKCVMC

SEQ ID NO: 2817806 - protein, 21 aa, Entamoeba invadens
GACVILEGLATTCQTFLPGGD

SEQ ID NO: 2817807 - protein, 23 aa, Entamoeba invadens
GADVFSFGVTMYETFGWSEAYNK

SEQ ID NO: 2817808 - protein, 26 aa, Entamoeba invadens
GAEVLIPKFLALLKSFKNVNFGGNEE

SEQ ID NO: 2817809 - protein, 18 aa, Entamoeba invadens
GAFGIVFKGVFRGNSVAV

SEQ ID NO: 2817810 - protein, 22 aa, Entamoeba invadens
GAFNNTLFISFMSDAGIASLGE

SEQ ID NO: 2817811 - protein, 20 aa, Entamoeba invadens
GAFTWMVYFAVEVFVFDTPK

SEQ ID NO: 2817812 - protein, 33 aa, Entamoeba invadens
GAGAAFPFYSLKFVDMLLILMRLEVGTDLTNSQ

SEQ ID NO: 2817813 - protein, 30 aa, Entamoeba invadens
GAGQRPLFSLRTLCLALQYITDVNGFFGFE

SEQ ID NO: 2817814 - protein, 23 aa, Entamoeba invadens
GAIVFITIIVVSIYSALRYKKID

SEQ ID NO: 2817815 - protein, 23 aa, Entamoeba invadens
GAKAFFSNMMLTEIKLPKIITTI

SEQ ID NO: 2817816 - protein, 22 aa, Entamoeba invadens
GAKAFYSSMLTEIKLPSVITTI

SEQ ID NO: 2817817 - protein, 23 aa, Entamoeba invadens
GAKGVFYYSFFDLVFMNDKGDPF

SEQ ID NO: 2817818 - protein, 18 aa, Entamoeba invadens
GALFQMIGTVLSAIVLCF

SEQ ID NO: 2817819 - protein, 17 aa, Entamoeba invadens
GALFYIYGKQYSTLECQ

SEQ ID NO: 2817820 - protein, 21 aa, Entamoeba invadens
GALGCFIFAIVFMLFGFGIVK

SEQ ID NO: 2817821 - protein, 20 aa, Entamoeba invadens
GALISFLGFSLYHTYILLAH

SEQ ID NO: 2817822 - protein, 22 aa, Entamoeba invadens
GALTVIVTVFSLIKKYFDKKQT

SEQ ID NO: 2817823 - protein, 33 aa, Entamoeba invadens
GANIKTFAECDFSLALPLTLQTGVELTCNKLNN

SEQ ID NO: 2817824 - protein, 17 aa, Entamoeba invadens
GANLIFSSILRVNFSGA

SEQ ID NO: 2817825 - protein, 17 aa, Entamoeba invadens
GAPLSQDIAKFFRIVIS

SEQ ID NO: 2817826 - protein, 30 aa, Entamoeba invadens
GAPMTVTFVIIVFIVAIIMVIISMIQKRKQ

SEQ ID NO: 2817827 - protein, 23 aa, Entamoeba invadens
GAPNLNFCFYIKHISSITNKVTE

SEQ ID NO: 2817828 - protein, 19 aa, Entamoeba invadens
GAQLFLFEGGLLVLVTKEN

SEQ ID NO: 2817829 - protein, 25 aa, Entamoeba invadens
GAQLSVKWIFVLSLRLRNSIISMIY

SEQ ID NO: 2817830 - protein, 23 aa, Entamoeba invadens
GASLQFLMVAMNLLEKKAAYLDT

SEQ ID NO: 2817831 - protein, 25 aa, Entamoeba invadens
GATLQIYLSLFLAASILVICLALMF

SEQ ID NO: 2817832 - protein, 18 aa, Entamoeba invadens
GATTSFAFLIRLGDDTYG

SEQ ID NO: 2817833 - protein, 17 aa, Entamoeba invadens
GAVFIRSKECMITEFAL

SEQ ID NO: 2817834 - protein, 17 aa, Entamoeba invadens
GAVLLNGVCSLCISGTM

SEQ ID NO: 2817835 - protein, 30 aa, Entamoeba invadens
GAVLTIDKLYVSEYFLLFGDVNVDEMVVSS

SEQ ID NO: 2817836 - protein, 24 aa, Entamoeba invadens
GAVMFIWVLTFLQSFMLFRTYKWY

SEQ ID NO: 2817837 - protein, 33 aa, Entamoeba invadens
GAVVQGLVLGWVHSFIFWKYAVLMYVAGQQLQK

SEQ ID NO: 2817838 - protein, 27 aa, Entamoeba invadens
GAVVYPPYYQDPLQTLGLLNNEWKSSC

SEQ ID NO: 2817839 - protein, 22 aa, Entamoeba invadens
GAYCGLFYLLETLEGNYCKYLA

SEQ ID NO: 2817840 - protein, 17 aa, Entamoeba invadens
GCAICHDGYYYQDKDCI

SEQ ID NO: 2817841 - protein, 25 aa, Entamoeba invadens
GCAICKNGYYWQGRNCYKCGSNCTT

SEQ ID NO: 2817842 - protein, 23 aa, Entamoeba invadens
GCAICRDGYYYKDKDCIKCDKSC

SEQ ID NO: 2817843 - protein, 19 aa, Entamoeba invadens
GCALCQEGYYREKSDCVTC

SEQ ID NO: 2817844 - protein, 17 aa, Entamoeba invadens
GCAVCQTGYLWQEKSCY

SEQ ID NO: 2817845 - protein, 46 aa, Entamoeba invadens
GCDIAFIVIICMADVTLLLVLGVFGTLAILQFLKNRKHAGTEGADA

SEQ ID NO: 2817846 - protein, 17 aa, Entamoeba invadens
GCDICEPNYLIVPQTKE

SEQ ID NO: 2817847 - protein, 25 aa, Entamoeba invadens
GCDNYTIRTIPPLITLSKGEACEFE

SEQ ID NO: 2817848 - protein, 30 aa, Entamoeba invadens
GCDTPNYVLVNFKCLFYSKVDNCISAEDSK

SEQ ID NO: 2817849 - protein, 17 aa, Entamoeba invadens
GCDVCQTGYYLTDPYCF

SEQ ID NO: 2817850 - protein, 20 aa, Entamoeba invadens
GCDYYEIRSVPPFVTLKPGY

SEQ ID NO: 2817851 - protein, 20 aa, Entamoeba invadens
GCDYYEIRSVPPLVNLKRGE

SEQ ID NO: 2817852 - protein, 20 aa, Entamoeba invadens
GCDYYEIRSVPPLVTLKPGY

SEQ ID NO: 2817853 - protein, 22 aa, Entamoeba invadens
GCDYYEIRSVPPLVTLKPGYAC

SEQ ID NO: 2817854 - protein, 21 aa, Entamoeba invadens
GCDYYQVRTVPPLVNLKRGFA

SEQ ID NO: 2817855 - protein, 46 aa, Entamoeba invadens
GCEKSGWKWYYYFLLIVGIFIVVIVLIIAIILIVAVNKKTTFDPDT

SEQ ID NO: 2817856 - protein, 17 aa, Entamoeba invadens
GCEYIVHFYGAVFVPNK

SEQ ID NO: 2817857 - protein, 27 aa, Entamoeba invadens
GCFFSTYLWFSVLLFASLLVRFVDKEN

SEQ ID NO: 2817858 - protein, 17 aa, Entamoeba invadens
GCFRCSDGFYLDNLKCI

SEQ ID NO: 2817859 - protein, 20 aa, Entamoeba invadens
GCFYTLLCLFGGCTIGCVLI

SEQ ID NO: 2817860 - protein, 22 aa, Entamoeba invadens
GCGSFLLYWVVSVIFCFIPVMI

SEQ ID NO: 2817861 - protein, 19 aa, Entamoeba invadens
GCIECECQPDWFGHGSADC

SEQ ID NO: 2817862 - protein, 27 aa, Entamoeba invadens
GCIEWICKRGFIPTLLKTLMGTTSLDM

SEQ ID NO: 2817863 - protein, 23 aa, Entamoeba invadens
GCIKCKDAFYINNKMCSPCNSNC

SEQ ID NO: 2817864 - protein, 24 aa, Entamoeba invadens
GCIKCKDAFYINNKMCSPCNSNCN

SEQ ID NO: 2817865 - protein, 32 aa, Entamoeba invadens
GCINQIGELCYLCKWAYVLIENKCHNYSIPCM

SEQ ID NO: 2817866 - protein, 17 aa, Entamoeba invadens
GCIRCMTGYYLSNGNCK

SEQ ID NO: 2817867 - protein, 17 aa, Entamoeba invadens
GCISCLDGYYLTNNSCN

SEQ ID NO: 2817868 - protein, 17 aa, Entamoeba invadens
GCKIGYVPNITTSLQCI

SEQ ID NO: 2817869 - protein, 23 aa, Entamoeba invadens
GCLKCLTGFYQQNQFCVTYNLTT

SEQ ID NO: 2817870 - protein, 25 aa, Entamoeba invadens
GCLRCCDGYYILNSLCVKCEYPCTQ

SEQ ID NO: 2817871 - protein, 17 aa, Entamoeba invadens
GCLSCNDGYYLENNKCV

SEQ ID NO: 2817872 - protein, 17 aa, Entamoeba invadens
GCLSCNNGYYLENNKCV

SEQ ID NO: 2817873 - protein, 17 aa, Entamoeba invadens
GCLSCSVGYYLDDGKCQ

SEQ ID NO: 2817874 - protein, 18 aa, Entamoeba invadens
GCLVCKVGYYKKGADCAQ

SEQ ID NO: 2817875 - protein, 18 aa, Entamoeba invadens
GCLVCKVGYYKKGADCVL

SEQ ID NO: 2817876 - protein, 17 aa, Entamoeba invadens
GCMLCESGYYLSNNLCV

SEQ ID NO: 2817877 - protein, 28 aa, Entamoeba invadens
GCMQCEGGYYLFNNLCVKCQDTCTQCNG

SEQ ID NO: 2817878 - protein, 17 aa, Entamoeba invadens
GCQICEFGYFPNNKKCS

SEQ ID NO: 2817879 - protein, 22 aa, Entamoeba invadens
GCQRCFEGFYIDSTECLKCNTN

SEQ ID NO: 2817880 - protein, 27 aa, Entamoeba invadens
GCSFIGRSCLLCPAGYYSPGGTQSCTL

SEQ ID NO: 2817881 - protein, 23 aa, Entamoeba invadens
GCSNIKSIYLKESVRFDKYLVFA

SEQ ID NO: 2817882 - protein, 17 aa, Entamoeba invadens
GCTECWIGYYKDNKGCS

SEQ ID NO: 2817883 - protein, 17 aa, Entamoeba invadens
GCTLCEDGFALKDNLCH

SEQ ID NO: 2817884 - protein, 23 aa, Entamoeba invadens
GCTLCVNGFAPKDNLCYKCGENC

SEQ ID NO: 2817885 - protein, 24 aa, Entamoeba invadens
GCTQCLDGFYIATPFCLSCQENCL

SEQ ID NO: 2817886 - protein, 28 aa, Entamoeba invadens
GCVCAFLIAVVIIGIIIFLVAKTKKIDI

SEQ ID NO: 2817887 - protein, 18 aa, Entamoeba invadens
GCVKCIIKINGSVIKTKC

SEQ ID NO: 2817888 - protein, 25 aa, Entamoeba invadens
GCVKFKDFCLLPPKQPNCVIEMVDK

SEQ ID NO: 2817889 - protein, 29 aa, Entamoeba invadens
GCVKLLSVNFYAPLTKLLDSLASQNNLFF

SEQ ID NO: 2817890 - protein, 17 aa, Entamoeba invadens
GCVLCEDGYYINSQYCF

SEQ ID NO: 2817891 - protein, 17 aa, Entamoeba invadens
GCVLCEESFYLQNGRCF

SEQ ID NO: 2817892 - protein, 20 aa, Entamoeba invadens
GCVQCKENCRFCNVSTCFLC

SEQ ID NO: 2817893 - protein, 18 aa, Entamoeba invadens
GCYSCRNGYYLTQISRCY

SEQ ID NO: 2817894 - protein, 29 aa, Entamoeba invadens
GDAFVSFPNLFPWDVAGLIAKNYRPPLDI

SEQ ID NO: 2817895 - protein, 39 aa, Entamoeba invadens
GDAKAMWTYIKYGGYFYFAMVVFFFFISSFMLIGSNFWL

SEQ ID NO: 2817896 - protein, 29 aa, Entamoeba invadens
GDANFIFFTYNILNIEKLILNANLRVSGN

SEQ ID NO: 2817897 - protein, 26 aa, Entamoeba invadens
GDCMDLINYKYHYSDKFDPFNFGYGY

SEQ ID NO: 2817898 - protein, 32 aa, Entamoeba invadens
GDDAIIPPFTNPHIFKLFDGHLVKYCPEGIDH

SEQ ID NO: 2817899 - protein, 17 aa, Entamoeba invadens
GDFLLSNKQIITFGVLN

SEQ ID NO: 2817900 - protein, 19 aa, Entamoeba invadens
GDFNKICNVSLPLSKGCAI

SEQ ID NO: 2817901 - protein, 27 aa, Entamoeba invadens
GDFPNVISIPSFYQPKQIETLSLGVNA

SEQ ID NO: 2817902 - protein, 43 aa, Entamoeba invadens
GDGCNTKIVWWVLLLVVLFVVMILILLIVVTALFTNKMLKKIH

SEQ ID NO: 2817903 - protein, 35 aa, Entamoeba invadens
GDGKELWFAYIIKYLILFFPVLNLTSTFPLLSNTL

SEQ ID NO: 2817904 - protein, 25 aa, Entamoeba invadens
GDGRIAFWQLGLYGHWGEWHEYYIK

SEQ ID NO: 2817905 - protein, 24 aa, Entamoeba invadens
GDIEALCIVLLDLIAIRLDTLKFL

SEQ ID NO: 2817906 - protein, 25 aa, Entamoeba invadens
GDIVKAPYYFLYVSTSSLSESAQKR

SEQ ID NO: 2817907 - protein, 19 aa, Entamoeba invadens
GDKFIYYKPGWGPGVRKFR

SEQ ID NO: 2817908 - protein, 23 aa, Entamoeba invadens
GDKVEYCSKCEPGYFLYDEDRPQ

SEQ ID NO: 2817909 - protein, 17 aa, Entamoeba invadens
GDLAFNAVTAVTTIIIP

SEQ ID NO: 2817910 - protein, 26 aa, Entamoeba invadens
GDLDQLKWTFVTRLVGFRSVGTNYTI

SEQ ID NO: 2817911 - protein, 17 aa, Entamoeba invadens
GDLFTKCALTLPTSGGC

SEQ ID NO: 2817912 - protein, 22 aa, Entamoeba invadens
GDLHFSTVVLLENCVITCPKTS

SEQ ID NO: 2817913 - protein, 18 aa, Entamoeba invadens
GDLKWFYAHLYSFAADFV

SEQ ID NO: 2817914 - protein, 24 aa, Entamoeba invadens
GDLLNLLWFPLTFVVQPLAADIDC

SEQ ID NO: 2817915 - protein, 27 aa, Entamoeba invadens
GDLNMWNTIIFMKSYQSLIIGTDIILT

SEQ ID NO: 2817916 - protein, 19 aa, Entamoeba invadens
GDNKDRIMCSTKVLIFENE

SEQ ID NO: 2817917 - protein, 24 aa, Entamoeba invadens
GDNKNLLWKFLINNKNVLWHLKNL

SEQ ID NO: 2817918 - protein, 52 aa, Entamoeba invadens
GDSCLYSLNLGIAVGIPISIVIVIIIIVTTIIVVTVILIQRKKERIKEKNVC

SEQ ID NO: 2817919 - protein, 26 aa, Entamoeba invadens
GDTEVFLCFLKWLCSDITITAWKAFW

SEQ ID NO: 2817920 - protein, 26 aa, Entamoeba invadens
GDTSYQLWLVPFYVGVLFSVITHVFD

SEQ ID NO: 2817921 - protein, 24 aa, Entamoeba invadens
GDVISLITSLLKTRTFFIPNRNET

SEQ ID NO: 2817922 - protein, 26 aa, Entamoeba invadens
GDVSAWVSGLLYFFGRFPQAVHIYRK

SEQ ID NO: 2817923 - protein, 24 aa, Entamoeba invadens
GDWNLFNSTWLLPKNHTAKIAASK

SEQ ID NO: 2817924 - protein, 43 aa, Entamoeba invadens
GDYCEYVLNIGLYIVLPIIVVLIFLTLVVIISTLLVFSILKKI

SEQ ID NO: 2817925 - protein, 25 aa, Entamoeba invadens
GDYEKLLFKIAPDFLVYEPSKISTG

SEQ ID NO: 2817926 - protein, 29 aa, Entamoeba invadens
GDYLRRMWESLVLVLFLRPFDIGDRISVG

SEQ ID NO: 2817927 - protein, 24 aa, Entamoeba invadens
GDYTKYIILSKPFVGTIRPKESVT

SEQ ID NO: 2817928 - protein, 23 aa, Entamoeba invadens
GEACEFEMFVTPHCSLKLHEEIM

SEQ ID NO: 2817929 - protein, 29 aa, Entamoeba invadens
GEAFPSEEFAFPWMIADFVFKGNRPPYRE

SEQ ID NO: 2817930 - protein, 18 aa, Entamoeba invadens
GECLLCDDGNYLTTDGGC

SEQ ID NO: 2817931 - protein, 24 aa, Entamoeba invadens
GECLTCYAGYGLGYDGNCELCPDG

SEQ ID NO: 2817932 - protein, 23 aa, Entamoeba invadens
GECLTCYSGYQLNASQSCEICQR

SEQ ID NO: 2817933 - protein, 24 aa, Entamoeba invadens
GECPSCLDGFFLNSLTCYPCSVSC

SEQ ID NO: 2817934 - protein, 24 aa, Entamoeba invadens
GEDITKICPLLYNYSNFTIFYSKC

SEQ ID NO: 2817935 - protein, 35 aa, Entamoeba invadens
GEDKLELNQPYYFSFTLQNLFSKVLLFTFHGVDSH

SEQ ID NO: 2817936 - protein, 20 aa, Entamoeba invadens
GEDPFFCLYYCIGSGNITNS

SEQ ID NO: 2817937 - protein, 17 aa, Entamoeba invadens
GEDTKMLFANKKMDAFA

SEQ ID NO: 2817938 - protein, 24 aa, Entamoeba invadens
GEEIRLQWYLGMIVVICGVTLLLV

SEQ ID NO: 2817939 - protein, 22 aa, Entamoeba invadens
GEEYFIIRNYWGDWGEEGYMRV

SEQ ID NO: 2817940 - protein, 24 aa, Entamoeba invadens
GEGNPYYHPAPTTAYRLHSVSETV

SEQ ID NO: 2817941 - protein, 30 aa, Entamoeba invadens
GEGSFGIVYKGLFKEKIVAIKKLKNANTTK

SEQ ID NO: 2817942 - protein, 20 aa, Entamoeba invadens
GEGSFGIVYKGSYRKNVVAI

SEQ ID NO: 2817943 - protein, 17 aa, Entamoeba invadens
GEIFIECPFYVKNLTKT

SEQ ID NO: 2817944 - protein, 24 aa, Entamoeba invadens
GEIFLAYVTTLFRIGDAFAQNPLT

SEQ ID NO: 2817945 - protein, 23 aa, Entamoeba invadens
GEINFSYVFSLLPKHIDDAHLMH

SEQ ID NO: 2817946 - protein, 23 aa, Entamoeba invadens
GEIQFFILAFCIDAFLFLGGVSF

SEQ ID NO: 2817947 - protein, 26 aa, Entamoeba invadens
GEITKFYFPPFYKTYFDELLAPFRTF

SEQ ID NO: 2817948 - protein, 26 aa, Entamoeba invadens
GELKQRAPVLFKYFNREISAFITDCI

SEQ ID NO: 2817949 - protein, 20 aa, Entamoeba invadens
GELTSKCYLTLPTGGGCAIC

SEQ ID NO: 2817950 - protein, 19 aa, Entamoeba invadens
GELYPRVGCFKVLDGKYVQ

SEQ ID NO: 2817951 - protein, 25 aa, Entamoeba invadens
GEMSDYFFLEVVSTIWFNERAYREM

SEQ ID NO: 2817952 - protein, 22 aa, Entamoeba invadens
GENVLIFSLNPHSAVCGKLTDF

SEQ ID NO: 2817953 - protein, 22 aa, Entamoeba invadens
GEPEYFMTCPMIEWSVDQRNCV

SEQ ID NO: 2817954 - protein, 17 aa, Entamoeba invadens
GEQPPMPLPPQAPTYNP

SEQ ID NO: 2817955 - protein, 18 aa, Entamoeba invadens
GERNILITSALPYCNNYP

SEQ ID NO: 2817956 - protein, 23 aa, Entamoeba invadens
GESFWVIYVLVIVFYILFIVFLH

SEQ ID NO: 2817957 - protein, 25 aa, Entamoeba invadens
GESKQYIFISIGAVVFVLVVGVVVF

SEQ ID NO: 2817958 - protein, 18 aa, Entamoeba invadens
GESLLLEYAVDQFLIDGT

SEQ ID NO: 2817959 - protein, 20 aa, Entamoeba invadens
GETCLKCDTGFYLSGSECSK

SEQ ID NO: 2817960 - protein, 26 aa, Entamoeba invadens
GETMSFIKYEFKFCYLFTTNKKTSYK

SEQ ID NO: 2817961 - protein, 22 aa, Entamoeba invadens
GEVNIKLRLKFLLDGAKGIQYL

SEQ ID NO: 2817962 - protein, 23 aa, Entamoeba invadens
GEVTTVYSLQIPPTITSVNVARN

SEQ ID NO: 2817963 - protein, 18 aa, Entamoeba invadens
GEVYFVETCINPSGVYAV

SEQ ID NO: 2817964 - protein, 25 aa, Entamoeba invadens
GEYKSFLIRLTDYAPSPYPYVYVAN

SEQ ID NO: 2817965 - protein, 20 aa, Entamoeba invadens
GFACEFEIFITPHCTLNLND

SEQ ID NO: 2817966 - protein, 29 aa, Entamoeba invadens
GFACEFEIFLTPLCTMHLVDEIVLVALDL

SEQ ID NO: 2817967 - protein, 24 aa, Entamoeba invadens
GFACEFEVFLTPLCTMDLSDEIVI

SEQ ID NO: 2817968 - protein, 24 aa, Entamoeba invadens
GFACEFEVFLTPYCTMDLSDEIVI

SEQ ID NO: 2817969 - protein, 26 aa, Entamoeba invadens
GFAKQFYQFTMFLKSYTTYINHQSLV

SEQ ID NO: 2817970 - protein, 21 aa, Entamoeba invadens
GFALSAIETLFYYGTSEPILG

SEQ ID NO: 2817971 - protein, 20 aa, Entamoeba invadens
GFCTLCEIGFYRDNTKCDSC

SEQ ID NO: 2817972 - protein, 27 aa, Entamoeba invadens
GFCTSCKLNYLLYDGLCYPKATNCATY

SEQ ID NO: 2817973 - protein, 20 aa, Entamoeba invadens
GFCYPALKFLGSTSLFIEPP

SEQ ID NO: 2817974 - protein, 30 aa, Entamoeba invadens
GFDVKQENTFLWLGKYTYTYTFSGSCCFSG

SEQ ID NO: 2817975 - protein, 17 aa, Entamoeba invadens
GFDWGVVESILLGSVNR

SEQ ID NO: 2817976 - protein, 24 aa, Entamoeba invadens
GFEKYLFFVPIMVMKYTIPRFNFV

SEQ ID NO: 2817977 - protein, 18 aa, Entamoeba invadens
GFELPQELMKVMPMIPFN

SEQ ID NO: 2817978 - protein, 29 aa, Entamoeba invadens
GFETHIDPYWFHYLMDFGAWAIPTAIYGK

SEQ ID NO: 2817979 - protein, 19 aa, Entamoeba invadens
GFFGYYPIDEPKLDCYEEF

SEQ ID NO: 2817980 - protein, 23 aa, Entamoeba invadens
GFFTLIYMSFISTGLFNCSRTIG

SEQ ID NO: 2817981 - protein, 21 aa, Entamoeba invadens
GFGAWAMITLAILIGMESLSA

SEQ ID NO: 2817982 - protein, 26 aa, Entamoeba invadens
GFGIFTLIIVFVFTIVLTVLLFGGYD

SEQ ID NO: 2817983 - protein, 24 aa, Entamoeba invadens
GFKAIFTHPLLLSIVFMVSSGFLN

SEQ ID NO: 2817984 - protein, 17 aa, Entamoeba invadens
GFKIPLVLLVSVHFLGV

SEQ ID NO: 2817985 - protein, 24 aa, Entamoeba invadens
GFKIQIIRKFLKQIINSLEILSRG

SEQ ID NO: 2817986 - protein, 28 aa, Entamoeba invadens
GFKMLTGIYCKSGYYYNKTLFDCVSYTD

SEQ ID NO: 2817987 - protein, 18 aa, Entamoeba invadens
GFLTFSRYSFSFGTARFT

SEQ ID NO: 2817988 - protein, 17 aa, Entamoeba invadens
GFLVFLMILGVVQNFAG

SEQ ID NO: 2817989 - protein, 30 aa, Entamoeba invadens
GFMFNFGVYFFWLVIPIILKDYDVNSIFIG

SEQ ID NO: 2817990 - protein, 20 aa, Entamoeba invadens
GFNEAKLFPHHNYGDGVYSN

SEQ ID NO: 2817991 - protein, 19 aa, Entamoeba invadens
GFNENLLVSLAIYNTKKLE

SEQ ID NO: 2817992 - protein, 33 aa, Entamoeba invadens
GFNIACAPLLWVCTFCMLVTIIPNFRSINLLID

SEQ ID NO: 2817993 - protein, 27 aa, Entamoeba invadens
GFPSTGVSFLPLLGLIGVEGILCVVLS

SEQ ID NO: 2817994 - protein, 21 aa, Entamoeba invadens
GFSFTIFVSILLVTNLKIVTI

SEQ ID NO: 2817995 - protein, 38 aa, Entamoeba invadens
  misc_feature (38)..(38): Xaa can be any naturally occurring amino acid
GFSSGNLWKFIFLILNFLFLNIIYNKPNKINMFRQVWX

SEQ ID NO: 2817996 - protein, 20 aa, Entamoeba invadens
GFTHDCDFDFLFTNNTLNES

SEQ ID NO: 2817997 - protein, 18 aa, Entamoeba invadens
GFTIRRWNWIIFASETSS

SEQ ID NO: 2817998 - protein, 30 aa, Entamoeba invadens
GFTKSWDLTLIILMVTPIMILCTLIIGFSS

SEQ ID NO: 2817999 - protein, 25 aa, Entamoeba invadens
GFVFPLIFFSIWQTLYLVITEGFKR

SEQ ID NO: 2818000 - protein, 36 aa, Entamoeba invadens
GFVKCWDLSLVILSIAPFMILGTIFMGSSTKVTRSK

SEQ ID NO: 2818001 - protein, 18 aa, Entamoeba invadens
GFVLINGVCSPCSSNCIT

SEQ ID NO: 2818002 - protein, 25 aa, Entamoeba invadens
GFVNWLCMWGCLVLATLIAQGMFYS

SEQ ID NO: 2818003 - protein, 34 aa, Entamoeba invadens
GFVVTFISLTTLLLFSATFYALVFNEKPAIFAKK

SEQ ID NO: 2818004 - protein, 18 aa, Entamoeba invadens
GFYCKFIEFNKNDPLEDT

SEQ ID NO: 2818005 - protein, 18 aa, Entamoeba invadens
GFYISVHRNNIFQDSFSQ

SEQ ID NO: 2818006 - protein, 17 aa, Entamoeba invadens
GFYLKGFNCKSLLTIEI

SEQ ID NO: 2818007 - protein, 21 aa, Entamoeba invadens
GFYPSCTSCLPKYYLSGIYCE

SEQ ID NO: 2818008 - protein, 30 aa, Entamoeba invadens
GGAAGFVLVLFITIIIIYFTVKLDRIDTNT

SEQ ID NO: 2818009 - protein, 29 aa, Entamoeba invadens
GGAVLVLIVIVVIFIFVIRIVTKNKRVDF

SEQ ID NO: 2818010 - protein, 18 aa, Entamoeba invadens
GGCLYIVGFIFKFRESRL

SEQ ID NO: 2818011 - protein, 24 aa, Entamoeba invadens
GGGEVVLPLFNKVYYIFVSVDQAV

SEQ ID NO: 2818012 - protein, 26 aa, Entamoeba invadens
GGGQPFQFFIIIGVFLLLTSLHSAFT

SEQ ID NO: 2818013 - protein, 24 aa, Entamoeba invadens
GGHLDALWLWVNGSEEKWVESVKK

SEQ ID NO: 2818014 - protein, 27 aa, Entamoeba invadens
GGIGVGIFLAIFIFQCYHRNCFQKIRE

SEQ ID NO: 2818015 - protein, 27 aa, Entamoeba invadens
GGIIPAMMFLLKFPEYQPTLIQIFVLG

SEQ ID NO: 2818016 - protein, 33 aa, Entamoeba invadens; identical to SEQ ID NO: 2594121

SEQ ID NO: 2818017 - protein, 28 aa, Entamoeba invadens
GGKCSSCIKGFFLTAYFKCDSCSKQCKG

SEQ ID NO: 2818018 - protein, 25 aa, Entamoeba invadens
GGKKYKIFADIFSYGITLYEVMNWG

SEQ ID NO: 2818019 - protein, 24 aa, Entamoeba invadens
GGKSVTFRSFNGLNAQFVSDYYTN

SEQ ID NO: 2818020 - protein, 24 aa, Entamoeba invadens
GGLCYLYFMYTFTRKDRDFSGKHI

SEQ ID NO: 2818021 - protein, 18 aa, Entamoeba invadens
GGLGCIECECQPDWFGHG

SEQ ID NO: 2818022 - protein, 24 aa, Entamoeba invadens
GGLMYMHCFLRKSLVIHETIPWML

SEQ ID NO: 2818023 - protein, 25 aa, Entamoeba invadens
GGLVLIFIVLFLLGYFLNGYLPELS

SEQ ID NO: 2818024 - protein, 20 aa, Entamoeba invadens
GGLYAVVFCPKKQSFSFIDL

SEQ ID NO: 2818025 - protein, 19 aa, Entamoeba invadens
GGMCNVAMLVGKKAGTKFF

SEQ ID NO: 2818026 - protein, 23 aa, Entamoeba invadens
GGMFLLKCFSAIQVLFSAFNAND

SEQ ID NO: 2818027 - protein, 20 aa, Entamoeba invadens
GGMVLFFNKYNFQTEITIPQ

SEQ ID NO: 2818028 - protein, 23 aa, Entamoeba invadens
GGSHQILLFITKYKPKLVCFGHT

SEQ ID NO: 2818029 - protein, 23 aa, Entamoeba invadens
GGSIYIPITTKTLTLKKITLVSR

SEQ ID NO: 2818030 - protein, 26 aa, Entamoeba invadens
GGSTRIPQFTFLSCGSLSLLTGTEKV

SEQ ID NO: 2818031 - protein, 17 aa, Entamoeba invadens
GGSYDILIFDKTSQIGF

SEQ ID NO: 2818032 - protein, 39 aa, Entamoeba invadens
GGTAPLLFLIVCIILLVLITYWALIPIGVCLLFVVINMI

SEQ ID NO: 2818033 - protein, 25 aa, Entamoeba invadens
GGTIKWYVIAVGLFVRMVICPAICI

SEQ ID NO: 2818034 - protein, 20 aa, Entamoeba invadens
GGTYFYASMYYGDKAKLIEL

SEQ ID NO: 2818035 - protein, 46 aa, Entamoeba invadens
GGVAWSTYFRYFSAGGFFWLFLLIVPFILRCGTRICYNLFLTWWTN

SEQ ID NO: 2818036 - protein, 36 aa, Entamoeba invadens
GGVGYKVFIYILALIIPLFLAIFTKYFKPTKVKYQN

SEQ ID NO: 2818037 - protein, 31 aa, Entamoeba invadens
GGVGYKVFIYILALIIPPFLAIFAKYFKPTK

SEQ ID NO: 2818038 - protein, 30 aa, Entamoeba invadens
GGVLLILLLLVTFLYIVYSILFQSRWVIKL

SEQ ID NO: 2818039 - protein, 33 aa, Entamoeba invadens
GGVMTNYLIHLFHLFMYPGTAPLLKFLVVGVIG

SEQ ID NO: 2818040 - protein, 27 aa, Entamoeba invadens
GGVSRAAYYKIFVPRKVSVQMNTCGWK

SEQ ID NO: 2818041 - protein, 35 aa, Entamoeba invadens
GGVVAFVIILCFLLIVFIFVFRYKKIDINIYKTQQ

SEQ ID NO: 2818042 - protein, 33 aa, Entamoeba invadens
GGVVAFWLLCFLNTFFLLFASTEITILCFVSQR

SEQ ID NO: 2818043 - protein, 31 aa, Entamoeba invadens
GGVVLIAAIILIIVAVVFFMKKKSSKYQEID

SEQ ID NO: 2818044 - protein, 29 aa, Entamoeba invadens
GGVVLLIGLILAFFFASLKIMKVQKMKEL

SEQ ID NO: 2818045 - protein, 19 aa, Entamoeba invadens
GGYEMLKVLLIVEKKLEWM

SEQ ID NO: 2818046 - protein, 18 aa, Entamoeba invadens
GGYFPFKQLNVLCVMYDA

SEQ ID NO: 2818047 - protein, 19 aa, Entamoeba invadens
GGYVLYVFSLVLLPISVCV

SEQ ID NO: 2818048 - protein, 19 aa, Entamoeba invadens
GHCFAFLAIVWKTPQLQKL

SEQ ID NO: 2818049 - protein, 27 aa, Entamoeba invadens
GHGDSMYRLMLLFNDPQFVQYNKTRAM

SEQ ID NO: 2818050 - protein, 18 aa, Entamoeba invadens
GHLVSFVLNCWDVLVKRL

SEQ ID NO: 2818051 - protein, 26 aa, Entamoeba invadens
GHNNGIYYQYTFLTGKSYVIDTCGLE

SEQ ID NO: 2818052 - protein, 20 aa, Entamoeba invadens
GHPFSNNLQYALAIILAVTL

SEQ ID NO: 2818053 - protein, 24 aa, Entamoeba invadens
GHPQNAFWFAISSLAGLEIPPKRY

SEQ ID NO: 2818054 - protein, 26 aa, Entamoeba invadens
GHRKDHGHFLPLKKYDSVFSQLRSTG

SEQ ID NO: 2818055 - protein, 27 aa, Entamoeba invadens
GHSEKTTFFTFAAKMLSYPTLTEHDKS

SEQ ID NO: 2818056 - protein, 17 aa, Entamoeba invadens
GHWILLDEINLASHETL

SEQ ID NO: 2818057 - protein, 29 aa, Entamoeba invadens
GIALGVVFGVILLCCGVAVIILKLKKKKN

SEQ ID NO: 2818058 - protein, 33 aa, Entamoeba invadens
GIALVLHFIVMLIKFIFSFLLLSGYNGTIFFIF

SEQ ID NO: 2818059 - protein, 30 aa, Entamoeba invadens
GIALYSYGNGRWWVLKHPNELFLFVNGTEA

SEQ ID NO: 2818060 - protein, 23 aa, Entamoeba invadens
GIANKMVLVYSEGQLYVINPKTL

SEQ ID NO: 2818061 - protein, 32 aa, Entamoeba invadens
GIAVVGKFPFIWIFLVFASICFWMSHQFAPKG

SEQ ID NO: 2818062 - protein, 26 aa, Entamoeba invadens
GICCLHIALYIGLLYDFKCEKLLEMC

SEQ ID NO: 2818063 - protein, 18 aa, Entamoeba invadens
GICKACEAGYFSLGGTAS

SEQ ID NO: 2818064 - protein, 18 aa, Entamoeba invadens
GICLICESGFTLKKPKNL

SEQ ID NO: 2818065 - protein, 19 aa, Entamoeba invadens
GICYEMVGLSGTLRFRVDN

SEQ ID NO: 2818066 - protein, 25 aa, Entamoeba invadens
GIDEKPVLFKKWELKECYRLSVDKS

SEQ ID NO: 2818067 - protein, 22 aa, Entamoeba invadens
GIDIYLLKWNEHYTMTFPEALA

SEQ ID NO: 2818068 - protein, 35 aa, Entamoeba invadens
GIDPTKFIADYAYKYFLLKNVNGAVTYFIRSFTGC

SEQ ID NO: 2818069 - protein, 23 aa, Entamoeba invadens
GIEVFCGLPFIETTGFIALNREK

SEQ ID NO: 2818070 - protein, 24 aa, Entamoeba invadens
GIFLLSVGLFIFLEAVERFIQIQV

SEQ ID NO: 2818071 - protein, 17 aa, Entamoeba invadens
GIFYCKNCTTKSVGIPL

SEQ ID NO: 2818072 - protein, 22 aa, Entamoeba invadens
GIGALFVVLTIAFQLITCTSSE

SEQ ID NO: 2818073 - protein, 49 aa, Entamoeba invadens
GIGCKSHAVWWIILLVILFLIICVVFVIFIAFYFTKFVSKIIHKQKQEE

SEQ ID NO: 2818074 - protein, 24 aa, Entamoeba invadens
GIGEFIADNFLPSNYIIYSGSCVL

SEQ ID NO: 2818075 - protein, 27 aa, Entamoeba invadens
GIGGGAVFPFYTLQFMDVLMVMMTMTP

SEQ ID NO: 2818076 - protein, 25 aa, Entamoeba invadens
GIGMGFVMFTIFCSITLGLFYGTVV

SEQ ID NO: 2818077 - protein, 25 aa, Entamoeba invadens
GIGQGAIFPFYSIKFMDIMMVMLNM

SEQ ID NO: 2818078 - protein, 30 aa, Entamoeba invadens
GIGWCDAYPKGLFAFPWKIAEYVNNGKRPE

SEQ ID NO: 2818079 - protein, 29 aa, Entamoeba invadens
GIHLFSNIDQHWWIVFHRNETISYSPYIL

SEQ ID NO: 2818080 - protein, 41 aa, Entamoeba invadens
GIIAAVIIGLLALVVIIAILCCSAVYIYRKKRKTANKDDTK

SEQ ID NO: 2818081 - protein, 18 aa, Entamoeba invadens
GIIFKCLVCLYVCCGLCL

SEQ ID NO: 2818082 - protein, 17 aa, Entamoeba invadens
GIIIFLVAKTKKIDINI

SEQ ID NO: 2818083 - protein, 21 aa, Entamoeba invadens
GIIIVLFCTILCEIVYHVGYV

SEQ ID NO: 2818084 - protein, 31 aa, Entamoeba invadens
GIIKTPLKFGVYTLLFKYNKPLQTYLEKKVT

SEQ ID NO: 2818085 - protein, 29 aa, Entamoeba invadens
GIILTVIAIILIFPFVAVSFVYSKDLKDY

SEQ ID NO: 2818086 - protein, 22 aa, Entamoeba invadens
GIISCFLAMVFMFVLRGTLFIS

SEQ ID NO: 2818087 - protein, 30 aa, Entamoeba invadens
GIIVNQKRYVFFFFYNFVVNQISHENSENH

SEQ ID NO: 2818088 - protein, 17 aa, Entamoeba invadens
GIIYMAVGGVFVIIAIL

SEQ ID NO: 2818089 - protein, 27 aa, Entamoeba invadens
GIKLSPTFWWYVGGLVFCLLFCTPCLI

SEQ ID NO: 2818090 - protein, 19 aa, Entamoeba invadens
GIKLTWWLGINLSLVYFFE

SEQ ID NO: 2818091 - protein, 21 aa, Entamoeba invadens
GIKRCFSMRRLIYWVIEALVV

SEQ ID NO: 2818092 - protein, 17 aa, Entamoeba invadens
GIKVYYIPLLPVFNECV

SEQ ID NO: 2818093 - protein, 22 aa, Entamoeba invadens
GILCIIIVVIVVLVKVVRKKMA

SEQ ID NO: 2818094 - protein, 17 aa, Entamoeba invadens
GILFLTIAPLTFNPLAA

SEQ ID NO: 2818095 - protein, 30 aa, Entamoeba invadens
GILHRDIKPDNFLVFSLDYGDEITAKLTDF

SEQ ID NO: 2818096 - protein, 21 aa, Entamoeba invadens
GILHRDIKPGNILICDYSYAA

SEQ ID NO: 2818097 - protein, 27 aa, Entamoeba invadens
GILKLMDSIFIKNFMYYFIDGSKTDQS

SEQ ID NO: 2818098 - protein, 18 aa, Entamoeba invadens
GIMSYKNGIFTFPQDVCQ

SEQ ID NO: 2818099 - protein, 23 aa, Entamoeba invadens
GINKYPCQKGYYSNNRAVSCTLC

SEQ ID NO: 2818100 - protein, 18 aa, Entamoeba invadens
GIPVVPLTVLFISFSLKT

SEQ ID NO: 2818101 - protein, 36 aa, Entamoeba invadens
GIQPILFVLTVISVLLMLIPKPIIVILLKRKDRMRV

SEQ ID NO: 2818102 - protein, 24 aa, Entamoeba invadens
GIQSFNFILEWEFNVSFKGSHAQE

SEQ ID NO: 2818103 - protein, 20 aa, Entamoeba invadens
GIRGVVWTHGNIIAQCCALK

SEQ ID NO: 2818104 - protein, 22 aa, Entamoeba invadens
GISLFFLIVFIPEMLTYIIYEW

SEQ ID NO: 2818105 - protein, 35 aa, Entamoeba invadens
GISSYGWIVVLQQPTFYLLLIVAVSFASLPQVVTH

SEQ ID NO: 2818106 - protein, 25 aa, Entamoeba invadens
GISTIFRKLLLSIYPNFVNYYIIHF

SEQ ID NO: 2818107 - protein, 26 aa, Entamoeba invadens
GISWKDPYPIEKYKFPWSISQCVTEG

SEQ ID NO: 2818108 - protein, 34 aa, Entamoeba invadens
GISWKDPYPIQKFKFPWSISQWVIEGKRPEILVD

SEQ ID NO: 2818109 - protein, 22 aa, Entamoeba invadens
GITAWEIFYQREPYFELKSVFE

SEQ ID NO: 2818110 - protein, 23 aa, Entamoeba invadens
GITLPSQITYGVILVKKSVTTPT

SEQ ID NO: 2818111 - protein, 38 aa, Entamoeba invadens
GITMFECFGWCQAYPKTQFKFPWTIAEFVIEGKRLDKK

SEQ ID NO: 2818112 - protein, 18 aa, Entamoeba invadens
GITMYEVFGWCKAYPITT

SEQ ID NO: 2818113 - protein, 22 aa, Entamoeba invadens
GIVFFIFLLLVIGSLIGTVYIP

SEQ ID NO: 2818114 - protein, 19 aa, Entamoeba invadens
GIVFKGTYRRNVVAIKKMK

SEQ ID NO: 2818115 - protein, 24 aa, Entamoeba invadens
GIVSCYPEYFLLDNACVLCSSKYS

SEQ ID NO: 2818116 - protein, 31 aa, Entamoeba invadens
GIVVFKEIFGWRNFMFFAAGTLVLFVGIICI

SEQ ID NO: 2818117 - protein, 36 aa, Entamoeba invadens
GIVVTSVIVFIFILGLISLLLYFALRYKKADVSIYK

SEQ ID NO: 2818118 - protein, 23 aa, Entamoeba invadens
GIYIYPICTPTKLLKGVFFSVNF

SEQ ID NO: 2818119 - protein, 40 aa, Entamoeba invadens
GIYLVLVLGMWLWGQFFCQWKNVFYLFLGISVVGVCVIGA

SEQ ID NO: 2818120 - protein, 20 aa, Entamoeba invadens
GIYPTIFDYGKFRPFALQNS

SEQ ID NO: 2818121 - protein, 29 aa, Entamoeba invadens
GIYRNGVYYQCKNIEYLNYFNSCTTCGGA

SEQ ID NO: 2818122 - protein, 30 aa, Entamoeba invadens
GKAQRVIYVIFWPLLMLLAYTIPDVKIKSL

SEQ ID NO: 2818123 - protein, 25 aa, Entamoeba invadens
GKAVEFEIFVTPLCTCSISETIAIV

SEQ ID NO: 2818124 - protein, 24 aa, Entamoeba invadens
GKCAYCKIQYYLDPINLICKDCPN

SEQ ID NO: 2818125 - protein, 20 aa, Entamoeba invadens
GKCDPYFRCVVRNSLGECTE

SEQ ID NO: 2818126 - protein, 20 aa, Entamoeba invadens
GKCFRLFTKSNFDKFQPSPT

SEQ ID NO: 2818127 - protein, 18 aa, Entamoeba invadens
GKCISCEGGYYIDGQYTC

SEQ ID NO: 2818128 - protein, 20 aa, Entamoeba invadens
GKCISCIMGYGLYSNNNCIK

SEQ ID NO: 2818129 - protein, 20 aa, Entamoeba invadens
GKCRCQDGYLFNETTETCSP

SEQ ID NO: 2818130 - protein, 20 aa, Entamoeba invadens
GKCYSPYLGYFLKNGECLKC

SEQ ID NO: 2818131 - protein, 41 aa, Entamoeba invadens
GKDCELQVTWILLIVFSILITLLGIFAVTTIFVLINKEKKG

SEQ ID NO: 2818132 - protein, 26 aa, Entamoeba invadens
GKDMYTFVIPVRIPVFFSTDLATDSK

SEQ ID NO: 2818133 - protein, 23 aa, Entamoeba invadens
GKEAPYLLVYQLLNQLVCQKMIM

SEQ ID NO: 2818134 - protein, 17 aa, Entamoeba invadens
GKEKFFYMKYAESLENP

SEQ ID NO: 2818135 - protein, 27 aa, Entamoeba invadens
GKEVHVNIWIAVIVPLAAIAIISFVAR

SEQ ID NO: 2818136 - protein, 19 aa, Entamoeba invadens
GKFEILQNCKFVLVEMVWE

SEQ ID NO: 2818137 - protein, 23 aa, Entamoeba invadens
GKFRINVHTFLHETLHALGFSSS

SEQ ID NO: 2818138 - protein, 27 aa, Entamoeba invadens
GKFRSEYIVHFYGAVFIPDKICMVTEF

SEQ ID NO: 2818139 - protein, 29 aa, Entamoeba invadens
GKGIAEIQIFAFDKLSLVLKSTRAPHIVK

SEQ ID NO: 2818140 - protein, 22 aa, Entamoeba invadens
GKGSFGIVYVGLYKGNKVAIKK

SEQ ID NO: 2818141 - protein, 24 aa, Entamoeba invadens
GKHYNAALPLPLRKILLNQMNATL

SEQ ID NO: 2818142 - protein, 25 aa, Entamoeba invadens
GKIDQYIFFMSLGAEITFFSAYARQ

SEQ ID NO: 2818143 - protein, 23 aa, Entamoeba invadens
GKIFTVLRVLTPINIANFEFTED

SEQ ID NO: 2818144 - protein, 17 aa, Entamoeba invadens
GKIPQGELLIRGPSLFK

SEQ ID NO: 2818145 - protein, 39 aa, Entamoeba invadens
GKIQTTFYGLLILSIVLFLVLAYWLFMLSKQCYITELKA

SEQ ID NO: 2818146 - protein, 29 aa, Entamoeba invadens
GKKKDLSIVYFLVLVRLLQTFDQKNLPNN

SEQ ID NO: 2818147 - protein, 17 aa, Entamoeba invadens
GKKLTTTQWRALLALVV

SEQ ID NO: 2818148 - protein, 22 aa, Entamoeba invadens
GKKRYFSFLSQDYRAEITMALS

SEQ ID NO: 2818149 - protein, 24 aa, Entamoeba invadens
GKLCMDWFFTFQEKSDVVYSTHSM

SEQ ID NO: 2818150 - protein, 27 aa, Entamoeba invadens
GKLDLYCGLWYFGIGFIGAAFGQFGFS

SEQ ID NO: 2818151 - protein, 25 aa, Entamoeba invadens
GKLFLIIFIVFNCFVAIGVFGVVSY

SEQ ID NO: 2818152 - protein, 30 aa, Entamoeba invadens
GKLGFGCALIVFSILVVYWVIDAINYSDMV

SEQ ID NO: 2818153 - protein, 21 aa, Entamoeba invadens
GKLTGMRLVGWVFPGELFTVT

SEQ ID NO: 2818154 - protein, 25 aa, Entamoeba invadens
GKLWPPGFMSFFTMAPFISANFQVH

SEQ ID NO: 2818155 - protein, 22 aa, Entamoeba invadens
GKMKFAIFSDVIPRPAELFFQH

SEQ ID NO: 2818156 - protein, 18 aa, Entamoeba invadens
GKMLHMWGLLSHSVIPLV

SEQ ID NO: 2818157 - protein, 37 aa, Entamoeba invadens
GKNNMKFFLQFMFYASITLFFAIIINGSSLFHAITNM

SEQ ID NO: 2818158 - protein, 24 aa, Entamoeba invadens
GKNVLFLTKCRFTKFAKVLYRKYN

SEQ ID NO: 2818159 - protein, 32 aa, Entamoeba invadens
GKQNFVEYFYKFQRLIFDLHDLHISISLKSNT

SEQ ID NO: 2818160 - protein, 20 aa, Entamoeba invadens
GKRLFIPNKVPNELSIIITK

SEQ ID NO: 2818161 - protein, 19 aa, Entamoeba invadens
GKRLVVPVTYYIKQTPDVD

SEQ ID NO: 2818162 - protein, 24 aa, Entamoeba invadens
GKSITFRSFNGYDSNIRYGIVWGI

SEQ ID NO: 2818163 - protein, 24 aa, Entamoeba invadens
GKSPYNDWGFNALPNWVDTKMFHR

SEQ ID NO: 2818164 - protein, 18 aa, Entamoeba invadens
GKTIKCAIGYFIKSNKCE

SEQ ID NO: 2818165 - protein, 34 aa, Entamoeba invadens
GKTQMKSKMTFFVSTLLVILSMSKTLYVDQTLGS

SEQ ID NO: 2818166 - protein, 22 aa, Entamoeba invadens
GKVFAILRVLTPINVANFKIKD

SEQ ID NO: 2818167 - protein, 23 aa, Entamoeba invadens
GKVFTVLRVLTPINIANFEFTED

SEQ ID NO: 2818168 - protein, 21 aa, Entamoeba invadens
GKVFVYFDNILSGFSPRFELV

SEQ ID NO: 2818169 - protein, 31 aa, Entamoeba invadens
GKYLKHNFFQFRFFCLRSKRYILKHMIFFKM

SEQ ID NO: 2818170 - protein, 17 aa, Entamoeba invadens
GLAGLRNLYYSIYPNYN

SEQ ID NO: 2818171 - protein, 45 aa, Entamoeba invadens
GLAIGLPVVFVIIIVTLIALSIVGIYLLFLHNKKEKKMLNVCVFK

SEQ ID NO: 2818172 - protein, 44 aa, Entamoeba invadens
GLAIGLPVVFVIIIVTLIALSIVGIYLLYLHNKEEKKMLNVCVF

SEQ ID NO: 2818173 - protein, 21 aa, Entamoeba invadens
GLAIGYPFSVLALTAIVLGMG

SEQ ID NO: 2818174 - protein, 18 aa, Entamoeba invadens
GLAILIISFVIFAISCCK

SEQ ID NO: 2818175 - protein, 18 aa, Entamoeba invadens
GLCIRCSDGYFLNNIFCE

SEQ ID NO: 2818176 - protein, 26 aa, Entamoeba invadens
GLCKPCYQMFDKCLNCFSNGSYCYSC

SEQ ID NO: 2818177 - protein, 23 aa, Entamoeba invadens
GLCNNFFLNSLWTFPQNVDTKEK

SEQ ID NO: 2818178 - protein, 17 aa, Entamoeba invadens
GLFIFSMYRKNQKVGYQ

SEQ ID NO: 2818179 - protein, 21 aa, Entamoeba invadens
GLFLTLISFFETQDFKVLTCP

SEQ ID NO: 2818180 - protein, 21 aa, Entamoeba invadens
GLFNAFLILLTPRSLSFTKSA

SEQ ID NO: 2818181 - protein, 25 aa, Entamoeba invadens
GLFVAYLCVFGWHEVSIEDKYTFES

SEQ ID NO: 2818182 - protein, 18 aa, Entamoeba invadens
GLGFLSLFISLSFFIFPT

SEQ ID NO: 2818183 - protein, 17 aa, Entamoeba invadens
GLHLFSNIDQRYWIVYR

SEQ ID NO: 2818184 - protein, 28 aa, Entamoeba invadens
GLHNLKFFFLFLLYAFAIVSIHFRLSIL

SEQ ID NO: 2818185 - protein, 19 aa, Entamoeba invadens
GLHYFARTFSAMNVTKYAR

SEQ ID NO: 2818186 - protein, 22 aa, Entamoeba invadens
GLICFIFCYWYIYNLVTFILIF

SEQ ID NO: 2818187 - protein, 17 aa, Entamoeba invadens
GLIFSFLGDLLLLFEGN

SEQ ID NO: 2818188 - protein, 44 aa, Entamoeba invadens
GLILGASISAFIVLLLLVVILTMIVFFLLRKKKEDMKTLFKMKD

SEQ ID NO: 2818189 - protein, 26 aa, Entamoeba invadens
GLILSIVFVVLYIEKKMRHKQIEQTT

SEQ ID NO: 2818190 - protein, 46 aa, Entamoeba invadens
GLIQIEMFEMSLWPLVVLFVFIATTGAIVLFVIAFDKIKHFCKMLC

SEQ ID NO: 2818191 - protein, 18 aa, Entamoeba invadens
GLITFFNLIPYIPKEIEC

SEQ ID NO: 2818192 - protein, 24 aa, Entamoeba invadens
GLKVLLLFVLFLTFCLFCVENHPV

SEQ ID NO: 2818193 - protein, 21 aa, Entamoeba invadens
GLLFVQYRCLKIKNLLKEWWP

SEQ ID NO: 2818194 - protein, 19 aa, Entamoeba invadens
GLLIDKWEIIPIEEVLLVS

SEQ ID NO: 2818195 - protein, 18 aa, Entamoeba invadens
GLLILMLGFSLNGNDLQS

SEQ ID NO: 2818196 - protein, 25 aa, Entamoeba invadens
GLLLYTFLCFVLFSKYQIKDYVKLM

SEQ ID NO: 2818197 - protein, 17 aa, Entamoeba invadens
GLLPYYTTTRFLQNSMP

SEQ ID NO: 2818198 - protein, 20 aa, Entamoeba invadens
GLLRLIYTLYCSQKDFVSKL

SEQ ID NO: 2818199 - protein, 18 aa, Entamoeba invadens
GLMKLDVILFGEKLDQIT

SEQ ID NO: 2818200 - protein, 27 aa, Entamoeba invadens
GLNRYTLLVWIILFLGWTANLAFENSN

SEQ ID NO: 2818201 - protein, 29 aa, Entamoeba invadens
GLNSKLLEWDLILFLKPNSLEVQKKTSKN

SEQ ID NO: 2818202 - protein, 26 aa, Entamoeba invadens
GLNTTIFLSLALLISKLPHLVETITP

SEQ ID NO: 2818203 - protein, 22 aa, Entamoeba invadens
GLPEWLYYFRDNNQNWAIPSNA

SEQ ID NO: 2818204 - protein, 24 aa, Entamoeba invadens
GLPLSMIMIIVMLILTILTSFYTM

SEQ ID NO: 2818205 - protein, 19 aa, Entamoeba invadens
GLPTKFRFAKYATSCFRRL

SEQ ID NO: 2818206 - protein, 19 aa, Entamoeba invadens
GLQLYVLPVPNVITTELWI

SEQ ID NO: 2818207 - protein, 30 aa, Entamoeba invadens
GLSGFAFVVYLFILAFMVMAVRTHPVFTLL

SEQ ID NO: 2818208 - protein, 24 aa, Entamoeba invadens
GLSLLECMKWRQAYEKPEFNYMWQ

SEQ ID NO: 2818209 - protein, 40 aa, Entamoeba invadens
GLSVVCVVVLVVIIIATITSVVLFLLKKKDNKHTEDICVF

SEQ ID NO: 2818210 - protein, 20 aa, Entamoeba invadens
GLTRRVNFYLLGLSAKSQDV

SEQ ID NO: 2818211 - protein, 24 aa, Entamoeba invadens
GLVIYLSNIFYFFTTILHVIEEVV

SEQ ID NO: 2818212 - protein, 29 aa, Entamoeba invadens
GLVTMMYSVVMFLTLVTNYRLLLEELSEN

SEQ ID NO: 2818213 - protein, 42 aa, Entamoeba invadens
GLVVGVPISITLTVIVLIVVIIIILITMIQKKKIAKKEQNIC

SEQ ID NO: 2818214 - protein, 18 aa, Entamoeba invadens
GLWYRLIHVTEGQSEAFT

SEQ ID NO: 2818215 - protein, 18 aa, Entamoeba invadens
GLYLLPVAIINCILPATN

SEQ ID NO: 2818216 - protein, 21 aa, Entamoeba invadens
GLYVFFPFETNCGKGEFGCFN

SEQ ID NO: 2818217 - protein, 17 aa, Entamoeba invadens
GMCADFTYWFGYVFGFG

SEQ ID NO: 2818218 - protein, 34 aa, Entamoeba invadens
GMCLAYIMIFLFDFILYFFRPLVKAIVLITCFYI

SEQ ID NO: 2818219 - protein, 18 aa, Entamoeba invadens
GMCLTCNDGYYLTSQNTC

SEQ ID NO: 2818220 - protein, 39 aa, Entamoeba invadens
GMDKDLMITIIVFSIAVFLLIVINIGLIGFIIYSKKVKK

SEQ ID NO: 2818221 - protein, 27 aa, Entamoeba invadens
GMECLHTFRIPLIHRDLKSPNVLIRLD

SEQ ID NO: 2818222 - protein, 17 aa, Entamoeba invadens
GMFITSICGCDVPLLHI

SEQ ID NO: 2818223 - protein, 24 aa, Entamoeba invadens
GMFMGMPMFHVVKMMRNMKKLVET

SEQ ID NO: 2818224 - protein, 20 aa, Entamoeba invadens
GMIDDLIFSLGLTVQKGDAD

SEQ ID NO: 2818225 - protein, 18 aa, Entamoeba invadens
GMIFFSVMPLLKNSANLL

SEQ ID NO: 2818226 - protein, 26 aa, Entamoeba invadens
GMIVALVIVILLIPFLVVGVVGNKGF

SEQ ID NO: 2818227 - protein, 17 aa, Entamoeba invadens
GMKMRVKIMLDSSKGIF

SEQ ID NO: 2818228 - protein, 29 aa, Entamoeba invadens
GMKTFSFRHFSFKDGIFKDCKELETVNMY

SEQ ID NO: 2818229 - protein, 17 aa, Entamoeba invadens
GMKVDKFGKLVYCSIKG

SEQ ID NO: 2818230 - protein, 23 aa, Entamoeba invadens
GMKVYKHVILKNAFQIYKVKEFS

SEQ ID NO: 2818231 - protein, 26 aa, Entamoeba invadens
GMLNCLQCEPGWYLIGQNCYNTTTSC

SEQ ID NO: 2818232 - protein, 25 aa, Entamoeba invadens
GMPHVIALCRAVMSNWIAFKDIPNS

SEQ ID NO: 2818233 - protein, 41 aa, Entamoeba invadens
GMSLTLVWTYKRSLFLLFQTGFILFLLIIGVSRNAYLNWFM

SEQ ID NO: 2818234 - protein, 24 aa, Entamoeba invadens
GMSNQPLLYILKAPTRMSLYFFSS

SEQ ID NO: 2818235 - protein, 25 aa, Entamoeba invadens
GMSPLLIMISIIMIIASFITYYLVP

SEQ ID NO: 2818236 - protein, 25 aa, Entamoeba invadens
GMSQKFAILFQTLAGFITGYAIGFS

SEQ ID NO: 2818237 - protein, 20 aa, Entamoeba invadens
GMTRLLLRMLDITHITNPFK

SEQ ID NO: 2818238 - protein, 43 aa, Entamoeba invadens
GMTTGFIVAITVLSIFIALIFIVVVVLITLFVIKKCKKSNAPG

SEQ ID NO: 2818239 - protein, 18 aa, Entamoeba invadens
GMTTPFLLKLMKIKMGGA

SEQ ID NO: 2818240 - protein, 23 aa, Entamoeba invadens
GMTWVWRILIILALELLELSVCM

SEQ ID NO: 2818241 - protein, 26 aa, Entamoeba invadens
GMVLRGSYYRFYLNKPMHITVKTCTS

SEQ ID NO: 2818242 - protein, 24 aa, Entamoeba invadens
GMVMGYFFAIFTDKLGIFPTLVVH

SEQ ID NO: 2818243 - protein, 30 aa, Entamoeba invadens
GNANLYVYKRLNELFLFVNGTKPSDIFFSF

SEQ ID NO: 2818244 - protein, 19 aa, Entamoeba invadens
GNCEICVDGYYSLGGTLSC

SEQ ID NO: 2818245 - protein, 21 aa, Entamoeba invadens
GNCEVVCMYYIFNIIKEFKED

SEQ ID NO: 2818246 - protein, 17 aa, Entamoeba invadens
GNCLILADGLKGKWFTF

SEQ ID NO: 2818247 - protein, 19 aa, Entamoeba invadens
GNDCLLCDAGYLLVQQNGV

SEQ ID NO: 2818248 - protein, 22 aa, Entamoeba invadens
GNDFLGNVFRKSFEKIHMETSG

SEQ ID NO: 2818249 - protein, 27 aa, Entamoeba invadens
GNDILRFFCDVLYQTVIYKDHRIFYKS

SEQ ID NO: 2818250 - protein, 17 aa, Entamoeba invadens
GNDLRSLNLKWLRNQIG

SEQ ID NO: 2818251 - protein, 25 aa, Entamoeba invadens
GNDVDWYITPLYNVTSLLIENTTKS

SEQ ID NO: 2818252 - protein, 27 aa, Entamoeba invadens
GNERSRLLPYTLFRLGGAAILLSNKSS

SEQ ID NO: 2818253 - protein, 23 aa, Entamoeba invadens
GNFIGGTFFVGVPFWFAHVSNVY

SEQ ID NO: 2818254 - protein, 23 aa, Entamoeba invadens
GNFTIHSYKQLTLKLRNTFIINE

SEQ ID NO: 2818255 - protein, 24 aa, Entamoeba invadens
GNFTLFNNSLFTTKLPIGITSTIS

SEQ ID NO: 2818256 - protein, 20 aa, Entamoeba invadens
GNGFQCIPCQKGTYSSLPGS

SEQ ID NO: 2818257 - protein, 21 aa, Entamoeba invadens
GNGIVFLDSIIRAHSFRFSEN

SEQ ID NO: 2818258 - protein, 27 aa, Entamoeba invadens
GNGSFGIVFLGTFRRKKVAIKKMKQST

SEQ ID NO: 2818259 - protein, 25 aa, Entamoeba invadens
GNGTTLTKSFYFLDNNYINIKTLFI

SEQ ID NO: 2818260 - protein, 36 aa, Entamoeba invadens
GNHYSSIATPLVFLFRAEPYTYMHMKLFDGHFDTER

SEQ ID NO: 2818261 - protein, 18 aa, Entamoeba invadens
GNIFIVGSNNFKLSSTLT

SEQ ID NO: 2818262 - protein, 22 aa, Entamoeba invadens
GNKYMMVIIHTPNNPKFVFYFD

SEQ ID NO: 2818263 - protein, 23 aa, Entamoeba invadens
GNNLILFFCKMNFTVTGNTISTV

SEQ ID NO: 2818264 - protein, 29 aa, Entamoeba invadens
GNQELVYMHLYIRLMRKIFKHSPKSGEKF

SEQ ID NO: 2818265 - protein, 37 aa, Entamoeba invadens
GNQFPLNIYFPFFCFMAFGFIDFFASLFLPKSINFPK

SEQ ID NO: 2818266 - protein, 29 aa, Entamoeba invadens
GNSAFMGTKLVTLILPTTPITTFGTGVFE

SEQ ID NO: 2818267 - protein, 24 aa, Entamoeba invadens
GNSTFFVIFPLLMIAEYGVGGFNF

SEQ ID NO: 2818268 - protein, 33 aa, Entamoeba invadens
GNTYSFYFGALLPLIIFVVFPRIPGYKNDQTNP

SEQ ID NO: 2818269 - protein, 19 aa, Entamoeba invadens
GNVALLIHIFSVVKIEIKK

SEQ ID NO: 2818270 - protein, 21 aa, Entamoeba invadens
GNYAYEFTAVDKFPLSLDTNT

SEQ ID NO: 2818271 - protein, 24 aa, Entamoeba invadens
GNYIPSYILSTQTKLGFSYILGGI

SEQ ID NO: 2818272 - protein, 23 aa, Entamoeba invadens
GNYKGNLVAIKKMKQIASPNTLT

SEQ ID NO: 2818273 - protein, 23 aa, Entamoeba invadens
GNYKGNLVAIKKMKQIASTNTLT

SEQ ID NO: 2818274 - protein, 25 aa, Entamoeba invadens
GNYNSSLFPIKYTSGIAILISHNRL

SEQ ID NO: 2818275 - protein, 23 aa, Entamoeba invadens
GNYRGNIVAIKKMKQIASPNTVT

SEQ ID NO: 2818276 - protein, 20 aa, Entamoeba invadens
GPAMTAKLTTLLSLGNHFHE

SEQ ID NO: 2818277 - protein, 31 aa, Entamoeba invadens
GPEGTLLGLLTPTQTFNLPQSLKPARRNAQI

SEQ ID NO: 2818278 - protein, 27 aa, Entamoeba invadens
GPEKACQTPVFDLRWVPELERFKRSQQ

SEQ ID NO: 2818279 - protein, 22 aa, Entamoeba invadens
GPFMSFLMFLTMVLNKVELDVE

SEQ ID NO: 2818280 - protein, 24 aa, Entamoeba invadens
GPLDGLVVSFFFYDSKKNERVTSS

SEQ ID NO: 2818281 - protein, 19 aa, Entamoeba invadens
GPLYSFYYELKQIIRDAND

SEQ ID NO: 2818282 - protein, 23 aa, Entamoeba invadens
GPNNTMFSLSVFPKSLFTSSKIN

SEQ ID NO: 2818283 - protein, 17 aa, Entamoeba invadens
GPPLPVELLIAPGGVTK

SEQ ID NO: 2818284 - protein, 26 aa, Entamoeba invadens
GPVESFFYVFYFGAVSFFMSSRFTCQ

SEQ ID NO: 2818285 - protein, 18 aa, Entamoeba invadens
GPVHLPNASLFLSGSVEF

SEQ ID NO: 2818286 - protein, 23 aa, Entamoeba invadens
GQDHWYCAVFTFQTLQKNPLVLV

SEQ ID NO: 2818287 - protein, 28 aa, Entamoeba invadens
GQFVPFGWFVYLFFRWPNGFYNIKKGDH

SEQ ID NO: 2818288 - protein, 18 aa, Entamoeba invadens
GQIALFIPVPEQKVKKFK

SEQ ID NO: 2818289 - protein, 25 aa, Entamoeba invadens
GQIFAKIFFALLIGSIFFDIKNDQQ

SEQ ID NO: 2818290 - protein, 19 aa, Entamoeba invadens
GQIKLWIEPLYLECVHTSS

SEQ ID NO: 2818291 - protein, 34 aa, Entamoeba invadens
GQIKTTWVYVNLFFLVFLCPLLNTPQLFVEGISQ

SEQ ID NO: 2818292 - protein, 25 aa, Entamoeba invadens
GQNCLSCFYGYTLNGTTCIKCTDHC

SEQ ID NO: 2818293 - protein, 18 aa, Entamoeba invadens
GQNCYQYPAKSPLVSIIL

SEQ ID NO: 2818294 - protein, 26 aa, Entamoeba invadens
GQNLPITFSITKFGIDHLKISKGTAV

SEQ ID NO: 2818295 - protein, 24 aa, Entamoeba invadens
GQNNKYRYLISVTPPVVLLKKNEA

SEQ ID NO: 2818296 - protein, 20 aa, Entamoeba invadens
GQQCSLCELGYSLNNSKCEK

SEQ ID NO: 2818297 - protein, 21 aa, Entamoeba invadens
GQQICLRCYGNYSFGTESGKT

SEQ ID NO: 2818298 - protein, 20 aa, Entamoeba invadens
GQSEFYIGADAFLIFSKRQH

SEQ ID NO: 2818299 - protein, 19 aa, Entamoeba invadens
GQSKFWIEPLYLECVQTSS

SEQ ID NO: 2818300 - protein, 19 aa, Entamoeba invadens
GQTKLWIEPLYLECVHTSS

SEQ ID NO: 2818301 - protein, 23 aa, Entamoeba invadens
GQTPFQYIRTFAEMFAGMKNEHA

SEQ ID NO: 2818302 - protein, 22 aa, Entamoeba invadens
GQTPILVALRFNHPEIALEIVK

SEQ ID NO: 2818303 - protein, 21 aa, Entamoeba invadens
GQTQKLLFSKLNDKYVFYQQK

SEQ ID NO: 2818304 - protein, 37 aa, Entamoeba invadens
GQVIVDGIIEEDIIALYLVFFALADNTLSEDDGILFL

SEQ ID NO: 2818305 - protein, 23 aa, Entamoeba invadens
GQVRVQMLQIPSSTLWISFHELP

SEQ ID NO: 2818306 - protein, 19 aa, Entamoeba invadens
GQVWKLLIGYIPCERQKQF

SEQ ID NO: 2818307 - protein, 25 aa, Entamoeba invadens
GQYILTLIMTPSYPPVLQLFDHFDP

SEQ ID NO: 2818308 - protein, 37 aa, Entamoeba invadens
GQYQVTNFFNDLTNGLSLILFMETLSRNHMKRYNKTP

SEQ ID NO: 2818309 - protein, 18 aa, Entamoeba invadens
GQYSPLSYILFQNETIQT

SEQ ID NO: 2818310 - protein, 29 aa, Entamoeba invadens
GRCGQIVCTPGQFITPEKTCRNCKATYED

SEQ ID NO: 2818311 - protein, 19 aa, Entamoeba invadens
GRCLTCIEGYLLTKIGECE

SEQ ID NO: 2818312 - protein, 20 aa, Entamoeba invadens
GRCPADRYFDISTLSCMPCK

SEQ ID NO: 2818313 - protein, 18 aa, Entamoeba invadens
GRCVLSHCLTFVINLNTT

SEQ ID NO: 2818314 - protein, 19 aa, Entamoeba invadens
GREAPGKCFRLFTKSNFDK

SEQ ID NO: 2818315 - protein, 27 aa, Entamoeba invadens
GRFVLTQYAFYFIPYVEENIATKSANL

SEQ ID NO: 2818316 - protein, 23 aa, Entamoeba invadens
GRIEEKRWYVKGKGLPIHNDENG

SEQ ID NO: 2818317 - protein, 17 aa, Entamoeba invadens
GRIFTGVCSFKLDNCSI

SEQ ID NO: 2818318 - protein, 20 aa, Entamoeba invadens
GRIPVLTWFDQKSQKALLRS

SEQ ID NO: 2818319 - protein, 25 aa, Entamoeba invadens
GRNITFLGKVILPDSPILITGSVIF

SEQ ID NO: 2818320 - protein, 17 aa, Entamoeba invadens
GRPLFAKLPLYENGRVV

SEQ ID NO: 2818321 - protein, 32 aa, Entamoeba invadens
GRRAFYVESLLNGYMCYCNYTNGIWDPSDAFL

SEQ ID NO: 2818322 - protein, 28 aa, Entamoeba invadens
GRRIPVINIFLSPFVFSALVCMIDRLIC

SEQ ID NO: 2818323 - protein, 34 aa, Entamoeba invadens
GRSVFMTIFGLISFALFLLLTYCHYKAIHTSPGV

SEQ ID NO: 2818324 - protein, 45 aa, Entamoeba invadens
GRVKLKWRPVHFITWTVILSIIHISFIVQCILGYGGVIMSCVYTI

SEQ ID NO: 2818325 - protein, 52 aa, Entamoeba invadens
GRVPLHVYWQYIKSGSLLMFFIMWLCLAGRICALYFYNTYLTKWGKSIRPLK

SEQ ID NO: 2818326 - protein, 52 aa, Entamoeba invadens
GRVPLHVYWQYIKSGSLLMFFIMWLCLAGRICALYYYNTYLTKWGKSIRPLK

SEQ ID NO: 2818327 - protein, 25 aa, Entamoeba invadens
GRVPLRVFWEYIKSGSLVMFVIMWI

SEQ ID NO: 2818328 - protein, 24 aa, Entamoeba invadens
GRVVPLNIWNFCFGDGLHLSHFNQ

SEQ ID NO: 2818329 - protein, 20 aa, Entamoeba invadens
GRVYFLSNIDAPTGLKKTCV

SEQ ID NO: 2818330 - protein, 25 aa, Entamoeba invadens
GSAALTLFLFLYTNFHYISFHITRF

SEQ ID NO: 2818331 - protein, 28 aa, Entamoeba invadens
GSADAYFFNPIYKGQFSYLYKLKVMKDI

SEQ ID NO: 2818332 - protein, 27 aa, Entamoeba invadens
GSAFEELMFFKWYIKHINMDGTGTMYD

SEQ ID NO: 2818333 - protein, 21 aa, Entamoeba invadens
GSCVPLPPGVKYYINDTTLEC

SEQ ID NO: 2818334 - protein, 17 aa, Entamoeba invadens
GSDEYLELPYHLKLRIL

SEQ ID NO: 2818335 - protein, 47 aa, Entamoeba invadens
GSENFFKMFRFFETIDQILLFWGLVGSLLVGILDPLVVLILGNVFDA

SEQ ID NO: 2818336 - protein, 22 aa, Entamoeba invadens
GSFAEYFVLSLLSVKKLDFSVV

SEQ ID NO: 2818337 - protein, 43 aa, Entamoeba invadens
GSFCKTAMRYDIIFGTIVGVVILIILVLVIVVVLCYQINLHNK

SEQ ID NO: 2818338 - protein, 19 aa, Entamoeba invadens
GSFCKTAMRYDIIFVTNVA

SEQ ID NO: 2818339 - protein, 24 aa, Entamoeba invadens
GSFGIVFLGYYRGNKVAIKYARNI

SEQ ID NO: 2818340 - protein, 18 aa, Entamoeba invadens
GSFGIVYKGAYRGNVVAI

SEQ ID NO: 2818341 - protein, 18 aa, Entamoeba invadens
GSFGIVYKGTFRGNVVCI

SEQ ID NO: 2818342 - protein, 25 aa, Entamoeba invadens
GSFGIVYLGEFRGLKVAIKKLREGC

SEQ ID NO: 2818343 - protein, 20 aa, Entamoeba invadens
GSFGIVYLGTFRGNKVAIKK

SEQ ID NO: 2818344 - protein, 32 aa, Entamoeba invadens
GSFGVECVLTLFLFMIAFPNSLYLARGNHETK

SEQ ID NO: 2818345 - protein, 26 aa, Entamoeba invadens
GSFGVVFLGFYKGNRVAIKKLKITQI

SEQ ID NO: 2818346 - protein, 23 aa, Entamoeba invadens
GSGCATCIKFVESKTVKCIKCTA

SEQ ID NO: 2818347 - protein, 24 aa, Entamoeba invadens
GSGKTFIILSLLNKLEKSTGEVAL

SEQ ID NO: 2818348 - protein, 26 aa, Entamoeba invadens
GSGYPANMLIPFDNPIMGKFVVDTSN

SEQ ID NO: 2818349 - protein, 31 aa, Entamoeba invadens
GSIIGFIVVILILIIIIVLLVKTDKVSIETF

SEQ ID NO: 2818350 - protein, 18 aa, Entamoeba invadens
GSISRIKSHIKSDKLCFG

SEQ ID NO: 2818351 - protein, 29 aa, Entamoeba invadens
GSITYIPQISIVLDYFFLGSLEDYIRIDN

SEQ ID NO: 2818352 - protein, 26 aa, Entamoeba invadens
GSIVLFVLGFIFPCFWLINGCMCCCS

SEQ ID NO: 2818353 - protein, 24 aa, Entamoeba invadens
GSLAFYVKMLIEKIDLLITNINIT

SEQ ID NO: 2818354 - protein, 18 aa, Entamoeba invadens
GSLIYGMILGAITGYYQM

SEQ ID NO: 2818355 - protein, 28 aa, Entamoeba invadens
GSLSLPKLYRFSDTLDLLLLFGGIIGDV

SEQ ID NO: 2818356 - protein, 33 aa, Entamoeba invadens
GSLSRIWGKHDVSYLLKVKILEDVAFALSYLHQ

SEQ ID NO: 2818357 - protein, 19 aa, Entamoeba invadens
GSLSYLISKKKILTKYLRV

SEQ ID NO: 2818358 - protein, 26 aa, Entamoeba invadens
GSLVICKYYFDIYDNTTFTLEKGGQL

SEQ ID NO: 2818359 - protein, 26 aa, Entamoeba invadens
GSMGPPIYLKILLNASPDVLEIQQRI

SEQ ID NO: 2818360 - protein, 23 aa, Entamoeba invadens
GSNMTFLSPVYLPNDNLIIDGMV

SEQ ID NO: 2818361 - protein, 17 aa, Entamoeba invadens
GSPQLYLALLVAFSLLA

SEQ ID NO: 2818362 - protein, 17 aa, Entamoeba invadens
GSQYPLLNYWNDKIDEA

SEQ ID NO: 2818363 - protein, 31 aa, Entamoeba invadens
GSRFGIPYQYSLIVLLVFQACAIGSLVLCTI

SEQ ID NO: 2818364 - protein, 25 aa, Entamoeba invadens
GSRICTNCMVGYFPQSDGRCGLCDT

SEQ ID NO: 2818365 - protein, 43 aa, Entamoeba invadens
GSSCVTKAVWWVIFIIVLIVILLFIILLIVIVVITKMILDKLH

SEQ ID NO: 2818366 - protein, 43 aa, Entamoeba invadens
GSSCVTKAVWWVIFIIVLIVILLLIILLIVIIVVTKMILDKLH

SEQ ID NO: 2818367 - protein, 31 aa, Entamoeba invadens
GSSITLPTTIALGIFILPTSVANPPGAYNCP

SEQ ID NO: 2818368 - protein, 27 aa, Entamoeba invadens
GSSYPAYMVIPLDNPIMGNMCYILGGV

SEQ ID NO: 2818369 - protein, 28 aa, Entamoeba invadens
GSTFEETMFFKWYIKHIKMDATGTMYDS

SEQ ID NO: 2818370 - protein, 26 aa, Entamoeba invadens
GSTGNWNPFFLTFDNLGLAPRINYGE

SEQ ID NO: 2818371 - protein, 25 aa, Entamoeba invadens
GSTICDYCPFLTYSNRGWPHCKKCS

SEQ ID NO: 2818372 - protein, 24 aa, Entamoeba invadens
GSTITLKMKKIKSIKFNNIEWDSE

SEQ ID NO: 2818373 - protein, 29 aa, Entamoeba invadens
GSTQWYAYIIRYLILAFPLVNLTSSFPIV

SEQ ID NO: 2818374 - protein, 28 aa, Entamoeba invadens
GSVCTLYNNVYFDYLCKSTSIIDIEDFK

SEQ ID NO: 2818375 - protein, 23 aa, Entamoeba invadens
GSVEFIYYLGDEAKKLILPHSVC

SEQ ID NO: 2818376 - protein, 18 aa, Entamoeba invadens
GSVIAGVAIFIKNKRHHN

SEQ ID NO: 2818377 - protein, 24 aa, Entamoeba invadens
GSVRMPKIIGMVIEYAPYGSLRNN

SEQ ID NO: 2818378 - protein, 21 aa, Entamoeba invadens
GSVSFIYIIPISTAFVNFLTV

SEQ ID NO: 2818379 - protein, 24 aa, Entamoeba invadens
GSVSWNIFTLTMTTTLLYGKITAT

SEQ ID NO: 2818380 - protein, 46 aa, Entamoeba invadens
GSYCEKYTPAWLVIVIVFAILVMFVLFVALLLIASLVLLKKMKERR

SEQ ID NO: 2818381 - protein, 22 aa, Entamoeba invadens
GSYLLVCVAIAVLIRIYSVLRY

SEQ ID NO: 2818382 - protein, 31 aa, Entamoeba invadens
GSYTFFDLCWRFAFIFYSVIVVLAFLITFRK

SEQ ID NO: 2818383 - protein, 40 aa, Entamoeba invadens
GTACDLKAVWWVLLFVIVISILVVILIIAVVVVTTNHIIT

SEQ ID NO: 2818384 - protein, 26 aa, Entamoeba invadens
GTAKSLMQTLFITKFTIGKKRILMDI

SEQ ID NO: 2818385 - protein, 20 aa, Entamoeba invadens
GTCAIFICLVFCGRVILVYY

SEQ ID NO: 2818386 - protein, 23 aa, Entamoeba invadens
GTCKICADGYYKSSYGICSECPL

SEQ ID NO: 2818387 - protein, 26 aa, Entamoeba invadens
GTCKLMHTYYEFLIHLKFDCVICRHK

SEQ ID NO: 2818388 - protein, 18 aa, Entamoeba invadens
GTCQLLLWGYYPDEPSAR

SEQ ID NO: 2818389 - protein, 24 aa, Entamoeba invadens
GTCYLCKEGYYLDNNKCVKCKDNC

SEQ ID NO: 2818390 - protein, 24 aa, Entamoeba invadens
GTDSFNYYIYISISDICELNLEIE

SEQ ID NO: 2818391 - protein, 31 aa, Entamoeba invadens
GTDVYLPPPILKERKRLELMLERIIKREERN

SEQ ID NO: 2818392 - protein, 25 aa, Entamoeba invadens
GTEKPTMELLKRKPFKRTDGLLSKQ

SEQ ID NO: 2818393 - protein, 18 aa, Entamoeba invadens
GTELLKPNLKFAKARPTT

SEQ ID NO: 2818394 - protein, 47 aa, Entamoeba invadens
GTFCNKKVVWWVLLIIVLFIIGVLIILILTIVFVALYVEKKIHQKEI

SEQ ID NO: 2818395 - protein, 18 aa, Entamoeba invadens
GTFLPFLFCTTDQTQHIS

SEQ ID NO: 2818396 - protein, 26 aa, Entamoeba invadens
GTHDKYYYVCSNSYEGFLPCPKGERC

SEQ ID NO: 2818397 - protein, 27 aa, Entamoeba invadens
GTIFTAIWHLFYIITKVPPERVSEEIS

SEQ ID NO: 2818398 - protein, 21 aa, Entamoeba invadens
GTIGVILPLNGGGYLDLESII

SEQ ID NO: 2818399 - protein, 28 aa, Entamoeba invadens
GTIIAYLFPVLYLIQLIFSIAVICFFGF

SEQ ID NO: 2818400 - protein, 18 aa, Entamoeba invadens
GTILLGLAILIISFVIFA

SEQ ID NO: 2818401 - protein, 21 aa, Entamoeba invadens
GTIVFIVRYRKMKGREMLKEY

SEQ ID NO: 2818402 - protein, 23 aa, Entamoeba invadens
GTIVLIVMVVYVSLFVVIGGICI

SEQ ID NO: 2818403 - protein, 23 aa, Entamoeba invadens
GTKALALEMYKKALLTDDVKVPI

SEQ ID NO: 2818404 - protein, 32 aa, Entamoeba invadens
GTKKLVYWIPRILFFLLFFVSVEVTFVYNKIV

SEQ ID NO: 2818405 - protein, 17 aa, Entamoeba invadens
GTKLTAITLPTTAVTAF

SEQ ID NO: 2818406 - protein, 17 aa, Entamoeba invadens
GTKLTAITLPTTAVTTF

SEQ ID NO: 2818407 - protein, 46 aa, Entamoeba invadens
GTLCDKKVVWWVLLVIILFTIIMMILYVLLIVFTVKYIEKKIHQKQ

SEQ ID NO: 2818408 - protein, 41 aa, Entamoeba invadens
GTLCESQIVWWVIFVLVICVLIVFIILIVSIVIVTKTTFNK

SEQ ID NO: 2818409 - protein, 46 aa, Entamoeba invadens
GTLCNKKIVWWVLFIIILFTIIMMIFLILLIVFTVKCIEKKVHQKQ

SEQ ID NO: 2818410 - protein, 23 aa, Entamoeba invadens
GTLDSDFLCVIASGKKFEGPSTF

SEQ ID NO: 2818411 - protein, 23 aa, Entamoeba invadens
GTLFGLLFEFLLENEIKCIGVLK

SEQ ID NO: 2818412 - protein, 21 aa, Entamoeba invadens
GTLFYPVLTKGVIQITLCGVS

SEQ ID NO: 2818413 - protein, 25 aa, Entamoeba invadens
GTLTFFNTIMIFTNTIHFALNENST

SEQ ID NO: 2818414 - protein, 27 aa, Entamoeba invadens
GTLVHVMALYFLLLSIISALIGSTMDI

SEQ ID NO: 2818415 - protein, 23 aa, Entamoeba invadens
GTNIFEQCWDLAIIDFGGSTRIP

SEQ ID NO: 2818416 - protein, 22 aa, Entamoeba invadens
GTPKFMAPEILQRTVYQKPADV

SEQ ID NO: 2818417 - protein, 26 aa, Entamoeba invadens
GTPKYMAPEILNKKHYKKPADVYSFA

SEQ ID NO: 2818418 - protein, 25 aa, Entamoeba invadens
GTPKYMAPEILNKQHYKKPADVYSF

SEQ ID NO: 2818419 - protein, 21 aa, Entamoeba invadens
GTQCKTNFYLVADTSKCVDKC

SEQ ID NO: 2818420 - protein, 22 aa, Entamoeba invadens
GTQKNCYIIINKGGSITIDEFS

SEQ ID NO: 2818421 - protein, 24 aa, Entamoeba invadens
GTRSCTLCKSTFYISDHKKCSKCD

SEQ ID NO: 2818422 - protein, 23 aa, Entamoeba invadens
GTSCLSCYSSCLYCSGPNSNQCT

SEQ ID NO: 2818423 - protein, 24 aa, Entamoeba invadens
GTSMKNYVLPPRDYKYFVFGHVVT

SEQ ID NO: 2818424 - protein, 26 aa, Entamoeba invadens
GTSTYQYCHIILDDLKIISTYETISN

SEQ ID NO: 2818425 - protein, 25 aa, Entamoeba invadens
GTSYCDMCPLGFYQSLEGQSECYEC

SEQ ID NO: 2818426 - protein, 28 aa, Entamoeba invadens
GTTKIQCTLSCDVLLSGAFEIISDNVVI

SEQ ID NO: 2818427 - protein, 19 aa, Entamoeba invadens
GTTQYLFIHSKYAAAPMKD

SEQ ID NO: 2818428 - protein, 23 aa, Entamoeba invadens
GTYAIFIFVALLTGSIVFYVWQV

SEQ ID NO: 2818429 - protein, 49 aa, Entamoeba invadens
GTYCDKSPVWWVIVIVVIVALVILIVVFTVFALVAFLLSHLTKKKKTEE

SEQ ID NO: 2818430 - protein, 47 aa, Entamoeba invadens
GTYCEKHTVWWVILVIVLFIIIVLTLFIIILVFTVKHILKKIHTKEL

SEQ ID NO: 2818431 - protein, 47 aa, Entamoeba invadens
GTYCEKHTVWWVILVIVLFIIIVLTLFIIILVYTVKHILKKIHTKEL

SEQ ID NO: 2818432 - protein, 48 aa, Entamoeba invadens
GTYCEKHTVWWVILVIVLFIIIVLTLFIIILVYTVKYILKNIHTKELE

SEQ ID NO: 2818433 - protein, 48 aa, Entamoeba invadens
GTYCEKHTVWWVILVIVLFIIIVLTLFIILLVFTVKHILKKIHTKELE

SEQ ID NO: 2818434 - protein, 45 aa, Entamoeba invadens
GTYCNSHVVWWVILIGVLLIIVIFIVTTLVIVLIVKHVSKYLKEK

SEQ ID NO: 2818435 - protein, 50 aa, Entamoeba invadens
GTYCTTQAEWWVILIIIISLILLIIIIILIVYFFTKRVLEKIHLKAASKS

SEQ ID NO: 2818436 - protein, 35 aa, Entamoeba invadens
GTYSVLIPPTLELPHEFWLEIFPDGLVVSKTPRKP

SEQ ID NO: 2818437 - protein, 21 aa, Entamoeba invadens
GVACFILHFCFFVLSEQQGIK

SEQ ID NO: 2818438 - protein, 26 aa, Entamoeba invadens
GVCEQQSVYWLVRNGVVFGCKAGTYL

SEQ ID NO: 2818439 - protein, 30 aa, Entamoeba invadens
GVCKFIEKMILEGTKFLVFAHHQEMLDAIE

SEQ ID NO: 2818440 - protein, 30 aa, Entamoeba invadens
GVCLSCIEGYYLEYGKCYWCYIKEHCVECS

SEQ ID NO: 2818441 - protein, 19 aa, Entamoeba invadens
GVCVLCEDTFILKNEKCIP

SEQ ID NO: 2818442 - protein, 28 aa, Entamoeba invadens
GVCYRCNSGFYLTPIYTKGVICTACSAL

SEQ ID NO: 2818443 - protein, 18 aa, Entamoeba invadens
GVDILVSFIMKKVKKDKD

SEQ ID NO: 2818444 - protein, 20 aa, Entamoeba invadens
GVDMVYLGAQKERILCSTKE

SEQ ID NO: 2818445 - protein, 22 aa, Entamoeba invadens
GVFAGLVYVSFKMTRKPKKVVM

SEQ ID NO: 2818446 - protein, 26 aa, Entamoeba invadens
GVFVIIAILLFILTKTSPRKFADKRF

SEQ ID NO: 2818447 - protein, 20 aa, Entamoeba invadens
GVGIWFTNTQIFQGEAHGGP

SEQ ID NO: 2818448 - protein, 33 aa, Entamoeba invadens
GVGKTTWWAFIIKYLILLFPIVNLTNEFPLVAT

SEQ ID NO: 2818449 - protein, 17 aa, Entamoeba invadens
GVGLFFSSMIRTIIFDL

SEQ ID NO: 2818450 - protein, 26 aa, Entamoeba invadens
GVGLVPALLIYFAVRTKYVLQLIQQK

SEQ ID NO: 2818451 - protein, 24 aa, Entamoeba invadens
GVGNVRFFVCFLVSFAISLLLAFV

SEQ ID NO: 2818452 - protein, 25 aa, Entamoeba invadens
GVHPTSFLLILFSVTLSGVLGNLLD

SEQ ID NO: 2818453 - protein, 26 aa, Entamoeba invadens
GVICSCPQGYYYNSYFRQCFKQVGGV

SEQ ID NO: 2818454 - protein, 24 aa, Entamoeba invadens
GVIEYICKFGFIKNILQTMMNSTD

SEQ ID NO: 2818455 - protein, 32 aa, Entamoeba invadens
GVIFAIPKMPVMWLYCWGMSVVLWVCCWRQRG

SEQ ID NO: 2818456 - protein, 20 aa, Entamoeba invadens
GVIICLTMHYLLTKKIRQDI

SEQ ID NO: 2818457 - protein, 18 aa, Entamoeba invadens
GVIIGIVVSVIVCVIIAV

SEQ ID NO: 2818458 - protein, 24 aa, Entamoeba invadens
GVIIVFVVIVLGSIIIFELVRERA

SEQ ID NO: 2818459 - protein, 28 aa, Entamoeba invadens
GVIQAGIFFSLFYFVINGTDVTFYGKVN

SEQ ID NO: 2818460 - protein, 18 aa, Entamoeba invadens
GVITSLVLVLTNKYYRSF

SEQ ID NO: 2818461 - protein, 44 aa, Entamoeba invadens
GVIVGVPITIIIVLIIVITVGIIITIFFIIRHKEKIETLNICVF

SEQ ID NO: 2818462 - protein, 17 aa, Entamoeba invadens
GVIVLKRPFKRVGQSHV

SEQ ID NO: 2818463 - protein, 19 aa, Entamoeba invadens
GVLIIGKIIYRNVINRLNT

SEQ ID NO: 2818464 - protein, 31 aa, Entamoeba invadens
GVLIITEPVFDPLIFFYARNIELLNQTKGDL

SEQ ID NO: 2818465 - protein, 23 aa, Entamoeba invadens
GVLLLEILLRFYGAAHVEIFSDL

SEQ ID NO: 2818466 - protein, 25 aa, Entamoeba invadens
GVLLNGKCILTPTDIILEIVDNYDT

SEQ ID NO: 2818467 - protein, 18 aa, Entamoeba invadens
GVLLRKKICRLWSRVNPD

SEQ ID NO: 2818468 - protein, 34 aa, Entamoeba invadens
GVLLVMTAATIWFFQKYKIKFAIVFSLFCVVLVT

SEQ ID NO: 2818469 - protein, 26 aa, Entamoeba invadens
GVLMFVAIFIFVVLLIVAFFLGFENS

SEQ ID NO: 2818470 - protein, 18 aa, Entamoeba invadens
GVLMIRFGDAANMYALFL

SEQ ID NO: 2818471 - protein, 27 aa, Entamoeba invadens
GVLVMSRTYFNYTYLPKGENAFAPKIN

SEQ ID NO: 2818472 - protein, 38 aa, Entamoeba invadens
GVLVMSTWTYLILINLITFLITLHSMVYFVTPLNTIET

SEQ ID NO: 2818473 - protein, 25 aa, Entamoeba invadens
GVLVYFVYLITFTPLPSYFVTLQID

SEQ ID NO: 2818474 - protein, 27 aa, Entamoeba invadens
GVMLSCLYLAYDIHPLYDFTSSNLFDA

SEQ ID NO: 2818475 - protein, 22 aa, Entamoeba invadens
GVMYAFSYVLFWIPIQTSISRE

SEQ ID NO: 2818476 - protein, 21 aa, Entamoeba invadens
GVPLTYRNLSASSSSLWMRVP

SEQ ID NO: 2818477 - protein, 26 aa, Entamoeba invadens
GVQSFGIDLFSGFPAWSSWEYIVSEA

SEQ ID NO: 2818478 - protein, 24 aa, Entamoeba invadens
GVSGVLQFYYVRFFGTNIDKHLDG

SEQ ID NO: 2818479 - protein, 39 aa, Entamoeba invadens
GVSHLVILFFILLYCMDFLFESTLFRKFNLYIASGLTII

SEQ ID NO: 2818480 - protein, 25 aa, Entamoeba invadens
GVSQNQFFNLWALIAEHCKDEETVL

SEQ ID NO: 2818481 - protein, 24 aa, Entamoeba invadens
GVSVDLIMMLLSPTIKKAILVPLT

SEQ ID NO: 2818482 - protein, 22 aa, Entamoeba invadens
GVTKLILVGKNKSNKFIITEPP

SEQ ID NO: 2818483 - protein, 26 aa, Entamoeba invadens
GVTSEFPILGLMRKWLKTIYEGGYDN

SEQ ID NO: 2818484 - protein, 41 aa, Entamoeba invadens
GVVFGIPIVSVFIIVLIIVGIIIITIIVLQKRKETKKMENI

SEQ ID NO: 2818485 - protein, 17 aa, Entamoeba invadens
GVVFMSGLFLLAFFFFN

SEQ ID NO: 2818486 - protein, 27 aa, Entamoeba invadens
GVVGLTRALLILDYMLRYHNDFSVDLL

SEQ ID NO: 2818487 - protein, 26 aa, Entamoeba invadens
GVVICMFIISIIFLVVTFTLKCKDFT

SEQ ID NO: 2818488 - protein, 43 aa, Entamoeba invadens
GVVIGIPITVRILLVIFITMIILLIIILLNKRQVKKKMQNVCV

SEQ ID NO: 2818489 - protein, 43 aa, Entamoeba invadens
GVVIGIPLSVVIVLIIIVSIIIVLLYLLVLKKKEEVKMRNICV

SEQ ID NO: 2818490 - protein, 39 aa, Entamoeba invadens
GVVIGIPVAVLIVFFILIAIILVVVLFINTKKKEKMKMK

SEQ ID NO: 2818491 - protein, 22 aa, Entamoeba invadens
GVVLPALLPKYTTVNNALLTVE

SEQ ID NO: 2818492 - protein, 43 aa, Entamoeba invadens
GVVVGIPIVIVLILLLVIISIIIIIVLVFHKQEKTKKMENICV

SEQ ID NO: 2818493 - protein, 41 aa, Entamoeba invadens
GVVVGIPIVSVFIIVFIIIGFLIITIVVLQKRKETKKMENI

SEQ ID NO: 2818494 - protein, 45 aa, Entamoeba invadens
GVVVGVPISVVLLLVLLIVCVIVTILYILMKRKEKVKMENVCVFR

SEQ ID NO: 2818495 - protein, 18 aa, Entamoeba invadens
GVVYFFLSLVLDVSDTIA

SEQ ID NO: 2818496 - protein, 21 aa, Entamoeba invadens
GVVYLGLYRGAYVAVKTFNWE

SEQ ID NO: 2818497 - protein, 36 aa, Entamoeba invadens
GVYCKWHYIILYLVALLLNLPLIIPKSVKFLNRISM

SEQ ID NO: 2818498 - protein, 37 aa, Entamoeba invadens
GVYCKWHYIILYLVAVLLNFPLIIPKSVKFLNRISML

SEQ ID NO: 2818499 - protein, 27 aa, Entamoeba invadens
GVYPSLLILILFFFLNNITAGYVLEAL

SEQ ID NO: 2818500 - protein, 34 aa, Entamoeba invadens
GWAVVSMYITFSGFFMVFFTLMTQVKTWNWWTVF

SEQ ID NO: 2818501 - protein, 20 aa, Entamoeba invadens
GWCEAIPITTFKFPWKIAEF

SEQ ID NO: 2818502 - protein, 22 aa, Entamoeba invadens
GWCIYTCFVFIILGLIGCGATQ

SEQ ID NO: 2818503 - protein, 28 aa, Entamoeba invadens
GWECGYRIVFFIHKLLLGCSLYDSVKYN

SEQ ID NO: 2818504 - protein, 36 aa, Entamoeba invadens
GWELYQIVTWYIIFSIFMCLVMLTLVIGSYVCILVG

SEQ ID NO: 2818505 - protein, 28 aa, Entamoeba invadens
GWHYIILYLVAVILNFPLIIPRSVKFLS

SEQ ID NO: 2818506 - protein, 17 aa, Entamoeba invadens
GWNRYFIKAQTAGSLCT

SEQ ID NO: 2818507 - protein, 18 aa, Entamoeba invadens
GWQYKQMFNLLAFGAMLV

SEQ ID NO: 2818508 - protein, 22 aa, Entamoeba invadens
GWSNAYPIETFKFPWKIAEFVM

SEQ ID NO: 2818509 - protein, 31 aa, Entamoeba invadens
GWYMSALQLFDTFIPLLPIRVLFFIFSVVGV

SEQ ID NO: 2818510 - protein, 24 aa, Entamoeba invadens
GYACEFEIFITPKCTLKTQDNFVI

SEQ ID NO: 2818511 - protein, 22 aa, Entamoeba invadens
GYAVFHLLRWLPGSEENVERIK

SEQ ID NO: 2818512 - protein, 24 aa, Entamoeba invadens
GYCCEFHIYLKPMCTCRVVEDIVF

SEQ ID NO: 2818513 - protein, 17 aa, Entamoeba invadens
GYCFAGKSGYYTTRQDS

SEQ ID NO: 2818514 - protein, 22 aa, Entamoeba invadens
GYCLSCVTGFVLSASPSQHCIT

SEQ ID NO: 2818515 - protein, 23 aa, Entamoeba invadens
GYCTSCISGYYLYGAECITNEQS

SEQ ID NO: 2818516 - protein, 25 aa, Entamoeba invadens
GYCVHKLDLHYSFDSTKTNPQCADG

SEQ ID NO: 2818517 - protein, 24 aa, Entamoeba invadens
GYDQALFNVLYYNGTFNSIGAEAS

SEQ ID NO: 2818518 - protein, 24 aa, Entamoeba invadens
GYDQALLNVLYYHGKFNSTGLKLV

SEQ ID NO: 2818519 - protein, 23 aa, Entamoeba invadens
GYDRLMLCLFMPELINFVISIPQ

SEQ ID NO: 2818520 - protein, 31 aa, Entamoeba invadens
GYDVWNMFNNLFKCLPLCAVVDNKLFCVHGG

SEQ ID NO: 2818521 - protein, 26 aa, Entamoeba invadens
GYETVCLMLFIFHNLSRDSRILYMRK

SEQ ID NO: 2818522 - protein, 20 aa, Entamoeba invadens
GYFALNGECNLFANGGLEMS

SEQ ID NO: 2818523 - protein, 19 aa, Entamoeba invadens
GYFALNGECNLFSNGGLEM

SEQ ID NO: 2818524 - protein, 18 aa, Entamoeba invadens
GYFNKIEMYKIDSLPNLN

SEQ ID NO: 2818525 - protein, 23 aa, Entamoeba invadens
GYGKVGVLLWLLDLEDMLCPDNE

SEQ ID NO: 2818526 - protein, 19 aa, Entamoeba invadens
GYHIMIVSKYFKTINDFIN

SEQ ID NO: 2818527 - protein, 30 aa, Entamoeba invadens
GYHNFRYFFLFLFYLWVSVLFVVFNIYEIF

SEQ ID NO: 2818528 - protein, 31 aa, Entamoeba invadens
GYIIYHVIHLYFNQHKLIFYPTHNGEDFPTL

SEQ ID NO: 2818529 - protein, 19 aa, Entamoeba invadens
GYIKFSTVFRGISAGIILG

SEQ ID NO: 2818530 - protein, 24 aa, Entamoeba invadens
GYIKFSTVFRGLSAGIILGGGIDI

SEQ ID NO: 2818531 - protein, 30 aa, Entamoeba invadens
GYIPTGTHLYFKQLLRYGNLTDFFCHVEHF

SEQ ID NO: 2818532 - protein, 20 aa, Entamoeba invadens
GYIQNGIYVCLLCGTAKPIS

SEQ ID NO: 2818533 - protein, 27 aa, Entamoeba invadens
GYKIFIYIIALIIPPFLAIFVRYFKTT

SEQ ID NO: 2818534 - protein, 21 aa, Entamoeba invadens
GYLISNKKLIRFCPNGTQLDT

SEQ ID NO: 2818535 - protein, 25 aa, Entamoeba invadens
GYLKIDGRLITTLNIKWLRNQIGLV

SEQ ID NO: 2818536 - protein, 26 aa, Entamoeba invadens
GYLWMLIPVILLVLYFFCTYVIDRYF

SEQ ID NO: 2818537 - protein, 17 aa, Entamoeba invadens
GYNIKCDVVYRRNYLYK

SEQ ID NO: 2818538 - protein, 25 aa, Entamoeba invadens
GYNYNWQLNLIINYTVYMTDQINIK

SEQ ID NO: 2818539 - protein, 19 aa, Entamoeba invadens
GYSFVIRKPTKTQCKRMSH

SEQ ID NO: 2818540 - protein, 17 aa, Entamoeba invadens
GYSKLPADKFLSILTTL

SEQ ID NO: 2818541 - protein, 17 aa, Entamoeba invadens
GYTIALVKCWDLALVVI

SEQ ID NO: 2818542 - protein, 17 aa, Entamoeba invadens
GYTLNTFGECVFCKTYF

SEQ ID NO: 2818543 - protein, 19 aa, Entamoeba invadens
GYTSFVLFAVVVAAIFVLF

SEQ ID NO: 2818544 - protein, 19 aa, Entamoeba invadens
GYVIGFVKCWDLSLVILSI

SEQ ID NO: 2818545 - protein, 25 aa, Entamoeba invadens
GYYFMTYDVFLEHNLRHPIGGHDTY

SEQ ID NO: 2818546 - protein, 20 aa, Entamoeba invadens
GYYLLNNVCNSCASLFPNCQ

SEQ ID NO: 2818547 - protein, 23 aa, Entamoeba invadens
HWYGLFFHIPWDYSLNGSQNRSC

SEQ ID NO: 2818548 - protein, 28 aa, Entamoeba invadens
HAADTVVFAELYWTPGILRQAEDRVHRI

SEQ ID NO: 2818549 - protein, 24 aa, Entamoeba invadens
HACITIFGFLFLLTYTVYGMADAG

SEQ ID NO: 2818550 - protein, 44 aa, Entamoeba invadens
HAGIYPLAILILLFSCIWPYTKLILLFFTWTTPPTIMSTKVRYR

SEQ ID NO: 2818551 - protein, 25 aa, Entamoeba invadens
HANIVLHQFVLDDVLFGIFPFVDLV

SEQ ID NO: 2818552 - protein, 27 aa, Entamoeba invadens
HAQLSAVFLEYVFYLLLGLNNCITTFF

SEQ ID NO: 2818553 - protein, 17 aa, Entamoeba invadens
HASVKMVFEFFSHFVLT

SEQ ID NO: 2818554 - protein, 17 aa, Entamoeba invadens
HCKMCSRDYARKCYECN

SEQ ID NO: 2818555 - protein, 19 aa, Entamoeba invadens
HCLECEKEHMSLGYGLTQC

SEQ ID NO: 2818556 - protein, 18 aa, Entamoeba invadens
HCLSCRPELEFLNKDNTC

SEQ ID NO: 2818557 - protein, 17 aa, Entamoeba invadens
HCMFFDQVPLKMIYDVR

SEQ ID NO: 2818558 - protein, 18 aa, Entamoeba invadens
HCTKCQDGYFIDATDHKC

SEQ ID NO: 2818559 - protein, 17 aa, Entamoeba invadens
HCTSCYVGMITQNGICV

SEQ ID NO: 2818560 - protein, 21 aa, Entamoeba invadens
HDEMILLFNGTSFTSTTLTQG

SEQ ID NO: 2818561 - protein, 24 aa, Entamoeba invadens
HDFSYITIIMIFITSIGGILVALV

SEQ ID NO: 2818562 - protein, 23 aa, Entamoeba invadens
HDIVNIIYIFTMFVGSYPIQMIR

SEQ ID NO: 2818563 - protein, 27 aa, Entamoeba invadens
HDMRLLKKLLMILTPCSMVLNSLATKV

SEQ ID NO: 2818564 - protein, 21 aa, Entamoeba invadens
HDTSLLEMNFATISVVQAGLP

SEQ ID NO: 2818565 - protein, 26 aa, Entamoeba invadens
HDVLALVKIMLNMFPQWAKLDQTSIF

SEQ ID NO: 2818566 - protein, 23 aa, Entamoeba invadens
HEDPDLHILYGFRAEAFSKYDPE

SEQ ID NO: 2818567 - protein, 33 aa, Entamoeba invadens
HEEAVYIFFAFNAVVFCLFIVITFPVGQIQSGK

SEQ ID NO: 2818568 - protein, 27 aa, Entamoeba invadens
HEEYHPYLLSILTPLLTKAPPKDPTSS

SEQ ID NO: 2818569 - protein, 19 aa, Entamoeba invadens
HEKFLLLMNDSFIYPRELL

SEQ ID NO: 2818570 - protein, 19 aa, Entamoeba invadens
HELLLPYLEKLFEDKSFHQ

SEQ ID NO: 2818571 - protein, 18 aa, Entamoeba invadens
HENGILHRDIKPDNLLVI

SEQ ID NO: 2818572 - protein, 18 aa, Entamoeba invadens
HENGILHRDIKPDNLLVV

SEQ ID NO: 2818573 - protein, 17 aa, Entamoeba invadens
HENGILHRDIKSDNILV

SEQ ID NO: 2818574 - protein, 18 aa, Entamoeba invadens
HENMMFLHKASRTVNRCG

SEQ ID NO: 2818575 - protein, 23 aa, Entamoeba invadens
HENNLFKWSLFQKQIDGSIEEID

SEQ ID NO: 2818576 - protein, 25 aa, Entamoeba invadens
HEVSMLLQMRYVSVVELIGAIYTEG

SEQ ID NO: 2818577 - protein, 18 aa, Entamoeba invadens
HFCFTLRNTTRTVMLYTF

SEQ ID NO: 2818578 - protein, 25 aa, Entamoeba invadens
HFDKEELLEFFYYPIKMSVKSVKHQ

SEQ ID NO: 2818579 - protein, 26 aa, Entamoeba invadens
HFEMPKDMFMSDDSMFYFFFGIAQES

SEQ ID NO: 2818580 - protein, 22 aa, Entamoeba invadens
HFEPFSFLLKRIIRLQPMQVLS

SEQ ID NO: 2818581 - protein, 18 aa, Entamoeba invadens
HFHFLNPAFEGFFRSINE

SEQ ID NO: 2818582 - protein, 23 aa, Entamoeba invadens
HFKRHMQKVMRPKLFPVFENCAD

SEQ ID NO: 2818583 - protein, 27 aa, Entamoeba invadens
HFMIYGTFLTLLYLVGSVLLSYAIFEI

SEQ ID NO: 2818584 - protein, 18 aa, Entamoeba invadens
HFMNGFFIMWRLKDCAIG

SEQ ID NO: 2818585 - protein, 18 aa, Entamoeba invadens
HFNPLPIRTMRFNVETDG

SEQ ID NO: 2818586 - protein, 19 aa, Entamoeba invadens
HFPLFGLFVSILRWVLLFD

SEQ ID NO: 2818587 - protein, 22 aa, Entamoeba invadens
HFRKLLNYIFFGWKIPKNKICK

SEQ ID NO: 2818588 - protein, 18 aa, Entamoeba invadens
HFSFVKWSENQKVEMCLT

SEQ ID NO: 2818589 - protein, 26 aa, Entamoeba invadens
HFSMTSLFLLSILYAFYAFNLKFRLH

SEQ ID NO: 2818590 - protein, 27 aa, Entamoeba invadens
HFVRLIEESLLFFPTKDFKTTSVLLIQ

SEQ ID NO: 2818591 - protein, 20 aa, Entamoeba invadens
HGCAICEDRYYWQGRNCYKC

SEQ ID NO: 2818592 - protein, 17 aa, Entamoeba invadens
HGFFKQVDFAKKTQHVL

SEQ ID NO: 2818593 - protein, 36 aa, Entamoeba invadens
HGGFDSLFRFLGLNPLVFLAIIPVVSDIYTARRGRK

SEQ ID NO: 2818594 - protein, 35 aa, Entamoeba invadens
HGGFDSLFRFLGLNPLVFLAIRPVVSDIYTARRGR

SEQ ID NO: 2818595 - protein, 24 aa, Entamoeba invadens
HGGPTDWKGFALFIDTYDNDRNKD

SEQ ID NO: 2818596 - protein, 20 aa, Entamoeba invadens
HGGVLKWIVRFHPDLVFSLS

SEQ ID NO: 2818597 - protein, 17 aa, Entamoeba invadens
HGIATIVYILVSLISEA

SEQ ID NO: 2818598 - protein, 23 aa, Entamoeba invadens
HGLKSMYLLEYGDRSFWSFNNSN

SEQ ID NO: 2818599 - protein, 20 aa, Entamoeba invadens
HGLYPGYLLFFFCCGIPYEF

SEQ ID NO: 2818600 - protein, 20 aa, Entamoeba invadens
HGVFFVLFIATTVFYIIKNN

SEQ ID NO: 2818601 - protein, 26 aa, Entamoeba invadens
HHASDQFLLEKLKIVAILSVCDIEPY

SEQ ID NO: 2818602 - protein, 27 aa, Entamoeba invadens
HHETIINTAYLFYLTDHSIFTMNDDSI

SEQ ID NO: 2818603 - protein, 24 aa, Entamoeba invadens
HHETIINTAYLLYLTDHSIFTMND

SEQ ID NO: 2818604 - protein, 26 aa, Entamoeba invadens
HHICKTSLVFLLRYFELNSARQEKTF

SEQ ID NO: 2818605 - protein, 37 aa, Entamoeba invadens
HHKMNWLRPLIIPLIKLRPYELLQHLMIITNDLNRME

SEQ ID NO: 2818606 - protein, 17 aa, Entamoeba invadens
HHKVIKFYTVREMTLRI

SEQ ID NO: 2818607 - protein, 31 aa, Entamoeba invadens
HICRCLFLRVIPMDYLVLFVSTLLLEKRLFI

SEQ ID NO: 2818608 - protein, 24 aa, Entamoeba invadens
HIDLSIFRQQQPFYYFDITQSTSL

SEQ ID NO: 2818609 - protein, 26 aa, Entamoeba invadens
HIFQILTYFRRLCVHPKLVLDDNHPM

SEQ ID NO: 2818610 - protein, 20 aa, Entamoeba invadens
HIHTHIYIYIYICVCVYVCV

SEQ ID NO: 2818611 - protein, 25 aa, Entamoeba invadens
HIILIINCVLLFIYYFILLVNFNKL

SEQ ID NO: 2818612 - protein, 29 aa, Entamoeba invadens
HIITIPPNYGCEFSLFLTPLCNSNMESSF

SEQ ID NO: 2818613 - protein, 17 aa, Entamoeba invadens
HILCIIQSLKRVLNLNP

SEQ ID NO: 2818614 - protein, 19 aa, Entamoeba invadens
HILCIVAMLAVDTQFFVSA

SEQ ID NO: 2818615 - protein, 20 aa, Entamoeba invadens
HILVYNMLLMVHILLDTNKC

SEQ ID NO: 2818616 - protein, 17 aa, Entamoeba invadens
HIPITPTNPLYLKNNNE

SEQ ID NO: 2818617 - protein, 28 aa, Entamoeba invadens
HIRKALLLFSVFPMQTLPDAPKLYLKEL

SEQ ID NO: 2818618 - protein, 23 aa, Entamoeba invadens
HISAYWCSDAQDIPPSFITCDMK

SEQ ID NO: 2818619 - protein, 25 aa, Entamoeba invadens
HITIFSIAVFLILTGSYVIFISWVY

SEQ ID NO: 2818620 - protein, 30 aa, Entamoeba invadens
HITQRIFFVLDFSFFIVCDLSLILPRVGLF

SEQ ID NO: 2818621 - protein, 22 aa, Entamoeba invadens
HITRPYKMFSLPVALFCLTPLT

SEQ ID NO: 2818622 - protein, 36 aa, Entamoeba invadens
HIVLITLVTISCIFLFFVLIITVCLTIIISRKERFI

SEQ ID NO: 2818623 - protein, 17 aa, Entamoeba invadens
HIYKELEYPKFEFDEEF

SEQ ID NO: 2818624 - protein, 38 aa, Entamoeba invadens
HIYSLSFVRIIYSNVLLGTIINFLWVGKDQKFYDIVST

SEQ ID NO: 2818625 - protein, 32 aa, Entamoeba invadens
HKIKLLKYDEEYTWCFPPTKASGFFVGPFIME

SEQ ID NO: 2818626 - protein, 19 aa, Entamoeba invadens
HKIMCILVYVLLFPLILVS

SEQ ID NO: 2818627 - protein, 24 aa, Entamoeba invadens
HKKKLFEIALFTAAIMDEGIQPRC

SEQ ID NO: 2818628 - protein, 31 aa, Entamoeba invadens
HKKREDIDIKLRIKMMIDAAKGILYLHENGI

SEQ ID NO: 2818629 - protein, 26 aa, Entamoeba invadens
HKLSKAIFFEVFLTSEEWILIYSNRE

SEQ ID NO: 2818630 - protein, 25 aa, Entamoeba invadens
HKNLIHKLLKCKLGFFDVTPMGRII

SEQ ID NO: 2818631 - protein, 26 aa, Entamoeba invadens
HKNLIHKLLKCKLGFFDVTPMGRIIN

SEQ ID NO: 2818632 - protein, 18 aa, Entamoeba invadens
HKNLIIHRNLSTSTIVIC

SEQ ID NO: 2818633 - protein, 24 aa, Entamoeba invadens
HKNNEVMQTLIWTNDLFSNNTQLL

SEQ ID NO: 2818634 - protein, 17 aa, Entamoeba invadens
HKPLTLNNNLTLTIPLL

SEQ ID NO: 2818635 - protein, 26 aa, Entamoeba invadens
HKQLDVRPLLLNLMKALITFIKSDQT

SEQ ID NO: 2818636 - protein, 28 aa, Entamoeba invadens
HKQMPELVFFSIKFLDVLATKLVLSPKF

SEQ ID NO: 2818637 - protein, 23 aa, Entamoeba invadens
HKSPQLFHLFMTYKTFCIDTFVV

SEQ ID NO: 2818638 - protein, 28 aa, Entamoeba invadens
HKTATEFFFLILTQTFQLNLQLVCMPEI

SEQ ID NO: 2818639 - protein, 34 aa, Entamoeba invadens
HKTRTIFLSLLVLEFITLTPFITITWVKGSQEEL

SEQ ID NO: 2818640 - protein, 18 aa, Entamoeba invadens
HLCVCKSDYELIAGKCLK

SEQ ID NO: 2818641 - protein, 27 aa, Entamoeba invadens
HLDELFVWQLYRVTPSLRLVPITFDNG

SEQ ID NO: 2818642 - protein, 18 aa, Entamoeba invadens
HLDGVVFEFMTRSDVWAS

SEQ ID NO: 2818643 - protein, 42 aa, Entamoeba invadens
HLEITMKYLLLYLLIVVIIFIILPSYSLLFISVRPFSTPYWY

SEQ ID NO: 2818644 - protein, 26 aa, Entamoeba invadens
HLFSNIDQRWWLSFHRDSTMLYSPYL

SEQ ID NO: 2818645 - protein, 19 aa, Entamoeba invadens
HLGTMMVMFPRNLCIKSCR

SEQ ID NO: 2818646 - protein, 23 aa, Entamoeba invadens
HLHDTCHTALPIQIPFSGVFSNH

SEQ ID NO: 2818647 - protein, 20 aa, Entamoeba invadens
HLICFMTIRNYFAMNSPLIT

SEQ ID NO: 2818648 - protein, 18 aa, Entamoeba invadens
HLIFLETVGFLNGDGSSY

SEQ ID NO: 2818649 - protein, 18 aa, Entamoeba invadens
HLKIEQPIECENVMMSAI

SEQ ID NO: 2818650 - protein, 18 aa, Entamoeba invadens
HLKYLVVCSLISSVPALI

SEQ ID NO: 2818651 - protein, 19 aa, Entamoeba invadens
HLLAYLDHRIIRDIPDNVR

SEQ ID NO: 2818652 - protein, 27 aa, Entamoeba invadens
HLLGKLLVISRWLGRNPVLHDITTFNA

SEQ ID NO: 2818653 - protein, 17 aa, Entamoeba invadens
HLLMLQRNNILFPKSQP

SEQ ID NO: 2818654 - protein, 24 aa, Entamoeba invadens
HLLSLVFPALLSFSATYLQNVGLV

SEQ ID NO: 2818655 - protein, 18 aa, Entamoeba invadens
HLMNSLCKIKYGGGTRYS

SEQ ID NO: 2818656 - protein, 28 aa, Entamoeba invadens
HLNIIYTCLSCNLGYYPTNYNCALCNAG

SEQ ID NO: 2818657 - protein, 18 aa, Entamoeba invadens
HLPLLFINGQITNFNRVT

SEQ ID NO: 2818658 - protein, 17 aa, Entamoeba invadens
HLQCALIAFISAKADIK

SEQ ID NO: 2818659 - protein, 20 aa, Entamoeba invadens
HLQLVKLLRRNAETGCFVGD

SEQ ID NO: 2818660 - protein, 22 aa, Entamoeba invadens
HLRKKKLPLGFKYLQKKINVKD

SEQ ID NO: 2818661 - protein, 17 aa, Entamoeba invadens
HLRLLNVSSMYLLKANE

SEQ ID NO: 2818662 - protein, 29 aa, Entamoeba invadens
HLSKQLCYFHKWYKFFNFHGKNISRCGQF

SEQ ID NO: 2818663 - protein, 19 aa, Entamoeba invadens
HLSLPYKLKVRMLYDTARG

SEQ ID NO: 2818664 - protein, 26 aa, Entamoeba invadens
HLSTYSLDILYLMPFENITATVNTIV

SEQ ID NO: 2818665 - protein, 22 aa, Entamoeba invadens
HLTALFVWFFLLFTALYIVTWL

SEQ ID NO: 2818666 - protein, 30 aa, Entamoeba invadens
HLTLLPEKWNEIFLIHFKTNNLMKVVINSE

SEQ ID NO: 2818667 - protein, 18 aa, Entamoeba invadens
HLTTIIQLITILPNPMES

SEQ ID NO: 2818668 - protein, 26 aa, Entamoeba invadens
HLVADYFVVNPIQFSLKGTKVYFSVP

SEQ ID NO: 2818669 - protein, 27 aa, Entamoeba invadens
HLVMAALLALWAFTAYSRLTKKIRQEI

SEQ ID NO: 2818670 - protein, 32 aa, Entamoeba invadens
HLYVLLYIEFGVNVYLLLSWFYEFVVNLHVRR

SEQ ID NO: 2818671 - protein, 17 aa, Entamoeba invadens
HMAVKEMIFALPEKTPQ

SEQ ID NO: 2818672 - protein, 31 aa, Entamoeba invadens
HMKKYINIWFHWIPEMIFMICSFGYLCFLII

SEQ ID NO: 2818673 - protein, 27 aa, Entamoeba invadens
HMLRKHEFFRVLLQTQFYTIVGNYDLS

SEQ ID NO: 2818674 - protein, 17 aa, Entamoeba invadens
HMPQGAYKLIKAVDFMP

SEQ ID NO: 2818675 - protein, 18 aa, Entamoeba invadens
HMWFGEGVCLKIPKDKMS

SEQ ID NO: 2818676 - protein, 18 aa, Entamoeba invadens
HMWKTILPDSFFSSEEFQ

SEQ ID NO: 2818677 - protein, 25 aa, Entamoeba invadens
HNHLFSDFLMMTLSSTLKMIVTMVN

SEQ ID NO: 2818678 - protein, 27 aa, Entamoeba invadens
HNIFQNIFANMYFACIFVGISITQVII

SEQ ID NO: 2818679 - protein, 34 aa, Entamoeba invadens
HNLSRDSRILYMRKLFKIILNAPVKINTKGVVGL

SEQ ID NO: 2818680 - protein, 25 aa, Entamoeba invadens
HNNDILHRDIKPDNFLIVSLDQNVK

SEQ ID NO: 2818681 - protein, 17 aa, Entamoeba invadens
HNPDDFAFWAGVRFVII

SEQ ID NO: 2818682 - protein, 31 aa, Entamoeba invadens
HNRTIRDIPLIQTIFIYFSNANTVVSEFDFD

SEQ ID NO: 2818683 - protein, 29 aa, Entamoeba invadens
HPCHNLKVFCLLLQKTFITYTEKVLKIFC

SEQ ID NO: 2818684 - protein, 22 aa, Entamoeba invadens
HPCYSVYWQYLDTTKYLPTFDA

SEQ ID NO: 2818685 - protein, 17 aa, Entamoeba invadens
HPDFVSISFYKMFGFPT

SEQ ID NO: 2818686 - protein, 29 aa, Entamoeba invadens
HPEPPKYILFYFINALILHFHVYGTIAII

SEQ ID NO: 2818687 - protein, 17 aa, Entamoeba invadens
HPFTLLLVFCAAKTTTD

SEQ ID NO: 2818688 - protein, 23 aa, Entamoeba invadens
HPGLYSILSQLKILSAALLSVII

SEQ ID NO: 2818689 - protein, 25 aa, Entamoeba invadens
HPILMFVVVLVWYASPKLIKNEMMK

SEQ ID NO: 2818690 - protein, 21 aa, Entamoeba invadens
HPKIVLSAYLNLTSDFNVFED

SEQ ID NO: 2818691 - protein, 30 aa, Entamoeba invadens
HPKKVHTTFPFKLLVTGGNFLFMETFVKIE

SEQ ID NO: 2818692 - protein, 20 aa, Entamoeba invadens
HPKMPWSTRLNIAVSIAKGM

SEQ ID NO: 2818693 - protein, 26 aa, Entamoeba invadens
HPKSPSLLRALFRMEWKQLLLCILAM

SEQ ID NO: 2818694 - protein, 27 aa, Entamoeba invadens
HPYQCKSCVTGFYLNTSTYTCEQGATP

SEQ ID NO: 2818695 - protein, 26 aa, Entamoeba invadens
HQETCNLFFFFEESIFFQQSLSFAVK

SEQ ID NO: 2818696 - protein, 28 aa, Entamoeba invadens
HQETGTQCFLLYDITSFTGAVKHAKSCL

SEQ ID NO: 2818697 - protein, 19 aa, Entamoeba invadens
HQIGLTQILFAFLVLTESK

SEQ ID NO: 2818698 - protein, 19 aa, Entamoeba invadens
HQIRLKICIDSAKGLFYLH

SEQ ID NO: 2818699 - protein, 19 aa, Entamoeba invadens
HQISTLVNFYNLSVTHTLS

SEQ ID NO: 2818700 - protein, 24 aa, Entamoeba invadens
HQLNSWFFYQFGDVSNFTTVTAKP

SEQ ID NO: 2818701 - protein, 17 aa, Entamoeba invadens
HQNGILHRDIKPGNILI

SEQ ID NO: 2818702 - protein, 19 aa, Entamoeba invadens
HQQYDPYFLDFLHSCFNVE

SEQ ID NO: 2818703 - protein, 23 aa, Entamoeba invadens
HQTERIFILPPTDTSVQLTPNVT

SEQ ID NO: 2818704 - protein, 19 aa, Entamoeba invadens
HRDFKPDNILIVSLEIFDK

SEQ ID NO: 2818705 - protein, 26 aa, Entamoeba invadens
HRDIKPANLLIFSYDTDEPILAKLTD

SEQ ID NO: 2818706 - protein, 18 aa, Entamoeba invadens
HRDIKPDNFLIFSLEAKD

SEQ ID NO: 2818707 - protein, 24 aa, Entamoeba invadens
HRDIKPDNFLVLSLDLNEIVNAKL

SEQ ID NO: 2818708 - protein, 20 aa, Entamoeba invadens
HRDIKPDNILIFSLDDNERV

SEQ ID NO: 2818709 - protein, 24 aa, Entamoeba invadens
HRDIKPDNILLFSLQPNVQINAKL

SEQ ID NO: 2818710 - protein, 27 aa, Entamoeba invadens
HRDIKPDNILVFLLNINDKVNAKLTDF

SEQ ID NO: 2818711 - protein, 19 aa, Entamoeba invadens
HRDIKPDNILVFSLDTIDK

SEQ ID NO: 2818712 - protein, 17 aa, Entamoeba invadens
HRDIKPDNLLVFSINLK

SEQ ID NO: 2818713 - protein, 24 aa, Entamoeba invadens
HRDIKPDNYLIFSLDINDCVNAKL

SEQ ID NO: 2818714 - protein, 18 aa, Entamoeba invadens
HRDVKGENLLIFSMNPHT

SEQ ID NO: 2818715 - protein, 27 aa, Entamoeba invadens
HRDVKPANLLIFSYDLEETILAKLTDF

SEQ ID NO: 2818716 - protein, 43 aa, Entamoeba invadens
HRGSVWNFVLWWFYGAYQSLIFFLVFYWIILPTDVNGPNGING

SEQ ID NO: 2818717 - protein, 40 aa, Entamoeba invadens
HRHLYKLLGVQSILIFIVFKIIEIFLFKKTLYKDFGFDRT

SEQ ID NO: 2818718 - protein, 24 aa, Entamoeba invadens
HRHNLSVYWYYLSLAFDFPKSTVR

SEQ ID NO: 2818719 - protein, 17 aa, Entamoeba invadens
HRHVVWYWKSENSLFLY

SEQ ID NO: 2818720 - protein, 27 aa, Entamoeba invadens
HRKVWYPVLLIWKVLYFLNRFTYFRIF

SEQ ID NO: 2818721 - protein, 22 aa, Entamoeba invadens
HRNFDRMFCHWNHNVRVFFCEL

SEQ ID NO: 2818722 - protein, 24 aa, Entamoeba invadens
HRQMCGIVIFMYAKPDIANLMKNV

SEQ ID NO: 2818723 - protein, 21 aa, Entamoeba invadens
HSAFTLRWLYTAAHPIFIVLS

SEQ ID NO: 2818724 - protein, 18 aa, Entamoeba invadens
HSCVESYILIKGTCVHFE

SEQ ID NO: 2818725 - protein, 28 aa, Entamoeba invadens
HSEINNNLFIFKFENSFLTLNKFSKINN

SEQ ID NO: 2818726 - protein, 37 aa, Entamoeba invadens
HSFDNGVDIFYYLAMQPWRHFVWTQKENNIWVTNTMN

SEQ ID NO: 2818727 - protein, 24 aa, Entamoeba invadens
HSFPFLLLLTCLATSQSCWHLNNS

SEQ ID NO: 2818728 - protein, 22 aa, Entamoeba invadens
HSFPLLFLLVDCFVFAQGNKRV

SEQ ID NO: 2818729 - protein, 25 aa, Entamoeba invadens
HSGRLSVFNYFSGVILKSVTIKSCA

SEQ ID NO: 2818730 - protein, 18 aa, Entamoeba invadens
HSKLNYIRTFYLRNGGNP

SEQ ID NO: 2818731 - protein, 17 aa, Entamoeba invadens
HSKRRLTANDIFGPLTP

SEQ ID NO: 2818732 - protein, 24 aa, Entamoeba invadens
HSLCFLRIIYVDCLFSEALMYFWI

SEQ ID NO: 2818733 - protein, 17 aa, Entamoeba invadens
HSLRYDVIIRLVGAVYT

SEQ ID NO: 2818734 - protein, 19 aa, Entamoeba invadens
HSMFLDGWSIWNGVIGDEF

SEQ ID NO: 2818735 - protein, 25 aa, Entamoeba invadens
HSNGIAFWFTQTPLKLGNAFGAEEK

SEQ ID NO: 2818736 - protein, 17 aa, Entamoeba invadens
HSNQYWCSQCNSGYFPY

SEQ ID NO: 2818737 - protein, 19 aa, Entamoeba invadens
HSPVQCTKGFLLNSHTKEC

SEQ ID NO: 2818738 - protein, 21 aa, Entamoeba invadens
HSQMCLTCHYGYVLSTIDNSC

SEQ ID NO: 2818739 - protein, 17 aa, Entamoeba invadens
HSRLLVEGIELGRQHLF

SEQ ID NO: 2818740 - protein, 26 aa, Entamoeba invadens
HSSSPVNRYFVWTPYLNVSGISKQFN

SEQ ID NO: 2818741 - protein, 20 aa, Entamoeba invadens
HSSYCRLLNNLLIGLENNTT

SEQ ID NO: 2818742 - protein, 46 aa, Entamoeba invadens
HSTCYSKPVWWVIMISCFISVFIVVCVIAVIYFVSNTILKKVDFAL

SEQ ID NO: 2818743 - protein, 24 aa, Entamoeba invadens
HSTTYLFLMIFDVMMTVLIADLVH

SEQ ID NO: 2818744 - protein, 26 aa, Entamoeba invadens
HSVIPLVLFCYIIKPDYSIWKENIDA

SEQ ID NO: 2818745 - protein, 24 aa, Entamoeba invadens
HSYISCDIGYYLLFAKCHPCSENC

SEQ ID NO: 2818746 - protein, 17 aa, Entamoeba invadens
HSYKQLTLKLRNTFIIN

SEQ ID NO: 2818747 - protein, 17 aa, Entamoeba invadens
HSYLAVDFFFLVSGFFV

SEQ ID NO: 2818748 - protein, 23 aa, Entamoeba invadens
HTCTVFLEMKSNPILYFSGELIS

SEQ ID NO: 2818749 - protein, 29 aa, Entamoeba invadens
HTDCYFAREFFYQKLLGKDYPRCGICVEV

SEQ ID NO: 2818750 - protein, 23 aa, Entamoeba invadens
HTFFFFLFINVLVQPITVAVDSN

SEQ ID NO: 2818751 - protein, 36 aa, Entamoeba invadens
HTFSSLIHPFVWQHILIPILPPKMLDLAHAPMPFII

SEQ ID NO: 2818752 - protein, 20 aa, Entamoeba invadens
HTFYQYIQSRYYRSPEVALG

SEQ ID NO: 2818753 - protein, 25 aa, Entamoeba invadens
HTGAAPILFLLCSVAMFCIPQRYFT

SEQ ID NO: 2818754 - protein, 28 aa, Entamoeba invadens
HTKIVNDLVFFFTFGKVKISLFDDSSSF

SEQ ID NO: 2818755 - protein, 23 aa, Entamoeba invadens
HTKQFMLIIFHTPNIQKYTIHFC

SEQ ID NO: 2818756 - protein, 23 aa, Entamoeba invadens
HTLIKQFDLKSIPEITIKQGVTL

SEQ ID NO: 2818757 - protein, 23 aa, Entamoeba invadens
HTLLFLFVVFTINTILYALGLPS

SEQ ID NO: 2818758 - protein, 23 aa, Entamoeba invadens
HTLTLFFHIMALNVSINSSGYAL

SEQ ID NO: 2818759 - protein, 25 aa, Entamoeba invadens
HTLVKKIPLALLKKVSMKKATPDVL

SEQ ID NO: 2818760 - protein, 18 aa, Entamoeba invadens
HTNGILHRDIKPDNFLVF

SEQ ID NO: 2818761 - protein, 27 aa, Entamoeba invadens
HTPNDPKFILNFKPQVLFLSPISKAKT

SEQ ID NO: 2818762 - protein, 29 aa, Entamoeba invadens
HTPNNPKFVFYFDPQVIFLRPKQKTTLTS

SEQ ID NO: 2818763 - protein, 34 aa, Entamoeba invadens
HTPNSPKFIFHFDPQVLYIPPSFNGKNMKIMTCY

SEQ ID NO: 2818764 - protein, 20 aa, Entamoeba invadens
HTRAVFITDLYLGSTRKLSQ

SEQ ID NO: 2818765 - protein, 28 aa, Entamoeba invadens
HTRKDYLWKEIPPLVSPPLYNMRSRVTQ

SEQ ID NO: 2818766 - protein, 19 aa, Entamoeba invadens
HTRQFLRKYKFGRPPYFYL

SEQ ID NO: 2818767 - protein, 33 aa, Entamoeba invadens
HTTKKELYSLYTFFMFLLLTKTVQSNTFDCANG

SEQ ID NO: 2818768 - protein, 18 aa, Entamoeba invadens
HTVKYRFCTKCTSCLNYI

SEQ ID NO: 2818769 - protein, 26 aa, Entamoeba invadens
HVCSYASERLYWADLSRGITKVLSEE

SEQ ID NO: 2818770 - protein, 18 aa, Entamoeba invadens
HVENELIPTILSLVVRPT

SEQ ID NO: 2818771 - protein, 18 aa, Entamoeba invadens
HVFGEVFAENGFLQRSDR

SEQ ID NO: 2818772 - protein, 17 aa, Entamoeba invadens
HVFGEVFSENGFFQRSD

SEQ ID NO: 2818773 - protein, 17 aa, Entamoeba invadens
HVGPECTLRCKLFNYNT

SEQ ID NO: 2818774 - protein, 26 aa, Entamoeba invadens
HVISYFYLIKICPFTLSFLQSPLQVL

SEQ ID NO: 2818775 - protein, 25 aa, Entamoeba invadens
HVLFNGYLIILKYFSSFTGKNVLFL

SEQ ID NO: 2818776 - protein, 17 aa, Entamoeba invadens
HVMQIVRPLGVTRLWGA

SEQ ID NO: 2818777 - protein, 24 aa, Entamoeba invadens
HVPIWRYLVFIPCMVICVGLCILS

SEQ ID NO: 2818778 - protein, 18 aa, Entamoeba invadens
HVSALYLAILGLLSALVG

SEQ ID NO: 2818779 - protein, 17 aa, Entamoeba invadens
HVSLFMTLSIQGFFCFP

SEQ ID NO: 2818780 - protein, 25 aa, Entamoeba invadens
HVTNIYFLLVAIISLIPQISATNPV

SEQ ID NO: 2818781 - protein, 22 aa, Entamoeba invadens
HVTPLIFVLTVAVLKELFDEVH

SEQ ID NO: 2818782 - protein, 26 aa, Entamoeba invadens
HVVLDFLLILFALLMFCNHWFTYTLF

SEQ ID NO: 2818783 - protein, 18 aa, Entamoeba invadens
HVYGEIFAENGFLQRSDK

SEQ ID NO: 2818784 - protein, 17 aa, Entamoeba invadens
HVYIVRRKNMKVFEDGE

SEQ ID NO: 2818785 - protein, 19 aa, Entamoeba invadens
HYDRPCEDDECRKCTGGVV

SEQ ID NO: 2818786 - protein, 18 aa, Entamoeba invadens
HYIMDRYIIPTFNGFCVI

SEQ ID NO: 2818787 - protein, 19 aa, Entamoeba invadens
HYNNQNTLLKLCPDHFLLS

SEQ ID NO: 2818788 - protein, 29 aa, Entamoeba invadens
HYSFVPQPILLFGLFLAVLMYFIPMIVGY

SEQ ID NO: 2818789 - protein, 28 aa, Entamoeba invadens
HYSSKLDVYKLNYGFPQSPDFIEEADKE

SEQ ID NO: 2818790 - protein, 31 aa, Entamoeba invadens
HYSTPAYVVFFLVRLVPEFMLHLQNGVFDKP

SEQ ID NO: 2818791 - protein, 17 aa, Entamoeba invadens
HYVVLFLASYTQSNHHE

SEQ ID NO: 2818792 - protein, 19 aa, Entamoeba invadens
IAAIKLNKWNLLKKGRVLI

SEQ ID NO: 2818793 - protein, 20 aa, Entamoeba invadens
IAAIPPWETFYNFWERVISI

SEQ ID NO: 2818794 - protein, 27 aa, Entamoeba invadens
IAALNGSYVTLKWLLTKGANPNAENCM

SEQ ID NO: 2818795 - protein, 17 aa, Entamoeba invadens
IACKKIIETFFGFMVKT

SEQ ID NO: 2818796 - protein, 32 aa, Entamoeba invadens
IADLFSITTLIRAVIFLIKQSGIWVKRTALMI

SEQ ID NO: 2818797 - protein, 22 aa, Entamoeba invadens
IADVILPVYALIVKGGKYNKIE

SEQ ID NO: 2818798 - protein, 20 aa, Entamoeba invadens
IADYVNSQHICTTCFAPYVT

SEQ ID NO: 2818799 - protein, 17 aa, Entamoeba invadens
IAEFVISGKGLPNKEII

SEQ ID NO: 2818800 - protein, 24 aa, Entamoeba invadens
IAEKVIAKVYLPDGAKYTKCTGLG

SEQ ID NO: 2818801 - protein, 18 aa, Entamoeba invadens
IAFFLFVVYGQNCYYNQI

SEQ ID NO: 2818802 - protein, 33 aa, Entamoeba invadens
IAGGLILIAVILVFIFLLWRRRRRTEKERETEI

SEQ ID NO: 2818803 - protein, 21 aa, Entamoeba invadens
IAGIVIGVIIFVAVSALLIGV

SEQ ID NO: 2818804 - protein, 33 aa, Entamoeba invadens
IAGLIGHAIILLLLYVVTLFLIKRFDRNNYKNE

SEQ ID NO: 2818805 - protein, 33 aa, Entamoeba invadens
IAGLVIVVVVVVLILFLIWRRRLAVEKERKKSF

SEQ ID NO: 2818806 - protein, 28 aa, Entamoeba invadens
IAGPVCYTLFALHFFTPQFKTMSEQKRK

SEQ ID NO: 2818807 - protein, 17 aa, Entamoeba invadens
IAGTIVITVLIISLCAY

SEQ ID NO: 2818808 - protein, 20 aa, Entamoeba invadens
IAHCDVCFPPFSPQNGDCVS

SEQ ID NO: 2818809 - protein, 19 aa, Entamoeba invadens
IAHKPIGMLFNYITKKKDS

SEQ ID NO: 2818810 - protein, 31 aa, Entamoeba invadens
IAIIMCVLYIVFWMFTLYPGGGVFVIWYCVV

SEQ ID NO: 2818811 - protein, 31 aa, Entamoeba invadens
IAILSMYKYANWFDYTLLLVGIVGAIGVGIL

SEQ ID NO: 2818812 - protein, 21 aa, Entamoeba invadens
IAIPDGTFVNCTILSTVTGFE

SEQ ID NO: 2818813 - protein, 24 aa, Entamoeba invadens
IAITTLIIIYLVKHIKKQEEMYRY

SEQ ID NO: 2818814 - protein, 26 aa, Entamoeba invadens
IAKKRLPRLFAWKQFHSYIRELGIDE

SEQ ID NO: 2818815 - protein, 17 aa, Entamoeba invadens
IAKLFLLQTYSFDFPTP

SEQ ID NO: 2818816 - protein, 26 aa, Entamoeba invadens
IAKLSMFVFPRYLSIFSIAVFLSTII

SEQ ID NO: 2818817 - protein, 24 aa, Entamoeba invadens
IAKNLREMYWQYNSLHSYIKNDPI

SEQ ID NO: 2818818 - protein, 17 aa, Entamoeba invadens
IAKQLLLTESMKSVFVL

SEQ ID NO: 2818819 - protein, 22 aa, Entamoeba invadens
IALFDYDLTWDYIKRYPQSHRE

SEQ ID NO: 2818820 - protein, 23 aa, Entamoeba invadens
IALFLCVLGFYRGTHISIERIFL

SEQ ID NO: 2818821 - protein, 25 aa, Entamoeba invadens
IALLLRLVHIFPDTKLRVPLRGFFV

SEQ ID NO: 2818822 - protein, 20 aa, Entamoeba invadens
IALLNQFCSIKLQKPFKQSV

SEQ ID NO: 2818823 - protein, 23 aa, Entamoeba invadens
IALNKIVFLFEKFNAETSAEYVN

SEQ ID NO: 2818824 - protein, 27 aa, Entamoeba invadens
IALTIVIVSVFLAIGFIGLVLNKRFQM

SEQ ID NO: 2818825 - protein, 20 aa, Entamoeba invadens
IALVFFFLNNVVVAGYFILD

SEQ ID NO: 2818826 - protein, 22 aa, Entamoeba invadens
IALVSFVFFIISTVFTIFVVGY

SEQ ID NO: 2818827 - protein, 18 aa, Entamoeba invadens
IALWTIQNEMPLCIILRE

SEQ ID NO: 2818828 - protein, 35 aa, Entamoeba invadens
IALYSYGNGKWWVIKHLYELFLFVKGTEASDITFD

SEQ ID NO: 2818829 - protein, 18 aa, Entamoeba invadens
IAMLFIATSNGMIHCLDG

SEQ ID NO: 2818830 - protein, 23 aa, Entamoeba invadens
IAMPDCRIVFLLFSSIPSTCVGN

SEQ ID NO: 2818831 - protein, 26 aa, Entamoeba invadens
IAMPDCRIVFLLFSSIPSTCVGNFKR

SEQ ID NO: 2818832 - protein, 19 aa, Entamoeba invadens
IAPFMILGTIFMGSSTKVT

SEQ ID NO: 2818833 - protein, 18 aa, Entamoeba invadens
IAPIVIVVLMIFTGFFIQ

SEQ ID NO: 2818834 - protein, 24 aa, Entamoeba invadens
IAQIPVFILLIIAFVFLTLIKNHH

SEQ ID NO: 2818835 - protein, 25 aa, Entamoeba invadens
IAQYKKQLLPPDLIDVILPLDRAEK

SEQ ID NO: 2818836 - protein, 34 aa, Entamoeba invadens
IAREALVDVILLLPIICIVLYFIGAICKCHFLTI

SEQ ID NO: 2818837 - protein, 25 aa, Entamoeba invadens
IASIGISVFFPPAAPYVLVGAGVML

SEQ ID NO: 2818838 - protein, 24 aa, Entamoeba invadens
IASPNLFNLISIPQVFKIGDQVRF

SEQ ID NO: 2818839 - protein, 18 aa, Entamoeba invadens
IATIPYVGLVIYLSNIFY

SEQ ID NO: 2818840 - protein, 24 aa, Entamoeba invadens
IATLIMVLILLFKLVIATVVGFAN

SEQ ID NO: 2818841 - protein, 28 aa, Entamoeba invadens
IATLLEMATLFFLFIFSGTFKNSTNLRG

SEQ ID NO: 2818842 - protein, 27 aa, Entamoeba invadens
IATVSLVIFYIFKVIYWVFSGLQIKSG

SEQ ID NO: 2818843 - protein, 22 aa, Entamoeba invadens
IAVIPFSIFSDPQKIPILIEFV

SEQ ID NO: 2818844 - protein, 24 aa, Entamoeba invadens
IAVRPYPENVAFAQLLIRAGNDVG

SEQ ID NO: 2818845 - protein, 30 aa, Entamoeba invadens
IAVSVSCAIFVFFIIFVGAALIVGLVVRSA

SEQ ID NO: 2818846 - protein, 19 aa, Entamoeba invadens
IAVTILTFIFALTLSLFVA

SEQ ID NO: 2818847 - protein, 21 aa, Entamoeba invadens
IAVVVVLIILKRKSSANYSSF

SEQ ID NO: 2818848 - protein, 31 aa, Entamoeba invadens
IAVVYSIYIIAFFILLTYFVIKYKQINDVIA

SEQ ID NO: 2818849 - protein, 18 aa, Entamoeba invadens
IAWLNPRPGSHAQHEQIY

SEQ ID NO: 2818850 - protein, 38 aa, Entamoeba invadens
IAYELPVKLPFHYPLWKAMIAITLLLTPIALDVAGFYK

SEQ ID NO: 2818851 - protein, 20 aa, Entamoeba invadens
ICADGYYLYNGACVPCTTKF

SEQ ID NO: 2818852 - protein, 22 aa, Entamoeba invadens
ICASFFFIMVSSGFVMVHKATE

SEQ ID NO: 2818853 - protein, 28 aa, Entamoeba invadens
ICCFGIPRKVRGFVWYALLLKPEDANDI

SEQ ID NO: 2818854 - protein, 25 aa, Entamoeba invadens
ICCIAILFLVVKWRMAKQVDSEEKS

SEQ ID NO: 2818855 - protein, 25 aa, Entamoeba invadens
ICCYPQKFRQGRWFKFNLSQMTKDH

SEQ ID NO: 2818856 - protein, 47 aa, Entamoeba invadens
ICETKSLWWISLVVIISIFFVILVIVLYFLLTFISKKVLKVKQENTI

SEQ ID NO: 2818857 - protein, 25 aa, Entamoeba invadens
ICFPERMYKCVLFTLEYNGNYSLLI

SEQ ID NO: 2818858 - protein, 25 aa, Entamoeba invadens
ICFQKAICLALLGFFGNFTIKIPKK

SEQ ID NO: 2818859 - protein, 36 aa, Entamoeba invadens
ICFVFGVLYFAWYLLMYPIFLKFIKPNTHLFYRENV

SEQ ID NO: 2818860 - protein, 18 aa, Entamoeba invadens
ICGFLGCILIVIGLALGS

SEQ ID NO: 2818861 - protein, 19 aa, Entamoeba invadens
ICGTMSVLFVIIVTPGIAY

SEQ ID NO: 2818862 - protein, 19 aa, Entamoeba invadens
ICGVIWGLWHAPLVYFGHN

SEQ ID NO: 2818863 - protein, 17 aa, Entamoeba invadens
ICHRCLKGFYLSNGICK

SEQ ID NO: 2818864 - protein, 30 aa, Entamoeba invadens
ICIGINFALWYYGIVPSDPMFFFVLCVESS

SEQ ID NO: 2818865 - protein, 17 aa, Entamoeba invadens
ICINYKSISIVLSCGNN

SEQ ID NO: 2818866 - protein, 26 aa, Entamoeba invadens
ICLDKNFYFISLNSIGSLILSSSNVF

SEQ ID NO: 2818867 - protein, 18 aa, Entamoeba invadens
ICLFAYIVFFTTLGFIKD

SEQ ID NO: 2818868 - protein, 27 aa, Entamoeba invadens
ICLKGNLMIIAITTSGFVFGSYNSMTF

SEQ ID NO: 2818869 - protein, 24 aa, Entamoeba invadens
ICLTITMVVTFVALTVMVANIVDI

SEQ ID NO: 2818870 - protein, 19 aa, Entamoeba invadens
ICLVLYIYASWTFFEDRIP

SEQ ID NO: 2818871 - protein, 19 aa, Entamoeba invadens
ICLVTEFALLGSLQDLIKH

SEQ ID NO: 2818872 - protein, 26 aa, Entamoeba invadens
ICMCMYVYNYYLYPSPLKGVAPLDCV

SEQ ID NO: 2818873 - protein, 17 aa, Entamoeba invadens
ICMLCGAPLCSENYCLI

SEQ ID NO: 2818874 - protein, 17 aa, Entamoeba invadens
ICMVAGSVKPFFRTLPF

SEQ ID NO: 2818875 - protein, 22 aa, Entamoeba invadens
ICNECKLPFYPSQSGQNIGQCI

SEQ ID NO: 2818876 - protein, 20 aa, Entamoeba invadens
ICNNGYYLDNNMCSLCNSIS

SEQ ID NO: 2818877 - protein, 26 aa, Entamoeba invadens
ICNSYEICTYCYPNFYLDNGICLFCQ

SEQ ID NO: 2818878 - protein, 27 aa, Entamoeba invadens
ICNSYEICTYCYPNFYLDNGKCLSCQF

SEQ ID NO: 2818879 - protein, 17 aa, Entamoeba invadens
ICNTCQIGYFPEIQCKS

SEQ ID NO: 2818880 - protein, 34 aa, Entamoeba invadens
ICPDHKIRWYGYLIQFIVLMFPLVNLTSEYPLVS

SEQ ID NO: 2818881 - protein, 17 aa, Entamoeba invadens
ICRVCRDGFYFKDKKCV

SEQ ID NO: 2818882 - protein, 17 aa, Entamoeba invadens
ICSFFAIFFVKFVSTIF

SEQ ID NO: 2818883 - protein, 25 aa, Entamoeba invadens
ICSFGYLCFLIIFKWCAPFQEGAPM

SEQ ID NO: 2818884 - protein, 19 aa, Entamoeba invadens
ICSNYIVITRFSKDEKTIC

SEQ ID NO: 2818885 - protein, 19 aa, Entamoeba invadens
ICTACMAEYKLEGGKCNGA

SEQ ID NO: 2818886 - protein, 26 aa, Entamoeba invadens
ICTDFNYRPQLFNSFFFRFERGQNGI

SEQ ID NO: 2818887 - protein, 24 aa, Entamoeba invadens
ICTIFVTIIILPIQTKSILDIVSQ

SEQ ID NO: 2818888 - protein, 22 aa, Entamoeba invadens
ICTLCIDYYYYNQTNKTCLQYN

SEQ ID NO: 2818889 - protein, 18 aa, Entamoeba invadens
ICTPMITNCKYQKSFKGV

SEQ ID NO: 2818890 - protein, 18 aa, Entamoeba invadens
ICTSCFAPYSLNVNTRRC

SEQ ID NO: 2818891 - protein, 17 aa, Entamoeba invadens
ICTSCNFGYYLSDFICV

SEQ ID NO: 2818892 - protein, 26 aa, Entamoeba invadens
ICVGRRPPCLIGMDPTLFDIIANCWE

SEQ ID NO: 2818893 - protein, 19 aa, Entamoeba invadens
ICVMCPDMQYSFAGSTMCK

SEQ ID NO: 2818894 - protein, 33 aa, Entamoeba invadens
ICVMSLISTFLLSRIIMLYGLNITVPSLKENLL

SEQ ID NO: 2818895 - protein, 28 aa, Entamoeba invadens
ICVRMFTRYGLLSIYVPSAQPTYAKREI

SEQ ID NO: 2818896 - protein, 50 aa, Entamoeba invadens
ICVTQFTLGLLSPFLMCMFSVLVMLVFFFRHHLSRFYFLVPTIPNTDMSS

SEQ ID NO: 2818897 - protein, 18 aa, Entamoeba invadens
ICWIPGTAFFYTVEHLLW

SEQ ID NO: 2818898 - protein, 17 aa, Entamoeba invadens
ICYFNCIRLPFMNFGYF

SEQ ID NO: 2818899 - protein, 21 aa, Entamoeba invadens
ICYLIPNCKNGYYDNATLKCT

SEQ ID NO: 2818900 - protein, 31 aa, Entamoeba invadens
IDATSQHVILVQMVFIWTMGSVQHVKQNISI

SEQ ID NO: 2818901 - protein, 34 aa, Entamoeba invadens
IDAYTKDFYYYLLPPLVLYLFDVLLRITHICVPG

SEQ ID NO: 2818902 - protein, 23 aa, Entamoeba invadens
IDCTLCPLGYYSNGGASQCTACL

SEQ ID NO: 2818903 - protein, 19 aa, Entamoeba invadens
IDCVTKGCLTCDATKCLSC

SEQ ID NO: 2818904 - protein, 55 aa, Entamoeba invadens
IDDRISVFKIFHVFQSLMILHIICSPFHLAVTLFWLLFPLRSFSQTYCAAGTYPL

SEQ ID NO: 2818905 - protein, 23 aa, Entamoeba invadens
IDDVLVYSTCWRLAHSELEIENF

SEQ ID NO: 2818906 - protein, 23 aa, Entamoeba invadens
IDEDLLLMIAIGHPDTKFVENLP

SEQ ID NO: 2818907 - protein, 21 aa, Entamoeba invadens
IDEDYYIYYYGNDTIIPTPIA

SEQ ID NO: 2818908 - protein, 25 aa, Entamoeba invadens
IDEEKHICFLKPVNCLEYENNIYRG

SEQ ID NO: 2818909 - protein, 23 aa, Entamoeba invadens
IDEKFRIVYTRDLSTVTPLVYID

SEQ ID NO: 2818910 - protein, 18 aa, Entamoeba invadens
IDEKNYFERITPFVTKMI

SEQ ID NO: 2818911 - protein, 24 aa, Entamoeba invadens
IDERFRIVYTRNVFTTVPLVYIDG

SEQ ID NO: 2818912 - protein, 37 aa, Entamoeba invadens
IDFASECIRWLGAFRFILWTLWYCVKLMCTKMVVKVK

SEQ ID NO: 2818913 - protein, 26 aa, Entamoeba invadens
IDFKKYLQIQPIYFYDIIGSSEITKT

SEQ ID NO: 2818914 - protein, 33 aa, Entamoeba invadens
IDFSRRKWFCFVFLIGFVIFSFAIYYGDWKKEA

SEQ ID NO: 2818915 - protein, 40 aa, Entamoeba invadens
IDFVGWIAICVAIVVILFVILAIYLFYRFRPKKVEEPLKS

SEQ ID NO: 2818916 - protein, 26 aa, Entamoeba invadens
IDGKGFLSVGFFYPTEMLISQDFKEL

SEQ ID NO: 2818917 - protein, 17 aa, Entamoeba invadens
IDGYYLNGKTCKKCGEN

SEQ ID NO: 2818918 - protein, 18 aa, Entamoeba invadens
IDIDMKIKFMLDAAKGIE

SEQ ID NO: 2818919 - protein, 27 aa, Entamoeba invadens
IDIKEFILFVFYSLFSFEMTFFIFVQD

SEQ ID NO: 2818920 - protein, 21 aa, Entamoeba invadens
IDKFIFKVEPEVVLIKRGRAC

SEQ ID NO: 2818921 - protein, 17 aa, Entamoeba invadens
IDKLFGVSFNYLNDKKS

SEQ ID NO: 2818922 - protein, 17 aa, Entamoeba invadens
IDKNCFKCKDPCYHCSG

SEQ ID NO: 2818923 - protein, 24 aa, Entamoeba invadens
IDKNMRIKILLDASKGVKYLHDND

SEQ ID NO: 2818924 - protein, 25 aa, Entamoeba invadens
IDLLPLTMIDYLTSPMTYLIGICQE

SEQ ID NO: 2818925 - protein, 27 aa, Entamoeba invadens
IDLQGMELYFFPLFHNFPSLENVTKLC

SEQ ID NO: 2818926 - protein, 29 aa, Entamoeba invadens
IDLSVLLMESPFLNLFDWNDDLNTPLHYL

SEQ ID NO: 2818927 - protein, 17 aa, Entamoeba invadens
IDLWFELCRTVQFQEFI

SEQ ID NO: 2818928 - protein, 18 aa, Entamoeba invadens
IDMKMRVKMLLDAANGIS

SEQ ID NO: 2818929 - protein, 18 aa, Entamoeba invadens
IDMKMRVKMLLDATNGIS

SEQ ID NO: 2818930 - protein, 33 aa, Entamoeba invadens
IDMWSLGCLTAVFYFGVPLFSTKSEYSLLRRMV

SEQ ID NO: 2818931 - protein, 26 aa, Entamoeba invadens
IDNDFSLPTFPFTVNGGFIVNGVLTI

SEQ ID NO: 2818932 - protein, 19 aa, Entamoeba invadens
IDNDKFVCVLGYSNTTHFN

SEQ ID NO: 2818933 - protein, 32 aa, Entamoeba invadens
IDNETKWKWGEYKQFHMIGYINQSSLIILNAD

SEQ ID NO: 2818934 - protein, 18 aa, Entamoeba invadens
IDNILYIDDTWLYSNTIT

SEQ ID NO: 2818935 - protein, 29 aa, Entamoeba invadens
IDNYILTNKQCVYKRLLGCETYDREKQTC

SEQ ID NO: 2818936 - protein, 20 aa, Entamoeba invadens
IDNYNFAFGYPQSDEFMAEA

SEQ ID NO: 2818937 - protein, 23 aa, Entamoeba invadens
IDNYYNFMFILSAVLIAITSFVT

SEQ ID NO: 2818938 - protein, 25 aa, Entamoeba invadens
IDPERTINDLLLIWNVRKPADKNET

SEQ ID NO: 2818939 - protein, 34 aa, Entamoeba invadens
IDREQRRVIINKPFFFILVDSKSLPLFFGKCTHP

SEQ ID NO: 2818940 - protein, 33 aa, Entamoeba invadens
IDSALSFMFSVSWSSVLYLAQDLGIFSTLLPKP

SEQ ID NO: 2818941 - protein, 27 aa, Entamoeba invadens
IDSESRVHLFPYSIVRGNGYIREMDVQ

SEQ ID NO: 2818942 - protein, 17 aa, Entamoeba invadens
IDSVIVELLPNGTYNYT

SEQ ID NO: 2818943 - protein, 17 aa, Entamoeba invadens
IDTFLSYFPLNHEDSLK

SEQ ID NO: 2818944 - protein, 28 aa, Entamoeba invadens
IDTVFICFLMFYVLIMFDALRKPIKQRM

SEQ ID NO: 2818945 - protein, 18 aa, Entamoeba invadens
IDVFILKMESASLGVVVS

SEQ ID NO: 2818946 - protein, 24 aa, Entamoeba invadens
IDVLFNGAFVVSKLLCVAKKNGED

SEQ ID NO: 2818947 - protein, 30 aa, Entamoeba invadens
IDVLLTTEMKVFLFLLDGFGNYRTHFNFSQ

SEQ ID NO: 2818948 - protein, 18 aa, Entamoeba invadens
IDVSMLITFSLQGYFCFP

SEQ ID NO: 2818949 - protein, 26 aa, Entamoeba invadens
IDVTDKFFLYAPDPQSPLATKIEFLE

SEQ ID NO: 2818950 - protein, 25 aa, Entamoeba invadens
IDWKTSFFPLTNFTKTLSFLVEPKS

SEQ ID NO: 2818951 - protein, 17 aa, Entamoeba invadens
IDWLIIVSRILMIIVVV

SEQ ID NO: 2818952 - protein, 24 aa, Entamoeba invadens
IDYHVINLKTLFIREKYSYHSFYI

SEQ ID NO: 2818953 - protein, 32 aa, Entamoeba invadens
IDYIYIIHSFFKRYLVPFELLKRNISGSHPKS

SEQ ID NO: 2818954 - protein, 24 aa, Entamoeba invadens
IDYTFNPLLFKDSLLSILTGIVCG

SEQ ID NO: 2818955 - protein, 25 aa, Entamoeba invadens
IDYYTLQFIEFGFDSVLSIQDVCPS

SEQ ID NO: 2818956 - protein, 29 aa, Entamoeba invadens
IEADEMATLFFLFIGLFKSSVLIENDFTS

SEQ ID NO: 2818957 - protein, 18 aa, Entamoeba invadens
IEADQFVFTLLKLKNALA

SEQ ID NO: 2818958 - protein, 23 aa, Entamoeba invadens
IECKEMYFNYPGSLSKLCLSYET

SEQ ID NO: 2818959 - protein, 18 aa, Entamoeba invadens
IECKFWYTPSEDGTYCAS

SEQ ID NO: 2818960 - protein, 25 aa, Entamoeba invadens
IECWDLTLVILSSLPFVVLSTSFIG

SEQ ID NO: 2818961 - protein, 24 aa, Entamoeba invadens
IECYGCLIGYYLDKNDCLECPSIC

SEQ ID NO: 2818962 - protein, 25 aa, Entamoeba invadens
IEDEDLLFVLSRYKEYLTLKTQIKS

SEQ ID NO: 2818963 - protein, 17 aa, Entamoeba invadens
IEDLKVFKYKIVKEFIF

SEQ ID NO: 2818964 - protein, 20 aa, Entamoeba invadens
IEEQIFKKSFPYISYYRLDG

SEQ ID NO: 2818965 - protein, 18 aa, Entamoeba invadens
IEFIADECNLPILTESRE

SEQ ID NO: 2818966 - protein, 18 aa, Entamoeba invadens
IEFPRKCGLIQCDGVAQG

SEQ ID NO: 2818967 - protein, 25 aa, Entamoeba invadens
IEGKYSYCLPIPREDNCKYLTTSNS

SEQ ID NO: 2818968 - protein, 24 aa, Entamoeba invadens
IEGNLVRLYIKNKIQTKYVNINNL

SEQ ID NO: 2818969 - protein, 25 aa, Entamoeba invadens
IEHGLCEVAIVYYLFKSLYGDNVAG

SEQ ID NO: 2818970 - protein, 25 aa, Entamoeba invadens
IEIKLRIKFMLDASKGILYLHTNGI

SEQ ID NO: 2818971 - protein, 32 aa, Entamoeba invadens
IEIPLNVIINKPFFFVIVDPHSLPIFFGKCTT

SEQ ID NO: 2818972 - protein, 31 aa, Entamoeba invadens
IEISKKYIAATYLITFIIGVLGKYAQPEDSE

SEQ ID NO: 2818973 - protein, 31 aa, Entamoeba invadens
IEITDWYSVIFAPDKFWTFIREYEDVKYLNF

SEQ ID NO: 2818974 - protein, 19 aa, Entamoeba invadens
IEIYRNGNIPMFGPLIHGD

SEQ ID NO: 2818975 - protein, 35 aa, Entamoeba invadens
IEKIQWLCRLPFQFLFATLYWAYKKLILCQWSKKN

SEQ ID NO: 2818976 - protein, 25 aa, Entamoeba invadens
IEKLSWTINTYYIISGSTLTLMGRA

SEQ ID NO: 2818977 - protein, 19 aa, Entamoeba invadens
IEKTKRDGELLKTEKEKVI

SEQ ID NO: 2818978 - protein, 25 aa, Entamoeba invadens
IELKKRYVFQLFIGNKSLNIASFAI

SEQ ID NO: 2818979 - protein, 22 aa, Entamoeba invadens
IELKVAFNIKSLIYANVITITQ

SEQ ID NO: 2818980 - protein, 24 aa, Entamoeba invadens
IELMKQICQLLLSSASMEYNDMFL

SEQ ID NO: 2818981 - protein, 18 aa, Entamoeba invadens
IELVIKRGGLSEQSTLIA

SEQ ID NO: 2818982 - protein, 24 aa, Entamoeba invadens
IEMASILFYNKTSLRIEADPFPLF

SEQ ID NO: 2818983 - protein, 25 aa, Entamoeba invadens
IEMKLRIKLMLDTLSGILYLHTNGI

SEQ ID NO: 2818984 - protein, 26 aa, Entamoeba invadens
IENFNNKVLYCKPTFYFKKTKCDYCG

SEQ ID NO: 2818985 - protein, 22 aa, Entamoeba invadens
IENLQKQYLFLKSFKDAEYILD

SEQ ID NO: 2818986 - protein, 22 aa, Entamoeba invadens
IENMWVIYVLYITALIPSFLSY

SEQ ID NO: 2818987 - protein, 18 aa, Entamoeba invadens
IENSFLSITSLKKFNCLS

SEQ ID NO: 2818988 - protein, 19 aa, Entamoeba invadens
IEQLKTLVLTHKLPVVQVK

SEQ ID NO: 2818989 - protein, 24 aa, Entamoeba invadens
IEQRKIFISFLFDGVRSQSIAQFA

SEQ ID NO: 2818990 - protein, 23 aa, Entamoeba invadens
IEQSTIPMLFMSDNGFLVEINET

SEQ ID NO: 2818991 - protein, 27 aa, Entamoeba invadens
IERMGGWFKVVISLIVSLVIVSVGVIV

SEQ ID NO: 2818992 - protein, 20 aa, Entamoeba invadens
IERRTIGVYSLLYKRLTSGV

SEQ ID NO: 2818993 - protein, 23 aa, Entamoeba invadens
IESKSFCIKKWKNLIEEYESNIN

SEQ ID NO: 2818994 - protein, 24 aa, Entamoeba invadens
IETELLIQIPYNENLILKFTKERK

SEQ ID NO: 2818995 - protein, 17 aa, Entamoeba invadens
IETLDMLVRGGIKVWVI

SEQ ID NO: 2818996 - protein, 17 aa, Entamoeba invadens
IETLFYYGTSEPILGKD

SEQ ID NO: 2818997 - protein, 31 aa, Entamoeba invadens
IEVTKIRFNIYPEPLQLRFSFYDMDFCKMTA

SEQ ID NO: 2818998 - protein, 31 aa, Entamoeba invadens
IEVTVLCTLKFQSSFLLVANLFEKEKAICKE

SEQ ID NO: 2818999 - protein, 17 aa, Entamoeba invadens
IEWFYGLWVIYGIIFLV

SEQ ID NO: 2819000 - protein, 17 aa, Entamoeba invadens
IEWLIVMVDFYIEKKRS

SEQ ID NO: 2819001 - protein, 20 aa, Entamoeba invadens
IEWLRLQDYRLPPSTDKLLP

SEQ ID NO: 2819002 - protein, 17 aa, Entamoeba invadens
IEWSAFPVLKTIVIFLV

SEQ ID NO: 2819003 - protein, 19 aa, Entamoeba invadens
IEYITINLQFFPFSTQKVS

SEQ ID NO: 2819004 - protein, 35 aa, Entamoeba invadens
IEYPKIDSPPLVLWDSYYLHLNYNYHGRPNFSIIN

SEQ ID NO: 2819005 - protein, 32 aa, Entamoeba invadens
IFAFCQNKQLLACHFLWLLKNGVCSLGLKAEN

SEQ ID NO: 2819006 - protein, 28 aa, Entamoeba invadens
IFAILAVLLYLLFVEIPFVFQALLNFVS

SEQ ID NO: 2819007 - protein, 19 aa, Entamoeba invadens
IFANLIEKSWQHKVSMRPS

SEQ ID NO: 2819008 - protein, 18 aa, Entamoeba invadens
IFCSMLVRYLVPENRNLI

SEQ ID NO: 2819009 - protein, 26 aa, Entamoeba invadens
IFDEKKLRFYLDPTSSKFLLNSVIEF

SEQ ID NO: 2819010 - protein, 29 aa, Entamoeba invadens
IFDIEMLGLIFVWVLKNLKKEVLVEWIKN

SEQ ID NO: 2819011 - protein, 18 aa, Entamoeba invadens
IFEIFKCNTNTILKTNEG

SEQ ID NO: 2819012 - protein, 24 aa, Entamoeba invadens
IFEIIALLWYLFSYIPYGQEMLKK

SEQ ID NO: 2819013 - protein, 24 aa, Entamoeba invadens
IFEKDGVVLLYNLQSNVIQIKCSN

SEQ ID NO: 2819014 - protein, 22 aa, Entamoeba invadens
IFFALLLPLTLTLYTSEKTSPQ

SEQ ID NO: 2819015 - protein, 20 aa, Entamoeba invadens
IFFGTLIYVISRWALVPLVT

SEQ ID NO: 2819016 - protein, 17 aa, Entamoeba invadens
IFFILGFFCYCIWIVAF

SEQ ID NO: 2819017 - protein, 18 aa, Entamoeba invadens
IFFILGFFCYCIWIVAFC

SEQ ID NO: 2819018 - protein, 26 aa, Entamoeba invadens
IFGFSFMLISLIFIFVPLSYARRAWP

SEQ ID NO: 2819019 - protein, 20 aa, Entamoeba invadens
IFGILLMKYRGCRDKALRET

SEQ ID NO: 2819020 - protein, 17 aa, Entamoeba invadens
IFGINYYSDLTPKEMGI

SEQ ID NO: 2819021 - protein, 23 aa, Entamoeba invadens
IFGLIGLPVVIFFVSSEKYILTT

SEQ ID NO: 2819022 - protein, 18 aa, Entamoeba invadens
IFGLVLSEQRKDLREVLA

SEQ ID NO: 2819023 - protein, 24 aa, Entamoeba invadens
IFGPKLLHITIPTTLTQIGKNVLD

SEQ ID NO: 2819024 - protein, 23 aa, Entamoeba invadens
IFGSWYKLRIRENVNYRLYGGVI

SEQ ID NO: 2819025 - protein, 24 aa, Entamoeba invadens
IFGVITFVIILTSLNFKFIKRQAM

SEQ ID NO: 2819026 - protein, 19 aa, Entamoeba invadens
IFGVLVIVMIVLTLICIVV

SEQ ID NO: 2819027 - protein, 21 aa, Entamoeba invadens
IFGWLITLWYLIKVDMSFKDN

SEQ ID NO: 2819028 - protein, 20 aa, Entamoeba invadens
IFHFFAIVMIFYNQKRYHKT

SEQ ID NO: 2819029 - protein, 19 aa, Entamoeba invadens
IFIECPFYVKNLTKTPKVV

SEQ ID NO: 2819030 - protein, 26 aa, Entamoeba invadens
IFIGLLFAFFIFALYHNYIKLAQTRN

SEQ ID NO: 2819031 - protein, 35 aa, Entamoeba invadens
IFITHWCATLTYTTFLLLFLISAASSWCLTVMTFS

SEQ ID NO: 2819032 - protein, 19 aa, Entamoeba invadens
IFKFPWKIAEFVTSGQRPE

SEQ ID NO: 2819033 - protein, 19 aa, Entamoeba invadens
IFKNGWVVMLFSLPMGMVA

SEQ ID NO: 2819034 - protein, 18 aa, Entamoeba invadens
IFKTCMIIIGIGAGAFCA

SEQ ID NO: 2819035 - protein, 17 aa, Entamoeba invadens
IFKVLTQNFDITTQNDL

SEQ ID NO: 2819036 - protein, 31 aa, Entamoeba invadens
IFKVMHYLRYAIIVFWLVCALGFCYPALKFL

SEQ ID NO: 2819037 - protein, 24 aa, Entamoeba invadens
IFKVYTFIFCLYLFNKSIYVHHNY

SEQ ID NO: 2819038 - protein, 17 aa, Entamoeba invadens
IFLGLVAAFFFITPTEI

SEQ ID NO: 2819039 - protein, 25 aa, Entamoeba invadens
IFLLSVGFFIFIEAIQRFIDIEEIT

SEQ ID NO: 2819040 - protein, 20 aa, Entamoeba invadens
IFLTLPIGVIIVCALALIIT

SEQ ID NO: 2819041 - protein, 21 aa, Entamoeba invadens
IFLVMKLFYLKNHNWDSFLSM

SEQ ID NO: 2819042 - protein, 31 aa, Entamoeba invadens
IFMFSIAFEWKMIWVMLTWLCIYNTIESVDF

SEQ ID NO: 2819043 - protein, 23 aa, Entamoeba invadens
IFNFSTFTMLLFAIAIDSTLIIE

SEQ ID NO: 2819044 - protein, 29 aa, Entamoeba invadens
IFNFTGIFGFFLLFIIPAVLQIYSKFIIR

SEQ ID NO: 2819045 - protein, 18 aa, Entamoeba invadens
IFNMKKSNISFTKLNDFL

SEQ ID NO: 2819046 - protein, 30 aa, Entamoeba invadens
IFNPITFMLHRFIRLFPMQLFGTCLLSATF

SEQ ID NO: 2819047 - protein, 18 aa, Entamoeba invadens
IFNSIKLPFQSFGFLIAC

SEQ ID NO: 2819048 - protein, 39 aa, Entamoeba invadens
IFNTKLYLRIYKLGRIPYFYLFLVALFTAVVTSPWGNIS

SEQ ID NO: 2819049 - protein, 17 aa, Entamoeba invadens
IFNTSPVKIYGADKVKT

SEQ ID NO: 2819050 - protein, 33 aa, Entamoeba invadens
IFNVLNIFLCIPLVLYFLPNVGFFSSFFGVGAV

SEQ ID NO: 2819051 - protein, 17 aa, Entamoeba invadens
IFNYSFIFAYEPNAKSA

SEQ ID NO: 2819052 - protein, 23 aa, Entamoeba invadens
IFPFNMFIKFFHSKACGLFNITS

SEQ ID NO: 2819053 - protein, 25 aa, Entamoeba invadens
IFQAVVHFIVIQLALKWAKEAAGSD

SEQ ID NO: 2819054 - protein, 20 aa, Entamoeba invadens
IFSFGFYKLFPDLPRTFTFV

SEQ ID NO: 2819055 - protein, 26 aa, Entamoeba invadens
IFSFTALFLLYLGPITFHILEAPLSF

SEQ ID NO: 2819056 - protein, 31 aa, Entamoeba invadens
IFSIFVVYIGPLSIIMLWPRIEKLGDPNFRK

SEQ ID NO: 2819057 - protein, 19 aa, Entamoeba invadens
IFSIVLALDDFTVHIFKVG

SEQ ID NO: 2819058 - protein, 17 aa, Entamoeba invadens
IFSYVHFPFLVTSVVLS

SEQ ID NO: 2819059 - protein, 21 aa, Entamoeba invadens
IFTFIILLCLTNFGSYDWDLV

SEQ ID NO: 2819060 - protein, 17 aa, Entamoeba invadens
IFTGVCSFKLDNCSILP

SEQ ID NO: 2819061 - protein, 17 aa, Entamoeba invadens
IFTIPETRYTLFKNIES

SEQ ID NO: 2819062 - protein, 27 aa, Entamoeba invadens
IFTKLNGTLGLLYFDCLLTDDIPTTPV

SEQ ID NO: 2819063 - protein, 26 aa, Entamoeba invadens
IFTSKMLWLLIPSFIGLIIIYIFQAV

SEQ ID NO: 2819064 - protein, 26 aa, Entamoeba invadens
IFTVPSILFLVFALALIIAFFVGFGY

SEQ ID NO: 2819065 - protein, 17 aa, Entamoeba invadens
IFVALRVPSPVNSFVLF

SEQ ID NO: 2819066 - protein, 19 aa, Entamoeba invadens
IFVDVVFCLLLVLSQLHVL

SEQ ID NO: 2819067 - protein, 18 aa, Entamoeba invadens
IFVETLILFVWNLIYQNS

SEQ ID NO: 2819068 - protein, 17 aa, Entamoeba invadens
IFVIFSVCKSESGWCED

SEQ ID NO: 2819069 - protein, 27 aa, Entamoeba invadens
IFVIILFILLYVVLKTRKISSFPKTIP

SEQ ID NO: 2819070 - protein, 18 aa, Entamoeba invadens
IFVTLFCTSKIQSSFLLV

SEQ ID NO: 2819071 - protein, 17 aa, Entamoeba invadens
IFVVETYTYVCDCYPKG

SEQ ID NO: 2819072 - protein, 20 aa, Entamoeba invadens
IFVVICTCSYYLIIVVVFIL

SEQ ID NO: 2819073 - protein, 18 aa, Entamoeba invadens
IFVVTKGMKWCRYGNVIR

SEQ ID NO: 2819074 - protein, 18 aa, Entamoeba invadens
IFYRCKKLSTIYLPPHIL

SEQ ID NO: 2819075 - protein, 34 aa, Entamoeba invadens
IGAFCKLHFLVIPIFPCSIFFAVVAAVIVMVEYP

SEQ ID NO: 2819076 - protein, 29 aa, Entamoeba invadens
IGAVVLFIFLVCVYFAWVGLLLARLDIPK

SEQ ID NO: 2819077 - protein, 24 aa, Entamoeba invadens
IGCDKCSFGFLWNSTTQSCTTVAY

SEQ ID NO: 2819078 - protein, 18 aa, Entamoeba invadens
IGCLWCENGYYLDNYICK

SEQ ID NO: 2819079 - protein, 19 aa, Entamoeba invadens
IGCSSNYVFLTTNSLICDS

SEQ ID NO: 2819080 - protein, 23 aa, Entamoeba invadens
IGCTQCLAGYYLNAGQCVQCDWS

SEQ ID NO: 2819081 - protein, 27 aa, Entamoeba invadens
IGCTSEVIPVLYIINTFFTIDRKMSTV

SEQ ID NO: 2819082 - protein, 20 aa, Entamoeba invadens
IGCVTYLIDAFFPALIVSMS

SEQ ID NO: 2819083 - protein, 24 aa, Entamoeba invadens
IGDHDYVIWMGDLNYRIQMDDKEV

SEQ ID NO: 2819084 - protein, 25 aa, Entamoeba invadens
IGEKCFNWCSYLSSITIPLGVTSFS

SEQ ID NO: 2819085 - protein, 20 aa, Entamoeba invadens
IGEPKVVMWNINRLHLYKNS

SEQ ID NO: 2819086 - protein, 26 aa, Entamoeba invadens
IGETCVLPSLGYYLFDGKTNECDNRH

SEQ ID NO: 2819087 - protein, 18 aa, Entamoeba invadens
IGFIFLVISYARFRLWVF

SEQ ID NO: 2819088 - protein, 30 aa, Entamoeba invadens
IGFLHKRRYYLQLFGYYGMVPTSNVVLFTR

SEQ ID NO: 2819089 - protein, 17 aa, Entamoeba invadens
IGFPFFLFCVILGGAME

SEQ ID NO: 2819090 - protein, 24 aa, Entamoeba invadens
IGGFIPFFIKFLPNRKLAGDILDV

SEQ ID NO: 2819091 - protein, 28 aa, Entamoeba invadens
IGGFLILLPFCCFIYKFKWTLDTNQVVP

SEQ ID NO: 2819092 - protein, 18 aa, Entamoeba invadens
IGGFSYFVNNSHVRWSTI

SEQ ID NO: 2819093 - protein, 34 aa, Entamoeba invadens
IGGGAIFPFFTLKFIDIIMVLMVLSPSVPITDEQ

SEQ ID NO: 2819094 - protein, 25 aa, Entamoeba invadens
IGGIHHQFYFTTSFLKILISECKDF

SEQ ID NO: 2819095 - protein, 32 aa, Entamoeba invadens
IGGIVFVVILITIIITVILLVLNYKQIDIEVF

SEQ ID NO: 2819096 - protein, 38 aa, Entamoeba invadens
IGGNLLMRRKFVRRPFWLNRILRMRGRRWRGNRRFQYG

SEQ ID NO: 2819097 - protein, 20 aa, Entamoeba invadens
IGGVQQYLGAYLKLVGVLEL

SEQ ID NO: 2819098 - protein, 25 aa, Entamoeba invadens
IGHYYCKELLFFQTQFYIKAKNKER

SEQ ID NO: 2819099 - protein, 25 aa, Entamoeba invadens
IGINALIFLVYPYTHVKWLKDKLIE

SEQ ID NO: 2819100 - protein, 18 aa, Entamoeba invadens
IGIPLNNLERWNGEHHVI

SEQ ID NO: 2819101 - protein, 18 aa, Entamoeba invadens
IGISGIVTGVILYNRKKA

SEQ ID NO: 2819102 - protein, 24 aa, Entamoeba invadens
IGKFYGKFTFWKDKRLGFFGEIIH

SEQ ID NO: 2819103 - protein, 30 aa, Entamoeba invadens
IGKKTVDDYIWPLLEKKLYITGEALDGKES

SEQ ID NO: 2819104 - protein, 37 aa, Entamoeba invadens
IGKMGMLCAGVVFVVLSLWWFYKAVTFNGYVLKGDHC

SEQ ID NO: 2819105 - protein, 18 aa, Entamoeba invadens
IGKYRNTIVAVKKVKFVL

SEQ ID NO: 2819106 - protein, 33 aa, Entamoeba invadens
IGLAIAFLVVLLVSIFVIYFTLYRKEKAKNNLT

SEQ ID NO: 2819107 - protein, 30 aa, Entamoeba invadens
IGLGMGFFMFVNLCTFALGLFYGTLVISGR

SEQ ID NO: 2819108 - protein, 18 aa, Entamoeba invadens
IGLILGYLGNVTIAWVAT

SEQ ID NO: 2819109 - protein, 22 aa, Entamoeba invadens
IGLKIRKLYFSSLLRQDSTFYD

SEQ ID NO: 2819110 - protein, 56 aa, Entamoeba invadens
IGLRLRQPIQFASFTSCPILRHVLYFTIYILFQLLLTFLLDRLNTILLAEYVSTIS

SEQ ID NO: 2819111 - protein, 37 aa, Entamoeba invadens
IGLSFGTIMLFMMLSLALSGWYGSLLMMGKGKTPNFT

SEQ ID NO: 2819112 - protein, 38 aa, Entamoeba invadens
IGLSVAGFIILLIVGIIIIVLFVIFHSLRNEEKRKEAQ

SEQ ID NO: 2819113 - protein, 23 aa, Entamoeba invadens
IGLYSVVVLFLYSLLKSNYSGMA

SEQ ID NO: 2819114 - protein, 25 aa, Entamoeba invadens
IGMKKTDLPFAIRPISNTKLSHSDI

SEQ ID NO: 2819115 - protein, 25 aa, Entamoeba invadens
IGNKIQFIFYMRQTATLFVLEEVSD

SEQ ID NO: 2819116 - protein, 26 aa, Entamoeba invadens
IGNNIKYAMKTFPTKTMIVFECNEGF

SEQ ID NO: 2819117 - protein, 33 aa, Entamoeba invadens
IGPLKLVQFVGFDILPILLRLAVHAFLKSQPLN

SEQ ID NO: 2819118 - protein, 27 aa, Entamoeba invadens
IGQIRLFEDIWCFTPGLFPLIRSGSTD

SEQ ID NO: 2819119 - protein, 22 aa, Entamoeba invadens
IGQMILACFYYRKLKTNFSYSY

SEQ ID NO: 2819120 - protein, 22 aa, Entamoeba invadens
IGRKFDIWLTTNEITNGGIAVQ

SEQ ID NO: 2819121 - protein, 41 aa, Entamoeba invadens
IGRKPMFIVTAIFLIFFSVASAFVFPIIFAAPYVGLSIIRF

SEQ ID NO: 2819122 - protein, 35 aa, Entamoeba invadens
IGRVYSFNFLPLQFMMMFLSIFAVKHKLINSWRGG

SEQ ID NO: 2819123 - protein, 29 aa, Entamoeba invadens
IGSFNIIIFPLFVVPYYRYKKTKKSLENV

SEQ ID NO: 2819124 - protein, 28 aa, Entamoeba invadens
IGSGVLLLFFIIMTVFIILITQKERFIV

SEQ ID NO: 2819125 - protein, 29 aa, Entamoeba invadens
IGSMGVGVLFPLFAYQFVCLTSVFSQITT

SEQ ID NO: 2819126 - protein, 24 aa, Entamoeba invadens
IGSVFGYFHRGPHPSLKTWRIPQT

SEQ ID NO: 2819127 - protein, 19 aa, Entamoeba invadens
IGSVIAGVAIFIKNKRHHN

SEQ ID NO: 2819128 - protein, 17 aa, Entamoeba invadens
IGSYIILRSAYLTRSDA

SEQ ID NO: 2819129 - protein, 24 aa, Entamoeba invadens
IGTNQFSFYFVDKFVMTIKSKQMI

SEQ ID NO: 2819130 - protein, 27 aa, Entamoeba invadens
IGTSQNQLLIYCEIPTILNVIFEGAND

SEQ ID NO: 2819131 - protein, 20 aa, Entamoeba invadens
IGTTYFIKVFCREKACDMTL

SEQ ID NO: 2819132 - protein, 18 aa, Entamoeba invadens
IGTYDTTYKFCKYKGVNS

SEQ ID NO: 2819133 - protein, 26 aa, Entamoeba invadens
IGVGAFITFLLYVGVFEYSSAGMIGR

SEQ ID NO: 2819134 - protein, 28 aa, Entamoeba invadens
IGVIFTPATLLIKKWYDPLPKAIVSVKD

SEQ ID NO: 2819135 - protein, 19 aa, Entamoeba invadens
IGVTICWLRKNKNVALETG

SEQ ID NO: 2819136 - protein, 37 aa, Entamoeba invadens
IGYNLYVFGTLIPLVVVYYKNLITLQMGTLLGLNSCE

SEQ ID NO: 2819137 - protein, 22 aa, Entamoeba invadens
IGYTFIVILLLYSSVGVFKVNI

SEQ ID NO: 2819138 - protein, 24 aa, Entamoeba invadens
IHCDTCLPGYFKFDSYSCSACFVG

SEQ ID NO: 2819139 - protein, 24 aa, Entamoeba invadens
IHCTLCFAPYILNDNKLSCIDANN

SEQ ID NO: 2819140 - protein, 20 aa, Entamoeba invadens
IHDIFYLTSFQNSSLFINPY

SEQ ID NO: 2819141 - protein, 18 aa, Entamoeba invadens
IHFSIFTAVCFLFALFCV

SEQ ID NO: 2819142 - protein, 19 aa, Entamoeba invadens
IHHYGSVLVAIMANATGIM

SEQ ID NO: 2819143 - protein, 17 aa, Entamoeba invadens
IHIIFSLITFVEKSPHC

SEQ ID NO: 2819144 - protein, 19 aa, Entamoeba invadens
IHISFIISTVLGFGGLILT

SEQ ID NO: 2819145 - protein, 17 aa, Entamoeba invadens
IHKFDKEYLEHCLQTVL

SEQ ID NO: 2819146 - protein, 34 aa, Entamoeba invadens
IHLLGGVIIPLFVKTPKLYRPASVVWLYANVMEK

SEQ ID NO: 2819147 - protein, 19 aa, Entamoeba invadens
IHLQLLMNVVYFLSREFSR

SEQ ID NO: 2819148 - protein, 19 aa, Entamoeba invadens
IHMNYYLNILSTSVAPLKD

SEQ ID NO: 2819149 - protein, 18 aa, Entamoeba invadens
IHNFLMFDALICVDKKLQ

SEQ ID NO: 2819150 - protein, 26 aa, Entamoeba invadens
IHNKFVLAGGYIRLFNSLRTVRRVPT

SEQ ID NO: 2819151 - protein, 17 aa, Entamoeba invadens
IHPGLYSILAQAKILSA

SEQ ID NO: 2819152 - protein, 21 aa, Entamoeba invadens
IHPIWESKRKYTYTFPFAQVH

SEQ ID NO: 2819153 - protein, 20 aa, Entamoeba invadens
IHPTFFVNYFMYLDTESPSA

SEQ ID NO: 2819154 - protein, 28 aa, Entamoeba invadens
IHRDVKGENLLLFSLNPHSPVCAKLTDF

SEQ ID NO: 2819155 - protein, 28 aa, Entamoeba invadens
IHRDVKGENLLLFSLNPRSPVCAKLTDF

SEQ ID NO: 2819156 - protein, 23 aa, Entamoeba invadens
IHSLNLTLLFKNVSLMKEQIELC

SEQ ID NO: 2819157 - protein, 17 aa, Entamoeba invadens
IHYIPFPLVITSGVGSH

SEQ ID NO: 2819158 - protein, 18 aa, Entamoeba invadens
IIAMTTAHWCLIEETIRC

SEQ ID NO: 2819159 - protein, 25 aa, Entamoeba invadens
IIASTDFGLLIYISNQLKPSTITTT

SEQ ID NO: 2819160 - protein, 22 aa, Entamoeba invadens
IIATVIIVVLIVFKKKDDKLIE

SEQ ID NO: 2819161 - protein, 44 aa, Entamoeba invadens
IICGVVLVLFYYWQLGLCIIAIFPVLLFFLFWNGYLNSEQSSPA

SEQ ID NO: 2819162 - protein, 24 aa, Entamoeba invadens
IICTHCYDSYYLNKTDLTCSNCNI

SEQ ID NO: 2819163 - protein, 18 aa, Entamoeba invadens
IIDFRDVLFFADFFRTFS

SEQ ID NO: 2819164 - protein, 31 aa, Entamoeba invadens
IIDIGACTLTFHIFRKMQMDIMSRFTLIETT

SEQ ID NO: 2819165 - protein, 31 aa, Entamoeba invadens
IIDLTYVVVWVWYIYHFNFGLVLLPYSIFCV

SEQ ID NO: 2819166 - protein, 27 aa, Entamoeba invadens
IIEGVVFLLYNIIKLLLRLKTVQQFFS

SEQ ID NO: 2819167 - protein, 24 aa, Entamoeba invadens
IIELKRLGLLWQKAPQKKIRLLLP

SEQ ID NO: 2819168 - protein, 17 aa, Entamoeba invadens
IIELKSDWYKRCFLDGR

SEQ ID NO: 2819169 - protein, 24 aa, Entamoeba invadens
IIENVFEFLKLMVDLLPTVVETFQ

SEQ ID NO: 2819170 - protein, 22 aa, Entamoeba invadens
IIESNLILSYLTKIGYDTSSFN

SEQ ID NO: 2819171 - protein, 24 aa, Entamoeba invadens
IIFAMFLAIFWRKQKQRAFHFIGV

SEQ ID NO: 2819172 - protein, 17 aa, Entamoeba invadens
IIFFNFLILFMINGQDN

SEQ ID NO: 2819173 - protein, 20 aa, Entamoeba invadens
IIFFSTEYLVRRCCAFYLGS

SEQ ID NO: 2819174 - protein, 22 aa, Entamoeba invadens
IIFILWNLFFISTTLFLLCCYF

SEQ ID NO: 2819175 - protein, 17 aa, Entamoeba invadens
IIFITLLTATSVYTVLG

SEQ ID NO: 2819176 - protein, 26 aa, Entamoeba invadens
IIFQQFTTLLIDKVVRIVFHNPQNNT

SEQ ID NO: 2819177 - protein, 23 aa, Entamoeba invadens
IIFTIWYTLFWQRKITVVGGFLI

SEQ ID NO: 2819178 - protein, 23 aa, Entamoeba invadens
IIGAIIFVCIAVVFVVVVLVVVS

SEQ ID NO: 2819179 - protein, 19 aa, Entamoeba invadens
IIGGVFTVFQLIDAFVFDS

SEQ ID NO: 2819180 - protein, 25 aa, Entamoeba invadens
IIGLKAKLFMLGSSQLTYVKDSVYQ

SEQ ID NO: 2819181 - protein, 26 aa, Entamoeba invadens
IIGSLLGVVCVFAIGSVIAGVAIFIK

SEQ ID NO: 2819182 - protein, 19 aa, Entamoeba invadens
IIGSYKISYISLGYASSVI

SEQ ID NO: 2819183 - protein, 17 aa, Entamoeba invadens
IIIKKRNEKYQLFETST

SEQ ID NO: 2819184 - protein, 21 aa, Entamoeba invadens
IIILGLFLYYVKVGWVLVIFV

SEQ ID NO: 2819185 - protein, 20 aa, Entamoeba invadens
IIIMLGYLIIRWKDFVYKRK

SEQ ID NO: 2819186 - protein, 27 aa, Entamoeba invadens
IIIPENGFVFFFDNFINFSRKSYFICK

SEQ ID NO: 2819187 - protein, 17 aa, Entamoeba invadens
IIISVNSSILKWCKVKD

SEQ ID NO: 2819188 - protein, 28 aa, Entamoeba invadens
IIIVILTILYFYRPPRLSKDLYGVWIGE

SEQ ID NO: 2819189 - protein, 17 aa, Entamoeba invadens
IIKMRRNAKLRKQFSIF

SEQ ID NO: 2819190 - protein, 24 aa, Entamoeba invadens
IIKNKFVIIYYGIALVIVAIVQSV

SEQ ID NO: 2819191 - protein, 24 aa, Entamoeba invadens
IIKQQKLLFNTYNTMFCNEHVSST

SEQ ID NO: 2819192 - protein, 18 aa, Entamoeba invadens
IIKRILQYTMYDYPKDVD

SEQ ID NO: 2819193 - protein, 24 aa, Entamoeba invadens
IIKRLIYCIFPCCLPPFVANSRLE

SEQ ID NO: 2819194 - protein, 19 aa, Entamoeba invadens
IIKSLVCVILIINTSLLTF

SEQ ID NO: 2819195 - protein, 26 aa, Entamoeba invadens
IIKVYNGGILLFTDIRFVFPDTFIND

SEQ ID NO: 2819196 - protein, 17 aa, Entamoeba invadens
IILDAARGIQYLHENSI

SEQ ID NO: 2819197 - protein, 17 aa, Entamoeba invadens
IILEKYEISKMKGKAFS

SEQ ID NO: 2819198 - protein, 32 aa, Entamoeba invadens
IILFIVFVTLLAFFPILTLCPKKVLPPPQIVT

SEQ ID NO: 2819199 - protein, 18 aa, Entamoeba invadens
IILHCITALKYEGNECRC

SEQ ID NO: 2819200 - protein, 22 aa, Entamoeba invadens
IILKNIFFEQLGDFKGIFSQDS

SEQ ID NO: 2819201 - protein, 17 aa, Entamoeba invadens
IILLCCLCPAPLLNIIY

SEQ ID NO: 2819202 - protein, 18 aa, Entamoeba invadens
IILTFYTKIVNDLVFSFT

SEQ ID NO: 2819203 - protein, 25 aa, Entamoeba invadens
IIMILLTVFVIFSLRVVRPLLVVLM

SEQ ID NO: 2819204 - protein, 26 aa, Entamoeba invadens
IIMVLSMFVILLYVVGYPQFYVDIKK

SEQ ID NO: 2819205 - protein, 21 aa, Entamoeba invadens
IINAYLKCESLVILSSNVIKS

SEQ ID NO: 2819206 - protein, 21 aa, Entamoeba invadens
IINCSILKLFDKNTSLFMTDN

SEQ ID NO: 2819207 - protein, 26 aa, Entamoeba invadens
IINLLYLTLFVVIFVLFVANNSPIDS

SEQ ID NO: 2819208 - protein, 23 aa, Entamoeba invadens
IINSTFILCFYSATLVMNLNTQI

SEQ ID NO: 2819209 - protein, 27 aa, Entamoeba invadens
IINTLVIKEKLILTSPYIITNLVDAVE

SEQ ID NO: 2819210 - protein, 19 aa, Entamoeba invadens
IIPIPTLKEDVHLGMFICS

SEQ ID NO: 2819211 - protein, 26 aa, Entamoeba invadens
IIQQFNELITKIPFKFINKTVGDVLL

SEQ ID NO: 2819212 - protein, 17 aa, Entamoeba invadens
IISAMQLTSLTTAVKCQ

SEQ ID NO: 2819213 - protein, 31 aa, Entamoeba invadens
IISATYNLLILLLRYFGMLLTPSSLTDNTWT

SEQ ID NO: 2819214 - protein, 17 aa, Entamoeba invadens
IISFICYTTKFKTLWGN

SEQ ID NO: 2819215 - protein, 18 aa, Entamoeba invadens
IISIFQAIPGLSPTGRFT

SEQ ID NO: 2819216 - protein, 17 aa, Entamoeba invadens
IISIFVVSYFFALLQAS

SEQ ID NO: 2819217 - protein, 18 aa, Entamoeba invadens
IISLFSMFCNLTALNWEN

SEQ ID NO: 2819218 - protein, 26 aa, Entamoeba invadens
IISLLLYMVYLVFIVLAVRSHPVLTA

SEQ ID NO: 2819219 - protein, 24 aa, Entamoeba invadens
IISNYTTLICNNKIFLNNNSTLII

SEQ ID NO: 2819220 - protein, 17 aa, Entamoeba invadens
IISSLTQFDFGVSNTAI

SEQ ID NO: 2819221 - protein, 23 aa, Entamoeba invadens
IISTITTYILFNVYNNNKNKKKT

SEQ ID NO: 2819222 - protein, 23 aa, Entamoeba invadens
IISTLLVFSILKKIERKQQDEQV

SEQ ID NO: 2819223 - protein, 26 aa, Entamoeba invadens
IISVLFVFFHYLVYHARFFDITKYLP

SEQ ID NO: 2819224 - protein, 24 aa, Entamoeba invadens
IITAILYISLFALNAIIPPRNAYS

SEQ ID NO: 2819225 - protein, 21 aa, Entamoeba invadens
IITFFLYIFVSEITFKSPSHF

SEQ ID NO: 2819226 - protein, 18 aa, Entamoeba invadens
IITLLCVFSPFLFQIDKR

SEQ ID NO: 2819227 - protein, 17 aa, Entamoeba invadens
IITNAYYYCDYERNGTF

SEQ ID NO: 2819228 - protein, 25 aa, Entamoeba invadens
IITTIVLVFVQPFIFMNVKDMARPY

SEQ ID NO: 2819229 - protein, 18 aa, Entamoeba invadens
IITYNTVYYAFVWSNTIP

SEQ ID NO: 2819230 - protein, 46 aa, Entamoeba invadens
IIVDFTLIITVVPLFLYFFGAFFRLHFFVAVIFPFAVIFACISMSY

SEQ ID NO: 2819231 - protein, 32 aa, Entamoeba invadens
IIVEHFYRLTFVYFIFISILCFIPSLERGRET

SEQ ID NO: 2819232 - protein, 42 aa, Entamoeba invadens
IIVGIVVGICFFFIVFITIALVLLFVVLRRNKKEHVKKINMS

SEQ ID NO: 2819233 - protein, 33 aa, Entamoeba invadens
IIVKLVLITIPTLIVLKIFKFWKSYLDLSSGIF

SEQ ID NO: 2819234 - protein, 17 aa, Entamoeba invadens
IIVLTHSRGIKTTTDPE

SEQ ID NO: 2819235 - protein, 25 aa, Entamoeba invadens
IIVSRILMIIVVVISYPALMFPTCA

SEQ ID NO: 2819236 - protein, 32 aa, Entamoeba invadens
IIVTACCFVLFFIIIAIVGVLLAYMMKSKEKE

SEQ ID NO: 2819237 - protein, 25 aa, Entamoeba invadens
IIVVIIFLLPLFYSTPTIIFWTIVT

SEQ ID NO: 2819238 - protein, 17 aa, Entamoeba invadens
IIYEHFTCTPKEINLIP

SEQ ID NO: 2819239 - protein, 18 aa, Entamoeba invadens
IIYHIVFVILKEVKIRFI

SEQ ID NO: 2819240 - protein, 31 aa, Entamoeba invadens
IKAHWSVFLKLTTSPIFIQILVKLVKEEEAA

SEQ ID NO: 2819241 - protein, 24 aa, Entamoeba invadens
IKATTLTWILQIEQLRDPLSKIKR

SEQ ID NO: 2819242 - protein, 21 aa, Entamoeba invadens
IKCDVVYRRNYLYKTQTEGNT

SEQ ID NO: 2819243 - protein, 21 aa, Entamoeba invadens
IKCENFLIEPLPGVSLDAVTN

SEQ ID NO: 2819244 - protein, 20 aa, Entamoeba invadens
IKCLPGYFLIQGKCGNCIPN

SEQ ID NO: 2819245 - protein, 19 aa, Entamoeba invadens
IKCLRPNNLSLPLKSIKDK

SEQ ID NO: 2819246 - protein, 18 aa, Entamoeba invadens
IKCPFWQAPSVDGLYCMN

SEQ ID NO: 2819247 - protein, 30 aa, Entamoeba invadens
IKCVTFITLYLLLIVVLYQINLYIGDQQYV

SEQ ID NO: 2819248 - protein, 23 aa, Entamoeba invadens
IKDGNILKLDYAPEFSARLAYDQ

SEQ ID NO: 2819249 - protein, 43 aa, Entamoeba invadens
IKDNYKYIVTSLKTDLFLIGPKGLTFYSLPEPIPNVVITETYV

SEQ ID NO: 2819250 - protein, 38 aa, Entamoeba invadens
IKDSEEQFPLYDLFIRLFKMFALPKDLHFALNIQSNTT

SEQ ID NO: 2819251 - protein, 22 aa, Entamoeba invadens
IKDYFFTAILLLSALATMIYGY

SEQ ID NO: 2819252 - protein, 22 aa, Entamoeba invadens
IKEGVRILSFPIGYYEEMLPNN

SEQ ID NO: 2819253 - protein, 20 aa, Entamoeba invadens
IKEHLLAIFAGKKYIQPFLD

SEQ ID NO: 2819254 - protein, 18 aa, Entamoeba invadens
IKFTLAVILFLAMSFVTM

SEQ ID NO: 2819255 - protein, 23 aa, Entamoeba invadens
IKFWQKDLHLWPYTYEFSQSDLD

SEQ ID NO: 2819256 - protein, 23 aa, Entamoeba invadens
IKGKFKVYIFSSTITSYRGYVMT

SEQ ID NO: 2819257 - protein, 17 aa, Entamoeba invadens
IKHFGISNLALLVQPCE

SEQ ID NO: 2819258 - protein, 26 aa, Entamoeba invadens
IKIKDMKYRVSTFNKYYCTYKNDVEG

SEQ ID NO: 2819259 - protein, 18 aa, Entamoeba invadens
IKMFHSLKFYRCSCWSYF

SEQ ID NO: 2819260 - protein, 27 aa, Entamoeba invadens
IKMFNVNFVLILIFNKHDLLISQKNII

SEQ ID NO: 2819261 - protein, 18 aa, Entamoeba invadens
IKNIYLFQDVKLTGDFIL

SEQ ID NO: 2819262 - protein, 17 aa, Entamoeba invadens
IKNLLKEWWPQVVKFSK

SEQ ID NO: 2819263 - protein, 21 aa, Entamoeba invadens
IKNMFPYTFTVTRQYKYMYCP

SEQ ID NO: 2819264 - protein, 32 aa, Entamoeba invadens
IKNSYMYYKYTIYYNSLIQTLSIYPNLNIDIE

SEQ ID NO: 2819265 - protein, 24 aa, Entamoeba invadens
IKPDNILIFSYDLKENVLAKLTDF

SEQ ID NO: 2819266 - protein, 25 aa, Entamoeba invadens
IKPDNILVFSLNFNANFPSKLTDFG

SEQ ID NO: 2819267 - protein, 23 aa, Entamoeba invadens
IKPDNLLIFSLDLGTTINAKMTD

SEQ ID NO: 2819268 - protein, 17 aa, Entamoeba invadens
IKPLCTCEISDKIAIIS

SEQ ID NO: 2819269 - protein, 19 aa, Entamoeba invadens
IKPLCTCVIKNKIMIFSKG

SEQ ID NO: 2819270 - protein, 28 aa, Entamoeba invadens
IKPPPFYLQMYIKRTSNILTLCSEALLP

SEQ ID NO: 2819271 - protein, 27 aa, Entamoeba invadens
IKRSSLWRKVLLLTILSAFLALEMSYC

SEQ ID NO: 2819272 - protein, 29 aa, Entamoeba invadens
IKRTIRDLPIFFIYQINTTIFTFQSSYEV

SEQ ID NO: 2819273 - protein, 22 aa, Entamoeba invadens
IKSFEYPWCIADFVTQGKRMEK

SEQ ID NO: 2819274 - protein, 42 aa, Entamoeba invadens
IKSGSYMMFVLMWLCLAGRICALYYYNSYLTLWGKSIETNNE

SEQ ID NO: 2819275 - protein, 18 aa, Entamoeba invadens
IKSLMCVSLYKKCDIETP

SEQ ID NO: 2819276 - protein, 26 aa, Entamoeba invadens
IKSLNATTFTPFASFDKLTISDVMTV

SEQ ID NO: 2819277 - protein, 20 aa, Entamoeba invadens
IKSLSFLKTTKPPKSSMLKN

SEQ ID NO: 2819278 - protein, 28 aa, Entamoeba invadens
IKSPVLIFKIQENVPLYIFLHTKYAEKT

SEQ ID NO: 2819279 - protein, 36 aa, Entamoeba invadens
IKSQLIFSEYLFLPKNIGLSPNALFLVFDNFVTILS

SEQ ID NO: 2819280 - protein, 27 aa, Entamoeba invadens
IKTAKTFYQTMYWINGIPSVAVEYTPF

SEQ ID NO: 2819281 - protein, 17 aa, Entamoeba invadens
IKTSTLDKLLTKNPRKP

SEQ ID NO: 2819282 - protein, 21 aa, Entamoeba invadens
IKVGWICLIFAVPTGFISGLD

SEQ ID NO: 2819283 - protein, 17 aa, Entamoeba invadens
IKVKLPTPISFTTTLVF

SEQ ID NO: 2819284 - protein, 26 aa, Entamoeba invadens
IKVMTRLFIILFGVVFPVIFSVILIV

SEQ ID NO: 2819285 - protein, 20 aa, Entamoeba invadens
IKYATQWYGSVLVLLAVLIS

SEQ ID NO: 2819286 - protein, 30 aa, Entamoeba invadens
ILAAQAMFLLFLILLVVVFNPYVIFAIAFF

SEQ ID NO: 2819287 - protein, 32 aa, Entamoeba invadens
ILAEIKKYKYPTFFPFFMSYSHTYNGNKYGRT

SEQ ID NO: 2819288 - protein, 17 aa, Entamoeba invadens
ILANADPFLKVGEIEPR

SEQ ID NO: 2819289 - protein, 18 aa, Entamoeba invadens
ILCEGLYNCIQLNLRFQT

SEQ ID NO: 2819290 - protein, 20 aa, Entamoeba invadens
ILCETKYYRTLQNSTKYFNP

SEQ ID NO: 2819291 - protein, 18 aa, Entamoeba invadens
ILCPEGCATGCLTDNTCR

SEQ ID NO: 2819292 - protein, 18 aa, Entamoeba invadens
ILCSLFIGQLLVVLGFVL

SEQ ID NO: 2819293 - protein, 29 aa, Entamoeba invadens
ILDKRWRKLCFFDYILYTVGTPTTICNDL

SEQ ID NO: 2819294 - protein, 18 aa, Entamoeba invadens
ILEETWNIKLAILSLCFS

SEQ ID NO: 2819295 - protein, 19 aa, Entamoeba invadens
ILEFLPSIQTFLKAKVRIG

SEQ ID NO: 2819296 - protein, 18 aa, Entamoeba invadens
ILEIFIFNTIHAIEFVLG

SEQ ID NO: 2819297 - protein, 27 aa, Entamoeba invadens
ILENFPQSSYLTKLIGKVLLDKTHLIV

SEQ ID NO: 2819298 - protein, 17 aa, Entamoeba invadens
ILEQSVAIRYVIFHKYI

SEQ ID NO: 2819299 - protein, 17 aa, Entamoeba invadens
ILETIQMMYFAVTGLSE

SEQ ID NO: 2819300 - protein, 27 aa, Entamoeba invadens
ILFAAFVIFLLIIVVFEGVKTIQRKMN

SEQ ID NO: 2819301 - protein, 30 aa, Entamoeba invadens
ILFDDWIMTCFNILFTSLPPGAIALFDYEL

SEQ ID NO: 2819302 - protein, 18 aa, Entamoeba invadens
ILFFCIAQSTLIYCNNNS

SEQ ID NO: 2819303 - protein, 19 aa, Entamoeba invadens
ILFFLVHLQAECPPEELIG

SEQ ID NO: 2819304 - protein, 29 aa, Entamoeba invadens
ILFFQGLLDWVAVIILPFLFEHVPFEEAR

SEQ ID NO: 2819305 - protein, 24 aa, Entamoeba invadens
ILFTALLAVFVRKVKLLPNQVFSL

SEQ ID NO: 2819306 - protein, 21 aa, Entamoeba invadens
ILFVLGFFCLITWVVNLMLFN

SEQ ID NO: 2819307 - protein, 25 aa, Entamoeba invadens
ILFVVLYVFWLLYVVCRSCSEGKKI

SEQ ID NO: 2819308 - protein, 24 aa, Entamoeba invadens
ILGAFLAFLFYSFNVYKLVTTTKM

SEQ ID NO: 2819309 - protein, 24 aa, Entamoeba invadens
ILHCPIIEDLLRKIQTVDNVLIVG

SEQ ID NO: 2819310 - protein, 17 aa, Entamoeba invadens
ILHEKPHMMIITLESEN

SEQ ID NO: 2819311 - protein, 35 aa, Entamoeba invadens
ILHGIMNTIFLAYLIFFVIAFFQYLRIDNGLFLNK

SEQ ID NO: 2819312 - protein, 20 aa, Entamoeba invadens
ILHHVIQLILLVVGFSLVCC

SEQ ID NO: 2819313 - protein, 18 aa, Entamoeba invadens
ILHLVTIPTPKWCRYVLF

SEQ ID NO: 2819314 - protein, 30 aa, Entamoeba invadens
ILHRDIKPDNFLILSLDLYEKVNAKLTDFG

SEQ ID NO: 2819315 - protein, 19 aa, Entamoeba invadens
ILHRDIKPDNFLVTSIHED

SEQ ID NO: 2819316 - protein, 30 aa, Entamoeba invadens
ILHRDIKPDNILIFSLELSVSVNAKLTDFG

SEQ ID NO: 2819317 - protein, 30 aa, Entamoeba invadens
ILHRDIKPDNILIFTLEFDAKVNGKLTDFG

SEQ ID NO: 2819318 - protein, 29 aa, Entamoeba invadens
ILHRDIKPDNYLIFSLDPNEKVNAKLTDF

SEQ ID NO: 2819319 - protein, 29 aa, Entamoeba invadens
ILHRDLKPDNLLLFSFSPKVQFAAKISDF

SEQ ID NO: 2819320 - protein, 33 aa, Entamoeba invadens
ILHYSKFMFDRLFYLEDVGLFIAMIFGLFDGST

SEQ ID NO: 2819321 - protein, 18 aa, Entamoeba invadens
ILIASAVVSLILAAIVPH

SEQ ID NO: 2819322 - protein, 29 aa, Entamoeba invadens
ILICALYALIFISLITLTAIIHFNCSKQF

SEQ ID NO: 2819323 - protein, 19 aa, Entamoeba invadens
ILIDLSQASLPDIHNSILG

SEQ ID NO: 2819324 - protein, 21 aa, Entamoeba invadens
ILIELIVIFIARIFYRDTDTY

SEQ ID NO: 2819325 - protein, 28 aa, Entamoeba invadens
ILIESGAILLLGALFAPLLEGLIVSDRV

SEQ ID NO: 2819326 - protein, 23 aa, Entamoeba invadens
ILIFLSILPFTVSKVIQVSLTGN

SEQ ID NO: 2819327 - protein, 18 aa, Entamoeba invadens
ILINFIVGTGVFGLPHAF

SEQ ID NO: 2819328 - protein, 25 aa, Entamoeba invadens
ILINTIYFKGTWSEKFDVLPNKMKF

SEQ ID NO: 2819329 - protein, 18 aa, Entamoeba invadens
ILISTLVNFLYIYMKRAF

SEQ ID NO: 2819330 - protein, 17 aa, Entamoeba invadens
ILKKRKTKINGQIVLIK

SEQ ID NO: 2819331 - protein, 18 aa, Entamoeba invadens
ILKLIGDFSLKVSGEKNV

SEQ ID NO: 2819332 - protein, 23 aa, Entamoeba invadens
ILKNCLLILLIGVTTMISFFFYV

SEQ ID NO: 2819333 - protein, 25 aa, Entamoeba invadens
ILKTSNFHLFSPQLTKLDIKELIVD

SEQ ID NO: 2819334 - protein, 19 aa, Entamoeba invadens
ILLCLCIILSVIGLRWFDE

SEQ ID NO: 2819335 - protein, 17 aa, Entamoeba invadens
ILLFFLNSSQFGIEMVY

SEQ ID NO: 2819336 - protein, 18 aa, Entamoeba invadens
ILLFVVWLSFIWEALKII

SEQ ID NO: 2819337 - protein, 20 aa, Entamoeba invadens
ILLLSSIFFVLGFVFCPGYF

SEQ ID NO: 2819338 - protein, 25 aa, Entamoeba invadens
ILLPVIIITLLVLRLFKKKKTVAFF

SEQ ID NO: 2819339 - protein, 25 aa, Entamoeba invadens
ILLRNVFFLYLCVIGLLTLLTGLLH

SEQ ID NO: 2819340 - protein, 27 aa, Entamoeba invadens
ILLSLTLVFFGIFTCLSQFLITIPPVE

SEQ ID NO: 2819341 - protein, 33 aa, Entamoeba invadens
ILLSTGVAVLGVLFIVAVIIIGALFTLFVLSRR

SEQ ID NO: 2819342 - protein, 18 aa, Entamoeba invadens
ILNDFMFSGCKKLTTVNG

SEQ ID NO: 2819343 - protein, 27 aa, Entamoeba invadens
ILNIQTSLIKLLLGNKYKFANTINSNN

SEQ ID NO: 2819344 - protein, 23 aa, Entamoeba invadens
ILNVLYLIVLIVIDIVMITTKLS

SEQ ID NO: 2819345 - protein, 17 aa, Entamoeba invadens
ILPLMENVIHELFLRRL

SEQ ID NO: 2819346 - protein, 19 aa, Entamoeba invadens
ILRFNKWWELFNPFAKQVD

SEQ ID NO: 2819347 - protein, 17 aa, Entamoeba invadens
ILRKKMCILPQEATLFS

SEQ ID NO: 2819348 - protein, 17 aa, Entamoeba invadens
ILRLCPTNHIDTSITCE

SEQ ID NO: 2819349 - protein, 27 aa, Entamoeba invadens
ILRVDMLNIFRDSSLLFLSSYIESTES

SEQ ID NO: 2819350 - protein, 37 aa, Entamoeba invadens
ILSAFCWCCFRIFDILFSFFFLLYTILNTSPSDSTSP

SEQ ID NO: 2819351 - protein, 17 aa, Entamoeba invadens
ILSLFYSTEAIVDFLRS

SEQ ID NO: 2819352 - protein, 17 aa, Entamoeba invadens
ILSLRNGVIYRCEKSKY

SEQ ID NO: 2819353 - protein, 27 aa, Entamoeba invadens
ILSPHWEFWRLLLVNIYTLWTVPLLLV

SEQ ID NO: 2819354 - protein, 18 aa, Entamoeba invadens
ILSTMFPYKFDDGTGYLI

SEQ ID NO: 2819355 - protein, 33 aa, Entamoeba invadens
ILSVLPYYQNALFMKLFHLCKPTIFANLVKLDK

SEQ ID NO: 2819356 - protein, 18 aa, Entamoeba invadens
ILTCKIYVKLFECIEMLK

SEQ ID NO: 2819357 - protein, 31 aa, Entamoeba invadens
ILTITICVITILYIIRPSPLDTKLFGVWVGE

SEQ ID NO: 2819358 - protein, 26 aa, Entamoeba invadens
ILTIVLWTVVIAQRKKLKDFLIFRVM

SEQ ID NO: 2819359 - protein, 18 aa, Entamoeba invadens
ILTKAQSFALLLAKVYFK

SEQ ID NO: 2819360 - protein, 25 aa, Entamoeba invadens
ILTKNLPYLYILKSPTRISAYLFSS

SEQ ID NO: 2819361 - protein, 19 aa, Entamoeba invadens
ILTVFLAMVLSSQSLSMVA

SEQ ID NO: 2819362 - protein, 19 aa, Entamoeba invadens
ILTVFSYELTLKNLKTNCM

SEQ ID NO: 2819363 - protein, 17 aa, Entamoeba invadens
ILVDNKSVLWRLKNLKK

SEQ ID NO: 2819364 - protein, 27 aa, Entamoeba invadens
ILVDYYFLFFFTLGCIFIVPPLVLNTS

SEQ ID NO: 2819365 - protein, 31 aa, Entamoeba invadens
ILVFLSGRIAALFYFNTFLTKWGKSLHPLLK

SEQ ID NO: 2819366 - protein, 17 aa, Entamoeba invadens
ILVFSIDKGIPVNAKLT

SEQ ID NO: 2819367 - protein, 17 aa, Entamoeba invadens
ILVIIRKLQEVVKMRNI

SEQ ID NO: 2819368 - protein, 18 aa, Entamoeba invadens
ILVKRRCEYYTTIKYCAS

SEQ ID NO: 2819369 - protein, 26 aa, Entamoeba invadens
ILVMQTIVLFLSQNYFKFSNWRDYIK

SEQ ID NO: 2819370 - protein, 26 aa, Entamoeba invadens
ILVNKTTFFLNRCGGWLQLIGPSENV

SEQ ID NO: 2819371 - protein, 17 aa, Entamoeba invadens
ILVSVGLTTHFTTTSTT

SEQ ID NO: 2819372 - protein, 17 aa, Entamoeba invadens
ILWLIGGVQQYLGAYLK

SEQ ID NO: 2819373 - protein, 29 aa, Entamoeba invadens
ILWLIIQLSASLMWCQIGKEIIQCNTTTL

SEQ ID NO: 2819374 - protein, 19 aa, Entamoeba invadens
ILWNVPFEEHGAFAQPICF

SEQ ID NO: 2819375 - protein, 17 aa, Entamoeba invadens
ILYCATSYYKDTSSNSC

SEQ ID NO: 2819376 - protein, 19 aa, Entamoeba invadens
IMAITFYRWSIENNILKNK

SEQ ID NO: 2819377 - protein, 31 aa, Entamoeba invadens
IMCHNMSYYVERLFSLYLPIMVGYHVYISTD

SEQ ID NO: 2819378 - protein, 28 aa, Entamoeba invadens
IMISIPVGLLLIIFKVVITVVCFVGGAF

SEQ ID NO: 2819379 - protein, 20 aa, Entamoeba invadens
IMIVSKYLEFFNNTNFINLE

SEQ ID NO: 2819380 - protein, 24 aa, Entamoeba invadens
IMKLPFIGFGLYWMDNIMLKRNFA

SEQ ID NO: 2819381 - protein, 17 aa, Entamoeba invadens
IMKTMLFTMNFTGDYSI

SEQ ID NO: 2819382 - protein, 20 aa, Entamoeba invadens
IMNAFWHGLYPGYLLFFFCC

SEQ ID NO: 2819383 - protein, 21 aa, Entamoeba invadens
IMNSLSLIMYSSCSECAVVIQ

SEQ ID NO: 2819384 - protein, 24 aa, Entamoeba invadens
IMNVAIYLLTLCALIGFVGGFFFG

SEQ ID NO: 2819385 - protein, 18 aa, Entamoeba invadens
IMPPIGEGAFGMVFRGTY

SEQ ID NO: 2819386 - protein, 27 aa, Entamoeba invadens
IMRNQHFFHGILIRQFMKILVKDVSGT

SEQ ID NO: 2819387 - protein, 19 aa, Entamoeba invadens
IMRVKQYASMKLLTLEKNS

SEQ ID NO: 2819388 - protein, 18 aa, Entamoeba invadens
IMSLCFIAFYLKKGRSFP

SEQ ID NO: 2819389 - protein, 19 aa, Entamoeba invadens
IMSQLFMLFFSSFFSQNTS

SEQ ID NO: 2819390 - protein, 28 aa, Entamoeba invadens
IMVVIIFAILWFPLLLMSSAAPNFIQPA

SEQ ID NO: 2819391 - protein, 19 aa, Entamoeba invadens
IMYEEHNYLIFGCVDSLLG

SEQ ID NO: 2819392 - protein, 22 aa, Entamoeba invadens
INAVKFLHFFNSNAKKTVFSKV

SEQ ID NO: 2819393 - protein, 23 aa, Entamoeba invadens
INCKKCNTPYYLTSDTKACVIEC

SEQ ID NO: 2819394 - protein, 24 aa, Entamoeba invadens
INDNFCLLQWSLGCIRCITNMTEP

SEQ ID NO: 2819395 - protein, 19 aa, Entamoeba invadens
INEILPFVKHFALGGGVGG

SEQ ID NO: 2819396 - protein, 30 aa, Entamoeba invadens
INEQKYVHLYVKFFIRITQLMETMENKKEI

SEQ ID NO: 2819397 - protein, 20 aa, Entamoeba invadens
INESNVLWKLLNNSSLGVST

SEQ ID NO: 2819398 - protein, 26 aa, Entamoeba invadens
INETSKVFLIVYYNNGQLEFHKETIP

SEQ ID NO: 2819399 - protein, 20 aa, Entamoeba invadens
INEYILKDNTCVFKRDLFCE

SEQ ID NO: 2819400 - protein, 36 aa, Entamoeba invadens
INFKVKQTLFFTLENTFYKFLKIKNYFENITNLFKK

SEQ ID NO: 2819401 - protein, 21 aa, Entamoeba invadens
INFLTLWMVSFGFITTVWANN

SEQ ID NO: 2819402 - protein, 17 aa, Entamoeba invadens
INFVTQQYPALASMFLQ

SEQ ID NO: 2819403 - protein, 28 aa, Entamoeba invadens
INGKTCYQYPAKSPLVYVALSEKMTAET

SEQ ID NO: 2819404 - protein, 25 aa, Entamoeba invadens
INGPLYSVGLGFSNLLYKMWKPTRE

SEQ ID NO: 2819405 - protein, 23 aa, Entamoeba invadens
INGYNFPVFKFNTIVTTTEVDTI

SEQ ID NO: 2819406 - protein, 39 aa, Entamoeba invadens
INHRSSLYTLLSLLLPFVTPLFVFLIGSPRLPDSQEYVP

SEQ ID NO: 2819407 - protein, 23 aa, Entamoeba invadens
INILVTMVVCAMALGFVGYGYGG

SEQ ID NO: 2819408 - protein, 23 aa, Entamoeba invadens
INKDKTIIILRCSGNKILNEKID

SEQ ID NO: 2819409 - protein, 23 aa, Entamoeba invadens
INKLFQFIDIIFTKTAVISFAEY

SEQ ID NO: 2819410 - protein, 29 aa, Entamoeba invadens
INKVSAMLFARMKRGLLPLVHGGTFTFEK

SEQ ID NO: 2819411 - protein, 26 aa, Entamoeba invadens
INLAERIPKLMFFNCSTLANVTHTES

SEQ ID NO: 2819412 - protein, 24 aa, Entamoeba invadens
INLGFVLYYFVDNILPFASFPKVH

SEQ ID NO: 2819413 - protein, 18 aa, Entamoeba invadens
INLIKRKIVNYTFSLSFC

SEQ ID NO: 2819414 - protein, 23 aa, Entamoeba invadens
INLKNYPYIIRNTNKKYQIHNIS

SEQ ID NO: 2819415 - protein, 21 aa, Entamoeba invadens
INLLMTNMTFTKGIGTPVYMA

SEQ ID NO: 2819416 - protein, 27 aa, Entamoeba invadens
INMATYFCWLILPYLIKEQGGSSFMIG

SEQ ID NO: 2819417 - protein, 24 aa, Entamoeba invadens
INMKLRIKFVLDASKGLLYLHENG

SEQ ID NO: 2819418 - protein, 20 aa, Entamoeba invadens
INMVIKLVYIDLKRGEEKSY

SEQ ID NO: 2819419 - protein, 25 aa, Entamoeba invadens
INNFKDFDLFFRELDIYKKINTILI

SEQ ID NO: 2819420 - protein, 26 aa, Entamoeba invadens
INNIIKLIFNCHFIYSKKAKICFFFF

SEQ ID NO: 2819421 - protein, 30 aa, Entamoeba invadens
INNLSLSLLCKPNYIFTLKDSLCSDDTNCA

SEQ ID NO: 2819422 - protein, 24 aa, Entamoeba invadens
INQWSTLIRLLCQEKQFKSIWAYF

SEQ ID NO: 2819423 - protein, 36 aa, Entamoeba invadens
INRGTRTLKIILLHMQVLLILSVAIAAIATPKCPQT

SEQ ID NO: 2819424 - protein, 18 aa, Entamoeba invadens
INRLFICAICDQKYFRND

SEQ ID NO: 2819425 - protein, 17 aa, Entamoeba invadens
INRLFMCAICDQKYFRN

SEQ ID NO: 2819426 - protein, 18 aa, Entamoeba invadens
INSFVLKMLGVSNNVFDR

SEQ ID NO: 2819427 - protein, 17 aa, Entamoeba invadens
INSIKFFGVIHISPLCP

SEQ ID NO: 2819428 - protein, 26 aa, Entamoeba invadens
INSKFTNLVFLFTFGKVETIIKEDIY

SEQ ID NO: 2819429 - protein, 19 aa, Entamoeba invadens
INTIIFRMAMKQIMKGRKG

SEQ ID NO: 2819430 - protein, 32 aa, Entamoeba invadens
INVCIFPMKKSNIHFFKINEWLVSNKKVLEFE

SEQ ID NO: 2819431 - protein, 21 aa, Entamoeba invadens
INYGYFFVRIGVIIGSPRMGE

SEQ ID NO: 2819432 - protein, 29 aa, Entamoeba invadens
INYLELLYCHNWFYPILAFMVLGIVVIFY

SEQ ID NO: 2819433 - protein, 17 aa, Entamoeba invadens
INYVLYSGDVRMFSLFD

SEQ ID NO: 2819434 - protein, 25 aa, Entamoeba invadens
IPAEVWRYYLLMNRPEQSDTIFLWT

SEQ ID NO: 2819435 - protein, 32 aa, Entamoeba invadens
IPALMDAIYIKNFRYYFVPTPPTSQAELPIYA

SEQ ID NO: 2819436 - protein, 22 aa, Entamoeba invadens
IPANMIIEEPIWDDKWSALKYT

SEQ ID NO: 2819437 - protein, 24 aa, Entamoeba invadens
IPDEMILFVQLIRYISNDPKQYII

SEQ ID NO: 2819438 - protein, 18 aa, Entamoeba invadens
IPDFANLMTMVVKTSISA

SEQ ID NO: 2819439 - protein, 22 aa, Entamoeba invadens
IPDIPVFYSDMLITIGDSAQYL

SEQ ID NO: 2819440 - protein, 30 aa, Entamoeba invadens
IPEDVIINKPFFFVIVDPHSLPIFFGKCTT

SEQ ID NO: 2819441 - protein, 29 aa, Entamoeba invadens
IPEKYRQCLILLPDLFQCCLHFIQYDPSC

SEQ ID NO: 2819442 - protein, 17 aa, Entamoeba invadens
IPHCKSFTRTITGGVPT

SEQ ID NO: 2819443 - protein, 18 aa, Entamoeba invadens
IPHYFFMYYINELVVHFT

SEQ ID NO: 2819444 - protein, 33 aa, Entamoeba invadens
IPIAFTTFLYIILWTFYSLYAWVAYKFDLFGVK

SEQ ID NO: 2819445 - protein, 26 aa, Entamoeba invadens
IPIFRYLTCFVLSNLPLLFLAYYAIT

SEQ ID NO: 2819446 - protein, 18 aa, Entamoeba invadens
IPIQVNVTIFPPAALHVV

SEQ ID NO: 2819447 - protein, 21 aa, Entamoeba invadens
IPKDMFKMHFAEELLAGIAMG

SEQ ID NO: 2819448 - protein, 20 aa, Entamoeba invadens
IPKDTFKGCILLNEVDGFEK

SEQ ID NO: 2819449 - protein, 27 aa, Entamoeba invadens
IPLIILWVILFILQIGIFIVSVISFTM

SEQ ID NO: 2819450 - protein, 20 aa, Entamoeba invadens
IPLIVSFIQPIFGLLSDIFP

SEQ ID NO: 2819451 - protein, 22 aa, Entamoeba invadens
IPLLWMIYTNAFNLEKNYNFSC

SEQ ID NO: 2819452 - protein, 21 aa, Entamoeba invadens
IPLVLNCVLFVPTLNTYLIGS

SEQ ID NO: 2819453 - protein, 18 aa, Entamoeba invadens
IPMEEGVMYPFTIDFTSK

SEQ ID NO: 2819454 - protein, 24 aa, Entamoeba invadens
IPMEIIWYVIYYTLIVFAAIILPF

SEQ ID NO: 2819455 - protein, 19 aa, Entamoeba invadens
IPMLYNIVRLKSSSQIYTD

SEQ ID NO: 2819456 - protein, 20 aa, Entamoeba invadens
IPNHICMVTEFALYGSLQDL

SEQ ID NO: 2819457 - protein, 32 aa, Entamoeba invadens
IPNSMGCAFCKDGYYWSEWSCLECSAACLTCS

SEQ ID NO: 2819458 - protein, 29 aa, Entamoeba invadens
IPNYSFSYLLTKYLDYYLNFDYSKRISTS

SEQ ID NO: 2819459 - protein, 26 aa, Entamoeba invadens
IPPDFNGFFFTLVYNAIRALSDSILR

SEQ ID NO: 2819460 - protein, 24 aa, Entamoeba invadens
IPPGYRFVTIFTQSTWTRTAGFAG

SEQ ID NO: 2819461 - protein, 19 aa, Entamoeba invadens
IPPHRKGVITLFATLFCTT

SEQ ID NO: 2819462 - protein, 20 aa, Entamoeba invadens
IPPKFACEFSLFLNPLCTST

SEQ ID NO: 2819463 - protein, 18 aa, Entamoeba invadens
IPQISMVIQFFVLGSLGE

SEQ ID NO: 2819464 - protein, 32 aa, Entamoeba invadens
IPQNVSLSFFVWYLHEVQSLFKILPNSLVLIE

SEQ ID NO: 2819465 - protein, 19 aa, Entamoeba invadens
IPQVSMVIQFFILGSLGEY

SEQ ID NO: 2819466 - protein, 19 aa, Entamoeba invadens
IPQVSMVIQFFVLGALGEY

SEQ ID NO: 2819467 - protein, 18 aa, Entamoeba invadens
IPQVSMVIQFFVLGSLGE

SEQ ID NO: 2819468 - protein, 22 aa, Entamoeba invadens
IPRDLILPDFFFKILPHLKQSW

SEQ ID NO: 2819469 - protein, 32 aa, Entamoeba invadens
IPRLNYDKLIVGDVYYLYIYDYKDTSTNNKAG

SEQ ID NO: 2819470 - protein, 18 aa, Entamoeba invadens
IPRPINLNIPKRGPLKTK

SEQ ID NO: 2819471 - protein, 27 aa, Entamoeba invadens
IPSAFIAIVLVILTLVVYIFACTRCCF

SEQ ID NO: 2819472 - protein, 18 aa, Entamoeba invadens
IPSDLLDFVLKTMCNFDL

SEQ ID NO: 2819473 - protein, 20 aa, Entamoeba invadens
IPSEFLLLSQPTENPLIITQ

SEQ ID NO: 2819474 - protein, 19 aa, Entamoeba invadens
IPSICCLLIYFMKGTYKIE

SEQ ID NO: 2819475 - protein, 20 aa, Entamoeba invadens
IPSPLVRFIHAAHLVVIDGV

SEQ ID NO: 2819476 - protein, 27 aa, Entamoeba invadens
IPTMSAIFGIIFMLIKPLRDTLLVSGN

SEQ ID NO: 2819477 - protein, 32 aa, Entamoeba invadens
IPTTNTLVINKLFKFFVMKMSQNINIRATKSL

SEQ ID NO: 2819478 - protein, 20 aa, Entamoeba invadens
IPVISWFLPFIGHPAVCDTK

SEQ ID NO: 2819479 - protein, 45 aa, Entamoeba invadens
IPVTNIVAIVLPIVFVMIFIVLIVVIFALIGFYIRNKKLENKRKE

SEQ ID NO: 2819480 - protein, 23 aa, Entamoeba invadens
IPVTPYHITLVKQHGRPFTKSVV

SEQ ID NO: 2819481 - protein, 17 aa, Entamoeba invadens
IPYSVWFSRSKKTLEKI

SEQ ID NO: 2819482 - protein, 20 aa, Entamoeba invadens
IPYTGIPVNCDLTIDGDVSV

SEQ ID NO: 2819483 - protein, 17 aa, Entamoeba invadens
IPYTVWFSQSRRTLNEL

SEQ ID NO: 2819484 - protein, 20 aa, Entamoeba invadens
IQATLRLLAFFQNVFETKNQ

SEQ ID NO: 2819485 - protein, 24 aa, Entamoeba invadens
IQDITIIILIVFYAKKIDAKFIEI

SEQ ID NO: 2819486 - protein, 23 aa, Entamoeba invadens
IQEKLCVFDISRSNVKFFKTSAP

SEQ ID NO: 2819487 - protein, 19 aa, Entamoeba invadens
IQESFALAFFWSICEYLLS

SEQ ID NO: 2819488 - protein, 19 aa, Entamoeba invadens
IQKFYLPHNLKLKGSFDSE

SEQ ID NO: 2819489 - protein, 24 aa, Entamoeba invadens
IQKTTPAVLFPLSLTLMTVCTSVV

SEQ ID NO: 2819490 - protein, 17 aa, Entamoeba invadens
IQKWRCWQLKSWDKMTE

SEQ ID NO: 2819491 - protein, 20 aa, Entamoeba invadens
IQLEEKSIFYLNNSKVVYTT

SEQ ID NO: 2819492 - protein, 27 aa, Entamoeba invadens
IQLGMFKIMCLILSKYEDYVRCSWVTD

SEQ ID NO: 2819493 - protein, 18 aa, Entamoeba invadens
IQLITILPNPMESIKHFF

SEQ ID NO: 2819494 - protein, 17 aa, Entamoeba invadens
IQLMRRLTHPNVLQFFG

SEQ ID NO: 2819495 - protein, 30 aa, Entamoeba invadens
IQLPAPTNLLKILFPILCLVIPCILEAFKV

SEQ ID NO: 2819496 - protein, 19 aa, Entamoeba invadens
IQMSKLNSILLSNKKLLKF

SEQ ID NO: 2819497 - protein, 18 aa, Entamoeba invadens
IQMTRISDVLLTNKNVLK

SEQ ID NO: 2819498 - protein, 25 aa, Entamoeba invadens
IQNEMPLCIILRESDDYYKTSEVIT

SEQ ID NO: 2819499 - protein, 30 aa, Entamoeba invadens
IQNVKISCTSIFLLEINIPKDLASIWVSLN

SEQ ID NO: 2819500 - protein, 26 aa, Entamoeba invadens
IQNVVDTRLFFGILASFHANLLMSKA

SEQ ID NO: 2819501 - protein, 17 aa, Entamoeba invadens
IQQQFKELILSLKANFD

SEQ ID NO: 2819502 - protein, 29 aa, Entamoeba invadens
IQSLCFVHPDFFIVNKSTLFLNRCGEWLQ

SEQ ID NO: 2819503 - protein, 28 aa, Entamoeba invadens
IQSPFLDFLLSWKLFGMLYVVSMMVGLN

SEQ ID NO: 2819504 - protein, 20 aa, Entamoeba invadens
IQTCLKCFAPYVINDMTSEC

SEQ ID NO: 2819505 - protein, 25 aa, Entamoeba invadens
IQTFIIYHMWLDILIRAGVSIIPIL

SEQ ID NO: 2819506 - protein, 17 aa, Entamoeba invadens
IQTFYMVNQYSNVSFGE

SEQ ID NO: 2819507 - protein, 18 aa, Entamoeba invadens
IQTIKSLALPPHCEFLFG

SEQ ID NO: 2819508 - protein, 18 aa, Entamoeba invadens
IQVFGQFSIGYDLTIENP

SEQ ID NO: 2819509 - protein, 27 aa, Entamoeba invadens
IQVRAVVTHLLTLNLKILYIHMKKCTE

SEQ ID NO: 2819510 - protein, 23 aa, Entamoeba invadens
IQWMQLWMVYAVDKYGVWAIVAL

SEQ ID NO: 2819511 - protein, 19 aa, Entamoeba invadens
IRAFVFLMALIRSSKIDPQ

SEQ ID NO: 2819512 - protein, 18 aa, Entamoeba invadens
IRAKFYTVDIPAGKKLRV

SEQ ID NO: 2819513 - protein, 21 aa, Entamoeba invadens
IRCDVGYYLYNSKCVNCPSHC

SEQ ID NO: 2819514 - protein, 29 aa, Entamoeba invadens
IRCNSHVVWWVIVIVAIVCLSMIIVFTTT

SEQ ID NO: 2819515 - protein, 18 aa, Entamoeba invadens
IRCYSCVSGYYQSYGHCY

SEQ ID NO: 2819516 - protein, 17 aa, Entamoeba invadens
IRDIPLFQVNKVSNFDK

SEQ ID NO: 2819517 - protein, 17 aa, Entamoeba invadens
IRDLPVMFNINSIYIDF

SEQ ID NO: 2819518 - protein, 25 aa, Entamoeba invadens
IRFELSIVTIPPKFACEFSLFLNPL

SEQ ID NO: 2819519 - protein, 23 aa, Entamoeba invadens
IRFEPSIATIPPKFACEFSLFLN

SEQ ID NO: 2819520 - protein, 34 aa, Entamoeba invadens
IRFNQWFLTFTFILSFILWPYGGFWIVSGDLFGL

SEQ ID NO: 2819521 - protein, 19 aa, Entamoeba invadens
IRFTILLLTTLFASFLADI

SEQ ID NO: 2819522 - protein, 18 aa, Entamoeba invadens
IRFTPFRGVIRPKSEKDV

SEQ ID NO: 2819523 - protein, 27 aa, Entamoeba invadens
IRGTKIPYTVWFSRNRFVLKQIAELLK

SEQ ID NO: 2819524 - protein, 26 aa, Entamoeba invadens
IRHHRLYHAYFRYFARYSVNDPRAAM

SEQ ID NO: 2819525 - protein, 22 aa, Entamoeba invadens
IRKCTTCLTGKYPNPSSPFSCI

SEQ ID NO: 2819526 - protein, 26 aa, Entamoeba invadens
IRKKVPIDMKMRFKLLYDAAKGIEYL

SEQ ID NO: 2819527 - protein, 20 aa, Entamoeba invadens
IRKMIISGVRPKLGKEIPQC

SEQ ID NO: 2819528 - protein, 28 aa, Entamoeba invadens
IRLCSFNVVLWLLPVKFGLSDKFDYKIF

SEQ ID NO: 2819529 - protein, 19 aa, Entamoeba invadens
IRLVAFGMFKACLITLMVE

SEQ ID NO: 2819530 - protein, 26 aa, Entamoeba invadens
IRMLLTIFCVMYISSYLIYLLEGESI

SEQ ID NO: 2819531 - protein, 31 aa, Entamoeba invadens
IRNNHWVAFIFLKRDLTWSLFYFDTLPQNNK

SEQ ID NO: 2819532 - protein, 25 aa, Entamoeba invadens
IRQCALFFLNFFVTTQLAYCISSGF

SEQ ID NO: 2819533 - protein, 40 aa, Entamoeba invadens
IRQIISLVFSIVFQPLGCATLFAIRLRRSLNLLKMMDGDE

SEQ ID NO: 2819534 - protein, 41 aa, Entamoeba invadens
IRREFIQFKLYVLKNVFVQQIMFILILSLILDVSSYNCSYG

SEQ ID NO: 2819535 - protein, 18 aa, Entamoeba invadens
IRSNSWINVLQLFDISKN

SEQ ID NO: 2819536 - protein, 26 aa, Entamoeba invadens
IRSSRNTHLFFLKPITHIDLTSTFIR

SEQ ID NO: 2819537 - protein, 51 aa, Entamoeba invadens
IRTEPQIVTLKYGFACEFEIFLTPYCTMQLIDEIIIIALDLTTGKQNTTSI

SEQ ID NO: 2819538 - protein, 17 aa, Entamoeba invadens
IRTTLPRGTKLLIDGRL

SEQ ID NO: 2819539 - protein, 32 aa, Entamoeba invadens
IRVEWKSFLFCYLFLLISQLGTLLIPLVIQFL

SEQ ID NO: 2819540 - protein, 23 aa, Entamoeba invadens
IRVLLYFVVAIGNSFNFWSNSKL

SEQ ID NO: 2819541 - protein, 27 aa, Entamoeba invadens
IRWYVIIIGLFTRLVIVPAICIGINYL

SEQ ID NO: 2819542 - protein, 18 aa, Entamoeba invadens
ISALCVVIIIAVTLGVVL

SEQ ID NO: 2819543 - protein, 24 aa, Entamoeba invadens
ISATLNRWIDLIFGYKSCGEEALK

SEQ ID NO: 2819544 - protein, 41 aa, Entamoeba invadens
ISAYEVIGWVDCYPKKLFHFPWDIATFIAKGGRRPKTPNMS

SEQ ID NO: 2819545 - protein, 26 aa, Entamoeba invadens
ISCHSRYFLDLFMKCQTLGELANRCE

SEQ ID NO: 2819546 - protein, 21 aa, Entamoeba invadens
ISCNDGYYLNNGTCHNCPSAC

SEQ ID NO: 2819547 - protein, 28 aa, Entamoeba invadens
ISDCPIDFLTLPPVIFAKQVTLLQSEVF

SEQ ID NO: 2819548 - protein, 24 aa, Entamoeba invadens
ISDEFVAVSFFKLTKSVLLISQNA

SEQ ID NO: 2819549 - protein, 26 aa, Entamoeba invadens
ISDGSCVTFYMKDDLYLKNNVYYRCE

SEQ ID NO: 2819550 - protein, 24 aa, Entamoeba invadens
ISDNQILYLPRRLTSMKLFEINLN

SEQ ID NO: 2819551 - protein, 25 aa, Entamoeba invadens
ISDQVWLLLTLSFLSGLVAGFAYQT

SEQ ID NO: 2819552 - protein, 24 aa, Entamoeba invadens
ISDTRTIVWRLEKNRRIILETIVR

SEQ ID NO: 2819553 - protein, 22 aa, Entamoeba invadens
ISEDLCYELKLFSGLETIHADV

SEQ ID NO: 2819554 - protein, 26 aa, Entamoeba invadens
ISELLRLIQIAFIASPIFYSINVTCS

SEQ ID NO: 2819555 - protein, 17 aa, Entamoeba invadens
ISELRLISFDYNKLIIK

SEQ ID NO: 2819556 - protein, 26 aa, Entamoeba invadens
ISESSSFIYPMHCPIYTNSSLFKVES

SEQ ID NO: 2819557 - protein, 19 aa, Entamoeba invadens
ISFPFEAEGYFAYPVCFQT

SEQ ID NO: 2819558 - protein, 24 aa, Entamoeba invadens
ISFYLITPIQRIPRYELLIRDMLK

SEQ ID NO: 2819559 - protein, 21 aa, Entamoeba invadens
ISGDLKPLTLLQKGARLITSK

SEQ ID NO: 2819560 - protein, 22 aa, Entamoeba invadens
ISGMPFYIFNLIEELDEEGEYY

SEQ ID NO: 2819561 - protein, 20 aa, Entamoeba invadens
ISGNGLDVFFNCHICPAGTY

SEQ ID NO: 2819562 - protein, 25 aa, Entamoeba invadens
ISIAKKSGLIFAGGKIRLPGSNESV

SEQ ID NO: 2819563 - protein, 26 aa, Entamoeba invadens
ISIAVLFQLLFFTTVMLFGICVIFIT

SEQ ID NO: 2819564 - protein, 23 aa, Entamoeba invadens
ISIIHFSFYNLVLSATLLIFVLI

SEQ ID NO: 2819565 - protein, 21 aa, Entamoeba invadens
ISIIIRVIVPLVIFLTFAVFI

SEQ ID NO: 2819566 - protein, 17 aa, Entamoeba invadens
ISIIYSHFDRTPKVWLL

SEQ ID NO: 2819567 - protein, 25 aa, Entamoeba invadens
ISILVFLGLLIFFNNPFEVLRYWFN

SEQ ID NO: 2819568 - protein, 18 aa, Entamoeba invadens
ISILYFYIFGFVEVLICL

SEQ ID NO: 2819569 - protein, 29 aa, Entamoeba invadens
ISIPIETPLIMFKTLKRKITGITPICSNY

SEQ ID NO: 2819570 - protein, 26 aa, Entamoeba invadens
ISISYFFQFLFPEEFLKQKVIHNYFE

SEQ ID NO: 2819571 - protein, 17 aa, Entamoeba invadens
ISITQVIIVVFLGIIFD

SEQ ID NO: 2819572 - protein, 35 aa, Entamoeba invadens
ISITSKQWDFVYFWQYYLKLLVPGKTRIYVCLIHE

SEQ ID NO: 2819573 - protein, 24 aa, Entamoeba invadens
ISKILRVRFCLNAAKGIQYLHSNG

SEQ ID NO: 2819574 - protein, 25 aa, Entamoeba invadens
ISKKCLDIFLVIPKIEISAQRLNVT

SEQ ID NO: 2819575 - protein, 17 aa, Entamoeba invadens
ISKKKILTKYLRVKLCL

SEQ ID NO: 2819576 - protein, 18 aa, Entamoeba invadens
ISKLEFKCFCNCRNMSKI

SEQ ID NO: 2819577 - protein, 17 aa, Entamoeba invadens
ISKNLDQLLLLLDKERL

SEQ ID NO: 2819578 - protein, 30 aa, Entamoeba invadens
ISKSSFVLQYLFTLAFIIKKELYVKMQMRP

SEQ ID NO: 2819579 - protein, 45 aa, Entamoeba invadens
ISKTALAISLPLIATLFIIFFVVFIILLVLFLREKNHKNQLEKSI

SEQ ID NO: 2819580 - protein, 32 aa, Entamoeba invadens
ISKWSSAKNLWIKGYFKYLWSDSTIAVDNINT

SEQ ID NO: 2819581 - protein, 18 aa, Entamoeba invadens
ISLAVMFWVGLTDVSIFG

SEQ ID NO: 2819582 - protein, 17 aa, Entamoeba invadens
ISLFGCCDKIIDGLFLG

SEQ ID NO: 2819583 - protein, 19 aa, Entamoeba invadens
ISLLFTAVLAVLTYVRQSK

SEQ ID NO: 2819584 - protein, 18 aa, Entamoeba invadens
ISLTLLICITLAENLICP

SEQ ID NO: 2819585 - protein, 17 aa, Entamoeba invadens
ISLVLFMVITIPLSYIN

SEQ ID NO: 2819586 - protein, 17 aa, Entamoeba invadens
ISNFAPDIPLIVTEWSF

SEQ ID NO: 2819587 - protein, 18 aa, Entamoeba invadens
ISNFWFKKGLGVTSVTIT

SEQ ID NO: 2819588 - protein, 25 aa, Entamoeba invadens
ISNKWINVLQLFYISKDTTLVLNGL

SEQ ID NO: 2819589 - protein, 38 aa, Entamoeba invadens
ISNPKLDAPPLDLWDSMYLHLYHNYPGRLDFEIKNPIG

SEQ ID NO: 2819590 - protein, 25 aa, Entamoeba invadens
ISNSFSKFLKHRNFFNKISTRLVTS

SEQ ID NO: 2819591 - protein, 41 aa, Entamoeba invadens
ISNYMIRNITIQTLYQLACMLPLIFAGRFIPFLEAPCGFVS

SEQ ID NO: 2819592 - protein, 25 aa, Entamoeba invadens
ISPFEWCNVCIDLLPLTMIDYLTSP

SEQ ID NO: 2819593 - protein, 31 aa, Entamoeba invadens
ISPILSLCMLLRYFYLRFVNKLETSTSDIIV

SEQ ID NO: 2819594 - protein, 23 aa, Entamoeba invadens
ISQMKVPPSPLPLLVSFTNIILE

SEQ ID NO: 2819595 - protein, 23 aa, Entamoeba invadens
ISQRDWIFLYQSSARIANLIPFN

SEQ ID NO: 2819596 - protein, 18 aa, Entamoeba invadens
ISRFILLSSNNPVIDCDC

SEQ ID NO: 2819597 - protein, 26 aa, Entamoeba invadens
ISSVVVLFIICITITIVVITKKHSKV

SEQ ID NO: 2819598 - protein, 20 aa, Entamoeba invadens
ISTEVFALNTLYSSPNNISQ

SEQ ID NO: 2819599 - protein, 22 aa, Entamoeba invadens
ISTFEYLCILNFFAGRSFVDIS

SEQ ID NO: 2819600 - protein, 25 aa, Entamoeba invadens
ISTVLILYILFLILENRKVCDLQKK

SEQ ID NO: 2819601 - protein, 19 aa, Entamoeba invadens
ISVCIIGFVALLQHTFENF

SEQ ID NO: 2819602 - protein, 23 aa, Entamoeba invadens
ISVDTKFIFVKSTLIINNRDIRD
